United States Patent 11,293,017 (OLIGONUCLEOTIDE PROBES AND USES THEREOF) - sequence listing, part 4

SEQ ID NO: 74698 - DNA, 35 bp, Artificial Sequence
  Synthetic oligonucleotide
tctcccatccgatgacctccacggccgtcgatctc

SEQ ID NO: 74699 - DNA, 35 bp, Artificial Sequence
  Synthetic oligonucleotide
agcaaccagtggtgaaggagtggtgtgtcggtgag

SEQ ID NO: 74700 - DNA, 35 bp, Artificial Sequence
  Synthetic oligonucleotide
acgcaaacgctaaaccttcccaagcagactctacg

SEQ ID NO: 74701 - DNA, 35 bp, Artificial Sequence
  Synthetic oligonucleotide
tttgtcaccgcaggaaataccctccgactcgtacg

SEQ ID NO: 74702 - DNA, 35 bp, Artificial Sequence
  Synthetic oligonucleotide
aagaccatccgcagcggggatagaaaaatcaatcg

SEQ ID NO: 74703 - DNA, 35 bp, Artificial Sequence
  Synthetic oligonucleotide
tacatcgatgcgcgctcccatccaagattgtctcg

SEQ ID NO: 74704 - DNA, 35 bp, Artificial Sequence
  Synthetic oligonucleotide
agagcgacaaccctcgcgtacatatcaccctttcg

SEQ ID NO: 74705 - DNA, 35 bp, Artificial Sequence
  Synthetic oligonucleotide
gtcgcgaggtgaaaataggttcaagaaaggaaagg

SEQ ID NO: 74706 - DNA, 35 bp, Artificial Sequence
  Synthetic oligonucleotide
tgtgaagagtggaactgtccgaagggagaacgtgg

SEQ ID NO: 74707 - DNA, 35 bp, Artificial Sequence
  Synthetic oligonucleotide
tccatcgcattcggcgtggtcgctcatacctttgg

SEQ ID NO: 74708 - DNA, 35 bp, Artificial Sequence
  Synthetic oligonucleotide
gattgccgggtggtgttatgttgtctctaatcatg

SEQ ID NO: 74709 - DNA, 35 bp, Artificial Sequence
  Synthetic oligonucleotide
ttgcggagcactatcttaacgtcacaattacgctg

SEQ ID NO: 74710 - DNA, 35 bp, Artificial Sequence
  Synthetic oligonucleotide
tgtgtaacggctccttgacctctgcctagttcgat

SEQ ID NO: 74711 - DNA, 35 bp, Artificial Sequence
  Synthetic oligonucleotide
tcccaatgccccaattcttctatgaccttttctat

SEQ ID NO: 74712 - DNA, 35 bp, Artificial Sequence
  Synthetic oligonucleotide
actccatccgatctgtttttaacttgctgttgtat

SEQ ID NO: 74713 - DNA, 35 bp, Artificial Sequence
  Synthetic oligonucleotide
actaagggccctgaccccttttagtgatctattat

SEQ ID NO: 74714 - DNA, 35 bp, Artificial Sequence
  Synthetic oligonucleotide
gttgcccattacgcgtattcataacctagaccact

SEQ ID NO: 74715 - DNA, 35 bp, Artificial Sequence
  Synthetic oligonucleotide
atcacatcaaaaggcaagcgggaccctgcttcact

SEQ ID NO: 74716 - DNA, 35 bp, Artificial Sequence
  Synthetic oligonucleotide
tcccatctgttggtgccgggacacgacctccacct

SEQ ID NO: 74717 - DNA, 35 bp, Artificial Sequence
  Synthetic oligonucleotide
tcacttccgcaccagatttttatctaaatccatct

SEQ ID NO: 74718 - DNA, 35 bp, Artificial Sequence
  Synthetic oligonucleotide
tcctgcgctcaatcttcaccactcgacgccgatct

SEQ ID NO: 74719 - DNA, 35 bp, Artificial Sequence
  Synthetic oligonucleotide
accaacgggcgaagagataggtcgtcgatgtctct

SEQ ID NO: 74720 - DNA, 35 bp, Artificial Sequence
  Synthetic oligonucleotide
gccaacgtctctcgaaccctgcgagcctccagtct

SEQ ID NO: 74721 - DNA, 35 bp, Artificial Sequence
  Synthetic oligonucleotide
ttttcgccggctctttacgcggacccttgtcttct

SEQ ID NO: 74722 - DNA, 35 bp, Artificial Sequence
  Synthetic oligonucleotide
tcagtctccgtacgaggccgtttgatctgctttct

SEQ ID NO: 74723 - DNA, 35 bp, Artificial Sequence
  Synthetic oligonucleotide
tgatgtggatgtgggggggcataataatgcaaagt

SEQ ID NO: 74724 - DNA, 35 bp, Artificial Sequence
  Synthetic oligonucleotide
gttcactcaggcttggctcaccatccctaacaggt

SEQ ID NO: 74725 - DNA, 35 bp, Artificial Sequence
  Synthetic oligonucleotide
gaggagagggtgaaaggcctagggggctatgaggt

SEQ ID NO: 74726 - DNA, 35 bp, Artificial Sequence
  Synthetic oligonucleotide
tgctcaccttggccttcccgccctactggagcggt

SEQ ID NO: 74727 - DNA, 35 bp, Artificial Sequence
  Synthetic oligonucleotide
atgataccgggcgtcgcgctactccaaatctggtt

SEQ ID NO: 74728 - DNA, 35 bp, Artificial Sequence
  Synthetic oligonucleotide
gacgctacccctcaattcacgccgatttccatgtt

SEQ ID NO: 74729 - DNA, 35 bp, Artificial Sequence
  Synthetic oligonucleotide
gatctcgccctatttccagaactagaccttccttt

SEQ ID NO: 74730 - DNA, 35 bp, Artificial Sequence
  Synthetic oligonucleotide
aataagggggcaggagtgccagcaagggggtgttt

SEQ ID NO: 74731 - DNA, 35 bp, Artificial Sequence
  Synthetic oligonucleotide
aattgccgatccgcacgtatgtgaaactcgtccaa

SEQ ID NO: 74732 - DNA, 36 bp, Artificial Sequence
  Synthetic oligonucleotide
ggaagtggaggggcgaggagaaactgggacacagaa

SEQ ID NO: 74733 - DNA, 35 bp, Artificial Sequence
  Synthetic oligonucleotide
gacctcactgctcttatcatcgacttggcgacgaa

SEQ ID NO: 74734 - DNA, 35 bp, Artificial Sequence
  Synthetic oligonucleotide
ttggggctgtctagctcctcgttatccctggcgaa

SEQ ID NO: 74735 - DNA, 36 bp, Artificial Sequence
  Synthetic oligonucleotide
gttgcttaccatccctggcgaaattacaaacaggaa

SEQ ID NO: 74736 - DNA, 36 bp, Artificial Sequence
  Synthetic oligonucleotide
gtcaaaaacccgggagcaggggggaccttttaggaa

SEQ ID NO: 74737 - DNA, 36 bp, Artificial Sequence
  Synthetic oligonucleotide
aaggactgggttatggggggagaaagacgagtggaa

SEQ ID NO: 74738 - DNA, 36 bp, Artificial Sequence
  Synthetic oligonucleotide
gccgccggaagaccacagccaatctccaacactgaa

SEQ ID NO: 74739 - DNA, 36 bp, Artificial Sequence
  Synthetic oligonucleotide
gatgaactacggggggcttaaaaggatagtacgtaa

SEQ ID NO: 74740 - DNA, 36 bp, Artificial Sequence
  Synthetic oligonucleotide
tgctaaagccaagtcggcaccctatctcgttacaca

SEQ ID NO: 74741 - DNA, 35 bp, Artificial Sequence
  Synthetic oligonucleotide
atccctgacctccgtatgcctatacagcgcctaca

SEQ ID NO: 74742 - DNA, 36 bp, Artificial Sequence
  Synthetic oligonucleotide
gagatacgtacaccggccgagagtccctgctcacca

SEQ ID NO: 74743 - DNA, 35 bp, Artificial Sequence
  Synthetic oligonucleotide
acgtgacactgcccggtgccaggcacatcgcccca

SEQ ID NO: 74744 - DNA, 36 bp, Artificial Sequence
  Synthetic oligonucleotide
tgagcaaagctgccacgccttctcggtagttcccca

SEQ ID NO: 74745 - DNA, 36 bp, Artificial Sequence
  Synthetic oligonucleotide
tacacccctgccagtcacgggggaccctttttccca

SEQ ID NO: 74746 - DNA, 35 bp, Artificial Sequence
  Synthetic oligonucleotide
tacgctgaacttcctgcctgggtcatcccgttcca

SEQ ID NO: 74747 - DNA, 36 bp, Artificial Sequence
  Synthetic oligonucleotide
ttcgtgccttagcttgtcccttacactttctgcgca

SEQ ID NO: 74748 - DNA, 35 bp, Artificial Sequence
  Synthetic oligonucleotide
gagacaggtaggtagatatctaaatagtgtcggca

SEQ ID NO: 74749 - DNA, 37 bp, Artificial Sequence
  Synthetic oligonucleotide
tcagcccctctgactctcatccagacccctgacaaga

SEQ ID NO: 74750 - DNA, 37 bp, Artificial Sequence
  Synthetic oligonucleotide
ggacgtctgcagagcgcatcaccccaaaccaccaaga

SEQ ID NO: 74751 - DNA, 37 bp, Artificial Sequence
  Synthetic oligonucleotide
gacccaaccgcccttcgccctcagcctgtataggaga

SEQ ID NO: 74752 - DNA, 37 bp, Artificial Sequence
  Synthetic oligonucleotide
gcacaccatctcaggccattactacgccgccactaga

SEQ ID NO: 74753 - DNA, 35 bp, Artificial Sequence
  Synthetic oligonucleotide
tccaccctcaggttgatacctgttaaccctctaga

SEQ ID NO: 74754 - DNA, 36 bp, Artificial Sequence
  Synthetic oligonucleotide
tccccgcccgcataatacgcattcacgccggaacga

SEQ ID NO: 74755 - DNA, 37 bp, Artificial Sequence
  Synthetic oligonucleotide
ggagctgcacgtctaatgttctctgcttccaccacga

SEQ ID NO: 74756 - DNA, 37 bp, Artificial Sequence
  Synthetic oligonucleotide
aactacgaggctgccgttgctcccatttctgtcccga

SEQ ID NO: 74757 - DNA, 37 bp, Artificial Sequence
  Synthetic oligonucleotide
gacggggacatcacgcccatccttctcgacgctccga

SEQ ID NO: 74758 - DNA, 37 bp, Artificial Sequence
  Synthetic oligonucleotide
gtcccgaagccgccctcccagtccacactgtacgcga

SEQ ID NO: 74759 - DNA, 37 bp, Artificial Sequence
  Synthetic oligonucleotide
gcattcgccgttttcgtccttctctggttttgcgcga

SEQ ID NO: 74760 - DNA, 37 bp, Artificial Sequence
  Synthetic oligonucleotide
atgtcgcagacatacgactactagcgggaagtccgga

SEQ ID NO: 74761 - DNA, 35 bp, Artificial Sequence
  Synthetic oligonucleotide
gacccgaaggagagttcgcgtaaacaggtcaggga

SEQ ID NO: 74762 - DNA, 37 bp, Artificial Sequence
  Synthetic oligonucleotide
gaaacgcctccggagcatttttgttgtccagcctgga

SEQ ID NO: 74763 - DNA, 36 bp, Artificial Sequence
  Synthetic oligonucleotide
atcccatgcaccatcacgcaagtacctgttcctgga

SEQ ID NO: 74764 - DNA, 37 bp, Artificial Sequence
  Synthetic oligonucleotide
gccaccatcgggcgttaatgggggcacacaatttgga

SEQ ID NO: 74765 - DNA, 38 bp, Artificial Sequence
  Synthetic oligonucleotide
gtatatgcggccacctgaatttgcgctacctttaatga

SEQ ID NO: 74766 - DNA, 38 bp, Artificial Sequence
  Synthetic oligonucleotide
tctcatccgccgccccgcattctttcctccactgatga

SEQ ID NO: 74767 - DNA, 37 bp, Artificial Sequence
  Synthetic oligonucleotide
taaccactcaatgagcttaacgctacctctactatga

SEQ ID NO: 74768 - DNA, 38 bp, Artificial Sequence
  Synthetic oligonucleotide
tcgcaccaactggtacagccccgctttaatgccactga

SEQ ID NO: 74769 - DNA, 38 bp, Artificial Sequence
  Synthetic oligonucleotide
tagcaaatggtgggtgtatggaaggggagggggactga

SEQ ID NO: 74770 - DNA, 38 bp, Artificial Sequence
  Synthetic oligonucleotide
tagatcgtatccgtgcacttcgaacctcatctacctga

SEQ ID NO: 74771 - DNA, 38 bp, Artificial Sequence
  Synthetic oligonucleotide
tgaagcaatgtgtaaacaccgcgttggcccccccctga

SEQ ID NO: 74772 - DNA, 38 bp, Artificial Sequence
  Synthetic oligonucleotide
tatccaggtagctgtagcacttccgtaacgttccctga

SEQ ID NO: 74773 - DNA, 38 bp, Artificial Sequence
  Synthetic oligonucleotide
atgaccccgcgcagtattaggctatctacacttcctga

SEQ ID NO: 74774 - DNA, 38 bp, Artificial Sequence
  Synthetic oligonucleotide
tactatgcaggtgtccattgctacaccacccactgtga

SEQ ID NO: 74775 - DNA, 38 bp, Artificial Sequence
  Synthetic oligonucleotide
tacaaggggtggacgcgtgcaggaggagttgggtgtga

SEQ ID NO: 74776 - DNA, 37 bp, Artificial Sequence
  Synthetic oligonucleotide
gagaaacgaagggctggttcgggaacgggttgattga

SEQ ID NO: 74777 - DNA, 38 bp, Artificial Sequence
  Synthetic oligonucleotide
gccgtgcgcccattcaacatttaggaacgcacccttga

SEQ ID NO: 74778 - DNA, 38 bp, Artificial Sequence
  Synthetic oligonucleotide
tactcaccacggttgagggctttaccacacatatttga

SEQ ID NO: 74779 - DNA, 37 bp, Artificial Sequence
  Synthetic oligonucleotide
taattcgcaatgtgcctacgcaccactctccttttga

SEQ ID NO: 74780 - DNA, 35 bp, Artificial Sequence
  Synthetic oligonucleotide
ggttgggtgggcacgatcgaggcgggcattgaata

SEQ ID NO: 74781 - DNA, 36 bp, Artificial Sequence
  Synthetic oligonucleotide
gagggaccgacagcagaaagggagtgtgcgtgtata

SEQ ID NO: 74782 - DNA, 36 bp, Artificial Sequence
  Synthetic oligonucleotide
ttcctccctcgtgttaggccctgccggtgaaaacta

SEQ ID NO: 74783 - DNA, 35 bp, Artificial Sequence
  Synthetic oligonucleotide
ttaagcagggaggagggggatgctgggatgtacta

SEQ ID NO: 74784 - DNA, 35 bp, Artificial Sequence
  Synthetic oligonucleotide
gaacctgcgaaccttctgaaccgctactcttacta

SEQ ID NO: 74785 - DNA, 36 bp, Artificial Sequence
  Synthetic oligonucleotide
ataccgcttcaccggtgccctgccgttcgttcccta

SEQ ID NO: 74786 - DNA, 36 bp, Artificial Sequence
  Synthetic oligonucleotide
gcccttcctctctgtgaatgtttcatatttggccta

SEQ ID NO: 74787 - DNA, 36 bp, Artificial Sequence
  Synthetic oligonucleotide
tgtttgccccacaactcctctccgtatcgatagcta

SEQ ID NO: 74788 - DNA, 35 bp, Artificial Sequence
  Synthetic oligonucleotide
atcgttcgaggttaggacggaggaaagaagggcta

SEQ ID NO: 74789 - DNA, 36 bp, Artificial Sequence
  Synthetic oligonucleotide
gtcctgccccgcactgtcatgggcatttgttgtcta

SEQ ID NO: 74790 - DNA, 35 bp, Artificial Sequence
  Synthetic oligonucleotide
gtgaccaccatgagcttgttctaaacgcaaccgta

SEQ ID NO: 74791 - DNA, 35 bp, Artificial Sequence
  Synthetic oligonucleotide
ttcctgccaccaccggataagcgtcttctccggta

SEQ ID NO: 74792 - DNA, 35 bp, Artificial Sequence
  Synthetic oligonucleotide
acccaatcgcctgcctctgacatatagtatctgta

SEQ ID NO: 74793 - DNA, 36 bp, Artificial Sequence
  Synthetic oligonucleotide
tgtgaacctccttgtttgcgccactagcccattgta

SEQ ID NO: 74794 - DNA, 35 bp, Artificial Sequence
  Synthetic oligonucleotide
gcgccatgaatgatgattgtcacactccgctctac

SEQ ID NO: 74795 - DNA, 35 bp, Artificial Sequence
  Synthetic oligonucleotide
acgttgtgcaggatatccgttactcggcaccaacc

SEQ ID NO: 74796 - DNA, 35 bp, Artificial Sequence
  Synthetic oligonucleotide
gacaaagtcggaaatcattacacatcatgctaccc

SEQ ID NO: 74797 - DNA, 35 bp, Artificial Sequence
  Synthetic oligonucleotide
agtgaccttacttcctgctgtccgtaatttcgccc

SEQ ID NO: 74798 - DNA, 35 bp, Artificial Sequence
  Synthetic oligonucleotide
gcattgtactcatgcacccgagtatgtaacctccc

SEQ ID NO: 74799 - DNA, 35 bp, Artificial Sequence
  Synthetic oligonucleotide
ttcgcatcggttaaacaccacgcctgcctaacgcc

SEQ ID NO: 74800 - DNA, 35 bp, Artificial Sequence
  Synthetic oligonucleotide
gacgctcccccgggatatacgctattgtgctggcc

SEQ ID NO: 74801 - DNA, 32 bp, Artificial Sequence
  Synthetic oligonucleotide
agccccccccgatctccgggttgccacttgcc

SEQ ID NO: 74802 - DNA, 35 bp, Artificial Sequence
  Synthetic oligonucleotide
ttctgcgcggctccggattcacgcaattttcatcc

SEQ ID NO: 74803 - DNA, 35 bp, Artificial Sequence
  Synthetic oligonucleotide
atgcttgacatggcatcatttcgcgttacccacgc

SEQ ID NO: 74804 - DNA, 35 bp, Artificial Sequence
  Synthetic oligonucleotide
gatacacgatgggttggaatgttagggtaatgggc

SEQ ID NO: 74805 - DNA, 35 bp, Artificial Sequence
  Synthetic oligonucleotide
gtgggcgctgtacttcactctgacttcttttctgc

SEQ ID NO: 74806 - DNA, 35 bp, Artificial Sequence
  Synthetic oligonucleotide
taacgaacgttatcgccgccctccactcgttgtgc

SEQ ID NO: 74807 - DNA, 35 bp, Artificial Sequence
  Synthetic oligonucleotide
gttccctggcacaggagcgcggcgatacgcgaatc

SEQ ID NO: 74808 - DNA, 35 bp, Artificial Sequence
  Synthetic oligonucleotide
tcatgtacgcccaaagttactaaacgtgggcactc

SEQ ID NO: 74809 - DNA, 35 bp, Artificial Sequence
  Synthetic oligonucleotide
tgacgcttgagtgccgcaccgattataattccgtc

SEQ ID NO: 74810 - DNA, 35 bp, Artificial Sequence
  Synthetic oligonucleotide
tttcccccggcccatagactcgtgacctatacttc

SEQ ID NO: 74811 - DNA, 35 bp, Artificial Sequence
  Synthetic oligonucleotide
ttacgcactggcccccaacgatatgttcaacacag

SEQ ID NO: 74812 - DNA, 35 bp, Artificial Sequence
  Synthetic oligonucleotide
atgggcatagcctgaattcttcgtccactacatag

SEQ ID NO: 74813 - DNA, 35 bp, Artificial Sequence
  Synthetic oligonucleotide
attggaccctgcttggcattactcccgtttcttag

SEQ ID NO: 74814 - DNA, 35 bp, Artificial Sequence
  Synthetic oligonucleotide
actgacaatctgtcgttggcctttatcttagcccg

SEQ ID NO: 74815 - DNA, 35 bp, Artificial Sequence
  Synthetic oligonucleotide
gtgggaagggtggtgagagctcagggaggagcagg

SEQ ID NO: 74816 - DNA, 35 bp, Artificial Sequence
  Synthetic oligonucleotide
tactcgagcgcccactacggatactatttgctcgg

SEQ ID NO: 74817 - DNA, 35 bp, Artificial Sequence
  Synthetic oligonucleotide
gtgaacagaacaaaaatagacaggacggatcgtgg

SEQ ID NO: 74818 - DNA, 35 bp, Artificial Sequence
  Synthetic oligonucleotide
cacacgatccgttcgtccacctccgctcctcgtgg

SEQ ID NO: 74819 - DNA, 35 bp, Artificial Sequence
  Synthetic oligonucleotide
tggacgtactgccttatccgctcattttctacttg

SEQ ID NO: 74820 - DNA, 35 bp, Artificial Sequence
  Synthetic oligonucleotide
acaatcaaggcggaaggagaaaagtagtgatgttg

SEQ ID NO: 74821 - DNA, 35 bp, Artificial Sequence
  Synthetic oligonucleotide
gctgccgtaacaaactccacgtctacatgccctat

SEQ ID NO: 74822 - DNA, 35 bp, Artificial Sequence
  Synthetic oligonucleotide
gacacgccaggtaggagtgaggtggttctatttat

SEQ ID NO: 74823 - DNA, 35 bp, Artificial Sequence
  Synthetic oligonucleotide
gcatgttactatgccgactttactacaccattcct

SEQ ID NO: 74824 - DNA, 35 bp, Artificial Sequence
  Synthetic oligonucleotide
acccaccaacgatccaattcactatagatctcgct

SEQ ID NO: 74825 - DNA, 35 bp, Artificial Sequence
  Synthetic oligonucleotide
acgtagacgatcccgacctatggcaatcttactct

SEQ ID NO: 74826 - DNA, 35 bp, Artificial Sequence
  Synthetic oligonucleotide
tggacatggcccctgcactcgagttactacgctct

SEQ ID NO: 74827 - DNA, 35 bp, Artificial Sequence
  Synthetic oligonucleotide
tcacaccccacacgtcgtactgccggcaattttct

SEQ ID NO: 74828 - DNA, 35 bp, Artificial Sequence
  Synthetic oligonucleotide
agtggaatgagggatggggctagaggaagctgggt

SEQ ID NO: 74829 - DNA, 35 bp, Artificial Sequence
  Synthetic oligonucleotide
atcactacgccattgttgcggtttggcgaacactt

SEQ ID NO: 74830 - DNA, 34 bp, Artificial Sequence
  Synthetic oligonucleotide
gccacctgggctcacttcacttagtggtttactt

SEQ ID NO: 74831 - DNA, 35 bp, Artificial Sequence
  Synthetic oligonucleotide
tacggacgccggaacggctatttctatgacccctt

SEQ ID NO: 74832 - DNA, 35 bp, Artificial Sequence
  Synthetic oligonucleotide
ttcgagcaccatcatagtcccttccgtgctgtctt

SEQ ID NO: 74833 - DNA, 36 bp, Artificial Sequence
  Synthetic oligonucleotide
tatccccccaccaacaagtgatggcccagtcccaaa

SEQ ID NO: 74834 - DNA, 35 bp, Artificial Sequence
  Synthetic oligonucleotide
gaaagccgcactcatcgccccagtcacactcgaaa

SEQ ID NO: 74835 - DNA, 35 bp, Artificial Sequence
  Synthetic oligonucleotide
tacgccaccctgcccacctaacgccgttccctaaa

SEQ ID NO: 74836 - DNA, 36 bp, Artificial Sequence
  Synthetic oligonucleotide
gcaacgtgggaggaagggttgggctagcagggtaaa

SEQ ID NO: 74837 - DNA, 37 bp, Artificial Sequence
  Synthetic oligonucleotide
gcgaatcaccacacgtattatttatgtccctgtacaa

SEQ ID NO: 74838 - DNA, 36 bp, Artificial Sequence
  Synthetic oligonucleotide
tctgtcccgatcgaatccaccagtgctaacctccaa

SEQ ID NO: 74839 - DNA, 36 bp, Artificial Sequence
  Synthetic oligonucleotide
gcacccgaaatgacactctgaagccaccctgccgaa

SEQ ID NO: 74840 - DNA, 33 bp, Artificial Sequence
  Synthetic oligonucleotide
gctgatcctcccccggttgaaacgatacttgaa

SEQ ID NO: 74841 - DNA, 36 bp, Artificial Sequence
  Synthetic oligonucleotide
tacgcgccatgtcgtatgtatcaccttgatcttgaa

SEQ ID NO: 74842 - DNA, 36 bp, Artificial Sequence
  Synthetic oligonucleotide
gccattcccttgctggttgagcttactaatttctaa

SEQ ID NO: 74843 - DNA, 34 bp, Artificial Sequence
  Synthetic oligonucleotide
tcacagaggggcaatgggatgtcagaggaagaca

SEQ ID NO: 74844 - DNA, 35 bp, Artificial Sequence
  Synthetic oligonucleotide
agcatgcccatcgctgccattgcatgacaccgaca

SEQ ID NO: 74845 - DNA, 35 bp, Artificial Sequence
  Synthetic oligonucleotide
aacaccagtcaggtgttcgttgtcttggtaataca

SEQ ID NO: 74846 - DNA, 35 bp, Artificial Sequence
  Synthetic oligonucleotide
gctgagtgcgaactgctatcttgattaactgtaca

SEQ ID NO: 74847 - DNA, 36 bp, Artificial Sequence
  Synthetic oligonucleotide
gataagccaattccttcgtgtcagacccttcatcca

SEQ ID NO: 74848 - DNA, 36 bp, Artificial Sequence
  Synthetic oligonucleotide
taacaggcctcgttgccccgcgcccctcctggtcca

SEQ ID NO: 74849 - DNA, 36 bp, Artificial Sequence
  Synthetic oligonucleotide
gaatatgggagggaaagcaaggcggaacggacggca

SEQ ID NO: 74850 - DNA, 36 bp, Artificial Sequence
  Synthetic oligonucleotide
gagcaacattagtcacgccctcgaccaatcactgca

SEQ ID NO: 74851 - DNA, 36 bp, Artificial Sequence
  Synthetic oligonucleotide
tagccaacggcctttacgctttaatgactgactgca

SEQ ID NO: 74852 - DNA, 36 bp, Artificial Sequence
  Synthetic oligonucleotide
tgttgactggcaccatctcacgcatagttgcttgca

SEQ ID NO: 74853 - DNA, 37 bp, Artificial Sequence
  Synthetic oligonucleotide
gctgggcggaggaaataagtggggactaacggagaga

SEQ ID NO: 74854 - DNA, 37 bp, Artificial Sequence
  Synthetic oligonucleotide
gctgtgaatgaaggtgatgggggagtgaccatggaga

SEQ ID NO: 74855 - DNA, 37 bp, Artificial Sequence
  Synthetic oligonucleotide
gatgctcccggctgttggcttttcttcctatgctaga

SEQ ID NO: 74856 - DNA, 37 bp, Artificial Sequence
  Synthetic oligonucleotide
gcgccgcccccccgcagaccccacaccagttgctaga

SEQ ID NO: 74857 - DNA, 36 bp, Artificial Sequence
  Synthetic oligonucleotide
tatggggggtgagggggccagaggtacagttttaga

SEQ ID NO: 74858 - DNA, 37 bp, Artificial Sequence
  Synthetic oligonucleotide
acgaaatgtgccgaagtaagggatggaaggcggacga

SEQ ID NO: 74859 - DNA, 37 bp, Artificial Sequence
  Synthetic oligonucleotide
atcgcacgcggctccagctcgatccctttactgacga

SEQ ID NO: 74860 - DNA, 37 bp, Artificial Sequence
  Synthetic oligonucleotide
ttgatccgccgtccacctttttagtctgccattacga

SEQ ID NO: 74861 - DNA, 36 bp, Artificial Sequence
  Synthetic oligonucleotide
acaaccctcgcgtactgcttgccgctcgaaaaccga

SEQ ID NO: 74862 - DNA, 37 bp, Artificial Sequence
  Synthetic oligonucleotide
gccttgaccaacatttttgagcccactcctaccccga

SEQ ID NO: 74863 - DNA, 37 bp, Artificial Sequence
  Synthetic oligonucleotide
tctgccaccccaatgctttgctgctcgaaattgccga

SEQ ID NO: 74864 - DNA, 36 bp, Artificial Sequence
  Synthetic oligonucleotide
tccctacccactatctaacgtcttctgccttcgcga

SEQ ID NO: 74865 - DNA, 37 bp, Artificial Sequence
  Synthetic oligonucleotide
atgctgggcccccctcctctacatctcacactggcga

SEQ ID NO: 74866 - DNA, 37 bp, Artificial Sequence
  Synthetic oligonucleotide
tgagcatgtgttgttttcccagcctgttcctctgcga

SEQ ID NO: 74867 - DNA, 37 bp, Artificial Sequence
  Synthetic oligonucleotide
ttgtctgcccgccccaatcccacgagagacctatcga

SEQ ID NO: 74868 - DNA, 37 bp, Artificial Sequence
  Synthetic oligonucleotide
acctctgtacggtgctgactaacgggctccccctcga

SEQ ID NO: 74869 - DNA, 37 bp, Artificial Sequence
  Synthetic oligonucleotide
tgtcgacggtcgctcgattgccgcaccccgttttcga

SEQ ID NO: 74870 - DNA, 37 bp, Artificial Sequence
  Synthetic oligonucleotide
tcgcaatgccctcacccccagaacccgttttccagga

SEQ ID NO: 74871 - DNA, 37 bp, Artificial Sequence
  Synthetic oligonucleotide
aaatccacctgccttgtatggccttgtcttatcagga

SEQ ID NO: 74872 - DNA, 36 bp, Artificial Sequence
  Synthetic oligonucleotide
gtatctcagagcgggggggtgggactatgctaggga

SEQ ID NO: 74873 - DNA, 36 bp, Artificial Sequence
  Synthetic oligonucleotide
aaatgacgaacacataaaccaaggattgagacggga

SEQ ID NO: 74874 - DNA, 36 bp, Artificial Sequence
  Synthetic oligonucleotide
aagtgtcgtgggaaatactcatgggctcaaggggga

SEQ ID NO: 74875 - DNA, 37 bp, Artificial Sequence
  Synthetic oligonucleotide
gagcccatgcctagacaacacactgctacttcgtgga

SEQ ID NO: 74876 - DNA, 34 bp, Artificial Sequence
  Synthetic oligonucleotide
tgagttaaccaccgatgctctcactctgcttgga

SEQ ID NO: 74877 - DNA, 37 bp, Artificial Sequence
  Synthetic oligonucleotide
gacgcaaacgaggctggtgtgatggagggaggaatga

SEQ ID NO: 74878 - DNA, 38 bp, Artificial Sequence
  Synthetic oligonucleotide
tcactacacgctggtgaactcaacattgcaattaatga

SEQ ID NO: 74879 - DNA, 38 bp, Artificial Sequence
  Synthetic oligonucleotide
atgcaaagggtggggataagggcgcatgaactcgatga

SEQ ID NO: 74880 - DNA, 38 bp, Artificial Sequence
  Synthetic oligonucleotide
gcgacgtgcgaacggagggagtgaggaatgattgatga

SEQ ID NO: 74881 - DNA, 38 bp, Artificial Sequence
  Synthetic oligonucleotide
taatcacacctcaagttgccctcagaggcctcctatga

SEQ ID NO: 74882 - DNA, 38 bp, Artificial Sequence
  Synthetic oligonucleotide
accatggtcacccctcctttgccagtcactccgtatga

SEQ ID NO: 74883 - DNA, 38 bp, Artificial Sequence
  Synthetic oligonucleotide
tccacctggcgcccaacgccttacctcgacatacctga

SEQ ID NO: 74884 - DNA, 38 bp, Artificial Sequence
  Synthetic oligonucleotide
aactgccaacatcgtactaccattcctggctggcctga

SEQ ID NO: 74885 - DNA, 38 bp, Artificial Sequence
  Synthetic oligonucleotide
tcttcgccagtcgcccttcgtttccttgcgcatcctga

SEQ ID NO: 74886 - DNA, 38 bp, Artificial Sequence
  Synthetic oligonucleotide
gtacagggcatcctaggctcatcggagtctaactctga

SEQ ID NO: 74887 - DNA, 38 bp, Artificial Sequence
  Synthetic oligonucleotide
taccacctccacgcatctcgcataatagaataacttga

SEQ ID NO: 74888 - DNA, 38 bp, Artificial Sequence
  Synthetic oligonucleotide
gccactccggttgacttatcttgagaaaacttacttga

SEQ ID NO: 74889 - DNA, 38 bp, Artificial Sequence
  Synthetic oligonucleotide
gtgacactgcggcccagccgtttctctgttccccttga

SEQ ID NO: 74890 - DNA, 38 bp, Artificial Sequence
  Synthetic oligonucleotide
acctgccaacgccgtgcgatttgtactctctgccttga

SEQ ID NO: 74891 - DNA, 37 bp, Artificial Sequence
  Synthetic oligonucleotide
gcccatctctgcccgactactaagtttaatgtcttga

SEQ ID NO: 74892 - DNA, 38 bp, Artificial Sequence
  Synthetic oligonucleotide
ttgacttgcgcctccctctcgcattaacgacttcttga

SEQ ID NO: 74893 - DNA, 37 bp, Artificial Sequence
  Synthetic oligonucleotide
tgtcttagccagcccatgtccgttccttagccgttga

SEQ ID NO: 74894 - DNA, 38 bp, Artificial Sequence
  Synthetic oligonucleotide
tccacgccaagatttcaccatctccgctcactcgttga

SEQ ID NO: 74895 - DNA, 38 bp, Artificial Sequence
  Synthetic oligonucleotide
gaccatgatcgggaaggatgggaaagggctgaggttga

SEQ ID NO: 74896 - DNA, 38 bp, Artificial Sequence
  Synthetic oligonucleotide
gctaaggttagcgcgtactttccccgttcctctgttga

SEQ ID NO: 74897 - DNA, 38 bp, Artificial Sequence
  Synthetic oligonucleotide
agggtacgtaccggcgtcatttttctatcccttgttga

SEQ ID NO: 74898 - DNA, 36 bp, Artificial Sequence
  Synthetic oligonucleotide
gcacccctcgtcacccgccggatccttctgaaaata

SEQ ID NO: 74899 - DNA, 36 bp, Artificial Sequence
  Synthetic oligonucleotide
gaggaaggggtgtcggctgggatgtacggggaaata

SEQ ID NO: 74900 - DNA, 31 bp, Artificial Sequence
  Synthetic oligonucleotide
tataccaccccagtctcagtcctcacgcata

SEQ ID NO: 74901 - DNA, 35 bp, Artificial Sequence
  Synthetic oligonucleotide
acatccgatcaggcagcacttggcgcaaatcacta

SEQ ID NO: 74902 - DNA, 36 bp, Artificial Sequence
  Synthetic oligonucleotide
gcaatgcacggacacgtaacgcaaacaagcctgcta

SEQ ID NO: 74903 - DNA, 36 bp, Artificial Sequence
  Synthetic oligonucleotide
gatcaggggggagaaggagcgcttatcgcgaacgta

SEQ ID NO: 74904 - DNA, 36 bp, Artificial Sequence
  Synthetic oligonucleotide
ggaacagaggtgtgtggtgggtatgcgcatatggta

SEQ ID NO: 74905 - DNA, 36 bp, Artificial Sequence
  Synthetic oligonucleotide
ttcgccgaattatcctgctgcaactcccgccagtta

SEQ ID NO: 74906 - DNA, 36 bp, Artificial Sequence
  Synthetic oligonucleotide
gcccgtagtaagtacctcgtttgcgcctcctcgtta

SEQ ID NO: 74907 - DNA, 35 bp, Artificial Sequence
  Synthetic oligonucleotide
agatgccataccgggtggaggggaggaagacttta

SEQ ID NO: 74908 - DNA, 36 bp, Artificial Sequence
  Synthetic oligonucleotide
tggacaagtgacatcggcgcccttctccacgtttta

SEQ ID NO: 74909 - DNA, 35 bp, Artificial Sequence
  Synthetic oligonucleotide
tcagtgcatgccgtaccatattcctacgctgaaac

SEQ ID NO: 74910 - DNA, 35 bp, Artificial Sequence
  Synthetic oligonucleotide
gccgacgcctatttgggccgaaggaggctccacac

SEQ ID NO: 74911 - DNA, 35 bp, Artificial Sequence
  Synthetic oligonucleotide
aatcgaggtccttagcctcctctgccatgttccac

SEQ ID NO: 74912 - DNA, 35 bp, Artificial Sequence
  Synthetic oligonucleotide
atgtgactgaaggccacccagttccctctttgcac

SEQ ID NO: 74913 - DNA, 35 bp, Artificial Sequence
  Synthetic oligonucleotide
tcttggcgcagtaggtccccccttttatcttgacc

SEQ ID NO: 74914 - DNA, 35 bp, Artificial Sequence
  Synthetic oligonucleotide
tgcaaaccctgctacccacgcccataacttacgcc

SEQ ID NO: 74915 - DNA, 35 bp, Artificial Sequence
  Synthetic oligonucleotide
accttcggtcgattcccatcaatatcgccgactcc

SEQ ID NO: 74916 - DNA, 35 bp, Artificial Sequence
  Synthetic oligonucleotide
tggtgactgtgtcagctctacctacgtttcggtcc

SEQ ID NO: 74917 - DNA, 35 bp, Artificial Sequence
  Synthetic oligonucleotide
aatgccatcaaaacgagtccctgcaggacatttcc

SEQ ID NO: 74918 - DNA, 35 bp, Artificial Sequence
  Synthetic oligonucleotide
aatgacggcgggagaaagcaaagaattgagagagc

SEQ ID NO: 74919 - DNA, 35 bp, Artificial Sequence
  Synthetic oligonucleotide
ttgagccacaactgggggatgtaacgcctgtccgc

SEQ ID NO: 74920 - DNA, 35 bp, Artificial Sequence
  Synthetic oligonucleotide
gaatcagcaaatatcgcccacgctcacgtccgtgc

SEQ ID NO: 74921 - DNA, 35 bp, Artificial Sequence
  Synthetic oligonucleotide
ggggaggcggggtaagggaaaaccgaggtccgtgc

SEQ ID NO: 74922 - DNA, 35 bp, Artificial Sequence
  Synthetic oligonucleotide
acaacgcgccaggtatcaaccccaccgcgtatatc

SEQ ID NO: 74923 - DNA, 35 bp, Artificial Sequence
  Synthetic oligonucleotide
atccggagctactcgcaacactccttacacacgtc

SEQ ID NO: 74924 - DNA, 35 bp, Artificial Sequence
  Synthetic oligonucleotide
attcatccacatcgagaagagtctttgactccgtc

SEQ ID NO: 74925 - DNA, 35 bp, Artificial Sequence
  Synthetic oligonucleotide
tgcgatagccgggccgaagcgtaaataactcattc

SEQ ID NO: 74926 - DNA, 35 bp, Artificial Sequence
  Synthetic oligonucleotide
aagcagccacgcctcgattcctgcaactgtgcttc

SEQ ID NO: 74927 - DNA, 35 bp, Artificial Sequence
  Synthetic oligonucleotide
gttactcacactgtaagtctcgaccttacgatttc

SEQ ID NO: 74928 - DNA, 35 bp, Artificial Sequence
  Synthetic oligonucleotide
gagaggagtaggtgggaggtacgaaaacgtgaaag

SEQ ID NO: 74929 - DNA, 35 bp, Artificial Sequence
  Synthetic oligonucleotide
actagcctcggatgattcccgctctccctcccaag

SEQ ID NO: 74930 - DNA, 35 bp, Artificial Sequence
  Synthetic oligonucleotide
gacgactacgtaatatcgacactctgctctccacg

SEQ ID NO: 74931 - DNA, 35 bp, Artificial Sequence
  Synthetic oligonucleotide
tgagtcagtataggtcggggtggggccagggggcg

SEQ ID NO: 74932 - DNA, 35 bp, Artificial Sequence
  Synthetic oligonucleotide
ggaaaggtaatgcggtggcgcggtgggtgggaagg

SEQ ID NO: 74933 - DNA, 35 bp, Artificial Sequence
  Synthetic oligonucleotide
tcaaagggggggtgaggtccgtttcaggcctaagg

SEQ ID NO: 74934 - DNA, 35 bp, Artificial Sequence
  Synthetic oligonucleotide
tcctacccacgcttggattaatctccttcctcgtg

SEQ ID NO: 74935 - DNA, 35 bp, Artificial Sequence
  Synthetic oligonucleotide
tgagccactgtgcgcctatacatggctaatacttg

SEQ ID NO: 74936 - DNA, 35 bp, Artificial Sequence
  Synthetic oligonucleotide
acggtgttcccgcccacaacgtccatttccatttg

SEQ ID NO: 74937 - DNA, 35 bp, Artificial Sequence
  Synthetic oligonucleotide
atccactcatgacccctaaaacaagacgattgcct

SEQ ID NO: 74938 - DNA, 35 bp, Artificial Sequence
  Synthetic oligonucleotide
tgcacgccgaatcaatgctcaacagttttcccgct

SEQ ID NO: 74939 - DNA, 35 bp, Artificial Sequence
  Synthetic oligonucleotide
gactgaaactacatccgtggacggcctaacttgct

SEQ ID NO: 74940 - DNA, 35 bp, Artificial Sequence
  Synthetic oligonucleotide
atcaacgagtcgctcgcccactgaaaaggtcatct

SEQ ID NO: 74941 - DNA, 35 bp, Artificial Sequence
  Synthetic oligonucleotide
ttcgccatgcccttgttggtattgccatgtactct

SEQ ID NO: 74942 - DNA, 35 bp, Artificial Sequence
  Synthetic oligonucleotide
tctgagactgccctacggtttattatttttgttct

SEQ ID NO: 74943 - DNA, 35 bp, Artificial Sequence
  Synthetic oligonucleotide
attggtgcgcgttccctcttgatgatctcgccatt

SEQ ID NO: 74944 - DNA, 35 bp, Artificial Sequence
  Synthetic oligonucleotide
gcctcgtcctgtctttaactctccatcgcatactt

SEQ ID NO: 74945 - DNA, 35 bp, Artificial Sequence
  Synthetic oligonucleotide
tcagctccgtcgtttggcttattcttccgcatctt

SEQ ID NO: 74946 - DNA, 35 bp, Artificial Sequence
  Synthetic oligonucleotide
atgttcaccccagtaatgctaccgctctatgtctt

SEQ ID NO: 74947 - DNA, 35 bp, Artificial Sequence
  Synthetic oligonucleotide
ttgatgggcccgttgaattgttctgcgcgtttctt

SEQ ID NO: 74948 - DNA, 35 bp, Artificial Sequence
  Synthetic oligonucleotide
tgtggaagacacgttgatagggtgggaggggattt

SEQ ID NO: 74949 - DNA, 35 bp, Artificial Sequence
  Synthetic oligonucleotide
gtcctggcgcacggcacccagttctgtcactcttt

SEQ ID NO: 74950 - DNA, 35 bp, Artificial Sequence
  Synthetic oligonucleotide
agcacaggggggcacaaagaacggggtgcaagaaa

SEQ ID NO: 74951 - DNA, 36 bp, Artificial Sequence
  Synthetic oligonucleotide
tcacccagaacgaacatgcttgccggaacgccccaa

SEQ ID NO: 74952 - DNA, 35 bp, Artificial Sequence
  Synthetic oligonucleotide
tctcaacatctgtgcactactccctaaacgcccaa

SEQ ID NO: 74953 - DNA, 35 bp, Artificial Sequence
  Synthetic oligonucleotide
gttcgtaggccctcatgtcgatcattgcacctcaa

SEQ ID NO: 74954 - DNA, 36 bp, Artificial Sequence
  Synthetic oligonucleotide
acgacatacttgccatccctttgcctaagatctcaa

SEQ ID NO: 74955 - DNA, 35 bp, Artificial Sequence
  Synthetic oligonucleotide
agccaggagctagctgcttacacactgggattgaa

SEQ ID NO: 74956 - DNA, 36 bp, Artificial Sequence
  Synthetic oligonucleotide
tcatcaaactctgcatgcccatctgtacgaccgtaa

SEQ ID NO: 74957 - DNA, 36 bp, Artificial Sequence
  Synthetic oligonucleotide
ttgcccacctacgtgcttcttctagccttgtcttaa

SEQ ID NO: 74958 - DNA, 36 bp, Artificial Sequence
  Synthetic oligonucleotide
gtattcccccgcagttcatccgacacaccgagtaca

SEQ ID NO: 74959 - DNA, 35 bp, Artificial Sequence
  Synthetic oligonucleotide
ggacggtcactacgagtttgcgctgcgcccaccca

SEQ ID NO: 74960 - DNA, 35 bp, Artificial Sequence
  Synthetic oligonucleotide
tctcataccgagaaggttctcccccaccgtggcca

SEQ ID NO: 74961 - DNA, 36 bp, Artificial Sequence
  Synthetic oligonucleotide
gtcaaaccaggccgtgtctttcatctaccctttcca

SEQ ID NO: 74962 - DNA, 36 bp, Artificial Sequence
  Synthetic oligonucleotide
acctacatccttgttctatcagtcagtagccacgca

SEQ ID NO: 74963 - DNA, 36 bp, Artificial Sequence
  Synthetic oligonucleotide
gacatccgcataggcactccccgtgacgggtcatca

SEQ ID NO: 74964 - DNA, 35 bp, Artificial Sequence
  Synthetic oligonucleotide
tcattgggccaggtctattccatgcgatgctctca

SEQ ID NO: 74965 - DNA, 37 bp, Artificial Sequence
  Synthetic oligonucleotide
tttagcgcggaggggaaagcagggtccgagggggaga

SEQ ID NO: 74966 - DNA, 37 bp, Artificial Sequence
  Synthetic oligonucleotide
ggtcccatctgtcggccctcttcgtgacaataaccga

SEQ ID NO: 74967 - DNA, 36 bp, Artificial Sequence
  Synthetic oligonucleotide
actgtccgcccctccaggattcgtttgtcagcccga

SEQ ID NO: 74968 - DNA, 37 bp, Artificial Sequence
  Synthetic oligonucleotide
agccacgcctaagcgcggccccagacctactctccga

SEQ ID NO: 74969 - DNA, 37 bp, Artificial Sequence
  Synthetic oligonucleotide
gtggccactcggcgcgacactctaatctatcatgcga

SEQ ID NO: 74970 - DNA, 37 bp, Artificial Sequence
  Synthetic oligonucleotide
tgacgagtaggcagggcacgaacagaagagggtgcga

SEQ ID NO: 74971 - DNA, 37 bp, Artificial Sequence
  Synthetic oligonucleotide
taatagcgctatgcccacttgctctcgtgctcctcga

SEQ ID NO: 74972 - DNA, 37 bp, Artificial Sequence
  Synthetic oligonucleotide
gcatgtcggagggggttctaggagtaattttggtcga

SEQ ID NO: 74973 - DNA, 37 bp, Artificial Sequence
  Synthetic oligonucleotide
atggcaaccacctacgcaccccgcgacgcccgttcga

SEQ ID NO: 74974 - DNA, 37 bp, Artificial Sequence
  Synthetic oligonucleotide
gtgggacgagtggaggatgaaggcgaacacggttcga

SEQ ID NO: 74975 - DNA, 37 bp, Artificial Sequence
  Synthetic oligonucleotide
actgcagatgagacgagcgaaagcgggatgttaagga

SEQ ID NO: 74976 - DNA, 37 bp, Artificial Sequence
  Synthetic oligonucleotide
agtgaaagtaggaggggagtggaccgcacaagcagga

SEQ ID NO: 74977 - DNA, 37 bp, Artificial Sequence
  Synthetic oligonucleotide
aaccctcaccaactctctggtccgacgtagaaacgga

SEQ ID NO: 74978 - DNA, 36 bp, Artificial Sequence
  Synthetic oligonucleotide
ggaccgccctctttgctacgcccctcgtctgccgga

SEQ ID NO: 74979 - DNA, 37 bp, Artificial Sequence
  Synthetic oligonucleotide
tgcccattcacacacacgcgacttatcatgcgtcgga

SEQ ID NO: 74980 - DNA, 36 bp, Artificial Sequence
  Synthetic oligonucleotide
tcttgcgtgggaggggcgggttttgagtgcaaggga

SEQ ID NO: 74981 - DNA, 37 bp, Artificial Sequence
  Synthetic oligonucleotide
agaggcgcaagccggtacgtgactgtaaaatcaggga

SEQ ID NO: 74982 - DNA, 37 bp, Artificial Sequence
  Synthetic oligonucleotide
tacgcaccgccgtggttcgtacatgtagacgggggga

SEQ ID NO: 74983 - DNA, 37 bp, Artificial Sequence
  Synthetic oligonucleotide
gtgccaagggtgcccggatagataggaggagctggga

SEQ ID NO: 74984 - DNA, 37 bp, Artificial Sequence
  Synthetic oligonucleotide
accatgcccagtttagcatgatggagagacacgtgga

SEQ ID NO: 74985 - DNA, 37 bp, Artificial Sequence
  Synthetic oligonucleotide
gatcggtacggaacggggcctgcatgggtagggtgga

SEQ ID NO: 74986 - DNA, 35 bp, Artificial Sequence
  Synthetic oligonucleotide
gacacggggggcaaattccatttaaaagtggtgga

SEQ ID NO: 74987 - DNA, 37 bp, Artificial Sequence
  Synthetic oligonucleotide
ggaaacgcccacaatggtgatttggttttaggttgga

SEQ ID NO: 74988 - DNA, 35 bp, Artificial Sequence
  Synthetic oligonucleotide
tgccccctccatgactgcttttccccttcacatga

SEQ ID NO: 74989 - DNA, 38 bp, Artificial Sequence
  Synthetic oligonucleotide
aacatccatctgccgttcaagcttgaccccatacatga

SEQ ID NO: 74990 - DNA, 38 bp, Artificial Sequence
  Synthetic oligonucleotide
ttgaggaggccggaatcggtataagagatgtgcgatga

SEQ ID NO: 74991 - DNA, 38 bp, Artificial Sequence
  Synthetic oligonucleotide
aacaagggttgaaacgtgttcagggggagggaatatga

SEQ ID NO: 74992 - DNA, 38 bp, Artificial Sequence
  Synthetic oligonucleotide
acgacgaggaggtgggtagggagtgtggcagtgtatga

SEQ ID NO: 74993 - DNA, 37 bp, Artificial Sequence
  Synthetic oligonucleotide
tcgcacctcggctacaatctcgcgcaaacctgactga

SEQ ID NO: 74994 - DNA, 38 bp, Artificial Sequence
  Synthetic oligonucleotide
taaccactgcactgatgcctatatgcagtgtctgctga

SEQ ID NO: 74995 - DNA, 38 bp, Artificial Sequence
  Synthetic oligonucleotide
gaactcatacatgtctcagaccccccgccatttgctga

SEQ ID NO: 74996 - DNA, 38 bp, Artificial Sequence
  Synthetic oligonucleotide
gattcagcacctgcaccgccgtatcttcgttcttctga

SEQ ID NO: 74997 - DNA, 38 bp, Artificial Sequence
  Synthetic oligonucleotide
gatacgcccatgttaaccgtaagtttttccttttctga

SEQ ID NO: 74998 - DNA, 38 bp, Artificial Sequence
  Synthetic oligonucleotide
tagcatcgtgaagggcgggaatatggaagggcaagtga

SEQ ID NO: 74999 - DNA, 38 bp, Artificial Sequence
  Synthetic oligonucleotide
gagcaacacacgatgtgaggataattgtgatatggtga

SEQ ID NO: 75000 - DNA, 38 bp, Artificial Sequence
  Synthetic oligonucleotide
gagaggacgatgtggaatcaaaaggggggttctggtga

SEQ ID NO: 75001 - DNA, 35 bp, Artificial Sequence
  Synthetic oligonucleotide
tttgaggtgcgggtgcggaggtggggattgtgtga

SEQ ID NO: 75002 - DNA, 38 bp, Artificial Sequence
  Synthetic oligonucleotide
gataatgtggaagggtgctggggcaggctgttttgtga

SEQ ID NO: 75003 - DNA, 37 bp, Artificial Sequence
  Synthetic oligonucleotide
tagtgaggaggtggtgatttaggagttggttaattga

SEQ ID NO: 75004 - DNA, 38 bp, Artificial Sequence
  Synthetic oligonucleotide
gcaagaggtcgtgacgttggggaagggcacgcgattga

SEQ ID NO: 75005 - DNA, 38 bp, Artificial Sequence
  Synthetic oligonucleotide
gagagcatcatacgaaccttatgctctgtaacacttga

SEQ ID NO: 75006 - DNA, 38 bp, Artificial Sequence
  Synthetic oligonucleotide
aactcggcgacaccatcacgcgcacactgaaaccttga

SEQ ID NO: 75007 - DNA, 35 bp, Artificial Sequence
  Synthetic oligonucleotide
tgcacgttccaatcccgccgcgcttgcccccttga

SEQ ID NO: 75008 - DNA, 38 bp, Artificial Sequence
  Synthetic oligonucleotide
ggacatctggacacaggagataagggatggagggttga

SEQ ID NO: 75009 - DNA, 37 bp, Artificial Sequence
  Synthetic oligonucleotide
atagcccccaacgtgctccatctttgtcctaatttga

SEQ ID NO: 75010 - DNA, 37 bp, Artificial Sequence
  Synthetic oligonucleotide
tgcgcctctaagcagcccgattttgccccacctttga

SEQ ID NO: 75011 - DNA, 36 bp, Artificial Sequence
  Synthetic oligonucleotide
atccaacagccctctctacttgtgcttctctcaata

SEQ ID NO: 75012 - DNA, 35 bp, Artificial Sequence
  Synthetic oligonucleotide
gactggggtgcccaggaaggagggatgaggggata

SEQ ID NO: 75013 - DNA, 36 bp, Artificial Sequence
  Synthetic oligonucleotide
gctgctgtccaatcacggcctatccatgcgccccta

SEQ ID NO: 75014 - DNA, 36 bp, Artificial Sequence
  Synthetic oligonucleotide
tcgagttcccacggctttgtactacaccacgatcta

SEQ ID NO: 75015 - DNA, 36 bp, Artificial Sequence
  Synthetic oligonucleotide
atgggtggcgcaggacctccgatctgactttctcta

SEQ ID NO: 75016 - DNA, 36 bp, Artificial Sequence
  Synthetic oligonucleotide
gcattccccggttgctgatcgcctgcacctattcta

SEQ ID NO: 75017 - DNA, 35 bp, Artificial Sequence
  Synthetic oligonucleotide
gttgaaacgtgccggtcgactcctctggcccctta

SEQ ID NO: 75018 - DNA, 36 bp, Artificial Sequence
  Synthetic oligonucleotide
ttgcccctacctcctgtcaaatttgtccgaccttta

SEQ ID NO: 75019 - DNA, 35 bp, Artificial Sequence
  Synthetic oligonucleotide
gttgccacggaccctgtcactgttcttttgatcac

SEQ ID NO: 75020 - DNA, 35 bp, Artificial Sequence
  Synthetic oligonucleotide
tccacggtatgacagtggtagaatcagggcgagac

SEQ ID NO: 75021 - DNA, 35 bp, Artificial Sequence
  Synthetic oligonucleotide
gcttggggggatgttgggtgggtgaatgggattac

SEQ ID NO: 75022 - DNA, 35 bp, Artificial Sequence
  Synthetic oligonucleotide
acaaatgcggcgatctcattccacgactcactacc

SEQ ID NO: 75023 - DNA, 35 bp, Artificial Sequence
  Synthetic oligonucleotide
gactacccgaggctctaggaccgttgcctggcccc

SEQ ID NO: 75024 - DNA, 35 bp, Artificial Sequence
  Synthetic oligonucleotide
atcacgtcccgaatcccaattaccgggtttatccc

SEQ ID NO: 75025 - DNA, 35 bp, Artificial Sequence
  Synthetic oligonucleotide
acagcccctgaattcctttaacttgcctgaaagcc

SEQ ID NO: 75026 - DNA, 35 bp, Artificial Sequence
  Synthetic oligonucleotide
ccactgccgcaatctgaactctactgtcctgcgcc

SEQ ID NO: 75027 - DNA, 35 bp, Artificial Sequence
  Synthetic oligonucleotide
tacgcaatgctgtgcggcgactgttcacccttgcc

SEQ ID NO: 75028 - DNA, 34 bp, Artificial Sequence
  Synthetic oligonucleotide
gctaaccattatttgtccgctgaacacgctgtcc

SEQ ID NO: 75029 - DNA, 35 bp, Artificial Sequence
  Synthetic oligonucleotide
ttgccgccggcataagcatgccagcaccctcacgc

SEQ ID NO: 75030 - DNA, 35 bp, Artificial Sequence
  Synthetic oligonucleotide
tttgccaccgggatgaacgttgtccgtgtcttcgc

SEQ ID NO: 75031 - DNA, 35 bp, Artificial Sequence
  Synthetic oligonucleotide
gaccctagatcgccaccttcggcctgcatacaggc

SEQ ID NO: 75032 - DNA, 35 bp, Artificial Sequence
  Synthetic oligonucleotide
gatagcccacgccctggttgacccttgttagatgc

SEQ ID NO: 75033 - DNA, 35 bp, Artificial Sequence
  Synthetic oligonucleotide
tttacgccgggacttcacccatacctccctgctgc

SEQ ID NO: 75034 - DNA, 35 bp, Artificial Sequence
  Synthetic oligonucleotide
acccatcacgacattatattacgattttgctgtgc

SEQ ID NO: 75035 - DNA, 35 bp, Artificial Sequence
  Synthetic oligonucleotide
gttggccggctatctatcgctgctccttaaattgc

SEQ ID NO: 75036 - DNA, 35 bp, Artificial Sequence
  Synthetic oligonucleotide
tgggggaggtggagcaatgagtttggtggtgattc

SEQ ID NO: 75037 - DNA, 35 bp, Artificial Sequence
  Synthetic oligonucleotide
agacaactgggaacgtaagttgcaatcagcccttc

SEQ ID NO: 75038 - DNA, 36 bp, Artificial Sequence
  Synthetic oligonucleotide
gcgtggaggccgggcaggaatgggagtgcgagggag

SEQ ID NO: 75039 - DNA, 35 bp, Artificial Sequence
  Synthetic oligonucleotide
accacccctgtcctaccagaactccgcccactgag

SEQ ID NO: 75040 - DNA, 35 bp, Artificial Sequence
  Synthetic oligonucleotide
gtgatctgcccttctccccagtcttcatgggtgag

SEQ ID NO: 75041 - DNA, 35 bp, Artificial Sequence
  Synthetic oligonucleotide
tcttcactcccaccgctgaccgacccacctgtgag

SEQ ID NO: 75042 - DNA, 35 bp, Artificial Sequence
  Synthetic oligonucleotide
tgtcaccccggtcgttaggcactatatatttcacg

SEQ ID NO: 75043 - DNA, 35 bp, Artificial Sequence
  Synthetic oligonucleotide
gaacgctcccactctcgtaacctacggttttgtcg

SEQ ID NO: 75044 - DNA, 35 bp, Artificial Sequence
  Synthetic oligonucleotide
gcggagccaaatccggggaatggagggggagcagg

SEQ ID NO: 75045 - DNA, 35 bp, Artificial Sequence
  Synthetic oligonucleotide
tcacaggagctacacatggcaggggggatctgggg

SEQ ID NO: 75046 - DNA, 35 bp, Artificial Sequence
  Synthetic oligonucleotide
ttcgccattaccataccttaactgccgtgagctgg

SEQ ID NO: 75047 - DNA, 35 bp, Artificial Sequence
  Synthetic oligonucleotide
acgtggctgactgcgtacttttccttagattttgg

SEQ ID NO: 75048 - DNA, 35 bp, Artificial Sequence
  Synthetic oligonucleotide
gcccgcaccccactttgaactacagtacccacctg

SEQ ID NO: 75049 - DNA, 35 bp, Artificial Sequence
  Synthetic oligonucleotide
tgccatcccctggtctcccttctaatgtctgcctg

SEQ ID NO: 75050 - DNA, 35 bp, Artificial Sequence
  Synthetic oligonucleotide
tacgcactctcctcgtggcccatgttaattgtgtg

SEQ ID NO: 75051 - DNA, 35 bp, Artificial Sequence
  Synthetic oligonucleotide
ggagcgcatgagaggactaggaggaacgagcattg

SEQ ID NO: 75052 - DNA, 35 bp, Artificial Sequence
  Synthetic oligonucleotide
atcgcgcccgattcgtcccatctcccgagttatat

SEQ ID NO: 75053 - DNA, 35 bp, Artificial Sequence
  Synthetic oligonucleotide
ggccatccccccgctgcctatattcaatattctat

SEQ ID NO: 75054 - DNA, 35 bp, Artificial Sequence
  Synthetic oligonucleotide
gcccatccagttctgcaatctaaagttccgcgact

SEQ ID NO: 75055 - DNA, 35 bp, Artificial Sequence
  Synthetic oligonucleotide
gcactccgaaaacaagcggctacagccctaaacct

SEQ ID NO: 75056 - DNA, 35 bp, Artificial Sequence
  Synthetic oligonucleotide
aaccagcttggaccctcatccctggtgctccgcct

SEQ ID NO: 75057 - DNA, 35 bp, Artificial Sequence
  Synthetic oligonucleotide
ccacggtctggatcgcaccctacacttagctttct

SEQ ID NO: 75058 - DNA, 35 bp, Artificial Sequence
  Synthetic oligonucleotide
aaagagggtgcaggtgccaggaacgtgaggtgggt

SEQ ID NO: 75059 - DNA, 35 bp, Artificial Sequence
  Synthetic oligonucleotide
gacggaggggtcgccgtagcttttactcttttggt

SEQ ID NO: 75060 - DNA, 35 bp, Artificial Sequence
  Synthetic oligonucleotide
gtacacccgtactagcagtatatcctagctcctgt

SEQ ID NO: 75061 - DNA, 35 bp, Artificial Sequence
  Synthetic oligonucleotide
atccaatcggccactatcgtgggattcaatccatt

SEQ ID NO: 75062 - DNA, 35 bp, Artificial Sequence
  Synthetic oligonucleotide
ggacaagcatcgtggggagggcggtcaagtcggtt

SEQ ID NO: 75063 - DNA, 35 bp, Artificial Sequence
  Synthetic oligonucleotide
gacgctcaaccacctgttagaccatgcatgctttt

SEQ ID NO: 75064 - DNA, 36 bp, Artificial Sequence
  Synthetic oligonucleotide
atcgtccatcgcaggcgtatttaacccctcatacaa

SEQ ID NO: 75065 - DNA, 35 bp, Artificial Sequence
  Synthetic oligonucleotide
acactcgttgcgagcgagacacgtaccatccccaa

SEQ ID NO: 75066 - DNA, 36 bp, Artificial Sequence
  Synthetic oligonucleotide
gcgggcctcacacccagcctatgtaactttcacgaa

SEQ ID NO: 75067 - DNA, 36 bp, Artificial Sequence
  Synthetic oligonucleotide
gaaccgtcttaatgcctcttaccccggcccaccgaa

SEQ ID NO: 75068 - DNA, 36 bp, Artificial Sequence
  Synthetic oligonucleotide
gcaccgcgcgttggttttcacacattatggattgaa

SEQ ID NO: 75069 - DNA, 35 bp, Artificial Sequence
  Synthetic oligonucleotide
tcgccccgcgattctgctaatctccaccttcaaca

SEQ ID NO: 75070 - DNA, 36 bp, Artificial Sequence
  Synthetic oligonucleotide
tctaccacgacgaggctctcggagctactactcaca

SEQ ID NO: 75071 - DNA, 36 bp, Artificial Sequence
  Synthetic oligonucleotide
tacatgttagccgtgcaatacctcccgactcgacca

SEQ ID NO: 75072 - DNA, 36 bp, Artificial Sequence
  Synthetic oligonucleotide
tagtagcacaatctctaactgctcatcctttgccca

SEQ ID NO: 75073 - DNA, 36 bp, Artificial Sequence
  Synthetic oligonucleotide
gcagtccgccacaacctgaatgcagcactagaagca

SEQ ID NO: 75074 - DNA, 36 bp, Artificial Sequence
  Synthetic oligonucleotide
tttcaagccgtctcatctcctgtagcttttcgtgca

SEQ ID NO: 75075 - DNA, 36 bp, Artificial Sequence
  Synthetic oligonucleotide
aattaccatcaggtgcccgaaccgcagccgcttgca

SEQ ID NO: 75076 - DNA, 36 bp, Artificial Sequence
  Synthetic oligonucleotide
gaccaggctctgtattcgcaattgcccccgcagtca

SEQ ID NO: 75077 - DNA, 36 bp, Artificial Sequence
  Synthetic oligonucleotide
gcaaacatctccccaccgtcctcacacctgaggtca

SEQ ID NO: 75078 - DNA, 36 bp, Artificial Sequence
  Synthetic oligonucleotide
atcaccaggtcgcctgcaactattctgtgagtttca

SEQ ID NO: 75079 - DNA, 37 bp, Artificial Sequence
  Synthetic oligonucleotide
tccgccctcggctctacctgaacttatctctgcaaga

SEQ ID NO: 75080 - DNA, 37 bp, Artificial Sequence
  Synthetic oligonucleotide
agagggaggtggtagagcaagctatgggaagtcaaga

SEQ ID NO: 75081 - DNA, 37 bp, Artificial Sequence
  Synthetic oligonucleotide
tcactacacccgcacagttcccggtcaatacctaaga

SEQ ID NO: 75082 - DNA, 37 bp, Artificial Sequence
  Synthetic oligonucleotide
tggttggaaggggtgacacaattgaaaagtagagaga

SEQ ID NO: 75083 - DNA, 37 bp, Artificial Sequence
  Synthetic oligonucleotide
gactagcgcagcccactctcgccttgtcttgctacga

SEQ ID NO: 75084 - DNA, 37 bp, Artificial Sequence
  Synthetic oligonucleotide
gagataaccagcatcagcatctctctagtgccaccga

SEQ ID NO: 75085 - DNA, 37 bp, Artificial Sequence
  Synthetic oligonucleotide
tgatggtcaatcacttctataccgcgtggcaacccga

SEQ ID NO: 75086 - DNA, 37 bp, Artificial Sequence
  Synthetic oligonucleotide
accacagcagcgattatcgccctccctcgtttcccga

SEQ ID NO: 75087 - DNA, 36 bp, Artificial Sequence
  Synthetic oligonucleotide
aaccaaggcggaaacagcagctccagagccctccga

SEQ ID NO: 75088 - DNA, 37 bp, Artificial Sequence
  Synthetic oligonucleotide
ttctcacaaacgcgcatcctcagccacattgctccga

SEQ ID NO: 75089 - DNA, 37 bp, Artificial Sequence
  Synthetic oligonucleotide
tcccgccccgctcggcgtatcctggagtaaatatcga

SEQ ID NO: 75090 - DNA, 37 bp, Artificial Sequence
  Synthetic oligonucleotide
ttcgaggtggggtgagttttagcggttactggaagga

SEQ ID NO: 75091 - DNA, 37 bp, Artificial Sequence
  Synthetic oligonucleotide
gcactgtagtattcctttgcccaccccgcacccagga

SEQ ID NO: 75092 - DNA, 35 bp, Artificial Sequence
  Synthetic oligonucleotide
gtggagcataatcagcagagtgaaaagggcgagga

SEQ ID NO: 75093 - DNA, 37 bp, Artificial Sequence
  Synthetic oligonucleotide
gcaaaacgagcctagaacgcgcactatctcacaggga

SEQ ID NO: 75094 - DNA, 35 bp, Artificial Sequence
  Synthetic oligonucleotide
taatcgcaaagggggggccatattaaggtctggga

SEQ ID NO: 75095 - DNA, 37 bp, Artificial Sequence
  Synthetic oligonucleotide
tcatccttcccagtttatgatctagatttccgctgga

SEQ ID NO: 75096 - DNA, 36 bp, Artificial Sequence
  Synthetic oligonucleotide
accacctctaagttctatcgcccatgccgtagtgga

SEQ ID NO: 75097 - DNA, 35 bp, Artificial Sequence
  Synthetic oligonucleotide
gtatgcatcgtgagcaaccccactctcgaccatga

SEQ ID NO: 75098 - DNA, 38 bp, Artificial Sequence
  Synthetic oligonucleotide
tgccacgtggttcaaggaaggggggggaatgccgatga

SEQ ID NO: 75099 - DNA, 38 bp, Artificial Sequence
  Synthetic oligonucleotide
gacatcgcaactgcgcttttctgagaactgatggatga

SEQ ID NO: 75100 - DNA, 38 bp, Artificial Sequence
  Synthetic oligonucleotide
gatcacaacagtcagcattcgccgtcccagcctactga

SEQ ID NO: 75101 - DNA, 38 bp, Artificial Sequence
  Synthetic oligonucleotide
acaactccacccatccgacggccacaatgtgctactga

SEQ ID NO: 75102 - DNA, 35 bp, Artificial Sequence
  Synthetic oligonucleotide
aacggagcattccctggcccattgaggtctactga

SEQ ID NO: 75103 - DNA, 38 bp, Artificial Sequence
  Synthetic oligonucleotide
acattcccccgccatgaatctcagtgccttaaccctga

SEQ ID NO: 75104 - DNA, 38 bp, Artificial Sequence
  Synthetic oligonucleotide
tgcgcctacactgtcattatcttatcccctgtccctga

SEQ ID NO: 75105 - DNA, 37 bp, Artificial Sequence
  Synthetic oligonucleotide
gaccatcaacccgcgttcctacacatcagactcctga

SEQ ID NO: 75106 - DNA, 37 bp, Artificial Sequence
  Synthetic oligonucleotide
ttaggggtgggaggttaagtgaaaggggtagggctga

SEQ ID NO: 75107 - DNA, 38 bp, Artificial Sequence
  Synthetic oligonucleotide
tcagatgccgggggatagcagaggatagtgggtgctga

SEQ ID NO: 75108 - DNA, 37 bp, Artificial Sequence
  Synthetic oligonucleotide
gccatccccgggtaggttctgtgcaacatctatctga

SEQ ID NO: 75109 - DNA, 38 bp, Artificial Sequence
  Synthetic oligonucleotide
gttgggagggcgcagtcatgagtagggcaggggagtga

SEQ ID NO: 75110 - DNA, 38 bp, Artificial Sequence
  Synthetic oligonucleotide
tatgcccctgatcttgttccgttcttcgttcttagtga

SEQ ID NO: 75111 - DNA, 38 bp, Artificial Sequence
  Synthetic oligonucleotide
tgggactaggggggggtggagtagaatcggaaacgtga

SEQ ID NO: 75112 - DNA, 38 bp, Artificial Sequence
  Synthetic oligonucleotide
gagtaagggtgaggatgggctactgaaggccgaggtga

SEQ ID NO: 75113 - DNA, 38 bp, Artificial Sequence
  Synthetic oligonucleotide
gtgagatcgcgggtggaacaaagttaatgaagtggtga

SEQ ID NO: 75114 - DNA, 38 bp, Artificial Sequence
  Synthetic oligonucleotide
gcacaggtcggagacgttgcgaaaaaaggggaatgtga

SEQ ID NO: 75115 - DNA, 38 bp, Artificial Sequence
  Synthetic oligonucleotide
ggaacgtgcgggaatggctggctgggtgtacgctgtga

SEQ ID NO: 75116 - DNA, 38 bp, Artificial Sequence
  Synthetic oligonucleotide
aaacacccgcaaccgctgacatcgcgctaccgcattga

SEQ ID NO: 75117 - DNA, 38 bp, Artificial Sequence
  Synthetic oligonucleotide
ttggcgtgggaaggagagctgataacgggagggattga

SEQ ID NO: 75118 - DNA, 38 bp, Artificial Sequence
  Synthetic oligonucleotide
gccccagtcagtggttacgcttgtcttctttctattga

SEQ ID NO: 75119 - DNA, 38 bp, Artificial Sequence
  Synthetic oligonucleotide
tgattcggtgcagctgcttggatcaactaccaccttga

SEQ ID NO: 75120 - DNA, 38 bp, Artificial Sequence
  Synthetic oligonucleotide
aagtaccgccatactcagtaccatactgactcccttga

SEQ ID NO: 75121 - DNA, 37 bp, Artificial Sequence
  Synthetic oligonucleotide
gtgacgtggaaggtggttggggtttataggtgcttga

SEQ ID NO: 75122 - DNA, 38 bp, Artificial Sequence
  Synthetic oligonucleotide
gtgcgcccaggggaagaacggggaggtcccggggttga

SEQ ID NO: 75123 - DNA, 38 bp, Artificial Sequence
  Synthetic oligonucleotide
gtaggacgcgggaggtaagggccctggtgcggtgttga

SEQ ID NO: 75124 - DNA, 37 bp, Artificial Sequence
  Synthetic oligonucleotide
aagcgaaggcgtacagccacttaacaccacactttga

SEQ ID NO: 75125 - DNA, 38 bp, Artificial Sequence
  Synthetic oligonucleotide
tcagacgtggggccttcgtaatcgttcatgctctttga

SEQ ID NO: 75126 - DNA, 36 bp, Artificial Sequence
  Synthetic oligonucleotide
gacaacgcgaaggtaaaccaagctttgcacttttga

SEQ ID NO: 75127 - DNA, 35 bp, Artificial Sequence
  Synthetic oligonucleotide
atacaggcgggacaaaggggaagtgaggttgcata

SEQ ID NO: 75128 - DNA, 36 bp, Artificial Sequence
  Synthetic oligonucleotide
ttgttacccggctctatggtaagcaccatataacta

SEQ ID NO: 75129 - DNA, 36 bp, Artificial Sequence
  Synthetic oligonucleotide
gagttccgcaacatccaccatgcgtctaatttccta

SEQ ID NO: 75130 - DNA, 36 bp, Artificial Sequence
  Synthetic oligonucleotide
gcttgactctgcactccttaaaccagacgttcgcta

SEQ ID NO: 75131 - DNA, 36 bp, Artificial Sequence
  Synthetic oligonucleotide
agatgcgcgctacagcatcattccccattctggcta

SEQ ID NO: 75132 - DNA, 36 bp, Artificial Sequence
  Synthetic oligonucleotide
aacacagtcgcatggaaggagcaacgcattcaagta

SEQ ID NO: 75133 - DNA, 36 bp, Artificial Sequence
  Synthetic oligonucleotide
tagatggggcggaccaggaggggatagagtgaagta

SEQ ID NO: 75134 - DNA, 36 bp, Artificial Sequence
  Synthetic oligonucleotide
gacgcactgggggaaggggccttaaggaggggagta

SEQ ID NO: 75135 - DNA, 36 bp, Artificial Sequence
  Synthetic oligonucleotide
aaccacccagtgtcttccttgcagtccactcccgta

SEQ ID NO: 75136 - DNA, 35 bp, Artificial Sequence
  Synthetic oligonucleotide
atcgcccactcctaagggcccaaccgcctccggta

SEQ ID NO: 75137 - DNA, 36 bp, Artificial Sequence
  Synthetic oligonucleotide
gcccgccggtgaccgcacatcccctcatcgttggta

SEQ ID NO: 75138 - DNA, 36 bp, Artificial Sequence
  Synthetic oligonucleotide
aacacacctgctgcaactgcgcggctcttcgactta

SEQ ID NO: 75139 - DNA, 35 bp, Artificial Sequence
  Synthetic oligonucleotide
aagtgggaacacacatagggttgataggcgggtta

SEQ ID NO: 75140 - DNA, 36 bp, Artificial Sequence
  Synthetic oligonucleotide
tcgaccctccatgttatcatctgaaatataatgtta

SEQ ID NO: 75141 - DNA, 35 bp, Artificial Sequence
  Synthetic oligonucleotide
agatcaaccgttggggcctcctgcctttgtaaaac

SEQ ID NO: 75142 - DNA, 35 bp, Artificial Sequence
  Synthetic oligonucleotide
gatggcccttcgcccttgggtctttctcataccac

SEQ ID NO: 75143 - DNA, 35 bp, Artificial Sequence
  Synthetic oligonucleotide
gcccatcacctgtggtcttcctggccgttccgcac

SEQ ID NO: 75144 - DNA, 35 bp, Artificial Sequence
  Synthetic oligonucleotide
atctgtcagcacgcgccccggcaactatcctcgac

SEQ ID NO: 75145 - DNA, 35 bp, Artificial Sequence
  Synthetic oligonucleotide
gccaagggagacgaccgtcgcaactaaatcctgac

SEQ ID NO: 75146 - DNA, 35 bp, Artificial Sequence
  Synthetic oligonucleotide
tcgaacatattcaacttcactgcccgttctctgac

SEQ ID NO: 75147 - DNA, 35 bp, Artificial Sequence
  Synthetic oligonucleotide
tgccaccacaggtcctgcacgataaatctgtctac

SEQ ID NO: 75148 - DNA, 35 bp, Artificial Sequence
  Synthetic oligonucleotide
tccacctcgcgatctaccaaactttgagaacgtac

SEQ ID NO: 75149 - DNA, 35 bp, Artificial Sequence
  Synthetic oligonucleotide
gtgcgcaccagccccactactatgctccgcgttac

SEQ ID NO: 75150 - DNA, 35 bp, Artificial Sequence
  Synthetic oligonucleotide
acgctcacccgacgccttgtcatccgttgactacc

SEQ ID NO: 75151 - DNA, 35 bp, Artificial Sequence
  Synthetic oligonucleotide
acgtgttgaccgtccccccgcaaatgtcaagtacc

SEQ ID NO: 75152 - DNA, 35 bp, Artificial Sequence
  Synthetic oligonucleotide
ttacgtgtccttgcttagctgcctgttgaatgccc

SEQ ID NO: 75153 - DNA, 35 bp, Artificial Sequence
  Synthetic oligonucleotide
tgccacggccggaccgttaattagcatcacatccc

SEQ ID NO: 75154 - DNA, 35 bp, Artificial Sequence
  Synthetic oligonucleotide
gacaacccgagcgtccaataatgccaatcgtctcc

SEQ ID NO: 75155 - DNA, 35 bp, Artificial Sequence
  Synthetic oligonucleotide
ttaccaatccgaacaccgaagtccatacgtggtcc

SEQ ID NO: 75156 - DNA, 35 bp, Artificial Sequence
  Synthetic oligonucleotide
acagaccttggcccacattattagatcctttttcc

SEQ ID NO: 75157 - DNA, 35 bp, Artificial Sequence
  Synthetic oligonucleotide
accaacggtgggctaagctccactccctcccgagc

SEQ ID NO: 75158 - DNA, 35 bp, Artificial Sequence
  Synthetic oligonucleotide
gtgacaatacagctacatctcacccggcccttagc

SEQ ID NO: 75159 - DNA, 35 bp, Artificial Sequence
  Synthetic oligonucleotide
gactgttaccatcctgcatctctcagtgatcccgc

SEQ ID NO: 75160 - DNA, 35 bp, Artificial Sequence
  Synthetic oligonucleotide
tgctatcctgccccccctattgtgcgtgtaaaggc

SEQ ID NO: 75161 - DNA, 35 bp, Artificial Sequence
  Synthetic oligonucleotide
agtccccccgccctgtcatctgagctctgcatggc

SEQ ID NO: 75162 - DNA, 35 bp, Artificial Sequence
  Synthetic oligonucleotide
aacccccactcgacccaccttgttctctgccatgc

SEQ ID NO: 75163 - DNA, 35 bp, Artificial Sequence
  Synthetic oligonucleotide
tccatcggctcaccttcgaccaaagtcgctcatgc

SEQ ID NO: 75164 - DNA, 36 bp, Artificial Sequence
  Synthetic oligonucleotide
tcactccgccggccacacgactcctccttcgcctgc

SEQ ID NO: 75165 - DNA, 35 bp, Artificial Sequence
  Synthetic oligonucleotide
accccttgcacattaacttcatagtacaggtctgc

SEQ ID NO: 75166 - DNA, 35 bp, Artificial Sequence
  Synthetic oligonucleotide
gaaatgcactacagctccgtcgcagaccctattgc

SEQ ID NO: 75167 - DNA, 35 bp, Artificial Sequence
  Synthetic oligonucleotide
tgcaacatgggacagtacatagctggtgcaccatc

SEQ ID NO: 75168 - DNA, 35 bp, Artificial Sequence
  Synthetic oligonucleotide
gaaatcgtatcgctgacccccgaatgagtcccctc

SEQ ID NO: 75169 - DNA, 35 bp, Artificial Sequence
  Synthetic oligonucleotide
tgaacgagctaacagctgactgttgctaacccttc

SEQ ID NO: 75170 - DNA, 35 bp, Artificial Sequence
  Synthetic oligonucleotide
agcaagagcgtgggcaggggagctagggattgcag

SEQ ID NO: 75171 - DNA, 35 bp, Artificial Sequence
  Synthetic oligonucleotide
gcgaacgttcagagcatagtctccccactcgtacg

SEQ ID NO: 75172 - DNA, 35 bp, Artificial Sequence
  Synthetic oligonucleotide
agttcggtcctgaacatcgagtgcaacatattccg

SEQ ID NO: 75173 - DNA, 35 bp, Artificial Sequence
  Synthetic oligonucleotide
tgaacctagccccgtggacctctcgaacctttccg

SEQ ID NO: 75174 - DNA, 35 bp, Artificial Sequence
  Synthetic oligonucleotide
ccacccaccgttctacccatgttggcgccatttcg

SEQ ID NO: 75175 - DNA, 35 bp, Artificial Sequence
  Synthetic oligonucleotide
tcacccctgataacggtcgacgtacgtacctttcg

SEQ ID NO: 75176 - DNA, 35 bp, Artificial Sequence
  Synthetic oligonucleotide
tacttcccgattacggtccatctctaccctggtgg

SEQ ID NO: 75177 - DNA, 35 bp, Artificial Sequence
  Synthetic oligonucleotide
acatgccctctgtcgtcctccatttcgctgccctg

SEQ ID NO: 75178 - DNA, 35 bp, Artificial Sequence
  Synthetic oligonucleotide
gaagacgtgggaaaagggagggtatgaacggggtg

SEQ ID NO: 75179 - DNA, 35 bp, Artificial Sequence
  Synthetic oligonucleotide
tacagcatctctacttggcgcacttgtcactcttg

SEQ ID NO: 75180 - DNA, 35 bp, Artificial Sequence
  Synthetic oligonucleotide
agtcggtcgccgcttttttttacacgttaacccat

SEQ ID NO: 75181 - DNA, 35 bp, Artificial Sequence
  Synthetic oligonucleotide
tatgccctggtttctagaacgccgaactgctttat

SEQ ID NO: 75182 - DNA, 35 bp, Artificial Sequence
  Synthetic oligonucleotide
atggccacctttcactttccttacatccgggcact

SEQ ID NO: 75183 - DNA, 36 bp, Artificial Sequence
  Synthetic oligonucleotide
tatgcgtactatggtgtcccggcttaactcccccct

SEQ ID NO: 75184 - DNA, 35 bp, Artificial Sequence
  Synthetic oligonucleotide
acttgcaaccgaacgcgattggtttggccgtgcct

SEQ ID NO: 75185 - DNA, 35 bp, Artificial Sequence
  Synthetic oligonucleotide
ttgggtccgtctttccgttccaaacagcctccgct

SEQ ID NO: 75186 - DNA, 35 bp, Artificial Sequence
  Synthetic oligonucleotide
gaggggaaagttgacggtgcagaaggagaggcgct

SEQ ID NO: 75187 - DNA, 35 bp, Artificial Sequence
  Synthetic oligonucleotide
gacgacagggcgatcttgtttttcggggttggtct

SEQ ID NO: 75188 - DNA, 35 bp, Artificial Sequence
  Synthetic oligonucleotide
tcagcacgggacaaaggaggatatttgaaaacggt

SEQ ID NO: 75189 - DNA, 35 bp, Artificial Sequence
  Synthetic oligonucleotide
acaggtcacaactggcaataggggggagcaatggt

SEQ ID NO: 75190 - DNA, 35 bp, Artificial Sequence
  Synthetic oligonucleotide
tccgacgccgctcattgttcgcttcttgcccctgt

SEQ ID NO: 75191 - DNA, 35 bp, Artificial Sequence
  Synthetic oligonucleotide
gtcacatcggtcggttaccttgttgcaactcaatt

SEQ ID NO: 75192 - DNA, 35 bp, Artificial Sequence
  Synthetic oligonucleotide
ttgcctgactcccgcccatggttacaaacttgatt

SEQ ID NO: 75193 - DNA, 35 bp, Artificial Sequence
  Synthetic oligonucleotide
accgtcctcctatctgtgagttactgtcacctatt

SEQ ID NO: 75194 - DNA, 35 bp, Artificial Sequence
  Synthetic oligonucleotide
tgttgaggcgtcgctccccggtagcctccccattt

SEQ ID NO: 75195 - DNA, 35 bp, Artificial Sequence
  Synthetic oligonucleotide
atccatcttcctcgcgttgttcaggtttctgcttt

SEQ ID NO: 75196 - DNA, 36 bp, Artificial Sequence
  Synthetic oligonucleotide
cccatccggcacaatgcaccatcatgcacgggaaaa

SEQ ID NO: 75197 - DNA, 35 bp, Artificial Sequence
  Synthetic oligonucleotide
tccttcgacagtgaagctcgtcaactataggcaaa

SEQ ID NO: 75198 - DNA, 35 bp, Artificial Sequence
  Synthetic oligonucleotide
ttgcgggagcaccgcacattctgcacctatctaaa

SEQ ID NO: 75199 - DNA, 36 bp, Artificial Sequence
  Synthetic oligonucleotide
gcacacgtatcggtacattgcttctacctgtctaaa

SEQ ID NO: 75200 - DNA, 35 bp, Artificial Sequence
  Synthetic oligonucleotide
acatcaggtcgcctgcttccgtcccccacccccaa

SEQ ID NO: 75201 - DNA, 35 bp, Artificial Sequence
  Synthetic oligonucleotide
tttgacatccatggcgttcgaggcccatccctcaa

SEQ ID NO: 75202 - DNA, 35 bp, Artificial Sequence
  Synthetic oligonucleotide
gacctgtcgtgcgccctgctactggcccatttcaa

SEQ ID NO: 75203 - DNA, 36 bp, Artificial Sequence
  Synthetic oligonucleotide
tagtgcagaatggggccatggagcggagattagtaa

SEQ ID NO: 75204 - DNA, 36 bp, Artificial Sequence
  Synthetic oligonucleotide
aactcaatggggtggggaggtcacaagtagggaaca

SEQ ID NO: 75205 - DNA, 36 bp, Artificial Sequence
  Synthetic oligonucleotide
acgccgctcatgcttacatttccgcacacctctcca

SEQ ID NO: 75206 - DNA, 35 bp, Artificial Sequence
  Synthetic oligonucleotide
tcgccacaccacctttttcgtagactagattagca

SEQ ID NO: 75207 - DNA, 36 bp, Artificial Sequence
  Synthetic oligonucleotide
gttcctcctaccgccgctactcgcaccgtgccatca

SEQ ID NO: 75208 - DNA, 36 bp, Artificial Sequence
  Synthetic oligonucleotide
gatacccatactgacgtagcaacttgaccggactca

SEQ ID NO: 75209 - DNA, 36 bp, Artificial Sequence
  Synthetic oligonucleotide
gcaacgccgaacgcatacgacgggaagggggtgtca

SEQ ID NO: 75210 - DNA, 37 bp, Artificial Sequence
  Synthetic oligonucleotide
gatagctggcggacggcgtgggaaaggtcggaaaaga

SEQ ID NO: 75211 - DNA, 37 bp, Artificial Sequence
  Synthetic oligonucleotide
ggtggggttacagggcggaccaaggaaaagtttcaga

SEQ ID NO: 75212 - DNA, 35 bp, Artificial Sequence
  Synthetic oligonucleotide
gtgagagcccgcacgatccgacttatcttcataga

SEQ ID NO: 75213 - DNA, 37 bp, Artificial Sequence
  Synthetic oligonucleotide
accgtcgtagtgctcgctcccctccctatacattaga

SEQ ID NO: 75214 - DNA, 35 bp, Artificial Sequence
  Synthetic oligonucleotide
gaagtaggggggaagggcaaggaagagtggttaga

SEQ ID NO: 75215 - DNA, 37 bp, Artificial Sequence
  Synthetic oligonucleotide
tatcaccctcggctaaacacggtcacgccctcaacga

SEQ ID NO: 75216 - DNA, 35 bp, Artificial Sequence
  Synthetic oligonucleotide
gcaacaacacgtgaaagtacctgcctcccaagcga

SEQ ID NO: 75217 - DNA, 37 bp, Artificial Sequence
  Synthetic oligonucleotide
ttgaggaggggccatggggtggtgagctgagtagcga

SEQ ID NO: 75218 - DNA, 37 bp, Artificial Sequence
  Synthetic oligonucleotide
gtgagtgcgacaaaaagaggggggaggacctatgcga

SEQ ID NO: 75219 - DNA, 37 bp, Artificial Sequence
  Synthetic oligonucleotide
atgccaccattatccggttatggaacgtatctctcga

SEQ ID NO: 75220 - DNA, 37 bp, Artificial Sequence
  Synthetic oligonucleotide
gtcgatcggtcctgctgtcgtaatcagcacgcttcga

SEQ ID NO: 75221 - DNA, 37 bp, Artificial Sequence
  Synthetic oligonucleotide
acatactatcacgctactttacaccgtccgccaagga

SEQ ID NO: 75222 - DNA, 37 bp, Artificial Sequence
  Synthetic oligonucleotide
acatccacacctccgacacggtccacactcgcaagga

SEQ ID NO: 75223 - DNA, 36 bp, Artificial Sequence
  Synthetic oligonucleotide
gaacctcccctacacacctacgaatcagtcatcgga

SEQ ID NO: 75224 - DNA, 36 bp, Artificial Sequence
  Synthetic oligonucleotide
gcctaaacaggggtgccattcgagggaagggaggga

SEQ ID NO: 75225 - DNA, 36 bp, Artificial Sequence
  Synthetic oligonucleotide
ggtgggcacgccatagggacagggggtccaggggga

SEQ ID NO: 75226 - DNA, 37 bp, Artificial Sequence
  Synthetic oligonucleotide
acgatgccagtgggaggttaggtgatatagcggggga

SEQ ID NO: 75227 - DNA, 36 bp, Artificial Sequence
  Synthetic oligonucleotide
gactaggggctatacggtgtaacaagggattgggga

SEQ ID NO: 75228 - DNA, 37 bp, Artificial Sequence
  Synthetic oligonucleotide
ggatgataggggaattggttatgagagagggatggga

SEQ ID NO: 75229 - DNA, 37 bp, Artificial Sequence
  Synthetic oligonucleotide
acatactggcgtgtgaagggcgagggctgtaactgga

SEQ ID NO: 75230 - DNA, 37 bp, Artificial Sequence
  Synthetic oligonucleotide
tgaacgaagggtgacgtagcagcgagttaagattgga

SEQ ID NO: 75231 - DNA, 37 bp, Artificial Sequence
  Synthetic oligonucleotide
gacccaggcgcccttccagctttgatcgtaatttgga

SEQ ID NO: 75232 - DNA, 37 bp, Artificial Sequence
  Synthetic oligonucleotide
gtccctcatcgcttatctgccaggtgcctgccaatga

SEQ ID NO: 75233 - DNA, 37 bp, Artificial Sequence
  Synthetic oligonucleotide
agatccggctggcccccctctatgccttttcgcatga

SEQ ID NO: 75234 - DNA, 38 bp, Artificial Sequence
  Synthetic oligonucleotide
aagtccgaaggggtgagttgggaagctgggcacactga

SEQ ID NO: 75235 - DNA, 38 bp, Artificial Sequence
  Synthetic oligonucleotide
accgtcacatagacctaccccgtgcctcctgttcctga

SEQ ID NO: 75236 - DNA, 38 bp, Artificial Sequence
  Synthetic oligonucleotide
tcccgatcgacctaacacgttatcctgccctttagtga

SEQ ID NO: 75237 - DNA, 37 bp, Artificial Sequence
  Synthetic oligonucleotide
agcacccctccgatattccaaacacgacgaaccgtga

SEQ ID NO: 75238 - DNA, 38 bp, Artificial Sequence
  Synthetic oligonucleotide
gtggaggcaccatggtacatccgctcgtccttccgtga

SEQ ID NO: 75239 - DNA, 38 bp, Artificial Sequence
  Synthetic oligonucleotide
tacagagggaggggagactaaaacgtgagcggtggtga

SEQ ID NO: 75240 - DNA, 36 bp, Artificial Sequence
  Synthetic oligonucleotide
tgtaaaaagcatgggtggcacatttgtgggtggtga

SEQ ID NO: 75241 - DNA, 38 bp, Artificial Sequence
  Synthetic oligonucleotide
ttgtgtgtggtgcgtaggaaaggaatgccttgtggtga

SEQ ID NO: 75242 - DNA, 38 bp, Artificial Sequence
  Synthetic oligonucleotide
tcccggtcacaactttatgactcgcaccatccaattga

SEQ ID NO: 75243 - DNA, 38 bp, Artificial Sequence
  Synthetic oligonucleotide
acctcgcgataccactgtgcacttacctccagccttga

SEQ ID NO: 75244 - DNA, 37 bp, Artificial Sequence
  Synthetic oligonucleotide
tgcccacgctgaacactagctatgccgattgccttga

SEQ ID NO: 75245 - DNA, 36 bp, Artificial Sequence
  Synthetic oligonucleotide
tctaccccagggcggagccgtggatccttgccttga

SEQ ID NO: 75246 - DNA, 37 bp, Artificial Sequence
  Synthetic oligonucleotide
gattgccggttccctacctcgtgtctactctgcttga

SEQ ID NO: 75247 - DNA, 37 bp, Artificial Sequence
  Synthetic oligonucleotide
gggggctgagagggaaatgtggggattgcggggttga

SEQ ID NO: 75248 - DNA, 37 bp, Artificial Sequence
  Synthetic oligonucleotide
tgactaggacaggggaaggggcttgggcggtggttga

SEQ ID NO: 75249 - DNA, 37 bp, Artificial Sequence
  Synthetic oligonucleotide
tccggtgttggctattactattcgtgcaccactttga

SEQ ID NO: 75250 - DNA, 36 bp, Artificial Sequence
  Synthetic oligonucleotide
acatgcaccgatggatgctacctttaaccgatgata

SEQ ID NO: 75251 - DNA, 36 bp, Artificial Sequence
  Synthetic oligonucleotide
ttctcccatccggctaatgtaaggcctatctcccta

SEQ ID NO: 75252 - DNA, 36 bp, Artificial Sequence
  Synthetic oligonucleotide
gttctgcccatagacctaccaagctgactattccta

SEQ ID NO: 75253 - DNA, 33 bp, Artificial Sequence
  Synthetic oligonucleotide
ttatcagggacagtcactcccgctcatcctcta

SEQ ID NO: 75254 - DNA, 36 bp, Artificial Sequence
  Synthetic oligonucleotide
tacgaaggactgaggggggggaacagaagaatagta

SEQ ID NO: 75255 - DNA, 35 bp, Artificial Sequence
  Synthetic oligonucleotide
tcagggcgttgttgccgccgcgttacctgcccgta

SEQ ID NO: 75256 - DNA, 34 bp, Artificial Sequence
  Synthetic oligonucleotide
atggggagcggggcatatcgggtcgtgggaggta

SEQ ID NO: 75257 - DNA, 36 bp, Artificial Sequence
  Synthetic oligonucleotide
aacaccctggggcgtttgggcgtacagtcaagggta

SEQ ID NO: 75258 - DNA, 36 bp, Artificial Sequence
  Synthetic oligonucleotide
gatgcacagcaatctcaaacggtctctctcatggta

SEQ ID NO: 75259 - DNA, 35 bp, Artificial Sequence
  Synthetic oligonucleotide
gttccgatacccgcccgcgatctatcatacactta

SEQ ID NO: 75260 - DNA, 36 bp, Artificial Sequence
  Synthetic oligonucleotide
gtgcgcgatagctcgtccgaacattacaatgcctta

SEQ ID NO: 75261 - DNA, 35 bp, Artificial Sequence
  Synthetic oligonucleotide
agggacacccagccactcgcattgctagcacacac

SEQ ID NO: 75262 - DNA, 35 bp, Artificial Sequence
  Synthetic oligonucleotide
agagcccacctatgctcatttcgatattggcacac

SEQ ID NO: 75263 - DNA, 35 bp, Artificial Sequence
  Synthetic oligonucleotide
aagccgccttcagaagccttccgtccaacctacac

SEQ ID NO: 75264 - DNA, 35 bp, Artificial Sequence
  Synthetic oligonucleotide
tacctcacgaccctagcgatgctcaaatttctgac

SEQ ID NO: 75265 - DNA, 35 bp, Artificial Sequence
  Synthetic oligonucleotide
cctggttcgcacaccaattcggtccgctttgtgac

SEQ ID NO: 75266 - DNA, 35 bp, Artificial Sequence
  Synthetic oligonucleotide
gtttgctcgctttctgctcggtctacagccattac

SEQ ID NO: 75267 - DNA, 35 bp, Artificial Sequence
  Synthetic oligonucleotide
gccacatcctccactccggcctccccgagccttac

SEQ ID NO: 75268 - DNA, 35 bp, Artificial Sequence
  Synthetic oligonucleotide
gagacggtcgtacatcaaatctgatcacgctcacc

SEQ ID NO: 75269 - DNA, 35 bp, Artificial Sequence
  Synthetic oligonucleotide
gttgctggccgtcgtctttattattggctccatcc

SEQ ID NO: 75270 - DNA, 35 bp, Artificial Sequence
  Synthetic oligonucleotide
gtacgctgaagtttcgcatccctcagcctggatcc

SEQ ID NO: 75271 - DNA, 35 bp, Artificial Sequence
  Synthetic oligonucleotide
acaccagcactcaggcacttcctacgccccgctcc

SEQ ID NO: 75272 - DNA, 35 bp, Artificial Sequence
  Synthetic oligonucleotide
gtcctccggagccactaaccttgctatttgtatgc

SEQ ID NO: 75273 - DNA, 35 bp, Artificial Sequence
  Synthetic oligonucleotide
gcctgcctacgcgccaacacatgcgcccacagtgc

SEQ ID NO: 75274 - DNA, 35 bp, Artificial Sequence
  Synthetic oligonucleotide
gcttccactccgccaattagagccatcttgcaatc

SEQ ID NO: 75275 - DNA, 35 bp, Artificial Sequence
  Synthetic oligonucleotide
acgactactcgccttatggatacactctctccatc

SEQ ID NO: 75276 - DNA, 35 bp, Artificial Sequence
  Synthetic oligonucleotide
gaaccttccaccgcccgatgcttggccaacgcatc

SEQ ID NO: 75277 - DNA, 35 bp, Artificial Sequence
  Synthetic oligonucleotide
tttccagttcgcatggttttcgaactagtatcctc

SEQ ID NO: 75278 - DNA, 35 bp, Artificial Sequence
  Synthetic oligonucleotide
ttcgacgtcactgagcacaaaccaacagaacgctc

SEQ ID NO: 75279 - DNA, 35 bp, Artificial Sequence
  Synthetic oligonucleotide
tacgactgctccagttgcaatctgctcaatatctc

SEQ ID NO: 75280 - DNA, 35 bp, Artificial Sequence
  Synthetic oligonucleotide
tccgggcagattcggcctctatctgttctagtctc

SEQ ID NO: 75281 - DNA, 34 bp, Artificial Sequence
  Synthetic oligonucleotide
tgtggtcgcagtcaaaaatcagtgccatatgttc

SEQ ID NO: 75282 - DNA, 35 bp, Artificial Sequence
  Synthetic oligonucleotide
atgacgcgcacctgggcgaattccacctcctgttc

SEQ ID NO: 75283 - DNA, 35 bp, Artificial Sequence
  Synthetic oligonucleotide
gtggtgactccggccaccctctcgatgtcctgttc

SEQ ID NO: 75284 - DNA, 35 bp, Artificial Sequence
  Synthetic oligonucleotide
ccctggacagaccttcaccgtgcccgaactgtttc

SEQ ID NO: 75285 - DNA, 35 bp, Artificial Sequence
  Synthetic oligonucleotide
gtggtgggggaggccgcaacgcgctctgagagaag

SEQ ID NO: 75286 - DNA, 35 bp, Artificial Sequence
  Synthetic oligonucleotide
gacaggcgctcccgaaactaatggccctccttcag

SEQ ID NO: 75287 - DNA, 35 bp, Artificial Sequence
  Synthetic oligonucleotide
acacgccttccatcggttgcttatttttacgttag

SEQ ID NO: 75288 - DNA, 35 bp, Artificial Sequence
  Synthetic oligonucleotide
gaccccctgtcgtacatctcgaataaccgagtacg

SEQ ID NO: 75289 - DNA, 35 bp, Artificial Sequence
  Synthetic oligonucleotide
gaaggaaaggaagggagatacgaagtggagtagcg

SEQ ID NO: 75290 - DNA, 35 bp, Artificial Sequence
  Synthetic oligonucleotide
tgacatacagggagcagagacaacgtaggaagggg

SEQ ID NO: 75291 - DNA, 35 bp, Artificial Sequence
  Synthetic oligonucleotide
gtctcgtgcacactcgtatgcctaccgtgtacatg

SEQ ID NO: 75292 - DNA, 35 bp, Artificial Sequence
  Synthetic oligonucleotide
tctgtgactaccgttcgctactttaacagctgttg

SEQ ID NO: 75293 - DNA, 35 bp, Artificial Sequence
  Synthetic oligonucleotide
gagggtcgtggttgccggaatggaagggaatatat

SEQ ID NO: 75294 - DNA, 35 bp, Artificial Sequence
  Synthetic oligonucleotide
gtcaacctctcccccgaagccatccgagacgttat

SEQ ID NO: 75295 - DNA, 35 bp, Artificial Sequence
  Synthetic oligonucleotide
atttcctgccgccatcgcttactcgaccacttact

SEQ ID NO: 75296 - DNA, 35 bp, Artificial Sequence
  Synthetic oligonucleotide
atcctccccgtcgctccgttttcactagcctgcct

SEQ ID NO: 75297 - DNA, 35 bp, Artificial Sequence
  Synthetic oligonucleotide
tccaccaggtccacttctgccgcccgttcgacgct

SEQ ID NO: 75298 - DNA, 35 bp, Artificial Sequence
  Synthetic oligonucleotide
ggacatccgctatatatacgtgcaaccgcgcctct

SEQ ID NO: 75299 - DNA, 35 bp, Artificial Sequence
  Synthetic oligonucleotide
tctgtgcgacttggcttgggcgggttttctcttct

SEQ ID NO: 75300 - DNA, 35 bp, Artificial Sequence
  Synthetic oligonucleotide
gccctgccggaatgcgccttgcttcgataacatgt

SEQ ID NO: 75301 - DNA, 35 bp, Artificial Sequence
  Synthetic oligonucleotide
tacgactcagcctacagcctggacccatgttattt

SEQ ID NO: 75302 - DNA, 35 bp, Artificial Sequence
  Synthetic oligonucleotide
tgtggcttccggagctcgacatcctgcacctgttt

SEQ ID NO: 75303 - DNA, 36 bp, Artificial Sequence
  Synthetic oligonucleotide
gtcaccctacaacgccggacccagccctccgcaaaa

SEQ ID NO: 75304 - DNA, 36 bp, Artificial Sequence
  Synthetic oligonucleotide
tgtgaagcaagtgggggagttctggtcatgttcaaa

SEQ ID NO: 75305 - DNA, 36 bp, Artificial Sequence
  Synthetic oligonucleotide
gaggggtgagtggcacggaaatgaaattatgggaaa

SEQ ID NO: 75306 - DNA, 36 bp, Artificial Sequence
  Synthetic oligonucleotide
tattgcccgccacttcaatctgcccggtatcttaaa

SEQ ID NO: 75307 - DNA, 35 bp, Artificial Sequence
  Synthetic oligonucleotide
tgacacacaacagttcctcacaaacaggctgtcaa

SEQ ID NO: 75308 - DNA, 35 bp, Artificial Sequence
  Synthetic oligonucleotide
gaaaagtgggttgatagggggaagcagtataggaa

SEQ ID NO: 75309 - DNA, 36 bp, Artificial Sequence
  Synthetic oligonucleotide
tgaggtgccaaccgtcctttatggcaggtatcaaca

SEQ ID NO: 75310 - DNA, 35 bp, Artificial Sequence
  Synthetic oligonucleotide
gttgctattgggcacacactggttctttaagacca

SEQ ID NO: 75311 - DNA, 36 bp, Artificial Sequence
  Synthetic oligonucleotide
tactcgtaacgagtgatcgacctaaccgaaactcca

SEQ ID NO: 75312 - DNA, 36 bp, Artificial Sequence
  Synthetic oligonucleotide
gcatccgcatatatgcttatgaatgccatgcttcca

SEQ ID NO: 75313 - DNA, 35 bp, Artificial Sequence
  Synthetic oligonucleotide
tagacgcgcgcaaccttcactctacaactatagca

SEQ ID NO: 75314 - DNA, 36 bp, Artificial Sequence
  Synthetic oligonucleotide
gccacgcctcaagacgcttagcccactgccaaggca

SEQ ID NO: 75315 - DNA, 36 bp, Artificial Sequence
  Synthetic oligonucleotide
ttcatcgtccaccctgctccagccgtaaagcgtgca

SEQ ID NO: 75316 - DNA, 35 bp, Artificial Sequence
  Synthetic oligonucleotide
agcaaattggagaatggggtggaaaaccggagtca

SEQ ID NO: 75317 - DNA, 36 bp, Artificial Sequence
  Synthetic oligonucleotide
gaaccgcagggctgggaatggtgatgggggaggtca

SEQ ID NO: 75318 - DNA, 36 bp, Artificial Sequence
  Synthetic oligonucleotide
tcccgcctcaagtactttatttcgaaagacccttca

SEQ ID NO: 75319 - DNA, 35 bp, Artificial Sequence
  Synthetic oligonucleotide
accacacaccggcgaaagtgcgcatggcatcttca

SEQ ID NO: 75320 - DNA, 37 bp, Artificial Sequence
  Synthetic oligonucleotide
gtcactcgcattccgttagccaaggtttcttcacaga

SEQ ID NO: 75321 - DNA, 36 bp, Artificial Sequence
  Synthetic oligonucleotide
atcccgatccatgtcctgccacgtgcaatatacaga

SEQ ID NO: 75322 - DNA, 35 bp, Artificial Sequence
  Synthetic oligonucleotide
gtggtcccgtctgcccattgcccgcctattccaga

SEQ ID NO: 75323 - DNA, 37 bp, Artificial Sequence
  Synthetic oligonucleotide
tacctgggctcctctgtctctccgcctcgtatcgaga

SEQ ID NO: 75324 - DNA, 37 bp, Artificial Sequence
  Synthetic oligonucleotide
tgtgtgttgagctcgggaggtggggcggagggtgaga

SEQ ID NO: 75325 - DNA, 36 bp, Artificial Sequence
  Synthetic oligonucleotide
tacgctccacagcgggggacaattacggtttcacga

SEQ ID NO: 75326 - DNA, 37 bp, Artificial Sequence
  Synthetic oligonucleotide
tccaccgctttgttgtgacctccgcaaggctcaccga

SEQ ID NO: 75327 - DNA, 37 bp, Artificial Sequence
  Synthetic oligonucleotide
tgagggggagggccgggtatggcgcagggtggaccga

SEQ ID NO: 75328 - DNA, 37 bp, Artificial Sequence
  Synthetic oligonucleotide
tgctctcgcttgttcctgttgcgcctactccacccga

SEQ ID NO: 75329 - DNA, 37 bp, Artificial Sequence
  Synthetic oligonucleotide
acccaacctagtgcgatccggcggctttcccccccga

SEQ ID NO: 75330 - DNA, 37 bp, Artificial Sequence
  Synthetic oligonucleotide
accgcaaacgtctcccgaacgcttcatacattgccga

SEQ ID NO: 75331 - DNA, 37 bp, Artificial Sequence
  Synthetic oligonucleotide
acgctagtacccagttgccttttgtaacaacatccga

SEQ ID NO: 75332 - DNA, 36 bp, Artificial Sequence
  Synthetic oligonucleotide
acagaggaagtgggggaggtggcagagcagcatcga

SEQ ID NO: 75333 - DNA, 37 bp, Artificial Sequence
  Synthetic oligonucleotide
tcacgcagaaggagcgttgtagagggagagaaaagga

SEQ ID NO: 75334 - DNA, 37 bp, Artificial Sequence
  Synthetic oligonucleotide
gacacaccagagctctgcagcacccttctcacaagga

SEQ ID NO: 75335 - DNA, 37 bp, Artificial Sequence
  Synthetic oligonucleotide
gcaaagggcgatttggttaagggtggggctgctagga

SEQ ID NO: 75336 - DNA, 35 bp, Artificial Sequence
  Synthetic oligonucleotide
tgaaccagccaccctgtatcaattgctcgaacgga

SEQ ID NO: 75337 - DNA, 37 bp, Artificial Sequence
  Synthetic oligonucleotide
gtgtcgaacccccctgcgccttgtccgctttctcgga

SEQ ID NO: 75338 - DNA, 37 bp, Artificial Sequence
  Synthetic oligonucleotide
gtgcaagggtagggaagggttaagagttgcggaggga

SEQ ID NO: 75339 - DNA, 37 bp, Artificial Sequence
  Synthetic oligonucleotide
atgcgagtgggcaagggaatgtcatcgaagggaggga

SEQ ID NO: 75340 - DNA, 37 bp, Artificial Sequence
  Synthetic oligonucleotide
gaccggaaaaattggggaagtacggtgttcctgggga

SEQ ID NO: 75341 - DNA, 37 bp, Artificial Sequence
  Synthetic oligonucleotide
gtggtcagaaagggaatcagggcgcaggggctgggga

SEQ ID NO: 75342 - DNA, 37 bp, Artificial Sequence
  Synthetic oligonucleotide
accaacggagggggttgcatggtgatgtaagtatgga

SEQ ID NO: 75343 - DNA, 37 bp, Artificial Sequence
  Synthetic oligonucleotide
tgaagacagcaccgatccgcgcctccatgcacctgga

SEQ ID NO: 75344 - DNA, 37 bp, Artificial Sequence
  Synthetic oligonucleotide
accatggacccgtacgcgcacgaccataccgcctgga

SEQ ID NO: 75345 - DNA, 38 bp, Artificial Sequence
  Synthetic oligonucleotide
aacattggggaggaggggcctgggggagttgtaaatga

SEQ ID NO: 75346 - DNA, 38 bp, Artificial Sequence
  Synthetic oligonucleotide
atgtctggccccctgataattgccgttcggtcgaatga

SEQ ID NO: 75347 - DNA, 37 bp, Artificial Sequence
  Synthetic oligonucleotide
aaggacgacacgaagtgagaatggtgtgagtgtatga

SEQ ID NO: 75348 - DNA, 38 bp, Artificial Sequence
  Synthetic oligonucleotide
gccggccacctgttgcctcttgcgtactccattactga

SEQ ID NO: 75349 - DNA, 37 bp, Artificial Sequence
  Synthetic oligonucleotide
gatcctccagactcacccttgttctttacggacctga

SEQ ID NO: 75350 - DNA, 38 bp, Artificial Sequence
  Synthetic oligonucleotide
tcctagtccacgccccccgcctcagagtctaaccctga

SEQ ID NO: 75351 - DNA, 38 bp, Artificial Sequence
  Synthetic oligonucleotide
tcacgctacctcacgccgtgcaaaacactgactcctga

SEQ ID NO: 75352 - DNA, 38 bp, Artificial Sequence
  Synthetic oligonucleotide
gaacccacacatctatatcgtactgtagtttgtcctga

SEQ ID NO: 75353 - DNA, 38 bp, Artificial Sequence
  Synthetic oligonucleotide
gactgtcattgggtccctgcgcattttctatttcctga

SEQ ID NO: 75354 - DNA, 38 bp, Artificial Sequence
  Synthetic oligonucleotide
accaccctcatcctataggacctagacttctaggctga

SEQ ID NO: 75355 - DNA, 37 bp, Artificial Sequence
  Synthetic oligonucleotide
gcaccttaaggagctaacaatcactccaccatgctga

SEQ ID NO: 75356 - DNA, 38 bp, Artificial Sequence
  Synthetic oligonucleotide
gctgacttcagtcatgggatggggtggagggctgctga

SEQ ID NO: 75357 - DNA, 38 bp, Artificial Sequence
  Synthetic oligonucleotide
actcgaccgcaccgaatacttccccggcgccttgctga

SEQ ID NO: 75358 - DNA, 38 bp, Artificial Sequence
  Synthetic oligonucleotide
gttcaagtgggggtgacctcggaggcagaaaatagtga

SEQ ID NO: 75359 - DNA, 38 bp, Artificial Sequence
  Synthetic oligonucleotide
agtactgggaaacatggggggcaagaagaagaccgtga

SEQ ID NO: 75360 - DNA, 38 bp, Artificial Sequence
  Synthetic oligonucleotide
aagcccctcctcctgcgtgcgaccgcacgatatcgtga

SEQ ID NO: 75361 - DNA, 38 bp, Artificial Sequence
  Synthetic oligonucleotide
gagatcaagtgatgggaaggaacgggggtcgctggtga

SEQ ID NO: 75362 - DNA, 38 bp, Artificial Sequence
  Synthetic oligonucleotide
ggatgtcagaaagggggcaagggatgaatgagtattga

SEQ ID NO: 75363 - DNA, 38 bp, Artificial Sequence
  Synthetic oligonucleotide
gcctcggtgcacaaagtgaatcgccatataccccttga

SEQ ID NO: 75364 - DNA, 38 bp, Artificial Sequence
  Synthetic oligonucleotide
aaacacgcacgcagacggaaggacccaccgcaatttga

SEQ ID NO: 75365 - DNA, 37 bp, Artificial Sequence
  Synthetic oligonucleotide
ttcgcacctcatacgtcgttagtaagccccgatttga

SEQ ID NO: 75366 - DNA, 38 bp, Artificial Sequence
  Synthetic oligonucleotide
tatggtggcatcctgcgttatactcctccgtactttga

SEQ ID NO: 75367 - DNA, 38 bp, Artificial Sequence
  Synthetic oligonucleotide
atgttggaggagtggggagtgaggcctttggagtttga

SEQ ID NO: 75368 - DNA, 36 bp, Artificial Sequence
  Synthetic oligonucleotide
ggggtgggtgagcgggtagaataattatggggaata

SEQ ID NO: 75369 - DNA, 36 bp, Artificial Sequence
  Synthetic oligonucleotide
gacatacacggagttgatcgacctggcctcggacta

SEQ ID NO: 75370 - DNA, 36 bp, Artificial Sequence
  Synthetic oligonucleotide
accacggagaacgggcttatcaagacccaccaccta

SEQ ID NO: 75371 - DNA, 36 bp, Artificial Sequence
  Synthetic oligonucleotide
tagacccacgtctaccccacactgttccgttaccta

SEQ ID NO: 75372 - DNA, 36 bp, Artificial Sequence
  Synthetic oligonucleotide
agccatacatcgatgccctaccacacgtagctgcta

SEQ ID NO: 75373 - DNA, 36 bp, Artificial Sequence
  Synthetic oligonucleotide
atcgagggtagggaaagggcttgagctggggagtta

SEQ ID NO: 75374 - DNA, 36 bp, Artificial Sequence
  Synthetic oligonucleotide
tgcacctacatcgcgcatgggggcccacgcatttta

SEQ ID NO: 75375 - DNA, 35 bp, Artificial Sequence
  Synthetic oligonucleotide
gcggggcgggtttgggcgggcataccccactttta

SEQ ID NO: 75376 - DNA, 35 bp, Artificial Sequence
  Synthetic oligonucleotide
gtgcactcgaacagccgccccgaccctccgtttta

SEQ ID NO: 75377 - DNA, 36 bp, Artificial Sequence
  Synthetic oligonucleotide
agcctcccactgtatttctggtcgaacccgttttta

SEQ ID NO: 75378 - DNA, 36 bp, Artificial Sequence
  Synthetic oligonucleotide
tcactgacacctcgatgacgtgttgtacaataccac

SEQ ID NO: 75379 - DNA, 35 bp, Artificial Sequence
  Synthetic oligonucleotide
ttgcgtaccatctgtactccgcccgtaagttccac

SEQ ID NO: 75380 - DNA, 35 bp, Artificial Sequence
  Synthetic oligonucleotide
atgccccgccaccactttctggcctactgttccac

SEQ ID NO: 75381 - DNA, 35 bp, Artificial Sequence
  Synthetic oligonucleotide
tatcaatccagggctaaacaccaggcaggcaatac

SEQ ID NO: 75382 - DNA, 35 bp, Artificial Sequence
  Synthetic oligonucleotide
gccacggaccacacgctggtctatatcaggtctac

SEQ ID NO: 75383 - DNA, 35 bp, Artificial Sequence
  Synthetic oligonucleotide
tactccggtgccggtcctcgtggacatccgcttac

SEQ ID NO: 75384 - DNA, 35 bp, Artificial Sequence
  Synthetic oligonucleotide
accactacggaagatgtggctaaggcggtagttac

SEQ ID NO: 75385 - DNA, 35 bp, Artificial Sequence
  Synthetic oligonucleotide
tgccacctggggtcacagagcaccgtgtcccaacc

SEQ ID NO: 75386 - DNA, 36 bp, Artificial Sequence
  Synthetic oligonucleotide
agagcccgtgcacgcttgccgttgattgcccccacc

SEQ ID NO: 75387 - DNA, 35 bp, Artificial Sequence
  Synthetic oligonucleotide
acgcccaccccccaaagccacgcttggacgtgacc

SEQ ID NO: 75388 - DNA, 35 bp, Artificial Sequence
  Synthetic oligonucleotide
tgccgcagatcgccctcttaaccccgtgccactcc

SEQ ID NO: 75389 - DNA, 35 bp, Artificial Sequence
  Synthetic oligonucleotide
tgaccgtagcgagcgctattaaaacacctttgtcc

SEQ ID NO: 75390 - DNA, 35 bp, Artificial Sequence
  Synthetic oligonucleotide
actgacacccctcctccgcacgcttagtctgttcc

SEQ ID NO: 75391 - DNA, 35 bp, Artificial Sequence
  Synthetic oligonucleotide
ggaccggcaggctccatttttcagtcgctttttgc

SEQ ID NO: 75392 - DNA, 35 bp, Artificial Sequence
  Synthetic oligonucleotide
tcccgcctacgccagttacgtccctctgtccactc

SEQ ID NO: 75393 - DNA, 35 bp, Artificial Sequence
  Synthetic oligonucleotide
tcacactgtaatcaataccgtgttttcaagccctc

SEQ ID NO: 75394 - DNA, 35 bp, Artificial Sequence
  Synthetic oligonucleotide
gacgggatcactctctctccatcgtggtcaatctc

SEQ ID NO: 75395 - DNA, 35 bp, Artificial Sequence
  Synthetic oligonucleotide
gatgcgatcaccgggatgggtgcagtctcgccgtc

SEQ ID NO: 75396 - DNA, 35 bp, Artificial Sequence
  Synthetic oligonucleotide
tccacaccaaacacaaagtgttcctaaccccggtc

SEQ ID NO: 75397 - DNA, 34 bp, Artificial Sequence
  Synthetic oligonucleotide
tgatgggctcacatggaattatcgcacctggttc

SEQ ID NO: 75398 - DNA, 34 bp, Artificial Sequence
  Synthetic oligonucleotide
atttgacgagcggggttcggcgcctcttcgtttc

SEQ ID NO: 75399 - DNA, 35 bp, Artificial Sequence
  Synthetic oligonucleotide
tcccctcgcgggtacaatacgcaccatctatatag

SEQ ID NO: 75400 - DNA, 35 bp, Artificial Sequence
  Synthetic oligonucleotide
acttgccacctgctcctgttaagttgagactctag

SEQ ID NO: 75401 - DNA, 35 bp, Artificial Sequence
  Synthetic oligonucleotide
gacacctccaggtggttttgccgcacacggtaacg

SEQ ID NO: 75402 - DNA, 35 bp, Artificial Sequence
  Synthetic oligonucleotide
gccctatcctacacatcgatactcgtccgcctacg

SEQ ID NO: 75403 - DNA, 35 bp, Artificial Sequence
  Synthetic oligonucleotide
tctcatcatagtgcactcatagctctttaccatcg

SEQ ID NO: 75404 - DNA, 35 bp, Artificial Sequence
  Synthetic oligonucleotide
tagcgcctcgttctatattctaccttccgacgtcg

SEQ ID NO: 75405 - DNA, 35 bp, Artificial Sequence
  Synthetic oligonucleotide
tatgtgtggaattggaagtaagtgaggcgagccgg

SEQ ID NO: 75406 - DNA, 35 bp, Artificial Sequence
  Synthetic oligonucleotide
aatgcgcgaggggtgggcagagtcgtgggactggg

SEQ ID NO: 75407 - DNA, 35 bp, Artificial Sequence
  Synthetic oligonucleotide
gtatccccaccctgcctactctctatggtatgtgg

SEQ ID NO: 75408 - DNA, 35 bp, Artificial Sequence
  Synthetic oligonucleotide
gtggtggagcacaaaggttcgtgcgtggttttctg

SEQ ID NO: 75409 - DNA, 35 bp, Artificial Sequence
  Synthetic oligonucleotide
gaacgggacgatgcctagcaagaggatggaagttg

SEQ ID NO: 75410 - DNA, 35 bp, Artificial Sequence
  Synthetic oligonucleotide
aacgtgagacctaaatgggggtaggggtggggcat

SEQ ID NO: 75411 - DNA, 36 bp, Artificial Sequence
  Synthetic oligonucleotide
tcggacaactccacccgttgcttgtttggcacctat

SEQ ID NO: 75412 - DNA, 35 bp, Artificial Sequence
  Synthetic oligonucleotide
ttgatcgcagtgttaccgcccgtttcctcccgtat

SEQ ID NO: 75413 - DNA, 35 bp, Artificial Sequence
  Synthetic oligonucleotide
tccccctagtgtgcttccattttgttcaagtttat

SEQ ID NO: 75414 - DNA, 35 bp, Artificial Sequence
  Synthetic oligonucleotide
ataaccggtcaatggcacctacaacttgtcgcact

SEQ ID NO: 75415 - DNA, 35 bp, Artificial Sequence
  Synthetic oligonucleotide
tccccacctaacagtagatttaatggtcataacct

SEQ ID NO: 75416 - DNA, 35 bp, Artificial Sequence
  Synthetic oligonucleotide
tcctgtcctaaagtcctcactgacgagggccccct

SEQ ID NO: 75417 - DNA, 35 bp, Artificial Sequence
  Synthetic oligonucleotide
gtcacgcaagttctttacgggtttttctcttcgct

SEQ ID NO: 75418 - DNA, 35 bp, Artificial Sequence
  Synthetic oligonucleotide
tcccatccctctttccaggcttgacttacaatggt

SEQ ID NO: 75419 - DNA, 35 bp, Artificial Sequence
  Synthetic oligonucleotide
agcatacggagatcccatccacctacatcctgtgt

SEQ ID NO: 75420 - DNA, 35 bp, Artificial Sequence
  Synthetic oligonucleotide
atgaacgatactgctcctaggttcctgggttcctt

SEQ ID NO: 75421 - DNA, 35 bp, Artificial Sequence
  Synthetic oligonucleotide
ttgactctacaacccgatgacgctattgctggctt

SEQ ID NO: 75422 - DNA, 35 bp, Artificial Sequence
  Synthetic oligonucleotide
tccactctctccagtacttgtcacagctccgcttt

SEQ ID NO: 75423 - DNA, 36 bp, Artificial Sequence
  Synthetic oligonucleotide
ttacatcacactgtgcaaaacggctctatcctcaaa

SEQ ID NO: 75424 - DNA, 35 bp, Artificial Sequence
  Synthetic oligonucleotide
actgatgtgcggctcagaaaggggggtaggggaaa

SEQ ID NO: 75425 - DNA, 36 bp, Artificial Sequence
  Synthetic oligonucleotide
gttgggagagggggggtggaaggttctataaagcaa

SEQ ID NO: 75426 - DNA, 35 bp, Artificial Sequence
  Synthetic oligonucleotide
atcacaaccgcggttgcaaataatcaggggaagaa

SEQ ID NO: 75427 - DNA, 36 bp, Artificial Sequence
  Synthetic oligonucleotide
aacggtccacctcccgcccattgtatgaaattggaa

SEQ ID NO: 75428 - DNA, 35 bp, Artificial Sequence
  Synthetic oligonucleotide
agatagccagtgctgtccatattttcacgccgtaa

SEQ ID NO: 75429 - DNA, 35 bp, Artificial Sequence
  Synthetic oligonucleotide
gatgcgcgcttggcatccttccggccatttgttaa

SEQ ID NO: 75430 - DNA, 35 bp, Artificial Sequence
  Synthetic oligonucleotide
gagatggaattgaaggcatgatgagctcagtttaa

SEQ ID NO: 75431 - DNA, 35 bp, Artificial Sequence
  Synthetic oligonucleotide
gatgctacagcctgtccggcctcttctggcacaca

SEQ ID NO: 75432 - DNA, 35 bp, Artificial Sequence
  Synthetic oligonucleotide
acctgggccctctaatgccttaatgatcgcataca

SEQ ID NO: 75433 - DNA, 36 bp, Artificial Sequence
  Synthetic oligonucleotide
acgaccctccatccgttgcgacacactgtccaccca

SEQ ID NO: 75434 - DNA, 35 bp, Artificial Sequence
  Synthetic oligonucleotide
tagaccccagtgcgggtccatgttaaagcttgcca

SEQ ID NO: 75435 - DNA, 36 bp, Artificial Sequence
  Synthetic oligonucleotide
tcaggtgtacgcatattgcctttctacgatcttcca

SEQ ID NO: 75436 - DNA, 36 bp, Artificial Sequence
  Synthetic oligonucleotide
agttacctcccgtgcctagatctgactagcttatca

SEQ ID NO: 75437 - DNA, 36 bp, Artificial Sequence
  Synthetic oligonucleotide
gtgtcccttccgcacctgtatcttgtcgtgaccaga

SEQ ID NO: 75438 - DNA, 36 bp, Artificial Sequence
  Synthetic oligonucleotide
tccatgtcccggtgatcctactgagtgagtcggaga

SEQ ID NO: 75439 - DNA, 37 bp, Artificial Sequence
  Synthetic oligonucleotide
tagtgcaggcgaccaataagaagcaggtaagtggaga

SEQ ID NO: 75440 - DNA, 37 bp, Artificial Sequence
  Synthetic oligonucleotide
gaccatcatgcacatgcgcatcacccgccccatgaga

SEQ ID NO: 75441 - DNA, 37 bp, Artificial Sequence
  Synthetic oligonucleotide
gaccagggtataggaggggaggggttttgcagtgaga

SEQ ID NO: 75442 - DNA, 35 bp, Artificial Sequence
  Synthetic oligonucleotide
tgtagggggaaacgggggccgaggctctagtacga

SEQ ID NO: 75443 - DNA, 37 bp, Artificial Sequence
  Synthetic oligonucleotide
acaccgcccacccagccctcagtgtcgggtagtacga

SEQ ID NO: 75444 - DNA, 37 bp, Artificial Sequence
  Synthetic oligonucleotide
gttgaaccgcgagattatgctatttactctacaccga

SEQ ID NO: 75445 - DNA, 37 bp, Artificial Sequence
  Synthetic oligonucleotide
agtcccaagcccggatcagatcttctcgctccaccga

SEQ ID NO: 75446 - DNA, 37 bp, Artificial Sequence
  Synthetic oligonucleotide
gcacccacgcgttccttttcttctcgtcttttaccga

SEQ ID NO: 75447 - DNA, 37 bp, Artificial Sequence
  Synthetic oligonucleotide
gcacgatcgatcgatcatacctgggtgtcctctccga

SEQ ID NO: 75448 - DNA, 37 bp, Artificial Sequence
  Synthetic oligonucleotide
ggtgaggagttcgataacaaaagggataggtaggcga

SEQ ID NO: 75449 - DNA, 36 bp, Artificial Sequence
  Synthetic oligonucleotide
ttctgcctcgcgagttcccacaatgcatcactgcga

SEQ ID NO: 75450 - DNA, 36 bp, Artificial Sequence
  Synthetic oligonucleotide
ccttagcactcgttgttcttgttattacccttgcga

SEQ ID NO: 75451 - DNA, 37 bp, Artificial Sequence
  Synthetic oligonucleotide
gatcacgcgctatttggcctcacagaatcttcatcga

SEQ ID NO: 75452 - DNA, 37 bp, Artificial Sequence
  Synthetic oligonucleotide
tagcctgccagaccgttctgttattcaccctgttcga

SEQ ID NO: 75453 - DNA, 36 bp, Artificial Sequence
  Synthetic oligonucleotide
gtcaaggaattattgtggataggcgggagggaagga

SEQ ID NO: 75454 - DNA, 35 bp, Artificial Sequence
  Synthetic oligonucleotide
aactagaccggggctgtcgtctgcctactccagga

SEQ ID NO: 75455 - DNA, 37 bp, Artificial Sequence
  Synthetic oligonucleotide
tttgaccctgctacttgccagtacctaccccttagga

SEQ ID NO: 75456 - DNA, 37 bp, Artificial Sequence
  Synthetic oligonucleotide
aacgacctgagccgatatctctaacaggcagaacgga

SEQ ID NO: 75457 - DNA, 37 bp, Artificial Sequence
  Synthetic oligonucleotide
gtgcccacaaccaaatcttcatgctccgttacacgga

SEQ ID NO: 75458 - DNA, 37 bp, Artificial Sequence
  Synthetic oligonucleotide
tgagcatgaggtgctgtgtgagagtgattgacgcgga

SEQ ID NO: 75459 - DNA, 37 bp, Artificial Sequence
  Synthetic oligonucleotide
tcatccccgaaacttgcccccaactccctagtaggga

SEQ ID NO: 75460 - DNA, 37 bp, Artificial Sequence
  Synthetic oligonucleotide
tccggagagggacgaacgtacgggactgagaaatgga

SEQ ID NO: 75461 - DNA, 37 bp, Artificial Sequence
  Synthetic oligonucleotide
aacggggccacccccctctctatgaactccccatgga

SEQ ID NO: 75462 - DNA, 36 bp, Artificial Sequence
  Synthetic oligonucleotide
gttcacactccccatatgacagaatcgcgcgatgga

SEQ ID NO: 75463 - DNA, 37 bp, Artificial Sequence
  Synthetic oligonucleotide
gaagttcggatgtagggcgggcaaattggggggtgga

SEQ ID NO: 75464 - DNA, 37 bp, Artificial Sequence
  Synthetic oligonucleotide
aatgggcgaggtaatcggttcgttgaagggtggtgga

SEQ ID NO: 75465 - DNA, 38 bp, Artificial Sequence
  Synthetic oligonucleotide
acacatcctataactctgcacactgccgcccgcaatga

SEQ ID NO: 75466 - DNA, 38 bp, Artificial Sequence
  Synthetic oligonucleotide
tcacgtggcgcaatacaggcgaaggagggggagaatga

SEQ ID NO: 75467 - DNA, 38 bp, Artificial Sequence
  Synthetic oligonucleotide
tctcacctgccctgtccatgcatatcagtttcttatga

SEQ ID NO: 75468 - DNA, 37 bp, Artificial Sequence
  Synthetic oligonucleotide
ttgagagctacgctgtctttttactaccaccacctga

SEQ ID NO: 75469 - DNA, 37 bp, Artificial Sequence
  Synthetic oligonucleotide
acacacaaccgtctgtaaatcctgaggccctgcctga

SEQ ID NO: 75470 - DNA, 37 bp, Artificial Sequence
  Synthetic oligonucleotide
tacgccgaactgtagaaagactaaggaaaagggctga

SEQ ID NO: 75471 - DNA, 38 bp, Artificial Sequence
  Synthetic oligonucleotide
ttcacacctcctatgtagctgtagccttccttggctga

SEQ ID NO: 75472 - DNA, 37 bp, Artificial Sequence
  Synthetic oligonucleotide
acgaagaggtaaaggcgttttatgaagggcgaagtga

SEQ ID NO: 75473 - DNA, 35 bp, Artificial Sequence
  Synthetic oligonucleotide
caccacctccctccttcatcacgactggcccgtga

SEQ ID NO: 75474 - DNA, 38 bp, Artificial Sequence
  Synthetic oligonucleotide
gaacccacctgtcgcgtgctgcacgtctcccacggtga

SEQ ID NO: 75475 - DNA, 38 bp, Artificial Sequence
  Synthetic oligonucleotide
tgcaacgggtgggcgcatattggagtgatccttggtga

SEQ ID NO: 75476 - DNA, 37 bp, Artificial Sequence
  Synthetic oligonucleotide
tgtgaaggtaaaggttggacgcgggagggacttgtga

SEQ ID NO: 75477 - DNA, 38 bp, Artificial Sequence
  Synthetic oligonucleotide
aatcgtccacgcgacccccgaactgcctgactaattga

SEQ ID NO: 75478 - DNA, 37 bp, Artificial Sequence
  Synthetic oligonucleotide
gaggggtgggatcctggcgtgagggaaggcaccttga

SEQ ID NO: 75479 - DNA, 38 bp, Artificial Sequence
  Synthetic oligonucleotide
tgcctggtcgtcaccgccggctttattcttcaccttga

SEQ ID NO: 75480 - DNA, 38 bp, Artificial Sequence
  Synthetic oligonucleotide
agcttacacgcgcacattcaactactgcctcctcttga

SEQ ID NO: 75481 - DNA, 38 bp, Artificial Sequence
  Synthetic oligonucleotide
tgaaagcagacttgcgcgtactgccgacacttatttga

SEQ ID NO: 75482 - DNA, 37 bp, Artificial Sequence
  Synthetic oligonucleotide
gtgcaacgctgcgaatttaaggtacgcattagtttga

SEQ ID NO: 75483 - DNA, 36 bp, Artificial Sequence
  Synthetic oligonucleotide
ataccccagaccgggaatgtgggtgccccgtaacta

SEQ ID NO: 75484 - DNA, 36 bp, Artificial Sequence
  Synthetic oligonucleotide
tcaccccccggcaaatagtgacagtgctacccacta

SEQ ID NO: 75485 - DNA, 35 bp, Artificial Sequence
  Synthetic oligonucleotide
tacaaccccccagtggcatcttaatgactgaccta

SEQ ID NO: 75486 - DNA, 36 bp, Artificial Sequence
  Synthetic oligonucleotide
tacgccactttggcgaatcacgacaacaccttggta

SEQ ID NO: 75487 - DNA, 36 bp, Artificial Sequence
  Synthetic oligonucleotide
tagggcgagaccgaggaggaatagtgtgaggttgta

SEQ ID NO: 75488 - DNA, 36 bp, Artificial Sequence
  Synthetic oligonucleotide
taatgacaaaccccgcccgtacactctgccgtatta

SEQ ID NO: 75489 - DNA, 36 bp, Artificial Sequence
  Synthetic oligonucleotide
accgctgtcctcatgactccttacgtctagcgctta

SEQ ID NO: 75490 - DNA, 36 bp, Artificial Sequence
  Synthetic oligonucleotide
gccgaactgactcgtacttcgatcccttgaatctta

SEQ ID NO: 75491 - DNA, 34 bp, Artificial Sequence
  Synthetic oligonucleotide
ttaaccgttctccgcgcccatgtgcgccacacac

SEQ ID NO: 75492 - DNA, 35 bp, Artificial Sequence
  Synthetic oligonucleotide
tccatctggcggtaaatgctaaccgtctacctcac

SEQ ID NO: 75493 - DNA, 35 bp, Artificial Sequence
  Synthetic oligonucleotide
atccactcccctgccatacggttacagtcccggac

SEQ ID NO: 75494 - DNA, 35 bp, Artificial Sequence
  Synthetic oligonucleotide
ttgcgagtgcatcctgcaagccactggcctaatac

SEQ ID NO: 75495 - DNA, 35 bp, Artificial Sequence
  Synthetic oligonucleotide
gtgggtaactgccaatgcttcgccccttaatatac

SEQ ID NO: 75496 - DNA, 35 bp, Artificial Sequence
  Synthetic oligonucleotide
ttcgagaacatgccatcaagccggcttccatctac

SEQ ID NO: 75497 - DNA, 35 bp, Artificial Sequence
  Synthetic oligonucleotide
ttgactcgacagataagcctcagccgcgctatacc

SEQ ID NO: 75498 - DNA, 35 bp, Artificial Sequence
  Synthetic oligonucleotide
gccatgtaggccggtacgatattgcccattgcgcc

SEQ ID NO: 75499 - DNA, 35 bp, Artificial Sequence
  Synthetic oligonucleotide
tagtgaggtgcgtcatttttcgccgtgttcgctcc

SEQ ID NO: 75500 - DNA, 35 bp, Artificial Sequence
  Synthetic oligonucleotide
ggacaggatagccgtaatattaccccctccgacgc

SEQ ID NO: 75501 - DNA, 35 bp, Artificial Sequence
  Synthetic oligonucleotide
gccggccttagcattgttttcctcggtcctttcgc

SEQ ID NO: 75502 - DNA, 35 bp, Artificial Sequence
  Synthetic oligonucleotide
agcacccaggggatacccgcctccctcgcaaatgc

SEQ ID NO: 75503 - DNA, 35 bp, Artificial Sequence
  Synthetic oligonucleotide
acttcgcgaaccaatactctccttttgcgaacatc

SEQ ID NO: 75504 - DNA, 35 bp, Artificial Sequence
  Synthetic oligonucleotide
tgctccaccgcacctgatagttccttttccccatc

SEQ ID NO: 75505 - DNA, 36 bp, Artificial Sequence
  Synthetic oligonucleotide
acactatcgactctagctgggcttatcatacttatc

SEQ ID NO: 75506 - DNA, 35 bp, Artificial Sequence
  Synthetic oligonucleotide
tgcgcccggagtttaccagtgttcctcctctactc

SEQ ID NO: 75507 - DNA, 35 bp, Artificial Sequence
  Synthetic oligonucleotide
aatgaagaagtaatcggggaaaggggggacaggtc

SEQ ID NO: 75508 - DNA, 35 bp, Artificial Sequence
  Synthetic oligonucleotide
gggggagagtacatgcaaggcgagggggaggggtc

SEQ ID NO: 75509 - DNA, 35 bp, Artificial Sequence
  Synthetic oligonucleotide
accccccccatgatgaatagcccacggttcccttc

SEQ ID NO: 75510 - DNA, 35 bp, Artificial Sequence
  Synthetic oligonucleotide
gtaatcacacgtacgacgcccgggtttaccagttc

SEQ ID NO: 75511 - DNA, 35 bp, Artificial Sequence
  Synthetic oligonucleotide
ggtggggtagggcactgaatatacaggcaagcaag

SEQ ID NO: 75512 - DNA, 35 bp, Artificial Sequence
  Synthetic oligonucleotide
gaccaattcgcccttgttcttgttgtctccctaag

SEQ ID NO: 75513 - DNA, 35 bp, Artificial Sequence
  Synthetic oligonucleotide
tctccctgcagagcacaaagtccgctttacctacg

SEQ ID NO: 75514 - DNA, 35 bp, Artificial Sequence
  Synthetic oligonucleotide
ttcacccccgaagcctaccacgccctcccgcatgg

SEQ ID NO: 75515 - DNA, 35 bp, Artificial Sequence
  Synthetic oligonucleotide
ggacaactacccgtttgctccggccctaaatttgg

SEQ ID NO: 75516 - DNA, 35 bp, Artificial Sequence
  Synthetic oligonucleotide
gaccggggatggggcaaatgcaaggggatattgtg

SEQ ID NO: 75517 - DNA, 36 bp, Artificial Sequence
  Synthetic oligonucleotide
atggccggagagttcacatttcacacctaacctttg

SEQ ID NO: 75518 - DNA, 35 bp, Artificial Sequence
  Synthetic oligonucleotide
ggaacggacgcagggttgggggtttaaagggtttg

SEQ ID NO: 75519 - DNA, 35 bp, Artificial Sequence
  Synthetic oligonucleotide
taagcccacctcggttcgcccgtttcccagtttat

SEQ ID NO: 75520 - DNA, 35 bp, Artificial Sequence
  Synthetic oligonucleotide
aatcccgcttcgtagtagtccgccaccaaacccct

SEQ ID NO: 75521 - DNA, 35 bp, Artificial Sequence
  Synthetic oligonucleotide
gctattaccgctagcactgtgatgctcccgcccct

SEQ ID NO: 75522 - DNA, 35 bp, Artificial Sequence
  Synthetic oligonucleotide
accttgtctgcgtcaacttccctacccatgcccct

SEQ ID NO: 75523 - DNA, 35 bp, Artificial Sequence
  Synthetic oligonucleotide
gtgtacccgcactatattcgttcaaggcctcccct

SEQ ID NO: 75524 - DNA, 35 bp, Artificial Sequence
  Synthetic oligonucleotide
gcccagtgcccacaacacaagccgattcgcatgct

SEQ ID NO: 75525 - DNA, 35 bp, Artificial Sequence
  Synthetic oligonucleotide
agtagctcccgggtcttggctcatctaatcttgct

SEQ ID NO: 75526 - DNA, 35 bp, Artificial Sequence
  Synthetic oligonucleotide
tacatgaccaaggatacggggggggaggagttcgt

SEQ ID NO: 75527 - DNA, 35 bp, Artificial Sequence
  Synthetic oligonucleotide
gataggtcaggtgctgggctgggtttgagggaggt

SEQ ID NO: 75528 - DNA, 35 bp, Artificial Sequence
  Synthetic oligonucleotide
gtgggagtaggaaggtaagttataattgatgaggt

SEQ ID NO: 75529 - DNA, 35 bp, Artificial Sequence
  Synthetic oligonucleotide
atttgcctagccttccgaaatacgcttttctctgt

SEQ ID NO: 75530 - DNA, 35 bp, Artificial Sequence
  Synthetic oligonucleotide
gcgtttcgccaccattcacgactttcgatgccatt

SEQ ID NO: 75531 - DNA, 35 bp, Artificial Sequence
  Synthetic oligonucleotide
tcacgccaggcactgaacgaatggctgtaaatatt

SEQ ID NO: 75532 - DNA, 35 bp, Artificial Sequence
  Synthetic oligonucleotide
taccgcaacctccatctgatcaagcgcggtacgtt

SEQ ID NO: 75533 - DNA, 35 bp, Artificial Sequence
  Synthetic oligonucleotide
gatacggagggaaaatgggctcttgtgatgcggtt

SEQ ID NO: 75534 - DNA, 35 bp, Artificial Sequence
  Synthetic oligonucleotide
tgacacccgttccgtagctccatcgtctcgttttt

SEQ ID NO: 75535 - DNA, 36 bp, Artificial Sequence
  Synthetic oligonucleotide
ggacacttcgggacgttcttggctaccttcattaaa

SEQ ID NO: 75536 - DNA, 35 bp, Artificial Sequence
  Synthetic oligonucleotide
tgtccgtgctctccctgctcaggttcttggcccaa

SEQ ID NO: 75537 - DNA, 36 bp, Artificial Sequence
  Synthetic oligonucleotide
aacccgttagcccaccccctggtttggtcaagccaa

SEQ ID NO: 75538 - DNA, 36 bp, Artificial Sequence
  Synthetic oligonucleotide
gttctatcctgtgctgctgctacagttccatgataa

SEQ ID NO: 75539 - DNA, 34 bp, Artificial Sequence
  Synthetic oligonucleotide
aacgcgtcattcacctcagccgcattcagactaa

SEQ ID NO: 75540 - DNA, 36 bp, Artificial Sequence
  Synthetic oligonucleotide
gcaacatgtggggttgggagggggatcaagaagtaa

SEQ ID NO: 75541 - DNA, 35 bp, Artificial Sequence
  Synthetic oligonucleotide
tatgccacccctgtagattgcggcgataggccaca

SEQ ID NO: 75542 - DNA, 36 bp, Artificial Sequence
  Synthetic oligonucleotide
atgcactcctgataccctcccccagaagcctggaca

SEQ ID NO: 75543 - DNA, 36 bp, Artificial Sequence
  Synthetic oligonucleotide
gatcagcatgtagggggtctgacgggaaggggtaca

SEQ ID NO: 75544 - DNA, 36 bp, Artificial Sequence
  Synthetic oligonucleotide
tttggatcagctcactcgaactggttttggtcacca

SEQ ID NO: 75545 - DNA, 36 bp, Artificial Sequence
  Synthetic oligonucleotide
gttgacaaccccgagagcgctacgaatacgctacca

SEQ ID NO: 75546 - DNA, 36 bp, Artificial Sequence
  Synthetic oligonucleotide
gcatctcatgaccgggatactactgctcgcccccca

SEQ ID NO: 75547 - DNA, 36 bp, Artificial Sequence
  Synthetic oligonucleotide
ttcgcgagtgttcgcctgttccatccgtgcctccca

SEQ ID NO: 75548 - DNA, 35 bp, Artificial Sequence
  Synthetic oligonucleotide
ggacctgtggctctccccagtattccgtttgtcca

SEQ ID NO: 75549 - DNA, 35 bp, Artificial Sequence
  Synthetic oligonucleotide
aaccacgatatcctagtgcgctattttcgattcca

SEQ ID NO: 75550 - DNA, 35 bp, Artificial Sequence
  Synthetic oligonucleotide
aaccgccacactattcactcctgtgatacctcgca

SEQ ID NO: 75551 - DNA, 36 bp, Artificial Sequence
  Synthetic oligonucleotide
gggacccgtagcctattggccaacaacgttctctca

SEQ ID NO: 75552 - DNA, 36 bp, Artificial Sequence
  Synthetic oligonucleotide
ttcgacccattggataggtcgtgttgccctttctca

SEQ ID NO: 75553 - DNA, 35 bp, Artificial Sequence
  Synthetic oligonucleotide
attcagtacgacggccagagctctcccgtttttca

SEQ ID NO: 75554 - DNA, 37 bp, Artificial Sequence
  Synthetic oligonucleotide
gactgacgccttgtcactcctctcatctatatgacga

SEQ ID NO: 75555 - DNA, 37 bp, Artificial Sequence
  Synthetic oligonucleotide
gcgcgccgtgcgcccccttccagtccaatagtgacga

SEQ ID NO: 75556 - DNA, 37 bp, Artificial Sequence
  Synthetic oligonucleotide
gtggggaaggttatgtaggaaagcaattgggtgacga

SEQ ID NO: 75557 - DNA, 38 bp, Artificial Sequence
  Synthetic oligonucleotide
gactccctcagccacgggtaaccccggtcggattacga

SEQ ID NO: 75558 - DNA, 37 bp, Artificial Sequence
  Synthetic oligonucleotide
acacggggagggcgggatacggggcgggggctgccga

SEQ ID NO: 75559 - DNA, 37 bp, Artificial Sequence
  Synthetic oligonucleotide
gagtacgaagaagcgatcagtaatcggatgcctccga

SEQ ID NO: 75560 - DNA, 37 bp, Artificial Sequence
  Synthetic oligonucleotide
gagtcagaaaacggaggattggggagtgagcgggcga

SEQ ID NO: 75561 - DNA, 37 bp, Artificial Sequence
  Synthetic oligonucleotide
ggacaagtcgaagtaagatggcaatgtaatggttcga

SEQ ID NO: 75562 - DNA, 37 bp, Artificial Sequence
  Synthetic oligonucleotide
gcacagggtagcccatggagcttggagtacaggagga

SEQ ID NO: 75563 - DNA, 37 bp, Artificial Sequence
  Synthetic oligonucleotide
tcaacccgccacggctcgctttgacgcacacaaggga

SEQ ID NO: 75564 - DNA, 37 bp, Artificial Sequence
  Synthetic oligonucleotide
tgatgcagtgcgaggggagccatggacggaagaggga

SEQ ID NO: 75565 - DNA, 37 bp, Artificial Sequence
  Synthetic oligonucleotide
ttcttcccaccgtattgcgcacccactgacctcggga

SEQ ID NO: 75566 - DNA, 37 bp, Artificial Sequence
  Synthetic oligonucleotide
acgtgcacggttcgcacacccactccactcttatgga

SEQ ID NO: 75567 - DNA, 37 bp, Artificial Sequence
  Synthetic oligonucleotide
gcatgccactcttgcctgctctacgctccagactgga

SEQ ID NO: 75568 - DNA, 38 bp, Artificial Sequence
  Synthetic oligonucleotide
tcacgcccttgctttccagttaccaccgtcgccaatga

SEQ ID NO: 75569 - DNA, 38 bp, Artificial Sequence
  Synthetic oligonucleotide
gttcatcctatgctggccccatgacgttatcttcatga

SEQ ID NO: 75570 - DNA, 36 bp, Artificial Sequence
  Synthetic oligonucleotide
gtgcgggtagtggatcggaagggtgaaaaaggatga

SEQ ID NO: 75571 - DNA, 36 bp, Artificial Sequence
  Synthetic oligonucleotide
ttgccactgactgtatcgcaccatcaagttctatga

SEQ ID NO: 75572 - DNA, 38 bp, Artificial Sequence
  Synthetic oligonucleotide
cccaccggcctgtgttacctatgccctgtaggccctga

SEQ ID NO: 75573 - DNA, 38 bp, Artificial Sequence
  Synthetic oligonucleotide
atagcctcttgccacccccgatcagcccggatccctga

SEQ ID NO: 75574 - DNA, 38 bp, Artificial Sequence
  Synthetic oligonucleotide
gcctcccccgttatgctcctgaatcgcgacctggctga

SEQ ID NO: 75575 - DNA, 38 bp, Artificial Sequence
  Synthetic oligonucleotide
ggaaccgcctccgaaccgagtgcccacttaattgctga

SEQ ID NO: 75576 - DNA, 37 bp, Artificial Sequence
  Synthetic oligonucleotide
ttcctgccattctgcttatcctcgcatcgcactctga

SEQ ID NO: 75577 - DNA, 38 bp, Artificial Sequence
  Synthetic oligonucleotide
taccgcatcctcctgactacatacacaacttgttctga

SEQ ID NO: 75578 - DNA, 38 bp, Artificial Sequence
  Synthetic oligonucleotide
gagtaaccggaaaaggtggatagggtgctccggagtga

SEQ ID NO: 75579 - DNA, 38 bp, Artificial Sequence
  Synthetic oligonucleotide
acgccgccacccttcggacttcctcgccctgtttgtga

SEQ ID NO: 75580 - DNA, 38 bp, Artificial Sequence
  Synthetic oligonucleotide
agccccacgaatcgtcctggaccatcccgcattattga

SEQ ID NO: 75581 - DNA, 37 bp, Artificial Sequence
  Synthetic oligonucleotide
tcactgtagtaccatcgaacacacggtttaaacttga

SEQ ID NO: 75582 - DNA, 38 bp, Artificial Sequence
  Synthetic oligonucleotide
gcgcacatagtctcgaagtcccacgctggcctccttga

SEQ ID NO: 75583 - DNA, 38 bp, Artificial Sequence
  Synthetic oligonucleotide
atggggcgggaggtggcgggtgctggatcaacggttga

SEQ ID NO: 75584 - DNA, 38 bp, Artificial Sequence
  Synthetic oligonucleotide
gagtaatgccacggggggaccagataagggagggttga

SEQ ID NO: 75585 - DNA, 37 bp, Artificial Sequence
  Synthetic oligonucleotide
gatgcactgcatgagtcatggggggtaggggtgttga

SEQ ID NO: 75586 - DNA, 38 bp, Artificial Sequence
  Synthetic oligonucleotide
gtagactgggggggtggggccaatgctgacgaatttga

SEQ ID NO: 75587 - DNA, 38 bp, Artificial Sequence
  Synthetic oligonucleotide
tgctcatgcccttagggtccgcaccttcttccatttga

SEQ ID NO: 75588 - DNA, 37 bp, Artificial Sequence
  Synthetic oligonucleotide
atcagtccagatctacttccgattctgtgccctttga

SEQ ID NO: 75589 - DNA, 38 bp, Artificial Sequence
  Synthetic oligonucleotide
tgacattcagggcccctttcgccacaccgtttgtttga

SEQ ID NO: 75590 - DNA, 36 bp, Artificial Sequence
  Synthetic oligonucleotide
agtgctaaccgccgaacgacacaggtacacctcata

SEQ ID NO: 75591 - DNA, 36 bp, Artificial Sequence
  Synthetic oligonucleotide
tcacactacactctgtggaaaagggaagggaaccta

SEQ ID NO: 75592 - DNA, 36 bp, Artificial Sequence
  Synthetic oligonucleotide
actgggcccacctcgagtctctaagctcgtagccta

SEQ ID NO: 75593 - DNA, 36 bp, Artificial Sequence
  Synthetic oligonucleotide
atctcgtcgacgggtcgctttcacttgatctctcta

SEQ ID NO: 75594 - DNA, 36 bp, Artificial Sequence
  Synthetic oligonucleotide
tgtgcgacgacgcgacaacgccccacaacgtctcta

SEQ ID NO: 75595 - DNA, 36 bp, Artificial Sequence
  Synthetic oligonucleotide
gcgtttgccccaccatcgcctactacgatccccgta

SEQ ID NO: 75596 - DNA, 36 bp, Artificial Sequence
  Synthetic oligonucleotide
aatgcacgctaacgggacgaggtggggaggggtgta

SEQ ID NO: 75597 - DNA, 35 bp, Artificial Sequence
  Synthetic oligonucleotide
gcgatcctacgcccttttgagtttaccatccctta

SEQ ID NO: 75598 - DNA, 35 bp, Artificial Sequence
  Synthetic oligonucleotide
aactagtgggaagggccgggggggtataccgctta

SEQ ID NO: 75599 - DNA, 36 bp, Artificial Sequence
  Synthetic oligonucleotide
tgaacgggctaaggtagtgggaggggactgtggtta

SEQ ID NO: 75600 - DNA, 35 bp, Artificial Sequence
  Synthetic oligonucleotide
gttaagttgccgccgcgatcgtagtctccccttta

SEQ ID NO: 75601 - DNA, 35 bp, Artificial Sequence
  Synthetic oligonucleotide
atgacacaagcaaagtcagattccttggttatcac

SEQ ID NO: 75602 - DNA, 35 bp, Artificial Sequence
  Synthetic oligonucleotide
gataagtgcagcgctagcaagtccgttcgtctcac

SEQ ID NO: 75603 - DNA, 35 bp, Artificial Sequence
  Synthetic oligonucleotide
aacgcgctcacgtaggaccgctaccaaattacgac

SEQ ID NO: 75604 - DNA, 35 bp, Artificial Sequence
  Synthetic oligonucleotide
tcacgctggagaaattcctagacaccacaggggac

SEQ ID NO: 75605 - DNA, 35 bp, Artificial Sequence
  Synthetic oligonucleotide
tatgtcacggtcggaatgaaaacctccggctcacc

SEQ ID NO: 75606 - DNA, 35 bp, Artificial Sequence
  Synthetic oligonucleotide
tgcaacccaactaatgaggagttctccctatgccc

SEQ ID NO: 75607 - DNA, 35 bp, Artificial Sequence
  Synthetic oligonucleotide
tagagcatgctcataagccgcctatatttgtctcc

SEQ ID NO: 75608 - DNA, 35 bp, Artificial Sequence
  Synthetic oligonucleotide
gtaatcccccacgcttccttgcgttattatagtcc

SEQ ID NO: 75609 - DNA, 35 bp, Artificial Sequence
  Synthetic oligonucleotide
gacattcgccccatgagacatgacccgcctagtcc

SEQ ID NO: 75610 - DNA, 35 bp, Artificial Sequence
  Synthetic oligonucleotide
ttacaacatgccgcggcttatttcggttactttcc

SEQ ID NO: 75611 - DNA, 35 bp, Artificial Sequence
  Synthetic oligonucleotide
aaaaagcgcaattaactttgccagcctcacttcgc

SEQ ID NO: 75612 - DNA, 35 bp, Artificial Sequence
  Synthetic oligonucleotide
gatcctcccagagtcatacgctttttacgacctgc

SEQ ID NO: 75613 - DNA, 35 bp, Artificial Sequence
  Synthetic oligonucleotide
atgctcctgctaacgaagcccaaagctcgacctgc

SEQ ID NO: 75614 - DNA, 35 bp, Artificial Sequence
  Synthetic oligonucleotide
gcatgggctagcggccggcacatctcaaccacatc

SEQ ID NO: 75615 - DNA, 35 bp, Artificial Sequence
  Synthetic oligonucleotide
tagatccgcttcgtgcggtaggaaaacatccactc

SEQ ID NO: 75616 - DNA, 35 bp, Artificial Sequence
  Synthetic oligonucleotide
tttatgctgcgcatcccgccggtactacattcctc

SEQ ID NO: 75617 - DNA, 35 bp, Artificial Sequence
  Synthetic oligonucleotide
tcactcttcgcacattcgctctgcggcaaccgctc

SEQ ID NO: 75618 - DNA, 35 bp, Artificial Sequence
  Synthetic oligonucleotide
gactacaccactgccaaccctccctaccgggggtc

SEQ ID NO: 75619 - DNA, 35 bp, Artificial Sequence
  Synthetic oligonucleotide
agtgcgccctcacaagcactcggatcctactggtc

SEQ ID NO: 75620 - DNA, 35 bp, Artificial Sequence
  Synthetic oligonucleotide
tcccctgggtaagttccccccttgtaagcttgttc

SEQ ID NO: 75621 - DNA, 35 bp, Artificial Sequence
  Synthetic oligonucleotide
ttgcacctctcacccaggttcgagaatacaatgag

SEQ ID NO: 75622 - DNA, 35 bp, Artificial Sequence
  Synthetic oligonucleotide
cgttcgaccccgcatgcacaaaagacgtacgtacg

SEQ ID NO: 75623 - DNA, 35 bp, Artificial Sequence
  Synthetic oligonucleotide
gcgactacccggtctaaagtatggtttctctgccg

SEQ ID NO: 75624 - DNA, 35 bp, Artificial Sequence
  Synthetic oligonucleotide
atcatcgaaccatccccggagttggagctccttcg

SEQ ID NO: 75625 - DNA, 35 bp, Artificial Sequence
  Synthetic oligonucleotide
gaagggatcggggtgggagataaacaaacagcagg

SEQ ID NO: 75626 - DNA, 35 bp, Artificial Sequence
  Synthetic oligonucleotide
gctaggtgcagttagggggttgggagtgtcggagg

SEQ ID NO: 75627 - DNA, 35 bp, Artificial Sequence
  Synthetic oligonucleotide
gtaatggacgaacggtgtggcgtaatgaaggtagg

SEQ ID NO: 75628 - DNA, 35 bp, Artificial Sequence
  Synthetic oligonucleotide
ggaccacctacggcacggttctttatcccttacgg

SEQ ID NO: 75629 - DNA, 35 bp, Artificial Sequence
  Synthetic oligonucleotide
gtcgtaggtcggggtaaatctggataggtaagggg

SEQ ID NO: 75630 - DNA, 35 bp, Artificial Sequence
  Synthetic oligonucleotide
tgcaggtatcaagggggagggtgagggtatctggg

SEQ ID NO: 75631 - DNA, 35 bp, Artificial Sequence
  Synthetic oligonucleotide
gaccgacgagcggagtttccaaggggaaggttggg

SEQ ID NO: 75632 - DNA, 35 bp, Artificial Sequence
  Synthetic oligonucleotide
aagccgatgacggaccaatccccgccctaccctgg

SEQ ID NO: 75633 - DNA, 35 bp, Artificial Sequence
  Synthetic oligonucleotide
gctaccaagctccgtcgtaccatcttgtccgctgg

SEQ ID NO: 75634 - DNA, 35 bp, Artificial Sequence
  Synthetic oligonucleotide
gatgcgataggtggaggagtttcatttacatgtgg

SEQ ID NO: 75635 - DNA, 35 bp, Artificial Sequence
  Synthetic oligonucleotide
atatgcaccgcaagccaatgtgtctctcgttcatg

SEQ ID NO: 75636 - DNA, 35 bp, Artificial Sequence
  Synthetic oligonucleotide
gagatatgaggggtacgggttgcatgggacgactg

SEQ ID NO: 75637 - DNA, 35 bp, Artificial Sequence
  Synthetic oligonucleotide
atcgaaggggacaagacggtcttggtgggatgcat

SEQ ID NO: 75638 - DNA, 35 bp, Artificial Sequence
  Synthetic oligonucleotide
tctacacccgcgtggtggctgcattctttcgcact

SEQ ID NO: 75639 - DNA, 35 bp, Artificial Sequence
  Synthetic oligonucleotide
tttgagccagactgcttgttccatgccggtcccct

SEQ ID NO: 75640 - DNA, 35 bp, Artificial Sequence
  Synthetic oligonucleotide
tgttatcgcatggtcgttcggtcctcagccatcct

SEQ ID NO: 75641 - DNA, 35 bp, Artificial Sequence
  Synthetic oligonucleotide
tgtggcttcaaatttctccgcggtttccttctgct

SEQ ID NO: 75642 - DNA, 35 bp, Artificial Sequence
  Synthetic oligonucleotide
gaggggatgaaaggtactggggcatgaggtggtct

SEQ ID NO: 75643 - DNA, 35 bp, Artificial Sequence
  Synthetic oligonucleotide
gtgggaacagcgacttcttgcctcgaacaccccgt

SEQ ID NO: 75644 - DNA, 35 bp, Artificial Sequence
  Synthetic oligonucleotide
gtggacatccgcaactttgacactcagtatgaggt

SEQ ID NO: 75645 - DNA, 35 bp, Artificial Sequence
  Synthetic oligonucleotide
actgacccaccctggttgtcatctgactaccttgt

SEQ ID NO: 75646 - DNA, 35 bp, Artificial Sequence
  Synthetic oligonucleotide
gggacccatgccgtaaacttgtttctattttgctt

SEQ ID NO: 75647 - DNA, 35 bp, Artificial Sequence
  Synthetic oligonucleotide
tgcattgcggtggctcctgcgaaaccgaacatctt

SEQ ID NO: 75648 - DNA, 35 bp, Artificial Sequence
  Synthetic oligonucleotide
tccttcgcaatctacgcctcccgctgccatgggtt

SEQ ID NO: 75649 - DNA, 35 bp, Artificial Sequence
  Synthetic oligonucleotide
acacgccgacgctgaaaaaggatgactcgtaattt

SEQ ID NO: 75650 - DNA, 35 bp, Artificial Sequence
  Synthetic oligonucleotide
aagcccggcttgctccggttcaaccatgcaccttt

SEQ ID NO: 75651 - DNA, 35 bp, Artificial Sequence
  Synthetic oligonucleotide
gctcttcagcacacgtaataccatccttccccttt

SEQ ID NO: 75652 - DNA, 36 bp, Artificial Sequence
  Synthetic oligonucleotide
gtccaatcgaaaacccgcacaagggcccagccaaaa

SEQ ID NO: 75653 - DNA, 36 bp, Artificial Sequence
  Synthetic oligonucleotide
cccactgcctacgctattagatcttcctgtgcacaa

SEQ ID NO: 75654 - DNA, 36 bp, Artificial Sequence
  Synthetic oligonucleotide
tagagaggaggcgggggtcgcagataagcatcacaa

SEQ ID NO: 75655 - DNA, 35 bp, Artificial Sequence
  Synthetic oligonucleotide
tcagccaccaacgtctaaataccccggctcctgaa

SEQ ID NO: 75656 - DNA, 36 bp, Artificial Sequence
  Synthetic oligonucleotide
gcgaggtggtagcggaaacggggtagtaggtctgaa

SEQ ID NO: 75657 - DNA, 36 bp, Artificial Sequence
  Synthetic oligonucleotide
tccgtacgtacgcttttttgcctacacccacttgaa

SEQ ID NO: 75658 - DNA, 35 bp, Artificial Sequence
  Synthetic oligonucleotide
gtccagccatcgcatcgcgccttggcccaacttaa

SEQ ID NO: 75659 - DNA, 36 bp, Artificial Sequence
  Synthetic oligonucleotide
aagggcatccccacagcacgcctatagaccgcaaca

SEQ ID NO: 75660 - DNA, 35 bp, Artificial Sequence
  Synthetic oligonucleotide
cccacgcccgcctaggccctcctcgtccggtaaca

SEQ ID NO: 75661 - DNA, 35 bp, Artificial Sequence
  Synthetic oligonucleotide
ttccaccctttgaggtgaaccacaccgacaccaca

SEQ ID NO: 75662 - DNA, 35 bp, Artificial Sequence
  Synthetic oligonucleotide
taacatcgcaatatgcctcgccgctgcacccgaca

SEQ ID NO: 75663 - DNA, 35 bp, Artificial Sequence
  Synthetic oligonucleotide
gtggtccaacagcaattagcgagtctggttcccca

SEQ ID NO: 75664 - DNA, 36 bp, Artificial Sequence
  Synthetic oligonucleotide
gacaaggctagggggattgaaagtagtagcctgcca

SEQ ID NO: 75665 - DNA, 35 bp, Artificial Sequence
  Synthetic oligonucleotide
acccgctttccacttaatgtccccatacgttgcca

SEQ ID NO: 75666 - DNA, 36 bp, Artificial Sequence
  Synthetic oligonucleotide
actgcggccctacccccgtccccagatcgtagagca

SEQ ID NO: 75667 - DNA, 36 bp, Artificial Sequence
  Synthetic oligonucleotide
ttcacgcccggcgtcgcgaattctggtcccaacgca

SEQ ID NO: 75668 - DNA, 35 bp, Artificial Sequence
  Synthetic oligonucleotide
ccccccccgccgatatcaaaggctgatccctcgca

SEQ ID NO: 75669 - DNA, 36 bp, Artificial Sequence
  Synthetic oligonucleotide
aatccacccatacgactaagtgacagcccctttgca

SEQ ID NO: 75670 - DNA, 36 bp, Artificial Sequence
  Synthetic oligonucleotide
gtggatccaagcgtgctctccttactctcgtttgca

SEQ ID NO: 75671 - DNA, 35 bp, Artificial Sequence
  Synthetic oligonucleotide
gcgaggtgaggcgaaataaagaaaggacagtcaga

SEQ ID NO: 75672 - DNA, 37 bp, Artificial Sequence
  Synthetic oligonucleotide
gacatcacgccccttaatgcctggcctacacaggaga

SEQ ID NO: 75673 - DNA, 37 bp, Artificial Sequence
  Synthetic oligonucleotide
gatggccgctcatgaaagtaatgggcgggtgagtaga

SEQ ID NO: 75674 - DNA, 36 bp, Artificial Sequence
  Synthetic oligonucleotide
tgacacttcaaacagggatcagggggaggtggacga

SEQ ID NO: 75675 - DNA, 37 bp, Artificial Sequence
  Synthetic oligonucleotide
gatcacacctttggctaacgagctgtgcccccgccga

SEQ ID NO: 75676 - DNA, 37 bp, Artificial Sequence
  Synthetic oligonucleotide
gcactcagctcacttacccgttttgcccttaatccga

SEQ ID NO: 75677 - DNA, 37 bp, Artificial Sequence
  Synthetic oligonucleotide
tccgagctcagcgagatccacctttttttgcatccga

SEQ ID NO: 75678 - DNA, 37 bp, Artificial Sequence
  Synthetic oligonucleotide
ttgacccgagaagcgactttcgccaaccaatctccga

SEQ ID NO: 75679 - DNA, 36 bp, Artificial Sequence
  Synthetic oligonucleotide
tgtgccatagtatgccgtgctcggttcccctctcga

SEQ ID NO: 75680 - DNA, 37 bp, Artificial Sequence
  Synthetic oligonucleotide
gagcgagggacggacgacactttgggaggtaacagga

SEQ ID NO: 75681 - DNA, 36 bp, Artificial Sequence
  Synthetic oligonucleotide
agctcgtgggggggggaaggaaggctcttcgcagga

SEQ ID NO: 75682 - DNA, 37 bp, Artificial Sequence
  Synthetic oligonucleotide
tacatgcgcaattatggcatgtatgtgtgtcagggga

SEQ ID NO: 75683 - DNA, 37 bp, Artificial Sequence
  Synthetic oligonucleotide
aacagtcacacggcaggggtacggaaggtggatggga

SEQ ID NO: 75684 - DNA, 37 bp, Artificial Sequence
  Synthetic oligonucleotide
gtgctgagctacagaagaggtggtgggtcgacatgga

SEQ ID NO: 75685 - DNA, 37 bp, Artificial Sequence
  Synthetic oligonucleotide
tagagaaggagggtggaaatggcgcgtggcatctgga

SEQ ID NO: 75686 - DNA, 37 bp, Artificial Sequence
  Synthetic oligonucleotide
tcaccccttactatcaagccaggtcctttatgttgga

SEQ ID NO: 75687 - DNA, 37 bp, Artificial Sequence
  Synthetic oligonucleotide
gtgtggggtatggggggggcgaatgcggcctaaatga

SEQ ID NO: 75688 - DNA, 38 bp, Artificial Sequence
  Synthetic oligonucleotide
gtctgtgcacgtaggggggggtgggagagtgtacatga

SEQ ID NO: 75689 - DNA, 38 bp, Artificial Sequence
  Synthetic oligonucleotide
atgtccagccagcacccacttgatccatgcattcatga

SEQ ID NO: 75690 - DNA, 38 bp, Artificial Sequence
  Synthetic oligonucleotide
ttggactggtgtggggcaaaggagggtgggagggatga

SEQ ID NO: 75691 - DNA, 38 bp, Artificial Sequence
  Synthetic oligonucleotide
ttagtggagcttgggggggtacggggcatgggtgatga

SEQ ID NO: 75692 - DNA, 38 bp, Artificial Sequence
  Synthetic oligonucleotide
ttaacgcagaagaggggggacagggcgattgggtatga

SEQ ID NO: 75693 - DNA, 38 bp, Artificial Sequence
  Synthetic oligonucleotide
gaggtctgactccgtatctcgtactcgcccccttatga

SEQ ID NO: 75694 - DNA, 38 bp, Artificial Sequence
  Synthetic oligonucleotide
tcactcgccatggtcgaatagacctctgacccacctga

SEQ ID NO: 75695 - DNA, 38 bp, Artificial Sequence
  Synthetic oligonucleotide
acttctccgccatggctttaaacttcccctcgccctga

SEQ ID NO: 75696 - DNA, 38 bp, Artificial Sequence
  Synthetic oligonucleotide
ttcatgtccttggtacgctgctcaccctccccatctga

SEQ ID NO: 75697 - DNA, 38 bp, Artificial Sequence
  Synthetic oligonucleotide
gtcacacctcggcacactgctcattccgccccctctga

SEQ ID NO: 75698 - DNA, 38 bp, Artificial Sequence
  Synthetic oligonucleotide
ttgggctgtgcgtcatgggaaggggggggtagctctga

SEQ ID NO: 75699 - DNA, 37 bp, Artificial Sequence
  Synthetic oligonucleotide
gaaccatggtcccattgttgtttttcaatttttctga

SEQ ID NO: 75700 - DNA, 38 bp, Artificial Sequence
  Synthetic oligonucleotide
gagacgatcggtcggggagggagggaatgtctcagtga

SEQ ID NO: 75701 - DNA, 38 bp, Artificial Sequence
  Synthetic oligonucleotide
gaagccgagtgaggagagggtagagagccaggtagtga

SEQ ID NO: 75702 - DNA, 38 bp, Artificial Sequence
  Synthetic oligonucleotide
tcaccggtccagttctgcctgccctcacgcttaggtga

SEQ ID NO: 75703 - DNA, 38 bp, Artificial Sequence
  Synthetic oligonucleotide
ggagtgagtctggtggacagggcgtgagttaggggtga

SEQ ID NO: 75704 - DNA, 38 bp, Artificial Sequence
  Synthetic oligonucleotide
gaacgggcgagggaccaacatgatgtgtgagggggtga

SEQ ID NO: 75705 - DNA, 38 bp, Artificial Sequence
  Synthetic oligonucleotide
tcacgagacggagatgtgcggtgtagtggatggggtga

SEQ ID NO: 75706 - DNA, 38 bp, Artificial Sequence
  Synthetic oligonucleotide
accaacgcactcctggttcaaattggaatactctgtga

SEQ ID NO: 75707 - DNA, 38 bp, Artificial Sequence
  Synthetic oligonucleotide
gccaccgccgaaaagcctgccgaattttgaccaattga

SEQ ID NO: 75708 - DNA, 38 bp, Artificial Sequence
  Synthetic oligonucleotide
tgagtgtcaaatccccctagctgatccaactgaattga

SEQ ID NO: 75709 - DNA, 37 bp, Artificial Sequence
  Synthetic oligonucleotide
taccgcggtcccatcctaagcctgctcgtgatattga

SEQ ID NO: 75710 - DNA, 38 bp, Artificial Sequence
  Synthetic oligonucleotide
ttgcacccatttgcccaggctagatatgctccccttga

SEQ ID NO: 75711 - DNA, 38 bp, Artificial Sequence
  Synthetic oligonucleotide
gccctgccctgctattttcagagttcacccgcccttga

SEQ ID NO: 75712 - DNA, 38 bp, Artificial Sequence
  Synthetic oligonucleotide
gatggatcgcgacacaggtgattgtgaagctgagttga

SEQ ID NO: 75713 - DNA, 37 bp, Artificial Sequence
  Synthetic oligonucleotide
acgttcatgccattgcccgggaggctctccttgttga

SEQ ID NO: 75714 - DNA, 35 bp, Artificial Sequence
  Synthetic oligonucleotide
gttgatggaagaaggggaatatgaaaaacgcgata

SEQ ID NO: 75715 - DNA, 35 bp, Artificial Sequence
  Synthetic oligonucleotide
tcgcgatctcacgcgaggctcgccacatccaccta

SEQ ID NO: 75716 - DNA, 35 bp, Artificial Sequence
  Synthetic oligonucleotide
gaccaatgccctgtcttcacaacgttgtgatccta

SEQ ID NO: 75717 - DNA, 36 bp, Artificial Sequence
  Synthetic oligonucleotide
tgttatccccgtacgacctgacgcgcaagtttgcta

SEQ ID NO: 75718 - DNA, 36 bp, Artificial Sequence
  Synthetic oligonucleotide
tgtagcccggcggttccctatctgctgttttgtcta

SEQ ID NO: 75719 - DNA, 34 bp, Artificial Sequence
  Synthetic oligonucleotide
gatcgatcatggcttgagtcgtctctattccgta

SEQ ID NO: 75720 - DNA, 36 bp, Artificial Sequence
  Synthetic oligonucleotide
tcacactactgcttaacgtacactcggagtgactta

SEQ ID NO: 75721 - DNA, 36 bp, Artificial Sequence
  Synthetic oligonucleotide
taatgacactgccatatagatctaaccgaactgtta

SEQ ID NO: 75722 - DNA, 36 bp, Artificial Sequence
  Synthetic oligonucleotide
ttcatcacatgtgctccccccggtattgtcctttta

SEQ ID NO: 75723 - DNA, 35 bp, Artificial Sequence
  Synthetic oligonucleotide
ttcgtacacatctgttgcctatgcccatccagacc

SEQ ID NO: 75724 - DNA, 35 bp, Artificial Sequence
  Synthetic oligonucleotide
gacatccaactcgggatgatagacgcttctctacc

SEQ ID NO: 75725 - DNA, 35 bp, Artificial Sequence
  Synthetic oligonucleotide
gaaatgccaccagcaggctctatagctgacttacc

SEQ ID NO: 75726 - DNA, 35 bp, Artificial Sequence
  Synthetic oligonucleotide
gatcccccgccgcatgggtaaatgactccacgcgc

SEQ ID NO: 75727 - DNA, 36 bp, Artificial Sequence
  Synthetic oligonucleotide
atgtcccaccacaaatcgtcccaccaattgccgtgc

SEQ ID NO: 75728 - DNA, 35 bp, Artificial Sequence
  Synthetic oligonucleotide
aggtcacctcacccggccatcataattgcctttgc

SEQ ID NO: 75729 - DNA, 35 bp, Artificial Sequence
  Synthetic oligonucleotide
gatggggggagcggggatcggggatggtggcgatc

SEQ ID NO: 75730 - DNA, 35 bp, Artificial Sequence
  Synthetic oligonucleotide
aacatctggtgtccgactcactatttcaacgtatc

SEQ ID NO: 75731 - DNA, 35 bp, Artificial Sequence
  Synthetic oligonucleotide
acctggccgacactacccctgatcccgcctgtatc

SEQ ID NO: 75732 - DNA, 35 bp, Artificial Sequence
  Synthetic oligonucleotide
gatccttgcgctgaaaccaattacctgacgacctc

SEQ ID NO: 75733 - DNA, 35 bp, Artificial Sequence
  Synthetic oligonucleotide
ggggcctgcaaccaccacgccgttcagctgctctc

SEQ ID NO: 75734 - DNA, 35 bp, Artificial Sequence
  Synthetic oligonucleotide
ttgccaaccatcacccacctgcgtctacaggcttc

SEQ ID NO: 75735 - DNA, 35 bp, Artificial Sequence
  Synthetic oligonucleotide
tgccaccgtacgccccttgtcagtaacagtcgaag

SEQ ID NO: 75736 - DNA, 35 bp, Artificial Sequence
  Synthetic oligonucleotide
gtggtgcaattcaataagggggtatgggtcttgag

SEQ ID NO: 75737 - DNA, 35 bp, Artificial Sequence
  Synthetic oligonucleotide
aatgagtggccaaaacggagggaatcatgagcacg

SEQ ID NO: 75738 - DNA, 35 bp, Artificial Sequence
  Synthetic oligonucleotide
ggaactaccatggcgaggagggagggtttgggacg

SEQ ID NO: 75739 - DNA, 35 bp, Artificial Sequence
  Synthetic oligonucleotide
ttaccactgtagaactgcaattgccacatcccccg

SEQ ID NO: 75740 - DNA, 35 bp, Artificial Sequence
  Synthetic oligonucleotide
gacacctaagtggcactagtgattaacggtagccg

SEQ ID NO: 75741 - DNA, 35 bp, Artificial Sequence
  Synthetic oligonucleotide
gtccaaaatcgaaatgctgctctgccactcctccg

SEQ ID NO: 75742 - DNA, 35 bp, Artificial Sequence
  Synthetic oligonucleotide
ttgatatacacccgcccaactgagatcgctttgcg

SEQ ID NO: 75743 - DNA, 35 bp, Artificial Sequence
  Synthetic oligonucleotide
tcttgaccccgtaaaccaaatcgtgtttgtattcg

SEQ ID NO: 75744 - DNA, 35 bp, Artificial Sequence
  Synthetic oligonucleotide
ttagctctctgccaaattgtgaatgttctcctggg

SEQ ID NO: 75745 - DNA, 35 bp, Artificial Sequence
  Synthetic oligonucleotide
gaggaaaggtctagggattgtcttggtgtaggtgg

SEQ ID NO: 75746 - DNA, 35 bp, Artificial Sequence
  Synthetic oligonucleotide
actacggaagggcctgtcggaaaggagggtaaaat

SEQ ID NO: 75747 - DNA, 35 bp, Artificial Sequence
  Synthetic oligonucleotide
accaacgcaaggcttgcaattctgcgttttcctat

SEQ ID NO: 75748 - DNA, 35 bp, Artificial Sequence
  Synthetic oligonucleotide
ttggcacactcgtctccagactcccgtgctgctat

SEQ ID NO: 75749 - DNA, 35 bp, Artificial Sequence
  Synthetic oligonucleotide
gtgtcatcgaccgcacctcgcatactgcatgcact

SEQ ID NO: 75750 - DNA, 35 bp, Artificial Sequence
  Synthetic oligonucleotide
gattagcccgttgttatgtctcgaaaccaccccct

SEQ ID NO: 75751 - DNA, 35 bp, Artificial Sequence
  Synthetic oligonucleotide
ttgtcgatacgtgacctcccaacctccaaactgct

SEQ ID NO: 75752 - DNA, 35 bp, Artificial Sequence
  Synthetic oligonucleotide
ttcccccaagttccgcctatcgattcagttttgct

SEQ ID NO: 75753 - DNA, 35 bp, Artificial Sequence
  Synthetic oligonucleotide
tcaacgcccccctcggggcccgggcctcaacatct

SEQ ID NO: 75754 - DNA, 35 bp, Artificial Sequence
  Synthetic oligonucleotide
cgccgagggcaattcgtcacaacggccaccactct

SEQ ID NO: 75755 - DNA, 35 bp, Artificial Sequence
  Synthetic oligonucleotide
tgaaacgttgaagggaaaggggatagtgcgtccgt

SEQ ID NO: 75756 - DNA, 35 bp, Artificial Sequence
  Synthetic oligonucleotide
tccatgtcgttgttgggtctcgtctttcttcgcgt

SEQ ID NO: 75757 - DNA, 35 bp, Artificial Sequence
  Synthetic oligonucleotide
tagtgagggagggcgagggcattccgtgacggggt

SEQ ID NO: 75758 - DNA, 35 bp, Artificial Sequence
  Synthetic oligonucleotide
tcccctaccagcccacaggactttttgcgccatgt

SEQ ID NO: 75759 - DNA, 35 bp, Artificial Sequence
  Synthetic oligonucleotide
gtcaatcacaagatggatgaaggggtgtgttatgt

SEQ ID NO: 75760 - DNA, 35 bp, Artificial Sequence
  Synthetic oligonucleotide
gacgagcttacacctcatccgagcctgtcacctgt

SEQ ID NO: 75761 - DNA, 35 bp, Artificial Sequence
  Synthetic oligonucleotide
tatccggcccaatctcgccgtacgcaaccctttgt

SEQ ID NO: 75762 - DNA, 35 bp, Artificial Sequence
  Synthetic oligonucleotide
agccgggtacttgacggtctatactgcatcctctt

SEQ ID NO: 75763 - DNA, 35 bp, Artificial Sequence
  Synthetic oligonucleotide
tcacggtgggcaggctcatttccggcattcctctt

SEQ ID NO: 75764 - DNA, 35 bp, Artificial Sequence
  Synthetic oligonucleotide
aaggccgacgtggcactagcgtactgctcccattt

SEQ ID NO: 75765 - DNA, 36 bp, Artificial Sequence
  Synthetic oligonucleotide
tgatgccctgcccttttttcatcgtatggctaccaa

SEQ ID NO: 75766 - DNA, 35 bp, Artificial Sequence
  Synthetic oligonucleotide
aacgcccgagcactatcggaaggactgccccccaa

SEQ ID NO: 75767 - DNA, 35 bp, Artificial Sequence
  Synthetic oligonucleotide
tgaaaaccgcctcgctatttattgacccaatcgaa

SEQ ID NO: 75768 - DNA, 36 bp, Artificial Sequence
  Synthetic oligonucleotide
tacacgcactcattcagaccccacgtcattcgtgaa

SEQ ID NO: 75769 - DNA, 35 bp, Artificial Sequence
  Synthetic oligonucleotide
aacccgcccactcaggcatacgcacatctccgtaa

SEQ ID NO: 75770 - DNA, 36 bp, Artificial Sequence
  Synthetic oligonucleotide
tgtcatgccctgctactttttacgtatcccatttaa

SEQ ID NO: 75771 - DNA, 35 bp, Artificial Sequence
  Synthetic oligonucleotide
gcattggccaagctgtactacactgtcccgtaaca

SEQ ID NO: 75772 - DNA, 36 bp, Artificial Sequence
  Synthetic oligonucleotide
tcatagtactgtccgcatatcgttagatcacacaca

SEQ ID NO: 75773 - DNA, 36 bp, Artificial Sequence
  Synthetic oligonucleotide
atgccagagggacggggggtaacatcaagaggtaca

SEQ ID NO: 75774 - DNA, 35 bp, Artificial Sequence
  Synthetic oligonucleotide
tccacgagagtaccctatggcaaacgacgaaacca

SEQ ID NO: 75775 - DNA, 36 bp, Artificial Sequence
  Synthetic oligonucleotide
acacctgtacacgggacgtgctacaacattaaccca

SEQ ID NO: 75776 - DNA, 35 bp, Artificial Sequence
  Synthetic oligonucleotide
tatttaccgcgctccccctacgcctcgttgaccca

SEQ ID NO: 75777 - DNA, 36 bp, Artificial Sequence
  Synthetic oligonucleotide
gaacccgcgatgggaaccctagtcaagctctaccca

SEQ ID NO: 75778 - DNA, 36 bp, Artificial Sequence
  Synthetic oligonucleotide
gcgccgtgggctcgaaccctgtcttccttaccagca

SEQ ID NO: 75779 - DNA, 36 bp, Artificial Sequence
  Synthetic oligonucleotide
actccctacgtctgaaatagcgttaccttcccatca

SEQ ID NO: 75780 - DNA, 36 bp, Artificial Sequence
  Synthetic oligonucleotide
tcactacggctctctcgtatgtcatcaatcacctca

SEQ ID NO: 75781 - DNA, 36 bp, Artificial Sequence
  Synthetic oligonucleotide
tcccttcagccctgaacggttatatcaagctcctca

SEQ ID NO: 75782 - DNA, 36 bp, Artificial Sequence
  Synthetic oligonucleotide
tttactgccacgccgtattttgtctccttggtctca

SEQ ID NO: 75783 - DNA, 36 bp, Artificial Sequence
  Synthetic oligonucleotide
agagcagtaggcaaagaagaggtaggaaaggtcaga

SEQ ID NO: 75784 - DNA, 37 bp, Artificial Sequence
  Synthetic oligonucleotide
aatgcgccgcggggcataggtcaaggggtttctgaga

SEQ ID NO: 75785 - DNA, 36 bp, Artificial Sequence
  Synthetic oligonucleotide
gtaccgccgctcaccgaatattcccttgttttgaga

SEQ ID NO: 75786 - DNA, 37 bp, Artificial Sequence
  Synthetic oligonucleotide
tcacccggcttgttatcttaatctcgaacaccctaga

SEQ ID NO: 75787 - DNA, 37 bp, Artificial Sequence
  Synthetic oligonucleotide
tccgccgagcctggtcgagtcgccacatcctcgtaga

SEQ ID NO: 75788 - DNA, 37 bp, Artificial Sequence
  Synthetic oligonucleotide
gctgcaacacattctgtccacacacggcgtagaacga

SEQ ID NO: 75789 - DNA, 36 bp, Artificial Sequence
  Synthetic oligonucleotide
atcatacattcctgccttgtcttaacggtcgaacga

SEQ ID NO: 75790 - DNA, 37 bp, Artificial Sequence
  Synthetic oligonucleotide
tcaattcccgtttcacctttcgatgactcatcgacga

SEQ ID NO: 75791 - DNA, 36 bp, Artificial Sequence
  Synthetic oligonucleotide
gtggacagacagtagggaagaaagacaacgtgacga

SEQ ID NO: 75792 - DNA, 36 bp, Artificial Sequence
  Synthetic oligonucleotide
tgacaccactaaccacatggactcggtactaaccga

SEQ ID NO: 75793 - DNA, 37 bp, Artificial Sequence
  Synthetic oligonucleotide
ggtcgcttcgacactcgctgccacttcactttcccga

SEQ ID NO: 75794 - DNA, 37 bp, Artificial Sequence
  Synthetic oligonucleotide
tgcccaactgcagcctacattgtttcagcgcatccga

SEQ ID NO: 75795 - DNA, 37 bp, Artificial Sequence
  Synthetic oligonucleotide
tcatcgctgttgtaacgctacccgccccctggtccga

SEQ ID NO: 75796 - DNA, 37 bp, Artificial Sequence
  Synthetic oligonucleotide
gccctatcccaccggcctcagtccaaactcagttcga

SEQ ID NO: 75797 - DNA, 37 bp, Artificial Sequence
  Synthetic oligonucleotide
gatcagcccaatcctgcgaattcatcacttttacgga

SEQ ID NO: 75798 - DNA, 37 bp, Artificial Sequence
  Synthetic oligonucleotide
gaccccggggcgggtttgaaggatgctgcacaaggga

SEQ ID NO: 75799 - DNA, 37 bp, Artificial Sequence
  Synthetic oligonucleotide
tccgcaaggttggggaagaggggggactgttcaggga

SEQ ID NO: 75800 - DNA, 36 bp, Artificial Sequence
  Synthetic oligonucleotide
gcaaccgccctgaacgctattcgtgtcaacacggga

SEQ ID NO: 75801 - DNA, 37 bp, Artificial Sequence
  Synthetic oligonucleotide
tacatgcccaccggtagtcgcacgaatctgtcgtgga

SEQ ID NO: 75802 - DNA, 38 bp, Artificial Sequence
  Synthetic oligonucleotide
agccaggctcagtctgaactcctgccatacccaaatga

SEQ ID NO: 75803 - DNA, 38 bp, Artificial Sequence
  Synthetic oligonucleotide
aaatgccaaaggtaggggggaagggacgcattaaatga

SEQ ID NO: 75804 - DNA, 38 bp, Artificial Sequence
  Synthetic oligonucleotide
gagaagctcgccaagtagtttcactctcacacccatga

SEQ ID NO: 75805 - DNA, 38 bp, Artificial Sequence
  Synthetic oligonucleotide
aacgacggggcgtgcctccccactcatatttcatatga

SEQ ID NO: 75806 - DNA, 37 bp, Artificial Sequence
  Synthetic oligonucleotide
accaacagctctatcgtcgcctgcttccaattactga

SEQ ID NO: 75807 - DNA, 37 bp, Artificial Sequence
  Synthetic oligonucleotide
tcgtccaaccagttgaccgtgatgaatcctcccctga

SEQ ID NO: 75808 - DNA, 37 bp, Artificial Sequence
  Synthetic oligonucleotide
gcaaacataccgactcacgcacaggacactgccctga

SEQ ID NO: 75809 - DNA, 37 bp, Artificial Sequence
  Synthetic oligonucleotide
acacactgcataatgctgatttaatctcccctcctga

SEQ ID NO: 75810 - DNA, 37 bp, Artificial Sequence
  Synthetic oligonucleotide
actgtcctcccgatgttccatttgctgagtttcctga

SEQ ID NO: 75811 - DNA, 38 bp, Artificial Sequence
  Synthetic oligonucleotide
gagtggctgggtagtttgttttgacagaggcgggctga

SEQ ID NO: 75812 - DNA, 38 bp, Artificial Sequence
  Synthetic oligonucleotide
aaccgtagttaggttagggaaggagtggggggggctga

SEQ ID NO: 75813 - DNA, 38 bp, Artificial Sequence
  Synthetic oligonucleotide
gctccgtgcttctgcgcccgtccgtgcctctttgctga

SEQ ID NO: 75814 - DNA, 38 bp, Artificial Sequence
  Synthetic oligonucleotide
aacaatgggaagggggggccaaaagggtcaagctctga

SEQ ID NO: 75815 - DNA, 37 bp, Artificial Sequence
  Synthetic oligonucleotide
tcctggtcacaccacaccctgtttaccgtgtctctga

SEQ ID NO: 75816 - DNA, 38 bp, Artificial Sequence
  Synthetic oligonucleotide
accctcacccacaacgtgctagcctaaaggccacgtga

SEQ ID NO: 75817 - DNA, 38 bp, Artificial Sequence
  Synthetic oligonucleotide
gtacgcactatccccagtctcagtcaatgcatacgtga

SEQ ID NO: 75818 - DNA, 36 bp, Artificial Sequence
  Synthetic oligonucleotide
tcaatgtccggtccctttccccactagactgcgtga

SEQ ID NO: 75819 - DNA, 38 bp, Artificial Sequence
  Synthetic oligonucleotide
tttgtgcaccacgctgccgtcattctccaccctcgtga

SEQ ID NO: 75820 - DNA, 38 bp, Artificial Sequence
  Synthetic oligonucleotide
taaaacatcgcccctcgtcaatacctgtccacatgtga

SEQ ID NO: 75821 - DNA, 38 bp, Artificial Sequence
  Synthetic oligonucleotide
tatgagtaggttcgaggagggcgatatgacagctgtga

SEQ ID NO: 75822 - DNA, 38 bp, Artificial Sequence
  Synthetic oligonucleotide
gacacggtacctgccgtatttacgtacaacacgcttga

SEQ ID NO: 75823 - DNA, 36 bp, Artificial Sequence
  Synthetic oligonucleotide
aacccatcgtactgctatcgtatcgcccgattaata

SEQ ID NO: 75824 - DNA, 36 bp, Artificial Sequence
  Synthetic oligonucleotide
atccccactgctccagccacgggactctatttcata

SEQ ID NO: 75825 - DNA, 36 bp, Artificial Sequence
  Synthetic oligonucleotide
tcccagcgatagtccgaacgatcagcgcttcctcta

SEQ ID NO: 75826 - DNA, 35 bp, Artificial Sequence
  Synthetic oligonucleotide
tccacctgcctcacccggaaacatactcgcccgta

SEQ ID NO: 75827 - DNA, 36 bp, Artificial Sequence
  Synthetic oligonucleotide
gtggtgggtagaaaggagggaggagaggaaggcgta

SEQ ID NO: 75828 - DNA, 36 bp, Artificial Sequence
  Synthetic oligonucleotide
gtgcgggggtggtgatagtgggcgggagagtctgta

SEQ ID NO: 75829 - DNA, 35 bp, Artificial Sequence
  Synthetic oligonucleotide
tatgggaccgcagtctctagttgactgcctaaaac

SEQ ID NO: 75830 - DNA, 35 bp, Artificial Sequence
  Synthetic oligonucleotide
tactattgcgtcatgaactcccccccagtcataac

SEQ ID NO: 75831 - DNA, 35 bp, Artificial Sequence
  Synthetic oligonucleotide
tcatgaatcgcaacacgctggcacatacgtttcac

SEQ ID NO: 75832 - DNA, 35 bp, Artificial Sequence
  Synthetic oligonucleotide
gtgttatctatcgccactgccctggtgttcgctac

SEQ ID NO: 75833 - DNA, 35 bp, Artificial Sequence
  Synthetic oligonucleotide
tctaccgccctcttctgttagtcgtctattggtac

SEQ ID NO: 75834 - DNA, 35 bp, Artificial Sequence
  Synthetic oligonucleotide
gttgtcctctccccgccggtaaacgtgacacgacc

SEQ ID NO: 75835 - DNA, 35 bp, Artificial Sequence
  Synthetic oligonucleotide
acaagcccatgcctcaacgttcgcatctcactacc

SEQ ID NO: 75836 - DNA, 34 bp, Artificial Sequence
  Synthetic oligonucleotide
actgactggcgggctgattctaccctacgtaccc

SEQ ID NO: 75837 - DNA, 35 bp, Artificial Sequence
  Synthetic oligonucleotide
ttggtgggcgcgttcaactttattctgcatatccc

SEQ ID NO: 75838 - DNA, 35 bp, Artificial Sequence
  Synthetic oligonucleotide
ggaccacctgccactgtcttccatgctcgacatcc

SEQ ID NO: 75839 - DNA, 35 bp, Artificial Sequence
  Synthetic oligonucleotide
ttccccccgcccatccttgtgtctgcaaacgctcc

SEQ ID NO: 75840 - DNA, 35 bp, Artificial Sequence
  Synthetic oligonucleotide
gaccaattgttacaacacgccgcaggagttcgcgc

SEQ ID NO: 75841 - DNA, 35 bp, Artificial Sequence
  Synthetic oligonucleotide
tttaaacacctctgcaccattgcactgccctcggc

SEQ ID NO: 75842 - DNA, 35 bp, Artificial Sequence
  Synthetic oligonucleotide
tgcaacaatgccccgtaggcccaaactgcacgtgc

SEQ ID NO: 75843 - DNA, 35 bp, Artificial Sequence
  Synthetic oligonucleotide
gataccacgtagttatgggcccggtccctcacatc

SEQ ID NO: 75844 - DNA, 35 bp, Artificial Sequence
  Synthetic oligonucleotide
gtaacccctgaaacttacaggatacagaccaactc

SEQ ID NO: 75845 - DNA, 35 bp, Artificial Sequence
  Synthetic oligonucleotide
tcctacctaccccactctgtcagagggcttgcttc

SEQ ID NO: 75846 - DNA, 35 bp, Artificial Sequence
  Synthetic oligonucleotide
actcgtagctgcacattggccgtactatttacaag

SEQ ID NO: 75847 - DNA, 35 bp, Artificial Sequence
  Synthetic oligonucleotide
ggaaggggtgggtgcttgggaaattttcggatgag

SEQ ID NO: 75848 - DNA, 35 bp, Artificial Sequence
  Synthetic oligonucleotide
tagtagaagggagggaacggatataatggggatag

SEQ ID NO: 75849 - DNA, 35 bp, Artificial Sequence
  Synthetic oligonucleotide
tgatgtcagccgccctgcctgcgccttcaccctag

SEQ ID NO: 75850 - DNA, 35 bp, Artificial Sequence
  Synthetic oligonucleotide
gtcatggcacacgtctggcccgtaccgtccccacg

SEQ ID NO: 75851 - DNA, 35 bp, Artificial Sequence
  Synthetic oligonucleotide
gccacacctagccgtttggtgactcagttaatccg

SEQ ID NO: 75852 - DNA, 35 bp, Artificial Sequence
  Synthetic oligonucleotide
gcctagccaccgcttacgaccttgttggtgttccg

SEQ ID NO: 75853 - DNA, 35 bp, Artificial Sequence
  Synthetic oligonucleotide
gctgggaaggggataggcggccgggggtgcatgcg

SEQ ID NO: 75854 - DNA, 35 bp, Artificial Sequence
  Synthetic oligonucleotide
taggatggctcgcagaagataggcaggggggtgcg

SEQ ID NO: 75855 - DNA, 35 bp, Artificial Sequence
  Synthetic oligonucleotide
gcactgcccagggagttgaggtgtggggtgttggg

SEQ ID NO: 75856 - DNA, 35 bp, Artificial Sequence
  Synthetic oligonucleotide
ttaacccgttctgcattgcattctcattggacctg

SEQ ID NO: 75857 - DNA, 35 bp, Artificial Sequence
  Synthetic oligonucleotide
atgccgaggtgagggtttttatgtttgttgttctg

SEQ ID NO: 75858 - DNA, 35 bp, Artificial Sequence
  Synthetic oligonucleotide
gtcccatccacacggctaatgacgtagcaccggtg

SEQ ID NO: 75859 - DNA, 35 bp, Artificial Sequence
  Synthetic oligonucleotide
acctcgcagcaggatcgggaggtaagggatgggtg

SEQ ID NO: 75860 - DNA, 35 bp, Artificial Sequence
  Synthetic oligonucleotide
atcccttcgttcgatctgacatgtcgaccgttttg

SEQ ID NO: 75861 - DNA, 35 bp, Artificial Sequence
  Synthetic oligonucleotide
agagtgctgatgtcgccctgttccagtctcttcat

SEQ ID NO: 75862 - DNA, 35 bp, Artificial Sequence
  Synthetic oligonucleotide
ggaccccatatattgccttgtactgttcactgact

SEQ ID NO: 75863 - DNA, 35 bp, Artificial Sequence
  Synthetic oligonucleotide
gacgctctgccaggagggcatggtccctctctact

SEQ ID NO: 75864 - DNA, 35 bp, Artificial Sequence
  Synthetic oligonucleotide
gccggtttatcgggtttttatgcacatgttcccct

SEQ ID NO: 75865 - DNA, 35 bp, Artificial Sequence
  Synthetic oligonucleotide
tatcccgaaccgatctgtcgcttgaactaaatgct

SEQ ID NO: 75866 - DNA, 35 bp, Artificial Sequence
  Synthetic oligonucleotide
ccaacacccgcgcacgcctcagagcggctccatct

SEQ ID NO: 75867 - DNA, 35 bp, Artificial Sequence
  Synthetic oligonucleotide
tcgaacttgctccaacgtctcaaaatcgttcttct

SEQ ID NO: 75868 - DNA, 33 bp, Artificial Sequence
  Synthetic oligonucleotide
gttatcactgggctgcacacatctcagcctagt

SEQ ID NO: 75869 - DNA, 35 bp, Artificial Sequence
  Synthetic oligonucleotide
aatctcacgagcctgccactcattccttggaccgt

SEQ ID NO: 75870 - DNA, 35 bp, Artificial Sequence
  Synthetic oligonucleotide
tccctgccggcattgatactcgccagctatttcgt

SEQ ID NO: 75871 - DNA, 35 bp, Artificial Sequence
  Synthetic oligonucleotide
aaatccccccatcgtggccagttcgccttacgatt

SEQ ID NO: 75872 - DNA, 35 bp, Artificial Sequence
  Synthetic oligonucleotide
agagacccgtttctgcgcgtgtcacctcacacttt

SEQ ID NO: 75873 - DNA, 35 bp, Artificial Sequence
  Synthetic oligonucleotide
gccgaatgttggtgggcaggctgtgggggaggttt

SEQ ID NO: 75874 - DNA, 35 bp, Artificial Sequence
  Synthetic oligonucleotide
gcccatcctactcgactaactgtttgcgaatcaaa

SEQ ID NO: 75875 - DNA, 36 bp, Artificial Sequence
  Synthetic oligonucleotide
gtacgccccggagacctcagcgtccaattaccgaaa

SEQ ID NO: 75876 - DNA, 36 bp, Artificial Sequence
  Synthetic oligonucleotide
tcactggaggttgcgatacaacacgccgcccataaa

SEQ ID NO: 75877 - DNA, 36 bp, Artificial Sequence
  Synthetic oligonucleotide
agttcgcttagcccgtgtctcctctttcctggtaaa

SEQ ID NO: 75878 - DNA, 35 bp, Artificial Sequence
  Synthetic oligonucleotide
agaacagggtgaggcgggcactgaaaggttaacaa

SEQ ID NO: 75879 - DNA, 36 bp, Artificial Sequence
  Synthetic oligonucleotide
aaccaaccgcccggatttatgaagctgaaccgccaa

SEQ ID NO: 75880 - DNA, 35 bp, Artificial Sequence
  Synthetic oligonucleotide
gattggggaaagcaggattgcgtagggacgtggaa

SEQ ID NO: 75881 - DNA, 36 bp, Artificial Sequence
  Synthetic oligonucleotide
acagggtgggtaagggtggaccgggtgcactcgtaa

SEQ ID NO: 75882 - DNA, 35 bp, Artificial Sequence
  Synthetic oligonucleotide
cctaccaccctgaaggcctcgctttacactagaca

SEQ ID NO: 75883 - DNA, 36 bp, Artificial Sequence
  Synthetic oligonucleotide
gcacgagtgtggttcgggcacgaaaacttaggtaca

SEQ ID NO: 75884 - DNA, 36 bp, Artificial Sequence
  Synthetic oligonucleotide
gatccagagcaagacactcgagccaccataacacca

SEQ ID NO: 75885 - DNA, 35 bp, Artificial Sequence
  Synthetic oligonucleotide
gaacgccccatcaccgttcacggcatgagtgacca

SEQ ID NO: 75886 - DNA, 37 bp, Artificial Sequence
  Synthetic oligonucleotide
gctgaccacttatgtttgttgtatgcgaactttacca

SEQ ID NO: 75887 - DNA, 35 bp, Artificial Sequence
  Synthetic oligonucleotide
ttgtcctcccaacatgtcgcccatgacaataccca

SEQ ID NO: 75888 - DNA, 36 bp, Artificial Sequence
  Synthetic oligonucleotide
tccgacaccacgctgaattgcaaagctaactaccca

SEQ ID NO: 75889 - DNA, 35 bp, Artificial Sequence
  Synthetic oligonucleotide
atgcctctgcgaacctcccttgcaggcccctccca

SEQ ID NO: 75890 - DNA, 35 bp, Artificial Sequence
  Synthetic oligonucleotide
ggtgctccaagctacctctgctcgatctcatgcca

SEQ ID NO: 75891 - DNA, 36 bp, Artificial Sequence
  Synthetic oligonucleotide
ttgcgtgctcgccctggcgcctccctcccttaagca

SEQ ID NO: 75892 - DNA, 36 bp, Artificial Sequence
  Synthetic oligonucleotide
gcacaagggatggttggcatgggtgaacatggtgca

SEQ ID NO: 75893 - DNA, 36 bp, Artificial Sequence
  Synthetic oligonucleotide
aaccgacacggaagttaggttttcgccccctaatca

SEQ ID NO: 75894 - DNA, 36 bp, Artificial Sequence
  Synthetic oligonucleotide
gatacaggcctgaggattgaagggaaaaggtggtca

SEQ ID NO: 75895 - DNA, 37 bp, Artificial Sequence
  Synthetic oligonucleotide
gccgcactctcatcccacttaaaggccgttcccaaga

SEQ ID NO: 75896 - DNA, 36 bp, Artificial Sequence
  Synthetic oligonucleotide
gtgcaacacgactgcagagtgtggtttcacttgaga

SEQ ID NO: 75897 - DNA, 37 bp, Artificial Sequence
  Synthetic oligonucleotide
tgagagcaacgcaactatcccgccccgttccattaga

SEQ ID NO: 75898 - DNA, 36 bp, Artificial Sequence
  Synthetic oligonucleotide
tgacaaccgtgagctggggcggtaggcgggtttaga

SEQ ID NO: 75899 - DNA, 37 bp, Artificial Sequence
  Synthetic oligonucleotide
atgggagagttggggagaactagaagagggagaacga

SEQ ID NO: 75900 - DNA, 37 bp, Artificial Sequence
  Synthetic oligonucleotide
attggcaatcgcaggccctctatcaccgcccccccga

SEQ ID NO: 75901 - DNA, 33 bp, Artificial Sequence
  Synthetic oligonucleotide
agctgcccgaggtcatgtcaatcttctccccga

SEQ ID NO: 75902 - DNA, 37 bp, Artificial Sequence
  Synthetic oligonucleotide
gagaacgggaggcggtaagaggagagtctggacgcga

SEQ ID NO: 75903 - DNA, 37 bp, Artificial Sequence
  Synthetic oligonucleotide
gtgagcaaggcgggggcgggtggaagcgctggatcga

SEQ ID NO: 75904 - DNA, 37 bp, Artificial Sequence
  Synthetic oligonucleotide
tcccgcgcgctactgctcatggttcacgcaaattcga

SEQ ID NO: 75905 - DNA, 37 bp, Artificial Sequence
  Synthetic oligonucleotide
tacgggataggtgagaaaactagaaatgggacacgga

SEQ ID NO: 75906 - DNA, 37 bp, Artificial Sequence
  Synthetic oligonucleotide
tgagtagctggggagaggggtacggtggggatccgga

SEQ ID NO: 75907 - DNA, 37 bp, Artificial Sequence
  Synthetic oligonucleotide
tttgggtgaggagggggaaaggggtgatcttatggga

SEQ ID NO: 75908 - DNA, 36 bp, Artificial Sequence
  Synthetic oligonucleotide
acaacccccgtactagctttgggaaatcgacctgga

SEQ ID NO: 75909 - DNA, 35 bp, Artificial Sequence
  Synthetic oligonucleotide
tattgtcccgggtaagggcatgggaggtgggtgga

SEQ ID NO: 75910 - DNA, 38 bp, Artificial Sequence
  Synthetic oligonucleotide
gagcacctacctccatcgccgttagaagccaggaatga

SEQ ID NO: 75911 - DNA, 37 bp, Artificial Sequence
  Synthetic oligonucleotide
tccatcctcggtccgagtactattcttaacttaatga

SEQ ID NO: 75912 - DNA, 38 bp, Artificial Sequence
  Synthetic oligonucleotide
tgaggcccgacggaaatttgcttcacacctgatcatga

SEQ ID NO: 75913 - DNA, 38 bp, Artificial Sequence
  Synthetic oligonucleotide
agatggggggcacagtgggaaatagggttgccggatga

SEQ ID NO: 75914 - DNA, 38 bp, Artificial Sequence
  Synthetic oligonucleotide
gcgatgcactccttcctcggcgtcattaggacctatga

SEQ ID NO: 75915 - DNA, 38 bp, Artificial Sequence
  Synthetic oligonucleotide
acccgaccctcgtgcctgctaacgaacaattcttatga

SEQ ID NO: 75916 - DNA, 37 bp, Artificial Sequence
  Synthetic oligonucleotide
gaccggcctctggtgagggcgggggggacttttatga

SEQ ID NO: 75917 - DNA, 37 bp, Artificial Sequence
  Synthetic oligonucleotide
tgaccatgtgccgccctacgtttgtccgctccactga

SEQ ID NO: 75918 - DNA, 38 bp, Artificial Sequence
  Synthetic oligonucleotide
tccagtggctgtccccgcggacctatctccatcactga

SEQ ID NO: 75919 - DNA, 37 bp, Artificial Sequence
  Synthetic oligonucleotide
gaccctcatcggaatgagccacatatttactcactga

SEQ ID NO: 75920 - DNA, 38 bp, Artificial Sequence
  Synthetic oligonucleotide
gaggagcgcgcctattttttctgctgcggctcacctga

SEQ ID NO: 75921 - DNA, 36 bp, Artificial Sequence
  Synthetic oligonucleotide
gccggtctcaacgcctaggcctatcgggttacctga

SEQ ID NO: 75922 - DNA, 38 bp, Artificial Sequence
  Synthetic oligonucleotide
gaacaacggctatagcaccacgacaccagacgccctga

SEQ ID NO: 75923 - DNA, 38 bp, Artificial Sequence
  Synthetic oligonucleotide
acaagccgtgcgcatcactctaccaccgccgttcctga

SEQ ID NO: 75924 - DNA, 37 bp, Artificial Sequence
  Synthetic oligonucleotide
agggtgaaccatctgcaattaaggcctgccgctctga

SEQ ID NO: 75925 - DNA, 37 bp, Artificial Sequence
  Synthetic oligonucleotide
tatctcgcacacctgtctacacgactagtcgttctga

SEQ ID NO: 75926 - DNA, 38 bp, Artificial Sequence
  Synthetic oligonucleotide
acttcggggtaggtaggtgaggggggaggcgtaagtga

SEQ ID NO: 75927 - DNA, 38 bp, Artificial Sequence
  Synthetic oligonucleotide
atcgccttcccacatttgtcatgtgcctctgccagtga

SEQ ID NO: 75928 - DNA, 38 bp, Artificial Sequence
  Synthetic oligonucleotide
atgacccatgggcctatgtctttaactccctttagtga

SEQ ID NO: 75929 - DNA, 37 bp, Artificial Sequence
  Synthetic oligonucleotide
agatccacaacaattccgaggtccaaccgagacgtga

SEQ ID NO: 75930 - DNA, 38 bp, Artificial Sequence
  Synthetic oligonucleotide
actccgtgccaacgtttgcgtacatcttatcaccgtga

SEQ ID NO: 75931 - DNA, 37 bp, Artificial Sequence
  Synthetic oligonucleotide
tcgcacgcaacagcgggcccttactgagttttcgtga

SEQ ID NO: 75932 - DNA, 38 bp, Artificial Sequence
  Synthetic oligonucleotide
acagccaccttaatttcgcaatgctccgccctcggtga

SEQ ID NO: 75933 - DNA, 38 bp, Artificial Sequence
  Synthetic oligonucleotide
actcacccgtactgctgctgttaccaagtggctggtga

SEQ ID NO: 75934 - DNA, 38 bp, Artificial Sequence
  Synthetic oligonucleotide
tgacgcacgaactggggggaaggtacagtaaactgtga

SEQ ID NO: 75935 - DNA, 38 bp, Artificial Sequence
  Synthetic oligonucleotide
gttcaatcgctcgaggctggtttttcctccaatattga

SEQ ID NO: 75936 - DNA, 38 bp, Artificial Sequence
  Synthetic oligonucleotide
agattcccgccgccgcgaaacaacactcatcaacttga

SEQ ID NO: 75937 - DNA, 38 bp, Artificial Sequence
  Synthetic oligonucleotide
acccggtgcactccaactcgaaccgctcccttccttga

SEQ ID NO: 75938 - DNA, 38 bp, Artificial Sequence
  Synthetic oligonucleotide
accgcacaatctgtgcgacataccaattatatgcttga

SEQ ID NO: 75939 - DNA, 38 bp, Artificial Sequence
  Synthetic oligonucleotide
tgcaactgctcgtctgcgttcctcctggtgcctcttga

SEQ ID NO: 75940 - DNA, 38 bp, Artificial Sequence
  Synthetic oligonucleotide
atccgcacttggctacccattccctataagatcgttga

SEQ ID NO: 75941 - DNA, 37 bp, Artificial Sequence
  Synthetic oligonucleotide
actgtggggggccaatgatgcggaattggcactttga

SEQ ID NO: 75942 - DNA, 37 bp, Artificial Sequence
  Synthetic oligonucleotide
accttcacctcgtgccctgtggaatatatccttttga

SEQ ID NO: 75943 - DNA, 36 bp, Artificial Sequence
  Synthetic oligonucleotide
actccacgaggcctaaataatgccacaccaacgata

SEQ ID NO: 75944 - DNA, 35 bp, Artificial Sequence
  Synthetic oligonucleotide
agaacacacacaattgggggggtcacttacaccta

SEQ ID NO: 75945 - DNA, 36 bp, Artificial Sequence
  Synthetic oligonucleotide
gtggggcatatgattgtattgccacacacacctcta

SEQ ID NO: 75946 - DNA, 36 bp, Artificial Sequence
  Synthetic oligonucleotide
gaggacgcccgagtcccttattttgatccgtttcta

SEQ ID NO: 75947 - DNA, 36 bp, Artificial Sequence
  Synthetic oligonucleotide
tcgagagccaccggcggcgacctttccgtccctgta

SEQ ID NO: 75948 - DNA, 36 bp, Artificial Sequence
  Synthetic oligonucleotide
tgccatccgcaagtatattttagttctttgcattta

SEQ ID NO: 75949 - DNA, 35 bp, Artificial Sequence
  Synthetic oligonucleotide
ggtgctcatcagcctctatcatccagcctgcaaac

SEQ ID NO: 75950 - DNA, 35 bp, Artificial Sequence
  Synthetic oligonucleotide
acctgacgaatgcgtctctgtcaaactccctgcac

SEQ ID NO: 75951 - DNA, 35 bp, Artificial Sequence
  Synthetic oligonucleotide
gctgctgatcctgacccctccaaaagtcactttac

SEQ ID NO: 75952 - DNA, 35 bp, Artificial Sequence
  Synthetic oligonucleotide
acgttccatcaatgcttgctacttagtccctgacc

SEQ ID NO: 75953 - DNA, 35 bp, Artificial Sequence
  Synthetic oligonucleotide
ggatccgtcccaaacccgcatgccgaggcttcccc

SEQ ID NO: 75954 - DNA, 35 bp, Artificial Sequence
  Synthetic oligonucleotide
acacgcggcacattgtcccagcacgcattacgccc

SEQ ID NO: 75955 - DNA, 35 bp, Artificial Sequence
  Synthetic oligonucleotide
gccctggcgtaccgttatctcacccaatacaatcc

SEQ ID NO: 75956 - DNA, 35 bp, Artificial Sequence
  Synthetic oligonucleotide
ttgatcctaccagcacatcagccacctgggccagc

SEQ ID NO: 75957 - DNA, 35 bp, Artificial Sequence
  Synthetic oligonucleotide
gtgtccgaggagaggaatgagtgagggaggaaggc

SEQ ID NO: 75958 - DNA, 35 bp, Artificial Sequence
  Synthetic oligonucleotide
gaaagccgagcctggtccctttttcccgttctatc

SEQ ID NO: 75959 - DNA, 35 bp, Artificial Sequence
  Synthetic oligonucleotide
tcaccatcagtcgtacaagacggagtgctgttatc

SEQ ID NO: 75960 - DNA, 35 bp, Artificial Sequence
  Synthetic oligonucleotide
acacgtgtccgcacccaacttgggcctcggtcctc

SEQ ID NO: 75961 - DNA, 35 bp, Artificial Sequence
  Synthetic oligonucleotide
tagaaaggggacaaagggtggtagggcagtaggtc

SEQ ID NO: 75962 - DNA, 35 bp, Artificial Sequence
  Synthetic oligonucleotide
gttggcaaaagcaatatctaagcagttcgcccttc

SEQ ID NO: 75963 - DNA, 35 bp, Artificial Sequence
  Synthetic oligonucleotide
agttcagggcctacggtgaacatgggaagggaaag

SEQ ID NO: 75964 - DNA, 35 bp, Artificial Sequence
  Synthetic oligonucleotide
agcaccgattcatcctgtcactgacccgcacccag

SEQ ID NO: 75965 - DNA, 35 bp, Artificial Sequence
  Synthetic oligonucleotide
aacccgcctacatgggtccaccgccttccagccag

SEQ ID NO: 75966 - DNA, 35 bp, Artificial Sequence
  Synthetic oligonucleotide
ggttctccaccacttgctttgtgctgcctcccgag

SEQ ID NO: 75967 - DNA, 35 bp, Artificial Sequence
  Synthetic oligonucleotide
gtggggggacgggggggggtggcaagaatgggtag

SEQ ID NO: 75968 - DNA, 35 bp, Artificial Sequence
  Synthetic oligonucleotide
tgtgacctccgtgctgctctcttacacctccaacg

SEQ ID NO: 75969 - DNA, 35 bp, Artificial Sequence
  Synthetic oligonucleotide
tcatggcgaggggaacaggagaggtcattgcagcg

SEQ ID NO: 75970 - DNA, 35 bp, Artificial Sequence
  Synthetic oligonucleotide
gtgacaaaatggcaaggaacagagagggcaccgcg

SEQ ID NO: 75971 - DNA, 35 bp, Artificial Sequence
  Synthetic oligonucleotide
agtaatggaagggacgagggtaggtagggccgggg

SEQ ID NO: 75972 - DNA, 35 bp, Artificial Sequence
  Synthetic oligonucleotide
gaggagaagcttcaaaaagaggggacggggcctgg

SEQ ID NO: 75973 - DNA, 35 bp, Artificial Sequence
  Synthetic oligonucleotide
tttgggaagtaacgggaaaaggaaaaggagtctgg

SEQ ID NO: 75974 - DNA, 35 bp, Artificial Sequence
  Synthetic oligonucleotide
acacgaatagcgatcaggggtgctgtcaatggtgg

SEQ ID NO: 75975 - DNA, 35 bp, Artificial Sequence
  Synthetic oligonucleotide
tgatgggctctccatggtaacaattcaatttcatg

SEQ ID NO: 75976 - DNA, 35 bp, Artificial Sequence
  Synthetic oligonucleotide
aaccctcctctgacataaactgcttactaagtatg

SEQ ID NO: 75977 - DNA, 35 bp, Artificial Sequence
  Synthetic oligonucleotide
agcctggtgcatcccttgatttcatactctcactg

SEQ ID NO: 75978 - DNA, 35 bp, Artificial Sequence
  Synthetic oligonucleotide
agccaattgtgcgccgaccctctgcttgctgcctg

SEQ ID NO: 75979 - DNA, 35 bp, Artificial Sequence
  Synthetic oligonucleotide
acttcacagaccccgccgttccaccttaccagttg

SEQ ID NO: 75980 - DNA, 35 bp, Artificial Sequence
  Synthetic oligonucleotide
gtgacaccgagagtagcgggccatttacgtatttg

SEQ ID NO: 75981 - DNA, 35 bp, Artificial Sequence
  Synthetic oligonucleotide
tgccctatcctcttctttgcctgctgggcactaat

SEQ ID NO: 75982 - DNA, 35 bp, Artificial Sequence
  Synthetic oligonucleotide
gcaacacccagcacctacatctggccctgatacat

SEQ ID NO: 75983 - DNA, 35 bp, Artificial Sequence
  Synthetic oligonucleotide
gcctccgccccatcgcttgtgggatttacaaatat

SEQ ID NO: 75984 - DNA, 35 bp, Artificial Sequence
  Synthetic oligonucleotide
tcacttcgctccatacgccctttatagtttcgact

SEQ ID NO: 75985 - DNA, 35 bp, Artificial Sequence
  Synthetic oligonucleotide
agaagaggtgcaaaacaagggggtgtggggtgact

SEQ ID NO: 75986 - DNA, 35 bp, Artificial Sequence
  Synthetic oligonucleotide
gatgttaggccccataccatgcactgctcctgcct

SEQ ID NO: 75987 - DNA, 35 bp, Artificial Sequence
  Synthetic oligonucleotide
acccggtgcgtgtttacgtcacacacttcgttgct

SEQ ID NO: 75988 - DNA, 35 bp, Artificial Sequence
  Synthetic oligonucleotide
atccaaccaccggcttcctgaataagctatgctct

SEQ ID NO: 75989 - DNA, 35 bp, Artificial Sequence
  Synthetic oligonucleotide
tacgcagagttatgaggggtggacggggatatggt

SEQ ID NO: 75990 - DNA, 35 bp, Artificial Sequence
  Synthetic oligonucleotide
tgtggaggacaagggggatggaccaggacgactgt

SEQ ID NO: 75991 - DNA, 35 bp, Artificial Sequence
  Synthetic oligonucleotide
attaacccattgagtgcccatttgcagacctttgt

SEQ ID NO: 75992 - DNA, 35 bp, Artificial Sequence
  Synthetic oligonucleotide
acggacgaagctctgttccactctttcatctcatt

SEQ ID NO: 75993 - DNA, 35 bp, Artificial Sequence
  Synthetic oligonucleotide
tgcgctggttgccgcttagtacttgtcccacactt

SEQ ID NO: 75994 - DNA, 35 bp, Artificial Sequence
  Synthetic oligonucleotide
gatacgccattcggtggggagcgggtttggaagtt

SEQ ID NO: 75995 - DNA, 35 bp, Artificial Sequence
  Synthetic oligonucleotide
gcccgtctcgctctacctgctatcagcgctccgtt

SEQ ID NO: 75996 - DNA, 35 bp, Artificial Sequence
  Synthetic oligonucleotide
tgagtcgcagttaccaggggggaggtgtgtgggtt

SEQ ID NO: 75997 - DNA, 35 bp, Artificial Sequence
  Synthetic oligonucleotide
tgggtctcacgaatcggttctttcgcctgctgttt

SEQ ID NO: 75998 - DNA, 36 bp, Artificial Sequence
  Synthetic oligonucleotide
tagacgggcccacggctgtccctattcgaacctaaa

SEQ ID NO: 75999 - DNA, 36 bp, Artificial Sequence
  Synthetic oligonucleotide
atccactccacctctgacgaacgcccggtaatacaa

SEQ ID NO: 76000 - DNA, 36 bp, Artificial Sequence
  Synthetic oligonucleotide
atcacccatccgtggcataccaggcctcccgtccaa

SEQ ID NO: 76001 - DNA, 35 bp, Artificial Sequence
  Synthetic oligonucleotide
gagccgaggggctccggactagcagacagtcgcaa

SEQ ID NO: 76002 - DNA, 35 bp, Artificial Sequence
  Synthetic oligonucleotide
gtagggttgacgaaccggagcagcaggggaacgaa

SEQ ID NO: 76003 - DNA, 35 bp, Artificial Sequence
  Synthetic oligonucleotide
ggaacgggtgaacaggggagatagcccgtagataa

SEQ ID NO: 76004 - DNA, 36 bp, Artificial Sequence
  Synthetic oligonucleotide
gagacggtgaggctgccgggaagggagtatcgttaa

SEQ ID NO: 76005 - DNA, 36 bp, Artificial Sequence
  Synthetic oligonucleotide
gcgatcaggcgtgcaaattgcccccccggtacaaca

SEQ ID NO: 76006 - DNA, 36 bp, Artificial Sequence
  Synthetic oligonucleotide
gcatgtacgccctctgatcccctgctctcttgaaca

SEQ ID NO: 76007 - DNA, 36 bp, Artificial Sequence
  Synthetic oligonucleotide
ttgtacgaccgtcttacctcctccggctccagacca

SEQ ID NO: 76008 - DNA, 35 bp, Artificial Sequence
  Synthetic oligonucleotide
gacgtgcccaatcgtcgaacctcctgcgtttacca

SEQ ID NO: 76009 - DNA, 36 bp, Artificial Sequence
  Synthetic oligonucleotide
gaatgggccagccttaccccgaagtctctcaagcca

SEQ ID NO: 76010 - DNA, 36 bp, Artificial Sequence
  Synthetic oligonucleotide
gaggtgggaggaactaattcgacgagaggctaagca

SEQ ID NO: 76011 - DNA, 35 bp, Artificial Sequence
  Synthetic oligonucleotide
tggtgctatgggctgggtgctgcaagggggaggca

SEQ ID NO: 76012 - DNA, 36 bp, Artificial Sequence
  Synthetic oligonucleotide
tgacccgcgcctcatactcgcctcccggttcgggca

SEQ ID NO: 76013 - DNA, 36 bp, Artificial Sequence
  Synthetic oligonucleotide
tcccattcacccctgtagaaccgttctgcacctgca

SEQ ID NO: 76014 - DNA, 36 bp, Artificial Sequence
  Synthetic oligonucleotide
acgaccttctcagcacgatctcagccacatcaatca

SEQ ID NO: 76015 - DNA, 36 bp, Artificial Sequence
  Synthetic oligonucleotide
gccgtgcccgggtggccgtatcaccatcctagatca

SEQ ID NO: 76016 - DNA, 36 bp, Artificial Sequence
  Synthetic oligonucleotide
gaggcgcagaatcccgtcgcctgtctaacaccttca

SEQ ID NO: 76017 - DNA, 36 bp, Artificial Sequence
  Synthetic oligonucleotide
ttcgagcagtctattaccgttctagttaggccttca

SEQ ID NO: 76018 - DNA, 37 bp, Artificial Sequence
  Synthetic oligonucleotide
gcccaccactgtcttggttctttcgtactccggaaga

SEQ ID NO: 76019 - DNA, 37 bp, Artificial Sequence
  Synthetic oligonucleotide
atcgagaggtgagacacgcgggggacaagggtagaga

SEQ ID NO: 76020 - DNA, 36 bp, Artificial Sequence
  Synthetic oligonucleotide
tccgtgatgaaaagggataaaaggtgacagcggaga

SEQ ID NO: 76021 - DNA, 37 bp, Artificial Sequence
  Synthetic oligonucleotide
gcccacgatcatatcgttgccttttggaccttggaga

SEQ ID NO: 76022 - DNA, 37 bp, Artificial Sequence
  Synthetic oligonucleotide
ttgaaacccgtcatctcgccgcctaagttcagctaga

SEQ ID NO: 76023 - DNA, 37 bp, Artificial Sequence
  Synthetic oligonucleotide
agcccatcaccacagccattcctaccagtccgctaga

SEQ ID NO: 76024 - DNA, 37 bp, Artificial Sequence
  Synthetic oligonucleotide
gccccatcttgtggaactgtgtcccatacctccacga

SEQ ID NO: 76025 - DNA, 37 bp, Artificial Sequence
  Synthetic oligonucleotide
ttcgtctcgccagcccgcccttcccaacttcggacga

SEQ ID NO: 76026 - DNA, 35 bp, Artificial Sequence
  Synthetic oligonucleotide
gacacccgaagagagccctatgaacgcgtacccga

SEQ ID NO: 76027 - DNA, 37 bp, Artificial Sequence
  Synthetic oligonucleotide
acttctctcagtcgctgtaatgtcgtccccgccccga

SEQ ID NO: 76028 - DNA, 36 bp, Artificial Sequence
  Synthetic oligonucleotide
agcgaagcgtgcggccctgaattgccaacatcccga

SEQ ID NO: 76029 - DNA, 36 bp, Artificial Sequence
  Synthetic oligonucleotide
agagagggagtgtttgtcggggagtggacggcgcga

SEQ ID NO: 76030 - DNA, 37 bp, Artificial Sequence
  Synthetic oligonucleotide
gatcatcccccaaccctccccaacagtagcgctgcga

SEQ ID NO: 76031 - DNA, 37 bp, Artificial Sequence
  Synthetic oligonucleotide
gaaaaccactgcacaactggcaccttcgtgagaagga

SEQ ID NO: 76032 - DNA, 37 bp, Artificial Sequence
  Synthetic oligonucleotide
atggggcctcgccgaaaccaaacaactccatgaagga

SEQ ID NO: 76033 - DNA, 37 bp, Artificial Sequence
  Synthetic oligonucleotide
tcatcactccatgtttcccaaagccgaatttgacgga

SEQ ID NO: 76034 - DNA, 37 bp, Artificial Sequence
  Synthetic oligonucleotide
gaaacagccggtcatgaaggtgtggaaagtggaggga

SEQ ID NO: 76035 - DNA, 36 bp, Artificial Sequence
  Synthetic oligonucleotide
tccacccccggtcgaactggtcccctccgcagggga

SEQ ID NO: 76036 - DNA, 37 bp, Artificial Sequence
  Synthetic oligonucleotide
tcgaggggcgaggaagggtccggtggagtacggggga

SEQ ID NO: 76037 - DNA, 35 bp, Artificial Sequence
  Synthetic oligonucleotide
gacaagatgggctgtctattccagggtgggtggga

SEQ ID NO: 76038 - DNA, 37 bp, Artificial Sequence
  Synthetic oligonucleotide
actcgaaccattatatttgaccctgacgagacgtgga

SEQ ID NO: 76039 - DNA, 37 bp, Artificial Sequence
  Synthetic oligonucleotide
gctgcgggcggaaaagggtaggcgggctttgggtgga

SEQ ID NO: 76040 - DNA, 37 bp, Artificial Sequence
  Synthetic oligonucleotide
tcatcaccctacgcatcccttaaggtaacaggaatga

SEQ ID NO: 76041 - DNA, 36 bp, Artificial Sequence
  Synthetic oligonucleotide
gtgcgatgtgaagcaggaggatatgggtggtaatga

SEQ ID NO: 76042 - DNA, 37 bp, Artificial Sequence
  Synthetic oligonucleotide
acgcgacgcctagggtcacaacccattcctcacatga

SEQ ID NO: 76043 - DNA, 38 bp, Artificial Sequence
  Synthetic oligonucleotide
gtcgggaaaggggggggtaaatagccagaggtacatga

SEQ ID NO: 76044 - DNA, 38 bp, Artificial Sequence
  Synthetic oligonucleotide
gtaactgtcggaaacagggagggaacgggcaatgatga

SEQ ID NO: 76045 - DNA, 38 bp, Artificial Sequence
  Synthetic oligonucleotide
aagttgggggcaggagagtgcgcgaacgggggtgatga

SEQ ID NO: 76046 - DNA, 37 bp, Artificial Sequence
  Synthetic oligonucleotide
gtcaacccatcgtgcattcaaaagtgccccaatatga

SEQ ID NO: 76047 - DNA, 38 bp, Artificial Sequence
  Synthetic oligonucleotide
gtgccaccaaccatctagtgagacactggtatctatga

SEQ ID NO: 76048 - DNA, 38 bp, Artificial Sequence
  Synthetic oligonucleotide
gatcggtgcggggcgggctcaggggactggcggtatga

SEQ ID NO: 76049 - DNA, 38 bp, Artificial Sequence
  Synthetic oligonucleotide
acataaccaccccactcacggaagtatgcagatactga

SEQ ID NO: 76050 - DNA, 38 bp, Artificial Sequence
  Synthetic oligonucleotide
gttgggggcagaaagaggcaagggaccgtttggcctga

SEQ ID NO: 76051 - DNA, 38 bp, Artificial Sequence
  Synthetic oligonucleotide
tctaagagctgcctccttgaatgtctatcttctcctga

SEQ ID NO: 76052 - DNA, 38 bp, Artificial Sequence
  Synthetic oligonucleotide
tcgtaccttcacccatccctatccggctgttttcctga

SEQ ID NO: 76053 - DNA, 37 bp, Artificial Sequence
  Synthetic oligonucleotide
gcctccacccctggactcgagccctgtagctcgctga

SEQ ID NO: 76054 - DNA, 38 bp, Artificial Sequence
  Synthetic oligonucleotide
ggtgggagagatggaaggtggggttcgcgacgggctga

SEQ ID NO: 76055 - DNA, 37 bp, Artificial Sequence
  Synthetic oligonucleotide
gcgatacgtttgcgcgaattcaccggtccgactctga

SEQ ID NO: 76056 - DNA, 38 bp, Artificial Sequence
  Synthetic oligonucleotide
ggaacagcagagggccgggtatgaggggatggacgtga

SEQ ID NO: 76057 - DNA, 38 bp, Artificial Sequence
  Synthetic oligonucleotide
gtcacacaggaggccagagtacatccatattgcggtga

SEQ ID NO: 76058 - DNA, 37 bp, Artificial Sequence
  Synthetic oligonucleotide
atggtccacacgccccatgagaactcttcctttgtga

SEQ ID NO: 76059 - DNA, 38 bp, Artificial Sequence
  Synthetic oligonucleotide
ggggatggttgagggggggaaaacgagatggtttgtga

SEQ ID NO: 76060 - DNA, 37 bp, Artificial Sequence
  Synthetic oligonucleotide
ttgaccgcacaggtggcgcattgggtagacaaattga

SEQ ID NO: 76061 - DNA, 38 bp, Artificial Sequence
  Synthetic oligonucleotide
ggggtgttgccaacgggagggacggggtagcatattga

SEQ ID NO: 76062 - DNA, 37 bp, Artificial Sequence
  Synthetic oligonucleotide
atgtcccggtccgccttatcgcatcgattcaccttga

SEQ ID NO: 76063 - DNA, 36 bp, Artificial Sequence
  Synthetic oligonucleotide
accacctcaatgcctgatgcgaaaccgtccccttga

SEQ ID NO: 76064 - DNA, 38 bp, Artificial Sequence
  Synthetic oligonucleotide
accggtccgcccaatctctatagaatatccgttgttga

SEQ ID NO: 76065 - DNA, 38 bp, Artificial Sequence
  Synthetic oligonucleotide
accctcgccggtgactctctcctgcttaaatcctttga

SEQ ID NO: 76066 - DNA, 38 bp, Artificial Sequence
  Synthetic oligonucleotide
gacgacccgtctctgttgattgtactcaacgcgtttga

SEQ ID NO: 76067 - DNA, 36 bp, Artificial Sequence
  Synthetic oligonucleotide
taccaggctacatcgtttattaacaccctcgaaata

SEQ ID NO: 76068 - DNA, 36 bp, Artificial Sequence
  Synthetic oligonucleotide
tagtgcccattaaaggggcttctttacatactcgta

SEQ ID NO: 76069 - DNA, 36 bp, Artificial Sequence
  Synthetic oligonucleotide
aagaggcgggagaggggggtcaattggaatgctgta

SEQ ID NO: 76070 - DNA, 35 bp, Artificial Sequence
  Synthetic oligonucleotide
gcgattgcaacatcctttactatagctagtgctta

SEQ ID NO: 76071 - DNA, 35 bp, Artificial Sequence
  Synthetic oligonucleotide
taacatcggcggggcactctccgtcccacctctta

SEQ ID NO: 76072 - DNA, 35 bp, Artificial Sequence
  Synthetic oligonucleotide
tgagaactaccctgcgaacagctccgcacttttta

SEQ ID NO: 76073 - DNA, 35 bp, Artificial Sequence
  Synthetic oligonucleotide
ggcccccatgaattcgaatctgttgtcctcctcac

SEQ ID NO: 76074 - DNA, 35 bp, Artificial Sequence
  Synthetic oligonucleotide
tatcgtgcatgcctcctcgagccccagtatgctac

SEQ ID NO: 76075 - DNA, 35 bp, Artificial Sequence
  Synthetic oligonucleotide
gtgcacgcgcccctattgtcccattccatcgcccc

SEQ ID NO: 76076 - DNA, 35 bp, Artificial Sequence
  Synthetic oligonucleotide
aacccacgctttgtgtatccacatgttaaaccgcc

SEQ ID NO: 76077 - DNA, 36 bp, Artificial Sequence
  Synthetic oligonucleotide
tcactcctccggccacacgactccgccttcgcctgc

SEQ ID NO: 76078 - DNA, 35 bp, Artificial Sequence
  Synthetic oligonucleotide
gctggaccccatcggctcatatcatcatcgcttgc

SEQ ID NO: 76079 - DNA, 35 bp, Artificial Sequence
  Synthetic oligonucleotide
acgtccaacccaaataacccgccatgtcgaccatc

SEQ ID NO: 76080 - DNA, 35 bp, Artificial Sequence
  Synthetic oligonucleotide
tcacggccacctcccatctacctccaagatttatc

SEQ ID NO: 76081 - DNA, 35 bp, Artificial Sequence
  Synthetic oligonucleotide
gctcccatcgcaaactatcagcccgctagtaactc

SEQ ID NO: 76082 - DNA, 35 bp, Artificial Sequence
  Synthetic oligonucleotide
gtcaagctgtgagtctcgctttgcatattacgctc

SEQ ID NO: 76083 - DNA, 35 bp, Artificial Sequence
  Synthetic oligonucleotide
tgagcacaacgcgagtctcgtatcttacggttgtc

SEQ ID NO: 76084 - DNA, 35 bp, Artificial Sequence
  Synthetic oligonucleotide
ccaccccagattacctgcttcctcatggaccgttc

SEQ ID NO: 76085 - DNA, 35 bp, Artificial Sequence
  Synthetic oligonucleotide
gcgccaagggctggggagggagaaggggatcgttc

SEQ ID NO: 76086 - DNA, 35 bp, Artificial Sequence
  Synthetic oligonucleotide
ggtggccactcgctatgctttgccccctaaccacg

SEQ ID NO: 76087 - DNA, 35 bp, Artificial Sequence
  Synthetic oligonucleotide
atgtaacaggctggcgaaattacttctctcccacg

SEQ ID NO: 76088 - DNA, 35 bp, Artificial Sequence
  Synthetic oligonucleotide
gtcgcacatgctgaaaaacctgttcctctgacttg

SEQ ID NO: 76089 - DNA, 35 bp, Artificial Sequence
  Synthetic oligonucleotide
tcaaccaccaagtgaagtcgccctcacatagcttg

SEQ ID NO: 76090 - DNA, 35 bp, Artificial Sequence
  Synthetic oligonucleotide
ggacggtccccggctcggttctcattttacgctat

SEQ ID NO: 76091 - DNA, 35 bp, Artificial Sequence
  Synthetic oligonucleotide
tcgctgacccgccggaagcttacttacttacaact

SEQ ID NO: 76092 - DNA, 35 bp, Artificial Sequence
  Synthetic oligonucleotide
gcaagttgcctctgtcgtttcgcatgcgatcccct

SEQ ID NO: 76093 - DNA, 35 bp, Artificial Sequence
  Synthetic oligonucleotide
aaccgctatcggcctacacttttcgattacctgct

SEQ ID NO: 76094 - DNA, 34 bp, Artificial Sequence
  Synthetic oligonucleotide
atgccctgaccctgccctccttgtttaccctggt

SEQ ID NO: 76095 - DNA, 35 bp, Artificial Sequence
  Synthetic oligonucleotide
tcccactccgtccggcccccccgtcccatgcctgt

SEQ ID NO: 76096 - DNA, 35 bp, Artificial Sequence
  Synthetic oligonucleotide
ttcctcgtcacatctccttgggcctcagtctattt

SEQ ID NO: 76097 - DNA, 35 bp, Artificial Sequence
  Synthetic oligonucleotide
ttacatccacgttgtgatcggccttgtgattcttt

SEQ ID NO: 76098 - DNA, 36 bp, Artificial Sequence
  Synthetic oligonucleotide
aacagggcctcgcaccacgtgccactcgaaccccaa

SEQ ID NO: 76099 - DNA, 36 bp, Artificial Sequence
  Synthetic oligonucleotide
gatgactaccggagtcggtggggacggaagaagcaa

SEQ ID NO: 76100 - DNA, 35 bp, Artificial Sequence
  Synthetic oligonucleotide
gcactacccatgttcatttgctcgtcccggacgaa

SEQ ID NO: 76101 - DNA, 36 bp, Artificial Sequence
  Synthetic oligonucleotide
gcatagacgttgggagtgggagggggcaggtcggaa

SEQ ID NO: 76102 - DNA, 36 bp, Artificial Sequence
  Synthetic oligonucleotide
gcaagcccggaacctgataactctcgtctacgaaca

SEQ ID NO: 76103 - DNA, 35 bp, Artificial Sequence
  Synthetic oligonucleotide
aaagctgggaaggggggcgcaaaataaagggaaca

SEQ ID NO: 76104 - DNA, 35 bp, Artificial Sequence
  Synthetic oligonucleotide
agcctcgggccccttttacgccttggctcccacca

SEQ ID NO: 76105 - DNA, 35 bp, Artificial Sequence
  Synthetic oligonucleotide
ttccaaacccattgatctctatctccagggcacca

SEQ ID NO: 76106 - DNA, 35 bp, Artificial Sequence
  Synthetic oligonucleotide
gaatttccacaggacgttgacgacgcactctacca

SEQ ID NO: 76107 - DNA, 36 bp, Artificial Sequence
  Synthetic oligonucleotide
ggttacgatcaggtcgtccgggatcccaccccccca

SEQ ID NO: 76108 - DNA, 36 bp, Artificial Sequence
  Synthetic oligonucleotide
atcatgcgggcaatattacttgtggtagtccggcca

SEQ ID NO: 76109 - DNA, 36 bp, Artificial Sequence
  Synthetic oligonucleotide
tcgccactcggcctacggattacacttgctatgcca

SEQ ID NO: 76110 - DNA, 36 bp, Artificial Sequence
  Synthetic oligonucleotide
gactgaagcgtcatggcgagtgcttctttttctcca

SEQ ID NO: 76111 - DNA, 36 bp, Artificial Sequence
  Synthetic oligonucleotide
gacaaatcatggctgaacacgaagcacgcccttcca

SEQ ID NO: 76112 - DNA, 36 bp, Artificial Sequence
  Synthetic oligonucleotide
ggtgcccatgtcgatcagaccttcacaccatttcca

SEQ ID NO: 76113 - DNA, 36 bp, Artificial Sequence
  Synthetic oligonucleotide
tctcgacccagctgcgaacttcccagcgttaccgca

SEQ ID NO: 76114 - DNA, 34 bp, Artificial Sequence
  Synthetic oligonucleotide
gtctgcgctgcgggtactatcacttcttgcggca

SEQ ID NO: 76115 - DNA, 35 bp, Artificial Sequence
  Synthetic oligonucleotide
ttagaggggcggcacgggcaatttcgggaagggca

SEQ ID NO: 76116 - DNA, 36 bp, Artificial Sequence
  Synthetic oligonucleotide
tccactgcatgcgataatatagcacataggccatca

SEQ ID NO: 76117 - DNA, 36 bp, Artificial Sequence
  Synthetic oligonucleotide
ttaggctacacacttccctgccgtttggtacactca

SEQ ID NO: 76118 - DNA, 36 bp, Artificial Sequence
  Synthetic oligonucleotide
gcacgctgtgcgtaggaccacctcactcgccactca

SEQ ID NO: 76119 - DNA, 36 bp, Artificial Sequence
  Synthetic oligonucleotide
atcccacgcggcatttacccgttactcgcgatgtca

SEQ ID NO: 76120 - DNA, 37 bp, Artificial Sequence
  Synthetic oligonucleotide
taggggagggggggttaaacgagcgtgcttagccaga

SEQ ID NO: 76121 - DNA, 37 bp, Artificial Sequence
  Synthetic oligonucleotide
gaaagccgccccagccgtcgcctacatgacaccgaga

SEQ ID NO: 76122 - DNA, 37 bp, Artificial Sequence
  Synthetic oligonucleotide
tgtctgccggccgtctgtctctgtctctctaatccga

SEQ ID NO: 76123 - DNA, 37 bp, Artificial Sequence
  Synthetic oligonucleotide
atgtggtgaagaccaggtgggtatggggaatgagcga

SEQ ID NO: 76124 - DNA, 37 bp, Artificial Sequence
  Synthetic oligonucleotide
gagtctcttcacccatcgtcataacaccattctgcga

SEQ ID NO: 76125 - DNA, 37 bp, Artificial Sequence
  Synthetic oligonucleotide
gagcattctgctgccccgctccctatttaaattgcga

SEQ ID NO: 76126 - DNA, 37 bp, Artificial Sequence
  Synthetic oligonucleotide
accgggcgaaacaatgggctgggcggagaggggtcga

SEQ ID NO: 76127 - DNA, 37 bp, Artificial Sequence
  Synthetic oligonucleotide
gttccctcccaaaactgttatctacgggtcgtttcga

SEQ ID NO: 76128 - DNA, 37 bp, Artificial Sequence
  Synthetic oligonucleotide
agcaacctccaactcccatctgctcccgtgttccgga

SEQ ID NO: 76129 - DNA, 37 bp, Artificial Sequence
  Synthetic oligonucleotide
tccacgaacgagtatccctccctgccgccgaagcgga

SEQ ID NO: 76130 - DNA, 37 bp, Artificial Sequence
  Synthetic oligonucleotide
gatgcatccgtgccctcaccgccctacgatgtgcgga

SEQ ID NO: 76131 - DNA, 37 bp, Artificial Sequence
  Synthetic oligonucleotide
ggtaaaggggaagggggctagggtgagtgagttcgga

SEQ ID NO: 76132 - DNA, 37 bp, Artificial Sequence
  Synthetic oligonucleotide
gacgatcggcacgtacagcaatctggaagcaaaggga

SEQ ID NO: 76133 - DNA, 35 bp, Artificial Sequence
  Synthetic oligonucleotide
gtggggaaaagggttcgggttcaagaacgtaggga

SEQ ID NO: 76134 - DNA, 37 bp, Artificial Sequence
  Synthetic oligonucleotide
gatcacccagtgaggggtaataccaaaggagagggga

SEQ ID NO: 76135 - DNA, 37 bp, Artificial Sequence
  Synthetic oligonucleotide
tacacgacacgtccttcgtaattccgccgccatggga

SEQ ID NO: 76136 - DNA, 37 bp, Artificial Sequence
  Synthetic oligonucleotide
ttgccacgcgcctctacacctctattcccctctggga

SEQ ID NO: 76137 - DNA, 37 bp, Artificial Sequence
  Synthetic oligonucleotide
agggagaaagggcgtgcgtgaatgggggtgggtggga

SEQ ID NO: 76138 - DNA, 36 bp, Artificial Sequence
  Synthetic oligonucleotide
aggtgcacgcacatctatgctccccaactttttgga

SEQ ID NO: 76139 - DNA, 37 bp, Artificial Sequence
  Synthetic oligonucleotide
tccgatcccggctacgatcctccacgggccatcatga

SEQ ID NO: 76140 - DNA, 38 bp, Artificial Sequence
  Synthetic oligonucleotide
tcaacaccagagcagccctcgacacaacctgatcatga

SEQ ID NO: 76141 - DNA, 38 bp, Artificial Sequence
  Synthetic oligonucleotide
gcattagttagggggtccggggactggtcaacggatga

SEQ ID NO: 76142 - DNA, 38 bp, Artificial Sequence
  Synthetic oligonucleotide
aaatgcgaaaaggggaaacagggcggagtgtgggatga

SEQ ID NO: 76143 - DNA, 38 bp, Artificial Sequence
  Synthetic oligonucleotide
tcaagagcgcaacgccccccggacactcccctggatga

SEQ ID NO: 76144 - DNA, 37 bp, Artificial Sequence
  Synthetic oligonucleotide
ggtgttgggtagggttgtaggtatgcctaggtgatga

SEQ ID NO: 76145 - DNA, 38 bp, Artificial Sequence
  Synthetic oligonucleotide
gggggggaaacgggtgggtagatggcgcgttgttatga

SEQ ID NO: 76146 - DNA, 37 bp, Artificial Sequence
  Synthetic oligonucleotide
gcaagggtgcgattgttcttgtttcaccactcactga

SEQ ID NO: 76147 - DNA, 38 bp, Artificial Sequence
  Synthetic oligonucleotide
tcgttgccccatgatccgctggtctttattcgtactga

SEQ ID NO: 76148 - DNA, 38 bp, Artificial Sequence
  Synthetic oligonucleotide
aacccccgcgcaagtatcggtatcattcctcgtgctga

SEQ ID NO: 76149 - DNA, 37 bp, Artificial Sequence
  Synthetic oligonucleotide
ggtcattcgacatctcccatcttgctgcacttgctga

SEQ ID NO: 76150 - DNA, 38 bp, Artificial Sequence
  Synthetic oligonucleotide
gcgatagccgctgccggtcgcattatgagggcctctga

SEQ ID NO: 76151 - DNA, 38 bp, Artificial Sequence
  Synthetic oligonucleotide
ggtgcgggccgttctatccgctgcttctacttctctga

SEQ ID NO: 76152 - DNA, 38 bp, Artificial Sequence
  Synthetic oligonucleotide
aacgcattcacagcgcatttcgcatctacccattctga

SEQ ID NO: 76153 - DNA, 37 bp, Artificial Sequence
  Synthetic oligonucleotide
tagtactgcggtaggctgacggaggtccagaaagtga

SEQ ID NO: 76154 - DNA, 37 bp, Artificial Sequence
  Synthetic oligonucleotide
acgcaaaaggtgaggaggatcaacgggagctcagtga

SEQ ID NO: 76155 - DNA, 38 bp, Artificial Sequence
  Synthetic oligonucleotide
gtgaacagtctgggggtaaggcgtacggtcaggagtga

SEQ ID NO: 76156 - DNA, 38 bp, Artificial Sequence
  Synthetic oligonucleotide
acgcccccacttttttgtgttttctccgccttgagtga

SEQ ID NO: 76157 - DNA, 38 bp, Artificial Sequence
  Synthetic oligonucleotide
taggaacgccacgcagacgtaacgtcttacatccgtga

SEQ ID NO: 76158 - DNA, 38 bp, Artificial Sequence
  Synthetic oligonucleotide
tacagtccaacggtggggtaagataggctgggcggtga

SEQ ID NO: 76159 - DNA, 38 bp, Artificial Sequence
  Synthetic oligonucleotide
accaccccgcggtccttgaaggtacatttgtaatgtga

SEQ ID NO: 76160 - DNA, 38 bp, Artificial Sequence
  Synthetic oligonucleotide
tcgatggtacttggaagggggtgggccggggtctgtga

SEQ ID NO: 76161 - DNA, 38 bp, Artificial Sequence
  Synthetic oligonucleotide
tcaccttggtggatgcagcctgccttttcgttctgtga

SEQ ID NO: 76162 - DNA, 38 bp, Artificial Sequence
  Synthetic oligonucleotide
gacgcgggagcgtgactccctatcccaccgtattgtga

SEQ ID NO: 76163 - DNA, 38 bp, Artificial Sequence
  Synthetic oligonucleotide
atgcccactggtccacattacggattgccgagcattga

SEQ ID NO: 76164 - DNA, 38 bp, Artificial Sequence
  Synthetic oligonucleotide
gatcgacccacaccgccttgagaggctcaccctattga

SEQ ID NO: 76165 - DNA, 38 bp, Artificial Sequence
  Synthetic oligonucleotide
tttagccacactgtcgccgcccataacccgacccttga

SEQ ID NO: 76166 - DNA, 37 bp, Artificial Sequence
  Synthetic oligonucleotide
actcgcagtggtgaatctgctaacgcttgccccttga

SEQ ID NO: 76167 - DNA, 37 bp, Artificial Sequence
  Synthetic oligonucleotide
tactccccggttgtaaatctgtgcctcacaatcttga

SEQ ID NO: 76168 - DNA, 37 bp, Artificial Sequence
  Synthetic oligonucleotide
tgaaggaggtatagatagggagcgatgggtgagttga

SEQ ID NO: 76169 - DNA, 37 bp, Artificial Sequence
  Synthetic oligonucleotide
taaaccgccgctctcccatatgatcagccgccgttga

SEQ ID NO: 76170 - DNA, 38 bp, Artificial Sequence
  Synthetic oligonucleotide
aaatagaggcatggggtgcaaggggtagataaggttga

SEQ ID NO: 76171 - DNA, 37 bp, Artificial Sequence
  Synthetic oligonucleotide
gacgcgtgtcttcaacatctgaccactgccactttga

SEQ ID NO: 76172 - DNA, 38 bp, Artificial Sequence
  Synthetic oligonucleotide
tatgcgctgccggacccctgatatcgttatcgttttga

SEQ ID NO: 76173 - DNA, 36 bp, Artificial Sequence
  Synthetic oligonucleotide
tctgccacgcgctttttttcgtcaccagggccgata

SEQ ID NO: 76174 - DNA, 36 bp, Artificial Sequence
  Synthetic oligonucleotide
gagccaaccgacatgctctgcatcattcgtgcacta

SEQ ID NO: 76175 - DNA, 36 bp, Artificial Sequence
  Synthetic oligonucleotide
actaccgctacatcactaactacgcgagtgtaccta

SEQ ID NO: 76176 - DNA, 36 bp, Artificial Sequence
  Synthetic oligonucleotide
agaccccgtactaccgggtaaagttatccctcccta

SEQ ID NO: 76177 - DNA, 35 bp, Artificial Sequence
  Synthetic oligonucleotide
acgcgcccggacttattaggtcacacatcacgcta

SEQ ID NO: 76178 - DNA, 35 bp, Artificial Sequence
  Synthetic oligonucleotide
gccgacaggtagtgggggggagtttaagaacggta

SEQ ID NO: 76179 - DNA, 36 bp, Artificial Sequence
  Synthetic oligonucleotide
atgtggccgaagggggggccggtgacagtaccggta

SEQ ID NO: 76180 - DNA, 36 bp, Artificial Sequence
  Synthetic oligonucleotide
gctccaaccacattgtaactgttcacggtacctgta

SEQ ID NO: 76181 - DNA, 36 bp, Artificial Sequence
  Synthetic oligonucleotide
gactgccactgaaactcatatggatcatgaatatta

SEQ ID NO: 76182 - DNA, 36 bp, Artificial Sequence
  Synthetic oligonucleotide
aaacaagcgagcacagcgcttggatagcagaattta

SEQ ID NO: 76183 - DNA, 36 bp, Artificial Sequence
  Synthetic oligonucleotide
tccaggcttgacaacagagtcatctccgcccattta

SEQ ID NO: 76184 - DNA, 36 bp, Artificial Sequence
  Synthetic oligonucleotide
acgctctggcggtagcctgctttactcctcagttta

SEQ ID NO: 76185 - DNA, 35 bp, Artificial Sequence
  Synthetic oligonucleotide
tctggctccacgaacgtctgtcgactccacctaac

SEQ ID NO: 76186 - DNA, 35 bp, Artificial Sequence
  Synthetic oligonucleotide
tgacatgctgaccaccttttgccttgcccttacac

SEQ ID NO: 76187 - DNA, 35 bp, Artificial Sequence
  Synthetic oligonucleotide
ataccgacgttcagccatagcaccctattacccac

SEQ ID NO: 76188 - DNA, 35 bp, Artificial Sequence
  Synthetic oligonucleotide
taaggagaggcacatcaacccatgttcctgtccac

SEQ ID NO: 76189 - DNA, 35 bp, Artificial Sequence
  Synthetic oligonucleotide
acaccatacatgagccctctcgccattgtctgcac

SEQ ID NO: 76190 - DNA, 35 bp, Artificial Sequence
  Synthetic oligonucleotide
tgaccccaccaatcttacgatcccgctggagggac

SEQ ID NO: 76191 - DNA, 35 bp, Artificial Sequence
  Synthetic oligonucleotide
ttcaaaccgggctatgcgcgactaatcaatgcacc

SEQ ID NO: 76192 - DNA, 36 bp, Artificial Sequence
  Synthetic oligonucleotide
gtccgccgtccttggctcatctaaacgtccgtgacc

SEQ ID NO: 76193 - DNA, 35 bp, Artificial Sequence
  Synthetic oligonucleotide
gcctcccagtcatccaaagcaaaccggcggtcccc

SEQ ID NO: 76194 - DNA, 35 bp, Artificial Sequence
  Synthetic oligonucleotide
agaccggataggacgtgaacgcgcctcttcttccc

SEQ ID NO: 76195 - DNA, 35 bp, Artificial Sequence
  Synthetic oligonucleotide
tacctgagtctaaccgcgtctgccacctagccgcc

SEQ ID NO: 76196 - DNA, 35 bp, Artificial Sequence
  Synthetic oligonucleotide
gagacttagaagggtgggggtaggcgtgaggggcc

SEQ ID NO: 76197 - DNA, 35 bp, Artificial Sequence
  Synthetic oligonucleotide
ttccaggctgcagctatccgtacgatttactggcc

SEQ ID NO: 76198 - DNA, 35 bp, Artificial Sequence
  Synthetic oligonucleotide
tcatgctcaccgacgcaccaagaatgtcgatatcc

SEQ ID NO: 76199 - DNA, 35 bp, Artificial Sequence
  Synthetic oligonucleotide
ggacggtcacatttcacccatcgtagtcttactcc

SEQ ID NO: 76200 - DNA, 35 bp, Artificial Sequence
  Synthetic oligonucleotide
cccgcacccccctcggttcgtcgctctgttctcgc

SEQ ID NO: 76201 - DNA, 35 bp, Artificial Sequence
  Synthetic oligonucleotide
tgtgccgtccgttgctttccgccccctcagccatc

SEQ ID NO: 76202 - DNA, 35 bp, Artificial Sequence
  Synthetic oligonucleotide
taagtcgcatgagctaaacgacacacgctgacctc

SEQ ID NO: 76203 - DNA, 35 bp, Artificial Sequence
  Synthetic oligonucleotide
tacatggtagttgcctcacggagcatcatctcctc

SEQ ID NO: 76204 - DNA, 35 bp, Artificial Sequence
  Synthetic oligonucleotide
acccacttgcagtttaaaggccctccccatgtctc

SEQ ID NO: 76205 - DNA, 35 bp, Artificial Sequence
  Synthetic oligonucleotide
atcgcgaaccctcgagggtcgctaaacaacacttc

SEQ ID NO: 76206 - DNA, 35 bp, Artificial Sequence
  Synthetic oligonucleotide
acattgtcatacgccagggcgaaaatcacaccttc

SEQ ID NO: 76207 - DNA, 35 bp, Artificial Sequence
  Synthetic oligonucleotide
gaccgctacctcaggcactatcgtttgttctgttc

SEQ ID NO: 76208 - DNA, 35 bp, Artificial Sequence
  Synthetic oligonucleotide
tcgatgcaaccccaagggtctagcgctagcctttc

SEQ ID NO: 76209 - DNA, 35 bp, Artificial Sequence
  Synthetic oligonucleotide
actggcccgagtgcgcgtaaagcagcattcttttc

SEQ ID NO: 76210 - DNA, 35 bp, Artificial Sequence
  Synthetic oligonucleotide
tcaaccacgcaggtgaacgagtacccccccttaag

SEQ ID NO: 76211 - DNA, 35 bp, Artificial Sequence
  Synthetic oligonucleotide
atgtgcacggttagtactagggcctggtatggtag

SEQ ID NO: 76212 - DNA, 35 bp, Artificial Sequence
  Synthetic oligonucleotide
gatgaaagaggcaagacggtcgttggtcaaaatcg

SEQ ID NO: 76213 - DNA, 35 bp, Artificial Sequence
  Synthetic oligonucleotide
tacgcctatgccaaccattatagacactcagctcg

SEQ ID NO: 76214 - DNA, 35 bp, Artificial Sequence
  Synthetic oligonucleotide
gctgtgcgccggtagtgtagagggggaaggactgg

SEQ ID NO: 76215 - DNA, 35 bp, Artificial Sequence
  Synthetic oligonucleotide
tcaatcgaacatggcgtcactccctcacccgttgg

SEQ ID NO: 76216 - DNA, 36 bp, Artificial Sequence
  Synthetic oligonucleotide
gtgcccctcttccgttcctgcctgcctttaatttgg

SEQ ID NO: 76217 - DNA, 35 bp, Artificial Sequence
  Synthetic oligonucleotide
gcacaagcaaccctagggctgtacaacaatctctg

SEQ ID NO: 76218 - DNA, 35 bp, Artificial Sequence
  Synthetic oligonucleotide
tggatcgtcaatccccacgccctctgtgcttcgtg

SEQ ID NO: 76219 - DNA, 35 bp, Artificial Sequence
  Synthetic oligonucleotide
ttgtttaacgcctagttgcgcccctgcctgccttg

SEQ ID NO: 76220 - DNA, 35 bp, Artificial Sequence
  Synthetic oligonucleotide
agaggggtgaaaaggtctgaggggctggcgagttg

SEQ ID NO: 76221 - DNA, 35 bp, Artificial Sequence
  Synthetic oligonucleotide
tccttcccaacctgctagtatttatggcctgtttg

SEQ ID NO: 76222 - DNA, 35 bp, Artificial Sequence
  Synthetic oligonucleotide
tgagcatccacattcatatctatcagcctgaaaat

SEQ ID NO: 76223 - DNA, 35 bp, Artificial Sequence
  Synthetic oligonucleotide
acgactgcatccttagcagcctcgaacttccgact

SEQ ID NO: 76224 - DNA, 35 bp, Artificial Sequence
  Synthetic oligonucleotide
ggtacggcgcctttgttttcaccatcgtaccacct

SEQ ID NO: 76225 - DNA, 35 bp, Artificial Sequence
  Synthetic oligonucleotide
tgatctgttcattctgcaatggtcccgcgaatcct

SEQ ID NO: 76226 - DNA, 35 bp, Artificial Sequence
  Synthetic oligonucleotide
gccccggagcgcttattttacggctcacatggtct

SEQ ID NO: 76227 - DNA, 35 bp, Artificial Sequence
  Synthetic oligonucleotide
agtcacatcctcaggcccacaccccgcaatacagt

SEQ ID NO: 76228 - DNA, 35 bp, Artificial Sequence
  Synthetic oligonucleotide
ttcggttcaacatgccctctcctccttaaagacgt

SEQ ID NO: 76229 - DNA, 35 bp, Artificial Sequence
  Synthetic oligonucleotide
tgtgcctcctccgactacatactgtcagccaccgt

SEQ ID NO: 76230 - DNA, 35 bp, Artificial Sequence
  Synthetic oligonucleotide
ttgcggaacgggtggggtctacgcatgattaaggt

SEQ ID NO: 76231 - DNA, 35 bp, Artificial Sequence
  Synthetic oligonucleotide
gaagggagggcgggattaactgccataaatggggt

SEQ ID NO: 76232 - DNA, 35 bp, Artificial Sequence
  Synthetic oligonucleotide
tcgtcccacagagcacattactccatctacacatt

SEQ ID NO: 76233 - DNA, 35 bp, Artificial Sequence
  Synthetic oligonucleotide
ttgggtcgagcagcccccttcacatccataacctt

SEQ ID NO: 76234 - DNA, 35 bp, Artificial Sequence
  Synthetic oligonucleotide
gccccgcctccctatgtagattcaggcttcatctt

SEQ ID NO: 76235 - DNA, 35 bp, Artificial Sequence
  Synthetic oligonucleotide
agtcacctgagccgtattcgttttccgcacctctt

SEQ ID NO: 76236 - DNA, 35 bp, Artificial Sequence
  Synthetic oligonucleotide
tcatggatgcatgcccatttgccgtgttccccgtt

SEQ ID NO: 76237 - DNA, 35 bp, Artificial Sequence
  Synthetic oligonucleotide
acgacaactgcatattcacacaccgcataatcgtt

SEQ ID NO: 76238 - DNA, 35 bp, Artificial Sequence
  Synthetic oligonucleotide
gaactatccgtagtggcgaaaggcccaccctattt

SEQ ID NO: 76239 - DNA, 36 bp, Artificial Sequence
  Synthetic oligonucleotide
ttgagccattcgacaatctggcggttctggaacttt

SEQ ID NO: 76240 - DNA, 35 bp, Artificial Sequence
  Synthetic oligonucleotide
gtacggggaatgggcattcgtcactcctcatcttt

SEQ ID NO: 76241 - DNA, 35 bp, Artificial Sequence
  Synthetic oligonucleotide
gccctgttgcgtatctcccactctcgtgtccgttt

SEQ ID NO: 76242 - DNA, 35 bp, Artificial Sequence
  Synthetic oligonucleotide
tagggcaaagcataccgccattccgctcgcctttt

SEQ ID NO: 76243 - DNA, 36 bp, Artificial Sequence
  Synthetic oligonucleotide
acccacaacttgaatgatactgctaacgagtgaaaa

SEQ ID NO: 76244 - DNA, 35 bp, Artificial Sequence
  Synthetic oligonucleotide
gctggatagcgcgtggagggttggtggagttaaaa

SEQ ID NO: 76245 - DNA, 35 bp, Artificial Sequence
  Synthetic oligonucleotide
atgctgtgcgcagcgcctccatatgggcccccaaa

SEQ ID NO: 76246 - DNA, 36 bp, Artificial Sequence
  Synthetic oligonucleotide
gccgacacactaatcttcttttgttgctgtttcaaa

SEQ ID NO: 76247 - DNA, 35 bp, Artificial Sequence
  Synthetic oligonucleotide
gtgcaacaactgccactacgaacaactccaggaaa

SEQ ID NO: 76248 - DNA, 36 bp, Artificial Sequence
  Synthetic oligonucleotide
attcatcaccgtccccttaggggtcagcctgcccaa

SEQ ID NO: 76249 - DNA, 36 bp, Artificial Sequence
  Synthetic oligonucleotide
tcctcctgcccaccggggttttgagcctcagcataa

SEQ ID NO: 76250 - DNA, 36 bp, Artificial Sequence
  Synthetic oligonucleotide
gacctacttccacgggtttttcgagctttacactaa

SEQ ID NO: 76251 - DNA, 36 bp, Artificial Sequence
  Synthetic oligonucleotide
ggatgacgtgggctagggtaggcagaaatgggctaa

SEQ ID NO: 76252 - DNA, 36 bp, Artificial Sequence
  Synthetic oligonucleotide
gccaccgaattgcctctagaccctacctgaacgtaa

SEQ ID NO: 76253 - DNA, 35 bp, Artificial Sequence
  Synthetic oligonucleotide
gcacctcctgcgatgcccggtccttccccgtttaa

SEQ ID NO: 76254 - DNA, 36 bp, Artificial Sequence
  Synthetic oligonucleotide
gatttccgacgtcaccatcattaccctatgcacaca

SEQ ID NO: 76255 - DNA, 36 bp, Artificial Sequence
  Synthetic oligonucleotide
agtggatggggaggtgggcgaagcaagatccagaca

SEQ ID NO: 76256 - DNA, 36 bp, Artificial Sequence
  Synthetic oligonucleotide
ttagcccgatcagacctctatcgaagttttgcccca

SEQ ID NO: 76257 - DNA, 36 bp, Artificial Sequence
  Synthetic oligonucleotide
gcacttcgatgttggatgccctcgtttttttgtcca

SEQ ID NO: 76258 - DNA, 36 bp, Artificial Sequence
  Synthetic oligonucleotide
tacacgcagagtacccttctcggccctggcttcgca

SEQ ID NO: 76259 - DNA, 36 bp, Artificial Sequence
  Synthetic oligonucleotide
gtatcccccgtcagagcgccacactccacagatgca

SEQ ID NO: 76260 - DNA, 36 bp, Artificial Sequence
  Synthetic oligonucleotide
tcgaccactcattgttacgggccctacattgactca

SEQ ID NO: 76261 - DNA, 36 bp, Artificial Sequence
  Synthetic oligonucleotide
tactcagccacagattcgctaacaggaatgagctca

SEQ ID NO: 76262 - DNA, 35 bp, Artificial Sequence
  Synthetic oligonucleotide
gtgttccacacggctgtccccacttgctgatctca

SEQ ID NO: 76263 - DNA, 36 bp, Artificial Sequence
  Synthetic oligonucleotide
aaagtccacagttctgttcacaggccactcctctca

SEQ ID NO: 76264 - DNA, 36 bp, Artificial Sequence
  Synthetic oligonucleotide
gctcatcgttgcattgattgctcgtcctttttctca

SEQ ID NO: 76265 - DNA, 36 bp, Artificial Sequence
  Synthetic oligonucleotide
gcgtgtgggcccggacgtccccctgctagaacttca

SEQ ID NO: 76266 - DNA, 36 bp, Artificial Sequence
  Synthetic oligonucleotide
agatccctgtgccccagtcggacaatgcacgtttca

SEQ ID NO: 76267 - DNA, 37 bp, Artificial Sequence
  Synthetic oligonucleotide
gcaaggagaggtaaatggcgaaattgtgggagaaaga

SEQ ID NO: 76268 - DNA, 36 bp, Artificial Sequence
  Synthetic oligonucleotide
atgcgctgcaaagacacgggaagttggatggaaaga

SEQ ID NO: 76269 - DNA, 37 bp, Artificial Sequence
  Synthetic oligonucleotide
ggatgaaggcgaaggaggcttgtgggaagcaagtaga

SEQ ID NO: 76270 - DNA, 37 bp, Artificial Sequence
  Synthetic oligonucleotide
acatgcatgccccacgcaggctccctttctcggacga

SEQ ID NO: 76271 - DNA, 37 bp, Artificial Sequence
  Synthetic oligonucleotide
acaccacccgacccacggcatcatttatggaatacga

SEQ ID NO: 76272 - DNA, 37 bp, Artificial Sequence
  Synthetic oligonucleotide
attgcctgctcacgacgtcttttcgcctgacttacga

SEQ ID NO: 76273 - DNA, 34 bp, Artificial Sequence
  Synthetic oligonucleotide
gttacttgccaacccacctattcgcgagacccga

SEQ ID NO: 76274 - DNA, 37 bp, Artificial Sequence
  Synthetic oligonucleotide
tgacaaacgccctctttagcggacatccactacccga

SEQ ID NO: 76275 - DNA, 37 bp, Artificial Sequence
  Synthetic oligonucleotide
gagacgagggtggcgcggtgtgaggtgtcgtgagcga

SEQ ID NO: 76276 - DNA, 37 bp, Artificial Sequence
  Synthetic oligonucleotide
aacggagaggcacatgggggggtgagtaagggatcga

SEQ ID NO: 76277 - DNA, 37 bp, Artificial Sequence
  Synthetic oligonucleotide
tgtgcgcatgcaaatagggccactgttacttactcga

SEQ ID NO: 76278 - DNA, 37 bp, Artificial Sequence
  Synthetic oligonucleotide
ttcaaccctaggtcctatgacacctgtctcgcttcga

SEQ ID NO: 76279 - DNA, 37 bp, Artificial Sequence
  Synthetic oligonucleotide
gaagcgccgggtggggaacggcggtgactttgaggga

SEQ ID NO: 76280 - DNA, 37 bp, Artificial Sequence
  Synthetic oligonucleotide
tcgcctctgccactctgcacgaccatatcatccggga

SEQ ID NO: 76281 - DNA, 37 bp, Artificial Sequence
  Synthetic oligonucleotide
gcaacatgactactatggaggcgggggactaggggga

SEQ ID NO: 76282 - DNA, 37 bp, Artificial Sequence
  Synthetic oligonucleotide
gtagatcgggcgatctacgggggggaggaacatggga

SEQ ID NO: 76283 - DNA, 37 bp, Artificial Sequence
  Synthetic oligonucleotide
ggttggctcagccgagcaccgacttccccaccctgga

SEQ ID NO: 76284 - DNA, 38 bp, Artificial Sequence
  Synthetic oligonucleotide
aagcacggaggaggggttcatgtgcgcacgcgcaatga

SEQ ID NO: 76285 - DNA, 37 bp, Artificial Sequence
  Synthetic oligonucleotide
gaaccacccattgagtttttcagtcaatgatgaatga

SEQ ID NO: 76286 - DNA, 36 bp, Artificial Sequence
  Synthetic oligonucleotide
tatccgacaacagattgttgttcgctatccacatga

SEQ ID NO: 76287 - DNA, 38 bp, Artificial Sequence
  Synthetic oligonucleotide
gcatggcgctggtctcacattcatttatggcgacatga

SEQ ID NO: 76288 - DNA, 38 bp, Artificial Sequence
  Synthetic oligonucleotide
acctacctgacctgcgccacatcctgctagtagactga

SEQ ID NO: 76289 - DNA, 37 bp, Artificial Sequence
  Synthetic oligonucleotide
gtacacgcacgtaactcatccagcaaaaaccacctga

SEQ ID NO: 76290 - DNA, 38 bp, Artificial Sequence
  Synthetic oligonucleotide
gagatggccagtgtacaaccgacctctattactgctga

SEQ ID NO: 76291 - DNA, 38 bp, Artificial Sequence
  Synthetic oligonucleotide
tgagtacgctagtcccagcctgcacgtgacccccgtga

SEQ ID NO: 76292 - DNA, 38 bp, Artificial Sequence
  Synthetic oligonucleotide
gtcccaacgaaccaccattggcctatgactggccgtga

SEQ ID NO: 76293 - DNA, 38 bp, Artificial Sequence
  Synthetic oligonucleotide
atgggggtagccgggtgagggtagcatctttggggtga

SEQ ID NO: 76294 - DNA, 37 bp, Artificial Sequence
  Synthetic oligonucleotide
ttgaagccgagcactgggaagtaggggtatggtgtga

SEQ ID NO: 76295 - DNA, 38 bp, Artificial Sequence
  Synthetic oligonucleotide
tgcacgcagggtgatcccgtgttatatccttattgtga

SEQ ID NO: 76296 - DNA, 38 bp, Artificial Sequence
  Synthetic oligonucleotide
tacatcctttctgtaccccttcgcgcagtccccattga

SEQ ID NO: 76297 - DNA, 36 bp, Artificial Sequence
  Synthetic oligonucleotide
tacattccgctctgtccggtaacccgtttcccttga

SEQ ID NO: 76298 - DNA, 36 bp, Artificial Sequence
  Synthetic oligonucleotide
tgtttccccgcaactgctcctcgctcgtatgcttga

SEQ ID NO: 76299 - DNA, 38 bp, Artificial Sequence
  Synthetic oligonucleotide
aacaaggtggcaagggggtggttcaaaacgagggttga

SEQ ID NO: 76300 - DNA, 37 bp, Artificial Sequence
  Synthetic oligonucleotide
aacactcagcggccataaccagcatccctacatttga

SEQ ID NO: 76301 - DNA, 36 bp, Artificial Sequence
  Synthetic oligonucleotide
gaaacctcagggatgatggaaaggcgctgggacata

SEQ ID NO: 76302 - DNA, 35 bp, Artificial Sequence
  Synthetic oligonucleotide
tgtgccagggcaatctagccacaatccctgtacta

SEQ ID NO: 76303 - DNA, 36 bp, Artificial Sequence
  Synthetic oligonucleotide
gtttgcaccccatacgccgtgagtctacctgccgta

SEQ ID NO: 76304 - DNA, 36 bp, Artificial Sequence
  Synthetic oligonucleotide
tagtcgcaccccatgctgcacatcccatagctcgta

SEQ ID NO: 76305 - DNA, 36 bp, Artificial Sequence
  Synthetic oligonucleotide
gcacccatcgcccctagtgccctccgttcagtggta

SEQ ID NO: 76306 - DNA, 36 bp, Artificial Sequence
  Synthetic oligonucleotide
tcagtcccaaaatgatgttagcgggggtggccttta

SEQ ID NO: 76307 - DNA, 36 bp, Artificial Sequence
  Synthetic oligonucleotide
gtgagagcgtgagcggcctcaattaccccttcttta

SEQ ID NO: 76308 - DNA, 35 bp, Artificial Sequence
  Synthetic oligonucleotide
tctcgacacggtcgaggaattattctttacacaac

SEQ ID NO: 76309 - DNA, 36 bp, Artificial Sequence
  Synthetic oligonucleotide
gcccacgctaccaaaactctgagagcactattcgac

SEQ ID NO: 76310 - DNA, 35 bp, Artificial Sequence
  Synthetic oligonucleotide
tgctcacgtgccggccttctatatatcacgattac

SEQ ID NO: 76311 - DNA, 35 bp, Artificial Sequence
  Synthetic oligonucleotide
atctgaacccacacatctgcgcgcactacggttac

SEQ ID NO: 76312 - DNA, 35 bp, Artificial Sequence
  Synthetic oligonucleotide
tcaccattccgacgaacactgggtaactgctttac

SEQ ID NO: 76313 - DNA, 35 bp, Artificial Sequence
  Synthetic oligonucleotide
tccatccttgggatcttaagacgtaccacttttac

SEQ ID NO: 76314 - DNA, 35 bp, Artificial Sequence
  Synthetic oligonucleotide
tactgccccactgacctcctggtactataccgacc

SEQ ID NO: 76315 - DNA, 35 bp, Artificial Sequence
  Synthetic oligonucleotide
gacccttagcggcgcgttctcaaatgactaccccc

SEQ ID NO: 76316 - DNA, 35 bp, Artificial Sequence
  Synthetic oligonucleotide
tcgtcccgtgagccaagcacccgcagtcttgcccc

SEQ ID NO: 76317 - DNA, 35 bp, Artificial Sequence
  Synthetic oligonucleotide
atccctcacgcgcaaacgtggctacctctgttccc

SEQ ID NO: 76318 - DNA, 35 bp, Artificial Sequence
  Synthetic oligonucleotide
tcaacaatctgccggttccaaacagcctgaaagcc

SEQ ID NO: 76319 - DNA, 35 bp, Artificial Sequence
  Synthetic oligonucleotide
gttatgacgccgcgtccgccccgttagctcatgcc

SEQ ID NO: 76320 - DNA, 34 bp, Artificial Sequence
  Synthetic oligonucleotide
gtggctcccttaatggcatggcatgaatcgctcc

SEQ ID NO: 76321 - DNA, 35 bp, Artificial Sequence
  Synthetic oligonucleotide
acacggttgccacacctaaacactaaattccgtcc

SEQ ID NO: 76322 - DNA, 35 bp, Artificial Sequence
  Synthetic oligonucleotide
tatggggaggggacgcaggtccaaaaaggcatagc

SEQ ID NO: 76323 - DNA, 35 bp, Artificial Sequence
  Synthetic oligonucleotide
acgagcaccagttccttccgcgtttgccgtctagc

SEQ ID NO: 76324 - DNA, 35 bp, Artificial Sequence
  Synthetic oligonucleotide
tgccgttgcctaagggcgtttccctgctactccgc

SEQ ID NO: 76325 - DNA, 35 bp, Artificial Sequence
  Synthetic oligonucleotide
ttgccgccctatcctgcgcctaaccttttcatggc

SEQ ID NO: 76326 - DNA, 35 bp, Artificial Sequence
  Synthetic oligonucleotide
tgggtccacgtgcttacgtttttatcatatcctgc

SEQ ID NO: 76327 - DNA, 35 bp, Artificial Sequence
  Synthetic oligonucleotide
acttccacgtctcagtctgccccttgatctcctgc

SEQ ID NO: 76328 - DNA, 35 bp, Artificial Sequence
  Synthetic oligonucleotide
ctaccacccggttaggttaggctccacctcaactc

SEQ ID NO: 76329 - DNA, 35 bp, Artificial Sequence
  Synthetic oligonucleotide
gcctcgagttagccacccgccgattgaacacactc

SEQ ID NO: 76330 - DNA, 35 bp, Artificial Sequence
  Synthetic oligonucleotide
tgtgctccgggcacattgactatacaaatatcctc

SEQ ID NO: 76331 - DNA, 35 bp, Artificial Sequence
  Synthetic oligonucleotide
aagaggacgaaggcagagaatatgtgagtggcgag

SEQ ID NO: 76332 - DNA, 35 bp, Artificial Sequence
  Synthetic oligonucleotide
aacaaccgccgccgccctttaagggaactttaacg

SEQ ID NO: 76333 - DNA, 35 bp, Artificial Sequence
  Synthetic oligonucleotide
tacccgccttgtggtgcccaccctgttccagcccg

SEQ ID NO: 76334 - DNA, 35 bp, Artificial Sequence
  Synthetic oligonucleotide
gtacccagccgatccatacctcgccttcggctccg

SEQ ID NO: 76335 - DNA, 35 bp, Artificial Sequence
  Synthetic oligonucleotide
ttaccatccagcccgccccttacacgtgaactgcg

SEQ ID NO: 76336 - DNA, 35 bp, Artificial Sequence
  Synthetic oligonucleotide
gagtcggaccgcctggggggaggaataggtgtgcg

SEQ ID NO: 76337 - DNA, 35 bp, Artificial Sequence
  Synthetic oligonucleotide
gtcgacgggggttacagggaattggattaagaggg

SEQ ID NO: 76338 - DNA, 35 bp, Artificial Sequence
  Synthetic oligonucleotide
acctgtaggggaaggcgtggtaagtagtgctcggg

SEQ ID NO: 76339 - DNA, 35 bp, Artificial Sequence
  Synthetic oligonucleotide
taagtcatgcggcgggtaagtacctgggtaggggg

SEQ ID NO: 76340 - DNA, 35 bp, Artificial Sequence
  Synthetic oligonucleotide
ggggaaggtcgcgctgatacgggtccgggtggtgg

SEQ ID NO: 76341 - DNA, 35 bp, Artificial Sequence
  Synthetic oligonucleotide
gctctcatctctcgatactacactgaacttgcctg

SEQ ID NO: 76342 - DNA, 35 bp, Artificial Sequence
  Synthetic oligonucleotide
atcgactcccctgcttatatatggccttctctctg

SEQ ID NO: 76343 - DNA, 35 bp, Artificial Sequence
  Synthetic oligonucleotide
ttatcaccgccccggctcctacctcttcctacgtg

SEQ ID NO: 76344 - DNA, 35 bp, Artificial Sequence
  Synthetic oligonucleotide
tcaggacgaaggtggagttctaggattgtagtgtg

SEQ ID NO: 76345 - DNA, 35 bp, Artificial Sequence
  Synthetic oligonucleotide
gaacgggcccaagtttagtctcgaccgcactacat

SEQ ID NO: 76346 - DNA, 35 bp, Artificial Sequence
  Synthetic oligonucleotide
atcgagtcgcgcccgccgttattaacctctattat

SEQ ID NO: 76347 - DNA, 35 bp, Artificial Sequence
  Synthetic oligonucleotide
taccatctgacgttgcgaccttgtccaagccttat

SEQ ID NO: 76348 - DNA, 35 bp, Artificial Sequence
  Synthetic oligonucleotide
gactctcaggtttgcccccattaaccgcgcccact

SEQ ID NO: 76349 - DNA, 34 bp, Artificial Sequence
  Synthetic oligonucleotide
tgtgacacaaactatcccaccacccgtggaacct

SEQ ID NO: 76350 - DNA, 35 bp, Artificial Sequence
  Synthetic oligonucleotide
tccagcaatgcattactccggggtgcagcactcct

SEQ ID NO: 76351 - DNA, 35 bp, Artificial Sequence
  Synthetic oligonucleotide
tggtgtcgctgctgtatttcttctgcccggttcct

SEQ ID NO: 76352 - DNA, 35 bp, Artificial Sequence
  Synthetic oligonucleotide
gaggacgatcggcgtggaaaagaaaggggtgagct

SEQ ID NO: 76353 - DNA, 35 bp, Artificial Sequence
  Synthetic oligonucleotide
gaccatcgcacggttcctggtttaactaatgatct

SEQ ID NO: 76354 - DNA, 35 bp, Artificial Sequence
  Synthetic oligonucleotide
gatcgggatgaaatgaaaggtggggttgggtaagt

SEQ ID NO: 76355 - DNA, 35 bp, Artificial Sequence
  Synthetic oligonucleotide
agatcaacgccagtttcgctcctattcctatctgt

SEQ ID NO: 76356 - DNA, 35 bp, Artificial Sequence
  Synthetic oligonucleotide
tcgtgtggcgcgattgtcaaatttctgtttccctt

SEQ ID NO: 76357 - DNA, 35 bp, Artificial Sequence
  Synthetic oligonucleotide
acaccgcactgtatcgcccgctcccaatcacgctt

SEQ ID NO: 76358 - DNA, 35 bp, Artificial Sequence
  Synthetic oligonucleotide
ggacgcacagtcccgggcgtcccggactccttttt

SEQ ID NO: 76359 - DNA, 36 bp, Artificial Sequence
  Synthetic oligonucleotide
tcaacccctgcaacgctatctgagtcatcatcaaaa

SEQ ID NO: 76360 - DNA, 36 bp, Artificial Sequence
  Synthetic oligonucleotide
tgtagtggcacacggggggagcggagtaagcacaaa

SEQ ID NO: 76361 - DNA, 36 bp, Artificial Sequence
  Synthetic oligonucleotide
gatgtccatggtacgtcgacgaactcccacaccaaa

SEQ ID NO: 76362 - DNA, 36 bp, Artificial Sequence
  Synthetic oligonucleotide
aacgcggggaaaactgtaaaaaaagttgagtggaaa

SEQ ID NO: 76363 - DNA, 35 bp, Artificial Sequence
  Synthetic oligonucleotide
tatgttaccgccataactctcattttgctttgcaa

SEQ ID NO: 76364 - DNA, 35 bp, Artificial Sequence
  Synthetic oligonucleotide
taaccgaattccgacgccagtatggcctatttcaa

SEQ ID NO: 76365 - DNA, 35 bp, Artificial Sequence
  Synthetic oligonucleotide
ttgtgcatccgcaagagtgcctgtgccttctctaa

SEQ ID NO: 76366 - DNA, 36 bp, Artificial Sequence
  Synthetic oligonucleotide
gatgccaatagcagcccgtcactgtgactaccgtaa

SEQ ID NO: 76367 - DNA, 36 bp, Artificial Sequence
  Synthetic oligonucleotide
gcgatggcactgtatccacacacggctaataaaaca

SEQ ID NO: 76368 - DNA, 36 bp, Artificial Sequence
  Synthetic oligonucleotide
gtgccaccgcaccaaatccgcttatcccatggacca

SEQ ID NO: 76369 - DNA, 36 bp, Artificial Sequence
  Synthetic oligonucleotide
tgctccaactccacggcgagaaactaaggtccccca

SEQ ID NO: 76370 - DNA, 36 bp, Artificial Sequence
  Synthetic oligonucleotide
ataccccaccgtttatgtttcgccgggcgtttccca

SEQ ID NO: 76371 - DNA, 35 bp, Artificial Sequence
  Synthetic oligonucleotide
gccgcctctgacccccctattatgttaaccatcca

SEQ ID NO: 76372 - DNA, 36 bp, Artificial Sequence
  Synthetic oligonucleotide
ttaaccgctacaccaccatttgctaacaagatagca

SEQ ID NO: 76373 - DNA, 36 bp, Artificial Sequence
  Synthetic oligonucleotide
aatttggggggaggcataggaggagaagtgcacgca

SEQ ID NO: 76374 - DNA, 36 bp, Artificial Sequence
  Synthetic oligonucleotide
gcatacccatttcctcctccgcgcctctgaaccgca

SEQ ID NO: 76375 - DNA, 35 bp, Artificial Sequence
  Synthetic oligonucleotide
tatggcaccaacatttccaggtcagcttttccgca

SEQ ID NO: 76376 - DNA, 36 bp, Artificial Sequence
  Synthetic oligonucleotide
tcccaccttggcttttgtacggatttgccctcggca

SEQ ID NO: 76377 - DNA, 36 bp, Artificial Sequence
  Synthetic oligonucleotide
tagcgaggaacacagtgcaaaaataacaacgcatca

SEQ ID NO: 76378 - DNA, 35 bp, Artificial Sequence
  Synthetic oligonucleotide
caagcaacaaccagcctgtcccaatcgatcgctca

SEQ ID NO: 76379 - DNA, 36 bp, Artificial Sequence
  Synthetic oligonucleotide
tgccacgtgttcacaggtccacgtaccttcgtctca

SEQ ID NO: 76380 - DNA, 36 bp, Artificial Sequence
  Synthetic oligonucleotide
tccacacggtggggatcgtgtccactccaaacttca

SEQ ID NO: 76381 - DNA, 36 bp, Artificial Sequence
  Synthetic oligonucleotide
tcccgctgtttcaccttatatgccgtccatagttca

SEQ ID NO: 76382 - DNA, 37 bp, Artificial Sequence
  Synthetic oligonucleotide
tcacaccactcaaccgctggactgactgttgaacaga

SEQ ID NO: 76383 - DNA, 37 bp, Artificial Sequence
  Synthetic oligonucleotide
tgacccaccatgcggtctccctgtctctgtacacaga

SEQ ID NO: 76384 - DNA, 37 bp, Artificial Sequence
  Synthetic oligonucleotide
atagatggcggggcacgatgaaaggtggacgcgcaga

SEQ ID NO: 76385 - DNA, 37 bp, Artificial Sequence
  Synthetic oligonucleotide
tgaccactgaacctctgaactgaaaaaccaccggaga

SEQ ID NO: 76386 - DNA, 37 bp, Artificial Sequence
  Synthetic oligonucleotide
tgtacaggggggaccatggggggtaagagaggggaga

SEQ ID NO: 76387 - DNA, 37 bp, Artificial Sequence
  Synthetic oligonucleotide
aaaagagtgacaggggtgtcgtgtgcgtggggggaga

SEQ ID NO: 76388 - DNA, 37 bp, Artificial Sequence
  Synthetic oligonucleotide
aaccgcgataaagggacaacgagcaagggtggataga

SEQ ID NO: 76389 - DNA, 37 bp, Artificial Sequence
  Synthetic oligonucleotide
aaacgaagggaggtgtgagggatgtagatctgtacga

SEQ ID NO: 76390 - DNA, 37 bp, Artificial Sequence
  Synthetic oligonucleotide
agtatgtaccacgggccacaccacacttcgtttacga

SEQ ID NO: 76391 - DNA, 37 bp, Artificial Sequence
  Synthetic oligonucleotide
aatgatgcccctacatgcgccacgcgtgactccccga

SEQ ID NO: 76392 - DNA, 36 bp, Artificial Sequence
  Synthetic oligonucleotide
gcaaggcccagccttcataggaccttccgttcccga

SEQ ID NO: 76393 - DNA, 37 bp, Artificial Sequence
  Synthetic oligonucleotide
gctccctgcctccgtgcactgaatggtccttcgccga

SEQ ID NO: 76394 - DNA, 36 bp, Artificial Sequence
  Synthetic oligonucleotide
attgcacataggagctgggcgaagaaagataggcga

SEQ ID NO: 76395 - DNA, 37 bp, Artificial Sequence
  Synthetic oligonucleotide
gccgtgtccagcgtgttttctacgcccatgccctcga

SEQ ID NO: 76396 - DNA, 36 bp, Artificial Sequence
  Synthetic oligonucleotide
gttgatcccgtgtggtgcagctcccatgcccttcga

SEQ ID NO: 76397 - DNA, 37 bp, Artificial Sequence
  Synthetic oligonucleotide
gagtgcgggggtggcgtatgaaggcttgcgggcagga

SEQ ID NO: 76398 - DNA, 35 bp, Artificial Sequence
  Synthetic oligonucleotide
gcacgcttaccgccccccctccgaattataccgga

SEQ ID NO: 76399 - DNA, 37 bp, Artificial Sequence
  Synthetic oligonucleotide
atgtgtaaaacgggcggcatgggcaggaaggggcgga

SEQ ID NO: 76400 - DNA, 37 bp, Artificial Sequence
  Synthetic oligonucleotide
gcgacctagtggtagggagaatgagctgggggaggga

SEQ ID NO: 76401 - DNA, 37 bp, Artificial Sequence
  Synthetic oligonucleotide
agaggtggggaatgaacgagggaaaaagcgcggggga

SEQ ID NO: 76402 - DNA, 37 bp, Artificial Sequence
  Synthetic oligonucleotide
tagcacttgggactaggaggggcggagagggctggga

SEQ ID NO: 76403 - DNA, 37 bp, Artificial Sequence
  Synthetic oligonucleotide
accccggagaacgttgggaaaagggaaggggtatgga

SEQ ID NO: 76404 - DNA, 36 bp, Artificial Sequence
  Synthetic oligonucleotide
tgccataacgcctcacacaatctatcccgggctgga

SEQ ID NO: 76405 - DNA, 37 bp, Artificial Sequence
  Synthetic oligonucleotide
gagggatggtgtgctggaatagggttattgccttgga

SEQ ID NO: 76406 - DNA, 38 bp, Artificial Sequence
  Synthetic oligonucleotide
actatgcgtgcatagtgccgcctccattacccaaatga

SEQ ID NO: 76407 - DNA, 38 bp, Artificial Sequence
  Synthetic oligonucleotide
agaggcaccacgcatgtgctccgctttatccgaaatga

SEQ ID NO: 76408 - DNA, 38 bp, Artificial Sequence
  Synthetic oligonucleotide
gaccgcctctgttctatcatgccccgacctttgaatga

SEQ ID NO: 76409 - DNA, 38 bp, Artificial Sequence
  Synthetic oligonucleotide
gagtggtgtagggaaggataaacggtagtatagcatga

SEQ ID NO: 76410 - DNA, 38 bp, Artificial Sequence
  Synthetic oligonucleotide
actgacaccagtgctctaacgtgctccatcaatcatga

SEQ ID NO: 76411 - DNA, 38 bp, Artificial Sequence
  Synthetic oligonucleotide
tccaacggaccgcgaatgaaaacaaagggaggcgatga

SEQ ID NO: 76412 - DNA, 38 bp, Artificial Sequence
  Synthetic oligonucleotide
aagacacaatcggagaccctctttatgaccctggatga

SEQ ID NO: 76413 - DNA, 38 bp, Artificial Sequence
  Synthetic oligonucleotide
atcacccatccgtaaacaagctacttagtgacgactga

SEQ ID NO: 76414 - DNA, 38 bp, Artificial Sequence
  Synthetic oligonucleotide
tagaacagggcgggagagtctagtgagggggtcgctga

SEQ ID NO: 76415 - DNA, 35 bp, Artificial Sequence
  Synthetic oligonucleotide
gtgtgggacgtttgtgaggtaggggatggggctga

SEQ ID NO: 76416 - DNA, 38 bp, Artificial Sequence
  Synthetic oligonucleotide
aatcgtaccgggcgggaagggagcatgggaaagagtga

SEQ ID NO: 76417 - DNA, 38 bp, Artificial Sequence
  Synthetic oligonucleotide
atgatgtgcggtgaggaattgggtagtagggctagtga

SEQ ID NO: 76418 - DNA, 38 bp, Artificial Sequence
  Synthetic oligonucleotide
attcctcagcgctttcccacttaaccgcctgtccgtga

SEQ ID NO: 76419 - DNA, 38 bp, Artificial Sequence
  Synthetic oligonucleotide
tcacccacgtagcacttattggtaagcctctttcgtga

SEQ ID NO: 76420 - DNA, 38 bp, Artificial Sequence
  Synthetic oligonucleotide
tcaatagggtgcaggggtcgggatcaatcggaaggtga

SEQ ID NO: 76421 - DNA, 37 bp, Artificial Sequence
  Synthetic oligonucleotide
gattagccccacctgatcttttgcgcgacatcattga

SEQ ID NO: 76422 - DNA, 38 bp, Artificial Sequence
  Synthetic oligonucleotide
taacgagacggaggaggacggcggggtagagcgattga

SEQ ID NO: 76423 - DNA, 38 bp, Artificial Sequence
  Synthetic oligonucleotide
acgcaacagcttaatgccctctcttttcgcgcccttga

SEQ ID NO: 76424 - DNA, 38 bp, Artificial Sequence
  Synthetic oligonucleotide
tgacaactgggttgactttctgctactagactccttga

SEQ ID NO: 76425 - DNA, 38 bp, Artificial Sequence
  Synthetic oligonucleotide
gacgaagtggcacgtggaagtctcagcgtggggcttga

SEQ ID NO: 76426 - DNA, 38 bp, Artificial Sequence
  Synthetic oligonucleotide
gcccactccacaataattaaagtcagggacctgcttga

SEQ ID NO: 76427 - DNA, 38 bp, Artificial Sequence
  Synthetic oligonucleotide
gtcaccatccccatggttcaagtctgacaatctcttga

SEQ ID NO: 76428 - DNA, 38 bp, Artificial Sequence
  Synthetic oligonucleotide
gacttgctcagcgccttagcctccctactttcagttga

SEQ ID NO: 76429 - DNA, 38 bp, Artificial Sequence
  Synthetic oligonucleotide
ttcaccgccacttgggagcctctttcggtttttgttga

SEQ ID NO: 76430 - DNA, 36 bp, Artificial Sequence
  Synthetic oligonucleotide
gaaagtgcgggggcggaaggggtttagtggttgata

SEQ ID NO: 76431 - DNA, 36 bp, Artificial Sequence
  Synthetic oligonucleotide
tccgatggacaatcagttgcaccccgactctgacta

SEQ ID NO: 76432 - DNA, 35 bp, Artificial Sequence
  Synthetic oligonucleotide
accgacgtaccggtctgtcgccacttttttgccta

SEQ ID NO: 76433 - DNA, 36 bp, Artificial Sequence
  Synthetic oligonucleotide
gcgaacgcggaacgcagtatcgctggcaagcacgta

SEQ ID NO: 76434 - DNA, 35 bp, Artificial Sequence
  Synthetic oligonucleotide
tagtactcccgcacctccaatctctgagttctgta

SEQ ID NO: 76435 - DNA, 35 bp, Artificial Sequence
  Synthetic oligonucleotide
gcacgtcaccacattcacgtttgtctggtacctta

SEQ ID NO: 76436 - DNA, 35 bp, Artificial Sequence
  Synthetic oligonucleotide
gtcaaccttatcccgtgataaacgaactcttgtta

SEQ ID NO: 76437 - DNA, 35 bp, Artificial Sequence
  Synthetic oligonucleotide
aacggggctgtgggagtggcgggaggagacgaaac

SEQ ID NO: 76438 - DNA, 35 bp, Artificial Sequence
  Synthetic oligonucleotide
tagagcgcgcatattcagccctcttccttgcacac

SEQ ID NO: 76439 - DNA, 35 bp, Artificial Sequence
  Synthetic oligonucleotide
atgcccgggtactaaccgtcctgcaccaagccgac

SEQ ID NO: 76440 - DNA, 35 bp, Artificial Sequence
  Synthetic oligonucleotide
gcctaccactatcttgagatatacacatgacgtac

SEQ ID NO: 76441 - DNA, 35 bp, Artificial Sequence
  Synthetic oligonucleotide
tctctcccgtgcgaaggctggtttacttctcttac

SEQ ID NO: 76442 - DNA, 35 bp, Artificial Sequence
  Synthetic oligonucleotide
gagatccgatcgtcgaaccgttagccaaattcacc

SEQ ID NO: 76443 - DNA, 35 bp, Artificial Sequence
  Synthetic oligonucleotide
gagtgacccgccgccgcaccctactggctatgacc

SEQ ID NO: 76444 - DNA, 35 bp, Artificial Sequence
  Synthetic oligonucleotide
gaccagccgctgctctactgtcacgtacaccaccc

SEQ ID NO: 76445 - DNA, 35 bp, Artificial Sequence
  Synthetic oligonucleotide
tttcaacgcaccatctggattttggtcattgcccc

SEQ ID NO: 76446 - DNA, 29 bp, Artificial Sequence
  Synthetic oligonucleotide
gccacaccttgacttgcccagataaagcc

SEQ ID NO: 76447 - DNA, 35 bp, Artificial Sequence
  Synthetic oligonucleotide
gcagcccgcggacctgccgacccactttgctcgcc

SEQ ID NO: 76448 - DNA, 35 bp, Artificial Sequence
  Synthetic oligonucleotide
tggaactgtcacctcaccttcatgatcgactctcc

SEQ ID NO: 76449 - DNA, 35 bp, Artificial Sequence
  Synthetic oligonucleotide
gatacgcgtccgaagattcccagtttgggccgtcc

SEQ ID NO: 76450 - DNA, 36 bp, Artificial Sequence
  Synthetic oligonucleotide
tctgaatgaacggcgcgggagggtgtggacgggggc

SEQ ID NO: 76451 - DNA, 35 bp, Artificial Sequence
  Synthetic oligonucleotide
gccgcttccgccatccaatacagttactgcttggc

SEQ ID NO: 76452 - DNA, 35 bp, Artificial Sequence
  Synthetic oligonucleotide
aaccacaaccgtgctttcctctggcgatattttgc

SEQ ID NO: 76453 - DNA, 35 bp, Artificial Sequence
  Synthetic oligonucleotide
ttgtgacgccccctttcggacgacttatactaatc

SEQ ID NO: 76454 - DNA, 35 bp, Artificial Sequence
  Synthetic oligonucleotide
gaccaaccactcttgtttccagagagtcactgatc

SEQ ID NO: 76455 - DNA, 35 bp, Artificial Sequence
  Synthetic oligonucleotide
gtcaaccacgctccgggactcgtagtttcatactc

SEQ ID NO: 76456 - DNA, 35 bp, Artificial Sequence
  Synthetic oligonucleotide
tcacttcgtatgaagcatctcccagttacgatctc

SEQ ID NO: 76457 - DNA, 35 bp, Artificial Sequence
  Synthetic oligonucleotide
tgcacgttcctcatggctatgtccgcgcgaccgtc

SEQ ID NO: 76458 - DNA, 35 bp, Artificial Sequence
  Synthetic oligonucleotide
gtctcggccctgtcctatcgatcagaccatgcttc

SEQ ID NO: 76459 - DNA, 35 bp, Artificial Sequence
  Synthetic oligonucleotide
agaggtgccgcctagtcgtattggccccatctttc

SEQ ID NO: 76460 - DNA, 35 bp, Artificial Sequence
  Synthetic oligonucleotide
gttggagatatgaggggtgtggggcgggatatcag

SEQ ID NO: 76461 - DNA, 35 bp, Artificial Sequence
  Synthetic oligonucleotide
gagatcgtccccgccccgagtccgcttatccagag

SEQ ID NO: 76462 - DNA, 35 bp, Artificial Sequence
  Synthetic oligonucleotide
tcccgcccccagctccgtttggcccttccttggag

SEQ ID NO: 76463 - DNA, 35 bp, Artificial Sequence
  Synthetic oligonucleotide
gagtttcggctgttcttcctgggttctgttcctcg

SEQ ID NO: 76464 - DNA, 35 bp, Artificial Sequence
  Synthetic oligonucleotide
agatcgacggtgcctcgttctcgctcttatattcg

SEQ ID NO: 76465 - DNA, 35 bp, Artificial Sequence
  Synthetic oligonucleotide
tgccccgttacacacatttagtgccccaagttagg

SEQ ID NO: 76466 - DNA, 35 bp, Artificial Sequence
  Synthetic oligonucleotide
accctgcacaatcgtttgtctccgacctcattcgg

SEQ ID NO: 76467 - DNA, 35 bp, Artificial Sequence
  Synthetic oligonucleotide
tcagaacttatggagagggcaggaggaggctaggg

SEQ ID NO: 76468 - DNA, 35 bp, Artificial Sequence
  Synthetic oligonucleotide
aagtaggcataacggaaccagagcgggtgggcggg

SEQ ID NO: 76469 - DNA, 35 bp, Artificial Sequence
  Synthetic oligonucleotide
tagagcaattgtgggtgggatttgggagatggggg

SEQ ID NO: 76470 - DNA, 35 bp, Artificial Sequence
  Synthetic oligonucleotide
gtggggggattgaggagatcagtagggcatgctgg

SEQ ID NO: 76471 - DNA, 35 bp, Artificial Sequence
  Synthetic oligonucleotide
tatccagcccgtgggcatattcccatccatgcatg

SEQ ID NO: 76472 - DNA, 35 bp, Artificial Sequence
  Synthetic oligonucleotide
tcactggcgtccagccaggttcgcctcaccctatg

SEQ ID NO: 76473 - DNA, 37 bp, Artificial Sequence
  Synthetic oligonucleotide
taaattgcaggcctggttcccgtgttttttctgcctg

SEQ ID NO: 76474 - DNA, 35 bp, Artificial Sequence
  Synthetic oligonucleotide
gagacccggtctatttatccatggtctgccccttg

SEQ ID NO: 76475 - DNA, 35 bp, Artificial Sequence
  Synthetic oligonucleotide
tcaggtctgcagccagaaactattcacttacccat

SEQ ID NO: 76476 - DNA, 35 bp, Artificial Sequence
  Synthetic oligonucleotide
ggttggtaccgctcccttccagccacttcttgtat

SEQ ID NO: 76477 - DNA, 35 bp, Artificial Sequence
  Synthetic oligonucleotide
gatgacaccaaagagttcccaagcctggtacccct

SEQ ID NO: 76478 - DNA, 35 bp, Artificial Sequence
  Synthetic oligonucleotide
ataccgacgcgcacctgaacgtaccttcctgccct

SEQ ID NO: 76479 - DNA, 35 bp, Artificial Sequence
  Synthetic oligonucleotide
acatcctcactactaaagcctcgtgtttaccgcct

SEQ ID NO: 76480 - DNA, 35 bp, Artificial Sequence
  Synthetic oligonucleotide
ggtgcaatccagacttaaagctaccgaatcatcct

SEQ ID NO: 76481 - DNA, 35 bp, Artificial Sequence
  Synthetic oligonucleotide
tcgatctgacatctctacctgggtctcacggatct

SEQ ID NO: 76482 - DNA, 35 bp, Artificial Sequence
  Synthetic oligonucleotide
tgacggaccaaatctccagttagcctgaatactct

SEQ ID NO: 76483 - DNA, 35 bp, Artificial Sequence
  Synthetic oligonucleotide
gacgcagtcaccgtgattgactctactccgagggt

SEQ ID NO: 76484 - DNA, 35 bp, Artificial Sequence
  Synthetic oligonucleotide
tatacgcccctgttgatcctcatgatacatattgt

SEQ ID NO: 76485 - DNA, 35 bp, Artificial Sequence
  Synthetic oligonucleotide
gtctgtgattccgtctgtttttagtcctgcccctt

SEQ ID NO: 76486 - DNA, 35 bp, Artificial Sequence
  Synthetic oligonucleotide
acacacacagtctccgtttgccaggaactacgctt

SEQ ID NO: 76487 - DNA, 35 bp, Artificial Sequence
  Synthetic oligonucleotide
tccaactgcaggaggagcgatgaagggtccatctt

SEQ ID NO: 76488 - DNA, 35 bp, Artificial Sequence
  Synthetic oligonucleotide
gccgagagtggtctcgtgcttcatatggtcttttt

SEQ ID NO: 76489 - DNA, 36 bp, Artificial Sequence
  Synthetic oligonucleotide
atcgcccccgaattgggccatcgctatccctgcaaa

SEQ ID NO: 76490 - DNA, 36 bp, Artificial Sequence
  Synthetic oligonucleotide
atccgcccaatgtcaccctgtcctccttgtcagaaa

SEQ ID NO: 76491 - DNA, 36 bp, Artificial Sequence
  Synthetic oligonucleotide
acgttcgccctggtctcgacacgtctgttcccgaaa

SEQ ID NO: 76492 - DNA, 36 bp, Artificial Sequence
  Synthetic oligonucleotide
tcaccatggccacagttgttgttgctcacttgacaa

SEQ ID NO: 76493 - DNA, 36 bp, Artificial Sequence
  Synthetic oligonucleotide
taaaacgcaacctcaggcctgcaccatcttgaccaa

SEQ ID NO: 76494 - DNA, 36 bp, Artificial Sequence
  Synthetic oligonucleotide
acccaaccgtgccacatgtaagcgtcttgaatccaa

SEQ ID NO: 76495 - DNA, 36 bp, Artificial Sequence
  Synthetic oligonucleotide
gcctgagccgacaaacggggaggacggggtgacgaa

SEQ ID NO: 76496 - DNA, 36 bp, Artificial Sequence
  Synthetic oligonucleotide
ggaccatccggctagtattggccttcactatgataa

SEQ ID NO: 76497 - DNA, 35 bp, Artificial Sequence
  Synthetic oligonucleotide
gatctgccaaatgcttaatacgttcgagttgcaca

SEQ ID NO: 76498 - DNA, 36 bp, Artificial Sequence
  Synthetic oligonucleotide
ttgtgcgtagcatgggctcgtagggggaacatgaca

SEQ ID NO: 76499 - DNA, 36 bp, Artificial Sequence
  Synthetic oligonucleotide
gaaggaacggagtaggggcaatgaagatcgagacca

SEQ ID NO: 76500 - DNA, 36 bp, Artificial Sequence
  Synthetic oligonucleotide
tcatcagatcatcctctgttgcatacgtattcccca

SEQ ID NO: 76501 - DNA, 36 bp, Artificial Sequence
  Synthetic oligonucleotide
actaacacgacgtcgcagagcaccgaaacacgtcca

SEQ ID NO: 76502 - DNA, 37 bp, Artificial Sequence
  Synthetic oligonucleotide
ttctccggcgcataccgactgccctaccgaatattca

SEQ ID NO: 76503 - DNA, 36 bp, Artificial Sequence
  Synthetic oligonucleotide
tcaccgcacaacgcgcacttgtacttctcacagaga

SEQ ID NO: 76504 - DNA, 37 bp, Artificial Sequence
  Synthetic oligonucleotide
tatcgccccggtggtacgcctttcggtcctaaataga

SEQ ID NO: 76505 - DNA, 36 bp, Artificial Sequence
  Synthetic oligonucleotide
aactgctccacctgtcttccgtaagaccttcataga

SEQ ID NO: 76506 - DNA, 37 bp, Artificial Sequence
  Synthetic oligonucleotide
gatccgcccgtgataccctgtactgtccgcacctaga

SEQ ID NO: 76507 - DNA, 35 bp, Artificial Sequence
  Synthetic oligonucleotide
atcatcacgccctcctggggtgttaactatctaga

SEQ ID NO: 76508 - DNA, 37 bp, Artificial Sequence
  Synthetic oligonucleotide
tccgacgtgagtcgtcacccatagttctttccgtaga

SEQ ID NO: 76509 - DNA, 35 bp, Artificial Sequence
  Synthetic oligonucleotide
gagacatgaaggataaggggaaacgctactgtaga

SEQ ID NO: 76510 - DNA, 37 bp, Artificial Sequence
  Synthetic oligonucleotide
gggtgcacgtgcgagctttggggtgggggtttgtaga

SEQ ID NO: 76511 - DNA, 37 bp, Artificial Sequence
  Synthetic oligonucleotide
tgaccctcgggtcacttcccccgtactcgcttaacga

SEQ ID NO: 76512 - DNA, 37 bp, Artificial Sequence
  Synthetic oligonucleotide
gtgttgttgggtgactgagagggacaatgggggacga

SEQ ID NO: 76513 - DNA, 37 bp, Artificial Sequence
  Synthetic oligonucleotide
tcgatcacatacttcattctgcacatgagctccccga

SEQ ID NO: 76514 - DNA, 37 bp, Artificial Sequence
  Synthetic oligonucleotide
gtggacattctcgccagcctctcataatcttctccga

SEQ ID NO: 76515 - DNA, 37 bp, Artificial Sequence
  Synthetic oligonucleotide
atctgacggcaccatcttctctctgcatcaatgtcga

SEQ ID NO: 76516 - DNA, 35 bp, Artificial Sequence
  Synthetic oligonucleotide
aagtacggcacaccagcgaaaaagggcctattcga

SEQ ID NO: 76517 - DNA, 37 bp, Artificial Sequence
  Synthetic oligonucleotide
accaacgcataggcaccactcatataccctaccagga

SEQ ID NO: 76518 - DNA, 37 bp, Artificial Sequence
  Synthetic oligonucleotide
gacaaaggcaagagttgtggcctggatggaaggagga

SEQ ID NO: 76519 - DNA, 37 bp, Artificial Sequence
  Synthetic oligonucleotide
atatggcgaggagcggaggagggaatccgagggagga

SEQ ID NO: 76520 - DNA, 37 bp, Artificial Sequence
  Synthetic oligonucleotide
atcaccctcatatctgtcaggtctccgcactgtagga

SEQ ID NO: 76521 - DNA, 37 bp, Artificial Sequence
  Synthetic oligonucleotide
tctcactccgagctcccttaaagtaactcccgtggga

SEQ ID NO: 76522 - DNA, 37 bp, Artificial Sequence
  Synthetic oligonucleotide
gcggtggagagaggggatgatttcagggggtgtggga

SEQ ID NO: 76523 - DNA, 37 bp, Artificial Sequence
  Synthetic oligonucleotide
gtcaactcccgcccgaactggtcttaatcatcatgga

SEQ ID NO: 76524 - DNA, 38 bp, Artificial Sequence
  Synthetic oligonucleotide
gtggtccaggctggccacagaacacgcacactctatga

SEQ ID NO: 76525 - DNA, 38 bp, Artificial Sequence
  Synthetic oligonucleotide
gtcacaccacgcttgataaaatccctctcagacactga

SEQ ID NO: 76526 - DNA, 38 bp, Artificial Sequence
  Synthetic oligonucleotide
gtgcccgattagcgtcgtcatctcattgcaatccctga

SEQ ID NO: 76527 - DNA, 37 bp, Artificial Sequence
  Synthetic oligonucleotide
aactgacgtctcccagccccgacgctccttcgcctga

SEQ ID NO: 76528 - DNA, 38 bp, Artificial Sequence
  Synthetic oligonucleotide
gtcccaccattcatgaatcaggcgttacaactgcctga

SEQ ID NO: 76529 - DNA, 36 bp, Artificial Sequence
  Synthetic oligonucleotide
accacaaccgcactacaagagttgtgttcctcctga

SEQ ID NO: 76530 - DNA, 37 bp, Artificial Sequence
  Synthetic oligonucleotide
gagaaaccgctgagtgtgagggggattggcggagtga

SEQ ID NO: 76531 - DNA, 36 bp, Artificial Sequence
  Synthetic oligonucleotide
atacgtggcgaggagaaggttagtagggggtcgtga

SEQ ID NO: 76532 - DNA, 36 bp, Artificial Sequence
  Synthetic oligonucleotide
tccgacccacatgggagtgaaagggggtacctgtga

SEQ ID NO: 76533 - DNA, 37 bp, Artificial Sequence
  Synthetic oligonucleotide
tagcggactctgcccctctgtgcttttctttcattga

SEQ ID NO: 76534 - DNA, 38 bp, Artificial Sequence
  Synthetic oligonucleotide
tacatcctcacttgctgccatagttcgacatcgattga

SEQ ID NO: 76535 - DNA, 38 bp, Artificial Sequence
  Synthetic oligonucleotide
tcaccgactgcgcacacctctaccgaacagtgccttga

SEQ ID NO: 76536 - DNA, 38 bp, Artificial Sequence
  Synthetic oligonucleotide
atgacgctacctaatcttaacagccgccttgtccttga

SEQ ID NO: 76537 - DNA, 38 bp, Artificial Sequence
  Synthetic oligonucleotide
gccaccttgccgtccagttctttctataaaacgcttga

SEQ ID NO: 76538 - DNA, 38 bp, Artificial Sequence
  Synthetic oligonucleotide
gtgtgtggggggcggatcgggtgaaaatccgcagttga

SEQ ID NO: 76539 - DNA, 38 bp, Artificial Sequence
  Synthetic oligonucleotide
gacccgatgtcaccattgcgatataccaccctagttga

SEQ ID NO: 76540 - DNA, 38 bp, Artificial Sequence
  Synthetic oligonucleotide
acaatgcaatcggaggaaaggggcacgatgcgggttga

SEQ ID NO: 76541 - DNA, 38 bp, Artificial Sequence
  Synthetic oligonucleotide
aagtgagggactgtgaaggggctactagcgatatttga

SEQ ID NO: 76542 - DNA, 37 bp, Artificial Sequence
  Synthetic oligonucleotide
attacaggggggtgggtgagggcagggtaagttttga

SEQ ID NO: 76543 - DNA, 35 bp, Artificial Sequence
  Synthetic oligonucleotide
tctgttccagccctgccatacttcgtcgtttttga

SEQ ID NO: 76544 - DNA, 36 bp, Artificial Sequence
  Synthetic oligonucleotide
ttagccactgtacccgccatgaacctctgcatacta

SEQ ID NO: 76545 - DNA, 36 bp, Artificial Sequence
  Synthetic oligonucleotide
agctgattcccgctttgctctggtgtcgcattccta

SEQ ID NO: 76546 - DNA, 36 bp, Artificial Sequence
  Synthetic oligonucleotide
gtctggtcgacccttcccattgcatgccggttccta

SEQ ID NO: 76547 - DNA, 36 bp, Artificial Sequence
  Synthetic oligonucleotide
aatgtcaccctccaagcatctgcagttcatacgcta

SEQ ID NO: 76548 - DNA, 36 bp, Artificial Sequence
  Synthetic oligonucleotide
aacctacccgccatgttgaccgacaaaggtctgcta

SEQ ID NO: 76549 - DNA, 36 bp, Artificial Sequence
  Synthetic oligonucleotide
ttccagcccacacctctcctctttttaccggcagta

SEQ ID NO: 76550 - DNA, 36 bp, Artificial Sequence
  Synthetic oligonucleotide
gagccccggcttgcacctccttattcccggtaggta

SEQ ID NO: 76551 - DNA, 36 bp, Artificial Sequence
  Synthetic oligonucleotide
gcacccagacgtctaagcgtttctatatgccactta

SEQ ID NO: 76552 - DNA, 35 bp, Artificial Sequence
  Synthetic oligonucleotide
acacgcaatccgcatcattccacatgatgctttta

SEQ ID NO: 76553 - DNA, 35 bp, Artificial Sequence
  Synthetic oligonucleotide
tccacccgagcgaaacgtcaagcatattcgcgcac

SEQ ID NO: 76554 - DNA, 35 bp, Artificial Sequence
  Synthetic oligonucleotide
gcccggacagggaaaacagtgtaaggtggttgtac

SEQ ID NO: 76555 - DNA, 35 bp, Artificial Sequence
  Synthetic oligonucleotide
tgcctgtcgttaaagactatccttatcacgctacc

SEQ ID NO: 76556 - DNA, 35 bp, Artificial Sequence
  Synthetic oligonucleotide
tcaccgaattcaactcactgctgccttatgtaccc

SEQ ID NO: 76557 - DNA, 35 bp, Artificial Sequence
  Synthetic oligonucleotide
ttgatgtcagcctgccccttggctccttagagccc

SEQ ID NO: 76558 - DNA, 35 bp, Artificial Sequence
  Synthetic oligonucleotide
gcacacacagcaataactcacgctacgtttcatcc

SEQ ID NO: 76559 - DNA, 36 bp, Artificial Sequence
  Synthetic oligonucleotide
ggacacccaccagacctagctcgttcatgcatatcc

SEQ ID NO: 76560 - DNA, 35 bp, Artificial Sequence
  Synthetic oligonucleotide
gcccgcgatacggaattatgtccttgtcggtctcc

SEQ ID NO: 76561 - DNA, 35 bp, Artificial Sequence
  Synthetic oligonucleotide
gactccgcctcgtgccttactgcattcacccgtgc

SEQ ID NO: 76562 - DNA, 35 bp, Artificial Sequence
  Synthetic oligonucleotide
agtggataccaccctctattacgttcactgcactc

SEQ ID NO: 76563 - DNA, 35 bp, Artificial Sequence
  Synthetic oligonucleotide
attgcccctcaccgaccatgtattcatgccccctc

SEQ ID NO: 76564 - DNA, 35 bp, Artificial Sequence
  Synthetic oligonucleotide
atgtgcactgcacacacctgggtgtggttgatctc

SEQ ID NO: 76565 - DNA, 35 bp, Artificial Sequence
  Synthetic oligonucleotide
accagttcgccattgtttctagctcttacacattc

SEQ ID NO: 76566 - DNA, 35 bp, Artificial Sequence
  Synthetic oligonucleotide
tggtgcagtgtaccgttttacaaccaccgtgcttc

SEQ ID NO: 76567 - DNA, 35 bp, Artificial Sequence
  Synthetic oligonucleotide
atcccacaacccaagcggacaggtcgcattacaag

SEQ ID NO: 76568 - DNA, 35 bp, Artificial Sequence
  Synthetic oligonucleotide
acctcctccggctactgttgcgttctcgactccag

SEQ ID NO: 76569 - DNA, 35 bp, Artificial Sequence
  Synthetic oligonucleotide
acttcagcaagtccggtcgaacgccccatccaccg

SEQ ID NO: 76570 - DNA, 35 bp, Artificial Sequence
  Synthetic oligonucleotide
gtgcaccacaacttcgtgatgcgtttcctttaccg

SEQ ID NO: 76571 - DNA, 35 bp, Artificial Sequence
  Synthetic oligonucleotide
gcgcctgtcgatcgttttgtttactcccctattcg

SEQ ID NO: 76572 - DNA, 35 bp, Artificial Sequence
  Synthetic oligonucleotide
ataccggagaggggggggatatggcaaaggcaagg

SEQ ID NO: 76573 - DNA, 35 bp, Artificial Sequence
  Synthetic oligonucleotide
gcgttgcccgggacgtcacattttatgttctttgg

SEQ ID NO: 76574 - DNA, 35 bp, Artificial Sequence
  Synthetic oligonucleotide
acccatcaccacagatgcctgtgctgcctattatg

SEQ ID NO: 76575 - DNA, 35 bp, Artificial Sequence
  Synthetic oligonucleotide
acggacttgacgctgacctcatttagttccccctg

SEQ ID NO: 76576 - DNA, 35 bp, Artificial Sequence
  Synthetic oligonucleotide
gccatggcacgggtctcgctgctacatagtccctg

SEQ ID NO: 76577 - DNA, 35 bp, Artificial Sequence
  Synthetic oligonucleotide
gaggatggtgcgaaaatggggaaatgtgtatattg

SEQ ID NO: 76578 - DNA, 35 bp, Artificial Sequence
  Synthetic oligonucleotide
accatgccaccactcaatcgtcctcgcaagatcat

SEQ ID NO: 76579 - DNA, 36 bp, Artificial Sequence
  Synthetic oligonucleotide
ttgtgcccctatcctaactgagtcgcaagtctacct

SEQ ID NO: 76580 - DNA, 35 bp, Artificial Sequence
  Synthetic oligonucleotide
tgactgccatacgccttctgaccccacgggagcct

SEQ ID NO: 76581 - DNA, 35 bp, Artificial Sequence
  Synthetic oligonucleotide
atatgcccggccaattatcagtcgcaattgttcct

SEQ ID NO: 76582 - DNA, 35 bp, Artificial Sequence
  Synthetic oligonucleotide
gttaaagcggcatagtccctaattctgtgctctct

SEQ ID NO: 76583 - DNA, 35 bp, Artificial Sequence
  Synthetic oligonucleotide
atggttaggaggcgaaggcacttagcggagagagt

SEQ ID NO: 76584 - DNA, 35 bp, Artificial Sequence
  Synthetic oligonucleotide
gtgcgcagaagttggaaattacgtaggaacggagt

SEQ ID NO: 76585 - DNA, 35 bp, Artificial Sequence
  Synthetic oligonucleotide
acgacgtggtggaaaggttacggaataacgaaggt

SEQ ID NO: 76586 - DNA, 35 bp, Artificial Sequence
  Synthetic oligonucleotide
acgttctgcctacccaggggcttgcatataccctt

SEQ ID NO: 76587 - DNA, 35 bp, Artificial Sequence
  Synthetic oligonucleotide
gacacccccctgatttagacgccgtgaattttctt

SEQ ID NO: 76588 - DNA, 35 bp, Artificial Sequence
  Synthetic oligonucleotide
gacgtctatcagctcataaaatacttccacccgtt

SEQ ID NO: 76589 - DNA, 35 bp, Artificial Sequence
  Synthetic oligonucleotide
gaacatcatccacgggaacgtagtccattgcattt

SEQ ID NO: 76590 - DNA, 35 bp, Artificial Sequence
  Synthetic oligonucleotide
gccgccctcgtccatttgaatcgttcatatacttt

SEQ ID NO: 76591 - DNA, 35 bp, Artificial Sequence
  Synthetic oligonucleotide
tttccccgttccgttggttctttattcgttccttt

SEQ ID NO: 76592 - DNA, 35 bp, Artificial Sequence
  Synthetic oligonucleotide
aagtctggtggtaggaggggggtgtgtacgaaaaa

SEQ ID NO: 76593 - DNA, 35 bp, Artificial Sequence
  Synthetic oligonucleotide
gaagccgaacaccagattgaacgccgcctataaaa

SEQ ID NO: 76594 - DNA, 36 bp, Artificial Sequence
  Synthetic oligonucleotide
tctctagcacgtcattcggtaccactccgcgccaaa

SEQ ID NO: 76595 - DNA, 36 bp, Artificial Sequence
  Synthetic oligonucleotide
tcgccactctgttctatctgctactctattgcgaaa

SEQ ID NO: 76596 - DNA, 35 bp, Artificial Sequence
  Synthetic oligonucleotide
aagacaagggtggggcagctaaggctcgatggaaa

SEQ ID NO: 76597 - DNA, 36 bp, Artificial Sequence
  Synthetic oligonucleotide
agaaacgcaggattttgagggggctggagggataaa

SEQ ID NO: 76598 - DNA, 36 bp, Artificial Sequence
  Synthetic oligonucleotide
acatatgctccgcctggtgtgctccgtactccccaa

SEQ ID NO: 76599 - DNA, 36 bp, Artificial Sequence
  Synthetic oligonucleotide
ggatcattcctgcctgtacagtaccacccggtccaa

SEQ ID NO: 76600 - DNA, 35 bp, Artificial Sequence
  Synthetic oligonucleotide
aacacaggcaggcgagtagagacatagaacatcaa

SEQ ID NO: 76601 - DNA, 36 bp, Artificial Sequence
  Synthetic oligonucleotide
actgggtgggttgcaggaggggctaaaaactaagaa

SEQ ID NO: 76602 - DNA, 35 bp, Artificial Sequence
  Synthetic oligonucleotide
gctacccagggctttgatctgaacccccctctgaa

SEQ ID NO: 76603 - DNA, 35 bp, Artificial Sequence
  Synthetic oligonucleotide
gtgccatatcgatcgacacgcccactatccattaa

SEQ ID NO: 76604 - DNA, 36 bp, Artificial Sequence
  Synthetic oligonucleotide
accacaccatcctatgttaaattcctacagacttaa

SEQ ID NO: 76605 - DNA, 35 bp, Artificial Sequence
  Synthetic oligonucleotide
gaccagtagaatggtaaaaatcgttgtaaaggaca

SEQ ID NO: 76606 - DNA, 35 bp, Artificial Sequence
  Synthetic oligonucleotide
atatcggccactactagctaacaagggctccacca

SEQ ID NO: 76607 - DNA, 36 bp, Artificial Sequence
  Synthetic oligonucleotide
tctccacaccgaggttatctctcaccttttggacca

SEQ ID NO: 76608 - DNA, 36 bp, Artificial Sequence
  Synthetic oligonucleotide
tcgaggtgccgacgcgccttatgtccctacctacca

SEQ ID NO: 76609 - DNA, 36 bp, Artificial Sequence
  Synthetic oligonucleotide
gacataccaccgatgcgattgtgcaagtatcgccca

SEQ ID NO: 76610 - DNA, 36 bp, Artificial Sequence
  Synthetic oligonucleotide
agctcgccttccacatgtatgagctcgccccttcca

SEQ ID NO: 76611 - DNA, 36 bp, Artificial Sequence
  Synthetic oligonucleotide
tcactgcgtacccaagcaagatcggaccaaaacgca

SEQ ID NO: 76612 - DNA, 36 bp, Artificial Sequence
  Synthetic oligonucleotide
tcccaccctggttgtcatccactcactgcccactca

SEQ ID NO: 76613 - DNA, 35 bp, Artificial Sequence
  Synthetic oligonucleotide
acccgcacccactcgcacccgccgccttgcactca

SEQ ID NO: 76614 - DNA, 35 bp, Artificial Sequence
  Synthetic oligonucleotide
tgaaacccctgttagtataccgtgcatcggtgtca

SEQ ID NO: 76615 - DNA, 36 bp, Artificial Sequence
  Synthetic oligonucleotide
gccacgctgatcgtagtaatagttttccatccttca

SEQ ID NO: 76616 - DNA, 36 bp, Artificial Sequence
  Synthetic oligonucleotide
gtcccccgcccaaaattgctaaggtgctttggttca

SEQ ID NO: 76617 - DNA, 35 bp, Artificial Sequence
  Synthetic oligonucleotide
gactccatcagtgcaacggacctttatatatttca

SEQ ID NO: 76618 - DNA, 36 bp, Artificial Sequence
  Synthetic oligonucleotide
tcagttcgatcatagtaccatctgcatgttctttca

SEQ ID NO: 76619 - DNA, 37 bp, Artificial Sequence
  Synthetic oligonucleotide
gacactcccgaggcttaacagtacatgcatatccaga

SEQ ID NO: 76620 - DNA, 36 bp, Artificial Sequence
  Synthetic oligonucleotide
atacccacacacttaatgccataccttcgactcaga

SEQ ID NO: 76621 - DNA, 37 bp, Artificial Sequence
  Synthetic oligonucleotide
gggggggggggtggggtaagagcaaagggtcgggaga

SEQ ID NO: 76622 - DNA, 37 bp, Artificial Sequence
  Synthetic oligonucleotide
accgccaccccgttgtgaccacgctagccccatgaga

SEQ ID NO: 76623 - DNA, 37 bp, Artificial Sequence
  Synthetic oligonucleotide
actcctagccacttcaccgtgccgttctccttgtaga

SEQ ID NO: 76624 - DNA, 37 bp, Artificial Sequence
  Synthetic oligonucleotide
tgcatatctccgcacgccatctttccgcaacagacga

SEQ ID NO: 76625 - DNA, 37 bp, Artificial Sequence
  Synthetic oligonucleotide
ggggggacgacatagagactcgggtggggtgggacga

SEQ ID NO: 76626 - DNA, 35 bp, Artificial Sequence
  Synthetic oligonucleotide
tccttacccctcccgatccgtacgagtgcccccga

SEQ ID NO: 76627 - DNA, 37 bp, Artificial Sequence
  Synthetic oligonucleotide
acaccaccgaacatatccgcctcttatttattgccga

SEQ ID NO: 76628 - DNA, 37 bp, Artificial Sequence
  Synthetic oligonucleotide
gatgtagcccggccctgaatagccatttctcctccga

SEQ ID NO: 76629 - DNA, 36 bp, Artificial Sequence
  Synthetic oligonucleotide
gagggaggggagcagattgggtaccaaacggggcga

SEQ ID NO: 76630 - DNA, 37 bp, Artificial Sequence
  Synthetic oligonucleotide
tataaccactcccatccgccccagtctgccgtccgga

SEQ ID NO: 76631 - DNA, 36 bp, Artificial Sequence
  Synthetic oligonucleotide
ttcagacgtgagggtcgacacagtggagggtgcgga

SEQ ID NO: 76632 - DNA, 37 bp, Artificial Sequence
  Synthetic oligonucleotide
tactgggggcaaacaacggagactgagaccaacggga

SEQ ID NO: 76633 - DNA, 35 bp, Artificial Sequence
  Synthetic oligonucleotide
actggaaagacggggatggaagtgaactgacggga

SEQ ID NO: 76634 - DNA, 36 bp, Artificial Sequence
  Synthetic oligonucleotide
ggacaatcgcgtggtgggaaataggatgcgtttgga

SEQ ID NO: 76635 - DNA, 38 bp, Artificial Sequence
  Synthetic oligonucleotide
accgactcctttgccaccacgttacattcaacgaatga

SEQ ID NO: 76636 - DNA, 38 bp, Artificial Sequence
  Synthetic oligonucleotide
ggatgaagaaagggaaaacgacgggacgctaggaatga

SEQ ID NO: 76637 - DNA, 37 bp, Artificial Sequence
  Synthetic oligonucleotide
tgatcaccttgccttagagttaccgttccaaacatga

SEQ ID NO: 76638 - DNA, 38 bp, Artificial Sequence
  Synthetic oligonucleotide
tgaaaccttccacacttgcccatgcaacaaatgcatga

SEQ ID NO: 76639 - DNA, 38 bp, Artificial Sequence
  Synthetic oligonucleotide
gtgtgcaccgctgaataatcgtatcgcgccacctatga

SEQ ID NO: 76640 - DNA, 38 bp, Artificial Sequence
  Synthetic oligonucleotide
tgtctagccgtaaaactcacgctcccagacccctatga

SEQ ID NO: 76641 - DNA, 37 bp, Artificial Sequence
  Synthetic oligonucleotide
gctggaagcccaccttagggcgaatttggaacactga

SEQ ID NO: 76642 - DNA, 38 bp, Artificial Sequence
  Synthetic oligonucleotide
catcgcgaatctccggcgtattataactctcatactga

SEQ ID NO: 76643 - DNA, 38 bp, Artificial Sequence
  Synthetic oligonucleotide
acctgcaactcagcgtgctccatgtccctcgaacctga

SEQ ID NO: 76644 - DNA, 38 bp, Artificial Sequence
  Synthetic oligonucleotide
gtccagcggcctcgtagtacctcgctggtgttccctga

SEQ ID NO: 76645 - DNA, 38 bp, Artificial Sequence
  Synthetic oligonucleotide
tcctgccagagttcaacgttctttttagcgcctcctga

SEQ ID NO: 76646 - DNA, 38 bp, Artificial Sequence
  Synthetic oligonucleotide
agggccacacacccggatttcgactcgctttcatctga

SEQ ID NO: 76647 - DNA, 37 bp, Artificial Sequence
  Synthetic oligonucleotide
accgcgcatctctcacacccgtagtctctgaaagtga

SEQ ID NO: 76648 - DNA, 38 bp, Artificial Sequence
  Synthetic oligonucleotide
acgctacaaaggctagaaaggggatgggggataggtga

SEQ ID NO: 76649 - DNA, 38 bp, Artificial Sequence
  Synthetic oligonucleotide
gccactgggttagggtaagggataagggagaggggtga

SEQ ID NO: 76650 - DNA, 38 bp, Artificial Sequence
  Synthetic oligonucleotide
tgacaaagaggaagaaaaggtagttacacacggggtga

SEQ ID NO: 76651 - DNA, 38 bp, Artificial Sequence
  Synthetic oligonucleotide
tcaggacatgaggaggtaggggggaaagcaccctgtga

SEQ ID NO: 76652 - DNA, 38 bp, Artificial Sequence
  Synthetic oligonucleotide
attggcccagtctcatctccgacagcacctgcgtgtga

SEQ ID NO: 76653 - DNA, 37 bp, Artificial Sequence
  Synthetic oligonucleotide
tcattacccggcccatacatctgtccgcctcgtgtga

SEQ ID NO: 76654 - DNA, 38 bp, Artificial Sequence
  Synthetic oligonucleotide
gaagcatacaaaaggagggaggatagggtgcaatttga

SEQ ID NO: 76655 - DNA, 37 bp, Artificial Sequence
  Synthetic oligonucleotide
tagcgacgccgcatcggtacgtaatttaccactttga

SEQ ID NO: 76656 - DNA, 38 bp, Artificial Sequence
  Synthetic oligonucleotide
gccacgatgttcgtgttcctcgaattcacccactttga

SEQ ID NO: 76657 - DNA, 38 bp, Artificial Sequence
  Synthetic oligonucleotide
gaaacgcagatctcaaacctgccccgtccccgctttga

SEQ ID NO: 76658 - DNA, 36 bp, Artificial Sequence
  Synthetic oligonucleotide
acacacgtcgtccagtcgcaaaccaattatagcata

SEQ ID NO: 76659 - DNA, 36 bp, Artificial Sequence
  Synthetic oligonucleotide
aactacctccatcctgttgtgagattcgcacaccta

SEQ ID NO: 76660 - DNA, 34 bp, Artificial Sequence
  Synthetic oligonucleotide
taccccagccttggctctcaatcttacgtcccta

SEQ ID NO: 76661 - DNA, 35 bp, Artificial Sequence
  Synthetic oligonucleotide
tacgtagggcatccagagtttccgtttctctcgta

SEQ ID NO: 76662 - DNA, 35 bp, Artificial Sequence
  Synthetic oligonucleotide
gacaccgacttatcttaccaatgtcggattgatta

SEQ ID NO: 76663 - DNA, 36 bp, Artificial Sequence
  Synthetic oligonucleotide
ttcccgttcccgttcgtccccaatactgatgcctta

SEQ ID NO: 76664 - DNA, 36 bp, Artificial Sequence
  Synthetic oligonucleotide
atggatgctcgggtccttttccaacgcttctcctta

SEQ ID NO: 76665 - DNA, 36 bp, Artificial Sequence
  Synthetic oligonucleotide
gcacaaccgcccactcttgacggacaaggcatctta

SEQ ID NO: 76666 - DNA, 36 bp, Artificial Sequence
  Synthetic oligonucleotide
agtggggggggtgacaaactgggcgtaatggggtta

SEQ ID NO: 76667 - DNA, 35 bp, Artificial Sequence
  Synthetic oligonucleotide
ttgtcccgcacaacagcgcagttcctcctcattta

SEQ ID NO: 76668 - DNA, 35 bp, Artificial Sequence
  Synthetic oligonucleotide
gcccgatcatgccggcgcgaccttatccaacaaac

SEQ ID NO: 76669 - DNA, 35 bp, Artificial Sequence
  Synthetic oligonucleotide
tcatgtaccgcccatatagttggcttgtcatttac

SEQ ID NO: 76670 - DNA, 35 bp, Artificial Sequence
  Synthetic oligonucleotide
tgtcccccacatgctattctcgtacgtacttaacc

SEQ ID NO: 76671 - DNA, 35 bp, Artificial Sequence
  Synthetic oligonucleotide
acgctaacccgacgccttgtcatccgttgcctacc

SEQ ID NO: 76672 - DNA, 35 bp, Artificial Sequence
  Synthetic oligonucleotide
gccccattacacatggttttgtacttgtgaccccc

SEQ ID NO: 76673 - DNA, 35 bp, Artificial Sequence
  Synthetic oligonucleotide
gcgatgtgatcgcgaatcgttacttctgtgatccc

SEQ ID NO: 76674 - DNA, 35 bp, Artificial Sequence
  Synthetic oligonucleotide
gtgcgtcgcccccgtccctattgcatcattgtccc

SEQ ID NO: 76675 - DNA, 35 bp, Artificial Sequence
  Synthetic oligonucleotide
acctaccatacgatgaatgtcgctaaactcgtgcc

SEQ ID NO: 76676 - DNA, 35 bp, Artificial Sequence
  Synthetic oligonucleotide
agtccgacatgtcccgctggctcacccatatatcc

SEQ ID NO: 76677 - DNA, 35 bp, Artificial Sequence
  Synthetic oligonucleotide
tgtcctctgatagcttccgtgcagtcacgacctcc

SEQ ID NO: 76678 - DNA, 35 bp, Artificial Sequence
  Synthetic oligonucleotide
gactagagcacggttcacagcccgaaattttccgc

SEQ ID NO: 76679 - DNA, 35 bp, Artificial Sequence
  Synthetic oligonucleotide
gggggaagcccatcggtaggtcccctccatattgc

SEQ ID NO: 76680 - DNA, 35 bp, Artificial Sequence
  Synthetic oligonucleotide
ttgaggctcccccggtccggcccgtttgtcacatc

SEQ ID NO: 76681 - DNA, 35 bp, Artificial Sequence
  Synthetic oligonucleotide
cattacgatgccttccatgtccttgagaacctatc

SEQ ID NO: 76682 - DNA, 35 bp, Artificial Sequence
  Synthetic oligonucleotide
tgcccgtaaatgcccagcaatcaccggatcaactc

SEQ ID NO: 76683 - DNA, 35 bp, Artificial Sequence
  Synthetic oligonucleotide
atctcgacagcctttgaaccgttgcttctcgactc

SEQ ID NO: 76684 - DNA, 35 bp, Artificial Sequence
  Synthetic oligonucleotide
acgtccagccgcctcgtttcgctttcttctacctc

SEQ ID NO: 76685 - DNA, 35 bp, Artificial Sequence
  Synthetic oligonucleotide
tcccacgcgcactcgcatatcggtgcgttcctctc

SEQ ID NO: 76686 - DNA, 35 bp, Artificial Sequence
  Synthetic oligonucleotide
aacacgccgaggctccaagaggcgtgtggattctc

SEQ ID NO: 76687 - DNA, 35 bp, Artificial Sequence
  Synthetic oligonucleotide
tggtgcccggatcttcatcgttggtaggccttctc

SEQ ID NO: 76688 - DNA, 35 bp, Artificial Sequence
  Synthetic oligonucleotide
tgcctccgcgcacaactcgcccgggtctcaaggtc

SEQ ID NO: 76689 - DNA, 35 bp, Artificial Sequence
  Synthetic oligonucleotide
gcgcgatcctgcccagtgtcgatatcttctgcttc

SEQ ID NO: 76690 - DNA, 35 bp, Artificial Sequence
  Synthetic oligonucleotide
gggaactgcgccccacttgcataccccccgttttc

SEQ ID NO: 76691 - DNA, 35 bp, Artificial Sequence
  Synthetic oligonucleotide
atgcgtggtagtaattacggtgtggtggtgaggag

SEQ ID NO: 76692 - DNA, 35 bp, Artificial Sequence
  Synthetic oligonucleotide
tgccagtgccgttttgccccaccccactcatggag

SEQ ID NO: 76693 - DNA, 35 bp, Artificial Sequence
  Synthetic oligonucleotide
gtgatgagggttggattggacagatcaccagatag

SEQ ID NO: 76694 - DNA, 35 bp, Artificial Sequence
  Synthetic oligonucleotide
gataccgtacatcttaccgccggccctcttggtag

SEQ ID NO: 76695 - DNA, 35 bp, Artificial Sequence
  Synthetic oligonucleotide
acaccagtcgtatggggaactaagggttcgtgacg

SEQ ID NO: 76696 - DNA, 35 bp, Artificial Sequence
  Synthetic oligonucleotide
tgcgatgtggctggtttttcggtgtcgctttatcg

SEQ ID NO: 76697 - DNA, 35 bp, Artificial Sequence
  Synthetic oligonucleotide
tcgcccctccgcttgtttcttgctcctcttggtcg

SEQ ID NO: 76698 - DNA, 35 bp, Artificial Sequence
  Synthetic oligonucleotide
agcgcaatcctttgtgtcggctttttcactcttcg

SEQ ID NO: 76699 - DNA, 35 bp, Artificial Sequence
  Synthetic oligonucleotide
tatggatgcggcgagggggcgcgtggagttagggg

SEQ ID NO: 76700 - DNA, 35 bp, Artificial Sequence
  Synthetic oligonucleotide
aactggtggggtgcaaggggatagccgcgcttggg

SEQ ID NO: 76701 - DNA, 35 bp, Artificial Sequence
  Synthetic oligonucleotide
tgtgccccgtttcttgtcccgaattttcacacatg

SEQ ID NO: 76702 - DNA, 35 bp, Artificial Sequence
  Synthetic oligonucleotide
gcccacccacgacttcacaacctgaaaatttgctg

SEQ ID NO: 76703 - DNA, 35 bp, Artificial Sequence
  Synthetic oligonucleotide
gaatataagttcgcccagcctgcctattgatccat

SEQ ID NO: 76704 - DNA, 35 bp, Artificial Sequence
  Synthetic oligonucleotide
gctcctctgcggagccgatccgcccccttacgtat

SEQ ID NO: 76705 - DNA, 35 bp, Artificial Sequence
  Synthetic oligonucleotide
gatgaacggaagtaaggccaaaggggtcagcaact

SEQ ID NO: 76706 - DNA, 35 bp, Artificial Sequence
  Synthetic oligonucleotide
accattcggtgcggagtcaatgtatcccatcccct

SEQ ID NO: 76707 - DNA, 35 bp, Artificial Sequence
  Synthetic oligonucleotide
tgcgcgagtgtaacccccgaccaagcacttcccct

SEQ ID NO: 76708 - DNA, 35 bp, Artificial Sequence
  Synthetic oligonucleotide
gcgtgaacaggcgatattgagcctatgcacctcct

SEQ ID NO: 76709 - DNA, 35 bp, Artificial Sequence
  Synthetic oligonucleotide
agtcccgcacttgcccttcgcaccctgttccttct

SEQ ID NO: 76710 - DNA, 35 bp, Artificial Sequence
  Synthetic oligonucleotide
tcccacgccccccgtctccgctaagactatactgt

SEQ ID NO: 76711 - DNA, 35 bp, Artificial Sequence
  Synthetic oligonucleotide
acgcggagcccccccttcacactcgtatatgctgt

SEQ ID NO: 76712 - DNA, 35 bp, Artificial Sequence
  Synthetic oligonucleotide
gacgaccatgtacctgccaatcaaccgcttgcctt

SEQ ID NO: 76713 - DNA, 35 bp, Artificial Sequence
  Synthetic oligonucleotide
ttcacctgccggcggttactcgaataaccttcctt

SEQ ID NO: 76714 - DNA, 36 bp, Artificial Sequence
  Synthetic oligonucleotide
acatccttcacatcgtggatcattgatgatcgcaaa

SEQ ID NO: 76715 - DNA, 36 bp, Artificial Sequence
  Synthetic oligonucleotide
gtcacgtgctgtcctctatagccaccggtgcctaaa

SEQ ID NO: 76716 - DNA, 36 bp, Artificial Sequence
  Synthetic oligonucleotide
ttctcaatcagcctgccgtaccaagcgcaacaccaa

SEQ ID NO: 76717 - DNA, 36 bp, Artificial Sequence
  Synthetic oligonucleotide
ttgatagacgcaatcgttcctcgcccttgctaccaa

SEQ ID NO: 76718 - DNA, 36 bp, Artificial Sequence
  Synthetic oligonucleotide
tcagttacccgcctgtcccgtttaccacccggtcaa

SEQ ID NO: 76719 - DNA, 35 bp, Artificial Sequence
  Synthetic oligonucleotide
tttagcgcctctggacccccttactcatgccggaa

SEQ ID NO: 76720 - DNA, 35 bp, Artificial Sequence
  Synthetic oligonucleotide
acactcacaggcatgccgggggatcccggtgggaa

SEQ ID NO: 76721 - DNA, 35 bp, Artificial Sequence
  Synthetic oligonucleotide
ggaagacggctacatttgtgaggggggagggataa

SEQ ID NO: 76722 - DNA, 36 bp, Artificial Sequence
  Synthetic oligonucleotide
acaccgaacgggacgttgaatagggcggggggataa

SEQ ID NO: 76723 - DNA, 36 bp, Artificial Sequence
  Synthetic oligonucleotide
tccaccgtacaacatgatactactccgcctggctaa

SEQ ID NO: 76724 - DNA, 31 bp, Artificial Sequence
  Synthetic oligonucleotide
gcaccaccctttggctctagtacttttgtaa

SEQ ID NO: 76725 - DNA, 36 bp, Artificial Sequence
  Synthetic oligonucleotide
actcgtgcgcaccaatcctgctggttagcaaacaca

SEQ ID NO: 76726 - DNA, 36 bp, Artificial Sequence
  Synthetic oligonucleotide
actgggctacattatgcgcatctaacactagttaca

SEQ ID NO: 76727 - DNA, 36 bp, Artificial Sequence
  Synthetic oligonucleotide
tccctccgccattcccatataaccgaacgttgacca

SEQ ID NO: 76728 - DNA, 36 bp, Artificial Sequence
  Synthetic oligonucleotide
gcatcgcaagccttagtcgacctgttactcatacca

SEQ ID NO: 76729 - DNA, 36 bp, Artificial Sequence
  Synthetic oligonucleotide
gcacccctgggtcgaacataacagacaataccccca

SEQ ID NO: 76730 - DNA, 36 bp, Artificial Sequence
  Synthetic oligonucleotide
ttcacccctgtgcttctgtcttcacggcattgccca

SEQ ID NO: 76731 - DNA, 36 bp, Artificial Sequence
  Synthetic oligonucleotide
tttgtcgaccggtgcccgtcctatagcacacatcca

SEQ ID NO: 76732 - DNA, 36 bp, Artificial Sequence
  Synthetic oligonucleotide
gcatctgcaccaggtcctctatttgcgggggctcca

SEQ ID NO: 76733 - DNA, 35 bp, Artificial Sequence
  Synthetic oligonucleotide
attgcgaccttccaatgctgatactattacgtcca

SEQ ID NO: 76734 - DNA, 36 bp, Artificial Sequence
  Synthetic oligonucleotide
ttacacgggggagggggtcgagggtgacgaggtcca

SEQ ID NO: 76735 - DNA, 36 bp, Artificial Sequence
  Synthetic oligonucleotide
aacaggtacgccattaactgattcatccttcacgca

SEQ ID NO: 76736 - DNA, 36 bp, Artificial Sequence
  Synthetic oligonucleotide
tctgatcgcaacgagtttatcacacccacacgcgca

SEQ ID NO: 76737 - DNA, 35 bp, Artificial Sequence
  Synthetic oligonucleotide
caaccacatctgcctgagaactactcaacgcctca

SEQ ID NO: 76738 - DNA, 36 bp, Artificial Sequence
  Synthetic oligonucleotide
gcaccgctgtgtcgatcctgcccgcgcgcctgctca

SEQ ID NO: 76739 - DNA, 36 bp, Artificial Sequence
  Synthetic oligonucleotide
tgtactccaatgcattttcactgttcccagttctca

SEQ ID NO: 76740 - DNA, 36 bp, Artificial Sequence
  Synthetic oligonucleotide
gtctgaatccgacgcctccagcctactagtatgtca

SEQ ID NO: 76741 - DNA, 36 bp, Artificial Sequence
  Synthetic oligonucleotide
aggagtactgcagctgggtgggaatcatggatttca

SEQ ID NO: 76742 - DNA, 35 bp, Artificial Sequence
  Synthetic oligonucleotide
gagcccagacaatactagatccaccatacgtttca

SEQ ID NO: 76743 - DNA, 37 bp, Artificial Sequence
  Synthetic oligonucleotide
tcactgttgaagcgatatggggggcaaagtaggaaga

SEQ ID NO: 76744 - DNA, 37 bp, Artificial Sequence
  Synthetic oligonucleotide
gtgtctggcggagggtgacacgggttaagaggtgaga

SEQ ID NO: 76745 - DNA, 37 bp, Artificial Sequence
  Synthetic oligonucleotide
gttacccgaacccggcctcattcatcccgcctataga

SEQ ID NO: 76746 - DNA, 37 bp, Artificial Sequence
  Synthetic oligonucleotide
agccagtggccgcccccgttcctcacaaacagctaga

SEQ ID NO: 76747 - DNA, 37 bp, Artificial Sequence
  Synthetic oligonucleotide
actctacgcgccgattctaccttcctgtacccaacga

SEQ ID NO: 76748 - DNA, 37 bp, Artificial Sequence
  Synthetic oligonucleotide
gatacgcgcatagtatgcgggggtggggtggaaccga

SEQ ID NO: 76749 - DNA, 37 bp, Artificial Sequence
  Synthetic oligonucleotide
aaccgaccacccatatccgtttgacgaggtgacccga

SEQ ID NO: 76750 - DNA, 35 bp, Artificial Sequence
  Synthetic oligonucleotide
tcgacgaccgcctatcgttccatcgccgttgccga

SEQ ID NO: 76751 - DNA, 35 bp, Artificial Sequence
  Synthetic oligonucleotide
gtatctgccctcacgctaacaccatatgtttccga

SEQ ID NO: 76752 - DNA, 37 bp, Artificial Sequence
  Synthetic oligonucleotide
gatgtgtccacttgtctccctggcttggcttcctcga

SEQ ID NO: 76753 - DNA, 37 bp, Artificial Sequence
  Synthetic oligonucleotide
cacccttacatgattccgcccagtgccgattcgtcga

SEQ ID NO: 76754 - DNA, 37 bp, Artificial Sequence
  Synthetic oligonucleotide
ataaccccgccctgctactacgactgagaactgtcga

SEQ ID NO: 76755 - DNA, 37 bp, Artificial Sequence
  Synthetic oligonucleotide
gccaatccgacactcaccctcccgagtgtaacgagga

SEQ ID NO: 76756 - DNA, 36 bp, Artificial Sequence
  Synthetic oligonucleotide
acaggggcctttgtagggggagtaaaggggtacgga

SEQ ID NO: 76757 - DNA, 37 bp, Artificial Sequence
  Synthetic oligonucleotide
acaccactctatcaaatgcgtctttacagttagcgga

SEQ ID NO: 76758 - DNA, 37 bp, Artificial Sequence
  Synthetic oligonucleotide
tacgtgtgtgcgtaacgtacataaggagtcacaggga

SEQ ID NO: 76759 - DNA, 37 bp, Artificial Sequence
  Synthetic oligonucleotide
ggggagagggagtgggcctagcagaggtcacatggga

SEQ ID NO: 76760 - DNA, 37 bp, Artificial Sequence
  Synthetic oligonucleotide
gcggagccgcatccctcccgactcataacccgtggga

SEQ ID NO: 76761 - DNA, 37 bp, Artificial Sequence
  Synthetic oligonucleotide
gaacagctgtgcaacaagattaagagcgggtgatgga

SEQ ID NO: 76762 - DNA, 37 bp, Artificial Sequence
  Synthetic oligonucleotide
acactcccggtctcagtgcatatttcgtggcacatga

SEQ ID NO: 76763 - DNA, 38 bp, Artificial Sequence
  Synthetic oligonucleotide
accagccaccggtgaaaaatacctcctccgtaccatga

SEQ ID NO: 76764 - DNA, 37 bp, Artificial Sequence
  Synthetic oligonucleotide
acacacgaacgcgaaaatgaacatgttgatgggatga

SEQ ID NO: 76765 - DNA, 38 bp, Artificial Sequence
  Synthetic oligonucleotide
gacataccgagtggaccgactgcagctgaacgccctga

SEQ ID NO: 76766 - DNA, 35 bp, Artificial Sequence
  Synthetic oligonucleotide
tgtcaagcagaccacaccgtacccaaaccatctga

SEQ ID NO: 76767 - DNA, 38 bp, Artificial Sequence
  Synthetic oligonucleotide
aatctccacccgtctcatactctcgacgtgacacgtga

SEQ ID NO: 76768 - DNA, 37 bp, Artificial Sequence
  Synthetic oligonucleotide
gattgtcgcaccatcgatctcttcgctccctccgtga

SEQ ID NO: 76769 - DNA, 38 bp, Artificial Sequence
  Synthetic oligonucleotide
gaaacgccacccgcacatacttcgctatctctgcgtga

SEQ ID NO: 76770 - DNA, 38 bp, Artificial Sequence
  Synthetic oligonucleotide
gttgcggtggcatttcttcgctccatccttcctcgtga

SEQ ID NO: 76771 - DNA, 37 bp, Artificial Sequence
  Synthetic oligonucleotide
accggaaggatatgggatgggaggggtagggaggtga

SEQ ID NO: 76772 - DNA, 38 bp, Artificial Sequence
  Synthetic oligonucleotide
attacgctagggacaggagcgaggaggacacggggtga

SEQ ID NO: 76773 - DNA, 37 bp, Artificial Sequence
  Synthetic oligonucleotide
tctcagggaaaaaagcaaagggggctggccgtggtga

SEQ ID NO: 76774 - DNA, 37 bp, Artificial Sequence
  Synthetic oligonucleotide
aacatcgcactgcacgggggaacagtaggcttggtga

SEQ ID NO: 76775 - DNA, 38 bp, Artificial Sequence
  Synthetic oligonucleotide
acccgcgagtggaaagggggagcggagtggacatgtga

SEQ ID NO: 76776 - DNA, 38 bp, Artificial Sequence
  Synthetic oligonucleotide
gactgtgctgccctctaggaccccagtcaaccgtgtga

SEQ ID NO: 76777 - DNA, 38 bp, Artificial Sequence
  Synthetic oligonucleotide
gatcccaccgggtatgttctcattaatactgacattga

SEQ ID NO: 76778 - DNA, 38 bp, Artificial Sequence
  Synthetic oligonucleotide
gacccgtgccatctttaactatagcctatgtacattga

SEQ ID NO: 76779 - DNA, 37 bp, Artificial Sequence
  Synthetic oligonucleotide
ggggatggtccgacatgggggggactaggggtattga

SEQ ID NO: 76780 - DNA, 38 bp, Artificial Sequence
  Synthetic oligonucleotide
atcgcaacaacacaaattgccaacgacccagttattga

SEQ ID NO: 76781 - DNA, 38 bp, Artificial Sequence
  Synthetic oligonucleotide
gacacatacaatacctcgcctggtcaaggaaaccttga

SEQ ID NO: 76782 - DNA, 38 bp, Artificial Sequence
  Synthetic oligonucleotide
gccgcctgcggtcctgtatccgcttctcaaactgttga

SEQ ID NO: 76783 - DNA, 36 bp, Artificial Sequence
  Synthetic oligonucleotide
atgaaagcgacgttccccctgttgccatcccacata

SEQ ID NO: 76784 - DNA, 36 bp, Artificial Sequence
  Synthetic oligonucleotide
acgaagaacgtggggttgaatggtcgtatggggata

SEQ ID NO: 76785 - DNA, 36 bp, Artificial Sequence
  Synthetic oligonucleotide
tcatgagaacactgagcccgcgccaaactacaacta

SEQ ID NO: 76786 - DNA, 36 bp, Artificial Sequence
  Synthetic oligonucleotide
gcaagccctcttcgactttgtaactagctccatcta

SEQ ID NO: 76787 - DNA, 36 bp, Artificial Sequence
  Synthetic oligonucleotide
gctgaacggctttcagttggccccatctctcgtcta

SEQ ID NO: 76788 - DNA, 36 bp, Artificial Sequence
  Synthetic oligonucleotide
tgctgatgcgcagctcaacagctcccccctaatgta

SEQ ID NO: 76789 - DNA, 36 bp, Artificial Sequence
  Synthetic oligonucleotide
tctgtctggttggtccatctgtgcgccccagcctta

SEQ ID NO: 76790 - DNA, 36 bp, Artificial Sequence
  Synthetic oligonucleotide
gtcaagcaggtgccccacggcccttccttctagtta

SEQ ID NO: 76791 - DNA, 35 bp, Artificial Sequence
  Synthetic oligonucleotide
tccgcctctatgtcccagcgatatgcggaacgtta

SEQ ID NO: 76792 - DNA, 36 bp, Artificial Sequence
  Synthetic oligonucleotide
aacaacgctccatcgcttccagatgttcctctgtta

SEQ ID NO: 76793 - DNA, 35 bp, Artificial Sequence
  Synthetic oligonucleotide
tctagggcactactgcgaaattatgatccttccac

SEQ ID NO: 76794 - DNA, 35 bp, Artificial Sequence
  Synthetic oligonucleotide
gcgctcgtaccttacgcattatgaagtctacctac

SEQ ID NO: 76795 - DNA, 35 bp, Artificial Sequence
  Synthetic oligonucleotide
gccacatcctccaatccggcctccccgagccgtac

SEQ ID NO: 76796 - DNA, 35 bp, Artificial Sequence
  Synthetic oligonucleotide
gctccctaccgctgccctctcaccagtgaacttac

SEQ ID NO: 76797 - DNA, 35 bp, Artificial Sequence
  Synthetic oligonucleotide
tgaggcctacgtgctcgcgttgtctccatgatacc

SEQ ID NO: 76798 - DNA, 35 bp, Artificial Sequence
  Synthetic oligonucleotide
agccacatcaattagtttccgatctcatggtcccc

SEQ ID NO: 76799 - DNA, 35 bp, Artificial Sequence
  Synthetic oligonucleotide
ttcgaaccatcgtctcaccctgttgcggcggtccc

SEQ ID NO: 76800 - DNA, 35 bp, Artificial Sequence
  Synthetic oligonucleotide
acacccggcctacctacgttctatgctatgttgcc

SEQ ID NO: 76801 - DNA, 35 bp, Artificial Sequence
  Synthetic oligonucleotide
atggaacggatctcattagcttcgaagactcccgc

SEQ ID NO: 76802 - DNA, 35 bp, Artificial Sequence
  Synthetic oligonucleotide
tgcgagagcatgagagggtttgggaaagggtgggc

SEQ ID NO: 76803 - DNA, 35 bp, Artificial Sequence
  Synthetic oligonucleotide
ggacacgtggcttccctgttgcacttcgccgtggc

SEQ ID NO: 76804 - DNA, 35 bp, Artificial Sequence
  Synthetic oligonucleotide
aaacgcccacatttccgttgagctttcaagccatc

SEQ ID NO: 76805 - DNA, 35 bp, Artificial Sequence
  Synthetic oligonucleotide
tcttcgcataacatccccgtcacgctactcgcatc

SEQ ID NO: 76806 - DNA, 35 bp, Artificial Sequence
  Synthetic oligonucleotide
ttcgtaacgtcacagaactttactatggcactatc

SEQ ID NO: 76807 - DNA, 35 bp, Artificial Sequence
  Synthetic oligonucleotide
acaccgcaccattggctactcaacagcactacctc

SEQ ID NO: 76808 - DNA, 35 bp, Artificial Sequence
  Synthetic oligonucleotide
tcccgcgtgctcctttaaccctccatggtcctgtc

SEQ ID NO: 76809 - DNA, 35 bp, Artificial Sequence
  Synthetic oligonucleotide
gcaaacatccgcatagaccactcgatacccgaaag

SEQ ID NO: 76810 - DNA, 35 bp, Artificial Sequence
  Synthetic oligonucleotide
gttgcccaaaatgcgctccctcccctgctatccag

SEQ ID NO: 76811 - DNA, 35 bp, Artificial Sequence
  Synthetic oligonucleotide
tgggagagtcaaggagggggaaaagggagccgcag

SEQ ID NO: 76812 - DNA, 35 bp, Artificial Sequence
  Synthetic oligonucleotide
tgcaataaccatccccgtgttcacagacttctacg

SEQ ID NO: 76813 - DNA, 35 bp, Artificial Sequence
  Synthetic oligonucleotide
gccccacccgccaaacatcaagaaacaagcgtccg

SEQ ID NO: 76814 - DNA, 35 bp, Artificial Sequence
  Synthetic oligonucleotide
tagtactatccgtgtgcaaatctatctatctctcg

SEQ ID NO: 76815 - DNA, 35 bp, Artificial Sequence
  Synthetic oligonucleotide
acgtgcctgataggaaaggggtgtctggacggtgg

SEQ ID NO: 76816 - DNA, 35 bp, Artificial Sequence
  Synthetic oligonucleotide
aacatgggaaccggaatcaatggaccagcaggttg

SEQ ID NO: 76817 - DNA, 35 bp, Artificial Sequence
  Synthetic oligonucleotide
gtgccaaatccccggtaatccgtactgtgaccaat

SEQ ID NO: 76818 - DNA, 35 bp, Artificial Sequence
  Synthetic oligonucleotide
accgtctacactctacactgtcctgtgagccctat

SEQ ID NO: 76819 - DNA, 35 bp, Artificial Sequence
  Synthetic oligonucleotide
tcacagaggaagggggcagtaatcaagtgcgctat

SEQ ID NO: 76820 - DNA, 35 bp, Artificial Sequence
  Synthetic oligonucleotide
gtcgagtcaccaccacctagttaagtcatctctat

SEQ ID NO: 76821 - DNA, 35 bp, Artificial Sequence
  Synthetic oligonucleotide
atgccacgccctcgcatactacctgcccatccact

SEQ ID NO: 76822 - DNA, 35 bp, Artificial Sequence
  Synthetic oligonucleotide
tcccatgcgcatgccgattcacttaacatgcgact

SEQ ID NO: 76823 - DNA, 35 bp, Artificial Sequence
  Synthetic oligonucleotide
tcgtggtgaccacggtagggagaagaatggcgcct

SEQ ID NO: 76824 - DNA, 35 bp, Artificial Sequence
  Synthetic oligonucleotide
agacgtcggtacctgggcggggagtagggagggct

SEQ ID NO: 76825 - DNA, 35 bp, Artificial Sequence
  Synthetic oligonucleotide
gattaggtaagggaggccctgggatggattgaagt

SEQ ID NO: 76826 - DNA, 35 bp, Artificial Sequence
  Synthetic oligonucleotide
ataacagccactcactcctcgtatctgggttaatt

SEQ ID NO: 76827 - DNA, 35 bp, Artificial Sequence
  Synthetic oligonucleotide
acttcagctcagaaattcccctcatgctctttatt

SEQ ID NO: 76828 - DNA, 35 bp, Artificial Sequence
  Synthetic oligonucleotide
tcacgagaacctgtgggcgatttatccctgtcctt

SEQ ID NO: 76829 - DNA, 35 bp, Artificial Sequence
  Synthetic oligonucleotide
aaggtggcacagcatggctttactccattatcttt

SEQ ID NO: 76830 - DNA, 36 bp, Artificial Sequence
  Synthetic oligonucleotide
ttggtggacgccaaacgaatctctccaggtcccaaa

SEQ ID NO: 76831 - DNA, 36 bp, Artificial Sequence
  Synthetic oligonucleotide
gattgcctcagttctttcctcgatcaatatagcaaa

SEQ ID NO: 76832 - DNA, 35 bp, Artificial Sequence
  Synthetic oligonucleotide
agcggtcgtccttgtcacccagcctagctcccgaa

SEQ ID NO: 76833 - DNA, 36 bp, Artificial Sequence
  Synthetic oligonucleotide
agacacatccgttgcgttcagcccggtccacttgaa

SEQ ID NO: 76834 - DNA, 35 bp, Artificial Sequence
  Synthetic oligonucleotide
tgactccccgctccacctaccgttgcagagagtaa

SEQ ID NO: 76835 - DNA, 35 bp, Artificial Sequence
  Synthetic oligonucleotide
tatgcctccacagcatttgtcacatatattcgtaa

SEQ ID NO: 76836 - DNA, 36 bp, Artificial Sequence
  Synthetic oligonucleotide
ttgggagggcacaggttccaggcgggagggggttaa

SEQ ID NO: 76837 - DNA, 35 bp, Artificial Sequence
  Synthetic oligonucleotide
acactacgagctgcaatgactcacacgcgatcaca

SEQ ID NO: 76838 - DNA, 35 bp, Artificial Sequence
  Synthetic oligonucleotide
acaggaacggggatcaacaaaatggaacaacgaca

SEQ ID NO: 76839 - DNA, 36 bp, Artificial Sequence
  Synthetic oligonucleotide
tcagttcgctcgttatgcgctggccctcgcacacca

SEQ ID NO: 76840 - DNA, 35 bp, Artificial Sequence
  Synthetic oligonucleotide
gtacgcatgcatggagcctaccgcatttcctacca

SEQ ID NO: 76841 - DNA, 36 bp, Artificial Sequence
  Synthetic oligonucleotide
tcctccgaaccactggaaacgactgcggttaaccca

SEQ ID NO: 76842 - DNA, 36 bp, Artificial Sequence
  Synthetic oligonucleotide
atgccgagacatcctccattcatgcacatattgcca

SEQ ID NO: 76843 - DNA, 36 bp, Artificial Sequence
  Synthetic oligonucleotide
aatgtcgcagatagtcccttacaatccctttacgca

SEQ ID NO: 76844 - DNA, 36 bp, Artificial Sequence
  Synthetic oligonucleotide
gaaggatgtaggcgggttatgagagggtcggaggca

SEQ ID NO: 76845 - DNA, 36 bp, Artificial Sequence
  Synthetic oligonucleotide
ggtatgggggggtacggggagagtggggctgtggca

SEQ ID NO: 76846 - DNA, 35 bp, Artificial Sequence
  Synthetic oligonucleotide
gtgtacccccccccttatgtcgcaaataacgctca

SEQ ID NO: 76847 - DNA, 37 bp, Artificial Sequence
  Synthetic oligonucleotide
gatacgcggctgaacactttttcttgcatccaccaga

SEQ ID NO: 76848 - DNA, 37 bp, Artificial Sequence
  Synthetic oligonucleotide
agcgaggggaccagggaaaggtggggacagacgcaga

SEQ ID NO: 76849 - DNA, 36 bp, Artificial Sequence
  Synthetic oligonucleotide
gaaccaccctcacgatctgggcttcccgtactcaga

SEQ ID NO: 76850 - DNA, 37 bp, Artificial Sequence
  Synthetic oligonucleotide
taggccatcattacgccgcatatctctcgctttgaga

SEQ ID NO: 76851 - DNA, 37 bp, Artificial Sequence
  Synthetic oligonucleotide
tgcaacccactgccgaacttcccaaggcacctctaga

SEQ ID NO: 76852 - DNA, 37 bp, Artificial Sequence
  Synthetic oligonucleotide
gatcatcgcgccaccactctaaaattgctgtcttaga

SEQ ID NO: 76853 - DNA, 37 bp, Artificial Sequence
  Synthetic oligonucleotide
gagcacatctccatcccatgtccaccgcacgaaacga

SEQ ID NO: 76854 - DNA, 37 bp, Artificial Sequence
  Synthetic oligonucleotide
tttgaccgagtacagcgcattcgatccccacacacga

SEQ ID NO: 76855 - DNA, 37 bp, Artificial Sequence
  Synthetic oligonucleotide
tcataccagtgggcggagggggggttgtaggccacga

SEQ ID NO: 76856 - DNA, 37 bp, Artificial Sequence
  Synthetic oligonucleotide
tacccctcatacgacctgcgacgcaatcaagctacga

SEQ ID NO: 76857 - DNA, 37 bp, Artificial Sequence
  Synthetic oligonucleotide
ttctccgcacaccctcacagaatcgcgaattgtacga

SEQ ID NO: 76858 - DNA, 36 bp, Artificial Sequence
  Synthetic oligonucleotide
tggaaccctcaaaacggtcacgatacctcccaccga

SEQ ID NO: 76859 - DNA, 37 bp, Artificial Sequence
  Synthetic oligonucleotide
cacgagcccatctggtcattcttcgttctatctccga

SEQ ID NO: 76860 - DNA, 36 bp, Artificial Sequence
  Synthetic oligonucleotide
tcccgccccaccagcctcaagacctccttcacgcga

SEQ ID NO: 76861 - DNA, 37 bp, Artificial Sequence
  Synthetic oligonucleotide
gcaccggttgaatcgcatttgaccgcttatctctcga

SEQ ID NO: 76862 - DNA, 37 bp, Artificial Sequence
  Synthetic oligonucleotide
gagaccccgacagtgcatctctatcttcctctcagga

SEQ ID NO: 76863 - DNA, 37 bp, Artificial Sequence
  Synthetic oligonucleotide
aatgagcagagcgcgttgggacggttgggacagagga

SEQ ID NO: 76864 - DNA, 37 bp, Artificial Sequence
  Synthetic oligonucleotide
atgtcacggtcctgcctccatgtacgtaccatacgga

SEQ ID NO: 76865 - DNA, 37 bp, Artificial Sequence
  Synthetic oligonucleotide
gtgtagtcacaaaaaaagcactttgagacaggccgga

SEQ ID NO: 76866 - DNA, 37 bp, Artificial Sequence
  Synthetic oligonucleotide
gtgaacccggcttagtgaggggtggaagagggaggga

SEQ ID NO: 76867 - DNA, 37 bp, Artificial Sequence
  Synthetic oligonucleotide
gaggagaggggggcggctggatgctgggtgggaggga

SEQ ID NO: 76868 - DNA, 37 bp, Artificial Sequence
  Synthetic oligonucleotide
gcaatgcaagtgggcaaattgccaaacggacatggga

SEQ ID NO: 76869 - DNA, 37 bp, Artificial Sequence
  Synthetic oligonucleotide
atgcaggcgcagggcgttgcgggggggggagattgga

SEQ ID NO: 76870 - DNA, 38 bp, Artificial Sequence
  Synthetic oligonucleotide
atgtcccatcgaaggggctggaacctcacatccaatga

SEQ ID NO: 76871 - DNA, 37 bp, Artificial Sequence
  Synthetic oligonucleotide
gtgtcacgtgggtggagggatcatatattagggatga

SEQ ID NO: 76872 - DNA, 38 bp, Artificial Sequence
  Synthetic oligonucleotide
tactacgcattcacaccctgaccatccacgcgaactga

SEQ ID NO: 76873 - DNA, 38 bp, Artificial Sequence
  Synthetic oligonucleotide
tcatggccggacgaccacttctgtcactaatcacctga

SEQ ID NO: 76874 - DNA, 38 bp, Artificial Sequence
  Synthetic oligonucleotide
tgacacagtccacatccttcaccaggacatatacctga

SEQ ID NO: 76875 - DNA, 38 bp, Artificial Sequence
  Synthetic oligonucleotide
gagaggggctaggtggaatggtgtggcggttatgctga

SEQ ID NO: 76876 - DNA, 38 bp, Artificial Sequence
  Synthetic oligonucleotide
ggaaagtggagggggaagggggtgtcctgaggtgctga

SEQ ID NO: 76877 - DNA, 36 bp, Artificial Sequence
  Synthetic oligonucleotide
ggaacgctctccttggtccatttgcgcccttgctga

SEQ ID NO: 76878 - DNA, 37 bp, Artificial Sequence
  Synthetic oligonucleotide
gactcacagatgttcattttggctcgtatgttgctga

SEQ ID NO: 76879 - DNA, 38 bp, Artificial Sequence
  Synthetic oligonucleotide
tacacatggcgccaggctggttcctgatgttactctga

SEQ ID NO: 76880 - DNA, 38 bp, Artificial Sequence
  Synthetic oligonucleotide
gagtgggacgaggggttagaagtaccaagggcaagtga

SEQ ID NO: 76881 - DNA, 38 bp, Artificial Sequence
  Synthetic oligonucleotide
tagcgatgttgacaggggtaaggaggggggaccagtga

SEQ ID NO: 76882 - DNA, 38 bp, Artificial Sequence
  Synthetic oligonucleotide
gcccagggtgggtgagggtgttcgggaaggcccagtga

SEQ ID NO: 76883 - DNA, 38 bp, Artificial Sequence
  Synthetic oligonucleotide
gatgatagaagggagattagaggggaggacgcgcgtga

SEQ ID NO: 76884 - DNA, 37 bp, Artificial Sequence
  Synthetic oligonucleotide
atggtacgaacggttaggtcaaaggagggcaaggtga

SEQ ID NO: 76885 - DNA, 37 bp, Artificial Sequence
  Synthetic oligonucleotide
gcacaattccgggcaagaatgggattagaaggggtga

SEQ ID NO: 76886 - DNA, 38 bp, Artificial Sequence
  Synthetic oligonucleotide
agaacgcacgcagtggaagttaagtggggccggggtga

SEQ ID NO: 76887 - DNA, 38 bp, Artificial Sequence
  Synthetic oligonucleotide
ggcccaaacgccccctctgttgttgttatcacatgtga

SEQ ID NO: 76888 - DNA, 37 bp, Artificial Sequence
  Synthetic oligonucleotide
tcgaggagcaataaaggtggtgccggggggggtgtga

SEQ ID NO: 76889 - DNA, 38 bp, Artificial Sequence
  Synthetic oligonucleotide
accgacacccatgctcttttgccggttcaccattgtga

SEQ ID NO: 76890 - DNA, 37 bp, Artificial Sequence
  Synthetic oligonucleotide
agccctccccccgagtggacacccgacttatttgtga

SEQ ID NO: 76891 - DNA, 38 bp, Artificial Sequence
  Synthetic oligonucleotide
gaccgccaacaatgcatggggggtaagggctaacttga

SEQ ID NO: 76892 - DNA, 38 bp, Artificial Sequence
  Synthetic oligonucleotide
tctgtgctatcgtttgtttctttcactgcccctcttga

SEQ ID NO: 76893 - DNA, 38 bp, Artificial Sequence
  Synthetic oligonucleotide
gcacctgttagtagttatgcccgcttcccccacgttga

SEQ ID NO: 76894 - DNA, 37 bp, Artificial Sequence
  Synthetic oligonucleotide
tgtggagcgcaaagaggtgggaaggtttgtgtgttga

SEQ ID NO: 76895 - DNA, 35 bp, Artificial Sequence
  Synthetic oligonucleotide
gattccggagggcctccactagtgatcatgcgata

SEQ ID NO: 76896 - DNA, 36 bp, Artificial Sequence
  Synthetic oligonucleotide
gcccagtctactccaccccatgcccgagactcgata

SEQ ID NO: 76897 - DNA, 36 bp, Artificial Sequence
  Synthetic oligonucleotide
gcacgccccactcgttgtcgatctggccgatcacta

SEQ ID NO: 76898 - DNA, 35 bp, Artificial Sequence
  Synthetic oligonucleotide
tccacctgcctcaccaggacacatactcgcccgta

SEQ ID NO: 76899 - DNA, 36 bp, Artificial Sequence
  Synthetic oligonucleotide
tgacatccatgatctccctccgtcatcccggccgta

SEQ ID NO: 76900 - DNA, 36 bp, Artificial Sequence
  Synthetic oligonucleotide
agcccgcctacgcactcaagggggtcccacctgtta

SEQ ID NO: 76901 - DNA, 35 bp, Artificial Sequence
  Synthetic oligonucleotide
acttaccccgtgtagctaccagccgcccacgttta

SEQ ID NO: 76902 - DNA, 35 bp, Artificial Sequence
  Synthetic oligonucleotide
gtcataattgcaggagggggtgggtggtgtacaac

SEQ ID NO: 76903 - DNA, 35 bp, Artificial Sequence
  Synthetic oligonucleotide
tcctcccaatgttatttagtgtggcctttctgaac

SEQ ID NO: 76904 - DNA, 35 bp, Artificial Sequence
  Synthetic oligonucleotide
tgacaaacagtcgtttgccaacagacccttcacac

SEQ ID NO: 76905 - DNA, 35 bp, Artificial Sequence
  Synthetic oligonucleotide
aacaaccccccggcacgcttcgtaggaatttacac

SEQ ID NO: 76906 - DNA, 35 bp, Artificial Sequence
  Synthetic oligonucleotide
tcaaccgcaaacgtgacttagccgctttgtttcac

SEQ ID NO: 76907 - DNA, 35 bp, Artificial Sequence
  Synthetic oligonucleotide
agtgagcgggggttcggtttgacggaagagttgac

SEQ ID NO: 76908 - DNA, 35 bp, Artificial Sequence
  Synthetic oligonucleotide
gccagagcgagattcccaacgttgaactaaccacc

SEQ ID NO: 76909 - DNA, 35 bp, Artificial Sequence
  Synthetic oligonucleotide
tacgtagtcagctgaaatccctgcattgtcctacc

SEQ ID NO: 76910 - DNA, 35 bp, Artificial Sequence
  Synthetic oligonucleotide
tgacccttactgcctgttctgctaaaacgtgaccc

SEQ ID NO: 76911 - DNA, 35 bp, Artificial Sequence
  Synthetic oligonucleotide
tccacagacaccccaccacgtttaacggcgggccc

SEQ ID NO: 76912 - DNA, 35 bp, Artificial Sequence
  Synthetic oligonucleotide
ttcctgctcgcactgtttcgcctcgaacgtttccc

SEQ ID NO: 76913 - DNA, 35 bp, Artificial Sequence
  Synthetic oligonucleotide
tcatccagctcctctctgcacttgttggtgctgcc

SEQ ID NO: 76914 - DNA, 35 bp, Artificial Sequence
  Synthetic oligonucleotide
tccgactatgccccctcccgagatgcctgcactcc

SEQ ID NO: 76915 - DNA, 35 bp, Artificial Sequence
  Synthetic oligonucleotide
tcccatcgatttgaacttgttagattcacgtgtcc

SEQ ID NO: 76916 - DNA, 35 bp, Artificial Sequence
  Synthetic oligonucleotide
aatccatcacttccttggtccccaggcattcttcc

SEQ ID NO: 76917 - DNA, 35 bp, Artificial Sequence
  Synthetic oligonucleotide
tgcacccgcattcgggaccttttacgggtctttcc

SEQ ID NO: 76918 - DNA, 35 bp, Artificial Sequence
  Synthetic oligonucleotide
tgccaacatcacacggcccgtgcaggtcttcgtgc

SEQ ID NO: 76919 - DNA, 35 bp, Artificial Sequence
  Synthetic oligonucleotide
tcagtgatcacccttctgtcacttaatgtttactc

SEQ ID NO: 76920 - DNA, 35 bp, Artificial Sequence
  Synthetic oligonucleotide
accatcggacacgcgaaattccccgcatgttcctc

SEQ ID NO: 76921 - DNA, 35 bp, Artificial Sequence
  Synthetic oligonucleotide
acgccgttaaggctctctgtctaatggcaaacttc

SEQ ID NO: 76922 - DNA, 35 bp, Artificial Sequence
  Synthetic oligonucleotide
gatcggtgctgcaatcgatcatagtacttccccag

SEQ ID NO: 76923 - DNA, 35 bp, Artificial Sequence
  Synthetic oligonucleotide
ggctgagggggtggtgggaggggtgagtcgctacg

SEQ ID NO: 76924 - DNA, 35 bp, Artificial Sequence
  Synthetic oligonucleotide
tcagcaggtcgttaccatccctgacactactaccg

SEQ ID NO: 76925 - DNA, 35 bp, Artificial Sequence
  Synthetic oligonucleotide
aaaagggcgggtggagggcatgagtttaagaaggg

SEQ ID NO: 76926 - DNA, 35 bp, Artificial Sequence
  Synthetic oligonucleotide
tccccctgcacccggttgactcccctgagacatgg

SEQ ID NO: 76927 - DNA, 35 bp, Artificial Sequence
  Synthetic oligonucleotide
ttaatcggtcgtgggtgggtagggtcaaggaattg

SEQ ID NO: 76928 - DNA, 35 bp, Artificial Sequence
  Synthetic oligonucleotide
ttcacccgtggacgctcgaagttgccttctcattg

SEQ ID NO: 76929 - DNA, 35 bp, Artificial Sequence
  Synthetic oligonucleotide
gcgctgctctgctccgactccctccacagcgcttg

SEQ ID NO: 76930 - DNA, 35 bp, Artificial Sequence
  Synthetic oligonucleotide
tctcacctcccatcgcgtattttccatttcaccat

SEQ ID NO: 76931 - DNA, 35 bp, Artificial Sequence
  Synthetic oligonucleotide
gaccatcatccgtccctccatcgttcatattccat

SEQ ID NO: 76932 - DNA, 35 bp, Artificial Sequence
  Synthetic oligonucleotide
aacctagcactgtgcacgctaccacgagccactat

SEQ ID NO: 76933 - DNA, 35 bp, Artificial Sequence
  Synthetic oligonucleotide
gtccctcgtccttcattgtattgttccttgcctat

SEQ ID NO: 76934 - DNA, 35 bp, Artificial Sequence
  Synthetic oligonucleotide
tttgactcttgtcgtggactagctccccttcctat

SEQ ID NO: 76935 - DNA, 35 bp, Artificial Sequence
  Synthetic oligonucleotide
atcctccccgtcgctccttttgcactagcctgcct

SEQ ID NO: 76936 - DNA, 36 bp, Artificial Sequence
  Synthetic oligonucleotide
gcctcaccgctcctcagttctaggactcaccccgct

SEQ ID NO: 76937 - DNA, 35 bp, Artificial Sequence
  Synthetic oligonucleotide
gtgggacagacgccccatacctattagcacatgct

SEQ ID NO: 76938 - DNA, 35 bp, Artificial Sequence
  Synthetic oligonucleotide
gtcacacccattactcctccgcggttttcgatgct

SEQ ID NO: 76939 - DNA, 35 bp, Artificial Sequence
  Synthetic oligonucleotide
gccaacctccccagtaccgagtggtgaggccatct

SEQ ID NO: 76940 - DNA, 35 bp, Artificial Sequence
  Synthetic oligonucleotide
ttgccacccgcttcaatttgttaccgttgtaccgt

SEQ ID NO: 76941 - DNA, 35 bp, Artificial Sequence
  Synthetic oligonucleotide
tagcgaggaaaggaaagtcgttttatggagggggt

SEQ ID NO: 76942 - DNA, 35 bp, Artificial Sequence
  Synthetic oligonucleotide
tacgcgcaggctacgagtgaaggtggaaatggtgt

SEQ ID NO: 76943 - DNA, 35 bp, Artificial Sequence
  Synthetic oligonucleotide
agtgggggtggagccagggtagggcgtgcgtgtgt

SEQ ID NO: 76944 - DNA, 35 bp, Artificial Sequence
  Synthetic oligonucleotide
gaccatgtttgatctactatttctcgcctatttgt

SEQ ID NO: 76945 - DNA, 35 bp, Artificial Sequence
  Synthetic oligonucleotide
gttagcgcgccactatgtctctttgtacctcgatt

SEQ ID NO: 76946 - DNA, 35 bp, Artificial Sequence
  Synthetic oligonucleotide
tgcaagtcagtgccgtgctggcctgccttctcctt

SEQ ID NO: 76947 - DNA, 35 bp, Artificial Sequence
  Synthetic oligonucleotide
tgaccaccactgacccacacatagggattgatctt

SEQ ID NO: 76948 - DNA, 35 bp, Artificial Sequence
  Synthetic oligonucleotide
aaggtgggcaatggtgggtacatgggcgatcggtt

SEQ ID NO: 76949 - DNA, 35 bp, Artificial Sequence
  Synthetic oligonucleotide
tgtgcccagcttgttctggcacattgttcctcttt

SEQ ID NO: 76950 - DNA, 35 bp, Artificial Sequence
  Synthetic oligonucleotide
tacgcgtagccttccctgcccgctcggcccagttt

SEQ ID NO: 76951 - DNA, 35 bp, Artificial Sequence
  Synthetic oligonucleotide
aactcgagcgtcgcttactgacatccgccgctttt

SEQ ID NO: 76952 - DNA, 35 bp, Artificial Sequence
  Synthetic oligonucleotide
gaggcgccacaagtgcactcctttaccagcttttt

SEQ ID NO: 76953 - DNA, 36 bp, Artificial Sequence
  Synthetic oligonucleotide
aactcactccgccacaagttataaccgttcatcaaa

SEQ ID NO: 76954 - DNA, 36 bp, Artificial Sequence
  Synthetic oligonucleotide
agacacctgcccgtaagtaacacacagtacctgaaa

SEQ ID NO: 76955 - DNA, 36 bp, Artificial Sequence
  Synthetic oligonucleotide
tgactcctctcagtacgctggcgttatatataccaa

SEQ ID NO: 76956 - DNA, 36 bp, Artificial Sequence
  Synthetic oligonucleotide
gccatcggtcagtgaaagctctacaccgcgccccaa

SEQ ID NO: 76957 - DNA, 36 bp, Artificial Sequence
  Synthetic oligonucleotide
ggaacgcgaacacctgtcgcccgctgcacccctgaa

SEQ ID NO: 76958 - DNA, 35 bp, Artificial Sequence
  Synthetic oligonucleotide
ttaaccgcctccggatcgcacccatctcgcgataa

SEQ ID NO: 76959 - DNA, 36 bp, Artificial Sequence
  Synthetic oligonucleotide
acgctggggggaaggtgcgtggagctggcggagtaa

SEQ ID NO: 76960 - DNA, 35 bp, Artificial Sequence
  Synthetic oligonucleotide
actgggacgggagggcgacaagtaacatggcgtaa

SEQ ID NO: 76961 - DNA, 36 bp, Artificial Sequence
  Synthetic oligonucleotide
gatggcatggaaaagaaggggctggggtttctgtaa

SEQ ID NO: 76962 - DNA, 35 bp, Artificial Sequence
  Synthetic oligonucleotide
tgtcacacacactaatcgggggtttccatgcttaa

SEQ ID NO: 76963 - DNA, 36 bp, Artificial Sequence
  Synthetic oligonucleotide
gcctgaggcaatgccttttcctttagctcacgttaa

SEQ ID NO: 76964 - DNA, 36 bp, Artificial Sequence
  Synthetic oligonucleotide
gccacccgcccatactcccctcttgaccagctcaca

SEQ ID NO: 76965 - DNA, 36 bp, Artificial Sequence
  Synthetic oligonucleotide
attacccgagctttcccacgtaggctgtccttgaca

SEQ ID NO: 76966 - DNA, 35 bp, Artificial Sequence
  Synthetic oligonucleotide
gtgcccaccgttcctgcgacgcacacgtgaaccca

SEQ ID NO: 76967 - DNA, 36 bp, Artificial Sequence
  Synthetic oligonucleotide
gaaacctgccttactttgacgattggactcgcccca

SEQ ID NO: 76968 - DNA, 36 bp, Artificial Sequence
  Synthetic oligonucleotide
ttgacgacacacagtctaggtacgtgctccagccca

SEQ ID NO: 76969 - DNA, 36 bp, Artificial Sequence
  Synthetic oligonucleotide
ttgcacgtggcctcagtgcatttaatgtccctccca

SEQ ID NO: 76970 - DNA, 35 bp, Artificial Sequence
  Synthetic oligonucleotide
tcgaacacccattttgctatggttttaatgtccca

SEQ ID NO: 76971 - DNA, 36 bp, Artificial Sequence
  Synthetic oligonucleotide
taagcaggtccccccatctgactccgcgttgtccca

SEQ ID NO: 76972 - DNA, 36 bp, Artificial Sequence
  Synthetic oligonucleotide
gacgacgtattggctccagctaaggacgaaaagcca

SEQ ID NO: 76973 - DNA, 36 bp, Artificial Sequence
  Synthetic oligonucleotide
gtcactcaacattttgggggaggagagggggaagca

SEQ ID NO: 76974 - DNA, 36 bp, Artificial Sequence
  Synthetic oligonucleotide
ggatcgcccctgcacacatactccaataatgaagca

SEQ ID NO: 76975 - DNA, 36 bp, Artificial Sequence
  Synthetic oligonucleotide
acaatggggagggtgtagggtgtctagacgttagca

SEQ ID NO: 76976 - DNA, 35 bp, Artificial Sequence
  Synthetic oligonucleotide
tttgctcgcactctagactcggcgactgtattgca

SEQ ID NO: 76977 - DNA, 37 bp, Artificial Sequence
  Synthetic oligonucleotide
atcgcgagtctttgtgttccattacctcctacgctca

SEQ ID NO: 76978 - DNA, 36 bp, Artificial Sequence
  Synthetic oligonucleotide
atccacctccgcgcccggttatcggtaaggtgctca

SEQ ID NO: 76979 - DNA, 37 bp, Artificial Sequence
  Synthetic oligonucleotide
atgcgccggcaccgggccaaccatgacagtaagcaga

SEQ ID NO: 76980 - DNA, 37 bp, Artificial Sequence
  Synthetic oligonucleotide
gactccgacccagtatgcctattcgccaaccaggaga

SEQ ID NO: 76981 - DNA, 37 bp, Artificial Sequence
  Synthetic oligonucleotide
gcacacgaacatttgcatgtgctacctctatgcacga

SEQ ID NO: 76982 - DNA, 37 bp, Artificial Sequence
  Synthetic oligonucleotide
agaggccaccttcgcccaatcacccgccaaatcacga

SEQ ID NO: 76983 - DNA, 37 bp, Artificial Sequence
  Synthetic oligonucleotide
tctgggagccgcgcctcacctgtccgcaccaagacga

SEQ ID NO: 76984 - DNA, 37 bp, Artificial Sequence
  Synthetic oligonucleotide
acacccaactccatggatactggacctgttcagacga

SEQ ID NO: 76985 - DNA, 37 bp, Artificial Sequence
  Synthetic oligonucleotide
gaccaccgcccccgtccacttccgtgacatctgacga

SEQ ID NO: 76986 - DNA, 37 bp, Artificial Sequence
  Synthetic oligonucleotide
aacagcaccacgcaccccccgataatactggtaccga

SEQ ID NO: 76987 - DNA, 37 bp, Artificial Sequence
  Synthetic oligonucleotide
tgaactcctcccatcatccaagggaacagactcccga

SEQ ID NO: 76988 - DNA, 36 bp, Artificial Sequence
  Synthetic oligonucleotide
acatacgccttgtcttgagcccgatattctctccga

SEQ ID NO: 76989 - DNA, 37 bp, Artificial Sequence
  Synthetic oligonucleotide
acactcccagcatatagccagctttcgcaccaagcga

SEQ ID NO: 76990 - DNA, 37 bp, Artificial Sequence
  Synthetic oligonucleotide
tgtgccgcactatgcgtccgacccaaatgttccgcga

SEQ ID NO: 76991 - DNA, 37 bp, Artificial Sequence
  Synthetic oligonucleotide
tgctcccatccatcatcccgttctgagataatcgcga

SEQ ID NO: 76992 - DNA, 37 bp, Artificial Sequence
  Synthetic oligonucleotide
gtcatcggacgtagtggggaggaaagtagctgtgcga

SEQ ID NO: 76993 - DNA, 37 bp, Artificial Sequence
  Synthetic oligonucleotide
tcccgatcagggcaaactttaatgctgttcacaagga

SEQ ID NO: 76994 - DNA, 37 bp, Artificial Sequence
  Synthetic oligonucleotide
atactggagagggggaaaggggcagcggggcttagga

SEQ ID NO: 76995 - DNA, 37 bp, Artificial Sequence
  Synthetic oligonucleotide
tgagggggtggggttgtagatcgaaaactggaacgga

SEQ ID NO: 76996 - DNA, 37 bp, Artificial Sequence
  Synthetic oligonucleotide
gtgatggaggcatagagggtgacgaggaatgggggga

SEQ ID NO: 76997 - DNA, 37 bp, Artificial Sequence
  Synthetic oligonucleotide
gttgggtgggtcgctgaagggagggctttttgtggga

SEQ ID NO: 76998 - DNA, 37 bp, Artificial Sequence
  Synthetic oligonucleotide
ggacaggggaggtatagtgggcgtggtgtgccatgga

SEQ ID NO: 76999 - DNA, 36 bp, Artificial Sequence
  Synthetic oligonucleotide
gcatcagcctgatctcaacctttcgcccttgttgga

SEQ ID NO: 77000 - DNA, 37 bp, Artificial Sequence
  Synthetic oligonucleotide
agatagggagggagtcgggagggtcgcatgacaatga

SEQ ID NO: 77001 - DNA, 38 bp, Artificial Sequence
  Synthetic oligonucleotide
tgcatctgcccgccccgaacgtgacccgcgaaacatga

SEQ ID NO: 77002 - DNA, 38 bp, Artificial Sequence
  Synthetic oligonucleotide
gccctcacaggaacttcctcgcctaagacaggccatga

SEQ ID NO: 77003 - DNA, 38 bp, Artificial Sequence
  Synthetic oligonucleotide
atctccatgcgccgacagtgcgcctgcctaatccatga

SEQ ID NO: 77004 - DNA, 38 bp, Artificial Sequence
  Synthetic oligonucleotide
accagcctagggtaccttctactgcatttgtcgcatga

SEQ ID NO: 77005 - DNA, 38 bp, Artificial Sequence
  Synthetic oligonucleotide
ggtgcgggaaagaggggaaggggcgataaatacgatga

SEQ ID NO: 77006 - DNA, 38 bp, Artificial Sequence
  Synthetic oligonucleotide
atgccaacagtcgataccatcctgaaatgcctttatga

SEQ ID NO: 77007 - DNA, 38 bp, Artificial Sequence
  Synthetic oligonucleotide
atgtgcggagtggggtggggaggtgcacattctactga

SEQ ID NO: 77008 - DNA, 37 bp, Artificial Sequence
  Synthetic oligonucleotide
tgcgcatcacgtattcaagcgttttgaacctccctga

SEQ ID NO: 77009 - DNA, 38 bp, Artificial Sequence
  Synthetic oligonucleotide
tccgcccagactttcagatatatgctcccttcgcctga

SEQ ID NO: 77010 - DNA, 38 bp, Artificial Sequence
  Synthetic oligonucleotide
gacgccctcggacaattaggtcatccgctcctgcctga

SEQ ID NO: 77011 - DNA, 38 bp, Artificial Sequence
  Synthetic oligonucleotide
gaaacaccaatggatcaacacgtggtcagcttagctga

SEQ ID NO: 77012 - DNA, 38 bp, Artificial Sequence
  Synthetic oligonucleotide
aggacagtcgtagcatatacatggccacttttttctga

SEQ ID NO: 77013 - DNA, 38 bp, Artificial Sequence
  Synthetic oligonucleotide
gaaagtaaaagctgggggggtgcgacggggaagagtga

SEQ ID NO: 77014 - DNA, 38 bp, Artificial Sequence
  Synthetic oligonucleotide
gccttgcgtcctgctgtgcccttctgcctttatagtga

SEQ ID NO: 77015 - DNA, 38 bp, Artificial Sequence
  Synthetic oligonucleotide
gaacacaggctgtgtattcatctctgacccgaccgtga

SEQ ID NO: 77016 - DNA, 38 bp, Artificial Sequence
  Synthetic oligonucleotide
gccacatccacctgtggtacttcatcgttcatccgtga

SEQ ID NO: 77017 - DNA, 38 bp, Artificial Sequence
  Synthetic oligonucleotide
acactggggcatcatactggctgggaagggtggggtga

SEQ ID NO: 77018 - DNA, 38 bp, Artificial Sequence
  Synthetic oligonucleotide
gatgcgtactgctatccgtatctctctgtccgtggtga

SEQ ID NO: 77019 - DNA, 38 bp, Artificial Sequence
  Synthetic oligonucleotide
acttgggggtgggtggataaagggcctggggaatgtga

SEQ ID NO: 77020 - DNA, 37 bp, Artificial Sequence
  Synthetic oligonucleotide
atcgggcgggaccgggtgaatcgtgcagggactgtga

SEQ ID NO: 77021 - DNA, 37 bp, Artificial Sequence
  Synthetic oligonucleotide
acacaccccacacatacgccatgctcccgacgtgtga

SEQ ID NO: 77022 - DNA, 37 bp, Artificial Sequence
  Synthetic oligonucleotide
tgctgggggggaatgcgggggtggcacggttgtgtga

SEQ ID NO: 77023 - DNA, 38 bp, Artificial Sequence
  Synthetic oligonucleotide
tagagacatagggtggggaggatgggagataggattga

SEQ ID NO: 77024 - DNA, 38 bp, Artificial Sequence
  Synthetic oligonucleotide
actttgcgtaataggaacgtagcctgcccaccccttga

SEQ ID NO: 77025 - DNA, 38 bp, Artificial Sequence
  Synthetic oligonucleotide
tgagggcatctgaccctacccgtatttgtccctcttga

SEQ ID NO: 77026 - DNA, 38 bp, Artificial Sequence
  Synthetic oligonucleotide
tgaagcgaaacgctgccatatatttaccactcctttga

SEQ ID NO: 77027 - DNA, 38 bp, Artificial Sequence
  Synthetic oligonucleotide
atgccacgtctcctgcctccctggttcacacgctttga

SEQ ID NO: 77028 - DNA, 35 bp, Artificial Sequence
  Synthetic oligonucleotide
tacgctacaagcataatgcagttgatggaatcata

SEQ ID NO: 77029 - DNA, 36 bp, Artificial Sequence
  Synthetic oligonucleotide
tcactgtcggtgacgtgtttacccctgcgccaccta

SEQ ID NO: 77030 - DNA, 36 bp, Artificial Sequence
  Synthetic oligonucleotide
tgccgattctaccgctgcgttcacgtcatcacccta

SEQ ID NO: 77031 - DNA, 36 bp, Artificial Sequence
  Synthetic oligonucleotide
atcgccgatcgttgacttctatattccaacgcccta

SEQ ID NO: 77032 - DNA, 36 bp, Artificial Sequence
  Synthetic oligonucleotide
acgttccagtgaacacacaacacgcccacacgctta

SEQ ID NO: 77033 - DNA, 36 bp, Artificial Sequence
  Synthetic oligonucleotide
ttcagtggcttgtcctttgcgcgcccaaccctgtta

SEQ ID NO: 77034 - DNA, 35 bp, Artificial Sequence
  Synthetic oligonucleotide
tgccgacggctcccccaacgaccattgttggttac

SEQ ID NO: 77035 - DNA, 35 bp, Artificial Sequence
  Synthetic oligonucleotide
ccacctctgacgcggagtgtagcgaactgcgagcc

SEQ ID NO: 77036 - DNA, 35 bp, Artificial Sequence
  Synthetic oligonucleotide
ttgtacccgacgttgctattaccatcgctctcgcc

SEQ ID NO: 77037 - DNA, 35 bp, Artificial Sequence
  Synthetic oligonucleotide
tcgagcacatctacggtttagcgcttactctggcc

SEQ ID NO: 77038 - DNA, 35 bp, Artificial Sequence
  Synthetic oligonucleotide
gacctaaccatagatgggccttgtcaatcccgtcc

SEQ ID NO: 77039 - DNA, 35 bp, Artificial Sequence
  Synthetic oligonucleotide
acgttgggacggttcttccgcgtttcttgctttcc

SEQ ID NO: 77040 - DNA, 35 bp, Artificial Sequence
  Synthetic oligonucleotide
tacatcctaatggatcactatcccacgacgctcgc

SEQ ID NO: 77041 - DNA, 35 bp, Artificial Sequence
  Synthetic oligonucleotide
acgagcctggctccctttgtttggcgctctctggc

SEQ ID NO: 77042 - DNA, 35 bp, Artificial Sequence
  Synthetic oligonucleotide
gttactccttgatccaaatgcacctgcccgttggc

SEQ ID NO: 77043 - DNA, 35 bp, Artificial Sequence
  Synthetic oligonucleotide
gagatagtcgcatatatcggtcaccactggcaatc

SEQ ID NO: 77044 - DNA, 35 bp, Artificial Sequence
  Synthetic oligonucleotide
tcaagggaggcatcggtatcagcattccttccatc

SEQ ID NO: 77045 - DNA, 35 bp, Artificial Sequence
  Synthetic oligonucleotide
tcgtaaccggagatagtcaccttgtccagccactc

SEQ ID NO: 77046 - DNA, 35 bp, Artificial Sequence
  Synthetic oligonucleotide
atacaccttcagtatgacccctgcccattaacctc

SEQ ID NO: 77047 - DNA, 35 bp, Artificial Sequence
  Synthetic oligonucleotide
ggacctccagagcttaaatcgttgtccagcacctc

SEQ ID NO: 77048 - DNA, 35 bp, Artificial Sequence
  Synthetic oligonucleotide
tttgtggcgcgctcaaacctatccacccgggcctc

SEQ ID NO: 77049 - DNA, 35 bp, Artificial Sequence
  Synthetic oligonucleotide
gttgacctgtccaaatgaactaagtcagtttcctc

SEQ ID NO: 77050 - DNA, 35 bp, Artificial Sequence
  Synthetic oligonucleotide
agccatggtcgtgcgaagctgccagttcctagctc

SEQ ID NO: 77051 - DNA, 35 bp, Artificial Sequence
  Synthetic oligonucleotide
ggtagtctctggtcgctcgttcctcctgtccgctc

SEQ ID NO: 77052 - DNA, 35 bp, Artificial Sequence
  Synthetic oligonucleotide
atcgccacagcgagtttctccagaatgctactgtc

SEQ ID NO: 77053 - DNA, 35 bp, Artificial Sequence
  Synthetic oligonucleotide
cacccatgcctactgtaacttagggccgaaaattc

SEQ ID NO: 77054 - DNA, 35 bp, Artificial Sequence
  Synthetic oligonucleotide
accgccaacctggagtataccgccttgacctggcg

SEQ ID NO: 77055 - DNA, 35 bp, Artificial Sequence
  Synthetic oligonucleotide
tctcctgccaataccatctgagcgaccattatgcg

SEQ ID NO: 77056 - DNA, 35 bp, Artificial Sequence
  Synthetic oligonucleotide
gtgttcagcagaatgcacaggacaggtagagatcg

SEQ ID NO: 77057 - DNA, 35 bp, Artificial Sequence
  Synthetic oligonucleotide
tgttacaccgctcagggactatctctacctcgtcg

SEQ ID NO: 77058 - DNA, 35 bp, Artificial Sequence
  Synthetic oligonucleotide
tatcattcggccagaactcctgctaccatcgttcg

SEQ ID NO: 77059 - DNA, 35 bp, Artificial Sequence
  Synthetic oligonucleotide
ttggtctcccctatggttctatctgcgcgccgcgg

SEQ ID NO: 77060 - DNA, 35 bp, Artificial Sequence
  Synthetic oligonucleotide
atgggaggggtaagaggagttagagaggtgatcgg

SEQ ID NO: 77061 - DNA, 35 bp, Artificial Sequence
  Synthetic oligonucleotide
gactaacgaagtttaatttcgcccgcctgccttgg

SEQ ID NO: 77062 - DNA, 35 bp, Artificial Sequence
  Synthetic oligonucleotide
atgggaccaagaggaaggctgtgatgctgaagatg

SEQ ID NO: 77063 - DNA, 35 bp, Artificial Sequence
  Synthetic oligonucleotide
acctcatcatgccagattgcggttggtcgcatctg

SEQ ID NO: 77064 - DNA, 35 bp, Artificial Sequence
  Synthetic oligonucleotide
taagaagggagctagggttgcggggtggacgggtg

SEQ ID NO: 77065 - DNA, 35 bp, Artificial Sequence
  Synthetic oligonucleotide
ggtgaccactccctgccattattgagcagttattg

SEQ ID NO: 77066 - DNA, 35 bp, Artificial Sequence
  Synthetic oligonucleotide
tccgacactgtacacctgtctcaggtcaccgtttg

SEQ ID NO: 77067 - DNA, 35 bp, Artificial Sequence
  Synthetic oligonucleotide
tcgtgcaattgtgccccgccccatccgaacgccat

SEQ ID NO: 77068 - DNA, 35 bp, Artificial Sequence
  Synthetic oligonucleotide
tcaggtctagtttgccttcccatgttggatttcat

SEQ ID NO: 77069 - DNA, 35 bp, Artificial Sequence
  Synthetic oligonucleotide
ttatcgcacattgtcttttgaatccatacaccgat

SEQ ID NO: 77070 - DNA, 35 bp, Artificial Sequence
  Synthetic oligonucleotide
gttccaccgacacgcctgacctcacttatcgcgat

SEQ ID NO: 77071 - DNA, 35 bp, Artificial Sequence
  Synthetic oligonucleotide
gctcgcatggtgcagagtccgtactttcttatact

SEQ ID NO: 77072 - DNA, 35 bp, Artificial Sequence
  Synthetic oligonucleotide
gggatcgcaactattatcacccacgcgttccacct

SEQ ID NO: 77073 - DNA, 35 bp, Artificial Sequence
  Synthetic oligonucleotide
agcacaaacgcgggaacgaagaagtttgcccccct

SEQ ID NO: 77074 - DNA, 35 bp, Artificial Sequence
  Synthetic oligonucleotide
tccacatccaattcgactttactgcctaggttcct

SEQ ID NO: 77075 - DNA, 34 bp, Artificial Sequence
  Synthetic oligonucleotide
cccaccccacgtagcctttatagaactgctgtct

SEQ ID NO: 77076 - DNA, 35 bp, Artificial Sequence
  Synthetic oligonucleotide
gtgtccgtttagcagcatcttggggcggggggggt

SEQ ID NO: 77077 - DNA, 35 bp, Artificial Sequence
  Synthetic oligonucleotide
ggatgcgcaaactgaggactggggatggatgtggt

SEQ ID NO: 77078 - DNA, 35 bp, Artificial Sequence
  Synthetic oligonucleotide
ataccatcagctggccaatgttaacgcctgtctgt

SEQ ID NO: 77079 - DNA, 35 bp, Artificial Sequence
  Synthetic oligonucleotide
gttggcagtctaattttgggcgccccaaccccctt

SEQ ID NO: 77080 - DNA, 35 bp, Artificial Sequence
  Synthetic oligonucleotide
tcacatgccaccgaggactctcctgagccgccctt

SEQ ID NO: 77081 - DNA, 35 bp, Artificial Sequence
  Synthetic oligonucleotide
acatcacacttcatactgccaggacatggccagtt

SEQ ID NO: 77082 - DNA, 35 bp, Artificial Sequence
  Synthetic oligonucleotide
ttccggttgcatgcggtggagtgcctgttcccttt

SEQ ID NO: 77083 - DNA, 35 bp, Artificial Sequence
  Synthetic oligonucleotide
aaccgccaatgcccatgccctccgtaagttccttt

SEQ ID NO: 77084 - DNA, 35 bp, Artificial Sequence
  Synthetic oligonucleotide
taccatctacgcgaaggcgttacggcgacgagttt

SEQ ID NO: 77085 - DNA, 35 bp, Artificial Sequence
  Synthetic oligonucleotide
tactgacccaagtgtggcaccccgaccttctaaaa

SEQ ID NO: 77086 - DNA, 35 bp, Artificial Sequence
  Synthetic oligonucleotide
tcacgacacacggtcaagccttggtggttcacaaa

SEQ ID NO: 77087 - DNA, 36 bp, Artificial Sequence
  Synthetic oligonucleotide
tgatacgtctgccgctgcctctctatctctgtccaa

SEQ ID NO: 77088 - DNA, 35 bp, Artificial Sequence
  Synthetic oligonucleotide
tagagaaacggggacatgggttgggggaggatcaa

SEQ ID NO: 77089 - DNA, 35 bp, Artificial Sequence
  Synthetic oligonucleotide
tactgaccaaatgtctcaccataaccccggttcaa

SEQ ID NO: 77090 - DNA, 36 bp, Artificial Sequence
  Synthetic oligonucleotide
aagttaggagggggagaggtaaactatgggcaagaa

SEQ ID NO: 77091 - DNA, 36 bp, Artificial Sequence
  Synthetic oligonucleotide
tacgcactgtaggcctggggctggttttagggcgaa

SEQ ID NO: 77092 - DNA, 36 bp, Artificial Sequence
  Synthetic oligonucleotide
tacttgccatcacacagccgcactcagtctactgaa

SEQ ID NO: 77093 - DNA, 36 bp, Artificial Sequence
  Synthetic oligonucleotide
atccacactgttgattgcccccagataatgccataa

SEQ ID NO: 77094 - DNA, 36 bp, Artificial Sequence
  Synthetic oligonucleotide
ttgtgtgtcgcattgcacgactcttctcttacgtaa

SEQ ID NO: 77095 - DNA, 36 bp, Artificial Sequence
  Synthetic oligonucleotide
tgtgggccctagtgctgctataccctttattcttaa

SEQ ID NO: 77096 - DNA, 35 bp, Artificial Sequence
  Synthetic oligonucleotide
tctgccaaccgttccgtaacttgcaccttcgttaa

SEQ ID NO: 77097 - DNA, 35 bp, Artificial Sequence
  Synthetic oligonucleotide
cctcaagcccgtcatacttcggggctcgaacaaca

SEQ ID NO: 77098 - DNA, 35 bp, Artificial Sequence
  Synthetic oligonucleotide
gacttcagcaaacccgttgcgccacaggttacaca

SEQ ID NO: 77099 - DNA, 36 bp, Artificial Sequence
  Synthetic oligonucleotide
gtgcgccccccattgctgtgccctctccaataccca

SEQ ID NO: 77100 - DNA, 36 bp, Artificial Sequence
  Synthetic oligonucleotide
tcccgattcagtttcgggtttgcaatccattctcca

SEQ ID NO: 77101 - DNA, 36 bp, Artificial Sequence
  Synthetic oligonucleotide
gttacatgtcgcggattaggtccccctcggcttcca

SEQ ID NO: 77102 - DNA, 36 bp, Artificial Sequence
  Synthetic oligonucleotide
gtccgaggtcaagaccatctagttcgcactcttcca

SEQ ID NO: 77103 - DNA, 36 bp, Artificial Sequence
  Synthetic oligonucleotide
tcagtgtgagcgcgaggaaggagaggacacaaggca

SEQ ID NO: 77104 - DNA, 36 bp, Artificial Sequence
  Synthetic oligonucleotide
gtccctcccgtcatgtcccctctctgggtccgtgca

SEQ ID NO: 77105 - DNA, 36 bp, Artificial Sequence
  Synthetic oligonucleotide
agcccactttcaagtccgacattagtgccccgttca

SEQ ID NO: 77106 - DNA, 37 bp, Artificial Sequence
  Synthetic oligonucleotide
acactgcctagcatggcttagtgctaaccctcaacga

SEQ ID NO: 77107 - DNA, 37 bp, Artificial Sequence
  Synthetic oligonucleotide
accgaaccctccaatcataagcagaccttatgaacga

SEQ ID NO: 77108 - DNA, 37 bp, Artificial Sequence
  Synthetic oligonucleotide
gtagaggaagccatggaacttagggcagaaaggacga

SEQ ID NO: 77109 - DNA, 37 bp, Artificial Sequence
  Synthetic oligonucleotide
tcaggcggaacacctctggtcatgatagcctgcccga

SEQ ID NO: 77110 - DNA, 36 bp, Artificial Sequence
  Synthetic oligonucleotide
tgttacaccagtaacataggagacgttccttcccga

SEQ ID NO: 77111 - DNA, 37 bp, Artificial Sequence
  Synthetic oligonucleotide
acgacacacggaggagagtgtacggtagtactagcga

SEQ ID NO: 77112 - DNA, 37 bp, Artificial Sequence
  Synthetic oligonucleotide
tcatcactgttgtgctatccattatccgtacaatcga

SEQ ID NO: 77113 - DNA, 37 bp, Artificial Sequence
  Synthetic oligonucleotide
gtcgcaggccaagccggggaagggtgtggtgggtcga

SEQ ID NO: 77114 - DNA, 37 bp, Artificial Sequence
  Synthetic oligonucleotide
gcccaacgtccgatctctgcctacggctccgcttcga

SEQ ID NO: 77115 - DNA, 37 bp, Artificial Sequence
  Synthetic oligonucleotide
gcacgcagggatgcaggagtcagggcagggcaaagga

SEQ ID NO: 77116 - DNA, 37 bp, Artificial Sequence
  Synthetic oligonucleotide
gagtaaggaatggggaaagcgaagggaaatcgaagga

SEQ ID NO: 77117 - DNA, 37 bp, Artificial Sequence
  Synthetic oligonucleotide
gacaacaaggagaaccgacagttcgtgggatgtagga

SEQ ID NO: 77118 - DNA, 37 bp, Artificial Sequence
  Synthetic oligonucleotide
acacacgcggggggtagtagcggtactaaaaaatgga

SEQ ID NO: 77119 - DNA, 38 bp, Artificial Sequence
  Synthetic oligonucleotide
tagacatctgcgcaaccctcgcctatatttcatcatga

SEQ ID NO: 77120 - DNA, 38 bp, Artificial Sequence
  Synthetic oligonucleotide
tatggatgaaggcagagtatacggggagtatgggatga

SEQ ID NO: 77121 - DNA, 38 bp, Artificial Sequence
  Synthetic oligonucleotide
accatacctcccgtgggctaaccatcatagccatatga

SEQ ID NO: 77122 - DNA, 38 bp, Artificial Sequence
  Synthetic oligonucleotide
tctgggccactgacgaagcgccaattgcctctctatga

SEQ ID NO: 77123 - DNA, 38 bp, Artificial Sequence
  Synthetic oligonucleotide
atcatccccctgctacacgtgtcctccgcgagcactga

SEQ ID NO: 77124 - DNA, 38 bp, Artificial Sequence
  Synthetic oligonucleotide
tgcgccctacatgcgtcatcccccgtcggactcactga

SEQ ID NO: 77125 - DNA, 37 bp, Artificial Sequence
  Synthetic oligonucleotide
gccacatgacgaccgcgcgtattagcgatacccctga

SEQ ID NO: 77126 - DNA, 38 bp, Artificial Sequence
  Synthetic oligonucleotide
acatgccagccccgtgactcgcagcaacatggccctga

SEQ ID NO: 77127 - DNA, 37 bp, Artificial Sequence
  Synthetic oligonucleotide
tccccccggttcaatttggctttgtgctatccgctga

SEQ ID NO: 77128 - DNA, 38 bp, Artificial Sequence
  Synthetic oligonucleotide
tcatgacccgcccaaggacgcccgctacattatcgtga

SEQ ID NO: 77129 - DNA, 38 bp, Artificial Sequence
  Synthetic oligonucleotide
gactaggagaaaggcgcgtgctaagagtacaaaggtga

SEQ ID NO: 77130 - DNA, 37 bp, Artificial Sequence
  Synthetic oligonucleotide
atgcggggtcgcaatggggcaagctagcgggaggtga

SEQ ID NO: 77131 - DNA, 38 bp, Artificial Sequence
  Synthetic oligonucleotide
tagacggccggataggcaagggtcggaacggacggtga

SEQ ID NO: 77132 - DNA, 37 bp, Artificial Sequence
  Synthetic oligonucleotide
acgtggaggtggtgggatcttggtgtggaaatggtga

SEQ ID NO: 77133 - DNA, 38 bp, Artificial Sequence
  Synthetic oligonucleotide
gccctccctacgtccacgtgctttctgctttgtggtga

SEQ ID NO: 77134 - DNA, 37 bp, Artificial Sequence
  Synthetic oligonucleotide
gggtgagggtggattgcttggaggcgggtaggattga

SEQ ID NO: 77135 - DNA, 35 bp, Artificial Sequence
  Synthetic oligonucleotide
tccctgcattatgacatcttagcgcccccccttga

SEQ ID NO: 77136 - DNA, 38 bp, Artificial Sequence
  Synthetic oligonucleotide
gaggggtggaaagggctaaacatagtggaatggcttga

SEQ ID NO: 77137 - DNA, 38 bp, Artificial Sequence
  Synthetic oligonucleotide
gacacgtctaaaccatccgttttgcacaagcactttga

SEQ ID NO: 77138 - DNA, 38 bp, Artificial Sequence
  Synthetic oligonucleotide
gttacctcagctgccttcgaggacttaacgccctttga

SEQ ID NO: 77139 - DNA, 38 bp, Artificial Sequence
  Synthetic oligonucleotide
aacgcggcctaatgtactcgtacatcctttagctttga

SEQ ID NO: 77140 - DNA, 37 bp, Artificial Sequence
  Synthetic oligonucleotide
tacgcaggttgtcactcccactcgtttcgttctttga

SEQ ID NO: 77141 - DNA, 36 bp, Artificial Sequence
  Synthetic oligonucleotide
gtgacagtgtgcaagaaaggggcgatgacgggaata

SEQ ID NO: 77142 - DNA, 36 bp, Artificial Sequence
  Synthetic oligonucleotide
tcaacacccaccttcatgcctcgaacagataccata

SEQ ID NO: 77143 - DNA, 36 bp, Artificial Sequence
  Synthetic oligonucleotide
aacgctactgtccctccggcccttgcaacaccccta

SEQ ID NO: 77144 - DNA, 36 bp, Artificial Sequence
  Synthetic oligonucleotide
tgagtgttcgcctataaagtttcctgctgctcccta

SEQ ID NO: 77145 - DNA, 36 bp, Artificial Sequence
  Synthetic oligonucleotide
gcatcgcctgaactcgcacgcacttctctcacgcta

SEQ ID NO: 77146 - DNA, 35 bp, Artificial Sequence
  Synthetic oligonucleotide
tcttggagccggcacaaattcgcgggccacttcta

SEQ ID NO: 77147 - DNA, 36 bp, Artificial Sequence
  Synthetic oligonucleotide
gcacaccccctctgtactgtcggaaatcctgttcta

SEQ ID NO: 77148 - DNA, 36 bp, Artificial Sequence
  Synthetic oligonucleotide
gagaatgagcggggcaagggggccaaagtttctgta

SEQ ID NO: 77149 - DNA, 36 bp, Artificial Sequence
  Synthetic oligonucleotide
acaacccccattaatgagtaatgggaacacctctta

SEQ ID NO: 77150 - DNA, 35 bp, Artificial Sequence
  Synthetic oligonucleotide
gaacatgcccttccgttgcctcacgaatcctttta

SEQ ID NO: 77151 - DNA, 35 bp, Artificial Sequence
  Synthetic oligonucleotide
agcctccccaccggtccatgtattggtacttcaac

SEQ ID NO: 77152 - DNA, 35 bp, Artificial Sequence
  Synthetic oligonucleotide
gtcgtacacatctgttgcctatgcccatccagaac

SEQ ID NO: 77153 - DNA, 35 bp, Artificial Sequence
  Synthetic oligonucleotide
gaagggagtcccgttccccgatagtttcacctcac

SEQ ID NO: 77154 - DNA, 35 bp, Artificial Sequence
  Synthetic oligonucleotide
tcacacggctttatgcgctgtcaggaccctctcac

SEQ ID NO: 77155 - DNA, 35 bp, Artificial Sequence
  Synthetic oligonucleotide
gagatgtatggaacgtggtaaggaagggacaggac

SEQ ID NO: 77156 - DNA, 37 bp, Artificial Sequence
  Synthetic oligonucleotide
ggtgtgagcgagagcaaggagtattgaaggataggac

SEQ ID NO: 77157 - DNA, 35 bp, Artificial Sequence
  Synthetic oligonucleotide
tcactcccgcttgcattgccattggcccacttgac

SEQ ID NO: 77158 - DNA, 35 bp, Artificial Sequence
  Synthetic oligonucleotide
tgtagcacctcatgggcgcacactagtctctcacc

SEQ ID NO: 77159 - DNA, 35 bp, Artificial Sequence
  Synthetic oligonucleotide
tagcaggctgaacattaacggcccaggcaataccc

SEQ ID NO: 77160 - DNA, 35 bp, Artificial Sequence
  Synthetic oligonucleotide
atcatctgtctagatccacctttacgaagcccccc

SEQ ID NO: 77161 - DNA, 35 bp, Artificial Sequence
  Synthetic oligonucleotide
tctcgaccggtctctgatagcgtaactgaatcccc

SEQ ID NO: 77162 - DNA, 35 bp, Artificial Sequence
  Synthetic oligonucleotide
gtgaccctgagggagttgcatcttttacccgagcc

SEQ ID NO: 77163 - DNA, 35 bp, Artificial Sequence
  Synthetic oligonucleotide
gtgcatgtcggtaactcgcccctactcccactgcc

SEQ ID NO: 77164 - DNA, 35 bp, Artificial Sequence
  Synthetic oligonucleotide
cacacatcattagcccccgcactcttccagctgcc

SEQ ID NO: 77165 - DNA, 35 bp, Artificial Sequence
  Synthetic oligonucleotide
tgtgccggttatacgctacctggccgccactatcc

SEQ ID NO: 77166 - DNA, 35 bp, Artificial Sequence
  Synthetic oligonucleotide
aacaccatccattcaggcgcctgagctttttctcc

SEQ ID NO: 77167 - DNA, 35 bp, Artificial Sequence
  Synthetic oligonucleotide
atgagcgtggggccgccggtcgcacacgagtttcc

SEQ ID NO: 77168 - DNA, 35 bp, Artificial Sequence
  Synthetic oligonucleotide
tgacgaggagcagtctgggagaagttagacgaggc

SEQ ID NO: 77169 - DNA, 35 bp, Artificial Sequence
  Synthetic oligonucleotide
aactgccaagagagtgcttcctatcgcacttaggc

SEQ ID NO: 77170 - DNA, 35 bp, Artificial Sequence
  Synthetic oligonucleotide
tacaggacgcggggggtcctgtgcaattcgccttc

SEQ ID NO: 77171 - DNA, 35 bp, Artificial Sequence
  Synthetic oligonucleotide
gaacatgcgtaagtattttggttcttgtcatcttc

SEQ ID NO: 77172 - DNA, 35 bp, Artificial Sequence
  Synthetic oligonucleotide
tctaacctgcccacgacgagctttgcgattgacag

SEQ ID NO: 77173 - DNA, 35 bp, Artificial Sequence
  Synthetic oligonucleotide
gccaacccgctgataatcctacctcgaacgtatag

SEQ ID NO: 77174 - DNA, 35 bp, Artificial Sequence
  Synthetic oligonucleotide
acgagagatccaacaagcacgccaagagacaaacg

SEQ ID NO: 77175 - DNA, 35 bp, Artificial Sequence
  Synthetic oligonucleotide
tagcccgtaaatttccccccgactaagtcaccccg

SEQ ID NO: 77176 - DNA, 35 bp, Artificial Sequence
  Synthetic oligonucleotide
tgttgcgcatacttttctacgatcgggggaggtcg

SEQ ID NO: 77177 - DNA, 35 bp, Artificial Sequence
  Synthetic oligonucleotide
gaacgcaaccgcccctattccgaccgcctttgcgg

SEQ ID NO: 77178 - DNA, 35 bp, Artificial Sequence
  Synthetic oligonucleotide
tacggtgggtggttgtacttagtgtgtgacgtggg

SEQ ID NO: 77179 - DNA, 35 bp, Artificial Sequence
  Synthetic oligonucleotide
accgaccggggctgggtgttggtcgtctgggtatg

SEQ ID NO: 77180 - DNA, 35 bp, Artificial Sequence
  Synthetic oligonucleotide
gcgtgaagcgttattactgttgccgtacactccat

SEQ ID NO: 77181 - DNA, 35 bp, Artificial Sequence
  Synthetic oligonucleotide
accggaggcgacgaatcgaaataccacccgtaagt

SEQ ID NO: 77182 - DNA, 34 bp, Artificial Sequence
  Synthetic oligonucleotide
gactcaccgagggcatcttactaacgattaccgt

SEQ ID NO: 77183 - DNA, 35 bp, Artificial Sequence
  Synthetic oligonucleotide
tgagtactgcagcctggtcgagcgtacattatcgt

SEQ ID NO: 77184 - DNA, 35 bp, Artificial Sequence
  Synthetic oligonucleotide
ttgccgctgtgcatctctctgtacttggttgcggt

SEQ ID NO: 77185 - DNA, 35 bp, Artificial Sequence
  Synthetic oligonucleotide
actatgctctgtaccagtctcaactgttgccctgt

SEQ ID NO: 77186 - DNA, 35 bp, Artificial Sequence
  Synthetic oligonucleotide
tctgaccggggtctgcagccttcaccttatcactt

SEQ ID NO: 77187 - DNA, 35 bp, Artificial Sequence
  Synthetic oligonucleotide
tatcctcggcctcctcaaccgatacaggcttcctt

SEQ ID NO: 77188 - DNA, 35 bp, Artificial Sequence
  Synthetic oligonucleotide
atccggacgaggcggggcttatccgtacttttctt

SEQ ID NO: 77189 - DNA, 35 bp, Artificial Sequence
  Synthetic oligonucleotide
gcaggacgagacagtggaaggagcgtagtcaggtt

SEQ ID NO: 77190 - DNA, 35 bp, Artificial Sequence
  Synthetic oligonucleotide
accgttagctaccagcccggccttttatgcaattt

SEQ ID NO: 77191 - DNA, 35 bp, Artificial Sequence
  Synthetic oligonucleotide
attggatggtcctgcattgtcgtgcctatcgcttt

SEQ ID NO: 77192 - DNA, 35 bp, Artificial Sequence
  Synthetic oligonucleotide
aactgcaacttgttcgcagtacttatagcactttt

SEQ ID NO: 77193 - DNA, 36 bp, Artificial Sequence
  Synthetic oligonucleotide
gcgatggaaggcaagtggagatttaaaccaagcaaa

SEQ ID NO: 77194 - DNA, 35 bp, Artificial Sequence
  Synthetic oligonucleotide
gctgctgcctacccatcaaccatagcacacggaaa

SEQ ID NO: 77195 - DNA, 36 bp, Artificial Sequence
  Synthetic oligonucleotide
gccgttgccccccccgtccagtctcctacacaagaa

SEQ ID NO: 77196 - DNA, 36 bp, Artificial Sequence
  Synthetic oligonucleotide
gtagtgccgctgcggataggctccctgcaccataca

SEQ ID NO: 77197 - DNA, 36 bp, Artificial Sequence
  Synthetic oligonucleotide
tcaacgcctggtcgttctttatgtagcacattacca

SEQ ID NO: 77198 - DNA, 36 bp, Artificial Sequence
  Synthetic oligonucleotide
gacgcctcttgtctcggcgtgtttcctccggaccca

SEQ ID NO: 77199 - DNA, 36 bp, Artificial Sequence
  Synthetic oligonucleotide
atcactgtcactgactttgaagccgccctaacgcca

SEQ ID NO: 77200 - DNA, 36 bp, Artificial Sequence
  Synthetic oligonucleotide
agccgacgaatagttggcctttttaatcgaacatca

SEQ ID NO: 77201 - DNA, 35 bp, Artificial Sequence
  Synthetic oligonucleotide
tgagcaaacggcatgagtccagcaatcccaactca

SEQ ID NO: 77202 - DNA, 36 bp, Artificial Sequence
  Synthetic oligonucleotide
gggtaggattcaagggtgaggcgggaggattggtca

SEQ ID NO: 77203 - DNA, 36 bp, Artificial Sequence
  Synthetic oligonucleotide
aatgggactgtcagggacatgggggggtaactgtca

SEQ ID NO: 77204 - DNA, 36 bp, Artificial Sequence
  Synthetic oligonucleotide
ttcacgccctcggaccaaccccgtctcaccaattca

SEQ ID NO: 77205 - DNA, 36 bp, Artificial Sequence
  Synthetic oligonucleotide
gttgccatacatctgtgcggcattagactcttttca

SEQ ID NO: 77206 - DNA, 35 bp, Artificial Sequence
  Synthetic oligonucleotide
gccatcctacgctccaggccatcactatccctaga

SEQ ID NO: 77207 - DNA, 36 bp, Artificial Sequence
  Synthetic oligonucleotide
tgacccccctctctgccttataaatttgctgtacga

SEQ ID NO: 77208 - DNA, 36 bp, Artificial Sequence
  Synthetic oligonucleotide
taaccaactgtactctcttgtgatccacgtttacga

SEQ ID NO: 77209 - DNA, 37 bp, Artificial Sequence
  Synthetic oligonucleotide
gactcaccaactatcctgatcgtcaataattcaccga

SEQ ID NO: 77210 - DNA, 36 bp, Artificial Sequence
  Synthetic oligonucleotide
ttcatgccgcccgacatgtcatgtgcacttcaccga

SEQ ID NO: 77211 - DNA, 37 bp, Artificial Sequence
  Synthetic oligonucleotide
gaatgaagtgaggtgaggattaggaataggcagccga

SEQ ID NO: 77212 - DNA, 37 bp, Artificial Sequence
  Synthetic oligonucleotide
gatgaaggggaattaatgatgggactgcgggaatcga

SEQ ID NO: 77213 - DNA, 37 bp, Artificial Sequence
  Synthetic oligonucleotide
agtcgccttcccgccttgcattcaggttatacctcga

SEQ ID NO: 77214 - DNA, 37 bp, Artificial Sequence
  Synthetic oligonucleotide
caatctcaccacgcccgtcccataactagagtctcga

SEQ ID NO: 77215 - DNA, 37 bp, Artificial Sequence
  Synthetic oligonucleotide
gcctgcacggctcccaacttgatatctcacgtctcga

SEQ ID NO: 77216 - DNA, 37 bp, Artificial Sequence
  Synthetic oligonucleotide
ggtaaacgcattgacgttcccgtgcctccattctcga

SEQ ID NO: 77217 - DNA, 36 bp, Artificial Sequence
  Synthetic oligonucleotide
tagacgggctgtgtggacggtgacggaattgcagga

SEQ ID NO: 77218 - DNA, 36 bp, Artificial Sequence
  Synthetic oligonucleotide
tcatcacccaatccgtctcggctcaagtccgtagga

SEQ ID NO: 77219 - DNA, 36 bp, Artificial Sequence
  Synthetic oligonucleotide
tcgaatgtccaacccggtgccccatccgccaacgga

SEQ ID NO: 77220 - DNA, 37 bp, Artificial Sequence
  Synthetic oligonucleotide
gagtgccttattggagaaggtggaggcgggtaacgga

SEQ ID NO: 77221 - DNA, 37 bp, Artificial Sequence
  Synthetic oligonucleotide
gactagctaggggaaaatgcgggtcaagggctaggga

SEQ ID NO: 77222 - DNA, 37 bp, Artificial Sequence
  Synthetic oligonucleotide
aagcctgccacctgtctcagcacccacgacctcggga

SEQ ID NO: 77223 - DNA, 37 bp, Artificial Sequence
  Synthetic oligonucleotide
tatgctgcagaaggtatcgatcagtgtgaggatggga

SEQ ID NO: 77224 - DNA, 37 bp, Artificial Sequence
  Synthetic oligonucleotide
agtccgtctaaacgccgccacttccacacacctggga

SEQ ID NO: 77225 - DNA, 37 bp, Artificial Sequence
  Synthetic oligonucleotide
ttttgacctccgcatccgctgttttccgtacctggga

SEQ ID NO: 77226 - DNA, 37 bp, Artificial Sequence
  Synthetic oligonucleotide
ggatggaaggaaggggttgaagccgcagtgattggga

SEQ ID NO: 77227 - DNA, 38 bp, Artificial Sequence
  Synthetic oligonucleotide
tcagactgcacaagcgatattttggcccccctcaatga

SEQ ID NO: 77228 - DNA, 37 bp, Artificial Sequence
  Synthetic oligonucleotide
atgatgagggggggctgtaccttgggtagaggaatga

SEQ ID NO: 77229 - DNA, 38 bp, Artificial Sequence
  Synthetic oligonucleotide
ggtggagaaacggtggctgggaaaaaaaggcgtcatga

SEQ ID NO: 77230 - DNA, 38 bp, Artificial Sequence
  Synthetic oligonucleotide
gaggggtgggaggagcgtgtgagggtgggccttgatga

SEQ ID NO: 77231 - DNA, 38 bp, Artificial Sequence
  Synthetic oligonucleotide
accggaagaccgccaacactctgatctctgcccactga

SEQ ID NO: 77232 - DNA, 38 bp, Artificial Sequence
  Synthetic oligonucleotide
gtccaccggtccgtcaccaactccacagcctctactga

SEQ ID NO: 77233 - DNA, 38 bp, Artificial Sequence
  Synthetic oligonucleotide
gtgacgaaagtccgatggctcacaaattcggaacctga

SEQ ID NO: 77234 - DNA, 37 bp, Artificial Sequence
  Synthetic oligonucleotide
gtagcagcacgccctcaacttccccatggtagcctga

SEQ ID NO: 77235 - DNA, 37 bp, Artificial Sequence
  Synthetic oligonucleotide
gtgccggtatgcactaccacctgaaactgactcctga

SEQ ID NO: 77236 - DNA, 38 bp, Artificial Sequence
  Synthetic oligonucleotide
tcagaattgggtggggtgatggggcagagagaggctga

SEQ ID NO: 77237 - DNA, 38 bp, Artificial Sequence
  Synthetic oligonucleotide
gcatgacgtgggggtggtgtgggctaatgcatatctga

SEQ ID NO: 77238 - DNA, 38 bp, Artificial Sequence
  Synthetic oligonucleotide
tctgcgcgatacatctcatctgggccgtctgactctga

SEQ ID NO: 77239 - DNA, 38 bp, Artificial Sequence
  Synthetic oligonucleotide
tccaccgtaagtcttaacccgcagatcccgttctctga

SEQ ID NO: 77240 - DNA, 38 bp, Artificial Sequence
  Synthetic oligonucleotide
ggatagggggctaggacctgggaacggggacatcgtga

SEQ ID NO: 77241 - DNA, 38 bp, Artificial Sequence
  Synthetic oligonucleotide
acacgagagggggaagacggtcggccttcgggaattga

SEQ ID NO: 77242 - DNA, 36 bp, Artificial Sequence
  Synthetic oligonucleotide
gtgtggagggtgggacaaaaataaacaactgattga

SEQ ID NO: 77243 - DNA, 36 bp, Artificial Sequence
  Synthetic oligonucleotide
gtagggtcaccaccatcttgcccccgtgaaacttga

SEQ ID NO: 77244 - DNA, 37 bp, Artificial Sequence
  Synthetic oligonucleotide
aagtctaccgccgcctggccgtccaaccaccacttga

SEQ ID NO: 77245 - DNA, 38 bp, Artificial Sequence
  Synthetic oligonucleotide
ggtgccacgcagtgatcaatcatttacctggcccttga

SEQ ID NO: 77246 - DNA, 37 bp, Artificial Sequence
  Synthetic oligonucleotide
gtaacggtgtgtggaagcaaagatgatggtgcgttga

SEQ ID NO: 77247 - DNA, 38 bp, Artificial Sequence
  Synthetic oligonucleotide
tgatgcgggtgcattgctggcaaatggaaggtggttga

SEQ ID NO: 77248 - DNA, 38 bp, Artificial Sequence
  Synthetic oligonucleotide
acgaaagggtgcaataggcggtaggtaaggttggttga

SEQ ID NO: 77249 - DNA, 36 bp, Artificial Sequence
  Synthetic oligonucleotide
acccccagaccggcgatcttcgcgcataatctttga

SEQ ID NO: 77250 - DNA, 37 bp, Artificial Sequence
  Synthetic oligonucleotide
ggtcggggagcagtaaaggtatcacgggcgggtttga

SEQ ID NO: 77251 - DNA, 36 bp, Artificial Sequence
  Synthetic oligonucleotide
taaaccgcgccaaacgcctctcagtactgttcgata

SEQ ID NO: 77252 - DNA, 36 bp, Artificial Sequence
  Synthetic oligonucleotide
tccccccccggtacataggtcacctccgtaactata

SEQ ID NO: 77253 - DNA, 36 bp, Artificial Sequence
  Synthetic oligonucleotide
catacttgcccgtttccacattgtcatgctacccta

SEQ ID NO: 77254 - DNA, 36 bp, Artificial Sequence
  Synthetic oligonucleotide
tgctaccatttgtcccacaacacattcgttttcgta

SEQ ID NO: 77255 - DNA, 36 bp, Artificial Sequence
  Synthetic oligonucleotide
atccacaaaccacgctcacatcaccttaaaggggta

SEQ ID NO: 77256 - DNA, 36 bp, Artificial Sequence
  Synthetic oligonucleotide
tcaagcagagggcagagacgggcaagttgtggggta

SEQ ID NO: 77257 - DNA, 36 bp, Artificial Sequence
  Synthetic oligonucleotide
gaacggatgaaggatgataccacactcacacatgta

SEQ ID NO: 77258 - DNA, 36 bp, Artificial Sequence
  Synthetic oligonucleotide
ttcgaagtgtgcgctagtctctatgatcttccatta

SEQ ID NO: 77259 - DNA, 37 bp, Artificial Sequence
  Synthetic oligonucleotide
gcaggtgaggggaggacgggcacagagttcttattta

SEQ ID NO: 77260 - DNA, 35 bp, Artificial Sequence
  Synthetic oligonucleotide
tccgcggaggcgttcggttctgcaacctggcttta

SEQ ID NO: 77261 - DNA, 35 bp, Artificial Sequence
  Synthetic oligonucleotide
agaggacgagtatggggcgggtgggtgtctacaac

SEQ ID NO: 77262 - DNA, 35 bp, Artificial Sequence
  Synthetic oligonucleotide
aattgtgccccccagtcccttagccaacgtggaac

SEQ ID NO: 77263 - DNA, 35 bp, Artificial Sequence
  Synthetic oligonucleotide
aaccgctcgtctcaccgactgatcccgcacaacac

SEQ ID NO: 77264 - DNA, 34 bp, Artificial Sequence
  Synthetic oligonucleotide
tcccccgccgcctgcccatcaaagtcacctacac

SEQ ID NO: 77265 - DNA, 35 bp, Artificial Sequence
  Synthetic oligonucleotide
gcggagcccacccaaaataagccctgaattccgac

SEQ ID NO: 77266 - DNA, 35 bp, Artificial Sequence
  Synthetic oligonucleotide
aacacgcaggatcgcgcgttcttgagtttgcctac

SEQ ID NO: 77267 - DNA, 34 bp, Artificial Sequence
  Synthetic oligonucleotide
gaccgccaaaaagggcggcattttttatctctac

SEQ ID NO: 77268 - DNA, 35 bp, Artificial Sequence
  Synthetic oligonucleotide
aatatgtccgccccgttcgtttgttttgcgattac

SEQ ID NO: 77269 - DNA, 35 bp, Artificial Sequence
  Synthetic oligonucleotide
ggacacatccacgctgttttttcttgctttgttac

SEQ ID NO: 77270 - DNA, 35 bp, Artificial Sequence
  Synthetic oligonucleotide
gtggtgagtgtccctagtcaatcgtagcacaaacc

SEQ ID NO: 77271 - DNA, 35 bp, Artificial Sequence
  Synthetic oligonucleotide
acttatccctgccgtccccaggttctgtgcgaacc

SEQ ID NO: 77272 - DNA, 35 bp, Artificial Sequence
  Synthetic oligonucleotide
tcgaaccgtacacgatcaactaccgcccaataacc

SEQ ID NO: 77273 - DNA, 35 bp, Artificial Sequence
  Synthetic oligonucleotide
gttcatggcattccttccagttctgagtccccacc

SEQ ID NO: 77274 - DNA, 35 bp, Artificial Sequence
  Synthetic oligonucleotide
gcagtaaccgccagtcctcgatggtgtctgtcccc

SEQ ID NO: 77275 - DNA, 35 bp, Artificial Sequence
  Synthetic oligonucleotide
atctcagacttcaccccttgacgagtcacctgccc

SEQ ID NO: 77276 - DNA, 36 bp, Artificial Sequence
  Synthetic oligonucleotide
atgacatgccgaatcgttccgaaccattacttgccc

SEQ ID NO: 77277 - DNA, 35 bp, Artificial Sequence
  Synthetic oligonucleotide
tcaccccgcactctttggtcgcgataaccgatccc

SEQ ID NO: 77278 - DNA, 35 bp, Artificial Sequence
  Synthetic oligonucleotide
gtttctgacggtagcccgctttcaagcttcctgcc

SEQ ID NO: 77279 - DNA, 35 bp, Artificial Sequence
  Synthetic oligonucleotide
tccgccactaaccactcgcgatggtccatgaatcc

SEQ ID NO: 77280 - DNA, 35 bp, Artificial Sequence
  Synthetic oligonucleotide
gcttagcttagcagccccaccgtgccaatctctcc

SEQ ID NO: 77281 - DNA, 35 bp, Artificial Sequence
  Synthetic oligonucleotide
gacaccatgatctcctctgtcggggcgtaccgtcc

SEQ ID NO: 77282 - DNA, 35 bp, Artificial Sequence
  Synthetic oligonucleotide
gtcaacccctgcgtattgttttctctgtaggttcc

SEQ ID NO: 77283 - DNA, 33 bp, Artificial Sequence
  Synthetic oligonucleotide
ccgatcgccacgcccccacaatggttcgtttcc

SEQ ID NO: 77284 - DNA, 35 bp, Artificial Sequence
  Synthetic oligonucleotide
gttcggtctggaagggtggtgggggttggtaaggc

SEQ ID NO: 77285 - DNA, 35 bp, Artificial Sequence
  Synthetic oligonucleotide
atgtccatctatcaccgtactgcctaggtattggc

SEQ ID NO: 77286 - DNA, 35 bp, Artificial Sequence
  Synthetic oligonucleotide
ttgcatatactcctggtctgcatagttccctcctc

SEQ ID NO: 77287 - DNA, 35 bp, Artificial Sequence
  Synthetic oligonucleotide
gtgctcaccgtttccccactatgctcttggcgctc

SEQ ID NO: 77288 - DNA, 35 bp, Artificial Sequence
  Synthetic oligonucleotide
acacccctgcgatgtacgaccgctgaacctgtctc

SEQ ID NO: 77289 - DNA, 35 bp, Artificial Sequence
  Synthetic oligonucleotide
gggacaccaccaatgccaggcccctgagtctgttc

SEQ ID NO: 77290 - DNA, 35 bp, Artificial Sequence
  Synthetic oligonucleotide
accctcgtgcccagtttagccccctgatccatcag

SEQ ID NO: 77291 - DNA, 35 bp, Artificial Sequence
  Synthetic oligonucleotide
tacccgcctgagatcgctgacaaccacgaacatag

SEQ ID NO: 77292 - DNA, 35 bp, Artificial Sequence
  Synthetic oligonucleotide
accatcagtcggcatgtccaaaatgacctttctcg

SEQ ID NO: 77293 - DNA, 35 bp, Artificial Sequence
  Synthetic oligonucleotide
catccaccccaggactcacgacaacgagttggtcg

SEQ ID NO: 77294 - DNA, 35 bp, Artificial Sequence
  Synthetic oligonucleotide
gtcaatggcgtggtagagtgaggtaggtgaagcgg

SEQ ID NO: 77295 - DNA, 35 bp, Artificial Sequence
  Synthetic oligonucleotide
gccgggtgagtttgagaggaaaggtagaggtaatg

SEQ ID NO: 77296 - DNA, 35 bp, Artificial Sequence
  Synthetic oligonucleotide
acacaacgctccaaaattgctctattaggtcccat

SEQ ID NO: 77297 - DNA, 35 bp, Artificial Sequence
  Synthetic oligonucleotide
atcatcctgtccctcggaatgttccaagttttcat

SEQ ID NO: 77298 - DNA, 35 bp, Artificial Sequence
  Synthetic oligonucleotide
gcagacggaacatgcttgtggtcccattaacttat

SEQ ID NO: 77299 - DNA, 35 bp, Artificial Sequence
  Synthetic oligonucleotide
acgctccgcacccaacgcccttgatatgatcttat

SEQ ID NO: 77300 - DNA, 35 bp, Artificial Sequence
  Synthetic oligonucleotide
ttgctccaacctccgccaccgtggtgatatgttat

SEQ ID NO: 77301 - DNA, 35 bp, Artificial Sequence
  Synthetic oligonucleotide
gccactgatcacacgtcgttgaactactactaact

SEQ ID NO: 77302 - DNA, 35 bp, Artificial Sequence
  Synthetic oligonucleotide
atcctgtactctcctgtagctgtaattttagccct

SEQ ID NO: 77303 - DNA, 35 bp, Artificial Sequence
  Synthetic oligonucleotide
tgacgtacagagcgttctcagcatctcatcatcct

SEQ ID NO: 77304 - DNA, 35 bp, Artificial Sequence
  Synthetic oligonucleotide
gacccctacagcccgcaccccaccgctattatgct

SEQ ID NO: 77305 - DNA, 34 bp, Artificial Sequence
  Synthetic oligonucleotide
gatagatcccccgctggcctgtcaccccagctct

SEQ ID NO: 77306 - DNA, 35 bp, Artificial Sequence
  Synthetic oligonucleotide
atgccgcccctttcgaagcacgccctgaacgctct

SEQ ID NO: 77307 - DNA, 35 bp, Artificial Sequence
  Synthetic oligonucleotide
atgagtggcccgagaggaggagtcgacgatagagt

SEQ ID NO: 77308 - DNA, 35 bp, Artificial Sequence
  Synthetic oligonucleotide
gaacgagagagaggtgcgtagtttaagaggtatgt

SEQ ID NO: 77309 - DNA, 35 bp, Artificial Sequence
  Synthetic oligonucleotide
tttctgccgtgaggctgtcccttccattcttttgt

SEQ ID NO: 77310 - DNA, 35 bp, Artificial Sequence
  Synthetic oligonucleotide
gccacgcccttcccccagcgattacccagtccatt

SEQ ID NO: 77311 - DNA, 35 bp, Artificial Sequence
  Synthetic oligonucleotide
aacctgtgtacgagcggcacgtgctgccttcactt

SEQ ID NO: 77312 - DNA, 35 bp, Artificial Sequence
  Synthetic oligonucleotide
tccaagcagcccctcgaggtacagctcccaacctt

SEQ ID NO: 77313 - DNA, 35 bp, Artificial Sequence
  Synthetic oligonucleotide
gacattacctctcacagcctctataagcgaacctt

SEQ ID NO: 77314 - DNA, 35 bp, Artificial Sequence
  Synthetic oligonucleotide
agtcaactcgcagtcccagtgtcccttagcccgtt

SEQ ID NO: 77315 - DNA, 35 bp, Artificial Sequence
  Synthetic oligonucleotide
tcacgcacagaatgggttggtattctccgttattt

SEQ ID NO: 77316 - DNA, 35 bp, Artificial Sequence
  Synthetic oligonucleotide
tctttcccccatgggtggctatgaccacattcttt

SEQ ID NO: 77317 - DNA, 35 bp, Artificial Sequence
  Synthetic oligonucleotide
atacgctcagtcccctctacctgttcgcctttttt

SEQ ID NO: 77318 - DNA, 36 bp, Artificial Sequence
  Synthetic oligonucleotide
tccgtaggcatctgtgctctgctattgccattttaa

SEQ ID NO: 77319 - DNA, 36 bp, Artificial Sequence
  Synthetic oligonucleotide
gcatctacacgtgcgacataacacgattactcccca

SEQ ID NO: 77320 - DNA, 35 bp, Artificial Sequence
  Synthetic oligonucleotide
tctatccgcgcttcatcatacctggaccacagcca

SEQ ID NO: 77321 - DNA, 36 bp, Artificial Sequence
  Synthetic oligonucleotide
gtgccaactctggggagctgctaattctacgtgcca

SEQ ID NO: 77322 - DNA, 36 bp, Artificial Sequence
  Synthetic oligonucleotide
gcttttggccgacctgcatctacgaacacggctcca

SEQ ID NO: 77323 - DNA, 36 bp, Artificial Sequence
  Synthetic oligonucleotide
aacatcgccatgccggataaccggcgacctgctcca

SEQ ID NO: 77324 - DNA, 36 bp, Artificial Sequence
  Synthetic oligonucleotide
tccagggcgaatcgaccggggaggggaataagggca

SEQ ID NO: 77325 - DNA, 36 bp, Artificial Sequence
  Synthetic oligonucleotide
gagcgagggggcagagcgctttagatggaggtggca

SEQ ID NO: 77326 - DNA, 35 bp, Artificial Sequence
  Synthetic oligonucleotide
gctcgccctcctcactatcttcagtcaagtcatca

SEQ ID NO: 77327 - DNA, 36 bp, Artificial Sequence
  Synthetic oligonucleotide
gttagctctgatcgtcactggtctcatctcttatca

SEQ ID NO: 77328 - DNA, 37 bp, Artificial Sequence
  Synthetic oligonucleotide
gaaccgaggttcacgagcagaaagtgagcttgggaga

SEQ ID NO: 77329 - DNA, 37 bp, Artificial Sequence
  Synthetic oligonucleotide
agacagaggggtggagggaagaaggacgatcgtgaga

SEQ ID NO: 77330 - DNA, 37 bp, Artificial Sequence
  Synthetic oligonucleotide
atgtacgggtgggttctgatacgggcagggcattaga

SEQ ID NO: 77331 - DNA, 37 bp, Artificial Sequence
  Synthetic oligonucleotide
gtagacaccacaccgcgtacttacgtatacctgccga

SEQ ID NO: 77332 - DNA, 37 bp, Artificial Sequence
  Synthetic oligonucleotide
tgtcctgtacgcctaagcaattgtcattgaccctcga

SEQ ID NO: 77333 - DNA, 37 bp, Artificial Sequence
  Synthetic oligonucleotide
agccagagcacatactacgcactctttcgatattcga

SEQ ID NO: 77334 - DNA, 37 bp, Artificial Sequence
  Synthetic oligonucleotide
ttactactccacaatagggtttctcgtcccccaagga

SEQ ID NO: 77335 - DNA, 35 bp, Artificial Sequence
  Synthetic oligonucleotide
tcacgggcggggcaagtaggtggggggacgtagga

SEQ ID NO: 77336 - DNA, 36 bp, Artificial Sequence
  Synthetic oligonucleotide
gatgggccgacgcctccagaatgattcttacacgga

SEQ ID NO: 77337 - DNA, 37 bp, Artificial Sequence
  Synthetic oligonucleotide
tgaaaacatacgggaggaatggtggagggaatacgga

SEQ ID NO: 77338 - DNA, 37 bp, Artificial Sequence
  Synthetic oligonucleotide
tttagcgctgtccttccttgagcctggtttccgcgga

SEQ ID NO: 77339 - DNA, 37 bp, Artificial Sequence
  Synthetic oligonucleotide
taaccgggcgagagaaagtggacataggtggttcgga

SEQ ID NO: 77340 - DNA, 37 bp, Artificial Sequence
  Synthetic oligonucleotide
actccagtgcggctaccggtttcctctgctccaggga

SEQ ID NO: 77341 - DNA, 37 bp, Artificial Sequence
  Synthetic oligonucleotide
aaaagtgaggtggatggggaatacaggtgaaacggga

SEQ ID NO: 77342 - DNA, 37 bp, Artificial Sequence
  Synthetic oligonucleotide
ggaataggttcagggaaaacaaaggtggggtagggga

SEQ ID NO: 77343 - DNA, 37 bp, Artificial Sequence
  Synthetic oligonucleotide
aagcatgggagcagggcgaaggtgacttcatcgggga

SEQ ID NO: 77344 - DNA, 37 bp, Artificial Sequence
  Synthetic oligonucleotide
gggtgcaatcctcgggcagggaaaggttagcggggga

SEQ ID NO: 77345 - DNA, 37 bp, Artificial Sequence
  Synthetic oligonucleotide
actgggtcggtcggttaggcaatctgggagaatggga

SEQ ID NO: 77346 - DNA, 36 bp, Artificial Sequence
  Synthetic oligonucleotide
tacaccgataactccgtacatattgctggcctggga

SEQ ID NO: 77347 - DNA, 37 bp, Artificial Sequence
  Synthetic oligonucleotide
acgcccgacaccatccgaattgccgacacacgatgga

SEQ ID NO: 77348 - DNA, 37 bp, Artificial Sequence
  Synthetic oligonucleotide
ggatcgctcacatctcttttttctctagctttatgga

SEQ ID NO: 77349 - DNA, 37 bp, Artificial Sequence
  Synthetic oligonucleotide
agagccgccgcgcgttctgtttcggatattacctgga

SEQ ID NO: 77350 - DNA, 37 bp, Artificial Sequence
  Synthetic oligonucleotide
atatgtgaaggtggtacgaatagtgagggtggctgga

SEQ ID NO: 77351 - DNA, 38 bp, Artificial Sequence
  Synthetic oligonucleotide
tgacatgcccctccgcatctgtcagggcataacaatga

SEQ ID NO: 77352 - DNA, 38 bp, Artificial Sequence
  Synthetic oligonucleotide
gacagatggtccggcccaccttgcgttcgatctcatga

SEQ ID NO: 77353 - DNA, 38 bp, Artificial Sequence
  Synthetic oligonucleotide
gctgggaggtgagggtaagggtgaggcgttacgtatga

SEQ ID NO: 77354 - DNA, 37 bp, Artificial Sequence
  Synthetic oligonucleotide
gaacgtaccctggtttggctattcactaccattatga

SEQ ID NO: 77355 - DNA, 38 bp, Artificial Sequence
  Synthetic oligonucleotide
tgtccccctaagaatagaacccgcgtgctccccactga

SEQ ID NO: 77356 - DNA, 37 bp, Artificial Sequence
  Synthetic oligonucleotide
gtcaccgagacccttctccttcagccctttccactga

SEQ ID NO: 77357 - DNA, 37 bp, Artificial Sequence
  Synthetic oligonucleotide
gttgccgccgaagcactttaaggcaccagcaacctga

SEQ ID NO: 77358 - DNA, 37 bp, Artificial Sequence
  Synthetic oligonucleotide
tatgcactgtcccgcccgtcgacccattcgaccctga

SEQ ID NO: 77359 - DNA, 38 bp, Artificial Sequence
  Synthetic oligonucleotide
tgccccacgatcactgtcatccttggcccctgaagtga

SEQ ID NO: 77360 - DNA, 38 bp, Artificial Sequence
  Synthetic oligonucleotide
gtcgcccgacgctcattttatctccgacactacagtga

SEQ ID NO: 77361 - DNA, 37 bp, Artificial Sequence
  Synthetic oligonucleotide
gccgagtcatggtgccggcacgcaaggtagggagtga

SEQ ID NO: 77362 - DNA, 38 bp, Artificial Sequence
  Synthetic oligonucleotide
atgcggtgtgtttggggtgtgtgaggggggctgagtga

SEQ ID NO: 77363 - DNA, 38 bp, Artificial Sequence
  Synthetic oligonucleotide
ttgaggatggggatggtgggagcaggtgtgactagtga

SEQ ID NO: 77364 - DNA, 38 bp, Artificial Sequence
  Synthetic oligonucleotide
actccatccgtcctacctgtgtctggcgttggccgtga

SEQ ID NO: 77365 - DNA, 38 bp, Artificial Sequence
  Synthetic oligonucleotide
tacgccaagaccaatgtgaagcctacctccgctcgtga

SEQ ID NO: 77366 - DNA, 37 bp, Artificial Sequence
  Synthetic oligonucleotide
tgatacaggctagcaggagaggcttaaaagggggtga

SEQ ID NO: 77367 - DNA, 38 bp, Artificial Sequence
  Synthetic oligonucleotide
gcgagatgcgcacgggggctagacgaaaaatggtgtga

SEQ ID NO: 77368 - DNA, 36 bp, Artificial Sequence
  Synthetic oligonucleotide
atccactgtacagagcggatctcttcgtactattga

SEQ ID NO: 77369 - DNA, 38 bp, Artificial Sequence
  Synthetic oligonucleotide
gacgccgtagaccgtgcagccctacttgcatgccttga

SEQ ID NO: 77370 - DNA, 38 bp, Artificial Sequence
  Synthetic oligonucleotide
gacccttcccgccacatggattcctgatgttctgttga

SEQ ID NO: 77371 - DNA, 38 bp, Artificial Sequence
  Synthetic oligonucleotide
tatgctcccacacttctgtacgcctccttccgtgttga

SEQ ID NO: 77372 - DNA, 38 bp, Artificial Sequence
  Synthetic oligonucleotide
tgttctctccgccccaactatcgctcaacgtttgttga

SEQ ID NO: 77373 - DNA, 38 bp, Artificial Sequence
  Synthetic oligonucleotide
tataaccgccacaagacctgcacgctctacccgtttga

SEQ ID NO: 77374 - DNA, 38 bp, Artificial Sequence
  Synthetic oligonucleotide
actgcacagacatccctcatgatttccagcccttttga

SEQ ID NO: 77375 - DNA, 36 bp, Artificial Sequence
  Synthetic oligonucleotide
tcaacgctacccttcacggagcagttctcccacata

SEQ ID NO: 77376 - DNA, 35 bp, Artificial Sequence
  Synthetic oligonucleotide
gtggccctaccgtaccattgcccctctacaggata

SEQ ID NO: 77377 - DNA, 35 bp, Artificial Sequence
  Synthetic oligonucleotide
gcatgacatgccctgctcgtatttggcacacccta

SEQ ID NO: 77378 - DNA, 35 bp, Artificial Sequence
  Synthetic oligonucleotide
atcttatcgcctcccatttgatcgttattactcta

SEQ ID NO: 77379 - DNA, 35 bp, Artificial Sequence
  Synthetic oligonucleotide
actttggcccagtgcaccagattttggccctctta

SEQ ID NO: 77380 - DNA, 35 bp, Artificial Sequence
  Synthetic oligonucleotide
gactcctttccgggtctatcaccaaaagcacttta

SEQ ID NO: 77381 - DNA, 35 bp, Artificial Sequence
  Synthetic oligonucleotide
tagtgacctcctgcttccattgcacaggttcttta

SEQ ID NO: 77382 - DNA, 36 bp, Artificial Sequence
  Synthetic oligonucleotide
atcccactcgccggcccaaagcatacccgtgtttta

SEQ ID NO: 77383 - DNA, 35 bp, Artificial Sequence
  Synthetic oligonucleotide
gcacgaattggttagctccgtaagtccccaactac

SEQ ID NO: 77384 - DNA, 35 bp, Artificial Sequence
  Synthetic oligonucleotide
tgctacgccccgactacccgctgaccttcgtaacc

SEQ ID NO: 77385 - DNA, 35 bp, Artificial Sequence
  Synthetic oligonucleotide
gatgtgtgcccggcgctttcccacaaaggtacacc

SEQ ID NO: 77386 - DNA, 35 bp, Artificial Sequence
  Synthetic oligonucleotide
aatcatccagcttacggcgagcccttctcttgacc

SEQ ID NO: 77387 - DNA, 35 bp, Artificial Sequence
  Synthetic oligonucleotide
acataagcacgccgggcacagaccatcccctcccc

SEQ ID NO: 77388 - DNA, 35 bp, Artificial Sequence
  Synthetic oligonucleotide
gttgagtgtcagctttctgcctacgacactatccc

SEQ ID NO: 77389 - DNA, 35 bp, Artificial Sequence
  Synthetic oligonucleotide
tccctccaccagtctattcgacgacgtcgagtccc

SEQ ID NO: 77390 - DNA, 35 bp, Artificial Sequence
  Synthetic oligonucleotide
gatactacgccgtatgttccccctgggccctgagc

SEQ ID NO: 77391 - DNA, 35 bp, Artificial Sequence
  Synthetic oligonucleotide
atctgccttggtccactggcatcgcaaatacaatc

SEQ ID NO: 77392 - DNA, 35 bp, Artificial Sequence
  Synthetic oligonucleotide
gagctatcttctcgcttccgttctccagaaccatc

SEQ ID NO: 77393 - DNA, 35 bp, Artificial Sequence
  Synthetic oligonucleotide
acttggctcctccggtacctatattcatttccatc

SEQ ID NO: 77394 - DNA, 35 bp, Artificial Sequence
  Synthetic oligonucleotide
aacacgcccccgtgcgttgccaccaatgagcactc

SEQ ID NO: 77395 - DNA, 35 bp, Artificial Sequence
  Synthetic oligonucleotide
gatcagggcccaagcaaaattcagacggtttcgtc

SEQ ID NO: 77396 - DNA, 35 bp, Artificial Sequence
  Synthetic oligonucleotide
acgagggctctgtgctctgcataccccatactgtc

SEQ ID NO: 77397 - DNA, 35 bp, Artificial Sequence
  Synthetic oligonucleotide
acatgcacccgtccctttgctttttcgctaccttc

SEQ ID NO: 77398 - DNA, 35 bp, Artificial Sequence
  Synthetic oligonucleotide
tttggaggagggacggcctcggtaaggcgaaagag

SEQ ID NO: 77399 - DNA, 35 bp, Artificial Sequence
  Synthetic oligonucleotide
gtcccatcactcaggcatcctttttacgaaactcg

SEQ ID NO: 77400 - DNA, 35 bp, Artificial Sequence
  Synthetic oligonucleotide
tcacgacaccgcattattctgccttcctgtcctcg

SEQ ID NO: 77401 - DNA, 35 bp, Artificial Sequence
  Synthetic oligonucleotide
ttctattgccggagtggcgtttcctgcctggctcg

SEQ ID NO: 77402 - DNA, 35 bp, Artificial Sequence
  Synthetic oligonucleotide
gtgttagcacacttttgcccgatcccgtagattcg

SEQ ID NO: 77403 - DNA, 35 bp, Artificial Sequence
  Synthetic oligonucleotide
tgtcaccagacaacgtagactctccatccatgcgg

SEQ ID NO: 77404 - DNA, 35 bp, Artificial Sequence
  Synthetic oligonucleotide
gtggacacgtaaggatggaccagggaattataggg

SEQ ID NO: 77405 - DNA, 35 bp, Artificial Sequence
  Synthetic oligonucleotide
actggggggtgagagggttacgacaaggttggatg

SEQ ID NO: 77406 - DNA, 35 bp, Artificial Sequence
  Synthetic oligonucleotide
tactctcatgacggtaccgaacgctcgccttcctg

SEQ ID NO: 77407 - DNA, 35 bp, Artificial Sequence
  Synthetic oligonucleotide
tcagacaggaggcggtatcgggccaaattacagtg

SEQ ID NO: 77408 - DNA, 35 bp, Artificial Sequence
  Synthetic oligonucleotide
gcgacccatgcctccttatgtctgatctctcatat

SEQ ID NO: 77409 - DNA, 35 bp, Artificial Sequence
  Synthetic oligonucleotide
ccacccttcaccttctgtgaccgtacgaacactat

SEQ ID NO: 77410 - DNA, 35 bp, Artificial Sequence
  Synthetic oligonucleotide
attgatcctggacgagaggggggggacataagtat

SEQ ID NO: 77411 - DNA, 35 bp, Artificial Sequence
  Synthetic oligonucleotide
gtcacgtggagacaaaaaattagctggggatgtat

SEQ ID NO: 77412 - DNA, 35 bp, Artificial Sequence
  Synthetic oligonucleotide
accgccgcctttgtacatatccatcagtcacttat

SEQ ID NO: 77413 - DNA, 35 bp, Artificial Sequence
  Synthetic oligonucleotide
atctaccatcagggctcaaacgcgtgtgccaccct

SEQ ID NO: 77414 - DNA, 35 bp, Artificial Sequence
  Synthetic oligonucleotide
tgcccacgacatgcagaatatttcgaatcatgcct

SEQ ID NO: 77415 - DNA, 35 bp, Artificial Sequence
  Synthetic oligonucleotide
acaaccaatgctctgaccacgaccgtccctgtcct

SEQ ID NO: 77416 - DNA, 35 bp, Artificial Sequence
  Synthetic oligonucleotide
gccgaaccctctgtaggtaaggactcgtttttcct

SEQ ID NO: 77417 - DNA, 35 bp, Artificial Sequence
  Synthetic oligonucleotide
gttacgcagccgcataggacccaaacgtcgcttct

SEQ ID NO: 77418 - DNA, 35 bp, Artificial Sequence
  Synthetic oligonucleotide
ggtagggaggggtgtgtggttccggaagtgggggt

SEQ ID NO: 77419 - DNA, 35 bp, Artificial Sequence
  Synthetic oligonucleotide
ttgtgattggccgataaggtaggaggcggtgtggt

SEQ ID NO: 77420 - DNA, 35 bp, Artificial Sequence
  Synthetic oligonucleotide
actgcccaggtgaccatacatgcggcattgccatt

SEQ ID NO: 77421 - DNA, 35 bp, Artificial Sequence
  Synthetic oligonucleotide
tgctaccctcctcccgttcgcatcatctcttgatt

SEQ ID NO: 77422 - DNA, 35 bp, Artificial Sequence
  Synthetic oligonucleotide
tcccaccgcatattctttcatgataatgttcgttt

SEQ ID NO: 77423 - DNA, 35 bp, Artificial Sequence
  Synthetic oligonucleotide
ttgccctagcgatcgccgacctttgaagctatttt

SEQ ID NO: 77424 - DNA, 35 bp, Artificial Sequence
  Synthetic oligonucleotide
ttgaccgcacccaatctatcactggccgtgagcaa

SEQ ID NO: 77425 - DNA, 36 bp, Artificial Sequence
  Synthetic oligonucleotide
tagcaccctagcctaacgatcctcgcgtacacgcaa

SEQ ID NO: 77426 - DNA, 36 bp, Artificial Sequence
  Synthetic oligonucleotide
actgctcggaaaaggcgattggattaggggaggcaa

SEQ ID NO: 77427 - DNA, 35 bp, Artificial Sequence
  Synthetic oligonucleotide
gatcgactcgcctgcaggaccccaccttagttcaa

SEQ ID NO: 77428 - DNA, 36 bp, Artificial Sequence
  Synthetic oligonucleotide
ttccagctgcacggtttttcgcgtttctttgttcaa

SEQ ID NO: 77429 - DNA, 36 bp, Artificial Sequence
  Synthetic oligonucleotide
acaacgtgtctcgggtaagggtgggtacagcaggaa

SEQ ID NO: 77430 - DNA, 36 bp, Artificial Sequence
  Synthetic oligonucleotide
tcaatccattcttcgatcctcctttggtacagtgaa

SEQ ID NO: 77431 - DNA, 35 bp, Artificial Sequence
  Synthetic oligonucleotide
tcccgcactgtagacccgcgagcgaatcgccctaa

SEQ ID NO: 77432 - DNA, 36 bp, Artificial Sequence
  Synthetic oligonucleotide
atgtgggcacctgtgtcgtcctctggtaatttctaa

SEQ ID NO: 77433 - DNA, 36 bp, Artificial Sequence
  Synthetic oligonucleotide
gaccgctcactgtcttcccgctcgctcgccctttaa

SEQ ID NO: 77434 - DNA, 36 bp, Artificial Sequence
  Synthetic oligonucleotide
agccccacaccgaggaggtgcacttcatcctccaca

SEQ ID NO: 77435 - DNA, 35 bp, Artificial Sequence
  Synthetic oligonucleotide
gtaacccggggacgtggttgcatactggtctcaca

SEQ ID NO: 77436 - DNA, 36 bp, Artificial Sequence
  Synthetic oligonucleotide
tgtctcgctgcccaccctatcacgtcgatccagaca

SEQ ID NO: 77437 - DNA, 36 bp, Artificial Sequence
  Synthetic oligonucleotide
tcataacaccacgagcgagcgtaggaaccggggaca

SEQ ID NO: 77438 - DNA, 35 bp, Artificial Sequence
  Synthetic oligonucleotide
aaacggtatccgtcactttcgttttgccgccccca

SEQ ID NO: 77439 - DNA, 35 bp, Artificial Sequence
  Synthetic oligonucleotide
tcagtcgcaggcaaggatttcgtccgaccctcgca

SEQ ID NO: 77440 - DNA, 32 bp, Artificial Sequence
  Synthetic oligonucleotide
aaccggaggcctccccagtttctctcattgca

SEQ ID NO: 77441 - DNA, 34 bp, Artificial Sequence
  Synthetic oligonucleotide
gaaaagccataatgtcggccattccatctactca

SEQ ID NO: 77442 - DNA, 36 bp, Artificial Sequence
  Synthetic oligonucleotide
gaaccacgctgaacgctttgaccttgctctttctca

SEQ ID NO: 77443 - DNA, 37 bp, Artificial Sequence
  Synthetic oligonucleotide
gtgagtaggatgggtaacggtcgattttgtggaaaga

SEQ ID NO: 77444 - DNA, 36 bp, Artificial Sequence
  Synthetic oligonucleotide
agtaacgggcgagggcgtggggaaattaggcacaga

SEQ ID NO: 77445 - DNA, 37 bp, Artificial Sequence
  Synthetic oligonucleotide
acttcaccgatctccacttgtccgactctgttgcaga

SEQ ID NO: 77446 - DNA, 37 bp, Artificial Sequence
  Synthetic oligonucleotide
gtggacgagagggggacaataggcaaaggtctaccga

SEQ ID NO: 77447 - DNA, 36 bp, Artificial Sequence
  Synthetic oligonucleotide
tgcgcctccacctttcgtatgccacatgcaacccga

SEQ ID NO: 77448 - DNA, 37 bp, Artificial Sequence
  Synthetic oligonucleotide
tgtccgtgcgcgtacataaccttcaatcacgccccga

SEQ ID NO: 77449 - DNA, 37 bp, Artificial Sequence
  Synthetic oligonucleotide
tacccacccccgtcgcccgcctgatctcgggccccga

SEQ ID NO: 77450 - DNA, 37 bp, Artificial Sequence
  Synthetic oligonucleotide
gcatgaccggatctgtttgcttgtgaatcgtgcccga

SEQ ID NO: 77451 - DNA, 37 bp, Artificial Sequence
  Synthetic oligonucleotide
tagcactcttgcgacgagtctctccccttctggccga

SEQ ID NO: 77452 - DNA, 37 bp, Artificial Sequence
  Synthetic oligonucleotide
ggatcatcgcacccagtcccccgcaacagacttccga

SEQ ID NO: 77453 - DNA, 37 bp, Artificial Sequence
  Synthetic oligonucleotide
agcctcccttaccacacgttatcgccaggcgaatcga

SEQ ID NO: 77454 - DNA, 37 bp, Artificial Sequence
  Synthetic oligonucleotide
ctcaccacccggaacctcactctatgctctgcatcga

SEQ ID NO: 77455 - DNA, 37 bp, Artificial Sequence
  Synthetic oligonucleotide
tgtgagccagggtccgcaatataatcactccactcga

SEQ ID NO: 77456 - DNA, 37 bp, Artificial Sequence
  Synthetic oligonucleotide
gtcccgcccccgatccgttttcattaagcctcttcga

SEQ ID NO: 77457 - DNA, 37 bp, Artificial Sequence
  Synthetic oligonucleotide
gaacagactcaaggacagtgaggattgggatggagga

SEQ ID NO: 77458 - DNA, 36 bp, Artificial Sequence
  Synthetic oligonucleotide
gatccagcggaggtcgaggaagggtgcgcggtagga

SEQ ID NO: 77459 - DNA, 36 bp, Artificial Sequence
  Synthetic oligonucleotide
atcatgccccgcgtaccaggtctgaagttgcccgga

SEQ ID NO: 77460 - DNA, 32 bp, Artificial Sequence
  Synthetic oligonucleotide
taagaccacgtaggtacgatcagtgagccgga

SEQ ID NO: 77461 - DNA, 37 bp, Artificial Sequence
  Synthetic oligonucleotide
actctgcacacacgctatacccatatcttttgccgga

SEQ ID NO: 77462 - DNA, 37 bp, Artificial Sequence
  Synthetic oligonucleotide
tacacgcggcaacagcgtgtatccgttatattccgga

SEQ ID NO: 77463 - DNA, 37 bp, Artificial Sequence
  Synthetic oligonucleotide
agatcgccggttcatccccctcatgcccaaccaggga

SEQ ID NO: 77464 - DNA, 36 bp, Artificial Sequence
  Synthetic oligonucleotide
tatgcgggtggtcagttgggaggggggaatggggga

SEQ ID NO: 77465 - DNA, 37 bp, Artificial Sequence
  Synthetic oligonucleotide
tacctgcctagggctctccattcgttaactctctgga

SEQ ID NO: 77466 - DNA, 37 bp, Artificial Sequence
  Synthetic oligonucleotide
tgaacactatctgccgatgcccatatcttccgttgga

SEQ ID NO: 77467 - DNA, 38 bp, Artificial Sequence
  Synthetic oligonucleotide
aacgtgaaacagcagtcacccactcgtcgacaacatga

SEQ ID NO: 77468 - DNA, 38 bp, Artificial Sequence
  Synthetic oligonucleotide
ttgccagggtccgtgcattacctggccctcttccatga

SEQ ID NO: 77469 - DNA, 38 bp, Artificial Sequence
  Synthetic oligonucleotide
tacgaggggcgaagcaagcggggaacggacatggatga

SEQ ID NO: 77470 - DNA, 38 bp, Artificial Sequence
  Synthetic oligonucleotide
tcacgtccgaaacatacatctgagcccgccttcactga

SEQ ID NO: 77471 - DNA, 38 bp, Artificial Sequence
  Synthetic oligonucleotide
tcgatcgtcgatcctattaatttttgctcgcttcctga

SEQ ID NO: 77472 - DNA, 38 bp, Artificial Sequence
  Synthetic oligonucleotide
atccatcacatggttgttttagtgccttgcgccgctga

SEQ ID NO: 77473 - DNA, 38 bp, Artificial Sequence
  Synthetic oligonucleotide
gtgcccccattatgactagtcccttctcgtctttctga

SEQ ID NO: 77474 - DNA, 38 bp, Artificial Sequence
  Synthetic oligonucleotide
acctgctgggcacatccctccaagcaccgatttagtga

SEQ ID NO: 77475 - DNA, 38 bp, Artificial Sequence
  Synthetic oligonucleotide
tcaggtgccacgtaatgcgctcatcatgtcatccgtga

SEQ ID NO: 77476 - DNA, 38 bp, Artificial Sequence
  Synthetic oligonucleotide
tgccgcccaccattcaccacggcatcacgttcttgtga

SEQ ID NO: 77477 - DNA, 38 bp, Artificial Sequence
  Synthetic oligonucleotide
gggactctgtccttgcccgaacctagtagccaccttga

SEQ ID NO: 77478 - DNA, 37 bp, Artificial Sequence
  Synthetic oligonucleotide
ttccacgaccagcttgagctaaataccaactccttga

SEQ ID NO: 77479 - DNA, 37 bp, Artificial Sequence
  Synthetic oligonucleotide
taaacgcgacagcggacttttattctcaccctgttga

SEQ ID NO: 77480 - DNA, 36 bp, Artificial Sequence
  Synthetic oligonucleotide
aaccccatgcgatgacgacgctgactctcttgaata

SEQ ID NO: 77481 - DNA, 35 bp, Artificial Sequence
  Synthetic oligonucleotide
ttgtacccactccaaatgaatacgatcctcggata

SEQ ID NO: 77482 - DNA, 36 bp, Artificial Sequence
  Synthetic oligonucleotide
gtgacacgggcactggtaagtaccgtgtaagatata

SEQ ID NO: 77483 - DNA, 36 bp, Artificial Sequence
  Synthetic oligonucleotide
gtacgcccggcgaaagtcactggaagaattgggcta

SEQ ID NO: 77484 - DNA, 35 bp, Artificial Sequence
  Synthetic oligonucleotide
gcctacgcactcttcgcgggcccagtattcctcta

SEQ ID NO: 77485 - DNA, 36 bp, Artificial Sequence
  Synthetic oligonucleotide
atccgcccctcgagttcttgccgaatgtgcctatta

SEQ ID NO: 77486 - DNA, 36 bp, Artificial Sequence
  Synthetic oligonucleotide
gtcaccgccggcataccttgcaggggctcttcctta

SEQ ID NO: 77487 - DNA, 36 bp, Artificial Sequence
  Synthetic oligonucleotide
acccacacacttcatagttaatcacatgttcgctta

SEQ ID NO: 77488 - DNA, 35 bp, Artificial Sequence
  Synthetic oligonucleotide
gagcctacctcgtatgtgcccacgcgagcctctta

SEQ ID NO: 77489 - DNA, 35 bp, Artificial Sequence
  Synthetic oligonucleotide
tagcccaatgtcccgaaattcactcggctttcaac

SEQ ID NO: 77490 - DNA, 35 bp, Artificial Sequence
  Synthetic oligonucleotide
taaccgataggaaagggagtagggcggtgcgtaac

SEQ ID NO: 77491 - DNA, 35 bp, Artificial Sequence
  Synthetic oligonucleotide
gggagaaacccccgacaccaggccacatataccac

SEQ ID NO: 77492 - DNA, 35 bp, Artificial Sequence
  Synthetic oligonucleotide
agacaagctgaatttctgttctccatcgttgccac

SEQ ID NO: 77493 - DNA, 37 bp, Artificial Sequence
  Synthetic oligonucleotide
gctacccacacatgtcccttcctaatctcatttggac

SEQ ID NO: 77494 - DNA, 34 bp, Artificial Sequence
  Synthetic oligonucleotide
gttcctgccgcagctctcctagtcttcaagttac

SEQ ID NO: 77495 - DNA, 35 bp, Artificial Sequence
  Synthetic oligonucleotide
gtataccctagcctgaagccacgtgactgccaccc

SEQ ID NO: 77496 - DNA, 35 bp, Artificial Sequence
  Synthetic oligonucleotide
gtctaccactgccttggggattcactggcataccc

SEQ ID NO: 77497 - DNA, 35 bp, Artificial Sequence
  Synthetic oligonucleotide
gaactggaagcgcctctcatgttttggctgccccc

SEQ ID NO: 77498 - DNA, 35 bp, Artificial Sequence
  Synthetic oligonucleotide
acgctgcacgccctaaaaccgcagtaaccatggcc

SEQ ID NO: 77499 - DNA, 35 bp, Artificial Sequence
  Synthetic oligonucleotide
aaggtgctgcgaccacctacgtccccgcactttcc

SEQ ID NO: 77500 - DNA, 35 bp, Artificial Sequence
  Synthetic oligonucleotide
attggcgtgcacttcactttaaagcctgttcccgc

SEQ ID NO: 77501 - DNA, 35 bp, Artificial Sequence
  Synthetic oligonucleotide
gcacatgaacctgcagtcccgtcgtacctatccgc

SEQ ID NO: 77502 - DNA, 35 bp, Artificial Sequence
  Synthetic oligonucleotide
gttgcacagccccagttgttcacctctacccatgc

SEQ ID NO: 77503 - DNA, 35 bp, Artificial Sequence
  Synthetic oligonucleotide
tccatgtgtcacgccttgccagatcgatgcgcatc

SEQ ID NO: 77504 - DNA, 35 bp, Artificial Sequence
  Synthetic oligonucleotide
gtgggcgtaagtgtcctattgctcctggctcgatc

SEQ ID NO: 77505 - DNA, 36 bp, Artificial Sequence
  Synthetic oligonucleotide
tacgacgcaagtttacgagggtaagtgtggaggatc

SEQ ID NO: 77506 - DNA, 35 bp, Artificial Sequence
  Synthetic oligonucleotide
atcaccccctaggtcacttatatttgctcaggctc

SEQ ID NO: 77507 - DNA, 35 bp, Artificial Sequence
  Synthetic oligonucleotide
cagggcgtttaaccgtaagccgctggtgtccattc

SEQ ID NO: 77508 - DNA, 35 bp, Artificial Sequence
  Synthetic oligonucleotide
tctgcgctagactagcatcttgcctttttccgttc

SEQ ID NO: 77509 - DNA, 35 bp, Artificial Sequence
  Synthetic oligonucleotide
gtgccctcccttcagtccctccgcttctaggtcag

SEQ ID NO: 77510 - DNA, 35 bp, Artificial Sequence
  Synthetic oligonucleotide
gcttccgctacaccgtctttcactgccattgttcg

SEQ ID NO: 77511 - DNA, 35 bp, Artificial Sequence
  Synthetic oligonucleotide
gaataacacgggcatggaaattgaagagacggagg

SEQ ID NO: 77512 - DNA, 35 bp, Artificial Sequence
  Synthetic oligonucleotide
gttctcatccccattgtctccgcctaaaagcccgg

SEQ ID NO: 77513 - DNA, 35 bp, Artificial Sequence
  Synthetic oligonucleotide
gtgtgactgcaaggatgaacaatgtaagaaaaggg

SEQ ID NO: 77514 - DNA, 34 bp, Artificial Sequence
  Synthetic oligonucleotide
gagtgctgcaatcctttagcgccttggatacggg

SEQ ID NO: 77515 - DNA, 35 bp, Artificial Sequence
  Synthetic oligonucleotide
atgccacctttcatgcaggatagtgctacttcttg

SEQ ID NO: 77516 - DNA, 35 bp, Artificial Sequence
  Synthetic oligonucleotide
tgtgccaccgtctaccatcgctcatgacaacgcat

SEQ ID NO: 77517 - DNA, 34 bp, Artificial Sequence
  Synthetic oligonucleotide
gatcctactcctatggctctacaatcctgacgat

SEQ ID NO: 77518 - DNA, 35 bp, Artificial Sequence
  Synthetic oligonucleotide
gcacaggagaccgtcctgccactctaccttacgat

SEQ ID NO: 77519 - DNA, 35 bp, Artificial Sequence
  Synthetic oligonucleotide
gacgtgtcaccccttttagtcacgtcagaacccct

SEQ ID NO: 77520 - DNA, 35 bp, Artificial Sequence
  Synthetic oligonucleotide
acaccactagccacgagccagaacattttgcgcct

SEQ ID NO: 77521 - DNA, 35 bp, Artificial Sequence
  Synthetic oligonucleotide
aaagcgcgtagttgtcctctcttttattcgtgcct

SEQ ID NO: 77522 - DNA, 35 bp, Artificial Sequence
  Synthetic oligonucleotide
atgcccaccacccatattcttacaactggagtcct

SEQ ID NO: 77523 - DNA, 35 bp, Artificial Sequence
  Synthetic oligonucleotide
ggacccaggtacaatgccaccccacctaactctct

SEQ ID NO: 77524 - DNA, 35 bp, Artificial Sequence
  Synthetic oligonucleotide
ggacacaatctcagctccaacttccccaagcacgt

SEQ ID NO: 77525 - DNA, 35 bp, Artificial Sequence
  Synthetic oligonucleotide
gaacagtcatcgtacatggttttgttgccttatgt

SEQ ID NO: 77526 - DNA, 36 bp, Artificial Sequence
  Synthetic oligonucleotide
atgtcgcaacaacatcgataatacagtcgaccttgt

SEQ ID NO: 77527 - DNA, 35 bp, Artificial Sequence
  Synthetic oligonucleotide
ttgaactgacccgctgtctcctcgatccgcaaatt

SEQ ID NO: 77528 - DNA, 35 bp, Artificial Sequence
  Synthetic oligonucleotide
gaaccgacgtacgcgacgagactaagacaggcatt

SEQ ID NO: 77529 - DNA, 36 bp, Artificial Sequence
  Synthetic oligonucleotide
tgcacaaccgcctgacttaatgtaatttcgaaaaaa

SEQ ID NO: 77530 - DNA, 36 bp, Artificial Sequence
  Synthetic oligonucleotide
ttcagctgagtagcttcccgaggccctgatactaaa

SEQ ID NO: 77531 - DNA, 36 bp, Artificial Sequence
  Synthetic oligonucleotide
gtagtgaggaaatatatggtggactgggaaggggaa

SEQ ID NO: 77532 - DNA, 36 bp, Artificial Sequence
  Synthetic oligonucleotide
gccacaccatccgccttcgtgcgaaatccagcataa

SEQ ID NO: 77533 - DNA, 36 bp, Artificial Sequence
  Synthetic oligonucleotide
gtaacccttatgctgcttaaccggcccctgataaca

SEQ ID NO: 77534 - DNA, 36 bp, Artificial Sequence
  Synthetic oligonucleotide
acacaatcgccatgccgtcgtcgtcctgttattaca

SEQ ID NO: 77535 - DNA, 36 bp, Artificial Sequence
  Synthetic oligonucleotide
taaccactagcgtgcgggatcactagctccactcca

SEQ ID NO: 77536 - DNA, 36 bp, Artificial Sequence
  Synthetic oligonucleotide
atcttcatccctgcagccataacacactgcgcggca

SEQ ID NO: 77537 - DNA, 36 bp, Artificial Sequence
  Synthetic oligonucleotide
tgcgcagatttcctggcctcccctccgtcgcgggca

SEQ ID NO: 77538 - DNA, 36 bp, Artificial Sequence
  Synthetic oligonucleotide
gcgcctcggtcgccatctatccatcgtaatcatgca

SEQ ID NO: 77539 - DNA, 36 bp, Artificial Sequence
  Synthetic oligonucleotide
acattcccgcagggatataacacccaccgccgatca

SEQ ID NO: 77540 - DNA, 36 bp, Artificial Sequence
  Synthetic oligonucleotide
atgttccagccacctttatgcaacgatacactcaga

SEQ ID NO: 77541 - DNA, 37 bp, Artificial Sequence
  Synthetic oligonucleotide
gccgaagatagagtcgagaggacatgtctgaacgaga

SEQ ID NO: 77542 - DNA, 37 bp, Artificial Sequence
  Synthetic oligonucleotide
tgacgcgaggagcagagtagtaggggataggaggaga

SEQ ID NO: 77543 - DNA, 37 bp, Artificial Sequence
  Synthetic oligonucleotide
gtacgtatgaagggaaatggcacagtatgttgtgaga

SEQ ID NO: 77544 - DNA, 37 bp, Artificial Sequence
  Synthetic oligonucleotide
acactcgcaattgcccggccatcgtcttagctcacga

SEQ ID NO: 77545 - DNA, 35 bp, Artificial Sequence
  Synthetic oligonucleotide
gcaacactgcgccatccacgctaattctgagacga

SEQ ID NO: 77546 - DNA, 37 bp, Artificial Sequence
  Synthetic oligonucleotide
gagtgcgagatagaaaaagcttaaaggggcgcgacga

SEQ ID NO: 77547 - DNA, 37 bp, Artificial Sequence
  Synthetic oligonucleotide
taagtctagcgccccagccctcgcctaccatggacga

SEQ ID NO: 77548 - DNA, 37 bp, Artificial Sequence
  Synthetic oligonucleotide
tctcgaccgcatagccgaattgcgcgctgactaccga

SEQ ID NO: 77549 - DNA, 35 bp, Artificial Sequence
  Synthetic oligonucleotide
ttcaacaatgcattcacctgaggctaacaagccga

SEQ ID NO: 77550 - DNA, 37 bp, Artificial Sequence
  Synthetic oligonucleotide
gcgctcgcgtgctccccgcgtaattgtttctctccga

SEQ ID NO: 77551 - DNA, 38 bp, Artificial Sequence
  Synthetic oligonucleotide
tcgaatagaggaggaatgaccaagggcgggaagggcga

SEQ ID NO: 77552 - DNA, 37 bp, Artificial Sequence
  Synthetic oligonucleotide
gtgtcgcaaaaattgcgctgtgatcccttcctatcga

SEQ ID NO: 77553 - DNA, 37 bp, Artificial Sequence
  Synthetic oligonucleotide
gtcgacacgtcattagcgcctctctctactttatcga

SEQ ID NO: 77554 - DNA, 37 bp, Artificial Sequence
  Synthetic oligonucleotide
gtggtcggctctatccggcgtcctctttcctcccgga

SEQ ID NO: 77555 - DNA, 37 bp, Artificial Sequence
  Synthetic oligonucleotide
tgtctgggggggaaaagggtaggcccggggctaggga

SEQ ID NO: 77556 - DNA, 36 bp, Artificial Sequence
  Synthetic oligonucleotide
acgctcctcccgtgcaattctccctcatgagatgga

SEQ ID NO: 77557 - DNA, 37 bp, Artificial Sequence
  Synthetic oligonucleotide
atagttatcgcccctgttcccctgccactagtatgga

SEQ ID NO: 77558 - DNA, 37 bp, Artificial Sequence
  Synthetic oligonucleotide
gccatgcgcacgatatatccatagctcgcccgctgga

SEQ ID NO: 77559 - DNA, 37 bp, Artificial Sequence
  Synthetic oligonucleotide
agtgccacatcacacggatacacgatccacctctgga

SEQ ID NO: 77560 - DNA, 37 bp, Artificial Sequence
  Synthetic oligonucleotide
gcaggagcacgaggcgcatttgaaaggtgaggttgga

SEQ ID NO: 77561 - DNA, 37 bp, Artificial Sequence
  Synthetic oligonucleotide
gtacagcacgtgggggggtgcaaaactgacggttgga

SEQ ID NO: 77562 - DNA, 38 bp, Artificial Sequence
  Synthetic oligonucleotide
tccctccttcttgtaccatctgctgagcctgtcgatga

SEQ ID NO: 77563 - DNA, 38 bp, Artificial Sequence
  Synthetic oligonucleotide
ttagcgagcaccgtatgtatcgtctcgcacctctatga

SEQ ID NO: 77564 - DNA, 38 bp, Artificial Sequence
  Synthetic oligonucleotide
gctgcactcaggtgagctaactttccctccttgtatga

SEQ ID NO: 77565 - DNA, 37 bp, Artificial Sequence
  Synthetic oligonucleotide
ggggacgcaccagtttttgaaattcgaacctcactga

SEQ ID NO: 77566 - DNA, 38 bp, Artificial Sequence
  Synthetic oligonucleotide
ttccacagcatcccagcttcatcctttgtggaccctga

SEQ ID NO: 77567 - DNA, 35 bp, Artificial Sequence
  Synthetic oligonucleotide
gttcaccctgacgcctatactaccccggtagctga

SEQ ID NO: 77568 - DNA, 38 bp, Artificial Sequence
  Synthetic oligonucleotide
atcgcatgcacctaatgggcctggttctttttatctga

SEQ ID NO: 77569 - DNA, 38 bp, Artificial Sequence
  Synthetic oligonucleotide
gccacacgcccctgaaaatatggttgaactatacgtga

SEQ ID NO: 77570 - DNA, 38 bp, Artificial Sequence
  Synthetic oligonucleotide
tcaagccgtcgcttgaacaagcctctccatttccgtga

SEQ ID NO: 77571 - DNA, 36 bp, Artificial Sequence
  Synthetic oligonucleotide
ttgggcggtggtggacggctaaatgtcagggcgtga

SEQ ID NO: 77572 - DNA, 38 bp, Artificial Sequence
  Synthetic oligonucleotide
accgctgacagttgcgcacaatcgtgtccgcttggtga

SEQ ID NO: 77573 - DNA, 38 bp, Artificial Sequence
  Synthetic oligonucleotide
ttggactagcctctaaccctacaaccccagtcttgtga

SEQ ID NO: 77574 - DNA, 37 bp, Artificial Sequence
  Synthetic oligonucleotide
tacagaccactgtgtgccgtggcgcacccctttgtga

SEQ ID NO: 77575 - DNA, 38 bp, Artificial Sequence
  Synthetic oligonucleotide
tccgaaccgcgcgtcttagcgaaatgccctctttgtga

SEQ ID NO: 77576 - DNA, 38 bp, Artificial Sequence
  Synthetic oligonucleotide
aagggacaatgggggtaaaagggatagtgggctattga

SEQ ID NO: 77577 - DNA, 37 bp, Artificial Sequence
  Synthetic oligonucleotide
gtcccgtgagccgtgcttatcctctactatcacttga

SEQ ID NO: 77578 - DNA, 37 bp, Artificial Sequence
  Synthetic oligonucleotide
gctcaggcagtccctcgctgtgccgctctcaccttga

SEQ ID NO: 77579 - DNA, 36 bp, Artificial Sequence
  Synthetic oligonucleotide
aaatcattctccgcttgcatagcgatacatccttga

SEQ ID NO: 77580 - DNA, 38 bp, Artificial Sequence
  Synthetic oligonucleotide
gtaaagcgcatctgtccgtacgcccgatttctccttga

SEQ ID NO: 77581 - DNA, 37 bp, Artificial Sequence
  Synthetic oligonucleotide
gttggcccttctttgcatacagcactcctaatcttga

SEQ ID NO: 77582 - DNA, 38 bp, Artificial Sequence
  Synthetic oligonucleotide
acggtggagaggatacgtgggggtgatggacgtcttga

SEQ ID NO: 77583 - DNA, 38 bp, Artificial Sequence
  Synthetic oligonucleotide
tcaaccagccgaccgggattatacgcgcacaccgttga

SEQ ID NO: 77584 - DNA, 38 bp, Artificial Sequence
  Synthetic oligonucleotide
acgttgatactgccgcgaaaagcggacctcacatttga

SEQ ID NO: 77585 - DNA, 38 bp, Artificial Sequence
  Synthetic oligonucleotide
gttcgccctacgttatttgtctgcacacacccatttga

SEQ ID NO: 77586 - DNA, 37 bp, Artificial Sequence
  Synthetic oligonucleotide
gtagactcgggttcagtggccgcacccttcactttga

SEQ ID NO: 77587 - DNA, 38 bp, Artificial Sequence
  Synthetic oligonucleotide
agagtggagggatagggtgtgggcatgggtccgtttga

SEQ ID NO: 77588 - DNA, 38 bp, Artificial Sequence
  Synthetic oligonucleotide
tccagggtgtatgatctacatttgctgcccctttttga

SEQ ID NO: 77589 - DNA, 36 bp, Artificial Sequence
  Synthetic oligonucleotide
acgcgtgtcacgcctgctttgtactactctctaata

SEQ ID NO: 77590 - DNA, 35 bp, Artificial Sequence
  Synthetic oligonucleotide
tgcaaagccctcccgacgccaactcgctatcgata

SEQ ID NO: 77591 - DNA, 35 bp, Artificial Sequence
  Synthetic oligonucleotide
acacctgcacatcgactataacaggcttgcatata

SEQ ID NO: 77592 - DNA, 36 bp, Artificial Sequence
  Synthetic oligonucleotide
tctagacacacgacctcaagctttgagctagaccta

SEQ ID NO: 77593 - DNA, 38 bp, Artificial Sequence
  Synthetic oligonucleotide
tgacctcccccattcccgcctccggtgcagtaacatta

SEQ ID NO: 77594 - DNA, 36 bp, Artificial Sequence
  Synthetic oligonucleotide
gttgcacgctcggggtctacttcttcactatgctta

SEQ ID NO: 77595 - DNA, 35 bp, Artificial Sequence
  Synthetic oligonucleotide
gccccgatagtgagaaatgcacggagagggagtta

SEQ ID NO: 77596 - DNA, 36 bp, Artificial Sequence
  Synthetic oligonucleotide
ggttagcctcgaaggggttcgtctattccatcttta

SEQ ID NO: 77597 - DNA, 35 bp, Artificial Sequence
  Synthetic oligonucleotide
atgaatcacacgaggtgatctctcgagttctaaac

SEQ ID NO: 77598 - DNA, 35 bp, Artificial Sequence
  Synthetic oligonucleotide
atgcccgtcccttaccatccgggagtagttccaac

SEQ ID NO: 77599 - DNA, 35 bp, Artificial Sequence
  Synthetic oligonucleotide
tgaccattgccccccttatgtttgacgtactgcac

SEQ ID NO: 77600 - DNA, 35 bp, Artificial Sequence
  Synthetic oligonucleotide
aacgttgctcagccgttcctttctcggctcttgac

SEQ ID NO: 77601 - DNA, 35 bp, Artificial Sequence
  Synthetic oligonucleotide
gccaacggcatttggtgacttctctctttctctac

SEQ ID NO: 77602 - DNA, 35 bp, Artificial Sequence
  Synthetic oligonucleotide
agtcgtcatcctctacttgcaatgcacacgtttac

SEQ ID NO: 77603 - DNA, 35 bp, Artificial Sequence
  Synthetic oligonucleotide
gatcgacgcctccactgtcccagtcgctgtgcacc

SEQ ID NO: 77604 - DNA, 35 bp, Artificial Sequence
  Synthetic oligonucleotide
taacgtttgcgaagtagctctatcactgcccgccc

SEQ ID NO: 77605 - DNA, 35 bp, Artificial Sequence
  Synthetic oligonucleotide
gtgcattgaaacccggaatgccatagcactctccc

SEQ ID NO: 77606 - DNA, 35 bp, Artificial Sequence
  Synthetic oligonucleotide
taaccgatgccacaatggtcgatcgccgtagtccc

SEQ ID NO: 77607 - DNA, 34 bp, Artificial Sequence
  Synthetic oligonucleotide
gtgcactgctagcccttgctgtatcggcatatcc

SEQ ID NO: 77608 - DNA, 35 bp, Artificial Sequence
  Synthetic oligonucleotide
tactgtcggcaccctattccgttcgccactattcc

SEQ ID NO: 77609 - DNA, 35 bp, Artificial Sequence
  Synthetic oligonucleotide
tgtcccgcacttcgcccttgtgacaccctgcccgc

SEQ ID NO: 77610 - DNA, 35 bp, Artificial Sequence
  Synthetic oligonucleotide
gtgcctcccctatagctgtttgtcctcacttgcgc

SEQ ID NO: 77611 - DNA, 35 bp, Artificial Sequence
  Synthetic oligonucleotide
gatacctaagtgggctacttatgcgccttgtcctc

SEQ ID NO: 77612 - DNA, 35 bp, Artificial Sequence
  Synthetic oligonucleotide
gctgaactgcggggaaaagtggcagtaagcaagtc

SEQ ID NO: 77613 - DNA, 35 bp, Artificial Sequence
  Synthetic oligonucleotide
gctgccacccacccgcgctgtactgacttgatgtc

SEQ ID NO: 77614 - DNA, 35 bp, Artificial Sequence
  Synthetic oligonucleotide
ttgcatgccctccccacatcatcggttcatttgtc

SEQ ID NO: 77615 - DNA, 35 bp, Artificial Sequence
  Synthetic oligonucleotide
ggtgccagtcatcccggtgccacctcattaccttc

SEQ ID NO: 77616 - DNA, 35 bp, Artificial Sequence
  Synthetic oligonucleotide
agatgcacccgtatgaaccccgtgcccaatttttc

SEQ ID NO: 77617 - DNA, 35 bp, Artificial Sequence
  Synthetic oligonucleotide
gacatcggagggcagaagctaatctaagggtaaag

SEQ ID NO: 77618 - DNA, 35 bp, Artificial Sequence
  Synthetic oligonucleotide
accttacgccaccacccaccgtcacccctgttgag

SEQ ID NO: 77619 - DNA, 35 bp, Artificial Sequence
  Synthetic oligonucleotide
taacgctgtgatcgcgctttgcttttcatcctccg

SEQ ID NO: 77620 - DNA, 34 bp, Artificial Sequence
  Synthetic oligonucleotide
gcgatagcacgaaaatggaccattaggtttgtcg

SEQ ID NO: 77621 - DNA, 35 bp, Artificial Sequence
  Synthetic oligonucleotide
agttgatggacggagggaagagatggacgtacagg

SEQ ID NO: 77622 - DNA, 35 bp, Artificial Sequence
  Synthetic oligonucleotide
tatgcgaagtggcgagggagcgtaagtcctggagg

SEQ ID NO: 77623 - DNA, 35 bp, Artificial Sequence
  Synthetic oligonucleotide
gtaagcgcagtaatcgcctcttccgtttgcttcgg

SEQ ID NO: 77624 - DNA, 35 bp, Artificial Sequence
  Synthetic oligonucleotide
tgttcaatcggccacccaccttgcgcttttatggg

SEQ ID NO: 77625 - DNA, 35 bp, Artificial Sequence
  Synthetic oligonucleotide
ttgagaggctggaaagcgggaatactgggactggg

SEQ ID NO: 77626 - DNA, 35 bp, Artificial Sequence
  Synthetic oligonucleotide
gacagtagcctatacagggagatccaggagaatgg

SEQ ID NO: 77627 - DNA, 35 bp, Artificial Sequence
  Synthetic oligonucleotide
tacgactggaatgcagcctgggaaagaactgatgg

SEQ ID NO: 77628 - DNA, 35 bp, Artificial Sequence
  Synthetic oligonucleotide
gaacaggcgaacaatcctgtcagttaaataccctg

SEQ ID NO: 77629 - DNA, 35 bp, Artificial Sequence
  Synthetic oligonucleotide
ttacaacgcatgtgaacaagaacagggggagggtg

SEQ ID NO: 77630 - DNA, 35 bp, Artificial Sequence
  Synthetic oligonucleotide
gtgctgcaggtcgtttttttcctttgggtcccttg

SEQ ID NO: 77631 - DNA, 35 bp, Artificial Sequence
  Synthetic oligonucleotide
ttttcccaccgcacaattgcattagggcactgttg

SEQ ID NO: 77632 - DNA, 35 bp, Artificial Sequence
  Synthetic oligonucleotide
gttgacccatccgaggactcctgatttcggtaaat

SEQ ID NO: 77633 - DNA, 32 bp, Artificial Sequence
  Synthetic oligonucleotide
gactggccccctatctcactttctgaacacat

SEQ ID NO: 77634 - DNA, 35 bp, Artificial Sequence
  Synthetic oligonucleotide
atgaataccccaactggcatacgccttcctgctat

SEQ ID NO: 77635 - DNA, 35 bp, Artificial Sequence
  Synthetic oligonucleotide
agctccaacccccctcgctcgtgctattgcggact

SEQ ID NO: 77636 - DNA, 34 bp, Artificial Sequence
  Synthetic oligonucleotide
gtagtgcaagcgactgtagctcactttctaccct

SEQ ID NO: 77637 - DNA, 35 bp, Artificial Sequence
  Synthetic oligonucleotide
gcacatccctgctggaatatcgtaccatctatcct

SEQ ID NO: 77638 - DNA, 35 bp, Artificial Sequence
  Synthetic oligonucleotide
gtgaccggggaacggaatgaactgaggtggttgct

SEQ ID NO: 77639 - DNA, 36 bp, Artificial Sequence
  Synthetic oligonucleotide
atctgaatcgagctggcgattcccttcacattatct

SEQ ID NO: 77640 - DNA, 35 bp, Artificial Sequence
  Synthetic oligonucleotide
aatcccttccagcgtggaccctaccgagtgattct

SEQ ID NO: 77641 - DNA, 35 bp, Artificial Sequence
  Synthetic oligonucleotide
gacgccctcacacgttgtcgcacgttccgcacagt

SEQ ID NO: 77642 - DNA, 35 bp, Artificial Sequence
  Synthetic oligonucleotide
ttcgtgcatatcattctgctcccggtttaatcctt

SEQ ID NO: 77643 - DNA, 35 bp, Artificial Sequence
  Synthetic oligonucleotide
gaccaccctcacttgtttaaatgttcacggagctt

SEQ ID NO: 77644 - DNA, 35 bp, Artificial Sequence
  Synthetic oligonucleotide
atcgtgttccgcatttcgttctattgatctaggtt

SEQ ID NO: 77645 - DNA, 35 bp, Artificial Sequence
  Synthetic oligonucleotide
accgtccctccagaagccgtagttcatcgatattt

SEQ ID NO: 77646 - DNA, 35 bp, Artificial Sequence
  Synthetic oligonucleotide
tcagacggggtaggtcatagtcttgtttggggttt

SEQ ID NO: 77647 - DNA, 36 bp, Artificial Sequence
  Synthetic oligonucleotide
gcatgtacgccctctgatccccggctctcttgaaaa

SEQ ID NO: 77648 - DNA, 36 bp, Artificial Sequence
  Synthetic oligonucleotide
gagtcgcccgggcctttcgtgatcaccttgctcaaa

SEQ ID NO: 77649 - DNA, 35 bp, Artificial Sequence
  Synthetic oligonucleotide
actgtgcggccggccaccatacacttcatttgaaa

SEQ ID NO: 77650 - DNA, 36 bp, Artificial Sequence
  Synthetic oligonucleotide
tccaaacccccacatctgcacggtttgttgcataaa

SEQ ID NO: 77651 - DNA, 35 bp, Artificial Sequence
  Synthetic oligonucleotide
aatataccatgcgccctccttgctcgttacctcaa

SEQ ID NO: 77652 - DNA, 35 bp, Artificial Sequence
  Synthetic oligonucleotide
gattccctcaccccctgcagttgtcgcagagagaa

SEQ ID NO: 77653 - DNA, 36 bp, Artificial Sequence
  Synthetic oligonucleotide
ttggaagctacaacgctacggaccgtccctggctaa

SEQ ID NO: 77654 - DNA, 36 bp, Artificial Sequence
  Synthetic oligonucleotide
gtgtgcaagtaagggatagggggagggactacgtaa

SEQ ID NO: 77655 - DNA, 35 bp, Artificial Sequence
  Synthetic oligonucleotide
gccgaccatccaatccccggtacgacgccgcttaa

SEQ ID NO: 77656 - DNA, 36 bp, Artificial Sequence
  Synthetic oligonucleotide
acaccccggacatcaactaaagggatcagtagaaca

SEQ ID NO: 77657 - DNA, 36 bp, Artificial Sequence
  Synthetic oligonucleotide
tatccccccgctctacgttacgtcaatcgctagaca

SEQ ID NO: 77658 - DNA, 36 bp, Artificial Sequence
  Synthetic oligonucleotide
gtaccaccaggtggtacgatgtagcaatcttgccca

SEQ ID NO: 77659 - DNA, 36 bp, Artificial Sequence
  Synthetic oligonucleotide
gtgctgccccgccgccgtctctcacataacatccca

SEQ ID NO: 77660 - DNA, 36 bp, Artificial Sequence
  Synthetic oligonucleotide
aaagcaatccatcagacctcgcatgcactgctatca

SEQ ID NO: 77661 - DNA, 36 bp, Artificial Sequence
  Synthetic oligonucleotide
gatcgcactccaacgcctcccgctatacgggactca

SEQ ID NO: 77662 - DNA, 36 bp, Artificial Sequence
  Synthetic oligonucleotide
atctcgcggctaattcatactcctacttggctctca

SEQ ID NO: 77663 - DNA, 36 bp, Artificial Sequence
  Synthetic oligonucleotide
gtgaaacgggcgatggcgttaccctgctcaccttca

SEQ ID NO: 77664 - DNA, 36 bp, Artificial Sequence
  Synthetic oligonucleotide
gaagcacagctttgagtatgccctgtcctactttca

SEQ ID NO: 77665 - DNA, 37 bp, Artificial Sequence
  Synthetic oligonucleotide
gaatgggatgtgacgggtagagacaagggaggcaaga

SEQ ID NO: 77666 - DNA, 37 bp, Artificial Sequence
  Synthetic oligonucleotide
gcgccagggagggctggggaaagcggcaaagaagaga

SEQ ID NO: 77667 - DNA, 37 bp, Artificial Sequence
  Synthetic oligonucleotide
atcgcccatcctaaccgaccttttcccggacacgaga

SEQ ID NO: 77668 - DNA, 37 bp, Artificial Sequence
  Synthetic oligonucleotide
gaaacaccacatcgtctatacctgatcccatgcgaga

SEQ ID NO: 77669 - DNA, 37 bp, Artificial Sequence
  Synthetic oligonucleotide
aaccggtacagcatgtctagtagggggctgggggaga

SEQ ID NO: 77670 - DNA, 36 bp, Artificial Sequence
  Synthetic oligonucleotide
gactaaaggctggagcgagcggggataggatggaga

SEQ ID NO: 77671 - DNA, 37 bp, Artificial Sequence
  Synthetic oligonucleotide
acccctgcacctggcgcgtgtccacccgtccctgaga

SEQ ID NO: 77672 - DNA, 37 bp, Artificial Sequence
  Synthetic oligonucleotide
acgcacgcgctcccgccatccgctttcaacgcaacga

SEQ ID NO: 77673 - DNA, 38 bp, Artificial Sequence
  Synthetic oligonucleotide
tgaccgcccacaactattgtacgttgccgttagtacga

SEQ ID NO: 77674 - DNA, 35 bp, Artificial Sequence
  Synthetic oligonucleotide
gtccgcagaattatttaccgcccacgctcttacga

SEQ ID NO: 77675 - DNA, 37 bp, Artificial Sequence
  Synthetic oligonucleotide
tccggaccttaccaccccacgtcaagatgcccaccga

SEQ ID NO: 77676 - DNA, 36 bp, Artificial Sequence
  Synthetic oligonucleotide
ttaagccaagtctcgctccatgccctgctgtcccga

SEQ ID NO: 77677 - DNA, 37 bp, Artificial Sequence
  Synthetic oligonucleotide
gctaagttaggggtcggggggaagaagggaaggtcga

SEQ ID NO: 77678 - DNA, 37 bp, Artificial Sequence
  Synthetic oligonucleotide
acatactcgcgccaccacgtatatttgccaccaagga

SEQ ID NO: 77679 - DNA, 37 bp, Artificial Sequence
  Synthetic oligonucleotide
gagaccgactgcctggacacgaggaaggaacggagga

SEQ ID NO: 77680 - DNA, 36 bp, Artificial Sequence
  Synthetic oligonucleotide
gttcacccagatggttagcatcttgtggggggagga

SEQ ID NO: 77681 - DNA, 37 bp, Artificial Sequence
  Synthetic oligonucleotide
ttgtgcaaaagctcacatcccccacgatacgttcgga

SEQ ID NO: 77682 - DNA, 36 bp, Artificial Sequence
  Synthetic oligonucleotide
aatggagtttaaggcgagggactgaggtggtaggga

SEQ ID NO: 77683 - DNA, 37 bp, Artificial Sequence
  Synthetic oligonucleotide
gttgcaggaagggaaaaaataattgtacgtggcggga

SEQ ID NO: 77684 - DNA, 37 bp, Artificial Sequence
  Synthetic oligonucleotide
ggggctgcatgcacgggcgggtacttcgcttagggga

SEQ ID NO: 77685 - DNA, 37 bp, Artificial Sequence
  Synthetic oligonucleotide
tctggtacagtatggcgggtgcgggagggatatggga

SEQ ID NO: 77686 - DNA, 36 bp, Artificial Sequence
  Synthetic oligonucleotide
gggggggggggggaatgggtctcaaggtgggatgga

SEQ ID NO: 77687 - DNA, 37 bp, Artificial Sequence
  Synthetic oligonucleotide
tcactggttgtagtgctctctctgttcccggtatgga

SEQ ID NO: 77688 - DNA, 36 bp, Artificial Sequence
  Synthetic oligonucleotide
ggtacgggaactgcggggggcaacaggttttatgga

SEQ ID NO: 77689 - DNA, 36 bp, Artificial Sequence
  Synthetic oligonucleotide
gctgtaggaggaatggaggctaactatggagctgga

SEQ ID NO: 77690 - DNA, 38 bp, Artificial Sequence
  Synthetic oligonucleotide
gccacgcccctccagaactcacagtttcttgtcactga

SEQ ID NO: 77691 - DNA, 38 bp, Artificial Sequence
  Synthetic oligonucleotide
gcacgtccgaacctcctgcactatacgtcccctactga

SEQ ID NO: 77692 - DNA, 38 bp, Artificial Sequence
  Synthetic oligonucleotide
ttggtcgtgagcctgctaaattgttttgtacctcctga

SEQ ID NO: 77693 - DNA, 38 bp, Artificial Sequence
  Synthetic oligonucleotide
tctgaaggcgctactcttctgctataatgctttcctga

SEQ ID NO: 77694 - DNA, 37 bp, Artificial Sequence
  Synthetic oligonucleotide
acactccccctgaagaagcaacacatgatcccgctga

SEQ ID NO: 77695 - DNA, 37 bp, Artificial Sequence
  Synthetic oligonucleotide
gtacgcctgccacgtttttgtaacccaggtttagtga

SEQ ID NO: 77696 - DNA, 36 bp, Artificial Sequence
  Synthetic oligonucleotide
aagaaggggccattgggtgtcggggtggattggtga

SEQ ID NO: 77697 - DNA, 38 bp, Artificial Sequence
  Synthetic oligonucleotide
agaaccccccgctggtccgcagactatctccttggtga

SEQ ID NO: 77698 - DNA, 38 bp, Artificial Sequence
  Synthetic oligonucleotide
taatacacgtcgatatcaccctcctatgccgcccttga

SEQ ID NO: 77699 - DNA, 38 bp, Artificial Sequence
  Synthetic oligonucleotide
gacagaagcacacggtcccatcgcctacatcagcttga

SEQ ID NO: 77700 - DNA, 38 bp, Artificial Sequence
  Synthetic oligonucleotide
gaactcggccatccgtatccaccgccctatttagttga

SEQ ID NO: 77701 - DNA, 36 bp, Artificial Sequence
  Synthetic oligonucleotide
tctctacccgacttttggttgcccactccactttga

SEQ ID NO: 77702 - DNA, 36 bp, Artificial Sequence
  Synthetic oligonucleotide
agtctggtacgggtggtagggaagatagagctaata

SEQ ID NO: 77703 - DNA, 35 bp, Artificial Sequence
  Synthetic oligonucleotide
gccgggagccttactctgtcacggcattttccata

SEQ ID NO: 77704 - DNA, 36 bp, Artificial Sequence
  Synthetic oligonucleotide
gggaagagagtgctgcgaaggagggggggtcgtata

SEQ ID NO: 77705 - DNA, 36 bp, Artificial Sequence
  Synthetic oligonucleotide
gcacgggcgcaggttgcaatctgcgttcgggcacta

SEQ ID NO: 77706 - DNA, 36 bp, Artificial Sequence
  Synthetic oligonucleotide
gaacctcagtgcatttgtttagcccgccgcttccta

SEQ ID NO: 77707 - DNA, 35 bp, Artificial Sequence
  Synthetic oligonucleotide
gtcgtacgcccggcctcagcccaaccgcactggta

SEQ ID NO: 77708 - DNA, 36 bp, Artificial Sequence
  Synthetic oligonucleotide
atgccccattgctgccaaccctcgatagctcctgta

SEQ ID NO: 77709 - DNA, 36 bp, Artificial Sequence
  Synthetic oligonucleotide
gtgggtctactgcagctgttttacctcaccattgta

SEQ ID NO: 77710 - DNA, 35 bp, Artificial Sequence
  Synthetic oligonucleotide
gactgcatacttcccatcgacacggttaatttgta

SEQ ID NO: 77711 - DNA, 37 bp, Artificial Sequence
  Synthetic oligonucleotide
gccgccaactcttctcttctgtactgtgccttggtta

SEQ ID NO: 77712 - DNA, 35 bp, Artificial Sequence
  Synthetic oligonucleotide
gatggagagcactgtcaagacgattaggctggaac

SEQ ID NO: 77713 - DNA, 35 bp, Artificial Sequence
  Synthetic oligonucleotide
gtcgggcacccgcggtgtgctctgacctaccaacc

SEQ ID NO: 77714 - DNA, 35 bp, Artificial Sequence
  Synthetic oligonucleotide
gggtccggtcaccagcgccggcaagcacacctacc

SEQ ID NO: 77715 - DNA, 35 bp, Artificial Sequence
  Synthetic oligonucleotide
aacactgttcgtaatgcaaacatccgtaataaccc

SEQ ID NO: 77716 - DNA, 35 bp, Artificial Sequence
  Synthetic oligonucleotide
gcccaccttaccctatgccgcttctcgggatagcc

SEQ ID NO: 77717 - DNA, 35 bp, Artificial Sequence
  Synthetic oligonucleotide
tgggcattccactacactgttattcgctttgggcc

SEQ ID NO: 77718 - DNA, 35 bp, Artificial Sequence
  Synthetic oligonucleotide
gccttgcccatatccaccctgctcaatgccgcagc

SEQ ID NO: 77719 - DNA, 35 bp, Artificial Sequence
  Synthetic oligonucleotide
tgcgcatactggtaagccataacattcctccatgc

SEQ ID NO: 77720 - DNA, 35 bp, Artificial Sequence
  Synthetic oligonucleotide
tccacgagacgtattcgaatttatgacttacctgc

SEQ ID NO: 77721 - DNA, 35 bp, Artificial Sequence
  Synthetic oligonucleotide
tcgctaggccattgccgcatctgttccataacatc

SEQ ID NO: 77722 - DNA, 35 bp, Artificial Sequence
  Synthetic oligonucleotide
gttgccccactcacatataccacagctcaatgatc

SEQ ID NO: 77723 - DNA, 34 bp, Artificial Sequence
  Synthetic oligonucleotide
ttgtgtagtcgcatttctatcttgctcggcgctc

SEQ ID NO: 77724 - DNA, 35 bp, Artificial Sequence
  Synthetic oligonucleotide
accgaaagctcctaccgatgcccttcgccagtctc

SEQ ID NO: 77725 - DNA, 35 bp, Artificial Sequence
  Synthetic oligonucleotide
attgccgccgcaactacgattcccggtgctgattc

SEQ ID NO: 77726 - DNA, 35 bp, Artificial Sequence
  Synthetic oligonucleotide
tcgatacctccccgcgcggaaacctcaccctcgag

SEQ ID NO: 77727 - DNA, 35 bp, Artificial Sequence
  Synthetic oligonucleotide
ttcacgggaactgtaaggggtataagggaggggag

SEQ ID NO: 77728 - DNA, 35 bp, Artificial Sequence
  Synthetic oligonucleotide
gaccacggttatgaatggccgcacgatcaacaacg

SEQ ID NO: 77729 - DNA, 35 bp, Artificial Sequence
  Synthetic oligonucleotide
tctgactaactacaccgacggcccttgacgacccg

SEQ ID NO: 77730 - DNA, 35 bp, Artificial Sequence
  Synthetic oligonucleotide
gggtgaacgcatccgtttctgctatggtccctccg

SEQ ID NO: 77731 - DNA, 35 bp, Artificial Sequence
  Synthetic oligonucleotide
tatcacccagcccacttatcaaaatctgccgcgcg

SEQ ID NO: 77732 - DNA, 35 bp, Artificial Sequence
  Synthetic oligonucleotide
atcgaggtgagtatggcaatggtggttagaatcgg

SEQ ID NO: 77733 - DNA, 35 bp, Artificial Sequence
  Synthetic oligonucleotide
atgtggagggggtgcatgaacctgggctgaacggg

SEQ ID NO: 77734 - DNA, 35 bp, Artificial Sequence
  Synthetic oligonucleotide
agtgatgtgggaggctcaggaagaaagaggtatgg

SEQ ID NO: 77735 - DNA, 36 bp, Artificial Sequence
  Synthetic oligonucleotide
aacatcccaaatgcgatttcatctttccgccggatg

SEQ ID NO: 77736 - DNA, 35 bp, Artificial Sequence
  Synthetic oligonucleotide
tttcctcccgctccatttgtttcgccttggttatg

SEQ ID NO: 77737 - DNA, 35 bp, Artificial Sequence
  Synthetic oligonucleotide
gaacgccaaacggggtgcggctctcaccctacctg

SEQ ID NO: 77738 - DNA, 35 bp, Artificial Sequence
  Synthetic oligonucleotide
gcgccgctgcctgattgtgccacctcaccattctg

SEQ ID NO: 77739 - DNA, 35 bp, Artificial Sequence
  Synthetic oligonucleotide
gcatgcatacggtacggagcaacgcccttgatttg

SEQ ID NO: 77740 - DNA, 35 bp, Artificial Sequence
  Synthetic oligonucleotide
gtgcggggccccttgcatgagcgctacatctacat

SEQ ID NO: 77741 - DNA, 35 bp, Artificial Sequence
  Synthetic oligonucleotide
gccatccccgccgtcgttttggacgtcttctgcat

SEQ ID NO: 77742 - DNA, 35 bp, Artificial Sequence
  Synthetic oligonucleotide
gcgagggtaggggtttcgcgccacggaaaaatcat

SEQ ID NO: 77743 - DNA, 35 bp, Artificial Sequence
  Synthetic oligonucleotide
tcccccactaccgagcccagttctgccccctagat

SEQ ID NO: 77744 - DNA, 35 bp, Artificial Sequence
  Synthetic oligonucleotide
gcaagggaccctccccacatcaattatcctctgat

SEQ ID NO: 77745 - DNA, 35 bp, Artificial Sequence
  Synthetic oligonucleotide
cacggactagccacccagcactcacaaaggaatat

SEQ ID NO: 77746 - DNA, 35 bp, Artificial Sequence
  Synthetic oligonucleotide
tcatcgcccccgtgattcatcctttgtgcatttat

SEQ ID NO: 77747 - DNA, 35 bp, Artificial Sequence
  Synthetic oligonucleotide
tcacgactatctcactgaacacacggcccctaact

SEQ ID NO: 77748 - DNA, 35 bp, Artificial Sequence
  Synthetic oligonucleotide
gtgggggggggataggaatgttcttggttgggact

SEQ ID NO: 77749 - DNA, 35 bp, Artificial Sequence
  Synthetic oligonucleotide
agatgccctactgtaggacccaaagcacccgtact

SEQ ID NO: 77750 - DNA, 35 bp, Artificial Sequence
  Synthetic oligonucleotide
gttgcccgcaggtacaactacaggttcttgttact

SEQ ID NO: 77751 - DNA, 35 bp, Artificial Sequence
  Synthetic oligonucleotide
gatgtaccactcataccatgttatcaacgtttact

SEQ ID NO: 77752 - DNA, 35 bp, Artificial Sequence
  Synthetic oligonucleotide
tgaattgcactcccggttcccgcttgttcgtgcct

SEQ ID NO: 77753 - DNA, 35 bp, Artificial Sequence
  Synthetic oligonucleotide
tgcgtaaccacacgcaaatcacctcgccggtatct

SEQ ID NO: 77754 - DNA, 35 bp, Artificial Sequence
  Synthetic oligonucleotide
actctgctcatggcgcatattccatggactcctct

SEQ ID NO: 77755 - DNA, 35 bp, Artificial Sequence
  Synthetic oligonucleotide
accgtgagtgcgctactgcttgggatggatggtct

SEQ ID NO: 77756 - DNA, 35 bp, Artificial Sequence
  Synthetic oligonucleotide
gtgcatacccgcttgcgccctttaggacattttct

SEQ ID NO: 77757 - DNA, 35 bp, Artificial Sequence
  Synthetic oligonucleotide
gtgacagtaacggggaggtgagtagatggttgagt

SEQ ID NO: 77758 - DNA, 35 bp, Artificial Sequence
  Synthetic oligonucleotide
gttggacgccgtcggagccgatacttatctctcgt

SEQ ID NO: 77759 - DNA, 35 bp, Artificial Sequence
  Synthetic oligonucleotide
tagagtatgaggagtgggagggggggcaccttcgt

SEQ ID NO: 77760 - DNA, 35 bp, Artificial Sequence
  Synthetic oligonucleotide
ttggaaggtggtcgggaaaggttgcttctgtgggt

SEQ ID NO: 77761 - DNA, 35 bp, Artificial Sequence
  Synthetic oligonucleotide
gccccctcggacacccataatacatcttacattgt

SEQ ID NO: 77762 - DNA, 35 bp, Artificial Sequence
  Synthetic oligonucleotide
tactgccgcaaatcttcgatgatgatctcccttgt

SEQ ID NO: 77763 - DNA, 35 bp, Artificial Sequence
  Synthetic oligonucleotide
tgttccttctctcacaccgacgatgctctgtttgt

SEQ ID NO: 77764 - DNA, 35 bp, Artificial Sequence
  Synthetic oligonucleotide
gcaacagacccgccgaccgtaagtgcccgcccatt

SEQ ID NO: 77765 - DNA, 35 bp, Artificial Sequence
  Synthetic oligonucleotide
gtgcctgggtccatccgttcacggcctgccctctt

SEQ ID NO: 77766 - DNA, 35 bp, Artificial Sequence
  Synthetic oligonucleotide
taatgtccctgcctagatccttccttctcatggtt

SEQ ID NO: 77767 - DNA, 35 bp, Artificial Sequence
  Synthetic oligonucleotide
tccgacgcccgtcctggtattccggtccaagtgtt

SEQ ID NO: 77768 - DNA, 35 bp, Artificial Sequence
  Synthetic oligonucleotide
acgttccactgagcggtcccgagccaatcgccttt

SEQ ID NO: 77769 - DNA, 35 bp, Artificial Sequence
  Synthetic oligonucleotide
gcctagtcttccatctggcaaccttctccttgttt

SEQ ID NO: 77770 - DNA, 34 bp, Artificial Sequence
  Synthetic oligonucleotide
tgagccaccgtggggatatcggggctcatgtttt

SEQ ID NO: 77771 - DNA, 35 bp, Artificial Sequence
  Synthetic oligonucleotide
gacatggcgctaacttgcaaatgccagtacttttt

SEQ ID NO: 77772 - DNA, 35 bp, Artificial Sequence
  Synthetic oligonucleotide
aatatgccccatccacgtcggtgacaattgaacaa

SEQ ID NO: 77773 - DNA, 36 bp, Artificial Sequence
  Synthetic oligonucleotide
gatagccatcaactggtcccaacatccccatgccaa

SEQ ID NO: 77774 - DNA, 35 bp, Artificial Sequence
  Synthetic oligonucleotide
gacgcccggtttggtagttgtccatgccttcgcaa

SEQ ID NO: 77775 - DNA, 36 bp, Artificial Sequence
  Synthetic oligonucleotide
ttacgcaccccgacctcaggcagagaagtctatcaa

SEQ ID NO: 77776 - DNA, 36 bp, Artificial Sequence
  Synthetic oligonucleotide
gaccgaaggtcgttgtggggggatatgatagctcaa

SEQ ID NO: 77777 - DNA, 36 bp, Artificial Sequence
  Synthetic oligonucleotide
tatcgcccatttccgaccaaagtattcgctttagaa

SEQ ID NO: 77778 - DNA, 35 bp, Artificial Sequence
  Synthetic oligonucleotide
actggtcacgccatgaactgttgtctccatccgaa

SEQ ID NO: 77779 - DNA, 35 bp, Artificial Sequence
  Synthetic oligonucleotide
taaggtcgccggagaaggtcggtagaaggggtgaa

SEQ ID NO: 77780 - DNA, 36 bp, Artificial Sequence
  Synthetic oligonucleotide
accacatgcgcgactcatcgaattaactatcgctaa

SEQ ID NO: 77781 - DNA, 36 bp, Artificial Sequence
  Synthetic oligonucleotide
gtgacggtagtatgtaacgtctgctaacttcgctaa

SEQ ID NO: 77782 - DNA, 35 bp, Artificial Sequence
  Synthetic oligonucleotide
tgcacgtgctcctgctgctagcatttcccaacaca

SEQ ID NO: 77783 - DNA, 35 bp, Artificial Sequence
  Synthetic oligonucleotide
gaactgggcaggtcttacgcgaggaaccacacaca

SEQ ID NO: 77784 - DNA, 36 bp, Artificial Sequence
  Synthetic oligonucleotide
ttccgaaaacggccaagtagcaaaacgccggacaca

SEQ ID NO: 77785 - DNA, 36 bp, Artificial Sequence
  Synthetic oligonucleotide
gaagcagaagaggcgatggagagtagacaatggaca

SEQ ID NO: 77786 - DNA, 36 bp, Artificial Sequence
  Synthetic oligonucleotide
tacagctggagcgcgtttcacttatccctaccacca

SEQ ID NO: 77787 - DNA, 36 bp, Artificial Sequence
  Synthetic oligonucleotide
gtggagcatagctaacctgtaattttgtctttacca

SEQ ID NO: 77788 - DNA, 36 bp, Artificial Sequence
  Synthetic oligonucleotide
gatacaccggacccacactggaacgcgcctttccca

SEQ ID NO: 77789 - DNA, 36 bp, Artificial Sequence
  Synthetic oligonucleotide
gaatgctgctagcaatgacgggaacaggggtggcca

SEQ ID NO: 77790 - DNA, 35 bp, Artificial Sequence
  Synthetic oligonucleotide
tgtcgattgccaggcgctgggcccaccgatctcca

SEQ ID NO: 77791 - DNA, 36 bp, Artificial Sequence
  Synthetic oligonucleotide
tgcacccttccggatcgggtccgtgatgcctttcca

SEQ ID NO: 77792 - DNA, 37 bp, Artificial Sequence
  Synthetic oligonucleotide
atcgacaccccttcattgatactccctctcactagca

SEQ ID NO: 77793 - DNA, 36 bp, Artificial Sequence
  Synthetic oligonucleotide
gtcaagaaaggggagatcgaggctagaagcagcgca

SEQ ID NO: 77794 - DNA, 35 bp, Artificial Sequence
  Synthetic oligonucleotide
tcccccacgtcatgaccatgcctccaggtggatca

SEQ ID NO: 77795 - DNA, 37 bp, Artificial Sequence
  Synthetic oligonucleotide
acacttccccacgttccaatgagcaccagacctaaga

SEQ ID NO: 77796 - DNA, 37 bp, Artificial Sequence
  Synthetic oligonucleotide
gagagttgtgggatgggagggaggcaggagatacaga

SEQ ID NO: 77797 - DNA, 37 bp, Artificial Sequence
  Synthetic oligonucleotide
ggatgtggcggaagggtgcagataagggcaaggcaga

SEQ ID NO: 77798 - DNA, 36 bp, Artificial Sequence
  Synthetic oligonucleotide
gacgaaagaggcacagggggagcgaatggacctaga

SEQ ID NO: 77799 - DNA, 37 bp, Artificial Sequence
  Synthetic oligonucleotide
gccactcaccttcggcctgataacctcaacagctaga

SEQ ID NO: 77800 - DNA, 36 bp, Artificial Sequence
  Synthetic oligonucleotide
gtggacaccaaccatagctcttaaacaacagaacga

SEQ ID NO: 77801 - DNA, 37 bp, Artificial Sequence
  Synthetic oligonucleotide
tctaccgtcacgtcgcgcggccctctgaatatcacga

SEQ ID NO: 77802 - DNA, 37 bp, Artificial Sequence
  Synthetic oligonucleotide
gtgggggcaaaggagtgacagggaggcaacaatacga

SEQ ID NO: 77803 - DNA, 37 bp, Artificial Sequence
  Synthetic oligonucleotide
tcatcgatccgtcacttcaccgctctgacttaaccga

SEQ ID NO: 77804 - DNA, 37 bp, Artificial Sequence
  Synthetic oligonucleotide
accgagctatggggccccccctccgtccattccccga

SEQ ID NO: 77805 - DNA, 34 bp, Artificial Sequence
  Synthetic oligonucleotide
ttcacggttcagcatacgttctttcattgcccga

SEQ ID NO: 77806 - DNA, 37 bp, Artificial Sequence
  Synthetic oligonucleotide
atacagcaagctgcgggttagggtggggaggatgcga

SEQ ID NO: 77807 - DNA, 36 bp, Artificial Sequence
  Synthetic oligonucleotide
aacctggccttccctcacgacacactgtgccgtcga

SEQ ID NO: 77808 - DNA, 36 bp, Artificial Sequence
  Synthetic oligonucleotide
tcacatacaagaacgggatgagagtccatgaaagga

SEQ ID NO: 77809 - DNA, 37 bp, Artificial Sequence
  Synthetic oligonucleotide
gtgccaaggtcactcatcgcattctaccagtgaagga

SEQ ID NO: 77810 - DNA, 37 bp, Artificial Sequence
  Synthetic oligonucleotide
gaagagggaaagatgccgggcggttactggggtagga

SEQ ID NO: 77811 - DNA, 37 bp, Artificial Sequence
  Synthetic oligonucleotide
gggaccagcctcgatcttcttaatcgcccaccacgga

SEQ ID NO: 77812 - DNA, 36 bp, Artificial Sequence
  Synthetic oligonucleotide
taaccaatgacgccggtgcggggatagcgataggga

SEQ ID NO: 77813 - DNA, 37 bp, Artificial Sequence
  Synthetic oligonucleotide
gccctggggtcagaggggcggtggagaaaaaggggga

SEQ ID NO: 77814 - DNA, 37 bp, Artificial Sequence
  Synthetic oligonucleotide
gcaagggttcggagaacaacgagggcgaaggttggga

SEQ ID NO: 77815 - DNA, 36 bp, Artificial Sequence
  Synthetic oligonucleotide
tgacgcaacgtggaagtgaaggcgggcgataatgga

SEQ ID NO: 77816 - DNA, 36 bp, Artificial Sequence
  Synthetic oligonucleotide
gctgcgagtaggcaagagggaggaatggctagtgga

SEQ ID NO: 77817 - DNA, 38 bp, Artificial Sequence
  Synthetic oligonucleotide
tcgagaggtaggggggtgggcgtagcggggataaatga

SEQ ID NO: 77818 - DNA, 38 bp, Artificial Sequence
  Synthetic oligonucleotide
gagagtggacggcggttgcagaagcatgtccactatga

SEQ ID NO: 77819 - DNA, 38 bp, Artificial Sequence
  Synthetic oligonucleotide
gcccctatgccggttctttcattgccgacaggttatga

SEQ ID NO: 77820 - DNA, 37 bp, Artificial Sequence
  Synthetic oligonucleotide
gtggagcatactatgcggggtgggatagaataactga

SEQ ID NO: 77821 - DNA, 37 bp, Artificial Sequence
  Synthetic oligonucleotide
accctacacatgcgtattgctttctgttctacactga

SEQ ID NO: 77822 - DNA, 36 bp, Artificial Sequence
  Synthetic oligonucleotide
tcacaccaccccccagcatggcctactcctcactga

SEQ ID NO: 77823 - DNA, 38 bp, Artificial Sequence
  Synthetic oligonucleotide
gacacatcccgcctacgacgaaatcaagatcaccctga

SEQ ID NO: 77824 - DNA, 37 bp, Artificial Sequence
  Synthetic oligonucleotide
acgtgggactcagcgatgttctgactaccgtgcctga

SEQ ID NO: 77825 - DNA, 37 bp, Artificial Sequence
  Synthetic oligonucleotide
gtaggtcaagcctacaaccctctctatttgatcctga

SEQ ID NO: 77826 - DNA, 38 bp, Artificial Sequence
  Synthetic oligonucleotide
atgtccactactcgatctatctcagtcttcggagctga

SEQ ID NO: 77827 - DNA, 38 bp, Artificial Sequence
  Synthetic oligonucleotide
gaaccacattccgcttgcatttcgccgattcccgctga

SEQ ID NO: 77828 - DNA, 38 bp, Artificial Sequence
  Synthetic oligonucleotide
ggtacgcagcccccctcacacggacgcacatcatctga

SEQ ID NO: 77829 - DNA, 38 bp, Artificial Sequence
  Synthetic oligonucleotide
acgcattagagcgtaccccctgtcccctgcctatctga

SEQ ID NO: 77830 - DNA, 38 bp, Artificial Sequence
  Synthetic oligonucleotide
tagacaggcacataaggaaacgtaaccagtggtagtga

SEQ ID NO: 77831 - DNA, 36 bp, Artificial Sequence
  Synthetic oligonucleotide
tacacacctcccgcgttctactctatcacgctgtga

SEQ ID NO: 77832 - DNA, 37 bp, Artificial Sequence
  Synthetic oligonucleotide
ggaccgacccacctttcccgtaagcccgaggctgtga

SEQ ID NO: 77833 - DNA, 38 bp, Artificial Sequence
  Synthetic oligonucleotide
tcatgcgatgcgttgtgcagattccgccttcattgtga

SEQ ID NO: 77834 - DNA, 38 bp, Artificial Sequence
  Synthetic oligonucleotide
gagcccgctcaccttgtcccccaagccttgcccattga

SEQ ID NO: 77835 - DNA, 38 bp, Artificial Sequence
  Synthetic oligonucleotide
ttgtcgctgcccccactctgcgcacattgtttcattga

SEQ ID NO: 77836 - DNA, 38 bp, Artificial Sequence
  Synthetic oligonucleotide
gtcgagggggatcggggtttgggcgctcggaaacttga

SEQ ID NO: 77837 - DNA, 37 bp, Artificial Sequence
  Synthetic oligonucleotide
acacccttacggaggtgtccatattttaccaacttga

SEQ ID NO: 77838 - DNA, 38 bp, Artificial Sequence
  Synthetic oligonucleotide
acgtggctagccattgtccgcatcgttttgccccttga

SEQ ID NO: 77839 - DNA, 37 bp, Artificial Sequence
  Synthetic oligonucleotide
tcaacccggcacttatttcaccactgcagcctcttga

SEQ ID NO: 77840 - DNA, 38 bp, Artificial Sequence
  Synthetic oligonucleotide
ttggtcgccgccactgttgctcatccagctgctcttga

SEQ ID NO: 77841 - DNA, 38 bp, Artificial Sequence
  Synthetic oligonucleotide
tgcccaccaaacgatattactctaaggtagcctgttga

SEQ ID NO: 77842 - DNA, 36 bp, Artificial Sequence
  Synthetic oligonucleotide
tacacggtcgtcccaattagccactgtgcctgttga

SEQ ID NO: 77843 - DNA, 38 bp, Artificial Sequence
  Synthetic oligonucleotide
gatacgcagtgcccgaccgtttgctaatcctctgttga

SEQ ID NO: 77844 - DNA, 37 bp, Artificial Sequence
  Synthetic oligonucleotide
actcgcgcggacggaactggggcgcgagcaaatttga

SEQ ID NO: 77845 - DNA, 38 bp, Artificial Sequence
  Synthetic oligonucleotide
taccaccgcgcttgacaaccgcctttgtccttatttga

SEQ ID NO: 77846 - DNA, 38 bp, Artificial Sequence
  Synthetic oligonucleotide
gacgtcaaccccacaagactagcccctgcctcctttga

SEQ ID NO: 77847 - DNA, 38 bp, Artificial Sequence
  Synthetic oligonucleotide
atgacaaatgctgcagctactctaggttctttctttga

SEQ ID NO: 77848 - DNA, 38 bp, Artificial Sequence
  Synthetic oligonucleotide
gatccatccccacaatatgactgttcagacatttttga

SEQ ID NO: 77849 - DNA, 35 bp, Artificial Sequence
  Synthetic oligonucleotide
tccccattcgtgagttcttgcccctttgagcgata

SEQ ID NO: 77850 - DNA, 35 bp, Artificial Sequence
  Synthetic oligonucleotide
ttcctgccccacttgtaaaatactgcattcgtata

SEQ ID NO: 77851 - DNA, 36 bp, Artificial Sequence
  Synthetic oligonucleotide
atgtgcctgccaatcgctcacatgtttcgcccacta

SEQ ID NO: 77852 - DNA, 36 bp, Artificial Sequence
  Synthetic oligonucleotide
gtgagcacgaggtcagcatcgatccgcttctcacta

SEQ ID NO: 77853 - DNA, 36 bp, Artificial Sequence
  Synthetic oligonucleotide
ttgcgatgtctcctcgctgcgttatcatgcccccta

SEQ ID NO: 77854 - DNA, 36 bp, Artificial Sequence
  Synthetic oligonucleotide
aaccactggacctttcgtaaattgtaagcttcgcta

SEQ ID NO: 77855 - DNA, 32 bp, Artificial Sequence
  Synthetic oligonucleotide
tttgtccatctgtcatcccaaacctacgtcta

SEQ ID NO: 77856 - DNA, 35 bp, Artificial Sequence
  Synthetic oligonucleotide
tacgacaaaaccccctcatggactgtgttccagta

SEQ ID NO: 77857 - DNA, 36 bp, Artificial Sequence
  Synthetic oligonucleotide
gcctgaccggtggacattaagcgggccatttacgta

SEQ ID NO: 77858 - DNA, 36 bp, Artificial Sequence
  Synthetic oligonucleotide
tgattccgcccagtaccctgcattccagacgccgta

SEQ ID NO: 77859 - DNA, 36 bp, Artificial Sequence
  Synthetic oligonucleotide
agcctcaacgacccatctccggataaacgcctggta

SEQ ID NO: 77860 - DNA, 35 bp, Artificial Sequence
  Synthetic oligonucleotide
acatctaccgctgggccttcttaccttgggtggta

SEQ ID NO: 77861 - DNA, 35 bp, Artificial Sequence
  Synthetic oligonucleotide
ggaccaacctttcgcaccacattactgtaagctta

SEQ ID NO: 77862 - DNA, 35 bp, Artificial Sequence
  Synthetic oligonucleotide
tgagtagtcgctggccctccaccctctatggctta

SEQ ID NO: 77863 - DNA, 36 bp, Artificial Sequence
  Synthetic oligonucleotide
tccacctccatgccggtatccgtattctcttgctta

SEQ ID NO: 77864 - DNA, 36 bp, Artificial Sequence
  Synthetic oligonucleotide
tgtggacacttccgtcgctctctacttaccctgtta

SEQ ID NO: 77865 - DNA, 34 bp, Artificial Sequence
  Synthetic oligonucleotide
attactcccacgtccgggcaccaactgggcttta

SEQ ID NO: 77866 - DNA, 35 bp, Artificial Sequence
  Synthetic oligonucleotide
tgcacctatcactgttcataccacgattgtcttta

SEQ ID NO: 77867 - DNA, 36 bp, Artificial Sequence
  Synthetic oligonucleotide
gcccgacttcctcattgctggttttagttccgttta

SEQ ID NO: 77868 - DNA, 35 bp, Artificial Sequence
  Synthetic oligonucleotide
gtgcaacacctggacccggcacttcttcaatttta

SEQ ID NO: 77869 - DNA, 36 bp, Artificial Sequence
  Synthetic oligonucleotide
tagacggacgacacactgtctctgggaactctttta

SEQ ID NO: 77870 - DNA, 35 bp, Artificial Sequence
  Synthetic oligonucleotide
gacaggttgtgccaccgttaccgacattctccaac

SEQ ID NO: 77871 - DNA, 35 bp, Artificial Sequence
  Synthetic oligonucleotide
gcgaacacaacactttccgctgacacgacgtcaac

SEQ ID NO: 77872 - DNA, 35 bp, Artificial Sequence
  Synthetic oligonucleotide
tcgacaccgttaccgcccagtctcccaagttccac

SEQ ID NO: 77873 - DNA, 35 bp, Artificial Sequence
  Synthetic oligonucleotide
ttgcagagctgagaacgccgatattccctcgctac

SEQ ID NO: 77874 - DNA, 35 bp, Artificial Sequence
  Synthetic oligonucleotide
ttcatcacctatgacgttgcccggccactagcacc

SEQ ID NO: 77875 - DNA, 35 bp, Artificial Sequence
  Synthetic oligonucleotide
agttaacatccatggcggcccaacaagtttcgccc

SEQ ID NO: 77876 - DNA, 35 bp, Artificial Sequence
  Synthetic oligonucleotide
agtgtgcaccccctgaccgcagtgaacgcccctcc

SEQ ID NO: 77877 - DNA, 35 bp, Artificial Sequence
  Synthetic oligonucleotide
tgttagatcacccagcccagacgtaaacacacagc

SEQ ID NO: 77878 - DNA, 35 bp, Artificial Sequence
  Synthetic oligonucleotide
ttcgcgcgcgcgggatatctgataatctcccctgc

SEQ ID NO: 77879 - DNA, 35 bp, Artificial Sequence
  Synthetic oligonucleotide
tgactcgctgctaacccccccagcgtggttcctgc

SEQ ID NO: 77880 - DNA, 35 bp, Artificial Sequence
  Synthetic oligonucleotide
tagtcatcgccttcctgcgtgtctctagcgccctc

SEQ ID NO: 77881 - DNA, 35 bp, Artificial Sequence
  Synthetic oligonucleotide
tcagcctagtgcggtcgaacccactcatttccctc

SEQ ID NO: 77882 - DNA, 35 bp, Artificial Sequence
  Synthetic oligonucleotide
gccaagctgggctccttttaaaccatcatttggtc

SEQ ID NO: 77883 - DNA, 35 bp, Artificial Sequence
  Synthetic oligonucleotide
actcccctagctccctgggggaaactttgagtttc

SEQ ID NO: 77884 - DNA, 35 bp, Artificial Sequence
  Synthetic oligonucleotide
actcatgctgaccacgttgccttttgtagcgaacg

SEQ ID NO: 77885 - DNA, 35 bp, Artificial Sequence
  Synthetic oligonucleotide
tgagcgggggggtggtgagggagcaatatcgtacg

SEQ ID NO: 77886 - DNA, 35 bp, Artificial Sequence
  Synthetic oligonucleotide
gttgtgagggggtggacgaggatcttaattgggcg

SEQ ID NO: 77887 - DNA, 35 bp, Artificial Sequence
  Synthetic oligonucleotide
taacgctatccggtaacgtgccgttttgtctctcg

SEQ ID NO: 77888 - DNA, 35 bp, Artificial Sequence
  Synthetic oligonucleotide
gatggtggcctaaaataatgtgggggtcagtgtcg

SEQ ID NO: 77889 - DNA, 35 bp, Artificial Sequence
  Synthetic oligonucleotide
gaccacatggtggtgtagatctgctctgtttgagg

SEQ ID NO: 77890 - DNA, 35 bp, Artificial Sequence
  Synthetic oligonucleotide
accacggagctgactcctctcgtacgacctttcgg

SEQ ID NO: 77891 - DNA, 35 bp, Artificial Sequence
  Synthetic oligonucleotide
gctcaacaatgcgaaatgggggatcaagtgtgggg

SEQ ID NO: 77892 - DNA, 35 bp, Artificial Sequence
  Synthetic oligonucleotide
gtcaacaaggcattctgtcccaaagcccaccctgg

SEQ ID NO: 77893 - DNA, 35 bp, Artificial Sequence
  Synthetic oligonucleotide
tgatgccgacttatgtcttcctatccaagtgctgg

SEQ ID NO: 77894 - DNA, 35 bp, Artificial Sequence
  Synthetic oligonucleotide
gccaatgtcgagagtgcaaatgtaagggaggttgg

SEQ ID NO: 77895 - DNA, 35 bp, Artificial Sequence
  Synthetic oligonucleotide
gcccttcccaagatgatgattacccacccttactg

SEQ ID NO: 77896 - DNA, 35 bp, Artificial Sequence
  Synthetic oligonucleotide
gctcactacccgttcagtccgaaacctcctacctg

SEQ ID NO: 77897 - DNA, 35 bp, Artificial Sequence
  Synthetic oligonucleotide
actccggtagccggctgttcatgttctccttcctg

SEQ ID NO: 77898 - DNA, 35 bp, Artificial Sequence
  Synthetic oligonucleotide
gccaggctaccgcgaatctgctttcttcacccgtg

SEQ ID NO: 77899 - DNA, 35 bp, Artificial Sequence
  Synthetic oligonucleotide
atacccactcggaacaaaagccgggccaacttgtg

SEQ ID NO: 77900 - DNA, 37 bp, Artificial Sequence
  Synthetic oligonucleotide
tcactcccgccagtgttcatttgctgctgaacttgtg

SEQ ID NO: 77901 - DNA, 35 bp, Artificial Sequence
  Synthetic oligonucleotide
taagacaccattcgctttttggacacgagcctttg

SEQ ID NO: 77902 - DNA, 35 bp, Artificial Sequence
  Synthetic oligonucleotide
acccccagagccttggagtccacgtgcacacatat

SEQ ID NO: 77903 - DNA, 35 bp, Artificial Sequence
  Synthetic oligonucleotide
tccgaaaccagcctccgggggacgtatcacgttat

SEQ ID NO: 77904 - DNA, 35 bp, Artificial Sequence
  Synthetic oligonucleotide
gcttaatccccggcattcttcgtaccagttgcact

SEQ ID NO: 77905 - DNA, 35 bp, Artificial Sequence
  Synthetic oligonucleotide
gcggagtacccgtcagacctccttcacttcaccct

SEQ ID NO: 77906 - DNA, 35 bp, Artificial Sequence
  Synthetic oligonucleotide
acccacacctcccattcgaacatctgaagagagct

SEQ ID NO: 77907 - DNA, 35 bp, Artificial Sequence
  Synthetic oligonucleotide
tccgcaaagggtgacgggtgtagtaggggcgggct

SEQ ID NO: 77908 - DNA, 35 bp, Artificial Sequence
  Synthetic oligonucleotide
gcgccccgcgataagtgtaccccgccgctgcttct

SEQ ID NO: 77909 - DNA, 35 bp, Artificial Sequence
  Synthetic oligonucleotide
tgacgacagtcaggaaactcatttggatggaccgt

SEQ ID NO: 77910 - DNA, 35 bp, Artificial Sequence
  Synthetic oligonucleotide
tcatttccgcgatcaaccttacaagtcctggtcgt

SEQ ID NO: 77911 - DNA, 35 bp, Artificial Sequence
  Synthetic oligonucleotide
gtagggggggcatggaaagatcggggcctttgggt

SEQ ID NO: 77912 - DNA, 35 bp, Artificial Sequence
  Synthetic oligonucleotide
cccgtgcccgaagtgtcttacgctatccaccctgt

SEQ ID NO: 77913 - DNA, 35 bp, Artificial Sequence
  Synthetic oligonucleotide
gtcactactcgcctgaacttggaaaatcccgtatt

SEQ ID NO: 77914 - DNA, 35 bp, Artificial Sequence
  Synthetic oligonucleotide
ttccctaccatcttctgtattacgcgccatgcctt

SEQ ID NO: 77915 - DNA, 35 bp, Artificial Sequence
  Synthetic oligonucleotide
ggacaccacacaatcctgtcctgcacggcctggtt

SEQ ID NO: 77916 - DNA, 35 bp, Artificial Sequence
  Synthetic oligonucleotide
tctacccagcgcgaccagcccacttattcagcaaa

SEQ ID NO: 77917 - DNA, 35 bp, Artificial Sequence
  Synthetic oligonucleotide
gagcacgaactaccaggcaccttcgacggtggaaa

SEQ ID NO: 77918 - DNA, 36 bp, Artificial Sequence
  Synthetic oligonucleotide
gaagtgagaggaatggggatgcagccggaaaagcaa

SEQ ID NO: 77919 - DNA, 36 bp, Artificial Sequence
  Synthetic oligonucleotide
tcaacgggcgtgatacgcaaatgcatttgctatgaa

SEQ ID NO: 77920 - DNA, 35 bp, Artificial Sequence
  Synthetic oligonucleotide
gatcaaggtcagtgctgccggccaatcaccccaca

SEQ ID NO: 77921 - DNA, 35 bp, Artificial Sequence
  Synthetic oligonucleotide
atagtccccgttaggccttcgtgtcctgtctcaca

SEQ ID NO: 77922 - DNA, 36 bp, Artificial Sequence
  Synthetic oligonucleotide
accccgcagctcaccctcgttaccatagttctcaca

SEQ ID NO: 77923 - DNA, 36 bp, Artificial Sequence
  Synthetic oligonucleotide
acgaccaggtcccagcaggcttatgcttccccccca

SEQ ID NO: 77924 - DNA, 34 bp, Artificial Sequence
  Synthetic oligonucleotide
ggtgtgaccagtgcgcctcgaagtctgtctccca

SEQ ID NO: 77925 - DNA, 36 bp, Artificial Sequence
  Synthetic oligonucleotide
ttcgcaacagcatctgtacacttggaaccgacgcca

SEQ ID NO: 77926 - DNA, 35 bp, Artificial Sequence
  Synthetic oligonucleotide
tcatgcaacgtacgcccgtcaatccctttgctcca

SEQ ID NO: 77927 - DNA, 35 bp, Artificial Sequence
  Synthetic oligonucleotide
gcatcattcttggaccgcgggttgcaacttctcca

SEQ ID NO: 77928 - DNA, 36 bp, Artificial Sequence
  Synthetic oligonucleotide
ggaggggtggggggcgatgattccagaaaataggca

SEQ ID NO: 77929 - DNA, 35 bp, Artificial Sequence
  Synthetic oligonucleotide
ttcccacgcacgttaatgcctggattccacctgca

SEQ ID NO: 77930 - DNA, 35 bp, Artificial Sequence
  Synthetic oligonucleotide
gatgggtcaggcctcgcgtttgccctgttgtctca

SEQ ID NO: 77931 - DNA, 36 bp, Artificial Sequence
  Synthetic oligonucleotide
acagagtgtccccgttaacctccgcgatacttctca

SEQ ID NO: 77932 - DNA, 36 bp, Artificial Sequence
  Synthetic oligonucleotide
aatgccgagacgccacacgaagccgggcccttctca

SEQ ID NO: 77933 - DNA, 36 bp, Artificial Sequence
  Synthetic oligonucleotide
tccgatccgtaaccgatgtgattcccgctttggtca

SEQ ID NO: 77934 - DNA, 36 bp, Artificial Sequence
  Synthetic oligonucleotide
ttggaattcgggtggaggaggtacgggggtgtgtca

SEQ ID NO: 77935 - DNA, 36 bp, Artificial Sequence
  Synthetic oligonucleotide
actcgcccactgaccctcccgactggtcgaacaaga

SEQ ID NO: 77936 - DNA, 37 bp, Artificial Sequence
  Synthetic oligonucleotide
gcgaatgtgtgggtagaggtagcgagtgagcgtaaga

SEQ ID NO: 77937 - DNA, 37 bp, Artificial Sequence
  Synthetic oligonucleotide
gccacgcggatattttagcgctctcctgtcgaccaga

SEQ ID NO: 77938 - DNA, 34 bp, Artificial Sequence
  Synthetic oligonucleotide
tgacggactccgacttggcctatcgactccgaga

SEQ ID NO: 77939 - DNA, 37 bp, Artificial Sequence
  Synthetic oligonucleotide
gccgtagggcggggatctcaggacaaggagggggaga

SEQ ID NO: 77940 - DNA, 37 bp, Artificial Sequence
  Synthetic oligonucleotide
accactcgcctttccctgtctgcagacttacgtgaga

SEQ ID NO: 77941 - DNA, 37 bp, Artificial Sequence
  Synthetic oligonucleotide
actcaccggcacaggaatgtacctcaactccggtaga

SEQ ID NO: 77942 - DNA, 37 bp, Artificial Sequence
  Synthetic oligonucleotide
acaccgggtcaagtaattgaagcgcaccacctaccga

SEQ ID NO: 77943 - DNA, 37 bp, Artificial Sequence
  Synthetic oligonucleotide
tacagacgggggttacgagttatcgtaggaaagccga

SEQ ID NO: 77944 - DNA, 37 bp, Artificial Sequence
  Synthetic oligonucleotide
gtaccaccatacctgtaatgctcttccaccgagccga

SEQ ID NO: 77945 - DNA, 37 bp, Artificial Sequence
  Synthetic oligonucleotide
acctccccctcaacttagaactccagccctgggccga

SEQ ID NO: 77946 - DNA, 38 bp, Artificial Sequence
  Synthetic oligonucleotide
gactacgcgagcatagaaacaaggagaggctatagcga

SEQ ID NO: 77947 - DNA, 37 bp, Artificial Sequence
  Synthetic oligonucleotide
actcgagaggaggggatggaaccggattgagtcgcga

SEQ ID NO: 77948 - DNA, 37 bp, Artificial Sequence
  Synthetic oligonucleotide
tacagggcgtggaggcgtggtaatctggggtaggcga

SEQ ID NO: 77949 - DNA, 37 bp, Artificial Sequence
  Synthetic oligonucleotide
accagccacggaactcaggacacagcaaacaaatcga

SEQ ID NO: 77950 - DNA, 37 bp, Artificial Sequence
  Synthetic oligonucleotide
gaaccgccaattatgctaaattctacgatcctatcga

SEQ ID NO: 77951 - DNA, 37 bp, Artificial Sequence
  Synthetic oligonucleotide
ggagggggagctgtaggtgccgtggtgctctgaagga

SEQ ID NO: 77952 - DNA, 37 bp, Artificial Sequence
  Synthetic oligonucleotide
gaggacgtaacgcagaaaaatggtgggggagcaggga

SEQ ID NO: 77953 - DNA, 36 bp, Artificial Sequence
  Synthetic oligonucleotide
gagcaccctgaagggtttatggggagggtggcggga

SEQ ID NO: 77954 - DNA, 37 bp, Artificial Sequence
  Synthetic oligonucleotide
acccatctctcaacggttcgtgttttcgcttctggga

SEQ ID NO: 77955 - DNA, 37 bp, Artificial Sequence
  Synthetic oligonucleotide
ggttcagaactccggtacgcatacacacatcacatga

SEQ ID NO: 77956 - DNA, 38 bp, Artificial Sequence
  Synthetic oligonucleotide
tgcacgtatcatccacacacaacagtccagtgacatga

SEQ ID NO: 77957 - DNA, 35 bp, Artificial Sequence
  Synthetic oligonucleotide
gtgcgaaccgccgactgtcttcacatagctcatga

SEQ ID NO: 77958 - DNA, 38 bp, Artificial Sequence
  Synthetic oligonucleotide
atcacacactggggttgccagtaatttccctaaactga

SEQ ID NO: 77959 - DNA, 36 bp, Artificial Sequence
  Synthetic oligonucleotide
gaacctcctgcctggattggtgctttcttgaactga

SEQ ID NO: 77960 - DNA, 38 bp, Artificial Sequence
  Synthetic oligonucleotide
accttgcatccgagcccggccatcattgttcaacctga

SEQ ID NO: 77961 - DNA, 38 bp, Artificial Sequence
  Synthetic oligonucleotide
gacaaggctaggcagtggtccgcgctcccataccctga

SEQ ID NO: 77962 - DNA, 38 bp, Artificial Sequence
  Synthetic oligonucleotide
actgtcgtcgtcgcaccccggcccggtctccgccctga

SEQ ID NO: 77963 - DNA, 38 bp, Artificial Sequence
  Synthetic oligonucleotide
gtcccggtctccccctgtagtgtctctgaccttcctga

SEQ ID NO: 77964 - DNA, 37 bp, Artificial Sequence
  Synthetic oligonucleotide
accgccaaacatcgctcacctgaaattgctctgctga

SEQ ID NO: 77965 - DNA, 38 bp, Artificial Sequence
  Synthetic oligonucleotide
gatgtccgccattcgcgcgtcggtcccatcgcccgtga

SEQ ID NO: 77966 - DNA, 38 bp, Artificial Sequence
  Synthetic oligonucleotide
gcaactgccacattctcacgtaatggatctctccgtga

SEQ ID NO: 77967 - DNA, 37 bp, Artificial Sequence
  Synthetic oligonucleotide
acagcaagcgggacaaggggtgaaatgtctggggtga

SEQ ID NO: 77968 - DNA, 38 bp, Artificial Sequence
  Synthetic oligonucleotide
gcctcccgcaacccaatcatccccaactcccgtggtga

SEQ ID NO: 77969 - DNA, 36 bp, Artificial Sequence
  Synthetic oligonucleotide
gaggtgggacggatagcaagatagggcggacattga

SEQ ID NO: 77970 - DNA, 38 bp, Artificial Sequence
  Synthetic oligonucleotide
gttgaaacggaataggtggcttactgggcaaggattga

SEQ ID NO: 77971 - DNA, 37 bp, Artificial Sequence
  Synthetic oligonucleotide
actgccccagggattccctggcccgcttatcacttga

SEQ ID NO: 77972 - DNA, 38 bp, Artificial Sequence
  Synthetic oligonucleotide
gcgtggccccttgcagctggaattggcccttaccttga

SEQ ID NO: 77973 - DNA, 37 bp, Artificial Sequence
  Synthetic oligonucleotide
gtgtaggtacgtggttggtggcggacggtgcgcttga

SEQ ID NO: 77974 - DNA, 37 bp, Artificial Sequence
  Synthetic oligonucleotide
gttgccatacacacaaagggctccaacatattgttga

SEQ ID NO: 77975 - DNA, 36 bp, Artificial Sequence
  Synthetic oligonucleotide
agagcgatacccgcacccagttacgtcttcctttga

SEQ ID NO: 77976 - DNA, 38 bp, Artificial Sequence
  Synthetic oligonucleotide
agaccccgcaccctcgattgcggcccaaacctctttga

SEQ ID NO: 77977 - DNA, 35 bp, Artificial Sequence
  Synthetic oligonucleotide
tacccaccgaacgatcggagtcccaaaaaacgata

SEQ ID NO: 77978 - DNA, 36 bp, Artificial Sequence
  Synthetic oligonucleotide
ggccctggcaccccgcacacgcatgcttcttcgcta

SEQ ID NO: 77979 - DNA, 36 bp, Artificial Sequence
  Synthetic oligonucleotide
atgacaccgccgcaagggcacaatcggagagcggta

SEQ ID NO: 77980 - DNA, 36 bp, Artificial Sequence
  Synthetic oligonucleotide
tctcatcgtggcccctcccacacgcctgaaagggta

SEQ ID NO: 77981 - DNA, 35 bp, Artificial Sequence
  Synthetic oligonucleotide
gcaccgcgaacatctcgtgggcctttgtttactta

SEQ ID NO: 77982 - DNA, 36 bp, Artificial Sequence
  Synthetic oligonucleotide
atgccacccagggcataactggagggttggacctta

SEQ ID NO: 77983 - DNA, 35 bp, Artificial Sequence
  Synthetic oligonucleotide
atagcctcatgggggttgcgtttccttccgcctta

SEQ ID NO: 77984 - DNA, 36 bp, Artificial Sequence
  Synthetic oligonucleotide
acaccatgaagttggtccgaggaggacctgcggtta

SEQ ID NO: 77985 - DNA, 36 bp, Artificial Sequence
  Synthetic oligonucleotide
gcaactctggttggttctctttaaatgttctggtta

SEQ ID NO: 77986 - DNA, 36 bp, Artificial Sequence
  Synthetic oligonucleotide
gactcatcctcgttgccgtccgtaatccatctgtta

SEQ ID NO: 77987 - DNA, 35 bp, Artificial Sequence
  Synthetic oligonucleotide
tgaataccgcagaactgtccttccccgacgcgaac

SEQ ID NO: 77988 - DNA, 35 bp, Artificial Sequence
  Synthetic oligonucleotide
gtacatgcccgtgagtttttaccctaaccccgcac

SEQ ID NO: 77989 - DNA, 35 bp, Artificial Sequence
  Synthetic oligonucleotide
gagggaggatcggtctgtggaggggagttggggac

SEQ ID NO: 77990 - DNA, 35 bp, Artificial Sequence
  Synthetic oligonucleotide
agcgagaggaggaaagcgagcgaaatggtggtgac

SEQ ID NO: 77991 - DNA, 35 bp, Artificial Sequence
  Synthetic oligonucleotide
acaccgacactttcaacgcttggctattcatctac

SEQ ID NO: 77992 - DNA, 35 bp, Artificial Sequence
  Synthetic oligonucleotide
aaatcaccagtcactaccaactctgctgctagccc

SEQ ID NO: 77993 - DNA, 35 bp, Artificial Sequence
  Synthetic oligonucleotide
ttacgaccttctgctagccccgcgactcttcggcc

SEQ ID NO: 77994 - DNA, 36 bp, Artificial Sequence
  Synthetic oligonucleotide
gaggagaggctccgttctagtgtccatccaccatcc

SEQ ID NO: 77995 - DNA, 35 bp, Artificial Sequence
  Synthetic oligonucleotide
tgccagattacagcacaccttcaattttgccatcc

SEQ ID NO: 77996 - DNA, 35 bp, Artificial Sequence
  Synthetic oligonucleotide
gctcacttccgattgtcagcctacgccattcgtcc

SEQ ID NO: 77997 - DNA, 35 bp, Artificial Sequence
  Synthetic oligonucleotide
tcacgccgcattcctgctgtcagctatccacttcc

SEQ ID NO: 77998 - DNA, 35 bp, Artificial Sequence
  Synthetic oligonucleotide
actgaacccaacacctcaacgtgcttttagctagc

SEQ ID NO: 77999 - DNA, 35 bp, Artificial Sequence
  Synthetic oligonucleotide
aactaaccgaccctcaccgagccatacgaacgcgc

SEQ ID NO: 78000 - DNA, 35 bp, Artificial Sequence
  Synthetic oligonucleotide
gtctgcctacggagtttctccctttgcaacgtatc

SEQ ID NO: 78001 - DNA, 35 bp, Artificial Sequence
  Synthetic oligonucleotide
gacttcttagcctcctctgggttcctgcacatgtc

SEQ ID NO: 78002 - DNA, 35 bp, Artificial Sequence
  Synthetic oligonucleotide
gatcctactccctggtattgaactttgatgctgtc

SEQ ID NO: 78003 - DNA, 35 bp, Artificial Sequence
  Synthetic oligonucleotide
atgcaccctgtgacgtttccgctacaccaattcag

SEQ ID NO: 78004 - DNA, 35 bp, Artificial Sequence
  Synthetic oligonucleotide
gtaaccaccacaaccgctccgcctggaggacagag

SEQ ID NO: 78005 - DNA, 35 bp, Artificial Sequence
  Synthetic oligonucleotide
aggacggaggtgggagaggagcgggcacgggcgag

SEQ ID NO: 78006 - DNA, 35 bp, Artificial Sequence
  Synthetic oligonucleotide
gatcatatacccccgctgctttttcatcctagacg

SEQ ID NO: 78007 - DNA, 35 bp, Artificial Sequence
  Synthetic oligonucleotide
agcctcacttcctaaactgttattacacgattccg

SEQ ID NO: 78008 - DNA, 35 bp, Artificial Sequence
  Synthetic oligonucleotide
ggaactgccacgcaacaaccccgtacaagccacgg

SEQ ID NO: 78009 - DNA, 35 bp, Artificial Sequence
  Synthetic oligonucleotide
tgcgcaagcattgatagtaggagcaggatgtgggg

SEQ ID NO: 78010 - DNA, 35 bp, Artificial Sequence
  Synthetic oligonucleotide
gaagttcctagcccccactgacgctgccagccctg

SEQ ID NO: 78011 - DNA, 35 bp, Artificial Sequence
  Synthetic oligonucleotide
ttgtacacccctctaagacgcgatttgacctcctg

SEQ ID NO: 78012 - DNA, 35 bp, Artificial Sequence
  Synthetic oligonucleotide
agttagacccgtgcgatgactccactcgttcccat

SEQ ID NO: 78013 - DNA, 34 bp, Artificial Sequence
  Synthetic oligonucleotide
acttcgacactaccttcagttgcccggtctttat

SEQ ID NO: 78014 - DNA, 35 bp, Artificial Sequence
  Synthetic oligonucleotide
gactggcaatgaacccccgcactggcatgcaaact

SEQ ID NO: 78015 - DNA, 35 bp, Artificial Sequence
  Synthetic oligonucleotide
tacatactgactgatatcagtcccccagaggcact

SEQ ID NO: 78016 - DNA, 35 bp, Artificial Sequence
  Synthetic oligonucleotide
gacggcgatggaatcggttcatgcactaccttact

SEQ ID NO: 78017 - DNA, 35 bp, Artificial Sequence
  Synthetic oligonucleotide
atctccacttacgcgccacaagttcactgcttact

SEQ ID NO: 78018 - DNA, 35 bp, Artificial Sequence
  Synthetic oligonucleotide
tcactgcggttaagcgatgaagctcccggccccct

SEQ ID NO: 78019 - DNA, 35 bp, Artificial Sequence
  Synthetic oligonucleotide
accgacagtctgcttcctacaccaggtcaggttct

SEQ ID NO: 78020 - DNA, 35 bp, Artificial Sequence
  Synthetic oligonucleotide
ggtccacagcgaggaggagggtttaggaaaaacgt

SEQ ID NO: 78021 - DNA, 35 bp, Artificial Sequence
  Synthetic oligonucleotide
tcatcatagccctctcgcagtgccaccactcccgt

SEQ ID NO: 78022 - DNA, 35 bp, Artificial Sequence
  Synthetic oligonucleotide
gtgcgtcaatggcgcccacctatactttcttccgt

SEQ ID NO: 78023 - DNA, 35 bp, Artificial Sequence
  Synthetic oligonucleotide
gaaactcacaaatgtcgtcccacttgcctctatgt

SEQ ID NO: 78024 - DNA, 35 bp, Artificial Sequence
  Synthetic oligonucleotide
gaaccaggtgtacactgcatatataaaatgcctgt

SEQ ID NO: 78025 - DNA, 34 bp, Artificial Sequence
  Synthetic oligonucleotide
gttgggtggagcggcacggatggattaattttgt

SEQ ID NO: 78026 - DNA, 35 bp, Artificial Sequence
  Synthetic oligonucleotide
gtctcacggcaaattgttcctacgtcgacctaatt

SEQ ID NO: 78027 - DNA, 35 bp, Artificial Sequence
  Synthetic oligonucleotide
gtgcacaagcatcacagactattcaccatcccctt

SEQ ID NO: 78028 - DNA, 35 bp, Artificial Sequence
  Synthetic oligonucleotide
gacgcccacttacgcttagcctacagccgagcgtt

SEQ ID NO: 78029 - DNA, 35 bp, Artificial Sequence
  Synthetic oligonucleotide
taccatcctcatgataggtcttaagcattttggtt

SEQ ID NO: 78030 - DNA, 35 bp, Artificial Sequence
  Synthetic oligonucleotide
actcggagacaggagaatgcgtgaccactcctttt

SEQ ID NO: 78031 - DNA, 35 bp, Artificial Sequence
  Synthetic oligonucleotide
ttcatgtcattgcctcctgcctgctgctcaagcaa

SEQ ID NO: 78032 - DNA, 36 bp, Artificial Sequence
  Synthetic oligonucleotide
ttcgctaccggttgtccatggttttcaggcccgcaa

SEQ ID NO: 78033 - DNA, 37 bp, Artificial Sequence
  Synthetic oligonucleotide
gcggacgggatagaatggagtcgcgggtggagcagaa

SEQ ID NO: 78034 - DNA, 36 bp, Artificial Sequence
  Synthetic oligonucleotide
tcgtgcgttacaccttgccgcctcaacgatcatgaa

SEQ ID NO: 78035 - DNA, 35 bp, Artificial Sequence
  Synthetic oligonucleotide
aaagcacgcaattctccatggtccccagtgcctaa

SEQ ID NO: 78036 - DNA, 36 bp, Artificial Sequence
  Synthetic oligonucleotide
accacggacaggggggcggacggaaattcggtgtaa

SEQ ID NO: 78037 - DNA, 36 bp, Artificial Sequence
  Synthetic oligonucleotide
ttccaccagtagatctcgaccattacgaccccttaa

SEQ ID NO: 78038 - DNA, 36 bp, Artificial Sequence
  Synthetic oligonucleotide
tgcgacctgcattaagcatcctgctagaataccaca

SEQ ID NO: 78039 - DNA, 36 bp, Artificial Sequence
  Synthetic oligonucleotide
aacggcgggcaacctcgttctcgtttctggatcaca

SEQ ID NO: 78040 - DNA, 36 bp, Artificial Sequence
  Synthetic oligonucleotide
aatgcaggaggtacgaaggatgactgcgggacgaca

SEQ ID NO: 78041 - DNA, 36 bp, Artificial Sequence
  Synthetic oligonucleotide
agcgataccgccggctaatgccctccctcacggaca

SEQ ID NO: 78042 - DNA, 36 bp, Artificial Sequence
  Synthetic oligonucleotide
ttcagactcgcgggcacaactgaacgtacaggtaca

SEQ ID NO: 78043 - DNA, 35 bp, Artificial Sequence
  Synthetic oligonucleotide
gccgactcattggctgacctgcaattgccgcccca

SEQ ID NO: 78044 - DNA, 36 bp, Artificial Sequence
  Synthetic oligonucleotide
tttgtgtaaggagccccgcaccccctgtcttcccca

SEQ ID NO: 78045 - DNA, 35 bp, Artificial Sequence
  Synthetic oligonucleotide
gtagcaccagccttgctctattctgtgcgtgccca

SEQ ID NO: 78046 - DNA, 36 bp, Artificial Sequence
  Synthetic oligonucleotide
ttacaaactacaccgctgtctatcagtgcccagcca

SEQ ID NO: 78047 - DNA, 35 bp, Artificial Sequence
  Synthetic oligonucleotide
agacgttgccttgcaggttatttacgttccatcca

SEQ ID NO: 78048 - DNA, 36 bp, Artificial Sequence
  Synthetic oligonucleotide
tcgcataactacgataccctgtccctctggctcgca

SEQ ID NO: 78049 - DNA, 36 bp, Artificial Sequence
  Synthetic oligonucleotide
tacagtgcatttatagttctctccccgcttagtgca

SEQ ID NO: 78050 - DNA, 35 bp, Artificial Sequence
  Synthetic oligonucleotide
gggacccctgacattgcccattattgtaagtttca

SEQ ID NO: 78051 - DNA, 37 bp, Artificial Sequence
  Synthetic oligonucleotide
attcggtcgggtctggggggaactaaggcatggaaga

SEQ ID NO: 78052 - DNA, 37 bp, Artificial Sequence
  Synthetic oligonucleotide
gtgccacaacatgggaacattgatggacagtatgaga

SEQ ID NO: 78053 - DNA, 37 bp, Artificial Sequence
  Synthetic oligonucleotide
ggacgaggacgggcaattaaaagaagtgaaggtgaga

SEQ ID NO: 78054 - DNA, 35 bp, Artificial Sequence
  Synthetic oligonucleotide
agagcacggacatagggggtttggattagaataga

SEQ ID NO: 78055 - DNA, 37 bp, Artificial Sequence
  Synthetic oligonucleotide
aaccaagcaggagtgccagaatgcagcactacttaga

SEQ ID NO: 78056 - DNA, 36 bp, Artificial Sequence
  Synthetic oligonucleotide
tccctttacatccccctgcgcacccgctccgttaga

SEQ ID NO: 78057 - DNA, 37 bp, Artificial Sequence
  Synthetic oligonucleotide
agttgggaagcaggtgagaaacggaggttgggtccga

SEQ ID NO: 78058 - DNA, 35 bp, Artificial Sequence
  Synthetic oligonucleotide
gacattgtcccacaaacttcatgatcccgacgcga

SEQ ID NO: 78059 - DNA, 37 bp, Artificial Sequence
  Synthetic oligonucleotide
gacttggtaggtggcgtaacagggggggaccaatcga

SEQ ID NO: 78060 - DNA, 37 bp, Artificial Sequence
  Synthetic oligonucleotide
tctcctaccggccccataccttaaggacctctatcga

SEQ ID NO: 78061 - DNA, 37 bp, Artificial Sequence
  Synthetic oligonucleotide
gcaaaccagttatgccatcgacactactccaactcga

SEQ ID NO: 78062 - DNA, 37 bp, Artificial Sequence
  Synthetic oligonucleotide
gcccactgatcggcgaaccgatgacccgctttttcga

SEQ ID NO: 78063 - DNA, 37 bp, Artificial Sequence
  Synthetic oligonucleotide
tccaccacgccaaggtagcgagttaggtaccgaagga

SEQ ID NO: 78064 - DNA, 36 bp, Artificial Sequence
  Synthetic oligonucleotide
acgacttgccagcactccccaaacccactcgtagga

SEQ ID NO: 78065 - DNA, 37 bp, Artificial Sequence
  Synthetic oligonucleotide
aaagagggggggactcggaggaattagatggcacgga

SEQ ID NO: 78066 - DNA, 37 bp, Artificial Sequence
  Synthetic oligonucleotide
ggggcagggcgacgatgaagggggcgtgacatgggga

SEQ ID NO: 78067 - DNA, 37 bp, Artificial Sequence
  Synthetic oligonucleotide
actgatgaaggatgggcacggacgaagaaggatggga

SEQ ID NO: 78068 - DNA, 37 bp, Artificial Sequence
  Synthetic oligonucleotide
acactcgcagaaacccagcctctctgcctctcctgga

SEQ ID NO: 78069 - DNA, 37 bp, Artificial Sequence
  Synthetic oligonucleotide
tggacaggtccaggagaatggaggcatggtgggtgga

SEQ ID NO: 78070 - DNA, 37 bp, Artificial Sequence
  Synthetic oligonucleotide
tgcgaggtgccggctaggtaaggactatgggtgtgga

SEQ ID NO: 78071 - DNA, 38 bp, Artificial Sequence
  Synthetic oligonucleotide
tacatagcgctggggttggggggacgaaataccaatga

SEQ ID NO: 78072 - DNA, 38 bp, Artificial Sequence
  Synthetic oligonucleotide
gttgcgaccaaactctccttgggcacctcccataatga

SEQ ID NO: 78073 - DNA, 37 bp, Artificial Sequence
  Synthetic oligonucleotide
gtcagggacacgtgaaacaggtctagtcacaggatga

SEQ ID NO: 78074 - DNA, 37 bp, Artificial Sequence
  Synthetic oligonucleotide
tatgtgggagggagtaggaccgtgggaaggatgatga

SEQ ID NO: 78075 - DNA, 36 bp, Artificial Sequence
  Synthetic oligonucleotide
ttcgcccccgtccatttcgtccctttaaagctatga

SEQ ID NO: 78076 - DNA, 38 bp, Artificial Sequence
  Synthetic oligonucleotide
gtcacgtacacccagtccggccagttttttcgaactga

SEQ ID NO: 78077 - DNA, 37 bp, Artificial Sequence
  Synthetic oligonucleotide
acctatacctaacagcgccggcctcatccgccactga

SEQ ID NO: 78078 - DNA, 38 bp, Artificial Sequence
  Synthetic oligonucleotide
gtctcaccaccgattcaccagcgatcgctcttcactga

SEQ ID NO: 78079 - DNA, 38 bp, Artificial Sequence
  Synthetic oligonucleotide
gaatgtgtgaggtgggattgaggggctgtaaagactga

SEQ ID NO: 78080 - DNA, 37 bp, Artificial Sequence
  Synthetic oligonucleotide
gtttgcgcgcgcctcactattgtttctttgcgcctga

SEQ ID NO: 78081 - DNA, 37 bp, Artificial Sequence
  Synthetic oligonucleotide
attccgcacacccgctcaagttggcccatgtgcctga

SEQ ID NO: 78082 - DNA, 38 bp, Artificial Sequence
  Synthetic oligonucleotide
gcctgcgtctccgtaccatcgctcccttcgccgtctga

SEQ ID NO: 78083 - DNA, 37 bp, Artificial Sequence
  Synthetic oligonucleotide
gacatgtcaacgacgtccttgctttccctcgccgtga

SEQ ID NO: 78084 - DNA, 37 bp, Artificial Sequence
  Synthetic oligonucleotide
gagtaggacgggcataggaagtggacgcttttcgtga

SEQ ID NO: 78085 - DNA, 38 bp, Artificial Sequence
  Synthetic oligonucleotide
tagaccccgctccgagtgccctcgggtcccccgggtga

SEQ ID NO: 78086 - DNA, 38 bp, Artificial Sequence
  Synthetic oligonucleotide
gaagagggcgatgggggacagggcagattggcgggtga

SEQ ID NO: 78087 - DNA, 38 bp, Artificial Sequence
  Synthetic oligonucleotide
gtaaacgccgcaggaaatcaaggaatcgaagggggtga

SEQ ID NO: 78088 - DNA, 36 bp, Artificial Sequence
  Synthetic oligonucleotide
gtcaacccgcttgttttcccgtatgtcaattggtga

SEQ ID NO: 78089 - DNA, 38 bp, Artificial Sequence
  Synthetic oligonucleotide
atgaacaccgcttacgtgtcttagtatcaacactgtga

SEQ ID NO: 78090 - DNA, 38 bp, Artificial Sequence
  Synthetic oligonucleotide
tccgactggtcggctgacctcctcaacgattactgtga

SEQ ID NO: 78091 - DNA, 38 bp, Artificial Sequence
  Synthetic oligonucleotide
gtgagggtctaggatactggaagggatgttggggttga

SEQ ID NO: 78092 - DNA, 38 bp, Artificial Sequence
  Synthetic oligonucleotide
agcccctcacccgcacgttcactaatgcatgcctttga

SEQ ID NO: 78093 - DNA, 38 bp, Artificial Sequence
  Synthetic oligonucleotide
gaccctgaccgagtggcccctgttgactaacattttga

SEQ ID NO: 78094 - DNA, 35 bp, Artificial Sequence
  Synthetic oligonucleotide
gtctatcctccctcctggtacgcagttccttaata

SEQ ID NO: 78095 - DNA, 35 bp, Artificial Sequence
  Synthetic oligonucleotide
ttccgcccccatccgtgtcctctttaggttttata

SEQ ID NO: 78096 - DNA, 36 bp, Artificial Sequence
  Synthetic oligonucleotide
ttccaacgggaagggcgggggactgatatgggagta

SEQ ID NO: 78097 - DNA, 35 bp, Artificial Sequence
  Synthetic oligonucleotide
tcttgcacccccggagggtttactctcgatccgta

SEQ ID NO: 78098 - DNA, 36 bp, Artificial Sequence
  Synthetic oligonucleotide
acgaagagccgggtggtgatctgggtgtggtgtgta

SEQ ID NO: 78099 - DNA, 35 bp, Artificial Sequence
  Synthetic oligonucleotide
atcgtgccggctcgcggtaccatccttgcaaatta

SEQ ID NO: 78100 - DNA, 36 bp, Artificial Sequence
  Synthetic oligonucleotide
gtcgcgactgccttgtgcctgttttgccacatctta

SEQ ID NO: 78101 - DNA, 36 bp, Artificial Sequence
  Synthetic oligonucleotide
gcctagtcccgacggcacctatgtactcttttctta

SEQ ID NO: 78102 - DNA, 36 bp, Artificial Sequence
  Synthetic oligonucleotide
aacccacctttggggtgtagaaacactcatccgtta

SEQ ID NO: 78103 - DNA, 35 bp, Artificial Sequence
  Synthetic oligonucleotide
gtaagtcacgcgctccataccgtaattacacaaac

SEQ ID NO: 78104 - DNA, 35 bp, Artificial Sequence
  Synthetic oligonucleotide
gacgaccatacccggaggtccggaggacttacaac

SEQ ID NO: 78105 - DNA, 35 bp, Artificial Sequence
  Synthetic oligonucleotide
tagcacagtaccacgtccccgcaccgataccacac

SEQ ID NO: 78106 - DNA, 35 bp, Artificial Sequence
  Synthetic oligonucleotide
ttcgataacgcacaagcactgttctgtgcgaccac

SEQ ID NO: 78107 - DNA, 35 bp, Artificial Sequence
  Synthetic oligonucleotide
acgtggcaagcatttacgatctccgttccagccac

SEQ ID NO: 78108 - DNA, 35 bp, Artificial Sequence
  Synthetic oligonucleotide
gttagacgactaccaccgtagctgacattctttac

SEQ ID NO: 78109 - DNA, 35 bp, Artificial Sequence
  Synthetic oligonucleotide
tgatgtcacccacgagctcgtgctacaagttttac

SEQ ID NO: 78110 - DNA, 35 bp, Artificial Sequence
  Synthetic oligonucleotide
ggatcgcgccgttatgtcctcagctaacattaacc

SEQ ID NO: 78111 - DNA, 35 bp, Artificial Sequence
  Synthetic oligonucleotide
gttactgcacgcctcaacattagtgctttataccc

SEQ ID NO: 78112 - DNA, 35 bp, Artificial Sequence
  Synthetic oligonucleotide
aagtcagacaacaccgccgtcgcctatgtaattcc

SEQ ID NO: 78113 - DNA, 35 bp, Artificial Sequence
  Synthetic oligonucleotide
atgagaggaggggtgttagtactgcggagcatatc

SEQ ID NO: 78114 - DNA, 35 bp, Artificial Sequence
  Synthetic oligonucleotide
tcatgacatgtccactcatcgcgtttccccgcctc

SEQ ID NO: 78115 - DNA, 35 bp, Artificial Sequence
  Synthetic oligonucleotide
tcgcgtagcctcacaccgttcctttcttccagctc

SEQ ID NO: 78116 - DNA, 35 bp, Artificial Sequence
  Synthetic oligonucleotide
gtcaagccaccctccgtaggccgtttttgtatgtc

SEQ ID NO: 78117 - DNA, 35 bp, Artificial Sequence
  Synthetic oligonucleotide
tgcttaccccggtggacacactcagtagaactgtc

SEQ ID NO: 78118 - DNA, 35 bp, Artificial Sequence
  Synthetic oligonucleotide
ttgccgcaagcacctagacccaattcacctttcag

SEQ ID NO: 78119 - DNA, 35 bp, Artificial Sequence
  Synthetic oligonucleotide
tacatgcgcttcctaaaccccgtgtctgtccaccg

SEQ ID NO: 78120 - DNA, 35 bp, Artificial Sequence
  Synthetic oligonucleotide
gaagggaggagactacaaaggcgggtcgtaaatcg

SEQ ID NO: 78121 - DNA, 35 bp, Artificial Sequence
  Synthetic oligonucleotide
tcccagacaaatgctatctacacaaaggcctttcg

SEQ ID NO: 78122 - DNA, 35 bp, Artificial Sequence
  Synthetic oligonucleotide
tctgacgctggcttctgacacatattttctctagg

SEQ ID NO: 78123 - DNA, 35 bp, Artificial Sequence
  Synthetic oligonucleotide
tatgtcacgcaggttaggaagtcacagtagttggg

SEQ ID NO: 78124 - DNA, 35 bp, Artificial Sequence
  Synthetic oligonucleotide
acctgccatgagcgtgtggggttggaatgcaggtg

SEQ ID NO: 78125 - DNA, 35 bp, Artificial Sequence
  Synthetic oligonucleotide
gcgatgccgatactgacctatgttgccctacgaat

SEQ ID NO: 78126 - DNA, 35 bp, Artificial Sequence
  Synthetic oligonucleotide
accaacaggatccacgacgcccctattgctgtaat

SEQ ID NO: 78127 - DNA, 35 bp, Artificial Sequence
  Synthetic oligonucleotide
tttgagggccgggggggaaggatcgttacaaacat

SEQ ID NO: 78128 - DNA, 35 bp, Artificial Sequence
  Synthetic oligonucleotide
attgatgtctgtcggtcgcttacgtttcctcccat

SEQ ID NO: 78129 - DNA, 35 bp, Artificial Sequence
  Synthetic oligonucleotide
atacatccattccccaggcgtagccgatccgtgat

SEQ ID NO: 78130 - DNA, 35 bp, Artificial Sequence
  Synthetic oligonucleotide
gtgtcacactctcatgcctgatatccgcctaatat

SEQ ID NO: 78131 - DNA, 35 bp, Artificial Sequence
  Synthetic oligonucleotide
ggaaacgcatcacacgttcttactttctccactat

SEQ ID NO: 78132 - DNA, 35 bp, Artificial Sequence
  Synthetic oligonucleotide
acttgaacttgcgcttccgagtccttctcacctct

SEQ ID NO: 78133 - DNA, 35 bp, Artificial Sequence
  Synthetic oligonucleotide
tgaacgtctgtacccactcgcattgctttagttct

SEQ ID NO: 78134 - DNA, 35 bp, Artificial Sequence
  Synthetic oligonucleotide
acctgagccgatgaggtaggctgaatgatgtaagt

SEQ ID NO: 78135 - DNA, 35 bp, Artificial Sequence
  Synthetic oligonucleotide
gtgctcacaggctggtatgaatccacttgaatagt

SEQ ID NO: 78136 - DNA, 35 bp, Artificial Sequence
  Synthetic oligonucleotide
tttagctcctgctctaatccacatccggacactgt

SEQ ID NO: 78137 - DNA, 36 bp, Artificial Sequence
  Synthetic oligonucleotide
ataccgcatgttccggaatatagtttcttgtcttgt

SEQ ID NO: 78138 - DNA, 35 bp, Artificial Sequence
  Synthetic oligonucleotide
ttgatcttccgcacgaaccacgagtaccattcatt

SEQ ID NO: 78139 - DNA, 35 bp, Artificial Sequence
  Synthetic oligonucleotide
tgtgaaaagtcagggccgcaattgtcatcttcctt

SEQ ID NO: 78140 - DNA, 35 bp, Artificial Sequence
  Synthetic oligonucleotide
gccctaagctcgcatcgtccgcctatactgccttt

SEQ ID NO: 78141 - DNA, 36 bp, Artificial Sequence
  Synthetic oligonucleotide
tcccattcgcccatctcgatatcaccaggttataaa

SEQ ID NO: 78142 - DNA, 36 bp, Artificial Sequence
  Synthetic oligonucleotide
gtcttaggcggttcaactgcaccttcattcaaccaa

SEQ ID NO: 78143 - DNA, 35 bp, Artificial Sequence
  Synthetic oligonucleotide
tagctgaagcactgcgacttaatccgatacaccaa

SEQ ID NO: 78144 - DNA, 36 bp, Artificial Sequence
  Synthetic oligonucleotide
gggaaccgcagcacaccccttatgatatcgctagaa

SEQ ID NO: 78145 - DNA, 36 bp, Artificial Sequence
  Synthetic oligonucleotide
gtactaggagggatggggggcttcttctaataggaa

SEQ ID NO: 78146 - DNA, 36 bp, Artificial Sequence
  Synthetic oligonucleotide
actgcgcgtggacccatcacgcagaccctccctgaa

SEQ ID NO: 78147 - DNA, 36 bp, Artificial Sequence
  Synthetic oligonucleotide
agtatggtgaaggtcggaaagagggggagagtctaa

SEQ ID NO: 78148 - DNA, 36 bp, Artificial Sequence
  Synthetic oligonucleotide
tatttgccgcaatgcgtaactactccgactcccaca

SEQ ID NO: 78149 - DNA, 36 bp, Artificial Sequence
  Synthetic oligonucleotide
tgaacagattctgccgcaacgatgccattctcacca

SEQ ID NO: 78150 - DNA, 36 bp, Artificial Sequence
  Synthetic oligonucleotide
gcacgccatcagcaggatccgctttgactaccccca

SEQ ID NO: 78151 - DNA, 36 bp, Artificial Sequence
  Synthetic oligonucleotide
gttgtctgtcagttcgtaccgcgctcgtacccccca

SEQ ID NO: 78152 - DNA, 36 bp, Artificial Sequence
  Synthetic oligonucleotide
gcaaccaggggacattggaactacggaaccgcatca

SEQ ID NO: 78153 - DNA, 36 bp, Artificial Sequence
  Synthetic oligonucleotide
gttaccccagcttttcttcactgctagccactttca

SEQ ID NO: 78154 - DNA, 37 bp, Artificial Sequence
  Synthetic oligonucleotide
gtagacggaccgctggccccacctagacactcgaaga

SEQ ID NO: 78155 - DNA, 36 bp, Artificial Sequence
  Synthetic oligonucleotide
gaccagccgccgccgcgaggaactacctaatccaga

SEQ ID NO: 78156 - DNA, 36 bp, Artificial Sequence
  Synthetic oligonucleotide
gggggacgggggggatagtaactgtcgcagaagaga

SEQ ID NO: 78157 - DNA, 37 bp, Artificial Sequence
  Synthetic oligonucleotide
tgatggataaggggggggtagaaacgtcagtgtgaga

SEQ ID NO: 78158 - DNA, 37 bp, Artificial Sequence
  Synthetic oligonucleotide
tacacgagacgcaatgaccgtgctctaccaaagacga

SEQ ID NO: 78159 - DNA, 36 bp, Artificial Sequence
  Synthetic oligonucleotide
taccaactaatccggtcagtctcatcttgccgccga

SEQ ID NO: 78160 - DNA, 37 bp, Artificial Sequence
  Synthetic oligonucleotide
gtcagaaccctagacctgctacgccgccatctgccga

SEQ ID NO: 78161 - DNA, 35 bp, Artificial Sequence
  Synthetic oligonucleotide
tcaaagtgggaggagtgcgggtgtagggttgccga

SEQ ID NO: 78162 - DNA, 36 bp, Artificial Sequence
  Synthetic oligonucleotide
gacgaaaggacaggacgggctggaggggtactgcga

SEQ ID NO: 78163 - DNA, 37 bp, Artificial Sequence
  Synthetic oligonucleotide
cacaatgcctcattcccacctgcccactgtcattcga

SEQ ID NO: 78164 - DNA, 37 bp, Artificial Sequence
  Synthetic oligonucleotide
ggtcgggccaggcacaggtgaggggggtgggctcgga

SEQ ID NO: 78165 - DNA, 37 bp, Artificial Sequence
  Synthetic oligonucleotide
gattgcttgccggggagggaggggttggagccaggga

SEQ ID NO: 78166 - DNA, 36 bp, Artificial Sequence
  Synthetic oligonucleotide
gtaccaccacacatccccacgaggtacgcaggggga

SEQ ID NO: 78167 - DNA, 37 bp, Artificial Sequence
  Synthetic oligonucleotide
accacgcgggtggtagggtatactagagagcgtggga

SEQ ID NO: 78168 - DNA, 37 bp, Artificial Sequence
  Synthetic oligonucleotide
gtggtggaggtaacgcagcactcgactcttattggga

SEQ ID NO: 78169 - DNA, 37 bp, Artificial Sequence
  Synthetic oligonucleotide
gccacctaccggtggggttatccgaacacttcctgga

SEQ ID NO: 78170 - DNA, 35 bp, Artificial Sequence
  Synthetic oligonucleotide
aaaagggcggggcatggctggggttcggtggtgga

SEQ ID NO: 78171 - DNA, 38 bp, Artificial Sequence
  Synthetic oligonucleotide
aacgcgagcgcacacgacctgccctcgagaacgcatga

SEQ ID NO: 78172 - DNA, 36 bp, Artificial Sequence
  Synthetic oligonucleotide
aaagggacgggtgcgggcaagcgaggggatagatga

SEQ ID NO: 78173 - DNA, 38 bp, Artificial Sequence
  Synthetic oligonucleotide
acaccttgcaactgcatgttctctcccgtatgggatga

SEQ ID NO: 78174 - DNA, 38 bp, Artificial Sequence
  Synthetic oligonucleotide
acacgtcagttccatgaccttgccggacctaatactga

SEQ ID NO: 78175 - DNA, 38 bp, Artificial Sequence
  Synthetic oligonucleotide
gagagacacgatggcggaggatgtagacggtatactga

SEQ ID NO: 78176 - DNA, 37 bp, Artificial Sequence
  Synthetic oligonucleotide
actgaccggtaagctgttctgcatcactcctgcctga

SEQ ID NO: 78177 - DNA, 38 bp, Artificial Sequence
  Synthetic oligonucleotide
ttgagcaatgccagccgaggcccattacattttcctga

SEQ ID NO: 78178 - DNA, 35 bp, Artificial Sequence
  Synthetic oligonucleotide
atgaaccactctcacccccgtagggtgtcctctga

SEQ ID NO: 78179 - DNA, 38 bp, Artificial Sequence
  Synthetic oligonucleotide
agaaagggtgggtggcaagcagaagggaagggccgtga

SEQ ID NO: 78180 - DNA, 36 bp, Artificial Sequence
  Synthetic oligonucleotide
tgcaaacccatctcttagtatttttgccattcgtga

SEQ ID NO: 78181 - DNA, 37 bp, Artificial Sequence
  Synthetic oligonucleotide
tggaacgtcatacgccatatgcctcttctaccggtga

SEQ ID NO: 78182 - DNA, 38 bp, Artificial Sequence
  Synthetic oligonucleotide
tggggtggtatggggtgggtggcgaatggcacgggtga

SEQ ID NO: 78183 - DNA, 38 bp, Artificial Sequence
  Synthetic oligonucleotide
agtctgagccccccacgttctcgtccccgtaattgtga

SEQ ID NO: 78184 - DNA, 37 bp, Artificial Sequence
  Synthetic oligonucleotide
gcctcaacgcggttgatttgcgtttgtgcccttgtga

SEQ ID NO: 78185 - DNA, 38 bp, Artificial Sequence
  Synthetic oligonucleotide
ttgtaacgcgtgctggtcccgtatgatgcctcgattga

SEQ ID NO: 78186 - DNA, 38 bp, Artificial Sequence
  Synthetic oligonucleotide
gaagacacagccggggtatggggggtgctgggtattga

SEQ ID NO: 78187 - DNA, 38 bp, Artificial Sequence
  Synthetic oligonucleotide
gtacgccaacgggttgaaaccggcccagcacaccttga

SEQ ID NO: 78188 - DNA, 38 bp, Artificial Sequence
  Synthetic oligonucleotide
actgacattgcccagtcggtgattctttttgcccttga

SEQ ID NO: 78189 - DNA, 38 bp, Artificial Sequence
  Synthetic oligonucleotide
gcaggtgcagggaaggtaaaaaaaagcatgagccttga

SEQ ID NO: 78190 - DNA, 37 bp, Artificial Sequence
  Synthetic oligonucleotide
ttgaaagcagggtgtggatgaccatgggggctgttga

SEQ ID NO: 78191 - DNA, 35 bp, Artificial Sequence
  Synthetic oligonucleotide
tccccccgctgtccggacacatcttactagtgata

SEQ ID NO: 78192 - DNA, 36 bp, Artificial Sequence
  Synthetic oligonucleotide
gccatatggccttcacccccgactcgatagcttata

SEQ ID NO: 78193 - DNA, 36 bp, Artificial Sequence
  Synthetic oligonucleotide
tggttcacctctatcatgtaccgccccgaactacta

SEQ ID NO: 78194 - DNA, 35 bp, Artificial Sequence
  Synthetic oligonucleotide
gtacacgcatatatgttaccatggtaatttcgcta

SEQ ID NO: 78195 - DNA, 35 bp, Artificial Sequence
  Synthetic oligonucleotide
aacgggtcgacggggggggtgggcttattccagta

SEQ ID NO: 78196 - DNA, 36 bp, Artificial Sequence
  Synthetic oligonucleotide
agcggtgggcctggggacaaagggtaagctggagta

SEQ ID NO: 78197 - DNA, 36 bp, Artificial Sequence
  Synthetic oligonucleotide
tgacgggtggagaaatttcgagaggtttgggatgta

SEQ ID NO: 78198 - DNA, 35 bp, Artificial Sequence
  Synthetic oligonucleotide
gaccgtccgttcgaccgtcccctgtggtttctgta

SEQ ID NO: 78199 - DNA, 36 bp, Artificial Sequence
  Synthetic oligonucleotide
ttacgtggggggtgggaaggtttttaggatgttgta

SEQ ID NO: 78200 - DNA, 36 bp, Artificial Sequence
  Synthetic oligonucleotide
taccactccgcattttaaacgtctttgactgcatta

SEQ ID NO: 78201 - DNA, 36 bp, Artificial Sequence
  Synthetic oligonucleotide
tcaaaccgcctcacagcgaatataggcctaatatta

SEQ ID NO: 78202 - DNA, 36 bp, Artificial Sequence
  Synthetic oligonucleotide
atgtgccatcctctcctgagacgtcacaccaagtta

SEQ ID NO: 78203 - DNA, 36 bp, Artificial Sequence
  Synthetic oligonucleotide
tacttgcccgcccccaaccagcagtccctacagtta

SEQ ID NO: 78204 - DNA, 36 bp, Artificial Sequence
  Synthetic oligonucleotide
gctacgtatatgcgccgcacaatcccttccacgtta

SEQ ID NO: 78205 - DNA, 35 bp, Artificial Sequence
  Synthetic oligonucleotide
agagtcgagggcaggagcaagtaggtgagagaaac

SEQ ID NO: 78206 - DNA, 35 bp, Artificial Sequence
  Synthetic oligonucleotide
tacactgctcctctatggctatgtcattcgcgaac

SEQ ID NO: 78207 - DNA, 35 bp, Artificial Sequence
  Synthetic oligonucleotide
acttcgccaatacgctgtctattctgtacgcctac

SEQ ID NO: 78208 - DNA, 35 bp, Artificial Sequence
  Synthetic oligonucleotide
gcgccccgcgttcctcccacctcaaaactggctac

SEQ ID NO: 78209 - DNA, 35 bp, Artificial Sequence
  Synthetic oligonucleotide
tgatccttcacattgccacgcccgctttgcgaccc

SEQ ID NO: 78210 - DNA, 35 bp, Artificial Sequence
  Synthetic oligonucleotide
tccggtgccccgaccgggattagcgtggttttccc

SEQ ID NO: 78211 - DNA, 35 bp, Artificial Sequence
  Synthetic oligonucleotide
tcacatagttgctggtccccttaattagtttcagc

SEQ ID NO: 78212 - DNA, 35 bp, Artificial Sequence
  Synthetic oligonucleotide
tacgtcccgcacacttttgatatccttgtccccgc

SEQ ID NO: 78213 - DNA, 35 bp, Artificial Sequence
  Synthetic oligonucleotide
gcctcattcagggcggtaacagtaccgccttccgc

SEQ ID NO: 78214 - DNA, 35 bp, Artificial Sequence
  Synthetic oligonucleotide
agtctgaccatccttcacttttgtgttttattcgc

SEQ ID NO: 78215 - DNA, 35 bp, Artificial Sequence
  Synthetic oligonucleotide
tttcgccattctgtatagtctgccgtctcccaatc

SEQ ID NO: 78216 - DNA, 35 bp, Artificial Sequence
  Synthetic oligonucleotide
tgctaactcactcaccagttctatcggactacatc

SEQ ID NO: 78217 - DNA, 35 bp, Artificial Sequence
  Synthetic oligonucleotide
attctaccggcaccaatgcatttcctctctccatc

SEQ ID NO: 78218 - DNA, 35 bp, Artificial Sequence
  Synthetic oligonucleotide
tgccgatagtgttagctccccgcgtctccagcctc

SEQ ID NO: 78219 - DNA, 35 bp, Artificial Sequence
  Synthetic oligonucleotide
aactggcactcgcaccccgtttaagggtatatctc

SEQ ID NO: 78220 - DNA, 35 bp, Artificial Sequence
  Synthetic oligonucleotide
taactagtacgcagggtaagcataattacaccgtc

SEQ ID NO: 78221 - DNA, 35 bp, Artificial Sequence
  Synthetic oligonucleotide
gccccgttgctggtctactatcctgccatctcgtc

SEQ ID NO: 78222 - DNA, 35 bp, Artificial Sequence
  Synthetic oligonucleotide
gttcaccacaccgctcctactccctgtcacaggtc

SEQ ID NO: 78223 - DNA, 36 bp, Artificial Sequence
  Synthetic oligonucleotide
acgtgggcctccagtggctgctctattgtccttgtc

SEQ ID NO: 78224 - DNA, 35 bp, Artificial Sequence
  Synthetic oligonucleotide
tgctatgaccggggcctgctgaacttgggacgttc

SEQ ID NO: 78225 - DNA, 35 bp, Artificial Sequence
  Synthetic oligonucleotide
gccactaggtaccattgcgacaggatccctccccg

SEQ ID NO: 78226 - DNA, 35 bp, Artificial Sequence
  Synthetic oligonucleotide
agccgcacacgacattactgcaatttagcccgccg

SEQ ID NO: 78227 - DNA, 35 bp, Artificial Sequence
  Synthetic oligonucleotide
ttatggatgagtgggtatatggtttggggggagcg

SEQ ID NO: 78228 - DNA, 35 bp, Artificial Sequence
  Synthetic oligonucleotide
aagggcacaccacgccaaataacttacaaggatcg

SEQ ID NO: 78229 - DNA, 35 bp, Artificial Sequence
  Synthetic oligonucleotide
atcgctgctggttttcttcattaggattccctggg

SEQ ID NO: 78230 - DNA, 35 bp, Artificial Sequence
  Synthetic oligonucleotide
gtggcgatgtagttcgtccctttttcgtatcctgg

SEQ ID NO: 78231 - DNA, 35 bp, Artificial Sequence
  Synthetic oligonucleotide
ggctgccacatcgcattgtctcctcacccgtcctg

SEQ ID NO: 78232 - DNA, 35 bp, Artificial Sequence
  Synthetic oligonucleotide
taggatggaaggagagtgtgggcgggagggaggtg

SEQ ID NO: 78233 - DNA, 35 bp, Artificial Sequence
  Synthetic oligonucleotide
gcatctgaccacgcacacgatcataccccgggaat

SEQ ID NO: 78234 - DNA, 35 bp, Artificial Sequence
  Synthetic oligonucleotide
atgctgcagggagggggtcatgcacattgtttgat

SEQ ID NO: 78235 - DNA, 35 bp, Artificial Sequence
  Synthetic oligonucleotide
tcgtggcatacttaccactgaaaccatcctggact

SEQ ID NO: 78236 - DNA, 34 bp, Artificial Sequence
  Synthetic oligonucleotide
gtcgtgcacagccttcctctaactcacgtatact

SEQ ID NO: 78237 - DNA, 35 bp, Artificial Sequence
  Synthetic oligonucleotide
ggactcgtatctcgccacccccgcttgcttaggct

SEQ ID NO: 78238 - DNA, 35 bp, Artificial Sequence
  Synthetic oligonucleotide
tactgcacgggcagagtagccacccccctcctggt

SEQ ID NO: 78239 - DNA, 35 bp, Artificial Sequence
  Synthetic oligonucleotide
tcccggtcgctgcctgagatcatggcccctttctt

SEQ ID NO: 78240 - DNA, 35 bp, Artificial Sequence
  Synthetic oligonucleotide
tccagctgtggcaccggctactgcttgtatccttt

SEQ ID NO: 78241 - DNA, 35 bp, Artificial Sequence
  Synthetic oligonucleotide
tgactgcccttaatgtattgcctccctttatgttt

SEQ ID NO: 78242 - DNA, 35 bp, Artificial Sequence
  Synthetic oligonucleotide
aagcactcgcattccgtcccttcgatggttctttt

SEQ ID NO: 78243 - DNA, 36 bp, Artificial Sequence
  Synthetic oligonucleotide
ttcttcgctgggcccccttccggacgttgttaacaa

SEQ ID NO: 78244 - DNA, 36 bp, Artificial Sequence
  Synthetic oligonucleotide
ggcccaccccaggtaaactactcatacgcatgcgaa

SEQ ID NO: 78245 - DNA, 35 bp, Artificial Sequence
  Synthetic oligonucleotide
gcatccgcatttgcctgagcctccatcatgtcgaa

SEQ ID NO: 78246 - DNA, 36 bp, Artificial Sequence
  Synthetic oligonucleotide
gaccatgttctggccgcccactgtgccttaccataa

SEQ ID NO: 78247 - DNA, 36 bp, Artificial Sequence
  Synthetic oligonucleotide
acgccccctgacggtatgtcattctatagctcctaa

SEQ ID NO: 78248 - DNA, 35 bp, Artificial Sequence
  Synthetic oligonucleotide
acccctacgttacttgattgacccgcccatacaca

SEQ ID NO: 78249 - DNA, 35 bp, Artificial Sequence
  Synthetic oligonucleotide
gacccgccgtagactggcaggcaaacacactcaca

SEQ ID NO: 78250 - DNA, 36 bp, Artificial Sequence
  Synthetic oligonucleotide
tcgacgggggagggaggaaccaattggcttagtaca

SEQ ID NO: 78251 - DNA, 35 bp, Artificial Sequence
  Synthetic oligonucleotide
gtgaaccgacggggtattttggaggagggtgacca

SEQ ID NO: 78252 - DNA, 36 bp, Artificial Sequence
  Synthetic oligonucleotide
gagttcccatcccgaggctggtctaacgctttacca

SEQ ID NO: 78253 - DNA, 36 bp, Artificial Sequence
  Synthetic oligonucleotide
actgccctcgtagcctgttcgcattcttcagcccca

SEQ ID NO: 78254 - DNA, 36 bp, Artificial Sequence
  Synthetic oligonucleotide
ttccacacctcatgctatgggaccgctcttactcca

SEQ ID NO: 78255 - DNA, 35 bp, Artificial Sequence
  Synthetic oligonucleotide
gtgactccttaggttcatcgcctctgtgcggtcca

SEQ ID NO: 78256 - DNA, 36 bp, Artificial Sequence
  Synthetic oligonucleotide
gcaaacccagcccgacctgcatgtagtctccaagca

SEQ ID NO: 78257 - DNA, 35 bp, Artificial Sequence
  Synthetic oligonucleotide
tgaaccgttctccacacatctcattgacactagca

SEQ ID NO: 78258 - DNA, 36 bp, Artificial Sequence
  Synthetic oligonucleotide
gcacataacgtccactgctttgacccgcttgtcgca

SEQ ID NO: 78259 - DNA, 36 bp, Artificial Sequence
  Synthetic oligonucleotide
tgcacagtaagccgaaccctattaaacacctttgca

SEQ ID NO: 78260 - DNA, 36 bp, Artificial Sequence
  Synthetic oligonucleotide
gaacggagaggagagcgatggtactggttagagtca

SEQ ID NO: 78261 - DNA, 36 bp, Artificial Sequence
  Synthetic oligonucleotide
ttagcacgggtgtgagtgtacagacagaaaggaaga

SEQ ID NO: 78262 - DNA, 35 bp, Artificial Sequence
  Synthetic oligonucleotide
aggacgcgggagggaggggatcaaggtagtggaga

SEQ ID NO: 78263 - DNA, 35 bp, Artificial Sequence
  Synthetic oligonucleotide
tacacatctcttgctatcctcgcctccaggctaga

SEQ ID NO: 78264 - DNA, 36 bp, Artificial Sequence
  Synthetic oligonucleotide
tatgcgatgtagtcgtttacacaccccccctttaga

SEQ ID NO: 78265 - DNA, 35 bp, Artificial Sequence
  Synthetic oligonucleotide
tagcgacatcacggctcgtgttcttcctttttaga

SEQ ID NO: 78266 - DNA, 37 bp, Artificial Sequence
  Synthetic oligonucleotide
gcgacgaagtccacaccgaacatgggccatccaacga

SEQ ID NO: 78267 - DNA, 37 bp, Artificial Sequence
  Synthetic oligonucleotide
gacgatgaccggcggggggttatataggagaccacga

SEQ ID NO: 78268 - DNA, 37 bp, Artificial Sequence
  Synthetic oligonucleotide
ttaccccccctgttgcctaaccatcagccatagacga

SEQ ID NO: 78269 - DNA, 37 bp, Artificial Sequence
  Synthetic oligonucleotide
gccaggtcctgccaacttcacgcagttctacatacga

SEQ ID NO: 78270 - DNA, 37 bp, Artificial Sequence
  Synthetic oligonucleotide
gagcctgcagccatggaacaactctctacacttacga

SEQ ID NO: 78271 - DNA, 37 bp, Artificial Sequence
  Synthetic oligonucleotide
gaggtgtcccagggctctgctatcatgttccttacga

SEQ ID NO: 78272 - DNA, 37 bp, Artificial Sequence
  Synthetic oligonucleotide
acggaacgcaactgagaacgcccgccgtcccacccga

SEQ ID NO: 78273 - DNA, 37 bp, Artificial Sequence
  Synthetic oligonucleotide
gagatcatgcgtgcatccgtcacgagccttcccccga

SEQ ID NO: 78274 - DNA, 37 bp, Artificial Sequence
  Synthetic oligonucleotide
tgagccggtcgttctgctctccagcctattgcttcga

SEQ ID NO: 78275 - DNA, 37 bp, Artificial Sequence
  Synthetic oligonucleotide
gcgggtgggcaagaaataaaaaaggtggaaaaaagga

SEQ ID NO: 78276 - DNA, 36 bp, Artificial Sequence
  Synthetic oligonucleotide
actcagactccctgtccagcactctataccaccgga

SEQ ID NO: 78277 - DNA, 37 bp, Artificial Sequence
  Synthetic oligonucleotide
gcacggtcgttgagacactgggcggggcgaaaaggga

SEQ ID NO: 78278 - DNA, 37 bp, Artificial Sequence
  Synthetic oligonucleotide
attggtatgcatgggaagggattgcggggaggaggga

SEQ ID NO: 78279 - DNA, 37 bp, Artificial Sequence
  Synthetic oligonucleotide
atgcaagtggggtagggggggtcgtgttataacggga

SEQ ID NO: 78280 - DNA, 36 bp, Artificial Sequence
  Synthetic oligonucleotide
atgtaggcctcccatatcgaccggttccttccggga

SEQ ID NO: 78281 - DNA, 35 bp, Artificial Sequence
  Synthetic oligonucleotide
gcgaacatctgcggggaggatcaatactaggggga

SEQ ID NO: 78282 - DNA, 37 bp, Artificial Sequence
  Synthetic oligonucleotide
tcagggagggcttgtgcaggcctctggggatggggga

SEQ ID NO: 78283 - DNA, 37 bp, Artificial Sequence
  Synthetic oligonucleotide
atccagcagagagaaagccagaatatggtgatgggga

SEQ ID NO: 78284 - DNA, 37 bp, Artificial Sequence
  Synthetic oligonucleotide
gactggtcggggaatcctggagaaggggggcttggga

SEQ ID NO: 78285 - DNA, 35 bp, Artificial Sequence
  Synthetic oligonucleotide
gaggtagagcaaggaatcggtagtttaggcgtgga

SEQ ID NO: 78286 - DNA, 37 bp, Artificial Sequence
  Synthetic oligonucleotide
tcccatcgcggatcgtttagctcactactatcttgga

SEQ ID NO: 78287 - DNA, 37 bp, Artificial Sequence
  Synthetic oligonucleotide
gggaggaacgtggtgaaataggcggagggcgtttgga

SEQ ID NO: 78288 - DNA, 38 bp, Artificial Sequence
  Synthetic oligonucleotide
atgcgcaaccgaaccggcccgacgacatgatcaaatga

SEQ ID NO: 78289 - DNA, 38 bp, Artificial Sequence
  Synthetic oligonucleotide
atgcacgggagggcgaaacaaaggggggctaggaatga

SEQ ID NO: 78290 - DNA, 37 bp, Artificial Sequence
  Synthetic oligonucleotide
gttgcgggagccacgtgggaaacgaggaaatccatga

SEQ ID NO: 78291 - DNA, 37 bp, Artificial Sequence
  Synthetic oligonucleotide
acacctcacatcttgccgtgatgactagttatcatga

SEQ ID NO: 78292 - DNA, 37 bp, Artificial Sequence
  Synthetic oligonucleotide
gagaaagacataagggggaaggtacaaatagcgatga

SEQ ID NO: 78293 - DNA, 37 bp, Artificial Sequence
  Synthetic oligonucleotide
gctcgtaccacattactggaccctgcccttactatga

SEQ ID NO: 78294 - DNA, 38 bp, Artificial Sequence
  Synthetic oligonucleotide
atgtagacctccgcttgcttttctgttgttaacactga

SEQ ID NO: 78295 - DNA, 37 bp, Artificial Sequence
  Synthetic oligonucleotide
acgttctgccccatccaaccgcttcagtcagcactga

SEQ ID NO: 78296 - DNA, 38 bp, Artificial Sequence
  Synthetic oligonucleotide
tagtgaaaggaaggatggagaagggcactgaggactga

SEQ ID NO: 78297 - DNA, 38 bp, Artificial Sequence
  Synthetic oligonucleotide
cccgccgtcaccccctaccctcacgcagaaggacctga

SEQ ID NO: 78298 - DNA, 38 bp, Artificial Sequence
  Synthetic oligonucleotide
gacacatagtaaggtgagtggtggtaggggagttctga

SEQ ID NO: 78299 - DNA, 37 bp, Artificial Sequence
  Synthetic oligonucleotide
gcgggaggggaggggaggcgtttagtattctcagtga

SEQ ID NO: 78300 - DNA, 38 bp, Artificial Sequence
  Synthetic oligonucleotide
gaaggggcgtacctgggagttggggacagtggaggtga

SEQ ID NO: 78301 - DNA, 38 bp, Artificial Sequence
  Synthetic oligonucleotide
gatgtggaaccgcctgagaggttgaggggccgtggtga

SEQ ID NO: 78302 - DNA, 38 bp, Artificial Sequence
  Synthetic oligonucleotide
atgtatagcgaaggggtgtagtggggctggaaatgtga

SEQ ID NO: 78303 - DNA, 37 bp, Artificial Sequence
  Synthetic oligonucleotide
gagacaaccgcaaacaaggaaggaatactgactgtga

SEQ ID NO: 78304 - DNA, 37 bp, Artificial Sequence
  Synthetic oligonucleotide
gacaagacggctatcgaacaggacgaacaatctgtga

SEQ ID NO: 78305 - DNA, 36 bp, Artificial Sequence
  Synthetic oligonucleotide
tttgacctccgcccaatgcaccttgacacagtgtga

SEQ ID NO: 78306 - DNA, 38 bp, Artificial Sequence
  Synthetic oligonucleotide
gcgcgttgagggcaagtacgggggacgggggagtgtga

SEQ ID NO: 78307 - DNA, 38 bp, Artificial Sequence
  Synthetic oligonucleotide
ttgctcggtcggattccttgtggcctcttcgtttgtga

SEQ ID NO: 78308 - DNA, 37 bp, Artificial Sequence
  Synthetic oligonucleotide
gtgcacggagaacgctaagggaaggatggcgtattga

SEQ ID NO: 78309 - DNA, 37 bp, Artificial Sequence
  Synthetic oligonucleotide
ttctgcccgatcggctaactatgcgcgtaccccttga

SEQ ID NO: 78310 - DNA, 38 bp, Artificial Sequence
  Synthetic oligonucleotide
aaccgtccggacaccactgcctcagatgcctgccttga

SEQ ID NO: 78311 - DNA, 38 bp, Artificial Sequence
  Synthetic oligonucleotide
gacccccctatcagctcgtgataaccgtaatttcttga

SEQ ID NO: 78312 - DNA, 38 bp, Artificial Sequence
  Synthetic oligonucleotide
gcccctgtcgcacggacccctaagccttgcaactttga

SEQ ID NO: 78313 - DNA, 38 bp, Artificial Sequence
  Synthetic oligonucleotide
aaccaggtgatcgccattggcagacctccatcctttga

SEQ ID NO: 78314 - DNA, 36 bp, Artificial Sequence
  Synthetic oligonucleotide
tgagggtgaaacgaggaaaaggtggagtccgggata

SEQ ID NO: 78315 - DNA, 36 bp, Artificial Sequence
  Synthetic oligonucleotide
gaacaaaaggggaaggaaagccaggaggtttatata

SEQ ID NO: 78316 - DNA, 35 bp, Artificial Sequence
  Synthetic oligonucleotide
aactgacacccgcccgttagagtcggagtctacta

SEQ ID NO: 78317 - DNA, 36 bp, Artificial Sequence
  Synthetic oligonucleotide
atggacccgctgtgatgttgtccgcctatccaccta

SEQ ID NO: 78318 - DNA, 36 bp, Artificial Sequence
  Synthetic oligonucleotide
tattggccttccacatggctcgaactacacgcccta

SEQ ID NO: 78319 - DNA, 36 bp, Artificial Sequence
  Synthetic oligonucleotide
tgcaccccacaagttggcccattgtcaccaaggcta

SEQ ID NO: 78320 - DNA, 35 bp, Artificial Sequence
  Synthetic oligonucleotide
tgacacgccggtctcacctctagctaattagcgta

SEQ ID NO: 78321 - DNA, 36 bp, Artificial Sequence
  Synthetic oligonucleotide
gagacggaggtcgagagttaggagtcgagtggcgta

SEQ ID NO: 78322 - DNA, 36 bp, Artificial Sequence
  Synthetic oligonucleotide
tgccgcaggcgtaatccccctctgtctattcactta

SEQ ID NO: 78323 - DNA, 36 bp, Artificial Sequence
  Synthetic oligonucleotide
aagcactgctgccgtgtagcagggcttagaccttta

SEQ ID NO: 78324 - DNA, 35 bp, Artificial Sequence
  Synthetic oligonucleotide
gccgacctcaacgtcaggtctcctacctcatttta

SEQ ID NO: 78325 - DNA, 35 bp, Artificial Sequence
  Synthetic oligonucleotide
atgccgatcacatcctattcttctgctgtttttta

SEQ ID NO: 78326 - DNA, 35 bp, Artificial Sequence
  Synthetic oligonucleotide
gcaatcggactgcggctggttcattctctcgccac

SEQ ID NO: 78327 - DNA, 35 bp, Artificial Sequence
  Synthetic oligonucleotide
acaccgcacattcgcccacatcctttggaacatac

SEQ ID NO: 78328 - DNA, 36 bp, Artificial Sequence
  Synthetic oligonucleotide
acagtctcgctggtcctccgcctactgcttacgtac

SEQ ID NO: 78329 - DNA, 35 bp, Artificial Sequence
  Synthetic oligonucleotide
acataccagatgaacgatacctactcacgccaacc

SEQ ID NO: 78330 - DNA, 35 bp, Artificial Sequence
  Synthetic oligonucleotide
gtctgcacgtgccgtactgcgtcgtttattccacc

SEQ ID NO: 78331 - DNA, 35 bp, Artificial Sequence
  Synthetic oligonucleotide
acgctcacccgacgccttgtcatcctttgcctacc

SEQ ID NO: 78332 - DNA, 35 bp, Artificial Sequence
  Synthetic oligonucleotide
atacgcgccgcagataagttttgcgcgccaacccc

SEQ ID NO: 78333 - DNA, 35 bp, Artificial Sequence
  Synthetic oligonucleotide
gggaactgccgctgtattcacgctgcgtacgcccc

SEQ ID NO: 78334 - DNA, 35 bp, Artificial Sequence
  Synthetic oligonucleotide
gtacacgtaaggctctgacgctactctagctcccc

SEQ ID NO: 78335 - DNA, 35 bp, Artificial Sequence
  Synthetic oligonucleotide
aagcccgaacggcaacctcatggcacagacctccc

SEQ ID NO: 78336 - DNA, 35 bp, Artificial Sequence
  Synthetic oligonucleotide
agtctaagcagcaccactgtttgaggcctcttccc

SEQ ID NO: 78337 - DNA, 35 bp, Artificial Sequence
  Synthetic oligonucleotide
gagcccgtattttgttgccgatatgcccctcatcc

SEQ ID NO: 78338 - DNA, 35 bp, Artificial Sequence
  Synthetic oligonucleotide
gcaggccttacgtatgccccgaatctctcggatcc

SEQ ID NO: 78339 - DNA, 35 bp, Artificial Sequence
  Synthetic oligonucleotide
gacccttccaccgcccgattcttggccaacgcatc

SEQ ID NO: 78340 - DNA, 35 bp, Artificial Sequence
  Synthetic oligonucleotide
tccagggccaccgatgacgaacgtaagtcaatatc

SEQ ID NO: 78341 - DNA, 35 bp, Artificial Sequence
  Synthetic oligonucleotide
aactgcgatggacgaggccatcggtatttcttctc

SEQ ID NO: 78342 - DNA, 35 bp, Artificial Sequence
  Synthetic oligonucleotide
agtcactcgtgcggagggtggagtgggagatcgtc

SEQ ID NO: 78343 - DNA, 35 bp, Artificial Sequence
  Synthetic oligonucleotide
aataccgcgttcgcacggacaacatacgactcttc

SEQ ID NO: 78344 - DNA, 35 bp, Artificial Sequence
  Synthetic oligonucleotide
tgtccaatcccttcgttgcattttagaaactgttc

SEQ ID NO: 78345 - DNA, 35 bp, Artificial Sequence
  Synthetic oligonucleotide
tgccaacacgtgtcccgctgtttttcttgtttttc

SEQ ID NO: 78346 - DNA, 35 bp, Artificial Sequence
  Synthetic oligonucleotide
agtaaacgaacgtggttagggggagcgaaggagag

SEQ ID NO: 78347 - DNA, 35 bp, Artificial Sequence
  Synthetic oligonucleotide
ttcgtgtgtgccccccctctgttgataccgagacg

SEQ ID NO: 78348 - DNA, 35 bp, Artificial Sequence
  Synthetic oligonucleotide
gagtgaacgtcactatgcatttttttgggtcacgg

SEQ ID NO: 78349 - DNA, 35 bp, Artificial Sequence
  Synthetic oligonucleotide
tgatcgggacaagtgggggtacgttttctctaggg

SEQ ID NO: 78350 - DNA, 35 bp, Artificial Sequence
  Synthetic oligonucleotide
gaagctccctgaacctttttaccattgacgcatgg

SEQ ID NO: 78351 - DNA, 35 bp, Artificial Sequence
  Synthetic oligonucleotide
taaacggggacaggaattgaggatggttagcgtgg

SEQ ID NO: 78352 - DNA, 35 bp, Artificial Sequence
  Synthetic oligonucleotide
gttcctgtctgtccgccaattaatacttgctcctg

SEQ ID NO: 78353 - DNA, 35 bp, Artificial Sequence
  Synthetic oligonucleotide
ttgacgtgcacttcgactgctgcgtaacgctaact

SEQ ID NO: 78354 - DNA, 35 bp, Artificial Sequence
  Synthetic oligonucleotide
ttacggatcagcccgccacaagaaacgtgtctcct

SEQ ID NO: 78355 - DNA, 35 bp, Artificial Sequence
  Synthetic oligonucleotide
tacgttgcctaccccatctatgctcctggttccgt

SEQ ID NO: 78356 - DNA, 35 bp, Artificial Sequence
  Synthetic oligonucleotide
taaatacccaccgtacagcccgcaaatcaactggt

SEQ ID NO: 78357 - DNA, 35 bp, Artificial Sequence
  Synthetic oligonucleotide
tgttccgttacactcctatctgcctgtgcacttgt

SEQ ID NO: 78358 - DNA, 35 bp, Artificial Sequence
  Synthetic oligonucleotide
ttgcgcagtctgcaccggtcatcgttgttccttgt

SEQ ID NO: 78359 - DNA, 35 bp, Artificial Sequence
  Synthetic oligonucleotide
ttcacgacgggtccacgaaggtgccgtactccatt

SEQ ID NO: 78360 - DNA, 35 bp, Artificial Sequence
  Synthetic oligonucleotide
tatacccggtgcctgccttattgaaaatacctgtt

SEQ ID NO: 78361 - DNA, 35 bp, Artificial Sequence
  Synthetic oligonucleotide
tatgactcaggccccaatgccaatgcaccaaattt

SEQ ID NO: 78362 - DNA, 35 bp, Artificial Sequence
  Synthetic oligonucleotide
gatgcgccgtccccacctcgctggacattcaattt

SEQ ID NO: 78363 - DNA, 36 bp, Artificial Sequence
  Synthetic oligonucleotide
gcgcgagtactcagcgccctgctctttacacttaaa

SEQ ID NO: 78364 - DNA, 36 bp, Artificial Sequence
  Synthetic oligonucleotide
tcactagcgccctctaaacctgcagctgccccccaa

SEQ ID NO: 78365 - DNA, 36 bp, Artificial Sequence
  Synthetic oligonucleotide
atcgcctgtcgtaatgtcctctggcaacccaccgaa

SEQ ID NO: 78366 - DNA, 35 bp, Artificial Sequence
  Synthetic oligonucleotide
gaccactctacgacgtcgtaaacttttttcctgaa

SEQ ID NO: 78367 - DNA, 36 bp, Artificial Sequence
  Synthetic oligonucleotide
ggcccgggccgatgccgtcactcgcttccctgttaa

SEQ ID NO: 78368 - DNA, 35 bp, Artificial Sequence
  Synthetic oligonucleotide
gtgaaatcaccactggatccgtaccatgtaacaca

SEQ ID NO: 78369 - DNA, 36 bp, Artificial Sequence
  Synthetic oligonucleotide
gttgctgccacattaggtctactttttttctccaca

SEQ ID NO: 78370 - DNA, 36 bp, Artificial Sequence
  Synthetic oligonucleotide
gtcgatcagtgccacatgaatgcctagccactacca

SEQ ID NO: 78371 - DNA, 35 bp, Artificial Sequence
  Synthetic oligonucleotide
tgcacatctctatctcattgaccttacctgaccca

SEQ ID NO: 78372 - DNA, 35 bp, Artificial Sequence
  Synthetic oligonucleotide
gacgtaggtccaaccgagtgagtagccttatgcca

SEQ ID NO: 78373 - DNA, 36 bp, Artificial Sequence
  Synthetic oligonucleotide
acgcacgtttgtctgttacctgcctagtcctctcca

SEQ ID NO: 78374 - DNA, 36 bp, Artificial Sequence
  Synthetic oligonucleotide
tacacgatgtggtgcaattaactaccctgccttcca

SEQ ID NO: 78375 - DNA, 36 bp, Artificial Sequence
  Synthetic oligonucleotide
ataccccttcagtgacccgcattacgtgatcttcca

SEQ ID NO: 78376 - DNA, 36 bp, Artificial Sequence
  Synthetic oligonucleotide
atgccaatttagctcccggcgcccgtacatttcgca

SEQ ID NO: 78377 - DNA, 35 bp, Artificial Sequence
  Synthetic oligonucleotide
tcagcccactaccgaccacccgcgctccacctgca

SEQ ID NO: 78378 - DNA, 36 bp, Artificial Sequence
  Synthetic oligonucleotide
tgcccccggcactcccccgtgtgtagatttcctgca

SEQ ID NO: 78379 - DNA, 35 bp, Artificial Sequence
  Synthetic oligonucleotide
gtgttgcgactcatgccggcttctacatactatca

SEQ ID NO: 78380 - DNA, 36 bp, Artificial Sequence
  Synthetic oligonucleotide
gcgcattgaaccgttgaccctgtgccctttcgctca

SEQ ID NO: 78381 - DNA, 35 bp, Artificial Sequence
  Synthetic oligonucleotide
aagctaccacacgcgagttgacgctatttacttca

SEQ ID NO: 78382 - DNA, 35 bp, Artificial Sequence
  Synthetic oligonucleotide
gtacgcctcccttgatgatcttgcgggtatcttca

SEQ ID NO: 78383 - DNA, 36 bp, Artificial Sequence
  Synthetic oligonucleotide
aacgcctcaacacattctgcaggagagggtagttca

SEQ ID NO: 78384 - DNA, 36 bp, Artificial Sequence
  Synthetic oligonucleotide
atcgtatcaccccctagatccgtggtcacactttca

SEQ ID NO: 78385 - DNA, 37 bp, Artificial Sequence
  Synthetic oligonucleotide
attgaaaagggatacagagaggggacaggacacaaga

SEQ ID NO: 78386 - DNA, 37 bp, Artificial Sequence
  Synthetic oligonucleotide
tccggatcgcagttcgtttttgaccccccatctaaga

SEQ ID NO: 78387 - DNA, 37 bp, Artificial Sequence
  Synthetic oligonucleotide
ggatgcagaggtagaggccggaagggatggatacaga

SEQ ID NO: 78388 - DNA, 37 bp, Artificial Sequence
  Synthetic oligonucleotide
gcccaccatgtggacccccccgcattacacctcgaga

SEQ ID NO: 78389 - DNA, 37 bp, Artificial Sequence
  Synthetic oligonucleotide
aagggatggggaaaacgggatattggtacgagtgaga

SEQ ID NO: 78390 - DNA, 37 bp, Artificial Sequence
  Synthetic oligonucleotide
gtagcgggggtggtaggtgttagtagcgtaggataga

SEQ ID NO: 78391 - DNA, 37 bp, Artificial Sequence
  Synthetic oligonucleotide
acatccgctccacctaccctcgtcatgtgatagtaga

SEQ ID NO: 78392 - DNA, 37 bp, Artificial Sequence
  Synthetic oligonucleotide
atgttcccgccccagacgtggggagttatattgccga

SEQ ID NO: 78393 - DNA, 36 bp, Artificial Sequence
  Synthetic oligonucleotide
tcgcagagtacatctgcacacttattcccgctccga

SEQ ID NO: 78394 - DNA, 37 bp, Artificial Sequence
  Synthetic oligonucleotide
gtccgccgtaggttccaggcgggccactttcttccga

SEQ ID NO: 78395 - DNA, 37 bp, Artificial Sequence
  Synthetic oligonucleotide
cccctgccatctacgctgagaagaagcccgttcgcga

SEQ ID NO: 78396 - DNA, 37 bp, Artificial Sequence
  Synthetic oligonucleotide
tgtgaggaaatgtgtggggtgtggcgtgtatcggcga

SEQ ID NO: 78397 - DNA, 37 bp, Artificial Sequence
  Synthetic oligonucleotide
tgacgccgatgtgcggccctctgcaccccctattcga

SEQ ID NO: 78398 - DNA, 36 bp, Artificial Sequence
  Synthetic oligonucleotide
gaggactgaggctgtttgtaaaacaaggcaaaagga

SEQ ID NO: 78399 - DNA, 37 bp, Artificial Sequence
  Synthetic oligonucleotide
taggttacgaatgggggtagaacggctaaaatgagga

SEQ ID NO: 78400 - DNA, 37 bp, Artificial Sequence
  Synthetic oligonucleotide
attctcgcgggcgtatactctttgcctaccctccgga

SEQ ID NO: 78401 - DNA, 37 bp, Artificial Sequence
  Synthetic oligonucleotide
gtagacagggagagatggagggtacgtagcgcgcgga

SEQ ID NO: 78402 - DNA, 37 bp, Artificial Sequence
  Synthetic oligonucleotide
tcaaggggcgggagggaatgccgcattacggaaggga

SEQ ID NO: 78403 - DNA, 37 bp, Artificial Sequence
  Synthetic oligonucleotide
gcgatggccacagtgagatccgaggattggatgggga

SEQ ID NO: 78404 - DNA, 36 bp, Artificial Sequence
  Synthetic oligonucleotide
gggaggggaaaaatgaggtggagtaaagattgggga

SEQ ID NO: 78405 - DNA, 37 bp, Artificial Sequence
  Synthetic oligonucleotide
gcactgaaccggaaaatgggagtggtggagtggtgga

SEQ ID NO: 78406 - DNA, 37 bp, Artificial Sequence
  Synthetic oligonucleotide
gatcaacgggccggatgctgtctgaacgggtggtgga

SEQ ID NO: 78407 - DNA, 37 bp, Artificial Sequence
  Synthetic oligonucleotide
tgaaagagatggaatgggtagttaggatgggattgga

SEQ ID NO: 78408 - DNA, 37 bp, Artificial Sequence
  Synthetic oligonucleotide
ttgcacccgacaggatgcgcttcagctcaattttgga

SEQ ID NO: 78409 - DNA, 38 bp, Artificial Sequence
  Synthetic oligonucleotide
aaagggagtgacgctgctaagatgagcggtgaaaatga

SEQ ID NO: 78410 - DNA, 38 bp, Artificial Sequence
  Synthetic oligonucleotide
ttacgcagcacgccttatgtctgtcttcttggccatga

SEQ ID NO: 78411 - DNA, 37 bp, Artificial Sequence
  Synthetic oligonucleotide
tgatcttgtccaccacctgttatcgtacatggcatga

SEQ ID NO: 78412 - DNA, 38 bp, Artificial Sequence
  Synthetic oligonucleotide
ttagccacctgccaccatctgtccatacctcgcactga

SEQ ID NO: 78413 - DNA, 38 bp, Artificial Sequence
  Synthetic oligonucleotide
gcgctgcaccgctagtgaactcgaacaccgcttcctga

SEQ ID NO: 78414 - DNA, 37 bp, Artificial Sequence
  Synthetic oligonucleotide
agtcgacgcacatctctactctctcatttcgatctga

SEQ ID NO: 78415 - DNA, 38 bp, Artificial Sequence
  Synthetic oligonucleotide
agctggatgtgacaggtatgatagggcaggtgcagtga

SEQ ID NO: 78416 - DNA, 38 bp, Artificial Sequence
  Synthetic oligonucleotide
gatgcaagggtgcggggataggtcacgggggaccgtga

SEQ ID NO: 78417 - DNA, 38 bp, Artificial Sequence
  Synthetic oligonucleotide
gaccccccgccgccggtcgttattgccctctctcgtga

SEQ ID NO: 78418 - DNA, 37 bp, Artificial Sequence
  Synthetic oligonucleotide
tagcgggggaatgactagtggaggtactacggggtga

SEQ ID NO: 78419 - DNA, 38 bp, Artificial Sequence
  Synthetic oligonucleotide
acggggtgcagcaagggcgacattggggtggtgggtga

SEQ ID NO: 78420 - DNA, 38 bp, Artificial Sequence
  Synthetic oligonucleotide
tgtggtgcctccttcatggctttaaaatgcccgcttga

SEQ ID NO: 78421 - DNA, 37 bp, Artificial Sequence
  Synthetic oligonucleotide
gacagagatcaccatgagagggaaaagacaatgttga

SEQ ID NO: 78422 - DNA, 38 bp, Artificial Sequence
  Synthetic oligonucleotide
ggttgagggtgtgacgggggggagaaggatcctgttga

SEQ ID NO: 78423 - DNA, 38 bp, Artificial Sequence
  Synthetic oligonucleotide
gactgaggacggattaggagttggctgtttggtgttga

SEQ ID NO: 78424 - DNA, 38 bp, Artificial Sequence
  Synthetic oligonucleotide
ggtggtgggttgggaaagggtatctgggaaattgttga

SEQ ID NO: 78425 - DNA, 37 bp, Artificial Sequence
  Synthetic oligonucleotide
tcgcccttccgcctctcaatgtatgggcctgatttga

SEQ ID NO: 78426 - DNA, 38 bp, Artificial Sequence
  Synthetic oligonucleotide
aaccaccatcacttcccgcaagacacaggtcgttttga

SEQ ID NO: 78427 - DNA, 36 bp, Artificial Sequence
  Synthetic oligonucleotide
tttgctcctctgccccgaaaggacgtctttcggata

SEQ ID NO: 78428 - DNA, 36 bp, Artificial Sequence
  Synthetic oligonucleotide
tacgtgcgtgcttattccgcgcggtccttccccgta

SEQ ID NO: 78429 - DNA, 35 bp, Artificial Sequence
  Synthetic oligonucleotide
gagacacgctggttacctgtttttgatttattgta

SEQ ID NO: 78430 - DNA, 35 bp, Artificial Sequence
  Synthetic oligonucleotide
aatgcgagggagcgaattgcgtgctaccctcctta

SEQ ID NO: 78431 - DNA, 35 bp, Artificial Sequence
  Synthetic oligonucleotide
tggtatgcccaggcattccttcacttgtcctacac

SEQ ID NO: 78432 - DNA, 35 bp, Artificial Sequence
  Synthetic oligonucleotide
gccacacatagtgtctgtatatccaacacctccac

SEQ ID NO: 78433 - DNA, 38 bp, Artificial Sequence
  Synthetic oligonucleotide
ggaaggggccgaggggcgataggggttacctagtagac

SEQ ID NO: 78434 - DNA, 35 bp, Artificial Sequence
  Synthetic oligonucleotide
tcaccggtcgctgttcagttcctcctctggactac

SEQ ID NO: 78435 - DNA, 35 bp, Artificial Sequence
  Synthetic oligonucleotide
tgtcccacaccgggcatgggctacaacttcgaacc

SEQ ID NO: 78436 - DNA, 35 bp, Artificial Sequence
  Synthetic oligonucleotide
tccggtccaaggcaatatcggttcccctcctaccc

SEQ ID NO: 78437 - DNA, 34 bp, Artificial Sequence
  Synthetic oligonucleotide
gtgaggcccattttcagcgatttgtcggtccccc

SEQ ID NO: 78438 - DNA, 35 bp, Artificial Sequence
  Synthetic oligonucleotide
tcttccacgaccagaatcaatcccctaatgtgccc

SEQ ID NO: 78439 - DNA, 35 bp, Artificial Sequence
  Synthetic oligonucleotide
gtttggggcggaggacctggccactttcatctccc

SEQ ID NO: 78440 - DNA, 35 bp, Artificial Sequence
  Synthetic oligonucleotide
tcacccaactggggtgttgctcattatactacgcc

SEQ ID NO: 78441 - DNA, 35 bp, Artificial Sequence
  Synthetic oligonucleotide
tatgtctgagcgggtagggagggcggcatgatgcc

SEQ ID NO: 78442 - DNA, 35 bp, Artificial Sequence
  Synthetic oligonucleotide
acccagactgggcaaagctggttaccattcactcc

SEQ ID NO: 78443 - DNA, 35 bp, Artificial Sequence
  Synthetic oligonucleotide
tatggccaacccctagtagtatcatctgaagttcc

SEQ ID NO: 78444 - DNA, 35 bp, Artificial Sequence
  Synthetic oligonucleotide
tacctgcaccgaggcccctgacttctttctcaagc

SEQ ID NO: 78445 - DNA, 35 bp, Artificial Sequence
  Synthetic oligonucleotide
tcagcgttaacccaagcccaccgcgcccctccagc

SEQ ID NO: 78446 - DNA, 35 bp, Artificial Sequence
  Synthetic oligonucleotide
tccaccatccgcgctgactccgcttattgccccgc

SEQ ID NO: 78447 - DNA, 35 bp, Artificial Sequence
  Synthetic oligonucleotide
taccatagtccatttcgtcctcttgattcgcccgc

SEQ ID NO: 78448 - DNA, 35 bp, Artificial Sequence
  Synthetic oligonucleotide
tcccaactcatagcactcgagccaggtacactggc

SEQ ID NO: 78449 - DNA, 35 bp, Artificial Sequence
  Synthetic oligonucleotide
gacctatactcagcttacggcactgcctggccctc

SEQ ID NO: 78450 - DNA, 35 bp, Artificial Sequence
  Synthetic oligonucleotide
gagtaggccctaccaatcccccgtgagaaatgctc

SEQ ID NO: 78451 - DNA, 35 bp, Artificial Sequence
  Synthetic oligonucleotide
ttgccacttgtacggtattcgttgtaccgctgctc

SEQ ID NO: 78452 - DNA, 35 bp, Artificial Sequence
  Synthetic oligonucleotide
atgcaccgcatcgtacgtagcccatggtgttagtc

SEQ ID NO: 78453 - DNA, 35 bp, Artificial Sequence
  Synthetic oligonucleotide
atatggcacaggggggcgaaggaagggtcatcgtc

SEQ ID NO: 78454 - DNA, 35 bp, Artificial Sequence
  Synthetic oligonucleotide
aaaacacgctgggggtcgaacggaccaaggtcgtc

SEQ ID NO: 78455 - DNA, 35 bp, Artificial Sequence
  Synthetic oligonucleotide
gtagtcccggggcaccatcacctgatctaaaggtc

SEQ ID NO: 78456 - DNA, 35 bp, Artificial Sequence
  Synthetic oligonucleotide
ttccaccatagactgttgccttgctgttttcggtc

SEQ ID NO: 78457 - DNA, 35 bp, Artificial Sequence
  Synthetic oligonucleotide
tcgagtcgtcgaccgtgcgctcaatgctctcattc

SEQ ID NO: 78458 - DNA, 35 bp, Artificial Sequence
  Synthetic oligonucleotide
gtgtgtgaccacatgccatggtgttttattccccg

SEQ ID NO: 78459 - DNA, 35 bp, Artificial Sequence
  Synthetic oligonucleotide
atccgcctaccctatgtctgggtccttcgtgcccg

SEQ ID NO: 78460 - DNA, 35 bp, Artificial Sequence
  Synthetic oligonucleotide
accggatccaacacccatacgtgcatacgcctccg

SEQ ID NO: 78461 - DNA, 35 bp, Artificial Sequence
  Synthetic oligonucleotide
tcttggcccccctgttggcagtgaccgtaacatcg

SEQ ID NO: 78462 - DNA, 35 bp, Artificial Sequence
  Synthetic oligonucleotide
actgagcgaatgggcgataaaaagtagataggagg

SEQ ID NO: 78463 - DNA, 35 bp, Artificial Sequence
  Synthetic oligonucleotide
gccgggcgacggggtgtgtgggaagtaggtaaggg

SEQ ID NO: 78464 - DNA, 35 bp, Artificial Sequence
  Synthetic oligonucleotide
agagggacagggaactggagggcaatgtattaggg

SEQ ID NO: 78465 - DNA, 35 bp, Artificial Sequence
  Synthetic oligonucleotide
gctcgtctagtgcctgtcctaactctcgccacctg

SEQ ID NO: 78466 - DNA, 35 bp, Artificial Sequence
  Synthetic oligonucleotide
aacatcctgccccccactccgacgccgaacgcctg

SEQ ID NO: 78467 - DNA, 35 bp, Artificial Sequence
  Synthetic oligonucleotide
gtatccgacacacgcccgttggttctcatctgcct

SEQ ID NO: 78468 - DNA, 35 bp, Artificial Sequence
  Synthetic oligonucleotide
tcagatgcctccaaatctgatcgtttccttcagct

SEQ ID NO: 78469 - DNA, 35 bp, Artificial Sequence
  Synthetic oligonucleotide
tcgcacgtatcacctgtttctccccggcccacgct

SEQ ID NO: 78470 - DNA, 35 bp, Artificial Sequence
  Synthetic oligonucleotide
aactcccgcgccgattttgcgggctcgtttcatct

SEQ ID NO: 78471 - DNA, 35 bp, Artificial Sequence
  Synthetic oligonucleotide
gaggtgtaggggtgcatggttggctcttttttagt

SEQ ID NO: 78472 - DNA, 35 bp, Artificial Sequence
  Synthetic oligonucleotide
atggcccgctcgctctggaaacctcctcctatggt

SEQ ID NO: 78473 - DNA, 35 bp, Artificial Sequence
  Synthetic oligonucleotide
ttagtgccgcaaatcctatggctctgaactctatt

SEQ ID NO: 78474 - DNA, 35 bp, Artificial Sequence
  Synthetic oligonucleotide
agtgagggggggacgggaggtggcatgtgtttatt

SEQ ID NO: 78475 - DNA, 35 bp, Artificial Sequence
  Synthetic oligonucleotide
tgaccacggccatactgccggcggtcaaacccctt

SEQ ID NO: 78476 - DNA, 35 bp, Artificial Sequence
  Synthetic oligonucleotide
tgtgtaccgctctagggctttgctttgttaatctt

SEQ ID NO: 78477 - DNA, 35 bp, Artificial Sequence
  Synthetic oligonucleotide
tcgcgctgtgcaccttctcgtccgttcacttcgtt

SEQ ID NO: 78478 - DNA, 35 bp, Artificial Sequence
  Synthetic oligonucleotide
gacctccacgcctgtccgtcgtcatctccgaggtt

SEQ ID NO: 78479 - DNA, 35 bp, Artificial Sequence
  Synthetic oligonucleotide
actgacagtcggggaccagtcgccgtagccctttt

SEQ ID NO: 78480 - DNA, 36 bp, Artificial Sequence
  Synthetic oligonucleotide
tagctagccgagtagtacacggcttcctctaccaaa

SEQ ID NO: 78481 - DNA, 36 bp, Artificial Sequence
  Synthetic oligonucleotide
ttgcggacatgttggtaggacacggtggggtgcaaa

SEQ ID NO: 78482 - DNA, 36 bp, Artificial Sequence
  Synthetic oligonucleotide
tcaccaccactttgtctagaacctaggcccggccaa

SEQ ID NO: 78483 - DNA, 36 bp, Artificial Sequence
  Synthetic oligonucleotide
acagtcacacaaaccatgcagacactgaccttccaa

SEQ ID NO: 78484 - DNA, 36 bp, Artificial Sequence
  Synthetic oligonucleotide
gttgggagcatcgctcgtcactagatattccatcaa

SEQ ID NO: 78485 - DNA, 36 bp, Artificial Sequence
  Synthetic oligonucleotide
tgctctgcccttgcccttgccctcgcgccggttcaa

SEQ ID NO: 78486 - DNA, 36 bp, Artificial Sequence
  Synthetic oligonucleotide
tccacagcctggcatccaaggcacctattctcggaa

SEQ ID NO: 78487 - DNA, 36 bp, Artificial Sequence
  Synthetic oligonucleotide
tagtacccgcgcaattgtcaattctcctgcgttgaa

SEQ ID NO: 78488 - DNA, 35 bp, Artificial Sequence
  Synthetic oligonucleotide
gcctcaacccgtctgcctttcgacccctggttgaa

SEQ ID NO: 78489 - DNA, 36 bp, Artificial Sequence
  Synthetic oligonucleotide
tactcccattgcagcgtacctaattatacctgctaa

SEQ ID NO: 78490 - DNA, 35 bp, Artificial Sequence
  Synthetic oligonucleotide
gatccaaccactgcgtgtacctgtttggctgttaa

SEQ ID NO: 78491 - DNA, 36 bp, Artificial Sequence
  Synthetic oligonucleotide
gtgacaaggcacttggagggtggtggcaggataaca

SEQ ID NO: 78492 - DNA, 36 bp, Artificial Sequence
  Synthetic oligonucleotide
tcctgtagctccccatcgttagccttttcgaacaca

SEQ ID NO: 78493 - DNA, 36 bp, Artificial Sequence
  Synthetic oligonucleotide
gccctggtacctttgtttaaaacccgacttctacca

SEQ ID NO: 78494 - DNA, 35 bp, Artificial Sequence
  Synthetic oligonucleotide
atccattgcccgggattcttcttaacacccagcca

SEQ ID NO: 78495 - DNA, 36 bp, Artificial Sequence
  Synthetic oligonucleotide
ttggagacactttccataccgtgtacaacctagcca

SEQ ID NO: 78496 - DNA, 36 bp, Artificial Sequence
  Synthetic oligonucleotide
tctgtacccgacagaacttatattcactcgcatcca

SEQ ID NO: 78497 - DNA, 36 bp, Artificial Sequence
  Synthetic oligonucleotide
atccccccgtgcaacctccgacgtcttgacgtagca

SEQ ID NO: 78498 - DNA, 35 bp, Artificial Sequence
  Synthetic oligonucleotide
gccgcctgaactgatcatgaccgtctcgtgtggca

SEQ ID NO: 78499 - DNA, 35 bp, Artificial Sequence
  Synthetic oligonucleotide
tgcgaatctaggcgcttctcgtctctcccgactca

SEQ ID NO: 78500 - DNA, 36 bp, Artificial Sequence
  Synthetic oligonucleotide
tctccgctgccagcccttagaaattcgtatcgctca

SEQ ID NO: 78501 - DNA, 36 bp, Artificial Sequence
  Synthetic oligonucleotide
gacaccctgtttggacactcttggacctttatctca

SEQ ID NO: 78502 - DNA, 36 bp, Artificial Sequence
  Synthetic oligonucleotide
tactctcccacgcatgtgaattctatcttgggttca

SEQ ID NO: 78503 - DNA, 36 bp, Artificial Sequence
  Synthetic oligonucleotide
gaccccctccctacttgacagttaagatgacagaga

SEQ ID NO: 78504 - DNA, 37 bp, Artificial Sequence
  Synthetic oligonucleotide
agagagggggggacatatgggatgtgtgcgggtgaga

SEQ ID NO: 78505 - DNA, 37 bp, Artificial Sequence
  Synthetic oligonucleotide
gcgaaccatcctgtgagctcactcttcatgtcataga

SEQ ID NO: 78506 - DNA, 37 bp, Artificial Sequence
  Synthetic oligonucleotide
taactcgccccgccgtactggttgcctttccattaga

SEQ ID NO: 78507 - DNA, 37 bp, Artificial Sequence
  Synthetic oligonucleotide
gtgcatcccccggcctgttcacacctgtcgtccacga

SEQ ID NO: 78508 - DNA, 37 bp, Artificial Sequence
  Synthetic oligonucleotide
tccatagtccgtgatgccagtgcacttccctcgacga

SEQ ID NO: 78509 - DNA, 37 bp, Artificial Sequence
  Synthetic oligonucleotide
gacacagcctggcctgtattgctgcagtaacatccga

SEQ ID NO: 78510 - DNA, 36 bp, Artificial Sequence
  Synthetic oligonucleotide
gtacccgcccatacaaagcgattcgcccattcgcga

SEQ ID NO: 78511 - DNA, 37 bp, Artificial Sequence
  Synthetic oligonucleotide
tcgcgcttcacatcccgatccgcatcactccctgcga

SEQ ID NO: 78512 - DNA, 37 bp, Artificial Sequence
  Synthetic oligonucleotide
gccgtggcacgtgatgcgagaattcctggacgctcga

SEQ ID NO: 78513 - DNA, 37 bp, Artificial Sequence
  Synthetic oligonucleotide
gtccacgaagtatggtagggcacttccacggagagga

SEQ ID NO: 78514 - DNA, 37 bp, Artificial Sequence
  Synthetic oligonucleotide
gacctccgccggtcacattaacagtcacgagggagga

SEQ ID NO: 78515 - DNA, 36 bp, Artificial Sequence
  Synthetic oligonucleotide
gcccgtcctctctgcctccgtccaagtctatccgga

SEQ ID NO: 78516 - DNA, 37 bp, Artificial Sequence
  Synthetic oligonucleotide
tatacacacccgttgccgaaaagaccaggttctcgga

SEQ ID NO: 78517 - DNA, 37 bp, Artificial Sequence
  Synthetic oligonucleotide
aagaggggaagcaatgagaggtgcgtgctgacgggga

SEQ ID NO: 78518 - DNA, 37 bp, Artificial Sequence
  Synthetic oligonucleotide
ggtgggggcgaggtaattgactctgacgggggtggga

SEQ ID NO: 78519 - DNA, 37 bp, Artificial Sequence
  Synthetic oligonucleotide
acgtggactcatgccttcaaaccctgttccgttggga

SEQ ID NO: 78520 - DNA, 37 bp, Artificial Sequence
  Synthetic oligonucleotide
gagccgcaactctggtaggcaactttatcttcctgga

SEQ ID NO: 78521 - DNA, 37 bp, Artificial Sequence
  Synthetic oligonucleotide
gatgggcgaataaaggggggagggtttcgggtctgga

SEQ ID NO: 78522 - DNA, 37 bp, Artificial Sequence
  Synthetic oligonucleotide
gacacccttctaacgcccaactggacatgtctgtgga

SEQ ID NO: 78523 - DNA, 38 bp, Artificial Sequence
  Synthetic oligonucleotide
gagagccggaggggttttacgatggtgcgtggaaatga

SEQ ID NO: 78524 - DNA, 38 bp, Artificial Sequence
  Synthetic oligonucleotide
aaacgggttggaggggatgaagggagaggagagaatga

SEQ ID NO: 78525 - DNA, 37 bp, Artificial Sequence
  Synthetic oligonucleotide
tagacgaagcctcccgttaactgccttgatcgaatga

SEQ ID NO: 78526 - DNA, 37 bp, Artificial Sequence
  Synthetic oligonucleotide
attgctgcgagcggttggtaggtgtttgggggaatga

SEQ ID NO: 78527 - DNA, 38 bp, Artificial Sequence
  Synthetic oligonucleotide
gccgcctccagggcgactaaccactcattcttgaatga

SEQ ID NO: 78528 - DNA, 38 bp, Artificial Sequence
  Synthetic oligonucleotide
gactacgccatcaccggttatttatgcgacgcccatga

SEQ ID NO: 78529 - DNA, 37 bp, Artificial Sequence
  Synthetic oligonucleotide
ggggctgagggggcggggcgagggaagtaggccatga

SEQ ID NO: 78530 - DNA, 38 bp, Artificial Sequence
  Synthetic oligonucleotide
acgatgggaatggtgtatgctaagggatacggggatga

SEQ ID NO: 78531 - DNA, 38 bp, Artificial Sequence
  Synthetic oligonucleotide
agtcgacatggagaagcgggaggcacgggagttgatga

SEQ ID NO: 78532 - DNA, 38 bp, Artificial Sequence
  Synthetic oligonucleotide
tcacgtcaccttattcagccgcgtgtaccctttgatga

SEQ ID NO: 78533 - DNA, 38 bp, Artificial Sequence
  Synthetic oligonucleotide
ttgagcccgcccccaagacgtcaaaaaggatcttatga

SEQ ID NO: 78534 - DNA, 38 bp, Artificial Sequence
  Synthetic oligonucleotide
aaccccatccttggtctccaccctgccagttgaactga

SEQ ID NO: 78535 - DNA, 38 bp, Artificial Sequence
  Synthetic oligonucleotide
gtgttcgtccctggccatagacctaccgctaccactga

SEQ ID NO: 78536 - DNA, 37 bp, Artificial Sequence
  Synthetic oligonucleotide
accaaccgtcccttgcggtaccacgttcttctactga

SEQ ID NO: 78537 - DNA, 38 bp, Artificial Sequence
  Synthetic oligonucleotide
atgtccgccctccgagtagtatcaatcctgcttactga

SEQ ID NO: 78538 - DNA, 38 bp, Artificial Sequence
  Synthetic oligonucleotide
tgaccacagccctccatgcaagtttgatgatcacctga

SEQ ID NO: 78539 - DNA, 35 bp, Artificial Sequence
  Synthetic oligonucleotide
aaacccatcgtcccccgttatactaccctctctga

SEQ ID NO: 78540 - DNA, 38 bp, Artificial Sequence
  Synthetic oligonucleotide
gagtatgccatgaggagaggggaggagttagcgcgtga

SEQ ID NO: 78541 - DNA, 38 bp, Artificial Sequence
  Synthetic oligonucleotide
gggactgtcgcccgtctaaggcctcccctctctcgtga

SEQ ID NO: 78542 - DNA, 38 bp, Artificial Sequence
  Synthetic oligonucleotide
aactagcagcattgttaggaaaggggttggagaggtga

SEQ ID NO: 78543 - DNA, 38 bp, Artificial Sequence
  Synthetic oligonucleotide
tacgcgggtggtgaagacgggagggctagttgttgtga

SEQ ID NO: 78544 - DNA, 38 bp, Artificial Sequence
  Synthetic oligonucleotide
tccgcatgggcctgtttcaccgtattcactagcattga

SEQ ID NO: 78545 - DNA, 37 bp, Artificial Sequence
  Synthetic oligonucleotide
gtcaggcgcaaccctgccagccgcctttctaccttga

SEQ ID NO: 78546 - DNA, 38 bp, Artificial Sequence
  Synthetic oligonucleotide
gcctgccggggtacctgtggggctattcctttgcttga

SEQ ID NO: 78547 - DNA, 37 bp, Artificial Sequence
  Synthetic oligonucleotide
gcttgcccacctgcttccctaacgtcaggtctgttga

SEQ ID NO: 78548 - DNA, 37 bp, Artificial Sequence
  Synthetic oligonucleotide
gatcgaacactgacaaccctgtattgcaaccatttga

SEQ ID NO: 78549 - DNA, 38 bp, Artificial Sequence
  Synthetic oligonucleotide
aacgcgaatgtcagctatcggcctctcacatcctttga

SEQ ID NO: 78550 - DNA, 35 bp, Artificial Sequence
  Synthetic oligonucleotide
gcgtgtgccggggggtgggagggtgctatggcata

SEQ ID NO: 78551 - DNA, 35 bp, Artificial Sequence
  Synthetic oligonucleotide
tccgcactatcctgcaccatcgattgaagttcata

SEQ ID NO: 78552 - DNA, 36 bp, Artificial Sequence
  Synthetic oligonucleotide
actgccgtgtgatccgccttccttgcacgtttcata

SEQ ID NO: 78553 - DNA, 37 bp, Artificial Sequence
  Synthetic oligonucleotide
tgcgaccccgcgcgagtgcgatccctccccctgccta

SEQ ID NO: 78554 - DNA, 36 bp, Artificial Sequence
  Synthetic oligonucleotide
gtctgcggccgtcacccgtcccctccggttcctgta

SEQ ID NO: 78555 - DNA, 35 bp, Artificial Sequence
  Synthetic oligonucleotide
gacaagggcacaatagtagcgtcaacttatcatta

SEQ ID NO: 78556 - DNA, 35 bp, Artificial Sequence
  Synthetic oligonucleotide
tgttgcctcactgccgctacagtattccctctcac

SEQ ID NO: 78557 - DNA, 38 bp, Artificial Sequence
  Synthetic oligonucleotide
actgtgcataccagccgggccaaaattcaagtaatgac

SEQ ID NO: 78558 - DNA, 35 bp, Artificial Sequence
  Synthetic oligonucleotide
accccggggtctttcaattctgagcgcaccatacc

SEQ ID NO: 78559 - DNA, 35 bp, Artificial Sequence
  Synthetic oligonucleotide
tacaactcgcctatcgtaggcgtcatggacccccc

SEQ ID NO: 78560 - DNA, 35 bp, Artificial Sequence
  Synthetic oligonucleotide
gctccaccgcactgttttccgttacctcgcttccc

SEQ ID NO: 78561 - DNA, 35 bp, Artificial Sequence
  Synthetic oligonucleotide
cccatccgcctgttacctggccaatacattcatcc

SEQ ID NO: 78562 - DNA, 35 bp, Artificial Sequence
  Synthetic oligonucleotide
acctgtaccactggtcgtaacctcgaggttcatcc

SEQ ID NO: 78563 - DNA, 35 bp, Artificial Sequence
  Synthetic oligonucleotide
gtgatcccgcgattgaattctgcgcaagcttatcc

SEQ ID NO: 78564 - DNA, 35 bp, Artificial Sequence
  Synthetic oligonucleotide
tgctccaccgcacctgatagttccttttcaccagc

SEQ ID NO: 78565 - DNA, 35 bp, Artificial Sequence
  Synthetic oligonucleotide
tagttcccaccggtcgaaaattttggtgctcccgc

SEQ ID NO: 78566 - DNA, 35 bp, Artificial Sequence
  Synthetic oligonucleotide
tagtccccccactcacttgcggttcgtatgttcgc

SEQ ID NO: 78567 - DNA, 35 bp, Artificial Sequence
  Synthetic oligonucleotide
tgctcatgtgctcgattttcttccaacgaacttgc

SEQ ID NO: 78568 - DNA, 35 bp, Artificial Sequence
  Synthetic oligonucleotide
gtacagcggtagctgcttccttttcctgtgcaatc

SEQ ID NO: 78569 - DNA, 35 bp, Artificial Sequence
  Synthetic oligonucleotide
gacggtctggaggctctcaaccacggtcacccatc

SEQ ID NO: 78570 - DNA, 35 bp, Artificial Sequence
  Synthetic oligonucleotide
gaatggtcgtcgcgtaggccatgtacgtttccctc

SEQ ID NO: 78571 - DNA, 35 bp, Artificial Sequence
  Synthetic oligonucleotide
acagtggaacgtaagttccgcgcttatatgttctc

SEQ ID NO: 78572 - DNA, 35 bp, Artificial Sequence
  Synthetic oligonucleotide
acctcacgaagtttcgagtgttttactcatctttc

SEQ ID NO: 78573 - DNA, 35 bp, Artificial Sequence
  Synthetic oligonucleotide
agcccacactggtgctgtaatcattttctcgatag

SEQ ID NO: 78574 - DNA, 35 bp, Artificial Sequence
  Synthetic oligonucleotide
gtcatcgcctcattgcattttcctttgtagtaccg

SEQ ID NO: 78575 - DNA, 35 bp, Artificial Sequence
  Synthetic oligonucleotide
gtgcctagcgcagccacgccctcctaaccacctcg

SEQ ID NO: 78576 - DNA, 35 bp, Artificial Sequence
  Synthetic oligonucleotide
gtcatccccccgacaacgagtatttgccataaagg

SEQ ID NO: 78577 - DNA, 35 bp, Artificial Sequence
  Synthetic oligonucleotide
gttacggagaagtgggaggaattgaaatgattggg

SEQ ID NO: 78578 - DNA, 35 bp, Artificial Sequence
  Synthetic oligonucleotide
gtgcccccgggatactcattggacttcactaatgg

SEQ ID NO: 78579 - DNA, 35 bp, Artificial Sequence
  Synthetic oligonucleotide
atcctgctctatctagtgtacgtgcgctgactttg

SEQ ID NO: 78580 - DNA, 35 bp, Artificial Sequence
  Synthetic oligonucleotide
gctgtttgctcggcgccaccatcttgcctatcgat

SEQ ID NO: 78581 - DNA, 35 bp, Artificial Sequence
  Synthetic oligonucleotide
gaagggtcatgtggggtaccatcgctcattcctat

SEQ ID NO: 78582 - DNA, 34 bp, Artificial Sequence
  Synthetic oligonucleotide
accaaacctccgagagggctatttagataccact

SEQ ID NO: 78583 - DNA, 35 bp, Artificial Sequence
  Synthetic oligonucleotide
tgctacacagcctactgacatctaagtctaccact

SEQ ID NO: 78584 - DNA, 35 bp, Artificial Sequence
  Synthetic oligonucleotide
gtggaccctcactatattcgttcaaggcctcccct

SEQ ID NO: 78585 - DNA, 35 bp, Artificial Sequence
  Synthetic oligonucleotide
acaataccgcgtatgcatatccaccggtctgccct

SEQ ID NO: 78586 - DNA, 35 bp, Artificial Sequence
  Synthetic oligonucleotide
tgatctgtcggggagggggtagggccagtggagct

SEQ ID NO: 78587 - DNA, 35 bp, Artificial Sequence
  Synthetic oligonucleotide
gtatgccggtccaccacctttgtttcggtctatct

SEQ ID NO: 78588 - DNA, 35 bp, Artificial Sequence
  Synthetic oligonucleotide
gtgagacgaggcgggatagggtgactagtacgtct

SEQ ID NO: 78589 - DNA, 35 bp, Artificial Sequence
  Synthetic oligonucleotide
ttggcccgcaatgtccatccttgggcgcgttttct

SEQ ID NO: 78590 - DNA, 35 bp, Artificial Sequence
  Synthetic oligonucleotide
gccgacttcggagccttcctggtagttcttttagt

SEQ ID NO: 78591 - DNA, 35 bp, Artificial Sequence
  Synthetic oligonucleotide
gtgtggtgggtttagggagggagtctctgtatggt

SEQ ID NO: 78592 - DNA, 35 bp, Artificial Sequence
  Synthetic oligonucleotide
acccacttagttacccctgcgctgagcaccgctgt

SEQ ID NO: 78593 - DNA, 35 bp, Artificial Sequence
  Synthetic oligonucleotide
tcatcaatgggatgggaagggagtaaacagcgctt

SEQ ID NO: 78594 - DNA, 35 bp, Artificial Sequence
  Synthetic oligonucleotide
tacaggtcgtaggctaggtccgttagctcctcttt

SEQ ID NO: 78595 - DNA, 35 bp, Artificial Sequence
  Synthetic oligonucleotide
acctgaggacgaggttataaagcgggggtcggttt

SEQ ID NO: 78596 - DNA, 36 bp, Artificial Sequence
  Synthetic oligonucleotide
tcccagtgtgcacgccttctaatagggcctctacaa

SEQ ID NO: 78597 - DNA, 36 bp, Artificial Sequence
  Synthetic oligonucleotide
tgcttcaccatcatccagtcgttgcatatcaggcaa

SEQ ID NO: 78598 - DNA, 35 bp, Artificial Sequence
  Synthetic oligonucleotide
gtgctaagcacgagcaatcggggatcattttgcaa

SEQ ID NO: 78599 - DNA, 36 bp, Artificial Sequence
  Synthetic oligonucleotide
gagccggctcgcatcccatcatacctccgtgcggaa

SEQ ID NO: 78600 - DNA, 36 bp, Artificial Sequence
  Synthetic oligonucleotide
accaactctgtccacttccgctacataatgccgtaa

SEQ ID NO: 78601 - DNA, 36 bp, Artificial Sequence
  Synthetic oligonucleotide
ggtcaccgctcgccaacactctcgttgtccccgaca

SEQ ID NO: 78602 - DNA, 36 bp, Artificial Sequence
  Synthetic oligonucleotide
actcccacgcccgagaattcaacacatctatttaca

SEQ ID NO: 78603 - DNA, 35 bp, Artificial Sequence
  Synthetic oligonucleotide
aataaccacgtagtagacctacaacgacacaacca

SEQ ID NO: 78604 - DNA, 35 bp, Artificial Sequence
  Synthetic oligonucleotide
atttggcgccacctcattgcagtcccgccatccca

SEQ ID NO: 78605 - DNA, 36 bp, Artificial Sequence
  Synthetic oligonucleotide
tcaacggattcgctggtcgccgccttttgaatgcca

SEQ ID NO: 78606 - DNA, 35 bp, Artificial Sequence
  Synthetic oligonucleotide
tcatcttcaactcgttataccatgtcctgaatcca

SEQ ID NO: 78607 - DNA, 36 bp, Artificial Sequence
  Synthetic oligonucleotide
atgcctgacatagtctgagcgccctttcgaactcca

SEQ ID NO: 78608 - DNA, 36 bp, Artificial Sequence
  Synthetic oligonucleotide
acccgacgttaccaattacgtattcactgccttcca

SEQ ID NO: 78609 - DNA, 36 bp, Artificial Sequence
  Synthetic oligonucleotide
agcagcacaaccactcctcaataggtctccgttgca

SEQ ID NO: 78610 - DNA, 35 bp, Artificial Sequence
  Synthetic oligonucleotide
attgtcggactctgccaaatacgcgctttccatca

SEQ ID NO: 78611 - DNA, 36 bp, Artificial Sequence
  Synthetic oligonucleotide
gacgagcctcatggagcatttagttatgatctctca

SEQ ID NO: 78612 - DNA, 36 bp, Artificial Sequence
  Synthetic oligonucleotide
tacactacccgctagcctctaggggattcattctca

SEQ ID NO: 78613 - DNA, 36 bp, Artificial Sequence
  Synthetic oligonucleotide
tcaccgtgacgaaactggcctccatccacagtgtca

SEQ ID NO: 78614 - DNA, 36 bp, Artificial Sequence
  Synthetic oligonucleotide
tactagccccggatgcagccctggatctacgcttca

SEQ ID NO: 78615 - DNA, 36 bp, Artificial Sequence
  Synthetic oligonucleotide
gctacatgtacctgcccagaaaacccggctatttca

SEQ ID NO: 78616 - DNA, 37 bp, Artificial Sequence
  Synthetic oligonucleotide
gccaggggcacggggatgtctcaaaggcttgagcaga

SEQ ID NO: 78617 - DNA, 37 bp, Artificial Sequence
  Synthetic oligonucleotide
tatgagggggggttctgaggggctgactgagacgaga

SEQ ID NO: 78618 - DNA, 36 bp, Artificial Sequence
  Synthetic oligonucleotide
agatgacgaaggatggctgagatatgggcacggaga

SEQ ID NO: 78619 - DNA, 37 bp, Artificial Sequence
  Synthetic oligonucleotide
gaggggaccgctgaactactgacccgaccaattgaga

SEQ ID NO: 78620 - DNA, 35 bp, Artificial Sequence
  Synthetic oligonucleotide
tacgtggggttatgtaaggggggtggtagtataga

SEQ ID NO: 78621 - DNA, 36 bp, Artificial Sequence
  Synthetic oligonucleotide
aacacgtaatgtgaaactgccctgcccccacgtaga

SEQ ID NO: 78622 - DNA, 36 bp, Artificial Sequence
  Synthetic oligonucleotide
tgtcctgccccacctgtctcctgtcacataccacga

SEQ ID NO: 78623 - DNA, 37 bp, Artificial Sequence
  Synthetic oligonucleotide
ttacggtgccagctgtcacgttactctgccctcacga

SEQ ID NO: 78624 - DNA, 36 bp, Artificial Sequence
  Synthetic oligonucleotide
tccttgccgcaccatcggatcacctgcctagcccga

SEQ ID NO: 78625 - DNA, 37 bp, Artificial Sequence
  Synthetic oligonucleotide
gctgacccagccccgagcacgcgtatgccacgcccga

SEQ ID NO: 78626 - DNA, 36 bp, Artificial Sequence
  Synthetic oligonucleotide
agatcgcccggccataaaccgactccgcttctccga

SEQ ID NO: 78627 - DNA, 37 bp, Artificial Sequence
  Synthetic oligonucleotide
ttgcccgcctatacaatttatcagctccgccgatcga

SEQ ID NO: 78628 - DNA, 35 bp, Artificial Sequence
  Synthetic oligonucleotide
tcacctcaagccgagcgtattgctgctgaactcga

SEQ ID NO: 78629 - DNA, 37 bp, Artificial Sequence
  Synthetic oligonucleotide
gtccacctatccgcatcgatatgcagaaatgcaagga

SEQ ID NO: 78630 - DNA, 37 bp, Artificial Sequence
  Synthetic oligonucleotide
gaactgctgccagacataaatcgcctgacccacagga

SEQ ID NO: 78631 - DNA, 36 bp, Artificial Sequence
  Synthetic oligonucleotide
gagacaccacgattcacaccctcctcgtatggagga

SEQ ID NO: 78632 - DNA, 36 bp, Artificial Sequence
  Synthetic oligonucleotide
agtataacaggagagggaaaggggactgaaatagga

SEQ ID NO: 78633 - DNA, 38 bp, Artificial Sequence
  Synthetic oligonucleotide
tcctccgcgtgcaccacagactcaccactcgattcgga

SEQ ID NO: 78634 - DNA, 37 bp, Artificial Sequence
  Synthetic oligonucleotide
tacactgagggcggtacgagcgttgggtccagcggga

SEQ ID NO: 78635 - DNA, 37 bp, Artificial Sequence
  Synthetic oligonucleotide
ggtgggtggttcaggatatattggctggcattgggga

SEQ ID NO: 78636 - DNA, 37 bp, Artificial Sequence
  Synthetic oligonucleotide
ttactccgttcgccctttgacctgcccccgtgtggga

SEQ ID NO: 78637 - DNA, 36 bp, Artificial Sequence
  Synthetic oligonucleotide
ttcgctaccggttgccatctaccacatcgtgtggga

SEQ ID NO: 78638 - DNA, 35 bp, Artificial Sequence
  Synthetic oligonucleotide
ttgtccggccccacctccacaaacgttagtatgga

SEQ ID NO: 78639 - DNA, 36 bp, Artificial Sequence
  Synthetic oligonucleotide
gcactcaggaaaagaaggcggtgcaatcgaactgga

SEQ ID NO: 78640 - DNA, 37 bp, Artificial Sequence
  Synthetic oligonucleotide
tcagtgggggggcggttacgggaaaggaggtcttgga

SEQ ID NO: 78641 - DNA, 38 bp, Artificial Sequence
  Synthetic oligonucleotide
ggacacctcttctcgacctatataagccgccgctatga

SEQ ID NO: 78642 - DNA, 38 bp, Artificial Sequence
  Synthetic oligonucleotide
agcacgtacgccttcacacccaggccatcttagactga

SEQ ID NO: 78643 - DNA, 38 bp, Artificial Sequence
  Synthetic oligonucleotide
gctcgcctctagcttcccagaaccgatcccttacctga

SEQ ID NO: 78644 - DNA, 38 bp, Artificial Sequence
  Synthetic oligonucleotide
atgacacctgtaccatttgattattcgtcctctagtga

SEQ ID NO: 78645 - DNA, 37 bp, Artificial Sequence
  Synthetic oligonucleotide
ataccccccatgtgcatataacccgatgtttacgtga

SEQ ID NO: 78646 - DNA, 38 bp, Artificial Sequence
  Synthetic oligonucleotide
aagtctcgcaaatcccatcagccacctgtcgcccgtga

SEQ ID NO: 78647 - DNA, 38 bp, Artificial Sequence
  Synthetic oligonucleotide
tacgaagtgcaccgatccccacacccgtctccaggtga

SEQ ID NO: 78648 - DNA, 38 bp, Artificial Sequence
  Synthetic oligonucleotide
tttggggccctgtcatcgtggggggagatttggggtga

SEQ ID NO: 78649 - DNA, 37 bp, Artificial Sequence
  Synthetic oligonucleotide
gggacgaagaagggcaaggaagtcagaatcagtgtga

SEQ ID NO: 78650 - DNA, 37 bp, Artificial Sequence
  Synthetic oligonucleotide
accacctgcatcaccgggaaacatcgatcggcattga

SEQ ID NO: 78651 - DNA, 36 bp, Artificial Sequence
  Synthetic oligonucleotide
attgtacttccaccgctataggtgtcctctcattga

SEQ ID NO: 78652 - DNA, 37 bp, Artificial Sequence
  Synthetic oligonucleotide
atgctggtgaggaggggatggttgatcaacggattga

SEQ ID NO: 78653 - DNA, 36 bp, Artificial Sequence
  Synthetic oligonucleotide
ttaaccgttcacctgtatgttccacctgtggcttga

SEQ ID NO: 78654 - DNA, 38 bp, Artificial Sequence
  Synthetic oligonucleotide
gcccgcggcacggaggagtgagggggtcatctagttga

SEQ ID NO: 78655 - DNA, 37 bp, Artificial Sequence
  Synthetic oligonucleotide
ttagcccctgagcgcatggcgattctgctcttgttga

SEQ ID NO: 78656 - DNA, 38 bp, Artificial Sequence
  Synthetic oligonucleotide
gattctgcgccgactagcctcgcctgctcaaattttga

SEQ ID NO: 78657 - DNA, 38 bp, Artificial Sequence
  Synthetic oligonucleotide
agacgcaggtcggaatgcacgcgttctgcactttttga

SEQ ID NO: 78658 - DNA, 36 bp, Artificial Sequence
  Synthetic oligonucleotide
atgtactgtaggcacatccaatccataaggacgata

SEQ ID NO: 78659 - DNA, 36 bp, Artificial Sequence
  Synthetic oligonucleotide
gatcactcgctcttctctaaagtctacttgctccta

SEQ ID NO: 78660 - DNA, 36 bp, Artificial Sequence
  Synthetic oligonucleotide
gatccagatcgccgttgcggattgggagtccctcta

SEQ ID NO: 78661 - DNA, 35 bp, Artificial Sequence
  Synthetic oligonucleotide
ccaccacgcgcatcacctggagcctcttagctcta

SEQ ID NO: 78662 - DNA, 36 bp, Artificial Sequence
  Synthetic oligonucleotide
ttcacctgacctggagtactttatgtaacctttcta

SEQ ID NO: 78663 - DNA, 35 bp, Artificial Sequence
  Synthetic oligonucleotide
gagtacgacctgccgctacggaacgcttattcgta

SEQ ID NO: 78664 - DNA, 36 bp, Artificial Sequence
  Synthetic oligonucleotide
aggggcgacgcccgggtaggggaacaatagggggta

SEQ ID NO: 78665 - DNA, 36 bp, Artificial Sequence
  Synthetic oligonucleotide
gatcgcaggcgttagttccatgggcctcctgttgta

SEQ ID NO: 78666 - DNA, 36 bp, Artificial Sequence
  Synthetic oligonucleotide
gattcgccgcattgcgcctcccgcccatatagctta

SEQ ID NO: 78667 - DNA, 36 bp, Artificial Sequence
  Synthetic oligonucleotide
gtggccctaccaattgcacgtcatcgaactagttta

SEQ ID NO: 78668 - DNA, 35 bp, Artificial Sequence
  Synthetic oligonucleotide
cccacccacccctacgcaccggcgtatccagcaac

SEQ ID NO: 78669 - DNA, 35 bp, Artificial Sequence
  Synthetic oligonucleotide
tcacactgggacctacattgacattagtctgcaac

SEQ ID NO: 78670 - DNA, 35 bp, Artificial Sequence
  Synthetic oligonucleotide
tcacatctggggccaacctatctgacgtggtgaac

SEQ ID NO: 78671 - DNA, 35 bp, Artificial Sequence
  Synthetic oligonucleotide
attcccgttcgagtccttctacactgctaccccac

SEQ ID NO: 78672 - DNA, 35 bp, Artificial Sequence
  Synthetic oligonucleotide
gagggcacccctgtgttattactaccttcatccac

SEQ ID NO: 78673 - DNA, 35 bp, Artificial Sequence
  Synthetic oligonucleotide
aacggccccctctacacaacaactgccagtcgcac

SEQ ID NO: 78674 - DNA, 35 bp, Artificial Sequence
  Synthetic oligonucleotide
tgcgtagtctgacagctcgtactacctttcctcac

SEQ ID NO: 78675 - DNA, 35 bp, Artificial Sequence
  Synthetic oligonucleotide
agcaagcccacccgtggcagttcctaacccccgac

SEQ ID NO: 78676 - DNA, 35 bp, Artificial Sequence
  Synthetic oligonucleotide
tgttcatgattagggggagggagggtagacgcgac

SEQ ID NO: 78677 - DNA, 35 bp, Artificial Sequence
  Synthetic oligonucleotide
acccaagcggtactccttgctaacaatacgatgac

SEQ ID NO: 78678 - DNA, 35 bp, Artificial Sequence
  Synthetic oligonucleotide
tagcccactcagtacgcgccgcacacaatggaacc

SEQ ID NO: 78679 - DNA, 35 bp, Artificial Sequence
  Synthetic oligonucleotide
gtgctttgccagcgcatgtcttcccgtcttacacc

SEQ ID NO: 78680 - DNA, 35 bp, Artificial Sequence
  Synthetic oligonucleotide
atgccggagggaggtgtacttcctttgctgctacc

SEQ ID NO: 78681 - DNA, 35 bp, Artificial Sequence
  Synthetic oligonucleotide
tgtagctacacagccatccaagttccctcttcccc

SEQ ID NO: 78682 - DNA, 35 bp, Artificial Sequence
  Synthetic oligonucleotide
tgctagcctcaatcgtctaaattttatcctccgcc

SEQ ID NO: 78683 - DNA, 35 bp, Artificial Sequence
  Synthetic oligonucleotide
tctacaggctgctgctccaaggcaacgcaccctcc

SEQ ID NO: 78684 - DNA, 35 bp, Artificial Sequence
  Synthetic oligonucleotide
aaatgggagcccccgtctctaatcatcgccgaatc

SEQ ID NO: 78685 - DNA, 35 bp, Artificial Sequence
  Synthetic oligonucleotide
acctatccctcacgacaatttcattagacgtagtc

SEQ ID NO: 78686 - DNA, 35 bp, Artificial Sequence
  Synthetic oligonucleotide
gccgtgccggaacctggtatgggcccgcacttttc

SEQ ID NO: 78687 - DNA, 35 bp, Artificial Sequence
  Synthetic oligonucleotide
gaaggcatgatcatgcctatcttatactagttttc

SEQ ID NO: 78688 - DNA, 35 bp, Artificial Sequence
  Synthetic oligonucleotide
gtgtggtcggtgggacgcaggaggcacagtgaaag

SEQ ID NO: 78689 - DNA, 35 bp, Artificial Sequence
  Synthetic oligonucleotide
cgagggtgggaaggccagtttggggcagaagggcg

SEQ ID NO: 78690 - DNA, 35 bp, Artificial Sequence
  Synthetic oligonucleotide
accacttcacgatccgcaccaaaacgcgttactcg

SEQ ID NO: 78691 - DNA, 35 bp, Artificial Sequence
  Synthetic oligonucleotide
gtccgcacctcctgtcctggcaaaccacgctgggg

SEQ ID NO: 78692 - DNA, 35 bp, Artificial Sequence
  Synthetic oligonucleotide
atcccaacatcattgcaagttgtccatgccgctgg

SEQ ID NO: 78693 - DNA, 35 bp, Artificial Sequence
  Synthetic oligonucleotide
tgagtcgcacctcgtttgtctctgcctttttcatg

SEQ ID NO: 78694 - DNA, 35 bp, Artificial Sequence
  Synthetic oligonucleotide
atcatcatcgaactgctcttgggctggtaaccctg

SEQ ID NO: 78695 - DNA, 35 bp, Artificial Sequence
  Synthetic oligonucleotide
gcacgtgcgccatccccgttcctctgtactgtctg

SEQ ID NO: 78696 - DNA, 35 bp, Artificial Sequence
  Synthetic oligonucleotide
tcgtaggggcaacggaggagtaagggggaaaattg

SEQ ID NO: 78697 - DNA, 34 bp, Artificial Sequence
  Synthetic oligonucleotide
tgtgcattctgcccctgtaaccttaagctccttg

SEQ ID NO: 78698 - DNA, 35 bp, Artificial Sequence
  Synthetic oligonucleotide
tgtgtcatctccggagtctatgctcgctcttccct

SEQ ID NO: 78699 - DNA, 35 bp, Artificial Sequence
  Synthetic oligonucleotide
acctaaccagtcccgtcccttgtggttctcaatct

SEQ ID NO: 78700 - DNA, 35 bp, Artificial Sequence
  Synthetic oligonucleotide
gcaacacacgagttgaaatcctctccgagacgtct

SEQ ID NO: 78701 - DNA, 35 bp, Artificial Sequence
  Synthetic oligonucleotide
taacatcactcgaacctaatcgcaccagacacagt

SEQ ID NO: 78702 - DNA, 35 bp, Artificial Sequence
  Synthetic oligonucleotide
tgtctcggccaggaaaccgtcattactttcgccgt

SEQ ID NO: 78703 - DNA, 35 bp, Artificial Sequence
  Synthetic oligonucleotide
gaatctatagggggagttcatgagcggaatggggt

SEQ ID NO: 78704 - DNA, 35 bp, Artificial Sequence
  Synthetic oligonucleotide
ttcggatggcaggagaattgcgtcggggggtgggt

SEQ ID NO: 78705 - DNA, 35 bp, Artificial Sequence
  Synthetic oligonucleotide
tcagacacgacaatgagtggaaggtgtaagaatgt

SEQ ID NO: 78706 - DNA, 35 bp, Artificial Sequence
  Synthetic oligonucleotide
atccaccacagccaatctgcccctgccaccattgt

SEQ ID NO: 78707 - DNA, 35 bp, Artificial Sequence
  Synthetic oligonucleotide
gaccacggtggtatcctgcattggtctgcttaatt

SEQ ID NO: 78708 - DNA, 35 bp, Artificial Sequence
  Synthetic oligonucleotide
attgcgcgttatgaacatgctcctgtcctgccatt

SEQ ID NO: 78709 - DNA, 35 bp, Artificial Sequence
  Synthetic oligonucleotide
gatcctgccggaattctcatccatatgccacgctt

SEQ ID NO: 78710 - DNA, 35 bp, Artificial Sequence
  Synthetic oligonucleotide
tcaacaggggggggcgcggaatgaagcgattgttt

SEQ ID NO: 78711 - DNA, 35 bp, Artificial Sequence
  Synthetic oligonucleotide
tatcatcccctggtttggtttcattagcctgtttt

SEQ ID NO: 78712 - DNA, 35 bp, Artificial Sequence
  Synthetic oligonucleotide
gtctgcaggcgcctacattccgtgctcgttttttt

SEQ ID NO: 78713 - DNA, 36 bp, Artificial Sequence
  Synthetic oligonucleotide
taaccaccgtccaatatgccttcggcttgcaaccaa

SEQ ID NO: 78714 - DNA, 36 bp, Artificial Sequence
  Synthetic oligonucleotide
ggattgtcagccgatttactgattccaccacctcaa

SEQ ID NO: 78715 - DNA, 36 bp, Artificial Sequence
  Synthetic oligonucleotide
gggtccccgcaatcaatgccaaactcgcactttcaa

SEQ ID NO: 78716 - DNA, 36 bp, Artificial Sequence
  Synthetic oligonucleotide
tcagagcgcagcacgccccgggagtctccgtttcaa

SEQ ID NO: 78717 - DNA, 35 bp, Artificial Sequence
  Synthetic oligonucleotide
tgcgatagccgggggggagtaggggagcttacgaa

SEQ ID NO: 78718 - DNA, 35 bp, Artificial Sequence
  Synthetic oligonucleotide
gacacatacggactgcctcttaacactttggcgaa

SEQ ID NO: 78719 - DNA, 35 bp, Artificial Sequence
  Synthetic oligonucleotide
attgccacctccgccttccaagtccgcccctcgaa

SEQ ID NO: 78720 - DNA, 36 bp, Artificial Sequence
  Synthetic oligonucleotide
tgacgggcttcgttcgcccattgcactttcccctaa

SEQ ID NO: 78721 - DNA, 36 bp, Artificial Sequence
  Synthetic oligonucleotide
acccttgtacatggccctcacgactgtttcgggtaa

SEQ ID NO: 78722 - DNA, 36 bp, Artificial Sequence
  Synthetic oligonucleotide
tcatcgataccacccgcgtcccgattacacttgaca

SEQ ID NO: 78723 - DNA, 35 bp, Artificial Sequence
  Synthetic oligonucleotide
gccctgcaccaattgacgcaccgtaaatcccacca

SEQ ID NO: 78724 - DNA, 36 bp, Artificial Sequence
  Synthetic oligonucleotide
gctctacggctaataccatctaagccactccaccca

SEQ ID NO: 78725 - DNA, 36 bp, Artificial Sequence
  Synthetic oligonucleotide
tcgccgtcgggttcgtcatttccctgtcgtttgcca

SEQ ID NO: 78726 - DNA, 34 bp, Artificial Sequence
  Synthetic oligonucleotide
tgtccaacctaccttggctttttacatgacagca

SEQ ID NO: 78727 - DNA, 35 bp, Artificial Sequence
  Synthetic oligonucleotide
tgacgcacaacgttccaatcaggcgaatcctctca

SEQ ID NO: 78728 - DNA, 36 bp, Artificial Sequence
  Synthetic oligonucleotide
gacttccattcgcgatctccatcatagtgctgttca

SEQ ID NO: 78729 - DNA, 37 bp, Artificial Sequence
  Synthetic oligonucleotide
aacttcccctccatgtgctctgttctggtctcgaaga

SEQ ID NO: 78730 - DNA, 37 bp, Artificial Sequence
  Synthetic oligonucleotide
gtcgcacgccatcacggtgcgctccacctccaaccga

SEQ ID NO: 78731 - DNA, 37 bp, Artificial Sequence
  Synthetic oligonucleotide
aagtggatcacacgttattgcccgtccccacccccga

SEQ ID NO: 78732 - DNA, 37 bp, Artificial Sequence
  Synthetic oligonucleotide
ttggaggcacccgacatattggctatatttcccccga

SEQ ID NO: 78733 - DNA, 37 bp, Artificial Sequence
  Synthetic oligonucleotide
aagtcccaaggcgtcctgacctcccatttgaacgcga

SEQ ID NO: 78734 - DNA, 35 bp, Artificial Sequence
  Synthetic oligonucleotide
gtcggggggccatggagtaaggggctgaggatcga

SEQ ID NO: 78735 - DNA, 37 bp, Artificial Sequence
  Synthetic oligonucleotide
tcccccaccgctcgagtaatacaagtgtttcggtcga

SEQ ID NO: 78736 - DNA, 36 bp, Artificial Sequence
  Synthetic oligonucleotide
gcccatgcctgttgcttgcgtttttttacatacgga

SEQ ID NO: 78737 - DNA, 37 bp, Artificial Sequence
  Synthetic oligonucleotide
gtgtgaccccctaaaacgcgcaagccatcctgccgga

SEQ ID NO: 78738 - DNA, 37 bp, Artificial Sequence
  Synthetic oligonucleotide
tgaaagccatgtgcattcccccctctttacgatcgga

SEQ ID NO: 78739 - DNA, 36 bp, Artificial Sequence
  Synthetic oligonucleotide
gccacaacgcatccattgtcaccctaccttcaggga

SEQ ID NO: 78740 - DNA, 37 bp, Artificial Sequence
  Synthetic oligonucleotide
tgcgagcacgcaactggctgtaggttacaaggaggga

SEQ ID NO: 78741 - DNA, 37 bp, Artificial Sequence
  Synthetic oligonucleotide
ttgacagtacgtatgggaatgatcatcggagggggga

SEQ ID NO: 78742 - DNA, 37 bp, Artificial Sequence
  Synthetic oligonucleotide
tcatccagggtgggtagttgccctcatgtgggtggga

SEQ ID NO: 78743 - DNA, 36 bp, Artificial Sequence
  Synthetic oligonucleotide
gccctccgaccacaaatgtccctcactaatttggga

SEQ ID NO: 78744 - DNA, 37 bp, Artificial Sequence
  Synthetic oligonucleotide
gtcgcactcgagaatccctatccccgttcactatgga

SEQ ID NO: 78745 - DNA, 35 bp, Artificial Sequence
  Synthetic oligonucleotide
tgaaaccccaatggtggtgaacgaaaatgactgga

SEQ ID NO: 78746 - DNA, 37 bp, Artificial Sequence
  Synthetic oligonucleotide
gaactccacgtaaactttgctgccatactcgcctgga

SEQ ID NO: 78747 - DNA, 38 bp, Artificial Sequence
  Synthetic oligonucleotide
gtactgtcgctcgtaagctttacacttttgccagatga

SEQ ID NO: 78748 - DNA, 38 bp, Artificial Sequence
  Synthetic oligonucleotide
gcgcaactacacatgtctgaccctccgtcctccgatga

SEQ ID NO: 78749 - DNA, 38 bp, Artificial Sequence
  Synthetic oligonucleotide
tatgggggtagtttgagtagtagggttgggagggatga

SEQ ID NO: 78750 - DNA, 38 bp, Artificial Sequence
  Synthetic oligonucleotide
tcgtggtggggccgggtatgctaaaaatggggggatga

SEQ ID NO: 78751 - DNA, 38 bp, Artificial Sequence
  Synthetic oligonucleotide
gaaaagcgaggaggcggaccagggaaagtatgggatga

SEQ ID NO: 78752 - DNA, 37 bp, Artificial Sequence
  Synthetic oligonucleotide
gttgggtgcggggtggtatataggaagagggttatga

SEQ ID NO: 78753 - DNA, 38 bp, Artificial Sequence
  Synthetic oligonucleotide
tcagtcgcaagcttatgcacacgctgaccaatcactga

SEQ ID NO: 78754 - DNA, 38 bp, Artificial Sequence
  Synthetic oligonucleotide
tacacccaggctcccccacatgccctgtctcggactga

SEQ ID NO: 78755 - DNA, 38 bp, Artificial Sequence
  Synthetic oligonucleotide
tgaaacaaacgccacactacctgctccctctggactga

SEQ ID NO: 78756 - DNA, 37 bp, Artificial Sequence
  Synthetic oligonucleotide
tacgtgtcgcccccacttgtagttaaaacgttactga

SEQ ID NO: 78757 - DNA, 38 bp, Artificial Sequence
  Synthetic oligonucleotide
gtcacacctccagggcactccagggagtctttacctga

SEQ ID NO: 78758 - DNA, 38 bp, Artificial Sequence
  Synthetic oligonucleotide
tacggagtgtcacctcatcgtcacgttttgcatcctga

SEQ ID NO: 78759 - DNA, 38 bp, Artificial Sequence
  Synthetic oligonucleotide
gcctcacccgatcttggttgctgagctatctatcctga

SEQ ID NO: 78760 - DNA, 38 bp, Artificial Sequence
  Synthetic oligonucleotide
tcagtccaatcacgtccctgcatttacgatcctgctga

SEQ ID NO: 78761 - DNA, 37 bp, Artificial Sequence
  Synthetic oligonucleotide
gtcagtgactcctgcaaggctccaacgttacctctga

SEQ ID NO: 78762 - DNA, 35 bp, Artificial Sequence
  Synthetic oligonucleotide
tcgataaaggtcgaggagggaacaaggggaagtga

SEQ ID NO: 78763 - DNA, 38 bp, Artificial Sequence
  Synthetic oligonucleotide
tgagtgagacgagagggccggcggggaatgacgagtga

SEQ ID NO: 78764 - DNA, 37 bp, Artificial Sequence
  Synthetic oligonucleotide
aacacgagcgacggggggtcattttaagtcctagtga

SEQ ID NO: 78765 - DNA, 38 bp, Artificial Sequence
  Synthetic oligonucleotide
accgcccgcatctcgctatctcactccacctttagtga

SEQ ID NO: 78766 - DNA, 38 bp, Artificial Sequence
  Synthetic oligonucleotide
gatcgcgccccccctaagcagctcaattactcacgtga

SEQ ID NO: 78767 - DNA, 38 bp, Artificial Sequence
  Synthetic oligonucleotide
atgcatcgggtagtggacggagagggaatgtagcgtga

SEQ ID NO: 78768 - DNA, 38 bp, Artificial Sequence
  Synthetic oligonucleotide
actgaccccgcctgaagtagttcccccgttacgcgtga

SEQ ID NO: 78769 - DNA, 38 bp, Artificial Sequence
  Synthetic oligonucleotide
tagacgcctcacacgaaacgcgatcacctgtagggtga

SEQ ID NO: 78770 - DNA, 38 bp, Artificial Sequence
  Synthetic oligonucleotide
gtgtaggacgaggaggttgtgcgaggtgtatcgggtga

SEQ ID NO: 78771 - DNA, 38 bp, Artificial Sequence
  Synthetic oligonucleotide
tacacagtcgcaagcggcatttaaggtgtggggggtga

SEQ ID NO: 78772 - DNA, 38 bp, Artificial Sequence
  Synthetic oligonucleotide
gagaggatggacggagtaggtaggtgtagaaggtgtga

SEQ ID NO: 78773 - DNA, 38 bp, Artificial Sequence
  Synthetic oligonucleotide
ttaaccgtcgcctccctgcccatgtaacatctttgtga

SEQ ID NO: 78774 - DNA, 37 bp, Artificial Sequence
  Synthetic oligonucleotide
accacccaatgcctcgattacagacgcatggaattga

SEQ ID NO: 78775 - DNA, 38 bp, Artificial Sequence
  Synthetic oligonucleotide
tagcctggtggacgggagtgatgcaggggggttattga

SEQ ID NO: 78776 - DNA, 38 bp, Artificial Sequence
  Synthetic oligonucleotide
tgaaccgaccctgggcaaccaaactgccgttcacttga

SEQ ID NO: 78777 - DNA, 37 bp, Artificial Sequence
  Synthetic oligonucleotide
gatccttcatcaccgaactgttcttagtgcaccttga

SEQ ID NO: 78778 - DNA, 36 bp, Artificial Sequence
  Synthetic oligonucleotide
ttcgtagcacagtgcggtcctctgcttctctcttga

SEQ ID NO: 78779 - DNA, 38 bp, Artificial Sequence
  Synthetic oligonucleotide
aataaccaccccttgtagtatgtgccttcgcttcttga

SEQ ID NO: 78780 - DNA, 38 bp, Artificial Sequence
  Synthetic oligonucleotide
aaccatgcggaggggtagggtgcgaagggtggggttga

SEQ ID NO: 78781 - DNA, 37 bp, Artificial Sequence
  Synthetic oligonucleotide
gcgagcaggggcacggatgaactggtgttggggttga

SEQ ID NO: 78782 - DNA, 38 bp, Artificial Sequence
  Synthetic oligonucleotide
gcaccaccctgtccccttctaacagacacgaaatttga

SEQ ID NO: 78783 - DNA, 38 bp, Artificial Sequence
  Synthetic oligonucleotide
gcctgacacaaatccccgccgacgacaggcacctttga

SEQ ID NO: 78784 - DNA, 38 bp, Artificial Sequence
  Synthetic oligonucleotide
gatccgccattttcgaactatctgactgcatcctttga

SEQ ID NO: 78785 - DNA, 38 bp, Artificial Sequence
  Synthetic oligonucleotide
atctgtgccaggctcgtcgtatcatacccgcgttttga

SEQ ID NO: 78786 - DNA, 36 bp, Artificial Sequence
  Synthetic oligonucleotide
taagtgtggggccatcatctgtagcgtacaaacata

SEQ ID NO: 78787 - DNA, 36 bp, Artificial Sequence
  Synthetic oligonucleotide
atcatctccggggccacgagatttacactcaccata

SEQ ID NO: 78788 - DNA, 36 bp, Artificial Sequence
  Synthetic oligonucleotide
ggtccacgcaaggccctgtccgaatattgtaccata

SEQ ID NO: 78789 - DNA, 36 bp, Artificial Sequence
  Synthetic oligonucleotide
gtcaatacatcagctctgttcactcgcctactcata

SEQ ID NO: 78790 - DNA, 36 bp, Artificial Sequence
  Synthetic oligonucleotide
aatgaggtcagaccgctactcacacacgatcctcta

SEQ ID NO: 78791 - DNA, 35 bp, Artificial Sequence
  Synthetic oligonucleotide
tgatcaaactgggcctcatcttataccgaatggta

SEQ ID NO: 78792 - DNA, 35 bp, Artificial Sequence
  Synthetic oligonucleotide
tcccgactccctgtccttggtctttaatttttgta

SEQ ID NO: 78793 - DNA, 36 bp, Artificial Sequence
  Synthetic oligonucleotide
gagatactaggtgagaaggatgaggatggaagttta

SEQ ID NO: 78794 - DNA, 35 bp, Artificial Sequence
  Synthetic oligonucleotide
agatgcgccgctcgggcccagtttgcatgtccaac

SEQ ID NO: 78795 - DNA, 35 bp, Artificial Sequence
  Synthetic oligonucleotide
gttgtagaagcccatgctgccccgtgaaagtacac

SEQ ID NO: 78796 - DNA, 35 bp, Artificial Sequence
  Synthetic oligonucleotide
ggtatgcctccggactcgccctcacctttcgcacc

SEQ ID NO: 78797 - DNA, 35 bp, Artificial Sequence
  Synthetic oligonucleotide
tcgcggggcctacagaactacatacactcatcacc

SEQ ID NO: 78798 - DNA, 35 bp, Artificial Sequence
  Synthetic oligonucleotide
tgaccccgggagtccatcgctattgtcccacaccc

SEQ ID NO: 78799 - DNA, 35 bp, Artificial Sequence
  Synthetic oligonucleotide
tgccgccaagtcgtagtcattcaacgcttcaagcc

SEQ ID NO: 78800 - DNA, 35 bp, Artificial Sequence
  Synthetic oligonucleotide
ggtgcctgccacgtgttccctgctcccattccgcc

SEQ ID NO: 78801 - DNA, 35 bp, Artificial Sequence
  Synthetic oligonucleotide
gccccgcctgtctgtatattcgcttccgccaatcc

SEQ ID NO: 78802 - DNA, 35 bp, Artificial Sequence
  Synthetic oligonucleotide
agaaaaacgcagagccccccactgtgcccccatgc

SEQ ID NO: 78803 - DNA, 35 bp, Artificial Sequence
  Synthetic oligonucleotide
atccgcctaggcctaccggtccttctttccactgc

SEQ ID NO: 78804 - DNA, 35 bp, Artificial Sequence
  Synthetic oligonucleotide
tgtgaggcatagggagggggttgaggcaattttgc

SEQ ID NO: 78805 - DNA, 35 bp, Artificial Sequence
  Synthetic oligonucleotide
gcgaaccactgatagccaacacgtgtggcgaaatc

SEQ ID NO: 78806 - DNA, 34 bp, Artificial Sequence
  Synthetic oligonucleotide
gtaccgctcgcacgtagaaaccgctcctacaatc

SEQ ID NO: 78807 - DNA, 35 bp, Artificial Sequence
  Synthetic oligonucleotide
gaaaaccgcctgccatcccggtcgagttcgccatc

SEQ ID NO: 78808 - DNA, 35 bp, Artificial Sequence
  Synthetic oligonucleotide
ggactccaaacgacccactggattagcacgccctc

SEQ ID NO: 78809 - DNA, 35 bp, Artificial Sequence
  Synthetic oligonucleotide
tattgctagcgttgaccacaaggctagaactcctc

SEQ ID NO: 78810 - DNA, 32 bp, Artificial Sequence
  Synthetic oligonucleotide
gaccgtgcaaaactcgcataccgatccatgtc

SEQ ID NO: 78811 - DNA, 35 bp, Artificial Sequence
  Synthetic oligonucleotide
gaatgcgccagcagcgcttcacattatctagtgtc

SEQ ID NO: 78812 - DNA, 35 bp, Artificial Sequence
  Synthetic oligonucleotide
taggactaccccagaattggcgcctctcaccattc

SEQ ID NO: 78813 - DNA, 35 bp, Artificial Sequence
  Synthetic oligonucleotide
aaaccgagagggaagcaagtaaaccgaccagaccg

SEQ ID NO: 78814 - DNA, 35 bp, Artificial Sequence
  Synthetic oligonucleotide
tcgtggcatcacctacgctttcatttcctactgcg

SEQ ID NO: 78815 - DNA, 35 bp, Artificial Sequence
  Synthetic oligonucleotide
gtcaccctgcttcacctgtccgctgagtactctcg

SEQ ID NO: 78816 - DNA, 35 bp, Artificial Sequence
  Synthetic oligonucleotide
tccaaacgaggtgaaggaatattagggcgtgaagg

SEQ ID NO: 78817 - DNA, 35 bp, Artificial Sequence
  Synthetic oligonucleotide
gtatgcaagggactttggagagattggggggatgg

SEQ ID NO: 78818 - DNA, 35 bp, Artificial Sequence
  Synthetic oligonucleotide
gcacgcctcattcatctgcccatactactgcaatg

SEQ ID NO: 78819 - DNA, 35 bp, Artificial Sequence
  Synthetic oligonucleotide
ttgggtgccgagatagaggggaacagagcttgctg

SEQ ID NO: 78820 - DNA, 35 bp, Artificial Sequence
  Synthetic oligonucleotide
ggttggcgcctcttttgttaatccaccctgtattg

SEQ ID NO: 78821 - DNA, 35 bp, Artificial Sequence
  Synthetic oligonucleotide
agttgaacgcaaacagggcatttagctgaaccttg

SEQ ID NO: 78822 - DNA, 35 bp, Artificial Sequence
  Synthetic oligonucleotide
tgtgccacctggcgaggtctagcccattaatcttg

SEQ ID NO: 78823 - DNA, 35 bp, Artificial Sequence
  Synthetic oligonucleotide
tacgggaggaacttgggtaggacaatattattttg

SEQ ID NO: 78824 - DNA, 35 bp, Artificial Sequence
  Synthetic oligonucleotide
gacgcgggttgggtgaataaatcaatttgcggcat

SEQ ID NO: 78825 - DNA, 35 bp, Artificial Sequence
  Synthetic oligonucleotide
acctcatccaccgcgcgtagtaatacctgccgtat

SEQ ID NO: 78826 - DNA, 35 bp, Artificial Sequence
  Synthetic oligonucleotide
tattgctgcgggggccaacgcactgaactaccact

SEQ ID NO: 78827 - DNA, 35 bp, Artificial Sequence
  Synthetic oligonucleotide
gtcagatcttccggcatggttcgcgtccctccact

SEQ ID NO: 78828 - DNA, 35 bp, Artificial Sequence
  Synthetic oligonucleotide
attgcgccgccgtgctatgcatcgttgtctccact

SEQ ID NO: 78829 - DNA, 35 bp, Artificial Sequence
  Synthetic oligonucleotide
atggaatgcaatgatggggttgtagggaatgagct

SEQ ID NO: 78830 - DNA, 35 bp, Artificial Sequence
  Synthetic oligonucleotide
gaagacgtaaagggagtagcagtcggaacagcgct

SEQ ID NO: 78831 - DNA, 35 bp, Artificial Sequence
  Synthetic oligonucleotide
tccaccctcgcacaccgggatgtatgctcattgct

SEQ ID NO: 78832 - DNA, 35 bp, Artificial Sequence
  Synthetic oligonucleotide
ataagcgcgctaaccgttcctgtctcccacttgct

SEQ ID NO: 78833 - DNA, 35 bp, Artificial Sequence
  Synthetic oligonucleotide
tgccaccggagtccataccctaaccaagccgatct

SEQ ID NO: 78834 - DNA, 35 bp, Artificial Sequence
  Synthetic oligonucleotide
tcatcagtgtcaaaaatatccctcttgtccttagt

SEQ ID NO: 78835 - DNA, 35 bp, Artificial Sequence
  Synthetic oligonucleotide
gaggaatggggggtggtatgtgaaaacgattgggt

SEQ ID NO: 78836 - DNA, 35 bp, Artificial Sequence
  Synthetic oligonucleotide
tccacgcacgccattgcctacttactacggtgatt

SEQ ID NO: 78837 - DNA, 35 bp, Artificial Sequence
  Synthetic oligonucleotide
tccgccctgcctcgagtgggtcgtgcccaaatatt

SEQ ID NO: 78838 - DNA, 35 bp, Artificial Sequence
  Synthetic oligonucleotide
tgtgggacgcttgtcacatggtctgtctccttatt

SEQ ID NO: 78839 - DNA, 35 bp, Artificial Sequence
  Synthetic oligonucleotide
tcaccaccgcaacacccggaactgtaatttacctt

SEQ ID NO: 78840 - DNA, 35 bp, Artificial Sequence
  Synthetic oligonucleotide
atcacatcggggggggcatcgggacacaatgcgtt

SEQ ID NO: 78841 - DNA, 35 bp, Artificial Sequence
  Synthetic oligonucleotide
gaaaggtgggggcggagaggttcggaaactcgttt

SEQ ID NO: 78842 - DNA, 35 bp, Artificial Sequence
  Synthetic oligonucleotide
tcgatggcattgtacttgagttcaccatcttcaaa

SEQ ID NO: 78843 - DNA, 36 bp, Artificial Sequence
  Synthetic oligonucleotide
tcctacatgcctcgcgtatgctccccatctgttaaa

SEQ ID NO: 78844 - DNA, 36 bp, Artificial Sequence
  Synthetic oligonucleotide
tcactccccgcacaagggcgctcacgcctgtcccaa

SEQ ID NO: 78845 - DNA, 36 bp, Artificial Sequence
  Synthetic oligonucleotide
ggtgagcagggggcaaggaacggccggggataagaa

SEQ ID NO: 78846 - DNA, 36 bp, Artificial Sequence
  Synthetic oligonucleotide
ggactcactcattgtcactcatggtaacctcccgaa

SEQ ID NO: 78847 - DNA, 36 bp, Artificial Sequence
  Synthetic oligonucleotide
gacaacgtgtggaaaaactgacggatacgatgtgaa

SEQ ID NO: 78848 - DNA, 36 bp, Artificial Sequence
  Synthetic oligonucleotide
gcctcgccagagccccgacgccctagctccgattaa

SEQ ID NO: 78849 - DNA, 36 bp, Artificial Sequence
  Synthetic oligonucleotide
gattggtgggcgtagcaacactgataacgtttaaca

SEQ ID NO: 78850 - DNA, 35 bp, Artificial Sequence
  Synthetic oligonucleotide
tcccctgtgctcgaccgtattctggctcccgcaca

SEQ ID NO: 78851 - DNA, 36 bp, Artificial Sequence
  Synthetic oligonucleotide
gccctgccggctcctcattgcacttggtaaacgaca

SEQ ID NO: 78852 - DNA, 36 bp, Artificial Sequence
  Synthetic oligonucleotide
gccaccttacatccgctagttacgcacgggcataca

SEQ ID NO: 78853 - DNA, 36 bp, Artificial Sequence
  Synthetic oligonucleotide
tggaccggctgattaggaagggggcggggtagtaca

SEQ ID NO: 78854 - DNA, 36 bp, Artificial Sequence
  Synthetic oligonucleotide
gttgctgtaacggcgatattgtcacttcccacacca

SEQ ID NO: 78855 - DNA, 35 bp, Artificial Sequence
  Synthetic oligonucleotide
gaccccagtcctgttggtcttgcctgcccctccca

SEQ ID NO: 78856 - DNA, 35 bp, Artificial Sequence
  Synthetic oligonucleotide
tattcgtgcccctgttattagctgcgtgaccgcca

SEQ ID NO: 78857 - DNA, 36 bp, Artificial Sequence
  Synthetic oligonucleotide
gcacgacgctgctcacccacattggcgctgcctcca

SEQ ID NO: 78858 - DNA, 35 bp, Artificial Sequence
  Synthetic oligonucleotide
atcgcccagaattgcagttaccctcacctacagca

SEQ ID NO: 78859 - DNA, 36 bp, Artificial Sequence
  Synthetic oligonucleotide
ttgggagagcgctgggaaagcaagaggaagagcgca

SEQ ID NO: 78860 - DNA, 36 bp, Artificial Sequence
  Synthetic oligonucleotide
tacctccagtgcgtgccgcttcatcgccccacatca

SEQ ID NO: 78861 - DNA, 35 bp, Artificial Sequence
  Synthetic oligonucleotide
gaagtcacgcgggggaggttcaacatgcaggatca

SEQ ID NO: 78862 - DNA, 36 bp, Artificial Sequence
  Synthetic oligonucleotide
aatccgccacgtctgacgaacctgatttttcactca

SEQ ID NO: 78863 - DNA, 36 bp, Artificial Sequence
  Synthetic oligonucleotide
gtgcgagggctcgaacgctcacattttttcacttca

SEQ ID NO: 78864 - DNA, 36 bp, Artificial Sequence
  Synthetic oligonucleotide
ggacacgatccgttttttgatatgctccccttttca

SEQ ID NO: 78865 - DNA, 36 bp, Artificial Sequence
  Synthetic oligonucleotide
tgtcgtgttcccttgttcttttttaccagcttttca

SEQ ID NO: 78866 - DNA, 37 bp, Artificial Sequence
  Synthetic oligonucleotide
tgaaccgggggatagttacgtagggggtggtggaaga

SEQ ID NO: 78867 - DNA, 36 bp, Artificial Sequence
  Synthetic oligonucleotide
atcaccttgcccgacctaggagctcccgtatccaga

SEQ ID NO: 78868 - DNA, 37 bp, Artificial Sequence
  Synthetic oligonucleotide
gtccaccctctccacctcttcgggaacagtacagaga

SEQ ID NO: 78869 - DNA, 37 bp, Artificial Sequence
  Synthetic oligonucleotide
ccagccctcctaacgtcctgtccttgctccactacga

SEQ ID NO: 78870 - DNA, 37 bp, Artificial Sequence
  Synthetic oligonucleotide
accatccttcctcgtattcgtctgccttcataaccga

SEQ ID NO: 78871 - DNA, 37 bp, Artificial Sequence
  Synthetic oligonucleotide
aactcccaccgcctctcatcgtgcactagtagcccga

SEQ ID NO: 78872 - DNA, 37 bp, Artificial Sequence
  Synthetic oligonucleotide
tcaggtgggtgcggggtccaaagggtaacaggggcga

SEQ ID NO: 78873 - DNA, 37 bp, Artificial Sequence
  Synthetic oligonucleotide
gtggacacacatcgcattaaaaaaggtcaggaatcga

SEQ ID NO: 78874 - DNA, 37 bp, Artificial Sequence
  Synthetic oligonucleotide
ggggccttgcaccacgacacaccggaacacatttcga

SEQ ID NO: 78875 - DNA, 37 bp, Artificial Sequence
  Synthetic oligonucleotide
ttggacgcggtctttacccgcactatcttacgcagga

SEQ ID NO: 78876 - DNA, 37 bp, Artificial Sequence
  Synthetic oligonucleotide
tgccccgaaatcactcccttacagccacttgcccgga

SEQ ID NO: 78877 - DNA, 37 bp, Artificial Sequence
  Synthetic oligonucleotide
taccaccgctcccataccgctcgcccgtgtacaggga

SEQ ID NO: 78878 - DNA, 37 bp, Artificial Sequence
  Synthetic oligonucleotide
gccagggtacctgcaaacacgggtgggagtaagggga

SEQ ID NO: 78879 - DNA, 37 bp, Artificial Sequence
  Synthetic oligonucleotide
aacggggtggggcccagatgtacgacgaatgcgggga

SEQ ID NO: 78880 - DNA, 37 bp, Artificial Sequence
  Synthetic oligonucleotide
gagaaacaaaggtgttgtgggaaggcggtttggggga

SEQ ID NO: 78881 - DNA, 37 bp, Artificial Sequence
  Synthetic oligonucleotide
tgtccagcattacctcaccgccgtgcttttcatggga

SEQ ID NO: 78882 - DNA, 37 bp, Artificial Sequence
  Synthetic oligonucleotide
gtcggagtctgtgagaacgggatggattggtgtggga

SEQ ID NO: 78883 - DNA, 37 bp, Artificial Sequence
  Synthetic oligonucleotide
gaagccactctccatgcctaacgtacattcaaatgga

SEQ ID NO: 78884 - DNA, 36 bp, Artificial Sequence
  Synthetic oligonucleotide
tagtgtgctccatcagcctctatcttcctacttgga

SEQ ID NO: 78885 - DNA, 37 bp, Artificial Sequence
  Synthetic oligonucleotide
gcacggaaggggagaggagatcgttgggtgatttgga

SEQ ID NO: 78886 - DNA, 38 bp, Artificial Sequence
  Synthetic oligonucleotide
tctgcaccttcggtctgccgtattattccacctaatga

SEQ ID NO: 78887 - DNA, 38 bp, Artificial Sequence
  Synthetic oligonucleotide
gaaaggaaaagggatgttacggtgtgcggagacgatga

SEQ ID NO: 78888 - DNA, 38 bp, Artificial Sequence
  Synthetic oligonucleotide
tacgaagagatggcgtgctgaagaagcaggacggatga

SEQ ID NO: 78889 - DNA, 38 bp, Artificial Sequence
  Synthetic oligonucleotide
tccccccttcacattaacagagctggtgcccttgatga

SEQ ID NO: 78890 - DNA, 38 bp, Artificial Sequence
  Synthetic oligonucleotide
tactaccgcacgttagttctgctctatccttactatga

SEQ ID NO: 78891 - DNA, 38 bp, Artificial Sequence
  Synthetic oligonucleotide
gtacgctccagctaaagctactctccggtttacactga

SEQ ID NO: 78892 - DNA, 38 bp, Artificial Sequence
  Synthetic oligonucleotide
tcacacagcagcatgagtaattttcccatcgccactga

SEQ ID NO: 78893 - DNA, 38 bp, Artificial Sequence
  Synthetic oligonucleotide
tgatggggtacggaatggttgtacgagggctggactga

SEQ ID NO: 78894 - DNA, 38 bp, Artificial Sequence
  Synthetic oligonucleotide
accacggcatgtcgtaactagtctttgccttcccctga

SEQ ID NO: 78895 - DNA, 36 bp, Artificial Sequence
  Synthetic oligonucleotide
gtctcccttgcctctgtctctggttgggtctcctga

SEQ ID NO: 78896 - DNA, 38 bp, Artificial Sequence
  Synthetic oligonucleotide
gaccgaacacacataacttcgcagtccacataagctga

SEQ ID NO: 78897 - DNA, 38 bp, Artificial Sequence
  Synthetic oligonucleotide
gtacgagaacgggttggggaaaagggcacgggggctga

SEQ ID NO: 78898 - DNA, 37 bp, Artificial Sequence
  Synthetic oligonucleotide
agcgcgccgaaccctatgcgcacccattcatccgtga

SEQ ID NO: 78899 - DNA, 38 bp, Artificial Sequence
  Synthetic oligonucleotide
tcatcagctgtcttcacactctgtcttcccggtcgtga

SEQ ID NO: 78900 - DNA, 38 bp, Artificial Sequence
  Synthetic oligonucleotide
atgcacggaaaaaaagagggacggctgaggtttcgtga

SEQ ID NO: 78901 - DNA, 38 bp, Artificial Sequence
  Synthetic oligonucleotide
gcaaggttatggtgggcaaggggctctgcgcaaggtga

SEQ ID NO: 78902 - DNA, 36 bp, Artificial Sequence
  Synthetic oligonucleotide
acatttcgagccctccaccatggcccaccgaggtga

SEQ ID NO: 78903 - DNA, 38 bp, Artificial Sequence
  Synthetic oligonucleotide
atccgcaccgctcactctatccggtcttttttcggtga

SEQ ID NO: 78904 - DNA, 38 bp, Artificial Sequence
  Synthetic oligonucleotide
gtggaggggtgttagacggctatagtgggggggggtga

SEQ ID NO: 78905 - DNA, 36 bp, Artificial Sequence
  Synthetic oligonucleotide
gcacagcctgtgctcgccttaaccgtaccatggtga

SEQ ID NO: 78906 - DNA, 38 bp, Artificial Sequence
  Synthetic oligonucleotide
atgcgacgctagggaatggaagttggtgctgcatgtga

SEQ ID NO: 78907 - DNA, 38 bp, Artificial Sequence
  Synthetic oligonucleotide
attgcgacacctccagcaacccactgaccactcattga

SEQ ID NO: 78908 - DNA, 38 bp, Artificial Sequence
  Synthetic oligonucleotide
gtttgcagcatgttgtccctgcctcaccacgttattga

SEQ ID NO: 78909 - DNA, 36 bp, Artificial Sequence
  Synthetic oligonucleotide
gtgagccgcatctctatgttctccaatgctacttga

SEQ ID NO: 78910 - DNA, 38 bp, Artificial Sequence
  Synthetic oligonucleotide
tatgcgctgttcgctaacgtagaccgccgtgaccttga

SEQ ID NO: 78911 - DNA, 37 bp, Artificial Sequence
  Synthetic oligonucleotide
atcaagtgggcgcgactacgactcatcactgccttga

SEQ ID NO: 78912 - DNA, 38 bp, Artificial Sequence
  Synthetic oligonucleotide
gtctgtggcaccatagtgctgtaccctccgatccttga

SEQ ID NO: 78913 - DNA, 37 bp, Artificial Sequence
  Synthetic oligonucleotide
gacgcatcaccaccgcatctacatccagcacggttga

SEQ ID NO: 78914 - DNA, 36 bp, Artificial Sequence
  Synthetic oligonucleotide
tcccccctctcctgcacaacatgctctcctggcata

SEQ ID NO: 78915 - DNA, 35 bp, Artificial Sequence
  Synthetic oligonucleotide
acgagacactcacatggctagccttcatcactata

SEQ ID NO: 78916 - DNA, 36 bp, Artificial Sequence
  Synthetic oligonucleotide
gtgcgccacactgtagtcgtttgctaccctgcccta

SEQ ID NO: 78917 - DNA, 36 bp, Artificial Sequence
  Synthetic oligonucleotide
gacctctatcgttggcctttgctctgaacgcacgta

SEQ ID NO: 78918 - DNA, 36 bp, Artificial Sequence
  Synthetic oligonucleotide
tttcgactcacggtttgtccggatccctacctcgta

SEQ ID NO: 78919 - DNA, 36 bp, Artificial Sequence
  Synthetic oligonucleotide
gatgcattgtggagacagagcaaggtgtgggtcgta

SEQ ID NO: 78920 - DNA, 35 bp, Artificial Sequence
  Synthetic oligonucleotide
agtcagagcagcctgcatcgggataatttttcgta

SEQ ID NO: 78921 - DNA, 35 bp, Artificial Sequence
  Synthetic oligonucleotide
atgatgtcgacgacttggtagaggaggggggtgta

SEQ ID NO: 78922 - DNA, 35 bp, Artificial Sequence
  Synthetic oligonucleotide
gcgcaatggaggggggaacgtgggcttagctgtta

SEQ ID NO: 78923 - DNA, 36 bp, Artificial Sequence
  Synthetic oligonucleotide
ttgagggatcagcactcttacgcacactagccttta

SEQ ID NO: 78924 - DNA, 35 bp, Artificial Sequence
  Synthetic oligonucleotide
tccgcacatacacgcgtgcgggcttatttgtaaac

SEQ ID NO: 78925 - DNA, 35 bp, Artificial Sequence
  Synthetic oligonucleotide
gcccatgagaagttgatcccccctaaagccgtaac

SEQ ID NO: 78926 - DNA, 35 bp, Artificial Sequence
  Synthetic oligonucleotide
tctctagggcgacccgcaatcacatgcttgaccac

SEQ ID NO: 78927 - DNA, 35 bp, Artificial Sequence
  Synthetic oligonucleotide
gtatcgacggatccctccctgtgacactaatccac

SEQ ID NO: 78928 - DNA, 35 bp, Artificial Sequence
  Synthetic oligonucleotide
gtcgccgatctagaacctctttgccattgacgcac

SEQ ID NO: 78929 - DNA, 35 bp, Artificial Sequence
  Synthetic oligonucleotide
atgcgaggccatacctccgacaccacccacccgac

SEQ ID NO: 78930 - DNA, 35 bp, Artificial Sequence
  Synthetic oligonucleotide
gtcacccgtcatggaccctcgggaagcgcaccacc

SEQ ID NO: 78931 - DNA, 35 bp, Artificial Sequence
  Synthetic oligonucleotide
tgcgaggacggcatccacccttgcgagcctttgcc

SEQ ID NO: 78932 - DNA, 35 bp, Artificial Sequence
  Synthetic oligonucleotide
gtggcgacaagccggtgacgaccaagccgcaatcc

SEQ ID NO: 78933 - DNA, 35 bp, Artificial Sequence
  Synthetic oligonucleotide
gtgccatatcataaaccggccctaccgtctttcgc

SEQ ID NO: 78934 - DNA, 35 bp, Artificial Sequence
  Synthetic oligonucleotide
gtgcgcacagcacatagtttggcatgggttgctgc

SEQ ID NO: 78935 - DNA, 35 bp, Artificial Sequence
  Synthetic oligonucleotide
ttcccatcctcacgtcaccactcgcaagagcgtgc

SEQ ID NO: 78936 - DNA, 35 bp, Artificial Sequence
  Synthetic oligonucleotide
gcctatatctgtggtgcgtgcccccgcccatttgc

SEQ ID NO: 78937 - DNA, 35 bp, Artificial Sequence
  Synthetic oligonucleotide
tgatgcacggtcgaactcggagtagtgcgcctctc

SEQ ID NO: 78938 - DNA, 35 bp, Artificial Sequence
  Synthetic oligonucleotide
gatgaggaagcagcatttccccttcctggcctgtc

SEQ ID NO: 78939 - DNA, 35 bp, Artificial Sequence
  Synthetic oligonucleotide
gcgaaacacgcctgcagaaccacttgagtttattc

SEQ ID NO: 78940 - DNA, 35 bp, Artificial Sequence
  Synthetic oligonucleotide
attatgccacacggttcacgcctccggttcggttc

SEQ ID NO: 78941 - DNA, 35 bp, Artificial Sequence
  Synthetic oligonucleotide
gatgaggttttaggaggggtagagcgaaagtagag

SEQ ID NO: 78942 - DNA, 35 bp, Artificial Sequence
  Synthetic oligonucleotide
agcaaaaggcggaaaggacggagcatgagggctag

SEQ ID NO: 78943 - DNA, 35 bp, Artificial Sequence
  Synthetic oligonucleotide
gccgtagcggctttttgtctcttttctccatagcg

SEQ ID NO: 78944 - DNA, 35 bp, Artificial Sequence
  Synthetic oligonucleotide
gagggatgagtccgaagcagaaagggggtgccagg

SEQ ID NO: 78945 - DNA, 35 bp, Artificial Sequence
  Synthetic oligonucleotide
tcaaacgttgcagaacgtccaccttcattttctgg

SEQ ID NO: 78946 - DNA, 35 bp, Artificial Sequence
  Synthetic oligonucleotide
tgtggggtacggggacaggtgcaggttggataatg

SEQ ID NO: 78947 - DNA, 35 bp, Artificial Sequence
  Synthetic oligonucleotide
aggactacagcgagttgccctccccccatcaagtg

SEQ ID NO: 78948 - DNA, 35 bp, Artificial Sequence
  Synthetic oligonucleotide
tacaatctctggcccgaacaaacgccacgcccgtg

SEQ ID NO: 78949 - DNA, 35 bp, Artificial Sequence
  Synthetic oligonucleotide
ttctgccgccatttccgccagtccacgaacttgat

SEQ ID NO: 78950 - DNA, 35 bp, Artificial Sequence
  Synthetic oligonucleotide
tcgagccagcatttgtgcaacgtttccctacgcct

SEQ ID NO: 78951 - DNA, 35 bp, Artificial Sequence
  Synthetic oligonucleotide
gatgcgcgcccccgcgtggaagcctgcccatagct

SEQ ID NO: 78952 - DNA, 35 bp, Artificial Sequence
  Synthetic oligonucleotide
atgtacgggaagagagcgtatgggtctgtgggctt

SEQ ID NO: 78953 - DNA, 35 bp, Artificial Sequence
  Synthetic oligonucleotide
gaccctgattccgacgattgttgccgctactgctt

SEQ ID NO: 78954 - DNA, 35 bp, Artificial Sequence
  Synthetic oligonucleotide
aagtcaatgcgaggctacggggaagggctggagtt

SEQ ID NO: 78955 - DNA, 35 bp, Artificial Sequence
  Synthetic oligonucleotide
gacgggacgcaggacgagggactatttcgtgcttt

SEQ ID NO: 78956 - DNA, 36 bp, Artificial Sequence
  Synthetic oligonucleotide
tcccgtgcatatagcgggtgggtagggccgagggaa

SEQ ID NO: 78957 - DNA, 35 bp, Artificial Sequence
  Synthetic oligonucleotide
tcagcccctcgttccgatcgttccccagtatctaa

SEQ ID NO: 78958 - DNA, 36 bp, Artificial Sequence
  Synthetic oligonucleotide
tagttgcgcagtccgccacccccggtccgcagttaa

SEQ ID NO: 78959 - DNA, 36 bp, Artificial Sequence
  Synthetic oligonucleotide
taacccgtgcggcacctgcatctctacaacagaaca

SEQ ID NO: 78960 - DNA, 35 bp, Artificial Sequence
  Synthetic oligonucleotide
gcacatacccacgatattcgaagtgtagttttaca

SEQ ID NO: 78961 - DNA, 36 bp, Artificial Sequence
  Synthetic oligonucleotide
ggtatcgcccgctctccaccacctgttaattgccca

SEQ ID NO: 78962 - DNA, 36 bp, Artificial Sequence
  Synthetic oligonucleotide
gcctccgctgttgctcttcttatgcctggttaggca

SEQ ID NO: 78963 - DNA, 36 bp, Artificial Sequence
  Synthetic oligonucleotide
tactcaccgcagaagaccagcgctaggtgtcttgca

SEQ ID NO: 78964 - DNA, 36 bp, Artificial Sequence
  Synthetic oligonucleotide
gaccatgcccaacggtcctcatactgactcgcctca

SEQ ID NO: 78965 - DNA, 36 bp, Artificial Sequence
  Synthetic oligonucleotide
gcctcatcccgggcccaattctgtttgcactcctca

SEQ ID NO: 78966 - DNA, 35 bp, Artificial Sequence
  Synthetic oligonucleotide
tctaatacacccccaaatgtggcatcttttgttca

SEQ ID NO: 78967 - DNA, 36 bp, Artificial Sequence
  Synthetic oligonucleotide
gtgacctcgctctatgtatcactacgatcgctttca

SEQ ID NO: 78968 - DNA, 37 bp, Artificial Sequence
  Synthetic oligonucleotide
gagtagcggaaccgggaatgggggtgaactatacaga

SEQ ID NO: 78969 - DNA, 37 bp, Artificial Sequence
  Synthetic oligonucleotide
tgaatcagggaaggcaggagtcgaagaacgagagaga

SEQ ID NO: 78970 - DNA, 36 bp, Artificial Sequence
  Synthetic oligonucleotide
tgaaactggacacacgactacatgactgtcgcgaga

SEQ ID NO: 78971 - DNA, 37 bp, Artificial Sequence
  Synthetic oligonucleotide
tatacctgcccatgtccgttctcagtaccctgcgaga

SEQ ID NO: 78972 - DNA, 36 bp, Artificial Sequence
  Synthetic oligonucleotide
gtcgccggacaggaatattactttggtggggggaga

SEQ ID NO: 78973 - DNA, 37 bp, Artificial Sequence
  Synthetic oligonucleotide
gattcccgctgtcctaagcagcacatcctctctgaga

SEQ ID NO: 78974 - DNA, 37 bp, Artificial Sequence
  Synthetic oligonucleotide
attgaggaggaggtgaaagctggggcactttgataga

SEQ ID NO: 78975 - DNA, 37 bp, Artificial Sequence
  Synthetic oligonucleotide
gtcaagcagaggagtatagctcatggtggtagttaga

SEQ ID NO: 78976 - DNA, 36 bp, Artificial Sequence
  Synthetic oligonucleotide
tgcatggggggcatgaggtgtgcggagggcaaacga

SEQ ID NO: 78977 - DNA, 37 bp, Artificial Sequence
  Synthetic oligonucleotide
aaccgggggaaaggaaatcaagttttaggaggtacga

SEQ ID NO: 78978 - DNA, 37 bp, Artificial Sequence
  Synthetic oligonucleotide
gtgaacatccacggtcaccggctccaatcatacccga

SEQ ID NO: 78979 - DNA, 37 bp, Artificial Sequence
  Synthetic oligonucleotide
ttgctctcgcccctcgatttaatatgcgtccccccga

SEQ ID NO: 78980 - DNA, 37 bp, Artificial Sequence
  Synthetic oligonucleotide
tcatcccgaccgttctgagctgtggtttcacgtccga

SEQ ID NO: 78981 - DNA, 37 bp, Artificial Sequence
  Synthetic oligonucleotide
tcagaccaagccctcttcgaattatcagtccaagcga

SEQ ID NO: 78982 - DNA, 37 bp, Artificial Sequence
  Synthetic oligonucleotide
attaccgccactgacgtgctatcgtcgaacagtgcga

SEQ ID NO: 78983 - DNA, 37 bp, Artificial Sequence
  Synthetic oligonucleotide
acgcattgcggccatcccctgcctgctggtaactcga

SEQ ID NO: 78984 - DNA, 36 bp, Artificial Sequence
  Synthetic oligonucleotide
acacgggaggggaactgtagtggtaaagtaagtcga

SEQ ID NO: 78985 - DNA, 37 bp, Artificial Sequence
  Synthetic oligonucleotide
gagccacgccatccctatttccgttttaccccgtcga

SEQ ID NO: 78986 - DNA, 36 bp, Artificial Sequence
  Synthetic oligonucleotide
tgtgggtagagagcggggaacgcggggacgggtcga

SEQ ID NO: 78987 - DNA, 35 bp, Artificial Sequence
  Synthetic oligonucleotide
agtggatccagtgccggccaatgcacctccttcga

SEQ ID NO: 78988 - DNA, 37 bp, Artificial Sequence
  Synthetic oligonucleotide
gatggcgagttccatcgtttctacacaaggctttcga

SEQ ID NO: 78989 - DNA, 37 bp, Artificial Sequence
  Synthetic oligonucleotide
atggagtgtgtgggggcggagtgcaacagtgaaagga

SEQ ID NO: 78990 - DNA, 37 bp, Artificial Sequence
  Synthetic oligonucleotide
gacatatgaccgggagagagagggtcgtttagcagga

SEQ ID NO: 78991 - DNA, 37 bp, Artificial Sequence
  Synthetic oligonucleotide
gagggtgtcgggaaaggcggagctctcatagggagga

SEQ ID NO: 78992 - DNA, 37 bp, Artificial Sequence
  Synthetic oligonucleotide
atcgcatctacctcctgtatccctcgccgccatagga

SEQ ID NO: 78993 - DNA, 37 bp, Artificial Sequence
  Synthetic oligonucleotide
taaggggggggaggacattaacgaagcgcacgtagga

SEQ ID NO: 78994 - DNA, 37 bp, Artificial Sequence
  Synthetic oligonucleotide
atcctacatcgggtgcggcactcttccatcggccgga

SEQ ID NO: 78995 - DNA, 37 bp, Artificial Sequence
  Synthetic oligonucleotide
tagctacggcctaggcgggttggtgggagggggcgga

SEQ ID NO: 78996 - DNA, 35 bp, Artificial Sequence
  Synthetic oligonucleotide
actcaaaggcgaaagggaacatagaggagctcgga

SEQ ID NO: 78997 - DNA, 37 bp, Artificial Sequence
  Synthetic oligonucleotide
acgatgtcgtgctgggttccatttgggaagggtggga

SEQ ID NO: 78998 - DNA, 37 bp, Artificial Sequence
  Synthetic oligonucleotide
tacctccgccaatactcgaagtccctatcctttggga

SEQ ID NO: 78999 - DNA, 37 bp, Artificial Sequence
  Synthetic oligonucleotide
tgtggggggaggataggtacatttaatgggccctgga

SEQ ID NO: 79000 - DNA, 37 bp, Artificial Sequence
  Synthetic oligonucleotide
atggtggtgaaggggggctgtttaagtagctagatga

SEQ ID NO: 79001 - DNA, 36 bp, Artificial Sequence
  Synthetic oligonucleotide
atttccgccaaaaagtttccactgctcactctatga

SEQ ID NO: 79002 - DNA, 38 bp, Artificial Sequence
  Synthetic oligonucleotide
aagtctgggtggggggcttataaaacggaagagtatga

SEQ ID NO: 79003 - DNA, 36 bp, Artificial Sequence
  Synthetic oligonucleotide
gacgacacagttcgtagtgcaaatcggtcgttatga

SEQ ID NO: 79004 - DNA, 38 bp, Artificial Sequence
  Synthetic oligonucleotide
gatgtagtgcaggggggcgcgcggaaagatagaactga

SEQ ID NO: 79005 - DNA, 38 bp, Artificial Sequence
  Synthetic oligonucleotide
gccatagggccatgtgcgtttttgccgccacccactga

SEQ ID NO: 79006 - DNA, 37 bp, Artificial Sequence
  Synthetic oligonucleotide
gtgcacaagtcgacaaccaccctcccgagtaccctga

SEQ ID NO: 79007 - DNA, 38 bp, Artificial Sequence
  Synthetic oligonucleotide
tcacgcattccgttttcttatcctcgggtcaggcctga

SEQ ID NO: 79008 - DNA, 38 bp, Artificial Sequence
  Synthetic oligonucleotide
gcacgtaacatccccctccactttgtcatgaaggctga

SEQ ID NO: 79009 - DNA, 35 bp, Artificial Sequence
  Synthetic oligonucleotide
aaggggggggtgaggtgctacttggcgtctagtga

SEQ ID NO: 79010 - DNA, 36 bp, Artificial Sequence
  Synthetic oligonucleotide
tctaccccgacgcgtaagacgactgacttcgcgtga

SEQ ID NO: 79011 - DNA, 37 bp, Artificial Sequence
  Synthetic oligonucleotide
gcacggttacaggggcgatgaaagggttgtggggtga

SEQ ID NO: 79012 - DNA, 37 bp, Artificial Sequence
  Synthetic oligonucleotide
ggaatacaccgcccgttcgttctattggccttggtga

SEQ ID NO: 79013 - DNA, 37 bp, Artificial Sequence
  Synthetic oligonucleotide
tccctcccgcccgacgttcatccgacactgcaattga

SEQ ID NO: 79014 - DNA, 38 bp, Artificial Sequence
  Synthetic oligonucleotide
gcactcctgcgcccgccctctttgactgtggtcattga

SEQ ID NO: 79015 - DNA, 38 bp, Artificial Sequence
  Synthetic oligonucleotide
gttccaacccctgaaggtaccattgctgacgagcttga

SEQ ID NO: 79016 - DNA, 38 bp, Artificial Sequence
  Synthetic oligonucleotide
acgacgacataacctccacagtgcagcatctacgttga

SEQ ID NO: 79017 - DNA, 38 bp, Artificial Sequence
  Synthetic oligonucleotide
agtgcgatagctcccccccagatataccgctccgttga

SEQ ID NO: 79018 - DNA, 36 bp, Artificial Sequence
  Synthetic oligonucleotide
gaccatccagtcgcgtgacttctccgggccctgata

SEQ ID NO: 79019 - DNA, 36 bp, Artificial Sequence
  Synthetic oligonucleotide
acgaacccgcgtgccatacgccctgatcgtatccta

SEQ ID NO: 79020 - DNA, 36 bp, Artificial Sequence
  Synthetic oligonucleotide
taagtcactcgcacttagcactcccacctggttgta

SEQ ID NO: 79021 - DNA, 35 bp, Artificial Sequence
  Synthetic oligonucleotide
atcggaaccgcatcagaaccccagaccctgactta

SEQ ID NO: 79022 - DNA, 36 bp, Artificial Sequence
  Synthetic oligonucleotide
attaccctgcgccgaccgactcaagggatcctgtta

SEQ ID NO: 79023 - DNA, 35 bp, Artificial Sequence
  Synthetic oligonucleotide
agatccagccgcaatggaccgctggacctaccaac

SEQ ID NO: 79024 - DNA, 35 bp, Artificial Sequence
  Synthetic oligonucleotide
gcacatcgccccgagctttaggcatcttagaacac

SEQ ID NO: 79025 - DNA, 35 bp, Artificial Sequence
  Synthetic oligonucleotide
gacatccccgccttaccggattgatctctggacac

SEQ ID NO: 79026 - DNA, 35 bp, Artificial Sequence
  Synthetic oligonucleotide
tcatgccgtacgcgtaggtcttaacgagcatgcac

SEQ ID NO: 79027 - DNA, 35 bp, Artificial Sequence
  Synthetic oligonucleotide
tccgccccaggctttctatcatcattgtttgctac

SEQ ID NO: 79028 - DNA, 35 bp, Artificial Sequence
  Synthetic oligonucleotide
agagggcatccaatcatctcgagctgctcccgtac

SEQ ID NO: 79029 - DNA, 35 bp, Artificial Sequence
  Synthetic oligonucleotide
gactcgacaacccgaataaaccgcggtatagcccc

SEQ ID NO: 79030 - DNA, 35 bp, Artificial Sequence
  Synthetic oligonucleotide
gaaaaccagccccgcatctcgtttacgaaaatccc

SEQ ID NO: 79031 - DNA, 35 bp, Artificial Sequence
  Synthetic oligonucleotide
gaagggactggcgtgcacgcgcataatcttctccc

SEQ ID NO: 79032 - DNA, 35 bp, Artificial Sequence
  Synthetic oligonucleotide
gttgcccattcaacgcaaattatcatgtagatgcc

SEQ ID NO: 79033 - DNA, 35 bp, Artificial Sequence
  Synthetic oligonucleotide
tgtcggtgcccagcgtgcgaacctgcccaactgcc

SEQ ID NO: 79034 - DNA, 35 bp, Artificial Sequence
  Synthetic oligonucleotide
atcgccgtcccgtctaaccttggaatttttgctcc

SEQ ID NO: 79035 - DNA, 35 bp, Artificial Sequence
  Synthetic oligonucleotide
gcgctgactcactgccacattctattcctagttcc

SEQ ID NO: 79036 - DNA, 35 bp, Artificial Sequence
  Synthetic oligonucleotide
gcataactgcggtattggtgcccactacgtctcgc

SEQ ID NO: 79037 - DNA, 35 bp, Artificial Sequence
  Synthetic oligonucleotide
caaccaccgcattaccataacgtctcgactccggc

SEQ ID NO: 79038 - DNA, 35 bp, Artificial Sequence
  Synthetic oligonucleotide
gaatcgccagtcatggtcctcctctacagtcatgc

SEQ ID NO: 79039 - DNA, 35 bp, Artificial Sequence
  Synthetic oligonucleotide
tctgacactggcgggtgggggggaggcagaaactc

SEQ ID NO: 79040 - DNA, 35 bp, Artificial Sequence
  Synthetic oligonucleotide
aagtggcattgctcctcgctccaatactctttgtc

SEQ ID NO: 79041 - DNA, 35 bp, Artificial Sequence
  Synthetic oligonucleotide
ataatcgtagcatccccatccgcctcgcgacattc

SEQ ID NO: 79042 - DNA, 35 bp, Artificial Sequence
  Synthetic oligonucleotide
tcaaggtgacaggaaatgatgggggactaggggag

SEQ ID NO: 79043 - DNA, 35 bp, Artificial Sequence
  Synthetic oligonucleotide
gaccaattatggtcattgcaccgtttgccaaaacg

SEQ ID NO: 79044 - DNA, 35 bp, Artificial Sequence
  Synthetic oligonucleotide
tacatcccgtgccagatcaccagttacttcgtacg

SEQ ID NO: 79045 - DNA, 35 bp, Artificial Sequence
  Synthetic oligonucleotide
atgcatgtcccccaccacgtgtttccccccgagcg

SEQ ID NO: 79046 - DNA, 35 bp, Artificial Sequence
  Synthetic oligonucleotide
gtgaaagagttgaggtgttagctgaaggtggtgcg

SEQ ID NO: 79047 - DNA, 35 bp, Artificial Sequence
  Synthetic oligonucleotide
gtcagaagttgtggcttaggtaatgaaagggaggg

SEQ ID NO: 79048 - DNA, 35 bp, Artificial Sequence
  Synthetic oligonucleotide
tagtgtaagggcaatgaggttgaggtgcgaacggg

SEQ ID NO: 79049 - DNA, 35 bp, Artificial Sequence
  Synthetic oligonucleotide
gaggaatggaccaatggaggtactaacgaaagggg

SEQ ID NO: 79050 - DNA, 35 bp, Artificial Sequence
  Synthetic oligonucleotide
gcttggacatggcatgtgtggtgttttatgcatgg

SEQ ID NO: 79051 - DNA, 34 bp, Artificial Sequence
  Synthetic oligonucleotide
tgcagtcccaagtgtaattctgctcttcaccctg

SEQ ID NO: 79052 - DNA, 35 bp, Artificial Sequence
  Synthetic oligonucleotide
agacaggaaaccacagggtcatcgaactatgcctg

SEQ ID NO: 79053 - DNA, 35 bp, Artificial Sequence
  Synthetic oligonucleotide
gaccccatgctgaatacgttccagcccacgttgtg

SEQ ID NO: 79054 - DNA, 35 bp, Artificial Sequence
  Synthetic oligonucleotide
gagagacccctgaacccctagatgagtagccgaat

SEQ ID NO: 79055 - DNA, 35 bp, Artificial Sequence
  Synthetic oligonucleotide
attcgtcgcagtcccctaggccgcagtctcatcat

SEQ ID NO: 79056 - DNA, 35 bp, Artificial Sequence
  Synthetic oligonucleotide
tatccaccagggctcatgcgatagaaaaccctcat

SEQ ID NO: 79057 - DNA, 35 bp, Artificial Sequence
  Synthetic oligonucleotide
aaccctgtcgtctgcacagcccgtttgccgttcat

SEQ ID NO: 79058 - DNA, 35 bp, Artificial Sequence
  Synthetic oligonucleotide
atggagctgtgcgaaccatacaccaaatcaaatct

SEQ ID NO: 79059 - DNA, 35 bp, Artificial Sequence
  Synthetic oligonucleotide
tcaatgcttgtttcgcctgcgcttccctcatctct

SEQ ID NO: 79060 - DNA, 35 bp, Artificial Sequence
  Synthetic oligonucleotide
agttagcacactgcaacttagtgttttgcaattct

SEQ ID NO: 79061 - DNA, 35 bp, Artificial Sequence
  Synthetic oligonucleotide
agatcagcacgggccggtgagtgggcggggtgcgt

SEQ ID NO: 79062 - DNA, 35 bp, Artificial Sequence
  Synthetic oligonucleotide
tagtgcctccaacttcgcacccagtttgacctatt

SEQ ID NO: 79063 - DNA, 35 bp, Artificial Sequence
  Synthetic oligonucleotide
gaacatggttggggtgtctgttttggctcatattt

SEQ ID NO: 79064 - DNA, 36 bp, Artificial Sequence
  Synthetic oligonucleotide
gaccgatctggcacatcgcgttttcaaccgctcgaa

SEQ ID NO: 79065 - DNA, 36 bp, Artificial Sequence
  Synthetic oligonucleotide
attggacggccggggggatcattgggcgttggtgaa

SEQ ID NO: 79066 - DNA, 35 bp, Artificial Sequence
  Synthetic oligonucleotide
tgtgcgcaaccgactattttgcatggtgcttgtaa

SEQ ID NO: 79067 - DNA, 36 bp, Artificial Sequence
  Synthetic oligonucleotide
gccacacaattgcaccctgagtagggaacacattaa

SEQ ID NO: 79068 - DNA, 36 bp, Artificial Sequence
  Synthetic oligonucleotide
agtgcctcccgaccttatttggccgctcttttcaca

SEQ ID NO: 79069 - DNA, 36 bp, Artificial Sequence
  Synthetic oligonucleotide
gcctcgtccgtgccactccatgtcccgtcctaacca

SEQ ID NO: 79070 - DNA, 35 bp, Artificial Sequence
  Synthetic oligonucleotide
atccgtgcgggccacgggttccgaattcgctacca

SEQ ID NO: 79071 - DNA, 36 bp, Artificial Sequence
  Synthetic oligonucleotide
ggaccaccccgtctcctctacgtcactgcactccca

SEQ ID NO: 79072 - DNA, 35 bp, Artificial Sequence
  Synthetic oligonucleotide
tgcttgcctcccttgctgagtccggtaattctcca

SEQ ID NO: 79073 - DNA, 35 bp, Artificial Sequence
  Synthetic oligonucleotide
aggtgacatgggcgggagggagaggattcgttcca

SEQ ID NO: 79074 - DNA, 36 bp, Artificial Sequence
  Synthetic oligonucleotide
gcccataccacgccgtccatcataattgagacagca

SEQ ID NO: 79075 - DNA, 36 bp, Artificial Sequence
  Synthetic oligonucleotide
accgataagcgaggggtaatggattcgggggaggca

SEQ ID NO: 79076 - DNA, 36 bp, Artificial Sequence
  Synthetic oligonucleotide
ggtacaccgccaacccttacccgtgatcacatggca

SEQ ID NO: 79077 - DNA, 36 bp, Artificial Sequence
  Synthetic oligonucleotide
actgacaccatatgatgtttaattctgttagctgca

SEQ ID NO: 79078 - DNA, 35 bp, Artificial Sequence
  Synthetic oligonucleotide
gaccagtcgccgcttggccaatgaggtacctctca

SEQ ID NO: 79079 - DNA, 36 bp, Artificial Sequence
  Synthetic oligonucleotide
aatcctcaccgcaacgatattcagcccccggagtca

SEQ ID NO: 79080 - DNA, 37 bp, Artificial Sequence
  Synthetic oligonucleotide
acgaccgtacaggtaacatccccgaatcgcaccgaga

SEQ ID NO: 79081 - DNA, 36 bp, Artificial Sequence
  Synthetic oligonucleotide
aacacatagcggttcaggggagggaaccgaaggaga

SEQ ID NO: 79082 - DNA, 37 bp, Artificial Sequence
  Synthetic oligonucleotide
ttgcgtccagcaaaggggggaattgtggaaggggaga

SEQ ID NO: 79083 - DNA, 37 bp, Artificial Sequence
  Synthetic oligonucleotide
actcccacctgcacatttaaccaagacgtgcactaga

SEQ ID NO: 79084 - DNA, 36 bp, Artificial Sequence
  Synthetic oligonucleotide
aacaccaacctgaatgcctaggacagcttccttaga

SEQ ID NO: 79085 - DNA, 36 bp, Artificial Sequence
  Synthetic oligonucleotide
gtcttccgccgtataccgcccttctcaaatttacga

SEQ ID NO: 79086 - DNA, 35 bp, Artificial Sequence
  Synthetic oligonucleotide
gagcccatcttttgcgatttgcccacgtgacccga

SEQ ID NO: 79087 - DNA, 36 bp, Artificial Sequence
  Synthetic oligonucleotide
gagtgccctagtagtgcctgtagttccccttgccga

SEQ ID NO: 79088 - DNA, 35 bp, Artificial Sequence
  Synthetic oligonucleotide
tttggggcgcactcactgttgatattaccctgcga

SEQ ID NO: 79089 - DNA, 37 bp, Artificial Sequence
  Synthetic oligonucleotide
gtgtgcgacaggtaggaactatccttttcccgtgcga

SEQ ID NO: 79090 - DNA, 37 bp, Artificial Sequence
  Synthetic oligonucleotide
tgacctcgcccattaccgcccataccaattgttgcga

SEQ ID NO: 79091 - DNA, 37 bp, Artificial Sequence
  Synthetic oligonucleotide
atcctctctcagagcccacaatagcctggaccctcga

SEQ ID NO: 79092 - DNA, 36 bp, Artificial Sequence
  Synthetic oligonucleotide
taccaactaccaaccgtcgtgcgccgccgccctcga

SEQ ID NO: 79093 - DNA, 37 bp, Artificial Sequence
  Synthetic oligonucleotide
gaagggagggttagctgggctggaggcatctccagga

SEQ ID NO: 79094 - DNA, 37 bp, Artificial Sequence
  Synthetic oligonucleotide
ttggaggaacaagggggagagcttgcataggagagga

SEQ ID NO: 79095 - DNA, 37 bp, Artificial Sequence
  Synthetic oligonucleotide
gccggaggcccgaaggggaggctcgggactgatagga

SEQ ID NO: 79096 - DNA, 36 bp, Artificial Sequence
  Synthetic oligonucleotide
gaccctcattccgcccgcaggccactcgactacgga

SEQ ID NO: 79097 - DNA, 36 bp, Artificial Sequence
  Synthetic oligonucleotide
gttgtagggtagcctttggggtcggggatggaggga

SEQ ID NO: 79098 - DNA, 36 bp, Artificial Sequence
  Synthetic oligonucleotide
gaggggggccacaaaaagggtcacgaccattaggga

SEQ ID NO: 79099 - DNA, 37 bp, Artificial Sequence
  Synthetic oligonucleotide
atggagcattgggggaggaccaaggaggttggcggga

SEQ ID NO: 79100 - DNA, 37 bp, Artificial Sequence
  Synthetic oligonucleotide
accgtccgggtaagaacgaggagtggttgggagggga

SEQ ID NO: 79101 - DNA, 37 bp, Artificial Sequence
  Synthetic oligonucleotide
gaccgctgattcccgtcgacttcgcacttcccttgga

SEQ ID NO: 79102 - DNA, 38 bp, Artificial Sequence
  Synthetic oligonucleotide
gtgggagtgcggggaaaggggtattgtgggagaaatga

SEQ ID NO: 79103 - DNA, 38 bp, Artificial Sequence
  Synthetic oligonucleotide
ttgacccatgcagactgggaatcatgcggtcagcatga

SEQ ID NO: 79104 - DNA, 38 bp, Artificial Sequence
  Synthetic oligonucleotide
gccacatccgcctagaccgctccatttgagaattatga

SEQ ID NO: 79105 - DNA, 38 bp, Artificial Sequence
  Synthetic oligonucleotide
agcgggaaggcgggtggttgaattaaggatagaactga

SEQ ID NO: 79106 - DNA, 37 bp, Artificial Sequence
  Synthetic oligonucleotide
gactgctcatcagggtccctttgtacgaactcactga

SEQ ID NO: 79107 - DNA, 38 bp, Artificial Sequence
  Synthetic oligonucleotide
aaacgccgtcatcctcccttggaccgatcctaccctga

SEQ ID NO: 79108 - DNA, 38 bp, Artificial Sequence
  Synthetic oligonucleotide
caacaccccaggtctttgcccaagttatccacccctga

SEQ ID NO: 79109 - DNA, 36 bp, Artificial Sequence
  Synthetic oligonucleotide
gcattaaacgcaccgcccaacatatacgccgcctga

SEQ ID NO: 79110 - DNA, 38 bp, Artificial Sequence
  Synthetic oligonucleotide
aaccatcgatccgaaggatcacttcgcctcatgcctga

SEQ ID NO: 79111 - DNA, 37 bp, Artificial Sequence
  Synthetic oligonucleotide
tccatagctagccgcctaaagctctaacacccgctga

SEQ ID NO: 79112 - DNA, 38 bp, Artificial Sequence
  Synthetic oligonucleotide
gaccccgataaggcattttccaccacgaccttggctga

SEQ ID NO: 79113 - DNA, 38 bp, Artificial Sequence
  Synthetic oligonucleotide
gacacgcgatcatccttgtttgctctcatctatgctga

SEQ ID NO: 79114 - DNA, 36 bp, Artificial Sequence
  Synthetic oligonucleotide
gtgaccctaatcatgaccctagcgccccgctgctga

SEQ ID NO: 79115 - DNA, 38 bp, Artificial Sequence
  Synthetic oligonucleotide
tcccacccgagagttagcccagggtcccattctgctga

SEQ ID NO: 79116 - DNA, 38 bp, Artificial Sequence
  Synthetic oligonucleotide
tgctcccgcaatcatctctaagacctccaaccatctga

SEQ ID NO: 79117 - DNA, 38 bp, Artificial Sequence
  Synthetic oligonucleotide
gcacctgcgaccgttgccccgttccagttcgtatctga

SEQ ID NO: 79118 - DNA, 37 bp, Artificial Sequence
  Synthetic oligonucleotide
tccaggctcagcttatccttgtgcgttattcctctga

SEQ ID NO: 79119 - DNA, 38 bp, Artificial Sequence
  Synthetic oligonucleotide
gtggaaggagcaggtgataccgttgatagggtgcgtga

SEQ ID NO: 79120 - DNA, 37 bp, Artificial Sequence
  Synthetic oligonucleotide
aatgaaggggcggtcggtgaggtgagctgtgtcgtga

SEQ ID NO: 79121 - DNA, 38 bp, Artificial Sequence
  Synthetic oligonucleotide
gggcgggagggagggtttcagttagtctctctaggtga

SEQ ID NO: 79122 - DNA, 38 bp, Artificial Sequence
  Synthetic oligonucleotide
agcccatccccctctgtgtaggccaaactagccggtga

SEQ ID NO: 79123 - DNA, 37 bp, Artificial Sequence
  Synthetic oligonucleotide
tcaagccctaccttatcgatctacagacacactgtga

SEQ ID NO: 79124 - DNA, 38 bp, Artificial Sequence
  Synthetic oligonucleotide
tgaacacccgagctgccataccttgcaccacattgtga

SEQ ID NO: 79125 - DNA, 38 bp, Artificial Sequence
  Synthetic oligonucleotide
tcacgcacagtgatggccagctactctaatactattga

SEQ ID NO: 79126 - DNA, 38 bp, Artificial Sequence
  Synthetic oligonucleotide
tcactcgggacaaactgcacattactcgcggtccttga

SEQ ID NO: 79127 - DNA, 38 bp, Artificial Sequence
  Synthetic oligonucleotide
gtcgacccccgcattaatctgtgaagggtaccttttga

SEQ ID NO: 79128 - DNA, 35 bp, Artificial Sequence
  Synthetic oligonucleotide
gactgggacatggagaaatggtgcggctatcgata

SEQ ID NO: 79129 - DNA, 36 bp, Artificial Sequence
  Synthetic oligonucleotide
gtggtggagtggtagggacaaggtggtagatggata

SEQ ID NO: 79130 - DNA, 35 bp, Artificial Sequence
  Synthetic oligonucleotide
accaaataccactcttgtgcgtactcgattacaac

SEQ ID NO: 79131 - DNA, 35 bp, Artificial Sequence
  Synthetic oligonucleotide
atcaactgtctgctcctcatcccggagttttacac

SEQ ID NO: 79132 - DNA, 35 bp, Artificial Sequence
  Synthetic oligonucleotide
tcctcactcggtccttgcactctgtctatctgcac

SEQ ID NO: 79133 - DNA, 35 bp, Artificial Sequence
  Synthetic oligonucleotide
tgcaaccgacgccgtgcacatcctactacgatcac

SEQ ID NO: 79134 - DNA, 35 bp, Artificial Sequence
  Synthetic oligonucleotide
gctacccgtatcatcttgcacacaataccgtgtac

SEQ ID NO: 79135 - DNA, 35 bp, Artificial Sequence
  Synthetic oligonucleotide
agtcctcctcagtcatccctcggacgcttggaacc

SEQ ID NO: 79136 - DNA, 35 bp, Artificial Sequence
  Synthetic oligonucleotide
ggtcccacggtcaggctatactgctcactataacc

SEQ ID NO: 79137 - DNA, 35 bp, Artificial Sequence
  Synthetic oligonucleotide
acgcacatgccatccatatttagatggatcactcc

SEQ ID NO: 79138 - DNA, 36 bp, Artificial Sequence
  Synthetic oligonucleotide
gccgtgccacccggacctgttcgtcgactactaggc

SEQ ID NO: 79139 - DNA, 35 bp, Artificial Sequence
  Synthetic oligonucleotide
tgccactcgtacgttagctacactgccagttaatc

SEQ ID NO: 79140 - DNA, 35 bp, Artificial Sequence
  Synthetic oligonucleotide
aatgcaaccgcagcctatctcgtttactttccatc

SEQ ID NO: 79141 - DNA, 35 bp, Artificial Sequence
  Synthetic oligonucleotide
atctaacacatcgagcccaccgccggctttagctc

SEQ ID NO: 79142 - DNA, 33 bp, Artificial Sequence
  Synthetic oligonucleotide
gtctgttgcaaatgacccagtactagccctctc

SEQ ID NO: 79143 - DNA, 35 bp, Artificial Sequence
  Synthetic oligonucleotide
tgatggcccaagcctactgatttttcttaagtctc

SEQ ID NO: 79144 - DNA, 35 bp, Artificial Sequence
  Synthetic oligonucleotide
gctagacctctgtttcctgtctcgtttttagtctc

SEQ ID NO: 79145 - DNA, 35 bp, Artificial Sequence
  Synthetic oligonucleotide
tccgttcataaatcgcctgcatggacacatttctc

SEQ ID NO: 79146 - DNA, 35 bp, Artificial Sequence
  Synthetic oligonucleotide
tgttcaccacatttcttgtagtattctgtcgtgtc

SEQ ID NO: 79147 - DNA, 35 bp, Artificial Sequence
  Synthetic oligonucleotide
gcgaacactcacacgttaactataaggaacctttc

SEQ ID NO: 79148 - DNA, 35 bp, Artificial Sequence
  Synthetic oligonucleotide
aagggagggggatggacgttgggattgtaagtaag

SEQ ID NO: 79149 - DNA, 35 bp, Artificial Sequence
  Synthetic oligonucleotide
tccatgccacataccctccccctggtcgtttcgag

SEQ ID NO: 79150 - DNA, 35 bp, Artificial Sequence
  Synthetic oligonucleotide
gtgcgaacaccatacgttcatatggcctgtccacg

SEQ ID NO: 79151 - DNA, 35 bp, Artificial Sequence
  Synthetic oligonucleotide
ggacctacctcacctaaacaccccggacctacgcg

SEQ ID NO: 79152 - DNA, 35 bp, Artificial Sequence
  Synthetic oligonucleotide
gtgcgaagtaggtagagctcagagggggaaggggg

SEQ ID NO: 79153 - DNA, 35 bp, Artificial Sequence
  Synthetic oligonucleotide
tctacggccatcaggaaggcgtggtgggaaggggg

SEQ ID NO: 79154 - DNA, 35 bp, Artificial Sequence
  Synthetic oligonucleotide
tttgaacccgtccagtctcctgccatcaacccgtg

SEQ ID NO: 79155 - DNA, 35 bp, Artificial Sequence
  Synthetic oligonucleotide
acacactgtgtcggtcgaaaatggggccagggttg

SEQ ID NO: 79156 - DNA, 35 bp, Artificial Sequence
  Synthetic oligonucleotide
ttcggacttccccgatgatcttactccttttgcat

SEQ ID NO: 79157 - DNA, 35 bp, Artificial Sequence
  Synthetic oligonucleotide
acgaggggggcactgcacacgcccagttgcacgat

SEQ ID NO: 79158 - DNA, 35 bp, Artificial Sequence
  Synthetic oligonucleotide
tttagcccacaacgcctggcactgtggtaccccct

SEQ ID NO: 79159 - DNA, 35 bp, Artificial Sequence
  Synthetic oligonucleotide
acatctactacgtcaccgctcctcgaattatgcct

SEQ ID NO: 79160 - DNA, 35 bp, Artificial Sequence
  Synthetic oligonucleotide
accaccctacccagagagtcaacggatcgcctcct

SEQ ID NO: 79161 - DNA, 35 bp, Artificial Sequence
  Synthetic oligonucleotide
gtctcacgtcgtccaagtatccccgaagcacctct

SEQ ID NO: 79162 - DNA, 35 bp, Artificial Sequence
  Synthetic oligonucleotide
ttagaagctgccccaagccgaaagttctcatgtct

SEQ ID NO: 79163 - DNA, 35 bp, Artificial Sequence
  Synthetic oligonucleotide
tctaccccacggacgtactggtcatttctgaacgt

SEQ ID NO: 79164 - DNA, 35 bp, Artificial Sequence
  Synthetic oligonucleotide
tgaccccgaagcgtgctgttctgagcttttcgggt

SEQ ID NO: 79165 - DNA, 35 bp, Artificial Sequence
  Synthetic oligonucleotide
ttttacatacgccgctgcccgttccccaggcgtgt

SEQ ID NO: 79166 - DNA, 35 bp, Artificial Sequence
  Synthetic oligonucleotide
tgttccgcactatttcatgagtacctacttctatt

SEQ ID NO: 79167 - DNA, 35 bp, Artificial Sequence
  Synthetic oligonucleotide
atcatccgccctgccaagcttgcccattgatactt

SEQ ID NO: 79168 - DNA, 36 bp, Artificial Sequence
  Synthetic oligonucleotide
gaccaaggacaggaacgtgagcatgagtcaagggtt

SEQ ID NO: 79169 - DNA, 35 bp, Artificial Sequence
  Synthetic oligonucleotide
actaccgcccgagctacaagcgcaccttctaattt

SEQ ID NO: 79170 - DNA, 35 bp, Artificial Sequence
  Synthetic oligonucleotide
tcactggtgaactacacacgcgaccatttcggttt

SEQ ID NO: 79171 - DNA, 35 bp, Artificial Sequence
  Synthetic oligonucleotide
gtaacgcaaccgccgctgataactaatctcctttt

SEQ ID NO: 79172 - DNA, 35 bp, Artificial Sequence
  Synthetic oligonucleotide
attcaccgcgtccttcttattcaatgcgctttttt

SEQ ID NO: 79173 - DNA, 36 bp, Artificial Sequence
  Synthetic oligonucleotide
tcagatgccctaccgtcctctgccatgtctcacaaa

SEQ ID NO: 79174 - DNA, 36 bp, Artificial Sequence
  Synthetic oligonucleotide
gacatggcacctttagttgacgcaccttctagcaaa

SEQ ID NO: 79175 - DNA, 35 bp, Artificial Sequence
  Synthetic oligonucleotide
tcacacctacataccgctttcacaggacactacaa

SEQ ID NO: 79176 - DNA, 36 bp, Artificial Sequence
  Synthetic oligonucleotide
gaccgccaaatgcggcacttcttcttcttggggcaa

SEQ ID NO: 79177 - DNA, 36 bp, Artificial Sequence
  Synthetic oligonucleotide
gagtacgatcagaagtgtggcgacgacccacacgaa

SEQ ID NO: 79178 - DNA, 36 bp, Artificial Sequence
  Synthetic oligonucleotide
gatgaagcatccaaacggagctgaacacagcaggaa

SEQ ID NO: 79179 - DNA, 36 bp, Artificial Sequence
  Synthetic oligonucleotide
tttgatgtcgttcaccctccccccattgtcattgaa

SEQ ID NO: 79180 - DNA, 36 bp, Artificial Sequence
  Synthetic oligonucleotide
gccgcaatgccaggacctcctaatcccccccgctaa

SEQ ID NO: 79181 - DNA, 36 bp, Artificial Sequence
  Synthetic oligonucleotide
tgactgaggctgggaacctcgaacatctggccaaca

SEQ ID NO: 79182 - DNA, 35 bp, Artificial Sequence
  Synthetic oligonucleotide
aagcacgtgcggcctccttttttctcctactgaca

SEQ ID NO: 79183 - DNA, 35 bp, Artificial Sequence
  Synthetic oligonucleotide
aacccatccgtctaggcatccattcctgtgtgaca

SEQ ID NO: 79184 - DNA, 35 bp, Artificial Sequence
  Synthetic oligonucleotide
actcacctcagcctgaagttccatgaaattctaca

SEQ ID NO: 79185 - DNA, 36 bp, Artificial Sequence
  Synthetic oligonucleotide
tcgaagtcacgaatccatctcgcaaagactccacca

SEQ ID NO: 79186 - DNA, 36 bp, Artificial Sequence
  Synthetic oligonucleotide
tgtatcgatcacttctagtcctctgctgtctggcca

SEQ ID NO: 79187 - DNA, 36 bp, Artificial Sequence
  Synthetic oligonucleotide
gggtaaccgccaccatcgccttgtcaaccctatcca

SEQ ID NO: 79188 - DNA, 35 bp, Artificial Sequence
  Synthetic oligonucleotide
tccgacaagaggcactgcgcattccgtggcttcca

SEQ ID NO: 79189 - DNA, 35 bp, Artificial Sequence
  Synthetic oligonucleotide
tatccgtcacgcctcgactggttggtctgcacgca

SEQ ID NO: 79190 - DNA, 36 bp, Artificial Sequence
  Synthetic oligonucleotide
gtgtcacgacattcacaattcgcccctcgacccgca

SEQ ID NO: 79191 - DNA, 36 bp, Artificial Sequence
  Synthetic oligonucleotide
gatgacgttaagccccccctgttaacgagtacatca

SEQ ID NO: 79192 - DNA, 35 bp, Artificial Sequence
  Synthetic oligonucleotide
atccccatctcactgtaaaagtcagtttcatctca

SEQ ID NO: 79193 - DNA, 35 bp, Artificial Sequence
  Synthetic oligonucleotide
gtatctagcacccccgcctcagaccgttgatttca

SEQ ID NO: 79194 - DNA, 36 bp, Artificial Sequence
  Synthetic oligonucleotide
gtatcatcgtgggtcgccatacatctgtagttttca

SEQ ID NO: 79195 - DNA, 37 bp, Artificial Sequence
  Synthetic oligonucleotide
atctgtcccgttcaccattatcgagccacccttaaga

SEQ ID NO: 79196 - DNA, 37 bp, Artificial Sequence
  Synthetic oligonucleotide
tactacgcctttgatctatggctaccacctccctaga

SEQ ID NO: 79197 - DNA, 37 bp, Artificial Sequence
  Synthetic oligonucleotide
accgtatcccccccaagctgtacaacacggttttaga

SEQ ID NO: 79198 - DNA, 37 bp, Artificial Sequence
  Synthetic oligonucleotide
tagtacgcccattaacatcgaatacgccgaaccccga

SEQ ID NO: 79199 - DNA, 36 bp, Artificial Sequence
  Synthetic oligonucleotide
tcagggtcctggcccacatactgaactttctcccga

SEQ ID NO: 79200 - DNA, 37 bp, Artificial Sequence
  Synthetic oligonucleotide
tccaggtgccacctgcgttctctctggttcaatccga

SEQ ID NO: 79201 - DNA, 36 bp, Artificial Sequence
  Synthetic oligonucleotide
agctgcaccaattccctgtcacacactttgcctcga

SEQ ID NO: 79202 - DNA, 35 bp, Artificial Sequence
  Synthetic oligonucleotide
tagccaggatttagcgtgacctcctcctctttcga

SEQ ID NO: 79203 - DNA, 37 bp, Artificial Sequence
  Synthetic oligonucleotide
agcctcccaaccgcaactgctgataaactctgtagga

SEQ ID NO: 79204 - DNA, 37 bp, Artificial Sequence
  Synthetic oligonucleotide
tcactccgtcgggtagttatcttgtttcgctgccgga

SEQ ID NO: 79205 - DNA, 37 bp, Artificial Sequence
  Synthetic oligonucleotide
ttgaagaggagacaaggtatagggtgagagaggggga

SEQ ID NO: 79206 - DNA, 37 bp, Artificial Sequence
  Synthetic oligonucleotide
agtggaacgcgcaagtttgtttgcggtgcggggggga

SEQ ID NO: 79207 - DNA, 37 bp, Artificial Sequence
  Synthetic oligonucleotide
agaggggggcaagatagggtgaatcacatagctggga

SEQ ID NO: 79208 - DNA, 35 bp, Artificial Sequence
  Synthetic oligonucleotide
aattcagttggaaaggcggtatgggggtggtggga

SEQ ID NO: 79209 - DNA, 37 bp, Artificial Sequence
  Synthetic oligonucleotide
tccatgagaagagacgcgagtgaagacgaaagatgga

SEQ ID NO: 79210 - DNA, 36 bp, Artificial Sequence
  Synthetic oligonucleotide
acccacaccgggcaaattgatttagtcaacgctgga

SEQ ID NO: 79211 - DNA, 37 bp, Artificial Sequence
  Synthetic oligonucleotide
attggtgagagcaacctgcagaggaaagggtggtgga

SEQ ID NO: 79212 - DNA, 37 bp, Artificial Sequence
  Synthetic oligonucleotide
tagacacctctcatccgcatgtccacatactattgga

SEQ ID NO: 79213 - DNA, 38 bp, Artificial Sequence
  Synthetic oligonucleotide
taagacgggggggaagtgtaacgataggcggtggatga

SEQ ID NO: 79214 - DNA, 38 bp, Artificial Sequence
  Synthetic oligonucleotide
tgtacaagggggtattagcagtaaagagggaggtatga

SEQ ID NO: 79215 - DNA, 38 bp, Artificial Sequence
  Synthetic oligonucleotide
tcacctccatcttgccattccaagagtcgggaacctga

SEQ ID NO: 79216 - DNA, 38 bp, Artificial Sequence
  Synthetic oligonucleotide
ggtcactgtcttctcgccttccgaccagctctccctga

SEQ ID NO: 79217 - DNA, 36 bp, Artificial Sequence
  Synthetic oligonucleotide
acctatcccacagcgctacgaccttccatatgctga

SEQ ID NO: 79218 - DNA, 37 bp, Artificial Sequence
  Synthetic oligonucleotide
tcacacaatacgaccttgctgcacagcctcttgctga

SEQ ID NO: 79219 - DNA, 38 bp, Artificial Sequence
  Synthetic oligonucleotide
tctgcgcgcatgtcgcactcaatgcaccttccatctga

SEQ ID NO: 79220 - DNA, 38 bp, Artificial Sequence
  Synthetic oligonucleotide
gtcacctagatctctccacccccacgcacggtatctga

SEQ ID NO: 79221 - DNA, 38 bp, Artificial Sequence
  Synthetic oligonucleotide
atcatcatgcctctcactatgccgtaatggggttctga

SEQ ID NO: 79222 - DNA, 38 bp, Artificial Sequence
  Synthetic oligonucleotide
tcgcccagcccccgactatcttcatgcgcatttagtga

SEQ ID NO: 79223 - DNA, 38 bp, Artificial Sequence
  Synthetic oligonucleotide
tgcgtatccacgttagtatttgcccctctcccccgtga

SEQ ID NO: 79224 - DNA, 37 bp, Artificial Sequence
  Synthetic oligonucleotide
gcgacatgcggagtgttgataggggtgggtacggtga

SEQ ID NO: 79225 - DNA, 38 bp, Artificial Sequence
  Synthetic oligonucleotide
taccaggcggcaagagtgatggcgttcgttcatggtga

SEQ ID NO: 79226 - DNA, 38 bp, Artificial Sequence
  Synthetic oligonucleotide
gacaatggaaggggtagaaagggcgtcgaaaaatgtga

SEQ ID NO: 79227 - DNA, 38 bp, Artificial Sequence
  Synthetic oligonucleotide
agtgtggacaaagggatagaagtatgtgacggatgtga

SEQ ID NO: 79228 - DNA, 37 bp, Artificial Sequence
  Synthetic oligonucleotide
atgtgcgcacgcctgcctcttcctcgtcacagtgtga

SEQ ID NO: 79229 - DNA, 37 bp, Artificial Sequence
  Synthetic oligonucleotide
acgccctacccctaagtatcctgtcgatcggaattga

SEQ ID NO: 79230 - DNA, 38 bp, Artificial Sequence
  Synthetic oligonucleotide
agcctgttcacattatcacgcgactatccttccattga

SEQ ID NO: 79231 - DNA, 37 bp, Artificial Sequence
  Synthetic oligonucleotide
tctagcccatctctcaagttggtttcgccaaccttga

SEQ ID NO: 79232 - DNA, 38 bp, Artificial Sequence
  Synthetic oligonucleotide
gcaacgtgactctgtgcattacgctctctgtgccttga

SEQ ID NO: 79233 - DNA, 37 bp, Artificial Sequence
  Synthetic oligonucleotide
tacccgcgccaccaccagtcttgcgatagatccttga

SEQ ID NO: 79234 - DNA, 38 bp, Artificial Sequence
  Synthetic oligonucleotide
gagcgccctcttgcttgtctttgtaccggttctcttga

SEQ ID NO: 79235 - DNA, 37 bp, Artificial Sequence
  Synthetic oligonucleotide
gaaaggatgcacggtgaaaaaaggggatagacgttga

SEQ ID NO: 79236 - DNA, 37 bp, Artificial Sequence
  Synthetic oligonucleotide
agatccacgtgccgagtagccttcttttagacgttga

SEQ ID NO: 79237 - DNA, 35 bp, Artificial Sequence
  Synthetic oligonucleotide
tcgtgcccttacacacacgcctcattgaccgttga

SEQ ID NO: 79238 - DNA, 37 bp, Artificial Sequence
  Synthetic oligonucleotide
agccccatcgtggctagcgtactaacatccccgttga

SEQ ID NO: 79239 - DNA, 37 bp, Artificial Sequence
  Synthetic oligonucleotide
aacatagtcatccgctgccgcctctttagcccgttga

SEQ ID NO: 79240 - DNA, 38 bp, Artificial Sequence
  Synthetic oligonucleotide
gttgcagacgggggggcgttgcacaggctctgggttga

SEQ ID NO: 79241 - DNA, 35 bp, Artificial Sequence
  Synthetic oligonucleotide
gggagggatggggcgataatgatatagggttaata

SEQ ID NO: 79242 - DNA, 36 bp, Artificial Sequence
  Synthetic oligonucleotide
acttcgggccggacttcaagggccagaacctacata

SEQ ID NO: 79243 - DNA, 36 bp, Artificial Sequence
  Synthetic oligonucleotide
tagtccggcaaggccattcgcatatccactcgcata

SEQ ID NO: 79244 - DNA, 35 bp, Artificial Sequence
  Synthetic oligonucleotide
tgtgaactgccctaaccgcggttataacccctata

SEQ ID NO: 79245 - DNA, 35 bp, Artificial Sequence
  Synthetic oligonucleotide
taccacgccacttctggtgtaagcgcttgcttata

SEQ ID NO: 79246 - DNA, 36 bp, Artificial Sequence
  Synthetic oligonucleotide
tatgtgacctccaagtctggatcctgtctactacta

SEQ ID NO: 79247 - DNA, 35 bp, Artificial Sequence
  Synthetic oligonucleotide
gcctccgtaagatctgcttcgatcaatcaccccta

SEQ ID NO: 79248 - DNA, 36 bp, Artificial Sequence
  Synthetic oligonucleotide
atcgcacgacgggaggaaggcaggaacgtgcgtcta

SEQ ID NO: 79249 - DNA, 35 bp, Artificial Sequence
  Synthetic oligonucleotide
gatgctccgttactaggtcttagttgtcgcttcta

SEQ ID NO: 79250 - DNA, 36 bp, Artificial Sequence
  Synthetic oligonucleotide
caggtgacagctcgcaaattagtatatgttttcgta

SEQ ID NO: 79251 - DNA, 36 bp, Artificial Sequence
  Synthetic oligonucleotide
accatgcctcccttagcacccttgatatcgcctgta

SEQ ID NO: 79252 - DNA, 36 bp, Artificial Sequence
  Synthetic oligonucleotide
tccaacagtgccatcgtcgtttcctaatcctactta

SEQ ID NO: 79253 - DNA, 36 bp, Artificial Sequence
  Synthetic oligonucleotide
atgccgtgaactcatgtactttagcgacatgattta

SEQ ID NO: 79254 - DNA, 35 bp, Artificial Sequence
  Synthetic oligonucleotide
tgacacccagtaagattccatcgtttgctgtacac

SEQ ID NO: 79255 - DNA, 35 bp, Artificial Sequence
  Synthetic oligonucleotide
ttatgtgccgctcccccagtaccattagctttcac

SEQ ID NO: 79256 - DNA, 35 bp, Artificial Sequence
  Synthetic oligonucleotide
gcatggatgaaagcggctgcaagggatagggatac

SEQ ID NO: 79257 - DNA, 35 bp, Artificial Sequence
  Synthetic oligonucleotide
tacatgttggtgccaatgactgtccgccgtacacc

SEQ ID NO: 79258 - DNA, 35 bp, Artificial Sequence
  Synthetic oligonucleotide
ttcgcggtgccggttcgtcttacccacattttccc

SEQ ID NO: 79259 - DNA, 35 bp, Artificial Sequence
  Synthetic oligonucleotide
agacctgacgtggtcttgccgctctccttttatcc

SEQ ID NO: 79260 - DNA, 35 bp, Artificial Sequence
  Synthetic oligonucleotide
actttcgcgcgcgccccatatgctttcttaccagc

SEQ ID NO: 79261 - DNA, 35 bp, Artificial Sequence
  Synthetic oligonucleotide
gttccctgaccgtcgttaccgttaactgctctggc

SEQ ID NO: 79262 - DNA, 35 bp, Artificial Sequence
  Synthetic oligonucleotide
atggcaacgccctgtcgctccctcattctgtctgc

SEQ ID NO: 79263 - DNA, 35 bp, Artificial Sequence
  Synthetic oligonucleotide
tacaccgtagttttacgcgttgtttcctcttttgc

SEQ ID NO: 79264 - DNA, 35 bp, Artificial Sequence
  Synthetic oligonucleotide
ttgccaataagctgttgctagcgggttgctccctc

SEQ ID NO: 79265 - DNA, 35 bp, Artificial Sequence
  Synthetic oligonucleotide
tgagcatgatatgcttcattcaactggtgcctgtc

SEQ ID NO: 79266 - DNA, 35 bp, Artificial Sequence
  Synthetic oligonucleotide
acccacatacactatgcgaacgctccaggctctag

SEQ ID NO: 79267 - DNA, 35 bp, Artificial Sequence
  Synthetic oligonucleotide
ataggtctagggggaaggaaagcggaggggtttag

SEQ ID NO: 79268 - DNA, 35 bp, Artificial Sequence
  Synthetic oligonucleotide
gatgctgactccctcgccgtcgatacaccgccccg

SEQ ID NO: 79269 - DNA, 35 bp, Artificial Sequence
  Synthetic oligonucleotide
ggagacgctgcacaaacggtttggtgagttctgcg

SEQ ID NO: 79270 - DNA, 35 bp, Artificial Sequence
  Synthetic oligonucleotide
atccgcggcatactaacccccgggttccatcttcg

SEQ ID NO: 79271 - DNA, 35 bp, Artificial Sequence
  Synthetic oligonucleotide
agccccgcctttattaacaacacaccacctgaagg

SEQ ID NO: 79272 - DNA, 35 bp, Artificial Sequence
  Synthetic oligonucleotide
gagccgtcaaacggggataagggtgggggaagagg

SEQ ID NO: 79273 - DNA, 35 bp, Artificial Sequence
  Synthetic oligonucleotide
gtgggtcaagggatagagttggctgtggaagaatg

SEQ ID NO: 79274 - DNA, 35 bp, Artificial Sequence
  Synthetic oligonucleotide
ggtactagcgataacaagggaggtagggtggaatg

SEQ ID NO: 79275 - DNA, 35 bp, Artificial Sequence
  Synthetic oligonucleotide
gtacacacctttgccaccacactcgatatgacctg

SEQ ID NO: 79276 - DNA, 35 bp, Artificial Sequence
  Synthetic oligonucleotide
gatcacgcattccagtgacatcattgacacgattg

SEQ ID NO: 79277 - DNA, 35 bp, Artificial Sequence
  Synthetic oligonucleotide
gatacctccgagtcgcttaagtccccttcctgttg

SEQ ID NO: 79278 - DNA, 35 bp, Artificial Sequence
  Synthetic oligonucleotide
acccaaccagtcggagtctatcggcgtcattccat

SEQ ID NO: 79279 - DNA, 35 bp, Artificial Sequence
  Synthetic oligonucleotide
gccgactccgggtgttgaacgtccgccccctccct

SEQ ID NO: 79280 - DNA, 35 bp, Artificial Sequence
  Synthetic oligonucleotide
gtccacctggccattaactttaagcattcgtagct

SEQ ID NO: 79281 - DNA, 35 bp, Artificial Sequence
  Synthetic oligonucleotide
tagcttacagccacaactgcttaccgtcttcatct

SEQ ID NO: 79282 - DNA, 35 bp, Artificial Sequence
  Synthetic oligonucleotide
gaacgacacgtcgccatcagcgctctttccgccgt

SEQ ID NO: 79283 - DNA, 35 bp, Artificial Sequence
  Synthetic oligonucleotide
gattgggcaaagcgggcaacacgttgctggtaggt

SEQ ID NO: 79284 - DNA, 35 bp, Artificial Sequence
  Synthetic oligonucleotide
agtggagggctgaggcgcttggtaacctgtcaatt

SEQ ID NO: 79285 - DNA, 35 bp, Artificial Sequence
  Synthetic oligonucleotide
atacgcgcaaccctcggcgcataccactagatatt

SEQ ID NO: 79286 - DNA, 35 bp, Artificial Sequence
  Synthetic oligonucleotide
attacccgccatcatcgaattcaactaaccccgtt

SEQ ID NO: 79287 - DNA, 35 bp, Artificial Sequence
  Synthetic oligonucleotide
aagcagaccctatttactgtggtcacccccttgtt

SEQ ID NO: 79288 - DNA, 35 bp, Artificial Sequence
  Synthetic oligonucleotide
gagaagccgggggtttggccgtgcctattgctttt

SEQ ID NO: 79289 - DNA, 35 bp, Artificial Sequence
  Synthetic oligonucleotide
gctcacgggtggcctacacctcatcctgggttttt

SEQ ID NO: 79290 - DNA, 35 bp, Artificial Sequence
  Synthetic oligonucleotide
attgacgcctccacgccttataggattacataaaa

SEQ ID NO: 79291 - DNA, 36 bp, Artificial Sequence
  Synthetic oligonucleotide
gatgcaagcaaccgacttgctccacatcctgttaaa

SEQ ID NO: 79292 - DNA, 36 bp, Artificial Sequence
  Synthetic oligonucleotide
gcgccccgatttctgccgacttctttcattgagcaa

SEQ ID NO: 79293 - DNA, 36 bp, Artificial Sequence
  Synthetic oligonucleotide
attctggtggtggaggtaggagggagtgccaggcaa

SEQ ID NO: 79294 - DNA, 36 bp, Artificial Sequence
  Synthetic oligonucleotide
tgctcccgccaaaggtcgattccatggatttctcaa

SEQ ID NO: 79295 - DNA, 35 bp, Artificial Sequence
  Synthetic oligonucleotide
ggatgggagctgaaaaattaggattggggcaggaa

SEQ ID NO: 79296 - DNA, 35 bp, Artificial Sequence
  Synthetic oligonucleotide
tgttaccatcacagcaccccgggccataccgctaa

SEQ ID NO: 79297 - DNA, 36 bp, Artificial Sequence
  Synthetic oligonucleotide
aacaccagtagctacattgcatggcgccccaattaa

SEQ ID NO: 79298 - DNA, 35 bp, Artificial Sequence
  Synthetic oligonucleotide
agtgaacgcatcgtttggacctcatgatcttgcca

SEQ ID NO: 79299 - DNA, 36 bp, Artificial Sequence
  Synthetic oligonucleotide
aagaacagtcagactccctgtgggcccttccctcca

SEQ ID NO: 79300 - DNA, 35 bp, Artificial Sequence
  Synthetic oligonucleotide
gactatctacgccaaccatttggggaccatttcca

SEQ ID NO: 79301 - DNA, 35 bp, Artificial Sequence
  Synthetic oligonucleotide
tctactgccactggatacatctactttttgtcgca

SEQ ID NO: 79302 - DNA, 36 bp, Artificial Sequence
  Synthetic oligonucleotide
gtgcccccattgttccccgttctggtcttacatgca

SEQ ID NO: 79303 - DNA, 36 bp, Artificial Sequence
  Synthetic oligonucleotide
gcatcacggcctggcccacttacctttgtacgctca

SEQ ID NO: 79304 - DNA, 35 bp, Artificial Sequence
  Synthetic oligonucleotide
tgttacgctccgcctatatgtgcattaccttgtca

SEQ ID NO: 79305 - DNA, 37 bp, Artificial Sequence
  Synthetic oligonucleotide
gaacaccgctatcgaccgcggtacagtcacaaagaga

SEQ ID NO: 79306 - DNA, 36 bp, Artificial Sequence
  Synthetic oligonucleotide
aagggccacaaccctgtattaacctaccgaacgaga

SEQ ID NO: 79307 - DNA, 37 bp, Artificial Sequence
  Synthetic oligonucleotide
taacaagataggggggacatgagcatgtcgattgaga

SEQ ID NO: 79308 - DNA, 37 bp, Artificial Sequence
  Synthetic oligonucleotide
aacgcaccctgcgccacattatttagcctgcccacga

SEQ ID NO: 79309 - DNA, 37 bp, Artificial Sequence
  Synthetic oligonucleotide
ttcgtacctgcctgtagatttcatgtttcactcccga

SEQ ID NO: 79310 - DNA, 36 bp, Artificial Sequence
  Synthetic oligonucleotide
aacatggaacaaaagctagttgcagctcgggtccga

SEQ ID NO: 79311 - DNA, 37 bp, Artificial Sequence
  Synthetic oligonucleotide
aaacacccttccgagtcacccatatgacgcaccgcga

SEQ ID NO: 79312 - DNA, 36 bp, Artificial Sequence
  Synthetic oligonucleotide
gctgggctcgggtccactcttcgttcttcccatcga

SEQ ID NO: 79313 - DNA, 37 bp, Artificial Sequence
  Synthetic oligonucleotide
agactgggaacacaggggcaagacatgagggcatcga

SEQ ID NO: 79314 - DNA, 37 bp, Artificial Sequence
  Synthetic oligonucleotide
gggccacatgcagctgcctgcgaccctatacattcga

SEQ ID NO: 79315 - DNA, 37 bp, Artificial Sequence
  Synthetic oligonucleotide
acagcaggttatacgtgctgtttttacctatcttcga

SEQ ID NO: 79316 - DNA, 37 bp, Artificial Sequence
  Synthetic oligonucleotide
tggtcatgaagaaaggggaaacgggtgatgggttcga

SEQ ID NO: 79317 - DNA, 37 bp, Artificial Sequence
  Synthetic oligonucleotide
tcagacgcatggcgcgaacggagcgagctacaaagga

SEQ ID NO: 79318 - DNA, 36 bp, Artificial Sequence
  Synthetic oligonucleotide
gaaagacagaaggcagaaataattggtcgtgtagga

SEQ ID NO: 79319 - DNA, 37 bp, Artificial Sequence
  Synthetic oligonucleotide
tgagacgtatgaacgggtggtacaggggacgaacgga

SEQ ID NO: 79320 - DNA, 37 bp, Artificial Sequence
  Synthetic oligonucleotide
tggacttggaaaaaggaagtaggaggagcagggcgga

SEQ ID NO: 79321 - DNA, 37 bp, Artificial Sequence
  Synthetic oligonucleotide
acaaagagaggaatgactggtggtggagacaggggga

SEQ ID NO: 79322 - DNA, 37 bp, Artificial Sequence
  Synthetic oligonucleotide
aagcggcacaggggaaagtacgtaggtttggtgggga

SEQ ID NO: 79323 - DNA, 37 bp, Artificial Sequence
  Synthetic oligonucleotide
gatcacgttactacctgctatctccagcttcctggga

SEQ ID NO: 79324 - DNA, 37 bp, Artificial Sequence
  Synthetic oligonucleotide
gtcgggtgatgaatctggataatggttggggggtgga

SEQ ID NO: 79325 - DNA, 37 bp, Artificial Sequence
  Synthetic oligonucleotide
tgtgagagacagtggattaagggttttcagttgtgga

SEQ ID NO: 79326 - DNA, 36 bp, Artificial Sequence
  Synthetic oligonucleotide
tgtatgccgccgtaggggtggggaaggctgattgga

SEQ ID NO: 79327 - DNA, 38 bp, Artificial Sequence
  Synthetic oligonucleotide
gtccactcaacgcggttacacgtcctctcaaaacatga

SEQ ID NO: 79328 - DNA, 38 bp, Artificial Sequence
  Synthetic oligonucleotide
accatcccccaaacctttcatcagctcagtccccatga

SEQ ID NO: 79329 - DNA, 37 bp, Artificial Sequence
  Synthetic oligonucleotide
tttgccccccgaccccatataaagattagctccatga

SEQ ID NO: 79330 - DNA, 37 bp, Artificial Sequence
  Synthetic oligonucleotide
tgctcctcccctagccactcactccccggtgagatga

SEQ ID NO: 79331 - DNA, 38 bp, Artificial Sequence
  Synthetic oligonucleotide
tgcgacgaggtagagcatgaaaggttgagaactgatga

SEQ ID NO: 79332 - DNA, 37 bp, Artificial Sequence
  Synthetic oligonucleotide
gtgtaggaaggatacgggaataggaaggcgaatatga

SEQ ID NO: 79333 - DNA, 38 bp, Artificial Sequence
  Synthetic oligonucleotide
tcattgccggatctgccaaccgaaccttctgattatga

SEQ ID NO: 79334 - DNA, 38 bp, Artificial Sequence
  Synthetic oligonucleotide
gatcgctcattggtaactttattcacgcatcccactga

SEQ ID NO: 79335 - DNA, 38 bp, Artificial Sequence
  Synthetic oligonucleotide
tacgcacccccagtttggcccacgcatccgcatactga

SEQ ID NO: 79336 - DNA, 37 bp, Artificial Sequence
  Synthetic oligonucleotide
tagacacgccaccgcacccttattttgcaccacctga

SEQ ID NO: 79337 - DNA, 38 bp, Artificial Sequence
  Synthetic oligonucleotide
atcctcgcagacgcgctcgattcatctattggccctga

SEQ ID NO: 79338 - DNA, 38 bp, Artificial Sequence
  Synthetic oligonucleotide
agagccccatgccgtacagttctctcatttttccctga

SEQ ID NO: 79339 - DNA, 38 bp, Artificial Sequence
  Synthetic oligonucleotide
tactgctcgggaaaaggtggttaacggtggtaggctga

SEQ ID NO: 79340 - DNA, 38 bp, Artificial Sequence
  Synthetic oligonucleotide
gagccgatctgccagccctttttctttctacgctctga

SEQ ID NO: 79341 - DNA, 38 bp, Artificial Sequence
  Synthetic oligonucleotide
tgcactccgctcctgtctaggtatgtccctccgcgtga

SEQ ID NO: 79342 - DNA, 34 bp, Artificial Sequence
  Synthetic oligonucleotide
atgggtgggggggggaggaaaagggagcgggtga

SEQ ID NO: 79343 - DNA, 38 bp, Artificial Sequence
  Synthetic oligonucleotide
tcagggcatgtggatacggggattagggggagtggtga

SEQ ID NO: 79344 - DNA, 38 bp, Artificial Sequence
  Synthetic oligonucleotide
gtttaaccgtcccgcgtgtcttcccgcccatactgtga

SEQ ID NO: 79345 - DNA, 37 bp, Artificial Sequence
  Synthetic oligonucleotide
actgtggtgaaggcgatagcgggggacaaaacattga

SEQ ID NO: 79346 - DNA, 37 bp, Artificial Sequence
  Synthetic oligonucleotide
ttgcccaaatagccccggacctgttgctgatcattga

SEQ ID NO: 79347 - DNA, 37 bp, Artificial Sequence
  Synthetic oligonucleotide
atgtggctacatcctctctgcccctgttccaacttga

SEQ ID NO: 79348 - DNA, 38 bp, Artificial Sequence
  Synthetic oligonucleotide
tctgactcccgtctggtctgtcgcgcctcaaaccttga

SEQ ID NO: 79349 - DNA, 37 bp, Artificial Sequence
  Synthetic oligonucleotide
tctcaacacggacacagagcattgtccgcacccttga

SEQ ID NO: 79350 - DNA, 37 bp, Artificial Sequence
  Synthetic oligonucleotide
ggagaaagcacaggtgatggcctgggggaagggttga

SEQ ID NO: 79351 - DNA, 37 bp, Artificial Sequence
  Synthetic oligonucleotide
accagcggtcagttcggatcggaaggcggggggttga

SEQ ID NO: 79352 - DNA, 38 bp, Artificial Sequence
  Synthetic oligonucleotide
tgatagcggagcatcgggcttttatctcttcactttga

SEQ ID NO: 79353 - DNA, 37 bp, Artificial Sequence
  Synthetic oligonucleotide
gcgatcctcaactatgtcactggcatcatcgctttga

SEQ ID NO: 79354 - DNA, 37 bp, Artificial Sequence
  Synthetic oligonucleotide
gccgcaacttcctccatggttgggcttacatctttga

SEQ ID NO: 79355 - DNA, 36 bp, Artificial Sequence
  Synthetic oligonucleotide
acacgcacacattgtggactgtcctggctcaaaata

SEQ ID NO: 79356 - DNA, 36 bp, Artificial Sequence
  Synthetic oligonucleotide
aatgagccgcactatggtctgcatacccgttacata

SEQ ID NO: 79357 - DNA, 36 bp, Artificial Sequence
  Synthetic oligonucleotide
gctgaacagggaggaattacaagcagcttgacgata

SEQ ID NO: 79358 - DNA, 36 bp, Artificial Sequence
  Synthetic oligonucleotide
gatgtcgtgcttggaggggggagccgtacttcacta

SEQ ID NO: 79359 - DNA, 35 bp, Artificial Sequence
  Synthetic oligonucleotide
agagacggcgtgaatccacactacatacactgcta

SEQ ID NO: 79360 - DNA, 35 bp, Artificial Sequence
  Synthetic oligonucleotide
tgttgccctgccagaatgtacctttccgcgagtta

SEQ ID NO: 79361 - DNA, 35 bp, Artificial Sequence
  Synthetic oligonucleotide
tccactcacgagagattcccgtgaaccaactacac

SEQ ID NO: 79362 - DNA, 35 bp, Artificial Sequence
  Synthetic oligonucleotide
acgacgtgtcgaggatccgccgcagattcttccac

SEQ ID NO: 79363 - DNA, 35 bp, Artificial Sequence
  Synthetic oligonucleotide
tctcgggccgttctttattcatgtaactgttccac

SEQ ID NO: 79364 - DNA, 35 bp, Artificial Sequence
  Synthetic oligonucleotide
aactgcctacccttcgctcgtaatcaacggggccc

SEQ ID NO: 79365 - DNA, 35 bp, Artificial Sequence
  Synthetic oligonucleotide
acgagaacgccacagtcaacctctatagcgcagcc

SEQ ID NO: 79366 - DNA, 35 bp, Artificial Sequence
  Synthetic oligonucleotide
ttggaaccacggccatgttactttctggtgctgcc

SEQ ID NO: 79367 - DNA, 35 bp, Artificial Sequence
  Synthetic oligonucleotide
gccatattccccgaggtactgaagtgccgcttgcc

SEQ ID NO: 79368 - DNA, 35 bp, Artificial Sequence
  Synthetic oligonucleotide
tcaatcctccctgcacatcgacttttgtgtaatcc

SEQ ID NO: 79369 - DNA, 35 bp, Artificial Sequence
  Synthetic oligonucleotide
agcccgaaggggctctcttttgcccagtcttatcc

SEQ ID NO: 79370 - DNA, 35 bp, Artificial Sequence
  Synthetic oligonucleotide
gccacttgcggatgcagcttgcctttgaccagtcc

SEQ ID NO: 79371 - DNA, 34 bp, Artificial Sequence
  Synthetic oligonucleotide
tctccacggtcacacctcccggattggatcgtcc

SEQ ID NO: 79372 - DNA, 35 bp, Artificial Sequence
  Synthetic oligonucleotide
cccaccggaccgaagtgggcctctgcctcctgtcc

SEQ ID NO: 79373 - DNA, 35 bp, Artificial Sequence
  Synthetic oligonucleotide
ggtcgcccactcttcaacggtttctcttgtacagc

SEQ ID NO: 79374 - DNA, 31 bp, Artificial Sequence
  Synthetic oligonucleotide
gtgggcctctccatccgttagtaatttccgc

SEQ ID NO: 79375 - DNA, 35 bp, Artificial Sequence
  Synthetic oligonucleotide
gttaaggcgtaatccccgtccctgttgcctctcgc

SEQ ID NO: 79376 - DNA, 35 bp, Artificial Sequence
  Synthetic oligonucleotide
gccccatcacccacataacattggtcttctaaggc

SEQ ID NO: 79377 - DNA, 36 bp, Artificial Sequence
  Synthetic oligonucleotide
gatacgccgcctccgcacgctacgctgttctttggc

SEQ ID NO: 79378 - DNA, 35 bp, Artificial Sequence
  Synthetic oligonucleotide
actcgtcaacgcaggttgacatagttcgctacatc

SEQ ID NO: 79379 - DNA, 35 bp, Artificial Sequence
  Synthetic oligonucleotide
cacaacgacacgctgcccggtccacgtttgccctc

SEQ ID NO: 79380 - DNA, 35 bp, Artificial Sequence
  Synthetic oligonucleotide
gtctaacgctctgaccctgaattcatgatcgcctc

SEQ ID NO: 79381 - DNA, 35 bp, Artificial Sequence
  Synthetic oligonucleotide
aaccaccaacagtatgccctgacccccccgtgctc

SEQ ID NO: 79382 - DNA, 35 bp, Artificial Sequence
  Synthetic oligonucleotide
gaccgaattagccgtggtgccatgtttcgtatctc

SEQ ID NO: 79383 - DNA, 35 bp, Artificial Sequence
  Synthetic oligonucleotide
tgtgtcttgccaggtgatcattctgtcacgctctc

SEQ ID NO: 79384 - DNA, 35 bp, Artificial Sequence
  Synthetic oligonucleotide
acaccttatctgggctcatttgacgcaacacggtc

SEQ ID NO: 79385 - DNA, 35 bp, Artificial Sequence
  Synthetic oligonucleotide
agtccgccttgcactatcccaagaactttagggtc

SEQ ID NO: 79386 - DNA, 35 bp, Artificial Sequence
  Synthetic oligonucleotide
gcaaccctggcgaaaccaacagtaattacgtattc

SEQ ID NO: 79387 - DNA, 35 bp, Artificial Sequence
  Synthetic oligonucleotide
tgcacggccgtttagacgacccttccatgcccttc

SEQ ID NO: 79388 - DNA, 35 bp, Artificial Sequence
  Synthetic oligonucleotide
tccgacacttccggtctgctattaaccgttttcag

SEQ ID NO: 79389 - DNA, 35 bp, Artificial Sequence
  Synthetic oligonucleotide
ttcagcacgcagtctccagtttacgtacccacacg

SEQ ID NO: 79390 - DNA, 35 bp, Artificial Sequence
  Synthetic oligonucleotide
aactgacttcctcaggcctatatactcgttctacg

SEQ ID NO: 79391 - DNA, 35 bp, Artificial Sequence
  Synthetic oligonucleotide
tcaacacctagtgggtctaccacatcagcataccg

SEQ ID NO: 79392 - DNA, 35 bp, Artificial Sequence
  Synthetic oligonucleotide
gtcccgtacacgcgctcagtatcctctcacgcccg

SEQ ID NO: 79393 - DNA, 35 bp, Artificial Sequence
  Synthetic oligonucleotide
gattgcatgtaccagcaatgtgagatcgtatctcg

SEQ ID NO: 79394 - DNA, 35 bp, Artificial Sequence
  Synthetic oligonucleotide
gatcatctcaggtttcatcgtctggccctacttcg

SEQ ID NO: 79395 - DNA, 35 bp, Artificial Sequence
  Synthetic oligonucleotide
atggacgccgcagaatttggggttggagcgggggg

SEQ ID NO: 79396 - DNA, 35 bp, Artificial Sequence
  Synthetic oligonucleotide
gcgcccttcccatggtcactactacggctccttgg

SEQ ID NO: 79397 - DNA, 35 bp, Artificial Sequence
  Synthetic oligonucleotide
ggatgccctgttgaggcctagtttcgatgggaatg

SEQ ID NO: 79398 - DNA, 35 bp, Artificial Sequence
  Synthetic oligonucleotide
tatcagtggatgttggtgcaagggggggggaattg

SEQ ID NO: 79399 - DNA, 35 bp, Artificial Sequence
  Synthetic oligonucleotide
tactctcccagtccagtgcggctaatccacccttg

SEQ ID NO: 79400 - DNA, 35 bp, Artificial Sequence
  Synthetic oligonucleotide
tcgcaccacgcctatcgcttaaggcctagccgttg

SEQ ID NO: 79401 - DNA, 35 bp, Artificial Sequence
  Synthetic oligonucleotide
gaccggttaccccctgtttctatcctcaagtgttg

SEQ ID NO: 79402 - DNA, 35 bp, Artificial Sequence
  Synthetic oligonucleotide
accgggtcgcgagtggtcgccctccttattcgaat

SEQ ID NO: 79403 - DNA, 35 bp, Artificial Sequence
  Synthetic oligonucleotide
atagtacgcccatccatcctggtttcgatcaccat

SEQ ID NO: 79404 - DNA, 35 bp, Artificial Sequence
  Synthetic oligonucleotide
gacgttgccctgttcccctgattgttccgttccat

SEQ ID NO: 79405 - DNA, 35 bp, Artificial Sequence
  Synthetic oligonucleotide
tcaatccgcccaggataagggttcggcctccctat

SEQ ID NO: 79406 - DNA, 35 bp, Artificial Sequence
  Synthetic oligonucleotide
tgccctcgatgctatgtctggcctcctgatcaact

SEQ ID NO: 79407 - DNA, 35 bp, Artificial Sequence
  Synthetic oligonucleotide
cctcacctccggtcacgttgtctcccgttagtcct

SEQ ID NO: 79408 - DNA, 35 bp, Artificial Sequence
  Synthetic oligonucleotide
tgacgcctcaacagcagtctcatgggaggtggtct

SEQ ID NO: 79409 - DNA, 35 bp, Artificial Sequence
  Synthetic oligonucleotide
gcacacatgaggccaggactcctttcagccattct

SEQ ID NO: 79410 - DNA, 35 bp, Artificial Sequence
  Synthetic oligonucleotide
tatggccagccgcctggtccacatttcttatccgt

SEQ ID NO: 79411 - DNA, 35 bp, Artificial Sequence
  Synthetic oligonucleotide
tacctctcgactcctgagcttttcaacacacgatt

SEQ ID NO: 79412 - DNA, 35 bp, Artificial Sequence
  Synthetic oligonucleotide
gcacccgcgttcttcccgtttttcgtagttttatt

SEQ ID NO: 79413 - DNA, 35 bp, Artificial Sequence
  Synthetic oligonucleotide
ttacgcagttagggccttgatctgcctacttcctt

SEQ ID NO: 79414 - DNA, 35 bp, Artificial Sequence
  Synthetic oligonucleotide
tcaacctggcacccgctgttcgtcgctctaaggtt

SEQ ID NO: 79415 - DNA, 35 bp, Artificial Sequence
  Synthetic oligonucleotide
tgtgtaaccggaagggtgggatcggacgagggttt

SEQ ID NO: 79416 - DNA, 35 bp, Artificial Sequence
  Synthetic oligonucleotide
tcatcactcccccgcttcatgccattttgactaaa

SEQ ID NO: 79417 - DNA, 35 bp, Artificial Sequence
  Synthetic oligonucleotide
gcaagcatgggggcgcacaggaaacaggtcagcaa

SEQ ID NO: 79418 - DNA, 36 bp, Artificial Sequence
  Synthetic oligonucleotide
gcacaccacgcagctatccccgcaccagtgaggcaa

SEQ ID NO: 79419 - DNA, 36 bp, Artificial Sequence
  Synthetic oligonucleotide
gagcaccactcgatatgccggtttctcaatggtcaa

SEQ ID NO: 79420 - DNA, 36 bp, Artificial Sequence
  Synthetic oligonucleotide
acaaccaacacagccctctaacgaactcgatccgaa

SEQ ID NO: 79421 - DNA, 36 bp, Artificial Sequence
  Synthetic oligonucleotide
tggagccacatcccgctgacctgagaaccacgttaa

SEQ ID NO: 79422 - DNA, 36 bp, Artificial Sequence
  Synthetic oligonucleotide
aatcgatatcgccttcacacgtgtcccgctctttaa

SEQ ID NO: 79423 - DNA, 36 bp, Artificial Sequence
  Synthetic oligonucleotide
gttcaggctcgtaatcttgtggcaccccgtttttaa

SEQ ID NO: 79424 - DNA, 36 bp, Artificial Sequence
  Synthetic oligonucleotide
ttgcaatccggcggcctacatggcatctctccaaca

SEQ ID NO: 79425 - DNA, 36 bp, Artificial Sequence
  Synthetic oligonucleotide
gagccccactgccgattattacttgtgtggtcgaca

SEQ ID NO: 79426 - DNA, 36 bp, Artificial Sequence
  Synthetic oligonucleotide
ttgcgcaattctgcctcactttctgggtccctgaca

SEQ ID NO: 79427 - DNA, 36 bp, Artificial Sequence
  Synthetic oligonucleotide
agccaaccgttacgcgacggactcttctttcctaca

SEQ ID NO: 79428 - DNA, 36 bp, Artificial Sequence
  Synthetic oligonucleotide
gccgattcgctcctggtgcccataaagtactccgca

SEQ ID NO: 79429 - DNA, 36 bp, Artificial Sequence
  Synthetic oligonucleotide
tcactccccaggaagttccaatgcctctatactgca

SEQ ID NO: 79430 - DNA, 35 bp, Artificial Sequence
  Synthetic oligonucleotide
tgacactccccgtccctgcctctttgtttgctgca

SEQ ID NO: 79431 - DNA, 36 bp, Artificial Sequence
  Synthetic oligonucleotide
tgaatggtcccgcttggcgaataccggattacttca

SEQ ID NO: 79432 - DNA, 35 bp, Artificial Sequence
  Synthetic oligonucleotide
tccgcgcttagcactgctaaatctgcctcctttca

SEQ ID NO: 79433 - DNA, 37 bp, Artificial Sequence
  Synthetic oligonucleotide
aagggtgggaacttgagagggggaccggttcgaaaga

SEQ ID NO: 79434 - DNA, 37 bp, Artificial Sequence
  Synthetic oligonucleotide
gggagggggagcaggttaattactgaaggatgcaaga

SEQ ID NO: 79435 - DNA, 37 bp, Artificial Sequence
  Synthetic oligonucleotide
cagaggggggggaagggagggttagagttaggacaga

SEQ ID NO: 79436 - DNA, 37 bp, Artificial Sequence
  Synthetic oligonucleotide
gctgatcccacccctccaacgctgactcgttcccaga

SEQ ID NO: 79437 - DNA, 37 bp, Artificial Sequence
  Synthetic oligonucleotide
gacacgccgccacacctggctttcaattttcaaacga

SEQ ID NO: 79438 - DNA, 37 bp, Artificial Sequence
  Synthetic oligonucleotide
gctccaccctgaaccccatgtatttagcgtgtaacga

SEQ ID NO: 79439 - DNA, 37 bp, Artificial Sequence
  Synthetic oligonucleotide
gttaccgcgcagttctgtccttttgcactcttaacga

SEQ ID NO: 79440 - DNA, 37 bp, Artificial Sequence
  Synthetic oligonucleotide
gaaacagtcgagatcgcactcctctatccttccacga

SEQ ID NO: 79441 - DNA, 37 bp, Artificial Sequence
  Synthetic oligonucleotide
agtctactcctcacgtgaatacacctccgttctacga

SEQ ID NO: 79442 - DNA, 36 bp, Artificial Sequence
  Synthetic oligonucleotide
gtacacgtcgtatcacctagccccaggtccagccga

SEQ ID NO: 79443 - DNA, 37 bp, Artificial Sequence
  Synthetic oligonucleotide
tacgaagagagagggatatagggcaggagattcgcga

SEQ ID NO: 79444 - DNA, 37 bp, Artificial Sequence
  Synthetic oligonucleotide
tgtgggggcttggtgcggaagtcgggacgtgaggcga

SEQ ID NO: 79445 - DNA, 37 bp, Artificial Sequence
  Synthetic oligonucleotide
aatggaggggcttccggtaagggaaacgggggggcga

SEQ ID NO: 79446 - DNA, 36 bp, Artificial Sequence
  Synthetic oligonucleotide
aaagggcatggacaggagagaggcactggctggcga

SEQ ID NO: 79447 - DNA, 36 bp, Artificial Sequence
  Synthetic oligonucleotide
acacactctctcagcgtaacaaattacgtgcatcga

SEQ ID NO: 79448 - DNA, 37 bp, Artificial Sequence
  Synthetic oligonucleotide
gtggagggccggtagagttaggaacgcaaggtaagga

SEQ ID NO: 79449 - DNA, 35 bp, Artificial Sequence
  Synthetic oligonucleotide
aagtagggtgacggagtggtaactgagtacgagga

SEQ ID NO: 79450 - DNA, 37 bp, Artificial Sequence
  Synthetic oligonucleotide
ttgtgtgaaggtggcaagaagggctagaccaaatgga

SEQ ID NO: 79451 - DNA, 37 bp, Artificial Sequence
  Synthetic oligonucleotide
aacacaccctgcttgccccaccttatgtcagcctgga

SEQ ID NO: 79452 - DNA, 36 bp, Artificial Sequence
  Synthetic oligonucleotide
gaagggggagtgtctaaccaggaaggagggagtgga

SEQ ID NO: 79453 - DNA, 37 bp, Artificial Sequence
  Synthetic oligonucleotide
ggatgggtccaagtgatgggggtggtttggatgtgga

SEQ ID NO: 79454 - DNA, 38 bp, Artificial Sequence
  Synthetic oligonucleotide
gtccgcgcaagctttggtacctcctctgtctgacatga

SEQ ID NO: 79455 - DNA, 37 bp, Artificial Sequence
  Synthetic oligonucleotide
acccaacagacagtccacgcctttgaactgcccatga

SEQ ID NO: 79456 - DNA, 38 bp, Artificial Sequence
  Synthetic oligonucleotide
gccaccgtccttgttaagtgttccctccgatcccatga

SEQ ID NO: 79457 - DNA, 36 bp, Artificial Sequence
  Synthetic oligonucleotide
gttgaggaaagaagcacaaaattaggagatggatga

SEQ ID NO: 79458 - DNA, 38 bp, Artificial Sequence
  Synthetic oligonucleotide
aaacacccactcacgcagttacgagactggaggtatga

SEQ ID NO: 79459 - DNA, 38 bp, Artificial Sequence
  Synthetic oligonucleotide
tagccgaacctactgagaggcgtaactcaaatcactga

SEQ ID NO: 79460 - DNA, 38 bp, Artificial Sequence
  Synthetic oligonucleotide
taccgttgacgtcgggttttggggagggggggtactga

SEQ ID NO: 79461 - DNA, 38 bp, Artificial Sequence
  Synthetic oligonucleotide
ttgcacggcgtgggattctgtgccactcctttccctga

SEQ ID NO: 79462 - DNA, 38 bp, Artificial Sequence
  Synthetic oligonucleotide
agacactccaatcctgttgtgaccatcacgactcctga

SEQ ID NO: 79463 - DNA, 38 bp, Artificial Sequence
  Synthetic oligonucleotide
gcgaggcctcgctcgacttggaacctccacctagctga

SEQ ID NO: 79464 - DNA, 38 bp, Artificial Sequence
  Synthetic oligonucleotide
gtacagcccgtcccataactcgcatcccaagccggtga

SEQ ID NO: 79465 - DNA, 38 bp, Artificial Sequence
  Synthetic oligonucleotide
ggtgccggggagtgaaggggtacggcgtaaaggggtga

SEQ ID NO: 79466 - DNA, 38 bp, Artificial Sequence
  Synthetic oligonucleotide
gcattggacgtccattctggagggtgggacgggggtga

SEQ ID NO: 79467 - DNA, 38 bp, Artificial Sequence
  Synthetic oligonucleotide
acagaccactcgccgttgtggtatttctctcacattga

SEQ ID NO: 79468 - DNA, 38 bp, Artificial Sequence
  Synthetic oligonucleotide
tgcaaacgccgggggaattaacgagggagggggattga

SEQ ID NO: 79469 - DNA, 38 bp, Artificial Sequence
  Synthetic oligonucleotide
accacccgggccagggaattcgtgccttccaatattga

SEQ ID NO: 79470 - DNA, 38 bp, Artificial Sequence
  Synthetic oligonucleotide
gagttgccccattggtgtcttggccgtgccctacttga

SEQ ID NO: 79471 - DNA, 37 bp, Artificial Sequence
  Synthetic oligonucleotide
ggagcccatcagctttcccgcgctcacacgaccttga

SEQ ID NO: 79472 - DNA, 38 bp, Artificial Sequence
  Synthetic oligonucleotide
gcacactgtcctttctgctccggactaaatcccgttga

SEQ ID NO: 79473 - DNA, 38 bp, Artificial Sequence
  Synthetic oligonucleotide
gaccggacgaaagaggctaggagatgatggtgtgttga

SEQ ID NO: 79474 - DNA, 36 bp, Artificial Sequence
  Synthetic oligonucleotide
tcccactgaacactgccacccataggagttgggata

SEQ ID NO: 79475 - DNA, 36 bp, Artificial Sequence
  Synthetic oligonucleotide
gtcgacatgtgggccgtgggcggggtgacgggggta

SEQ ID NO: 79476 - DNA, 36 bp, Artificial Sequence
  Synthetic oligonucleotide
acgacacatgttccagcgatggcttttttccactta

SEQ ID NO: 79477 - DNA, 36 bp, Artificial Sequence
  Synthetic oligonucleotide
gacgatccgactatcggcctttgaaccctttagtta

SEQ ID NO: 79478 - DNA, 35 bp, Artificial Sequence
  Synthetic oligonucleotide
ttagtgaggcgggtcacggggaaggcacgggcaac

SEQ ID NO: 79479 - DNA, 35 bp, Artificial Sequence
  Synthetic oligonucleotide
ggaggcccaacgggtcttacacattacgaattaac

SEQ ID NO: 79480 - DNA, 35 bp, Artificial Sequence
  Synthetic oligonucleotide
gtgtggaggggagagaaaagtaaggccaggcgcac

SEQ ID NO: 79481 - DNA, 35 bp, Artificial Sequence
  Synthetic oligonucleotide
caactgacctcacctccgatagaattgcctgcacc

SEQ ID NO: 79482 - DNA, 35 bp, Artificial Sequence
  Synthetic oligonucleotide
acgctgcctgaatgccctgaacgcgcgccgtaccc

SEQ ID NO: 79483 - DNA, 35 bp, Artificial Sequence
  Synthetic oligonucleotide
tgaacacctcatcagcgactctaggcctccattcc

SEQ ID NO: 79484 - DNA, 35 bp, Artificial Sequence
  Synthetic oligonucleotide
tagtgtcttcctccacgcccgcgctctgtccttcc

SEQ ID NO: 79485 - DNA, 35 bp, Artificial Sequence
  Synthetic oligonucleotide
accatcctccctataaacgacgctgtcagccgcgc

SEQ ID NO: 79486 - DNA, 35 bp, Artificial Sequence
  Synthetic oligonucleotide
ggaatgggtgcggagaaagaactgagcggacttgc

SEQ ID NO: 79487 - DNA, 35 bp, Artificial Sequence
  Synthetic oligonucleotide
gactgcctcaaggcctttctctacctgaggcttgc

SEQ ID NO: 79488 - DNA, 35 bp, Artificial Sequence
  Synthetic oligonucleotide
gcccacccacggagaacgttagagtgtgggccatc

SEQ ID NO: 79489 - DNA, 35 bp, Artificial Sequence
  Synthetic oligonucleotide
tcgtatactcatgcccagtcgtggggcccctcctc

SEQ ID NO: 79490 - DNA, 35 bp, Artificial Sequence
  Synthetic oligonucleotide
gaccaggcgaggtcctatatcagtttcttcaagtc

SEQ ID NO: 79491 - DNA, 35 bp, Artificial Sequence
  Synthetic oligonucleotide
ttgtgacgccgtatacttctcatcgtttattggtc

SEQ ID NO: 79492 - DNA, 35 bp, Artificial Sequence
  Synthetic oligonucleotide
acggtgccccatcgctgtctaattccggccctgtc

SEQ ID NO: 79493 - DNA, 35 bp, Artificial Sequence
  Synthetic oligonucleotide
tacctcctgccacattttaattcaccgttgttgtc

SEQ ID NO: 79494 - DNA, 35 bp, Artificial Sequence
  Synthetic oligonucleotide
gtaccactgtagaactgcaattgccacatccccag

SEQ ID NO: 79495 - DNA, 35 bp, Artificial Sequence
  Synthetic oligonucleotide
tacgacggcgtaactatacacgcttggcaaccccg

SEQ ID NO: 79496 - DNA, 34 bp, Artificial Sequence
  Synthetic oligonucleotide
gctacgtacatgctccctctacgatatgtctgcg

SEQ ID NO: 79497 - DNA, 35 bp, Artificial Sequence
  Synthetic oligonucleotide
tgccaaatcgggctttatctgttcacccttagagg

SEQ ID NO: 79498 - DNA, 36 bp, Artificial Sequence
  Synthetic oligonucleotide
tgttccaccccataaccttacgcgcgaatccgcggg

SEQ ID NO: 79499 - DNA, 35 bp, Artificial Sequence
  Synthetic oligonucleotide
gggtctgggggggaaatgggttaaagggccgttgg

SEQ ID NO: 79500 - DNA, 35 bp, Artificial Sequence
  Synthetic oligonucleotide
gacatgggggggtttactgcaggtggactatgctg

SEQ ID NO: 79501 - DNA, 35 bp, Artificial Sequence
  Synthetic oligonucleotide
tgtggctcagggaggagcttgggggggtgattgtg

SEQ ID NO: 79502 - DNA, 35 bp, Artificial Sequence
  Synthetic oligonucleotide
tgggcgcttttcccgtacccgtgcccacccttgtg

SEQ ID NO: 79503 - DNA, 35 bp, Artificial Sequence
  Synthetic oligonucleotide
tcctcccacgcgaggggggtgcttttgaattcttg

SEQ ID NO: 79504 - DNA, 35 bp, Artificial Sequence
  Synthetic oligonucleotide
acctccgacacggtccagctcgtcgcacggtccat

SEQ ID NO: 79505 - DNA, 35 bp, Artificial Sequence
  Synthetic oligonucleotide
gtcgtggccctgctcgcattgaaggtccatcttat

SEQ ID NO: 79506 - DNA, 35 bp, Artificial Sequence
  Synthetic oligonucleotide
acgcatacgaggaggtctccgtccctgcaaccact

SEQ ID NO: 79507 - DNA, 35 bp, Artificial Sequence
  Synthetic oligonucleotide
acgttccgcctcgttcagctccgccacgttcacct

SEQ ID NO: 79508 - DNA, 35 bp, Artificial Sequence
  Synthetic oligonucleotide
atgcgacattccgtcccgtgattaccctattacct

SEQ ID NO: 79509 - DNA, 35 bp, Artificial Sequence
  Synthetic oligonucleotide
acagtgccgcaaacatccttgtcaatccacttcct

SEQ ID NO: 79510 - DNA, 35 bp, Artificial Sequence
  Synthetic oligonucleotide
actcacaactgcccacctgcattacagttaaagct

SEQ ID NO: 79511 - DNA, 35 bp, Artificial Sequence
  Synthetic oligonucleotide
gcctttgacgtgacctggcccttcacacatgtgct

SEQ ID NO: 79512 - DNA, 35 bp, Artificial Sequence
  Synthetic oligonucleotide
ttgcgcatcatactctcgtccgtcccgctatatct

SEQ ID NO: 79513 - DNA, 35 bp, Artificial Sequence
  Synthetic oligonucleotide
actgagtgtcgcagccctctctataccatgtatct

SEQ ID NO: 79514 - DNA, 34 bp, Artificial Sequence
  Synthetic oligonucleotide
agcacgacgtaacactcacgccctattctttagt

SEQ ID NO: 79515 - DNA, 35 bp, Artificial Sequence
  Synthetic oligonucleotide
gatccccataacgtactcttgtcctgacattacgt

SEQ ID NO: 79516 - DNA, 35 bp, Artificial Sequence
  Synthetic oligonucleotide
tccgcgagaatactcccgtcaatccagccctccgt

SEQ ID NO: 79517 - DNA, 35 bp, Artificial Sequence
  Synthetic oligonucleotide
actgcatgcagcccggactgttcatgtttctctgt

SEQ ID NO: 79518 - DNA, 35 bp, Artificial Sequence
  Synthetic oligonucleotide
gtcctccctccgtcgccgcatttagcttcccttgt

SEQ ID NO: 79519 - DNA, 35 bp, Artificial Sequence
  Synthetic oligonucleotide
ttcaactgcgcggggccgtagtactatctttttgt

SEQ ID NO: 79520 - DNA, 35 bp, Artificial Sequence
  Synthetic oligonucleotide
gactcagctggtacttgcactgcacatagcccatt

SEQ ID NO: 79521 - DNA, 35 bp, Artificial Sequence
  Synthetic oligonucleotide
atccgtaccgaatcatcttgagcgcttgatacctt

SEQ ID NO: 79522 - DNA, 35 bp, Artificial Sequence
  Synthetic oligonucleotide
gacgacggaggtgcgtgctgccgatccagtttctt

SEQ ID NO: 79523 - DNA, 35 bp, Artificial Sequence
  Synthetic oligonucleotide
tcaccaccactcgcgatttgacgccattctacgtt

SEQ ID NO: 79524 - DNA, 36 bp, Artificial Sequence
  Synthetic oligonucleotide
gaaacgtggggtatgcgcggagggtgcaattgcaaa

SEQ ID NO: 79525 - DNA, 36 bp, Artificial Sequence
  Synthetic oligonucleotide
gccacgccgcttgtctagcgccacaaaatctaacaa

SEQ ID NO: 79526 - DNA, 36 bp, Artificial Sequence
  Synthetic oligonucleotide
gccccccgactgaatggtccaccatgtttgtatcaa

SEQ ID NO: 79527 - DNA, 36 bp, Artificial Sequence
  Synthetic oligonucleotide
gttggcgatctacctggcgtttatcacagtattcaa

SEQ ID NO: 79528 - DNA, 36 bp, Artificial Sequence
  Synthetic oligonucleotide
gccatccccgaagggaaagcgacctttgccatggaa

SEQ ID NO: 79529 - DNA, 36 bp, Artificial Sequence
  Synthetic oligonucleotide
gccgtagtcaaatcctcgccgcaacaccttacataa

SEQ ID NO: 79530 - DNA, 36 bp, Artificial Sequence
  Synthetic oligonucleotide
tgtttcccatccgaccactgggttatgtcatactaa

SEQ ID NO: 79531 - DNA, 35 bp, Artificial Sequence
  Synthetic oligonucleotide
tcacacattcctgatattaacacatagatccctaa

SEQ ID NO: 79532 - DNA, 35 bp, Artificial Sequence
  Synthetic oligonucleotide
acgcacgccccggagccgccttcctttgagagtaa

SEQ ID NO: 79533 - DNA, 36 bp, Artificial Sequence
  Synthetic oligonucleotide
ttcaccactggcgcccatcctgcactcctagcgtaa

SEQ ID NO: 79534 - DNA, 36 bp, Artificial Sequence
  Synthetic oligonucleotide
tactgtgcaccgccggctggtggtcttcgcctttaa

SEQ ID NO: 79535 - DNA, 35 bp, Artificial Sequence
  Synthetic oligonucleotide
gactggggacaaagagatggaaaggcgacgagaca

SEQ ID NO: 79536 - DNA, 36 bp, Artificial Sequence
  Synthetic oligonucleotide
attcaggacgcggggtgggggtcgggttatcataca

SEQ ID NO: 79537 - DNA, 36 bp, Artificial Sequence
  Synthetic oligonucleotide
gcctaccacgagcctttataaattgagtcatcccca

SEQ ID NO: 79538 - DNA, 35 bp, Artificial Sequence
  Synthetic oligonucleotide
gcaactgcgcggatatctgtcctgtttttttgcca

SEQ ID NO: 79539 - DNA, 35 bp, Artificial Sequence
  Synthetic oligonucleotide
tgcgcaactggggcggaagactaacacttccctca

SEQ ID NO: 79540 - DNA, 36 bp, Artificial Sequence
  Synthetic oligonucleotide
gctgatgcgcttatgattcggtcctgctagtcctca

SEQ ID NO: 79541 - DNA, 36 bp, Artificial Sequence
  Synthetic oligonucleotide
tttcaactcggtcttgttcacacacgattactctca

SEQ ID NO: 79542 - DNA, 36 bp, Artificial Sequence
  Synthetic oligonucleotide
gacacaggtagttcgggtctaatcattcgtttctca

SEQ ID NO: 79543 - DNA, 36 bp, Artificial Sequence
  Synthetic oligonucleotide
tcccccggcccccctgcattcaaatccgttctttca

SEQ ID NO: 79544 - DNA, 34 bp, Artificial Sequence
  Synthetic oligonucleotide
ttgtctcctgtcactttcggggtcttctttttca

SEQ ID NO: 79545 - DNA, 36 bp, Artificial Sequence
  Synthetic oligonucleotide
agctcacccatttgcccaacactgtttcttaacaga

SEQ ID NO: 79546 - DNA, 35 bp, Artificial Sequence
  Synthetic oligonucleotide
gtcctgtccggtcaaccttactaccctgagacaga

SEQ ID NO: 79547 - DNA, 37 bp, Artificial Sequence
  Synthetic oligonucleotide
agttggtgaaggtggcatggtggtattagagggcaga

SEQ ID NO: 79548 - DNA, 36 bp, Artificial Sequence
  Synthetic oligonucleotide
gatgttgtgaggtaaatggagtgtgggacgggcaga

SEQ ID NO: 79549 - DNA, 37 bp, Artificial Sequence
  Synthetic oligonucleotide
actaggacaggaaggaacggaggagggtggacggaga

SEQ ID NO: 79550 - DNA, 37 bp, Artificial Sequence
  Synthetic oligonucleotide
gcacccacatccttgcatagaaacctttcaccataga

SEQ ID NO: 79551 - DNA, 36 bp, Artificial Sequence
  Synthetic oligonucleotide
gtcaacagcactgtacgcgaaggccactacaaacga

SEQ ID NO: 79552 - DNA, 37 bp, Artificial Sequence
  Synthetic oligonucleotide
tccatcaggctccggtcaatcggccgttacctaccga

SEQ ID NO: 79553 - DNA, 37 bp, Artificial Sequence
  Synthetic oligonucleotide
gtggggccgcacatgggctgtgccactcctaccccga

SEQ ID NO: 79554 - DNA, 37 bp, Artificial Sequence
  Synthetic oligonucleotide
aacgctctaacgccgcataatccacatcttcgcccga

SEQ ID NO: 79555 - DNA, 36 bp, Artificial Sequence
  Synthetic oligonucleotide
gcctagcaatggaggggggatccgggaaaaggccga

SEQ ID NO: 79556 - DNA, 37 bp, Artificial Sequence
  Synthetic oligonucleotide
gacccgacccagcccgaaatggcgttaatgcttccga

SEQ ID NO: 79557 - DNA, 37 bp, Artificial Sequence
  Synthetic oligonucleotide
tgatgcgatccatcatctggatctcttgttccttcga

SEQ ID NO: 79558 - DNA, 37 bp, Artificial Sequence
  Synthetic oligonucleotide
gatgcctcccagataggcaaaaacggacaaggaagga

SEQ ID NO: 79559 - DNA, 36 bp, Artificial Sequence
  Synthetic oligonucleotide
gacccacgaacctttcacccagctcactcggacgga

SEQ ID NO: 79560 - DNA, 37 bp, Artificial Sequence
  Synthetic oligonucleotide
tagccagtgacggagcaggaaggccgggtggtacgga

SEQ ID NO: 79561 - DNA, 36 bp, Artificial Sequence
  Synthetic oligonucleotide
ttggaacggggggtagttcgggcagtggtttacgga

SEQ ID NO: 79562 - DNA, 36 bp, Artificial Sequence
  Synthetic oligonucleotide
gaagggaagcctagccaggtgatggggtgatgcgga

SEQ ID NO: 79563 - DNA, 37 bp, Artificial Sequence
  Synthetic oligonucleotide
tcaacgagggatttgagtgtgaggggaggtaggggga

SEQ ID NO: 79564 - DNA, 37 bp, Artificial Sequence
  Synthetic oligonucleotide
taacgcagtagactcagatgagggggtgcatggggga

SEQ ID NO: 79565 - DNA, 36 bp, Artificial Sequence
  Synthetic oligonucleotide
gagcagtatgggaaagcaggagtgggaggctgggga

SEQ ID NO: 79566 - DNA, 35 bp, Artificial Sequence
  Synthetic oligonucleotide
gggagatggatgcctaaagtatggggaggaatgga

SEQ ID NO: 79567 - DNA, 38 bp, Artificial Sequence
  Synthetic oligonucleotide
gacgagggagcgggatggcgaatgaagaattgaaatga

SEQ ID NO: 79568 - DNA, 38 bp, Artificial Sequence
  Synthetic oligonucleotide
gcacgacatccgcctttcactagggacagtttgactga

SEQ ID NO: 79569 - DNA, 37 bp, Artificial Sequence
  Synthetic oligonucleotide
gctgacacctgatactgccacagcactgatctactga

SEQ ID NO: 79570 - DNA, 36 bp, Artificial Sequence
  Synthetic oligonucleotide
tcaacatgtgtctcgatctagaccccctgaacctga

SEQ ID NO: 79571 - DNA, 38 bp, Artificial Sequence
  Synthetic oligonucleotide
acatcggctcgacgtcaagtcacacgcactccccctga

SEQ ID NO: 79572 - DNA, 38 bp, Artificial Sequence
  Synthetic oligonucleotide
acgaaggaccggttggttgggactgtgtggagggctga

SEQ ID NO: 79573 - DNA, 38 bp, Artificial Sequence
  Synthetic oligonucleotide
agtgtcaggggtgggcaacggtgagggctagtacgtga

SEQ ID NO: 79574 - DNA, 38 bp, Artificial Sequence
  Synthetic oligonucleotide
acgtgccagccagccccttccttcccggtggaccgtga

SEQ ID NO: 79575 - DNA, 38 bp, Artificial Sequence
  Synthetic oligonucleotide
tatgttgagggggtacagtggggatggtgagggtgtga

SEQ ID NO: 79576 - DNA, 38 bp, Artificial Sequence
  Synthetic oligonucleotide
gctacgaaccgctctgttcccctaatgaccgcttgtga

SEQ ID NO: 79577 - DNA, 38 bp, Artificial Sequence
  Synthetic oligonucleotide
gagggaccgcggggaaaagggaagcgatgaatttgtga

SEQ ID NO: 79578 - DNA, 37 bp, Artificial Sequence
  Synthetic oligonucleotide
gaacatcgtgccactataacacacggttccctattga

SEQ ID NO: 79579 - DNA, 38 bp, Artificial Sequence
  Synthetic oligonucleotide
tcaattgtgccaacacccttatctgagcagtctattga

SEQ ID NO: 79580 - DNA, 38 bp, Artificial Sequence
  Synthetic oligonucleotide
tcacatacggtccttcgagagctgcccctgtctattga

SEQ ID NO: 79581 - DNA, 37 bp, Artificial Sequence
  Synthetic oligonucleotide
accaactgcatccggagcgccgcagctctcttattga

SEQ ID NO: 79582 - DNA, 37 bp, Artificial Sequence
  Synthetic oligonucleotide
aacgaggtaggtgcggacggggggggtctaggcttga

SEQ ID NO: 79583 - DNA, 36 bp, Artificial Sequence
  Synthetic oligonucleotide
gtcatggcaacatcatattggtttatttttgcttga

SEQ ID NO: 79584 - DNA, 38 bp, Artificial Sequence
  Synthetic oligonucleotide
gcaccgggcctgggaggtggtgtgagtctctaggttga

SEQ ID NO: 79585 - DNA, 38 bp, Artificial Sequence
  Synthetic oligonucleotide
tccgacgtagacaggtggaggtaatcggagcgggttga

SEQ ID NO: 79586 - DNA, 38 bp, Artificial Sequence
  Synthetic oligonucleotide
actgacagacaaaattgtaggataggggtaggtgttga

SEQ ID NO: 79587 - DNA, 36 bp, Artificial Sequence
  Synthetic oligonucleotide
tccgtgacccggatgttcccgccttctgtactttga

SEQ ID NO: 79588 - DNA, 37 bp, Artificial Sequence
  Synthetic oligonucleotide
taaccagggcgacgggaaaagaagttggtttgtttga

SEQ ID NO: 79589 - DNA, 36 bp, Artificial Sequence
  Synthetic oligonucleotide
gccgtacatcgggttcgcaaccataagcaccaccta

SEQ ID NO: 79590 - DNA, 35 bp, Artificial Sequence
  Synthetic oligonucleotide
atcgtacagtcctttcaagcttaactccctgccta

SEQ ID NO: 79591 - DNA, 36 bp, Artificial Sequence
  Synthetic oligonucleotide
acatggtgcatggaaatggttaatcaaactctccta

SEQ ID NO: 79592 - DNA, 36 bp, Artificial Sequence
  Synthetic oligonucleotide
gtccaccggatcctctgcccataccaagacgcgcta

SEQ ID NO: 79593 - DNA, 38 bp, Artificial Sequence
  Synthetic oligonucleotide
tgcaaccaaacaccatcacgcaccataccgcggcgcta

SEQ ID NO: 79594 - DNA, 36 bp, Artificial Sequence
  Synthetic oligonucleotide
taatgggaagacgaatcatagagggatggaaaggta

SEQ ID NO: 79595 - DNA, 36 bp, Artificial Sequence
  Synthetic oligonucleotide
ttgtgagggcgtgggatcgtcctgggtgccggggta

SEQ ID NO: 79596 - DNA, 36 bp, Artificial Sequence
  Synthetic oligonucleotide
aaacacaagcaaaggcaatagggggttacgtgggta

SEQ ID NO: 79597 - DNA, 37 bp, Artificial Sequence
  Synthetic oligonucleotide
aacatcactgcttcccatgccttactcttgacttgta

SEQ ID NO: 79598 - DNA, 36 bp, Artificial Sequence
  Synthetic oligonucleotide
gagtacatcatcggaaccccttgaccgcccgcatta

SEQ ID NO: 79599 - DNA, 36 bp, Artificial Sequence
  Synthetic oligonucleotide
tcaacctgcacagagcctcaggaacgcgccctatta

SEQ ID NO: 79600 - DNA, 36 bp, Artificial Sequence
  Synthetic oligonucleotide
ccaccgtcattgacctgggctctatccattcggtta

SEQ ID NO: 79601 - DNA, 35 bp, Artificial Sequence
  Synthetic oligonucleotide
tccatcctcccctataacccttgcgacgcaattta

SEQ ID NO: 79602 - DNA, 35 bp, Artificial Sequence
  Synthetic oligonucleotide
tgacccgcacgcctttattagcaaagttccgttta

SEQ ID NO: 79603 - DNA, 35 bp, Artificial Sequence
  Synthetic oligonucleotide
tgtccggtcccccataggtttgcccacccggttta

SEQ ID NO: 79604 - DNA, 35 bp, Artificial Sequence
  Synthetic oligonucleotide
gccaccggcacggacattaccaccgcaccttaaac

SEQ ID NO: 79605 - DNA, 35 bp, Artificial Sequence
  Synthetic oligonucleotide
tctgacaatccattgcgtccctagttcagcataac

SEQ ID NO: 79606 - DNA, 35 bp, Artificial Sequence
  Synthetic oligonucleotide
tctgtcacaaactgcggggactacagcttacacac

SEQ ID NO: 79607 - DNA, 35 bp, Artificial Sequence
  Synthetic oligonucleotide
gaacaggcccagctgcatttgcccgttatgtgcac

SEQ ID NO: 79608 - DNA, 33 bp, Artificial Sequence
  Synthetic oligonucleotide
gagcgctgtgggctagcatctctcttcggttac

SEQ ID NO: 79609 - DNA, 35 bp, Artificial Sequence
  Synthetic oligonucleotide
aagcgggcctgagctacgaataactgcactaaacc

SEQ ID NO: 79610 - DNA, 35 bp, Artificial Sequence
  Synthetic oligonucleotide
gccaccgcatgcctggccttacagagccgcaaccc

SEQ ID NO: 79611 - DNA, 35 bp, Artificial Sequence
  Synthetic oligonucleotide
ttacacccagcatcgcatcattatggcctggcccc

SEQ ID NO: 79612 - DNA, 35 bp, Artificial Sequence
  Synthetic oligonucleotide
atgacatggctttcgaaggattaggtcgctctccc

SEQ ID NO: 79613 - DNA, 35 bp, Artificial Sequence
  Synthetic oligonucleotide
tatccctcaaaccactcggatccgtgctttaggcc

SEQ ID NO: 79614 - DNA, 35 bp, Artificial Sequence
  Synthetic oligonucleotide
ttgactagacccgctggaaccatgtcccccttgcc

SEQ ID NO: 79615 - DNA, 35 bp, Artificial Sequence
  Synthetic oligonucleotide
gtccgcctccggcactgccatttctacgggaatcc

SEQ ID NO: 79616 - DNA, 35 bp, Artificial Sequence
  Synthetic oligonucleotide
actaccgggctgaggggaaatgccgccgatcctcc

SEQ ID NO: 79617 - DNA, 35 bp, Artificial Sequence
  Synthetic oligonucleotide
gtgtgaccaagcccttcccatacccgtctcagtcc

SEQ ID NO: 79618 - DNA, 35 bp, Artificial Sequence
  Synthetic oligonucleotide
tcgtgccccagccggccagtctcgtttccgtgtcc

SEQ ID NO: 79619 - DNA, 35 bp, Artificial Sequence
  Synthetic oligonucleotide
gagaccccccgctcctgcgccgatatgcgcgtagc

SEQ ID NO: 79620 - DNA, 35 bp, Artificial Sequence
  Synthetic oligonucleotide
atgacgtgtcgccgtcttggccgatgcattgccgc

SEQ ID NO: 79621 - DNA, 35 bp, Artificial Sequence
  Synthetic oligonucleotide
acatcgcgattttcaatattgttcttgttcattgc

SEQ ID NO: 79622 - DNA, 35 bp, Artificial Sequence
  Synthetic oligonucleotide
gggatgtcctcacattttgaattatcccgtttatc

SEQ ID NO: 79623 - DNA, 35 bp, Artificial Sequence
  Synthetic oligonucleotide
tgacactgtagggacgtaattgcttgcgcgcactc

SEQ ID NO: 79624 - DNA, 35 bp, Artificial Sequence
  Synthetic oligonucleotide
ggaaccaactgactgaacgattacatgctgacctc

SEQ ID NO: 79625 - DNA, 35 bp, Artificial Sequence
  Synthetic oligonucleotide
tcacaccataacatagaccaaatatcgtgtccctc

SEQ ID NO: 79626 - DNA, 35 bp, Artificial Sequence
  Synthetic oligonucleotide
gctgactacactgactggttttacgaggtctcctc

SEQ ID NO: 79627 - DNA, 35 bp, Artificial Sequence
  Synthetic oligonucleotide
acgcgcgcctgtacatcgcaccttacctgattctc

SEQ ID NO: 79628 - DNA, 35 bp, Artificial Sequence
  Synthetic oligonucleotide
acagtgtctccatatttgccatgtgactcgttttc

SEQ ID NO: 79629 - DNA, 35 bp, Artificial Sequence
  Synthetic oligonucleotide
aacaggagccgaaagcctggggggagcaaggcgag

SEQ ID NO: 79630 - DNA, 35 bp, Artificial Sequence
  Synthetic oligonucleotide
gaacgctgcctatcaggttccacccggttttcacg

SEQ ID NO: 79631 - DNA, 35 bp, Artificial Sequence
  Synthetic oligonucleotide
acgaagtagggtaggagtacatacggaacgggacg

SEQ ID NO: 79632 - DNA, 35 bp, Artificial Sequence
  Synthetic oligonucleotide
aagccgacccacgacagccccggaactcatttccg

SEQ ID NO: 79633 - DNA, 35 bp, Artificial Sequence
  Synthetic oligonucleotide
gcacccatgagaattaaccgggcctgagactttcg

SEQ ID NO: 79634 - DNA, 35 bp, Artificial Sequence
  Synthetic oligonucleotide
gtccaacatctttccatccatacgccacgctaagg

SEQ ID NO: 79635 - DNA, 35 bp, Artificial Sequence
  Synthetic oligonucleotide
gacaggaggaaaccttaaggacagattgcaactgg

SEQ ID NO: 79636 - DNA, 35 bp, Artificial Sequence
  Synthetic oligonucleotide
gtgcccaatccgcgaaatagtctatgtaaatgctg

SEQ ID NO: 79637 - DNA, 35 bp, Artificial Sequence
  Synthetic oligonucleotide
gccggacctcgctgagcacgccctgttatatgctg

SEQ ID NO: 79638 - DNA, 35 bp, Artificial Sequence
  Synthetic oligonucleotide
gcagtcccctccttcgtgcaagtactctcgtgttg

SEQ ID NO: 79639 - DNA, 35 bp, Artificial Sequence
  Synthetic oligonucleotide
gccccaggtgaggggaaaaggaagtaaccacggat

SEQ ID NO: 79640 - DNA, 35 bp, Artificial Sequence
  Synthetic oligonucleotide
acgaacgcaagcatcgggctctggctatccatgat

SEQ ID NO: 79641 - DNA, 35 bp, Artificial Sequence
  Synthetic oligonucleotide
accagccatcggggcccagtacttctccaattgat

SEQ ID NO: 79642 - DNA, 35 bp, Artificial Sequence
  Synthetic oligonucleotide
tcatgccccaaactaccaagtttgcatataacact

SEQ ID NO: 79643 - DNA, 35 bp, Artificial Sequence
  Synthetic oligonucleotide
gatctgacctccattcctagagtgtccacacccct

SEQ ID NO: 79644 - DNA, 35 bp, Artificial Sequence
  Synthetic oligonucleotide
acaaccaaggctctgacaacgaccgtccctgtcct

SEQ ID NO: 79645 - DNA, 35 bp, Artificial Sequence
  Synthetic oligonucleotide
tccacccggtccacttctgccgccctttcgacgct

SEQ ID NO: 79646 - DNA, 35 bp, Artificial Sequence
  Synthetic oligonucleotide
ccacgccacacacctcgagcaccaccggtcgtgct

SEQ ID NO: 79647 - DNA, 35 bp, Artificial Sequence
  Synthetic oligonucleotide
accacttcgcaagcccccgctaaacgttgttatct

SEQ ID NO: 79648 - DNA, 35 bp, Artificial Sequence
  Synthetic oligonucleotide
ttaccccttcctcggtgcttcgcgactggcattct

SEQ ID NO: 79649 - DNA, 35 bp, Artificial Sequence
  Synthetic oligonucleotide
aactatcgggtcagcggggtaacggggggggcagt

SEQ ID NO: 79650 - DNA, 35 bp, Artificial Sequence
  Synthetic oligonucleotide
ggtaccatctcccccacttacggctgcctttgcgt

SEQ ID NO: 79651 - DNA, 35 bp, Artificial Sequence
  Synthetic oligonucleotide
agtgcacccctcatcgttcggtcccatctatcggt

SEQ ID NO: 79652 - DNA, 35 bp, Artificial Sequence
  Synthetic oligonucleotide
ttgagcatacgcaagattctcagtccgttcccatt

SEQ ID NO: 79653 - DNA, 35 bp, Artificial Sequence
  Synthetic oligonucleotide
ggacaaactccaccagaccgcacgggttgtacctt

SEQ ID NO: 79654 - DNA, 35 bp, Artificial Sequence
  Synthetic oligonucleotide
tgccgctgtgcacgtcgtcttttgtctactttgtt

SEQ ID NO: 79655 - DNA, 35 bp, Artificial Sequence
  Synthetic oligonucleotide
tacctcgctgatctctccatggccaaacgaccttt

SEQ ID NO: 79656 - DNA, 35 bp, Artificial Sequence
  Synthetic oligonucleotide
gtgtctggggcgaacttcctgcaacggggtctttt

SEQ ID NO: 79657 - DNA, 35 bp, Artificial Sequence
  Synthetic oligonucleotide
accatagccccaaacaccgttccgagactgaaaaa

SEQ ID NO: 79658 - DNA, 36 bp, Artificial Sequence
  Synthetic oligonucleotide
tgtacaaaggggctgtgggggtggcctggatgaaaa

SEQ ID NO: 79659 - DNA, 35 bp, Artificial Sequence
  Synthetic oligonucleotide
gtgcccataggggcggggagaaacatggcaggaaa

SEQ ID NO: 79660 - DNA, 35 bp, Artificial Sequence
  Synthetic oligonucleotide
tcatgcccggtccctgctttgctgctgtcccccaa

SEQ ID NO: 79661 - DNA, 36 bp, Artificial Sequence
  Synthetic oligonucleotide
gaccactggcggatcggtactgtcgctcgaggggaa

SEQ ID NO: 79662 - DNA, 36 bp, Artificial Sequence
  Synthetic oligonucleotide
tgtacctgcgaccggaaatgcttcaacatcacctaa

SEQ ID NO: 79663 - DNA, 36 bp, Artificial Sequence
  Synthetic oligonucleotide
tgaccaccgttaacttattcttgcgaccgcttctaa

SEQ ID NO: 79664 - DNA, 36 bp, Artificial Sequence
  Synthetic oligonucleotide
ttaccaaccgcaccttgactatgggcgcctgtaaca

SEQ ID NO: 79665 - DNA, 36 bp, Artificial Sequence
  Synthetic oligonucleotide
atagcgacgccactgattgcaaatgcccaactcaca

SEQ ID NO: 79666 - DNA, 35 bp, Artificial Sequence
  Synthetic oligonucleotide
taccatcgggcctgcatacagcttcttcgacgaca

SEQ ID NO: 79667 - DNA, 36 bp, Artificial Sequence
  Synthetic oligonucleotide
tgtcccatacacttgtgtccagccccttctccgaca

SEQ ID NO: 79668 - DNA, 36 bp, Artificial Sequence
  Synthetic oligonucleotide
tagtacacgccactgttatttctgtttcttccgaca

SEQ ID NO: 79669 - DNA, 36 bp, Artificial Sequence
  Synthetic oligonucleotide
tgcaacaacgtgtgcaccagtccgtttcttaaccca

SEQ ID NO: 79670 - DNA, 36 bp, Artificial Sequence
  Synthetic oligonucleotide
tacaccattactactgtgacgcctcaggcctaggca

SEQ ID NO: 79671 - DNA, 36 bp, Artificial Sequence
  Synthetic oligonucleotide
tgagcgggcagagtcattagcgcctcacaccgatca

SEQ ID NO: 79672 - DNA, 35 bp, Artificial Sequence
  Synthetic oligonucleotide
gacgggcaatcgtccttacatagtcacctctctca

SEQ ID NO: 79673 - DNA, 36 bp, Artificial Sequence
  Synthetic oligonucleotide
gagacgggggcggggtagggtaagtaattcaagtca

SEQ ID NO: 79674 - DNA, 35 bp, Artificial Sequence
  Synthetic oligonucleotide
taccccgtgggtcctgtctcttccgatcctcgtca

SEQ ID NO: 79675 - DNA, 37 bp, Artificial Sequence
  Synthetic oligonucleotide
agatcgatctgccctacaccgccacatttgtcgaaga

SEQ ID NO: 79676 - DNA, 37 bp, Artificial Sequence
  Synthetic oligonucleotide
gagtacagcctgaacaccttgctctttgcctttaaga

SEQ ID NO: 79677 - DNA, 37 bp, Artificial Sequence
  Synthetic oligonucleotide
tgtaacgcccgatccgcattcctagaactcccagaga

SEQ ID NO: 79678 - DNA, 37 bp, Artificial Sequence
  Synthetic oligonucleotide
ttgtcgtcggggaattggggtgatggggcaaaggaga

SEQ ID NO: 79679 - DNA, 36 bp, Artificial Sequence
  Synthetic oligonucleotide
aaggggtggagggatagggcctcgcgggtcgtacga

SEQ ID NO: 79680 - DNA, 37 bp, Artificial Sequence
  Synthetic oligonucleotide
tgctgctcccctcctggtgacacccccgtgactccga

SEQ ID NO: 79681 - DNA, 37 bp, Artificial Sequence
  Synthetic oligonucleotide
tagccccttatgtacatgcgtaccacctttattccga

SEQ ID NO: 79682 - DNA, 37 bp, Artificial Sequence
  Synthetic oligonucleotide
agtgaggatcacttttgccctaagcttgccctttcga

SEQ ID NO: 79683 - DNA, 37 bp, Artificial Sequence
  Synthetic oligonucleotide
taccggataggcatggtggcggggggagactcgagga

SEQ ID NO: 79684 - DNA, 37 bp, Artificial Sequence
  Synthetic oligonucleotide
aaaaccagcacggggtgtgaagggtttttagtgagga

SEQ ID NO: 79685 - DNA, 37 bp, Artificial Sequence
  Synthetic oligonucleotide
accagcacgaacggtctactgcccctctcgttccgga

SEQ ID NO: 79686 - DNA, 37 bp, Artificial Sequence
  Synthetic oligonucleotide
atgcgagggaagtcggtacgggatagaaaggagcgga

SEQ ID NO: 79687 - DNA, 37 bp, Artificial Sequence
  Synthetic oligonucleotide
tgtggtacacatcagaagatataaggtggggggcgga

SEQ ID NO: 79688 - DNA, 37 bp, Artificial Sequence
  Synthetic oligonucleotide
actgacagggaagtaaagcaaagggtacgggaaggga

SEQ ID NO: 79689 - DNA, 37 bp, Artificial Sequence
  Synthetic oligonucleotide
aatcaactaccactcacttgccgacacagtcgcggga

SEQ ID NO: 79690 - DNA, 37 bp, Artificial Sequence
  Synthetic oligonucleotide
gggggcgtggaatgccgggagtgggctggtacgggga

SEQ ID NO: 79691 - DNA, 37 bp, Artificial Sequence
  Synthetic oligonucleotide
acgacgaacgtggaaaggttccgaatattggggggga

SEQ ID NO: 79692 - DNA, 37 bp, Artificial Sequence
  Synthetic oligonucleotide
gcacaaggcaacagtacgtttggtgatggaatgggga

SEQ ID NO: 79693 - DNA, 37 bp, Artificial Sequence
  Synthetic oligonucleotide
gtgggcgggaggggttattccccactaatcatgggga

SEQ ID NO: 79694 - DNA, 37 bp, Artificial Sequence
  Synthetic oligonucleotide
tcccgcaggtccatcctgcatataagtacgcatggga

SEQ ID NO: 79695 - DNA, 35 bp, Artificial Sequence
  Synthetic oligonucleotide
gatgcgatcccggcgataccctctcttggtctgga

SEQ ID NO: 79696 - DNA, 38 bp, Artificial Sequence
  Synthetic oligonucleotide
accgttccacgacgttttgcgctatcctcctgtaatga

SEQ ID NO: 79697 - DNA, 35 bp, Artificial Sequence
  Synthetic oligonucleotide
acactccgctcctttaaggtttccactcaacatga

SEQ ID NO: 79698 - DNA, 38 bp, Artificial Sequence
  Synthetic oligonucleotide
tgtcgactacctgcgacctgcatacacctcacccatga

SEQ ID NO: 79699 - DNA, 38 bp, Artificial Sequence
  Synthetic oligonucleotide
aacgccaccctgccgccgagcttaatcaactgccatga

SEQ ID NO: 79700 - DNA, 38 bp, Artificial Sequence
  Synthetic oligonucleotide
tatgcaagagtggggcatggaggaaatgaaacagatga

SEQ ID NO: 79701 - DNA, 38 bp, Artificial Sequence
  Synthetic oligonucleotide
gccggggtgggccaaatcaaggagggagttagggatga

SEQ ID NO: 79702 - DNA, 38 bp, Artificial Sequence
  Synthetic oligonucleotide
tcaccatgtctatgccgagctagtttccctctctatga

SEQ ID NO: 79703 - DNA, 38 bp, Artificial Sequence
  Synthetic oligonucleotide
gaccaaccgttgataatcgccgaccagaccgccactga

SEQ ID NO: 79704 - DNA, 38 bp, Artificial Sequence
  Synthetic oligonucleotide
atggagaccgcctattgcggaaggaaaggaagtactga

SEQ ID NO: 79705 - DNA, 37 bp, Artificial Sequence
  Synthetic oligonucleotide
ttctagcccccgacatgcccccctttcagtgtactga

SEQ ID NO: 79706 - DNA, 36 bp, Artificial Sequence
  Synthetic oligonucleotide
tcagctagcaacaggggagttgtagggggatgctga

SEQ ID NO: 79707 - DNA, 38 bp, Artificial Sequence
  Synthetic oligonucleotide
tgccgcgacccacgttaccatttgccttgttatgctga

SEQ ID NO: 79708 - DNA, 38 bp, Artificial Sequence
  Synthetic oligonucleotide
attcagccacggagagccgcgatccttgccactgctga

SEQ ID NO: 79709 - DNA, 38 bp, Artificial Sequence
  Synthetic oligonucleotide
gacgaatcttggcgatggtggggagggggggttgctga

SEQ ID NO: 79710 - DNA, 37 bp, Artificial Sequence
  Synthetic oligonucleotide
aaccccgccttatagtatttgccgccaagacatctga

SEQ ID NO: 79711 - DNA, 37 bp, Artificial Sequence
  Synthetic oligonucleotide
gttggcggaggtgctgcacgttcctttattcatctga

SEQ ID NO: 79712 - DNA, 37 bp, Artificial Sequence
  Synthetic oligonucleotide
gcagtgcggtcgagggaaaacagtgcgcaagaagtga

SEQ ID NO: 79713 - DNA, 36 bp, Artificial Sequence
  Synthetic oligonucleotide
ggagggacatgaggtgggtcggctgattttacgtga

SEQ ID NO: 79714 - DNA, 38 bp, Artificial Sequence
  Synthetic oligonucleotide
tgtgacgggcaagggaaaaaaagagtaatatgccgtga

SEQ ID NO: 79715 - DNA, 36 bp, Artificial Sequence
  Synthetic oligonucleotide
gatgacgacgataatacagcatgcagagaatcgtga

SEQ ID NO: 79716 - DNA, 38 bp, Artificial Sequence
  Synthetic oligonucleotide
gcacccatccaccccccgtgctgcattaaacatggtga

SEQ ID NO: 79717 - DNA, 38 bp, Artificial Sequence
  Synthetic oligonucleotide
tgttcacgtgccctatttactgacgctcccgcctgtga

SEQ ID NO: 79718 - DNA, 35 bp, Artificial Sequence
  Synthetic oligonucleotide
atccccaatgaaacgtgttagtgtcctcttcttga

SEQ ID NO: 79719 - DNA, 37 bp, Artificial Sequence
  Synthetic oligonucleotide
tccccaatcgccatgtaattcggtgtccctttcttga

SEQ ID NO: 79720 - DNA, 38 bp, Artificial Sequence
  Synthetic oligonucleotide
tacgcaatggtcgcccatctgatttgcggtttatttga

SEQ ID NO: 79721 - DNA, 37 bp, Artificial Sequence
  Synthetic oligonucleotide
acgccaccgattcattttagtgaccactgccctttga

SEQ ID NO: 79722 - DNA, 38 bp, Artificial Sequence
  Synthetic oligonucleotide
gcttacggcgttgggactcccggtactatcttctttga

SEQ ID NO: 79723 - DNA, 37 bp, Artificial Sequence
  Synthetic oligonucleotide
gatggtgaaggtaacggtgtcaggagggaaggtttga

SEQ ID NO: 79724 - DNA, 36 bp, Artificial Sequence
  Synthetic oligonucleotide
gccacgccctaaatgaacacttgcgaagggctaata

SEQ ID NO: 79725 - DNA, 36 bp, Artificial Sequence
  Synthetic oligonucleotide
tgtggagtttgccgtgaaatcgttaccctctccata

SEQ ID NO: 79726 - DNA, 36 bp, Artificial Sequence
  Synthetic oligonucleotide
tgtgggcggaggggagaagggataagaaaggtacta

SEQ ID NO: 79727 - DNA, 35 bp, Artificial Sequence
  Synthetic oligonucleotide
tgcgtgtgagcctagtcgcataaccgtaacaccta

SEQ ID NO: 79728 - DNA, 37 bp, Artificial Sequence
  Synthetic oligonucleotide
accacaccccccgtcctcacgatcggcttccgaccta

SEQ ID NO: 79729 - DNA, 36 bp, Artificial Sequence
  Synthetic oligonucleotide
atcatccgagtcacgcacaacattttaggctaccta

SEQ ID NO: 79730 - DNA, 35 bp, Artificial Sequence
  Synthetic oligonucleotide
gagtccggtgtgggggcttaggaatgcgggggcta

SEQ ID NO: 79731 - DNA, 35 bp, Artificial Sequence
  Synthetic oligonucleotide
gcacatgaccgatattgtctcttccgtagattcta

SEQ ID NO: 79732 - DNA, 35 bp, Artificial Sequence
  Synthetic oligonucleotide
tgtgcccctcaggatagcgttcctgcctgtccgta

SEQ ID NO: 79733 - DNA, 35 bp, Artificial Sequence
  Synthetic oligonucleotide
aagcaccccccatagcgacttttttcgatcgatta

SEQ ID NO: 79734 - DNA, 35 bp, Artificial Sequence
  Synthetic oligonucleotide
gaggggacaacgtcaggagggaatgggagggatta

SEQ ID NO: 79735 - DNA, 36 bp, Artificial Sequence
  Synthetic oligonucleotide
tgatccaaggttatacgtgctctgttcctcgcttta

SEQ ID NO: 79736 - DNA, 35 bp, Artificial Sequence
  Synthetic oligonucleotide
agtccctggtcctccgacgctcctcttagggtaac

SEQ ID NO: 79737 - DNA, 35 bp, Artificial Sequence
  Synthetic oligonucleotide
tgggacgtgcccggccgttttgtctctctgtttac

SEQ ID NO: 79738 - DNA, 35 bp, Artificial Sequence
  Synthetic oligonucleotide
tgtcacactacatactagctcaccaggccggaacc

SEQ ID NO: 79739 - DNA, 35 bp, Artificial Sequence
  Synthetic oligonucleotide
gaatgccttaggctcccagtgaacgcagtaatacc

SEQ ID NO: 79740 - DNA, 35 bp, Artificial Sequence
  Synthetic oligonucleotide
tggggtcaccgtcacgcgtttttattaccctcccc

SEQ ID NO: 79741 - DNA, 35 bp, Artificial Sequence
  Synthetic oligonucleotide
gacgtttgccggcaatcaagcaactcttatcgccc

SEQ ID NO: 79742 - DNA, 35 bp, Artificial Sequence
  Synthetic oligonucleotide
tctcaggtcctctgctttgggcccactcaccccgc

SEQ ID NO: 79743 - DNA, 35 bp, Artificial Sequence
  Synthetic oligonucleotide
ttagctacccaccagtacagtggcccccccgccgc

SEQ ID NO: 79744 - DNA, 35 bp, Artificial Sequence
  Synthetic oligonucleotide
taaccgatgacctgcccgccctcttagcctgcggc

SEQ ID NO: 79745 - DNA, 35 bp, Artificial Sequence
  Synthetic oligonucleotide
gcacgcaacacagacccctctctagatcttgcggc

SEQ ID NO: 79746 - DNA, 35 bp, Artificial Sequence
  Synthetic oligonucleotide
attgacttcgggcgcaatgcgactctgtacccctc

SEQ ID NO: 79747 - DNA, 35 bp, Artificial Sequence
  Synthetic oligonucleotide
gtcgccacagctcgacgtgctactcaagtcccctc

SEQ ID NO: 79748 - DNA, 35 bp, Artificial Sequence
  Synthetic oligonucleotide
gtgtatcctccagccaattggtgattcgtttcctc

SEQ ID NO: 79749 - DNA, 34 bp, Artificial Sequence
  Synthetic oligonucleotide
atcatcacatgtcctataggtttaccgaagtctc

SEQ ID NO: 79750 - DNA, 35 bp, Artificial Sequence
  Synthetic oligonucleotide
tttacgacaggtcgcctagtaacccatttccattc

SEQ ID NO: 79751 - DNA, 35 bp, Artificial Sequence
  Synthetic oligonucleotide
gggccgaatccagtctgcttttgcccgagcccttc

SEQ ID NO: 79752 - DNA, 35 bp, Artificial Sequence
  Synthetic oligonucleotide
aacccccccatgatgcatagcccacggttcccttc

SEQ ID NO: 79753 - DNA, 35 bp, Artificial Sequence
  Synthetic oligonucleotide
accacacgcactgcagagaccctgactgttggttc

SEQ ID NO: 79754 - DNA, 35 bp, Artificial Sequence
  Synthetic oligonucleotide
actgccctgagtcaggtgttctatctctatcacag

SEQ ID NO: 79755 - DNA, 35 bp, Artificial Sequence
  Synthetic oligonucleotide
acccgacccgttcccgcctctccctgatagccccg

SEQ ID NO: 79756 - DNA, 35 bp, Artificial Sequence
  Synthetic oligonucleotide
ttgccgagttctcgagattccacccctttaagccg

SEQ ID NO: 79757 - DNA, 35 bp, Artificial Sequence
  Synthetic oligonucleotide
gttgcggatccgttaccattgcctagtagagtccg

SEQ ID NO: 79758 - DNA, 35 bp, Artificial Sequence
  Synthetic oligonucleotide
acgcaccgctgacttcaacacatataattgcccgg

SEQ ID NO: 79759 - DNA, 35 bp, Artificial Sequence
  Synthetic oligonucleotide
tgactgcaaagactgggagggaaagtacattcggg

SEQ ID NO: 79760 - DNA, 35 bp, Artificial Sequence
  Synthetic oligonucleotide
gtcgtaagtgacgcggtgtggtgggcggggatggg

SEQ ID NO: 79761 - DNA, 35 bp, Artificial Sequence
  Synthetic oligonucleotide
tttccccgccggtgttcgacactattttgtttggg

SEQ ID NO: 79762 - DNA, 35 bp, Artificial Sequence
  Synthetic oligonucleotide
gaacacctccccgaccatagattaccgctctatgg

SEQ ID NO: 79763 - DNA, 35 bp, Artificial Sequence
  Synthetic oligonucleotide
accgcgcgcgcactttcggactgatccgccaactg

SEQ ID NO: 79764 - DNA, 35 bp, Artificial Sequence
  Synthetic oligonucleotide
tagatccctcgcgtgggctaaatctttaacacttg

SEQ ID NO: 79765 - DNA, 35 bp, Artificial Sequence
  Synthetic oligonucleotide
gtgttcccccagctgctccggacctactcgcaaat

SEQ ID NO: 79766 - DNA, 35 bp, Artificial Sequence
  Synthetic oligonucleotide
ctgtgaatggcccatgctctcttattgcttgatat

SEQ ID NO: 79767 - DNA, 35 bp, Artificial Sequence
  Synthetic oligonucleotide
gagacgggcgggccgttgggatgttgggaacctat

SEQ ID NO: 79768 - DNA, 35 bp, Artificial Sequence
  Synthetic oligonucleotide
tctcgctaacgaacatgactggattcatcccacct

SEQ ID NO: 79769 - DNA, 35 bp, Artificial Sequence
  Synthetic oligonucleotide
gctgacccagctgaatatgcccttaactgctacct

SEQ ID NO: 79770 - DNA, 35 bp, Artificial Sequence
  Synthetic oligonucleotide
aacctggcgcagctgatgactgcaaacaccacgct

SEQ ID NO: 79771 - DNA, 35 bp, Artificial Sequence
  Synthetic oligonucleotide
gcaacgctaataatgcttaacgcgaaggtccatct

SEQ ID NO: 79772 - DNA, 35 bp, Artificial Sequence
  Synthetic oligonucleotide
gcagtcggacgctagtccgttgcccgacaccctct

SEQ ID NO: 79773 - DNA, 35 bp, Artificial Sequence
  Synthetic oligonucleotide
tctaccccgtatttttaacagccacttgagtctct

SEQ ID NO: 79774 - DNA, 35 bp, Artificial Sequence
  Synthetic oligonucleotide
gtctcgggggggaggggtaatttgtacgggtcggt

SEQ ID NO: 79775 - DNA, 35 bp, Artificial Sequence
  Synthetic oligonucleotide
aagggagacgggcttggaggattggagactagggt

SEQ ID NO: 79776 - DNA, 35 bp, Artificial Sequence
  Synthetic oligonucleotide
gcaacaggcgcattctagaatttttgatatggggt

SEQ ID NO: 79777 - DNA, 35 bp, Artificial Sequence
  Synthetic oligonucleotide
atctatccacgcgaccggcttgcggttgggccatt

SEQ ID NO: 79778 - DNA, 35 bp, Artificial Sequence
  Synthetic oligonucleotide
gcgaggtggggggctattatgaggcacattctatt

SEQ ID NO: 79779 - DNA, 35 bp, Artificial Sequence
  Synthetic oligonucleotide
tgtgtccctctcctgcagtactaccttacaagctt

SEQ ID NO: 79780 - DNA, 35 bp, Artificial Sequence
  Synthetic oligonucleotide
taaaccaactgtaagtgccttaggtcacgcctctt

SEQ ID NO: 79781 - DNA, 35 bp, Artificial Sequence
  Synthetic oligonucleotide
acctacgctggtggcttaccgaacactataccgtt

SEQ ID NO: 79782 - DNA, 34 bp, Artificial Sequence
  Synthetic oligonucleotide
tgcaatgcccctgctggcccttctctgcatgaaa

SEQ ID NO: 79783 - DNA, 35 bp, Artificial Sequence
  Synthetic oligonucleotide
tagacgcagggaatagaacatgggtgtgatctgaa

SEQ ID NO: 79784 - DNA, 36 bp, Artificial Sequence
  Synthetic oligonucleotide
tcatcgacacattatcatcctctgagccttctgtaa

SEQ ID NO: 79785 - DNA, 35 bp, Artificial Sequence
  Synthetic oligonucleotide
ttcgatccatggtcttgttgcctatcaaagcttaa

SEQ ID NO: 79786 - DNA, 36 bp, Artificial Sequence
  Synthetic oligonucleotide
attggtgtacggatcttggaggaggaagggctgaca

SEQ ID NO: 79787 - DNA, 35 bp, Artificial Sequence
  Synthetic oligonucleotide
tgccgatccccgggaagaatatcacagcacttaca

SEQ ID NO: 79788 - DNA, 36 bp, Artificial Sequence
  Synthetic oligonucleotide
agtccgaactctgctgcctgtctattatctgtacca

SEQ ID NO: 79789 - DNA, 35 bp, Artificial Sequence
  Synthetic oligonucleotide
acttggcatgcggccactccggtaaccattcccca

SEQ ID NO: 79790 - DNA, 36 bp, Artificial Sequence
  Synthetic oligonucleotide
tatggtgaggcgttttgtacgaacctgccgctccca

SEQ ID NO: 79791 - DNA, 36 bp, Artificial Sequence
  Synthetic oligonucleotide
tatcatccatcaccatcgtacctcgcgggccgagca

SEQ ID NO: 79792 - DNA, 36 bp, Artificial Sequence
  Synthetic oligonucleotide
ttgggcctgagtgggggagaacgatagacgtgcgca

SEQ ID NO: 79793 - DNA, 35 bp, Artificial Sequence
  Synthetic oligonucleotide
aatcccctgttgtctctaatactgcgccgttcgca

SEQ ID NO: 79794 - DNA, 35 bp, Artificial Sequence
  Synthetic oligonucleotide
tcacccagcgcgagagagtgcgaagggtctgggca

SEQ ID NO: 79795 - DNA, 36 bp, Artificial Sequence
  Synthetic oligonucleotide
ggtacaccgttaccccgttacctcatgcccgttgca

SEQ ID NO: 79796 - DNA, 36 bp, Artificial Sequence
  Synthetic oligonucleotide
tatgacggtggaactacctaatgcgctcctccatca

SEQ ID NO: 79797 - DNA, 36 bp, Artificial Sequence
  Synthetic oligonucleotide
ttgagccaatccatggccctctgacttgtaacctca

SEQ ID NO: 79798 - DNA, 36 bp, Artificial Sequence
  Synthetic oligonucleotide
gcccacattcgtgaaagttatatattttgtcgctca

SEQ ID NO: 79799 - DNA, 37 bp, Artificial Sequence
  Synthetic oligonucleotide
gagacctccctttgccactgatattaccgacaccaga

SEQ ID NO: 79800 - DNA, 37 bp, Artificial Sequence
  Synthetic oligonucleotide
agagagtgatgctggtgggtataggtatgaaggcaga

SEQ ID NO: 79801 - DNA, 37 bp, Artificial Sequence
  Synthetic oligonucleotide
gtcatcacttcacacctccatccagcgtcctttcaga

SEQ ID NO: 79802 - DNA, 37 bp, Artificial Sequence
  Synthetic oligonucleotide
tgccgacgagtggtatgggggttttcagggggtgaga

SEQ ID NO: 79803 - DNA, 37 bp, Artificial Sequence
  Synthetic oligonucleotide
acagctcacgcgccttcgatcatgttcaattcttaga

SEQ ID NO: 79804 - DNA, 37 bp, Artificial Sequence
  Synthetic oligonucleotide
gccgatcagctggccaggagagggatgccgggttaga

SEQ ID NO: 79805 - DNA, 37 bp, Artificial Sequence
  Synthetic oligonucleotide
gccccatccggtcctcatagctaaacgatcgtaccga

SEQ ID NO: 79806 - DNA, 37 bp, Artificial Sequence
  Synthetic oligonucleotide
atatcgcgagtgggggtaggattcttcgggtaggcga

SEQ ID NO: 79807 - DNA, 37 bp, Artificial Sequence
  Synthetic oligonucleotide
ttatggtgggaacggagaaggagggaggtacgtgcga

SEQ ID NO: 79808 - DNA, 37 bp, Artificial Sequence
  Synthetic oligonucleotide
tagacgaaacgagggcgggtgggacggtaagcatcga

SEQ ID NO: 79809 - DNA, 37 bp, Artificial Sequence
  Synthetic oligonucleotide
ttccactacgcccggtctcatatgccccttctctcga

SEQ ID NO: 79810 - DNA, 36 bp, Artificial Sequence
  Synthetic oligonucleotide
tgaagggggggagggaaaaccggagatcgctgtcga

SEQ ID NO: 79811 - DNA, 37 bp, Artificial Sequence
  Synthetic oligonucleotide
taacagaggaaagtggtgtggtatgctatagcttcga

SEQ ID NO: 79812 - DNA, 37 bp, Artificial Sequence
  Synthetic oligonucleotide
tgtctactccaacttcgctatctcaagaactgttcga

SEQ ID NO: 79813 - DNA, 37 bp, Artificial Sequence
  Synthetic oligonucleotide
tcacaaacgccgattgctagtgctgccacatgacgga

SEQ ID NO: 79814 - DNA, 37 bp, Artificial Sequence
  Synthetic oligonucleotide
ttcgatccctcccttacgctaccggttacagaccgga

SEQ ID NO: 79815 - DNA, 37 bp, Artificial Sequence
  Synthetic oligonucleotide
atcgaagcgggggcaggaattgaggttcaaaagcgga

SEQ ID NO: 79816 - DNA, 37 bp, Artificial Sequence
  Synthetic oligonucleotide
gaagacggacaaggttaaggggggatcaatacaggga

SEQ ID NO: 79817 - DNA, 37 bp, Artificial Sequence
  Synthetic oligonucleotide
gtgtcgcagaaacgaaggacgatggaaaatggaggga

SEQ ID NO: 79818 - DNA, 36 bp, Artificial Sequence
  Synthetic oligonucleotide
gtctgacagcagggggggcacaaggaaataacggga

SEQ ID NO: 79819 - DNA, 37 bp, Artificial Sequence
  Synthetic oligonucleotide
ggataggcgcggaggagggggggggaatcaggtggga

SEQ ID NO: 79820 - DNA, 37 bp, Artificial Sequence
  Synthetic oligonucleotide
tgggcggggtggcgtgtaggaaggaggggacttggga

SEQ ID NO: 79821 - DNA, 37 bp, Artificial Sequence
  Synthetic oligonucleotide
gacgcccacctgatctgggacacttatggcaactgga

SEQ ID NO: 79822 - DNA, 38 bp, Artificial Sequence
  Synthetic oligonucleotide
gcccatcgacaaagctgtcgtaagcacgtgggcctgga

SEQ ID NO: 79823 - DNA, 37 bp, Artificial Sequence
  Synthetic oligonucleotide
tgccctcgccgctatctgttgcagctcggctcctgga

SEQ ID NO: 79824 - DNA, 36 bp, Artificial Sequence
  Synthetic oligonucleotide
gctcgcgcggccctgaggggacaagggaggagtgga

SEQ ID NO: 79825 - DNA, 36 bp, Artificial Sequence
  Synthetic oligonucleotide
aacttcacatcacgcctcatccccgcaaggggtgga

SEQ ID NO: 79826 - DNA, 37 bp, Artificial Sequence
  Synthetic oligonucleotide
tgagcgcatcccgttaactgggtgtcttcctcttgga

SEQ ID NO: 79827 - DNA, 37 bp, Artificial Sequence
  Synthetic oligonucleotide
gtaatccagcgctggccttcctccaacctcgtttgga

SEQ ID NO: 79828 - DNA, 38 bp, Artificial Sequence
  Synthetic oligonucleotide
gatgtgagggaaagggtaggagcgaggcagtggaatga

SEQ ID NO: 79829 - DNA, 37 bp, Artificial Sequence
  Synthetic oligonucleotide
acgccctccctctgtgcctgctatcctaccaccatga

SEQ ID NO: 79830 - DNA, 36 bp, Artificial Sequence
  Synthetic oligonucleotide
gtggggaagatgggtaggacgatgcatggacgatga

SEQ ID NO: 79831 - DNA, 38 bp, Artificial Sequence
  Synthetic oligonucleotide
tcatacggtgaagagggaagagatcgggcgagatatga

SEQ ID NO: 79832 - DNA, 38 bp, Artificial Sequence
  Synthetic oligonucleotide
tgcacacggtcagccacggtgttgcccctctcttatga

SEQ ID NO: 79833 - DNA, 38 bp, Artificial Sequence
  Synthetic oligonucleotide
tcgacctccctctcacgctgatagtctacccaacctga

SEQ ID NO: 79834 - DNA, 38 bp, Artificial Sequence
  Synthetic oligonucleotide
acgagagcgaaccaacttatgcattcctcgcctcctga

SEQ ID NO: 79835 - DNA, 35 bp, Artificial Sequence
  Synthetic oligonucleotide
gtgcttcccgcccctattgcccatgtacatgctga

SEQ ID NO: 79836 - DNA, 38 bp, Artificial Sequence
  Synthetic oligonucleotide
taccgcccacccaatggtagccaagctcaggcttctga

SEQ ID NO: 79837 - DNA, 38 bp, Artificial Sequence
  Synthetic oligonucleotide
gacgggggaacacatgatggggctactgcgaagagtga

SEQ ID NO: 79838 - DNA, 38 bp, Artificial Sequence
  Synthetic oligonucleotide
aacgcgggcgcagagggttgcgggtcgggatggagtga

SEQ ID NO: 79839 - DNA, 38 bp, Artificial Sequence
  Synthetic oligonucleotide
ttgggattgccggaggagggttgggtaggggttagtga

SEQ ID NO: 79840 - DNA, 37 bp, Artificial Sequence
  Synthetic oligonucleotide
gccaccgcaaccttatattgtttcaccgtataggtga

SEQ ID NO: 79841 - DNA, 38 bp, Artificial Sequence
  Synthetic oligonucleotide
agcggggttccgaggtaacatgggcaaaaacggggtga

SEQ ID NO: 79842 - DNA, 37 bp, Artificial Sequence
  Synthetic oligonucleotide
accaacgccagaacggtgtgccctttgccctgggtga

SEQ ID NO: 79843 - DNA, 38 bp, Artificial Sequence
  Synthetic oligonucleotide
gaccagatgccgtgccgcccttaacattcatgcattga

SEQ ID NO: 79844 - DNA, 38 bp, Artificial Sequence
  Synthetic oligonucleotide
tagtaggtggggtgcagtaaagtggggtaaactattga

SEQ ID NO: 79845 - DNA, 38 bp, Artificial Sequence
  Synthetic oligonucleotide
ttgacgccctcgattgtccttttccttgttttgcttga

SEQ ID NO: 79846 - DNA, 38 bp, Artificial Sequence
  Synthetic oligonucleotide
tccacctagtacacaccgccgtgtgtttgtcatcttga

SEQ ID NO: 79847 - DNA, 37 bp, Artificial Sequence
  Synthetic oligonucleotide
tgacaatggtcaatgttttgatggggggtgtagttga

SEQ ID NO: 79848 - DNA, 37 bp, Artificial Sequence
  Synthetic oligonucleotide
gcaacctgctcccgttttacagcctctccttcgttga

SEQ ID NO: 79849 - DNA, 38 bp, Artificial Sequence
  Synthetic oligonucleotide
tcccgcctgtcgctatgttactgctcgtttcttgttga

SEQ ID NO: 79850 - DNA, 38 bp, Artificial Sequence
  Synthetic oligonucleotide
gaccataccctccgctgtcttttctgtaggatctttga

SEQ ID NO: 79851 - DNA, 38 bp, Artificial Sequence
  Synthetic oligonucleotide
gagccatgttaactgtggtggccgtatttattctttga

SEQ ID NO: 79852 - DNA, 37 bp, Artificial Sequence
  Synthetic oligonucleotide
ggacactctcgcgattgctccacaccacgtattttga

SEQ ID NO: 79853 - DNA, 38 bp, Artificial Sequence
  Synthetic oligonucleotide
tcccacccttcatgcacaggtaaagcactatcttttga

SEQ ID NO: 79854 - DNA, 35 bp, Artificial Sequence
  Synthetic oligonucleotide
acagactcagtcgttctacgtctcctacctgcata

SEQ ID NO: 79855 - DNA, 35 bp, Artificial Sequence
  Synthetic oligonucleotide
tgttgtccacctgtgcctcttttgaaatcgatata

SEQ ID NO: 79856 - DNA, 35 bp, Artificial Sequence
  Synthetic oligonucleotide
atcgcccagcaccctcattttttttaattgcgcta

SEQ ID NO: 79857 - DNA, 35 bp, Artificial Sequence
  Synthetic oligonucleotide
tgacgggggggagccacagggacgggatgagcgta

SEQ ID NO: 79858 - DNA, 35 bp, Artificial Sequence
  Synthetic oligonucleotide
tttccctgccccgttaatgaccagtaggcacggta

SEQ ID NO: 79859 - DNA, 36 bp, Artificial Sequence
  Synthetic oligonucleotide
taaccagagcaatgtgggtgctggagtggtaaatta

SEQ ID NO: 79860 - DNA, 36 bp, Artificial Sequence
  Synthetic oligonucleotide
aagtcaagctgaaccggggaggataggcgacggtta

SEQ ID NO: 79861 - DNA, 35 bp, Artificial Sequence
  Synthetic oligonucleotide
gaggtgggtgaggactaggttgatgattagggtta

SEQ ID NO: 79862 - DNA, 36 bp, Artificial Sequence
  Synthetic oligonucleotide
tacgtagtgggcaaaggggtcaaacgcgttctgtta

SEQ ID NO: 79863 - DNA, 34 bp, Artificial Sequence
  Synthetic oligonucleotide
tcccccgccgccgtcccatcaaagtcacctacac

SEQ ID NO: 79864 - DNA, 35 bp, Artificial Sequence
  Synthetic oligonucleotide
aacgccgcaggagcaaagactaccttacgaccgac

SEQ ID NO: 79865 - DNA, 35 bp, Artificial Sequence
  Synthetic oligonucleotide
ttgaccgccactcgatctgcacctcacggacatac

SEQ ID NO: 79866 - DNA, 35 bp, Artificial Sequence
  Synthetic oligonucleotide
acctgggcccaatttgcaattctctcgtgtatacc

SEQ ID NO: 79867 - DNA, 35 bp, Artificial Sequence
  Synthetic oligonucleotide
tccttgcttcccctcagggtcgcctctttgacccc

SEQ ID NO: 79868 - DNA, 35 bp, Artificial Sequence
  Synthetic oligonucleotide
gactaccccctgggatgaattgcggtcctcaagcc

SEQ ID NO: 79869 - DNA, 35 bp, Artificial Sequence
  Synthetic oligonucleotide
gcctcgtgaaccctgctgttacatccttgcgtgcc

SEQ ID NO: 79870 - DNA, 35 bp, Artificial Sequence
  Synthetic oligonucleotide
atcaatctatcgacactggagccttcgccctgtcc

SEQ ID NO: 79871 - DNA, 35 bp, Artificial Sequence
  Synthetic oligonucleotide
actcccgtggctggcctgctttgaagtctctgtcc

SEQ ID NO: 79872 - DNA, 35 bp, Artificial Sequence
  Synthetic oligonucleotide
tccccaccaaactgtttagagtccccctgttgtcc

SEQ ID NO: 79873 - DNA, 35 bp, Artificial Sequence
  Synthetic oligonucleotide
tttggtgggccccccgtgcagactcgctcccccgc

SEQ ID NO: 79874 - DNA, 35 bp, Artificial Sequence
  Synthetic oligonucleotide
aacgcacacaattgatactttaagcccgttgccgc

SEQ ID NO: 79875 - DNA, 35 bp, Artificial Sequence
  Synthetic oligonucleotide
agttaggggaacgggggtacattactcttgggggc

SEQ ID NO: 79876 - DNA, 35 bp, Artificial Sequence
  Synthetic oligonucleotide
gtcagtaatcacccgtctcatgccaccgaaaatgc

SEQ ID NO: 79877 - DNA, 35 bp, Artificial Sequence
  Synthetic oligonucleotide
gagagacggacgaaaaggattatgttaaggtatgc

SEQ ID NO: 79878 - DNA, 35 bp, Artificial Sequence
  Synthetic oligonucleotide
ggtcgaaatcccatttgctgagtgccctctgttgc

SEQ ID NO: 79879 - DNA, 35 bp, Artificial Sequence
  Synthetic oligonucleotide
ttgagtctgcccacggaaacttgaccgttcacctc

SEQ ID NO: 79880 - DNA, 35 bp, Artificial Sequence
  Synthetic oligonucleotide
gtcaagccaggattgttctatacgcatcgcccctc

SEQ ID NO: 79881 - DNA, 35 bp, Artificial Sequence
  Synthetic oligonucleotide
acaaggcgcatccatactgttccgttttatcctag

SEQ ID NO: 79882 - DNA, 35 bp, Artificial Sequence
  Synthetic oligonucleotide
tacgcgatggcgatgacgcttccccaggcctgtcg

SEQ ID NO: 79883 - DNA, 35 bp, Artificial Sequence
  Synthetic oligonucleotide
ttgatccatctcccaaattgagtaaaatgcccatg

SEQ ID NO: 79884 - DNA, 35 bp, Artificial Sequence
  Synthetic oligonucleotide
gccgcctgctctccagtatgcgatgctctcccatg

SEQ ID NO: 79885 - DNA, 35 bp, Artificial Sequence
  Synthetic oligonucleotide
tgaactacgctttctacttacgacctcagccactg

SEQ ID NO: 79886 - DNA, 35 bp, Artificial Sequence
  Synthetic oligonucleotide
tcgcacatccgccccatgcgtctcgacgcgacaat

SEQ ID NO: 79887 - DNA, 35 bp, Artificial Sequence
  Synthetic oligonucleotide
gcggaaccaccacaccagttttagatccactcaat

SEQ ID NO: 79888 - DNA, 35 bp, Artificial Sequence
  Synthetic oligonucleotide
aacctgctccatttaccgtgtcctgtcgtggccat

SEQ ID NO: 79889 - DNA, 35 bp, Artificial Sequence
  Synthetic oligonucleotide
tgaagtggtggaggggaagagaagcttgttatact

SEQ ID NO: 79890 - DNA, 35 bp, Artificial Sequence
  Synthetic oligonucleotide
ggtccgcatcggtcaccaactcgacctcgacccct

SEQ ID NO: 79891 - DNA, 35 bp, Artificial Sequence
  Synthetic oligonucleotide
gagaggtcccccccacagcactgggcctctgccct

SEQ ID NO: 79892 - DNA, 35 bp, Artificial Sequence
  Synthetic oligonucleotide
gcacgttaccacatgccgttttccgctttgaatct

SEQ ID NO: 79893 - DNA, 35 bp, Artificial Sequence
  Synthetic oligonucleotide
ttacaatcagatggtcaggcttcatcccgccatct

SEQ ID NO: 79894 - DNA, 35 bp, Artificial Sequence
  Synthetic oligonucleotide
gaatagtggagaggagtgaggtcggcttaagtggt

SEQ ID NO: 79895 - DNA, 35 bp, Artificial Sequence
  Synthetic oligonucleotide
tcaaattgcacagcctctccgtaatcgataccctt

SEQ ID NO: 79896 - DNA, 35 bp, Artificial Sequence
  Synthetic oligonucleotide
agcctccccacattgatcaatggatacaaatcctt

SEQ ID NO: 79897 - DNA, 35 bp, Artificial Sequence
  Synthetic oligonucleotide
aaacaaccccacactgtagagaattagctgctgtt

SEQ ID NO: 79898 - DNA, 35 bp, Artificial Sequence
  Synthetic oligonucleotide
acccccgcacttatataccgcgatgttcaatgttt

SEQ ID NO: 79899 - DNA, 36 bp, Artificial Sequence
  Synthetic oligonucleotide
tgctcgcacgggccaacatgacgcttttttgggaaa

SEQ ID NO: 79900 - DNA, 35 bp, Artificial Sequence
  Synthetic oligonucleotide
gacaatgtacctcgtctgtccgcccctcttgtaaa

SEQ ID NO: 79901 - DNA, 36 bp, Artificial Sequence
  Synthetic oligonucleotide
tttgccgtctcattctgtgcatggtttcctttccca

SEQ ID NO: 79902 - DNA, 36 bp, Artificial Sequence
  Synthetic oligonucleotide
taacatcaatccagcaccaggcgcctccacgtcgca

SEQ ID NO: 79903 - DNA, 36 bp, Artificial Sequence
  Synthetic oligonucleotide
agtacgacgagctgatgaagtggtggaggaggggca

SEQ ID NO: 79904 - DNA, 36 bp, Artificial Sequence
  Synthetic oligonucleotide
tctcaacagtcccgtacgccccatctctctcatgca

SEQ ID NO: 79905 - DNA, 36 bp, Artificial Sequence
  Synthetic oligonucleotide
tgttacgttaatcgtcctccgctacgcccttttgca

SEQ ID NO: 79906 - DNA, 35 bp, Artificial Sequence
  Synthetic oligonucleotide
tagcggtgggagacggggacaaaagggagagatca

SEQ ID NO: 79907 - DNA, 35 bp, Artificial Sequence
  Synthetic oligonucleotide
gtcacaataacgttttgcccagaccgtttcactca

SEQ ID NO: 79908 - DNA, 35 bp, Artificial Sequence
  Synthetic oligonucleotide
gatgcggggaaagggtgggactgtggtggggctca

SEQ ID NO: 79909 - DNA, 36 bp, Artificial Sequence
  Synthetic oligonucleotide
actcgtcctgatatacctccgatccaatgcccgtca

SEQ ID NO: 79910 - DNA, 36 bp, Artificial Sequence
  Synthetic oligonucleotide
aagttaagagggggagacgggacagtggccggcaga

SEQ ID NO: 79911 - DNA, 37 bp, Artificial Sequence
  Synthetic oligonucleotide
gtgtaccgcattctccaggacgtactcttttcagaga

SEQ ID NO: 79912 - DNA, 37 bp, Artificial Sequence
  Synthetic oligonucleotide
gaagggggagattgaaaaacggtggaatcgagttaga

SEQ ID NO: 79913 - DNA, 37 bp, Artificial Sequence
  Synthetic oligonucleotide
gaaatgggttcaggaaggggcaatataactggtacga

SEQ ID NO: 79914 - DNA, 37 bp, Artificial Sequence
  Synthetic oligonucleotide
gccgtgagggggtaggcgggtagatagggcggagcga

SEQ ID NO: 79915 - DNA, 37 bp, Artificial Sequence
  Synthetic oligonucleotide
tcactcagcacagtgcctttacgtacaagcccatcga

SEQ ID NO: 79916 - DNA, 37 bp, Artificial Sequence
  Synthetic oligonucleotide
atcaagcggcgacggggaacgggggcaatgttgtcga

SEQ ID NO: 79917 - DNA, 36 bp, Artificial Sequence
  Synthetic oligonucleotide
aacgcgccctcgctgctttcaacacgttttgttcga

SEQ ID NO: 79918 - DNA, 37 bp, Artificial Sequence
  Synthetic oligonucleotide
agccgcactgaccccaagtatcctcctccttaaagga

SEQ ID NO: 79919 - DNA, 37 bp, Artificial Sequence
  Synthetic oligonucleotide
gttgggtggggagtcgtgagcggagtacgaaagcgga

SEQ ID NO: 79920 - DNA, 37 bp, Artificial Sequence
  Synthetic oligonucleotide
ttccggaaccaacgttattactgccaccccacgcgga

SEQ ID NO: 79921 - DNA, 37 bp, Artificial Sequence
  Synthetic oligonucleotide
gacaacatcggttggcaggaaggcgtgatagcgcgga

SEQ ID NO: 79922 - DNA, 37 bp, Artificial Sequence
  Synthetic oligonucleotide
tcgctctggcctccactttttaacccgttcgatcgga

SEQ ID NO: 79923 - DNA, 37 bp, Artificial Sequence
  Synthetic oligonucleotide
atccctgcatgcagctaccgccttccccgcctaggga

SEQ ID NO: 79924 - DNA, 37 bp, Artificial Sequence
  Synthetic oligonucleotide
gtgggagggggggccgttctcggagcctgcgctggga

SEQ ID NO: 79925 - DNA, 36 bp, Artificial Sequence
  Synthetic oligonucleotide
agcgggtggcatggtgggaatttgttgatgctggga

SEQ ID NO: 79926 - DNA, 36 bp, Artificial Sequence
  Synthetic oligonucleotide
tccagaacgctaaaaggggaataaagggatgctgga

SEQ ID NO: 79927 - DNA, 38 bp, Artificial Sequence
  Synthetic oligonucleotide
gccacctttccgaatcatacagtgtgcacccccaatga

SEQ ID NO: 79928 - DNA, 37 bp, Artificial Sequence
  Synthetic oligonucleotide
gaaaccgtccctgtcaaccaacctttatgccacatga

SEQ ID NO: 79929 - DNA, 37 bp, Artificial Sequence
  Synthetic oligonucleotide
taacgaggggattaagggcgtggcgggacactcatga

SEQ ID NO: 79930 - DNA, 37 bp, Artificial Sequence
  Synthetic oligonucleotide
actcccccaattacccttcggactccgtcattcatga

SEQ ID NO: 79931 - DNA, 38 bp, Artificial Sequence
  Synthetic oligonucleotide
tagatgtgtcattctgccaataacatcctgccctatga

SEQ ID NO: 79932 - DNA, 38 bp, Artificial Sequence
  Synthetic oligonucleotide
acatccctcgcgagagaattgggccctgtattacctga

SEQ ID NO: 79933 - DNA, 38 bp, Artificial Sequence
  Synthetic oligonucleotide
atgcgaccggggagcaaggaagagaagtgtcgccctga

SEQ ID NO: 79934 - DNA, 38 bp, Artificial Sequence
  Synthetic oligonucleotide
tcatcacaacattcatttagcacagcagcattagctga

SEQ ID NO: 79935 - DNA, 38 bp, Artificial Sequence
  Synthetic oligonucleotide
gctcgacgcattactggccctccgttccttctggctga

SEQ ID NO: 79936 - DNA, 37 bp, Artificial Sequence
  Synthetic oligonucleotide
tcctcctccatcccacttgtctgtccggcgatgctga

SEQ ID NO: 79937 - DNA, 37 bp, Artificial Sequence
  Synthetic oligonucleotide
ttcaccttcacttccggcttacgacacttattagtga

SEQ ID NO: 79938 - DNA, 38 bp, Artificial Sequence
  Synthetic oligonucleotide
gaacgggtgggtgggcctaggcctcgggaaaaccgtga

SEQ ID NO: 79939 - DNA, 38 bp, Artificial Sequence
  Synthetic oligonucleotide
gagccgtacaatatccttacttcgcttctctaccgtga

SEQ ID NO: 79940 - DNA, 38 bp, Artificial Sequence
  Synthetic oligonucleotide
attgtaccggctcggtgtcccacacttcttctccgtga

SEQ ID NO: 79941 - DNA, 38 bp, Artificial Sequence
  Synthetic oligonucleotide
ttactccaccacgcccctcatttgtgttacacgcgtga

SEQ ID NO: 79942 - DNA, 38 bp, Artificial Sequence
  Synthetic oligonucleotide
gaagagagaaggccatggtggtacgtgagggtgtgtga

SEQ ID NO: 79943 - DNA, 35 bp, Artificial Sequence
  Synthetic oligonucleotide
tgtaacgtgcccgcccatctacgtgtaccttgtga

SEQ ID NO: 79944 - DNA, 37 bp, Artificial Sequence
  Synthetic oligonucleotide
agactccgctcacacaatccgctactaacgaccttga

SEQ ID NO: 79945 - DNA, 38 bp, Artificial Sequence
  Synthetic oligonucleotide
atcatgagtccatgatcttaaaaccactcaccccttga

SEQ ID NO: 79946 - DNA, 38 bp, Artificial Sequence
  Synthetic oligonucleotide
tgctatgtctcgtttgcgtccattttgtcccgcgttga

SEQ ID NO: 79947 - DNA, 38 bp, Artificial Sequence
  Synthetic oligonucleotide
gtgaacgtcgggagggcgcggcgggttggcggtgttga

SEQ ID NO: 79948 - DNA, 38 bp, Artificial Sequence
  Synthetic oligonucleotide
atggcgcgctccgtctcatacaccgcaccccgatttga

SEQ ID NO: 79949 - DNA, 38 bp, Artificial Sequence
  Synthetic oligonucleotide
gttgggcgggaaaaaaagtaggagtaggggtagtttga

SEQ ID NO: 79950 - DNA, 38 bp, Artificial Sequence
  Synthetic oligonucleotide
tgtgctacgacgctatccccggcctgccactcttttga

SEQ ID NO: 79951 - DNA, 36 bp, Artificial Sequence
  Synthetic oligonucleotide
gtcgctcccctatttgttctattctgtggtttcata

SEQ ID NO: 79952 - DNA, 36 bp, Artificial Sequence
  Synthetic oligonucleotide
acccatggtcccttcgtaatttgggggaattatcta

SEQ ID NO: 79953 - DNA, 36 bp, Artificial Sequence
  Synthetic oligonucleotide
tgtccgcttaccttgggcactctcctacttgttcta

SEQ ID NO: 79954 - DNA, 36 bp, Artificial Sequence
  Synthetic oligonucleotide
tgtgataagggcgtggaacggaagaaggatgtagta

SEQ ID NO: 79955 - DNA, 34 bp, Artificial Sequence
  Synthetic oligonucleotide
tcacgctgggcctcactgatgagggatcgacgta

SEQ ID NO: 79956 - DNA, 36 bp, Artificial Sequence
  Synthetic oligonucleotide
agcacgagcatggcagcatttatctcgccccctgta

SEQ ID NO: 79957 - DNA, 36 bp, Artificial Sequence
  Synthetic oligonucleotide
acccacctaaggctataaaaactgtcgacctcttta

SEQ ID NO: 79958 - DNA, 35 bp, Artificial Sequence
  Synthetic oligonucleotide
acaactgccaaaacggggtatcatgtgagaggaac

SEQ ID NO: 79959 - DNA, 35 bp, Artificial Sequence
  Synthetic oligonucleotide
tagacacaccaacccctccaaaggggccgctacac

SEQ ID NO: 79960 - DNA, 35 bp, Artificial Sequence
  Synthetic oligonucleotide
aacgctccgtggcgtgtccatctcatgtgctacac

SEQ ID NO: 79961 - DNA, 35 bp, Artificial Sequence
  Synthetic oligonucleotide
atccggtccctgctaacttccaacattgccatcac

SEQ ID NO: 79962 - DNA, 35 bp, Artificial Sequence
  Synthetic oligonucleotide
acttaccggcccctgctctagcgtgaaccgcatac

SEQ ID NO: 79963 - DNA, 35 bp, Artificial Sequence
  Synthetic oligonucleotide
tgacgttatgtccgtctgtcatttgaccttgttac

SEQ ID NO: 79964 - DNA, 35 bp, Artificial Sequence
  Synthetic oligonucleotide
gatccccctcttttggctaacctctcgagaggacc

SEQ ID NO: 79965 - DNA, 35 bp, Artificial Sequence
  Synthetic oligonucleotide
gagcaagaagtagccagtttttcccacccatgccc

SEQ ID NO: 79966 - DNA, 35 bp, Artificial Sequence
  Synthetic oligonucleotide
gacacacatcctgcacccctagtttattgcctgcc

SEQ ID NO: 79967 - DNA, 35 bp, Artificial Sequence
  Synthetic oligonucleotide
tgctaacgcccgaaaaatcttggtcttaccgtgcc

SEQ ID NO: 79968 - DNA, 35 bp, Artificial Sequence
  Synthetic oligonucleotide
tttgctcgaaacccagagcgtgcactatcacatcc

SEQ ID NO: 79969 - DNA, 35 bp, Artificial Sequence
  Synthetic oligonucleotide
gttagcccacgagtcaaaggactcgctatcgttcc

SEQ ID NO: 79970 - DNA, 34 bp, Artificial Sequence
  Synthetic oligonucleotide
gccatccctcatttttacacacttgcccccgcgc

SEQ ID NO: 79971 - DNA, 35 bp, Artificial Sequence
  Synthetic oligonucleotide
tcgacccatcctcgcactatctctcgggcccatgc

SEQ ID NO: 79972 - DNA, 35 bp, Artificial Sequence
  Synthetic oligonucleotide
tagggggaatggaaaagtaggtcgaagaacggtgc

SEQ ID NO: 79973 - DNA, 35 bp, Artificial Sequence
  Synthetic oligonucleotide
gtagaggcacaactttgtattcaatgtttcccatc

SEQ ID NO: 79974 - DNA, 35 bp, Artificial Sequence
  Synthetic oligonucleotide
actcgcttcctaactcatggcgttcttgccctatc

SEQ ID NO: 79975 - DNA, 35 bp, Artificial Sequence
  Synthetic oligonucleotide
tgagtacgccgtacccacgctccacgactaccctc

SEQ ID NO: 79976 - DNA, 35 bp, Artificial Sequence
  Synthetic oligonucleotide
caactcagtgcagcacgcccctcgccatgtcgctc

SEQ ID NO: 79977 - DNA, 35 bp, Artificial Sequence
  Synthetic oligonucleotide
gtttcccccgcaaatccttcgtgagaagtcatctc

SEQ ID NO: 79978 - DNA, 35 bp, Artificial Sequence
  Synthetic oligonucleotide
ggatggggtagggcagaaggacgtagtagaaggtc

SEQ ID NO: 79979 - DNA, 35 bp, Artificial Sequence
  Synthetic oligonucleotide
gatgtagccactttctcaccgacatcttttgggtc

SEQ ID NO: 79980 - DNA, 35 bp, Artificial Sequence
  Synthetic oligonucleotide
accttcgcccatagcgatttaatactcagtctttc

SEQ ID NO: 79981 - DNA, 35 bp, Artificial Sequence
  Synthetic oligonucleotide
acttggtcaccctgttgctacctcaccgcacaacg

SEQ ID NO: 79982 - DNA, 35 bp, Artificial Sequence
  Synthetic oligonucleotide
tgagcccagcctagtagtctgtacatcctcgcacg

SEQ ID NO: 79983 - DNA, 35 bp, Artificial Sequence
  Synthetic oligonucleotide
ataggagtcgaaggaggtttaggatttggtgtagg

SEQ ID NO: 79984 - DNA, 35 bp, Artificial Sequence
  Synthetic oligonucleotide
aaaggtcgggtgaggaggtaaaaacgaaatgacgg

SEQ ID NO: 79985 - DNA, 35 bp, Artificial Sequence
  Synthetic oligonucleotide
ggtccaggcggggcaagatctaggaggtggttcgg

SEQ ID NO: 79986 - DNA, 35 bp, Artificial Sequence
  Synthetic oligonucleotide
aaaacatgtcggtgcagaacgaggatgagggatgg

SEQ ID NO: 79987 - DNA, 35 bp, Artificial Sequence
  Synthetic oligonucleotide
gtagacggcaatatcgggtcgctaccttcccttgg

SEQ ID NO: 79988 - DNA, 35 bp, Artificial Sequence
  Synthetic oligonucleotide
gcacccctaaagtgaattttgcattgtgccccaat

SEQ ID NO: 79989 - DNA, 35 bp, Artificial Sequence
  Synthetic oligonucleotide
gaccgccccactgcctgtacaacgacgtagttgat

SEQ ID NO: 79990 - DNA, 35 bp, Artificial Sequence
  Synthetic oligonucleotide
attgcgagtccagctactaccctccgacctcatat

SEQ ID NO: 79991 - DNA, 35 bp, Artificial Sequence
  Synthetic oligonucleotide
ccgtgcccccactaattgttccacactgacgatat

SEQ ID NO: 79992 - DNA, 35 bp, Artificial Sequence
  Synthetic oligonucleotide
ttgcgccctcccttatgccgtgctcgcctccgtat

SEQ ID NO: 79993 - DNA, 35 bp, Artificial Sequence
  Synthetic oligonucleotide
gcttccacgaggggttctcccgggccaatcacact

SEQ ID NO: 79994 - DNA, 35 bp, Artificial Sequence
  Synthetic oligonucleotide
tgaggctccgacctaatcaccagtagcccacgcct

SEQ ID NO: 79995 - DNA, 35 bp, Artificial Sequence
  Synthetic oligonucleotide
tccccactcgcacattgtttggttctgtcttcgct

SEQ ID NO: 79996 - DNA, 35 bp, Artificial Sequence
  Synthetic oligonucleotide
acagtgctccgatccgtttctttttctgtcttgct

SEQ ID NO: 79997 - DNA, 35 bp, Artificial Sequence
  Synthetic oligonucleotide
acatgagcgaggtagcgtgcctctcatatacatct

SEQ ID NO: 79998 - DNA, 35 bp, Artificial Sequence
  Synthetic oligonucleotide
tgatcctgtcgtcccctggatggatcctgttctct

SEQ ID NO: 79999 - DNA, 35 bp, Artificial Sequence
  Synthetic oligonucleotide
tcaccacatcaatgcatctactcttctcaacgtgt

SEQ ID NO: 80000 - DNA, 35 bp, Artificial Sequence
  Synthetic oligonucleotide
tcaggagccccttgcgacttcccaacaggagttgt

SEQ ID NO: 80001 - DNA, 35 bp, Artificial Sequence
  Synthetic oligonucleotide
gttcgtccggcaacaacgcgaaaacccccgtactt

SEQ ID NO: 80002 - DNA, 35 bp, Artificial Sequence
  Synthetic oligonucleotide
gaactcgccacgatcacatgctaccgtcccaagtt

SEQ ID NO: 80003 - DNA, 35 bp, Artificial Sequence
  Synthetic oligonucleotide
gggaatggggcaggtatcgatttaaagggggggtt

SEQ ID NO: 80004 - DNA, 36 bp, Artificial Sequence
  Synthetic oligonucleotide
gagacacccatcaatgccgatcgcgaactcttccaa

SEQ ID NO: 80005 - DNA, 35 bp, Artificial Sequence
  Synthetic oligonucleotide
atcccgcactctcacacacccctacccgtagtgaa

SEQ ID NO: 80006 - DNA, 35 bp, Artificial Sequence
  Synthetic oligonucleotide
ttgacacccgcaattctcagaaatagggatttgaa

SEQ ID NO: 80007 - DNA, 35 bp, Artificial Sequence
  Synthetic oligonucleotide
tgatctcgactccggcctttaacttctcgacataa

SEQ ID NO: 80008 - DNA, 35 bp, Artificial Sequence
  Synthetic oligonucleotide
ataccggcgaactgtgtcatctttcttgcgcctaa

SEQ ID NO: 80009 - DNA, 34 bp, Artificial Sequence
  Synthetic oligonucleotide
actgtgccgggagtagacttcagcaccactctaa

SEQ ID NO: 80010 - DNA, 35 bp, Artificial Sequence
  Synthetic oligonucleotide
gccctaggccctcactcctccggtcttggttctaa

SEQ ID NO: 80011 - DNA, 35 bp, Artificial Sequence
  Synthetic oligonucleotide
tatgccctcctggataccgtccgacaccgaaaaca

SEQ ID NO: 80012 - DNA, 36 bp, Artificial Sequence
  Synthetic oligonucleotide
atgctccctgcattgacctaaccgcgagtggccaca

SEQ ID NO: 80013 - DNA, 36 bp, Artificial Sequence
  Synthetic oligonucleotide
tagttgccgccaacggtcttgcctttttcctgccca

SEQ ID NO: 80014 - DNA, 36 bp, Artificial Sequence
  Synthetic oligonucleotide
acccccagagcgtattgtccatcctgcgattggcca

SEQ ID NO: 80015 - DNA, 35 bp, Artificial Sequence
  Synthetic oligonucleotide
tccgtcaaggctcgaaatccagttcccgtcccgca

SEQ ID NO: 80016 - DNA, 36 bp, Artificial Sequence
  Synthetic oligonucleotide
actgacaacgctgagtatctgccttaccagtcttca

SEQ ID NO: 80017 - DNA, 35 bp, Artificial Sequence
  Synthetic oligonucleotide
tcaatcaggggaataggactgctgggacaacaaga

SEQ ID NO: 80018 - DNA, 37 bp, Artificial Sequence
  Synthetic oligonucleotide
gaggggagtctgggggaggtccgaggcaaaggtaaga

SEQ ID NO: 80019 - DNA, 37 bp, Artificial Sequence
  Synthetic oligonucleotide
tagccccgtgtggtggtttttccctgccttaacgaga

SEQ ID NO: 80020 - DNA, 37 bp, Artificial Sequence
  Synthetic oligonucleotide
gactccaggcacgtgcggtatagtgtatcgtaggaga

SEQ ID NO: 80021 - DNA, 37 bp, Artificial Sequence
  Synthetic oligonucleotide
tgatagggtcacgttttaggggaagggatcggggaga

SEQ ID NO: 80022 - DNA, 37 bp, Artificial Sequence
  Synthetic oligonucleotide
gacaggaggagagtaaaggcacaagagatgggggaga

SEQ ID NO: 80023 - DNA, 37 bp, Artificial Sequence
  Synthetic oligonucleotide
gccgagtacgtcaataaggaaagggcgttggaaccga

SEQ ID NO: 80024 - DNA, 37 bp, Artificial Sequence
  Synthetic oligonucleotide
tcactaccatctacgtaaacacccagcgatcgcccga

SEQ ID NO: 80025 - DNA, 37 bp, Artificial Sequence
  Synthetic oligonucleotide
gcatcacctcatccgccagatttgccaactttcgcga

SEQ ID NO: 80026 - DNA, 37 bp, Artificial Sequence
  Synthetic oligonucleotide
tcccatccccggatacacaatgataagttaacctcga

SEQ ID NO: 80027 - DNA, 36 bp, Artificial Sequence
  Synthetic oligonucleotide
ttgacgaccagcgcccacacttcgccgatatctcga

SEQ ID NO: 80028 - DNA, 37 bp, Artificial Sequence
  Synthetic oligonucleotide
ttgactcgctcccgcctgtgacccccccaagagtcga

SEQ ID NO: 80029 - DNA, 36 bp, Artificial Sequence
  Synthetic oligonucleotide
agtagcgagagcggagggcaaggataaatgtaagga

SEQ ID NO: 80030 - DNA, 37 bp, Artificial Sequence
  Synthetic oligonucleotide
atggtcacctccagcgtcgccgcacaacacctgagga

SEQ ID NO: 80031 - DNA, 37 bp, Artificial Sequence
  Synthetic oligonucleotide
ggagaggtcaacaatgggggcggctggaggtgacgga

SEQ ID NO: 80032 - DNA, 37 bp, Artificial Sequence
  Synthetic oligonucleotide
gacggggggagggcgggtttaaaacgtgtgagccgga

SEQ ID NO: 80033 - DNA, 37 bp, Artificial Sequence
  Synthetic oligonucleotide
accctcgccggggggtttttccaagggctgaaaggga

SEQ ID NO: 80034 - DNA, 37 bp, Artificial Sequence
  Synthetic oligonucleotide
agatgggggggtctaatagggagatgtcgtcgcggga

SEQ ID NO: 80035 - DNA, 37 bp, Artificial Sequence
  Synthetic oligonucleotide
gagtggaggaacgagtaaaattctgaggtcggcggga

SEQ ID NO: 80036 - DNA, 37 bp, Artificial Sequence
  Synthetic oligonucleotide
tccaccattctctccgatcgttacgcgcatttcggga

SEQ ID NO: 80037 - DNA, 37 bp, Artificial Sequence
  Synthetic oligonucleotide
atgcagagtgagatcggcaaatggagggggcggggga

SEQ ID NO: 80038 - DNA, 37 bp, Artificial Sequence
  Synthetic oligonucleotide
gacgcgtggaagtttaggttggaccggtgtgggggga

SEQ ID NO: 80039 - DNA, 35 bp, Artificial Sequence
  Synthetic oligonucleotide
tccatgtaggaggggtgcaaagtggtagatgggga

SEQ ID NO: 80040 - DNA, 37 bp, Artificial Sequence
  Synthetic oligonucleotide
atctgacgagacaactgggtgcctgaagagagatgga

SEQ ID NO: 80041 - DNA, 37 bp, Artificial Sequence
  Synthetic oligonucleotide
ttgacatgcagggcataatggctaagaacaatctgga

SEQ ID NO: 80042 - DNA, 37 bp, Artificial Sequence
  Synthetic oligonucleotide
acaccaacccaatgagttccttgtaaaaactagtgga

SEQ ID NO: 80043 - DNA, 37 bp, Artificial Sequence
  Synthetic oligonucleotide
tttaggccggctgaatgtctttttcttctggggtgga

SEQ ID NO: 80044 - DNA, 37 bp, Artificial Sequence
  Synthetic oligonucleotide
tccccactgggactctgtgcaataacatctacttgga

SEQ ID NO: 80045 - DNA, 38 bp, Artificial Sequence
  Synthetic oligonucleotide
gaggagggggtgctgggatgggcaaggggtcgaaatga

SEQ ID NO: 80046 - DNA, 38 bp, Artificial Sequence
  Synthetic oligonucleotide
tgcgaaccgccacgtgtaggccaccttagaacccatga

SEQ ID NO: 80047 - DNA, 38 bp, Artificial Sequence
  Synthetic oligonucleotide
gacgctggagccgatcacatccctgaaccatatcatga

SEQ ID NO: 80048 - DNA, 37 bp, Artificial Sequence
  Synthetic oligonucleotide
gccacgcccacgtctctagtctgtcccgatcgtatga

SEQ ID NO: 80049 - DNA, 38 bp, Artificial Sequence
  Synthetic oligonucleotide
tagacgcacaaggtggtaggggggtagaactgaactga

SEQ ID NO: 80050 - DNA, 38 bp, Artificial Sequence
  Synthetic oligonucleotide
atcacccgtccatacctgtaccgcatttcttgtactga

SEQ ID NO: 80051 - DNA, 38 bp, Artificial Sequence
  Synthetic oligonucleotide
accacgcacgcgcatgactcaaggctaccggttactga

SEQ ID NO: 80052 - DNA, 38 bp, Artificial Sequence
  Synthetic oligonucleotide
tcatcgcgtcccccctcgctatgcattgtctttactga

SEQ ID NO: 80053 - DNA, 37 bp, Artificial Sequence
  Synthetic oligonucleotide
tgagcgattcttctggcttcggttcacttcaccctga

SEQ ID NO: 80054 - DNA, 38 bp, Artificial Sequence
  Synthetic oligonucleotide
tcaccccacgatcctattacaatctcgcctgcccctga

SEQ ID NO: 80055 - DNA, 38 bp, Artificial Sequence
  Synthetic oligonucleotide
tgcgcaattcctgtatggtacaaccaaccttcccctga

SEQ ID NO: 80056 - DNA, 37 bp, Artificial Sequence
  Synthetic oligonucleotide
tggggggccacacacctcgcacagtttcttcccctga

SEQ ID NO: 80057 - DNA, 35 bp, Artificial Sequence
  Synthetic oligonucleotide
gcggacaggccgacctctcttgtgctccctcctga

SEQ ID NO: 80058 - DNA, 38 bp, Artificial Sequence
  Synthetic oligonucleotide
atcgcatggcggagttcatacccggccgtttctcctga

SEQ ID NO: 80059 - DNA, 38 bp, Artificial Sequence
  Synthetic oligonucleotide
tcccacgcagtccttaatccgacgaagtcctacgctga

SEQ ID NO: 80060 - DNA, 38 bp, Artificial Sequence
  Synthetic oligonucleotide
acgcaacccccacacatccaataaggggacaaatctga

SEQ ID NO: 80061 - DNA, 38 bp, Artificial Sequence
  Synthetic oligonucleotide
accgccccctcatccgcctgacactccttgatctctga

SEQ ID NO: 80062 - DNA, 37 bp, Artificial Sequence
  Synthetic oligonucleotide
gcagggtaagcctgggtgggtggaggccgcgtagtga

SEQ ID NO: 80063 - DNA, 38 bp, Artificial Sequence
  Synthetic oligonucleotide
aagcgcctccgcctgcgctatccttgttcaccacgtga

SEQ ID NO: 80064 - DNA, 38 bp, Artificial Sequence
  Synthetic oligonucleotide
agctagacgaggtgggggggggaataaaaggggcgtga

SEQ ID NO: 80065 - DNA, 38 bp, Artificial Sequence
  Synthetic oligonucleotide
acgcagtaaggcaaaggccccaagagaggaagaggtga

SEQ ID NO: 80066 - DNA, 36 bp, Artificial Sequence
  Synthetic oligonucleotide
gtctcgggcgctgacctcctcttaccttcgcggtga

SEQ ID NO: 80067 - DNA, 38 bp, Artificial Sequence
  Synthetic oligonucleotide
tgcctggcgcagtattttcttatgggcccctcgtgtga

SEQ ID NO: 80068 - DNA, 37 bp, Artificial Sequence
  Synthetic oligonucleotide
ttgcgtgccgaactcgttagccatcttgaacacttga

SEQ ID NO: 80069 - DNA, 38 bp, Artificial Sequence
  Synthetic oligonucleotide
gtcaagcaagaaaacatggggaagggactttgtcttga

SEQ ID NO: 80070 - DNA, 38 bp, Artificial Sequence
  Synthetic oligonucleotide
gaacagtaatggaggaaacgggtagagggagtggttga

SEQ ID NO: 80071 - DNA, 37 bp, Artificial Sequence
  Synthetic oligonucleotide
gatgcgtaacctggtgacgcacactactcaaatttga

SEQ ID NO: 80072 - DNA, 38 bp, Artificial Sequence
  Synthetic oligonucleotide
gagaacgaaggtggggatccgggggctgcacaatttga

SEQ ID NO: 80073 - DNA, 35 bp, Artificial Sequence
  Synthetic oligonucleotide
taggatgcacatcgtactctccagcccttcgaata

SEQ ID NO: 80074 - DNA, 34 bp, Artificial Sequence
  Synthetic oligonucleotide
gcacgcgcataaccccgttatcaggttccccata

SEQ ID NO: 80075 - DNA, 36 bp, Artificial Sequence
  Synthetic oligonucleotide
gatcagtgcgctacctcttacccgtaccttcgcata

SEQ ID NO: 80076 - DNA, 36 bp, Artificial Sequence
  Synthetic oligonucleotide
actacaccgtaggttaactgcaacactagccctata

SEQ ID NO: 80077 - DNA, 36 bp, Artificial Sequence
  Synthetic oligonucleotide
gatcccagtgttgctcgttacccatctgtaccacta

SEQ ID NO: 80078 - DNA, 35 bp, Artificial Sequence
  Synthetic oligonucleotide
atcgcaataagtccatttcgctcaatcggttccta

SEQ ID NO: 80079 - DNA, 35 bp, Artificial Sequence
  Synthetic oligonucleotide
agactcaaggcaccatctttccagcattccagcta

SEQ ID NO: 80080 - DNA, 34 bp, Artificial Sequence
  Synthetic oligonucleotide
agcccacgcattaggagccccatgtcacattcta

SEQ ID NO: 80081 - DNA, 36 bp, Artificial Sequence
  Synthetic oligonucleotide
gacaacgcattcttgttttactggcccatccgcgta

SEQ ID NO: 80082 - DNA, 36 bp, Artificial Sequence
  Synthetic oligonucleotide
gtccgaacccatgcgcatcccattccaatacaggta

SEQ ID NO: 80083 - DNA, 35 bp, Artificial Sequence
  Synthetic oligonucleotide
gccacttggttttggccttaacatccctggaggta

SEQ ID NO: 80084 - DNA, 36 bp, Artificial Sequence
  Synthetic oligonucleotide
aacgagcgactggtgggcgtacggagggggcgtgta

SEQ ID NO: 80085 - DNA, 35 bp, Artificial Sequence
  Synthetic oligonucleotide
accacccgaacatgctatcgcaatcttctgaatta

SEQ ID NO: 80086 - DNA, 35 bp, Artificial Sequence
  Synthetic oligonucleotide
gatcacctcccggacgtactcacagtctcaccaac

SEQ ID NO: 80087 - DNA, 35 bp, Artificial Sequence
  Synthetic oligonucleotide
gtaccggaccagtagtttagctctccgtggtacac

SEQ ID NO: 80088 - DNA, 35 bp, Artificial Sequence
  Synthetic oligonucleotide
atccctaggatccggtgccatgccgagttcaccac

SEQ ID NO: 80089 - DNA, 35 bp, Artificial Sequence
  Synthetic oligonucleotide
atgcctgtgcgcgcatttctcccgtcaatgcccac

SEQ ID NO: 80090 - DNA, 35 bp, Artificial Sequence
  Synthetic oligonucleotide
agtcgccatccttggattagagttccttcctccac

SEQ ID NO: 80091 - DNA, 35 bp, Artificial Sequence
  Synthetic oligonucleotide
tacgcatccaccctattatgtcgagcggtccatac

SEQ ID NO: 80092 - DNA, 35 bp, Artificial Sequence
  Synthetic oligonucleotide
cccgagcccctagatcgacgtttccctcgcgcccc

SEQ ID NO: 80093 - DNA, 35 bp, Artificial Sequence
  Synthetic oligonucleotide
gatagtcgacggaatgggtggtatgagctgtgagc

SEQ ID NO: 80094 - DNA, 35 bp, Artificial Sequence
  Synthetic oligonucleotide
gatgcgtggtccgccaacgcgataaatgctcctgc

SEQ ID NO: 80095 - DNA, 35 bp, Artificial Sequence
  Synthetic oligonucleotide
aaagatggaagaaatgggggaatgagcaggtggtc

SEQ ID NO: 80096 - DNA, 35 bp, Artificial Sequence
  Synthetic oligonucleotide
gtggtcaggggtgcgttcaactgtatgtaccattc

SEQ ID NO: 80097 - DNA, 35 bp, Artificial Sequence
  Synthetic oligonucleotide
ttgctagctcgacgtaacggctactactattattc

SEQ ID NO: 80098 - DNA, 35 bp, Artificial Sequence
  Synthetic oligonucleotide
tccaccccctgtacttcagtgtccgctccggaaag

SEQ ID NO: 80099 - DNA, 35 bp, Artificial Sequence
  Synthetic oligonucleotide
ttgggaccatataaggaggggctggaggggggaag

SEQ ID NO: 80100 - DNA, 35 bp, Artificial Sequence
  Synthetic oligonucleotide
gtgcgacagcagtcgactttgttgaacgaatggag

SEQ ID NO: 80101 - DNA, 35 bp, Artificial Sequence
  Synthetic oligonucleotide
gaccgacacggtggcagtcgcgaggctccatcccg

SEQ ID NO: 80102 - DNA, 35 bp, Artificial Sequence
  Synthetic oligonucleotide
tcagcccaaccttatccgcaccaccctaccatgcg

SEQ ID NO: 80103 - DNA, 35 bp, Artificial Sequence
  Synthetic oligonucleotide
acatcccgcaccaccacccgcttaggagtgacagg

SEQ ID NO: 80104 - DNA, 35 bp, Artificial Sequence
  Synthetic oligonucleotide
tggaggggtgcgggaggtacggagtagtggcgcgg

SEQ ID NO: 80105 - DNA, 35 bp, Artificial Sequence
  Synthetic oligonucleotide
gatatcccactacgactcgacactccatgcccggg

SEQ ID NO: 80106 - DNA, 35 bp, Artificial Sequence
  Synthetic oligonucleotide
atttcccgccccattctccgtacgtccaccgctgg

SEQ ID NO: 80107 - DNA, 35 bp, Artificial Sequence
  Synthetic oligonucleotide
aatgccgctgaaccaggcacgaacctcaaacactg

SEQ ID NO: 80108 - DNA, 35 bp, Artificial Sequence
  Synthetic oligonucleotide
gtaacctgcgggtgggtaaggggacgggcccactg

SEQ ID NO: 80109 - DNA, 35 bp, Artificial Sequence
  Synthetic oligonucleotide
gctaccttcctaaattctccagacatcctggtctg

SEQ ID NO: 80110 - DNA, 35 bp, Artificial Sequence
  Synthetic oligonucleotide
gcgctaagctgatcactcttcatatttttccgttg

SEQ ID NO: 80111 - DNA, 35 bp, Artificial Sequence
  Synthetic oligonucleotide
gaacatctgaccagtacccatttagctgtcacaat

SEQ ID NO: 80112 - DNA, 35 bp, Artificial Sequence
  Synthetic oligonucleotide
gtgcagtagacagcgctccacccctagtgcttaat

SEQ ID NO: 80113 - DNA, 36 bp, Artificial Sequence
  Synthetic oligonucleotide
atgtggtggtcatgggctatggggcactagggggat

SEQ ID NO: 80114 - DNA, 35 bp, Artificial Sequence
  Synthetic oligonucleotide
gccccagaacggcttttatgcttcccccccctgat

SEQ ID NO: 80115 - DNA, 35 bp, Artificial Sequence
  Synthetic oligonucleotide
gtccaccccctatgatatggtctgctggagtatat

SEQ ID NO: 80116 - DNA, 35 bp, Artificial Sequence
  Synthetic oligonucleotide
tgtagctgctacactaccctgccatttgtttctat

SEQ ID NO: 80117 - DNA, 35 bp, Artificial Sequence
  Synthetic oligonucleotide
gatgcacgtgcccccttctatggtcgccggcgact

SEQ ID NO: 80118 - DNA, 35 bp, Artificial Sequence
  Synthetic oligonucleotide
atcctgacattgctattgacgctatcgcgatgact

SEQ ID NO: 80119 - DNA, 35 bp, Artificial Sequence
  Synthetic oligonucleotide
tgcgttcgccccgcgcgattgcacgtgaaacccct

SEQ ID NO: 80120 - DNA, 35 bp, Artificial Sequence
  Synthetic oligonucleotide
aacttcaccaggcgcaacttgagtcagacgtccct

SEQ ID NO: 80121 - DNA, 35 bp, Artificial Sequence
  Synthetic oligonucleotide
atcttaccgttccatgctaactgcatgcaatgcct

SEQ ID NO: 80122 - DNA, 35 bp, Artificial Sequence
  Synthetic oligonucleotide
ttcgctggccttcattcgcgcattagcgctgtcct

SEQ ID NO: 80123 - DNA, 35 bp, Artificial Sequence
  Synthetic oligonucleotide
ggagccccttgcgtagttttatacgcgcttttgct

SEQ ID NO: 80124 - DNA, 35 bp, Artificial Sequence
  Synthetic oligonucleotide
ttgtcccgatcgtggtctacgcgatttgaacctct

SEQ ID NO: 80125 - DNA, 35 bp, Artificial Sequence
  Synthetic oligonucleotide
accttctccctgctgtacacttaacgggtttctct

SEQ ID NO: 80126 - DNA, 35 bp, Artificial Sequence
  Synthetic oligonucleotide
ttgtgcggaacctagtgcatcttttgggggggagt

SEQ ID NO: 80127 - DNA, 35 bp, Artificial Sequence
  Synthetic oligonucleotide
gcctgcatcaatatttccggtacgttctctagcgt

SEQ ID NO: 80128 - DNA, 35 bp, Artificial Sequence
  Synthetic oligonucleotide
taatccaccgtacacttttacagcaagactctcgt

SEQ ID NO: 80129 - DNA, 35 bp, Artificial Sequence
  Synthetic oligonucleotide
ccactaccgcagcatactgtcgcaccattcccggt

SEQ ID NO: 80130 - DNA, 35 bp, Artificial Sequence
  Synthetic oligonucleotide
gaatgaaggcggaaagagacgcagctatggtatgt

SEQ ID NO: 80131 - DNA, 35 bp, Artificial Sequence
  Synthetic oligonucleotide
agcgggcacctcaacccctgggaagccaatcctgt

SEQ ID NO: 80132 - DNA, 35 bp, Artificial Sequence
  Synthetic oligonucleotide
actgcccgcctgcacgtttttggccacgtccaatt

SEQ ID NO: 80133 - DNA, 35 bp, Artificial Sequence
  Synthetic oligonucleotide
gtccaacgttatttgacaacaaatgccgccttatt

SEQ ID NO: 80134 - DNA, 35 bp, Artificial Sequence
  Synthetic oligonucleotide
atacactccgccaatgggccaaggttctagtagtt

SEQ ID NO: 80135 - DNA, 34 bp, Artificial Sequence
  Synthetic oligonucleotide
gaccacccaggtctgttccacgttatacatggtt

SEQ ID NO: 80136 - DNA, 35 bp, Artificial Sequence
  Synthetic oligonucleotide
tgccccgggcatctgggttcttaccgcttggcttt

SEQ ID NO: 80137 - DNA, 35 bp, Artificial Sequence
  Synthetic oligonucleotide
ggaggggggactcagcatgttcatgggtgtggaaa

SEQ ID NO: 80138 - DNA, 36 bp, Artificial Sequence
  Synthetic oligonucleotide
gagagctcgaggggagcaggaaaaagcactgaacaa

SEQ ID NO: 80139 - DNA, 36 bp, Artificial Sequence
  Synthetic oligonucleotide
gacagtcgcatgccccggcccattaggtgatcacaa

SEQ ID NO: 80140 - DNA, 36 bp, Artificial Sequence
  Synthetic oligonucleotide
gctcgttcaattacgcatactttcctgctgcaccaa

SEQ ID NO: 80141 - DNA, 36 bp, Artificial Sequence
  Synthetic oligonucleotide
gacgcctaacgaaacgttagtgttcctctttcccaa

SEQ ID NO: 80142 - DNA, 36 bp, Artificial Sequence
  Synthetic oligonucleotide
tgtcccctccttctagacgtccgacgaccttgccaa

SEQ ID NO: 80143 - DNA, 36 bp, Artificial Sequence
  Synthetic oligonucleotide
agacactctacaggagcagcactactctactttcaa

SEQ ID NO: 80144 - DNA, 36 bp, Artificial Sequence
  Synthetic oligonucleotide
gtatgtgcaggctgaggggacaatgcaatgtgtgaa

SEQ ID NO: 80145 - DNA, 36 bp, Artificial Sequence
  Synthetic oligonucleotide
gccgagctcccccgtcataatccactggtgcgctaa

SEQ ID NO: 80146 - DNA, 36 bp, Artificial Sequence
  Synthetic oligonucleotide
aacgactggggaggacgccatagcagataggcgtaa

SEQ ID NO: 80147 - DNA, 36 bp, Artificial Sequence
  Synthetic oligonucleotide
gagtaagcgtactgctccacgggctcgtctttaaca

SEQ ID NO: 80148 - DNA, 36 bp, Artificial Sequence
  Synthetic oligonucleotide
gccgccgatggcttggcctattaacttttgaacaca

SEQ ID NO: 80149 - DNA, 36 bp, Artificial Sequence
  Synthetic oligonucleotide
gcggattccgcccattctgccgagttgttaccacca

SEQ ID NO: 80150 - DNA, 35 bp, Artificial Sequence
  Synthetic oligonucleotide
gactacccggaggtacagtaacggaattgccccca

SEQ ID NO: 80151 - DNA, 36 bp, Artificial Sequence
  Synthetic oligonucleotide
agcattgatcgctttgtcgacttgactacccatcca

SEQ ID NO: 80152 - DNA, 36 bp, Artificial Sequence
  Synthetic oligonucleotide
gtcaccagcaagtaggcgtagcatctcaccacatca

SEQ ID NO: 80153 - DNA, 35 bp, Artificial Sequence
  Synthetic oligonucleotide
aagttgtgccccgaccatgcccctgattctcatca

SEQ ID NO: 80154 - DNA, 36 bp, Artificial Sequence
  Synthetic oligonucleotide
ttgcggtcgatcgcactgcgcacactaagttcctca

SEQ ID NO: 80155 - DNA, 35 bp, Artificial Sequence
  Synthetic oligonucleotide
gaatgggagtgaagggggggcatgccagtggttca

SEQ ID NO: 80156 - DNA, 36 bp, Artificial Sequence
  Synthetic oligonucleotide
aacgacgacgggcctgcctttatttccctccaaaga

SEQ ID NO: 80157 - DNA, 37 bp, Artificial Sequence
  Synthetic oligonucleotide
attcgcccccccggtagctgttggacgcactccaaga

SEQ ID NO: 80158 - DNA, 37 bp, Artificial Sequence
  Synthetic oligonucleotide
gtggaaacagtgagggggcagggtgcgtcgagcaaga

SEQ ID NO: 80159 - DNA, 37 bp, Artificial Sequence
  Synthetic oligonucleotide
tagacgtactgcgccgacgccacaatatctatccaga

SEQ ID NO: 80160 - DNA, 37 bp, Artificial Sequence
  Synthetic oligonucleotide
acacacacggctccgggcaaaaaaaagggaaagcaga

SEQ ID NO: 80161 - DNA, 36 bp, Artificial Sequence
  Synthetic oligonucleotide
gatagatggcaaacgggggaaatattaaagggcaga

SEQ ID NO: 80162 - DNA, 36 bp, Artificial Sequence
  Synthetic oligonucleotide
gaggacagtgggagggggccgaaagtggatatcaga

SEQ ID NO: 80163 - DNA, 36 bp, Artificial Sequence
  Synthetic oligonucleotide
gaacgccgaggacaaaggagagtgggatggcggaga

SEQ ID NO: 80164 - DNA, 37 bp, Artificial Sequence
  Synthetic oligonucleotide
ttgccacttgctgtcgctcttctcctgacccttgaga

SEQ ID NO: 80165 - DNA, 37 bp, Artificial Sequence
  Synthetic oligonucleotide
aacatctgcagccaccaatccttaagcacgcgaacga

SEQ ID NO: 80166 - DNA, 36 bp, Artificial Sequence
  Synthetic oligonucleotide
taacaccactgcctctactatgatcctgctggacga

SEQ ID NO: 80167 - DNA, 37 bp, Artificial Sequence
  Synthetic oligonucleotide
ttcgaccccgcgcgagtgcgatccctccccctgccga

SEQ ID NO: 80168 - DNA, 37 bp, Artificial Sequence
  Synthetic oligonucleotide
gttagcgcgccgtcgatcctgcactttaccactgcga

SEQ ID NO: 80169 - DNA, 35 bp, Artificial Sequence
  Synthetic oligonucleotide
tgttccccacttgagctctccttaatgacactcga

SEQ ID NO: 80170 - DNA, 37 bp, Artificial Sequence
  Synthetic oligonucleotide
tgtaggcggggcaaggaaaaagtgactggggaaagga

SEQ ID NO: 80171 - DNA, 35 bp, Artificial Sequence
  Synthetic oligonucleotide
gcccttgttccatcgttaatcatgtctgtttagga

SEQ ID NO: 80172 - DNA, 37 bp, Artificial Sequence
  Synthetic oligonucleotide
aaaggggatgcggcgaatgaaaatggtggggaccgga

SEQ ID NO: 80173 - DNA, 37 bp, Artificial Sequence
  Synthetic oligonucleotide
accggtcagagcagcttacgcataccactacttcgga

SEQ ID NO: 80174 - DNA, 36 bp, Artificial Sequence
  Synthetic oligonucleotide
ggaaaacgggccggggggagtagagtacacgaggga

SEQ ID NO: 80175 - DNA, 37 bp, Artificial Sequence
  Synthetic oligonucleotide
gtgtgtgaaggttagagggcggagctggggatgggga

SEQ ID NO: 80176 - DNA, 36 bp, Artificial Sequence
  Synthetic oligonucleotide
tcagctgggcgggttgaactcgttttttggctggga

SEQ ID NO: 80177 - DNA, 37 bp, Artificial Sequence
  Synthetic oligonucleotide
aagtcctggacagagcgaggggatacatcaaactgga

SEQ ID NO: 80178 - DNA, 36 bp, Artificial Sequence
  Synthetic oligonucleotide
gccatcaccctgcacgagcacccttgggaatctgga

SEQ ID NO: 80179 - DNA, 37 bp, Artificial Sequence
  Synthetic oligonucleotide
tcaccatagtgaggcacccccttttcgaacatctgga

SEQ ID NO: 80180 - DNA, 37 bp, Artificial Sequence
  Synthetic oligonucleotide
gtgctgtgggtcgtggaggagtgggaacttacttgga

SEQ ID NO: 80181 - DNA, 36 bp, Artificial Sequence
  Synthetic oligonucleotide
gcgaaagatgcggtgctggggatggggctggttgga

SEQ ID NO: 80182 - DNA, 37 bp, Artificial Sequence
  Synthetic oligonucleotide
gtggacgatggagcgtgataaacacaagtgagaatga

SEQ ID NO: 80183 - DNA, 38 bp, Artificial Sequence
  Synthetic oligonucleotide
tacaacgaatcacgtcgagaaggcactccctctcatga

SEQ ID NO: 80184 - DNA, 37 bp, Artificial Sequence
  Synthetic oligonucleotide
gtgaacgtgggggggttcgtaattagcactttgatga

SEQ ID NO: 80185 - DNA, 38 bp, Artificial Sequence
  Synthetic oligonucleotide
gagcacgagacaggggaagtagaacgcggctggtatga

SEQ ID NO: 80186 - DNA, 38 bp, Artificial Sequence
  Synthetic oligonucleotide
gacatcggccccaccccgcccggacgacgtcgcactga

SEQ ID NO: 80187 - DNA, 38 bp, Artificial Sequence
  Synthetic oligonucleotide
tccgcgggcgccactggtaaaccactctgaatcactga

SEQ ID NO: 80188 - DNA, 37 bp, Artificial Sequence
  Synthetic oligonucleotide
actcaactccctatcgcccgcgtgacgccgttactga

SEQ ID NO: 80189 - DNA, 37 bp, Artificial Sequence
  Synthetic oligonucleotide
agggcccctgcaaccatgactcgatccgaaccgctga

SEQ ID NO: 80190 - DNA, 36 bp, Artificial Sequence
  Synthetic oligonucleotide
ggagagacagctgtgtctccacccgttccttgctga

SEQ ID NO: 80191 - DNA, 38 bp, Artificial Sequence
  Synthetic oligonucleotide
gcgcgagcacggaagactacacccaattccgattctga

SEQ ID NO: 80192 - DNA, 37 bp, Artificial Sequence
  Synthetic oligonucleotide
tcactgcgggctcaggaaaaacacgtcaagacagtga

SEQ ID NO: 80193 - DNA, 38 bp, Artificial Sequence
  Synthetic oligonucleotide
gatgcgagggcaacggagaggggatcggcaattagtga

SEQ ID NO: 80194 - DNA, 38 bp, Artificial Sequence
  Synthetic oligonucleotide
ggagacccccgcccgcagaagactcatgtccaacgtga

SEQ ID NO: 80195 - DNA, 37 bp, Artificial Sequence
  Synthetic oligonucleotide
accatagctgccactttgacatgttctgatcccgtga

SEQ ID NO: 80196 - DNA, 38 bp, Artificial Sequence
  Synthetic oligonucleotide
gccaaggtagtaaaggaggggagcgaacagtatcgtga

SEQ ID NO: 80197 - DNA, 38 bp, Artificial Sequence
  Synthetic oligonucleotide
taagtctggagtgggggatgcggggctaccaagggtga

SEQ ID NO: 80198 - DNA, 38 bp, Artificial Sequence
  Synthetic oligonucleotide
gatcacgcgcggttctctattattccagggtcctgtga

SEQ ID NO: 80199 - DNA, 38 bp, Artificial Sequence
  Synthetic oligonucleotide
tcgaatacagatccagcctccattgttatttcctgtga

SEQ ID NO: 80200 - DNA, 38 bp, Artificial Sequence
  Synthetic oligonucleotide
gctgtcgtaccctgcgtttgaatgcgccaaccaattga

SEQ ID NO: 80201 - DNA, 38 bp, Artificial Sequence
  Synthetic oligonucleotide
gacgggccgaaaggccacctggaagagaacaggattga

SEQ ID NO: 80202 - DNA, 37 bp, Artificial Sequence
  Synthetic oligonucleotide
tgaaccggaaggggtatgtatttttgtatgtgattga

SEQ ID NO: 80203 - DNA, 37 bp, Artificial Sequence
  Synthetic oligonucleotide
tcaaacagcgggcatcaaccttatcctctccacttga

SEQ ID NO: 80204 - DNA, 38 bp, Artificial Sequence
  Synthetic oligonucleotide
gttcagggtcccgacttgccccccatcgtcacccttga

SEQ ID NO: 80205 - DNA, 38 bp, Artificial Sequence
  Synthetic oligonucleotide
tgttggggctggcagtaggtggtggaggcggttgttga

SEQ ID NO: 80206 - DNA, 37 bp, Artificial Sequence
  Synthetic oligonucleotide
tcctcgaccggcggggtgggggggaagttgactttga

SEQ ID NO: 80207 - DNA, 38 bp, Artificial Sequence
  Synthetic oligonucleotide
gtgacaggacccctattggtacgctctatctactttga

SEQ ID NO: 80208 - DNA, 36 bp, Artificial Sequence
  Synthetic oligonucleotide
tccatgcccagccgcccctcactgaattcggtttga

SEQ ID NO: 80209 - DNA, 37 bp, Artificial Sequence
  Synthetic oligonucleotide
ggatcgccaccgcccaaactggtatccgtctttttga

SEQ ID NO: 80210 - DNA, 36 bp, Artificial Sequence
  Synthetic oligonucleotide
gaaacgtcgtgtcccccgtttgtcctgggttctata

SEQ ID NO: 80211 - DNA, 35 bp, Artificial Sequence
  Synthetic oligonucleotide
taccctcctgcgagcacgcgagtatcagttaacta

SEQ ID NO: 80212 - DNA, 35 bp, Artificial Sequence
  Synthetic oligonucleotide
acaggtcaagcgccggttccgctcctgttgctcta

SEQ ID NO: 80213 - DNA, 36 bp, Artificial Sequence
  Synthetic oligonucleotide
gatgccttgatcggtatcactacactattcgccgta

SEQ ID NO: 80214 - DNA, 36 bp, Artificial Sequence
  Synthetic oligonucleotide
tcgtcgacccctatggctctggccttctcctccgta

SEQ ID NO: 80215 - DNA, 36 bp, Artificial Sequence
  Synthetic oligonucleotide
gaccgtcgtagacacgggcacgaataaccaagggta

SEQ ID NO: 80216 - DNA, 35 bp, Artificial Sequence
  Synthetic oligonucleotide
gcaacgcgcgccacatacttttcccgaaccttgta

SEQ ID NO: 80217 - DNA, 36 bp, Artificial Sequence
  Synthetic oligonucleotide
tcgtaccgatctggccccggttccgactacgtatta

SEQ ID NO: 80218 - DNA, 36 bp, Artificial Sequence
  Synthetic oligonucleotide
tccccatggctgacctgcactaattgcgcctcctta

SEQ ID NO: 80219 - DNA, 36 bp, Artificial Sequence
  Synthetic oligonucleotide
ttcaggaagggcacctttggagagggggggtggtta

SEQ ID NO: 80220 - DNA, 35 bp, Artificial Sequence
  Synthetic oligonucleotide
gaacaaccaatccgcgtagaatattaccctgccac

SEQ ID NO: 80221 - DNA, 35 bp, Artificial Sequence
  Synthetic oligonucleotide
atcgtcaaggtgttcgccctatgcatctcgttcac

SEQ ID NO: 80222 - DNA, 35 bp, Artificial Sequence
  Synthetic oligonucleotide
atggaccgctcagctcacatttttatgcttaggcc

SEQ ID NO: 80223 - DNA, 35 bp, Artificial Sequence
  Synthetic oligonucleotide
gtgttgtgtagtgctcccgtacgctaatcccatcc

SEQ ID NO: 80224 - DNA, 35 bp, Artificial Sequence
  Synthetic oligonucleotide
tgaccgacaagctaggctcatatttcggttcatcc

SEQ ID NO: 80225 - DNA, 35 bp, Artificial Sequence
  Synthetic oligonucleotide
gcaccacgaactgctcagccaggccactgtcttcc

SEQ ID NO: 80226 - DNA, 35 bp, Artificial Sequence
  Synthetic oligonucleotide
tccgacagggggggaggcgaattgggtgacctcgc

SEQ ID NO: 80227 - DNA, 35 bp, Artificial Sequence
  Synthetic oligonucleotide
gagtgccacggggggaagtatgacggggtaccggc

SEQ ID NO: 80228 - DNA, 35 bp, Artificial Sequence
  Synthetic oligonucleotide
atggggagggaactggtagtgtaaggccgttgggc

SEQ ID NO: 80229 - DNA, 35 bp, Artificial Sequence
  Synthetic oligonucleotide
atcgtacctgacacttgcatatactggcccctggc

SEQ ID NO: 80230 - DNA, 35 bp, Artificial Sequence
  Synthetic oligonucleotide
gcggtgtccgctccttcgatcttaaacacccttgc

SEQ ID NO: 80231 - DNA, 35 bp, Artificial Sequence
  Synthetic oligonucleotide
tacagtggtcgttaccccacctgtccgttatttgc

SEQ ID NO: 80232 - DNA, 35 bp, Artificial Sequence
  Synthetic oligonucleotide
tactccttgccgaattaggctgagatggagccatc

SEQ ID NO: 80233 - DNA, 35 bp, Artificial Sequence
  Synthetic oligonucleotide
tcgctccaccattccgccagacgctctccagtatc

SEQ ID NO: 80234 - DNA, 35 bp, Artificial Sequence
  Synthetic oligonucleotide
gttgccacaggcgcacctcgggcactattttggtc

SEQ ID NO: 80235 - DNA, 35 bp, Artificial Sequence
  Synthetic oligonucleotide
gccacatcgctcacgcaaatcgcgtatctcaattc

SEQ ID NO: 80236 - DNA, 35 bp, Artificial Sequence
  Synthetic oligonucleotide
tatgacgccacagcacaattaaggacatgcacttc

SEQ ID NO: 80237 - DNA, 35 bp, Artificial Sequence
  Synthetic oligonucleotide
tggatcaagcctcataccgcaccccacgacccgag

SEQ ID NO: 80238 - DNA, 35 bp, Artificial Sequence
  Synthetic oligonucleotide
gccctacacctgcacagacattcggttccaactag

SEQ ID NO: 80239 - DNA, 35 bp, Artificial Sequence
  Synthetic oligonucleotide
tccagtaccccacccgctttgctagtgacagctag

SEQ ID NO: 80240 - DNA, 35 bp, Artificial Sequence
  Synthetic oligonucleotide
tatcacgatccaagcgcttttttttacctctgacg

SEQ ID NO: 80241 - DNA, 35 bp, Artificial Sequence
  Synthetic oligonucleotide
accaaccacgcgcatccacctggcggtcgtccccg

SEQ ID NO: 80242 - DNA, 35 bp, Artificial Sequence
  Synthetic oligonucleotide
ggggaaggtgaaaggggatgggttttgtgtggccg

SEQ ID NO: 80243 - DNA, 35 bp, Artificial Sequence
  Synthetic oligonucleotide
tacccgccatcattgtccatcgtattttcgcggcg

SEQ ID NO: 80244 - DNA, 35 bp, Artificial Sequence
  Synthetic oligonucleotide
actaatcagtgcaagggtgtgctggtggggagagg

SEQ ID NO: 80245 - DNA, 35 bp, Artificial Sequence
  Synthetic oligonucleotide
aatcccgcgatattgcgcttttcctgtcccttagg

SEQ ID NO: 80246 - DNA, 35 bp, Artificial Sequence
  Synthetic oligonucleotide
gcctgccgagcgtgcacaccacccctctgaaccgg

SEQ ID NO: 80247 - DNA, 35 bp, Artificial Sequence
  Synthetic oligonucleotide
ttcacgacgtggttagtttttatttcgattctctg

SEQ ID NO: 80248 - DNA, 35 bp, Artificial Sequence
  Synthetic oligonucleotide
acccctgcccgcatgatgcactgttgtgttgcttg

SEQ ID NO: 80249 - DNA, 35 bp, Artificial Sequence
  Synthetic oligonucleotide
tctaacctgtcctcagaacggcgttaagacgtttg

SEQ ID NO: 80250 - DNA, 35 bp, Artificial Sequence
  Synthetic oligonucleotide
aactcgacctgatggcagaaggttttcatgttttg

SEQ ID NO: 80251 - DNA, 35 bp, Artificial Sequence
  Synthetic oligonucleotide
gcacgacaactccttgtatgtccgttcgacctaat

SEQ ID NO: 80252 - DNA, 35 bp, Artificial Sequence
  Synthetic oligonucleotide
tcaatcccgcctgttccggcttaccgataacacat

SEQ ID NO: 80253 - DNA, 35 bp, Artificial Sequence
  Synthetic oligonucleotide
tgatgggtagtatgtgccgcctctgtttccgtcat

SEQ ID NO: 80254 - DNA, 35 bp, Artificial Sequence
  Synthetic oligonucleotide
gttccaccgacccgcctgacctcacttatcgagat

SEQ ID NO: 80255 - DNA, 35 bp, Artificial Sequence
  Synthetic oligonucleotide
gattagaccagagctaatgctggttcacatactat

SEQ ID NO: 80256 - DNA, 35 bp, Artificial Sequence
  Synthetic oligonucleotide
tcaacacgctggatggttcgtttttttcgtcctat

SEQ ID NO: 80257 - DNA, 35 bp, Artificial Sequence
  Synthetic oligonucleotide
ttggaatacgcgagaggaaaggaagtgggaggtat

SEQ ID NO: 80258 - DNA, 35 bp, Artificial Sequence
  Synthetic oligonucleotide
gctcagccccttgagattacgcgcctcgaaattat

SEQ ID NO: 80259 - DNA, 35 bp, Artificial Sequence
  Synthetic oligonucleotide
tgggggagggagggacgggtggaggtcctgtaact

SEQ ID NO: 80260 - DNA, 35 bp, Artificial Sequence
  Synthetic oligonucleotide
gcgctcactcctggttgctaacaggttcgattcct

SEQ ID NO: 80261 - DNA, 35 bp, Artificial Sequence
  Synthetic oligonucleotide
tagcctttccagcgtagtacccgatatccctcgct

SEQ ID NO: 80262 - DNA, 35 bp, Artificial Sequence
  Synthetic oligonucleotide
gatgcgaggtacgggggcggattgacgggcgatct

SEQ ID NO: 80263 - DNA, 36 bp, Artificial Sequence
  Synthetic oligonucleotide
taccgcgaacggaggccccctggaagctacttaggt

SEQ ID NO: 80264 - DNA, 35 bp, Artificial Sequence
  Synthetic oligonucleotide
gtgggtcgccgtatcgttttacttctctctcttgt

SEQ ID NO: 80265 - DNA, 35 bp, Artificial Sequence
  Synthetic oligonucleotide
attgaaagccagggtacaggtgttggggtggttgt

SEQ ID NO: 80266 - DNA, 35 bp, Artificial Sequence
  Synthetic oligonucleotide
tactacgcgggtaagcagtaggagggtctctcgtt

SEQ ID NO: 80267 - DNA, 36 bp, Artificial Sequence
  Synthetic oligonucleotide
actcagtcacgcgccctctccgtttagcctagtgtt

SEQ ID NO: 80268 - DNA, 35 bp, Artificial Sequence
  Synthetic oligonucleotide
gagcgctcaagtgcacggcataccttctccaattt

SEQ ID NO: 80269 - DNA, 35 bp, Artificial Sequence
  Synthetic oligonucleotide
acttgcgcccattaacatgccggtatcacactttt

SEQ ID NO: 80270 - DNA, 35 bp, Artificial Sequence
  Synthetic oligonucleotide
ttcacactcctcatgtttaatcgcttttggacaaa

SEQ ID NO: 80271 - DNA, 36 bp, Artificial Sequence
  Synthetic oligonucleotide
gtgggagaggaaaaggatattggtagcgggccgaaa

SEQ ID NO: 80272 - DNA, 36 bp, Artificial Sequence
  Synthetic oligonucleotide
gtggccaatgcaccttgtcgattgaaactccctcaa

SEQ ID NO: 80273 - DNA, 35 bp, Artificial Sequence
  Synthetic oligonucleotide
tcacaccattcacttcagaccgttccaagcgagaa

SEQ ID NO: 80274 - DNA, 36 bp, Artificial Sequence
  Synthetic oligonucleotide
gggaaaccaaagggagtgaaatgggcagccaactaa

SEQ ID NO: 80275 - DNA, 36 bp, Artificial Sequence
  Synthetic oligonucleotide
aagcggagcgcggggcggagggtgatcgccgagtaa

SEQ ID NO: 80276 - DNA, 35 bp, Artificial Sequence
  Synthetic oligonucleotide
tacctgccttcaagacgagccaacccgccgcttaa

SEQ ID NO: 80277 - DNA, 35 bp, Artificial Sequence
  Synthetic oligonucleotide
aacgaatgcagctgcgcctcctccactacacacca

SEQ ID NO: 80278 - DNA, 35 bp, Artificial Sequence
  Synthetic oligonucleotide
atgggaagccaagacggctaggacggcacagacca

SEQ ID NO: 80279 - DNA, 36 bp, Artificial Sequence
  Synthetic oligonucleotide
atcgacgacgacagctcgcgctcccctcctctgcca

SEQ ID NO: 80280 - DNA, 36 bp, Artificial Sequence
  Synthetic oligonucleotide
aatcagacgctcaccctgcactccctccaggtgcca

SEQ ID NO: 80281 - DNA, 36 bp, Artificial Sequence
  Synthetic oligonucleotide
atgtccggacagtcgcgtctttgaacgtttcttcca

SEQ ID NO: 80282 - DNA, 36 bp, Artificial Sequence
  Synthetic oligonucleotide
ttcgccttaccgcattattcatcgttgacacaagca

SEQ ID NO: 80283 - DNA, 36 bp, Artificial Sequence
  Synthetic oligonucleotide
gaactgaacctgcaccgccacgacttctgaggagca

SEQ ID NO: 80284 - DNA, 35 bp, Artificial Sequence
  Synthetic oligonucleotide
tgaacatgcttaccgccccgcggcaccccgacgca

SEQ ID NO: 80285 - DNA, 36 bp, Artificial Sequence
  Synthetic oligonucleotide
tcaccaccaccgcgaaacttgcctcatcgtcccgca

SEQ ID NO: 80286 - DNA, 36 bp, Artificial Sequence
  Synthetic oligonucleotide
gcatcctccatgcatggggcgctatgcctgtaatca

SEQ ID NO: 80287 - DNA, 36 bp, Artificial Sequence
  Synthetic oligonucleotide
tcctggacggtgcgggaggaggggtaattaaaaaga

SEQ ID NO: 80288 - DNA, 37 bp, Artificial Sequence
  Synthetic oligonucleotide
tcccccccttccttgcgcttcggtaatcgacgcgaga

SEQ ID NO: 80289 - DNA, 37 bp, Artificial Sequence
  Synthetic oligonucleotide
tcgaccggtaggaagaccacatcccctttgccataga

SEQ ID NO: 80290 - DNA, 37 bp, Artificial Sequence
  Synthetic oligonucleotide
tcaatgcgcgaaatacatccatcatgtcgagggacga

SEQ ID NO: 80291 - DNA, 36 bp, Artificial Sequence
  Synthetic oligonucleotide
ttcgaatccttccgctatgtaaacacagcacaccga

SEQ ID NO: 80292 - DNA, 37 bp, Artificial Sequence
  Synthetic oligonucleotide
acttcatcgagctgatctccgtttcactacaccccga

SEQ ID NO: 80293 - DNA, 37 bp, Artificial Sequence
  Synthetic oligonucleotide
gacccccagtggtattccctcctgcaaatggtgccga

SEQ ID NO: 80294 - DNA, 35 bp, Artificial Sequence
  Synthetic oligonucleotide
tgcttcccacacaggccgacgaccacctgaagcga

SEQ ID NO: 80295 - DNA, 37 bp, Artificial Sequence
  Synthetic oligonucleotide
atccccgccattaactctcttcgctttactttagcga

SEQ ID NO: 80296 - DNA, 37 bp, Artificial Sequence
  Synthetic oligonucleotide
tctgtcctgaaggcaaacgaacccacaccactcgcga

SEQ ID NO: 80297 - DNA, 36 bp, Artificial Sequence
  Synthetic oligonucleotide
gctgaagggggatagatattctgagtaaccgggcga

SEQ ID NO: 80298 - DNA, 37 bp, Artificial Sequence
  Synthetic oligonucleotide
gcacatacgactatggctaactataaccctgcctcga

SEQ ID NO: 80299 - DNA, 37 bp, Artificial Sequence
  Synthetic oligonucleotide
gcgacggcaccggagcctgcacccaccgactcgagga

SEQ ID NO: 80300 - DNA, 37 bp, Artificial Sequence
  Synthetic oligonucleotide
ggagagggaggccgggcaagcgcgtaagtctggagga

SEQ ID NO: 80301 - DNA, 37 bp, Artificial Sequence
  Synthetic oligonucleotide
tcagactcctcgatgctattccactattttcaccgga

SEQ ID NO: 80302 - DNA, 37 bp, Artificial Sequence
  Synthetic oligonucleotide
tgacgatccaacatcaaaaacatccgagccccccgga

SEQ ID NO: 80303 - DNA, 37 bp, Artificial Sequence
  Synthetic oligonucleotide
atccgagaccaactgtatctgccttctccctgccgga

SEQ ID NO: 80304 - DNA, 37 bp, Artificial Sequence
  Synthetic oligonucleotide
gtgttcaactcctattgctcggccaggacgcttcgga

SEQ ID NO: 80305 - DNA, 36 bp, Artificial Sequence
  Synthetic oligonucleotide
ttcaccggacacctcggtgcctcccaatccaaggga

SEQ ID NO: 80306 - DNA, 37 bp, Artificial Sequence
  Synthetic oligonucleotide
gacgagggggagaaattgtcttatagtggtgaaggga

SEQ ID NO: 80307 - DNA, 36 bp, Artificial Sequence
  Synthetic oligonucleotide
acaaaacacgaaggggacacgggagggtactcggga

SEQ ID NO: 80308 - DNA, 37 bp, Artificial Sequence
  Synthetic oligonucleotide
ggtgggtgagtagagtgagagtcagcgagggagggga

SEQ ID NO: 80309 - DNA, 37 bp, Artificial Sequence
  Synthetic oligonucleotide
gagtcacagtagtgggagtaaatggggtgaccgggga

SEQ ID NO: 80310 - DNA, 37 bp, Artificial Sequence
  Synthetic oligonucleotide
gttggcatgtgcgtgggcaatgggctgggtgggggga

SEQ ID NO: 80311 - DNA, 37 bp, Artificial Sequence
  Synthetic oligonucleotide
tagcgcatagtcgggtgagggctggaactgggtggga

SEQ ID NO: 80312 - DNA, 37 bp, Artificial Sequence
  Synthetic oligonucleotide
ggtcgggggccacggtaatatgcggtcacggtatgga

SEQ ID NO: 80313 - DNA, 37 bp, Artificial Sequence
  Synthetic oligonucleotide
atacctcctggcgctccacgtgctcgtaacttctgga

SEQ ID NO: 80314 - DNA, 37 bp, Artificial Sequence
  Synthetic oligonucleotide
gatcgcaagagcactacgccacctcacaatcattgga

SEQ ID NO: 80315 - DNA, 37 bp, Artificial Sequence
  Synthetic oligonucleotide
ccagtcgaaacctcgcgaatctacctgccaaacatga

SEQ ID NO: 80316 - DNA, 38 bp, Artificial Sequence
  Synthetic oligonucleotide
gcctacccccatcctgatgtgaacgcctactaccatga

SEQ ID NO: 80317 - DNA, 37 bp, Artificial Sequence
  Synthetic oligonucleotide
gtgtgcggtcggggatgaggtggtgatttaaggatga

SEQ ID NO: 80318 - DNA, 37 bp, Artificial Sequence
  Synthetic oligonucleotide
tgcccgcctaggtaccactgctcccctattaggatga

SEQ ID NO: 80319 - DNA, 37 bp, Artificial Sequence
  Synthetic oligonucleotide
tcactgcaaaatggaacatggtaagtggaggggatga

SEQ ID NO: 80320 - DNA, 37 bp, Artificial Sequence
  Synthetic oligonucleotide
acacaactcgttgtgtaaccctgtggtccctatatga

SEQ ID NO: 80321 - DNA, 36 bp, Artificial Sequence
  Synthetic oligonucleotide
aaggggcggaggggcatagggaagttttattactga

SEQ ID NO: 80322 - DNA, 38 bp, Artificial Sequence
  Synthetic oligonucleotide
acgctgactccgaactcttatcatggatctgtgcctga

SEQ ID NO: 80323 - DNA, 36 bp, Artificial Sequence
  Synthetic oligonucleotide
gaccgtccacttatcttcagggcacgttcctcctga

SEQ ID NO: 80324 - DNA, 36 bp, Artificial Sequence
  Synthetic oligonucleotide
gcccgggccatacttggacttatatacatctcctga

SEQ ID NO: 80325 - DNA, 36 bp, Artificial Sequence
  Synthetic oligonucleotide
gcccattgctcgttcgttgtaacggggttctcctga

SEQ ID NO: 80326 - DNA, 38 bp, Artificial Sequence
  Synthetic oligonucleotide
gactgtccgcctcaagttcctatcaagttttacgctga

SEQ ID NO: 80327 - DNA, 37 bp, Artificial Sequence
  Synthetic oligonucleotide
gcgggggtagtgacgtgggtggggctttctgggctga

SEQ ID NO: 80328 - DNA, 38 bp, Artificial Sequence
  Synthetic oligonucleotide
gttgctggccaccaaatctcgttacagtagagctctga

SEQ ID NO: 80329 - DNA, 38 bp, Artificial Sequence
  Synthetic oligonucleotide
ggacggcgttcagttctcgtttggttttcactctctga

SEQ ID NO: 80330 - DNA, 38 bp, Artificial Sequence
  Synthetic oligonucleotide
gatggctcagacgttccacctcggccatttatgtctga

SEQ ID NO: 80331 - DNA, 36 bp, Artificial Sequence
  Synthetic oligonucleotide
actccacacattcatgtccagaatctaagattctga

SEQ ID NO: 80332 - DNA, 38 bp, Artificial Sequence
  Synthetic oligonucleotide
agcgggagaaaacggggttgagggaccggggggcgtga

SEQ ID NO: 80333 - DNA, 37 bp, Artificial Sequence
  Synthetic oligonucleotide
gaggatgggcagggcgcgggggtctcgaatagggtga

SEQ ID NO: 80334 - DNA, 38 bp, Artificial Sequence
  Synthetic oligonucleotide
gctggagtgaactggggcgacagagaggggtcgggtga

SEQ ID NO: 80335 - DNA, 38 bp, Artificial Sequence
  Synthetic oligonucleotide
tgcaagcccatccctacacatccactgtttcattgtga

SEQ ID NO: 80336 - DNA, 38 bp, Artificial Sequence
  Synthetic oligonucleotide
tggaaaaggtgggataggtgtgagtggtgtagtattga

SEQ ID NO: 80337 - DNA, 38 bp, Artificial Sequence
  Synthetic oligonucleotide
gcaacttgcccacaccgtctcacccactcatttattga

SEQ ID NO: 80338 - DNA, 38 bp, Artificial Sequence
  Synthetic oligonucleotide
gacgcaagtggtagtagcaggcatcaaggacgacttga

SEQ ID NO: 80339 - DNA, 38 bp, Artificial Sequence
  Synthetic oligonucleotide
gccaggacagctctcggcaactgatatacgccccttga

SEQ ID NO: 80340 - DNA, 38 bp, Artificial Sequence
  Synthetic oligonucleotide
agtaggcctcatcagctagtgcacgccctttcccttga

SEQ ID NO: 80341 - DNA, 36 bp, Artificial Sequence
  Synthetic oligonucleotide
tgaacaggtcggagccgaagatgatgcgaatgttga

SEQ ID NO: 80342 - DNA, 38 bp, Artificial Sequence
  Synthetic oligonucleotide
ttgccccctcgcttacattgctaacaccatctatttga

SEQ ID NO: 80343 - DNA, 37 bp, Artificial Sequence
  Synthetic oligonucleotide
acacacaccggtctaggaatctgacgacctgttttga

SEQ ID NO: 80344 - DNA, 38 bp, Artificial Sequence
  Synthetic oligonucleotide
tacaaatcaggtggtgtggtggggtggctggtttttga

SEQ ID NO: 80345 - DNA, 36 bp, Artificial Sequence
  Synthetic oligonucleotide
gcacaccatcgtagccacatatgagtgccctacata

SEQ ID NO: 80346 - DNA, 36 bp, Artificial Sequence
  Synthetic oligonucleotide
tgactaccagccattgcgttttatcatccatccata

SEQ ID NO: 80347 - DNA, 36 bp, Artificial Sequence
  Synthetic oligonucleotide
acgaatggtagtactggaggaatgtgaggggggata

SEQ ID NO: 80348 - DNA, 36 bp, Artificial Sequence
  Synthetic oligonucleotide
tatggccacccactaccgagcctcgcaaagtaccta

SEQ ID NO: 80349 - DNA, 36 bp, Artificial Sequence
  Synthetic oligonucleotide
gcctggcaccgcgcttcggtactactcgcctggcta

SEQ ID NO: 80350 - DNA, 36 bp, Artificial Sequence
  Synthetic oligonucleotide
gagcatcttgcatgcttcctcttgacgttacctcta

SEQ ID NO: 80351 - DNA, 36 bp, Artificial Sequence
  Synthetic oligonucleotide
tgttggataggtaatgtaggggaaagggaagaggta

SEQ ID NO: 80352 - DNA, 36 bp, Artificial Sequence
  Synthetic oligonucleotide
gctcacatacgcgcacgactaggcaccatcaactta

SEQ ID NO: 80353 - DNA, 36 bp, Artificial Sequence
  Synthetic oligonucleotide
atcgcgcgaggttggggggctattaggggagactta

SEQ ID NO: 80354 - DNA, 36 bp, Artificial Sequence
  Synthetic oligonucleotide
gagacgtccgccgagtagctgtcatttcgcaattta

SEQ ID NO: 80355 - DNA, 36 bp, Artificial Sequence
  Synthetic oligonucleotide
acaagcgcacccaactgtgtcgttggcctttcttta

SEQ ID NO: 80356 - DNA, 36 bp, Artificial Sequence
  Synthetic oligonucleotide
gtcatcctaccgcatgatatactttctgtattttta

SEQ ID NO: 80357 - DNA, 35 bp, Artificial Sequence
  Synthetic oligonucleotide
gtgcactcgaacagccgccccgacccgccttttta

SEQ ID NO: 80358 - DNA, 35 bp, Artificial Sequence
  Synthetic oligonucleotide
agacaccacaattcccgttcgaagccggtgtacac

SEQ ID NO: 80359 - DNA, 35 bp, Artificial Sequence
  Synthetic oligonucleotide
gcacctgccgctctggacctctgtttcctgctgac

SEQ ID NO: 80360 - DNA, 35 bp, Artificial Sequence
  Synthetic oligonucleotide
acactgcgcaatacaaattccgacatcatggttac

SEQ ID NO: 80361 - DNA, 35 bp, Artificial Sequence
  Synthetic oligonucleotide
acgtggactatcagtcttgatcacacgctatcccc

SEQ ID NO: 80362 - DNA, 35 bp, Artificial Sequence
  Synthetic oligonucleotide
atcgttcagtggctccgttactacccactggtccc

SEQ ID NO: 80363 - DNA, 35 bp, Artificial Sequence
  Synthetic oligonucleotide
ggattctgtcgccgcccaatttaactcactgtccc

SEQ ID NO: 80364 - DNA, 35 bp, Artificial Sequence
  Synthetic oligonucleotide
acacatggaaatgcgtcactcggtaaaaccttccc

SEQ ID NO: 80365 - DNA, 35 bp, Artificial Sequence
  Synthetic oligonucleotide
taacatcacagctatgaaattacacttgccccgcc

SEQ ID NO: 80366 - DNA, 35 bp, Artificial Sequence
  Synthetic oligonucleotide
gaccccgacatgtcatcattatgatacgacctgcc

SEQ ID NO: 80367 - DNA, 35 bp, Artificial Sequence
  Synthetic oligonucleotide
agacgcatgcagtgcctccgctgtctggcttctcc

SEQ ID NO: 80368 - DNA, 35 bp, Artificial Sequence
  Synthetic oligonucleotide
ttacagccaggccacattcgagccggcgctattcc

SEQ ID NO: 80369 - DNA, 35 bp, Artificial Sequence
  Synthetic oligonucleotide
tcccgctacgcctcctactcccgggactgcacggc

SEQ ID NO: 80370 - DNA, 36 bp, Artificial Sequence
  Synthetic oligonucleotide
ttggctgcacatcagcgtaagctcccccggtttctc

SEQ ID NO: 80371 - DNA, 35 bp, Artificial Sequence
  Synthetic oligonucleotide
gttacgtgggaggggaagaaatacaaagctgtgtc

SEQ ID NO: 80372 - DNA, 35 bp, Artificial Sequence
  Synthetic oligonucleotide
actctgcaccaatatccgggtgagggatgtccttc

SEQ ID NO: 80373 - DNA, 35 bp, Artificial Sequence
  Synthetic oligonucleotide
agtgactgcccagctttaccgtctcacgttggttc

SEQ ID NO: 80374 - DNA, 35 bp, Artificial Sequence
  Synthetic oligonucleotide
ttaccccccgcccactgggtcattacacctctttc

SEQ ID NO: 80375 - DNA, 35 bp, Artificial Sequence
  Synthetic oligonucleotide
gaacagcatggaggccggaaaaaactgtttactag

SEQ ID NO: 80376 - DNA, 35 bp, Artificial Sequence
  Synthetic oligonucleotide
taggactgcatttacggcccctttacactctaccg

SEQ ID NO: 80377 - DNA, 35 bp, Artificial Sequence
  Synthetic oligonucleotide
agatgggtaggcggggccggaagcgggtggaggcg

SEQ ID NO: 80378 - DNA, 35 bp, Artificial Sequence
  Synthetic oligonucleotide
tgaccatccagcccgccccttacacttgaactgcg

SEQ ID NO: 80379 - DNA, 35 bp, Artificial Sequence
  Synthetic oligonucleotide
tgatagaacaggaggtcttggtaatgggcgtaagg

SEQ ID NO: 80380 - DNA, 35 bp, Artificial Sequence
  Synthetic oligonucleotide
aactaacccggcccttcctctgtactctcgcaggg

SEQ ID NO: 80381 - DNA, 35 bp, Artificial Sequence
  Synthetic oligonucleotide
acatgggggatgagggatgaagatatgaggggggg

SEQ ID NO: 80382 - DNA, 35 bp, Artificial Sequence
  Synthetic oligonucleotide
gcaagggggcggggaagggtttaaggtgcgtggtg

SEQ ID NO: 80383 - DNA, 35 bp, Artificial Sequence
  Synthetic oligonucleotide
tcctgccttgaccagctgtcgtaacccttggtaat

SEQ ID NO: 80384 - DNA, 35 bp, Artificial Sequence
  Synthetic oligonucleotide
accactttgcctctcggtggtttatggtctcttat

SEQ ID NO: 80385 - DNA, 35 bp, Artificial Sequence
  Synthetic oligonucleotide
tttagggccccccacacgcgccaaggtactgcact

SEQ ID NO: 80386 - DNA, 35 bp, Artificial Sequence
  Synthetic oligonucleotide
tttggcccagctctacaacttttcgtcacgaacct

SEQ ID NO: 80387 - DNA, 35 bp, Artificial Sequence
  Synthetic oligonucleotide
tgactgaccttcccctgcaattagcgccagtacct

SEQ ID NO: 80388 - DNA, 35 bp, Artificial Sequence
  Synthetic oligonucleotide
ggtggaggtaacggtggtgaaaacggtgatcgagt

SEQ ID NO: 80389 - DNA, 35 bp, Artificial Sequence
  Synthetic oligonucleotide
agtaggacaagtggggcgatggtacaggcgttggt

SEQ ID NO: 80390 - DNA, 35 bp, Artificial Sequence
  Synthetic oligonucleotide
gacaccctcctgcattttcacatacgtggtttctt

SEQ ID NO: 80391 - DNA, 35 bp, Artificial Sequence
  Synthetic oligonucleotide
acacaactcgaaatatgttatctcaaacccgagtt

SEQ ID NO: 80392 - DNA, 35 bp, Artificial Sequence
  Synthetic oligonucleotide
acctcgacacggcatatatgctatccgtgttagtt

SEQ ID NO: 80393 - DNA, 35 bp, Artificial Sequence
  Synthetic oligonucleotide
actgcgcaaccaaaacatacgctgggaggggattt

SEQ ID NO: 80394 - DNA, 36 bp, Artificial Sequence
  Synthetic oligonucleotide
gaatccactcctgcgcaggagctgtcccctgcccaa

SEQ ID NO: 80395 - DNA, 36 bp, Artificial Sequence
  Synthetic oligonucleotide
gcacatggccacgaggcaacacgattacccagccaa

SEQ ID NO: 80396 - DNA, 35 bp, Artificial Sequence
  Synthetic oligonucleotide
gaacacattcgcaatgtgcactggatataacgcaa

SEQ ID NO: 80397 - DNA, 37 bp, Artificial Sequence
  Synthetic oligonucleotide
gttgcgccatccctttggaggacctggttccccgcaa

SEQ ID NO: 80398 - DNA, 36 bp, Artificial Sequence
  Synthetic oligonucleotide
gcaacccaggaatcacatcgacgagaagagtgagaa

SEQ ID NO: 80399 - DNA, 35 bp, Artificial Sequence
  Synthetic oligonucleotide
gagcaacagtgcaagcaatgcacaaaacaaaggaa

SEQ ID NO: 80400 - DNA, 36 bp, Artificial Sequence
  Synthetic oligonucleotide
ttggcccctgttctgttctcgttttcaaagcctgaa

SEQ ID NO: 80401 - DNA, 36 bp, Artificial Sequence
  Synthetic oligonucleotide
atactccgtgccccgcccatcacagtcacatctgaa

SEQ ID NO: 80402 - DNA, 36 bp, Artificial Sequence
  Synthetic oligonucleotide
ttactcacggccacagactgtaattcatggtaataa

SEQ ID NO: 80403 - DNA, 35 bp, Artificial Sequence
  Synthetic oligonucleotide
gctggcacccatgtccagctctcaaaattccataa

SEQ ID NO: 80404 - DNA, 36 bp, Artificial Sequence
  Synthetic oligonucleotide
gtgcccgtatagaacgattacacacgcacataaaca

SEQ ID NO: 80405 - DNA, 36 bp, Artificial Sequence
  Synthetic oligonucleotide
tccgcaaagcactcgctggaacattgccttcgaaca

SEQ ID NO: 80406 - DNA, 36 bp, Artificial Sequence
  Synthetic oligonucleotide
tcgccacgattagccggccctccaaagtctcgccca

SEQ ID NO: 80407 - DNA, 36 bp, Artificial Sequence
  Synthetic oligonucleotide
ggtccaccccacgacgccaaacttttgaggagagca

SEQ ID NO: 80408 - DNA, 32 bp, Artificial Sequence
  Synthetic oligonucleotide
acgacttgcccttgtaaacctcgcacttagca

SEQ ID NO: 80409 - DNA, 36 bp, Artificial Sequence
  Synthetic oligonucleotide
gctgctttcctgtacaggccctaccatgttctcgca

SEQ ID NO: 80410 - DNA, 37 bp, Artificial Sequence
  Synthetic oligonucleotide
aacccaccacaaacccgccgccccaggagtgtaatca

SEQ ID NO: 80411 - DNA, 36 bp, Artificial Sequence
  Synthetic oligonucleotide
tatgagaggtagtgggtcaggaatgtgcgggggtca

SEQ ID NO: 80412 - DNA, 36 bp, Artificial Sequence
  Synthetic oligonucleotide
acaacgcgggcctactctgagctatctactctgtca

SEQ ID NO: 80413 - DNA, 36 bp, Artificial Sequence
  Synthetic oligonucleotide
aacgcctactcgtgttatataacactatccctttca

SEQ ID NO: 80414 - DNA, 37 bp, Artificial Sequence
  Synthetic oligonucleotide
gcgagggggggttatgatggactgctgatgggtaaga

SEQ ID NO: 80415 - DNA, 37 bp, Artificial Sequence
  Synthetic oligonucleotide
gacaaactgggacagataatgagactgaggtctcaga

SEQ ID NO: 80416 - DNA, 36 bp, Artificial Sequence
  Synthetic oligonucleotide
gactggggggggggataagagtgaagttctgggaga

SEQ ID NO: 80417 - DNA, 37 bp, Artificial Sequence
  Synthetic oligonucleotide
ggagaaccggcgaagtgatgaaggatgtaagaataga

SEQ ID NO: 80418 - DNA, 37 bp, Artificial Sequence
  Synthetic oligonucleotide
gattgccccgcctcccgtggttcaaccctatgataga

SEQ ID NO: 80419 - DNA, 37 bp, Artificial Sequence
  Synthetic oligonucleotide
ctgttacaccgctacgtggaggttctcggtttttaga

SEQ ID NO: 80420 - DNA, 37 bp, Artificial Sequence
  Synthetic oligonucleotide
tcaggacagccgagatctctcatcaagcgccttacga

SEQ ID NO: 80421 - DNA, 37 bp, Artificial Sequence
  Synthetic oligonucleotide
ggacaaagttcacacctctcatccttatacgtgccga

SEQ ID NO: 80422 - DNA, 37 bp, Artificial Sequence
  Synthetic oligonucleotide
accgagtcatccatttggccccgagcccgccctccga

SEQ ID NO: 80423 - DNA, 37 bp, Artificial Sequence
  Synthetic oligonucleotide
gatgcatgagcgagtacgggggacagatgcacggcga

SEQ ID NO: 80424 - DNA, 37 bp, Artificial Sequence
  Synthetic oligonucleotide
ggaacaagtgggggctgggagaagttgaatcgggcga

SEQ ID NO: 80425 - DNA, 37 bp, Artificial Sequence
  Synthetic oligonucleotide
tccgacgccttcctgcttttttaccgttttgactcga

SEQ ID NO: 80426 - DNA, 35 bp, Artificial Sequence
  Synthetic oligonucleotide
gcgcaccttatacacagctgtctttcgtttctcga

SEQ ID NO: 80427 - DNA, 37 bp, Artificial Sequence
  Synthetic oligonucleotide
atcgacacgcaagtgtcacaccaggccgtgttaagga

SEQ ID NO: 80428 - DNA, 35 bp, Artificial Sequence
  Synthetic oligonucleotide
gaattacgtgggaggggaactcagtaacaatagga

SEQ ID NO: 80429 - DNA, 37 bp, Artificial Sequence
  Synthetic oligonucleotide
gacatcccggtgtaaatctcctccgttccttctagga

SEQ ID NO: 80430 - DNA, 37 bp, Artificial Sequence
  Synthetic oligonucleotide
gcgatccctcgtccacctatgcgatttttgttacgga

SEQ ID NO: 80431 - DNA, 36 bp, Artificial Sequence
  Synthetic oligonucleotide
ggacataatggaagagggagagtagatcggagcgga

SEQ ID NO: 80432 - DNA, 37 bp, Artificial Sequence
  Synthetic oligonucleotide
tagagaagggaaggagatctaggttagaggacgcgga

SEQ ID NO: 80433 - DNA, 37 bp, Artificial Sequence
  Synthetic oligonucleotide
gcatggcggggtgggaatcggatatagactatgggga

SEQ ID NO: 80434 - DNA, 37 bp, Artificial Sequence
  Synthetic oligonucleotide
acacgggcacctgacgttccgcaccagcacgctggga

SEQ ID NO: 80435 - DNA, 35 bp, Artificial Sequence
  Synthetic oligonucleotide
tacggtcaggaccacccctacgtttgatacttgga

SEQ ID NO: 80436 - DNA, 38 bp, Artificial Sequence
  Synthetic oligonucleotide
taaggtgggatatcgggtgagaggccagcgggaaatga

SEQ ID NO: 80437 - DNA, 38 bp, Artificial Sequence
  Synthetic oligonucleotide
gtcccagatgggtccacacctgccttacccgaacatga

SEQ ID NO: 80438 - DNA, 38 bp, Artificial Sequence
  Synthetic oligonucleotide
gccaaccatcccaataccagtcttcatgcgatacatga

SEQ ID NO: 80439 - DNA, 36 bp, Artificial Sequence
  Synthetic oligonucleotide
tactgtgctgtcacgcaaccttcctaaccgccatga

SEQ ID NO: 80440 - DNA, 38 bp, Artificial Sequence
  Synthetic oligonucleotide
agccaagggaaagagcgcaagcgaggcgatggggatga

SEQ ID NO: 80441 - DNA, 38 bp, Artificial Sequence
  Synthetic oligonucleotide
gcatgccacccgccattgtccggtcaacactgtgatga

SEQ ID NO: 80442 - DNA, 37 bp, Artificial Sequence
  Synthetic oligonucleotide
atgccagggataacttgttcgggtagggtggaactga

SEQ ID NO: 80443 - DNA, 37 bp, Artificial Sequence
  Synthetic oligonucleotide
tcactcgtcaccgagcgtcttgccctctcgtcactga

SEQ ID NO: 80444 - DNA, 38 bp, Artificial Sequence
  Synthetic oligonucleotide
tgtacgctgctgtacttactatggcttaactcacctga

SEQ ID NO: 80445 - DNA, 38 bp, Artificial Sequence
  Synthetic oligonucleotide
gcaatggctgcctcttgcgttttattgcttctccctga

SEQ ID NO: 80446 - DNA, 38 bp, Artificial Sequence
  Synthetic oligonucleotide
taagcgccagttatcgcacatccttaccaccttgctga

SEQ ID NO: 80447 - DNA, 37 bp, Artificial Sequence
  Synthetic oligonucleotide
actggaacggggacggcgggaatctgagcgatagtga

SEQ ID NO: 80448 - DNA, 38 bp, Artificial Sequence
  Synthetic oligonucleotide
acacgcacgctcgacccgtacccggcctgtaaacgtga

SEQ ID NO: 80449 - DNA, 38 bp, Artificial Sequence
  Synthetic oligonucleotide
tgcgggggggtgcgaagatgatgcaggggcgatcgtga

SEQ ID NO: 80450 - DNA, 37 bp, Artificial Sequence
  Synthetic oligonucleotide
agtgacaggggtaagcgattggtgaggagtatggtga

SEQ ID NO: 80451 - DNA, 37 bp, Artificial Sequence
  Synthetic oligonucleotide
tcaagtcactggcaagtagagaatggtagggtggtga

SEQ ID NO: 80452 - DNA, 38 bp, Artificial Sequence
  Synthetic oligonucleotide
ataacacgctgacgtactagtacctcccacataattga

SEQ ID NO: 80453 - DNA, 38 bp, Artificial Sequence
  Synthetic oligonucleotide
tccccctgcacacagcctcactgtcctcttgccgttga

SEQ ID NO: 80454 - DNA, 38 bp, Artificial Sequence
  Synthetic oligonucleotide
tgccggcgagggactacgggattaggggagggggttga

SEQ ID NO: 80455 - DNA, 37 bp, Artificial Sequence
  Synthetic oligonucleotide
accacgcagttgctacactcggccgtcccttgtttga

SEQ ID NO: 80456 - DNA, 35 bp, Artificial Sequence
  Synthetic oligonucleotide
atgtcggaaagagggtagcagggcgaagacgaata

SEQ ID NO: 80457 - DNA, 36 bp, Artificial Sequence
  Synthetic oligonucleotide
gccccacccgcttctaatcgtgacgcggtacccata

SEQ ID NO: 80458 - DNA, 36 bp, Artificial Sequence
  Synthetic oligonucleotide
cacgggtcgtctctttcatagcccggattagcacta

SEQ ID NO: 80459 - DNA, 35 bp, Artificial Sequence
  Synthetic oligonucleotide
acgaggacctctcgcctccatttggactaattcta

SEQ ID NO: 80460 - DNA, 36 bp, Artificial Sequence
  Synthetic oligonucleotide
aaatgcgtgcagcagaccacaggggccacatttcta

SEQ ID NO: 80461 - DNA, 36 bp, Artificial Sequence
  Synthetic oligonucleotide
atacgccgacggggaaagtagtgttgtcgagtagta

SEQ ID NO: 80462 - DNA, 36 bp, Artificial Sequence
  Synthetic oligonucleotide
agcgcctccctgtcttatcgccttaaaatcctggta

SEQ ID NO: 80463 - DNA, 36 bp, Artificial Sequence
  Synthetic oligonucleotide
gcaatcttcggataagcatgggggggtggtgctgta

SEQ ID NO: 80464 - DNA, 35 bp, Artificial Sequence
  Synthetic oligonucleotide
tgttccaccccatttgactgcaacgatgcagccac

SEQ ID NO: 80465 - DNA, 35 bp, Artificial Sequence
  Synthetic oligonucleotide
taacggagcatcggcatggattttgttccggtcac

SEQ ID NO: 80466 - DNA, 35 bp, Artificial Sequence
  Synthetic oligonucleotide
tcaatgcacagtgtggataggaacttttgcgatac

SEQ ID NO: 80467 - DNA, 35 bp, Artificial Sequence
  Synthetic oligonucleotide
gatcccctagttcgcgccaaagcgggcttccaacc

SEQ ID NO: 80468 - DNA, 36 bp, Artificial Sequence
  Synthetic oligonucleotide
ggtgaaccccccaccgtcatgtcctgacccttcacc

SEQ ID NO: 80469 - DNA, 35 bp, Artificial Sequence
  Synthetic oligonucleotide
acccatgaggacaactgcccggagatcgcgatacc

SEQ ID NO: 80470 - DNA, 35 bp, Artificial Sequence
  Synthetic oligonucleotide
ggacatccatcccgcaaccaaatcaagagccgccc

SEQ ID NO: 80471 - DNA, 35 bp, Artificial Sequence
  Synthetic oligonucleotide
ggcctcgcacgtgctcgatcgacgtgactccgccc

SEQ ID NO: 80472 - DNA, 35 bp, Artificial Sequence
  Synthetic oligonucleotide
gccttagcacgtccgttcgtctccttgcttgtgcc

SEQ ID NO: 80473 - DNA, 35 bp, Artificial Sequence
  Synthetic oligonucleotide
tgtgcggccatttagtctctattgcctgcccctcc

SEQ ID NO: 80474 - DNA, 35 bp, Artificial Sequence
  Synthetic oligonucleotide
tagcgttgcctctagttttccgccgacttcgacgc

SEQ ID NO: 80475 - DNA, 35 bp, Artificial Sequence
  Synthetic oligonucleotide
tgccaccactgggaatgggcgggcactgcatgggc

SEQ ID NO: 80476 - DNA, 35 bp, Artificial Sequence
  Synthetic oligonucleotide
gcacagcataccgtatctgaagctgccctccctgc

SEQ ID NO: 80477 - DNA, 35 bp, Artificial Sequence
  Synthetic oligonucleotide
tcgtatggccactcgtcatttcctgtcttccaatc

SEQ ID NO: 80478 - DNA, 35 bp, Artificial Sequence
  Synthetic oligonucleotide
gtcccaacgcggtgggtgttggctgtcccgccttc

SEQ ID NO: 80479 - DNA, 35 bp, Artificial Sequence
  Synthetic oligonucleotide
taaccatcccttgatgtccaaaagtgttcgctttc

SEQ ID NO: 80480 - DNA, 35 bp, Artificial Sequence
  Synthetic oligonucleotide
tgagaaggatagtggcggagtccgggaaaaacaag

SEQ ID NO: 80481 - DNA, 35 bp, Artificial Sequence
  Synthetic oligonucleotide
acatgggcgggtgaggactcgtggggggacccgag

SEQ ID NO: 80482 - DNA, 35 bp, Artificial Sequence
  Synthetic oligonucleotide
tacccggtcggggatattaaagcgtgggtaatgag

SEQ ID NO: 80483 - DNA, 35 bp, Artificial Sequence
  Synthetic oligonucleotide
tctccccgtccctgttgatccaatctccttacacg

SEQ ID NO: 80484 - DNA, 35 bp, Artificial Sequence
  Synthetic oligonucleotide
ggatggacggggataactgttttgcgcatgtgacg

SEQ ID NO: 80485 - DNA, 35 bp, Artificial Sequence
  Synthetic oligonucleotide
attaaccagccgcgcagagagtgagacccataccg

SEQ ID NO: 80486 - DNA, 35 bp, Artificial Sequence
  Synthetic oligonucleotide
tggaaggcccacctttcaagtcgacgtacaccccg

SEQ ID NO: 80487 - DNA, 35 bp, Artificial Sequence
  Synthetic oligonucleotide
ggaaagggacggtataggggttgtgcgaacgtggg

SEQ ID NO: 80488 - DNA, 35 bp, Artificial Sequence
  Synthetic oligonucleotide
actccctggccatcagcgctcaccgctttttttgg

SEQ ID NO: 80489 - DNA, 35 bp, Artificial Sequence
  Synthetic oligonucleotide
gtgcggtggggggaagcacagagggttcgttaatg

SEQ ID NO: 80490 - DNA, 35 bp, Artificial Sequence
  Synthetic oligonucleotide
aagagaaggggggcaatgtgaaagatggtggtatg

SEQ ID NO: 80491 - DNA, 35 bp, Artificial Sequence
  Synthetic oligonucleotide
tttatcgagaacggtcccgagcttgctcctttatg

SEQ ID NO: 80492 - DNA, 35 bp, Artificial Sequence
  Synthetic oligonucleotide
ttgggtgtgagcccaattgtatcatctgactactg

SEQ ID NO: 80493 - DNA, 34 bp, Artificial Sequence
  Synthetic oligonucleotide
ggttagctccatacgccgcctctcattaaccctg

SEQ ID NO: 80494 - DNA, 35 bp, Artificial Sequence
  Synthetic oligonucleotide
gagtggcgaaccacatctgcttgtaacctcccctg

SEQ ID NO: 80495 - DNA, 35 bp, Artificial Sequence
  Synthetic oligonucleotide
gcccgcaccccactttgaactacagtaccctcctg

SEQ ID NO: 80496 - DNA, 35 bp, Artificial Sequence
  Synthetic oligonucleotide
gcacgtatagctcctggtgcttttagtatttcctg

SEQ ID NO: 80497 - DNA, 35 bp, Artificial Sequence
  Synthetic oligonucleotide
accgtcagtcggttcgcccgtcaaagttcgcccat

SEQ ID NO: 80498 - DNA, 35 bp, Artificial Sequence
  Synthetic oligonucleotide
cacgccccccggtatttagcgcacctattgtccat

SEQ ID NO: 80499 - DNA, 35 bp, Artificial Sequence
  Synthetic oligonucleotide
ttggctgacttgaaacgctttgacacactcatcat

SEQ ID NO: 80500 - DNA, 35 bp, Artificial Sequence
  Synthetic oligonucleotide
ggtcacatcattgacctactctcagcccatacact

SEQ ID NO: 80501 - DNA, 35 bp, Artificial Sequence
  Synthetic oligonucleotide
gaatagcggggaagaacggcggtcggggcggggct

SEQ ID NO: 80502 - DNA, 35 bp, Artificial Sequence
  Synthetic oligonucleotide
agacgcatcggattcgtctacttcagttcttcagt

SEQ ID NO: 80503 - DNA, 35 bp, Artificial Sequence
  Synthetic oligonucleotide
aaatagggaagggtttgatacgagggagatgcggt

SEQ ID NO: 80504 - DNA, 35 bp, Artificial Sequence
  Synthetic oligonucleotide
acccctcctcagcccctgtcgatatggagaacatt

SEQ ID NO: 80505 - DNA, 35 bp, Artificial Sequence
  Synthetic oligonucleotide
tgattccacccccaggccttcgtttacaacgactt

SEQ ID NO: 80506 - DNA, 35 bp, Artificial Sequence
  Synthetic oligonucleotide
gtcattgccgccttagacccctggttcgtccgctt

SEQ ID NO: 80507 - DNA, 35 bp, Artificial Sequence
  Synthetic oligonucleotide
gaccatcgcatccagatacgccaagccccggtctt

SEQ ID NO: 80508 - DNA, 36 bp, Artificial Sequence
  Synthetic oligonucleotide
gcccccagccccacaagagggatgcgatctaaattt

SEQ ID NO: 80509 - DNA, 34 bp, Artificial Sequence
  Synthetic oligonucleotide
gatcccgtgacatatggtttacgtgttttgcttt

SEQ ID NO: 80510 - DNA, 35 bp, Artificial Sequence
  Synthetic oligonucleotide
tccccccacatttttcggagcagttcctatctttt

SEQ ID NO: 80511 - DNA, 35 bp, Artificial Sequence
  Synthetic oligonucleotide
agcatgcggcctcacatgcgcacacgacgtctttt

SEQ ID NO: 80512 - DNA, 36 bp, Artificial Sequence
  Synthetic oligonucleotide
gaccctaggggcacggtccagggctttttcaccaaa

SEQ ID NO: 80513 - DNA, 36 bp, Artificial Sequence
  Synthetic oligonucleotide
gcacagccaactatcttgcatatcacaaagaccgaa

SEQ ID NO: 80514 - DNA, 36 bp, Artificial Sequence
  Synthetic oligonucleotide
tcaccatacagacactagccccttcgcgccactgaa

SEQ ID NO: 80515 - DNA, 36 bp, Artificial Sequence
  Synthetic oligonucleotide
gtccggaacaacctacactgacgtggcttaccttaa

SEQ ID NO: 80516 - DNA, 36 bp, Artificial Sequence
  Synthetic oligonucleotide
gctacgcgccgacagcacatactccaaggcccaaca

SEQ ID NO: 80517 - DNA, 36 bp, Artificial Sequence
  Synthetic oligonucleotide
gccacaagcccgctttcgttgttgagaattccaaca

SEQ ID NO: 80518 - DNA, 36 bp, Artificial Sequence
  Synthetic oligonucleotide
gcgtgcctactctgttagtggtatgtccccttcaca

SEQ ID NO: 80519 - DNA, 36 bp, Artificial Sequence
  Synthetic oligonucleotide
gccgtccctcgtagcgttttcccttctttgacacca

SEQ ID NO: 80520 - DNA, 36 bp, Artificial Sequence
  Synthetic oligonucleotide
gatggtggaggataggttatgtgggctccgtaccca

SEQ ID NO: 80521 - DNA, 35 bp, Artificial Sequence
  Synthetic oligonucleotide
gagtctgtagtgaggtcgggggatgaaatgtagca

SEQ ID NO: 80522 - DNA, 36 bp, Artificial Sequence
  Synthetic oligonucleotide
accgccctgtactgtgcttttggtcatattatcgca

SEQ ID NO: 80523 - DNA, 36 bp, Artificial Sequence
  Synthetic oligonucleotide
gacccgtagaacaaaaacagaaggattggccgggca

SEQ ID NO: 80524 - DNA, 36 bp, Artificial Sequence
  Synthetic oligonucleotide
aactcttcagccggtacggggacctttgcatactca

SEQ ID NO: 80525 - DNA, 36 bp, Artificial Sequence
  Synthetic oligonucleotide
gtgcaaatgccccgacccgtcatcgagcaatattca

SEQ ID NO: 80526 - DNA, 36 bp, Artificial Sequence
  Synthetic oligonucleotide
gataagaaggagccagtgtgaatggcaggtgaaaga

SEQ ID NO: 80527 - DNA, 37 bp, Artificial Sequence
  Synthetic oligonucleotide
tggttgatcgggtgtagaggggggaaggagtgccaga

SEQ ID NO: 80528 - DNA, 37 bp, Artificial Sequence
  Synthetic oligonucleotide
tcccgtccgacgcctcatattttatgccaactcgaga

SEQ ID NO: 80529 - DNA, 37 bp, Artificial Sequence
  Synthetic oligonucleotide
gacacgggaagcggaaattgggataacggaggggaga

SEQ ID NO: 80530 - DNA, 37 bp, Artificial Sequence
  Synthetic oligonucleotide
gagcgaaggagagggaaactggtagtgcggcgtacga

SEQ ID NO: 80531 - DNA, 36 bp, Artificial Sequence
  Synthetic oligonucleotide
tcagccgttgcgttcgcctaaatcaaagtaccccga

SEQ ID NO: 80532 - DNA, 37 bp, Artificial Sequence
  Synthetic oligonucleotide
gatacacgtacgtgtctagatcctgttctttccccga

SEQ ID NO: 80533 - DNA, 35 bp, Artificial Sequence
  Synthetic oligonucleotide
atgacaccccagccttgaaagccatatcttgccga

SEQ ID NO: 80534 - DNA, 37 bp, Artificial Sequence
  Synthetic oligonucleotide
ggtcaccccgtggaagctcccgcccgacctccatcga

SEQ ID NO: 80535 - DNA, 37 bp, Artificial Sequence
  Synthetic oligonucleotide
gcgagtggctcctgctcagtgaactagcttacctcga

SEQ ID NO: 80536 - DNA, 37 bp, Artificial Sequence
  Synthetic oligonucleotide
attgatcagtgcgcccctatccgcaaacactcctcga

SEQ ID NO: 80537 - DNA, 37 bp, Artificial Sequence
  Synthetic oligonucleotide
tgcttccctcccatgtcttccacattcaatctttcga

SEQ ID NO: 80538 - DNA, 35 bp, Artificial Sequence
  Synthetic oligonucleotide
ggagcaagtcgcctctccatcgttacgtgcccgga

SEQ ID NO: 80539 - DNA, 37 bp, Artificial Sequence
  Synthetic oligonucleotide
tcctgccccctggcgacaggccgtatccaccttcgga

SEQ ID NO: 80540 - DNA, 36 bp, Artificial Sequence
  Synthetic oligonucleotide
tgacacagtggaaggcaagggctgagggccaaggga

SEQ ID NO: 80541 - DNA, 37 bp, Artificial Sequence
  Synthetic oligonucleotide
tacgcaagtaggcggggtaagaaggcctaggcaggga

SEQ ID NO: 80542 - DNA, 37 bp, Artificial Sequence
  Synthetic oligonucleotide
aagaccagtggcatggttgaatggaaaatagtaggga

SEQ ID NO: 80543 - DNA, 36 bp, Artificial Sequence
  Synthetic oligonucleotide
tcattgctccaccccgccggttaaacgtactcggga

SEQ ID NO: 80544 - DNA, 35 bp, Artificial Sequence
  Synthetic oligonucleotide
tgccaaagggccaccgggttgtacgggggagggga

SEQ ID NO: 80545 - DNA, 37 bp, Artificial Sequence
  Synthetic oligonucleotide
gcaatgtggtaggaggtaactggggtgggggttggga

SEQ ID NO: 80546 - DNA, 37 bp, Artificial Sequence
  Synthetic oligonucleotide
aagagagggcggggagtgtggggaaactgtgtatgga

SEQ ID NO: 80547 - DNA, 37 bp, Artificial Sequence
  Synthetic oligonucleotide
acctagcaggtgaggaggggttcaagtttgaaaatga

SEQ ID NO: 80548 - DNA, 38 bp, Artificial Sequence
  Synthetic oligonucleotide
tcggactgcctttctgtattgctcgcttcttcccatga

SEQ ID NO: 80549 - DNA, 38 bp, Artificial Sequence
  Synthetic oligonucleotide
tgttcaatggaaagggaggaaattaggaacagtgatga

SEQ ID NO: 80550 - DNA, 38 bp, Artificial Sequence
  Synthetic oligonucleotide
gagtcacgtagatagcgttttttgtggtgcctttatga

SEQ ID NO: 80551 - DNA, 38 bp, Artificial Sequence
  Synthetic oligonucleotide
gcctgcccatagagggcagaatcaagaacaaacactga

SEQ ID NO: 80552 - DNA, 38 bp, Artificial Sequence
  Synthetic oligonucleotide
tacgctgctctttcggctgagatccacttccacactga

SEQ ID NO: 80553 - DNA, 37 bp, Artificial Sequence
  Synthetic oligonucleotide
gttgctaaccgggggaaaaaggggtggtgaatgctga

SEQ ID NO: 80554 - DNA, 38 bp, Artificial Sequence
  Synthetic oligonucleotide
tcaacctgtcctgcatccgcgcaaatcgtcgactctga

SEQ ID NO: 80555 - DNA, 37 bp, Artificial Sequence
  Synthetic oligonucleotide
acactcgcagtcagagtcttcaagacttggtgagtga

SEQ ID NO: 80556 - DNA, 38 bp, Artificial Sequence
  Synthetic oligonucleotide
gcctgggtcattttccagtccacccacccctgccgtga

SEQ ID NO: 80557 - DNA, 38 bp, Artificial Sequence
  Synthetic oligonucleotide
gatggacagtcgaaaggttgaggccaaagttggcgtga

SEQ ID NO: 80558 - DNA, 38 bp, Artificial Sequence
  Synthetic oligonucleotide
ggtcactgtcccccatcggtaattcatcacactcgtga

SEQ ID NO: 80559 - DNA, 38 bp, Artificial Sequence
  Synthetic oligonucleotide
gacaacccaaaatacactgttcacccgttacgcggtga

SEQ ID NO: 80560 - DNA, 37 bp, Artificial Sequence
  Synthetic oligonucleotide
acaccgccgtcaagcatgacgccagctcttaaattga

SEQ ID NO: 80561 - DNA, 37 bp, Artificial Sequence
  Synthetic oligonucleotide
gccatggggccggatcaaaacagcagacgctaattga

SEQ ID NO: 80562 - DNA, 38 bp, Artificial Sequence
  Synthetic oligonucleotide
tcagggggggtgggtgtgggcaggggggatggcattga

SEQ ID NO: 80563 - DNA, 38 bp, Artificial Sequence
  Synthetic oligonucleotide
atatcactgacattttgcccctcaagctcaggccttga

SEQ ID NO: 80564 - DNA, 38 bp, Artificial Sequence
  Synthetic oligonucleotide
taccacggacacacgccgtttcacaatgggatccttga

SEQ ID NO: 80565 - DNA, 37 bp, Artificial Sequence
  Synthetic oligonucleotide
tccatcaaccgtaccacgctccgttaagtagtcttga

SEQ ID NO: 80566 - DNA, 37 bp, Artificial Sequence
  Synthetic oligonucleotide
acaccatcacatgtttccttcgttgagtcaccgttga

SEQ ID NO: 80567 - DNA, 37 bp, Artificial Sequence
  Synthetic oligonucleotide
ggactggagcggattgggggatgggcgtgaaggttga

SEQ ID NO: 80568 - DNA, 37 bp, Artificial Sequence
  Synthetic oligonucleotide
gtgagtgtaaaagagtgcggagggatagggaggttga

SEQ ID NO: 80569 - DNA, 38 bp, Artificial Sequence
  Synthetic oligonucleotide
agtggggccagagttctatacggggtggggcgggttga

SEQ ID NO: 80570 - DNA, 37 bp, Artificial Sequence
  Synthetic oligonucleotide
gcccgcaccgcaattattcgtgcattctggggtttga

SEQ ID NO: 80571 - DNA, 37 bp, Artificial Sequence
  Synthetic oligonucleotide
gccaagccgtctggtctcggttctttctggggtttga

SEQ ID NO: 80572 - DNA, 36 bp, Artificial Sequence
  Synthetic oligonucleotide
atcctcgctttggactatccgtcgttagttgcccta

SEQ ID NO: 80573 - DNA, 36 bp, Artificial Sequence
  Synthetic oligonucleotide
tgacaccggttaacagttcatgccgcttcccctcta

SEQ ID NO: 80574 - DNA, 35 bp, Artificial Sequence
  Synthetic oligonucleotide
cggtgccatgcccacaagtataacgtacgcctcta

SEQ ID NO: 80575 - DNA, 36 bp, Artificial Sequence
  Synthetic oligonucleotide
aaaacacataaggagaggtggggatgcgggagagta

SEQ ID NO: 80576 - DNA, 36 bp, Artificial Sequence
  Synthetic oligonucleotide
accctccgtgaatgcattgtcacctcctttcgcgta

SEQ ID NO: 80577 - DNA, 35 bp, Artificial Sequence
  Synthetic oligonucleotide
aatgtcacccgagaattcgttcgcccaccactgta

SEQ ID NO: 80578 - DNA, 36 bp, Artificial Sequence
  Synthetic oligonucleotide
ggtgctgacggggtggggaatgatgcagatactgta

SEQ ID NO: 80579 - DNA, 35 bp, Artificial Sequence
  Synthetic oligonucleotide
gaacctcgtcccgaccacccagacttaggaacaac

SEQ ID NO: 80580 - DNA, 35 bp, Artificial Sequence
  Synthetic oligonucleotide
gtccacctatctcgataactaccttgttctaggac

SEQ ID NO: 80581 - DNA, 35 bp, Artificial Sequence
  Synthetic oligonucleotide
atcgtcggggagggaaattaccggggtggctggac

SEQ ID NO: 80582 - DNA, 35 bp, Artificial Sequence
  Synthetic oligonucleotide
acttaccacctctgaatttaggaatttggctatac

SEQ ID NO: 80583 - DNA, 35 bp, Artificial Sequence
  Synthetic oligonucleotide
gtgctgcatatttctgcttgagccttcatcggccc

SEQ ID NO: 80584 - DNA, 34 bp, Artificial Sequence
  Synthetic oligonucleotide
taattgccccctgcttagtaatatacccttcagc

SEQ ID NO: 80585 - DNA, 35 bp, Artificial Sequence
  Synthetic oligonucleotide
tgtgatcacacatcttccaccctgcgccaccctgc

SEQ ID NO: 80586 - DNA, 35 bp, Artificial Sequence
  Synthetic oligonucleotide
agtgtgcaccccctgaccgcagtgaccgcccctgc

SEQ ID NO: 80587 - DNA, 35 bp, Artificial Sequence
  Synthetic oligonucleotide
atccgccccgtgttcgacaccttcgatccaaaatc

SEQ ID NO: 80588 - DNA, 35 bp, Artificial Sequence
  Synthetic oligonucleotide
gtgcgcccactgttacccgacgttgcctcatcctc

SEQ ID NO: 80589 - DNA, 35 bp, Artificial Sequence
  Synthetic oligonucleotide
agcatgtaacgtagcggaaccccatgaccttcctc

SEQ ID NO: 80590 - DNA, 35 bp, Artificial Sequence
  Synthetic oligonucleotide
acaatcccgcacggggtatccttagttgtaccttc

SEQ ID NO: 80591 - DNA, 35 bp, Artificial Sequence
  Synthetic oligonucleotide
aaaccagactgtgctatggggggtaggagaggaag

SEQ ID NO: 80592 - DNA, 35 bp, Artificial Sequence
  Synthetic oligonucleotide
gccaaccacgcttaggaaatatcaccagcatcccg

SEQ ID NO: 80593 - DNA, 35 bp, Artificial Sequence
  Synthetic oligonucleotide
tgatgatggaggggaggtggttcttcttgacgccg

SEQ ID NO: 80594 - DNA, 36 bp, Artificial Sequence
  Synthetic oligonucleotide
atttaccagtcgtccccgtcccttaactctgcggcg

SEQ ID NO: 80595 - DNA, 35 bp, Artificial Sequence
  Synthetic oligonucleotide
tacatcgcgatccacacagcacaacgtagctggcg

SEQ ID NO: 80596 - DNA, 33 bp, Artificial Sequence
  Synthetic oligonucleotide
gatcacggtacccttccagccccgattttctcg

SEQ ID NO: 80597 - DNA, 35 bp, Artificial Sequence
  Synthetic oligonucleotide
gagtcagcccatcttagcatcgagttccgacccgg

SEQ ID NO: 80598 - DNA, 35 bp, Artificial Sequence
  Synthetic oligonucleotide
gaaggatgacggtaattgagctctgggggtggggg

SEQ ID NO: 80599 - DNA, 35 bp, Artificial Sequence
  Synthetic oligonucleotide
aacccacggggcctcccagcataggacatctttgg

SEQ ID NO: 80600 - DNA, 35 bp, Artificial Sequence
  Synthetic oligonucleotide
atggggcaaaaggtggtattgggatagtggatatg

SEQ ID NO: 80601 - DNA, 35 bp, Artificial Sequence
  Synthetic oligonucleotide
acactgtcccgcaaaaactcatagccccgagtatg

SEQ ID NO: 80602 - DNA, 35 bp, Artificial Sequence
  Synthetic oligonucleotide
aacttccaccacacacatgtagtcataaaaccctg

SEQ ID NO: 80603 - DNA, 35 bp, Artificial Sequence
  Synthetic oligonucleotide
tttgcgggcatccctccactctgtcaggcactctg

SEQ ID NO: 80604 - DNA, 36 bp, Artificial Sequence
  Synthetic oligonucleotide
ttggggaatggaggacacaatggggagggagtggtg

SEQ ID NO: 80605 - DNA, 35 bp, Artificial Sequence
  Synthetic oligonucleotide
gtgtgctccaattgttttcctgatcctgtttacat

SEQ ID NO: 80606 - DNA, 35 bp, Artificial Sequence
  Synthetic oligonucleotide
tgcctgcaaatgtaccctattctgatcgcgccact

SEQ ID NO: 80607 - DNA, 35 bp, Artificial Sequence
  Synthetic oligonucleotide
acccccaattccgtacgcagtacttagagttcact

SEQ ID NO: 80608 - DNA, 33 bp, Artificial Sequence
  Synthetic oligonucleotide
gaccgccgtccatacctttaacacctttcgact

SEQ ID NO: 80609 - DNA, 35 bp, Artificial Sequence
  Synthetic oligonucleotide
cctcacctccggtcacgttgtctcccgttatgcct

SEQ ID NO: 80610 - DNA, 35 bp, Artificial Sequence
  Synthetic oligonucleotide
ttgtgccgtcctcctgctatagtcgaaatctatct

SEQ ID NO: 80611 - DNA, 35 bp, Artificial Sequence
  Synthetic oligonucleotide
gaccaccgcgcaaattaaaaggtgcgcgattatct

SEQ ID NO: 80612 - DNA, 35 bp, Artificial Sequence
  Synthetic oligonucleotide
ttggaccactgtctccttcttctatagttcagtct

SEQ ID NO: 80613 - DNA, 35 bp, Artificial Sequence
  Synthetic oligonucleotide
tacagacaggtgccaaaggggcaaaaataggccgt

SEQ ID NO: 80614 - DNA, 35 bp, Artificial Sequence
  Synthetic oligonucleotide
aaccgggtggtggggtttagtgtctttccgagtgt

SEQ ID NO: 80615 - DNA, 34 bp, Artificial Sequence
  Synthetic oligonucleotide
agcgcggagcggtcattctctcagccacacaatt

SEQ ID NO: 80616 - DNA, 35 bp, Artificial Sequence
  Synthetic oligonucleotide
tatccaatggctgcaacttatgccctccgccaatt

SEQ ID NO: 80617 - DNA, 35 bp, Artificial Sequence
  Synthetic oligonucleotide
ggtcaggaaccgaaggtttttttaccaatcttatt

SEQ ID NO: 80618 - DNA, 35 bp, Artificial Sequence
  Synthetic oligonucleotide
tttgctccgcacttatacctactcccgtgaacgtt

SEQ ID NO: 80619 - DNA, 35 bp, Artificial Sequence
  Synthetic oligonucleotide
tcgtggcgcaggtgatttcgttcgcttccgttgtt

SEQ ID NO: 80620 - DNA, 35 bp, Artificial Sequence
  Synthetic oligonucleotide
acatgcactgccaggcgcggtcacttcgttacttt

SEQ ID NO: 80621 - DNA, 36 bp, Artificial Sequence
  Synthetic oligonucleotide
tgctggacgccactgcgcaatgccattttcaacaaa

SEQ ID NO: 80622 - DNA, 35 bp, Artificial Sequence
  Synthetic oligonucleotide
aggtgggtgggcggagagcgaagtggggtcggaaa

SEQ ID NO: 80623 - DNA, 34 bp, Artificial Sequence
  Synthetic oligonucleotide
gccttgggtccacgttccgccttgtcatcttaaa

SEQ ID NO: 80624 - DNA, 35 bp, Artificial Sequence
  Synthetic oligonucleotide
gccgtaatgccgtactttatgtcgttccctcacaa

SEQ ID NO: 80625 - DNA, 36 bp, Artificial Sequence
  Synthetic oligonucleotide
tcctaccttggcgacgtttaggagtaaccccaccaa

SEQ ID NO: 80626 - DNA, 35 bp, Artificial Sequence
  Synthetic oligonucleotide
agctccccacccagctgggcttgttaccaactcaa

SEQ ID NO: 80627 - DNA, 35 bp, Artificial Sequence
  Synthetic oligonucleotide
agctcccccccgtacccaaaatctcagtctgtcaa

SEQ ID NO: 80628 - DNA, 36 bp, Artificial Sequence
  Synthetic oligonucleotide
atctggtgtatcctcatgcctacgccctttaacgaa

SEQ ID NO: 80629 - DNA, 37 bp, Artificial Sequence
  Synthetic oligonucleotide
cactcccgcgtcgcgaaatcctatgcactctactgaa

SEQ ID NO: 80630 - DNA, 36 bp, Artificial Sequence
  Synthetic oligonucleotide
ttcctacacccacgcatgcccgagcagtttatctaa

SEQ ID NO: 80631 - DNA, 36 bp, Artificial Sequence
  Synthetic oligonucleotide
tcccagatgccgaagcgtagtaccttcccgttaaca

SEQ ID NO: 80632 - DNA, 36 bp, Artificial Sequence
  Synthetic oligonucleotide
tcactctcgccgagtatgcgctcccggcctgtgaca

SEQ ID NO: 80633 - DNA, 36 bp, Artificial Sequence
  Synthetic oligonucleotide
tgacctcggagcccaacctcacacggttaacaacca

SEQ ID NO: 80634 - DNA, 36 bp, Artificial Sequence
  Synthetic oligonucleotide
gtccatgggacgatcttggtcctttttttatgccca

SEQ ID NO: 80635 - DNA, 36 bp, Artificial Sequence
  Synthetic oligonucleotide
gcaaagctactcctgcaatctgttaacacgtagcca

SEQ ID NO: 80636 - DNA, 36 bp, Artificial Sequence
  Synthetic oligonucleotide
gcaggccaccatctgttttcgccatctcaacctcca

SEQ ID NO: 80637 - DNA, 36 bp, Artificial Sequence
  Synthetic oligonucleotide
tagcatggctaattagtactgcccctgcattaagca

SEQ ID NO: 80638 - DNA, 35 bp, Artificial Sequence
  Synthetic oligonucleotide
ttgagccattttatttgaacgatccatctttcgca

SEQ ID NO: 80639 - DNA, 35 bp, Artificial Sequence
  Synthetic oligonucleotide
gatgtagaagccaaaccctatttagacgtcctgca

SEQ ID NO: 80640 - DNA, 36 bp, Artificial Sequence
  Synthetic oligonucleotide
agttaggtgggagggaggaggatttgaacttttgca

SEQ ID NO: 80641 - DNA, 36 bp, Artificial Sequence
  Synthetic oligonucleotide
ttgcaaacccgaacgtgctttacttcccccggatca

SEQ ID NO: 80642 - DNA, 36 bp, Artificial Sequence
  Synthetic oligonucleotide
gaattggaacggggtggtggctgaatacagggatca

SEQ ID NO: 80643 - DNA, 36 bp, Artificial Sequence
  Synthetic oligonucleotide
aaccccactggtcacgttccgattcgtgacacctca

SEQ ID NO: 80644 - DNA, 36 bp, Artificial Sequence
  Synthetic oligonucleotide
tccgaacgcctggctggctcttcgatactttcttca

SEQ ID NO: 80645 - DNA, 37 bp, Artificial Sequence
  Synthetic oligonucleotide
gatgggtgctggggtcagtggggagggtagtgtgaga

SEQ ID NO: 80646 - DNA, 37 bp, Artificial Sequence
  Synthetic oligonucleotide
atatgcagaaagcgcaggatggaactggggatgtaga

SEQ ID NO: 80647 - DNA, 37 bp, Artificial Sequence
  Synthetic oligonucleotide
attggctgcctcctgtaaccattccttccttgttaga

SEQ ID NO: 80648 - DNA, 37 bp, Artificial Sequence
  Synthetic oligonucleotide
tccgacctatacatgcgccccagactccgccacacga

SEQ ID NO: 80649 - DNA, 37 bp, Artificial Sequence
  Synthetic oligonucleotide
gacccatccgttattcatgaggcgtcgccctatacga

SEQ ID NO: 80650 - DNA, 37 bp, Artificial Sequence
  Synthetic oligonucleotide
gacgagtagtcgcattggggatgaggatgtcttacga

SEQ ID NO: 80651 - DNA, 37 bp, Artificial Sequence
  Synthetic oligonucleotide
atgtagagcgaagtgattcctcgtgcactccccccga

SEQ ID NO: 80652 - DNA, 37 bp, Artificial Sequence
  Synthetic oligonucleotide
aactgcccgggcattttggtgtcaatgcattttccga

SEQ ID NO: 80653 - DNA, 35 bp, Artificial Sequence
  Synthetic oligonucleotide
gaagacaaacatgcaatgcaccccgctttccgcga

SEQ ID NO: 80654 - DNA, 36 bp, Artificial Sequence
  Synthetic oligonucleotide
acatcatcctccactctagcctaacaggccgcgcga

SEQ ID NO: 80655 - DNA, 37 bp, Artificial Sequence
  Synthetic oligonucleotide
agctgggccacgtatttgcctcctgtagtcttggcga

SEQ ID NO: 80656 - DNA, 37 bp, Artificial Sequence
  Synthetic oligonucleotide
tgtaagctcaagccggctctacaccaatcacatgcga

SEQ ID NO: 80657 - DNA, 37 bp, Artificial Sequence
  Synthetic oligonucleotide
tcagggaaggtgctgggagagggaggaccagcatcga

SEQ ID NO: 80658 - DNA, 37 bp, Artificial Sequence
  Synthetic oligonucleotide
gatccctgggccctggatgtgctgccccgctcctcga

SEQ ID NO: 80659 - DNA, 37 bp, Artificial Sequence
  Synthetic oligonucleotide
ttggatagcctgcccacactagtgttcgccaattcga

SEQ ID NO: 80660 - DNA, 37 bp, Artificial Sequence
  Synthetic oligonucleotide
accgggctacccatcagtgtgatgcccttccgttcga

SEQ ID NO: 80661 - DNA, 36 bp, Artificial Sequence
  Synthetic oligonucleotide
tcaaccaacccgcgaatttgcatcatgacgaaagga

SEQ ID NO: 80662 - DNA, 37 bp, Artificial Sequence
  Synthetic oligonucleotide
aacacatccacgattactaatatcccttgtcccagga

SEQ ID NO: 80663 - DNA, 37 bp, Artificial Sequence
  Synthetic oligonucleotide
gtagccccagctcataacgttcctccgctgtacggga

SEQ ID NO: 80664 - DNA, 37 bp, Artificial Sequence
  Synthetic oligonucleotide
tccgaacctccattataatttccgcaaccttgcggga

SEQ ID NO: 80665 - DNA, 36 bp, Artificial Sequence
  Synthetic oligonucleotide
agtgtgctacccgctttcaactatcagtcttgggga

SEQ ID NO: 80666 - DNA, 37 bp, Artificial Sequence
  Synthetic oligonucleotide
ttgtcagagcgggtggtacggagggggataacatgga

SEQ ID NO: 80667 - DNA, 37 bp, Artificial Sequence
  Synthetic oligonucleotide
acagtccccccgcccacgtaccagtatatcatatgga

SEQ ID NO: 80668 - DNA, 37 bp, Artificial Sequence
  Synthetic oligonucleotide
tacaccactcctgaggcggaatcaacacaatactgga

SEQ ID NO: 80669 - DNA, 36 bp, Artificial Sequence
  Synthetic oligonucleotide
ggagacaggatacaaaagttcagtgggaggggtgga

SEQ ID NO: 80670 - DNA, 37 bp, Artificial Sequence
  Synthetic oligonucleotide
gaccataggacttggtgaggaaaaaggcaggtcatga

SEQ ID NO: 80671 - DNA, 38 bp, Artificial Sequence
  Synthetic oligonucleotide
tcaacagcagtagtggttgcacgatggaagtcatatga

SEQ ID NO: 80672 - DNA, 38 bp, Artificial Sequence
  Synthetic oligonucleotide
atctacacctgctggggtacacatacacttcactatga

SEQ ID NO: 80673 - DNA, 37 bp, Artificial Sequence
  Synthetic oligonucleotide
gcaccggttgggccgacgcaccatgctccctctatga

SEQ ID NO: 80674 - DNA, 35 bp, Artificial Sequence
  Synthetic oligonucleotide
gacaacctggtcgagaacgtgatgtagatcactga

SEQ ID NO: 80675 - DNA, 38 bp, Artificial Sequence
  Synthetic oligonucleotide
gcgctcggtagatcccccaatgctgattgcttcactga

SEQ ID NO: 80676 - DNA, 38 bp, Artificial Sequence
  Synthetic oligonucleotide
gtttgggtaaacatagggggaggtaagggcgggactga

SEQ ID NO: 80677 - DNA, 27 bp, Artificial Sequence
  Synthetic oligonucleotide
accaacctgctactgtcctactactga

SEQ ID NO: 80678 - DNA, 37 bp, Artificial Sequence
  Synthetic oligonucleotide
gatgccacctgtccgctcaaagatattatcgtactga

SEQ ID NO: 80679 - DNA, 38 bp, Artificial Sequence
  Synthetic oligonucleotide
tcagccccgacctcattgttagcctagatcgcctctga

SEQ ID NO: 80680 - DNA, 38 bp, Artificial Sequence
  Synthetic oligonucleotide
ttagagaaaggaaagtgggtaaagcaggataacagtga

SEQ ID NO: 80681 - DNA, 37 bp, Artificial Sequence
  Synthetic oligonucleotide
gtgcgcgcgttgtgcccgttagcccttctcttagtga

SEQ ID NO: 80682 - DNA, 38 bp, Artificial Sequence
  Synthetic oligonucleotide
aagttgacgggcaggagtgggagccgtgatgggcgtga

SEQ ID NO: 80683 - DNA, 38 bp, Artificial Sequence
  Synthetic oligonucleotide
gtttccgccctggcccttaagcacacccaatggggtga

SEQ ID NO: 80684 - DNA, 38 bp, Artificial Sequence
  Synthetic oligonucleotide
gtgcaacggtaaggcggataggtagggcgattgggtga

SEQ ID NO: 80685 - DNA, 38 bp, Artificial Sequence
  Synthetic oligonucleotide
gttgctcagctttgctcaactgcgctccccttttgtga

SEQ ID NO: 80686 - DNA, 38 bp, Artificial Sequence
  Synthetic oligonucleotide
gactacccgacctccggtgatgacacactattgcttga

SEQ ID NO: 80687 - DNA, 38 bp, Artificial Sequence
  Synthetic oligonucleotide
gacaccgcccatcgtaaatgttctttaccccgtcttga

SEQ ID NO: 80688 - DNA, 38 bp, Artificial Sequence
  Synthetic oligonucleotide
aatgtgcccccagcctctctattactgtatccggttga

SEQ ID NO: 80689 - DNA, 38 bp, Artificial Sequence
  Synthetic oligonucleotide
aacacgaagctcttggtgcctgccgatactccctttga

SEQ ID NO: 80690 - DNA, 36 bp, Artificial Sequence
  Synthetic oligonucleotide
gctcccgtcgcctactccactgttccccactggata

SEQ ID NO: 80691 - DNA, 35 bp, Artificial Sequence
  Synthetic oligonucleotide
tgctactcacccagcggctcccacgacccgttata

SEQ ID NO: 80692 - DNA, 36 bp, Artificial Sequence
  Synthetic oligonucleotide
accatcgactcgctggaccaaatgtgcccgatcgta

SEQ ID NO: 80693 - DNA, 35 bp, Artificial Sequence
  Synthetic oligonucleotide
tgtttcccaccgaacccacgccctttaaagaggta

SEQ ID NO: 80694 - DNA, 36 bp, Artificial Sequence
  Synthetic oligonucleotide
gcgacgggggattagggaataataatgcatggggta

SEQ ID NO: 80695 - DNA, 35 bp, Artificial Sequence
  Synthetic oligonucleotide
tcaatgcgctggggttagagtaatgggctttggta

SEQ ID NO: 80696 - DNA, 35 bp, Artificial Sequence
  Synthetic oligonucleotide
tcatgcgaggttggggaggtagctacggggcatta

SEQ ID NO: 80697 - DNA, 36 bp, Artificial Sequence
  Synthetic oligonucleotide
ttgtcacaccctatttcctcctcgacgtgaatctta

SEQ ID NO: 80698 - DNA, 36 bp, Artificial Sequence
  Synthetic oligonucleotide
tcactctgtacgcctgcgagtgcccaatccttttta

SEQ ID NO: 80699 - DNA, 35 bp, Artificial Sequence
  Synthetic oligonucleotide
gtaacacgtcccctgatttcttttgctcgatcgac

SEQ ID NO: 80700 - DNA, 35 bp, Artificial Sequence
  Synthetic oligonucleotide
acagagccagcccctcattgcgcgctttgggtacc

SEQ ID NO: 80701 - DNA, 35 bp, Artificial Sequence
  Synthetic oligonucleotide
tcagtgtggctgaaacccgtctcccggcagttacc

SEQ ID NO: 80702 - DNA, 35 bp, Artificial Sequence
  Synthetic oligonucleotide
gtgtcccggcttacccttacaccggtaaatccccc

SEQ ID NO: 80703 - DNA, 35 bp, Artificial Sequence
  Synthetic oligonucleotide
gagtgtgaagtgcagtctgcttagcctcgtccccc

SEQ ID NO: 80704 - DNA, 35 bp, Artificial Sequence
  Synthetic oligonucleotide
gccttaaccccagggtatatttcccggcaactgcc

SEQ ID NO: 80705 - DNA, 35 bp, Artificial Sequence
  Synthetic oligonucleotide
tccacctaccgacctcgttcctggacaggattgcc

SEQ ID NO: 80706 - DNA, 35 bp, Artificial Sequence
  Synthetic oligonucleotide
tcaacggtgtccgtcaaagcacttcacctaactcc

SEQ ID NO: 80707 - DNA, 35 bp, Artificial Sequence
  Synthetic oligonucleotide
attcaggcaatgattcgtattctcgtcatcgctcc

SEQ ID NO: 80708 - DNA, 35 bp, Artificial Sequence
  Synthetic oligonucleotide
ttaccccccgcccactgggtcattacacctcttcc

SEQ ID NO: 80709 - DNA, 35 bp, Artificial Sequence
  Synthetic oligonucleotide
accgaaccatgatagtccattatggactccctcgc

SEQ ID NO: 80710 - DNA, 35 bp, Artificial Sequence
  Synthetic oligonucleotide
aacgcccaccccgaccagcccacgatctcttcggc

SEQ ID NO: 80711 - DNA, 35 bp, Artificial Sequence
  Synthetic oligonucleotide
aagcacctggttgttattgcgtctccttctcgggc

SEQ ID NO: 80712 - DNA, 35 bp, Artificial Sequence
  Synthetic oligonucleotide
gccccagccgtgcatttgcatttaattcctgctgc

SEQ ID NO: 80713 - DNA, 35 bp, Artificial Sequence
  Synthetic oligonucleotide
gtggtgcaacacccgggattactacacctttgtgc

SEQ ID NO: 80714 - DNA, 35 bp, Artificial Sequence
  Synthetic oligonucleotide
ggtgtgctctgctgacatctatcgctccgtttatc

SEQ ID NO: 80715 - DNA, 35 bp, Artificial Sequence
  Synthetic oligonucleotide
agtcttggcctccctgcatgttgcgcaattcactc

SEQ ID NO: 80716 - DNA, 35 bp, Artificial Sequence
  Synthetic oligonucleotide
gaccattgtccaatagaattcatgtccgcaccctc

SEQ ID NO: 80717 - DNA, 35 bp, Artificial Sequence
  Synthetic oligonucleotide
atcctcgcttgccatgaacacccgacttgtccctc

SEQ ID NO: 80718 - DNA, 35 bp, Artificial Sequence
  Synthetic oligonucleotide
tgcaccctgccacgcgatcgggcctttttcctgtc

SEQ ID NO: 80719 - DNA, 35 bp, Artificial Sequence
  Synthetic oligonucleotide
tgtgcgcttcacggtgaactccgctgatccttgtc

SEQ ID NO: 80720 - DNA, 35 bp, Artificial Sequence
  Synthetic oligonucleotide
tgagcgatgattccacccccaactgcctcgctttc

SEQ ID NO: 80721 - DNA, 35 bp, Artificial Sequence
  Synthetic oligonucleotide
gtggaggtcccgtgggcgttaagggggatagtgag

SEQ ID NO: 80722 - DNA, 35 bp, Artificial Sequence
  Synthetic oligonucleotide
tacgccggagagggctgacaataagaatcgttacg

SEQ ID NO: 80723 - DNA, 35 bp, Artificial Sequence
  Synthetic oligonucleotide
gagacgtggtgacggttgtagggatgattgagggg

SEQ ID NO: 80724 - DNA, 35 bp, Artificial Sequence
  Synthetic oligonucleotide
tgaaccggtcacatcacgaacatttagcgggctgg

SEQ ID NO: 80725 - DNA, 35 bp, Artificial Sequence
  Synthetic oligonucleotide
gacacggaccaaagaaggcgtaggcgatagagtgg

SEQ ID NO: 80726 - DNA, 35 bp, Artificial Sequence
  Synthetic oligonucleotide
atcgcccgacaaccacactgatacgccaatcactg

SEQ ID NO: 80727 - DNA, 35 bp, Artificial Sequence
  Synthetic oligonucleotide
gccactgacccacccagatacccccctcgagactg

SEQ ID NO: 80728 - DNA, 35 bp, Artificial Sequence
  Synthetic oligonucleotide
gggggaaagggcggggtcaataggcgtagggaaat

SEQ ID NO: 80729 - DNA, 35 bp, Artificial Sequence
  Synthetic oligonucleotide
atcgtacaccgcgcctttccgccctcgcagtcaat

SEQ ID NO: 80730 - DNA, 35 bp, Artificial Sequence
  Synthetic oligonucleotide
ttgagggaagggcagacagggagttagaaaaggat

SEQ ID NO: 80731 - DNA, 35 bp, Artificial Sequence
  Synthetic oligonucleotide
accccccggcataagttagtcccgccatacgcact

SEQ ID NO: 80732 - DNA, 35 bp, Artificial Sequence
  Synthetic oligonucleotide
atgaccacgccggactgcggtcccttacttcacct

SEQ ID NO: 80733 - DNA, 35 bp, Artificial Sequence
  Synthetic oligonucleotide
atacctgcaagatgttggtcgctctcacgcctcct

SEQ ID NO: 80734 - DNA, 35 bp, Artificial Sequence
  Synthetic oligonucleotide
ccacgccacccacctcgagcaccaccggtcttgct

SEQ ID NO: 80735 - DNA, 35 bp, Artificial Sequence
  Synthetic oligonucleotide
tgtgcggtcaaaaaattggtcgttgggagggtggt

SEQ ID NO: 80736 - DNA, 35 bp, Artificial Sequence
  Synthetic oligonucleotide
gataagtcccgccttccccacccgcatcgcttggt

SEQ ID NO: 80737 - DNA, 35 bp, Artificial Sequence
  Synthetic oligonucleotide
gcaagcgcagaggggggtggtggtgctcagtgtgt

SEQ ID NO: 80738 - DNA, 36 bp, Artificial Sequence
  Synthetic oligonucleotide
gttcatacgaccccctggagacacctcctactgctt

SEQ ID NO: 80739 - DNA, 35 bp, Artificial Sequence
  Synthetic oligonucleotide
tgagaaaggtaggcctgggggtactgcagtgggtt

SEQ ID NO: 80740 - DNA, 35 bp, Artificial Sequence
  Synthetic oligonucleotide
atcgcaccagtataaaagggggttgggtgactgtt

SEQ ID NO: 80741 - DNA, 35 bp, Artificial Sequence
  Synthetic oligonucleotide
ttgacccgaccgctttcactgttacttcctaattt

SEQ ID NO: 80742 - DNA, 35 bp, Artificial Sequence
  Synthetic oligonucleotide
acgcccaccgcattttaacccaagcccggctgttt

SEQ ID NO: 80743 - DNA, 35 bp, Artificial Sequence
  Synthetic oligonucleotide
tcacgcatggcaccttgccctactcacaaactttt

SEQ ID NO: 80744 - DNA, 36 bp, Artificial Sequence
  Synthetic oligonucleotide
atacccaccgcaccatgaaatatggtcgaaagaaaa

SEQ ID NO: 80745 - DNA, 35 bp, Artificial Sequence
  Synthetic oligonucleotide
ttgatgtcgttgtgtactttctttgtgccatccaa

SEQ ID NO: 80746 - DNA, 36 bp, Artificial Sequence
  Synthetic oligonucleotide
gggaccaccttacttacgcgcctctgtaggttccaa

SEQ ID NO: 80747 - DNA, 36 bp, Artificial Sequence
  Synthetic oligonucleotide
gagcaccctcaattataaactcttctccaatgcgaa

SEQ ID NO: 80748 - DNA, 36 bp, Artificial Sequence
  Synthetic oligonucleotide
taacaacacagacaggacggccagggcgaggtcgaa

SEQ ID NO: 80749 - DNA, 36 bp, Artificial Sequence
  Synthetic oligonucleotide
tgatccgtgtcactccgcaccaaggccctgttcgaa

SEQ ID NO: 80750 - DNA, 36 bp, Artificial Sequence
  Synthetic oligonucleotide
gagcaaacacgccacgcctcacttaataacacataa

SEQ ID NO: 80751 - DNA, 36 bp, Artificial Sequence
  Synthetic oligonucleotide
gtaggcccgggagacaggtaagagcgaatgtggtaa

SEQ ID NO: 80752 - DNA, 36 bp, Artificial Sequence
  Synthetic oligonucleotide
atgccaccacttcggatctaacaccgcattcaaaca

SEQ ID NO: 80753 - DNA, 36 bp, Artificial Sequence
  Synthetic oligonucleotide
acgccaatcggaggtagcgcacttcttttcttgaca

SEQ ID NO: 80754 - DNA, 35 bp, Artificial Sequence
  Synthetic oligonucleotide
ttgacccacttatgataaaggtcgcctgggataca

SEQ ID NO: 80755 - DNA, 36 bp, Artificial Sequence
  Synthetic oligonucleotide
tccctgcaattcactcaaatcttgttcaagccacca

SEQ ID NO: 80756 - DNA, 36 bp, Artificial Sequence
  Synthetic oligonucleotide
gctactagacctcatgctcctttgacgtactgacca

SEQ ID NO: 80757 - DNA, 36 bp, Artificial Sequence
  Synthetic oligonucleotide
caagacgcatgactgctatgcccttcacgtacccca

SEQ ID NO: 80758 - DNA, 35 bp, Artificial Sequence
  Synthetic oligonucleotide
gctgcttagatctgtgtccccttctttcgctgcca

SEQ ID NO: 80759 - DNA, 36 bp, Artificial Sequence
  Synthetic oligonucleotide
aaggtcctgttgcagcctattacgctacattttcca

SEQ ID NO: 80760 - DNA, 35 bp, Artificial Sequence
  Synthetic oligonucleotide
tcacgcgaacgcccctatggttacccgtctcatca

SEQ ID NO: 80761 - DNA, 35 bp, Artificial Sequence
  Synthetic oligonucleotide
tgacgggtgggaagggacgcaaagatcggggctca

SEQ ID NO: 80762 - DNA, 35 bp, Artificial Sequence
  Synthetic oligonucleotide
atacattcgctggaattctgtaagctctactctca

SEQ ID NO: 80763 - DNA, 36 bp, Artificial Sequence
  Synthetic oligonucleotide
gtccccactataaccgtatcagcaggactaccttca

SEQ ID NO: 80764 - DNA, 37 bp, Artificial Sequence
  Synthetic oligonucleotide
tctccaccatccacgaaatgactcgccatcgccgaga

SEQ ID NO: 80765 - DNA, 37 bp, Artificial Sequence
  Synthetic oligonucleotide
ggttggggggactgcaagatagagatgacgagggaga

SEQ ID NO: 80766 - DNA, 37 bp, Artificial Sequence
  Synthetic oligonucleotide
gataacaccacggattgaaggacgatggcgggggaga

SEQ ID NO: 80767 - DNA, 37 bp, Artificial Sequence
  Synthetic oligonucleotide
gcatacaccgcctatcgggatcccagttaaacataga

SEQ ID NO: 80768 - DNA, 37 bp, Artificial Sequence
  Synthetic oligonucleotide
aatgacgcgggcgggtgcggggggataagtctcacga

SEQ ID NO: 80769 - DNA, 37 bp, Artificial Sequence
  Synthetic oligonucleotide
tgaatggggaggaaaggtataattcggaggaggacga

SEQ ID NO: 80770 - DNA, 37 bp, Artificial Sequence
  Synthetic oligonucleotide
attgccgcagatctccttatatatcctcatgctacga

SEQ ID NO: 80771 - DNA, 37 bp, Artificial Sequence
  Synthetic oligonucleotide
gtacacgcgtaggacaatcaccgagcccagaccccga

SEQ ID NO: 80772 - DNA, 37 bp, Artificial Sequence
  Synthetic oligonucleotide
gatgccatgcaacctcgcctcctatcgagacatccga

SEQ ID NO: 80773 - DNA, 37 bp, Artificial Sequence
  Synthetic oligonucleotide
atgtgcctacccggcaagttccatctcatttcagcga

SEQ ID NO: 80774 - DNA, 37 bp, Artificial Sequence
  Synthetic oligonucleotide
aggaaacatcacgttcggcatcctccaccattatcga

SEQ ID NO: 80775 - DNA, 37 bp, Artificial Sequence
  Synthetic oligonucleotide
ttcccgcgcagaaatcgttgtaatgcccactattcga

SEQ ID NO: 80776 - DNA, 36 bp, Artificial Sequence
  Synthetic oligonucleotide
aagccaggcccgctctctacgaaattagtccttcga

SEQ ID NO: 80777 - DNA, 36 bp, Artificial Sequence
  Synthetic oligonucleotide
gtgatgtccgcccactatcaacacctactcccagga

SEQ ID NO: 80778 - DNA, 37 bp, Artificial Sequence
  Synthetic oligonucleotide
ttggagccgcaaagactttcacaacagcagtatagga

SEQ ID NO: 80779 - DNA, 37 bp, Artificial Sequence
  Synthetic oligonucleotide
gacgtgcgacaggggcttcaagggggtatggggcgga

SEQ ID NO: 80780 - DNA, 37 bp, Artificial Sequence
  Synthetic oligonucleotide
gatgcagggaccacggtggcggggttgaaggatcgga

SEQ ID NO: 80781 - DNA, 36 bp, Artificial Sequence
  Synthetic oligonucleotide
gtggtgtggtgagtagcgaagggtgccggggaggga

SEQ ID NO: 80782 - DNA, 37 bp, Artificial Sequence
  Synthetic oligonucleotide
ccaacggggggagaagcgagggtaaaattgatatgga

SEQ ID NO: 80783 - DNA, 37 bp, Artificial Sequence
  Synthetic oligonucleotide
gtgagggggtggtgtggtttggcgtgcgtcctaatga

SEQ ID NO: 80784 - DNA, 37 bp, Artificial Sequence
  Synthetic oligonucleotide
tagtgctgtcggagggccacaggaggtggaaacatga

SEQ ID NO: 80785 - DNA, 38 bp, Artificial Sequence
  Synthetic oligonucleotide
aatgactggtctgcagggaggggcgaagggggagatga

SEQ ID NO: 80786 - DNA, 37 bp, Artificial Sequence
  Synthetic oligonucleotide
actctccccccgcacatggtcgtaggtccactgatga

SEQ ID NO: 80787 - DNA, 38 bp, Artificial Sequence
  Synthetic oligonucleotide
aatcatcacgtgttgtcgccgccattaccgccctatga

SEQ ID NO: 80788 - DNA, 38 bp, Artificial Sequence
  Synthetic oligonucleotide
ttgatgtgccagtgtacgtccccatatgcttcaactga

SEQ ID NO: 80789 - DNA, 38 bp, Artificial Sequence
  Synthetic oligonucleotide
atcaccgctgccaatcaagctgcttcataccccactga

SEQ ID NO: 80790 - DNA, 38 bp, Artificial Sequence
  Synthetic oligonucleotide
aaccgcacccctggacacaataggataaccgcacctga

SEQ ID NO: 80791 - DNA, 38 bp, Artificial Sequence
  Synthetic oligonucleotide
agatgcacaatgtcccccctgggcgagcccgcacctga

SEQ ID NO: 80792 - DNA, 35 bp, Artificial Sequence
  Synthetic oligonucleotide
agcccggacccaagaatatacgctatctgacctga

SEQ ID NO: 80793 - DNA, 37 bp, Artificial Sequence
  Synthetic oligonucleotide
gcatgattccggcctccgatctccaagggtaccctga

SEQ ID NO: 80794 - DNA, 38 bp, Artificial Sequence
  Synthetic oligonucleotide
ttgttagctacctgctcctctgccagcttttaccctga

SEQ ID NO: 80795 - DNA, 38 bp, Artificial Sequence
  Synthetic oligonucleotide
atgccacccgttctcgaagttcccaatggattgcctga

SEQ ID NO: 80796 - DNA, 38 bp, Artificial Sequence
  Synthetic oligonucleotide
acgatccacgtgcatcccaatttctggtacagtcctga

SEQ ID NO: 80797 - DNA, 37 bp, Artificial Sequence
  Synthetic oligonucleotide
tctcacccgcacttatgtttgtgccaatctttcctga

SEQ ID NO: 80798 - DNA, 38 bp, Artificial Sequence
  Synthetic oligonucleotide
taccaccaagctctgcccttcttagtgccttttgctga

SEQ ID NO: 80799 - DNA, 36 bp, Artificial Sequence
  Synthetic oligonucleotide
gccacacctgttctcaatacggtcctctcaaagtga

SEQ ID NO: 80800 - DNA, 38 bp, Artificial Sequence
  Synthetic oligonucleotide
ttcgcaagaaacgtccgagcagtttacttgagtagtga

SEQ ID NO: 80801 - DNA, 38 bp, Artificial Sequence
  Synthetic oligonucleotide
gcggaggaaagaaaaggctcatgagaaggccaccgtga

SEQ ID NO: 80802 - DNA, 38 bp, Artificial Sequence
  Synthetic oligonucleotide
actcaccagtccttgcgcccagatatttctctccgtga

SEQ ID NO: 80803 - DNA, 38 bp, Artificial Sequence
  Synthetic oligonucleotide
gcatgtgcggtagaccaagggagggacaaggggcgtga

SEQ ID NO: 80804 - DNA, 38 bp, Artificial Sequence
  Synthetic oligonucleotide
gacacagtgagtgtctttggagtcaacttcttgcgtga

SEQ ID NO: 80805 - DNA, 37 bp, Artificial Sequence
  Synthetic oligonucleotide
gatggcgtataggaggagaaaaagagggtgaatgtga

SEQ ID NO: 80806 - DNA, 38 bp, Artificial Sequence
  Synthetic oligonucleotide
ttgaatgggtggggtgtggtaagcaggatcatatgtga

SEQ ID NO: 80807 - DNA, 38 bp, Artificial Sequence
  Synthetic oligonucleotide
gatagcgcagaatcggagaccagggagaagggcattga

SEQ ID NO: 80808 - DNA, 37 bp, Artificial Sequence
  Synthetic oligonucleotide
atgaccctggcgccgatcccgcatctccgacgcttga

SEQ ID NO: 80809 - DNA, 38 bp, Artificial Sequence
  Synthetic oligonucleotide
agcgccccggcgctgtcgatcacaatcttcccgcttga

SEQ ID NO: 80810 - DNA, 37 bp, Artificial Sequence
  Synthetic oligonucleotide
ttaccccgccgtagtttcttcgcctaccaaaagttga

SEQ ID NO: 80811 - DNA, 36 bp, Artificial Sequence
  Synthetic oligonucleotide
tgtcaaccccctatacattaacaggactccagttga

SEQ ID NO: 80812 - DNA, 38 bp, Artificial Sequence
  Synthetic oligonucleotide
agtgctgcccagacagaagggggaggtacttgagttga

SEQ ID NO: 80813 - DNA, 36 bp, Artificial Sequence
  Synthetic oligonucleotide
gtcaccccaggcgtcaagagttagggcgagatttga

SEQ ID NO: 80814 - DNA, 38 bp, Artificial Sequence
  Synthetic oligonucleotide
ttcacgcacaccgtctatcgtccgtagacgacttttga

SEQ ID NO: 80815 - DNA, 38 bp, Artificial Sequence
  Synthetic oligonucleotide
tactggagtgggcaggggggacgagcgcttacttttga

SEQ ID NO: 80816 - DNA, 35 bp, Artificial Sequence
  Synthetic oligonucleotide
tcttgtcgatgtcgccctatcttgcgcccccacta

SEQ ID NO: 80817 - DNA, 36 bp, Artificial Sequence
  Synthetic oligonucleotide
gttgcgccgaccccttctagcttagaccttacctta

SEQ ID NO: 80818 - DNA, 36 bp, Artificial Sequence
  Synthetic oligonucleotide
gcctggcccccgacgcttcgccttttttgctgttta

SEQ ID NO: 80819 - DNA, 35 bp, Artificial Sequence
  Synthetic oligonucleotide
atcgacaaccgattcatggccccaagttgctcaac

SEQ ID NO: 80820 - DNA, 35 bp, Artificial Sequence
  Synthetic oligonucleotide
tgcgtacaccctgcctcggggccacggaccaatac

SEQ ID NO: 80821 - DNA, 35 bp, Artificial Sequence
  Synthetic oligonucleotide
tatcaatgcgcacctgccgaaacgccttcccatac

SEQ ID NO: 80822 - DNA, 35 bp, Artificial Sequence
  Synthetic oligonucleotide
gccactatgagtgtcgttctccgacatttcactac

SEQ ID NO: 80823 - DNA, 35 bp, Artificial Sequence
  Synthetic oligonucleotide
ggagccgaagggcatacagcgtgccactactttac

SEQ ID NO: 80824 - DNA, 35 bp, Artificial Sequence
  Synthetic oligonucleotide
gactcaccttgtgtatggcttatgtcctgctttac

SEQ ID NO: 80825 - DNA, 35 bp, Artificial Sequence
  Synthetic oligonucleotide
aagtgcgatcgtacaaaattcctgtctatcacgcc

SEQ ID NO: 80826 - DNA, 35 bp, Artificial Sequence
  Synthetic oligonucleotide
ggtgctcctcctcatgtgctaatcccatgttcgcc

SEQ ID NO: 80827 - DNA, 35 bp, Artificial Sequence
  Synthetic oligonucleotide
acatgtgctgacccgccacgttaagtagccgatcc

SEQ ID NO: 80828 - DNA, 35 bp, Artificial Sequence
  Synthetic oligonucleotide
agtgacccgcacgacctgactctggtagcatatcc

SEQ ID NO: 80829 - DNA, 35 bp, Artificial Sequence
  Synthetic oligonucleotide
aagggccgttgcctgaagttcgtatcgttctctcc

SEQ ID NO: 80830 - DNA, 35 bp, Artificial Sequence
  Synthetic oligonucleotide
gccaacggcatttggttacttctctctttctctcc

SEQ ID NO: 80831 - DNA, 35 bp, Artificial Sequence
  Synthetic oligonucleotide
tccctctctggtctcttggtcaagaccgcatgagc

SEQ ID NO: 80832 - DNA, 35 bp, Artificial Sequence
  Synthetic oligonucleotide
gagacgttggattgcgctccgattcctgttgtcgc

SEQ ID NO: 80833 - DNA, 35 bp, Artificial Sequence
  Synthetic oligonucleotide
gcttccacgcgacctttctcccccccttctgttgc

SEQ ID NO: 80834 - DNA, 35 bp, Artificial Sequence
  Synthetic oligonucleotide
acttgcacacaccctttgtggttcccaagcatatc

SEQ ID NO: 80835 - DNA, 35 bp, Artificial Sequence
  Synthetic oligonucleotide
tttgtgcggtcttagccgtctcctcttccaccctc

SEQ ID NO: 80836 - DNA, 35 bp, Artificial Sequence
  Synthetic oligonucleotide
gcaaagtcaccaggatcgaggtcctgttttgcctc

SEQ ID NO: 80837 - DNA, 35 bp, Artificial Sequence
  Synthetic oligonucleotide
acactgcctcaccttatatactattgtcatcggtc

SEQ ID NO: 80838 - DNA, 35 bp, Artificial Sequence
  Synthetic oligonucleotide
acctcacctgtccatttggccacttcgtttcattc

SEQ ID NO: 80839 - DNA, 35 bp, Artificial Sequence
  Synthetic oligonucleotide
atgacacgtctcgtcgtccccctgctggccgattc

SEQ ID NO: 80840 - DNA, 35 bp, Artificial Sequence
  Synthetic oligonucleotide
tcctgacccgccacacatgtatttggtcgatgttc

SEQ ID NO: 80841 - DNA, 35 bp, Artificial Sequence
  Synthetic oligonucleotide
gaccggactcgctagtaagaaaagcacagtgaaag

SEQ ID NO: 80842 - DNA, 35 bp, Artificial Sequence
  Synthetic oligonucleotide
gattggtcaccataattccatcttcgccactcacg

SEQ ID NO: 80843 - DNA, 35 bp, Artificial Sequence
  Synthetic oligonucleotide
gaggcctgacccttgctgtactcaccttgctcacg

SEQ ID NO: 80844 - DNA, 35 bp, Artificial Sequence
  Synthetic oligonucleotide
aacatgctacctgggggatccgccctaacctgacg

SEQ ID NO: 80845 - DNA, 35 bp, Artificial Sequence
  Synthetic oligonucleotide
gccaacctcggtcttagtataacttttattacccg

SEQ ID NO: 80846 - DNA, 35 bp, Artificial Sequence
  Synthetic oligonucleotide
gctgaccccgcgtgtgccatctattgcgtgatgcg

SEQ ID NO: 80847 - DNA, 35 bp, Artificial Sequence
  Synthetic oligonucleotide
acacccacgcgatttgactctccgtcattgctctg

SEQ ID NO: 80848 - DNA, 35 bp, Artificial Sequence
  Synthetic oligonucleotide
tagtccaccacattcaaatagtcacaggtctcgtg

SEQ ID NO: 80849 - DNA, 35 bp, Artificial Sequence
  Synthetic oligonucleotide
atgctgcaggtagaagacggaagtaagggtaggtg

SEQ ID NO: 80850 - DNA, 35 bp, Artificial Sequence
  Synthetic oligonucleotide
accgacggtctggtcgatctatacctcgtttcttg

SEQ ID NO: 80851 - DNA, 35 bp, Artificial Sequence
  Synthetic oligonucleotide
cactcaatggcctgtgccgtttgaaagacagacat

SEQ ID NO: 80852 - DNA, 35 bp, Artificial Sequence
  Synthetic oligonucleotide
gcccgcatgtgcgccaaacttttaaatcgtgtcat

SEQ ID NO: 80853 - DNA, 35 bp, Artificial Sequence
  Synthetic oligonucleotide
tactcgacgtagttgctaacattgccggttcttat

SEQ ID NO: 80854 - DNA, 35 bp, Artificial Sequence
  Synthetic oligonucleotide
gtaccccgggcctaggtgcactcgcatcaaccact

SEQ ID NO: 80855 - DNA, 35 bp, Artificial Sequence
  Synthetic oligonucleotide
gacccgcctaaccggtaccccaagggaatggcact

SEQ ID NO: 80856 - DNA, 35 bp, Artificial Sequence
  Synthetic oligonucleotide
gactcaatcgttgtaccgagcctttcgacctacct

SEQ ID NO: 80857 - DNA, 35 bp, Artificial Sequence
  Synthetic oligonucleotide
gcaaggtcatctcccgcaactctttcaccgctcct

SEQ ID NO: 80858 - DNA, 35 bp, Artificial Sequence
  Synthetic oligonucleotide
gacatgcacctcgtgaatggaatctaaaccaatct

SEQ ID NO: 80859 - DNA, 35 bp, Artificial Sequence
  Synthetic oligonucleotide
agtggcaaactacttcgcatgggactcaccgatct

SEQ ID NO: 80860 - DNA, 35 bp, Artificial Sequence
  Synthetic oligonucleotide
gttcgcctgggcgtacaattagaatccatttctct

SEQ ID NO: 80861 - DNA, 35 bp, Artificial Sequence
  Synthetic oligonucleotide
atgacaagcgattgctcgtttactatgggcactgt

SEQ ID NO: 80862 - DNA, 35 bp, Artificial Sequence
  Synthetic oligonucleotide
gagccacacttgagtcctccatcactcattcctgt

SEQ ID NO: 80863 - DNA, 35 bp, Artificial Sequence
  Synthetic oligonucleotide
acatcgccgcgattactttgcgaagtgaaaccctt

SEQ ID NO: 80864 - DNA, 35 bp, Artificial Sequence
  Synthetic oligonucleotide
agagtgaggtggaggtgtgaacaatgtttgcgctt

SEQ ID NO: 80865 - DNA, 35 bp, Artificial Sequence
  Synthetic oligonucleotide
agattgggggggcggggtcattgctgtcacgggtt

SEQ ID NO: 80866 - DNA, 35 bp, Artificial Sequence
  Synthetic oligonucleotide
tcgttgccaaccaccaagagggccatttgattttt

SEQ ID NO: 80867 - DNA, 35 bp, Artificial Sequence
  Synthetic oligonucleotide
ttcaacatccgctcgtattggcacgtctttcggaa

SEQ ID NO: 80868 - DNA, 38 bp, Artificial Sequence
  Synthetic oligonucleotide
gccgtgcatcacacactctgatatgacttggccactaa

SEQ ID NO: 80869 - DNA, 36 bp, Artificial Sequence
  Synthetic oligonucleotide
tagccctctcacttttatctggccgttcttttttaa

SEQ ID NO: 80870 - DNA, 36 bp, Artificial Sequence
  Synthetic oligonucleotide
gtccactgagccgactactccgtctatttcgtaaca

SEQ ID NO: 80871 - DNA, 35 bp, Artificial Sequence
  Synthetic oligonucleotide
acccttacgtcatgccttttctgtcggagtccaca

SEQ ID NO: 80872 - DNA, 35 bp, Artificial Sequence
  Synthetic oligonucleotide
aatccttcagcagattgggtccaatgctatgcaca

SEQ ID NO: 80873 - DNA, 35 bp, Artificial Sequence
  Synthetic oligonucleotide
tgaccctccccagtcccacggggcatctatgcaca

SEQ ID NO: 80874 - DNA, 36 bp, Artificial Sequence
  Synthetic oligonucleotide
ttactccgtacgccttatatccgcctcattgcacca

SEQ ID NO: 80875 - DNA, 36 bp, Artificial Sequence
  Synthetic oligonucleotide
ttgagccctttgtatggtaggttctcgtttgtgcca

SEQ ID NO: 80876 - DNA, 36 bp, Artificial Sequence
  Synthetic oligonucleotide
gtaaacgacggttggctcttgcgtccctggcctcca

SEQ ID NO: 80877 - DNA, 36 bp, Artificial Sequence
  Synthetic oligonucleotide
cttccgagcaatcatgtactttgcatcgactctcca

SEQ ID NO: 80878 - DNA, 36 bp, Artificial Sequence
  Synthetic oligonucleotide
ttaggcaacaaacgggtcgcgcctctagtacttcca

SEQ ID NO: 80879 - DNA, 36 bp, Artificial Sequence
  Synthetic oligonucleotide
tgttgttcccccatggtagtgttctgtccccgtgca

SEQ ID NO: 80880 - DNA, 36 bp, Artificial Sequence
  Synthetic oligonucleotide
tccgtagatccggttgccaatctgcctgtttaatca

SEQ ID NO: 80881 - DNA, 35 bp, Artificial Sequence
  Synthetic oligonucleotide
accctcaccccctcgcacccgccgccttgcactca

SEQ ID NO: 80882 - DNA, 36 bp, Artificial Sequence
  Synthetic oligonucleotide
gctgccgggcaaaggttcctattattttactgctca

SEQ ID NO: 80883 - DNA, 36 bp, Artificial Sequence
  Synthetic oligonucleotide
gcatcgcgcaatttaattggtccgccgttattctca

SEQ ID NO: 80884 - DNA, 34 bp, Artificial Sequence
  Synthetic oligonucleotide
gcccacagcctctcttacgttcctggttttctca

SEQ ID NO: 80885 - DNA, 37 bp, Artificial Sequence
  Synthetic oligonucleotide
gggaatgccaccagcccctcatcgtaccagactacga

SEQ ID NO: 80886 - DNA, 37 bp, Artificial Sequence
  Synthetic oligonucleotide
tcctatgcgcagataccgatggggccctcatttacga

SEQ ID NO: 80887 - DNA, 36 bp, Artificial Sequence
  Synthetic oligonucleotide
atctcatccaccgaatgaaatgtagaccaaacccga

SEQ ID NO: 80888 - DNA, 37 bp, Artificial Sequence
  Synthetic oligonucleotide
gcacgaggtagagtccaatttatatttgcccccccga

SEQ ID NO: 80889 - DNA, 37 bp, Artificial Sequence
  Synthetic oligonucleotide
gtttccgaccggataagcccatgctgccttcgcccga

SEQ ID NO: 80890 - DNA, 36 bp, Artificial Sequence
  Synthetic oligonucleotide
acacccgacataactggctgcccatgaacacgccga

SEQ ID NO: 80891 - DNA, 36 bp, Artificial Sequence
  Synthetic oligonucleotide
tacgatgttcataccgacgatctccttcactgccga

SEQ ID NO: 80892 - DNA, 36 bp, Artificial Sequence
  Synthetic oligonucleotide
gtccgaccagccttggcctcacacacgaagttgcga

SEQ ID NO: 80893 - DNA, 37 bp, Artificial Sequence
  Synthetic oligonucleotide
tgaccggtagtcaatgtgaggtggggaggacgctcga

SEQ ID NO: 80894 - DNA, 37 bp, Artificial Sequence
  Synthetic oligonucleotide
atgctgacgcgataccccacactggaggacatgtcga

SEQ ID NO: 80895 - DNA, 38 bp, Artificial Sequence
  Synthetic oligonucleotide
acctgccaggcacttttgctgtaccgttaacttttcga

SEQ ID NO: 80896 - DNA, 37 bp, Artificial Sequence
  Synthetic oligonucleotide
aggtggtggggtgtggtaaagtggtggtgggtgagga

SEQ ID NO: 80897 - DNA, 37 bp, Artificial Sequence
  Synthetic oligonucleotide
atgggttgggtagagggacgggggggaagtgttagga

SEQ ID NO: 80898 - DNA, 37 bp, Artificial Sequence
  Synthetic oligonucleotide
actgacggggcgatggaattgaagctgagtaaacgga

SEQ ID NO: 80899 - DNA, 37 bp, Artificial Sequence
  Synthetic oligonucleotide
aattgacgaaagaaggcaaatgggtggagtggccgga

SEQ ID NO: 80900 - DNA, 36 bp, Artificial Sequence
  Synthetic oligonucleotide
gggaaggggcactgggagagaaatatgaggatcgga

SEQ ID NO: 80901 - DNA, 37 bp, Artificial Sequence
  Synthetic oligonucleotide
gatgaaagtacaggagtaaggacgggtttaaagggga

SEQ ID NO: 80902 - DNA, 37 bp, Artificial Sequence
  Synthetic oligonucleotide
atgcaccagggtggaaggcctgagatcctggtgggga

SEQ ID NO: 80903 - DNA, 37 bp, Artificial Sequence
  Synthetic oligonucleotide
aatccatacgggcgattggcaatcttgaacactggga

SEQ ID NO: 80904 - DNA, 37 bp, Artificial Sequence
  Synthetic oligonucleotide
gtcgtgctaaaggtagtagggggcatgggtaagtgga

SEQ ID NO: 80905 - DNA, 37 bp, Artificial Sequence
  Synthetic oligonucleotide
ttgatggggggcaagggacgggtggatcgggtgtgga

SEQ ID NO: 80906 - DNA, 38 bp, Artificial Sequence
  Synthetic oligonucleotide
gtcaccactcatttgaatcggaactggaatacgaatga

SEQ ID NO: 80907 - DNA, 38 bp, Artificial Sequence
  Synthetic oligonucleotide
tccaagccatgttccgtaccccgtctgtccatacatga

SEQ ID NO: 80908 - DNA, 37 bp, Artificial Sequence
  Synthetic oligonucleotide
gagggaaccaccgctcactgagtgccacctgccatga

SEQ ID NO: 80909 - DNA, 38 bp, Artificial Sequence
  Synthetic oligonucleotide
gaagcgcgtttaggaaggacacggtggtgggatcatga

SEQ ID NO: 80910 - DNA, 38 bp, Artificial Sequence
  Synthetic oligonucleotide
tcactgcaagctggcacagtacctaaatttgacgatga

SEQ ID NO: 80911 - DNA, 38 bp, Artificial Sequence
  Synthetic oligonucleotide
tgagtcgacgactcatgctctactaccctaacatatga

SEQ ID NO: 80912 - DNA, 38 bp, Artificial Sequence
  Synthetic oligonucleotide
gacctcctgagctgattatctcgatagcatggctatga

SEQ ID NO: 80913 - DNA, 38 bp, Artificial Sequence
  Synthetic oligonucleotide
tcgcccccgggcaagactgcttcatattcaaccactga

SEQ ID NO: 80914 - DNA, 37 bp, Artificial Sequence
  Synthetic oligonucleotide
accaccgcccgcgtctatcaccctcgtctttccctga

SEQ ID NO: 80915 - DNA, 38 bp, Artificial Sequence
  Synthetic oligonucleotide
ggggggagggtggtgcttggctaatccggggatcctga

SEQ ID NO: 80916 - DNA, 37 bp, Artificial Sequence
  Synthetic oligonucleotide
tccctccctccgccgccgaagcagaacgccaagctga

SEQ ID NO: 80917 - DNA, 38 bp, Artificial Sequence
  Synthetic oligonucleotide
tagggagaggggcattggggtagggaaggtacggctga

SEQ ID NO: 80918 - DNA, 38 bp, Artificial Sequence
  Synthetic oligonucleotide
tgttcgtcacgggacttaatctactgccctcttgctga

SEQ ID NO: 80919 - DNA, 37 bp, Artificial Sequence
  Synthetic oligonucleotide
tgacctgtcccccggcacttatttgcccatcacgtga

SEQ ID NO: 80920 - DNA, 35 bp, Artificial Sequence
  Synthetic oligonucleotide
gtgattccactgggccctatctgacctccccgtga

SEQ ID NO: 80921 - DNA, 38 bp, Artificial Sequence
  Synthetic oligonucleotide
tcccccagccggcacgcatgttttcctacgatccgtga

SEQ ID NO: 80922 - DNA, 38 bp, Artificial Sequence
  Synthetic oligonucleotide
gctgactgggagaaggggtggtgaattgggttcggtga

SEQ ID NO: 80923 - DNA, 38 bp, Artificial Sequence
  Synthetic oligonucleotide
tactctgcccatttgacttaacactgtctctgctgtga

SEQ ID NO: 80924 - DNA, 38 bp, Artificial Sequence
  Synthetic oligonucleotide
acacacgtcatcacactgcatagatcgattttgtgtga

SEQ ID NO: 80925 - DNA, 38 bp, Artificial Sequence
  Synthetic oligonucleotide
accgttcggacacatgcgatagccacctgataccttga

SEQ ID NO: 80926 - DNA, 36 bp, Artificial Sequence
  Synthetic oligonucleotide
ccactgacccggtctgtctcactaagcactccttga

SEQ ID NO: 80927 - DNA, 37 bp, Artificial Sequence
  Synthetic oligonucleotide
acccatcgcatcttccgttgcgcgtactccatcttga

SEQ ID NO: 80928 - DNA, 38 bp, Artificial Sequence
  Synthetic oligonucleotide
tccatgctcacttggccgttatcgaagaattcttttga

SEQ ID NO: 80929 - DNA, 35 bp, Artificial Sequence
  Synthetic oligonucleotide
atgcgttggcggacaagcaaacaaggaagacaata

SEQ ID NO: 80930 - DNA, 36 bp, Artificial Sequence
  Synthetic oligonucleotide
acacgtggatccgcgggtaaggaagagcaggacata

SEQ ID NO: 80931 - DNA, 36 bp, Artificial Sequence
  Synthetic oligonucleotide
ttcactgtcaccacactttcatctccgccggacata

SEQ ID NO: 80932 - DNA, 35 bp, Artificial Sequence
  Synthetic oligonucleotide
tagaccaaccctccaagaacctgcgtgcttacata

SEQ ID NO: 80933 - DNA, 36 bp, Artificial Sequence
  Synthetic oligonucleotide
atgccgtcccctctgcattccccacactgggtcata

SEQ ID NO: 80934 - DNA, 35 bp, Artificial Sequence
  Synthetic oligonucleotide
tgacgcaatgcattgcgcgaatacttttgctacta

SEQ ID NO: 80935 - DNA, 35 bp, Artificial Sequence
  Synthetic oligonucleotide
acctgtgggcacaatgtacgcaaagccatctccta

SEQ ID NO: 80936 - DNA, 36 bp, Artificial Sequence
  Synthetic oligonucleotide
atccatgccattgtaaagcccgtcccgtattcagta

SEQ ID NO: 80937 - DNA, 35 bp, Artificial Sequence
  Synthetic oligonucleotide
tcagtccagggtggggaaatggagttgtcttagta

SEQ ID NO: 80938 - DNA, 36 bp, Artificial Sequence
  Synthetic oligonucleotide
aatccactcccgaacaggtgccaacgcgggttggta

SEQ ID NO: 80939 - DNA, 35 bp, Artificial Sequence
  Synthetic oligonucleotide
gtgtgaccacagcccgagccaattatgcttagtta

SEQ ID NO: 80940 - DNA, 36 bp, Artificial Sequence
  Synthetic oligonucleotide
acaacactacatgcctctgttcgcagccaagtttta

SEQ ID NO: 80941 - DNA, 36 bp, Artificial Sequence
  Synthetic oligonucleotide
agccggggcccacgaactaatccagcactttagaac

SEQ ID NO: 80942 - DNA, 35 bp, Artificial Sequence
  Synthetic oligonucleotide
atgtaccatcgctgatcttagtctcaatacgtaac

SEQ ID NO: 80943 - DNA, 35 bp, Artificial Sequence
  Synthetic oligonucleotide
gtgcatccctctcggaacgttctcattcctgtaac

SEQ ID NO: 80944 - DNA, 35 bp, Artificial Sequence
  Synthetic oligonucleotide
gactgcctgcatagctcatggccaagattcaccac

SEQ ID NO: 80945 - DNA, 35 bp, Artificial Sequence
  Synthetic oligonucleotide
atctcgccggtcccttatgagtcactccccttcac

SEQ ID NO: 80946 - DNA, 35 bp, Artificial Sequence
  Synthetic oligonucleotide
atggtccaccgattcagcgggcttttttccacgac

SEQ ID NO: 80947 - DNA, 35 bp, Artificial Sequence
  Synthetic oligonucleotide
agtggacgccgtgagccgtctccttggtttcatac

SEQ ID NO: 80948 - DNA, 35 bp, Artificial Sequence
  Synthetic oligonucleotide
actcgacccgtagcacagcacgctggtgcctctac

SEQ ID NO: 80949 - DNA, 35 bp, Artificial Sequence
  Synthetic oligonucleotide
ttcatggggcaggctctgggcatacctctgtctac

SEQ ID NO: 80950 - DNA, 35 bp, Artificial Sequence
  Synthetic oligonucleotide
gaaagtcactgagggggaggaaagggttcaagtac

SEQ ID NO: 80951 - DNA, 35 bp, Artificial Sequence
  Synthetic oligonucleotide
ttagcccattcgttcctgcaatcaggatctcgacc

SEQ ID NO: 80952 - DNA, 35 bp, Artificial Sequence
  Synthetic oligonucleotide
atcccccggcattggatatttccatattctcgacc

SEQ ID NO: 80953 - DNA, 35 bp, Artificial Sequence
  Synthetic oligonucleotide
tgtagcccagcataccctgtttcacactgtccccc

SEQ ID NO: 80954 - DNA, 35 bp, Artificial Sequence
  Synthetic oligonucleotide
gttggcctgtaaatcgtccagaacacgcttctgcc

SEQ ID NO: 80955 - DNA, 35 bp, Artificial Sequence
  Synthetic oligonucleotide
gctgttggtggcacctttggccttgtacgcttgcc

SEQ ID NO: 80956 - DNA, 35 bp, Artificial Sequence
  Synthetic oligonucleotide
gttggacgcgcattggaactagcccgcccgtctcc

SEQ ID NO: 80957 - DNA, 35 bp, Artificial Sequence
  Synthetic oligonucleotide
tctacgcccctcgtcccttagttgaccaacggtcc

SEQ ID NO: 80958 - DNA, 35 bp, Artificial Sequence
  Synthetic oligonucleotide
atcatcacggccactaactgtcgacatcattgtcc

SEQ ID NO: 80959 - DNA, 35 bp, Artificial Sequence
  Synthetic oligonucleotide
tgtgccctcctactccactccgtcaaagcctcggc

SEQ ID NO: 80960 - DNA, 34 bp, Artificial Sequence
  Synthetic oligonucleotide
taatcacccgtgctgaatccctccttgctctggc

SEQ ID NO: 80961 - DNA, 35 bp, Artificial Sequence
  Synthetic oligonucleotide
agtggcgcatttgacccacgatcctctgcctatgc

SEQ ID NO: 80962 - DNA, 35 bp, Artificial Sequence
  Synthetic oligonucleotide
aagctgtcgccttcgacgccgttgccgccccttgc

SEQ ID NO: 80963 - DNA, 35 bp, Artificial Sequence
  Synthetic oligonucleotide
tcccgtctaatagtcgccctcgtgccatccatatc

SEQ ID NO: 80964 - DNA, 35 bp, Artificial Sequence
  Synthetic oligonucleotide
acgctgcttatgcggttctcctggtcctctccgtc

SEQ ID NO: 80965 - DNA, 35 bp, Artificial Sequence
  Synthetic oligonucleotide
agccgctaggtgaatccacgtgccctgccccattc

SEQ ID NO: 80966 - DNA, 35 bp, Artificial Sequence
  Synthetic oligonucleotide
acctacctaagtgtttgctatgggcccatttgttc

SEQ ID NO: 80967 - DNA, 35 bp, Artificial Sequence
  Synthetic oligonucleotide
attcagtgccgctgcacatctattggccctctttc

SEQ ID NO: 80968 - DNA, 35 bp, Artificial Sequence
  Synthetic oligonucleotide
aacgacagacggaggggagccggctcgatgttaag

SEQ ID NO: 80969 - DNA, 35 bp, Artificial Sequence
  Synthetic oligonucleotide
atgtggcgtgggggtggttgtaacggcacttacag

SEQ ID NO: 80970 - DNA, 35 bp, Artificial Sequence
  Synthetic oligonucleotide
tcttcggtacggcctcttcgtcctttagctgcccg

SEQ ID NO: 80971 - DNA, 35 bp, Artificial Sequence
  Synthetic oligonucleotide
gttacgccaatatctgttgctagcttactgttccg

SEQ ID NO: 80972 - DNA, 35 bp, Artificial Sequence
  Synthetic oligonucleotide
atcacttcgacacataacaccaactctctggagcg

SEQ ID NO: 80973 - DNA, 35 bp, Artificial Sequence
  Synthetic oligonucleotide
agttgcggccccctgttgatatatgttctctcgcg

SEQ ID NO: 80974 - DNA, 35 bp, Artificial Sequence
  Synthetic oligonucleotide
ggagacgtgcaagggagagtgaggattgggaaagg

SEQ ID NO: 80975 - DNA, 35 bp, Artificial Sequence
  Synthetic oligonucleotide
acgcatatgaaaaggggtgcaagatggatgaaagg

SEQ ID NO: 80976 - DNA, 35 bp, Artificial Sequence
  Synthetic oligonucleotide
aatcgcccgcctgactctctcccaaaatatggggg

SEQ ID NO: 80977 - DNA, 35 bp, Artificial Sequence
  Synthetic oligonucleotide
gccgtgacatggaagagataatggcacctgggaat

SEQ ID NO: 80978 - DNA, 35 bp, Artificial Sequence
  Synthetic oligonucleotide
tacacggtgctggggttagcggcatcctgaaccat

SEQ ID NO: 80979 - DNA, 35 bp, Artificial Sequence
  Synthetic oligonucleotide
ggtcaccccagcctggatgtagcaccagcacgcat

SEQ ID NO: 80980 - DNA, 35 bp, Artificial Sequence
  Synthetic oligonucleotide
gccattcttgaccggaggtctgtacaacacatcat

SEQ ID NO: 80981 - DNA, 35 bp, Artificial Sequence
  Synthetic oligonucleotide
gccgccccacacttgcgactggttttccaatctat

SEQ ID NO: 80982 - DNA, 35 bp, Artificial Sequence
  Synthetic oligonucleotide
ccaaccgccacacatgcacccctcacactcggtat

SEQ ID NO: 80983 - DNA, 35 bp, Artificial Sequence
  Synthetic oligonucleotide
gtgcagtccatttagccacacgattacgctcaact

SEQ ID NO: 80984 - DNA, 35 bp, Artificial Sequence
  Synthetic oligonucleotide
gcatcatacctgatgatacgcgttccgaccaacct

SEQ ID NO: 80985 - DNA, 35 bp, Artificial Sequence
  Synthetic oligonucleotide
acaagaggcgattcatccccgaacgacgttaccct

SEQ ID NO: 80986 - DNA, 35 bp, Artificial Sequence
  Synthetic oligonucleotide
tagcagtggtgcctgcatcgttattctcacggcct

SEQ ID NO: 80987 - DNA, 35 bp, Artificial Sequence
  Synthetic oligonucleotide
gctggacatcgctgtccctggttttgcacatcgct

SEQ ID NO: 80988 - DNA, 35 bp, Artificial Sequence
  Synthetic oligonucleotide
taacgcgtaccgtgggcgggttgaaagtcctggct

SEQ ID NO: 80989 - DNA, 35 bp, Artificial Sequence
  Synthetic oligonucleotide
actcgagatcggttggaacacatgtcacatctgct

SEQ ID NO: 80990 - DNA, 35 bp, Artificial Sequence
  Synthetic oligonucleotide
acacatgtcagtgctggttacctttttctaactct

SEQ ID NO: 80991 - DNA, 35 bp, Artificial Sequence
  Synthetic oligonucleotide
tagatgcacgtacggttcctatactctccgccagt

SEQ ID NO: 80992 - DNA, 35 bp, Artificial Sequence
  Synthetic oligonucleotide
gaccatgccctgtggaacatataccgtccctatgt

SEQ ID NO: 80993 - DNA, 35 bp, Artificial Sequence
  Synthetic oligonucleotide
aacgacggggatgcttgcgtcgcctatatgccctt

SEQ ID NO: 80994 - DNA, 35 bp, Artificial Sequence
  Synthetic oligonucleotide
attcgcaggctagactgttcgttttgttggtggtt

SEQ ID NO: 80995 - DNA, 35 bp, Artificial Sequence
  Synthetic oligonucleotide
ggaccatggacccgtgcactcgcttgtacttcttt

SEQ ID NO: 80996 - DNA, 36 bp, Artificial Sequence
  Synthetic oligonucleotide
aacaaaggcgtgcacgactctggcaaagggggaaaa

SEQ ID NO: 80997 - DNA, 35 bp, Artificial Sequence
  Synthetic oligonucleotide
gaacgtcgtcacctggactatccctgcaccttaaa

SEQ ID NO: 80998 - DNA, 35 bp, Artificial Sequence
  Synthetic oligonucleotide
gggagccgcaccgctcttttatgttgccatttaaa

SEQ ID NO: 80999 - DNA, 35 bp, Artificial Sequence
  Synthetic oligonucleotide
ggttgccacctgtcgctccagatcgccctttacaa

SEQ ID NO: 81000 - DNA, 35 bp, Artificial Sequence
  Synthetic oligonucleotide
tccgaccaaccaattgacctgccatctcaagagaa

SEQ ID NO: 81001 - DNA, 35 bp, Artificial Sequence
  Synthetic oligonucleotide
atgtacgccggaagagtggaatgtatgcggtcgaa

SEQ ID NO: 81002 - DNA, 35 bp, Artificial Sequence
  Synthetic oligonucleotide
agtcgacgccccatctccattctgaggccccgtaa

SEQ ID NO: 81003 - DNA, 36 bp, Artificial Sequence
  Synthetic oligonucleotide
tcacgttgaagcgttacgccgatctagcctatcaca

SEQ ID NO: 81004 - DNA, 35 bp, Artificial Sequence
  Synthetic oligonucleotide
gtgctgaaggggcgtggggggcgcaacggtagaca

SEQ ID NO: 81005 - DNA, 36 bp, Artificial Sequence
  Synthetic oligonucleotide
tacgtagggcagactgagggggtttgggaattgaca

SEQ ID NO: 81006 - DNA, 35 bp, Artificial Sequence
  Synthetic oligonucleotide
atctctgcctattcgcaccgggctatcatggtaca

SEQ ID NO: 81007 - DNA, 35 bp, Artificial Sequence
  Synthetic oligonucleotide
tgtatccaaacgaggtcccctgggcacaccaacca

SEQ ID NO: 81008 - DNA, 35 bp, Artificial Sequence
  Synthetic oligonucleotide
gacgactcccgagcggagaggcactgccatcgcca

SEQ ID NO: 81009 - DNA, 36 bp, Artificial Sequence
  Synthetic oligonucleotide
accatcctgtttatgtgcatctcctagctttatcca

SEQ ID NO: 81010 - DNA, 36 bp, Artificial Sequence
  Synthetic oligonucleotide
aaactgacgcgcctgacccctgtaccccatgaagca

SEQ ID NO: 81011 - DNA, 36 bp, Artificial Sequence
  Synthetic oligonucleotide
tagccctgaccgagagggacctcttcactacttgca

SEQ ID NO: 81012 - DNA, 36 bp, Artificial Sequence
  Synthetic oligonucleotide
tcactccgaaggttaattcgcaactcgcatcactca

SEQ ID NO: 81013 - DNA, 36 bp, Artificial Sequence
  Synthetic oligonucleotide
atgtgtctatccggcgcgcaccaacgtttctgctca

SEQ ID NO: 81014 - DNA, 36 bp, Artificial Sequence
  Synthetic oligonucleotide
gcacacagcatccgtcttacaagcgctctctcttca

SEQ ID NO: 81015 - DNA, 36 bp, Artificial Sequence
  Synthetic oligonucleotide
tccccgtaaatgaatttatccgtgccctcagtttca

SEQ ID NO: 81016 - DNA, 37 bp, Artificial Sequence
  Synthetic oligonucleotide
aatgggctgcagtgcacgaggaaggagaggtttcaga

SEQ ID NO: 81017 - DNA, 37 bp, Artificial Sequence
  Synthetic oligonucleotide
agacgctgacgtccaagcgggggataggggtgggaga

SEQ ID NO: 81018 - DNA, 37 bp, Artificial Sequence
  Synthetic oligonucleotide
tcccggggtgtaggttaggtttagggtgggtagtaga

SEQ ID NO: 81019 - DNA, 37 bp, Artificial Sequence
  Synthetic oligonucleotide
tctgagtatagggagcaatgaaagacagagatgacga

SEQ ID NO: 81020 - DNA, 37 bp, Artificial Sequence
  Synthetic oligonucleotide
tagtaggtgcggctagcattcgtgagaggaggtacga

SEQ ID NO: 81021 - DNA, 37 bp, Artificial Sequence
  Synthetic oligonucleotide
gatgcccaactagcctattatcagcactgaaaaccga

SEQ ID NO: 81022 - DNA, 37 bp, Artificial Sequence
  Synthetic oligonucleotide
tcaacttgccggctttgattaccccttctgtaaccga

SEQ ID NO: 81023 - DNA, 35 bp, Artificial Sequence
  Synthetic oligonucleotide
actcacctgcgccctttacgtttgttacttcccga

SEQ ID NO: 81024 - DNA, 37 bp, Artificial Sequence
  Synthetic oligonucleotide
tctcgcccggcgctgcccctccattcgacgtcgccga

SEQ ID NO: 81025 - DNA, 37 bp, Artificial Sequence
  Synthetic oligonucleotide
gaccggtgtgctttttcccctcccgcttatatgccga

SEQ ID NO: 81026 - DNA, 37 bp, Artificial Sequence
  Synthetic oligonucleotide
acttgaccactcattgaatcgtatatctccgctccga

SEQ ID NO: 81027 - DNA, 37 bp, Artificial Sequence
  Synthetic oligonucleotide
gttctgccccgactaatgcagtttgttctatctccga

SEQ ID NO: 81028 - DNA, 37 bp, Artificial Sequence
  Synthetic oligonucleotide
tgcgaccccgcgcgagtgcgatccctcccccttccga

SEQ ID NO: 81029 - DNA, 37 bp, Artificial Sequence
  Synthetic oligonucleotide
atgtcccacatggagcgttacttcatcaatcctgcga

SEQ ID NO: 81030 - DNA, 35 bp, Artificial Sequence
  Synthetic oligonucleotide
aacagtggggggggctggtaacggcgcgagtgcga

SEQ ID NO: 81031 - DNA, 36 bp, Artificial Sequence
  Synthetic oligonucleotide
gatgcggagctctagtgaggaggggacagacgagga

SEQ ID NO: 81032 - DNA, 37 bp, Artificial Sequence
  Synthetic oligonucleotide
tgaaacgtgggggcaaggggggtaggtagagtgagga

SEQ ID NO: 81033 - DNA, 37 bp, Artificial Sequence
  Synthetic oligonucleotide
gtggaaccccccacatgcactcacattcgaagtagga

SEQ ID NO: 81034 - DNA, 35 bp, Artificial Sequence
  Synthetic oligonucleotide
tcctgaaccgttgctctcttgcccaatcccccgga

SEQ ID NO: 81035 - DNA, 37 bp, Artificial Sequence
  Synthetic oligonucleotide
acacaagtgaggcccacgtgaaggagtccggaaggga

SEQ ID NO: 81036 - DNA, 35 bp, Artificial Sequence
  Synthetic oligonucleotide
tgtgagggtgcaattatagaggtcaatgtgaggga

SEQ ID NO: 81037 - DNA, 37 bp, Artificial Sequence
  Synthetic oligonucleotide
gatggacccattgtttgctgaatcgatccctgcggga

SEQ ID NO: 81038 - DNA, 36 bp, Artificial Sequence
  Synthetic oligonucleotide
gagcggtaaatcaagagagggggtagatcggatgga

SEQ ID NO: 81039 - DNA, 37 bp, Artificial Sequence
  Synthetic oligonucleotide
tgagcgggtcacactggtttagggtgggtagagtgga

SEQ ID NO: 81040 - DNA, 37 bp, Artificial Sequence
  Synthetic oligonucleotide
catacgcgggggagctgcagaaatctagcatagatga

SEQ ID NO: 81041 - DNA, 37 bp, Artificial Sequence
  Synthetic oligonucleotide
ggacgggggggcggaggctactttgggatgacgatga

SEQ ID NO: 81042 - DNA, 38 bp, Artificial Sequence
  Synthetic oligonucleotide
gcgcaaggggagcaattatgcaaaagcgggagggatga

SEQ ID NO: 81043 - DNA, 38 bp, Artificial Sequence
  Synthetic oligonucleotide
aatggaggaacgggggacgcggtattgaagcgggatga

SEQ ID NO: 81044 - DNA, 37 bp, Artificial Sequence
  Synthetic oligonucleotide
agtgggggcgacggagtgcggtgtagatggatgatga

SEQ ID NO: 81045 - DNA, 38 bp, Artificial Sequence
  Synthetic oligonucleotide
ttgaacgcccagcaatgtaaaacctaaacaggaactga

SEQ ID NO: 81046 - DNA, 38 bp, Artificial Sequence
  Synthetic oligonucleotide
ttggtaggactctgcctgcgacccaggacaccccctga

SEQ ID NO: 81047 - DNA, 38 bp, Artificial Sequence
  Synthetic oligonucleotide
acagtggctgacatcatgtgccaccctaaatcccctga

SEQ ID NO: 81048 - DNA, 38 bp, Artificial Sequence
  Synthetic oligonucleotide
aagacaggcagatagtcagactgcttcctcccctctga

SEQ ID NO: 81049 - DNA, 38 bp, Artificial Sequence
  Synthetic oligonucleotide
tccgccgccgtgattagccttattcgtagcctttctga

SEQ ID NO: 81050 - DNA, 36 bp, Artificial Sequence
  Synthetic oligonucleotide
gataacccgcctccgaattaccggcactatacgtga

SEQ ID NO: 81051 - DNA, 37 bp, Artificial Sequence
  Synthetic oligonucleotide
gtcgaccatgcattacccgccgataactgactcgtga

SEQ ID NO: 81052 - DNA, 38 bp, Artificial Sequence
  Synthetic oligonucleotide
taacacctacgcccgtgcccttgccgacccctatgtga

SEQ ID NO: 81053 - DNA, 38 bp, Artificial Sequence
  Synthetic oligonucleotide
gaggctgaataaattgcctaacgatcgcccccctgtga

SEQ ID NO: 81054 - DNA, 37 bp, Artificial Sequence
  Synthetic oligonucleotide
aatagccagcacctgcctactcaccgcatttctgtga

SEQ ID NO: 81055 - DNA, 38 bp, Artificial Sequence
  Synthetic oligonucleotide
tctagtccgagccatcggtgcacttacccctccattga

SEQ ID NO: 81056 - DNA, 38 bp, Artificial Sequence
  Synthetic oligonucleotide
taagagtggcgcagggggaatcgggctctgaggattga

SEQ ID NO: 81057 - DNA, 37 bp, Artificial Sequence
  Synthetic oligonucleotide
tctgccaacttgtaaccgacccaccgacatctattga

SEQ ID NO: 81058 - DNA, 38 bp, Artificial Sequence
  Synthetic oligonucleotide
agcaccatctcgaagttcactacaccccaagttattga

SEQ ID NO: 81059 - DNA, 38 bp, Artificial Sequence
  Synthetic oligonucleotide
agtacacgcacattcctagaacctttgtggccacttga

SEQ ID NO: 81060 - DNA, 38 bp, Artificial Sequence
  Synthetic oligonucleotide
accgatgcttagcgtgaacacttactatcctccgttga

SEQ ID NO: 81061 - DNA, 37 bp, Artificial Sequence
  Synthetic oligonucleotide
gaaggcccgtggggggacagtagaacgggaaggttga

SEQ ID NO: 81062 - DNA, 38 bp, Artificial Sequence
  Synthetic oligonucleotide
gacacggcggtagaagctggaggggatgatggatttga

SEQ ID NO: 81063 - DNA, 38 bp, Artificial Sequence
  Synthetic oligonucleotide
aaggtgcgagggtgggaaaatagaggggtgggctttga

SEQ ID NO: 81064 - DNA, 37 bp, Artificial Sequence
  Synthetic oligonucleotide
tccgaccccgcatatttccccagttttccgagtttga

SEQ ID NO: 81065 - DNA, 38 bp, Artificial Sequence
  Synthetic oligonucleotide
gccacggcatgttataccgttctgagcccctggtttga

SEQ ID NO: 81066 - DNA, 35 bp, Artificial Sequence
  Synthetic oligonucleotide
ttcactccggtcggcccacgggtaaccggcccata

SEQ ID NO: 81067 - DNA, 36 bp, Artificial Sequence
  Synthetic oligonucleotide
atcccctgaacctcgcgcccctgaaagggatcacta

SEQ ID NO: 81068 - DNA, 36 bp, Artificial Sequence
  Synthetic oligonucleotide
atgtagtgcaaatgggaatgtgtgggctaggtccta

SEQ ID NO: 81069 - DNA, 36 bp, Artificial Sequence
  Synthetic oligonucleotide
tcgcacgtcttgcgatacgttgctttcattcttcta

SEQ ID NO: 81070 - DNA, 36 bp, Artificial Sequence
  Synthetic oligonucleotide
agcactcacatatttttccacctgccgtatgactta

SEQ ID NO: 81071 - DNA, 35 bp, Artificial Sequence
  Synthetic oligonucleotide
tacgacgtccacatgtgctcgatgccatcgttaac

SEQ ID NO: 81072 - DNA, 35 bp, Artificial Sequence
  Synthetic oligonucleotide
actcaccgcactagaccactctctctgaacatcac

SEQ ID NO: 81073 - DNA, 35 bp, Artificial Sequence
  Synthetic oligonucleotide
ttcatcagccccggcgagttcgtcgtctctctcac

SEQ ID NO: 81074 - DNA, 35 bp, Artificial Sequence
  Synthetic oligonucleotide
tgtgaccacatatactacaccgtgcgttgcacgac

SEQ ID NO: 81075 - DNA, 34 bp, Artificial Sequence
  Synthetic oligonucleotide
gtgtcctcagcatctaaagtctaccgtctgcgac

SEQ ID NO: 81076 - DNA, 35 bp, Artificial Sequence
  Synthetic oligonucleotide
gtcgcccttgcctctcgtctgcatacgcgctctac

SEQ ID NO: 81077 - DNA, 35 bp, Artificial Sequence
  Synthetic oligonucleotide
ggagtacgccctctcatgcgtcagcccgaaaaccc

SEQ ID NO: 81078 - DNA, 35 bp, Artificial Sequence
  Synthetic oligonucleotide
gcccccgacatcgctatgctaactggttgtaaccc

SEQ ID NO: 81079 - DNA, 35 bp, Artificial Sequence
  Synthetic oligonucleotide
acacagcctcggcattacgatcgaaccgtggcccc

SEQ ID NO: 81080 - DNA, 35 bp, Artificial Sequence
  Synthetic oligonucleotide
gcgatcatttcgtctcccttttttaacttggcccc

SEQ ID NO: 81081 - DNA, 35 bp, Artificial Sequence
  Synthetic oligonucleotide
taagacaatctgtccgtttacccgtgcctcaggcc

SEQ ID NO: 81082 - DNA, 35 bp, Artificial Sequence
  Synthetic oligonucleotide
gaatgccgtacaaatcacaccagagtacgttgtcc

SEQ ID NO: 81083 - DNA, 35 bp, Artificial Sequence
  Synthetic oligonucleotide
gccatgttcacagccatgacgagcgtaatgcgagc

SEQ ID NO: 81084 - DNA, 35 bp, Artificial Sequence
  Synthetic oligonucleotide
accacgcagttttgtatgcgtccgaactcacccgc

SEQ ID NO: 81085 - DNA, 35 bp, Artificial Sequence
  Synthetic oligonucleotide
ttgttgccaagctgccactcgtgccttcaccgcgc

SEQ ID NO: 81086 - DNA, 34 bp, Artificial Sequence
  Synthetic oligonucleotide
accgcgaatccccgaatgcgattattctgtgatc

SEQ ID NO: 81087 - DNA, 35 bp, Artificial Sequence
  Synthetic oligonucleotide
tgtctccccggtcctttataacccctcctgcgctc

SEQ ID NO: 81088 - DNA, 35 bp, Artificial Sequence
  Synthetic oligonucleotide
gatagccccgccctgccggctagtttggtttgctc

SEQ ID NO: 81089 - DNA, 35 bp, Artificial Sequence
  Synthetic oligonucleotide
atccacttgcatttccatccgttacgccgagagtc

SEQ ID NO: 81090 - DNA, 35 bp, Artificial Sequence
  Synthetic oligonucleotide
tccattagtaggtcagcctgcgcctctgttcattc

SEQ ID NO: 81091 - DNA, 35 bp, Artificial Sequence
  Synthetic oligonucleotide
tcccgcctattggtgatcgttatcctaagtacttc

SEQ ID NO: 81092 - DNA, 35 bp, Artificial Sequence
  Synthetic oligonucleotide
aacgcgtcaagccttggttctgttatatcctctag

SEQ ID NO: 81093 - DNA, 35 bp, Artificial Sequence
  Synthetic oligonucleotide
gacatgtaaaggtggaagtggggagattagagacg

SEQ ID NO: 81094 - DNA, 35 bp, Artificial Sequence
  Synthetic oligonucleotide
atccgccatactcccctattgacattcctgttacg

SEQ ID NO: 81095 - DNA, 35 bp, Artificial Sequence
  Synthetic oligonucleotide
agccccaatggttatgatctgatctcgcctctccg

SEQ ID NO: 81096 - DNA, 35 bp, Artificial Sequence
  Synthetic oligonucleotide
tgctgggggagggacgtgggagctctgtatgtgcg

SEQ ID NO: 81097 - DNA, 35 bp, Artificial Sequence
  Synthetic oligonucleotide
ttcacccactaattgatattggccggattccttcg

SEQ ID NO: 81098 - DNA, 35 bp, Artificial Sequence
  Synthetic oligonucleotide
gagggagaccgtgggggataggacgctggagcagg

SEQ ID NO: 81099 - DNA, 35 bp, Artificial Sequence
  Synthetic oligonucleotide
accacgacgatggatcgggacaaggggtaaagggg

SEQ ID NO: 81100 - DNA, 35 bp, Artificial Sequence
  Synthetic oligonucleotide
acgccatgggctcgtgttgttctttgattttgggg

SEQ ID NO: 81101 - DNA, 35 bp, Artificial Sequence
  Synthetic oligonucleotide
tagcctcgcgcttacccgttggtactccatctttg

SEQ ID NO: 81102 - DNA, 35 bp, Artificial Sequence
  Synthetic oligonucleotide
gcccccgcctctcccgccttttttcgagttggaat

SEQ ID NO: 81103 - DNA, 35 bp, Artificial Sequence
  Synthetic oligonucleotide
gaggcaccctccattcactagattggcttttccat

SEQ ID NO: 81104 - DNA, 35 bp, Artificial Sequence
  Synthetic oligonucleotide
tagtccttcatgcgtgcctatttgcccctattcat

SEQ ID NO: 81105 - DNA, 35 bp, Artificial Sequence
  Synthetic oligonucleotide
gatgcagtagaacgaggtgggggaaactgagtgat

SEQ ID NO: 81106 - DNA, 35 bp, Artificial Sequence
  Synthetic oligonucleotide
gacgccagaatgtaccttatccctagcacttgtat

SEQ ID NO: 81107 - DNA, 35 bp, Artificial Sequence
  Synthetic oligonucleotide
gatgaaaccccattgcgttctgcgcagtttaacct

SEQ ID NO: 81108 - DNA, 35 bp, Artificial Sequence
  Synthetic oligonucleotide
acacaacgtgacctcgcacaacgggaccaacatct

SEQ ID NO: 81109 - DNA, 35 bp, Artificial Sequence
  Synthetic oligonucleotide
atgacactgggtggggacactgaaggagcacgagt

SEQ ID NO: 81110 - DNA, 35 bp, Artificial Sequence
  Synthetic oligonucleotide
gccctgcctcatgtggtcgccgtttccgttctagt

SEQ ID NO: 81111 - DNA, 35 bp, Artificial Sequence
  Synthetic oligonucleotide
taagggagtgggaagggctcgagagctgttaaggt

SEQ ID NO: 81112 - DNA, 35 bp, Artificial Sequence
  Synthetic oligonucleotide
tcagcccttcttagtatccaccagcctgatgcggt

SEQ ID NO: 81113 - DNA, 35 bp, Artificial Sequence
  Synthetic oligonucleotide
acaccgggacttccgtggacggtgccaatccctgt

SEQ ID NO: 81114 - DNA, 35 bp, Artificial Sequence
  Synthetic oligonucleotide
ttgtgccacctctcgggcctgagccttgtccctgt

SEQ ID NO: 81115 - DNA, 35 bp, Artificial Sequence
  Synthetic oligonucleotide
atacgcgcgatcgccaacacgccgttgacttctgt

SEQ ID NO: 81116 - DNA, 35 bp, Artificial Sequence
  Synthetic oligonucleotide
tcccctgcctccaaacgcctgcatacaactcgtgt

SEQ ID NO: 81117 - DNA, 35 bp, Artificial Sequence
  Synthetic oligonucleotide
gccgcatgaggcaacacccgattgatcgcatactt

SEQ ID NO: 81118 - DNA, 35 bp, Artificial Sequence
  Synthetic oligonucleotide
gtaggacacaaactatggcattacgttaccacctt

SEQ ID NO: 81119 - DNA, 35 bp, Artificial Sequence
  Synthetic oligonucleotide
tctccgtacgagttgcccactattactccctggtt

SEQ ID NO: 81120 - DNA, 35 bp, Artificial Sequence
  Synthetic oligonucleotide
tcaacgacacctatctggggcgctcttgatatttt

SEQ ID NO: 81121 - DNA, 35 bp, Artificial Sequence
  Synthetic oligonucleotide
ggggaaagtgatgaatatagggggatggtggagaa

SEQ ID NO: 81122 - DNA, 36 bp, Artificial Sequence
  Synthetic oligonucleotide
tgtacctccccatttctgcgtccgcgcctctaggaa

SEQ ID NO: 81123 - DNA, 36 bp, Artificial Sequence
  Synthetic oligonucleotide
cacactcacagtgcgcttttcagtactggcccctaa

SEQ ID NO: 81124 - DNA, 36 bp, Artificial Sequence
  Synthetic oligonucleotide
tagccggaaggtgtcccgacccacccaactgaaaca

SEQ ID NO: 81125 - DNA, 36 bp, Artificial Sequence
  Synthetic oligonucleotide
gaccgagcgaggcaaagagagtagtttgaatcaaca

SEQ ID NO: 81126 - DNA, 36 bp, Artificial Sequence
  Synthetic oligonucleotide
acatggagctacccagtgtcagcctgttttaccaca

SEQ ID NO: 81127 - DNA, 35 bp, Artificial Sequence
  Synthetic oligonucleotide
atcactggacacaactgagctgttttctacctaca

SEQ ID NO: 81128 - DNA, 35 bp, Artificial Sequence
  Synthetic oligonucleotide
tttgaccacgtatcaggttttaccctatgctacca

SEQ ID NO: 81129 - DNA, 35 bp, Artificial Sequence
  Synthetic oligonucleotide
gactcgtagtgtagcgtttctattctttgccagca

SEQ ID NO: 81130 - DNA, 36 bp, Artificial Sequence
  Synthetic oligonucleotide
gccacatgcaccgaatgctaatgattctgctacgca

SEQ ID NO: 81131 - DNA, 36 bp, Artificial Sequence
  Synthetic oligonucleotide
gtcattccatccgtgacttctaaggaacgttacgca

SEQ ID NO: 81132 - DNA, 36 bp, Artificial Sequence
  Synthetic oligonucleotide
gtcatgcgccccagtttgccctccattccgctcgca

SEQ ID NO: 81133 - DNA, 36 bp, Artificial Sequence
  Synthetic oligonucleotide
gtgcgagctgatcgcttccttctccgtcatgttgca

SEQ ID NO: 81134 - DNA, 35 bp, Artificial Sequence
  Synthetic oligonucleotide
tgatgagccgagcttgaaacttgccccacctatca

SEQ ID NO: 81135 - DNA, 36 bp, Artificial Sequence
  Synthetic oligonucleotide
ggagctcggtcgataacgcctacctactttttgtca

SEQ ID NO: 81136 - DNA, 37 bp, Artificial Sequence
  Synthetic oligonucleotide
acagccccccaatcttccaaggcgcggtctctttaga

SEQ ID NO: 81137 - DNA, 37 bp, Artificial Sequence
  Synthetic oligonucleotide
gctgggcccacagcaaaatgacgacatccaagcacga

SEQ ID NO: 81138 - DNA, 37 bp, Artificial Sequence
  Synthetic oligonucleotide
tacgaatgaccgcccccgaatcccctgttgtcgacga

SEQ ID NO: 81139 - DNA, 37 bp, Artificial Sequence
  Synthetic oligonucleotide
gaaaccgaccacatgatagagtaagaataagggacga

SEQ ID NO: 81140 - DNA, 37 bp, Artificial Sequence
  Synthetic oligonucleotide
tacgccctccttagtcgttcttcacaactcgatacga

SEQ ID NO: 81141 - DNA, 37 bp, Artificial Sequence
  Synthetic oligonucleotide
gatgggaggaggtgccgattgttatggccggaagcga

SEQ ID NO: 81142 - DNA, 36 bp, Artificial Sequence
  Synthetic oligonucleotide
tcacacgtggaagccatgcagtatctaacatcgcga

SEQ ID NO: 81143 - DNA, 36 bp, Artificial Sequence
  Synthetic oligonucleotide
accaaacgcgttgataagggtggactggtagggcga

SEQ ID NO: 81144 - DNA, 37 bp, Artificial Sequence
  Synthetic oligonucleotide
atcccagccatcccgatgtcctcctcgcggcaatcga

SEQ ID NO: 81145 - DNA, 35 bp, Artificial Sequence
  Synthetic oligonucleotide
gaccaagccggaccaccccattttcatagtgtcga

SEQ ID NO: 81146 - DNA, 37 bp, Artificial Sequence
  Synthetic oligonucleotide
tatccatcgtgactcaccgtgcccactcctaaaagga

SEQ ID NO: 81147 - DNA, 37 bp, Artificial Sequence
  Synthetic oligonucleotide
ttagatcggacagagaggaataccggatagggaagga

SEQ ID NO: 81148 - DNA, 37 bp, Artificial Sequence
  Synthetic oligonucleotide
ggtggagggagggttaacgcggaaagatatcacagga

SEQ ID NO: 81149 - DNA, 33 bp, Artificial Sequence
  Synthetic oligonucleotide
gataaagcccatgaggtggggagggatgacgga

SEQ ID NO: 81150 - DNA, 37 bp, Artificial Sequence
  Synthetic oligonucleotide
gaagggggcttttgtaagggtgggcggaacccgggga

SEQ ID NO: 81151 - DNA, 37 bp, Artificial Sequence
  Synthetic oligonucleotide
aaccctcacatcatattcgcagcctgtttggcatgga

SEQ ID NO: 81152 - DNA, 35 bp, Artificial Sequence
  Synthetic oligonucleotide
gcgcaccacgaccacttcccccgagtactcatgga

SEQ ID NO: 81153 - DNA, 37 bp, Artificial Sequence
  Synthetic oligonucleotide
gcccgtacgctccttctctgtctcgttcctcgatgga

SEQ ID NO: 81154 - DNA, 37 bp, Artificial Sequence
  Synthetic oligonucleotide
tcaagatcacgagctggggggtgaaagggtggctgga

SEQ ID NO: 81155 - DNA, 37 bp, Artificial Sequence
  Synthetic oligonucleotide
tgaggcgtgacgccgccgctccttgtcctcacgtgga

SEQ ID NO: 81156 - DNA, 37 bp, Artificial Sequence
  Synthetic oligonucleotide
gaaaagccaggcagggggaggtgcagttggtggtgga

SEQ ID NO: 81157 - DNA, 37 bp, Artificial Sequence
  Synthetic oligonucleotide
tgttgggggcgtggttaggtcatggaggccatgtgga

SEQ ID NO: 81158 - DNA, 38 bp, Artificial Sequence
  Synthetic oligonucleotide
ttccctcgcgctcctcctgtactagtaatcgggcatga

SEQ ID NO: 81159 - DNA, 35 bp, Artificial Sequence
  Synthetic oligonucleotide
tgatcaaccacatgtacgcctcatcattctgatga

SEQ ID NO: 81160 - DNA, 38 bp, Artificial Sequence
  Synthetic oligonucleotide
gaagatggggccagatggagtatttggaatagatatga

SEQ ID NO: 81161 - DNA, 38 bp, Artificial Sequence
  Synthetic oligonucleotide
gagggatagtgtcggaaggggatgggcacactatatga

SEQ ID NO: 81162 - DNA, 37 bp, Artificial Sequence
  Synthetic oligonucleotide
gcatgggaacgtggggaatggatacagatgtatatga

SEQ ID NO: 81163 - DNA, 38 bp, Artificial Sequence
  Synthetic oligonucleotide
atgggcacagtgctccatcctcttgtttcctagtatga

SEQ ID NO: 81164 - DNA, 38 bp, Artificial Sequence
  Synthetic oligonucleotide
acatgccatggagtgtgaggtacaacggtggtttatga

SEQ ID NO: 81165 - DNA, 38 bp, Artificial Sequence
  Synthetic oligonucleotide
tgtcaagcgcttcatcacacggggccttccaaaactga

SEQ ID NO: 81166 - DNA, 37 bp, Artificial Sequence
  Synthetic oligonucleotide
gcctcaccactgaagcaatacggggttcgattcctga

SEQ ID NO: 81167 - DNA, 38 bp, Artificial Sequence
  Synthetic oligonucleotide
agtaaggggtagggtggggaagtgtgagcgcgggctga

SEQ ID NO: 81168 - DNA, 36 bp, Artificial Sequence
  Synthetic oligonucleotide
atgactgcggcaaggcacatttagggaggggtctga

SEQ ID NO: 81169 - DNA, 38 bp, Artificial Sequence
  Synthetic oligonucleotide
agtggaagaacggtgtacggggaggtatgcgggagtga

SEQ ID NO: 81170 - DNA, 38 bp, Artificial Sequence
  Synthetic oligonucleotide
agatagggcgggggagggtgaacattgttatgccgtga

SEQ ID NO: 81171 - DNA, 37 bp, Artificial Sequence
  Synthetic oligonucleotide
accactccatctagcttgcgtctttcccaatcattga

SEQ ID NO: 81172 - DNA, 38 bp, Artificial Sequence
  Synthetic oligonucleotide
tcgaagaccaccctcgctattctaacaggccctattga

SEQ ID NO: 81173 - DNA, 38 bp, Artificial Sequence
  Synthetic oligonucleotide
gtgggagggggggcgtgaatagtggaacttatacttga

SEQ ID NO: 81174 - DNA, 38 bp, Artificial Sequence
  Synthetic oligonucleotide
tgttacaacttccaccccttgccgagtgctgtccttga

SEQ ID NO: 81175 - DNA, 38 bp, Artificial Sequence
  Synthetic oligonucleotide
ttggttcctaccgattctgtcacatctttcaggcttga

SEQ ID NO: 81176 - DNA, 38 bp, Artificial Sequence
  Synthetic oligonucleotide
gattggggagatacgtgcatgatcagcagctatgttga

SEQ ID NO: 81177 - DNA, 38 bp, Artificial Sequence
  Synthetic oligonucleotide
tagtgccgctcacctggttctgccgtgtttagctttga

SEQ ID NO: 81178 - DNA, 37 bp, Artificial Sequence
  Synthetic oligonucleotide
ttagtggtccgcccttctcgccctgttcttgctttga

SEQ ID NO: 81179 - DNA, 36 bp, Artificial Sequence
  Synthetic oligonucleotide
gccgagtgtccgtccgctaccgtttctcgatttata

SEQ ID NO: 81180 - DNA, 35 bp, Artificial Sequence
  Synthetic oligonucleotide
agcaacccttgcttgaacccacattacagtaacta

SEQ ID NO: 81181 - DNA, 35 bp, Artificial Sequence
  Synthetic oligonucleotide
tcacttggcgttttcaggtcgtcccgttcgctcta

SEQ ID NO: 81182 - DNA, 36 bp, Artificial Sequence
  Synthetic oligonucleotide
ttcagacgctgttcccctgccggctatgacattcta

SEQ ID NO: 81183 - DNA, 36 bp, Artificial Sequence
  Synthetic oligonucleotide
tcccctcgacaacattttccatggcccaccagtgta

SEQ ID NO: 81184 - DNA, 36 bp, Artificial Sequence
  Synthetic oligonucleotide
tgatcgcctggaccagcgtatgactttgtcatctta

SEQ ID NO: 81185 - DNA, 38 bp, Artificial Sequence
  Synthetic oligonucleotide
ggtccccctgcactacgcctatcttcgacagttagtta

SEQ ID NO: 81186 - DNA, 36 bp, Artificial Sequence
  Synthetic oligonucleotide
tacgcgctgcatttctcccacaaaatcagtgcttta

SEQ ID NO: 81187 - DNA, 35 bp, Artificial Sequence
  Synthetic oligonucleotide
gactgcactgccccgaggaggcccttcattcccac

SEQ ID NO: 81188 - DNA, 35 bp, Artificial Sequence
  Synthetic oligonucleotide
acaaacagccgttctccttcgaccattcctgatac

SEQ ID NO: 81189 - DNA, 35 bp, Artificial Sequence
  Synthetic oligonucleotide
tacacaccgccacttaatggcaattaacactcacc

SEQ ID NO: 81190 - DNA, 35 bp, Artificial Sequence
  Synthetic oligonucleotide
tttgatgccccatactggcgctaatacacgacccc

SEQ ID NO: 81191 - DNA, 36 bp, Artificial Sequence
  Synthetic oligonucleotide
gctcacggtatgcatcgatcacatggcgcctccccc

SEQ ID NO: 81192 - DNA, 35 bp, Artificial Sequence
  Synthetic oligonucleotide
tctcgccacgtatatcgaattcgtgttactcgccc

SEQ ID NO: 81193 - DNA, 35 bp, Artificial Sequence
  Synthetic oligonucleotide
taaagagcggatgccacccagtacaacattcatcc

SEQ ID NO: 81194 - DNA, 35 bp, Artificial Sequence
  Synthetic oligonucleotide
gcggtctctctgttgcgtctatcattctcggttcc

SEQ ID NO: 81195 - DNA, 35 bp, Artificial Sequence
  Synthetic oligonucleotide
ggaaccactcctctgaagacgcaccgcgcaaacgc

SEQ ID NO: 81196 - DNA, 35 bp, Artificial Sequence
  Synthetic oligonucleotide
accacgcatcgcaaaggtgaacacggaaaccacgc

SEQ ID NO: 81197 - DNA, 35 bp, Artificial Sequence
  Synthetic oligonucleotide
gtaccgcacaagggctacaatgctgactaacttgc

SEQ ID NO: 81198 - DNA, 35 bp, Artificial Sequence
  Synthetic oligonucleotide
tcacatcatagttattgttccagatcacctccatc

SEQ ID NO: 81199 - DNA, 35 bp, Artificial Sequence
  Synthetic oligonucleotide
gctggagacaacaggtacataccgactgaggggag

SEQ ID NO: 81200 - DNA, 35 bp, Artificial Sequence
  Synthetic oligonucleotide
tcccccgcactagtgcaacgccacctgactgtgag

SEQ ID NO: 81201 - DNA, 35 bp, Artificial Sequence
  Synthetic oligonucleotide
tatctcactggccgttaactggctccatctcaacg

SEQ ID NO: 81202 - DNA, 35 bp, Artificial Sequence
  Synthetic oligonucleotide
tgatcgcccgtgtgactaatgctttctgccatacg

SEQ ID NO: 81203 - DNA, 35 bp, Artificial Sequence
  Synthetic oligonucleotide
atgagtcccgtcatctcaccttggcccacttttcg

SEQ ID NO: 81204 - DNA, 35 bp, Artificial Sequence
  Synthetic oligonucleotide
attgctgcaactcgagatcaactagccgattaagg

SEQ ID NO: 81205 - DNA, 35 bp, Artificial Sequence
  Synthetic oligonucleotide
taaacccgccgcccagtccccgttagtcacaaggg

SEQ ID NO: 81206 - DNA, 35 bp, Artificial Sequence
  Synthetic oligonucleotide
taagagccgttgggtggaggatcagaggtgttggg

SEQ ID NO: 81207 - DNA, 35 bp, Artificial Sequence
  Synthetic oligonucleotide
gagcgcagccccccgtgccccctctagaagtatgg

SEQ ID NO: 81208 - DNA, 35 bp, Artificial Sequence
  Synthetic oligonucleotide
gaccgacatccgcctcacctgtttctccggcaatg

SEQ ID NO: 81209 - DNA, 35 bp, Artificial Sequence
  Synthetic oligonucleotide
tactataccatcccgcgcgccccattgttgacatg

SEQ ID NO: 81210 - DNA, 35 bp, Artificial Sequence
  Synthetic oligonucleotide
ttgtgggacggttggtgttggtaggattgcagatg

SEQ ID NO: 81211 - DNA, 35 bp, Artificial Sequence
  Synthetic oligonucleotide
tccaccgtcatctgtctcccgcgctctgtaccctg

SEQ ID NO: 81212 - DNA, 35 bp, Artificial Sequence
  Synthetic oligonucleotide
gcacgaccggtcttctatttttgtttgttgccctg

SEQ ID NO: 81213 - DNA, 35 bp, Artificial Sequence
  Synthetic oligonucleotide
gtcgggtagcgggagggaagggggtttgctgtgtg

SEQ ID NO: 81214 - DNA, 35 bp, Artificial Sequence
  Synthetic oligonucleotide
aggtactgaggggtgggtaggtgatggagtttgtg

SEQ ID NO: 81215 - DNA, 35 bp, Artificial Sequence
  Synthetic oligonucleotide
agagtgggttatacggaagtatgggggaggaattg

SEQ ID NO: 81216 - DNA, 35 bp, Artificial Sequence
  Synthetic oligonucleotide
gcccccgcgatggctaaatagcccaccccgataat

SEQ ID NO: 81217 - DNA, 35 bp, Artificial Sequence
  Synthetic oligonucleotide
ttagctccagtcctcaaggctctttttatgcaact

SEQ ID NO: 81218 - DNA, 35 bp, Artificial Sequence
  Synthetic oligonucleotide
gagctcgctggtgatattttcctttgccgccacct

SEQ ID NO: 81219 - DNA, 35 bp, Artificial Sequence
  Synthetic oligonucleotide
agtgagtagaggagggggagacgagccgggcacct

SEQ ID NO: 81220 - DNA, 36 bp, Artificial Sequence
  Synthetic oligonucleotide
aacgcgagtgtgcatccagtcaaatacctgtgtcct

SEQ ID NO: 81221 - DNA, 35 bp, Artificial Sequence
  Synthetic oligonucleotide
gggaacttactgcctggagtcacatcacccacgct

SEQ ID NO: 81222 - DNA, 35 bp, Artificial Sequence
  Synthetic oligonucleotide
gagtcatccacccaggacccaccagattgatggct

SEQ ID NO: 81223 - DNA, 35 bp, Artificial Sequence
  Synthetic oligonucleotide
tacatccggatggaacgctcgacgttttattatct

SEQ ID NO: 81224 - DNA, 35 bp, Artificial Sequence
  Synthetic oligonucleotide
gactggcacctgttcctcgtaccccgcatattggt

SEQ ID NO: 81225 - DNA, 35 bp, Artificial Sequence
  Synthetic oligonucleotide
acacgccatttggaaaccattatgacaccccctgt

SEQ ID NO: 81226 - DNA, 35 bp, Artificial Sequence
  Synthetic oligonucleotide
gcacgttcatctctcgtacgcaccgtgttgccctt

SEQ ID NO: 81227 - DNA, 35 bp, Artificial Sequence
  Synthetic oligonucleotide
gccacctacacgctgatcccaattaaaagggtctt

SEQ ID NO: 81228 - DNA, 35 bp, Artificial Sequence
  Synthetic oligonucleotide
tatgttgtgccatcctcatgtatcatactcgattt

SEQ ID NO: 81229 - DNA, 35 bp, Artificial Sequence
  Synthetic oligonucleotide
aatggagggccgtaacatgcgctgcaggctatttt

SEQ ID NO: 81230 - DNA, 35 bp, Artificial Sequence
  Synthetic oligonucleotide
gccggggccacctacctttctttcgtcatagacaa

SEQ ID NO: 81231 - DNA, 35 bp, Artificial Sequence
  Synthetic oligonucleotide
tcaccccttcctttagacgctactgactcgaccaa

SEQ ID NO: 81232 - DNA, 36 bp, Artificial Sequence
  Synthetic oligonucleotide
gctagccctcctgtcctgggcatcgaacactatcaa

SEQ ID NO: 81233 - DNA, 36 bp, Artificial Sequence
  Synthetic oligonucleotide
agacacgtacatccaggtttctcgttcccctttcaa

SEQ ID NO: 81234 - DNA, 36 bp, Artificial Sequence
  Synthetic oligonucleotide
tcaacatcctcgtggcggtcttgattactctccgaa

SEQ ID NO: 81235 - DNA, 36 bp, Artificial Sequence
  Synthetic oligonucleotide
gcgaccgagaagggacgaggtttatatcgcgaggaa

SEQ ID NO: 81236 - DNA, 36 bp, Artificial Sequence
  Synthetic oligonucleotide
gccgacgccactggatttgaaagtctcctgcgctaa

SEQ ID NO: 81237 - DNA, 36 bp, Artificial Sequence
  Synthetic oligonucleotide
gttgcatactgcgccgaccaggatccacctttctaa

SEQ ID NO: 81238 - DNA, 36 bp, Artificial Sequence
  Synthetic oligonucleotide
tgcggccccccgcttgtgcgaactctccctaggtaa

SEQ ID NO: 81239 - DNA, 35 bp, Artificial Sequence
  Synthetic oligonucleotide
agttgaccgccctacccaatggaacattatgcaca

SEQ ID NO: 81240 - DNA, 36 bp, Artificial Sequence
  Synthetic oligonucleotide
tcccgagcgcgggaaacgaggtgggggggactcaca

SEQ ID NO: 81241 - DNA, 36 bp, Artificial Sequence
  Synthetic oligonucleotide
tattccgtgcatatgggctctcactctccgcataca

SEQ ID NO: 81242 - DNA, 33 bp, Artificial Sequence
  Synthetic oligonucleotide
cccgccactgccgccattctcgacgtacgtaca

SEQ ID NO: 81243 - DNA, 35 bp, Artificial Sequence
  Synthetic oligonucleotide
tacccgccattccttgcggcttgttcctcgttaca

SEQ ID NO: 81244 - DNA, 36 bp, Artificial Sequence
  Synthetic oligonucleotide
aacgtgcaacgggttgtccaccccactattgaccca

SEQ ID NO: 81245 - DNA, 36 bp, Artificial Sequence
  Synthetic oligonucleotide
ccatcccactctgtcttatagctgcaaacgctccca

SEQ ID NO: 81246 - DNA, 36 bp, Artificial Sequence
  Synthetic oligonucleotide
actgggcgctcacagctttcattcaaccacaagcca

SEQ ID NO: 81247 - DNA, 36 bp, Artificial Sequence
  Synthetic oligonucleotide
tagggcagatggctcaaactgtcgctgcttcctcca

SEQ ID NO: 81248 - DNA, 36 bp, Artificial Sequence
  Synthetic oligonucleotide
gatcaaggcggaacacggagtaatttgcggacagca

SEQ ID NO: 81249 - DNA, 35 bp, Artificial Sequence
  Synthetic oligonucleotide
tgatgtccccgcagcagaccctggctgttaacgca

SEQ ID NO: 81250 - DNA, 35 bp, Artificial Sequence
  Synthetic oligonucleotide
acttccccgaataacggcatgcctacctacacgca

SEQ ID NO: 81251 - DNA, 36 bp, Artificial Sequence
  Synthetic oligonucleotide
taacacctccgaaatctgcgaccctgcctctacgca

SEQ ID NO: 81252 - DNA, 36 bp, Artificial Sequence
  Synthetic oligonucleotide
tcccatcaccaaaatcacaggacgcggatttccgca

SEQ ID NO: 81253 - DNA, 35 bp, Artificial Sequence
  Synthetic oligonucleotide
atgacagtctcacatgaaacaccaggacggtggca

SEQ ID NO: 81254 - DNA, 36 bp, Artificial Sequence
  Synthetic oligonucleotide
accaaacgacacaggtcctggagatcgaaggttgca

SEQ ID NO: 81255 - DNA, 35 bp, Artificial Sequence
  Synthetic oligonucleotide
ccccaacgccacggtcccaaccaatcaatgtctca

SEQ ID NO: 81256 - DNA, 36 bp, Artificial Sequence
  Synthetic oligonucleotide
tccccagacacaaatctagaaactccctcggggtca

SEQ ID NO: 81257 - DNA, 36 bp, Artificial Sequence
  Synthetic oligonucleotide
gttgtctgtcccaggggtccctgtcgtccgtattca

SEQ ID NO: 81258 - DNA, 37 bp, Artificial Sequence
  Synthetic oligonucleotide
aaccacagggccagaaagatgtacagcagccacaaga

SEQ ID NO: 81259 - DNA, 37 bp, Artificial Sequence
  Synthetic oligonucleotide
tcaacagtcgcaacaatttgaagtggaggttcgaaga

SEQ ID NO: 81260 - DNA, 36 bp, Artificial Sequence
  Synthetic oligonucleotide
gtggccacattgtactcactgcccttccgacacaga

SEQ ID NO: 81261 - DNA, 37 bp, Artificial Sequence
  Synthetic oligonucleotide
gggtggggctgggcttatggagcgggacgaagataga

SEQ ID NO: 81262 - DNA, 37 bp, Artificial Sequence
  Synthetic oligonucleotide
ttgttgccccactatgacgcgtactgcttcccttaga

SEQ ID NO: 81263 - DNA, 37 bp, Artificial Sequence
  Synthetic oligonucleotide
gtcgccaccccgagattcatctactgttaacgcacga

SEQ ID NO: 81264 - DNA, 37 bp, Artificial Sequence
  Synthetic oligonucleotide
gagcgcacattctcctgttctcctacatcatgcacga

SEQ ID NO: 81265 - DNA, 37 bp, Artificial Sequence
  Synthetic oligonucleotide
gccactgtcttaaagctgcgtttccccttccgtacga

SEQ ID NO: 81266 - DNA, 35 bp, Artificial Sequence
  Synthetic oligonucleotide
agcaccgttgatcgcacccaccccaatgcccgcga

SEQ ID NO: 81267 - DNA, 37 bp, Artificial Sequence
  Synthetic oligonucleotide
ttcgaagcccgcttcctatgctatagccactgatcga

SEQ ID NO: 81268 - DNA, 37 bp, Artificial Sequence
  Synthetic oligonucleotide
gcacgctacgtgtacatcattttcctattcccttcga

SEQ ID NO: 81269 - DNA, 37 bp, Artificial Sequence
  Synthetic oligonucleotide
gcactacgcagacccctgattctatgtcctagttcga

SEQ ID NO: 81270 - DNA, 36 bp, Artificial Sequence
  Synthetic oligonucleotide
atccggtccgtatatgcacccccggccacctttcga

SEQ ID NO: 81271 - DNA, 37 bp, Artificial Sequence
  Synthetic oligonucleotide
atgggagtggggtactggagaagcatgagaggtagga

SEQ ID NO: 81272 - DNA, 37 bp, Artificial Sequence
  Synthetic oligonucleotide
taccgcaaggtcgattttagttctttcgctctacgga

SEQ ID NO: 81273 - DNA, 37 bp, Artificial Sequence
  Synthetic oligonucleotide
gctacgtgaggtaggcgttagggggggctgacgcgga

SEQ ID NO: 81274 - DNA, 37 bp, Artificial Sequence
  Synthetic oligonucleotide
gtggggggtagtaggattgcatgaaatagtaggcgga

SEQ ID NO: 81275 - DNA, 37 bp, Artificial Sequence
  Synthetic oligonucleotide
ttggagaggggagagctggcgtatgagaacgggcgga

SEQ ID NO: 81276 - DNA, 37 bp, Artificial Sequence
  Synthetic oligonucleotide
taatgggagggagggtctgatcgctatacgggtcgga

SEQ ID NO: 81277 - DNA, 37 bp, Artificial Sequence
  Synthetic oligonucleotide
tcaccacaaatatgcaccctacgtcagtcctgaggga

SEQ ID NO: 81278 - DNA, 37 bp, Artificial Sequence
  Synthetic oligonucleotide
gaagggcggccgcaggaaatggcttggggattcggga

SEQ ID NO: 81279 - DNA, 37 bp, Artificial Sequence
  Synthetic oligonucleotide
tacccgacccaatcaattaactacactgtctgtggga

SEQ ID NO: 81280 - DNA, 37 bp, Artificial Sequence
  Synthetic oligonucleotide
aacgaccctacataggggaccccctccattccctgga

SEQ ID NO: 81281 - DNA, 36 bp, Artificial Sequence
  Synthetic oligonucleotide
gtcaccagaattcgtctgctcctaatcatgcctgga

SEQ ID NO: 81282 - DNA, 37 bp, Artificial Sequence
  Synthetic oligonucleotide
gaggacagcaacaacggaggattcaggtgggcttgga

SEQ ID NO: 81283 - DNA, 37 bp, Artificial Sequence
  Synthetic oligonucleotide
tgcaatggttccgggtggggggagtgggcggtaatga

SEQ ID NO: 81284 - DNA, 38 bp, Artificial Sequence
  Synthetic oligonucleotide
acacgcctttgctatccgctgctgataacggtccatga

SEQ ID NO: 81285 - DNA, 38 bp, Artificial Sequence
  Synthetic oligonucleotide
gacgacccatgtttcaagccgccctcttccgctcatga

SEQ ID NO: 81286 - DNA, 37 bp, Artificial Sequence
  Synthetic oligonucleotide
gagttacgtactgctgtgtcctgtccccttgtcatga

SEQ ID NO: 81287 - DNA, 38 bp, Artificial Sequence
  Synthetic oligonucleotide
tatggcggagggagtgggggaacaggggacctggatga

SEQ ID NO: 81288 - DNA, 36 bp, Artificial Sequence
  Synthetic oligonucleotide
gccctcacacctcgaccgcaacataattcattatga

SEQ ID NO: 81289 - DNA, 38 bp, Artificial Sequence
  Synthetic oligonucleotide
tgtcacccgggccatcattctgtttctttagaccctga

SEQ ID NO: 81290 - DNA, 35 bp, Artificial Sequence
  Synthetic oligonucleotide
tgcatgaactatcgcgttaccacctagcctcctga

SEQ ID NO: 81291 - DNA, 38 bp, Artificial Sequence
  Synthetic oligonucleotide
atgccaacacttgatctttagtaacctgcacaacgtga

SEQ ID NO: 81292 - DNA, 38 bp, Artificial Sequence
  Synthetic oligonucleotide
gaagggggggtgagggaacaaaaagacccattacgtga

SEQ ID NO: 81293 - DNA, 37 bp, Artificial Sequence
  Synthetic oligonucleotide
agatccacgctacattccgtatttcaactgcccgtga

SEQ ID NO: 81294 - DNA, 37 bp, Artificial Sequence
  Synthetic oligonucleotide
atgccgcagactcatacactatccagcactgtcgtga

SEQ ID NO: 81295 - DNA, 38 bp, Artificial Sequence
  Synthetic oligonucleotide
gcgaaacagccgcccgacctctttttcaactttcgtga

SEQ ID NO: 81296 - DNA, 38 bp, Artificial Sequence
  Synthetic oligonucleotide
agtgccgatgtgtggttttttgtgtttcgtcatggtga

SEQ ID NO: 81297 - DNA, 38 bp, Artificial Sequence
  Synthetic oligonucleotide
atcagtaggtggtggtcggacggggatgtggatggtga

SEQ ID NO: 81298 - DNA, 38 bp, Artificial Sequence
  Synthetic oligonucleotide
aacaggagcgtataagggcggtaaggggtggttggtga

SEQ ID NO: 81299 - DNA, 38 bp, Artificial Sequence
  Synthetic oligonucleotide
tgatcaggcccttcctcccgccacaatacgcggtgtga

SEQ ID NO: 81300 - DNA, 35 bp, Artificial Sequence
  Synthetic oligonucleotide
gcaagcacagaagcagaggcgggcgggagtattga

SEQ ID NO: 81301 - DNA, 38 bp, Artificial Sequence
  Synthetic oligonucleotide
gatccaacctacgcgccacagggccgtgatcttattga

SEQ ID NO: 81302 - DNA, 37 bp, Artificial Sequence
  Synthetic oligonucleotide
tccgagggcccaaatgcacactctcaggtcaacttga

SEQ ID NO: 81303 - DNA, 36 bp, Artificial Sequence
  Synthetic oligonucleotide
aactcccacccaggatgcatggcgggaaacccttga

SEQ ID NO: 81304 - DNA, 37 bp, Artificial Sequence
  Synthetic oligonucleotide
gcaccggtgtgatcaaactgcaccttcccccgcttga

SEQ ID NO: 81305 - DNA, 38 bp, Artificial Sequence
  Synthetic oligonucleotide
ccacaccccacgctcgcgtatcaccatgttgatcttga

SEQ ID NO: 81306 - DNA, 38 bp, Artificial Sequence
  Synthetic oligonucleotide
atccaagccaccgatttcgccaccataagtcacgttga

SEQ ID NO: 81307 - DNA, 37 bp, Artificial Sequence
  Synthetic oligonucleotide
aaccatgccgggtgcacctagagttcgggtacgttga

SEQ ID NO: 81308 - DNA, 38 bp, Artificial Sequence
  Synthetic oligonucleotide
atcgcccccacttcaccgtgcaccttgagttacgttga

SEQ ID NO: 81309 - DNA, 38 bp, Artificial Sequence
  Synthetic oligonucleotide
gagctgacggcggtagggatcttttggcacgtggttga

SEQ ID NO: 81310 - DNA, 36 bp, Artificial Sequence
  Synthetic oligonucleotide
gaaccagcacatgggagtttgaaggagcttggttga

SEQ ID NO: 81311 - DNA, 37 bp, Artificial Sequence
  Synthetic oligonucleotide
ggacgggtagggggcggagataccggggcatgtttga

SEQ ID NO: 81312 - DNA, 38 bp, Artificial Sequence
  Synthetic oligonucleotide
gaacgcctacccgacgagtccacacatggcatttttga

SEQ ID NO: 81313 - DNA, 36 bp, Artificial Sequence
  Synthetic oligonucleotide
gtcgagtcacacattccgcgtcacgctacatcacta

SEQ ID NO: 81314 - DNA, 35 bp, Artificial Sequence
  Synthetic oligonucleotide
acacaacgatcccggatcgcttacttaggatccta

SEQ ID NO: 81315 - DNA, 35 bp, Artificial Sequence
  Synthetic oligonucleotide
tgctccccttgatagcccattgcggttgactccta

SEQ ID NO: 81316 - DNA, 36 bp, Artificial Sequence
  Synthetic oligonucleotide
ttacgctaccacatcatccaaccgcacgttgtccta

SEQ ID NO: 81317 - DNA, 36 bp, Artificial Sequence
  Synthetic oligonucleotide
gacacgcaatcctgtctgggctgatatttgcctcta

SEQ ID NO: 81318 - DNA, 36 bp, Artificial Sequence
  Synthetic oligonucleotide
gttgactacgcgggccagccttagacctgcctatta

SEQ ID NO: 81319 - DNA, 35 bp, Artificial Sequence
  Synthetic oligonucleotide
tgtttacacacacacgtatatatcatgaagcctta

SEQ ID NO: 81320 - DNA, 33 bp, Artificial Sequence
  Synthetic oligonucleotide
ccactacccaaccatttgtaaccctagggttta

SEQ ID NO: 81321 - DNA, 35 bp, Artificial Sequence
  Synthetic oligonucleotide
tccggtctagggccgcttccatattatgcctttta

SEQ ID NO: 81322 - DNA, 35 bp, Artificial Sequence
  Synthetic oligonucleotide
ttcgctcggctgctcccctcatactatcaccgaac

SEQ ID NO: 81323 - DNA, 35 bp, Artificial Sequence
  Synthetic oligonucleotide
gctgtggggcattccgctgcataaatttcacctac

SEQ ID NO: 81324 - DNA, 35 bp, Artificial Sequence
  Synthetic oligonucleotide
gcattcgtcccggcgctttattatgttagttttac

SEQ ID NO: 81325 - DNA, 35 bp, Artificial Sequence
  Synthetic oligonucleotide
gacgcctacgcgattcacctcattcagtgatcacc

SEQ ID NO: 81326 - DNA, 35 bp, Artificial Sequence
  Synthetic oligonucleotide
tgcgcggttaaagcggcctctttcctcgtttcgcc

SEQ ID NO: 81327 - DNA, 35 bp, Artificial Sequence
  Synthetic oligonucleotide
atgcctcgggtctggttacatctctctcgaatgcc

SEQ ID NO: 81328 - DNA, 35 bp, Artificial Sequence
  Synthetic oligonucleotide
atgccatccaaccgcgtcaatctgggtagtgctcc

SEQ ID NO: 81329 - DNA, 36 bp, Artificial Sequence
  Synthetic oligonucleotide
actagacaccctctatgatccaaagcctaggggtcc

SEQ ID NO: 81330 - DNA, 35 bp, Artificial Sequence
  Synthetic oligonucleotide
aaccaggcgaggggtggcttgcggcaactcgttcc

SEQ ID NO: 81331 - DNA, 35 bp, Artificial Sequence
  Synthetic oligonucleotide
aagtgccgcccttctgttcgtagctgttttccagc

SEQ ID NO: 81332 - DNA, 35 bp, Artificial Sequence
  Synthetic oligonucleotide
accataaacgcagataacttacttcccctgcgcgc

SEQ ID NO: 81333 - DNA, 35 bp, Artificial Sequence
  Synthetic oligonucleotide
acatcaacctcgtctgtcttggttgtaccgattgc

SEQ ID NO: 81334 - DNA, 35 bp, Artificial Sequence
  Synthetic oligonucleotide
gccatccgatgtctgtcaccattcttcagttgatc

SEQ ID NO: 81335 - DNA, 35 bp, Artificial Sequence
  Synthetic oligonucleotide
gccggacgcctcattgctccatgctcttcactatc

SEQ ID NO: 81336 - DNA, 35 bp, Artificial Sequence
  Synthetic oligonucleotide
tgaccaacctgcattactttgctatccgctttatc

SEQ ID NO: 81337 - DNA, 35 bp, Artificial Sequence
  Synthetic oligonucleotide
ggaaggtacagcacagtctcccttatggtttgctc

SEQ ID NO: 81338 - DNA, 35 bp, Artificial Sequence
  Synthetic oligonucleotide
gacacatcaaatactccatagtaggccaatgcttc

SEQ ID NO: 81339 - DNA, 35 bp, Artificial Sequence
  Synthetic oligonucleotide
acgaaagcggagagggcgggtcgggtacggtgtag

SEQ ID NO: 81340 - DNA, 35 bp, Artificial Sequence
  Synthetic oligonucleotide
gctccacccgacttaagttgtatcccatcctcggg

SEQ ID NO: 81341 - DNA, 35 bp, Artificial Sequence
  Synthetic oligonucleotide
aactgccacaattgctgcttttctcacggcttatg

SEQ ID NO: 81342 - DNA, 35 bp, Artificial Sequence
  Synthetic oligonucleotide
ggtgaaccgctccctttttatttttgttgtacttg

SEQ ID NO: 81343 - DNA, 35 bp, Artificial Sequence
  Synthetic oligonucleotide
actgggagaagtggaagtgagtgcattgggcggat

SEQ ID NO: 81344 - DNA, 35 bp, Artificial Sequence
  Synthetic oligonucleotide
ccttgtccaaccggctgccttcctccacggtacct

SEQ ID NO: 81345 - DNA, 35 bp, Artificial Sequence
  Synthetic oligonucleotide
agtgactctgccgttgccgcttttgctcgtagcct

SEQ ID NO: 81346 - DNA, 35 bp, Artificial Sequence
  Synthetic oligonucleotide
tgtccacctaacccatccgtatcatgcccctgtct

SEQ ID NO: 81347 - DNA, 35 bp, Artificial Sequence
  Synthetic oligonucleotide
gactgcaaagtagcgttaacgtatcccttgcttct

SEQ ID NO: 81348 - DNA, 35 bp, Artificial Sequence
  Synthetic oligonucleotide
ggggtgtgccgcacgatccattaaattccatttct

SEQ ID NO: 81349 - DNA, 35 bp, Artificial Sequence
  Synthetic oligonucleotide
tcgatcactgctattttgcttacgtattactccgt

SEQ ID NO: 81350 - DNA, 35 bp, Artificial Sequence
  Synthetic oligonucleotide
tacagctgcattgtaccagctttttgttctccatt

SEQ ID NO: 81351 - DNA, 35 bp, Artificial Sequence
  Synthetic oligonucleotide
ctcgacacctggcccggttttgccacccacttctt

SEQ ID NO: 81352 - DNA, 35 bp, Artificial Sequence
  Synthetic oligonucleotide
gaagaaggaagacggccttacggggggagggagtt

SEQ ID NO: 81353 - DNA, 35 bp, Artificial Sequence
  Synthetic oligonucleotide
gtagtccctcctagcttccgcagtttcatcgcgtt

SEQ ID NO: 81354 - DNA, 35 bp, Artificial Sequence
  Synthetic oligonucleotide
ttcagtcataagtccacccccccgatcgtatcgtt

SEQ ID NO: 81355 - DNA, 35 bp, Artificial Sequence
  Synthetic oligonucleotide
gacctgcaggacactgccggtgattattagttgtt

SEQ ID NO: 81356 - DNA, 35 bp, Artificial Sequence
  Synthetic oligonucleotide
gctacacgttgcatcctagtttctcagcttttgtt

SEQ ID NO: 81357 - DNA, 35 bp, Artificial Sequence
  Synthetic oligonucleotide
acattgctactgactcgggcccacgcgtattcttt

SEQ ID NO: 81358 - DNA, 35 bp, Artificial Sequence
  Synthetic oligonucleotide
agcttcagaacgggggggacgtagggagggctttt

SEQ ID NO: 81359 - DNA, 35 bp, Artificial Sequence
  Synthetic oligonucleotide
tgaccaacggggctaggatggagggtcaaaaaaaa

SEQ ID NO: 81360 - DNA, 35 bp, Artificial Sequence
  Synthetic oligonucleotide
gagggcaagtgggaggggacgaggtgaggtacaaa

SEQ ID NO: 81361 - DNA, 36 bp, Artificial Sequence
  Synthetic oligonucleotide
taccgcatgccatctcttcgttagttacaggtgcaa

SEQ ID NO: 81362 - DNA, 35 bp, Artificial Sequence
  Synthetic oligonucleotide
tccacgcaaccttggcggacttcctaggaaccgaa

SEQ ID NO: 81363 - DNA, 36 bp, Artificial Sequence
  Synthetic oligonucleotide
tactgacaacccgccgtaacctttaacgggcactaa

SEQ ID NO: 81364 - DNA, 35 bp, Artificial Sequence
  Synthetic oligonucleotide
tccgtgcggagtgaatccgtgagggaagggggtaa

SEQ ID NO: 81365 - DNA, 35 bp, Artificial Sequence
  Synthetic oligonucleotide
ttgcccccgctatcggctatccctaggctttttaa

SEQ ID NO: 81366 - DNA, 36 bp, Artificial Sequence
  Synthetic oligonucleotide
agtacggtcgggaggacgtccagcgcttggccaaca

SEQ ID NO: 81367 - DNA, 36 bp, Artificial Sequence
  Synthetic oligonucleotide
tgtctcgatcaatctgccacatccctgcgcttaaca

SEQ ID NO: 81368 - DNA, 36 bp, Artificial Sequence
  Synthetic oligonucleotide
gaacacctcgttgcggtcacactgtcgcctcccaca

SEQ ID NO: 81369 - DNA, 36 bp, Artificial Sequence
  Synthetic oligonucleotide
gctcctccgtgttcgtcccatactgtctcttccaca

SEQ ID NO: 81370 - DNA, 36 bp, Artificial Sequence
  Synthetic oligonucleotide
gtcaatgcgatgactatctgtcttggccggttcaca

SEQ ID NO: 81371 - DNA, 36 bp, Artificial Sequence
  Synthetic oligonucleotide
gcgctacactcccaccagccgaaattatgacggaca

SEQ ID NO: 81372 - DNA, 35 bp, Artificial Sequence
  Synthetic oligonucleotide
gtggaaccgcagccaccgcctacgctagcgaacca

SEQ ID NO: 81373 - DNA, 35 bp, Artificial Sequence
  Synthetic oligonucleotide
atgcctagcccctgaacacctcagtctaatgacca

SEQ ID NO: 81374 - DNA, 36 bp, Artificial Sequence
  Synthetic oligonucleotide
atgcgacacacgcttttgttcattgggagttaccca

SEQ ID NO: 81375 - DNA, 36 bp, Artificial Sequence
  Synthetic oligonucleotide
tcgcaacacagctgatgttatcgaattcgttgccca

SEQ ID NO: 81376 - DNA, 36 bp, Artificial Sequence
  Synthetic oligonucleotide
gtgccccgattcaacagtgactgccgcactctccca

SEQ ID NO: 81377 - DNA, 36 bp, Artificial Sequence
  Synthetic oligonucleotide
gctggccttcgttgacatcgccgtccgccttacgca

SEQ ID NO: 81378 - DNA, 36 bp, Artificial Sequence
  Synthetic oligonucleotide
tgttttggtcgggaatagagggaatggaggggcgca

SEQ ID NO: 81379 - DNA, 36 bp, Artificial Sequence
  Synthetic oligonucleotide
gaagaggaaagggaagggagatagcagctctcggca

SEQ ID NO: 81380 - DNA, 35 bp, Artificial Sequence
  Synthetic oligonucleotide
tcgatccggccacgtactctcattgaccccctgca

SEQ ID NO: 81381 - DNA, 36 bp, Artificial Sequence
  Synthetic oligonucleotide
gcaccacgcgacttgcagcttcgtctctacttttca

SEQ ID NO: 81382 - DNA, 37 bp, Artificial Sequence
  Synthetic oligonucleotide
gacgaaggcacgggaaggaaatggtggggtctaaaga

SEQ ID NO: 81383 - DNA, 37 bp, Artificial Sequence
  Synthetic oligonucleotide
gagtgtggggggggcaatggattagacagtatgcaga

SEQ ID NO: 81384 - DNA, 37 bp, Artificial Sequence
  Synthetic oligonucleotide
gtgtgatggggcgtggtgtcttggggaacgaaggaga

SEQ ID NO: 81385 - DNA, 37 bp, Artificial Sequence
  Synthetic oligonucleotide
gacaaaccagagagtcaaggggtatgttgtggggaga

SEQ ID NO: 81386 - DNA, 37 bp, Artificial Sequence
  Synthetic oligonucleotide
aaatcaaccactctcacatgcagtaacctgtgctaga

SEQ ID NO: 81387 - DNA, 37 bp, Artificial Sequence
  Synthetic oligonucleotide
aattcgcgcccccttccaacatgatcgtagatgacga

SEQ ID NO: 81388 - DNA, 37 bp, Artificial Sequence
  Synthetic oligonucleotide
tcagttacgcagcattcctgttcaatttcccatacga

SEQ ID NO: 81389 - DNA, 35 bp, Artificial Sequence
  Synthetic oligonucleotide
accatccatcgcaactctttgagctcgcattccga

SEQ ID NO: 81390 - DNA, 37 bp, Artificial Sequence
  Synthetic oligonucleotide
aatgcgggggaggtgagatggtgtgaagactaggcga

SEQ ID NO: 81391 - DNA, 37 bp, Artificial Sequence
  Synthetic oligonucleotide
aactgcacaccgtcagaatcatcttttacccgggcga

SEQ ID NO: 81392 - DNA, 37 bp, Artificial Sequence
  Synthetic oligonucleotide
gccgcaatggctccccacagtctcttcgtccgtgcga

SEQ ID NO: 81393 - DNA, 37 bp, Artificial Sequence
  Synthetic oligonucleotide
aacgagcgaggggaatagcgcagggaagtaagatcga

SEQ ID NO: 81394 - DNA, 36 bp, Artificial Sequence
  Synthetic oligonucleotide
caccgtcaccatcgctttctattctatttggatcga

SEQ ID NO: 81395 - DNA, 37 bp, Artificial Sequence
  Synthetic oligonucleotide
ttctacgcgcacaacaccactactcctgtatagtcga

SEQ ID NO: 81396 - DNA, 37 bp, Artificial Sequence
  Synthetic oligonucleotide
aaagtgggagtgtggaacgagtttggagaaaggagga

SEQ ID NO: 81397 - DNA, 36 bp, Artificial Sequence
  Synthetic oligonucleotide
tgaggttggtgggcggcaatagaagggaacttagga

SEQ ID NO: 81398 - DNA, 36 bp, Artificial Sequence
  Synthetic oligonucleotide
gcgagcctgccccggcccccaacaccgactatcgga

SEQ ID NO: 81399 - DNA, 37 bp, Artificial Sequence
  Synthetic oligonucleotide
agatagggaaaggtacgcggggaggtaggtcttcgga

SEQ ID NO: 81400 - DNA, 37 bp, Artificial Sequence
  Synthetic oligonucleotide
gtggacatgacggggaaggctgataaagagggaggga

SEQ ID NO: 81401 - DNA, 37 bp, Artificial Sequence
  Synthetic oligonucleotide
gacatgtccaggctcgcgctctcgtttgttcccggga

SEQ ID NO: 81402 - DNA, 37 bp, Artificial Sequence
  Synthetic oligonucleotide
acacgagaacggatcagggcgcgagggaatactggga

SEQ ID NO: 81403 - DNA, 37 bp, Artificial Sequence
  Synthetic oligonucleotide
agagtgcaccgcacatgatattcatttttatttggga

SEQ ID NO: 81404 - DNA, 37 bp, Artificial Sequence
  Synthetic oligonucleotide
agttgagaccaaaaggataggagtaggaaaggctgga

SEQ ID NO: 81405 - DNA, 37 bp, Artificial Sequence
  Synthetic oligonucleotide
tatagggggtgagggctagtagaggaagttacgtgga

SEQ ID NO: 81406 - DNA, 38 bp, Artificial Sequence
  Synthetic oligonucleotide
ttccaggcagtcagtttcccgtttcgcccgatccatga

SEQ ID NO: 81407 - DNA, 38 bp, Artificial Sequence
  Synthetic oligonucleotide
atgccatgggttggctctgttcactgtcatgtccatga

SEQ ID NO: 81408 - DNA, 38 bp, Artificial Sequence
  Synthetic oligonucleotide
gcccacttcacctttgtttacgttcacccacggcatga

SEQ ID NO: 81409 - DNA, 37 bp, Artificial Sequence
  Synthetic oligonucleotide
ttacacgctcacctgcccctccatatgatcctcatga

SEQ ID NO: 81410 - DNA, 38 bp, Artificial Sequence
  Synthetic oligonucleotide
gcacaggcacgggagattgtcagaataatggttgatga

SEQ ID NO: 81411 - DNA, 38 bp, Artificial Sequence
  Synthetic oligonucleotide
ggtgccgtcctgccccacacattgacactggaaactga

SEQ ID NO: 81412 - DNA, 38 bp, Artificial Sequence
  Synthetic oligonucleotide
tagagtcgcagacgtttaggatccaccttttccactga

SEQ ID NO: 81413 - DNA, 38 bp, Artificial Sequence
  Synthetic oligonucleotide
ttagagtggtgtggggttggcaaagagaaagagactga

SEQ ID NO: 81414 - DNA, 38 bp, Artificial Sequence
  Synthetic oligonucleotide
aacagggccctaaacgtactggccaccccgctacctga

SEQ ID NO: 81415 - DNA, 37 bp, Artificial Sequence
  Synthetic oligonucleotide
gattcacgtacacgacacgtcacgtgcacctccctga

SEQ ID NO: 81416 - DNA, 37 bp, Artificial Sequence
  Synthetic oligonucleotide
acttgagcatgctgaagtcttcgatcctcacctctga

SEQ ID NO: 81417 - DNA, 38 bp, Artificial Sequence
  Synthetic oligonucleotide
ttggtgtcgccgcgcatggtaacaactcaattttctga

SEQ ID NO: 81418 - DNA, 36 bp, Artificial Sequence
  Synthetic oligonucleotide
ttggatcggtcgaactgtgaactgaatgatacgtga

SEQ ID NO: 81419 - DNA, 36 bp, Artificial Sequence
  Synthetic oligonucleotide
ggaaaaggcgggaaggaagaatctaggggaccgtga

SEQ ID NO: 81420 - DNA, 38 bp, Artificial Sequence
  Synthetic oligonucleotide
tgtgaaccctgagctatgtgacctccaactgcccgtga

SEQ ID NO: 81421 - DNA, 38 bp, Artificial Sequence
  Synthetic oligonucleotide
acgacttggcccctatcaacacactcagtccttcgtga

SEQ ID NO: 81422 - DNA, 37 bp, Artificial Sequence
  Synthetic oligonucleotide
ggatgaggggaaagcggaaatctgggtcagacggtga

SEQ ID NO: 81423 - DNA, 38 bp, Artificial Sequence
  Synthetic oligonucleotide
gtcaaagggggggcggtttggtaggataggctcggtga

SEQ ID NO: 81424 - DNA, 38 bp, Artificial Sequence
  Synthetic oligonucleotide
agtgtgcgcaaggtgggtgcgggggagaggcggggtga

SEQ ID NO: 81425 - DNA, 38 bp, Artificial Sequence
  Synthetic oligonucleotide
ttggggcgggcttaacgggggagttgccctgggggtga

SEQ ID NO: 81426 - DNA, 38 bp, Artificial Sequence
  Synthetic oligonucleotide
gccaaccccttttgccgtcacatcgattctactggtga

SEQ ID NO: 81427 - DNA, 37 bp, Artificial Sequence
  Synthetic oligonucleotide
gtcatgtccatggttattgaggtcgtgagggatgtga

SEQ ID NO: 81428 - DNA, 38 bp, Artificial Sequence
  Synthetic oligonucleotide
atgctgcccgcatgatagacatggagtagtggggttga

SEQ ID NO: 81429 - DNA, 37 bp, Artificial Sequence
  Synthetic oligonucleotide
ttaggacacgcacatgacgagcaagggggggtgttga

SEQ ID NO: 81430 - DNA, 38 bp, Artificial Sequence
  Synthetic oligonucleotide
actccgcgggggaacatttggattggcggtgagtttga

SEQ ID NO: 81431 - DNA, 38 bp, Artificial Sequence
  Synthetic oligonucleotide
gcgtgtcgcacccgcccaccgtgagttcctagttttga

SEQ ID NO: 81432 - DNA, 35 bp, Artificial Sequence
  Synthetic oligonucleotide
ttactccacaatgcacggacgtccgcgcccgacta

SEQ ID NO: 81433 - DNA, 36 bp, Artificial Sequence
  Synthetic oligonucleotide
gaggtcgtgccggtaagaggaggagtaggctaagta

SEQ ID NO: 81434 - DNA, 36 bp, Artificial Sequence
  Synthetic oligonucleotide
gcaagacgcaaggggagcacgagttggaaattagta

SEQ ID NO: 81435 - DNA, 35 bp, Artificial Sequence
  Synthetic oligonucleotide
tttggcaccttaactcctcggcttgggacttcgta

SEQ ID NO: 81436 - DNA, 36 bp, Artificial Sequence
  Synthetic oligonucleotide
tgctacaccactacgccctgcaccagaatgcaggta

SEQ ID NO: 81437 - DNA, 36 bp, Artificial Sequence
  Synthetic oligonucleotide
tgcataaccgcacattttttagcaccatagacgtta

SEQ ID NO: 81438 - DNA, 36 bp, Artificial Sequence
  Synthetic oligonucleotide
tgcactcgcgttctgccatttaccgtcctgaataac

SEQ ID NO: 81439 - DNA, 35 bp, Artificial Sequence
  Synthetic oligonucleotide
tagagcatccacctgtctcacaagtttcaaagcac

SEQ ID NO: 81440 - DNA, 35 bp, Artificial Sequence
  Synthetic oligonucleotide
atttaaccgcggctggccctactatgttctgtcac

SEQ ID NO: 81441 - DNA, 35 bp, Artificial Sequence
  Synthetic oligonucleotide
gatgacccggctgtgaggtacgagggggttaatac

SEQ ID NO: 81442 - DNA, 35 bp, Artificial Sequence
  Synthetic oligonucleotide
gagtgcttgaccgctggctttattcaatagcttac

SEQ ID NO: 81443 - DNA, 35 bp, Artificial Sequence
  Synthetic oligonucleotide
tttgcactgggcgagtcgaaccactccgcttttac

SEQ ID NO: 81444 - DNA, 35 bp, Artificial Sequence
  Synthetic oligonucleotide
gtgagaccagtagcagcccatgttcactaaacacc

SEQ ID NO: 81445 - DNA, 35 bp, Artificial Sequence
  Synthetic oligonucleotide
tagttctcacacgagtgcctaacacaacgaatccc

SEQ ID NO: 81446 - DNA, 35 bp, Artificial Sequence
  Synthetic oligonucleotide
ttccactctagtgcccctcagacaatttcctagcc

SEQ ID NO: 81447 - DNA, 35 bp, Artificial Sequence
  Synthetic oligonucleotide
tcatctgcatagctgccgttcattctctcagatcc

SEQ ID NO: 81448 - DNA, 35 bp, Artificial Sequence
  Synthetic oligonucleotide
tcgcccgtgctcacccagcctaggcccatggctcc

SEQ ID NO: 81449 - DNA, 34 bp, Artificial Sequence
  Synthetic oligonucleotide
aacttcccacccctgtctagtcggttatctgtcc

SEQ ID NO: 81450 - DNA, 35 bp, Artificial Sequence
  Synthetic oligonucleotide
attgttagcccagttttccaaagccttcgtgacgc

SEQ ID NO: 81451 - DNA, 35 bp, Artificial Sequence
  Synthetic oligonucleotide
gcgcgtgcgtacgccaaccaccctgcaatatacgc

SEQ ID NO: 81452 - DNA, 35 bp, Artificial Sequence
  Synthetic oligonucleotide
aacacgctgaatgcaaagagctgaggacacatggc

SEQ ID NO: 81453 - DNA, 35 bp, Artificial Sequence
  Synthetic oligonucleotide
cactgaccctatgcgagaacctactttgacctgtc

SEQ ID NO: 81454 - DNA, 35 bp, Artificial Sequence
  Synthetic oligonucleotide
tagtccccaccacagtcaatcacgttatcgaattc

SEQ ID NO: 81455 - DNA, 35 bp, Artificial Sequence
  Synthetic oligonucleotide
acgctcagggggcgtatgccaaactgcctcacttc

SEQ ID NO: 81456 - DNA, 35 bp, Artificial Sequence
  Synthetic oligonucleotide
gacgcccggtctttatttcccaaagttgtccgttc

SEQ ID NO: 81457 - DNA, 35 bp, Artificial Sequence
  Synthetic oligonucleotide
tccgtgtacctccaaggctactctttactcgtttc

SEQ ID NO: 81458 - DNA, 35 bp, Artificial Sequence
  Synthetic oligonucleotide
agttaccaacccgtcgtccttggcgctccccatag

SEQ ID NO: 81459 - DNA, 35 bp, Artificial Sequence
  Synthetic oligonucleotide
tgagatggagagttactgggtgggatggactttag

SEQ ID NO: 81460 - DNA, 35 bp, Artificial Sequence
  Synthetic oligonucleotide
acacatgttatagcgcgcgcctatcgcccccaccg

SEQ ID NO: 81461 - DNA, 35 bp, Artificial Sequence
  Synthetic oligonucleotide
aaacgaagggcctcagtgaaagtgagtgagggtcg

SEQ ID NO: 81462 - DNA, 35 bp, Artificial Sequence
  Synthetic oligonucleotide
gtttggtaggagcacgttaaagtcacgaagtaggg

SEQ ID NO: 81463 - DNA, 35 bp, Artificial Sequence
  Synthetic oligonucleotide
gctgatgtccgttagaggaaggggatacgaggggg

SEQ ID NO: 81464 - DNA, 35 bp, Artificial Sequence
  Synthetic oligonucleotide
agagagaggaatgcgggagtggagttcgtgtgggg

SEQ ID NO: 81465 - DNA, 35 bp, Artificial Sequence
  Synthetic oligonucleotide
tcagagagggcggtggtctctagtcatttcttggg

SEQ ID NO: 81466 - DNA, 35 bp, Artificial Sequence
  Synthetic oligonucleotide
tttgtccccttgctgcccgcctgactacctcattg

SEQ ID NO: 81467 - DNA, 35 bp, Artificial Sequence
  Synthetic oligonucleotide
gcccctgtggcttacagctgagttatccttttttg

SEQ ID NO: 81468 - DNA, 35 bp, Artificial Sequence
  Synthetic oligonucleotide
acaacgccccaatcggccgaccactggtctcaaat

SEQ ID NO: 81469 - DNA, 35 bp, Artificial Sequence
  Synthetic oligonucleotide
ttagcgtgtgcctttctgttcctcctagccgtaat

SEQ ID NO: 81470 - DNA, 35 bp, Artificial Sequence
  Synthetic oligonucleotide
aagcttagcccccatgatcactttctttttgtaat

SEQ ID NO: 81471 - DNA, 35 bp, Artificial Sequence
  Synthetic oligonucleotide
tgaatcccaggcgtgaagggggcccatcaatccat

SEQ ID NO: 81472 - DNA, 35 bp, Artificial Sequence
  Synthetic oligonucleotide
gactctgcaactcgagtcgcttcaaccttggtact

SEQ ID NO: 81473 - DNA, 35 bp, Artificial Sequence
  Synthetic oligonucleotide
aaacgaggggggtggggtttaggttcctggttact

SEQ ID NO: 81474 - DNA, 35 bp, Artificial Sequence
  Synthetic oligonucleotide
tggatagtcaccctgcatggctaatcgttacccct

SEQ ID NO: 81475 - DNA, 35 bp, Artificial Sequence
  Synthetic oligonucleotide
tgcaccgaggttcgtcccttaggtttacgttcgct

SEQ ID NO: 81476 - DNA, 35 bp, Artificial Sequence
  Synthetic oligonucleotide
tatggggggctagcacccgggttgattttcactct

SEQ ID NO: 81477 - DNA, 34 bp, Artificial Sequence
  Synthetic oligonucleotide
gtgggccgtactgaggccgtcctggaattctagt

SEQ ID NO: 81478 - DNA, 35 bp, Artificial Sequence
  Synthetic oligonucleotide
tgtgaatcatcacaggggatcgaagtaaggagggt

SEQ ID NO: 81479 - DNA, 35 bp, Artificial Sequence
  Synthetic oligonucleotide
gcgccaatcggtcccaattcccaccttagccgggt

SEQ ID NO: 81480 - DNA, 35 bp, Artificial Sequence
  Synthetic oligonucleotide
acacccgcctgttgctataattcctatttattatt

SEQ ID NO: 81481 - DNA, 34 bp, Artificial Sequence
  Synthetic oligonucleotide
tttcaggtcccacatagcccgttccctgtttatt

SEQ ID NO: 81482 - DNA, 35 bp, Artificial Sequence
  Synthetic oligonucleotide
ttgtccaccgcgtgaattatgtccattgcttgctt

SEQ ID NO: 81483 - DNA, 35 bp, Artificial Sequence
  Synthetic oligonucleotide
ttacgacgtacggtcaccatttgaaatggcacttt

SEQ ID NO: 81484 - DNA, 36 bp, Artificial Sequence
  Synthetic oligonucleotide
ttcaaagcccagcctgccacttaccttacaggcaaa

SEQ ID NO: 81485 - DNA, 36 bp, Artificial Sequence
  Synthetic oligonucleotide
acactcactacaccatggcgttgctctgctatcaaa

SEQ ID NO: 81486 - DNA, 36 bp, Artificial Sequence
  Synthetic oligonucleotide
gttgaaccggtaacaaaacgtgtgggacaagtgaaa

SEQ ID NO: 81487 - DNA, 36 bp, Artificial Sequence
  Synthetic oligonucleotide
tcgatacgccctactgcgggagccccactaaataaa

SEQ ID NO: 81488 - DNA, 36 bp, Artificial Sequence
  Synthetic oligonucleotide
tcactcacttaacatgctgacactcgaacaggtaaa

SEQ ID NO: 81489 - DNA, 35 bp, Artificial Sequence
  Synthetic oligonucleotide
gaaccgtacagctggaccctatttgcgaaccacaa

SEQ ID NO: 81490 - DNA, 36 bp, Artificial Sequence
  Synthetic oligonucleotide
actccccacactagtaatttggactcttcaagggaa

SEQ ID NO: 81491 - DNA, 36 bp, Artificial Sequence
  Synthetic oligonucleotide
ttccggggaaaggcgaggaaaggggtcattatggaa

SEQ ID NO: 81492 - DNA, 35 bp, Artificial Sequence
  Synthetic oligonucleotide
tgacgatgcactgcatgaatccctccctagtggaa

SEQ ID NO: 81493 - DNA, 36 bp, Artificial Sequence
  Synthetic oligonucleotide
gacgcaacacagcttaataccaaatcacgcacataa

SEQ ID NO: 81494 - DNA, 36 bp, Artificial Sequence
  Synthetic oligonucleotide
ttcgaacgtatgtggggtgagatgtggccgatataa

SEQ ID NO: 81495 - DNA, 36 bp, Artificial Sequence
  Synthetic oligonucleotide
tgctcccactgcttgttcctttccgaattttgctaa

SEQ ID NO: 81496 - DNA, 35 bp, Artificial Sequence
  Synthetic oligonucleotide
gttacctcctgcctcactcgccacttttggcgtaa

SEQ ID NO: 81497 - DNA, 36 bp, Artificial Sequence
  Synthetic oligonucleotide
gcaacaagctcacgtcccttaacagctatacgcaca

SEQ ID NO: 81498 - DNA, 36 bp, Artificial Sequence
  Synthetic oligonucleotide
agttccatcgcggtcttacattcccattatggcaca

SEQ ID NO: 81499 - DNA, 36 bp, Artificial Sequence
  Synthetic oligonucleotide
agcgccgggctcgaggcgctcttccaacccgataca

SEQ ID NO: 81500 - DNA, 36 bp, Artificial Sequence
  Synthetic oligonucleotide
ttcgtccaccttgactgacgctattctgtctgtaca

SEQ ID NO: 81501 - DNA, 35 bp, Artificial Sequence
  Synthetic oligonucleotide
gactcacgactccattcgcaaacggtggttttaca

SEQ ID NO: 81502 - DNA, 35 bp, Artificial Sequence
  Synthetic oligonucleotide
ggtagaccgccctctgctgaacctggttacgccca

SEQ ID NO: 81503 - DNA, 36 bp, Artificial Sequence
  Synthetic oligonucleotide
atatgacaccccagacaggccgttaagctcaagcca

SEQ ID NO: 81504 - DNA, 35 bp, Artificial Sequence
  Synthetic oligonucleotide
gcatgggaacttgtctggtttagtctgtcgctcca

SEQ ID NO: 81505 - DNA, 36 bp, Artificial Sequence
  Synthetic oligonucleotide
tcctagtgcacagcctgtcgtccttagttacatgca

SEQ ID NO: 81506 - DNA, 37 bp, Artificial Sequence
  Synthetic oligonucleotide
aacacggctacaaggataggagcggggaaggaagaga

SEQ ID NO: 81507 - DNA, 37 bp, Artificial Sequence
  Synthetic oligonucleotide
gcaaagggaacatgtagtagaggtgggtgggtctaga

SEQ ID NO: 81508 - DNA, 37 bp, Artificial Sequence
  Synthetic oligonucleotide
gccacccctgtcccttggtcgacttatcgtgcaacga

SEQ ID NO: 81509 - DNA, 37 bp, Artificial Sequence
  Synthetic oligonucleotide
tcaacacatactgtcttgctctatcgacgtaccacga

SEQ ID NO: 81510 - DNA, 37 bp, Artificial Sequence
  Synthetic oligonucleotide
acattccctatctgttccacacatccagttctcacga

SEQ ID NO: 81511 - DNA, 37 bp, Artificial Sequence
  Synthetic oligonucleotide
tgatgtggtaactgtgggggatattggtgcaggacga

SEQ ID NO: 81512 - DNA, 36 bp, Artificial Sequence
  Synthetic oligonucleotide
gttgtacccgtcacgttccttggcctctcactccga

SEQ ID NO: 81513 - DNA, 37 bp, Artificial Sequence
  Synthetic oligonucleotide
gccattgcaatctgtagcgtaacctcgtcctttccga

SEQ ID NO: 81514 - DNA, 37 bp, Artificial Sequence
  Synthetic oligonucleotide
gaacacacttccccgactcgttatcacatacatgcga

SEQ ID NO: 81515 - DNA, 37 bp, Artificial Sequence
  Synthetic oligonucleotide
atcagaggcatcagcctccgacccctctttcgatcga

SEQ ID NO: 81516 - DNA, 35 bp, Artificial Sequence
  Synthetic oligonucleotide
gcccgcacgccaaaagtccttctcttacgtatcga

SEQ ID NO: 81517 - DNA, 35 bp, Artificial Sequence
  Synthetic oligonucleotide
aaatgacacgataggggaggaaatacatgagtcga

SEQ ID NO: 81518 - DNA, 37 bp, Artificial Sequence
  Synthetic oligonucleotide
gagtcgggataagagggacgagagggcgaggacagga

SEQ ID NO: 81519 - DNA, 36 bp, Artificial Sequence
  Synthetic oligonucleotide
ggaaagctgtcccgcgcgcccgctaccacctgagga

SEQ ID NO: 81520 - DNA, 37 bp, Artificial Sequence
  Synthetic oligonucleotide
aaggaaggcgggggggctgatcgagggcaaaaacgga

SEQ ID NO: 81521 - DNA, 37 bp, Artificial Sequence
  Synthetic oligonucleotide
tagtcccccccggtaggtaaataggctggctcacgga

SEQ ID NO: 81522 - DNA, 37 bp, Artificial Sequence
  Synthetic oligonucleotide
actgccatcctctacagttaagcggttatcccccgga

SEQ ID NO: 81523 - DNA, 37 bp, Artificial Sequence
  Synthetic oligonucleotide
tttcatggccagtgaacgcacacacaccggacaggga

SEQ ID NO: 81524 - DNA, 37 bp, Artificial Sequence
  Synthetic oligonucleotide
gacagttggagactgaatggcggaagtaggatcggga

SEQ ID NO: 81525 - DNA, 37 bp, Artificial Sequence
  Synthetic oligonucleotide
gagtgaccgccgtgaatatagtgaacgccgattggga

SEQ ID NO: 81526 - DNA, 37 bp, Artificial Sequence
  Synthetic oligonucleotide
tcaccgaaccacccaaggtcataatttcccgtatgga

SEQ ID NO: 81527 - DNA, 36 bp, Artificial Sequence
  Synthetic oligonucleotide
tgtacgcctcaccggaaacttaactaacctgctgga

SEQ ID NO: 81528 - DNA, 37 bp, Artificial Sequence
  Synthetic oligonucleotide
gttgggagaacgggataggtagaaaatctttggtgga

SEQ ID NO: 81529 - DNA, 36 bp, Artificial Sequence
  Synthetic oligonucleotide
tgcgacccagaccctcatcaatgacccgcgaaatga

SEQ ID NO: 81530 - DNA, 38 bp, Artificial Sequence
  Synthetic oligonucleotide
tgcgggacgcggtcgggaggcggtgggtcggtcaatga

SEQ ID NO: 81531 - DNA, 38 bp, Artificial Sequence
  Synthetic oligonucleotide
ttgagcctcccgtttcgccccagtcaacccttacatga

SEQ ID NO: 81532 - DNA, 37 bp, Artificial Sequence
  Synthetic oligonucleotide
agacgggtccgacgctctacacacaattcaaccatga

SEQ ID NO: 81533 - DNA, 37 bp, Artificial Sequence
  Synthetic oligonucleotide
tgcaccaacacaaccccttagccgagcctcgatatga

SEQ ID NO: 81534 - DNA, 38 bp, Artificial Sequence
  Synthetic oligonucleotide
acgatacgccacactttttcggacgtccctggctatga

SEQ ID NO: 81535 - DNA, 38 bp, Artificial Sequence
  Synthetic oligonucleotide
agcatgactaactgctgtcccgccattttatacactga

SEQ ID NO: 81536 - DNA, 38 bp, Artificial Sequence
  Synthetic oligonucleotide
tcaattctgacctcacacttggcgtgtaaacgcactga

SEQ ID NO: 81537 - DNA, 38 bp, Artificial Sequence
  Synthetic oligonucleotide
gacagtgtttgccttccgttgccctttgtcactactga

SEQ ID NO: 81538 - DNA, 37 bp, Artificial Sequence
  Synthetic oligonucleotide
tgctcagccgttatcatttcctagtcgaccgccctga

SEQ ID NO: 81539 - DNA, 38 bp, Artificial Sequence
  Synthetic oligonucleotide
tatccacaccggccatctcattaaaacttcagtgctga

SEQ ID NO: 81540 - DNA, 37 bp, Artificial Sequence
  Synthetic oligonucleotide
tgtccccgatcctggtccacccattatttcatagtga

SEQ ID NO: 81541 - DNA, 38 bp, Artificial Sequence
  Synthetic oligonucleotide
ttcgcgacctcagtttcttacttggaccatccacgtga

SEQ ID NO: 81542 - DNA, 37 bp, Artificial Sequence
  Synthetic oligonucleotide
gcaccgccctttctactcgtttgatcacccgaggtga

SEQ ID NO: 81543 - DNA, 38 bp, Artificial Sequence
  Synthetic oligonucleotide
agccctgctcacattgctcctgtacttttcatgtgtga

SEQ ID NO: 81544 - DNA, 37 bp, Artificial Sequence
  Synthetic oligonucleotide
gttctaacacgccacactctcataactagccaattga

SEQ ID NO: 81545 - DNA, 38 bp, Artificial Sequence
  Synthetic oligonucleotide
gaccttcccgcattctcagtcattgtcgccgagattga

SEQ ID NO: 81546 - DNA, 38 bp, Artificial Sequence
  Synthetic oligonucleotide
ttcgatcacggcgatcccgatttgcgctctgcccttga

SEQ ID NO: 81547 - DNA, 37 bp, Artificial Sequence
  Synthetic oligonucleotide
ccttgcggctcctcgttgctgctaatctgtttcttga

SEQ ID NO: 81548 - DNA, 38 bp, Artificial Sequence
  Synthetic oligonucleotide
ttcgcccccatcctcgtctgctaattcattttcgttga

SEQ ID NO: 81549 - DNA, 38 bp, Artificial Sequence
  Synthetic oligonucleotide
cccctagcgccaccatctgcttttgtactaccggttga

SEQ ID NO: 81550 - DNA, 38 bp, Artificial Sequence
  Synthetic oligonucleotide
ttggatgatgggggtgatcggcccaggggtcgggttga

SEQ ID NO: 81551 - DNA, 36 bp, Artificial Sequence
  Synthetic oligonucleotide
aacgtgggaacggagcatgctaagggattgggttga

SEQ ID NO: 81552 - DNA, 38 bp, Artificial Sequence
  Synthetic oligonucleotide
accgccgcaccggagcaggcaagggaacaggatgttga

SEQ ID NO: 81553 - DNA, 38 bp, Artificial Sequence
  Synthetic oligonucleotide
gcaaggtcagagcataccgtccgcctctcccagtttga

SEQ ID NO: 81554 - DNA, 36 bp, Artificial Sequence
  Synthetic oligonucleotide
gaaggaatcgcccagactccgccttccactgtttga

SEQ ID NO: 81555 - DNA, 38 bp, Artificial Sequence
  Synthetic oligonucleotide
aaccaccatcactgccctcaagacacaggtcgttttga

SEQ ID NO: 81556 - DNA, 36 bp, Artificial Sequence
  Synthetic oligonucleotide
tgtggccggctcttgcttaacggatcttcgcccata

SEQ ID NO: 81557 - DNA, 36 bp, Artificial Sequence
  Synthetic oligonucleotide
gcaggactctgggacggataaatgggggctaatata

SEQ ID NO: 81558 - DNA, 36 bp, Artificial Sequence
  Synthetic oligonucleotide
gacattgcctcctccgggttgctatgacaaattata

SEQ ID NO: 81559 - DNA, 36 bp, Artificial Sequence
  Synthetic oligonucleotide
gctgtgcaatgccaaatgctctcctcggttccccta

SEQ ID NO: 81560 - DNA, 36 bp, Artificial Sequence
  Synthetic oligonucleotide
aacaacatcgatttctgggcacctacggacttccta

SEQ ID NO: 81561 - DNA, 36 bp, Artificial Sequence
  Synthetic oligonucleotide
tacccgcatcgatactatttctgccttagtttccta

SEQ ID NO: 81562 - DNA, 36 bp, Artificial Sequence
  Synthetic oligonucleotide
attgtatcgatcaccgtgatacgcccccctgagcta

SEQ ID NO: 81563 - DNA, 36 bp, Artificial Sequence
  Synthetic oligonucleotide
gaagacgtatgtgctgggatagaagtagtccatgta

SEQ ID NO: 81564 - DNA, 35 bp, Artificial Sequence
  Synthetic oligonucleotide
gcacactgagccaaactaagagaggcacttttgta

SEQ ID NO: 81565 - DNA, 34 bp, Artificial Sequence
  Synthetic oligonucleotide
gtcgccacacccgccatggccatctgacctatta

SEQ ID NO: 81566 - DNA, 34 bp, Artificial Sequence
  Synthetic oligonucleotide
tctgaaagtgaggaaggggtcttaaagcagctta

SEQ ID NO: 81567 - DNA, 38 bp, Artificial Sequence
  Synthetic oligonucleotide
tatcgcctcaatctgcctggactcagccggttctgtta

SEQ ID NO: 81568 - DNA, 36 bp, Artificial Sequence
  Synthetic oligonucleotide
tagagcccgccaggctgtaacggctgttgatcttta

SEQ ID NO: 81569 - DNA, 35 bp, Artificial Sequence
  Synthetic oligonucleotide
agagcgactacaacgcattaaccctgtttcgaaac

SEQ ID NO: 81570 - DNA, 35 bp, Artificial Sequence
  Synthetic oligonucleotide
acccttcagcctctaaaaacgagctgctctcacac

SEQ ID NO: 81571 - DNA, 35 bp, Artificial Sequence
  Synthetic oligonucleotide
tgtacggactccaacagactctcacagtttatcac

SEQ ID NO: 81572 - DNA, 35 bp, Artificial Sequence
  Synthetic oligonucleotide
ggatgctcccttcagcgataatccatgaacctgac

SEQ ID NO: 81573 - DNA, 33 bp, Artificial Sequence
  Synthetic oligonucleotide
tgttcacccacgccgtttcttgctttgctgacc

SEQ ID NO: 81574 - DNA, 35 bp, Artificial Sequence
  Synthetic oligonucleotide
gcacaactctgcgcattggcggtcttagctcaccc

SEQ ID NO: 81575 - DNA, 35 bp, Artificial Sequence
  Synthetic oligonucleotide
acccgacgtgtggtttagtttcctggtgggtgccc

SEQ ID NO: 81576 - DNA, 35 bp, Artificial Sequence
  Synthetic oligonucleotide
tcaacggtgtgcataccgccttcatttccctcgcc

SEQ ID NO: 81577 - DNA, 35 bp, Artificial Sequence
  Synthetic oligonucleotide
tcaccacgaactgctcagcccggccactgtcttcc

SEQ ID NO: 81578 - DNA, 35 bp, Artificial Sequence
  Synthetic oligonucleotide
gtggtagatgtccagttgcgttctcccaccgttcc

SEQ ID NO: 81579 - DNA, 35 bp, Artificial Sequence
  Synthetic oligonucleotide
tcaacgccagtactgcccctgtctctccaattcgc

SEQ ID NO: 81580 - DNA, 35 bp, Artificial Sequence
  Synthetic oligonucleotide
aatgacatccacttgcttactctgtaccggttcgc

SEQ ID NO: 81581 - DNA, 35 bp, Artificial Sequence
  Synthetic oligonucleotide
aaccgccaaatccacaccgtcttcacacgaatggc

SEQ ID NO: 81582 - DNA, 35 bp, Artificial Sequence
  Synthetic oligonucleotide
ccattaggcggcctgcagggcacttggcatactgc

SEQ ID NO: 81583 - DNA, 35 bp, Artificial Sequence
  Synthetic oligonucleotide
tcctacaacccagtgtacgtaaccctccaaccatc

SEQ ID NO: 81584 - DNA, 34 bp, Artificial Sequence
  Synthetic oligonucleotide
tgcaccgctacttccgacgtcaatgtcccccatc

SEQ ID NO: 81585 - DNA, 35 bp, Artificial Sequence
  Synthetic oligonucleotide
ccacactctgctgtccgtttcgttctaactaggtc

SEQ ID NO: 81586 - DNA, 35 bp, Artificial Sequence
  Synthetic oligonucleotide
tgaaccgtgctcttaagttgctttacctacctttc

SEQ ID NO: 81587 - DNA, 35 bp, Artificial Sequence
  Synthetic oligonucleotide
gtatgggggagggaggggattgggtgcgagacaag

SEQ ID NO: 81588 - DNA, 35 bp, Artificial Sequence
  Synthetic oligonucleotide
tatacgccagaatgaaaaacaaacactcttctacg

SEQ ID NO: 81589 - DNA, 34 bp, Artificial Sequence
  Synthetic oligonucleotide
tctggtgtcccctgtgcatccgtgtccttcttcg

SEQ ID NO: 81590 - DNA, 35 bp, Artificial Sequence
  Synthetic oligonucleotide
ttatcagccgcgcaaatttgactatcttccctggg

SEQ ID NO: 81591 - DNA, 35 bp, Artificial Sequence
  Synthetic oligonucleotide
gattggaaggggcgggttttagaccgaagacgtgg

SEQ ID NO: 81592 - DNA, 35 bp, Artificial Sequence
  Synthetic oligonucleotide
cataagtcgaggagggagggtgatgacaaggggtg

SEQ ID NO: 81593 - DNA, 35 bp, Artificial Sequence
  Synthetic oligonucleotide
gggacgctgtggtggaaatctcaatgagaggggtg

SEQ ID NO: 81594 - DNA, 35 bp, Artificial Sequence
  Synthetic oligonucleotide
gctctctcagcaagaacgcccaccacatatcgact

SEQ ID NO: 81595 - DNA, 35 bp, Artificial Sequence
  Synthetic oligonucleotide
accgacgggtgaaaatcgtaacgcccatgtaccct

SEQ ID NO: 81596 - DNA, 35 bp, Artificial Sequence
  Synthetic oligonucleotide
aagatcaccaacaattgttctactcctgtgggcct

SEQ ID NO: 81597 - DNA, 35 bp, Artificial Sequence
  Synthetic oligonucleotide
atgcaagggtgataatggtggaaagttagcacagt

SEQ ID NO: 81598 - DNA, 35 bp, Artificial Sequence
  Synthetic oligonucleotide
tgtacgctccgtccgccagctatactatccctcgt

SEQ ID NO: 81599 - DNA, 35 bp, Artificial Sequence
  Synthetic oligonucleotide
tgtcgatgtgtacagtatcatccctgttcccttgt

SEQ ID NO: 81600 - DNA, 35 bp, Artificial Sequence
  Synthetic oligonucleotide
ctttcccgccgccctgtaattggttacctccactt

SEQ ID NO: 81601 - DNA, 35 bp, Artificial Sequence
  Synthetic oligonucleotide
atacggacgtgctagccgcctatcaaccgttactt

SEQ ID NO: 81602 - DNA, 35 bp, Artificial Sequence
  Synthetic oligonucleotide
aacctcgcactaccactgccttttaagaagatctt

SEQ ID NO: 81603 - DNA, 35 bp, Artificial Sequence
  Synthetic oligonucleotide
aaacccaagtcgaatgatccatcacttttcacgtt

SEQ ID NO: 81604 - DNA, 35 bp, Artificial Sequence
  Synthetic oligonucleotide
ttaccggccgcatgcagaggatcgtcccttctgtt

SEQ ID NO: 81605 - DNA, 35 bp, Artificial Sequence
  Synthetic oligonucleotide
tcacatcctccttcccgtgtgtcgttactcccttt

SEQ ID NO: 81606 - DNA, 35 bp, Artificial Sequence
  Synthetic oligonucleotide
taacaaacccagcccgcattaccgagccaacgttt

SEQ ID NO: 81607 - DNA, 36 bp, Artificial Sequence
  Synthetic oligonucleotide
tcagacccaacccatttgtcatacacgcaccatcaa

SEQ ID NO: 81608 - DNA, 36 bp, Artificial Sequence
  Synthetic oligonucleotide
atacagtccacatccgatcatgaccgtcgaactcaa

SEQ ID NO: 81609 - DNA, 36 bp, Artificial Sequence
  Synthetic oligonucleotide
gcaaccgccgcaagcgttacgccatcccccatcgaa

SEQ ID NO: 81610 - DNA, 36 bp, Artificial Sequence
  Synthetic oligonucleotide
gacacggggagagatggcgacggggcttattcggaa

SEQ ID NO: 81611 - DNA, 36 bp, Artificial Sequence
  Synthetic oligonucleotide
gtcaccctcagcccacctacggcagtcccacgctaa

SEQ ID NO: 81612 - DNA, 35 bp, Artificial Sequence
  Synthetic oligonucleotide
ttactcgcgctgagctgtctcgactccgcgacaca

SEQ ID NO: 81613 - DNA, 36 bp, Artificial Sequence
  Synthetic oligonucleotide
tgacctcctccccctgcaagttgtttctgtaaacca

SEQ ID NO: 81614 - DNA, 36 bp, Artificial Sequence
  Synthetic oligonucleotide
tctaccccgaggatatctgtcgcccttattgtacca

SEQ ID NO: 81615 - DNA, 36 bp, Artificial Sequence
  Synthetic oligonucleotide
gacgggccaccacaaattgaagccactcatgtccca

SEQ ID NO: 81616 - DNA, 32 bp, Artificial Sequence
  Synthetic oligonucleotide
gcaacctcacatacatcgcctttagcgcgcca

SEQ ID NO: 81617 - DNA, 36 bp, Artificial Sequence
  Synthetic oligonucleotide
tactcgagcggtaaaggttgctcgggccttactcca

SEQ ID NO: 81618 - DNA, 36 bp, Artificial Sequence
  Synthetic oligonucleotide
tacacaacggttaccgcgctgcttgggatccttcca

SEQ ID NO: 81619 - DNA, 36 bp, Artificial Sequence
  Synthetic oligonucleotide
atcgccctcaccgaattgcattgcaatacttaagca

SEQ ID NO: 81620 - DNA, 36 bp, Artificial Sequence
  Synthetic oligonucleotide
tgagggaaacttgggttaatgcagaggggagacgca

SEQ ID NO: 81621 - DNA, 36 bp, Artificial Sequence
  Synthetic oligonucleotide
tccaacacgtcaatctctttggtttcactttgcgca

SEQ ID NO: 81622 - DNA, 36 bp, Artificial Sequence
  Synthetic oligonucleotide
tcaaaaggccattcctccgcgctactcctctgggca

SEQ ID NO: 81623 - DNA, 36 bp, Artificial Sequence
  Synthetic oligonucleotide
gaccaccatccctgcactacgtacgttagccctgca

SEQ ID NO: 81624 - DNA, 35 bp, Artificial Sequence
  Synthetic oligonucleotide
tagtcgtgcaaagtccccccagcacctgttctgca

SEQ ID NO: 81625 - DNA, 37 bp, Artificial Sequence
  Synthetic oligonucleotide
tgtgatgggacaagaatggggggaaatgctgatatca

SEQ ID NO: 81626 - DNA, 36 bp, Artificial Sequence
  Synthetic oligonucleotide
tcatagtatgggaggagcgggggggagaggttatca

SEQ ID NO: 81627 - DNA, 35 bp, Artificial Sequence
  Synthetic oligonucleotide
gacgatgcttgcagggagtctttatatggcactca

SEQ ID NO: 81628 - DNA, 36 bp, Artificial Sequence
  Synthetic oligonucleotide
ttgctccggggtacgtcgttttttgcaagctcctca

SEQ ID NO: 81629 - DNA, 36 bp, Artificial Sequence
  Synthetic oligonucleotide
gagccataaggtcgctttcttatcagcctgctttca

SEQ ID NO: 81630 - DNA, 37 bp, Artificial Sequence
  Synthetic oligonucleotide
ggtcaaaggggggaggaacggttgagtcttcgcaaga

SEQ ID NO: 81631 - DNA, 36 bp, Artificial Sequence
  Synthetic oligonucleotide
taggtgagaaggcggttgagggtgaggatatgaaga

SEQ ID NO: 81632 - DNA, 37 bp, Artificial Sequence
  Synthetic oligonucleotide
agcgcggtagggagggaaaattgtttgcgggttaaga

SEQ ID NO: 81633 - DNA, 37 bp, Artificial Sequence
  Synthetic oligonucleotide
tgcaagactggccaaagaacggatagcaggggaacga

SEQ ID NO: 81634 - DNA, 37 bp, Artificial Sequence
  Synthetic oligonucleotide
tccgttccacacacccatgccaaggagagttacacga

SEQ ID NO: 81635 - DNA, 36 bp, Artificial Sequence
  Synthetic oligonucleotide
aaccacgtttgagtgtttttgcccgcctattcacga

SEQ ID NO: 81636 - DNA, 33 bp, Artificial Sequence
  Synthetic oligonucleotide
gtctcacgccgtcatttttttcttgtgggccga

SEQ ID NO: 81637 - DNA, 37 bp, Artificial Sequence
  Synthetic oligonucleotide
gtaagtaggtgaggaaaggaggatcttgaacgggcga

SEQ ID NO: 81638 - DNA, 37 bp, Artificial Sequence
  Synthetic oligonucleotide
gaggaaagtggggggtggtttaggaatgcatatgcga

SEQ ID NO: 81639 - DNA, 37 bp, Artificial Sequence
  Synthetic oligonucleotide
tgcactccctccgacgttgtacgcccgcgtcctgcga

SEQ ID NO: 81640 - DNA, 37 bp, Artificial Sequence
  Synthetic oligonucleotide
acacacacggagatgctgatcgctacgatcttgtcga

SEQ ID NO: 81641 - DNA, 37 bp, Artificial Sequence
  Synthetic oligonucleotide
atgggacgcgcggttcttctcttcctggggggttcga

SEQ ID NO: 81642 - DNA, 35 bp, Artificial Sequence
  Synthetic oligonucleotide
gcaccgtaaccgtgcttgtccccctaccgatagga

SEQ ID NO: 81643 - DNA, 37 bp, Artificial Sequence
  Synthetic oligonucleotide
gactgaagtcgcagcttatacccgattcccactagga

SEQ ID NO: 81644 - DNA, 36 bp, Artificial Sequence
  Synthetic oligonucleotide
gacccccctccacttcgcgtgaccagtcatgtagga

SEQ ID NO: 81645 - DNA, 37 bp, Artificial Sequence
  Synthetic oligonucleotide
tccgccgttcaacggttctgcaccgtccattaccgga

SEQ ID NO: 81646 - DNA, 36 bp, Artificial Sequence
  Synthetic oligonucleotide
gaggtaccgggaagaagtaaatagtgggggggcgga

SEQ ID NO: 81647 - DNA, 37 bp, Artificial Sequence
  Synthetic oligonucleotide
ttcacatgttacccgttccgttgcgccttccctggga

SEQ ID NO: 81648 - DNA, 37 bp, Artificial Sequence
  Synthetic oligonucleotide
tttggggcttacgtcatggggaacgtttggggtggga

SEQ ID NO: 81649 - DNA, 37 bp, Artificial Sequence
  Synthetic oligonucleotide
attgtgacaccgcctttctttgtcattgaggactgga

SEQ ID NO: 81650 - DNA, 35 bp, Artificial Sequence
  Synthetic oligonucleotide
atacccccgtgcacttggatcaggatctatctgga

SEQ ID NO: 81651 - DNA, 35 bp, Artificial Sequence
  Synthetic oligonucleotide
gtcaggtagaaagatcgaacgttgggagggaatga

SEQ ID NO: 81652 - DNA, 38 bp, Artificial Sequence
  Synthetic oligonucleotide
gttccgtactccgcatctcaaagcctgggatttcatga

SEQ ID NO: 81653 - DNA, 38 bp, Artificial Sequence
  Synthetic oligonucleotide
gtgcaatacgttgcggaaggaagtacagtcagggatga

SEQ ID NO: 81654 - DNA, 38 bp, Artificial Sequence
  Synthetic oligonucleotide
gacaggggagtggagggtatgggtcgtaacaggtatga

SEQ ID NO: 81655 - DNA, 37 bp, Artificial Sequence
  Synthetic oligonucleotide
tgttgaacacggcacaggggaatctaggtaaaactga

SEQ ID NO: 81656 - DNA, 38 bp, Artificial Sequence
  Synthetic oligonucleotide
tacgttgaggcgcccggtttcgtttccttgcacactga

SEQ ID NO: 81657 - DNA, 38 bp, Artificial Sequence
  Synthetic oligonucleotide
ttgccccttagttgccatcgactgttaacaatgcctga

SEQ ID NO: 81658 - DNA, 38 bp, Artificial Sequence
  Synthetic oligonucleotide
tcgatctatcgcatccccgtacggtccgttcctcctga

SEQ ID NO: 81659 - DNA, 37 bp, Artificial Sequence
  Synthetic oligonucleotide
gacccgccggcaaactgacctccctcttagttcctga

SEQ ID NO: 81660 - DNA, 38 bp, Artificial Sequence
  Synthetic oligonucleotide
ttccaaccccgtgtgtgacgtttcacttctcttgctga

SEQ ID NO: 81661 - DNA, 38 bp, Artificial Sequence
  Synthetic oligonucleotide
tcatctcacacgccacgccacggacagtcatttgctga

SEQ ID NO: 81662 - DNA, 38 bp, Artificial Sequence
  Synthetic oligonucleotide
gggaccatgaacgggggggaggtaggaaggtagagtga

SEQ ID NO: 81663 - DNA, 36 bp, Artificial Sequence
  Synthetic oligonucleotide
tgtatgcccgcgttgctgcctaacccaaatccgtga

SEQ ID NO: 81664 - DNA, 38 bp, Artificial Sequence
  Synthetic oligonucleotide
gagacattgacaacaggtatggacaagggggcaggtga

SEQ ID NO: 81665 - DNA, 36 bp, Artificial Sequence
  Synthetic oligonucleotide
aaccagttaggggtaggtccgggggggggtaggtga

SEQ ID NO: 81666 - DNA, 36 bp, Artificial Sequence
  Synthetic oligonucleotide
tctaccgtgcgcagggctattaggatgaatgggtga

SEQ ID NO: 81667 - DNA, 38 bp, Artificial Sequence
  Synthetic oligonucleotide
gagcacgggactgactggggtgcaaatgtgcgtggtga

SEQ ID NO: 81668 - DNA, 38 bp, Artificial Sequence
  Synthetic oligonucleotide
accgccgtacctgatcgggtgatttctctgcactgtga

SEQ ID NO: 81669 - DNA, 37 bp, Artificial Sequence
  Synthetic oligonucleotide
aaatcacctctccataatgtgttcacccacggtgtga

SEQ ID NO: 81670 - DNA, 38 bp, Artificial Sequence
  Synthetic oligonucleotide
acggtgggggtcagccctgcgctcactatttgccttga

SEQ ID NO: 81671 - DNA, 37 bp, Artificial Sequence
  Synthetic oligonucleotide
tcgacctccccgttgtctacctttcgtgattccttga

SEQ ID NO: 81672 - DNA, 38 bp, Artificial Sequence
  Synthetic oligonucleotide
gcggagtgtcccattcatctcgttgcgctccatcttga

SEQ ID NO: 81673 - DNA, 36 bp, Artificial Sequence
  Synthetic oligonucleotide
aatacctctcgcactgactgtaagggagtgctttga

SEQ ID NO: 81674 - DNA, 35 bp, Artificial Sequence
  Synthetic oligonucleotide
agtgaccggggaaaggagctaaagcaagtgagata

SEQ ID NO: 81675 - DNA, 36 bp, Artificial Sequence
  Synthetic oligonucleotide
aggagccatcgacccagcacaactgccagcactcta

SEQ ID NO: 81676 - DNA, 35 bp, Artificial Sequence
  Synthetic oligonucleotide
gagcgaagcgagcccccgagcggccctggagagta

SEQ ID NO: 81677 - DNA, 36 bp, Artificial Sequence
  Synthetic oligonucleotide
agagtcacagagcagggataggggggttgtggagta

SEQ ID NO: 81678 - DNA, 35 bp, Artificial Sequence
  Synthetic oligonucleotide
gagatggagataggggctggcatcagaagagcgta

SEQ ID NO: 81679 - DNA, 36 bp, Artificial Sequence
  Synthetic oligonucleotide
gcacacatgacttagaaatcgcctgcaaacctcgta

SEQ ID NO: 81680 - DNA, 36 bp, Artificial Sequence
  Synthetic oligonucleotide
gtcccactcgcgtcacctacgcaatcagcagttgta

SEQ ID NO: 81681 - DNA, 36 bp, Artificial Sequence
  Synthetic oligonucleotide
ggagctggccctcgcgcgtgcactctctcttttgta

SEQ ID NO: 81682 - DNA, 35 bp, Artificial Sequence
  Synthetic oligonucleotide
atcccaagccccactaaacggtaatagcggtatta

SEQ ID NO: 81683 - DNA, 36 bp, Artificial Sequence
  Synthetic oligonucleotide
tgtacgaccccgtgcactgctgccactcgatactta

SEQ ID NO: 81684 - DNA, 35 bp, Artificial Sequence
  Synthetic oligonucleotide
tatccgatcaccgcatgaacctcgctccttattta

SEQ ID NO: 81685 - DNA, 37 bp, Artificial Sequence
  Synthetic oligonucleotide
gacgcatcaccaccgcatctacatccagcacggttta

SEQ ID NO: 81686 - DNA, 35 bp, Artificial Sequence
  Synthetic oligonucleotide
tccgacgtcacgaaacctaatgccgccccatcgac

SEQ ID NO: 81687 - DNA, 36 bp, Artificial Sequence
  Synthetic oligonucleotide
gccttctcctcaccgtcctatctgccacctggatac

SEQ ID NO: 81688 - DNA, 35 bp, Artificial Sequence
  Synthetic oligonucleotide
agtccgacccgtggcttataacaccctggccctac

SEQ ID NO: 81689 - DNA, 35 bp, Artificial Sequence
  Synthetic oligonucleotide
gatacactggaagcgcattctaattggcttgaacc

SEQ ID NO: 81690 - DNA, 35 bp, Artificial Sequence
  Synthetic oligonucleotide
ttgacccattacaggtttcagcgctggccatcccc

SEQ ID NO: 81691 - DNA, 35 bp, Artificial Sequence
  Synthetic oligonucleotide
aagtacaatcacccccgtgccgcagattcaaggcc

SEQ ID NO: 81692 - DNA, 35 bp, Artificial Sequence
  Synthetic oligonucleotide
atcgtccaccgagttgctgttttattatgcatgcc

SEQ ID NO: 81693 - DNA, 35 bp, Artificial Sequence
  Synthetic oligonucleotide
tcatctccgccaacagttaagtcatattttgctcc

SEQ ID NO: 81694 - DNA, 35 bp, Artificial Sequence
  Synthetic oligonucleotide
gctgaggaccgcccgattgcatcttcctgggttcc

SEQ ID NO: 81695 - DNA, 35 bp, Artificial Sequence
  Synthetic oligonucleotide
taacacggagggcatgtccttctgtttctccttgc

SEQ ID NO: 81696 - DNA, 35 bp, Artificial Sequence
  Synthetic oligonucleotide
gacatgcgaactgactagccccgcccagcgaaatc

SEQ ID NO: 81697 - DNA, 35 bp, Artificial Sequence
  Synthetic oligonucleotide
aattgccaccccccctagtaccactcggctctatc

SEQ ID NO: 81698 - DNA, 35 bp, Artificial Sequence
  Synthetic oligonucleotide
atcccacagcccacgcgccttccagaccgcttatc

SEQ ID NO: 81699 - DNA, 34 bp, Artificial Sequence
  Synthetic oligonucleotide
tgccgcccaatcgcacccctcagtagtaaaactc

SEQ ID NO: 81700 - DNA, 35 bp, Artificial Sequence
  Synthetic oligonucleotide
tagccaaccacgatcctcctctaactcatgtagtc

SEQ ID NO: 81701 - DNA, 35 bp, Artificial Sequence
  Synthetic oligonucleotide
ttggagggacaggaggagactatgggggatgtgtc

SEQ ID NO: 81702 - DNA, 35 bp, Artificial Sequence
  Synthetic oligonucleotide
cccattacacgaactgcatcttgtaggaacctttc

SEQ ID NO: 81703 - DNA, 35 bp, Artificial Sequence
  Synthetic oligonucleotide
gagtagacacagacgaaaaatggaaagagcgacag

SEQ ID NO: 81704 - DNA, 35 bp, Artificial Sequence
  Synthetic oligonucleotide
gactcccgcccttagactaccgccgaatctaagag

SEQ ID NO: 81705 - DNA, 35 bp, Artificial Sequence
  Synthetic oligonucleotide
atgggggccgaaataatggaaggagaataaaatcg

SEQ ID NO: 81706 - DNA, 35 bp, Artificial Sequence
  Synthetic oligonucleotide
acacccaacgagttccgctccagtagcccaccagg

SEQ ID NO: 81707 - DNA, 33 bp, Artificial Sequence
  Synthetic oligonucleotide
tgtgttgggggagatgtccacgggttgaaaggg

SEQ ID NO: 81708 - DNA, 35 bp, Artificial Sequence
  Synthetic oligonucleotide
acgcgataccaggaaggtgttgaaggtgggtaggg

SEQ ID NO: 81709 - DNA, 35 bp, Artificial Sequence
  Synthetic oligonucleotide
gaaggaaaagtggctgattgatctttaacgtgggg

SEQ ID NO: 81710 - DNA, 35 bp, Artificial Sequence
  Synthetic oligonucleotide
gacatgctgggttaggaatcgtagggggtgaatgg

SEQ ID NO: 81711 - DNA, 35 bp, Artificial Sequence
  Synthetic oligonucleotide
tccctgactcacccgcgccaatcggcattaattgg

SEQ ID NO: 81712 - DNA, 35 bp, Artificial Sequence
  Synthetic oligonucleotide
aagtagtgtaggtacacaaagggaataggttttgg

SEQ ID NO: 81713 - DNA, 35 bp, Artificial Sequence
  Synthetic oligonucleotide
atgcacccccttgtagcctccaactgctctacctg

SEQ ID NO: 81714 - DNA, 35 bp, Artificial Sequence
  Synthetic oligonucleotide
gtgagcgcccggatggcctaaatatccccttgctg

SEQ ID NO: 81715 - DNA, 35 bp, Artificial Sequence
  Synthetic oligonucleotide
tcaccctgccccccgttagcgtacgcggccagttg

SEQ ID NO: 81716 - DNA, 35 bp, Artificial Sequence
  Synthetic oligonucleotide
acatgagggaggcgggcgaaacagagatcactttg

SEQ ID NO: 81717 - DNA, 35 bp, Artificial Sequence
  Synthetic oligonucleotide
ttgccctgcacgatcctccttatatacggttgtat

SEQ ID NO: 81718 - DNA, 35 bp, Artificial Sequence
  Synthetic oligonucleotide
gctgggtgctgccagtcagaaaccacactaccact

SEQ ID NO: 81719 - DNA, 35 bp, Artificial Sequence
  Synthetic oligonucleotide
gtccgctccaatcaatacttgtatgggctccacct

SEQ ID NO: 81720 - DNA, 35 bp, Artificial Sequence
  Synthetic oligonucleotide
atttgtgtcggtcgccattatggaacctcctccct

SEQ ID NO: 81721 - DNA, 35 bp, Artificial Sequence
  Synthetic oligonucleotide
tttccgaaggatgccacagcatagtatctctccct

SEQ ID NO: 81722 - DNA, 35 bp, Artificial Sequence
  Synthetic oligonucleotide
ctccctgggccctctgacgctgttatatccgtcct

SEQ ID NO: 81723 - DNA, 35 bp, Artificial Sequence
  Synthetic oligonucleotide
tattccgggagacacctcgtgacgttacaattcct

SEQ ID NO: 81724 - DNA, 35 bp, Artificial Sequence
  Synthetic oligonucleotide
agctgcacatgccgtgcgcccggccgtatcttcct

SEQ ID NO: 81725 - DNA, 35 bp, Artificial Sequence
  Synthetic oligonucleotide
tagctctccggtaaggtttcgctgacccacaatct

SEQ ID NO: 81726 - DNA, 35 bp, Artificial Sequence
  Synthetic oligonucleotide
acccatcacagaagttctgagttcgctcgatatct

SEQ ID NO: 81727 - DNA, 35 bp, Artificial Sequence
  Synthetic oligonucleotide
ggtccctgaggtattgatcctgccgccttctctct

SEQ ID NO: 81728 - DNA, 35 bp, Artificial Sequence
  Synthetic oligonucleotide
ttgcgaagggtaacttgcggaagtggaggacccgt

SEQ ID NO: 81729 - DNA, 35 bp, Artificial Sequence
  Synthetic oligonucleotide
aacataggcccatctgaccactcaggccccccggt

SEQ ID NO: 81730 - DNA, 35 bp, Artificial Sequence
  Synthetic oligonucleotide
gtaacatccgactgccgtgagcgcaaccccagggt

SEQ ID NO: 81731 - DNA, 35 bp, Artificial Sequence
  Synthetic oligonucleotide
tccacttgcgcagactctaccccgccaccgttatt

SEQ ID NO: 81732 - DNA, 35 bp, Artificial Sequence
  Synthetic oligonucleotide
gctggggggaaatggaaacgaaatcggaggtcctt

SEQ ID NO: 81733 - DNA, 35 bp, Artificial Sequence
  Synthetic oligonucleotide
tcaacgccacccttctgcaccagttgtggaatctt

SEQ ID NO: 81734 - DNA, 35 bp, Artificial Sequence
  Synthetic oligonucleotide
gtccatggctgtggttaaccttgtaccgtattttt

SEQ ID NO: 81735 - DNA, 35 bp, Artificial Sequence
  Synthetic oligonucleotide
gtcgactacaactgctccagtttgccctcaggcaa

SEQ ID NO: 81736 - DNA, 35 bp, Artificial Sequence
  Synthetic oligonucleotide
gagccggagtgggaattagggctggcgaaaacgaa

SEQ ID NO: 81737 - DNA, 34 bp, Artificial Sequence
  Synthetic oligonucleotide
ggactacaacactccgcctgcgccgccacctgaa

SEQ ID NO: 81738 - DNA, 36 bp, Artificial Sequence
  Synthetic oligonucleotide
gccctcactgcctcctcaagaccgagacagattgaa

SEQ ID NO: 81739 - DNA, 36 bp, Artificial Sequence
  Synthetic oligonucleotide
gtgacacccctcatctcatggctgacgggccaataa

SEQ ID NO: 81740 - DNA, 36 bp, Artificial Sequence
  Synthetic oligonucleotide
tccgcacccaacccactgtgccttccgtctctataa

SEQ ID NO: 81741 - DNA, 36 bp, Artificial Sequence
  Synthetic oligonucleotide
gaccactgcatccgacctcctatacacttattttaa

SEQ ID NO: 81742 - DNA, 36 bp, Artificial Sequence
  Synthetic oligonucleotide
gtgaggggaaggtttgggggagcggcgcaagtaaca

SEQ ID NO: 81743 - DNA, 35 bp, Artificial Sequence
  Synthetic oligonucleotide
gcccttaaccgcccccgtctggggttgttcacaca

SEQ ID NO: 81744 - DNA, 36 bp, Artificial Sequence
  Synthetic oligonucleotide
tcgaagacccagactcccgcttagtacactgacaca

SEQ ID NO: 81745 - DNA, 35 bp, Artificial Sequence
  Synthetic oligonucleotide
ttggtctgccccttcaaagcccggtaaatgccaca

SEQ ID NO: 81746 - DNA, 36 bp, Artificial Sequence
  Synthetic oligonucleotide
gcccccgcaatcgcagttccgctccgatcttgcaca

SEQ ID NO: 81747 - DNA, 35 bp, Artificial Sequence
  Synthetic oligonucleotide
ggtaagggtggagagtagcgaggagggaagcgaca

SEQ ID NO: 81748 - DNA, 36 bp, Artificial Sequence
  Synthetic oligonucleotide
tcctgtccatctggtcctcgccatgtcccctgtaca

SEQ ID NO: 81749 - DNA, 36 bp, Artificial Sequence
  Synthetic oligonucleotide
tcccggaactcacatcgactctcttagctacgacca

SEQ ID NO: 81750 - DNA, 36 bp, Artificial Sequence
  Synthetic oligonucleotide
tgcatcggaaaaaccaggctcacttctaggaacgca

SEQ ID NO: 81751 - DNA, 35 bp, Artificial Sequence
  Synthetic oligonucleotide
gaccggggcacaggcccgggaaaaaatgggacgca

SEQ ID NO: 81752 - DNA, 36 bp, Artificial Sequence
  Synthetic oligonucleotide
gcacaggacatcggagcaaagtaaaataaggcatca

SEQ ID NO: 81753 - DNA, 36 bp, Artificial Sequence
  Synthetic oligonucleotide
gcccccgcaagagagccaatgctcactactgtatca

SEQ ID NO: 81754 - DNA, 36 bp, Artificial Sequence
  Synthetic oligonucleotide
gcgcaatgggcactggcgtttttatttcactactca

SEQ ID NO: 81755 - DNA, 36 bp, Artificial Sequence
  Synthetic oligonucleotide
ttgcgacccggcgcttttacttccttttgttcctca

SEQ ID NO: 81756 - DNA, 38 bp, Artificial Sequence
  Synthetic oligonucleotide
tcacccgccccgccccaatcaaaccactgtccgagtca

SEQ ID NO: 81757 - DNA, 36 bp, Artificial Sequence
  Synthetic oligonucleotide
gagcgatcatacgctctgcaacaaccggttttttca

SEQ ID NO: 81758 - DNA, 37 bp, Artificial Sequence
  Synthetic oligonucleotide
atggatagggcggctggtgaaatgcaggatgccaaga

SEQ ID NO: 81759 - DNA, 36 bp, Artificial Sequence
  Synthetic oligonucleotide
gtgtccgcctagttttaccgtagtccccttccaaga

SEQ ID NO: 81760 - DNA, 37 bp, Artificial Sequence
  Synthetic oligonucleotide
tagcccaccgactgggccatacgctgaccgaactaga

SEQ ID NO: 81761 - DNA, 37 bp, Artificial Sequence
  Synthetic oligonucleotide
gatgcaggtcaaacttccccattccctaacagttaga

SEQ ID NO: 81762 - DNA, 37 bp, Artificial Sequence
  Synthetic oligonucleotide
gtcactccacgtccacattccgacgttcgctgaacga

SEQ ID NO: 81763 - DNA, 37 bp, Artificial Sequence
  Synthetic oligonucleotide
gagcctcccgcttacgttgccggcctggtaatcccga

SEQ ID NO: 81764 - DNA, 36 bp, Artificial Sequence
  Synthetic oligonucleotide
tccacccgagaagcccttgacattaagaggactcga

SEQ ID NO: 81765 - DNA, 36 bp, Artificial Sequence
  Synthetic oligonucleotide
gcacgaccgccccgccgcaggtcatcagtccctcga

SEQ ID NO: 81766 - DNA, 37 bp, Artificial Sequence
  Synthetic oligonucleotide
acccgccgctggtttcactcttcgacttccatgtcga

SEQ ID NO: 81767 - DNA, 37 bp, Artificial Sequence
  Synthetic oligonucleotide
tgtgtccaagtccgccgttcctaattccgcccttcga

SEQ ID NO: 81768 - DNA, 37 bp, Artificial Sequence
  Synthetic oligonucleotide
tccgcacctgtatcagccatccggttattatgttcga

SEQ ID NO: 81769 - DNA, 37 bp, Artificial Sequence
  Synthetic oligonucleotide
acttgccggggatatcaatgggggtggatggccagga

SEQ ID NO: 81770 - DNA, 37 bp, Artificial Sequence
  Synthetic oligonucleotide
agcgccatggagtgggagagggggtggaggtatagga

SEQ ID NO: 81771 - DNA, 37 bp, Artificial Sequence
  Synthetic oligonucleotide
ttgccaccacacgacagcagggatagggaaatacgga

SEQ ID NO: 81772 - DNA, 37 bp, Artificial Sequence
  Synthetic oligonucleotide
gcgtggggggtggacgaaaggaaacgagcatcccgga

SEQ ID NO: 81773 - DNA, 37 bp, Artificial Sequence
  Synthetic oligonucleotide
tcgattacacctccgccttgtgctcattttctcggga

SEQ ID NO: 81774 - DNA, 36 bp, Artificial Sequence
  Synthetic oligonucleotide
aacgggaggagggtatgttaaaagcaggtgggtgga

SEQ ID NO: 81775 - DNA, 37 bp, Artificial Sequence
  Synthetic oligonucleotide
tggtgggagggggggaagacagtataatcgatcatga

SEQ ID NO: 81776 - DNA, 38 bp, Artificial Sequence
  Synthetic oligonucleotide
gactcacgaaggtccccgcatatcctggacgtctatga

SEQ ID NO: 81777 - DNA, 37 bp, Artificial Sequence
  Synthetic oligonucleotide
aataggcggggtcaatgcaccaccctcctttttatga

SEQ ID NO: 81778 - DNA, 37 bp, Artificial Sequence
  Synthetic oligonucleotide
tgctccccatcgcgattcacgtgtctgtctttactga

SEQ ID NO: 81779 - DNA, 38 bp, Artificial Sequence
  Synthetic oligonucleotide
tgtcgccacgaagttttaatctccgctgtaacacctga

SEQ ID NO: 81780 - DNA, 38 bp, Artificial Sequence
  Synthetic oligonucleotide
gacaccgaagaagtgttaaacgggtcgggcgcatctga

SEQ ID NO: 81781 - DNA, 37 bp, Artificial Sequence
  Synthetic oligonucleotide
ataggggcgggagagggatcacaggtcgggtaagtga

SEQ ID NO: 81782 - DNA, 38 bp, Artificial Sequence
  Synthetic oligonucleotide
gtggtacaagccgacaggaaagggtcttgggggcgtga

SEQ ID NO: 81783 - DNA, 37 bp, Artificial Sequence
  Synthetic oligonucleotide
tagtacgtgatagggtgttcgggcatggtatgggtga

SEQ ID NO: 81784 - DNA, 38 bp, Artificial Sequence
  Synthetic oligonucleotide
gctgccagttgatgcctctatctttcttccctctgtga

SEQ ID NO: 81785 - DNA, 38 bp, Artificial Sequence
  Synthetic oligonucleotide
tgagccactagtgtgcccactcacctcctgtaaattga

SEQ ID NO: 81786 - DNA, 38 bp, Artificial Sequence
  Synthetic oligonucleotide
taggtgggagtggagggcctgaggtggacgccaattga

SEQ ID NO: 81787 - DNA, 38 bp, Artificial Sequence
  Synthetic oligonucleotide
accgtcccgcatctgcgaaaattactgctgggcattga

SEQ ID NO: 81788 - DNA, 35 bp, Artificial Sequence
  Synthetic oligonucleotide
tgcacacaaccactttaggcgttcgtaaaccttga

SEQ ID NO: 81789 - DNA, 38 bp, Artificial Sequence
  Synthetic oligonucleotide
aatgccgccacggaacaattgcaatggatctgccttga

SEQ ID NO: 81790 - DNA, 37 bp, Artificial Sequence
  Synthetic oligonucleotide
acgcagagtctgtcattttcaccagcaccctccttga

SEQ ID NO: 81791 - DNA, 38 bp, Artificial Sequence
  Synthetic oligonucleotide
tgtactgcccatcatataacaatttggatccatcttga

SEQ ID NO: 81792 - DNA, 38 bp, Artificial Sequence
  Synthetic oligonucleotide
atacgtccctgctctccacgtccggcctctgactttga

SEQ ID NO: 81793 - DNA, 38 bp, Artificial Sequence
  Synthetic oligonucleotide
gagtgtggggagagattacacaggggagtggggtttga

SEQ ID NO: 81794 - DNA, 38 bp, Artificial Sequence
  Synthetic oligonucleotide
gcacacaatgagcgaagttcgcgagttccaatttttga

SEQ ID NO: 81795 - DNA, 38 bp, Artificial Sequence
  Synthetic oligonucleotide
gtgctcctcttaagcgattggagcttatgcctttttga

SEQ ID NO: 81796 - DNA, 36 bp, Artificial Sequence
  Synthetic oligonucleotide
atccacccggtcggcgcaactccctcggactaaata

SEQ ID NO: 81797 - DNA, 36 bp, Artificial Sequence
  Synthetic oligonucleotide
gtgtcggtgtaataggtggcacaggaggagcatata

SEQ ID NO: 81798 - DNA, 36 bp, Artificial Sequence
  Synthetic oligonucleotide
gctccacaaacgagtatggtcccgcttgcctatcta

SEQ ID NO: 81799 - DNA, 35 bp, Artificial Sequence
  Synthetic oligonucleotide
atagtccaccacatttgctacttgagtgacgagta

SEQ ID NO: 81800 - DNA, 36 bp, Artificial Sequence
  Synthetic oligonucleotide
taggcctggtcgctccatcgcctcacgtaacccgta

SEQ ID NO: 81801 - DNA, 36 bp, Artificial Sequence
  Synthetic oligonucleotide
tgtgaccacgccacttccgtacatcgccctcccgta

SEQ ID NO: 81802 - DNA, 36 bp, Artificial Sequence
  Synthetic oligonucleotide
agcccggtcctcctctataaataacctacggatgta

SEQ ID NO: 81803 - DNA, 36 bp, Artificial Sequence
  Synthetic oligonucleotide
tgtcccctcaaactcccgatatatgcactaactgta

SEQ ID NO: 81804 - DNA, 36 bp, Artificial Sequence
  Synthetic oligonucleotide
tcagtgcgaagcggtaagaagaacgagtagtcgtta

SEQ ID NO: 81805 - DNA, 36 bp, Artificial Sequence
  Synthetic oligonucleotide
ggaccccaactgaggtcaacgaacctggcaaattta

SEQ ID NO: 81806 - DNA, 36 bp, Artificial Sequence
  Synthetic oligonucleotide
gccatacgccatcataactgcgattttcatctttta

SEQ ID NO: 81807 - DNA, 35 bp, Artificial Sequence
  Synthetic oligonucleotide
gactcaaagcatgcgtatctcacgcctcgcgtaac

SEQ ID NO: 81808 - DNA, 35 bp, Artificial Sequence
  Synthetic oligonucleotide
taagagttgtcgatctgtcctgccttcgttcacac

SEQ ID NO: 81809 - DNA, 35 bp, Artificial Sequence
  Synthetic oligonucleotide
tagccaacctcacaaagacggaacgccccacccac

SEQ ID NO: 81810 - DNA, 35 bp, Artificial Sequence
  Synthetic oligonucleotide
acacgttccgcgtggcattccacccaagaccgcac

SEQ ID NO: 81811 - DNA, 35 bp, Artificial Sequence
  Synthetic oligonucleotide
atccccgctccaccacacctccattgcttggagac

SEQ ID NO: 81812 - DNA, 36 bp, Artificial Sequence
  Synthetic oligonucleotide
tcgcacgggcacataacgaaaacctcacgggtagac

SEQ ID NO: 81813 - DNA, 35 bp, Artificial Sequence
  Synthetic oligonucleotide
gcaggggccagtaggacaaagtgatgttgtacgac

SEQ ID NO: 81814 - DNA, 35 bp, Artificial Sequence
  Synthetic oligonucleotide
acacatgacttcgcatcaccaccaatctattggac

SEQ ID NO: 81815 - DNA, 35 bp, Artificial Sequence
  Synthetic oligonucleotide
tcaggcaatcgatgtaacttacgctcgcccacccc

SEQ ID NO: 81816 - DNA, 35 bp, Artificial Sequence
  Synthetic oligonucleotide
gtccgattccgttgagcctttcttccggcttcccc

SEQ ID NO: 81817 - DNA, 35 bp, Artificial Sequence
  Synthetic oligonucleotide
gcgcctgttgcgtccctgctcttctacgccagccc

SEQ ID NO: 81818 - DNA, 35 bp, Artificial Sequence
  Synthetic oligonucleotide
gactcgtgcataggtattggaaaccttgctgtccc

SEQ ID NO: 81819 - DNA, 35 bp, Artificial Sequence
  Synthetic oligonucleotide
tacccgtttgctagcctgagcactgaagccacgcc

SEQ ID NO: 81820 - DNA, 35 bp, Artificial Sequence
  Synthetic oligonucleotide
taggggtgcggtccacaagcgattcaacttccgcc

SEQ ID NO: 81821 - DNA, 35 bp, Artificial Sequence
  Synthetic oligonucleotide
tctgctcctcgcaccgttgccaagccccaattgcc

SEQ ID NO: 81822 - DNA, 34 bp, Artificial Sequence
  Synthetic oligonucleotide
tctcgtggggggcgtttccttcttgtctcactcc

SEQ ID NO: 81823 - DNA, 35 bp, Artificial Sequence
  Synthetic oligonucleotide
atgcccgacccgttgttggcacgcactattcctcc

SEQ ID NO: 81824 - DNA, 35 bp, Artificial Sequence
  Synthetic oligonucleotide
gtccgaccaagaggactgtcaacgtaacccaacgc

SEQ ID NO: 81825 - DNA, 35 bp, Artificial Sequence
  Synthetic oligonucleotide
atgtcctccgccgtaacctcaaattcaccatacgc

SEQ ID NO: 81826 - DNA, 35 bp, Artificial Sequence
  Synthetic oligonucleotide
taaggctccgcagcaccgcatcatgctaatctcgc

SEQ ID NO: 81827 - DNA, 35 bp, Artificial Sequence
  Synthetic oligonucleotide
accgtagaggtccgccgtaatcgatcatctggatc

SEQ ID NO: 81828 - DNA, 34 bp, Artificial Sequence
  Synthetic oligonucleotide
ttcctgctgtgttccgtacccccttctattggtc

SEQ ID NO: 81829 - DNA, 35 bp, Artificial Sequence
  Synthetic oligonucleotide
ggatggaacaaccgacccctgccttctgctcattc

SEQ ID NO: 81830 - DNA, 35 bp, Artificial Sequence
  Synthetic oligonucleotide
ttgaactgcccagcccataatggtgactcctaaag

SEQ ID NO: 81831 - DNA, 35 bp, Artificial Sequence
  Synthetic oligonucleotide
taaatgttggcggaagggaggggtgctgttgcgag

SEQ ID NO: 81832 - DNA, 35 bp, Artificial Sequence
  Synthetic oligonucleotide
tggtacgtccacacgtctccgccgcacactgttag

SEQ ID NO: 81833 - DNA, 35 bp, Artificial Sequence
  Synthetic oligonucleotide
ttggtggaaccatcgacgtataccctacttgaacg

SEQ ID NO: 81834 - DNA, 35 bp, Artificial Sequence
  Synthetic oligonucleotide
atcttcactgcccgcacgttatggcgcatttaacg

SEQ ID NO: 81835 - DNA, 35 bp, Artificial Sequence
  Synthetic oligonucleotide
gcgctgccccatcacagacgcctcagacccgtacg

SEQ ID NO: 81836 - DNA, 35 bp, Artificial Sequence
  Synthetic oligonucleotide
gaccgatctcgccctcgctttgaaacaggggaccg

SEQ ID NO: 81837 - DNA, 34 bp, Artificial Sequence
  Synthetic oligonucleotide
gcatgttctgaacgcacaccccgccgtagtatcg

SEQ ID NO: 81838 - DNA, 32 bp, Artificial Sequence
  Synthetic oligonucleotide
gataacggaacatggttagtaaggggggtagg

SEQ ID NO: 81839 - DNA, 34 bp, Artificial Sequence
  Synthetic oligonucleotide
gtgggctcatggtgagggggaatgatattgcggg

SEQ ID NO: 81840 - DNA, 35 bp, Artificial Sequence
  Synthetic oligonucleotide
agtggaaggaggagccgtggcgtttgagggcgggg

SEQ ID NO: 81841 - DNA, 35 bp, Artificial Sequence
  Synthetic oligonucleotide
agacggaagaaagtaccaacgaaggtggggcgggg

SEQ ID NO: 81842 - DNA, 35 bp, Artificial Sequence
  Synthetic oligonucleotide
ggatcaccctggtgtccgcgcccttcattgcactg

SEQ ID NO: 81843 - DNA, 35 bp, Artificial Sequence
  Synthetic oligonucleotide
atgcgctttagttaccgtccactctacgatccgtg

SEQ ID NO: 81844 - DNA, 35 bp, Artificial Sequence
  Synthetic oligonucleotide
gttgtccaccgagtatttgtttcattcgcaacttg

SEQ ID NO: 81845 - DNA, 35 bp, Artificial Sequence
  Synthetic oligonucleotide
gtagcatcccggcgtagtaacttctgccacttttg

SEQ ID NO: 81846 - DNA, 35 bp, Artificial Sequence
  Synthetic oligonucleotide
tcccatcgaaaccattgtgactatttttgccggat

SEQ ID NO: 81847 - DNA, 35 bp, Artificial Sequence
  Synthetic oligonucleotide
gaccgtacccatactctgaactgacgcgatcctat

SEQ ID NO: 81848 - DNA, 35 bp, Artificial Sequence
  Synthetic oligonucleotide
acgcactgaccagcctacatggctgaattactcct

SEQ ID NO: 81849 - DNA, 35 bp, Artificial Sequence
  Synthetic oligonucleotide
gaacacagcggcccccagtttcatcattttatgct

SEQ ID NO: 81850 - DNA, 35 bp, Artificial Sequence
  Synthetic oligonucleotide
atgaagccggaaggaaaggaaggaaataggcctct

SEQ ID NO: 81851 - DNA, 32 bp, Artificial Sequence
  Synthetic oligonucleotide
gtcacgtaactgctccgtaaaacttggttcgt

SEQ ID NO: 81852 - DNA, 35 bp, Artificial Sequence
  Synthetic oligonucleotide
gtcatctgcctcacatatcgccgaatctttacggt

SEQ ID NO: 81853 - DNA, 35 bp, Artificial Sequence
  Synthetic oligonucleotide
gactgcaatcgtagggttgatctgatcttcttctt

SEQ ID NO: 81854 - DNA, 35 bp, Artificial Sequence
  Synthetic oligonucleotide
tgtgtaccaccatccatcggaagaaaaggtttctt

SEQ ID NO: 81855 - DNA, 35 bp, Artificial Sequence
  Synthetic oligonucleotide
tccaccgttcaccaacaacaattaagggttccgtt

SEQ ID NO: 81856 - DNA, 35 bp, Artificial Sequence
  Synthetic oligonucleotide
gcagaccccctgttgcctggtatgacgctggcgtt

SEQ ID NO: 81857 - DNA, 35 bp, Artificial Sequence
  Synthetic oligonucleotide
tgtgacaaacccccgatattaacacatgacgtgtt

SEQ ID NO: 81858 - DNA, 35 bp, Artificial Sequence
  Synthetic oligonucleotide
gaagggtggtggaggtatttatcatttggaggaaa

SEQ ID NO: 81859 - DNA, 36 bp, Artificial Sequence
  Synthetic oligonucleotide
tcatctccgcatggagctttaccgcattactatcaa

SEQ ID NO: 81860 - DNA, 35 bp, Artificial Sequence
  Synthetic oligonucleotide
accaagggggggctaaggatggagaggggacgtaa

SEQ ID NO: 81861 - DNA, 36 bp, Artificial Sequence
  Synthetic oligonucleotide
gtcgcaaactccgcccgggctttactggccgacaca

SEQ ID NO: 81862 - DNA, 36 bp, Artificial Sequence
  Synthetic oligonucleotide
ggacacggcctggttctttaatctgttacgtccaca

SEQ ID NO: 81863 - DNA, 36 bp, Artificial Sequence
  Synthetic oligonucleotide
gtacgtgatggggagtgggtggatgataaaactaca

SEQ ID NO: 81864 - DNA, 36 bp, Artificial Sequence
  Synthetic oligonucleotide
gacctctgcgcttacctttagttatttgggcctaca

SEQ ID NO: 81865 - DNA, 36 bp, Artificial Sequence
  Synthetic oligonucleotide
gttgcaccatcctggcgaggttccatcgacgttaca

SEQ ID NO: 81866 - DNA, 36 bp, Artificial Sequence
  Synthetic oligonucleotide
gctcaaacagggtacgtacaaccgaccccaacacca

SEQ ID NO: 81867 - DNA, 36 bp, Artificial Sequence
  Synthetic oligonucleotide
gccaaaacaagcgtgcacagtcatctcgtaacacca

SEQ ID NO: 81868 - DNA, 35 bp, Artificial Sequence
  Synthetic oligonucleotide
acaaccaggggtagacctgttttcgttggttacca

SEQ ID NO: 81869 - DNA, 35 bp, Artificial Sequence
  Synthetic oligonucleotide
gcaaacgtcaactactgtgcttacgacgcccccca

SEQ ID NO: 81870 - DNA, 36 bp, Artificial Sequence
  Synthetic oligonucleotide
tgcacccttcacatctaacgcgcaagtgcatcggca

SEQ ID NO: 81871 - DNA, 36 bp, Artificial Sequence
  Synthetic oligonucleotide
tcagatgggcgggggaggtcggagtaaggagaatca

SEQ ID NO: 81872 - DNA, 36 bp, Artificial Sequence
  Synthetic oligonucleotide
atggtgtctggggcttgccgttttgtgctctcttca

SEQ ID NO: 81873 - DNA, 37 bp, Artificial Sequence
  Synthetic oligonucleotide
aacgagatgggcggtgagagggaacatcattggaaga

SEQ ID NO: 81874 - DNA, 36 bp, Artificial Sequence
  Synthetic oligonucleotide
gccattcctatcttgccgtgttgtttgcccctaaga

SEQ ID NO: 81875 - DNA, 37 bp, Artificial Sequence
  Synthetic oligonucleotide
aaagataacggagtgagggggaaaacggtgacataga

SEQ ID NO: 81876 - DNA, 37 bp, Artificial Sequence
  Synthetic oligonucleotide
tagggggagggagtggccggatgttcagtcgagtaga

SEQ ID NO: 81877 - DNA, 37 bp, Artificial Sequence
  Synthetic oligonucleotide
tctgcatccgcacgccattgttaaaatctcctgtaga

SEQ ID NO: 81878 - DNA, 37 bp, Artificial Sequence
  Synthetic oligonucleotide
tttgatcgcagaccatttcctacttagtgctgaacga

SEQ ID NO: 81879 - DNA, 37 bp, Artificial Sequence
  Synthetic oligonucleotide
acctcccccgctccggttcatattttcgggttaacga

SEQ ID NO: 81880 - DNA, 37 bp, Artificial Sequence
  Synthetic oligonucleotide
gtcactgcccatgccgttagaggaggctcatatccga

SEQ ID NO: 81881 - DNA, 37 bp, Artificial Sequence
  Synthetic oligonucleotide
acccaacgcctaatgcttatccgattatgttcgtcga

SEQ ID NO: 81882 - DNA, 37 bp, Artificial Sequence
  Synthetic oligonucleotide
tccgaagggcggtgatatggaaaggggattgaaagga

SEQ ID NO: 81883 - DNA, 37 bp, Artificial Sequence
  Synthetic oligonucleotide
gttgaggctggacggtggcagggggcggcaagcagga

SEQ ID NO: 81884 - DNA, 37 bp, Artificial Sequence
  Synthetic oligonucleotide
gacacctagcctgtttttttcgttccctgcagacgga

SEQ ID NO: 81885 - DNA, 37 bp, Artificial Sequence
  Synthetic oligonucleotide
gtgtagcagtcacttcatcccacactcacccccggga

SEQ ID NO: 81886 - DNA, 36 bp, Artificial Sequence
  Synthetic oligonucleotide
aagtatgcgggctgcagagagagggcggtaggggga

SEQ ID NO: 81887 - DNA, 37 bp, Artificial Sequence
  Synthetic oligonucleotide
tgggagataggtgggaaaggggacttgatgtggggga

SEQ ID NO: 81888 - DNA, 36 bp, Artificial Sequence
  Synthetic oligonucleotide
ggaggggccgaaggcgctgggaaggcgacatgggga

SEQ ID NO: 81889 - DNA, 35 bp, Artificial Sequence
  Synthetic oligonucleotide
gctggctccggccattcatcatactccgcctggga

SEQ ID NO: 81890 - DNA, 37 bp, Artificial Sequence
  Synthetic oligonucleotide
gttggcatctgggggataacagctgtagggggatgga

SEQ ID NO: 81891 - DNA, 38 bp, Artificial Sequence
  Synthetic oligonucleotide
ttgagccgccacggagtcattcaccggtcatggaatga

SEQ ID NO: 81892 - DNA, 36 bp, Artificial Sequence
  Synthetic oligonucleotide
tctggccctgctgagctactcgagccctactaatga

SEQ ID NO: 81893 - DNA, 38 bp, Artificial Sequence
  Synthetic oligonucleotide
aagggtagcgcatagggtggagatggtgagagggatga

SEQ ID NO: 81894 - DNA, 38 bp, Artificial Sequence
  Synthetic oligonucleotide
attgtgcaccattcgttctcccgcaagttcatacctga

SEQ ID NO: 81895 - DNA, 37 bp, Artificial Sequence
  Synthetic oligonucleotide
aatccgcccgaatctgatcggtccgttccactcctga

SEQ ID NO: 81896 - DNA, 37 bp, Artificial Sequence
  Synthetic oligonucleotide
acaccgcacatgtcacagtggtgatgcacaacgctga

SEQ ID NO: 81897 - DNA, 38 bp, Artificial Sequence
  Synthetic oligonucleotide
attgttgctgtcctcaggtacccatcccccattgctga

SEQ ID NO: 81898 - DNA, 36 bp, Artificial Sequence
  Synthetic oligonucleotide
tattcagcgcagattatgatcgctcctttcctctga

SEQ ID NO: 81899 - DNA, 37 bp, Artificial Sequence
  Synthetic oligonucleotide
ttgagaacgaaggggttaggagaggagacattagtga

SEQ ID NO: 81900 - DNA, 38 bp, Artificial Sequence
  Synthetic oligonucleotide
gtaacgaaaatgcgaaggggacaaggaaatagacgtga

SEQ ID NO: 81901 - DNA, 37 bp, Artificial Sequence
  Synthetic oligonucleotide
tagtaaggcgctttccccctgtctcatcatcccgtga

SEQ ID NO: 81902 - DNA, 38 bp, Artificial Sequence
  Synthetic oligonucleotide
gatcacgaagttggcctgataaaagggatggagggtga

SEQ ID NO: 81903 - DNA, 35 bp, Artificial Sequence
  Synthetic oligonucleotide
tccaccccatcacttaactccgggcacctttgtga

SEQ ID NO: 81904 - DNA, 37 bp, Artificial Sequence
  Synthetic oligonucleotide
tgaccgtctcagttatcgccttccccgtacgaattga

SEQ ID NO: 81905 - DNA, 38 bp, Artificial Sequence
  Synthetic oligonucleotide
agaccacccaccggacgaccccaatggcaggctattga

SEQ ID NO: 81906 - DNA, 38 bp, Artificial Sequence
  Synthetic oligonucleotide
gactccgtgtcgtttcaactttgggtgtcactccttga

SEQ ID NO: 81907 - DNA, 36 bp, Artificial Sequence
  Synthetic oligonucleotide
tcaggagctcgaccaccttaccgcgtatttgcttga

SEQ ID NO: 81908 - DNA, 38 bp, Artificial Sequence
  Synthetic oligonucleotide
acctgttgctggccatctaatatatgtggtttggttga

SEQ ID NO: 81909 - DNA, 38 bp, Artificial Sequence
  Synthetic oligonucleotide
atcgcggcaaacaggtggcggcattaggggtgttttga

SEQ ID NO: 81910 - DNA, 36 bp, Artificial Sequence
  Synthetic oligonucleotide
tcactctcgcttagacactctattacatgacagata

SEQ ID NO: 81911 - DNA, 35 bp, Artificial Sequence
  Synthetic oligonucleotide
gtaaaaacgggtagagggatggggactttgatata

SEQ ID NO: 81912 - DNA, 35 bp, Artificial Sequence
  Synthetic oligonucleotide
tcccgtgcgcctgcctcctgccggaaacagatcta

SEQ ID NO: 81913 - DNA, 36 bp, Artificial Sequence
  Synthetic oligonucleotide
aacaacgcggcgactgctctcgaaccctgccaagta

SEQ ID NO: 81914 - DNA, 36 bp, Artificial Sequence
  Synthetic oligonucleotide
tagcagacctcccgccccataggtcgaaaccttgta

SEQ ID NO: 81915 - DNA, 35 bp, Artificial Sequence
  Synthetic oligonucleotide
tcagcgactgccttgatccacccctgcacggctta

SEQ ID NO: 81916 - DNA, 35 bp, Artificial Sequence
  Synthetic oligonucleotide
ttgtaagtacgactacgcccggcctcttcccgtta

SEQ ID NO: 81917 - DNA, 35 bp, Artificial Sequence
  Synthetic oligonucleotide
agagaaacaggggacgcagaggaagagagataaac

SEQ ID NO: 81918 - DNA, 35 bp, Artificial Sequence
  Synthetic oligonucleotide
gatacactcgtccggttatccgtctattaccacac

SEQ ID NO: 81919 - DNA, 35 bp, Artificial Sequence
  Synthetic oligonucleotide
agccgacctgacttttgattctctgtacgttgcac

SEQ ID NO: 81920 - DNA, 35 bp, Artificial Sequence
  Synthetic oligonucleotide
tcagactcgagcgaacgaacctctagggctaatac

SEQ ID NO: 81921 - DNA, 35 bp, Artificial Sequence
  Synthetic oligonucleotide
ttcgcacgaaatcgccgtccccgcccgaaaccacc

SEQ ID NO: 81922 - DNA, 35 bp, Artificial Sequence
  Synthetic oligonucleotide
gccacccacatgatcttgattctttcacacacccc

SEQ ID NO: 81923 - DNA, 35 bp, Artificial Sequence
  Synthetic oligonucleotide
accctgcccctgtacgattgacagcttggagcccc

SEQ ID NO: 81924 - DNA, 35 bp, Artificial Sequence
  Synthetic oligonucleotide
gcaccagattagccgttaacgcccgatgtattccc

SEQ ID NO: 81925 - DNA, 35 bp, Artificial Sequence
  Synthetic oligonucleotide
acgtaacccgcaccgtacccctagccttagttgcc

SEQ ID NO: 81926 - DNA, 35 bp, Artificial Sequence
  Synthetic oligonucleotide
tcagagtcactcatgggcgtatgcatcatccttcc

SEQ ID NO: 81927 - DNA, 35 bp, Artificial Sequence
  Synthetic oligonucleotide
tgctcaggtccccgccaatttcgtttatccgttgc

SEQ ID NO: 81928 - DNA, 35 bp, Artificial Sequence
  Synthetic oligonucleotide
aatcgcgcactgcgatatcaacgtgctatcggctc

SEQ ID NO: 81929 - DNA, 33 bp, Artificial Sequence
  Synthetic oligonucleotide
gcattgtccgaaccggtactcctcccgaacgtc

SEQ ID NO: 81930 - DNA, 35 bp, Artificial Sequence
  Synthetic oligonucleotide
tgcaatcagcccaccacataagctactgttcacag

SEQ ID NO: 81931 - DNA, 35 bp, Artificial Sequence
  Synthetic oligonucleotide
aatccaccacctagtccgagcttggctttcgctcg

SEQ ID NO: 81932 - DNA, 35 bp, Artificial Sequence
  Synthetic oligonucleotide
tccaactgacgtcagcagaacacgaaagcacatgg

SEQ ID NO: 81933 - DNA, 35 bp, Artificial Sequence
  Synthetic oligonucleotide
ttaatcggcgggggagtgcgggggggattcaaatg

SEQ ID NO: 81934 - DNA, 35 bp, Artificial Sequence
  Synthetic oligonucleotide
gagtggagagcagtatgcgataaggacgtgtaatg

SEQ ID NO: 81935 - DNA, 35 bp, Artificial Sequence
  Synthetic oligonucleotide
gcatccagtccgctccgactgctcatttcgtactg

SEQ ID NO: 81936 - DNA, 35 bp, Artificial Sequence
  Synthetic oligonucleotide
tgtgcctagagccactcatcttcacgtacagcttg

SEQ ID NO: 81937 - DNA, 35 bp, Artificial Sequence
  Synthetic oligonucleotide
acctacgactcgacctgtttgtgcgccaatgcttg

SEQ ID NO: 81938 - DNA, 35 bp, Artificial Sequence
  Synthetic oligonucleotide
acccagcacacattacactgtggccacacgtgcat

SEQ ID NO: 81939 - DNA, 34 bp, Artificial Sequence
  Synthetic oligonucleotide
agccgcgatcggatcataacaacctgcgcctcat

SEQ ID NO: 81940 - DNA, 35 bp, Artificial Sequence
  Synthetic oligonucleotide
gcttcccgtaccacgccttcacctgcggtcttcat

SEQ ID NO: 81941 - DNA, 35 bp, Artificial Sequence
  Synthetic oligonucleotide
gaacaccgcctgttcaaagaattctagtttactat

SEQ ID NO: 81942 - DNA, 35 bp, Artificial Sequence
  Synthetic oligonucleotide
gtgtcgtacagggttggttttgctacatcccttct

SEQ ID NO: 81943 - DNA, 35 bp, Artificial Sequence
  Synthetic oligonucleotide
gcacgctgggtctttctattttggtatgttgcggt

SEQ ID NO: 81944 - DNA, 35 bp, Artificial Sequence
  Synthetic oligonucleotide
tccctggtccgctcaaagcatacttttggccctgt

SEQ ID NO: 81945 - DNA, 35 bp, Artificial Sequence
  Synthetic oligonucleotide
tccccgactcgtgcacctttggtagctcccaaatt

SEQ ID NO: 81946 - DNA, 35 bp, Artificial Sequence
  Synthetic oligonucleotide
gccgtagcccccgtgtcgctacatacatacatatt

SEQ ID NO: 81947 - DNA, 35 bp, Artificial Sequence
  Synthetic oligonucleotide
ccagacatcggcttagtcttctttttttacgcgtt

SEQ ID NO: 81948 - DNA, 35 bp, Artificial Sequence
  Synthetic oligonucleotide
gcaacgtgcattgcaccacatgacgacctgaggtt

SEQ ID NO: 81949 - DNA, 35 bp, Artificial Sequence
  Synthetic oligonucleotide
tcctcacccacttgggttggtccatttaattacaa

SEQ ID NO: 81950 - DNA, 35 bp, Artificial Sequence
  Synthetic oligonucleotide
gctgggagcactagaaggcgatgcactccccccaa

SEQ ID NO: 81951 - DNA, 36 bp, Artificial Sequence
  Synthetic oligonucleotide
gattccagctctaaacgctggctgttatgtttccaa

SEQ ID NO: 81952 - DNA, 36 bp, Artificial Sequence
  Synthetic oligonucleotide
tatccacctcatttcggctgctgtactcgttccgaa

SEQ ID NO: 81953 - DNA, 36 bp, Artificial Sequence
  Synthetic oligonucleotide
gttatggccatgcgagatcctgccctctcacggtaa

SEQ ID NO: 81954 - DNA, 35 bp, Artificial Sequence
  Synthetic oligonucleotide
ggaaccgggtagggggggcgccgcggggcaattaa

SEQ ID NO: 81955 - DNA, 35 bp, Artificial Sequence
  Synthetic oligonucleotide
tcagccacaacgattatccctgcagcgccgacaca

SEQ ID NO: 81956 - DNA, 36 bp, Artificial Sequence
  Synthetic oligonucleotide
taccccctgcccgcaggagtgcatatgtcacgcaca

SEQ ID NO: 81957 - DNA, 36 bp, Artificial Sequence
  Synthetic oligonucleotide
gctgcccgtggccccaggaacgccctcaatgtacca

SEQ ID NO: 81958 - DNA, 36 bp, Artificial Sequence
  Synthetic oligonucleotide
gattgcaggcaaagttgactccatctcaatcaccca

SEQ ID NO: 81959 - DNA, 35 bp, Artificial Sequence
  Synthetic oligonucleotide
acgatacacccactcatctgcctggtattacgcca

SEQ ID NO: 81960 - DNA, 36 bp, Artificial Sequence
  Synthetic oligonucleotide
gagcccgctacatttacaccaggtacacctactcca

SEQ ID NO: 81961 - DNA, 36 bp, Artificial Sequence
  Synthetic oligonucleotide
aattcggccgacgccgttcggtcatcgccccttcca

SEQ ID NO: 81962 - DNA, 36 bp, Artificial Sequence
  Synthetic oligonucleotide
ggaccctacaaatatccgaatgcaccatgcatagca

SEQ ID NO: 81963 - DNA, 35 bp, Artificial Sequence
  Synthetic oligonucleotide
acccactggaccgctcctccaatcataactgcgca

SEQ ID NO: 81964 - DNA, 36 bp, Artificial Sequence
  Synthetic oligonucleotide
tgacgaccacaggggcttcgtgacaccttaatcgca

SEQ ID NO: 81965 - DNA, 36 bp, Artificial Sequence
  Synthetic oligonucleotide
gctggtcccgcctacacaatgctcccacagtctgca

SEQ ID NO: 81966 - DNA, 35 bp, Artificial Sequence
  Synthetic oligonucleotide
tcaggaccactactcccgcgtctgatcggctctca

SEQ ID NO: 81967 - DNA, 36 bp, Artificial Sequence
  Synthetic oligonucleotide
tgggacaaggggagaatggggattcacggggggtca

SEQ ID NO: 81968 - DNA, 36 bp, Artificial Sequence
  Synthetic oligonucleotide
ggagcgcatgaaatttccgttaccgcctctctttca

SEQ ID NO: 81969 - DNA, 37 bp, Artificial Sequence
  Synthetic oligonucleotide
tacactgaggtcagcgggggggaaggaatttggaaga

SEQ ID NO: 81970 - DNA, 37 bp, Artificial Sequence
  Synthetic oligonucleotide
tgaacgaactcatcctcatagcgacagacaggccaga

SEQ ID NO: 81971 - DNA, 37 bp, Artificial Sequence
  Synthetic oligonucleotide
taagtgacgggcgagagggtaagatagaaggaataga

SEQ ID NO: 81972 - DNA, 37 bp, Artificial Sequence
  Synthetic oligonucleotide
acacaacaagggtatggtaggggggtgcaatcttaga

SEQ ID NO: 81973 - DNA, 36 bp, Artificial Sequence
  Synthetic oligonucleotide
tgtggagagaggacagacagggagtaaggagttaga

SEQ ID NO: 81974 - DNA, 36 bp, Artificial Sequence
  Synthetic oligonucleotide
tattgccgccagctgccgggtacaccgcttctacga

SEQ ID NO: 81975 - DNA, 37 bp, Artificial Sequence
  Synthetic oligonucleotide
agaccgcttcacatcctctgccccgacgactgcgcga

SEQ ID NO: 81976 - DNA, 37 bp, Artificial Sequence
  Synthetic oligonucleotide
gggaacgacacagcaggtaggaaggtggagagtgcga

SEQ ID NO: 81977 - DNA, 36 bp, Artificial Sequence
  Synthetic oligonucleotide
tcacaaatggcacattctatcttcgtacagaatcga

SEQ ID NO: 81978 - DNA, 37 bp, Artificial Sequence
  Synthetic oligonucleotide
atgagtgcagcctgaaccagcgacaccttgctctcga

SEQ ID NO: 81979 - DNA, 37 bp, Artificial Sequence
  Synthetic oligonucleotide
gtaccggagtggagcgtaaagcatcaggaagaaagga

SEQ ID NO: 81980 - DNA, 37 bp, Artificial Sequence
  Synthetic oligonucleotide
gaccgccgtccagtagcatagaagttgctcatcagga

SEQ ID NO: 81981 - DNA, 37 bp, Artificial Sequence
  Synthetic oligonucleotide
gcatccacctagtcagcaaaaccaccccctcctagga

SEQ ID NO: 81982 - DNA, 37 bp, Artificial Sequence
  Synthetic oligonucleotide
tattgcggccctggttgttaccctctttgttccggga

SEQ ID NO: 81983 - DNA, 37 bp, Artificial Sequence
  Synthetic oligonucleotide
ggatcagttcacaaggcaaacgtgaggtaggggggga

SEQ ID NO: 81984 - DNA, 37 bp, Artificial Sequence
  Synthetic oligonucleotide
ttggggttatcccgggtgttatcaggggttgggggga

SEQ ID NO: 81985 - DNA, 37 bp, Artificial Sequence
  Synthetic oligonucleotide
gcatcatgggggtacggtacgaagggaggagtgggga

SEQ ID NO: 81986 - DNA, 37 bp, Artificial Sequence
  Synthetic oligonucleotide
tccactccccataccggacaggagccccgaccatgga

SEQ ID NO: 81987 - DNA, 36 bp, Artificial Sequence
  Synthetic oligonucleotide
tccacggtcaactcgcacgctccggtaccttatgga

SEQ ID NO: 81988 - DNA, 36 bp, Artificial Sequence
  Synthetic oligonucleotide
ggtgggtgttggggcgaagcgaggaacgcaagtgga

SEQ ID NO: 81989 - DNA, 37 bp, Artificial Sequence
  Synthetic oligonucleotide
agattcgaaggagggaggaaacaggggtggacgtgga

SEQ ID NO: 81990 - DNA, 37 bp, Artificial Sequence
  Synthetic oligonucleotide
actaaaagagccgggtgcaggtgcgggggaaggtgga

SEQ ID NO: 81991 - DNA, 38 bp, Artificial Sequence
  Synthetic oligonucleotide
tcactcctccatggaaattccgacaccgacatccatga

SEQ ID NO: 81992 - DNA, 38 bp, Artificial Sequence
  Synthetic oligonucleotide
gccagactcccgcttcttatggccacacaaattcatga

SEQ ID NO: 81993 - DNA, 37 bp, Artificial Sequence
  Synthetic oligonucleotide
ttacatggccagcactcctataccgacctgctgatga

SEQ ID NO: 81994 - DNA, 37 bp, Artificial Sequence
  Synthetic oligonucleotide
gatgcaagtccgtggttattatcccccatgcttatga

SEQ ID NO: 81995 - DNA, 37 bp, Artificial Sequence
  Synthetic oligonucleotide
tgccatgtaagatctccatccctgacgatgctactga

SEQ ID NO: 81996 - DNA, 38 bp, Artificial Sequence
  Synthetic oligonucleotide
tgcgaacccgggaggtggtaggatcactattgtactga

SEQ ID NO: 81997 - DNA, 38 bp, Artificial Sequence
  Synthetic oligonucleotide
gagacctcagcaggggtggagggatgtagtacggctga

SEQ ID NO: 81998 - DNA, 38 bp, Artificial Sequence
  Synthetic oligonucleotide
gaacgaagtggcgggcgtggtggttgtttatgggctga

SEQ ID NO: 81999 - DNA, 38 bp, Artificial Sequence
  Synthetic oligonucleotide
tacgatgtgagttgtggtggtagagatggtggatctga

SEQ ID NO: 82000 - DNA, 38 bp, Artificial Sequence
  Synthetic oligonucleotide
ggacaaggcgtcctgaagcttcgccatcactcttctga

SEQ ID NO: 82001 - DNA, 38 bp, Artificial Sequence
  Synthetic oligonucleotide
atggaggggaatcagcggaggataagacggagtagtga

SEQ ID NO: 82002 - DNA, 38 bp, Artificial Sequence
  Synthetic oligonucleotide
gggagtgggcgggagggttctccaggtgcaggcggtga

SEQ ID NO: 82003 - DNA, 37 bp, Artificial Sequence
  Synthetic oligonucleotide
gcgaggtgttgatgacatggagtgaggaatgatgtga

SEQ ID NO: 82004 - DNA, 37 bp, Artificial Sequence
  Synthetic oligonucleotide
gcatcgttcctgccccagcccgtgctctccacattga

SEQ ID NO: 82005 - DNA, 38 bp, Artificial Sequence
  Synthetic oligonucleotide
gctggggcacacgtgcacactgcaagacccgcccttga

SEQ ID NO: 82006 - DNA, 37 bp, Artificial Sequence
  Synthetic oligonucleotide
gaaggagtgcggcccgaagatggatgagaggatttga

SEQ ID NO: 82007 - DNA, 38 bp, Artificial Sequence
  Synthetic oligonucleotide
acgccgattgagctcacccgcctgtcacctagctttga

SEQ ID NO: 82008 - DNA, 35 bp, Artificial Sequence
  Synthetic oligonucleotide
gccgcccgaacgcattaggtgaatgctcaagcata

SEQ ID NO: 82009 - DNA, 36 bp, Artificial Sequence
  Synthetic oligonucleotide
agccagagcattgggggggattattgggcgggtata

SEQ ID NO: 82010 - DNA, 35 bp, Artificial Sequence
  Synthetic oligonucleotide
gcaccctcgacgtgccctttacttttgcaccacta

SEQ ID NO: 82011 - DNA, 36 bp, Artificial Sequence
  Synthetic oligonucleotide
gcttcatgcagccccctcaacgctcaaccatggcta

SEQ ID NO: 82012 - DNA, 36 bp, Artificial Sequence
  Synthetic oligonucleotide
ggacaggtgctccaagcgtgggagggagggtttcta

SEQ ID NO: 82013 - DNA, 35 bp, Artificial Sequence
  Synthetic oligonucleotide
ttctacgcccgcacgtgctttgctgcccaatctta

SEQ ID NO: 82014 - DNA, 35 bp, Artificial Sequence
  Synthetic oligonucleotide
tacctactcacgtgtctgccactatccagctctta

SEQ ID NO: 82015 - DNA, 36 bp, Artificial Sequence
  Synthetic oligonucleotide
tgctcagctacatttcctacacctgggcccttctta

SEQ ID NO: 82016 - DNA, 36 bp, Artificial Sequence
  Synthetic oligonucleotide
gtaagcccgcggcctcaatttatactatcaacgtta

SEQ ID NO: 82017 - DNA, 36 bp, Artificial Sequence
  Synthetic oligonucleotide
agtacgttgggaccactttttttgctgaacttttta

SEQ ID NO: 82018 - DNA, 35 bp, Artificial Sequence
  Synthetic oligonucleotide
gaccaacgcatgtaacctgggccatcactacacac

SEQ ID NO: 82019 - DNA, 35 bp, Artificial Sequence
  Synthetic oligonucleotide
acaccaactagcccgttgtttggggccactcctac

SEQ ID NO: 82020 - DNA, 35 bp, Artificial Sequence
  Synthetic oligonucleotide
ggtgtgcgccgacacaaattttgatacgcctaacc

SEQ ID NO: 82021 - DNA, 35 bp, Artificial Sequence
  Synthetic oligonucleotide
gatgctggatcgctgctttcatctagttagtcacc

SEQ ID NO: 82022 - DNA, 35 bp, Artificial Sequence
  Synthetic oligonucleotide
gacgcattgggcgtcaacgcggagggagattcacc

SEQ ID NO: 82023 - DNA, 35 bp, Artificial Sequence
  Synthetic oligonucleotide
acatctatcgcacaacacgggcggcacatataccc

SEQ ID NO: 82024 - DNA, 35 bp, Artificial Sequence
  Synthetic oligonucleotide
tgatacctagcaaccatgatagtcccgttttaccc

SEQ ID NO: 82025 - DNA, 35 bp, Artificial Sequence
  Synthetic oligonucleotide
atccgactgaactcatacaggtgtccatcatgccc

SEQ ID NO: 82026 - DNA, 35 bp, Artificial Sequence
  Synthetic oligonucleotide
gacacacatcatgcaccccgagtttattgcctgcc

SEQ ID NO: 82027 - DNA, 35 bp, Artificial Sequence
  Synthetic oligonucleotide
tcacagtgcgggagtgtaagctcactaccacctcc

SEQ ID NO: 82028 - DNA, 35 bp, Artificial Sequence
  Synthetic oligonucleotide
attaccgctcctgtacttcgattatcatacgattc

SEQ ID NO: 82029 - DNA, 36 bp, Artificial Sequence
  Synthetic oligonucleotide
gtgacacacacaaaggtaacatttccaagcccgttc

SEQ ID NO: 82030 - DNA, 35 bp, Artificial Sequence
  Synthetic oligonucleotide
gaacacgttagaatgtcccatggtgggtggggaag

SEQ ID NO: 82031 - DNA, 35 bp, Artificial Sequence
  Synthetic oligonucleotide
acgtctggccattcttctgcgcaacacctacgtag

SEQ ID NO: 82032 - DNA, 35 bp, Artificial Sequence
  Synthetic oligonucleotide
gattgaacaaagggagttgggagagtattgggagg

SEQ ID NO: 82033 - DNA, 35 bp, Artificial Sequence
  Synthetic oligonucleotide
gtggtcgccccaaatgctgcccaattgctactagg

SEQ ID NO: 82034 - DNA, 35 bp, Artificial Sequence
  Synthetic oligonucleotide
gtggcattagccacgtaatagagggggaggatggg

SEQ ID NO: 82035 - DNA, 35 bp, Artificial Sequence
  Synthetic oligonucleotide
tcactcgctcctggctttctaaacagcagcttggg

SEQ ID NO: 82036 - DNA, 35 bp, Artificial Sequence
  Synthetic oligonucleotide
agacgacctctcccctccttacagcgctaggctgg

SEQ ID NO: 82037 - DNA, 35 bp, Artificial Sequence
  Synthetic oligonucleotide
gccctgccccgtttttgggttaactatcgtacctg

SEQ ID NO: 82038 - DNA, 35 bp, Artificial Sequence
  Synthetic oligonucleotide
atgtgtgcgcatttccgaacttacactggtttgtg

SEQ ID NO: 82039 - DNA, 35 bp, Artificial Sequence
  Synthetic oligonucleotide
gacagggggcgttcatcaggccggaaccttcgaat

SEQ ID NO: 82040 - DNA, 35 bp, Artificial Sequence
  Synthetic oligonucleotide
acatgtccacgatcacgcctacatggttgttacat

SEQ ID NO: 82041 - DNA, 35 bp, Artificial Sequence
  Synthetic oligonucleotide
tgaaggtgctcagggcgtcttgaggagggggggat

SEQ ID NO: 82042 - DNA, 35 bp, Artificial Sequence
  Synthetic oligonucleotide
tgttgacgacgcccgggagtactggaaaacccact

SEQ ID NO: 82043 - DNA, 35 bp, Artificial Sequence
  Synthetic oligonucleotide
acatccacccagcttctgccgccatttcagtcgct

SEQ ID NO: 82044 - DNA, 35 bp, Artificial Sequence
  Synthetic oligonucleotide
ttcacgctaccctgtctcgttccatattaagctct

SEQ ID NO: 82045 - DNA, 35 bp, Artificial Sequence
  Synthetic oligonucleotide
gcgatggcgggcggttaccttcgtctcgtttctct

SEQ ID NO: 82046 - DNA, 35 bp, Artificial Sequence
  Synthetic oligonucleotide
tccacccttgcactatcgttatgccccaccttggt

SEQ ID NO: 82047 - DNA, 35 bp, Artificial Sequence
  Synthetic oligonucleotide
atcccatgcggtaaccatccgcgttcattgcctgt

SEQ ID NO: 82048 - DNA, 35 bp, Artificial Sequence
  Synthetic oligonucleotide
gatcgaaatcagcaatcttaacactgtctctctgt

SEQ ID NO: 82049 - DNA, 35 bp, Artificial Sequence
  Synthetic oligonucleotide
acccctgcacggatcttttattaaactcgggaatt

SEQ ID NO: 82050 - DNA, 35 bp, Artificial Sequence
  Synthetic oligonucleotide
agaccgagggctgaactgggcactatgggggaatt

SEQ ID NO: 82051 - DNA, 35 bp, Artificial Sequence
  Synthetic oligonucleotide
tcagcccaatgcccccttacgatgcacgccgcctt

SEQ ID NO: 82052 - DNA, 35 bp, Artificial Sequence
  Synthetic oligonucleotide
gatgcatcaatagcgggtagatagcaagcggagtt

SEQ ID NO: 82053 - DNA, 35 bp, Artificial Sequence
  Synthetic oligonucleotide
gaccacgggcgactggcttcgcatcagtccttttt

SEQ ID NO: 82054 - DNA, 35 bp, Artificial Sequence
  Synthetic oligonucleotide
gctcagtgccgtcccatcttcccctcaattaaaaa

SEQ ID NO: 82055 - DNA, 36 bp, Artificial Sequence
  Synthetic oligonucleotide
gatggagcacctgggggggggatacagtgtcgaaaa

SEQ ID NO: 82056 - DNA, 36 bp, Artificial Sequence
  Synthetic oligonucleotide
agaccgcaactgttaatctgaccacctcacgacaaa

SEQ ID NO: 82057 - DNA, 36 bp, Artificial Sequence
  Synthetic oligonucleotide
aaccgcgcacggacggtaccccatactaagcccaaa

SEQ ID NO: 82058 - DNA, 36 bp, Artificial Sequence
  Synthetic oligonucleotide
gcacgctctacttgatcgcacattcgcacatatcaa

SEQ ID NO: 82059 - DNA, 36 bp, Artificial Sequence
  Synthetic oligonucleotide
taacacgtgaggaggccacagcagcctgagaacgaa

SEQ ID NO: 82060 - DNA, 36 bp, Artificial Sequence
  Synthetic oligonucleotide
agaccgcaaaaggagagctggagcaactatcgtgaa

SEQ ID NO: 82061 - DNA, 36 bp, Artificial Sequence
  Synthetic oligonucleotide
ttgtcacacctggcttagcgctttgcattccactaa

SEQ ID NO: 82062 - DNA, 36 bp, Artificial Sequence
  Synthetic oligonucleotide
acgcacgccctctacataacgaagcagcgactctaa

SEQ ID NO: 82063 - DNA, 37 bp, Artificial Sequence
  Synthetic oligonucleotide
ttcaagtgccattacaccattgggcctgatcttttaa

SEQ ID NO: 82064 - DNA, 35 bp, Artificial Sequence
  Synthetic oligonucleotide
tcccgcctccctcatgcgctttttatgaaactaca

SEQ ID NO: 82065 - DNA, 36 bp, Artificial Sequence
  Synthetic oligonucleotide
ttgcacccatgcactccctggacgacctgtcctaca

SEQ ID NO: 82066 - DNA, 36 bp, Artificial Sequence
  Synthetic oligonucleotide
tacctccagccctcgtcctaataaatgtgcccacca

SEQ ID NO: 82067 - DNA, 35 bp, Artificial Sequence
  Synthetic oligonucleotide
gacacacgcacgcatgactctattaggattgacca

SEQ ID NO: 82068 - DNA, 36 bp, Artificial Sequence
  Synthetic oligonucleotide
acgactggccaattgggtaattccataactcgccca

SEQ ID NO: 82069 - DNA, 36 bp, Artificial Sequence
  Synthetic oligonucleotide
accacgcatcggcgttcttgtcggtacattatccca

SEQ ID NO: 82070 - DNA, 35 bp, Artificial Sequence
  Synthetic oligonucleotide
actgatacacccgcgcattagtccgtggtttccca

SEQ ID NO: 82071 - DNA, 36 bp, Artificial Sequence
  Synthetic oligonucleotide
accgtccgcgaatgcatccctactgaatagccgcca

SEQ ID NO: 82072 - DNA, 36 bp, Artificial Sequence
  Synthetic oligonucleotide
tcccgtgcacacatcgtctaacactcccgcatgcca

SEQ ID NO: 82073 - DNA, 36 bp, Artificial Sequence
  Synthetic oligonucleotide
gcacatcttccgttgcgaaaccttgccttgcatcca

SEQ ID NO: 82074 - DNA, 36 bp, Artificial Sequence
  Synthetic oligonucleotide
atcagcctccccgtggtcacagaccatgcatctcca

SEQ ID NO: 82075 - DNA, 36 bp, Artificial Sequence
  Synthetic oligonucleotide
tacgcctcatttggaccgctctgacgattgccatca

SEQ ID NO: 82076 - DNA, 36 bp, Artificial Sequence
  Synthetic oligonucleotide
gctgctcaccgatgtaactcaccttattctgtatca

SEQ ID NO: 82077 - DNA, 36 bp, Artificial Sequence
  Synthetic oligonucleotide
actagcgggccagtttgatgctagcgctctccctca

SEQ ID NO: 82078 - DNA, 36 bp, Artificial Sequence
  Synthetic oligonucleotide
taagcttgtggcctattgatccatctgctgccttca

SEQ ID NO: 82079 - DNA, 37 bp, Artificial Sequence
  Synthetic oligonucleotide
atccacatcgcaggacctttttctccattctctcaga

SEQ ID NO: 82080 - DNA, 36 bp, Artificial Sequence
  Synthetic oligonucleotide
gtgaaacgcacggttctgtcacggataggatggaga

SEQ ID NO: 82081 - DNA, 37 bp, Artificial Sequence
  Synthetic oligonucleotide
gacgacacgagaagtctcggggaggaaacgtagtaga

SEQ ID NO: 82082 - DNA, 37 bp, Artificial Sequence
  Synthetic oligonucleotide
tacacgtaccagcccataacgtcctatgacaatacga

SEQ ID NO: 82083 - DNA, 31 bp, Artificial Sequence
  Synthetic oligonucleotide
tccgccgaatctcttagcctagcccccccga

SEQ ID NO: 82084 - DNA, 37 bp, Artificial Sequence
  Synthetic oligonucleotide
tccctgtgacgctttgacagagccatgctcttcccga

SEQ ID NO: 82085 - DNA, 37 bp, Artificial Sequence
  Synthetic oligonucleotide
gaacgcaccgagattgccgtctacttctgagggccga

SEQ ID NO: 82086 - DNA, 36 bp, Artificial Sequence
  Synthetic oligonucleotide
gacctcatgtgcaagttgacttgctgtactatccga

SEQ ID NO: 82087 - DNA, 37 bp, Artificial Sequence
  Synthetic oligonucleotide
tccagggggcgaagaagggggatctgaggaagcgcga

SEQ ID NO: 82088 - DNA, 37 bp, Artificial Sequence
  Synthetic oligonucleotide
aaaagtggggaaagacgggtgagggcagtgatggcga

SEQ ID NO: 82089 - DNA, 37 bp, Artificial Sequence
  Synthetic oligonucleotide
taccgaccattggacctgtggtacaaccactcttcga

SEQ ID NO: 82090 - DNA, 37 bp, Artificial Sequence
  Synthetic oligonucleotide
gcccgcacatccacgggcatcggacctcgcttttcga

SEQ ID NO: 82091 - DNA, 36 bp, Artificial Sequence
  Synthetic oligonucleotide
tggaaccgtagcgacctggcacacctctacatagga

SEQ ID NO: 82092 - DNA, 36 bp, Artificial Sequence
  Synthetic oligonucleotide
gaatcgccctaggggttacgcccacttccacacgga

SEQ ID NO: 82093 - DNA, 37 bp, Artificial Sequence
  Synthetic oligonucleotide
tctcatgccaaaaggtgggggaaggacgtggcacgga

SEQ ID NO: 82094 - DNA, 37 bp, Artificial Sequence
  Synthetic oligonucleotide
gcatccgtgctcatttttcagggcccctcacaccgga

SEQ ID NO: 82095 - DNA, 36 bp, Artificial Sequence
  Synthetic oligonucleotide
gaatagtgcaggggatcatcgggcgggtcgaaggga

SEQ ID NO: 82096 - DNA, 37 bp, Artificial Sequence
  Synthetic oligonucleotide
gacaggggcagggttatccactggggactggagggga

SEQ ID NO: 82097 - DNA, 37 bp, Artificial Sequence
  Synthetic oligonucleotide
gaggtggggttgattctggggatgatgtctttgggga

SEQ ID NO: 82098 - DNA, 36 bp, Artificial Sequence
  Synthetic oligonucleotide
agtgactgcacgagctgggtcgtggtttttctggga

SEQ ID NO: 82099 - DNA, 37 bp, Artificial Sequence
  Synthetic oligonucleotide
ggaggtccgtatggatgtgggatgggtggaggtggga

SEQ ID NO: 82100 - DNA, 38 bp, Artificial Sequence
  Synthetic oligonucleotide
gcctcccacaccaacatgggatacgtaccgctcctgga

SEQ ID NO: 82101 - DNA, 38 bp, Artificial Sequence
  Synthetic oligonucleotide
agttgggtgcaggggacgggactgaaagaagagaatga

SEQ ID NO: 82102 - DNA, 36 bp, Artificial Sequence
  Synthetic oligonucleotide
gtggggtgatcggggagtcatcaggagcaggaatga

SEQ ID NO: 82103 - DNA, 37 bp, Artificial Sequence
  Synthetic oligonucleotide
acagggaaaggcacggagtaatggcatggaaatatga

SEQ ID NO: 82104 - DNA, 38 bp, Artificial Sequence
  Synthetic oligonucleotide
gtcgtgtcatcgcttcatgggccttctcgtctctatga

SEQ ID NO: 82105 - DNA, 37 bp, Artificial Sequence
  Synthetic oligonucleotide
gcttgccacacactaagtacttgtacctctcaactga

SEQ ID NO: 82106 - DNA, 38 bp, Artificial Sequence
  Synthetic oligonucleotide
tacgcactgcgaggagccttacatgccgaaaaccctga

SEQ ID NO: 82107 - DNA, 38 bp, Artificial Sequence
  Synthetic oligonucleotide
gcgcacctgagtttggccctttgtcgccggttccctga

SEQ ID NO: 82108 - DNA, 38 bp, Artificial Sequence
  Synthetic oligonucleotide
tgcgccttgcagtggcctctactctccaaacttgctga

SEQ ID NO: 82109 - DNA, 37 bp, Artificial Sequence
  Synthetic oligonucleotide
aaaacacagcgcttttcccgttaatcgccgttgctga

SEQ ID NO: 82110 - DNA, 38 bp, Artificial Sequence
  Synthetic oligonucleotide
taatggtgggagggcaagaagtggggtatacaacgtga

SEQ ID NO: 82111 - DNA, 38 bp, Artificial Sequence
  Synthetic oligonucleotide
tacacgcattgtgctggtttggggcctgccttccgtga

SEQ ID NO: 82112 - DNA, 38 bp, Artificial Sequence
  Synthetic oligonucleotide
agcgacaacagaaagatgtgatacgggtgtggaggtga

SEQ ID NO: 82113 - DNA, 38 bp, Artificial Sequence
  Synthetic oligonucleotide
tagacaatcgcacacggtaacgaactctccatcggtga

SEQ ID NO: 82114 - DNA, 38 bp, Artificial Sequence
  Synthetic oligonucleotide
tcagtggagtgagaggagtaaacaggatctggatgtga

SEQ ID NO: 82115 - DNA, 38 bp, Artificial Sequence
  Synthetic oligonucleotide
atcaacggctgatatgcgcccatgccttgattctgtga

SEQ ID NO: 82116 - DNA, 37 bp, Artificial Sequence
  Synthetic oligonucleotide
gatcaaagggcaaatgggtaaaaatggtagggtgtga

SEQ ID NO: 82117 - DNA, 37 bp, Artificial Sequence
  Synthetic oligonucleotide
ggtccgcataggtactattccatctgcctcttcttga

SEQ ID NO: 82118 - DNA, 38 bp, Artificial Sequence
  Synthetic oligonucleotide
acccgaaccaacacagtcgatatatggtgcatagttga

SEQ ID NO: 82119 - DNA, 38 bp, Artificial Sequence
  Synthetic oligonucleotide
aatgtgcgccgcaaatcctgtagcatgactcatgttga

SEQ ID NO: 82120 - DNA, 38 bp, Artificial Sequence
  Synthetic oligonucleotide
tgatcccaccttgtgcatgctcatgccccatttgttga

SEQ ID NO: 82121 - DNA, 36 bp, Artificial Sequence
  Synthetic oligonucleotide
gacgctcgcccgatctttgtcatttttaccgtttga

SEQ ID NO: 82122 - DNA, 35 bp, Artificial Sequence
  Synthetic oligonucleotide
gaaaggtggtgcgggggaagcgcgtggaggtttga

SEQ ID NO: 82123 - DNA, 38 bp, Artificial Sequence
  Synthetic oligonucleotide
ttgttcgcttacccgtgggcattatgctttttgtttga

SEQ ID NO: 82124 - DNA, 36 bp, Artificial Sequence
  Synthetic oligonucleotide
atacgggcggggggaggccgtggaatggcggaaata

SEQ ID NO: 82125 - DNA, 35 bp, Artificial Sequence
  Synthetic oligonucleotide
gtctcgggtaagggggtacggggggggtcaacata

SEQ ID NO: 82126 - DNA, 36 bp, Artificial Sequence
  Synthetic oligonucleotide
gaccagttgagccgatctgttctacgcgcacccata

SEQ ID NO: 82127 - DNA, 36 bp, Artificial Sequence
  Synthetic oligonucleotide
gtgcgacgtgagaggcggatgagaggggggtagata

SEQ ID NO: 82128 - DNA, 35 bp, Artificial Sequence
  Synthetic oligonucleotide
ttcactggccatgcctcacactgatacttgaacta

SEQ ID NO: 82129 - DNA, 35 bp, Artificial Sequence
  Synthetic oligonucleotide
aatgtggacgacattatctccttaagctcatccta

SEQ ID NO: 82130 - DNA, 36 bp, Artificial Sequence
  Synthetic oligonucleotide
atccctgccaaactgtgcttgccttagcaactggta

SEQ ID NO: 82131 - DNA, 36 bp, Artificial Sequence
  Synthetic oligonucleotide
agagagggtgtgagagtggggagctcgtgtggtgta

SEQ ID NO: 82132 - DNA, 35 bp, Artificial Sequence
  Synthetic oligonucleotide
gatgcaagggtgtaacgtgtggagggttgacatta

SEQ ID NO: 82133 - DNA, 35 bp, Artificial Sequence
  Synthetic oligonucleotide
acgtaccccctacctgtccaccgtatgacgagaac

SEQ ID NO: 82134 - DNA, 35 bp, Artificial Sequence
  Synthetic oligonucleotide
acaacatgtctctcagtcctgactccgagggccac

SEQ ID NO: 82135 - DNA, 35 bp, Artificial Sequence
  Synthetic oligonucleotide
gagatgcgttccacttaccctgtcgtgcctgccac

SEQ ID NO: 82136 - DNA, 35 bp, Artificial Sequence
  Synthetic oligonucleotide
cgatccgactcacctcacaatacgcggctggctac

SEQ ID NO: 82137 - DNA, 35 bp, Artificial Sequence
  Synthetic oligonucleotide
tccacccgccctcttgctcgaagattataccgtac

SEQ ID NO: 82138 - DNA, 35 bp, Artificial Sequence
  Synthetic oligonucleotide
acagagcggcctgtactttgccatctgccctcgcc

SEQ ID NO: 82139 - DNA, 35 bp, Artificial Sequence
  Synthetic oligonucleotide
gaagcgctcggtactccacctcggcgattactgcc

SEQ ID NO: 82140 - DNA, 35 bp, Artificial Sequence
  Synthetic oligonucleotide
aacaccggaggccaattggtagtgatgctccatcc

SEQ ID NO: 82141 - DNA, 35 bp, Artificial Sequence
  Synthetic oligonucleotide
gtgtcctttcctgaagctgtcctggactctgctcc

SEQ ID NO: 82142 - DNA, 35 bp, Artificial Sequence
  Synthetic oligonucleotide
actgagaaaacgccagtctcccccgaccacattcc

SEQ ID NO: 82143 - DNA, 35 bp, Artificial Sequence
  Synthetic oligonucleotide
ccacggccaaaccacttctctccagtccgctacgc

SEQ ID NO: 82144 - DNA, 35 bp, Artificial Sequence
  Synthetic oligonucleotide
gacaccgactccccttcgaactgccaccctagcgc

SEQ ID NO: 82145 - DNA, 35 bp, Artificial Sequence
  Synthetic oligonucleotide
gcaccattggttagctctgttacgtctctgccggc

SEQ ID NO: 82146 - DNA, 35 bp, Artificial Sequence
  Synthetic oligonucleotide
tctatcgcaacttcgcgtatgccgtacgcatgggc

SEQ ID NO: 82147 - DNA, 35 bp, Artificial Sequence
  Synthetic oligonucleotide
tcccatagccttgtcttaactgtttctgttcatgc

SEQ ID NO: 82148 - DNA, 36 bp, Artificial Sequence
  Synthetic oligonucleotide
accttgcgactcctggaacgctcgctttacccttgc

SEQ ID NO: 82149 - DNA, 35 bp, Artificial Sequence
  Synthetic oligonucleotide
ttgcgcccgagtcgcgaccaagtggtccaattatc

SEQ ID NO: 82150 - DNA, 35 bp, Artificial Sequence
  Synthetic oligonucleotide
tacacgtaggatccctctgtgcgttccattccctc

SEQ ID NO: 82151 - DNA, 35 bp, Artificial Sequence
  Synthetic oligonucleotide
tccgtacagcattctcgcccgaccttcaaacgttc

SEQ ID NO: 82152 - DNA, 35 bp, Artificial Sequence
  Synthetic oligonucleotide
gttgaggccaaaaggcatttttattctccctgttc

SEQ ID NO: 82153 - DNA, 35 bp, Artificial Sequence
  Synthetic oligonucleotide
gccacgccgtttcacccgcgtctaatatcatccag

SEQ ID NO: 82154 - DNA, 35 bp, Artificial Sequence
  Synthetic oligonucleotide
gaaaaagcggccaccatcaaacactcagttcgcag

SEQ ID NO: 82155 - DNA, 35 bp, Artificial Sequence
  Synthetic oligonucleotide
aagcattaccgtgccctcctgccaactcctgcgag

SEQ ID NO: 82156 - DNA, 35 bp, Artificial Sequence
  Synthetic oligonucleotide
gcttgaccatcggcggggttcagctttttcctccg

SEQ ID NO: 82157 - DNA, 35 bp, Artificial Sequence
  Synthetic oligonucleotide
gccgcctagggcttttcctacgatgtctatgtccg

SEQ ID NO: 82158 - DNA, 35 bp, Artificial Sequence
  Synthetic oligonucleotide
tacacgcgcccattcccaagacgaggctttaaagg

SEQ ID NO: 82159 - DNA, 35 bp, Artificial Sequence
  Synthetic oligonucleotide
gagagtggtggaggggcgcgagctgtgaagagagg

SEQ ID NO: 82160 - DNA, 35 bp, Artificial Sequence
  Synthetic oligonucleotide
ggacaacgcagctaagcactcgtccacccttgagg

SEQ ID NO: 82161 - DNA, 35 bp, Artificial Sequence
  Synthetic oligonucleotide
taacaacacgcattctcgtactctacatctgaggg

SEQ ID NO: 82162 - DNA, 35 bp, Artificial Sequence
  Synthetic oligonucleotide
ttctgatcggaacttctctatgccacccccaactg

SEQ ID NO: 82163 - DNA, 35 bp, Artificial Sequence
  Synthetic oligonucleotide
gcgaagatgtcgaaccgtttggtccctctaatctg

SEQ ID NO: 82164 - DNA, 35 bp, Artificial Sequence
  Synthetic oligonucleotide
gagccattactacccccatacgcttagcccatgtg

SEQ ID NO: 82165 - DNA, 35 bp, Artificial Sequence
  Synthetic oligonucleotide
gattagaggtggtctgggaaggggatggggtaaat

SEQ ID NO: 82166 - DNA, 35 bp, Artificial Sequence
  Synthetic oligonucleotide
tgatactgctcccgtattctgttcagttcaaccat

SEQ ID NO: 82167 - DNA, 35 bp, Artificial Sequence
  Synthetic oligonucleotide
ttcatggccccttcagctacgttcccctgtttcat

SEQ ID NO: 82168 - DNA, 35 bp, Artificial Sequence
  Synthetic oligonucleotide
accgaccgccatactatcccaatccagtattacct

SEQ ID NO: 82169 - DNA, 35 bp, Artificial Sequence
  Synthetic oligonucleotide
gcgctgtgctctcttttccgtgtagtgcgactgct

SEQ ID NO: 82170 - DNA, 35 bp, Artificial Sequence
  Synthetic oligonucleotide
tctgaccacccggtcgaccgacatagccaattgct

SEQ ID NO: 82171 - DNA, 35 bp, Artificial Sequence
  Synthetic oligonucleotide
atccatccgccacttaccttgggtcgttcacatct

SEQ ID NO: 82172 - DNA, 34 bp, Artificial Sequence
  Synthetic oligonucleotide
gactcaacacgtgttttcattctttgccaactct

SEQ ID NO: 82173 - DNA, 35 bp, Artificial Sequence
  Synthetic oligonucleotide
aaaatgcgcccatatcgctaatggtctccaactct

SEQ ID NO: 82174 - DNA, 35 bp, Artificial Sequence
  Synthetic oligonucleotide
tgttaccccggtgctggctgggtcctctcgactct

SEQ ID NO: 82175 - DNA, 35 bp, Artificial Sequence
  Synthetic oligonucleotide
ttacgagagccagtcgagaggggtaacacgtgggt

SEQ ID NO: 82176 - DNA, 35 bp, Artificial Sequence
  Synthetic oligonucleotide
tcaacatacgtaagaacccggtattccccctctgt

SEQ ID NO: 82177 - DNA, 35 bp, Artificial Sequence
  Synthetic oligonucleotide
ttgatgctgacctcaccttgtccttgcttgtttgt

SEQ ID NO: 82178 - DNA, 35 bp, Artificial Sequence
  Synthetic oligonucleotide
acacttggaccgagggtcgctacttattcctaatt

SEQ ID NO: 82179 - DNA, 35 bp, Artificial Sequence
  Synthetic oligonucleotide
aaccgtagccccgactagaatgagcatcaccgctt

SEQ ID NO: 82180 - DNA, 35 bp, Artificial Sequence
  Synthetic oligonucleotide
agcacatcatagttcgttttccggttacgtgtctt

SEQ ID NO: 82181 - DNA, 35 bp, Artificial Sequence
  Synthetic oligonucleotide
ttcagtgctcgagtcacattcctcccgcgttcgtt

SEQ ID NO: 82182 - DNA, 35 bp, Artificial Sequence
  Synthetic oligonucleotide
gcactcggtgacatagggcgggaaggtaggttgtt

SEQ ID NO: 82183 - DNA, 35 bp, Artificial Sequence
  Synthetic oligonucleotide
gttgtagccaaagaacttgaccggccttctccttt

SEQ ID NO: 82184 - DNA, 35 bp, Artificial Sequence
  Synthetic oligonucleotide
gaagactggcgagatctaccactcttcacgctttt

SEQ ID NO: 82185 - DNA, 35 bp, Artificial Sequence
  Synthetic oligonucleotide
tctgaaaacctcatcgatggtggactcccgctttt

SEQ ID NO: 82186 - DNA, 36 bp, Artificial Sequence
  Synthetic oligonucleotide
gcctaccccgacatgtatatttaccatctcataaaa

SEQ ID NO: 82187 - DNA, 36 bp, Artificial Sequence
  Synthetic oligonucleotide
acctgacgagcccatgctggaatgggtgacttgaaa

SEQ ID NO: 82188 - DNA, 36 bp, Artificial Sequence
  Synthetic oligonucleotide
actgtccccgtcctcatcgtacgccgggttgataaa

SEQ ID NO: 82189 - DNA, 36 bp, Artificial Sequence
  Synthetic oligonucleotide
actacgctgaccccccatgccgccggtgacggtaaa

SEQ ID NO: 82190 - DNA, 36 bp, Artificial Sequence
  Synthetic oligonucleotide
gcgccaaaaggcgggtgatacttgggggtggggcaa

SEQ ID NO: 82191 - DNA, 36 bp, Artificial Sequence
  Synthetic oligonucleotide
tgaccttgccctccgttccatgataatgaacctcaa

SEQ ID NO: 82192 - DNA, 35 bp, Artificial Sequence
  Synthetic oligonucleotide
atgccacggctacaccggatctcacgccctttcaa

SEQ ID NO: 82193 - DNA, 36 bp, Artificial Sequence
  Synthetic oligonucleotide
tgcacggtaacagccccgacgcacaccggtctcgaa

SEQ ID NO: 82194 - DNA, 36 bp, Artificial Sequence
  Synthetic oligonucleotide
gacccaacctgcctaagccccgtgacatcaggctaa

SEQ ID NO: 82195 - DNA, 36 bp, Artificial Sequence
  Synthetic oligonucleotide
gacaggccgaacttttttccggtccattctgccaca

SEQ ID NO: 82196 - DNA, 31 bp, Artificial Sequence
  Synthetic oligonucleotide
tataccacccccgtctcagtcctcacgcaca

SEQ ID NO: 82197 - DNA, 36 bp, Artificial Sequence
  Synthetic oligonucleotide
acgatagcctgcatatcctccatcatagtacgcaca

SEQ ID NO: 82198 - DNA, 36 bp, Artificial Sequence
  Synthetic oligonucleotide
attgacaccatggctgggggttggtgaaccactaca

SEQ ID NO: 82199 - DNA, 35 bp, Artificial Sequence
  Synthetic oligonucleotide
gcactctacacgggtcccagcaccaaagatcacca

SEQ ID NO: 82200 - DNA, 35 bp, Artificial Sequence
  Synthetic oligonucleotide
acgaccttagagttctatctttcacaccgttccca

SEQ ID NO: 82201 - DNA, 36 bp, Artificial Sequence
  Synthetic oligonucleotide
aattcacgcagtagacctcccgttacgacactgcca

SEQ ID NO: 82202 - DNA, 35 bp, Artificial Sequence
  Synthetic oligonucleotide
ggtggggaaccggaaggaggcaatcgatgttagca

SEQ ID NO: 82203 - DNA, 32 bp, Artificial Sequence
  Synthetic oligonucleotide
agtacgccctttccccccctgcaggatacgca

SEQ ID NO: 82204 - DNA, 36 bp, Artificial Sequence
  Synthetic oligonucleotide
ttcgatgcctctcctaggttgtctagtccatgatca

SEQ ID NO: 82205 - DNA, 35 bp, Artificial Sequence
  Synthetic oligonucleotide
tctgtaggtcgagtcacactactattaaccactca

SEQ ID NO: 82206 - DNA, 36 bp, Artificial Sequence
  Synthetic oligonucleotide
gacccgagatccgagtagccccatgcccgacgctca

SEQ ID NO: 82207 - DNA, 36 bp, Artificial Sequence
  Synthetic oligonucleotide
gatcgaagatccttactcatgagccaactacgctca

SEQ ID NO: 82208 - DNA, 36 bp, Artificial Sequence
  Synthetic oligonucleotide
tcctgtgcgtgtcgctttatttgttagtctctgtca

SEQ ID NO: 82209 - DNA, 36 bp, Artificial Sequence
  Synthetic oligonucleotide
ttcacgcatgacgctttcactctatgggctggttca

SEQ ID NO: 82210 - DNA, 36 bp, Artificial Sequence
  Synthetic oligonucleotide
acgaagctggtggcctagtctctggttaacttttca

SEQ ID NO: 82211 - DNA, 37 bp, Artificial Sequence
  Synthetic oligonucleotide
gtgaacggaggtgataagggctgtatggcggggaaga

SEQ ID NO: 82212 - DNA, 36 bp, Artificial Sequence
  Synthetic oligonucleotide
gtgcatggaaggagtggaaaacgcattggtgtcaga

SEQ ID NO: 82213 - DNA, 37 bp, Artificial Sequence
  Synthetic oligonucleotide
tatgggcggtcgcacggccctttctccttcttagaga

SEQ ID NO: 82214 - DNA, 36 bp, Artificial Sequence
  Synthetic oligonucleotide
gtgggggtgtctcagtcaaaagaggagtgggataga

SEQ ID NO: 82215 - DNA, 38 bp, Artificial Sequence
  Synthetic oligonucleotide
tgacacccgccgccaagctcattgtcagcgcgaaacga

SEQ ID NO: 82216 - DNA, 37 bp, Artificial Sequence
  Synthetic oligonucleotide
gacacgggcacctgtctcttaatcgtaattttaacga

SEQ ID NO: 82217 - DNA, 37 bp, Artificial Sequence
  Synthetic oligonucleotide
ttgccggacgctcgtggtttcctttgcgcattgacga

SEQ ID NO: 82218 - DNA, 36 bp, Artificial Sequence
  Synthetic oligonucleotide
actggcggaggggaacaggggaagtaactagaccga

SEQ ID NO: 82219 - DNA, 37 bp, Artificial Sequence
  Synthetic oligonucleotide
tcccctgccttatcccttgtgctccgtctaaacgcga

SEQ ID NO: 82220 - DNA, 36 bp, Artificial Sequence
  Synthetic oligonucleotide
gaccgggcgagaacacgatgtaattaggatgggcga

SEQ ID NO: 82221 - DNA, 37 bp, Artificial Sequence
  Synthetic oligonucleotide
gattgccctgtccatcccgacctacccattactgcga

SEQ ID NO: 82222 - DNA, 37 bp, Artificial Sequence
  Synthetic oligonucleotide
aatcactacaccccacaatagagcagcctgtctgcga

SEQ ID NO: 82223 - DNA, 37 bp, Artificial Sequence
  Synthetic oligonucleotide
gagtcaccgcccgctttgatggctttcactccatcga

SEQ ID NO: 82224 - DNA, 37 bp, Artificial Sequence
  Synthetic oligonucleotide
tgtcccaagcgggctcaccacggtaatattccatcga

SEQ ID NO: 82225 - DNA, 37 bp, Artificial Sequence
  Synthetic oligonucleotide
gcttgtgcggtaaggggggaaggatgggaccgatcga

SEQ ID NO: 82226 - DNA, 37 bp, Artificial Sequence
  Synthetic oligonucleotide
tgtccaccaaatcccttatacaggctgtttccttcga

SEQ ID NO: 82227 - DNA, 36 bp, Artificial Sequence
  Synthetic oligonucleotide
gtctaaccactcccctaacgcccgaggtgtcttcga

SEQ ID NO: 82228 - DNA, 37 bp, Artificial Sequence
  Synthetic oligonucleotide
tgactgaacgaagggcggaattgagagtgaggccgga

SEQ ID NO: 82229 - DNA, 37 bp, Artificial Sequence
  Synthetic oligonucleotide
tccaccaccgacgacttatgcctacattcctcaggga

SEQ ID NO: 82230 - DNA, 37 bp, Artificial Sequence
  Synthetic oligonucleotide
gactgagcacaggcggggggaccacaggagtacggga

SEQ ID NO: 82231 - DNA, 37 bp, Artificial Sequence
  Synthetic oligonucleotide
gcacgaatgaaggcttatgagggttggtgtgagggga

SEQ ID NO: 82232 - DNA, 37 bp, Artificial Sequence
  Synthetic oligonucleotide
gaccggggtggggttaggggagcagtctagacatgga

SEQ ID NO: 82233 - DNA, 37 bp, Artificial Sequence
  Synthetic oligonucleotide
gatcaacccccatgaagctttgtctagaatacatgga

SEQ ID NO: 82234 - DNA, 37 bp, Artificial Sequence
  Synthetic oligonucleotide
gaacccacattctgtatatctgtttcattatcgtgga

SEQ ID NO: 82235 - DNA, 37 bp, Artificial Sequence
  Synthetic oligonucleotide
tgaacggtagtgaacattaagacgaggggtcggtgga

SEQ ID NO: 82236 - DNA, 34 bp, Artificial Sequence
  Synthetic oligonucleotide
gtgatggtaggcgcgatatattagggtgggtgga

SEQ ID NO: 82237 - DNA, 37 bp, Artificial Sequence
  Synthetic oligonucleotide
aagtacgcggtcgctcgtgggattgaggggcacatga

SEQ ID NO: 82238 - DNA, 38 bp, Artificial Sequence
  Synthetic oligonucleotide
gtctccgtggttttgtccacctcccgtttctcacatga

SEQ ID NO: 82239 - DNA, 35 bp, Artificial Sequence
  Synthetic oligonucleotide
atgtcaccacctcccttcgcaaaccagctgtatga

SEQ ID NO: 82240 - DNA, 38 bp, Artificial Sequence
  Synthetic oligonucleotide
agactgctctgacgcctgatcactgggcccctttatga

SEQ ID NO: 82241 - DNA, 38 bp, Artificial Sequence
  Synthetic oligonucleotide
gatgtcccgtacctcgtcgagccaatcctcttttatga

SEQ ID NO: 82242 - DNA, 38 bp, Artificial Sequence
  Synthetic oligonucleotide
acaacacatcctcatcatcgggacagctgacaacctga

SEQ ID NO: 82243 - DNA, 38 bp, Artificial Sequence
  Synthetic oligonucleotide
ttctccatccgttgtgaccgcccagttagcggacctga

SEQ ID NO: 82244 - DNA, 38 bp, Artificial Sequence
  Synthetic oligonucleotide
aacagaagtcatgaagggacgggggaaattatagctga

SEQ ID NO: 82245 - DNA, 38 bp, Artificial Sequence
  Synthetic oligonucleotide
gtcagggtggaggggaaggtagtctgagctagggctga

SEQ ID NO: 82246 - DNA, 38 bp, Artificial Sequence
  Synthetic oligonucleotide
acgggaccgaggagaagaaggattacagggggggctga

SEQ ID NO: 82247 - DNA, 37 bp, Artificial Sequence
  Synthetic oligonucleotide
tcatcaccacgtcacttatccggttttttcatgctga

SEQ ID NO: 82248 - DNA, 37 bp, Artificial Sequence
  Synthetic oligonucleotide
tacacatgctcgatatcgaaccgcctccctatgctga

SEQ ID NO: 82249 - DNA, 38 bp, Artificial Sequence
  Synthetic oligonucleotide
tcacgcctgagctttcgcctatactcaccgacctctga

SEQ ID NO: 82250 - DNA, 38 bp, Artificial Sequence
  Synthetic oligonucleotide
actagacgcgtgttgtgtctacccttccctatgtctga

SEQ ID NO: 82251 - DNA, 36 bp, Artificial Sequence
  Synthetic oligonucleotide
tacaccgcgaggtgatgcccttcaaccctcaagtga

SEQ ID NO: 82252 - DNA, 37 bp, Artificial Sequence
  Synthetic oligonucleotide
gaccacaccatcgatagcgacaccacccgggacgtga

SEQ ID NO: 82253 - DNA, 38 bp, Artificial Sequence
  Synthetic oligonucleotide
gacacccgctacctgattaaaactggctcccaccgtga

SEQ ID NO: 82254 - DNA, 38 bp, Artificial Sequence
  Synthetic oligonucleotide
tgaagacggaaaaagtggcaacgaggatcgggaggtga

SEQ ID NO: 82255 - DNA, 37 bp, Artificial Sequence
  Synthetic oligonucleotide
tcgatgaggtgaggtggtgttgatcgaggaacggtga

SEQ ID NO: 82256 - DNA, 38 bp, Artificial Sequence
  Synthetic oligonucleotide
tttgcacgagcctgcgttggctcctcctcccttggtga

SEQ ID NO: 82257 - DNA, 38 bp, Artificial Sequence
  Synthetic oligonucleotide
ggatgcccaactgcaagctacaccgatacatcatgtga

SEQ ID NO: 82258 - DNA, 38 bp, Artificial Sequence
  Synthetic oligonucleotide
gcccagacgcgactccctgctacaccattatcatgtga

SEQ ID NO: 82259 - DNA, 38 bp, Artificial Sequence
  Synthetic oligonucleotide
tacccagcttcactggttctttcatccctccactgtga

SEQ ID NO: 82260 - DNA, 37 bp, Artificial Sequence
  Synthetic oligonucleotide
tccaacatgaggcgcggaccgtacacacatcccttga

SEQ ID NO: 82261 - DNA, 38 bp, Artificial Sequence
  Synthetic oligonucleotide
atgcgaaggctaaggtggaacccgtcagaacaggttga

SEQ ID NO: 82262 - DNA, 38 bp, Artificial Sequence
  Synthetic oligonucleotide
acttgcaccgtacccacctaattcgccgtacttgttga

SEQ ID NO: 82263 - DNA, 36 bp, Artificial Sequence
  Synthetic oligonucleotide
gattctatgccccgccagtgttagtcaacctggcta

SEQ ID NO: 82264 - DNA, 36 bp, Artificial Sequence
  Synthetic oligonucleotide
atagtgcccctcctccccgtaagtaccccgtggcta

SEQ ID NO: 82265 - DNA, 35 bp, Artificial Sequence
  Synthetic oligonucleotide
tgtgaagcgctgccctcctgactggtttactgcta

SEQ ID NO: 82266 - DNA, 36 bp, Artificial Sequence
  Synthetic oligonucleotide
ggtcccgtcaggctgccgccattctcgccctatcta

SEQ ID NO: 82267 - DNA, 36 bp, Artificial Sequence
  Synthetic oligonucleotide
actccgcgctctcgaatcacggtactaaactctcta

SEQ ID NO: 82268 - DNA, 36 bp, Artificial Sequence
  Synthetic oligonucleotide
gttgcgcgtgctctgtctctttgggtgatttgcgta

SEQ ID NO: 82269 - DNA, 36 bp, Artificial Sequence
  Synthetic oligonucleotide
attccacctagccgccgacaggtaggcttactcgta

SEQ ID NO: 82270 - DNA, 36 bp, Artificial Sequence
  Synthetic oligonucleotide
tccatctggcgttcgctcgtccaatcctcttcctta

SEQ ID NO: 82271 - DNA, 36 bp, Artificial Sequence
  Synthetic oligonucleotide
attccagccgcgtttccatctagcgaccgctggtta

SEQ ID NO: 82272 - DNA, 35 bp, Artificial Sequence
  Synthetic oligonucleotide
gccacatcctccactccggcctccccgagcagtac

SEQ ID NO: 82273 - DNA, 35 bp, Artificial Sequence
  Synthetic oligonucleotide
tatcgcacaccataaaaccatggccctgagtaacc

SEQ ID NO: 82274 - DNA, 35 bp, Artificial Sequence
  Synthetic oligonucleotide
atcccggtacgccatagcccctgaaattggccccc

SEQ ID NO: 82275 - DNA, 35 bp, Artificial Sequence
  Synthetic oligonucleotide
accataactcaattgattaacatcagccacgcccc

SEQ ID NO: 82276 - DNA, 35 bp, Artificial Sequence
  Synthetic oligonucleotide
tcgcgtagcctcacaccgttcctttcgtccagccc

SEQ ID NO: 82277 - DNA, 35 bp, Artificial Sequence
  Synthetic oligonucleotide
tcgaggagagggcacacctccttacaatcgctccc

SEQ ID NO: 82278 - DNA, 35 bp, Artificial Sequence
  Synthetic oligonucleotide
acccgacaatctgtttcctgccaggtacttacgcc

SEQ ID NO: 82279 - DNA, 35 bp, Artificial Sequence
  Synthetic oligonucleotide
gcgcggtgagcgagcgctgttccactccatctgcc

SEQ ID NO: 82280 - DNA, 35 bp, Artificial Sequence
  Synthetic oligonucleotide
atcgcggccaaccctggtttggtttatccacttcc

SEQ ID NO: 82281 - DNA, 35 bp, Artificial Sequence
  Synthetic oligonucleotide
acgtgccggggggctgggggaaagcatagtatcgc

SEQ ID NO: 82282 - DNA, 35 bp, Artificial Sequence
  Synthetic oligonucleotide
gtctgaatcgcccttcgtagtcagtcccgattctc

SEQ ID NO: 82283 - DNA, 35 bp, Artificial Sequence
  Synthetic oligonucleotide
tgcctactcggcatatcccatgtctaatacatgtc

SEQ ID NO: 82284 - DNA, 35 bp, Artificial Sequence
  Synthetic oligonucleotide
tatgcccgcaaccggaatgggatccttgatatgtc

SEQ ID NO: 82285 - DNA, 35 bp, Artificial Sequence
  Synthetic oligonucleotide
ttccgcctagctcgccatcttcttcaaaaactgtc

SEQ ID NO: 82286 - DNA, 35 bp, Artificial Sequence
  Synthetic oligonucleotide
gaccttcctgccttattgaccggacacctatttag

SEQ ID NO: 82287 - DNA, 35 bp, Artificial Sequence
  Synthetic oligonucleotide
ggaaaccgaaggtaagaaatgaggggacgggcacg

SEQ ID NO: 82288 - DNA, 35 bp, Artificial Sequence
  Synthetic oligonucleotide
tgtaccttatcctctcgtgtccgcccggtataccg

SEQ ID NO: 82289 - DNA, 35 bp, Artificial Sequence
  Synthetic oligonucleotide
gcgttcagccgaactggtcttactaaatgtccccg

SEQ ID NO: 82290 - DNA, 35 bp, Artificial Sequence
  Synthetic oligonucleotide
gaagtggggaatagaggctaggggacacacgagcg

SEQ ID NO: 82291 - DNA, 35 bp, Artificial Sequence
  Synthetic oligonucleotide
atccgcacacgtactcctcaatcgggcacatcgcg

SEQ ID NO: 82292 - DNA, 35 bp, Artificial Sequence
  Synthetic oligonucleotide
gagatggcatcgaattatttgggagcatgggctcg

SEQ ID NO: 82293 - DNA, 35 bp, Artificial Sequence
  Synthetic oligonucleotide
gtccatcgcatttgcctccttatatcttaagttcg

SEQ ID NO: 82294 - DNA, 33 bp, Artificial Sequence
  Synthetic oligonucleotide
agagaatgggtggggcggaatcggactaatcgg

SEQ ID NO: 82295 - DNA, 35 bp, Artificial Sequence
  Synthetic oligonucleotide
tatcccgttgccccagtatctatatgtttttatgg

SEQ ID NO: 82296 - DNA, 35 bp, Artificial Sequence
  Synthetic oligonucleotide
aaccccatgattcccagctttggtgacaactcctg

SEQ ID NO: 82297 - DNA, 35 bp, Artificial Sequence
  Synthetic oligonucleotide
gtgctagccaggccgcccaaacattacatattctg

SEQ ID NO: 82298 - DNA, 35 bp, Artificial Sequence
  Synthetic oligonucleotide
tcgtaccacgctctgtaacatcctgacgaccattg

SEQ ID NO: 82299 - DNA, 35 bp, Artificial Sequence
  Synthetic oligonucleotide
gatattcccggtccccccccgcttccgcccaggat

SEQ ID NO: 82300 - DNA, 35 bp, Artificial Sequence
  Synthetic oligonucleotide
taagagctgtatccttcgcaccatcagccctttat

SEQ ID NO: 82301 - DNA, 35 bp, Artificial Sequence
  Synthetic oligonucleotide
gccccgcccgcgacattgaagtcttccctggtact

SEQ ID NO: 82302 - DNA, 35 bp, Artificial Sequence
  Synthetic oligonucleotide
gtgattcgcggtcgcctgctgttagtcctcaccct

SEQ ID NO: 82303 - DNA, 35 bp, Artificial Sequence
  Synthetic oligonucleotide
aaatagcgtgcctccgttgcctggtgccgtgtcct

SEQ ID NO: 82304 - DNA, 35 bp, Artificial Sequence
  Synthetic oligonucleotide
gtcgctgaccgattgcctggctctgctttcacgct

SEQ ID NO: 82305 - DNA, 35 bp, Artificial Sequence
  Synthetic oligonucleotide
accgaccgacattcgctttccatgttacctctgct

SEQ ID NO: 82306 - DNA, 35 bp, Artificial Sequence
  Synthetic oligonucleotide
gcatacctcggttccttggtttaatacgtattgct

SEQ ID NO: 82307 - DNA, 35 bp, Artificial Sequence
  Synthetic oligonucleotide
accttcgacgcaagtcgcagtaaatacttttctct

SEQ ID NO: 82308 - DNA, 35 bp, Artificial Sequence
  Synthetic oligonucleotide
tccccggtctatttgccctcgctctagggacttct

SEQ ID NO: 82309 - DNA, 35 bp, Artificial Sequence
  Synthetic oligonucleotide
gtcagacgacacgcggcccccactaatcgtcttct

SEQ ID NO: 82310 - DNA, 35 bp, Artificial Sequence
  Synthetic oligonucleotide
tgctattcccacactcatatggacgccttcgcagt

SEQ ID NO: 82311 - DNA, 35 bp, Artificial Sequence
  Synthetic oligonucleotide
ttgattccccccgtctagcaggcttacacccgagt

SEQ ID NO: 82312 - DNA, 35 bp, Artificial Sequence
  Synthetic oligonucleotide
gaagaacgcgaagaagcagtgggaagaatgtgcgt

SEQ ID NO: 82313 - DNA, 35 bp, Artificial Sequence
  Synthetic oligonucleotide
ttgaggaagcggagctcaatccacgcacacccatt

SEQ ID NO: 82314 - DNA, 35 bp, Artificial Sequence
  Synthetic oligonucleotide
tatcagtcctcgccggagtgatcctcgttttcgtt

SEQ ID NO: 82315 - DNA, 35 bp, Artificial Sequence
  Synthetic oligonucleotide
tgtggaagggcccggatacagtgtcaggcaaggtt

SEQ ID NO: 82316 - DNA, 35 bp, Artificial Sequence
  Synthetic oligonucleotide
atgtaaccgcggtcggctgtcatccccacgcattt

SEQ ID NO: 82317 - DNA, 35 bp, Artificial Sequence
  Synthetic oligonucleotide
actaccgtccgcccgctcaacatccgttgggcttt

SEQ ID NO: 82318 - DNA, 35 bp, Artificial Sequence
  Synthetic oligonucleotide
gaacccaggaagagggctgcttggttcggttcttt

SEQ ID NO: 82319 - DNA, 35 bp, Artificial Sequence
  Synthetic oligonucleotide
tccaccgtccagcctttgtttccaagggaactttt

SEQ ID NO: 82320 - DNA, 35 bp, Artificial Sequence
  Synthetic oligonucleotide
actcaagcccctctcatgctgctcatgtcacacaa

SEQ ID NO: 82321 - DNA, 35 bp, Artificial Sequence
  Synthetic oligonucleotide
atggaagacagtctgagagggctggggtgtgacaa

SEQ ID NO: 82322 - DNA, 36 bp, Artificial Sequence
  Synthetic oligonucleotide
accgcagtagccactacctaactgttcgccaatcaa

SEQ ID NO: 82323 - DNA, 36 bp, Artificial Sequence
  Synthetic oligonucleotide
gtcccacacaaccggggatcacaggatctcatagaa

SEQ ID NO: 82324 - DNA, 35 bp, Artificial Sequence
  Synthetic oligonucleotide
tcgaatatcgggaggaggagggctgggtccaataa

SEQ ID NO: 82325 - DNA, 36 bp, Artificial Sequence
  Synthetic oligonucleotide
tcttgcccaacgccctcaacactaccctcgacgtaa

SEQ ID NO: 82326 - DNA, 36 bp, Artificial Sequence
  Synthetic oligonucleotide
gtcgccccctgcccggtacacactcaccctatgtaa

SEQ ID NO: 82327 - DNA, 36 bp, Artificial Sequence
  Synthetic oligonucleotide
gtgtgctcccggcactatctgttgcctgaaccaaca

SEQ ID NO: 82328 - DNA, 36 bp, Artificial Sequence
  Synthetic oligonucleotide
gaccatgcttctcaccctcccctccaagtgttgcca

SEQ ID NO: 82329 - DNA, 36 bp, Artificial Sequence
  Synthetic oligonucleotide
ttactcctactgctgttcactacacgtatctatgca

SEQ ID NO: 82330 - DNA, 36 bp, Artificial Sequence
  Synthetic oligonucleotide
aaacggggcacggtgggaggggtgagactcggtgca

SEQ ID NO: 82331 - DNA, 36 bp, Artificial Sequence
  Synthetic oligonucleotide
gcatgcgactccccatcctgcattcatttaattgca

SEQ ID NO: 82332 - DNA, 36 bp, Artificial Sequence
  Synthetic oligonucleotide
aactcacgctcttcgtactgacccgacggattatca

SEQ ID NO: 82333 - DNA, 35 bp, Artificial Sequence
  Synthetic oligonucleotide
aatcacgcggtttgtctttatgcttactattctca

SEQ ID NO: 82334 - DNA, 36 bp, Artificial Sequence
  Synthetic oligonucleotide
gtccggctcagaacacgatatcattttcacgcttca

SEQ ID NO: 82335 - DNA, 36 bp, Artificial Sequence
  Synthetic oligonucleotide
taagcacggaccacgactccacggcgccatctttca

SEQ ID NO: 82336 - DNA, 37 bp, Artificial Sequence
  Synthetic oligonucleotide
tgttgcagggtgagtaggatggcgggatagggaaaga

SEQ ID NO: 82337 - DNA, 36 bp, Artificial Sequence
  Synthetic oligonucleotide
agtcgggtaggggggagcacgtacagcaaacgaaga

SEQ ID NO: 82338 - DNA, 37 bp, Artificial Sequence
  Synthetic oligonucleotide
tcgcaacgtggtggtccggagagggggtggaagcaga

SEQ ID NO: 82339 - DNA, 37 bp, Artificial Sequence
  Synthetic oligonucleotide
tcgatgtcgccgacgcctggaccgccaatatccgaga

SEQ ID NO: 82340 - DNA, 37 bp, Artificial Sequence
  Synthetic oligonucleotide
tgaggagacagcggtgacaaattcgggggctaggaga

SEQ ID NO: 82341 - DNA, 36 bp, Artificial Sequence
  Synthetic oligonucleotide
gccagtgccctgaccttggttgttctcttcgtgaga

SEQ ID NO: 82342 - DNA, 35 bp, Artificial Sequence
  Synthetic oligonucleotide
gatcgctgtgaacgtctttccccacactctctaga

SEQ ID NO: 82343 - DNA, 36 bp, Artificial Sequence
  Synthetic oligonucleotide
tcagcaccggataccatgccgatccccgttcaacga

SEQ ID NO: 82344 - DNA, 37 bp, Artificial Sequence
  Synthetic oligonucleotide
attcgcccgacccctaaaactgtccatctcatcccga

SEQ ID NO: 82345 - DNA, 37 bp, Artificial Sequence
  Synthetic oligonucleotide
aataaactacgacgggggggtgaggaaaggaggccga

SEQ ID NO: 82346 - DNA, 36 bp, Artificial Sequence
  Synthetic oligonucleotide
attctagccgtcttgcttcccttagccacctgccga

SEQ ID NO: 82347 - DNA, 37 bp, Artificial Sequence
  Synthetic oligonucleotide
atcttggagcggtggagtgaatggtggcggggatcga

SEQ ID NO: 82348 - DNA, 37 bp, Artificial Sequence
  Synthetic oligonucleotide
attagagggtgaggtgggtttactggtaacgtaagga

SEQ ID NO: 82349 - DNA, 37 bp, Artificial Sequence
  Synthetic oligonucleotide
aacccagccgcaggcgtacatgcgtcccactcgagga

SEQ ID NO: 82350 - DNA, 37 bp, Artificial Sequence
  Synthetic oligonucleotide
ttgaagtaggtgggagctggtgagcaactcgggagga

SEQ ID NO: 82351 - DNA, 37 bp, Artificial Sequence
  Synthetic oligonucleotide
gaccagggagtagtggttaaggaagcatagataggga

SEQ ID NO: 82352 - DNA, 36 bp, Artificial Sequence
  Synthetic oligonucleotide
gtggcatcggaggaactagttgagggtggctaggga

SEQ ID NO: 82353 - DNA, 37 bp, Artificial Sequence
  Synthetic oligonucleotide
tactgacgccgtggggaggatgacgagtggcgcggga

SEQ ID NO: 82354 - DNA, 36 bp, Artificial Sequence
  Synthetic oligonucleotide
tgacgttggagtcgcggaaaatcggggctggtggga

SEQ ID NO: 82355 - DNA, 35 bp, Artificial Sequence
  Synthetic oligonucleotide
gcatgggaatgaatggggtgatggtggagaatgga

SEQ ID NO: 82356 - DNA, 37 bp, Artificial Sequence
  Synthetic oligonucleotide
gacgtatgccgtggaacaggggaaggggggatttgga

SEQ ID NO: 82357 - DNA, 38 bp, Artificial Sequence
  Synthetic oligonucleotide
gctcttgccggctccctccccccatgtgtcagaaatga

SEQ ID NO: 82358 - DNA, 38 bp, Artificial Sequence
  Synthetic oligonucleotide
gcagtcccagagaactcgccctatatgcaccccaatga

SEQ ID NO: 82359 - DNA, 38 bp, Artificial Sequence
  Synthetic oligonucleotide
agaccgagcaaggagggcaaaggactagtgaacgatga

SEQ ID NO: 82360 - DNA, 38 bp, Artificial Sequence
  Synthetic oligonucleotide
tgccacgaagaggtgaagggaattgtaagacggtatga

SEQ ID NO: 82361 - DNA, 38 bp, Artificial Sequence
  Synthetic oligonucleotide
agatcagaccgcaccctctcatgtaactagccttatga

SEQ ID NO: 82362 - DNA, 38 bp, Artificial Sequence
  Synthetic oligonucleotide
gtggcaatcccatttgtcttgtgcctccgccaaactga

SEQ ID NO: 82363 - DNA, 38 bp, Artificial Sequence
  Synthetic oligonucleotide
gacgcacgttctcgtgtatgcccctccgtttgaactga

SEQ ID NO: 82364 - DNA, 38 bp, Artificial Sequence
  Synthetic oligonucleotide
tgcctcggcgactgtcgaggcaagatcctcataactga

SEQ ID NO: 82365 - DNA, 38 bp, Artificial Sequence
  Synthetic oligonucleotide
gttgccccgggtcgccatgaagtcaccgtccacactga

SEQ ID NO: 82366 - DNA, 38 bp, Artificial Sequence
  Synthetic oligonucleotide
gcatggctaggggggtggtgaggaatgtggggcactga

SEQ ID NO: 82367 - DNA, 37 bp, Artificial Sequence
  Synthetic oligonucleotide
ttcggagtgctcgtccattgctactcctcatgcctga

SEQ ID NO: 82368 - DNA, 38 bp, Artificial Sequence
  Synthetic oligonucleotide
gacgacacacaccgcatccgatagctgttcactcctga

SEQ ID NO: 82369 - DNA, 38 bp, Artificial Sequence
  Synthetic oligonucleotide
atagacagcagctgtttccttgcgtgcctcattcctga

SEQ ID NO: 82370 - DNA, 38 bp, Artificial Sequence
  Synthetic oligonucleotide
gacaacagtgttacggtccctgccatgccccctgctga

SEQ ID NO: 82371 - DNA, 38 bp, Artificial Sequence
  Synthetic oligonucleotide
gagacgccaaggaaaacaggtagtgaggcttgtgctga

SEQ ID NO: 82372 - DNA, 37 bp, Artificial Sequence
  Synthetic oligonucleotide
gcgacatcccctttgctccagctccgactgaatctga

SEQ ID NO: 82373 - DNA, 38 bp, Artificial Sequence
  Synthetic oligonucleotide
ttgtgccgcaacatacctgtcccgacacagttatctga

SEQ ID NO: 82374 - DNA, 38 bp, Artificial Sequence
  Synthetic oligonucleotide
gcaagtcgttctgtacctgccttttcccgttagtctga

SEQ ID NO: 82375 - DNA, 37 bp, Artificial Sequence
  Synthetic oligonucleotide
ataaccgtccatcggttctatctcacatactaagtga

SEQ ID NO: 82376 - DNA, 37 bp, Artificial Sequence
  Synthetic oligonucleotide
tgctcgaacatacgtccatgcatccctcctccagtga

SEQ ID NO: 82377 - DNA, 38 bp, Artificial Sequence
  Synthetic oligonucleotide
atggtgggtggaggcgaggagctgggcgagtgtagtga

SEQ ID NO: 82378 - DNA, 37 bp, Artificial Sequence
  Synthetic oligonucleotide
tcataccctcgggcttcattattttcccagacggtga

SEQ ID NO: 82379 - DNA, 38 bp, Artificial Sequence
  Synthetic oligonucleotide
gccggttgggagagagaggagttaggagtggtgggtga

SEQ ID NO: 82380 - DNA, 38 bp, Artificial Sequence
  Synthetic oligonucleotide
atccgcagggggggggagtatcggaaaacgattggtga

SEQ ID NO: 82381 - DNA, 37 bp, Artificial Sequence
  Synthetic oligonucleotide
gtggtgctgtgggcggaaggatgaccaggttatgtga

SEQ ID NO: 82382 - DNA, 38 bp, Artificial Sequence
  Synthetic oligonucleotide
gagcgggggaaaccaaggggaaaataggtcgagtgtga

SEQ ID NO: 82383 - DNA, 38 bp, Artificial Sequence
  Synthetic oligonucleotide
cagcgaagccttcccagttgtttcccgttcttttgtga

SEQ ID NO: 82384 - DNA, 36 bp, Artificial Sequence
  Synthetic oligonucleotide
gccttatccactgcgacctaggagccctgacattga

SEQ ID NO: 82385 - DNA, 38 bp, Artificial Sequence
  Synthetic oligonucleotide
acaccgcattgagatacgcacgatcatcgaaaccttga

SEQ ID NO: 82386 - DNA, 38 bp, Artificial Sequence
  Synthetic oligonucleotide
atagtaaagggtggaccaggaggcaataggggggttga

SEQ ID NO: 82387 - DNA, 38 bp, Artificial Sequence
  Synthetic oligonucleotide
gccggatacactcccctatatgggacgccttcctttga

SEQ ID NO: 82388 - DNA, 38 bp, Artificial Sequence
  Synthetic oligonucleotide
gcacgttccggcacttgctaggccatctgcatttttga

SEQ ID NO: 82389 - DNA, 35 bp, Artificial Sequence
  Synthetic oligonucleotide
accccacaatccatgactgatgaatcatcgcaata

SEQ ID NO: 82390 - DNA, 36 bp, Artificial Sequence
  Synthetic oligonucleotide
gtgcattaaggaagtagggtggaaagtgggggcata

SEQ ID NO: 82391 - DNA, 36 bp, Artificial Sequence
  Synthetic oligonucleotide
acctctgcgcaaatcttagtttgcttacccctgata

SEQ ID NO: 82392 - DNA, 36 bp, Artificial Sequence
  Synthetic oligonucleotide
aacgccgcgcgcccagaattctacccgtggccacta

SEQ ID NO: 82393 - DNA, 36 bp, Artificial Sequence
  Synthetic oligonucleotide
tatcctcatccgttgtccctagttggaagtttacta

SEQ ID NO: 82394 - DNA, 34 bp, Artificial Sequence
  Synthetic oligonucleotide
actagaactcgcaatctgtacctatgtatcgcta

SEQ ID NO: 82395 - DNA, 36 bp, Artificial Sequence
  Synthetic oligonucleotide
tgcacgtcctgaatcacctcgcggccccgcctgcta

SEQ ID NO: 82396 - DNA, 35 bp, Artificial Sequence
  Synthetic oligonucleotide
tgaccatcctcttttccgctatgcgctctgtgcta

SEQ ID NO: 82397 - DNA, 36 bp, Artificial Sequence
  Synthetic oligonucleotide
atagctcccactcgttgatcagtgagccttattcta

SEQ ID NO: 82398 - DNA, 36 bp, Artificial Sequence
  Synthetic oligonucleotide
tccacaatcagactatccccgcatgagccccgagta

SEQ ID NO: 82399 - DNA, 36 bp, Artificial Sequence
  Synthetic oligonucleotide
gccgacattaggtcgcccttccattttactcgcgta

SEQ ID NO: 82400 - DNA, 36 bp, Artificial Sequence
  Synthetic oligonucleotide
acacccatgcgtttcaactcgttctcccttgaggta

SEQ ID NO: 82401 - DNA, 36 bp, Artificial Sequence
  Synthetic oligonucleotide
gttgccctaacctgtttatggctttgtcttcctgta

SEQ ID NO: 82402 - DNA, 36 bp, Artificial Sequence
  Synthetic oligonucleotide
tgagaagggtaggggcaggacgaagtcagatcatta

SEQ ID NO: 82403 - DNA, 36 bp, Artificial Sequence
  Synthetic oligonucleotide
acgggcctcacgatgcactttaccattcctctctta

SEQ ID NO: 82404 - DNA, 35 bp, Artificial Sequence
  Synthetic oligonucleotide
gaccaattacgtgaattggtaatgacactgcatac

SEQ ID NO: 82405 - DNA, 35 bp, Artificial Sequence
  Synthetic oligonucleotide
tgaacaccgcatcagcgactctaggcctccattac

SEQ ID NO: 82406 - DNA, 35 bp, Artificial Sequence
  Synthetic oligonucleotide
agtcccccaccaggtccccatagctcctgccgccc

SEQ ID NO: 82407 - DNA, 35 bp, Artificial Sequence
  Synthetic oligonucleotide
gacgcgcaacagcccacagtaatcgctgcttggcc

SEQ ID NO: 82408 - DNA, 35 bp, Artificial Sequence
  Synthetic oligonucleotide
atgcaactggtgaaaatcaaccggtttacaattcc

SEQ ID NO: 82409 - DNA, 35 bp, Artificial Sequence
  Synthetic oligonucleotide
gtactctgggcggacccttcgtttggctgacttcc

SEQ ID NO: 82410 - DNA, 35 bp, Artificial Sequence
  Synthetic oligonucleotide
tctatgcggcatcattaccctcttaacacgtaggc

SEQ ID NO: 82411 - DNA, 35 bp, Artificial Sequence
  Synthetic oligonucleotide
agtcaaggcatatcatcttgcgttccccattgggc

SEQ ID NO: 82412 - DNA, 35 bp, Artificial Sequence
  Synthetic oligonucleotide
agaactgtgcccacccgactctccaatgtacctgc

SEQ ID NO: 82413 - DNA, 35 bp, Artificial Sequence
  Synthetic oligonucleotide
actagcaccgccatccacagtacccctccgtcatc

SEQ ID NO: 82414 - DNA, 35 bp, Artificial Sequence
  Synthetic oligonucleotide
gtaacctcgacgacttttggttttgcatttctatc

SEQ ID NO: 82415 - DNA, 35 bp, Artificial Sequence
  Synthetic oligonucleotide
gtcccttgctggtccctacgtccgacctgctactc

SEQ ID NO: 82416 - DNA, 35 bp, Artificial Sequence
  Synthetic oligonucleotide
taatacggcaccatggcgcttaccgtgcctacctc

SEQ ID NO: 82417 - DNA, 35 bp, Artificial Sequence
  Synthetic oligonucleotide
gcaggcaaaacggcgcggccacctgcaacctcctc

SEQ ID NO: 82418 - DNA, 35 bp, Artificial Sequence
  Synthetic oligonucleotide
tgttgttcagtcccgtttagggcgctttgtttctc

SEQ ID NO: 82419 - DNA, 35 bp, Artificial Sequence
  Synthetic oligonucleotide
gtcgtcccgctcacctagttgatatactcgtagtc

SEQ ID NO: 82420 - DNA, 35 bp, Artificial Sequence
  Synthetic oligonucleotide
gagtagcctccgccttcacgttgcttttacatgtc

SEQ ID NO: 82421 - DNA, 35 bp, Artificial Sequence
  Synthetic oligonucleotide
tgcacccctgcgttcgtgatacttatttttccttc

SEQ ID NO: 82422 - DNA, 35 bp, Artificial Sequence
  Synthetic oligonucleotide
atacaccgggctttggccgtggagaattactcttc

SEQ ID NO: 82423 - DNA, 35 bp, Artificial Sequence
  Synthetic oligonucleotide
acacccaatgagctgataaagcttgcgagttcttc

SEQ ID NO: 82424 - DNA, 35 bp, Artificial Sequence
  Synthetic oligonucleotide
gatcagctggcaccttctcatctctgtctggtttc

SEQ ID NO: 82425 - DNA, 35 bp, Artificial Sequence
  Synthetic oligonucleotide
gatgtcacacgaaccgggtttccatgccttttttc

SEQ ID NO: 82426 - DNA, 35 bp, Artificial Sequence
  Synthetic oligonucleotide
tgataggcgcccgcaccatctcttgctaacatcag

SEQ ID NO: 82427 - DNA, 35 bp, Artificial Sequence
  Synthetic oligonucleotide
tctcgttgccccactactcgccaatttgtacgtag

SEQ ID NO: 82428 - DNA, 35 bp, Artificial Sequence
  Synthetic oligonucleotide
gggtgcaattgcggggagggactttagtgggcacg

SEQ ID NO: 82429 - DNA, 35 bp, Artificial Sequence
  Synthetic oligonucleotide
taactcgccgagtcccttcaccgcggtacccttcg

SEQ ID NO: 82430 - DNA, 35 bp, Artificial Sequence
  Synthetic oligonucleotide
gtgaggggggaaattgtgcaataggtacaaagcgg

SEQ ID NO: 82431 - DNA, 34 bp, Artificial Sequence
  Synthetic oligonucleotide
aaagctgacttgagggaagggagtggggcacggg

SEQ ID NO: 82432 - DNA, 35 bp, Artificial Sequence
  Synthetic oligonucleotide
gatcatgacgctccgacgataaagcacagttcggg

SEQ ID NO: 82433 - DNA, 34 bp, Artificial Sequence
  Synthetic oligonucleotide
gaccatcacagaacctgtttagcatatctttggg

SEQ ID NO: 82434 - DNA, 35 bp, Artificial Sequence
  Synthetic oligonucleotide
gaccgctgaaaagggcagggaggactcgcaattgg

SEQ ID NO: 82435 - DNA, 35 bp, Artificial Sequence
  Synthetic oligonucleotide
gatccgcgccataaatcgggttgcctctcctcgtg

SEQ ID NO: 82436 - DNA, 35 bp, Artificial Sequence
  Synthetic oligonucleotide
tccaccagggactggggactctttaccaacgtgtg

SEQ ID NO: 82437 - DNA, 35 bp, Artificial Sequence
  Synthetic oligonucleotide
aagtcctcgcgtcctcgccgtttctataccacttg

SEQ ID NO: 82438 - DNA, 35 bp, Artificial Sequence
  Synthetic oligonucleotide
ccacaaacgcacctggggcactcaccatccttttg

SEQ ID NO: 82439 - DNA, 35 bp, Artificial Sequence
  Synthetic oligonucleotide
gatcaccgcacgcatgttgtcactcccttgttttg

SEQ ID NO: 82440 - DNA, 35 bp, Artificial Sequence
  Synthetic oligonucleotide
tacgtatgccttgtgcctctggttttatcctggat

SEQ ID NO: 82441 - DNA, 35 bp, Artificial Sequence
  Synthetic oligonucleotide
atgggcgggaatggggcatcggggatgacggtgat

SEQ ID NO: 82442 - DNA, 35 bp, Artificial Sequence
  Synthetic oligonucleotide
gatcgctcactacctacttgtcatctgtcttctat

SEQ ID NO: 82443 - DNA, 35 bp, Artificial Sequence
  Synthetic oligonucleotide
tccacgtgtcccaccattaacgggcgccaccttat

SEQ ID NO: 82444 - DNA, 35 bp, Artificial Sequence
  Synthetic oligonucleotide
agcatccccagtgcgctcgtaccgtaatttcccct

SEQ ID NO: 82445 - DNA, 35 bp, Artificial Sequence
  Synthetic oligonucleotide
atcacaccccaccgccttggggcactcgtacgcct

SEQ ID NO: 82446 - DNA, 35 bp, Artificial Sequence
  Synthetic oligonucleotide
atctctcccccgcacgatgccgcgactaggtcgct

SEQ ID NO: 82447 - DNA, 35 bp, Artificial Sequence
  Synthetic oligonucleotide
tagtacccgcttcatacgatcaataccttgtcgct

SEQ ID NO: 82448 - DNA, 35 bp, Artificial Sequence
  Synthetic oligonucleotide
atcatgtgcatcagcaccacgaatattttttatct

SEQ ID NO: 82449 - DNA, 35 bp, Artificial Sequence
  Synthetic oligonucleotide
aacgcccccggaacgtagtctactttttttgctct

SEQ ID NO: 82450 - DNA, 35 bp, Artificial Sequence
  Synthetic oligonucleotide
gctacatctagcactactagcgactctccaccagt

SEQ ID NO: 82451 - DNA, 35 bp, Artificial Sequence
  Synthetic oligonucleotide
atgcgatacggccgaacgagaaggtgagggctagt

SEQ ID NO: 82452 - DNA, 35 bp, Artificial Sequence
  Synthetic oligonucleotide
acccgaaacagtgccccttcagctccacgcccggt

SEQ ID NO: 82453 - DNA, 35 bp, Artificial Sequence
  Synthetic oligonucleotide
atatacccgcaccattccccgacggcatggcctgt

SEQ ID NO: 82454 - DNA, 35 bp, Artificial Sequence
  Synthetic oligonucleotide
gggagtcacgaagtgtgctggggatgggggggtgt

SEQ ID NO: 82455 - DNA, 35 bp, Artificial Sequence
  Synthetic oligonucleotide
gttgccaggtgcacctcctaattcttgctgcactt

SEQ ID NO: 82456 - DNA, 35 bp, Artificial Sequence
  Synthetic oligonucleotide
acaacaagcatagaggagataaaatcgacgacctt

SEQ ID NO: 82457 - DNA, 35 bp, Artificial Sequence
  Synthetic oligonucleotide
agagcgaccacgggacacccctcggatatgcgctt

SEQ ID NO: 82458 - DNA, 35 bp, Artificial Sequence
  Synthetic oligonucleotide
ttagagagccccttagtaaacccgacctccaagtt

SEQ ID NO: 82459 - DNA, 35 bp, Artificial Sequence
  Synthetic oligonucleotide
aacccgcctgtccatgtatcctcgatcacaatgtt

SEQ ID NO: 82460 - DNA, 36 bp, Artificial Sequence
  Synthetic oligonucleotide
acaccgctccttcggtctgccgtaagacagctgaaa

SEQ ID NO: 82461 - DNA, 36 bp, Artificial Sequence
  Synthetic oligonucleotide
gtccatcgaagagcgatggttcttacgtcttctaaa

SEQ ID NO: 82462 - DNA, 35 bp, Artificial Sequence
  Synthetic oligonucleotide
ccacgccccatgttgcctttatggaattatttaaa

SEQ ID NO: 82463 - DNA, 35 bp, Artificial Sequence
  Synthetic oligonucleotide
tgcagaagcacctgtctccctgtcaccctttacaa

SEQ ID NO: 82464 - DNA, 36 bp, Artificial Sequence
  Synthetic oligonucleotide
tgtacggtccactatcttatcaatgaatcttgccaa

SEQ ID NO: 82465 - DNA, 36 bp, Artificial Sequence
  Synthetic oligonucleotide
atgtcatgggccacatgagtgggtttctcattcaca

SEQ ID NO: 82466 - DNA, 36 bp, Artificial Sequence
  Synthetic oligonucleotide
agccatgcctgccacctgcgcaactccttcggtaca

SEQ ID NO: 82467 - DNA, 36 bp, Artificial Sequence
  Synthetic oligonucleotide
gtgtaaccccggtgtgttgcacgtatgccctgacca

SEQ ID NO: 82468 - DNA, 35 bp, Artificial Sequence
  Synthetic oligonucleotide
tgatgaggccgtctaaagtacacctccgcctacca

SEQ ID NO: 82469 - DNA, 36 bp, Artificial Sequence
  Synthetic oligonucleotide
gtcgcgccaatagctccccaaatccacgcctgccca

SEQ ID NO: 82470 - DNA, 36 bp, Artificial Sequence
  Synthetic oligonucleotide
ggtgcaaccctctcaacgccctagctcgctttagca

SEQ ID NO: 82471 - DNA, 36 bp, Artificial Sequence
  Synthetic oligonucleotide
ggatacgtagatcagatcttctcccctgttggtgca

SEQ ID NO: 82472 - DNA, 36 bp, Artificial Sequence
  Synthetic oligonucleotide
tgactccacaaggtcaattgtccgtttctatttgca

SEQ ID NO: 82473 - DNA, 36 bp, Artificial Sequence
  Synthetic oligonucleotide
tacccccgaactgatcgatcctctacgtttagatca

SEQ ID NO: 82474 - DNA, 36 bp, Artificial Sequence
  Synthetic oligonucleotide
gctcacccgagcctatatgtattcgtagtgtgatca

SEQ ID NO: 82475 - DNA, 36 bp, Artificial Sequence
  Synthetic oligonucleotide
aaaacgccctccatgttgcctggtctgtgggcttca

SEQ ID NO: 82476 - DNA, 37 bp, Artificial Sequence
  Synthetic oligonucleotide
gtgtagtgcaggctgaagcacgaagatggcggaaaga

SEQ ID NO: 82477 - DNA, 37 bp, Artificial Sequence
  Synthetic oligonucleotide
taacacactcaccaaatcctgagaagtccttgacaga

SEQ ID NO: 82478 - DNA, 37 bp, Artificial Sequence
  Synthetic oligonucleotide
ggaggggggaaaccgggggagtagtgccgtctacaga

SEQ ID NO: 82479 - DNA, 36 bp, Artificial Sequence
  Synthetic oligonucleotide
acccacataccgcgcctggacttcaaacatgggaga

SEQ ID NO: 82480 - DNA, 37 bp, Artificial Sequence
  Synthetic oligonucleotide
gggattgggcctgaactgcgggggggacgatcataga

SEQ ID NO: 82481 - DNA, 37 bp, Artificial Sequence
  Synthetic oligonucleotide
acgcatgccccttgatcttttcccacttgcgcctaga

SEQ ID NO: 82482 - DNA, 35 bp, Artificial Sequence
  Synthetic oligonucleotide
ttgccgggccaattccgctaccagttcctcaacga

SEQ ID NO: 82483 - DNA, 37 bp, Artificial Sequence
  Synthetic oligonucleotide
aggaggtcgcgagcagcaaaggcaaggtggaggacga

SEQ ID NO: 82484 - DNA, 37 bp, Artificial Sequence
  Synthetic oligonucleotide
gatcgctccacactgctctagcgcgggatttgcccga

SEQ ID NO: 82485 - DNA, 37 bp, Artificial Sequence
  Synthetic oligonucleotide
tcagacgcaccctttttccacgtcaccttcccggcga

SEQ ID NO: 82486 - DNA, 36 bp, Artificial Sequence
  Synthetic oligonucleotide
gttgctcgctcctccattcctcccgcgcattatcga

SEQ ID NO: 82487 - DNA, 37 bp, Artificial Sequence
  Synthetic oligonucleotide
tcgatggactattgatctgtgctttccgcttactcga

SEQ ID NO: 82488 - DNA, 37 bp, Artificial Sequence
  Synthetic oligonucleotide
gcaggggtagcaccgggtgggaacctgatagggcgga

SEQ ID NO: 82489 - DNA, 36 bp, Artificial Sequence
  Synthetic oligonucleotide
gaaggggaactggaaatatgtaggttgtcactcgga

SEQ ID NO: 82490 - DNA, 37 bp, Artificial Sequence
  Synthetic oligonucleotide
aaacaagcggcaacttgtttcatcacctttactcgga

SEQ ID NO: 82491 - DNA, 37 bp, Artificial Sequence
  Synthetic oligonucleotide
tgagctcgaactgccatacctcaacctgcctctcgga

SEQ ID NO: 82492 - DNA, 37 bp, Artificial Sequence
  Synthetic oligonucleotide
tcatcccccatgctgtggtacgtgcatccgattcgga

SEQ ID NO: 82493 - DNA, 37 bp, Artificial Sequence
  Synthetic oligonucleotide
tagtcgctccggggagaggaggaaggagggtttcgga

SEQ ID NO: 82494 - DNA, 37 bp, Artificial Sequence
  Synthetic oligonucleotide
gacagacaggggaattctgggtgtcgaagggtaggga

SEQ ID NO: 82495 - DNA, 37 bp, Artificial Sequence
  Synthetic oligonucleotide
gtcgccctccccgctgttcccgaacgtacattcggga

SEQ ID NO: 82496 - DNA, 37 bp, Artificial Sequence
  Synthetic oligonucleotide
acggggagtgtaggttccgtgggtggggtggctggga

SEQ ID NO: 82497 - DNA, 38 bp, Artificial Sequence
  Synthetic oligonucleotide
gccaaccaccctggttctgtaataaccatcctgaatga

SEQ ID NO: 82498 - DNA, 38 bp, Artificial Sequence
  Synthetic oligonucleotide
ttcgaggggccaggctgcatcctcactatttaacatga

SEQ ID NO: 82499 - DNA, 38 bp, Artificial Sequence
  Synthetic oligonucleotide
ggtacaccgcagagtccttcgcttatgatctgccatga

SEQ ID NO: 82500 - DNA, 37 bp, Artificial Sequence
  Synthetic oligonucleotide
tagagggagtgtgaagaaaaaacgggaagagtcatga

SEQ ID NO: 82501 - DNA, 38 bp, Artificial Sequence
  Synthetic oligonucleotide
tggggagacgataaaggagggcacgggaagatggatga

SEQ ID NO: 82502 - DNA, 38 bp, Artificial Sequence
  Synthetic oligonucleotide
gatggcgccgctcttggagcccgataccttgactatga

SEQ ID NO: 82503 - DNA, 38 bp, Artificial Sequence
  Synthetic oligonucleotide
acaaccatcccagacttatttattgtgtctacaactga

SEQ ID NO: 82504 - DNA, 38 bp, Artificial Sequence
  Synthetic oligonucleotide
gtgctcacccgtgtgagctttagaacttccatcgctga

SEQ ID NO: 82505 - DNA, 38 bp, Artificial Sequence
  Synthetic oligonucleotide
gaggggaatgcgcggattaacttagggtgaggggctga

SEQ ID NO: 82506 - DNA, 38 bp, Artificial Sequence
  Synthetic oligonucleotide
gcgatgcgcctcattgcgcgcttattatacttctctga

SEQ ID NO: 82507 - DNA, 38 bp, Artificial Sequence
  Synthetic oligonucleotide
gagccgggtcctagccctatcatgtgccaatcccgtga

SEQ ID NO: 82508 - DNA, 38 bp, Artificial Sequence
  Synthetic oligonucleotide
actcgccgagccggcggactaagtaaggggcaaggtga

SEQ ID NO: 82509 - DNA, 37 bp, Artificial Sequence
  Synthetic oligonucleotide
taggacacctcgcggaattcaagcccctaccctgtga

SEQ ID NO: 82510 - DNA, 38 bp, Artificial Sequence
  Synthetic oligonucleotide
gatgatgggcggtgcggtggaggggaacgcactattga

SEQ ID NO: 82511 - DNA, 38 bp, Artificial Sequence
  Synthetic oligonucleotide
tcccagcccactgcatattgaaacccctagttatttga

SEQ ID NO: 82512 - DNA, 38 bp, Artificial Sequence
  Synthetic oligonucleotide
acgctgtgcgctggtttcacgccatacatgacctttga

SEQ ID NO: 82513 - DNA, 36 bp, Artificial Sequence
  Synthetic oligonucleotide
ttaccgagatcgctcggacgttactcacaacccata

SEQ ID NO: 82514 - DNA, 36 bp, Artificial Sequence
  Synthetic oligonucleotide
ttagcgcgccatcctcccttgctctaactgctcata

SEQ ID NO: 82515 - DNA, 34 bp, Artificial Sequence
  Synthetic oligonucleotide
ggagcactcggtgtgcgacacgggcatagggata

SEQ ID NO: 82516 - DNA, 36 bp, Artificial Sequence
  Synthetic oligonucleotide
aagactgtcctgccccttatgcttcagcgctttata

SEQ ID NO: 82517 - DNA, 36 bp, Artificial Sequence
  Synthetic oligonucleotide
tccttgcctccgacgctctcctgagcctattaacta

SEQ ID NO: 82518 - DNA, 35 bp, Artificial Sequence
  Synthetic oligonucleotide
gtcaaccaacccggtccgtatcactccgtggacta

SEQ ID NO: 82519 - DNA, 36 bp, Artificial Sequence
  Synthetic oligonucleotide
aacgccacacctccatttcatccccgcccggtacta

SEQ ID NO: 82520 - DNA, 36 bp, Artificial Sequence
  Synthetic oligonucleotide
ttgagccccggctcgcgactaaatccctttccttta

SEQ ID NO: 82521 - DNA, 36 bp, Artificial Sequence
  Synthetic oligonucleotide
gtcccctaccgcatgcctgaagtctaccggtcttta

SEQ ID NO: 82522 - DNA, 35 bp, Artificial Sequence
  Synthetic oligonucleotide
tgcatcctgcaaggatcaacgttcctaccttcaac

SEQ ID NO: 82523 - DNA, 35 bp, Artificial Sequence
  Synthetic oligonucleotide
gagccgacacagctcctaaccatctataatggcac

SEQ ID NO: 82524 - DNA, 35 bp, Artificial Sequence
  Synthetic oligonucleotide
gtggccttggcggttcgtttcatacactatgtcac

SEQ ID NO: 82525 - DNA, 35 bp, Artificial Sequence
  Synthetic oligonucleotide
tagatcacacacagcaagctttgttccgtccttac

SEQ ID NO: 82526 - DNA, 35 bp, Artificial Sequence
  Synthetic oligonucleotide
tcctcgctggagccttgagctgtctgccactcacc

SEQ ID NO: 82527 - DNA, 36 bp, Artificial Sequence
  Synthetic oligonucleotide
gcgagctttaccatccgctatcacagcgtactcacc

SEQ ID NO: 82528 - DNA, 35 bp, Artificial Sequence
  Synthetic oligonucleotide
tcgccctccctcatcggagccccaatgtcctgacc

SEQ ID NO: 82529 - DNA, 35 bp, Artificial Sequence
  Synthetic oligonucleotide
gcaccgtacgcgttcacacctctgctaccaaaccc

SEQ ID NO: 82530 - DNA, 35 bp, Artificial Sequence
  Synthetic oligonucleotide
acccagccctattcacaatgcactgagtccgcccc

SEQ ID NO: 82531 - DNA, 35 bp, Artificial Sequence
  Synthetic oligonucleotide
gccaggacgaatctgattttgcaacaccgatgccc

SEQ ID NO: 82532 - DNA, 35 bp, Artificial Sequence
  Synthetic oligonucleotide
gtgtaccgacgcagtaagtttaggttttcattccc

SEQ ID NO: 82533 - DNA, 36 bp, Artificial Sequence
  Synthetic oligonucleotide
tccgggccagaagactctttgcaaggcttgattccc

SEQ ID NO: 82534 - DNA, 35 bp, Artificial Sequence
  Synthetic oligonucleotide
atcgcactagcctccaaaccacctgcattagatcc

SEQ ID NO: 82535 - DNA, 35 bp, Artificial Sequence
  Synthetic oligonucleotide
actctcccggattcgttttacgagattatctatcc

SEQ ID NO: 82536 - DNA, 35 bp, Artificial Sequence
  Synthetic oligonucleotide
aagtgccgctacaattccatcgtatcactctgtcc

SEQ ID NO: 82537 - DNA, 35 bp, Artificial Sequence
  Synthetic oligonucleotide
tgtgacgtgcccggccgttttgtctctctgtttcc

SEQ ID NO: 82538 - DNA, 35 bp, Artificial Sequence
  Synthetic oligonucleotide
atgccaggtcacagcgaagcacctcattcactagc

SEQ ID NO: 82539 - DNA, 35 bp, Artificial Sequence
  Synthetic oligonucleotide
gacccttccaccgcccgatgcttgtccaacgcatc

SEQ ID NO: 82540 - DNA, 35 bp, Artificial Sequence
  Synthetic oligonucleotide
ggtgctcagccttccgtagaaaaattcgctgcatc

SEQ ID NO: 82541 - DNA, 35 bp, Artificial Sequence
  Synthetic oligonucleotide
tactcagccgtcggtcccctactccccaacgtatc

SEQ ID NO: 82542 - DNA, 35 bp, Artificial Sequence
  Synthetic oligonucleotide
tccttgtcaggattacctgttacagttagatcctc

SEQ ID NO: 82543 - DNA, 35 bp, Artificial Sequence
  Synthetic oligonucleotide
taccgctcaccgctggggcaaattcagtacatctc

SEQ ID NO: 82544 - DNA, 35 bp, Artificial Sequence
  Synthetic oligonucleotide
gtccatgccaagcgatcgatagctgggcaattttc

SEQ ID NO: 82545 - DNA, 35 bp, Artificial Sequence
  Synthetic oligonucleotide
tatagctgggggaggggaagcggatagggctaaag

SEQ ID NO: 82546 - DNA, 35 bp, Artificial Sequence
  Synthetic oligonucleotide
aattcgagaaggacatagcgtgcatggggggtgag

SEQ ID NO: 82547 - DNA, 35 bp, Artificial Sequence
  Synthetic oligonucleotide
gttgagacaatggttcatctactccgccgtccccg

SEQ ID NO: 82548 - DNA, 35 bp, Artificial Sequence
  Synthetic oligonucleotide
ttgatgcccaccctgagcgcttgcgccacccgccg

SEQ ID NO: 82549 - DNA, 35 bp, Artificial Sequence
  Synthetic oligonucleotide
gccacatcatgttacccattccgcgctgccaaagg

SEQ ID NO: 82550 - DNA, 35 bp, Artificial Sequence
  Synthetic oligonucleotide
accacccgcctaatggtttactacgtatccactgg

SEQ ID NO: 82551 - DNA, 35 bp, Artificial Sequence
  Synthetic oligonucleotide
tgcatctgagaggggggggataacggacgtaaatg

SEQ ID NO: 82552 - DNA, 35 bp, Artificial Sequence
  Synthetic oligonucleotide
ttcggtcctgccactccacccgacacatgacccat

SEQ ID NO: 82553 - DNA, 35 bp, Artificial Sequence
  Synthetic oligonucleotide
acaaagcgcgtaggtccatcccgatcacctcctat

SEQ ID NO: 82554 - DNA, 35 bp, Artificial Sequence
  Synthetic oligonucleotide
tttccaccccggacagaacgactgtgctcccttat

SEQ ID NO: 82555 - DNA, 35 bp, Artificial Sequence
  Synthetic oligonucleotide
attgtcgtgcatgaaccccgccaagggccgctact

SEQ ID NO: 82556 - DNA, 35 bp, Artificial Sequence
  Synthetic oligonucleotide
gtcataccgctcggaaactctatcgttccacgcct

SEQ ID NO: 82557 - DNA, 35 bp, Artificial Sequence
  Synthetic oligonucleotide
gataaccgacgatatttaatgattacctgtcgcct

SEQ ID NO: 82558 - DNA, 35 bp, Artificial Sequence
  Synthetic oligonucleotide
agagcgcacgcccccaattgttcccggtgctcgct

SEQ ID NO: 82559 - DNA, 35 bp, Artificial Sequence
  Synthetic oligonucleotide
aggtggatcgggggagaaaaggggggcggaaccgt

SEQ ID NO: 82560 - DNA, 34 bp, Artificial Sequence
  Synthetic oligonucleotide
atgccctgcccctgccctccttgtttacccttgt

SEQ ID NO: 82561 - DNA, 35 bp, Artificial Sequence
  Synthetic oligonucleotide
ttgtacatggggcaccctcatagtttttttcttgt

SEQ ID NO: 82562 - DNA, 35 bp, Artificial Sequence
  Synthetic oligonucleotide
tctaacatcctggggtgaatcctttccttcgtatt

SEQ ID NO: 82563 - DNA, 35 bp, Artificial Sequence
  Synthetic oligonucleotide
taccactgtaccctacgaaatgggacagggaactt

SEQ ID NO: 82564 - DNA, 35 bp, Artificial Sequence
  Synthetic oligonucleotide
gtccatagcgctgtcccatcccgctgggcatactt

SEQ ID NO: 82565 - DNA, 35 bp, Artificial Sequence
  Synthetic oligonucleotide
atgaccaacccggatgcagcccatttaccctggtt

SEQ ID NO: 82566 - DNA, 35 bp, Artificial Sequence
  Synthetic oligonucleotide
actcaggaaacgcgcgacacatccacatgcacttt

SEQ ID NO: 82567 - DNA, 35 bp, Artificial Sequence
  Synthetic oligonucleotide
gacgcgcccttctccactggcgttgccgatccaaa

SEQ ID NO: 82568 - DNA, 36 bp, Artificial Sequence
  Synthetic oligonucleotide
gtgcgcattactgaactatcgatggtggctctcaaa

SEQ ID NO: 82569 - DNA, 35 bp, Artificial Sequence
  Synthetic oligonucleotide
acatccgtcggtgcctatcccgctctgaataacaa

SEQ ID NO: 82570 - DNA, 36 bp, Artificial Sequence
  Synthetic oligonucleotide
gtgaagcctacggagctggacagaaagggctggcaa

SEQ ID NO: 82571 - DNA, 36 bp, Artificial Sequence
  Synthetic oligonucleotide
tccgaaccattacataggtctgagaccgcacccgaa

SEQ ID NO: 82572 - DNA, 36 bp, Artificial Sequence
  Synthetic oligonucleotide
gtctaagctaaaaaggggggggtacggaggcaaaca

SEQ ID NO: 82573 - DNA, 35 bp, Artificial Sequence
  Synthetic oligonucleotide
gatggcggtcataccttttttttagcgcaacaaca

SEQ ID NO: 82574 - DNA, 35 bp, Artificial Sequence
  Synthetic oligonucleotide
ccaccgcacagaatcgcctcgtcattgcaaacaca

SEQ ID NO: 82575 - DNA, 36 bp, Artificial Sequence
  Synthetic oligonucleotide
gacacaccagttgcatccggaacagcgaaaaagaca

SEQ ID NO: 82576 - DNA, 36 bp, Artificial Sequence
  Synthetic oligonucleotide
agtgcaacggttcgcgctgactgcctaacactacca

SEQ ID NO: 82577 - DNA, 36 bp, Artificial Sequence
  Synthetic oligonucleotide
ttatggcacatctgaccctaactgtaccacccagca

SEQ ID NO: 82578 - DNA, 36 bp, Artificial Sequence
  Synthetic oligonucleotide
actgaccagcaaacgtttcgcggcttccctttagca

SEQ ID NO: 82579 - DNA, 36 bp, Artificial Sequence
  Synthetic oligonucleotide
ttactcccccggcctcggacccgtagcacagacgca

SEQ ID NO: 82580 - DNA, 36 bp, Artificial Sequence
  Synthetic oligonucleotide
atgaggccgacccggcgcgctatccccactactgca

SEQ ID NO: 82581 - DNA, 36 bp, Artificial Sequence
  Synthetic oligonucleotide
gtgcgacacaggacaggttaaggggcaaggattgca

SEQ ID NO: 82582 - DNA, 36 bp, Artificial Sequence
  Synthetic oligonucleotide
attgccccctccgttgttacacccctgctactctca

SEQ ID NO: 82583 - DNA, 36 bp, Artificial Sequence
  Synthetic oligonucleotide
tgtagtgaggggtatgttagggggatagtatgcaga

SEQ ID NO: 82584 - DNA, 37 bp, Artificial Sequence
  Synthetic oligonucleotide
tgatgggaggtaaggggatcggggcctaagtggtaga

SEQ ID NO: 82585 - DNA, 37 bp, Artificial Sequence
  Synthetic oligonucleotide
acttgcgatgagtggtgtggggtgggggtcataacga

SEQ ID NO: 82586 - DNA, 37 bp, Artificial Sequence
  Synthetic oligonucleotide
ggaccgtactagactgcaaacaactgccctttcacga

SEQ ID NO: 82587 - DNA, 37 bp, Artificial Sequence
  Synthetic oligonucleotide
atcgtaatccccgtaatggcgtatcatgccctatcga

SEQ ID NO: 82588 - DNA, 37 bp, Artificial Sequence
  Synthetic oligonucleotide
tagctggcccacaatatgcatagcttaactgcctcga

SEQ ID NO: 82589 - DNA, 37 bp, Artificial Sequence
  Synthetic oligonucleotide
ttgaccccaatgtactcacacgtagatactgcctcga

SEQ ID NO: 82590 - DNA, 36 bp, Artificial Sequence
  Synthetic oligonucleotide
gacgccgcaactctcagggaaagggcaaacaaagga

SEQ ID NO: 82591 - DNA, 37 bp, Artificial Sequence
  Synthetic oligonucleotide
acccactcgccgtatgtctcggaccacaggagcagga

SEQ ID NO: 82592 - DNA, 37 bp, Artificial Sequence
  Synthetic oligonucleotide
gttgaggaggggccaaattagacggtcaaaccgagga

SEQ ID NO: 82593 - DNA, 37 bp, Artificial Sequence
  Synthetic oligonucleotide
gcctgatccgcatctgccatattttcctccgatagga

SEQ ID NO: 82594 - DNA, 35 bp, Artificial Sequence
  Synthetic oligonucleotide
tccaaccctgtctaccactcacgcctgtccacgga

SEQ ID NO: 82595 - DNA, 37 bp, Artificial Sequence
  Synthetic oligonucleotide
gtgacgcgatcgtcttgctacgccactgccgcccgga

SEQ ID NO: 82596 - DNA, 37 bp, Artificial Sequence
  Synthetic oligonucleotide
gcgaaggggcggggagcggaaacacaagacggccgga

SEQ ID NO: 82597 - DNA, 37 bp, Artificial Sequence
  Synthetic oligonucleotide
gtgtgagggagaaaggggcagatgagaagggctcgga

SEQ ID NO: 82598 - DNA, 37 bp, Artificial Sequence
  Synthetic oligonucleotide
tccatctcctattgccattcttagcatcctacaggga

SEQ ID NO: 82599 - DNA, 37 bp, Artificial Sequence
  Synthetic oligonucleotide
aaaaccgcactatccgtcaatcagtccgttggaggga

SEQ ID NO: 82600 - DNA, 36 bp, Artificial Sequence
  Synthetic oligonucleotide
ttgggccgctccacactccttattttgtagacggga

SEQ ID NO: 82601 - DNA, 37 bp, Artificial Sequence
  Synthetic oligonucleotide
atcgcaagtaagggcaggcgcatgtacagggggggga

SEQ ID NO: 82602 - DNA, 37 bp, Artificial Sequence
  Synthetic oligonucleotide
gtgatccaacttgccacgatagtccagggacactgga

SEQ ID NO: 82603 - DNA, 37 bp, Artificial Sequence
  Synthetic oligonucleotide
atgtccgaggcacattttcagcttggaataccctgga

SEQ ID NO: 82604 - DNA, 37 bp, Artificial Sequence
  Synthetic oligonucleotide
gcctagtgcacgtggtcgaccgattggccgtggtgga

SEQ ID NO: 82605 - DNA, 36 bp, Artificial Sequence
  Synthetic oligonucleotide
ggaggtcatgcgcgcctctttctccgccctattgga

SEQ ID NO: 82606 - DNA, 38 bp, Artificial Sequence
  Synthetic oligonucleotide
acaccgggtgcgtgctttgaggaccacacacacaatga

SEQ ID NO: 82607 - DNA, 38 bp, Artificial Sequence
  Synthetic oligonucleotide
acatcatgtcccgtggcgtcattatcagttaccaatga

SEQ ID NO: 82608 - DNA, 38 bp, Artificial Sequence
  Synthetic oligonucleotide
gaacgcgcgatgccccccgtactgccgatcccaactga

SEQ ID NO: 82609 - DNA, 38 bp, Artificial Sequence
  Synthetic oligonucleotide
tagccacataccttcactgcgacaagacggtcatctga

SEQ ID NO: 82610 - DNA, 38 bp, Artificial Sequence
  Synthetic oligonucleotide
gggaagacatggaggtgggagggggtggtttgtagtga

SEQ ID NO: 82611 - DNA, 37 bp, Artificial Sequence
  Synthetic oligonucleotide
gattcagcacgggcgtacctggtgccgacctacgtga

SEQ ID NO: 82612 - DNA, 38 bp, Artificial Sequence
  Synthetic oligonucleotide
ttcgattcaccaacatttgtctttatagtcgtacgtga

SEQ ID NO: 82613 - DNA, 38 bp, Artificial Sequence
  Synthetic oligonucleotide
gatgcgcgcaccgaaatccccccccccgaacggcgtga

SEQ ID NO: 82614 - DNA, 38 bp, Artificial Sequence
  Synthetic oligonucleotide
tcacctccccgcctctgtacttgtcgtcgccatcgtga

SEQ ID NO: 82615 - DNA, 37 bp, Artificial Sequence
  Synthetic oligonucleotide
acactcgatggatgggaagggagggcgggaacggtga

SEQ ID NO: 82616 - DNA, 37 bp, Artificial Sequence
  Synthetic oligonucleotide
aatactggggcatgaggtttaggatcgaggggggtga

SEQ ID NO: 82617 - DNA, 37 bp, Artificial Sequence
  Synthetic oligonucleotide
atggtcataggatcaatcggggtgaggcggtgggtga

SEQ ID NO: 82618 - DNA, 38 bp, Artificial Sequence
  Synthetic oligonucleotide
actgtgcgcagcctgtcgttcccgaatcgtatcattga

SEQ ID NO: 82619 - DNA, 37 bp, Artificial Sequence
  Synthetic oligonucleotide
agtgagccaggggaacttgtaagagggttgggattga

SEQ ID NO: 82620 - DNA, 37 bp, Artificial Sequence
  Synthetic oligonucleotide
tgctctcaccgggtccatgcgattattgtccacttga

SEQ ID NO: 82621 - DNA, 37 bp, Artificial Sequence
  Synthetic oligonucleotide
tctgcccgccaaccgtttcgtaaagcaaagcccttga

SEQ ID NO: 82622 - DNA, 37 bp, Artificial Sequence
  Synthetic oligonucleotide
ggggcactcagatttcgcttttttgcccgttccttga

SEQ ID NO: 82623 - DNA, 38 bp, Artificial Sequence
  Synthetic oligonucleotide
tccgaaccaggcatgacggtgagcgtgccctatcttga

SEQ ID NO: 82624 - DNA, 35 bp, Artificial Sequence
  Synthetic oligonucleotide
agccgcgggcacaatgcagcatttctccctcttga

SEQ ID NO: 82625 - DNA, 38 bp, Artificial Sequence
  Synthetic oligonucleotide
aaccagcctctgaccacaacgttccgccctctagttga

SEQ ID NO: 82626 - DNA, 38 bp, Artificial Sequence
  Synthetic oligonucleotide
gacacgtgcggcatgggttgtgaggtgaggaaggttga

SEQ ID NO: 82627 - DNA, 38 bp, Artificial Sequence
  Synthetic oligonucleotide
tgcgactgcctcggttccctgccgctatttaaggttga

SEQ ID NO: 82628 - DNA, 38 bp, Artificial Sequence
  Synthetic oligonucleotide
tagctgaccccaccgtcctttccagcgtgccttgttga

SEQ ID NO: 82629 - DNA, 38 bp, Artificial Sequence
  Synthetic oligonucleotide
tgttgctcgtcaccatgcactgccgctatcctctttga

SEQ ID NO: 82630 - DNA, 38 bp, Artificial Sequence
  Synthetic oligonucleotide
tacatcgcgctctacatgcggttttatgcatgttttga

SEQ ID NO: 82631 - DNA, 36 bp, Artificial Sequence
  Synthetic oligonucleotide
ttggtaagtgcaagaggatagaagggggatcaaata

SEQ ID NO: 82632 - DNA, 36 bp, Artificial Sequence
  Synthetic oligonucleotide
gctgcctcccatatccgccagtcaggaaacaccata

SEQ ID NO: 82633 - DNA, 35 bp, Artificial Sequence
  Synthetic oligonucleotide
gcaccagcctccagtcctattgcttactgatgata

SEQ ID NO: 82634 - DNA, 35 bp, Artificial Sequence
  Synthetic oligonucleotide
tagacccttcacgaacgaccacgtggtggttacta

SEQ ID NO: 82635 - DNA, 36 bp, Artificial Sequence
  Synthetic oligonucleotide
acttacccgcgacaagcctcttgcgaccttcgagta

SEQ ID NO: 82636 - DNA, 37 bp, Artificial Sequence
  Synthetic oligonucleotide
tagaatagcgcccaccatctaccttcttgtgtcggta

SEQ ID NO: 82637 - DNA, 36 bp, Artificial Sequence
  Synthetic oligonucleotide
gagtcaactccgtcatttccttgctggcgaactgta

SEQ ID NO: 82638 - DNA, 35 bp, Artificial Sequence
  Synthetic oligonucleotide
gcgcgaacccctccgcaccctttgggactcttgta

SEQ ID NO: 82639 - DNA, 35 bp, Artificial Sequence
  Synthetic oligonucleotide
tgtgtgtcacctttccattctctagtccgtcgtta

SEQ ID NO: 82640 - DNA, 36 bp, Artificial Sequence
  Synthetic oligonucleotide
tcattgcccccccacctagttttttcaggtccttta

SEQ ID NO: 82641 - DNA, 35 bp, Artificial Sequence
  Synthetic oligonucleotide
attataggtcagccgagctagcctgtcccccaaac

SEQ ID NO: 82642 - DNA, 35 bp, Artificial Sequence
  Synthetic oligonucleotide
atcatccggcccgccctatagccaccgggctcaac

SEQ ID NO: 82643 - DNA, 35 bp, Artificial Sequence
  Synthetic oligonucleotide
tgatcccgcaaaccgctgtcaagccaccgcatcac

SEQ ID NO: 82644 - DNA, 35 bp, Artificial Sequence
  Synthetic oligonucleotide
tcgtccctgccttttcgttcaagtttgaagctcac

SEQ ID NO: 82645 - DNA, 35 bp, Artificial Sequence
  Synthetic oligonucleotide
aagccccgcgttggactcgccaacaagcctctcac

SEQ ID NO: 82646 - DNA, 35 bp, Artificial Sequence
  Synthetic oligonucleotide
gtacacctacgttacattatcacgccgcccgggac

SEQ ID NO: 82647 - DNA, 35 bp, Artificial Sequence
  Synthetic oligonucleotide
attcccctagtcgtacctcctggcctggtgcaacc

SEQ ID NO: 82648 - DNA, 35 bp, Artificial Sequence
  Synthetic oligonucleotide
aacatggatgagcaggcgcgactcgaatccccacc

SEQ ID NO: 82649 - DNA, 35 bp, Artificial Sequence
  Synthetic oligonucleotide
taataggccgaatgctttgccgtaacaacaatacc

SEQ ID NO: 82650 - DNA, 35 bp, Artificial Sequence
  Synthetic oligonucleotide
gcgaacaccacgagcctaggtgaacgggcattacc

SEQ ID NO: 82651 - DNA, 35 bp, Artificial Sequence
  Synthetic oligonucleotide
atgaaccgccggttttaggccggttaccacatccc

SEQ ID NO: 82652 - DNA, 35 bp, Artificial Sequence
  Synthetic oligonucleotide
tttgacctctctgtccatgggggtttgcttatccc

SEQ ID NO: 82653 - DNA, 35 bp, Artificial Sequence
  Synthetic oligonucleotide
aacccccactcgacccaccttgttcgctgccatcc

SEQ ID NO: 82654 - DNA, 35 bp, Artificial Sequence
  Synthetic oligonucleotide
gtggcagtcagccccattcggcccggacctcatcc

SEQ ID NO: 82655 - DNA, 35 bp, Artificial Sequence
  Synthetic oligonucleotide
tagcctctccggtcgcgcgtttactaatgccctcc

SEQ ID NO: 82656 - DNA, 35 bp, Artificial Sequence
  Synthetic oligonucleotide
ttagcccatcctttagcacaatgctctatcgtagc

SEQ ID NO: 82657 - DNA, 35 bp, Artificial Sequence
  Synthetic oligonucleotide
agagggcaacaaacactttccggcgcctaacccgc

SEQ ID NO: 82658 - DNA, 35 bp, Artificial Sequence
  Synthetic oligonucleotide
actcatatcgcccgttccctgcgttgtttgtgatc

SEQ ID NO: 82659 - DNA, 35 bp, Artificial Sequence
  Synthetic oligonucleotide
gcgccatgtcatccctgtttacagttcctcagctc

SEQ ID NO: 82660 - DNA, 35 bp, Artificial Sequence
  Synthetic oligonucleotide
gtgaccggccctagttcttttcggcctgttcattc

SEQ ID NO: 82661 - DNA, 35 bp, Artificial Sequence
  Synthetic oligonucleotide
taagttgctgttcacgcgagttggcattttacttc

SEQ ID NO: 82662 - DNA, 35 bp, Artificial Sequence
  Synthetic oligonucleotide
acttaccgttccggcttggagttctaacgcccttc

SEQ ID NO: 82663 - DNA, 35 bp, Artificial Sequence
  Synthetic oligonucleotide
agcctcacgccttccctttatttactgggatcttc

SEQ ID NO: 82664 - DNA, 35 bp, Artificial Sequence
  Synthetic oligonucleotide
tatggactcgctttcctctatggttgacactgttc

SEQ ID NO: 82665 - DNA, 35 bp, Artificial Sequence
  Synthetic oligonucleotide
tgggggacatggggggaagggggtgctatttaaag

SEQ ID NO: 82666 - DNA, 35 bp, Artificial Sequence
  Synthetic oligonucleotide
ggtggggtgtcacatggcgggtaggggatttggag

SEQ ID NO: 82667 - DNA, 35 bp, Artificial Sequence
  Synthetic oligonucleotide
gagcaaaacgcgaacaagcgggggaaaagcgtacg

SEQ ID NO: 82668 - DNA, 35 bp, Artificial Sequence
  Synthetic oligonucleotide
acgggacacacgtcggtcatccaaactctcccccg

SEQ ID NO: 82669 - DNA, 35 bp, Artificial Sequence
  Synthetic oligonucleotide
aacgcatggccttggagtcaccagtcccgcttccg

SEQ ID NO: 82670 - DNA, 35 bp, Artificial Sequence
  Synthetic oligonucleotide
acccacccgaaactccatctagaactagacagagg

SEQ ID NO: 82671 - DNA, 35 bp, Artificial Sequence
  Synthetic oligonucleotide
gacgacggggagaacgggggagggcgatcgggggg

SEQ ID NO: 82672 - DNA, 35 bp, Artificial Sequence
  Synthetic oligonucleotide
tctcatagggatacgtaatagaaggagagggggtg

SEQ ID NO: 82673 - DNA, 35 bp, Artificial Sequence
  Synthetic oligonucleotide
tatccctccgtagtcccagagcacactatgggttg

SEQ ID NO: 82674 - DNA, 35 bp, Artificial Sequence
  Synthetic oligonucleotide
taccatctactgcgcccgctacagccagacttttg

SEQ ID NO: 82675 - DNA, 35 bp, Artificial Sequence
  Synthetic oligonucleotide
ttggtgcagtcttagaggaaaatggggaaaaggat

SEQ ID NO: 82676 - DNA, 35 bp, Artificial Sequence
  Synthetic oligonucleotide
gatcatactcacgtgaaacacgattcactcccact

SEQ ID NO: 82677 - DNA, 35 bp, Artificial Sequence
  Synthetic oligonucleotide
gacaccactaaggttcagagctcaacgctcccact

SEQ ID NO: 82678 - DNA, 35 bp, Artificial Sequence
  Synthetic oligonucleotide
gtatgccggcggacctaacctaagtgccccctact

SEQ ID NO: 82679 - DNA, 35 bp, Artificial Sequence
  Synthetic oligonucleotide
tacgccgtgtaacgttgcattgatgccattacgct

SEQ ID NO: 82680 - DNA, 35 bp, Artificial Sequence
  Synthetic oligonucleotide
ggtggccgaagtggggcacggaaaggaggatgtct

SEQ ID NO: 82681 - DNA, 35 bp, Artificial Sequence
  Synthetic oligonucleotide
tagtgccgcccgtgtgtctcctttacatctacagt

SEQ ID NO: 82682 - DNA, 35 bp, Artificial Sequence
  Synthetic oligonucleotide
acacggagagcattgtggggggtggaggacaacgt

SEQ ID NO: 82683 - DNA, 35 bp, Artificial Sequence
  Synthetic oligonucleotide
gtctcttccacactgacgacgtcactacccgatgt

SEQ ID NO: 82684 - DNA, 35 bp, Artificial Sequence
  Synthetic oligonucleotide
ttccacgccctgagcttaattgaaggataaacatt

SEQ ID NO: 82685 - DNA, 35 bp, Artificial Sequence
  Synthetic oligonucleotide
tatcccatcgcatttgaacccggccatacctcctt

SEQ ID NO: 82686 - DNA, 35 bp, Artificial Sequence
  Synthetic oligonucleotide
ttgcaagggagggaaaagggtacgtgacgatagtt

SEQ ID NO: 82687 - DNA, 35 bp, Artificial Sequence
  Synthetic oligonucleotide
tagtcgacggtggggctgaatagttagggagcttt

SEQ ID NO: 82688 - DNA, 35 bp, Artificial Sequence
  Synthetic oligonucleotide
tgatagccaactatgctcttggcttgcccctgttt

SEQ ID NO: 82689 - DNA, 35 bp, Artificial Sequence
  Synthetic oligonucleotide
ttcccaccctgttgctgtactgtctcgcctgaaaa

SEQ ID NO: 82690 - DNA, 36 bp, Artificial Sequence
  Synthetic oligonucleotide
tctgcacgtcactgcctccttacgttcgcggcccaa

SEQ ID NO: 82691 - DNA, 35 bp, Artificial Sequence
  Synthetic oligonucleotide
actcatactcgtcgcacctgttcatactaccagaa

SEQ ID NO: 82692 - DNA, 36 bp, Artificial Sequence
  Synthetic oligonucleotide
acgtcgatccacgcacattgtcaagctgcccggtaa

SEQ ID NO: 82693 - DNA, 36 bp, Artificial Sequence
  Synthetic oligonucleotide
gtgcgccgacctgctaagttcgggccatctaccaca

SEQ ID NO: 82694 - DNA, 35 bp, Artificial Sequence
  Synthetic oligonucleotide
ggtggccaatgccaatccactatgtcctatccaca

SEQ ID NO: 82695 - DNA, 36 bp, Artificial Sequence
  Synthetic oligonucleotide
atgcgtgtggaggctcggggggtcttggaaggcaca

SEQ ID NO: 82696 - DNA, 35 bp, Artificial Sequence
  Synthetic oligonucleotide
actacgggctgcaggtctccattttgcgcggcaca

SEQ ID NO: 82697 - DNA, 36 bp, Artificial Sequence
  Synthetic oligonucleotide
gcctccaaccgcacgccacatatcagtttctgcaca

SEQ ID NO: 82698 - DNA, 36 bp, Artificial Sequence
  Synthetic oligonucleotide
gttgccacaactactagtctctgtcgttcattcaca

SEQ ID NO: 82699 - DNA, 35 bp, Artificial Sequence
  Synthetic oligonucleotide
gtgaggggttgtatgttggtagggaagaggagaca

SEQ ID NO: 82700 - DNA, 36 bp, Artificial Sequence
  Synthetic oligonucleotide
tgcgaggggaaggaaaaaaaagtggccttggttaca

SEQ ID NO: 82701 - DNA, 36 bp, Artificial Sequence
  Synthetic oligonucleotide
aacactgtctgtcgtacagacaaagtgcccctacca

SEQ ID NO: 82702 - DNA, 35 bp, Artificial Sequence
  Synthetic oligonucleotide
gagcccacgtgctcacacatttccctccggaccca

SEQ ID NO: 82703 - DNA, 36 bp, Artificial Sequence
  Synthetic oligonucleotide
caccttcgccatagctgagctttcatgacctcccca

SEQ ID NO: 82704 - DNA, 36 bp, Artificial Sequence
  Synthetic oligonucleotide
taagcgcaaacactcagttcacctagcccccgccca

SEQ ID NO: 82705 - DNA, 36 bp, Artificial Sequence
  Synthetic oligonucleotide
gacacatcactgtggacaccggcgtacccgctccca

SEQ ID NO: 82706 - DNA, 36 bp, Artificial Sequence
  Synthetic oligonucleotide
atgcctggggggcggacttcgggcaaatggactcca

SEQ ID NO: 82707 - DNA, 36 bp, Artificial Sequence
  Synthetic oligonucleotide
gaacgcaggggagtgcagtgacgttggttcgttcca

SEQ ID NO: 82708 - DNA, 36 bp, Artificial Sequence
  Synthetic oligonucleotide
tacgctctcgccactctctccccggatgggatcgca

SEQ ID NO: 82709 - DNA, 31 bp, Artificial Sequence
  Synthetic oligonucleotide
atgatactacacattgcgccgctcttttgca

SEQ ID NO: 82710 - DNA, 35 bp, Artificial Sequence
  Synthetic oligonucleotide
gctaatgcggcctgccctgcacggttcgttcatca

SEQ ID NO: 82711 - DNA, 35 bp, Artificial Sequence
  Synthetic oligonucleotide
gtgggtgccgccgcataacactggggttcacctca

SEQ ID NO: 82712 - DNA, 36 bp, Artificial Sequence
  Synthetic oligonucleotide
agatgccctcaaccgcccataagatgtaggtgctca

SEQ ID NO: 82713 - DNA, 35 bp, Artificial Sequence
  Synthetic oligonucleotide
gcgccccttcgccttgtcactgtcaatggatctca

SEQ ID NO: 82714 - DNA, 36 bp, Artificial Sequence
  Synthetic oligonucleotide
aagggcggctctatcgtcacttgccctgtcctgtca

SEQ ID NO: 82715 - DNA, 36 bp, Artificial Sequence
  Synthetic oligonucleotide
acgcggtcgcccatcctccacaccactatggtgtca

SEQ ID NO: 82716 - DNA, 36 bp, Artificial Sequence
  Synthetic oligonucleotide
tcccacaaccccagtttaagagcatgataggcaaga

SEQ ID NO: 82717 - DNA, 37 bp, Artificial Sequence
  Synthetic oligonucleotide
ggggagaccgtgcgaggcgctgcaatagggaaggaga

SEQ ID NO: 82718 - DNA, 37 bp, Artificial Sequence
  Synthetic oligonucleotide
ggttgggacgggggtcggactaggggcatccatgaga

SEQ ID NO: 82719 - DNA, 37 bp, Artificial Sequence
  Synthetic oligonucleotide
gaccccacatccgaatttgtgttagtaacacactaga

SEQ ID NO: 82720 - DNA, 37 bp, Artificial Sequence
  Synthetic oligonucleotide
taacccgacactcatcagcttctgcacactacttaga

SEQ ID NO: 82721 - DNA, 37 bp, Artificial Sequence
  Synthetic oligonucleotide
tccaccacactctcttgacggaccattcacgtaacga

SEQ ID NO: 82722 - DNA, 36 bp, Artificial Sequence
  Synthetic oligonucleotide
gcaaactgcagacggtttaccccacttcccgcacga

SEQ ID NO: 82723 - DNA, 36 bp, Artificial Sequence
  Synthetic oligonucleotide
actacgctccatttgctcatggtccaccacatacga

SEQ ID NO: 82724 - DNA, 36 bp, Artificial Sequence
  Synthetic oligonucleotide
tacagccaactgtgcatctatttcatcgctttacga

SEQ ID NO: 82725 - DNA, 37 bp, Artificial Sequence
  Synthetic oligonucleotide
acgtacgacctctgatgctgcctttaccgtggcccga

SEQ ID NO: 82726 - DNA, 37 bp, Artificial Sequence
  Synthetic oligonucleotide
gcgagcccagtgtctaatctttaacgcgccatcccga

SEQ ID NO: 82727 - DNA, 36 bp, Artificial Sequence
  Synthetic oligonucleotide
gcccatcagcccctattaccagaatcagttgtccga

SEQ ID NO: 82728 - DNA, 37 bp, Artificial Sequence
  Synthetic oligonucleotide
tcccgggcgggtggacttaatactgggcaaatatcga

SEQ ID NO: 82729 - DNA, 37 bp, Artificial Sequence
  Synthetic oligonucleotide
agtacgcaccatttagacactggccatagtctttcga

SEQ ID NO: 82730 - DNA, 37 bp, Artificial Sequence
  Synthetic oligonucleotide
actctccgcacatttcccgctccgcaagtacgaagga

SEQ ID NO: 82731 - DNA, 37 bp, Artificial Sequence
  Synthetic oligonucleotide
gagctcgagcgtgggtaggctagggggggccgaagga

SEQ ID NO: 82732 - DNA, 37 bp, Artificial Sequence
  Synthetic oligonucleotide
gatgcgcaaggacatgcaattctgcatcatggaagga

SEQ ID NO: 82733 - DNA, 37 bp, Artificial Sequence
  Synthetic oligonucleotide
ggagagccagagtggtacggggtggttgggtagagga

SEQ ID NO: 82734 - DNA, 37 bp, Artificial Sequence
  Synthetic oligonucleotide
tgtcgcagaagggcattggctgtgggtacttcgcgga

SEQ ID NO: 82735 - DNA, 37 bp, Artificial Sequence
  Synthetic oligonucleotide
ttgcgagcataaagtaaggggctaggaggctaaggga

SEQ ID NO: 82736 - DNA, 37 bp, Artificial Sequence
  Synthetic oligonucleotide
taccggggagcgacattgtctgggagaacgggtggga

SEQ ID NO: 82737 - DNA, 36 bp, Artificial Sequence
  Synthetic oligonucleotide
tacccaaatctcgcaccgtgaacgccctcttgtgga

SEQ ID NO: 82738 - DNA, 36 bp, Artificial Sequence
  Synthetic oligonucleotide
tgatcgaaatgtacaggggatgagggggcgattgga

SEQ ID NO: 82739 - DNA, 37 bp, Artificial Sequence
  Synthetic oligonucleotide
tccgtaccaccggggatttgaccatggcgattttgga

SEQ ID NO: 82740 - DNA, 38 bp, Artificial Sequence
  Synthetic oligonucleotide
tccatttacctcagtgtatcacgctcccccccgaatga

SEQ ID NO: 82741 - DNA, 37 bp, Artificial Sequence
  Synthetic oligonucleotide
gacccacgcatgccggatagagtgtgtggtctaatga

SEQ ID NO: 82742 - DNA, 38 bp, Artificial Sequence
  Synthetic oligonucleotide
tgagcggtacgtacctgcccctttttgcctgatcatga

SEQ ID NO: 82743 - DNA, 38 bp, Artificial Sequence
  Synthetic oligonucleotide
tgctgcccaactctttaaacggcccgtatttctcatga

SEQ ID NO: 82744 - DNA, 36 bp, Artificial Sequence
  Synthetic oligonucleotide
gtacgcacacccagttcaactctccggacttcatga

SEQ ID NO: 82745 - DNA, 38 bp, Artificial Sequence
  Synthetic oligonucleotide
acgacccccgtgcgaattgtatgccttctctttgatga

SEQ ID NO: 82746 - DNA, 38 bp, Artificial Sequence
  Synthetic oligonucleotide
accatacccccgtcccatcgtttacgtgccgcatatga

SEQ ID NO: 82747 - DNA, 38 bp, Artificial Sequence
  Synthetic oligonucleotide
tatacgccaccatccgttgttcactgaccagggtatga

SEQ ID NO: 82748 - DNA, 38 bp, Artificial Sequence
  Synthetic oligonucleotide
ttagtcaccggacgctgattcgtttccttttgcactga

SEQ ID NO: 82749 - DNA, 38 bp, Artificial Sequence
  Synthetic oligonucleotide
gactaatgccccgcagggtgtgcccacctgatacctga

SEQ ID NO: 82750 - DNA, 37 bp, Artificial Sequence
  Synthetic oligonucleotide
cacttcgcctgctgtccatttgtctgatatcccctga

SEQ ID NO: 82751 - DNA, 38 bp, Artificial Sequence
  Synthetic oligonucleotide
acgcgctctgaccttgacactttgccccgaatgcctga

SEQ ID NO: 82752 - DNA, 38 bp, Artificial Sequence
  Synthetic oligonucleotide
gcaccgtcacccatcgtaccaaacattatcaccgctga

SEQ ID NO: 82753 - DNA, 38 bp, Artificial Sequence
  Synthetic oligonucleotide
taacgcctcgatgcagcgattcccacaccatgttctga

SEQ ID NO: 82754 - DNA, 36 bp, Artificial Sequence
  Synthetic oligonucleotide
taggggatcaggatagggcaggggtaggaaaagtga

SEQ ID NO: 82755 - DNA, 38 bp, Artificial Sequence
  Synthetic oligonucleotide
agcacaaagcacgttctggcctgacctccctctcgtga

SEQ ID NO: 82756 - DNA, 38 bp, Artificial Sequence
  Synthetic oligonucleotide
gggaacgggttgggctactggctgggaactgcgggtga

SEQ ID NO: 82757 - DNA, 38 bp, Artificial Sequence
  Synthetic oligonucleotide
gagtgagtgcagtgcgggggtgggttccggcgtggtga

SEQ ID NO: 82758 - DNA, 38 bp, Artificial Sequence
  Synthetic oligonucleotide
ggtcgcactccatagttaacacacctcctttcatgtga

SEQ ID NO: 82759 - DNA, 38 bp, Artificial Sequence
  Synthetic oligonucleotide
tgcacagtgcaccagtatcccttattagcccgctgtga

SEQ ID NO: 82760 - DNA, 38 bp, Artificial Sequence
  Synthetic oligonucleotide
tagaccaacctttgcactacgagagcattaccttgtga

SEQ ID NO: 82761 - DNA, 37 bp, Artificial Sequence
  Synthetic oligonucleotide
tcgagccacccatcttgacgtacgacatagagcttga

SEQ ID NO: 82762 - DNA, 36 bp, Artificial Sequence
  Synthetic oligonucleotide
gtgtaagccatgcatgggttggggggaaggtgttga

SEQ ID NO: 82763 - DNA, 36 bp, Artificial Sequence
  Synthetic oligonucleotide
aaccacatgcaccctgaggcaaataccacgaaaata

SEQ ID NO: 82764 - DNA, 36 bp, Artificial Sequence
  Synthetic oligonucleotide
gccacttgggtgcatgttctgtctacggccacaata

SEQ ID NO: 82765 - DNA, 36 bp, Artificial Sequence
  Synthetic oligonucleotide
tgcatccatccgcaccgcttatttatgactaacata

SEQ ID NO: 82766 - DNA, 35 bp, Artificial Sequence
  Synthetic oligonucleotide
acagtccgacccaagttgtcccacgatttcatata

SEQ ID NO: 82767 - DNA, 36 bp, Artificial Sequence
  Synthetic oligonucleotide
tcagccacaagtcacccggtccatgatccccaggta

SEQ ID NO: 82768 - DNA, 35 bp, Artificial Sequence
  Synthetic oligonucleotide
atcgacagcagtggaaagtcaacggaggaatggta

SEQ ID NO: 82769 - DNA, 35 bp, Artificial Sequence
  Synthetic oligonucleotide
atgccaaaaacgcccattgtgcactggtctcctta

SEQ ID NO: 82770 - DNA, 35 bp, Artificial Sequence
  Synthetic oligonucleotide
gatcaacttgaactcacgagcccgtgggaacttac

SEQ ID NO: 82771 - DNA, 35 bp, Artificial Sequence
  Synthetic oligonucleotide
acatcgcacccgacttcatcccagtacgtcccacc

SEQ ID NO: 82772 - DNA, 35 bp, Artificial Sequence
  Synthetic oligonucleotide
aacactagtgagcaggcgtcgccgatccccgcacc

SEQ ID NO: 82773 - DNA, 35 bp, Artificial Sequence
  Synthetic oligonucleotide
aagaccacacttcatctttgcgcctatgctgcacc

SEQ ID NO: 82774 - DNA, 36 bp, Artificial Sequence
  Synthetic oligonucleotide
tacatacccgcacatccgctagaataaggtgtgacc

SEQ ID NO: 82775 - DNA, 35 bp, Artificial Sequence
  Synthetic oligonucleotide
tgtgtgctgatactcccggcttagaacgtgctacc

SEQ ID NO: 82776 - DNA, 35 bp, Artificial Sequence
  Synthetic oligonucleotide
gaccatgctctccaggctaactgtaatgcgctccc

SEQ ID NO: 82777 - DNA, 35 bp, Artificial Sequence
  Synthetic oligonucleotide
acctcacctggaagggcacatgaccttgggttccc

SEQ ID NO: 82778 - DNA, 35 bp, Artificial Sequence
  Synthetic oligonucleotide
tgatacgagctcgacattatctctccggactcgcc

SEQ ID NO: 82779 - DNA, 35 bp, Artificial Sequence
  Synthetic oligonucleotide
gccgacctgcaattggtcggtgggatccctttgcc

SEQ ID NO: 82780 - DNA, 35 bp, Artificial Sequence
  Synthetic oligonucleotide
gatcaccctaacgatcggctacttacacgaagtcc

SEQ ID NO: 82781 - DNA, 35 bp, Artificial Sequence
  Synthetic oligonucleotide
gactctcgtctcaccgcttaaaatattcgcctagc

SEQ ID NO: 82782 - DNA, 35 bp, Artificial Sequence
  Synthetic oligonucleotide
aattctacgcccgtttgtcgccatacatacatcgc

SEQ ID NO: 82783 - DNA, 35 bp, Artificial Sequence
  Synthetic oligonucleotide
acacactctctaattttacgtactagtcctatggc

SEQ ID NO: 82784 - DNA, 35 bp, Artificial Sequence
  Synthetic oligonucleotide
gtgggaatatccccccgctcacacgctgacattgc

SEQ ID NO: 82785 - DNA, 35 bp, Artificial Sequence
  Synthetic oligonucleotide
gccgagctctggtcccttatcatatcgaaacttgc

SEQ ID NO: 82786 - DNA, 35 bp, Artificial Sequence
  Synthetic oligonucleotide
ttggtccttgcgatctattctaactgctattcatc

SEQ ID NO: 82787 - DNA, 35 bp, Artificial Sequence
  Synthetic oligonucleotide
gaatgccaccctgttttgttcttgtggagggcctc

SEQ ID NO: 82788 - DNA, 35 bp, Artificial Sequence
  Synthetic oligonucleotide
agctagacgcatcggtcccggaatcctgaatcctc

SEQ ID NO: 82789 - DNA, 35 bp, Artificial Sequence
  Synthetic oligonucleotide
aagcaccatcttccgcacgtcgaggctttcggctc

SEQ ID NO: 82790 - DNA, 35 bp, Artificial Sequence
  Synthetic oligonucleotide
gaacggatgccgtgttagcatcttatccctgagtc

SEQ ID NO: 82791 - DNA, 35 bp, Artificial Sequence
  Synthetic oligonucleotide
acagtcctcccgccggataggtagtcaaccatgtc

SEQ ID NO: 82792 - DNA, 35 bp, Artificial Sequence
  Synthetic oligonucleotide
gtagcccgtcattcctgtacctcctgcatctattc

SEQ ID NO: 82793 - DNA, 35 bp, Artificial Sequence
  Synthetic oligonucleotide
ttagcacgcacctctcgtgttttggccatttcttc

SEQ ID NO: 82794 - DNA, 35 bp, Artificial Sequence
  Synthetic oligonucleotide
gactccaccatgtaggatgcgattggggtccgttc

SEQ ID NO: 82795 - DNA, 35 bp, Artificial Sequence
  Synthetic oligonucleotide
ttcttgcccgatttgcctgtccgcgtgaccatttc

SEQ ID NO: 82796 - DNA, 35 bp, Artificial Sequence
  Synthetic oligonucleotide
ttcaggcctattgggctggaccctgcaatcatttc

SEQ ID NO: 82797 - DNA, 35 bp, Artificial Sequence
  Synthetic oligonucleotide
tcgggcgcctccgacgatcatctacctgttttttc

SEQ ID NO: 82798 - DNA, 35 bp, Artificial Sequence
  Synthetic oligonucleotide
gacagaacgcacttagggttacggatggcgagaag

SEQ ID NO: 82799 - DNA, 35 bp, Artificial Sequence
  Synthetic oligonucleotide
gtcgacattcaagcctcttcgcctctcctcattag

SEQ ID NO: 82800 - DNA, 35 bp, Artificial Sequence
  Synthetic oligonucleotide
aatgctgaggttggagaaatgggtgggtgtgggcg

SEQ ID NO: 82801 - DNA, 35 bp, Artificial Sequence
  Synthetic oligonucleotide
ttcaaatgggagggaggtggaagtggatgacatcg

SEQ ID NO: 82802 - DNA, 35 bp, Artificial Sequence
  Synthetic oligonucleotide
ggtgcctcggagtgccacctggcccatattactcg

SEQ ID NO: 82803 - DNA, 35 bp, Artificial Sequence
  Synthetic oligonucleotide
gcaaatcgaggggacgtaggaaggtagggagcagg

SEQ ID NO: 82804 - DNA, 35 bp, Artificial Sequence
  Synthetic oligonucleotide
gtctgactcactgccaactcgtcctcacctgtagg

SEQ ID NO: 82805 - DNA, 35 bp, Artificial Sequence
  Synthetic oligonucleotide
agcaaacacagtctgtttaatacctccttgtccgg

SEQ ID NO: 82806 - DNA, 35 bp, Artificial Sequence
  Synthetic oligonucleotide
tcagaccgggaagtgcaagggcatgttgattaggg

SEQ ID NO: 82807 - DNA, 35 bp, Artificial Sequence
  Synthetic oligonucleotide
ggagagccgaggggcagttaggcattggtaagggg

SEQ ID NO: 82808 - DNA, 35 bp, Artificial Sequence
  Synthetic oligonucleotide
tgaccgacgatcggcgtttagaagaagaaacctgg

SEQ ID NO: 82809 - DNA, 35 bp, Artificial Sequence
  Synthetic oligonucleotide
gttaaggggggtgagcgatgcttaagtggggggtg

SEQ ID NO: 82810 - DNA, 35 bp, Artificial Sequence
  Synthetic oligonucleotide
ggaccgggcaacatctcacctaacttttgcgattg

SEQ ID NO: 82811 - DNA, 35 bp, Artificial Sequence
  Synthetic oligonucleotide
atcgtggggggcagaaatcacaatggaaggtcttg

SEQ ID NO: 82812 - DNA, 35 bp, Artificial Sequence
  Synthetic oligonucleotide
tacatccctgcttgttttccgtgaaccgggtgaat

SEQ ID NO: 82813 - DNA, 35 bp, Artificial Sequence
  Synthetic oligonucleotide
tcataacaccatggcgcgtccctccaccacaccat

SEQ ID NO: 82814 - DNA, 35 bp, Artificial Sequence
  Synthetic oligonucleotide
ttatgtgccctgccatcactaatagatcacaccat

SEQ ID NO: 82815 - DNA, 36 bp, Artificial Sequence
  Synthetic oligonucleotide
tggcgggcggtggggaatgtttggagttacggccat

SEQ ID NO: 82816 - DNA, 35 bp, Artificial Sequence
  Synthetic oligonucleotide
tcgataccctcatggcacccttataacgcaggtat

SEQ ID NO: 82817 - DNA, 35 bp, Artificial Sequence
  Synthetic oligonucleotide
gacaccgactagttctcatctcgatctcacggtat

SEQ ID NO: 82818 - DNA, 35 bp, Artificial Sequence
  Synthetic oligonucleotide
tcacgcaccttccgcagcgggttaatagcgccact

SEQ ID NO: 82819 - DNA, 35 bp, Artificial Sequence
  Synthetic oligonucleotide
gaatgcgaccatgttgggccgtttcagcgattact

SEQ ID NO: 82820 - DNA, 35 bp, Artificial Sequence
  Synthetic oligonucleotide
atctcacatgcgccttggctttacaatacgtgcct

SEQ ID NO: 82821 - DNA, 35 bp, Artificial Sequence
  Synthetic oligonucleotide
tgctgattgggggggtggagtgagtgtacggtcct

SEQ ID NO: 82822 - DNA, 35 bp, Artificial Sequence
  Synthetic oligonucleotide
gtgacgcgcaccgctcttacacaggcacattatct

SEQ ID NO: 82823 - DNA, 35 bp, Artificial Sequence
  Synthetic oligonucleotide
gacgcgggacaggtcatcatctagcccacttttct

SEQ ID NO: 82824 - DNA, 34 bp, Artificial Sequence
  Synthetic oligonucleotide
gcatgggggggggagttctgaaagggattcgggt

SEQ ID NO: 82825 - DNA, 35 bp, Artificial Sequence
  Synthetic oligonucleotide
acgcggcctatcctcacttagcttataatcctggt

SEQ ID NO: 82826 - DNA, 35 bp, Artificial Sequence
  Synthetic oligonucleotide
acccacaggcctgaccataatcaactcgacaatgt

SEQ ID NO: 82827 - DNA, 35 bp, Artificial Sequence
  Synthetic oligonucleotide
tagcccgtgaacttaaaatagctccatcaccatgt

SEQ ID NO: 82828 - DNA, 35 bp, Artificial Sequence
  Synthetic oligonucleotide
gcagtcgcagcctcgcatttgggaccacttctatt

SEQ ID NO: 82829 - DNA, 35 bp, Artificial Sequence
  Synthetic oligonucleotide
gtctgacatcagacgctttacaaggtgcttccctt

SEQ ID NO: 82830 - DNA, 35 bp, Artificial Sequence
  Synthetic oligonucleotide
aagcccactggatcagattgcgtacgtccttcctt

SEQ ID NO: 82831 - DNA, 35 bp, Artificial Sequence
  Synthetic oligonucleotide
ttagtcccccggtgacaataaccgttgttttcctt

SEQ ID NO: 82832 - DNA, 35 bp, Artificial Sequence
  Synthetic oligonucleotide
acgaggccaaatcccgtatgacattatcccctctt

SEQ ID NO: 82833 - DNA, 35 bp, Artificial Sequence
  Synthetic oligonucleotide
tcctccacatccgagagtatgccactatccctgtt

SEQ ID NO: 82834 - DNA, 35 bp, Artificial Sequence
  Synthetic oligonucleotide
gccaaccccaggcagtgcttcttcgtagttcccaa

SEQ ID NO: 82835 - DNA, 36 bp, Artificial Sequence
  Synthetic oligonucleotide
tccgaatcctcagtgcgcaagcagcccctgaatcaa

SEQ ID NO: 82836 - DNA, 36 bp, Artificial Sequence
  Synthetic oligonucleotide
gtgcaacccccttcctggtggtatcaacatcatcaa

SEQ ID NO: 82837 - DNA, 35 bp, Artificial Sequence
  Synthetic oligonucleotide
gattaacggtgtcggtagggtaagggggtggagaa

SEQ ID NO: 82838 - DNA, 36 bp, Artificial Sequence
  Synthetic oligonucleotide
acaacgtgagagaggaagggaggatactaagtagaa

SEQ ID NO: 82839 - DNA, 36 bp, Artificial Sequence
  Synthetic oligonucleotide
aacgggaccacaatgcgttaatcccaatcctgcgaa

SEQ ID NO: 82840 - DNA, 36 bp, Artificial Sequence
  Synthetic oligonucleotide
atgtctcctctgccccgattatgaactatttctgaa

SEQ ID NO: 82841 - DNA, 36 bp, Artificial Sequence
  Synthetic oligonucleotide
ttcaccctccgcccacctacggcagtcccacgctaa

SEQ ID NO: 82842 - DNA, 36 bp, Artificial Sequence
  Synthetic oligonucleotide
tcaccacgttcccccgggtccatagtgtactcgtaa

SEQ ID NO: 82843 - DNA, 35 bp, Artificial Sequence
  Synthetic oligonucleotide
gtatacgtggtgggggagatcgctggtggaggtaa

SEQ ID NO: 82844 - DNA, 35 bp, Artificial Sequence
  Synthetic oligonucleotide
actcgtgctaatcaaggagtggggggggggcttaa

SEQ ID NO: 82845 - DNA, 36 bp, Artificial Sequence
  Synthetic oligonucleotide
tcccccgctgcattggtttccccactgggtcgttaa

SEQ ID NO: 82846 - DNA, 37 bp, Artificial Sequence
  Synthetic oligonucleotide
ggagccataccgtagcatgggggaaatgttcgtttaa

SEQ ID NO: 82847 - DNA, 36 bp, Artificial Sequence
  Synthetic oligonucleotide
tctatctacagcccctcttctaaagctgcctggaca

SEQ ID NO: 82848 - DNA, 36 bp, Artificial Sequence
  Synthetic oligonucleotide
gttcaggccaacgggcttttggggtccctgcctaca

SEQ ID NO: 82849 - DNA, 36 bp, Artificial Sequence
  Synthetic oligonucleotide
ggttcaacgctggtctcgaccactgcaacccttaca

SEQ ID NO: 82850 - DNA, 35 bp, Artificial Sequence
  Synthetic oligonucleotide
atcgtggcgctagcacggtctatgccctttcccca

SEQ ID NO: 82851 - DNA, 36 bp, Artificial Sequence
  Synthetic oligonucleotide
gttcccgcaaatcacttggacgttctctaggtccca

SEQ ID NO: 82852 - DNA, 35 bp, Artificial Sequence
  Synthetic oligonucleotide
aacgcttcccaccccgttcttcgtgaccggtgcca

SEQ ID NO: 82853 - DNA, 36 bp, Artificial Sequence
  Synthetic oligonucleotide
tgcaccagctgtcctgccccggtctctacaactcca

SEQ ID NO: 82854 - DNA, 36 bp, Artificial Sequence
  Synthetic oligonucleotide
tccataatcactccacgttccctcaggccggttcca

SEQ ID NO: 82855 - DNA, 36 bp, Artificial Sequence
  Synthetic oligonucleotide
aacttggcaaagagaggagggcgggcgaaacgggca

SEQ ID NO: 82856 - DNA, 35 bp, Artificial Sequence
  Synthetic oligonucleotide
atctgcggtcgtagcacgcatgtgggggttgggca

SEQ ID NO: 82857 - DNA, 36 bp, Artificial Sequence
  Synthetic oligonucleotide
tgaagctggagggggcttgaattatgggaaggtgca

SEQ ID NO: 82858 - DNA, 35 bp, Artificial Sequence
  Synthetic oligonucleotide
accactggggtcctcacgtgccccgtcaaccatca

SEQ ID NO: 82859 - DNA, 35 bp, Artificial Sequence
  Synthetic oligonucleotide
aaccgacgtccctgtacttgctccccctgttgtca

SEQ ID NO: 82860 - DNA, 36 bp, Artificial Sequence
  Synthetic oligonucleotide
gatctacgccgtagacgcctgccataacgctcttca

SEQ ID NO: 82861 - DNA, 36 bp, Artificial Sequence
  Synthetic oligonucleotide
gcatgcctacctttagtacatacccgaacacgttca

SEQ ID NO: 82862 - DNA, 37 bp, Artificial Sequence
  Synthetic oligonucleotide
gaaagcagggaagagtaactgagtgagtccgaccaga

SEQ ID NO: 82863 - DNA, 37 bp, Artificial Sequence
  Synthetic oligonucleotide
taagacgtgcaaggtaggtggaagggtggtgtagaga

SEQ ID NO: 82864 - DNA, 37 bp, Artificial Sequence
  Synthetic oligonucleotide
aagcacacaacgcattttagccggaccgcccccgaga

SEQ ID NO: 82865 - DNA, 37 bp, Artificial Sequence
  Synthetic oligonucleotide
gacgcctccgtgtcgagctcttcccctctggccgaga

SEQ ID NO: 82866 - DNA, 37 bp, Artificial Sequence
  Synthetic oligonucleotide
agaaggcaaggggtgtagcaacgggggggcatcgaga

SEQ ID NO: 82867 - DNA, 37 bp, Artificial Sequence
  Synthetic oligonucleotide
atccgctagcaacaaagcgaaacggggatggtggaga

SEQ ID NO: 82868 - DNA, 36 bp, Artificial Sequence
  Synthetic oligonucleotide
ggacacgggatcacggggagtgcacatttggtgaga

SEQ ID NO: 82869 - DNA, 37 bp, Artificial Sequence
  Synthetic oligonucleotide
acgaggtggggcgaggggaataggaatcaaagctaga

SEQ ID NO: 82870 - DNA, 37 bp, Artificial Sequence
  Synthetic oligonucleotide
tgtcgactggccaaacaatacaaggggcatgtgacga

SEQ ID NO: 82871 - DNA, 36 bp, Artificial Sequence
  Synthetic oligonucleotide
aagggagggcgcacagggatcgcgaaggtgtgacga

SEQ ID NO: 82872 - DNA, 37 bp, Artificial Sequence
  Synthetic oligonucleotide
tccaggaccgcacagagccacccatccgttaatacga

SEQ ID NO: 82873 - DNA, 37 bp, Artificial Sequence
  Synthetic oligonucleotide
tagtaggagggatcggagaaggaggtagtcggtacga

SEQ ID NO: 82874 - DNA, 37 bp, Artificial Sequence
  Synthetic oligonucleotide
gacatgggccggattttgcaggaggagggccattcga

SEQ ID NO: 82875 - DNA, 37 bp, Artificial Sequence
  Synthetic oligonucleotide
atggatcaagccccgaagtcaggccgctcatcttcga

SEQ ID NO: 82876 - DNA, 37 bp, Artificial Sequence
  Synthetic oligonucleotide
actcacccgcctgtccctacgaattctggcctttcga

SEQ ID NO: 82877 - DNA, 37 bp, Artificial Sequence
  Synthetic oligonucleotide
tgaacaggggagggctggaggagtgagtcgagaagga

SEQ ID NO: 82878 - DNA, 38 bp, Artificial Sequence
  Synthetic oligonucleotide
gccaaaggtgtcacgggtggagtggcgggtatgaagga

SEQ ID NO: 82879 - DNA, 36 bp, Artificial Sequence
  Synthetic oligonucleotide
gcgcactctctcccgtatctccaccccttaccagga

SEQ ID NO: 82880 - DNA, 37 bp, Artificial Sequence
  Synthetic oligonucleotide
tccccgcatgcacctgcaggaactaaacctctccgga

SEQ ID NO: 82881 - DNA, 37 bp, Artificial Sequence
  Synthetic oligonucleotide
tccaactgccccggtcctctcaagacaccaacgcgga

SEQ ID NO: 82882 - DNA, 37 bp, Artificial Sequence
  Synthetic oligonucleotide
agccggagagtgcttgggtgcagggggaacgggcgga

SEQ ID NO: 82883 - DNA, 37 bp, Artificial Sequence
  Synthetic oligonucleotide
gtgcgaaaggttaagcgcacgcagagcggtgtaggga

SEQ ID NO: 82884 - DNA, 36 bp, Artificial Sequence
  Synthetic oligonucleotide
tgagaggaagggccaaataaacatcgacacggggga

SEQ ID NO: 82885 - DNA, 37 bp, Artificial Sequence
  Synthetic oligonucleotide
gagccgacatagcgggtggagcgtgtcggagggggga

SEQ ID NO: 82886 - DNA, 37 bp, Artificial Sequence
  Synthetic oligonucleotide
gatccgcaggatcgcgggacttacgcttcggatggga

SEQ ID NO: 82887 - DNA, 37 bp, Artificial Sequence
  Synthetic oligonucleotide
gccagaaccccagtgtaactatgttttctcccctgga

SEQ ID NO: 82888 - DNA, 37 bp, Artificial Sequence
  Synthetic oligonucleotide
ttgtgcctcaactgcctcactcatgtaccaccgtgga

SEQ ID NO: 82889 - DNA, 37 bp, Artificial Sequence
  Synthetic oligonucleotide
gaacacacaacatggcaattttaggtctcaccttgga

SEQ ID NO: 82890 - DNA, 37 bp, Artificial Sequence
  Synthetic oligonucleotide
gctgtggggggttaggaccgggggagtgacatttgga

SEQ ID NO: 82891 - DNA, 35 bp, Artificial Sequence
  Synthetic oligonucleotide
atcctgttccgcgtgttgcttttgggcccgaatga

SEQ ID NO: 82892 - DNA, 38 bp, Artificial Sequence
  Synthetic oligonucleotide
ataggaccagtggggtgataggggaatgtgagaactga

SEQ ID NO: 82893 - DNA, 38 bp, Artificial Sequence
  Synthetic oligonucleotide
acaactccacatagtgcattaggtctcatcctccctga

SEQ ID NO: 82894 - DNA, 38 bp, Artificial Sequence
  Synthetic oligonucleotide
atgcttcaggcggccgacccacgaactaccctatctga

SEQ ID NO: 82895 - DNA, 36 bp, Artificial Sequence
  Synthetic oligonucleotide
tgatcacccgtcatggttactgcccgttatctctga

SEQ ID NO: 82896 - DNA, 38 bp, Artificial Sequence
  Synthetic oligonucleotide
tgcctcgcgtgcggtactgctatcctcgtccgttctga

SEQ ID NO: 82897 - DNA, 38 bp, Artificial Sequence
  Synthetic oligonucleotide
ggtgccaggggggcaatggtggtgtgggaattacgtga

SEQ ID NO: 82898 - DNA, 38 bp, Artificial Sequence
  Synthetic oligonucleotide
tgttgaagggcccaagagcgaaggcggagattaggtga

SEQ ID NO: 82899 - DNA, 38 bp, Artificial Sequence
  Synthetic oligonucleotide
gaacgctggcgggtggtggagcggtaatgctggggtga

SEQ ID NO: 82900 - DNA, 36 bp, Artificial Sequence
  Synthetic oligonucleotide
gtaggagaagggtggaatagtggccaagacgtgtga

SEQ ID NO: 82901 - DNA, 37 bp, Artificial Sequence
  Synthetic oligonucleotide
aaccacgctccagccttttgctattacgcctgtgtga

SEQ ID NO: 82902 - DNA, 38 bp, Artificial Sequence
  Synthetic oligonucleotide
tgcatgctccgccagcacccaccacgttgagccattga

SEQ ID NO: 82903 - DNA, 38 bp, Artificial Sequence
  Synthetic oligonucleotide
gacgtacgtcaccgaccctatcaccttacgtggcttga

SEQ ID NO: 82904 - DNA, 38 bp, Artificial Sequence
  Synthetic oligonucleotide
tgtgtcgcactgacgggaatggggatagtttgtgttga

SEQ ID NO: 82905 - DNA, 38 bp, Artificial Sequence
  Synthetic oligonucleotide
gtccctcgctccagacacgtcggctggtttccctttga

SEQ ID NO: 82906 - DNA, 38 bp, Artificial Sequence
  Synthetic oligonucleotide
tcaccgtgctgtcatagcatcttgtttcgcctgtttga

SEQ ID NO: 82907 - DNA, 37 bp, Artificial Sequence
  Synthetic oligonucleotide
gtggtggagggggaaacggtcagttctgtgtgtttga

SEQ ID NO: 82908 - DNA, 38 bp, Artificial Sequence
  Synthetic oligonucleotide
atcccctcgttgccctctatgagcggctactcttttga

SEQ ID NO: 82909 - DNA, 38 bp, Artificial Sequence
  Synthetic oligonucleotide
aacacctacggatcctatattctcgttcatagttttga

SEQ ID NO: 82910 - DNA, 38 bp, Artificial Sequence
  Synthetic oligonucleotide
aagacagcccactactgccgaccagccacagtttttga

SEQ ID NO: 82911 - DNA, 37 bp, Artificial Sequence
  Synthetic oligonucleotide
gtactgcaggcccgtgtttgtgccttactttttttga

SEQ ID NO: 82912 - DNA, 35 bp, Artificial Sequence
  Synthetic oligonucleotide
gccgtccatagatcgtcgcgccccccgttgaaata

SEQ ID NO: 82913 - DNA, 36 bp, Artificial Sequence
  Synthetic oligonucleotide
tagcgactctccgttcggtgattttgcatgccacta

SEQ ID NO: 82914 - DNA, 35 bp, Artificial Sequence
  Synthetic oligonucleotide
acttctgccgccatgtcgttttcctcgcgccccta

SEQ ID NO: 82915 - DNA, 35 bp, Artificial Sequence
  Synthetic oligonucleotide
gctgcacctgggcataatcctgctgccaactccta

SEQ ID NO: 82916 - DNA, 36 bp, Artificial Sequence
  Synthetic oligonucleotide
agtaacctccgaaggttgcgggttccttttactcta

SEQ ID NO: 82917 - DNA, 36 bp, Artificial Sequence
  Synthetic oligonucleotide
gtgcacactgaaaagcataagctaacctgctccgta

SEQ ID NO: 82918 - DNA, 36 bp, Artificial Sequence
  Synthetic oligonucleotide
gcggtcatccggaggtctcaagcgctcccttccgta

SEQ ID NO: 82919 - DNA, 36 bp, Artificial Sequence
  Synthetic oligonucleotide
acgtctactgtcctgttcctgcatatgcctatcgta

SEQ ID NO: 82920 - DNA, 35 bp, Artificial Sequence
  Synthetic oligonucleotide
acagagcccaggctgcccttctacaataattggta

SEQ ID NO: 82921 - DNA, 35 bp, Artificial Sequence
  Synthetic oligonucleotide
tccaaccgagagggaggtaatgtaagtgcgttgta

SEQ ID NO: 82922 - DNA, 36 bp, Artificial Sequence
  Synthetic oligonucleotide
acttacgcccccatgtctccttcagtgccccaatta

SEQ ID NO: 82923 - DNA, 35 bp, Artificial Sequence
  Synthetic oligonucleotide
gtcaatcccaacgccacgatatctgtagttcgtta

SEQ ID NO: 82924 - DNA, 35 bp, Artificial Sequence
  Synthetic oligonucleotide
tgtcacccgactcacagtcctgctggccactacac

SEQ ID NO: 82925 - DNA, 35 bp, Artificial Sequence
  Synthetic oligonucleotide
gaacagcagggcacatatctacgcatccgcaccac

SEQ ID NO: 82926 - DNA, 35 bp, Artificial Sequence
  Synthetic oligonucleotide
gattgccggtggttagcacgaaattttgacttgac

SEQ ID NO: 82927 - DNA, 35 bp, Artificial Sequence
  Synthetic oligonucleotide
gcagacaccgaccataactgtcagcattgggctac

SEQ ID NO: 82928 - DNA, 35 bp, Artificial Sequence
  Synthetic oligonucleotide
aaacacgtagaaggagttcaggccccgacttctac

SEQ ID NO: 82929 - DNA, 35 bp, Artificial Sequence
  Synthetic oligonucleotide
tcgaccccccgttccctattgcatggcctgttacc

SEQ ID NO: 82930 - DNA, 35 bp, Artificial Sequence
  Synthetic oligonucleotide
gaacctgtcgggccacctgcaattttttcggaccc

SEQ ID NO: 82931 - DNA, 35 bp, Artificial Sequence
  Synthetic oligonucleotide
gatcgcaccattccttactatgtctgactcgcccc

SEQ ID NO: 82932 - DNA, 35 bp, Artificial Sequence
  Synthetic oligonucleotide
ttgtctcccccgaattcctgcgctgtattgattcc

SEQ ID NO: 82933 - DNA, 35 bp, Artificial Sequence
  Synthetic oligonucleotide
ggtgtcgcttgcgggccccctttctcgattgttcc

SEQ ID NO: 82934 - DNA, 35 bp, Artificial Sequence
  Synthetic oligonucleotide
gcactgcacgtgtgtcgtctggtctgttcgctagc

SEQ ID NO: 82935 - DNA, 35 bp, Artificial Sequence
  Synthetic oligonucleotide
tgtaaaaggtgtgtgtgtagtgttgatgtggtcgc

SEQ ID NO: 82936 - DNA, 35 bp, Artificial Sequence
  Synthetic oligonucleotide
gaaagggccgtaggatatccagctttccatttctc

SEQ ID NO: 82937 - DNA, 35 bp, Artificial Sequence
  Synthetic oligonucleotide
tcaatcgacggccttgcttttctgccacccaacag

SEQ ID NO: 82938 - DNA, 35 bp, Artificial Sequence
  Synthetic oligonucleotide
gccgggtagtggagggaaggcatactcatcgggag

SEQ ID NO: 82939 - DNA, 35 bp, Artificial Sequence
  Synthetic oligonucleotide
atgagacgaagggggttgttcgaaccaaaggggag

SEQ ID NO: 82940 - DNA, 35 bp, Artificial Sequence
  Synthetic oligonucleotide
caagtaccaccgcgggcgccacggatcacttcacg

SEQ ID NO: 82941 - DNA, 35 bp, Artificial Sequence
  Synthetic oligonucleotide
tgtgacaccccacagggcagggaccacgaaacccg

SEQ ID NO: 82942 - DNA, 35 bp, Artificial Sequence
  Synthetic oligonucleotide
tccccccgccggtcctctatattctaccagtcccg

SEQ ID NO: 82943 - DNA, 35 bp, Artificial Sequence
  Synthetic oligonucleotide
tgcatgcactccaagacttcactgggccccactcg

SEQ ID NO: 82944 - DNA, 35 bp, Artificial Sequence
  Synthetic oligonucleotide
acccgtcagattaccctcacgcgcttccaatcagg

SEQ ID NO: 82945 - DNA, 35 bp, Artificial Sequence
  Synthetic oligonucleotide
gcactactaccccgtttctgatccaccgtgatagg

SEQ ID NO: 82946 - DNA, 35 bp, Artificial Sequence
  Synthetic oligonucleotide
acccgctcaccaaaaactacgccagacctcgtagg

SEQ ID NO: 82947 - DNA, 35 bp, Artificial Sequence
  Synthetic oligonucleotide
gggtgggagttgggaaaactaaaagttgagggatg

SEQ ID NO: 82948 - DNA, 35 bp, Artificial Sequence
  Synthetic oligonucleotide
ttgcccaatatgtggcatgataacctccccctatg

SEQ ID NO: 82949 - DNA, 35 bp, Artificial Sequence
  Synthetic oligonucleotide
gcacccaagagaaatgagacataagtgatgtgctg

SEQ ID NO: 82950 - DNA, 35 bp, Artificial Sequence
  Synthetic oligonucleotide
tgccccacacacctcgacaaccttccagttctttg

SEQ ID NO: 82951 - DNA, 35 bp, Artificial Sequence
  Synthetic oligonucleotide
gtacactcggcgtgtcccctgcctcctgaaacaat

SEQ ID NO: 82952 - DNA, 35 bp, Artificial Sequence
  Synthetic oligonucleotide
atccgcagacgcgcctactactctttgcacacgat

SEQ ID NO: 82953 - DNA, 35 bp, Artificial Sequence
  Synthetic oligonucleotide
gtgattctccgccctccgttcaacatgggcatact

SEQ ID NO: 82954 - DNA, 35 bp, Artificial Sequence
  Synthetic oligonucleotide
aacgacgcagtggttccagtacactccgactccct

SEQ ID NO: 82955 - DNA, 35 bp, Artificial Sequence
  Synthetic oligonucleotide
gttagactcgctggtggtttgctaagcccttccct

SEQ ID NO: 82956 - DNA, 35 bp, Artificial Sequence
  Synthetic oligonucleotide
gacccgccgctggcatcacttctaagtcctccgct

SEQ ID NO: 82957 - DNA, 33 bp, Artificial Sequence
  Synthetic oligonucleotide
tggtgaactcctgctatccacactcatgctgct

SEQ ID NO: 82958 - DNA, 35 bp, Artificial Sequence
  Synthetic oligonucleotide
gaggcaaacgagggcggagggggcgggcaacaagt

SEQ ID NO: 82959 - DNA, 35 bp, Artificial Sequence
  Synthetic oligonucleotide
aaaggtcggattgggccggaatatgggaaggtggt

SEQ ID NO: 82960 - DNA, 35 bp, Artificial Sequence
  Synthetic oligonucleotide
accgttccctcacgcctcgtatcccctgaacttgt

SEQ ID NO: 82961 - DNA, 35 bp, Artificial Sequence
  Synthetic oligonucleotide
gtaacgcacgaagaggaagtacgggttcacagatt

SEQ ID NO: 82962 - DNA, 35 bp, Artificial Sequence
  Synthetic oligonucleotide
tcatgcacacctgatccaatgcatcaatacgactt

SEQ ID NO: 82963 - DNA, 35 bp, Artificial Sequence
  Synthetic oligonucleotide
gccgagcgcattgacggcatcctttgaaactactt

SEQ ID NO: 82964 - DNA, 35 bp, Artificial Sequence
  Synthetic oligonucleotide
ttgggcgtacgccacgggtcctcacttaatacctt

SEQ ID NO: 82965 - DNA, 35 bp, Artificial Sequence
  Synthetic oligonucleotide
ttcactacaccgggttcgtatggcatccccctgtt

SEQ ID NO: 82966 - DNA, 36 bp, Artificial Sequence
  Synthetic oligonucleotide
tcatgacccgccggtatcaagggcgcctcgcccttt

SEQ ID NO: 82967 - DNA, 35 bp, Artificial Sequence
  Synthetic oligonucleotide
gaggggtcagggcaatggaggtgagtaatgcgttt

SEQ ID NO: 82968 - DNA, 35 bp, Artificial Sequence
  Synthetic oligonucleotide
ggacctcactccttgtccgcctgcgccttctgttt

SEQ ID NO: 82969 - DNA, 36 bp, Artificial Sequence
  Synthetic oligonucleotide
gctcgccctacttgcgatctcgcgtttgcacacaaa

SEQ ID NO: 82970 - DNA, 36 bp, Artificial Sequence
  Synthetic oligonucleotide
tccagccatgccttggtctaccctgcggttctcaaa

SEQ ID NO: 82971 - DNA, 35 bp, Artificial Sequence
  Synthetic oligonucleotide
ataccccgtagagccaacaggcctggactttgaaa

SEQ ID NO: 82972 - DNA, 36 bp, Artificial Sequence
  Synthetic oligonucleotide
gtcattgccacttgatccggcagtgcccaatcacaa

SEQ ID NO: 82973 - DNA, 35 bp, Artificial Sequence
  Synthetic oligonucleotide
tgatcacacctgatgacacgaccgacctcgtacaa

SEQ ID NO: 82974 - DNA, 35 bp, Artificial Sequence
  Synthetic oligonucleotide
tccgtcagaagcctgatctaccaccagacatccaa

SEQ ID NO: 82975 - DNA, 36 bp, Artificial Sequence
  Synthetic oligonucleotide
gggaggaggatgaaaggtagaaaggtgagtacgcaa

SEQ ID NO: 82976 - DNA, 36 bp, Artificial Sequence
  Synthetic oligonucleotide
agccaacaccaacctacgtaccgtgacaagaccgaa

SEQ ID NO: 82977 - DNA, 35 bp, Artificial Sequence
  Synthetic oligonucleotide
accaggtagccgcaccctgttaggtcccctgtgaa

SEQ ID NO: 82978 - DNA, 36 bp, Artificial Sequence
  Synthetic oligonucleotide
acctgtgtaacccggcctcccgccgccctgccgtaa

SEQ ID NO: 82979 - DNA, 35 bp, Artificial Sequence
  Synthetic oligonucleotide
tgcacgagccgcatctcacttaacgctttcattaa

SEQ ID NO: 82980 - DNA, 36 bp, Artificial Sequence
  Synthetic oligonucleotide
tgtacaccggagcggactccgcgcctccacatgaca

SEQ ID NO: 82981 - DNA, 36 bp, Artificial Sequence
  Synthetic oligonucleotide
tgcattgtagcaatgcacgttgctttagcaaaccca

SEQ ID NO: 82982 - DNA, 36 bp, Artificial Sequence
  Synthetic oligonucleotide
aagtggcacctccataaccgtaggccttcagcccca

SEQ ID NO: 82983 - DNA, 35 bp, Artificial Sequence
  Synthetic oligonucleotide
gggtgggaggtagggtgggcgttcgcaggtgcgca

SEQ ID NO: 82984 - DNA, 35 bp, Artificial Sequence
  Synthetic oligonucleotide
acctaacggtggccagcataacaggagaataggca

SEQ ID NO: 82985 - DNA, 36 bp, Artificial Sequence
  Synthetic oligonucleotide
tccgtgacgtgccttttttgtgatcttaccttggca

SEQ ID NO: 82986 - DNA, 36 bp, Artificial Sequence
  Synthetic oligonucleotide
actccacgcagtactttgtgtaggattaccgctgca

SEQ ID NO: 82987 - DNA, 36 bp, Artificial Sequence
  Synthetic oligonucleotide
cacgcctagctttgtttctccgtcttgaaatgctca

SEQ ID NO: 82988 - DNA, 36 bp, Artificial Sequence
  Synthetic oligonucleotide
ggacgcacaccaatgcaagttcatgaccgactctca

SEQ ID NO: 82989 - DNA, 35 bp, Artificial Sequence
  Synthetic oligonucleotide
atacagcagaactacacgactgtatctcttcttca

SEQ ID NO: 82990 - DNA, 37 bp, Artificial Sequence
  Synthetic oligonucleotide
gacctagcctcatctagaagcatcatctccttccaga

SEQ ID NO: 82991 - DNA, 37 bp, Artificial Sequence
  Synthetic oligonucleotide
gcgaagacggatagctgggagtggaatgggattcaga

SEQ ID NO: 82992 - DNA, 37 bp, Artificial Sequence
  Synthetic oligonucleotide
atgatagcgcgattccctctattgtttcttgttgaga

SEQ ID NO: 82993 - DNA, 37 bp, Artificial Sequence
  Synthetic oligonucleotide
acgaacaaccgttccgttcataccatttaacatacga

SEQ ID NO: 82994 - DNA, 37 bp, Artificial Sequence
  Synthetic oligonucleotide
gcaaacgcagtgctcagctacgcacactgatacccga

SEQ ID NO: 82995 - DNA, 37 bp, Artificial Sequence
  Synthetic oligonucleotide
gcttgcacgttatgcggtattttatgttctttcccga

SEQ ID NO: 82996 - DNA, 35 bp, Artificial Sequence
  Synthetic oligonucleotide
gtcgccaaacattgctgtgcacgcatttcatccga

SEQ ID NO: 82997 - DNA, 36 bp, Artificial Sequence
  Synthetic oligonucleotide
aaggatgggaatgggtatggaaatggaaggtagcga

SEQ ID NO: 82998 - DNA, 37 bp, Artificial Sequence
  Synthetic oligonucleotide
tccacagcttagttccctccaaagtcccgcacatcga

SEQ ID NO: 82999 - DNA, 37 bp, Artificial Sequence
  Synthetic oligonucleotide
acgggccagcaatctgcatctactcgttttccttcga

SEQ ID NO: 83000 - DNA, 37 bp, Artificial Sequence
  Synthetic oligonucleotide
acaccgccacatcgaaattgctgtaagtagtcaagga

SEQ ID NO: 83001 - DNA, 37 bp, Artificial Sequence
  Synthetic oligonucleotide
acgaagtgaaggacgggcaggagaaggggcaccagga

SEQ ID NO: 83002 - DNA, 37 bp, Artificial Sequence
  Synthetic oligonucleotide
gcaagtggggcaagtggtatcggctagggaggtagga

SEQ ID NO: 83003 - DNA, 37 bp, Artificial Sequence
  Synthetic oligonucleotide
atgacggtgggaagggggcctgtaaggtgtgaacgga

SEQ ID NO: 83004 - DNA, 37 bp, Artificial Sequence
  Synthetic oligonucleotide
attggatagtgcggtggggtaaggggatgtctacgga

SEQ ID NO: 83005 - DNA, 36 bp, Artificial Sequence
  Synthetic oligonucleotide
gacaccaagcacatgtccgttttaggttccatcgga

SEQ ID NO: 83006 - DNA, 36 bp, Artificial Sequence
  Synthetic oligonucleotide
gtcaatcccctgcatgtaaacaaatccccgccggga

SEQ ID NO: 83007 - DNA, 37 bp, Artificial Sequence
  Synthetic oligonucleotide
acgagcgagggacaaagtccagggaagtacagcggga

SEQ ID NO: 83008 - DNA, 37 bp, Artificial Sequence
  Synthetic oligonucleotide
ggtaagagggggggtagtacagactgagtggagggga

SEQ ID NO: 83009 - DNA, 37 bp, Artificial Sequence
  Synthetic oligonucleotide
ttcctccgccccacccacagcctccaatctcagtgga

SEQ ID NO: 83010 - DNA, 37 bp, Artificial Sequence
  Synthetic oligonucleotide
gatgggggtggtggctttgaatggcactgctagtgga

SEQ ID NO: 83011 - DNA, 38 bp, Artificial Sequence
  Synthetic oligonucleotide
ggaggccggggggaatgaaggcacgtggcaaataatga

SEQ ID NO: 83012 - DNA, 38 bp, Artificial Sequence
  Synthetic oligonucleotide
tcccgaacgggaattattatgttgtgtgtcacccatga

SEQ ID NO: 83013 - DNA, 38 bp, Artificial Sequence
  Synthetic oligonucleotide
gatgctcacgtcgtaagatcaggacgtacctggcatga

SEQ ID NO: 83014 - DNA, 37 bp, Artificial Sequence
  Synthetic oligonucleotide
gagtgagggtcggtgggatggagtgttcagcggatga

SEQ ID NO: 83015 - DNA, 37 bp, Artificial Sequence
  Synthetic oligonucleotide
tgaacgtcaggattcttcgccctagccgccctactga

SEQ ID NO: 83016 - DNA, 37 bp, Artificial Sequence
  Synthetic oligonucleotide
acacgccctctattcctcacatagcctcgtcccctga

SEQ ID NO: 83017 - DNA, 36 bp, Artificial Sequence
  Synthetic oligonucleotide
ttcagcgcatcaaaaatcaccgtccgaatgccctga

SEQ ID NO: 83018 - DNA, 37 bp, Artificial Sequence
  Synthetic oligonucleotide
acccacccaatggcatatggtaagttggttctcctga

SEQ ID NO: 83019 - DNA, 38 bp, Artificial Sequence
  Synthetic oligonucleotide
tcaggatcgcctacaccctggataaacaccaccgctga

SEQ ID NO: 83020 - DNA, 38 bp, Artificial Sequence
  Synthetic oligonucleotide
ataactgccggtgccaccctgtcttgaatgactgctga

SEQ ID NO: 83021 - DNA, 38 bp, Artificial Sequence
  Synthetic oligonucleotide
gactcaacggcggacaaacatcttgaaactacctctga

SEQ ID NO: 83022 - DNA, 38 bp, Artificial Sequence
  Synthetic oligonucleotide
gaccccacccgtctgtactataatgctcgcgagcgtga

SEQ ID NO: 83023 - DNA, 38 bp, Artificial Sequence
  Synthetic oligonucleotide
acaacgctcgaatgggaaagagcgggtggggcgggtga

SEQ ID NO: 83024 - DNA, 37 bp, Artificial Sequence
  Synthetic oligonucleotide
tgacggaccgcaatcacccttttgtccttcctggtga

SEQ ID NO: 83025 - DNA, 38 bp, Artificial Sequence
  Synthetic oligonucleotide
agctagggggcggccgagaggagcgaagggggaattga

SEQ ID NO: 83026 - DNA, 36 bp, Artificial Sequence
  Synthetic oligonucleotide
gacagtcgaggagggacggagtagtaacataattga

SEQ ID NO: 83027 - DNA, 37 bp, Artificial Sequence
  Synthetic oligonucleotide
gccctccgaccttcactgccaggactaccattattga

SEQ ID NO: 83028 - DNA, 37 bp, Artificial Sequence
  Synthetic oligonucleotide
gcatgatctgcccgtatttaacgattgcgctccttga

SEQ ID NO: 83029 - DNA, 37 bp, Artificial Sequence
  Synthetic oligonucleotide
gctaacgacggcccctgttaatctttactctccttga

SEQ ID NO: 83030 - DNA, 37 bp, Artificial Sequence
  Synthetic oligonucleotide
tacacctctgctccgagtagcacccaggatagcttga

SEQ ID NO: 83031 - DNA, 38 bp, Artificial Sequence
  Synthetic oligonucleotide
gcggggcaccatgctcgatcctcatgtttacacgttga

SEQ ID NO: 83032 - DNA, 38 bp, Artificial Sequence
  Synthetic oligonucleotide
acgcacgtctgatccccctttcttccatttcgcgttga

SEQ ID NO: 83033 - DNA, 38 bp, Artificial Sequence
  Synthetic oligonucleotide
gcgctggtggaggcgcaagtgagggggaatgggtttga

SEQ ID NO: 83034 - DNA, 38 bp, Artificial Sequence
  Synthetic oligonucleotide
gttcctactccatctgttctcaaatccggtctgtttga

SEQ ID NO: 83035 - DNA, 36 bp, Artificial Sequence
  Synthetic oligonucleotide
ttatccatccgcggtgcaggtcatacctacaaaata

SEQ ID NO: 83036 - DNA, 36 bp, Artificial Sequence
  Synthetic oligonucleotide
aagagagcacaacaggaggcctacgagtgggaaata

SEQ ID NO: 83037 - DNA, 36 bp, Artificial Sequence
  Synthetic oligonucleotide
atgcaagtgggcctccttctttacacgtctcacata

SEQ ID NO: 83038 - DNA, 36 bp, Artificial Sequence
  Synthetic oligonucleotide
tcccaaacagtggcgagggggaagggagttaatata

SEQ ID NO: 83039 - DNA, 36 bp, Artificial Sequence
  Synthetic oligonucleotide
gacgcacatcgaacaaacaagagatggcggagtata

SEQ ID NO: 83040 - DNA, 36 bp, Artificial Sequence
  Synthetic oligonucleotide
tggggccccacctttagcggactcttgctactacta

SEQ ID NO: 83041 - DNA, 36 bp, Artificial Sequence
  Synthetic oligonucleotide
tgcacgtacttgggcatggcttttcattcgtaccta

SEQ ID NO: 83042 - DNA, 35 bp, Artificial Sequence
  Synthetic oligonucleotide
aatcacatgccgtagggccaaactcctgatgccta

SEQ ID NO: 83043 - DNA, 36 bp, Artificial Sequence
  Synthetic oligonucleotide
gttcacacaaccatgtccagtcatccctaacggcta

SEQ ID NO: 83044 - DNA, 36 bp, Artificial Sequence
  Synthetic oligonucleotide
gaagcggtcgtcccatcgcccagcccatacttagta

SEQ ID NO: 83045 - DNA, 36 bp, Artificial Sequence
  Synthetic oligonucleotide
atgatccccaggccccagttacctttacgccccgta

SEQ ID NO: 83046 - DNA, 35 bp, Artificial Sequence
  Synthetic oligonucleotide
gtgggaggtaatttggccagagggaggatggggta

SEQ ID NO: 83047 - DNA, 36 bp, Artificial Sequence
  Synthetic oligonucleotide
tactgaggcaccacctgtctcaccaaaacagtttta

SEQ ID NO: 83048 - DNA, 35 bp, Artificial Sequence
  Synthetic oligonucleotide
ttcgaccggaaacgcgcaactttcccacctgtgac

SEQ ID NO: 83049 - DNA, 35 bp, Artificial Sequence
  Synthetic oligonucleotide
tcacagaggtctatcgttcaagctgcttgtcttac

SEQ ID NO: 83050 - DNA, 36 bp, Artificial Sequence
  Synthetic oligonucleotide
tacacccctcgtatcccttcacagaaccggatttac

SEQ ID NO: 83051 - DNA, 35 bp, Artificial Sequence
  Synthetic oligonucleotide
ggccactgccaaacactacacgagttatgttaacc

SEQ ID NO: 83052 - DNA, 35 bp, Artificial Sequence
  Synthetic oligonucleotide
attagatgcgccggtcgaacccaacaatgccaccc

SEQ ID NO: 83053 - DNA, 35 bp, Artificial Sequence
  Synthetic oligonucleotide
tatctaacaactggctgttgtcgacatgacacccc

SEQ ID NO: 83054 - DNA, 35 bp, Artificial Sequence
  Synthetic oligonucleotide
gtaaccacaccaggtcattatgtgccgtgccgccc

SEQ ID NO: 83055 - DNA, 35 bp, Artificial Sequence
  Synthetic oligonucleotide
tcaccctgggcctttggtgttttcgtcgatcggcc

SEQ ID NO: 83056 - DNA, 35 bp, Artificial Sequence
  Synthetic oligonucleotide
ttatacgggccaccggtgggacttctgccattgcc

SEQ ID NO: 83057 - DNA, 35 bp, Artificial Sequence
  Synthetic oligonucleotide
gtccgcccgccgcgccgagcacacgccctattgcc

SEQ ID NO: 83058 - DNA, 35 bp, Artificial Sequence
  Synthetic oligonucleotide
caccgatcacaggtgcacgggcgctcataccatcc

SEQ ID NO: 83059 - DNA, 35 bp, Artificial Sequence
  Synthetic oligonucleotide
tcccgtattcgtaccgatatcgtagtcccggttcc

SEQ ID NO: 83060 - DNA, 35 bp, Artificial Sequence
  Synthetic oligonucleotide
tacaccctcgcccctactattgtgcggaattaagc

SEQ ID NO: 83061 - DNA, 34 bp, Artificial Sequence
  Synthetic oligonucleotide
tagcctagcgacaattccagccatttactgctgc

SEQ ID NO: 83062 - DNA, 35 bp, Artificial Sequence
  Synthetic oligonucleotide
tacctccgttcccgtatagttccttggcttagatc

SEQ ID NO: 83063 - DNA, 35 bp, Artificial Sequence
  Synthetic oligonucleotide
tgtcacctaatccaacacttccgagccacgtgctc

SEQ ID NO: 83064 - DNA, 35 bp, Artificial Sequence
  Synthetic oligonucleotide
gtctgtgccgccggttatgagggatgaaggtggag

SEQ ID NO: 83065 - DNA, 35 bp, Artificial Sequence
  Synthetic oligonucleotide
atgtagccatggttgcgggagggagggatttgtag

SEQ ID NO: 83066 - DNA, 35 bp, Artificial Sequence
  Synthetic oligonucleotide
tagtagtgaaagtgggtcggggggggcgtaattag

SEQ ID NO: 83067 - DNA, 35 bp, Artificial Sequence
  Synthetic oligonucleotide
gagtggtgcatggggtcaacttgaggcaggtaacg

SEQ ID NO: 83068 - DNA, 35 bp, Artificial Sequence
  Synthetic oligonucleotide
gtgcacgctgcgggaagacagagaatggacagccg

SEQ ID NO: 83069 - DNA, 35 bp, Artificial Sequence
  Synthetic oligonucleotide
atttctgtgcctgtggtacctccccttccctcggg

SEQ ID NO: 83070 - DNA, 35 bp, Artificial Sequence
  Synthetic oligonucleotide
gaactcggggcgatgtaggtggagctggacggggg

SEQ ID NO: 83071 - DNA, 35 bp, Artificial Sequence
  Synthetic oligonucleotide
gatccacccgaactctcgcgtcgcttctaacttgg

SEQ ID NO: 83072 - DNA, 35 bp, Artificial Sequence
  Synthetic oligonucleotide
ggtgtggggaatatggtgaaggtaaatgtacttgg

SEQ ID NO: 83073 - DNA, 35 bp, Artificial Sequence
  Synthetic oligonucleotide
tcgatacgcccgaacccccatattctggacaactg

SEQ ID NO: 83074 - DNA, 35 bp, Artificial Sequence
  Synthetic oligonucleotide
tccggtcgacacaccgcaccattctacaggtactg

SEQ ID NO: 83075 - DNA, 35 bp, Artificial Sequence
  Synthetic oligonucleotide
tcacctgtcaccccgtttaccgctcataacgagtg

SEQ ID NO: 83076 - DNA, 35 bp, Artificial Sequence
  Synthetic oligonucleotide
gagcgaggcctagcacgccaccactcccaccattg

SEQ ID NO: 83077 - DNA, 35 bp, Artificial Sequence
  Synthetic oligonucleotide
attctgacattgtgacaccactccttcgtgtcttg

SEQ ID NO: 83078 - DNA, 35 bp, Artificial Sequence
  Synthetic oligonucleotide
acaagtggtagtatggtcggggttaagggtcgcat

SEQ ID NO: 83079 - DNA, 35 bp, Artificial Sequence
  Synthetic oligonucleotide
agcaccctggctccttcccatggcatcctttggat

SEQ ID NO: 83080 - DNA, 35 bp, Artificial Sequence
  Synthetic oligonucleotide
atgccgaccaccttgcttatcacttcggcaaatat

SEQ ID NO: 83081 - DNA, 35 bp, Artificial Sequence
  Synthetic oligonucleotide
gcaacgctccgatattattgttctcggagtgcact

SEQ ID NO: 83082 - DNA, 35 bp, Artificial Sequence
  Synthetic oligonucleotide
acacatgacatgctccatcgatccagaagctacct

SEQ ID NO: 83083 - DNA, 35 bp, Artificial Sequence
  Synthetic oligonucleotide
tatgcctcctatcaaggtcgtagcgcaccattcct

SEQ ID NO: 83084 - DNA, 35 bp, Artificial Sequence
  Synthetic oligonucleotide
agtctagcgtacagttgccacctcgatatcctgct

SEQ ID NO: 83085 - DNA, 35 bp, Artificial Sequence
  Synthetic oligonucleotide
accaaccgccgcgtcttattgttggttttcctcgt

SEQ ID NO: 83086 - DNA, 35 bp, Artificial Sequence
  Synthetic oligonucleotide
agttcgcgcaactcaggcatatttttctaccctgt

SEQ ID NO: 83087 - DNA, 35 bp, Artificial Sequence
  Synthetic oligonucleotide
ggggtcacccgtacctagtttgcctcgccacttgt

SEQ ID NO: 83088 - DNA, 35 bp, Artificial Sequence
  Synthetic oligonucleotide
tgtaaccgcagatcgaacctgttccagcgttactt

SEQ ID NO: 83089 - DNA, 35 bp, Artificial Sequence
  Synthetic oligonucleotide
gactatcgacctacccgcggcgtgaacaccaattt

SEQ ID NO: 83090 - DNA, 35 bp, Artificial Sequence
  Synthetic oligonucleotide
acatcggtccggaggacttaactcaggaagccttt

SEQ ID NO: 83091 - DNA, 36 bp, Artificial Sequence
  Synthetic oligonucleotide
gtggaacggaactgctgcaattcgatacctgcgaaa

SEQ ID NO: 83092 - DNA, 36 bp, Artificial Sequence
  Synthetic oligonucleotide
gcaccctaaatgacactctgacgccaccctgccgaa

SEQ ID NO: 83093 - DNA, 35 bp, Artificial Sequence
  Synthetic oligonucleotide
gcaatcacggcatccgaatggccctttgttccgaa

SEQ ID NO: 83094 - DNA, 37 bp, Artificial Sequence
  Synthetic oligonucleotide
tgaagcggtagggcggcaacaaaaaaaataaatcgaa

SEQ ID NO: 83095 - DNA, 36 bp, Artificial Sequence
  Synthetic oligonucleotide
gtttgggaccaagcaagagggggatagtacggggaa

SEQ ID NO: 83096 - DNA, 36 bp, Artificial Sequence
  Synthetic oligonucleotide
ttgaggtcgacggaccaatggggacgagtgattgaa

SEQ ID NO: 83097 - DNA, 37 bp, Artificial Sequence
  Synthetic oligonucleotide
tagagtaagcgcgctgcactggccttgtaactttgaa

SEQ ID NO: 83098 - DNA, 34 bp, Artificial Sequence
  Synthetic oligonucleotide
agcccacaaacctggcccaagagagcactggtaa

SEQ ID NO: 83099 - DNA, 36 bp, Artificial Sequence
  Synthetic oligonucleotide
acgatgcccttctgcaaaacctggaacttcggaaca

SEQ ID NO: 83100 - DNA, 35 bp, Artificial Sequence
  Synthetic oligonucleotide
gatcataaaccctccactgcccttcaactgggaca

SEQ ID NO: 83101 - DNA, 35 bp, Artificial Sequence
  Synthetic oligonucleotide
tccgcaaaccccatcctccgctgctgttctttaca

SEQ ID NO: 83102 - DNA, 36 bp, Artificial Sequence
  Synthetic oligonucleotide
tgatgggtccaccatcgtgtttatttctgttcccca

SEQ ID NO: 83103 - DNA, 35 bp, Artificial Sequence
  Synthetic oligonucleotide
tacaggacgcctctctttttccccagcgacggcca

SEQ ID NO: 83104 - DNA, 36 bp, Artificial Sequence
  Synthetic oligonucleotide
gccccgcggagcctatcaccgtatcgacacgccgca

SEQ ID NO: 83105 - DNA, 36 bp, Artificial Sequence
  Synthetic oligonucleotide
ggtgaacatgctgaatggggggtgggcgactctgca

SEQ ID NO: 83106 - DNA, 36 bp, Artificial Sequence
  Synthetic oligonucleotide
ttggacacgcttgaactggctgtatccgtttaatca

SEQ ID NO: 83107 - DNA, 35 bp, Artificial Sequence
  Synthetic oligonucleotide
aacactgggtgtgacaagattccgtctcttcatca

SEQ ID NO: 83108 - DNA, 35 bp, Artificial Sequence
  Synthetic oligonucleotide
atacgcagactcaggcccggaaacacccttactca

SEQ ID NO: 83109 - DNA, 36 bp, Artificial Sequence
  Synthetic oligonucleotide
tccagtgctcaggaacactactcggcatccacctca

SEQ ID NO: 83110 - DNA, 36 bp, Artificial Sequence
  Synthetic oligonucleotide
ttatgcgccactatctgcggtccagtatacgtctca

SEQ ID NO: 83111 - DNA, 36 bp, Artificial Sequence
  Synthetic oligonucleotide
tcataccgattagtaggtccattcgcttccacttca

SEQ ID NO: 83112 - DNA, 37 bp, Artificial Sequence
  Synthetic oligonucleotide
gagatggagtgggaataggggccgagtggtagaaaga

SEQ ID NO: 83113 - DNA, 36 bp, Artificial Sequence
  Synthetic oligonucleotide
gttggtacggatatcgctgggtaggggggagcaaga

SEQ ID NO: 83114 - DNA, 36 bp, Artificial Sequence
  Synthetic oligonucleotide
aaggacggggggttggcacaacgaaagaagagaaga

SEQ ID NO: 83115 - DNA, 36 bp, Artificial Sequence
  Synthetic oligonucleotide
tcaccggacgtggccgtacatgaaggcgggaggaga

SEQ ID NO: 83116 - DNA, 37 bp, Artificial Sequence
  Synthetic oligonucleotide
gtcgaacgctgctgcgttgagggaagggcgagggaga

SEQ ID NO: 83117 - DNA, 37 bp, Artificial Sequence
  Synthetic oligonucleotide
ggaatgtgggtacgtagcaaaaagaggcagggataga

SEQ ID NO: 83118 - DNA, 35 bp, Artificial Sequence
  Synthetic oligonucleotide
gacgaaggggcactcctaagaggagactgggtaga

SEQ ID NO: 83119 - DNA, 35 bp, Artificial Sequence
  Synthetic oligonucleotide
atctgcaactgctctcaagcctccctacgccacga

SEQ ID NO: 83120 - DNA, 37 bp, Artificial Sequence
  Synthetic oligonucleotide
gcttaagccggcgcgcaattatattcctattccacga

SEQ ID NO: 83121 - DNA, 37 bp, Artificial Sequence
  Synthetic oligonucleotide
accgcgctcccccctgttatcggacgtttacagacga

SEQ ID NO: 83122 - DNA, 37 bp, Artificial Sequence
  Synthetic oligonucleotide
ggaccagcaagaccgcattcattcatgttccttccga

SEQ ID NO: 83123 - DNA, 37 bp, Artificial Sequence
  Synthetic oligonucleotide
gacccgcctctggaccctgccggtgcgatttacgcga

SEQ ID NO: 83124 - DNA, 37 bp, Artificial Sequence
  Synthetic oligonucleotide
agcctaagcacatgcccacgtggaccgactcccgcga

SEQ ID NO: 83125 - DNA, 37 bp, Artificial Sequence
  Synthetic oligonucleotide
gaaccactgacagacagccttaacggaggaaacagga

SEQ ID NO: 83126 - DNA, 37 bp, Artificial Sequence
  Synthetic oligonucleotide
tcacacgcacagtctgttgagtgccttaatttcagga

SEQ ID NO: 83127 - DNA, 37 bp, Artificial Sequence
  Synthetic oligonucleotide
atcattcggccaaacactatcctctcagcccgccgga

SEQ ID NO: 83128 - DNA, 36 bp, Artificial Sequence
  Synthetic oligonucleotide
gagcaatgaggaggaaagtagttaatggggggcgga

SEQ ID NO: 83129 - DNA, 37 bp, Artificial Sequence
  Synthetic oligonucleotide
gagccagtggaagccggggaggtcgtggcgcggggga

SEQ ID NO: 83130 - DNA, 36 bp, Artificial Sequence
  Synthetic oligonucleotide
gatgagggtggtcatagggccgggcggtagtgggga

SEQ ID NO: 83131 - DNA, 37 bp, Artificial Sequence
  Synthetic oligonucleotide
gagcggggccgggttggcaaggtgattactgtgggga

SEQ ID NO: 83132 - DNA, 36 bp, Artificial Sequence
  Synthetic oligonucleotide
ggaggggggggggaatgggtctcaaggtgggatgga

SEQ ID NO: 83133 - DNA, 37 bp, Artificial Sequence
  Synthetic oligonucleotide
tcccgacttcaagcgtctcgttccctttccgtatgga

SEQ ID NO: 83134 - DNA, 36 bp, Artificial Sequence
  Synthetic oligonucleotide
gcatgacggggtgtcatggcatgatgtagggctgga

SEQ ID NO: 83135 - DNA, 36 bp, Artificial Sequence
  Synthetic oligonucleotide
gatcacggatggtatggggttgaggggaaacgtgga

SEQ ID NO: 83136 - DNA, 37 bp, Artificial Sequence
  Synthetic oligonucleotide
gacgagtagctgtgatgacgatagagtgaggtgtgga

SEQ ID NO: 83137 - DNA, 38 bp, Artificial Sequence
  Synthetic oligonucleotide
tctcccccccacgtctaaaatgctgccgtttgagatga

SEQ ID NO: 83138 - DNA, 38 bp, Artificial Sequence
  Synthetic oligonucleotide
agacgcaatgaggtaatgcagtagcatgtcatcgatga

SEQ ID NO: 83139 - DNA, 38 bp, Artificial Sequence
  Synthetic oligonucleotide
atgcccccgcaacttctcccctctgtccatcttgatga

SEQ ID NO: 83140 - DNA, 38 bp, Artificial Sequence
  Synthetic oligonucleotide
taccccgcatcctggacgccatggcatactgcttatga

SEQ ID NO: 83141 - DNA, 38 bp, Artificial Sequence
  Synthetic oligonucleotide
gagacgctcccatctaattgtgccatccggtatactga

SEQ ID NO: 83142 - DNA, 37 bp, Artificial Sequence
  Synthetic oligonucleotide
ttatcccatccagttgttacgctctaaggtgccctga

SEQ ID NO: 83143 - DNA, 38 bp, Artificial Sequence
  Synthetic oligonucleotide
gactaggggggacgcggtgggggaccactgtaaagtga

SEQ ID NO: 83144 - DNA, 38 bp, Artificial Sequence
  Synthetic oligonucleotide
accgcaccggggacggtgcataaataaccttgtcgtga

SEQ ID NO: 83145 - DNA, 38 bp, Artificial Sequence
  Synthetic oligonucleotide
agacagggtggggacgggcctgtgagagggtcaggtga

SEQ ID NO: 83146 - DNA, 37 bp, Artificial Sequence
  Synthetic oligonucleotide
gacccccacaatcgacagctagcgctccatgcggtga

SEQ ID NO: 83147 - DNA, 37 bp, Artificial Sequence
  Synthetic oligonucleotide
tgaaggacgagggactgttcaggggggtggagggtga

SEQ ID NO: 83148 - DNA, 37 bp, Artificial Sequence
  Synthetic oligonucleotide
gggtggaggcggggcaacctaaagggagggatggtga

SEQ ID NO: 83149 - DNA, 38 bp, Artificial Sequence
  Synthetic oligonucleotide
ttgaaccccagagccccccatatgtcaccgagtggtga

SEQ ID NO: 83150 - DNA, 38 bp, Artificial Sequence
  Synthetic oligonucleotide
tccatgtcccatccgttccgacagacgttctttggtga

SEQ ID NO: 83151 - DNA, 38 bp, Artificial Sequence
  Synthetic oligonucleotide
tcacgccgatcttagatcaagctgtcacctccctgtga

SEQ ID NO: 83152 - DNA, 37 bp, Artificial Sequence
  Synthetic oligonucleotide
attcgcgcccaccttgtctcacatgggcatcttgtga

SEQ ID NO: 83153 - DNA, 37 bp, Artificial Sequence
  Synthetic oligonucleotide
atgccgcacctcttataacatgattgctgctccttga

SEQ ID NO: 83154 - DNA, 36 bp, Artificial Sequence
  Synthetic oligonucleotide
gtgggggtgggctgcacattataccagtctccttga

SEQ ID NO: 83155 - DNA, 37 bp, Artificial Sequence
  Synthetic oligonucleotide
gctgttgggtgaggggaaggtgagaggcggagcttga

SEQ ID NO: 83156 - DNA, 37 bp, Artificial Sequence
  Synthetic oligonucleotide
tcacgtgccaactgggtcactcgctttattatcttga

SEQ ID NO: 83157 - DNA, 38 bp, Artificial Sequence
  Synthetic oligonucleotide
tgacgaggggcagataaggacggatggggcatagttga

SEQ ID NO: 83158 - DNA, 35 bp, Artificial Sequence
  Synthetic oligonucleotide
gactcacgaaacccccaactttgttcccacgttga

SEQ ID NO: 83159 - DNA, 37 bp, Artificial Sequence
  Synthetic oligonucleotide
acatgccccgacacatacttttcccccaagaggttga

SEQ ID NO: 83160 - DNA, 38 bp, Artificial Sequence
  Synthetic oligonucleotide
ttggacgttgccacggttcttgttaccccacttgttga

SEQ ID NO: 83161 - DNA, 38 bp, Artificial Sequence
  Synthetic oligonucleotide
ttgtgcaccgccatcatcttggaacaccacatatttga

SEQ ID NO: 83162 - DNA, 38 bp, Artificial Sequence
  Synthetic oligonucleotide
gcagaggcgaagggttagtgggtggattaagggtttga

SEQ ID NO: 83163 - DNA, 35 bp, Artificial Sequence
  Synthetic oligonucleotide
acccctgtctcagccattcttttactgttctcata

SEQ ID NO: 83164 - DNA, 36 bp, Artificial Sequence
  Synthetic oligonucleotide
tagtacgtgacctcgcgcatctttatacagtttata

SEQ ID NO: 83165 - DNA, 36 bp, Artificial Sequence
  Synthetic oligonucleotide
tgaaacgcaggaggggaagctcgggtcaatctacta

SEQ ID NO: 83166 - DNA, 36 bp, Artificial Sequence
  Synthetic oligonucleotide
tattggggcagacgtcttaatgctcctccacccgta

SEQ ID NO: 83167 - DNA, 36 bp, Artificial Sequence
  Synthetic oligonucleotide
tcactgcgctcattgtctttgttgtgaaccactgta

SEQ ID NO: 83168 - DNA, 36 bp, Artificial Sequence
  Synthetic oligonucleotide
gctcacctcgtgttccctcattgtcatctctttgta

SEQ ID NO: 83169 - DNA, 36 bp, Artificial Sequence
  Synthetic oligonucleotide
tacgaggcacgggggggttcggaacctggggtctta

SEQ ID NO: 83170 - DNA, 35 bp, Artificial Sequence
  Synthetic oligonucleotide
acccagtcgcttcctgtttcgtggttaatccgtta

SEQ ID NO: 83171 - DNA, 36 bp, Artificial Sequence
  Synthetic oligonucleotide
gtgatcatctccgtactgcctaatttgtcctcttta

SEQ ID NO: 83172 - DNA, 35 bp, Artificial Sequence
  Synthetic oligonucleotide
tatcggtcgcacccctgccgtgatctccttgccac

SEQ ID NO: 83173 - DNA, 35 bp, Artificial Sequence
  Synthetic oligonucleotide
gtcgaacgcgccccgctttattttgaccctatcac

SEQ ID NO: 83174 - DNA, 35 bp, Artificial Sequence
  Synthetic oligonucleotide
gggggccctccatcccgggttgaacgcaaaactac

SEQ ID NO: 83175 - DNA, 35 bp, Artificial Sequence
  Synthetic oligonucleotide
agccactaacagttcctctatcactacgagcctac

SEQ ID NO: 83176 - DNA, 35 bp, Artificial Sequence
  Synthetic oligonucleotide
actgcccactcattctgagctcactccacgcgtac

SEQ ID NO: 83177 - DNA, 35 bp, Artificial Sequence
  Synthetic oligonucleotide
gctcgcacgaacttgccgttttattttactggtac

SEQ ID NO: 83178 - DNA, 35 bp, Artificial Sequence
  Synthetic oligonucleotide
tcgcactcctcaatcactcatcattctggaccacc

SEQ ID NO: 83179 - DNA, 35 bp, Artificial Sequence
  Synthetic oligonucleotide
ttgtccaagcaacggtatgcatgatttccctcccc

SEQ ID NO: 83180 - DNA, 35 bp, Artificial Sequence
  Synthetic oligonucleotide
gatccttacccctgtctgcgtgaaacgtttacgcc

SEQ ID NO: 83181 - DNA, 35 bp, Artificial Sequence
  Synthetic oligonucleotide
tcgccctccgcccccaactgttgaagtaatattcc

SEQ ID NO: 83182 - DNA, 35 bp, Artificial Sequence
  Synthetic oligonucleotide
tcttagggccgcctgttaatccgtacaacacttcc

SEQ ID NO: 83183 - DNA, 35 bp, Artificial Sequence
  Synthetic oligonucleotide
aatacggagtggttgggaatggggtcggctctcgc

SEQ ID NO: 83184 - DNA, 35 bp, Artificial Sequence
  Synthetic oligonucleotide
aatccgtgcctaacggaccacaataactagcctgc

SEQ ID NO: 83185 - DNA, 35 bp, Artificial Sequence
  Synthetic oligonucleotide
tgactgtcctaggtttaccgcagcacttaaccatc

SEQ ID NO: 83186 - DNA, 35 bp, Artificial Sequence
  Synthetic oligonucleotide
tacgcgtcgagccgcaggtcgtccgcacaccactc

SEQ ID NO: 83187 - DNA, 35 bp, Artificial Sequence
  Synthetic oligonucleotide
tgctcgcccctgtgcatacaccacaaacgcaggtc

SEQ ID NO: 83188 - DNA, 36 bp, Artificial Sequence
  Synthetic oligonucleotide
gactgaggagggaggggcacggcggaacgggacgag

SEQ ID NO: 83189 - DNA, 35 bp, Artificial Sequence
  Synthetic oligonucleotide
gacttgacccagaacactccgaccagaacccatcg

SEQ ID NO: 83190 - DNA, 35 bp, Artificial Sequence
  Synthetic oligonucleotide
accctcagccgcctcctgtcccgcacccactctcg

SEQ ID NO: 83191 - DNA, 34 bp, Artificial Sequence
  Synthetic oligonucleotide
taaggatggtggcaatccaaagaaagggggaggg

SEQ ID NO: 83192 - DNA, 35 bp, Artificial Sequence
  Synthetic oligonucleotide
tgaccactcgttcccttacctccagggcctgcggg

SEQ ID NO: 83193 - DNA, 35 bp, Artificial Sequence
  Synthetic oligonucleotide
aacagacgcacggaggatcggtgcaggtttaaatg

SEQ ID NO: 83194 - DNA, 34 bp, Artificial Sequence
  Synthetic oligonucleotide
gttgccctgccccatcaacccgcgcgagctggtg

SEQ ID NO: 83195 - DNA, 35 bp, Artificial Sequence
  Synthetic oligonucleotide
gaagatgccagtatgttgtggcgtggatatttgtg

SEQ ID NO: 83196 - DNA, 35 bp, Artificial Sequence
  Synthetic oligonucleotide
actcggcccgccccgggttgctcctctcacacttg

SEQ ID NO: 83197 - DNA, 35 bp, Artificial Sequence
  Synthetic oligonucleotide
acagtggccacgaatcttggcgaaaggaaggcttg

SEQ ID NO: 83198 - DNA, 35 bp, Artificial Sequence
  Synthetic oligonucleotide
acacggaaacggatgccgaacgaacgctccaccat

SEQ ID NO: 83199 - DNA, 35 bp, Artificial Sequence
  Synthetic oligonucleotide
accatcataccgcccactgctagtgttgttgccat

SEQ ID NO: 83200 - DNA, 35 bp, Artificial Sequence
  Synthetic oligonucleotide
agtgcgcatatgtgtgggggggggtctggtttcat

SEQ ID NO: 83201 - DNA, 35 bp, Artificial Sequence
  Synthetic oligonucleotide
gatgtacgcagggggaatgtagtgagtgggccgat

SEQ ID NO: 83202 - DNA, 35 bp, Artificial Sequence
  Synthetic oligonucleotide
agttcgcaatctgtaggtcacccgtctctttctat

SEQ ID NO: 83203 - DNA, 35 bp, Artificial Sequence
  Synthetic oligonucleotide
gacacgccgcggtccatcttaattacgtcctgcct

SEQ ID NO: 83204 - DNA, 35 bp, Artificial Sequence
  Synthetic oligonucleotide
ttgccccgaatttggtccttgtacccacggttcct

SEQ ID NO: 83205 - DNA, 35 bp, Artificial Sequence
  Synthetic oligonucleotide
accgaccaatcccggttgttacatttgcttactct

SEQ ID NO: 83206 - DNA, 35 bp, Artificial Sequence
  Synthetic oligonucleotide
tctccccttcagatcagcaaatgctcctcgggtct

SEQ ID NO: 83207 - DNA, 35 bp, Artificial Sequence
  Synthetic oligonucleotide
ttcgaccatgcgtaacccaccgtcctctatgacgt

SEQ ID NO: 83208 - DNA, 35 bp, Artificial Sequence
  Synthetic oligonucleotide
aaccaggccaattccgcctactgttgtgaaactgt

SEQ ID NO: 83209 - DNA, 35 bp, Artificial Sequence
  Synthetic oligonucleotide
agatacgcggctccttttgtactaacatcgcgtgt

SEQ ID NO: 83210 - DNA, 35 bp, Artificial Sequence
  Synthetic oligonucleotide
acaaggcggaccatgaaatgaattggttgcgactt

SEQ ID NO: 83211 - DNA, 35 bp, Artificial Sequence
  Synthetic oligonucleotide
tatcccgcccccagagtctagcctagccttccctt

SEQ ID NO: 83212 - DNA, 35 bp, Artificial Sequence
  Synthetic oligonucleotide
gttcgatactggttctgttggttattccttccctt

SEQ ID NO: 83213 - DNA, 35 bp, Artificial Sequence
  Synthetic oligonucleotide
agaagccattgagggatggacgagggttagggctt

SEQ ID NO: 83214 - DNA, 35 bp, Artificial Sequence
  Synthetic oligonucleotide
gaccgcgctgacgatcttcaacatttgttcatgtt

SEQ ID NO: 83215 - DNA, 35 bp, Artificial Sequence
  Synthetic oligonucleotide
gtgccactggctgagccccttgataccaccttgtt

SEQ ID NO: 83216 - DNA, 36 bp, Artificial Sequence
  Synthetic oligonucleotide
gtgggtgggtggtcgtgggacggccaatctgagaaa

SEQ ID NO: 83217 - DNA, 35 bp, Artificial Sequence
  Synthetic oligonucleotide
tgaccgaggtaggctttgactgggcggtgaggaaa

SEQ ID NO: 83218 - DNA, 35 bp, Artificial Sequence
  Synthetic oligonucleotide
atccccgactcctagtaccccggtactagcataaa

SEQ ID NO: 83219 - DNA, 36 bp, Artificial Sequence
  Synthetic oligonucleotide
gttgagacgccagttgtctcttgctaacgttttaaa

SEQ ID NO: 83220 - DNA, 36 bp, Artificial Sequence
  Synthetic oligonucleotide
aagtgcacctccgaagccacaataccccaacgggaa

SEQ ID NO: 83221 - DNA, 36 bp, Artificial Sequence
  Synthetic oligonucleotide
ttgtcctaccgcattgtagtccgtcctgccctggaa

SEQ ID NO: 83222 - DNA, 36 bp, Artificial Sequence
  Synthetic oligonucleotide
tgcactctgccctgaaatggatctatcagtgcataa

SEQ ID NO: 83223 - DNA, 35 bp, Artificial Sequence
  Synthetic oligonucleotide
gatcgaagacccgcgtagccctccacacattttaa

SEQ ID NO: 83224 - DNA, 36 bp, Artificial Sequence
  Synthetic oligonucleotide
gacgcctctccgcattaatagccggttacctccaca

SEQ ID NO: 83225 - DNA, 36 bp, Artificial Sequence
  Synthetic oligonucleotide
aatgagcgggcctcctcacacagtcgccttatcaca

SEQ ID NO: 83226 - DNA, 35 bp, Artificial Sequence
  Synthetic oligonucleotide
gacgccaacccactttggttagggacggctaacca

SEQ ID NO: 83227 - DNA, 36 bp, Artificial Sequence
  Synthetic oligonucleotide
gacaggtcatcctgagtcgttgctccaaggtcacca

SEQ ID NO: 83228 - DNA, 36 bp, Artificial Sequence
  Synthetic oligonucleotide
gccaacatccgggtctagcctggacactacctacca

SEQ ID NO: 83229 - DNA, 35 bp, Artificial Sequence
  Synthetic oligonucleotide
accacgatgacgcctatagttactccatttaccca

SEQ ID NO: 83230 - DNA, 35 bp, Artificial Sequence
  Synthetic oligonucleotide
acctcatgtagttggcggcccattccttcatccca

SEQ ID NO: 83231 - DNA, 35 bp, Artificial Sequence
  Synthetic oligonucleotide
ttcaacctacttctgagacagtaacctccttccca

SEQ ID NO: 83232 - DNA, 36 bp, Artificial Sequence
  Synthetic oligonucleotide
gtgacctgtgaggtgggagggaaagtccaggtcgca

SEQ ID NO: 83233 - DNA, 36 bp, Artificial Sequence
  Synthetic oligonucleotide
ggtatccctgccccggttgccagaaagccattatca

SEQ ID NO: 83234 - DNA, 36 bp, Artificial Sequence
  Synthetic oligonucleotide
gatgcacaggtcattttgtcaggctggtcgatctca

SEQ ID NO: 83235 - DNA, 36 bp, Artificial Sequence
  Synthetic oligonucleotide
gggtcccatccgtgcgtaaacgccgctctgttttca

SEQ ID NO: 83236 - DNA, 37 bp, Artificial Sequence
  Synthetic oligonucleotide
ttgccagtagcaaacgagcgtgaggggaggattcaga

SEQ ID NO: 83237 - DNA, 37 bp, Artificial Sequence
  Synthetic oligonucleotide
gcctggagggaggggtgtgagtgcaaccacacagaga

SEQ ID NO: 83238 - DNA, 37 bp, Artificial Sequence
  Synthetic oligonucleotide
gcccacagtctctcacgcagcggtactcctttcgaga

SEQ ID NO: 83239 - DNA, 37 bp, Artificial Sequence
  Synthetic oligonucleotide
gccattgcatatatggcttaatgatctcactcttaga

SEQ ID NO: 83240 - DNA, 37 bp, Artificial Sequence
  Synthetic oligonucleotide
aagggcggtgggtgaatggggcgcgggtgcgaaccga

SEQ ID NO: 83241 - DNA, 37 bp, Artificial Sequence
  Synthetic oligonucleotide
aaccttgagcatgattagtgcccgccgctccccccga

SEQ ID NO: 83242 - DNA, 37 bp, Artificial Sequence
  Synthetic oligonucleotide
agtgagcgccccacgagtgtccataccctttctgcga

SEQ ID NO: 83243 - DNA, 38 bp, Artificial Sequence
  Synthetic oligonucleotide
gcctggagtaaagcggaatagggaacgggtgaactcga

SEQ ID NO: 83244 - DNA, 37 bp, Artificial Sequence
  Synthetic oligonucleotide
gaccatcagttgttatccgcatcctttttcgtctcga

SEQ ID NO: 83245 - DNA, 37 bp, Artificial Sequence
  Synthetic oligonucleotide
atggtcaagacgcaaagggtgatgatccgttcttcga

SEQ ID NO: 83246 - DNA, 35 bp, Artificial Sequence
  Synthetic oligonucleotide
gattaggtaccagggaaggatcgctgaatggagga

SEQ ID NO: 83247 - DNA, 37 bp, Artificial Sequence
  Synthetic oligonucleotide
atgagtggaaacaatgcgaacaatgggacacagggga

SEQ ID NO: 83248 - DNA, 37 bp, Artificial Sequence
  Synthetic oligonucleotide
actatggcacgatatacgagtgtgggggggtggggga

SEQ ID NO: 83249 - DNA, 37 bp, Artificial Sequence
  Synthetic oligonucleotide
gcgggtacgactaatgggggaggcgggaatggatgga

SEQ ID NO: 83250 - DNA, 37 bp, Artificial Sequence
  Synthetic oligonucleotide
gaaaggagcgagcagagcgagggatatgggtccatga

SEQ ID NO: 83251 - DNA, 35 bp, Artificial Sequence
  Synthetic oligonucleotide
acctgcaccgagaacggactttccccatttcatga

SEQ ID NO: 83252 - DNA, 38 bp, Artificial Sequence
  Synthetic oligonucleotide
tctggggccacgatgggttggagtgggattggggatga

SEQ ID NO: 83253 - DNA, 37 bp, Artificial Sequence
  Synthetic oligonucleotide
agcgccgcctcccattaagcccaccccgcttctatga

SEQ ID NO: 83254 - DNA, 37 bp, Artificial Sequence
  Synthetic oligonucleotide
gcataggcgcggggaaaaataggtggtgaatgtatga

SEQ ID NO: 83255 - DNA, 38 bp, Artificial Sequence
  Synthetic oligonucleotide
gacaaaaccagcgcccttttagcctggcccatttatga

SEQ ID NO: 83256 - DNA, 36 bp, Artificial Sequence
  Synthetic oligonucleotide
attagcagccccgcgttccgacactcttctttatga

SEQ ID NO: 83257 - DNA, 38 bp, Artificial Sequence
  Synthetic oligonucleotide
gctggaggggaggtggtatgcggcggggcagacactga

SEQ ID NO: 83258 - DNA, 38 bp, Artificial Sequence
  Synthetic oligonucleotide
aaccaaccttcacgcatgcccgaataagccgttactga

SEQ ID NO: 83259 - DNA, 38 bp, Artificial Sequence
  Synthetic oligonucleotide
tgtggttcgacagaaccataaggttatccactccctga

SEQ ID NO: 83260 - DNA, 38 bp, Artificial Sequence
  Synthetic oligonucleotide
atcgcgacttggtgcatcgcggtactatctaatcctga

SEQ ID NO: 83261 - DNA, 37 bp, Artificial Sequence
  Synthetic oligonucleotide
ttaaagcggtgggggtggagatgatgagggcagctga

SEQ ID NO: 83262 - DNA, 38 bp, Artificial Sequence
  Synthetic oligonucleotide
atcagccggtgggcggggatatgagcaaataatgctga

SEQ ID NO: 83263 - DNA, 37 bp, Artificial Sequence
  Synthetic oligonucleotide
accacgcccggctgccctccaactcaaagggtgctga

SEQ ID NO: 83264 - DNA, 37 bp, Artificial Sequence
  Synthetic oligonucleotide
tcatcaacgcgagcactctattactgcaattctctga

SEQ ID NO: 83265 - DNA, 38 bp, Artificial Sequence
  Synthetic oligonucleotide
atcccgcccatgaacgcattccttcacattattagtga

SEQ ID NO: 83266 - DNA, 37 bp, Artificial Sequence
  Synthetic oligonucleotide
atctggagcagttcgcaccttttgactgcatacgtga

SEQ ID NO: 83267 - DNA, 38 bp, Artificial Sequence
  Synthetic oligonucleotide
gacacaggagaatggaaagctggcgaatagagtcgtga

SEQ ID NO: 83268 - DNA, 38 bp, Artificial Sequence
  Synthetic oligonucleotide
gtgatgcaaggagggtgggtggggtggttccacggtga

SEQ ID NO: 83269 - DNA, 36 bp, Artificial Sequence
  Synthetic oligonucleotide
gacgacgccctccgcatttagattcagaacatgtga

SEQ ID NO: 83270 - DNA, 38 bp, Artificial Sequence
  Synthetic oligonucleotide
atcgtcctccctgcatttgccacccatgaccactgtga

SEQ ID NO: 83271 - DNA, 38 bp, Artificial Sequence
  Synthetic oligonucleotide
gcacacagggggcgagatagcaacgcggggggcattga

SEQ ID NO: 83272 - DNA, 38 bp, Artificial Sequence
  Synthetic oligonucleotide
tcaatcacgcccctctgtccgttatgataggtcattga

SEQ ID NO: 83273 - DNA, 38 bp, Artificial Sequence
  Synthetic oligonucleotide
atccgcgccacatcccctagctggtcaaggttcattga

SEQ ID NO: 83274 - DNA, 38 bp, Artificial Sequence
  Synthetic oligonucleotide
tgatgtaggcagatgacgcgccctcttcttgctcttga

SEQ ID NO: 83275 - DNA, 38 bp, Artificial Sequence
  Synthetic oligonucleotide
gacctcttctacacatttccccgagacactctatttga

SEQ ID NO: 83276 - DNA, 38 bp, Artificial Sequence
  Synthetic oligonucleotide
gccaaggggaaagtggcctgaatgggggcgagttttga

SEQ ID NO: 83277 - DNA, 36 bp, Artificial Sequence
  Synthetic oligonucleotide
gtggtaacaaagtagaaaaggaaggtgcaggacata

SEQ ID NO: 83278 - DNA, 36 bp, Artificial Sequence
  Synthetic oligonucleotide
tgtccccccatactcgaatcttggtgctagttacta

SEQ ID NO: 83279 - DNA, 35 bp, Artificial Sequence
  Synthetic oligonucleotide
aagacacagaatgcggtccatagtacaccttccta

SEQ ID NO: 83280 - DNA, 36 bp, Artificial Sequence
  Synthetic oligonucleotide
gaatccgagtgagggtgtccccgaggaatgaacgta

SEQ ID NO: 83281 - DNA, 35 bp, Artificial Sequence
  Synthetic oligonucleotide
atcctcccctaccctgtggtgtcttactgctcgta

SEQ ID NO: 83282 - DNA, 36 bp, Artificial Sequence
  Synthetic oligonucleotide
ggatacgcaggggagtatgtactgtgcaggaaggta

SEQ ID NO: 83283 - DNA, 36 bp, Artificial Sequence
  Synthetic oligonucleotide
gatcgccctgttcgcctcatacccatcctttcggta

SEQ ID NO: 83284 - DNA, 36 bp, Artificial Sequence
  Synthetic oligonucleotide
aatgacagtgcagtagcgtcgtaggaggtatgggta

SEQ ID NO: 83285 - DNA, 35 bp, Artificial Sequence
  Synthetic oligonucleotide
gccacgaactgccaaactcctctgcgtacaatgta

SEQ ID NO: 83286 - DNA, 36 bp, Artificial Sequence
  Synthetic oligonucleotide
gttgtcacagcgcccccctgtcagggccttcaatta

SEQ ID NO: 83287 - DNA, 35 bp, Artificial Sequence
  Synthetic oligonucleotide
tcttgcgctgacctgctgagctgcgtcctttccac

SEQ ID NO: 83288 - DNA, 35 bp, Artificial Sequence
  Synthetic oligonucleotide
taactcgccctgcttgaatataccacacggggtac

SEQ ID NO: 83289 - DNA, 35 bp, Artificial Sequence
  Synthetic oligonucleotide
gagtcaatgtaagggggaaacgaggaagagcaacc

SEQ ID NO: 83290 - DNA, 35 bp, Artificial Sequence
  Synthetic oligonucleotide
tccacttgcttcgtaacatcgttcatctccagacc

SEQ ID NO: 83291 - DNA, 35 bp, Artificial Sequence
  Synthetic oligonucleotide
aagacagatcacttactgggcccctacacactacc

SEQ ID NO: 83292 - DNA, 35 bp, Artificial Sequence
  Synthetic oligonucleotide
ttgcgtaccagagcgaaccacgaaaaatacacccc

SEQ ID NO: 83293 - DNA, 35 bp, Artificial Sequence
  Synthetic oligonucleotide
gatcagggtcccagttcaaccgagcatcctcgccc

SEQ ID NO: 83294 - DNA, 35 bp, Artificial Sequence
  Synthetic oligonucleotide
actcgcgtcctatcaccgtcgcctcgagcttagcc

SEQ ID NO: 83295 - DNA, 35 bp, Artificial Sequence
  Synthetic oligonucleotide
tgcaaaccctgctcccaacgcccataacttacgcc

SEQ ID NO: 83296 - DNA, 35 bp, Artificial Sequence
  Synthetic oligonucleotide
gcctgccccgagctttatattccaccgtccctgcc

SEQ ID NO: 83297 - DNA, 35 bp, Artificial Sequence
  Synthetic oligonucleotide
gacacctgcccttacacacttatctgactagtgcc

SEQ ID NO: 83298 - DNA, 35 bp, Artificial Sequence
  Synthetic oligonucleotide
gccataccaggtccagcgcgtaatgacacctatcc

SEQ ID NO: 83299 - DNA, 35 bp, Artificial Sequence
  Synthetic oligonucleotide
aagtacaccttagcactcccggcgccaattcccgc

SEQ ID NO: 83300 - DNA, 35 bp, Artificial Sequence
  Synthetic oligonucleotide
atatcgcgagcccacttcttaatccgaggccgtgc

SEQ ID NO: 83301 - DNA, 35 bp, Artificial Sequence
  Synthetic oligonucleotide
aatacgcacatacgccacgaatgaaccgggtactc

SEQ ID NO: 83302 - DNA, 35 bp, Artificial Sequence
  Synthetic oligonucleotide
agttaaccgaccagtcagccacctttgccgtcgtc

SEQ ID NO: 83303 - DNA, 35 bp, Artificial Sequence
  Synthetic oligonucleotide
gttattcgccaacacatccatcgtcactaactgtc

SEQ ID NO: 83304 - DNA, 35 bp, Artificial Sequence
  Synthetic oligonucleotide
taggcaacccacacgtctccggtcctgcacctgtc

SEQ ID NO: 83305 - DNA, 35 bp, Artificial Sequence
  Synthetic oligonucleotide
acctgtgcacttgtcggcttaatacctttgagttc

SEQ ID NO: 83306 - DNA, 35 bp, Artificial Sequence
  Synthetic oligonucleotide
ttagccattcccctgttcaggccgagtcctctcag

SEQ ID NO: 83307 - DNA, 35 bp, Artificial Sequence
  Synthetic oligonucleotide
aaatgagcgatccccccggcattctgtagtacacg

SEQ ID NO: 83308 - DNA, 35 bp, Artificial Sequence
  Synthetic oligonucleotide
gtcgcactcagccggtcaagtatccacagtcaccg

SEQ ID NO: 83309 - DNA, 35 bp, Artificial Sequence
  Synthetic oligonucleotide
aatgttgctccccccttgctattggattgtttccg

SEQ ID NO: 83310 - DNA, 35 bp, Artificial Sequence
  Synthetic oligonucleotide
actggggggaaacaagggcgtggtgagatggggcg

SEQ ID NO: 83311 - DNA, 35 bp, Artificial Sequence
  Synthetic oligonucleotide
tgccccttgccaccttgcaccatatcatggtgtcg

SEQ ID NO: 83312 - DNA, 35 bp, Artificial Sequence
  Synthetic oligonucleotide
catccaccccaggactcacgacaacgagtgtgtcg

SEQ ID NO: 83313 - DNA, 35 bp, Artificial Sequence
  Synthetic oligonucleotide
ttgtcacccgcagccgacctcgctatcacactggg

SEQ ID NO: 83314 - DNA, 35 bp, Artificial Sequence
  Synthetic oligonucleotide
gattgtggaggtcagataagaggtgttgaggtggg

SEQ ID NO: 83315 - DNA, 35 bp, Artificial Sequence
  Synthetic oligonucleotide
atgcgcacaactcgtaccagagcttggtatctctg

SEQ ID NO: 83316 - DNA, 35 bp, Artificial Sequence
  Synthetic oligonucleotide
taccgaagacgaagaggtgggaaggggaacgggtg

SEQ ID NO: 83317 - DNA, 35 bp, Artificial Sequence
  Synthetic oligonucleotide
tgcaccttaaccactatggggaatcactgtttttg

SEQ ID NO: 83318 - DNA, 35 bp, Artificial Sequence
  Synthetic oligonucleotide
aataccaccagacgcaaactttgtgtacagttgat

SEQ ID NO: 83319 - DNA, 35 bp, Artificial Sequence
  Synthetic oligonucleotide
accgatgcgctcctctgtccacattccggtctact

SEQ ID NO: 83320 - DNA, 35 bp, Artificial Sequence
  Synthetic oligonucleotide
attacgcagggactttagtccattgcaatccacct

SEQ ID NO: 83321 - DNA, 35 bp, Artificial Sequence
  Synthetic oligonucleotide
aatccccgtgcatacagttgcgcttgtatgtacct

SEQ ID NO: 83322 - DNA, 35 bp, Artificial Sequence
  Synthetic oligonucleotide
gtgtacgctacgttaatccgtgcgttgttttcgct

SEQ ID NO: 83323 - DNA, 35 bp, Artificial Sequence
  Synthetic oligonucleotide
gatgacgacaggtactttgaaagggacgcaaaggt

SEQ ID NO: 83324 - DNA, 35 bp, Artificial Sequence
  Synthetic oligonucleotide
acaaaaggggcgagcgtgttcggggggacaacggt

SEQ ID NO: 83325 - DNA, 35 bp, Artificial Sequence
  Synthetic oligonucleotide
agccaagcaggtcgtccgggggatagcaggaatgt

SEQ ID NO: 83326 - DNA, 35 bp, Artificial Sequence
  Synthetic oligonucleotide
tgccacctttcgggtttcgccttaccaagttcatt

SEQ ID NO: 83327 - DNA, 35 bp, Artificial Sequence
  Synthetic oligonucleotide
ggtcgcggtccaactgccttatctacagtatgctt

SEQ ID NO: 83328 - DNA, 35 bp, Artificial Sequence
  Synthetic oligonucleotide
gatacggacccttgacggtctaccgagcatacttt

SEQ ID NO: 83329 - DNA, 35 bp, Artificial Sequence
  Synthetic oligonucleotide
actagccaacacctcccggatgaaccagactcttt

SEQ ID NO: 83330 - DNA, 34 bp, Artificial Sequence
  Synthetic oligonucleotide
actcagcccaccctggcatgtcgccttctcccaa

SEQ ID NO: 83331 - DNA, 36 bp, Artificial Sequence
  Synthetic oligonucleotide
ttcgtaccaccgtggttgcgttacaatatccagcaa

SEQ ID NO: 83332 - DNA, 36 bp, Artificial Sequence
  Synthetic oligonucleotide
taagagcaggtaaggaagagggtaggaaacgtgcaa

SEQ ID NO: 83333 - DNA, 36 bp, Artificial Sequence
  Synthetic oligonucleotide
atctggtactgtgccgcttttatgacccgacccgaa

SEQ ID NO: 83334 - DNA, 36 bp, Artificial Sequence
  Synthetic oligonucleotide
tacgtcacagcagttcagtccccggaccgccacaca

SEQ ID NO: 83335 - DNA, 35 bp, Artificial Sequence
  Synthetic oligonucleotide
aatcagcgcgaaaccgaattcaccgaacgcaccca

SEQ ID NO: 83336 - DNA, 35 bp, Artificial Sequence
  Synthetic oligonucleotide
gtgcgtgccatcttcccggtttgagcgcctggcca

SEQ ID NO: 83337 - DNA, 35 bp, Artificial Sequence
  Synthetic oligonucleotide
tctgccggccatatagcttttctagtacttatcca

SEQ ID NO: 83338 - DNA, 36 bp, Artificial Sequence
  Synthetic oligonucleotide
gacctacggccacatgcctcgctattctcggactca

SEQ ID NO: 83339 - DNA, 36 bp, Artificial Sequence
  Synthetic oligonucleotide
tagggaggtcgctatcgttcgaaactgtctggctca

SEQ ID NO: 83340 - DNA, 36 bp, Artificial Sequence
  Synthetic oligonucleotide
accaacggaacagccccctgcattcacgacgagtca

SEQ ID NO: 83341 - DNA, 36 bp, Artificial Sequence
  Synthetic oligonucleotide
tcacaccgtgatggatggtgtgaaattttttggtca

SEQ ID NO: 83342 - DNA, 35 bp, Artificial Sequence
  Synthetic oligonucleotide
aacatggccttgttctatcgccgtcacccgtttca

SEQ ID NO: 83343 - DNA, 37 bp, Artificial Sequence
  Synthetic oligonucleotide
aaccccacggtacagcttggttcgcactttgccaaga

SEQ ID NO: 83344 - DNA, 37 bp, Artificial Sequence
  Synthetic oligonucleotide
gcggtgggggggtggcatgggaacgtcgaagaacaga

SEQ ID NO: 83345 - DNA, 37 bp, Artificial Sequence
  Synthetic oligonucleotide
ttcacctgccagcccgcgaagacaatcgcgcaagaga

SEQ ID NO: 83346 - DNA, 37 bp, Artificial Sequence
  Synthetic oligonucleotide
tggaacagggggggtgaaacaagttgcggcagggaga

SEQ ID NO: 83347 - DNA, 37 bp, Artificial Sequence
  Synthetic oligonucleotide
gttcggtgggagtgggctgctgtaggcaaattttaga

SEQ ID NO: 83348 - DNA, 36 bp, Artificial Sequence
  Synthetic oligonucleotide
ttgcactgtcccgcccctgcaagcctgacgacacga

SEQ ID NO: 83349 - DNA, 37 bp, Artificial Sequence
  Synthetic oligonucleotide
tcgaccttcccccgaatgattacgctacagctatcga

SEQ ID NO: 83350 - DNA, 37 bp, Artificial Sequence
  Synthetic oligonucleotide
gacgactactccatcgtattgttcactgctctgcgga

SEQ ID NO: 83351 - DNA, 37 bp, Artificial Sequence
  Synthetic oligonucleotide
gctacggtccagcaatcggaaacggtggggaaaggga

SEQ ID NO: 83352 - DNA, 37 bp, Artificial Sequence
  Synthetic oligonucleotide
tccgacgtgaaggggctcttatcggagagggagggga

SEQ ID NO: 83353 - DNA, 37 bp, Artificial Sequence
  Synthetic oligonucleotide
tatgcgaggggatagtaagtgatttgctggaggggga

SEQ ID NO: 83354 - DNA, 37 bp, Artificial Sequence
  Synthetic oligonucleotide
agcgcaaggggcaggggctcgggccatggacatggga

SEQ ID NO: 83355 - DNA, 37 bp, Artificial Sequence
  Synthetic oligonucleotide
agcgggtaggagggaggggtaactgcgtcaactggga

SEQ ID NO: 83356 - DNA, 37 bp, Artificial Sequence
  Synthetic oligonucleotide
atacgagcacgggagcaggcggggttgcgaggtggga

SEQ ID NO: 83357 - DNA, 37 bp, Artificial Sequence
  Synthetic oligonucleotide
gcgcacgtgcggcactagggaattggcttcaactgga

SEQ ID NO: 83358 - DNA, 37 bp, Artificial Sequence
  Synthetic oligonucleotide
attaaaccgcagtgagacaaggcgggcgagcactgga

SEQ ID NO: 83359 - DNA, 38 bp, Artificial Sequence
  Synthetic oligonucleotide
atcctgagcccgttgcgcacaaagccatcgactaatga

SEQ ID NO: 83360 - DNA, 38 bp, Artificial Sequence
  Synthetic oligonucleotide
tagtcaaccccgcactcgtcgcacctttacgtccatga

SEQ ID NO: 83361 - DNA, 38 bp, Artificial Sequence
  Synthetic oligonucleotide
gtggcccactcactgagtaatctcctgccatacgatga

SEQ ID NO: 83362 - DNA, 38 bp, Artificial Sequence
  Synthetic oligonucleotide
tcagggggtaggtggagaagtgggtcccggagttatga

SEQ ID NO: 83363 - DNA, 38 bp, Artificial Sequence
  Synthetic oligonucleotide
tcagtactgcatggaacggctgcttgggggaacactga

SEQ ID NO: 83364 - DNA, 38 bp, Artificial Sequence
  Synthetic oligonucleotide
ttccccaaccgcattatagacgcgtactctttcactga

SEQ ID NO: 83365 - DNA, 38 bp, Artificial Sequence
  Synthetic oligonucleotide
acccccccgctcgccatatattacgccccagtgactga

SEQ ID NO: 83366 - DNA, 38 bp, Artificial Sequence
  Synthetic oligonucleotide
gataccccctgttgagtgctccattgttacgaccctga

SEQ ID NO: 83367 - DNA, 38 bp, Artificial Sequence
  Synthetic oligonucleotide
agcacgacgccgtgcgactgagttcccgccccccctga

SEQ ID NO: 83368 - DNA, 38 bp, Artificial Sequence
  Synthetic oligonucleotide
ttagccatactccgccctttcaagtgcacatttcctga

SEQ ID NO: 83369 - DNA, 38 bp, Artificial Sequence
  Synthetic oligonucleotide
tcaacacccccaatgtgtctaggcctctgcatgtctga

SEQ ID NO: 83370 - DNA, 37 bp, Artificial Sequence
  Synthetic oligonucleotide
atggagggggcgggccagggtctgggaggagaagtga

SEQ ID NO: 83371 - DNA, 38 bp, Artificial Sequence
  Synthetic oligonucleotide
gagaccaccactccatcttaagagagcagcccgagtga

SEQ ID NO: 83372 - DNA, 38 bp, Artificial Sequence
  Synthetic oligonucleotide
gcaccccgaaattcgaaataaagccttggccaacgtga

SEQ ID NO: 83373 - DNA, 37 bp, Artificial Sequence
  Synthetic oligonucleotide
taatgctagcccgcctcccattgtagagttaacgtga

SEQ ID NO: 83374 - DNA, 38 bp, Artificial Sequence
  Synthetic oligonucleotide
gtgctaacgcagcttgatatggttcgtttttgccgtga

SEQ ID NO: 83375 - DNA, 35 bp, Artificial Sequence
  Synthetic oligonucleotide
ggagaggtaccgggtcggtaaggtcaggggggtga

SEQ ID NO: 83376 - DNA, 38 bp, Artificial Sequence
  Synthetic oligonucleotide
tagagtaggggcaggtaggagatcggtgaggggggtga

SEQ ID NO: 83377 - DNA, 38 bp, Artificial Sequence
  Synthetic oligonucleotide
accctccccacacatgtagacgatgtgatttgctgtga

SEQ ID NO: 83378 - DNA, 38 bp, Artificial Sequence
  Synthetic oligonucleotide
ataggaacaggggagaaggaggtcgctatcgcgtgtga

SEQ ID NO: 83379 - DNA, 38 bp, Artificial Sequence
  Synthetic oligonucleotide
acgcacggctgccatacccatgctcctgtgggccttga

SEQ ID NO: 83380 - DNA, 38 bp, Artificial Sequence
  Synthetic oligonucleotide
tagccacagtgaggaagggtattagttaggatgtttga

SEQ ID NO: 83381 - DNA, 38 bp, Artificial Sequence
  Synthetic oligonucleotide
gtacatgcctcacgtgtgcgttaaacttccctttttga

SEQ ID NO: 83382 - DNA, 37 bp, Artificial Sequence
  Synthetic oligonucleotide
ttgtgagcccgtcggcgctgcttccttgctttcgata

SEQ ID NO: 83383 - DNA, 36 bp, Artificial Sequence
  Synthetic oligonucleotide
gacaccctgaaggaacggttaatgcctcgctcacta

SEQ ID NO: 83384 - DNA, 35 bp, Artificial Sequence
  Synthetic oligonucleotide
acgcgcacacctcttggctttttaaaacttaccta

SEQ ID NO: 83385 - DNA, 36 bp, Artificial Sequence
  Synthetic oligonucleotide
gccggtctcatcgtggcatgtcttctgttttctcta

SEQ ID NO: 83386 - DNA, 36 bp, Artificial Sequence
  Synthetic oligonucleotide
atgtcgggctcaggcttttttgctggtgttctcgta

SEQ ID NO: 83387 - DNA, 35 bp, Artificial Sequence
  Synthetic oligonucleotide
gttctgtgcctatgtccactgtaccacattgttta

SEQ ID NO: 83388 - DNA, 35 bp, Artificial Sequence
  Synthetic oligonucleotide
acagtgccgcagacgtcgaaccaccggaggaaaac

SEQ ID NO: 83389 - DNA, 35 bp, Artificial Sequence
  Synthetic oligonucleotide
atgattcctccgaccgacctcggcaggccctggac

SEQ ID NO: 83390 - DNA, 35 bp, Artificial Sequence
  Synthetic oligonucleotide
gagagcggaggccgaatgtcacaactaccatctac

SEQ ID NO: 83391 - DNA, 35 bp, Artificial Sequence
  Synthetic oligonucleotide
tcaacaccaactcggacgatagtcgcctgtccccc

SEQ ID NO: 83392 - DNA, 35 bp, Artificial Sequence
  Synthetic oligonucleotide
tcaacaagggcgtatatcaatggtctctgtgcccc

SEQ ID NO: 83393 - DNA, 35 bp, Artificial Sequence
  Synthetic oligonucleotide
atacgccccccggatgcacatcagttggaatcccc

SEQ ID NO: 83394 - DNA, 35 bp, Artificial Sequence
  Synthetic oligonucleotide
tcaccacacgtactaccaacgccgcgctaaacgcc

SEQ ID NO: 83395 - DNA, 35 bp, Artificial Sequence
  Synthetic oligonucleotide
tgctcacctcccataaacgcagccgtagatcggcc

SEQ ID NO: 83396 - DNA, 35 bp, Artificial Sequence
  Synthetic oligonucleotide
tcgccctcatccatttcaaatgttctttacttgcc

SEQ ID NO: 83397 - DNA, 35 bp, Artificial Sequence
  Synthetic oligonucleotide
ttatcctcgtggtatcagattctatctgccttgcc

SEQ ID NO: 83398 - DNA, 35 bp, Artificial Sequence
  Synthetic oligonucleotide
tccctcccgcgtactccgctcggctattttcctcc

SEQ ID NO: 83399 - DNA, 35 bp, Artificial Sequence
  Synthetic oligonucleotide
gtgagagctgtaaagctcgcgtttgtttactgtcc

SEQ ID NO: 83400 - DNA, 35 bp, Artificial Sequence
  Synthetic oligonucleotide
aatcgcgggcgataatgcttgtctccagtaccatc

SEQ ID NO: 83401 - DNA, 35 bp, Artificial Sequence
  Synthetic oligonucleotide
gtcactgccaacgtgcggacgataaacgcctcatc

SEQ ID NO: 83402 - DNA, 35 bp, Artificial Sequence
  Synthetic oligonucleotide
gccacccgccttttgttctttcttactgtaatatc

SEQ ID NO: 83403 - DNA, 35 bp, Artificial Sequence
  Synthetic oligonucleotide
tgtctgccgctgcacgaactccgggttctatcgtc

SEQ ID NO: 83404 - DNA, 35 bp, Artificial Sequence
  Synthetic oligonucleotide
atgtcgctcaccagtacacctgtctgtcttccttc

SEQ ID NO: 83405 - DNA, 35 bp, Artificial Sequence
  Synthetic oligonucleotide
tagtacactcggcgtatattatcatgcgctcgttc

SEQ ID NO: 83406 - DNA, 35 bp, Artificial Sequence
  Synthetic oligonucleotide
taccatgtcttcacgtgtctgctacttcttcccag

SEQ ID NO: 83407 - DNA, 35 bp, Artificial Sequence
  Synthetic oligonucleotide
gtcagcacgcgccgcaggtcccgctcttacgtacg

SEQ ID NO: 83408 - DNA, 35 bp, Artificial Sequence
  Synthetic oligonucleotide
gctcccacatccgccaatggaataacgtatatccg

SEQ ID NO: 83409 - DNA, 35 bp, Artificial Sequence
  Synthetic oligonucleotide
ttagtgcaagctggagggtaggaggggaatgatcg

SEQ ID NO: 83410 - DNA, 35 bp, Artificial Sequence
  Synthetic oligonucleotide
ttgtggagtaggaggcggagtgacaaaggaagagg

SEQ ID NO: 83411 - DNA, 35 bp, Artificial Sequence
  Synthetic oligonucleotide
gagccggggggaatggggtatactactcgtagagg

SEQ ID NO: 83412 - DNA, 35 bp, Artificial Sequence
  Synthetic oligonucleotide
agacaccaaaagcggggaactgatgaaaggcgagg

SEQ ID NO: 83413 - DNA, 35 bp, Artificial Sequence
  Synthetic oligonucleotide
gccacaagtagggggagaagcgtgcgtgaggccgg

SEQ ID NO: 83414 - DNA, 35 bp, Artificial Sequence
  Synthetic oligonucleotide
accccacccctcattgacgacatcgctgaagcggg

SEQ ID NO: 83415 - DNA, 35 bp, Artificial Sequence
  Synthetic oligonucleotide
tctggggaggggagataaagtaatcatgattcggg

SEQ ID NO: 83416 - DNA, 35 bp, Artificial Sequence
  Synthetic oligonucleotide
gcaagcggtagaagatttcggggacgtgtgggggg

SEQ ID NO: 83417 - DNA, 35 bp, Artificial Sequence
  Synthetic oligonucleotide
gatgctcggaccggagtgagggggggtgggctggg

SEQ ID NO: 83418 - DNA, 35 bp, Artificial Sequence
  Synthetic oligonucleotide
tcctagccctcgtctattcttcattttgagtcctg

SEQ ID NO: 83419 - DNA, 35 bp, Artificial Sequence
  Synthetic oligonucleotide
tgatctcataactgtcaactcaccggtcttatctg

SEQ ID NO: 83420 - DNA, 35 bp, Artificial Sequence
  Synthetic oligonucleotide
tgcttcctccatctgtcgtgatctttctgcataat

SEQ ID NO: 83421 - DNA, 35 bp, Artificial Sequence
  Synthetic oligonucleotide
actcgccgttacggatttacctttgtggaccacat

SEQ ID NO: 83422 - DNA, 35 bp, Artificial Sequence
  Synthetic oligonucleotide
aacgcactcttcagtttgcactctttgggtatcat

SEQ ID NO: 83423 - DNA, 35 bp, Artificial Sequence
  Synthetic oligonucleotide
gactgcgcccataaaaactcgcaacccgtaccgat

SEQ ID NO: 83424 - DNA, 35 bp, Artificial Sequence
  Synthetic oligonucleotide
tgtcgactacggtccagtttttattcgctacctat

SEQ ID NO: 83425 - DNA, 35 bp, Artificial Sequence
  Synthetic oligonucleotide
aatacctcgagtgttaacgttacatctgctgtact

SEQ ID NO: 83426 - DNA, 35 bp, Artificial Sequence
  Synthetic oligonucleotide
tggttatcgagcgtccatcccccaccgtttgtcct

SEQ ID NO: 83427 - DNA, 35 bp, Artificial Sequence
  Synthetic oligonucleotide
gacctcgcccttgcgcgcaactagctatatgcgct

SEQ ID NO: 83428 - DNA, 35 bp, Artificial Sequence
  Synthetic oligonucleotide
acttcatccacacaagggggggcacaaacctcgct

SEQ ID NO: 83429 - DNA, 35 bp, Artificial Sequence
  Synthetic oligonucleotide
gcctcgtaaggcctggtgcgccccaattccgttct

SEQ ID NO: 83430 - DNA, 35 bp, Artificial Sequence
  Synthetic oligonucleotide
gtacacagggggatgtaaaagtggggaaggtaagt

SEQ ID NO: 83431 - DNA, 35 bp, Artificial Sequence
  Synthetic oligonucleotide
tccgctacggtcccctggtccaacccgcatactgt

SEQ ID NO: 83432 - DNA, 35 bp, Artificial Sequence
  Synthetic oligonucleotide
tgtgtgcgacttagtcacactgaccttcttacctt

SEQ ID NO: 83433 - DNA, 35 bp, Artificial Sequence
  Synthetic oligonucleotide
aaagtgagaggtgggtagaagggaaggtcattttt

SEQ ID NO: 83434 - DNA, 35 bp, Artificial Sequence
  Synthetic oligonucleotide
tgcggtgtcctggggcgggcaggaggataatgaaa

SEQ ID NO: 83435 - DNA, 36 bp, Artificial Sequence
  Synthetic oligonucleotide
gaagtcgccgccacatttattcaatggcaattgaaa

SEQ ID NO: 83436 - DNA, 36 bp, Artificial Sequence
  Synthetic oligonucleotide
tccaatccacagttgcttatcgcctggtgcgcacaa

SEQ ID NO: 83437 - DNA, 36 bp, Artificial Sequence
  Synthetic oligonucleotide
tctaccaaacggctgacatcattcctttcgttgcaa

SEQ ID NO: 83438 - DNA, 35 bp, Artificial Sequence
  Synthetic oligonucleotide
tgtaaagtcggagctgcccaacactatcttgcgaa

SEQ ID NO: 83439 - DNA, 35 bp, Artificial Sequence
  Synthetic oligonucleotide
gtcgctacacacacaaggccactttatccttctaa

SEQ ID NO: 83440 - DNA, 35 bp, Artificial Sequence
  Synthetic oligonucleotide
acgcccaacaacaccacatggacttagagtcgtaa

SEQ ID NO: 83441 - DNA, 36 bp, Artificial Sequence
  Synthetic oligonucleotide
gatgggtgagagaagatagggtgtcgccgagggtaa

SEQ ID NO: 83442 - DNA, 36 bp, Artificial Sequence
  Synthetic oligonucleotide
gatgcggttcacatgcaccgaaacctgatttgcaca

SEQ ID NO: 83443 - DNA, 36 bp, Artificial Sequence
  Synthetic oligonucleotide
tctgaatcacaacctttgaatccagacgtgggtaca

SEQ ID NO: 83444 - DNA, 36 bp, Artificial Sequence
  Synthetic oligonucleotide
tccgagcccggtcaatgctcagtgcaatctccacca

SEQ ID NO: 83445 - DNA, 36 bp, Artificial Sequence
  Synthetic oligonucleotide
aacgcccgccgggagggcacagggaagggtctccca

SEQ ID NO: 83446 - DNA, 36 bp, Artificial Sequence
  Synthetic oligonucleotide
gccgccactagccgccacgaagactaggccttccca

SEQ ID NO: 83447 - DNA, 35 bp, Artificial Sequence
  Synthetic oligonucleotide
gtagattgattgggggtgggaaggtggggaggcca

SEQ ID NO: 83448 - DNA, 36 bp, Artificial Sequence
  Synthetic oligonucleotide
accacgtacggcagttcttgaaaagccaccatgcca

SEQ ID NO: 83449 - DNA, 35 bp, Artificial Sequence
  Synthetic oligonucleotide
gtactaccgcccagctgaacatttaggagttgcca

SEQ ID NO: 83450 - DNA, 35 bp, Artificial Sequence
  Synthetic oligonucleotide
aatagcaaccatagcatgactattgcacgattcca

SEQ ID NO: 83451 - DNA, 36 bp, Artificial Sequence
  Synthetic oligonucleotide
gtgcaatgcacgagcgtcctagcgatctagccctca

SEQ ID NO: 83452 - DNA, 36 bp, Artificial Sequence
  Synthetic oligonucleotide
ataagccgccgacccgtttctacgctagcatattca

SEQ ID NO: 83453 - DNA, 36 bp, Artificial Sequence
  Synthetic oligonucleotide
gaggggggacagtagcaaatcagcgcgggaggttca

SEQ ID NO: 83454 - DNA, 36 bp, Artificial Sequence
  Synthetic oligonucleotide
ttccagtgccagcttgattttcaccctgtgctttca

SEQ ID NO: 83455 - DNA, 35 bp, Artificial Sequence
  Synthetic oligonucleotide
gaacaccagggatgatttaaatggcagacgtttca

SEQ ID NO: 83456 - DNA, 37 bp, Artificial Sequence
  Synthetic oligonucleotide
gacaaaagcatagaacgagcagttcgaggggacaaga

SEQ ID NO: 83457 - DNA, 37 bp, Artificial Sequence
  Synthetic oligonucleotide
gagaacgtcgcagtaggtggagcggggtttacacaga

SEQ ID NO: 83458 - DNA, 37 bp, Artificial Sequence
  Synthetic oligonucleotide
tgcaccagccgcaggatcgcccgccttcagtcacaga

SEQ ID NO: 83459 - DNA, 37 bp, Artificial Sequence
  Synthetic oligonucleotide
gaagagagctaaaaggaagaggggaggttgatgcaga

SEQ ID NO: 83460 - DNA, 37 bp, Artificial Sequence
  Synthetic oligonucleotide
gcaaatgcccacatcggagagccacctcgttcggaga

SEQ ID NO: 83461 - DNA, 37 bp, Artificial Sequence
  Synthetic oligonucleotide
gaggggggaactgttggagataggtgaggcaatgaga

SEQ ID NO: 83462 - DNA, 37 bp, Artificial Sequence
  Synthetic oligonucleotide
atgcgcacgccagccctttgccgaaaagccgattaga

SEQ ID NO: 83463 - DNA, 35 bp, Artificial Sequence
  Synthetic oligonucleotide
ttgtccctcccgaggtagtaccgaacctttttaga

SEQ ID NO: 83464 - DNA, 37 bp, Artificial Sequence
  Synthetic oligonucleotide
gaccattgcctgccccctggtgattttctcagtacga

SEQ ID NO: 83465 - DNA, 36 bp, Artificial Sequence
  Synthetic oligonucleotide
gacgccgagatgcttgtcctctctgggaacacccga

SEQ ID NO: 83466 - DNA, 36 bp, Artificial Sequence
  Synthetic oligonucleotide
tgccacagtgatgaaatgcatctaaaccttctccga

SEQ ID NO: 83467 - DNA, 37 bp, Artificial Sequence
  Synthetic oligonucleotide
gaaggtgagtgacgcaggactgggagcattatggcga

SEQ ID NO: 83468 - DNA, 37 bp, Artificial Sequence
  Synthetic oligonucleotide
tagaactgtgggagtcggttggagggacgggatgcga

SEQ ID NO: 83469 - DNA, 36 bp, Artificial Sequence
  Synthetic oligonucleotide
agtctcccacccagtacgccagcaataacattgcga

SEQ ID NO: 83470 - DNA, 36 bp, Artificial Sequence
  Synthetic oligonucleotide
tcctccctggatcacagcttatattcacacactcga

SEQ ID NO: 83471 - DNA, 36 bp, Artificial Sequence
  Synthetic oligonucleotide
gccccagcccttcgacgttgtaactctctgtctcga

SEQ ID NO: 83472 - DNA, 37 bp, Artificial Sequence
  Synthetic oligonucleotide
gcacctcgggacgggtcagccatagttccttcttcga

SEQ ID NO: 83473 - DNA, 37 bp, Artificial Sequence
  Synthetic oligonucleotide
tcatgtcgcctatcacctttcgtcttccgcagttcga

SEQ ID NO: 83474 - DNA, 37 bp, Artificial Sequence
  Synthetic oligonucleotide
gccccgttcagcgaccatacacacccaggcatcagga

SEQ ID NO: 83475 - DNA, 37 bp, Artificial Sequence
  Synthetic oligonucleotide
gagttagggtaggtacgtgggagggctcatgagagga

SEQ ID NO: 83476 - DNA, 36 bp, Artificial Sequence
  Synthetic oligonucleotide
gacacggtaccctacgcctgcacaccctacctagga

SEQ ID NO: 83477 - DNA, 37 bp, Artificial Sequence
  Synthetic oligonucleotide
ttaccagccctcgagaatccgcctaccgtccttagga

SEQ ID NO: 83478 - DNA, 36 bp, Artificial Sequence
  Synthetic oligonucleotide
gcccacccgccagtgacctcatcacccttctacgga

SEQ ID NO: 83479 - DNA, 35 bp, Artificial Sequence
  Synthetic oligonucleotide
atactcacctgggtgctttttcgttctcttacgga

SEQ ID NO: 83480 - DNA, 36 bp, Artificial Sequence
  Synthetic oligonucleotide
tgatgccccagcactgctacaccatagtacaccgga

SEQ ID NO: 83481 - DNA, 37 bp, Artificial Sequence
  Synthetic oligonucleotide
tgacgaacagtaattaggggtggaggacaataaggga

SEQ ID NO: 83482 - DNA, 37 bp, Artificial Sequence
  Synthetic oligonucleotide
tcagtcgcactagagtcgataaaggacgtaataggga

SEQ ID NO: 83483 - DNA, 37 bp, Artificial Sequence
  Synthetic oligonucleotide
tgaagctgggccgaatgagagggaaggtacgcgggga

SEQ ID NO: 83484 - DNA, 37 bp, Artificial Sequence
  Synthetic oligonucleotide
aacctgtgggggggtagcaagaagaagacgtggggga

SEQ ID NO: 83485 - DNA, 37 bp, Artificial Sequence
  Synthetic oligonucleotide
acgacggagacatgaccaatactagatcacacatgga

SEQ ID NO: 83486 - DNA, 37 bp, Artificial Sequence
  Synthetic oligonucleotide
gaagccaaaggcgagtgggagaatcggatagcatgga

SEQ ID NO: 83487 - DNA, 38 bp, Artificial Sequence
  Synthetic oligonucleotide
gcccactttgagaaggttcctatagctggtttccatga

SEQ ID NO: 83488 - DNA, 38 bp, Artificial Sequence
  Synthetic oligonucleotide
tccgacggtaggaggattacacgaggtccttctcatga

SEQ ID NO: 83489 - DNA, 38 bp, Artificial Sequence
  Synthetic oligonucleotide
tacgcatgactctgaccccgccacccccttagtgatga

SEQ ID NO: 83490 - DNA, 38 bp, Artificial Sequence
  Synthetic oligonucleotide
tgtagggttcgtgtgcgggtacttggggaaggtgatga

SEQ ID NO: 83491 - DNA, 38 bp, Artificial Sequence
  Synthetic oligonucleotide
gatttgcctaacgtgatgcttgtttacactcttgatga

SEQ ID NO: 83492 - DNA, 38 bp, Artificial Sequence
  Synthetic oligonucleotide
acctgccactagcacacaccttatcgtcattgaactga

SEQ ID NO: 83493 - DNA, 36 bp, Artificial Sequence
  Synthetic oligonucleotide
actcccgagcggaacacgatatgcctgccaccctga

SEQ ID NO: 83494 - DNA, 38 bp, Artificial Sequence
  Synthetic oligonucleotide
gctcctggccctagacgagttttcaccaccgaccctga

SEQ ID NO: 83495 - DNA, 38 bp, Artificial Sequence
  Synthetic oligonucleotide
ggaccttaccttcactgtgcgcgagcatctcatcctga

SEQ ID NO: 83496 - DNA, 38 bp, Artificial Sequence
  Synthetic oligonucleotide
agtctcacacgcgccaagcacgacgccccatatcctga

SEQ ID NO: 83497 - DNA, 38 bp, Artificial Sequence
  Synthetic oligonucleotide
acccccgatacaccagcccgatttcacgacagtcctga

SEQ ID NO: 83498 - DNA, 36 bp, Artificial Sequence
  Synthetic oligonucleotide
tccagcaagtggcctggttgtccttctggttcctga

SEQ ID NO: 83499 - DNA, 38 bp, Artificial Sequence
  Synthetic oligonucleotide
accctgtaacatcatgtgcgatgcacagccccttctga

SEQ ID NO: 83500 - DNA, 37 bp, Artificial Sequence
  Synthetic oligonucleotide
gacccttaccatccgtatacgggactgacccacgtga

SEQ ID NO: 83501 - DNA, 37 bp, Artificial Sequence
  Synthetic oligonucleotide
acctctgccccgattacaaagcccctatacaccgtga

SEQ ID NO: 83502 - DNA, 35 bp, Artificial Sequence
  Synthetic oligonucleotide
agagggccagggaggttaagagagaaaggtcgtga

SEQ ID NO: 83503 - DNA, 38 bp, Artificial Sequence
  Synthetic oligonucleotide
gctgtgaagtggggttgtgggtacggtaacaaaggtga

SEQ ID NO: 83504 - DNA, 38 bp, Artificial Sequence
  Synthetic oligonucleotide
tagagactgcgggcatgcgtgtaagtgcctgtcggtga

SEQ ID NO: 83505 - DNA, 37 bp, Artificial Sequence
  Synthetic oligonucleotide
atgcccccattgtccatatacagtcttaggatggtga

SEQ ID NO: 83506 - DNA, 38 bp, Artificial Sequence
  Synthetic oligonucleotide
tcatgtggtagcagggaaggggaaacagtggttggtga

SEQ ID NO: 83507 - DNA, 37 bp, Artificial Sequence
  Synthetic oligonucleotide
taactactccagccgggtcctcttgccaactaattga

SEQ ID NO: 83508 - DNA, 38 bp, Artificial Sequence
  Synthetic oligonucleotide
tccagtgcacacctatcattacatcattagttcattga

SEQ ID NO: 83509 - DNA, 37 bp, Artificial Sequence
  Synthetic oligonucleotide
tacacaaaccaacatgcgaaaaccatgtcatacttga

SEQ ID NO: 83510 - DNA, 38 bp, Artificial Sequence
  Synthetic oligonucleotide
tgctcccattgcatccacgacttggtttcctcccttga

SEQ ID NO: 83511 - DNA, 38 bp, Artificial Sequence
  Synthetic oligonucleotide
aagtagcacgcaggacctcatcgctttctctctgttga

SEQ ID NO: 83512 - DNA, 37 bp, Artificial Sequence
  Synthetic oligonucleotide
gccaggtgggagatagtgttcacatggtggaatttga

SEQ ID NO: 83513 - DNA, 36 bp, Artificial Sequence
  Synthetic oligonucleotide
tcgagggtgggtaggagtgcggggtacatgatttga

SEQ ID NO: 83514 - DNA, 38 bp, Artificial Sequence
  Synthetic oligonucleotide
gtaacatcccgtgagatccgaacgccgctacactttga

SEQ ID NO: 83515 - DNA, 38 bp, Artificial Sequence
  Synthetic oligonucleotide
tactcccacagcactggcatgaggccaccagactttga

SEQ ID NO: 83516 - DNA, 38 bp, Artificial Sequence
  Synthetic oligonucleotide
gcgatgccccagcgctcatgtctccctgaacgctttga

SEQ ID NO: 83517 - DNA, 36 bp, Artificial Sequence
  Synthetic oligonucleotide
gtgcccgacgtcaaactcataactcgtccgtgaata

SEQ ID NO: 83518 - DNA, 36 bp, Artificial Sequence
  Synthetic oligonucleotide
tcgaacacaccgacggatcttcttacgctcgaacta

SEQ ID NO: 83519 - DNA, 36 bp, Artificial Sequence
  Synthetic oligonucleotide
gtgacccgcctggttccatacggattcactccacta

SEQ ID NO: 83520 - DNA, 36 bp, Artificial Sequence
  Synthetic oligonucleotide
tgaatgggggggtgttacgtaaacactgattggcta

SEQ ID NO: 83521 - DNA, 35 bp, Artificial Sequence
  Synthetic oligonucleotide
gaatgcacaatgagggcattcgcttacttgttcta

SEQ ID NO: 83522 - DNA, 36 bp, Artificial Sequence
  Synthetic oligonucleotide
attcccagcgatccgctcgcaccatcgaacctagta

SEQ ID NO: 83523 - DNA, 36 bp, Artificial Sequence
  Synthetic oligonucleotide
agacttgggctggccctcttaccgtacctgttcgta

SEQ ID NO: 83524 - DNA, 33 bp, Artificial Sequence
  Synthetic oligonucleotide
taccaaagccaccaatcgactcagggtactgta

SEQ ID NO: 83525 - DNA, 36 bp, Artificial Sequence
  Synthetic oligonucleotide
gactgggcagtccagacttttaaaacgccgccatta

SEQ ID NO: 83526 - DNA, 35 bp, Artificial Sequence
  Synthetic oligonucleotide
taggagacgcccgatctctcggttccaaactttta

SEQ ID NO: 83527 - DNA, 35 bp, Artificial Sequence
  Synthetic oligonucleotide
tcctcatgcactggattattgagcgctgcacccac

SEQ ID NO: 83528 - DNA, 35 bp, Artificial Sequence
  Synthetic oligonucleotide
acgtcgactctacctccgcatcttgattgcccgac

SEQ ID NO: 83529 - DNA, 35 bp, Artificial Sequence
  Synthetic oligonucleotide
accgatgtgcgacttttcatcccgagatcccatac

SEQ ID NO: 83530 - DNA, 35 bp, Artificial Sequence
  Synthetic oligonucleotide
taacaggccgcccctcctgatcatcgtcacgctac

SEQ ID NO: 83531 - DNA, 35 bp, Artificial Sequence
  Synthetic oligonucleotide
gtcactgattgccgggcacttgctttttccattac

SEQ ID NO: 83532 - DNA, 35 bp, Artificial Sequence
  Synthetic oligonucleotide
aatctagccacctgttactgacattattgccttac

SEQ ID NO: 83533 - DNA, 35 bp, Artificial Sequence
  Synthetic oligonucleotide
tcaccccgccacttggggccttccagtctttcacc

SEQ ID NO: 83534 - DNA, 35 bp, Artificial Sequence
  Synthetic oligonucleotide
gtgtaggtaggtcacacgaacagaccatactgacc

SEQ ID NO: 83535 - DNA, 35 bp, Artificial Sequence
  Synthetic oligonucleotide
aacacatactgtagtgctatgtgcttacatgtacc

SEQ ID NO: 83536 - DNA, 35 bp, Artificial Sequence
  Synthetic oligonucleotide
gttgatacccaagtctcggtagagcgacctcaccc

SEQ ID NO: 83537 - DNA, 35 bp, Artificial Sequence
  Synthetic oligonucleotide
tcgaaatgtctggcatcggcggaagcacacctccc

SEQ ID NO: 83538 - DNA, 35 bp, Artificial Sequence
  Synthetic oligonucleotide
gacgactcgagccgcagttcgactacatcccctcc

SEQ ID NO: 83539 - DNA, 35 bp, Artificial Sequence
  Synthetic oligonucleotide
agttacgggtacagtacgcgtccgagtctgcctcc

SEQ ID NO: 83540 - DNA, 35 bp, Artificial Sequence
  Synthetic oligonucleotide
actgcatgactgataagtcccggttgctcgttcgc

SEQ ID NO: 83541 - DNA, 35 bp, Artificial Sequence
  Synthetic oligonucleotide
gcacagttcataccatgcttactagctcctgttgc

SEQ ID NO: 83542 - DNA, 35 bp, Artificial Sequence
  Synthetic oligonucleotide
aaagccatcgctcgcaccggaaacgcacatgaatc

SEQ ID NO: 83543 - DNA, 35 bp, Artificial Sequence
  Synthetic oligonucleotide
accgtctacggtcccggagtttgtttgctttcatc

SEQ ID NO: 83544 - DNA, 35 bp, Artificial Sequence
  Synthetic oligonucleotide
tcccgccgccttgtttttttggtccttcgtcactc

SEQ ID NO: 83545 - DNA, 35 bp, Artificial Sequence
  Synthetic oligonucleotide
tctaaagcccttaccatgcgaaattctgggttctc

SEQ ID NO: 83546 - DNA, 35 bp, Artificial Sequence
  Synthetic oligonucleotide
ttcacccctcgttgtatacttcccgagagctagtc

SEQ ID NO: 83547 - DNA, 29 bp, Artificial Sequence
  Synthetic oligonucleotide
tgcctcgcatagatatctccacatctgtc

SEQ ID NO: 83548 - DNA, 35 bp, Artificial Sequence
  Synthetic oligonucleotide
acaccctccgtaatcctatttgtgcttgtcttgtc

SEQ ID NO: 83549 - DNA, 35 bp, Artificial Sequence
  Synthetic oligonucleotide
atcctccgctttatagctcacctacagtgccattc

SEQ ID NO: 83550 - DNA, 35 bp, Artificial Sequence
  Synthetic oligonucleotide
ggtcacgtagaattagccactacttccgcaccttc

SEQ ID NO: 83551 - DNA, 35 bp, Artificial Sequence
  Synthetic oligonucleotide
tccgggacgggccggaaggtacgagttctaaaacg

SEQ ID NO: 83552 - DNA, 35 bp, Artificial Sequence
  Synthetic oligonucleotide
gtactgcacgactggttgccttttttcagtcagcg

SEQ ID NO: 83553 - DNA, 35 bp, Artificial Sequence
  Synthetic oligonucleotide
ggttggtagcgctacgatctgatcttccacttgcg

SEQ ID NO: 83554 - DNA, 35 bp, Artificial Sequence
  Synthetic oligonucleotide
aacgagccaaagtaggaggaacctcaacggagagg

SEQ ID NO: 83555 - DNA, 35 bp, Artificial Sequence
  Synthetic oligonucleotide
tgacgtcacaagcaaaggattcaggaggttttggg

SEQ ID NO: 83556 - DNA, 35 bp, Artificial Sequence
  Synthetic oligonucleotide
tatgtcagacgtgaaactgtaggcttataaggtgg

SEQ ID NO: 83557 - DNA, 35 bp, Artificial Sequence
  Synthetic oligonucleotide
tgagggcccgcacacgtaatacctgttttatttgg

SEQ ID NO: 83558 - DNA, 35 bp, Artificial Sequence
  Synthetic oligonucleotide
ggtagtgaaggggggaaatattggaataataaatg

SEQ ID NO: 83559 - DNA, 35 bp, Artificial Sequence
  Synthetic oligonucleotide
gcatgcccctccgctctaaccaagccgaatcactg

SEQ ID NO: 83560 - DNA, 35 bp, Artificial Sequence
  Synthetic oligonucleotide
aagatggaaaggtgggcattcgacgacatgggctg

SEQ ID NO: 83561 - DNA, 35 bp, Artificial Sequence
  Synthetic oligonucleotide
gctgacaccccgcctcgcctgatgtgtgatcagtg

SEQ ID NO: 83562 - DNA, 35 bp, Artificial Sequence
  Synthetic oligonucleotide
gaagaaagaaaggagaggtagttacgagagtcttg

SEQ ID NO: 83563 - DNA, 35 bp, Artificial Sequence
  Synthetic oligonucleotide
gtgcgccctcgaaggctcattcgattcattttcat

SEQ ID NO: 83564 - DNA, 35 bp, Artificial Sequence
  Synthetic oligonucleotide
ttaccgtcagccgttatctccttcgcttcgttact

SEQ ID NO: 83565 - DNA, 35 bp, Artificial Sequence
  Synthetic oligonucleotide
tagaccgcgcatccttccacgagcaaaatcagcct

SEQ ID NO: 83566 - DNA, 35 bp, Artificial Sequence
  Synthetic oligonucleotide
gcctgcgacttcgccgttcgcctacctgaatcgct

SEQ ID NO: 83567 - DNA, 35 bp, Artificial Sequence
  Synthetic oligonucleotide
tgcacgtggtgaacatggccccctctcgactatct

SEQ ID NO: 83568 - DNA, 35 bp, Artificial Sequence
  Synthetic oligonucleotide
tgatgctggccagaggctccgaaatgttctcctct

SEQ ID NO: 83569 - DNA, 35 bp, Artificial Sequence
  Synthetic oligonucleotide
aaaccatccagctggaggctcgctgagccatctct

SEQ ID NO: 83570 - DNA, 35 bp, Artificial Sequence
  Synthetic oligonucleotide
gcgctcaccctcatcagatacacattagcttttct

SEQ ID NO: 83571 - DNA, 35 bp, Artificial Sequence
  Synthetic oligonucleotide
atgactttaccgtgatctgccgccccccgacgcgt

SEQ ID NO: 83572 - DNA, 35 bp, Artificial Sequence
  Synthetic oligonucleotide
tgcaaagaggggacgagcgtgattggttggagggt

SEQ ID NO: 83573 - DNA, 35 bp, Artificial Sequence
  Synthetic oligonucleotide
aacaaggggagatgtaatgggaatgtgcaggctgt

SEQ ID NO: 83574 - DNA, 35 bp, Artificial Sequence
  Synthetic oligonucleotide
tgactgcccatcggcataccctcctcggtatgtgt

SEQ ID NO: 83575 - DNA, 35 bp, Artificial Sequence
  Synthetic oligonucleotide
tccgttcctcagctgtggtctattaatgtttgtgt

SEQ ID NO: 83576 - DNA, 35 bp, Artificial Sequence
  Synthetic oligonucleotide
acagttggtggtgggtcgtagcgcgggaagcaatt

SEQ ID NO: 83577 - DNA, 35 bp, Artificial Sequence
  Synthetic oligonucleotide
gaccgtgttcggcgtcttgttttccatcatccctt

SEQ ID NO: 83578 - DNA, 35 bp, Artificial Sequence
  Synthetic oligonucleotide
gacgtgtcccagattatctttccgtccggctcctt

SEQ ID NO: 83579 - DNA, 35 bp, Artificial Sequence
  Synthetic oligonucleotide
tgccggaccccgtcttcgccttcaggtaattcctt

SEQ ID NO: 83580 - DNA, 35 bp, Artificial Sequence
  Synthetic oligonucleotide
cggtggtcgccagctatatggatgaatcggatctt

SEQ ID NO: 83581 - DNA, 35 bp, Artificial Sequence
  Synthetic oligonucleotide
gtacctactcacgaccatcacagccggacaccgtt

SEQ ID NO: 83582 - DNA, 35 bp, Artificial Sequence
  Synthetic oligonucleotide
tcaacgctgctatctctgtttgagcttgcatcttt

SEQ ID NO: 83583 - DNA, 36 bp, Artificial Sequence
  Synthetic oligonucleotide
gggtgagaccgaggactgtggaaaaaaacggggaaa

SEQ ID NO: 83584 - DNA, 36 bp, Artificial Sequence
  Synthetic oligonucleotide
ttgaccatctgcgcatcgcgtgctacaaagcaacaa

SEQ ID NO: 83585 - DNA, 36 bp, Artificial Sequence
  Synthetic oligonucleotide
actccacagccgcacctattactacagcgtcccgaa

SEQ ID NO: 83586 - DNA, 35 bp, Artificial Sequence
  Synthetic oligonucleotide
atctgacggaaggagagggcgccagggggacggaa

SEQ ID NO: 83587 - DNA, 36 bp, Artificial Sequence
  Synthetic oligonucleotide
gttgctgtggggccgggtaggagaggggggtgtgaa

SEQ ID NO: 83588 - DNA, 36 bp, Artificial Sequence
  Synthetic oligonucleotide
gaggagggtaggatgggggaaccgcagcacacctaa

SEQ ID NO: 83589 - DNA, 36 bp, Artificial Sequence
  Synthetic oligonucleotide
atactgcgccaacgtagctttctcatttacctaaca

SEQ ID NO: 83590 - DNA, 35 bp, Artificial Sequence
  Synthetic oligonucleotide
actgacacgcgagagccatccccttggtatccaca

SEQ ID NO: 83591 - DNA, 36 bp, Artificial Sequence
  Synthetic oligonucleotide
tgatacgcactgggagcaaatccgaccgacctcaca

SEQ ID NO: 83592 - DNA, 36 bp, Artificial Sequence
  Synthetic oligonucleotide
gtgaacaggcgttcttcttctggggtcttgcctaca

SEQ ID NO: 83593 - DNA, 35 bp, Artificial Sequence
  Synthetic oligonucleotide
gacttgaaagttgcagtatcccccacacaacacca

SEQ ID NO: 83594 - DNA, 36 bp, Artificial Sequence
  Synthetic oligonucleotide
gagccactacgccaacggagtttttgtgtcccacca

SEQ ID NO: 83595 - DNA, 35 bp, Artificial Sequence
  Synthetic oligonucleotide
tacccaaggccgtcctggatttaataccctcgcca

SEQ ID NO: 83596 - DNA, 35 bp, Artificial Sequence
  Synthetic oligonucleotide
atgcacccgagtgggttttgattcctcctgtgcca

SEQ ID NO: 83597 - DNA, 36 bp, Artificial Sequence
  Synthetic oligonucleotide
cccgtgcttgcaacatgaccctaatgcactgctcca

SEQ ID NO: 83598 - DNA, 36 bp, Artificial Sequence
  Synthetic oligonucleotide
tacccacctaatggccctatcagtgtaagttctcca

SEQ ID NO: 83599 - DNA, 36 bp, Artificial Sequence
  Synthetic oligonucleotide
taccccctacgcgactgattacttcgcgcccgatca

SEQ ID NO: 83600 - DNA, 35 bp, Artificial Sequence
  Synthetic oligonucleotide
ttacgccaggcctgcccacattcaatcttatatca

SEQ ID NO: 83601 - DNA, 37 bp, Artificial Sequence
  Synthetic oligonucleotide
acacgtacggtaaaaggggggccgggtaggtgactca

SEQ ID NO: 83602 - DNA, 36 bp, Artificial Sequence
  Synthetic oligonucleotide
tacaacgcaggagacgggggacatggagcaaggtca

SEQ ID NO: 83603 - DNA, 36 bp, Artificial Sequence
  Synthetic oligonucleotide
gtacctccattctctgttcctgccagttttcaaaga

SEQ ID NO: 83604 - DNA, 37 bp, Artificial Sequence
  Synthetic oligonucleotide
aagcaaccgctggggtaatagtaggacgggggaaaga

SEQ ID NO: 83605 - DNA, 37 bp, Artificial Sequence
  Synthetic oligonucleotide
aacgaagggacgggcacaagtgtgaagtgggatcaga

SEQ ID NO: 83606 - DNA, 36 bp, Artificial Sequence
  Synthetic oligonucleotide
accatccatgcgcggaaccgaggtgaccaaccgaga

SEQ ID NO: 83607 - DNA, 37 bp, Artificial Sequence
  Synthetic oligonucleotide
gtggggcaacaagcgagacggagggtgggaggggaga

SEQ ID NO: 83608 - DNA, 37 bp, Artificial Sequence
  Synthetic oligonucleotide
gtacgccaccaatctaaaacagagcacgcctcctaga

SEQ ID NO: 83609 - DNA, 36 bp, Artificial Sequence
  Synthetic oligonucleotide
gcacccttcactctttaccatgcgacgtttccacga

SEQ ID NO: 83610 - DNA, 37 bp, Artificial Sequence
  Synthetic oligonucleotide
ttgagccacatccatgcccttaatatcagtgtcccga

SEQ ID NO: 83611 - DNA, 37 bp, Artificial Sequence
  Synthetic oligonucleotide
atggcaacattcatggccctaacgcacttaccatcga

SEQ ID NO: 83612 - DNA, 37 bp, Artificial Sequence
  Synthetic oligonucleotide
ttgcgcgggatgccgcccgtccgcttatgaatctcga

SEQ ID NO: 83613 - DNA, 37 bp, Artificial Sequence
  Synthetic oligonucleotide
gttacgttcgatcacagcaccttcacccctacgcgga

SEQ ID NO: 83614 - DNA, 36 bp, Artificial Sequence
  Synthetic oligonucleotide
aggtgagggttggtgcacgggaaggcggagcgcgga

SEQ ID NO: 83615 - DNA, 37 bp, Artificial Sequence
  Synthetic oligonucleotide
ttcgacactcgcatctgttctgctctaatttcaggga

SEQ ID NO: 83616 - DNA, 37 bp, Artificial Sequence
  Synthetic oligonucleotide
aaatcatgcctagcattgggggaggggtaaggcggga

SEQ ID NO: 83617 - DNA, 35 bp, Artificial Sequence
  Synthetic oligonucleotide
tagtagattcggagagaggagcgtagtgagtggga

SEQ ID NO: 83618 - DNA, 37 bp, Artificial Sequence
  Synthetic oligonucleotide
gttaccctcctccgattgtcctgtagtgtacgtggga

SEQ ID NO: 83619 - DNA, 36 bp, Artificial Sequence
  Synthetic oligonucleotide
tagtgtgggaaggggtgaaagtgagtctaacaatga

SEQ ID NO: 83620 - DNA, 38 bp, Artificial Sequence
  Synthetic oligonucleotide
tctgcagtagggctgacgggaggggggtggactaatga

SEQ ID NO: 83621 - DNA, 38 bp, Artificial Sequence
  Synthetic oligonucleotide
gactggagggtcgggtaaggggatgtcaaaagtaatga

SEQ ID NO: 83622 - DNA, 38 bp, Artificial Sequence
  Synthetic oligonucleotide
gaccggtagggggcattaaaggaagtgtgtgttaatga

SEQ ID NO: 83623 - DNA, 38 bp, Artificial Sequence
  Synthetic oligonucleotide
gcacgaccatcggtccccaggcagtccacctatcatga

SEQ ID NO: 83624 - DNA, 38 bp, Artificial Sequence
  Synthetic oligonucleotide
aagccagacagggtagggtaaggataaaacgaggatga

SEQ ID NO: 83625 - DNA, 38 bp, Artificial Sequence
  Synthetic oligonucleotide
gatggctccggtgcaggtggtggaagatagagggatga

SEQ ID NO: 83626 - DNA, 37 bp, Artificial Sequence
  Synthetic oligonucleotide
actgagagacggggataaagtaatggtaggcgtatga

SEQ ID NO: 83627 - DNA, 38 bp, Artificial Sequence
  Synthetic oligonucleotide
tcgctaccggcgaacgggctttaaatactgaggtatga

SEQ ID NO: 83628 - DNA, 38 bp, Artificial Sequence
  Synthetic oligonucleotide
acacgttaatgcgcccctcgaactcatcggtgaactga

SEQ ID NO: 83629 - DNA, 38 bp, Artificial Sequence
  Synthetic oligonucleotide
ttagcaccctgccaccatctgtccatacctcgcactga

SEQ ID NO: 83630 - DNA, 38 bp, Artificial Sequence
  Synthetic oligonucleotide
gtcgacggacgcaaaacggggcgaggggattgtcctga

SEQ ID NO: 83631 - DNA, 38 bp, Artificial Sequence
  Synthetic oligonucleotide
acgcgaggtgagtactggtaggtggtaatatgcgctga

SEQ ID NO: 83632 - DNA, 38 bp, Artificial Sequence
  Synthetic oligonucleotide
ttgcgcccttactcatgttcctgtcccatttaatctga

SEQ ID NO: 83633 - DNA, 38 bp, Artificial Sequence
  Synthetic oligonucleotide
gctccgtcgtccctcgcctagatcatagctccatctga

SEQ ID NO: 83634 - DNA, 38 bp, Artificial Sequence
  Synthetic oligonucleotide
gatgccctccgttttccactactttcagtctaaagtga

SEQ ID NO: 83635 - DNA, 38 bp, Artificial Sequence
  Synthetic oligonucleotide
ggtgcccaacagctctatagcttcgaaccgacccgtga

SEQ ID NO: 83636 - DNA, 35 bp, Artificial Sequence
  Synthetic oligonucleotide
gagagggtccgaaacgggttagcaatagtaggtga

SEQ ID NO: 83637 - DNA, 37 bp, Artificial Sequence
  Synthetic oligonucleotide
tactcatctcacctgttttgatcaactctcatggtga

SEQ ID NO: 83638 - DNA, 38 bp, Artificial Sequence
  Synthetic oligonucleotide
agacaactcatgggatggggcgggcatgggggtggtga

SEQ ID NO: 83639 - DNA, 37 bp, Artificial Sequence
  Synthetic oligonucleotide
gacgacgacctgactatgaatcatgtctgacatgtga

SEQ ID NO: 83640 - DNA, 38 bp, Artificial Sequence
  Synthetic oligonucleotide
gtggggcaatgggtttatgggaatggcggtgtgtgtga

SEQ ID NO: 83641 - DNA, 38 bp, Artificial Sequence
  Synthetic oligonucleotide
atgtagccgcccaaagtcacctggcagttccctattga

SEQ ID NO: 83642 - DNA, 37 bp, Artificial Sequence
  Synthetic oligonucleotide
acccacacacgtgagatggattaaatgtatgacttga

SEQ ID NO: 83643 - DNA, 38 bp, Artificial Sequence
  Synthetic oligonucleotide
agactatcgcagatttcgcccgttgcccctctgcttga

SEQ ID NO: 83644 - DNA, 38 bp, Artificial Sequence
  Synthetic oligonucleotide
agagcacgaggcggtgggacgggagcatggtgtcttga

SEQ ID NO: 83645 - DNA, 38 bp, Artificial Sequence
  Synthetic oligonucleotide
tccgaaggtgacctggctgtttctcttgtacctgttga

SEQ ID NO: 83646 - DNA, 37 bp, Artificial Sequence
  Synthetic oligonucleotide
gtccacgtagtttgacgaagggtgggtagattgttga

SEQ ID NO: 83647 - DNA, 36 bp, Artificial Sequence
  Synthetic oligonucleotide
aatcacactaggtagtcgggaaagggggcaatttga

SEQ ID NO: 83648 - DNA, 36 bp, Artificial Sequence
  Synthetic oligonucleotide
acctgagcaactcttattcgatcatacgcacacata

SEQ ID NO: 83649 - DNA, 35 bp, Artificial Sequence
  Synthetic oligonucleotide
tcatcacccatgcgattgtagcacccgttctcata

SEQ ID NO: 83650 - DNA, 36 bp, Artificial Sequence
  Synthetic oligonucleotide
taacccaccacccgttctatgcctctaagttatata

SEQ ID NO: 83651 - DNA, 36 bp, Artificial Sequence
  Synthetic oligonucleotide
gacgaacgctatctagttaacttaacctctacccta

SEQ ID NO: 83652 - DNA, 35 bp, Artificial Sequence
  Synthetic oligonucleotide
attgcccagctgagtcgatccatgcctttaggcta

SEQ ID NO: 83653 - DNA, 35 bp, Artificial Sequence
  Synthetic oligonucleotide
acatccttgcccccggcttatggctccgctctcta

SEQ ID NO: 83654 - DNA, 36 bp, Artificial Sequence
  Synthetic oligonucleotide
gattgaggtggggggaaataaacgggaggaaaagta

SEQ ID NO: 83655 - DNA, 35 bp, Artificial Sequence
  Synthetic oligonucleotide
actgtgaggtgggtgggaggtgccagtgcctagta

SEQ ID NO: 83656 - DNA, 35 bp, Artificial Sequence
  Synthetic oligonucleotide
taaacccgcctggtgcacctcgctgatttcccgta

SEQ ID NO: 83657 - DNA, 35 bp, Artificial Sequence
  Synthetic oligonucleotide
accgggtcagacacgacggttggggatgggtggta

SEQ ID NO: 83658 - DNA, 35 bp, Artificial Sequence
  Synthetic oligonucleotide
gaagcggacgcggtctgggaaacaagctgcatgta

SEQ ID NO: 83659 - DNA, 36 bp, Artificial Sequence
  Synthetic oligonucleotide
ctggtgaccggaaaaattgtcaacgccgtgccctta

SEQ ID NO: 83660 - DNA, 36 bp, Artificial Sequence
  Synthetic oligonucleotide
acatgatgccccaattagccggggttccgcccgtta

SEQ ID NO: 83661 - DNA, 35 bp, Artificial Sequence
  Synthetic oligonucleotide
aacgccaatggttgacccttccgcccggttccgac

SEQ ID NO: 83662 - DNA, 35 bp, Artificial Sequence
  Synthetic oligonucleotide
tgcccgtaacgggtttctccgctggcctaacgtac

SEQ ID NO: 83663 - DNA, 35 bp, Artificial Sequence
  Synthetic oligonucleotide
gacgaccatagatggaggaaaactgattctcgtac

SEQ ID NO: 83664 - DNA, 35 bp, Artificial Sequence
  Synthetic oligonucleotide
actgtccgaccaacattcagccggcctggggtacc

SEQ ID NO: 83665 - DNA, 35 bp, Artificial Sequence
  Synthetic oligonucleotide
gtactcccacccggagctgagggctggatcacccc

SEQ ID NO: 83666 - DNA, 35 bp, Artificial Sequence
  Synthetic oligonucleotide
ggaatcgcgaccagcgtgcccaaacaatcccgccc

SEQ ID NO: 83667 - DNA, 35 bp, Artificial Sequence
  Synthetic oligonucleotide
aagcactacccgccggctacaatccgacattgccc

SEQ ID NO: 83668 - DNA, 35 bp, Artificial Sequence
  Synthetic oligonucleotide
agcttgtgcccggcatttgttcgcgccctggtccc

SEQ ID NO: 83669 - DNA, 35 bp, Artificial Sequence
  Synthetic oligonucleotide
ttgagccgtgtctcatctctattctttgccctgcc

SEQ ID NO: 83670 - DNA, 35 bp, Artificial Sequence
  Synthetic oligonucleotide
atgcttgcactctactcgggcaaaatctgcattcc

SEQ ID NO: 83671 - DNA, 35 bp, Artificial Sequence
  Synthetic oligonucleotide
tcgccctccgccaccaactgttgacgtaatattcc

SEQ ID NO: 83672 - DNA, 35 bp, Artificial Sequence
  Synthetic oligonucleotide
gtgtccacgagctgcccgaacacaccctataaggc

SEQ ID NO: 83673 - DNA, 35 bp, Artificial Sequence
  Synthetic oligonucleotide
gttaccgcaggcatagtggcattgcggtgccaatc

SEQ ID NO: 83674 - DNA, 36 bp, Artificial Sequence
  Synthetic oligonucleotide
ttgggccccagcttacttgtagtcgttcctcctatc

SEQ ID NO: 83675 - DNA, 35 bp, Artificial Sequence
  Synthetic oligonucleotide
gcgtgtgtcgaaagctcgtgctatttccttctgtc

SEQ ID NO: 83676 - DNA, 35 bp, Artificial Sequence
  Synthetic oligonucleotide
acacccgcccaagtcgtcccggtgtgtgggttgtc

SEQ ID NO: 83677 - DNA, 35 bp, Artificial Sequence
  Synthetic oligonucleotide
tcgtgcttgcactgtctcttaagcccatattgttc

SEQ ID NO: 83678 - DNA, 35 bp, Artificial Sequence
  Synthetic oligonucleotide
aatacgatgttggaagggagggtccgggggggaag

SEQ ID NO: 83679 - DNA, 35 bp, Artificial Sequence
  Synthetic oligonucleotide
actgagactgctccgtgttccatcctccgtgttag

SEQ ID NO: 83680 - DNA, 35 bp, Artificial Sequence
  Synthetic oligonucleotide
atggacgagttgtaatgggaatgtggtcactaacg

SEQ ID NO: 83681 - DNA, 35 bp, Artificial Sequence
  Synthetic oligonucleotide
ttggtgtgtcactgctacctccttacatcactacg

SEQ ID NO: 83682 - DNA, 36 bp, Artificial Sequence
  Synthetic oligonucleotide
tcagggtggggacaatgaccttgggagatggattcg

SEQ ID NO: 83683 - DNA, 35 bp, Artificial Sequence
  Synthetic oligonucleotide
gagagtgcaattaaattggagaaggatggttgagg

SEQ ID NO: 83684 - DNA, 35 bp, Artificial Sequence
  Synthetic oligonucleotide
gtgatcgccggatggaggttaaccgaatacgtagg

SEQ ID NO: 83685 - DNA, 35 bp, Artificial Sequence
  Synthetic oligonucleotide
gtgtccgtctgccctccaatactcctcagtgacgg

SEQ ID NO: 83686 - DNA, 35 bp, Artificial Sequence
  Synthetic oligonucleotide
gtgtgctaggggacgaaggagttaggttgagttgg

SEQ ID NO: 83687 - DNA, 35 bp, Artificial Sequence
  Synthetic oligonucleotide
ggttcaccgctcatgctccgaatcctgttgaccat

SEQ ID NO: 83688 - DNA, 35 bp, Artificial Sequence
  Synthetic oligonucleotide
cctcaccgccgtacctcattgtcattctacgccat

SEQ ID NO: 83689 - DNA, 35 bp, Artificial Sequence
  Synthetic oligonucleotide
accctacattagttgggattattacctggatccat

SEQ ID NO: 83690 - DNA, 35 bp, Artificial Sequence
  Synthetic oligonucleotide
gcacccgtagggggggctcaattctactgcaatat

SEQ ID NO: 83691 - DNA, 35 bp, Artificial Sequence
  Synthetic oligonucleotide
gccaaatcgcgatcaaacaagggaaatggaaaact

SEQ ID NO: 83692 - DNA, 36 bp, Artificial Sequence
  Synthetic oligonucleotide
tccttcactgcctctcaccttatataagagagcact

SEQ ID NO: 83693 - DNA, 35 bp, Artificial Sequence
  Synthetic oligonucleotide
tagcgacgcgctctggtctccacttacaccaccct

SEQ ID NO: 83694 - DNA, 35 bp, Artificial Sequence
  Synthetic oligonucleotide
gtcgcacacggtgaagacaaattacacgtttatct

SEQ ID NO: 83695 - DNA, 35 bp, Artificial Sequence
  Synthetic oligonucleotide
tacacgtggtacctgctaaggtgacacagttctct

SEQ ID NO: 83696 - DNA, 35 bp, Artificial Sequence
  Synthetic oligonucleotide
agtggggcgggaaaacgggttctaaatgcaaaagt

SEQ ID NO: 83697 - DNA, 35 bp, Artificial Sequence
  Synthetic oligonucleotide
aaagggatacgtacgaactggatggagtggggagt

SEQ ID NO: 83698 - DNA, 35 bp, Artificial Sequence
  Synthetic oligonucleotide
acttcaccacgcattatactatatgtgactctcgt

SEQ ID NO: 83699 - DNA, 35 bp, Artificial Sequence
  Synthetic oligonucleotide
gcccacacgacccggcggattgtcccatcccaggt

SEQ ID NO: 83700 - DNA, 35 bp, Artificial Sequence
  Synthetic oligonucleotide
ttcccccgtacatctcgcggcctcttttcggaggt

SEQ ID NO: 83701 - DNA, 35 bp, Artificial Sequence
  Synthetic oligonucleotide
gaagggtgaggggatacgaactcgaaaagaagggt

SEQ ID NO: 83702 - DNA, 35 bp, Artificial Sequence
  Synthetic oligonucleotide
tcacctgtgtcaatgccgtggtttttcttgcgtgt

SEQ ID NO: 83703 - DNA, 35 bp, Artificial Sequence
  Synthetic oligonucleotide
gatctccgtgttgctgcatctaccccttgcgcctt

SEQ ID NO: 83704 - DNA, 35 bp, Artificial Sequence
  Synthetic oligonucleotide
gacactcagaaggctgatatgcccaactaaatctt

SEQ ID NO: 83705 - DNA, 35 bp, Artificial Sequence
  Synthetic oligonucleotide
tacgcgggggcaccaccttatacgacctgcatgtt

SEQ ID NO: 83706 - DNA, 35 bp, Artificial Sequence
  Synthetic oligonucleotide
ggataggggcgtcgagcctcgtacactcaaccttt

SEQ ID NO: 83707 - DNA, 35 bp, Artificial Sequence
  Synthetic oligonucleotide
acagctcctgcccgtaagattcttcgtctctgttt

SEQ ID NO: 83708 - DNA, 35 bp, Artificial Sequence
  Synthetic oligonucleotide
gttgggcccagacgtacctgaggtctggtttgttt

SEQ ID NO: 83709 - DNA, 35 bp, Artificial Sequence
  Synthetic oligonucleotide
gaagtgaaagctgctgggtaggagcaagggaaaaa

SEQ ID NO: 83710 - DNA, 36 bp, Artificial Sequence
  Synthetic oligonucleotide
tagccccgggccataccgcgctgatccttcgccgaa

SEQ ID NO: 83711 - DNA, 35 bp, Artificial Sequence
  Synthetic oligonucleotide
gacgggaagagaaaaatgagagggacaagatcgaa

SEQ ID NO: 83712 - DNA, 36 bp, Artificial Sequence
  Synthetic oligonucleotide
aggattgaggacacaagtggtcaggggataggggaa

SEQ ID NO: 83713 - DNA, 36 bp, Artificial Sequence
  Synthetic oligonucleotide
aatgcacccctacacatgctctcaagcgcgccataa

SEQ ID NO: 83714 - DNA, 36 bp, Artificial Sequence
  Synthetic oligonucleotide
agtggcccatttgctctatattgcccctaagcttaa

SEQ ID NO: 83715 - DNA, 36 bp, Artificial Sequence
  Synthetic oligonucleotide
aacatgtggacgctcctgacatcgtatgccctaaca

SEQ ID NO: 83716 - DNA, 35 bp, Artificial Sequence
  Synthetic oligonucleotide
tagtgtccgagagtttccattcagcccctttcaca

SEQ ID NO: 83717 - DNA, 36 bp, Artificial Sequence
  Synthetic oligonucleotide
gctcgggtagggggaaggagtggatctagccagaca

SEQ ID NO: 83718 - DNA, 36 bp, Artificial Sequence
  Synthetic oligonucleotide
tccccatggtgtaactatagcagccaatgcgctaca

SEQ ID NO: 83719 - DNA, 36 bp, Artificial Sequence
  Synthetic oligonucleotide
tccctcgcgacaccagagtctcttctcgttatccca

SEQ ID NO: 83720 - DNA, 37 bp, Artificial Sequence
  Synthetic oligonucleotide
ttgtcatccagctttaaacgtccgtgttgcttcgcca

SEQ ID NO: 83721 - DNA, 36 bp, Artificial Sequence
  Synthetic oligonucleotide
acatggtggtacggagcagggataggggtaatggca

SEQ ID NO: 83722 - DNA, 36 bp, Artificial Sequence
  Synthetic oligonucleotide
taccaccattgtttgttatatccctcgctacgtgca

SEQ ID NO: 83723 - DNA, 35 bp, Artificial Sequence
  Synthetic oligonucleotide
ttgtaacgctgcccgattcgttttatctcattgca

SEQ ID NO: 83724 - DNA, 35 bp, Artificial Sequence
  Synthetic oligonucleotide
aagcccacctgcccccttcagagatctgatgatca

SEQ ID NO: 83725 - DNA, 36 bp, Artificial Sequence
  Synthetic oligonucleotide
tcacatcgcttcacagtgtagcgccaagtagcctca

SEQ ID NO: 83726 - DNA, 36 bp, Artificial Sequence
  Synthetic oligonucleotide
gcactccggttcgtacgatacggtttttcctgctca

SEQ ID NO: 83727 - DNA, 36 bp, Artificial Sequence
  Synthetic oligonucleotide
tgtggcgcctacactatcccaccagcccagtgctca

SEQ ID NO: 83728 - DNA, 35 bp, Artificial Sequence
  Synthetic oligonucleotide
tattcctctcaccgtacacggtatgtcttcattca

SEQ ID NO: 83729 - DNA, 36 bp, Artificial Sequence
  Synthetic oligonucleotide
tcctcaattctcacatgcatggccgtacgcacttca

SEQ ID NO: 83730 - DNA, 37 bp, Artificial Sequence
  Synthetic oligonucleotide
gaccgggagggcactgtactgccgtatgggaataaga

SEQ ID NO: 83731 - DNA, 37 bp, Artificial Sequence
  Synthetic oligonucleotide
aacatcatctaccgcacatatggcctctcacaggaga

SEQ ID NO: 83732 - DNA, 37 bp, Artificial Sequence
  Synthetic oligonucleotide
aacaagggggtgacggaagtaagcgagtcgacggaga

SEQ ID NO: 83733 - DNA, 37 bp, Artificial Sequence
  Synthetic oligonucleotide
gacaaaggagtaggagcccgaagggagtagagtgaga

SEQ ID NO: 83734 - DNA, 37 bp, Artificial Sequence
  Synthetic oligonucleotide
agagtgacagacacgcatgcacgttctctcttgacga

SEQ ID NO: 83735 - DNA, 37 bp, Artificial Sequence
  Synthetic oligonucleotide
gagtactcccgctcgttggcatttactgtcccaccga

SEQ ID NO: 83736 - DNA, 37 bp, Artificial Sequence
  Synthetic oligonucleotide
tcgtccctccaaccaggataccgtgccagtttgccga

SEQ ID NO: 83737 - DNA, 37 bp, Artificial Sequence
  Synthetic oligonucleotide
gtgtaaggtggatagggtgtggatggccggtccgcga

SEQ ID NO: 83738 - DNA, 36 bp, Artificial Sequence
  Synthetic oligonucleotide
acaccggagttcccgtgcgtaatgcaactatcgcga

SEQ ID NO: 83739 - DNA, 35 bp, Artificial Sequence
  Synthetic oligonucleotide
aaactagagggtgtgaggtaaggcaaggacgagga

SEQ ID NO: 83740 - DNA, 37 bp, Artificial Sequence
  Synthetic oligonucleotide
gcgagtaacatgatatatggggggtagcacgggagga

SEQ ID NO: 83741 - DNA, 37 bp, Artificial Sequence
  Synthetic oligonucleotide
tcgaacgtgtaagggagggagagaagtgaggatagga

SEQ ID NO: 83742 - DNA, 37 bp, Artificial Sequence
  Synthetic oligonucleotide
actgttgggcgggcgggaggctagagggtctaccgga

SEQ ID NO: 83743 - DNA, 36 bp, Artificial Sequence
  Synthetic oligonucleotide
gtgttgttcaaacgcagggggggcggggcaacggga

SEQ ID NO: 83744 - DNA, 37 bp, Artificial Sequence
  Synthetic oligonucleotide
atgggtggaggtaggtggcgggtattataactgggga

SEQ ID NO: 83745 - DNA, 37 bp, Artificial Sequence
  Synthetic oligonucleotide
gcatgcgagagaaagaggaatcggggaacttttggga

SEQ ID NO: 83746 - DNA, 36 bp, Artificial Sequence
  Synthetic oligonucleotide
gatcattctgcctccgtacaccgggccactcatgga

SEQ ID NO: 83747 - DNA, 27 bp, Artificial Sequence
  Synthetic oligonucleotide
atggggccaagtaaccgctgcactgga

SEQ ID NO: 83748 - DNA, 37 bp, Artificial Sequence
  Synthetic oligonucleotide
tccgacatggcctggaacattccctcatgctattgga

SEQ ID NO: 83749 - DNA, 37 bp, Artificial Sequence
  Synthetic oligonucleotide
gaaggtggaggggttcgcgcgaaactggtctcaatga

SEQ ID NO: 83750 - DNA, 38 bp, Artificial Sequence
  Synthetic oligonucleotide
aacgaaacggtagtgcattataagtcttttttcaatga

SEQ ID NO: 83751 - DNA, 38 bp, Artificial Sequence
  Synthetic oligonucleotide
aacggacggataacaagaggggtgtggtgcggacatga

SEQ ID NO: 83752 - DNA, 38 bp, Artificial Sequence
  Synthetic oligonucleotide
tacgcgagcagaaggcgggtgacgtttacatcggatga

SEQ ID NO: 83753 - DNA, 38 bp, Artificial Sequence
  Synthetic oligonucleotide
acgcgaggggtgggcggtgagagattttatgtggatga

SEQ ID NO: 83754 - DNA, 37 bp, Artificial Sequence
  Synthetic oligonucleotide
gcgactacgcctacgctactccttcagtggtacctga

SEQ ID NO: 83755 - DNA, 38 bp, Artificial Sequence
  Synthetic oligonucleotide
aagcacacgccgtcaccccgagcagtgtgttcccctga

SEQ ID NO: 83756 - DNA, 38 bp, Artificial Sequence
  Synthetic oligonucleotide
gtccgacatgccccacaactattgactcctagccctga

SEQ ID NO: 83757 - DNA, 38 bp, Artificial Sequence
  Synthetic oligonucleotide
agccaccctctgttaattgatgcctactgcttggctga

SEQ ID NO: 83758 - DNA, 38 bp, Artificial Sequence
  Synthetic oligonucleotide
tacgtcaacctcgcgaccgcttcctacctacttgctga

SEQ ID NO: 83759 - DNA, 38 bp, Artificial Sequence
  Synthetic oligonucleotide
tttgccctcgtccaatgcccctcctgcatcacatctga

SEQ ID NO: 83760 - DNA, 38 bp, Artificial Sequence
  Synthetic oligonucleotide
atgtgcatcgcatagttcgttctttttgttcgctctga

SEQ ID NO: 83761 - DNA, 38 bp, Artificial Sequence
  Synthetic oligonucleotide
gcctgcgcaaaatcccaaccctgatcactggtctctga

SEQ ID NO: 83762 - DNA, 38 bp, Artificial Sequence
  Synthetic oligonucleotide
ggacacgtgtcaggtttttcgtgggtggtgggtagtga

SEQ ID NO: 83763 - DNA, 37 bp, Artificial Sequence
  Synthetic oligonucleotide
tgatggtcagacccttcgcctacaattatattcgtga

SEQ ID NO: 83764 - DNA, 38 bp, Artificial Sequence
  Synthetic oligonucleotide
actcaccctgtattttgaataagctccctcgttcgtga

SEQ ID NO: 83765 - DNA, 38 bp, Artificial Sequence
  Synthetic oligonucleotide
tcagtgagggtgttaagttagattcgggggtggggtga

SEQ ID NO: 83766 - DNA, 38 bp, Artificial Sequence
  Synthetic oligonucleotide
atgcgctcgattttagctctgttacacacacccattga

SEQ ID NO: 83767 - DNA, 37 bp, Artificial Sequence
  Synthetic oligonucleotide
tgtttcgaacgccactcctgctgaccaccacagttga

SEQ ID NO: 83768 - DNA, 38 bp, Artificial Sequence
  Synthetic oligonucleotide
gaaacgagccgtcgaggaaatgttggagggtatgttga

SEQ ID NO: 83769 - DNA, 38 bp, Artificial Sequence
  Synthetic oligonucleotide
acgtcgcacattcttccgccacacgtcttcttatttga

SEQ ID NO: 83770 - DNA, 37 bp, Artificial Sequence
  Synthetic oligonucleotide
ggaactggctgtgtgcccctgctgcccgtgcctttga

SEQ ID NO: 83771 - DNA, 38 bp, Artificial Sequence
  Synthetic oligonucleotide
gctgctaccacacacgcaatatagaccacaccttttga

SEQ ID NO: 83772 - DNA, 36 bp, Artificial Sequence
  Synthetic oligonucleotide
acctgtgccgttgtcctaaccgccaaagaattacta

SEQ ID NO: 83773 - DNA, 36 bp, Artificial Sequence
  Synthetic oligonucleotide
ggtgcatcatactgagcatcctgcccctgattacta

SEQ ID NO: 83774 - DNA, 35 bp, Artificial Sequence
  Synthetic oligonucleotide
atgactaccggttctcttctgctgaccagcaccta

SEQ ID NO: 83775 - DNA, 36 bp, Artificial Sequence
  Synthetic oligonucleotide
aacccctcagccaattcgtgttaccttgtcacccta

SEQ ID NO: 83776 - DNA, 35 bp, Artificial Sequence
  Synthetic oligonucleotide
gtatgaatgtcccagcgtcatcatttctcccccta

SEQ ID NO: 83777 - DNA, 35 bp, Artificial Sequence
  Synthetic oligonucleotide
gcgcacacaccacctagctgctccatctgccccta

SEQ ID NO: 83778 - DNA, 35 bp, Artificial Sequence
  Synthetic oligonucleotide
ggtagtcgccgcttcgttccatacttcaacccgta

SEQ ID NO: 83779 - DNA, 36 bp, Artificial Sequence
  Synthetic oligonucleotide
atcatccagcgtggttttccgcccagagttcccgta

SEQ ID NO: 83780 - DNA, 36 bp, Artificial Sequence
  Synthetic oligonucleotide
gcaccctcctagaactatgtttgctccactactgta

SEQ ID NO: 83781 - DNA, 35 bp, Artificial Sequence
  Synthetic oligonucleotide
ggaatcagcaatggggaggtgcgggatagggtgta

SEQ ID NO: 83782 - DNA, 36 bp, Artificial Sequence
  Synthetic oligonucleotide
ttaccgttgcgtaacttcggcactggcgcctcttta

SEQ ID NO: 83783 - DNA, 35 bp, Artificial Sequence
  Synthetic oligonucleotide
actccgaacgaactgacgctgcctcatacctggac

SEQ ID NO: 83784 - DNA, 35 bp, Artificial Sequence
  Synthetic oligonucleotide
gttcgagtaggagggcacgtaggtcggttgttgac

SEQ ID NO: 83785 - DNA, 35 bp, Artificial Sequence
  Synthetic oligonucleotide
acattcagacgcagtagatgtgcgttgctgcttac

SEQ ID NO: 83786 - DNA, 35 bp, Artificial Sequence
  Synthetic oligonucleotide
atcgattcgcccacccgtttcgaggtacgtatccc

SEQ ID NO: 83787 - DNA, 34 bp, Artificial Sequence
  Synthetic oligonucleotide
acgacttgagctggagttttggtctgtgctctcc

SEQ ID NO: 83788 - DNA, 35 bp, Artificial Sequence
  Synthetic oligonucleotide
gagatggaaggatatggactaaatgtacgctcagc

SEQ ID NO: 83789 - DNA, 34 bp, Artificial Sequence
  Synthetic oligonucleotide
aacgatgccagccccgagccttatggtctgtagc

SEQ ID NO: 83790 - DNA, 35 bp, Artificial Sequence
  Synthetic oligonucleotide
gaatagcggcacaccaccggtacacggatcaacgc

SEQ ID NO: 83791 - DNA, 35 bp, Artificial Sequence
  Synthetic oligonucleotide
gctcgtcccccgtcttccgaggtcactgccttcgc

SEQ ID NO: 83792 - DNA, 35 bp, Artificial Sequence
  Synthetic oligonucleotide
accaacacagcgctggaccaactgatatctctggc

SEQ ID NO: 83793 - DNA, 35 bp, Artificial Sequence
  Synthetic oligonucleotide
caccaccctccatacatcagccgcatggctcgtgc

SEQ ID NO: 83794 - DNA, 35 bp, Artificial Sequence
  Synthetic oligonucleotide
tcctccactcgaccagttccattgccacaccttgc

SEQ ID NO: 83795 - DNA, 35 bp, Artificial Sequence
  Synthetic oligonucleotide
gtgacgtcctataatccagttctagttcacccctc

SEQ ID NO: 83796 - DNA, 35 bp, Artificial Sequence
  Synthetic oligonucleotide
ttgtggcgctactcattgtcagtcaccttcctttc

SEQ ID NO: 83797 - DNA, 35 bp, Artificial Sequence
  Synthetic oligonucleotide
atagtagtggggggtgcataaagcagggtggtaag

SEQ ID NO: 83798 - DNA, 35 bp, Artificial Sequence
  Synthetic oligonucleotide
gacacatgacttcgagcgaacatgcccaacccccg

SEQ ID NO: 83799 - DNA, 35 bp, Artificial Sequence
  Synthetic oligonucleotide
tgcactccattcgcgcgcttaagccgtacctgccg

SEQ ID NO: 83800 - DNA, 35 bp, Artificial Sequence
  Synthetic oligonucleotide
gtcaccatgggaaggggttgtaagaagtatgtgcg

SEQ ID NO: 83801 - DNA, 35 bp, Artificial Sequence
  Synthetic oligonucleotide
tcacaccgtagcacgtgattattaacccattctcg

SEQ ID NO: 83802 - DNA, 34 bp, Artificial Sequence
  Synthetic oligonucleotide
gatagaaagaggaatggaagatacgggatggtcg

SEQ ID NO: 83803 - DNA, 35 bp, Artificial Sequence
  Synthetic oligonucleotide
aattggaaacacggggggtagtaaacggctgaagg

SEQ ID NO: 83804 - DNA, 35 bp, Artificial Sequence
  Synthetic oligonucleotide
tagacttcaaccggggtggctcaacactgcaaggg

SEQ ID NO: 83805 - DNA, 35 bp, Artificial Sequence
  Synthetic oligonucleotide
gtagagccggaaaagtacatgaggcgatgctgggg

SEQ ID NO: 83806 - DNA, 35 bp, Artificial Sequence
  Synthetic oligonucleotide
gctagggaataggtgggtctggggtggtggtgggg

SEQ ID NO: 83807 - DNA, 35 bp, Artificial Sequence
  Synthetic oligonucleotide
gactgggaacgtgagtacggtcaaggaaggtaatg

SEQ ID NO: 83808 - DNA, 35 bp, Artificial Sequence
  Synthetic oligonucleotide
gagacgcaggagaatgcatcaccagtagcactatg

SEQ ID NO: 83809 - DNA, 35 bp, Artificial Sequence
  Synthetic oligonucleotide
acccatttggttgagctatcgggcctgcttacctg

SEQ ID NO: 83810 - DNA, 35 bp, Artificial Sequence
  Synthetic oligonucleotide
gtccgtcatagagctggaggagggagtgtgaattg

SEQ ID NO: 83811 - DNA, 35 bp, Artificial Sequence
  Synthetic oligonucleotide
acgcaacacacctccgccacgatcgtacatccttg

SEQ ID NO: 83812 - DNA, 35 bp, Artificial Sequence
  Synthetic oligonucleotide
taagaaaggcaagagggtctgggcacagacgtaat

SEQ ID NO: 83813 - DNA, 35 bp, Artificial Sequence
  Synthetic oligonucleotide
tcagtcggtccccgtgctggttctcctaatcgtat

SEQ ID NO: 83814 - DNA, 35 bp, Artificial Sequence
  Synthetic oligonucleotide
acaacacctgcgcattgatcaccgttattccccct

SEQ ID NO: 83815 - DNA, 35 bp, Artificial Sequence
  Synthetic oligonucleotide
attgcacaccggtctcatagcgtaaaatcctggct

SEQ ID NO: 83816 - DNA, 35 bp, Artificial Sequence
  Synthetic oligonucleotide
ttttagcctggccaattacgtggtcgataccctct

SEQ ID NO: 83817 - DNA, 35 bp, Artificial Sequence
  Synthetic oligonucleotide
tcgacccgccaactaacagcccggcaccaggttct

SEQ ID NO: 83818 - DNA, 35 bp, Artificial Sequence
  Synthetic oligonucleotide
gaaaagggcaaggggcgagacggaacagatctcgt

SEQ ID NO: 83819 - DNA, 35 bp, Artificial Sequence
  Synthetic oligonucleotide
tgacaaggggaggtaccaggggacaagattcatgt

SEQ ID NO: 83820 - DNA, 35 bp, Artificial Sequence
  Synthetic oligonucleotide
ttgaacgcagacacactgttgtacttacgtccgtt

SEQ ID NO: 83821 - DNA, 36 bp, Artificial Sequence
  Synthetic oligonucleotide
acaccacattgaagcaggccagtgggctacgcgaaa

SEQ ID NO: 83822 - DNA, 36 bp, Artificial Sequence
  Synthetic oligonucleotide
tactcgcctccgcagtatcttcgttctgttccacaa

SEQ ID NO: 83823 - DNA, 36 bp, Artificial Sequence
  Synthetic oligonucleotide
tgcacccacaaatgatactaggcaccaactttacaa

SEQ ID NO: 83824 - DNA, 36 bp, Artificial Sequence
  Synthetic oligonucleotide
gagagctggaggggtagacagacaagagcaaagcaa

SEQ ID NO: 83825 - DNA, 35 bp, Artificial Sequence
  Synthetic oligonucleotide
atgacccgtgacatgtggtggcccgcccgtcgcaa

SEQ ID NO: 83826 - DNA, 35 bp, Artificial Sequence
  Synthetic oligonucleotide
acgtactccagccacatatcgtcaagcggtcgcaa

SEQ ID NO: 83827 - DNA, 36 bp, Artificial Sequence
  Synthetic oligonucleotide
ttcaccaccaaggtcagttttccctcatcctaagaa

SEQ ID NO: 83828 - DNA, 36 bp, Artificial Sequence
  Synthetic oligonucleotide
tcactcacattgataaccacccctcgtagctccgaa

SEQ ID NO: 83829 - DNA, 36 bp, Artificial Sequence
  Synthetic oligonucleotide
tctccccgcacccggcatatcgcgtcacgctcggaa

SEQ ID NO: 83830 - DNA, 36 bp, Artificial Sequence
  Synthetic oligonucleotide
gtcacgcaggggttggagatctgaacgggagctgaa

SEQ ID NO: 83831 - DNA, 36 bp, Artificial Sequence
  Synthetic oligonucleotide
aaactaaggtaggagaggagaacgtgcgggattgaa

SEQ ID NO: 83832 - DNA, 36 bp, Artificial Sequence
  Synthetic oligonucleotide
aagtcgtaccccctgcctatggacacaatttttgaa

SEQ ID NO: 83833 - DNA, 35 bp, Artificial Sequence
  Synthetic oligonucleotide
acatctccatccgctctggtccattttcgtgttaa

SEQ ID NO: 83834 - DNA, 35 bp, Artificial Sequence
  Synthetic oligonucleotide
attaccaatcgcctggtgcctacgaccacagcaca

SEQ ID NO: 83835 - DNA, 36 bp, Artificial Sequence
  Synthetic oligonucleotide
tctgacccatatgctttatcaaagaagtctgcccca

SEQ ID NO: 83836 - DNA, 36 bp, Artificial Sequence
  Synthetic oligonucleotide
gacaccgactgtccttgtcccctcgttgggagccca

SEQ ID NO: 83837 - DNA, 36 bp, Artificial Sequence
  Synthetic oligonucleotide
tgaaagccatcctcccttcgtatagatgcaatccca

SEQ ID NO: 83838 - DNA, 36 bp, Artificial Sequence
  Synthetic oligonucleotide
gactagttacggcatctgcattcgtagtccatccca

SEQ ID NO: 83839 - DNA, 36 bp, Artificial Sequence
  Synthetic oligonucleotide
gatgcacgttcctaattgcggccaaccgtatcgcca

SEQ ID NO: 83840 - DNA, 35 bp, Artificial Sequence
  Synthetic oligonucleotide
accatcaagctgcatccgcctagagtcattgagca

SEQ ID NO: 83841 - DNA, 35 bp, Artificial Sequence
  Synthetic oligonucleotide
tcttacgtccatcgtagcagccatggtttctcgca

SEQ ID NO: 83842 - DNA, 36 bp, Artificial Sequence
  Synthetic oligonucleotide
atctggtggggcgccggggtgagtcttggggttgca

SEQ ID NO: 83843 - DNA, 36 bp, Artificial Sequence
  Synthetic oligonucleotide
gtcatcctcccatgtctcgaatggtcccagtcatca

SEQ ID NO: 83844 - DNA, 36 bp, Artificial Sequence
  Synthetic oligonucleotide
tgaccgctaattgtgggcacatgcgccacctactca

SEQ ID NO: 83845 - DNA, 36 bp, Artificial Sequence
  Synthetic oligonucleotide
tcacccaacactgtgtaaatctataattatggctca

SEQ ID NO: 83846 - DNA, 35 bp, Artificial Sequence
  Synthetic oligonucleotide
gacacgaagaccccaaccgacaccggtagctctca

SEQ ID NO: 83847 - DNA, 36 bp, Artificial Sequence
  Synthetic oligonucleotide
aatgcggcttacacgtgtcgcatggcctttctctca

SEQ ID NO: 83848 - DNA, 35 bp, Artificial Sequence
  Synthetic oligonucleotide
gctacctcaggttttgcccactgggccatgtctca

SEQ ID NO: 83849 - DNA, 36 bp, Artificial Sequence
  Synthetic oligonucleotide
gcccacatagtgacacaatagccttggtacctgtca

SEQ ID NO: 83850 - DNA, 36 bp, Artificial Sequence
  Synthetic oligonucleotide
gactgcaggctacatcagttccggcgctgcaattca

SEQ ID NO: 83851 - DNA, 35 bp, Artificial Sequence
  Synthetic oligonucleotide
actagtactgccatcactccatcactgttgtaaga

SEQ ID NO: 83852 - DNA, 37 bp, Artificial Sequence
  Synthetic oligonucleotide
actctaccccctgaagtttaacagaccctgggacaga

SEQ ID NO: 83853 - DNA, 37 bp, Artificial Sequence
  Synthetic oligonucleotide
actaagtcggaggggataaggaatcgtgaatgagaga

SEQ ID NO: 83854 - DNA, 37 bp, Artificial Sequence
  Synthetic oligonucleotide
gaccacccttactttatgttgcgcagagcaaccgaga

SEQ ID NO: 83855 - DNA, 36 bp, Artificial Sequence
  Synthetic oligonucleotide
agcgagggggaaagtacgaatagggttgtgaggaga

SEQ ID NO: 83856 - DNA, 37 bp, Artificial Sequence
  Synthetic oligonucleotide
attgtagacagacaggtggaggcgaggacgaagacga

SEQ ID NO: 83857 - DNA, 37 bp, Artificial Sequence
  Synthetic oligonucleotide
gaaactcgccctatcacccacgtgacaactcctacga

SEQ ID NO: 83858 - DNA, 37 bp, Artificial Sequence
  Synthetic oligonucleotide
acctccgactacgggtaacttgactctcgccccccga

SEQ ID NO: 83859 - DNA, 35 bp, Artificial Sequence
  Synthetic oligonucleotide
gacatcatagcggttgcattaaggtgagccgccga

SEQ ID NO: 83860 - DNA, 36 bp, Artificial Sequence
  Synthetic oligonucleotide
gagctccatcccacctgtctgtagcctacatcgcga

SEQ ID NO: 83861 - DNA, 37 bp, Artificial Sequence
  Synthetic oligonucleotide
gcgatgcagtctgctcgcacgggcatgttccactcga

SEQ ID NO: 83862 - DNA, 37 bp, Artificial Sequence
  Synthetic oligonucleotide
tgtatcccgcaaaccgttgagaacgcaagttctagga

SEQ ID NO: 83863 - DNA, 36 bp, Artificial Sequence
  Synthetic oligonucleotide
aacccagaggaggaaaaggggtggtattttttagga

SEQ ID NO: 83864 - DNA, 37 bp, Artificial Sequence
  Synthetic oligonucleotide
atgatgcatgcgggtgtgtgcacgtggaggggccgga

SEQ ID NO: 83865 - DNA, 37 bp, Artificial Sequence
  Synthetic oligonucleotide
agccatcgcgccaatcttctgccttctttatcgcgga

SEQ ID NO: 83866 - DNA, 37 bp, Artificial Sequence
  Synthetic oligonucleotide
taggaccatcctcagcccgttcatccttccactcgga

SEQ ID NO: 83867 - DNA, 37 bp, Artificial Sequence
  Synthetic oligonucleotide
tacgccggcgaaaatttagggggacaacgggaaggga

SEQ ID NO: 83868 - DNA, 37 bp, Artificial Sequence
  Synthetic oligonucleotide
ggagggttcggcgagagaaagggtggcgaacgaggga

SEQ ID NO: 83869 - DNA, 37 bp, Artificial Sequence
  Synthetic oligonucleotide
agttcgtccgtacactcgtaaccgcgcctccccggga

SEQ ID NO: 83870 - DNA, 36 bp, Artificial Sequence
  Synthetic oligonucleotide
gtccaagcggattagtttccaccgctcaaatctgga

SEQ ID NO: 83871 - DNA, 38 bp, Artificial Sequence
  Synthetic oligonucleotide
gcagacaaggacatgggggcggggggtaacagtcatga

SEQ ID NO: 83872 - DNA, 36 bp, Artificial Sequence
  Synthetic oligonucleotide
tcgtgaggacatggatgaaacatgatagggtgatga

SEQ ID NO: 83873 - DNA, 38 bp, Artificial Sequence
  Synthetic oligonucleotide
gacgacgtacgcaaatgtgtacgtgaacaaaattatga

SEQ ID NO: 83874 - DNA, 38 bp, Artificial Sequence
  Synthetic oligonucleotide
gtggaatggactggtgggggcattagtgggtgttatga

SEQ ID NO: 83875 - DNA, 38 bp, Artificial Sequence
  Synthetic oligonucleotide
agaccgagccaatgtacgagaagggaggggttgactga

SEQ ID NO: 83876 - DNA, 38 bp, Artificial Sequence
  Synthetic oligonucleotide
gacaagtacgctagtggtaaaggagggggagtgcctga

SEQ ID NO: 83877 - DNA, 38 bp, Artificial Sequence
  Synthetic oligonucleotide
aaacggtgccaagcgtttgatacttcctcgcttcctga

SEQ ID NO: 83878 - DNA, 38 bp, Artificial Sequence
  Synthetic oligonucleotide
gccacgcggaacctcgccccactcaccgtatgagctga

SEQ ID NO: 83879 - DNA, 37 bp, Artificial Sequence
  Synthetic oligonucleotide
gcccaacctctagaaatcgatagaacaactttgctga

SEQ ID NO: 83880 - DNA, 35 bp, Artificial Sequence
  Synthetic oligonucleotide
agaccgggggcggaggaaggggggaagtcaagtga

SEQ ID NO: 83881 - DNA, 38 bp, Artificial Sequence
  Synthetic oligonucleotide
atacccgcccttaaaaatatgcccaggcaactacgtga

SEQ ID NO: 83882 - DNA, 38 bp, Artificial Sequence
  Synthetic oligonucleotide
accagagggggggagtttgaagcagggctcacaggtga

SEQ ID NO: 83883 - DNA, 38 bp, Artificial Sequence
  Synthetic oligonucleotide
atgtactgccagccttagatggttaagcaacagggtga

SEQ ID NO: 83884 - DNA, 38 bp, Artificial Sequence
  Synthetic oligonucleotide
ttgtacgtagtgtgaggcaacacgagggggaggggtga

SEQ ID NO: 83885 - DNA, 38 bp, Artificial Sequence
  Synthetic oligonucleotide
aacatccgcggatacgccgtctatcaccaccggggtga

SEQ ID NO: 83886 - DNA, 37 bp, Artificial Sequence
  Synthetic oligonucleotide
ggaggctataccgaggagaggaggacgaggggggtga

SEQ ID NO: 83887 - DNA, 38 bp, Artificial Sequence
  Synthetic oligonucleotide
tccaggaagggtggtaggaagaacgacgggagtggtga

SEQ ID NO: 83888 - DNA, 38 bp, Artificial Sequence
  Synthetic oligonucleotide
gagggtggacaaggaggggggccgactcgcaactgtga

SEQ ID NO: 83889 - DNA, 38 bp, Artificial Sequence
  Synthetic oligonucleotide
gaggttgatgcgggaagaaggtgagaaggtgtgtgtga

SEQ ID NO: 83890 - DNA, 38 bp, Artificial Sequence
  Synthetic oligonucleotide
tgtgacccccgtgtccgtataaaatcaccccctattga

SEQ ID NO: 83891 - DNA, 38 bp, Artificial Sequence
  Synthetic oligonucleotide
gcatcacgtactatcggttcataggcgctacttcttga

SEQ ID NO: 83892 - DNA, 38 bp, Artificial Sequence
  Synthetic oligonucleotide
tcgtggtcgctccggtctccttactagtctcctgttga

SEQ ID NO: 83893 - DNA, 38 bp, Artificial Sequence
  Synthetic oligonucleotide
tagtcgcatcatagccagtggctgttctccttatttga

SEQ ID NO: 83894 - DNA, 37 bp, Artificial Sequence
  Synthetic oligonucleotide
agcatacctccctgcccttgtgattccttgagtttga

SEQ ID NO: 83895 - DNA, 38 bp, Artificial Sequence
  Synthetic oligonucleotide
gaccatcgacgacccccatgggatgcacatacttttga

SEQ ID NO: 83896 - DNA, 36 bp, Artificial Sequence
  Synthetic oligonucleotide
accacactcctcggttcgccgtactatcatctcata

SEQ ID NO: 83897 - DNA, 35 bp, Artificial Sequence
  Synthetic oligonucleotide
gtcaacccgcctgtcttaccctctagtaaaaacta

SEQ ID NO: 83898 - DNA, 36 bp, Artificial Sequence
  Synthetic oligonucleotide
gccccacagtaagctggctctcaccgtcctacgcta

SEQ ID NO: 83899 - DNA, 36 bp, Artificial Sequence
  Synthetic oligonucleotide
aaggccccacaattatctcacaatcaggccctgcta

SEQ ID NO: 83900 - DNA, 35 bp, Artificial Sequence
  Synthetic oligonucleotide
gcacacctaattatgatcctttggagtcccttcta

SEQ ID NO: 83901 - DNA, 36 bp, Artificial Sequence
  Synthetic oligonucleotide
ttgggccacaggaaagggatcgtgattactggggta

SEQ ID NO: 83902 - DNA, 35 bp, Artificial Sequence
  Synthetic oligonucleotide
ttcgcaacggacgcaaaaaaatcgaggggatggta

SEQ ID NO: 83903 - DNA, 36 bp, Artificial Sequence
  Synthetic oligonucleotide
gtggagggtgccggggactgagtgagcttggttgta

SEQ ID NO: 83904 - DNA, 36 bp, Artificial Sequence
  Synthetic oligonucleotide
gcatcgataagggcgtagggaggggggcgattatta

SEQ ID NO: 83905 - DNA, 36 bp, Artificial Sequence
  Synthetic oligonucleotide
gcactgacagcaactatcttgaaagatcctacctta

SEQ ID NO: 83906 - DNA, 35 bp, Artificial Sequence
  Synthetic oligonucleotide
tttcacgtccatcatctcatacgttttgtccctta

SEQ ID NO: 83907 - DNA, 36 bp, Artificial Sequence
  Synthetic oligonucleotide
tcgaatcggcgccctgcaaatttttcggtcctgtta

SEQ ID NO: 83908 - DNA, 35 bp, Artificial Sequence
  Synthetic oligonucleotide
gaggcccctgccgaaattctgtgctgttccgcaac

SEQ ID NO: 83909 - DNA, 35 bp, Artificial Sequence
  Synthetic oligonucleotide
ggtgagagcgctttgtcacatgttcttaattccac

SEQ ID NO: 83910 - DNA, 35 bp, Artificial Sequence
  Synthetic oligonucleotide
acagaggtcgtccagctgcctgatccttctatcac

SEQ ID NO: 83911 - DNA, 35 bp, Artificial Sequence
  Synthetic oligonucleotide
tgaggggcccgtttcggcaatcgatacctcttcac

SEQ ID NO: 83912 - DNA, 35 bp, Artificial Sequence
  Synthetic oligonucleotide
gtcccacccctgtgatctgagaatccttcgccacc

SEQ ID NO: 83913 - DNA, 35 bp, Artificial Sequence
  Synthetic oligonucleotide
taaccccatagacggtacagtgggccccccaaccc

SEQ ID NO: 83914 - DNA, 35 bp, Artificial Sequence
  Synthetic oligonucleotide
tcccgcctacgccagttacgtcccgctgtccaccc

SEQ ID NO: 83915 - DNA, 34 bp, Artificial Sequence
  Synthetic oligonucleotide
ataagccatggtgtcgctctcagtaccatccccc

SEQ ID NO: 83916 - DNA, 35 bp, Artificial Sequence
  Synthetic oligonucleotide
tgactgacataaagtgcgtctacttcaacgctccc

SEQ ID NO: 83917 - DNA, 35 bp, Artificial Sequence
  Synthetic oligonucleotide
tgtacatctgtgtcttaagcaacaccaccgctccc

SEQ ID NO: 83918 - DNA, 35 bp, Artificial Sequence
  Synthetic oligonucleotide
tgcaaaccctgctccccacgaccataacttacgcc

SEQ ID NO: 83919 - DNA, 35 bp, Artificial Sequence
  Synthetic oligonucleotide
tgctggaccagcctggcccgaagcctattatatcc

SEQ ID NO: 83920 - DNA, 35 bp, Artificial Sequence
  Synthetic oligonucleotide
gagaaaccccatggtttaactgcgggcctcactcc

SEQ ID NO: 83921 - DNA, 35 bp, Artificial Sequence
  Synthetic oligonucleotide
gtgagcgccattttcccccctgaaccgtgtactcc

SEQ ID NO: 83922 - DNA, 35 bp, Artificial Sequence
  Synthetic oligonucleotide
tgccagatgtccagcaaacggtttggctaacttcc

SEQ ID NO: 83923 - DNA, 35 bp, Artificial Sequence
  Synthetic oligonucleotide
gctgcgggccgttaccagtttagttagctccccgc

SEQ ID NO: 83924 - DNA, 35 bp, Artificial Sequence
  Synthetic oligonucleotide
tcatcaagttgtccatgttcgtcccccttacaggc

SEQ ID NO: 83925 - DNA, 35 bp, Artificial Sequence
  Synthetic oligonucleotide
agtgtggctcgggggaaggggtgcgcgttacaggc

SEQ ID NO: 83926 - DNA, 35 bp, Artificial Sequence
  Synthetic oligonucleotide
tgatggccaacacgtctgcgcgaatctacccttgc

SEQ ID NO: 83927 - DNA, 35 bp, Artificial Sequence
  Synthetic oligonucleotide
aagcagaaacggagcgtactttccttacctcaatc

SEQ ID NO: 83928 - DNA, 35 bp, Artificial Sequence
  Synthetic oligonucleotide
tccgaacctctcccgtgtccgactcagtctggatc

SEQ ID NO: 83929 - DNA, 35 bp, Artificial Sequence
  Synthetic oligonucleotide
tatctgtcgtacgctggcgttacgtggcccctatc

SEQ ID NO: 83930 - DNA, 35 bp, Artificial Sequence
  Synthetic oligonucleotide
tacaccgtccttggatctcgtcagtaaatggcctc

SEQ ID NO: 83931 - DNA, 35 bp, Artificial Sequence
  Synthetic oligonucleotide
aagcacctatcaagctccggctatccggcccattc

SEQ ID NO: 83932 - DNA, 35 bp, Artificial Sequence
  Synthetic oligonucleotide
agcgggacgcatttgcacgtaaacgttacctcttc

SEQ ID NO: 83933 - DNA, 35 bp, Artificial Sequence
  Synthetic oligonucleotide
gccgtgagcgccccctctcttcttcaatgtcgttc

SEQ ID NO: 83934 - DNA, 35 bp, Artificial Sequence
  Synthetic oligonucleotide
gccacacctcactggaaccgaccctcctttttaag

SEQ ID NO: 83935 - DNA, 35 bp, Artificial Sequence
  Synthetic oligonucleotide
aaagaggggaacaacaaggagggcggatagaagag

SEQ ID NO: 83936 - DNA, 35 bp, Artificial Sequence
  Synthetic oligonucleotide
tcaacacgtagtatcattggacttctccacctgcg

SEQ ID NO: 83937 - DNA, 35 bp, Artificial Sequence
  Synthetic oligonucleotide
tgaacagtcccacttacgcttgttacttattgtcg

SEQ ID NO: 83938 - DNA, 35 bp, Artificial Sequence
  Synthetic oligonucleotide
gcggaacaagggaattgtctgggagggggttgggg

SEQ ID NO: 83939 - DNA, 35 bp, Artificial Sequence
  Synthetic oligonucleotide
atacctgtccgaccctccgatgattgagtgtagtg

SEQ ID NO: 83940 - DNA, 34 bp, Artificial Sequence
  Synthetic oligonucleotide
atggcccccgaaataggttacctcctctgcattg

SEQ ID NO: 83941 - DNA, 35 bp, Artificial Sequence
  Synthetic oligonucleotide
gaccacgggaccataattgaggatgcggatgattg

SEQ ID NO: 83942 - DNA, 35 bp, Artificial Sequence
  Synthetic oligonucleotide
agtgacgtgtccatgtatcgctcaaccccatcaat

SEQ ID NO: 83943 - DNA, 35 bp, Artificial Sequence
  Synthetic oligonucleotide
tccgacctggcaatcactgtcccagcataaaccat

SEQ ID NO: 83944 - DNA, 36 bp, Artificial Sequence
  Synthetic oligonucleotide
gtgccatgctcagacagtccgctacctgcccttcat

SEQ ID NO: 83945 - DNA, 35 bp, Artificial Sequence
  Synthetic oligonucleotide
ggtggctgatcgcacggttttcgcttcttcttcat

SEQ ID NO: 83946 - DNA, 35 bp, Artificial Sequence
  Synthetic oligonucleotide
atgccacgccctcgcatacgacctgcacatccact

SEQ ID NO: 83947 - DNA, 35 bp, Artificial Sequence
  Synthetic oligonucleotide
gcctgcaggccttttcctaatccgctccaggacct

SEQ ID NO: 83948 - DNA, 35 bp, Artificial Sequence
  Synthetic oligonucleotide
gcacacaacaggcttatacagcccagggatttcct

SEQ ID NO: 83949 - DNA, 35 bp, Artificial Sequence
  Synthetic oligonucleotide
gcatgccctactctggcgctgcatggtccctctct

SEQ ID NO: 83950 - DNA, 35 bp, Artificial Sequence
  Synthetic oligonucleotide
tacccgtaccggcagttcgtcttcatactattcgt

SEQ ID NO: 83951 - DNA, 35 bp, Artificial Sequence
  Synthetic oligonucleotide
taacgcgagatgtctcatgggtgtgggtggaaggt

SEQ ID NO: 83952 - DNA, 35 bp, Artificial Sequence
  Synthetic oligonucleotide
gacgacccacccgctctccactgatgttcccgggt

SEQ ID NO: 83953 - DNA, 35 bp, Artificial Sequence
  Synthetic oligonucleotide
ggatcccccctgatgcacgtggtttcagtccgggt

SEQ ID NO: 83954 - DNA, 35 bp, Artificial Sequence
  Synthetic oligonucleotide
ttcgcctcccattatagtttacacgacgtacaatt

SEQ ID NO: 83955 - DNA, 35 bp, Artificial Sequence
  Synthetic oligonucleotide
gccttcgctccttccctcacatcctcgtgggactt

SEQ ID NO: 83956 - DNA, 36 bp, Artificial Sequence
  Synthetic oligonucleotide
tagcactgacagccttcgcgaggcacctaccgcctt

SEQ ID NO: 83957 - DNA, 35 bp, Artificial Sequence
  Synthetic oligonucleotide
tgacgaacggcttgcatacacaccgcattatgctt

SEQ ID NO: 83958 - DNA, 35 bp, Artificial Sequence
  Synthetic oligonucleotide
acaatcccgccgtgcgccttagacctaaagaagtt

SEQ ID NO: 83959 - DNA, 35 bp, Artificial Sequence
  Synthetic oligonucleotide
tactctcgtgtccctgagttgacgacctggccttt

SEQ ID NO: 83960 - DNA, 36 bp, Artificial Sequence
  Synthetic oligonucleotide
gctgccctccggacgccacagaccttacactagaaa

SEQ ID NO: 83961 - DNA, 35 bp, Artificial Sequence
  Synthetic oligonucleotide
atgttcagcccacaaagaggaaagcgtggccacaa

SEQ ID NO: 83962 - DNA, 36 bp, Artificial Sequence
  Synthetic oligonucleotide
gtagtcgcatccccagttgctaagtctgcctcccaa

SEQ ID NO: 83963 - DNA, 35 bp, Artificial Sequence
  Synthetic oligonucleotide
ttgcggtctggtcccgcgcgcattatacatctcaa

SEQ ID NO: 83964 - DNA, 36 bp, Artificial Sequence
  Synthetic oligonucleotide
atcaccgcacgctgcgggggtgtgggagttcgagaa

SEQ ID NO: 83965 - DNA, 36 bp, Artificial Sequence
  Synthetic oligonucleotide
gtgcacgcacgtccctagatccaccaactacaggaa

SEQ ID NO: 83966 - DNA, 36 bp, Artificial Sequence
  Synthetic oligonucleotide
gactgccggtgttaggcagtcgaacctttgtcctaa

SEQ ID NO: 83967 - DNA, 36 bp, Artificial Sequence
  Synthetic oligonucleotide
accggtcgccaccacgcaaggggaacatagctctaa

SEQ ID NO: 83968 - DNA, 36 bp, Artificial Sequence
  Synthetic oligonucleotide
gtcacatcctcaaatcgatgccactttgccctaaca

SEQ ID NO: 83969 - DNA, 35 bp, Artificial Sequence
  Synthetic oligonucleotide
atgtgtagccgcgttatacttcaacacactgcaca

SEQ ID NO: 83970 - DNA, 36 bp, Artificial Sequence
  Synthetic oligonucleotide
tgccgtactcattgcatacattcacccatgttgaca

SEQ ID NO: 83971 - DNA, 36 bp, Artificial Sequence
  Synthetic oligonucleotide
tccgatgttctgtaccagcagctctctacataccca

SEQ ID NO: 83972 - DNA, 35 bp, Artificial Sequence
  Synthetic oligonucleotide
agcactcgtgcatctttgcaccacttgggccccca

SEQ ID NO: 83973 - DNA, 36 bp, Artificial Sequence
  Synthetic oligonucleotide
agcatgtgcatcgggtgagggtgggcacgggcgcca

SEQ ID NO: 83974 - DNA, 36 bp, Artificial Sequence
  Synthetic oligonucleotide
ggaggggcagttcagggcgggaagtgtagggtatca

SEQ ID NO: 83975 - DNA, 36 bp, Artificial Sequence
  Synthetic oligonucleotide
taccaaacgctaaccacggggttcattctgtactca

SEQ ID NO: 83976 - DNA, 36 bp, Artificial Sequence
  Synthetic oligonucleotide
gctgtcagccagcatttggtcctaaattcgccctca

SEQ ID NO: 83977 - DNA, 35 bp, Artificial Sequence
  Synthetic oligonucleotide
gacagtcgctgttgtaccccgagttatctcggtca

SEQ ID NO: 83978 - DNA, 37 bp, Artificial Sequence
  Synthetic oligonucleotide
gatgtgaaagtatgtgggtggaagttagtgttagaga

SEQ ID NO: 83979 - DNA, 37 bp, Artificial Sequence
  Synthetic oligonucleotide
tgtcacattcgacctgactttaatacgccatactaga

SEQ ID NO: 83980 - DNA, 36 bp, Artificial Sequence
  Synthetic oligonucleotide
gatgctggcccaggggaacgctgatacgacgaacga

SEQ ID NO: 83981 - DNA, 36 bp, Artificial Sequence
  Synthetic oligonucleotide
gcactgagagcgtgcagattccctttaccatcacga

SEQ ID NO: 83982 - DNA, 37 bp, Artificial Sequence
  Synthetic oligonucleotide
tgttgggggcaagggaggagactgagcgtcacgacga

SEQ ID NO: 83983 - DNA, 37 bp, Artificial Sequence
  Synthetic oligonucleotide
tgagccgtttctccctgcattcgacgtcttggcccga

SEQ ID NO: 83984 - DNA, 37 bp, Artificial Sequence
  Synthetic oligonucleotide
gtgggggctggaccggtaaagctgatggaggggccga

SEQ ID NO: 83985 - DNA, 36 bp, Artificial Sequence
  Synthetic oligonucleotide
acaccctcgttgctgatctatcgtctaagactccga

SEQ ID NO: 83986 - DNA, 36 bp, Artificial Sequence
  Synthetic oligonucleotide
gcacctgcgcgccacctctatgggccttgacctcga

SEQ ID NO: 83987 - DNA, 36 bp, Artificial Sequence
  Synthetic oligonucleotide
tcctcatgcactatcttcgtaaatggattacctcga

SEQ ID NO: 83988 - DNA, 37 bp, Artificial Sequence
  Synthetic oligonucleotide
gatcaagcgtactgctcttttcgtgttccatgctcga

SEQ ID NO: 83989 - DNA, 37 bp, Artificial Sequence
  Synthetic oligonucleotide
gaacaccacgtttgaggccttcgtacgcccttaagga

SEQ ID NO: 83990 - DNA, 37 bp, Artificial Sequence
  Synthetic oligonucleotide
gagttgatgtcggaaaacctagttagggggcaaggga

SEQ ID NO: 83991 - DNA, 36 bp, Artificial Sequence
  Synthetic oligonucleotide
aacgatctcacactccccgtaggtcatgccccggga

SEQ ID NO: 83992 - DNA, 37 bp, Artificial Sequence
  Synthetic oligonucleotide
ggggaggccttattgggggaggagaggttaggcggga

SEQ ID NO: 83993 - DNA, 37 bp, Artificial Sequence
  Synthetic oligonucleotide
gtggtggctcaggagacaatgagtggagttaagggga

SEQ ID NO: 83994 - DNA, 37 bp, Artificial Sequence
  Synthetic oligonucleotide
atcaacaaccgtcccatgtaagcacctatgtcgggga

SEQ ID NO: 83995 - DNA, 37 bp, Artificial Sequence
  Synthetic oligonucleotide
gcctacgacaggcgtaggactagacaggtggggggga

SEQ ID NO: 83996 - DNA, 37 bp, Artificial Sequence
  Synthetic oligonucleotide
aacgaaagcgactcggagttctgggtagggggatgga

SEQ ID NO: 83997 - DNA, 37 bp, Artificial Sequence
  Synthetic oligonucleotide
aaccgcaatgctatccctcacacgtcgtttttatgga

SEQ ID NO: 83998 - DNA, 37 bp, Artificial Sequence
  Synthetic oligonucleotide
atccctcacatcggattcgtgctccaaaccgcctgga

SEQ ID NO: 83999 - DNA, 37 bp, Artificial Sequence
  Synthetic oligonucleotide
tgtcgcggcactctccttccccgtgatctttagtgga

SEQ ID NO: 84000 - DNA, 38 bp, Artificial Sequence
  Synthetic oligonucleotide
gtagttggccgggtggtacgagcagggagtgagaatga

SEQ ID NO: 84001 - DNA, 38 bp, Artificial Sequence
  Synthetic oligonucleotide
gagcgatcacggggataacacaaatttaggctgcatga

SEQ ID NO: 84002 - DNA, 38 bp, Artificial Sequence
  Synthetic oligonucleotide
agcactgccagccaccatgccgttcgataacacgatga

SEQ ID NO: 84003 - DNA, 37 bp, Artificial Sequence
  Synthetic oligonucleotide
gagtaggacggacttggggtgaagttatggtggatga

SEQ ID NO: 84004 - DNA, 36 bp, Artificial Sequence
  Synthetic oligonucleotide
acccatgcaacctgccatcataccgcattaatatga

SEQ ID NO: 84005 - DNA, 37 bp, Artificial Sequence
  Synthetic oligonucleotide
gggcggtgtcgttccatctgcacttggacctaactga

SEQ ID NO: 84006 - DNA, 38 bp, Artificial Sequence
  Synthetic oligonucleotide
ggaccccgtctaagcttcatcgccattgccaacactga

SEQ ID NO: 84007 - DNA, 38 bp, Artificial Sequence
  Synthetic oligonucleotide
gatcaccccgttctagaccatagtgcactgcccgctga

SEQ ID NO: 84008 - DNA, 38 bp, Artificial Sequence
  Synthetic oligonucleotide
tccacacgcccgtgtgttgcgaggaatgtcgttgctga

SEQ ID NO: 84009 - DNA, 38 bp, Artificial Sequence
  Synthetic oligonucleotide
atcgcaccgcggcacctagttcatgtttttcggtctga

SEQ ID NO: 84010 - DNA, 38 bp, Artificial Sequence
  Synthetic oligonucleotide
accccacgtcttaggctggctgcttatcacccgagtga

SEQ ID NO: 84011 - DNA, 38 bp, Artificial Sequence
  Synthetic oligonucleotide
gtgaagggggcattagtatttgggtgagtccgtagtga

SEQ ID NO: 84012 - DNA, 37 bp, Artificial Sequence
  Synthetic oligonucleotide
acttgctgaggccattgaaccactcccctcgccgtga

SEQ ID NO: 84013 - DNA, 37 bp, Artificial Sequence
  Synthetic oligonucleotide
tgaaaagctaagggaagagagtaggacggaggcgtga

SEQ ID NO: 84014 - DNA, 37 bp, Artificial Sequence
  Synthetic oligonucleotide
acactatcatcattccggttagacgtccgcctcgtga

SEQ ID NO: 84015 - DNA, 38 bp, Artificial Sequence
  Synthetic oligonucleotide
gcttgacgcagattcttggttttcggggtgggcggtga

SEQ ID NO: 84016 - DNA, 38 bp, Artificial Sequence
  Synthetic oligonucleotide
tcgaggtggtatggtggaatggtagtgcgcgtgggtga

SEQ ID NO: 84017 - DNA, 38 bp, Artificial Sequence
  Synthetic oligonucleotide
gtcacgcactgtgccatcattttcacgatccttggtga

SEQ ID NO: 84018 - DNA, 38 bp, Artificial Sequence
  Synthetic oligonucleotide
tcctacgccttccacccatattcgtcacctggttgtga

SEQ ID NO: 84019 - DNA, 38 bp, Artificial Sequence
  Synthetic oligonucleotide
gagtgggacggcgggggcccggaacagccttgaattga

SEQ ID NO: 84020 - DNA, 37 bp, Artificial Sequence
  Synthetic oligonucleotide
atcgccccatcccggtagttggagtcctatggattga

SEQ ID NO: 84021 - DNA, 38 bp, Artificial Sequence
  Synthetic oligonucleotide
gtcgctccgcctacagtactgcccgctgtctaccttga

SEQ ID NO: 84022 - DNA, 38 bp, Artificial Sequence
  Synthetic oligonucleotide
tcctgcgttggcgccccgtaaatatcgttcactcttga

SEQ ID NO: 84023 - DNA, 38 bp, Artificial Sequence
  Synthetic oligonucleotide
gcggggcacgtgcgcaggcggaaggaagtcgaggttga

SEQ ID NO: 84024 - DNA, 38 bp, Artificial Sequence
  Synthetic oligonucleotide
tacgtgcccgtctggcctcccgccgcacttattgttga

SEQ ID NO: 84025 - DNA, 38 bp, Artificial Sequence
  Synthetic oligonucleotide
accaacggcactcttgaacacacggggggtcaatttga

SEQ ID NO: 84026 - DNA, 38 bp, Artificial Sequence
  Synthetic oligonucleotide
gcaacggaatgcaaaggcgacggggcatggagatttga

SEQ ID NO: 84027 - DNA, 38 bp, Artificial Sequence
  Synthetic oligonucleotide
tatgcgcttcgccctcatgtctcgccgactatctttga

SEQ ID NO: 84028 - DNA, 38 bp, Artificial Sequence
  Synthetic oligonucleotide
ggacgccgactgccctgcatacatgctttgatttttga

SEQ ID NO: 84029 - DNA, 35 bp, Artificial Sequence
  Synthetic oligonucleotide
gatacgctgcgctaaaccggcacctctcacctata

SEQ ID NO: 84030 - DNA, 35 bp, Artificial Sequence
  Synthetic oligonucleotide
gcaagccgggctgcaccaccaaaaatcccgaacta

SEQ ID NO: 84031 - DNA, 36 bp, Artificial Sequence
  Synthetic oligonucleotide
tgcattgccattcacacgccaagatccatactgcta

SEQ ID NO: 84032 - DNA, 35 bp, Artificial Sequence
  Synthetic oligonucleotide
tacttgccatcacgtcgttctcactgcctgctcta

SEQ ID NO: 84033 - DNA, 36 bp, Artificial Sequence
  Synthetic oligonucleotide
tagtacgtcacaccatttcgttagtgtcctgcagta

SEQ ID NO: 84034 - DNA, 36 bp, Artificial Sequence
  Synthetic oligonucleotide
tcatttcacagacctattcagggcactaccttgtta

SEQ ID NO: 84035 - DNA, 36 bp, Artificial Sequence
  Synthetic oligonucleotide
gcgttgcctggcacatggcctccgacccggtcttta

SEQ ID NO: 84036 - DNA, 35 bp, Artificial Sequence
  Synthetic oligonucleotide
gatcattgggactcccctgcgctcgcacaatttta

SEQ ID NO: 84037 - DNA, 35 bp, Artificial Sequence
  Synthetic oligonucleotide
gggtggcctcgacgcctccatcttaaccgttttta

SEQ ID NO: 84038 - DNA, 35 bp, Artificial Sequence
  Synthetic oligonucleotide
gtcatatcgcggtgacgtatccctgtcctgaaaac

SEQ ID NO: 84039 - DNA, 35 bp, Artificial Sequence
  Synthetic oligonucleotide
ttccacccgttggcgccgtttagaaattcccacac

SEQ ID NO: 84040 - DNA, 35 bp, Artificial Sequence
  Synthetic oligonucleotide
tatcaggcaccggtaatccacccactggctttcac

SEQ ID NO: 84041 - DNA, 35 bp, Artificial Sequence
  Synthetic oligonucleotide
atcagtcggcttgttatttgtcgcccgttctaccc

SEQ ID NO: 84042 - DNA, 35 bp, Artificial Sequence
  Synthetic oligonucleotide
gcgtacccccggtggccacgtaccgttcaagtccc

SEQ ID NO: 84043 - DNA, 35 bp, Artificial Sequence
  Synthetic oligonucleotide
actgtgaccggcagtagtgatgctgtcgttcctcc

SEQ ID NO: 84044 - DNA, 35 bp, Artificial Sequence
  Synthetic oligonucleotide
ggtgcttgtcatctcgtcttgtaacatattcttcc

SEQ ID NO: 84045 - DNA, 35 bp, Artificial Sequence
  Synthetic oligonucleotide
ttcactccatggtactttccgacagcacattcggc

SEQ ID NO: 84046 - DNA, 35 bp, Artificial Sequence
  Synthetic oligonucleotide
gctgaccacttatgactccgctctggccttgtggc

SEQ ID NO: 84047 - DNA, 35 bp, Artificial Sequence
  Synthetic oligonucleotide
atttcgccccagacgcttcatctattacaacatgc

SEQ ID NO: 84048 - DNA, 35 bp, Artificial Sequence
  Synthetic oligonucleotide
gccgttagcttactgatttcccgacactatgctgc

SEQ ID NO: 84049 - DNA, 35 bp, Artificial Sequence
  Synthetic oligonucleotide
tgagggggggaggtgtagggctgggatgtttcatc

SEQ ID NO: 84050 - DNA, 35 bp, Artificial Sequence
  Synthetic oligonucleotide
gaccatctcggtgatacccatgatcgatgcttatc

SEQ ID NO: 84051 - DNA, 35 bp, Artificial Sequence
  Synthetic oligonucleotide
ttagtgccccctccactgcgcacccacatgtactc

SEQ ID NO: 84052 - DNA, 35 bp, Artificial Sequence
  Synthetic oligonucleotide
tccatacgaagtatcttaatctatgtacgtgcctc

SEQ ID NO: 84053 - DNA, 35 bp, Artificial Sequence
  Synthetic oligonucleotide
gtgaaaagcataccaaatgccttgattagttcctc

SEQ ID NO: 84054 - DNA, 35 bp, Artificial Sequence
  Synthetic oligonucleotide
actcccagccacctaaattcgtttcagcatacgtc

SEQ ID NO: 84055 - DNA, 35 bp, Artificial Sequence
  Synthetic oligonucleotide
tatgtcgccggtccaccctccatgcaatgcgattc

SEQ ID NO: 84056 - DNA, 35 bp, Artificial Sequence
  Synthetic oligonucleotide
gtaccaccctgacaacagttctgcaagcgagcttc

SEQ ID NO: 84057 - DNA, 35 bp, Artificial Sequence
  Synthetic oligonucleotide
gtagacggaggacactgaaatggcggagtaggaag

SEQ ID NO: 84058 - DNA, 35 bp, Artificial Sequence
  Synthetic oligonucleotide
gcctggagacaacaaaataagaagagggatgtaag

SEQ ID NO: 84059 - DNA, 35 bp, Artificial Sequence
  Synthetic oligonucleotide
tagtgtcggacgcgagggggtcaggcgtgaggtag

SEQ ID NO: 84060 - DNA, 35 bp, Artificial Sequence
  Synthetic oligonucleotide
gtaactccgccccttatcttgcccagccccagacg

SEQ ID NO: 84061 - DNA, 35 bp, Artificial Sequence
  Synthetic oligonucleotide
ttactacgttcagctaacgatcgcccacccatccg

SEQ ID NO: 84062 - DNA, 35 bp, Artificial Sequence
  Synthetic oligonucleotide
tatacgcccgaactattagccactgttttcgaggg

SEQ ID NO: 84063 - DNA, 35 bp, Artificial Sequence
  Synthetic oligonucleotide
tagtggggagaagcagggattcgtaacgtcagggg

SEQ ID NO: 84064 - DNA, 35 bp, Artificial Sequence
  Synthetic oligonucleotide
taggaaagaaaggacgatgggttttggtgttgtgg

SEQ ID NO: 84065 - DNA, 35 bp, Artificial Sequence
  Synthetic oligonucleotide
cccaacgccggcgcctgcgaatgtcttctttgtgg

SEQ ID NO: 84066 - DNA, 35 bp, Artificial Sequence
  Synthetic oligonucleotide
gagccgataagggcgagaggttggttatggggatg

SEQ ID NO: 84067 - DNA, 35 bp, Artificial Sequence
  Synthetic oligonucleotide
aaaccatcggggctgacctaattcagagtgcggtg

SEQ ID NO: 84068 - DNA, 35 bp, Artificial Sequence
  Synthetic oligonucleotide
atcagacgtaagactgaaccaattgaaagcctgtg

SEQ ID NO: 84069 - DNA, 35 bp, Artificial Sequence
  Synthetic oligonucleotide
tgatgcgccgcggccgtcccttgccacgttataat

SEQ ID NO: 84070 - DNA, 35 bp, Artificial Sequence
  Synthetic oligonucleotide
tagtgataagccagggtgttaggggtgagctgcat

SEQ ID NO: 84071 - DNA, 35 bp, Artificial Sequence
  Synthetic oligonucleotide
tacctcggggggttgccgtttgcattttctttcat

SEQ ID NO: 84072 - DNA, 35 bp, Artificial Sequence
  Synthetic oligonucleotide
ggatccgatcgttcccatcaagtgcctgctattat

SEQ ID NO: 84073 - DNA, 35 bp, Artificial Sequence
  Synthetic oligonucleotide
tgctctccccgtccagctttcttcgacataagcct

SEQ ID NO: 84074 - DNA, 35 bp, Artificial Sequence
  Synthetic oligonucleotide
tgagctaagttgcaccctgtcgtttccactatcct

SEQ ID NO: 84075 - DNA, 35 bp, Artificial Sequence
  Synthetic oligonucleotide
gactgtcagaaccccgaccttattgccctactcct

SEQ ID NO: 84076 - DNA, 35 bp, Artificial Sequence
  Synthetic oligonucleotide
agtcactggacgccgccgttaaatttcgcgcctct

SEQ ID NO: 84077 - DNA, 35 bp, Artificial Sequence
  Synthetic oligonucleotide
gacggacgcatctcgtgcccgcgctgatctcctct

SEQ ID NO: 84078 - DNA, 35 bp, Artificial Sequence
  Synthetic oligonucleotide
tagtcgcccgtcaaaccaccgaagttctagtctct

SEQ ID NO: 84079 - DNA, 35 bp, Artificial Sequence
  Synthetic oligonucleotide
ttcagacggtggcaatgtaggaaacaggttgtagt

SEQ ID NO: 84080 - DNA, 32 bp, Artificial Sequence
  Synthetic oligonucleotide
tcaaaagcaacgtcactaaccgaactcaccgt

SEQ ID NO: 84081 - DNA, 34 bp, Artificial Sequence
  Synthetic oligonucleotide
tgcctaggcagaaacaccacctcccccataaggt

SEQ ID NO: 84082 - DNA, 35 bp, Artificial Sequence
  Synthetic oligonucleotide
aacatccttgccataagactaactttccatccggt

SEQ ID NO: 84083 - DNA, 35 bp, Artificial Sequence
  Synthetic oligonucleotide
tgatccacctggttatacatacgcctccctattgt

SEQ ID NO: 84084 - DNA, 35 bp, Artificial Sequence
  Synthetic oligonucleotide
gttaaaccacccgccccccggacgtagttgcactt

SEQ ID NO: 84085 - DNA, 35 bp, Artificial Sequence
  Synthetic oligonucleotide
taccctactgtgattagtacacgtgacccgccctt

SEQ ID NO: 84086 - DNA, 35 bp, Artificial Sequence
  Synthetic oligonucleotide
taaccatcctttgtcgaagaccgtatatcggcctt

SEQ ID NO: 84087 - DNA, 35 bp, Artificial Sequence
  Synthetic oligonucleotide
gcctacccctatctccatggtactatgtatatctt

SEQ ID NO: 84088 - DNA, 35 bp, Artificial Sequence
  Synthetic oligonucleotide
gcctggcaataccaacaagatgtccgccgcccttt

SEQ ID NO: 84089 - DNA, 35 bp, Artificial Sequence
  Synthetic oligonucleotide
gaagccattcttggctcttgagatttctgcatttt

SEQ ID NO: 84090 - DNA, 35 bp, Artificial Sequence
  Synthetic oligonucleotide
gttcaagctgcatgggatccgttccgtactgtttt

SEQ ID NO: 84091 - DNA, 36 bp, Artificial Sequence
  Synthetic oligonucleotide
gccaacgccccctcccatgtcgggctgaaggaacaa

SEQ ID NO: 84092 - DNA, 35 bp, Artificial Sequence
  Synthetic oligonucleotide
gtgtcatacgtctcttgctctatgctattgccgaa

SEQ ID NO: 84093 - DNA, 36 bp, Artificial Sequence
  Synthetic oligonucleotide
gtaccgtcaggtggataggtaagggagggataggaa

SEQ ID NO: 84094 - DNA, 36 bp, Artificial Sequence
  Synthetic oligonucleotide
tctatccccctgtatccaccagtttcgtcctaggaa

SEQ ID NO: 84095 - DNA, 34 bp, Artificial Sequence
  Synthetic oligonucleotide
atacgccaccgactagcccgcccatcacccggaa

SEQ ID NO: 84096 - DNA, 35 bp, Artificial Sequence
  Synthetic oligonucleotide
tcaactcttgccctccgcctcacacgtgtccggaa

SEQ ID NO: 84097 - DNA, 36 bp, Artificial Sequence
  Synthetic oligonucleotide
gattgccacccctacgtattatggtccccagatgaa

SEQ ID NO: 84098 - DNA, 36 bp, Artificial Sequence
  Synthetic oligonucleotide
gagagggtggagattaggggatgcgccatgcttgaa

SEQ ID NO: 84099 - DNA, 36 bp, Artificial Sequence
  Synthetic oligonucleotide
agaaccacgcaacattcgccggggacgcccctataa

SEQ ID NO: 84100 - DNA, 36 bp, Artificial Sequence
  Synthetic oligonucleotide
gatcttgaccccatggtctaatgacaccttcactaa

SEQ ID NO: 84101 - DNA, 35 bp, Artificial Sequence
  Synthetic oligonucleotide
gatgaaattcgtgtggggagcgggggggtggaaca

SEQ ID NO: 84102 - DNA, 35 bp, Artificial Sequence
  Synthetic oligonucleotide
tttaagatcgcctgcctgccttcttatagaccaca

SEQ ID NO: 84103 - DNA, 36 bp, Artificial Sequence
  Synthetic oligonucleotide
gatgcgtgacaattattgttcttccgtaccctcaca

SEQ ID NO: 84104 - DNA, 36 bp, Artificial Sequence
  Synthetic oligonucleotide
gaactgcagccggtaagcacccctatactagtgaca

SEQ ID NO: 84105 - DNA, 36 bp, Artificial Sequence
  Synthetic oligonucleotide
atgattcccgccctattatgaccgctcagtcttaca

SEQ ID NO: 84106 - DNA, 36 bp, Artificial Sequence
  Synthetic oligonucleotide
atacgtgagacgcaaattaagccaccatcgtttcca

SEQ ID NO: 84107 - DNA, 36 bp, Artificial Sequence
  Synthetic oligonucleotide
gacgcgcacatttatcgtacaactcaagccgtggca

SEQ ID NO: 84108 - DNA, 36 bp, Artificial Sequence
  Synthetic oligonucleotide
tgcgacgatcctcgttgtccttgatcattccgtgca

SEQ ID NO: 84109 - DNA, 36 bp, Artificial Sequence
  Synthetic oligonucleotide
gtgggagtgaccccagcaaattatctgacccttgca

SEQ ID NO: 84110 - DNA, 36 bp, Artificial Sequence
  Synthetic oligonucleotide
atcgttgctacgcgctgagcacgtttcacctcatca

SEQ ID NO: 84111 - DNA, 36 bp, Artificial Sequence
  Synthetic oligonucleotide
aagtcgccacatgtccaggcccagtttcacgcctca

SEQ ID NO: 84112 - DNA, 36 bp, Artificial Sequence
  Synthetic oligonucleotide
gtgaccccgagctgcggatcagatcctgccacgtca

SEQ ID NO: 84113 - DNA, 35 bp, Artificial Sequence
  Synthetic oligonucleotide
ttgcaccgcgggcaacgaatcatcctcccttgtca

SEQ ID NO: 84114 - DNA, 35 bp, Artificial Sequence
  Synthetic oligonucleotide
gaagcaatccgcaatagtaggtcatattcccttca

SEQ ID NO: 84115 - DNA, 36 bp, Artificial Sequence
  Synthetic oligonucleotide
gcacatgctcatatggcatcgctaaatgttccttca

SEQ ID NO: 84116 - DNA, 36 bp, Artificial Sequence
  Synthetic oligonucleotide
tcatattgcgcagaacgccctttctcgtagttttca

SEQ ID NO: 84117 - DNA, 37 bp, Artificial Sequence
  Synthetic oligonucleotide
attcacacggcgtcatctttgctctctaccaggcaga

SEQ ID NO: 84118 - DNA, 37 bp, Artificial Sequence
  Synthetic oligonucleotide
atgccctcacactagtttttcagctgactatcataga

SEQ ID NO: 84119 - DNA, 37 bp, Artificial Sequence
  Synthetic oligonucleotide
tggagggtatagggtgggagggaagtattctaaccga

SEQ ID NO: 84120 - DNA, 36 bp, Artificial Sequence
  Synthetic oligonucleotide
tgacacgctcgcttcataagcatttctgaccaccga

SEQ ID NO: 84121 - DNA, 37 bp, Artificial Sequence
  Synthetic oligonucleotide
ttcgcatgctacctgccgttagaaagtctctcaccga

SEQ ID NO: 84122 - DNA, 37 bp, Artificial Sequence
  Synthetic oligonucleotide
gatggcacgaacgtccaatttgcccctgtatacccga

SEQ ID NO: 84123 - DNA, 37 bp, Artificial Sequence
  Synthetic oligonucleotide
accggttgaacgcccattgctgaaactaattccccga

SEQ ID NO: 84124 - DNA, 37 bp, Artificial Sequence
  Synthetic oligonucleotide
gcacatcacaaaattgcctacgcctatacagacgcga

SEQ ID NO: 84125 - DNA, 37 bp, Artificial Sequence
  Synthetic oligonucleotide
ttgagcgcagtatactcttgcaccttctacacggcga

SEQ ID NO: 84126 - DNA, 37 bp, Artificial Sequence
  Synthetic oligonucleotide
gagaggagaagtggagctgaacagacggtgtatgcga

SEQ ID NO: 84127 - DNA, 35 bp, Artificial Sequence
  Synthetic oligonucleotide
tgtgtgtcaatccccgccgttcccgagcatatcga

SEQ ID NO: 84128 - DNA, 37 bp, Artificial Sequence
  Synthetic oligonucleotide
gcgcatgggagaaatggagattgaggagatgtgtcga

SEQ ID NO: 84129 - DNA, 37 bp, Artificial Sequence
  Synthetic oligonucleotide
tcattccgaggcaggtcttctcgcccccctttttcga

SEQ ID NO: 84130 - DNA, 36 bp, Artificial Sequence
  Synthetic oligonucleotide
tgcgaagggggcactcattgggacaggggggcagga

SEQ ID NO: 84131 - DNA, 37 bp, Artificial Sequence
  Synthetic oligonucleotide
gtggtccggaggggtggaataggagccatgtagagga

SEQ ID NO: 84132 - DNA, 37 bp, Artificial Sequence
  Synthetic oligonucleotide
tcgccggcccggcctcccaatatgctcattcaacgga

SEQ ID NO: 84133 - DNA, 34 bp, Artificial Sequence
  Synthetic oligonucleotide
tcccgcaccctcttacctactttgctgcaaggga

SEQ ID NO: 84134 - DNA, 37 bp, Artificial Sequence
  Synthetic oligonucleotide
acacgggaaaggggcaagtggtattgggagtgaggga

SEQ ID NO: 84135 - DNA, 37 bp, Artificial Sequence
  Synthetic oligonucleotide
gatgggagtgatcggcaacaagggcattagggcggga

SEQ ID NO: 84136 - DNA, 36 bp, Artificial Sequence
  Synthetic oligonucleotide
tgacccatcctcattatacgctggaactttcgggga

SEQ ID NO: 84137 - DNA, 37 bp, Artificial Sequence
  Synthetic oligonucleotide
tgccgggggggtggtatggtgaaggtagagcgatgga

SEQ ID NO: 84138 - DNA, 37 bp, Artificial Sequence
  Synthetic oligonucleotide
ttcgtaacctcccgaaggcttgcacattaacactgga

SEQ ID NO: 84139 - DNA, 37 bp, Artificial Sequence
  Synthetic oligonucleotide
tgctaactcaccggtgattacgccttctcttggtgga

SEQ ID NO: 84140 - DNA, 37 bp, Artificial Sequence
  Synthetic oligonucleotide
ggtggaaggtagtggtggttaattgggagagtttgga

SEQ ID NO: 84141 - DNA, 38 bp, Artificial Sequence
  Synthetic oligonucleotide
ttgggtggtggaggaagcaacgggatcaagagacatga

SEQ ID NO: 84142 - DNA, 38 bp, Artificial Sequence
  Synthetic oligonucleotide
tgctgctcatagcgtacactggctgcacctactcatga

SEQ ID NO: 84143 - DNA, 38 bp, Artificial Sequence
  Synthetic oligonucleotide
gtgtcccggggagagcataagggatgggagcaggatga

SEQ ID NO: 84144 - DNA, 37 bp, Artificial Sequence
  Synthetic oligonucleotide
gctggcggccctctgcacccgcacctgttatcactga

SEQ ID NO: 84145 - DNA, 38 bp, Artificial Sequence
  Synthetic oligonucleotide
cccgccgtcaccccctacccgcactcagaaggacctga

SEQ ID NO: 84146 - DNA, 38 bp, Artificial Sequence
  Synthetic oligonucleotide
taccaaccaggagctcctactgcattcatctcgcctga

SEQ ID NO: 84147 - DNA, 38 bp, Artificial Sequence
  Synthetic oligonucleotide
acaccatttccgtacaggacgattcaacactggcctga

SEQ ID NO: 84148 - DNA, 38 bp, Artificial Sequence
  Synthetic oligonucleotide
gcaatcacacatgtcttcgagcgtatgccatatcctga

SEQ ID NO: 84149 - DNA, 37 bp, Artificial Sequence
  Synthetic oligonucleotide
acgccggaaggcagttacgaaaaatgggaagtcctga

SEQ ID NO: 84150 - DNA, 38 bp, Artificial Sequence
  Synthetic oligonucleotide
acgaagcctgggggggagggcccaaataggtgggctga

SEQ ID NO: 84151 - DNA, 37 bp, Artificial Sequence
  Synthetic oligonucleotide
gagctgcccctacttgtcgagctctccttatatctga

SEQ ID NO: 84152 - DNA, 37 bp, Artificial Sequence
  Synthetic oligonucleotide
ttgacactacggcataagtcaacactacgcactctga

SEQ ID NO: 84153 - DNA, 38 bp, Artificial Sequence
  Synthetic oligonucleotide
tatctcaccgccctattgccgcatccgggacatcgtga

SEQ ID NO: 84154 - DNA, 35 bp, Artificial Sequence
  Synthetic oligonucleotide
gtcacatcaacccccctagaacaaagcagtcgtga

SEQ ID NO: 84155 - DNA, 37 bp, Artificial Sequence
  Synthetic oligonucleotide
tacatagggcggggctgcggggagacgctgggggtga

SEQ ID NO: 84156 - DNA, 38 bp, Artificial Sequence
  Synthetic oligonucleotide
gcttacgacgaagtgtgaggacaaagggtggatggtga

SEQ ID NO: 84157 - DNA, 38 bp, Artificial Sequence
  Synthetic oligonucleotide
gtgggttagcagtggggtgggctatcggaatgatgtga

SEQ ID NO: 84158 - DNA, 38 bp, Artificial Sequence
  Synthetic oligonucleotide
gttcaaaggagaggaataggaagtacgaacaactgtga

SEQ ID NO: 84159 - DNA, 38 bp, Artificial Sequence
  Synthetic oligonucleotide
tgtacgtcaagcccctcgcgtttcttcactgcctgtga

SEQ ID NO: 84160 - DNA, 38 bp, Artificial Sequence
  Synthetic oligonucleotide
gctgtccacgttgttccttgtctctggcgccctattga

SEQ ID NO: 84161 - DNA, 38 bp, Artificial Sequence
  Synthetic oligonucleotide
acgatcgccagtgtgcttcccatacacctccgcgttga

SEQ ID NO: 84162 - DNA, 37 bp, Artificial Sequence
  Synthetic oligonucleotide
gattcatgcaggggacggcgtttgaggggaaggttga

SEQ ID NO: 84163 - DNA, 37 bp, Artificial Sequence
  Synthetic oligonucleotide
tgcccaacgccgaaccacctgaagtaatcgtatttga

SEQ ID NO: 84164 - DNA, 38 bp, Artificial Sequence
  Synthetic oligonucleotide
gcagtgcacgggtttaggtggcttacggggtggtttga

SEQ ID NO: 84165 - DNA, 38 bp, Artificial Sequence
  Synthetic oligonucleotide
acccgccgccgtacggcagaacggtgaactacttttga

SEQ ID NO: 84166 - DNA, 38 bp, Artificial Sequence
  Synthetic oligonucleotide
tcagacgtccccgcgctaataccatacggaccttttga

SEQ ID NO: 84167 - DNA, 36 bp, Artificial Sequence
  Synthetic oligonucleotide
aagacctggccaacatggtggaggggaaggtatata

SEQ ID NO: 84168 - DNA, 36 bp, Artificial Sequence
  Synthetic oligonucleotide
tagtgctcccgccggtactcccttactcaatttata

SEQ ID NO: 84169 - DNA, 35 bp, Artificial Sequence
  Synthetic oligonucleotide
gctatactgtcgcccgttacctgttcttcacccta

SEQ ID NO: 84170 - DNA, 36 bp, Artificial Sequence
  Synthetic oligonucleotide
tacacctctcgatgccgtccgtagctattcagccta

SEQ ID NO: 84171 - DNA, 36 bp, Artificial Sequence
  Synthetic oligonucleotide
aaccaattcgtaactctgtgaagctcacctttccta

SEQ ID NO: 84172 - DNA, 36 bp, Artificial Sequence
  Synthetic oligonucleotide
gttccaccaggcgcactaatccccgcggctttccta

SEQ ID NO: 84173 - DNA, 36 bp, Artificial Sequence
  Synthetic oligonucleotide
agcctaccgccattcaaatctcgtccagtcatctta

SEQ ID NO: 84174 - DNA, 35 bp, Artificial Sequence
  Synthetic oligonucleotide
aaccaagcactgcgagaggtgcgttttggttctta

SEQ ID NO: 84175 - DNA, 35 bp, Artificial Sequence
  Synthetic oligonucleotide
gatcctgctccccaattggaatgacccgcgcacac

SEQ ID NO: 84176 - DNA, 35 bp, Artificial Sequence
  Synthetic oligonucleotide
tgatcggtaatgggaacgaacctcactattacacc

SEQ ID NO: 84177 - DNA, 35 bp, Artificial Sequence
  Synthetic oligonucleotide
accatacaacagtctgccaggcgccatcgcgcacc

SEQ ID NO: 84178 - DNA, 35 bp, Artificial Sequence
  Synthetic oligonucleotide
gcattatacctcagcccacattttggtactcgacc

SEQ ID NO: 84179 - DNA, 35 bp, Artificial Sequence
  Synthetic oligonucleotide
gctccactgctacacgcaaccctgatctaatgccc

SEQ ID NO: 84180 - DNA, 35 bp, Artificial Sequence
  Synthetic oligonucleotide
gacttgggtcccggccgacgtcgaagatcgctccc

SEQ ID NO: 84181 - DNA, 35 bp, Artificial Sequence
  Synthetic oligonucleotide
acctcgccatcagccgacaatccgtgtcgtattcc

SEQ ID NO: 84182 - DNA, 35 bp, Artificial Sequence
  Synthetic oligonucleotide
tccaaggctgtcgtgtgcctacatctgctccccgc

SEQ ID NO: 84183 - DNA, 35 bp, Artificial Sequence
  Synthetic oligonucleotide
acccatccacgttctcgccttagcttcatgaaggc

SEQ ID NO: 84184 - DNA, 35 bp, Artificial Sequence
  Synthetic oligonucleotide
taccactcgattccctggccgtaaaagactcgggc

SEQ ID NO: 84185 - DNA, 35 bp, Artificial Sequence
  Synthetic oligonucleotide
acgtccgtccgcccccctgtcctatccatgtatgc

SEQ ID NO: 84186 - DNA, 35 bp, Artificial Sequence
  Synthetic oligonucleotide
tcccatctagcgacagcagaccgtcgttcctgctc

SEQ ID NO: 84187 - DNA, 35 bp, Artificial Sequence
  Synthetic oligonucleotide
acatagcatcgcgcacgtggcgaagtccccttgtc

SEQ ID NO: 84188 - DNA, 35 bp, Artificial Sequence
  Synthetic oligonucleotide
tctgcgagtaggctgcttcagatctctccccgttc

SEQ ID NO: 84189 - DNA, 35 bp, Artificial Sequence
  Synthetic oligonucleotide
tacataacacgaactcatggtaaacgcccaacgag

SEQ ID NO: 84190 - DNA, 35 bp, Artificial Sequence
  Synthetic oligonucleotide
accgtccgacctcccgttatgcctatacacacgag

SEQ ID NO: 84191 - DNA, 35 bp, Artificial Sequence
  Synthetic oligonucleotide
gacggttccgaaaggtggagggcaggatattgacg

SEQ ID NO: 84192 - DNA, 35 bp, Artificial Sequence
  Synthetic oligonucleotide
gagcgcgcccctagcattacttcgcaccgccttcg

SEQ ID NO: 84193 - DNA, 35 bp, Artificial Sequence
  Synthetic oligonucleotide
gatacgaactgagctccacggcctccattgccagg

SEQ ID NO: 84194 - DNA, 35 bp, Artificial Sequence
  Synthetic oligonucleotide
attggatgagcgcttgggtggacaggtgagtgagg

SEQ ID NO: 84195 - DNA, 35 bp, Artificial Sequence
  Synthetic oligonucleotide
gatgcttacgcctgccaccccataccgactatcgg

SEQ ID NO: 84196 - DNA, 35 bp, Artificial Sequence
  Synthetic oligonucleotide
gactcagccagtctatgtttcctaccccaatgatg

SEQ ID NO: 84197 - DNA, 35 bp, Artificial Sequence
  Synthetic oligonucleotide
accttacatccacagcacggaccttgcaatcgctg

SEQ ID NO: 84198 - DNA, 35 bp, Artificial Sequence
  Synthetic oligonucleotide
aaatcagctcgcattcgtcggtcatactggttctg

SEQ ID NO: 84199 - DNA, 35 bp, Artificial Sequence
  Synthetic oligonucleotide
ttgacggtgggatgggctggataagtagtggtgtg

SEQ ID NO: 84200 - DNA, 35 bp, Artificial Sequence
  Synthetic oligonucleotide
tgcgaagcacgacctgaatttctctgtgcatacat

SEQ ID NO: 84201 - DNA, 35 bp, Artificial Sequence
  Synthetic oligonucleotide
atgtcgtaaacgatcccgactatcctttgctatct

SEQ ID NO: 84202 - DNA, 35 bp, Artificial Sequence
  Synthetic oligonucleotide
gccactcttgtacgaacagaacatgaggacactct

SEQ ID NO: 84203 - DNA, 36 bp, Artificial Sequence
  Synthetic oligonucleotide
agtccgcgccccgcatgatccatcgtttccagccgt

SEQ ID NO: 84204 - DNA, 35 bp, Artificial Sequence
  Synthetic oligonucleotide
gtgaaatcgcagcatatttggccaccggttagggt

SEQ ID NO: 84205 - DNA, 35 bp, Artificial Sequence
  Synthetic oligonucleotide
tttaccctgcccattcagtacccccaaggactggt

SEQ ID NO: 84206 - DNA, 35 bp, Artificial Sequence
  Synthetic oligonucleotide
tcaagctgcggtagggaacttagggacggggatgt

SEQ ID NO: 84207 - DNA, 35 bp, Artificial Sequence
  Synthetic oligonucleotide
taacagagcctgatcgcccggaccaccatctctgt

SEQ ID NO: 84208 - DNA, 35 bp, Artificial Sequence
  Synthetic oligonucleotide
aacaacgctgatcctgtgggtctaggggagggtgt

SEQ ID NO: 84209 - DNA, 35 bp, Artificial Sequence
  Synthetic oligonucleotide
gaccaggagcgcagactctcactttgacctcactt

SEQ ID NO: 84210 - DNA, 35 bp, Artificial Sequence
  Synthetic oligonucleotide
tgcacacgaactctttaacttgacaccgcggactt

SEQ ID NO: 84211 - DNA, 35 bp, Artificial Sequence
  Synthetic oligonucleotide
gttgcccccacacactcatctacatgaacttggtt

SEQ ID NO: 84212 - DNA, 35 bp, Artificial Sequence
  Synthetic oligonucleotide
tcagtgagaagggtagcagggagggaatgggtgtt

SEQ ID NO: 84213 - DNA, 35 bp, Artificial Sequence
  Synthetic oligonucleotide
gcctaacctgacggcgcttttccgtgaccttgttt

SEQ ID NO: 84214 - DNA, 36 bp, Artificial Sequence
  Synthetic oligonucleotide
agccaaggccaatactgtctattcagctcaactaaa

SEQ ID NO: 84215 - DNA, 35 bp, Artificial Sequence
  Synthetic oligonucleotide
tcccctatccgtcttgtgcccatggcgtcctacaa

SEQ ID NO: 84216 - DNA, 36 bp, Artificial Sequence
  Synthetic oligonucleotide
tagggacaacaacacatgatctggcgaaatacccaa

SEQ ID NO: 84217 - DNA, 36 bp, Artificial Sequence
  Synthetic oligonucleotide
ttgcaccaacattccgcttttacttagtccgtccaa

SEQ ID NO: 84218 - DNA, 36 bp, Artificial Sequence
  Synthetic oligonucleotide
ttgacgtcccctggttcgggtattgtctcggatcaa

SEQ ID NO: 84219 - DNA, 35 bp, Artificial Sequence
  Synthetic oligonucleotide
gcgcatcccacgagccataaatccgaacaatcgaa

SEQ ID NO: 84220 - DNA, 35 bp, Artificial Sequence
  Synthetic oligonucleotide
tgcctctactagcactctccgcaacgcttgccaca

SEQ ID NO: 84221 - DNA, 35 bp, Artificial Sequence
  Synthetic oligonucleotide
tcccgtcccgtatggaacctcacaattgcccacca

SEQ ID NO: 84222 - DNA, 35 bp, Artificial Sequence
  Synthetic oligonucleotide
acgataaaccgcccctctactgtgggctctcacca

SEQ ID NO: 84223 - DNA, 36 bp, Artificial Sequence
  Synthetic oligonucleotide
tctagctgactcgctcaatggccgttttccacccca

SEQ ID NO: 84224 - DNA, 36 bp, Artificial Sequence
  Synthetic oligonucleotide
aagaccacgtcgctggtatcacgagttgatgtccca

SEQ ID NO: 84225 - DNA, 36 bp, Artificial Sequence
  Synthetic oligonucleotide
ttacgccctgtctaaaggtaccctctgtccttccca

SEQ ID NO: 84226 - DNA, 36 bp, Artificial Sequence
  Synthetic oligonucleotide
actctcggctaacatgcacacactagaccggtgcca

SEQ ID NO: 84227 - DNA, 35 bp, Artificial Sequence
  Synthetic oligonucleotide
gcccgaccgggagcctcacgccgacgcatcatcca

SEQ ID NO: 84228 - DNA, 35 bp, Artificial Sequence
  Synthetic oligonucleotide
tatgggcaccgctacacctttcgccttctaagtca

SEQ ID NO: 84229 - DNA, 36 bp, Artificial Sequence
  Synthetic oligonucleotide
aaagcacacctgtaatacgtactatttatcctgtca

SEQ ID NO: 84230 - DNA, 36 bp, Artificial Sequence
  Synthetic oligonucleotide
accattgcagtgtccggctggaacatctccacttca

SEQ ID NO: 84231 - DNA, 35 bp, Artificial Sequence
  Synthetic oligonucleotide
tgctcacagtccctacatttgaccccgttctttca

SEQ ID NO: 84232 - DNA, 37 bp, Artificial Sequence
  Synthetic oligonucleotide
gccccaacccctgtgtcgctttgaattgattggcaga

SEQ ID NO: 84233 - DNA, 37 bp, Artificial Sequence
  Synthetic oligonucleotide
gcattgtgagtgggggtatggtgggaatgcatagaga

SEQ ID NO: 84234 - DNA, 36 bp, Artificial Sequence
  Synthetic oligonucleotide
tagaactgggtgagagatgtagggtgagtgaggaga

SEQ ID NO: 84235 - DNA, 36 bp, Artificial Sequence
  Synthetic oligonucleotide
gagacgcatggagtgggtggtctgacgacgggtaga

SEQ ID NO: 84236 - DNA, 35 bp, Artificial Sequence
  Synthetic oligonucleotide
gccacacacatcgcgcgctacaactacatagacga

SEQ ID NO: 84237 - DNA, 37 bp, Artificial Sequence
  Synthetic oligonucleotide
aagtcgagcgtagcggtgggggcgacggggccgacga

SEQ ID NO: 84238 - DNA, 37 bp, Artificial Sequence
  Synthetic oligonucleotide
actcaccgcacaagcatttcgacggtcccttcgacga

SEQ ID NO: 84239 - DNA, 35 bp, Artificial Sequence
  Synthetic oligonucleotide
agtcccgtcacctgtcccacccgggtacccgccga

SEQ ID NO: 84240 - DNA, 37 bp, Artificial Sequence
  Synthetic oligonucleotide
gcatcctgcgacgccggccgcgagtcctcctctccga

SEQ ID NO: 84241 - DNA, 37 bp, Artificial Sequence
  Synthetic oligonucleotide
tggtgactgggggggtgtgggatgggctaatgcgcga

SEQ ID NO: 84242 - DNA, 37 bp, Artificial Sequence
  Synthetic oligonucleotide
gacgagtgtataaggtgtggtttgaggaaaggggcga

SEQ ID NO: 84243 - DNA, 37 bp, Artificial Sequence
  Synthetic oligonucleotide
ttgtagcgcagtcaatctgttcttcctttgtgtgcga

SEQ ID NO: 84244 - DNA, 36 bp, Artificial Sequence
  Synthetic oligonucleotide
ttcgtcacaaaccacatatgcattacccgttatcga

SEQ ID NO: 84245 - DNA, 37 bp, Artificial Sequence
  Synthetic oligonucleotide
gcgtgtcagggcgtcggaaggaagggaaggtggtcga

SEQ ID NO: 84246 - DNA, 37 bp, Artificial Sequence
  Synthetic oligonucleotide
atcaggcccatgcatgctgcttctatcattaccagga

SEQ ID NO: 84247 - DNA, 37 bp, Artificial Sequence
  Synthetic oligonucleotide
tgcagaaccgtcacccatcttctcagcattctcagga

SEQ ID NO: 84248 - DNA, 37 bp, Artificial Sequence
  Synthetic oligonucleotide
gcagacccttgcccctgccagatcgctcttatccgga

SEQ ID NO: 84249 - DNA, 37 bp, Artificial Sequence
  Synthetic oligonucleotide
atcacatgcaggtggatggcgacaactgtgggaggga

SEQ ID NO: 84250 - DNA, 37 bp, Artificial Sequence
  Synthetic oligonucleotide
tgttcaacactcacacgccactgcgcgactcgcggga

SEQ ID NO: 84251 - DNA, 37 bp, Artificial Sequence
  Synthetic oligonucleotide
tatgtcccaaacgaagtgtacccaaacccaatcggga

SEQ ID NO: 84252 - DNA, 35 bp, Artificial Sequence
  Synthetic oligonucleotide
gcgtgagtggggtgtactttgggtggcgaggggga

SEQ ID NO: 84253 - DNA, 36 bp, Artificial Sequence
  Synthetic oligonucleotide
agtgggcagggaaataacggaatggagatcgtggga

SEQ ID NO: 84254 - DNA, 37 bp, Artificial Sequence
  Synthetic oligonucleotide
agcagggggaaagagggaagaatcgagattcgtggga

SEQ ID NO: 84255 - DNA, 37 bp, Artificial Sequence
  Synthetic oligonucleotide
ggtggggcagggcggaaaatgtagcatgtgggtggga

SEQ ID NO: 84256 - DNA, 37 bp, Artificial Sequence
  Synthetic oligonucleotide
gcatgcagagggggggggaaaaagatgtgtgttggga

SEQ ID NO: 84257 - DNA, 36 bp, Artificial Sequence
  Synthetic oligonucleotide
aggacgggggacaagtgggtagtgcaattatatgga

SEQ ID NO: 84258 - DNA, 37 bp, Artificial Sequence
  Synthetic oligonucleotide
tcatgccgggcctcgcgtaagccattacttccctgga

SEQ ID NO: 84259 - DNA, 37 bp, Artificial Sequence
  Synthetic oligonucleotide
tctgccgatggggagggtggaagaatattgagctgga

SEQ ID NO: 84260 - DNA, 37 bp, Artificial Sequence
  Synthetic oligonucleotide
gtccaacggagaaaagcgaatgaatggtggtgctgga

SEQ ID NO: 84261 - DNA, 37 bp, Artificial Sequence
  Synthetic oligonucleotide
tgaacaacctccgcatggaagttatgtaccacttgga

SEQ ID NO: 84262 - DNA, 38 bp, Artificial Sequence
  Synthetic oligonucleotide
atcgcgtagcagatgaatggaactggggagttggatga

SEQ ID NO: 84263 - DNA, 38 bp, Artificial Sequence
  Synthetic oligonucleotide
accgaagaccctatcgagctatgacctatacagtatga

SEQ ID NO: 84264 - DNA, 37 bp, Artificial Sequence
  Synthetic oligonucleotide
acgcgacttggagagggtgggaggaagcgtacactga

SEQ ID NO: 84265 - DNA, 38 bp, Artificial Sequence
  Synthetic oligonucleotide
tccacccgctagatgcttgccaacggcttccccactga

SEQ ID NO: 84266 - DNA, 38 bp, Artificial Sequence
  Synthetic oligonucleotide
gacttcaccgaaggtctgtgctgtaatccttccactga

SEQ ID NO: 84267 - DNA, 38 bp, Artificial Sequence
  Synthetic oligonucleotide
gaaccagagctcagtggtcgctctccttctccacctga

SEQ ID NO: 84268 - DNA, 37 bp, Artificial Sequence
  Synthetic oligonucleotide
gccgaacgagaggtggacgggaggggtacgaggctga

SEQ ID NO: 84269 - DNA, 37 bp, Artificial Sequence
  Synthetic oligonucleotide
atgctccaccccctaggcatgcctgtcgagaccgtga

SEQ ID NO: 84270 - DNA, 38 bp, Artificial Sequence
  Synthetic oligonucleotide
ttgagggaggggtaatcaagggaattagtcacgcgtga

SEQ ID NO: 84271 - DNA, 37 bp, Artificial Sequence
  Synthetic oligonucleotide
gtgaacgaactaggtggggggcgaaaacaagaggtga

SEQ ID NO: 84272 - DNA, 38 bp, Artificial Sequence
  Synthetic oligonucleotide
tgggagggtcggtctgtattggttaaaggggtgggtga

SEQ ID NO: 84273 - DNA, 38 bp, Artificial Sequence
  Synthetic oligonucleotide
actgcggtcgccacggagagagaggacggtaactgtga

SEQ ID NO: 84274 - DNA, 38 bp, Artificial Sequence
  Synthetic oligonucleotide
gtgggaagaatgaggtagaatggggggaagtcctgtga

SEQ ID NO: 84275 - DNA, 38 bp, Artificial Sequence
  Synthetic oligonucleotide
gagcaaagaagaaaatgggcatacttgtaggggtgtga

SEQ ID NO: 84276 - DNA, 38 bp, Artificial Sequence
  Synthetic oligonucleotide
taccaccataggtccttctatccagtgaatcccattga

SEQ ID NO: 84277 - DNA, 38 bp, Artificial Sequence
  Synthetic oligonucleotide
tgcccgcatacgcttccacttgccgctcacacacttga

SEQ ID NO: 84278 - DNA, 37 bp, Artificial Sequence
  Synthetic oligonucleotide
gcgatcaccgggaccgctgcacttagaacgtacttga

SEQ ID NO: 84279 - DNA, 38 bp, Artificial Sequence
  Synthetic oligonucleotide
gcctgcccatcggccatcccactccttgacgtggttga

SEQ ID NO: 84280 - DNA, 38 bp, Artificial Sequence
  Synthetic oligonucleotide
tttggtcaagcctctccgctacgtacactcctatttga

SEQ ID NO: 84281 - DNA, 36 bp, Artificial Sequence
  Synthetic oligonucleotide
taacgttgcaaccggtcctaccccactcatctttga

SEQ ID NO: 84282 - DNA, 36 bp, Artificial Sequence
  Synthetic oligonucleotide
tcgccctcgcccctgccaccatctccgtacaccata

SEQ ID NO: 84283 - DNA, 35 bp, Artificial Sequence
  Synthetic oligonucleotide
gatgcccaccccgttctgtgcaacttgtacgtata

SEQ ID NO: 84284 - DNA, 36 bp, Artificial Sequence
  Synthetic oligonucleotide
tcccattcgcatgactgaggcatttaacgcatccta

SEQ ID NO: 84285 - DNA, 36 bp, Artificial Sequence
  Synthetic oligonucleotide
gcgcatacggatcgcgctgctttctagtttctccta

SEQ ID NO: 84286 - DNA, 36 bp, Artificial Sequence
  Synthetic oligonucleotide
aacaagtgcatcgtccgtatccaccgtcccgtccta

SEQ ID NO: 84287 - DNA, 36 bp, Artificial Sequence
  Synthetic oligonucleotide
tcaaagaggcaagtcgctggcccactcgaaaccgta

SEQ ID NO: 84288 - DNA, 37 bp, Artificial Sequence
  Synthetic oligonucleotide
atatcgcacatgtcggcgacctcacacccccgcatta

SEQ ID NO: 84289 - DNA, 36 bp, Artificial Sequence
  Synthetic oligonucleotide
actggagggacggagagggatagtgtatttgcatta

SEQ ID NO: 84290 - DNA, 35 bp, Artificial Sequence
  Synthetic oligonucleotide
gtgcatgacctctgcctgtaccttctgggggatta

SEQ ID NO: 84291 - DNA, 36 bp, Artificial Sequence
  Synthetic oligonucleotide
ctgcatgggagaccttcatcttggattgaaccctta

SEQ ID NO: 84292 - DNA, 36 bp, Artificial Sequence
  Synthetic oligonucleotide
gaacaggtcagagagatccatcccggcctttcctta

SEQ ID NO: 84293 - DNA, 36 bp, Artificial Sequence
  Synthetic oligonucleotide
tttcctcccctccgccagtctacgacaaagggctta

SEQ ID NO: 84294 - DNA, 36 bp, Artificial Sequence
  Synthetic oligonucleotide
ggtgaccgtcccattaagtcctggttactcctctta

SEQ ID NO: 84295 - DNA, 35 bp, Artificial Sequence
  Synthetic oligonucleotide
tagccggacagagctgggctacggtaggaacgtta

SEQ ID NO: 84296 - DNA, 36 bp, Artificial Sequence
  Synthetic oligonucleotide
tcacatgcctatctcctgccgagagctgcgaattta

SEQ ID NO: 84297 - DNA, 35 bp, Artificial Sequence
  Synthetic oligonucleotide
gtgccttgctccccgggagttcctcggatccgaac

SEQ ID NO: 84298 - DNA, 35 bp, Artificial Sequence
  Synthetic oligonucleotide
tatcctggccgcccccattcacgcgccttgtgaac

SEQ ID NO: 84299 - DNA, 35 bp, Artificial Sequence
  Synthetic oligonucleotide
gccctgacctccagtgaccgtaggccgatggtcac

SEQ ID NO: 84300 - DNA, 35 bp, Artificial Sequence
  Synthetic oligonucleotide
gggggcttccgcggggtggggagcaaaggggtgac

SEQ ID NO: 84301 - DNA, 35 bp, Artificial Sequence
  Synthetic oligonucleotide
gatgtgtggccccgcccttccaatattgcgtgacc

SEQ ID NO: 84302 - DNA, 35 bp, Artificial Sequence
  Synthetic oligonucleotide
agagaagcgcccaccgcgacgtaaaattcccgccc

SEQ ID NO: 84303 - DNA, 35 bp, Artificial Sequence
  Synthetic oligonucleotide
aacccggagttgcagtcaaatcactgttacgtccc

SEQ ID NO: 84304 - DNA, 35 bp, Artificial Sequence
  Synthetic oligonucleotide
gaatccgctaactagctgcccctgggtggcatgcc

SEQ ID NO: 84305 - DNA, 35 bp, Artificial Sequence
  Synthetic oligonucleotide
tcatgcgctttccattatccttgtggcaggcatcc

SEQ ID NO: 84306 - DNA, 35 bp, Artificial Sequence
  Synthetic oligonucleotide
ttttcctcaccggttccgcctcgacgtttacatgc

SEQ ID NO: 84307 - DNA, 35 bp, Artificial Sequence
  Synthetic oligonucleotide
gccaccggcacggacattaccacagcaccttaatc

SEQ ID NO: 84308 - DNA, 35 bp, Artificial Sequence
  Synthetic oligonucleotide
tatatgcaccctctctggtcactggttcaggtatc

SEQ ID NO: 84309 - DNA, 35 bp, Artificial Sequence
  Synthetic oligonucleotide
tgttgcctggtatgccatcatgttcctgcaaactc

SEQ ID NO: 84310 - DNA, 35 bp, Artificial Sequence
  Synthetic oligonucleotide
accatgtagggcctgaatcgcctagcttaactctc

SEQ ID NO: 84311 - DNA, 35 bp, Artificial Sequence
  Synthetic oligonucleotide
tcatgtgccaggaactctttctctcaacggaagtc

SEQ ID NO: 84312 - DNA, 35 bp, Artificial Sequence
  Synthetic oligonucleotide
gctgggcacgactagatttgatctacttttcggtc

SEQ ID NO: 84313 - DNA, 35 bp, Artificial Sequence
  Synthetic oligonucleotide
ttcgtctctcaggtgcccctattacgttcgctgtc

SEQ ID NO: 84314 - DNA, 35 bp, Artificial Sequence
  Synthetic oligonucleotide
gaagggtcaatagctgaggacgtggtcggttgaag

SEQ ID NO: 84315 - DNA, 35 bp, Artificial Sequence
  Synthetic oligonucleotide
tccgctacccagccccggataatacatttaggtag

SEQ ID NO: 84316 - DNA, 35 bp, Artificial Sequence
  Synthetic oligonucleotide
tccgacgcccagccaacaggctaacctaaatggcg

SEQ ID NO: 84317 - DNA, 33 bp, Artificial Sequence
  Synthetic oligonucleotide
gtaacctccccccgttaacaacgagcatttgcg

SEQ ID NO: 84318 - DNA, 35 bp, Artificial Sequence
  Synthetic oligonucleotide
gacgtcgtcatccctcactccgttaccatcaaagg

SEQ ID NO: 84319 - DNA, 35 bp, Artificial Sequence
  Synthetic oligonucleotide
tagcgggggtggaactgggtctgagtttagagggg

SEQ ID NO: 84320 - DNA, 35 bp, Artificial Sequence
  Synthetic oligonucleotide
actatgcacaggctaggaagggacagggggtgggg

SEQ ID NO: 84321 - DNA, 35 bp, Artificial Sequence
  Synthetic oligonucleotide
cgacagactgactcaccatggttacgaatggctgg

SEQ ID NO: 84322 - DNA, 35 bp, Artificial Sequence
  Synthetic oligonucleotide
tcacggtcgggagtagttggtcgtcttccttcatg

SEQ ID NO: 84323 - DNA, 35 bp, Artificial Sequence
  Synthetic oligonucleotide
gtccgctccccttttaggtcattggtacacccgtg

SEQ ID NO: 84324 - DNA, 35 bp, Artificial Sequence
  Synthetic oligonucleotide
accatgcaaatggaggaggtaatgggttgggattg

SEQ ID NO: 84325 - DNA, 35 bp, Artificial Sequence
  Synthetic oligonucleotide
aacgctcccaggagtaacatcgaaattcatccttg

SEQ ID NO: 84326 - DNA, 35 bp, Artificial Sequence
  Synthetic oligonucleotide
ttgagcgggaaaccatttaagcgagaggcgggttg

SEQ ID NO: 84327 - DNA, 35 bp, Artificial Sequence
  Synthetic oligonucleotide
gtgatgaccgactgagtcctgtccccttgtttaat

SEQ ID NO: 84328 - DNA, 35 bp, Artificial Sequence
  Synthetic oligonucleotide
actcgcgtggccgtaccgtctgctctattgttcat

SEQ ID NO: 84329 - DNA, 35 bp, Artificial Sequence
  Synthetic oligonucleotide
gaaccgctgtgcgaatcacaatcactggcctctat

SEQ ID NO: 84330 - DNA, 35 bp, Artificial Sequence
  Synthetic oligonucleotide
tacatgacaatgggcaacgcactgaaactttggct

SEQ ID NO: 84331 - DNA, 35 bp, Artificial Sequence
  Synthetic oligonucleotide
tggagtcctccccactatgcctgcagctttatgct

SEQ ID NO: 84332 - DNA, 35 bp, Artificial Sequence
  Synthetic oligonucleotide
tacgctgggatctgccgcctcttgccgccttctct

SEQ ID NO: 84333 - DNA, 35 bp, Artificial Sequence
  Synthetic oligonucleotide
atcgcgaaggtaggcgaatgggtaggactgtaagt

SEQ ID NO: 84334 - DNA, 35 bp, Artificial Sequence
  Synthetic oligonucleotide
gccagccatgtggcgcccccaacaaccttccctgt

SEQ ID NO: 84335 - DNA, 35 bp, Artificial Sequence
  Synthetic oligonucleotide
acgtactgccgcaagaacggttttgggggctttgt

SEQ ID NO: 84336 - DNA, 35 bp, Artificial Sequence
  Synthetic oligonucleotide
gcctgtgcatttttgattttcccatttgtaccatt

SEQ ID NO: 84337 - DNA, 35 bp, Artificial Sequence
  Synthetic oligonucleotide
gcctggtcaaaacgttctctgtaggctggccactt

SEQ ID NO: 84338 - DNA, 35 bp, Artificial Sequence
  Synthetic oligonucleotide
tctggcacctcccccgtttctagtaacctaacctt

SEQ ID NO: 84339 - DNA, 35 bp, Artificial Sequence
  Synthetic oligonucleotide
cttgccagatccggtctttgcacgttagttggctt

SEQ ID NO: 84340 - DNA, 35 bp, Artificial Sequence
  Synthetic oligonucleotide
ggtggtgtggcacaggggggccgaaggaggaattt

SEQ ID NO: 84341 - DNA, 35 bp, Artificial Sequence
  Synthetic oligonucleotide
ccccccggagcaatctctgacccctggcatgattt

SEQ ID NO: 84342 - DNA, 35 bp, Artificial Sequence
  Synthetic oligonucleotide
taccgttcccatcaggtggtggccgtttgcccttt

SEQ ID NO: 84343 - DNA, 35 bp, Artificial Sequence
  Synthetic oligonucleotide
gagaagggtagagggttcggctgtggaccgggttt

SEQ ID NO: 84344 - DNA, 36 bp, Artificial Sequence
  Synthetic oligonucleotide
acaccgttctacatcttggccttcagctaccgcaaa

SEQ ID NO: 84345 - DNA, 35 bp, Artificial Sequence
  Synthetic oligonucleotide
aagcggggggggcgggggcaaagcatatcagtaaa

SEQ ID NO: 84346 - DNA, 36 bp, Artificial Sequence
  Synthetic oligonucleotide
ggaacaaagtagtatgacaaaaacggaaaaagacaa

SEQ ID NO: 84347 - DNA, 36 bp, Artificial Sequence
  Synthetic oligonucleotide
gttgccaacagtcgcagttaccgtgcaatcctacaa

SEQ ID NO: 84348 - DNA, 36 bp, Artificial Sequence
  Synthetic oligonucleotide
tggagggagggaggtaagctaaatgtaggtttataa

SEQ ID NO: 84349 - DNA, 36 bp, Artificial Sequence
  Synthetic oligonucleotide
gcccacggccgggaacatcatgacgcgtaaacctaa

SEQ ID NO: 84350 - DNA, 35 bp, Artificial Sequence
  Synthetic oligonucleotide
tgtacattctgccagcacctgttgaacgatctaca

SEQ ID NO: 84351 - DNA, 35 bp, Artificial Sequence
  Synthetic oligonucleotide
tccgaaaccttggagtggtgctttcttactgtaca

SEQ ID NO: 84352 - DNA, 35 bp, Artificial Sequence
  Synthetic oligonucleotide
tccaggccatacagtctcctgactgtcactaccca

SEQ ID NO: 84353 - DNA, 35 bp, Artificial Sequence
  Synthetic oligonucleotide
gtgacaagggccaaatgggtataacgggcgggcca

SEQ ID NO: 84354 - DNA, 36 bp, Artificial Sequence
  Synthetic oligonucleotide
tactccgctcgggccattaaacagattgcacctcca

SEQ ID NO: 84355 - DNA, 35 bp, Artificial Sequence
  Synthetic oligonucleotide
gatcgccatcctcgcagaagactattgtcgttcca

SEQ ID NO: 84356 - DNA, 36 bp, Artificial Sequence
  Synthetic oligonucleotide
tatggccccactctctgaatgacactcgatcacgca

SEQ ID NO: 84357 - DNA, 36 bp, Artificial Sequence
  Synthetic oligonucleotide
ggagccctgtactctcatgtatgttcaccgtttgca

SEQ ID NO: 84358 - DNA, 36 bp, Artificial Sequence
  Synthetic oligonucleotide
tccccaatcggcacacgtggccaaatcctctactca

SEQ ID NO: 84359 - DNA, 36 bp, Artificial Sequence
  Synthetic oligonucleotide
gatttgcctgcatcaccatctcatctagacggttca

SEQ ID NO: 84360 - DNA, 37 bp, Artificial Sequence
  Synthetic oligonucleotide
ttaagcaccatcacctgcagtcgagagcagagccaga

SEQ ID NO: 84361 - DNA, 36 bp, Artificial Sequence
  Synthetic oligonucleotide
aacaccacagagcggggacagagccgtacattcaga

SEQ ID NO: 84362 - DNA, 37 bp, Artificial Sequence
  Synthetic oligonucleotide
gccaagctgcagggaaggtcatagcaatacgacgaga

SEQ ID NO: 84363 - DNA, 37 bp, Artificial Sequence
  Synthetic oligonucleotide
gagcatgggtaaggtggcggccatggaagtggggaga

SEQ ID NO: 84364 - DNA, 37 bp, Artificial Sequence
  Synthetic oligonucleotide
gagcgtgtttaggaagggctaggggagggtttggaga

SEQ ID NO: 84365 - DNA, 37 bp, Artificial Sequence
  Synthetic oligonucleotide
aaccctcgctccatcctactacactacagcccctaga

SEQ ID NO: 84366 - DNA, 35 bp, Artificial Sequence
  Synthetic oligonucleotide
acatccccctgaagacataatgcctcccgtaacga

SEQ ID NO: 84367 - DNA, 37 bp, Artificial Sequence
  Synthetic oligonucleotide
acagcccgccggtgtctagggctctccttctctacga

SEQ ID NO: 84368 - DNA, 37 bp, Artificial Sequence
  Synthetic oligonucleotide
ggtcaatgagggggaagtaagtgcaaactgattacga

SEQ ID NO: 84369 - DNA, 37 bp, Artificial Sequence
  Synthetic oligonucleotide
tcaccgggcctgttatcaagcgccagagtactcccga

SEQ ID NO: 84370 - DNA, 36 bp, Artificial Sequence
  Synthetic oligonucleotide
gagcacctcccattgcccaggatagagccggatcga

SEQ ID NO: 84371 - DNA, 37 bp, Artificial Sequence
  Synthetic oligonucleotide
acgtgggacttcctcgctgcatttaacttttgatcga

SEQ ID NO: 84372 - DNA, 37 bp, Artificial Sequence
  Synthetic oligonucleotide
tgtacgcacgccgttctagtttagtggttcatctcga

SEQ ID NO: 84373 - DNA, 34 bp, Artificial Sequence
  Synthetic oligonucleotide
gcctcgcaccaacccgtgaccgcactcgtttcga

SEQ ID NO: 84374 - DNA, 37 bp, Artificial Sequence
  Synthetic oligonucleotide
tgtgttgaaggggatgtctgaagacaaggggggagga

SEQ ID NO: 84375 - DNA, 37 bp, Artificial Sequence
  Synthetic oligonucleotide
gggaggtgtggtaaggaggggtgagaaggactgagga

SEQ ID NO: 84376 - DNA, 37 bp, Artificial Sequence
  Synthetic oligonucleotide
gtggccggcccccatcctatattctcgtgcctgagga

SEQ ID NO: 84377 - DNA, 37 bp, Artificial Sequence
  Synthetic oligonucleotide
cacgcccacgcctccaccatgtcccaagcctcacgga

SEQ ID NO: 84378 - DNA, 37 bp, Artificial Sequence
  Synthetic oligonucleotide
atcgcatgtcgattcggcacctggtgggctggaggga

SEQ ID NO: 84379 - DNA, 36 bp, Artificial Sequence
  Synthetic oligonucleotide
gtgggacaacagaagcgcgatcagcggaggggggga

SEQ ID NO: 84380 - DNA, 37 bp, Artificial Sequence
  Synthetic oligonucleotide
gagaatcggacggggcgaggggacacactgttgggga

SEQ ID NO: 84381 - DNA, 34 bp, Artificial Sequence
  Synthetic oligonucleotide
accccgacctgtttcgcatgtttgcgacttggga

SEQ ID NO: 84382 - DNA, 36 bp, Artificial Sequence
  Synthetic oligonucleotide
tagtccaagcggtgaggtttttaggcaaggattgga

SEQ ID NO: 84383 - DNA, 36 bp, Artificial Sequence
  Synthetic oligonucleotide
tttcacccacaaactgccggccaggtagaccttgga

SEQ ID NO: 84384 - DNA, 38 bp, Artificial Sequence
  Synthetic oligonucleotide
tcgattctcccagttgctatcccgcctaatctcaatga

SEQ ID NO: 84385 - DNA, 38 bp, Artificial Sequence
  Synthetic oligonucleotide
ttggggctggttgacggaggtacgagggggggacatga

SEQ ID NO: 84386 - DNA, 37 bp, Artificial Sequence
  Synthetic oligonucleotide
aatggcatccactttgagctactaactgcatccatga

SEQ ID NO: 84387 - DNA, 38 bp, Artificial Sequence
  Synthetic oligonucleotide
tagaaacgccgggggaagcataaaacggtgtgagatga

SEQ ID NO: 84388 - DNA, 37 bp, Artificial Sequence
  Synthetic oligonucleotide
acaaggaaggggggggtgtgacgtggggaagggatga

SEQ ID NO: 84389 - DNA, 38 bp, Artificial Sequence
  Synthetic oligonucleotide
ggagggtcataaagggcgggatagtcagggaagtatga

SEQ ID NO: 84390 - DNA, 37 bp, Artificial Sequence
  Synthetic oligonucleotide
gagtagggccggaacgggaagaacgagagcggtatga

SEQ ID NO: 84391 - DNA, 38 bp, Artificial Sequence
  Synthetic oligonucleotide
gtccacgccacatctttctctcgatgcttcacgactga

SEQ ID NO: 84392 - DNA, 35 bp, Artificial Sequence
  Synthetic oligonucleotide
tgacctaccgaccctctcatagccccatggactga

SEQ ID NO: 84393 - DNA, 37 bp, Artificial Sequence
  Synthetic oligonucleotide
tgcgataagcgccacgatgatcgctcacttgccctga

SEQ ID NO: 84394 - DNA, 38 bp, Artificial Sequence
  Synthetic oligonucleotide
gccacggagctgctccttctgcacattgtttggcctga

SEQ ID NO: 84395 - DNA, 38 bp, Artificial Sequence
  Synthetic oligonucleotide
ttgctcgcagcactttctttttgttcacaggtcgctga

SEQ ID NO: 84396 - DNA, 38 bp, Artificial Sequence
  Synthetic oligonucleotide
tcaccatcctcacgccagccgcggtccccatgtgctga

SEQ ID NO: 84397 - DNA, 38 bp, Artificial Sequence
  Synthetic oligonucleotide
gccgcacctctatccagacctcttaatgtagccagtga

SEQ ID NO: 84398 - DNA, 38 bp, Artificial Sequence
  Synthetic oligonucleotide
ttgcgaccacggagcaaacaagaatgtctcccacgtga

SEQ ID NO: 84399 - DNA, 37 bp, Artificial Sequence
  Synthetic oligonucleotide
gagggaaagccagagataaaatcgtggtgaagggtga

SEQ ID NO: 84400 - DNA, 38 bp, Artificial Sequence
  Synthetic oligonucleotide
gcaaggggtggagaggcaaggttaatggtgcgtggtga

SEQ ID NO: 84401 - DNA, 38 bp, Artificial Sequence
  Synthetic oligonucleotide
gcaccagacgacgccctgctctagctgtctacctgtga

SEQ ID NO: 84402 - DNA, 38 bp, Artificial Sequence
  Synthetic oligonucleotide
agcaacgtcacttcgacctgctgccgtcttgtcattga

SEQ ID NO: 84403 - DNA, 38 bp, Artificial Sequence
  Synthetic oligonucleotide
tctatcaccctccgttttcatgtaatcccgtggattga

SEQ ID NO: 84404 - DNA, 37 bp, Artificial Sequence
  Synthetic oligonucleotide
gccgggcgggttggaggggaggtagcgggacacttga

SEQ ID NO: 84405 - DNA, 38 bp, Artificial Sequence
  Synthetic oligonucleotide
gagcattcagctagcgtactggcactactacaccttga

SEQ ID NO: 84406 - DNA, 38 bp, Artificial Sequence
  Synthetic oligonucleotide
ataacgccacatgccgcacactgggctttccttcttga

SEQ ID NO: 84407 - DNA, 38 bp, Artificial Sequence
  Synthetic oligonucleotide
aacagctaggtgcgtgacgagtgagggggtgaagttga

SEQ ID NO: 84408 - DNA, 38 bp, Artificial Sequence
  Synthetic oligonucleotide
acgacccactcatggaactaccgtgcatctaacgttga

SEQ ID NO: 84409 - DNA, 38 bp, Artificial Sequence
  Synthetic oligonucleotide
accatcgacaggtgtccccctcatattgccccggttga

SEQ ID NO: 84410 - DNA, 38 bp, Artificial Sequence
  Synthetic oligonucleotide
agcgccccctcctctgtcttgtaataccactctgttga

SEQ ID NO: 84411 - DNA, 38 bp, Artificial Sequence
  Synthetic oligonucleotide
tatgcgctcgacctctgcgtaggggcttgcctatttga

SEQ ID NO: 84412 - DNA, 38 bp, Artificial Sequence
  Synthetic oligonucleotide
gttggcccaatgcttataattccgcccacttgctttga

SEQ ID NO: 84413 - DNA, 37 bp, Artificial Sequence
  Synthetic oligonucleotide
tgagcacagactggcgctattcctgttacatgtttga

SEQ ID NO: 84414 - DNA, 37 bp, Artificial Sequence
  Synthetic oligonucleotide
atgggccccctccgtcttgccttttacctatgtttga

SEQ ID NO: 84415 - DNA, 38 bp, Artificial Sequence
  Synthetic oligonucleotide
accctcggagggtgccgtaccacgagggaatgttttga

SEQ ID NO: 84416 - DNA, 36 bp, Artificial Sequence
  Synthetic oligonucleotide
gtcactgtccgaccagaaggacatcacttgcacata

SEQ ID NO: 84417 - DNA, 36 bp, Artificial Sequence
  Synthetic oligonucleotide
agtcaacgcgcaccgtgagcccattttttcacccta

SEQ ID NO: 84418 - DNA, 36 bp, Artificial Sequence
  Synthetic oligonucleotide
gttgtcacactgggcttgtgactgcctctctgccta

SEQ ID NO: 84419 - DNA, 35 bp, Artificial Sequence
  Synthetic oligonucleotide
aatgcctctccgagctcctcacagtaacatttcta

SEQ ID NO: 84420 - DNA, 36 bp, Artificial Sequence
  Synthetic oligonucleotide
gtagtagtggacagggttttggggccggagagagta

SEQ ID NO: 84421 - DNA, 35 bp, Artificial Sequence
  Synthetic oligonucleotide
gctgctaccatccccggcctttgtctgtgcacgta

SEQ ID NO: 84422 - DNA, 36 bp, Artificial Sequence
  Synthetic oligonucleotide
gacagtggtatagtgcgtggcgggagaaaggacgta

SEQ ID NO: 84423 - DNA, 35 bp, Artificial Sequence
  Synthetic oligonucleotide
aataaacacgggggaaggaagggtccatgggggta

SEQ ID NO: 84424 - DNA, 35 bp, Artificial Sequence
  Synthetic oligonucleotide
tccagcccccttgtcacatactggatgtttctgta

SEQ ID NO: 84425 - DNA, 36 bp, Artificial Sequence
  Synthetic oligonucleotide
tacagccctctcctgcctcgctttcgagatcaatta

SEQ ID NO: 84426 - DNA, 36 bp, Artificial Sequence
  Synthetic oligonucleotide
acatcttcgctgccaactcgtcgccttagactctta

SEQ ID NO: 84427 - DNA, 38 bp, Artificial Sequence
  Synthetic oligonucleotide
tgcgggggggggcgaagatgatgcaggggcgatcgtta

SEQ ID NO: 84428 - DNA, 35 bp, Artificial Sequence
  Synthetic oligonucleotide
aatgttgccggtggtgggacatgttgttggtgtta

SEQ ID NO: 84429 - DNA, 35 bp, Artificial Sequence
  Synthetic oligonucleotide
gcccacatcacggttattttccactgggtgtcaac

SEQ ID NO: 84430 - DNA, 35 bp, Artificial Sequence
  Synthetic oligonucleotide
gattcggcatactccgcgtaggcgctctcactcac

SEQ ID NO: 84431 - DNA, 35 bp, Artificial Sequence
  Synthetic oligonucleotide
gcaaggtcccggcaaacacgcctctctggtccgac

SEQ ID NO: 84432 - DNA, 35 bp, Artificial Sequence
  Synthetic oligonucleotide
tctgcgttcaccgaccccggccttccttgctaacc

SEQ ID NO: 84433 - DNA, 35 bp, Artificial Sequence
  Synthetic oligonucleotide
gctcgccccggtaggcccagctaattctagcaccc

SEQ ID NO: 84434 - DNA, 34 bp, Artificial Sequence
  Synthetic oligonucleotide
gtctgggttgaaccgtcctaacatcgccgctccc

SEQ ID NO: 84435 - DNA, 35 bp, Artificial Sequence
  Synthetic oligonucleotide
ttacactccccgtccctgcctctttgtttgctgcc

SEQ ID NO: 84436 - DNA, 35 bp, Artificial Sequence
  Synthetic oligonucleotide
gagtgcttttgcgcaatgccacctatctccgatcc

SEQ ID NO: 84437 - DNA, 35 bp, Artificial Sequence
  Synthetic oligonucleotide
accgcctcaggccctcctgtaccctgatcctatcc

SEQ ID NO: 84438 - DNA, 35 bp, Artificial Sequence
  Synthetic oligonucleotide
gtgactagtccactcgctccattagagcctcctgc

SEQ ID NO: 84439 - DNA, 35 bp, Artificial Sequence
  Synthetic oligonucleotide
gattccgtacgaggacctcttcccctgtccatatc

SEQ ID NO: 84440 - DNA, 35 bp, Artificial Sequence
  Synthetic oligonucleotide
gccacgcacagcaacccgacacatcccgtgacctc

SEQ ID NO: 84441 - DNA, 35 bp, Artificial Sequence
  Synthetic oligonucleotide
gggaatgccttagtactgtcgcctagccactcctc

SEQ ID NO: 84442 - DNA, 35 bp, Artificial Sequence
  Synthetic oligonucleotide
acacctctgccatctgcttcccgcttactaagctc

SEQ ID NO: 84443 - DNA, 34 bp, Artificial Sequence
  Synthetic oligonucleotide
gccgcagggctattctatgatagtacctaatctc

SEQ ID NO: 84444 - DNA, 35 bp, Artificial Sequence
  Synthetic oligonucleotide
tctcccatggccgaatcctcaaaggcgccgacgtc

SEQ ID NO: 84445 - DNA, 35 bp, Artificial Sequence
  Synthetic oligonucleotide
gcgcataatgtcgttgtcattcaaattgcctggtc

SEQ ID NO: 84446 - DNA, 35 bp, Artificial Sequence
  Synthetic oligonucleotide
tcatcggaggccctgcacgaatacggtccactgtc

SEQ ID NO: 84447 - DNA, 35 bp, Artificial Sequence
  Synthetic oligonucleotide
ttgcgaaaacggtgcgtacttataactactcattc

SEQ ID NO: 84448 - DNA, 35 bp, Artificial Sequence
  Synthetic oligonucleotide
acacgcccagggaaaagcatcttgagctggatttc

SEQ ID NO: 84449 - DNA, 35 bp, Artificial Sequence
  Synthetic oligonucleotide
gacacctacgggaattgtgggcatggggtatgcag

SEQ ID NO: 84450 - DNA, 35 bp, Artificial Sequence
  Synthetic oligonucleotide
acacgtggcacataactccatcactaccatcagag

SEQ ID NO: 84451 - DNA, 35 bp, Artificial Sequence
  Synthetic oligonucleotide
tttgtgccttttcttccgtcattgtctcgatcgag

SEQ ID NO: 84452 - DNA, 35 bp, Artificial Sequence
  Synthetic oligonucleotide
tattaccatctcgctcgtgggtaccgctgttcccg

SEQ ID NO: 84453 - DNA, 35 bp, Artificial Sequence
  Synthetic oligonucleotide
cactcccgacactctgaacgcacccaggcccgccg

SEQ ID NO: 84454 - DNA, 36 bp, Artificial Sequence
  Synthetic oligonucleotide
ttggcacccttttacactttggaccatgaatactcg

SEQ ID NO: 84455 - DNA, 35 bp, Artificial Sequence
  Synthetic oligonucleotide
ttcgcactaccaccgagttaacttcgtcgttttcg

SEQ ID NO: 84456 - DNA, 35 bp, Artificial Sequence
  Synthetic oligonucleotide
tacgagcgcaatagtagttgctgaattcacaaagg

SEQ ID NO: 84457 - DNA, 35 bp, Artificial Sequence
  Synthetic oligonucleotide
aacgcatgaggaaccgtgggccgtttatttagggg

SEQ ID NO: 84458 - DNA, 34 bp, Artificial Sequence
  Synthetic oligonucleotide
gatggtgggtgcaacaaggggtggtaaagcactg

SEQ ID NO: 84459 - DNA, 35 bp, Artificial Sequence
  Synthetic oligonucleotide
ttggtcatattcccccgtcgtccttcgcatagctg

SEQ ID NO: 84460 - DNA, 35 bp, Artificial Sequence
  Synthetic oligonucleotide
gaaagcgcgctcaatccccttcatttatgctgctg

SEQ ID NO: 84461 - DNA, 35 bp, Artificial Sequence
  Synthetic oligonucleotide
gcgagagggtcagcctgtactatctttggtccgtg

SEQ ID NO: 84462 - DNA, 35 bp, Artificial Sequence
  Synthetic oligonucleotide
gtgtggggaagatagggatgaaatcggattgcttg

SEQ ID NO: 84463 - DNA, 35 bp, Artificial Sequence
  Synthetic oligonucleotide
gcatgtagcagggtgaaaaataggaagtctatttg

SEQ ID NO: 84464 - DNA, 35 bp, Artificial Sequence
  Synthetic oligonucleotide
gccccgcccgtcattggtcagactaccgttttcat

SEQ ID NO: 84465 - DNA, 35 bp, Artificial Sequence
  Synthetic oligonucleotide
gactgactcgctattcctcccatgtcaagcactat

SEQ ID NO: 84466 - DNA, 35 bp, Artificial Sequence
  Synthetic oligonucleotide
ttgagccgtacacctctcgcctcgttggaatgact

SEQ ID NO: 84467 - DNA, 35 bp, Artificial Sequence
  Synthetic oligonucleotide
ttgccccgtttgccctggtcacggcctgcatacct

SEQ ID NO: 84468 - DNA, 35 bp, Artificial Sequence
  Synthetic oligonucleotide
tggacacccagtccaccctcctccgctgtcttcct

SEQ ID NO: 84469 - DNA, 35 bp, Artificial Sequence
  Synthetic oligonucleotide
tcctagtccacatgagttccctggttcttcgtgct

SEQ ID NO: 84470 - DNA, 35 bp, Artificial Sequence
  Synthetic oligonucleotide
tacacacaccccgggtcccattacgcaggcaatct

SEQ ID NO: 84471 - DNA, 35 bp, Artificial Sequence
  Synthetic oligonucleotide
tcgcacctctcatcgtatactcccctccgtcctct

SEQ ID NO: 84472 - DNA, 35 bp, Artificial Sequence
  Synthetic oligonucleotide
tacgatctctcgtgctatctccccccgctggctct

SEQ ID NO: 84473 - DNA, 35 bp, Artificial Sequence
  Synthetic oligonucleotide
accaacggagcctctgttctcagttctggccttct

SEQ ID NO: 84474 - DNA, 35 bp, Artificial Sequence
  Synthetic oligonucleotide
agcacattcggatcagctgctcgggtccctccagt

SEQ ID NO: 84475 - DNA, 35 bp, Artificial Sequence
  Synthetic oligonucleotide
tgctgtcccgttgtaagcagtttgtcacccatcgt

SEQ ID NO: 84476 - DNA, 35 bp, Artificial Sequence
  Synthetic oligonucleotide
gttgaccccgcagaaactccctggactaccgtggt

SEQ ID NO: 84477 - DNA, 35 bp, Artificial Sequence
  Synthetic oligonucleotide
gtcatcaccgccacggagagtgttttgtcttctgt

SEQ ID NO: 84478 - DNA, 35 bp, Artificial Sequence
  Synthetic oligonucleotide
tacgctgaggcatcccacaatgacgcacctatatt

SEQ ID NO: 84479 - DNA, 35 bp, Artificial Sequence
  Synthetic oligonucleotide
ggacgggcacgtggggatgcgttccacctttcctt

SEQ ID NO: 84480 - DNA, 36 bp, Artificial Sequence
  Synthetic oligonucleotide
gactgcggtggtcatgggggtggtaggtttggcaaa

SEQ ID NO: 84481 - DNA, 36 bp, Artificial Sequence
  Synthetic oligonucleotide
ggtgtgggggagcacgaggggaaggttcgtatcaaa

SEQ ID NO: 84482 - DNA, 36 bp, Artificial Sequence
  Synthetic oligonucleotide
tacgaacagcgaacttactgcttactggttcgacaa

SEQ ID NO: 84483 - DNA, 36 bp, Artificial Sequence
  Synthetic oligonucleotide
ggacccacgcctgtcttgtttcaccgctaatgccaa

SEQ ID NO: 84484 - DNA, 36 bp, Artificial Sequence
  Synthetic oligonucleotide
agccaccaccctctgcctttgcacatactcgtttaa

SEQ ID NO: 84485 - DNA, 36 bp, Artificial Sequence
  Synthetic oligonucleotide
atcaccgttaagtgcgaacttggcactggtcccaca

SEQ ID NO: 84486 - DNA, 36 bp, Artificial Sequence
  Synthetic oligonucleotide
aacgggggagggaaggaaatgctaattgatgccaca

SEQ ID NO: 84487 - DNA, 36 bp, Artificial Sequence
  Synthetic oligonucleotide
tccatcccagtgtcgataactttgcaccgcgtgaca

SEQ ID NO: 84488 - DNA, 37 bp, Artificial Sequence
  Synthetic oligonucleotide
gtccaacctacgtccctgccatttgcacactggtaca

SEQ ID NO: 84489 - DNA, 35 bp, Artificial Sequence
  Synthetic oligonucleotide
gccggtacgacttacgcgttacacatctctaccca

SEQ ID NO: 84490 - DNA, 36 bp, Artificial Sequence
  Synthetic oligonucleotide
gaaaaaccactcgcctcacctgtactaggtggtcca

SEQ ID NO: 84491 - DNA, 35 bp, Artificial Sequence
  Synthetic oligonucleotide
aatgtcccgggtcggcgggagggcaaccaagagca

SEQ ID NO: 84492 - DNA, 35 bp, Artificial Sequence
  Synthetic oligonucleotide
aatgcaaccgcaaggctttttctgggtgtttcgca

SEQ ID NO: 84493 - DNA, 35 bp, Artificial Sequence
  Synthetic oligonucleotide
tctaccacgcatcgttttcatttattgtcttggca

SEQ ID NO: 84494 - DNA, 35 bp, Artificial Sequence
  Synthetic oligonucleotide
gatcgctggcagaacacctaccttactcatatgca

SEQ ID NO: 84495 - DNA, 35 bp, Artificial Sequence
  Synthetic oligonucleotide
tcacctcactcagccgtgactgacatgttgttgca

SEQ ID NO: 84496 - DNA, 36 bp, Artificial Sequence
  Synthetic oligonucleotide
tcgcataggtacacctgttttcatttcaagttatca

SEQ ID NO: 84497 - DNA, 35 bp, Artificial Sequence
  Synthetic oligonucleotide
ttggcctatctccaggtacgtagctcatttcttca

SEQ ID NO: 84498 - DNA, 36 bp, Artificial Sequence
  Synthetic oligonucleotide
tacccgtaccaggcgttattcgacgctgacctttca

SEQ ID NO: 84499 - DNA, 36 bp, Artificial Sequence
  Synthetic oligonucleotide
tgccggggtaggaggtaggaaatgagctaagcaaga

SEQ ID NO: 84500 - DNA, 36 bp, Artificial Sequence
  Synthetic oligonucleotide
tagggagggatggaggggagaagtattcccgagaga

SEQ ID NO: 84501 - DNA, 37 bp, Artificial Sequence
  Synthetic oligonucleotide
agtgcgcaaccgtggtaaagaagttagtgcaaggaga

SEQ ID NO: 84502 - DNA, 36 bp, Artificial Sequence
  Synthetic oligonucleotide
gaagaccactgtgcagtcggaaaaaaacggaataga

SEQ ID NO: 84503 - DNA, 36 bp, Artificial Sequence
  Synthetic oligonucleotide
gccaccatcatcttagcgttgaacactgcggaacga

SEQ ID NO: 84504 - DNA, 37 bp, Artificial Sequence
  Synthetic oligonucleotide
tagccccatcctgcatcaacttttgcctcagccacga

SEQ ID NO: 84505 - DNA, 36 bp, Artificial Sequence
  Synthetic oligonucleotide
gtgggagctttctttagcgttacattccatccacga

SEQ ID NO: 84506 - DNA, 37 bp, Artificial Sequence
  Synthetic oligonucleotide
tccgctgtggtccgcctcgtcccttcgttcgttacga

SEQ ID NO: 84507 - DNA, 36 bp, Artificial Sequence
  Synthetic oligonucleotide
atcacgcacaatttttaagtacgaatacccacccga

SEQ ID NO: 84508 - DNA, 36 bp, Artificial Sequence
  Synthetic oligonucleotide
aatgcactcgacccgtttgccggttcactttcccga

SEQ ID NO: 84509 - DNA, 37 bp, Artificial Sequence
  Synthetic oligonucleotide
atgtctatcacctgccgatctgtcattgtttctccga

SEQ ID NO: 84510 - DNA, 37 bp, Artificial Sequence
  Synthetic oligonucleotide
ggaccggggatatttagggaagagaggggacgtccga

SEQ ID NO: 84511 - DNA, 37 bp, Artificial Sequence
  Synthetic oligonucleotide
tgatgtgctccgtaaccctaccttttctgcttggcga

SEQ ID NO: 84512 - DNA, 37 bp, Artificial Sequence
  Synthetic oligonucleotide
atccgtcgctctcaggcctgcgctgctcgcttctcga

SEQ ID NO: 84513 - DNA, 37 bp, Artificial Sequence
  Synthetic oligonucleotide
atgttagccccagggagttgccgggaggggcgaagga

SEQ ID NO: 84514 - DNA, 37 bp, Artificial Sequence
  Synthetic oligonucleotide
atgcccatgccgtttcaccgtagcacctccaccagga

SEQ ID NO: 84515 - DNA, 37 bp, Artificial Sequence
  Synthetic oligonucleotide
accgacctggaaagtgtggtcgggaaggggaaacgga

SEQ ID NO: 84516 - DNA, 33 bp, Artificial Sequence
  Synthetic oligonucleotide
tctgtacgcggaacacacattacggagggggga

SEQ ID NO: 84517 - DNA, 37 bp, Artificial Sequence
  Synthetic oligonucleotide
agagaccgtgaaagagtagggaagtactagttgggga

SEQ ID NO: 84518 - DNA, 37 bp, Artificial Sequence
  Synthetic oligonucleotide
gtacgaacccagtgagggggttaaggaggggtatgga

SEQ ID NO: 84519 - DNA, 37 bp, Artificial Sequence
  Synthetic oligonucleotide
ttggtggaccacggggaggtaaatgggctggaaatga

SEQ ID NO: 84520 - DNA, 37 bp, Artificial Sequence
  Synthetic oligonucleotide
tccacgcaggatcggtttctggtttcttcataaatga

SEQ ID NO: 84521 - DNA, 38 bp, Artificial Sequence
  Synthetic oligonucleotide
ttaggagcagaaagagcaccaacagccggacctaatga

SEQ ID NO: 84522 - DNA, 36 bp, Artificial Sequence
  Synthetic oligonucleotide
acccatcctggaggtcctcttcgaacagattaatga

SEQ ID NO: 84523 - DNA, 38 bp, Artificial Sequence
  Synthetic oligonucleotide
aatgcacgagcagggtggacagggtgccgggaggatga

SEQ ID NO: 84524 - DNA, 37 bp, Artificial Sequence
  Synthetic oligonucleotide
gaactcggcaaggaggggtagagtaagggatgtatga

SEQ ID NO: 84525 - DNA, 38 bp, Artificial Sequence
  Synthetic oligonucleotide
gaccaccacaggttcatgcatatactcgcccattatga

SEQ ID NO: 84526 - DNA, 38 bp, Artificial Sequence
  Synthetic oligonucleotide
ttaggaggccatagcagcagcaaccacagcatttatga

SEQ ID NO: 84527 - DNA, 38 bp, Artificial Sequence
  Synthetic oligonucleotide
gcccgaacacccatccgttttttcacagacaacactga

SEQ ID NO: 84528 - DNA, 38 bp, Artificial Sequence
  Synthetic oligonucleotide
gtgaagcggcacatgcgctttcgcacgctctacactga

SEQ ID NO: 84529 - DNA, 38 bp, Artificial Sequence
  Synthetic oligonucleotide
tatgagggggcaactacgggaggagacggttccactga

SEQ ID NO: 84530 - DNA, 38 bp, Artificial Sequence
  Synthetic oligonucleotide
tcgcaaaccgtcgttacggccccctcaggtccacctga

SEQ ID NO: 84531 - DNA, 38 bp, Artificial Sequence
  Synthetic oligonucleotide
ttgaacgatacagtgcgtctttagcctgaactccctga

SEQ ID NO: 84532 - DNA, 38 bp, Artificial Sequence
  Synthetic oligonucleotide
aggacgccacatccattggtgctatatcttactgctga

SEQ ID NO: 84533 - DNA, 38 bp, Artificial Sequence
  Synthetic oligonucleotide
ttctccatccgccttatatgaagcgcagacattgctga

SEQ ID NO: 84534 - DNA, 37 bp, Artificial Sequence
  Synthetic oligonucleotide
gcacctccccaagccgcccgaccaaacaggccagtga

SEQ ID NO: 84535 - DNA, 38 bp, Artificial Sequence
  Synthetic oligonucleotide
gcatagtgagagggacggtggcatgggcattcgagtga

SEQ ID NO: 84536 - DNA, 38 bp, Artificial Sequence
  Synthetic oligonucleotide
gtcgggtgacgagaagggtaagactgtgagcggagtga

SEQ ID NO: 84537 - DNA, 37 bp, Artificial Sequence
  Synthetic oligonucleotide
gctacaaccgcggacggctcctctactgccttagtga

SEQ ID NO: 84538 - DNA, 37 bp, Artificial Sequence
  Synthetic oligonucleotide
acgacaagatacaactgcaaacataaaggtgacgtga

SEQ ID NO: 84539 - DNA, 37 bp, Artificial Sequence
  Synthetic oligonucleotide
atggaggacgaagacagaggggaatggggtactgtga

SEQ ID NO: 84540 - DNA, 37 bp, Artificial Sequence
  Synthetic oligonucleotide
tctgggatctcacatacgcttaccgccacccctgtga

SEQ ID NO: 84541 - DNA, 38 bp, Artificial Sequence
  Synthetic oligonucleotide
ttgcggagcacggctttggcgcactaccccccctgtga

SEQ ID NO: 84542 - DNA, 38 bp, Artificial Sequence
  Synthetic oligonucleotide
ggtgaacgacgagggaggagtggtatgggcctgtgtga

SEQ ID NO: 84543 - DNA, 38 bp, Artificial Sequence
  Synthetic oligonucleotide
aagtcaaccaccactgtgtcaaggccttgaaacattga

SEQ ID NO: 84544 - DNA, 38 bp, Artificial Sequence
  Synthetic oligonucleotide
acactggccaagctgaatttatagcgcctctttattga

SEQ ID NO: 84545 - DNA, 38 bp, Artificial Sequence
  Synthetic oligonucleotide
tctgaaccgcgcatttcattacatttttgggcccttga

SEQ ID NO: 84546 - DNA, 37 bp, Artificial Sequence
  Synthetic oligonucleotide
gcgaagtctcgttggcgatccttccgttttcccttga

SEQ ID NO: 84547 - DNA, 37 bp, Artificial Sequence
  Synthetic oligonucleotide
tcaactcgcgtcacttttccgccattaatgctcttga

SEQ ID NO: 84548 - DNA, 37 bp, Artificial Sequence
  Synthetic oligonucleotide
tcccggtccccgcgtgcgtactggcatcctgtcttga

SEQ ID NO: 84549 - DNA, 36 bp, Artificial Sequence
  Synthetic oligonucleotide
gtggtatcccgcaactctgctcccatcagttcttga

SEQ ID NO: 84550 - DNA, 36 bp, Artificial Sequence
  Synthetic oligonucleotide
gtgccgtcgctcggtccgcactagttattttcttga

SEQ ID NO: 84551 - DNA, 38 bp, Artificial Sequence
  Synthetic oligonucleotide
acaaccggggtagggtggtttatggggagtatagttga

SEQ ID NO: 84552 - DNA, 38 bp, Artificial Sequence
  Synthetic oligonucleotide
tttgcccccgccccagcccgattagtcactagtgttga

SEQ ID NO: 84553 - DNA, 38 bp, Artificial Sequence
  Synthetic oligonucleotide
accgctggcagacaagagggtgggtgggaggaatttga

SEQ ID NO: 84554 - DNA, 38 bp, Artificial Sequence
  Synthetic oligonucleotide
acaccatcttccggctttggcaacatgggaatgtttga

SEQ ID NO: 84555 - DNA, 37 bp, Artificial Sequence
  Synthetic oligonucleotide
tcgaatcccacgcaaggtactctctctcgctgtttga

SEQ ID NO: 84556 - DNA, 35 bp, Artificial Sequence
  Synthetic oligonucleotide
agttggcacccccaggatgaaacgccatcatcata

SEQ ID NO: 84557 - DNA, 35 bp, Artificial Sequence
  Synthetic oligonucleotide
atccaatccgctgtacacctagccttgctcgtata

SEQ ID NO: 84558 - DNA, 32 bp, Artificial Sequence
  Synthetic oligonucleotide
gttacacctgccctgttttgtcctggtcacta

SEQ ID NO: 84559 - DNA, 34 bp, Artificial Sequence
  Synthetic oligonucleotide
ttgaaccaccaccccttccacgtaagggacccta

SEQ ID NO: 84560 - DNA, 36 bp, Artificial Sequence
  Synthetic oligonucleotide
tagacatcaagcagagggggcattggtggggcgcta

SEQ ID NO: 84561 - DNA, 36 bp, Artificial Sequence
  Synthetic oligonucleotide
ttcgaacagccacatcgttaatatttcatcatgcta

SEQ ID NO: 84562 - DNA, 35 bp, Artificial Sequence
  Synthetic oligonucleotide
acatggactgcgcacttacacgcctgttcatcgta

SEQ ID NO: 84563 - DNA, 36 bp, Artificial Sequence
  Synthetic oligonucleotide
tgatcgccgcactccgctcctatgttcgctaatgta

SEQ ID NO: 84564 - DNA, 35 bp, Artificial Sequence
  Synthetic oligonucleotide
attgtgcggccgacctctgcaaaggcacaattgta

SEQ ID NO: 84565 - DNA, 36 bp, Artificial Sequence
  Synthetic oligonucleotide
tgaaccgccctctactggttacgcgcacttggctta

SEQ ID NO: 84566 - DNA, 35 bp, Artificial Sequence
  Synthetic oligonucleotide
gaatgccgcccaatatctccgttaactactattta

SEQ ID NO: 84567 - DNA, 36 bp, Artificial Sequence
  Synthetic oligonucleotide
gctcgcatcctaccgcgtctcctattgtcctgttta

SEQ ID NO: 84568 - DNA, 35 bp, Artificial Sequence
  Synthetic oligonucleotide
gtctacgcggctgttgacgtccttaatgctaccac

SEQ ID NO: 84569 - DNA, 35 bp, Artificial Sequence
  Synthetic oligonucleotide
aacacgctagtgaaccacccccacggatctgccac

SEQ ID NO: 84570 - DNA, 35 bp, Artificial Sequence
  Synthetic oligonucleotide
gctgaaggcgggttagttaccatcgcccatctcac

SEQ ID NO: 84571 - DNA, 35 bp, Artificial Sequence
  Synthetic oligonucleotide
acccacatcggtgcattaagttgccgctcaaagac

SEQ ID NO: 84572 - DNA, 35 bp, Artificial Sequence
  Synthetic oligonucleotide
gcacctgcactacgcccgtaaatccatcttctgac

SEQ ID NO: 84573 - DNA, 35 bp, Artificial Sequence
  Synthetic oligonucleotide
tgtcacccaaacgtggcgcctggcggtaaactacc

SEQ ID NO: 84574 - DNA, 35 bp, Artificial Sequence
  Synthetic oligonucleotide
gccgaagggcttcgttcgttcacgcttactttacc

SEQ ID NO: 84575 - DNA, 35 bp, Artificial Sequence
  Synthetic oligonucleotide
ttgctggcataacgcttcacttggatccgccgccc

SEQ ID NO: 84576 - DNA, 35 bp, Artificial Sequence
  Synthetic oligonucleotide
gtgatacatctgcccgaccggtcgcgggaaatccc

SEQ ID NO: 84577 - DNA, 35 bp, Artificial Sequence
  Synthetic oligonucleotide
accagacctggttacttttatctcgggctacagcc

SEQ ID NO: 84578 - DNA, 35 bp, Artificial Sequence
  Synthetic oligonucleotide
agaatcggtctcgcacacctacatgtactgcatcc

SEQ ID NO: 84579 - DNA, 35 bp, Artificial Sequence
  Synthetic oligonucleotide
gcatccccgcgcggactacctgcagttgttactcc

SEQ ID NO: 84580 - DNA, 35 bp, Artificial Sequence
  Synthetic oligonucleotide
atgaggagcagccgctggtacacatcacgccctcc

SEQ ID NO: 84581 - DNA, 35 bp, Artificial Sequence
  Synthetic oligonucleotide
gaaatcaggtcctggtccccgcacgaggcacttcc

SEQ ID NO: 84582 - DNA, 35 bp, Artificial Sequence
  Synthetic oligonucleotide
cacttgcctgccatttagccgacgaacgactttcc

SEQ ID NO: 84583 - DNA, 35 bp, Artificial Sequence
  Synthetic oligonucleotide
ttcatcctccgttgaaccgattgaccgacacaagc

SEQ ID NO: 84584 - DNA, 35 bp, Artificial Sequence
  Synthetic oligonucleotide
cgatcagccacaccctgactgagagcttcatccgc

SEQ ID NO: 84585 - DNA, 35 bp, Artificial Sequence
  Synthetic oligonucleotide
gtgctgaccccatagcagactgtagatttgccctc

SEQ ID NO: 84586 - DNA, 35 bp, Artificial Sequence
  Synthetic oligonucleotide
tcatgcacaatgctcactgccccaacgtagggttc

SEQ ID NO: 84587 - DNA, 35 bp, Artificial Sequence
  Synthetic oligonucleotide
gttgctggctgcataccggttcatctttttctttc

SEQ ID NO: 84588 - DNA, 35 bp, Artificial Sequence
  Synthetic oligonucleotide
tgattgacggtgacgaaagggaggccacgtgcaag

SEQ ID NO: 84589 - DNA, 35 bp, Artificial Sequence
  Synthetic oligonucleotide
gtcgaaacggggccccttactatagagttcttcag

SEQ ID NO: 84590 - DNA, 35 bp, Artificial Sequence
  Synthetic oligonucleotide
gccacagtccgtcatgtctatttatccgtacgtag

SEQ ID NO: 84591 - DNA, 35 bp, Artificial Sequence
  Synthetic oligonucleotide
gagagggtggtgggctcgccacggggaaagggtag

SEQ ID NO: 84592 - DNA, 35 bp, Artificial Sequence
  Synthetic oligonucleotide
agacacgtacgttctgaaattagcatcccacaccg

SEQ ID NO: 84593 - DNA, 35 bp, Artificial Sequence
  Synthetic oligonucleotide
gatgctcaacgccgagtaggttccattaacacccg

SEQ ID NO: 84594 - DNA, 35 bp, Artificial Sequence
  Synthetic oligonucleotide
aagcaccgatacccattgccgaggccttcacagcg

SEQ ID NO: 84595 - DNA, 35 bp, Artificial Sequence
  Synthetic oligonucleotide
tcccgcccccagctccgtttgtcccttccttggcg

SEQ ID NO: 84596 - DNA, 35 bp, Artificial Sequence
  Synthetic oligonucleotide
gacacacaacccagaggacctataagacccttgcg

SEQ ID NO: 84597 - DNA, 35 bp, Artificial Sequence
  Synthetic oligonucleotide
tgtgggtaggggggatatgactggtattcctgtgg

SEQ ID NO: 84598 - DNA, 35 bp, Artificial Sequence
  Synthetic oligonucleotide
tccatacccgcaagaccttgcgtacgaccttttgg

SEQ ID NO: 84599 - DNA, 35 bp, Artificial Sequence
  Synthetic oligonucleotide
ggaaccgactcttttcgtcatcaggcccacatctg

SEQ ID NO: 84600 - DNA, 35 bp, Artificial Sequence
  Synthetic oligonucleotide
gtgtaggtggaaagggagttgagatagccctggtg

SEQ ID NO: 84601 - DNA, 35 bp, Artificial Sequence
  Synthetic oligonucleotide
tcaacacagggtagtttagagagagaggagatgtg

SEQ ID NO: 84602 - DNA, 34 bp, Artificial Sequence
  Synthetic oligonucleotide
gacaatcagcatgttctgctaattcatccctgtg

SEQ ID NO: 84603 - DNA, 35 bp, Artificial Sequence
  Synthetic oligonucleotide
aactacgcaagccgttgacccgtcccatctgtgtg

SEQ ID NO: 84604 - DNA, 35 bp, Artificial Sequence
  Synthetic oligonucleotide
attgcccgccccattctccgtacgtccaccgcttg

SEQ ID NO: 84605 - DNA, 35 bp, Artificial Sequence
  Synthetic oligonucleotide
tgtatgacccggccgtgatcgaccatgctctcaat

SEQ ID NO: 84606 - DNA, 35 bp, Artificial Sequence
  Synthetic oligonucleotide
tgcatgctcgtaactgtctatcggttctgcctcat

SEQ ID NO: 84607 - DNA, 35 bp, Artificial Sequence
  Synthetic oligonucleotide
gaccacatctagacaaagtcaacggttcgtggact

SEQ ID NO: 84608 - DNA, 35 bp, Artificial Sequence
  Synthetic oligonucleotide
gtgtgcacatgcgccctttgcattacgcaccacct

SEQ ID NO: 84609 - DNA, 35 bp, Artificial Sequence
  Synthetic oligonucleotide
taggacatatgcctgacttcgaatcggccctacct

SEQ ID NO: 84610 - DNA, 35 bp, Artificial Sequence
  Synthetic oligonucleotide
gtctggttaccagtacttcatcaacagatccccct

SEQ ID NO: 84611 - DNA, 35 bp, Artificial Sequence
  Synthetic oligonucleotide
tagacggtgtggaggccgacgtcatgattcccgct

SEQ ID NO: 84612 - DNA, 35 bp, Artificial Sequence
  Synthetic oligonucleotide
atgatagtcacccttactgtcacctgttaacctct

SEQ ID NO: 84613 - DNA, 35 bp, Artificial Sequence
  Synthetic oligonucleotide
gtatgaagggggtaagcggggaagcatgtaggtct

SEQ ID NO: 84614 - DNA, 35 bp, Artificial Sequence
  Synthetic oligonucleotide
tcgcccactgcgtattttatatgcccttttggtct

SEQ ID NO: 84615 - DNA, 35 bp, Artificial Sequence
  Synthetic oligonucleotide
atggtcagtccttcaaatttcgcgcatttttgtct

SEQ ID NO: 84616 - DNA, 35 bp, Artificial Sequence
  Synthetic oligonucleotide
ggggcctccatccacaactacccggactcccaagt

SEQ ID NO: 84617 - DNA, 35 bp, Artificial Sequence
  Synthetic oligonucleotide
ggacgtggtgatcaagcaaggtaggggtgcggtgt

SEQ ID NO: 84618 - DNA, 35 bp, Artificial Sequence
  Synthetic oligonucleotide
gcctcctacagatggcccgtcgtacaaaactcctt

SEQ ID NO: 84619 - DNA, 35 bp, Artificial Sequence
  Synthetic oligonucleotide
acccccccagcatgtatctctgccaattgacagtt

SEQ ID NO: 84620 - DNA, 35 bp, Artificial Sequence
  Synthetic oligonucleotide
tgccgtctctctgaagttgcactgtcccaccattt

SEQ ID NO: 84621 - DNA, 35 bp, Artificial Sequence
  Synthetic oligonucleotide
actccgtatgcagtgtcgcgtaggcccctttgttt

SEQ ID NO: 84622 - DNA, 35 bp, Artificial Sequence
  Synthetic oligonucleotide
gatgggccgattcgaggagcaccggggccgatttt

SEQ ID NO: 84623 - DNA, 36 bp, Artificial Sequence
  Synthetic oligonucleotide
ggacggtggggctcggacaagagaggattcacaaaa

SEQ ID NO: 84624 - DNA, 36 bp, Artificial Sequence
  Synthetic oligonucleotide
atacccgcctgtcttaaagtcattctccattacaaa

SEQ ID NO: 84625 - DNA, 36 bp, Artificial Sequence
  Synthetic oligonucleotide
atcacaccgcaccgaccactagcgtaaacagttaaa

SEQ ID NO: 84626 - DNA, 35 bp, Artificial Sequence
  Synthetic oligonucleotide
attaccgccaagatccgtaccaaccgtgttgccaa

SEQ ID NO: 84627 - DNA, 35 bp, Artificial Sequence
  Synthetic oligonucleotide
tctgccgtcccctattactatatttcgcagggcaa

SEQ ID NO: 84628 - DNA, 35 bp, Artificial Sequence
  Synthetic oligonucleotide
atggacacgccacatttattcactaaccgatcgaa

SEQ ID NO: 84629 - DNA, 35 bp, Artificial Sequence
  Synthetic oligonucleotide
gtggagggaagggaaaaatgtgggggccaattgaa

SEQ ID NO: 84630 - DNA, 36 bp, Artificial Sequence
  Synthetic oligonucleotide
gaccgggccggtaagatcatcagcccccgccttaca

SEQ ID NO: 84631 - DNA, 35 bp, Artificial Sequence
  Synthetic oligonucleotide
ccacctgcagcaacatcacatttcatcgaccacca

SEQ ID NO: 84632 - DNA, 35 bp, Artificial Sequence
  Synthetic oligonucleotide
ggatcatccctgatcgcttatacgaagttgtacca

SEQ ID NO: 84633 - DNA, 36 bp, Artificial Sequence
  Synthetic oligonucleotide
gccaccccgcctgtttctacttgtacccggatgcca

SEQ ID NO: 84634 - DNA, 35 bp, Artificial Sequence
  Synthetic oligonucleotide
atgatgggagcggttctagccattttcctttgcca

SEQ ID NO: 84635 - DNA, 35 bp, Artificial Sequence
  Synthetic oligonucleotide
gtactgttgaagggggggagagagggccagacgca

SEQ ID NO: 84636 - DNA, 36 bp, Artificial Sequence
  Synthetic oligonucleotide
tacgagaaggggaagcaggacatgataaaagcggca

SEQ ID NO: 84637 - DNA, 37 bp, Artificial Sequence
  Synthetic oligonucleotide
acccccgcccccacagctgtaagctttcaatacctca

SEQ ID NO: 84638 - DNA, 36 bp, Artificial Sequence
  Synthetic oligonucleotide
acgaactgccattcgctcgccccatcgtcgaagtca

SEQ ID NO: 84639 - DNA, 36 bp, Artificial Sequence
  Synthetic oligonucleotide
acgcgcttccccggtgggctacgtccctgtccttca

SEQ ID NO: 84640 - DNA, 37 bp, Artificial Sequence
  Synthetic oligonucleotide
acacccgcccactggatcattgcggacttactcaaga

SEQ ID NO: 84641 - DNA, 37 bp, Artificial Sequence
  Synthetic oligonucleotide
gatgcagtcacgaggatgggggaagggaagttggaga

SEQ ID NO: 84642 - DNA, 37 bp, Artificial Sequence
  Synthetic oligonucleotide
actgcgcaaggtattgggtgggtgggtcagttggaga

SEQ ID NO: 84643 - DNA, 37 bp, Artificial Sequence
  Synthetic oligonucleotide
ttggccactcgcgtgtttttattttttgcatgaccga

SEQ ID NO: 84644 - DNA, 37 bp, Artificial Sequence
  Synthetic oligonucleotide
tccaccacaccagtgaatgcgggattacttacatcga

SEQ ID NO: 84645 - DNA, 37 bp, Artificial Sequence
  Synthetic oligonucleotide
ttcagccaccgacaatatctaccaccgtttctatcga

SEQ ID NO: 84646 - DNA, 37 bp, Artificial Sequence
  Synthetic oligonucleotide
acacagccggaccacaaagtatcatgcaggacacgga

SEQ ID NO: 84647 - DNA, 37 bp, Artificial Sequence
  Synthetic oligonucleotide
gactagagggaaggacctgggttttgaccgtcgcgga

SEQ ID NO: 84648 - DNA, 37 bp, Artificial Sequence
  Synthetic oligonucleotide
ttcgagcgtcgtcatcaattcgtttcctgccatcgga

SEQ ID NO: 84649 - DNA, 37 bp, Artificial Sequence
  Synthetic oligonucleotide
tgcaaggggtaaggaagggtgctcggttggtcaggga

SEQ ID NO: 84650 - DNA, 36 bp, Artificial Sequence
  Synthetic oligonucleotide
gtggggagagcggggtgtgtacgtgagatgttggga

SEQ ID NO: 84651 - DNA, 36 bp, Artificial Sequence
  Synthetic oligonucleotide
atccaaaaccacagggcaacaagaacatttcatgga

SEQ ID NO: 84652 - DNA, 37 bp, Artificial Sequence
  Synthetic oligonucleotide
acacgagcgctcgttgcattgttgcaccaccgctgga

SEQ ID NO: 84653 - DNA, 37 bp, Artificial Sequence
  Synthetic oligonucleotide
acacaaatgccagcgatgggccaaaagatggcttgga

SEQ ID NO: 84654 - DNA, 37 bp, Artificial Sequence
  Synthetic oligonucleotide
tgcatggaggagaatttgctttgggtaaacgtttgga

SEQ ID NO: 84655 - DNA, 38 bp, Artificial Sequence
  Synthetic oligonucleotide
gacacgacaggttagtgctacggaaacgaatctaatga

SEQ ID NO: 84656 - DNA, 38 bp, Artificial Sequence
  Synthetic oligonucleotide
atgtaaccctcgccgcatatttagacctttcccgatga

SEQ ID NO: 84657 - DNA, 38 bp, Artificial Sequence
  Synthetic oligonucleotide
atgccatcgcgcccggcactcgtttccatccgttatga

SEQ ID NO: 84658 - DNA, 38 bp, Artificial Sequence
  Synthetic oligonucleotide
tgcgccagtcgttccatctcttacgaagcgctaactga

SEQ ID NO: 84659 - DNA, 38 bp, Artificial Sequence
  Synthetic oligonucleotide
acttcgaccaccaccggcatagcagacatcaaggctga

SEQ ID NO: 84660 - DNA, 38 bp, Artificial Sequence
  Synthetic oligonucleotide
gccaggggcccaggtttcgcccttcatgtaccatctga

SEQ ID NO: 84661 - DNA, 38 bp, Artificial Sequence
  Synthetic oligonucleotide
gatctgccccactctgcccaaatagccttcttatctga

SEQ ID NO: 84662 - DNA, 38 bp, Artificial Sequence
  Synthetic oligonucleotide
gtgcatgacagaggctcctctatccacgtgctttctga

SEQ ID NO: 84663 - DNA, 38 bp, Artificial Sequence
  Synthetic oligonucleotide
gatgctcaatagcagtaaggataagcaggcggtagtga

SEQ ID NO: 84664 - DNA, 38 bp, Artificial Sequence
  Synthetic oligonucleotide
gttaccaggcgttctcatgatctttctcccagccgtga

SEQ ID NO: 84665 - DNA, 38 bp, Artificial Sequence
  Synthetic oligonucleotide
gacgcaggtggctcatggttaacaggagttccgcgtga

SEQ ID NO: 84666 - DNA, 38 bp, Artificial Sequence
  Synthetic oligonucleotide
tcatcgcaaaacctttaatcgccccgcccctccggtga

SEQ ID NO: 84667 - DNA, 38 bp, Artificial Sequence
  Synthetic oligonucleotide
gccccatcactttctcatgaaacactacccgcgggtga

SEQ ID NO: 84668 - DNA, 38 bp, Artificial Sequence
  Synthetic oligonucleotide
acctcacatcattgtaactttctccgttctcttggtga

SEQ ID NO: 84669 - DNA, 37 bp, Artificial Sequence
  Synthetic oligonucleotide
gatggccagcaggtaggcgggcaaggttgaaatgtga

SEQ ID NO: 84670 - DNA, 37 bp, Artificial Sequence
  Synthetic oligonucleotide
gtccccccatcgtgagttatgggtaccgcccccttga

SEQ ID NO: 84671 - DNA, 38 bp, Artificial Sequence
  Synthetic oligonucleotide
gagcctgactaagctcttgtagcacgccttccccttga

SEQ ID NO: 84672 - DNA, 36 bp, Artificial Sequence
  Synthetic oligonucleotide
gcaacgccggggacttatcaacctacgcctccttga

SEQ ID NO: 84673 - DNA, 37 bp, Artificial Sequence
  Synthetic oligonucleotide
gatcccccgcctgacacccgccattaaggagagttga

SEQ ID NO: 84674 - DNA, 38 bp, Artificial Sequence
  Synthetic oligonucleotide
gttcagcagcaaaggccaggaaaacggagtggagttga

SEQ ID NO: 84675 - DNA, 38 bp, Artificial Sequence
  Synthetic oligonucleotide
gtcacacatcgcaggcgcgagagccgctccttatttga

SEQ ID NO: 84676 - DNA, 37 bp, Artificial Sequence
  Synthetic oligonucleotide
gccactcccagtgtcaacgcaacgatcttctctttga

SEQ ID NO: 84677 - DNA, 38 bp, Artificial Sequence
  Synthetic oligonucleotide
gaccaccggaccctctgttgtcatgaacgttcgtttga

SEQ ID NO: 84678 - DNA, 38 bp, Artificial Sequence
  Synthetic oligonucleotide
gccacccgatttgtgcaattcctgcagtcatgttttga

SEQ ID NO: 84679 - DNA, 35 bp, Artificial Sequence
  Synthetic oligonucleotide
agcggaccaaagagtaaggggctacggttgaaata

SEQ ID NO: 84680 - DNA, 36 bp, Artificial Sequence
  Synthetic oligonucleotide
gcaccatctctgccgcttagcgagagtagtgcaata

SEQ ID NO: 84681 - DNA, 35 bp, Artificial Sequence
  Synthetic oligonucleotide
gccataacaggtcctttccgcgaggtctcgccata

SEQ ID NO: 84682 - DNA, 35 bp, Artificial Sequence
  Synthetic oligonucleotide
ttcacccatgagctggctaaatgcaccaaatcata

SEQ ID NO: 84683 - DNA, 36 bp, Artificial Sequence
  Synthetic oligonucleotide
actcccggcccatttttaaacatggctttgccacta

SEQ ID NO: 84684 - DNA, 35 bp, Artificial Sequence
  Synthetic oligonucleotide
tagtcaccacaactgtgtcagctctgcatcgacta

SEQ ID NO: 84685 - DNA, 36 bp, Artificial Sequence
  Synthetic oligonucleotide
gaagttgacgtcgggtgggaagcacggggaggggta

SEQ ID NO: 84686 - DNA, 36 bp, Artificial Sequence
  Synthetic oligonucleotide
gaaggggcagggggactaggaggtacggggcatgta

SEQ ID NO: 84687 - DNA, 35 bp, Artificial Sequence
  Synthetic oligonucleotide
gcccccacgcccaccggggtagttaaatcttatta

SEQ ID NO: 84688 - DNA, 36 bp, Artificial Sequence
  Synthetic oligonucleotide
aagtgggcaagctgacacctacaccgccttctgtta

SEQ ID NO: 84689 - DNA, 35 bp, Artificial Sequence
  Synthetic oligonucleotide
gcgagacaaagcccgcgcgaactgacaatttgaac

SEQ ID NO: 84690 - DNA, 35 bp, Artificial Sequence
  Synthetic oligonucleotide
gttaccgctacttccgaagctacgttcattctaac

SEQ ID NO: 84691 - DNA, 35 bp, Artificial Sequence
  Synthetic oligonucleotide
tacatggtcgctcctatacgccggttttagcacac

SEQ ID NO: 84692 - DNA, 35 bp, Artificial Sequence
  Synthetic oligonucleotide
tatgaacgcaccacctcacgggcagtcttcaggac

SEQ ID NO: 84693 - DNA, 35 bp, Artificial Sequence
  Synthetic oligonucleotide
gtcgtacacatctgttgcctattcccatccagacc

SEQ ID NO: 84694 - DNA, 35 bp, Artificial Sequence
  Synthetic oligonucleotide
aacgacccaatcttctttttactaagtgccatacc

SEQ ID NO: 84695 - DNA, 35 bp, Artificial Sequence
  Synthetic oligonucleotide
tgtgccctccagctgactccccccgtcatctaccc

SEQ ID NO: 84696 - DNA, 35 bp, Artificial Sequence
  Synthetic oligonucleotide
ttgtccaccacgattcgtgcgtatatccgttcccc

SEQ ID NO: 84697 - DNA, 35 bp, Artificial Sequence
  Synthetic oligonucleotide
gtatgcgtacagagaacgctcgcagcacttttgcc

SEQ ID NO: 84698 - DNA, 35 bp, Artificial Sequence
  Synthetic oligonucleotide
actcaccatcgcttatatgcatgcgacccccctcc

SEQ ID NO: 84699 - DNA, 35 bp, Artificial Sequence
  Synthetic oligonucleotide
gtctccctggcatctcctagtccgcttaaacgtcc

SEQ ID NO: 84700 - DNA, 35 bp, Artificial Sequence
  Synthetic oligonucleotide
gacttcgccagcgacctttaccacctggccggtcc

SEQ ID NO: 84701 - DNA, 33 bp, Artificial Sequence
  Synthetic oligonucleotide
gatctctgccaaacacgtggttaaacatcttcc

SEQ ID NO: 84702 - DNA, 35 bp, Artificial Sequence
  Synthetic oligonucleotide
atcagtactgcgccaatagcctgtccatctctagc

SEQ ID NO: 84703 - DNA, 35 bp, Artificial Sequence
  Synthetic oligonucleotide
tgcgacaacgtgttggcacgaccttcattctccgc

SEQ ID NO: 84704 - DNA, 35 bp, Artificial Sequence
  Synthetic oligonucleotide
aacactactgcggtggactttcctggctccctcgc

SEQ ID NO: 84705 - DNA, 36 bp, Artificial Sequence
  Synthetic oligonucleotide
gtcacgagcagacagtttaacccatggacacaatgc

SEQ ID NO: 84706 - DNA, 35 bp, Artificial Sequence
  Synthetic oligonucleotide
gaccgatcgtgtttgtccccgttgttatgcattgc

SEQ ID NO: 84707 - DNA, 35 bp, Artificial Sequence
  Synthetic oligonucleotide
tgtggcgaacggttacactcgtcccggatcacctc

SEQ ID NO: 84708 - DNA, 35 bp, Artificial Sequence
  Synthetic oligonucleotide
ggtgcctaccgagcatgtatcggtgcgcctccctc

SEQ ID NO: 84709 - DNA, 36 bp, Artificial Sequence
  Synthetic oligonucleotide
ggtggcacgttctggccaatacccgaccatttcctc

SEQ ID NO: 84710 - DNA, 35 bp, Artificial Sequence
  Synthetic oligonucleotide
tccctccggaacgagcgcgacattagaaccttctc

SEQ ID NO: 84711 - DNA, 35 bp, Artificial Sequence
  Synthetic oligonucleotide
aacccccagataccttgcgacgtccttgcggcttc

SEQ ID NO: 84712 - DNA, 35 bp, Artificial Sequence
  Synthetic oligonucleotide
gccccgggctcaatttagttgccttcgacttgttc

SEQ ID NO: 84713 - DNA, 35 bp, Artificial Sequence
  Synthetic oligonucleotide
gagccagtggaggacagaggaggatcggctatttc

SEQ ID NO: 84714 - DNA, 35 bp, Artificial Sequence
  Synthetic oligonucleotide
tgtggaacggggagggaggtgagcggaaatgtgag

SEQ ID NO: 84715 - DNA, 35 bp, Artificial Sequence
  Synthetic oligonucleotide
acccgtcaccaccgatccgtgtcatgctactcccg

SEQ ID NO: 84716 - DNA, 35 bp, Artificial Sequence
  Synthetic oligonucleotide
aacgcttgtggggtggggttgaagtaggagtcgcg

SEQ ID NO: 84717 - DNA, 35 bp, Artificial Sequence
  Synthetic oligonucleotide
gtacacgtcggagaaacgttcgtaaaacagaatcg

SEQ ID NO: 84718 - DNA, 35 bp, Artificial Sequence
  Synthetic oligonucleotide
tgaagggcctgctgacctttcattacgctatttcg

SEQ ID NO: 84719 - DNA, 36 bp, Artificial Sequence
  Synthetic oligonucleotide
gtagtaggtgcatgataggtgatgaagggtaagcgg

SEQ ID NO: 84720 - DNA, 35 bp, Artificial Sequence
  Synthetic oligonucleotide
aacatgcgctgctataacttcaaaaggggtacggg

SEQ ID NO: 84721 - DNA, 35 bp, Artificial Sequence
  Synthetic oligonucleotide
atgcagcatagtaccccctggcaccactcccctgg

SEQ ID NO: 84722 - DNA, 35 bp, Artificial Sequence
  Synthetic oligonucleotide
gctggaggagagtgataggccgggatgtagggtgg

SEQ ID NO: 84723 - DNA, 35 bp, Artificial Sequence
  Synthetic oligonucleotide
acacaccaatccgtgctctttggaaaccttatatg

SEQ ID NO: 84724 - DNA, 35 bp, Artificial Sequence
  Synthetic oligonucleotide
gatggggcgttaagtgggtacaattagtgtgcgtg

SEQ ID NO: 84725 - DNA, 35 bp, Artificial Sequence
  Synthetic oligonucleotide
tacatgtgacacaaaggtgagtgggacgggacttg

SEQ ID NO: 84726 - DNA, 35 bp, Artificial Sequence
  Synthetic oligonucleotide
gcctagctcgtcaaaacgaatacttctcctcacat

SEQ ID NO: 84727 - DNA, 36 bp, Artificial Sequence
  Synthetic oligonucleotide
gtacagggcgggcggaatacggggaatggggctgat

SEQ ID NO: 84728 - DNA, 35 bp, Artificial Sequence
  Synthetic oligonucleotide
atctgcacgcagggaaaccgcatcgacagaactat

SEQ ID NO: 84729 - DNA, 33 bp, Artificial Sequence
  Synthetic oligonucleotide
ttcgccacgaggcgttatattattctcacccct

SEQ ID NO: 84730 - DNA, 35 bp, Artificial Sequence
  Synthetic oligonucleotide
tcagtagccgttcgtcctgtccgtaccattgcgct

SEQ ID NO: 84731 - DNA, 35 bp, Artificial Sequence
  Synthetic oligonucleotide
ttcccgtgggccgactgcacccttagctatgatct

SEQ ID NO: 84732 - DNA, 35 bp, Artificial Sequence
  Synthetic oligonucleotide
atgcaccctcaacctgtgcgtgcattacatgctct

SEQ ID NO: 84733 - DNA, 35 bp, Artificial Sequence
  Synthetic oligonucleotide
gacattgcaagtatagcgcgtgattccgcctctct

SEQ ID NO: 84734 - DNA, 35 bp, Artificial Sequence
  Synthetic oligonucleotide
cagtacatacgtcgtatgtcttcaaatcgcagtct

SEQ ID NO: 84735 - DNA, 35 bp, Artificial Sequence
  Synthetic oligonucleotide
gagtcctcatgcgtggcaaatctatcaactctagt

SEQ ID NO: 84736 - DNA, 35 bp, Artificial Sequence
  Synthetic oligonucleotide
tctggacattcgcgccctatcattactgtattcgt

SEQ ID NO: 84737 - DNA, 35 bp, Artificial Sequence
  Synthetic oligonucleotide
tacgagagtgggggggcataaacatgtcgagatgt

SEQ ID NO: 84738 - DNA, 35 bp, Artificial Sequence
  Synthetic oligonucleotide
taagtgcgtgcaggagggaattcgcatgtgtgatt

SEQ ID NO: 84739 - DNA, 35 bp, Artificial Sequence
  Synthetic oligonucleotide
tccacgcccaggtgtacctatgtaacgtctccgtt

SEQ ID NO: 84740 - DNA, 36 bp, Artificial Sequence
  Synthetic oligonucleotide
gatactggcaaatggggttatcaaaacgagggaaaa

SEQ ID NO: 84741 - DNA, 36 bp, Artificial Sequence
  Synthetic oligonucleotide
ggactgcgcctcgctcagccgacccagcaaaccaaa

SEQ ID NO: 84742 - DNA, 36 bp, Artificial Sequence
  Synthetic oligonucleotide
agccatccccggcttacagtacgtttctcggccaaa

SEQ ID NO: 84743 - DNA, 36 bp, Artificial Sequence
  Synthetic oligonucleotide
gtggtggttggagctgtatagatggtggtctggaaa

SEQ ID NO: 84744 - DNA, 35 bp, Artificial Sequence
  Synthetic oligonucleotide
atggtacgtccctgctatccgtcttcagccttaaa

SEQ ID NO: 84745 - DNA, 35 bp, Artificial Sequence
  Synthetic oligonucleotide
taaacaacgccggagagcataaggtagggtcgcaa

SEQ ID NO: 84746 - DNA, 35 bp, Artificial Sequence
  Synthetic oligonucleotide
tccaccaacgcagggattgaacccttgtaattcaa

SEQ ID NO: 84747 - DNA, 36 bp, Artificial Sequence
  Synthetic oligonucleotide
taagcgtacacacgtctccgtccttgtcgtgcaaca

SEQ ID NO: 84748 - DNA, 35 bp, Artificial Sequence
  Synthetic oligonucleotide
gacaaagcagtggtggacaaatagatggtactaca

SEQ ID NO: 84749 - DNA, 36 bp, Artificial Sequence
  Synthetic oligonucleotide
gacgccacataggaaacgatttccaacgtagttaca

SEQ ID NO: 84750 - DNA, 35 bp, Artificial Sequence
  Synthetic oligonucleotide
ggtccatcgagcttttcacttattagcactgacca

SEQ ID NO: 84751 - DNA, 36 bp, Artificial Sequence
  Synthetic oligonucleotide
gtttggctcctcacatactgggttacgtcccaccca

SEQ ID NO: 84752 - DNA, 36 bp, Artificial Sequence
  Synthetic oligonucleotide
gctggctagtgccccctcgttattgtacgttaccca

SEQ ID NO: 84753 - DNA, 35 bp, Artificial Sequence
  Synthetic oligonucleotide
gtagccaccacctgtcctcagtaaccactccccca

SEQ ID NO: 84754 - DNA, 35 bp, Artificial Sequence
  Synthetic oligonucleotide
tgtacagctgccatatcttcccacgagggcgccca

SEQ ID NO: 84755 - DNA, 35 bp, Artificial Sequence
  Synthetic oligonucleotide
tacatggcatatccaccctttgattcgttcgccca

SEQ ID NO: 84756 - DNA, 36 bp, Artificial Sequence
  Synthetic oligonucleotide
gaagcaacggacggactagttcaatgctctcctcca

SEQ ID NO: 84757 - DNA, 36 bp, Artificial Sequence
  Synthetic oligonucleotide
gagccaggactggggcaagttggggcgggctgggca

SEQ ID NO: 84758 - DNA, 36 bp, Artificial Sequence
  Synthetic oligonucleotide
gccgcggagagggcgggaagggggaagggggtggca

SEQ ID NO: 84759 - DNA, 37 bp, Artificial Sequence
  Synthetic oligonucleotide
acccgcctgtcgctcatgcccccattctttccgaaga

SEQ ID NO: 84760 - DNA, 37 bp, Artificial Sequence
  Synthetic oligonucleotide
ggaggggatggagggaagcagatgcacgttaggaaga

SEQ ID NO: 84761 - DNA, 37 bp, Artificial Sequence
  Synthetic oligonucleotide
gtgaaccaaaaaagcgggcaaaagaaggacattaaga

SEQ ID NO: 84762 - DNA, 37 bp, Artificial Sequence
  Synthetic oligonucleotide
atcaccgcccatgatcctaggacacctcttatacaga

SEQ ID NO: 84763 - DNA, 37 bp, Artificial Sequence
  Synthetic oligonucleotide
tcacacggcaggttgacttgcttgccactcctagaga

SEQ ID NO: 84764 - DNA, 36 bp, Artificial Sequence
  Synthetic oligonucleotide
ttgccagtagggccgagaggaggagggacgtttaga

SEQ ID NO: 84765 - DNA, 37 bp, Artificial Sequence
  Synthetic oligonucleotide
gacatggggggaaggagcgcctcgaaacgggacacga

SEQ ID NO: 84766 - DNA, 35 bp, Artificial Sequence
  Synthetic oligonucleotide
gtgcgactcacctcaggctccataatgtttcacga

SEQ ID NO: 84767 - DNA, 37 bp, Artificial Sequence
  Synthetic oligonucleotide
ggtccatcacacgctacatcgtcgcccaccgagacga

SEQ ID NO: 84768 - DNA, 37 bp, Artificial Sequence
  Synthetic oligonucleotide
gatcagacgaaacctgtaaggctcacgaatgagacga

SEQ ID NO: 84769 - DNA, 37 bp, Artificial Sequence
  Synthetic oligonucleotide
tcccgtacacaggtggaatctgtgtgtctgtacccga

SEQ ID NO: 84770 - DNA, 37 bp, Artificial Sequence
  Synthetic oligonucleotide
tcctggccccacatgttctaagcgtattatacgccga

SEQ ID NO: 84771 - DNA, 37 bp, Artificial Sequence
  Synthetic oligonucleotide
agtagaacggggtggtggcccgagaggagagtatcga

SEQ ID NO: 84772 - DNA, 35 bp, Artificial Sequence
  Synthetic oligonucleotide
aacgtcgagcccctcgcctctattgacatcttcga

SEQ ID NO: 84773 - DNA, 37 bp, Artificial Sequence
  Synthetic oligonucleotide
gccccggggaaagtgaaatcatacaaaggggcacgga

SEQ ID NO: 84774 - DNA, 37 bp, Artificial Sequence
  Synthetic oligonucleotide
gcccaccactatctataatacagtgtcttataccgga

SEQ ID NO: 84775 - DNA, 37 bp, Artificial Sequence
  Synthetic oligonucleotide
ttgagggggaacacgggagtttaatggatatgtcgga

SEQ ID NO: 84776 - DNA, 37 bp, Artificial Sequence
  Synthetic oligonucleotide
taaggggacatagttgggcttgggggacaaggtggga

SEQ ID NO: 84777 - DNA, 38 bp, Artificial Sequence
  Synthetic oligonucleotide
gataggccaaagaagcgtagggcgaagaggggaaatga

SEQ ID NO: 84778 - DNA, 38 bp, Artificial Sequence
  Synthetic oligonucleotide
tacttagtacgcggcgggggggaatgggtgatccatga

SEQ ID NO: 84779 - DNA, 37 bp, Artificial Sequence
  Synthetic oligonucleotide
gaacggctaatgcaatgacggagaggggaggtgatga

SEQ ID NO: 84780 - DNA, 35 bp, Artificial Sequence
  Synthetic oligonucleotide
attgccgcgcataaggtgttcctccactaccctga

SEQ ID NO: 84781 - DNA, 38 bp, Artificial Sequence
  Synthetic oligonucleotide
gccgtgagccacccgtccttcggcttcctttaccctga

SEQ ID NO: 84782 - DNA, 38 bp, Artificial Sequence
  Synthetic oligonucleotide
acgcactgcccaaatagttccgtgaacttgcctcctga

SEQ ID NO: 84783 - DNA, 38 bp, Artificial Sequence
  Synthetic oligonucleotide
gacaggtgaacactgtagtacgatcattaatttgctga

SEQ ID NO: 84784 - DNA, 38 bp, Artificial Sequence
  Synthetic oligonucleotide
gtgggcctctgcattgacgcagtctcaactccatctga

SEQ ID NO: 84785 - DNA, 38 bp, Artificial Sequence
  Synthetic oligonucleotide
gtgggaaggatgggatggcaggtcaatggttggagtga

SEQ ID NO: 84786 - DNA, 38 bp, Artificial Sequence
  Synthetic oligonucleotide
gacatggtggtgttgtacctggtggggcattttagtga

SEQ ID NO: 84787 - DNA, 38 bp, Artificial Sequence
  Synthetic oligonucleotide
aagcacgaacttgcgcgccacatctccggtctaggtga

SEQ ID NO: 84788 - DNA, 38 bp, Artificial Sequence
  Synthetic oligonucleotide
ttgggtgatagtacggagggagtaagtggggggggtga

SEQ ID NO: 84789 - DNA, 36 bp, Artificial Sequence
  Synthetic oligonucleotide
atggggcaagaggggcgtttggtacagacgctgtga

SEQ ID NO: 84790 - DNA, 38 bp, Artificial Sequence
  Synthetic oligonucleotide
acacgggatgcaagggtgagggtgactcggctctgtga

SEQ ID NO: 84791 - DNA, 38 bp, Artificial Sequence
  Synthetic oligonucleotide
tatgcccagccagtaaattgtgtgggttcgtggtgtga

SEQ ID NO: 84792 - DNA, 38 bp, Artificial Sequence
  Synthetic oligonucleotide
gaaccaccgtacagtggtttccctgttagccccattga

SEQ ID NO: 84793 - DNA, 38 bp, Artificial Sequence
  Synthetic oligonucleotide
gacctatgctcctgaagttcacatctgtactccattga

SEQ ID NO: 84794 - DNA, 38 bp, Artificial Sequence
  Synthetic oligonucleotide
gactccgaccgatattgtccattcctacactcgattga

SEQ ID NO: 84795 - DNA, 35 bp, Artificial Sequence
  Synthetic oligonucleotide
gttgccacccggcggactggcccaaaacatcttga

SEQ ID NO: 84796 - DNA, 38 bp, Artificial Sequence
  Synthetic oligonucleotide
agtgagcggaaggggcattataactcgggggacgttga

SEQ ID NO: 84797 - DNA, 38 bp, Artificial Sequence
  Synthetic oligonucleotide
gcaaaacgcagtatcgtggttagcatcagcaatgttga

SEQ ID NO: 84798 - DNA, 37 bp, Artificial Sequence
  Synthetic oligonucleotide
aagtacggagggtcatgaaggagcagtgcaaatttga

SEQ ID NO: 84799 - DNA, 38 bp, Artificial Sequence
  Synthetic oligonucleotide
gtgcactgcacagagtgttctgcactgccggaatttga

SEQ ID NO: 84800 - DNA, 35 bp, Artificial Sequence
  Synthetic oligonucleotide
tcgagtgacatgccgaaccaccgatatccaacata

SEQ ID NO: 84801 - DNA, 36 bp, Artificial Sequence
  Synthetic oligonucleotide
atgcgctcatgcagggtgtttgcttgggggggcata

SEQ ID NO: 84802 - DNA, 36 bp, Artificial Sequence
  Synthetic oligonucleotide
tgagacaccttgtccttcccatctgacagtggtata

SEQ ID NO: 84803 - DNA, 37 bp, Artificial Sequence
  Synthetic oligonucleotide
gcaagacgcacggcccttcgtccttctcagagcccta

SEQ ID NO: 84804 - DNA, 36 bp, Artificial Sequence
  Synthetic oligonucleotide
tgtcatgggggaaatattggaggaataggcggtgta

SEQ ID NO: 84805 - DNA, 35 bp, Artificial Sequence
  Synthetic oligonucleotide
tccaccatcaagtaagtttttcctcccgttttgta

SEQ ID NO: 84806 - DNA, 35 bp, Artificial Sequence
  Synthetic oligonucleotide
gctcgacgagcacttggatttgagggggatgatta

SEQ ID NO: 84807 - DNA, 35 bp, Artificial Sequence
  Synthetic oligonucleotide
gaattgggaggggggggtaagcgacagttgcaaac

SEQ ID NO: 84808 - DNA, 35 bp, Artificial Sequence
  Synthetic oligonucleotide
tccgccctcctacattgttgtgacactttatcaac

SEQ ID NO: 84809 - DNA, 35 bp, Artificial Sequence
  Synthetic oligonucleotide
gaacctgcgatagtcttctcttctctcgtgctcac

SEQ ID NO: 84810 - DNA, 35 bp, Artificial Sequence
  Synthetic oligonucleotide
actccctagccgtgaactgcgaaaatctttcagac

SEQ ID NO: 84811 - DNA, 35 bp, Artificial Sequence
  Synthetic oligonucleotide
acaagccgtcaccgggaattccatactccttatac

SEQ ID NO: 84812 - DNA, 35 bp, Artificial Sequence
  Synthetic oligonucleotide
gcaccgcctcctcgtttcctcgtttgtcacgtacc

SEQ ID NO: 84813 - DNA, 35 bp, Artificial Sequence
  Synthetic oligonucleotide
gtgccactgtatttggttctgtcgttcctgccccc

SEQ ID NO: 84814 - DNA, 35 bp, Artificial Sequence
  Synthetic oligonucleotide
gccaaactcctacatgggtagcgcctactcgcgcc

SEQ ID NO: 84815 - DNA, 35 bp, Artificial Sequence
  Synthetic oligonucleotide
gcactaaacctcgccacatgtcgcttgcatttcgc

SEQ ID NO: 84816 - DNA, 35 bp, Artificial Sequence
  Synthetic oligonucleotide
acgaactgtcgcggactcccttcacatcaactggc

SEQ ID NO: 84817 - DNA, 35 bp, Artificial Sequence
  Synthetic oligonucleotide
tctggggggtgaggctggagaacgatttgagatgc

SEQ ID NO: 84818 - DNA, 35 bp, Artificial Sequence
  Synthetic oligonucleotide
acccattggttccgttatctgctgcattacgctgc

SEQ ID NO: 84819 - DNA, 35 bp, Artificial Sequence
  Synthetic oligonucleotide
gcaatcgcgcaagtggtgacgtacaccctatctgc

SEQ ID NO: 84820 - DNA, 35 bp, Artificial Sequence
  Synthetic oligonucleotide
gcactgagggttttggtgctatttgcgtgcccatc

SEQ ID NO: 84821 - DNA, 35 bp, Artificial Sequence
  Synthetic oligonucleotide
gtgattgcgtgcctctcagggtctcgctccatatc

SEQ ID NO: 84822 - DNA, 35 bp, Artificial Sequence
  Synthetic oligonucleotide
gtacaccgctcaaataggagcgtgacgtatcactc

SEQ ID NO: 84823 - DNA, 35 bp, Artificial Sequence
  Synthetic oligonucleotide
gctgcacaccgcagactcccggcattgtgtgcctc

SEQ ID NO: 84824 - DNA, 35 bp, Artificial Sequence
  Synthetic oligonucleotide
tcccaacctcaccgtgccctcattgtacctaagtc

SEQ ID NO: 84825 - DNA, 35 bp, Artificial Sequence
  Synthetic oligonucleotide
gacttgcatgccgttcttaagccctgatttaagtc

SEQ ID NO: 84826 - DNA, 35 bp, Artificial Sequence
  Synthetic oligonucleotide
taacgcgctcgcttttcattgccgatgttctattc

SEQ ID NO: 84827 - DNA, 35 bp, Artificial Sequence
  Synthetic oligonucleotide
gatcatcgtgagggaaagagaaggcgggaatagag

SEQ ID NO: 84828 - DNA, 35 bp, Artificial Sequence
  Synthetic oligonucleotide
accaaggcatgaagtgaagatggtggtggctagag

SEQ ID NO: 84829 - DNA, 35 bp, Artificial Sequence
  Synthetic oligonucleotide
tgcatgatcccgagcatattcgccctactgctgag

SEQ ID NO: 84830 - DNA, 35 bp, Artificial Sequence
  Synthetic oligonucleotide
gtcttgcatcaacgttcctcatgtcggccacaacg

SEQ ID NO: 84831 - DNA, 35 bp, Artificial Sequence
  Synthetic oligonucleotide
acaagctgctccgtttcagacccatctctatctcg

SEQ ID NO: 84832 - DNA, 35 bp, Artificial Sequence
  Synthetic oligonucleotide
gggtagaaagcggcccggtcaacacttccctctcg

SEQ ID NO: 84833 - DNA, 35 bp, Artificial Sequence
  Synthetic oligonucleotide
acagccacgtttagcttcattgtacccgaatttgg

SEQ ID NO: 84834 - DNA, 35 bp, Artificial Sequence
  Synthetic oligonucleotide
ttgacccaatgtcatacctgctctccgatttaatg

SEQ ID NO: 84835 - DNA, 35 bp, Artificial Sequence
  Synthetic oligonucleotide
tgatcaggcctacggagagagaagttgccggcatg

SEQ ID NO: 84836 - DNA, 35 bp, Artificial Sequence
  Synthetic oligonucleotide
cctgacgaaccatgagtgccatcctgaaccaactg

SEQ ID NO: 84837 - DNA, 35 bp, Artificial Sequence
  Synthetic oligonucleotide
gtgtagggttacggggagtcgggaacaaaagcgtg

SEQ ID NO: 84838 - DNA, 34 bp, Artificial Sequence
  Synthetic oligonucleotide
aacgccaaccatctcatcgacaccttaccttttg

SEQ ID NO: 84839 - DNA, 35 bp, Artificial Sequence
  Synthetic oligonucleotide
tcaccgtagtagggcggaggaggtcgtttaaccat

SEQ ID NO: 84840 - DNA, 35 bp, Artificial Sequence
  Synthetic oligonucleotide
tagtcacgccggtaagtggggggaatcctgttgat

SEQ ID NO: 84841 - DNA, 35 bp, Artificial Sequence
  Synthetic oligonucleotide
tagtcctcccactcggtattatttccgtacactat

SEQ ID NO: 84842 - DNA, 35 bp, Artificial Sequence
  Synthetic oligonucleotide
gtgcgtggcccacaatgctttttgtaataatctat

SEQ ID NO: 84843 - DNA, 35 bp, Artificial Sequence
  Synthetic oligonucleotide
tcaagtccatcgcgtactgtactatcaagcttact

SEQ ID NO: 84844 - DNA, 35 bp, Artificial Sequence
  Synthetic oligonucleotide
atcatgccggcaattgcttcaatctgcactaacct

SEQ ID NO: 84845 - DNA, 35 bp, Artificial Sequence
  Synthetic oligonucleotide
ttcgaccccgtaccagttctgcggtggctcgctct

SEQ ID NO: 84846 - DNA, 35 bp, Artificial Sequence
  Synthetic oligonucleotide
tataccacggtctagaattgctcctacgtcctcgt

SEQ ID NO: 84847 - DNA, 35 bp, Artificial Sequence
  Synthetic oligonucleotide
gaccaagagccaccggatcactgtgcctaccctgt

SEQ ID NO: 84848 - DNA, 35 bp, Artificial Sequence
  Synthetic oligonucleotide
acactccgcgtgcccttactgacggtcgagtactt

SEQ ID NO: 84849 - DNA, 35 bp, Artificial Sequence
  Synthetic oligonucleotide
gtgggcacacgtatggcctaaaccctgggttactt

SEQ ID NO: 84850 - DNA, 35 bp, Artificial Sequence
  Synthetic oligonucleotide
ggggtggtgccgccggctatttatttctcctcgtt

SEQ ID NO: 84851 - DNA, 35 bp, Artificial Sequence
  Synthetic oligonucleotide
tgagggcgggaagtgcggcgaatgttcaggtcgtt

SEQ ID NO: 84852 - DNA, 35 bp, Artificial Sequence
  Synthetic oligonucleotide
tccgattcgacttcaaccttgcttccggagctgtt

SEQ ID NO: 84853 - DNA, 35 bp, Artificial Sequence
  Synthetic oligonucleotide
gcctcatccgcacattcctagggctcttcccattt

SEQ ID NO: 84854 - DNA, 35 bp, Artificial Sequence
  Synthetic oligonucleotide
gacctcgccacggccccagctttaggctgatcttt

SEQ ID NO: 84855 - DNA, 35 bp, Artificial Sequence
  Synthetic oligonucleotide
actgccatctagcctaatgcttaaactttgatttt

SEQ ID NO: 84856 - DNA, 35 bp, Artificial Sequence
  Synthetic oligonucleotide
gatgcctcaggccggaccaatctgcaacgaacaaa

SEQ ID NO: 84857 - DNA, 36 bp, Artificial Sequence
  Synthetic oligonucleotide
acgtgtcgcccactcgtccaggtttccttttccaaa

SEQ ID NO: 84858 - DNA, 36 bp, Artificial Sequence
  Synthetic oligonucleotide
gcgattgaaccgccctcgcaaccatcacgttctaaa

SEQ ID NO: 84859 - DNA, 35 bp, Artificial Sequence
  Synthetic oligonucleotide
tgagtgtcggtcagccttcacacatccctgcacaa

SEQ ID NO: 84860 - DNA, 36 bp, Artificial Sequence
  Synthetic oligonucleotide
tactgatctggctcacctcgtgcgattaactcccaa

SEQ ID NO: 84861 - DNA, 35 bp, Artificial Sequence
  Synthetic oligonucleotide
atgtgcggtcgacccgttgtttgtcgatgctccaa

SEQ ID NO: 84862 - DNA, 36 bp, Artificial Sequence
  Synthetic oligonucleotide
agcgacggggagcgggtcagtcacgacggggtgcaa

SEQ ID NO: 84863 - DNA, 36 bp, Artificial Sequence
  Synthetic oligonucleotide
gacactcgaacaggcagggggaatacaaaacaggaa

SEQ ID NO: 84864 - DNA, 36 bp, Artificial Sequence
  Synthetic oligonucleotide
tgcactaggccccgttacctattcctgcgctaataa

SEQ ID NO: 84865 - DNA, 36 bp, Artificial Sequence
  Synthetic oligonucleotide
atcgttcgccacacttgtctctatccgtcagggcca

SEQ ID NO: 84866 - DNA, 36 bp, Artificial Sequence
  Synthetic oligonucleotide
agtctaaacggaccagcatttcgtaccacccttcca

SEQ ID NO: 84867 - DNA, 36 bp, Artificial Sequence
  Synthetic oligonucleotide
agcccggccccatcagcaccgcactgatttctatca

SEQ ID NO: 84868 - DNA, 34 bp, Artificial Sequence
  Synthetic oligonucleotide
gaaatctgcacgctcctaccagcctgggttatca

SEQ ID NO: 84869 - DNA, 36 bp, Artificial Sequence
  Synthetic oligonucleotide
agatgggccacaagcgggtggggtagggaaagctca

SEQ ID NO: 84870 - DNA, 36 bp, Artificial Sequence
  Synthetic oligonucleotide
atctcccgtcatggggtcccttccccgtaactctca

SEQ ID NO: 84871 - DNA, 36 bp, Artificial Sequence
  Synthetic oligonucleotide
acaactgagacgcacacttgtttagttactctttca

SEQ ID NO: 84872 - DNA, 36 bp, Artificial Sequence
  Synthetic oligonucleotide
gttgtgcacattccacgcttttcatgggccttttca

SEQ ID NO: 84873 - DNA, 37 bp, Artificial Sequence
  Synthetic oligonucleotide
tcaagggaagtagggtggatacgtgtgcgtgttaaga

SEQ ID NO: 84874 - DNA, 37 bp, Artificial Sequence
  Synthetic oligonucleotide
gacgcagtcacatactgctgttctaaaagtcgagaga

SEQ ID NO: 84875 - DNA, 37 bp, Artificial Sequence
  Synthetic oligonucleotide
tgttatcgtgctggtacctccccccgtcccgtagaga

SEQ ID NO: 84876 - DNA, 37 bp, Artificial Sequence
  Synthetic oligonucleotide
gatctagggagcggtggggaggcatcaatttgggaga

SEQ ID NO: 84877 - DNA, 37 bp, Artificial Sequence
  Synthetic oligonucleotide
tcaactcgaccccttgtgcctacatatctgactgaga

SEQ ID NO: 84878 - DNA, 36 bp, Artificial Sequence
  Synthetic oligonucleotide
gactgaagaggggggacgtggatgttcattagacga

SEQ ID NO: 84879 - DNA, 37 bp, Artificial Sequence
  Synthetic oligonucleotide
gttatctcgtgccccgtacctatcgtccttctgacga

SEQ ID NO: 84880 - DNA, 37 bp, Artificial Sequence
  Synthetic oligonucleotide
tatcaaccccacaaccgctttgaggcaacctctacga

SEQ ID NO: 84881 - DNA, 37 bp, Artificial Sequence
  Synthetic oligonucleotide
acgagtgcccacgaggcgatcgactcgccaaacccga

SEQ ID NO: 84882 - DNA, 37 bp, Artificial Sequence
  Synthetic oligonucleotide
acttaggcacctccaacattttgcgacatccctccga

SEQ ID NO: 84883 - DNA, 37 bp, Artificial Sequence
  Synthetic oligonucleotide
tgtaccacggcctcacggatagaaccgcactttccga

SEQ ID NO: 84884 - DNA, 37 bp, Artificial Sequence
  Synthetic oligonucleotide
acaggagcaggccgagggcgggtaaagtgtacagcga

SEQ ID NO: 84885 - DNA, 37 bp, Artificial Sequence
  Synthetic oligonucleotide
tacccaccggcatgttaacaccacgcattattagcga

SEQ ID NO: 84886 - DNA, 35 bp, Artificial Sequence
  Synthetic oligonucleotide
gctcaacgcagttaaacacaatccgccatccgcga

SEQ ID NO: 84887 - DNA, 37 bp, Artificial Sequence
  Synthetic oligonucleotide
gtgagcctgccgccccattccgaattatctagtgcga

SEQ ID NO: 84888 - DNA, 35 bp, Artificial Sequence
  Synthetic oligonucleotide
actggcgtggggttgccgtttatggggtggtgcga

SEQ ID NO: 84889 - DNA, 37 bp, Artificial Sequence
  Synthetic oligonucleotide
gtggcgcattcgcacctgtttcctagccctcaatcga

SEQ ID NO: 84890 - DNA, 37 bp, Artificial Sequence
  Synthetic oligonucleotide
gagccgggtacggaaatacagggcagagagaagtcga

SEQ ID NO: 84891 - DNA, 37 bp, Artificial Sequence
  Synthetic oligonucleotide
atgaagtggggaagggatatagtactagggaattcga

SEQ ID NO: 84892 - DNA, 37 bp, Artificial Sequence
  Synthetic oligonucleotide
gaaccggagagaagtgcagggggacgttgtgggagga

SEQ ID NO: 84893 - DNA, 37 bp, Artificial Sequence
  Synthetic oligonucleotide
gagtgctgagggggaagcgggtgacagttgcgtagga

SEQ ID NO: 84894 - DNA, 37 bp, Artificial Sequence
  Synthetic oligonucleotide
acgcatggcggattaatgaaccgggaggtaaaaggga

SEQ ID NO: 84895 - DNA, 36 bp, Artificial Sequence
  Synthetic oligonucleotide
gccgcacacttttcgtcgtttacttttgccccggga

SEQ ID NO: 84896 - DNA, 37 bp, Artificial Sequence
  Synthetic oligonucleotide
gaccggctgcacaggacagaggagggggaaaggggga

SEQ ID NO: 84897 - DNA, 37 bp, Artificial Sequence
  Synthetic oligonucleotide
gtggtgcggtcggggacagaacacaggaacaggggga

SEQ ID NO: 84898 - DNA, 37 bp, Artificial Sequence
  Synthetic oligonucleotide
gcacgaaacggaaggaaacgtgccggttggaggggga

SEQ ID NO: 84899 - DNA, 35 bp, Artificial Sequence
  Synthetic oligonucleotide
gtgacgagtcaacaaaagggatagtggtggtggga

SEQ ID NO: 84900 - DNA, 38 bp, Artificial Sequence
  Synthetic oligonucleotide
tctggtcagtctggcacccctgcagacctttcccatga

SEQ ID NO: 84901 - DNA, 38 bp, Artificial Sequence
  Synthetic oligonucleotide
gcacccgtctcgatactaatcccaagcactcgaactga

SEQ ID NO: 84902 - DNA, 36 bp, Artificial Sequence
  Synthetic oligonucleotide
gtgatccgcgattgtctttgcattacgtccacctga

SEQ ID NO: 84903 - DNA, 38 bp, Artificial Sequence
  Synthetic oligonucleotide
tccacgtaagcaggtacgtccattcgcttatccgctga

SEQ ID NO: 84904 - DNA, 36 bp, Artificial Sequence
  Synthetic oligonucleotide
tagtacacttcatcgttcacgcgccgacccatctga

SEQ ID NO: 84905 - DNA, 37 bp, Artificial Sequence
  Synthetic oligonucleotide
ttgcagacgctctcccctaggccaccgatccatctga

SEQ ID NO: 84906 - DNA, 37 bp, Artificial Sequence
  Synthetic oligonucleotide
tagtagcaggtcggagaagggaacgtgaaacgtctga

SEQ ID NO: 84907 - DNA, 37 bp, Artificial Sequence
  Synthetic oligonucleotide
tagtggaaggggagagggagtaataggctttaagtga

SEQ ID NO: 84908 - DNA, 37 bp, Artificial Sequence
  Synthetic oligonucleotide
gctacacgactcattatctacgaagtactccgcgtga

SEQ ID NO: 84909 - DNA, 37 bp, Artificial Sequence
  Synthetic oligonucleotide
accgctactttgggcctgttactcactgtcctcgtga

SEQ ID NO: 84910 - DNA, 38 bp, Artificial Sequence
  Synthetic oligonucleotide
gcatggactgggggggttaaagtgtgcctgggtggtga

SEQ ID NO: 84911 - DNA, 38 bp, Artificial Sequence
  Synthetic oligonucleotide
gactccccacatatcatcacgacacgttccttgattga

SEQ ID NO: 84912 - DNA, 37 bp, Artificial Sequence
  Synthetic oligonucleotide
acgttcaggcggggcaaaaggcaatggaaaaacttga

SEQ ID NO: 84913 - DNA, 38 bp, Artificial Sequence
  Synthetic oligonucleotide
agcgagggaagacatctaggaagggagggggggcttga

SEQ ID NO: 84914 - DNA, 37 bp, Artificial Sequence
  Synthetic oligonucleotide
accgacgtccctctcgtgatcgagttccatacgttga

SEQ ID NO: 84915 - DNA, 38 bp, Artificial Sequence
  Synthetic oligonucleotide
tgtcctgattaccttgctcgtctataagccctcgttga

SEQ ID NO: 84916 - DNA, 38 bp, Artificial Sequence
  Synthetic oligonucleotide
tctaccccgctcggcactcatatagactccacggttga

SEQ ID NO: 84917 - DNA, 38 bp, Artificial Sequence
  Synthetic oligonucleotide
tcgcaccccacgaggtccatctcccagcactcctttga

SEQ ID NO: 84918 - DNA, 38 bp, Artificial Sequence
  Synthetic oligonucleotide
tcgaatacccacgctactgagccgtccgacttctttga

SEQ ID NO: 84919 - DNA, 36 bp, Artificial Sequence
  Synthetic oligonucleotide
gagcgagcgggaagacaacacaatgagcgggggata

SEQ ID NO: 84920 - DNA, 35 bp, Artificial Sequence
  Synthetic oligonucleotide
gagtgccttagcccgacaccacagaccaatcacta

SEQ ID NO: 84921 - DNA, 36 bp, Artificial Sequence
  Synthetic oligonucleotide
atgcgacgacggtacccagtcgcctgtcgtttccta

SEQ ID NO: 84922 - DNA, 36 bp, Artificial Sequence
  Synthetic oligonucleotide
ttccgacctcgctcctctgctgcgcataagtagcta

SEQ ID NO: 84923 - DNA, 36 bp, Artificial Sequence
  Synthetic oligonucleotide
tgatgcccgagcttagttctagctactggacctcta

SEQ ID NO: 84924 - DNA, 36 bp, Artificial Sequence
  Synthetic oligonucleotide
gaccaaatcgccaggacggctattgccaacgctcta

SEQ ID NO: 84925 - DNA, 36 bp, Artificial Sequence
  Synthetic oligonucleotide
gcaagaaggggggccgaagtcggaatgtagggtcta

SEQ ID NO: 84926 - DNA, 36 bp, Artificial Sequence
  Synthetic oligonucleotide
gtagagcccttccctgttcgtcgaatgagtgccgta

SEQ ID NO: 84927 - DNA, 36 bp, Artificial Sequence
  Synthetic oligonucleotide
gaacgctccctcacccaaggggacctctatactgta

SEQ ID NO: 84928 - DNA, 36 bp, Artificial Sequence
  Synthetic oligonucleotide
gtgcccataccgagccgaatataccagcctgctgta

SEQ ID NO: 84929 - DNA, 36 bp, Artificial Sequence
  Synthetic oligonucleotide
ggggtgcaccgctcggttatacgacctctcattgta

SEQ ID NO: 84930 - DNA, 36 bp, Artificial Sequence
  Synthetic oligonucleotide
accaccagtcgcggtaacgaagccatctttgcatta

SEQ ID NO: 84931 - DNA, 36 bp, Artificial Sequence
  Synthetic oligonucleotide
tccatcctgcccggctggctcttactatacgtatta

SEQ ID NO: 84932 - DNA, 35 bp, Artificial Sequence
  Synthetic oligonucleotide
tctccgcaaaagctgaacttatcgggtctttctta

SEQ ID NO: 84933 - DNA, 36 bp, Artificial Sequence
  Synthetic oligonucleotide
attcgcccctattgtcgaacgacccttgatacgtta

SEQ ID NO: 84934 - DNA, 36 bp, Artificial Sequence
  Synthetic oligonucleotide
gagtggtccgcattctgtcccgttgtttttgcgtta

SEQ ID NO: 84935 - DNA, 35 bp, Artificial Sequence
  Synthetic oligonucleotide
tccccacctgacgtgctggccttacgtaccattta

SEQ ID NO: 84936 - DNA, 36 bp, Artificial Sequence
  Synthetic oligonucleotide
tatgatcccgcaattgctacccccgtccgttattta

SEQ ID NO: 84937 - DNA, 38 bp, Artificial Sequence
  Synthetic oligonucleotide
gtggtcgcctcctactgcaccctgtgtcctcctgttta

SEQ ID NO: 84938 - DNA, 35 bp, Artificial Sequence
  Synthetic oligonucleotide
tagacgccgagggccgtttccactacttgttttta

SEQ ID NO: 84939 - DNA, 35 bp, Artificial Sequence
  Synthetic oligonucleotide
tcccacctaccacatggtgagaaaatccgtaacac

SEQ ID NO: 84940 - DNA, 35 bp, Artificial Sequence
  Synthetic oligonucleotide
tacgccaccccactataccttccctggtaaggcac

SEQ ID NO: 84941 - DNA, 35 bp, Artificial Sequence
  Synthetic oligonucleotide
aactacatcaaccggcgatcgccctggtcatggac

SEQ ID NO: 84942 - DNA, 35 bp, Artificial Sequence
  Synthetic oligonucleotide
ttggcctcgaatgctaccggctacacgtgcactac

SEQ ID NO: 84943 - DNA, 35 bp, Artificial Sequence
  Synthetic oligonucleotide
tacccccccccttcgactcgtttttgagcgctacc

SEQ ID NO: 84944 - DNA, 35 bp, Artificial Sequence
  Synthetic oligonucleotide
tgcgaagcaagggtatgatagcttgtaacggtacc

SEQ ID NO: 84945 - DNA, 33 bp, Artificial Sequence
  Synthetic oligonucleotide
gtcgtgaacaaatgttgcgttcttacaatcccc

SEQ ID NO: 84946 - DNA, 35 bp, Artificial Sequence
  Synthetic oligonucleotide
tgaacaccttgtgtcgaattgattcatctaatccc

SEQ ID NO: 84947 - DNA, 35 bp, Artificial Sequence
  Synthetic oligonucleotide
ttgatgtgcgtccctatccgaaccataccccagcc

SEQ ID NO: 84948 - DNA, 35 bp, Artificial Sequence
  Synthetic oligonucleotide
actgctttatccgctcccctgtgacctgtccagcc

SEQ ID NO: 84949 - DNA, 35 bp, Artificial Sequence
  Synthetic oligonucleotide
gcccgctactctcattcgcgctaactgttgccgcc

SEQ ID NO: 84950 - DNA, 33 bp, Artificial Sequence
  Synthetic oligonucleotide
gagtcccagccggttcatcccttcgtttttggc

SEQ ID NO: 84951 - DNA, 35 bp, Artificial Sequence
  Synthetic oligonucleotide
atcccatcatccggtttatttcgttgaaaacttgc

SEQ ID NO: 84952 - DNA, 35 bp, Artificial Sequence
  Synthetic oligonucleotide
tcacccaacccgacaactgctcagcttataaactc

SEQ ID NO: 84953 - DNA, 35 bp, Artificial Sequence
  Synthetic oligonucleotide
aaccgcaaccatgatcaaactcccctcgtgcactc

SEQ ID NO: 84954 - DNA, 35 bp, Artificial Sequence
  Synthetic oligonucleotide
actcgtcgaactgctatcaaggccaccgctcactc

SEQ ID NO: 84955 - DNA, 35 bp, Artificial Sequence
  Synthetic oligonucleotide
gcatatcggctgtgtggtgcgcaccttattccgtc

SEQ ID NO: 84956 - DNA, 35 bp, Artificial Sequence
  Synthetic oligonucleotide
aatcgccactcgctgctgtagtcccactcgccttc

SEQ ID NO: 84957 - DNA, 35 bp, Artificial Sequence
  Synthetic oligonucleotide
gttgacgccgttcgcttatatagccgcagagtttc

SEQ ID NO: 84958 - DNA, 35 bp, Artificial Sequence
  Synthetic oligonucleotide
accccctccaccattgcgcatccctagcgacggag

SEQ ID NO: 84959 - DNA, 35 bp, Artificial Sequence
  Synthetic oligonucleotide
attgcgtaggcgaatctggatggagctatgtggag

SEQ ID NO: 84960 - DNA, 35 bp, Artificial Sequence
  Synthetic oligonucleotide
gctgcctgccaccgagcttcttaatcccgaaatag

SEQ ID NO: 84961 - DNA, 35 bp, Artificial Sequence
  Synthetic oligonucleotide
accaacgcttatttaatagtcgccacctgtctacg

SEQ ID NO: 84962 - DNA, 35 bp, Artificial Sequence
  Synthetic oligonucleotide
gttgacgtaattataggttgctacgacgccccccg

SEQ ID NO: 84963 - DNA, 35 bp, Artificial Sequence
  Synthetic oligonucleotide
atccggaggcctagcatgcgatttacacctctgcg

SEQ ID NO: 84964 - DNA, 35 bp, Artificial Sequence
  Synthetic oligonucleotide
tactcgcctgagaattatgggggtggtaataaggg

SEQ ID NO: 84965 - DNA, 35 bp, Artificial Sequence
  Synthetic oligonucleotide
gagaggggaaagcaaaggtgcaagttgtttttggg

SEQ ID NO: 84966 - DNA, 35 bp, Artificial Sequence
  Synthetic oligonucleotide
tcatgcccgtgcgacgtttcttccttgtatcctgg

SEQ ID NO: 84967 - DNA, 35 bp, Artificial Sequence
  Synthetic oligonucleotide
gatgagagtctgcgtggagcaatgaggcggagtgg

SEQ ID NO: 84968 - DNA, 35 bp, Artificial Sequence
  Synthetic oligonucleotide
acatccatgacacgtgcatatatataccaaacctg

SEQ ID NO: 84969 - DNA, 35 bp, Artificial Sequence
  Synthetic oligonucleotide
gaccacaacagagaaaggatgtgttcgtgttattg

SEQ ID NO: 84970 - DNA, 35 bp, Artificial Sequence
  Synthetic oligonucleotide
ttcgctccacactgcatcgtgtgaagtcgttccat

SEQ ID NO: 84971 - DNA, 35 bp, Artificial Sequence
  Synthetic oligonucleotide
ttacaaccccggtcgctacagactgctcaccacct

SEQ ID NO: 84972 - DNA, 35 bp, Artificial Sequence
  Synthetic oligonucleotide
gtccacgggcatgagcgtactagacattaccacct

SEQ ID NO: 84973 - DNA, 35 bp, Artificial Sequence
  Synthetic oligonucleotide
tcgattggcccatccgtcaaggcttacgcccgcct

SEQ ID NO: 84974 - DNA, 35 bp, Artificial Sequence
  Synthetic oligonucleotide
tgcgcacaccccgcgccatcttagaccatgatcct

SEQ ID NO: 84975 - DNA, 35 bp, Artificial Sequence
  Synthetic oligonucleotide
agcccggtcttaatcggtgcaggccttactatcct

SEQ ID NO: 84976 - DNA, 35 bp, Artificial Sequence
  Synthetic oligonucleotide
agtagagcagggtgaacagtggcaatgtcccatct

SEQ ID NO: 84977 - DNA, 35 bp, Artificial Sequence
  Synthetic oligonucleotide
gtcggttcacgtgcatagcctacaaaacgccctct

SEQ ID NO: 84978 - DNA, 35 bp, Artificial Sequence
  Synthetic oligonucleotide
tctgggagggtaggggttaataataaaaatttagt

SEQ ID NO: 84979 - DNA, 35 bp, Artificial Sequence
  Synthetic oligonucleotide
tccatcctgtcagtttccaaaaatctgtgcacggt

SEQ ID NO: 84980 - DNA, 35 bp, Artificial Sequence
  Synthetic oligonucleotide
gttagccaacggatcaggcaacagaatagtaatgt

SEQ ID NO: 84981 - DNA, 35 bp, Artificial Sequence
  Synthetic oligonucleotide
ggaccgcctacgggccacgcataaatcttttctgt

SEQ ID NO: 84982 - DNA, 35 bp, Artificial Sequence
  Synthetic oligonucleotide
tcggaggaagccaatatccaacgaacctgtcttgt

SEQ ID NO: 84983 - DNA, 35 bp, Artificial Sequence
  Synthetic oligonucleotide
atgacatccctcccatgcgagtatgtatgcacctt

SEQ ID NO: 84984 - DNA, 35 bp, Artificial Sequence
  Synthetic oligonucleotide
tctgtacccagcaccgggagctttctaactacctt

SEQ ID NO: 84985 - DNA, 35 bp, Artificial Sequence
  Synthetic oligonucleotide
tactatgtaggcaagtatcgtcgattcacgccctt

SEQ ID NO: 84986 - DNA, 35 bp, Artificial Sequence
  Synthetic oligonucleotide
tcacctcgggtgaactctcctgttatcgattgctt

SEQ ID NO: 84987 - DNA, 35 bp, Artificial Sequence
  Synthetic oligonucleotide
tttgggaccccaagtttgtttcatttcccgtagtt

SEQ ID NO: 84988 - DNA, 35 bp, Artificial Sequence
  Synthetic oligonucleotide
tacgttgcgtgcagctctatataccttcgttagtt

SEQ ID NO: 84989 - DNA, 35 bp, Artificial Sequence
  Synthetic oligonucleotide
gcctccctgcctcttcaggttatttggctttcgtt

SEQ ID NO: 84990 - DNA, 35 bp, Artificial Sequence
  Synthetic oligonucleotide
tttgcacatacaaaccgagcccgtactgtcgtttt

SEQ ID NO: 84991 - DNA, 36 bp, Artificial Sequence
  Synthetic oligonucleotide
gacaacccagattagaaacccatggccacccaaaaa

SEQ ID NO: 84992 - DNA, 36 bp, Artificial Sequence
  Synthetic oligonucleotide
ttgagcggagctgatgtagcaactcacaccagcaaa

SEQ ID NO: 84993 - DNA, 36 bp, Artificial Sequence
  Synthetic oligonucleotide
aaccccaggcgcgctcgcacaccgtaacactggaaa

SEQ ID NO: 84994 - DNA, 35 bp, Artificial Sequence
  Synthetic oligonucleotide
gtgatgcgggacgaggacggagaacaaggtgtaaa

SEQ ID NO: 84995 - DNA, 35 bp, Artificial Sequence
  Synthetic oligonucleotide
gttgcactatgcatgctcctaaaccattgccccaa

SEQ ID NO: 84996 - DNA, 36 bp, Artificial Sequence
  Synthetic oligonucleotide
tccgccgtcctcttcgttccctacaggctcgtccaa

SEQ ID NO: 84997 - DNA, 36 bp, Artificial Sequence
  Synthetic oligonucleotide
acccaccaatgactaccctgcgatcacctggatcaa

SEQ ID NO: 84998 - DNA, 35 bp, Artificial Sequence
  Synthetic oligonucleotide
gtgtcctgcaaacacacttgtgccaacagaacgaa

SEQ ID NO: 84999 - DNA, 35 bp, Artificial Sequence
  Synthetic oligonucleotide
agtacgggtcgggggctgggacggggagtgccgaa

SEQ ID NO: 85000 - DNA, 36 bp, Artificial Sequence
  Synthetic oligonucleotide
gcccttcccacatccggttcacctacaattaggtaa

SEQ ID NO: 85001 - DNA, 35 bp, Artificial Sequence
  Synthetic oligonucleotide
gccacagtcggtttgaagtatttattcctcccaca

SEQ ID NO: 85002 - DNA, 36 bp, Artificial Sequence
  Synthetic oligonucleotide
acctagctaggactgaggggggaggaaaaatggaca

SEQ ID NO: 85003 - DNA, 35 bp, Artificial Sequence
  Synthetic oligonucleotide
tgcccacatttcgcttcatactgaccgccattaca

SEQ ID NO: 85004 - DNA, 36 bp, Artificial Sequence
  Synthetic oligonucleotide
tcctggccccgcagaacgctccccacccgtctacca

SEQ ID NO: 85005 - DNA, 36 bp, Artificial Sequence
  Synthetic oligonucleotide
gaccactcacgtaggtagacaacactcttagtacca

SEQ ID NO: 85006 - DNA, 36 bp, Artificial Sequence
  Synthetic oligonucleotide
tgtccatccgactacttcaaagactcttgtagccca

SEQ ID NO: 85007 - DNA, 36 bp, Artificial Sequence
  Synthetic oligonucleotide
gccaacaagccggtagggaaggctgagaacactcca

SEQ ID NO: 85008 - DNA, 36 bp, Artificial Sequence
  Synthetic oligonucleotide
ttatcgccctgttgctcccagttaaagtgccccgca

SEQ ID NO: 85009 - DNA, 37 bp, Artificial Sequence
  Synthetic oligonucleotide
acccccctggctgtaccaacaatgttgtttctccgca

SEQ ID NO: 85010 - DNA, 36 bp, Artificial Sequence
  Synthetic oligonucleotide
tacgcccgggaaaaaaggtaaaacgggcaacaggca

SEQ ID NO: 85011 - DNA, 35 bp, Artificial Sequence
  Synthetic oligonucleotide
ggtggagggaatatagcgtgggggtaacggtggca

SEQ ID NO: 85012 - DNA, 36 bp, Artificial Sequence
  Synthetic oligonucleotide
tacccgcgaacaataaattaccacccttctggtgca

SEQ ID NO: 85013 - DNA, 36 bp, Artificial Sequence
  Synthetic oligonucleotide
ggagttacggccatcatctattctgaccacattgca

SEQ ID NO: 85014 - DNA, 36 bp, Artificial Sequence
  Synthetic oligonucleotide
gggccaacgccgtacgcctctcgcacacccattgca

SEQ ID NO: 85015 - DNA, 33 bp, Artificial Sequence
  Synthetic oligonucleotide
tcgatcggggggtcgggaagtaacgtcgcatca

SEQ ID NO: 85016 - DNA, 37 bp, Artificial Sequence
  Synthetic oligonucleotide
agaacgggggacatgccaagtggaaggaggggaaaga

SEQ ID NO: 85017 - DNA, 37 bp, Artificial Sequence
  Synthetic oligonucleotide
ggaatggggatgagggtggatgtagagaagtagaaga

SEQ ID NO: 85018 - DNA, 36 bp, Artificial Sequence
  Synthetic oligonucleotide
ggagagattcacaggtaggacatggtagggtgcaga

SEQ ID NO: 85019 - DNA, 37 bp, Artificial Sequence
  Synthetic oligonucleotide
tccctctgacgccattggttagcctgtactattcaga

SEQ ID NO: 85020 - DNA, 37 bp, Artificial Sequence
  Synthetic oligonucleotide
tccaacattcgtccgactccccgctacatcacggaga

SEQ ID NO: 85021 - DNA, 37 bp, Artificial Sequence
  Synthetic oligonucleotide
gtaacgagggtgtgtgaagggtaatctaccagggaga

SEQ ID NO: 85022 - DNA, 36 bp, Artificial Sequence
  Synthetic oligonucleotide
gtggggtgaggggtcgtaagggacaaccgggttaga

SEQ ID NO: 85023 - DNA, 37 bp, Artificial Sequence
  Synthetic oligonucleotide
gctacccatgccccttatgtcgttatcaccttttaga

SEQ ID NO: 85024 - DNA, 36 bp, Artificial Sequence
  Synthetic oligonucleotide
gtgaccccccgtaaatcgtaagagacgcaaacacga

SEQ ID NO: 85025 - DNA, 37 bp, Artificial Sequence
  Synthetic oligonucleotide
gaatgatcgggaagggaaggcacgaacgaggctacga

SEQ ID NO: 85026 - DNA, 36 bp, Artificial Sequence
  Synthetic oligonucleotide
gtgccacctcctgcgcccaacccgatgccaatgcga

SEQ ID NO: 85027 - DNA, 37 bp, Artificial Sequence
  Synthetic oligonucleotide
atgacaggtgggcagtacttacaagaggtagatgcga

SEQ ID NO: 85028 - DNA, 37 bp, Artificial Sequence
  Synthetic oligonucleotide
gccggtagcaacacatctggctacttacactttgcga

SEQ ID NO: 85029 - DNA, 36 bp, Artificial Sequence
  Synthetic oligonucleotide
acatcgcggaactggttctcgactcacgacactcga

SEQ ID NO: 85030 - DNA, 36 bp, Artificial Sequence
  Synthetic oligonucleotide
atcgcgtatgcgcgttccttctcgccgccccttcga

SEQ ID NO: 85031 - DNA, 37 bp, Artificial Sequence
  Synthetic oligonucleotide
acaggtaggcgatttgacagggagggaacaaaaagga

SEQ ID NO: 85032 - DNA, 36 bp, Artificial Sequence
  Synthetic oligonucleotide
aatggggggagggcttgcagggagaaatactaagga

SEQ ID NO: 85033 - DNA, 35 bp, Artificial Sequence
  Synthetic oligonucleotide
gacaagagggggtgtggattttgggatacttagga

SEQ ID NO: 85034 - DNA, 37 bp, Artificial Sequence
  Synthetic oligonucleotide
gtcacagtaggggtggggatggtacagcgaccacgga

SEQ ID NO: 85035 - DNA, 37 bp, Artificial Sequence
  Synthetic oligonucleotide
attggactcggggtgggggaggaataaggctcaggga

SEQ ID NO: 85036 - DNA, 37 bp, Artificial Sequence
  Synthetic oligonucleotide
tatggggggagggcgatgaagcgggactttagaggga

SEQ ID NO: 85037 - DNA, 37 bp, Artificial Sequence
  Synthetic oligonucleotide
tgtggttggccgtatgaataggtttgccctgacggga

SEQ ID NO: 85038 - DNA, 37 bp, Artificial Sequence
  Synthetic oligonucleotide
ttgcggggaaagggagaatgacggaaggtctcttgga

SEQ ID NO: 85039 - DNA, 38 bp, Artificial Sequence
  Synthetic oligonucleotide
tccatgcccatccagtcctcggacgctcactagaatga

SEQ ID NO: 85040 - DNA, 37 bp, Artificial Sequence
  Synthetic oligonucleotide
acgactgtccctgccggcttaggatccccccgaatga

SEQ ID NO: 85041 - DNA, 37 bp, Artificial Sequence
  Synthetic oligonucleotide
gcacagatccgccgactcatttttatactgaccatga

SEQ ID NO: 85042 - DNA, 38 bp, Artificial Sequence
  Synthetic oligonucleotide
gcacctacctgctgacgacttactcttaacatccatga

SEQ ID NO: 85043 - DNA, 38 bp, Artificial Sequence
  Synthetic oligonucleotide
tgcgacggaggaggaggcggcatggggaaagcggatga

SEQ ID NO: 85044 - DNA, 38 bp, Artificial Sequence
  Synthetic oligonucleotide
agcgagagtaaggggggcgtaggggcggatcggactga

SEQ ID NO: 85045 - DNA, 38 bp, Artificial Sequence
  Synthetic oligonucleotide
gcgaagcagccggatttacctgcaacatctcttactga

SEQ ID NO: 85046 - DNA, 37 bp, Artificial Sequence
  Synthetic oligonucleotide
aacgcgccatgaacctataaaactacacgcagcctga

SEQ ID NO: 85047 - DNA, 38 bp, Artificial Sequence
  Synthetic oligonucleotide
tgccgtaacgcatctgtagaacccggcctttttcctga

SEQ ID NO: 85048 - DNA, 38 bp, Artificial Sequence
  Synthetic oligonucleotide
gacactctgggaccatccatgcagtcacgtccagctga

SEQ ID NO: 85049 - DNA, 38 bp, Artificial Sequence
  Synthetic oligonucleotide
gcgccgccacgctggatctgatcttctcaccaatctga

SEQ ID NO: 85050 - DNA, 38 bp, Artificial Sequence
  Synthetic oligonucleotide
atccgcgcaccaagctggcgaactaaactcatctctga

SEQ ID NO: 85051 - DNA, 38 bp, Artificial Sequence
  Synthetic oligonucleotide
ttcgagcctctctccatggtggcaaacctgttttctga

SEQ ID NO: 85052 - DNA, 38 bp, Artificial Sequence
  Synthetic oligonucleotide
tcacctacctcagatccacccatttataccgaacgtga

SEQ ID NO: 85053 - DNA, 38 bp, Artificial Sequence
  Synthetic oligonucleotide
taagctgcaggaacttggagagaggacatgtcccgtga

SEQ ID NO: 85054 - DNA, 38 bp, Artificial Sequence
  Synthetic oligonucleotide
gaggaaaacggggaggagggctcgtggaaaggccgtga

SEQ ID NO: 85055 - DNA, 37 bp, Artificial Sequence
  Synthetic oligonucleotide
tcagaggtcggctttctctggacctccaaaactgtga

SEQ ID NO: 85056 - DNA, 38 bp, Artificial Sequence
  Synthetic oligonucleotide
tatgatgaggggcgggaggtaatagaaaggtagtgtga

SEQ ID NO: 85057 - DNA, 38 bp, Artificial Sequence
  Synthetic oligonucleotide
gatagctgcccagtccccacacaccgtccagtttgtga

SEQ ID NO: 85058 - DNA, 38 bp, Artificial Sequence
  Synthetic oligonucleotide
acccgccagtcgtcccccgcaatgatcgaataccttga

SEQ ID NO: 85059 - DNA, 38 bp, Artificial Sequence
  Synthetic oligonucleotide
gcctgcacccgttacgttcggagggcgctttaccttga

SEQ ID NO: 85060 - DNA, 37 bp, Artificial Sequence
  Synthetic oligonucleotide
tcactagcccatgctgctctatcccagatggccttga

SEQ ID NO: 85061 - DNA, 37 bp, Artificial Sequence
  Synthetic oligonucleotide
atcaccaccgacagacctctcatcattgcctccttga

SEQ ID NO: 85062 - DNA, 38 bp, Artificial Sequence
  Synthetic oligonucleotide
gaaggccaccctaccgactgtgatcttcggtttcttga

SEQ ID NO: 85063 - DNA, 37 bp, Artificial Sequence
  Synthetic oligonucleotide
tttcacccccgtacaccaataaagtttagacagttga

SEQ ID NO: 85064 - DNA, 36 bp, Artificial Sequence
  Synthetic oligonucleotide
gcgtgtcagcctgctcttttccctcccgcacgttga

SEQ ID NO: 85065 - DNA, 38 bp, Artificial Sequence
  Synthetic oligonucleotide
ttcgggggatgaagggtaggcaaggaggggagcgttga

SEQ ID NO: 85066 - DNA, 37 bp, Artificial Sequence
  Synthetic oligonucleotide
tttcaccccgcctgaaataactgtcccgcccgtttga

SEQ ID NO: 85067 - DNA, 38 bp, Artificial Sequence
  Synthetic oligonucleotide
gcactgagaccagcccttcgtgtcatccacatttttga

SEQ ID NO: 85068 - DNA, 38 bp, Artificial Sequence
  Synthetic oligonucleotide
tacgagcaggaagcagaagttggaatgggggtttttga

SEQ ID NO: 85069 - DNA, 36 bp, Artificial Sequence
  Synthetic oligonucleotide
aaaaccgccaacaccgtccgtcctacggtctccata

SEQ ID NO: 85070 - DNA, 36 bp, Artificial Sequence
  Synthetic oligonucleotide
acccacaaacgcagcctgccaaagtagtcgaaccta

SEQ ID NO: 85071 - DNA, 36 bp, Artificial Sequence
  Synthetic oligonucleotide
acctcctccttgtattaactctgctagcgatgccta

SEQ ID NO: 85072 - DNA, 36 bp, Artificial Sequence
  Synthetic oligonucleotide
acaagccaggtcacattacctttatgcgtgctccta

SEQ ID NO: 85073 - DNA, 36 bp, Artificial Sequence
  Synthetic oligonucleotide
acacgccgtggagagtaaggatggaggccatatcta

SEQ ID NO: 85074 - DNA, 36 bp, Artificial Sequence
  Synthetic oligonucleotide
agacgccactcgcgccccgtgacgtcctcctaagta

SEQ ID NO: 85075 - DNA, 36 bp, Artificial Sequence
  Synthetic oligonucleotide
gttcagctgacaaattgctccaccttcctctcagta

SEQ ID NO: 85076 - DNA, 36 bp, Artificial Sequence
  Synthetic oligonucleotide
agatacgcatgcaggtcaacacccacgagagacgta

SEQ ID NO: 85077 - DNA, 35 bp, Artificial Sequence
  Synthetic oligonucleotide
tgccgcaagctcacctcttcttgagccgacccgta

SEQ ID NO: 85078 - DNA, 36 bp, Artificial Sequence
  Synthetic oligonucleotide
tcagcaacaagtctattcgtgacctcatttttcgta

SEQ ID NO: 85079 - DNA, 35 bp, Artificial Sequence
  Synthetic oligonucleotide
atgtcaccccagccggaccgcaggctgtttaatta

SEQ ID NO: 85080 - DNA, 36 bp, Artificial Sequence
  Synthetic oligonucleotide
gcacccgggagaacgtgcccccaagcactaacatta

SEQ ID NO: 85081 - DNA, 36 bp, Artificial Sequence
  Synthetic oligonucleotide
tgtgcacggtggcccctttttatatgtctggtatta

SEQ ID NO: 85082 - DNA, 35 bp, Artificial Sequence
  Synthetic oligonucleotide
atccctaacgccaatactcggtttggcccgcctta

SEQ ID NO: 85083 - DNA, 36 bp, Artificial Sequence
  Synthetic oligonucleotide
tcaagcaaaggccccggttgttttgtcccatattta

SEQ ID NO: 85084 - DNA, 34 bp, Artificial Sequence
  Synthetic oligonucleotide
gcactagagcggccctcgacatcatctatcacac

SEQ ID NO: 85085 - DNA, 35 bp, Artificial Sequence
  Synthetic oligonucleotide
gagcatttcaaatgcctgtcgaaacccttgcccac

SEQ ID NO: 85086 - DNA, 35 bp, Artificial Sequence
  Synthetic oligonucleotide
tgcctgtcgccgagaaccgcagctccctactccac

SEQ ID NO: 85087 - DNA, 35 bp, Artificial Sequence
  Synthetic oligonucleotide
atgccccgccacaactttctggcctacggttccac

SEQ ID NO: 85088 - DNA, 35 bp, Artificial Sequence
  Synthetic oligonucleotide
tggtacctgcacaacaggcttcgaccgttaacacc

SEQ ID NO: 85089 - DNA, 35 bp, Artificial Sequence
  Synthetic oligonucleotide
ggagtgcccatggtacttatctgccacgttatacc

SEQ ID NO: 85090 - DNA, 35 bp, Artificial Sequence
  Synthetic oligonucleotide
gcgcatgaccaatgatctgtctagatcgccctacc

SEQ ID NO: 85091 - DNA, 35 bp, Artificial Sequence
  Synthetic oligonucleotide
taggtggagccccgctaacgacgcccccagttacc

SEQ ID NO: 85092 - DNA, 36 bp, Artificial Sequence
  Synthetic oligonucleotide
aagtacgcctctccagtactcctcaggtgtcacccc

SEQ ID NO: 85093 - DNA, 35 bp, Artificial Sequence
  Synthetic oligonucleotide
atgaaaccacaattccataaccagccaggatcccc

SEQ ID NO: 85094 - DNA, 35 bp, Artificial Sequence
  Synthetic oligonucleotide
gtgcgcacccacgtaccaggcccccgagcccgccc

SEQ ID NO: 85095 - DNA, 35 bp, Artificial Sequence
  Synthetic oligonucleotide
agctcaacaggcaggtcttgtttcgtctctggtcc

SEQ ID NO: 85096 - DNA, 35 bp, Artificial Sequence
  Synthetic oligonucleotide
agccccacttcgtagcacccgcccggagcccacgc

SEQ ID NO: 85097 - DNA, 35 bp, Artificial Sequence
  Synthetic oligonucleotide
acatgcgcaaagaaatatggaagtgtgcgttgcgc

SEQ ID NO: 85098 - DNA, 35 bp, Artificial Sequence
  Synthetic oligonucleotide
aggtcacggtgaggccacgtataccacccccctgc

SEQ ID NO: 85099 - DNA, 35 bp, Artificial Sequence
  Synthetic oligonucleotide
aacagtggcacaaccctcccacttttaggtacctc

SEQ ID NO: 85100 - DNA, 35 bp, Artificial Sequence
  Synthetic oligonucleotide
gatggccaaatcaaccgagcgtaccgtcaacgctc

SEQ ID NO: 85101 - DNA, 35 bp, Artificial Sequence
  Synthetic oligonucleotide
ggtcactccgtagattggcccgaccccatagtctc

SEQ ID NO: 85102 - DNA, 35 bp, Artificial Sequence
  Synthetic oligonucleotide
gctgacgatgggggagaggaattatgttgcgaaag

SEQ ID NO: 85103 - DNA, 35 bp, Artificial Sequence
  Synthetic oligonucleotide
tcctcaccgcgacccttcaaatgcgttccatgccg

SEQ ID NO: 85104 - DNA, 35 bp, Artificial Sequence
  Synthetic oligonucleotide
atagccacaagctgctatcgtattcatgccgtgcg

SEQ ID NO: 85105 - DNA, 35 bp, Artificial Sequence
  Synthetic oligonucleotide
tgttacccgtttctatcgcaaggcctccctactcg

SEQ ID NO: 85106 - DNA, 35 bp, Artificial Sequence
  Synthetic oligonucleotide
tcgcccctccgctttgttcttgctcctcttggtcg

SEQ ID NO: 85107 - DNA, 35 bp, Artificial Sequence
  Synthetic oligonucleotide
tacggaaggagggaaagggttggggtagtgatcgg

SEQ ID NO: 85108 - DNA, 35 bp, Artificial Sequence
  Synthetic oligonucleotide
ttagcccatcgaatcatgtgcctcctaaactatgg

SEQ ID NO: 85109 - DNA, 35 bp, Artificial Sequence
  Synthetic oligonucleotide
tcatccgaggtctcctgtcgaatttccacaatatg

SEQ ID NO: 85110 - DNA, 35 bp, Artificial Sequence
  Synthetic oligonucleotide
acctgccatcattgattaattgcgttcatgcactg

SEQ ID NO: 85111 - DNA, 35 bp, Artificial Sequence
  Synthetic oligonucleotide
gtaggttgatgaacggaggacgtaaggaggtggtg

SEQ ID NO: 85112 - DNA, 35 bp, Artificial Sequence
  Synthetic oligonucleotide
tccgtccccgctgtcatgtttgcgttcaatccttg

SEQ ID NO: 85113 - DNA, 35 bp, Artificial Sequence
  Synthetic oligonucleotide
gtgcaaaagcgagggggggacacaagtttcatttg

SEQ ID NO: 85114 - DNA, 35 bp, Artificial Sequence
  Synthetic oligonucleotide
tgtggaccatcgcacggcacccttaggcagtaaat

SEQ ID NO: 85115 - DNA, 35 bp, Artificial Sequence
  Synthetic oligonucleotide
tatcccgtacctgagctcccccaagcctcatcgat

SEQ ID NO: 85116 - DNA, 35 bp, Artificial Sequence
  Synthetic oligonucleotide
gcctggtatggcctccattatcgttgacctcaact

SEQ ID NO: 85117 - DNA, 35 bp, Artificial Sequence
  Synthetic oligonucleotide
acacgccccaattacgaacataccctcgtgggcct

SEQ ID NO: 85118 - DNA, 35 bp, Artificial Sequence
  Synthetic oligonucleotide
ttcgcaaaccacagcactccctctgtcttatgcct

SEQ ID NO: 85119 - DNA, 35 bp, Artificial Sequence
  Synthetic oligonucleotide
gccaggaagaagttattatcaggggggggacggct

SEQ ID NO: 85120 - DNA, 35 bp, Artificial Sequence
  Synthetic oligonucleotide
gtgcctggtcgacgttgtcatcttatttactatct

SEQ ID NO: 85121 - DNA, 35 bp, Artificial Sequence
  Synthetic oligonucleotide
ggttggtggcatcctgagtctatcaccgttgttct

SEQ ID NO: 85122 - DNA, 35 bp, Artificial Sequence
  Synthetic oligonucleotide
aaacggacgggtctcatatatcgatctggggaagt

SEQ ID NO: 85123 - DNA, 35 bp, Artificial Sequence
  Synthetic oligonucleotide
tgcatgcaacccagcctttcgtttttcctagacgt

SEQ ID NO: 85124 - DNA, 35 bp, Artificial Sequence
  Synthetic oligonucleotide
aaaataaagggggagtgggatgagagggcgggggt

SEQ ID NO: 85125 - DNA, 35 bp, Artificial Sequence
  Synthetic oligonucleotide
accttcacttgtcatcgagccctgctgaacactgt

SEQ ID NO: 85126 - DNA, 35 bp, Artificial Sequence
  Synthetic oligonucleotide
atcgtgggaccggtcgtcgctatggctctgtactt

SEQ ID NO: 85127 - DNA, 35 bp, Artificial Sequence
  Synthetic oligonucleotide
tcgctgtgcccctgctctgtatccaatccaccctt

SEQ ID NO: 85128 - DNA, 35 bp, Artificial Sequence
  Synthetic oligonucleotide
gtaccatcggtattcaggccctccacttggctgtt

SEQ ID NO: 85129 - DNA, 36 bp, Artificial Sequence
  Synthetic oligonucleotide
tagtggcgcttttccactgtgatctgctcggttgtt

SEQ ID NO: 85130 - DNA, 35 bp, Artificial Sequence
  Synthetic oligonucleotide
tgaaggggacccacgccgtaaaaacatggcccttt

SEQ ID NO: 85131 - DNA, 35 bp, Artificial Sequence
  Synthetic oligonucleotide
gagggcggagtgggctcgacgggatggcaaggttt

SEQ ID NO: 85132 - DNA, 36 bp, Artificial Sequence
  Synthetic oligonucleotide
gaaccacccatcgcagatttttgccaattcatacaa

SEQ ID NO: 85133 - DNA, 36 bp, Artificial Sequence
  Synthetic oligonucleotide
tgtagccccaagccccgcgttaactcttaccctgaa

SEQ ID NO: 85134 - DNA, 35 bp, Artificial Sequence
  Synthetic oligonucleotide
ttggtgctgcttacgttcctctgccaagggccaca

SEQ ID NO: 85135 - DNA, 35 bp, Artificial Sequence
  Synthetic oligonucleotide
gacctccatcaggttacttgccgactctcccacca

SEQ ID NO: 85136 - DNA, 36 bp, Artificial Sequence
  Synthetic oligonucleotide
gctgctctatggttcggccattccgccctgttccca

SEQ ID NO: 85137 - DNA, 36 bp, Artificial Sequence
  Synthetic oligonucleotide
tcaacctccgggaagtgaaattggggtcttgttcca

SEQ ID NO: 85138 - DNA, 36 bp, Artificial Sequence
  Synthetic oligonucleotide
gagtaccggggaactaaagccatgggagggtgggca

SEQ ID NO: 85139 - DNA, 36 bp, Artificial Sequence
  Synthetic oligonucleotide
ggatgcaaagggggtgagttgggaaatgagtggtca

SEQ ID NO: 85140 - DNA, 36 bp, Artificial Sequence
  Synthetic oligonucleotide
tatgaactgccttcactctctttgctttagttgtca

SEQ ID NO: 85141 - DNA, 36 bp, Artificial Sequence
  Synthetic oligonucleotide
actcatgccgcatgcgccttcgtaacgtcccaaaga

SEQ ID NO: 85142 - DNA, 37 bp, Artificial Sequence
  Synthetic oligonucleotide
gccgtggggtgactggaaaaaagaggagtgtacaaga

SEQ ID NO: 85143 - DNA, 37 bp, Artificial Sequence
  Synthetic oligonucleotide
gtcaaacagtacggacagacgtggaacagtgaccaga

SEQ ID NO: 85144 - DNA, 37 bp, Artificial Sequence
  Synthetic oligonucleotide
aatgtgcacacaggccccccgccccgattttttgaga

SEQ ID NO: 85145 - DNA, 37 bp, Artificial Sequence
  Synthetic oligonucleotide
attgcacccgtcctgcactctagttacagtcgttaga

SEQ ID NO: 85146 - DNA, 37 bp, Artificial Sequence
  Synthetic oligonucleotide
gacgaagcatgtcagtgatttggaggagggttaacga

SEQ ID NO: 85147 - DNA, 35 bp, Artificial Sequence
  Synthetic oligonucleotide
ggacgacgcgggggaatcgaattatggtgggacga

SEQ ID NO: 85148 - DNA, 34 bp, Artificial Sequence
  Synthetic oligonucleotide
ccacccgaccaatggcacctcgtacgaatcccga

SEQ ID NO: 85149 - DNA, 37 bp, Artificial Sequence
  Synthetic oligonucleotide
aactgcgactaggtccgctctctggttctcatcccga

SEQ ID NO: 85150 - DNA, 36 bp, Artificial Sequence
  Synthetic oligonucleotide
gatccgaaacgcgtctgatttgcccatttctgccga

SEQ ID NO: 85151 - DNA, 37 bp, Artificial Sequence
  Synthetic oligonucleotide
gttccctcgcccgaacctggtaactcactgtatccga

SEQ ID NO: 85152 - DNA, 36 bp, Artificial Sequence
  Synthetic oligonucleotide
tatcagtgtcaacatctcctgcgctaaggtttccga

SEQ ID NO: 85153 - DNA, 37 bp, Artificial Sequence
  Synthetic oligonucleotide
acaccaccctcggccaagcacatctctttgtatgcga

SEQ ID NO: 85154 - DNA, 37 bp, Artificial Sequence
  Synthetic oligonucleotide
gcacgactcaccggatcctcaacatcttaacgtgcga

SEQ ID NO: 85155 - DNA, 36 bp, Artificial Sequence
  Synthetic oligonucleotide
tgctggacaggaaagggagggcaacgacataaagga

SEQ ID NO: 85156 - DNA, 37 bp, Artificial Sequence
  Synthetic oligonucleotide
ttgtagggtaaggggtacgaagggaggatcaacagga

SEQ ID NO: 85157 - DNA, 37 bp, Artificial Sequence
  Synthetic oligonucleotide
acctggcacagctgacgaggggaagatgggggcagga

SEQ ID NO: 85158 - DNA, 37 bp, Artificial Sequence
  Synthetic oligonucleotide
gatgtgcgggcagtcgggggctcggagggtgtgagga

SEQ ID NO: 85159 - DNA, 35 bp, Artificial Sequence
  Synthetic oligonucleotide
actcagagggagaaaaatgtggtgtactgatagga

SEQ ID NO: 85160 - DNA, 37 bp, Artificial Sequence
  Synthetic oligonucleotide
gcctccgcccattgccctatatgctagtcttgtagga

SEQ ID NO: 85161 - DNA, 36 bp, Artificial Sequence
  Synthetic oligonucleotide
ttcaacgggggggattatgggaggtccgctatcgga

SEQ ID NO: 85162 - DNA, 37 bp, Artificial Sequence
  Synthetic oligonucleotide
tccgtacgccccttttcgttaccgcctcaatttcgga

SEQ ID NO: 85163 - DNA, 37 bp, Artificial Sequence
  Synthetic oligonucleotide
gattatagtggcggaaaagggtagacatgggtaggga

SEQ ID NO: 85164 - DNA, 36 bp, Artificial Sequence
  Synthetic oligonucleotide
tagcccacacaactgcgctatgccacttcaccggga

SEQ ID NO: 85165 - DNA, 36 bp, Artificial Sequence
  Synthetic oligonucleotide
acagcagaaatttcaggaggagggatgagggcggga

SEQ ID NO: 85166 - DNA, 37 bp, Artificial Sequence
  Synthetic oligonucleotide
tcatgaagtcgggtgaaaaactgggatgagggcggga

SEQ ID NO: 85167 - DNA, 37 bp, Artificial Sequence
  Synthetic oligonucleotide
atggtgcagggcgggtgttgctgatggtgacgtggga

SEQ ID NO: 85168 - DNA, 37 bp, Artificial Sequence
  Synthetic oligonucleotide
agcccacccttccgatttttcggcgcaggaccctgga

SEQ ID NO: 85169 - DNA, 37 bp, Artificial Sequence
  Synthetic oligonucleotide
gacgcccctaatgcgtacatagcaaggaacccctgga

SEQ ID NO: 85170 - DNA, 37 bp, Artificial Sequence
  Synthetic oligonucleotide
gtgaaaggcatgggaaggtgaaatgggtgaggctgga

SEQ ID NO: 85171 - DNA, 38 bp, Artificial Sequence
  Synthetic oligonucleotide
gtgcactgccggtgcccgctcccatccctaggacatga

SEQ ID NO: 85172 - DNA, 36 bp, Artificial Sequence
  Synthetic oligonucleotide
aacgcgaccatcacgatttgttctttcccagcatga

SEQ ID NO: 85173 - DNA, 38 bp, Artificial Sequence
  Synthetic oligonucleotide
gcctgttcctgttcattacagacactcttcacctatga

SEQ ID NO: 85174 - DNA, 37 bp, Artificial Sequence
  Synthetic oligonucleotide
gtgttggcaagggggcaagggttcagttcacaactga

SEQ ID NO: 85175 - DNA, 38 bp, Artificial Sequence
  Synthetic oligonucleotide
tacatgccgaccctcgctgcgatcacaatttgaactga

SEQ ID NO: 85176 - DNA, 38 bp, Artificial Sequence
  Synthetic oligonucleotide
ttcaagggtcgggggaggaaatgactgctgagcactga

SEQ ID NO: 85177 - DNA, 37 bp, Artificial Sequence
  Synthetic oligonucleotide
tccaccagagcgaggttcatcgtcacagccgcactga

SEQ ID NO: 85178 - DNA, 37 bp, Artificial Sequence
  Synthetic oligonucleotide
tccgtcactgggcaaccgttgccagtccttcacctga

SEQ ID NO: 85179 - DNA, 37 bp, Artificial Sequence
  Synthetic oligonucleotide
atcgccctcttgcctctctgttcaatgttaaccctga

SEQ ID NO: 85180 - DNA, 38 bp, Artificial Sequence
  Synthetic oligonucleotide
tgagaacgtgacccattatcgcgtaagccagaccctga

SEQ ID NO: 85181 - DNA, 37 bp, Artificial Sequence
  Synthetic oligonucleotide
actccgacgttacatcacgcatttgtcttgaccctga

SEQ ID NO: 85182 - DNA, 38 bp, Artificial Sequence
  Synthetic oligonucleotide
tgcgagttacctgatttcgttctttgttcgtgccctga

SEQ ID NO: 85183 - DNA, 38 bp, Artificial Sequence
  Synthetic oligonucleotide
accgccctctcaacttcataggctgactggtctcctga

SEQ ID NO: 85184 - DNA, 38 bp, Artificial Sequence
  Synthetic oligonucleotide
tgtcccctcaccaccgctgtttagatgtcatattctga

SEQ ID NO: 85185 - DNA, 38 bp, Artificial Sequence
  Synthetic oligonucleotide
gggacgagggcaggagagacgtttggggacagcagtga

SEQ ID NO: 85186 - DNA, 37 bp, Artificial Sequence
  Synthetic oligonucleotide
aatcctacccgcccacgtcccctcagtatgcgagtga

SEQ ID NO: 85187 - DNA, 38 bp, Artificial Sequence
  Synthetic oligonucleotide
tgcgggggggggggaagatgatgcaggggcgatcgtga

SEQ ID NO: 85188 - DNA, 38 bp, Artificial Sequence
  Synthetic oligonucleotide
tcacggaaggatacggaacggactgcaagagacggtga

SEQ ID NO: 85189 - DNA, 37 bp, Artificial Sequence
  Synthetic oligonucleotide
gatagagccaagagcggggagtcctgggtgatggtga

SEQ ID NO: 85190 - DNA, 38 bp, Artificial Sequence
  Synthetic oligonucleotide
gagacggaagaaaaggaatgtatgggggggcgctgtga

SEQ ID NO: 85191 - DNA, 36 bp, Artificial Sequence
  Synthetic oligonucleotide
atgtcgtaccctcacccgaacacatgagacgattga

SEQ ID NO: 85192 - DNA, 37 bp, Artificial Sequence
  Synthetic oligonucleotide
agtgcgatcacatgctactctataccgttctgattga

SEQ ID NO: 85193 - DNA, 38 bp, Artificial Sequence
  Synthetic oligonucleotide
tattgccgccgattctgttgggccctcctcttgattga

SEQ ID NO: 85194 - DNA, 38 bp, Artificial Sequence
  Synthetic oligonucleotide
cctgccgaacgcaacacctatggcctgtttcaccttga

SEQ ID NO: 85195 - DNA, 37 bp, Artificial Sequence
  Synthetic oligonucleotide
gtcacccaagccactcttgacctatagtcagccttga

SEQ ID NO: 85196 - DNA, 37 bp, Artificial Sequence
  Synthetic oligonucleotide
acaggccacaccccagtacatagcgaagctggcttga

SEQ ID NO: 85197 - DNA, 38 bp, Artificial Sequence
  Synthetic oligonucleotide
gactgttatcagccgtttgtaatggctcttttgcttga

SEQ ID NO: 85198 - DNA, 38 bp, Artificial Sequence
  Synthetic oligonucleotide
tctggtacggaaaaatgggagggaagagatagcgttga

SEQ ID NO: 85199 - DNA, 37 bp, Artificial Sequence
  Synthetic oligonucleotide
gcgaggagggtcgggggtcaagagcatagttggttga

SEQ ID NO: 85200 - DNA, 38 bp, Artificial Sequence
  Synthetic oligonucleotide
gggtcgaccgctgaggcgccatacccggatccatttga

SEQ ID NO: 85201 - DNA, 37 bp, Artificial Sequence
  Synthetic oligonucleotide
tactcacgacacgtgccgtacggaaagatccctttga

SEQ ID NO: 85202 - DNA, 38 bp, Artificial Sequence
  Synthetic oligonucleotide
gatgacaggaaggttggtgggcaaggtttcgagtttga

SEQ ID NO: 85203 - DNA, 38 bp, Artificial Sequence
  Synthetic oligonucleotide
gcgccaagcggattcttagtcacgtgccatctttttga

SEQ ID NO: 85204 - DNA, 38 bp, Artificial Sequence
  Synthetic oligonucleotide
acacactacgaacgggcttccacgcatacagtttttga

SEQ ID NO: 85205 - DNA, 37 bp, Artificial Sequence
  Synthetic oligonucleotide
gaccgatctgtggcgagccaacgatttttttttttga

SEQ ID NO: 85206 - DNA, 35 bp, Artificial Sequence
  Synthetic oligonucleotide
ggggacgagagagggggacatggataaggaagata

SEQ ID NO: 85207 - DNA, 36 bp, Artificial Sequence
  Synthetic oligonucleotide
agaagggaacaagctggggtctgaaagggaggtgta

SEQ ID NO: 85208 - DNA, 35 bp, Artificial Sequence
  Synthetic oligonucleotide
atccgtgcgccaccctccaattcagtgttttctta

SEQ ID NO: 85209 - DNA, 36 bp, Artificial Sequence
  Synthetic oligonucleotide
tgaaacgcgtagaatcggacgaggggtgaaaggtta

SEQ ID NO: 85210 - DNA, 36 bp, Artificial Sequence
  Synthetic oligonucleotide
atacgcgggggaaggaatgtggtttttgtaagttta

SEQ ID NO: 85211 - DNA, 35 bp, Artificial Sequence
  Synthetic oligonucleotide
ttgagcacatcgcctaagctccaccatctagttta

SEQ ID NO: 85212 - DNA, 35 bp, Artificial Sequence
  Synthetic oligonucleotide
tcaacctgattacgccgttcttttgcgccatttta

SEQ ID NO: 85213 - DNA, 35 bp, Artificial Sequence
  Synthetic oligonucleotide
ttgcgcacccggaaatgcagcccgctccctggaac

SEQ ID NO: 85214 - DNA, 35 bp, Artificial Sequence
  Synthetic oligonucleotide
gtcgcaaagcactcggttaccttgcaatctaccac

SEQ ID NO: 85215 - DNA, 35 bp, Artificial Sequence
  Synthetic oligonucleotide
gtccgacccacccttagccgtgatgcactaccgac

SEQ ID NO: 85216 - DNA, 35 bp, Artificial Sequence
  Synthetic oligonucleotide
tcttggcccctccatgacttggcttcactgctacc

SEQ ID NO: 85217 - DNA, 35 bp, Artificial Sequence
  Synthetic oligonucleotide
tgcaccgtgtgcgtgacgaacctaggaacttaccc

SEQ ID NO: 85218 - DNA, 35 bp, Artificial Sequence
  Synthetic oligonucleotide
gctaacccgctagacctgccttgagttgccccccc

SEQ ID NO: 85219 - DNA, 35 bp, Artificial Sequence
  Synthetic oligonucleotide
tccgcaccgcgcgcttgcactttttggctcggccc

SEQ ID NO: 85220 - DNA, 35 bp, Artificial Sequence
  Synthetic oligonucleotide
gcaactcctcgtggcttatcaacacatcgggtgcc

SEQ ID NO: 85221 - DNA, 35 bp, Artificial Sequence
  Synthetic oligonucleotide
gtggggcaccgctttctctaattttcgtgcgttcc

SEQ ID NO: 85222 - DNA, 35 bp, Artificial Sequence
  Synthetic oligonucleotide
gagggaaagaaggttgtaacttgggggaagagagc

SEQ ID NO: 85223 - DNA, 35 bp, Artificial Sequence
  Synthetic oligonucleotide
gactctccatctgctatgacttacggtcctctagc

SEQ ID NO: 85224 - DNA, 35 bp, Artificial Sequence
  Synthetic oligonucleotide
ttcccaacgcgcatgccatccatatccgttctagc

SEQ ID NO: 85225 - DNA, 35 bp, Artificial Sequence
  Synthetic oligonucleotide
atacatccacgcgtacggaaccacctacgtacatc

SEQ ID NO: 85226 - DNA, 35 bp, Artificial Sequence
  Synthetic oligonucleotide
agcatgagccgggctagagttgggtaggtgcgatc

SEQ ID NO: 85227 - DNA, 35 bp, Artificial Sequence
  Synthetic oligonucleotide
tccaggacgagcgccgcttaccaccttgtctcgtc

SEQ ID NO: 85228 - DNA, 35 bp, Artificial Sequence
  Synthetic oligonucleotide
gaatagagggggatacgcgcgtggtcagggcacag

SEQ ID NO: 85229 - DNA, 35 bp, Artificial Sequence
  Synthetic oligonucleotide
tcaatcccctcgcgtgaccccctactcaatttgag

SEQ ID NO: 85230 - DNA, 35 bp, Artificial Sequence
  Synthetic oligonucleotide
attcactcgacactccgctaccagcccggctctag

SEQ ID NO: 85231 - DNA, 35 bp, Artificial Sequence
  Synthetic oligonucleotide
taagtaagggtagggtcatggaatggttggtgtag

SEQ ID NO: 85232 - DNA, 35 bp, Artificial Sequence
  Synthetic oligonucleotide
acccacccaggactctgatccgtattagcctcacg

SEQ ID NO: 85233 - DNA, 35 bp, Artificial Sequence
  Synthetic oligonucleotide
tagatagcggcccacagtttttcatgcccataccg

SEQ ID NO: 85234 - DNA, 35 bp, Artificial Sequence
  Synthetic oligonucleotide
tcaggaccggcctctttgtgcgatcattgctaccg

SEQ ID NO: 85235 - DNA, 35 bp, Artificial Sequence
  Synthetic oligonucleotide
ttctcccccgtaccctggtctcagtcatcctgggg

SEQ ID NO: 85236 - DNA, 35 bp, Artificial Sequence
  Synthetic oligonucleotide
tcctcccaccgccgttttacttactgctagcttgg

SEQ ID NO: 85237 - DNA, 35 bp, Artificial Sequence
  Synthetic oligonucleotide
tgatgcccgcctcgatttattgcttttaccctctg

SEQ ID NO: 85238 - DNA, 35 bp, Artificial Sequence
  Synthetic oligonucleotide
acgtgggggcgccggaaaatgactgaagtggggtg

SEQ ID NO: 85239 - DNA, 35 bp, Artificial Sequence
  Synthetic oligonucleotide
cccgtaggggcagtaaaaaacatggtgacaataat

SEQ ID NO: 85240 - DNA, 35 bp, Artificial Sequence
  Synthetic oligonucleotide
tcaagggcagtctcctgtgctcctctaccgccgat

SEQ ID NO: 85241 - DNA, 35 bp, Artificial Sequence
  Synthetic oligonucleotide
actgaggcactcgaacacctttctacgaactatat

SEQ ID NO: 85242 - DNA, 35 bp, Artificial Sequence
  Synthetic oligonucleotide
ttatgcccggctcgacgtcatacctccaaccaact

SEQ ID NO: 85243 - DNA, 35 bp, Artificial Sequence
  Synthetic oligonucleotide
ggggagcgcacccgtttcttggactctctgtgcct

SEQ ID NO: 85244 - DNA, 35 bp, Artificial Sequence
  Synthetic oligonucleotide
acgattggacactgctcagcattctatattttcct

SEQ ID NO: 85245 - DNA, 35 bp, Artificial Sequence
  Synthetic oligonucleotide
attcgggcgtgggggggtgcggtcggtgaaatgct

SEQ ID NO: 85246 - DNA, 35 bp, Artificial Sequence
  Synthetic oligonucleotide
ccacgccacccacatcgagcaccaccggtcgtgct

SEQ ID NO: 85247 - DNA, 35 bp, Artificial Sequence
  Synthetic oligonucleotide
gtcaacccttatgtcgttcccctactggcccctct

SEQ ID NO: 85248 - DNA, 35 bp, Artificial Sequence
  Synthetic oligonucleotide
actatcgcatgccctggttatatgcccttcacagt

SEQ ID NO: 85249 - DNA, 35 bp, Artificial Sequence
  Synthetic oligonucleotide
gttgaacactggggcaatgtaataaagggtgtggt

SEQ ID NO: 85250 - DNA, 35 bp, Artificial Sequence
  Synthetic oligonucleotide
ccaccgtgtatcttatcgctgtcaagaccgcctgt

SEQ ID NO: 85251 - DNA, 35 bp, Artificial Sequence
  Synthetic oligonucleotide
acaggattggcacaatatggtggaggggtggttgt

SEQ ID NO: 85252 - DNA, 35 bp, Artificial Sequence
  Synthetic oligonucleotide
taccgtgacccgcgccctgcaaactacgaggaatt

SEQ ID NO: 85253 - DNA, 35 bp, Artificial Sequence
  Synthetic oligonucleotide
atcgctcccagggacgttatgcgcccttcctaatt

SEQ ID NO: 85254 - DNA, 35 bp, Artificial Sequence
  Synthetic oligonucleotide
gaggccggtggtcccgctggcctttgctccacatt

SEQ ID NO: 85255 - DNA, 35 bp, Artificial Sequence
  Synthetic oligonucleotide
gatgcgtaccgggacacacaatttactcgcgcatt

SEQ ID NO: 85256 - DNA, 35 bp, Artificial Sequence
  Synthetic oligonucleotide
tcagcccactgcccccttacgatgcaagccgcctt

SEQ ID NO: 85257 - DNA, 35 bp, Artificial Sequence
  Synthetic oligonucleotide
attggggggagaacttggagaggaggagcaaggtt

SEQ ID NO: 85258 - DNA, 35 bp, Artificial Sequence
  Synthetic oligonucleotide
tttcacctcgctggtggtcccaggtactacctgtt

SEQ ID NO: 85259 - DNA, 35 bp, Artificial Sequence
  Synthetic oligonucleotide
actagatcccgacgtcgatagcctcacctaaattt

SEQ ID NO: 85260 - DNA, 35 bp, Artificial Sequence
  Synthetic oligonucleotide
acctaccatcggcccagctgtctctcttggtcttt

SEQ ID NO: 85261 - DNA, 35 bp, Artificial Sequence
  Synthetic oligonucleotide
ttgcagacgccgaaggcaaattacgacctttcttt

SEQ ID NO: 85262 - DNA, 36 bp, Artificial Sequence
  Synthetic oligonucleotide
gaggtcgggtggggggggtgttgtacaagtcacaaa

SEQ ID NO: 85263 - DNA, 35 bp, Artificial Sequence
  Synthetic oligonucleotide
gacgacatgcaaaacgacgacgcccactccgtaaa

SEQ ID NO: 85264 - DNA, 36 bp, Artificial Sequence
  Synthetic oligonucleotide
gtctacgccgagggcaaaaagctagggggggcacaa

SEQ ID NO: 85265 - DNA, 36 bp, Artificial Sequence
  Synthetic oligonucleotide
acgaacgcactgtcgtgtcatcccccgtacttacaa

SEQ ID NO: 85266 - DNA, 36 bp, Artificial Sequence
  Synthetic oligonucleotide
acacacagccccactctgtcgtaaagaagacaagaa

SEQ ID NO: 85267 - DNA, 36 bp, Artificial Sequence
  Synthetic oligonucleotide
ttcctatcccgtaccgttgtgacctccacgagggaa

SEQ ID NO: 85268 - DNA, 36 bp, Artificial Sequence
  Synthetic oligonucleotide
tttgcagtcgggaccaggcggaaattacttagggaa

SEQ ID NO: 85269 - DNA, 36 bp, Artificial Sequence
  Synthetic oligonucleotide
gtcgggggggtcaacaagggtggatgtggcatggaa

SEQ ID NO: 85270 - DNA, 36 bp, Artificial Sequence
  Synthetic oligonucleotide
tctaaccaggcacctgcctccaactgtttctgtgaa

SEQ ID NO: 85271 - DNA, 36 bp, Artificial Sequence
  Synthetic oligonucleotide
gcaccacctaaaacgttctgagatgccatgaacaca

SEQ ID NO: 85272 - DNA, 35 bp, Artificial Sequence
  Synthetic oligonucleotide
tcttgctgcgagctactgcttcgaccgacctcaca

SEQ ID NO: 85273 - DNA, 36 bp, Artificial Sequence
  Synthetic oligonucleotide
gaaaacgggaagttaggggagtaggccatgcagaca

SEQ ID NO: 85274 - DNA, 36 bp, Artificial Sequence
  Synthetic oligonucleotide
aaggctactccgctatctgtgacctagcgtgttaca

SEQ ID NO: 85275 - DNA, 36 bp, Artificial Sequence
  Synthetic oligonucleotide
tacacccagaacagcaattgccaggcgatcgaacca

SEQ ID NO: 85276 - DNA, 36 bp, Artificial Sequence
  Synthetic oligonucleotide
tacgacccgcagaggctggcaatctgtctgctacca

SEQ ID NO: 85277 - DNA, 35 bp, Artificial Sequence
  Synthetic oligonucleotide
gctgctgcaggctcgcaacctttaaaatcggccca

SEQ ID NO: 85278 - DNA, 36 bp, Artificial Sequence
  Synthetic oligonucleotide
tgagggcggggccgagtggacggaggaggggcgcca

SEQ ID NO: 85279 - DNA, 36 bp, Artificial Sequence
  Synthetic oligonucleotide
accggtccccaactatgactagcgagccacttgcca

SEQ ID NO: 85280 - DNA, 35 bp, Artificial Sequence
  Synthetic oligonucleotide
acgaacatcaacggggacagggttcagtggctgca

SEQ ID NO: 85281 - DNA, 36 bp, Artificial Sequence
  Synthetic oligonucleotide
tgacacggccgtcccagctgaaccatcaagcgatca

SEQ ID NO: 85282 - DNA, 36 bp, Artificial Sequence
  Synthetic oligonucleotide
gcacgcaggcccaaccttaaatgaataccgtgatca

SEQ ID NO: 85283 - DNA, 36 bp, Artificial Sequence
  Synthetic oligonucleotide
aaccccaccgtgcatcatgttgcttttcgaatctca

SEQ ID NO: 85284 - DNA, 36 bp, Artificial Sequence
  Synthetic oligonucleotide
gtcacgtcgccatgtcgccccttatccttcctctca

SEQ ID NO: 85285 - DNA, 36 bp, Artificial Sequence
  Synthetic oligonucleotide
tcacacatcactttatctggttgacctcttcagtca

SEQ ID NO: 85286 - DNA, 36 bp, Artificial Sequence
  Synthetic oligonucleotide
gccacgtccaggcattaaactttgcgacctgagtca

SEQ ID NO: 85287 - DNA, 37 bp, Artificial Sequence
  Synthetic oligonucleotide
atcgaacaggcgtgcgggggagatctgcgaagtaaga

SEQ ID NO: 85288 - DNA, 37 bp, Artificial Sequence
  Synthetic oligonucleotide
gaagagggacgattgtggcatgcaggagtacgtcaga

SEQ ID NO: 85289 - DNA, 37 bp, Artificial Sequence
  Synthetic oligonucleotide
tcaccataccctctcctgatttacgcctgtatttaga

SEQ ID NO: 85290 - DNA, 37 bp, Artificial Sequence
  Synthetic oligonucleotide
gtacttcgcactggtacagcagtttcgtctctgacga

SEQ ID NO: 85291 - DNA, 35 bp, Artificial Sequence
  Synthetic oligonucleotide
gagcaggctcacattcccatcccaccgttagccga

SEQ ID NO: 85292 - DNA, 37 bp, Artificial Sequence
  Synthetic oligonucleotide
gagtggaggccgggcatggggtgcgagacaatgtcga

SEQ ID NO: 85293 - DNA, 37 bp, Artificial Sequence
  Synthetic oligonucleotide
acgctaacgacagaggatggtgaggttaggataagga

SEQ ID NO: 85294 - DNA, 37 bp, Artificial Sequence
  Synthetic oligonucleotide
aagtgcacgggtaaatgagggggagtaacgcaacgga

SEQ ID NO: 85295 - DNA, 36 bp, Artificial Sequence
  Synthetic oligonucleotide
gtgcgggaacaggagtaaggacagacagagcacgga

SEQ ID NO: 85296 - DNA, 36 bp, Artificial Sequence
  Synthetic oligonucleotide
gacagtggatagcgcatctccaaccccccttccgga

SEQ ID NO: 85297 - DNA, 37 bp, Artificial Sequence
  Synthetic oligonucleotide
gctcgtgggaagtaatatggcggggggaaccaaggga

SEQ ID NO: 85298 - DNA, 37 bp, Artificial Sequence
  Synthetic oligonucleotide
gcaaccacaccatatgataaactttcgtacacaggga

SEQ ID NO: 85299 - DNA, 37 bp, Artificial Sequence
  Synthetic oligonucleotide
tgcggtgagaaaggtgatgggaatgtacaacagggga

SEQ ID NO: 85300 - DNA, 37 bp, Artificial Sequence
  Synthetic oligonucleotide
gtgcgagtaggaggaatgacggctaaaactgggggga

SEQ ID NO: 85301 - DNA, 37 bp, Artificial Sequence
  Synthetic oligonucleotide
tcatcatcggaccaatatgcatatcaccaaccatgga

SEQ ID NO: 85302 - DNA, 37 bp, Artificial Sequence
  Synthetic oligonucleotide
tttagcgaaggaaggggcaccaaacagggaaagtgga

SEQ ID NO: 85303 - DNA, 36 bp, Artificial Sequence
  Synthetic oligonucleotide
acacagtaggggaaggggctggcagaatacgttgga

SEQ ID NO: 85304 - DNA, 37 bp, Artificial Sequence
  Synthetic oligonucleotide
ttacccaggtcgaacgcctcttgcacccatatttgga

SEQ ID NO: 85305 - DNA, 38 bp, Artificial Sequence
  Synthetic oligonucleotide
gatgtagcaaatcggggaagggtgacacggagacatga

SEQ ID NO: 85306 - DNA, 38 bp, Artificial Sequence
  Synthetic oligonucleotide
gtcctggcaatcgcataacccagccaacctagccatga

SEQ ID NO: 85307 - DNA, 38 bp, Artificial Sequence
  Synthetic oligonucleotide
gtgccggccataacccgcgtagtcctcctgccgcatga

SEQ ID NO: 85308 - DNA, 38 bp, Artificial Sequence
  Synthetic oligonucleotide
taactgcctccctatcgagcgtataagctcctcactga

SEQ ID NO: 85309 - DNA, 38 bp, Artificial Sequence
  Synthetic oligonucleotide
accgacgtggggatgtagtacgcccatactcctactga

SEQ ID NO: 85310 - DNA, 38 bp, Artificial Sequence
  Synthetic oligonucleotide
gccgagcaccccatgtcatggaacaaggctatacctga

SEQ ID NO: 85311 - DNA, 37 bp, Artificial Sequence
  Synthetic oligonucleotide
tccaccatcggtacttggatcgcataacttaccctga

SEQ ID NO: 85312 - DNA, 38 bp, Artificial Sequence
  Synthetic oligonucleotide
acacccctctggaataagtttcaccttcgttaccctga

SEQ ID NO: 85313 - DNA, 38 bp, Artificial Sequence
  Synthetic oligonucleotide
aagacgcgcaacatataaatgctctgaacgtacgctga

SEQ ID NO: 85314 - DNA, 37 bp, Artificial Sequence
  Synthetic oligonucleotide
ggtgacaacgtagctatctcgtgacttctttttctga

SEQ ID NO: 85315 - DNA, 37 bp, Artificial Sequence
  Synthetic oligonucleotide
gtcccgatcctgtcccctgcttctcgtattacagtga

SEQ ID NO: 85316 - DNA, 38 bp, Artificial Sequence
  Synthetic oligonucleotide
agggacgctgacatgaaggtaagggggggtgcgagtga

SEQ ID NO: 85317 - DNA, 38 bp, Artificial Sequence
  Synthetic oligonucleotide
ttgacgcacgcacgcttaaactcagtcaatcttagtga

SEQ ID NO: 85318 - DNA, 38 bp, Artificial Sequence
  Synthetic oligonucleotide
tgatcccccaccatgcaaacaagccgctatccccgtga

SEQ ID NO: 85319 - DNA, 36 bp, Artificial Sequence
  Synthetic oligonucleotide
tcatgtgacctccgctccccactggtctttccgtga

SEQ ID NO: 85320 - DNA, 38 bp, Artificial Sequence
  Synthetic oligonucleotide
accgtccaggagaccgagagaatgagtgtggggggtga

SEQ ID NO: 85321 - DNA, 37 bp, Artificial Sequence
  Synthetic oligonucleotide
gacgactacagggcgatcaagcgttttacttgggtga

SEQ ID NO: 85322 - DNA, 38 bp, Artificial Sequence
  Synthetic oligonucleotide
tctagagacgatggaggtgtgacaggaggcgactgtga

SEQ ID NO: 85323 - DNA, 38 bp, Artificial Sequence
  Synthetic oligonucleotide
gacgagccgagttccttccgcccccagattctctgtga

SEQ ID NO: 85324 - DNA, 36 bp, Artificial Sequence
  Synthetic oligonucleotide
agtacagccccagctgcctactctacacgcttgtga

SEQ ID NO: 85325 - DNA, 37 bp, Artificial Sequence
  Synthetic oligonucleotide
accgacgtaaacgggaggggtggacgacaaatattga

SEQ ID NO: 85326 - DNA, 38 bp, Artificial Sequence
  Synthetic oligonucleotide
tcctgtcccctgatcgtctcgggccaatctcaccttga

SEQ ID NO: 85327 - DNA, 38 bp, Artificial Sequence
  Synthetic oligonucleotide
tctgccaaccagcttaacgttccgcatcaccttcttga

SEQ ID NO: 85328 - DNA, 36 bp, Artificial Sequence
  Synthetic oligonucleotide
aaccgagggacaaaatgagtggaattaacgagttga

SEQ ID NO: 85329 - DNA, 37 bp, Artificial Sequence
  Synthetic oligonucleotide
accttacaccggccagtggcatccatcctcgagttga

SEQ ID NO: 85330 - DNA, 38 bp, Artificial Sequence
  Synthetic oligonucleotide
ggggggaagggggccgggatatcgtcagcacaggttga

SEQ ID NO: 85331 - DNA, 38 bp, Artificial Sequence
  Synthetic oligonucleotide
ttaacgcgccctctcagcctttcatacgattactttga

SEQ ID NO: 85332 - DNA, 38 bp, Artificial Sequence
  Synthetic oligonucleotide
tctttagcactcctgccatctctgagcaccctctttga

SEQ ID NO: 85333 - DNA, 36 bp, Artificial Sequence
  Synthetic oligonucleotide
tccatcccatacgctgtatagcggtcgataccgata

SEQ ID NO: 85334 - DNA, 36 bp, Artificial Sequence
  Synthetic oligonucleotide
tcctccatatcgacctgctataccggtaggtaacta

SEQ ID NO: 85335 - DNA, 35 bp, Artificial Sequence
  Synthetic oligonucleotide
accgccggtgaaacggggtctagtgccttcaccta

SEQ ID NO: 85336 - DNA, 36 bp, Artificial Sequence
  Synthetic oligonucleotide
agtatccacagtgccattgcgctgattcttgcccta

SEQ ID NO: 85337 - DNA, 36 bp, Artificial Sequence
  Synthetic oligonucleotide
ttgggttcgtactcattcttccttgcaacggtgcta

SEQ ID NO: 85338 - DNA, 36 bp, Artificial Sequence
  Synthetic oligonucleotide
atgcccgggccatgttactcgattccccctagtcta

SEQ ID NO: 85339 - DNA, 35 bp, Artificial Sequence
  Synthetic oligonucleotide
tcccccacgccccctatcaggtattgatacccgta

SEQ ID NO: 85340 - DNA, 36 bp, Artificial Sequence
  Synthetic oligonucleotide
tgatggtactgatgcttcggccttgttttcactgta

SEQ ID NO: 85341 - DNA, 36 bp, Artificial Sequence
  Synthetic oligonucleotide
gttcccctccaatggctctgaagggcaattctatta

SEQ ID NO: 85342 - DNA, 35 bp, Artificial Sequence
  Synthetic oligonucleotide
atccgcgcgacattgcctggtctcgttacgtatta

SEQ ID NO: 85343 - DNA, 35 bp, Artificial Sequence
  Synthetic oligonucleotide
tacaacagctccccctgatagacctagcgtggtta

SEQ ID NO: 85344 - DNA, 36 bp, Artificial Sequence
  Synthetic oligonucleotide
agccacgtgccaaattccagggcatatttcgcttta

SEQ ID NO: 85345 - DNA, 35 bp, Artificial Sequence
  Synthetic oligonucleotide
aactttgctcgacctgcatttccccgctcacgaac

SEQ ID NO: 85346 - DNA, 35 bp, Artificial Sequence
  Synthetic oligonucleotide
gctagcctagccaaggctgaattctcccgtttaac

SEQ ID NO: 85347 - DNA, 35 bp, Artificial Sequence
  Synthetic oligonucleotide
tccgatacagccgaaattcgtatcttctgatccac

SEQ ID NO: 85348 - DNA, 35 bp, Artificial Sequence
  Synthetic oligonucleotide
ggatcggggggagtaagtgggaaacgatgggatac

SEQ ID NO: 85349 - DNA, 35 bp, Artificial Sequence
  Synthetic oligonucleotide
tcgaccactcgttctgccctacccaacggataccc

SEQ ID NO: 85350 - DNA, 35 bp, Artificial Sequence
  Synthetic oligonucleotide
atccccacgtaatccaatagcccccatgagccccc

SEQ ID NO: 85351 - DNA, 35 bp, Artificial Sequence
  Synthetic oligonucleotide
atcgcaaacaagttagtcgcagtcttctggctccc

SEQ ID NO: 85352 - DNA, 35 bp, Artificial Sequence
  Synthetic oligonucleotide
acaggcaaacctccgattccgccactggcattccc

SEQ ID NO: 85353 - DNA, 35 bp, Artificial Sequence
  Synthetic oligonucleotide
gcacaacaagcccatcaggcacgcttcgggttccc

SEQ ID NO: 85354 - DNA, 35 bp, Artificial Sequence
  Synthetic oligonucleotide
tgctgccagcagatcgtccgctctatcacggggcc

SEQ ID NO: 85355 - DNA, 35 bp, Artificial Sequence
  Synthetic oligonucleotide
gttttccgcacgtgtttcgccgatcttagtttgcc

SEQ ID NO: 85356 - DNA, 35 bp, Artificial Sequence
  Synthetic oligonucleotide
gcgcggagcatcccttctctaatcctctgtgttcc

SEQ ID NO: 85357 - DNA, 35 bp, Artificial Sequence
  Synthetic oligonucleotide
gcgatagccctgtttggttcttgttggtcactggc

SEQ ID NO: 85358 - DNA, 36 bp, Artificial Sequence
  Synthetic oligonucleotide
tcactagcagctgaaatctgccacttctgggaatgc

SEQ ID NO: 85359 - DNA, 35 bp, Artificial Sequence
  Synthetic oligonucleotide
tcgtgcccctacgccccaatcggaaagctacctgc

SEQ ID NO: 85360 - DNA, 35 bp, Artificial Sequence
  Synthetic oligonucleotide
agaccccccccacatccgggtattacaggccctgc

SEQ ID NO: 85361 - DNA, 35 bp, Artificial Sequence
  Synthetic oligonucleotide
atcggagcaatcgcccacgccatttcattcccatc

SEQ ID NO: 85362 - DNA, 35 bp, Artificial Sequence
  Synthetic oligonucleotide
ttgctgtgcgggtactccatagcgactactccatc

SEQ ID NO: 85363 - DNA, 35 bp, Artificial Sequence
  Synthetic oligonucleotide
gcattggcccttgtcacaccagttcgtttctcatc

SEQ ID NO: 85364 - DNA, 35 bp, Artificial Sequence
  Synthetic oligonucleotide
tacccgctgtgtaagatgttccgtcgttcttcatc

SEQ ID NO: 85365 - DNA, 35 bp, Artificial Sequence
  Synthetic oligonucleotide
gctacacacatcacctgccctcttagaaagcgatc

SEQ ID NO: 85366 - DNA, 35 bp, Artificial Sequence
  Synthetic oligonucleotide
ggtggctacgctgccctgtcaatcgaactagcctc

SEQ ID NO: 85367 - DNA, 35 bp, Artificial Sequence
  Synthetic oligonucleotide
ccgatccacgtgcaagcctcactatctagcccttc

SEQ ID NO: 85368 - DNA, 35 bp, Artificial Sequence
  Synthetic oligonucleotide
tgatccatctgccctgagcctgaatgctgttcttc

SEQ ID NO: 85369 - DNA, 35 bp, Artificial Sequence
  Synthetic oligonucleotide
tgtgggatggacagtaagcgatgggcaagcataag

SEQ ID NO: 85370 - DNA, 35 bp, Artificial Sequence
  Synthetic oligonucleotide
gttaggccgggagaaaggtagttaaagggggcgcg

SEQ ID NO: 85371 - DNA, 35 bp, Artificial Sequence
  Synthetic oligonucleotide
acacttgtgcacgaacgtattaatctcttgctgcg

SEQ ID NO: 85372 - DNA, 35 bp, Artificial Sequence
  Synthetic oligonucleotide
agcgaccgagcaggtaagggcgggggaggccatcg

SEQ ID NO: 85373 - DNA, 35 bp, Artificial Sequence
  Synthetic oligonucleotide
tggagcacacggaacaataccctatcccaccttgg

SEQ ID NO: 85374 - DNA, 35 bp, Artificial Sequence
  Synthetic oligonucleotide
gtaagcgaatatacatccgcgcgccccctcaactg

SEQ ID NO: 85375 - DNA, 35 bp, Artificial Sequence
  Synthetic oligonucleotide
tgcaacaggggggggtaatgagcgtagtggggctg

SEQ ID NO: 85376 - DNA, 35 bp, Artificial Sequence
  Synthetic oligonucleotide
tctatgcacgcagcaatagagtctgcatggatctg

SEQ ID NO: 85377 - DNA, 35 bp, Artificial Sequence
  Synthetic oligonucleotide
tactacacgaaacgctccttaggcccacagtggtg

SEQ ID NO: 85378 - DNA, 35 bp, Artificial Sequence
  Synthetic oligonucleotide
gttcaccacacctttgacgtaactcttcagtattg

SEQ ID NO: 85379 - DNA, 35 bp, Artificial Sequence
  Synthetic oligonucleotide
gtacactcctatctgctccggctacgggacttttg

SEQ ID NO: 85380 - DNA, 35 bp, Artificial Sequence
  Synthetic oligonucleotide
tgcgacgtccagccatagtacgtacccccgtgaat

SEQ ID NO: 85381 - DNA, 35 bp, Artificial Sequence
  Synthetic oligonucleotide
gagtagggatcaatacgggagggggggagattgat

SEQ ID NO: 85382 - DNA, 35 bp, Artificial Sequence
  Synthetic oligonucleotide
ttgttcgcaccatctgccgtgttgcgtcgtactat

SEQ ID NO: 85383 - DNA, 35 bp, Artificial Sequence
  Synthetic oligonucleotide
agcaccccattctgcgtgatagcttacatgcctct

SEQ ID NO: 85384 - DNA, 35 bp, Artificial Sequence
  Synthetic oligonucleotide
tacatggtgggaaggcaacgctgacaaattcaagt

SEQ ID NO: 85385 - DNA, 35 bp, Artificial Sequence
  Synthetic oligonucleotide
gaagaggtagggtaaagcatctggggttgtagggt

SEQ ID NO: 85386 - DNA, 35 bp, Artificial Sequence
  Synthetic oligonucleotide
tgaaaaacaccagtaggtggtaaggggtagaatgt

SEQ ID NO: 85387 - DNA, 35 bp, Artificial Sequence
  Synthetic oligonucleotide
tccgacacctcactggaatcaggctcttcaccctt

SEQ ID NO: 85388 - DNA, 35 bp, Artificial Sequence
  Synthetic oligonucleotide
acgagcaccgccgtactaggcgcatagcacccctt

SEQ ID NO: 85389 - DNA, 35 bp, Artificial Sequence
  Synthetic oligonucleotide
tgatccacccaagtccctgctctttcagtcatctt

SEQ ID NO: 85390 - DNA, 35 bp, Artificial Sequence
  Synthetic oligonucleotide
acaatacgacgtcgcataccaactccagacgtctt

SEQ ID NO: 85391 - DNA, 35 bp, Artificial Sequence
  Synthetic oligonucleotide
gatgctgctgtacgtaagtgatttgcaaacacgtt

SEQ ID NO: 85392 - DNA, 35 bp, Artificial Sequence
  Synthetic oligonucleotide
gaccactccggttgtacgtgtgggaaccccttgtt

SEQ ID NO: 85393 - DNA, 35 bp, Artificial Sequence
  Synthetic oligonucleotide
ttgccctggtgcgctcataccctacactgatattt

SEQ ID NO: 85394 - DNA, 35 bp, Artificial Sequence
  Synthetic oligonucleotide
tgtccacctaacccatccttatcatgcccctgttt

SEQ ID NO: 85395 - DNA, 35 bp, Artificial Sequence
  Synthetic oligonucleotide
tgttctgacctgtgtggcatcccctttccggtttt

SEQ ID NO: 85396 - DNA, 35 bp, Artificial Sequence
  Synthetic oligonucleotide
aagggaaacgggaagagacggagtgaagggggaaa

SEQ ID NO: 85397 - DNA, 36 bp, Artificial Sequence
  Synthetic oligonucleotide
ttaacatcccccgcccaggtaattcgagacactcaa

SEQ ID NO: 85398 - DNA, 35 bp, Artificial Sequence
  Synthetic oligonucleotide
gagggcgaacgcctatagtaaccgcacttttcgaa

SEQ ID NO: 85399 - DNA, 36 bp, Artificial Sequence
  Synthetic oligonucleotide
gatggtcgtagggcagtcgtactgtacgtgatggaa

SEQ ID NO: 85400 - DNA, 36 bp, Artificial Sequence
  Synthetic oligonucleotide
tcacaggccaccccaagcgattttgcacaggcaaca

SEQ ID NO: 85401 - DNA, 36 bp, Artificial Sequence
  Synthetic oligonucleotide
gtgcgacccctttgtccttacgatgcctacaccaca

SEQ ID NO: 85402 - DNA, 35 bp, Artificial Sequence
  Synthetic oligonucleotide
gccaccgggccgttgccaccctccacgggatgcca

SEQ ID NO: 85403 - DNA, 35 bp, Artificial Sequence
  Synthetic oligonucleotide
tacctcctgttcgctagtggcactacgctatgcca

SEQ ID NO: 85404 - DNA, 35 bp, Artificial Sequence
  Synthetic oligonucleotide
tgacggttctcgctggacttctttcgcttgctcca

SEQ ID NO: 85405 - DNA, 36 bp, Artificial Sequence
  Synthetic oligonucleotide
gcaacggaaacgtcgacataactttggagggaggca

SEQ ID NO: 85406 - DNA, 36 bp, Artificial Sequence
  Synthetic oligonucleotide
atgaggggagagacgtgagagagagcgagtacggca

SEQ ID NO: 85407 - DNA, 36 bp, Artificial Sequence
  Synthetic oligonucleotide
tcgcacccgtcccgggaggtcttacttggcaaatca

SEQ ID NO: 85408 - DNA, 36 bp, Artificial Sequence
  Synthetic oligonucleotide
acacccaccctccaacgttcgcactcgtgttcatca

SEQ ID NO: 85409 - DNA, 35 bp, Artificial Sequence
  Synthetic oligonucleotide
gccgaccgcatgctggagcatgtgataacacctca

SEQ ID NO: 85410 - DNA, 35 bp, Artificial Sequence
  Synthetic oligonucleotide
aagggggaggagtaagggtggaagattgccgctca

SEQ ID NO: 85411 - DNA, 36 bp, Artificial Sequence
  Synthetic oligonucleotide
tagggggggtcgggtagaaactagagggagcagtca

SEQ ID NO: 85412 - DNA, 36 bp, Artificial Sequence
  Synthetic oligonucleotide
aatatccaccgccaaattacaatcagacgcgtgtca

SEQ ID NO: 85413 - DNA, 35 bp, Artificial Sequence
  Synthetic oligonucleotide
ttccatcaacaggtcgcatcccgttcgcatcttca

SEQ ID NO: 85414 - DNA, 35 bp, Artificial Sequence
  Synthetic oligonucleotide
gcacctcgccatcagagtacctctctaatttttca

SEQ ID NO: 85415 - DNA, 36 bp, Artificial Sequence
  Synthetic oligonucleotide
aacgccacttaacatgtatcgacacccctacacaga

SEQ ID NO: 85416 - DNA, 36 bp, Artificial Sequence
  Synthetic oligonucleotide
agagatgcataaggggtacttgaggagggagggaga

SEQ ID NO: 85417 - DNA, 37 bp, Artificial Sequence
  Synthetic oligonucleotide
atgcacggtagttcttactcgaccccgaacctggaga

SEQ ID NO: 85418 - DNA, 37 bp, Artificial Sequence
  Synthetic oligonucleotide
tgggtggccggggcgtgggaaaggatagggctggaga

SEQ ID NO: 85419 - DNA, 37 bp, Artificial Sequence
  Synthetic oligonucleotide
gagtggggtcatgggcgtggatatctcgagggtgaga

SEQ ID NO: 85420 - DNA, 37 bp, Artificial Sequence
  Synthetic oligonucleotide
tggacaaccccccatcgaagccagccacgccggtaga

SEQ ID NO: 85421 - DNA, 35 bp, Artificial Sequence
  Synthetic oligonucleotide
aacgcctattcgaggaacgctcctgccttatacga

SEQ ID NO: 85422 - DNA, 35 bp, Artificial Sequence
  Synthetic oligonucleotide
tccaccacttgatagacgctttcttattcgtacga

SEQ ID NO: 85423 - DNA, 37 bp, Artificial Sequence
  Synthetic oligonucleotide
tacctgcctcgcatcttcgcaccggttcgcattacga

SEQ ID NO: 85424 - DNA, 36 bp, Artificial Sequence
  Synthetic oligonucleotide
aaacgtgcaatctgccaaataaggttatctccccga

SEQ ID NO: 85425 - DNA, 37 bp, Artificial Sequence
  Synthetic oligonucleotide
tccagcccggcgtaccccattcagaccaccctcccga

SEQ ID NO: 85426 - DNA, 36 bp, Artificial Sequence
  Synthetic oligonucleotide
tatatcagtcgcacgaatgcgttcatgttcctccga

SEQ ID NO: 85427 - DNA, 37 bp, Artificial Sequence
  Synthetic oligonucleotide
atccatccccgttcaaagactgaccgagtgattccga

SEQ ID NO: 85428 - DNA, 36 bp, Artificial Sequence
  Synthetic oligonucleotide
acccaacgagctgcctcaggtgaacaccctcatcga

SEQ ID NO: 85429 - DNA, 37 bp, Artificial Sequence
  Synthetic oligonucleotide
tcaccatatcgtgccatgccattactttcaagctcga

SEQ ID NO: 85430 - DNA, 37 bp, Artificial Sequence
  Synthetic oligonucleotide
tacgcttcgtccgcctcgtttgcatcatttctttcga

SEQ ID NO: 85431 - DNA, 37 bp, Artificial Sequence
  Synthetic oligonucleotide
tagatcccatcttcccacatgtttgtcctagtaagga

SEQ ID NO: 85432 - DNA, 36 bp, Artificial Sequence
  Synthetic oligonucleotide
ggaaaaaaggacgggtgtaaaattaaatgggcagga

SEQ ID NO: 85433 - DNA, 37 bp, Artificial Sequence
  Synthetic oligonucleotide
tactacactgctttgcaacgcgatcatctctttagga

SEQ ID NO: 85434 - DNA, 37 bp, Artificial Sequence
  Synthetic oligonucleotide
taacgagcaaaggtggagataatcagatacgcacgga

SEQ ID NO: 85435 - DNA, 37 bp, Artificial Sequence
  Synthetic oligonucleotide
tacgccccactggatctctctgccctgtaccatcgga

SEQ ID NO: 85436 - DNA, 35 bp, Artificial Sequence
  Synthetic oligonucleotide
gccaccttccgactggatgtcatcactcgtaggga

SEQ ID NO: 85437 - DNA, 36 bp, Artificial Sequence
  Synthetic oligonucleotide
ttgtaccgttacataaccgcccagctcggaacggga

SEQ ID NO: 85438 - DNA, 36 bp, Artificial Sequence
  Synthetic oligonucleotide
gtggtcaaatttgtggggggatggatagtagcggga

SEQ ID NO: 85439 - DNA, 37 bp, Artificial Sequence
  Synthetic oligonucleotide
tgattcgtgagcttcggggggagacgaaggcatggga

SEQ ID NO: 85440 - DNA, 37 bp, Artificial Sequence
  Synthetic oligonucleotide
tcccccaacacccctgcatttgaaaggacgccatgga

SEQ ID NO: 85441 - DNA, 35 bp, Artificial Sequence
  Synthetic oligonucleotide
actcgcggagaagggtgcctctgggcatggttgga

SEQ ID NO: 85442 - DNA, 37 bp, Artificial Sequence
  Synthetic oligonucleotide
cacaccagtgccggcgaaggggtgaatgcacccatga

SEQ ID NO: 85443 - DNA, 38 bp, Artificial Sequence
  Synthetic oligonucleotide
gacgcccaacccaggtcgcacgaagggtacctccatga

SEQ ID NO: 85444 - DNA, 37 bp, Artificial Sequence
  Synthetic oligonucleotide
gtccacgggtgcctttgacactgtagtcaaatcatga

SEQ ID NO: 85445 - DNA, 38 bp, Artificial Sequence
  Synthetic oligonucleotide
tgaacgcaggaaagaacacgggtcgccaggggggatga

SEQ ID NO: 85446 - DNA, 38 bp, Artificial Sequence
  Synthetic oligonucleotide
agtccgcaggagggatcaagtggggatcttggggatga

SEQ ID NO: 85447 - DNA, 37 bp, Artificial Sequence
  Synthetic oligonucleotide
ggacatggagggaggggaacgggcctctaaactatga

SEQ ID NO: 85448 - DNA, 37 bp, Artificial Sequence
  Synthetic oligonucleotide
gacatgcggtagtccatctcttttccctcccgtatga

SEQ ID NO: 85449 - DNA, 37 bp, Artificial Sequence
  Synthetic oligonucleotide
accgaccacccggttgtacgattcgagccttttatga

SEQ ID NO: 85450 - DNA, 37 bp, Artificial Sequence
  Synthetic oligonucleotide
gtgcgccaaatctgcactttaactggctacacactga

SEQ ID NO: 85451 - DNA, 38 bp, Artificial Sequence
  Synthetic oligonucleotide
agcccagccactcatttcctcaagttagcccgacctga

SEQ ID NO: 85452 - DNA, 38 bp, Artificial Sequence
  Synthetic oligonucleotide
gaccatacctttcagtgttcgtctctgtccatacctga

SEQ ID NO: 85453 - DNA, 37 bp, Artificial Sequence
  Synthetic oligonucleotide
tgaggaacgctagcctctatctttagcccctcgctga

SEQ ID NO: 85454 - DNA, 38 bp, Artificial Sequence
  Synthetic oligonucleotide
tctgcactcccgttttatccgtcgtacgtactggctga

SEQ ID NO: 85455 - DNA, 38 bp, Artificial Sequence
  Synthetic oligonucleotide
gtggggagggaagggttagatgggatctcttcaagtga

SEQ ID NO: 85456 - DNA, 38 bp, Artificial Sequence
  Synthetic oligonucleotide
gtatccacctgtaatgcctttaacagtcaggagagtga

SEQ ID NO: 85457 - DNA, 38 bp, Artificial Sequence
  Synthetic oligonucleotide
attgcccgtctaattttccccccgtcctcctaccgtga

SEQ ID NO: 85458 - DNA, 38 bp, Artificial Sequence
  Synthetic oligonucleotide
gcaccgagatgttcatactcttttagctgccggggtga

SEQ ID NO: 85459 - DNA, 38 bp, Artificial Sequence
  Synthetic oligonucleotide
ttgatccccatcgtccgtctcttggcgcactcctgtga

SEQ ID NO: 85460 - DNA, 37 bp, Artificial Sequence
  Synthetic oligonucleotide
gtacggcccccacggtacatctcttatccagtattga

SEQ ID NO: 85461 - DNA, 37 bp, Artificial Sequence
  Synthetic oligonucleotide
ttggtccctcgacgctgccaagcccatttacacttga

SEQ ID NO: 85462 - DNA, 36 bp, Artificial Sequence
  Synthetic oligonucleotide
ttcgggtcccacaccttgtatattttctgtacttga

SEQ ID NO: 85463 - DNA, 37 bp, Artificial Sequence
  Synthetic oligonucleotide
tctcttcgcctgcactcgtctaacacaaacgccttga

SEQ ID NO: 85464 - DNA, 38 bp, Artificial Sequence
  Synthetic oligonucleotide
atccggtgtcggtggaggggctgtaataggttgcttga

SEQ ID NO: 85465 - DNA, 37 bp, Artificial Sequence
  Synthetic oligonucleotide
aagacccgtcagcgttctcgcctctcactttgcttga

SEQ ID NO: 85466 - DNA, 38 bp, Artificial Sequence
  Synthetic oligonucleotide
tgtggcggaggcggggtgatggacggtcgggactttga

SEQ ID NO: 85467 - DNA, 38 bp, Artificial Sequence
  Synthetic oligonucleotide
acccaccccctaaggaaggcagacagccttatctttga

SEQ ID NO: 85468 - DNA, 37 bp, Artificial Sequence
  Synthetic oligonucleotide
acgcgtcctccacgtactttatagcaccctggtttga

SEQ ID NO: 85469 - DNA, 38 bp, Artificial Sequence
  Synthetic oligonucleotide
gcgaagcatcctcgattatactgatttctgtgttttga

SEQ ID NO: 85470 - DNA, 37 bp, Artificial Sequence
  Synthetic oligonucleotide
gttacacgcacctgcgctagacaaacagattttttga

SEQ ID NO: 85471 - DNA, 36 bp, Artificial Sequence
  Synthetic oligonucleotide
tcatgtgcacggtgggctgcctacgaacctatcata

SEQ ID NO: 85472 - DNA, 36 bp, Artificial Sequence
  Synthetic oligonucleotide
tgtcgagccccgaagtgccccatgatctgctctata

SEQ ID NO: 85473 - DNA, 35 bp, Artificial Sequence
  Synthetic oligonucleotide
acagggctactccccacctgaggacgacttcacta

SEQ ID NO: 85474 - DNA, 35 bp, Artificial Sequence
  Synthetic oligonucleotide
aattgcctccgtacatgctttgtcgtttagtacta

SEQ ID NO: 85475 - DNA, 36 bp, Artificial Sequence
  Synthetic oligonucleotide
tttggtcaggggtaccgcattgccttctccacgcta

SEQ ID NO: 85476 - DNA, 36 bp, Artificial Sequence
  Synthetic oligonucleotide
gtagggaacaggagagggagtgaactgaagtggcta

SEQ ID NO: 85477 - DNA, 36 bp, Artificial Sequence
  Synthetic oligonucleotide
tcgtggcctcccgagcatcattatttacacgtgcta

SEQ ID NO: 85478 - DNA, 36 bp, Artificial Sequence
  Synthetic oligonucleotide
ttaccatcgccctggtaggtcgtgagaatcgatcta

SEQ ID NO: 85479 - DNA, 36 bp, Artificial Sequence
  Synthetic oligonucleotide
accgacaggagaatggggcctagggaactaacagta

SEQ ID NO: 85480 - DNA, 35 bp, Artificial Sequence
  Synthetic oligonucleotide
aactacgggcgcggagggaggggctcagaaatgta

SEQ ID NO: 85481 - DNA, 35 bp, Artificial Sequence
  Synthetic oligonucleotide
gtaccccccggtccaggtgacatcgttgccactta

SEQ ID NO: 85482 - DNA, 36 bp, Artificial Sequence
  Synthetic oligonucleotide
tgcaccgatatccgatccgagtctgtgcaaccctta

SEQ ID NO: 85483 - DNA, 36 bp, Artificial Sequence
  Synthetic oligonucleotide
tcttaccccgcttgtgacgagttatgccccttgtta

SEQ ID NO: 85484 - DNA, 35 bp, Artificial Sequence
  Synthetic oligonucleotide
tccggaagtacagcgcgtcacaagcgttcccccac

SEQ ID NO: 85485 - DNA, 35 bp, Artificial Sequence
  Synthetic oligonucleotide
tagggccacacctgctggcataaagccacttgtac

SEQ ID NO: 85486 - DNA, 35 bp, Artificial Sequence
  Synthetic oligonucleotide
agaaccggcaccccgccgattgcttcttctggtcc

SEQ ID NO: 85487 - DNA, 35 bp, Artificial Sequence
  Synthetic oligonucleotide
tgcccctcacccgttgctatctggttaattgttcc

SEQ ID NO: 85488 - DNA, 34 bp, Artificial Sequence
  Synthetic oligonucleotide
gattcaccgcctcctctgttaagtataccttcgc

SEQ ID NO: 85489 - DNA, 35 bp, Artificial Sequence
  Synthetic oligonucleotide
ttgatcctgcctcgttcgcttattctgtaccatgc

SEQ ID NO: 85490 - DNA, 35 bp, Artificial Sequence
  Synthetic oligonucleotide
taagtccggcaatggtggttatttctgggtgctgc

SEQ ID NO: 85491 - DNA, 35 bp, Artificial Sequence
  Synthetic oligonucleotide
tttgtaccggccaccctgaaccttgcgtatcgtgc

SEQ ID NO: 85492 - DNA, 35 bp, Artificial Sequence
  Synthetic oligonucleotide
atgcgaccaagacggcgcatattagcttggaaatc

SEQ ID NO: 85493 - DNA, 35 bp, Artificial Sequence
  Synthetic oligonucleotide
gagtgccgaacagctggccaaatcgcatgctaatc

SEQ ID NO: 85494 - DNA, 35 bp, Artificial Sequence
  Synthetic oligonucleotide
gttgcactacgtaacaattcacttgcccgcacatc

SEQ ID NO: 85495 - DNA, 35 bp, Artificial Sequence
  Synthetic oligonucleotide
cgaccacccggttagtttaggctccacctcaactc

SEQ ID NO: 85496 - DNA, 35 bp, Artificial Sequence
  Synthetic oligonucleotide
gcggacggtacctactgggtcgccatcttaacctc

SEQ ID NO: 85497 - DNA, 35 bp, Artificial Sequence
  Synthetic oligonucleotide
tgagcctggcccatgcttatgtaatccaagctgtc

SEQ ID NO: 85498 - DNA, 35 bp, Artificial Sequence
  Synthetic oligonucleotide
gtcacgtgtggcacgttaccgtcctcttcggtgtc

SEQ ID NO: 85499 - DNA, 35 bp, Artificial Sequence
  Synthetic oligonucleotide
gaagtgggggatggacgggggatggtgtgtaattc

SEQ ID NO: 85500 - DNA, 35 bp, Artificial Sequence
  Synthetic oligonucleotide
agttacggcaccgccccctgttattgcctcatttc

SEQ ID NO: 85501 - DNA, 35 bp, Artificial Sequence
  Synthetic oligonucleotide
tcacgtccggtgccatccgtccctgagtgcctttc

SEQ ID NO: 85502 - DNA, 35 bp, Artificial Sequence
  Synthetic oligonucleotide
gacgcggaaaaagtaaaaaacgtgggcggtaacag

SEQ ID NO: 85503 - DNA, 35 bp, Artificial Sequence
  Synthetic oligonucleotide
taatccagagaacagcttcaaaaagagggcaatag

SEQ ID NO: 85504 - DNA, 35 bp, Artificial Sequence
  Synthetic oligonucleotide
tagtactacgcgcacctttgcaaatctgtctttag

SEQ ID NO: 85505 - DNA, 35 bp, Artificial Sequence
  Synthetic oligonucleotide
gacgagataggaagggcaaatgttaggttgcgagg

SEQ ID NO: 85506 - DNA, 35 bp, Artificial Sequence
  Synthetic oligonucleotide
aataccccacgacacaaacgcttgcttccgctagg

SEQ ID NO: 85507 - DNA, 35 bp, Artificial Sequence
  Synthetic oligonucleotide
tccatatgcagtgcaaaacaaaacccgaacttagg

SEQ ID NO: 85508 - DNA, 35 bp, Artificial Sequence
  Synthetic oligonucleotide
tttacgcgcccctaccgttccactaccaatgatgg

SEQ ID NO: 85509 - DNA, 35 bp, Artificial Sequence
  Synthetic oligonucleotide
ttcgccatcccaattcttttaaggtaactgcctgg

SEQ ID NO: 85510 - DNA, 35 bp, Artificial Sequence
  Synthetic oligonucleotide
gacttgctcccctctattggtttatcctactttgg

SEQ ID NO: 85511 - DNA, 35 bp, Artificial Sequence
  Synthetic oligonucleotide
tgacaaggtgagccaatctgtcaatgtaccacctg

SEQ ID NO: 85512 - DNA, 35 bp, Artificial Sequence
  Synthetic oligonucleotide
gcaacctattgactgcccagccacatgtctctctg

SEQ ID NO: 85513 - DNA, 35 bp, Artificial Sequence
  Synthetic oligonucleotide
acataacagcctatcctgcagtctttctctacttg

SEQ ID NO: 85514 - DNA, 35 bp, Artificial Sequence
  Synthetic oligonucleotide
aacagggggggccactatgagcaccgggggaaaat

SEQ ID NO: 85515 - DNA, 35 bp, Artificial Sequence
  Synthetic oligonucleotide
ggtaccaaacactggctaatcaaccaatcttccat

SEQ ID NO: 85516 - DNA, 35 bp, Artificial Sequence
  Synthetic oligonucleotide
tgcatgacccttggtctaatactcccctggtttat

SEQ ID NO: 85517 - DNA, 35 bp, Artificial Sequence
  Synthetic oligonucleotide
acaacttgccgtgcccagggagccccggcctgcct

SEQ ID NO: 85518 - DNA, 35 bp, Artificial Sequence
  Synthetic oligonucleotide
atgtgccgcgatctgccgcacaacgttgtttgcct

SEQ ID NO: 85519 - DNA, 35 bp, Artificial Sequence
  Synthetic oligonucleotide
acctcactgcctgacagagttcttcgaagaccgct

SEQ ID NO: 85520 - DNA, 35 bp, Artificial Sequence
  Synthetic oligonucleotide
gaaatgaacgggtgaggaaaagtaatggcgtatct

SEQ ID NO: 85521 - DNA, 35 bp, Artificial Sequence
  Synthetic oligonucleotide
gttcacctcacacattacccgccgtctcgtctagt

SEQ ID NO: 85522 - DNA, 35 bp, Artificial Sequence
  Synthetic oligonucleotide
aagtgggggagaaatcgttgagcagttgatccggt

SEQ ID NO: 85523 - DNA, 35 bp, Artificial Sequence
  Synthetic oligonucleotide
tccatcctaaatatatcacgaccacacacgagggt

SEQ ID NO: 85524 - DNA, 35 bp, Artificial Sequence
  Synthetic oligonucleotide
gactaatagcaggagggctaagcacaagggtgggt

SEQ ID NO: 85525 - DNA, 35 bp, Artificial Sequence
  Synthetic oligonucleotide
tatcaacaggactgctaactatttggccccattgt

SEQ ID NO: 85526 - DNA, 35 bp, Artificial Sequence
  Synthetic oligonucleotide
agcgaggagaactcattagtatttttctgcccctt

SEQ ID NO: 85527 - DNA, 35 bp, Artificial Sequence
  Synthetic oligonucleotide
tccccacgcaccactcccccggtctgtgacatctt

SEQ ID NO: 85528 - DNA, 35 bp, Artificial Sequence
  Synthetic oligonucleotide
tactgtgggtggtggcgaagtgacatccatatgtt

SEQ ID NO: 85529 - DNA, 36 bp, Artificial Sequence
  Synthetic oligonucleotide
gagtagtcgctccaccgtatacgcactcttacaaaa

SEQ ID NO: 85530 - DNA, 36 bp, Artificial Sequence
  Synthetic oligonucleotide
tcacacaccaagcgacgattgacgcagcccgtcaaa

SEQ ID NO: 85531 - DNA, 36 bp, Artificial Sequence
  Synthetic oligonucleotide
accaggacccgctccgtcttgagcgaaactatacaa

SEQ ID NO: 85532 - DNA, 36 bp, Artificial Sequence
  Synthetic oligonucleotide
gataagcgggtggggagcgcggcaaggtaagggcaa

SEQ ID NO: 85533 - DNA, 36 bp, Artificial Sequence
  Synthetic oligonucleotide
tttggaggatgtcacttggtaaacggggtggggcaa

SEQ ID NO: 85534 - DNA, 36 bp, Artificial Sequence
  Synthetic oligonucleotide
tacacaccccgactgacgttgtgtggagatgatgaa

SEQ ID NO: 85535 - DNA, 35 bp, Artificial Sequence
  Synthetic oligonucleotide
gaagatagggaggagaagtgggtgttgggatctaa

SEQ ID NO: 85536 - DNA, 35 bp, Artificial Sequence
  Synthetic oligonucleotide
acccaccaccgggtgagaacaccttaccattctaa

SEQ ID NO: 85537 - DNA, 35 bp, Artificial Sequence
  Synthetic oligonucleotide
gtagaacagggggggtcgcggccggggttaattaa

SEQ ID NO: 85538 - DNA, 36 bp, Artificial Sequence
  Synthetic oligonucleotide
taacggtgccaccaatttgtacaccatgcccattaa

SEQ ID NO: 85539 - DNA, 36 bp, Artificial Sequence
  Synthetic oligonucleotide
acgaccactgacggacgcaggaccatatacaaaaca

SEQ ID NO: 85540 - DNA, 36 bp, Artificial Sequence
  Synthetic oligonucleotide
agactacgcacaaaggtctccattgcttacacaaca

SEQ ID NO: 85541 - DNA, 36 bp, Artificial Sequence
  Synthetic oligonucleotide
ggtacaggggcaacggtcctaaaaacgaggataaca

SEQ ID NO: 85542 - DNA, 36 bp, Artificial Sequence
  Synthetic oligonucleotide
gagtgcggaaggggaggcgcctgtgatggtcccaca

SEQ ID NO: 85543 - DNA, 36 bp, Artificial Sequence
  Synthetic oligonucleotide
ttgcaccacacaggctgtacgacggaccacaagaca

SEQ ID NO: 85544 - DNA, 36 bp, Artificial Sequence
  Synthetic oligonucleotide
ttgcacgacgtctcctacggtataccgcacatacca

SEQ ID NO: 85545 - DNA, 36 bp, Artificial Sequence
  Synthetic oligonucleotide
ggcttgcacgggctctttagtctaggctgctttcca

SEQ ID NO: 85546 - DNA, 36 bp, Artificial Sequence
  Synthetic oligonucleotide
gatagtcgcccgttctgccttctgtcgatgtacgca

SEQ ID NO: 85547 - DNA, 35 bp, Artificial Sequence
  Synthetic oligonucleotide
gtgacctcccgactgaatcaacgtgctctcggtca

SEQ ID NO: 85548 - DNA, 36 bp, Artificial Sequence
  Synthetic oligonucleotide
accgcgcatcgatatcggccaattatcactctgtca

SEQ ID NO: 85549 - DNA, 36 bp, Artificial Sequence
  Synthetic oligonucleotide
acgcatcactgtccaggttggtccccccgctgttca

SEQ ID NO: 85550 - DNA, 36 bp, Artificial Sequence
  Synthetic oligonucleotide
tagtcaaccacgtgcttcttatttttgcctgtttca

SEQ ID NO: 85551 - DNA, 37 bp, Artificial Sequence
  Synthetic oligonucleotide
aacaaaacggcatgggttattggggggggaaagaaga

SEQ ID NO: 85552 - DNA, 37 bp, Artificial Sequence
  Synthetic oligonucleotide
tgtgacgcattgcgataaccagcgactcctttccaga

SEQ ID NO: 85553 - DNA, 37 bp, Artificial Sequence
  Synthetic oligonucleotide
taaccacatccgcactagcagggataggctcactaga

SEQ ID NO: 85554 - DNA, 37 bp, Artificial Sequence
  Synthetic oligonucleotide
gaaaacgtcatcccgccgccagatcccaacttcacga

SEQ ID NO: 85555 - DNA, 37 bp, Artificial Sequence
  Synthetic oligonucleotide
ttgcgtacaatctgcctcgccactccggagcacccga

SEQ ID NO: 85556 - DNA, 37 bp, Artificial Sequence
  Synthetic oligonucleotide
gtccgccacagtctttacttaacagatattgccccga

SEQ ID NO: 85557 - DNA, 37 bp, Artificial Sequence
  Synthetic oligonucleotide
cgcacccctggacatacctgccatcgctcctcggcga

SEQ ID NO: 85558 - DNA, 36 bp, Artificial Sequence
  Synthetic oligonucleotide
acatcgacgacaagtatggttttctctcatctgcga

SEQ ID NO: 85559 - DNA, 37 bp, Artificial Sequence
  Synthetic oligonucleotide
ttggagtaaagcggctgtaagggtggcggaggtgcga

SEQ ID NO: 85560 - DNA, 37 bp, Artificial Sequence
  Synthetic oligonucleotide
gttggcgtaaccgctcctatattcaagcacacctcga

SEQ ID NO: 85561 - DNA, 37 bp, Artificial Sequence
  Synthetic oligonucleotide
atgcatcaacccttcaagtgaaattagctcacctcga

SEQ ID NO: 85562 - DNA, 37 bp, Artificial Sequence
  Synthetic oligonucleotide
gaaccatcgcccagcatccccgatcacagagcctcga

SEQ ID NO: 85563 - DNA, 37 bp, Artificial Sequence
  Synthetic oligonucleotide
gatgcacggtgggcacgtgccaacgacctctggtcga

SEQ ID NO: 85564 - DNA, 37 bp, Artificial Sequence
  Synthetic oligonucleotide
agctgtcatgtcagctatctgcatttttccttttcga

SEQ ID NO: 85565 - DNA, 36 bp, Artificial Sequence
  Synthetic oligonucleotide
agtaacggcggagagagataaagggattgcggagga

SEQ ID NO: 85566 - DNA, 37 bp, Artificial Sequence
  Synthetic oligonucleotide
tcaccagacgacccccgcgttactacttctcatagga

SEQ ID NO: 85567 - DNA, 35 bp, Artificial Sequence
  Synthetic oligonucleotide
tctcgcaccgttcgcacgcattttctccgcacgga

SEQ ID NO: 85568 - DNA, 37 bp, Artificial Sequence
  Synthetic oligonucleotide
ggatgggggtacattttatggggttacggaagacgga

SEQ ID NO: 85569 - DNA, 37 bp, Artificial Sequence
  Synthetic oligonucleotide
gattggaaggtggtggagccggggtacagtggacgga

SEQ ID NO: 85570 - DNA, 37 bp, Artificial Sequence
  Synthetic oligonucleotide
gtataggggagtggggagaagcagacggggcaccgga

SEQ ID NO: 85571 - DNA, 37 bp, Artificial Sequence
  Synthetic oligonucleotide
agaactgcaggaacggagggattgcagggggaccgga

SEQ ID NO: 85572 - DNA, 37 bp, Artificial Sequence
  Synthetic oligonucleotide
taacatggggtgatggggcggcatatagggaggcgga

SEQ ID NO: 85573 - DNA, 37 bp, Artificial Sequence
  Synthetic oligonucleotide
ttcacggtcccctcatgccagtgtctggcctttcgga

SEQ ID NO: 85574 - DNA, 37 bp, Artificial Sequence
  Synthetic oligonucleotide
tatgtcagggggaagtaacgatagtcagtgcagtgga

SEQ ID NO: 85575 - DNA, 38 bp, Artificial Sequence
  Synthetic oligonucleotide
gatgtctgaggaaagggcgtcaggggaacggtggatga

SEQ ID NO: 85576 - DNA, 37 bp, Artificial Sequence
  Synthetic oligonucleotide
gatgtagttggaaggtggttaatgtggggaggtatga

SEQ ID NO: 85577 - DNA, 38 bp, Artificial Sequence
  Synthetic oligonucleotide
gataagcgcccggcccgtccatcgatttgctacactga

SEQ ID NO: 85578 - DNA, 38 bp, Artificial Sequence
  Synthetic oligonucleotide
aactgcaacgcggtctttccctcctaaacagtcactga

SEQ ID NO: 85579 - DNA, 38 bp, Artificial Sequence
  Synthetic oligonucleotide
gaaccatcggaggaaggtggactccaagcgaagactga

SEQ ID NO: 85580 - DNA, 37 bp, Artificial Sequence
  Synthetic oligonucleotide
gcactaccccttcattccagcccggcggtctccctga

SEQ ID NO: 85581 - DNA, 38 bp, Artificial Sequence
  Synthetic oligonucleotide
ttcgggccacaccacgtacttcaactctaggatcctga

SEQ ID NO: 85582 - DNA, 36 bp, Artificial Sequence
  Synthetic oligonucleotide
tactgcctggcgtagtactgcggtgcccactcctga

SEQ ID NO: 85583 - DNA, 37 bp, Artificial Sequence
  Synthetic oligonucleotide
tcaatctctcgctcacatgcttcaccacgggtcctga

SEQ ID NO: 85584 - DNA, 38 bp, Artificial Sequence
  Synthetic oligonucleotide
gtgcgagcctgtgggggtgggaatttgatgctggctga

SEQ ID NO: 85585 - DNA, 38 bp, Artificial Sequence
  Synthetic oligonucleotide
gggacggggaagaaatatagttcggcgcataaaagtga

SEQ ID NO: 85586 - DNA, 38 bp, Artificial Sequence
  Synthetic oligonucleotide
gtggtatggggggattggaggtaggtaagcagaagtga

SEQ ID NO: 85587 - DNA, 38 bp, Artificial Sequence
  Synthetic oligonucleotide
atcacatcagcacttaaatccgaaccttccctacgtga

SEQ ID NO: 85588 - DNA, 38 bp, Artificial Sequence
  Synthetic oligonucleotide
acaccgcatctgagcgggtcccaccgtatgtaccgtga

SEQ ID NO: 85589 - DNA, 36 bp, Artificial Sequence
  Synthetic oligonucleotide
tccgaacctctcactatgtatcatcgcgcacggtga

SEQ ID NO: 85590 - DNA, 38 bp, Artificial Sequence
  Synthetic oligonucleotide
tcagccggtcgagggctggttgctgttgctctcggtga

SEQ ID NO: 85591 - DNA, 36 bp, Artificial Sequence
  Synthetic oligonucleotide
gcaaacgtacaagtgtctttttttttttttcggtga

SEQ ID NO: 85592 - DNA, 38 bp, Artificial Sequence
  Synthetic oligonucleotide
tcagagcgccactccctcctgcccagactttccattga

SEQ ID NO: 85593 - DNA, 38 bp, Artificial Sequence
  Synthetic oligonucleotide
tgcggcactgctgctcttacaatctacctcacccttga

SEQ ID NO: 85594 - DNA, 37 bp, Artificial Sequence
  Synthetic oligonucleotide
tgtcacctcctctacctgtcgaataccttcgccttga

SEQ ID NO: 85595 - DNA, 38 bp, Artificial Sequence
  Synthetic oligonucleotide
attgaagccgaaaggcggtgggagtcaggggccgttga

SEQ ID NO: 85596 - DNA, 37 bp, Artificial Sequence
  Synthetic oligonucleotide
tactacaggagttgggggtgaaagtaggggtggttga

SEQ ID NO: 85597 - DNA, 37 bp, Artificial Sequence
  Synthetic oligonucleotide
tgtgtccctggtccatgcgataggttccttctgttga

SEQ ID NO: 85598 - DNA, 38 bp, Artificial Sequence
  Synthetic oligonucleotide
aaggacgctgctgaggacgggggacgggcagggtttga

SEQ ID NO: 85599 - DNA, 36 bp, Artificial Sequence
  Synthetic oligonucleotide
gaccacgtactcccatcgagcctgtgttagctcata

SEQ ID NO: 85600 - DNA, 36 bp, Artificial Sequence
  Synthetic oligonucleotide
ttacgtcgcccctgtagcctacttatgccattgata

SEQ ID NO: 85601 - DNA, 35 bp, Artificial Sequence
  Synthetic oligonucleotide
taccgcgctctccctgcgttcacccggacaatata

SEQ ID NO: 85602 - DNA, 36 bp, Artificial Sequence
  Synthetic oligonucleotide
gcaactgtcggcactaaattacatccgcgtgtgcta

SEQ ID NO: 85603 - DNA, 36 bp, Artificial Sequence
  Synthetic oligonucleotide
gccacccatagatcgtacgagaactccatgttgcta

SEQ ID NO: 85604 - DNA, 35 bp, Artificial Sequence
  Synthetic oligonucleotide
gactcccggccgtcgcgtccccccagcaaaatcta

SEQ ID NO: 85605 - DNA, 35 bp, Artificial Sequence
  Synthetic oligonucleotide
tacgcatggcaaccgcactacgcccggtttatcta

SEQ ID NO: 85606 - DNA, 35 bp, Artificial Sequence
  Synthetic oligonucleotide
gagtgcagggccgaatctgccttctgctttgcgta

SEQ ID NO: 85607 - DNA, 35 bp, Artificial Sequence
  Synthetic oligonucleotide
tacgtcgtccacatatagcgactcccgaccctgta

SEQ ID NO: 85608 - DNA, 35 bp, Artificial Sequence
  Synthetic oligonucleotide
tgcctgctaccagctcccccattttcacttgtgta

SEQ ID NO: 85609 - DNA, 36 bp, Artificial Sequence
  Synthetic oligonucleotide
tttgcgccgttacaccttctggctccctcccgatta

SEQ ID NO: 85610 - DNA, 35 bp, Artificial Sequence
  Synthetic oligonucleotide
accctcatcaagacccgaagctgttacaggaaaac

SEQ ID NO: 85611 - DNA, 35 bp, Artificial Sequence
  Synthetic oligonucleotide
gccatccgtggcgcataatctcgtcgtccgctaac

SEQ ID NO: 85612 - DNA, 35 bp, Artificial Sequence
  Synthetic oligonucleotide
aaggggacctgggcaagcactcatcttcctctaac

SEQ ID NO: 85613 - DNA, 35 bp, Artificial Sequence
  Synthetic oligonucleotide
agtacacctagacgcttcaaggcctcgaacaacac

SEQ ID NO: 85614 - DNA, 35 bp, Artificial Sequence
  Synthetic oligonucleotide
tccaatgccggaccccttgctcgcgctgcctgcac

SEQ ID NO: 85615 - DNA, 34 bp, Artificial Sequence
  Synthetic oligonucleotide
ttcaactgccgttgagggcttgtcgcgctactac

SEQ ID NO: 85616 - DNA, 35 bp, Artificial Sequence
  Synthetic oligonucleotide
acgcccgtgcacatcgctttccctacagaccctac

SEQ ID NO: 85617 - DNA, 35 bp, Artificial Sequence
  Synthetic oligonucleotide
tcaaggaccagcttgccggacactgatccatcacc

SEQ ID NO: 85618 - DNA, 35 bp, Artificial Sequence
  Synthetic oligonucleotide
acttgcgcatcgcacgactattcacctgcactccc

SEQ ID NO: 85619 - DNA, 35 bp, Artificial Sequence
  Synthetic oligonucleotide
gcctactcacttgttgaatataccgaaggcttccc

SEQ ID NO: 85620 - DNA, 35 bp, Artificial Sequence
  Synthetic oligonucleotide
gtggttctatcccgtcccatttgttatacctcgcc

SEQ ID NO: 85621 - DNA, 35 bp, Artificial Sequence
  Synthetic oligonucleotide
gaaatgttgactgtcccacccagccccgccttgcc

SEQ ID NO: 85622 - DNA, 35 bp, Artificial Sequence
  Synthetic oligonucleotide
gacccgactcaatttctcatcagaaggactttgcc

SEQ ID NO: 85623 - DNA, 35 bp, Artificial Sequence
  Synthetic oligonucleotide
tccccaaccatttggccttgggtaccaaagtatcc

SEQ ID NO: 85624 - DNA, 35 bp, Artificial Sequence
  Synthetic oligonucleotide
tacattggcgggaaaacgctggctctcacccctcc

SEQ ID NO: 85625 - DNA, 35 bp, Artificial Sequence
  Synthetic oligonucleotide
tctcgccaagcacgcaatcatacgatacctcgtcc

SEQ ID NO: 85626 - DNA, 35 bp, Artificial Sequence
  Synthetic oligonucleotide
gctgcacttgagcgcgcgaactaggctcgatttcc

SEQ ID NO: 85627 - DNA, 35 bp, Artificial Sequence
  Synthetic oligonucleotide
gttgagccatctgtcttggacgcacgtccttttcc

SEQ ID NO: 85628 - DNA, 35 bp, Artificial Sequence
  Synthetic oligonucleotide
tgaaggtcacttccacccggctcctactataccgc

SEQ ID NO: 85629 - DNA, 35 bp, Artificial Sequence
  Synthetic oligonucleotide
tgtgcacgttcgcttgtcccttcgcatttttccgc

SEQ ID NO: 85630 - DNA, 35 bp, Artificial Sequence
  Synthetic oligonucleotide
tcatctcaatctttcgcctggcaatacaaactcgc

SEQ ID NO: 85631 - DNA, 35 bp, Artificial Sequence
  Synthetic oligonucleotide
ttggaacttacaattggggctctgcacatccctgc

SEQ ID NO: 85632 - DNA, 35 bp, Artificial Sequence
  Synthetic oligonucleotide
tgggactgcttaggccccgttcccctgatttgatc

SEQ ID NO: 85633 - DNA, 35 bp, Artificial Sequence
  Synthetic oligonucleotide
gcatggtaccgcggccaggttgactacattgcttc

SEQ ID NO: 85634 - DNA, 35 bp, Artificial Sequence
  Synthetic oligonucleotide
gacaccattgtgtaataaccttactccggctgttc

SEQ ID NO: 85635 - DNA, 35 bp, Artificial Sequence
  Synthetic oligonucleotide
tagacccctggtctaacaattgtttttccgtgttc

SEQ ID NO: 85636 - DNA, 35 bp, Artificial Sequence
  Synthetic oligonucleotide
gaacaagatagggtaagtgcaggggggtctaagag

SEQ ID NO: 85637 - DNA, 35 bp, Artificial Sequence
  Synthetic oligonucleotide
gacgccaacagagaggaaagattacgtacatggag

SEQ ID NO: 85638 - DNA, 35 bp, Artificial Sequence
  Synthetic oligonucleotide
ttacaacccgtgcgccttctcgtgtcccactgacg

SEQ ID NO: 85639 - DNA, 35 bp, Artificial Sequence
  Synthetic oligonucleotide
actcagccgacgatcggcccacgtctctggtaccg

SEQ ID NO: 85640 - DNA, 35 bp, Artificial Sequence
  Synthetic oligonucleotide
gcccaccctaaccaagacacgagggtagcacctcg

SEQ ID NO: 85641 - DNA, 35 bp, Artificial Sequence
  Synthetic oligonucleotide
tcctgcacccccgccttgttgagaccctcctctcg

SEQ ID NO: 85642 - DNA, 35 bp, Artificial Sequence
  Synthetic oligonucleotide
gccgtcctatcacaacctcacctggtcttatccgg

SEQ ID NO: 85643 - DNA, 35 bp, Artificial Sequence
  Synthetic oligonucleotide
atggtcaccacatggaagcagcttgcgggggaggg

SEQ ID NO: 85644 - DNA, 35 bp, Artificial Sequence
  Synthetic oligonucleotide
gatctggcggccgcaagtacaagaatctggagggg

SEQ ID NO: 85645 - DNA, 35 bp, Artificial Sequence
  Synthetic oligonucleotide
gtggaagcaactcgatcactgtcactgggtcctgg

SEQ ID NO: 85646 - DNA, 35 bp, Artificial Sequence
  Synthetic oligonucleotide
actgcggtaaccactggggagaatagggggtaatg

SEQ ID NO: 85647 - DNA, 35 bp, Artificial Sequence
  Synthetic oligonucleotide
aaaaggtggtgcgagaaaaatgagagagtgtaatg

SEQ ID NO: 85648 - DNA, 35 bp, Artificial Sequence
  Synthetic oligonucleotide
gtcacagacgccaaagcactcttcctttcgaagtg

SEQ ID NO: 85649 - DNA, 35 bp, Artificial Sequence
  Synthetic oligonucleotide
atgagaggaggagaggttgataatagcaagtagtg

SEQ ID NO: 85650 - DNA, 35 bp, Artificial Sequence
  Synthetic oligonucleotide
tgagacacgtgcgcaaattgagttgatcctgtgtg

SEQ ID NO: 85651 - DNA, 35 bp, Artificial Sequence
  Synthetic oligonucleotide
tgactccggtctgttctggcactcgaactatcttg

SEQ ID NO: 85652 - DNA, 35 bp, Artificial Sequence
  Synthetic oligonucleotide
gacactggttaggacggttgcatggatcggggttg

SEQ ID NO: 85653 - DNA, 35 bp, Artificial Sequence
  Synthetic oligonucleotide
ttgctatcctccgctccatcgatagtagttgtttg

SEQ ID NO: 85654 - DNA, 35 bp, Artificial Sequence
  Synthetic oligonucleotide
atgcacccgtcgatgcgaccccacccatcagtact

SEQ ID NO: 85655 - DNA, 35 bp, Artificial Sequence
  Synthetic oligonucleotide
actcgtccgccgccccctgtacgattcagtaacct

SEQ ID NO: 85656 - DNA, 35 bp, Artificial Sequence
  Synthetic oligonucleotide
gtccgactacaacctgtcatcgttatctactccct

SEQ ID NO: 85657 - DNA, 35 bp, Artificial Sequence
  Synthetic oligonucleotide
tcgtgacctccttgggctaaatcctttacactcct

SEQ ID NO: 85658 - DNA, 35 bp, Artificial Sequence
  Synthetic oligonucleotide
gagccacaccaaatgctcagactgccctcccgtct

SEQ ID NO: 85659 - DNA, 35 bp, Artificial Sequence
  Synthetic oligonucleotide
gacgcgcgagtggctattgatcttatgctccttct

SEQ ID NO: 85660 - DNA, 35 bp, Artificial Sequence
  Synthetic oligonucleotide
tgctctacccgcgtgctgaatcttatacactttct

SEQ ID NO: 85661 - DNA, 35 bp, Artificial Sequence
  Synthetic oligonucleotide
gctcaaccacggcttctgtcgacggagattattgt

SEQ ID NO: 85662 - DNA, 35 bp, Artificial Sequence
  Synthetic oligonucleotide
attgctggcctcacgtccacttaatagccctcatt

SEQ ID NO: 85663 - DNA, 35 bp, Artificial Sequence
  Synthetic oligonucleotide
tccccccgttcacgattcggcataggcctcctatt

SEQ ID NO: 85664 - DNA, 35 bp, Artificial Sequence
  Synthetic oligonucleotide
tctacgcccggtgcttggagttcgacccgccccaa

SEQ ID NO: 85665 - DNA, 36 bp, Artificial Sequence
  Synthetic oligonucleotide
tagccgctccaacattggttatttcttctccggcaa

SEQ ID NO: 85666 - DNA, 36 bp, Artificial Sequence
  Synthetic oligonucleotide
gtgtggccgcatgtccacccctatctgtaaaacgaa

SEQ ID NO: 85667 - DNA, 35 bp, Artificial Sequence
  Synthetic oligonucleotide
ttcaggcgcaaatttcctcttgtccacgttgcgaa

SEQ ID NO: 85668 - DNA, 36 bp, Artificial Sequence
  Synthetic oligonucleotide
tgccccactctctgtacatgtcatttcggggatgaa

SEQ ID NO: 85669 - DNA, 36 bp, Artificial Sequence
  Synthetic oligonucleotide
acacgcctaccataaccgaacggttttctcagtgaa

SEQ ID NO: 85670 - DNA, 36 bp, Artificial Sequence
  Synthetic oligonucleotide
tacatcgcaccagctataatgcatccgtacgcgtaa

SEQ ID NO: 85671 - DNA, 35 bp, Artificial Sequence
  Synthetic oligonucleotide
tttaacaaggggtgggggggaaaggtcgtataaca

SEQ ID NO: 85672 - DNA, 35 bp, Artificial Sequence
  Synthetic oligonucleotide
gaccacctattaacacagtgtcggtccataacaca

SEQ ID NO: 85673 - DNA, 35 bp, Artificial Sequence
  Synthetic oligonucleotide
attcacgtcccccatttttgaaagttcgacacaca

SEQ ID NO: 85674 - DNA, 36 bp, Artificial Sequence
  Synthetic oligonucleotide
gcaccggtgtgggacaagaatcatcactgttacaca

SEQ ID NO: 85675 - DNA, 36 bp, Artificial Sequence
  Synthetic oligonucleotide
atgtcacgcatatgcatgcattacttaggtttgaca

SEQ ID NO: 85676 - DNA, 36 bp, Artificial Sequence
  Synthetic oligonucleotide
gaccgtaactcctgtgcacgtgagcaccctcttaca

SEQ ID NO: 85677 - DNA, 35 bp, Artificial Sequence
  Synthetic oligonucleotide
tctgcacgtaacacccgaaatatcttaggtcacca

SEQ ID NO: 85678 - DNA, 36 bp, Artificial Sequence
  Synthetic oligonucleotide
ttaccgcgccctctgtatcccagctccttctagcca

SEQ ID NO: 85679 - DNA, 36 bp, Artificial Sequence
  Synthetic oligonucleotide
gaccaacgtagttcttcacatacatagacttagcca

SEQ ID NO: 85680 - DNA, 36 bp, Artificial Sequence
  Synthetic oligonucleotide
agccacactacaactgctcttaaatagatggtgcca

SEQ ID NO: 85681 - DNA, 36 bp, Artificial Sequence
  Synthetic oligonucleotide
tcctccagccccggataatgatggtttcatcgtcca

SEQ ID NO: 85682 - DNA, 36 bp, Artificial Sequence
  Synthetic oligonucleotide
ttcccctcccttagttccgtatacccagcctgatca

SEQ ID NO: 85683 - DNA, 36 bp, Artificial Sequence
  Synthetic oligonucleotide
aacccgccactaccttgcaagatccttgtagactca

SEQ ID NO: 85684 - DNA, 37 bp, Artificial Sequence
  Synthetic oligonucleotide
agtcctacgaacggggggaaggatgaatggggaaaga

SEQ ID NO: 85685 - DNA, 37 bp, Artificial Sequence
  Synthetic oligonucleotide
gagatgcacatggcgttgggtgaagtgagggagaaga

SEQ ID NO: 85686 - DNA, 37 bp, Artificial Sequence
  Synthetic oligonucleotide
tgaggagggaagtagtgtgctttggggtgacggaaga

SEQ ID NO: 85687 - DNA, 37 bp, Artificial Sequence
  Synthetic oligonucleotide
atagcgaggcactaggaagaagggaaaaacgagcaga

SEQ ID NO: 85688 - DNA, 37 bp, Artificial Sequence
  Synthetic oligonucleotide
ttcgaggggggacggcaggtgggagcattttgtcaga

SEQ ID NO: 85689 - DNA, 37 bp, Artificial Sequence
  Synthetic oligonucleotide
tcaaacggagaaatcgtgatgagtttcacgtgagaga

SEQ ID NO: 85690 - DNA, 35 bp, Artificial Sequence
  Synthetic oligonucleotide
actcacgtagctgcctccccgagtaacattaacga

SEQ ID NO: 85691 - DNA, 37 bp, Artificial Sequence
  Synthetic oligonucleotide
tcccctccgagcagggctatatcctacacagtcacga

SEQ ID NO: 85692 - DNA, 37 bp, Artificial Sequence
  Synthetic oligonucleotide
gacgacctacggttgtgagttatcctatcttctacga

SEQ ID NO: 85693 - DNA, 35 bp, Artificial Sequence
  Synthetic oligonucleotide
tcctgaaactgggccatggcatcggtagtaaccga

SEQ ID NO: 85694 - DNA, 37 bp, Artificial Sequence
  Synthetic oligonucleotide
tgatcatgcaagggggtaactggcgatgaagagccga

SEQ ID NO: 85695 - DNA, 37 bp, Artificial Sequence
  Synthetic oligonucleotide
agccagaccagctcaccgccaagtctctcttatccga

SEQ ID NO: 85696 - DNA, 37 bp, Artificial Sequence
  Synthetic oligonucleotide
ttccgcagccacaacatggcatgatcaaattctccga

SEQ ID NO: 85697 - DNA, 37 bp, Artificial Sequence
  Synthetic oligonucleotide
gtggatccgatcaccgtctatctatgcctgctcgcga

SEQ ID NO: 85698 - DNA, 37 bp, Artificial Sequence
  Synthetic oligonucleotide
gacaccgacttcagaacacacactcgccctaaatcga

SEQ ID NO: 85699 - DNA, 36 bp, Artificial Sequence
  Synthetic oligonucleotide
gtgagtgcaaatcagcctggcccaaattctcctcga

SEQ ID NO: 85700 - DNA, 37 bp, Artificial Sequence
  Synthetic oligonucleotide
aaatggccgtgcagatatggtgggatggaggggtcga

SEQ ID NO: 85701 - DNA, 37 bp, Artificial Sequence
  Synthetic oligonucleotide
actcgccccgccgccttggtcgttgttggtacttcga

SEQ ID NO: 85702 - DNA, 37 bp, Artificial Sequence
  Synthetic oligonucleotide
tgcctttgccccacatctgttcagtcgtaccgcagga

SEQ ID NO: 85703 - DNA, 36 bp, Artificial Sequence
  Synthetic oligonucleotide
gcggatgaggtgggttgagggaagcgcggtgcagga

SEQ ID NO: 85704 - DNA, 37 bp, Artificial Sequence
  Synthetic oligonucleotide
acacggcgggtttggagggaagaaaagggtaatagga

SEQ ID NO: 85705 - DNA, 37 bp, Artificial Sequence
  Synthetic oligonucleotide
accctcggggggtacagctaccgccgccattcacgga

SEQ ID NO: 85706 - DNA, 37 bp, Artificial Sequence
  Synthetic oligonucleotide
gtcgagaggttgacaactaaaaacatgatgggacgga

SEQ ID NO: 85707 - DNA, 37 bp, Artificial Sequence
  Synthetic oligonucleotide
gttcgcactgatctccgcctcacagctggctttcgga

SEQ ID NO: 85708 - DNA, 37 bp, Artificial Sequence
  Synthetic oligonucleotide
gggggtggaggaagcatggttatgaacctaataggga

SEQ ID NO: 85709 - DNA, 37 bp, Artificial Sequence
  Synthetic oligonucleotide
gcatgagcggatacgcgaagggtgggcacgggcggga

SEQ ID NO: 85710 - DNA, 37 bp, Artificial Sequence
  Synthetic oligonucleotide
gcgcaatcgtggtggacagttagtcggcgggagggga

SEQ ID NO: 85711 - DNA, 37 bp, Artificial Sequence
  Synthetic oligonucleotide
tgagggtggtggaaaatcttacggtcatgctagggga

SEQ ID NO: 85712 - DNA, 37 bp, Artificial Sequence
  Synthetic oligonucleotide
acagcgggcaaaacatgtatggggggtggacaatgga

SEQ ID NO: 85713 - DNA, 36 bp, Artificial Sequence
  Synthetic oligonucleotide
ttacatcactgtcctgccctgtccctgaataatgga

SEQ ID NO: 85714 - DNA, 36 bp, Artificial Sequence
  Synthetic oligonucleotide
gctgacgggccagactcccctccgcgaaatccatga

SEQ ID NO: 85715 - DNA, 37 bp, Artificial Sequence
  Synthetic oligonucleotide
tcaaatgaaggggttaggaagtagtactggaggatga

SEQ ID NO: 85716 - DNA, 38 bp, Artificial Sequence
  Synthetic oligonucleotide
ttccgccctccgtccacaatgacgaaagcaccctatga

SEQ ID NO: 85717 - DNA, 38 bp, Artificial Sequence
  Synthetic oligonucleotide
gccatcttcccctatgggagtacttttcttctctatga

SEQ ID NO: 85718 - DNA, 38 bp, Artificial Sequence
  Synthetic oligonucleotide
atgtgaatcggccaacacgcgtctctatccgccactga

SEQ ID NO: 85719 - DNA, 38 bp, Artificial Sequence
  Synthetic oligonucleotide
gaaagagggtgggttgaatggtgagcagtgtggcctga

SEQ ID NO: 85720 - DNA, 38 bp, Artificial Sequence
  Synthetic oligonucleotide
tgacagttcgcccatgaaattcacacgcatgttcctga

SEQ ID NO: 85721 - DNA, 38 bp, Artificial Sequence
  Synthetic oligonucleotide
tggattccatcgccgcgtatcacaactccttatgctga

SEQ ID NO: 85722 - DNA, 38 bp, Artificial Sequence
  Synthetic oligonucleotide
gaggccgacgagcgtaatgcctcactgttccgatctga

SEQ ID NO: 85723 - DNA, 36 bp, Artificial Sequence
  Synthetic oligonucleotide
gtccgagacgaggatggtacgtatgagggaacgtga

SEQ ID NO: 85724 - DNA, 36 bp, Artificial Sequence
  Synthetic oligonucleotide
tatagctcctgcgcgactccacaccatctaccgtga

SEQ ID NO: 85725 - DNA, 38 bp, Artificial Sequence
  Synthetic oligonucleotide
gtagcggatagagaggggtacgtgggggtagtgcgtga

SEQ ID NO: 85726 - DNA, 36 bp, Artificial Sequence
  Synthetic oligonucleotide
gcatgccactgcatcgggaccatgagtagctggtga

SEQ ID NO: 85727 - DNA, 38 bp, Artificial Sequence
  Synthetic oligonucleotide
ggagtgcgggggtcgggagacgaaagaacatgctgtga

SEQ ID NO: 85728 - DNA, 38 bp, Artificial Sequence
  Synthetic oligonucleotide
gactgggcgcaagctcgccttctcactcccctttgtga

SEQ ID NO: 85729 - DNA, 38 bp, Artificial Sequence
  Synthetic oligonucleotide
atgcatacagggaaggtagcaagttggatgaggattga

SEQ ID NO: 85730 - DNA, 38 bp, Artificial Sequence
  Synthetic oligonucleotide
agtacgcatcaaccgtcctgccctctagtattgattga

SEQ ID NO: 85731 - DNA, 38 bp, Artificial Sequence
  Synthetic oligonucleotide
tgacaggtccctgccgccctacccgtgccagcacttga

SEQ ID NO: 85732 - DNA, 37 bp, Artificial Sequence
  Synthetic oligonucleotide
gactgcggtgagcgggtcctacacagaacgtacttga

SEQ ID NO: 85733 - DNA, 38 bp, Artificial Sequence
  Synthetic oligonucleotide
tcatcccacccggtcgccgcgacgacacctacggttga

SEQ ID NO: 85734 - DNA, 38 bp, Artificial Sequence
  Synthetic oligonucleotide
tcacactagatggaaaggggggctgttgggcgggttga

SEQ ID NO: 85735 - DNA, 37 bp, Artificial Sequence
  Synthetic oligonucleotide
actgaccaaccgctaccgagtcgtaattaacatttga

SEQ ID NO: 85736 - DNA, 37 bp, Artificial Sequence
  Synthetic oligonucleotide
tgtccacccccgtcccgaatccgatgatatcatttga

SEQ ID NO: 85737 - DNA, 37 bp, Artificial Sequence
  Synthetic oligonucleotide
gcgctcctgcgacctatcttttttgtgtggcctttga

SEQ ID NO: 85738 - DNA, 38 bp, Artificial Sequence
  Synthetic oligonucleotide
acctagctccctcatcgcgttctggttaccacttttga

SEQ ID NO: 85739 - DNA, 36 bp, Artificial Sequence
  Synthetic oligonucleotide
tcctgatggaccctgcctgtctactcgccaaccata

SEQ ID NO: 85740 - DNA, 35 bp, Artificial Sequence
  Synthetic oligonucleotide
agaactgcagtggaagggatgggaaggggttcata

SEQ ID NO: 85741 - DNA, 36 bp, Artificial Sequence
  Synthetic oligonucleotide
accccactcgcggagcctaagccacttacccatata

SEQ ID NO: 85742 - DNA, 36 bp, Artificial Sequence
  Synthetic oligonucleotide
ggttagcctcccctgaatttaggcaccaggccacta

SEQ ID NO: 85743 - DNA, 36 bp, Artificial Sequence
  Synthetic oligonucleotide
gtcaagggcaatccatccggtaagtgagtctcgcta

SEQ ID NO: 85744 - DNA, 36 bp, Artificial Sequence
  Synthetic oligonucleotide
ttgaccaacaggacttacgttaggagaccttgtcta

SEQ ID NO: 85745 - DNA, 36 bp, Artificial Sequence
  Synthetic oligonucleotide
attgcatctgatgaatggggggggttgcaggaagta

SEQ ID NO: 85746 - DNA, 36 bp, Artificial Sequence
  Synthetic oligonucleotide
agattcgcatatgtctgcggaccccacccccatgta

SEQ ID NO: 85747 - DNA, 35 bp, Artificial Sequence
  Synthetic oligonucleotide
gccgctatctccgttaatgtctgtcccccgctgta

SEQ ID NO: 85748 - DNA, 35 bp, Artificial Sequence
  Synthetic oligonucleotide
tacgtccagcgggtttctgccgtttgccgttctta

SEQ ID NO: 85749 - DNA, 35 bp, Artificial Sequence
  Synthetic oligonucleotide
tgttagtgcaatctgtttgatcccgcgctacttta

SEQ ID NO: 85750 - DNA, 35 bp, Artificial Sequence
  Synthetic oligonucleotide
tccaccatccaaatcaaatacagtgccgagcaaac

SEQ ID NO: 85751 - DNA, 35 bp, Artificial Sequence
  Synthetic oligonucleotide
actaccagtgggcccgctcacagtcgtaaccacac

SEQ ID NO: 85752 - DNA, 35 bp, Artificial Sequence
  Synthetic oligonucleotide
atctgcacagagtctccaaggccagatttctacac

SEQ ID NO: 85753 - DNA, 35 bp, Artificial Sequence
  Synthetic oligonucleotide
tgtgccgccagaaaatatggcccttgtctgtccac

SEQ ID NO: 85754 - DNA, 35 bp, Artificial Sequence
  Synthetic oligonucleotide
tctgtacggactccccgaacaattgacggtattac

SEQ ID NO: 85755 - DNA, 35 bp, Artificial Sequence
  Synthetic oligonucleotide
ttagcaccaggcaatctcatataaaaccctcaacc

SEQ ID NO: 85756 - DNA, 35 bp, Artificial Sequence
  Synthetic oligonucleotide
gtctgtgaggcacatatttagcacctcggtccacc

SEQ ID NO: 85757 - DNA, 35 bp, Artificial Sequence
  Synthetic oligonucleotide
acacagcatggtatgggcgtcgaagttaccacccc

SEQ ID NO: 85758 - DNA, 35 bp, Artificial Sequence
  Synthetic oligonucleotide
gcgaacgacacacttagatctgcccatatgccccc

SEQ ID NO: 85759 - DNA, 35 bp, Artificial Sequence
  Synthetic oligonucleotide
agttgctgtggtggtgtcatctgttctgtctcccc

SEQ ID NO: 85760 - DNA, 35 bp, Artificial Sequence
  Synthetic oligonucleotide
atatccgccccaccgtgcatctggtcctgtatccc

SEQ ID NO: 85761 - DNA, 35 bp, Artificial Sequence
  Synthetic oligonucleotide
gcacctcccgctggcttggacggttatccacctcc

SEQ ID NO: 85762 - DNA, 35 bp, Artificial Sequence
  Synthetic oligonucleotide
tttgggccacatactgtccttatcaaatccattcc

SEQ ID NO: 85763 - DNA, 35 bp, Artificial Sequence
  Synthetic oligonucleotide
aacatccggaatgatgttccagtcccacgccttcc

SEQ ID NO: 85764 - DNA, 35 bp, Artificial Sequence
  Synthetic oligonucleotide
gacgttgtggcggtttttcctgacttcttacaagc

SEQ ID NO: 85765 - DNA, 35 bp, Artificial Sequence
  Synthetic oligonucleotide
tcccatcactgcttgtttcggctttattacgaagc

SEQ ID NO: 85766 - DNA, 35 bp, Artificial Sequence
  Synthetic oligonucleotide
aaccacttcgcgaccctgctttgaccgtgcgtagc

SEQ ID NO: 85767 - DNA, 35 bp, Artificial Sequence
  Synthetic oligonucleotide
atgtcaatatccgcgctatcaccgccccgcttcgc

SEQ ID NO: 85768 - DNA, 35 bp, Artificial Sequence
  Synthetic oligonucleotide
acgcagtacaccggtattagtcatctcagtactgc

SEQ ID NO: 85769 - DNA, 35 bp, Artificial Sequence
  Synthetic oligonucleotide
gatgcgattatggtcgcctactgtagagtttctgc

SEQ ID NO: 85770 - DNA, 35 bp, Artificial Sequence
  Synthetic oligonucleotide
gtatacgtccattgccatctcaacactgccacatc

SEQ ID NO: 85771 - DNA, 35 bp, Artificial Sequence
  Synthetic oligonucleotide
tgggagggtacagagtgagtgtgtggtgtgctatc

SEQ ID NO: 85772 - DNA, 34 bp, Artificial Sequence
  Synthetic oligonucleotide
tcaacttggtcttatacgacacctgacaccactc

SEQ ID NO: 85773 - DNA, 35 bp, Artificial Sequence
  Synthetic oligonucleotide
tgacacgctgccactcagtatcatgcattcccctc

SEQ ID NO: 85774 - DNA, 35 bp, Artificial Sequence
  Synthetic oligonucleotide
gccaccggctggcctgtgcaatgaccctgtccgtc

SEQ ID NO: 85775 - DNA, 34 bp, Artificial Sequence
  Synthetic oligonucleotide
tagcctgagcagagaagatagccagtctgtattc

SEQ ID NO: 85776 - DNA, 35 bp, Artificial Sequence
  Synthetic oligonucleotide
ttgacgaaacgctatctgactcagttttaaacttc

SEQ ID NO: 85777 - DNA, 35 bp, Artificial Sequence
  Synthetic oligonucleotide
gtccatcccccacccttccagatagcatgcgcttc

SEQ ID NO: 85778 - DNA, 33 bp, Artificial Sequence
  Synthetic oligonucleotide
tcttgcccatctacattcgactcctctgtaaag

SEQ ID NO: 85779 - DNA, 35 bp, Artificial Sequence
  Synthetic oligonucleotide
tcggaacccccgatctgatcccgtcactctcgtag

SEQ ID NO: 85780 - DNA, 35 bp, Artificial Sequence
  Synthetic oligonucleotide
tacgaactcaggcaaagtagctgcccgtcaccacg

SEQ ID NO: 85781 - DNA, 35 bp, Artificial Sequence
  Synthetic oligonucleotide
tcacccttatgttagttgtgcgtcctttcctatcg

SEQ ID NO: 85782 - DNA, 35 bp, Artificial Sequence
  Synthetic oligonucleotide
tacgtatccaccgaccggaggcgcttcttgtctcg

SEQ ID NO: 85783 - DNA, 35 bp, Artificial Sequence
  Synthetic oligonucleotide
taggaccatgtggcccactcccttttcatattagg

SEQ ID NO: 85784 - DNA, 35 bp, Artificial Sequence
  Synthetic oligonucleotide
tagtgatcgcgcatggtgatacttattggcttatg

SEQ ID NO: 85785 - DNA, 35 bp, Artificial Sequence
  Synthetic oligonucleotide
aattccgccacattcgcagggcccgccttattctg

SEQ ID NO: 85786 - DNA, 35 bp, Artificial Sequence
  Synthetic oligonucleotide
taggccatcgatacaccatttgccacgggttcttg

SEQ ID NO: 85787 - DNA, 35 bp, Artificial Sequence
  Synthetic oligonucleotide
ttggggcggggaccaattaggagaaagaaaggaat

SEQ ID NO: 85788 - DNA, 34 bp, Artificial Sequence
  Synthetic oligonucleotide
gaagcagatcactagctactaggggggggaacat

SEQ ID NO: 85789 - DNA, 35 bp, Artificial Sequence
  Synthetic oligonucleotide
gtgaggagtgaaagatggaaagtcgcggtggagat

SEQ ID NO: 85790 - DNA, 35 bp, Artificial Sequence
  Synthetic oligonucleotide
tatgcctaccgagcttcaggctccgaatcctcgat

SEQ ID NO: 85791 - DNA, 35 bp, Artificial Sequence
  Synthetic oligonucleotide
tcaactgacgccaagaatatttcaagccctcttat

SEQ ID NO: 85792 - DNA, 35 bp, Artificial Sequence
  Synthetic oligonucleotide
tgtccgataccccgccattcgacaggttgggaact

SEQ ID NO: 85793 - DNA, 35 bp, Artificial Sequence
  Synthetic oligonucleotide
tttgtacaacaatcgcctgactggaagtcccccct

SEQ ID NO: 85794 - DNA, 35 bp, Artificial Sequence
  Synthetic oligonucleotide
gacatacttcacaatgcgccccacttctgcgagct

SEQ ID NO: 85795 - DNA, 35 bp, Artificial Sequence
  Synthetic oligonucleotide
gtaccctgttgcctcccgtttggtggttcgaatct

SEQ ID NO: 85796 - DNA, 35 bp, Artificial Sequence
  Synthetic oligonucleotide
tcagtaagacccgggccacgtccaggttgcattct

SEQ ID NO: 85797 - DNA, 35 bp, Artificial Sequence
  Synthetic oligonucleotide
gaagtgagcctatacgtctatagcacatgccttct

SEQ ID NO: 85798 - DNA, 35 bp, Artificial Sequence
  Synthetic oligonucleotide
gtgaccgtgtctggtaacttccgtcacccattatt

SEQ ID NO: 85799 - DNA, 36 bp, Artificial Sequence
  Synthetic oligonucleotide
atcacgtgctcaaggttttggtgcgctcggttcctt

SEQ ID NO: 85800 - DNA, 35 bp, Artificial Sequence
  Synthetic oligonucleotide
gtacgtagcaatctgcaggcctcgatatccctctt

SEQ ID NO: 85801 - DNA, 35 bp, Artificial Sequence
  Synthetic oligonucleotide
aacccgcccctccgaactctacacggtatttgttt

SEQ ID NO: 85802 - DNA, 35 bp, Artificial Sequence
  Synthetic oligonucleotide
gaacaaggggtaggggtgtcatgtgtaggttgaaa

SEQ ID NO: 85803 - DNA, 36 bp, Artificial Sequence
  Synthetic oligonucleotide
gagcccacaacgtagggggaggaggcggtcgggcaa

SEQ ID NO: 85804 - DNA, 36 bp, Artificial Sequence
  Synthetic oligonucleotide
gacgcttccgtaggtctcttgatgatactcttgcaa

SEQ ID NO: 85805 - DNA, 36 bp, Artificial Sequence
  Synthetic oligonucleotide
gtgggtgaggccgggggtgcgcggggtaagaccgaa

SEQ ID NO: 85806 - DNA, 36 bp, Artificial Sequence
  Synthetic oligonucleotide
tcgcatgaccagagcgcctcttgcgatgtctccgaa

SEQ ID NO: 85807 - DNA, 36 bp, Artificial Sequence
  Synthetic oligonucleotide
taagggtaggtgggtgcaaagtaatgatgtggtgaa

SEQ ID NO: 85808 - DNA, 36 bp, Artificial Sequence
  Synthetic oligonucleotide
tggtgtcgccgctgtcactactcccattttattgaa

SEQ ID NO: 85809 - DNA, 36 bp, Artificial Sequence
  Synthetic oligonucleotide
gagtgtgcgcggaacgctaggaggggggccaaataa

SEQ ID NO: 85810 - DNA, 35 bp, Artificial Sequence
  Synthetic oligonucleotide
tcaacgctcaatgctggcttggtgctgggtggtaa

SEQ ID NO: 85811 - DNA, 36 bp, Artificial Sequence
  Synthetic oligonucleotide
taatagggcaggccaacattgccctgaggttctaca

SEQ ID NO: 85812 - DNA, 35 bp, Artificial Sequence
  Synthetic oligonucleotide
accgcccgtcaacacatagaaaaccatacgtccca

SEQ ID NO: 85813 - DNA, 35 bp, Artificial Sequence
  Synthetic oligonucleotide
gacccgatagcacgttgcattctccgtttaccgca

SEQ ID NO: 85814 - DNA, 35 bp, Artificial Sequence
  Synthetic oligonucleotide
gagcggtgggtggaggtagctgggtcttaggggca

SEQ ID NO: 85815 - DNA, 35 bp, Artificial Sequence
  Synthetic oligonucleotide
acgcgttccaatagttttccgtccatgcccctgca

SEQ ID NO: 85816 - DNA, 35 bp, Artificial Sequence
  Synthetic oligonucleotide
tattgcatccccaatcctccacagaccctcctgca

SEQ ID NO: 85817 - DNA, 36 bp, Artificial Sequence
  Synthetic oligonucleotide
gacgcctctcccaagtttcctcaattatctgttgca

SEQ ID NO: 85818 - DNA, 37 bp, Artificial Sequence
  Synthetic oligonucleotide
gttgagtgaaaatgtaattaatggcagggactcaaga

SEQ ID NO: 85819 - DNA, 36 bp, Artificial Sequence
  Synthetic oligonucleotide
gacggggggagttcgggaattcgagagatggtaaga

SEQ ID NO: 85820 - DNA, 37 bp, Artificial Sequence
  Synthetic oligonucleotide
attgcgctcgcctcagcacccgtagaccgtaggtaga

SEQ ID NO: 85821 - DNA, 37 bp, Artificial Sequence
  Synthetic oligonucleotide
attggccgcctggagctacttccttcatactgcacga

SEQ ID NO: 85822 - DNA, 37 bp, Artificial Sequence
  Synthetic oligonucleotide
aatggcgagccgttcgactcttcctgcgttccaccga

SEQ ID NO: 85823 - DNA, 36 bp, Artificial Sequence
  Synthetic oligonucleotide
aacatgtgcacgggcgggaaggctttgtgggatcga

SEQ ID NO: 85824 - DNA, 37 bp, Artificial Sequence
  Synthetic oligonucleotide
gttgccagggacggaacagagataaagagaaactcga

SEQ ID NO: 85825 - DNA, 38 bp, Artificial Sequence
  Synthetic oligonucleotide
accaccctgaggaaacaaaaaattactgtcgagttcga

SEQ ID NO: 85826 - DNA, 37 bp, Artificial Sequence
  Synthetic oligonucleotide
gtatgaaggtggtaaaaaaagaaggtataggtaagga

SEQ ID NO: 85827 - DNA, 37 bp, Artificial Sequence
  Synthetic oligonucleotide
gaattacagggaggtatagtacgcagagagaacagga

SEQ ID NO: 85828 - DNA, 35 bp, Artificial Sequence
  Synthetic oligonucleotide
tgcactccccaatccctgtactaccttcgcccgga

SEQ ID NO: 85829 - DNA, 37 bp, Artificial Sequence
  Synthetic oligonucleotide
ttgacaaggtggatgggaaatgagaacgagtacggga

SEQ ID NO: 85830 - DNA, 37 bp, Artificial Sequence
  Synthetic oligonucleotide
ttagaccggcgtggatctcttgattgggggaatggga

SEQ ID NO: 85831 - DNA, 37 bp, Artificial Sequence
  Synthetic oligonucleotide
gggaagagcaacgacgataagaatggtaggggtggga

SEQ ID NO: 85832 - DNA, 38 bp, Artificial Sequence
  Synthetic oligonucleotide
accgccaacaccagctagccttgtgcggtatgtaatga

SEQ ID NO: 85833 - DNA, 38 bp, Artificial Sequence
  Synthetic oligonucleotide
taccagtcatcagagcgaaaacaaatggttcaagatga

SEQ ID NO: 85834 - DNA, 38 bp, Artificial Sequence
  Synthetic oligonucleotide
ttgggcgtaaaggggtaggggagatgatggttggatga

SEQ ID NO: 85835 - DNA, 38 bp, Artificial Sequence
  Synthetic oligonucleotide
atgggagggatgctgcgatgaacgagtgacgagtatga

SEQ ID NO: 85836 - DNA, 35 bp, Artificial Sequence
  Synthetic oligonucleotide
ggtcaccgcacgcaccccatagtggtacaccctga

SEQ ID NO: 85837 - DNA, 37 bp, Artificial Sequence
  Synthetic oligonucleotide
cccgacgcaggcttatacccaaagacccctgccctga

SEQ ID NO: 85838 - DNA, 38 bp, Artificial Sequence
  Synthetic oligonucleotide
gcggaacgggtttgactgcgcatccgtaccatccctga

SEQ ID NO: 85839 - DNA, 36 bp, Artificial Sequence
  Synthetic oligonucleotide
ttacccgtggccgacctgggtttgtctactccctga

SEQ ID NO: 85840 - DNA, 38 bp, Artificial Sequence
  Synthetic oligonucleotide
acacgtggcacgacacatgctcccgtgtttgttcctga

SEQ ID NO: 85841 - DNA, 38 bp, Artificial Sequence
  Synthetic oligonucleotide
acctggcaaccatcagttatgcatttatggctagctga

SEQ ID NO: 85842 - DNA, 38 bp, Artificial Sequence
  Synthetic oligonucleotide
tgaaagcacactttatgttactgaatcgcccctgctga

SEQ ID NO: 85843 - DNA, 38 bp, Artificial Sequence
  Synthetic oligonucleotide
tagccacccggtgctggtcaactatggaactcctctga

SEQ ID NO: 85844 - DNA, 38 bp, Artificial Sequence
  Synthetic oligonucleotide
taagcgcgctcacataccatcatctcgctatacagtga

SEQ ID NO: 85845 - DNA, 37 bp, Artificial Sequence
  Synthetic oligonucleotide
tacatctccacacgatctcaaaagactgcctgagtga

SEQ ID NO: 85846 - DNA, 37 bp, Artificial Sequence
  Synthetic oligonucleotide
tccaaccctaggtggcaacattcgacttaccccgtga

SEQ ID NO: 85847 - DNA, 38 bp, Artificial Sequence
  Synthetic oligonucleotide
tgacaccgtacccataagctctgcccgtgctgtcgtga

SEQ ID NO: 85848 - DNA, 38 bp, Artificial Sequence
  Synthetic oligonucleotide
tgaaacaaagacggaatgaactgtgagggcaggggtga

SEQ ID NO: 85849 - DNA, 38 bp, Artificial Sequence
  Synthetic oligonucleotide
ttgcctcctcccgctcttgcgaattcaacctctggtga

SEQ ID NO: 85850 - DNA, 38 bp, Artificial Sequence
  Synthetic oligonucleotide
gatggagtgtcaaagtcaagtaagataacgatgtgtga

SEQ ID NO: 85851 - DNA, 38 bp, Artificial Sequence
  Synthetic oligonucleotide
taccacagggcggtgaggataactggcgaaggaattga

SEQ ID NO: 85852 - DNA, 38 bp, Artificial Sequence
  Synthetic oligonucleotide
atgacccaagcgcatacttatcatctcacgacccttga

SEQ ID NO: 85853 - DNA, 38 bp, Artificial Sequence
  Synthetic oligonucleotide
attcagcaacctgattccatatgcaatacgccccttga

SEQ ID NO: 85854 - DNA, 37 bp, Artificial Sequence
  Synthetic oligonucleotide
gcctgaggccgtcgctccaccatccacgacacgttga

SEQ ID NO: 85855 - DNA, 37 bp, Artificial Sequence
  Synthetic oligonucleotide
tgcaagccccccccttacggtaaacaggcctggttga

SEQ ID NO: 85856 - DNA, 38 bp, Artificial Sequence
  Synthetic oligonucleotide
gtgggggcagacaaattgtggacatgtagggatgttga

SEQ ID NO: 85857 - DNA, 38 bp, Artificial Sequence
  Synthetic oligonucleotide
gcacagcgcacttttgatggatgctctctatcctttga

SEQ ID NO: 85858 - DNA, 36 bp, Artificial Sequence
  Synthetic oligonucleotide
agcatagcgctgggccatgccgctcacttcctttga

SEQ ID NO: 85859 - DNA, 36 bp, Artificial Sequence
  Synthetic oligonucleotide
tacttcctcccccacctgtgaaaaatgttgcacata

SEQ ID NO: 85860 - DNA, 36 bp, Artificial Sequence
  Synthetic oligonucleotide
aacaccttccacaagtgtagtcaatatacttgacta

SEQ ID NO: 85861 - DNA, 36 bp, Artificial Sequence
  Synthetic oligonucleotide
gttggggcgtgcgagctttcttgttggccctcccta

SEQ ID NO: 85862 - DNA, 35 bp, Artificial Sequence
  Synthetic oligonucleotide
gctgcttcgggcctctgttcagctcaatctgccta

SEQ ID NO: 85863 - DNA, 35 bp, Artificial Sequence
  Synthetic oligonucleotide
aaaccatccgactccagggcggccgtgaaccgcta

SEQ ID NO: 85864 - DNA, 35 bp, Artificial Sequence
  Synthetic oligonucleotide
gaatcgaggggagaggaaagaaccggcactgagta

SEQ ID NO: 85865 - DNA, 36 bp, Artificial Sequence
  Synthetic oligonucleotide
aacaaacgaaaaagggtgggtggatctaagcgggta

SEQ ID NO: 85866 - DNA, 36 bp, Artificial Sequence
  Synthetic oligonucleotide
acccgcccggtaactggttgatagcattcatctgta

SEQ ID NO: 85867 - DNA, 35 bp, Artificial Sequence
  Synthetic oligonucleotide
agacaatcgctcgccacctgcggctttcccgaaac

SEQ ID NO: 85868 - DNA, 35 bp, Artificial Sequence
  Synthetic oligonucleotide
gaagagccactcggctttagcatcctgagcaacac

SEQ ID NO: 85869 - DNA, 35 bp, Artificial Sequence
  Synthetic oligonucleotide
gtatcgcccggcacatcttccgtctccgccccgac

SEQ ID NO: 85870 - DNA, 35 bp, Artificial Sequence
  Synthetic oligonucleotide
gaacaggcatggtgcgattaggctcccctgaatac

SEQ ID NO: 85871 - DNA, 35 bp, Artificial Sequence
  Synthetic oligonucleotide
ttaacccgtctcttgtgcgtgcttacacatcctac

SEQ ID NO: 85872 - DNA, 35 bp, Artificial Sequence
  Synthetic oligonucleotide
gcaaccaatggtgctagtttggtctcttaccttac

SEQ ID NO: 85873 - DNA, 35 bp, Artificial Sequence
  Synthetic oligonucleotide
tgtctcgatccttcttgtggtccttgaccccttac

SEQ ID NO: 85874 - DNA, 35 bp, Artificial Sequence
  Synthetic oligonucleotide
acttccccgacgttagtgatcgtaccttttacacc

SEQ ID NO: 85875 - DNA, 35 bp, Artificial Sequence
  Synthetic oligonucleotide
aatatcgccgacactccctggccagtggttcaccc

SEQ ID NO: 85876 - DNA, 35 bp, Artificial Sequence
  Synthetic oligonucleotide
gtgcctcccggtcgtaaagaattttccttgccagc

SEQ ID NO: 85877 - DNA, 35 bp, Artificial Sequence
  Synthetic oligonucleotide
tccccacattgcaatgactgacttgcacccaacgc

SEQ ID NO: 85878 - DNA, 35 bp, Artificial Sequence
  Synthetic oligonucleotide
accagccccagctaactctaatgtggcatccacgc

SEQ ID NO: 85879 - DNA, 35 bp, Artificial Sequence
  Synthetic oligonucleotide
tagctcgggaaataaagatagacggaagacgaggc

SEQ ID NO: 85880 - DNA, 35 bp, Artificial Sequence
  Synthetic oligonucleotide
acatcccgatccgttagtgcctcactgctggcggc

SEQ ID NO: 85881 - DNA, 35 bp, Artificial Sequence
  Synthetic oligonucleotide
gaagtgtcggacaaaagggggatgattcgggtggc

SEQ ID NO: 85882 - DNA, 35 bp, Artificial Sequence
  Synthetic oligonucleotide
aatctgctggagcgcaatatcctctatttttatgc

SEQ ID NO: 85883 - DNA, 35 bp, Artificial Sequence
  Synthetic oligonucleotide
gcttgtccgctggcgacctacccctgaattcctgc

SEQ ID NO: 85884 - DNA, 35 bp, Artificial Sequence
  Synthetic oligonucleotide
gctgatcagaagaccaggaggaagtgcagggctgc

SEQ ID NO: 85885 - DNA, 35 bp, Artificial Sequence
  Synthetic oligonucleotide
gcactcgggtgatatggttgtgcttcacttgtatc

SEQ ID NO: 85886 - DNA, 35 bp, Artificial Sequence
  Synthetic oligonucleotide
aaccgggatgtctttagcatgcattcgcctcactc

SEQ ID NO: 85887 - DNA, 35 bp, Artificial Sequence
  Synthetic oligonucleotide
gcaccaccgcgatgggccgaaaggcctagcacctc

SEQ ID NO: 85888 - DNA, 35 bp, Artificial Sequence
  Synthetic oligonucleotide
tgttgtgacagtcgatgtctctccgccaccccgtc

SEQ ID NO: 85889 - DNA, 36 bp, Artificial Sequence
  Synthetic oligonucleotide
atctgcacccatcgaggcgcaatgcacaacccggtc

SEQ ID NO: 85890 - DNA, 35 bp, Artificial Sequence
  Synthetic oligonucleotide
atgttcgcgcgtgactgactgtttgcctcacgttc

SEQ ID NO: 85891 - DNA, 35 bp, Artificial Sequence
  Synthetic oligonucleotide
gatgacgccattttggggactctatctatcctttc

SEQ ID NO: 85892 - DNA, 35 bp, Artificial Sequence
  Synthetic oligonucleotide
gtggggggacgggagggggtggcaagaatgggtag

SEQ ID NO: 85893 - DNA, 35 bp, Artificial Sequence
  Synthetic oligonucleotide
acactactttgacggttaggccccgttcctaaacg

SEQ ID NO: 85894 - DNA, 35 bp, Artificial Sequence
  Synthetic oligonucleotide
atccatcatcgattgcctagacctggtcgagaacg

SEQ ID NO: 85895 - DNA, 35 bp, Artificial Sequence
  Synthetic oligonucleotide
atgacttcacatgtcccaacgtacatcccagaccg

SEQ ID NO: 85896 - DNA, 35 bp, Artificial Sequence
  Synthetic oligonucleotide
atcaggcccccgtaggcataactactacattcccg

SEQ ID NO: 85897 - DNA, 35 bp, Artificial Sequence
  Synthetic oligonucleotide
agtgaatgggaggaatgatgagagcgattagggcg

SEQ ID NO: 85898 - DNA, 35 bp, Artificial Sequence
  Synthetic oligonucleotide
tgcggatgggtctgccattgttcaaaattgtttcg

SEQ ID NO: 85899 - DNA, 35 bp, Artificial Sequence
  Synthetic oligonucleotide
agttgcctttgcctgttaacccccatccgtatggg

SEQ ID NO: 85900 - DNA, 35 bp, Artificial Sequence
  Synthetic oligonucleotide
attccgcccaccccgtgtccagatgccataacatg

SEQ ID NO: 85901 - DNA, 35 bp, Artificial Sequence
  Synthetic oligonucleotide
aaccccaccttattggccttcgctctgacgaactg

SEQ ID NO: 85902 - DNA, 35 bp, Artificial Sequence
  Synthetic oligonucleotide
gccgatagtcgggaggggacgaaaagggagtactg

SEQ ID NO: 85903 - DNA, 35 bp, Artificial Sequence
  Synthetic oligonucleotide
tcgcagacaccactgaaacttacccgccacgcctg

SEQ ID NO: 85904 - DNA, 35 bp, Artificial Sequence
  Synthetic oligonucleotide
ggactaggaacgagagggatacgggaggggtcgtg

SEQ ID NO: 85905 - DNA, 35 bp, Artificial Sequence
  Synthetic oligonucleotide
aatgggtgggttcgtaaggctaggtgacagttgtg

SEQ ID NO: 85906 - DNA, 34 bp, Artificial Sequence
  Synthetic oligonucleotide
tacaccataggctagcttgtcccatctattattg

SEQ ID NO: 85907 - DNA, 35 bp, Artificial Sequence
  Synthetic oligonucleotide
taccccacgtccgggccacgcattttcctgccttg

SEQ ID NO: 85908 - DNA, 35 bp, Artificial Sequence
  Synthetic oligonucleotide
gcctctgacctctgcctaacacagagaatgctttg

SEQ ID NO: 85909 - DNA, 35 bp, Artificial Sequence
  Synthetic oligonucleotide
gtccaacccaggtgcgctacgagtacgctctaaat

SEQ ID NO: 85910 - DNA, 35 bp, Artificial Sequence
  Synthetic oligonucleotide
tgtagaggttgacgaggaaggatggacaggggaat

SEQ ID NO: 85911 - DNA, 35 bp, Artificial Sequence
  Synthetic oligonucleotide
agacgtcgcgaacaaagctcatcatcaaccactat

SEQ ID NO: 85912 - DNA, 35 bp, Artificial Sequence
  Synthetic oligonucleotide
ttgtcacaccatcattgataacgcgtatcagctat

SEQ ID NO: 85913 - DNA, 36 bp, Artificial Sequence
  Synthetic oligonucleotide
gttacacacactcacagcacttttatgtgcctgtat

SEQ ID NO: 85914 - DNA, 35 bp, Artificial Sequence
  Synthetic oligonucleotide
tacctgcttacacactgatatcccatgctcaaact

SEQ ID NO: 85915 - DNA, 35 bp, Artificial Sequence
  Synthetic oligonucleotide
gtgtcccaacgtgctctacgtctataaccttaact

SEQ ID NO: 85916 - DNA, 35 bp, Artificial Sequence
  Synthetic oligonucleotide
tcgcccacaccgcaggtgaacttgtacatcgcact

SEQ ID NO: 85917 - DNA, 35 bp, Artificial Sequence
  Synthetic oligonucleotide
tttaggccccgcacttctatggttgcttcaccgct

SEQ ID NO: 85918 - DNA, 35 bp, Artificial Sequence
  Synthetic oligonucleotide
gttctgccgtccgttcttctgatatataacctcgt

SEQ ID NO: 85919 - DNA, 35 bp, Artificial Sequence
  Synthetic oligonucleotide
tagtagagaagtggcaaagtacacggcgaggatgt

SEQ ID NO: 85920 - DNA, 35 bp, Artificial Sequence
  Synthetic oligonucleotide
tgccaccacgggtctcgttctttgcactaaccatt

SEQ ID NO: 85921 - DNA, 35 bp, Artificial Sequence
  Synthetic oligonucleotide
gatggcccgatgaaggtggtgtgatcggtaggctt

SEQ ID NO: 85922 - DNA, 36 bp, Artificial Sequence
  Synthetic oligonucleotide
acaccttccgaccaattgatcgctttgagtttaaaa

SEQ ID NO: 85923 - DNA, 36 bp, Artificial Sequence
  Synthetic oligonucleotide
tccacatcagaatcctatgtattccaagccctgcaa

SEQ ID NO: 85924 - DNA, 35 bp, Artificial Sequence
  Synthetic oligonucleotide
gacaaaggtaggatcgggaccggggactctgagaa

SEQ ID NO: 85925 - DNA, 35 bp, Artificial Sequence
  Synthetic oligonucleotide
gacgtaggggaaagttggaacggggcaggttggaa

SEQ ID NO: 85926 - DNA, 36 bp, Artificial Sequence
  Synthetic oligonucleotide
gtcgcgtttggggaggggaaatcaatggagggataa

SEQ ID NO: 85927 - DNA, 36 bp, Artificial Sequence
  Synthetic oligonucleotide
tattcgcacgccggacctgcctgacaccaagtaaca

SEQ ID NO: 85928 - DNA, 36 bp, Artificial Sequence
  Synthetic oligonucleotide
gggggtagggagaaggaatgctgacacggcggtaca

SEQ ID NO: 85929 - DNA, 35 bp, Artificial Sequence
  Synthetic oligonucleotide
gtcgcatgagctgtgttgaaacctatgatccacca

SEQ ID NO: 85930 - DNA, 36 bp, Artificial Sequence
  Synthetic oligonucleotide
atccgctgaagcgctttttagatccgcattctacca

SEQ ID NO: 85931 - DNA, 36 bp, Artificial Sequence
  Synthetic oligonucleotide
gtgtgccatacggtgttgtccatgtaacgtcgccca

SEQ ID NO: 85932 - DNA, 36 bp, Artificial Sequence
  Synthetic oligonucleotide
tacatgccaacatgcgtgtttgaatttgccaatcca

SEQ ID NO: 85933 - DNA, 35 bp, Artificial Sequence
  Synthetic oligonucleotide
ggtgaaaacgtagggacgaacggtcacggcttcca

SEQ ID NO: 85934 - DNA, 36 bp, Artificial Sequence
  Synthetic oligonucleotide
tattgaacagcgtgacttgcaggtagccatcttcca

SEQ ID NO: 85935 - DNA, 36 bp, Artificial Sequence
  Synthetic oligonucleotide
gcgaagggccatgagcgaaataatatgtaagcagca

SEQ ID NO: 85936 - DNA, 35 bp, Artificial Sequence
  Synthetic oligonucleotide
tcgaactcgccgaccatccgcgtctacaaatagca

SEQ ID NO: 85937 - DNA, 36 bp, Artificial Sequence
  Synthetic oligonucleotide
tttagccaccactgaactccagagcttgacaatgca

SEQ ID NO: 85938 - DNA, 35 bp, Artificial Sequence
  Synthetic oligonucleotide
gctgcctacagcctgtccttttgaaactcaatgca

SEQ ID NO: 85939 - DNA, 36 bp, Artificial Sequence
  Synthetic oligonucleotide
tgcgctagcgtggatacgcctgctgcctgttcatca

SEQ ID NO: 85940 - DNA, 35 bp, Artificial Sequence
  Synthetic oligonucleotide
tattaaggaggaacacacggtagacagggcgatca

SEQ ID NO: 85941 - DNA, 36 bp, Artificial Sequence
  Synthetic oligonucleotide
tgagccgaaaggtctgaagagagcttgaggttatca

SEQ ID NO: 85942 - DNA, 36 bp, Artificial Sequence
  Synthetic oligonucleotide
gcacgagcagaactccccgatgccccacgaagctca

SEQ ID NO: 85943 - DNA, 36 bp, Artificial Sequence
  Synthetic oligonucleotide
tagtctccggcgcagtgtatctccacccgccagtca

SEQ ID NO: 85944 - DNA, 36 bp, Artificial Sequence
  Synthetic oligonucleotide
aggggggggggggaacagggatcgtgagacatgtca

SEQ ID NO: 85945 - DNA, 35 bp, Artificial Sequence
  Synthetic oligonucleotide
ttgcggaccgcccaccagtcccagtccaggcttca

SEQ ID NO: 85946 - DNA, 36 bp, Artificial Sequence
  Synthetic oligonucleotide
tgcattcgcagagttgggcgaactcgtcacctttca

SEQ ID NO: 85947 - DNA, 37 bp, Artificial Sequence
  Synthetic oligonucleotide
atggacacgaatcgctggtatcgctcccccatcaaga

SEQ ID NO: 85948 - DNA, 37 bp, Artificial Sequence
  Synthetic oligonucleotide
atacacgcacctccccgtatttgctagcttttcaaga

SEQ ID NO: 85949 - DNA, 37 bp, Artificial Sequence
  Synthetic oligonucleotide
gtcgcagagcgtatgggtgttgaggcgatggaagaga

SEQ ID NO: 85950 - DNA, 37 bp, Artificial Sequence
  Synthetic oligonucleotide
ggacctcacaggtgatcgccccctccccagttcgaga

SEQ ID NO: 85951 - DNA, 36 bp, Artificial Sequence
  Synthetic oligonucleotide
gtcgaacctcgccctatgctgaatcaatccctgaga

SEQ ID NO: 85952 - DNA, 37 bp, Artificial Sequence
  Synthetic oligonucleotide
tacccgacccaccatgttatcgcctggaacagtgaga

SEQ ID NO: 85953 - DNA, 37 bp, Artificial Sequence
  Synthetic oligonucleotide
gaagtcgggatgggaagacgggaaatggtggtataga

SEQ ID NO: 85954 - DNA, 35 bp, Artificial Sequence
  Synthetic oligonucleotide
atcatccggtgcctagcccgatcagtccttataga

SEQ ID NO: 85955 - DNA, 37 bp, Artificial Sequence
  Synthetic oligonucleotide
ggtgctctggcgccacgttaaaaatcgaccaaaacga

SEQ ID NO: 85956 - DNA, 36 bp, Artificial Sequence
  Synthetic oligonucleotide
taaaggggggggaaagcgagaaactgtggtagacga

SEQ ID NO: 85957 - DNA, 37 bp, Artificial Sequence
  Synthetic oligonucleotide
ggagaagcacatgctagatttgcctctatgtaaccga

SEQ ID NO: 85958 - DNA, 37 bp, Artificial Sequence
  Synthetic oligonucleotide
atgagcggaccgcagcgattgaatctactgcccccga

SEQ ID NO: 85959 - DNA, 37 bp, Artificial Sequence
  Synthetic oligonucleotide
tacactgcgctcgtcttagcaattgatatatctccga

SEQ ID NO: 85960 - DNA, 37 bp, Artificial Sequence
  Synthetic oligonucleotide
taccgcagggttggagcaggaagtaagggataggcga

SEQ ID NO: 85961 - DNA, 37 bp, Artificial Sequence
  Synthetic oligonucleotide
ttcgtaggcgcatggaagtgtgaacgggggagggcga

SEQ ID NO: 85962 - DNA, 37 bp, Artificial Sequence
  Synthetic oligonucleotide
ggaacacggtaggggctattactttcttcacatgcga

SEQ ID NO: 85963 - DNA, 35 bp, Artificial Sequence
  Synthetic oligonucleotide
gccgggtctgctgaacctatcactacttccatcga

SEQ ID NO: 85964 - DNA, 37 bp, Artificial Sequence
  Synthetic oligonucleotide
tgtacgcgtcctggacccgctcctaccacgaactcga

SEQ ID NO: 85965 - DNA, 37 bp, Artificial Sequence
  Synthetic oligonucleotide
gtgtaggaggtggtggaatagggatggctcaggtcga

SEQ ID NO: 85966 - DNA, 35 bp, Artificial Sequence
  Synthetic oligonucleotide
gacaccaaaactacttggaatactgacccattcga

SEQ ID NO: 85967 - DNA, 37 bp, Artificial Sequence
  Synthetic oligonucleotide
aaaggagcaggaagggtagcaaaatgctgatgacgga

SEQ ID NO: 85968 - DNA, 37 bp, Artificial Sequence
  Synthetic oligonucleotide
tgaacctgcttagccacccttgaaacaacagtccgga

SEQ ID NO: 85969 - DNA, 36 bp, Artificial Sequence
  Synthetic oligonucleotide
attgttacggaaacgggttaaggagtgaggggcgga

SEQ ID NO: 85970 - DNA, 36 bp, Artificial Sequence
  Synthetic oligonucleotide
ggaggagagggggagtatcatataggagcaccggga

SEQ ID NO: 85971 - DNA, 37 bp, Artificial Sequence
  Synthetic oligonucleotide
aacagagagcaaagcctgtggggtaggggactgtgga

SEQ ID NO: 85972 - DNA, 35 bp, Artificial Sequence
  Synthetic oligonucleotide
ttggactgcctgcttttcttaccattctggttgga

SEQ ID NO: 85973 - DNA, 37 bp, Artificial Sequence
  Synthetic oligonucleotide
ttagaggcgtaccacctatgcgtcccagaactttgga

SEQ ID NO: 85974 - DNA, 38 bp, Artificial Sequence
  Synthetic oligonucleotide
gtcggggggagcggtgggctagggatgaaaaagaatga

SEQ ID NO: 85975 - DNA, 36 bp, Artificial Sequence
  Synthetic oligonucleotide
tgatgccctggacctaaggttgcctgtacttaatga

SEQ ID NO: 85976 - DNA, 38 bp, Artificial Sequence
  Synthetic oligonucleotide
gacactacagtgcgaggggttggagcatttgaacatga

SEQ ID NO: 85977 - DNA, 37 bp, Artificial Sequence
  Synthetic oligonucleotide
tgaggtggtcggagaaatgtctggtgtgcagacatga

SEQ ID NO: 85978 - DNA, 37 bp, Artificial Sequence
  Synthetic oligonucleotide
tgcgaaagcctcaaggtgcttgatcctccatacatga

SEQ ID NO: 85979 - DNA, 37 bp, Artificial Sequence
  Synthetic oligonucleotide
gaacgcgcctgctctcagcccccgtcatgattcatga

SEQ ID NO: 85980 - DNA, 38 bp, Artificial Sequence
  Synthetic oligonucleotide
tccgacaactctccttcttgtatttcgtcctgagatga

SEQ ID NO: 85981 - DNA, 38 bp, Artificial Sequence
  Synthetic oligonucleotide
atgtgcaccttagctccacccccggtttgacagactga

SEQ ID NO: 85982 - DNA, 38 bp, Artificial Sequence
  Synthetic oligonucleotide
tacgcctgccaggtgttgcttccgttctttgcgactga

SEQ ID NO: 85983 - DNA, 38 bp, Artificial Sequence
  Synthetic oligonucleotide
gtgacgcctccatcttagcggggtacacgttttactga

SEQ ID NO: 85984 - DNA, 37 bp, Artificial Sequence
  Synthetic oligonucleotide
tatgagaagggccgagaaaacaaagggagtgacctga

SEQ ID NO: 85985 - DNA, 37 bp, Artificial Sequence
  Synthetic oligonucleotide
gcacacacagtcaaagaacaccacgtatcatacctga

SEQ ID NO: 85986 - DNA, 37 bp, Artificial Sequence
  Synthetic oligonucleotide
tgctgttgaactcgctgcacagacctcccactagtga

SEQ ID NO: 85987 - DNA, 37 bp, Artificial Sequence
  Synthetic oligonucleotide
ggagtgaagtatggagtgggggggagaggtgtagtga

SEQ ID NO: 85988 - DNA, 38 bp, Artificial Sequence
  Synthetic oligonucleotide
aagatctgctcaacactgctatgcccgctcctacgtga

SEQ ID NO: 85989 - DNA, 37 bp, Artificial Sequence
  Synthetic oligonucleotide
acgaccctatcccaatatgatttgagaattaccgtga

SEQ ID NO: 85990 - DNA, 37 bp, Artificial Sequence
  Synthetic oligonucleotide
tgtccaccacaattgaattacctgtcacaccatgtga

SEQ ID NO: 85991 - DNA, 37 bp, Artificial Sequence
  Synthetic oligonucleotide
tactctgcacccttgaatcacactgcccagcctgtga

SEQ ID NO: 85992 - DNA, 38 bp, Artificial Sequence
  Synthetic oligonucleotide
attcaccagtcagcctcctacgcgcgaaatccttgtga

SEQ ID NO: 85993 - DNA, 38 bp, Artificial Sequence
  Synthetic oligonucleotide
atagaggggaccggagtaggaagagggtaaggttgtga

SEQ ID NO: 85994 - DNA, 36 bp, Artificial Sequence
  Synthetic oligonucleotide
taccacggctcctctgtggccccgtctgtacattga

SEQ ID NO: 85995 - DNA, 37 bp, Artificial Sequence
  Synthetic oligonucleotide
tagtctcgccgcttccgcatctttttcatgtccttga

SEQ ID NO: 85996 - DNA, 38 bp, Artificial Sequence
  Synthetic oligonucleotide
aggacggagccgagagacggagaaaagtcatagcttga

SEQ ID NO: 85997 - DNA, 38 bp, Artificial Sequence
  Synthetic oligonucleotide
attgccgctggaactgtaccctctcgaatgccagttga

SEQ ID NO: 85998 - DNA, 37 bp, Artificial Sequence
  Synthetic oligonucleotide
gtaccctcgactagtaccgcatcacacattgagttga

SEQ ID NO: 85999 - DNA, 38 bp, Artificial Sequence
  Synthetic oligonucleotide
tcaaggtagaggtcactctgtgagggggctggggttga

SEQ ID NO: 86000 - DNA, 38 bp, Artificial Sequence
  Synthetic oligonucleotide
atcgcccacagcccctcttttatgcgtatttaatttga

SEQ ID NO: 86001 - DNA, 38 bp, Artificial Sequence
  Synthetic oligonucleotide
gcagttgccacccgttcgcgctactctggtacttttga

SEQ ID NO: 86002 - DNA, 36 bp, Artificial Sequence
  Synthetic oligonucleotide
gtagcacccacccatgtccctgtatatagcccgcta

SEQ ID NO: 86003 - DNA, 36 bp, Artificial Sequence
  Synthetic oligonucleotide
ttccatgtcgcgctcggtaatctttggaccttgcta

SEQ ID NO: 86004 - DNA, 35 bp, Artificial Sequence
  Synthetic oligonucleotide
gccacaagcctgcctttatttctactgcgaatcta

SEQ ID NO: 86005 - DNA, 36 bp, Artificial Sequence
  Synthetic oligonucleotide
gtcaccacctggaacggttcttacgcccggtttcta

SEQ ID NO: 86006 - DNA, 36 bp, Artificial Sequence
  Synthetic oligonucleotide
atgtctgttcgcatccaccacgtgataaacctagta

SEQ ID NO: 86007 - DNA, 36 bp, Artificial Sequence
  Synthetic oligonucleotide
ttgcgccccaatctttatgtcccgggtttcctatta

SEQ ID NO: 86008 - DNA, 36 bp, Artificial Sequence
  Synthetic oligonucleotide
gcagatacagtcatctgccggaaatgctgaacctta

SEQ ID NO: 86009 - DNA, 35 bp, Artificial Sequence
  Synthetic oligonucleotide
gtctgagcgctaccccttcggtatgtcccccctta

SEQ ID NO: 86010 - DNA, 36 bp, Artificial Sequence
  Synthetic oligonucleotide
gcaaacacgccagcattcgggtactaactgctctta

SEQ ID NO: 86011 - DNA, 36 bp, Artificial Sequence
  Synthetic oligonucleotide
tactgcacacggtcaatttgtctcccttcaacgtta

SEQ ID NO: 86012 - DNA, 35 bp, Artificial Sequence
  Synthetic oligonucleotide
tcaacgatccctcgcacatagagcccggcacttta

SEQ ID NO: 86013 - DNA, 34 bp, Artificial Sequence
  Synthetic oligonucleotide
gcctgcagccaccacacccctctcagtcatgcac

SEQ ID NO: 86014 - DNA, 35 bp, Artificial Sequence
  Synthetic oligonucleotide
gagcccggcatccgtatcactgcccctttcatgac

SEQ ID NO: 86015 - DNA, 35 bp, Artificial Sequence
  Synthetic oligonucleotide
gcccacacatcgttccgtcggtaacacaccctgac

SEQ ID NO: 86016 - DNA, 35 bp, Artificial Sequence
  Synthetic oligonucleotide
gcgagggtgggaggatgggaatggtgaccgctgac

SEQ ID NO: 86017 - DNA, 35 bp, Artificial Sequence
  Synthetic oligonucleotide
tcccaccagggtcatgtcattcactttcagcatac

SEQ ID NO: 86018 - DNA, 35 bp, Artificial Sequence
  Synthetic oligonucleotide
agcgcccgcctcaagtccgacggcttgttttctac

SEQ ID NO: 86019 - DNA, 35 bp, Artificial Sequence
  Synthetic oligonucleotide
atgttgctgatcgaccccaagtttgcggcccttac

SEQ ID NO: 86020 - DNA, 35 bp, Artificial Sequence
  Synthetic oligonucleotide
taccacatacctgtaacaccgtgtatgcgcacccc

SEQ ID NO: 86021 - DNA, 35 bp, Artificial Sequence
  Synthetic oligonucleotide
tattatcccgctctctgcctgttgctttatgcccc

SEQ ID NO: 86022 - DNA, 35 bp, Artificial Sequence
  Synthetic oligonucleotide
caaccactgccaccacaatataacaagacgccgcc

SEQ ID NO: 86023 - DNA, 35 bp, Artificial Sequence
  Synthetic oligonucleotide
gtgtcccctatatgcctaatgccgggccgcattcc

SEQ ID NO: 86024 - DNA, 35 bp, Artificial Sequence
  Synthetic oligonucleotide
gcacgtgagagcctcttaaaggtggcgctatttcc

SEQ ID NO: 86025 - DNA, 35 bp, Artificial Sequence
  Synthetic oligonucleotide
gacagtttacagcatccgcacacacattgcctcgc

SEQ ID NO: 86026 - DNA, 35 bp, Artificial Sequence
  Synthetic oligonucleotide
gtcacctcctggtttttctcaaggggttcttgctc

SEQ ID NO: 86027 - DNA, 35 bp, Artificial Sequence
  Synthetic oligonucleotide
tcccataccagcagtatttggtcgttctcggattc

SEQ ID NO: 86028 - DNA, 35 bp, Artificial Sequence
  Synthetic oligonucleotide
tagtcacgcacagctctatccggtttttatttcag

SEQ ID NO: 86029 - DNA, 35 bp, Artificial Sequence
  Synthetic oligonucleotide
taagcgtggtggcgaaagtgagtgcatgggagggg

SEQ ID NO: 86030 - DNA, 35 bp, Artificial Sequence
  Synthetic oligonucleotide
aactcgtgtcggaggcggggttccacaaagggggg

SEQ ID NO: 86031 - DNA, 35 bp, Artificial Sequence
  Synthetic oligonucleotide
tttcacacgcggattccgatgatttgttcaactgg

SEQ ID NO: 86032 - DNA, 34 bp, Artificial Sequence
  Synthetic oligonucleotide
gtcctaactgtaacaccgctccatcatatctatg

SEQ ID NO: 86033 - DNA, 35 bp, Artificial Sequence
  Synthetic oligonucleotide
tcagtcgtagaagggcgaattccctgtctctcctg

SEQ ID NO: 86034 - DNA, 34 bp, Artificial Sequence
  Synthetic oligonucleotide
cagttcatcaccgcaaatcgccgccggactccat

SEQ ID NO: 86035 - DNA, 35 bp, Artificial Sequence
  Synthetic oligonucleotide
acgacacattagcttctgacagttcccccctccat

SEQ ID NO: 86036 - DNA, 35 bp, Artificial Sequence
  Synthetic oligonucleotide
gtatgccagttcgtcgacttcctactttggttcat

SEQ ID NO: 86037 - DNA, 34 bp, Artificial Sequence
  Synthetic oligonucleotide
ttgccgacctgattctggtcacgggccccccact

SEQ ID NO: 86038 - DNA, 35 bp, Artificial Sequence
  Synthetic oligonucleotide
tgagagggacagactgcttcttggccgtgcaacct

SEQ ID NO: 86039 - DNA, 36 bp, Artificial Sequence
  Synthetic oligonucleotide
tagtatcgcaagcatttaatcgcgcttcgggtccct

SEQ ID NO: 86040 - DNA, 35 bp, Artificial Sequence
  Synthetic oligonucleotide
agtgttgctgcggacgtagacccctttactatcct

SEQ ID NO: 86041 - DNA, 35 bp, Artificial Sequence
  Synthetic oligonucleotide
gtgcgggtgaagggagagtgggtggacgcgtgggt

SEQ ID NO: 86042 - DNA, 35 bp, Artificial Sequence
  Synthetic oligonucleotide
tccactactccctggtgcgcgtatacgtgcctggt

SEQ ID NO: 86043 - DNA, 35 bp, Artificial Sequence
  Synthetic oligonucleotide
aactcccgccgtggtcgtggccaacaataggtggt

SEQ ID NO: 86044 - DNA, 35 bp, Artificial Sequence
  Synthetic oligonucleotide
acttgccctgtctcgctcttcgcccgagtcactgt

SEQ ID NO: 86045 - DNA, 35 bp, Artificial Sequence
  Synthetic oligonucleotide
ttaggcctgccggggtacttggcgctccttttatt

SEQ ID NO: 86046 - DNA, 35 bp, Artificial Sequence
  Synthetic oligonucleotide
acaacattgacgaggccgagagctggacgctcctt

SEQ ID NO: 86047 - DNA, 35 bp, Artificial Sequence
  Synthetic oligonucleotide
actaactgtcgctgactccctgaatcacctttctt

SEQ ID NO: 86048 - DNA, 36 bp, Artificial Sequence
  Synthetic oligonucleotide
aaccatgctgaccactgtcgagcctctttatcaaaa

SEQ ID NO: 86049 - DNA, 34 bp, Artificial Sequence
  Synthetic oligonucleotide
gagtcgcagggggaccaagtgtgtggggttcaaa

SEQ ID NO: 86050 - DNA, 36 bp, Artificial Sequence
  Synthetic oligonucleotide
gattacagcgcgggtccatgatatggcgctggtaaa

SEQ ID NO: 86051 - DNA, 35 bp, Artificial Sequence
  Synthetic oligonucleotide
gacacgcccttttatgccggcacggttcactccaa

SEQ ID NO: 86052 - DNA, 36 bp, Artificial Sequence
  Synthetic oligonucleotide
gtaacggaaggtggggactggggagggcgggaagaa

SEQ ID NO: 86053 - DNA, 36 bp, Artificial Sequence
  Synthetic oligonucleotide
ttgaaccccgtcgctgcaactacataatacgccgaa

SEQ ID NO: 86054 - DNA, 35 bp, Artificial Sequence
  Synthetic oligonucleotide
attgccgtgcagatcactctgtcgctccgttttaa

SEQ ID NO: 86055 - DNA, 35 bp, Artificial Sequence
  Synthetic oligonucleotide
gtgactccagtacaccagtttgtgcatacacaaca

SEQ ID NO: 86056 - DNA, 35 bp, Artificial Sequence
  Synthetic oligonucleotide
ttgcttccctcctggtatccctgcatctgacaaca

SEQ ID NO: 86057 - DNA, 36 bp, Artificial Sequence
  Synthetic oligonucleotide
agcccggcaatgcatctttcgttcggctactacaca

SEQ ID NO: 86058 - DNA, 36 bp, Artificial Sequence
  Synthetic oligonucleotide
tgtggtgcacctggaaatacccttgacatacctcca

SEQ ID NO: 86059 - DNA, 36 bp, Artificial Sequence
  Synthetic oligonucleotide
gtccccgcgacgggaatcgcacagatctcttctcca

SEQ ID NO: 86060 - DNA, 35 bp, Artificial Sequence
  Synthetic oligonucleotide
tcaacgctactgagccattagcaggctaacttcca

SEQ ID NO: 86061 - DNA, 36 bp, Artificial Sequence
  Synthetic oligonucleotide
tgctctgcccttgcccttgccctcgcgccgtttcca

SEQ ID NO: 86062 - DNA, 35 bp, Artificial Sequence
  Synthetic oligonucleotide
tgagccgacgcatctacgcacaatatggtttcgca

SEQ ID NO: 86063 - DNA, 36 bp, Artificial Sequence
  Synthetic oligonucleotide
tccgcctcctccgatacttcgcattttatgcttgca

SEQ ID NO: 86064 - DNA, 36 bp, Artificial Sequence
  Synthetic oligonucleotide
gccgagcgtaatcgctgtggctgaatcaccccatca

SEQ ID NO: 86065 - DNA, 36 bp, Artificial Sequence
  Synthetic oligonucleotide
atgcccagtggtaatcgttcctgccagcgcctatca

SEQ ID NO: 86066 - DNA, 36 bp, Artificial Sequence
  Synthetic oligonucleotide
ataatgccaccccagacttacatattgtccagctca

SEQ ID NO: 86067 - DNA, 36 bp, Artificial Sequence
  Synthetic oligonucleotide
tctatgccccagcacccacgccagctcaagccttca

SEQ ID NO: 86068 - DNA, 35 bp, Artificial Sequence
  Synthetic oligonucleotide
gtggggctggtcctggctgtctagttttatcttca

SEQ ID NO: 86069 - DNA, 37 bp, Artificial Sequence
  Synthetic oligonucleotide
agacaaaatgccctgctcttataggtaacaccagaga

SEQ ID NO: 86070 - DNA, 36 bp, Artificial Sequence
  Synthetic oligonucleotide
ggaccccgccaccctagtcacgtccgtcagtagaga

SEQ ID NO: 86071 - DNA, 37 bp, Artificial Sequence
  Synthetic oligonucleotide
accgccaccatttgccgaaactggactgacatgtaga

SEQ ID NO: 86072 - DNA, 37 bp, Artificial Sequence
  Synthetic oligonucleotide
gtcagcaagcttccttagtttaaccccactgccccga

SEQ ID NO: 86073 - DNA, 37 bp, Artificial Sequence
  Synthetic oligonucleotide
agcgcgctcattgtactctccgccgaacgccgcccga

SEQ ID NO: 86074 - DNA, 37 bp, Artificial Sequence
  Synthetic oligonucleotide
ccacaactacctaccaccacgaggacacgttctccga

SEQ ID NO: 86075 - DNA, 36 bp, Artificial Sequence
  Synthetic oligonucleotide
gagggcgtcgcgcgcgatccttactcccgtttccga

SEQ ID NO: 86076 - DNA, 36 bp, Artificial Sequence
  Synthetic oligonucleotide
agctcaccccagcgtgcttcatgttaccctaatcga

SEQ ID NO: 86077 - DNA, 37 bp, Artificial Sequence
  Synthetic oligonucleotide
gcgactgccgcacggctttacgcacttcgtctctcga

SEQ ID NO: 86078 - DNA, 37 bp, Artificial Sequence
  Synthetic oligonucleotide
gaccctccgacgtccgctgatacagcgttcttctcga

SEQ ID NO: 86079 - DNA, 37 bp, Artificial Sequence
  Synthetic oligonucleotide
ttcgaacgggtgggttggttagctcgctaggagagga

SEQ ID NO: 86080 - DNA, 35 bp, Artificial Sequence
  Synthetic oligonucleotide
gtgagatcgcaggggggggcattggcggttgagga

SEQ ID NO: 86081 - DNA, 37 bp, Artificial Sequence
  Synthetic oligonucleotide
ttccgcgccgccaacttgcaagcttcgtcccgtagga

SEQ ID NO: 86082 - DNA, 37 bp, Artificial Sequence
  Synthetic oligonucleotide
gagccggctacctccagcaatgacaccttcgcacgga

SEQ ID NO: 86083 - DNA, 37 bp, Artificial Sequence
  Synthetic oligonucleotide
ttcggagcaccatctctgccccggttgcctttacgga

SEQ ID NO: 86084 - DNA, 37 bp, Artificial Sequence
  Synthetic oligonucleotide
gggtgccgaggaggaacgatgatagttccgggaggga

SEQ ID NO: 86085 - DNA, 37 bp, Artificial Sequence
  Synthetic oligonucleotide
attcggagggcgcaagaagggctggaattgcgcggga

SEQ ID NO: 86086 - DNA, 36 bp, Artificial Sequence
  Synthetic oligonucleotide
actcaggagacggatggctactcaggaagcagggga

SEQ ID NO: 86087 - DNA, 37 bp, Artificial Sequence
  Synthetic oligonucleotide
tagaccatcgcgcttgttgccgtctaagcaacgggga

SEQ ID NO: 86088 - DNA, 37 bp, Artificial Sequence
  Synthetic oligonucleotide
gattgcaagccgcaatggggacggggtgcggatggga

SEQ ID NO: 86089 - DNA, 36 bp, Artificial Sequence
  Synthetic oligonucleotide
tcgcgccacctgggtcaccttaatacgccgcttgga

SEQ ID NO: 86090 - DNA, 37 bp, Artificial Sequence
  Synthetic oligonucleotide
gactgcgagcataggggtagatatgtgtgcgaaatga

SEQ ID NO: 86091 - DNA, 37 bp, Artificial Sequence
  Synthetic oligonucleotide
gatggggtatggaggttggggttagatggcagaatga

SEQ ID NO: 86092 - DNA, 38 bp, Artificial Sequence
  Synthetic oligonucleotide
tccgagcagtgaccgcgacaaccgaccacattccatga

SEQ ID NO: 86093 - DNA, 38 bp, Artificial Sequence
  Synthetic oligonucleotide
gaggagcaacctgtccgctatattgttccccggtatga

SEQ ID NO: 86094 - DNA, 37 bp, Artificial Sequence
  Synthetic oligonucleotide
gcacccctgcacttcaagccatacaggtcatttatga

SEQ ID NO: 86095 - DNA, 38 bp, Artificial Sequence
  Synthetic oligonucleotide
tctactgcgaagcatcgttgctgtaaactcctcactga

SEQ ID NO: 86096 - DNA, 37 bp, Artificial Sequence
  Synthetic oligonucleotide
aaagtgcacacgacgggaatccgctacaccaacctga

SEQ ID NO: 86097 - DNA, 36 bp, Artificial Sequence
  Synthetic oligonucleotide
acggtggccatacacgatctcatgcgcctcacctga

SEQ ID NO: 86098 - DNA, 37 bp, Artificial Sequence
  Synthetic oligonucleotide
gtcacggtggccacccgtttttgagctcaacccctga

SEQ ID NO: 86099 - DNA, 38 bp, Artificial Sequence
  Synthetic oligonucleotide
aacgcccgcgtgcacccaagccgatacaaacttcctga

SEQ ID NO: 86100 - DNA, 38 bp, Artificial Sequence
  Synthetic oligonucleotide
gtcagagtaggagagggcagggacgcaggtcaagctga

SEQ ID NO: 86101 - DNA, 38 bp, Artificial Sequence
  Synthetic oligonucleotide
aatcaccccgacggacattcagcttacagtacgtctga

SEQ ID NO: 86102 - DNA, 38 bp, Artificial Sequence
  Synthetic oligonucleotide
atggggcgtaaaggaggtaaggagcggacgatgcgtga

SEQ ID NO: 86103 - DNA, 38 bp, Artificial Sequence
  Synthetic oligonucleotide
accgcgaactagctgttggttttcttgaatttgggtga

SEQ ID NO: 86104 - DNA, 38 bp, Artificial Sequence
  Synthetic oligonucleotide
gtgtcaccccctgctttccactttgtgataacttgtga

SEQ ID NO: 86105 - DNA, 38 bp, Artificial Sequence
  Synthetic oligonucleotide
gccccgacccgagctctttgcagcatcctcccttgtga

SEQ ID NO: 86106 - DNA, 36 bp, Artificial Sequence
  Synthetic oligonucleotide
cacaaccacagcattatcgtaatgtccaccacttga

SEQ ID NO: 86107 - DNA, 38 bp, Artificial Sequence
  Synthetic oligonucleotide
agcacaacatatcaataccttcactgtccctgtcttga

SEQ ID NO: 86108 - DNA, 38 bp, Artificial Sequence
  Synthetic oligonucleotide
atcgaccaccttccattccaactcgtgaaacacgttga

SEQ ID NO: 86109 - DNA, 38 bp, Artificial Sequence
  Synthetic oligonucleotide
actcagggcgaataagtgcataggtgggagggggttga

SEQ ID NO: 86110 - DNA, 38 bp, Artificial Sequence
  Synthetic oligonucleotide
tctcgcacctctatcatagaaatttcctccgtgtttga

SEQ ID NO: 86111 - DNA, 38 bp, Artificial Sequence
  Synthetic oligonucleotide
ggtcggaacaggtatgttgcgcaccctaccatttttga

SEQ ID NO: 86112 - DNA, 36 bp, Artificial Sequence
  Synthetic oligonucleotide
atagcgtactggtcctcataacaactgctgcaaata

SEQ ID NO: 86113 - DNA, 36 bp, Artificial Sequence
  Synthetic oligonucleotide
gcgacccacgtcattcgcaccttctcatacctcata

SEQ ID NO: 86114 - DNA, 36 bp, Artificial Sequence
  Synthetic oligonucleotide
tgtgtatagcaccactttttccttgcgcaaccgata

SEQ ID NO: 86115 - DNA, 36 bp, Artificial Sequence
  Synthetic oligonucleotide
accctgaggagcgggtgggaggggtaggaggaccta

SEQ ID NO: 86116 - DNA, 35 bp, Artificial Sequence
  Synthetic oligonucleotide
aacacaggggaaatttagccggagtaggattgcta

SEQ ID NO: 86117 - DNA, 36 bp, Artificial Sequence
  Synthetic oligonucleotide
acaccacctcaggagccggatacctcttaggcggta

SEQ ID NO: 86118 - DNA, 36 bp, Artificial Sequence
  Synthetic oligonucleotide
ttcacccagcgccctcagaaatgaactctgcctgta

SEQ ID NO: 86119 - DNA, 36 bp, Artificial Sequence
  Synthetic oligonucleotide
ataacgagggtgggagatcgaaaggtgtagagtgta

SEQ ID NO: 86120 - DNA, 35 bp, Artificial Sequence
  Synthetic oligonucleotide
gagcggggacaactaggacagatcgccgaggatta

SEQ ID NO: 86121 - DNA, 36 bp, Artificial Sequence
  Synthetic oligonucleotide
gacagtcgggggtcggttttggcgggttagtgttta

SEQ ID NO: 86122 - DNA, 36 bp, Artificial Sequence
  Synthetic oligonucleotide
gagccacgcacgattccggcttgacctcaattttta

SEQ ID NO: 86123 - DNA, 35 bp, Artificial Sequence
  Synthetic oligonucleotide
tatgagcgacgggccactcaatttccgtgatccac

SEQ ID NO: 86124 - DNA, 35 bp, Artificial Sequence
  Synthetic oligonucleotide
agtccggttcaattctgtcaactagctacctctac

SEQ ID NO: 86125 - DNA, 35 bp, Artificial Sequence
  Synthetic oligonucleotide
gagcgtgatccctgcaaaccggcttacgaccttac

SEQ ID NO: 86126 - DNA, 35 bp, Artificial Sequence
  Synthetic oligonucleotide
agcggacgacaccgcgttcgagcacccagtccacc

SEQ ID NO: 86127 - DNA, 35 bp, Artificial Sequence
  Synthetic oligonucleotide
gacatgtcgctagcaaccaaagactaacgttcccc

SEQ ID NO: 86128 - DNA, 35 bp, Artificial Sequence
  Synthetic oligonucleotide
gccatgatctggacttgacgcttcgtaatcctccc

SEQ ID NO: 86129 - DNA, 35 bp, Artificial Sequence
  Synthetic oligonucleotide
gcaccccaacatgatccgcttctgctgccagtccc

SEQ ID NO: 86130 - DNA, 35 bp, Artificial Sequence
  Synthetic oligonucleotide
gcgttgatctgcactctatctgtttaccgaagtcc

SEQ ID NO: 86131 - DNA, 35 bp, Artificial Sequence
  Synthetic oligonucleotide
acacggtgtagcaatcgtcgacccccgccctttcc

SEQ ID NO: 86132 - DNA, 35 bp, Artificial Sequence
  Synthetic oligonucleotide
agaagcagggccctgtacacgcaccactacccagc

SEQ ID NO: 86133 - DNA, 35 bp, Artificial Sequence
  Synthetic oligonucleotide
ggacctcctcctccatccatcatagtcaagggagc

SEQ ID NO: 86134 - DNA, 35 bp, Artificial Sequence
  Synthetic oligonucleotide
gttgcgatcgaagcaagattaaaaacccgccactc

SEQ ID NO: 86135 - DNA, 35 bp, Artificial Sequence
  Synthetic oligonucleotide
tcatacgctatgcgggcccaacttgtcgttcactc

SEQ ID NO: 86136 - DNA, 35 bp, Artificial Sequence
  Synthetic oligonucleotide
tcgcgtagcctcacacctttcctttcgtccagctc

SEQ ID NO: 86137 - DNA, 35 bp, Artificial Sequence
  Synthetic oligonucleotide
tctctgggcctcaagtttttcttcacacgtttctc

SEQ ID NO: 86138 - DNA, 35 bp, Artificial Sequence
  Synthetic oligonucleotide
taagcacattggcggatcaagcccactaacctgtc

SEQ ID NO: 86139 - DNA, 36 bp, Artificial Sequence
  Synthetic oligonucleotide
acagtcacgcacacgttagacttccaacatctcttc

SEQ ID NO: 86140 - DNA, 35 bp, Artificial Sequence
  Synthetic oligonucleotide
gctgccatccggactctggctacttgagctgtttc

SEQ ID NO: 86141 - DNA, 35 bp, Artificial Sequence
  Synthetic oligonucleotide
gtgtggggacgagcgagaaggaagttcaattgcag

SEQ ID NO: 86142 - DNA, 35 bp, Artificial Sequence
  Synthetic oligonucleotide
tcagctcgccgcctcgacccaacggatcttccacg

SEQ ID NO: 86143 - DNA, 35 bp, Artificial Sequence
  Synthetic oligonucleotide
tatacccacatcacataattaagccgcgcacgacg

SEQ ID NO: 86144 - DNA, 35 bp, Artificial Sequence
  Synthetic oligonucleotide
tcgtcgtacgatggtacggaacctctatgccctcg

SEQ ID NO: 86145 - DNA, 35 bp, Artificial Sequence
  Synthetic oligonucleotide
taggtcgttcgcccgttcgccctggtattgattcg

SEQ ID NO: 86146 - DNA, 35 bp, Artificial Sequence
  Synthetic oligonucleotide
gccgttgggccccgataccgccatcttcctgttcg

SEQ ID NO: 86147 - DNA, 35 bp, Artificial Sequence
  Synthetic oligonucleotide
gacgtgggctatggggattagggagtgacgagagg

SEQ ID NO: 86148 - DNA, 35 bp, Artificial Sequence
  Synthetic oligonucleotide
gtgttgaccgagcttgttatggggggttgttgagg

SEQ ID NO: 86149 - DNA, 35 bp, Artificial Sequence
  Synthetic oligonucleotide
gacgcgtacgaggttgttgggtgggatgggaccgg

SEQ ID NO: 86150 - DNA, 35 bp, Artificial Sequence
  Synthetic oligonucleotide
tatacagagcaagacgtaaagaagggcggttaggg

SEQ ID NO: 86151 - DNA, 35 bp, Artificial Sequence
  Synthetic oligonucleotide
gacaccgcttgcacttgccaccgctcctttattgg

SEQ ID NO: 86152 - DNA, 35 bp, Artificial Sequence
  Synthetic oligonucleotide
gacgcccgccgcccgtgccatggtcttgtcacctg

SEQ ID NO: 86153 - DNA, 35 bp, Artificial Sequence
  Synthetic oligonucleotide
tatccgtacggatgcacgcactgagcgccttcctg

SEQ ID NO: 86154 - DNA, 35 bp, Artificial Sequence
  Synthetic oligonucleotide
gtgaagcactggaataacacaaaagaagacagctg

SEQ ID NO: 86155 - DNA, 35 bp, Artificial Sequence
  Synthetic oligonucleotide
tgaaacgtacgcacggtggtttaatatgtgtgctg

SEQ ID NO: 86156 - DNA, 35 bp, Artificial Sequence
  Synthetic oligonucleotide
gccatgcgtgactctatgagcaaccgtgatctctg

SEQ ID NO: 86157 - DNA, 35 bp, Artificial Sequence
  Synthetic oligonucleotide
atatcgcgcgtgtctcccaaccccattccctgttg

SEQ ID NO: 86158 - DNA, 35 bp, Artificial Sequence
  Synthetic oligonucleotide
atcgaactttctccccggtgccattattagctttg

SEQ ID NO: 86159 - DNA, 35 bp, Artificial Sequence
  Synthetic oligonucleotide
atgcccgccctacatcggttccctcgttcgttaat

SEQ ID NO: 86160 - DNA, 35 bp, Artificial Sequence
  Synthetic oligonucleotide
tcgccccccggtgtttccacggcagtttctttcat

SEQ ID NO: 86161 - DNA, 35 bp, Artificial Sequence
  Synthetic oligonucleotide
atcccagctccgccctgtcacattatgctcccgat

SEQ ID NO: 86162 - DNA, 35 bp, Artificial Sequence
  Synthetic oligonucleotide
atccagacgcgacgatacacactgcgttcatttat

SEQ ID NO: 86163 - DNA, 35 bp, Artificial Sequence
  Synthetic oligonucleotide
agcgatgcaaactctataacgcgccttgccacact

SEQ ID NO: 86164 - DNA, 35 bp, Artificial Sequence
  Synthetic oligonucleotide
acaccttgtgtagtttgtcaaatacagttgcccct

SEQ ID NO: 86165 - DNA, 35 bp, Artificial Sequence
  Synthetic oligonucleotide
gagcgactcggtgagtcctttcatacacacagcct

SEQ ID NO: 86166 - DNA, 35 bp, Artificial Sequence
  Synthetic oligonucleotide
aatgcatgaaggaacagcgtttgacctcccccgct

SEQ ID NO: 86167 - DNA, 35 bp, Artificial Sequence
  Synthetic oligonucleotide
ttgcctagctcgcctactcgtgttttttctcctct

SEQ ID NO: 86168 - DNA, 35 bp, Artificial Sequence
  Synthetic oligonucleotide
tagccccctcgcaacggacatttttcgtttgttct

SEQ ID NO: 86169 - DNA, 35 bp, Artificial Sequence
  Synthetic oligonucleotide
gatgtcgtgacccgtttccatcacccgaccgaggt

SEQ ID NO: 86170 - DNA, 35 bp, Artificial Sequence
  Synthetic oligonucleotide
atccgtccctgcgcacaaaccacgccgtcttaggt

SEQ ID NO: 86171 - DNA, 35 bp, Artificial Sequence
  Synthetic oligonucleotide
tgcgtggggggctagtgggggtcgtatttccctgt

SEQ ID NO: 86172 - DNA, 35 bp, Artificial Sequence
  Synthetic oligonucleotide
tgcactcacgcaccaatgggccggaattcttttgt

SEQ ID NO: 86173 - DNA, 35 bp, Artificial Sequence
  Synthetic oligonucleotide
acctcctcactgtcgacgattcactacggtgaatt

SEQ ID NO: 86174 - DNA, 35 bp, Artificial Sequence
  Synthetic oligonucleotide
tcacgccgtcggggacaagatttaatggatgattt

SEQ ID NO: 86175 - DNA, 35 bp, Artificial Sequence
  Synthetic oligonucleotide
ttacccttactgtccttggacgggatttcttgttt

SEQ ID NO: 86176 - DNA, 36 bp, Artificial Sequence
  Synthetic oligonucleotide
tcgacccacgttccatgcaattgtactgcttccaaa

SEQ ID NO: 86177 - DNA, 36 bp, Artificial Sequence
  Synthetic oligonucleotide
atccccccccacagcccgtatggcaggatttctaaa

SEQ ID NO: 86178 - DNA, 36 bp, Artificial Sequence
  Synthetic oligonucleotide
agacccgcctatgccgcgatctccgttattcaacaa

SEQ ID NO: 86179 - DNA, 36 bp, Artificial Sequence
  Synthetic oligonucleotide
gacagacgagccgaatggaacaccttaatttgacaa

SEQ ID NO: 86180 - DNA, 36 bp, Artificial Sequence
  Synthetic oligonucleotide
agacacaggagaaggttaacgatgagatcgcgccaa

SEQ ID NO: 86181 - DNA, 36 bp, Artificial Sequence
  Synthetic oligonucleotide
aaccagtcgcacatattctacccagacaatcagcaa

SEQ ID NO: 86182 - DNA, 36 bp, Artificial Sequence
  Synthetic oligonucleotide
accaaccccgcccatcccgtgatagggacgcatcaa

SEQ ID NO: 86183 - DNA, 34 bp, Artificial Sequence
  Synthetic oligonucleotide
actccatccccaaaactgccgtacagatggtcaa

SEQ ID NO: 86184 - DNA, 36 bp, Artificial Sequence
  Synthetic oligonucleotide
gtccggaatgctatgcatttcgtatagttccttcaa

SEQ ID NO: 86185 - DNA, 36 bp, Artificial Sequence
  Synthetic oligonucleotide
tgcacccgcgcagcggcttccagtacacacaccgaa

SEQ ID NO: 86186 - DNA, 35 bp, Artificial Sequence
  Synthetic oligonucleotide
gcgtgagccagcacaggctacactctctatcgtaa

SEQ ID NO: 86187 - DNA, 35 bp, Artificial Sequence
  Synthetic oligonucleotide
gtgggacgagagcgtaaaaaggggaaggtataaca

SEQ ID NO: 86188 - DNA, 36 bp, Artificial Sequence
  Synthetic oligonucleotide
tctgggcgaggtcggtgaggtggtggggggagcaca

SEQ ID NO: 86189 - DNA, 36 bp, Artificial Sequence
  Synthetic oligonucleotide
acacactcatgagacaggcccatcagacactgtaca

SEQ ID NO: 86190 - DNA, 36 bp, Artificial Sequence
  Synthetic oligonucleotide
tcagtccccgccgactacatcatccgaacgctacca

SEQ ID NO: 86191 - DNA, 35 bp, Artificial Sequence
  Synthetic oligonucleotide
tgctttgtcccgcctgactttatctctcgagccca

SEQ ID NO: 86192 - DNA, 36 bp, Artificial Sequence
  Synthetic oligonucleotide
gggtgcacgcactgtttcccccactatttggagcca

SEQ ID NO: 86193 - DNA, 36 bp, Artificial Sequence
  Synthetic oligonucleotide
aacgagcccacattacctggtgatccactacacgca

SEQ ID NO: 86194 - DNA, 36 bp, Artificial Sequence
  Synthetic oligonucleotide
gttgtgacgtagggggaataaatctaggtggtcgca

SEQ ID NO: 86195 - DNA, 36 bp, Artificial Sequence
  Synthetic oligonucleotide
gccccctgcttatagcgcccttgtccgttcatggca

SEQ ID NO: 86196 - DNA, 36 bp, Artificial Sequence
  Synthetic oligonucleotide
tccacgccgatgtagttggggttctttcgtgtggca

SEQ ID NO: 86197 - DNA, 35 bp, Artificial Sequence
  Synthetic oligonucleotide
ggaaccgttagagccgcgtttctcatctgtctgca

SEQ ID NO: 86198 - DNA, 36 bp, Artificial Sequence
  Synthetic oligonucleotide
gtgcggggcacggattgcggtagggatgggcgtgca

SEQ ID NO: 86199 - DNA, 36 bp, Artificial Sequence
  Synthetic oligonucleotide
aacggacaggttggtacgtccttcttctccgttgca

SEQ ID NO: 86200 - DNA, 38 bp, Artificial Sequence
  Synthetic oligonucleotide
atgcccccgcaactgctcccctctgtccatcttgatca

SEQ ID NO: 86201 - DNA, 36 bp, Artificial Sequence
  Synthetic oligonucleotide
tggtgcactgttcgctcactctctctatcgtactca

SEQ ID NO: 86202 - DNA, 36 bp, Artificial Sequence
  Synthetic oligonucleotide
actgccgcccatcaccgtttaaagtccattgggtca

SEQ ID NO: 86203 - DNA, 36 bp, Artificial Sequence
  Synthetic oligonucleotide
tttgccgcgcaaatccttgggggcctacatcattca

SEQ ID NO: 86204 - DNA, 37 bp, Artificial Sequence
  Synthetic oligonucleotide
tatccgctgtgccgctgcgcctatctacaattccaga

SEQ ID NO: 86205 - DNA, 37 bp, Artificial Sequence
  Synthetic oligonucleotide
gtaggggtgagagtggggggtaggagcgcaatgcaga

SEQ ID NO: 86206 - DNA, 37 bp, Artificial Sequence
  Synthetic oligonucleotide
atcgcacacacacaggttctacaacacattcacgaga

SEQ ID NO: 86207 - DNA, 37 bp, Artificial Sequence
  Synthetic oligonucleotide
aactgggaacgggcgagatataggtgcgaggggacga

SEQ ID NO: 86208 - DNA, 37 bp, Artificial Sequence
  Synthetic oligonucleotide
gtcacgccctctatgaagctgtcaattatgcacccga

SEQ ID NO: 86209 - DNA, 37 bp, Artificial Sequence
  Synthetic oligonucleotide
gtcccgcccagaactgccgtttcgactgtccacgcga

SEQ ID NO: 86210 - DNA, 35 bp, Artificial Sequence
  Synthetic oligonucleotide
accgacctcccctccagacctgcaacgttttgcga

SEQ ID NO: 86211 - DNA, 37 bp, Artificial Sequence
  Synthetic oligonucleotide
gtacgacaggagatcaggcaggtaggttcgtcgtcga

SEQ ID NO: 86212 - DNA, 37 bp, Artificial Sequence
  Synthetic oligonucleotide
ggtcgcccgccctttctagagagcttctatgcttcga

SEQ ID NO: 86213 - DNA, 37 bp, Artificial Sequence
  Synthetic oligonucleotide
actcccaccgtgtcacctttgcagtactgacccagga

SEQ ID NO: 86214 - DNA, 36 bp, Artificial Sequence
  Synthetic oligonucleotide
gtgtgcgaagggcaagggttgagggccgttgcagga

SEQ ID NO: 86215 - DNA, 37 bp, Artificial Sequence
  Synthetic oligonucleotide
ggggtagggaacgtgagcaaaaggtcgaaggtcagga

SEQ ID NO: 86216 - DNA, 37 bp, Artificial Sequence
  Synthetic oligonucleotide
tgcacacgaggaccaggacattaagacggagatagga

SEQ ID NO: 86217 - DNA, 36 bp, Artificial Sequence
  Synthetic oligonucleotide
gcaccggcgagcatcctgctgccctcttcgaacgga

SEQ ID NO: 86218 - DNA, 37 bp, Artificial Sequence
  Synthetic oligonucleotide
tagtagggtgcggaaggtgcgggcacaaggtgaggga

SEQ ID NO: 86219 - DNA, 37 bp, Artificial Sequence
  Synthetic oligonucleotide
gtatgctcgcctcccctgtctgacgtacagctatgga

SEQ ID NO: 86220 - DNA, 37 bp, Artificial Sequence
  Synthetic oligonucleotide
atggtgacgtaggctgcttccttcctaatactttgga

SEQ ID NO: 86221 - DNA, 37 bp, Artificial Sequence
  Synthetic oligonucleotide
tgtccatgcctgggctaggcccgttccatcttttgga

SEQ ID NO: 86222 - DNA, 38 bp, Artificial Sequence
  Synthetic oligonucleotide
gccagggtggggaaccgattaaagaggaggggaaatga

SEQ ID NO: 86223 - DNA, 38 bp, Artificial Sequence
  Synthetic oligonucleotide
ggagcattgcacacttgtctgttaccgcacaaccatga

SEQ ID NO: 86224 - DNA, 37 bp, Artificial Sequence
  Synthetic oligonucleotide
gtacaaagggtagtgcgtgggttaggtagtaccatga

SEQ ID NO: 86225 - DNA, 38 bp, Artificial Sequence
  Synthetic oligonucleotide
actcctctccatcctatctgttcacggtcaggttatga

SEQ ID NO: 86226 - DNA, 38 bp, Artificial Sequence
  Synthetic oligonucleotide
acacgaacactcgcctaatgttagctctcgaatactga

SEQ ID NO: 86227 - DNA, 38 bp, Artificial Sequence
  Synthetic oligonucleotide
aaggatccccctccgtgcctgattagaaacctccctga

SEQ ID NO: 86228 - DNA, 38 bp, Artificial Sequence
  Synthetic oligonucleotide
ggagcaacccccagtttgctagtgtctatacatcctga

SEQ ID NO: 86229 - DNA, 38 bp, Artificial Sequence
  Synthetic oligonucleotide
acaaccgatggttattgttacgcgcgttatccctctga

SEQ ID NO: 86230 - DNA, 38 bp, Artificial Sequence
  Synthetic oligonucleotide
tctcacaacaccatccatcttagattagatgtctctga

SEQ ID NO: 86231 - DNA, 38 bp, Artificial Sequence
  Synthetic oligonucleotide
gatagtaggagtggcgaaaacggactcgcggaacgtga

SEQ ID NO: 86232 - DNA, 38 bp, Artificial Sequence
  Synthetic oligonucleotide
atcgcacctcctattcgacccggttatacgctccgtga

SEQ ID NO: 86233 - DNA, 38 bp, Artificial Sequence
  Synthetic oligonucleotide
gagggcaaagctagaagggagggggggatatttcgtga

SEQ ID NO: 86234 - DNA, 38 bp, Artificial Sequence
  Synthetic oligonucleotide
agcctgcgcgactctgccagcccacataaacccggtga

SEQ ID NO: 86235 - DNA, 37 bp, Artificial Sequence
  Synthetic oligonucleotide
tagaggggcgcagggaaattaagttagcgaagggtga

SEQ ID NO: 86236 - DNA, 38 bp, Artificial Sequence
  Synthetic oligonucleotide
gacgccgtcggtcgtttgtcttaggggttccgtggtga

SEQ ID NO: 86237 - DNA, 38 bp, Artificial Sequence
  Synthetic oligonucleotide
gatgaccccccatatgtgcgttgttactactcatgtga

SEQ ID NO: 86238 - DNA, 38 bp, Artificial Sequence
  Synthetic oligonucleotide
aatgcaggtggttggagcgttcgaaggctgggatgtga

SEQ ID NO: 86239 - DNA, 38 bp, Artificial Sequence
  Synthetic oligonucleotide
gtcaactcgatctcctgtcgtcgtcctactttctgtga

SEQ ID NO: 86240 - DNA, 38 bp, Artificial Sequence
  Synthetic oligonucleotide
gactacgcagagctggacccggtctcacatgccattga

SEQ ID NO: 86241 - DNA, 38 bp, Artificial Sequence
  Synthetic oligonucleotide
gtctcgcacacatccatggaataccgatcgacccttga

SEQ ID NO: 86242 - DNA, 38 bp, Artificial Sequence
  Synthetic oligonucleotide
atcgtgtcgtggggtaaaaaaaaagaaatagggcttga

SEQ ID NO: 86243 - DNA, 38 bp, Artificial Sequence
  Synthetic oligonucleotide
gaccggtcggtcgcagttgctgcagtttattggcttga

SEQ ID NO: 86244 - DNA, 38 bp, Artificial Sequence
  Synthetic oligonucleotide
tctatccacgccttacatgcttattcgaagaatcttga

SEQ ID NO: 86245 - DNA, 38 bp, Artificial Sequence
  Synthetic oligonucleotide
tgctccgacggatgccctatttcatctttccttcttga

SEQ ID NO: 86246 - DNA, 38 bp, Artificial Sequence
  Synthetic oligonucleotide
tgcacttgcatttcaccttacgccagtcacccagttga

SEQ ID NO: 86247 - DNA, 38 bp, Artificial Sequence
  Synthetic oligonucleotide
gccttgcaaccgaaggtatgcaatttgagagttgttga

SEQ ID NO: 86248 - DNA, 35 bp, Artificial Sequence
  Synthetic oligonucleotide
tgttggggttggggaaagggagaggggatgacata

SEQ ID NO: 86249 - DNA, 36 bp, Artificial Sequence
  Synthetic oligonucleotide
aaacgtggcggcactaacaaggggatgggagggata

SEQ ID NO: 86250 - DNA, 35 bp, Artificial Sequence
  Synthetic oligonucleotide
acacggttgtgcaagggggaggggatgactcacta

SEQ ID NO: 86251 - DNA, 36 bp, Artificial Sequence
  Synthetic oligonucleotide
accacaccgacgttgcactcgatatttgcaattcta

SEQ ID NO: 86252 - DNA, 35 bp, Artificial Sequence
  Synthetic oligonucleotide
tgacgaggtgcaggaccactatcgcgttacacgta

SEQ ID NO: 86253 - DNA, 36 bp, Artificial Sequence
  Synthetic oligonucleotide
ttcccgcgcgtaatttctcgtttcttggcactcgta

SEQ ID NO: 86254 - DNA, 36 bp, Artificial Sequence
  Synthetic oligonucleotide
gatcgccctgttctccgcatacccatcctttcggta

SEQ ID NO: 86255 - DNA, 36 bp, Artificial Sequence
  Synthetic oligonucleotide
gaagaagtccaggtagtacgatggatggcttgggta

SEQ ID NO: 86256 - DNA, 35 bp, Artificial Sequence
  Synthetic oligonucleotide
acacctgaaggtgatcccaacaccagaactttgta

SEQ ID NO: 86257 - DNA, 35 bp, Artificial Sequence
  Synthetic oligonucleotide
agggcctgcacacctatctttgctctaagcactta

SEQ ID NO: 86258 - DNA, 36 bp, Artificial Sequence
  Synthetic oligonucleotide
ggacaagtgtacgcgttcccgtgcatggctccctta

SEQ ID NO: 86259 - DNA, 36 bp, Artificial Sequence
  Synthetic oligonucleotide
acgcccagactcttcgtgacctcacgcgcatgctta

SEQ ID NO: 86260 - DNA, 35 bp, Artificial Sequence
  Synthetic oligonucleotide
ggagaggggtgggtgggacgtagtgtatgtcgtta

SEQ ID NO: 86261 - DNA, 35 bp, Artificial Sequence
  Synthetic oligonucleotide
gcacacactgagcatagggttcaaaactacgttta

SEQ ID NO: 86262 - DNA, 35 bp, Artificial Sequence
  Synthetic oligonucleotide
acaccgaactgcaccctgttgatatccacgtaaac

SEQ ID NO: 86263 - DNA, 35 bp, Artificial Sequence
  Synthetic oligonucleotide
actgtgtgtctttgcccattactagcctgtgcaac

SEQ ID NO: 86264 - DNA, 35 bp, Artificial Sequence
  Synthetic oligonucleotide
ttgcaaactacgctgtttgacctgactgcaataac

SEQ ID NO: 86265 - DNA, 35 bp, Artificial Sequence
  Synthetic oligonucleotide
tccatcctccggttacatattcaaagtcccaagac

SEQ ID NO: 86266 - DNA, 35 bp, Artificial Sequence
  Synthetic oligonucleotide
tagtggtaggcctcgattacgcctcggtggtaacc

SEQ ID NO: 86267 - DNA, 36 bp, Artificial Sequence
  Synthetic oligonucleotide
ccgagccaccacatgatctatatttactacctcacc

SEQ ID NO: 86268 - DNA, 35 bp, Artificial Sequence
  Synthetic oligonucleotide
tagagcgcgacccctgcccagcagctggtacaccc

SEQ ID NO: 86269 - DNA, 35 bp, Artificial Sequence
  Synthetic oligonucleotide
gtttccccgcccccagatctaatggttgctccccc

SEQ ID NO: 86270 - DNA, 35 bp, Artificial Sequence
  Synthetic oligonucleotide
tccacactccccccactcttgtattcagcctggcc

SEQ ID NO: 86271 - DNA, 35 bp, Artificial Sequence
  Synthetic oligonucleotide
ttggggcaccgttacaccaccacagtctagaatcc

SEQ ID NO: 86272 - DNA, 35 bp, Artificial Sequence
  Synthetic oligonucleotide
attcgcgcgacgtgtaaattccacaccctgtctcc

SEQ ID NO: 86273 - DNA, 35 bp, Artificial Sequence
  Synthetic oligonucleotide
gcccacacctgcaaggtgttcttttccctctttcc

SEQ ID NO: 86274 - DNA, 35 bp, Artificial Sequence
  Synthetic oligonucleotide
accatgctgcaccatctgcccttgaccgttcgtgc

SEQ ID NO: 86275 - DNA, 35 bp, Artificial Sequence
  Synthetic oligonucleotide
tccgactgctgctcgtacctatggctggagcttgc

SEQ ID NO: 86276 - DNA, 35 bp, Artificial Sequence
  Synthetic oligonucleotide
gtcaaagtcgatcctcgtgtttgtttcgctacatc

SEQ ID NO: 86277 - DNA, 35 bp, Artificial Sequence
  Synthetic oligonucleotide
tacccacgcaccgccgacccatgagctacactatc

SEQ ID NO: 86278 - DNA, 35 bp, Artificial Sequence
  Synthetic oligonucleotide
gtacgccacaaaggctgagaaaacctggtcttatc

SEQ ID NO: 86279 - DNA, 35 bp, Artificial Sequence
  Synthetic oligonucleotide
gtgtaacacccgccgcacgtgtccctgtagttatc

SEQ ID NO: 86280 - DNA, 35 bp, Artificial Sequence
  Synthetic oligonucleotide
acggacccactagaatgtttaccgtcatccatctc

SEQ ID NO: 86281 - DNA, 34 bp, Artificial Sequence
  Synthetic oligonucleotide
gactacgcaggcttactgtgacgtaactcttctc

SEQ ID NO: 86282 - DNA, 35 bp, Artificial Sequence
  Synthetic oligonucleotide
gccaagccgtcgacattcttcgcgctttcgtcgtc

SEQ ID NO: 86283 - DNA, 35 bp, Artificial Sequence
  Synthetic oligonucleotide
tgtctgccggttgtgaccgccttttttagtagttc

SEQ ID NO: 86284 - DNA, 35 bp, Artificial Sequence
  Synthetic oligonucleotide
gtgggactgtatggtgtccgtcttttcgcatgttc

SEQ ID NO: 86285 - DNA, 34 bp, Artificial Sequence
  Synthetic oligonucleotide
aagtgggggggggctgatagaggatatttaatag

SEQ ID NO: 86286 - DNA, 35 bp, Artificial Sequence
  Synthetic oligonucleotide
tttagccacacctctcagaccgccggttactttag

SEQ ID NO: 86287 - DNA, 35 bp, Artificial Sequence
  Synthetic oligonucleotide
actccacgtggccctggggatccaggaaacctacg

SEQ ID NO: 86288 - DNA, 35 bp, Artificial Sequence
  Synthetic oligonucleotide
gtgagtagaggggatgatcgtagtatagcggaggg

SEQ ID NO: 86289 - DNA, 35 bp, Artificial Sequence
  Synthetic oligonucleotide
tattaccccgcccaatctgtctgaagctgaccggg

SEQ ID NO: 86290 - DNA, 35 bp, Artificial Sequence
  Synthetic oligonucleotide
tggggagggaaaatcggagaggggtagttgatggg

SEQ ID NO: 86291 - DNA, 35 bp, Artificial Sequence
  Synthetic oligonucleotide
tgcgtgcgtcttgggggaactgatgggggagtggg

SEQ ID NO: 86292 - DNA, 35 bp, Artificial Sequence
  Synthetic oligonucleotide
gctgcccttacttaggtatgtcgccccttctttgg

SEQ ID NO: 86293 - DNA, 37 bp, Artificial Sequence
  Synthetic oligonucleotide
aatcaatgtggcgggcgggtgtggagaaaataccatg

SEQ ID NO: 86294 - DNA, 35 bp, Artificial Sequence
  Synthetic oligonucleotide
attgacgtccctggagtaacgaatactggaaaaat

SEQ ID NO: 86295 - DNA, 35 bp, Artificial Sequence
  Synthetic oligonucleotide
tcagacgcccgggagaatcatgtaacgtgtcaaat

SEQ ID NO: 86296 - DNA, 35 bp, Artificial Sequence
  Synthetic oligonucleotide
actcaactcccgcgcgaccaggccagaaattctat

SEQ ID NO: 86297 - DNA, 35 bp, Artificial Sequence
  Synthetic oligonucleotide
atggagagccggggcataagggggggggcaattat

SEQ ID NO: 86298 - DNA, 35 bp, Artificial Sequence
  Synthetic oligonucleotide
gacccgtttgttgccaagtacaaacacccaaacct

SEQ ID NO: 86299 - DNA, 35 bp, Artificial Sequence
  Synthetic oligonucleotide
atccttcgccgtgccagttatatactcgtacacct

SEQ ID NO: 86300 - DNA, 35 bp, Artificial Sequence
  Synthetic oligonucleotide
ttacgcggccatcgagatttagacactcccgccct

SEQ ID NO: 86301 - DNA, 35 bp, Artificial Sequence
  Synthetic oligonucleotide
acagacgcaagtgcgtcttaccaatggatttgcct

SEQ ID NO: 86302 - DNA, 35 bp, Artificial Sequence
  Synthetic oligonucleotide
tgccgtcctgggaacccttttttccgaccgctgct

SEQ ID NO: 86303 - DNA, 35 bp, Artificial Sequence
  Synthetic oligonucleotide
acgaccatccccccgcagtctccatggcctggtct

SEQ ID NO: 86304 - DNA, 35 bp, Artificial Sequence
  Synthetic oligonucleotide
tgtcacggttgacgtaactactggtacattggtct

SEQ ID NO: 86305 - DNA, 35 bp, Artificial Sequence
  Synthetic oligonucleotide
tttgtccccatgcgctattcgatactttgccttct

SEQ ID NO: 86306 - DNA, 35 bp, Artificial Sequence
  Synthetic oligonucleotide
gatcacgctctctaggtcgttgggggaagggttct

SEQ ID NO: 86307 - DNA, 35 bp, Artificial Sequence
  Synthetic oligonucleotide
ttcgcaggtaggccgagaaacgggaaatggccagt

SEQ ID NO: 86308 - DNA, 35 bp, Artificial Sequence
  Synthetic oligonucleotide
acccacatccagagttaaacacgcaccctggcggt

SEQ ID NO: 86309 - DNA, 35 bp, Artificial Sequence
  Synthetic oligonucleotide
gatgaaggtgtggatgtctgagatggttagcgggt

SEQ ID NO: 86310 - DNA, 35 bp, Artificial Sequence
  Synthetic oligonucleotide
tcatgccgtctcgaaggctaaccgtccatcatggt

SEQ ID NO: 86311 - DNA, 35 bp, Artificial Sequence
  Synthetic oligonucleotide
gcactctgcccccgtttgcactataaaataaactt

SEQ ID NO: 86312 - DNA, 35 bp, Artificial Sequence
  Synthetic oligonucleotide
attgacctccccaggttaaggtatcatgccacctt

SEQ ID NO: 86313 - DNA, 35 bp, Artificial Sequence
  Synthetic oligonucleotide
gcgtggctctgagcgcaaatattgtctcccttgtt

SEQ ID NO: 86314 - DNA, 35 bp, Artificial Sequence
  Synthetic oligonucleotide
acggacaaactcttgtccatgttcgctcctttgtt

SEQ ID NO: 86315 - DNA, 35 bp, Artificial Sequence
  Synthetic oligonucleotide
taagtcaccatacatgcgttaatcacttgacgttt

SEQ ID NO: 86316 - DNA, 35 bp, Artificial Sequence
  Synthetic oligonucleotide
gaaccgtcgctgtccctctattcgttgcctggttt

SEQ ID NO: 86317 - DNA, 35 bp, Artificial Sequence
  Synthetic oligonucleotide
tcgtgctgagagaggggggaggatatggtgatttt

SEQ ID NO: 86318 - DNA, 36 bp, Artificial Sequence
  Synthetic oligonucleotide
atcgctcccaccgcattggctatggcctcaacaaaa

SEQ ID NO: 86319 - DNA, 36 bp, Artificial Sequence
  Synthetic oligonucleotide
ttgactgaccaatccatctagttgagacgcacgaaa

SEQ ID NO: 86320 - DNA, 36 bp, Artificial Sequence
  Synthetic oligonucleotide
gaactcgtcgcccgtgttaacaactacgtaactaaa

SEQ ID NO: 86321 - DNA, 36 bp, Artificial Sequence
  Synthetic oligonucleotide
tctccttcgcccaaagtactactgcaatcctgtaaa

SEQ ID NO: 86322 - DNA, 36 bp, Artificial Sequence
  Synthetic oligonucleotide
tgtgaatcacgacctgcctggcctcgctccagccaa

SEQ ID NO: 86323 - DNA, 36 bp, Artificial Sequence
  Synthetic oligonucleotide
aacccaacattggtaggaatcaccgttgcatttcaa

SEQ ID NO: 86324 - DNA, 35 bp, Artificial Sequence
  Synthetic oligonucleotide
gtgtggggaggaaggaccggtaggtactgacagaa

SEQ ID NO: 86325 - DNA, 35 bp, Artificial Sequence
  Synthetic oligonucleotide
aactcaaacagagggcaaaagggcagggagtagaa

SEQ ID NO: 86326 - DNA, 35 bp, Artificial Sequence
  Synthetic oligonucleotide
acacccacagcttatactgatttcgagttcacgaa

SEQ ID NO: 86327 - DNA, 36 bp, Artificial Sequence
  Synthetic oligonucleotide
gacatcaggctccggaggcgaacaagggcttaggaa

SEQ ID NO: 86328 - DNA, 36 bp, Artificial Sequence
  Synthetic oligonucleotide
aaccaccgcaagagcaatgacccctgacaccgggaa

SEQ ID NO: 86329 - DNA, 36 bp, Artificial Sequence
  Synthetic oligonucleotide
tgccgtcgagcgggtaagggggggattctcggggaa

SEQ ID NO: 86330 - DNA, 35 bp, Artificial Sequence
  Synthetic oligonucleotide
tagtgcccccagaccgctgcctatggatatttgaa

SEQ ID NO: 86331 - DNA, 36 bp, Artificial Sequence
  Synthetic oligonucleotide
tccacagacagttaatggaatgtagtgagaagctaa

SEQ ID NO: 86332 - DNA, 36 bp, Artificial Sequence
  Synthetic oligonucleotide
tgtgacccatctcttgtaagctaacgtcgccattaa

SEQ ID NO: 86333 - DNA, 35 bp, Artificial Sequence
  Synthetic oligonucleotide
gtcacgtgatggtcgcgcttcttattttacgttaa

SEQ ID NO: 86334 - DNA, 36 bp, Artificial Sequence
  Synthetic oligonucleotide
gtcccgttgcccgtgttaagccgtcccacctataca

SEQ ID NO: 86335 - DNA, 36 bp, Artificial Sequence
  Synthetic oligonucleotide
ttagccacattcttatagggagcacttcgacgacca

SEQ ID NO: 86336 - DNA, 36 bp, Artificial Sequence
  Synthetic oligonucleotide
tcacgcgattggttcctctccctagtatcgggccca

SEQ ID NO: 86337 - DNA, 36 bp, Artificial Sequence
  Synthetic oligonucleotide
gttgaagtccgtcagccattccgttgtcgtgtcgca

SEQ ID NO: 86338 - DNA, 36 bp, Artificial Sequence
  Synthetic oligonucleotide
tccccccattggtcttagtcgcctacgcaagctgca

SEQ ID NO: 86339 - DNA, 36 bp, Artificial Sequence
  Synthetic oligonucleotide
tgtgacagccggcaattcactacgcattcagctgca

SEQ ID NO: 86340 - DNA, 35 bp, Artificial Sequence
  Synthetic oligonucleotide
gcacccaccttcctgataatgacgcctgaacatca

SEQ ID NO: 86341 - DNA, 36 bp, Artificial Sequence
  Synthetic oligonucleotide
ggacctgccacggtgcagtttatacattgttgatca

SEQ ID NO: 86342 - DNA, 36 bp, Artificial Sequence
  Synthetic oligonucleotide
gcgtagccctgatctcacttgcttgttgggctctca

SEQ ID NO: 86343 - DNA, 37 bp, Artificial Sequence
  Synthetic oligonucleotide
ttggtaacaggcaatgggaatcggagcggagggaaga

SEQ ID NO: 86344 - DNA, 37 bp, Artificial Sequence
  Synthetic oligonucleotide
tgccccccacgactcatgtgccccccattgcataaga

SEQ ID NO: 86345 - DNA, 37 bp, Artificial Sequence
  Synthetic oligonucleotide
tatccgctctgccctaaatacaactgtccgctcgaga

SEQ ID NO: 86346 - DNA, 37 bp, Artificial Sequence
  Synthetic oligonucleotide
atcattgacgggaagagaagcaggagtcggtgggaga

SEQ ID NO: 86347 - DNA, 37 bp, Artificial Sequence
  Synthetic oligonucleotide
gccgagcacggttgcttgggaaacgtcgctcccacga

SEQ ID NO: 86348 - DNA, 35 bp, Artificial Sequence
  Synthetic oligonucleotide
gcgaaaagggggaggaacaatttggcgaggtacga

SEQ ID NO: 86349 - DNA, 37 bp, Artificial Sequence
  Synthetic oligonucleotide
gccatgacaataaccgagccccgttccaactgtacga

SEQ ID NO: 86350 - DNA, 37 bp, Artificial Sequence
  Synthetic oligonucleotide
aacgccctctcattagactatcgtacgattctaccga

SEQ ID NO: 86351 - DNA, 37 bp, Artificial Sequence
  Synthetic oligonucleotide
gggtccatgccagccgtttctatcacgcgtgccccga

SEQ ID NO: 86352 - DNA, 37 bp, Artificial Sequence
  Synthetic oligonucleotide
ggttgaggatatggtggcggccgggaggacagatcga

SEQ ID NO: 86353 - DNA, 37 bp, Artificial Sequence
  Synthetic oligonucleotide
gtgcaaggaccagcactttttggcctttcgttatcga

SEQ ID NO: 86354 - DNA, 37 bp, Artificial Sequence
  Synthetic oligonucleotide
gcaccgcaactgtttatctttttctcctatgggtcga

SEQ ID NO: 86355 - DNA, 37 bp, Artificial Sequence
  Synthetic oligonucleotide
gcactccatcaagtcacgggtacctcgactctttcga

SEQ ID NO: 86356 - DNA, 37 bp, Artificial Sequence
  Synthetic oligonucleotide
tgatccaacccagagaaaacacagcgccccccaagga

SEQ ID NO: 86357 - DNA, 37 bp, Artificial Sequence
  Synthetic oligonucleotide
aaggggcacggaggggcgaatcgagggagttttagga

SEQ ID NO: 86358 - DNA, 37 bp, Artificial Sequence
  Synthetic oligonucleotide
acaccacacgggaagcagaagtaacgcgcaaacggga

SEQ ID NO: 86359 - DNA, 37 bp, Artificial Sequence
  Synthetic oligonucleotide
tgacggttaaagggggatacggactaggcgatatgga

SEQ ID NO: 86360 - DNA, 37 bp, Artificial Sequence
  Synthetic oligonucleotide
tcagcaagagtaaagagggatggcggtagaacgtgga

SEQ ID NO: 86361 - DNA, 37 bp, Artificial Sequence
  Synthetic oligonucleotide
aacaacgaagcgccaaggagcaggaagggcgtgtgga

SEQ ID NO: 86362 - DNA, 36 bp, Artificial Sequence
  Synthetic oligonucleotide
tctgaaggaagaggacggaaaggggcggccgaatga

SEQ ID NO: 86363 - DNA, 38 bp, Artificial Sequence
  Synthetic oligonucleotide
agcaactaaacagggtgttggaatgggtgcagatatga

SEQ ID NO: 86364 - DNA, 37 bp, Artificial Sequence
  Synthetic oligonucleotide
taggacgtgggaggaatcatcggagcgggaaaactga

SEQ ID NO: 86365 - DNA, 37 bp, Artificial Sequence
  Synthetic oligonucleotide
tgatgctcagacgttgctgcccccctacccacactga

SEQ ID NO: 86366 - DNA, 38 bp, Artificial Sequence
  Synthetic oligonucleotide
gccacacccgactcactgccaggacccaagggcactga

SEQ ID NO: 86367 - DNA, 38 bp, Artificial Sequence
  Synthetic oligonucleotide
tgctcgttcgcgagatttactcatgacgcctcacctga

SEQ ID NO: 86368 - DNA, 37 bp, Artificial Sequence
  Synthetic oligonucleotide
tggaaccgaagcaatgttagaaccctcccgccgctga

SEQ ID NO: 86369 - DNA, 37 bp, Artificial Sequence
  Synthetic oligonucleotide
gtctgccagcactacgtctaatcgctcttttctctga

SEQ ID NO: 86370 - DNA, 38 bp, Artificial Sequence
  Synthetic oligonucleotide
tgctacggtaggcaataaaggtgaggggctatgagtga

SEQ ID NO: 86371 - DNA, 37 bp, Artificial Sequence
  Synthetic oligonucleotide
acaccccatctccagtaacaacaatcattgaaggtga

SEQ ID NO: 86372 - DNA, 38 bp, Artificial Sequence
  Synthetic oligonucleotide
tggaagggagccgggaggtaagagggtggggacggtga

SEQ ID NO: 86373 - DNA, 38 bp, Artificial Sequence
  Synthetic oligonucleotide
gagctgggcacagtcaaaacgcttccgtcctacggtga

SEQ ID NO: 86374 - DNA, 38 bp, Artificial Sequence
  Synthetic oligonucleotide
gagtgcgcaagtgcatgggatggggtgaacggaattga

SEQ ID NO: 86375 - DNA, 38 bp, Artificial Sequence
  Synthetic oligonucleotide
tgccatgagcaatggtttccaaactgaacttctattga

SEQ ID NO: 86376 - DNA, 38 bp, Artificial Sequence
  Synthetic oligonucleotide
tgcaagctgccgctctcgttcctccacccccagtttga

SEQ ID NO: 86377 - DNA, 38 bp, Artificial Sequence
  Synthetic oligonucleotide
atatcacgccagtcagtgttggcgcttttggattttga

SEQ ID NO: 86378 - DNA, 38 bp, Artificial Sequence
  Synthetic oligonucleotide
actgagaactgttgcgccgatcgcgtctcgccttttga

SEQ ID NO: 86379 - DNA, 35 bp, Artificial Sequence
  Synthetic oligonucleotide
accccgttcctcatgttttgcgctctcgatcgata

SEQ ID NO: 86380 - DNA, 36 bp, Artificial Sequence
  Synthetic oligonucleotide
acgaccgacaccacagtgcaccttgcttggcttata

SEQ ID NO: 86381 - DNA, 35 bp, Artificial Sequence
  Synthetic oligonucleotide
ggagatgagggctggtgaacttggggagggaccta

SEQ ID NO: 86382 - DNA, 36 bp, Artificial Sequence
  Synthetic oligonucleotide
taccatcgacacagatctcgtcctgacatccctcta

SEQ ID NO: 86383 - DNA, 35 bp, Artificial Sequence
  Synthetic oligonucleotide
atccattgttccccggtcctatctacagttttcta

SEQ ID NO: 86384 - DNA, 37 bp, Artificial Sequence
  Synthetic oligonucleotide
acccgcccaccaccgcgcccgacaggacaatagcgta

SEQ ID NO: 86385 - DNA, 35 bp, Artificial Sequence
  Synthetic oligonucleotide
gcaccatgcaccgtgacccacccgtctcgcgcgta

SEQ ID NO: 86386 - DNA, 36 bp, Artificial Sequence
  Synthetic oligonucleotide
tggtcgagggcggataaaaaaggggtcaagaaggta

SEQ ID NO: 86387 - DNA, 36 bp, Artificial Sequence
  Synthetic oligonucleotide
gcgcaagcacacttgcataaccactcaattttggta

SEQ ID NO: 86388 - DNA, 35 bp, Artificial Sequence
  Synthetic oligonucleotide
gggacaagtccacccgcgaacacgttttccttgta

SEQ ID NO: 86389 - DNA, 36 bp, Artificial Sequence
  Synthetic oligonucleotide
tattgcgagagggggaggaaggcgaagagataatta

SEQ ID NO: 86390 - DNA, 35 bp, Artificial Sequence
  Synthetic oligonucleotide
tgctccacctctatcgtttaatctgggaatgatta

SEQ ID NO: 86391 - DNA, 35 bp, Artificial Sequence
  Synthetic oligonucleotide
aaaggaggaccgagagaggaggggcgattaattta

SEQ ID NO: 86392 - DNA, 36 bp, Artificial Sequence
  Synthetic oligonucleotide
tcaacacctgttgatgattttccaccttggccttta

SEQ ID NO: 86393 - DNA, 36 bp, Artificial Sequence
  Synthetic oligonucleotide
atgacacctactccttccatctaagccgagagttta

SEQ ID NO: 86394 - DNA, 36 bp, Artificial Sequence
  Synthetic oligonucleotide
gcaacctgataaggtgaggacaaaggataacgttta

SEQ ID NO: 86395 - DNA, 35 bp, Artificial Sequence
  Synthetic oligonucleotide
atcttaactgctgacccttcgtattcacgtgtcac

SEQ ID NO: 86396 - DNA, 35 bp, Artificial Sequence
  Synthetic oligonucleotide
gcggaggggcgggaggggagggaaactatgcgacc

SEQ ID NO: 86397 - DNA, 35 bp, Artificial Sequence
  Synthetic oligonucleotide
tccctgcacgcgccttggtgaccacccccctaccc

SEQ ID NO: 86398 - DNA, 35 bp, Artificial Sequence
  Synthetic oligonucleotide
tcacgcgccccttccgatcataggcagtttgcccc

SEQ ID NO: 86399 - DNA, 35 bp, Artificial Sequence
  Synthetic oligonucleotide
gcattagcaggcacctgtctccgtccgtccgtgcc

SEQ ID NO: 86400 - DNA, 35 bp, Artificial Sequence
  Synthetic oligonucleotide
atgcacgatcccagtggttttcacgtgacgcctcc

SEQ ID NO: 86401 - DNA, 35 bp, Artificial Sequence
  Synthetic oligonucleotide
gtacacccatttacctagtgacgtggcttcttagc

SEQ ID NO: 86402 - DNA, 35 bp, Artificial Sequence
  Synthetic oligonucleotide
gaggatgtccacagttccgcaactatagctcacgc

SEQ ID NO: 86403 - DNA, 35 bp, Artificial Sequence
  Synthetic oligonucleotide
tattgagcgctacccctcttgggacctttagttgc

SEQ ID NO: 86404 - DNA, 35 bp, Artificial Sequence
  Synthetic oligonucleotide
acacaccacacgtgcaccgtccttccctgggcatc

SEQ ID NO: 86405 - DNA, 35 bp, Artificial Sequence
  Synthetic oligonucleotide
gattcaacatctaccgcctgttaggggacgcactc

SEQ ID NO: 86406 - DNA, 35 bp, Artificial Sequence
  Synthetic oligonucleotide
gttgtgatccacgtgcactcgacaagtaatatctc

SEQ ID NO: 86407 - DNA, 35 bp, Artificial Sequence
  Synthetic oligonucleotide
tgtaactctgccctttattcgttgctccttggaag

SEQ ID NO: 86408 - DNA, 35 bp, Artificial Sequence
  Synthetic oligonucleotide
tccacattggaccgcgccctcccgcatcgtttcag

SEQ ID NO: 86409 - DNA, 35 bp, Artificial Sequence
  Synthetic oligonucleotide
tatgccacaatgtgcttcttcgccccagttactag

SEQ ID NO: 86410 - DNA, 35 bp, Artificial Sequence
  Synthetic oligonucleotide
tctccccacaaccggtaggcgcaactttcatttag

SEQ ID NO: 86411 - DNA, 35 bp, Artificial Sequence
  Synthetic oligonucleotide
gtccacgttgcttcctaggcaccttattcccgacg

SEQ ID NO: 86412 - DNA, 35 bp, Artificial Sequence
  Synthetic oligonucleotide
aactcgtgccacccaggtttaacatgccgatagcg

SEQ ID NO: 86413 - DNA, 35 bp, Artificial Sequence
  Synthetic oligonucleotide
taaccaccgtcagctccaagtcgccaactatatcg

SEQ ID NO: 86414 - DNA, 35 bp, Artificial Sequence
  Synthetic oligonucleotide
tgctatcggtcatcctaccgatcaagaccacctcg

SEQ ID NO: 86415 - DNA, 35 bp, Artificial Sequence
  Synthetic oligonucleotide
atcagagcgataggaggaagggctggcaggtaagg

SEQ ID NO: 86416 - DNA, 35 bp, Artificial Sequence
  Synthetic oligonucleotide
ggaagtgagtggaggatttcgtgcgtggactaggg

SEQ ID NO: 86417 - DNA, 35 bp, Artificial Sequence
  Synthetic oligonucleotide
gacccacagatggccaaatcgaagcaattagcggg

SEQ ID NO: 86418 - DNA, 35 bp, Artificial Sequence
  Synthetic oligonucleotide
gtatgcccaccaccttcgattgcacaatatcatgg

SEQ ID NO: 86419 - DNA, 35 bp, Artificial Sequence
  Synthetic oligonucleotide
aagtgggcgggaaatggacactctgacataggatg

SEQ ID NO: 86420 - DNA, 35 bp, Artificial Sequence
  Synthetic oligonucleotide
tacactcccgcctatggaagttaaccttttgcctg

SEQ ID NO: 86421 - DNA, 35 bp, Artificial Sequence
  Synthetic oligonucleotide
gtccacagcgcaatccatccttcgtatgcgtagtg

SEQ ID NO: 86422 - DNA, 35 bp, Artificial Sequence
  Synthetic oligonucleotide
accaatcccagggcgctatccgttccagaccacat

SEQ ID NO: 86423 - DNA, 35 bp, Artificial Sequence
  Synthetic oligonucleotide
ccactccgcaaattttgccctatccccatggacat

SEQ ID NO: 86424 - DNA, 35 bp, Artificial Sequence
  Synthetic oligonucleotide
atacctcccgcacctgagtgagtagctcagtgcat

SEQ ID NO: 86425 - DNA, 35 bp, Artificial Sequence
  Synthetic oligonucleotide
atagaccgtccgaagccgggcatatacacttcact

SEQ ID NO: 86426 - DNA, 35 bp, Artificial Sequence
  Synthetic oligonucleotide
ttcaccgacaaggaggtcatgatttggcgttcact

SEQ ID NO: 86427 - DNA, 36 bp, Artificial Sequence
  Synthetic oligonucleotide
gtgcacctgcctaccattgtatggtcctttctgcct

SEQ ID NO: 86428 - DNA, 35 bp, Artificial Sequence
  Synthetic oligonucleotide
gattcgcaccttctgtgtttgctcctctcaatgct

SEQ ID NO: 86429 - DNA, 35 bp, Artificial Sequence
  Synthetic oligonucleotide
accgcaccaccactagcggtcaatataatgaaggt

SEQ ID NO: 86430 - DNA, 35 bp, Artificial Sequence
  Synthetic oligonucleotide
gtaccgctaggcattaactgcatccattaaacggt

SEQ ID NO: 86431 - DNA, 35 bp, Artificial Sequence
  Synthetic oligonucleotide
gaagtaggcggtcaataatgaggttggggtgtggt

SEQ ID NO: 86432 - DNA, 35 bp, Artificial Sequence
  Synthetic oligonucleotide
ttgttgtcgccaccgccgtaacaatgcccctaatt

SEQ ID NO: 86433 - DNA, 35 bp, Artificial Sequence
  Synthetic oligonucleotide
acaagccgaccccctattctgcctgatagtccatt

SEQ ID NO: 86434 - DNA, 35 bp, Artificial Sequence
  Synthetic oligonucleotide
gacgcatcccgtacttgcatcacttctcacgactt

SEQ ID NO: 86435 - DNA, 35 bp, Artificial Sequence
  Synthetic oligonucleotide
tctccatccaccgatcacggggaaaacaaaacctt

SEQ ID NO: 86436 - DNA, 35 bp, Artificial Sequence
  Synthetic oligonucleotide
gcgcccaccgccatttttatcgtacagcatcgctt

SEQ ID NO: 86437 - DNA, 35 bp, Artificial Sequence
  Synthetic oligonucleotide
gaatctggtcctacacgtgcgcaatcagcaatctt

SEQ ID NO: 86438 - DNA, 35 bp, Artificial Sequence
  Synthetic oligonucleotide
aacgcgcctctctatccccaaaccgctaacatgtt

SEQ ID NO: 86439 - DNA, 36 bp, Artificial Sequence
  Synthetic oligonucleotide
tccgacgcgcccacattctatgacaccttcacacaa

SEQ ID NO: 86440 - DNA, 35 bp, Artificial Sequence
  Synthetic oligonucleotide
agattcccgtccccctccctttacgtgacgtacaa

SEQ ID NO: 86441 - DNA, 35 bp, Artificial Sequence
  Synthetic oligonucleotide
gtgaggcacgcactacctcgccgtcaacgctgcaa

SEQ ID NO: 86442 - DNA, 35 bp, Artificial Sequence
  Synthetic oligonucleotide
gcgaaaggggaggtgagtgagatagcctgctagaa

SEQ ID NO: 86443 - DNA, 35 bp, Artificial Sequence
  Synthetic oligonucleotide
aagccaccgaagggtctgtcaactatcacaccgaa

SEQ ID NO: 86444 - DNA, 35 bp, Artificial Sequence
  Synthetic oligonucleotide
tggagcaacaccttcggtccagacgatttcccaca

SEQ ID NO: 86445 - DNA, 36 bp, Artificial Sequence
  Synthetic oligonucleotide
gacgcaaatactgctcagccttacccgctctgcaca

SEQ ID NO: 86446 - DNA, 35 bp, Artificial Sequence
  Synthetic oligonucleotide
gcacattctactcctgccgatacgcgctattgaca

SEQ ID NO: 86447 - DNA, 36 bp, Artificial Sequence
  Synthetic oligonucleotide
tatggtagtgaacgcaggaacgggtgggatttgaca

SEQ ID NO: 86448 - DNA, 35 bp, Artificial Sequence
  Synthetic oligonucleotide
gtccaccgtgggcgtgctcctagagtgcatcacca

SEQ ID NO: 86449 - DNA, 36 bp, Artificial Sequence
  Synthetic oligonucleotide
cctgccacaaacgcgctttcccgtcatccttcgcca

SEQ ID NO: 86450 - DNA, 36 bp, Artificial Sequence
  Synthetic oligonucleotide
tacgcatcctgttacctgatttccggcgtattgcca

SEQ ID NO: 86451 - DNA, 37 bp, Artificial Sequence
  Synthetic oligonucleotide
agtcgccgggcaagcaggagcaaggggaagggcggca

SEQ ID NO: 86452 - DNA, 35 bp, Artificial Sequence
  Synthetic oligonucleotide
gaactgcctcagccgcccctcccgcccgctttgca

SEQ ID NO: 86453 - DNA, 35 bp, Artificial Sequence
  Synthetic oligonucleotide
tgttgacgccttggggtgccatcctagtactatca

SEQ ID NO: 86454 - DNA, 35 bp, Artificial Sequence
  Synthetic oligonucleotide
tgttgtccccctttagacgcccttatcgagactca

SEQ ID NO: 86455 - DNA, 36 bp, Artificial Sequence
  Synthetic oligonucleotide
gcgctccttccatctgtggcgacgccgatctcctca

SEQ ID NO: 86456 - DNA, 37 bp, Artificial Sequence
  Synthetic oligonucleotide
gatggggaagaaggtacaatgtagctcgtagtgcaga

SEQ ID NO: 86457 - DNA, 37 bp, Artificial Sequence
  Synthetic oligonucleotide
tggagccattcgggactaacatccaccgtccctacga

SEQ ID NO: 86458 - DNA, 37 bp, Artificial Sequence
  Synthetic oligonucleotide
gaacatgggccccagcgtcatacctcgcgatctacga

SEQ ID NO: 86459 - DNA, 37 bp, Artificial Sequence
  Synthetic oligonucleotide
tctacttccatcgatctcttttgtggacctctaccga

SEQ ID NO: 86460 - DNA, 36 bp, Artificial Sequence
  Synthetic oligonucleotide
gaagaccccggagccgtacattagtcgacatcccga

SEQ ID NO: 86461 - DNA, 37 bp, Artificial Sequence
  Synthetic oligonucleotide
gatggtaggtagcaccggagaaaagcgacgaatccga

SEQ ID NO: 86462 - DNA, 37 bp, Artificial Sequence
  Synthetic oligonucleotide
acccatggcctatacttacagcaggtgacccttccga

SEQ ID NO: 86463 - DNA, 37 bp, Artificial Sequence
  Synthetic oligonucleotide
gatcactccaccagttgggccaggtttacggttccga

SEQ ID NO: 86464 - DNA, 36 bp, Artificial Sequence
  Synthetic oligonucleotide
gataacgccgggtagctacgcagccgcatatagcga

SEQ ID NO: 86465 - DNA, 37 bp, Artificial Sequence
  Synthetic oligonucleotide
atggtccacccgtctgatccaatagctcacgatgcga

SEQ ID NO: 86466 - DNA, 37 bp, Artificial Sequence
  Synthetic oligonucleotide
tcacgaggcctgatgcatgccaatgcacttttctcga

SEQ ID NO: 86467 - DNA, 37 bp, Artificial Sequence
  Synthetic oligonucleotide
accaacccgttctcaatagtgtgattacacccttcga

SEQ ID NO: 86468 - DNA, 37 bp, Artificial Sequence
  Synthetic oligonucleotide
gatctgcgccatcactcccgtcagagggtcccttcga

SEQ ID NO: 86469 - DNA, 37 bp, Artificial Sequence
  Synthetic oligonucleotide
tctggccaagtgggacaaggaggatcgaggggcagga

SEQ ID NO: 86470 - DNA, 37 bp, Artificial Sequence
  Synthetic oligonucleotide
gatggtgacaagggcaggggtggcggttacaagagga

SEQ ID NO: 86471 - DNA, 36 bp, Artificial Sequence
  Synthetic oligonucleotide
gacaacggtcagaggagatgggctgttcattgagga

SEQ ID NO: 86472 - DNA, 37 bp, Artificial Sequence
  Synthetic oligonucleotide
atgaggggcgaggggaggggaatcagatgccaaggga

SEQ ID NO: 86473 - DNA, 37 bp, Artificial Sequence
  Synthetic oligonucleotide
acataggctgggacatgcaaagaaacgtggacaggga

SEQ ID NO: 86474 - DNA, 36 bp, Artificial Sequence
  Synthetic oligonucleotide
ttaggtggtggaaagggggtgttatagagccaggga

SEQ ID NO: 86475 - DNA, 37 bp, Artificial Sequence
  Synthetic oligonucleotide
ggggagtggactttaaggtgggaagaagcaaagggga

SEQ ID NO: 86476 - DNA, 36 bp, Artificial Sequence
  Synthetic oligonucleotide
gtcccacgagctgggtggactggacggttaggggga

SEQ ID NO: 86477 - DNA, 37 bp, Artificial Sequence
  Synthetic oligonucleotide
aagggttggaagacgcggggtaaagtcaaggtgggga

SEQ ID NO: 86478 - DNA, 37 bp, Artificial Sequence
  Synthetic oligonucleotide
tacgatcggtccaagcttctacaccctcctgtctgga

SEQ ID NO: 86479 - DNA, 38 bp, Artificial Sequence
  Synthetic oligonucleotide
gcacagaagctgatacggaaaaggagaagagtacatga

SEQ ID NO: 86480 - DNA, 37 bp, Artificial Sequence
  Synthetic oligonucleotide
tagccacacagacgtccctgcgactacagtaccatga

SEQ ID NO: 86481 - DNA, 37 bp, Artificial Sequence
  Synthetic oligonucleotide
gggtgccatcccgtccatctcgtaaaactcgccatga

SEQ ID NO: 86482 - DNA, 38 bp, Artificial Sequence
  Synthetic oligonucleotide
gagacagcaaagctggtgggtggaggcaaacgagatga

SEQ ID NO: 86483 - DNA, 35 bp, Artificial Sequence
  Synthetic oligonucleotide
gctgcctccatcgaccgttccccttttttagatga

SEQ ID NO: 86484 - DNA, 38 bp, Artificial Sequence
  Synthetic oligonucleotide
gcagaccacggtcgtcataatcaattgctgcccactga

SEQ ID NO: 86485 - DNA, 38 bp, Artificial Sequence
  Synthetic oligonucleotide
gacccaaatgcagcacgttatacccgcatcctcactga

SEQ ID NO: 86486 - DNA, 37 bp, Artificial Sequence
  Synthetic oligonucleotide
tgcacagtctctcgacgcgtttgtcccttcttactga

SEQ ID NO: 86487 - DNA, 37 bp, Artificial Sequence
  Synthetic oligonucleotide
taagccgcccgctcgatcccggagatttaccccctga

SEQ ID NO: 86488 - DNA, 36 bp, Artificial Sequence
  Synthetic oligonucleotide
agggatgcactgggtccactacctacggatttctga

SEQ ID NO: 86489 - DNA, 35 bp, Artificial Sequence
  Synthetic oligonucleotide
ttgtgacacctctccacctctttgccacgaagtga

SEQ ID NO: 86490 - DNA, 37 bp, Artificial Sequence
  Synthetic oligonucleotide
gccacgtcgggcacgtttaatttacatttcccagtga

SEQ ID NO: 86491 - DNA, 37 bp, Artificial Sequence
  Synthetic oligonucleotide
acatcacatactcacccctgatacgagtcactcgtga

SEQ ID NO: 86492 - DNA, 35 bp, Artificial Sequence
  Synthetic oligonucleotide
aatgtgccaaggggacaagaaatagtataaggtga

SEQ ID NO: 86493 - DNA, 37 bp, Artificial Sequence
  Synthetic oligonucleotide
tgttgccgaagggggtggaggatacgaaggacggtga

SEQ ID NO: 86494 - DNA, 38 bp, Artificial Sequence
  Synthetic oligonucleotide
attgcagtagtaaacggtggattaaagtgagagggtga

SEQ ID NO: 86495 - DNA, 38 bp, Artificial Sequence
  Synthetic oligonucleotide
tttgagccgccctattcttaacgctggacttcttgtga

SEQ ID NO: 86496 - DNA, 38 bp, Artificial Sequence
  Synthetic oligonucleotide
aacgcacgtaaggggaagtgttactgcctgccaattga

SEQ ID NO: 86497 - DNA, 38 bp, Artificial Sequence
  Synthetic oligonucleotide
tgagtgacgtcctgtggctccacgccgatctgccttga

SEQ ID NO: 86498 - DNA, 38 bp, Artificial Sequence
  Synthetic oligonucleotide
gcatggaaaagtgggggattggagaaggtggagcttga

SEQ ID NO: 86499 - DNA, 38 bp, Artificial Sequence
  Synthetic oligonucleotide
gtcttgcgcaaagcgtggcgtaagggggggtgggttga

SEQ ID NO: 86500 - DNA, 38 bp, Artificial Sequence
  Synthetic oligonucleotide
gtagcacgtgtgggcggtatgatggctggggtggttga

SEQ ID NO: 86501 - DNA, 37 bp, Artificial Sequence
  Synthetic oligonucleotide
tcacacgtaggttcgattcaattgctcagtcctttga

SEQ ID NO: 86502 - DNA, 35 bp, Artificial Sequence
  Synthetic oligonucleotide
accgtccggtcggaggctcgcttttgaacaccata

SEQ ID NO: 86503 - DNA, 35 bp, Artificial Sequence
  Synthetic oligonucleotide
taggtcagacgctattggctaaatcactcacacta

SEQ ID NO: 86504 - DNA, 35 bp, Artificial Sequence
  Synthetic oligonucleotide
acaaagccgcagacaatcgaaccacctccgcctta

SEQ ID NO: 86505 - DNA, 36 bp, Artificial Sequence
  Synthetic oligonucleotide
tttgtcacatggcacattgacctagcccctctctta

SEQ ID NO: 86506 - DNA, 36 bp, Artificial Sequence
  Synthetic oligonucleotide
ttacctcagaccacaacagcctcgtttcgacggtta

SEQ ID NO: 86507 - DNA, 35 bp, Artificial Sequence
  Synthetic oligonucleotide
gacgtggggagcgggatcgggggacgcagggcaac

SEQ ID NO: 86508 - DNA, 35 bp, Artificial Sequence
  Synthetic oligonucleotide
agatggtgcagagggagaacaaaagaaaaatacac

SEQ ID NO: 86509 - DNA, 35 bp, Artificial Sequence
  Synthetic oligonucleotide
gagactagccggccctctctattgcgaccgcccac

SEQ ID NO: 86510 - DNA, 35 bp, Artificial Sequence
  Synthetic oligonucleotide
gccactctgctggggtccgccacttaggtccgcac

SEQ ID NO: 86511 - DNA, 35 bp, Artificial Sequence
  Synthetic oligonucleotide
tatgacgctacatatacacgaaagaaacgatgcac

SEQ ID NO: 86512 - DNA, 35 bp, Artificial Sequence
  Synthetic oligonucleotide
gacgtacgcactgtattgattaaatcgagttcccc

SEQ ID NO: 86513 - DNA, 35 bp, Artificial Sequence
  Synthetic oligonucleotide
gtaagcagaccgtccttttcattgccctggttccc

SEQ ID NO: 86514 - DNA, 35 bp, Artificial Sequence
  Synthetic oligonucleotide
tgcaaaccctgctcctcacgcccataacttacgcc

SEQ ID NO: 86515 - DNA, 35 bp, Artificial Sequence
  Synthetic oligonucleotide
gtacttcctccctatcggttccgtgacggcgatcc

SEQ ID NO: 86516 - DNA, 35 bp, Artificial Sequence
  Synthetic oligonucleotide
agtcaccatgaatgccgacgaaataccagtggtcc

SEQ ID NO: 86517 - DNA, 35 bp, Artificial Sequence
  Synthetic oligonucleotide
agcaagacgcggcgctaccaaccgatcatctccgc

SEQ ID NO: 86518 - DNA, 35 bp, Artificial Sequence
  Synthetic oligonucleotide
agccacgccactaagttcgccctctaatcatgggc

SEQ ID NO: 86519 - DNA, 35 bp, Artificial Sequence
  Synthetic oligonucleotide
taacacaccactcgttcctgttgaccatgattatc

SEQ ID NO: 86520 - DNA, 35 bp, Artificial Sequence
  Synthetic oligonucleotide
tgcctaccgtaggtattaattgcgggttaccactc

SEQ ID NO: 86521 - DNA, 35 bp, Artificial Sequence
  Synthetic oligonucleotide
gacgagcatttcgtgtctcccatgagtcccacctc

SEQ ID NO: 86522 - DNA, 35 bp, Artificial Sequence
  Synthetic oligonucleotide
gccctggggagagtttttacgcacgaactgccctc

SEQ ID NO: 86523 - DNA, 35 bp, Artificial Sequence
  Synthetic oligonucleotide
taccacaccacgggtcgcaggaatatcggtccctc

SEQ ID NO: 86524 - DNA, 35 bp, Artificial Sequence
  Synthetic oligonucleotide
gatgcttgagtgccttctacttcttgggttttctc

SEQ ID NO: 86525 - DNA, 35 bp, Artificial Sequence
  Synthetic oligonucleotide
atccgccaccaccgaagctcgcgttggatgacttc

SEQ ID NO: 86526 - DNA, 35 bp, Artificial Sequence
  Synthetic oligonucleotide
acccacttcctgccttagccatgctcatacagttc

SEQ ID NO: 86527 - DNA, 35 bp, Artificial Sequence
  Synthetic oligonucleotide
gaacgcctgtgtccggtcgcgaggaccattctttc

SEQ ID NO: 86528 - DNA, 35 bp, Artificial Sequence
  Synthetic oligonucleotide
atgccgagccaaatactcttcgatgacagttggag

SEQ ID NO: 86529 - DNA, 35 bp, Artificial Sequence
  Synthetic oligonucleotide
atcgtgcgatccgttccttctccattggcttttag

SEQ ID NO: 86530 - DNA, 35 bp, Artificial Sequence
  Synthetic oligonucleotide
atcgcgccatcgcctcaattatcatcgggtttacg

SEQ ID NO: 86531 - DNA, 35 bp, Artificial Sequence
  Synthetic oligonucleotide
gcactgccaactaggcagggaacaggatgccatcg

SEQ ID NO: 86532 - DNA, 35 bp, Artificial Sequence
  Synthetic oligonucleotide
tccatccagcctctgaaccagtctaggtgtcaagg

SEQ ID NO: 86533 - DNA, 35 bp, Artificial Sequence
  Synthetic oligonucleotide
tgttgggcgaagtgtggggtctgtaaggtcggatg

SEQ ID NO: 86534 - DNA, 35 bp, Artificial Sequence
  Synthetic oligonucleotide
taaaccccaacaaagctcacgacagaatggacgtg

SEQ ID NO: 86535 - DNA, 35 bp, Artificial Sequence
  Synthetic oligonucleotide
gtacatcggtcgcgtttatagccccctcccgcgtg

SEQ ID NO: 86536 - DNA, 35 bp, Artificial Sequence
  Synthetic oligonucleotide
atggggggacaggagaggggttgccacgcgtcgtg

SEQ ID NO: 86537 - DNA, 35 bp, Artificial Sequence
  Synthetic oligonucleotide
agaacggcgggtgggtagagagcgataggttcttg

SEQ ID NO: 86538 - DNA, 35 bp, Artificial Sequence
  Synthetic oligonucleotide
ttactgctgcaggtggaagttattcgggttgtttg

SEQ ID NO: 86539 - DNA, 35 bp, Artificial Sequence
  Synthetic oligonucleotide
gcaatccgtgcgtgccgagcactgtacttttcaat

SEQ ID NO: 86540 - DNA, 35 bp, Artificial Sequence
  Synthetic oligonucleotide
gccgccaggcggaagcgcttaaacgcctgatacat

SEQ ID NO: 86541 - DNA, 35 bp, Artificial Sequence
  Synthetic oligonucleotide
tcctcagccgccgcctctcaacgcttagtcgccat

SEQ ID NO: 86542 - DNA, 35 bp, Artificial Sequence
  Synthetic oligonucleotide
ggggcatagtctcggtctgtcacgctccacaatct

SEQ ID NO: 86543 - DNA, 35 bp, Artificial Sequence
  Synthetic oligonucleotide
gatgcccacgcctttgcctgctctagtacctctct

SEQ ID NO: 86544 - DNA, 35 bp, Artificial Sequence
  Synthetic oligonucleotide
gcgcctgccagccggaccccattcttaatcacagt

SEQ ID NO: 86545 - DNA, 35 bp, Artificial Sequence
  Synthetic oligonucleotide
actagatgggggccgtttggcggaggaatggacgt

SEQ ID NO: 86546 - DNA, 35 bp, Artificial Sequence
  Synthetic oligonucleotide
ttaggtcatgtcactcttcctatgttttggtccgt

SEQ ID NO: 86547 - DNA, 35 bp, Artificial Sequence
  Synthetic oligonucleotide
agatgagagaggtggagggcggtcagtagcatcgt

SEQ ID NO: 86548 - DNA, 35 bp, Artificial Sequence
  Synthetic oligonucleotide
accacaggtacgggaataacgattgcggcggaggt

SEQ ID NO: 86549 - DNA, 35 bp, Artificial Sequence
  Synthetic oligonucleotide
tcaccaccgcaaccaccggaactgtaatttacctt

SEQ ID NO: 86550 - DNA, 35 bp, Artificial Sequence
  Synthetic oligonucleotide
agtgcactcctgaaaggtgattctgtccctgcctt

SEQ ID NO: 86551 - DNA, 35 bp, Artificial Sequence
  Synthetic oligonucleotide
ccggtcggagtggcactaagattctgccccctgtt

SEQ ID NO: 86552 - DNA, 35 bp, Artificial Sequence
  Synthetic oligonucleotide
tgcgtccccactgcctcagtgtaccggttctattt

SEQ ID NO: 86553 - DNA, 36 bp, Artificial Sequence
  Synthetic oligonucleotide
acaacctcaagatacccgccatataggcacctgaaa

SEQ ID NO: 86554 - DNA, 36 bp, Artificial Sequence
  Synthetic oligonucleotide
gtgcgggtgtcgcagaagagagggaaattgctgaaa

SEQ ID NO: 86555 - DNA, 35 bp, Artificial Sequence
  Synthetic oligonucleotide
ttccgaccccgcactgcccacgttctgctacccaa

SEQ ID NO: 86556 - DNA, 35 bp, Artificial Sequence
  Synthetic oligonucleotide
atgaaggataaggatataacggtggtagggaggaa

SEQ ID NO: 86557 - DNA, 36 bp, Artificial Sequence
  Synthetic oligonucleotide
agtggggcctaggggaatacatgcggaccgagggaa

SEQ ID NO: 86558 - DNA, 35 bp, Artificial Sequence
  Synthetic oligonucleotide
gggggagggatggaaagcacttgacgcaaggggaa

SEQ ID NO: 86559 - DNA, 36 bp, Artificial Sequence
  Synthetic oligonucleotide
gactacgcacacgtggggtctaacctgaaacatgaa

SEQ ID NO: 86560 - DNA, 35 bp, Artificial Sequence
  Synthetic oligonucleotide
attatcgacgtactcgtacttgaaccacagttgaa

SEQ ID NO: 86561 - DNA, 36 bp, Artificial Sequence
  Synthetic oligonucleotide
aaatcaccgcacattcattcgtagagcatacactaa

SEQ ID NO: 86562 - DNA, 36 bp, Artificial Sequence
  Synthetic oligonucleotide
acgccgccggtaggattcttttttgggttttggtaa

SEQ ID NO: 86563 - DNA, 36 bp, Artificial Sequence
  Synthetic oligonucleotide
gacacaaaggccgggtactctggtgatagggtaaca

SEQ ID NO: 86564 - DNA, 36 bp, Artificial Sequence
  Synthetic oligonucleotide
tatgcgagcagcatatctcaggtcgcacccttcaca

SEQ ID NO: 86565 - DNA, 35 bp, Artificial Sequence
  Synthetic oligonucleotide
gctggcgaagcacattaccattcgccccagttaca

SEQ ID NO: 86566 - DNA, 36 bp, Artificial Sequence
  Synthetic oligonucleotide
gagttcgacgcgaaccagagattcatagcaccccca

SEQ ID NO: 86567 - DNA, 35 bp, Artificial Sequence
  Synthetic oligonucleotide
tcgcccttccgttcctcagtgtagttctctgccca

SEQ ID NO: 86568 - DNA, 36 bp, Artificial Sequence
  Synthetic oligonucleotide
gagtgttcccgacctgtctattccgcatggcatcca

SEQ ID NO: 86569 - DNA, 36 bp, Artificial Sequence
  Synthetic oligonucleotide
gttgaccttgctcgcgtttatagcaccgttgccgca

SEQ ID NO: 86570 - DNA, 35 bp, Artificial Sequence
  Synthetic oligonucleotide
agtcactgagctgctgctaacacgccgacactgca

SEQ ID NO: 86571 - DNA, 36 bp, Artificial Sequence
  Synthetic oligonucleotide
acacctctgcagatggtgaggtaagggtgttaatca

SEQ ID NO: 86572 - DNA, 36 bp, Artificial Sequence
  Synthetic oligonucleotide
gatcagccccccttaaggttcactagctgttcatca

SEQ ID NO: 86573 - DNA, 35 bp, Artificial Sequence
  Synthetic oligonucleotide
gcctgatctgtaactatcccgctaccttatgttca

SEQ ID NO: 86574 - DNA, 37 bp, Artificial Sequence
  Synthetic oligonucleotide
gaaaggtgggttggccgagggagcctgcgaagaaaga

SEQ ID NO: 86575 - DNA, 37 bp, Artificial Sequence
  Synthetic oligonucleotide
gacgagtacggaagggtgttgggctggctgtatcaga

SEQ ID NO: 86576 - DNA, 37 bp, Artificial Sequence
  Synthetic oligonucleotide
gtagcgagggggggaagcaaagtgatcggaacagaga

SEQ ID NO: 86577 - DNA, 36 bp, Artificial Sequence
  Synthetic oligonucleotide
accgcccgtacaaacaatggtccgaacatcctgaga

SEQ ID NO: 86578 - DNA, 37 bp, Artificial Sequence
  Synthetic oligonucleotide
ggatcctcctgtgcctgcatcactccacttctataga

SEQ ID NO: 86579 - DNA, 36 bp, Artificial Sequence
  Synthetic oligonucleotide
gaaggggctgccgaagaaagcaggggtcggtataga

SEQ ID NO: 86580 - DNA, 36 bp, Artificial Sequence
  Synthetic oligonucleotide
tatgcctggggtggtattgagctggtaaggagtaga

SEQ ID NO: 86581 - DNA, 37 bp, Artificial Sequence
  Synthetic oligonucleotide
tcaacaaagcgcaaatccgtctgccccgacgagacga

SEQ ID NO: 86582 - DNA, 35 bp, Artificial Sequence
  Synthetic oligonucleotide
ttgtgaggacggagtggacgggtgaaacggtacga

SEQ ID NO: 86583 - DNA, 37 bp, Artificial Sequence
  Synthetic oligonucleotide
gacgctcaatacctcagtttcatcctaacttgtacga

SEQ ID NO: 86584 - DNA, 37 bp, Artificial Sequence
  Synthetic oligonucleotide
gcctagtgcctgtactgccgggaactcactccaccga

SEQ ID NO: 86585 - DNA, 37 bp, Artificial Sequence
  Synthetic oligonucleotide
tcaccaacctccgccgttctgaactgaggcatcccga

SEQ ID NO: 86586 - DNA, 37 bp, Artificial Sequence
  Synthetic oligonucleotide
tagggctcgctcaccactgctactgatccacctccga

SEQ ID NO: 86587 - DNA, 37 bp, Artificial Sequence
  Synthetic oligonucleotide
atagctgaggcaatggtcgcttgaagcaggagggcga

SEQ ID NO: 86588 - DNA, 35 bp, Artificial Sequence
  Synthetic oligonucleotide
tgcccccttcgtcatactcctcttgcccctggcga

SEQ ID NO: 86589 - DNA, 37 bp, Artificial Sequence
  Synthetic oligonucleotide
ctgaaacagacggccaatagacaacgatcatggtcga

SEQ ID NO: 86590 - DNA, 37 bp, Artificial Sequence
  Synthetic oligonucleotide
gttgaatcctcactttgtgcgttcgtgcctcattcga

SEQ ID NO: 86591 - DNA, 37 bp, Artificial Sequence
  Synthetic oligonucleotide
tccatagcgcagtcataccacagtcttgtcagttcga

SEQ ID NO: 86592 - DNA, 37 bp, Artificial Sequence
  Synthetic oligonucleotide
tgactaaaacgttcttcacgacgcgccatccccagga

SEQ ID NO: 86593 - DNA, 36 bp, Artificial Sequence
  Synthetic oligonucleotide
gctgcctgctgggctccgaccgtcttttctgcagga

SEQ ID NO: 86594 - DNA, 36 bp, Artificial Sequence
  Synthetic oligonucleotide
acagccgggaaatcagatgcaccacaacacaacgga

SEQ ID NO: 86595 - DNA, 36 bp, Artificial Sequence
  Synthetic oligonucleotide
gagggacggaaataggtttaaactgcctagagggga

SEQ ID NO: 86596 - DNA, 36 bp, Artificial Sequence
  Synthetic oligonucleotide
gcgatagatggggtgtggtgtgtgcgtgttgtggga

SEQ ID NO: 86597 - DNA, 37 bp, Artificial Sequence
  Synthetic oligonucleotide
tgacaatccacctctctgggtaactatgggccatgga

SEQ ID NO: 86598 - DNA, 37 bp, Artificial Sequence
  Synthetic oligonucleotide
gtcgcgtgggagggaggcactaagccaggggtatgga

SEQ ID NO: 86599 - DNA, 37 bp, Artificial Sequence
  Synthetic oligonucleotide
gtaactgcctggcccttaatatcacgtccgacctgga

SEQ ID NO: 86600 - DNA, 37 bp, Artificial Sequence
  Synthetic oligonucleotide
tacgaccactgtataggtgccgaaacgacattctgga

SEQ ID NO: 86601 - DNA, 37 bp, Artificial Sequence
  Synthetic oligonucleotide
gtcctccgccccaaccacagcctccaatctcagtgga

SEQ ID NO: 86602 - DNA, 36 bp, Artificial Sequence
  Synthetic oligonucleotide
gataaccgcgtggacgtcgccataccagccattgga

SEQ ID NO: 86603 - DNA, 37 bp, Artificial Sequence
  Synthetic oligonucleotide
tgtggcaccccttccgttccgttgattgccgcaatga

SEQ ID NO: 86604 - DNA, 38 bp, Artificial Sequence
  Synthetic oligonucleotide
agacccggccagcagtttctacttcagcctggcaatga

SEQ ID NO: 86605 - DNA, 38 bp, Artificial Sequence
  Synthetic oligonucleotide
tgtctcggccacccgcgaagactccactacctgcatga

SEQ ID NO: 86606 - DNA, 37 bp, Artificial Sequence
  Synthetic oligonucleotide
aagaccgtgcacatgtgatcctatcacggtttcatga

SEQ ID NO: 86607 - DNA, 38 bp, Artificial Sequence
  Synthetic oligonucleotide
gtcaagtgggggagtcgagggacgtagggaggagatga

SEQ ID NO: 86608 - DNA, 37 bp, Artificial Sequence
  Synthetic oligonucleotide
tcccacggcaatgtctcacgcttcactgcagtactga

SEQ ID NO: 86609 - DNA, 38 bp, Artificial Sequence
  Synthetic oligonucleotide
gtgcgaaccgacctgcaaacacgcatagtctcacctga

SEQ ID NO: 86610 - DNA, 38 bp, Artificial Sequence
  Synthetic oligonucleotide
gagtgacgacctgaacctccagcttttgctgtccctga

SEQ ID NO: 86611 - DNA, 38 bp, Artificial Sequence
  Synthetic oligonucleotide
gtacgcggatggtgcggtgggagggcgagtcgtgctga

SEQ ID NO: 86612 - DNA, 38 bp, Artificial Sequence
  Synthetic oligonucleotide
tgtgcaaccgcttgtttctctatctttacctccagtga

SEQ ID NO: 86613 - DNA, 37 bp, Artificial Sequence
  Synthetic oligonucleotide
ttaagccactccatcctgtctccacagtaacatgtga

SEQ ID NO: 86614 - DNA, 38 bp, Artificial Sequence
  Synthetic oligonucleotide
tttaccgcgccacctgtcacttttatcgacgaacttga

SEQ ID NO: 86615 - DNA, 38 bp, Artificial Sequence
  Synthetic oligonucleotide
gtccccgcatatcgtttcgttaggctccccccacttga

SEQ ID NO: 86616 - DNA, 38 bp, Artificial Sequence
  Synthetic oligonucleotide
ggaaccgagcgcaggaggagggtggtctgggtggttga

SEQ ID NO: 86617 - DNA, 37 bp, Artificial Sequence
  Synthetic oligonucleotide
gtcacgggggggtaattacggcggggaacaaatttga

SEQ ID NO: 86618 - DNA, 37 bp, Artificial Sequence
  Synthetic oligonucleotide
tgacgaacgcgaacagggcgtgcttcccatcatttga

SEQ ID NO: 86619 - DNA, 37 bp, Artificial Sequence
  Synthetic oligonucleotide
gatcaaccatcatacatgttcattccatccactttga

SEQ ID NO: 86620 - DNA, 37 bp, Artificial Sequence
  Synthetic oligonucleotide
gttcaccgagccccgttgagcccgcttatccctttga

SEQ ID NO: 86621 - DNA, 38 bp, Artificial Sequence
  Synthetic oligonucleotide
gtccagccactgctttttccgtgaaactccatgtttga

SEQ ID NO: 86622 - DNA, 36 bp, Artificial Sequence
  Synthetic oligonucleotide
tcaccatcgaacgattggtagggtaggcgggggata

SEQ ID NO: 86623 - DNA, 36 bp, Artificial Sequence
  Synthetic oligonucleotide
tgatcatgcgcatgtcgcactggccctatcgatata

SEQ ID NO: 86624 - DNA, 36 bp, Artificial Sequence
  Synthetic oligonucleotide
gatacccaccccttcttggcctgagcacactctata

SEQ ID NO: 86625 - DNA, 36 bp, Artificial Sequence
  Synthetic oligonucleotide
gggacacgaccgctgaccgctgtcacttgatttcta

SEQ ID NO: 86626 - DNA, 36 bp, Artificial Sequence
  Synthetic oligonucleotide
tacccatcgcttgctaggaagcacattcccgccgta

SEQ ID NO: 86627 - DNA, 36 bp, Artificial Sequence
  Synthetic oligonucleotide
ttgcattcctactcgattccctgcataacaccatta

SEQ ID NO: 86628 - DNA, 35 bp, Artificial Sequence
  Synthetic oligonucleotide
taggagacgtcgcagaacaacgggggcagaagtta

SEQ ID NO: 86629 - DNA, 35 bp, Artificial Sequence
  Synthetic oligonucleotide
acaggtcggcccgccgctgcctgtccctttcgtta

SEQ ID NO: 86630 - DNA, 35 bp, Artificial Sequence
  Synthetic oligonucleotide
aaccacgaggctgggaattcacgctttcaggccac

SEQ ID NO: 86631 - DNA, 36 bp, Artificial Sequence
  Synthetic oligonucleotide
tttgcctcagccctccgctcccagctaggccttcac

SEQ ID NO: 86632 - DNA, 35 bp, Artificial Sequence
  Synthetic oligonucleotide
gtccaccctgcatctatggcaaagtgttgttcacc

SEQ ID NO: 86633 - DNA, 35 bp, Artificial Sequence
  Synthetic oligonucleotide
accacaagtttgcagctgcacgtttttctttaccc

SEQ ID NO: 86634 - DNA, 35 bp, Artificial Sequence
  Synthetic oligonucleotide
gcttcatcgagtcagtaactgcgacgtgccacccc

SEQ ID NO: 86635 - DNA, 35 bp, Artificial Sequence
  Synthetic oligonucleotide
gagactccggccattgttgcaacatcttaagtccc

SEQ ID NO: 86636 - DNA, 35 bp, Artificial Sequence
  Synthetic oligonucleotide
tactgcgcttcggtgcctagcggtaggctatatcc

SEQ ID NO: 86637 - DNA, 35 bp, Artificial Sequence
  Synthetic oligonucleotide
tgcattcggtctatagccgcttgattcgatcctcc

SEQ ID NO: 86638 - DNA, 35 bp, Artificial Sequence
  Synthetic oligonucleotide
acgccacgcccatgtatccctctttgtttctgtcc

SEQ ID NO: 86639 - DNA, 35 bp, Artificial Sequence
  Synthetic oligonucleotide
gagccagcactcctttcctctctagcagtttgtcc

SEQ ID NO: 86640 - DNA, 35 bp, Artificial Sequence
  Synthetic oligonucleotide
tccgaggacgcatcggcttaatctgccttccacgc

SEQ ID NO: 86641 - DNA, 35 bp, Artificial Sequence
  Synthetic oligonucleotide
gttgcctcgtcctgtcttttgcctgtctagcacgc

SEQ ID NO: 86642 - DNA, 35 bp, Artificial Sequence
  Synthetic oligonucleotide
atgcctgcttcccttaatcaacatcgcacgtacgc

SEQ ID NO: 86643 - DNA, 35 bp, Artificial Sequence
  Synthetic oligonucleotide
gaccgtcgcactatgtgattagcctctcttaccgc

SEQ ID NO: 86644 - DNA, 35 bp, Artificial Sequence
  Synthetic oligonucleotide
ggtggagcccacccgtaattggactgtaccatcgc

SEQ ID NO: 86645 - DNA, 35 bp, Artificial Sequence
  Synthetic oligonucleotide
gcgcctgctccttgtattcagcgtcaactcccggc

SEQ ID NO: 86646 - DNA, 35 bp, Artificial Sequence
  Synthetic oligonucleotide
gtgacggactggaagacccccaatacgtgccatgc

SEQ ID NO: 86647 - DNA, 35 bp, Artificial Sequence
  Synthetic oligonucleotide
aactgccagcgtaatctctcgtcaagtacacctgc

SEQ ID NO: 86648 - DNA, 35 bp, Artificial Sequence
  Synthetic oligonucleotide
ataacgctgcactctccatatgccatggtgcaatc

SEQ ID NO: 86649 - DNA, 34 bp, Artificial Sequence
  Synthetic oligonucleotide
atacccacatggctaataccggttctgcaacatc

SEQ ID NO: 86650 - DNA, 36 bp, Artificial Sequence
  Synthetic oligonucleotide
ttgagcgacgcatcatcaggcacgacccggtacatc

SEQ ID NO: 86651 - DNA, 35 bp, Artificial Sequence
  Synthetic oligonucleotide
acttcactacgatgtcagcctgtgacctctccatc

SEQ ID NO: 86652 - DNA, 35 bp, Artificial Sequence
  Synthetic oligonucleotide
tactgagtgcatgattgtcatgtttcattgccctc

SEQ ID NO: 86653 - DNA, 35 bp, Artificial Sequence
  Synthetic oligonucleotide
ttggcgagaacatgatttggggggtggtgctggag

SEQ ID NO: 86654 - DNA, 35 bp, Artificial Sequence
  Synthetic oligonucleotide
aacgcaaacaagaggatgacggggacgtaggctag

SEQ ID NO: 86655 - DNA, 35 bp, Artificial Sequence
  Synthetic oligonucleotide
actaagcccaggcaaccagcatatccgctctcccg

SEQ ID NO: 86656 - DNA, 35 bp, Artificial Sequence
  Synthetic oligonucleotide
acgcgcacattaacatccgtagccaccggaacgcg

SEQ ID NO: 86657 - DNA, 35 bp, Artificial Sequence
  Synthetic oligonucleotide
tgaaatcgaagggttattgaggggatggaagggcg

SEQ ID NO: 86658 - DNA, 35 bp, Artificial Sequence
  Synthetic oligonucleotide
ggaccctctcagcacttgaatttcgccggcgtgcg

SEQ ID NO: 86659 - DNA, 35 bp, Artificial Sequence
  Synthetic oligonucleotide
ggtcgccatcactaccagactctgttaccccaagg

SEQ ID NO: 86660 - DNA, 36 bp, Artificial Sequence
  Synthetic oligonucleotide
ggggcgaatagtgggggttgaagcacggggcggagg

SEQ ID NO: 86661 - DNA, 35 bp, Artificial Sequence
  Synthetic oligonucleotide
gccaacggtctgcaaactcccacaattagagccgg

SEQ ID NO: 86662 - DNA, 35 bp, Artificial Sequence
  Synthetic oligonucleotide
tgctcacacacactggaccctaagcgtcaatccgg

SEQ ID NO: 86663 - DNA, 35 bp, Artificial Sequence
  Synthetic oligonucleotide
gaccgcaatgcgttaatactcggtaaaatttttgg

SEQ ID NO: 86664 - DNA, 35 bp, Artificial Sequence
  Synthetic oligonucleotide
agtacacaccctgacgcgttccagaccgcctaatg

SEQ ID NO: 86665 - DNA, 35 bp, Artificial Sequence
  Synthetic oligonucleotide
agtgcaggtacccatatccccagttctcccccgtg

SEQ ID NO: 86666 - DNA, 35 bp, Artificial Sequence
  Synthetic oligonucleotide
gacacgaacacggagggaatgactgatgcgcggtg

SEQ ID NO: 86667 - DNA, 35 bp, Artificial Sequence
  Synthetic oligonucleotide
tatggcacccgtactgaaccgtccgcgaacctgtg

SEQ ID NO: 86668 - DNA, 35 bp, Artificial Sequence
  Synthetic oligonucleotide
gcaatcggggagaacaagctaaagagagggcgaat

SEQ ID NO: 86669 - DNA, 35 bp, Artificial Sequence
  Synthetic oligonucleotide
gtctcgactgtacatcgcctgcctgacctatgaat

SEQ ID NO: 86670 - DNA, 35 bp, Artificial Sequence
  Synthetic oligonucleotide
ttgcgccccacgtaaggttcatgggatcttttcat

SEQ ID NO: 86671 - DNA, 35 bp, Artificial Sequence
  Synthetic oligonucleotide
gtacacagcagaagtcccatcgtgccgctctatat

SEQ ID NO: 86672 - DNA, 35 bp, Artificial Sequence
  Synthetic oligonucleotide
tatcactgacttgtgcatgaacgctacacatacct

SEQ ID NO: 86673 - DNA, 35 bp, Artificial Sequence
  Synthetic oligonucleotide
gcaatgcaccgattgctagtaaagtttactcccgt

SEQ ID NO: 86674 - DNA, 35 bp, Artificial Sequence
  Synthetic oligonucleotide
tttcacgcaccgaagggaatgtgtgttgttcccgt

SEQ ID NO: 86675 - DNA, 35 bp, Artificial Sequence
  Synthetic oligonucleotide
tacaccgaactcgatggccgtttcagctaggcctt

SEQ ID NO: 86676 - DNA, 35 bp, Artificial Sequence
  Synthetic oligonucleotide
atgaccgtattcgcggcatactaatcctcttgttt

SEQ ID NO: 86677 - DNA, 36 bp, Artificial Sequence
  Synthetic oligonucleotide
acaaccctctcgacactacgacttggacacgggaaa

SEQ ID NO: 86678 - DNA, 36 bp, Artificial Sequence
  Synthetic oligonucleotide
tcacaacacttcaggtgttgtccacccaggttccaa

SEQ ID NO: 86679 - DNA, 36 bp, Artificial Sequence
  Synthetic oligonucleotide
gaagccacgccaggggctccaaactacctaccggaa

SEQ ID NO: 86680 - DNA, 36 bp, Artificial Sequence
  Synthetic oligonucleotide
aactggcacagcgagaaaattgaggaagaattggaa

SEQ ID NO: 86681 - DNA, 36 bp, Artificial Sequence
  Synthetic oligonucleotide
gacaacccttggatggccccctcttgctgttcgtaa

SEQ ID NO: 86682 - DNA, 36 bp, Artificial Sequence
  Synthetic oligonucleotide
tcaggcaaacttgcctctgccatatggctaaccaca

SEQ ID NO: 86683 - DNA, 36 bp, Artificial Sequence
  Synthetic oligonucleotide
ggtcacaacctagctgtcgccacgttacactttaca

SEQ ID NO: 86684 - DNA, 36 bp, Artificial Sequence
  Synthetic oligonucleotide
taacgcttcatccctgctattgcgctacgttttaca

SEQ ID NO: 86685 - DNA, 35 bp, Artificial Sequence
  Synthetic oligonucleotide
ttgtctcgcaaacactcacgagctgaccagtacca

SEQ ID NO: 86686 - DNA, 35 bp, Artificial Sequence
  Synthetic oligonucleotide
tttctctgccgccggagcctaatccccacctgcca

SEQ ID NO: 86687 - DNA, 35 bp, Artificial Sequence
  Synthetic oligonucleotide
aaactgggtcgatctttcactgctcacctgtgcca

SEQ ID NO: 86688 - DNA, 35 bp, Artificial Sequence
  Synthetic oligonucleotide
taccgagcggaacctatacacgcactgccaatcca

SEQ ID NO: 86689 - DNA, 36 bp, Artificial Sequence
  Synthetic oligonucleotide
tgatctaccacccgatgtcatgcgatcttaacagca

SEQ ID NO: 86690 - DNA, 35 bp, Artificial Sequence
  Synthetic oligonucleotide
gtcgtacccttgcctcggactctccggtaggagca

SEQ ID NO: 86691 - DNA, 36 bp, Artificial Sequence
  Synthetic oligonucleotide
tatcctgccccatgcgagtacaacgacgtgatcgca

SEQ ID NO: 86692 - DNA, 35 bp, Artificial Sequence
  Synthetic oligonucleotide
taaaccacaccccaggacgcataccgttcggtgca

SEQ ID NO: 86693 - DNA, 36 bp, Artificial Sequence
  Synthetic oligonucleotide
tatgcacgatcgtatggcgcgggaggggagcaatca

SEQ ID NO: 86694 - DNA, 35 bp, Artificial Sequence
  Synthetic oligonucleotide
ttgcggtaccgccagccaaaatgctttcaccatca

SEQ ID NO: 86695 - DNA, 36 bp, Artificial Sequence
  Synthetic oligonucleotide
atccacctgttttgtggtgaagcttcgtatcactca

SEQ ID NO: 86696 - DNA, 35 bp, Artificial Sequence
  Synthetic oligonucleotide
tatcctgtacaccagtgaccgtacaatgcttctca

SEQ ID NO: 86697 - DNA, 35 bp, Artificial Sequence
  Synthetic oligonucleotide
tccacccaactcgcaatagtcacgcgagcacaaga

SEQ ID NO: 86698 - DNA, 36 bp, Artificial Sequence
  Synthetic oligonucleotide
gccccaagcctttacttcataggacagtagggaaga

SEQ ID NO: 86699 - DNA, 37 bp, Artificial Sequence
  Synthetic oligonucleotide
tgtcgaacaccgacaaaccttacctaagagacacaga

SEQ ID NO: 86700 - DNA, 37 bp, Artificial Sequence
  Synthetic oligonucleotide
tgatcaccttcccccgttctacgtcgcttataagaga

SEQ ID NO: 86701 - DNA, 37 bp, Artificial Sequence
  Synthetic oligonucleotide
gacagggagggaaactgatggccaacggtgggggaga

SEQ ID NO: 86702 - DNA, 37 bp, Artificial Sequence
  Synthetic oligonucleotide
ggtgatgataaagtggattgggtgagcgcggggtaga

SEQ ID NO: 86703 - DNA, 37 bp, Artificial Sequence
  Synthetic oligonucleotide
ttggaccagggtgagcgagaaacgaggatggtcacga

SEQ ID NO: 86704 - DNA, 37 bp, Artificial Sequence
  Synthetic oligonucleotide
ttcgtacgccggcaacgtacccgatcgcttacaccga

SEQ ID NO: 86705 - DNA, 37 bp, Artificial Sequence
  Synthetic oligonucleotide
gcgcacagccgcctcttatgcactatagggattccga

SEQ ID NO: 86706 - DNA, 37 bp, Artificial Sequence
  Synthetic oligonucleotide
gccaagcccgagccttatgcacacaatgacctgtcga

SEQ ID NO: 86707 - DNA, 37 bp, Artificial Sequence
  Synthetic oligonucleotide
gagagcaccaaggaattcaaagaagggctgttgtcga

SEQ ID NO: 86708 - DNA, 37 bp, Artificial Sequence
  Synthetic oligonucleotide
aacgccccctccaactcgtctagaccaccgggaagga

SEQ ID NO: 86709 - DNA, 37 bp, Artificial Sequence
  Synthetic oligonucleotide
agtggaggagagagtggtggtacagtatctgagagga

SEQ ID NO: 86710 - DNA, 37 bp, Artificial Sequence
  Synthetic oligonucleotide
gtttgcacgggccatgagaatgggacatttgagagga

SEQ ID NO: 86711 - DNA, 36 bp, Artificial Sequence
  Synthetic oligonucleotide
gaagggtgggtggttcaattggccgtgtgtagagga

SEQ ID NO: 86712 - DNA, 37 bp, Artificial Sequence
  Synthetic oligonucleotide
gggtgagaccgaagattgaggaagtcgatgaatagga

SEQ ID NO: 86713 - DNA, 35 bp, Artificial Sequence
  Synthetic oligonucleotide
gacccgagtcaggaagcgggagctgggggggcgga

SEQ ID NO: 86714 - DNA, 37 bp, Artificial Sequence
  Synthetic oligonucleotide
gtggattgtattcaaagtgtgtacgctcctcctcgga

SEQ ID NO: 86715 - DNA, 36 bp, Artificial Sequence
  Synthetic oligonucleotide
atctattccccgccgcatgcacgttccaccaaggga

SEQ ID NO: 86716 - DNA, 37 bp, Artificial Sequence
  Synthetic oligonucleotide
agccgggagcggctggtaggggcggggcggggaggga

SEQ ID NO: 86717 - DNA, 36 bp, Artificial Sequence
  Synthetic oligonucleotide
ttcggggggggaacatcaggcgaagagggaggggga

SEQ ID NO: 86718 - DNA, 37 bp, Artificial Sequence
  Synthetic oligonucleotide
gtggggggagaggaagtgcttctgtggcgtctgggga

SEQ ID NO: 86719 - DNA, 37 bp, Artificial Sequence
  Synthetic oligonucleotide
gacacgccacccgaccggaccatacaatgaggatgga

SEQ ID NO: 86720 - DNA, 37 bp, Artificial Sequence
  Synthetic oligonucleotide
actgatcctctgcaagtgcaaaaaccaaccatatgga

SEQ ID NO: 86721 - DNA, 37 bp, Artificial Sequence
  Synthetic oligonucleotide
tagaatagcgtaacttgttcaccaccctccttctgga

SEQ ID NO: 86722 - DNA, 37 bp, Artificial Sequence
  Synthetic oligonucleotide
tcgctcctgcccatctcgccggtacactttcagtgga

SEQ ID NO: 86723 - DNA, 36 bp, Artificial Sequence
  Synthetic oligonucleotide
tgcctagccaactgggggtttgaggtgaggggtgga

SEQ ID NO: 86724 - DNA, 37 bp, Artificial Sequence
  Synthetic oligonucleotide
tatgacgcggttcgggttagaacggtagctgattgga

SEQ ID NO: 86725 - DNA, 37 bp, Artificial Sequence
  Synthetic oligonucleotide
ttcgcaatctgccctgccgtgtttcatctatcaatga

SEQ ID NO: 86726 - DNA, 38 bp, Artificial Sequence
  Synthetic oligonucleotide
gaatgcacgccgtctcgctctacgcctcccgtcgatga

SEQ ID NO: 86727 - DNA, 37 bp, Artificial Sequence
  Synthetic oligonucleotide
gacgaagaggtcctgtgggatgaggggttaatgatga

SEQ ID NO: 86728 - DNA, 36 bp, Artificial Sequence
  Synthetic oligonucleotide
tccaccctatcttccgcagcgcgacttatcttatga

SEQ ID NO: 86729 - DNA, 38 bp, Artificial Sequence
  Synthetic oligonucleotide
gtgtggtgcggaaattgaccaggggacggggaaactga

SEQ ID NO: 86730 - DNA, 36 bp, Artificial Sequence
  Synthetic oligonucleotide
agaacgggatggtgggctgaaggcgggatgaactga

SEQ ID NO: 86731 - DNA, 38 bp, Artificial Sequence
  Synthetic oligonucleotide
tgtgggcaactggctccgttggaaactttgggtactga

SEQ ID NO: 86732 - DNA, 37 bp, Artificial Sequence
  Synthetic oligonucleotide
tacgaccatgccacaggccaagcctatgaactcctga

SEQ ID NO: 86733 - DNA, 38 bp, Artificial Sequence
  Synthetic oligonucleotide
acgtacagattcaggagaggggtgagggtttcggctga

SEQ ID NO: 86734 - DNA, 36 bp, Artificial Sequence
  Synthetic oligonucleotide
tacacacttggctcccggggttctgttctactctga

SEQ ID NO: 86735 - DNA, 37 bp, Artificial Sequence
  Synthetic oligonucleotide
acgaatcctgccatatggtgcaccccccttttagtga

SEQ ID NO: 86736 - DNA, 38 bp, Artificial Sequence
  Synthetic oligonucleotide
gaactcagaaaagatggggggcaaaggggtgcacgtga

SEQ ID NO: 86737 - DNA, 38 bp, Artificial Sequence
  Synthetic oligonucleotide
gttcccctcccagacctatattgtgtccccacaggtga

SEQ ID NO: 86738 - DNA, 38 bp, Artificial Sequence
  Synthetic oligonucleotide
tctgtgtgcccaattggttgtcctgtattctccggtga

SEQ ID NO: 86739 - DNA, 38 bp, Artificial Sequence
  Synthetic oligonucleotide
tgtcatggaagagcgattcagtgggcgggtgtgggtga

SEQ ID NO: 86740 - DNA, 37 bp, Artificial Sequence
  Synthetic oligonucleotide
gaacgtggacgggtatcgtaacgggtatggatggtga

SEQ ID NO: 86741 - DNA, 37 bp, Artificial Sequence
  Synthetic oligonucleotide
gcccagaagcccttgccactgcctctattcttggtga

SEQ ID NO: 86742 - DNA, 37 bp, Artificial Sequence
  Synthetic oligonucleotide
tgatgtgcctgtacgagttggagcggagtgactgtga

SEQ ID NO: 86743 - DNA, 37 bp, Artificial Sequence
  Synthetic oligonucleotide
acgccgaccggagattcttgttagcccgcccttgtga

SEQ ID NO: 86744 - DNA, 37 bp, Artificial Sequence
  Synthetic oligonucleotide
gacagtgtgacgccgcaggtaagtcacaatatattga

SEQ ID NO: 86745 - DNA, 38 bp, Artificial Sequence
  Synthetic oligonucleotide
tgatatgcaaaggcaaggaagcgggggagacgtattga

SEQ ID NO: 86746 - DNA, 36 bp, Artificial Sequence
  Synthetic oligonucleotide
gctggccacccgctggagaaccctggtcacccttga

SEQ ID NO: 86747 - DNA, 38 bp, Artificial Sequence
  Synthetic oligonucleotide
acaacatgtccctcgatagattagcactccttcgttga

SEQ ID NO: 86748 - DNA, 38 bp, Artificial Sequence
  Synthetic oligonucleotide
accggggacgcctctgcctctgaaattgcctgtgttga

SEQ ID NO: 86749 - DNA, 38 bp, Artificial Sequence
  Synthetic oligonucleotide
tcactggccttccgtcgatagctcgccctactctttga

SEQ ID NO: 86750 - DNA, 38 bp, Artificial Sequence
  Synthetic oligonucleotide
gctggagacagcacgcagtggagaatagatcggtttga

SEQ ID NO: 86751 - DNA, 36 bp, Artificial Sequence
  Synthetic oligonucleotide
tgaattggccatccttgatagattaccgtgcccata

SEQ ID NO: 86752 - DNA, 35 bp, Artificial Sequence
  Synthetic oligonucleotide
tcatgacaaaaggggacaacaagaaggtgcggata

SEQ ID NO: 86753 - DNA, 35 bp, Artificial Sequence
  Synthetic oligonucleotide
aatgaagggcggggagagggtcactcgcggggata

SEQ ID NO: 86754 - DNA, 36 bp, Artificial Sequence
  Synthetic oligonucleotide
accaccactccgaattcgtttctggctactatccta

SEQ ID NO: 86755 - DNA, 36 bp, Artificial Sequence
  Synthetic oligonucleotide
agtacgctacccacatcagcatggaatgaccagcta

SEQ ID NO: 86756 - DNA, 35 bp, Artificial Sequence
  Synthetic oligonucleotide
tctctcgacgctggctgctgcgatcacccgctcta

SEQ ID NO: 86757 - DNA, 36 bp, Artificial Sequence
  Synthetic oligonucleotide
tccgccctcctggagctgtgcctcgtaacttgcgta

SEQ ID NO: 86758 - DNA, 36 bp, Artificial Sequence
  Synthetic oligonucleotide
agcaacgcgccccccgagatacgagtttcgccttta

SEQ ID NO: 86759 - DNA, 35 bp, Artificial Sequence
  Synthetic oligonucleotide
gtccgtcgatcgtctccctactcctgcatatacac

SEQ ID NO: 86760 - DNA, 35 bp, Artificial Sequence
  Synthetic oligonucleotide
gctcagcccgtacctgaggggcgatttaataccac

SEQ ID NO: 86761 - DNA, 35 bp, Artificial Sequence
  Synthetic oligonucleotide
gttgggccatcaacgtttttttactcacagtagac

SEQ ID NO: 86762 - DNA, 35 bp, Artificial Sequence
  Synthetic oligonucleotide
atcctgtcccgacgatctgcccgctaaatcccgac

SEQ ID NO: 86763 - DNA, 35 bp, Artificial Sequence
  Synthetic oligonucleotide
tcatccgcactctggtcctggcactacctacggac

SEQ ID NO: 86764 - DNA, 35 bp, Artificial Sequence
  Synthetic oligonucleotide
attgaccgccacaagcgcaagacacctatacctac

SEQ ID NO: 86765 - DNA, 35 bp, Artificial Sequence
  Synthetic oligonucleotide
actgagcatcgtactccttgtagcatctgccgtac

SEQ ID NO: 86766 - DNA, 35 bp, Artificial Sequence
  Synthetic oligonucleotide
gctgggtgggcggagaacaggtaaaagtggggtac

SEQ ID NO: 86767 - DNA, 35 bp, Artificial Sequence
  Synthetic oligonucleotide
tgactacacatacccacgagtcgtgaggttcaccc

SEQ ID NO: 86768 - DNA, 33 bp, Artificial Sequence
  Synthetic oligonucleotide
ttacacgccacaggctcgtgccctcactatccc

SEQ ID NO: 86769 - DNA, 35 bp, Artificial Sequence
  Synthetic oligonucleotide
ttgaccccgcctgttctctcctatagtgacctccc

SEQ ID NO: 86770 - DNA, 35 bp, Artificial Sequence
  Synthetic oligonucleotide
atcctccgcggatacataactggacctgtctcgcc

SEQ ID NO: 86771 - DNA, 35 bp, Artificial Sequence
  Synthetic oligonucleotide
gaatatgcccgtctctcgtcgattctatctatgcc

SEQ ID NO: 86772 - DNA, 35 bp, Artificial Sequence
  Synthetic oligonucleotide
tacgaaccgactttgccaattgaggaccttctgcc

SEQ ID NO: 86773 - DNA, 35 bp, Artificial Sequence
  Synthetic oligonucleotide
tatgaggagccaggtcgccatcgaactgttctgcc

SEQ ID NO: 86774 - DNA, 35 bp, Artificial Sequence
  Synthetic oligonucleotide
gtgttcactgcaacggcccatttcggcacacctcc

SEQ ID NO: 86775 - DNA, 35 bp, Artificial Sequence
  Synthetic oligonucleotide
tcgataccgaacagcaacacgacatcatcgcgtcc

SEQ ID NO: 86776 - DNA, 35 bp, Artificial Sequence
  Synthetic oligonucleotide
tcccgtgtaggtgcttaccgttagtcctgctttcc

SEQ ID NO: 86777 - DNA, 35 bp, Artificial Sequence
  Synthetic oligonucleotide
tgcaattcccccacgtttacctcgccgaacgtagc

SEQ ID NO: 86778 - DNA, 35 bp, Artificial Sequence
  Synthetic oligonucleotide
taaccaactcactcgttacgaaatggccatcacgc

SEQ ID NO: 86779 - DNA, 35 bp, Artificial Sequence
  Synthetic oligonucleotide
actcaaccgccaacacccccatcggtatgaccatc

SEQ ID NO: 86780 - DNA, 35 bp, Artificial Sequence
  Synthetic oligonucleotide
atcagaggccgagaatcgcctacaatgactacctc

SEQ ID NO: 86781 - DNA, 35 bp, Artificial Sequence
  Synthetic oligonucleotide
ggtgagcggcctgcggtcgcttaatcctcctcctc

SEQ ID NO: 86782 - DNA, 35 bp, Artificial Sequence
  Synthetic oligonucleotide
acatctgtgaccagtagagtcctccgtctccgctc

SEQ ID NO: 86783 - DNA, 35 bp, Artificial Sequence
  Synthetic oligonucleotide
acttgggcttccgacccattctagagctgttgctc

SEQ ID NO: 86784 - DNA, 35 bp, Artificial Sequence
  Synthetic oligonucleotide
gcagtcacatatcttatcagctgagtcccgccgtc

SEQ ID NO: 86785 - DNA, 35 bp, Artificial Sequence
  Synthetic oligonucleotide
acgtacaccagctaccctttgctcgtttaaatgtc

SEQ ID NO: 86786 - DNA, 35 bp, Artificial Sequence
  Synthetic oligonucleotide
gacgccatgatgtatcgatcatcgcatttctgttc

SEQ ID NO: 86787 - DNA, 35 bp, Artificial Sequence
  Synthetic oligonucleotide
ggtacgacggtgttaaaagggggggggcgggccag

SEQ ID NO: 86788 - DNA, 35 bp, Artificial Sequence
  Synthetic oligonucleotide
aatccagggtggctgaagtgcaatttggtgctcag

SEQ ID NO: 86789 - DNA, 35 bp, Artificial Sequence
  Synthetic oligonucleotide
gttgggtcaattagcagtacttccctctcccgacg

SEQ ID NO: 86790 - DNA, 35 bp, Artificial Sequence
  Synthetic oligonucleotide
gcgggatcacccattggcccttcctgttgttagcg

SEQ ID NO: 86791 - DNA, 35 bp, Artificial Sequence
  Synthetic oligonucleotide
gactgacggcgtggtatcaatcatggggcgtggcg

SEQ ID NO: 86792 - DNA, 35 bp, Artificial Sequence
  Synthetic oligonucleotide
tgccgccgtcgctcccagttatctctgaaggctcg

SEQ ID NO: 86793 - DNA, 35 bp, Artificial Sequence
  Synthetic oligonucleotide
gaaggtacaagtggaatggcgtaggaattgtcagg

SEQ ID NO: 86794 - DNA, 35 bp, Artificial Sequence
  Synthetic oligonucleotide
gcaacactccgcgtgcccatccgcttcttggtagg

SEQ ID NO: 86795 - DNA, 35 bp, Artificial Sequence
  Synthetic oligonucleotide
aagtgggcaagaaaaggactatcagggctaagggg

SEQ ID NO: 86796 - DNA, 35 bp, Artificial Sequence
  Synthetic oligonucleotide
tgcaccaggattgtcatttctttctcttcgttggg

SEQ ID NO: 86797 - DNA, 35 bp, Artificial Sequence
  Synthetic oligonucleotide
tacgtaatccgaccctgctacccgtccatctaatg

SEQ ID NO: 86798 - DNA, 35 bp, Artificial Sequence
  Synthetic oligonucleotide
tgtgcttcagatagcacctacccttgtcaactatg

SEQ ID NO: 86799 - DNA, 35 bp, Artificial Sequence
  Synthetic oligonucleotide
gtcatccgagtttccctgcttacatttctggactg

SEQ ID NO: 86800 - DNA, 35 bp, Artificial Sequence
  Synthetic oligonucleotide
gagacttcgcctaggccacctacatacttgtcctg

SEQ ID NO: 86801 - DNA, 35 bp, Artificial Sequence
  Synthetic oligonucleotide
aaaggccggacacattctttctcctgcattatttg

SEQ ID NO: 86802 - DNA, 35 bp, Artificial Sequence
  Synthetic oligonucleotide
gcaaacagccgctgggtttctcgggctcatttttg

SEQ ID NO: 86803 - DNA, 35 bp, Artificial Sequence
  Synthetic oligonucleotide
atcacatgccccacacagtaggttgctattttaat

SEQ ID NO: 86804 - DNA, 35 bp, Artificial Sequence
  Synthetic oligonucleotide
tcatgcgcatttgcagggtttaacatccaatccat

SEQ ID NO: 86805 - DNA, 35 bp, Artificial Sequence
  Synthetic oligonucleotide
gaggatccgttcacgtcgtaatcctttctcctcat

SEQ ID NO: 86806 - DNA, 34 bp, Artificial Sequence
  Synthetic oligonucleotide
attccccccaccttatcgtggtttcaccacagat

SEQ ID NO: 86807 - DNA, 35 bp, Artificial Sequence
  Synthetic oligonucleotide
tgactccctgccgatttctggtgactttatcatat

SEQ ID NO: 86808 - DNA, 35 bp, Artificial Sequence
  Synthetic oligonucleotide
gccccagacatcgtacggttacgcaatactaaact

SEQ ID NO: 86809 - DNA, 35 bp, Artificial Sequence
  Synthetic oligonucleotide
tgctactgcgtacaaaggcaaaccaagcaccaact

SEQ ID NO: 86810 - DNA, 35 bp, Artificial Sequence
  Synthetic oligonucleotide
gtctgcacccgtcgtgcggcctgttctcttctcct

SEQ ID NO: 86811 - DNA, 35 bp, Artificial Sequence
  Synthetic oligonucleotide
gtgcccagactgaagttccgcgcaggttttttcct

SEQ ID NO: 86812 - DNA, 35 bp, Artificial Sequence
  Synthetic oligonucleotide
agagcgcagggttgtcggcaattacctctttcgct

SEQ ID NO: 86813 - DNA, 35 bp, Artificial Sequence
  Synthetic oligonucleotide
agcccatctcccgtggacgcccagtcactctttct

SEQ ID NO: 86814 - DNA, 35 bp, Artificial Sequence
  Synthetic oligonucleotide
acgatcccaccactgcggtcaacacatccctacgt

SEQ ID NO: 86815 - DNA, 35 bp, Artificial Sequence
  Synthetic oligonucleotide
gccaacagggcgagataggagtattgctttgccgt

SEQ ID NO: 86816 - DNA, 35 bp, Artificial Sequence
  Synthetic oligonucleotide
tatctacctcgtattcccccccgccagcctggggt

SEQ ID NO: 86817 - DNA, 35 bp, Artificial Sequence
  Synthetic oligonucleotide
gcttgggcctcattacgctccacctcgtgacatgt

SEQ ID NO: 86818 - DNA, 35 bp, Artificial Sequence
  Synthetic oligonucleotide
gttcacgggccactgaccgaccttcataaatctgt

SEQ ID NO: 86819 - DNA, 35 bp, Artificial Sequence
  Synthetic oligonucleotide
agtgacacttaccccagcgcctgctctccatttgt

SEQ ID NO: 86820 - DNA, 35 bp, Artificial Sequence
  Synthetic oligonucleotide
gtcactcgcacggctatcaaataggtttcggtatt

SEQ ID NO: 86821 - DNA, 35 bp, Artificial Sequence
  Synthetic oligonucleotide
atggagagccgccctgccgtcacacccgtcatttt

SEQ ID NO: 86822 - DNA, 35 bp, Artificial Sequence
  Synthetic oligonucleotide
gtcgccgtcgcacacctatgccaagtagccgtttt

SEQ ID NO: 86823 - DNA, 34 bp, Artificial Sequence
  Synthetic oligonucleotide
gaggtgacggaaggaggcgctgggcgaaaaaaaa

SEQ ID NO: 86824 - DNA, 36 bp, Artificial Sequence
  Synthetic oligonucleotide
actcgccgtctgtatgtcatagtccctcttgccgaa

SEQ ID NO: 86825 - DNA, 36 bp, Artificial Sequence
  Synthetic oligonucleotide
tcctacagaccgctctacatggtgcaaaatctcgaa

SEQ ID NO: 86826 - DNA, 36 bp, Artificial Sequence
  Synthetic oligonucleotide
gatgcgcgtaaatggcgcccaggtgaaaggcatgaa

SEQ ID NO: 86827 - DNA, 35 bp, Artificial Sequence
  Synthetic oligonucleotide
atccacataggcgcacattgacaccagcagggtaa

SEQ ID NO: 86828 - DNA, 36 bp, Artificial Sequence
  Synthetic oligonucleotide
gtcaccactaacacacatggactccagcttgattaa

SEQ ID NO: 86829 - DNA, 36 bp, Artificial Sequence
  Synthetic oligonucleotide
gaccaccggtcactacacttcaagccctgttcttaa

SEQ ID NO: 86830 - DNA, 36 bp, Artificial Sequence
  Synthetic oligonucleotide
ttgtcgctcctagacgccagcatatcttttaacaca

SEQ ID NO: 86831 - DNA, 35 bp, Artificial Sequence
  Synthetic oligonucleotide
gacatggtgaccctggtaatcgtgtgaatatcaca

SEQ ID NO: 86832 - DNA, 35 bp, Artificial Sequence
  Synthetic oligonucleotide
tctacctgccggcaatcaatctcaaacggtctaca

SEQ ID NO: 86833 - DNA, 36 bp, Artificial Sequence
  Synthetic oligonucleotide
taacaacccagccatctagcatataaatgcgttaca

SEQ ID NO: 86834 - DNA, 36 bp, Artificial Sequence
  Synthetic oligonucleotide
gctaacttccgttccgacctgctattctatggacca

SEQ ID NO: 86835 - DNA, 36 bp, Artificial Sequence
  Synthetic oligonucleotide
gcttaccatccgtggcggcccagtgaatgatattca

SEQ ID NO: 86836 - DNA, 36 bp, Artificial Sequence
  Synthetic oligonucleotide
tcacgcgtagagccgacaagcggaacgacttattca

SEQ ID NO: 86837 - DNA, 35 bp, Artificial Sequence
  Synthetic oligonucleotide
tgtagaacgacccgtgcgattagttctttccttca

SEQ ID NO: 86838 - DNA, 36 bp, Artificial Sequence
  Synthetic oligonucleotide
acccgaaccccaggtggtggtgctacaaaatcttca

SEQ ID NO: 86839 - DNA, 34 bp, Artificial Sequence
  Synthetic oligonucleotide
aacgggacgcaacggagttgaactaattctttca

SEQ ID NO: 86840 - DNA, 36 bp, Artificial Sequence
  Synthetic oligonucleotide
gtcatgggggcgataacttagggatggcaggaaaga

SEQ ID NO: 86841 - DNA, 37 bp, Artificial Sequence
  Synthetic oligonucleotide
gtcgagatgcagggggggattagggttcgcttgaaga

SEQ ID NO: 86842 - DNA, 37 bp, Artificial Sequence
  Synthetic oligonucleotide
actgctgccctaatgtactgcggatttcctgaccaga

SEQ ID NO: 86843 - DNA, 37 bp, Artificial Sequence
  Synthetic oligonucleotide
gaagacgtccggttcaatagcagagaagatggccaga

SEQ ID NO: 86844 - DNA, 37 bp, Artificial Sequence
  Synthetic oligonucleotide
tgtcataccccattgctgcaataacatatactcgaga

SEQ ID NO: 86845 - DNA, 37 bp, Artificial Sequence
  Synthetic oligonucleotide
atgtgcaacgcctcgtctttgttatcaaccttggaga

SEQ ID NO: 86846 - DNA, 37 bp, Artificial Sequence
  Synthetic oligonucleotide
tcaagcgctgcactctataccctgttagttcacacga

SEQ ID NO: 86847 - DNA, 37 bp, Artificial Sequence
  Synthetic oligonucleotide
aatgcacattcgcttacgacgcacctgaaatacccga

SEQ ID NO: 86848 - DNA, 34 bp, Artificial Sequence
  Synthetic oligonucleotide
tgccgccacagcaaatcgtatgcctgctacccga

SEQ ID NO: 86849 - DNA, 37 bp, Artificial Sequence
  Synthetic oligonucleotide
acatcccgacatccggtgtgctacactcttttcccga

SEQ ID NO: 86850 - DNA, 36 bp, Artificial Sequence
  Synthetic oligonucleotide
tctgccctcaagccagcccgtgccaatcccgtccga

SEQ ID NO: 86851 - DNA, 37 bp, Artificial Sequence
  Synthetic oligonucleotide
ttcacgatcgtaacggtccttaggtgtgttctatcga

SEQ ID NO: 86852 - DNA, 36 bp, Artificial Sequence
  Synthetic oligonucleotide
gaaggggggggtacaggctgctgaggtcgcctagga

SEQ ID NO: 86853 - DNA, 37 bp, Artificial Sequence
  Synthetic oligonucleotide
ttgggtaccctactgaatgcatacacgactcctcgga

SEQ ID NO: 86854 - DNA, 37 bp, Artificial Sequence
  Synthetic oligonucleotide
acccggtgagatgataggcggggtgggaggccatgga

SEQ ID NO: 86855 - DNA, 37 bp, Artificial Sequence
  Synthetic oligonucleotide
gtgacgctgaacaactgctgtactggggtgaactgga

SEQ ID NO: 86856 - DNA, 36 bp, Artificial Sequence
  Synthetic oligonucleotide
atcccccatcgctagctataggagtctgtccgtgga

SEQ ID NO: 86857 - DNA, 37 bp, Artificial Sequence
  Synthetic oligonucleotide
atagggagggtcgggatcgagagttaggaaaattgga

SEQ ID NO: 86858 - DNA, 37 bp, Artificial Sequence
  Synthetic oligonucleotide
gcgcggagttggtggtgcttcggagggggatgaatga

SEQ ID NO: 86859 - DNA, 37 bp, Artificial Sequence
  Synthetic oligonucleotide
gtacgagtggagggggaagagtatacgatcggcatga

SEQ ID NO: 86860 - DNA, 38 bp, Artificial Sequence
  Synthetic oligonucleotide
gtagccagagagtgagaggggacggcctaggttgatga

SEQ ID NO: 86861 - DNA, 37 bp, Artificial Sequence
  Synthetic oligonucleotide
tacggagagggatcgggggcaagaaaacctcatatga

SEQ ID NO: 86862 - DNA, 37 bp, Artificial Sequence
  Synthetic oligonucleotide
tcacgcattaggtgggtgggcctcactgctgcactga

SEQ ID NO: 86863 - DNA, 38 bp, Artificial Sequence
  Synthetic oligonucleotide
gccacgatccgacgtattggattggttacgccccctga

SEQ ID NO: 86864 - DNA, 35 bp, Artificial Sequence
  Synthetic oligonucleotide
accacccatgtcgagcgggtcgccccctcccctga

SEQ ID NO: 86865 - DNA, 38 bp, Artificial Sequence
  Synthetic oligonucleotide
gatcagatcgcttgctctattttgttgatgctccctga

SEQ ID NO: 86866 - DNA, 35 bp, Artificial Sequence
  Synthetic oligonucleotide
ttacgccacccgaaggcctgagattatcttcctga

SEQ ID NO: 86867 - DNA, 37 bp, Artificial Sequence
  Synthetic oligonucleotide
gtatgcgcaagggggtgcgcggggacaagagatctga

SEQ ID NO: 86868 - DNA, 38 bp, Artificial Sequence
  Synthetic oligonucleotide
gcagggaggaacaagattagatgcgggtaaaaaagtga

SEQ ID NO: 86869 - DNA, 36 bp, Artificial Sequence
  Synthetic oligonucleotide
tgactcatcctgctttaaatctatcgcacacggtga

SEQ ID NO: 86870 - DNA, 38 bp, Artificial Sequence
  Synthetic oligonucleotide
gagcacatcaggacgaggttcgtagcggggattggtga

SEQ ID NO: 86871 - DNA, 38 bp, Artificial Sequence
  Synthetic oligonucleotide
gccactgtccagtcgttttcgtccatagttacatgtga

SEQ ID NO: 86872 - DNA, 37 bp, Artificial Sequence
  Synthetic oligonucleotide
gaccgccatcggttttgccattcctctccgggtgtga

SEQ ID NO: 86873 - DNA, 38 bp, Artificial Sequence
  Synthetic oligonucleotide
gaccacggaagtggtgggggacataatagactgtgtga

SEQ ID NO: 86874 - DNA, 38 bp, Artificial Sequence
  Synthetic oligonucleotide
gtccagtccgagaggagggaatggtgcgggaaaattga

SEQ ID NO: 86875 - DNA, 37 bp, Artificial Sequence
  Synthetic oligonucleotide
tagtgtgcagataaggccccccctcaattaggattga

SEQ ID NO: 86876 - DNA, 36 bp, Artificial Sequence
  Synthetic oligonucleotide
gacgccccctccattctgttttggcatttgacttga

SEQ ID NO: 86877 - DNA, 38 bp, Artificial Sequence
  Synthetic oligonucleotide
aagccgctggcggtttcaaagtcactcccttaccttga

SEQ ID NO: 86878 - DNA, 37 bp, Artificial Sequence
  Synthetic oligonucleotide
acccaccccccaactgcacgtgttgtcgctcccttga

SEQ ID NO: 86879 - DNA, 38 bp, Artificial Sequence
  Synthetic oligonucleotide
gatgcacgttgtgatggcgttctgttttggatgcttga

SEQ ID NO: 86880 - DNA, 36 bp, Artificial Sequence
  Synthetic oligonucleotide
gaccgccgaagcctcctaaggccatacattgcttga

SEQ ID NO: 86881 - DNA, 38 bp, Artificial Sequence
  Synthetic oligonucleotide
acttcgcacgaggtacgtacgctgatactccttcttga

SEQ ID NO: 86882 - DNA, 37 bp, Artificial Sequence
  Synthetic oligonucleotide
tccagtgacggcctcgcaaatagcccatcgaagttga

SEQ ID NO: 86883 - DNA, 38 bp, Artificial Sequence
  Synthetic oligonucleotide
gtggaacgcacaagggctggtgggtgttgtctagttga

SEQ ID NO: 86884 - DNA, 37 bp, Artificial Sequence
  Synthetic oligonucleotide
tatagggcaggagtgggcatgatgagtggtgggttga

SEQ ID NO: 86885 - DNA, 37 bp, Artificial Sequence
  Synthetic oligonucleotide
aatgagcctgtgcagttgcgggcgtggtggctgttga

SEQ ID NO: 86886 - DNA, 38 bp, Artificial Sequence
  Synthetic oligonucleotide
gaagagcgtggaaaggcaagggttgcaaaattatttga

SEQ ID NO: 86887 - DNA, 38 bp, Artificial Sequence
  Synthetic oligonucleotide
tacgcaccacagtaccggtaatacaccgaggcctttga

SEQ ID NO: 86888 - DNA, 37 bp, Artificial Sequence
  Synthetic oligonucleotide
tcaactcatcgctatgttcgttcgaacgactctttga

SEQ ID NO: 86889 - DNA, 37 bp, Artificial Sequence
  Synthetic oligonucleotide
gaccatgccccacgcgcctatttgtgacttcgtttga

SEQ ID NO: 86890 - DNA, 37 bp, Artificial Sequence
  Synthetic oligonucleotide
actccacctggctactagggcttaactggacttttga

SEQ ID NO: 86891 - DNA, 38 bp, Artificial Sequence
  Synthetic oligonucleotide
tgcatcccacattcgagttagattcttcacctttttga

SEQ ID NO: 86892 - DNA, 36 bp, Artificial Sequence
  Synthetic oligonucleotide
tagcgaataccggccatgtcatcaccaactagcata

SEQ ID NO: 86893 - DNA, 36 bp, Artificial Sequence
  Synthetic oligonucleotide
acgtctccacctgccaaattcgtccttttgttgcta

SEQ ID NO: 86894 - DNA, 36 bp, Artificial Sequence
  Synthetic oligonucleotide
ggattgtcctgctgctctaacctaactttagctcta

SEQ ID NO: 86895 - DNA, 35 bp, Artificial Sequence
  Synthetic oligonucleotide
tcccgattcccctgccgtcaccttagcgagcagta

SEQ ID NO: 86896 - DNA, 36 bp, Artificial Sequence
  Synthetic oligonucleotide
gttaagcaagggggggcggagacgaacctgagggta

SEQ ID NO: 86897 - DNA, 36 bp, Artificial Sequence
  Synthetic oligonucleotide
gtgggcactatcgactactatgtctgcaccttggta

SEQ ID NO: 86898 - DNA, 35 bp, Artificial Sequence
  Synthetic oligonucleotide
ttcgaccatgctgctacatgccaaggtttactgta

SEQ ID NO: 86899 - DNA, 36 bp, Artificial Sequence
  Synthetic oligonucleotide
tccgcctaggcggttcattatcaaattgggccatta

SEQ ID NO: 86900 - DNA, 35 bp, Artificial Sequence
  Synthetic oligonucleotide
tcaacccaccgtggatggaaaacggatgtgggtta

SEQ ID NO: 86901 - DNA, 35 bp, Artificial Sequence
  Synthetic oligonucleotide
agcccacccatgactataggtcctatcccgtttta

SEQ ID NO: 86902 - DNA, 35 bp, Artificial Sequence
  Synthetic oligonucleotide
ttacacatgcctcgaattatgtggcatgattgaac

SEQ ID NO: 86903 - DNA, 35 bp, Artificial Sequence
  Synthetic oligonucleotide
tacgtaaccacaggtggatacgttgaggcctctac

SEQ ID NO: 86904 - DNA, 35 bp, Artificial Sequence
  Synthetic oligonucleotide
taaccccgtatgagctcttgtggacctgcgtaacc

SEQ ID NO: 86905 - DNA, 35 bp, Artificial Sequence
  Synthetic oligonucleotide
gactccgcgtaggcaatggtccccggcgtttcacc

SEQ ID NO: 86906 - DNA, 35 bp, Artificial Sequence
  Synthetic oligonucleotide
gacaacgcaattacacgttacctttggaatctacc

SEQ ID NO: 86907 - DNA, 35 bp, Artificial Sequence
  Synthetic oligonucleotide
gccattcctgcctatccatgtgcttgtaagccccc

SEQ ID NO: 86908 - DNA, 35 bp, Artificial Sequence
  Synthetic oligonucleotide
agccgcacacagcaaattgcatcggcaaggccccc

SEQ ID NO: 86909 - DNA, 35 bp, Artificial Sequence
  Synthetic oligonucleotide
acctaccggtaggttatcatgggctctggctggcc

SEQ ID NO: 86910 - DNA, 35 bp, Artificial Sequence
  Synthetic oligonucleotide
actcatcacatgactcccctttaaggggcgcatcc

SEQ ID NO: 86911 - DNA, 35 bp, Artificial Sequence
  Synthetic oligonucleotide
tgatgttcacacgtgatctgcaccccttcgcttcc

SEQ ID NO: 86912 - DNA, 35 bp, Artificial Sequence
  Synthetic oligonucleotide
tcccatccagtgtacttactgcgattttgtcttcc

SEQ ID NO: 86913 - DNA, 35 bp, Artificial Sequence
  Synthetic oligonucleotide
actgggacccaggggccgccctcaccaatgtttcc

SEQ ID NO: 86914 - DNA, 35 bp, Artificial Sequence
  Synthetic oligonucleotide
gaccacgatccaaatatgcctagaaacctcggagc

SEQ ID NO: 86915 - DNA, 35 bp, Artificial Sequence
  Synthetic oligonucleotide
atgcgcccatcaaacagcccggtctagtgctccgc

SEQ ID NO: 86916 - DNA, 35 bp, Artificial Sequence
  Synthetic oligonucleotide
acatggccttccctgagggactataactcttccgc

SEQ ID NO: 86917 - DNA, 35 bp, Artificial Sequence
  Synthetic oligonucleotide
gttcgaccgaacgtgcccctcccatttcgagtcgc

SEQ ID NO: 86918 - DNA, 35 bp, Artificial Sequence
  Synthetic oligonucleotide
atgctacctacgattcacattaagcactcacgggc

SEQ ID NO: 86919 - DNA, 35 bp, Artificial Sequence
  Synthetic oligonucleotide
accgtgtccggcggggtttcaaaaatctgcaatgc

SEQ ID NO: 86920 - DNA, 35 bp, Artificial Sequence
  Synthetic oligonucleotide
gagcacagtggcccccggctcaaatacttatctgc

SEQ ID NO: 86921 - DNA, 35 bp, Artificial Sequence
  Synthetic oligonucleotide
gaccgcgacactacatcacggcgcgagggggactc

SEQ ID NO: 86922 - DNA, 35 bp, Artificial Sequence
  Synthetic oligonucleotide
gtgtagcagtggaaccttcagcttggctcatcctc

SEQ ID NO: 86923 - DNA, 35 bp, Artificial Sequence
  Synthetic oligonucleotide
gaggtggaggtggtgtaatgcaattgctcagcgtc

SEQ ID NO: 86924 - DNA, 35 bp, Artificial Sequence
  Synthetic oligonucleotide
tctcacacacagactccaatttgtaataccgtgtc

SEQ ID NO: 86925 - DNA, 35 bp, Artificial Sequence
  Synthetic oligonucleotide
aaccgttggcaggacctttgcttttttttggattc

SEQ ID NO: 86926 - DNA, 35 bp, Artificial Sequence
  Synthetic oligonucleotide
gtgaccaccgtgtatgtactctacgcccactattc

SEQ ID NO: 86927 - DNA, 35 bp, Artificial Sequence
  Synthetic oligonucleotide
gttgaggtgccgtaggaggttatgcgggaatgttc

SEQ ID NO: 86928 - DNA, 35 bp, Artificial Sequence
  Synthetic oligonucleotide
gacatcggctgttaaaactttaggtgtaagcaacg

SEQ ID NO: 86929 - DNA, 35 bp, Artificial Sequence
  Synthetic oligonucleotide
gatctcagcctcttcctatgtcacgaacacccccg

SEQ ID NO: 86930 - DNA, 35 bp, Artificial Sequence
  Synthetic oligonucleotide
gaggatggagtgaggtttttgactgttgtaagcgg

SEQ ID NO: 86931 - DNA, 35 bp, Artificial Sequence
  Synthetic oligonucleotide
gggagggagggatataggctgctagagggccgcgg

SEQ ID NO: 86932 - DNA, 35 bp, Artificial Sequence
  Synthetic oligonucleotide
tgacagagggcgggggttctaccagcaagaggcgg

SEQ ID NO: 86933 - DNA, 35 bp, Artificial Sequence
  Synthetic oligonucleotide
gcaatagaagaaggtgacggggttcgaaacgaggg

SEQ ID NO: 86934 - DNA, 35 bp, Artificial Sequence
  Synthetic oligonucleotide
tgtgggatacaggttgcggtgaaggtagaggaggg

SEQ ID NO: 86935 - DNA, 35 bp, Artificial Sequence
  Synthetic oligonucleotide
agaggggaacgaccgaaaagtctggaatcgggggg

SEQ ID NO: 86936 - DNA, 35 bp, Artificial Sequence
  Synthetic oligonucleotide
ggcgatagtagggcggattggaggtgggaaggtgg

SEQ ID NO: 86937 - DNA, 35 bp, Artificial Sequence
  Synthetic oligonucleotide
gctgacgacatctgctgtgctagcctcccgtcatg

SEQ ID NO: 86938 - DNA, 35 bp, Artificial Sequence
  Synthetic oligonucleotide
gtgggagccgataccttacgatttaggacgatttg

SEQ ID NO: 86939 - DNA, 35 bp, Artificial Sequence
  Synthetic oligonucleotide
gaatggaggctggaggtgggtactgcgtctttcat

SEQ ID NO: 86940 - DNA, 35 bp, Artificial Sequence
  Synthetic oligonucleotide
aacgagccgcacacttttctctctcttatggaact

SEQ ID NO: 86941 - DNA, 35 bp, Artificial Sequence
  Synthetic oligonucleotide
ggacccaaccgagttgtaccgttcatgaccgtcct

SEQ ID NO: 86942 - DNA, 35 bp, Artificial Sequence
  Synthetic oligonucleotide
atgcctgtctgcaacccagcactctgactcatgct

SEQ ID NO: 86943 - DNA, 35 bp, Artificial Sequence
  Synthetic oligonucleotide
gaacgacattatcagttatcccacgtgtcttgtct

SEQ ID NO: 86944 - DNA, 35 bp, Artificial Sequence
  Synthetic oligonucleotide
gtttgctcacaatcgtgttttcgctcttaccttct

SEQ ID NO: 86945 - DNA, 35 bp, Artificial Sequence
  Synthetic oligonucleotide
acctccatctaactgtcaagctgaagcctatcatt

SEQ ID NO: 86946 - DNA, 35 bp, Artificial Sequence
  Synthetic oligonucleotide
aactaccattgacccacatagagacaaacacgttt

SEQ ID NO: 86947 - DNA, 35 bp, Artificial Sequence
  Synthetic oligonucleotide
aatgccgagaagaagcgaaatgtaacagacgtttt

SEQ ID NO: 86948 - DNA, 35 bp, Artificial Sequence
  Synthetic oligonucleotide
tccgagctaacttagcccatgactggaaaggaaaa

SEQ ID NO: 86949 - DNA, 36 bp, Artificial Sequence
  Synthetic oligonucleotide
tttgcacgacgtcaatgtccgcccttcctgtcgaaa

SEQ ID NO: 86950 - DNA, 36 bp, Artificial Sequence
  Synthetic oligonucleotide
gaaaccctgacgaccgagagctcatgccacaggaaa

SEQ ID NO: 86951 - DNA, 35 bp, Artificial Sequence
  Synthetic oligonucleotide
aaccaaacttgcagccgcgtgccccatgtaaccaa

SEQ ID NO: 86952 - DNA, 36 bp, Artificial Sequence
  Synthetic oligonucleotide
atcgccgagctgagtagggcctggtagctttttcaa

SEQ ID NO: 86953 - DNA, 36 bp, Artificial Sequence
  Synthetic oligonucleotide
gcacatgtgtggagggatattggattaggggcggaa

SEQ ID NO: 86954 - DNA, 36 bp, Artificial Sequence
  Synthetic oligonucleotide
tgtggtctggaggggaggggtaagtgctctcgggaa

SEQ ID NO: 86955 - DNA, 35 bp, Artificial Sequence
  Synthetic oligonucleotide
tactccagctacacccttgctccccgttaagttaa

SEQ ID NO: 86956 - DNA, 35 bp, Artificial Sequence
  Synthetic oligonucleotide
gtaccaccgtgcgtaaggcaccgtttggtcccaca

SEQ ID NO: 86957 - DNA, 36 bp, Artificial Sequence
  Synthetic oligonucleotide
ttcagtcgcaatgaatgcactggcttggttatcaca

SEQ ID NO: 86958 - DNA, 36 bp, Artificial Sequence
  Synthetic oligonucleotide
gagagggcgaaagataaccacaaggccgggcaacca

SEQ ID NO: 86959 - DNA, 35 bp, Artificial Sequence
  Synthetic oligonucleotide
gccactggtgccgttgccaattcaatatactacca

SEQ ID NO: 86960 - DNA, 36 bp, Artificial Sequence
  Synthetic oligonucleotide
ttggtgcaccaccacttctatgcctgccaatgagca

SEQ ID NO: 86961 - DNA, 36 bp, Artificial Sequence
  Synthetic oligonucleotide
taacaccataacctgtagtcctccgttgcccgggca

SEQ ID NO: 86962 - DNA, 36 bp, Artificial Sequence
  Synthetic oligonucleotide
atgcgcaaatggctagccgccgttcaattctctgca

SEQ ID NO: 86963 - DNA, 37 bp, Artificial Sequence
  Synthetic oligonucleotide
agtggaagcagtagcgggatcaggggatacaacaaga

SEQ ID NO: 86964 - DNA, 36 bp, Artificial Sequence
  Synthetic oligonucleotide
tcatcatcagccgctgccgcttatacactctcaaga

SEQ ID NO: 86965 - DNA, 37 bp, Artificial Sequence
  Synthetic oligonucleotide
ggaaccaacacggagacagacgagggcggagtggaga

SEQ ID NO: 86966 - DNA, 37 bp, Artificial Sequence
  Synthetic oligonucleotide
tcgcctgacaaacatgctcctaataactcgccgtaga

SEQ ID NO: 86967 - DNA, 36 bp, Artificial Sequence
  Synthetic oligonucleotide
gtaagcccccccaatttactccatcagtcgctacga

SEQ ID NO: 86968 - DNA, 37 bp, Artificial Sequence
  Synthetic oligonucleotide
atcatgttacgcagctcccctattcaccgttgtccga

SEQ ID NO: 86969 - DNA, 37 bp, Artificial Sequence
  Synthetic oligonucleotide
gacgccctaccagtttgatccgtatgctccgttccga

SEQ ID NO: 86970 - DNA, 37 bp, Artificial Sequence
  Synthetic oligonucleotide
tcagtgctacgggagggggtggtgtgcgacgaagcga

SEQ ID NO: 86971 - DNA, 37 bp, Artificial Sequence
  Synthetic oligonucleotide
accgccctatccaaaccgactgctcacaaggtggcga

SEQ ID NO: 86972 - DNA, 37 bp, Artificial Sequence
  Synthetic oligonucleotide
gtcgccaccactgctattttttgggccatatcttcga

SEQ ID NO: 86973 - DNA, 37 bp, Artificial Sequence
  Synthetic oligonucleotide
gacggtggagcagtgtgaaagtaggggtgaactagga

SEQ ID NO: 86974 - DNA, 37 bp, Artificial Sequence
  Synthetic oligonucleotide
attatcaggccattctcacagctcacagtcgcccgga

SEQ ID NO: 86975 - DNA, 37 bp, Artificial Sequence
  Synthetic oligonucleotide
gacgcaagggataaaggaggtaatgcagggtggcgga

SEQ ID NO: 86976 - DNA, 37 bp, Artificial Sequence
  Synthetic oligonucleotide
acacgtacaccttgcgcaacatcaaccacacgcggga

SEQ ID NO: 86977 - DNA, 37 bp, Artificial Sequence
  Synthetic oligonucleotide
gatcacgagggatgggcatctcgtgaatagacctgga

SEQ ID NO: 86978 - DNA, 38 bp, Artificial Sequence
  Synthetic oligonucleotide
ggaagcctagggagggggaagttcacagaccggaatga

SEQ ID NO: 86979 - DNA, 37 bp, Artificial Sequence
  Synthetic oligonucleotide
gcgctgtatcacagcctggtaccaataacacacatga

SEQ ID NO: 86980 - DNA, 37 bp, Artificial Sequence
  Synthetic oligonucleotide
tccactcctgctaacctcgtcgtttatccacacatga

SEQ ID NO: 86981 - DNA, 38 bp, Artificial Sequence
  Synthetic oligonucleotide
tcttcatccaccctgttgtccgtcaagacggaccatga

SEQ ID NO: 86982 - DNA, 38 bp, Artificial Sequence
  Synthetic oligonucleotide
tgacccgacgagaaaacatccccccggtcacttcatga

SEQ ID NO: 86983 - DNA, 38 bp, Artificial Sequence
  Synthetic oligonucleotide
gcatgctgtgtatgcacgtaacaaacaagtaactatga

SEQ ID NO: 86984 - DNA, 38 bp, Artificial Sequence
  Synthetic oligonucleotide
tcaccgcctatctgatggcgcttgctccttcttactga

SEQ ID NO: 86985 - DNA, 37 bp, Artificial Sequence
  Synthetic oligonucleotide
aatgaccacaccctactgtttcaatttacaggcctga

SEQ ID NO: 86986 - DNA, 38 bp, Artificial Sequence
  Synthetic oligonucleotide
ttcacccacgctcagcgacttagcgcaatacatcctga

SEQ ID NO: 86987 - DNA, 38 bp, Artificial Sequence
  Synthetic oligonucleotide
gaagtcacgtcctgcaaaccacccacacgtagtcctga

SEQ ID NO: 86988 - DNA, 36 bp, Artificial Sequence
  Synthetic oligonucleotide
ttcgtgagccaacgggaatggaggggagtatgctga

SEQ ID NO: 86989 - DNA, 38 bp, Artificial Sequence
  Synthetic oligonucleotide
atcacgcccggtgccatagtcgaatcgagtcattctga

SEQ ID NO: 86990 - DNA, 38 bp, Artificial Sequence
  Synthetic oligonucleotide
actgggaacgaggggttgcatagccaaggagcgagtga

SEQ ID NO: 86991 - DNA, 38 bp, Artificial Sequence
  Synthetic oligonucleotide
gcatgtgcgctcaccttcacgtaccacctgcatagtga

SEQ ID NO: 86992 - DNA, 37 bp, Artificial Sequence
  Synthetic oligonucleotide
actcagtcgagagggagtttttatggggagggcgtga

SEQ ID NO: 86993 - DNA, 37 bp, Artificial Sequence
  Synthetic oligonucleotide
gcgaatgtggcgtgggaaaggagttaccgataggtga

SEQ ID NO: 86994 - DNA, 38 bp, Artificial Sequence
  Synthetic oligonucleotide
gaaatgggacctgtgaaaggcagtgcggggggcggtga

SEQ ID NO: 86995 - DNA, 38 bp, Artificial Sequence
  Synthetic oligonucleotide
agcgcaagtagtcgcgggcggaccagggggaagggtga

SEQ ID NO: 86996 - DNA, 38 bp, Artificial Sequence
  Synthetic oligonucleotide
tgactgctgcccgtacttgtgctttcttccccaattga

SEQ ID NO: 86997 - DNA, 38 bp, Artificial Sequence
  Synthetic oligonucleotide
tcatcggttagcagctcagcagctccacactaacttga

SEQ ID NO: 86998 - DNA, 38 bp, Artificial Sequence
  Synthetic oligonucleotide
taccacgcctcaagtggtgcttattaggtcccacttga

SEQ ID NO: 86999 - DNA, 38 bp, Artificial Sequence
  Synthetic oligonucleotide
tgacgcagaggtcgaggtttattctgcccctcccttga

SEQ ID NO: 87000 - DNA, 38 bp, Artificial Sequence
  Synthetic oligonucleotide
atgagcacaaggagggggagggtatgtaaaagggttga

SEQ ID NO: 87001 - DNA, 37 bp, Artificial Sequence
  Synthetic oligonucleotide
gatagggtggtggtcgggggacggaactggtgtttga

SEQ ID NO: 87002 - DNA, 37 bp, Artificial Sequence
  Synthetic oligonucleotide
tagccctcgcaagattgttgcgtgtttttttttttga

SEQ ID NO: 87003 - DNA, 35 bp, Artificial Sequence
  Synthetic oligonucleotide
gtgggctcacgaggccctatcatcattactcaata

SEQ ID NO: 87004 - DNA, 36 bp, Artificial Sequence
  Synthetic oligonucleotide
tcatagctcacgtggccggggtcttttcgctctata

SEQ ID NO: 87005 - DNA, 36 bp, Artificial Sequence
  Synthetic oligonucleotide
gaccccactcagcctcacctcttaagtgcatttata

SEQ ID NO: 87006 - DNA, 36 bp, Artificial Sequence
  Synthetic oligonucleotide
atccctcatcagaacttgtgctacctactagtgcta

SEQ ID NO: 87007 - DNA, 35 bp, Artificial Sequence
  Synthetic oligonucleotide
attgaaccgccatagaatgcgaagccgttaatcta

SEQ ID NO: 87008 - DNA, 35 bp, Artificial Sequence
  Synthetic oligonucleotide
gcgaattaataggcgcaaaaaaaatgtgttccgta

SEQ ID NO: 87009 - DNA, 36 bp, Artificial Sequence
  Synthetic oligonucleotide
tccccagccgcaaaagacggtagcatttgttgcgta

SEQ ID NO: 87010 - DNA, 36 bp, Artificial Sequence
  Synthetic oligonucleotide
gattgatgtactggtggaggtcgaaggagccgggta

SEQ ID NO: 87011 - DNA, 36 bp, Artificial Sequence
  Synthetic oligonucleotide
gcccattcccgttgtttgcgaatgcaattaaatgta

SEQ ID NO: 87012 - DNA, 36 bp, Artificial Sequence
  Synthetic oligonucleotide
aaagtgggatattagggagggagggaacaatgtgta

SEQ ID NO: 87013 - DNA, 36 bp, Artificial Sequence
  Synthetic oligonucleotide
gatgtagccgtctactgcgttccatcgtacgaatta

SEQ ID NO: 87014 - DNA, 35 bp, Artificial Sequence
  Synthetic oligonucleotide
acatccccccagcacggcacctcccccgccgatta

SEQ ID NO: 87015 - DNA, 36 bp, Artificial Sequence
  Synthetic oligonucleotide
gctgccacctctcgatatcgtctcacgttgtgatta

SEQ ID NO: 87016 - DNA, 36 bp, Artificial Sequence
  Synthetic oligonucleotide
ttccgcctctgacactagtgttctaatgtcttctta

SEQ ID NO: 87017 - DNA, 35 bp, Artificial Sequence
  Synthetic oligonucleotide
gcaccgcctcctcgtttcctcgtttggcacgtaac

SEQ ID NO: 87018 - DNA, 35 bp, Artificial Sequence
  Synthetic oligonucleotide
attcctcatacaccacatgcggtattcgctgatac

SEQ ID NO: 87019 - DNA, 35 bp, Artificial Sequence
  Synthetic oligonucleotide
gaatcgctcacatcctgttctgcttaccgttttac

SEQ ID NO: 87020 - DNA, 35 bp, Artificial Sequence
  Synthetic oligonucleotide
aactgcacttgattgacgcactccatactgctacc

SEQ ID NO: 87021 - DNA, 35 bp, Artificial Sequence
  Synthetic oligonucleotide
agtcgggtcacctctcatgcgatccttcgattacc

SEQ ID NO: 87022 - DNA, 35 bp, Artificial Sequence
  Synthetic oligonucleotide
tatgtccgaaatcaggttgtggaccaacgcttacc

SEQ ID NO: 87023 - DNA, 35 bp, Artificial Sequence
  Synthetic oligonucleotide
gtccgtcgatcggctccctactcctgcatataccc

SEQ ID NO: 87024 - DNA, 35 bp, Artificial Sequence
  Synthetic oligonucleotide
gcctactctctcgatcgccgctcatagtcagcccc

SEQ ID NO: 87025 - DNA, 35 bp, Artificial Sequence
  Synthetic oligonucleotide
ttgcccggctccggaacaatattcaacgactgccc

SEQ ID NO: 87026 - DNA, 35 bp, Artificial Sequence
  Synthetic oligonucleotide
acgctagtgaagcgtgtcccgtgatcattgctgcc

SEQ ID NO: 87027 - DNA, 34 bp, Artificial Sequence
  Synthetic oligonucleotide
gtcctgtgcctacccactgggctgtggttttgcc

SEQ ID NO: 87028 - DNA, 35 bp, Artificial Sequence
  Synthetic oligonucleotide
tccacaatccgcgctgacgccgcttattgccccgc

SEQ ID NO: 87029 - DNA, 35 bp, Artificial Sequence
  Synthetic oligonucleotide
ccccatcgcccattcttgtaccgcaccccgctggc

SEQ ID NO: 87030 - DNA, 35 bp, Artificial Sequence
  Synthetic oligonucleotide
gcactgcagagacacaccgggttcgccttcacatc

SEQ ID NO: 87031 - DNA, 35 bp, Artificial Sequence
  Synthetic oligonucleotide
atcaactactaccgggaggtaggacatagtgcctc

SEQ ID NO: 87032 - DNA, 35 bp, Artificial Sequence
  Synthetic oligonucleotide
tagacgaccttggtccgaactatctaatttatgtc

SEQ ID NO: 87033 - DNA, 35 bp, Artificial Sequence
  Synthetic oligonucleotide
gccactcgaattgttacacccttaggtcgtgcttc

SEQ ID NO: 87034 - DNA, 35 bp, Artificial Sequence
  Synthetic oligonucleotide
taacaccgcgatatccgttctcatcatctgaaacg

SEQ ID NO: 87035 - DNA, 34 bp, Artificial Sequence
  Synthetic oligonucleotide
tagtacaccattgccacggattgtaccatccacg

SEQ ID NO: 87036 - DNA, 35 bp, Artificial Sequence
  Synthetic oligonucleotide
ttcgcggactgctatgttctcatctaccatatccg

SEQ ID NO: 87037 - DNA, 35 bp, Artificial Sequence
  Synthetic oligonucleotide
tttgccgctttctcgtataccttgcttccggtccg

SEQ ID NO: 87038 - DNA, 35 bp, Artificial Sequence
  Synthetic oligonucleotide
tagcgtgcaacttaccgccttgtatcgtactttcg

SEQ ID NO: 87039 - DNA, 35 bp, Artificial Sequence
  Synthetic oligonucleotide
tcaccggtaaagtaggagaagcgagaggaacaggg

SEQ ID NO: 87040 - DNA, 35 bp, Artificial Sequence
  Synthetic oligonucleotide
tgcgctcacaacttcggccttcgttcgatccatgg

SEQ ID NO: 87041 - DNA, 35 bp, Artificial Sequence
  Synthetic oligonucleotide
ggggggggcataggtggattaggttgtacgtttgg

SEQ ID NO: 87042 - DNA, 35 bp, Artificial Sequence
  Synthetic oligonucleotide
ttgaatgggggattgggagggggggcgaccgagtg

SEQ ID NO: 87043 - DNA, 35 bp, Artificial Sequence
  Synthetic oligonucleotide
gtgtggtgatggtgagggcataggtgtgccgcttg

SEQ ID NO: 87044 - DNA, 35 bp, Artificial Sequence
  Synthetic oligonucleotide
gtgatgggtaggggtaagcatgtggagcttcgttg

SEQ ID NO: 87045 - DNA, 35 bp, Artificial Sequence
  Synthetic oligonucleotide
aagtgtcggggagaggggaggcgttacgagctttg

SEQ ID NO: 87046 - DNA, 35 bp, Artificial Sequence
  Synthetic oligonucleotide
tgtgtctccagcgcgcttttcctgcatacattaat

SEQ ID NO: 87047 - DNA, 35 bp, Artificial Sequence
  Synthetic oligonucleotide
gcatcaaaactgtccgcattcatagctcagcccat

SEQ ID NO: 87048 - DNA, 35 bp, Artificial Sequence
  Synthetic oligonucleotide
ttgcccccaatcaccttcgactggccagtaactat

SEQ ID NO: 87049 - DNA, 35 bp, Artificial Sequence
  Synthetic oligonucleotide
atccaatcagctgtccacgtttacagcatgattat

SEQ ID NO: 87050 - DNA, 35 bp, Artificial Sequence
  Synthetic oligonucleotide
gactcaccaccggatcgacccctataatgtcccct

SEQ ID NO: 87051 - DNA, 35 bp, Artificial Sequence
  Synthetic oligonucleotide
acgaggagcactgtgtctcctaactcctattcgct

SEQ ID NO: 87052 - DNA, 35 bp, Artificial Sequence
  Synthetic oligonucleotide
ttccaccccgaaccgtgctgacccttgaagcacgt

SEQ ID NO: 87053 - DNA, 35 bp, Artificial Sequence
  Synthetic oligonucleotide
tcagagatccgggaagggggaggcgtggagaccgt

SEQ ID NO: 87054 - DNA, 35 bp, Artificial Sequence
  Synthetic oligonucleotide
tcaactgccggccctagatccagagccctgctcgt

SEQ ID NO: 87055 - DNA, 35 bp, Artificial Sequence
  Synthetic oligonucleotide
tgtcccgtgcttgtatcgtggctcccgtttctcgt

SEQ ID NO: 87056 - DNA, 35 bp, Artificial Sequence
  Synthetic oligonucleotide
gaatcgattaccggactacagccaccaccccatgt

SEQ ID NO: 87057 - DNA, 35 bp, Artificial Sequence
  Synthetic oligonucleotide
tcagcgagtcccgcccgcacgcctaagtatactgt

SEQ ID NO: 87058 - DNA, 35 bp, Artificial Sequence
  Synthetic oligonucleotide
tgatgctgaccattctcttcctcaccgacgggtgt

SEQ ID NO: 87059 - DNA, 35 bp, Artificial Sequence
  Synthetic oligonucleotide
atgaactgcagtgattgccaggcatcaggcacatt

SEQ ID NO: 87060 - DNA, 35 bp, Artificial Sequence
  Synthetic oligonucleotide
ggacagatcgccgcttgctacgccttgtctacatt

SEQ ID NO: 87061 - DNA, 36 bp, Artificial Sequence
  Synthetic oligonucleotide
ttaaccgatgacggccgccttacatgaacgaaggtt

SEQ ID NO: 87062 - DNA, 35 bp, Artificial Sequence
  Synthetic oligonucleotide
tgtatcactccccctttctgtaacggagacctttt

SEQ ID NO: 87063 - DNA, 35 bp, Artificial Sequence
  Synthetic oligonucleotide
tacgaacttcaggccaatgagttcgccctcttttt

SEQ ID NO: 87064 - DNA, 36 bp, Artificial Sequence
  Synthetic oligonucleotide
gagtggtgggggtacgctcttggggcggggagaaaa

SEQ ID NO: 87065 - DNA, 35 bp, Artificial Sequence
  Synthetic oligonucleotide
agacacaatgggtactacctcactcacgctgcaaa

SEQ ID NO: 87066 - DNA, 35 bp, Artificial Sequence
  Synthetic oligonucleotide
tcaggaacaccggactcttttttgttgcattgaaa

SEQ ID NO: 87067 - DNA, 37 bp, Artificial Sequence
  Synthetic oligonucleotide
ttggcaccgaccagttgagtcttcgcattcccaccaa

SEQ ID NO: 87068 - DNA, 36 bp, Artificial Sequence
  Synthetic oligonucleotide
atggccaagcctcttagtgacaccgtaccgtcccaa

SEQ ID NO: 87069 - DNA, 36 bp, Artificial Sequence
  Synthetic oligonucleotide
acacgaaagagtggtaacggcactctatcatgagaa

SEQ ID NO: 87070 - DNA, 36 bp, Artificial Sequence
  Synthetic oligonucleotide
tgccctcctgttgcctccgccgctgtcaagaccgaa

SEQ ID NO: 87071 - DNA, 35 bp, Artificial Sequence
  Synthetic oligonucleotide
gagatgaataggaacgtggggacgggcaacgggaa

SEQ ID NO: 87072 - DNA, 36 bp, Artificial Sequence
  Synthetic oligonucleotide
tgatgcctgtacacatcttagggctctccgtactaa

SEQ ID NO: 87073 - DNA, 35 bp, Artificial Sequence
  Synthetic oligonucleotide
gagtgtgtgctggaatttgcgttacccccctctaa

SEQ ID NO: 87074 - DNA, 35 bp, Artificial Sequence
  Synthetic oligonucleotide
atcagcgcatggcttctcgcgaccctcctatgtaa

SEQ ID NO: 87075 - DNA, 36 bp, Artificial Sequence
  Synthetic oligonucleotide
gcaccccaatcgcggtattaggcaactctccgcaca

SEQ ID NO: 87076 - DNA, 36 bp, Artificial Sequence
  Synthetic oligonucleotide
gtccccgacccggctttcagagttttcttccaacca

SEQ ID NO: 87077 - DNA, 36 bp, Artificial Sequence
  Synthetic oligonucleotide
ttgccggtcgcatagcaggtagtcggtcccctccca

SEQ ID NO: 87078 - DNA, 36 bp, Artificial Sequence
  Synthetic oligonucleotide
gatgccaacgcacataggacctggagcagcccgcca

SEQ ID NO: 87079 - DNA, 35 bp, Artificial Sequence
  Synthetic oligonucleotide
tcagtgacctaggaaaatgatggcgtgcaccggca

SEQ ID NO: 87080 - DNA, 36 bp, Artificial Sequence
  Synthetic oligonucleotide
gaggggaggtgctgttgatagaacgcggtaagggca

SEQ ID NO: 87081 - DNA, 36 bp, Artificial Sequence
  Synthetic oligonucleotide
gttccaagcaggctgttatgggggatagaacgggca

SEQ ID NO: 87082 - DNA, 36 bp, Artificial Sequence
  Synthetic oligonucleotide
tcacattcgtgttcccctgttcaagagccgcatgca

SEQ ID NO: 87083 - DNA, 36 bp, Artificial Sequence
  Synthetic oligonucleotide
gtgcacagcggcacatcagccatccgggtctcatca

SEQ ID NO: 87084 - DNA, 36 bp, Artificial Sequence
  Synthetic oligonucleotide
tcccacgctttgtcaccacaccgatcgtaccgatca

SEQ ID NO: 87085 - DNA, 36 bp, Artificial Sequence
  Synthetic oligonucleotide
aagaccgcgtagttctgttcgtactcatactcgtca

SEQ ID NO: 87086 - DNA, 35 bp, Artificial Sequence
  Synthetic oligonucleotide
gaacatgtgccgctgttctgtgcccaaattgttca

SEQ ID NO: 87087 - DNA, 36 bp, Artificial Sequence
  Synthetic oligonucleotide
gcatccgtccaccatccgccctgccagtccgtttca

SEQ ID NO: 87088 - DNA, 37 bp, Artificial Sequence
  Synthetic oligonucleotide
gaacactggcgcgattgccttgagggaccagggaaga

SEQ ID NO: 87089 - DNA, 37 bp, Artificial Sequence
  Synthetic oligonucleotide
gtatcactcctcctctccgtttagggtcaacttaaga

SEQ ID NO: 87090 - DNA, 37 bp, Artificial Sequence
  Synthetic oligonucleotide
tgacgagccaaggcgaggagaaggagcgcggagcaga

SEQ ID NO: 87091 - DNA, 37 bp, Artificial Sequence
  Synthetic oligonucleotide
tgcggacggaggagggcatggcgtggcaacacagaga

SEQ ID NO: 87092 - DNA, 37 bp, Artificial Sequence
  Synthetic oligonucleotide
gcgatgaccctacatgctacaccttctcggatcgaga

SEQ ID NO: 87093 - DNA, 36 bp, Artificial Sequence
  Synthetic oligonucleotide
tccccacccccgtttgtcactaccatcctgagacga

SEQ ID NO: 87094 - DNA, 36 bp, Artificial Sequence
  Synthetic oligonucleotide
agtagcgcaaacgcatgctgtactcccttcacccga

SEQ ID NO: 87095 - DNA, 37 bp, Artificial Sequence
  Synthetic oligonucleotide
gcgcactcagtgcatggccccctttactctaagccga

SEQ ID NO: 87096 - DNA, 37 bp, Artificial Sequence
  Synthetic oligonucleotide
tgcacggagccacgtagtccctatcacgatctgccga

SEQ ID NO: 87097 - DNA, 37 bp, Artificial Sequence
  Synthetic oligonucleotide
atctgtcgtccctcctgcccatcggacgtcgttccga

SEQ ID NO: 87098 - DNA, 37 bp, Artificial Sequence
  Synthetic oligonucleotide
gcgatacatcaagtcgccccagtttccgtcacctcga

SEQ ID NO: 87099 - DNA, 37 bp, Artificial Sequence
  Synthetic oligonucleotide
tttgcaccgaacgcccgaaattttgctacatcttcga

SEQ ID NO: 87100 - DNA, 35 bp, Artificial Sequence
  Synthetic oligonucleotide
gtggatgccaggcaaagtctccacaacccgaagga

SEQ ID NO: 87101 - DNA, 36 bp, Artificial Sequence
  Synthetic oligonucleotide
gactccctccagcttgttacatgttcccgtgaagga

SEQ ID NO: 87102 - DNA, 37 bp, Artificial Sequence
  Synthetic oligonucleotide
tcagtcacgtgcgaacagggggagtagtaacatcgga

SEQ ID NO: 87103 - DNA, 37 bp, Artificial Sequence
  Synthetic oligonucleotide
gtggaccggaggaggaagttgacgggccattacggga

SEQ ID NO: 87104 - DNA, 37 bp, Artificial Sequence
  Synthetic oligonucleotide
gaggaggagacccaggggaatgagtaaggatagggga

SEQ ID NO: 87105 - DNA, 37 bp, Artificial Sequence
  Synthetic oligonucleotide
gacaggtcacggttgttgaagcgtgagtgacactgga

SEQ ID NO: 87106 - DNA, 37 bp, Artificial Sequence
  Synthetic oligonucleotide
gagaatcaccacagttgcctcgataccgtgtcctgga

SEQ ID NO: 87107 - DNA, 38 bp, Artificial Sequence
  Synthetic oligonucleotide
gccacatgcactgcgaataagttcactgatgaacatga

SEQ ID NO: 87108 - DNA, 38 bp, Artificial Sequence
  Synthetic oligonucleotide
ttcgtcacacgaacccctcgtactgaaagtaaccatga

SEQ ID NO: 87109 - DNA, 38 bp, Artificial Sequence
  Synthetic oligonucleotide
tcgatatcgcgcctgaccgccgaccattttcatcatga

SEQ ID NO: 87110 - DNA, 38 bp, Artificial Sequence
  Synthetic oligonucleotide
gagatgggggttgatgaagtgaaggaaaacggatatga

SEQ ID NO: 87111 - DNA, 38 bp, Artificial Sequence
  Synthetic oligonucleotide
acacgacctcataatttcacacgtgatgtcttcactga

SEQ ID NO: 87112 - DNA, 36 bp, Artificial Sequence
  Synthetic oligonucleotide
tccttgcgctagcattcctgtaggtactttccctga

SEQ ID NO: 87113 - DNA, 38 bp, Artificial Sequence
  Synthetic oligonucleotide
tcactgcgcaaatccgtaaaatccccgtaccctgctga

SEQ ID NO: 87114 - DNA, 37 bp, Artificial Sequence
  Synthetic oligonucleotide
gtacagacggtagttgattaggcgactctggtgctga

SEQ ID NO: 87115 - DNA, 38 bp, Artificial Sequence
  Synthetic oligonucleotide
gactggcacggtgcacccgccgcttaaagccttgctga

SEQ ID NO: 87116 - DNA, 38 bp, Artificial Sequence
  Synthetic oligonucleotide
gtcgacaagagtccagtcgcgggatgaagagtaagtga

SEQ ID NO: 87117 - DNA, 37 bp, Artificial Sequence
  Synthetic oligonucleotide
ggaggccactaagggtagtagcggtggaaaatagtga

SEQ ID NO: 87118 - DNA, 38 bp, Artificial Sequence
  Synthetic oligonucleotide
gcaacgggcgaaatactcaattggaaggctcaaggtga

SEQ ID NO: 87119 - DNA, 38 bp, Artificial Sequence
  Synthetic oligonucleotide
gcaacggaaggagacgggtgactgggcggcttaggtga

SEQ ID NO: 87120 - DNA, 38 bp, Artificial Sequence
  Synthetic oligonucleotide
gacacgaatgggaagggtggtgtgtggctagcaattga

SEQ ID NO: 87121 - DNA, 38 bp, Artificial Sequence
  Synthetic oligonucleotide
ggtcggggataaagggaggtgagcgtgaacgggattga

SEQ ID NO: 87122 - DNA, 38 bp, Artificial Sequence
  Synthetic oligonucleotide
gatcactctcggaactttctgtgacattacttacttga

SEQ ID NO: 87123 - DNA, 38 bp, Artificial Sequence
  Synthetic oligonucleotide
gtgcaccatctttgagcatcgaatctgttcttacttga

SEQ ID NO: 87124 - DNA, 38 bp, Artificial Sequence
  Synthetic oligonucleotide
gtgaaggggaggaaatgtgcggtggcacatcaagttga

SEQ ID NO: 87125 - DNA, 38 bp, Artificial Sequence
  Synthetic oligonucleotide
acgagtctgtcagcaggaattgccgtacccttttttga

SEQ ID NO: 87126 - DNA, 35 bp, Artificial Sequence
  Synthetic oligonucleotide
gaaagcccgctctttacgcacatttgccgaacata

SEQ ID NO: 87127 - DNA, 35 bp, Artificial Sequence
  Synthetic oligonucleotide
acatcccacgtcgcacccccgcgtcccagttacta

SEQ ID NO: 87128 - DNA, 36 bp, Artificial Sequence
  Synthetic oligonucleotide
gtcgcaccgcctccaacacggcaacagccgacgcta

SEQ ID NO: 87129 - DNA, 36 bp, Artificial Sequence
  Synthetic oligonucleotide
gagtctcgccgaagtgcccccaggacctcatttcta

SEQ ID NO: 87130 - DNA, 36 bp, Artificial Sequence
  Synthetic oligonucleotide
atgcccgacagggaatagcgtaatatcccatctgta

SEQ ID NO: 87131 - DNA, 36 bp, Artificial Sequence
  Synthetic oligonucleotide
gacacgggattcaggtggtgaggtcggcaccgatta

SEQ ID NO: 87132 - DNA, 36 bp, Artificial Sequence
  Synthetic oligonucleotide
gacggagcccataattgttttcgctatgattattta

SEQ ID NO: 87133 - DNA, 36 bp, Artificial Sequence
  Synthetic oligonucleotide
gcctcgccgccttatgcgttcttgtctaatgcttta

SEQ ID NO: 87134 - DNA, 35 bp, Artificial Sequence
  Synthetic oligonucleotide
acactgcaggcaggattctggccccccaattttta

SEQ ID NO: 87135 - DNA, 35 bp, Artificial Sequence
  Synthetic oligonucleotide
gtcgcctcacttcttggcttagacgtgtctccaac

SEQ ID NO: 87136 - DNA, 35 bp, Artificial Sequence
  Synthetic oligonucleotide
tcgctatccacagcacggtgttttttcgttccaac

SEQ ID NO: 87137 - DNA, 35 bp, Artificial Sequence
  Synthetic oligonucleotide
gctcgtgcccagtgagccacgcacagttctcacac

SEQ ID NO: 87138 - DNA, 35 bp, Artificial Sequence
  Synthetic oligonucleotide
tacccggccgcttgccgaggtcctattctatccac

SEQ ID NO: 87139 - DNA, 35 bp, Artificial Sequence
  Synthetic oligonucleotide
tctagttgcagatccgtcacttctattatttccac

SEQ ID NO: 87140 - DNA, 35 bp, Artificial Sequence
  Synthetic oligonucleotide
gatgcccggtccctattagcccagcccttgattac

SEQ ID NO: 87141 - DNA, 35 bp, Artificial Sequence
  Synthetic oligonucleotide
tccttcgcccccatgttccctttacgacattcccc

SEQ ID NO: 87142 - DNA, 35 bp, Artificial Sequence
  Synthetic oligonucleotide
gcgatgcctactcatgccgtgtccggttcgatccc

SEQ ID NO: 87143 - DNA, 35 bp, Artificial Sequence
  Synthetic oligonucleotide
aggacataccacctcgctaaagagtacctctggcc

SEQ ID NO: 87144 - DNA, 35 bp, Artificial Sequence
  Synthetic oligonucleotide
tatctgtgccacctgtattcattcgtcagtttgcc

SEQ ID NO: 87145 - DNA, 35 bp, Artificial Sequence
  Synthetic oligonucleotide
attgtgacctcatcagagtgcatccgtttttctcc

SEQ ID NO: 87146 - DNA, 35 bp, Artificial Sequence
  Synthetic oligonucleotide
gcgagatcgggaaacggggaggacggtggggaagc

SEQ ID NO: 87147 - DNA, 35 bp, Artificial Sequence
  Synthetic oligonucleotide
agttcacacagtcctgttgctatctccctcctggc

SEQ ID NO: 87148 - DNA, 35 bp, Artificial Sequence
  Synthetic oligonucleotide
tgcctgccacttatatggcattcatatctaacatc

SEQ ID NO: 87149 - DNA, 35 bp, Artificial Sequence
  Synthetic oligonucleotide
tctgaactcatgcactaacacctgtggatcacctc

SEQ ID NO: 87150 - DNA, 35 bp, Artificial Sequence
  Synthetic oligonucleotide
gcatcaccgacatggtagggctgtgggtcttcctc

SEQ ID NO: 87151 - DNA, 35 bp, Artificial Sequence
  Synthetic oligonucleotide
gctgttggctcactacgcctggtactgactctctc

SEQ ID NO: 87152 - DNA, 35 bp, Artificial Sequence
  Synthetic oligonucleotide
gatcaccatactagcgaccttgttcgtagtaattc

SEQ ID NO: 87153 - DNA, 35 bp, Artificial Sequence
  Synthetic oligonucleotide
gacgcccagggcttataaataggtagttccctttc

SEQ ID NO: 87154 - DNA, 35 bp, Artificial Sequence
  Synthetic oligonucleotide
tagctacggcggaactagtccaggggggtcgcaag

SEQ ID NO: 87155 - DNA, 35 bp, Artificial Sequence
  Synthetic oligonucleotide
taaaatgcgggggcaggactaggagggcgattaag

SEQ ID NO: 87156 - DNA, 35 bp, Artificial Sequence
  Synthetic oligonucleotide
tgcgcctacaacaagttttctgccatcgcctacag

SEQ ID NO: 87157 - DNA, 35 bp, Artificial Sequence
  Synthetic oligonucleotide
aaacgacagatcggactgagcattgtgagtgtcag

SEQ ID NO: 87158 - DNA, 35 bp, Artificial Sequence
  Synthetic oligonucleotide
gagatggggcgggaagctctaaaaagttgggatag

SEQ ID NO: 87159 - DNA, 36 bp, Artificial Sequence
  Synthetic oligonucleotide
gatcacctccgcgatctcactgagcaccgcaccccg

SEQ ID NO: 87160 - DNA, 35 bp, Artificial Sequence
  Synthetic oligonucleotide
gcagtactgcaggtgacattttaaatgggttagcg

SEQ ID NO: 87161 - DNA, 35 bp, Artificial Sequence
  Synthetic oligonucleotide
gacgcggtccctttctgccagcctcaacacccgcg

SEQ ID NO: 87162 - DNA, 35 bp, Artificial Sequence
  Synthetic oligonucleotide
aacgcccaccgaaatcacttcgaacacctacaatg

SEQ ID NO: 87163 - DNA, 34 bp, Artificial Sequence
  Synthetic oligonucleotide
tagcacgcacccctccccagcgagctcccatctg

SEQ ID NO: 87164 - DNA, 35 bp, Artificial Sequence
  Synthetic oligonucleotide
tccgacaattcacctccactagacgcgccctcgtg

SEQ ID NO: 87165 - DNA, 35 bp, Artificial Sequence
  Synthetic oligonucleotide
tttcaggccgcagatgaatgatcgttctggggttg

SEQ ID NO: 87166 - DNA, 35 bp, Artificial Sequence
  Synthetic oligonucleotide
acacagccccagtgagcaagcaaagtcttcgaaat

SEQ ID NO: 87167 - DNA, 35 bp, Artificial Sequence
  Synthetic oligonucleotide
tgtgctagtcacagccgccgatcttcgggcctcat

SEQ ID NO: 87168 - DNA, 35 bp, Artificial Sequence
  Synthetic oligonucleotide
aacgaagccatgtgttgttgcatggtgacccgtat

SEQ ID NO: 87169 - DNA, 35 bp, Artificial Sequence
  Synthetic oligonucleotide
acatcaacgcggatatacggcccctatttctttat

SEQ ID NO: 87170 - DNA, 35 bp, Artificial Sequence
  Synthetic oligonucleotide
accacacataagactcggtctgtgcccgacacact

SEQ ID NO: 87171 - DNA, 35 bp, Artificial Sequence
  Synthetic oligonucleotide
aaaaccatcgcacagagcacacaaggctactccct

SEQ ID NO: 87172 - DNA, 35 bp, Artificial Sequence
  Synthetic oligonucleotide
acgcccccaatgcgactcacagaagccattactct

SEQ ID NO: 87173 - DNA, 35 bp, Artificial Sequence
  Synthetic oligonucleotide
ggagctgcacgcaagtctagctggtaccactctct

SEQ ID NO: 87174 - DNA, 35 bp, Artificial Sequence
  Synthetic oligonucleotide
gttagacaccgcccccaatgtcattcactactggt

SEQ ID NO: 87175 - DNA, 35 bp, Artificial Sequence
  Synthetic oligonucleotide
gcaacggaaggtgccttgaagtggaggatagtggt

SEQ ID NO: 87176 - DNA, 35 bp, Artificial Sequence
  Synthetic oligonucleotide
gcatcccttacgcatcatacgcaggatcgaccctt

SEQ ID NO: 87177 - DNA, 33 bp, Artificial Sequence
  Synthetic oligonucleotide
gcatctacagtccgtcctgtaaccgatattttt

SEQ ID NO: 87178 - DNA, 36 bp, Artificial Sequence
  Synthetic oligonucleotide
atgtcaggcgcagcactgcaggccggaacaaacaaa

SEQ ID NO: 87179 - DNA, 36 bp, Artificial Sequence
  Synthetic oligonucleotide
ttctagccgcccgatagctgccactggtggtgccaa

SEQ ID NO: 87180 - DNA, 35 bp, Artificial Sequence
  Synthetic oligonucleotide
tagcacgctctcttctgtacacacggtatcttcaa

SEQ ID NO: 87181 - DNA, 35 bp, Artificial Sequence
  Synthetic oligonucleotide
gagtgcgcattgcctgcaccttctcccacttctaa

SEQ ID NO: 87182 - DNA, 36 bp, Artificial Sequence
  Synthetic oligonucleotide
gaatgcgagactggtcgaagcggagtatgggagtaa

SEQ ID NO: 87183 - DNA, 36 bp, Artificial Sequence
  Synthetic oligonucleotide
attccacatcagaatggcacgcaataattacaaaca

SEQ ID NO: 87184 - DNA, 35 bp, Artificial Sequence
  Synthetic oligonucleotide
gatcccacaacgtatgtgccttacattccgacaca

SEQ ID NO: 87185 - DNA, 35 bp, Artificial Sequence
  Synthetic oligonucleotide
gactcgccacgccgttgataaactcttgcaataca

SEQ ID NO: 87186 - DNA, 35 bp, Artificial Sequence
  Synthetic oligonucleotide
gccaggtccgcctttgcttatccggggtaaaacca

SEQ ID NO: 87187 - DNA, 36 bp, Artificial Sequence
  Synthetic oligonucleotide
caccccagcctctcgctatcctgtaatcactagcca

SEQ ID NO: 87188 - DNA, 36 bp, Artificial Sequence
  Synthetic oligonucleotide
tcaaccgcctggtgagatgaagtgtcaaaaaaagca

SEQ ID NO: 87189 - DNA, 36 bp, Artificial Sequence
  Synthetic oligonucleotide
ggtgacgttctcaggaggggggagcgcggtagagca

SEQ ID NO: 87190 - DNA, 36 bp, Artificial Sequence
  Synthetic oligonucleotide
gacacgagtgatcattatcgataagcccggaacgca

SEQ ID NO: 87191 - DNA, 35 bp, Artificial Sequence
  Synthetic oligonucleotide
gagctcgccacattcaaaacgaatcaattgccgca

SEQ ID NO: 87192 - DNA, 36 bp, Artificial Sequence
  Synthetic oligonucleotide
ggactggcctatggtatcctgtctctccctgctgca

SEQ ID NO: 87193 - DNA, 36 bp, Artificial Sequence
  Synthetic oligonucleotide
tcgaaacccatcgccgcatttttggaacgacactca

SEQ ID NO: 87194 - DNA, 36 bp, Artificial Sequence
  Synthetic oligonucleotide
aacgcctaccatattgcttgcagaacattaacttca

SEQ ID NO: 87195 - DNA, 36 bp, Artificial Sequence
  Synthetic oligonucleotide
tgatgcccctctactctttgtttcgctcaggtttca

SEQ ID NO: 87196 - DNA, 36 bp, Artificial Sequence
  Synthetic oligonucleotide
agtctgagaaggagaggcattgttagagaaggaaga

SEQ ID NO: 87197 - DNA, 37 bp, Artificial Sequence
  Synthetic oligonucleotide
tacaagaggggaaaggtggggcaggtgagcacggaga

SEQ ID NO: 87198 - DNA, 37 bp, Artificial Sequence
  Synthetic oligonucleotide
gtcaagcgcgcaaatgatccttgccgcaacatcacga

SEQ ID NO: 87199 - DNA, 36 bp, Artificial Sequence
  Synthetic oligonucleotide
tcaagacacggtgggaggggtaccaataaaggacga

SEQ ID NO: 87200 - DNA, 36 bp, Artificial Sequence
  Synthetic oligonucleotide
gccaggcccatcaagagtcttcccacgttcatccga

SEQ ID NO: 87201 - DNA, 37 bp, Artificial Sequence
  Synthetic oligonucleotide
taacacgaacaaagaagccaacatcgactaggtgcga

SEQ ID NO: 87202 - DNA, 35 bp, Artificial Sequence
  Synthetic oligonucleotide
agcgacacggaacctaactgaactttgactatcga

SEQ ID NO: 87203 - DNA, 37 bp, Artificial Sequence
  Synthetic oligonucleotide
acgccttgacccaccggtatgacacatgtccagagga

SEQ ID NO: 87204 - DNA, 37 bp, Artificial Sequence
  Synthetic oligonucleotide
gcccatgcaacgctacatctttcctgcattatgagga

SEQ ID NO: 87205 - DNA, 35 bp, Artificial Sequence
  Synthetic oligonucleotide
tccccgaccatccgtctcaggaccaaacccacgga

SEQ ID NO: 87206 - DNA, 37 bp, Artificial Sequence
  Synthetic oligonucleotide
ggacacgctactgccccaagaaaacacactgcacgga

SEQ ID NO: 87207 - DNA, 35 bp, Artificial Sequence
  Synthetic oligonucleotide
ttgtcagaggcacaagagggaggaggtaaagcgga

SEQ ID NO: 87208 - DNA, 37 bp, Artificial Sequence
  Synthetic oligonucleotide
agtagtagacacagttgtaaaagggggagaaggcgga

SEQ ID NO: 87209 - DNA, 37 bp, Artificial Sequence
  Synthetic oligonucleotide
acgctgacacacaagggctgcaaaatttcaagaggga

SEQ ID NO: 87210 - DNA, 37 bp, Artificial Sequence
  Synthetic oligonucleotide
gatcggtgaggccatgatggaggggcttgggacggga

SEQ ID NO: 87211 - DNA, 36 bp, Artificial Sequence
  Synthetic oligonucleotide
acgcgcccacttcattgctcacaaattcttccggga

SEQ ID NO: 87212 - DNA, 37 bp, Artificial Sequence
  Synthetic oligonucleotide
gaaccaaaggaaaggaggaagggcgcggactgcggga

SEQ ID NO: 87213 - DNA, 37 bp, Artificial Sequence
  Synthetic oligonucleotide
gagtggcgaaggtagagaagtcgaattggtacgggga

SEQ ID NO: 87214 - DNA, 37 bp, Artificial Sequence
  Synthetic oligonucleotide
ggaacgtggagaagaagcggggcggcggataggggga

SEQ ID NO: 87215 - DNA, 36 bp, Artificial Sequence
  Synthetic oligonucleotide
accgtgtacggtacgcgccatccacaattatctgga

SEQ ID NO: 87216 - DNA, 37 bp, Artificial Sequence
  Synthetic oligonucleotide
tcacggccactcttttatgtacactaccatatttgga

SEQ ID NO: 87217 - DNA, 37 bp, Artificial Sequence
  Synthetic oligonucleotide
gatcgtgctgcagcgggtggtggagagaggaaaatga

SEQ ID NO: 87218 - DNA, 37 bp, Artificial Sequence
  Synthetic oligonucleotide
tccgccgagcctcctagcggtattccaggtcccatga

SEQ ID NO: 87219 - DNA, 38 bp, Artificial Sequence
  Synthetic oligonucleotide
gaaaattaaagagggcatgagagagatgtcacggatga

SEQ ID NO: 87220 - DNA, 36 bp, Artificial Sequence
  Synthetic oligonucleotide
ttgcgtaaagggtggcagggggacgggtgtggatga

SEQ ID NO: 87221 - DNA, 38 bp, Artificial Sequence
  Synthetic oligonucleotide
tacaacgactgttgctcagcaccactccacagaactga

SEQ ID NO: 87222 - DNA, 38 bp, Artificial Sequence
  Synthetic oligonucleotide
taatccagccgcgcactcaaatctggttctttccctga

SEQ ID NO: 87223 - DNA, 38 bp, Artificial Sequence
  Synthetic oligonucleotide
gtgacgggacggatcgtaattcttcgtactgtcgctga

SEQ ID NO: 87224 - DNA, 34 bp, Artificial Sequence
  Synthetic oligonucleotide
tccatagggcacgcctttgcttaacatctgctga

SEQ ID NO: 87225 - DNA, 38 bp, Artificial Sequence
  Synthetic oligonucleotide
gctgagcaccccgcatgacgcaattatgattactctga

SEQ ID NO: 87226 - DNA, 38 bp, Artificial Sequence
  Synthetic oligonucleotide
tgaaccccacgcaccatttcactgtaccctcacagtga

SEQ ID NO: 87227 - DNA, 38 bp, Artificial Sequence
  Synthetic oligonucleotide
accgacgcacccgtcagacattctaatatctcgagtga

SEQ ID NO: 87228 - DNA, 37 bp, Artificial Sequence
  Synthetic oligonucleotide
tgagtctcgcccaagccgtacttatacatatccgtga

SEQ ID NO: 87229 - DNA, 38 bp, Artificial Sequence
  Synthetic oligonucleotide
gaatgcgctgaattccgcactaccaccactttgcgtga

SEQ ID NO: 87230 - DNA, 37 bp, Artificial Sequence
  Synthetic oligonucleotide
aatgggctaggtgcaggtcagtatcggtgtcgggtga

SEQ ID NO: 87231 - DNA, 38 bp, Artificial Sequence
  Synthetic oligonucleotide
tgttccgtactgcaacgcatcacacccctcatgggtga

SEQ ID NO: 87232 - DNA, 38 bp, Artificial Sequence
  Synthetic oligonucleotide
tgcagaccctcgcggcatttgaacttatctctctgtga

SEQ ID NO: 87233 - DNA, 38 bp, Artificial Sequence
  Synthetic oligonucleotide
gatcccgccaccagagcaactagcctagcaaaaattga

SEQ ID NO: 87234 - DNA, 38 bp, Artificial Sequence
  Synthetic oligonucleotide
ggagtggagctgaggaggctaggggggcttgaaattga

SEQ ID NO: 87235 - DNA, 37 bp, Artificial Sequence
  Synthetic oligonucleotide
taccagacgcaaacacacttcatcgccgttacattga

SEQ ID NO: 87236 - DNA, 38 bp, Artificial Sequence
  Synthetic oligonucleotide
gcgccgatctgggctctcaacattgcaaccatccttga

SEQ ID NO: 87237 - DNA, 38 bp, Artificial Sequence
  Synthetic oligonucleotide
tacggtgccgttcagcattctttcgatggcctccttga

SEQ ID NO: 87238 - DNA, 37 bp, Artificial Sequence
  Synthetic oligonucleotide
tccacacaactgcatagtccttcgctagtaagcttga

SEQ ID NO: 87239 - DNA, 37 bp, Artificial Sequence
  Synthetic oligonucleotide
agtgggcgtgctccgtatccctgaatgaacctcttga

SEQ ID NO: 87240 - DNA, 38 bp, Artificial Sequence
  Synthetic oligonucleotide
accacaccggcgttccattggagtagcttacctcttga

SEQ ID NO: 87241 - DNA, 38 bp, Artificial Sequence
  Synthetic oligonucleotide
tagtggcgccctccatcgctgaagaacaattctcttga

SEQ ID NO: 87242 - DNA, 38 bp, Artificial Sequence
  Synthetic oligonucleotide
ttgaccggcctcctgctttttaaaaccactagctttga

SEQ ID NO: 87243 - DNA, 37 bp, Artificial Sequence
  Synthetic oligonucleotide
tcaccactcattgttgctatctggcaccacagtttga

SEQ ID NO: 87244 - DNA, 37 bp, Artificial Sequence
  Synthetic oligonucleotide
gtaacgcggaacaggagggaacgggctatcggtttga

SEQ ID NO: 87245 - DNA, 37 bp, Artificial Sequence
  Synthetic oligonucleotide
tccatcacccgacctttgcttagttctgcctgtttga

SEQ ID NO: 87246 - DNA, 38 bp, Artificial Sequence
  Synthetic oligonucleotide
tgaatcccgcccggttctgagtaaccgtccatttttga

SEQ ID NO: 87247 - DNA, 36 bp, Artificial Sequence
  Synthetic oligonucleotide
acgcacccccgcgacctggcatgaaccatatggata

SEQ ID NO: 87248 - DNA, 35 bp, Artificial Sequence
  Synthetic oligonucleotide
tcaccccgactataactgttgcggttaccgtgata

SEQ ID NO: 87249 - DNA, 36 bp, Artificial Sequence
  Synthetic oligonucleotide
gctgtcgtaaaatgcgctccatgatctcgccctata

SEQ ID NO: 87250 - DNA, 36 bp, Artificial Sequence
  Synthetic oligonucleotide
gtgccagcgcagccatgttttctttgccacgctata

SEQ ID NO: 87251 - DNA, 36 bp, Artificial Sequence
  Synthetic oligonucleotide
gacgaagcgccgcgaatagtctactcgttgttccta

SEQ ID NO: 87252 - DNA, 36 bp, Artificial Sequence
  Synthetic oligonucleotide
atctacgacggctcgtttccggtacctgttctgcta

SEQ ID NO: 87253 - DNA, 36 bp, Artificial Sequence
  Synthetic oligonucleotide
gtgtggggaaggggtgcgggggaacctggatgggta

SEQ ID NO: 87254 - DNA, 36 bp, Artificial Sequence
  Synthetic oligonucleotide
tgccgtcaacgccctctcttgcatgcgccccctgta

SEQ ID NO: 87255 - DNA, 35 bp, Artificial Sequence
  Synthetic oligonucleotide
actgccgggtttgaactcatgggggtagggcatta

SEQ ID NO: 87256 - DNA, 35 bp, Artificial Sequence
  Synthetic oligonucleotide
gtgagcggaccgaatttgctccaccctagttgtta

SEQ ID NO: 87257 - DNA, 35 bp, Artificial Sequence
  Synthetic oligonucleotide
gccaccatgcccatccagtactctagcttgtttta

SEQ ID NO: 87258 - DNA, 35 bp, Artificial Sequence
  Synthetic oligonucleotide
gctcacacaatcgaaccccacgtggcagggaaaac

SEQ ID NO: 87259 - DNA, 35 bp, Artificial Sequence
  Synthetic oligonucleotide
attgccgttcgctaggtacttaccagcctgtaaac

SEQ ID NO: 87260 - DNA, 35 bp, Artificial Sequence
  Synthetic oligonucleotide
gccacgcaccgcaacccgacacatcccgtgaccac

SEQ ID NO: 87261 - DNA, 35 bp, Artificial Sequence
  Synthetic oligonucleotide
gacatcaacaataaacccccacggactgcgcgcac

SEQ ID NO: 87262 - DNA, 35 bp, Artificial Sequence
  Synthetic oligonucleotide
gccttatgcacttaatgtggccacgccgccaaacc

SEQ ID NO: 87263 - DNA, 35 bp, Artificial Sequence
  Synthetic oligonucleotide
tagaccgtgcgtatttctttatcccagtagtcacc

SEQ ID NO: 87264 - DNA, 35 bp, Artificial Sequence
  Synthetic oligonucleotide
tgctcaagaggctccatccctcagtcagttccccc

SEQ ID NO: 87265 - DNA, 35 bp, Artificial Sequence
  Synthetic oligonucleotide
tagtacctcatttcctgttatacggacctctcccc

SEQ ID NO: 87266 - DNA, 35 bp, Artificial Sequence
  Synthetic oligonucleotide
gacacgcgattggaacgactccttcgtcataggcc

SEQ ID NO: 87267 - DNA, 35 bp, Artificial Sequence
  Synthetic oligonucleotide
agtgtgcaccccctgaccgaagtgaccgcccctcc

SEQ ID NO: 87268 - DNA, 35 bp, Artificial Sequence
  Synthetic oligonucleotide
atcactgtccacctgttcctaacacagccacttcc

SEQ ID NO: 87269 - DNA, 35 bp, Artificial Sequence
  Synthetic oligonucleotide
gggatgtcgctgccccagtcgtcgtaatctgttcc

SEQ ID NO: 87270 - DNA, 35 bp, Artificial Sequence
  Synthetic oligonucleotide
taagcccacaagattctatcgcgcggtctctttcc

SEQ ID NO: 87271 - DNA, 35 bp, Artificial Sequence
  Synthetic oligonucleotide
tggatacgcggtctggaaggggatggggggtaggc

SEQ ID NO: 87272 - DNA, 35 bp, Artificial Sequence
  Synthetic oligonucleotide
gagtacgagggaggagatatagccgtcagatatgc

SEQ ID NO: 87273 - DNA, 35 bp, Artificial Sequence
  Synthetic oligonucleotide
gatattgggatgccaccaggggtgagaggatgtgc

SEQ ID NO: 87274 - DNA, 35 bp, Artificial Sequence
  Synthetic oligonucleotide
taacctgtccggattctgacggaacgttcccttgc

SEQ ID NO: 87275 - DNA, 35 bp, Artificial Sequence
  Synthetic oligonucleotide
tctctggttcaactatgtccgcttctcaggctctc

SEQ ID NO: 87276 - DNA, 35 bp, Artificial Sequence
  Synthetic oligonucleotide
atgacggcgttgtgtacgcacttattactcttctc

SEQ ID NO: 87277 - DNA, 35 bp, Artificial Sequence
  Synthetic oligonucleotide
tccctaaccagccttaaggagcgttccttcctgtc

SEQ ID NO: 87278 - DNA, 35 bp, Artificial Sequence
  Synthetic oligonucleotide
tgtccaaacccgtttctgaatactccgagtggttc

SEQ ID NO: 87279 - DNA, 35 bp, Artificial Sequence
  Synthetic oligonucleotide
gcctccactccgtaacgcaattgggttcaaatttc

SEQ ID NO: 87280 - DNA, 35 bp, Artificial Sequence
  Synthetic oligonucleotide
gccgaagagcggattagtctgtgcctgttggaaag

SEQ ID NO: 87281 - DNA, 35 bp, Artificial Sequence
  Synthetic oligonucleotide
tggagctgcccgctttactcgccatccgtcgaccg

SEQ ID NO: 87282 - DNA, 35 bp, Artificial Sequence
  Synthetic oligonucleotide
tcaaccacgacgcatgggaacgactactgagagcg

SEQ ID NO: 87283 - DNA, 35 bp, Artificial Sequence
  Synthetic oligonucleotide
acatgccgtaatgctcctggtctcgaaacgaatcg

SEQ ID NO: 87284 - DNA, 35 bp, Artificial Sequence
  Synthetic oligonucleotide
gtacatctccgttttttactagcacctttatttcg

SEQ ID NO: 87285 - DNA, 35 bp, Artificial Sequence
  Synthetic oligonucleotide
ttcctagcccccagcctccttgttgcccccgcggg

SEQ ID NO: 87286 - DNA, 35 bp, Artificial Sequence
  Synthetic oligonucleotide
gagacgcgattaagtagaaggtggtgatttagatg

SEQ ID NO: 87287 - DNA, 35 bp, Artificial Sequence
  Synthetic oligonucleotide
acccacggtgcctccaatagatcgttacctttatg

SEQ ID NO: 87288 - DNA, 34 bp, Artificial Sequence
  Synthetic oligonucleotide
tcccaccggctaaccacattttgaggctttactg

SEQ ID NO: 87289 - DNA, 36 bp, Artificial Sequence
  Synthetic oligonucleotide
ttgatccatcagcgaccctttccggtatgtcacctg

SEQ ID NO: 87290 - DNA, 35 bp, Artificial Sequence
  Synthetic oligonucleotide
tgcaccccttctgcctcattcacatgctttggaat

SEQ ID NO: 87291 - DNA, 35 bp, Artificial Sequence
  Synthetic oligonucleotide
tgcataaacagtagtcgttatatctcacttaccat

SEQ ID NO: 87292 - DNA, 35 bp, Artificial Sequence
  Synthetic oligonucleotide
tctatatcgcctactcgtaccgtctggtttaccat

SEQ ID NO: 87293 - DNA, 35 bp, Artificial Sequence
  Synthetic oligonucleotide
tcacccgtccatgccggttttcgttccattgctat

SEQ ID NO: 87294 - DNA, 35 bp, Artificial Sequence
  Synthetic oligonucleotide
atgccacgccctcgcataagacctgcccatccact

SEQ ID NO: 87295 - DNA, 35 bp, Artificial Sequence
  Synthetic oligonucleotide
accgaccgcgacagcgcgaccctccaatttctact

SEQ ID NO: 87296 - DNA, 35 bp, Artificial Sequence
  Synthetic oligonucleotide
gaccacccgtaatatcatccagtattattctacct

SEQ ID NO: 87297 - DNA, 35 bp, Artificial Sequence
  Synthetic oligonucleotide
tagccaggcaacgaggctattgcgagctaaaccct

SEQ ID NO: 87298 - DNA, 35 bp, Artificial Sequence
  Synthetic oligonucleotide
tgctcggcctagttgattattcggtcccttgtcct

SEQ ID NO: 87299 - DNA, 35 bp, Artificial Sequence
  Synthetic oligonucleotide
acaatcgcaatctcctgggcaccgccaaaatggct

SEQ ID NO: 87300 - DNA, 35 bp, Artificial Sequence
  Synthetic oligonucleotide
gcacggaagggatggatgcttccgctgctggctct

SEQ ID NO: 87301 - DNA, 35 bp, Artificial Sequence
  Synthetic oligonucleotide
gcacatactgccacgcctgttgccttgagttgtct

SEQ ID NO: 87302 - DNA, 35 bp, Artificial Sequence
  Synthetic oligonucleotide
gcacggtggtacaaaagggtgctgaattaatgagt

SEQ ID NO: 87303 - DNA, 34 bp, Artificial Sequence
  Synthetic oligonucleotide
agacctagtcagaacatccaaccgtccccgctgt

SEQ ID NO: 87304 - DNA, 35 bp, Artificial Sequence
  Synthetic oligonucleotide
gttatcacacgcccgagttactgtctacattgatt

SEQ ID NO: 87305 - DNA, 35 bp, Artificial Sequence
  Synthetic oligonucleotide
tatcacccccaaatatctctttaagttgttgtctt

SEQ ID NO: 87306 - DNA, 35 bp, Artificial Sequence
  Synthetic oligonucleotide
ggtcacgctatgatagctgaccccttctttgtctt

SEQ ID NO: 87307 - DNA, 35 bp, Artificial Sequence
  Synthetic oligonucleotide
tcacccagactgcgctagagcttttttagtccgtt

SEQ ID NO: 87308 - DNA, 35 bp, Artificial Sequence
  Synthetic oligonucleotide
ggagagggggagctggtttcagtgcggacacattt

SEQ ID NO: 87309 - DNA, 35 bp, Artificial Sequence
  Synthetic oligonucleotide
gtgtgccagcgggggtcgccagcaatacctgcttt

SEQ ID NO: 87310 - DNA, 35 bp, Artificial Sequence
  Synthetic oligonucleotide
accaccgccgtccttattgtggtgtattctttttt

SEQ ID NO: 87311 - DNA, 35 bp, Artificial Sequence
  Synthetic oligonucleotide
gactcaggccaggtttcctctaaacgcaccgcaaa

SEQ ID NO: 87312 - DNA, 36 bp, Artificial Sequence
  Synthetic oligonucleotide
gcacaggaggctgagtgatcacacgcgcccttgaaa

SEQ ID NO: 87313 - DNA, 36 bp, Artificial Sequence
  Synthetic oligonucleotide
acatgccatccaatatgcgcaaataacgattttaaa

SEQ ID NO: 87314 - DNA, 36 bp, Artificial Sequence
  Synthetic oligonucleotide
atgaagtaggagcgggcgggggggggttatgagcaa

SEQ ID NO: 87315 - DNA, 36 bp, Artificial Sequence
  Synthetic oligonucleotide
tcgatacttcacaccacatggccgttgttcggtcaa

SEQ ID NO: 87316 - DNA, 36 bp, Artificial Sequence
  Synthetic oligonucleotide
tgattcgtaatcgcgctctgcatcaccaacctagaa

SEQ ID NO: 87317 - DNA, 36 bp, Artificial Sequence
  Synthetic oligonucleotide
gcatagccgcccacacgcaaactgatcggttacgaa

SEQ ID NO: 87318 - DNA, 36 bp, Artificial Sequence
  Synthetic oligonucleotide
atcaccagcacattgattccacgtcaaccgctcgaa

SEQ ID NO: 87319 - DNA, 36 bp, Artificial Sequence
  Synthetic oligonucleotide
gctcctcagcggttaatattccgttcacgttcataa

SEQ ID NO: 87320 - DNA, 35 bp, Artificial Sequence
  Synthetic oligonucleotide
agtacgtaagtcggaggaaagggccggacgggtaa

SEQ ID NO: 87321 - DNA, 36 bp, Artificial Sequence
  Synthetic oligonucleotide
gtggtacgccgcgaccctgaccacataccgacttaa

SEQ ID NO: 87322 - DNA, 35 bp, Artificial Sequence
  Synthetic oligonucleotide
tgcctgcgaccgaatactcaactcatgctaccaca

SEQ ID NO: 87323 - DNA, 36 bp, Artificial Sequence
  Synthetic oligonucleotide
agtgcctccctaccgtatttggccgctcttttcaca

SEQ ID NO: 87324 - DNA, 36 bp, Artificial Sequence
  Synthetic oligonucleotide
actcgcaccacccaattatcatgtcccgggaataca

SEQ ID NO: 87325 - DNA, 35 bp, Artificial Sequence
  Synthetic oligonucleotide
atcccccacggatattattcagatctctgtctaca

SEQ ID NO: 87326 - DNA, 35 bp, Artificial Sequence
  Synthetic oligonucleotide
ggtccaagcaggaatgcaggaaagacagagttaca

SEQ ID NO: 87327 - DNA, 36 bp, Artificial Sequence
  Synthetic oligonucleotide
tctacacctccacaagacgcgtcacctgcgacacca

SEQ ID NO: 87328 - DNA, 36 bp, Artificial Sequence
  Synthetic oligonucleotide
tccgactcgggtatgatttcctggcaccactcacca

SEQ ID NO: 87329 - DNA, 35 bp, Artificial Sequence
  Synthetic oligonucleotide
gtcaacgccgctttcattcttcggctttgtgccca

SEQ ID NO: 87330 - DNA, 36 bp, Artificial Sequence
  Synthetic oligonucleotide
aggagctaccgatcatgcatgctaccctctgtccca

SEQ ID NO: 87331 - DNA, 36 bp, Artificial Sequence
  Synthetic oligonucleotide
gctgccctatagcgcggcttttctgaaacgttccca

SEQ ID NO: 87332 - DNA, 36 bp, Artificial Sequence
  Synthetic oligonucleotide
ggggaggaagatagctgaagggggagtgcggggcca

SEQ ID NO: 87333 - DNA, 35 bp, Artificial Sequence
  Synthetic oligonucleotide
tcactctccatctcaatgctatctcagccgtgcca

SEQ ID NO: 87334 - DNA, 36 bp, Artificial Sequence
  Synthetic oligonucleotide
gttcagcaccgctttagtcatagtccggggcctcca

SEQ ID NO: 87335 - DNA, 36 bp, Artificial Sequence
  Synthetic oligonucleotide
ggtgacttccgtgccgtcttacaggtttgatctcca

SEQ ID NO: 87336 - DNA, 35 bp, Artificial Sequence
  Synthetic oligonucleotide
ggaccaccgaccaccccgtatgatctcactgtcca

SEQ ID NO: 87337 - DNA, 36 bp, Artificial Sequence
  Synthetic oligonucleotide
ggttcgtgccccagccgcgttttgaggtctccatca

SEQ ID NO: 87338 - DNA, 36 bp, Artificial Sequence
  Synthetic oligonucleotide
agttggacatgacacactgtactcaagcacacctca

SEQ ID NO: 87339 - DNA, 36 bp, Artificial Sequence
  Synthetic oligonucleotide
tgattgggtggggcggaaactatcagacaatgctca

SEQ ID NO: 87340 - DNA, 36 bp, Artificial Sequence
  Synthetic oligonucleotide
aagctgggcggcccacgcgttttttgtcctctttca

SEQ ID NO: 87341 - DNA, 37 bp, Artificial Sequence
  Synthetic oligonucleotide
gttgggtgagggggctttaataggcttcgcgataaga

SEQ ID NO: 87342 - DNA, 37 bp, Artificial Sequence
  Synthetic oligonucleotide
accgacctcggacgtgtttcgttattccccactaaga

SEQ ID NO: 87343 - DNA, 37 bp, Artificial Sequence
  Synthetic oligonucleotide
gacgacaagggatcactgtgttaatcagatgacgaga

SEQ ID NO: 87344 - DNA, 37 bp, Artificial Sequence
  Synthetic oligonucleotide
ggaagcaggcctaggacaacgggaaatgcaggggaga

SEQ ID NO: 87345 - DNA, 37 bp, Artificial Sequence
  Synthetic oligonucleotide
gacttcccccaagtgctagctttgcagaccccctaga

SEQ ID NO: 87346 - DNA, 37 bp, Artificial Sequence
  Synthetic oligonucleotide
atcgccgacccaggttcctccttgcaatgctgtacga

SEQ ID NO: 87347 - DNA, 37 bp, Artificial Sequence
  Synthetic oligonucleotide
gacgcccgatcaagcccaccgcctcagatcaccccga

SEQ ID NO: 87348 - DNA, 36 bp, Artificial Sequence
  Synthetic oligonucleotide
tcactcctcactgtggaatcccgttccaacgcccga

SEQ ID NO: 87349 - DNA, 37 bp, Artificial Sequence
  Synthetic oligonucleotide
aacttgtgcctccgaaattgggcgtcgactcagccga

SEQ ID NO: 87350 - DNA, 35 bp, Artificial Sequence
  Synthetic oligonucleotide
gccacacccaaagcgagtattattagagtggccga

SEQ ID NO: 87351 - DNA, 37 bp, Artificial Sequence
  Synthetic oligonucleotide
tcacaagcgaactcgcactgccttagctcgcttccga

SEQ ID NO: 87352 - DNA, 37 bp, Artificial Sequence
  Synthetic oligonucleotide
tacacgtggcggttggaggttaggtggtttagaagga

SEQ ID NO: 87353 - DNA, 37 bp, Artificial Sequence
  Synthetic oligonucleotide
atatgccacccggacgggacttgagaggtcggaagga

SEQ ID NO: 87354 - DNA, 37 bp, Artificial Sequence
  Synthetic oligonucleotide
agattgtggacgaacagtggaggtgcggatgaacgga

SEQ ID NO: 87355 - DNA, 36 bp, Artificial Sequence
  Synthetic oligonucleotide
tagaccatctgatctgcttgccgactcacttccgga

SEQ ID NO: 87356 - DNA, 37 bp, Artificial Sequence
  Synthetic oligonucleotide
gtccatgccccactgcctacctcgccactttggcgga

SEQ ID NO: 87357 - DNA, 36 bp, Artificial Sequence
  Synthetic oligonucleotide
atagcgatagggggaacggaaaaacgatgcacggga

SEQ ID NO: 87358 - DNA, 37 bp, Artificial Sequence
  Synthetic oligonucleotide
tgaagctggactgtgaattgcataggggaaaggggga

SEQ ID NO: 87359 - DNA, 36 bp, Artificial Sequence
  Synthetic oligonucleotide
gcaaagtccggagggatgcgggcgatggagggggga

SEQ ID NO: 87360 - DNA, 37 bp, Artificial Sequence
  Synthetic oligonucleotide
tgccacccgcttgtcctgaatattctcactgttggga

SEQ ID NO: 87361 - DNA, 37 bp, Artificial Sequence
  Synthetic oligonucleotide
actcgtgctccccgcagtattagccccgttcactgga

SEQ ID NO: 87362 - DNA, 37 bp, Artificial Sequence
  Synthetic oligonucleotide
gtgagaacgggggggcgggaaattgtctacaggtgga

SEQ ID NO: 87363 - DNA, 37 bp, Artificial Sequence
  Synthetic oligonucleotide
agaaggagaaaggggctgcaagtagggtgagggtgga

SEQ ID NO: 87364 - DNA, 36 bp, Artificial Sequence
  Synthetic oligonucleotide
ggatgggtgggtgctcgagatagagggacatgtgga

SEQ ID NO: 87365 - DNA, 37 bp, Artificial Sequence
  Synthetic oligonucleotide
gacaaacaagaaggcggttgtcagaggaatcattgga

SEQ ID NO: 87366 - DNA, 37 bp, Artificial Sequence
  Synthetic oligonucleotide
acgtggaccgtcccacctgtaagtctcttgaccatga

SEQ ID NO: 87367 - DNA, 38 bp, Artificial Sequence
  Synthetic oligonucleotide
acccccgacccttatgcaatatcgagcacctaccatga

SEQ ID NO: 87368 - DNA, 38 bp, Artificial Sequence
  Synthetic oligonucleotide
attcacgccgaacagccttttttgtgcagtcatgatga

SEQ ID NO: 87369 - DNA, 37 bp, Artificial Sequence
  Synthetic oligonucleotide
gtcctgcaccaactcgcattggaacgaaaacctatga

SEQ ID NO: 87370 - DNA, 36 bp, Artificial Sequence
  Synthetic oligonucleotide
gccatagcctctcatagttacaaaacctccttatga

SEQ ID NO: 87371 - DNA, 38 bp, Artificial Sequence
  Synthetic oligonucleotide
ttgaacatcagcagcgcgccctggaccttcctaactga

SEQ ID NO: 87372 - DNA, 36 bp, Artificial Sequence
  Synthetic oligonucleotide
gagacgcccattgcatcgttgctgccaatccactga

SEQ ID NO: 87373 - DNA, 38 bp, Artificial Sequence
  Synthetic oligonucleotide
gaccctgtcgcttagcgtggctctaacttcatcactga

SEQ ID NO: 87374 - DNA, 37 bp, Artificial Sequence
  Synthetic oligonucleotide
gactgctgacgtacgtctaggcttccttcattactga

SEQ ID NO: 87375 - DNA, 38 bp, Artificial Sequence
  Synthetic oligonucleotide
taagcaatccctgcctgatccctggtcgtgtgacctga

SEQ ID NO: 87376 - DNA, 37 bp, Artificial Sequence
  Synthetic oligonucleotide
tcaatcggaggtgtgtatagtacggaggggagtctga

SEQ ID NO: 87377 - DNA, 38 bp, Artificial Sequence
  Synthetic oligonucleotide
tgtgtggatatcggtggcatgagggagggtaagggtga

SEQ ID NO: 87378 - DNA, 37 bp, Artificial Sequence
  Synthetic oligonucleotide
atgcaagcgtaaatgggtggatggatatgatgggtga

SEQ ID NO: 87379 - DNA, 38 bp, Artificial Sequence
  Synthetic oligonucleotide
actgaccatccggccgaacttattgtcgctctttgtga

SEQ ID NO: 87380 - DNA, 38 bp, Artificial Sequence
  Synthetic oligonucleotide
gtcgcaccaacgagcacggggatccatcattcaattga

SEQ ID NO: 87381 - DNA, 38 bp, Artificial Sequence
  Synthetic oligonucleotide
accgcactcattacatttgttcatatgcacctcattga

SEQ ID NO: 87382 - DNA, 38 bp, Artificial Sequence
  Synthetic oligonucleotide
aatgggagcgggcggactagaataacgtggggacttga

SEQ ID NO: 87383 - DNA, 38 bp, Artificial Sequence
  Synthetic oligonucleotide
gcgagcatacctccgtacatatcccgtaagcaccttga

SEQ ID NO: 87384 - DNA, 38 bp, Artificial Sequence
  Synthetic oligonucleotide
acatctggggcgagagagagagggacggaaaccgttga

SEQ ID NO: 87385 - DNA, 38 bp, Artificial Sequence
  Synthetic oligonucleotide
tatgacatccgaccatatccagagatctcgttcgttga

SEQ ID NO: 87386 - DNA, 36 bp, Artificial Sequence
  Synthetic oligonucleotide
gcccctccactgatcacgttcctaagggcacccata

SEQ ID NO: 87387 - DNA, 35 bp, Artificial Sequence
  Synthetic oligonucleotide
tcgagtgggtcggcggtcttccattgttaccccta

SEQ ID NO: 87388 - DNA, 36 bp, Artificial Sequence
  Synthetic oligonucleotide
tgcgggcccaacggcgagaatctgcacaatctccta

SEQ ID NO: 87389 - DNA, 35 bp, Artificial Sequence
  Synthetic oligonucleotide
tagcaccttcaacaggtgcacaggttttcttccta

SEQ ID NO: 87390 - DNA, 35 bp, Artificial Sequence
  Synthetic oligonucleotide
tcccccacacgctcgtagtctgactggcacttcta

SEQ ID NO: 87391 - DNA, 36 bp, Artificial Sequence
  Synthetic oligonucleotide
tcaggaggaagggggtcaaggaattcatcggacgta

SEQ ID NO: 87392 - DNA, 36 bp, Artificial Sequence
  Synthetic oligonucleotide
gccccactacacattcatattagggtccttctcgta

SEQ ID NO: 87393 - DNA, 35 bp, Artificial Sequence
  Synthetic oligonucleotide
gatccccgcctgccccgtatatctgtcccgcggta

SEQ ID NO: 87394 - DNA, 36 bp, Artificial Sequence
  Synthetic oligonucleotide
aagacactggcaggaacaggagaggaactgattgta

SEQ ID NO: 87395 - DNA, 36 bp, Artificial Sequence
  Synthetic oligonucleotide
tccatcatcaagtgaattgctgtttttttctcctta

SEQ ID NO: 87396 - DNA, 38 bp, Artificial Sequence
  Synthetic oligonucleotide
tgtacgtccagcccctcgcgtttcttcactgcctgtta

SEQ ID NO: 87397 - DNA, 36 bp, Artificial Sequence
  Synthetic oligonucleotide
gaccgcctggtatgttatccgctgcgattgctttta

SEQ ID NO: 87398 - DNA, 35 bp, Artificial Sequence
  Synthetic oligonucleotide
taggtggagcgccgtcttcagtacacacacgcaac

SEQ ID NO: 87399 - DNA, 35 bp, Artificial Sequence
  Synthetic oligonucleotide
aggataccctggagcgccgtccttgttgcccacac

SEQ ID NO: 87400 - DNA, 35 bp, Artificial Sequence
  Synthetic oligonucleotide
tgctccaccgcacctgatagttccttttccccacc

SEQ ID NO: 87401 - DNA, 35 bp, Artificial Sequence
  Synthetic oligonucleotide
gacgcacccgccttaatgctcgctgaatgtcaccc

SEQ ID NO: 87402 - DNA, 35 bp, Artificial Sequence
  Synthetic oligonucleotide
acgcccctttcgtgcgcgttgcacagttcacgccc

SEQ ID NO: 87403 - DNA, 35 bp, Artificial Sequence
  Synthetic oligonucleotide
tccttgtcagcataaccacgttcgctgaagatccc

SEQ ID NO: 87404 - DNA, 35 bp, Artificial Sequence
  Synthetic oligonucleotide
gcgaacatttgaacggttttgtacggctcctatcc

SEQ ID NO: 87405 - DNA, 35 bp, Artificial Sequence
  Synthetic oligonucleotide
tgcatcctacttagaatctgggaaaatggccgtcc

SEQ ID NO: 87406 - DNA, 35 bp, Artificial Sequence
  Synthetic oligonucleotide
atgtcactgtccttgctaatgcacgctgtacttcc

SEQ ID NO: 87407 - DNA, 34 bp, Artificial Sequence
  Synthetic oligonucleotide
ttccctccgaactgtaccgcacttagatggttcc

SEQ ID NO: 87408 - DNA, 35 bp, Artificial Sequence
  Synthetic oligonucleotide
accacctggtcaggttttcgcccgtgttgcttggc

SEQ ID NO: 87409 - DNA, 35 bp, Artificial Sequence
  Synthetic oligonucleotide
acccccagtcggtagttcttgtccgagcccactgc

SEQ ID NO: 87410 - DNA, 35 bp, Artificial Sequence
  Synthetic oligonucleotide
tcacgccgcattcctgctgtccgctatccacttgc

SEQ ID NO: 87411 - DNA, 35 bp, Artificial Sequence
  Synthetic oligonucleotide
gccaaccatacgctatgtcggacgacgcaggaatc

SEQ ID NO: 87412 - DNA, 35 bp, Artificial Sequence
  Synthetic oligonucleotide
gacccttacaccgcccgatgcttggccaacgcatc

SEQ ID NO: 87413 - DNA, 35 bp, Artificial Sequence
  Synthetic oligonucleotide
agatcaccgaccactccgcttaggtcccagagatc

SEQ ID NO: 87414 - DNA, 35 bp, Artificial Sequence
  Synthetic oligonucleotide
agtactgtcagcgcgcacgcagttacctgtagatc

SEQ ID NO: 87415 - DNA, 35 bp, Artificial Sequence
  Synthetic oligonucleotide
aacgtaccatccagacctaaccgctatctgggatc

SEQ ID NO: 87416 - DNA, 35 bp, Artificial Sequence
  Synthetic oligonucleotide
gctgggcatcagctggaccttctagcggcactatc

SEQ ID NO: 87417 - DNA, 35 bp, Artificial Sequence
  Synthetic oligonucleotide
gcatactcatccattagcgaaatctcgacgtagtc

SEQ ID NO: 87418 - DNA, 35 bp, Artificial Sequence
  Synthetic oligonucleotide
gctcgacactttacagctaccgctacatctcgttc

SEQ ID NO: 87419 - DNA, 35 bp, Artificial Sequence
  Synthetic oligonucleotide
gcatacacgggcggaaagggagagacgctagtcag

SEQ ID NO: 87420 - DNA, 35 bp, Artificial Sequence
  Synthetic oligonucleotide
gtgcacaccactcgtgccctccgcctttctcgtag

SEQ ID NO: 87421 - DNA, 35 bp, Artificial Sequence
  Synthetic oligonucleotide
aagatagcaagggatagaggggtgttgcatagagg

SEQ ID NO: 87422 - DNA, 35 bp, Artificial Sequence
  Synthetic oligonucleotide
gacagacgtccccccgcaatttcgaagctgctagg

SEQ ID NO: 87423 - DNA, 35 bp, Artificial Sequence
  Synthetic oligonucleotide
gatacgcatctccggacctgcttctcgcctcacgg

SEQ ID NO: 87424 - DNA, 35 bp, Artificial Sequence
  Synthetic oligonucleotide
atgtactgcgcaacctgggaagtcgcagttttggg

SEQ ID NO: 87425 - DNA, 35 bp, Artificial Sequence
  Synthetic oligonucleotide
tgaggccgtcttccctgctccttgttattttgtgg

SEQ ID NO: 87426 - DNA, 35 bp, Artificial Sequence
  Synthetic oligonucleotide
attcgtgctccaacttcttacgcatactgccttgg

SEQ ID NO: 87427 - DNA, 35 bp, Artificial Sequence
  Synthetic oligonucleotide
gcaacctcgtttgctatcataaaaaatccctcgtg

SEQ ID NO: 87428 - DNA, 35 bp, Artificial Sequence
  Synthetic oligonucleotide
aacccgatcataccgtctccaccccagacggattg

SEQ ID NO: 87429 - DNA, 35 bp, Artificial Sequence
  Synthetic oligonucleotide
gattggtctagcgggaattagggtggggagtattg

SEQ ID NO: 87430 - DNA, 35 bp, Artificial Sequence
  Synthetic oligonucleotide
acacagtggtggtgctggtttatccaactgccaat

SEQ ID NO: 87431 - DNA, 35 bp, Artificial Sequence
  Synthetic oligonucleotide
tggccgggtgggtttgggaagtaccagggctcaat

SEQ ID NO: 87432 - DNA, 35 bp, Artificial Sequence
  Synthetic oligonucleotide
gacaaccgtcggtatcgagttgtaacattgttcat

SEQ ID NO: 87433 - DNA, 35 bp, Artificial Sequence
  Synthetic oligonucleotide
tcagatgctcattgtcaatgatattgcctttctat

SEQ ID NO: 87434 - DNA, 35 bp, Artificial Sequence
  Synthetic oligonucleotide
gtgaagcactcagaatccacccaattccacgtact

SEQ ID NO: 87435 - DNA, 35 bp, Artificial Sequence
  Synthetic oligonucleotide
gtctgcccacggctaacgtgcttcttgagcatgct

SEQ ID NO: 87436 - DNA, 35 bp, Artificial Sequence
  Synthetic oligonucleotide
atcgtgatcagccccatctgtcatccatccacagt

SEQ ID NO: 87437 - DNA, 35 bp, Artificial Sequence
  Synthetic oligonucleotide
tgacacaactcatcatgttagcttaccccatacgt

SEQ ID NO: 87438 - DNA, 35 bp, Artificial Sequence
  Synthetic oligonucleotide
acaaccccactatcatcgggacctcattttcccgt

SEQ ID NO: 87439 - DNA, 35 bp, Artificial Sequence
  Synthetic oligonucleotide
tgacaatgcaccgccgtaacgaaacagctggccgt

SEQ ID NO: 87440 - DNA, 35 bp, Artificial Sequence
  Synthetic oligonucleotide
gctggtaggggatagaatagatagctcgcacaggt

SEQ ID NO: 87441 - DNA, 35 bp, Artificial Sequence
  Synthetic oligonucleotide
atggtgccggcgttgaggagaagggggatcaatgt

SEQ ID NO: 87442 - DNA, 35 bp, Artificial Sequence
  Synthetic oligonucleotide
gattcatgcgatgggcttggggggcatagttggtt

SEQ ID NO: 87443 - DNA, 35 bp, Artificial Sequence
  Synthetic oligonucleotide
atttcccgcctgagtgctactggcctggtgttgtt

SEQ ID NO: 87444 - DNA, 35 bp, Artificial Sequence
  Synthetic oligonucleotide
gaacctagcgcaccgccatgcaaaccacgtggttt

SEQ ID NO: 87445 - DNA, 34 bp, Artificial Sequence
  Synthetic oligonucleotide
acaccgatcgggcttgcgttcctgcggctttttt

SEQ ID NO: 87446 - DNA, 35 bp, Artificial Sequence
  Synthetic oligonucleotide
agccactggaagtggacagaggaaggggatgaaaa

SEQ ID NO: 87447 - DNA, 35 bp, Artificial Sequence
  Synthetic oligonucleotide
ttggactgccgcatcgactggctccaaggcacaaa

SEQ ID NO: 87448 - DNA, 36 bp, Artificial Sequence
  Synthetic oligonucleotide
acatcgacgggtgcgaccgtcattcgctattacaaa

SEQ ID NO: 87449 - DNA, 36 bp, Artificial Sequence
  Synthetic oligonucleotide
tggaatccgcaacatgcacgcccattgtctacacaa

SEQ ID NO: 87450 - DNA, 36 bp, Artificial Sequence
  Synthetic oligonucleotide
atgacccgtgcccggtgcaatcatcgaccatgacaa

SEQ ID NO: 87451 - DNA, 36 bp, Artificial Sequence
  Synthetic oligonucleotide
ttcaccccggctacatataccttggcctatgcgcaa

SEQ ID NO: 87452 - DNA, 36 bp, Artificial Sequence
  Synthetic oligonucleotide
tacttgccccactcgtgacatctgcctgtatcgcaa

SEQ ID NO: 87453 - DNA, 36 bp, Artificial Sequence
  Synthetic oligonucleotide
tttgagacaccctcaccatgtgattaacactacgaa

SEQ ID NO: 87454 - DNA, 35 bp, Artificial Sequence
  Synthetic oligonucleotide
gacacgaacgcaatcgccttcggacattccatgaa

SEQ ID NO: 87455 - DNA, 36 bp, Artificial Sequence
  Synthetic oligonucleotide
acactccgtggctgtgttcgcacccggacttttgaa

SEQ ID NO: 87456 - DNA, 36 bp, Artificial Sequence
  Synthetic oligonucleotide
tcccaccccgttcccttacggctgctggaaatgtaa

SEQ ID NO: 87457 - DNA, 36 bp, Artificial Sequence
  Synthetic oligonucleotide
acatacgcctgtcgcgaccgaacgcctgacacttaa

SEQ ID NO: 87458 - DNA, 36 bp, Artificial Sequence
  Synthetic oligonucleotide
tagacacacgctgcattacaagccgaaccaccttaa

SEQ ID NO: 87459 - DNA, 35 bp, Artificial Sequence
  Synthetic oligonucleotide
tgcgccgttctccagctactcctggtcatgccaca

SEQ ID NO: 87460 - DNA, 36 bp, Artificial Sequence
  Synthetic oligonucleotide
gtatgacctgttgaggtaggggaggggtgcgggaca

SEQ ID NO: 87461 - DNA, 35 bp, Artificial Sequence
  Synthetic oligonucleotide
ctgagtctcctggacgtccattgcactttttacca

SEQ ID NO: 87462 - DNA, 35 bp, Artificial Sequence
  Synthetic oligonucleotide
tcccgccgcctttgatcttccataaaacctgccca

SEQ ID NO: 87463 - DNA, 35 bp, Artificial Sequence
  Synthetic oligonucleotide
tcattggcatcctcctctcaccggcccgtgatcca

SEQ ID NO: 87464 - DNA, 36 bp, Artificial Sequence
  Synthetic oligonucleotide
aacgcgcatggcctatgcctggaaccaccctctcca

SEQ ID NO: 87465 - DNA, 35 bp, Artificial Sequence
  Synthetic oligonucleotide
gatccgatattgtgtcatccttccatacttcagca

SEQ ID NO: 87466 - DNA, 36 bp, Artificial Sequence
  Synthetic oligonucleotide
tcatgacccccgcgccgaccactggagctttctgca

SEQ ID NO: 87467 - DNA, 35 bp, Artificial Sequence
  Synthetic oligonucleotide
accggacgtcacaagatctgcaccatccggcatca

SEQ ID NO: 87468 - DNA, 36 bp, Artificial Sequence
  Synthetic oligonucleotide
acgaggacacccatgacgcgacacctggttctatca

SEQ ID NO: 87469 - DNA, 36 bp, Artificial Sequence
  Synthetic oligonucleotide
tgcgtgatccgttcctcagcaagccctattcattca

SEQ ID NO: 87470 - DNA, 35 bp, Artificial Sequence
  Synthetic oligonucleotide
acaaatccacgacacgaccacctctgtgactttca

SEQ ID NO: 87471 - DNA, 36 bp, Artificial Sequence
  Synthetic oligonucleotide
gccaaccgatcctcgtctgtctacccatggcgtaga

SEQ ID NO: 87472 - DNA, 37 bp, Artificial Sequence
  Synthetic oligonucleotide
gtccctgacgcgtgcccgtatccgcccgttgagacga

SEQ ID NO: 87473 - DNA, 36 bp, Artificial Sequence
  Synthetic oligonucleotide
tcgaccactgagtccttaagctttccctgagcccga

SEQ ID NO: 87474 - DNA, 37 bp, Artificial Sequence
  Synthetic oligonucleotide
tgaaagccctagattccacgccgcgcgctcctcccga

SEQ ID NO: 87475 - DNA, 37 bp, Artificial Sequence
  Synthetic oligonucleotide
gaccacccttaatggcctccctctattctggagccga

SEQ ID NO: 87476 - DNA, 37 bp, Artificial Sequence
  Synthetic oligonucleotide
gatagagaaagggaggagggatgatgcagtggtccga

SEQ ID NO: 87477 - DNA, 37 bp, Artificial Sequence
  Synthetic oligonucleotide
tgatgcgtaacacccgcagacccacgttcacactcga

SEQ ID NO: 87478 - DNA, 35 bp, Artificial Sequence
  Synthetic oligonucleotide
tagcagtcagaactgcctctcatccacttggtcga

SEQ ID NO: 87479 - DNA, 37 bp, Artificial Sequence
  Synthetic oligonucleotide
tgataggggggttcagtgggtgggacatcagcttcga

SEQ ID NO: 87480 - DNA, 37 bp, Artificial Sequence
  Synthetic oligonucleotide
ttgttcaccctgtagtattgaaatcttccctcttcga

SEQ ID NO: 87481 - DNA, 35 bp, Artificial Sequence
  Synthetic oligonucleotide
gcaaccccactgccggcatatctggatttcttcga

SEQ ID NO: 87482 - DNA, 37 bp, Artificial Sequence
  Synthetic oligonucleotide
acccacttccccggtgttatgatgctctctattagga

SEQ ID NO: 87483 - DNA, 37 bp, Artificial Sequence
  Synthetic oligonucleotide
ggagacagatgaagggcggggaataatgaaaaacgga

SEQ ID NO: 87484 - DNA, 37 bp, Artificial Sequence
  Synthetic oligonucleotide
atcgtgagcacttacttgcctgctgacaccccccgga

SEQ ID NO: 87485 - DNA, 37 bp, Artificial Sequence
  Synthetic oligonucleotide
ttgtccacctagcttatgcataacttgcccttaggga

SEQ ID NO: 87486 - DNA, 37 bp, Artificial Sequence
  Synthetic oligonucleotide
tgatggtggcggaggacaaggaaagaatcatagggga

SEQ ID NO: 87487 - DNA, 37 bp, Artificial Sequence
  Synthetic oligonucleotide
ttaaaccgcggttggcatcctcgtaactccactggga

SEQ ID NO: 87488 - DNA, 35 bp, Artificial Sequence
  Synthetic oligonucleotide
gatgtgggagcgatgatgagtgggaatgtttggga

SEQ ID NO: 87489 - DNA, 35 bp, Artificial Sequence
  Synthetic oligonucleotide
acgggacgggaagtgggttacgggtatagggtgga

SEQ ID NO: 87490 - DNA, 38 bp, Artificial Sequence
  Synthetic oligonucleotide
tatagccgaacacatgccctaagcataagcctacatga

SEQ ID NO: 87491 - DNA, 38 bp, Artificial Sequence
  Synthetic oligonucleotide
gccatacagtagcagcgataaaaacaggtgtggcatga

SEQ ID NO: 87492 - DNA, 38 bp, Artificial Sequence
  Synthetic oligonucleotide
accgctagtcagtaccgggccaactacgcctttcatga

SEQ ID NO: 87493 - DNA, 37 bp, Artificial Sequence
  Synthetic oligonucleotide
acgggggggagggggggcgatggagagcgtgagatga

SEQ ID NO: 87494 - DNA, 38 bp, Artificial Sequence
  Synthetic oligonucleotide
gaaggacgcgaggagaaggtcgggtcgaggggttatga

SEQ ID NO: 87495 - DNA, 36 bp, Artificial Sequence
  Synthetic oligonucleotide
acgtgcgtagcctacccacttgattgatttaactga

SEQ ID NO: 87496 - DNA, 38 bp, Artificial Sequence
  Synthetic oligonucleotide
aacctcccccttctgcgtggctcacatgtgatcactga

SEQ ID NO: 87497 - DNA, 38 bp, Artificial Sequence
  Synthetic oligonucleotide
tctcacctgcttctgtatctcgctctccctgtcactga

SEQ ID NO: 87498 - DNA, 37 bp, Artificial Sequence
  Synthetic oligonucleotide
aggtgccactgtgacttcgaactccgcaaaaccctga

SEQ ID NO: 87499 - DNA, 38 bp, Artificial Sequence
  Synthetic oligonucleotide
tgatcacatgcacctgtctcccaatgcgcacttcctga

SEQ ID NO: 87500 - DNA, 37 bp, Artificial Sequence
  Synthetic oligonucleotide
gtgtacctccccgcatttgttgactccctagacgtga

SEQ ID NO: 87501 - DNA, 38 bp, Artificial Sequence
  Synthetic oligonucleotide
aacgcatggcctctgggatccatcaatgtccgccgtga

SEQ ID NO: 87502 - DNA, 38 bp, Artificial Sequence
  Synthetic oligonucleotide
agcggagggaaaaggtgcgaaagtagatgcccaggtga

SEQ ID NO: 87503 - DNA, 38 bp, Artificial Sequence
  Synthetic oligonucleotide
gcttggcacgggcatgggaaaaatgtgggggtaggtga

SEQ ID NO: 87504 - DNA, 37 bp, Artificial Sequence
  Synthetic oligonucleotide
agcaacacggtggaagcgaataaaatgggaggggtga

SEQ ID NO: 87505 - DNA, 36 bp, Artificial Sequence
  Synthetic oligonucleotide
gaaacggtgggttaggtaagggatggcatttggtga

SEQ ID NO: 87506 - DNA, 37 bp, Artificial Sequence
  Synthetic oligonucleotide
gctggggctgggaagggctacgagtgggaccctgtga

SEQ ID NO: 87507 - DNA, 37 bp, Artificial Sequence
  Synthetic oligonucleotide
gacccgcctgccgtactcaattgctgtttcattgtga

SEQ ID NO: 87508 - DNA, 35 bp, Artificial Sequence
  Synthetic oligonucleotide
atccgtcctagccatttctttatctttcgttgtga

SEQ ID NO: 87509 - DNA, 38 bp, Artificial Sequence
  Synthetic oligonucleotide
tgacacgtccagcacagccttataaccttccaaattga

SEQ ID NO: 87510 - DNA, 38 bp, Artificial Sequence
  Synthetic oligonucleotide
aactggggcagtattacatgcgcacctgtcaccattga

SEQ ID NO: 87511 - DNA, 38 bp, Artificial Sequence
  Synthetic oligonucleotide
tggactcacacatgcactcgcacaccctaatttattga

SEQ ID NO: 87512 - DNA, 38 bp, Artificial Sequence
  Synthetic oligonucleotide
tctggtaccgccctatcccatctacgtcagtcacttga

SEQ ID NO: 87513 - DNA, 38 bp, Artificial Sequence
  Synthetic oligonucleotide
gatgcgggaatggagggggagacataagtcaaagttga

SEQ ID NO: 87514 - DNA, 38 bp, Artificial Sequence
  Synthetic oligonucleotide
gctgtccctgcaatcagccgcgaattctgccccgttga

SEQ ID NO: 87515 - DNA, 36 bp, Artificial Sequence
  Synthetic oligonucleotide
gcgtcgcccccagttgttcccaatgctttctgttga

SEQ ID NO: 87516 - DNA, 38 bp, Artificial Sequence
  Synthetic oligonucleotide
atccactaccgatcctagaactgtacctatcttgttga

SEQ ID NO: 87517 - DNA, 35 bp, Artificial Sequence
  Synthetic oligonucleotide
gtcgcaaccctgtgctacgccattacattgaaata

SEQ ID NO: 87518 - DNA, 35 bp, Artificial Sequence
  Synthetic oligonucleotide
tcaccacgggagtctcgctctttcgtttagcaata

SEQ ID NO: 87519 - DNA, 36 bp, Artificial Sequence
  Synthetic oligonucleotide
gtggtcgcctctcctactcgcctagttattcacata

SEQ ID NO: 87520 - DNA, 35 bp, Artificial Sequence
  Synthetic oligonucleotide
gactgagggaaagcaggaaagtaacgcagctgata

SEQ ID NO: 87521 - DNA, 36 bp, Artificial Sequence
  Synthetic oligonucleotide
gttccacgatcaattgctcttggccttgttcttata

SEQ ID NO: 87522 - DNA, 36 bp, Artificial Sequence
  Synthetic oligonucleotide
acaggggtggcggagggggcgaacaatgcgcaccta

SEQ ID NO: 87523 - DNA, 35 bp, Artificial Sequence
  Synthetic oligonucleotide
gtacgccccgcatttccaaggatcgatctccagta

SEQ ID NO: 87524 - DNA, 36 bp, Artificial Sequence
  Synthetic oligonucleotide
agtaacgcattacgcttatttctgaccatctacgta

SEQ ID NO: 87525 - DNA, 35 bp, Artificial Sequence
  Synthetic oligonucleotide
ttcgaggccgaccctctctggaaagtgcgcgatta

SEQ ID NO: 87526 - DNA, 34 bp, Artificial Sequence
  Synthetic oligonucleotide
gaccgctcacgcccaccctggtatggtttcaaac

SEQ ID NO: 87527 - DNA, 35 bp, Artificial Sequence
  Synthetic oligonucleotide
gtagcaaacacctcgtaacggacctgtgcgcccac

SEQ ID NO: 87528 - DNA, 35 bp, Artificial Sequence
  Synthetic oligonucleotide
atgccaaccacatcgaagcgtcgtattatgatgac

SEQ ID NO: 87529 - DNA, 35 bp, Artificial Sequence
  Synthetic oligonucleotide
tgttgcctcttggattcctgccggacatagcctac

SEQ ID NO: 87530 - DNA, 35 bp, Artificial Sequence
  Synthetic oligonucleotide
atccaccccgataactagtaccgggggtctcctac

SEQ ID NO: 87531 - DNA, 35 bp, Artificial Sequence
  Synthetic oligonucleotide
gctgagagtggggtttgtgaggatggtgaagctac

SEQ ID NO: 87532 - DNA, 35 bp, Artificial Sequence
  Synthetic oligonucleotide
gtcaacgggggggaaactctaaatagggacaaacc

SEQ ID NO: 87533 - DNA, 35 bp, Artificial Sequence
  Synthetic oligonucleotide
tcaccgaccgcacgtagtcaggcctagcatatacc

SEQ ID NO: 87534 - DNA, 35 bp, Artificial Sequence
  Synthetic oligonucleotide
tacacccagcaggtaacttgaccgtgttcgtcgcc

SEQ ID NO: 87535 - DNA, 35 bp, Artificial Sequence
  Synthetic oligonucleotide
gcgtgccccctaagccttacattccttgacactcc

SEQ ID NO: 87536 - DNA, 35 bp, Artificial Sequence
  Synthetic oligonucleotide
ataatcgaacggcgtattgtcacctagctgcctcc

SEQ ID NO: 87537 - DNA, 35 bp, Artificial Sequence
  Synthetic oligonucleotide
ttgccgaccggtcacgagggcgatctggtcacatc

SEQ ID NO: 87538 - DNA, 35 bp, Artificial Sequence
  Synthetic oligonucleotide
tgtaggtccagtaacttcctccgtggcaccacctc

SEQ ID NO: 87539 - DNA, 35 bp, Artificial Sequence
  Synthetic oligonucleotide
gaaccagcaaaaattcgctttaactgctagcagtc

SEQ ID NO: 87540 - DNA, 36 bp, Artificial Sequence
  Synthetic oligonucleotide
gaacgcgttggagtttgctggcgcctcgttctcttc

SEQ ID NO: 87541 - DNA, 35 bp, Artificial Sequence
  Synthetic oligonucleotide
agccgagccgtagggttccggtttcgtaccttttc

SEQ ID NO: 87542 - DNA, 35 bp, Artificial Sequence
  Synthetic oligonucleotide
acgaacaacccgtcctcatagtacatgcgcaagag

SEQ ID NO: 87543 - DNA, 35 bp, Artificial Sequence
  Synthetic oligonucleotide
tagtagcccactcattgcagccattcaacacgtag

SEQ ID NO: 87544 - DNA, 35 bp, Artificial Sequence
  Synthetic oligonucleotide
acatacgctcgggaccctattttcgttcacaaacg

SEQ ID NO: 87545 - DNA, 35 bp, Artificial Sequence
  Synthetic oligonucleotide
agccgacccccgagcaatccgaaagaccgcgcacg

SEQ ID NO: 87546 - DNA, 35 bp, Artificial Sequence
  Synthetic oligonucleotide
ttggggcgggaactaccaaaacacagggaacaccg

SEQ ID NO: 87547 - DNA, 35 bp, Artificial Sequence
  Synthetic oligonucleotide
ggagtcgtggtcaccccacaatcgtgtcatccccg

SEQ ID NO: 87548 - DNA, 35 bp, Artificial Sequence
  Synthetic oligonucleotide
tgatcgcgaggtgatcggtacaccctgttcaatcg

SEQ ID NO: 87549 - DNA, 35 bp, Artificial Sequence
  Synthetic oligonucleotide
acgcgatccttagcggcctgcacttttctttctcg

SEQ ID NO: 87550 - DNA, 35 bp, Artificial Sequence
  Synthetic oligonucleotide
gatttcgcgcacatcggaacggcctgtcccttagg

SEQ ID NO: 87551 - DNA, 35 bp, Artificial Sequence
  Synthetic oligonucleotide
gagaccgagataggtcaatgatcaaatagtggggg

SEQ ID NO: 87552 - DNA, 35 bp, Artificial Sequence
  Synthetic oligonucleotide
aagtccgggggagaaagatttacgtgcagggatgg

SEQ ID NO: 87553 - DNA, 35 bp, Artificial Sequence
  Synthetic oligonucleotide
acaaacgctgagtagcggattgcatttcatcctgg

SEQ ID NO: 87554 - DNA, 35 bp, Artificial Sequence
  Synthetic oligonucleotide
ggtgtactgcaatggtcgaaatatggtcgttgtgg

SEQ ID NO: 87555 - DNA, 35 bp, Artificial Sequence
  Synthetic oligonucleotide
tagccaagccgcggttcttctatcaatggcattgg

SEQ ID NO: 87556 - DNA, 35 bp, Artificial Sequence
  Synthetic oligonucleotide
caatcagactcgatggccctttcgtttcctccctg

SEQ ID NO: 87557 - DNA, 35 bp, Artificial Sequence
  Synthetic oligonucleotide
gttacacccagggagccagcgctctctatgctctg

SEQ ID NO: 87558 - DNA, 35 bp, Artificial Sequence
  Synthetic oligonucleotide
ggagtgaggaggggatcggcgggttgacgttggtg

SEQ ID NO: 87559 - DNA, 35 bp, Artificial Sequence
  Synthetic oligonucleotide
tgaccacacctggagcgtaatggcaaatttggttg

SEQ ID NO: 87560 - DNA, 35 bp, Artificial Sequence
  Synthetic oligonucleotide
ggagcgcccatagcattcccgttcgtaatactcat

SEQ ID NO: 87561 - DNA, 35 bp, Artificial Sequence
  Synthetic oligonucleotide
accgggggggggatgataaagggtgagctgccgat

SEQ ID NO: 87562 - DNA, 35 bp, Artificial Sequence
  Synthetic oligonucleotide
atgagggggggcgtagaaacggtggtcaaaatgct

SEQ ID NO: 87563 - DNA, 35 bp, Artificial Sequence
  Synthetic oligonucleotide
tatgcacggtgcgttgttctctcgcgtgcgatgct

SEQ ID NO: 87564 - DNA, 35 bp, Artificial Sequence
  Synthetic oligonucleotide
ttgagcactgttgtctcactgataggtgctgttct

SEQ ID NO: 87565 - DNA, 35 bp, Artificial Sequence
  Synthetic oligonucleotide
gccacctggcgtattccgagtatcggatattttct

SEQ ID NO: 87566 - DNA, 35 bp, Artificial Sequence
  Synthetic oligonucleotide
tagcgtggtaatattagagagggggggatcagagt

SEQ ID NO: 87567 - DNA, 36 bp, Artificial Sequence
  Synthetic oligonucleotide
gtgggaacgatgcaaggcggcaaagggtggctaggt

SEQ ID NO: 87568 - DNA, 35 bp, Artificial Sequence
  Synthetic oligonucleotide
gcgaacaccatagcagaggtgatacacatttctgt

SEQ ID NO: 87569 - DNA, 35 bp, Artificial Sequence
  Synthetic oligonucleotide
actacaccttcacccgccgtgtaccgccacctttt

SEQ ID NO: 87570 - DNA, 36 bp, Artificial Sequence
  Synthetic oligonucleotide
gcacaactgacccagtctgcgttgcaacaccccaaa

SEQ ID NO: 87571 - DNA, 35 bp, Artificial Sequence
  Synthetic oligonucleotide
gagggtgggagccccgagtaaaggggtagtggaaa

SEQ ID NO: 87572 - DNA, 35 bp, Artificial Sequence
  Synthetic oligonucleotide
tatcacattggttcgtgccgctgtgccactctaaa

SEQ ID NO: 87573 - DNA, 35 bp, Artificial Sequence
  Synthetic oligonucleotide
tcctcctcgtgtgtacctgcttctgctctgcacaa

SEQ ID NO: 87574 - DNA, 35 bp, Artificial Sequence
  Synthetic oligonucleotide
atctggggagggcatgtaaatcgatcaggagacaa

SEQ ID NO: 87575 - DNA, 35 bp, Artificial Sequence
  Synthetic oligonucleotide
aatctgcctgactcgtagtttctatccgaacccaa

SEQ ID NO: 87576 - DNA, 36 bp, Artificial Sequence
  Synthetic oligonucleotide
accacaccacttcaactcacgcattgagaccagcaa

SEQ ID NO: 87577 - DNA, 36 bp, Artificial Sequence
  Synthetic oligonucleotide
tgaggagagggtggggaagtgttttttggccggcaa

SEQ ID NO: 87578 - DNA, 35 bp, Artificial Sequence
  Synthetic oligonucleotide
acctgtgccctctctgcttgcgcgatttattgcaa

SEQ ID NO: 87579 - DNA, 36 bp, Artificial Sequence
  Synthetic oligonucleotide
atgcccccgaccagccgttctatccagcttggagaa

SEQ ID NO: 87580 - DNA, 36 bp, Artificial Sequence
  Synthetic oligonucleotide
gcaatccaagaggcgggtgtgggttatgggctggaa

SEQ ID NO: 87581 - DNA, 36 bp, Artificial Sequence
  Synthetic oligonucleotide
aaacgggggaaggtcaggcaatggtggtggcgctaa

SEQ ID NO: 87582 - DNA, 36 bp, Artificial Sequence
  Synthetic oligonucleotide
gactaccgcctacgggtcactctatacagtctctaa

SEQ ID NO: 87583 - DNA, 36 bp, Artificial Sequence
  Synthetic oligonucleotide
ggtccgaaagagggagggccgggtttgggagagtaa

SEQ ID NO: 87584 - DNA, 36 bp, Artificial Sequence
  Synthetic oligonucleotide
aaagagtgccgacggtgaggcctacgttggagaaca

SEQ ID NO: 87585 - DNA, 37 bp, Artificial Sequence
  Synthetic oligonucleotide
acaagcacctgcccgtctaaaatgcaccgcgggaaca

SEQ ID NO: 87586 - DNA, 36 bp, Artificial Sequence
  Synthetic oligonucleotide
tcagatgccctaccgtcctctgacatgtctcacaca

SEQ ID NO: 87587 - DNA, 36 bp, Artificial Sequence
  Synthetic oligonucleotide
ccccagggctcaggacccgcctacacagagtataca

SEQ ID NO: 87588 - DNA, 36 bp, Artificial Sequence
  Synthetic oligonucleotide
tggaccgccgccacgggtgagttaccgtccgcccca

SEQ ID NO: 87589 - DNA, 36 bp, Artificial Sequence
  Synthetic oligonucleotide
aacaggtcgtttccgcgttgaagcgctacctctcca

SEQ ID NO: 87590 - DNA, 36 bp, Artificial Sequence
  Synthetic oligonucleotide
taagtcacccacgaccgttataacacctgccttcca

SEQ ID NO: 87591 - DNA, 35 bp, Artificial Sequence
  Synthetic oligonucleotide
taaacacgagtccgaggggggcattggggtgagca

SEQ ID NO: 87592 - DNA, 36 bp, Artificial Sequence
  Synthetic oligonucleotide
atcgccgcctccattgggtagctgctcttcctcgca

SEQ ID NO: 87593 - DNA, 36 bp, Artificial Sequence
  Synthetic oligonucleotide
actgatagcaggggggaggagccggttatataggca

SEQ ID NO: 87594 - DNA, 35 bp, Artificial Sequence
  Synthetic oligonucleotide
tatacgtacgccattcaatccgggaccgcacctca

SEQ ID NO: 87595 - DNA, 35 bp, Artificial Sequence
  Synthetic oligonucleotide
ttggagtgcaggtacaccgttcatccttatagtca

SEQ ID NO: 87596 - DNA, 36 bp, Artificial Sequence
  Synthetic oligonucleotide
tgaccgactaaggtaactaactgatactcccgttca

SEQ ID NO: 87597 - DNA, 37 bp, Artificial Sequence
  Synthetic oligonucleotide
ttcccgtgcggatccgttcacattcagttcttccaga

SEQ ID NO: 87598 - DNA, 37 bp, Artificial Sequence
  Synthetic oligonucleotide
ttaccatcgatggactaacacctagcccttacaacga

SEQ ID NO: 87599 - DNA, 35 bp, Artificial Sequence
  Synthetic oligonucleotide
gtgcgtagcaccggggcgctttaacgggacctcga

SEQ ID NO: 87600 - DNA, 37 bp, Artificial Sequence
  Synthetic oligonucleotide
ttgtcgtcccacgtgttttttgtgttcttcggttcga

SEQ ID NO: 87601 - DNA, 37 bp, Artificial Sequence
  Synthetic oligonucleotide
gagcgggtaaagcagtctgggggacatagggcaagga

SEQ ID NO: 87602 - DNA, 37 bp, Artificial Sequence
  Synthetic oligonucleotide
ggaccggtggagataaatggggaaacgaggagaagga

SEQ ID NO: 87603 - DNA, 36 bp, Artificial Sequence
  Synthetic oligonucleotide
attctgcccggctccacctgcgaccagacaacagga

SEQ ID NO: 87604 - DNA, 35 bp, Artificial Sequence
  Synthetic oligonucleotide
gaccccagaatgtgctctgttacccctgttccgga

SEQ ID NO: 87605 - DNA, 36 bp, Artificial Sequence
  Synthetic oligonucleotide
gtgtgcgaggaaatagtcaatgaggaaaggcaggga

SEQ ID NO: 87606 - DNA, 37 bp, Artificial Sequence
  Synthetic oligonucleotide
ggaacggggagaagaagaggggcggcggataggggga

SEQ ID NO: 87607 - DNA, 37 bp, Artificial Sequence
  Synthetic oligonucleotide
ttcccccaggacgtacataccgcggaccaccgatgga

SEQ ID NO: 87608 - DNA, 37 bp, Artificial Sequence
  Synthetic oligonucleotide
aaccagcagagggcagcagggggtgagttagtatgga

SEQ ID NO: 87609 - DNA, 38 bp, Artificial Sequence
  Synthetic oligonucleotide
gagagctcgaatgcaaaacaatgacggacgaggaatga

SEQ ID NO: 87610 - DNA, 36 bp, Artificial Sequence
  Synthetic oligonucleotide
aaacactgtccacacttgatggaaatcgcaccatga

SEQ ID NO: 87611 - DNA, 38 bp, Artificial Sequence
  Synthetic oligonucleotide
aaccaagccatatgtggaagtatagtctgacgggatga

SEQ ID NO: 87612 - DNA, 38 bp, Artificial Sequence
  Synthetic oligonucleotide
gctgatgacggcattcattaagggagacggcaatatga

SEQ ID NO: 87613 - DNA, 38 bp, Artificial Sequence
  Synthetic oligonucleotide
gggggggcatgctgggtgggaggcaacggtacctatga

SEQ ID NO: 87614 - DNA, 37 bp, Artificial Sequence
  Synthetic oligonucleotide
caccactggtgacgggagaattgtaggcctagtatga

SEQ ID NO: 87615 - DNA, 37 bp, Artificial Sequence
  Synthetic oligonucleotide
gtacgcttagatggttgcgtgccccctcctcaactga

SEQ ID NO: 87616 - DNA, 38 bp, Artificial Sequence
  Synthetic oligonucleotide
gatgccttagcgaatcgatgaccttctctgggaactga

SEQ ID NO: 87617 - DNA, 38 bp, Artificial Sequence
  Synthetic oligonucleotide
atgggaccgacgatcgcacgggagaaagggggtactga

SEQ ID NO: 87618 - DNA, 36 bp, Artificial Sequence
  Synthetic oligonucleotide
ggcaactccacgaatgtaaaagccctccatccctga

SEQ ID NO: 87619 - DNA, 38 bp, Artificial Sequence
  Synthetic oligonucleotide
tgaaactgcctgtggtcttgagccgcaccgattcctga

SEQ ID NO: 87620 - DNA, 38 bp, Artificial Sequence
  Synthetic oligonucleotide
ttaaccacaccgctgcgttagtgtctaatgcttcctga

SEQ ID NO: 87621 - DNA, 37 bp, Artificial Sequence
  Synthetic oligonucleotide
ggaacaactcacggcataacgtttcccctttcagtga

SEQ ID NO: 87622 - DNA, 38 bp, Artificial Sequence
  Synthetic oligonucleotide
gcacgcttatgccactctgtcccgcttgatacacgtga

SEQ ID NO: 87623 - DNA, 38 bp, Artificial Sequence
  Synthetic oligonucleotide
gtgcagacgcgcctgtatgcctaaatttcctcacgtga

SEQ ID NO: 87624 - DNA, 37 bp, Artificial Sequence
  Synthetic oligonucleotide
aacgaccggcctctttctgcaatcttttttaaggtga

SEQ ID NO: 87625 - DNA, 37 bp, Artificial Sequence
  Synthetic oligonucleotide
accagccaccgttacgctaagatttgcgttctattga

SEQ ID NO: 87626 - DNA, 38 bp, Artificial Sequence
  Synthetic oligonucleotide
gtgacagcgcatccgactttcgcatacttcacccttga

SEQ ID NO: 87627 - DNA, 38 bp, Artificial Sequence
  Synthetic oligonucleotide
ggttgcgagccccacttggtcttcctgtctgcccttga

SEQ ID NO: 87628 - DNA, 37 bp, Artificial Sequence
  Synthetic oligonucleotide
gtccgaccagcgcttatcattgttagtgctcccttga

SEQ ID NO: 87629 - DNA, 37 bp, Artificial Sequence
  Synthetic oligonucleotide
ttgcaaccagtagtgagctctggcccgttctccttga

SEQ ID NO: 87630 - DNA, 38 bp, Artificial Sequence
  Synthetic oligonucleotide
tgcaactctgtgcccacccaaactcttggtcctcttga

SEQ ID NO: 87631 - DNA, 38 bp, Artificial Sequence
  Synthetic oligonucleotide
tccaccgcggcctgctgttgtcacgccttttctcttga

SEQ ID NO: 87632 - DNA, 37 bp, Artificial Sequence
  Synthetic oligonucleotide
acgatggagtgaacagggccctaaagagatacgttga

SEQ ID NO: 87633 - DNA, 38 bp, Artificial Sequence
  Synthetic oligonucleotide
gcgagagcttcacctagccatgttatcccgcctgttga

SEQ ID NO: 87634 - DNA, 38 bp, Artificial Sequence
  Synthetic oligonucleotide
tgagccaaggaggaaagaattatactggaccgtgttga

SEQ ID NO: 87635 - DNA, 38 bp, Artificial Sequence
  Synthetic oligonucleotide
gtctacaccactccgctttttatgtgcaccgcatttga

SEQ ID NO: 87636 - DNA, 38 bp, Artificial Sequence
  Synthetic oligonucleotide
gaccatctggtgcaaatgccgctgcaaggcatctttga

SEQ ID NO: 87637 - DNA, 36 bp, Artificial Sequence
  Synthetic oligonucleotide
tattgcaccttctgaacgcgcgggcactatgacata

SEQ ID NO: 87638 - DNA, 36 bp, Artificial Sequence
  Synthetic oligonucleotide
gatagaaaggggcaataaggagaattgggggaccta

SEQ ID NO: 87639 - DNA, 36 bp, Artificial Sequence
  Synthetic oligonucleotide
tcccatccatcttgctcccgaatcaaatcgtgagta

SEQ ID NO: 87640 - DNA, 35 bp, Artificial Sequence
  Synthetic oligonucleotide
gcccagcacctttcttcatatccgtttgtttcgta

SEQ ID NO: 87641 - DNA, 36 bp, Artificial Sequence
  Synthetic oligonucleotide
taggaggtgtcgggctgcggtgaatgggattgggta

SEQ ID NO: 87642 - DNA, 36 bp, Artificial Sequence
  Synthetic oligonucleotide
ccccaatgcgatccagcatgccccaacctccctgta

SEQ ID NO: 87643 - DNA, 35 bp, Artificial Sequence
  Synthetic oligonucleotide
gcctgagaacgggcgtacaggaaccccacacttta

SEQ ID NO: 87644 - DNA, 35 bp, Artificial Sequence
  Synthetic oligonucleotide
acgagagagagtggacaaaggtagtactgagacac

SEQ ID NO: 87645 - DNA, 35 bp, Artificial Sequence
  Synthetic oligonucleotide
ggtcggatcggcgttgcgcgttggccccactccac

SEQ ID NO: 87646 - DNA, 35 bp, Artificial Sequence
  Synthetic oligonucleotide
tgcgccacaatccacctactcatcaagatggtcac

SEQ ID NO: 87647 - DNA, 35 bp, Artificial Sequence
  Synthetic oligonucleotide
actcggagtccaacggtgtacgttgtcaaattacc

SEQ ID NO: 87648 - DNA, 35 bp, Artificial Sequence
  Synthetic oligonucleotide
accgcttacagtcttgagcactgtccatttctccc

SEQ ID NO: 87649 - DNA, 35 bp, Artificial Sequence
  Synthetic oligonucleotide
tataaccgcgagttcccgtaaggaggctcaaatcc

SEQ ID NO: 87650 - DNA, 35 bp, Artificial Sequence
  Synthetic oligonucleotide
gacatacaactgaaggtcctgccagaggcctgtcc

SEQ ID NO: 87651 - DNA, 35 bp, Artificial Sequence
  Synthetic oligonucleotide
aacccgtacatgcgataggtcctggttttgtgtcc

SEQ ID NO: 87652 - DNA, 35 bp, Artificial Sequence
  Synthetic oligonucleotide
tcgccctccgcccccaactgtttacgtaatattcc

SEQ ID NO: 87653 - DNA, 35 bp, Artificial Sequence
  Synthetic oligonucleotide
gccaggtcaccgcgcattgtttttacgtacgttcc

SEQ ID NO: 87654 - DNA, 35 bp, Artificial Sequence
  Synthetic oligonucleotide
ggatagccgccacatgcgattttccgtaactgttc

SEQ ID NO: 87655 - DNA, 35 bp, Artificial Sequence
  Synthetic oligonucleotide
acgccctacgccgccggacatcacctaaatgtttc

SEQ ID NO: 87656 - DNA, 35 bp, Artificial Sequence
  Synthetic oligonucleotide
agaccccgcacctggtcgcgcatttcacccacaag

SEQ ID NO: 87657 - DNA, 35 bp, Artificial Sequence
  Synthetic oligonucleotide
gatgctcagacgcgctcctcttgtccgatgcttag

SEQ ID NO: 87658 - DNA, 35 bp, Artificial Sequence
  Synthetic oligonucleotide
gagaagtgacaaaaagggatccgtgagcatcaagg

SEQ ID NO: 87659 - DNA, 35 bp, Artificial Sequence
  Synthetic oligonucleotide
attgcatgcgtacgtgatagggcacggcgtggagg

SEQ ID NO: 87660 - DNA, 35 bp, Artificial Sequence
  Synthetic oligonucleotide
attcggatgaggtaggaggggagagtgagcaccgg

SEQ ID NO: 87661 - DNA, 35 bp, Artificial Sequence
  Synthetic oligonucleotide
tggagtcgggaggggaatgagaatcgttgtcaggg

SEQ ID NO: 87662 - DNA, 35 bp, Artificial Sequence
  Synthetic oligonucleotide
aacgagtagacactgacgggactataatggggggg

SEQ ID NO: 87663 - DNA, 35 bp, Artificial Sequence
  Synthetic oligonucleotide
atatgaggagggagggccacaagggagacggtatg

SEQ ID NO: 87664 - DNA, 35 bp, Artificial Sequence
  Synthetic oligonucleotide
atgtccggggggtggtacgggtggtcgcgggactg

SEQ ID NO: 87665 - DNA, 35 bp, Artificial Sequence
  Synthetic oligonucleotide
atgatgggggggtgtgtattactgtcgtgtatctg

SEQ ID NO: 87666 - DNA, 35 bp, Artificial Sequence
  Synthetic oligonucleotide
gtagcgccgcacaaatttgccatctcttacccgtg

SEQ ID NO: 87667 - DNA, 35 bp, Artificial Sequence
  Synthetic oligonucleotide
acccgctgaccgtcccatttggttcctttcactat

SEQ ID NO: 87668 - DNA, 35 bp, Artificial Sequence
  Synthetic oligonucleotide
gtcacacgcctccgcggacccaaagagttccctat

SEQ ID NO: 87669 - DNA, 35 bp, Artificial Sequence
  Synthetic oligonucleotide
gttcgcccccaagcactagctctgtttcctacact

SEQ ID NO: 87670 - DNA, 35 bp, Artificial Sequence
  Synthetic oligonucleotide
tggacaagtcccgaagtctttcccgcgtcgcacct

SEQ ID NO: 87671 - DNA, 35 bp, Artificial Sequence
  Synthetic oligonucleotide
gaagcccccgccggggtgtttcatgcatgtaccct

SEQ ID NO: 87672 - DNA, 35 bp, Artificial Sequence
  Synthetic oligonucleotide
gagtcctcgtaggccaatctgtgctcactctgtct

SEQ ID NO: 87673 - DNA, 35 bp, Artificial Sequence
  Synthetic oligonucleotide
accgacgtcctgcgaatatcctcgtcccggattct

SEQ ID NO: 87674 - DNA, 35 bp, Artificial Sequence
  Synthetic oligonucleotide
tctaggtcgccgagcgtacccacaatctttgttct

SEQ ID NO: 87675 - DNA, 35 bp, Artificial Sequence
  Synthetic oligonucleotide
tatcgggcgagaatgcgtcgagccactgcttttct

SEQ ID NO: 87676 - DNA, 35 bp, Artificial Sequence
  Synthetic oligonucleotide
gactaacgagtggggggggaggtctagatggaagt

SEQ ID NO: 87677 - DNA, 35 bp, Artificial Sequence
  Synthetic oligonucleotide
gagaggtaggtggggaggacaataggcgttccggt

SEQ ID NO: 87678 - DNA, 35 bp, Artificial Sequence
  Synthetic oligonucleotide
accatggggagggagatctaagcatgatcgggggt

SEQ ID NO: 87679 - DNA, 35 bp, Artificial Sequence
  Synthetic oligonucleotide
gcgataagcagtaattggttagggaaagcgtgggt

SEQ ID NO: 87680 - DNA, 35 bp, Artificial Sequence
  Synthetic oligonucleotide
gacaggccgccacctcccgatgtcttcctatatgt

SEQ ID NO: 87681 - DNA, 35 bp, Artificial Sequence
  Synthetic oligonucleotide
tactgctatcaccatggacccgcatagtaatcatt

SEQ ID NO: 87682 - DNA, 35 bp, Artificial Sequence
  Synthetic oligonucleotide
tcaggtcctggttagccgtggtcttatcttgcctt

SEQ ID NO: 87683 - DNA, 35 bp, Artificial Sequence
  Synthetic oligonucleotide
atcagtgcggcatgagatacgcctggtcccttgtt

SEQ ID NO: 87684 - DNA, 35 bp, Artificial Sequence
  Synthetic oligonucleotide
gtcaggctccccgtctcagctgcctcccgtgattt

SEQ ID NO: 87685 - DNA, 35 bp, Artificial Sequence
  Synthetic oligonucleotide
ttgaccctgtctccattgccatacgcgcccacttt

SEQ ID NO: 87686 - DNA, 35 bp, Artificial Sequence
  Synthetic oligonucleotide
actccaggacctacgggggcacacagcaacctttt

SEQ ID NO: 87687 - DNA, 36 bp, Artificial Sequence
  Synthetic oligonucleotide
gtgaggggtgaccaacggggttgcgtgatagaaaaa

SEQ ID NO: 87688 - DNA, 36 bp, Artificial Sequence
  Synthetic oligonucleotide
tcacctcctgctgatcctcagtgtcccaactgaaaa

SEQ ID NO: 87689 - DNA, 36 bp, Artificial Sequence
  Synthetic oligonucleotide
gactacggacccggtaatttaactgctgcatttcaa

SEQ ID NO: 87690 - DNA, 36 bp, Artificial Sequence
  Synthetic oligonucleotide
gaccaccatcaccaccgcgcctactccagggtcgaa

SEQ ID NO: 87691 - DNA, 35 bp, Artificial Sequence
  Synthetic oligonucleotide
agttaacgcagagggggggattactatatggtgaa

SEQ ID NO: 87692 - DNA, 36 bp, Artificial Sequence
  Synthetic oligonucleotide
gccattcagcgccgaccgccgtcatccttactataa

SEQ ID NO: 87693 - DNA, 36 bp, Artificial Sequence
  Synthetic oligonucleotide
tcacggctcacatttgtcccgatcctgcctgtctaa

SEQ ID NO: 87694 - DNA, 36 bp, Artificial Sequence
  Synthetic oligonucleotide
tggatcaggcctgttccaccatgtgcaatctccaca

SEQ ID NO: 87695 - DNA, 35 bp, Artificial Sequence
  Synthetic oligonucleotide
ttagaccgaccgtcgtaggtgactcgtccactcca

SEQ ID NO: 87696 - DNA, 35 bp, Artificial Sequence
  Synthetic oligonucleotide
gatgcacgatgcgttcggactatatccgttctcca

SEQ ID NO: 87697 - DNA, 36 bp, Artificial Sequence
  Synthetic oligonucleotide
tatggatcctgtctcacacacgctgtttagtgtcca

SEQ ID NO: 87698 - DNA, 36 bp, Artificial Sequence
  Synthetic oligonucleotide
gctgcactcgttgagttttcgccgattcgttttcca

SEQ ID NO: 87699 - DNA, 35 bp, Artificial Sequence
  Synthetic oligonucleotide
acgaccctcctgatcagttgaactttggcctagca

SEQ ID NO: 87700 - DNA, 35 bp, Artificial Sequence
  Synthetic oligonucleotide
actcgaggacgaagggggcggtagacagaatcgca

SEQ ID NO: 87701 - DNA, 35 bp, Artificial Sequence
  Synthetic oligonucleotide
gacatgcgccgtatacagtggtagggattaaggca

SEQ ID NO: 87702 - DNA, 36 bp, Artificial Sequence
  Synthetic oligonucleotide
tgagcctagctgcatgattccgtcctggtcgcctca

SEQ ID NO: 87703 - DNA, 36 bp, Artificial Sequence
  Synthetic oligonucleotide
gacccatggaggtggccaagggagggggaattctca

SEQ ID NO: 87704 - DNA, 36 bp, Artificial Sequence
  Synthetic oligonucleotide
gccgccgcattccgcgttcctggtccccaaatttca

SEQ ID NO: 87705 - DNA, 37 bp, Artificial Sequence
  Synthetic oligonucleotide
ggacctggcccacaatccccaccttgctatggcaaga

SEQ ID NO: 87706 - DNA, 37 bp, Artificial Sequence
  Synthetic oligonucleotide
tccatcatgcccaaaaattgctccttaagacgacaga

SEQ ID NO: 87707 - DNA, 37 bp, Artificial Sequence
  Synthetic oligonucleotide
tgtagctaaggaggagatgaagtgtggtagtgcgaga

SEQ ID NO: 87708 - DNA, 37 bp, Artificial Sequence
  Synthetic oligonucleotide
acgtggctcacagtccacctccctccgctcttcgaga

SEQ ID NO: 87709 - DNA, 37 bp, Artificial Sequence
  Synthetic oligonucleotide
gatgcatgcagtgagctggttgacacggggacggaga

SEQ ID NO: 87710 - DNA, 37 bp, Artificial Sequence
  Synthetic oligonucleotide
gacacactatgggggaagaatggggacccgttgtaga

SEQ ID NO: 87711 - DNA, 37 bp, Artificial Sequence
  Synthetic oligonucleotide
tgtgcattccctcgacctgaagcgggccacccaacga

SEQ ID NO: 87712 - DNA, 36 bp, Artificial Sequence
  Synthetic oligonucleotide
gatggtgggggtgggaagtacagagatacatcacga

SEQ ID NO: 87713 - DNA, 37 bp, Artificial Sequence
  Synthetic oligonucleotide
aatgccatccgcctatacaccgacgtgtgtctcacga

SEQ ID NO: 87714 - DNA, 37 bp, Artificial Sequence
  Synthetic oligonucleotide
gccaatgcaccccttccgtccggttatcagccgacga

SEQ ID NO: 87715 - DNA, 37 bp, Artificial Sequence
  Synthetic oligonucleotide
gatcacctgcccttcaatcgttccagcgttttgacga

SEQ ID NO: 87716 - DNA, 37 bp, Artificial Sequence
  Synthetic oligonucleotide
ggtgcaacgggggggcaatgcagggtaagtcacccga

SEQ ID NO: 87717 - DNA, 37 bp, Artificial Sequence
  Synthetic oligonucleotide
gtgtcccgaacacatgtctacccgggtcgtagcccga

SEQ ID NO: 87718 - DNA, 32 bp, Artificial Sequence
  Synthetic oligonucleotide
tgagcgcatcccaaaacactcatcgcttccga

SEQ ID NO: 87719 - DNA, 37 bp, Artificial Sequence
  Synthetic oligonucleotide
attcaacggtcgccgctcccatcctgatttcgggcga

SEQ ID NO: 87720 - DNA, 37 bp, Artificial Sequence
  Synthetic oligonucleotide
gtaggagggggtagtgaaaagtagagggcggatgcga

SEQ ID NO: 87721 - DNA, 36 bp, Artificial Sequence
  Synthetic oligonucleotide
gtgtcgcacaggttctatccgacactcattggtcga

SEQ ID NO: 87722 - DNA, 37 bp, Artificial Sequence
  Synthetic oligonucleotide
tctcacttacctcaggggcttatgacacctctttcga

SEQ ID NO: 87723 - DNA, 37 bp, Artificial Sequence
  Synthetic oligonucleotide
gatggactggcgggagaaggggattgagatgggagga

SEQ ID NO: 87724 - DNA, 37 bp, Artificial Sequence
  Synthetic oligonucleotide
ttgacttgctctgtttctgattatgccctccggcgga

SEQ ID NO: 87725 - DNA, 36 bp, Artificial Sequence
  Synthetic oligonucleotide
ttgtgatacccgaaccaaccgactcttatcttcgga

SEQ ID NO: 87726 - DNA, 37 bp, Artificial Sequence
  Synthetic oligonucleotide
gtcgacggaggcgagggacgggctgccaagtttcgga

SEQ ID NO: 87727 - DNA, 35 bp, Artificial Sequence
  Synthetic oligonucleotide
tccatgacagaagaaaattgcgcaagcacggggga

SEQ ID NO: 87728 - DNA, 36 bp, Artificial Sequence
  Synthetic oligonucleotide
agtcagaagaggatgctgaaaattgtggtgtgggga

SEQ ID NO: 87729 - DNA, 37 bp, Artificial Sequence
  Synthetic oligonucleotide
gtggacctccctcaaaccgtagaactgttcgcctgga

SEQ ID NO: 87730 - DNA, 37 bp, Artificial Sequence
  Synthetic oligonucleotide
atcgactggccctttgcccattcaacacctacttgga

SEQ ID NO: 87731 - DNA, 37 bp, Artificial Sequence
  Synthetic oligonucleotide
gtatgagggcgggggtgtggtgggtccggtctttgga

SEQ ID NO: 87732 - DNA, 38 bp, Artificial Sequence
  Synthetic oligonucleotide
gccgcaatgcgcaactgccctcgcctcagtcgccatga

SEQ ID NO: 87733 - DNA, 35 bp, Artificial Sequence
  Synthetic oligonucleotide
tgttccaactcgcatttacatgaggaaactcatga

SEQ ID NO: 87734 - DNA, 38 bp, Artificial Sequence
  Synthetic oligonucleotide
attgggccacagtcacagtgcgaaggcccaacatatga

SEQ ID NO: 87735 - DNA, 37 bp, Artificial Sequence
  Synthetic oligonucleotide
gttcgggtcgcagtatgtgcttctttgctttccctga

SEQ ID NO: 87736 - DNA, 38 bp, Artificial Sequence
  Synthetic oligonucleotide
tgcccattctagaatgccatcatcacacccaggcctga

SEQ ID NO: 87737 - DNA, 38 bp, Artificial Sequence
  Synthetic oligonucleotide
gcaaacagtgtcaaatggggggatgcagggttggctga

SEQ ID NO: 87738 - DNA, 38 bp, Artificial Sequence
  Synthetic oligonucleotide
tgagaaccgcacaaatgctccccgtcctggaatgctga

SEQ ID NO: 87739 - DNA, 37 bp, Artificial Sequence
  Synthetic oligonucleotide
tccacactcggcccttggatatgctcgaagtttctga

SEQ ID NO: 87740 - DNA, 38 bp, Artificial Sequence
  Synthetic oligonucleotide
attggtggagtgggaagggcgaagcgttagcgaagtga

SEQ ID NO: 87741 - DNA, 38 bp, Artificial Sequence
  Synthetic oligonucleotide
gccgtggtggtgagagagcgtggcgagggggggagtga

SEQ ID NO: 87742 - DNA, 38 bp, Artificial Sequence
  Synthetic oligonucleotide
agtcacaaagggtgggtctagggcgtgggataacgtga

SEQ ID NO: 87743 - DNA, 36 bp, Artificial Sequence
  Synthetic oligonucleotide
tgacaaaggtttggtggctattatgcaggagggtga

SEQ ID NO: 87744 - DNA, 38 bp, Artificial Sequence
  Synthetic oligonucleotide
tcacccagtgttggagggacggaggacaatgaatgtga

SEQ ID NO: 87745 - DNA, 38 bp, Artificial Sequence
  Synthetic oligonucleotide
agtggggggactacaaggggttaggggagaccgtgtga

SEQ ID NO: 87746 - DNA, 38 bp, Artificial Sequence
  Synthetic oligonucleotide
gcacaaacggcacgtaggagactgggaatccggtgtga

SEQ ID NO: 87747 - DNA, 37 bp, Artificial Sequence
  Synthetic oligonucleotide
tcaacctgacaagaactggaacaaaggctgtttgtga

SEQ ID NO: 87748 - DNA, 38 bp, Artificial Sequence
  Synthetic oligonucleotide
tagcaacccgggacgtcatagcaaggtgtgccgattga

SEQ ID NO: 87749 - DNA, 38 bp, Artificial Sequence
  Synthetic oligonucleotide
gtcagacagccgggttacgccaacactctccttattga

SEQ ID NO: 87750 - DNA, 36 bp, Artificial Sequence
  Synthetic oligonucleotide
tgatgccgaagtaggtttccgttccctggggcttga

SEQ ID NO: 87751 - DNA, 38 bp, Artificial Sequence
  Synthetic oligonucleotide
gataacgccgtgtgcgactgggacgaccccccatttga

SEQ ID NO: 87752 - DNA, 38 bp, Artificial Sequence
  Synthetic oligonucleotide
ttcacatccctttcgattgctcttgttactgactttga

SEQ ID NO: 87753 - DNA, 38 bp, Artificial Sequence
  Synthetic oligonucleotide
tttacaccatgcccatgcccgggtcgagacgtttttga

SEQ ID NO: 87754 - DNA, 35 bp, Artificial Sequence
  Synthetic oligonucleotide
gcctgtcgcagacctgggctgtcctcgtctttcta

SEQ ID NO: 87755 - DNA, 35 bp, Artificial Sequence
  Synthetic oligonucleotide
acccaccctcgctatgccacttcattgtctttcta

SEQ ID NO: 87756 - DNA, 36 bp, Artificial Sequence
  Synthetic oligonucleotide
ttgtgaagccacatgcaaggggaacgaacgggggta

SEQ ID NO: 87757 - DNA, 35 bp, Artificial Sequence
  Synthetic oligonucleotide
tcgtcgccgcatttgctccacctgacgaccttgta

SEQ ID NO: 87758 - DNA, 36 bp, Artificial Sequence
  Synthetic oligonucleotide
tacgactaccaacatacacgctatgtgaccccctta

SEQ ID NO: 87759 - DNA, 35 bp, Artificial Sequence
  Synthetic oligonucleotide
accaaggcacctaacccggaccgacgatcccgtta

SEQ ID NO: 87760 - DNA, 35 bp, Artificial Sequence
  Synthetic oligonucleotide
acgacacgtacatccgccagcctccgcgcgaacac

SEQ ID NO: 87761 - DNA, 35 bp, Artificial Sequence
  Synthetic oligonucleotide
gacaactgttgcctatcccgcggaattgcttatac

SEQ ID NO: 87762 - DNA, 35 bp, Artificial Sequence
  Synthetic oligonucleotide
tgctacgcaccgacgacccgctgaccttcgtaacc

SEQ ID NO: 87763 - DNA, 35 bp, Artificial Sequence
  Synthetic oligonucleotide
acaacatcagagtagccttttacagccatcgcacc

SEQ ID NO: 87764 - DNA, 35 bp, Artificial Sequence
  Synthetic oligonucleotide
gcctccataacgatctgtccatatatggtttcacc

SEQ ID NO: 87765 - DNA, 35 bp, Artificial Sequence
  Synthetic oligonucleotide
tcagaccgttattatgttcatctcttggttcagcc

SEQ ID NO: 87766 - DNA, 35 bp, Artificial Sequence
  Synthetic oligonucleotide
tgacacctgcccgtccatccgcgtggcatacggcc

SEQ ID NO: 87767 - DNA, 35 bp, Artificial Sequence
  Synthetic oligonucleotide
aactcccaggtaccgcgcttatgccgacgcaatcc

SEQ ID NO: 87768 - DNA, 35 bp, Artificial Sequence
  Synthetic oligonucleotide
actagagctgatgtcgatcttgatcctgcacctcc

SEQ ID NO: 87769 - DNA, 35 bp, Artificial Sequence
  Synthetic oligonucleotide
ggtctcgtgaactctgttaatgtccatcctgctcc

SEQ ID NO: 87770 - DNA, 35 bp, Artificial Sequence
  Synthetic oligonucleotide
ttccccttgcatgccctacctggcttctgacttcc

SEQ ID NO: 87771 - DNA, 35 bp, Artificial Sequence
  Synthetic oligonucleotide
ggccaccccaagtctcgatcctagatgtcccacgc

SEQ ID NO: 87772 - DNA, 35 bp, Artificial Sequence
  Synthetic oligonucleotide
tagctcccccagtacatcgcccatcgctccgctgc

SEQ ID NO: 87773 - DNA, 35 bp, Artificial Sequence
  Synthetic oligonucleotide
ggcgaacaccggctctgaatcttcatcccctctgc

SEQ ID NO: 87774 - DNA, 35 bp, Artificial Sequence
  Synthetic oligonucleotide
gtgtggttccccgtaagtcctgcgattagctctgc

SEQ ID NO: 87775 - DNA, 35 bp, Artificial Sequence
  Synthetic oligonucleotide
tgttgcccggcaaggcacgcgcaactagccatttc

SEQ ID NO: 87776 - DNA, 35 bp, Artificial Sequence
  Synthetic oligonucleotide
gcgcaagagcgtgtaggttaagggtaaggtagaag

SEQ ID NO: 87777 - DNA, 35 bp, Artificial Sequence
  Synthetic oligonucleotide
gaaccccgtcggtaccgcccaccaattatcatcag

SEQ ID NO: 87778 - DNA, 35 bp, Artificial Sequence
  Synthetic oligonucleotide
gtcaacctcactggctgattggatcccctccatag

SEQ ID NO: 87779 - DNA, 35 bp, Artificial Sequence
  Synthetic oligonucleotide
tcacgacaccgcattattctgcctgcatgtcctcg

SEQ ID NO: 87780 - DNA, 35 bp, Artificial Sequence
  Synthetic oligonucleotide
aagtggagtggggagatgattggcggaaggcgagg

SEQ ID NO: 87781 - DNA, 35 bp, Artificial Sequence
  Synthetic oligonucleotide
agagggacggtgtgggaacgtaagggctgagcggg

SEQ ID NO: 87782 - DNA, 35 bp, Artificial Sequence
  Synthetic oligonucleotide
gacgcaagggtagtgtggaatgcacatgtatcggg

SEQ ID NO: 87783 - DNA, 35 bp, Artificial Sequence
  Synthetic oligonucleotide
gctaccctccttcctgtgtacatccgctcctcggg

SEQ ID NO: 87784 - DNA, 35 bp, Artificial Sequence
  Synthetic oligonucleotide
atgtactgaaggtggttgaatgggtgacccagggg

SEQ ID NO: 87785 - DNA, 35 bp, Artificial Sequence
  Synthetic oligonucleotide
tgacaggaagagaggttttggtgtctagtaaatgg

SEQ ID NO: 87786 - DNA, 35 bp, Artificial Sequence
  Synthetic oligonucleotide
acacctccatcactgcgtttcctatgtgtcggatg

SEQ ID NO: 87787 - DNA, 35 bp, Artificial Sequence
  Synthetic oligonucleotide
ttggggcaggaaaaatggcaagctatggagtagtg

SEQ ID NO: 87788 - DNA, 35 bp, Artificial Sequence
  Synthetic oligonucleotide
atgtgacgaactttaggaggggctagggacaggtg

SEQ ID NO: 87789 - DNA, 35 bp, Artificial Sequence
  Synthetic oligonucleotide
gtacggcctcctctgcctcttggccctctatacat

SEQ ID NO: 87790 - DNA, 35 bp, Artificial Sequence
  Synthetic oligonucleotide
ggattggcctgactcttttggtgctgaagtatcat

SEQ ID NO: 87791 - DNA, 35 bp, Artificial Sequence
  Synthetic oligonucleotide
acatggaggcgtaacatccgctcaagtcttatcat

SEQ ID NO: 87792 - DNA, 35 bp, Artificial Sequence
  Synthetic oligonucleotide
tcgtggagggtgagaacggggctaggagtgtggat

SEQ ID NO: 87793 - DNA, 35 bp, Artificial Sequence
  Synthetic oligonucleotide
attccaggaccaggtgggggtggtgggttattgat

SEQ ID NO: 87794 - DNA, 35 bp, Artificial Sequence
  Synthetic oligonucleotide
tgatgcgagggacgggatgtggggcgtcatcgtat

SEQ ID NO: 87795 - DNA, 35 bp, Artificial Sequence
  Synthetic oligonucleotide
tcttagccctagacacgcgcattcgcccccgttat

SEQ ID NO: 87796 - DNA, 35 bp, Artificial Sequence
  Synthetic oligonucleotide
tccggaaccacatctcaatcccgaagtacatacct

SEQ ID NO: 87797 - DNA, 35 bp, Artificial Sequence
  Synthetic oligonucleotide
gacatgtgtcgtttctattcacgctttaaccccct

SEQ ID NO: 87798 - DNA, 35 bp, Artificial Sequence
  Synthetic oligonucleotide
tccaacacctggacgactcgtattactagtttcct

SEQ ID NO: 87799 - DNA, 35 bp, Artificial Sequence
  Synthetic oligonucleotide
gtactgctaggcataaagggtgcgaaggggaaggt

SEQ ID NO: 87800 - DNA, 35 bp, Artificial Sequence
  Synthetic oligonucleotide
tcctggttccggcccaccctcgcttgagatctggt

SEQ ID NO: 87801 - DNA, 35 bp, Artificial Sequence
  Synthetic oligonucleotide
gaacgctatgcgtaaggtttaggtggagtgttggt

SEQ ID NO: 87802 - DNA, 35 bp, Artificial Sequence
  Synthetic oligonucleotide
tgacattcgatcccgtggatcctccgtttctatgt

SEQ ID NO: 87803 - DNA, 35 bp, Artificial Sequence
  Synthetic oligonucleotide
aatgcacgccgtacccatcgcgactcctgcttatt

SEQ ID NO: 87804 - DNA, 35 bp, Artificial Sequence
  Synthetic oligonucleotide
gacacaccatgcttgagtacaccaactcaaggctt

SEQ ID NO: 87805 - DNA, 35 bp, Artificial Sequence
  Synthetic oligonucleotide
tacccacgcacaagatcttcctgtcatgcatattt

SEQ ID NO: 87806 - DNA, 35 bp, Artificial Sequence
  Synthetic oligonucleotide
ttagtgtcacgtgtcctcctcgctcctaacagaaa

SEQ ID NO: 87807 - DNA, 35 bp, Artificial Sequence
  Synthetic oligonucleotide
tgcgtcccatccctgaggtgctgtaattcttccaa

SEQ ID NO: 87808 - DNA, 36 bp, Artificial Sequence
  Synthetic oligonucleotide
aacccacatgacactggaagggacagaagagctcaa

SEQ ID NO: 87809 - DNA, 36 bp, Artificial Sequence
  Synthetic oligonucleotide
gaaagtgggatgcaacatgcgggggaggttacggaa

SEQ ID NO: 87810 - DNA, 36 bp, Artificial Sequence
  Synthetic oligonucleotide
tgtgagaagtgggaacaggcggttggtgcgttggaa

SEQ ID NO: 87811 - DNA, 36 bp, Artificial Sequence
  Synthetic oligonucleotide
aacccaagtgcaggtgcgccgtaacgcgatgttgaa

SEQ ID NO: 87812 - DNA, 36 bp, Artificial Sequence
  Synthetic oligonucleotide
ggggccagccccgcgttgcacctgatactcgactaa

SEQ ID NO: 87813 - DNA, 36 bp, Artificial Sequence
  Synthetic oligonucleotide
gaccatgcccaacggtccgcatactgactcgcctaa

SEQ ID NO: 87814 - DNA, 36 bp, Artificial Sequence
  Synthetic oligonucleotide
gtgcgctggcccatactgatattttcatgccgctaa

SEQ ID NO: 87815 - DNA, 36 bp, Artificial Sequence
  Synthetic oligonucleotide
taccccatgatcacggtctttgtagcaattgcaaca

SEQ ID NO: 87816 - DNA, 35 bp, Artificial Sequence
  Synthetic oligonucleotide
gtggtacgattacttgcttgtagcgccctatcaca

SEQ ID NO: 87817 - DNA, 36 bp, Artificial Sequence
  Synthetic oligonucleotide
tatcagacacgatgaacggtgtgagtgaagcagaca

SEQ ID NO: 87818 - DNA, 36 bp, Artificial Sequence
  Synthetic oligonucleotide
gtgctgttggcgtctcttattttgtcatcacctaca

SEQ ID NO: 87819 - DNA, 36 bp, Artificial Sequence
  Synthetic oligonucleotide
ttcaccgacccgatatatcaagcttacttttgtaca

SEQ ID NO: 87820 - DNA, 36 bp, Artificial Sequence
  Synthetic oligonucleotide
gagctatgcccgtcctatttataggccattcaacca

SEQ ID NO: 87821 - DNA, 35 bp, Artificial Sequence
  Synthetic oligonucleotide
taccgacggttccgcacctgcacggggtcctacca

SEQ ID NO: 87822 - DNA, 36 bp, Artificial Sequence
  Synthetic oligonucleotide
tatcgtcaacacgtgacttaacacgcctttccccca

SEQ ID NO: 87823 - DNA, 36 bp, Artificial Sequence
  Synthetic oligonucleotide
tctactgccactacttgctttcgtgtctcgtatcca

SEQ ID NO: 87824 - DNA, 36 bp, Artificial Sequence
  Synthetic oligonucleotide
gaattcggcccctctctgacaagtccattcagtcca

SEQ ID NO: 87825 - DNA, 35 bp, Artificial Sequence
  Synthetic oligonucleotide
tgaaacgcccatgcctctcgtcgactcactttcca

SEQ ID NO: 87826 - DNA, 34 bp, Artificial Sequence
  Synthetic oligonucleotide
atatgtctgacccaacagacctcctttgtacgca

SEQ ID NO: 87827 - DNA, 35 bp, Artificial Sequence
  Synthetic oligonucleotide
atagtggacgtacgaacgagagatggaagcaggca

SEQ ID NO: 87828 - DNA, 36 bp, Artificial Sequence
  Synthetic oligonucleotide
gcacaaccatacaccgtagcacactgccttagatca

SEQ ID NO: 87829 - DNA, 37 bp, Artificial Sequence
  Synthetic oligonucleotide
tctgtaagccgatggatgggtggggtggcatggaaga

SEQ ID NO: 87830 - DNA, 36 bp, Artificial Sequence
  Synthetic oligonucleotide
gcgtagtgcggtgggggaaggttaataaatgggaga

SEQ ID NO: 87831 - DNA, 36 bp, Artificial Sequence
  Synthetic oligonucleotide
ggggacaggccccggtggtgggtggtgagggtgaga

SEQ ID NO: 87832 - DNA, 37 bp, Artificial Sequence
  Synthetic oligonucleotide
aatgcaaggcacatacgtgaaagaacgagggactaga

SEQ ID NO: 87833 - DNA, 37 bp, Artificial Sequence
  Synthetic oligonucleotide
tcgaacaagtggaggaggaggagcgaggggtcaacga

SEQ ID NO: 87834 - DNA, 37 bp, Artificial Sequence
  Synthetic oligonucleotide
ataaccccgacgcatacattacagccttctaggccga

SEQ ID NO: 87835 - DNA, 38 bp, Artificial Sequence
  Synthetic oligonucleotide
acatcattcgctcccggtcagcctagtggcggtgccga

SEQ ID NO: 87836 - DNA, 37 bp, Artificial Sequence
  Synthetic oligonucleotide
gcccatgaacagctccgtgcttactctaatcctccga

SEQ ID NO: 87837 - DNA, 37 bp, Artificial Sequence
  Synthetic oligonucleotide
gtggccctctcacgttgccaagttccgtggtttccga

SEQ ID NO: 87838 - DNA, 37 bp, Artificial Sequence
  Synthetic oligonucleotide
gcaggaagagggagatccgaaaggaagaggtgagcga

SEQ ID NO: 87839 - DNA, 37 bp, Artificial Sequence
  Synthetic oligonucleotide
gcgcaccattctccttcgtttttattcagccgcgcga

SEQ ID NO: 87840 - DNA, 37 bp, Artificial Sequence
  Synthetic oligonucleotide
gtccacgtaccagtgtcttcagaaccgttaatttcga

SEQ ID NO: 87841 - DNA, 38 bp, Artificial Sequence
  Synthetic oligonucleotide
agctgtggggcagggaaggggaggagttaagtatagga

SEQ ID NO: 87842 - DNA, 37 bp, Artificial Sequence
  Synthetic oligonucleotide
tgaagtggctatggagaaagaaaaaggaagggtagga

SEQ ID NO: 87843 - DNA, 37 bp, Artificial Sequence
  Synthetic oligonucleotide
tcaaacaaacggagggcgacccatgacggaggaggga

SEQ ID NO: 87844 - DNA, 36 bp, Artificial Sequence
  Synthetic oligonucleotide
acatgggagcgctgggggtcgaatggcttgtaggga

SEQ ID NO: 87845 - DNA, 37 bp, Artificial Sequence
  Synthetic oligonucleotide
agcgggcaggggacattgagactggtgtggcgtggga

SEQ ID NO: 87846 - DNA, 35 bp, Artificial Sequence
  Synthetic oligonucleotide
gttaaccccacgcctcaccgcagacgggtcatgga

SEQ ID NO: 87847 - DNA, 34 bp, Artificial Sequence
  Synthetic oligonucleotide
tgcccatcattccacggtgccgtctttttctgga

SEQ ID NO: 87848 - DNA, 38 bp, Artificial Sequence
  Synthetic oligonucleotide
atggggcggaggactggtggaaacctttagaatgatga

SEQ ID NO: 87849 - DNA, 37 bp, Artificial Sequence
  Synthetic oligonucleotide
tccacgcatccgccccgctcgttaaggccttttatga

SEQ ID NO: 87850 - DNA, 38 bp, Artificial Sequence
  Synthetic oligonucleotide
acgaaagggtggtggtgttttgagtgatgctgacctga

SEQ ID NO: 87851 - DNA, 37 bp, Artificial Sequence
  Synthetic oligonucleotide
gcgtacgcttcccgaagatcatggttccgctccctga

SEQ ID NO: 87852 - DNA, 37 bp, Artificial Sequence
  Synthetic oligonucleotide
ggacgtgcaccatatctgataaatttatcctgcctga

SEQ ID NO: 87853 - DNA, 37 bp, Artificial Sequence
  Synthetic oligonucleotide
tacaccaaaagggatggaggttcctgagaactcctga

SEQ ID NO: 87854 - DNA, 37 bp, Artificial Sequence
  Synthetic oligonucleotide
aaacaccccaggtgtcctattcatgcatcctcgctga

SEQ ID NO: 87855 - DNA, 38 bp, Artificial Sequence
  Synthetic oligonucleotide
acagcatatccttccgtacttaaccactgcactgctga

SEQ ID NO: 87856 - DNA, 38 bp, Artificial Sequence
  Synthetic oligonucleotide
tctggcttcctgctcctgtgcgaccatctctgttctga

SEQ ID NO: 87857 - DNA, 38 bp, Artificial Sequence
  Synthetic oligonucleotide
acccaatgcgacaaagcaaaatccaaaggcagaagtga

SEQ ID NO: 87858 - DNA, 38 bp, Artificial Sequence
  Synthetic oligonucleotide
tcacttgcccccactgcgttgccgacgacaattagtga

SEQ ID NO: 87859 - DNA, 34 bp, Artificial Sequence
  Synthetic oligonucleotide
gttaccatcatgcaccgcgctgacccctacgtga

SEQ ID NO: 87860 - DNA, 38 bp, Artificial Sequence
  Synthetic oligonucleotide
tgcggtggggggcgaagatgatgcaggggcgatcgtga

SEQ ID NO: 87861 - DNA, 38 bp, Artificial Sequence
  Synthetic oligonucleotide
agacaacgtgggggaatactcacgactgataacggtga

SEQ ID NO: 87862 - DNA, 38 bp, Artificial Sequence
  Synthetic oligonucleotide
actgggcagagtacggtgtcacaaggggcgaggggtga

SEQ ID NO: 87863 - DNA, 37 bp, Artificial Sequence
  Synthetic oligonucleotide
gcggagcactcgacgtctccgtcaccctaacctgtga

SEQ ID NO: 87864 - DNA, 38 bp, Artificial Sequence
  Synthetic oligonucleotide
tctacccgtgcctccgtgttcttaggaatacaaattga

SEQ ID NO: 87865 - DNA, 37 bp, Artificial Sequence
  Synthetic oligonucleotide
taacaccccacaatgccagaggcatcgaagacattga

SEQ ID NO: 87866 - DNA, 38 bp, Artificial Sequence
  Synthetic oligonucleotide
gtgggacagcacgtcgaccctgacaaccttttccttga

SEQ ID NO: 87867 - DNA, 38 bp, Artificial Sequence
  Synthetic oligonucleotide
atcgacgccccacaagtaccatcgaaggccttgcttga

SEQ ID NO: 87868 - DNA, 38 bp, Artificial Sequence
  Synthetic oligonucleotide
gaaagtcgtcatcccgttactgctccgtcatctcttga

SEQ ID NO: 87869 - DNA, 38 bp, Artificial Sequence
  Synthetic oligonucleotide
atgcctacgccctccgtatctttttgatgccaagttga

SEQ ID NO: 87870 - DNA, 38 bp, Artificial Sequence
  Synthetic oligonucleotide
gagcatccctatgcgtcgtcacttccactatcagttga

SEQ ID NO: 87871 - DNA, 38 bp, Artificial Sequence
  Synthetic oligonucleotide
acgcacgcgggcaaggttcgcggggaaaagggagttga

SEQ ID NO: 87872 - DNA, 38 bp, Artificial Sequence
  Synthetic oligonucleotide
agtggcacagggttgggcaaatggcaagtgatggttga

SEQ ID NO: 87873 - DNA, 38 bp, Artificial Sequence
  Synthetic oligonucleotide
atagcgagtgctgtgggagcggaggtcgaggtggttga

SEQ ID NO: 87874 - DNA, 38 bp, Artificial Sequence
  Synthetic oligonucleotide
gtgggtggaggcagctgggccacaagggttgattttga

SEQ ID NO: 87875 - DNA, 38 bp, Artificial Sequence
  Synthetic oligonucleotide
taggccagacaccgcagctctgatcatgccacttttga

SEQ ID NO: 87876 - DNA, 35 bp, Artificial Sequence
  Synthetic oligonucleotide
gtggtggtcggagcacattggggggtcaaaggata

SEQ ID NO: 87877 - DNA, 36 bp, Artificial Sequence
  Synthetic oligonucleotide
tgagcgttctgctacactaatcaccaccagcaccta

SEQ ID NO: 87878 - DNA, 36 bp, Artificial Sequence
  Synthetic oligonucleotide
gacaacagcagcaacctacattgacaagccctccta

SEQ ID NO: 87879 - DNA, 35 bp, Artificial Sequence
  Synthetic oligonucleotide
gtttgggtgtagggtgaaacggggaagcggcgcta

SEQ ID NO: 87880 - DNA, 35 bp, Artificial Sequence
  Synthetic oligonucleotide
ttggtagggtgggcgcgggcggctgatcgtatcta

SEQ ID NO: 87881 - DNA, 36 bp, Artificial Sequence
  Synthetic oligonucleotide
attgacacctggtgattagtcgcaagaacccttcta

SEQ ID NO: 87882 - DNA, 36 bp, Artificial Sequence
  Synthetic oligonucleotide
gcacgaagatctgccaccgtgtgtcgtgcttgggta

SEQ ID NO: 87883 - DNA, 36 bp, Artificial Sequence
  Synthetic oligonucleotide
acagcaatcccgcactggcatagacttccaatggta

SEQ ID NO: 87884 - DNA, 36 bp, Artificial Sequence
  Synthetic oligonucleotide
tcgctagtgcccggaagacgctctcttttccatgta

SEQ ID NO: 87885 - DNA, 35 bp, Artificial Sequence
  Synthetic oligonucleotide
tgcgacactcatacgacatcggtcgcctgtactta

SEQ ID NO: 87886 - DNA, 36 bp, Artificial Sequence
  Synthetic oligonucleotide
agacctccactggcctttctggtaatcccacggtta

SEQ ID NO: 87887 - DNA, 35 bp, Artificial Sequence
  Synthetic oligonucleotide
gatgtaggctcgggtagctctctaatgccacttta

SEQ ID NO: 87888 - DNA, 35 bp, Artificial Sequence
  Synthetic oligonucleotide
tcccaccgtattacagcgattatcttccggggcac

SEQ ID NO: 87889 - DNA, 35 bp, Artificial Sequence
  Synthetic oligonucleotide
gcgagttaccgagcaccgaggaccttgcatttcac

SEQ ID NO: 87890 - DNA, 35 bp, Artificial Sequence
  Synthetic oligonucleotide
tgcccatgtatccgcttgcctaaggttggcttgac

SEQ ID NO: 87891 - DNA, 35 bp, Artificial Sequence
  Synthetic oligonucleotide
aaacctacgccacttctgaattagtcattgcatac

SEQ ID NO: 87892 - DNA, 35 bp, Artificial Sequence
  Synthetic oligonucleotide
gatctcgcagagatgttgtcattgctacccgttac

SEQ ID NO: 87893 - DNA, 35 bp, Artificial Sequence
  Synthetic oligonucleotide
tatttctcgcccgtcctctctcacgcggccgttac

SEQ ID NO: 87894 - DNA, 35 bp, Artificial Sequence
  Synthetic oligonucleotide
gccctgactgccgcccttctgggtacatcctcacc

SEQ ID NO: 87895 - DNA, 35 bp, Artificial Sequence
  Synthetic oligonucleotide
gttcgaaccgcttccccaaagagaacatctggacc

SEQ ID NO: 87896 - DNA, 35 bp, Artificial Sequence
  Synthetic oligonucleotide
gccctcccgtccgatagcactgtagccacaatacc

SEQ ID NO: 87897 - DNA, 35 bp, Artificial Sequence
  Synthetic oligonucleotide
atggcactctatcccgtcacatctacgcgttgccc

SEQ ID NO: 87898 - DNA, 35 bp, Artificial Sequence
  Synthetic oligonucleotide
gccgtgaccccggcctgttacgagtttccggtccc

SEQ ID NO: 87899 - DNA, 35 bp, Artificial Sequence
  Synthetic oligonucleotide
tagccgacggcttgctcgatgttgggcccccatcc

SEQ ID NO: 87900 - DNA, 35 bp, Artificial Sequence
  Synthetic oligonucleotide
gattaatacgccgaattgtctaggcgttccattcc

SEQ ID NO: 87901 - DNA, 35 bp, Artificial Sequence
  Synthetic oligonucleotide
tccctgccgcgctttgatccttcgaacgaccgagc

SEQ ID NO: 87902 - DNA, 35 bp, Artificial Sequence
  Synthetic oligonucleotide
tacgccccagcccttccatatcgtcaaccggcggc

SEQ ID NO: 87903 - DNA, 35 bp, Artificial Sequence
  Synthetic oligonucleotide
aactcaaggtccgttcccgtggccattgcctaatc

SEQ ID NO: 87904 - DNA, 35 bp, Artificial Sequence
  Synthetic oligonucleotide
aactgctaccgcaatcgtcgacggccttagccatc

SEQ ID NO: 87905 - DNA, 35 bp, Artificial Sequence
  Synthetic oligonucleotide
gacgcaagggagagaatcatctagcaaaagtcatc

SEQ ID NO: 87906 - DNA, 35 bp, Artificial Sequence
  Synthetic oligonucleotide
gtactaccagccaccgaagtttgacatcaccgctc

SEQ ID NO: 87907 - DNA, 35 bp, Artificial Sequence
  Synthetic oligonucleotide
gccggtggattgaggtgcagggggtctgggtgctc

SEQ ID NO: 87908 - DNA, 35 bp, Artificial Sequence
  Synthetic oligonucleotide
tgtatcggtcctactgctcattgggcgactgtctc

SEQ ID NO: 87909 - DNA, 35 bp, Artificial Sequence
  Synthetic oligonucleotide
gtttctcgcctggccaatctaagcgcacatcgttc

SEQ ID NO: 87910 - DNA, 35 bp, Artificial Sequence
  Synthetic oligonucleotide
aaacgggtgggtcggagctcgtgggggataatttc

SEQ ID NO: 87911 - DNA, 35 bp, Artificial Sequence
  Synthetic oligonucleotide
gaccacaccgatagtgaaggatatcgcgctctttc

SEQ ID NO: 87912 - DNA, 35 bp, Artificial Sequence
  Synthetic oligonucleotide
gatggaggaggaggggtagaggtggacgggtacag

SEQ ID NO: 87913 - DNA, 35 bp, Artificial Sequence
  Synthetic oligonucleotide
gtcccagcctccaatatacccggcccctattcgag

SEQ ID NO: 87914 - DNA, 35 bp, Artificial Sequence
  Synthetic oligonucleotide
gggaaggtgtgagggagagttatgggagtcgaacg

SEQ ID NO: 87915 - DNA, 35 bp, Artificial Sequence
  Synthetic oligonucleotide
actccatgtcacccggcttgccctatggcgctacg

SEQ ID NO: 87916 - DNA, 35 bp, Artificial Sequence
  Synthetic oligonucleotide
ttcgctggcctgaatctctggggtaacattctacg

SEQ ID NO: 87917 - DNA, 35 bp, Artificial Sequence
  Synthetic oligonucleotide
tttgggcaagcaattacagggcgggatggcggagg

SEQ ID NO: 87918 - DNA, 35 bp, Artificial Sequence
  Synthetic oligonucleotide
tccatgaggggaggttggacggttgaaggcttggg

SEQ ID NO: 87919 - DNA, 35 bp, Artificial Sequence
  Synthetic oligonucleotide
tgggctagaccggccaatacgtcgtaccacccctg

SEQ ID NO: 87920 - DNA, 35 bp, Artificial Sequence
  Synthetic oligonucleotide
gacaccggcaccgcaaccctttgttctcgccgttg

SEQ ID NO: 87921 - DNA, 35 bp, Artificial Sequence
  Synthetic oligonucleotide
gcaacccctgggctactccgagacccgacattaat

SEQ ID NO: 87922 - DNA, 35 bp, Artificial Sequence
  Synthetic oligonucleotide
atcaactacgagtgccttatcagtatcttccgcat

SEQ ID NO: 87923 - DNA, 35 bp, Artificial Sequence
  Synthetic oligonucleotide
ggaggaggggaagggtgaggagggaggatgtggat

SEQ ID NO: 87924 - DNA, 35 bp, Artificial Sequence
  Synthetic oligonucleotide
tccacacaaagatttagcggttaggaccgatatat

SEQ ID NO: 87925 - DNA, 35 bp, Artificial Sequence
  Synthetic oligonucleotide
taccatgccgaacgtaaccccttgcaccctaggct

SEQ ID NO: 87926 - DNA, 35 bp, Artificial Sequence
  Synthetic oligonucleotide
tcaacacgctgtatggttcgtttttttcgtcctct

SEQ ID NO: 87927 - DNA, 35 bp, Artificial Sequence
  Synthetic oligonucleotide
agggaccggagtacgggggggcttctatggaaagt

SEQ ID NO: 87928 - DNA, 35 bp, Artificial Sequence
  Synthetic oligonucleotide
gtcacacaacgactctgtatactctgccccacagt

SEQ ID NO: 87929 - DNA, 35 bp, Artificial Sequence
  Synthetic oligonucleotide
tgacacccgcgactgttacgtttccggattgcatt

SEQ ID NO: 87930 - DNA, 35 bp, Artificial Sequence
  Synthetic oligonucleotide
gtacacattcacgatgtctctgcgatccccatatt

SEQ ID NO: 87931 - DNA, 35 bp, Artificial Sequence
  Synthetic oligonucleotide
tggggcattcccggtacacttcgctttccttcgtt

SEQ ID NO: 87932 - DNA, 36 bp, Artificial Sequence
  Synthetic oligonucleotide
accccccgtgagtaaatcgtgttctacacgcccaaa

SEQ ID NO: 87933 - DNA, 36 bp, Artificial Sequence
  Synthetic oligonucleotide
atcacgcatccctgcctgccacagtggaacgcccaa

SEQ ID NO: 87934 - DNA, 35 bp, Artificial Sequence
  Synthetic oligonucleotide
ttcaccactggtctgtaacagttcgagtgttgcaa

SEQ ID NO: 87935 - DNA, 36 bp, Artificial Sequence
  Synthetic oligonucleotide
tccgatacgcctttcatgcacgacccagttgaagaa

SEQ ID NO: 87936 - DNA, 36 bp, Artificial Sequence
  Synthetic oligonucleotide
tgtgggtgtgggttggagaggggtataagattagaa

SEQ ID NO: 87937 - DNA, 36 bp, Artificial Sequence
  Synthetic oligonucleotide
acgtggcaccatccgtccaactccaacaccgtgtaa

SEQ ID NO: 87938 - DNA, 35 bp, Artificial Sequence
  Synthetic oligonucleotide
gccgacccgcttgatgtctcacttggctggtcaca

SEQ ID NO: 87939 - DNA, 36 bp, Artificial Sequence
  Synthetic oligonucleotide
gtcaccaacaactggaacggggcttaatttcttaca

SEQ ID NO: 87940 - DNA, 36 bp, Artificial Sequence
  Synthetic oligonucleotide
agaggccgtaccgtaatcgatcatgcctgacaacca

SEQ ID NO: 87941 - DNA, 36 bp, Artificial Sequence
  Synthetic oligonucleotide
tcatcatgtgcctttgagttggttccagggctgcca

SEQ ID NO: 87942 - DNA, 36 bp, Artificial Sequence
  Synthetic oligonucleotide
tgtccaacctgcgaatccttatatgacgagtatgca

SEQ ID NO: 87943 - DNA, 36 bp, Artificial Sequence
  Synthetic oligonucleotide
gacgccacactccacatcctgattatgccatgtgca

SEQ ID NO: 87944 - DNA, 36 bp, Artificial Sequence
  Synthetic oligonucleotide
tgtgtcgcacccggggcctttattttcagtattgca

SEQ ID NO: 87945 - DNA, 36 bp, Artificial Sequence
  Synthetic oligonucleotide
gacaccgttagtctacagctacaacaggactgatca

SEQ ID NO: 87946 - DNA, 36 bp, Artificial Sequence
  Synthetic oligonucleotide
tacagcaaatctcgatcgtgccaaccgcttacctca

SEQ ID NO: 87947 - DNA, 36 bp, Artificial Sequence
  Synthetic oligonucleotide
tccagccactaggggattttggtccttacgttctca

SEQ ID NO: 87948 - DNA, 36 bp, Artificial Sequence
  Synthetic oligonucleotide
acacgactaacagtcgcttcaggatcccctccttca

SEQ ID NO: 87949 - DNA, 37 bp, Artificial Sequence
  Synthetic oligonucleotide
tacgttccatagtttggctcaccacagtctcaaaaga

SEQ ID NO: 87950 - DNA, 36 bp, Artificial Sequence
  Synthetic oligonucleotide
gacacgggactgggtcatgtgcagtattaggaaaga

SEQ ID NO: 87951 - DNA, 37 bp, Artificial Sequence
  Synthetic oligonucleotide
atgcaccctgaggggaagaattaaatagttggaaaga

SEQ ID NO: 87952 - DNA, 37 bp, Artificial Sequence
  Synthetic oligonucleotide
ttgttcagtgaagggtgtccgtggaggggggagaaga

SEQ ID NO: 87953 - DNA, 37 bp, Artificial Sequence
  Synthetic oligonucleotide
attcacgcagtggttctttttcctgtcattgtccaga

SEQ ID NO: 87954 - DNA, 36 bp, Artificial Sequence
  Synthetic oligonucleotide
tcacggggatcggaccagaaggggagggagaggaga

SEQ ID NO: 87955 - DNA, 37 bp, Artificial Sequence
  Synthetic oligonucleotide
actccgagggtgaaaggggaagcgtgtaaggaggaga

SEQ ID NO: 87956 - DNA, 37 bp, Artificial Sequence
  Synthetic oligonucleotide
aaaacagggcgggagcgaatccggaggaaatcggaga

SEQ ID NO: 87957 - DNA, 36 bp, Artificial Sequence
  Synthetic oligonucleotide
gacatgactgttcggagttagggaaaggtgatgaga

SEQ ID NO: 87958 - DNA, 37 bp, Artificial Sequence
  Synthetic oligonucleotide
gcttgaaccgcatcactgtcctgcgagcctgttgaga

SEQ ID NO: 87959 - DNA, 35 bp, Artificial Sequence
  Synthetic oligonucleotide
tggacctccaaacctgcacttatgactcgattaga

SEQ ID NO: 87960 - DNA, 37 bp, Artificial Sequence
  Synthetic oligonucleotide
tgactcccccaggaatggagtataccgtgctgtacga

SEQ ID NO: 87961 - DNA, 37 bp, Artificial Sequence
  Synthetic oligonucleotide
gaaggtacggggtgaggaagggttccgtcgataccga

SEQ ID NO: 87962 - DNA, 37 bp, Artificial Sequence
  Synthetic oligonucleotide
tcacactaaaacgggagccagccgtccgcgatcccga

SEQ ID NO: 87963 - DNA, 37 bp, Artificial Sequence
  Synthetic oligonucleotide
tgagtcgctcatgaatcaccccctgttgtccggccga

SEQ ID NO: 87964 - DNA, 37 bp, Artificial Sequence
  Synthetic oligonucleotide
gtagggaggtgggtaacattacgtgagggaaaggcga

SEQ ID NO: 87965 - DNA, 35 bp, Artificial Sequence
  Synthetic oligonucleotide
atcccgccgccaggccaccataccctatgtatcga

SEQ ID NO: 87966 - DNA, 37 bp, Artificial Sequence
  Synthetic oligonucleotide
gcctgccggacgcccgtatatctttctatgctgtcga

SEQ ID NO: 87967 - DNA, 35 bp, Artificial Sequence
  Synthetic oligonucleotide
tgtagggaagggagggagcctcggaacaggtagga

SEQ ID NO: 87968 - DNA, 37 bp, Artificial Sequence
  Synthetic oligonucleotide
ttgctactacccctcggtgtctaccctgtccaccgga

SEQ ID NO: 87969 - DNA, 37 bp, Artificial Sequence
  Synthetic oligonucleotide
tctagcaggggggggcaagggtcgaaaccagaccgga

SEQ ID NO: 87970 - DNA, 37 bp, Artificial Sequence
  Synthetic oligonucleotide
ttgtccctcactggcatcctatcttgtccttagcgga

SEQ ID NO: 87971 - DNA, 37 bp, Artificial Sequence
  Synthetic oligonucleotide
gagacccaccacaagacggcaaagtaggcgacaggga

SEQ ID NO: 87972 - DNA, 37 bp, Artificial Sequence
  Synthetic oligonucleotide
tccgatgaacaagcaggagcgagagtctgaggaggga

SEQ ID NO: 87973 - DNA, 36 bp, Artificial Sequence
  Synthetic oligonucleotide
aacatcatcacagccattgtctcgccaattggggga

SEQ ID NO: 87974 - DNA, 36 bp, Artificial Sequence
  Synthetic oligonucleotide
gatgtacgccgcctatcgagagataaggatagtgga

SEQ ID NO: 87975 - DNA, 37 bp, Artificial Sequence
  Synthetic oligonucleotide
gactatcagcacgatcactgccatttattccattgga

SEQ ID NO: 87976 - DNA, 37 bp, Artificial Sequence
  Synthetic oligonucleotide
atggacggtcatggagcgaggtatggggtgggttgga

SEQ ID NO: 87977 - DNA, 38 bp, Artificial Sequence
  Synthetic oligonucleotide
gcccaccgatctgtttccacctggaggtactctcatga

SEQ ID NO: 87978 - DNA, 38 bp, Artificial Sequence
  Synthetic oligonucleotide
gcagagaaggtagaaggtaggaattggagcgtggatga

SEQ ID NO: 87979 - DNA, 38 bp, Artificial Sequence
  Synthetic oligonucleotide
tcaaacgcggtggaggttcgttaattagtatggtatga

SEQ ID NO: 87980 - DNA, 37 bp, Artificial Sequence
  Synthetic oligonucleotide
tgagggacgaattaggtgagggtggcgggataactga

SEQ ID NO: 87981 - DNA, 36 bp, Artificial Sequence
  Synthetic oligonucleotide
ttgttacgttactgccactacgtccccgtggactga

SEQ ID NO: 87982 - DNA, 37 bp, Artificial Sequence
  Synthetic oligonucleotide
tactaccccgcgcggagcatatgattgccgttactga

SEQ ID NO: 87983 - DNA, 38 bp, Artificial Sequence
  Synthetic oligonucleotide
ttgccccccaggaattcctgatataaaccgtgccctga

SEQ ID NO: 87984 - DNA, 38 bp, Artificial Sequence
  Synthetic oligonucleotide
tacgactgttccgcccttacaatgtctttactgcctga

SEQ ID NO: 87985 - DNA, 37 bp, Artificial Sequence
  Synthetic oligonucleotide
gagacacgactgactagcctgcactccgctcaagtga

SEQ ID NO: 87986 - DNA, 37 bp, Artificial Sequence
  Synthetic oligonucleotide
gaatgcgaggggaaaatgaaaccgtcacgatcagtga

SEQ ID NO: 87987 - DNA, 37 bp, Artificial Sequence
  Synthetic oligonucleotide
acttgtgggcggggagttgaaggggctgggcccgtga

SEQ ID NO: 87988 - DNA, 38 bp, Artificial Sequence
  Synthetic oligonucleotide
gacgatgtgagggatgaggtgagaatgacaccgcgtga

SEQ ID NO: 87989 - DNA, 38 bp, Artificial Sequence
  Synthetic oligonucleotide
ggagtggtgaacgttagtggaagggggagcgcgggtga

SEQ ID NO: 87990 - DNA, 38 bp, Artificial Sequence
  Synthetic oligonucleotide
gtggggtgcgtgtaaggagattgtggggggcggggtga

SEQ ID NO: 87991 - DNA, 35 bp, Artificial Sequence
  Synthetic oligonucleotide
gaaatacgggtgtggtgccgaagcgggaatggtga

SEQ ID NO: 87992 - DNA, 38 bp, Artificial Sequence
  Synthetic oligonucleotide
tcaccccgcggtcctgcctctctttactctcatggtga

SEQ ID NO: 87993 - DNA, 36 bp, Artificial Sequence
  Synthetic oligonucleotide
acacccaggagcgttctcaccctgcctgcaaattga

SEQ ID NO: 87994 - DNA, 38 bp, Artificial Sequence
  Synthetic oligonucleotide
gcagaggagcatagttgggctggggctggggaaattga

SEQ ID NO: 87995 - DNA, 38 bp, Artificial Sequence
  Synthetic oligonucleotide
ttcgcccgccggtttcttctgggaattcattgcattga

SEQ ID NO: 87996 - DNA, 38 bp, Artificial Sequence
  Synthetic oligonucleotide
acagatcctgccccaatgcctccacacgagacccttga

SEQ ID NO: 87997 - DNA, 38 bp, Artificial Sequence
  Synthetic oligonucleotide
gcacaagtccaggttaacacacgtcactaagacgttga

SEQ ID NO: 87998 - DNA, 38 bp, Artificial Sequence
  Synthetic oligonucleotide
aatgccacagtgctagtatacatgggaccggttgttga

SEQ ID NO: 87999 - DNA, 38 bp, Artificial Sequence
  Synthetic oligonucleotide
gtcgcacgttatgcgcccacgaaactccatgattttga

SEQ ID NO: 88000 - DNA, 35 bp, Artificial Sequence
  Synthetic oligonucleotide
tatcacaggggggaaggtagatatagcggttttga

SEQ ID NO: 88001 - DNA, 36 bp, Artificial Sequence
  Synthetic oligonucleotide
accaccggttgccgactccattacattttgatccta

SEQ ID NO: 88002 - DNA, 36 bp, Artificial Sequence
  Synthetic oligonucleotide
aaagcatgccacgaacgggagagcgcgtgcatgcta

SEQ ID NO: 88003 - DNA, 35 bp, Artificial Sequence
  Synthetic oligonucleotide
gcgagagctgaccctgccaactgcaattcaactta

SEQ ID NO: 88004 - DNA, 36 bp, Artificial Sequence
  Synthetic oligonucleotide
gacgacactcattgtagcgcttaagggggggagtta

SEQ ID NO: 88005 - DNA, 35 bp, Artificial Sequence
  Synthetic oligonucleotide
tagatgcccactggaaaggggggagtaaccggtta

SEQ ID NO: 88006 - DNA, 35 bp, Artificial Sequence
  Synthetic oligonucleotide
atacgacacctgactctacccgtcgacagttgtta

SEQ ID NO: 88007 - DNA, 36 bp, Artificial Sequence
  Synthetic oligonucleotide
tcatagagctcaatctgccctccgtgtctccgttta

SEQ ID NO: 88008 - DNA, 35 bp, Artificial Sequence
  Synthetic oligonucleotide
tgcatccgttcacgctcaactagtgccttcctcac

SEQ ID NO: 88009 - DNA, 35 bp, Artificial Sequence
  Synthetic oligonucleotide
acatgtcgcaggttttccattatcacaagattcac

SEQ ID NO: 88010 - DNA, 35 bp, Artificial Sequence
  Synthetic oligonucleotide
gctgatcctcaagctacctactccactatgcggac

SEQ ID NO: 88011 - DNA, 35 bp, Artificial Sequence
  Synthetic oligonucleotide
atgagggtacagccatcatagcctccgtatccacc

SEQ ID NO: 88012 - DNA, 35 bp, Artificial Sequence
  Synthetic oligonucleotide
actcagtgctgggactttatctcgaccatatcacc

SEQ ID NO: 88013 - DNA, 35 bp, Artificial Sequence
  Synthetic oligonucleotide
ttgaatcaacagaccgtctagcgctctcggtcacc

SEQ ID NO: 88014 - DNA, 35 bp, Artificial Sequence
  Synthetic oligonucleotide
agtacgcgccgcccgctgccgtgacgcgaataccc

SEQ ID NO: 88015 - DNA, 32 bp, Artificial Sequence
  Synthetic oligonucleotide
ggtcgaggtccctttccacctcatgaggcccc

SEQ ID NO: 88016 - DNA, 35 bp, Artificial Sequence
  Synthetic oligonucleotide
gtgactggtatcctgtatcctccatgaatgggccc

SEQ ID NO: 88017 - DNA, 35 bp, Artificial Sequence
  Synthetic oligonucleotide
tgcccgcgctcctccccctcgtcgtgcgtagtccc

SEQ ID NO: 88018 - DNA, 35 bp, Artificial Sequence
  Synthetic oligonucleotide
tcagccttacttgtgcccgttccacctcctgcgcc

SEQ ID NO: 88019 - DNA, 35 bp, Artificial Sequence
  Synthetic oligonucleotide
tgtgacaaacgctgtcgagttcctttagtttggcc

SEQ ID NO: 88020 - DNA, 35 bp, Artificial Sequence
  Synthetic oligonucleotide
tctgtcccgcattacctctgccacgaacctcgtcc

SEQ ID NO: 88021 - DNA, 35 bp, Artificial Sequence
  Synthetic oligonucleotide
tccaacaatcaggaagttaatcaacccgtgcccgc

SEQ ID NO: 88022 - DNA, 35 bp, Artificial Sequence
  Synthetic oligonucleotide
gtacggccacgccttctctttgcatgacttcgggc

SEQ ID NO: 88023 - DNA, 35 bp, Artificial Sequence
  Synthetic oligonucleotide
agatgcacagctttcagtaaacacgtaccatctgc

SEQ ID NO: 88024 - DNA, 35 bp, Artificial Sequence
  Synthetic oligonucleotide
gtacgtcaacaccgtgatggtttttaatttattgc

SEQ ID NO: 88025 - DNA, 35 bp, Artificial Sequence
  Synthetic oligonucleotide
atgcccggagccatgtccagcaactctcccgaatc

SEQ ID NO: 88026 - DNA, 35 bp, Artificial Sequence
  Synthetic oligonucleotide
ttctgacaccgctactgaagatccgaccttccatc

SEQ ID NO: 88027 - DNA, 35 bp, Artificial Sequence
  Synthetic oligonucleotide
gtcaagggggggcgccgattaagttaggcaaagtc

SEQ ID NO: 88028 - DNA, 35 bp, Artificial Sequence
  Synthetic oligonucleotide
tactaccgtgcagactgcaatgcccaactgccgtc

SEQ ID NO: 88029 - DNA, 35 bp, Artificial Sequence
  Synthetic oligonucleotide
tctccgcgggggacaggggatgtggtgcctgggtc

SEQ ID NO: 88030 - DNA, 35 bp, Artificial Sequence
  Synthetic oligonucleotide
acgtggggggacgcgttcttgaccaacatggattc

SEQ ID NO: 88031 - DNA, 35 bp, Artificial Sequence
  Synthetic oligonucleotide
tcccccacctgaagatgcgcacgttccgcgtattc

SEQ ID NO: 88032 - DNA, 35 bp, Artificial Sequence
  Synthetic oligonucleotide
gcgagccgctctgggcactttactgctgctagttc

SEQ ID NO: 88033 - DNA, 35 bp, Artificial Sequence
  Synthetic oligonucleotide
gcgaccgaggccgtttgacccccgtaattacgttc

SEQ ID NO: 88034 - DNA, 35 bp, Artificial Sequence
  Synthetic oligonucleotide
actcaccagagcagttttattggtcttcccatttc

SEQ ID NO: 88035 - DNA, 35 bp, Artificial Sequence
  Synthetic oligonucleotide
gagcccctgatgcccattgcatccgatttgctttc

SEQ ID NO: 88036 - DNA, 34 bp, Artificial Sequence
  Synthetic oligonucleotide
actctgaccaccctcctaacgtcagtaccctgag

SEQ ID NO: 88037 - DNA, 35 bp, Artificial Sequence
  Synthetic oligonucleotide
gacgctccatcttcatacctgcacgggaactctag

SEQ ID NO: 88038 - DNA, 35 bp, Artificial Sequence
  Synthetic oligonucleotide
gcgaacctccttcgccggcaaaaaaatccctgtag

SEQ ID NO: 88039 - DNA, 35 bp, Artificial Sequence
  Synthetic oligonucleotide
aaacgcaggaatatggaggaaaaatgtcggggccg

SEQ ID NO: 88040 - DNA, 35 bp, Artificial Sequence
  Synthetic oligonucleotide
tatcccctccattcgcgttatgtaaactggattcg

SEQ ID NO: 88041 - DNA, 35 bp, Artificial Sequence
  Synthetic oligonucleotide
acatccagcatggagctcgttaaccctgcaaaagg

SEQ ID NO: 88042 - DNA, 35 bp, Artificial Sequence
  Synthetic oligonucleotide
aagtcgagggtgggtaagaataaccacatgggggg

SEQ ID NO: 88043 - DNA, 35 bp, Artificial Sequence
  Synthetic oligonucleotide
ttgataagggtgtgagctgtgcggttaggatgggg

SEQ ID NO: 88044 - DNA, 35 bp, Artificial Sequence
  Synthetic oligonucleotide
acgatgggtagtattgctggtgcggaggagcatgg

SEQ ID NO: 88045 - DNA, 34 bp, Artificial Sequence
  Synthetic oligonucleotide
gacaaaaagacgacagtgggtgtaaactaagtgg

SEQ ID NO: 88046 - DNA, 35 bp, Artificial Sequence
  Synthetic oligonucleotide
aatgcacagggaattgaatggtgcaaaataggatg

SEQ ID NO: 88047 - DNA, 35 bp, Artificial Sequence
  Synthetic oligonucleotide
acagtgctaaacgcttgtacgtaactgcaaacctg

SEQ ID NO: 88048 - DNA, 35 bp, Artificial Sequence
  Synthetic oligonucleotide
gaagtacagagagcgtatggaggtcgagggtgctg

SEQ ID NO: 88049 - DNA, 35 bp, Artificial Sequence
  Synthetic oligonucleotide
gagtgcctggtgggtgctatcgttgagggctagtg

SEQ ID NO: 88050 - DNA, 35 bp, Artificial Sequence
  Synthetic oligonucleotide
taccatgctggggacaggaggaagtacttgcattg

SEQ ID NO: 88051 - DNA, 35 bp, Artificial Sequence
  Synthetic oligonucleotide
gtcaccgcaggactcgttgtccgcattactcattg

SEQ ID NO: 88052 - DNA, 35 bp, Artificial Sequence
  Synthetic oligonucleotide
tacgtttagctcccattcgttttgtttcactattg

SEQ ID NO: 88053 - DNA, 35 bp, Artificial Sequence
  Synthetic oligonucleotide
aggtgtggagcatggtagtggggtcggaattgttg

SEQ ID NO: 88054 - DNA, 35 bp, Artificial Sequence
  Synthetic oligonucleotide
gaagcaagtacaattcgaacataggggcctttttg

SEQ ID NO: 88055 - DNA, 35 bp, Artificial Sequence
  Synthetic oligonucleotide
gacgagggtaggtcggtagaacttgtggaatcaat

SEQ ID NO: 88056 - DNA, 35 bp, Artificial Sequence
  Synthetic oligonucleotide
gccttcccaggcccttcctgaataccactttcaat

SEQ ID NO: 88057 - DNA, 35 bp, Artificial Sequence
  Synthetic oligonucleotide
actcaatggcggtgtcctcaaatagactctaccat

SEQ ID NO: 88058 - DNA, 35 bp, Artificial Sequence
  Synthetic oligonucleotide
tagcctcccccatgggtacgatcagatacctccat

SEQ ID NO: 88059 - DNA, 35 bp, Artificial Sequence
  Synthetic oligonucleotide
gcctccgcgaacgcgttgtcacctgatattgtcat

SEQ ID NO: 88060 - DNA, 35 bp, Artificial Sequence
  Synthetic oligonucleotide
gactgccctcagctatggcctgattatacttcgat

SEQ ID NO: 88061 - DNA, 35 bp, Artificial Sequence
  Synthetic oligonucleotide
actcacaccctggcttgtggttgttctttaatgat

SEQ ID NO: 88062 - DNA, 35 bp, Artificial Sequence
  Synthetic oligonucleotide
gcggtcgtacgcacattcctcgcgagactcgtgat

SEQ ID NO: 88063 - DNA, 35 bp, Artificial Sequence
  Synthetic oligonucleotide
gtgacattcccctgtgcgttccgacatccgtttat

SEQ ID NO: 88064 - DNA, 35 bp, Artificial Sequence
  Synthetic oligonucleotide
gcataacaccatggcgcgtccctccaccacaccct

SEQ ID NO: 88065 - DNA, 35 bp, Artificial Sequence
  Synthetic oligonucleotide
gatgtcaggggctcatttgggtggcacgctcccct

SEQ ID NO: 88066 - DNA, 35 bp, Artificial Sequence
  Synthetic oligonucleotide
acgcagacctcgacacatctccactccttgatgct

SEQ ID NO: 88067 - DNA, 35 bp, Artificial Sequence
  Synthetic oligonucleotide
ttggagtgctgcagggagtggattaacatggaagt

SEQ ID NO: 88068 - DNA, 31 bp, Artificial Sequence
  Synthetic oligonucleotide
gatttaggggttggggggaggtggtatgagt

SEQ ID NO: 88069 - DNA, 35 bp, Artificial Sequence
  Synthetic oligonucleotide
tgtccgtcccgactccctcgccttctatcaaaggt

SEQ ID NO: 88070 - DNA, 35 bp, Artificial Sequence
  Synthetic oligonucleotide
agtctacgcaccgtatgccacctatgttaaccggt

SEQ ID NO: 88071 - DNA, 35 bp, Artificial Sequence
  Synthetic oligonucleotide
ttgcgacggagcaaatgggtggctctttctttggt

SEQ ID NO: 88072 - DNA, 35 bp, Artificial Sequence
  Synthetic oligonucleotide
gccccgagacgcggacaatttagctgaccaccatt

SEQ ID NO: 88073 - DNA, 35 bp, Artificial Sequence
  Synthetic oligonucleotide
ttggaaagagacagctgagggtagggcataggatt

SEQ ID NO: 88074 - DNA, 35 bp, Artificial Sequence
  Synthetic oligonucleotide
tcccgtcgcatcttggatgacttctgcacatggtt

SEQ ID NO: 88075 - DNA, 35 bp, Artificial Sequence
  Synthetic oligonucleotide
tcgccccactagagcgtcctgcctttaaatcgttt

SEQ ID NO: 88076 - DNA, 35 bp, Artificial Sequence
  Synthetic oligonucleotide
gctgtgtctctcagctcttcattttagcctcgttt

SEQ ID NO: 88077 - DNA, 35 bp, Artificial Sequence
  Synthetic oligonucleotide
tagtaaacgtagcgtgcaccgtccccgtatctttt

SEQ ID NO: 88078 - DNA, 35 bp, Artificial Sequence
  Synthetic oligonucleotide
tcacgtgctgaggtaggcaggaaaagggcgcgaaa

SEQ ID NO: 88079 - DNA, 35 bp, Artificial Sequence
  Synthetic oligonucleotide
tgtgacggtccgtgtcagtaggtctgcgggtacaa

SEQ ID NO: 88080 - DNA, 35 bp, Artificial Sequence
  Synthetic oligonucleotide
gacgcagtctacattcgacccacgacacggaccaa

SEQ ID NO: 88081 - DNA, 35 bp, Artificial Sequence
  Synthetic oligonucleotide
acacagtgctaacggaaacggggcatactatcgaa

SEQ ID NO: 88082 - DNA, 35 bp, Artificial Sequence
  Synthetic oligonucleotide
ggaggggaagtcaagggagggggggcgtagcggaa

SEQ ID NO: 88083 - DNA, 35 bp, Artificial Sequence
  Synthetic oligonucleotide
gcctcctccccgacttgctggttagccgtacgtaa

SEQ ID NO: 88084 - DNA, 36 bp, Artificial Sequence
  Synthetic oligonucleotide
gtccggaacactggcctgtgatcggaattcccttaa

SEQ ID NO: 88085 - DNA, 36 bp, Artificial Sequence
  Synthetic oligonucleotide
tcccacgtgagcatagtcttttccggccgacgaaca

SEQ ID NO: 88086 - DNA, 36 bp, Artificial Sequence
  Synthetic oligonucleotide
tcgtgggcgcagttccgtctccggctacaacacaca

SEQ ID NO: 88087 - DNA, 36 bp, Artificial Sequence
  Synthetic oligonucleotide
gacatacccgccttctatggccagccttctaggaca

SEQ ID NO: 88088 - DNA, 35 bp, Artificial Sequence
  Synthetic oligonucleotide
taaacggccctccgtggttcgcatatccttttaca

SEQ ID NO: 88089 - DNA, 35 bp, Artificial Sequence
  Synthetic oligonucleotide
gcacagtcccgccgagtcacagcagcaattgacca

SEQ ID NO: 88090 - DNA, 36 bp, Artificial Sequence
  Synthetic oligonucleotide
attggctcggccattgtcaccccctgcacatgagca

SEQ ID NO: 88091 - DNA, 36 bp, Artificial Sequence
  Synthetic oligonucleotide
atccacacacctgctgaacgtttgtgagaactatca

SEQ ID NO: 88092 - DNA, 36 bp, Artificial Sequence
  Synthetic oligonucleotide
gccacgcagtgggacgtgccatctttagtactatca

SEQ ID NO: 88093 - DNA, 36 bp, Artificial Sequence
  Synthetic oligonucleotide
agtgcccctgatcttgtcccccgacggcgaccctca

SEQ ID NO: 88094 - DNA, 36 bp, Artificial Sequence
  Synthetic oligonucleotide
gaggaggggggtgatcggtggatcggaggccaaaga

SEQ ID NO: 88095 - DNA, 37 bp, Artificial Sequence
  Synthetic oligonucleotide
gtcacgggggagtaaggggtctctgaggcaggaaaga

SEQ ID NO: 88096 - DNA, 37 bp, Artificial Sequence
  Synthetic oligonucleotide
tcgagagattgggggttgaggagtgagaacaacgaga

SEQ ID NO: 88097 - DNA, 35 bp, Artificial Sequence
  Synthetic oligonucleotide
agcggaaagaaggggtggtgcagatagggggtaga

SEQ ID NO: 88098 - DNA, 37 bp, Artificial Sequence
  Synthetic oligonucleotide
tgatcgaacagggacctaggacgcaggagcacaacga

SEQ ID NO: 88099 - DNA, 36 bp, Artificial Sequence
  Synthetic oligonucleotide
ttgtgcgcgcatccacctaatcctctggcgtgacga

SEQ ID NO: 88100 - DNA, 37 bp, Artificial Sequence
  Synthetic oligonucleotide
tccacgtacagcatggattcttctcaacaccgtacga

SEQ ID NO: 88101 - DNA, 37 bp, Artificial Sequence
  Synthetic oligonucleotide
tgttgtgccacgccattcctattatagctctgtacga

SEQ ID NO: 88102 - DNA, 37 bp, Artificial Sequence
  Synthetic oligonucleotide
accacgcacactctctgttggaatttcatgtccccga

SEQ ID NO: 88103 - DNA, 37 bp, Artificial Sequence
  Synthetic oligonucleotide
agtgccagcacacctagatctaatccaccctgcccga

SEQ ID NO: 88104 - DNA, 35 bp, Artificial Sequence
  Synthetic oligonucleotide
tcatgcccagaactgcacgtgtgtgcctttcccga

SEQ ID NO: 88105 - DNA, 37 bp, Artificial Sequence
  Synthetic oligonucleotide
aacggttgcaggacgggggaagtaacggttggatcga

SEQ ID NO: 88106 - DNA, 37 bp, Artificial Sequence
  Synthetic oligonucleotide
gcatgccccggtctaacacacgcacactattcttcga

SEQ ID NO: 88107 - DNA, 37 bp, Artificial Sequence
  Synthetic oligonucleotide
acacgcaaagcgcgttcctgttggggggtggtaagga

SEQ ID NO: 88108 - DNA, 37 bp, Artificial Sequence
  Synthetic oligonucleotide
gcccaacccgaatcatttggtcaagtgaccataggga

SEQ ID NO: 88109 - DNA, 36 bp, Artificial Sequence
  Synthetic oligonucleotide
tgatctcaccgaatgcaattacaactctcgacggga

SEQ ID NO: 88110 - DNA, 37 bp, Artificial Sequence
  Synthetic oligonucleotide
gacaaggggggggtgaaccaatgttcaattctgggga

SEQ ID NO: 88111 - DNA, 37 bp, Artificial Sequence
  Synthetic oligonucleotide
gccacgcaggtgaatttcccacgaccttgcacttgga

SEQ ID NO: 88112 - DNA, 37 bp, Artificial Sequence
  Synthetic oligonucleotide
tacgcggtccaaagcactgccgataaaacagtcatga

SEQ ID NO: 88113 - DNA, 37 bp, Artificial Sequence
  Synthetic oligonucleotide
gacaatgggagcctaggcttagggaacagggggatga

SEQ ID NO: 88114 - DNA, 38 bp, Artificial Sequence
  Synthetic oligonucleotide
acacctcatgcggcctagcagcccatcacatactatga

SEQ ID NO: 88115 - DNA, 38 bp, Artificial Sequence
  Synthetic oligonucleotide
gacagggaagtggaaaagcgggagggatgatggtatga

SEQ ID NO: 88116 - DNA, 37 bp, Artificial Sequence
  Synthetic oligonucleotide
tgtcacgtcccgaccgcttccgtacatctacttatga

SEQ ID NO: 88117 - DNA, 38 bp, Artificial Sequence
  Synthetic oligonucleotide
atcgacgcacagtagggatccaacttacactcttatga

SEQ ID NO: 88118 - DNA, 38 bp, Artificial Sequence
  Synthetic oligonucleotide
ttcgccgtccagggcgaaagtcacggggggagttatga

SEQ ID NO: 88119 - DNA, 36 bp, Artificial Sequence
  Synthetic oligonucleotide
agatcctacccgctgttcgttttccagcaccactga

SEQ ID NO: 88120 - DNA, 38 bp, Artificial Sequence
  Synthetic oligonucleotide
tacacgcctccccgttattaaggcattttgtctactga

SEQ ID NO: 88121 - DNA, 37 bp, Artificial Sequence
  Synthetic oligonucleotide
acgcaacctcaggcctaccccaccgaatactgcctga

SEQ ID NO: 88122 - DNA, 38 bp, Artificial Sequence
  Synthetic oligonucleotide
gtgaaacgaaggtggttgtagcaggggaatcactctga

SEQ ID NO: 88123 - DNA, 38 bp, Artificial Sequence
  Synthetic oligonucleotide
aaaatggcggtggttggggcaggaacaaacgagagtga

SEQ ID NO: 88124 - DNA, 37 bp, Artificial Sequence
  Synthetic oligonucleotide
gagagcatcagacgtgtgtggaataaaaattgcgtga

SEQ ID NO: 88125 - DNA, 38 bp, Artificial Sequence
  Synthetic oligonucleotide
atcacacgcccctcattcgaagccgggcatcacggtga

SEQ ID NO: 88126 - DNA, 38 bp, Artificial Sequence
  Synthetic oligonucleotide
gatgcagtgcattccccgtatcaacccccagccggtga

SEQ ID NO: 88127 - DNA, 38 bp, Artificial Sequence
  Synthetic oligonucleotide
aatgaaatgacaatggggaatggagttggctagggtga

SEQ ID NO: 88128 - DNA, 37 bp, Artificial Sequence
  Synthetic oligonucleotide
agtgagcgcgggctgggaagtggtggtacgatggtga

SEQ ID NO: 88129 - DNA, 37 bp, Artificial Sequence
  Synthetic oligonucleotide
tgatagggacggggatgaacgaatggacagaatgtga

SEQ ID NO: 88130 - DNA, 38 bp, Artificial Sequence
  Synthetic oligonucleotide
aggacaggtgggaggaggcacgagggaaaaggatgtga

SEQ ID NO: 88131 - DNA, 38 bp, Artificial Sequence
  Synthetic oligonucleotide
acactcgaagcgatggcctctcacatacagtactgtga

SEQ ID NO: 88132 - DNA, 38 bp, Artificial Sequence
  Synthetic oligonucleotide
gacatcatatcggagcgaggccatcccatctagtgtga

SEQ ID NO: 88133 - DNA, 38 bp, Artificial Sequence
  Synthetic oligonucleotide
ggaactgaggaggagaatcttaggcctgtgacttgtga

SEQ ID NO: 88134 - DNA, 37 bp, Artificial Sequence
  Synthetic oligonucleotide
aatgcaccttgtttgtctttatgtcttccgcttgtga

SEQ ID NO: 88135 - DNA, 37 bp, Artificial Sequence
  Synthetic oligonucleotide
acacacgattcgggcctgtttgtgccatcacggttga

SEQ ID NO: 88136 - DNA, 38 bp, Artificial Sequence
  Synthetic oligonucleotide
gagtacgcgcaggggagtgtgagctgtgtgaagtttga

SEQ ID NO: 88137 - DNA, 38 bp, Artificial Sequence
  Synthetic oligonucleotide
ttgtcgcgcattttgttgccttttcttacatcgtttga

SEQ ID NO: 88138 - DNA, 37 bp, Artificial Sequence
  Synthetic oligonucleotide
taacacctaaggcttgcatacgcactagcttttttga

SEQ ID NO: 88139 - DNA, 35 bp, Artificial Sequence
  Synthetic oligonucleotide
tcgccggtcgcagcccttcatgtcaggaacacata

SEQ ID NO: 88140 - DNA, 35 bp, Artificial Sequence
  Synthetic oligonucleotide
accggtcacgcatgaacaactcgccccaactcata

SEQ ID NO: 88141 - DNA, 36 bp, Artificial Sequence
  Synthetic oligonucleotide
gatggaaagtttgcaaaggggaaagggaaactacta

SEQ ID NO: 88142 - DNA, 36 bp, Artificial Sequence
  Synthetic oligonucleotide
gcatactgtggcactatcatttaactcagtcttcta

SEQ ID NO: 88143 - DNA, 35 bp, Artificial Sequence
  Synthetic oligonucleotide
ggtgcataggggaggataacacgatgttatgggta

SEQ ID NO: 88144 - DNA, 36 bp, Artificial Sequence
  Synthetic oligonucleotide
gccataagcgatgagggggatgttggctgaagtgta

SEQ ID NO: 88145 - DNA, 35 bp, Artificial Sequence
  Synthetic oligonucleotide
gtacatccactccgcctgtgcatctacctaggtta

SEQ ID NO: 88146 - DNA, 35 bp, Artificial Sequence
  Synthetic oligonucleotide
tcatatcacgccatatttgtcataggccatcgaac

SEQ ID NO: 88147 - DNA, 35 bp, Artificial Sequence
  Synthetic oligonucleotide
gcaggggaaaggacaagcgggaattgggtgataac

SEQ ID NO: 88148 - DNA, 35 bp, Artificial Sequence
  Synthetic oligonucleotide
gttcatgcggcttttgctccttacccacttggcac

SEQ ID NO: 88149 - DNA, 35 bp, Artificial Sequence
  Synthetic oligonucleotide
gtagcgccccgcatggctccagcgtttgccctcac

SEQ ID NO: 88150 - DNA, 35 bp, Artificial Sequence
  Synthetic oligonucleotide
ttacgcccaatcaagagaaccacgagacaaaatac

SEQ ID NO: 88151 - DNA, 35 bp, Artificial Sequence
  Synthetic oligonucleotide
taagcttggcacgtcgtcgacctggctatctctac

SEQ ID NO: 88152 - DNA, 35 bp, Artificial Sequence
  Synthetic oligonucleotide
acaacccgatgattacgctttagtatcgctagtac

SEQ ID NO: 88153 - DNA, 35 bp, Artificial Sequence
  Synthetic oligonucleotide
atcataggacatggggggttggtaagtgatggtac

SEQ ID NO: 88154 - DNA, 34 bp, Artificial Sequence
  Synthetic oligonucleotide
actatccgtgtgggtctcgcccctagcttacacc

SEQ ID NO: 88155 - DNA, 36 bp, Artificial Sequence
  Synthetic oligonucleotide
tagcaagggcttaaaactgtttcggttcggttcacc

SEQ ID NO: 88156 - DNA, 35 bp, Artificial Sequence
  Synthetic oligonucleotide
gtcacccaggcatcactccgtagtacgaatatacc

SEQ ID NO: 88157 - DNA, 35 bp, Artificial Sequence
  Synthetic oligonucleotide
gagaccatacctacactcgtgttctcccaagtgcc

SEQ ID NO: 88158 - DNA, 35 bp, Artificial Sequence
  Synthetic oligonucleotide
tagctgcatcggccgtccttgttggcgatacctcc

SEQ ID NO: 88159 - DNA, 35 bp, Artificial Sequence
  Synthetic oligonucleotide
tcgccggtgcagtctaggtcgtcttaataccctcc

SEQ ID NO: 88160 - DNA, 34 bp, Artificial Sequence
  Synthetic oligonucleotide
tgttggaaagcctgatgtcgcttcacgtccttcc

SEQ ID NO: 88161 - DNA, 35 bp, Artificial Sequence
  Synthetic oligonucleotide
gcactccggttggccattggttgtcatctggctgc

SEQ ID NO: 88162 - DNA, 34 bp, Artificial Sequence
  Synthetic oligonucleotide
tatgccatcgctacgcatcccagagggaccttgc

SEQ ID NO: 88163 - DNA, 35 bp, Artificial Sequence
  Synthetic oligonucleotide
tcaccagccaggcccctctgtccggagtgcttatc

SEQ ID NO: 88164 - DNA, 33 bp, Artificial Sequence
  Synthetic oligonucleotide
gtccacctacgcccgactatgactaggagggtc

SEQ ID NO: 88165 - DNA, 35 bp, Artificial Sequence
  Synthetic oligonucleotide
tacgcacaccctatccaagccacaccagcgcgcag

SEQ ID NO: 88166 - DNA, 35 bp, Artificial Sequence
  Synthetic oligonucleotide
actgacgtcaccactctttgtcgcacctcttggag

SEQ ID NO: 88167 - DNA, 35 bp, Artificial Sequence
  Synthetic oligonucleotide
tcatggggcgagggaaaaaattggtgggtaaatag

SEQ ID NO: 88168 - DNA, 32 bp, Artificial Sequence
  Synthetic oligonucleotide
gaccttgcccctgcgaagagaccactaatacg

SEQ ID NO: 88169 - DNA, 35 bp, Artificial Sequence
  Synthetic oligonucleotide
gtactccgacgccacctggtccctgttcaggaccg

SEQ ID NO: 88170 - DNA, 35 bp, Artificial Sequence
  Synthetic oligonucleotide
aatcacactcatttgccgcaacatggcttagcccg

SEQ ID NO: 88171 - DNA, 35 bp, Artificial Sequence
  Synthetic oligonucleotide
tcagccactgaactgcggaaccgcgtctattcgcg

SEQ ID NO: 88172 - DNA, 35 bp, Artificial Sequence
  Synthetic oligonucleotide
gcgctgtgagcgtactcctgctcgccattaatgcg

SEQ ID NO: 88173 - DNA, 35 bp, Artificial Sequence
  Synthetic oligonucleotide
ttgcaccctcgacccctggcattagtcccaccagg

SEQ ID NO: 88174 - DNA, 35 bp, Artificial Sequence
  Synthetic oligonucleotide
ttattgcccctggtcccctctagacgccgtgtagg

SEQ ID NO: 88175 - DNA, 35 bp, Artificial Sequence
  Synthetic oligonucleotide
gatgattgtcggtgggttacggacaaggggaacgg

SEQ ID NO: 88176 - DNA, 35 bp, Artificial Sequence
  Synthetic oligonucleotide
gtgataggggggggcaagtattgtgcagtgctggg

SEQ ID NO: 88177 - DNA, 35 bp, Artificial Sequence
  Synthetic oligonucleotide
tatgcaccgcagtaactctggcgcaagctacttgg

SEQ ID NO: 88178 - DNA, 35 bp, Artificial Sequence
  Synthetic oligonucleotide
aagaacgaatcaaacggcggtagatatacatcatg

SEQ ID NO: 88179 - DNA, 35 bp, Artificial Sequence
  Synthetic oligonucleotide
gacgttccatgcccagtccacatattaatatcatg

SEQ ID NO: 88180 - DNA, 35 bp, Artificial Sequence
  Synthetic oligonucleotide
gaagacgcgtcacgtcccctatccttagttcactg

SEQ ID NO: 88181 - DNA, 35 bp, Artificial Sequence
  Synthetic oligonucleotide
tcatgagccagacccctaaaatacgtggagccgtg

SEQ ID NO: 88182 - DNA, 35 bp, Artificial Sequence
  Synthetic oligonucleotide
tgtccgccacgcacgacgcgctttgtttttatgtg

SEQ ID NO: 88183 - DNA, 35 bp, Artificial Sequence
  Synthetic oligonucleotide
tcttacgccaaccaggtctaaaggcctcaacctat

SEQ ID NO: 88184 - DNA, 35 bp, Artificial Sequence
  Synthetic oligonucleotide
acggacacccattgccacgaacagtccggtctact

SEQ ID NO: 88185 - DNA, 35 bp, Artificial Sequence
  Synthetic oligonucleotide
gactgctccgactagcatttggtgcgaatcttcct

SEQ ID NO: 88186 - DNA, 35 bp, Artificial Sequence
  Synthetic oligonucleotide
gttgcctttgcacgctgtaacttgtatcgccatct

SEQ ID NO: 88187 - DNA, 35 bp, Artificial Sequence
  Synthetic oligonucleotide
gcaagcccaaatcaaacgcctggtgaatctcctgt

SEQ ID NO: 88188 - DNA, 35 bp, Artificial Sequence
  Synthetic oligonucleotide
atgccacgttaagccgcgtacattccaggtcctgt

SEQ ID NO: 88189 - DNA, 35 bp, Artificial Sequence
  Synthetic oligonucleotide
gacccgcctagttcctccatccgatagcatgttgt

SEQ ID NO: 88190 - DNA, 35 bp, Artificial Sequence
  Synthetic oligonucleotide
ggtggcctgcgatcactgggaaacaactgcacctt

SEQ ID NO: 88191 - DNA, 35 bp, Artificial Sequence
  Synthetic oligonucleotide
gatgccccagagctttataggggaggggcgccctt

SEQ ID NO: 88192 - DNA, 35 bp, Artificial Sequence
  Synthetic oligonucleotide
atcgacctagcctaatgggctcctactatcatctt

SEQ ID NO: 88193 - DNA, 35 bp, Artificial Sequence
  Synthetic oligonucleotide
gcgatcggaatcatacggccatccacccagctttt

SEQ ID NO: 88194 - DNA, 35 bp, Artificial Sequence
  Synthetic oligonucleotide
gcgccgcaatccgttcgttcgaccgccgaagtttt

SEQ ID NO: 88195 - DNA, 36 bp, Artificial Sequence
  Synthetic oligonucleotide
aaacgcatgcctctctgtcctggtcgctctagaaaa

SEQ ID NO: 88196 - DNA, 34 bp, Artificial Sequence
  Synthetic oligonucleotide
acagacgccgactgccactcgccctcctcgaaaa

SEQ ID NO: 88197 - DNA, 35 bp, Artificial Sequence
  Synthetic oligonucleotide
ttgccaagcacaaacgcacgctggggtccatcaaa

SEQ ID NO: 88198 - DNA, 36 bp, Artificial Sequence
  Synthetic oligonucleotide
gccactgaagcggcctgctgatccgcgtgccaccaa

SEQ ID NO: 88199 - DNA, 36 bp, Artificial Sequence
  Synthetic oligonucleotide
accaatgcgtagctcggctgtagaccctttgcccaa

SEQ ID NO: 88200 - DNA, 36 bp, Artificial Sequence
  Synthetic oligonucleotide
tgtcacctcccagcgcacacatgtcctgcgttccaa

SEQ ID NO: 88201 - DNA, 36 bp, Artificial Sequence
  Synthetic oligonucleotide
atccctacggccgatgtacttcctctggcctcgcaa

SEQ ID NO: 88202 - DNA, 36 bp, Artificial Sequence
  Synthetic oligonucleotide
tgtagcctggccttgaatccgttttatactctggaa

SEQ ID NO: 88203 - DNA, 36 bp, Artificial Sequence
  Synthetic oligonucleotide
aacgggtcgggagctgggagggtaccccacacataa

SEQ ID NO: 88204 - DNA, 36 bp, Artificial Sequence
  Synthetic oligonucleotide
tatgtgaccggaaaggggggtaccgagccggagtaa

SEQ ID NO: 88205 - DNA, 36 bp, Artificial Sequence
  Synthetic oligonucleotide
gaacgccgagatgacaaccctcaatctatgaagaca

SEQ ID NO: 88206 - DNA, 36 bp, Artificial Sequence
  Synthetic oligonucleotide
ggagacgttcagtttgaacaactgcccttaacccca

SEQ ID NO: 88207 - DNA, 35 bp, Artificial Sequence
  Synthetic oligonucleotide
aacacagtcagcagaaatgaagatgactgggagca

SEQ ID NO: 88208 - DNA, 36 bp, Artificial Sequence
  Synthetic oligonucleotide
gcataccgcgagccagagctacgctaactcctctca

SEQ ID NO: 88209 - DNA, 35 bp, Artificial Sequence
  Synthetic oligonucleotide
gctgcattctgccgtttcccactgttttcgtctca

SEQ ID NO: 88210 - DNA, 36 bp, Artificial Sequence
  Synthetic oligonucleotide
tgtttcactcgcagccgtaccaccgggctaacttca

SEQ ID NO: 88211 - DNA, 37 bp, Artificial Sequence
  Synthetic oligonucleotide
gttgaggactggcgggagagggaaagcggaaaacaga

SEQ ID NO: 88212 - DNA, 36 bp, Artificial Sequence
  Synthetic oligonucleotide
aagcgggaactgaggagtgggaacattggctagaga

SEQ ID NO: 88213 - DNA, 37 bp, Artificial Sequence
  Synthetic oligonucleotide
agcgggtcggagggtggaattggcgtggtgtaggaga

SEQ ID NO: 88214 - DNA, 36 bp, Artificial Sequence
  Synthetic oligonucleotide
gggtcggcgaaggaagggtgaaggttggaagggaga

SEQ ID NO: 88215 - DNA, 37 bp, Artificial Sequence
  Synthetic oligonucleotide
aaacgcaggattaggagggaaacgacgtacgtggaga

SEQ ID NO: 88216 - DNA, 37 bp, Artificial Sequence
  Synthetic oligonucleotide
gaacggatggttggtggtttagaactgggggtggaga

SEQ ID NO: 88217 - DNA, 35 bp, Artificial Sequence
  Synthetic oligonucleotide
tctgaccgccttggagttagcgaacgaatccccga

SEQ ID NO: 88218 - DNA, 37 bp, Artificial Sequence
  Synthetic oligonucleotide
gtcgtccccccgtgcgaaccggacatccacttcccga

SEQ ID NO: 88219 - DNA, 35 bp, Artificial Sequence
  Synthetic oligonucleotide
ggacacctccagacctgtccttcatgttgatccga

SEQ ID NO: 88220 - DNA, 37 bp, Artificial Sequence
  Synthetic oligonucleotide
tactcactgccctgttgatcctacgccgcccgagcga

SEQ ID NO: 88221 - DNA, 37 bp, Artificial Sequence
  Synthetic oligonucleotide
ccagcgcataagacatcctctctcaacggaagtgcga

SEQ ID NO: 88222 - DNA, 37 bp, Artificial Sequence
  Synthetic oligonucleotide
acaagccatagttacccagccacccttgctagctcga

SEQ ID NO: 88223 - DNA, 36 bp, Artificial Sequence
  Synthetic oligonucleotide
tgaggacagtaggggagtggacaggattgagttcga

SEQ ID NO: 88224 - DNA, 37 bp, Artificial Sequence
  Synthetic oligonucleotide
atgcgcatgaaggtctccgagtatggcttgggaagga

SEQ ID NO: 88225 - DNA, 37 bp, Artificial Sequence
  Synthetic oligonucleotide
gtaataccatctcctgcacaagagctgcccactagga

SEQ ID NO: 88226 - DNA, 37 bp, Artificial Sequence
  Synthetic oligonucleotide
ttgagggaggaggggcatgtaacgcatcggccacgga

SEQ ID NO: 88227 - DNA, 36 bp, Artificial Sequence
  Synthetic oligonucleotide
atcgcactgcagaaaacggacgtaatgcatcccgga

SEQ ID NO: 88228 - DNA, 37 bp, Artificial Sequence
  Synthetic oligonucleotide
ttacacaaagcgggtggtatatgcacaggaggaggga

SEQ ID NO: 88229 - DNA, 35 bp, Artificial Sequence
  Synthetic oligonucleotide
aaaggacgggaaataagcggagtatggtgacggga

SEQ ID NO: 88230 - DNA, 35 bp, Artificial Sequence
  Synthetic oligonucleotide
tcgtgactggcgcagaggaggcgtggggtgcggga

SEQ ID NO: 88231 - DNA, 37 bp, Artificial Sequence
  Synthetic oligonucleotide
aacggagagcacacggtgacagggggtctttggggga

SEQ ID NO: 88232 - DNA, 36 bp, Artificial Sequence
  Synthetic oligonucleotide
agaccgcggtagggctaggacggtcaggggatggga

SEQ ID NO: 88233 - DNA, 34 bp, Artificial Sequence
  Synthetic oligonucleotide
gagtggagggtgcgagaaccggggcgaatatgga

SEQ ID NO: 88234 - DNA, 38 bp, Artificial Sequence
  Synthetic oligonucleotide
tgacaatggggaatagtcaaggaagtcaaatagaatga

SEQ ID NO: 88235 - DNA, 38 bp, Artificial Sequence
  Synthetic oligonucleotide
tactgccctagaagctcgagctcagctccatctaatga

SEQ ID NO: 88236 - DNA, 38 bp, Artificial Sequence
  Synthetic oligonucleotide
tgtagggcaacaacggaagagcaggtcaacggacatga

SEQ ID NO: 88237 - DNA, 37 bp, Artificial Sequence
  Synthetic oligonucleotide
gaaccgtagtaggcaggtaggtaagactacggcatga

SEQ ID NO: 88238 - DNA, 36 bp, Artificial Sequence
  Synthetic oligonucleotide
gcccgaccacgcccagacaccgcgagaaatcgatga

SEQ ID NO: 88239 - DNA, 38 bp, Artificial Sequence
  Synthetic oligonucleotide
tcacaacgcgggtggttgggttcgtaagaataggatga

SEQ ID NO: 88240 - DNA, 38 bp, Artificial Sequence
  Synthetic oligonucleotide
gacgacagggggagcaatggggtagctaacggctatga

SEQ ID NO: 88241 - DNA, 38 bp, Artificial Sequence
  Synthetic oligonucleotide
gactactaactggatagggagtgcacactcctttatga

SEQ ID NO: 88242 - DNA, 38 bp, Artificial Sequence
  Synthetic oligonucleotide
atgtacatcgatgtgcatttacccatgcaatccactga

SEQ ID NO: 88243 - DNA, 38 bp, Artificial Sequence
  Synthetic oligonucleotide
gactccagcaaatgcttattattgtcgcctctacctga

SEQ ID NO: 88244 - DNA, 37 bp, Artificial Sequence
  Synthetic oligonucleotide
ttgcaccacattggagatccttgtcccccgtacctga

SEQ ID NO: 88245 - DNA, 38 bp, Artificial Sequence
  Synthetic oligonucleotide
ttgccggtcgattcgatctgcggacgcctcaaccctga

SEQ ID NO: 88246 - DNA, 38 bp, Artificial Sequence
  Synthetic oligonucleotide
gagcccgcgactgctaagctggtcttcgaatatcctga

SEQ ID NO: 88247 - DNA, 38 bp, Artificial Sequence
  Synthetic oligonucleotide
ggtcatggcctcccgaacttcattgctacatgtcctga

SEQ ID NO: 88248 - DNA, 38 bp, Artificial Sequence
  Synthetic oligonucleotide
gttccgcacccactggtggtaatgctgaaaacttctga

SEQ ID NO: 88249 - DNA, 38 bp, Artificial Sequence
  Synthetic oligonucleotide
tgtgagcagccggaaaggtggaggggatttgcaagtga

SEQ ID NO: 88250 - DNA, 38 bp, Artificial Sequence
  Synthetic oligonucleotide
gacaccaccctgctgcagcctcctcacctatgacgtga

SEQ ID NO: 88251 - DNA, 38 bp, Artificial Sequence
  Synthetic oligonucleotide
tgacggtgccaccgtcgtccaagattgtcacgcggtga

SEQ ID NO: 88252 - DNA, 38 bp, Artificial Sequence
  Synthetic oligonucleotide
atgtccccaaatccgcctgagattcatctcccatgtga

SEQ ID NO: 88253 - DNA, 38 bp, Artificial Sequence
  Synthetic oligonucleotide
aacgtccccccgcgccctgatccgagttacaaccttga

SEQ ID NO: 88254 - DNA, 36 bp, Artificial Sequence
  Synthetic oligonucleotide
tactgcttcacgtcgcgattatggccccactcttga

SEQ ID NO: 88255 - DNA, 38 bp, Artificial Sequence
  Synthetic oligonucleotide
gagcggaccacgttattgagttgccgcgtagtcgttga

SEQ ID NO: 88256 - DNA, 37 bp, Artificial Sequence
  Synthetic oligonucleotide
atcgaaggtgcccgagttggacatgggggcgggttga

SEQ ID NO: 88257 - DNA, 38 bp, Artificial Sequence
  Synthetic oligonucleotide
aacaagagctgggcgtaggaaggagcggaattggttga

SEQ ID NO: 88258 - DNA, 37 bp, Artificial Sequence
  Synthetic oligonucleotide
tacgcataccgttctctgtttaccttaccttgtttga

SEQ ID NO: 88259 - DNA, 35 bp, Artificial Sequence
  Synthetic oligonucleotide
tatgaaaggagtgcggggggtacgtcgttaggcta

SEQ ID NO: 88260 - DNA, 35 bp, Artificial Sequence
  Synthetic oligonucleotide
tagcaggcggggctcagacaacacctgctaacgta

SEQ ID NO: 88261 - DNA, 35 bp, Artificial Sequence
  Synthetic oligonucleotide
tcgaatggggcaacttttgcgactgggcaccttta

SEQ ID NO: 88262 - DNA, 35 bp, Artificial Sequence
  Synthetic oligonucleotide
acaactgcaccagctagactatctggacgctacac

SEQ ID NO: 88263 - DNA, 35 bp, Artificial Sequence
  Synthetic oligonucleotide
gatcagggactgctaccctaatacgtttccacgcc

SEQ ID NO: 88264 - DNA, 35 bp, Artificial Sequence
  Synthetic oligonucleotide
ggtaacgcccggccctctccgtgtcagcataggcc

SEQ ID NO: 88265 - DNA, 35 bp, Artificial Sequence
  Synthetic oligonucleotide
acttcaaacctagcctggattccgtgacaatcagc

SEQ ID NO: 88266 - DNA, 35 bp, Artificial Sequence
  Synthetic oligonucleotide
agccacgccgaatattttcgctgaagacctcacgc

SEQ ID NO: 88267 - DNA, 35 bp, Artificial Sequence
  Synthetic oligonucleotide
atgtcgccggttagcgcgactcaactttaattggc

SEQ ID NO: 88268 - DNA, 35 bp, Artificial Sequence
  Synthetic oligonucleotide
aacacgtactgaccccccaatttgaaatcgacatc

SEQ ID NO: 88269 - DNA, 35 bp, Artificial Sequence
  Synthetic oligonucleotide
gtcagatctacgcccattggcacacgctatgcatc

SEQ ID NO: 88270 - DNA, 35 bp, Artificial Sequence
  Synthetic oligonucleotide
atcgtgcgagctgctttctatcatctatgtgcctc

SEQ ID NO: 88271 - DNA, 35 bp, Artificial Sequence
  Synthetic oligonucleotide
gacgcatccgcggttgagaacgccactgcctcgtc

SEQ ID NO: 88272 - DNA, 34 bp, Artificial Sequence
  Synthetic oligonucleotide
gatcagccctatagcaacttccaatccatgcaag

SEQ ID NO: 88273 - DNA, 32 bp, Artificial Sequence
  Synthetic oligonucleotide
tcactggggccgagacccgtgaaaggagagag

SEQ ID NO: 88274 - DNA, 35 bp, Artificial Sequence
  Synthetic oligonucleotide
gaccaggacaaggatagcaatgatttgggcgatag

SEQ ID NO: 88275 - DNA, 35 bp, Artificial Sequence
  Synthetic oligonucleotide
tgtggaggtagggaaagggatagtactaagtgacg

SEQ ID NO: 88276 - DNA, 35 bp, Artificial Sequence
  Synthetic oligonucleotide
atgtccgcctctaccgcttttgttggtttttgacg

SEQ ID NO: 88277 - DNA, 35 bp, Artificial Sequence
  Synthetic oligonucleotide
tccgaggctacgagcgcgcctatggaccattttcg

SEQ ID NO: 88278 - DNA, 35 bp, Artificial Sequence
  Synthetic oligonucleotide
gccaagggtaagtacttaggcaaattgaggggggg

SEQ ID NO: 88279 - DNA, 35 bp, Artificial Sequence
  Synthetic oligonucleotide
gagtggaaagtgcggttatacgaaccaggaagatg

SEQ ID NO: 88280 - DNA, 35 bp, Artificial Sequence
  Synthetic oligonucleotide
tcgtagaggcaaggaagggcttcggggggcgagtg

SEQ ID NO: 88281 - DNA, 35 bp, Artificial Sequence
  Synthetic oligonucleotide
tgttagctcgccgggattccggttactcctttttg

SEQ ID NO: 88282 - DNA, 35 bp, Artificial Sequence
  Synthetic oligonucleotide
gcgttctgcccgaaccccaacgctggtactcgaat

SEQ ID NO: 88283 - DNA, 35 bp, Artificial Sequence
  Synthetic oligonucleotide
gatgacaacccccgtcaatcctgtgctcacgggat

SEQ ID NO: 88284 - DNA, 35 bp, Artificial Sequence
  Synthetic oligonucleotide
gactgatggtgggatatagggaaaaaataagctat

SEQ ID NO: 88285 - DNA, 35 bp, Artificial Sequence
  Synthetic oligonucleotide
tctccaccccaggactggttaccacctctcaaact

SEQ ID NO: 88286 - DNA, 35 bp, Artificial Sequence
  Synthetic oligonucleotide
actgtcgagaggtacgggggtgaagtccaaaagct

SEQ ID NO: 88287 - DNA, 35 bp, Artificial Sequence
  Synthetic oligonucleotide
ttagtgagcctccatcactctgagtgcaacattct

SEQ ID NO: 88288 - DNA, 35 bp, Artificial Sequence
  Synthetic oligonucleotide
gtgtggtccgcacgacatccacgattgaattttct

SEQ ID NO: 88289 - DNA, 35 bp, Artificial Sequence
  Synthetic oligonucleotide
gatccaccgcaatactgaaccctaaccagtcactt

SEQ ID NO: 88290 - DNA, 35 bp, Artificial Sequence
  Synthetic oligonucleotide
tttgcatcaaaccaccactgtcttagcgcggactt

SEQ ID NO: 88291 - DNA, 35 bp, Artificial Sequence
  Synthetic oligonucleotide
ccacaccacgcgcgaactcaccgtcatacgacctt

SEQ ID NO: 88292 - DNA, 35 bp, Artificial Sequence
  Synthetic oligonucleotide
tatcctgtctaggtggccttatctaaacgttcctt

SEQ ID NO: 88293 - DNA, 35 bp, Artificial Sequence
  Synthetic oligonucleotide
acgcggacacagcaccttagtagttactctttctt

SEQ ID NO: 88294 - DNA, 35 bp, Artificial Sequence
  Synthetic oligonucleotide
gcccaggctcactgcccgaccaaccgcactgggtt

SEQ ID NO: 88295 - DNA, 35 bp, Artificial Sequence
  Synthetic oligonucleotide
agaacgcctgatcaccggcctctcactagtacttt

SEQ ID NO: 88296 - DNA, 35 bp, Artificial Sequence
  Synthetic oligonucleotide
gaacacccacacaccgggaaaatgtatgcattaaa

SEQ ID NO: 88297 - DNA, 35 bp, Artificial Sequence
  Synthetic oligonucleotide
agcaaagcccccagcaatccttcgtaggcatacaa

SEQ ID NO: 88298 - DNA, 35 bp, Artificial Sequence
  Synthetic oligonucleotide
tcccgactacgccaccgtaaactacgggcttccaa

SEQ ID NO: 88299 - DNA, 36 bp, Artificial Sequence
  Synthetic oligonucleotide
tgcatggtgggaacacgtacttgaccgaacaggcaa

SEQ ID NO: 88300 - DNA, 36 bp, Artificial Sequence
  Synthetic oligonucleotide
gtgtgcacagcgaactacttcgtctaattacttcaa

SEQ ID NO: 88301 - DNA, 35 bp, Artificial Sequence
  Synthetic oligonucleotide
atgacgtgcggtgacgattacatgcaacactagaa

SEQ ID NO: 88302 - DNA, 36 bp, Artificial Sequence
  Synthetic oligonucleotide
ggccagggacaaaggggcacggaaatcggggttgaa

SEQ ID NO: 88303 - DNA, 36 bp, Artificial Sequence
  Synthetic oligonucleotide
gagcgaagaggatcacggggggggacccagttataa

SEQ ID NO: 88304 - DNA, 36 bp, Artificial Sequence
  Synthetic oligonucleotide
ccctgacccacccgagtgacctaatatgatcgttaa

SEQ ID NO: 88305 - DNA, 36 bp, Artificial Sequence
  Synthetic oligonucleotide
ggacccacagcgagttcgagggccaatcacgaaaca

SEQ ID NO: 88306 - DNA, 36 bp, Artificial Sequence
  Synthetic oligonucleotide
tatcccgctactacgccggtccactcgtggttaaca

SEQ ID NO: 88307 - DNA, 35 bp, Artificial Sequence
  Synthetic oligonucleotide
atgcgtgtctactgcaggcctacacttttctcaca

SEQ ID NO: 88308 - DNA, 35 bp, Artificial Sequence
  Synthetic oligonucleotide
tgaaccatcctctgatggtgtatttcatttcacca

SEQ ID NO: 88309 - DNA, 35 bp, Artificial Sequence
  Synthetic oligonucleotide
accgaaagcgcacgtcttaacgtttctacctacca

SEQ ID NO: 88310 - DNA, 36 bp, Artificial Sequence
  Synthetic oligonucleotide
tcttgacatgttcgcccttgtattccgccggtgcca

SEQ ID NO: 88311 - DNA, 36 bp, Artificial Sequence
  Synthetic oligonucleotide
gagcgcatcccctatcgacgggcaagtaccaatcca

SEQ ID NO: 88312 - DNA, 36 bp, Artificial Sequence
  Synthetic oligonucleotide
acacccggtagagacaaggatcaccgcgctaacgca

SEQ ID NO: 88313 - DNA, 36 bp, Artificial Sequence
  Synthetic oligonucleotide
tcacccaccattcgacggcctaagagtctggccgca

SEQ ID NO: 88314 - DNA, 35 bp, Artificial Sequence
  Synthetic oligonucleotide
aacgccaagtcaatgttttcccagctcacgaggca

SEQ ID NO: 88315 - DNA, 36 bp, Artificial Sequence
  Synthetic oligonucleotide
aatatcctcccatggtcttaatacacagttacatca

SEQ ID NO: 88316 - DNA, 36 bp, Artificial Sequence
  Synthetic oligonucleotide
atcggttcagcccattatgactattcctacgcctca

SEQ ID NO: 88317 - DNA, 36 bp, Artificial Sequence
  Synthetic oligonucleotide
gggactacctcaacgtacctaacgaatctgatctca

SEQ ID NO: 88318 - DNA, 37 bp, Artificial Sequence
  Synthetic oligonucleotide
ggaatcctcaccgcctttctatcacaccagttccaga

SEQ ID NO: 88319 - DNA, 36 bp, Artificial Sequence
  Synthetic oligonucleotide
atgtcatgactccgcctaatacctgctccagtgaga

SEQ ID NO: 88320 - DNA, 36 bp, Artificial Sequence
  Synthetic oligonucleotide
ggatgggagtgaggcgggtgtcggtagaacattaga

SEQ ID NO: 88321 - DNA, 37 bp, Artificial Sequence
  Synthetic oligonucleotide
tgctatgcgctgcctgtttgttgcttgcgtgccacga

SEQ ID NO: 88322 - DNA, 37 bp, Artificial Sequence
  Synthetic oligonucleotide
aggtagtcagggggggcagaaggggatcggagcgcga

SEQ ID NO: 88323 - DNA, 37 bp, Artificial Sequence
  Synthetic oligonucleotide
ttcgatcgaaaaacggtagttggagggcaaagggcga

SEQ ID NO: 88324 - DNA, 37 bp, Artificial Sequence
  Synthetic oligonucleotide
gacgcagtcgttggtagtgttcgtagggtacttgcga

SEQ ID NO: 88325 - DNA, 37 bp, Artificial Sequence
  Synthetic oligonucleotide
ttgctacgtacgaggtcctcctacacccacatgtcga

SEQ ID NO: 88326 - DNA, 36 bp, Artificial Sequence
  Synthetic oligonucleotide
ttcccgcacacatcatcgccactgtcgagctttcga

SEQ ID NO: 88327 - DNA, 37 bp, Artificial Sequence
  Synthetic oligonucleotide
gatgaccgaggtatgtagagggccatgactgtttcga

SEQ ID NO: 88328 - DNA, 37 bp, Artificial Sequence
  Synthetic oligonucleotide
gactggcgccgcacgctggtagatgtcttcacccgga

SEQ ID NO: 88329 - DNA, 37 bp, Artificial Sequence
  Synthetic oligonucleotide
tcatagggaaaacagggagcatgcggtaagggcggga

SEQ ID NO: 88330 - DNA, 37 bp, Artificial Sequence
  Synthetic oligonucleotide
agcgggagaggtttggtgtttaggtaggaggggggga

SEQ ID NO: 88331 - DNA, 37 bp, Artificial Sequence
  Synthetic oligonucleotide
gacgaccgtggctgggggagatttagggcgggtggga

SEQ ID NO: 88332 - DNA, 36 bp, Artificial Sequence
  Synthetic oligonucleotide
gcgagggcatctagatctttggcattgctggtggga

SEQ ID NO: 88333 - DNA, 35 bp, Artificial Sequence
  Synthetic oligonucleotide
ggagggttgggctgggtaaaagggtgaatggtgga

SEQ ID NO: 88334 - DNA, 37 bp, Artificial Sequence
  Synthetic oligonucleotide
tcaaccataccctcgtgcgaactcctccagttcatga

SEQ ID NO: 88335 - DNA, 38 bp, Artificial Sequence
  Synthetic oligonucleotide
atgacgggcaggagaggggctttactgaggcattatga

SEQ ID NO: 88336 - DNA, 38 bp, Artificial Sequence
  Synthetic oligonucleotide
ttgcgccaagtcagttttcaccgatagcaacctcctga

SEQ ID NO: 88337 - DNA, 38 bp, Artificial Sequence
  Synthetic oligonucleotide
gaaggagggacggggaggtgagaccacaagtgcgctga

SEQ ID NO: 88338 - DNA, 36 bp, Artificial Sequence
  Synthetic oligonucleotide
tgtctacgcccagacccgatccgatctaaatgctga

SEQ ID NO: 88339 - DNA, 38 bp, Artificial Sequence
  Synthetic oligonucleotide
tgaccgtgctctcctcgtgctccaatctagcttgctga

SEQ ID NO: 88340 - DNA, 38 bp, Artificial Sequence
  Synthetic oligonucleotide
tgaacctccgatcactcagttcctcgacatttatctga

SEQ ID NO: 88341 - DNA, 38 bp, Artificial Sequence
  Synthetic oligonucleotide
gtcgagtcctgcgaccgccttagaatcacttcgtctga

SEQ ID NO: 88342 - DNA, 38 bp, Artificial Sequence
  Synthetic oligonucleotide
acaaccgccgggagttgttcgtagatgcactgcagtga

SEQ ID NO: 88343 - DNA, 37 bp, Artificial Sequence
  Synthetic oligonucleotide
tctgccctttgccgcactacacagttccttcacgtga

SEQ ID NO: 88344 - DNA, 38 bp, Artificial Sequence
  Synthetic oligonucleotide
tcgacctagggcaggaaatgcggaaggagtgttcgtga

SEQ ID NO: 88345 - DNA, 38 bp, Artificial Sequence
  Synthetic oligonucleotide
gaggtcaagggaagaccagggagaaagcacaaaggtga

SEQ ID NO: 88346 - DNA, 38 bp, Artificial Sequence
  Synthetic oligonucleotide
ggagaggtgaggtagcgccgagggagtgctgggggtga

SEQ ID NO: 88347 - DNA, 38 bp, Artificial Sequence
  Synthetic oligonucleotide
gccaagtcgtccgcttgtgctcctaacacccgttgtga

SEQ ID NO: 88348 - DNA, 37 bp, Artificial Sequence
  Synthetic oligonucleotide
acgcaccattgattcctcgacgctactcgcaaattga

SEQ ID NO: 88349 - DNA, 38 bp, Artificial Sequence
  Synthetic oligonucleotide
tgctcccaccgaccttttgagcttcagcattcaattga

SEQ ID NO: 88350 - DNA, 37 bp, Artificial Sequence
  Synthetic oligonucleotide
attacgcgcaccacatgaatgaacgcttccgtattga

SEQ ID NO: 88351 - DNA, 37 bp, Artificial Sequence
  Synthetic oligonucleotide
atcactcgggggtacttagccactccttttttattga

SEQ ID NO: 88352 - DNA, 38 bp, Artificial Sequence
  Synthetic oligonucleotide
accggacgaccgcacatgtctatccaagggaaggttga

SEQ ID NO: 88353 - DNA, 36 bp, Artificial Sequence
  Synthetic oligonucleotide
tccagacgtgcctcactccgctgcgctgttttcata

SEQ ID NO: 88354 - DNA, 36 bp, Artificial Sequence
  Synthetic oligonucleotide
aggacgccgaggggggaggtcataattaggaagata

SEQ ID NO: 88355 - DNA, 36 bp, Artificial Sequence
  Synthetic oligonucleotide
taggtacgatcacgacgctggctttggttactacta

SEQ ID NO: 88356 - DNA, 35 bp, Artificial Sequence
  Synthetic oligonucleotide
atgcggggacgagggagtgcaggcgcacagactta

SEQ ID NO: 88357 - DNA, 36 bp, Artificial Sequence
  Synthetic oligonucleotide
atcgccccgcagatacctccatctgggcagtactta

SEQ ID NO: 88358 - DNA, 35 bp, Artificial Sequence
  Synthetic oligonucleotide
gccaaacgtaactggtccgcgcattgagccctaac

SEQ ID NO: 88359 - DNA, 35 bp, Artificial Sequence
  Synthetic oligonucleotide
acccaagcccgccacgacttaccaggtgactagac

SEQ ID NO: 88360 - DNA, 35 bp, Artificial Sequence
  Synthetic oligonucleotide
gccccgaggtcacatcatctagtttcctgctcgac

SEQ ID NO: 88361 - DNA, 35 bp, Artificial Sequence
  Synthetic oligonucleotide
tacgacctcccaacgctgttcgcgacgggacatac

SEQ ID NO: 88362 - DNA, 35 bp, Artificial Sequence
  Synthetic oligonucleotide
gagcccacatgccaaacgggtctaccgccgggacc

SEQ ID NO: 88363 - DNA, 35 bp, Artificial Sequence
  Synthetic oligonucleotide
accacgcggatggcaaatctttccgcgttcttacc

SEQ ID NO: 88364 - DNA, 35 bp, Artificial Sequence
  Synthetic oligonucleotide
tcacagattgtcactcaccgcacgacgcatttacc

SEQ ID NO: 88365 - DNA, 35 bp, Artificial Sequence
  Synthetic oligonucleotide
atcttactacgcctgactatcttatatcaggaccc

SEQ ID NO: 88366 - DNA, 35 bp, Artificial Sequence
  Synthetic oligonucleotide
gacaacgctcgccgccatggaaccacacgctaccc

SEQ ID NO: 88367 - DNA, 35 bp, Artificial Sequence
  Synthetic oligonucleotide
atgctcaccagggggcttcctgcgtcactgtcccc

SEQ ID NO: 88368 - DNA, 35 bp, Artificial Sequence
  Synthetic oligonucleotide
tcctgacagtgactgatttcttccacccaaatccc

SEQ ID NO: 88369 - DNA, 35 bp, Artificial Sequence
  Synthetic oligonucleotide
gttacaccactgaccgccctcaccgcctcgacgcc

SEQ ID NO: 88370 - DNA, 35 bp, Artificial Sequence
  Synthetic oligonucleotide
ggaccgcaatcagatgtcactcgtcgcattgggcc

SEQ ID NO: 88371 - DNA, 35 bp, Artificial Sequence
  Synthetic oligonucleotide
atatcgaaccacctgcgtccctgctgcggttggcc

SEQ ID NO: 88372 - DNA, 35 bp, Artificial Sequence
  Synthetic oligonucleotide
gctcccatgccggcctggtttcagtttgccgtgcc

SEQ ID NO: 88373 - DNA, 35 bp, Artificial Sequence
  Synthetic oligonucleotide
gcaaccgcccgctgcatcgtcccgaatcactttcc

SEQ ID NO: 88374 - DNA, 35 bp, Artificial Sequence
  Synthetic oligonucleotide
attgccctacaatgtactttcccagaatgcgaatc

SEQ ID NO: 88375 - DNA, 35 bp, Artificial Sequence
  Synthetic oligonucleotide
gatgcggtgctcagggatcgtcatttctttccatc

SEQ ID NO: 88376 - DNA, 35 bp, Artificial Sequence
  Synthetic oligonucleotide
tccgcctactaggccgttcggagcaaccacgcatc

SEQ ID NO: 88377 - DNA, 35 bp, Artificial Sequence
  Synthetic oligonucleotide
acgtccagcagcctcgtttcgcttgcttctacctc

SEQ ID NO: 88378 - DNA, 35 bp, Artificial Sequence
  Synthetic oligonucleotide
gactgggcaatggggtgccctaagttgtatccctc

SEQ ID NO: 88379 - DNA, 35 bp, Artificial Sequence
  Synthetic oligonucleotide
gccggtcaatctaccaatggcggttccttgtgctc

SEQ ID NO: 88380 - DNA, 35 bp, Artificial Sequence
  Synthetic oligonucleotide
ttgatctccgtcattaccctggcctcttaattctc

SEQ ID NO: 88381 - DNA, 35 bp, Artificial Sequence
  Synthetic oligonucleotide
gaaacgcatctctcggttcatccccgtattgggtc

SEQ ID NO: 88382 - DNA, 35 bp, Artificial Sequence
  Synthetic oligonucleotide
atgaaccgtcatcatttggttcaatttttactgtc

SEQ ID NO: 88383 - DNA, 35 bp, Artificial Sequence
  Synthetic oligonucleotide
tctcaatgtccatgcgtcgcttagatccccaattc

SEQ ID NO: 88384 - DNA, 35 bp, Artificial Sequence
  Synthetic oligonucleotide
gacgacctaaggcacgcttaacacaatggactttc

SEQ ID NO: 88385 - DNA, 35 bp, Artificial Sequence
  Synthetic oligonucleotide
agtaccgggaatcgggggcaagaacggttgggaag

SEQ ID NO: 88386 - DNA, 35 bp, Artificial Sequence
  Synthetic oligonucleotide
atgtcgaaccggcccgctgtactcccccgtcttag

SEQ ID NO: 88387 - DNA, 35 bp, Artificial Sequence
  Synthetic oligonucleotide
gacgcacactggtgttttcttcttcaatggaatcg

SEQ ID NO: 88388 - DNA, 35 bp, Artificial Sequence
  Synthetic oligonucleotide
gcaaccattgtgaaattcactaagcccctccactg

SEQ ID NO: 88389 - DNA, 35 bp, Artificial Sequence
  Synthetic oligonucleotide
tgaccgggcggtcaacctttcctatcgaacacgtg

SEQ ID NO: 88390 - DNA, 35 bp, Artificial Sequence
  Synthetic oligonucleotide
tcaggcctcgcacaatcgcgcctgtattatccaat

SEQ ID NO: 88391 - DNA, 35 bp, Artificial Sequence
  Synthetic oligonucleotide
tcgaaagctcgccgacggcccctggttagcaccat

SEQ ID NO: 88392 - DNA, 36 bp, Artificial Sequence
  Synthetic oligonucleotide
gggtcatggggcgggaagggcgcggtgcatacatat

SEQ ID NO: 88393 - DNA, 35 bp, Artificial Sequence
  Synthetic oligonucleotide
accatgacgacacatactcttcgccccccgtgtat

SEQ ID NO: 88394 - DNA, 35 bp, Artificial Sequence
  Synthetic oligonucleotide
tgcgctctgcagaactttattgatcccccgttact

SEQ ID NO: 88395 - DNA, 35 bp, Artificial Sequence
  Synthetic oligonucleotide
ttccgcacccgaggctattgcatcgctagacacct

SEQ ID NO: 88396 - DNA, 35 bp, Artificial Sequence
  Synthetic oligonucleotide
tcacggcggtcctgcgttcactaccatcttcgcct

SEQ ID NO: 88397 - DNA, 35 bp, Artificial Sequence
  Synthetic oligonucleotide
gtgccccatcgcccatcgccacagctatcctgcct

SEQ ID NO: 88398 - DNA, 35 bp, Artificial Sequence
  Synthetic oligonucleotide
gaaccactttaccgcatctgcttggctcaaatcct

SEQ ID NO: 88399 - DNA, 35 bp, Artificial Sequence
  Synthetic oligonucleotide
atgcgcataacgtgcgcggatgctcattgcttcct

SEQ ID NO: 88400 - DNA, 35 bp, Artificial Sequence
  Synthetic oligonucleotide
tacgtccatccatcgtcccatagactcgtattgct

SEQ ID NO: 88401 - DNA, 35 bp, Artificial Sequence
  Synthetic oligonucleotide
tctggccagggggacgggatgtgatgggtttgcgt

SEQ ID NO: 88402 - DNA, 35 bp, Artificial Sequence
  Synthetic oligonucleotide
gtcagggacagggtggggtggggaactcggggggt

SEQ ID NO: 88403 - DNA, 35 bp, Artificial Sequence
  Synthetic oligonucleotide
ataccaccgccgcaactacatgtgtcgtccccatt

SEQ ID NO: 88404 - DNA, 33 bp, Artificial Sequence
  Synthetic oligonucleotide
gttaacggcgccgttattccaggtcattccatt

SEQ ID NO: 88405 - DNA, 35 bp, Artificial Sequence
  Synthetic oligonucleotide
gatgcgtttaacgctggatgtcgcccaaccctttt

SEQ ID NO: 88406 - DNA, 36 bp, Artificial Sequence
  Synthetic oligonucleotide
actacatgcctactctgctgacgtgatcaatcaaaa

SEQ ID NO: 88407 - DNA, 36 bp, Artificial Sequence
  Synthetic oligonucleotide
gtgtacctgcgtcctataaatacatggggaggaaaa

SEQ ID NO: 88408 - DNA, 35 bp, Artificial Sequence
  Synthetic oligonucleotide
tctaaccccattgctcctcacacagctttggaaaa

SEQ ID NO: 88409 - DNA, 35 bp, Artificial Sequence
  Synthetic oligonucleotide
gtgaacgacggaaaagggttcatctgggcgataaa

SEQ ID NO: 88410 - DNA, 35 bp, Artificial Sequence
  Synthetic oligonucleotide
acacacatcgatataggaacccagcagagagtaaa

SEQ ID NO: 88411 - DNA, 36 bp, Artificial Sequence
  Synthetic oligonucleotide
catcagtccactatcacacgcacttcgcgtcgacaa

SEQ ID NO: 88412 - DNA, 35 bp, Artificial Sequence
  Synthetic oligonucleotide
tgtacgcactccacgcttatgtcgaaggattccaa

SEQ ID NO: 88413 - DNA, 35 bp, Artificial Sequence
  Synthetic oligonucleotide
gcacgctgtcgccattgccccttcctggtctgcaa

SEQ ID NO: 88414 - DNA, 35 bp, Artificial Sequence
  Synthetic oligonucleotide
ggatgttgaactgggatgggaggttgggacgggaa

SEQ ID NO: 88415 - DNA, 36 bp, Artificial Sequence
  Synthetic oligonucleotide
gacaacagaaggcatgagtagttgaattgtggggaa

SEQ ID NO: 88416 - DNA, 35 bp, Artificial Sequence
  Synthetic oligonucleotide
tttgacgccacctgggtatgcgctcttattttgaa

SEQ ID NO: 88417 - DNA, 35 bp, Artificial Sequence
  Synthetic oligonucleotide
atccgcacggcgaataaacgttctaaatgcgaaca

SEQ ID NO: 88418 - DNA, 35 bp, Artificial Sequence
  Synthetic oligonucleotide
ttcgaccatcggaggtgcaagcctcgatatataca

SEQ ID NO: 88419 - DNA, 36 bp, Artificial Sequence
  Synthetic oligonucleotide
tgagacgcttccgaatagcttttttggctcactaca

SEQ ID NO: 88420 - DNA, 36 bp, Artificial Sequence
  Synthetic oligonucleotide
tacgacttgctcgcatcttctcccaacgttgaacca

SEQ ID NO: 88421 - DNA, 36 bp, Artificial Sequence
  Synthetic oligonucleotide
tgatgctctccactagtttaacggcacacgacacca

SEQ ID NO: 88422 - DNA, 35 bp, Artificial Sequence
  Synthetic oligonucleotide
ttgagcgattccttggattgccctgtcttgcacca

SEQ ID NO: 88423 - DNA, 36 bp, Artificial Sequence
  Synthetic oligonucleotide
tcagccgcggtctctgtcatggtctctctcatacca

SEQ ID NO: 88424 - DNA, 35 bp, Artificial Sequence
  Synthetic oligonucleotide
tagtccacacagcagccacatagcagcacccccca

SEQ ID NO: 88425 - DNA, 36 bp, Artificial Sequence
  Synthetic oligonucleotide
agtggaactcaaaggtacggtgctgcagttccccca

SEQ ID NO: 88426 - DNA, 36 bp, Artificial Sequence
  Synthetic oligonucleotide
tgcgtgcggaggtcactgtcttccatccctctgcca

SEQ ID NO: 88427 - DNA, 35 bp, Artificial Sequence
  Synthetic oligonucleotide
aacgccgtagcacgtttgcaggccactggtatcca

SEQ ID NO: 88428 - DNA, 36 bp, Artificial Sequence
  Synthetic oligonucleotide
atgtgcccacctgccgagaccttggagtacgtggca

SEQ ID NO: 88429 - DNA, 35 bp, Artificial Sequence
  Synthetic oligonucleotide
tttacccgacgttcaggctggtacctgatctatca

SEQ ID NO: 88430 - DNA, 35 bp, Artificial Sequence
  Synthetic oligonucleotide
gcaatggtcgccagctccgagttcacggcctctca

SEQ ID NO: 88431 - DNA, 36 bp, Artificial Sequence
  Synthetic oligonucleotide
gacagagcgaaatacggtaggggggacgctaagtca

SEQ ID NO: 88432 - DNA, 36 bp, Artificial Sequence
  Synthetic oligonucleotide
acctgggtgcggtaactagggaggatatcgacttca

SEQ ID NO: 88433 - DNA, 36 bp, Artificial Sequence
  Synthetic oligonucleotide
ttggtcgtccatgaccccgtatcctcccgaccttca

SEQ ID NO: 88434 - DNA, 36 bp, Artificial Sequence
  Synthetic oligonucleotide
agccacaccggtgagctgcattacacgtaggcttca

SEQ ID NO: 88435 - DNA, 36 bp, Artificial Sequence
  Synthetic oligonucleotide
tcatcgcacacctcgcgcaacttcgtgccaatttca

SEQ ID NO: 88436 - DNA, 36 bp, Artificial Sequence
  Synthetic oligonucleotide
gaatatcagccccttcgcctgccatgtacgatttca

SEQ ID NO: 88437 - DNA, 36 bp, Artificial Sequence
  Synthetic oligonucleotide
gtttgccgtagtaccgatagtctttcgttcgtttca

SEQ ID NO: 88438 - DNA, 37 bp, Artificial Sequence
  Synthetic oligonucleotide
cacacgcgcaagatcgtccagtagagcgctggcaaga

SEQ ID NO: 88439 - DNA, 37 bp, Artificial Sequence
  Synthetic oligonucleotide
agactgggttgatggcaagcggagggaagggtgcaga

SEQ ID NO: 88440 - DNA, 35 bp, Artificial Sequence
  Synthetic oligonucleotide
tccccgcaccatccctcgacgttaactctatcaga

SEQ ID NO: 88441 - DNA, 36 bp, Artificial Sequence
  Synthetic oligonucleotide
gttgctggagggaaggggtggttatcgcggttcaga

SEQ ID NO: 88442 - DNA, 37 bp, Artificial Sequence
  Synthetic oligonucleotide
gagtacgctgtagtgatgagcgaagcggaagaagaga

SEQ ID NO: 88443 - DNA, 36 bp, Artificial Sequence
  Synthetic oligonucleotide
tagacagagggggttattatggcacaggaggataga

SEQ ID NO: 88444 - DNA, 37 bp, Artificial Sequence
  Synthetic oligonucleotide
aacactcaaatactgctcatcgccgactggctgtaga

SEQ ID NO: 88445 - DNA, 37 bp, Artificial Sequence
  Synthetic oligonucleotide
ttccaccggcacaagtctgttcatgccctcttttaga

SEQ ID NO: 88446 - DNA, 37 bp, Artificial Sequence
  Synthetic oligonucleotide
gactgggtaggggggggcaaaaataggatcggaacga

SEQ ID NO: 88447 - DNA, 37 bp, Artificial Sequence
  Synthetic oligonucleotide
gacacttctatgctctattattgcctgttgcacacga

SEQ ID NO: 88448 - DNA, 37 bp, Artificial Sequence
  Synthetic oligonucleotide
gcaccccccatacgttctgactgtgagtgaaaaccga

SEQ ID NO: 88449 - DNA, 37 bp, Artificial Sequence
  Synthetic oligonucleotide
tccgttacggcgattaatggtccttatatgcccccga

SEQ ID NO: 88450 - DNA, 37 bp, Artificial Sequence
  Synthetic oligonucleotide
gacctgctccgaggagcctcgacgctcctttctccga

SEQ ID NO: 88451 - DNA, 37 bp, Artificial Sequence
  Synthetic oligonucleotide
tcacgctgttgtcacccctcctcccagctgagtccga

SEQ ID NO: 88452 - DNA, 37 bp, Artificial Sequence
  Synthetic oligonucleotide
acccatcacaaatcgcatggatcttagactttgtcga

SEQ ID NO: 88453 - DNA, 35 bp, Artificial Sequence
  Synthetic oligonucleotide
gcgaagaagaagggcggaaagtaatgcctggagga

SEQ ID NO: 88454 - DNA, 37 bp, Artificial Sequence
  Synthetic oligonucleotide
acggtgggaggagggaggggaactacgctggagcgga

SEQ ID NO: 88455 - DNA, 37 bp, Artificial Sequence
  Synthetic oligonucleotide
agactccgccaccggacactgagcctacactggcgga

SEQ ID NO: 88456 - DNA, 37 bp, Artificial Sequence
  Synthetic oligonucleotide
ggatcggaacaagggcttgaatgaagggccacaggga

SEQ ID NO: 88457 - DNA, 37 bp, Artificial Sequence
  Synthetic oligonucleotide
gccgtataggagggggcataatgtaacgggagaggga

SEQ ID NO: 88458 - DNA, 37 bp, Artificial Sequence
  Synthetic oligonucleotide
gcttgagacggtatgggaggggaagtggagggcggga

SEQ ID NO: 88459 - DNA, 37 bp, Artificial Sequence
  Synthetic oligonucleotide
gccgatggggggaaggtgcgagcacgaggtgggggga

SEQ ID NO: 88460 - DNA, 37 bp, Artificial Sequence
  Synthetic oligonucleotide
gccgagggagctgtaacagtgaggggggtggtgggga

SEQ ID NO: 88461 - DNA, 37 bp, Artificial Sequence
  Synthetic oligonucleotide
accggagggaaagggaaggtcacggcgtgtgttggga

SEQ ID NO: 88462 - DNA, 36 bp, Artificial Sequence
  Synthetic oligonucleotide
gagtgggaggggtacaaaagaagggtgggttatgga

SEQ ID NO: 88463 - DNA, 37 bp, Artificial Sequence
  Synthetic oligonucleotide
gacgtgtcaccataagggtagggccgtaccaaaatga

SEQ ID NO: 88464 - DNA, 37 bp, Artificial Sequence
  Synthetic oligonucleotide
actgtgtgtgggcgtaaggcagagagagggaaaatga

SEQ ID NO: 88465 - DNA, 38 bp, Artificial Sequence
  Synthetic oligonucleotide
actaggggggaagatcacatcaagagtggggggaatga

SEQ ID NO: 88466 - DNA, 38 bp, Artificial Sequence
  Synthetic oligonucleotide
atggtccgcactgctatatttacctctcgaccacatga

SEQ ID NO: 88467 - DNA, 37 bp, Artificial Sequence
  Synthetic oligonucleotide
gattggtggggaaaggcgaattcagggtaggacatga

SEQ ID NO: 88468 - DNA, 38 bp, Artificial Sequence
  Synthetic oligonucleotide
acgctggggtggaaaacataatgaaggggtgaccatga

SEQ ID NO: 88469 - DNA, 37 bp, Artificial Sequence
  Synthetic oligonucleotide
gcctggcacgccttcttcatcgtaaatacatccatga

SEQ ID NO: 88470 - DNA, 38 bp, Artificial Sequence
  Synthetic oligonucleotide
taatccatgcagtcgtaggtgaacaggggggtgcatga

SEQ ID NO: 88471 - DNA, 38 bp, Artificial Sequence
  Synthetic oligonucleotide
accccatgccccaccttccgatccaggacgctcgatga

SEQ ID NO: 88472 - DNA, 37 bp, Artificial Sequence
  Synthetic oligonucleotide
tctccacacactccccagctattagaacggcctatga

SEQ ID NO: 88473 - DNA, 38 bp, Artificial Sequence
  Synthetic oligonucleotide
gcgactgttgctcgctgcatgcctaccccttgacctga

SEQ ID NO: 88474 - DNA, 37 bp, Artificial Sequence
  Synthetic oligonucleotide
actgacagggaacgtcacaagctatctactatcctga

SEQ ID NO: 88475 - DNA, 38 bp, Artificial Sequence
  Synthetic oligonucleotide
gttgcaaacgcactttgattttagcacatacatgctga

SEQ ID NO: 88476 - DNA, 37 bp, Artificial Sequence
  Synthetic oligonucleotide
tgaacacagggcctcagcgccatgggcaatattctga

SEQ ID NO: 88477 - DNA, 37 bp, Artificial Sequence
  Synthetic oligonucleotide
agttgagggagtggtgtacgtgggtagtaataagtga

SEQ ID NO: 88478 - DNA, 38 bp, Artificial Sequence
  Synthetic oligonucleotide
ttgagagggtaaggcgagttgagagaagtcgttagtga

SEQ ID NO: 88479 - DNA, 37 bp, Artificial Sequence
  Synthetic oligonucleotide
tgcgcgcctgccacactgagcgctaataccaccgtga

SEQ ID NO: 88480 - DNA, 38 bp, Artificial Sequence
  Synthetic oligonucleotide
atcaccaacacaatgggtcatcgtatggaaatgcgtga

SEQ ID NO: 88481 - DNA, 36 bp, Artificial Sequence
  Synthetic oligonucleotide
gccatgggcacgggttatacatgcgtgtcttcgtga

SEQ ID NO: 88482 - DNA, 38 bp, Artificial Sequence
  Synthetic oligonucleotide
ttggagtgctgcggaggggtggaaaggtggggctgtga

SEQ ID NO: 88483 - DNA, 38 bp, Artificial Sequence
  Synthetic oligonucleotide
gccaaccctcaccataacattgtgcgagtccctattga

SEQ ID NO: 88484 - DNA, 38 bp, Artificial Sequence
  Synthetic oligonucleotide
acggaccatgaggggagtacgtgcggttgctatgttga

SEQ ID NO: 88485 - DNA, 38 bp, Artificial Sequence
  Synthetic oligonucleotide
ttgccccgtccaactcgtctgatgcgctctattgttga

SEQ ID NO: 88486 - DNA, 38 bp, Artificial Sequence
  Synthetic oligonucleotide
aacatcagcctgaccggactattcgtgcttttctttga

SEQ ID NO: 88487 - DNA, 38 bp, Artificial Sequence
  Synthetic oligonucleotide
gtacccatctaacagtgttactcgctcctgttttttga

SEQ ID NO: 88488 - DNA, 36 bp, Artificial Sequence
  Synthetic oligonucleotide
gacccgtaaatgccctgcctcaaggagtttccccta

SEQ ID NO: 88489 - DNA, 35 bp, Artificial Sequence
  Synthetic oligonucleotide
tctatcgacaggctgatcctccccctcaccggcta

SEQ ID NO: 88490 - DNA, 36 bp, Artificial Sequence
  Synthetic oligonucleotide
tgcctcccggtagtagttactagtcaccagcctcta

SEQ ID NO: 88491 - DNA, 36 bp, Artificial Sequence
  Synthetic oligonucleotide
gcctagacgctccgcaaccttcacgactcccccgta

SEQ ID NO: 88492 - DNA, 36 bp, Artificial Sequence
  Synthetic oligonucleotide
accaaccccctccggtctgagacatatccctccgta

SEQ ID NO: 88493 - DNA, 35 bp, Artificial Sequence
  Synthetic oligonucleotide
ggtccacacaggttattcggccatctttcggggta

SEQ ID NO: 88494 - DNA, 35 bp, Artificial Sequence
  Synthetic oligonucleotide
tacacctggacccgaagttgaaaaagcccgaatta

SEQ ID NO: 88495 - DNA, 35 bp, Artificial Sequence
  Synthetic oligonucleotide
gcgtaacactcgccgaccgttatttccgctcttta

SEQ ID NO: 88496 - DNA, 36 bp, Artificial Sequence
  Synthetic oligonucleotide
tgctacccagaacctgacttctgccggtttctttta

SEQ ID NO: 88497 - DNA, 35 bp, Artificial Sequence
  Synthetic oligonucleotide
atcacaacgcaactttggacatcccgagggcaaac

SEQ ID NO: 88498 - DNA, 35 bp, Artificial Sequence
  Synthetic oligonucleotide
tcaatgcctgccattcaaatgcacactgctacaac

SEQ ID NO: 88499 - DNA, 35 bp, Artificial Sequence
  Synthetic oligonucleotide
atgtgagagccaccattgctaccaggacagcctac

SEQ ID NO: 88500 - DNA, 35 bp, Artificial Sequence
  Synthetic oligonucleotide
tccgccgacacccagcctgcaccgaaaagccgtac

SEQ ID NO: 88501 - DNA, 35 bp, Artificial Sequence
  Synthetic oligonucleotide
acattatgcctcacgggtcgtttcctcacctgtac

SEQ ID NO: 88502 - DNA, 35 bp, Artificial Sequence
  Synthetic oligonucleotide
ttcagtgcagccccggccatatttcaagcaacgcc

SEQ ID NO: 88503 - DNA, 35 bp, Artificial Sequence
  Synthetic oligonucleotide
gcgccactctgtgctcgttaccacacgcctgtgcc

SEQ ID NO: 88504 - DNA, 35 bp, Artificial Sequence
  Synthetic oligonucleotide
ttccgcacgtcaccagccgatatcaacaagtctcc

SEQ ID NO: 88505 - DNA, 35 bp, Artificial Sequence
  Synthetic oligonucleotide
gcaggatgttccgcccttgacttttgatgctgtcc

SEQ ID NO: 88506 - DNA, 35 bp, Artificial Sequence
  Synthetic oligonucleotide
gcaaaggacacagttctatccctgactgcaaaagc

SEQ ID NO: 88507 - DNA, 35 bp, Artificial Sequence
  Synthetic oligonucleotide
tgctgaacgagtgatccccctcagctttaactatc

SEQ ID NO: 88508 - DNA, 35 bp, Artificial Sequence
  Synthetic oligonucleotide
tcagtccggcactggaagacatatcgttgcggctc

SEQ ID NO: 88509 - DNA, 35 bp, Artificial Sequence
  Synthetic oligonucleotide
acactacgtagtgagtgtcattggaacgggtattc

SEQ ID NO: 88510 - DNA, 35 bp, Artificial Sequence
  Synthetic oligonucleotide
ggacttgcgatcgcccttgatcaagtctacatttc

SEQ ID NO: 88511 - DNA, 35 bp, Artificial Sequence
  Synthetic oligonucleotide
gacgaggggcgttgagtttcgatcccgatgctttc

SEQ ID NO: 88512 - DNA, 35 bp, Artificial Sequence
  Synthetic oligonucleotide
acaacacactcgcagtagcggaacttaccacccag

SEQ ID NO: 88513 - DNA, 35 bp, Artificial Sequence
  Synthetic oligonucleotide
cacgtaccaccgcgggcgccacgtatcacttcacg

SEQ ID NO: 88514 - DNA, 35 bp, Artificial Sequence
  Synthetic oligonucleotide
gccgccccttaccacaccctcgccaattacttacg

SEQ ID NO: 88515 - DNA, 35 bp, Artificial Sequence
  Synthetic oligonucleotide
ttctccccgccggcctggtttctgagctcgtcccg

SEQ ID NO: 88516 - DNA, 35 bp, Artificial Sequence
  Synthetic oligonucleotide
aaaggaccgcacctgactaacccagctcgcatccg

SEQ ID NO: 88517 - DNA, 35 bp, Artificial Sequence
  Synthetic oligonucleotide
gtagccactgcaaggtatagcgtacgtgtcctccg

SEQ ID NO: 88518 - DNA, 35 bp, Artificial Sequence
  Synthetic oligonucleotide
tcctcgatcccattcgtactagcgtgcccatcgcg

SEQ ID NO: 88519 - DNA, 35 bp, Artificial Sequence
  Synthetic oligonucleotide
gacagataggacgtttcggaagggggaggccgtcg

SEQ ID NO: 88520 - DNA, 35 bp, Artificial Sequence
  Synthetic oligonucleotide
ttagttgaaaagggggtggacgggggggtaggagg

SEQ ID NO: 88521 - DNA, 35 bp, Artificial Sequence
  Synthetic oligonucleotide
agcatgccccgtccctccaaatcctcagtcagcgg

SEQ ID NO: 88522 - DNA, 35 bp, Artificial Sequence
  Synthetic oligonucleotide
ttggacgcggtcaactcgtttctttcatgtttggg

SEQ ID NO: 88523 - DNA, 35 bp, Artificial Sequence
  Synthetic oligonucleotide
atatggggcgggagggtgtcagggagctacgcctg

SEQ ID NO: 88524 - DNA, 35 bp, Artificial Sequence
  Synthetic oligonucleotide
gctaatgcacgtcggaacgggtggtgtgtggcgtg

SEQ ID NO: 88525 - DNA, 35 bp, Artificial Sequence
  Synthetic oligonucleotide
gtagacgagatacgcgtctagacatgagggggttg

SEQ ID NO: 88526 - DNA, 35 bp, Artificial Sequence
  Synthetic oligonucleotide
gcacgaggtagagtagggggcgagattgtgggttg

SEQ ID NO: 88527 - DNA, 35 bp, Artificial Sequence
  Synthetic oligonucleotide
gactctccagtaatgccatccgaaaccccatgaat

SEQ ID NO: 88528 - DNA, 35 bp, Artificial Sequence
  Synthetic oligonucleotide
acgaacacccatctgtttgattatgattccagcat

SEQ ID NO: 88529 - DNA, 35 bp, Artificial Sequence
  Synthetic oligonucleotide
gtgctaccggaactgtgctctctatctgttacact

SEQ ID NO: 88530 - DNA, 35 bp, Artificial Sequence
  Synthetic oligonucleotide
ttaacctgtgctgcctggaattccccctcgagact

SEQ ID NO: 88531 - DNA, 35 bp, Artificial Sequence
  Synthetic oligonucleotide
agatccgctccttgcatggaccccattttattcct

SEQ ID NO: 88532 - DNA, 35 bp, Artificial Sequence
  Synthetic oligonucleotide
tgcgcgcccctttattctggtcagctcctccagct

SEQ ID NO: 88533 - DNA, 35 bp, Artificial Sequence
  Synthetic oligonucleotide
gaccacgcaacttgcatatatgtaagccttacgct

SEQ ID NO: 88534 - DNA, 35 bp, Artificial Sequence
  Synthetic oligonucleotide
tacgcctatcgtatcaccccgccctggtgctggct

SEQ ID NO: 88535 - DNA, 35 bp, Artificial Sequence
  Synthetic oligonucleotide
aacgaccgcatacgccttttcaggacttttattct

SEQ ID NO: 88536 - DNA, 35 bp, Artificial Sequence
  Synthetic oligonucleotide
gccataactgcctgtcacattgcttgcggccttct

SEQ ID NO: 88537 - DNA, 35 bp, Artificial Sequence
  Synthetic oligonucleotide
attggccacatctgggcaggcttttacttacgggt

SEQ ID NO: 88538 - DNA, 35 bp, Artificial Sequence
  Synthetic oligonucleotide
tccgcccctgcctatggttcggtcatctccccatt

SEQ ID NO: 88539 - DNA, 35 bp, Artificial Sequence
  Synthetic oligonucleotide
gaagacaaactccgccttgggcctaatgggctatt

SEQ ID NO: 88540 - DNA, 35 bp, Artificial Sequence
  Synthetic oligonucleotide
gtacggggcgaagacaatggaaggggatgtaactt

SEQ ID NO: 88541 - DNA, 35 bp, Artificial Sequence
  Synthetic oligonucleotide
tcctccacgaatgcacgttgtgcagtctgaaattt

SEQ ID NO: 88542 - DNA, 35 bp, Artificial Sequence
  Synthetic oligonucleotide
taggtgccgccagggtggggaaggcataaggaaaa

SEQ ID NO: 88543 - DNA, 36 bp, Artificial Sequence
  Synthetic oligonucleotide
atcagcatagcctgggaatgggtggatatctgaaaa

SEQ ID NO: 88544 - DNA, 36 bp, Artificial Sequence
  Synthetic oligonucleotide
atagcccccactttgttgagttatccctgtcacaaa

SEQ ID NO: 88545 - DNA, 36 bp, Artificial Sequence
  Synthetic oligonucleotide
ttcagcggcgcccctctcatccaatgcctgtggaaa

SEQ ID NO: 88546 - DNA, 36 bp, Artificial Sequence
  Synthetic oligonucleotide
agacccgacgccaccacatgccagtcctccgtagaa

SEQ ID NO: 88547 - DNA, 36 bp, Artificial Sequence
  Synthetic oligonucleotide
tctgttcagtggaggggggaagggagcgtgtgggaa

SEQ ID NO: 88548 - DNA, 36 bp, Artificial Sequence
  Synthetic oligonucleotide
aagaggggaccggacaaggcaacaaggggggtggaa

SEQ ID NO: 88549 - DNA, 36 bp, Artificial Sequence
  Synthetic oligonucleotide
atgcgcatactgggggtggaggatgcatggtatgaa

SEQ ID NO: 88550 - DNA, 36 bp, Artificial Sequence
  Synthetic oligonucleotide
gagtccacgaatagcagtggacaattggatcctgaa

SEQ ID NO: 88551 - DNA, 36 bp, Artificial Sequence
  Synthetic oligonucleotide
aatggatccgccacctcgtgccttagaaatacgtaa

SEQ ID NO: 88552 - DNA, 35 bp, Artificial Sequence
  Synthetic oligonucleotide
gggaatgccacacgcacaccagggaaacagaaaca

SEQ ID NO: 88553 - DNA, 36 bp, Artificial Sequence
  Synthetic oligonucleotide
aatcgcggagcaatgtaaactcgggcccaagcaaca

SEQ ID NO: 88554 - DNA, 35 bp, Artificial Sequence
  Synthetic oligonucleotide
tccatgtgcctgcttttcgccgatacttatgcaca

SEQ ID NO: 88555 - DNA, 36 bp, Artificial Sequence
  Synthetic oligonucleotide
tccagccggactttgcacgttttacccatcgagaca

SEQ ID NO: 88556 - DNA, 36 bp, Artificial Sequence
  Synthetic oligonucleotide
gtttagccaagatgttctcgcattaccgccactaca

SEQ ID NO: 88557 - DNA, 35 bp, Artificial Sequence
  Synthetic oligonucleotide
ttaaaccgggtctgcatagtacttcaccatcacca

SEQ ID NO: 88558 - DNA, 36 bp, Artificial Sequence
  Synthetic oligonucleotide
atagtcaaacgccgctatgatggtctgtttctccca

SEQ ID NO: 88559 - DNA, 35 bp, Artificial Sequence
  Synthetic oligonucleotide
tgtgagtcctggcctcggataccgcttagttccca

SEQ ID NO: 88560 - DNA, 36 bp, Artificial Sequence
  Synthetic oligonucleotide
tgcgaggtcgcctatttggttctattccgtttccca

SEQ ID NO: 88561 - DNA, 35 bp, Artificial Sequence
  Synthetic oligonucleotide
gttaggcgccgacccgactggactagaaccatcca

SEQ ID NO: 88562 - DNA, 35 bp, Artificial Sequence
  Synthetic oligonucleotide
gaactgacgctcatgtaggccaatgtccagctcca

SEQ ID NO: 88563 - DNA, 36 bp, Artificial Sequence
  Synthetic oligonucleotide
tccttgctcccccggtatttaaacgcttctacagca

SEQ ID NO: 88564 - DNA, 36 bp, Artificial Sequence
  Synthetic oligonucleotide
tatgccaggcttcaccatgccctgatgaccgctgca

SEQ ID NO: 88565 - DNA, 36 bp, Artificial Sequence
  Synthetic oligonucleotide
tgaccaggaccaattccatcttcagtaagtgcctca

SEQ ID NO: 88566 - DNA, 36 bp, Artificial Sequence
  Synthetic oligonucleotide
ttcgacgcatcagcggttacccttctcggcttttca

SEQ ID NO: 88567 - DNA, 37 bp, Artificial Sequence
  Synthetic oligonucleotide
atataccgcaaaggtgagaaaggggcaattgcgaaga

SEQ ID NO: 88568 - DNA, 37 bp, Artificial Sequence
  Synthetic oligonucleotide
gctgagggaggaggcggaatttgagcgtgggcacaga

SEQ ID NO: 88569 - DNA, 37 bp, Artificial Sequence
  Synthetic oligonucleotide
tccacccatgatgctctccggggaacaactttacaga

SEQ ID NO: 88570 - DNA, 37 bp, Artificial Sequence
  Synthetic oligonucleotide
gacactgaataggctggtggtgggctccagcatgaga

SEQ ID NO: 88571 - DNA, 37 bp, Artificial Sequence
  Synthetic oligonucleotide
gacatgtccactgcatttctgacctatggctcctaga

SEQ ID NO: 88572 - DNA, 37 bp, Artificial Sequence
  Synthetic oligonucleotide
ttgacaaatgggccacatgcgttattagtaggctaga

SEQ ID NO: 88573 - DNA, 37 bp, Artificial Sequence
  Synthetic oligonucleotide
atgcacggtcgacatttcctgtatcgccctttttaga

SEQ ID NO: 88574 - DNA, 37 bp, Artificial Sequence
  Synthetic oligonucleotide
tcacaacgctaacctttgcacggagtacgtaatacga

SEQ ID NO: 88575 - DNA, 37 bp, Artificial Sequence
  Synthetic oligonucleotide
atctcacgcccttggattcttagcattatctttccga

SEQ ID NO: 88576 - DNA, 37 bp, Artificial Sequence
  Synthetic oligonucleotide
attcgtcaccgttactatattctttgctggcccgcga

SEQ ID NO: 88577 - DNA, 37 bp, Artificial Sequence
  Synthetic oligonucleotide
ttgcgcagtgcctccgatcaccacctgcaatatgcga

SEQ ID NO: 88578 - DNA, 37 bp, Artificial Sequence
  Synthetic oligonucleotide
tagaggggaaaggtagctggaagggagaccagtgcga

SEQ ID NO: 88579 - DNA, 37 bp, Artificial Sequence
  Synthetic oligonucleotide
ttgaacgcacacatagatgcagggacatgtggatcga

SEQ ID NO: 88580 - DNA, 37 bp, Artificial Sequence
  Synthetic oligonucleotide
tacgaatcaccaccatgcgagccaatggaaatctcga

SEQ ID NO: 88581 - DNA, 35 bp, Artificial Sequence
  Synthetic oligonucleotide
atgcgacgacagccacacctcggcccggccttcga

SEQ ID NO: 88582 - DNA, 37 bp, Artificial Sequence
  Synthetic oligonucleotide
ttccccgccatgacgctaagcctgctgcatctttcga

SEQ ID NO: 88583 - DNA, 37 bp, Artificial Sequence
  Synthetic oligonucleotide
tcacactgctgtatactcgaccgcccacaagtttcga

SEQ ID NO: 88584 - DNA, 37 bp, Artificial Sequence
  Synthetic oligonucleotide
acgcaaccgaatgcggttattgtgtccatctccagga

SEQ ID NO: 88585 - DNA, 37 bp, Artificial Sequence
  Synthetic oligonucleotide
gacagggcggtggtttggctctagggggcgcttagga

SEQ ID NO: 88586 - DNA, 37 bp, Artificial Sequence
  Synthetic oligonucleotide
gcgacaagcacattacttttcgcagtactcccccgga

SEQ ID NO: 88587 - DNA, 37 bp, Artificial Sequence
  Synthetic oligonucleotide
gggtggtggtgggggcgatttagttcgggtggccgga

SEQ ID NO: 88588 - DNA, 35 bp, Artificial Sequence
  Synthetic oligonucleotide
acgccccccccgctgatctggaggtcccgtccgga

SEQ ID NO: 88589 - DNA, 37 bp, Artificial Sequence
  Synthetic oligonucleotide
tcacactcaatgaacatcgatctcaggccgaaaggga

SEQ ID NO: 88590 - DNA, 35 bp, Artificial Sequence
  Synthetic oligonucleotide
agacggacacacggggctttgaacatgtgagggga

SEQ ID NO: 88591 - DNA, 37 bp, Artificial Sequence
  Synthetic oligonucleotide
gttgcggtggtggccattcgttggttgcgcgggggga

SEQ ID NO: 88592 - DNA, 36 bp, Artificial Sequence
  Synthetic oligonucleotide
accgctcgggcacaaacaggatgagaggtagtggga

SEQ ID NO: 88593 - DNA, 37 bp, Artificial Sequence
  Synthetic oligonucleotide
gtccacgccagacggttacctacacgccgcatttgga

SEQ ID NO: 88594 - DNA, 37 bp, Artificial Sequence
  Synthetic oligonucleotide
aatgaccgatggctgggcgcacaagggggcaaaatga

SEQ ID NO: 88595 - DNA, 38 bp, Artificial Sequence
  Synthetic oligonucleotide
taggagaagggggcataaagtgagcgaacagcatatga

SEQ ID NO: 88596 - DNA, 37 bp, Artificial Sequence
  Synthetic oligonucleotide
acctcctggctcatgcgcatttttccgtccactatga

SEQ ID NO: 88597 - DNA, 38 bp, Artificial Sequence
  Synthetic oligonucleotide
acctcagccacccgctgatagcccacagcaaatactga

SEQ ID NO: 88598 - DNA, 38 bp, Artificial Sequence
  Synthetic oligonucleotide
tagcccagccctcgcactgtacatgccttccgacctga

SEQ ID NO: 88599 - DNA, 37 bp, Artificial Sequence
  Synthetic oligonucleotide
tttcgctgacgaccacattcctcaccatttgacctga

SEQ ID NO: 88600 - DNA, 38 bp, Artificial Sequence
  Synthetic oligonucleotide
taaggaccgggcctcgatttctgtcaattgctccctga

SEQ ID NO: 88601 - DNA, 38 bp, Artificial Sequence
  Synthetic oligonucleotide
agccaagcccatctcgggggtacactgcacatgcctga

SEQ ID NO: 88602 - DNA, 37 bp, Artificial Sequence
  Synthetic oligonucleotide
aatcaccgtgatggatcccccgccgctcgttgcctga

SEQ ID NO: 88603 - DNA, 38 bp, Artificial Sequence
  Synthetic oligonucleotide
gagacggatgggagttattgcgggagatacacggctga

SEQ ID NO: 88604 - DNA, 38 bp, Artificial Sequence
  Synthetic oligonucleotide
agagctcgggtcaggtctatctctattttcctctctga

SEQ ID NO: 88605 - DNA, 38 bp, Artificial Sequence
  Synthetic oligonucleotide
tgcctcaatcggcctctattctgggttaccttcagtga

SEQ ID NO: 88606 - DNA, 38 bp, Artificial Sequence
  Synthetic oligonucleotide
taggaggaggccttggcaaaaaaggtcggctggagtga

SEQ ID NO: 88607 - DNA, 38 bp, Artificial Sequence
  Synthetic oligonucleotide
gtgcgcatatgtagagaagggggctgcaataatagtga

SEQ ID NO: 88608 - DNA, 38 bp, Artificial Sequence
  Synthetic oligonucleotide
tttgcgacgggagattggaaggagatgggataacgtga

SEQ ID NO: 88609 - DNA, 38 bp, Artificial Sequence
  Synthetic oligonucleotide
gcctcgaacatgcaatgccccccggtgtaaacacgtga

SEQ ID NO: 88610 - DNA, 38 bp, Artificial Sequence
  Synthetic oligonucleotide
gatgcaaacggacaaggggggatatacaccgtgcgtga

SEQ ID NO: 88611 - DNA, 37 bp, Artificial Sequence
  Synthetic oligonucleotide
gttggtaaggggctgagatgggcaggactgtgggtga

SEQ ID NO: 88612 - DNA, 38 bp, Artificial Sequence
  Synthetic oligonucleotide
gaagagtgtgagcgtagggtcgaggtttcttatggtga

SEQ ID NO: 88613 - DNA, 37 bp, Artificial Sequence
  Synthetic oligonucleotide
gaccatggttgagggtattatatttggcagaatgtga

SEQ ID NO: 88614 - DNA, 38 bp, Artificial Sequence
  Synthetic oligonucleotide
tatcaccgcagcagttatcgaagagacgttctatgtga

SEQ ID NO: 88615 - DNA, 38 bp, Artificial Sequence
  Synthetic oligonucleotide
taccctaaccaccgcagctgtcgccatatctgcattga

SEQ ID NO: 88616 - DNA, 38 bp, Artificial Sequence
  Synthetic oligonucleotide
gagtcgccctcaaacttaaagcgctggcccccacttga

SEQ ID NO: 88617 - DNA, 37 bp, Artificial Sequence
  Synthetic oligonucleotide
ttttgcccccatggttctggtgactatcaaaccttga

SEQ ID NO: 88618 - DNA, 38 bp, Artificial Sequence
  Synthetic oligonucleotide
acatcacgatccgacaacgaaaccgcagtctgccttga

SEQ ID NO: 88619 - DNA, 38 bp, Artificial Sequence
  Synthetic oligonucleotide
gagacaccacggagagcggtacgcggaggaacgcttga

SEQ ID NO: 88620 - DNA, 38 bp, Artificial Sequence
  Synthetic oligonucleotide
acatctaaccctccgacgttcagtgaccgaatctttga

SEQ ID NO: 88621 - DNA, 37 bp, Artificial Sequence
  Synthetic oligonucleotide
tccgatcacaccgccctaccacaggcataatttttga

SEQ ID NO: 88622 - DNA, 36 bp, Artificial Sequence
  Synthetic oligonucleotide
aaaccgcgccattgatagctccctgttccttgaata

SEQ ID NO: 88623 - DNA, 35 bp, Artificial Sequence
  Synthetic oligonucleotide
gtccctccatggcgatcgatgatcgtcattacata

SEQ ID NO: 88624 - DNA, 36 bp, Artificial Sequence
  Synthetic oligonucleotide
tccgggcctgactttgcgctgggccgtgttctccta

SEQ ID NO: 88625 - DNA, 35 bp, Artificial Sequence
  Synthetic oligonucleotide
tgccactcgcctcgaattgaacgaaggtttcgcta

SEQ ID NO: 88626 - DNA, 35 bp, Artificial Sequence
  Synthetic oligonucleotide
gttacacgccagctctccataaataggtcttgcta

SEQ ID NO: 88627 - DNA, 36 bp, Artificial Sequence
  Synthetic oligonucleotide
gcatccaccccaaccgaggccaatgtcttttaagta

SEQ ID NO: 88628 - DNA, 35 bp, Artificial Sequence
  Synthetic oligonucleotide
agagcggaaacgcctctcacacatgcatgtaatta

SEQ ID NO: 88629 - DNA, 36 bp, Artificial Sequence
  Synthetic oligonucleotide
gactcgcatgacaatcttccctatgtttcagcctta

SEQ ID NO: 88630 - DNA, 35 bp, Artificial Sequence
  Synthetic oligonucleotide
gtctacgcccgcacgttctttgctgcccaatctta

SEQ ID NO: 88631 - DNA, 36 bp, Artificial Sequence
  Synthetic oligonucleotide
gacatccatacaagaattgtattaattgatacgtta

SEQ ID NO: 88632 - DNA, 35 bp, Artificial Sequence
  Synthetic oligonucleotide
tgacactcccattgtgctccgcgtttctcgggtta

SEQ ID NO: 88633 - DNA, 36 bp, Artificial Sequence
  Synthetic oligonucleotide
actgcggtgccccatctcttttatatgttgaattta

SEQ ID NO: 88634 - DNA, 36 bp, Artificial Sequence
  Synthetic oligonucleotide
gcgcctgctccacctccatcgtgatcgtggccttta

SEQ ID NO: 88635 - DNA, 35 bp, Artificial Sequence
  Synthetic oligonucleotide
tactgtcccgccgtggtaggtctacaccgtcttta

SEQ ID NO: 88636 - DNA, 35 bp, Artificial Sequence
  Synthetic oligonucleotide
gtgccacggggaccttttttttgacagaatatcac

SEQ ID NO: 88637 - DNA, 35 bp, Artificial Sequence
  Synthetic oligonucleotide
ttccgcgccgtatcacccatagtattgtccgcgac

SEQ ID NO: 88638 - DNA, 35 bp, Artificial Sequence
  Synthetic oligonucleotide
tatgaggtagctccctgttgattacaccgctcacc

SEQ ID NO: 88639 - DNA, 35 bp, Artificial Sequence
  Synthetic oligonucleotide
tccatcccacgctctcgtgcatgcctaaggtaccc

SEQ ID NO: 88640 - DNA, 35 bp, Artificial Sequence
  Synthetic oligonucleotide
gagtcgcactacgacatcttacgacggctactccc

SEQ ID NO: 88641 - DNA, 35 bp, Artificial Sequence
  Synthetic oligonucleotide
tttggtctacagcaattgtacatcgccgccccgcc

SEQ ID NO: 88642 - DNA, 35 bp, Artificial Sequence
  Synthetic oligonucleotide
gcctgtgaagacatattacgttcgcattccctgcc

SEQ ID NO: 88643 - DNA, 35 bp, Artificial Sequence
  Synthetic oligonucleotide
aagtcgcgtagtcgatcctttgtctgccctgtgcc

SEQ ID NO: 88644 - DNA, 35 bp, Artificial Sequence
  Synthetic oligonucleotide
ttactgccaccatattcattatgatccgggcatcc

SEQ ID NO: 88645 - DNA, 35 bp, Artificial Sequence
  Synthetic oligonucleotide
gtgtacgagcatcctatgactatcacaaccgatcc

SEQ ID NO: 88646 - DNA, 35 bp, Artificial Sequence
  Synthetic oligonucleotide
agacacccttcgcgtgtctgatacccgatatatcc

SEQ ID NO: 88647 - DNA, 35 bp, Artificial Sequence
  Synthetic oligonucleotide
aaccatggcctggtggtcagcacccgccttctcgc

SEQ ID NO: 88648 - DNA, 35 bp, Artificial Sequence
  Synthetic oligonucleotide
atactagccgcgcaatatttcccggcgtaacctgc

SEQ ID NO: 88649 - DNA, 35 bp, Artificial Sequence
  Synthetic oligonucleotide
gactcttccgccctaacacagtcttgttttcctgc

SEQ ID NO: 88650 - DNA, 35 bp, Artificial Sequence
  Synthetic oligonucleotide
gctgagcagacaggggggtaaagtatgtaatttgc

SEQ ID NO: 88651 - DNA, 35 bp, Artificial Sequence
  Synthetic oligonucleotide
tgccctccctcccaggtttttaacatcaggccatc

SEQ ID NO: 88652 - DNA, 35 bp, Artificial Sequence
  Synthetic oligonucleotide
tcccaaccccactcagttataaacggtttttcatc

SEQ ID NO: 88653 - DNA, 35 bp, Artificial Sequence
  Synthetic oligonucleotide
tcagttgcctaatccgttgttagtccaataacctc

SEQ ID NO: 88654 - DNA, 35 bp, Artificial Sequence
  Synthetic oligonucleotide
gaacacacgatgactcgtcccggccgaaacgcctc

SEQ ID NO: 88655 - DNA, 35 bp, Artificial Sequence
  Synthetic oligonucleotide
tcgagcttggtctggtcaaccgtcctggcttcctc

SEQ ID NO: 88656 - DNA, 35 bp, Artificial Sequence
  Synthetic oligonucleotide
gtcaccatgcacaatttaccgcctatggcccgttc

SEQ ID NO: 88657 - DNA, 35 bp, Artificial Sequence
  Synthetic oligonucleotide
atgccggcccatggctaattctgtcttcatgtaag

SEQ ID NO: 88658 - DNA, 32 bp, Artificial Sequence
  Synthetic oligonucleotide
agacccgctcgatccgctccatctattcgcag

SEQ ID NO: 88659 - DNA, 35 bp, Artificial Sequence
  Synthetic oligonucleotide
attgcctgcctttccgttctgcctctttcgcctag

SEQ ID NO: 88660 - DNA, 35 bp, Artificial Sequence
  Synthetic oligonucleotide
gtccaagccagtcatacacatttcgtcttgccacg

SEQ ID NO: 88661 - DNA, 35 bp, Artificial Sequence
  Synthetic oligonucleotide
atcgcccgacaaccacactgatacgccaatcaccg

SEQ ID NO: 88662 - DNA, 35 bp, Artificial Sequence
  Synthetic oligonucleotide
accccgcaacgaccaattgcctcgcctatcacccg

SEQ ID NO: 88663 - DNA, 35 bp, Artificial Sequence
  Synthetic oligonucleotide
atcacacactcacaccctgctatcgatgctgcccg

SEQ ID NO: 88664 - DNA, 35 bp, Artificial Sequence
  Synthetic oligonucleotide
tttgccaacccaaactcctataatagaaccctccg

SEQ ID NO: 88665 - DNA, 35 bp, Artificial Sequence
  Synthetic oligonucleotide
gacggaatagtcgggggtgggggtgttgggtgagg

SEQ ID NO: 88666 - DNA, 35 bp, Artificial Sequence
  Synthetic oligonucleotide
gcttggcccgtgttgcaatctcattactttccctg

SEQ ID NO: 88667 - DNA, 35 bp, Artificial Sequence
  Synthetic oligonucleotide
agatcttgcccacccagacgcccacacgacgagtg

SEQ ID NO: 88668 - DNA, 35 bp, Artificial Sequence
  Synthetic oligonucleotide
gctgacgacgccctgtggaacccccgctcatattg

SEQ ID NO: 88669 - DNA, 35 bp, Artificial Sequence
  Synthetic oligonucleotide
acagtcgggggaggtagccctggagggaattcaat

SEQ ID NO: 88670 - DNA, 34 bp, Artificial Sequence
  Synthetic oligonucleotide
tgataccctcaatctcccgtgattcttcaaccat

SEQ ID NO: 88671 - DNA, 36 bp, Artificial Sequence
  Synthetic oligonucleotide
tccaagggacacgcgagtaggccgagttcacaccat

SEQ ID NO: 88672 - DNA, 35 bp, Artificial Sequence
  Synthetic oligonucleotide
accaccatgactaactggtggtgaaatctttccat

SEQ ID NO: 88673 - DNA, 35 bp, Artificial Sequence
  Synthetic oligonucleotide
gctcacgagcctctcaagtttcagtatcctgctat

SEQ ID NO: 88674 - DNA, 35 bp, Artificial Sequence
  Synthetic oligonucleotide
gcctcagcctatatgtaccacacatgttttgcact

SEQ ID NO: 88675 - DNA, 35 bp, Artificial Sequence
  Synthetic oligonucleotide
gccacccttcgatctggcccctaacgctttatact

SEQ ID NO: 88676 - DNA, 35 bp, Artificial Sequence
  Synthetic oligonucleotide
accccatcgcacttcgcgtaccctagcttttacct

SEQ ID NO: 88677 - DNA, 35 bp, Artificial Sequence
  Synthetic oligonucleotide
atgcaaagcatcctttttaccgattctgagcttct

SEQ ID NO: 88678 - DNA, 35 bp, Artificial Sequence
  Synthetic oligonucleotide
gcagtgcgcaccctggtcctttatctgtctcacgt

SEQ ID NO: 88679 - DNA, 35 bp, Artificial Sequence
  Synthetic oligonucleotide
acaaacgagccacggtgcgaatcagatcccgccgt

SEQ ID NO: 88680 - DNA, 35 bp, Artificial Sequence
  Synthetic oligonucleotide
gccggtcgcaagccaggtggtttttgttttccggt

SEQ ID NO: 88681 - DNA, 35 bp, Artificial Sequence
  Synthetic oligonucleotide
tcacatcctccttcccttgtgtcgttactccctgt

SEQ ID NO: 88682 - DNA, 35 bp, Artificial Sequence
  Synthetic oligonucleotide
ttgtcactcaccattacgattaagccaccttcatt

SEQ ID NO: 88683 - DNA, 35 bp, Artificial Sequence
  Synthetic oligonucleotide
ctgcatcagacgctacagtttgaagctctcgtttt

SEQ ID NO: 88684 - DNA, 35 bp, Artificial Sequence
  Synthetic oligonucleotide
tcccacttaccatggataaatctactgtgagaaaa

SEQ ID NO: 88685 - DNA, 36 bp, Artificial Sequence
  Synthetic oligonucleotide
ggatctgagggaagggtgcgggcagaacatcgaaaa

SEQ ID NO: 88686 - DNA, 35 bp, Artificial Sequence
  Synthetic oligonucleotide
gcatatgccactatggctatttatcttcgtacaaa

SEQ ID NO: 88687 - DNA, 36 bp, Artificial Sequence
  Synthetic oligonucleotide
tacccacggctgtacgtactcgtcgctggttgccaa

SEQ ID NO: 88688 - DNA, 36 bp, Artificial Sequence
  Synthetic oligonucleotide
atgaggtcacacgtggaactaattatgcttctccaa

SEQ ID NO: 88689 - DNA, 36 bp, Artificial Sequence
  Synthetic oligonucleotide
gcctggcccccttcaccgtgcctttttgcagggcaa

SEQ ID NO: 88690 - DNA, 35 bp, Artificial Sequence
  Synthetic oligonucleotide
gactcccttcgtccgtcaaaatctctgttcatcaa

SEQ ID NO: 88691 - DNA, 36 bp, Artificial Sequence
  Synthetic oligonucleotide
attggacacgtcattgccttcaccagcatgaccgaa

SEQ ID NO: 88692 - DNA, 36 bp, Artificial Sequence
  Synthetic oligonucleotide
gtgacccagcgcgacatcggagcgagtcttcccgaa

SEQ ID NO: 88693 - DNA, 35 bp, Artificial Sequence
  Synthetic oligonucleotide
actgtagctagatcgcccatcgtctaaaccacaca

SEQ ID NO: 88694 - DNA, 36 bp, Artificial Sequence
  Synthetic oligonucleotide
tacagacgtggcccgctatacccgatcaatgagaca

SEQ ID NO: 88695 - DNA, 36 bp, Artificial Sequence
  Synthetic oligonucleotide
acacgccccacaaatttgttacgttatgtccggaca

SEQ ID NO: 88696 - DNA, 36 bp, Artificial Sequence
  Synthetic oligonucleotide
taggtcagccgtcttgcaaactcttgcctgctccca

SEQ ID NO: 88697 - DNA, 36 bp, Artificial Sequence
  Synthetic oligonucleotide
gtcgcgatcggttcgtgttctccggcccccgtccca

SEQ ID NO: 88698 - DNA, 36 bp, Artificial Sequence
  Synthetic oligonucleotide
tctagcaactcatacagtgcctgctggtcatctcca

SEQ ID NO: 88699 - DNA, 36 bp, Artificial Sequence
  Synthetic oligonucleotide
gccgacccaccttccgcatgcgcatgccctcgtcca

SEQ ID NO: 88700 - DNA, 36 bp, Artificial Sequence
  Synthetic oligonucleotide
tgcctgtacattggtgttagccttccttcgtgtcca

SEQ ID NO: 88701 - DNA, 36 bp, Artificial Sequence
  Synthetic oligonucleotide
atgcccccgaccagcctttctatccagcttggagca

SEQ ID NO: 88702 - DNA, 35 bp, Artificial Sequence
  Synthetic oligonucleotide
gatgctactcccatcacaatttgcctttgcacgca

SEQ ID NO: 88703 - DNA, 36 bp, Artificial Sequence
  Synthetic oligonucleotide
aactgagtgcactggatgggaaatgggcgtcaggca

SEQ ID NO: 88704 - DNA, 36 bp, Artificial Sequence
  Synthetic oligonucleotide
gcagggtacgggtgaaggcggggttcaagtttggca

SEQ ID NO: 88705 - DNA, 36 bp, Artificial Sequence
  Synthetic oligonucleotide
tgacgaacggagcagcctggtttgggggggatatca

SEQ ID NO: 88706 - DNA, 36 bp, Artificial Sequence
  Synthetic oligonucleotide
gacagcatcactcgtactgcgctgaccccaaactca

SEQ ID NO: 88707 - DNA, 36 bp, Artificial Sequence
  Synthetic oligonucleotide
gttactgccactccgtattttgtctccttggtctca

SEQ ID NO: 88708 - DNA, 35 bp, Artificial Sequence
  Synthetic oligonucleotide
gcatccgttaaatattgccactcccccgttggtca

SEQ ID NO: 88709 - DNA, 36 bp, Artificial Sequence
  Synthetic oligonucleotide
acgcctagttaagcgctaagcccaccgatcccttca

SEQ ID NO: 88710 - DNA, 35 bp, Artificial Sequence
  Synthetic oligonucleotide
gacatactcctacatcgtggctcattacgggttca

SEQ ID NO: 88711 - DNA, 37 bp, Artificial Sequence
  Synthetic oligonucleotide
tcagggggtcgataaggagggctacgggaccacgaga

SEQ ID NO: 88712 - DNA, 36 bp, Artificial Sequence
  Synthetic oligonucleotide
gttcaccgattagaccactgttctgcctcatttaga

SEQ ID NO: 88713 - DNA, 37 bp, Artificial Sequence
  Synthetic oligonucleotide
aagacctgcaacacccctatggcctgaatcttttaga

SEQ ID NO: 88714 - DNA, 37 bp, Artificial Sequence
  Synthetic oligonucleotide
gttgcgacctcaccacagtacccggaaaacacgccga

SEQ ID NO: 88715 - DNA, 37 bp, Artificial Sequence
  Synthetic oligonucleotide
gcgaactcacctcctaagccgttacagcgctcgccga

SEQ ID NO: 88716 - DNA, 35 bp, Artificial Sequence
  Synthetic oligonucleotide
tacacgcctggatcgcgtttctcgttgcactccga

SEQ ID NO: 88717 - DNA, 37 bp, Artificial Sequence
  Synthetic oligonucleotide
gacatgctcaccaggtggctccgcacgaattttccga

SEQ ID NO: 88718 - DNA, 37 bp, Artificial Sequence
  Synthetic oligonucleotide
gccagtctccgtttttatgggccttctgcctctgcga

SEQ ID NO: 88719 - DNA, 37 bp, Artificial Sequence
  Synthetic oligonucleotide
cacacgctcccggcatcctggggttacgttctatcga

SEQ ID NO: 88720 - DNA, 35 bp, Artificial Sequence
  Synthetic oligonucleotide
gtgtcaccatcccgtcgttatagatcgcccctcga

SEQ ID NO: 88721 - DNA, 37 bp, Artificial Sequence
  Synthetic oligonucleotide
tcacctccggatttcgtccgcccataacagttctcga

SEQ ID NO: 88722 - DNA, 37 bp, Artificial Sequence
  Synthetic oligonucleotide
tgaggaacaggaggattattggtttgatagcagagga

SEQ ID NO: 88723 - DNA, 37 bp, Artificial Sequence
  Synthetic oligonucleotide
cacatcccatcgcaaggcgttccgccaggactccgga

SEQ ID NO: 88724 - DNA, 36 bp, Artificial Sequence
  Synthetic oligonucleotide
atgcctagggggggagtggggctagttgtgcaggga

SEQ ID NO: 88725 - DNA, 37 bp, Artificial Sequence
  Synthetic oligonucleotide
aatgtagctgacgaagggggagggcaccactccggga

SEQ ID NO: 88726 - DNA, 36 bp, Artificial Sequence
  Synthetic oligonucleotide
acaccgcagaatggctagttgactattgtgggggga

SEQ ID NO: 88727 - DNA, 36 bp, Artificial Sequence
  Synthetic oligonucleotide
ggggagcctgaaaaggctattggaagtaaatgggga

SEQ ID NO: 88728 - DNA, 37 bp, Artificial Sequence
  Synthetic oligonucleotide
agtgggtgcacacttagtgtctttgcatttcctggga

SEQ ID NO: 88729 - DNA, 37 bp, Artificial Sequence
  Synthetic oligonucleotide
atctcccacgtcattccgatcttagcatcctctggga

SEQ ID NO: 88730 - DNA, 37 bp, Artificial Sequence
  Synthetic oligonucleotide
tgaacgatgtcggctcatggcgggaaggaaaggtgga

SEQ ID NO: 88731 - DNA, 38 bp, Artificial Sequence
  Synthetic oligonucleotide
actgcacgcgctgtttcactctacaacctatgccatga

SEQ ID NO: 88732 - DNA, 36 bp, Artificial Sequence
  Synthetic oligonucleotide
tcactcctgccaaagaccttaactacgcattcatga

SEQ ID NO: 88733 - DNA, 37 bp, Artificial Sequence
  Synthetic oligonucleotide
tccatgacgtcctgagcttgttgcctgtttccgatga

SEQ ID NO: 88734 - DNA, 37 bp, Artificial Sequence
  Synthetic oligonucleotide
acagtcaaggggaaaaattagagtgggagggcgatga

SEQ ID NO: 88735 - DNA, 37 bp, Artificial Sequence
  Synthetic oligonucleotide
gatgacggacgtatccttaggcgtttaatctctatga

SEQ ID NO: 88736 - DNA, 38 bp, Artificial Sequence
  Synthetic oligonucleotide
gaagcacaggttgcttttctgccatgctcccatactga

SEQ ID NO: 88737 - DNA, 38 bp, Artificial Sequence
  Synthetic oligonucleotide
tatacgcggcctaaagtgcttccatctgacccccctga

SEQ ID NO: 88738 - DNA, 37 bp, Artificial Sequence
  Synthetic oligonucleotide
tgggacccatccttgtgccctagcaatcatttcctga

SEQ ID NO: 88739 - DNA, 36 bp, Artificial Sequence
  Synthetic oligonucleotide
gaaaagggaggggtttgggttaaggatatgggctga

SEQ ID NO: 88740 - DNA, 38 bp, Artificial Sequence
  Synthetic oligonucleotide
gatacatgagcgggaaaggacaagggcaaaagcagtga

SEQ ID NO: 88741 - DNA, 38 bp, Artificial Sequence
  Synthetic oligonucleotide
acccacggtcctttctcaggtcggtcaaactggagtga

SEQ ID NO: 88742 - DNA, 38 bp, Artificial Sequence
  Synthetic oligonucleotide
agtgctgcagcctgggggtggcgcaaaacgggaggtga

SEQ ID NO: 88743 - DNA, 38 bp, Artificial Sequence
  Synthetic oligonucleotide
gatgcgggcaaactaggtatggagtatgcaggcggtga

SEQ ID NO: 88744 - DNA, 38 bp, Artificial Sequence
  Synthetic oligonucleotide
tacgcgccgtgaggtgattcgtgtacttatggcggtga

SEQ ID NO: 88745 - DNA, 38 bp, Artificial Sequence
  Synthetic oligonucleotide
aggtcgcgggcgggcaaggtggtaatggtaaggggtga

SEQ ID NO: 88746 - DNA, 38 bp, Artificial Sequence
  Synthetic oligonucleotide
gatggcacaccatcaggtagctccactcgataccttga

SEQ ID NO: 88747 - DNA, 38 bp, Artificial Sequence
  Synthetic oligonucleotide
agttgggcaatgtatctgctgccattatccacccttga

SEQ ID NO: 88748 - DNA, 38 bp, Artificial Sequence
  Synthetic oligonucleotide
acatccgcgcatgctttatcatttgggaatgcccttga

SEQ ID NO: 88749 - DNA, 38 bp, Artificial Sequence
  Synthetic oligonucleotide
gccacgtcggagaggagttagatcgtggcacgagttga

SEQ ID NO: 88750 - DNA, 38 bp, Artificial Sequence
  Synthetic oligonucleotide
gccacaaaacctggtcgtcacagccttgccttggttga

SEQ ID NO: 88751 - DNA, 38 bp, Artificial Sequence
  Synthetic oligonucleotide
aaccgtccttggatcctccaccaatctccgtgctttga

SEQ ID NO: 88752 - DNA, 38 bp, Artificial Sequence
  Synthetic oligonucleotide
ggggcggagagggtggcgcatttatcatgagggtttga

SEQ ID NO: 88753 - DNA, 36 bp, Artificial Sequence
  Synthetic oligonucleotide
ttcgacgtgaccaaactttccatgcctgttgtaata

SEQ ID NO: 88754 - DNA, 36 bp, Artificial Sequence
  Synthetic oligonucleotide
gagggcggggcagttagggtcgggtgttgcaacata

SEQ ID NO: 88755 - DNA, 36 bp, Artificial Sequence
  Synthetic oligonucleotide
taccgccgcaccaaaattggcggtcctgaacccata

SEQ ID NO: 88756 - DNA, 35 bp, Artificial Sequence
  Synthetic oligonucleotide
ttgaccaccttgtttgaattattgaacttcgtata

SEQ ID NO: 88757 - DNA, 36 bp, Artificial Sequence
  Synthetic oligonucleotide
tcaagtgctgacccctggctggacacaagctgacta

SEQ ID NO: 88758 - DNA, 36 bp, Artificial Sequence
  Synthetic oligonucleotide
tgttacaccccggcgccgtatcttcaaggaaagcta

SEQ ID NO: 88759 - DNA, 36 bp, Artificial Sequence
  Synthetic oligonucleotide
tgccctgccctccgaggtctaccgtatggcttgcta

SEQ ID NO: 88760 - DNA, 36 bp, Artificial Sequence
  Synthetic oligonucleotide
gcagtgcagaaatacaccggggccctcttccatcta

SEQ ID NO: 88761 - DNA, 36 bp, Artificial Sequence
  Synthetic oligonucleotide
tcaaggctgtaatgtgtcacaaactcctccactcta

SEQ ID NO: 88762 - DNA, 35 bp, Artificial Sequence
  Synthetic oligonucleotide
gatcctccactaagtgggcaaataacatcactcta

SEQ ID NO: 88763 - DNA, 36 bp, Artificial Sequence
  Synthetic oligonucleotide
agatcacgagtgggggaaaaacaagtctgaagagta

SEQ ID NO: 88764 - DNA, 36 bp, Artificial Sequence
  Synthetic oligonucleotide
actacgccgggagtagggtcggaatgaacgagggta

SEQ ID NO: 88765 - DNA, 35 bp, Artificial Sequence
  Synthetic oligonucleotide
gccgacgttggggggttcggttgggaaaacggtta

SEQ ID NO: 88766 - DNA, 35 bp, Artificial Sequence
  Synthetic oligonucleotide
ttgacatggaacgcagcgatactattctgaactac

SEQ ID NO: 88767 - DNA, 35 bp, Artificial Sequence
  Synthetic oligonucleotide
tgaagctaacagcgatgacccgttgccgttcttac

SEQ ID NO: 88768 - DNA, 35 bp, Artificial Sequence
  Synthetic oligonucleotide
gagagcgcaatgaatttcatgctctaacctgttac

SEQ ID NO: 88769 - DNA, 35 bp, Artificial Sequence
  Synthetic oligonucleotide
gtgcaacccctgtatgtcgccaaaccttgtacacc

SEQ ID NO: 88770 - DNA, 35 bp, Artificial Sequence
  Synthetic oligonucleotide
tccacacatgcaacagtctcacgtgagtgcagacc

SEQ ID NO: 88771 - DNA, 35 bp, Artificial Sequence
  Synthetic oligonucleotide
gccctcccatacgctggcctctgtttactctggcc

SEQ ID NO: 88772 - DNA, 35 bp, Artificial Sequence
  Synthetic oligonucleotide
acgtcaccacgcgcggaccggtcctctgtagatcc

SEQ ID NO: 88773 - DNA, 35 bp, Artificial Sequence
  Synthetic oligonucleotide
gacatcatcttctcacgccgccttaagttgggcgc

SEQ ID NO: 88774 - DNA, 35 bp, Artificial Sequence
  Synthetic oligonucleotide
ggacgcccccactcgttacgataggaatgaccatc

SEQ ID NO: 88775 - DNA, 35 bp, Artificial Sequence
  Synthetic oligonucleotide
tcccggacttacttaatctgcatagacatcccatc

SEQ ID NO: 88776 - DNA, 35 bp, Artificial Sequence
  Synthetic oligonucleotide
ggtatagaggctgctgtctatacacctgttttatc

SEQ ID NO: 88777 - DNA, 35 bp, Artificial Sequence
  Synthetic oligonucleotide
atgaacagcccattcgtactctaaccggcttgctc

SEQ ID NO: 88778 - DNA, 35 bp, Artificial Sequence
  Synthetic oligonucleotide
acgagactagtacagtccgtcattactgaattctc

SEQ ID NO: 88779 - DNA, 35 bp, Artificial Sequence
  Synthetic oligonucleotide
aatgcctcctctgtcgtcctacatcacgagcattc

SEQ ID NO: 88780 - DNA, 35 bp, Artificial Sequence
  Synthetic oligonucleotide
ttccaccctctgacccgtactgtcattatttgttc

SEQ ID NO: 88781 - DNA, 35 bp, Artificial Sequence
  Synthetic oligonucleotide
ggaccttggcctaacatttgagctgcaattttttc

SEQ ID NO: 88782 - DNA, 35 bp, Artificial Sequence
  Synthetic oligonucleotide
tgtaagggggagaggggaaagaagtcaatgtgaag

SEQ ID NO: 88783 - DNA, 35 bp, Artificial Sequence
  Synthetic oligonucleotide
ttaaccgagcagtggatgtaggaacaatggctgag

SEQ ID NO: 88784 - DNA, 35 bp, Artificial Sequence
  Synthetic oligonucleotide
ttcggatgacgaaacgcacttagatggtaccaccg

SEQ ID NO: 88785 - DNA, 35 bp, Artificial Sequence
  Synthetic oligonucleotide
gcattgtgtcggcttttctacacccgtattccgcg

SEQ ID NO: 88786 - DNA, 35 bp, Artificial Sequence
  Synthetic oligonucleotide
gacaactggggggggagggcaaaactaggagcgcg

SEQ ID NO: 88787 - DNA, 35 bp, Artificial Sequence
  Synthetic oligonucleotide
gacgtgaaggggggaatagttgtttggaactgtcg

SEQ ID NO: 88788 - DNA, 35 bp, Artificial Sequence
  Synthetic oligonucleotide
gacgacagaagggaatgcacaggggaggagcaagg

SEQ ID NO: 88789 - DNA, 35 bp, Artificial Sequence
  Synthetic oligonucleotide
tgcaccccccatggaatttactcgcatatttcagg

SEQ ID NO: 88790 - DNA, 35 bp, Artificial Sequence
  Synthetic oligonucleotide
gatgtggagagaggttggacggttaggcagggagg

SEQ ID NO: 88791 - DNA, 35 bp, Artificial Sequence
  Synthetic oligonucleotide
gcgagggcaaggtgaggttctacccctggaatagg

SEQ ID NO: 88792 - DNA, 35 bp, Artificial Sequence
  Synthetic oligonucleotide
gccaaggtacatcgtgccagtaatcattccctggg

SEQ ID NO: 88793 - DNA, 31 bp, Artificial Sequence
  Synthetic oligonucleotide
tttacgatcccggccttacgaactacttggg

SEQ ID NO: 88794 - DNA, 35 bp, Artificial Sequence
  Synthetic oligonucleotide
ttctgcccgaaagtacaatcggccacacatccctg

SEQ ID NO: 88795 - DNA, 35 bp, Artificial Sequence
  Synthetic oligonucleotide
gaagacgggtggtgcgaagacaaatggcacacgtg

SEQ ID NO: 88796 - DNA, 35 bp, Artificial Sequence
  Synthetic oligonucleotide
aacacgcaaatggcattagaagtgcggaattcgtg

SEQ ID NO: 88797 - DNA, 35 bp, Artificial Sequence
  Synthetic oligonucleotide
ggacctgtacccactctgcgaagaactccctcttg

SEQ ID NO: 88798 - DNA, 35 bp, Artificial Sequence
  Synthetic oligonucleotide
gtatccactacatcccgcaaactggcctatgtttg

SEQ ID NO: 88799 - DNA, 35 bp, Artificial Sequence
  Synthetic oligonucleotide
tgccttgcaaccgctcttatttctgtggctattat

SEQ ID NO: 88800 - DNA, 35 bp, Artificial Sequence
  Synthetic oligonucleotide
gcacccgggggaactcaagcgacggtcgacgcact

SEQ ID NO: 88801 - DNA, 35 bp, Artificial Sequence
  Synthetic oligonucleotide
tatgttcggccccataccatgcactgctcctgcct

SEQ ID NO: 88802 - DNA, 35 bp, Artificial Sequence
  Synthetic oligonucleotide
tccgacggacgcaccatccagtaccgctctcctct

SEQ ID NO: 88803 - DNA, 35 bp, Artificial Sequence
  Synthetic oligonucleotide
attccaccacatgccacccgaaaaggtcccagagt

SEQ ID NO: 88804 - DNA, 35 bp, Artificial Sequence
  Synthetic oligonucleotide
gatgtccgttgagtcttgcttcgttttttatccgt

SEQ ID NO: 88805 - DNA, 35 bp, Artificial Sequence
  Synthetic oligonucleotide
gcggaggagacgagatctgggtggtggtggggggt

SEQ ID NO: 88806 - DNA, 35 bp, Artificial Sequence
  Synthetic oligonucleotide
gccatatgcaatcctgttccacggtccgagcatgt

SEQ ID NO: 88807 - DNA, 35 bp, Artificial Sequence
  Synthetic oligonucleotide
agtcaagcgcctcaccttgccgtcctctgggcctt

SEQ ID NO: 88808 - DNA, 35 bp, Artificial Sequence
  Synthetic oligonucleotide
acagacaaaccccccgtaaggtgtccgatttcctt

SEQ ID NO: 88809 - DNA, 35 bp, Artificial Sequence
  Synthetic oligonucleotide
acaccgctctcagcacatcttccatcagcctgctt

SEQ ID NO: 88810 - DNA, 35 bp, Artificial Sequence
  Synthetic oligonucleotide
gttggggcgcgtgaaaggggagcatactgtatctt

SEQ ID NO: 88811 - DNA, 35 bp, Artificial Sequence
  Synthetic oligonucleotide
aagtcgcgcctatatagcacctggtagttactctt

SEQ ID NO: 88812 - DNA, 35 bp, Artificial Sequence
  Synthetic oligonucleotide
tccgccccggaatgcgggtttacacctaatgtttt

SEQ ID NO: 88813 - DNA, 35 bp, Artificial Sequence
  Synthetic oligonucleotide
tgccgggcgtggttcgtccaactccatactgtttt

SEQ ID NO: 88814 - DNA, 36 bp, Artificial Sequence
  Synthetic oligonucleotide
tcgttgaacctggtgggctaatcgtatcactccaaa

SEQ ID NO: 88815 - DNA, 36 bp, Artificial Sequence
  Synthetic oligonucleotide
gacggtgggaggcacgaaataaaatacaaaccgaaa

SEQ ID NO: 88816 - DNA, 36 bp, Artificial Sequence
  Synthetic oligonucleotide
atccgtaggcttgagcagggagtggggcggaggaaa

SEQ ID NO: 88817 - DNA, 35 bp, Artificial Sequence
  Synthetic oligonucleotide
gaacccaccaccgtactccacgctgcccgtggaaa

SEQ ID NO: 88818 - DNA, 35 bp, Artificial Sequence
  Synthetic oligonucleotide
ggatggaggggaacggctgactaaagtgggagcaa

SEQ ID NO: 88819 - DNA, 36 bp, Artificial Sequence
  Synthetic oligonucleotide
aaccgcgcacgcgatattgtaccgctcctctttcaa

SEQ ID NO: 88820 - DNA, 35 bp, Artificial Sequence
  Synthetic oligonucleotide
gagtcgtagagctggtaggggaaggggcaagagaa

SEQ ID NO: 88821 - DNA, 36 bp, Artificial Sequence
  Synthetic oligonucleotide
gccaacacgatctggtattgcccctcgtacgtagaa

SEQ ID NO: 88822 - DNA, 36 bp, Artificial Sequence
  Synthetic oligonucleotide
attgccccacatattgtaagtccatctcaatgttaa

SEQ ID NO: 88823 - DNA, 36 bp, Artificial Sequence
  Synthetic oligonucleotide
aaccgccaaccaggaaggattgcgcccctaggaaca

SEQ ID NO: 88824 - DNA, 36 bp, Artificial Sequence
  Synthetic oligonucleotide
acaccacgcgcccggcgtattacgcttcacgacaca

SEQ ID NO: 88825 - DNA, 35 bp, Artificial Sequence
  Synthetic oligonucleotide
tccggttcaatggtcatcccggaacacgctccaca

SEQ ID NO: 88826 - DNA, 35 bp, Artificial Sequence
  Synthetic oligonucleotide
tctcccatgccccagactgcgacgtagcttcgaca

SEQ ID NO: 88827 - DNA, 36 bp, Artificial Sequence
  Synthetic oligonucleotide
gaaaccacagaatacagtcgcacaagctgtgtgaca

SEQ ID NO: 88828 - DNA, 36 bp, Artificial Sequence
  Synthetic oligonucleotide
aacgaagaaggcgccgaacacaccgaccgttagcca

SEQ ID NO: 88829 - DNA, 36 bp, Artificial Sequence
  Synthetic oligonucleotide
atcgcccgttcgtctcattacacaagccccccgcca

SEQ ID NO: 88830 - DNA, 36 bp, Artificial Sequence
  Synthetic oligonucleotide
tccgtcaagcccgcgtccgtgcacgtcccacttcca

SEQ ID NO: 88831 - DNA, 35 bp, Artificial Sequence
  Synthetic oligonucleotide
tgagtaacgagtaagggaggttagagttgtgggca

SEQ ID NO: 88832 - DNA, 36 bp, Artificial Sequence
  Synthetic oligonucleotide
tcacctctattgcttcctgacaccccctgaggctca

SEQ ID NO: 88833 - DNA, 37 bp, Artificial Sequence
  Synthetic oligonucleotide
gcaaccagttgcacacttcattgtattttccacaaga

SEQ ID NO: 88834 - DNA, 37 bp, Artificial Sequence
  Synthetic oligonucleotide
aaagcgaagggtcgtgggaggtgctggagagggaaga

SEQ ID NO: 88835 - DNA, 37 bp, Artificial Sequence
  Synthetic oligonucleotide
gtccacccagtccgcgtaggaacgtcccttcctcaga

SEQ ID NO: 88836 - DNA, 35 bp, Artificial Sequence
  Synthetic oligonucleotide
gtgcgtactgcacatataactctacttaggagaga

SEQ ID NO: 88837 - DNA, 37 bp, Artificial Sequence
  Synthetic oligonucleotide
ttcgacacacgtatgtgcgcttatcatcatttttaga

SEQ ID NO: 88838 - DNA, 37 bp, Artificial Sequence
  Synthetic oligonucleotide
tcatccctcgcctgcctcttattcactggtccaacga

SEQ ID NO: 88839 - DNA, 35 bp, Artificial Sequence
  Synthetic oligonucleotide
tagactcgccatcgtagcgtagaacttccccacga

SEQ ID NO: 88840 - DNA, 37 bp, Artificial Sequence
  Synthetic oligonucleotide
gatcgtgagggtgtttgagggggggtgtataagacga

SEQ ID NO: 88841 - DNA, 37 bp, Artificial Sequence
  Synthetic oligonucleotide
gtccaaattcgctgctgtagcagtcaccccaccccga

SEQ ID NO: 88842 - DNA, 37 bp, Artificial Sequence
  Synthetic oligonucleotide
acacgtgccatccgcggtgtattaatccttaccccga

SEQ ID NO: 88843 - DNA, 37 bp, Artificial Sequence
  Synthetic oligonucleotide
tgacttatccccatccgtgtccacgcgcatctgccga

SEQ ID NO: 88844 - DNA, 37 bp, Artificial Sequence
  Synthetic oligonucleotide
tgtgcgacaacggacttcattcaagctacacctccga

SEQ ID NO: 88845 - DNA, 37 bp, Artificial Sequence
  Synthetic oligonucleotide
taccagacgcatttgccaacccccatccctttcagga

SEQ ID NO: 88846 - DNA, 37 bp, Artificial Sequence
  Synthetic oligonucleotide
gactcaggtcggttattatgggatgaggtcgggagga

SEQ ID NO: 88847 - DNA, 37 bp, Artificial Sequence
  Synthetic oligonucleotide
tgtatgggcaaaggaaatcaagcgagggttttgagga

SEQ ID NO: 88848 - DNA, 36 bp, Artificial Sequence
  Synthetic oligonucleotide
gttaaccctcccagccgtgctcattatcacctagga

SEQ ID NO: 88849 - DNA, 37 bp, Artificial Sequence
  Synthetic oligonucleotide
gatgcagacgaacgggatcaatggttatggcttagga

SEQ ID NO: 88850 - DNA, 36 bp, Artificial Sequence
  Synthetic oligonucleotide
gaaacaaaggggagggttaggtggcggataggcgga

SEQ ID NO: 88851 - DNA, 37 bp, Artificial Sequence
  Synthetic oligonucleotide
ggtgagaaggaagggctgtttaatagtgcagaaggga

SEQ ID NO: 88852 - DNA, 37 bp, Artificial Sequence
  Synthetic oligonucleotide
ggtcgccggagaggattggcaagagtgttgacaggga

SEQ ID NO: 88853 - DNA, 37 bp, Artificial Sequence
  Synthetic oligonucleotide
aagagggtgcggggaggctgcgtggaagaaaggggga

SEQ ID NO: 88854 - DNA, 37 bp, Artificial Sequence
  Synthetic oligonucleotide
agttgacgggctgatcgtgtctttgttggagggggga

SEQ ID NO: 88855 - DNA, 35 bp, Artificial Sequence
  Synthetic oligonucleotide
gggaacgacactggggtgggaatttgtctggggga

SEQ ID NO: 88856 - DNA, 37 bp, Artificial Sequence
  Synthetic oligonucleotide
acctcaggccctgataggcgtaagtggctcacatgga

SEQ ID NO: 88857 - DNA, 37 bp, Artificial Sequence
  Synthetic oligonucleotide
gcacccttaaaccctgttacttgagcttagccgtgga

SEQ ID NO: 88858 - DNA, 36 bp, Artificial Sequence
  Synthetic oligonucleotide
tcacactttctgtccgcggtttctcgccaccttgga

SEQ ID NO: 88859 - DNA, 37 bp, Artificial Sequence
  Synthetic oligonucleotide
tagggccagggaccacccaccccatgtagtatttgga

SEQ ID NO: 88860 - DNA, 38 bp, Artificial Sequence
  Synthetic oligonucleotide
gtctaccaacgggtccacgcctggatattgttaaatga

SEQ ID NO: 88861 - DNA, 38 bp, Artificial Sequence
  Synthetic oligonucleotide
attcgccaccgccattgtctagccaccagcaggcatga

SEQ ID NO: 88862 - DNA, 38 bp, Artificial Sequence
  Synthetic oligonucleotide
tccaccgcatggtatgcgttcatttttcgaagtcatga

SEQ ID NO: 88863 - DNA, 37 bp, Artificial Sequence
  Synthetic oligonucleotide
accccacgatcgtggttgcacggtctcatattcatga

SEQ ID NO: 88864 - DNA, 38 bp, Artificial Sequence
  Synthetic oligonucleotide
tgcgataggtagtagcaagtggggagaaggggggatga

SEQ ID NO: 88865 - DNA, 38 bp, Artificial Sequence
  Synthetic oligonucleotide
gagtccctcacccatggaatatgtctccgcctttatga

SEQ ID NO: 88866 - DNA, 37 bp, Artificial Sequence
  Synthetic oligonucleotide
atccccatgttcagcgggtaatcacatgttccactga

SEQ ID NO: 88867 - DNA, 38 bp, Artificial Sequence
  Synthetic oligonucleotide
taatggtgcaaaggtggaagaacatggggggggactga

SEQ ID NO: 88868 - DNA, 38 bp, Artificial Sequence
  Synthetic oligonucleotide
tttgcctcccacggaacacgtatacgcacgttacctga

SEQ ID NO: 88869 - DNA, 37 bp, Artificial Sequence
  Synthetic oligonucleotide
aatggccgctagcacttgtagccatttgtacccctga

SEQ ID NO: 88870 - DNA, 37 bp, Artificial Sequence
  Synthetic oligonucleotide
ttgcatcagctgaattggggcccccctccgtgcctga

SEQ ID NO: 88871 - DNA, 38 bp, Artificial Sequence
  Synthetic oligonucleotide
atgacgcctcaggacaccgggagccccttcttttctga

SEQ ID NO: 88872 - DNA, 36 bp, Artificial Sequence
  Synthetic oligonucleotide
aaccatcgcgagccaacgtatgtactgtttttctga

SEQ ID NO: 88873 - DNA, 38 bp, Artificial Sequence
  Synthetic oligonucleotide
gcacttcgcaagaggtgcacgtacgggtgaacaagtga

SEQ ID NO: 88874 - DNA, 38 bp, Artificial Sequence
  Synthetic oligonucleotide
gcacctcccctcctctgtacttgtcgtcgccatcgtga

SEQ ID NO: 88875 - DNA, 38 bp, Artificial Sequence
  Synthetic oligonucleotide
ataccagctgcacctccccacgtcatgtcatcttgtga

SEQ ID NO: 88876 - DNA, 38 bp, Artificial Sequence
  Synthetic oligonucleotide
gctaagctgcacaccgtcattgcccgtatctcttgtga

SEQ ID NO: 88877 - DNA, 38 bp, Artificial Sequence
  Synthetic oligonucleotide
ggtcgactcaggtccgtcctgacgccatcttatattga

SEQ ID NO: 88878 - DNA, 38 bp, Artificial Sequence
  Synthetic oligonucleotide
ttgggacaccggcaaaacggattttgattgacccttga

SEQ ID NO: 88879 - DNA, 38 bp, Artificial Sequence
  Synthetic oligonucleotide
tggtaacctgagtaatgttccgcccccgtcccccttga

SEQ ID NO: 88880 - DNA, 35 bp, Artificial Sequence
  Synthetic oligonucleotide
aagccacgctccgtgcccacgttaattatccttga

SEQ ID NO: 88881 - DNA, 38 bp, Artificial Sequence
  Synthetic oligonucleotide
tcgatgcaaggtggatgtcacttgaggtgccacgttga

SEQ ID NO: 88882 - DNA, 38 bp, Artificial Sequence
  Synthetic oligonucleotide
tcatcacctcggtgtggctacactgggaatactgttga

SEQ ID NO: 88883 - DNA, 37 bp, Artificial Sequence
  Synthetic oligonucleotide
tgactcacaccgtcgtattatctctgcacgcctttga

SEQ ID NO: 88884 - DNA, 37 bp, Artificial Sequence
  Synthetic oligonucleotide
tgctccgccgcagttttttaccccacttatcgtttga

SEQ ID NO: 88885 - DNA, 36 bp, Artificial Sequence
  Synthetic oligonucleotide
acgctcacacacagtatcccggaccctcctcccata

SEQ ID NO: 88886 - DNA, 36 bp, Artificial Sequence
  Synthetic oligonucleotide
attccatccgacctttacacgtggacgagtatccta

SEQ ID NO: 88887 - DNA, 36 bp, Artificial Sequence
  Synthetic oligonucleotide
tcaggccattccgttggcctttgtttatcaccgcta

SEQ ID NO: 88888 - DNA, 35 bp, Artificial Sequence
  Synthetic oligonucleotide
gtcaatcacaagtaaaggtgcgcagggggggggta

SEQ ID NO: 88889 - DNA, 36 bp, Artificial Sequence
  Synthetic oligonucleotide
gtgtgtggaggatggcatgatcagggatgcgtggta

SEQ ID NO: 88890 - DNA, 35 bp, Artificial Sequence
  Synthetic oligonucleotide
gatgattcaccaagtgcgctagctggacccattta

SEQ ID NO: 88891 - DNA, 36 bp, Artificial Sequence
  Synthetic oligonucleotide
tcaacgtgctccatgtccgcccttgtggtatcttta

SEQ ID NO: 88892 - DNA, 35 bp, Artificial Sequence
  Synthetic oligonucleotide
ttagccccatgctagtgccctcagtacgataacac

SEQ ID NO: 88893 - DNA, 35 bp, Artificial Sequence
  Synthetic oligonucleotide
ggtgtagccctccgatctggccccgtctacgtcac

SEQ ID NO: 88894 - DNA, 35 bp, Artificial Sequence
  Synthetic oligonucleotide
ggggcctgccacgtgttccctgctcccattccgac

SEQ ID NO: 88895 - DNA, 35 bp, Artificial Sequence
  Synthetic oligonucleotide
agcctagccgagaccagaacacgcgctgaacatac

SEQ ID NO: 88896 - DNA, 35 bp, Artificial Sequence
  Synthetic oligonucleotide
ttgtcagtcgcagcactgcctttccctgtttttac

SEQ ID NO: 88897 - DNA, 35 bp, Artificial Sequence
  Synthetic oligonucleotide
ttcaatcgtacttctcggttccctgctcctgtgcc

SEQ ID NO: 88898 - DNA, 35 bp, Artificial Sequence
  Synthetic oligonucleotide
tcacgctcccgtcgctcttccttatttgcctgtcc

SEQ ID NO: 88899 - DNA, 35 bp, Artificial Sequence
  Synthetic oligonucleotide
tcacgccgcattcctgatgtccgctatccacttcc

SEQ ID NO: 88900 - DNA, 35 bp, Artificial Sequence
  Synthetic oligonucleotide
ggattcagccgctacccgtaaggtccacgacttcc

SEQ ID NO: 88901 - DNA, 35 bp, Artificial Sequence
  Synthetic oligonucleotide
ttcacatgtacaagtatgatcttagcacaccttcc

SEQ ID NO: 88902 - DNA, 35 bp, Artificial Sequence
  Synthetic oligonucleotide
aaacactcgcagggaatgcatttactctaactggc

SEQ ID NO: 88903 - DNA, 35 bp, Artificial Sequence
  Synthetic oligonucleotide
gaatcccgctacacaggttgggcctgggtgcctgc

SEQ ID NO: 88904 - DNA, 35 bp, Artificial Sequence
  Synthetic oligonucleotide
tcaatccaccgtcccgccacgctcctcctagcctc

SEQ ID NO: 88905 - DNA, 35 bp, Artificial Sequence
  Synthetic oligonucleotide
gcgcacgctagcccttattgtgggatttacgcctc

SEQ ID NO: 88906 - DNA, 35 bp, Artificial Sequence
  Synthetic oligonucleotide
taatgcaagcgcattcagttctccgttgccaagtc

SEQ ID NO: 88907 - DNA, 35 bp, Artificial Sequence
  Synthetic oligonucleotide
agtgccacgtgaggagggaattcctggaagtggtc

SEQ ID NO: 88908 - DNA, 35 bp, Artificial Sequence
  Synthetic oligonucleotide
gataaagacggttgtacgggaaaagtgagcgagag

SEQ ID NO: 88909 - DNA, 35 bp, Artificial Sequence
  Synthetic oligonucleotide
tgagcatgaactaaactgtcgcgcacatccctgag

SEQ ID NO: 88910 - DNA, 35 bp, Artificial Sequence
  Synthetic oligonucleotide
gcaacgcttccgactcaggcatataaggcctcccg

SEQ ID NO: 88911 - DNA, 35 bp, Artificial Sequence
  Synthetic oligonucleotide
ttcgctacgcactgagcctcgtatcaacttccgcg

SEQ ID NO: 88912 - DNA, 35 bp, Artificial Sequence
  Synthetic oligonucleotide
tgttggagaaggcggggttagacgacgggttcagg

SEQ ID NO: 88913 - DNA, 35 bp, Artificial Sequence
  Synthetic oligonucleotide
atgcggatggtggagtgtgtgtcttaaggtcacgg

SEQ ID NO: 88914 - DNA, 35 bp, Artificial Sequence
  Synthetic oligonucleotide
gtagttgcacaatagagttaggaggggagtggggg

SEQ ID NO: 88915 - DNA, 35 bp, Artificial Sequence
  Synthetic oligonucleotide
tcagacatgcctccgcaggatctagctccactggg

SEQ ID NO: 88916 - DNA, 35 bp, Artificial Sequence
  Synthetic oligonucleotide
aactcgcaggtcccgcattctcagtcttacactgg

SEQ ID NO: 88917 - DNA, 34 bp, Artificial Sequence
  Synthetic oligonucleotide
aaccgtcgaggccgtcggagcacccaccttaatg

SEQ ID NO: 88918 - DNA, 35 bp, Artificial Sequence
  Synthetic oligonucleotide
gtcacgagccaggggaaggggatggttatgctatg

SEQ ID NO: 88919 - DNA, 35 bp, Artificial Sequence
  Synthetic oligonucleotide
acgcgcccaccacaaattgttcatggcctatcctg

SEQ ID NO: 88920 - DNA, 35 bp, Artificial Sequence
  Synthetic oligonucleotide
tcaccctcacgccactactgtccgaagaccccgtg

SEQ ID NO: 88921 - DNA, 35 bp, Artificial Sequence
  Synthetic oligonucleotide
attctccgccccattccgcatgtgcctcttacttg

SEQ ID NO: 88922 - DNA, 35 bp, Artificial Sequence
  Synthetic oligonucleotide
gcacccgaattcacatcgcggccttcactgccttg

SEQ ID NO: 88923 - DNA, 35 bp, Artificial Sequence
  Synthetic oligonucleotide
ttgaagggagtgggacatgggagacaccctgtttg

SEQ ID NO: 88924 - DNA, 35 bp, Artificial Sequence
  Synthetic oligonucleotide
tccgactgctcatcctcgtgtctggtcttttgcat

SEQ ID NO: 88925 - DNA, 35 bp, Artificial Sequence
  Synthetic oligonucleotide
ttacaccgggtatctgtccataccagccttccact

SEQ ID NO: 88926 - DNA, 35 bp, Artificial Sequence
  Synthetic oligonucleotide
gacgcatggacggaccaggttccccgatctcacct

SEQ ID NO: 88927 - DNA, 35 bp, Artificial Sequence
  Synthetic oligonucleotide
atagtaagcccatccatcctggtttcgatcaccct

SEQ ID NO: 88928 - DNA, 35 bp, Artificial Sequence
  Synthetic oligonucleotide
ataccgacgcgcacctgaacttaccgtcctgccct

SEQ ID NO: 88929 - DNA, 35 bp, Artificial Sequence
  Synthetic oligonucleotide
gcatccagtccttccgccgcctgacattccttgct

SEQ ID NO: 88930 - DNA, 35 bp, Artificial Sequence
  Synthetic oligonucleotide
gacagaccaggccaatcgaaacataactctcgagt

SEQ ID NO: 88931 - DNA, 35 bp, Artificial Sequence
  Synthetic oligonucleotide
gatcgaccacctcgcagtacagggatctctatcgt

SEQ ID NO: 88932 - DNA, 35 bp, Artificial Sequence
  Synthetic oligonucleotide
tccaacgacggctaggtagggtgatctgggaaggt

SEQ ID NO: 88933 - DNA, 34 bp, Artificial Sequence
  Synthetic oligonucleotide
atgacctgcccctgccctccttgtttaccctggt

SEQ ID NO: 88934 - DNA, 36 bp, Artificial Sequence
  Synthetic oligonucleotide
attacaccatccggtacctgttaaagcttagcacaa

SEQ ID NO: 88935 - DNA, 36 bp, Artificial Sequence
  Synthetic oligonucleotide
gggtctgctgccctctggttatatctgctcgaccaa

SEQ ID NO: 88936 - DNA, 36 bp, Artificial Sequence
  Synthetic oligonucleotide
tttcaccgcagtagcgtatctgtccgcctctctcaa

SEQ ID NO: 88937 - DNA, 35 bp, Artificial Sequence
  Synthetic oligonucleotide
actggacaaggacgggggggcattacgttattgaa

SEQ ID NO: 88938 - DNA, 36 bp, Artificial Sequence
  Synthetic oligonucleotide
actaggggcgtagagaaggggcggagccgagggtaa

SEQ ID NO: 88939 - DNA, 35 bp, Artificial Sequence
  Synthetic oligonucleotide
gacacaccttcgatggagtccacgcgcacacttaa

SEQ ID NO: 88940 - DNA, 36 bp, Artificial Sequence
  Synthetic oligonucleotide
acctatcgacagcacgcacctgacttatacggttaa

SEQ ID NO: 88941 - DNA, 35 bp, Artificial Sequence
  Synthetic oligonucleotide
tgaacactaccgcatctatcccgcaccagcggaca

SEQ ID NO: 88942 - DNA, 36 bp, Artificial Sequence
  Synthetic oligonucleotide
tagcgcaggctcctagtctgtcagcccaatcctaca

SEQ ID NO: 88943 - DNA, 35 bp, Artificial Sequence
  Synthetic oligonucleotide
tgtgaacgtagttctacgtactcgacctccaacca

SEQ ID NO: 88944 - DNA, 35 bp, Artificial Sequence
  Synthetic oligonucleotide
gcccggtgcaacccgctgatccatcctgcctacca

SEQ ID NO: 88945 - DNA, 35 bp, Artificial Sequence
  Synthetic oligonucleotide
acgctactcaacgtccgcccccctaagcgtgccca

SEQ ID NO: 88946 - DNA, 36 bp, Artificial Sequence
  Synthetic oligonucleotide
gctgcacagcaaacctttggaatagcacttgatcca

SEQ ID NO: 88947 - DNA, 36 bp, Artificial Sequence
  Synthetic oligonucleotide
tccaccggagcccgcgattaagctggagggactcca

SEQ ID NO: 88948 - DNA, 36 bp, Artificial Sequence
  Synthetic oligonucleotide
gatgacgcgcagttcgcctttagaattctctctcca

SEQ ID NO: 88949 - DNA, 35 bp, Artificial Sequence
  Synthetic oligonucleotide
gttggccttagggcgcgtttcacaatctgtctcca

SEQ ID NO: 88950 - DNA, 36 bp, Artificial Sequence
  Synthetic oligonucleotide
gcagtggcttcggggtaggcgggaaggaagaacgca

SEQ ID NO: 88951 - DNA, 35 bp, Artificial Sequence
  Synthetic oligonucleotide
accgaccaccctcagttgttaaacgccccaccgca

SEQ ID NO: 88952 - DNA, 36 bp, Artificial Sequence
  Synthetic oligonucleotide
aatggaccaggagtaaggggggtggacgggagggca

SEQ ID NO: 88953 - DNA, 36 bp, Artificial Sequence
  Synthetic oligonucleotide
tgtgcggtaaggataggaggggatggggccaatgca

SEQ ID NO: 88954 - DNA, 36 bp, Artificial Sequence
  Synthetic oligonucleotide
acctacgcatgcgaccgttaaagtttctattcatca

SEQ ID NO: 88955 - DNA, 36 bp, Artificial Sequence
  Synthetic oligonucleotide
accacatcgagttcctggacgtcttctttttagtca

SEQ ID NO: 88956 - DNA, 36 bp, Artificial Sequence
  Synthetic oligonucleotide
tgccacacgcgacactgttctcgccccgccacttca

SEQ ID NO: 88957 - DNA, 36 bp, Artificial Sequence
  Synthetic oligonucleotide
tccactcctaatgagttcatcgattgtcgcatttca

SEQ ID NO: 88958 - DNA, 37 bp, Artificial Sequence
  Synthetic oligonucleotide
ttaccaaccactcagcgatgcaccaccattgctcaga

SEQ ID NO: 88959 - DNA, 37 bp, Artificial Sequence
  Synthetic oligonucleotide
acccgggaggagggtgatggggaccaacgtgtagaga

SEQ ID NO: 88960 - DNA, 37 bp, Artificial Sequence
  Synthetic oligonucleotide
tcgaggacttgcgatagggggcggacgggccaaacga

SEQ ID NO: 88961 - DNA, 37 bp, Artificial Sequence
  Synthetic oligonucleotide
tagtttgcgagggaggtggtgggtaggaggtagacga

SEQ ID NO: 88962 - DNA, 37 bp, Artificial Sequence
  Synthetic oligonucleotide
aacaagggtcggaatcagggcgggggaggcgtgccga

SEQ ID NO: 88963 - DNA, 36 bp, Artificial Sequence
  Synthetic oligonucleotide
gtactgctggagtcggaggggggtttgatcaggcga

SEQ ID NO: 88964 - DNA, 37 bp, Artificial Sequence
  Synthetic oligonucleotide
gcccacctgcaccttgatctccgagtaggctcctcga

SEQ ID NO: 88965 - DNA, 36 bp, Artificial Sequence
  Synthetic oligonucleotide
gcagaaaacatgagctggtaggggtctaggcgcgga

SEQ ID NO: 88966 - DNA, 36 bp, Artificial Sequence
  Synthetic oligonucleotide
gtgacgcctaggcggaggggatagaggaatgaggga

SEQ ID NO: 88967 - DNA, 37 bp, Artificial Sequence
  Synthetic oligonucleotide
gggaagggcgtgccagagaaaacggggctgtgaggga

SEQ ID NO: 88968 - DNA, 35 bp, Artificial Sequence
  Synthetic oligonucleotide
atgtccaaccaccactcctgcctcgcgagagggga

SEQ ID NO: 88969 - DNA, 37 bp, Artificial Sequence
  Synthetic oligonucleotide
actgtggcctataaggggttcaagggcgaagggggga

SEQ ID NO: 88970 - DNA, 37 bp, Artificial Sequence
  Synthetic oligonucleotide
gccacccactggaaacctaaagtctggccaactggga

SEQ ID NO: 88971 - DNA, 35 bp, Artificial Sequence
  Synthetic oligonucleotide
tcatccgtacgttttgaatttcatcagactctgga

SEQ ID NO: 88972 - DNA, 35 bp, Artificial Sequence
  Synthetic oligonucleotide
agacttgcacaatgcactttttccccccttctgga

SEQ ID NO: 88973 - DNA, 37 bp, Artificial Sequence
  Synthetic oligonucleotide
gtgcatccctgcctgtgacgcctaaagtcgcaaatga

SEQ ID NO: 88974 - DNA, 38 bp, Artificial Sequence
  Synthetic oligonucleotide
gcccactactgaagtccaaccgccatgccgaaacatga

SEQ ID NO: 88975 - DNA, 36 bp, Artificial Sequence
  Synthetic oligonucleotide
actccctgcaccatgcgtgcctcatctcatacatga

SEQ ID NO: 88976 - DNA, 37 bp, Artificial Sequence
  Synthetic oligonucleotide
aatgaaagggaaggggagatagaaataggacgcatga

SEQ ID NO: 88977 - DNA, 38 bp, Artificial Sequence
  Synthetic oligonucleotide
gtaccgtggcgggtatagggagggtatggaggtcatga

SEQ ID NO: 88978 - DNA, 38 bp, Artificial Sequence
  Synthetic oligonucleotide
tgtccccatcttttgcccattgttgactgttcttatga

SEQ ID NO: 88979 - DNA, 38 bp, Artificial Sequence
  Synthetic oligonucleotide
tcatgacaatcgttccttaggacgccccgtaatactga

SEQ ID NO: 88980 - DNA, 36 bp, Artificial Sequence
  Synthetic oligonucleotide
gaggtgcccgggggaagaggggtggggtgatactga

SEQ ID NO: 88981 - DNA, 37 bp, Artificial Sequence
  Synthetic oligonucleotide
gagcgccgtatccgatcaatccgcatccctttactga

SEQ ID NO: 88982 - DNA, 38 bp, Artificial Sequence
  Synthetic oligonucleotide
agacaacgcccgcgaaccgaatactagcccggacctga

SEQ ID NO: 88983 - DNA, 35 bp, Artificial Sequence
  Synthetic oligonucleotide
ttgtgacttcaatcgagtcgccactctcaccctga

SEQ ID NO: 88984 - DNA, 38 bp, Artificial Sequence
  Synthetic oligonucleotide
gacacaagtaagcactgaatctagtcctcgacccctga

SEQ ID NO: 88985 - DNA, 38 bp, Artificial Sequence
  Synthetic oligonucleotide
aatcgcagtagcagaagcagcactctccatactcctga

SEQ ID NO: 88986 - DNA, 37 bp, Artificial Sequence
  Synthetic oligonucleotide
cttggaccatcttgttctggaactgatatgttcctga

SEQ ID NO: 88987 - DNA, 38 bp, Artificial Sequence
  Synthetic oligonucleotide
ttgaggtgtgtgttgggacgtgagggacggcgagctga

SEQ ID NO: 88988 - DNA, 38 bp, Artificial Sequence
  Synthetic oligonucleotide
tcatcgcagaacggtctttctcgtctaggttatgctga

SEQ ID NO: 88989 - DNA, 38 bp, Artificial Sequence
  Synthetic oligonucleotide
ttggtcaccggttttgatccgcgcatctccactgctga

SEQ ID NO: 88990 - DNA, 38 bp, Artificial Sequence
  Synthetic oligonucleotide
gccgagcccacgccgcatagcctgtatttaaattctga

SEQ ID NO: 88991 - DNA, 37 bp, Artificial Sequence
  Synthetic oligonucleotide
agcacgctaagccacacagcaaagcccttcattctga

SEQ ID NO: 88992 - DNA, 38 bp, Artificial Sequence
  Synthetic oligonucleotide
acccaccggcgcttgttcacacggggaatggtttctga

SEQ ID NO: 88993 - DNA, 38 bp, Artificial Sequence
  Synthetic oligonucleotide
acagagaggatacggataaatgggtgtgcgtgaagtga

SEQ ID NO: 88994 - DNA, 37 bp, Artificial Sequence
  Synthetic oligonucleotide
aagggggatgcacaaaatacgggaggggagctcgtga

SEQ ID NO: 88995 - DNA, 38 bp, Artificial Sequence
  Synthetic oligonucleotide
tccaactcagcggcatcatcccacttccgccttcgtga

SEQ ID NO: 88996 - DNA, 38 bp, Artificial Sequence
  Synthetic oligonucleotide
gatgcaaggcggaacaggcagaagaccgtctaaggtga

SEQ ID NO: 88997 - DNA, 38 bp, Artificial Sequence
  Synthetic oligonucleotide
tacaacgtacggaggaaagagagcagggccacaggtga

SEQ ID NO: 88998 - DNA, 38 bp, Artificial Sequence
  Synthetic oligonucleotide
gcctatggaaaggtgaagaaaacgggatggtggggtga

SEQ ID NO: 88999 - DNA, 38 bp, Artificial Sequence
  Synthetic oligonucleotide
ttagggggcacgttctgcttcttttgattacctggtga

SEQ ID NO: 89000 - DNA, 38 bp, Artificial Sequence
  Synthetic oligonucleotide
acccgtaacgtcattcccgtaatttcccactttggtga

SEQ ID NO: 89001 - DNA, 38 bp, Artificial Sequence
  Synthetic oligonucleotide
gactgaaggaagagggtgggtgatgaattgggaattga

SEQ ID NO: 89002 - DNA, 38 bp, Artificial Sequence
  Synthetic oligonucleotide
gtaggtgtgcagaggacggtaggagcggctatgattga

SEQ ID NO: 89003 - DNA, 37 bp, Artificial Sequence
  Synthetic oligonucleotide
tgtgccgcagtgctcgcacacttaaactaggacttga

SEQ ID NO: 89004 - DNA, 38 bp, Artificial Sequence
  Synthetic oligonucleotide
atgctacgtctacatggccttacatttccccttcttga

SEQ ID NO: 89005 - DNA, 38 bp, Artificial Sequence
  Synthetic oligonucleotide
aagcacggctgtaatggagggcgggtcgtggagtttga

SEQ ID NO: 89006 - DNA, 36 bp, Artificial Sequence
  Synthetic oligonucleotide
gtcgcctacgccttcaatctcgtaattattaacata

SEQ ID NO: 89007 - DNA, 36 bp, Artificial Sequence
  Synthetic oligonucleotide
atggaacggtggggaggatcaaaagcaactcggata

SEQ ID NO: 89008 - DNA, 35 bp, Artificial Sequence
  Synthetic oligonucleotide
tagcactacacccttcattacagactattcatata

SEQ ID NO: 89009 - DNA, 36 bp, Artificial Sequence
  Synthetic oligonucleotide
tcgtggccacgcacccgatcctctagtttaagccta

SEQ ID NO: 89010 - DNA, 36 bp, Artificial Sequence
  Synthetic oligonucleotide
acaatcccctgctatcaatcgttctgttacaggcta

SEQ ID NO: 89011 - DNA, 36 bp, Artificial Sequence
  Synthetic oligonucleotide
gcgacactagctgtcgggcatttcatccggttctta

SEQ ID NO: 89012 - DNA, 36 bp, Artificial Sequence
  Synthetic oligonucleotide
agactgagccacccccagtaacgctcttttaggtta

SEQ ID NO: 89013 - DNA, 35 bp, Artificial Sequence
  Synthetic oligonucleotide
acggaaggtccgtcctgtcctatcgcatcctgtta

SEQ ID NO: 89014 - DNA, 35 bp, Artificial Sequence
  Synthetic oligonucleotide
ggtgggcacccctcctattgtaactcccgatcaac

SEQ ID NO: 89015 - DNA, 35 bp, Artificial Sequence
  Synthetic oligonucleotide
gtcaccttacaccatgaggctccttactaaagcac

SEQ ID NO: 89016 - DNA, 35 bp, Artificial Sequence
  Synthetic oligonucleotide
atgcgggaggtcaataggaggagaagtgcattcac

SEQ ID NO: 89017 - DNA, 35 bp, Artificial Sequence
  Synthetic oligonucleotide
gtacgctctgtcgaccagttctgctccgcccatac

SEQ ID NO: 89018 - DNA, 35 bp, Artificial Sequence
  Synthetic oligonucleotide
gaagcctaggattcgtttctctgccccggctctac

SEQ ID NO: 89019 - DNA, 35 bp, Artificial Sequence
  Synthetic oligonucleotide
gggaacctcataccggacaataatgtcgcccttac

SEQ ID NO: 89020 - DNA, 35 bp, Artificial Sequence
  Synthetic oligonucleotide
accgaggcgatcccgatccatacgttctgcttacc

SEQ ID NO: 89021 - DNA, 35 bp, Artificial Sequence
  Synthetic oligonucleotide
gagaaccaggatcttctctggaaccttcagttacc

SEQ ID NO: 89022 - DNA, 35 bp, Artificial Sequence
  Synthetic oligonucleotide
acgtccctccgatcgactgcattcagacgcaaccc

SEQ ID NO: 89023 - DNA, 35 bp, Artificial Sequence
  Synthetic oligonucleotide
gacgtccggtctctgagaggagcctttgtcccccc

SEQ ID NO: 89024 - DNA, 35 bp, Artificial Sequence
  Synthetic oligonucleotide
ttgatctgtcccactgcctatcttgtttacgcccc

SEQ ID NO: 89025 - DNA, 35 bp, Artificial Sequence
  Synthetic oligonucleotide
accacccagctcgaaactacatgtgacctatcgcc

SEQ ID NO: 89026 - DNA, 35 bp, Artificial Sequence
  Synthetic oligonucleotide
tgccccctccatgactgcttttccccttcacatcc

SEQ ID NO: 89027 - DNA, 35 bp, Artificial Sequence
  Synthetic oligonucleotide
tccctccctcgtactccgctcggctagtttcctcc

SEQ ID NO: 89028 - DNA, 35 bp, Artificial Sequence
  Synthetic oligonucleotide
atcataccttcgcttggggacgcctgtacttgtcc

SEQ ID NO: 89029 - DNA, 35 bp, Artificial Sequence
  Synthetic oligonucleotide
gtcgagagcgttggatatccccacgctcgcattcc

SEQ ID NO: 89030 - DNA, 35 bp, Artificial Sequence
  Synthetic oligonucleotide
gacgcaccctatatgctttgctaggtcacctgagc

SEQ ID NO: 89031 - DNA, 35 bp, Artificial Sequence
  Synthetic oligonucleotide
tatcgctggacacttgtctttcattagcttcttgc

SEQ ID NO: 89032 - DNA, 35 bp, Artificial Sequence
  Synthetic oligonucleotide
tacccacgcaccgccgcaccatgagctacactatc

SEQ ID NO: 89033 - DNA, 35 bp, Artificial Sequence
  Synthetic oligonucleotide
gatcacgtggccacggtcgagtagacctcggactc

SEQ ID NO: 89034 - DNA, 35 bp, Artificial Sequence
  Synthetic oligonucleotide
actcggtgtgagggggtggggaaggcgacgtagtc

SEQ ID NO: 89035 - DNA, 35 bp, Artificial Sequence
  Synthetic oligonucleotide
tgatccactccgagtgcattaccttattgtgcttc

SEQ ID NO: 89036 - DNA, 35 bp, Artificial Sequence
  Synthetic oligonucleotide
gataaccagcccgtttacgcatatataacctgttc

SEQ ID NO: 89037 - DNA, 35 bp, Artificial Sequence
  Synthetic oligonucleotide
taacacgccgggttggtcctgcgggatctgctttc

SEQ ID NO: 89038 - DNA, 35 bp, Artificial Sequence
  Synthetic oligonucleotide
aactgagacaggggaaacgcgtacgaattaggaag

SEQ ID NO: 89039 - DNA, 35 bp, Artificial Sequence
  Synthetic oligonucleotide
tgcagactcatacccacgcatatctccctgcagag

SEQ ID NO: 89040 - DNA, 35 bp, Artificial Sequence
  Synthetic oligonucleotide
tgtcgcgataaccctacggccccttcacttccgag

SEQ ID NO: 89041 - DNA, 35 bp, Artificial Sequence
  Synthetic oligonucleotide
gatagcccacgtccccatcagataaaccggcggag

SEQ ID NO: 89042 - DNA, 35 bp, Artificial Sequence
  Synthetic oligonucleotide
atgcacgtgtggtgcgccctgagtaacggttttag

SEQ ID NO: 89043 - DNA, 35 bp, Artificial Sequence
  Synthetic oligonucleotide
gatgcacaccacgagagcggagacgtgatctcacg

SEQ ID NO: 89044 - DNA, 35 bp, Artificial Sequence
  Synthetic oligonucleotide
attcacgcgtatctacagtgctcctccttgctccg

SEQ ID NO: 89045 - DNA, 35 bp, Artificial Sequence
  Synthetic oligonucleotide
gcacacctcagacaattcggagtcattttatttcg

SEQ ID NO: 89046 - DNA, 35 bp, Artificial Sequence
  Synthetic oligonucleotide
gaagggaatggtcaatacggggtgagctggtaagg

SEQ ID NO: 89047 - DNA, 35 bp, Artificial Sequence
  Synthetic oligonucleotide
tatgcaccacatactccgctaaaattccgaacagg

SEQ ID NO: 89048 - DNA, 35 bp, Artificial Sequence
  Synthetic oligonucleotide
atgtggtggtgagtcccacgggaaggatggggagg

SEQ ID NO: 89049 - DNA, 35 bp, Artificial Sequence
  Synthetic oligonucleotide
tccgacactcctctagtcccacaacagacttgggg

SEQ ID NO: 89050 - DNA, 35 bp, Artificial Sequence
  Synthetic oligonucleotide
acacgggagggcgagttagtcttgcattaaatggg

SEQ ID NO: 89051 - DNA, 34 bp, Artificial Sequence
  Synthetic oligonucleotide
ttgccccctcgcatgcgctggtctacggttctgg

SEQ ID NO: 89052 - DNA, 35 bp, Artificial Sequence
  Synthetic oligonucleotide
ttagatcgctccctgtagcctcacttgcaccttgg

SEQ ID NO: 89053 - DNA, 35 bp, Artificial Sequence
  Synthetic oligonucleotide
gactgcgggggggtctttctggtcacgacgagctg

SEQ ID NO: 89054 - DNA, 35 bp, Artificial Sequence
  Synthetic oligonucleotide
taatggcgaggcgaggagataggctgggggaagtg

SEQ ID NO: 89055 - DNA, 35 bp, Artificial Sequence
  Synthetic oligonucleotide
aattgaggcgaacaagaatattgggggagaatgtg

SEQ ID NO: 89056 - DNA, 35 bp, Artificial Sequence
  Synthetic oligonucleotide
gtgtcgagtgcaaaggtggtaattgcttaattgtg

SEQ ID NO: 89057 - DNA, 35 bp, Artificial Sequence
  Synthetic oligonucleotide
acttcgctaactgcccctataggttaaccagcttg

SEQ ID NO: 89058 - DNA, 35 bp, Artificial Sequence
  Synthetic oligonucleotide
gtacacgctattccccgttcgagttacacattaat

SEQ ID NO: 89059 - DNA, 35 bp, Artificial Sequence
  Synthetic oligonucleotide
tcccggccggtagcctcgcacgttacgcataccat

SEQ ID NO: 89060 - DNA, 35 bp, Artificial Sequence
  Synthetic oligonucleotide
gatgttcggccccataccatgcactgctcctgcat

SEQ ID NO: 89061 - DNA, 35 bp, Artificial Sequence
  Synthetic oligonucleotide
caccacaccagcctctatttccctgttctttagat

SEQ ID NO: 89062 - DNA, 35 bp, Artificial Sequence
  Synthetic oligonucleotide
actccctgaatgagacggaagacagacttgatact

SEQ ID NO: 89063 - DNA, 35 bp, Artificial Sequence
  Synthetic oligonucleotide
ggtgaaacgaacgtgactcagccacccgtgaccct

SEQ ID NO: 89064 - DNA, 35 bp, Artificial Sequence
  Synthetic oligonucleotide
ataacacccgtttgccacgtaatatgacatggcct

SEQ ID NO: 89065 - DNA, 35 bp, Artificial Sequence
  Synthetic oligonucleotide
gtatggccccactcgataacgtcccgttgttgcct

SEQ ID NO: 89066 - DNA, 35 bp, Artificial Sequence
  Synthetic oligonucleotide
aacacgggttggaacggaggggatgacaatcggct

SEQ ID NO: 89067 - DNA, 35 bp, Artificial Sequence
  Synthetic oligonucleotide
agcattgctccatcagcgcatgtcactttaacggt

SEQ ID NO: 89068 - DNA, 35 bp, Artificial Sequence
  Synthetic oligonucleotide
gaaccgtcctctccgatcactgctattctccttgt

SEQ ID NO: 89069 - DNA, 35 bp, Artificial Sequence
  Synthetic oligonucleotide
gcacacggcggtgcaaaatactttaccctggaatt

SEQ ID NO: 89070 - DNA, 35 bp, Artificial Sequence
  Synthetic oligonucleotide
gtacccgccgctcattcacattcctcgcggacgtt

SEQ ID NO: 89071 - DNA, 35 bp, Artificial Sequence
  Synthetic oligonucleotide
agcgaccgggagccgtcgcctcatctacttcggtt

SEQ ID NO: 89072 - DNA, 35 bp, Artificial Sequence
  Synthetic oligonucleotide
ttagccaacctcccccttggccgtagtcactcttt

SEQ ID NO: 89073 - DNA, 36 bp, Artificial Sequence
  Synthetic oligonucleotide
ggaaaaaggaggggcgaggtataaaaatcgacaaaa

SEQ ID NO: 89074 - DNA, 36 bp, Artificial Sequence
  Synthetic oligonucleotide
accctcctacgtgacctatgtctggatttaccgaaa

SEQ ID NO: 89075 - DNA, 35 bp, Artificial Sequence
  Synthetic oligonucleotide
tcccactcgccccgtacgccctaactcgttgtgaa

SEQ ID NO: 89076 - DNA, 36 bp, Artificial Sequence
  Synthetic oligonucleotide
tcttcacccgctgagccgtgcccctgcctactttaa

SEQ ID NO: 89077 - DNA, 35 bp, Artificial Sequence
  Synthetic oligonucleotide
tgacgagccgcccacatctgccatcgctccccaca

SEQ ID NO: 89078 - DNA, 35 bp, Artificial Sequence
  Synthetic oligonucleotide
ttatacccccgttgaagtactgccacctgcgcaca

SEQ ID NO: 89079 - DNA, 35 bp, Artificial Sequence
  Synthetic oligonucleotide
gagaggagctgcttacgaacgtgagggggctgaca

SEQ ID NO: 89080 - DNA, 36 bp, Artificial Sequence
  Synthetic oligonucleotide
tctcatgcgctcctcacagcggcttgtcaccaacca

SEQ ID NO: 89081 - DNA, 35 bp, Artificial Sequence
  Synthetic oligonucleotide
gaaccgcaggaatattccggacgctagggccccca

SEQ ID NO: 89082 - DNA, 35 bp, Artificial Sequence
  Synthetic oligonucleotide
gcgatgcaattccgcctatttaacagtagatgcca

SEQ ID NO: 89083 - DNA, 35 bp, Artificial Sequence
  Synthetic oligonucleotide
agcacgttcactatcatatgcctgttcccttgcca

SEQ ID NO: 89084 - DNA, 36 bp, Artificial Sequence
  Synthetic oligonucleotide
acacacgcacgaactagtccatatcgttttcaagca

SEQ ID NO: 89085 - DNA, 36 bp, Artificial Sequence
  Synthetic oligonucleotide
tcctgttccatctggtatatcgtgtccacccaggca

SEQ ID NO: 89086 - DNA, 36 bp, Artificial Sequence
  Synthetic oligonucleotide
tacgacccacattacaaggtgcatacttgataatca

SEQ ID NO: 89087 - DNA, 35 bp, Artificial Sequence
  Synthetic oligonucleotide
gatctcggacagccatacccacccgtacatagtca

SEQ ID NO: 89088 - DNA, 37 bp, Artificial Sequence
  Synthetic oligonucleotide
gttgggacgacccattttaggttatgagaggacaaga

SEQ ID NO: 89089 - DNA, 37 bp, Artificial Sequence
  Synthetic oligonucleotide
gacgtggggcaaggcagttcgggagagtaagcgaaga

SEQ ID NO: 89090 - DNA, 37 bp, Artificial Sequence
  Synthetic oligonucleotide
gtaatggaagaggagagcatgaaagaggcggtacaga

SEQ ID NO: 89091 - DNA, 37 bp, Artificial Sequence
  Synthetic oligonucleotide
atgtagtgaggaggtgttagcgagagcgtatgagaga

SEQ ID NO: 89092 - DNA, 37 bp, Artificial Sequence
  Synthetic oligonucleotide
atcggtggatggaggggaaagtaggcgcacgcataga

SEQ ID NO: 89093 - DNA, 36 bp, Artificial Sequence
  Synthetic oligonucleotide
taacacaatccgtgaacagtgacgtcttcctcacga

SEQ ID NO: 89094 - DNA, 37 bp, Artificial Sequence
  Synthetic oligonucleotide
gagcccaaagcagggccatctcttacctccgttacga

SEQ ID NO: 89095 - DNA, 37 bp, Artificial Sequence
  Synthetic oligonucleotide
gttgccgtctacctgcacctttgatcacggcccccga

SEQ ID NO: 89096 - DNA, 37 bp, Artificial Sequence
  Synthetic oligonucleotide
ttgtgtcaccatatgttagtgcgctattccctcccga

SEQ ID NO: 89097 - DNA, 36 bp, Artificial Sequence
  Synthetic oligonucleotide
ttgctgtcccatcttttgtactatgtgcaagtccga

SEQ ID NO: 89098 - DNA, 36 bp, Artificial Sequence
  Synthetic oligonucleotide
gttgccacggtggcatggggcccgcactgattccga

SEQ ID NO: 89099 - DNA, 36 bp, Artificial Sequence
  Synthetic oligonucleotide
ggcacccccgagcatccgtatcaactacctttccga

SEQ ID NO: 89100 - DNA, 37 bp, Artificial Sequence
  Synthetic oligonucleotide
taccccacggctccgactctctgatcatcctcatcga

SEQ ID NO: 89101 - DNA, 37 bp, Artificial Sequence
  Synthetic oligonucleotide
gcccgacgcaacgaccatctgagcaactgctgatcga

SEQ ID NO: 89102 - DNA, 37 bp, Artificial Sequence
  Synthetic oligonucleotide
taccacctccgctgtcgtaccgctggcctttactcga

SEQ ID NO: 89103 - DNA, 37 bp, Artificial Sequence
  Synthetic oligonucleotide
gtcaccgtaccaccagtgctggtcctcgaccgctcga

SEQ ID NO: 89104 - DNA, 37 bp, Artificial Sequence
  Synthetic oligonucleotide
agggaggaaggaaggggttaggcaatgaacaattcga

SEQ ID NO: 89105 - DNA, 36 bp, Artificial Sequence
  Synthetic oligonucleotide
gatgcacaacctgtctagatagggaatggtcgagga

SEQ ID NO: 89106 - DNA, 37 bp, Artificial Sequence
  Synthetic oligonucleotide
gtgaggtgtggaggaggcaaacggcaaggagggagga

SEQ ID NO: 89107 - DNA, 37 bp, Artificial Sequence
  Synthetic oligonucleotide
ggggcaatcgcacggtgaacagggaaacgggggagga

SEQ ID NO: 89108 - DNA, 36 bp, Artificial Sequence
  Synthetic oligonucleotide
ttgactggcgcacaatacccttgctatgaatacgga

SEQ ID NO: 89109 - DNA, 35 bp, Artificial Sequence
  Synthetic oligonucleotide
tgatcgcaatggactctttacactgtcgacaggga

SEQ ID NO: 89110 - DNA, 35 bp, Artificial Sequence
  Synthetic oligonucleotide
ttcctctgccccaaccacgtgaacacagccaggga

SEQ ID NO: 89111 - DNA, 37 bp, Artificial Sequence
  Synthetic oligonucleotide
acatccgcgaggaagaacatttcgggtaagtgaggga

SEQ ID NO: 89112 - DNA, 37 bp, Artificial Sequence
  Synthetic oligonucleotide
ggtgcggggagggattccaggggtactgcttgaggga

SEQ ID NO: 89113 - DNA, 37 bp, Artificial Sequence
  Synthetic oligonucleotide
acagacctcgcccgtatttaccatctgcaacaatgga

SEQ ID NO: 89114 - DNA, 37 bp, Artificial Sequence
  Synthetic oligonucleotide
tacgacgtgccagctatatggcatggtcgcccatgga

SEQ ID NO: 89115 - DNA, 37 bp, Artificial Sequence
  Synthetic oligonucleotide
ggagcttgcactgctcttgttgtcgttcttccctgga

SEQ ID NO: 89116 - DNA, 37 bp, Artificial Sequence
  Synthetic oligonucleotide
tcacctccactacactttcgtcctaggtaccgttgga

SEQ ID NO: 89117 - DNA, 36 bp, Artificial Sequence
  Synthetic oligonucleotide
attgcggagaagggatatcgaacaaggtaggttgga

SEQ ID NO: 89118 - DNA, 38 bp, Artificial Sequence
  Synthetic oligonucleotide
ttcgtccagacgcaggatcggaggggcgatggaaatga

SEQ ID NO: 89119 - DNA, 38 bp, Artificial Sequence
  Synthetic oligonucleotide
gacaagcagttgctctctacatacacactcagacatga

SEQ ID NO: 89120 - DNA, 38 bp, Artificial Sequence
  Synthetic oligonucleotide
agtgcgctctgctcgcccccgacgtgccccttgcatga

SEQ ID NO: 89121 - DNA, 38 bp, Artificial Sequence
  Synthetic oligonucleotide
gcaaaaggaaggcggtagtacggtaaacggcgggatga

SEQ ID NO: 89122 - DNA, 38 bp, Artificial Sequence
  Synthetic oligonucleotide
gcagggcttcagagtgaccatttaggcgggggggatga

SEQ ID NO: 89123 - DNA, 38 bp, Artificial Sequence
  Synthetic oligonucleotide
gatagccacgtacggcgggggtaaatcttaggctatga

SEQ ID NO: 89124 - DNA, 37 bp, Artificial Sequence
  Synthetic oligonucleotide
tgcgtactctcttcactctgcggacctaatagcctga

SEQ ID NO: 89125 - DNA, 38 bp, Artificial Sequence
  Synthetic oligonucleotide
tcaacaaacgcactatcgaattagccataccggcctga

SEQ ID NO: 89126 - DNA, 36 bp, Artificial Sequence
  Synthetic oligonucleotide
accttatgcgtgcccacctgccttcgagaacgctga

SEQ ID NO: 89127 - DNA, 38 bp, Artificial Sequence
  Synthetic oligonucleotide
tgccatgaggcgatgcgggctacattttccttcgctga

SEQ ID NO: 89128 - DNA, 38 bp, Artificial Sequence
  Synthetic oligonucleotide
tccatcgcgaacgccacatgtttaggagcgactgctga

SEQ ID NO: 89129 - DNA, 37 bp, Artificial Sequence
  Synthetic oligonucleotide
gtccgggccattgggagggtacgggagctggtgctga

SEQ ID NO: 89130 - DNA, 38 bp, Artificial Sequence
  Synthetic oligonucleotide
aatgtgcgggtgagggggtccgggtaagtaggctctga

SEQ ID NO: 89131 - DNA, 35 bp, Artificial Sequence
  Synthetic oligonucleotide
acgcaccccatgtcctctgctactcctttaagtga

SEQ ID NO: 89132 - DNA, 38 bp, Artificial Sequence
  Synthetic oligonucleotide
gaccggatggcggtcataagaacggtggtggagagtga

SEQ ID NO: 89133 - DNA, 38 bp, Artificial Sequence
  Synthetic oligonucleotide
gttgaacaagggcagaaggaagcacgggagatatgtga

SEQ ID NO: 89134 - DNA, 37 bp, Artificial Sequence
  Synthetic oligonucleotide
tgacggttcccaccccgacgtattctgcatactgtga

SEQ ID NO: 89135 - DNA, 37 bp, Artificial Sequence
  Synthetic oligonucleotide
atcgaggtggggccaaagtcagggagagcttgtgtga

SEQ ID NO: 89136 - DNA, 38 bp, Artificial Sequence
  Synthetic oligonucleotide
gtaggggacgggggtatgccgacgactgtagtttgtga

SEQ ID NO: 89137 - DNA, 38 bp, Artificial Sequence
  Synthetic oligonucleotide
gaatcaagaaggagtgggatcgagagcaagtcaattga

SEQ ID NO: 89138 - DNA, 38 bp, Artificial Sequence
  Synthetic oligonucleotide
gcaaacggaagttgccgcctttactaacctcacattga

SEQ ID NO: 89139 - DNA, 37 bp, Artificial Sequence
  Synthetic oligonucleotide
gaccgccgcaactatttgtcccttccaagttacttga

SEQ ID NO: 89140 - DNA, 38 bp, Artificial Sequence
  Synthetic oligonucleotide
aaccgggggaaggggggagtgcgtgagggtacgcttga

SEQ ID NO: 89141 - DNA, 38 bp, Artificial Sequence
  Synthetic oligonucleotide
gagttgcactgggcgtatggtgtccaccactctgttga

SEQ ID NO: 89142 - DNA, 38 bp, Artificial Sequence
  Synthetic oligonucleotide
gttagctgcatggaaggggaggatagtgtgggatttga

SEQ ID NO: 89143 - DNA, 36 bp, Artificial Sequence
  Synthetic oligonucleotide
gcatacaaccatcagacttgagggtgatctaacata

SEQ ID NO: 89144 - DNA, 35 bp, Artificial Sequence
  Synthetic oligonucleotide
aatccggggggggtggctggacgcaggaagtcata

SEQ ID NO: 89145 - DNA, 36 bp, Artificial Sequence
  Synthetic oligonucleotide
gatcgggtgggacggggtaaggtgagtggcgagcta

SEQ ID NO: 89146 - DNA, 35 bp, Artificial Sequence
  Synthetic oligonucleotide
aacgccccttcatcaatctagtctcgcaatagcta

SEQ ID NO: 89147 - DNA, 36 bp, Artificial Sequence
  Synthetic oligonucleotide
tcagcaagcgagcatttccggccattcacacaagta

SEQ ID NO: 89148 - DNA, 36 bp, Artificial Sequence
  Synthetic oligonucleotide
tggagatgcgcggccactgcacctcactgtacggta

SEQ ID NO: 89149 - DNA, 35 bp, Artificial Sequence
  Synthetic oligonucleotide
gctgattggcgggggggagctgacagtcgagggta

SEQ ID NO: 89150 - DNA, 36 bp, Artificial Sequence
  Synthetic oligonucleotide
ggtgcggagctaaggctcgaaaaaatggggggggta

SEQ ID NO: 89151 - DNA, 36 bp, Artificial Sequence
  Synthetic oligonucleotide
gcgcatcccgcacgtccacgataacccataccttta

SEQ ID NO: 89152 - DNA, 35 bp, Artificial Sequence
  Synthetic oligonucleotide
tgtcgacgccagggaccgtcttgccgccttgttta

SEQ ID NO: 89153 - DNA, 35 bp, Artificial Sequence
  Synthetic oligonucleotide
tctcacgactacgatggcacatgcactttttccac

SEQ ID NO: 89154 - DNA, 35 bp, Artificial Sequence
  Synthetic oligonucleotide
gccacatcctacactccggcctccccgagccgtac

SEQ ID NO: 89155 - DNA, 35 bp, Artificial Sequence
  Synthetic oligonucleotide
gcatcgcgcgcttttccccgggtgctagctttacc

SEQ ID NO: 89156 - DNA, 35 bp, Artificial Sequence
  Synthetic oligonucleotide
gcataaagcctcccctgctagagatcacgcgcccc

SEQ ID NO: 89157 - DNA, 35 bp, Artificial Sequence
  Synthetic oligonucleotide
gaaaaggccacctcaaacgcattgttcaatcgccc

SEQ ID NO: 89158 - DNA, 35 bp, Artificial Sequence
  Synthetic oligonucleotide
atgcactacacgtactccaggaggatcgtgtttcc

SEQ ID NO: 89159 - DNA, 35 bp, Artificial Sequence
  Synthetic oligonucleotide
acgtgacagggggagaactgaggggaccattgagc

SEQ ID NO: 89160 - DNA, 35 bp, Artificial Sequence
  Synthetic oligonucleotide
tgccacctttcaatgcttttgtggagcgatttcgc

SEQ ID NO: 89161 - DNA, 35 bp, Artificial Sequence
  Synthetic oligonucleotide
gaacgcatctgacttccggttacctccatctatgc

SEQ ID NO: 89162 - DNA, 35 bp, Artificial Sequence
  Synthetic oligonucleotide
gacttgccacttggtatcatgtggctaccttactc

SEQ ID NO: 89163 - DNA, 35 bp, Artificial Sequence
  Synthetic oligonucleotide
gtccacatacgatcttgctgggccgttacacattc

SEQ ID NO: 89164 - DNA, 35 bp, Artificial Sequence
  Synthetic oligonucleotide
ttcatccacggtcatcaggcaattcttctgggttc

SEQ ID NO: 89165 - DNA, 35 bp, Artificial Sequence
  Synthetic oligonucleotide
acaaactgccggcgtactccctatttgaaccacag

SEQ ID NO: 89166 - DNA, 35 bp, Artificial Sequence
  Synthetic oligonucleotide
tatcatgggtgcactcagggagcatgggggtggag

SEQ ID NO: 89167 - DNA, 35 bp, Artificial Sequence
  Synthetic oligonucleotide
gcctctcgcaccaagacatgatatctgcaaacacg

SEQ ID NO: 89168 - DNA, 35 bp, Artificial Sequence
  Synthetic oligonucleotide
gacgatgacgtcctatccgttattataatcatccg

SEQ ID NO: 89169 - DNA, 34 bp, Artificial Sequence
  Synthetic oligonucleotide
gtgaaggggagtagcgggaaacgtgagcatatcg

SEQ ID NO: 89170 - DNA, 35 bp, Artificial Sequence
  Synthetic oligonucleotide
atgacacaccaagacgggacggaccaggcgtaggg

SEQ ID NO: 89171 - DNA, 35 bp, Artificial Sequence
  Synthetic oligonucleotide
tcacctaggcccgcccttctcagaaacaccctggg

SEQ ID NO: 89172 - DNA, 35 bp, Artificial Sequence
  Synthetic oligonucleotide
ggtgcccgaacctgaggccgtttatcctacccatg

SEQ ID NO: 89173 - DNA, 35 bp, Artificial Sequence
  Synthetic oligonucleotide
acctatcccacgtgagttgctccataatacatctg

SEQ ID NO: 89174 - DNA, 35 bp, Artificial Sequence
  Synthetic oligonucleotide
tcagcacagttccttatattgcgtttcctttagtg

SEQ ID NO: 89175 - DNA, 35 bp, Artificial Sequence
  Synthetic oligonucleotide
gtggggctaaatgccagcatggatcatacacacat

SEQ ID NO: 89176 - DNA, 35 bp, Artificial Sequence
  Synthetic oligonucleotide
atacccaccacaatctgacagtaagacgcttgcat

SEQ ID NO: 89177 - DNA, 35 bp, Artificial Sequence
  Synthetic oligonucleotide
gctgttaccctcactccccggccgacgcagtcgat

SEQ ID NO: 89178 - DNA, 35 bp, Artificial Sequence
  Synthetic oligonucleotide
taagctgggcgggaagcaaagttatggggatgtat

SEQ ID NO: 89179 - DNA, 35 bp, Artificial Sequence
  Synthetic oligonucleotide
gtcctcactcagctttttacacatgttggcacact

SEQ ID NO: 89180 - DNA, 35 bp, Artificial Sequence
  Synthetic oligonucleotide
tctgtgagccgctccactaacaacttcgtacgact

SEQ ID NO: 89181 - DNA, 35 bp, Artificial Sequence
  Synthetic oligonucleotide
acacgtgaggggggtgagggttgggggacttacct

SEQ ID NO: 89182 - DNA, 35 bp, Artificial Sequence
  Synthetic oligonucleotide
tatgggggtgaggggcattaattgcttgagtggct

SEQ ID NO: 89183 - DNA, 35 bp, Artificial Sequence
  Synthetic oligonucleotide
agcaaccgattgtccctggtcggccatatattgct

SEQ ID NO: 89184 - DNA, 35 bp, Artificial Sequence
  Synthetic oligonucleotide
tccccgataagccgggattgtcgtaccataattct

SEQ ID NO: 89185 - DNA, 35 bp, Artificial Sequence
  Synthetic oligonucleotide
gctgacgagggcaaggggaagggatacgtgggagt

SEQ ID NO: 89186 - DNA, 35 bp, Artificial Sequence
  Synthetic oligonucleotide
agaccaccccccatacatacttcctcatcagtatt

SEQ ID NO: 89187 - DNA, 35 bp, Artificial Sequence
  Synthetic oligonucleotide
gagcgggtttaagggggggttatagggaacgcgtt

SEQ ID NO: 89188 - DNA, 35 bp, Artificial Sequence
  Synthetic oligonucleotide
tgccgtgcgtgactatcttcaaaacacacctcgtt

SEQ ID NO: 89189 - DNA, 35 bp, Artificial Sequence
  Synthetic oligonucleotide
acacctacgtgccgtggagtcttagttctcctgtt

SEQ ID NO: 89190 - DNA, 35 bp, Artificial Sequence
  Synthetic oligonucleotide
tcaagggtggttggggaggatgaattcaagggaaa

SEQ ID NO: 89191 - DNA, 36 bp, Artificial Sequence
  Synthetic oligonucleotide
gaggggagcttaggggggtctgctacgggctggaaa

SEQ ID NO: 89192 - DNA, 36 bp, Artificial Sequence
  Synthetic oligonucleotide
gatgtaggaggctggagataatagagggatgcccaa

SEQ ID NO: 89193 - DNA, 36 bp, Artificial Sequence
  Synthetic oligonucleotide
gttgccgcagaggcatatcactatagctccatcgaa

SEQ ID NO: 89194 - DNA, 36 bp, Artificial Sequence
  Synthetic oligonucleotide
gtcacggggggggcaggtttcacagggatctgggaa

SEQ ID NO: 89195 - DNA, 36 bp, Artificial Sequence
  Synthetic oligonucleotide
ttacccccacctagttttgcaaacaccacagttgaa

SEQ ID NO: 89196 - DNA, 36 bp, Artificial Sequence
  Synthetic oligonucleotide
tggagacgggtagtggtggaaagtaagcgaaggaca

SEQ ID NO: 89197 - DNA, 36 bp, Artificial Sequence
  Synthetic oligonucleotide
gccaattgcgcatggccgcataatccaggaactaca

SEQ ID NO: 89198 - DNA, 35 bp, Artificial Sequence
  Synthetic oligonucleotide
ttagccggcgacattgcactttacccattgcgcca

SEQ ID NO: 89199 - DNA, 36 bp, Artificial Sequence
  Synthetic oligonucleotide
gtgaccggaccccagcttgcggaagaagggctgcca

SEQ ID NO: 89200 - DNA, 36 bp, Artificial Sequence
  Synthetic oligonucleotide
attgtgcgcatttgacctttcatcctataactggca

SEQ ID NO: 89201 - DNA, 36 bp, Artificial Sequence
  Synthetic oligonucleotide
tgctcaggcaatgacctcaccctccgcacgttatca

SEQ ID NO: 89202 - DNA, 36 bp, Artificial Sequence
  Synthetic oligonucleotide
gcatccctccgttgtactcgatgcccgtttatctca

SEQ ID NO: 89203 - DNA, 35 bp, Artificial Sequence
  Synthetic oligonucleotide
accctgtccccaccccatgcgactcgttgctctca

SEQ ID NO: 89204 - DNA, 36 bp, Artificial Sequence
  Synthetic oligonucleotide
gcagtcctccttccgtctaccagtcgcgcggcttca

SEQ ID NO: 89205 - DNA, 35 bp, Artificial Sequence
  Synthetic oligonucleotide
tcaagaggaggaatgattgtgacgagggtggcaga

SEQ ID NO: 89206 - DNA, 37 bp, Artificial Sequence
  Synthetic oligonucleotide
tctcgaggagtgggtgcggtcaaggggggtccggaga

SEQ ID NO: 89207 - DNA, 37 bp, Artificial Sequence
  Synthetic oligonucleotide
gtgtgtgcggagttggacaaaagaacagtgggtgaga

SEQ ID NO: 89208 - DNA, 36 bp, Artificial Sequence
  Synthetic oligonucleotide
tccccgatccctagccttccgagaacgcccaataga

SEQ ID NO: 89209 - DNA, 37 bp, Artificial Sequence
  Synthetic oligonucleotide
aaaggtaggaggaagggagagtagtcttacagctaga

SEQ ID NO: 89210 - DNA, 37 bp, Artificial Sequence
  Synthetic oligonucleotide
tgatggcataagggaggtaggaggcggccagggtaga

SEQ ID NO: 89211 - DNA, 37 bp, Artificial Sequence
  Synthetic oligonucleotide
gcacgataatcatgtatgccgaacttctccaccacga

SEQ ID NO: 89212 - DNA, 37 bp, Artificial Sequence
  Synthetic oligonucleotide
gcaggtggggttaggggagatctggtagagtggacga

SEQ ID NO: 89213 - DNA, 37 bp, Artificial Sequence
  Synthetic oligonucleotide
ttggcaaagaaggtagggaggggctgcagcaatacga

SEQ ID NO: 89214 - DNA, 37 bp, Artificial Sequence
  Synthetic oligonucleotide
tagaccccacagctgaaacaacgcagtgaacaaccga

SEQ ID NO: 89215 - DNA, 36 bp, Artificial Sequence
  Synthetic oligonucleotide
ttacgcccgcagacattttggcctcagaaaacccga

SEQ ID NO: 89216 - DNA, 37 bp, Artificial Sequence
  Synthetic oligonucleotide
gagtcgccgtcgaacggttccgagtccatcttgccga

SEQ ID NO: 89217 - DNA, 37 bp, Artificial Sequence
  Synthetic oligonucleotide
atccgaagctctcagataggcctcctccgaccctcga

SEQ ID NO: 89218 - DNA, 37 bp, Artificial Sequence
  Synthetic oligonucleotide
gatcactgacgcaattgtaactcgtttgacagaagga

SEQ ID NO: 89219 - DNA, 37 bp, Artificial Sequence
  Synthetic oligonucleotide
gaagcctcgccaccgcgaccctagaacatttgaagga

SEQ ID NO: 89220 - DNA, 36 bp, Artificial Sequence
  Synthetic oligonucleotide
agcgacgcacagcagggggggtacgggtatttagga

SEQ ID NO: 89221 - DNA, 37 bp, Artificial Sequence
  Synthetic oligonucleotide
gtacgcaactaaggggcggagagggcgttatcacgga

SEQ ID NO: 89222 - DNA, 35 bp, Artificial Sequence
  Synthetic oligonucleotide
tacgggccaggtcgcgcatttgctttcacaccgga

SEQ ID NO: 89223 - DNA, 37 bp, Artificial Sequence
  Synthetic oligonucleotide
tgctaaaggggcgggaagggtaagtcgtgcaagggga

SEQ ID NO: 89224 - DNA, 37 bp, Artificial Sequence
  Synthetic oligonucleotide
gatcgcaaagtgaacggggggccggcttgtactggga

SEQ ID NO: 89225 - DNA, 35 bp, Artificial Sequence
  Synthetic oligonucleotide
aacacctggttgcgcttcactttacctccgctgga

SEQ ID NO: 89226 - DNA, 36 bp, Artificial Sequence
  Synthetic oligonucleotide
gagtagacgaccgctttctgtttgggctattctgga

SEQ ID NO: 89227 - DNA, 38 bp, Artificial Sequence
  Synthetic oligonucleotide
acacgcagaagaatgagaaatatggctaggattgatga

SEQ ID NO: 89228 - DNA, 37 bp, Artificial Sequence
  Synthetic oligonucleotide
accaagcccgagatcgttcccgccccattgtgactga

SEQ ID NO: 89229 - DNA, 36 bp, Artificial Sequence
  Synthetic oligonucleotide
gcattacattcctgcctactctccagacgctactga

SEQ ID NO: 89230 - DNA, 37 bp, Artificial Sequence
  Synthetic oligonucleotide
tgccgaccgcccccgtctgataggctacctgacctga

SEQ ID NO: 89231 - DNA, 37 bp, Artificial Sequence
  Synthetic oligonucleotide
acctacagcatccggcaagtaaacctcgtcaccctga

SEQ ID NO: 89232 - DNA, 37 bp, Artificial Sequence
  Synthetic oligonucleotide
atcgaagcggtcgaatcgcctagtagaatcctcctga

SEQ ID NO: 89233 - DNA, 37 bp, Artificial Sequence
  Synthetic oligonucleotide
gatgcaggtgcttttgtattacgtttactgcagctga

SEQ ID NO: 89234 - DNA, 37 bp, Artificial Sequence
  Synthetic oligonucleotide
tatgagggatggttggtgtgcaggactgggcggctga

SEQ ID NO: 89235 - DNA, 37 bp, Artificial Sequence
  Synthetic oligonucleotide
ttgctgctacaccctcacgcgcgtaaagtacttctga

SEQ ID NO: 89236 - DNA, 38 bp, Artificial Sequence
  Synthetic oligonucleotide
actgcccccggctttgtttgaatcggacccctttctga

SEQ ID NO: 89237 - DNA, 38 bp, Artificial Sequence
  Synthetic oligonucleotide
gcaaaccccgtcctcggcgtagtccaaccattttctga

SEQ ID NO: 89238 - DNA, 38 bp, Artificial Sequence
  Synthetic oligonucleotide
attccagccgggaggacgagggagtgcgagaccagtga

SEQ ID NO: 89239 - DNA, 38 bp, Artificial Sequence
  Synthetic oligonucleotide
agcaacaccgcaatctggttcggtcctcaacatggtga

SEQ ID NO: 89240 - DNA, 37 bp, Artificial Sequence
  Synthetic oligonucleotide
gagcagaagcatgatagggaagggggttctttggtga

SEQ ID NO: 89241 - DNA, 38 bp, Artificial Sequence
  Synthetic oligonucleotide
gctacaccgacgcccgggaacaacatcgtagacattga

SEQ ID NO: 89242 - DNA, 38 bp, Artificial Sequence
  Synthetic oligonucleotide
tcccgaacacaccttcagcatcaattaaggcccattga

SEQ ID NO: 89243 - DNA, 38 bp, Artificial Sequence
  Synthetic oligonucleotide
gaggagagtggggcacaggggcgttggagcgcgattga

SEQ ID NO: 89244 - DNA, 38 bp, Artificial Sequence
  Synthetic oligonucleotide
tacgaacccacacctgttctaagccatgtcctgcttga

SEQ ID NO: 89245 - DNA, 38 bp, Artificial Sequence
  Synthetic oligonucleotide
gactcacatcaatgcagatagcacgctccatttcttga

SEQ ID NO: 89246 - DNA, 38 bp, Artificial Sequence
  Synthetic oligonucleotide
tgttcatggcgtgggtgaggctagtgtgtcggtgttga

SEQ ID NO: 89247 - DNA, 37 bp, Artificial Sequence
  Synthetic oligonucleotide
gccggtatcacgatagggatgccctacaccttgttga

SEQ ID NO: 89248 - DNA, 38 bp, Artificial Sequence
  Synthetic oligonucleotide
acacgccatatcatcggttgctaccaagaatcgtttga

SEQ ID NO: 89249 - DNA, 35 bp, Artificial Sequence
  Synthetic oligonucleotide
ttaatgcccctgacgtaatgggatcttatgctata

SEQ ID NO: 89250 - DNA, 36 bp, Artificial Sequence
  Synthetic oligonucleotide
gccgaggtcagcaccgttactagtcccatcgttata

SEQ ID NO: 89251 - DNA, 35 bp, Artificial Sequence
  Synthetic oligonucleotide
gcatgaccactcgcacactcatctgcgagaaacta

SEQ ID NO: 89252 - DNA, 35 bp, Artificial Sequence
  Synthetic oligonucleotide
tctgggggccgagactctatctatcttgggaacta

SEQ ID NO: 89253 - DNA, 36 bp, Artificial Sequence
  Synthetic oligonucleotide
tccgatgcgtccacttcatacgtgccaagtctacta

SEQ ID NO: 89254 - DNA, 36 bp, Artificial Sequence
  Synthetic oligonucleotide
gacaggagaagagcaaaaaagagctggagtaaccta

SEQ ID NO: 89255 - DNA, 35 bp, Artificial Sequence
  Synthetic oligonucleotide
gccaccatcaccctaggtccccgaatcaggcccta

SEQ ID NO: 89256 - DNA, 36 bp, Artificial Sequence
  Synthetic oligonucleotide
taccagccagccgtctttaatgtttgccccgtccta

SEQ ID NO: 89257 - DNA, 36 bp, Artificial Sequence
  Synthetic oligonucleotide
gtgcaccacaggcggtggaaccgataactgatgcta

SEQ ID NO: 89258 - DNA, 36 bp, Artificial Sequence
  Synthetic oligonucleotide
gatgtccgagtgcgagcgaaccgttcttccctgcta

SEQ ID NO: 89259 - DNA, 36 bp, Artificial Sequence
  Synthetic oligonucleotide
actggccgatcattccgtcacaaggcctcgactcta

SEQ ID NO: 89260 - DNA, 36 bp, Artificial Sequence
  Synthetic oligonucleotide
acacatcggtccattagcctacctgctgaccttgta

SEQ ID NO: 89261 - DNA, 35 bp, Artificial Sequence
  Synthetic oligonucleotide
gcgcaatcattccacctgatatcgccgccacatta

SEQ ID NO: 89262 - DNA, 36 bp, Artificial Sequence
  Synthetic oligonucleotide
gaacccgccatctgcattatgaatctactttgatta

SEQ ID NO: 89263 - DNA, 36 bp, Artificial Sequence
  Synthetic oligonucleotide
acacgttagcaggtcgttacttactccgctttatta

SEQ ID NO: 89264 - DNA, 35 bp, Artificial Sequence
  Synthetic oligonucleotide
atggtgtaggagcgggggtgatggatgaataaaac

SEQ ID NO: 89265 - DNA, 35 bp, Artificial Sequence
  Synthetic oligonucleotide
ggtgacccaatgctttctacggctaaagcacacac

SEQ ID NO: 89266 - DNA, 35 bp, Artificial Sequence
  Synthetic oligonucleotide
tcaacaccaactctgacgatagtcgcctgtcccac

SEQ ID NO: 89267 - DNA, 35 bp, Artificial Sequence
  Synthetic oligonucleotide
tccaccttcagcctcgtccgccatccactcgtcac

SEQ ID NO: 89268 - DNA, 35 bp, Artificial Sequence
  Synthetic oligonucleotide
tttcaccctggcaatggtacttgtgcactcccgac

SEQ ID NO: 89269 - DNA, 35 bp, Artificial Sequence
  Synthetic oligonucleotide
atccgaagccatgcccacagttaataaggctgtac

SEQ ID NO: 89270 - DNA, 35 bp, Artificial Sequence
  Synthetic oligonucleotide
tgcaacggtcgatattcctggcctatcggatcacc

SEQ ID NO: 89271 - DNA, 35 bp, Artificial Sequence
  Synthetic oligonucleotide
gataacaccacgtctcctcaatgctctgttggccc

SEQ ID NO: 89272 - DNA, 35 bp, Artificial Sequence
  Synthetic oligonucleotide
attcgtcgcgatcttgaaccaccccgctttaagcc

SEQ ID NO: 89273 - DNA, 34 bp, Artificial Sequence
  Synthetic oligonucleotide
taacatccgcgctttaagttttctgtacacgtcc

SEQ ID NO: 89274 - DNA, 35 bp, Artificial Sequence
  Synthetic oligonucleotide
tcaacaccaaacatatgggaggtatccctgggtcc

SEQ ID NO: 89275 - DNA, 35 bp, Artificial Sequence
  Synthetic oligonucleotide
tatagcgcacttcttaatcacgtggcgtcgtttcc

SEQ ID NO: 89276 - DNA, 35 bp, Artificial Sequence
  Synthetic oligonucleotide
gtgtgtgtcggccttttcgaatgtaggcttcccgc

SEQ ID NO: 89277 - DNA, 35 bp, Artificial Sequence
  Synthetic oligonucleotide
gggtggtcgcacatttttcccaccgacaacgtggc

SEQ ID NO: 89278 - DNA, 35 bp, Artificial Sequence
  Synthetic oligonucleotide
tcatgcaaacgccttccggacgtacgaccccatgc

SEQ ID NO: 89279 - DNA, 35 bp, Artificial Sequence
  Synthetic oligonucleotide
agttcacactcacacccagcactgcacttctatgc

SEQ ID NO: 89280 - DNA, 35 bp, Artificial Sequence
  Synthetic oligonucleotide
gtcgcacccctcaattaactggcttgaaggcttgc

SEQ ID NO: 89281 - DNA, 35 bp, Artificial Sequence
  Synthetic oligonucleotide
atgcgtttcgtcgccctttttatcggtacaccatc

SEQ ID NO: 89282 - DNA, 35 bp, Artificial Sequence
  Synthetic oligonucleotide
gatgcccacccgcggtgtttcgcttgtcaagactc

SEQ ID NO: 89283 - DNA, 35 bp, Artificial Sequence
  Synthetic oligonucleotide
gaagcatcactatccgcgatactttgacattggtc

SEQ ID NO: 89284 - DNA, 35 bp, Artificial Sequence
  Synthetic oligonucleotide
ggtgatcatccgccattttgttcccgagttttgtc

SEQ ID NO: 89285 - DNA, 35 bp, Artificial Sequence
  Synthetic oligonucleotide
agggattgggtgggtggggttcaaccgagaagttc

SEQ ID NO: 89286 - DNA, 35 bp, Artificial Sequence
  Synthetic oligonucleotide
atgtggggggctagatcaagcgatgatggaggttc

SEQ ID NO: 89287 - DNA, 35 bp, Artificial Sequence
  Synthetic oligonucleotide
tgagacgccgcacgctcgcctggcccttccctttc

SEQ ID NO: 89288 - DNA, 35 bp, Artificial Sequence
  Synthetic oligonucleotide
gatgctcccctgtgaatgcaccgtcctcatagaag

SEQ ID NO: 89289 - DNA, 35 bp, Artificial Sequence
  Synthetic oligonucleotide
ggtggaactgatgatatgattggaggggagttcag

SEQ ID NO: 89290 - DNA, 35 bp, Artificial Sequence
  Synthetic oligonucleotide
atggggcggatatcaaggagttcggtggggaggag

SEQ ID NO: 89291 - DNA, 35 bp, Artificial Sequence
  Synthetic oligonucleotide
acagtgcacatacggtgttaaattcccctgtcacg

SEQ ID NO: 89292 - DNA, 35 bp, Artificial Sequence
  Synthetic oligonucleotide
tgccatcacacttcggttcaagctgtaacaagccg

SEQ ID NO: 89293 - DNA, 35 bp, Artificial Sequence
  Synthetic oligonucleotide
tcttacccccctgatctgacaactcagagactgcg

SEQ ID NO: 89294 - DNA, 35 bp, Artificial Sequence
  Synthetic oligonucleotide
ttcgcaccaacaatcccaacgggctcattttatcg

SEQ ID NO: 89295 - DNA, 35 bp, Artificial Sequence
  Synthetic oligonucleotide
agagactgattgcaaacttggggagaggtttctcg

SEQ ID NO: 89296 - DNA, 35 bp, Artificial Sequence
  Synthetic oligonucleotide
ggggccgaagggagtatcagggtaaggaatgaagg

SEQ ID NO: 89297 - DNA, 35 bp, Artificial Sequence
  Synthetic oligonucleotide
gacacatgagggtgcaagagtagcttttaccaatg

SEQ ID NO: 89298 - DNA, 35 bp, Artificial Sequence
  Synthetic oligonucleotide
taactcagccggcgactaactgacacctgggaaat

SEQ ID NO: 89299 - DNA, 35 bp, Artificial Sequence
  Synthetic oligonucleotide
tactgtgcctgccacacgtttcatgtacatgaaat

SEQ ID NO: 89300 - DNA, 34 bp, Artificial Sequence
  Synthetic oligonucleotide
tatggtcacctagtatgcctttcatttagcccat

SEQ ID NO: 89301 - DNA, 35 bp, Artificial Sequence
  Synthetic oligonucleotide
atcatctccacgttgtagcctcgcccgctttgcat

SEQ ID NO: 89302 - DNA, 35 bp, Artificial Sequence
  Synthetic oligonucleotide
gaccatccggtgacctctatggtcagtgaatctat

SEQ ID NO: 89303 - DNA, 35 bp, Artificial Sequence
  Synthetic oligonucleotide
tacccagcccccgtactatgcaggcaacatttgct

SEQ ID NO: 89304 - DNA, 35 bp, Artificial Sequence
  Synthetic oligonucleotide
gtcgggagggtgcgggatgatcggggggccatggt

SEQ ID NO: 89305 - DNA, 34 bp, Artificial Sequence
  Synthetic oligonucleotide
ttgaatcgcgctagccctataatttccatttggt

SEQ ID NO: 89306 - DNA, 35 bp, Artificial Sequence
  Synthetic oligonucleotide
gccccgccgcgcactcctttttggctgcttacatt

SEQ ID NO: 89307 - DNA, 35 bp, Artificial Sequence
  Synthetic oligonucleotide
gtgcatccaccgtttttcctttcagttagatcctt

SEQ ID NO: 89308 - DNA, 35 bp, Artificial Sequence
  Synthetic oligonucleotide
tgtacaccaacggtggttacaaggctttattcctt

SEQ ID NO: 89309 - DNA, 35 bp, Artificial Sequence
  Synthetic oligonucleotide
gcctccccctgctgtaaccgaataggtatcgtgtt

SEQ ID NO: 89310 - DNA, 35 bp, Artificial Sequence
  Synthetic oligonucleotide
gcgatccagacgcaaaccgcgtaaatctgatattt

SEQ ID NO: 89311 - DNA, 36 bp, Artificial Sequence
  Synthetic oligonucleotide
tgacacctggatgctccccgtacccgtaaaccacaa

SEQ ID NO: 89312 - DNA, 35 bp, Artificial Sequence
  Synthetic oligonucleotide
tactcccgcacctgttcatctaagctccgcctcaa

SEQ ID NO: 89313 - DNA, 36 bp, Artificial Sequence
  Synthetic oligonucleotide
atcgtgccggggagtttgcagggaattggaagcgaa

SEQ ID NO: 89314 - DNA, 35 bp, Artificial Sequence
  Synthetic oligonucleotide
actgtgtacgcagaagcagggaaaagggtggggaa

SEQ ID NO: 89315 - DNA, 36 bp, Artificial Sequence
  Synthetic oligonucleotide
gccgaacggcagggaggacgaagaggataatgggaa

SEQ ID NO: 89316 - DNA, 36 bp, Artificial Sequence
  Synthetic oligonucleotide
gaaatacgagcccatgggagtacagacaggggtgaa

SEQ ID NO: 89317 - DNA, 36 bp, Artificial Sequence
  Synthetic oligonucleotide
tagaccgacacctttttcgattctatgtgcccttaa

SEQ ID NO: 89318 - DNA, 35 bp, Artificial Sequence
  Synthetic oligonucleotide
ttgagggcggaatagcaaccaaaagaaaacgcaca

SEQ ID NO: 89319 - DNA, 36 bp, Artificial Sequence
  Synthetic oligonucleotide
agtgccatgcacggtcgtgttttccgattcctcaca

SEQ ID NO: 89320 - DNA, 36 bp, Artificial Sequence
  Synthetic oligonucleotide
gaaaaagggtggagcaagggactgtggggttagaca

SEQ ID NO: 89321 - DNA, 36 bp, Artificial Sequence
  Synthetic oligonucleotide
gaagcggtcgcaacaagtgttttgtctaaccaccca

SEQ ID NO: 89322 - DNA, 36 bp, Artificial Sequence
  Synthetic oligonucleotide
acgcgagagccaaaccgtacatcgtaggatactcca

SEQ ID NO: 89323 - DNA, 36 bp, Artificial Sequence
  Synthetic oligonucleotide
acatcagacgcattgcctcatacctgcctctctgca

SEQ ID NO: 89324 - DNA, 35 bp, Artificial Sequence
  Synthetic oligonucleotide
acaccgtgtagctgccagtgacattgccctttgca

SEQ ID NO: 89325 - DNA, 36 bp, Artificial Sequence
  Synthetic oligonucleotide
agacaggtcactaacgtattgccttgtctcctatca

SEQ ID NO: 89326 - DNA, 36 bp, Artificial Sequence
  Synthetic oligonucleotide
gtgtgacagacccgtcaggccccctctgttgattca

SEQ ID NO: 89327 - DNA, 35 bp, Artificial Sequence
  Synthetic oligonucleotide
acccagcgcgcgttctttgtcgatcgttcatttca

SEQ ID NO: 89328 - DNA, 38 bp, Artificial Sequence
  Synthetic oligonucleotide
taacgccagccactgcctctggtttccgtccgtttaga

SEQ ID NO: 89329 - DNA, 37 bp, Artificial Sequence
  Synthetic oligonucleotide
gagccgagaaaagcagtatggatagcaaggggcacga

SEQ ID NO: 89330 - DNA, 36 bp, Artificial Sequence
  Synthetic oligonucleotide
attgcctcctctgcaccttatattaacccaagacga

SEQ ID NO: 89331 - DNA, 36 bp, Artificial Sequence
  Synthetic oligonucleotide
gattcgaggggggaaaaggtaaatcgataagtacga

SEQ ID NO: 89332 - DNA, 36 bp, Artificial Sequence
  Synthetic oligonucleotide
tacgccgccttaccttcgaactctttcacgttacga

SEQ ID NO: 89333 - DNA, 37 bp, Artificial Sequence
  Synthetic oligonucleotide
tcacccctctgtttcccgcaactccagtcgtacccga

SEQ ID NO: 89334 - DNA, 35 bp, Artificial Sequence
  Synthetic oligonucleotide
ttgaacctcctctgcgatacgaaaattgtgcccga

SEQ ID NO: 89335 - DNA, 37 bp, Artificial Sequence
  Synthetic oligonucleotide
accgccgcctttctctgtcttcattggacattcccga

SEQ ID NO: 89336 - DNA, 37 bp, Artificial Sequence
  Synthetic oligonucleotide
acccatggggtgatgctttacagtgttcctctgccga

SEQ ID NO: 89337 - DNA, 37 bp, Artificial Sequence
  Synthetic oligonucleotide
tgttacgctacacatatttaatccgccgacccttcga

SEQ ID NO: 89338 - DNA, 36 bp, Artificial Sequence
  Synthetic oligonucleotide
tataggtggggtgaacaatgaggatcgaataaagga

SEQ ID NO: 89339 - DNA, 37 bp, Artificial Sequence
  Synthetic oligonucleotide
atcacgggaaagttcggaggacacgcgaaagggagga

SEQ ID NO: 89340 - DNA, 37 bp, Artificial Sequence
  Synthetic oligonucleotide
acatggccgcaacatggctgaaggtcgagcattagga

SEQ ID NO: 89341 - DNA, 37 bp, Artificial Sequence
  Synthetic oligonucleotide
gcatatcagcaaaggattggagtaggggtatcacgga

SEQ ID NO: 89342 - DNA, 37 bp, Artificial Sequence
  Synthetic oligonucleotide
tatggagggttagcatggggggcggaatatgttcgga

SEQ ID NO: 89343 - DNA, 37 bp, Artificial Sequence
  Synthetic oligonucleotide
ttcgagctcgccgccacttgcacccatcacacgggga

SEQ ID NO: 89344 - DNA, 35 bp, Artificial Sequence
  Synthetic oligonucleotide
gaactgacacttaggaatcactgagccccggggga

SEQ ID NO: 89345 - DNA, 37 bp, Artificial Sequence
  Synthetic oligonucleotide
gatgtcaggcgtagttgcaggactggggtggggggga

SEQ ID NO: 89346 - DNA, 37 bp, Artificial Sequence
  Synthetic oligonucleotide
actgactgtcgtgggaggaagggaggcagaccatgga

SEQ ID NO: 89347 - DNA, 37 bp, Artificial Sequence
  Synthetic oligonucleotide
gacccctccaccgaactgctaaactgaagcccatgga

SEQ ID NO: 89348 - DNA, 38 bp, Artificial Sequence
  Synthetic oligonucleotide
gacgactggcaaggagggagagcactgtccggcaatga

SEQ ID NO: 89349 - DNA, 38 bp, Artificial Sequence
  Synthetic oligonucleotide
tacgtacgttagtgcgggaattgaggagtgggacatga

SEQ ID NO: 89350 - DNA, 37 bp, Artificial Sequence
  Synthetic oligonucleotide
gccctgctgagcattgttatcctgttcctgtccatga

SEQ ID NO: 89351 - DNA, 37 bp, Artificial Sequence
  Synthetic oligonucleotide
atgcgtgaccactaccacctatctagaagctgcatga

SEQ ID NO: 89352 - DNA, 38 bp, Artificial Sequence
  Synthetic oligonucleotide
gccactcccgtagacacccatccgtacatctgggatga

SEQ ID NO: 89353 - DNA, 37 bp, Artificial Sequence
  Synthetic oligonucleotide
tcacagcataccgcacctagaaagcctcagcctatga

SEQ ID NO: 89354 - DNA, 38 bp, Artificial Sequence
  Synthetic oligonucleotide
gttcaagccagaaagaggtggggaacgggctaaactga

SEQ ID NO: 89355 - DNA, 37 bp, Artificial Sequence
  Synthetic oligonucleotide
atcttgctgcggcacaccccttatcgccaaacactga

SEQ ID NO: 89356 - DNA, 38 bp, Artificial Sequence
  Synthetic oligonucleotide
tagtcgccgcatcctatctttgtctctggtaccactga

SEQ ID NO: 89357 - DNA, 38 bp, Artificial Sequence
  Synthetic oligonucleotide
tccattgcccatcgcataacagtagcgtgccaacctga

SEQ ID NO: 89358 - DNA, 38 bp, Artificial Sequence
  Synthetic oligonucleotide
gatcacgcgatccaatataccgcatggctcctacctga

SEQ ID NO: 89359 - DNA, 38 bp, Artificial Sequence
  Synthetic oligonucleotide
gacagggcttagggtgcgagggtgggtataattcctga

SEQ ID NO: 89360 - DNA, 38 bp, Artificial Sequence
  Synthetic oligonucleotide
tgctgcccgcgattcgtttactaaacttgccctgctga

SEQ ID NO: 89361 - DNA, 38 bp, Artificial Sequence
  Synthetic oligonucleotide
ttggcctgcttacggctttgggacccatttccttctga

SEQ ID NO: 89362 - DNA, 37 bp, Artificial Sequence
  Synthetic oligonucleotide
taccgcacgggcgatcgatgtgattaatttgttctga

SEQ ID NO: 89363 - DNA, 37 bp, Artificial Sequence
  Synthetic oligonucleotide
acgaaccgcctcccccactcccagttgtagcaagtga

SEQ ID NO: 89364 - DNA, 36 bp, Artificial Sequence
  Synthetic oligonucleotide
ttcgaccgccctggcatcacctttctgtttcagtga

SEQ ID NO: 89365 - DNA, 38 bp, Artificial Sequence
  Synthetic oligonucleotide
atgggcctaccgctcgtgccgtacataatgccccgtga

SEQ ID NO: 89366 - DNA, 35 bp, Artificial Sequence
  Synthetic oligonucleotide
gaacgcgctattccttctcccagcatgatccgtga

SEQ ID NO: 89367 - DNA, 38 bp, Artificial Sequence
  Synthetic oligonucleotide
atgatcggcataaggaaggaatgactggtgatgggtga

SEQ ID NO: 89368 - DNA, 38 bp, Artificial Sequence
  Synthetic oligonucleotide
aacgggggggcgcggatggcactagagggagggtgtga

SEQ ID NO: 89369 - DNA, 38 bp, Artificial Sequence
  Synthetic oligonucleotide
gcatgcgttccacggtcccgacgcccccaactttgtga

SEQ ID NO: 89370 - DNA, 38 bp, Artificial Sequence
  Synthetic oligonucleotide
taaccgcttgatgccatacgcttcctcccctgcattga

SEQ ID NO: 89371 - DNA, 38 bp, Artificial Sequence
  Synthetic oligonucleotide
gtctcccaactgaagcgtacatatcccagcacctttga

SEQ ID NO: 89372 - DNA, 38 bp, Artificial Sequence
  Synthetic oligonucleotide
gcctcatagcaggtgcttttgctacctcgtccctttga

SEQ ID NO: 89373 - DNA, 38 bp, Artificial Sequence
  Synthetic oligonucleotide
atgccacgtcgccttcctccctggttcacacgctttga

SEQ ID NO: 89374 - DNA, 38 bp, Artificial Sequence
  Synthetic oligonucleotide
gttcaaaccactccatgagattgtgacctcccttttga

SEQ ID NO: 89375 - DNA, 38 bp, Artificial Sequence
  Synthetic oligonucleotide
ttaggctgccttagcctggaacatcttgcactttttga

SEQ ID NO: 89376 - DNA, 35 bp, Artificial Sequence
  Synthetic oligonucleotide
tgctggagcacatgcacacatccgattgcacacta

SEQ ID NO: 89377 - DNA, 36 bp, Artificial Sequence
  Synthetic oligonucleotide
atacacctcgctccttctgttgtccgtagtcgccta

SEQ ID NO: 89378 - DNA, 36 bp, Artificial Sequence
  Synthetic oligonucleotide
tgtggtgcgctcgacattcccctccccggtctcgta

SEQ ID NO: 89379 - DNA, 36 bp, Artificial Sequence
  Synthetic oligonucleotide
gcccatcatgtctccttgcttcccgcatatcgggta

SEQ ID NO: 89380 - DNA, 36 bp, Artificial Sequence
  Synthetic oligonucleotide
tgtacgcacctacccgctggtcttctagaagtctta

SEQ ID NO: 89381 - DNA, 35 bp, Artificial Sequence
  Synthetic oligonucleotide
acgaaggccgcaaggggagagctgatgtggtgaac

SEQ ID NO: 89382 - DNA, 35 bp, Artificial Sequence
  Synthetic oligonucleotide
ttgtcagtcgcatcactgcctttccctgtttgtac

SEQ ID NO: 89383 - DNA, 35 bp, Artificial Sequence
  Synthetic oligonucleotide
atggccgggatcagctttcgcacatgtcatttacc

SEQ ID NO: 89384 - DNA, 35 bp, Artificial Sequence
  Synthetic oligonucleotide
gtcgtctcgttcagcttactgtcacttcgcccccc

SEQ ID NO: 89385 - DNA, 35 bp, Artificial Sequence
  Synthetic oligonucleotide
atgtccgcactcaattatttagctatcgccctccc

SEQ ID NO: 89386 - DNA, 35 bp, Artificial Sequence
  Synthetic oligonucleotide
tgcaaaccctgctcaccacgcccataacttacgcc

SEQ ID NO: 89387 - DNA, 35 bp, Artificial Sequence
  Synthetic oligonucleotide
tgccgacccgaacgttagtagtgtcgactcccgcc

SEQ ID NO: 89388 - DNA, 35 bp, Artificial Sequence
  Synthetic oligonucleotide
tatccacgccgactgtcaccgctgaggtgggcgcc

SEQ ID NO: 89389 - DNA, 35 bp, Artificial Sequence
  Synthetic oligonucleotide
tgacaatccacctgtgccgtcacatacgacgctcc

SEQ ID NO: 89390 - DNA, 35 bp, Artificial Sequence
  Synthetic oligonucleotide
gcccgggaacacattctgatataatatgcttgtcc

SEQ ID NO: 89391 - DNA, 35 bp, Artificial Sequence
  Synthetic oligonucleotide
gccgctgtgcgatgtttacctgttcccttcacagc

SEQ ID NO: 89392 - DNA, 35 bp, Artificial Sequence
  Synthetic oligonucleotide
tgactcatgcaaagcgcatagtccagtctccacgc

SEQ ID NO: 89393 - DNA, 35 bp, Artificial Sequence
  Synthetic oligonucleotide
taccacttaggcccaaatgaagatatgcccaccgc

SEQ ID NO: 89394 - DNA, 35 bp, Artificial Sequence
  Synthetic oligonucleotide
tgtgtttggcacatacggctcctctcgaattccgc

SEQ ID NO: 89395 - DNA, 35 bp, Artificial Sequence
  Synthetic oligonucleotide
gccggaactcccgctgaactgttatcagtcccggc

SEQ ID NO: 89396 - DNA, 35 bp, Artificial Sequence
  Synthetic oligonucleotide
gatgcacttggcataaggtgaaattgggtactggc

SEQ ID NO: 89397 - DNA, 35 bp, Artificial Sequence
  Synthetic oligonucleotide
gaccggggggcaagccttttgtagtctgttgatgc

SEQ ID NO: 89398 - DNA, 35 bp, Artificial Sequence
  Synthetic oligonucleotide
acatgcagagccgtcctaaacgtacacatacctgc

SEQ ID NO: 89399 - DNA, 35 bp, Artificial Sequence
  Synthetic oligonucleotide
gagggggatgctgagggtaagaatgggaggggtgc

SEQ ID NO: 89400 - DNA, 35 bp, Artificial Sequence
  Synthetic oligonucleotide
ggatatcgctccaatgagctcatcaccactacatc

SEQ ID NO: 89401 - DNA, 35 bp, Artificial Sequence
  Synthetic oligonucleotide
ggacacccctttcatctcctgaccggtaaggcatc

SEQ ID NO: 89402 - DNA, 35 bp, Artificial Sequence
  Synthetic oligonucleotide
attgttgtactgccacttttgcatcatgcgatatc

SEQ ID NO: 89403 - DNA, 35 bp, Artificial Sequence
  Synthetic oligonucleotide
tcacgcccgccaagctagtaggcgtcaagctcctc

SEQ ID NO: 89404 - DNA, 35 bp, Artificial Sequence
  Synthetic oligonucleotide
tagtcactgtactgcctcattgttccaacctgctc

SEQ ID NO: 89405 - DNA, 35 bp, Artificial Sequence
  Synthetic oligonucleotide
ggtcgatgagcccccatcgtaaccaccctggattc

SEQ ID NO: 89406 - DNA, 35 bp, Artificial Sequence
  Synthetic oligonucleotide
ttaccgaagagggggcggtttggggggtgatacag

SEQ ID NO: 89407 - DNA, 35 bp, Artificial Sequence
  Synthetic oligonucleotide
gttggggccgtcgagcgaaacaccaagtaccaccg

SEQ ID NO: 89408 - DNA, 35 bp, Artificial Sequence
  Synthetic oligonucleotide
attgccccgccgaggacatccagcagatcttatgg

SEQ ID NO: 89409 - DNA, 35 bp, Artificial Sequence
  Synthetic oligonucleotide
gaccctgcgacgcgcaacacccaaccataacttgg

SEQ ID NO: 89410 - DNA, 35 bp, Artificial Sequence
  Synthetic oligonucleotide
tagccccgcaccttgctgcacacactgactggctg

SEQ ID NO: 89411 - DNA, 35 bp, Artificial Sequence
  Synthetic oligonucleotide
atcccatcgctgtggtcctgctgcttttaggcgtg

SEQ ID NO: 89412 - DNA, 35 bp, Artificial Sequence
  Synthetic oligonucleotide
atctgctccggttcccgtttggtgattcgttacat

SEQ ID NO: 89413 - DNA, 35 bp, Artificial Sequence
  Synthetic oligonucleotide
gactccaaccctagtgcgctatatcgcgtgttcat

SEQ ID NO: 89414 - DNA, 35 bp, Artificial Sequence
  Synthetic oligonucleotide
gacgcccacgaccttactctctatctgttggagat

SEQ ID NO: 89415 - DNA, 35 bp, Artificial Sequence
  Synthetic oligonucleotide
gacaccctcggcgcctgcatccggttaacttctat

SEQ ID NO: 89416 - DNA, 35 bp, Artificial Sequence
  Synthetic oligonucleotide
tcaacctgcgttccttagctttttaccgcttttat

SEQ ID NO: 89417 - DNA, 35 bp, Artificial Sequence
  Synthetic oligonucleotide
gccaccttactacactctgatacagtggacacact

SEQ ID NO: 89418 - DNA, 35 bp, Artificial Sequence
  Synthetic oligonucleotide
taaacagcgtttcaagcctgctgcactacatcact

SEQ ID NO: 89419 - DNA, 35 bp, Artificial Sequence
  Synthetic oligonucleotide
gaactgagctctatctgaattccttgggacctact

SEQ ID NO: 89420 - DNA, 35 bp, Artificial Sequence
  Synthetic oligonucleotide
gcgaggtcaccacccaggttatacccgagttccct

SEQ ID NO: 89421 - DNA, 35 bp, Artificial Sequence
  Synthetic oligonucleotide
gaacgtcactcaaattgtctcttcagttcgatcct

SEQ ID NO: 89422 - DNA, 35 bp, Artificial Sequence
  Synthetic oligonucleotide
actggacaacttagtctatctagctacttcctgct

SEQ ID NO: 89423 - DNA, 35 bp, Artificial Sequence
  Synthetic oligonucleotide
agagacacggccagtgacttggaagcagaagtagt

SEQ ID NO: 89424 - DNA, 35 bp, Artificial Sequence
  Synthetic oligonucleotide
acgtgaccattacgatgcgccggtctgtcccccgt

SEQ ID NO: 89425 - DNA, 35 bp, Artificial Sequence
  Synthetic oligonucleotide
atcctcaccgcccaatagtatcgttcaagaatggt

SEQ ID NO: 89426 - DNA, 35 bp, Artificial Sequence
  Synthetic oligonucleotide
aatgtagcgcatgggatacgtcgatggggtgatgt

SEQ ID NO: 89427 - DNA, 35 bp, Artificial Sequence
  Synthetic oligonucleotide
gtggcgaccaccgccgctatgtcgatttccactgt

SEQ ID NO: 89428 - DNA, 35 bp, Artificial Sequence
  Synthetic oligonucleotide
tttgcaccatcactcaccttgacgtcagtccctgt

SEQ ID NO: 89429 - DNA, 35 bp, Artificial Sequence
  Synthetic oligonucleotide
atcgagtgcgtgagtgggtgaaatggctctgttgt

SEQ ID NO: 89430 - DNA, 35 bp, Artificial Sequence
  Synthetic oligonucleotide
atgccccatgcgcctcaacgtttctatcaacgatt

SEQ ID NO: 89431 - DNA, 35 bp, Artificial Sequence
  Synthetic oligonucleotide
tatgattacagcagacagtcggcctcgccaccctt

SEQ ID NO: 89432 - DNA, 35 bp, Artificial Sequence
  Synthetic oligonucleotide
ttgccttggtacgtcgtcactcatctcgatttctt

SEQ ID NO: 89433 - DNA, 36 bp, Artificial Sequence
  Synthetic oligonucleotide
gtgccagaggtcgccgttctgtcgctgccgttgaaa

SEQ ID NO: 89434 - DNA, 36 bp, Artificial Sequence
  Synthetic oligonucleotide
gttgccccctcgtagtacctcgcaaggactcgtaaa

SEQ ID NO: 89435 - DNA, 35 bp, Artificial Sequence
  Synthetic oligonucleotide
gaggtggtcctggagggaaatgacatggcaaacaa

SEQ ID NO: 89436 - DNA, 36 bp, Artificial Sequence
  Synthetic oligonucleotide
ggacccacacgagtagtgatggcgttattcccacaa

SEQ ID NO: 89437 - DNA, 36 bp, Artificial Sequence
  Synthetic oligonucleotide
gatgcacgaggactatcgtaatgggaagggggccaa

SEQ ID NO: 89438 - DNA, 36 bp, Artificial Sequence
  Synthetic oligonucleotide
gacacggaataaaaaaaatggaagatctgggacgaa

SEQ ID NO: 89439 - DNA, 35 bp, Artificial Sequence
  Synthetic oligonucleotide
acaagacccgagaagaacggacagggagatgggaa

SEQ ID NO: 89440 - DNA, 36 bp, Artificial Sequence
  Synthetic oligonucleotide
ggagctacaggacgagcatcccgtacaccaacctaa

SEQ ID NO: 89441 - DNA, 36 bp, Artificial Sequence
  Synthetic oligonucleotide
aaatgccgggcaaggcgggggggggagtccttttaa

SEQ ID NO: 89442 - DNA, 36 bp, Artificial Sequence
  Synthetic oligonucleotide
agcggtcccggcctccctttgaaccagcacagcaca

SEQ ID NO: 89443 - DNA, 35 bp, Artificial Sequence
  Synthetic oligonucleotide
tctcaccctgatccttgcctcctttatgctgcaca

SEQ ID NO: 89444 - DNA, 35 bp, Artificial Sequence
  Synthetic oligonucleotide
acctcagacattaagctgcgtacttccgccataca

SEQ ID NO: 89445 - DNA, 36 bp, Artificial Sequence
  Synthetic oligonucleotide
gctggaacgctgaagggaaggtccgggggtgataca

SEQ ID NO: 89446 - DNA, 36 bp, Artificial Sequence
  Synthetic oligonucleotide
atcgtggcctcagcggttctcgctgcccaatttaca

SEQ ID NO: 89447 - DNA, 36 bp, Artificial Sequence
  Synthetic oligonucleotide
gaagcacataactatgatggaggtcgtcacgtacca

SEQ ID NO: 89448 - DNA, 36 bp, Artificial Sequence
  Synthetic oligonucleotide
gggacaccatctttatgcattacagcccaataagca

SEQ ID NO: 89449 - DNA, 35 bp, Artificial Sequence
  Synthetic oligonucleotide
ttaacgcagtcaccgagtctcggaccgcctccgca

SEQ ID NO: 89450 - DNA, 36 bp, Artificial Sequence
  Synthetic oligonucleotide
gatgcacacagcgttcttcgagcacaccgccaggca

SEQ ID NO: 89451 - DNA, 35 bp, Artificial Sequence
  Synthetic oligonucleotide
tgcaaaacagcccctgtcattgttcccatcaatca

SEQ ID NO: 89452 - DNA, 36 bp, Artificial Sequence
  Synthetic oligonucleotide
gatggaagagaagggggggcacattagataagatca

SEQ ID NO: 89453 - DNA, 35 bp, Artificial Sequence
  Synthetic oligonucleotide
acttacacctgtcgcgatatcagcggttcccctca

SEQ ID NO: 89454 - DNA, 36 bp, Artificial Sequence
  Synthetic oligonucleotide
gatacatcaagtccattggaaggtcgcatatgctca

SEQ ID NO: 89455 - DNA, 35 bp, Artificial Sequence
  Synthetic oligonucleotide
gtcaactgatgcgcattggccttccatatctgtca

SEQ ID NO: 89456 - DNA, 36 bp, Artificial Sequence
  Synthetic oligonucleotide
tacccgctccgcaatgccggagatgatttcctttca

SEQ ID NO: 89457 - DNA, 37 bp, Artificial Sequence
  Synthetic oligonucleotide
ggagactcaaacggtaaccgagcccctcctgtccaga

SEQ ID NO: 89458 - DNA, 37 bp, Artificial Sequence
  Synthetic oligonucleotide
gcttggtagagcggggaaagcataaaggaatcggaga

SEQ ID NO: 89459 - DNA, 37 bp, Artificial Sequence
  Synthetic oligonucleotide
accgtggcgagagaggtcaggaagttggtcggggaga

SEQ ID NO: 89460 - DNA, 37 bp, Artificial Sequence
  Synthetic oligonucleotide
tggggacgcagggagtggttggtgtacaagggggaga

SEQ ID NO: 89461 - DNA, 37 bp, Artificial Sequence
  Synthetic oligonucleotide
tgacccacactctgcgcaacgagcatcctttatccga

SEQ ID NO: 89462 - DNA, 37 bp, Artificial Sequence
  Synthetic oligonucleotide
acaggttggtcggggaggattgacaaaaggatagcga

SEQ ID NO: 89463 - DNA, 34 bp, Artificial Sequence
  Synthetic oligonucleotide
gatgatcaggggggcttgtaggtatggagggcga

SEQ ID NO: 89464 - DNA, 37 bp, Artificial Sequence
  Synthetic oligonucleotide
gctggagccctcgtgctttaccgtttagtcatggcga

SEQ ID NO: 89465 - DNA, 37 bp, Artificial Sequence
  Synthetic oligonucleotide
gttggcacgccacgcttctaccctaagataccttcga

SEQ ID NO: 89466 - DNA, 37 bp, Artificial Sequence
  Synthetic oligonucleotide
tcatcgacagtgcccattacacgatttgctttcagga

SEQ ID NO: 89467 - DNA, 35 bp, Artificial Sequence
  Synthetic oligonucleotide
gacgcaccgaggaagggatcccaatggaggacgga

SEQ ID NO: 89468 - DNA, 37 bp, Artificial Sequence
  Synthetic oligonucleotide
acacccaccacaccatcgtagcatcagctgtcgcgga

SEQ ID NO: 89469 - DNA, 37 bp, Artificial Sequence
  Synthetic oligonucleotide
ggactcgctcctctactataccaaccaccctagggga

SEQ ID NO: 89470 - DNA, 37 bp, Artificial Sequence
  Synthetic oligonucleotide
agcatggaggccgtgtggggcagggggaaaccgggga

SEQ ID NO: 89471 - DNA, 37 bp, Artificial Sequence
  Synthetic oligonucleotide
gttcctgtcatgggaagaggagtggaggaaaggggga

SEQ ID NO: 89472 - DNA, 37 bp, Artificial Sequence
  Synthetic oligonucleotide
taccggggatgggctagaagtttggggagcatgggga

SEQ ID NO: 89473 - DNA, 37 bp, Artificial Sequence
  Synthetic oligonucleotide
tgccccccaccgtgatgatccatcgaacactactgga

SEQ ID NO: 89474 - DNA, 38 bp, Artificial Sequence
  Synthetic oligonucleotide
gaaccaaggcgaggcgggtgtggggggtaccttcatga

SEQ ID NO: 89475 - DNA, 37 bp, Artificial Sequence
  Synthetic oligonucleotide
gacgttcgccgtccaagctgttcattcgcttctatga

SEQ ID NO: 89476 - DNA, 38 bp, Artificial Sequence
  Synthetic oligonucleotide
gcgagcttacgacagggggagcaagagggatggtatga

SEQ ID NO: 89477 - DNA, 38 bp, Artificial Sequence
  Synthetic oligonucleotide
gtgatcggcactgttttgacgtctgctaatatcactga

SEQ ID NO: 89478 - DNA, 38 bp, Artificial Sequence
  Synthetic oligonucleotide
atcgccaatcgctcacccgccctcgcattagtacctga

SEQ ID NO: 89479 - DNA, 38 bp, Artificial Sequence
  Synthetic oligonucleotide
atgcgcgctggatttcgattttttgcaacgttccctga

SEQ ID NO: 89480 - DNA, 37 bp, Artificial Sequence
  Synthetic oligonucleotide
tcgtacagtcacagctgctaaatgcgaactcacgtga

SEQ ID NO: 89481 - DNA, 38 bp, Artificial Sequence
  Synthetic oligonucleotide
aaagggtggagtccgaaggcggaacgggattgacgtga

SEQ ID NO: 89482 - DNA, 38 bp, Artificial Sequence
  Synthetic oligonucleotide
gcgatgccccttagattccgtgcccccagtctacgtga

SEQ ID NO: 89483 - DNA, 37 bp, Artificial Sequence
  Synthetic oligonucleotide
tacaacggcatccatacactggccatatcccgcgtga

SEQ ID NO: 89484 - DNA, 38 bp, Artificial Sequence
  Synthetic oligonucleotide
gcgaggatcagacgtacccgccttccatatcatcgtga

SEQ ID NO: 89485 - DNA, 38 bp, Artificial Sequence
  Synthetic oligonucleotide
tgatctcggccccatcgtgccccgcttcactctcgtga

SEQ ID NO: 89486 - DNA, 37 bp, Artificial Sequence
  Synthetic oligonucleotide
gtgacagcacgtggcaggggaactgattggaaggtga

SEQ ID NO: 89487 - DNA, 38 bp, Artificial Sequence
  Synthetic oligonucleotide
gccatggcacgagtagttgcgggccctttgggtggtga

SEQ ID NO: 89488 - DNA, 38 bp, Artificial Sequence
  Synthetic oligonucleotide
gaccgaggaagggaaataggttagactcaacggtgtga

SEQ ID NO: 89489 - DNA, 36 bp, Artificial Sequence
  Synthetic oligonucleotide
actaccattccacagcatgtaccatggcaacattga

SEQ ID NO: 89490 - DNA, 38 bp, Artificial Sequence
  Synthetic oligonucleotide
gtcccgttgcttagtaccacttgacgcccctaacttga

SEQ ID NO: 89491 - DNA, 37 bp, Artificial Sequence
  Synthetic oligonucleotide
ttggggagaagaggggcgcggtataacacggacttga

SEQ ID NO: 89492 - DNA, 37 bp, Artificial Sequence
  Synthetic oligonucleotide
tgcaccacgtaaggattcagcttgttcgttgccttga

SEQ ID NO: 89493 - DNA, 38 bp, Artificial Sequence
  Synthetic oligonucleotide
acgccaccacacatgtaggtcaccgagacgctggttga

SEQ ID NO: 89494 - DNA, 38 bp, Artificial Sequence
  Synthetic oligonucleotide
aacacccgcgctgacccaggacgacttccacactttga

SEQ ID NO: 89495 - DNA, 38 bp, Artificial Sequence
  Synthetic oligonucleotide
ttcacgtcctcgacacaaagcatagacgcaccctttga

SEQ ID NO: 89496 - DNA, 38 bp, Artificial Sequence
  Synthetic oligonucleotide
tccccgtaagccattgctttcgaattgaccctctttga

SEQ ID NO: 89497 - DNA, 37 bp, Artificial Sequence
  Synthetic oligonucleotide
aagtaccgcccaatgacctcccctcgtcctgttttga

SEQ ID NO: 89498 - DNA, 37 bp, Artificial Sequence
  Synthetic oligonucleotide
gacaccccaagtgcgtttgcatctagggcttttttga

SEQ ID NO: 89499 - DNA, 36 bp, Artificial Sequence
  Synthetic oligonucleotide
ggagaaggagggggggaaagtacgagccgtaaacta

SEQ ID NO: 89500 - DNA, 34 bp, Artificial Sequence
  Synthetic oligonucleotide
gacatcggctttggggggggcacactcggaacta

SEQ ID NO: 89501 - DNA, 36 bp, Artificial Sequence
  Synthetic oligonucleotide
gctcacctggtgactaaccactgtggtatcctccta

SEQ ID NO: 89502 - DNA, 36 bp, Artificial Sequence
  Synthetic oligonucleotide
gctgacctggcgtccctcattatcgcgaatcccgta

SEQ ID NO: 89503 - DNA, 36 bp, Artificial Sequence
  Synthetic oligonucleotide
tctggatgcaacgggaggaatggaaaggtaatggta

SEQ ID NO: 89504 - DNA, 35 bp, Artificial Sequence
  Synthetic oligonucleotide
tgatctaagcgctatctgccgggctacacttggta

SEQ ID NO: 89505 - DNA, 36 bp, Artificial Sequence
  Synthetic oligonucleotide
tagacgagcgattgatcatgagggggagggggctta

SEQ ID NO: 89506 - DNA, 36 bp, Artificial Sequence
  Synthetic oligonucleotide
tcagaaccgcaccttttcgcatcctaatcgaagtta

SEQ ID NO: 89507 - DNA, 36 bp, Artificial Sequence
  Synthetic oligonucleotide
gcacacgtcgtcagtatttattaagtagatgcgtta

SEQ ID NO: 89508 - DNA, 35 bp, Artificial Sequence
  Synthetic oligonucleotide
gcccatccccgccgtctctcgaatgtctcctgtta

SEQ ID NO: 89509 - DNA, 36 bp, Artificial Sequence
  Synthetic oligonucleotide
gacacacccgccacatgtggcatttttttttattta

SEQ ID NO: 89510 - DNA, 36 bp, Artificial Sequence
  Synthetic oligonucleotide
acccgagaaaatcagctgcttcaccgtcgtccttta

SEQ ID NO: 89511 - DNA, 35 bp, Artificial Sequence
  Synthetic oligonucleotide
acacgcacctcgttgacatgtgctctcatgaaaac

SEQ ID NO: 89512 - DNA, 35 bp, Artificial Sequence
  Synthetic oligonucleotide
taccgcaaccctgactgcaaacccaccgcacaaac

SEQ ID NO: 89513 - DNA, 35 bp, Artificial Sequence
  Synthetic oligonucleotide
accggacgtctctccattcttgcgcttcacctgac

SEQ ID NO: 89514 - DNA, 35 bp, Artificial Sequence
  Synthetic oligonucleotide
tatgatcggagacgcaagttctgttcctttgtgac

SEQ ID NO: 89515 - DNA, 35 bp, Artificial Sequence
  Synthetic oligonucleotide
tagtgctgcactcgggaacgcgtaacccacaatac

SEQ ID NO: 89516 - DNA, 35 bp, Artificial Sequence
  Synthetic oligonucleotide
gtacaaggctgacgtatcggcctggtccaaccccc

SEQ ID NO: 89517 - DNA, 35 bp, Artificial Sequence
  Synthetic oligonucleotide
gcacacgatggttagtactgtaacacctgtagccc

SEQ ID NO: 89518 - DNA, 35 bp, Artificial Sequence
  Synthetic oligonucleotide
tagctgacgaaccgtttcacgccctggcgacagcc

SEQ ID NO: 89519 - DNA, 35 bp, Artificial Sequence
  Synthetic oligonucleotide
gcacacagttggttttgatctttcgcccgactgcc

SEQ ID NO: 89520 - DNA, 35 bp, Artificial Sequence
  Synthetic oligonucleotide
gaattccgatcacctccacatgggtacatcgtgcc

SEQ ID NO: 89521 - DNA, 35 bp, Artificial Sequence
  Synthetic oligonucleotide
gctgtgggatatcttagtactctatgcgccttgcc

SEQ ID NO: 89522 - DNA, 35 bp, Artificial Sequence
  Synthetic oligonucleotide
tcccatcccgtgtacttactgcgattttttcttcc

SEQ ID NO: 89523 - DNA, 35 bp, Artificial Sequence
  Synthetic oligonucleotide
acacggccctccgcacatgtctaattaggctccgc

SEQ ID NO: 89524 - DNA, 35 bp, Artificial Sequence
  Synthetic oligonucleotide
gatcgcctctgcctacagttgtttttacaacgcgc

SEQ ID NO: 89525 - DNA, 35 bp, Artificial Sequence
  Synthetic oligonucleotide
gccacctcacagtttcggtcgacggcgactcgcgc

SEQ ID NO: 89526 - DNA, 35 bp, Artificial Sequence
  Synthetic oligonucleotide
gtgtcaccgcaactaagtattatcttctagctggc

SEQ ID NO: 89527 - DNA, 35 bp, Artificial Sequence
  Synthetic oligonucleotide
aacctcccacatgttgccttatatgcgtgcttggc

SEQ ID NO: 89528 - DNA, 35 bp, Artificial Sequence
  Synthetic oligonucleotide
gccgagtaggatcccatgttcacagcccctgactc

SEQ ID NO: 89529 - DNA, 35 bp, Artificial Sequence
  Synthetic oligonucleotide
agcacccggtcagtcactagtacacaacgcatgtc

SEQ ID NO: 89530 - DNA, 35 bp, Artificial Sequence
  Synthetic oligonucleotide
ttgcatgcccgccccacatcatctgttcatttgtc

SEQ ID NO: 89531 - DNA, 35 bp, Artificial Sequence
  Synthetic oligonucleotide
gtgatcacacacgtgctggtcgcctacatcataag

SEQ ID NO: 89532 - DNA, 35 bp, Artificial Sequence
  Synthetic oligonucleotide
attgcatccccggcctgtatgcccacccttataag

SEQ ID NO: 89533 - DNA, 35 bp, Artificial Sequence
  Synthetic oligonucleotide
gaggaacaaaaaacccaaagatgcagcctatcgag

SEQ ID NO: 89534 - DNA, 35 bp, Artificial Sequence
  Synthetic oligonucleotide
tacaccgcaaacggccgaagcaatagggatgaagg

SEQ ID NO: 89535 - DNA, 35 bp, Artificial Sequence
  Synthetic oligonucleotide
gaggacggtcacgtgctgtggttatcaaatggagg

SEQ ID NO: 89536 - DNA, 35 bp, Artificial Sequence
  Synthetic oligonucleotide
tcaaaacgcgggtattaccaaaggtagagaacggg

SEQ ID NO: 89537 - DNA, 34 bp, Artificial Sequence
  Synthetic oligonucleotide
gacgagttgcagaagtgtttcgttcgaattcctg

SEQ ID NO: 89538 - DNA, 35 bp, Artificial Sequence
  Synthetic oligonucleotide
gtacacggacgtcgggaatacggtgaggggtgctg

SEQ ID NO: 89539 - DNA, 35 bp, Artificial Sequence
  Synthetic oligonucleotide
acatagcagcaaatcgacaaggctaggctgtattg

SEQ ID NO: 89540 - DNA, 35 bp, Artificial Sequence
  Synthetic oligonucleotide
tctaaggccaactgccatcatgtatctgtcctgat

SEQ ID NO: 89541 - DNA, 35 bp, Artificial Sequence
  Synthetic oligonucleotide
gccaggtctagccccatgctacatttatatgctat

SEQ ID NO: 89542 - DNA, 35 bp, Artificial Sequence
  Synthetic oligonucleotide
gacttcacgagcatattaataaaccgaccatgact

SEQ ID NO: 89543 - DNA, 35 bp, Artificial Sequence
  Synthetic oligonucleotide
ttggaccttccatctgagcagtgatacaactgact

SEQ ID NO: 89544 - DNA, 35 bp, Artificial Sequence
  Synthetic oligonucleotide
atgcggccttgactattgccgtctctattgctact

SEQ ID NO: 89545 - DNA, 35 bp, Artificial Sequence
  Synthetic oligonucleotide
gtgcgcgcgtttatattgcccattacactcaccct

SEQ ID NO: 89546 - DNA, 35 bp, Artificial Sequence
  Synthetic oligonucleotide
aacgtagctgtatatcttcctcacgatcccagcct

SEQ ID NO: 89547 - DNA, 35 bp, Artificial Sequence
  Synthetic oligonucleotide
atcccgagtgtctgcgatcttgccggtcctagcct

SEQ ID NO: 89548 - DNA, 35 bp, Artificial Sequence
  Synthetic oligonucleotide
tcgatgccgatagtctgcacagcatacccacttct

SEQ ID NO: 89549 - DNA, 34 bp, Artificial Sequence
  Synthetic oligonucleotide
tgctccaccgcgccgacgaaattttaggttccgt

SEQ ID NO: 89550 - DNA, 35 bp, Artificial Sequence
  Synthetic oligonucleotide
aatcatgcgagaatagagggaaacggcaaatgggt

SEQ ID NO: 89551 - DNA, 35 bp, Artificial Sequence
  Synthetic oligonucleotide
tgtcacgcatggttgaactagctgttgggcctggt

SEQ ID NO: 89552 - DNA, 35 bp, Artificial Sequence
  Synthetic oligonucleotide
acgccgagaactcaggtctcttcggtaacaccatt

SEQ ID NO: 89553 - DNA, 35 bp, Artificial Sequence
  Synthetic oligonucleotide
ttagcgcggaggaccggtccattctgccattcatt

SEQ ID NO: 89554 - DNA, 36 bp, Artificial Sequence
  Synthetic oligonucleotide
ataccagtggcacgagctggactatcctctcacaaa

SEQ ID NO: 89555 - DNA, 35 bp, Artificial Sequence
  Synthetic oligonucleotide
gcacgactcacccctggtagcacatagaccccaaa

SEQ ID NO: 89556 - DNA, 36 bp, Artificial Sequence
  Synthetic oligonucleotide
gaagtcgggtgaatttggcgggtgaatgaacggaaa

SEQ ID NO: 89557 - DNA, 35 bp, Artificial Sequence
  Synthetic oligonucleotide
gttgacgaagcctgtcgctatctctctgtgggaaa

SEQ ID NO: 89558 - DNA, 35 bp, Artificial Sequence
  Synthetic oligonucleotide
gacacgctggaaatgcgctgggggaggctgataaa

SEQ ID NO: 89559 - DNA, 36 bp, Artificial Sequence
  Synthetic oligonucleotide
gaactgcgcccccgactggcaagtgtgcccaaccaa

SEQ ID NO: 89560 - DNA, 35 bp, Artificial Sequence
  Synthetic oligonucleotide
acccttgctctatccgtatgtctcgtctagtccaa

SEQ ID NO: 89561 - DNA, 36 bp, Artificial Sequence
  Synthetic oligonucleotide
attcgcgtaccgtacttagcgttctattctcatcaa

SEQ ID NO: 89562 - DNA, 36 bp, Artificial Sequence
  Synthetic oligonucleotide
tcatccttcgtatcgcctgttaatttgaacctcgaa

SEQ ID NO: 89563 - DNA, 35 bp, Artificial Sequence
  Synthetic oligonucleotide
gaacacatccgtcgcctgcaccccccgcaactgaa

SEQ ID NO: 89564 - DNA, 35 bp, Artificial Sequence
  Synthetic oligonucleotide
gccctcagcaagcctgcattacatccttccttgaa

SEQ ID NO: 89565 - DNA, 35 bp, Artificial Sequence
  Synthetic oligonucleotide
gaacaagtccgtcgagaaggaataggggtgggtaa

SEQ ID NO: 89566 - DNA, 35 bp, Artificial Sequence
  Synthetic oligonucleotide
gaccaaagtgggtgctgtgagagttagtagtgtaa

SEQ ID NO: 89567 - DNA, 37 bp, Artificial Sequence
  Synthetic oligonucleotide
tgcccaccgccaatcgcccctagttcgttatcacaca

SEQ ID NO: 89568 - DNA, 36 bp, Artificial Sequence
  Synthetic oligonucleotide
atccgcgacgctatgttctctttgatcaataataca

SEQ ID NO: 89569 - DNA, 36 bp, Artificial Sequence
  Synthetic oligonucleotide
ttgcacccattcactccctggccgacctgtcctaca

SEQ ID NO: 89570 - DNA, 36 bp, Artificial Sequence
  Synthetic oligonucleotide
atcgggcggagcgccatttctgttccccaatgtaca

SEQ ID NO: 89571 - DNA, 35 bp, Artificial Sequence
  Synthetic oligonucleotide
ttctgcccccactgtttcggtattagcaccaccca

SEQ ID NO: 89572 - DNA, 35 bp, Artificial Sequence
  Synthetic oligonucleotide
gaccccagtccgtttggtcttgcctgcccctccca

SEQ ID NO: 89573 - DNA, 35 bp, Artificial Sequence
  Synthetic oligonucleotide
tgtacgtcgcacgcactttgcccgcttgtctccca

SEQ ID NO: 89574 - DNA, 36 bp, Artificial Sequence
  Synthetic oligonucleotide
attgtcgaagacaagtaatccttaataggacctcca

SEQ ID NO: 89575 - DNA, 36 bp, Artificial Sequence
  Synthetic oligonucleotide
gacctgccttacatcggtgtcgcattcacttaagca

SEQ ID NO: 89576 - DNA, 35 bp, Artificial Sequence
  Synthetic oligonucleotide
tgtacggggggtagtggggcaaatagggagccgca

SEQ ID NO: 89577 - DNA, 35 bp, Artificial Sequence
  Synthetic oligonucleotide
gatgtcttccccgtcgtggtacccccgcttccgca

SEQ ID NO: 89578 - DNA, 35 bp, Artificial Sequence
  Synthetic oligonucleotide
acacgcaaccaggtaagccaaaggctgttacatca

SEQ ID NO: 89579 - DNA, 36 bp, Artificial Sequence
  Synthetic oligonucleotide
gggacaaggcctcaggcttacatcatggttcgctca

SEQ ID NO: 89580 - DNA, 35 bp, Artificial Sequence
  Synthetic oligonucleotide
gatgacggagtcatcgggttattattaatgattca

SEQ ID NO: 89581 - DNA, 38 bp, Artificial Sequence
  Synthetic oligonucleotide
agactggcggatggctcgaagtcagtagggggggaaga

SEQ ID NO: 89582 - DNA, 37 bp, Artificial Sequence
  Synthetic oligonucleotide
tgcatgaacgttcacctccactcctgtcttgtgaaga

SEQ ID NO: 89583 - DNA, 36 bp, Artificial Sequence
  Synthetic oligonucleotide
taggtgtgacgaagggaatgggaaaagacagtcaga

SEQ ID NO: 89584 - DNA, 36 bp, Artificial Sequence
  Synthetic oligonucleotide
gtggtggtgggcggaaacgacaaagggcacgagaga

SEQ ID NO: 89585 - DNA, 37 bp, Artificial Sequence
  Synthetic oligonucleotide
ggatcagcaaggaggagcaaaggggattgctgggaga

SEQ ID NO: 89586 - DNA, 37 bp, Artificial Sequence
  Synthetic oligonucleotide
accatccgtgcaagggggtaccttcaccatctataga

SEQ ID NO: 89587 - DNA, 35 bp, Artificial Sequence
  Synthetic oligonucleotide
tcgatcgcctccgctttcggtcccctcgctctaga

SEQ ID NO: 89588 - DNA, 36 bp, Artificial Sequence
  Synthetic oligonucleotide
gtgccacgaccccccaaacagctagccgctggtaga

SEQ ID NO: 89589 - DNA, 37 bp, Artificial Sequence
  Synthetic oligonucleotide
ttcgcggggggagtaaggcgggtaaagcttgcaacga

SEQ ID NO: 89590 - DNA, 37 bp, Artificial Sequence
  Synthetic oligonucleotide
ggtggggaggagtggtgtatgtttagaggaagcccga

SEQ ID NO: 89591 - DNA, 37 bp, Artificial Sequence
  Synthetic oligonucleotide
accatagtaggtgcggtactggaaacgcgattgccga

SEQ ID NO: 89592 - DNA, 36 bp, Artificial Sequence
  Synthetic oligonucleotide
taagtccaccgcagaagatcaacataacgcctccga

SEQ ID NO: 89593 - DNA, 37 bp, Artificial Sequence
  Synthetic oligonucleotide
tctggagaagatggttgcaggggtggaggcggagcga

SEQ ID NO: 89594 - DNA, 37 bp, Artificial Sequence
  Synthetic oligonucleotide
gcaacaccaatccagctaggtgagccgtacatggcga

SEQ ID NO: 89595 - DNA, 35 bp, Artificial Sequence
  Synthetic oligonucleotide
gagggagggtggacgggttcttacgcgcaatgcga

SEQ ID NO: 89596 - DNA, 37 bp, Artificial Sequence
  Synthetic oligonucleotide
gcggagagggtgccatgtgagttggatgggggtgcga

SEQ ID NO: 89597 - DNA, 37 bp, Artificial Sequence
  Synthetic oligonucleotide
tccacccttaagcacacctcgattctccatgcatcga

SEQ ID NO: 89598 - DNA, 37 bp, Artificial Sequence
  Synthetic oligonucleotide
actctgcccggtcattactatcttggaactttctcga

SEQ ID NO: 89599 - DNA, 36 bp, Artificial Sequence
  Synthetic oligonucleotide
tctggcaccctgaatccggcaacacttccactagga

SEQ ID NO: 89600 - DNA, 37 bp, Artificial Sequence
  Synthetic oligonucleotide
tcacgcgagtagggtgggggcttcaggaagaaacgga

SEQ ID NO: 89601 - DNA, 37 bp, Artificial Sequence
  Synthetic oligonucleotide
gagcgagggagccattcctacaagaaacgaaccggga

SEQ ID NO: 89602 - DNA, 37 bp, Artificial Sequence
  Synthetic oligonucleotide
ataacgcaagaaggaggatgcttgacttggaggggga

SEQ ID NO: 89603 - DNA, 37 bp, Artificial Sequence
  Synthetic oligonucleotide
tgagtaatgcgcacccttaggctatcacagactggga

SEQ ID NO: 89604 - DNA, 37 bp, Artificial Sequence
  Synthetic oligonucleotide
gatatgggcaaagaaggatactggacgggacttggga

SEQ ID NO: 89605 - DNA, 37 bp, Artificial Sequence
  Synthetic oligonucleotide
agacgcaacggggtgaccatatggctgctcaactgga

SEQ ID NO: 89606 - DNA, 37 bp, Artificial Sequence
  Synthetic oligonucleotide
ggagcgatgaagcggtgggaagttgggctgatgtgga

SEQ ID NO: 89607 - DNA, 37 bp, Artificial Sequence
  Synthetic oligonucleotide
gatgggtgattacaggtggtgcaggaagtgggttgga

SEQ ID NO: 89608 - DNA, 37 bp, Artificial Sequence
  Synthetic oligonucleotide
agcactcatcccgtatcgttcatgctctgtctttgga

SEQ ID NO: 89609 - DNA, 38 bp, Artificial Sequence
  Synthetic oligonucleotide
tgaccaaccgctttttaccgtacaaggccctgaaatga

SEQ ID NO: 89610 - DNA, 38 bp, Artificial Sequence
  Synthetic oligonucleotide
gaggagcggaggctaggaatatttaggctgagcaatga

SEQ ID NO: 89611 - DNA, 37 bp, Artificial Sequence
  Synthetic oligonucleotide
gctcaccagcgcgctttctcttgcctcttagcaatga

SEQ ID NO: 89612 - DNA, 38 bp, Artificial Sequence
  Synthetic oligonucleotide
aactggggagggggggcgaaaggtagtacgagtcatga

SEQ ID NO: 89613 - DNA, 37 bp, Artificial Sequence
  Synthetic oligonucleotide
tgatcaggagagaaggactctagggggaaacggatga

SEQ ID NO: 89614 - DNA, 38 bp, Artificial Sequence
  Synthetic oligonucleotide
gcgaaaggggagagaactgggcagaaatggagtgatga

SEQ ID NO: 89615 - DNA, 38 bp, Artificial Sequence
  Synthetic oligonucleotide
gtggtacctagcccatacgtcgttccatatacatatga

SEQ ID NO: 89616 - DNA, 38 bp, Artificial Sequence
  Synthetic oligonucleotide
gtgccgcacgcttgagatcaattggtgccttattatga

SEQ ID NO: 89617 - DNA, 37 bp, Artificial Sequence
  Synthetic oligonucleotide
ggaaaggacaagaggtaagggctgggcatcgttatga

SEQ ID NO: 89618 - DNA, 38 bp, Artificial Sequence
  Synthetic oligonucleotide
tgacaaagctgtgcgcgatgactgtggcccgtaactga

SEQ ID NO: 89619 - DNA, 38 bp, Artificial Sequence
  Synthetic oligonucleotide
tatcaccacagggcgctctgactagcaggccggactga

SEQ ID NO: 89620 - DNA, 36 bp, Artificial Sequence
  Synthetic oligonucleotide
gccacgcgcacattctaaggctctttgccatgctga

SEQ ID NO: 89621 - DNA, 38 bp, Artificial Sequence
  Synthetic oligonucleotide
ccatcccatcgcatgttcatcactctaggctctcgtga

SEQ ID NO: 89622 - DNA, 38 bp, Artificial Sequence
  Synthetic oligonucleotide
aatgcatggggcggaggagttggcaggtttaagggtga

SEQ ID NO: 89623 - DNA, 38 bp, Artificial Sequence
  Synthetic oligonucleotide
tcatggtcaggcgagggggagtgaatccgggggggtga

SEQ ID NO: 89624 - DNA, 38 bp, Artificial Sequence
  Synthetic oligonucleotide
tacgcctcaactcttgttctaaaattccctgctggtga

SEQ ID NO: 89625 - DNA, 36 bp, Artificial Sequence
  Synthetic oligonucleotide
tgatagcgcagtggcagtaaaaatataggggtgtga

SEQ ID NO: 89626 - DNA, 38 bp, Artificial Sequence
  Synthetic oligonucleotide
acacaagcgggcgaaggagttcggtaactcaccattga

SEQ ID NO: 89627 - DNA, 38 bp, Artificial Sequence
  Synthetic oligonucleotide
aacgatagtagaggaggggacagggacacgggtattga

SEQ ID NO: 89628 - DNA, 38 bp, Artificial Sequence
  Synthetic oligonucleotide
taacatacgccacctgccgcagtctctccaggacttga

SEQ ID NO: 89629 - DNA, 38 bp, Artificial Sequence
  Synthetic oligonucleotide
atgcgcaccgtccgcgttcccaattttgctctacttga

SEQ ID NO: 89630 - DNA, 36 bp, Artificial Sequence
  Synthetic oligonucleotide
gaggaagccacaacgcctttgtaatcctgcccttga

SEQ ID NO: 89631 - DNA, 38 bp, Artificial Sequence
  Synthetic oligonucleotide
ttaggagggggaagggcaagttcgacagacggccttga

SEQ ID NO: 89632 - DNA, 38 bp, Artificial Sequence
  Synthetic oligonucleotide
tcaaccgtcacatcgctgtgaccctactcattcgttga

SEQ ID NO: 89633 - DNA, 38 bp, Artificial Sequence
  Synthetic oligonucleotide
ggaacgaggaggcagtgaataatgtcatcggctgttga

SEQ ID NO: 89634 - DNA, 37 bp, Artificial Sequence
  Synthetic oligonucleotide
tcaggagcagtccttggccctaccgtcttgactttga

SEQ ID NO: 89635 - DNA, 36 bp, Artificial Sequence
  Synthetic oligonucleotide
gacgaacgttaggtcgctcctgataacgatctttga

SEQ ID NO: 89636 - DNA, 35 bp, Artificial Sequence
  Synthetic oligonucleotide
accccgagcctccagcgccttacgctcgccatata

SEQ ID NO: 89637 - DNA, 35 bp, Artificial Sequence
  Synthetic oligonucleotide
ttcggtgccctctgcacatgtctcgcggtactata

SEQ ID NO: 89638 - DNA, 35 bp, Artificial Sequence
  Synthetic oligonucleotide
aactccctgcagaggtcaatcatctcggccaccta

SEQ ID NO: 89639 - DNA, 36 bp, Artificial Sequence
  Synthetic oligonucleotide
aactgtgccggacatttttgatattgccactactta

SEQ ID NO: 89640 - DNA, 36 bp, Artificial Sequence
  Synthetic oligonucleotide
agtgtacggcacatcttacctggcctttacctgtta

SEQ ID NO: 89641 - DNA, 35 bp, Artificial Sequence
  Synthetic oligonucleotide
acccatccgcttatacatcctgctgcctagtgaac

SEQ ID NO: 89642 - DNA, 35 bp, Artificial Sequence
  Synthetic oligonucleotide
tgatcacgcgatactacggcttcctcgacacacac

SEQ ID NO: 89643 - DNA, 35 bp, Artificial Sequence
  Synthetic oligonucleotide
acaccaggacatgcgcttgctacttgcgctaccac

SEQ ID NO: 89644 - DNA, 35 bp, Artificial Sequence
  Synthetic oligonucleotide
tcattgaggcgtaattacacggctgctccactcac

SEQ ID NO: 89645 - DNA, 35 bp, Artificial Sequence
  Synthetic oligonucleotide
ttgtcaccacactgtttatttgcctagtatctcac

SEQ ID NO: 89646 - DNA, 35 bp, Artificial Sequence
  Synthetic oligonucleotide
ttcactccctggcatggccgacaccttttggtgac

SEQ ID NO: 89647 - DNA, 35 bp, Artificial Sequence
  Synthetic oligonucleotide
gttagcatggtgctcgttccgtattcggccattcc

SEQ ID NO: 89648 - DNA, 35 bp, Artificial Sequence
  Synthetic oligonucleotide
tggactcgccgacgtactcttcacttagcgattcc

SEQ ID NO: 89649 - DNA, 35 bp, Artificial Sequence
  Synthetic oligonucleotide
tgacgccactcaatcactggtatttttgcgtacgc

SEQ ID NO: 89650 - DNA, 35 bp, Artificial Sequence
  Synthetic oligonucleotide
gacctccctcacactggtaacacttcaagcctggc

SEQ ID NO: 89651 - DNA, 35 bp, Artificial Sequence
  Synthetic oligonucleotide
tgcgctcaacctgcttcgcttacgacctttcgtgc

SEQ ID NO: 89652 - DNA, 35 bp, Artificial Sequence
  Synthetic oligonucleotide
gtccgtagacttctatagcttccaccccaatttgc

SEQ ID NO: 89653 - DNA, 35 bp, Artificial Sequence
  Synthetic oligonucleotide
acccgcgtggcctcctgtactgttctcgctgactc

SEQ ID NO: 89654 - DNA, 35 bp, Artificial Sequence
  Synthetic oligonucleotide
tctccaccctccagtttgttcgactgtgctccctc

SEQ ID NO: 89655 - DNA, 35 bp, Artificial Sequence
  Synthetic oligonucleotide
atcatcccaaggcacccgatggttgcttcattctc

SEQ ID NO: 89656 - DNA, 35 bp, Artificial Sequence
  Synthetic oligonucleotide
gcttggggtggctggttttcctcgtggtctctgtc

SEQ ID NO: 89657 - DNA, 35 bp, Artificial Sequence
  Synthetic oligonucleotide
gacgcgcgactcgttaacactcccgataggcattc

SEQ ID NO: 89658 - DNA, 35 bp, Artificial Sequence
  Synthetic oligonucleotide
gtagtcgcagaacccgatcatcattttgcctattc

SEQ ID NO: 89659 - DNA, 35 bp, Artificial Sequence
  Synthetic oligonucleotide
tctcactcagaagcacgcctctgctgttcgttttc

SEQ ID NO: 89660 - DNA, 35 bp, Artificial Sequence
  Synthetic oligonucleotide
tcacacgttgcactttgactccttaacctgacaag

SEQ ID NO: 89661 - DNA, 35 bp, Artificial Sequence
  Synthetic oligonucleotide
gtcttggggaggaggggtggaaaagtaccgcgaag

SEQ ID NO: 89662 - DNA, 35 bp, Artificial Sequence
  Synthetic oligonucleotide
tggacggagtccaacaagggaacggttaacaaacg

SEQ ID NO: 89663 - DNA, 33 bp, Artificial Sequence
  Synthetic oligonucleotide
acgcgatggagaagggcgcatagatggcgaacg

SEQ ID NO: 89664 - DNA, 35 bp, Artificial Sequence
  Synthetic oligonucleotide
aacttccatcacaggccataatcaaacgctaagcg

SEQ ID NO: 89665 - DNA, 35 bp, Artificial Sequence
  Synthetic oligonucleotide
gaaacgggggggaagggcctgtgcgttattgcggg

SEQ ID NO: 89666 - DNA, 35 bp, Artificial Sequence
  Synthetic oligonucleotide
gcatcatcctaccattccaaccgacgtagcttggg

SEQ ID NO: 89667 - DNA, 35 bp, Artificial Sequence
  Synthetic oligonucleotide
gtacagctgcaacatcctccggcacccgtttatgg

SEQ ID NO: 89668 - DNA, 36 bp, Artificial Sequence
  Synthetic oligonucleotide
tcgagagggggtttgctcaaggcggatgccaactgg

SEQ ID NO: 89669 - DNA, 35 bp, Artificial Sequence
  Synthetic oligonucleotide
gcgtgtgagaaatgaagaattggagtaagggcatg

SEQ ID NO: 89670 - DNA, 35 bp, Artificial Sequence
  Synthetic oligonucleotide
tgtcaccactcctatttcttcccatcctgtgagtg

SEQ ID NO: 89671 - DNA, 35 bp, Artificial Sequence
  Synthetic oligonucleotide
acattgcacatatgcgagcctccattcctttcgtg

SEQ ID NO: 89672 - DNA, 35 bp, Artificial Sequence
  Synthetic oligonucleotide
tacatcagggcgcttatcggacattgggaactgtg

SEQ ID NO: 89673 - DNA, 35 bp, Artificial Sequence
  Synthetic oligonucleotide
gcaatgctagtgtggggacggagggtaggtttgtg

SEQ ID NO: 89674 - DNA, 35 bp, Artificial Sequence
  Synthetic oligonucleotide
tacatgcgctttcctccactgtccgcctgatgttg

SEQ ID NO: 89675 - DNA, 35 bp, Artificial Sequence
  Synthetic oligonucleotide
tgcttagcacctcaggtatggcatgcttcccccat

SEQ ID NO: 89676 - DNA, 35 bp, Artificial Sequence
  Synthetic oligonucleotide
attgttgccggcggttctccgcgtttcgacttcat

SEQ ID NO: 89677 - DNA, 35 bp, Artificial Sequence
  Synthetic oligonucleotide
gtgcacgtagcccccacgacagacaatggaacact

SEQ ID NO: 89678 - DNA, 35 bp, Artificial Sequence
  Synthetic oligonucleotide
ggagcatcgatctgtacttcctatcgtccgctact

SEQ ID NO: 89679 - DNA, 35 bp, Artificial Sequence
  Synthetic oligonucleotide
tgtcgccccgtgatgtgcacccgatcgccatccct

SEQ ID NO: 89680 - DNA, 35 bp, Artificial Sequence
  Synthetic oligonucleotide
tgttcacacgccgacgttcatcgcgccgcccttct

SEQ ID NO: 89681 - DNA, 35 bp, Artificial Sequence
  Synthetic oligonucleotide
aatgctcgctctcacagctgtttcatccctggagt

SEQ ID NO: 89682 - DNA, 35 bp, Artificial Sequence
  Synthetic oligonucleotide
gccgccagtcaacgactcccccatccctaggcggt

SEQ ID NO: 89683 - DNA, 35 bp, Artificial Sequence
  Synthetic oligonucleotide
gcatgcacaggatcaccaggggcggtactaggggt

SEQ ID NO: 89684 - DNA, 35 bp, Artificial Sequence
  Synthetic oligonucleotide
ggatggggatagggttctcagtgagacaagggtgt

SEQ ID NO: 89685 - DNA, 35 bp, Artificial Sequence
  Synthetic oligonucleotide
acaccgctctcctcacatcttccatcagcctgctt

SEQ ID NO: 89686 - DNA, 35 bp, Artificial Sequence
  Synthetic oligonucleotide
gattagtcgcgaccagctcgggagcttattaggtt

SEQ ID NO: 89687 - DNA, 36 bp, Artificial Sequence
  Synthetic oligonucleotide
gtgcgttctgcttcggatcccagctgccccttaaaa

SEQ ID NO: 89688 - DNA, 36 bp, Artificial Sequence
  Synthetic oligonucleotide
tgagtgggtagggtggtagcggatgagaatgaacaa

SEQ ID NO: 89689 - DNA, 30 bp, Artificial Sequence
  Synthetic oligonucleotide
ggacaccgcatacaccccccccagccacaa

SEQ ID NO: 89690 - DNA, 35 bp, Artificial Sequence
  Synthetic oligonucleotide
ggtgtgcagaggggggaggtgttacgtcggtggaa

SEQ ID NO: 89691 - DNA, 35 bp, Artificial Sequence
  Synthetic oligonucleotide
tgagccggccgtacactatcgatcgcaacaactaa

SEQ ID NO: 89692 - DNA, 37 bp, Artificial Sequence
  Synthetic oligonucleotide
atgcgaaggaaacaggagaacacatatcagccagtaa

SEQ ID NO: 89693 - DNA, 36 bp, Artificial Sequence
  Synthetic oligonucleotide
gcaggagagggtgggtccgagggaatgattatgtaa

SEQ ID NO: 89694 - DNA, 36 bp, Artificial Sequence
  Synthetic oligonucleotide
tccatgagcccactggtgttacgccttgttgcaaca

SEQ ID NO: 89695 - DNA, 36 bp, Artificial Sequence
  Synthetic oligonucleotide
aattagcccgcaggcatccagccagtacataccaca

SEQ ID NO: 89696 - DNA, 35 bp, Artificial Sequence
  Synthetic oligonucleotide
taaagccgggagggggcggtagtcctggtcggaca

SEQ ID NO: 89697 - DNA, 35 bp, Artificial Sequence
  Synthetic oligonucleotide
aaatgacgcggttgaggggaatcatggttgggaca

SEQ ID NO: 89698 - DNA, 35 bp, Artificial Sequence
  Synthetic oligonucleotide
gattggtactagcatgcccacccactacttcacca

SEQ ID NO: 89699 - DNA, 36 bp, Artificial Sequence
  Synthetic oligonucleotide
tgtaacccaggataggcgaaggatccgctccaccca

SEQ ID NO: 89700 - DNA, 36 bp, Artificial Sequence
  Synthetic oligonucleotide
taccaaagaggcatcatctgcgctacatgtcaccca

SEQ ID NO: 89701 - DNA, 36 bp, Artificial Sequence
  Synthetic oligonucleotide
ttcacaacactcagcatgagcattcgccgcggtcca

SEQ ID NO: 89702 - DNA, 36 bp, Artificial Sequence
  Synthetic oligonucleotide
tcaccccagagggtgagaggccacatgtgctcggca

SEQ ID NO: 89703 - DNA, 36 bp, Artificial Sequence
  Synthetic oligonucleotide
ggacgtggaggtatggtaggtggatagtatcatgca

SEQ ID NO: 89704 - DNA, 36 bp, Artificial Sequence
  Synthetic oligonucleotide
acatcgtgacatctcggtccaaggccatttgcttca

SEQ ID NO: 89705 - DNA, 37 bp, Artificial Sequence
  Synthetic oligonucleotide
tcaagaacggcgaaatattagggggcccgtggaaaga

SEQ ID NO: 89706 - DNA, 37 bp, Artificial Sequence
  Synthetic oligonucleotide
gtgagcgcaaggacacgtgagcgcttatactacaaga

SEQ ID NO: 89707 - DNA, 36 bp, Artificial Sequence
  Synthetic oligonucleotide
gtaccaccgctccatgttatttaattagaaggcaga

SEQ ID NO: 89708 - DNA, 37 bp, Artificial Sequence
  Synthetic oligonucleotide
taccaccgttgcacccaggtttacgttcagtccgaga

SEQ ID NO: 89709 - DNA, 37 bp, Artificial Sequence
  Synthetic oligonucleotide
gcactggcaaggacggtagttatggaaaatgatgaga

SEQ ID NO: 89710 - DNA, 37 bp, Artificial Sequence
  Synthetic oligonucleotide
acccacactccagtctagcacttgaaagactaataga

SEQ ID NO: 89711 - DNA, 37 bp, Artificial Sequence
  Synthetic oligonucleotide
acgcccctgatcagcgtcccccggccattcatctaga

SEQ ID NO: 89712 - DNA, 37 bp, Artificial Sequence
  Synthetic oligonucleotide
gtcaaccgcacaataagcttacatcatctgataacga

SEQ ID NO: 89713 - DNA, 37 bp, Artificial Sequence
  Synthetic oligonucleotide
ggatgcaaggcagatctcttctcgatggtgggcccga

SEQ ID NO: 89714 - DNA, 35 bp, Artificial Sequence
  Synthetic oligonucleotide
tgtgcttgcccgctccctgaggcttatttgcccga

SEQ ID NO: 89715 - DNA, 37 bp, Artificial Sequence
  Synthetic oligonucleotide
gtggacaggacgggtgcgggggtaaggacttgagcga

SEQ ID NO: 89716 - DNA, 35 bp, Artificial Sequence
  Synthetic oligonucleotide
tacgccctccacacgtatgttgtccatgtatgcga

SEQ ID NO: 89717 - DNA, 36 bp, Artificial Sequence
  Synthetic oligonucleotide
gtacgcgggcaagttgggaggtcggtgctctgagga

SEQ ID NO: 89718 - DNA, 37 bp, Artificial Sequence
  Synthetic oligonucleotide
acgtatcagcagggagaaggcgaataaataaatagga

SEQ ID NO: 89719 - DNA, 37 bp, Artificial Sequence
  Synthetic oligonucleotide
gagcgcaccggagctcattgctacaagtatctacgga

SEQ ID NO: 89720 - DNA, 36 bp, Artificial Sequence
  Synthetic oligonucleotide
agcagtacgcgggggtggtaaatcgtgggtgcggga

SEQ ID NO: 89721 - DNA, 36 bp, Artificial Sequence
  Synthetic oligonucleotide
gacaagggagataccggggctctgacgaggtgtgga

SEQ ID NO: 89722 - DNA, 37 bp, Artificial Sequence
  Synthetic oligonucleotide
acgatgcaggagttgctttcatagggggctttgtgga

SEQ ID NO: 89723 - DNA, 36 bp, Artificial Sequence
  Synthetic oligonucleotide
gcactcggagtggccctgtctcgcgatactcttgga

SEQ ID NO: 89724 - DNA, 38 bp, Artificial Sequence
  Synthetic oligonucleotide
tacccaatcagccgccacactgacgtcactttaaatga

SEQ ID NO: 89725 - DNA, 38 bp, Artificial Sequence
  Synthetic oligonucleotide
gggagggctgggaacaagggacactacatctgtcatga

SEQ ID NO: 89726 - DNA, 38 bp, Artificial Sequence
  Synthetic oligonucleotide
gtggtcgccctgttccacgtttgcacactctttcatga

SEQ ID NO: 89727 - DNA, 38 bp, Artificial Sequence
  Synthetic oligonucleotide
gtcaatggaactgacgggataaaagtggggacggatga

SEQ ID NO: 89728 - DNA, 38 bp, Artificial Sequence
  Synthetic oligonucleotide
agtgcgcatgacgggacgtgtggggaggatcgggatga

SEQ ID NO: 89729 - DNA, 38 bp, Artificial Sequence
  Synthetic oligonucleotide
tgatcactccggttgcctaattgcacgacctattatga

SEQ ID NO: 89730 - DNA, 38 bp, Artificial Sequence
  Synthetic oligonucleotide
gaaccctatcacggtgtactactaaacctcttccctga

SEQ ID NO: 89731 - DNA, 38 bp, Artificial Sequence
  Synthetic oligonucleotide
gataactccggctatacacgctgtcttgtctggcctga

SEQ ID NO: 89732 - DNA, 38 bp, Artificial Sequence
  Synthetic oligonucleotide
gccacacgagcacgtgttcagacgatactctacgctga

SEQ ID NO: 89733 - DNA, 37 bp, Artificial Sequence
  Synthetic oligonucleotide
atggaccatcaacagcttggcattaagcctaacgtga

SEQ ID NO: 89734 - DNA, 38 bp, Artificial Sequence
  Synthetic oligonucleotide
tgggaagggtggtgagggatggggcaagtcccacgtga

SEQ ID NO: 89735 - DNA, 38 bp, Artificial Sequence
  Synthetic oligonucleotide
ggtcactcccatgtctcccaatatgccatctcacgtga

SEQ ID NO: 89736 - DNA, 38 bp, Artificial Sequence
  Synthetic oligonucleotide
gtagcggaggctgggtgatgggaaaatagtaaaggtga

SEQ ID NO: 89737 - DNA, 38 bp, Artificial Sequence
  Synthetic oligonucleotide
acacggggggggatatggaaacgtaagtgtgcaggtga

SEQ ID NO: 89738 - DNA, 38 bp, Artificial Sequence
  Synthetic oligonucleotide
gtgcgcggtggcaagtctcagggaagggcgtggggtga

SEQ ID NO: 89739 - DNA, 38 bp, Artificial Sequence
  Synthetic oligonucleotide
gtgggtcagggaacgggttagtgggagcaaaatggtga

SEQ ID NO: 89740 - DNA, 38 bp, Artificial Sequence
  Synthetic oligonucleotide
taccgtcctcggcatctgatccttctcttctcttgtga

SEQ ID NO: 89741 - DNA, 38 bp, Artificial Sequence
  Synthetic oligonucleotide
acgcagttggggggtggtggagtacttgcaggcattga

SEQ ID NO: 89742 - DNA, 38 bp, Artificial Sequence
  Synthetic oligonucleotide
gtgaggggaagaggcctatggtgggcaacgggacttga

SEQ ID NO: 89743 - DNA, 38 bp, Artificial Sequence
  Synthetic oligonucleotide
atgcgctccggtcggttatcatgaactcctcaccttga

SEQ ID NO: 89744 - DNA, 37 bp, Artificial Sequence
  Synthetic oligonucleotide
gtgtccctcaccgccttaacatttgtgaatgtcttga

SEQ ID NO: 89745 - DNA, 38 bp, Artificial Sequence
  Synthetic oligonucleotide
gtgatcgtaaagccacgtgaagtgagcgggcgggttga

SEQ ID NO: 89746 - DNA, 38 bp, Artificial Sequence
  Synthetic oligonucleotide
actcgcgacgttgactaggagggcacgagcctatttga

SEQ ID NO: 89747 - DNA, 38 bp, Artificial Sequence
  Synthetic oligonucleotide
gccactgcaatacgttgctacttccccttgggctttga

SEQ ID NO: 89748 - DNA, 38 bp, Artificial Sequence
  Synthetic oligonucleotide
gttagggggctggtgggaaggaggagcgcgatttttga

SEQ ID NO: 89749 - DNA, 36 bp, Artificial Sequence
  Synthetic oligonucleotide
agtacacgcaaagggtcgtctgctcaccattccata

SEQ ID NO: 89750 - DNA, 35 bp, Artificial Sequence
  Synthetic oligonucleotide
tagagacgaaggaaacaggcggcgaaagtgggata

SEQ ID NO: 89751 - DNA, 36 bp, Artificial Sequence
  Synthetic oligonucleotide
agccggagacattggatcggtgtggcgggaatgcta

SEQ ID NO: 89752 - DNA, 36 bp, Artificial Sequence
  Synthetic oligonucleotide
tatggccaagccagacgtagaacctgctaccatcta

SEQ ID NO: 89753 - DNA, 35 bp, Artificial Sequence
  Synthetic oligonucleotide
atgtgccgcttccattgccagattgcctcttcgta

SEQ ID NO: 89754 - DNA, 35 bp, Artificial Sequence
  Synthetic oligonucleotide
tgtagtccgccacttgatcacatccgcacggtgta

SEQ ID NO: 89755 - DNA, 35 bp, Artificial Sequence
  Synthetic oligonucleotide
tacccaccgtgccgacccgccataatgagtgtgta

SEQ ID NO: 89756 - DNA, 35 bp, Artificial Sequence
  Synthetic oligonucleotide
agtatgcccctcgactggcatagacatgatcctta

SEQ ID NO: 89757 - DNA, 36 bp, Artificial Sequence
  Synthetic oligonucleotide
actgatcgctcgcatgacatctaatcaatctgctta

SEQ ID NO: 89758 - DNA, 36 bp, Artificial Sequence
  Synthetic oligonucleotide
atcaaccgcaaagttgtcgtatggcttgcccagtta

SEQ ID NO: 89759 - DNA, 36 bp, Artificial Sequence
  Synthetic oligonucleotide
accgcatggccaggcttaaatttctcggtcttgtta

SEQ ID NO: 89760 - DNA, 35 bp, Artificial Sequence
  Synthetic oligonucleotide
tgccctgacgcagcagctcatcttggctgaaccac

SEQ ID NO: 89761 - DNA, 35 bp, Artificial Sequence
  Synthetic oligonucleotide
taatagggccactccacctgttaccagttttgcac

SEQ ID NO: 89762 - DNA, 35 bp, Artificial Sequence
  Synthetic oligonucleotide
ttgcggcccctgaatgtctccctaatgctccttac

SEQ ID NO: 89763 - DNA, 35 bp, Artificial Sequence
  Synthetic oligonucleotide
gaggtcgaagcgcataggattttctcatttgcacc

SEQ ID NO: 89764 - DNA, 35 bp, Artificial Sequence
  Synthetic oligonucleotide
tctgcgctcatctgcatctttggttctattcaccc

SEQ ID NO: 89765 - DNA, 35 bp, Artificial Sequence
  Synthetic oligonucleotide
gcacatacgctagcctgtttggccgtttcttgccc

SEQ ID NO: 89766 - DNA, 35 bp, Artificial Sequence
  Synthetic oligonucleotide
agatggtgcaaggggaagcggattcggcataggcc

SEQ ID NO: 89767 - DNA, 35 bp, Artificial Sequence
  Synthetic oligonucleotide
attgaagtactgcctcccgtggactttctctggcc

SEQ ID NO: 89768 - DNA, 35 bp, Artificial Sequence
  Synthetic oligonucleotide
cagatagctccagcgttgcccctcccgttcactcc

SEQ ID NO: 89769 - DNA, 35 bp, Artificial Sequence
  Synthetic oligonucleotide
gacacgcagtgccaaatggtgtcgcgctcaatcgc

SEQ ID NO: 89770 - DNA, 35 bp, Artificial Sequence
  Synthetic oligonucleotide
gttaggcctcacttattccatcagccacgattggc

SEQ ID NO: 89771 - DNA, 35 bp, Artificial Sequence
  Synthetic oligonucleotide
gcccatgccggtagataccgccacgatgacccatc

SEQ ID NO: 89772 - DNA, 35 bp, Artificial Sequence
  Synthetic oligonucleotide
tcgattcctcccacgtggttagttttgcttggatc

SEQ ID NO: 89773 - DNA, 35 bp, Artificial Sequence
  Synthetic oligonucleotide
tggatcctcctgagcattaacatggcgaagcactc

SEQ ID NO: 89774 - DNA, 35 bp, Artificial Sequence
  Synthetic oligonucleotide
agccgacattgttactatttcgctgcctggtactc

SEQ ID NO: 89775 - DNA, 35 bp, Artificial Sequence
  Synthetic oligonucleotide
gtaatccgcaaacccgatgcgtgcattctttgctc

SEQ ID NO: 89776 - DNA, 35 bp, Artificial Sequence
  Synthetic oligonucleotide
gcattgacccagctggatgcctctatgtctctctc

SEQ ID NO: 89777 - DNA, 35 bp, Artificial Sequence
  Synthetic oligonucleotide
tcaagcgcatcgatccgctggccgccgtttttgtc

SEQ ID NO: 89778 - DNA, 35 bp, Artificial Sequence
  Synthetic oligonucleotide
tgcgaaaaggagtagtgggcaaggaactgggaaag

SEQ ID NO: 89779 - DNA, 35 bp, Artificial Sequence
  Synthetic oligonucleotide
gatcaacctccaagtgacgtcaatttgccagggag

SEQ ID NO: 89780 - DNA, 35 bp, Artificial Sequence
  Synthetic oligonucleotide
gcccgacctctctcttcgtcacagggaagctaccg

SEQ ID NO: 89781 - DNA, 35 bp, Artificial Sequence
  Synthetic oligonucleotide
gcatgaactcacactactataaagctctggcgccg

SEQ ID NO: 89782 - DNA, 35 bp, Artificial Sequence
  Synthetic oligonucleotide
ttggaaacagggggcgacagggtggggttagaggg

SEQ ID NO: 89783 - DNA, 35 bp, Artificial Sequence
  Synthetic oligonucleotide
aagaagagcggccaagcgaaagttcatgggagggg

SEQ ID NO: 89784 - DNA, 35 bp, Artificial Sequence
  Synthetic oligonucleotide
gagagtggggcggggccgcgggagaacaacaggtg

SEQ ID NO: 89785 - DNA, 35 bp, Artificial Sequence
  Synthetic oligonucleotide
tacaccgctaccaacttcaattatatgctgtcttg

SEQ ID NO: 89786 - DNA, 35 bp, Artificial Sequence
  Synthetic oligonucleotide
ttcgttcgggaagtgttttcttgtaactccccact

SEQ ID NO: 89787 - DNA, 35 bp, Artificial Sequence
  Synthetic oligonucleotide
acctagagccccgattctacaagcatagctcacct

SEQ ID NO: 89788 - DNA, 35 bp, Artificial Sequence
  Synthetic oligonucleotide
gacgctccgctgccttcggtggaactctcagccct

SEQ ID NO: 89789 - DNA, 35 bp, Artificial Sequence
  Synthetic oligonucleotide
gtctcgaaggggaagggtgagcgggcgtggaagct

SEQ ID NO: 89790 - DNA, 35 bp, Artificial Sequence
  Synthetic oligonucleotide
gtggaacggccgagcgttggtttttacgcttttct

SEQ ID NO: 89791 - DNA, 35 bp, Artificial Sequence
  Synthetic oligonucleotide
accgagatgtacggcaaggaaggaggcggtgaagt

SEQ ID NO: 89792 - DNA, 35 bp, Artificial Sequence
  Synthetic oligonucleotide
gacgggccagaggcaaacattatactcaccgcggt

SEQ ID NO: 89793 - DNA, 35 bp, Artificial Sequence
  Synthetic oligonucleotide
atgttgcacccagctgctatctggtactcacgctt

SEQ ID NO: 89794 - DNA, 36 bp, Artificial Sequence
  Synthetic oligonucleotide
tcaccatgctcccattctaccagtcacagtgcaaaa

SEQ ID NO: 89795 - DNA, 35 bp, Artificial Sequence
  Synthetic oligonucleotide
atggagggtgaggggtgacgctagggggtgccaaa

SEQ ID NO: 89796 - DNA, 36 bp, Artificial Sequence
  Synthetic oligonucleotide
aagtaaagagacgaaagtgatgaggagtcgtggaaa

SEQ ID NO: 89797 - DNA, 38 bp, Artificial Sequence
  Synthetic oligonucleotide
tgagaaggtacgtcggggtttgggaggtagcgggacaa

SEQ ID NO: 89798 - DNA, 35 bp, Artificial Sequence
  Synthetic oligonucleotide
gccaacctgtcactgccaaattgtgagaacgtgaa

SEQ ID NO: 89799 - DNA, 35 bp, Artificial Sequence
  Synthetic oligonucleotide
aacccgcccatccgttgtcatgataattggagtaa

SEQ ID NO: 89800 - DNA, 36 bp, Artificial Sequence
  Synthetic oligonucleotide
atgaccgggcgatggtggcggtaaccggggtcaaca

SEQ ID NO: 89801 - DNA, 36 bp, Artificial Sequence
  Synthetic oligonucleotide
ggtagagcctccaccgtgtcccatctagctattaca

SEQ ID NO: 89802 - DNA, 35 bp, Artificial Sequence
  Synthetic oligonucleotide
tgccactgcgctgtgcattgtaattaacctaccca

SEQ ID NO: 89803 - DNA, 36 bp, Artificial Sequence
  Synthetic oligonucleotide
tccacgaatcatatgagtcattctggtacgtaccca

SEQ ID NO: 89804 - DNA, 35 bp, Artificial Sequence
  Synthetic oligonucleotide
ggacgacccacctgcgagcgaaaggatcagcccca

SEQ ID NO: 89805 - DNA, 35 bp, Artificial Sequence
  Synthetic oligonucleotide
tccgaagggcatcgttagccttccgaattttagca

SEQ ID NO: 89806 - DNA, 36 bp, Artificial Sequence
  Synthetic oligonucleotide
agcaaggtagcatgagctcagggggagatgagggca

SEQ ID NO: 89807 - DNA, 35 bp, Artificial Sequence
  Synthetic oligonucleotide
aggaccaggaccgcatgctccacgttttttttgca

SEQ ID NO: 89808 - DNA, 35 bp, Artificial Sequence
  Synthetic oligonucleotide
gcctaccgcatagtcatctttcacgcgcaacctca

SEQ ID NO: 89809 - DNA, 37 bp, Artificial Sequence
  Synthetic oligonucleotide
gagaggagaaaaggagtatatactgtgcactgaaaga

SEQ ID NO: 89810 - DNA, 37 bp, Artificial Sequence
  Synthetic oligonucleotide
gagggacggcacaactctgaaatagcaggcttacaga

SEQ ID NO: 89811 - DNA, 37 bp, Artificial Sequence
  Synthetic oligonucleotide
gcacctgggaaaagtggcaaggaggaaaaggctcaga

SEQ ID NO: 89812 - DNA, 37 bp, Artificial Sequence
  Synthetic oligonucleotide
attcgatgtaggagtcggagggggaaagagcgcgaga

SEQ ID NO: 89813 - DNA, 37 bp, Artificial Sequence
  Synthetic oligonucleotide
tctgtccagcactggtctgtgggaggggagagggaga

SEQ ID NO: 89814 - DNA, 35 bp, Artificial Sequence
  Synthetic oligonucleotide
aacaagcgaggtgcatggctctgtaaggggtgaga

SEQ ID NO: 89815 - DNA, 37 bp, Artificial Sequence
  Synthetic oligonucleotide
acccccatcgctagatatagcttactcctgatttaga

SEQ ID NO: 89816 - DNA, 37 bp, Artificial Sequence
  Synthetic oligonucleotide
acgtcccgcgactttatctgccaccgatacaccacga

SEQ ID NO: 89817 - DNA, 37 bp, Artificial Sequence
  Synthetic oligonucleotide
tcacgagtgcagattgaatagtcttcccccaatccga

SEQ ID NO: 89818 - DNA, 37 bp, Artificial Sequence
  Synthetic oligonucleotide
ataagtcgtgcggtgggaaagcgggacgagatggcga

SEQ ID NO: 89819 - DNA, 37 bp, Artificial Sequence
  Synthetic oligonucleotide
agggaggagggagaggggtggctaggggccggtgcga

SEQ ID NO: 89820 - DNA, 37 bp, Artificial Sequence
  Synthetic oligonucleotide
gtgtaaccccgccactagtataaatgccattgtgcga

SEQ ID NO: 89821 - DNA, 35 bp, Artificial Sequence
  Synthetic oligonucleotide
tgtacctcgcgccggcttcttagctttgcaatcga

SEQ ID NO: 89822 - DNA, 36 bp, Artificial Sequence
  Synthetic oligonucleotide
tctcatgtccggtcgtaccctcatctgttaattcga

SEQ ID NO: 89823 - DNA, 37 bp, Artificial Sequence
  Synthetic oligonucleotide
aactgcaggacggaaatggcaggtagaagggaaagga

SEQ ID NO: 89824 - DNA, 37 bp, Artificial Sequence
  Synthetic oligonucleotide
gtggctaggtaaaagggctaataggggttgatgagga

SEQ ID NO: 89825 - DNA, 37 bp, Artificial Sequence
  Synthetic oligonucleotide
tgacaggaggatagtaagggtctgagggctagtcgga

SEQ ID NO: 89826 - DNA, 36 bp, Artificial Sequence
  Synthetic oligonucleotide
ttgaactggtccaactgcatgcctcacgacgcggga

SEQ ID NO: 89827 - DNA, 37 bp, Artificial Sequence
  Synthetic oligonucleotide
taggagggtccaggtcggggttatttgcgtaggggga

SEQ ID NO: 89828 - DNA, 37 bp, Artificial Sequence
  Synthetic oligonucleotide
atggacggaaaatcacgggggatcaaagaagctggga

SEQ ID NO: 89829 - DNA, 37 bp, Artificial Sequence
  Synthetic oligonucleotide
aacccgagagggaattttctaaacacaggggaatgga

SEQ ID NO: 89830 - DNA, 37 bp, Artificial Sequence
  Synthetic oligonucleotide
ggatgaaagatgtgtggggtggaactcgtgtgatgga

SEQ ID NO: 89831 - DNA, 37 bp, Artificial Sequence
  Synthetic oligonucleotide
atgcactccgtctgtacactcccataaattgcctgga

SEQ ID NO: 89832 - DNA, 38 bp, Artificial Sequence
  Synthetic oligonucleotide
tgtgagcaaagaggaacaaggacccgtagagagaatga

SEQ ID NO: 89833 - DNA, 38 bp, Artificial Sequence
  Synthetic oligonucleotide
atcccgcatggtcgagactctgcatcacgagaccatga

SEQ ID NO: 89834 - DNA, 38 bp, Artificial Sequence
  Synthetic oligonucleotide
ttgatcacatcgcgcactgtagcaaggttccactatga

SEQ ID NO: 89835 - DNA, 38 bp, Artificial Sequence
  Synthetic oligonucleotide
aaacgcggcacgactatcgaatctgaccctctctatga

SEQ ID NO: 89836 - DNA, 38 bp, Artificial Sequence
  Synthetic oligonucleotide
aatcgaccggtcgacgtactctatcactgctcaactga

SEQ ID NO: 89837 - DNA, 38 bp, Artificial Sequence
  Synthetic oligonucleotide
gaggacagtcagcaggcagggaaacagatatgaactga

SEQ ID NO: 89838 - DNA, 38 bp, Artificial Sequence
  Synthetic oligonucleotide
acccgcacccctggagcgtaggactgcattctaactga

SEQ ID NO: 89839 - DNA, 38 bp, Artificial Sequence
  Synthetic oligonucleotide
gccttatgccaatggttacccctccatccagacactga

SEQ ID NO: 89840 - DNA, 37 bp, Artificial Sequence
  Synthetic oligonucleotide
tccgcacagccataggtatgcaacctttcgatcctga

SEQ ID NO: 89841 - DNA, 35 bp, Artificial Sequence
  Synthetic oligonucleotide
gccccacccagcctgtcccgtatcgaaagctctga

SEQ ID NO: 89842 - DNA, 38 bp, Artificial Sequence
  Synthetic oligonucleotide
gacgccatgggggggcctagaatggcagtctttagtga

SEQ ID NO: 89843 - DNA, 38 bp, Artificial Sequence
  Synthetic oligonucleotide
ggagcgggcgccgctaaatctggactcttctcccgtga

SEQ ID NO: 89844 - DNA, 38 bp, Artificial Sequence
  Synthetic oligonucleotide
ttgccgcccgctagataaacacccccgtaatgccgtga

SEQ ID NO: 89845 - DNA, 38 bp, Artificial Sequence
  Synthetic oligonucleotide
gtgaacggaagtgggggtaagctaaggatagagggtga

SEQ ID NO: 89846 - DNA, 37 bp, Artificial Sequence
  Synthetic oligonucleotide
gaagagggatgcaaacatacggagagatggatggtga

SEQ ID NO: 89847 - DNA, 38 bp, Artificial Sequence
  Synthetic oligonucleotide
gcaccccattgctatatcctgtccgaaaacaaatgtga

SEQ ID NO: 89848 - DNA, 38 bp, Artificial Sequence
  Synthetic oligonucleotide
aatagggaggggccatgcgagtgaggagcggaatgtga

SEQ ID NO: 89849 - DNA, 38 bp, Artificial Sequence
  Synthetic oligonucleotide
agagaccgtgagaccagaaagaagggcaagtactgtga

SEQ ID NO: 89850 - DNA, 38 bp, Artificial Sequence
  Synthetic oligonucleotide
tgaccacacatcaaacggactatgagtaggtagattga

SEQ ID NO: 89851 - DNA, 37 bp, Artificial Sequence
  Synthetic oligonucleotide
gccgtgcctctagctttttttgctattgcatacttga

SEQ ID NO: 89852 - DNA, 38 bp, Artificial Sequence
  Synthetic oligonucleotide
gcccgcaaagatctaattcctcatcgcctgtaccttga

SEQ ID NO: 89853 - DNA, 38 bp, Artificial Sequence
  Synthetic oligonucleotide
aataggcggaaaagagggctggaaagaaaggggcttga

SEQ ID NO: 89854 - DNA, 37 bp, Artificial Sequence
  Synthetic oligonucleotide
actcactcgcgctggctatccgttgtactttgcttga

SEQ ID NO: 89855 - DNA, 35 bp, Artificial Sequence
  Synthetic oligonucleotide
tatgcaccaacggagtgaagagttggagaagttga

SEQ ID NO: 89856 - DNA, 38 bp, Artificial Sequence
  Synthetic oligonucleotide
gagtgctcaacctccaactcccatcctgccgaagttga

SEQ ID NO: 89857 - DNA, 37 bp, Artificial Sequence
  Synthetic oligonucleotide
tgaggatgcacaatgggaacgtgggggctgcagttga

SEQ ID NO: 89858 - DNA, 38 bp, Artificial Sequence
  Synthetic oligonucleotide
tctcaaccaccgacagcaatcaatttcgacttcgttga

SEQ ID NO: 89859 - DNA, 38 bp, Artificial Sequence
  Synthetic oligonucleotide
accaggggaagaagcatggggaactggggtacggttga

SEQ ID NO: 89860 - DNA, 37 bp, Artificial Sequence
  Synthetic oligonucleotide
aagttgacacagcagtatataggactttggatgttga

SEQ ID NO: 89861 - DNA, 38 bp, Artificial Sequence
  Synthetic oligonucleotide
tcacgcacctttctatgaattagtatgccaacctttga

SEQ ID NO: 89862 - DNA, 38 bp, Artificial Sequence
  Synthetic oligonucleotide
gggactgcccaactatgctcgcgtgatccgctttttga

SEQ ID NO: 89863 - DNA, 36 bp, Artificial Sequence
  Synthetic oligonucleotide
tctggcaccaccaattcgctacgactcttccgaata

SEQ ID NO: 89864 - DNA, 36 bp, Artificial Sequence
  Synthetic oligonucleotide
gttacgccgtgaaggggccatctattcgatttcata

SEQ ID NO: 89865 - DNA, 36 bp, Artificial Sequence
  Synthetic oligonucleotide
gaccgctccccgactcacaagaccgaaacatggata

SEQ ID NO: 89866 - DNA, 36 bp, Artificial Sequence
  Synthetic oligonucleotide
tacgggatcgagacccttctatgcaccatgttacta

SEQ ID NO: 89867 - DNA, 35 bp, Artificial Sequence
  Synthetic oligonucleotide
agcacgggcaagcagtagtaaaactgttggaccta

SEQ ID NO: 89868 - DNA, 36 bp, Artificial Sequence
  Synthetic oligonucleotide
atggccggagttaaacggcgttcttaccttggccta

SEQ ID NO: 89869 - DNA, 36 bp, Artificial Sequence
  Synthetic oligonucleotide
acccaaccagtgagtacagcccatctgggtacgcta

SEQ ID NO: 89870 - DNA, 36 bp, Artificial Sequence
  Synthetic oligonucleotide
acatatacgcactgacggctactgttgcctgcgcta

SEQ ID NO: 89871 - DNA, 35 bp, Artificial Sequence
  Synthetic oligonucleotide
atggtgctgtccagcctggctgaatgctctgtcta

SEQ ID NO: 89872 - DNA, 35 bp, Artificial Sequence
  Synthetic oligonucleotide
gccacgtttacaggggagggaaggtggtttttcta

SEQ ID NO: 89873 - DNA, 37 bp, Artificial Sequence
  Synthetic oligonucleotide
attgcgtgccatctctgaaaggctgtcgccacccgta

SEQ ID NO: 89874 - DNA, 36 bp, Artificial Sequence
  Synthetic oligonucleotide
tgtatcgcgccaccactgggtcataccacctccgta

SEQ ID NO: 89875 - DNA, 35 bp, Artificial Sequence
  Synthetic oligonucleotide
tgatcgtactggtgtcctggcccgcccacttcgta

SEQ ID NO: 89876 - DNA, 35 bp, Artificial Sequence
  Synthetic oligonucleotide
tccaaccacattcgcactcgtcacccggggaggta

SEQ ID NO: 89877 - DNA, 36 bp, Artificial Sequence
  Synthetic oligonucleotide
ggatcaggtagctgggtgagggtgaggtggatggta

SEQ ID NO: 89878 - DNA, 36 bp, Artificial Sequence
  Synthetic oligonucleotide
gagaggcgagaggagggacgggagaccagttttgta

SEQ ID NO: 89879 - DNA, 35 bp, Artificial Sequence
  Synthetic oligonucleotide
gaccatctcgagtaatgcagaacaaccgctcctta

SEQ ID NO: 89880 - DNA, 35 bp, Artificial Sequence
  Synthetic oligonucleotide
tcacaggatagggacaaaggaattatgaagggtta

SEQ ID NO: 89881 - DNA, 35 bp, Artificial Sequence
  Synthetic oligonucleotide
accaccgcgttatatacgtggtttgggtttcttta

SEQ ID NO: 89882 - DNA, 36 bp, Artificial Sequence
  Synthetic oligonucleotide
tctcaccctggccggtgcctacaagtcgttatttta

SEQ ID NO: 89883 - DNA, 35 bp, Artificial Sequence
  Synthetic oligonucleotide
gtgggggagggggagataaattcactagcaagcac

SEQ ID NO: 89884 - DNA, 35 bp, Artificial Sequence
  Synthetic oligonucleotide
actaccacaagacaggcctacttcgcttccgcgac

SEQ ID NO: 89885 - DNA, 35 bp, Artificial Sequence
  Synthetic oligonucleotide
tcagtggagcctccgcctcgatcccgttctttgac

SEQ ID NO: 89886 - DNA, 35 bp, Artificial Sequence
  Synthetic oligonucleotide
acgttgtgggtcagtccctgtagctctccacttac

SEQ ID NO: 89887 - DNA, 35 bp, Artificial Sequence
  Synthetic oligonucleotide
tgaacacgttatgccggccagcaactcccttttac

SEQ ID NO: 89888 - DNA, 35 bp, Artificial Sequence
  Synthetic oligonucleotide
gatcacgaagatgacaacactgctaatcctctacc

SEQ ID NO: 89889 - DNA, 35 bp, Artificial Sequence
  Synthetic oligonucleotide
atcatctcatgtagctcatcagcgtacacgctgcc

SEQ ID NO: 89890 - DNA, 35 bp, Artificial Sequence
  Synthetic oligonucleotide
tcctccaccggtgtgagggtatcatttaatctgcc

SEQ ID NO: 89891 - DNA, 35 bp, Artificial Sequence
  Synthetic oligonucleotide
gatggggggggaaacgagtaaggggatgctcaagc

SEQ ID NO: 89892 - DNA, 35 bp, Artificial Sequence
  Synthetic oligonucleotide
ggacatacctccgctcctctataggtcttgtaagc

SEQ ID NO: 89893 - DNA, 35 bp, Artificial Sequence
  Synthetic oligonucleotide
ggtgtaggggaagaaggattgcaataggcgagcgc

SEQ ID NO: 89894 - DNA, 35 bp, Artificial Sequence
  Synthetic oligonucleotide
actaccattccagctgtctaaaaacactagccatc

SEQ ID NO: 89895 - DNA, 35 bp, Artificial Sequence
  Synthetic oligonucleotide
ggggccgacgcgcctgtcgggccctcttgcccctc

SEQ ID NO: 89896 - DNA, 35 bp, Artificial Sequence
  Synthetic oligonucleotide
tcccgactcctcacccgtttctgcggttcacgctc

SEQ ID NO: 89897 - DNA, 35 bp, Artificial Sequence
  Synthetic oligonucleotide
gactgccaagccctgagtttgtcaccaattgagtc

SEQ ID NO: 89898 - DNA, 35 bp, Artificial Sequence
  Synthetic oligonucleotide
gacacgcattaaacgaacgcggtctggaaggcttc

SEQ ID NO: 89899 - DNA, 35 bp, Artificial Sequence
  Synthetic oligonucleotide
acgtagagtcccaacagcttgagtcacgtcctttc

SEQ ID NO: 89900 - DNA, 35 bp, Artificial Sequence
  Synthetic oligonucleotide
ttgtgcagtcgcgccatccaccagttcgacccaag

SEQ ID NO: 89901 - DNA, 35 bp, Artificial Sequence
  Synthetic oligonucleotide
tcacaacaccgccctgcctaacgtccccgacccag

SEQ ID NO: 89902 - DNA, 35 bp, Artificial Sequence
  Synthetic oligonucleotide
ggaaagaccaagcaaatcgacgaagggaccagcag

SEQ ID NO: 89903 - DNA, 35 bp, Artificial Sequence
  Synthetic oligonucleotide
gggtagaagcggtcggagggaaggaagcggacgag

SEQ ID NO: 89904 - DNA, 35 bp, Artificial Sequence
  Synthetic oligonucleotide
taaggagagggaaaagagttgtagggaattgtgag

SEQ ID NO: 89905 - DNA, 35 bp, Artificial Sequence
  Synthetic oligonucleotide
gtgcatgccacagctcccgcgtacctcctgttgag

SEQ ID NO: 89906 - DNA, 35 bp, Artificial Sequence
  Synthetic oligonucleotide
aggtgcccagcccccttcagtatccacttttctag

SEQ ID NO: 89907 - DNA, 35 bp, Artificial Sequence
  Synthetic oligonucleotide
taaaacgatgggttggccatagggatggggagtag

SEQ ID NO: 89908 - DNA, 35 bp, Artificial Sequence
  Synthetic oligonucleotide
tcattcgcacatattatatcgactccgaactaacg

SEQ ID NO: 89909 - DNA, 35 bp, Artificial Sequence
  Synthetic oligonucleotide
tcaaacggcctcatatcgactgccccctaagaccg

SEQ ID NO: 89910 - DNA, 35 bp, Artificial Sequence
  Synthetic oligonucleotide
tcacgtcgacgttctattcattttgctctcgcccg

SEQ ID NO: 89911 - DNA, 35 bp, Artificial Sequence
  Synthetic oligonucleotide
tatgggacggcgtaggtggggcacaaaggttagcg

SEQ ID NO: 89912 - DNA, 35 bp, Artificial Sequence
  Synthetic oligonucleotide
atattggccaacccgactcaatttcgacactggcg

SEQ ID NO: 89913 - DNA, 35 bp, Artificial Sequence
  Synthetic oligonucleotide
gtcctcgcaggtttggtcttgtactactcatctcg

SEQ ID NO: 89914 - DNA, 35 bp, Artificial Sequence
  Synthetic oligonucleotide
tcatggtccaggctccccgtcgtttcgtacaccgg

SEQ ID NO: 89915 - DNA, 35 bp, Artificial Sequence
  Synthetic oligonucleotide
ttgagtcagacaatacagattaacgggggggcggg

SEQ ID NO: 89916 - DNA, 35 bp, Artificial Sequence
  Synthetic oligonucleotide
tgcaccagtgaggagggagtggaaacttagagggg

SEQ ID NO: 89917 - DNA, 35 bp, Artificial Sequence
  Synthetic oligonucleotide
atgtcgagcaggaggaggaagggcgtaggggttgg

SEQ ID NO: 89918 - DNA, 35 bp, Artificial Sequence
  Synthetic oligonucleotide
gacgaccataaagatctcatcagtgaacacaaatg

SEQ ID NO: 89919 - DNA, 35 bp, Artificial Sequence
  Synthetic oligonucleotide
aacttgctacgttcaccatccgacataggctgctg

SEQ ID NO: 89920 - DNA, 35 bp, Artificial Sequence
  Synthetic oligonucleotide
aaagccgggcgtcatttgctccatcccattgcgat

SEQ ID NO: 89921 - DNA, 35 bp, Artificial Sequence
  Synthetic oligonucleotide
acaaaagggcgggctgctcttggtccacatcacct

SEQ ID NO: 89922 - DNA, 35 bp, Artificial Sequence
  Synthetic oligonucleotide
ggatggtgggtaggtggtggaatttgaggggtcct

SEQ ID NO: 89923 - DNA, 35 bp, Artificial Sequence
  Synthetic oligonucleotide
tccacgacagcagctgcgggattgccgcttactct

SEQ ID NO: 89924 - DNA, 35 bp, Artificial Sequence
  Synthetic oligonucleotide
gtgcgcatcgacgtactgctcatcgcttatgctct

SEQ ID NO: 89925 - DNA, 35 bp, Artificial Sequence
  Synthetic oligonucleotide
aggacccatcctccgtcagtgcttgcatttattct

SEQ ID NO: 89926 - DNA, 35 bp, Artificial Sequence
  Synthetic oligonucleotide
tgtggagggcgagcgagaggacgaatttaccaagt

SEQ ID NO: 89927 - DNA, 35 bp, Artificial Sequence
  Synthetic oligonucleotide
ttccacccaccagtagttgccccatccgcttcggt

SEQ ID NO: 89928 - DNA, 35 bp, Artificial Sequence
  Synthetic oligonucleotide
gaggggatcaggggactagggggaggctacgtatt

SEQ ID NO: 89929 - DNA, 35 bp, Artificial Sequence
  Synthetic oligonucleotide
ttctgcaaacccggttttcactgtaaatgccactt

SEQ ID NO: 89930 - DNA, 35 bp, Artificial Sequence
  Synthetic oligonucleotide
ttggggctgtgcgacgctattactttttgttcctt

SEQ ID NO: 89931 - DNA, 35 bp, Artificial Sequence
  Synthetic oligonucleotide
tcagtgggccggatcatggagggggggcacccgtt

SEQ ID NO: 89932 - DNA, 35 bp, Artificial Sequence
  Synthetic oligonucleotide
agtggtcggtcgaatagagaggggtgtattgggtt

SEQ ID NO: 89933 - DNA, 35 bp, Artificial Sequence
  Synthetic oligonucleotide
atcagccaggcactcttgaaccgcctcctttggtt

SEQ ID NO: 89934 - DNA, 35 bp, Artificial Sequence
  Synthetic oligonucleotide
tccgtgagattgtcgcgttcgccctcaagttcttt

SEQ ID NO: 89935 - DNA, 36 bp, Artificial Sequence
  Synthetic oligonucleotide
actgggccggcattcacggtgcatctcacgctaaaa

SEQ ID NO: 89936 - DNA, 36 bp, Artificial Sequence
  Synthetic oligonucleotide
tgcgggacaaaaagggtgttcgattgtggttgtaaa

SEQ ID NO: 89937 - DNA, 36 bp, Artificial Sequence
  Synthetic oligonucleotide
gtggcctgggtccctcggcgtacttgaccctttcaa

SEQ ID NO: 89938 - DNA, 35 bp, Artificial Sequence
  Synthetic oligonucleotide
gtcagagggacctggggaagaggaggcatacataa

SEQ ID NO: 89939 - DNA, 36 bp, Artificial Sequence
  Synthetic oligonucleotide
tcctctagcacggataagatgggagggggaatgtaa

SEQ ID NO: 89940 - DNA, 35 bp, Artificial Sequence
  Synthetic oligonucleotide
tcaacgctcccggaactcatggctgctacgcttaa

SEQ ID NO: 89941 - DNA, 36 bp, Artificial Sequence
  Synthetic oligonucleotide
tagaccatcgaatatgacttttattaacggcccaca

SEQ ID NO: 89942 - DNA, 35 bp, Artificial Sequence
  Synthetic oligonucleotide
gcgtgcccccgctgagcccgagccaggtttgcaca

SEQ ID NO: 89943 - DNA, 36 bp, Artificial Sequence
  Synthetic oligonucleotide
tgaagcacaggacttggctgaccttacacctctaca

SEQ ID NO: 89944 - DNA, 36 bp, Artificial Sequence
  Synthetic oligonucleotide
aatgcgcaatgcaccaaaagtacagcttctacacca

SEQ ID NO: 89945 - DNA, 36 bp, Artificial Sequence
  Synthetic oligonucleotide
ttgtgcaaggactgccatctagcggcgctaccacca

SEQ ID NO: 89946 - DNA, 36 bp, Artificial Sequence
  Synthetic oligonucleotide
ttgacgtgaaacctctgataacgtagctgttaccca

SEQ ID NO: 89947 - DNA, 35 bp, Artificial Sequence
  Synthetic oligonucleotide
gaggtgcatatcgttaaccccagcacatacatgca

SEQ ID NO: 89948 - DNA, 35 bp, Artificial Sequence
  Synthetic oligonucleotide
ttgagcgggagaccatcagcgccttgagtccatca

SEQ ID NO: 89949 - DNA, 35 bp, Artificial Sequence
  Synthetic oligonucleotide
tgtggacttaccatcccgttttaggtcgatcatca

SEQ ID NO: 89950 - DNA, 36 bp, Artificial Sequence
  Synthetic oligonucleotide
tgaggagagggccgcgggtaggtcaggtgaatctca

SEQ ID NO: 89951 - DNA, 37 bp, Artificial Sequence
  Synthetic oligonucleotide
gggtggtggggggtagataggtaagcagcttgagaga

SEQ ID NO: 89952 - DNA, 37 bp, Artificial Sequence
  Synthetic oligonucleotide
gcgagaggaggtattgcacaaaggaaacagatcgaga

SEQ ID NO: 89953 - DNA, 37 bp, Artificial Sequence
  Synthetic oligonucleotide
tatgacgcatggagcttaagggtgggggcctgttaga

SEQ ID NO: 89954 - DNA, 36 bp, Artificial Sequence
  Synthetic oligonucleotide
tgctggtcaccttcatgtccactatcgcatttacga

SEQ ID NO: 89955 - DNA, 37 bp, Artificial Sequence
  Synthetic oligonucleotide
tcacggcccttagttgtattacctcgtcccggcccga

SEQ ID NO: 89956 - DNA, 37 bp, Artificial Sequence
  Synthetic oligonucleotide
ttgggaggggcactaaaattgaaggggactgtcccga

SEQ ID NO: 89957 - DNA, 37 bp, Artificial Sequence
  Synthetic oligonucleotide
acggggggccgaaagatagagcgataggggatgccga

SEQ ID NO: 89958 - DNA, 37 bp, Artificial Sequence
  Synthetic oligonucleotide
atgcattccctctactgcgtgtcacatactcatccga

SEQ ID NO: 89959 - DNA, 36 bp, Artificial Sequence
  Synthetic oligonucleotide
gtgcactccatgtgcgtcgtaccctttagcttccga

SEQ ID NO: 89960 - DNA, 35 bp, Artificial Sequence
  Synthetic oligonucleotide
tcagaagtgaggggaaggtgaatttgcaagcgcga

SEQ ID NO: 89961 - DNA, 37 bp, Artificial Sequence
  Synthetic oligonucleotide
agctcgccagactacttgctattacacacctggtcga

SEQ ID NO: 89962 - DNA, 37 bp, Artificial Sequence
  Synthetic oligonucleotide
ggacatcgcaactccttcgtcagggcaaccacttcga

SEQ ID NO: 89963 - DNA, 37 bp, Artificial Sequence
  Synthetic oligonucleotide
ttgacctgcactcttccttgtttaatttccgcaagga

SEQ ID NO: 89964 - DNA, 37 bp, Artificial Sequence
  Synthetic oligonucleotide
gaccaacgatgaagagtggtgtgctatgttggaagga

SEQ ID NO: 89965 - DNA, 37 bp, Artificial Sequence
  Synthetic oligonucleotide
ctgcaaagcacgaccgacgtccttatggcttacagga

SEQ ID NO: 89966 - DNA, 37 bp, Artificial Sequence
  Synthetic oligonucleotide
gagccgactccgaactgtacgtcagacatgaccagga

SEQ ID NO: 89967 - DNA, 37 bp, Artificial Sequence
  Synthetic oligonucleotide
gccggggtggattcgagaggagaaggggccgccagga

SEQ ID NO: 89968 - DNA, 37 bp, Artificial Sequence
  Synthetic oligonucleotide
tccatgcccaggtggtctgacttttttggtgtgcgga

SEQ ID NO: 89969 - DNA, 37 bp, Artificial Sequence
  Synthetic oligonucleotide
gcctaaggcagagagaaacctgggggaactggaggga

SEQ ID NO: 89970 - DNA, 38 bp, Artificial Sequence
  Synthetic oligonucleotide
gggtcaacgagatggtcttaactagaagggcaagggga

SEQ ID NO: 89971 - DNA, 37 bp, Artificial Sequence
  Synthetic oligonucleotide
tgtggggtcgaatgcgggtcggggcacgcgacgggga

SEQ ID NO: 89972 - DNA, 37 bp, Artificial Sequence
  Synthetic oligonucleotide
gggagagcgggggaacgctcaaagggggaaaggggga

SEQ ID NO: 89973 - DNA, 37 bp, Artificial Sequence
  Synthetic oligonucleotide
taggacggatgaaggcggggaaggaatagaactggga

SEQ ID NO: 89974 - DNA, 36 bp, Artificial Sequence
  Synthetic oligonucleotide
tacctggcaacagctacttactcctcacatcctgga

SEQ ID NO: 89975 - DNA, 37 bp, Artificial Sequence
  Synthetic oligonucleotide
ggtaacgcattagcacgagggggaggaacatggtgga

SEQ ID NO: 89976 - DNA, 36 bp, Artificial Sequence
  Synthetic oligonucleotide
ttggaggagcgattcggagagcggagtcttattgga

SEQ ID NO: 89977 - DNA, 37 bp, Artificial Sequence
  Synthetic oligonucleotide
aaaaggaggactggtggtgacggaccgggatgaatga

SEQ ID NO: 89978 - DNA, 37 bp, Artificial Sequence
  Synthetic oligonucleotide
tcccaaccggcgagagcttttcctgactttctaatga

SEQ ID NO: 89979 - DNA, 38 bp, Artificial Sequence
  Synthetic oligonucleotide
gacacgtaaaattggtgacgacgacattggtgagatga

SEQ ID NO: 89980 - DNA, 38 bp, Artificial Sequence
  Synthetic oligonucleotide
aatgcccgcgagatctgtacccaccaccccatagatga

SEQ ID NO: 89981 - DNA, 38 bp, Artificial Sequence
  Synthetic oligonucleotide
atcaatccatcagtcaggctgtgtgtgggtgtggctga

SEQ ID NO: 89982 - DNA, 36 bp, Artificial Sequence
  Synthetic oligonucleotide
aaaccggggccatgagggaaggaggggtcgctctga

SEQ ID NO: 89983 - DNA, 38 bp, Artificial Sequence
  Synthetic oligonucleotide
acgatcgggggcggagggtgagtctagggaagttctga

SEQ ID NO: 89984 - DNA, 37 bp, Artificial Sequence
  Synthetic oligonucleotide
ttggggaaggggcgagtggaatgggccagctcagtga

SEQ ID NO: 89985 - DNA, 38 bp, Artificial Sequence
  Synthetic oligonucleotide
gaccatgcactcgcggtgcggttaacagacaagagtga

SEQ ID NO: 89986 - DNA, 38 bp, Artificial Sequence
  Synthetic oligonucleotide
acgcgtgcaggctaaggttagggtagacgggcgagtga

SEQ ID NO: 89987 - DNA, 38 bp, Artificial Sequence
  Synthetic oligonucleotide
acgctccgcagtacgcaccccccgtaagccgcccgtga

SEQ ID NO: 89988 - DNA, 38 bp, Artificial Sequence
  Synthetic oligonucleotide
gagatatggggggggtgcgaagacagaacctgcggtga

SEQ ID NO: 89989 - DNA, 38 bp, Artificial Sequence
  Synthetic oligonucleotide
tgaaacgctcagagatgacaaggaaaggggttgggtga

SEQ ID NO: 89990 - DNA, 38 bp, Artificial Sequence
  Synthetic oligonucleotide
tcctaccctctctaaattggactgtcgcattgctgtga

SEQ ID NO: 89991 - DNA, 37 bp, Artificial Sequence
  Synthetic oligonucleotide
gaccacgctggttgtcgcccgtttgaaccgaaattga

SEQ ID NO: 89992 - DNA, 38 bp, Artificial Sequence
  Synthetic oligonucleotide
gccgcaacgcacttattgtttctgattacccgcattga

SEQ ID NO: 89993 - DNA, 38 bp, Artificial Sequence
  Synthetic oligonucleotide
atcgctgacacgtgtacgtggaatcccctatttattga

SEQ ID NO: 89994 - DNA, 38 bp, Artificial Sequence
  Synthetic oligonucleotide
ttgtgcgacaagggctgtgatacagggaagggggttga

SEQ ID NO: 89995 - DNA, 37 bp, Artificial Sequence
  Synthetic oligonucleotide
gacagaaggtagggtacgcgatgtgtgtaggtgttga

SEQ ID NO: 89996 - DNA, 37 bp, Artificial Sequence
  Synthetic oligonucleotide
aactgccagagcagtgtgtagttggtaatggatttga

SEQ ID NO: 89997 - DNA, 38 bp, Artificial Sequence
  Synthetic oligonucleotide
tccatcgcacacccggcaaagatcaggttcccttttga

SEQ ID NO: 89998 - DNA, 38 bp, Artificial Sequence
  Synthetic oligonucleotide
gaacgacatgcgtatgtcatccgtccactcttttttga

SEQ ID NO: 89999 - DNA, 36 bp, Artificial Sequence
  Synthetic oligonucleotide
tgatagtgcgatccacccgtcaccaggccttgaata

SEQ ID NO: 90000 - DNA, 36 bp, Artificial Sequence
  Synthetic oligonucleotide
tcactactgcgcgcgtttgtaccttttctcggcata

SEQ ID NO: 90001 - DNA, 35 bp, Artificial Sequence
  Synthetic oligonucleotide
atgatcacctgcatgctcttcgcctttcactgata

SEQ ID NO: 90002 - DNA, 34 bp, Artificial Sequence
  Synthetic oligonucleotide
gccacacagggggattctctgccggtgatctata

SEQ ID NO: 90003 - DNA, 36 bp, Artificial Sequence
  Synthetic oligonucleotide
gcctgtccaactgtaatggttgtctcaccctgacta

SEQ ID NO: 90004 - DNA, 36 bp, Artificial Sequence
  Synthetic oligonucleotide
tctgtcccaacgtaacccgtgaagtacgatctacta

SEQ ID NO: 90005 - DNA, 36 bp, Artificial Sequence
  Synthetic oligonucleotide
ttcagccctaggagcgtttaggtaaccccccgccta

SEQ ID NO: 90006 - DNA, 36 bp, Artificial Sequence
  Synthetic oligonucleotide
tccgatatcgaccaatggcctggcgcgtgactccta

SEQ ID NO: 90007 - DNA, 36 bp, Artificial Sequence
  Synthetic oligonucleotide
aacgccatgctacagtatgcccttgttccctttcta

SEQ ID NO: 90008 - DNA, 35 bp, Artificial Sequence
  Synthetic oligonucleotide
atcaccacctgcacccactgtctcgtacttcggta

SEQ ID NO: 90009 - DNA, 35 bp, Artificial Sequence
  Synthetic oligonucleotide
accacctcgtggccatgccccatccttccattgta

SEQ ID NO: 90010 - DNA, 36 bp, Artificial Sequence
  Synthetic oligonucleotide
actacacaatccggtcaatagcgtgacctttgttta

SEQ ID NO: 90011 - DNA, 35 bp, Artificial Sequence
  Synthetic oligonucleotide
gtcaaccgcacctgatttgcgttctatcgtcttac

SEQ ID NO: 90012 - DNA, 35 bp, Artificial Sequence
  Synthetic oligonucleotide
tttgcccgacaatattctcgctcgtagcggttacc

SEQ ID NO: 90013 - DNA, 35 bp, Artificial Sequence
  Synthetic oligonucleotide
tgcaaaccctgctccccaagcccataacttacgcc

SEQ ID NO: 90014 - DNA, 35 bp, Artificial Sequence
  Synthetic oligonucleotide
gctggacatccattccttctgatctacgcgaggcc

SEQ ID NO: 90015 - DNA, 35 bp, Artificial Sequence
  Synthetic oligonucleotide
gtcttgtcctacgcgttaagccacaaagtccttcc

SEQ ID NO: 90016 - DNA, 35 bp, Artificial Sequence
  Synthetic oligonucleotide
atgtgctgcaattctaatctttacagctacctagc

SEQ ID NO: 90017 - DNA, 35 bp, Artificial Sequence
  Synthetic oligonucleotide
gtccagcaaccgtgctcgcaaccacgcactaaatc

SEQ ID NO: 90018 - DNA, 35 bp, Artificial Sequence
  Synthetic oligonucleotide
gcgtgtcaccgcatcgcacgcgcgctccacgaatc

SEQ ID NO: 90019 - DNA, 35 bp, Artificial Sequence
  Synthetic oligonucleotide
gcaagcacggccttaaatttcctggcgttcgactc

SEQ ID NO: 90020 - DNA, 35 bp, Artificial Sequence
  Synthetic oligonucleotide
gagtggcgagtgcgtatttcctttagctcgttctc

SEQ ID NO: 90021 - DNA, 35 bp, Artificial Sequence
  Synthetic oligonucleotide
ttgactggggcagttgtttacgcacatcgcccttc

SEQ ID NO: 90022 - DNA, 35 bp, Artificial Sequence
  Synthetic oligonucleotide
ttggtacgaacctagaagccgtcatacactctttc

SEQ ID NO: 90023 - DNA, 35 bp, Artificial Sequence
  Synthetic oligonucleotide
agatacacaccgaatcgtaaactgaccggtctccg

SEQ ID NO: 90024 - DNA, 35 bp, Artificial Sequence
  Synthetic oligonucleotide
gtccctgcccaactctgcttctctagcggtcctcg

SEQ ID NO: 90025 - DNA, 35 bp, Artificial Sequence
  Synthetic oligonucleotide
tcacgggaggaagggcagataggggcccatggagg

SEQ ID NO: 90026 - DNA, 35 bp, Artificial Sequence
  Synthetic oligonucleotide
gacgcatgcacgtagtagggaatgaggggcgtggg

SEQ ID NO: 90027 - DNA, 35 bp, Artificial Sequence
  Synthetic oligonucleotide
atgaacgggccgaagctgaatgagaggtaatcatg

SEQ ID NO: 90028 - DNA, 35 bp, Artificial Sequence
  Synthetic oligonucleotide
tcagctggccccatatcaccctccgcactatcatg

SEQ ID NO: 90029 - DNA, 35 bp, Artificial Sequence
  Synthetic oligonucleotide
acgaccgtattgactcctgaccactagttagcctg

SEQ ID NO: 90030 - DNA, 35 bp, Artificial Sequence
  Synthetic oligonucleotide
acacagcctcacacactgcattcaacccgcgcctg

SEQ ID NO: 90031 - DNA, 35 bp, Artificial Sequence
  Synthetic oligonucleotide
acaatgccatacgtcctcctgcagttcgcctccat

SEQ ID NO: 90032 - DNA, 35 bp, Artificial Sequence
  Synthetic oligonucleotide
tagaactgtggggccgggtatatggagtgggtcat

SEQ ID NO: 90033 - DNA, 35 bp, Artificial Sequence
  Synthetic oligonucleotide
acaccatctttcaggtagaccgagttgccgaccct

SEQ ID NO: 90034 - DNA, 35 bp, Artificial Sequence
  Synthetic oligonucleotide
ttgggtagccgctcccttgctctgttttcctccct

SEQ ID NO: 90035 - DNA, 35 bp, Artificial Sequence
  Synthetic oligonucleotide
ggtgcgcaatccttggtcgacagctcttttccgct

SEQ ID NO: 90036 - DNA, 35 bp, Artificial Sequence
  Synthetic oligonucleotide
atgcgtggtacttggtgcattctggttggttatct

SEQ ID NO: 90037 - DNA, 35 bp, Artificial Sequence
  Synthetic oligonucleotide
gccggtcaccttccgtggcgcggctcttaacctct

SEQ ID NO: 90038 - DNA, 35 bp, Artificial Sequence
  Synthetic oligonucleotide
gtggtcccatctttcccatattaagactatacggt

SEQ ID NO: 90039 - DNA, 35 bp, Artificial Sequence
  Synthetic oligonucleotide
aagccccgcggaatgagaaagggggagtagatggt

SEQ ID NO: 90040 - DNA, 35 bp, Artificial Sequence
  Synthetic oligonucleotide
tcgataccccggttcgctaaatatacaacactggt

SEQ ID NO: 90041 - DNA, 35 bp, Artificial Sequence
  Synthetic oligonucleotide
gaccccgacgcttaatccacgttaaaacacgtggt

SEQ ID NO: 90042 - DNA, 35 bp, Artificial Sequence
  Synthetic oligonucleotide
aactactcataggggattgcccgcccagacactgt

SEQ ID NO: 90043 - DNA, 35 bp, Artificial Sequence
  Synthetic oligonucleotide
gcaaccgtgagcacgccaaggccttgagaatctgt

SEQ ID NO: 90044 - DNA, 35 bp, Artificial Sequence
  Synthetic oligonucleotide
gtgtcttgtagctggtctgtcatacctcactctgt

SEQ ID NO: 90045 - DNA, 35 bp, Artificial Sequence
  Synthetic oligonucleotide
ttgatactcatgctggacagaagctcaacgccctt

SEQ ID NO: 90046 - DNA, 36 bp, Artificial Sequence
  Synthetic oligonucleotide
tatgcatggccccgatatttactgcctcaaacgcaa

SEQ ID NO: 90047 - DNA, 36 bp, Artificial Sequence
  Synthetic oligonucleotide
tcaacgacactattctcaaatcaccttgcactgcaa

SEQ ID NO: 90048 - DNA, 36 bp, Artificial Sequence
  Synthetic oligonucleotide
acacgcaggtggaacaactattcggatttgcgtgaa

SEQ ID NO: 90049 - DNA, 36 bp, Artificial Sequence
  Synthetic oligonucleotide
ttgactgtgccaatggcctacgtggcacattttgaa

SEQ ID NO: 90050 - DNA, 36 bp, Artificial Sequence
  Synthetic oligonucleotide
gcgaggtccgggggcttatgggtggcagatgaataa

SEQ ID NO: 90051 - DNA, 36 bp, Artificial Sequence
  Synthetic oligonucleotide
acaatcatgctcgcccatctgctttatgcggcctaa

SEQ ID NO: 90052 - DNA, 36 bp, Artificial Sequence
  Synthetic oligonucleotide
gaagggcctcccaccgtatagtcaccaagctggtaa

SEQ ID NO: 90053 - DNA, 35 bp, Artificial Sequence
  Synthetic oligonucleotide
ggtagacagccacactcatgaccctttgactttaa

SEQ ID NO: 90054 - DNA, 35 bp, Artificial Sequence
  Synthetic oligonucleotide
gtgggcggacctctaatggccaactgctatccaca

SEQ ID NO: 90055 - DNA, 36 bp, Artificial Sequence
  Synthetic oligonucleotide
gatgccctgcgaggaactggaatacgtggtctcaca

SEQ ID NO: 90056 - DNA, 34 bp, Artificial Sequence
  Synthetic oligonucleotide
tcatgaccatacgctattaggggttcatttcaca

SEQ ID NO: 90057 - DNA, 36 bp, Artificial Sequence
  Synthetic oligonucleotide
acatagcaacgcagtattgtccattctgcactacca

SEQ ID NO: 90058 - DNA, 35 bp, Artificial Sequence
  Synthetic oligonucleotide
gacgaatagtcacggaggccccgcgacgcttccca

SEQ ID NO: 90059 - DNA, 36 bp, Artificial Sequence
  Synthetic oligonucleotide
tacatcacttacaccccgaggcagtatctctgcgca

SEQ ID NO: 90060 - DNA, 36 bp, Artificial Sequence
  Synthetic oligonucleotide
tgtcgacgccgctcacgtatcctgtccacttctgca

SEQ ID NO: 90061 - DNA, 35 bp, Artificial Sequence
  Synthetic oligonucleotide
gccccatccatcgacaggatgcacaaaccagtgca

SEQ ID NO: 90062 - DNA, 37 bp, Artificial Sequence
  Synthetic oligonucleotide
accaccaccacgggcaaccacagtcactcgttcatca

SEQ ID NO: 90063 - DNA, 36 bp, Artificial Sequence
  Synthetic oligonucleotide
atcccatgccggaaagttagcccaataacctgctca

SEQ ID NO: 90064 - DNA, 36 bp, Artificial Sequence
  Synthetic oligonucleotide
ggaccttcccgcttgtacttagggcaattcccttca

SEQ ID NO: 90065 - DNA, 36 bp, Artificial Sequence
  Synthetic oligonucleotide
tcccacccaagcttttgcagctgctatgccttttca

SEQ ID NO: 90066 - DNA, 37 bp, Artificial Sequence
  Synthetic oligonucleotide
taagtgaagcagggggtgactaggatggtgcgtaaga

SEQ ID NO: 90067 - DNA, 35 bp, Artificial Sequence
  Synthetic oligonucleotide
agccgctgacgagtgggttcaggggtggggctaga

SEQ ID NO: 90068 - DNA, 36 bp, Artificial Sequence
  Synthetic oligonucleotide
accatcctcggcagactgcacaaatcagggtttaga

SEQ ID NO: 90069 - DNA, 37 bp, Artificial Sequence
  Synthetic oligonucleotide
gccgacgttaactcccctgctgaccgaacagtcacga

SEQ ID NO: 90070 - DNA, 37 bp, Artificial Sequence
  Synthetic oligonucleotide
gcctgccatccggctgtgtatctattaaatccaccga

SEQ ID NO: 90071 - DNA, 37 bp, Artificial Sequence
  Synthetic oligonucleotide
agccccaacccgacgcttggacatcgtgcacccccga

SEQ ID NO: 90072 - DNA, 37 bp, Artificial Sequence
  Synthetic oligonucleotide
actgtgcacgcagaagaaccagtgcagcctcccccga

SEQ ID NO: 90073 - DNA, 37 bp, Artificial Sequence
  Synthetic oligonucleotide
tgtgacgacagattcaacgacacccgcttttccccga

SEQ ID NO: 90074 - DNA, 37 bp, Artificial Sequence
  Synthetic oligonucleotide
gatgcacatacgcgcactcagtcgttatatctagcga

SEQ ID NO: 90075 - DNA, 37 bp, Artificial Sequence
  Synthetic oligonucleotide
tgtcacggtcatacgtttatcactcatttgctgtcga

SEQ ID NO: 90076 - DNA, 35 bp, Artificial Sequence
  Synthetic oligonucleotide
ttgtccgcttgctccacatcttgccgttccaagga

SEQ ID NO: 90077 - DNA, 37 bp, Artificial Sequence
  Synthetic oligonucleotide
taggtggggggccgagtggtcggtacctgacgtagga

SEQ ID NO: 90078 - DNA, 36 bp, Artificial Sequence
  Synthetic oligonucleotide
agtgagaggccacgaagaaaggaaccgggtcaggga

SEQ ID NO: 90079 - DNA, 37 bp, Artificial Sequence
  Synthetic oligonucleotide
gttaggacagtatggtagctcggggtggagggaggga

SEQ ID NO: 90080 - DNA, 37 bp, Artificial Sequence
  Synthetic oligonucleotide
atgggcgagggtgggctacaggggagtgttatcggga

SEQ ID NO: 90081 - DNA, 37 bp, Artificial Sequence
  Synthetic oligonucleotide
ttcgcaaaagacaaagtacggggggacagtaggggga

SEQ ID NO: 90082 - DNA, 36 bp, Artificial Sequence
  Synthetic oligonucleotide
atgcaatgcatggtagagggtcagagcgtgggggga

SEQ ID NO: 90083 - DNA, 37 bp, Artificial Sequence
  Synthetic oligonucleotide
gtggtggaaggtaccaagagggagagttcagtatgga

SEQ ID NO: 90084 - DNA, 36 bp, Artificial Sequence
  Synthetic oligonucleotide
tactgacacgtgggtagggtaggatcttgaagtgga

SEQ ID NO: 90085 - DNA, 37 bp, Artificial Sequence
  Synthetic oligonucleotide
gtaaccagatgggtctttgccccgcctttctgttgga

SEQ ID NO: 90086 - DNA, 37 bp, Artificial Sequence
  Synthetic oligonucleotide
gacgacgtccctgattttcagcctcttctgttttgga

SEQ ID NO: 90087 - DNA, 38 bp, Artificial Sequence
  Synthetic oligonucleotide
tcggagaagcatgaggtgcatataagggcgtaaaatga

SEQ ID NO: 90088 - DNA, 37 bp, Artificial Sequence
  Synthetic oligonucleotide
ttcaaggcaccgtcaagctacccatccatacgcatga

SEQ ID NO: 90089 - DNA, 37 bp, Artificial Sequence
  Synthetic oligonucleotide
agtactgcaaagtggttagtgtggggaatggggatga

SEQ ID NO: 90090 - DNA, 37 bp, Artificial Sequence
  Synthetic oligonucleotide
tagacgctcaccgaagaggcgcagtgcccttgtatga

SEQ ID NO: 90091 - DNA, 38 bp, Artificial Sequence
  Synthetic oligonucleotide
tcagaaagggtgagggtggtacagtataactggactga

SEQ ID NO: 90092 - DNA, 38 bp, Artificial Sequence
  Synthetic oligonucleotide
aacctcacccgtccgcatgcgtaatcatggggacctga

SEQ ID NO: 90093 - DNA, 37 bp, Artificial Sequence
  Synthetic oligonucleotide
tccactaccgcgcacgtgaatctgatctgctacctga

SEQ ID NO: 90094 - DNA, 38 bp, Artificial Sequence
  Synthetic oligonucleotide
gagaagcctctgattatcatggcactccccagtcctga

SEQ ID NO: 90095 - DNA, 37 bp, Artificial Sequence
  Synthetic oligonucleotide
gaccagttcaggtcccatttcagattcccttcgctga

SEQ ID NO: 90096 - DNA, 38 bp, Artificial Sequence
  Synthetic oligonucleotide
acagcgggggggaagaagcgaaaaggtggttatgctga

SEQ ID NO: 90097 - DNA, 38 bp, Artificial Sequence
  Synthetic oligonucleotide
acatgcgtgaccccttttttacgcacattacgacgtga

SEQ ID NO: 90098 - DNA, 38 bp, Artificial Sequence
  Synthetic oligonucleotide
tcgccgagactcatcttttcaagccaacccgtccgtga

SEQ ID NO: 90099 - DNA, 35 bp, Artificial Sequence
  Synthetic oligonucleotide
agagaggagggggatctaacaaatacgcacggtga

SEQ ID NO: 90100 - DNA, 38 bp, Artificial Sequence
  Synthetic oligonucleotide
tccgccccagaattaaaagcggcactcatcttatgtga

SEQ ID NO: 90101 - DNA, 38 bp, Artificial Sequence
  Synthetic oligonucleotide
gtgcgaatgcaggaatatgagcaagagttcacgtgtga

SEQ ID NO: 90102 - DNA, 37 bp, Artificial Sequence
  Synthetic oligonucleotide
tagaacgtgatggcaaagaccgaggcggggggtgtga

SEQ ID NO: 90103 - DNA, 38 bp, Artificial Sequence
  Synthetic oligonucleotide
tgcccgtacaaggctcctccacgacgtaacttcattga

SEQ ID NO: 90104 - DNA, 38 bp, Artificial Sequence
  Synthetic oligonucleotide
actcccgtgccctgtactgcgctccagtcgacacttga

SEQ ID NO: 90105 - DNA, 37 bp, Artificial Sequence
  Synthetic oligonucleotide
gaccatcgtcccccttgtccttgtgatgttttcttga

SEQ ID NO: 90106 - DNA, 36 bp, Artificial Sequence
  Synthetic oligonucleotide
tgtgtgacaatggtagcgggaccatattaaagttga

SEQ ID NO: 90107 - DNA, 38 bp, Artificial Sequence
  Synthetic oligonucleotide
tgagctctcacattgccgaccctcgatatctaagttga

SEQ ID NO: 90108 - DNA, 36 bp, Artificial Sequence
  Synthetic oligonucleotide
gggatcgtgaggcgggtcggaagcatgggaggttga

SEQ ID NO: 90109 - DNA, 37 bp, Artificial Sequence
  Synthetic oligonucleotide
ttgccgttcagcgaacagttttccatccaacctttga

SEQ ID NO: 90110 - DNA, 36 bp, Artificial Sequence
  Synthetic oligonucleotide
acatcgcgacatccctccagcctttatttgttcata

SEQ ID NO: 90111 - DNA, 35 bp, Artificial Sequence
  Synthetic oligonucleotide
gatgcgtaagaatggcgtgtgaaatgcgagcgata

SEQ ID NO: 90112 - DNA, 36 bp, Artificial Sequence
  Synthetic oligonucleotide
aaatagctgggtagcaggagtggcggaagggctcta

SEQ ID NO: 90113 - DNA, 35 bp, Artificial Sequence
  Synthetic oligonucleotide
gcgtgacccggaccgactcccaagtgctctctcta

SEQ ID NO: 90114 - DNA, 36 bp, Artificial Sequence
  Synthetic oligonucleotide
gtcgctgccgtcagtctcttctatgtcgccattcta

SEQ ID NO: 90115 - DNA, 36 bp, Artificial Sequence
  Synthetic oligonucleotide
tcagacccctcctgttctgtgaaaagtttccaagta

SEQ ID NO: 90116 - DNA, 36 bp, Artificial Sequence
  Synthetic oligonucleotide
gagacacgtaacgtactttggcacctttactacgta

SEQ ID NO: 90117 - DNA, 36 bp, Artificial Sequence
  Synthetic oligonucleotide
ggatccgtggaggagggtcaagggtcgtgtggtgta

SEQ ID NO: 90118 - DNA, 35 bp, Artificial Sequence
  Synthetic oligonucleotide
gtgcccgtcctttcgcgtcttgcaatattgttgta

SEQ ID NO: 90119 - DNA, 36 bp, Artificial Sequence
  Synthetic oligonucleotide
tgacaaacgcgattgtggtgtgggcgggttgttgta

SEQ ID NO: 90120 - DNA, 35 bp, Artificial Sequence
  Synthetic oligonucleotide
tgtcctgcctcacttcggaatggcgtcccacctta

SEQ ID NO: 90121 - DNA, 35 bp, Artificial Sequence
  Synthetic oligonucleotide
ttgtcctgtgttgtctgtcttcgaaccgttcacac

SEQ ID NO: 90122 - DNA, 35 bp, Artificial Sequence
  Synthetic oligonucleotide
gctgacccccggttatttttcgctaccatgagcac

SEQ ID NO: 90123 - DNA, 35 bp, Artificial Sequence
  Synthetic oligonucleotide
aaatcgaccacctgggccctttatgtcgtgacgac

SEQ ID NO: 90124 - DNA, 35 bp, Artificial Sequence
  Synthetic oligonucleotide
gtcacacactgagccagagtttgtcgctgatctac

SEQ ID NO: 90125 - DNA, 35 bp, Artificial Sequence
  Synthetic oligonucleotide
agttgccgacctgccatatatccttgcatcctgcc

SEQ ID NO: 90126 - DNA, 35 bp, Artificial Sequence
  Synthetic oligonucleotide
aaacaagtcgtcagtcctttttatagtttgcctcc

SEQ ID NO: 90127 - DNA, 35 bp, Artificial Sequence
  Synthetic oligonucleotide
attgcgcgaccactggtaagcgctcccggtattcc

SEQ ID NO: 90128 - DNA, 35 bp, Artificial Sequence
  Synthetic oligonucleotide
gcaccacgaactgctcatcccggccactgtcttcc

SEQ ID NO: 90129 - DNA, 35 bp, Artificial Sequence
  Synthetic oligonucleotide
tacagaacgcgtgttctgtgactcttgacttctgc

SEQ ID NO: 90130 - DNA, 35 bp, Artificial Sequence
  Synthetic oligonucleotide
aaccgccgtctgtcattgtccgctggcctcgcatc

SEQ ID NO: 90131 - DNA, 35 bp, Artificial Sequence
  Synthetic oligonucleotide
accaccagccgtaactaatagcaattcatggcatc

SEQ ID NO: 90132 - DNA, 35 bp, Artificial Sequence
  Synthetic oligonucleotide
ttattcctgctaccgatatgtaaccatcgtcgctc

SEQ ID NO: 90133 - DNA, 35 bp, Artificial Sequence
  Synthetic oligonucleotide
gtacccatcatgtgcggcggaggctgttccccgtc

SEQ ID NO: 90134 - DNA, 35 bp, Artificial Sequence
  Synthetic oligonucleotide
agacacccgaaacaatcctataacgacgcaagaag

SEQ ID NO: 90135 - DNA, 35 bp, Artificial Sequence
  Synthetic oligonucleotide
gcataacgcaataggcagaaatagggaaggctaag

SEQ ID NO: 90136 - DNA, 35 bp, Artificial Sequence
  Synthetic oligonucleotide
gtgttgagcggtctagtaagggggctgatcatgag

SEQ ID NO: 90137 - DNA, 35 bp, Artificial Sequence
  Synthetic oligonucleotide
gtggaggtaaggcgcgataaaagtgagaagtatcg

SEQ ID NO: 90138 - DNA, 35 bp, Artificial Sequence
  Synthetic oligonucleotide
ggaggtgcagtcaggaatctttagaggggtttggg

SEQ ID NO: 90139 - DNA, 35 bp, Artificial Sequence
  Synthetic oligonucleotide
ttccacctctgacacatagatatactgcttaactg

SEQ ID NO: 90140 - DNA, 35 bp, Artificial Sequence
  Synthetic oligonucleotide
acgccatacaattgcatacacccatggacaccctg

SEQ ID NO: 90141 - DNA, 35 bp, Artificial Sequence
  Synthetic oligonucleotide
gtggctagaggtaagggccgttcacacctctcctg

SEQ ID NO: 90142 - DNA, 35 bp, Artificial Sequence
  Synthetic oligonucleotide
acacttcgggaggagatatgggctttacttttctg

SEQ ID NO: 90143 - DNA, 35 bp, Artificial Sequence
  Synthetic oligonucleotide
attgcgacagatggtgttctgttaatagacgagtg

SEQ ID NO: 90144 - DNA, 35 bp, Artificial Sequence
  Synthetic oligonucleotide
aacgcgagttaggtgagtgcggtttcataatggtg

SEQ ID NO: 90145 - DNA, 35 bp, Artificial Sequence
  Synthetic oligonucleotide
atgagcgtttcccagtctttatgtgcctcccattg

SEQ ID NO: 90146 - DNA, 35 bp, Artificial Sequence
  Synthetic oligonucleotide
gtgaaagccgacactcgtcctccatcaccctgttg

SEQ ID NO: 90147 - DNA, 35 bp, Artificial Sequence
  Synthetic oligonucleotide
acctcactgcttccggtcccgactatactcaacat

SEQ ID NO: 90148 - DNA, 35 bp, Artificial Sequence
  Synthetic oligonucleotide
tccatcttgcccctaggtaacgccataagggccat

SEQ ID NO: 90149 - DNA, 35 bp, Artificial Sequence
  Synthetic oligonucleotide
gctaggacaagtgcacgtagacctcaccgaggcat

SEQ ID NO: 90150 - DNA, 35 bp, Artificial Sequence
  Synthetic oligonucleotide
aaatagggcaagaccaggtggtactggaattggat

SEQ ID NO: 90151 - DNA, 35 bp, Artificial Sequence
  Synthetic oligonucleotide
tgtgtgttggcactgaccgacctctcacgctttat

SEQ ID NO: 90152 - DNA, 35 bp, Artificial Sequence
  Synthetic oligonucleotide
gagccatggctgccttttcgaacttcgttacacct

SEQ ID NO: 90153 - DNA, 35 bp, Artificial Sequence
  Synthetic oligonucleotide
tctgttacggcacttgttctggtacatgctcacct

SEQ ID NO: 90154 - DNA, 35 bp, Artificial Sequence
  Synthetic oligonucleotide
agatggcagttccggagcctcacttgttcacgcct

SEQ ID NO: 90155 - DNA, 35 bp, Artificial Sequence
  Synthetic oligonucleotide
tcgaaagggtggcgggggataaatcgaggggggct

SEQ ID NO: 90156 - DNA, 35 bp, Artificial Sequence
  Synthetic oligonucleotide
tacaccacgatgcatgctaatgtggccacatatct

SEQ ID NO: 90157 - DNA, 35 bp, Artificial Sequence
  Synthetic oligonucleotide
tccggaccgccccactccgggaactagaggtatct

SEQ ID NO: 90158 - DNA, 35 bp, Artificial Sequence
  Synthetic oligonucleotide
ggatcaccgttccgctattttgcagggccttatct

SEQ ID NO: 90159 - DNA, 35 bp, Artificial Sequence
  Synthetic oligonucleotide
tcacatcctccttcccgtgtgtcgttactccctct

SEQ ID NO: 90160 - DNA, 35 bp, Artificial Sequence
  Synthetic oligonucleotide
gcatgagctgtattctcggttttacgctagcctct

SEQ ID NO: 90161 - DNA, 35 bp, Artificial Sequence
  Synthetic oligonucleotide
gtgccaagtgcgcgctcagctacctaccttaccgt

SEQ ID NO: 90162 - DNA, 35 bp, Artificial Sequence
  Synthetic oligonucleotide
atgtagtgagggagaagttagaagcagcagaaggt

SEQ ID NO: 90163 - DNA, 35 bp, Artificial Sequence
  Synthetic oligonucleotide
acccaacgcgtcccactcagtagttgcatttttgt

SEQ ID NO: 90164 - DNA, 35 bp, Artificial Sequence
  Synthetic oligonucleotide
tcccccaagcgccctgtcccaatcgcagcatgctt

SEQ ID NO: 90165 - DNA, 35 bp, Artificial Sequence
  Synthetic oligonucleotide
gctgaacttctgtgtttgttccatccccttcattt

SEQ ID NO: 90166 - DNA, 35 bp, Artificial Sequence
  Synthetic oligonucleotide
gtgtacgtaacgatgattacctcacgtccaccttt

SEQ ID NO: 90167 - DNA, 36 bp, Artificial Sequence
  Synthetic oligonucleotide
gcgaaacctccctgcttcgatcattgttccacgcaa

SEQ ID NO: 90168 - DNA, 35 bp, Artificial Sequence
  Synthetic oligonucleotide
gttggccgtacttcgacgataaccattgacttcaa

SEQ ID NO: 90169 - DNA, 36 bp, Artificial Sequence
  Synthetic oligonucleotide
aagtacgaggggagatggacagattcgggtggcgaa

SEQ ID NO: 90170 - DNA, 35 bp, Artificial Sequence
  Synthetic oligonucleotide
gtgaaggggttatggcagtagggatacagcgtgaa

SEQ ID NO: 90171 - DNA, 36 bp, Artificial Sequence
  Synthetic oligonucleotide
gtcggattggaacggccggaggggatgggagggtaa

SEQ ID NO: 90172 - DNA, 37 bp, Artificial Sequence
  Synthetic oligonucleotide
gcacgaggtgaaggggaatactgtgaaggatggaaca

SEQ ID NO: 90173 - DNA, 36 bp, Artificial Sequence
  Synthetic oligonucleotide
tgactatagaggggaacggtggggcaagacataaca

SEQ ID NO: 90174 - DNA, 35 bp, Artificial Sequence
  Synthetic oligonucleotide
gacagagggtggtgagggcgcgggaccgcggtaca

SEQ ID NO: 90175 - DNA, 36 bp, Artificial Sequence
  Synthetic oligonucleotide
gacacgaagctgcatgccatgtacattcgttaccca

SEQ ID NO: 90176 - DNA, 36 bp, Artificial Sequence
  Synthetic oligonucleotide
tagcgcagaagtcgttttgtcgcctaattcctccca

SEQ ID NO: 90177 - DNA, 35 bp, Artificial Sequence
  Synthetic oligonucleotide
tgagcacactcaaggcctactgtccagcttaagca

SEQ ID NO: 90178 - DNA, 36 bp, Artificial Sequence
  Synthetic oligonucleotide
gaacacgtacgatctcatagttgcatctggtgagca

SEQ ID NO: 90179 - DNA, 36 bp, Artificial Sequence
  Synthetic oligonucleotide
tgaccatcatgtggtcgtgtccggtaaccctttgca

SEQ ID NO: 90180 - DNA, 36 bp, Artificial Sequence
  Synthetic oligonucleotide
gaccagcttgtccagcaacattcaccacggtaatca

SEQ ID NO: 90181 - DNA, 33 bp, Artificial Sequence
  Synthetic oligonucleotide
gcgctgatcgccaggccgctccttaccctatca

SEQ ID NO: 90182 - DNA, 36 bp, Artificial Sequence
  Synthetic oligonucleotide
ttcagctcctagcagcgaaacgcgtactttccctca

SEQ ID NO: 90183 - DNA, 36 bp, Artificial Sequence
  Synthetic oligonucleotide
tagagagggggaacgggttttcggtgagggtagtca

SEQ ID NO: 90184 - DNA, 36 bp, Artificial Sequence
  Synthetic oligonucleotide
acacgactaacagtcgcttcagtatccccgccttca

SEQ ID NO: 90185 - DNA, 35 bp, Artificial Sequence
  Synthetic oligonucleotide
gacgccccatgtctgcctattagaacgctacaaga

SEQ ID NO: 90186 - DNA, 36 bp, Artificial Sequence
  Synthetic oligonucleotide
tcaggtcgccggggtgttatggggaactaaggaaga

SEQ ID NO: 90187 - DNA, 37 bp, Artificial Sequence
  Synthetic oligonucleotide
tccaacaatcaccacctgtatagtgaggtcaaacaga

SEQ ID NO: 90188 - DNA, 37 bp, Artificial Sequence
  Synthetic oligonucleotide
tcaatgaagggacagattggaagggggtaacacgaga

SEQ ID NO: 90189 - DNA, 37 bp, Artificial Sequence
  Synthetic oligonucleotide
gacatctgcgggtagcacgggggaggatgaggggaga

SEQ ID NO: 90190 - DNA, 37 bp, Artificial Sequence
  Synthetic oligonucleotide
gccgggcgggttggagtaaagatggaagatgttgaga

SEQ ID NO: 90191 - DNA, 37 bp, Artificial Sequence
  Synthetic oligonucleotide
agtagtgggtagagctggcaaaagtgcggtggctaga

SEQ ID NO: 90192 - DNA, 37 bp, Artificial Sequence
  Synthetic oligonucleotide
acacatgcccagggacattgttgagtgtcctattaga

SEQ ID NO: 90193 - DNA, 36 bp, Artificial Sequence
  Synthetic oligonucleotide
actgcccgcccccatatgcctttgttgctatcacga

SEQ ID NO: 90194 - DNA, 37 bp, Artificial Sequence
  Synthetic oligonucleotide
cctcgaaccggtctggaggatgacacaccgcctacga

SEQ ID NO: 90195 - DNA, 36 bp, Artificial Sequence
  Synthetic oligonucleotide
acacatggtgaaatggggtcgagtgaacagaaccga

SEQ ID NO: 90196 - DNA, 36 bp, Artificial Sequence
  Synthetic oligonucleotide
gatcacacgctccttgaatataaaccccgctggcga

SEQ ID NO: 90197 - DNA, 37 bp, Artificial Sequence
  Synthetic oligonucleotide
gacgcaacttcgactgcggtatgtttctcttcatcga

SEQ ID NO: 90198 - DNA, 37 bp, Artificial Sequence
  Synthetic oligonucleotide
ttgcccccacagtacggcatttaggggtcgatgtcga

SEQ ID NO: 90199 - DNA, 37 bp, Artificial Sequence
  Synthetic oligonucleotide
gtgggatcggtgggactgggaattagaaggatgtcga

SEQ ID NO: 90200 - DNA, 37 bp, Artificial Sequence
  Synthetic oligonucleotide
aagcccgcaacctgccgaacatcctggagtcattcga

SEQ ID NO: 90201 - DNA, 37 bp, Artificial Sequence
  Synthetic oligonucleotide
acaaacgcatggggcaggagggtggctgggcatagga

SEQ ID NO: 90202 - DNA, 37 bp, Artificial Sequence
  Synthetic oligonucleotide
gttcggcctcagtatctcgtcacgccgcccacccgga

SEQ ID NO: 90203 - DNA, 37 bp, Artificial Sequence
  Synthetic oligonucleotide
ggagggggagggctaagggcgggcaaacggggtcgga

SEQ ID NO: 90204 - DNA, 37 bp, Artificial Sequence
  Synthetic oligonucleotide
gattaggggggggcagtgtacttggcaaaataaggga

SEQ ID NO: 90205 - DNA, 36 bp, Artificial Sequence
  Synthetic oligonucleotide
ggggtggacgggtaaaagaacctccggtggagggga

SEQ ID NO: 90206 - DNA, 37 bp, Artificial Sequence
  Synthetic oligonucleotide
ggtagagggaacagcggggaaccggacaggaggggga

SEQ ID NO: 90207 - DNA, 37 bp, Artificial Sequence
  Synthetic oligonucleotide
gagctagggtaaggtacgcaaaaaagggggattggga

SEQ ID NO: 90208 - DNA, 37 bp, Artificial Sequence
  Synthetic oligonucleotide
agtacgaggggggatgacgacgtactgacataatgga

SEQ ID NO: 90209 - DNA, 36 bp, Artificial Sequence
  Synthetic oligonucleotide
attggcctggcgatacttttgcgatcccacactgga

SEQ ID NO: 90210 - DNA, 36 bp, Artificial Sequence
  Synthetic oligonucleotide
gacagtgagggagggggtgtggaattgttcgctgga

SEQ ID NO: 90211 - DNA, 37 bp, Artificial Sequence
  Synthetic oligonucleotide
gatgaagggagtaggtgggtcgcccaagtcttctgga

SEQ ID NO: 90212 - DNA, 36 bp, Artificial Sequence
  Synthetic oligonucleotide
ttggactgcgcgtaattatgccttctcttttctgga

SEQ ID NO: 90213 - DNA, 38 bp, Artificial Sequence
  Synthetic oligonucleotide
gcgtgagcacggttcgcgctatttgcattttgcaatga

SEQ ID NO: 90214 - DNA, 38 bp, Artificial Sequence
  Synthetic oligonucleotide
tagcaagtgcgtgaactaggacggggcagtaagaatga

SEQ ID NO: 90215 - DNA, 36 bp, Artificial Sequence
  Synthetic oligonucleotide
gacaatgttcgctgcacatccgtcatgatcacatga

SEQ ID NO: 90216 - DNA, 37 bp, Artificial Sequence
  Synthetic oligonucleotide
tgtacacgcaatgtgtcaaaaactgtgggaatcatga

SEQ ID NO: 90217 - DNA, 38 bp, Artificial Sequence
  Synthetic oligonucleotide
tgtcggaccagcctccttgccgtgggtaccctctatga

SEQ ID NO: 90218 - DNA, 38 bp, Artificial Sequence
  Synthetic oligonucleotide
ttgtcgcagacaagagccacggacacagggcacactga

SEQ ID NO: 90219 - DNA, 38 bp, Artificial Sequence
  Synthetic oligonucleotide
gggagggtggatcgggttaatgatcatacggggactga

SEQ ID NO: 90220 - DNA, 38 bp, Artificial Sequence
  Synthetic oligonucleotide
tccacaaaacggcaggaaataagcctcgggaaacctga

SEQ ID NO: 90221 - DNA, 36 bp, Artificial Sequence
  Synthetic oligonucleotide
gtgcccgggaaaatgatggaaggcaccggaccctga

SEQ ID NO: 90222 - DNA, 38 bp, Artificial Sequence
  Synthetic oligonucleotide
gtagccccgcccgttattatcccatcccgctaccctga

SEQ ID NO: 90223 - DNA, 38 bp, Artificial Sequence
  Synthetic oligonucleotide
tgcccgtcctcgatggcatctgccagttccgctcctga

SEQ ID NO: 90224 - DNA, 35 bp, Artificial Sequence
  Synthetic oligonucleotide
gagatcgcagggaggttcttggccacaaacgctga

SEQ ID NO: 90225 - DNA, 36 bp, Artificial Sequence
  Synthetic oligonucleotide
gaagcccatctagcttcagcgacgcctttacgctga

SEQ ID NO: 90226 - DNA, 38 bp, Artificial Sequence
  Synthetic oligonucleotide
ggtgacctcgctgatctaaacatcgcccatctcgctga

SEQ ID NO: 90227 - DNA, 38 bp, Artificial Sequence
  Synthetic oligonucleotide
taaatccgcgcactctttcctccagctgtatgtgctga

SEQ ID NO: 90228 - DNA, 38 bp, Artificial Sequence
  Synthetic oligonucleotide
gcatgacgtagttactgttaaattatcgccctctctga

SEQ ID NO: 90229 - DNA, 38 bp, Artificial Sequence
  Synthetic oligonucleotide
tgtcacaatccggtacttgcgatccatttcctctctga

SEQ ID NO: 90230 - DNA, 37 bp, Artificial Sequence
  Synthetic oligonucleotide
ggaccacgtgtccgatggcattactggttgcttctga

SEQ ID NO: 90231 - DNA, 37 bp, Artificial Sequence
  Synthetic oligonucleotide
gagccacctcaaaatctgttgaacactcgttttctga

SEQ ID NO: 90232 - DNA, 37 bp, Artificial Sequence
  Synthetic oligonucleotide
tgccaccgcaatccaagagtaagaattgtcaaagtga

SEQ ID NO: 90233 - DNA, 38 bp, Artificial Sequence
  Synthetic oligonucleotide
gcctggggggcacgagtaatgagacactctggaagtga

SEQ ID NO: 90234 - DNA, 38 bp, Artificial Sequence
  Synthetic oligonucleotide
tgttacgccgcttatcttaccaggcaccatgctagtga

SEQ ID NO: 90235 - DNA, 37 bp, Artificial Sequence
  Synthetic oligonucleotide
gatggatgtgccacagttggcaataggaaggtcgtga

SEQ ID NO: 90236 - DNA, 37 bp, Artificial Sequence
  Synthetic oligonucleotide
tgcggaactaaacgggaacgagggggaaggtaggtga

SEQ ID NO: 90237 - DNA, 38 bp, Artificial Sequence
  Synthetic oligonucleotide
gtgaggctttatctgcacggtatcccccccttcggtga

SEQ ID NO: 90238 - DNA, 38 bp, Artificial Sequence
  Synthetic oligonucleotide
tgccagaggcgcagggttcatcagtggatgttgggtga

SEQ ID NO: 90239 - DNA, 38 bp, Artificial Sequence
  Synthetic oligonucleotide
gccatcctcaatcgttgtctagcatttcctttgggtga

SEQ ID NO: 90240 - DNA, 37 bp, Artificial Sequence
  Synthetic oligonucleotide
tcaccacctacatatttcgggattgaacctggattga

SEQ ID NO: 90241 - DNA, 38 bp, Artificial Sequence
  Synthetic oligonucleotide
ggacaggcacgctgccttttagttaaaccactacttga

SEQ ID NO: 90242 - DNA, 38 bp, Artificial Sequence
  Synthetic oligonucleotide
tagcggacccctgtacgcttagccattcatcactttga

SEQ ID NO: 90243 - DNA, 37 bp, Artificial Sequence
  Synthetic oligonucleotide
ttcatcacccgacctttgcgtagttctgcctgtttga

SEQ ID NO: 90244 - DNA, 38 bp, Artificial Sequence
  Synthetic oligonucleotide
tgtgtcagactccatttggttgttgttcgcttttttga

SEQ ID NO: 90245 - DNA, 36 bp, Artificial Sequence
  Synthetic oligonucleotide
tcctacaacgctacatctgttcgtcgacgtgacata

SEQ ID NO: 90246 - DNA, 35 bp, Artificial Sequence
  Synthetic oligonucleotide
gacgatgtaaggggctgaaagtcaagcatgagata

SEQ ID NO: 90247 - DNA, 35 bp, Artificial Sequence
  Synthetic oligonucleotide
ggtaggggggtgaggttatgagtggggttacgata

SEQ ID NO: 90248 - DNA, 36 bp, Artificial Sequence
  Synthetic oligonucleotide
tccgctccaattcgggagtctatactactctcacta

SEQ ID NO: 90249 - DNA, 36 bp, Artificial Sequence
  Synthetic oligonucleotide
acaggtgccacagctatcacttctgtcgttacccta

SEQ ID NO: 90250 - DNA, 35 bp, Artificial Sequence
  Synthetic oligonucleotide
aactccacatcattgtttagcattactggcgccta

SEQ ID NO: 90251 - DNA, 35 bp, Artificial Sequence
  Synthetic oligonucleotide
agacaacaacgcctgttactatgccatttggccta

SEQ ID NO: 90252 - DNA, 36 bp, Artificial Sequence
  Synthetic oligonucleotide
gacccgccgcccccgcgttttccgtcctcatggcta

SEQ ID NO: 90253 - DNA, 36 bp, Artificial Sequence
  Synthetic oligonucleotide
acgccgtgatcatctgtctgtaattcttcacttcta

SEQ ID NO: 90254 - DNA, 36 bp, Artificial Sequence
  Synthetic oligonucleotide
gtctacccccagtctcagtccgtgttggctccagta

SEQ ID NO: 90255 - DNA, 36 bp, Artificial Sequence
  Synthetic oligonucleotide
gctcgccctttgtactgattccgtcgagctcccgta

SEQ ID NO: 90256 - DNA, 36 bp, Artificial Sequence
  Synthetic oligonucleotide
actagctgcctgcaaactgttccctaggctatggta

SEQ ID NO: 90257 - DNA, 37 bp, Artificial Sequence
  Synthetic oligonucleotide
gggaccctccatgcccgagcggcccctgttccttgta

SEQ ID NO: 90258 - DNA, 35 bp, Artificial Sequence
  Synthetic oligonucleotide
aagtgcgccgaggctgacggatctattagcactta

SEQ ID NO: 90259 - DNA, 36 bp, Artificial Sequence
  Synthetic oligonucleotide
gttacggagcttgagcataggcctcctctccattta

SEQ ID NO: 90260 - DNA, 35 bp, Artificial Sequence
  Synthetic oligonucleotide
ggttgccggcctagatctaacacctctttccttta

SEQ ID NO: 90261 - DNA, 35 bp, Artificial Sequence
  Synthetic oligonucleotide
tgcccaggtagaatggccacccatgcgtctgccac

SEQ ID NO: 90262 - DNA, 35 bp, Artificial Sequence
  Synthetic oligonucleotide
gcacacggtctctgataccaatttgtcttcgcgac

SEQ ID NO: 90263 - DNA, 35 bp, Artificial Sequence
  Synthetic oligonucleotide
gcaccgtactcgtgcacacctctgctaccaaaccc

SEQ ID NO: 90264 - DNA, 35 bp, Artificial Sequence
  Synthetic oligonucleotide
gtcacgcaaacttcaatggttcacgaatcttaccc

SEQ ID NO: 90265 - DNA, 35 bp, Artificial Sequence
  Synthetic oligonucleotide
tgactagtcgctcggctggaaccctttgccctccc

SEQ ID NO: 90266 - DNA, 35 bp, Artificial Sequence
  Synthetic oligonucleotide
ttgtgcacccgcaatggcaatggatacttgctccc

SEQ ID NO: 90267 - DNA, 35 bp, Artificial Sequence
  Synthetic oligonucleotide
tactgcacgacccgtagatccaactgatgttagcc

SEQ ID NO: 90268 - DNA, 35 bp, Artificial Sequence
  Synthetic oligonucleotide
atccaccgtaacatgactgcacgcttaattcctcc

SEQ ID NO: 90269 - DNA, 35 bp, Artificial Sequence
  Synthetic oligonucleotide
ttgacgcaaatatgcttcgtactttctctaagtcc

SEQ ID NO: 90270 - DNA, 35 bp, Artificial Sequence
  Synthetic oligonucleotide
gtctaacgccacccgatgcctatctctccctgtcc

SEQ ID NO: 90271 - DNA, 35 bp, Artificial Sequence
  Synthetic oligonucleotide
tagacctaggccaagcacgggaggggggaaaaagc

SEQ ID NO: 90272 - DNA, 35 bp, Artificial Sequence
  Synthetic oligonucleotide
tgatgcctcggtttagtctagttcgccacatcagc

SEQ ID NO: 90273 - DNA, 35 bp, Artificial Sequence
  Synthetic oligonucleotide
ttccaaacatcgccaacgttccttataggacctgc

SEQ ID NO: 90274 - DNA, 35 bp, Artificial Sequence
  Synthetic oligonucleotide
tctcccacgcctgcccttaccaagacgtttcttgc

SEQ ID NO: 90275 - DNA, 35 bp, Artificial Sequence
  Synthetic oligonucleotide
agtcaaacggtgggggtcctatatcttctagttgc

SEQ ID NO: 90276 - DNA, 35 bp, Artificial Sequence
  Synthetic oligonucleotide
tttaccggttgctgcctgcctcgcgagctactctc

SEQ ID NO: 90277 - DNA, 35 bp, Artificial Sequence
  Synthetic oligonucleotide
gcatactgccgagttctgtccgttcccggtcggtc

SEQ ID NO: 90278 - DNA, 35 bp, Artificial Sequence
  Synthetic oligonucleotide
atatcaccacgcacgtactactgtaaagtgctgtc

SEQ ID NO: 90279 - DNA, 35 bp, Artificial Sequence
  Synthetic oligonucleotide
gccgaatccgtccgccctgtccaaatcggtctgtc

SEQ ID NO: 90280 - DNA, 35 bp, Artificial Sequence
  Synthetic oligonucleotide
gtgccacagtgcgtaagtacgaatacctattaaag

SEQ ID NO: 90281 - DNA, 35 bp, Artificial Sequence
  Synthetic oligonucleotide
gaaagaagggttggagtcaagtttacagcaaatag

SEQ ID NO: 90282 - DNA, 35 bp, Artificial Sequence
  Synthetic oligonucleotide
taacaatagatgggagctgcaaagtggtggggtag

SEQ ID NO: 90283 - DNA, 35 bp, Artificial Sequence
  Synthetic oligonucleotide
gaatgatagagggccgggagaggatgggagctacg

SEQ ID NO: 90284 - DNA, 35 bp, Artificial Sequence
  Synthetic oligonucleotide
tatgcctcacgccgctgaacttgcctaattgatcg

SEQ ID NO: 90285 - DNA, 35 bp, Artificial Sequence
  Synthetic oligonucleotide
gcatacgtggagcggttgtactctaagggggtagg

SEQ ID NO: 90286 - DNA, 35 bp, Artificial Sequence
  Synthetic oligonucleotide
gctgaacaaacatggccttatgaccctgcctccgg

SEQ ID NO: 90287 - DNA, 35 bp, Artificial Sequence
  Synthetic oligonucleotide
ggacgcaacggctatcctggattgaggaggggggg

SEQ ID NO: 90288 - DNA, 35 bp, Artificial Sequence
  Synthetic oligonucleotide
tcctgcacccccgccttgttgagcccctcctctgg

SEQ ID NO: 90289 - DNA, 35 bp, Artificial Sequence
  Synthetic oligonucleotide
aaccatgggcgggtgagcggggactgttcaggtgg

SEQ ID NO: 90290 - DNA, 35 bp, Artificial Sequence
  Synthetic oligonucleotide
gcccggcattgcgcataacatcacccgcttcactg

SEQ ID NO: 90291 - DNA, 35 bp, Artificial Sequence
  Synthetic oligonucleotide
agacaccctgcccgattgccttctcccagccgctg

SEQ ID NO: 90292 - DNA, 34 bp, Artificial Sequence
  Synthetic oligonucleotide
gaaaacatcgcggcaccatacgtgttttttgttg

SEQ ID NO: 90293 - DNA, 35 bp, Artificial Sequence
  Synthetic oligonucleotide
agagccctcagccctggtactaacctgtcgaaaat

SEQ ID NO: 90294 - DNA, 35 bp, Artificial Sequence
  Synthetic oligonucleotide
tcacattctcgtggtatagtttcgcccttgataat

SEQ ID NO: 90295 - DNA, 35 bp, Artificial Sequence
  Synthetic oligonucleotide
tcagcacctgcctcataccaaggtgtaaacgccat

SEQ ID NO: 90296 - DNA, 35 bp, Artificial Sequence
  Synthetic oligonucleotide
gttccatccggggaaactgggatccacgcttccat

SEQ ID NO: 90297 - DNA, 36 bp, Artificial Sequence
  Synthetic oligonucleotide
aatgacgtgagtagggggatcgaacacagaacgcat

SEQ ID NO: 90298 - DNA, 35 bp, Artificial Sequence
  Synthetic oligonucleotide
accactgcgccccgactatctgcgtgttgctcgat

SEQ ID NO: 90299 - DNA, 35 bp, Artificial Sequence
  Synthetic oligonucleotide
tcgccccctatctgtacttgagtcccaccttttat

SEQ ID NO: 90300 - DNA, 32 bp, Artificial Sequence
  Synthetic oligonucleotide
tagtactcccgctgtttcagcaccgacccact

SEQ ID NO: 90301 - DNA, 35 bp, Artificial Sequence
  Synthetic oligonucleotide
aatccccccgaacctgtataagggttgtcattact

SEQ ID NO: 90302 - DNA, 34 bp, Artificial Sequence
  Synthetic oligonucleotide
tttagcacccccgacccatggcttattgacctct

SEQ ID NO: 90303 - DNA, 35 bp, Artificial Sequence
  Synthetic oligonucleotide
gagacccatacaaatgcttcacaccacctcggtct

SEQ ID NO: 90304 - DNA, 35 bp, Artificial Sequence
  Synthetic oligonucleotide
gaataaagcgagtatggtcggagggagttggcggt

SEQ ID NO: 90305 - DNA, 35 bp, Artificial Sequence
  Synthetic oligonucleotide
tttacgaacaggtcccccatggatgattatgctgt

SEQ ID NO: 90306 - DNA, 35 bp, Artificial Sequence
  Synthetic oligonucleotide
ttcttggaaggagaaggggacggagggagaacatt

SEQ ID NO: 90307 - DNA, 35 bp, Artificial Sequence
  Synthetic oligonucleotide
tagtctatcctcgcctcgttcgttaatttcgactt

SEQ ID NO: 90308 - DNA, 35 bp, Artificial Sequence
  Synthetic oligonucleotide
gcaagccacctgatctctctacgccccacgccttt

SEQ ID NO: 90309 - DNA, 35 bp, Artificial Sequence
  Synthetic oligonucleotide
ttggacctccccgccggaacattcgatcccgcaaa

SEQ ID NO: 90310 - DNA, 36 bp, Artificial Sequence
  Synthetic oligonucleotide
ggagtgtgcacagggaatagggctacatgtccgaaa

SEQ ID NO: 90311 - DNA, 34 bp, Artificial Sequence
  Synthetic oligonucleotide
atacgccaccgactcgccctcccatcacccggaa

SEQ ID NO: 90312 - DNA, 35 bp, Artificial Sequence
  Synthetic oligonucleotide
agacatgccggacagaacggtctgaagaatggtaa

SEQ ID NO: 90313 - DNA, 36 bp, Artificial Sequence
  Synthetic oligonucleotide
gatggcttaatcctgtttcttcaactgccggtaaca

SEQ ID NO: 90314 - DNA, 36 bp, Artificial Sequence
  Synthetic oligonucleotide
atccaaacaaccgagacaatggacgtagggtaacca

SEQ ID NO: 90315 - DNA, 36 bp, Artificial Sequence
  Synthetic oligonucleotide
tctgccctcccacagtgataagacgcgtatccacca

SEQ ID NO: 90316 - DNA, 36 bp, Artificial Sequence
  Synthetic oligonucleotide
gtgtgcgcgtactattctctatgcttcttggtacca

SEQ ID NO: 90317 - DNA, 35 bp, Artificial Sequence
  Synthetic oligonucleotide
tgtgaaccacgggatggtcattcggaaaatggcca

SEQ ID NO: 90318 - DNA, 36 bp, Artificial Sequence
  Synthetic oligonucleotide
agaaacccaactggtattgtactgtcccataacgca

SEQ ID NO: 90319 - DNA, 36 bp, Artificial Sequence
  Synthetic oligonucleotide
gtaccgctcgacgagcattctgtactatcaatatca

SEQ ID NO: 90320 - DNA, 36 bp, Artificial Sequence
  Synthetic oligonucleotide
acctccgcgcgtcccatatcgattgccactgggtca

SEQ ID NO: 90321 - DNA, 37 bp, Artificial Sequence
  Synthetic oligonucleotide
tccccgcaatcacattgcccatgattcaccctgtaga

SEQ ID NO: 90322 - DNA, 37 bp, Artificial Sequence
  Synthetic oligonucleotide
tccggaggaacgtctggtattagtcagaataattaga

SEQ ID NO: 90323 - DNA, 37 bp, Artificial Sequence
  Synthetic oligonucleotide
tgcactcgacacagtctagcttccaccctttcttaga

SEQ ID NO: 90324 - DNA, 37 bp, Artificial Sequence
  Synthetic oligonucleotide
accctgccggcacagagatgaaacatgagcgaaacga

SEQ ID NO: 90325 - DNA, 37 bp, Artificial Sequence
  Synthetic oligonucleotide
tctgatgtcctccgctgacctaacctgtgctgaacga

SEQ ID NO: 90326 - DNA, 37 bp, Artificial Sequence
  Synthetic oligonucleotide
gtagcaaagggatggtaccatagggatgatgtaacga

SEQ ID NO: 90327 - DNA, 37 bp, Artificial Sequence
  Synthetic oligonucleotide
gacacggttggctgtctctttgcacgtaccttaccga

SEQ ID NO: 90328 - DNA, 37 bp, Artificial Sequence
  Synthetic oligonucleotide
gcccacggccgttattactgtagtgccgatcccccga

SEQ ID NO: 90329 - DNA, 37 bp, Artificial Sequence
  Synthetic oligonucleotide
tcttaccactcagacggttatttccttgggcctccga

SEQ ID NO: 90330 - DNA, 36 bp, Artificial Sequence
  Synthetic oligonucleotide
ttgcccctgcgcatgagcagaccacagtcgttgcga

SEQ ID NO: 90331 - DNA, 37 bp, Artificial Sequence
  Synthetic oligonucleotide
gctggcctgggcagcctctttgatattgccaactcga

SEQ ID NO: 90332 - DNA, 37 bp, Artificial Sequence
  Synthetic oligonucleotide
ggactaaccgtgtgcgtcatattccatccaatctcga

SEQ ID NO: 90333 - DNA, 37 bp, Artificial Sequence
  Synthetic oligonucleotide
atctacactcggtgtatagcgctacaccatctctcga

SEQ ID NO: 90334 - DNA, 37 bp, Artificial Sequence
  Synthetic oligonucleotide
agggtgcaatccctggtcctatcaaacactgtctcga

SEQ ID NO: 90335 - DNA, 37 bp, Artificial Sequence
  Synthetic oligonucleotide
tcagcccagtctctgcgttatcccgggcttgattcga

SEQ ID NO: 90336 - DNA, 36 bp, Artificial Sequence
  Synthetic oligonucleotide
tcacgcaaacgcttagtccatacacgctggcttcga

SEQ ID NO: 90337 - DNA, 37 bp, Artificial Sequence
  Synthetic oligonucleotide
gtggggagcatccgctatgtccttttcatctcttcga

SEQ ID NO: 90338 - DNA, 36 bp, Artificial Sequence
  Synthetic oligonucleotide
agcactgctgctggtcagctcctatactctgttcga

SEQ ID NO: 90339 - DNA, 37 bp, Artificial Sequence
  Synthetic oligonucleotide
gtacgccgtcactttcacacctttcctgtcggacgga

SEQ ID NO: 90340 - DNA, 37 bp, Artificial Sequence
  Synthetic oligonucleotide
gatgaggctgaggggtgaactgagcaaatggtacgga

SEQ ID NO: 90341 - DNA, 37 bp, Artificial Sequence
  Synthetic oligonucleotide
ttgtggcccacctcgatataagttcacctctaccgga

SEQ ID NO: 90342 - DNA, 36 bp, Artificial Sequence
  Synthetic oligonucleotide
tacagggacagtcgaccctccacgttttatcccgga

SEQ ID NO: 90343 - DNA, 37 bp, Artificial Sequence
  Synthetic oligonucleotide
gcgcgtgcgcacggacgggtctggtctcggcaaggga

SEQ ID NO: 90344 - DNA, 37 bp, Artificial Sequence
  Synthetic oligonucleotide
tgcttgccccaattgctccgcactttcccgcgaggga

SEQ ID NO: 90345 - DNA, 36 bp, Artificial Sequence
  Synthetic oligonucleotide
attgcaagcgggtgggtcttgtgagagggactggga

SEQ ID NO: 90346 - DNA, 35 bp, Artificial Sequence
  Synthetic oligonucleotide
gttgggggatagtgggtggggtagttaataatgga

SEQ ID NO: 90347 - DNA, 37 bp, Artificial Sequence
  Synthetic oligonucleotide
gctggcgctcactacattattaccatacgccactgga

SEQ ID NO: 90348 - DNA, 37 bp, Artificial Sequence
  Synthetic oligonucleotide
gcaccaccatctcgtctccgcgtgcatttgttctgga

SEQ ID NO: 90349 - DNA, 37 bp, Artificial Sequence
  Synthetic oligonucleotide
aaccgggacgcgctgttctatctatccttatcgtgga

SEQ ID NO: 90350 - DNA, 37 bp, Artificial Sequence
  Synthetic oligonucleotide
gtgaggggttaggggtacaattaaaggtgcgtgtgga

SEQ ID NO: 90351 - DNA, 37 bp, Artificial Sequence
  Synthetic oligonucleotide
atggggtgggcgacgctgaggtgaacctggggaatga

SEQ ID NO: 90352 - DNA, 36 bp, Artificial Sequence
  Synthetic oligonucleotide
acagcagagggagaaagtggagtgggggcatgatga

SEQ ID NO: 90353 - DNA, 37 bp, Artificial Sequence
  Synthetic oligonucleotide
gtagccggaatatcgtctctaccgtacactcttatga

SEQ ID NO: 90354 - DNA, 37 bp, Artificial Sequence
  Synthetic oligonucleotide
gaaacgtacgcgagcgaggcactcatctcttttatga

SEQ ID NO: 90355 - DNA, 38 bp, Artificial Sequence
  Synthetic oligonucleotide
gctgcgaaggacgtccgctctacctctatggcccctga

SEQ ID NO: 90356 - DNA, 37 bp, Artificial Sequence
  Synthetic oligonucleotide
gcgatacgcacgttgtagactccgggtttgtccctga

SEQ ID NO: 90357 - DNA, 38 bp, Artificial Sequence
  Synthetic oligonucleotide
tcacgcactccggctatccgtgaagagtgcacttctga

SEQ ID NO: 90358 - DNA, 38 bp, Artificial Sequence
  Synthetic oligonucleotide
aacgtcgcaagggcatatacacccggggagtcaagtga

SEQ ID NO: 90359 - DNA, 38 bp, Artificial Sequence
  Synthetic oligonucleotide
gaccacgagaaggttggatgggaggagtttaggagtga

SEQ ID NO: 90360 - DNA, 38 bp, Artificial Sequence
  Synthetic oligonucleotide
gccgacgtggaggagagtaggagggccgtggagggtga

SEQ ID NO: 90361 - DNA, 38 bp, Artificial Sequence
  Synthetic oligonucleotide
gacgtctccagaggggttttcaggacgagggggggtga

SEQ ID NO: 90362 - DNA, 38 bp, Artificial Sequence
  Synthetic oligonucleotide
aagccaccgctcagatacctgtgaccacatcctattga

SEQ ID NO: 90363 - DNA, 38 bp, Artificial Sequence
  Synthetic oligonucleotide
tacctgtgctcacgggtagggatagggaagggtattga

SEQ ID NO: 90364 - DNA, 37 bp, Artificial Sequence
  Synthetic oligonucleotide
acccggtccagtggtgtgcccgcgattctacccttga

SEQ ID NO: 90365 - DNA, 38 bp, Artificial Sequence
  Synthetic oligonucleotide
gacgacgagtgagaggaagggacaaacgtgccagttga

SEQ ID NO: 90366 - DNA, 38 bp, Artificial Sequence
  Synthetic oligonucleotide
gtggagaagggtgaggtcgtggtcggagattatgttga

SEQ ID NO: 90367 - DNA, 38 bp, Artificial Sequence
  Synthetic oligonucleotide
tcctgccatcgctgccgtccatcaccaacacctgttga

SEQ ID NO: 90368 - DNA, 38 bp, Artificial Sequence
  Synthetic oligonucleotide
gtatgcgcaccgatctatccatcttttccgccctttga

SEQ ID NO: 90369 - DNA, 37 bp, Artificial Sequence
  Synthetic oligonucleotide
tacgcagaagtgtcctcgcgttctcgttttattttga

SEQ ID NO: 90370 - DNA, 38 bp, Artificial Sequence
  Synthetic oligonucleotide
agcgccatagcccacgccgctgtcaaccccgcttttga

SEQ ID NO: 90371 - DNA, 38 bp, Artificial Sequence
  Synthetic oligonucleotide
ttgtgtgcaccatcttgtacgtcttcgaccctttttga

SEQ ID NO: 90372 - DNA, 36 bp, Artificial Sequence
  Synthetic oligonucleotide
gacgcacgatgacacggtatacggtagatggcaata

SEQ ID NO: 90373 - DNA, 35 bp, Artificial Sequence
  Synthetic oligonucleotide
tcaggggcaacaatctaggggaacgtgcgggaata

SEQ ID NO: 90374 - DNA, 36 bp, Artificial Sequence
  Synthetic oligonucleotide
gtatgtctgccgtactcttgctatcagaccttcata

SEQ ID NO: 90375 - DNA, 36 bp, Artificial Sequence
  Synthetic oligonucleotide
gcgattagcgtagtacggggctggggggtaggtata

SEQ ID NO: 90376 - DNA, 36 bp, Artificial Sequence
  Synthetic oligonucleotide
ttggcttccccatccgctcactctttgcgtgtacta

SEQ ID NO: 90377 - DNA, 36 bp, Artificial Sequence
  Synthetic oligonucleotide
gaacgggcccgtttagtcctttccgaccttttgcta

SEQ ID NO: 90378 - DNA, 36 bp, Artificial Sequence
  Synthetic oligonucleotide
tcaccgccgccgagtgcaccctccatgtcgaatcta

SEQ ID NO: 90379 - DNA, 36 bp, Artificial Sequence
  Synthetic oligonucleotide
agcacacctcagtacgccagtgccgactactttcta

SEQ ID NO: 90380 - DNA, 35 bp, Artificial Sequence
  Synthetic oligonucleotide
gagaacgtgcacgggggggtgaggcatatccggta

SEQ ID NO: 90381 - DNA, 35 bp, Artificial Sequence
  Synthetic oligonucleotide
aacgaccgagacctgagtaaccgctacttgtctta

SEQ ID NO: 90382 - DNA, 35 bp, Artificial Sequence
  Synthetic oligonucleotide
gttccccagtcccgttacttgtccgccctaccgac

SEQ ID NO: 90383 - DNA, 35 bp, Artificial Sequence
  Synthetic oligonucleotide
gtgcatgtactgtctccgctttgccctacctggac

SEQ ID NO: 90384 - DNA, 35 bp, Artificial Sequence
  Synthetic oligonucleotide
cgccgaagcactgaccctgcacacggtgttcctcc

SEQ ID NO: 90385 - DNA, 35 bp, Artificial Sequence
  Synthetic oligonucleotide
tactacctacgcacctggtcatatacagctgctcc

SEQ ID NO: 90386 - DNA, 35 bp, Artificial Sequence
  Synthetic oligonucleotide
gccccccggcacctctcatccatgacacgccttcc

SEQ ID NO: 90387 - DNA, 35 bp, Artificial Sequence
  Synthetic oligonucleotide
aacgcaaagagaaggtgagagataccattacaagc

SEQ ID NO: 90388 - DNA, 35 bp, Artificial Sequence
  Synthetic oligonucleotide
tacacaccgccccttaatggcaattaacactcagc

SEQ ID NO: 90389 - DNA, 35 bp, Artificial Sequence
  Synthetic oligonucleotide
ctatgggcgccgtctacttatcatactccacatgc

SEQ ID NO: 90390 - DNA, 35 bp, Artificial Sequence
  Synthetic oligonucleotide
gttagaccccttgtcaggacatttgctatcccatc

SEQ ID NO: 90391 - DNA, 35 bp, Artificial Sequence
  Synthetic oligonucleotide
taccaaccaagtgtactcatatgtaaccaggcctc

SEQ ID NO: 90392 - DNA, 35 bp, Artificial Sequence
  Synthetic oligonucleotide
acatctacgcgccttgttccggtctcctggccgtc

SEQ ID NO: 90393 - DNA, 35 bp, Artificial Sequence
  Synthetic oligonucleotide
tttgatgtgccgacccgttacccggtactgtcgtc

SEQ ID NO: 90394 - DNA, 35 bp, Artificial Sequence
  Synthetic oligonucleotide
tcactccctcagggcttgtcaacgataggcacaag

SEQ ID NO: 90395 - DNA, 35 bp, Artificial Sequence
  Synthetic oligonucleotide
gaaccgtgcactggtttcagtgacttcgaatgaag

SEQ ID NO: 90396 - DNA, 35 bp, Artificial Sequence
  Synthetic oligonucleotide
tcaccttcactcgagcgatggttaatgatcaccag

SEQ ID NO: 90397 - DNA, 35 bp, Artificial Sequence
  Synthetic oligonucleotide
tgccgcccaaactcatttcagtctgtctgtaaacg

SEQ ID NO: 90398 - DNA, 35 bp, Artificial Sequence
  Synthetic oligonucleotide
ggtaaagggtacggatatggagggtgggcaacacg

SEQ ID NO: 90399 - DNA, 35 bp, Artificial Sequence
  Synthetic oligonucleotide
gactgtctcaccgtgggactacctacgttaacccg

SEQ ID NO: 90400 - DNA, 35 bp, Artificial Sequence
  Synthetic oligonucleotide
acaatgtgtcagtccacactcgccctttattctcg

SEQ ID NO: 90401 - DNA, 35 bp, Artificial Sequence
  Synthetic oligonucleotide
taagagcgggaatcaggagagtcaggagtaggcgg

SEQ ID NO: 90402 - DNA, 35 bp, Artificial Sequence
  Synthetic oligonucleotide
actttgcagtgttatcatgggtggtgggggaaggg

SEQ ID NO: 90403 - DNA, 35 bp, Artificial Sequence
  Synthetic oligonucleotide
gtaagagctggggttgcaaagcggtggggtggggg

SEQ ID NO: 90404 - DNA, 35 bp, Artificial Sequence
  Synthetic oligonucleotide
tagtccgacctcatacacgtatatgtttgaacctg

SEQ ID NO: 90405 - DNA, 35 bp, Artificial Sequence
  Synthetic oligonucleotide
tacgtgtggaagtgtgagtgtactggggagggttg

SEQ ID NO: 90406 - DNA, 34 bp, Artificial Sequence
  Synthetic oligonucleotide
aacgccaaccatcgaatcgacaccttaccttttg

SEQ ID NO: 90407 - DNA, 35 bp, Artificial Sequence
  Synthetic oligonucleotide
taccatcatccgtccctccatcgttcatatgccat

SEQ ID NO: 90408 - DNA, 35 bp, Artificial Sequence
  Synthetic oligonucleotide
aatgtgcggcctcacctgtcatgacatctgttcat

SEQ ID NO: 90409 - DNA, 35 bp, Artificial Sequence
  Synthetic oligonucleotide
acgaacccgccgcaagatagctcctatcctttcat

SEQ ID NO: 90410 - DNA, 35 bp, Artificial Sequence
  Synthetic oligonucleotide
atccactccccattttgcttaccctatgagacgat

SEQ ID NO: 90411 - DNA, 35 bp, Artificial Sequence
  Synthetic oligonucleotide
gttggtgcgctggcgaattacaccgctgaacctat

SEQ ID NO: 90412 - DNA, 35 bp, Artificial Sequence
  Synthetic oligonucleotide
aaaagcaaggaagggagatgataaaagcaagaact

SEQ ID NO: 90413 - DNA, 35 bp, Artificial Sequence
  Synthetic oligonucleotide
atcgggcaccattctcatcagcaatcgcacgcact

SEQ ID NO: 90414 - DNA, 35 bp, Artificial Sequence
  Synthetic oligonucleotide
tcatctgccaacaatttagtgcttgctgcttgact

SEQ ID NO: 90415 - DNA, 35 bp, Artificial Sequence
  Synthetic oligonucleotide
tcagcccactgcccccttacgatgcacgccgccct

SEQ ID NO: 90416 - DNA, 35 bp, Artificial Sequence
  Synthetic oligonucleotide
acaagcaatacgcgctagctgctgacatcttccct

SEQ ID NO: 90417 - DNA, 35 bp, Artificial Sequence
  Synthetic oligonucleotide
tgtcgcaccgcgcaccttcgcccaggcattttcct

SEQ ID NO: 90418 - DNA, 35 bp, Artificial Sequence
  Synthetic oligonucleotide
tcaaacaccggtcagggtcgctgcatgctgccgct

SEQ ID NO: 90419 - DNA, 35 bp, Artificial Sequence
  Synthetic oligonucleotide
acaggggccgcacgtgcgccgactcactcttggct

SEQ ID NO: 90420 - DNA, 35 bp, Artificial Sequence
  Synthetic oligonucleotide
gcccacttcatttcggtctatgaccgcgggcttct

SEQ ID NO: 90421 - DNA, 35 bp, Artificial Sequence
  Synthetic oligonucleotide
tgatccgcactgacttcttttttagcacacggtgt

SEQ ID NO: 90422 - DNA, 35 bp, Artificial Sequence
  Synthetic oligonucleotide
gccctctccactgcgccctggcgaagatcatttgt

SEQ ID NO: 90423 - DNA, 35 bp, Artificial Sequence
  Synthetic oligonucleotide
tggacaacactcatcgttggttcttttcttcaatt

SEQ ID NO: 90424 - DNA, 35 bp, Artificial Sequence
  Synthetic oligonucleotide
aacactcgtggggaatgggacacagatagcacgtt

SEQ ID NO: 90425 - DNA, 35 bp, Artificial Sequence
  Synthetic oligonucleotide
gaccggccattggttatcataaattctaccctgtt

SEQ ID NO: 90426 - DNA, 35 bp, Artificial Sequence
  Synthetic oligonucleotide
ttccacccagctccttggttcgtgctgtcaccttt

SEQ ID NO: 90427 - DNA, 35 bp, Artificial Sequence
  Synthetic oligonucleotide
ttcgatcggtaacgtactgtctttcttagtccttt

SEQ ID NO: 90428 - DNA, 35 bp, Artificial Sequence
  Synthetic oligonucleotide
gacgcactctcagaaattgtcgcgaaatttcgttt

SEQ ID NO: 90429 - DNA, 35 bp, Artificial Sequence
  Synthetic oligonucleotide
gccgtcccctcctcattgatcactggcgatttttt

SEQ ID NO: 90430 - DNA, 35 bp, Artificial Sequence
  Synthetic oligonucleotide
gtgccggaccctagggagagcaaggacggcccaaa

SEQ ID NO: 90431 - DNA, 36 bp, Artificial Sequence
  Synthetic oligonucleotide
gaagatcggacgagcgggcttggggcagtatgcaaa

SEQ ID NO: 90432 - DNA, 36 bp, Artificial Sequence
  Synthetic oligonucleotide
tacttcgcgttcgtgatccctcccctccgctgtaaa

SEQ ID NO: 90433 - DNA, 36 bp, Artificial Sequence
  Synthetic oligonucleotide
taagggagggacattggcgttaggtggtgtaaacaa

SEQ ID NO: 90434 - DNA, 36 bp, Artificial Sequence
  Synthetic oligonucleotide
gacatgggaggtaatgtggggctgttattttacgaa

SEQ ID NO: 90435 - DNA, 36 bp, Artificial Sequence
  Synthetic oligonucleotide
gacttgccatcacacatccgcactcagtctactgaa

SEQ ID NO: 90436 - DNA, 36 bp, Artificial Sequence
  Synthetic oligonucleotide
aatgccaacgagctgggtgggctacttcgattgtaa

SEQ ID NO: 90437 - DNA, 35 bp, Artificial Sequence
  Synthetic oligonucleotide
gtggtgatccatggatgggcgctaaggggggaaca

SEQ ID NO: 90438 - DNA, 36 bp, Artificial Sequence
  Synthetic oligonucleotide
tcatcgccctaccggatcgtccacacccgtcccaca

SEQ ID NO: 90439 - DNA, 36 bp, Artificial Sequence
  Synthetic oligonucleotide
tatgcaagcaaccgacttgctccacatcctgttaca

SEQ ID NO: 90440 - DNA, 36 bp, Artificial Sequence
  Synthetic oligonucleotide
gaccaacggaatgttggaagtcaacacctttatcca

SEQ ID NO: 90441 - DNA, 35 bp, Artificial Sequence
  Synthetic oligonucleotide
taccacgaccaccagagaccgcttgcactggtcca

SEQ ID NO: 90442 - DNA, 35 bp, Artificial Sequence
  Synthetic oligonucleotide
ggacgacgaacccatcgtgctaagcctttatcgca

SEQ ID NO: 90443 - DNA, 35 bp, Artificial Sequence
  Synthetic oligonucleotide
gtacccaggttgcggatcatgccatggccttctca

SEQ ID NO: 90444 - DNA, 36 bp, Artificial Sequence
  Synthetic oligonucleotide
acgcaagctgcatacagtgcttgaaattagatgtca

SEQ ID NO: 90445 - DNA, 36 bp, Artificial Sequence
  Synthetic oligonucleotide
agagacaccctccgatcgaatccctcggttccttca

SEQ ID NO: 90446 - DNA, 37 bp, Artificial Sequence
  Synthetic oligonucleotide
gcacctctagcgctgcgcaccgtccttcttcgcaaga

SEQ ID NO: 90447 - DNA, 36 bp, Artificial Sequence
  Synthetic oligonucleotide
tccaccacacgactgccagttgcgtaatgatcaaga

SEQ ID NO: 90448 - DNA, 37 bp, Artificial Sequence
  Synthetic oligonucleotide
tccacatggtggaagtggtggaataatgtacgtgaga

SEQ ID NO: 90449 - DNA, 37 bp, Artificial Sequence
  Synthetic oligonucleotide
tagctgctctgttcgtagcggcacctctttcacacga

SEQ ID NO: 90450 - DNA, 37 bp, Artificial Sequence
  Synthetic oligonucleotide
gcgaacggacacacgcattctatagacggtttgacga

SEQ ID NO: 90451 - DNA, 37 bp, Artificial Sequence
  Synthetic oligonucleotide
tcacgctgatgagcagttcgggtgggcgggggtacga

SEQ ID NO: 90452 - DNA, 37 bp, Artificial Sequence
  Synthetic oligonucleotide
tggtgtcagccagacttttgcgccccatctttaccga

SEQ ID NO: 90453 - DNA, 36 bp, Artificial Sequence
  Synthetic oligonucleotide
gttgccctcactcttccgttgtctgtaccaaagcga

SEQ ID NO: 90454 - DNA, 37 bp, Artificial Sequence
  Synthetic oligonucleotide
tgatgcagggctgcccgggggtacaaggtgggtgcga

SEQ ID NO: 90455 - DNA, 36 bp, Artificial Sequence
  Synthetic oligonucleotide
aactccatcacctgccagcggtaacctacattgcga

SEQ ID NO: 90456 - DNA, 37 bp, Artificial Sequence
  Synthetic oligonucleotide
ttcgcgagaaacgggagcattggagaacgcatctcga

SEQ ID NO: 90457 - DNA, 37 bp, Artificial Sequence
  Synthetic oligonucleotide
acccctccgctgttacgttaatagccgctttccagga

SEQ ID NO: 90458 - DNA, 37 bp, Artificial Sequence
  Synthetic oligonucleotide
gaagaggaagagtgaacccacggaactcagaagagga

SEQ ID NO: 90459 - DNA, 37 bp, Artificial Sequence
  Synthetic oligonucleotide
tatgtagaggtggtagtaagggggaggactgagagga

SEQ ID NO: 90460 - DNA, 37 bp, Artificial Sequence
  Synthetic oligonucleotide
atggacgggagcacgaaggggcgggtgccaactagga

SEQ ID NO: 90461 - DNA, 37 bp, Artificial Sequence
  Synthetic oligonucleotide
gacggagcaacggcaggcacttacctctttacacgga

SEQ ID NO: 90462 - DNA, 37 bp, Artificial Sequence
  Synthetic oligonucleotide
tcacccagctgcccattctttttcgacctgagccgga

SEQ ID NO: 90463 - DNA, 37 bp, Artificial Sequence
  Synthetic oligonucleotide
atgagcaacggtaagaactagagcgcggaggatcgga

SEQ ID NO: 90464 - DNA, 37 bp, Artificial Sequence
  Synthetic oligonucleotide
gcaccgtacacggctcacactcgtaacaccctcggga

SEQ ID NO: 90465 - DNA, 38 bp, Artificial Sequence
  Synthetic oligonucleotide
aaacaaggcgggggggatggctaatgtgaccccgatga

SEQ ID NO: 90466 - DNA, 38 bp, Artificial Sequence
  Synthetic oligonucleotide
gaaacacgcagtcagggaactggcggataaatggatga

SEQ ID NO: 90467 - DNA, 37 bp, Artificial Sequence
  Synthetic oligonucleotide
tgttcgaggaggcaagtgaggggtacgtagaatatga

SEQ ID NO: 90468 - DNA, 38 bp, Artificial Sequence
  Synthetic oligonucleotide
atccgccccattgatgattgtcctatcccgtcatatga

SEQ ID NO: 90469 - DNA, 37 bp, Artificial Sequence
  Synthetic oligonucleotide
gctacgacggagtctcatcctagtacgtcctccctga

SEQ ID NO: 90470 - DNA, 38 bp, Artificial Sequence
  Synthetic oligonucleotide
gactggcggactgcaggcggggcaattgagagagctga

SEQ ID NO: 90471 - DNA, 37 bp, Artificial Sequence
  Synthetic oligonucleotide
tgactccacctctgaaggacataaatacgtgtgctga

SEQ ID NO: 90472 - DNA, 38 bp, Artificial Sequence
  Synthetic oligonucleotide
cgaccacagcccttgaagtgatatccgtgggattctga

SEQ ID NO: 90473 - DNA, 37 bp, Artificial Sequence
  Synthetic oligonucleotide
agccaaccagtggccttcccggcattacaccaagtga

SEQ ID NO: 90474 - DNA, 38 bp, Artificial Sequence
  Synthetic oligonucleotide
gaagacaggagtatgggagggggacaagattttcgtga

SEQ ID NO: 90475 - DNA, 38 bp, Artificial Sequence
  Synthetic oligonucleotide
gcagtacagttatcgacgcactctacattttttcgtga

SEQ ID NO: 90476 - DNA, 38 bp, Artificial Sequence
  Synthetic oligonucleotide
agacgccagagggacggggagcgagtatggacgggtga

SEQ ID NO: 90477 - DNA, 37 bp, Artificial Sequence
  Synthetic oligonucleotide
atggtggagtgggaatttgtttgagtggacttggtga

SEQ ID NO: 90478 - DNA, 38 bp, Artificial Sequence
  Synthetic oligonucleotide
tccgatagccgtcgaacattggtgggggatcttggtga

SEQ ID NO: 90479 - DNA, 37 bp, Artificial Sequence
  Synthetic oligonucleotide
tccaggggcaactctgtcttctcctccaagcctgtga

SEQ ID NO: 90480 - DNA, 38 bp, Artificial Sequence
  Synthetic oligonucleotide
gcccaccatttcgctacctgtattatgctagtctgtga

SEQ ID NO: 90481 - DNA, 38 bp, Artificial Sequence
  Synthetic oligonucleotide
gatccgctcctgtagatatatgtatcgacggaaattga

SEQ ID NO: 90482 - DNA, 38 bp, Artificial Sequence
  Synthetic oligonucleotide
tgggatccgcaagtatcgttctcgccacaacctattga

SEQ ID NO: 90483 - DNA, 38 bp, Artificial Sequence
  Synthetic oligonucleotide
agtggcgatagtcagcgcgtttgcttttcctttcttga

SEQ ID NO: 90484 - DNA, 37 bp, Artificial Sequence
  Synthetic oligonucleotide
gcctccgcgaggaggcttgttctcttcattcagttga

SEQ ID NO: 90485 - DNA, 38 bp, Artificial Sequence
  Synthetic oligonucleotide
gggggagggtacggatagggggggcgatggttggttga

SEQ ID NO: 90486 - DNA, 37 bp, Artificial Sequence
  Synthetic oligonucleotide
tcgattgcgctccacctccccttgatacacctgttga

SEQ ID NO: 90487 - DNA, 38 bp, Artificial Sequence
  Synthetic oligonucleotide
gacccgccggcagtctgtatgcgcccttacgttgttga

SEQ ID NO: 90488 - DNA, 38 bp, Artificial Sequence
  Synthetic oligonucleotide
acgatcagccggaagagggtaagggatatggactttga

SEQ ID NO: 90489 - DNA, 35 bp, Artificial Sequence
  Synthetic oligonucleotide
tgttgcctgccacttcgggtcgcttcgacatccta

SEQ ID NO: 90490 - DNA, 36 bp, Artificial Sequence
  Synthetic oligonucleotide
atcagcgcggtagctattcaagccgcacttctcgta

SEQ ID NO: 90491 - DNA, 36 bp, Artificial Sequence
  Synthetic oligonucleotide
gccgcctgccgctgagtagcttacatggttttcgta

SEQ ID NO: 90492 - DNA, 36 bp, Artificial Sequence
  Synthetic oligonucleotide
tgcgggggtgggaactggtgttaaagagtggtggta

SEQ ID NO: 90493 - DNA, 36 bp, Artificial Sequence
  Synthetic oligonucleotide
acgtgacgccgtacggttgctagcccatgccatgta

SEQ ID NO: 90494 - DNA, 35 bp, Artificial Sequence
  Synthetic oligonucleotide
tgcaccccatgttgttattcatacctgcgcaatta

SEQ ID NO: 90495 - DNA, 35 bp, Artificial Sequence
  Synthetic oligonucleotide
gtatgcgcccactagacgtgctgccacacttcaac

SEQ ID NO: 90496 - DNA, 35 bp, Artificial Sequence
  Synthetic oligonucleotide
aataaccactgccagatctcatctagcaaacgaac

SEQ ID NO: 90497 - DNA, 35 bp, Artificial Sequence
  Synthetic oligonucleotide
tagacaggaacgaaggaacactggatgagaggaac

SEQ ID NO: 90498 - DNA, 35 bp, Artificial Sequence
  Synthetic oligonucleotide
tcaacaccaactcggacgatagtcgcctgtaccac

SEQ ID NO: 90499 - DNA, 35 bp, Artificial Sequence
  Synthetic oligonucleotide
acacggcattgccctatcgaaccgctagctgaacc

SEQ ID NO: 90500 - DNA, 35 bp, Artificial Sequence
  Synthetic oligonucleotide
acgccgtacaattctcactactgagccttctaacc

SEQ ID NO: 90501 - DNA, 35 bp, Artificial Sequence
  Synthetic oligonucleotide
tacccgtcgtatccatggttattcgtaccccgacc

SEQ ID NO: 90502 - DNA, 35 bp, Artificial Sequence
  Synthetic oligonucleotide
gtccgcaagtgccttatcagacgctgctcatggcc

SEQ ID NO: 90503 - DNA, 35 bp, Artificial Sequence
  Synthetic oligonucleotide
ttggtccaccccgcctatgtgccgttgcctctgcc

SEQ ID NO: 90504 - DNA, 35 bp, Artificial Sequence
  Synthetic oligonucleotide
gaggacagggaagggtctggagctggttggttagc

SEQ ID NO: 90505 - DNA, 35 bp, Artificial Sequence
  Synthetic oligonucleotide
gcacccctgacgtctctaatcctatcgcctcacgc

SEQ ID NO: 90506 - DNA, 34 bp, Artificial Sequence
  Synthetic oligonucleotide
tgacacagtcaactcttagctgaccatggggggc

SEQ ID NO: 90507 - DNA, 35 bp, Artificial Sequence
  Synthetic oligonucleotide
tatgacggtccttccttgctcactgggccatctgc

SEQ ID NO: 90508 - DNA, 34 bp, Artificial Sequence
  Synthetic oligonucleotide
gctggccggccaggctcaaccaacacccgacatc

SEQ ID NO: 90509 - DNA, 35 bp, Artificial Sequence
  Synthetic oligonucleotide
aacatcagcctgagatacgatcacgttaccgcctc

SEQ ID NO: 90510 - DNA, 35 bp, Artificial Sequence
  Synthetic oligonucleotide
tgtgcatgtttattcggtgcgccctcgttgccttc

SEQ ID NO: 90511 - DNA, 35 bp, Artificial Sequence
  Synthetic oligonucleotide
gatggaggaggaggggtcgaggtggacgggtaaag

SEQ ID NO: 90512 - DNA, 35 bp, Artificial Sequence
  Synthetic oligonucleotide
aaccaacacccgttcacagtccccacgcacccgag

SEQ ID NO: 90513 - DNA, 35 bp, Artificial Sequence
  Synthetic oligonucleotide
tgagtgtccgaacttggcctttttttcagatcacg

SEQ ID NO: 90514 - DNA, 35 bp, Artificial Sequence
  Synthetic oligonucleotide
acctccctcctgttggctctattgagttccctacg

SEQ ID NO: 90515 - DNA, 35 bp, Artificial Sequence
  Synthetic oligonucleotide
tcacgcacgcccactgaagcttcagaactggcccg

SEQ ID NO: 90516 - DNA, 35 bp, Artificial Sequence
  Synthetic oligonucleotide
gttcgagggcctcagttatgtccacatggtctccg

SEQ ID NO: 90517 - DNA, 35 bp, Artificial Sequence
  Synthetic oligonucleotide
tccgctctccgggcgacgagaggtcttctgttccg

SEQ ID NO: 90518 - DNA, 35 bp, Artificial Sequence
  Synthetic oligonucleotide
gtggtcacgcctgtcattatcgcaaaccgcgcgcg

SEQ ID NO: 90519 - DNA, 35 bp, Artificial Sequence
  Synthetic oligonucleotide
atgtagacacgcttttgccacagaacgccctttcg

SEQ ID NO: 90520 - DNA, 35 bp, Artificial Sequence
  Synthetic oligonucleotide
aaccgaggcaggaggagataaaacgattggcgggg

SEQ ID NO: 90521 - DNA, 35 bp, Artificial Sequence
  Synthetic oligonucleotide
gtgaggggcaaggtactggaattagaactgatggg

SEQ ID NO: 90522 - DNA, 35 bp, Artificial Sequence
  Synthetic oligonucleotide
atgttgtcgctgacttgtgctcgttgcctgtgctg

SEQ ID NO: 90523 - DNA, 35 bp, Artificial Sequence
  Synthetic oligonucleotide
atgtgcgtgaagaactcttatggtaaccatccttg

SEQ ID NO: 90524 - DNA, 35 bp, Artificial Sequence
  Synthetic oligonucleotide
taacccgccgagggtctccatgatccgtgtctttg

SEQ ID NO: 90525 - DNA, 35 bp, Artificial Sequence
  Synthetic oligonucleotide
aagctgtcccaacctgcgaccacacaatcagtaat

SEQ ID NO: 90526 - DNA, 35 bp, Artificial Sequence
  Synthetic oligonucleotide
tttgccaccgcctctgactttatgccgattaacat

SEQ ID NO: 90527 - DNA, 35 bp, Artificial Sequence
  Synthetic oligonucleotide
gtcacatcgagtaagggggagggaggggggcccat

SEQ ID NO: 90528 - DNA, 35 bp, Artificial Sequence
  Synthetic oligonucleotide
gagtctgaccagctgccctggccactaactcttat

SEQ ID NO: 90529 - DNA, 35 bp, Artificial Sequence
  Synthetic oligonucleotide
actgcctgtgccatggaaccttaaatgatcacact

SEQ ID NO: 90530 - DNA, 35 bp, Artificial Sequence
  Synthetic oligonucleotide
gtaccgatcgcatggccttatgtcaagtcgcccct

SEQ ID NO: 90531 - DNA, 35 bp, Artificial Sequence
  Synthetic oligonucleotide
acatgccgcccggcattggttcagtcatgtcctct

SEQ ID NO: 90532 - DNA, 35 bp, Artificial Sequence
  Synthetic oligonucleotide
tgtggtgtcgctccgcctgttggatcccgtcgtct

SEQ ID NO: 90533 - DNA, 35 bp, Artificial Sequence
  Synthetic oligonucleotide
gatgatgcccgactgccgtatgttcgcggaggtct

SEQ ID NO: 90534 - DNA, 35 bp, Artificial Sequence
  Synthetic oligonucleotide
ataggaacgagtagaggatgggaggtattcgatgt

SEQ ID NO: 90535 - DNA, 35 bp, Artificial Sequence
  Synthetic oligonucleotide
tcacatcctccttcacgtgtgtcgttactccctgt

SEQ ID NO: 90536 - DNA, 35 bp, Artificial Sequence
  Synthetic oligonucleotide
gcgcatcccagcccgcgctttcacaattttaaatt

SEQ ID NO: 90537 - DNA, 35 bp, Artificial Sequence
  Synthetic oligonucleotide
tcacattgtaggacgccctctaccctcgttgcgtt

SEQ ID NO: 90538 - DNA, 35 bp, Artificial Sequence
  Synthetic oligonucleotide
acccaacgcactttgccccgtggccattcgctttt

SEQ ID NO: 90539 - DNA, 36 bp, Artificial Sequence
  Synthetic oligonucleotide
agccgtaggagggggagagcaggtcgggggagcaaa

SEQ ID NO: 90540 - DNA, 34 bp, Artificial Sequence
  Synthetic oligonucleotide
tctgacgcgaacaccctgcccgcacggtctcaaa

SEQ ID NO: 90541 - DNA, 36 bp, Artificial Sequence
  Synthetic oligonucleotide
ggtcatggggggagggaggattatggacgcggccaa

SEQ ID NO: 90542 - DNA, 36 bp, Artificial Sequence
  Synthetic oligonucleotide
tcactgcactggtctgaagcggtctcctagctccaa

SEQ ID NO: 90543 - DNA, 35 bp, Artificial Sequence
  Synthetic oligonucleotide
ttgacactcgacgttagtgcccctctcatcctcaa

SEQ ID NO: 90544 - DNA, 36 bp, Artificial Sequence
  Synthetic oligonucleotide
acatgtgcaccactttcgctcccagaccgttaggaa

SEQ ID NO: 90545 - DNA, 35 bp, Artificial Sequence
  Synthetic oligonucleotide
acaacgcacagggcatcgattcacccccgatggaa

SEQ ID NO: 90546 - DNA, 36 bp, Artificial Sequence
  Synthetic oligonucleotide
acgaagtggccgtcgtacctagccccaaccggtgaa

SEQ ID NO: 90547 - DNA, 36 bp, Artificial Sequence
  Synthetic oligonucleotide
agtcggacagggggagggatgtcaagtggaatataa

SEQ ID NO: 90548 - DNA, 34 bp, Artificial Sequence
  Synthetic oligonucleotide
tccgtagttcggtatgcatcttagcctctccaca

SEQ ID NO: 90549 - DNA, 36 bp, Artificial Sequence
  Synthetic oligonucleotide
tgctgcaacactgagtaaccctccaacactgtacca

SEQ ID NO: 90550 - DNA, 36 bp, Artificial Sequence
  Synthetic oligonucleotide
ggtcgcctgtccgtaccaactgcgttatcatgccca

SEQ ID NO: 90551 - DNA, 36 bp, Artificial Sequence
  Synthetic oligonucleotide
agtgtgcggttggttttcccttgacctgtttgccca

SEQ ID NO: 90552 - DNA, 36 bp, Artificial Sequence
  Synthetic oligonucleotide
caccacgcatgaccgctcttgatcagacgcctccca

SEQ ID NO: 90553 - DNA, 36 bp, Artificial Sequence
  Synthetic oligonucleotide
gaccaagcacaacgcttaattctgggcctctggcca

SEQ ID NO: 90554 - DNA, 36 bp, Artificial Sequence
  Synthetic oligonucleotide
tgatcctctgctgtgctacttcacgtctaatatcca

SEQ ID NO: 90555 - DNA, 35 bp, Artificial Sequence
  Synthetic oligonucleotide
gatgcccgaagtggaggaacgtaatattattggca

SEQ ID NO: 90556 - DNA, 35 bp, Artificial Sequence
  Synthetic oligonucleotide
gaagacggaagggggagtatggattatatgtctca

SEQ ID NO: 90557 - DNA, 37 bp, Artificial Sequence
  Synthetic oligonucleotide
ggaccacggctaaaatgtgaggctggaaaggggaaga

SEQ ID NO: 90558 - DNA, 37 bp, Artificial Sequence
  Synthetic oligonucleotide
gacgatgcgatatgaggagggcgggttggtgcacaga

SEQ ID NO: 90559 - DNA, 37 bp, Artificial Sequence
  Synthetic oligonucleotide
tgaaaaagggtaaggaacagtgcgggaagaagacaga

SEQ ID NO: 90560 - DNA, 37 bp, Artificial Sequence
  Synthetic oligonucleotide
gacgcatcctccctgacgtgataaccaacgccccaga

SEQ ID NO: 90561 - DNA, 37 bp, Artificial Sequence
  Synthetic oligonucleotide
acacggggctactcatatcataaaacagtcgtccaga

SEQ ID NO: 90562 - DNA, 36 bp, Artificial Sequence
  Synthetic oligonucleotide
attgccttgcaagcgcgtcctccaatctcgcataga

SEQ ID NO: 90563 - DNA, 36 bp, Artificial Sequence
  Synthetic oligonucleotide
tgcctgccacgtgcgcgtactaccaccctctcacga

SEQ ID NO: 90564 - DNA, 37 bp, Artificial Sequence
  Synthetic oligonucleotide
gatgcccacccagtaatcgccctggtccgttggacga

SEQ ID NO: 90565 - DNA, 35 bp, Artificial Sequence
  Synthetic oligonucleotide
tgatgccaactgctggtctcaagcttcccgaccga

SEQ ID NO: 90566 - DNA, 37 bp, Artificial Sequence
  Synthetic oligonucleotide
gccacgttataacgttcttcaccctatgctgtgccga

SEQ ID NO: 90567 - DNA, 37 bp, Artificial Sequence
  Synthetic oligonucleotide
gacactgcattcatatcacttcgcacagatttagcga

SEQ ID NO: 90568 - DNA, 37 bp, Artificial Sequence
  Synthetic oligonucleotide
tccacctgcacagatccgtaggaatcctttttagcga

SEQ ID NO: 90569 - DNA, 35 bp, Artificial Sequence
  Synthetic oligonucleotide
gtggaagtgggagcattgtattatgacctgggcga

SEQ ID NO: 90570 - DNA, 37 bp, Artificial Sequence
  Synthetic oligonucleotide
gggttggtacatgggaaggaaacgtggacgtgggcga

SEQ ID NO: 90571 - DNA, 36 bp, Artificial Sequence
  Synthetic oligonucleotide
gcactgacactgtactaaggcatatgccgtatgcga

SEQ ID NO: 90572 - DNA, 36 bp, Artificial Sequence
  Synthetic oligonucleotide
tcacccgtccttctgctgattcgtccccctttgcga

SEQ ID NO: 90573 - DNA, 37 bp, Artificial Sequence
  Synthetic oligonucleotide
taatagtgcgccagcgtagcaaccagccccacctcga

SEQ ID NO: 90574 - DNA, 37 bp, Artificial Sequence
  Synthetic oligonucleotide
ttcccccacccctcagccgtgtcctcgcgtctctcga

SEQ ID NO: 90575 - DNA, 37 bp, Artificial Sequence
  Synthetic oligonucleotide
aaatcgcaggggaataggacgggtcgggacaccagga

SEQ ID NO: 90576 - DNA, 37 bp, Artificial Sequence
  Synthetic oligonucleotide
tgttaaccaagcagaaggcgaatcagggagggacgga

SEQ ID NO: 90577 - DNA, 37 bp, Artificial Sequence
  Synthetic oligonucleotide
tgaccgatgtagtagtgcaagggaagagtgggtcgga

SEQ ID NO: 90578 - DNA, 37 bp, Artificial Sequence
  Synthetic oligonucleotide
tacacgtaccgactgggaggtgtcaattagtgaggga

SEQ ID NO: 90579 - DNA, 37 bp, Artificial Sequence
  Synthetic oligonucleotide
attggcggggagaagaattgtgggggtgcatgcggga

SEQ ID NO: 90580 - DNA, 36 bp, Artificial Sequence
  Synthetic oligonucleotide
tcagaatggtgggtgcatggtacgaaccgcagggga

SEQ ID NO: 90581 - DNA, 37 bp, Artificial Sequence
  Synthetic oligonucleotide
atccagaccctgcccgttttcagacagccgacaatga

SEQ ID NO: 90582 - DNA, 37 bp, Artificial Sequence
  Synthetic oligonucleotide
gacacattgggaggcgtaggtaggtcggttaggatga

SEQ ID NO: 90583 - DNA, 38 bp, Artificial Sequence
  Synthetic oligonucleotide
ttggaagtgggaagggatgaggggagtagtgatgatga

SEQ ID NO: 90584 - DNA, 37 bp, Artificial Sequence
  Synthetic oligonucleotide
taccaccccctagaatgttagtacgccatattgatga

SEQ ID NO: 90585 - DNA, 38 bp, Artificial Sequence
  Synthetic oligonucleotide
aacctgcccacacgattctggcatattcgttgttatga

SEQ ID NO: 90586 - DNA, 38 bp, Artificial Sequence
  Synthetic oligonucleotide
gaccaaccataggcgtacaatacagcccgagctactga

SEQ ID NO: 90587 - DNA, 38 bp, Artificial Sequence
  Synthetic oligonucleotide
gttgccccgcgttatccataccaagaccagatccctga

SEQ ID NO: 90588 - DNA, 38 bp, Artificial Sequence
  Synthetic oligonucleotide
ttgacatcggtgatagtgaagaggtgagtagatcctga

SEQ ID NO: 90589 - DNA, 38 bp, Artificial Sequence
  Synthetic oligonucleotide
aacactgcatgtgtcacactagcacacccgcaatctga

SEQ ID NO: 90590 - DNA, 38 bp, Artificial Sequence
  Synthetic oligonucleotide
gttgtggaagggggcatagtggaggagggtgtaagtga

SEQ ID NO: 90591 - DNA, 38 bp, Artificial Sequence
  Synthetic oligonucleotide
tcaaccggagtctgtcgtcgaaatccgcacccacgtga

SEQ ID NO: 90592 - DNA, 37 bp, Artificial Sequence
  Synthetic oligonucleotide
accactccgatcagtactactacaaaaaactccgtga

SEQ ID NO: 90593 - DNA, 38 bp, Artificial Sequence
  Synthetic oligonucleotide
acggatgagaacgggtgctaagaaagagagctgggtga

SEQ ID NO: 90594 - DNA, 38 bp, Artificial Sequence
  Synthetic oligonucleotide
attggggggtgagggaaggggcgccagagtaacattga

SEQ ID NO: 90595 - DNA, 35 bp, Artificial Sequence
  Synthetic oligonucleotide
ttgtgatgcgccattaacttgatttgggcgattga

SEQ ID NO: 90596 - DNA, 38 bp, Artificial Sequence
  Synthetic oligonucleotide
tgcggagcaatgggacgagaagggtcacactatattga

SEQ ID NO: 90597 - DNA, 38 bp, Artificial Sequence
  Synthetic oligonucleotide
aaccacgcactctggcctttaacaacgatgaaacttga

SEQ ID NO: 90598 - DNA, 36 bp, Artificial Sequence
  Synthetic oligonucleotide
acccatgcccaggttacttctatttaggctgtttga

SEQ ID NO: 90599 - DNA, 37 bp, Artificial Sequence
  Synthetic oligonucleotide
tgtcttgccctgactctgttcgccgactttgttttga

SEQ ID NO: 90600 - DNA, 38 bp, Artificial Sequence
  Synthetic oligonucleotide
acgccacccgtagtctatgactttgttgcattttttga

SEQ ID NO: 90601 - DNA, 35 bp, Artificial Sequence
  Synthetic oligonucleotide
tccctcccgcaggttttttcagcccgagctacata

SEQ ID NO: 90602 - DNA, 36 bp, Artificial Sequence
  Synthetic oligonucleotide
atacactggcacatgcccgacgccgatgacgcacta

SEQ ID NO: 90603 - DNA, 35 bp, Artificial Sequence
  Synthetic oligonucleotide
atccggaagccgttgacatcctgtacccgctccta

SEQ ID NO: 90604 - DNA, 36 bp, Artificial Sequence
  Synthetic oligonucleotide
tcaagcgcacgtcgaactagccgatggattaccgta

SEQ ID NO: 90605 - DNA, 35 bp, Artificial Sequence
  Synthetic oligonucleotide
gacagagggagggttgtcttttcagtgttgtggta

SEQ ID NO: 90606 - DNA, 36 bp, Artificial Sequence
  Synthetic oligonucleotide
tccgtccatccgcaaggataggaaacatctcctgta

SEQ ID NO: 90607 - DNA, 35 bp, Artificial Sequence
  Synthetic oligonucleotide
atcgtacgcagggcagtgccacattctcccgatta

SEQ ID NO: 90608 - DNA, 36 bp, Artificial Sequence
  Synthetic oligonucleotide
gtgaccgtgaattcgcgaagtggttcctccccctta

SEQ ID NO: 90609 - DNA, 36 bp, Artificial Sequence
  Synthetic oligonucleotide
ttacgcctaggcccctcgatcgcattgttcagctta

SEQ ID NO: 90610 - DNA, 35 bp, Artificial Sequence
  Synthetic oligonucleotide
accctccgccgcagttacgaagtcccatccgaaac

SEQ ID NO: 90611 - DNA, 35 bp, Artificial Sequence
  Synthetic oligonucleotide
ttgggcaaacaccatggcactctagattccgacac

SEQ ID NO: 90612 - DNA, 35 bp, Artificial Sequence
  Synthetic oligonucleotide
tagactcaccgcatccccttttgtttcctcgccac

SEQ ID NO: 90613 - DNA, 35 bp, Artificial Sequence
  Synthetic oligonucleotide
aactcctgtcggcctgaccagcacaggctcgatac

SEQ ID NO: 90614 - DNA, 35 bp, Artificial Sequence
  Synthetic oligonucleotide
ccaacaggcgatcggtagtagaacttttgaggtac

SEQ ID NO: 90615 - DNA, 35 bp, Artificial Sequence
  Synthetic oligonucleotide
ccatccctccgactgaccttgaatgggtcaacacc

SEQ ID NO: 90616 - DNA, 35 bp, Artificial Sequence
  Synthetic oligonucleotide
gaccgacccacagacgggctggaatctggtccccc

SEQ ID NO: 90617 - DNA, 35 bp, Artificial Sequence
  Synthetic oligonucleotide
taccgctacgttggtttttgcttcaatcggttccc

SEQ ID NO: 90618 - DNA, 35 bp, Artificial Sequence
  Synthetic oligonucleotide
accgacgaaccgtcagctttacacatcgtttagcc

SEQ ID NO: 90619 - DNA, 34 bp, Artificial Sequence
  Synthetic oligonucleotide
gcccaccgcgaggtccttcgctacacaccaatcc

SEQ ID NO: 90620 - DNA, 35 bp, Artificial Sequence
  Synthetic oligonucleotide
ttcttcaaccgctgagggtgcattgtacttgttcc

SEQ ID NO: 90621 - DNA, 35 bp, Artificial Sequence
  Synthetic oligonucleotide
atgtcacccgcctgtctgccgcgctagttccaagc

SEQ ID NO: 90622 - DNA, 35 bp, Artificial Sequence
  Synthetic oligonucleotide
tagtacgttcataaacccagttgttccctcgccgc

SEQ ID NO: 90623 - DNA, 35 bp, Artificial Sequence
  Synthetic oligonucleotide
actccactatgatagttgcgataactgaattccgc

SEQ ID NO: 90624 - DNA, 35 bp, Artificial Sequence
  Synthetic oligonucleotide
gttgcctgcttcacctatggttcgttagaacatgc

SEQ ID NO: 90625 - DNA, 35 bp, Artificial Sequence
  Synthetic oligonucleotide
gcctatctaaccgttcacatcgtgtatgtcacatc

SEQ ID NO: 90626 - DNA, 35 bp, Artificial Sequence
  Synthetic oligonucleotide
attcgacccacgagtgacattcctgaactgatatc

SEQ ID NO: 90627 - DNA, 35 bp, Artificial Sequence
  Synthetic oligonucleotide
ggagcctgggtaactgcacatctgcccgccgactc

SEQ ID NO: 90628 - DNA, 35 bp, Artificial Sequence
  Synthetic oligonucleotide
gccatgtacacacatacatgagaacaccacacttc

SEQ ID NO: 90629 - DNA, 35 bp, Artificial Sequence
  Synthetic oligonucleotide
taccgtccccgttttagggctagggcctcattttc

SEQ ID NO: 90630 - DNA, 35 bp, Artificial Sequence
  Synthetic oligonucleotide
gaggggatgagcggcaagtagaatcggaggtacag

SEQ ID NO: 90631 - DNA, 35 bp, Artificial Sequence
  Synthetic oligonucleotide
accatccacaagtttacacggaccaccttcctgag

SEQ ID NO: 90632 - DNA, 35 bp, Artificial Sequence
  Synthetic oligonucleotide
ggtcacgtagatgagggctgtgggtagggggaacg

SEQ ID NO: 90633 - DNA, 35 bp, Artificial Sequence
  Synthetic oligonucleotide
ggtgcatccattttatgccgtactccctatggtcg

SEQ ID NO: 90634 - DNA, 35 bp, Artificial Sequence
  Synthetic oligonucleotide
ttaaacgtgcaaatgcggcacaaggaatgggttcg

SEQ ID NO: 90635 - DNA, 35 bp, Artificial Sequence
  Synthetic oligonucleotide
actatgcagaggtgagggggggggaaatggatcgg

SEQ ID NO: 90636 - DNA, 35 bp, Artificial Sequence
  Synthetic oligonucleotide
gatccatccaaccacgtccactattgccctgcctg

SEQ ID NO: 90637 - DNA, 35 bp, Artificial Sequence
  Synthetic oligonucleotide
ttacatccccacgtgctctttttaagcgagtcctg

SEQ ID NO: 90638 - DNA, 35 bp, Artificial Sequence
  Synthetic oligonucleotide
tgtccggaggatggccaagtttttgggaaagggtg

SEQ ID NO: 90639 - DNA, 35 bp, Artificial Sequence
  Synthetic oligonucleotide
tgcgagtgcgcaacactgatcgacctccctttaat

SEQ ID NO: 90640 - DNA, 35 bp, Artificial Sequence
  Synthetic oligonucleotide
aaccggaggttccacaggtactcttcatagaacat

SEQ ID NO: 90641 - DNA, 35 bp, Artificial Sequence
  Synthetic oligonucleotide
atcgagagagaacgaagaagagagtgaaccgagat

SEQ ID NO: 90642 - DNA, 35 bp, Artificial Sequence
  Synthetic oligonucleotide
gaggacatggagtgcaaggctatggggagtgtgat

SEQ ID NO: 90643 - DNA, 35 bp, Artificial Sequence
  Synthetic oligonucleotide
gcgctgtcccacgctatgcctcgaaagtctaatat

SEQ ID NO: 90644 - DNA, 35 bp, Artificial Sequence
  Synthetic oligonucleotide
gacttgataggcccaaacgagccttgttttacact

SEQ ID NO: 90645 - DNA, 35 bp, Artificial Sequence
  Synthetic oligonucleotide
agccccgctcacacgatatccacaagctctatact

SEQ ID NO: 90646 - DNA, 35 bp, Artificial Sequence
  Synthetic oligonucleotide
gctcaccgatcacgcacagtcacagtagcttcgct

SEQ ID NO: 90647 - DNA, 35 bp, Artificial Sequence
  Synthetic oligonucleotide
agcggacgcatcccaggtcatcacaaagcttctgt

SEQ ID NO: 90648 - DNA, 35 bp, Artificial Sequence
  Synthetic oligonucleotide
aacagatccaccatgctgtcttgccccgtctttgt

SEQ ID NO: 90649 - DNA, 35 bp, Artificial Sequence
  Synthetic oligonucleotide
gacagacccacagagcatgtcagtttggtgtcctt

SEQ ID NO: 90650 - DNA, 35 bp, Artificial Sequence
  Synthetic oligonucleotide
tgatccacgaggcgcacaccctgccatctatattt

SEQ ID NO: 90651 - DNA, 35 bp, Artificial Sequence
  Synthetic oligonucleotide
gttcaccacacctgacatctccttgccaagtgttt

SEQ ID NO: 90652 - DNA, 36 bp, Artificial Sequence
  Synthetic oligonucleotide
taagtggaaacacaacatggggaagggagacacaaa

SEQ ID NO: 90653 - DNA, 36 bp, Artificial Sequence
  Synthetic oligonucleotide
ggacacaacaccattcggaaggacggtacatccaaa

SEQ ID NO: 90654 - DNA, 35 bp, Artificial Sequence
  Synthetic oligonucleotide
acatgtcgcccgctcccgaggtcttcgaacgcaaa

SEQ ID NO: 90655 - DNA, 35 bp, Artificial Sequence
  Synthetic oligonucleotide
ttcgggtacccgtcacaccccagccctgcctgaaa

SEQ ID NO: 90656 - DNA, 35 bp, Artificial Sequence
  Synthetic oligonucleotide
tccgccttccaggagtattaaatatcccgcctaaa

SEQ ID NO: 90657 - DNA, 37 bp, Artificial Sequence
  Synthetic oligonucleotide
tgccgaccccggcatgtggcatacataattcagccaa

SEQ ID NO: 90658 - DNA, 36 bp, Artificial Sequence
  Synthetic oligonucleotide
ttcgccacatgggttgcccgccctttcactggccaa

SEQ ID NO: 90659 - DNA, 36 bp, Artificial Sequence
  Synthetic oligonucleotide
gtatcgcgccggttattccgtttactgtctccgcaa

SEQ ID NO: 90660 - DNA, 33 bp, Artificial Sequence
  Synthetic oligonucleotide
ttcagctacacgggacgaccccaaccatcgcaa

SEQ ID NO: 90661 - DNA, 36 bp, Artificial Sequence
  Synthetic oligonucleotide
tgaccgtcgagcctatttttggtcatcatagttcaa

SEQ ID NO: 90662 - DNA, 35 bp, Artificial Sequence
  Synthetic oligonucleotide
tcagtcacggtctctcctgtacttgcatcctagaa

SEQ ID NO: 90663 - DNA, 35 bp, Artificial Sequence
  Synthetic oligonucleotide
gccgaaagaaccgccgtcctcggagccctctagaa

SEQ ID NO: 90664 - DNA, 35 bp, Artificial Sequence
  Synthetic oligonucleotide
ttcgcctaacacaactccaatgttattggaccgaa

SEQ ID NO: 90665 - DNA, 36 bp, Artificial Sequence
  Synthetic oligonucleotide
gaccattagtgctgggtacggagggggtactgggaa

SEQ ID NO: 90666 - DNA, 36 bp, Artificial Sequence
  Synthetic oligonucleotide
gcgatggggcggtactcaatttggccagggaagtaa

SEQ ID NO: 90667 - DNA, 35 bp, Artificial Sequence
  Synthetic oligonucleotide
aacgcacgtggtatgggaaaggtaggtagtagtaa

SEQ ID NO: 90668 - DNA, 35 bp, Artificial Sequence
  Synthetic oligonucleotide
ggtgaccttgccggttgcatgctgcacacttttaa

SEQ ID NO: 90669 - DNA, 36 bp, Artificial Sequence
  Synthetic oligonucleotide
atcccagcacccataaggtgagtttcacccggaaca

SEQ ID NO: 90670 - DNA, 35 bp, Artificial Sequence
  Synthetic oligonucleotide
gttcatcgcaaacgaacaagtgagtcgtgttcaca

SEQ ID NO: 90671 - DNA, 35 bp, Artificial Sequence
  Synthetic oligonucleotide
tgcaacaagccgcgctcccacgtccatccgtgaca

SEQ ID NO: 90672 - DNA, 36 bp, Artificial Sequence
  Synthetic oligonucleotide
accaggggcggttgtagacagccgggaggtgaagca

SEQ ID NO: 90673 - DNA, 35 bp, Artificial Sequence
  Synthetic oligonucleotide
gccgacacggtctggttgcacttttgctttctgca

SEQ ID NO: 90674 - DNA, 36 bp, Artificial Sequence
  Synthetic oligonucleotide
acagcatagcctcgtcctgattccttgtcacgtgca

SEQ ID NO: 90675 - DNA, 35 bp, Artificial Sequence
  Synthetic oligonucleotide
tcagttcgcaagttaatatcagcttctctcgtgca

SEQ ID NO: 90676 - DNA, 35 bp, Artificial Sequence
  Synthetic oligonucleotide
aaacatagtcattcgatcggcacatacacacatca

SEQ ID NO: 90677 - DNA, 35 bp, Artificial Sequence
  Synthetic oligonucleotide
ttgcacttttggttggccaattcccaggatcctca

SEQ ID NO: 90678 - DNA, 36 bp, Artificial Sequence
  Synthetic oligonucleotide
gaatagcgctcgcattgcctaaaacgtatattgtca

SEQ ID NO: 90679 - DNA, 35 bp, Artificial Sequence
  Synthetic oligonucleotide
gcacattgcagcagtccattaatcccagcaattca

SEQ ID NO: 90680 - DNA, 37 bp, Artificial Sequence
  Synthetic oligonucleotide
ttggacgcgaacgagggcacgtaacgtagggcgaaga

SEQ ID NO: 90681 - DNA, 37 bp, Artificial Sequence
  Synthetic oligonucleotide
acctccggtcgactcaagcactctctatcttcgaaga

SEQ ID NO: 90682 - DNA, 37 bp, Artificial Sequence
  Synthetic oligonucleotide
aaagaggggcggggcggataagactgcattgatcaga

SEQ ID NO: 90683 - DNA, 36 bp, Artificial Sequence
  Synthetic oligonucleotide
tgggaggaggaggggtaaagtggtagttggctcaga

SEQ ID NO: 90684 - DNA, 37 bp, Artificial Sequence
  Synthetic oligonucleotide
gactgcccacccgttcataaacgctcttgaagaacga

SEQ ID NO: 90685 - DNA, 36 bp, Artificial Sequence
  Synthetic oligonucleotide
gtaccgaccagcagtgattccacagcgcacctccga

SEQ ID NO: 90686 - DNA, 37 bp, Artificial Sequence
  Synthetic oligonucleotide
acactgccccttgatcgtcctccactcgcgatatcga

SEQ ID NO: 90687 - DNA, 37 bp, Artificial Sequence
  Synthetic oligonucleotide
gtgcaaggggggtgggtgaatatttgttacaacagga

SEQ ID NO: 90688 - DNA, 37 bp, Artificial Sequence
  Synthetic oligonucleotide
agacaggggaagacacgagaggacaaggaagtcagga

SEQ ID NO: 90689 - DNA, 37 bp, Artificial Sequence
  Synthetic oligonucleotide
gacgacgagaaagggtaggaagagggaggcgtgagga

SEQ ID NO: 90690 - DNA, 37 bp, Artificial Sequence
  Synthetic oligonucleotide
tagggaacggtagggtgcggggggatacgatgtagga

SEQ ID NO: 90691 - DNA, 36 bp, Artificial Sequence
  Synthetic oligonucleotide
aacatgtccagcctccagtctcgaattgagaaggga

SEQ ID NO: 90692 - DNA, 36 bp, Artificial Sequence
  Synthetic oligonucleotide
gaagaggggacctgtgaataagatggaaggaaggga

SEQ ID NO: 90693 - DNA, 36 bp, Artificial Sequence
  Synthetic oligonucleotide
atgactgcgcattggctatccccttccccataggga

SEQ ID NO: 90694 - DNA, 37 bp, Artificial Sequence
  Synthetic oligonucleotide
gagggggaatgcgagaataagcgaagtgccttaggga

SEQ ID NO: 90695 - DNA, 36 bp, Artificial Sequence
  Synthetic oligonucleotide
gtgggaagggggcgagcagtttaaggtggctcggga

SEQ ID NO: 90696 - DNA, 37 bp, Artificial Sequence
  Synthetic oligonucleotide
tccagcctcgccgtagaaacaccaccactggcgggga

SEQ ID NO: 90697 - DNA, 36 bp, Artificial Sequence
  Synthetic oligonucleotide
tagaggtgaaataggtgttatggaggaaggaatgga

SEQ ID NO: 90698 - DNA, 37 bp, Artificial Sequence
  Synthetic oligonucleotide
aactcaacccatactggcctaataagaggggcatgga

SEQ ID NO: 90699 - DNA, 36 bp, Artificial Sequence
  Synthetic oligonucleotide
tgacgaaagcgccttatcaaacgtacctgccaatga

SEQ ID NO: 90700 - DNA, 38 bp, Artificial Sequence
  Synthetic oligonucleotide
tgcgactgatgacacaggaggggaaaaacgcggaatga

SEQ ID NO: 90701 - DNA, 36 bp, Artificial Sequence
  Synthetic oligonucleotide
tcatggcaaaccaaccattagagacgaaaaacatga

SEQ ID NO: 90702 - DNA, 38 bp, Artificial Sequence
  Synthetic oligonucleotide
tctagtccatgcatccgactgcacgacgacacccatga

SEQ ID NO: 90703 - DNA, 38 bp, Artificial Sequence
  Synthetic oligonucleotide
tcttggcacgtgccatctgcctttctgttagtccatga

SEQ ID NO: 90704 - DNA, 38 bp, Artificial Sequence
  Synthetic oligonucleotide
aagctggggcaagtgggggagcggagaattgcggatga

SEQ ID NO: 90705 - DNA, 38 bp, Artificial Sequence
  Synthetic oligonucleotide
accgcggggataaaagaggaagggcaggcttgatatga

SEQ ID NO: 90706 - DNA, 38 bp, Artificial Sequence
  Synthetic oligonucleotide
gcatgcccaatacgccacgccaatgctcgtcattatga

SEQ ID NO: 90707 - DNA, 38 bp, Artificial Sequence
  Synthetic oligonucleotide
tgatggtcgacccgcattgcatccctggaacatactga

SEQ ID NO: 90708 - DNA, 37 bp, Artificial Sequence
  Synthetic oligonucleotide
acccgactgaaggtggaacgtctgacaccccccctga

SEQ ID NO: 90709 - DNA, 38 bp, Artificial Sequence
  Synthetic oligonucleotide
aagacggcgagttggggctgggcactggattgggctga

SEQ ID NO: 90710 - DNA, 37 bp, Artificial Sequence
  Synthetic oligonucleotide
gccactcgccaggttctagtctcgaaagcagctctga

SEQ ID NO: 90711 - DNA, 38 bp, Artificial Sequence
  Synthetic oligonucleotide
gtgtacgcaaaaggggttgataggattaaccggagtga

SEQ ID NO: 90712 - DNA, 38 bp, Artificial Sequence
  Synthetic oligonucleotide
gagggggtggagtgggatgtgaatggttaagaccgtga

SEQ ID NO: 90713 - DNA, 37 bp, Artificial Sequence
  Synthetic oligonucleotide
tgcgcattgtccaatcgcaacactccccctttcgtga

SEQ ID NO: 90714 - DNA, 38 bp, Artificial Sequence
  Synthetic oligonucleotide
ttagccaggagctgtggtcgagtgtagcgggggggtga

SEQ ID NO: 90715 - DNA, 38 bp, Artificial Sequence
  Synthetic oligonucleotide
atgtgcaaacgtatcggtggtacttcctgccttggtga

SEQ ID NO: 90716 - DNA, 38 bp, Artificial Sequence
  Synthetic oligonucleotide
ggggccgaaggttgaaatggggtagaggtcaggtgtga

SEQ ID NO: 90717 - DNA, 38 bp, Artificial Sequence
  Synthetic oligonucleotide
agtgcggacaatgattatgggggggaaaggggttgtga

SEQ ID NO: 90718 - DNA, 37 bp, Artificial Sequence
  Synthetic oligonucleotide
acgtaacaacttccccgcgtcctacatcaggcattga

SEQ ID NO: 90719 - DNA, 36 bp, Artificial Sequence
  Synthetic oligonucleotide
gacgccttcgcatcattccttcctgacgtgcattga

SEQ ID NO: 90720 - DNA, 38 bp, Artificial Sequence
  Synthetic oligonucleotide
ttgagcgaagggtgcaggcccgggttgacaatgattga

SEQ ID NO: 90721 - DNA, 35 bp, Artificial Sequence
  Synthetic oligonucleotide
atgccgtcaaccagttttgttccacatactattga

SEQ ID NO: 90722 - DNA, 37 bp, Artificial Sequence
  Synthetic oligonucleotide
accgcacgccgttgctgactccggaggagaaccttga

SEQ ID NO: 90723 - DNA, 38 bp, Artificial Sequence
  Synthetic oligonucleotide
gcgtaactgcacgaagctctttactccacagcccttga

SEQ ID NO: 90724 - DNA, 37 bp, Artificial Sequence
  Synthetic oligonucleotide
tcatcgacgaaagggggggtagtattaggcatgttga

SEQ ID NO: 90725 - DNA, 37 bp, Artificial Sequence
  Synthetic oligonucleotide
aacatcacgatcagcttgcttctgcctagttctttga

SEQ ID NO: 90726 - DNA, 35 bp, Artificial Sequence
  Synthetic oligonucleotide
ttgagcgcgctccacaccatctctgagtcgaaata

SEQ ID NO: 90727 - DNA, 35 bp, Artificial Sequence
  Synthetic oligonucleotide
gagcaaccacccatatgagatttaactcgcgaata

SEQ ID NO: 90728 - DNA, 36 bp, Artificial Sequence
  Synthetic oligonucleotide
gtagctgggtgagctctttttttacctgttgaccta

SEQ ID NO: 90729 - DNA, 36 bp, Artificial Sequence
  Synthetic oligonucleotide
tagcacctatgtctaaccctaaatgcctggtccgta

SEQ ID NO: 90730 - DNA, 36 bp, Artificial Sequence
  Synthetic oligonucleotide
agatcgcgctggatacaaaaggaacatttactggta

SEQ ID NO: 90731 - DNA, 36 bp, Artificial Sequence
  Synthetic oligonucleotide
acaccctcgacctgaagtttcgacgcgatgtactta

SEQ ID NO: 90732 - DNA, 35 bp, Artificial Sequence
  Synthetic oligonucleotide
gttacgtgacgtcttgtccttatctcgtttgttta

SEQ ID NO: 90733 - DNA, 34 bp, Artificial Sequence
  Synthetic oligonucleotide
acaaccggtaagcgaaacaccgtctcacgttcac

SEQ ID NO: 90734 - DNA, 35 bp, Artificial Sequence
  Synthetic oligonucleotide
gcacactggagattgcgctttttgggtggcccgac

SEQ ID NO: 90735 - DNA, 35 bp, Artificial Sequence
  Synthetic oligonucleotide
gacttccggcacgttaatctttacaccccgcgtac

SEQ ID NO: 90736 - DNA, 35 bp, Artificial Sequence
  Synthetic oligonucleotide
taccgaccctcgcgcccaaactatgtcacaacacc

SEQ ID NO: 90737 - DNA, 35 bp, Artificial Sequence
  Synthetic oligonucleotide
gtgccctgcacgcatgccgtagacccgttcccacc

SEQ ID NO: 90738 - DNA, 35 bp, Artificial Sequence
  Synthetic oligonucleotide
gcatacccacgccgttgcattcaccaggcgatacc

SEQ ID NO: 90739 - DNA, 35 bp, Artificial Sequence
  Synthetic oligonucleotide
taatgaaagcggaggagtggtgggcatctgttacc

SEQ ID NO: 90740 - DNA, 35 bp, Artificial Sequence
  Synthetic oligonucleotide
cgatccggcaggctccaaagtgcatgccatttgcc

SEQ ID NO: 90741 - DNA, 35 bp, Artificial Sequence
  Synthetic oligonucleotide
atccacgcgtggccgtagtgcccagtggcatatcc

SEQ ID NO: 90742 - DNA, 35 bp, Artificial Sequence
  Synthetic oligonucleotide
acccaagttcggtccctgccatggtcactctctgc

SEQ ID NO: 90743 - DNA, 35 bp, Artificial Sequence
  Synthetic oligonucleotide
gtccactgttagttcacgcgtaaacttgtctctgc

SEQ ID NO: 90744 - DNA, 35 bp, Artificial Sequence
  Synthetic oligonucleotide
tgaccatcgcgacgtacgcatccttaaatcagtgc

SEQ ID NO: 90745 - DNA, 35 bp, Artificial Sequence
  Synthetic oligonucleotide
ttagtgtgtgcagcatacacccatgacttccgtgc

SEQ ID NO: 90746 - DNA, 35 bp, Artificial Sequence
  Synthetic oligonucleotide
gtcggacagacccagcataccccgtaaaatacctc

SEQ ID NO: 90747 - DNA, 35 bp, Artificial Sequence
  Synthetic oligonucleotide
tgaggccctctggccgatgtaatttgtttattctc

SEQ ID NO: 90748 - DNA, 35 bp, Artificial Sequence
  Synthetic oligonucleotide
actgtccagggtcaacaaatcacctcatgcacgtc

SEQ ID NO: 90749 - DNA, 35 bp, Artificial Sequence
  Synthetic oligonucleotide
atgaagcggatgcgccattatactcccacgcggtc

SEQ ID NO: 90750 - DNA, 35 bp, Artificial Sequence
  Synthetic oligonucleotide
acccgctagagcatgacggctctcgaaaaaatttc

SEQ ID NO: 90751 - DNA, 35 bp, Artificial Sequence
  Synthetic oligonucleotide
attgcctgcctttccgttctgcatcttgcgcctag

SEQ ID NO: 90752 - DNA, 36 bp, Artificial Sequence
  Synthetic oligonucleotide
gaacgcgcatagaaaagaaagggcaaggatgagtag

SEQ ID NO: 90753 - DNA, 35 bp, Artificial Sequence
  Synthetic oligonucleotide
tcatccctgcccccctatccgtgacatccggcacg

SEQ ID NO: 90754 - DNA, 35 bp, Artificial Sequence
  Synthetic oligonucleotide
agatccgttagagcgcccgtcctcccttaatcacg

SEQ ID NO: 90755 - DNA, 35 bp, Artificial Sequence
  Synthetic oligonucleotide
tacaccaccaatcactgacagacagcagggcttcg

SEQ ID NO: 90756 - DNA, 35 bp, Artificial Sequence
  Synthetic oligonucleotide
tcatggacaaggtggagcagggattgtgaccaggg

SEQ ID NO: 90757 - DNA, 35 bp, Artificial Sequence
  Synthetic oligonucleotide
gataggagtgagtcgggacaggaaggcttcgcggg

SEQ ID NO: 90758 - DNA, 35 bp, Artificial Sequence
  Synthetic oligonucleotide
gacgatgagcagcagttttgagcggggtcttatgg

SEQ ID NO: 90759 - DNA, 35 bp, Artificial Sequence
  Synthetic oligonucleotide
atcccccgcctgatgaatcgagtgttcgtgttatg

SEQ ID NO: 90760 - DNA, 35 bp, Artificial Sequence
  Synthetic oligonucleotide
atgacatgcgcaaggggtgggtggagaacttggtg

SEQ ID NO: 90761 - DNA, 35 bp, Artificial Sequence
  Synthetic oligonucleotide
gcccacacgacgcatagtgccgggattctaccttg

SEQ ID NO: 90762 - DNA, 35 bp, Artificial Sequence
  Synthetic oligonucleotide
taagtacggatggtagatcaatgagaggggtgttg

SEQ ID NO: 90763 - DNA, 35 bp, Artificial Sequence
  Synthetic oligonucleotide
ttgctaccatgtgcgactcgcttctcgccccaact

SEQ ID NO: 90764 - DNA, 35 bp, Artificial Sequence
  Synthetic oligonucleotide
tggtcacctccgagaaacacgcttctattgcaact

SEQ ID NO: 90765 - DNA, 35 bp, Artificial Sequence
  Synthetic oligonucleotide
gccaccctaacagcgacctcattcaagtagccact

SEQ ID NO: 90766 - DNA, 35 bp, Artificial Sequence
  Synthetic oligonucleotide
gtgaaaccagcccacaaggtgctgcctacactact

SEQ ID NO: 90767 - DNA, 35 bp, Artificial Sequence
  Synthetic oligonucleotide
agtacagcatggtgagttccgctctcgacccgcct

SEQ ID NO: 90768 - DNA, 35 bp, Artificial Sequence
  Synthetic oligonucleotide
gacgcacttcgatcccgcgtgagtcattaacatct

SEQ ID NO: 90769 - DNA, 35 bp, Artificial Sequence
  Synthetic oligonucleotide
tccctgcccttgactttacagctttagacatatct

SEQ ID NO: 90770 - DNA, 35 bp, Artificial Sequence
  Synthetic oligonucleotide
ttgatatctgaaagggcccagacgaaccactctct

SEQ ID NO: 90771 - DNA, 35 bp, Artificial Sequence
  Synthetic oligonucleotide
acactcacattatatcgactggcacagatctctct

SEQ ID NO: 90772 - DNA, 35 bp, Artificial Sequence
  Synthetic oligonucleotide
gagcaagccaaagagtaaacagtcgggttaatagt

SEQ ID NO: 90773 - DNA, 35 bp, Artificial Sequence
  Synthetic oligonucleotide
tacaacccggtatggggtcaacttgccagaatggt

SEQ ID NO: 90774 - DNA, 35 bp, Artificial Sequence
  Synthetic oligonucleotide
aaaaccacacagactaggacatcggacagttatgt

SEQ ID NO: 90775 - DNA, 35 bp, Artificial Sequence
  Synthetic oligonucleotide
tacttgccgttttctgtcttttgcgatacctactt

SEQ ID NO: 90776 - DNA, 35 bp, Artificial Sequence
  Synthetic oligonucleotide
gagcccacaaatatatgaatgctacctggactctt

SEQ ID NO: 90777 - DNA, 35 bp, Artificial Sequence
  Synthetic oligonucleotide
gctgaggcactacccacaacataacatagtttgtt

SEQ ID NO: 90778 - DNA, 36 bp, Artificial Sequence
  Synthetic oligonucleotide
gactcagccatctggctgcactggccccaatccaaa

SEQ ID NO: 90779 - DNA, 36 bp, Artificial Sequence
  Synthetic oligonucleotide
tgtgacaaagggcacagtgtgacggaggagtggaaa

SEQ ID NO: 90780 - DNA, 35 bp, Artificial Sequence
  Synthetic oligonucleotide
gtacactcccgcctcgtatctccatgagcatacaa

SEQ ID NO: 90781 - DNA, 36 bp, Artificial Sequence
  Synthetic oligonucleotide
acactagcgcggacgtctcttgcggcccttaccgaa

SEQ ID NO: 90782 - DNA, 35 bp, Artificial Sequence
  Synthetic oligonucleotide
acccttacgtcaaactggtgttgccccatcgtgaa

SEQ ID NO: 90783 - DNA, 36 bp, Artificial Sequence
  Synthetic oligonucleotide
aactgcacgaacatatgtttccatcccccacacaca

SEQ ID NO: 90784 - DNA, 36 bp, Artificial Sequence
  Synthetic oligonucleotide
ttgggcgccggtgtacccatctatgttttgtccaca

SEQ ID NO: 90785 - DNA, 36 bp, Artificial Sequence
  Synthetic oligonucleotide
accaaaccgacacatggcactgcctgtgtacgccca

SEQ ID NO: 90786 - DNA, 36 bp, Artificial Sequence
  Synthetic oligonucleotide
gctagtgcagtcactgtcgccattcttctactccca

SEQ ID NO: 90787 - DNA, 36 bp, Artificial Sequence
  Synthetic oligonucleotide
aaacacgcgcctgcactcgatagggtgggtccgcca

SEQ ID NO: 90788 - DNA, 36 bp, Artificial Sequence
  Synthetic oligonucleotide
ttgccagctctacgcactattaatggccttcccgca

SEQ ID NO: 90789 - DNA, 36 bp, Artificial Sequence
  Synthetic oligonucleotide
atgagactgcaggcatgttgacggggtaagacggca

SEQ ID NO: 90790 - DNA, 36 bp, Artificial Sequence
  Synthetic oligonucleotide
gcacgccgggtatgggtaaaatggatagggggggca

SEQ ID NO: 90791 - DNA, 36 bp, Artificial Sequence
  Synthetic oligonucleotide
tatggaagacggagggtgggaagacctcaagtggca

SEQ ID NO: 90792 - DNA, 35 bp, Artificial Sequence
  Synthetic oligonucleotide
tatcacctgcgcgcactggcgtgtaacccgtatca

SEQ ID NO: 90793 - DNA, 36 bp, Artificial Sequence
  Synthetic oligonucleotide
attgccccctccgttgtgacacacctgctactctca

SEQ ID NO: 90794 - DNA, 35 bp, Artificial Sequence
  Synthetic oligonucleotide
gacgtagccggacgtctcctcgtttcttgagttca

SEQ ID NO: 90795 - DNA, 35 bp, Artificial Sequence
  Synthetic oligonucleotide
agccacctacagcaatgtctgccgccttgctttca

SEQ ID NO: 90796 - DNA, 36 bp, Artificial Sequence
  Synthetic oligonucleotide
gagccgaacagcatattgggaggaaaggatcggaga

SEQ ID NO: 90797 - DNA, 37 bp, Artificial Sequence
  Synthetic oligonucleotide
acagaacgagatgaagcagagaaaagtgtatgataga

SEQ ID NO: 90798 - DNA, 37 bp, Artificial Sequence
  Synthetic oligonucleotide
tccgccgttaagccctacgtacaacccacgtcctaga

SEQ ID NO: 90799 - DNA, 37 bp, Artificial Sequence
  Synthetic oligonucleotide
gcgataggccggaatggaggctaaatggtgtcgtaga

SEQ ID NO: 90800 - DNA, 36 bp, Artificial Sequence
  Synthetic oligonucleotide
gctgttgccccagataatttacgccacctgaaccga

SEQ ID NO: 90801 - DNA, 37 bp, Artificial Sequence
  Synthetic oligonucleotide
ttgtcccctcgaactgcgcgcctgacattctgaccga

SEQ ID NO: 90802 - DNA, 37 bp, Artificial Sequence
  Synthetic oligonucleotide
acgcaaacgccataccccttgtcacgcctgttagcga

SEQ ID NO: 90803 - DNA, 37 bp, Artificial Sequence
  Synthetic oligonucleotide
gtgccggaaaagggttgggcaagggcgggtagcgcga

SEQ ID NO: 90804 - DNA, 37 bp, Artificial Sequence
  Synthetic oligonucleotide
ggagtgccggggctgggaggggagtttgcgacatcga

SEQ ID NO: 90805 - DNA, 37 bp, Artificial Sequence
  Synthetic oligonucleotide
gatgggggtggtggtggtatgatggttgacgtttcga

SEQ ID NO: 90806 - DNA, 36 bp, Artificial Sequence
  Synthetic oligonucleotide
ttcgtcacgctccgtagcccacacttaccctcagga

SEQ ID NO: 90807 - DNA, 37 bp, Artificial Sequence
  Synthetic oligonucleotide
gacgacggtggaagctttccacagggagagacgagga

SEQ ID NO: 90808 - DNA, 37 bp, Artificial Sequence
  Synthetic oligonucleotide
tttggcccagcacactactctattgacacaagtagga

SEQ ID NO: 90809 - DNA, 37 bp, Artificial Sequence
  Synthetic oligonucleotide
acaatcccggcgttggtgaggcggtagagggtacgga

SEQ ID NO: 90810 - DNA, 37 bp, Artificial Sequence
  Synthetic oligonucleotide
atccagccgtattagctttaccactccgcctgaggga

SEQ ID NO: 90811 - DNA, 37 bp, Artificial Sequence
  Synthetic oligonucleotide
ttgagggcaccctcacctgactctagcctcgccggga

SEQ ID NO: 90812 - DNA, 37 bp, Artificial Sequence
  Synthetic oligonucleotide
acaagaggacacagggtgaagcgagtgtgggtcggga

SEQ ID NO: 90813 - DNA, 37 bp, Artificial Sequence
  Synthetic oligonucleotide
ttggggagggctatgggttcgtgcattcgttctggga

SEQ ID NO: 90814 - DNA, 37 bp, Artificial Sequence
  Synthetic oligonucleotide
atgggagcaattcaggggggggtaaccacacgtggga

SEQ ID NO: 90815 - DNA, 37 bp, Artificial Sequence
  Synthetic oligonucleotide
gtcttctgcctcgaatacttagtgcctatctcctgga

SEQ ID NO: 90816 - DNA, 37 bp, Artificial Sequence
  Synthetic oligonucleotide
tccacatcagtggtcgtcgattggaactctctctgga

SEQ ID NO: 90817 - DNA, 37 bp, Artificial Sequence
  Synthetic oligonucleotide
tgacgcccttgcgtcgcacaatcatactttacgtgga

SEQ ID NO: 90818 - DNA, 37 bp, Artificial Sequence
  Synthetic oligonucleotide
taccacgcagtggtgctaattgtctgatactcgtgga

SEQ ID NO: 90819 - DNA, 37 bp, Artificial Sequence
  Synthetic oligonucleotide
agcaagggaggacgggaaagttggctcgaacggtgga

SEQ ID NO: 90820 - DNA, 35 bp, Artificial Sequence
  Synthetic oligonucleotide
tcaccactcgacgcgctagttcctatatttaatga

SEQ ID NO: 90821 - DNA, 38 bp, Artificial Sequence
  Synthetic oligonucleotide
gacgcaggcaacgtgcaagttttcgtggggttacatga

SEQ ID NO: 90822 - DNA, 38 bp, Artificial Sequence
  Synthetic oligonucleotide
atccacgtccctcatcgtgatgacaccaccattcatga

SEQ ID NO: 90823 - DNA, 38 bp, Artificial Sequence
  Synthetic oligonucleotide
agtacgctgtcatggagcaggaccgggcaaggggatga

SEQ ID NO: 90824 - DNA, 38 bp, Artificial Sequence
  Synthetic oligonucleotide
tgacaaagctctatggtggtagaaggtggtttggatga

SEQ ID NO: 90825 - DNA, 38 bp, Artificial Sequence
  Synthetic oligonucleotide
taacgacacagaccgtttaaggtctagtagagatatga

SEQ ID NO: 90826 - DNA, 38 bp, Artificial Sequence
  Synthetic oligonucleotide
atcacaacctccgtatactttgcgtaatcagtcactga

SEQ ID NO: 90827 - DNA, 37 bp, Artificial Sequence
  Synthetic oligonucleotide
ggtacgttcgctgtaacgtgccccctttgtaacctga

SEQ ID NO: 90828 - DNA, 38 bp, Artificial Sequence
  Synthetic oligonucleotide
gacacgcaaaccgtccgcgatacagaatgttcccctga

SEQ ID NO: 90829 - DNA, 36 bp, Artificial Sequence
  Synthetic oligonucleotide
ttgtggcaagtagcacctcgatagctttcgccctga

SEQ ID NO: 90830 - DNA, 38 bp, Artificial Sequence
  Synthetic oligonucleotide
gcaccggcctgaatagccgacgcttgtccttaatctga

SEQ ID NO: 90831 - DNA, 37 bp, Artificial Sequence
  Synthetic oligonucleotide
tcacgccaggtcacttcataacatcaaccctgtctga

SEQ ID NO: 90832 - DNA, 38 bp, Artificial Sequence
  Synthetic oligonucleotide
gatgggacggtttgggaagaacgagccgtggacagtga

SEQ ID NO: 90833 - DNA, 38 bp, Artificial Sequence
  Synthetic oligonucleotide
atgcgccaaacgagaggctatcaaggcagttagagtga

SEQ ID NO: 90834 - DNA, 37 bp, Artificial Sequence
  Synthetic oligonucleotide
agtgggtgcgggtgctgagcccaaggtaggtgcgtga

SEQ ID NO: 90835 - DNA, 37 bp, Artificial Sequence
  Synthetic oligonucleotide
gttaccgtcaaagcctttgatcgcatttccttcgtga

SEQ ID NO: 90836 - DNA, 36 bp, Artificial Sequence
  Synthetic oligonucleotide
gttgcggccgggtggagtggagtggatggcgggtga

SEQ ID NO: 90837 - DNA, 37 bp, Artificial Sequence
  Synthetic oligonucleotide
atcacagtcgtaacattcgtcctgacgcggatggtga

SEQ ID NO: 90838 - DNA, 38 bp, Artificial Sequence
  Synthetic oligonucleotide
gacacgcggtgtgtaacacggactggttttagtggtga

SEQ ID NO: 90839 - DNA, 37 bp, Artificial Sequence
  Synthetic oligonucleotide
tccatcctcgatcttgtccaaagcttagcccatgtga

SEQ ID NO: 90840 - DNA, 37 bp, Artificial Sequence
  Synthetic oligonucleotide
tgacacgaagcaggcgaggtcaaaaattacagtgtga

SEQ ID NO: 90841 - DNA, 38 bp, Artificial Sequence
  Synthetic oligonucleotide
aagacaaggggcgttgaggtgacgtaacgtcaaattga

SEQ ID NO: 90842 - DNA, 35 bp, Artificial Sequence
  Synthetic oligonucleotide
aacactcctggagctgagaggcactcgctaattga

SEQ ID NO: 90843 - DNA, 38 bp, Artificial Sequence
  Synthetic oligonucleotide
atgcgctacccacctggcattcaagttaagcatattga

SEQ ID NO: 90844 - DNA, 38 bp, Artificial Sequence
  Synthetic oligonucleotide
tgacaacaacaggaaagggatggactgaccgatattga

SEQ ID NO: 90845 - DNA, 38 bp, Artificial Sequence
  Synthetic oligonucleotide
tcactgctgcacctcgtcacgcctgcctgttcacttga

SEQ ID NO: 90846 - DNA, 38 bp, Artificial Sequence
  Synthetic oligonucleotide
aaaacaacacgtgagagggagttcggggactgtgttga

SEQ ID NO: 90847 - DNA, 36 bp, Artificial Sequence
  Synthetic oligonucleotide
cccatgcactattcgtacggcgatgcctcactttga

SEQ ID NO: 90848 - DNA, 37 bp, Artificial Sequence
  Synthetic oligonucleotide
tacactgccctctatgtatcaggcgctgaacctttga

SEQ ID NO: 90849 - DNA, 35 bp, Artificial Sequence
  Synthetic oligonucleotide
tagacagccacagcctactttggctcatcttttga

SEQ ID NO: 90850 - DNA, 36 bp, Artificial Sequence
  Synthetic oligonucleotide
attgcccggcacgtgccctcagaatcgggaaaaata

SEQ ID NO: 90851 - DNA, 36 bp, Artificial Sequence
  Synthetic oligonucleotide
attggcggagggttcgttggtttgtgggggttaata

SEQ ID NO: 90852 - DNA, 36 bp, Artificial Sequence
  Synthetic oligonucleotide
taagacacgacgaacgtcacgaacacacggcccata

SEQ ID NO: 90853 - DNA, 36 bp, Artificial Sequence
  Synthetic oligonucleotide
gtggacggggggataaaacgggtatcggccatagta

SEQ ID NO: 90854 - DNA, 35 bp, Artificial Sequence
  Synthetic oligonucleotide
tgtctacacaccatcgcttacggttactagccgta

SEQ ID NO: 90855 - DNA, 36 bp, Artificial Sequence
  Synthetic oligonucleotide
tcgatccctcaggcgctatattaaacatcctcatta

SEQ ID NO: 90856 - DNA, 36 bp, Artificial Sequence
  Synthetic oligonucleotide
ttacgactcagaccgggctgctcgcccctctcctta

SEQ ID NO: 90857 - DNA, 36 bp, Artificial Sequence
  Synthetic oligonucleotide
aacgccacttgtgatatccttttatggccctcgtta

SEQ ID NO: 90858 - DNA, 35 bp, Artificial Sequence
  Synthetic oligonucleotide
agtaaccggcgcataaacgcagctttcttcattta

SEQ ID NO: 90859 - DNA, 36 bp, Artificial Sequence
  Synthetic oligonucleotide
ttgggccgccacgtccagatctatacaacctcttta

SEQ ID NO: 90860 - DNA, 36 bp, Artificial Sequence
  Synthetic oligonucleotide
ttcgtacactgcagttcctcgtggtccttcatttta

SEQ ID NO: 90861 - DNA, 36 bp, Artificial Sequence
  Synthetic oligonucleotide
agtaaactccacatcagtagtcgaccgccgctttta

SEQ ID NO: 90862 - DNA, 35 bp, Artificial Sequence
  Synthetic oligonucleotide
gccgactacatccgtggctcatctgtatcattaac

SEQ ID NO: 90863 - DNA, 35 bp, Artificial Sequence
  Synthetic oligonucleotide
gccactttcccatgcccttgctacagccacgacac

SEQ ID NO: 90864 - DNA, 35 bp, Artificial Sequence
  Synthetic oligonucleotide
tgttggtacactggttaccagtcataaattttcac

SEQ ID NO: 90865 - DNA, 35 bp, Artificial Sequence
  Synthetic oligonucleotide
gatcacaccgtgtttcggggagaacaaaaaccacc

SEQ ID NO: 90866 - DNA, 35 bp, Artificial Sequence
  Synthetic oligonucleotide
gaacatcgtgtcgggatgtcagacgtactctcccc

SEQ ID NO: 90867 - DNA, 35 bp, Artificial Sequence
  Synthetic oligonucleotide
gacaatgaccctctgacaagttgcaatgctagccc

SEQ ID NO: 90868 - DNA, 35 bp, Artificial Sequence
  Synthetic oligonucleotide
atccactcagctggtaataaccactacccggcgcc

SEQ ID NO: 90869 - DNA, 35 bp, Artificial Sequence
  Synthetic oligonucleotide
gtactgagcctgagcgcgttcacacacctggctcc

SEQ ID NO: 90870 - DNA, 35 bp, Artificial Sequence
  Synthetic oligonucleotide
accacatgagcaggaggggagtgcgaaccgtgtcc

SEQ ID NO: 90871 - DNA, 35 bp, Artificial Sequence
  Synthetic oligonucleotide
gctgaccgtgtcgcaacgaggtcacctaagtttcc

SEQ ID NO: 90872 - DNA, 35 bp, Artificial Sequence
  Synthetic oligonucleotide
agacccaattgcgtgtttttagtcccagtaccagc

SEQ ID NO: 90873 - DNA, 35 bp, Artificial Sequence
  Synthetic oligonucleotide
tgaatgcggaaggggtggggcgtgtactgtcttgc

SEQ ID NO: 90874 - DNA, 35 bp, Artificial Sequence
  Synthetic oligonucleotide
gattgacgcaaattaatgggccttagcgttccatc

SEQ ID NO: 90875 - DNA, 35 bp, Artificial Sequence
  Synthetic oligonucleotide
aaatgagagaagtcgagtcgaatgagaggggcgag

SEQ ID NO: 90876 - DNA, 35 bp, Artificial Sequence
  Synthetic oligonucleotide
tgatgcggagccgaaatttgcgcctgttaatcacg

SEQ ID NO: 90877 - DNA, 35 bp, Artificial Sequence
  Synthetic oligonucleotide
gacatgcagtcgttgtcgatcccctcggcatttcg

SEQ ID NO: 90878 - DNA, 35 bp, Artificial Sequence
  Synthetic oligonucleotide
aacgagtgctgtggtagaacgggcttgatggcagg

SEQ ID NO: 90879 - DNA, 35 bp, Artificial Sequence
  Synthetic oligonucleotide
ggaagaggaatgctgtggtggagcgagggggcggg

SEQ ID NO: 90880 - DNA, 35 bp, Artificial Sequence
  Synthetic oligonucleotide
tgtagcgcgcccatcctcgcactcgaacccattgg

SEQ ID NO: 90881 - DNA, 35 bp, Artificial Sequence
  Synthetic oligonucleotide
ggaatgggatctctggtacaatggggagggaaatg

SEQ ID NO: 90882 - DNA, 35 bp, Artificial Sequence
  Synthetic oligonucleotide
gaacgatcgatcgtgtagatatactgggtagactg

SEQ ID NO: 90883 - DNA, 35 bp, Artificial Sequence
  Synthetic oligonucleotide
atgactgctacacctccaacgagcgacggacacat

SEQ ID NO: 90884 - DNA, 35 bp, Artificial Sequence
  Synthetic oligonucleotide
atcatcctcgcactgcgatggtccgtacttgccat

SEQ ID NO: 90885 - DNA, 35 bp, Artificial Sequence
  Synthetic oligonucleotide
ttgcggtgccgcagctgttgtacctgcatcattat

SEQ ID NO: 90886 - DNA, 35 bp, Artificial Sequence
  Synthetic oligonucleotide
taccacaccaactgttgatgacatttgtatcttat

SEQ ID NO: 90887 - DNA, 35 bp, Artificial Sequence
  Synthetic oligonucleotide
acgaacagaggtaggaacggtggggaagcagcact

SEQ ID NO: 90888 - DNA, 35 bp, Artificial Sequence
  Synthetic oligonucleotide
agacagggtaacacccgtaggccatagctttatct

SEQ ID NO: 90889 - DNA, 35 bp, Artificial Sequence
  Synthetic oligonucleotide
gagacctctatgcaaccagacgcctcgattactct

SEQ ID NO: 90890 - DNA, 35 bp, Artificial Sequence
  Synthetic oligonucleotide
tacttgccggaacctgcagtttattcctcacttct

SEQ ID NO: 90891 - DNA, 35 bp, Artificial Sequence
  Synthetic oligonucleotide
ttgaccatcacatgcgaatgcccctcactcgatgt

SEQ ID NO: 90892 - DNA, 35 bp, Artificial Sequence
  Synthetic oligonucleotide
tcaagacgaactggctctgaccctaccttctatgt

SEQ ID NO: 90893 - DNA, 35 bp, Artificial Sequence
  Synthetic oligonucleotide
gccatgcctcacgcgtatgtttaaatttatactgt

SEQ ID NO: 90894 - DNA, 35 bp, Artificial Sequence
  Synthetic oligonucleotide
tgaacgaacgaccctgaaactccagcctagtcctt

SEQ ID NO: 90895 - DNA, 35 bp, Artificial Sequence
  Synthetic oligonucleotide
gacacaaccgccactttgcgctccaacttgagctt

SEQ ID NO: 90896 - DNA, 35 bp, Artificial Sequence
  Synthetic oligonucleotide
gtgaggcgcaaacaacacacatagatggaggtctt

SEQ ID NO: 90897 - DNA, 35 bp, Artificial Sequence
  Synthetic oligonucleotide
ttcaccttcctgcgaacttgggaagacacatagtt

SEQ ID NO: 90898 - DNA, 35 bp, Artificial Sequence
  Synthetic oligonucleotide
tacgcccaatggatccgatatctgcgagctacttt

SEQ ID NO: 90899 - DNA, 37 bp, Artificial Sequence
  Synthetic oligonucleotide
ttgccaccaggtcattgtaactcgggttagtggcaaa

SEQ ID NO: 90900 - DNA, 36 bp, Artificial Sequence
  Synthetic oligonucleotide
aagccatgggggcgagtaggaaattttgagcaccaa

SEQ ID NO: 90901 - DNA, 36 bp, Artificial Sequence
  Synthetic oligonucleotide
acgcccctccgaagcctcacatcgccagcctaggaa

SEQ ID NO: 90902 - DNA, 36 bp, Artificial Sequence
  Synthetic oligonucleotide
ggaaggggagctatgggcgactgaatagggggtgaa

SEQ ID NO: 90903 - DNA, 35 bp, Artificial Sequence
  Synthetic oligonucleotide
gaacacccgtaaatgatatcgcccgtgtaacataa

SEQ ID NO: 90904 - DNA, 36 bp, Artificial Sequence
  Synthetic oligonucleotide
gcacccctcccgtcgattgacatccattttcagtaa

SEQ ID NO: 90905 - DNA, 36 bp, Artificial Sequence
  Synthetic oligonucleotide
gcaaagcactggcaagacctggcccaacggagttaa

SEQ ID NO: 90906 - DNA, 36 bp, Artificial Sequence
  Synthetic oligonucleotide
ggtcaccgggcagactaccgatgtcctgatccacca

SEQ ID NO: 90907 - DNA, 35 bp, Artificial Sequence
  Synthetic oligonucleotide
aacgtccccaaccggcaaacatttagtgatcacca

SEQ ID NO: 90908 - DNA, 35 bp, Artificial Sequence
  Synthetic oligonucleotide
ggactgaggggcaagggaaagcatggtcatcgcca

SEQ ID NO: 90909 - DNA, 36 bp, Artificial Sequence
  Synthetic oligonucleotide
actatgcatcgcatatggcattcggttcccactcca

SEQ ID NO: 90910 - DNA, 36 bp, Artificial Sequence
  Synthetic oligonucleotide
tgcgggtaggcgcttcttggagggggaaatgaggca

SEQ ID NO: 90911 - DNA, 36 bp, Artificial Sequence
  Synthetic oligonucleotide
gacacccatccatactgttaatggtcaattacatca

SEQ ID NO: 90912 - DNA, 36 bp, Artificial Sequence
  Synthetic oligonucleotide
agtgcgcatcagtgacacagcgctgttacatgttca

SEQ ID NO: 90913 - DNA, 37 bp, Artificial Sequence
  Synthetic oligonucleotide
gtcaccacacgtaagtgtcagcatctacgctccgaga

SEQ ID NO: 90914 - DNA, 36 bp, Artificial Sequence
  Synthetic oligonucleotide
gaatgggttaggtgaaaggcggagttcatagcgaga

SEQ ID NO: 90915 - DNA, 37 bp, Artificial Sequence
  Synthetic oligonucleotide
gaccaaagcagcctcttcccgttccagacctcataga

SEQ ID NO: 90916 - DNA, 37 bp, Artificial Sequence
  Synthetic oligonucleotide
gcgggtggagagggtgtgtatttatgggatatctaga

SEQ ID NO: 90917 - DNA, 37 bp, Artificial Sequence
  Synthetic oligonucleotide
ggtacaatggggcgaggaaaaggaaagaaccggtaga

SEQ ID NO: 90918 - DNA, 37 bp, Artificial Sequence
  Synthetic oligonucleotide
gaacaagtgcagggaatggacagtaatacgtattaga

SEQ ID NO: 90919 - DNA, 35 bp, Artificial Sequence
  Synthetic oligonucleotide
tcttggtcccatacttttcaccgtgacagcaccga

SEQ ID NO: 90920 - DNA, 37 bp, Artificial Sequence
  Synthetic oligonucleotide
tttgccaagcccatggcaagataccgatttcctccga

SEQ ID NO: 90921 - DNA, 37 bp, Artificial Sequence
  Synthetic oligonucleotide
gaacgtgaatgctgggaagaaaggggaaactgcgcga

SEQ ID NO: 90922 - DNA, 37 bp, Artificial Sequence
  Synthetic oligonucleotide
ggttcacgacagcttcttactcactggacctttgcga

SEQ ID NO: 90923 - DNA, 37 bp, Artificial Sequence
  Synthetic oligonucleotide
tacacggctatggtggactcatctcttcttcactcga

SEQ ID NO: 90924 - DNA, 37 bp, Artificial Sequence
  Synthetic oligonucleotide
gttcgtcgaggaacacatggtcagatcctgctctcga

SEQ ID NO: 90925 - DNA, 37 bp, Artificial Sequence
  Synthetic oligonucleotide
tcgttccccacagccagtgattacaccctcatgtcga

SEQ ID NO: 90926 - DNA, 37 bp, Artificial Sequence
  Synthetic oligonucleotide
tgggaggtggggtgaaaggtacagatggtcagttcga

SEQ ID NO: 90927 - DNA, 37 bp, Artificial Sequence
  Synthetic oligonucleotide
gacttcgtacaggagacgtaacagggggtcataagga

SEQ ID NO: 90928 - DNA, 37 bp, Artificial Sequence
  Synthetic oligonucleotide
gccacacccaaaagagctagtccgatggcggggagga

SEQ ID NO: 90929 - DNA, 37 bp, Artificial Sequence
  Synthetic oligonucleotide
gaggtgtaggaatggggccttagggaccaggttagga

SEQ ID NO: 90930 - DNA, 36 bp, Artificial Sequence
  Synthetic oligonucleotide
gtttagacgggtgaggttgggaaggcaaggcacgga

SEQ ID NO: 90931 - DNA, 37 bp, Artificial Sequence
  Synthetic oligonucleotide
tccgccccacgtttgcgttgttaccgtctccttcgga

SEQ ID NO: 90932 - DNA, 37 bp, Artificial Sequence
  Synthetic oligonucleotide
tgtgggaattgcgtgggcggaagcgggaccgaatgga

SEQ ID NO: 90933 - DNA, 37 bp, Artificial Sequence
  Synthetic oligonucleotide
accacagtacgcagagtctcaaatagttgcttctgga

SEQ ID NO: 90934 - DNA, 37 bp, Artificial Sequence
  Synthetic oligonucleotide
gttctccgccgttcattccgctcacatcctgtgtgga

SEQ ID NO: 90935 - DNA, 37 bp, Artificial Sequence
  Synthetic oligonucleotide
ggacccggggcgctgctattctggtacgtaacttgga

SEQ ID NO: 90936 - DNA, 37 bp, Artificial Sequence
  Synthetic oligonucleotide
tcgagaggcggactggaggggttcttggttagttgga

SEQ ID NO: 90937 - DNA, 38 bp, Artificial Sequence
  Synthetic oligonucleotide
actagattccaggcctgaacaagaccctgcccccatga

SEQ ID NO: 90938 - DNA, 38 bp, Artificial Sequence
  Synthetic oligonucleotide
atcaccgcactggcacctagactgccatatcacgatga

SEQ ID NO: 90939 - DNA, 38 bp, Artificial Sequence
  Synthetic oligonucleotide
tcaaccgacagtgtgatttctcctaagctctccgatga

SEQ ID NO: 90940 - DNA, 38 bp, Artificial Sequence
  Synthetic oligonucleotide
ggaggcacgtttgaggaggaacgggaaggtgaggatga

SEQ ID NO: 90941 - DNA, 38 bp, Artificial Sequence
  Synthetic oligonucleotide
gtgagacgcggtgtgtggtattgttacagaagatatga

SEQ ID NO: 90942 - DNA, 38 bp, Artificial Sequence
  Synthetic oligonucleotide
tcttgagcatggacgatgcgtttcctgcctcactatga

SEQ ID NO: 90943 - DNA, 38 bp, Artificial Sequence
  Synthetic oligonucleotide
gacaacgaggttctatcattgcatccaccattctatga

SEQ ID NO: 90944 - DNA, 37 bp, Artificial Sequence
  Synthetic oligonucleotide
taacgagaacacaaaagagggcaacagtgatgactga

SEQ ID NO: 90945 - DNA, 38 bp, Artificial Sequence
  Synthetic oligonucleotide
gaccatgacagatgcctgacccccaatggacgacctga

SEQ ID NO: 90946 - DNA, 37 bp, Artificial Sequence
  Synthetic oligonucleotide
gacacccgaacagttaggcgaagctgcaaaaagctga

SEQ ID NO: 90947 - DNA, 38 bp, Artificial Sequence
  Synthetic oligonucleotide
tacgcctcaattggcgcaacctcttcttcccaaagtga

SEQ ID NO: 90948 - DNA, 37 bp, Artificial Sequence
  Synthetic oligonucleotide
tcgcacatttagttttgtaactcgcctgcacccgtga

SEQ ID NO: 90949 - DNA, 38 bp, Artificial Sequence
  Synthetic oligonucleotide
accaggcaccactggccgttctcagattccattcgtga

SEQ ID NO: 90950 - DNA, 38 bp, Artificial Sequence
  Synthetic oligonucleotide
gccacgccgtcattcactagctactttcccgtctgtga

SEQ ID NO: 90951 - DNA, 38 bp, Artificial Sequence
  Synthetic oligonucleotide
gagccggggggagcggagggggatagcccattctgtga

SEQ ID NO: 90952 - DNA, 36 bp, Artificial Sequence
  Synthetic oligonucleotide
tactctccgacgcacacttatcccgcagtgcattga

SEQ ID NO: 90953 - DNA, 38 bp, Artificial Sequence
  Synthetic oligonucleotide
gtgtgctgcccgccattcccttcataagcgcaacttga

SEQ ID NO: 90954 - DNA, 37 bp, Artificial Sequence
  Synthetic oligonucleotide
gacacatcctggaattctgagctatctaacgacttga

SEQ ID NO: 90955 - DNA, 38 bp, Artificial Sequence
  Synthetic oligonucleotide
gagcagaactaaacgtggtggggagtggacggacttga

SEQ ID NO: 90956 - DNA, 37 bp, Artificial Sequence
  Synthetic oligonucleotide
tagtccgcccgtccttactcgtctttggcttccttga

SEQ ID NO: 90957 - DNA, 36 bp, Artificial Sequence
  Synthetic oligonucleotide
ttcgccgcaccccatagcatgaatatcgccgtacta

SEQ ID NO: 90958 - DNA, 36 bp, Artificial Sequence
  Synthetic oligonucleotide
gacccgccgcccccgcttttgccgtcctcatggcta

SEQ ID NO: 90959 - DNA, 36 bp, Artificial Sequence
  Synthetic oligonucleotide
tccatcattccccgccatcatgttcacgtggtgcta

SEQ ID NO: 90960 - DNA, 33 bp, Artificial Sequence
  Synthetic oligonucleotide
atcgccgatccgaaccctaaattgtaatatcta

SEQ ID NO: 90961 - DNA, 29 bp, Artificial Sequence
  Synthetic oligonucleotide
gtccgcaccgtacaccctttgccaaagta

SEQ ID NO: 90962 - DNA, 36 bp, Artificial Sequence
  Synthetic oligonucleotide
gtgccgtccgttgcatcacctcctgtaagttccgta

SEQ ID NO: 90963 - DNA, 36 bp, Artificial Sequence
  Synthetic oligonucleotide
agacaccgcctgccgtcaccactgacaggaattgta

SEQ ID NO: 90964 - DNA, 36 bp, Artificial Sequence
  Synthetic oligonucleotide
atccgatcccggaggtagttaagggggggggcatta

SEQ ID NO: 90965 - DNA, 35 bp, Artificial Sequence
  Synthetic oligonucleotide
gtcgccgccgcacatgtacacaccgctccaaaaac

SEQ ID NO: 90966 - DNA, 35 bp, Artificial Sequence
  Synthetic oligonucleotide
acgacacgccgtaggccttactaggtctgcccaac

SEQ ID NO: 90967 - DNA, 35 bp, Artificial Sequence
  Synthetic oligonucleotide
gcgtcacacgctcgatctttttgtgccattgcaac

SEQ ID NO: 90968 - DNA, 35 bp, Artificial Sequence
  Synthetic oligonucleotide
ggaggagggagcaaagcaaataggctaagtggaac

SEQ ID NO: 90969 - DNA, 35 bp, Artificial Sequence
  Synthetic oligonucleotide
gccctctgcccccatcagttttaatgctatttcac

SEQ ID NO: 90970 - DNA, 35 bp, Artificial Sequence
  Synthetic oligonucleotide
tagcaattcatccacacacctcgcattcgcgggac

SEQ ID NO: 90971 - DNA, 35 bp, Artificial Sequence
  Synthetic oligonucleotide
actcgagggtcaacgaacgcacacacgcctgggac

SEQ ID NO: 90972 - DNA, 35 bp, Artificial Sequence
  Synthetic oligonucleotide
gcctgccaagcccctgttttggtgacccgctgacc

SEQ ID NO: 90973 - DNA, 35 bp, Artificial Sequence
  Synthetic oligonucleotide
acgcgcccacacctcttgcctgggagcctgttccc

SEQ ID NO: 90974 - DNA, 35 bp, Artificial Sequence
  Synthetic oligonucleotide
tccgtcatggctcgcctcggtaaggtccgacttcc

SEQ ID NO: 90975 - DNA, 35 bp, Artificial Sequence
  Synthetic oligonucleotide
ttgctactccagtgggattgttccctcctatccgc

SEQ ID NO: 90976 - DNA, 35 bp, Artificial Sequence
  Synthetic oligonucleotide
tagtacgctcaggacatcttcgtcgcagtttgatc

SEQ ID NO: 90977 - DNA, 35 bp, Artificial Sequence
  Synthetic oligonucleotide
tacccacgcaccgccgccacatgagctacactatc

SEQ ID NO: 90978 - DNA, 35 bp, Artificial Sequence
  Synthetic oligonucleotide
aaagtggctccgggggggataatgattggggtgtc

SEQ ID NO: 90979 - DNA, 35 bp, Artificial Sequence
  Synthetic oligonucleotide
tccacgaccggtacacgcccaccgatctgtttttc

SEQ ID NO: 90980 - DNA, 35 bp, Artificial Sequence
  Synthetic oligonucleotide
actggacgggggggtgtatgcagtaacaagtaaag

SEQ ID NO: 90981 - DNA, 35 bp, Artificial Sequence
  Synthetic oligonucleotide
ggtgagggaactgcgaggggcggaaagacatgtag

SEQ ID NO: 90982 - DNA, 35 bp, Artificial Sequence
  Synthetic oligonucleotide
gtagtggggaggcgttggaggtcctagcgagttag

SEQ ID NO: 90983 - DNA, 35 bp, Artificial Sequence
  Synthetic oligonucleotide
gtggtagcacacctatggcaacatcctgcactccg

SEQ ID NO: 90984 - DNA, 35 bp, Artificial Sequence
  Synthetic oligonucleotide
gatgggcacatgtgtctgacccctgctgtacctcg

SEQ ID NO: 90985 - DNA, 35 bp, Artificial Sequence
  Synthetic oligonucleotide
actcagtcagatcctttcacccgattcccgcaggg

SEQ ID NO: 90986 - DNA, 35 bp, Artificial Sequence
  Synthetic oligonucleotide
tagaccgacggtcgtgagggagggctacgagtggg

SEQ ID NO: 90987 - DNA, 35 bp, Artificial Sequence
  Synthetic oligonucleotide
gaccactaccccggcatttttcaactcggcattgg

SEQ ID NO: 90988 - DNA, 35 bp, Artificial Sequence
  Synthetic oligonucleotide
gatcgcaccgcgacctactaccattttcggccatg

SEQ ID NO: 90989 - DNA, 35 bp, Artificial Sequence
  Synthetic oligonucleotide
agaccaacatccccacgccggactctcgctccaat

SEQ ID NO: 90990 - DNA, 35 bp, Artificial Sequence
  Synthetic oligonucleotide
acacctcaatctagattgcgtgattattattccat

SEQ ID NO: 90991 - DNA, 35 bp, Artificial Sequence
  Synthetic oligonucleotide
gcaacccggtattttgcatacgattggcatttcat

SEQ ID NO: 90992 - DNA, 35 bp, Artificial Sequence
  Synthetic oligonucleotide
gtgtcatcccacaagtttcgtctctacgcgccgat

SEQ ID NO: 90993 - DNA, 29 bp, Artificial Sequence
  Synthetic oligonucleotide
cacaatgactgggacaacactgcccttat

SEQ ID NO: 90994 - DNA, 36 bp, Artificial Sequence
  Synthetic oligonucleotide
gtacaattcggtccaacgcaaagggaccaacgaact

SEQ ID NO: 90995 - DNA, 35 bp, Artificial Sequence
  Synthetic oligonucleotide
atgcggggggcggagtgagtggcagccttgtaact

SEQ ID NO: 90996 - DNA, 35 bp, Artificial Sequence
  Synthetic oligonucleotide
gatgctcgctacattgtccaacgcgataccaccct

SEQ ID NO: 90997 - DNA, 35 bp, Artificial Sequence
  Synthetic oligonucleotide
ggaccagaaatctgctgcagttattcgcgcaccct

SEQ ID NO: 90998 - DNA, 35 bp, Artificial Sequence
  Synthetic oligonucleotide
acgttgaagccgatcggtaaggcccttcgtctcct

SEQ ID NO: 90999 - DNA, 35 bp, Artificial Sequence
  Synthetic oligonucleotide
ttcgggacgactgcgaccataccagaaacttctct

SEQ ID NO: 91000 - DNA, 35 bp, Artificial Sequence
  Synthetic oligonucleotide
taactggtacaggaatgggtgtggtgtaggggtgt

SEQ ID NO: 91001 - DNA, 33 bp, Artificial Sequence
  Synthetic oligonucleotide
ttcgacgacgacttcgttctattcccactttgt

SEQ ID NO: 91002 - DNA, 35 bp, Artificial Sequence
  Synthetic oligonucleotide
tgccccggggtgcctatacattgctccatcttatt

SEQ ID NO: 91003 - DNA, 35 bp, Artificial Sequence
  Synthetic oligonucleotide
tctctgggcccggagcaatcctgagctttcacctt

SEQ ID NO: 91004 - DNA, 35 bp, Artificial Sequence
  Synthetic oligonucleotide
tacgcaggtgggtagttctgtaaatcgtgcgcctt

SEQ ID NO: 91005 - DNA, 36 bp, Artificial Sequence
  Synthetic oligonucleotide
tacccgaacgcccactgcattccaatcagttgaaaa

SEQ ID NO: 91006 - DNA, 35 bp, Artificial Sequence
  Synthetic oligonucleotide
tgtataacaccctagcgcgcagaccgcgataccaa

SEQ ID NO: 91007 - DNA, 36 bp, Artificial Sequence
  Synthetic oligonucleotide
gtgagaagggggtagggtagtgcgcgtggcatgcaa

SEQ ID NO: 91008 - DNA, 37 bp, Artificial Sequence
  Synthetic oligonucleotide
gactgcatcctacacggttgtagcctatatcttcgaa

SEQ ID NO: 91009 - DNA, 36 bp, Artificial Sequence
  Synthetic oligonucleotide
gacgcggagagggcgggaagggggaagggggtggaa

SEQ ID NO: 91010 - DNA, 36 bp, Artificial Sequence
  Synthetic oligonucleotide
aggacactagtggggaaggtgaaaggcatgagtgaa

SEQ ID NO: 91011 - DNA, 36 bp, Artificial Sequence
  Synthetic oligonucleotide
tgaggggaagtggaagaccgtatgtggtgtgtctaa

SEQ ID NO: 91012 - DNA, 36 bp, Artificial Sequence
  Synthetic oligonucleotide
gtgaccatcctgttgacattaagttttcctatgtaa

SEQ ID NO: 91013 - DNA, 36 bp, Artificial Sequence
  Synthetic oligonucleotide
acccccgatgcccctgcacgtgatattccggtgtaa

SEQ ID NO: 91014 - DNA, 36 bp, Artificial Sequence
  Synthetic oligonucleotide
ttgccacgaacagtctgcctgcttctctaccaaaca

SEQ ID NO: 91015 - DNA, 36 bp, Artificial Sequence
  Synthetic oligonucleotide
agtggcataggctaggtcaaacgttcacacctcaca

SEQ ID NO: 91016 - DNA, 36 bp, Artificial Sequence
  Synthetic oligonucleotide
acaccacctgccttgccaagttagttcccgaagaca

SEQ ID NO: 91017 - DNA, 36 bp, Artificial Sequence
  Synthetic oligonucleotide
gaaaaggagggtggttcagcgcggttaggggataca

SEQ ID NO: 91018 - DNA, 36 bp, Artificial Sequence
  Synthetic oligonucleotide
tcagtccgcccctctcttgtccatcgttggacacca

SEQ ID NO: 91019 - DNA, 35 bp, Artificial Sequence
  Synthetic oligonucleotide
gcccggtgcaacccgctgatccatccgtcctacca

SEQ ID NO: 91020 - DNA, 36 bp, Artificial Sequence
  Synthetic oligonucleotide
gaatagcgcattccgtccgatccggaaaccacgcca

SEQ ID NO: 91021 - DNA, 36 bp, Artificial Sequence
  Synthetic oligonucleotide
agatcctcatcacccatggcctatacgtgtgggcca

SEQ ID NO: 91022 - DNA, 36 bp, Artificial Sequence
  Synthetic oligonucleotide
tactgtggccgcttagtagctctgttgcctcctcca

SEQ ID NO: 91023 - DNA, 35 bp, Artificial Sequence
  Synthetic oligonucleotide
tctgcacgcctcccaggcatccctcactgcttcca

SEQ ID NO: 91024 - DNA, 36 bp, Artificial Sequence
  Synthetic oligonucleotide
aacgatgtggatcgccatgtaggccaagctgttcca

SEQ ID NO: 91025 - DNA, 36 bp, Artificial Sequence
  Synthetic oligonucleotide
aaggacaacaccgcaagcatgtaatcaccaattgca

SEQ ID NO: 91026 - DNA, 36 bp, Artificial Sequence
  Synthetic oligonucleotide
gagcccactctatgccattatacagttcactttgca

SEQ ID NO: 91027 - DNA, 35 bp, Artificial Sequence
  Synthetic oligonucleotide
tcaatgcacgcgcatgttaacccgattagtcatca

SEQ ID NO: 91028 - DNA, 36 bp, Artificial Sequence
  Synthetic oligonucleotide
tacccacccgtccgctttacccccccgtccagttca

SEQ ID NO: 91029 - DNA, 37 bp, Artificial Sequence
  Synthetic oligonucleotide
gtgggcaatatggttggaaggggtggacgctaaaaga

SEQ ID NO: 91030 - DNA, 37 bp, Artificial Sequence
  Synthetic oligonucleotide
acttgaatcgccattgccttacgctctgacaacgaga

SEQ ID NO: 91031 - DNA, 37 bp, Artificial Sequence
  Synthetic oligonucleotide
gtgggcggtgggctgggtaccgggtcagggtgggaga

SEQ ID NO: 91032 - DNA, 35 bp, Artificial Sequence
  Synthetic oligonucleotide
gacgaaggataagggttgtagggggggaggtgaga

SEQ ID NO: 91033 - DNA, 37 bp, Artificial Sequence
  Synthetic oligonucleotide
accgcaccaagcctctcatcctcaggacacaggacga

SEQ ID NO: 91034 - DNA, 37 bp, Artificial Sequence
  Synthetic oligonucleotide
acctcacctgcctcacatccggtgccatatatgacga

SEQ ID NO: 91035 - DNA, 37 bp, Artificial Sequence
  Synthetic oligonucleotide
tcctagggagcagtcgcgtctgatcgccttcccccga

SEQ ID NO: 91036 - DNA, 37 bp, Artificial Sequence
  Synthetic oligonucleotide
ggacaccgggatggaccctctcgaccgaaaactccga

SEQ ID NO: 91037 - DNA, 37 bp, Artificial Sequence
  Synthetic oligonucleotide
gacatggagacattgggggtgaaatgcggctcaagga

SEQ ID NO: 91038 - DNA, 37 bp, Artificial Sequence
  Synthetic oligonucleotide
gcgcgatgttgaagggatggaacaggcggagatagga

SEQ ID NO: 91039 - DNA, 37 bp, Artificial Sequence
  Synthetic oligonucleotide
aatgcgggaggaggcaaatcggggaatgatcctagga

SEQ ID NO: 91040 - DNA, 37 bp, Artificial Sequence
  Synthetic oligonucleotide
gccctaacaaaggtggtctggaagctgccatcccgga

SEQ ID NO: 91041 - DNA, 37 bp, Artificial Sequence
  Synthetic oligonucleotide
accgtgcctgactacacaagctatctatccagccgga

SEQ ID NO: 91042 - DNA, 37 bp, Artificial Sequence
  Synthetic oligonucleotide
ggaccaaaattagccgactttacagcagtcactcgga

SEQ ID NO: 91043 - DNA, 37 bp, Artificial Sequence
  Synthetic oligonucleotide
accaacgaaaagtggcgcaaggtgcgggccgaaggga

SEQ ID NO: 91044 - DNA, 37 bp, Artificial Sequence
  Synthetic oligonucleotide
atgataggccggagacgagagagggatatgctaggga

SEQ ID NO: 91045 - DNA, 37 bp, Artificial Sequence
  Synthetic oligonucleotide
gcaggaataggggttgagctgctcaacagggtgggga

SEQ ID NO: 91046 - DNA, 37 bp, Artificial Sequence
  Synthetic oligonucleotide
ttgtcccccccattaggaggaaagcacattcctggga

SEQ ID NO: 91047 - DNA, 37 bp, Artificial Sequence
  Synthetic oligonucleotide
gacctatcccgctgtgtttctgcgtacccactatgga

SEQ ID NO: 91048 - DNA, 34 bp, Artificial Sequence
  Synthetic oligonucleotide
aagaggtacagtggagaaaagggaggatactgga

SEQ ID NO: 91049 - DNA, 36 bp, Artificial Sequence
  Synthetic oligonucleotide
acgacagtcccagaaccacattacctagacattgga

SEQ ID NO: 91050 - DNA, 37 bp, Artificial Sequence
  Synthetic oligonucleotide
agtcaagcgagtggggaacttgaggagattggaatga

SEQ ID NO: 91051 - DNA, 37 bp, Artificial Sequence
  Synthetic oligonucleotide
gtgccccaccgccacctgcgttttcgggccaccatga

SEQ ID NO: 91052 - DNA, 38 bp, Artificial Sequence
  Synthetic oligonucleotide
gtccgtcaggggcccacgacccagcctctcacccatga

SEQ ID NO: 91053 - DNA, 38 bp, Artificial Sequence
  Synthetic oligonucleotide
tgaggggggaggcagaggccggtcaggagggtcgatga

SEQ ID NO: 91054 - DNA, 38 bp, Artificial Sequence
  Synthetic oligonucleotide
gtgggggcggggttggggctgagaaagaatgaggatga

SEQ ID NO: 91055 - DNA, 37 bp, Artificial Sequence
  Synthetic oligonucleotide
tcacgggtgcggagaaatgggagtaggtgatggatga

SEQ ID NO: 91056 - DNA, 36 bp, Artificial Sequence
  Synthetic oligonucleotide
tcatcgggtagagccgtggggaagtgaaagatatga

SEQ ID NO: 91057 - DNA, 38 bp, Artificial Sequence
  Synthetic oligonucleotide
atatgcaaggtgaaggagtggacaggggagcagtatga

SEQ ID NO: 91058 - DNA, 37 bp, Artificial Sequence
  Synthetic oligonucleotide
tacatcctcggtgaataactgcacttgctatcactga

SEQ ID NO: 91059 - DNA, 37 bp, Artificial Sequence
  Synthetic oligonucleotide
gttgcatcaaccaattgtcttaggtcctgaaccctga

SEQ ID NO: 91060 - DNA, 38 bp, Artificial Sequence
  Synthetic oligonucleotide
tactacgttagcggcgttctcctggcacaatctcctga

SEQ ID NO: 91061 - DNA, 38 bp, Artificial Sequence
  Synthetic oligonucleotide
tgagcgggcgagagcggcaaggaggagggggtatctga

SEQ ID NO: 91062 - DNA, 37 bp, Artificial Sequence
  Synthetic oligonucleotide
atcgccactacccagacgagtctcactgcgaacgtga

SEQ ID NO: 91063 - DNA, 38 bp, Artificial Sequence
  Synthetic oligonucleotide
gatgtaccgcacaactggtgcacacctatgttccgtga

SEQ ID NO: 91064 - DNA, 38 bp, Artificial Sequence
  Synthetic oligonucleotide
aagtgcgggggtggttggcgggctgaggttctgcgtga

SEQ ID NO: 91065 - DNA, 38 bp, Artificial Sequence
  Synthetic oligonucleotide
tccccacatcccgcccggttcgaactgttacttcgtga

SEQ ID NO: 91066 - DNA, 37 bp, Artificial Sequence
  Synthetic oligonucleotide
tgtgaccagcccatctcttacctgtgtttcactgtga

SEQ ID NO: 91067 - DNA, 38 bp, Artificial Sequence
  Synthetic oligonucleotide
tgagaggggcatgtaattggaaggtgacccatctgtga

SEQ ID NO: 91068 - DNA, 38 bp, Artificial Sequence
  Synthetic oligonucleotide
gacacgccgggccggttctacagtgagtctaccattga

SEQ ID NO: 91069 - DNA, 37 bp, Artificial Sequence
  Synthetic oligonucleotide
tctgcaaacgccgctgccgctataactgccctattga

SEQ ID NO: 91070 - DNA, 37 bp, Artificial Sequence
  Synthetic oligonucleotide
atcacaggtcgactcacgatggtattcccgcacttga

SEQ ID NO: 91071 - DNA, 38 bp, Artificial Sequence
  Synthetic oligonucleotide
gtaaccttccggtatcgctactacacctactcagttga

SEQ ID NO: 91072 - DNA, 37 bp, Artificial Sequence
  Synthetic oligonucleotide
accgatcgtgcgcctgttccatccaccgacccgttga

SEQ ID NO: 91073 - DNA, 38 bp, Artificial Sequence
  Synthetic oligonucleotide
gcacatacccgtgcgaactaacgagtgaacatcgttga

SEQ ID NO: 91074 - DNA, 35 bp, Artificial Sequence
  Synthetic oligonucleotide
acaactcgggcgcatatatcgggaaaaggggttga

SEQ ID NO: 91075 - DNA, 38 bp, Artificial Sequence
  Synthetic oligonucleotide
taggccaagagggcggaggataaatgggttcgtgttga

SEQ ID NO: 91076 - DNA, 38 bp, Artificial Sequence
  Synthetic oligonucleotide
gttgcatcccagatacgtgcgaaatggaaggttgttga

SEQ ID NO: 91077 - DNA, 35 bp, Artificial Sequence
  Synthetic oligonucleotide
tgcacacttcgccatctgcaagcctggaaatcata

SEQ ID NO: 91078 - DNA, 36 bp, Artificial Sequence
  Synthetic oligonucleotide
gaaggagagtagttggggagggttctgtcgcagata

SEQ ID NO: 91079 - DNA, 36 bp, Artificial Sequence
  Synthetic oligonucleotide
gaccaacgaactgggagctaggctaacggaggccta

SEQ ID NO: 91080 - DNA, 36 bp, Artificial Sequence
  Synthetic oligonucleotide
taggggccctcctacaatcgagcctccgctttgcta

SEQ ID NO: 91081 - DNA, 36 bp, Artificial Sequence
  Synthetic oligonucleotide
gagagagcggaggagaacgcagcaggatcgttggta

SEQ ID NO: 91082 - DNA, 35 bp, Artificial Sequence
  Synthetic oligonucleotide
agcaagttcggtgatacggaagatggtggggtgta

SEQ ID NO: 91083 - DNA, 38 bp, Artificial Sequence
  Synthetic oligonucleotide
gtagccccgcccgttattagcccatcccgctaccctta

SEQ ID NO: 91084 - DNA, 36 bp, Artificial Sequence
  Synthetic oligonucleotide
gccacgcgcttttgtaacattgcacgttccctctta

SEQ ID NO: 91085 - DNA, 36 bp, Artificial Sequence
  Synthetic oligonucleotide
atgacgtgccaaaggggagatttctgggacaggtta

SEQ ID NO: 91086 - DNA, 35 bp, Artificial Sequence
  Synthetic oligonucleotide
gtccagccaatctccaattattgtcatgctgacac

SEQ ID NO: 91087 - DNA, 35 bp, Artificial Sequence
  Synthetic oligonucleotide
aatcaacatgtcatgcgcatgccgccgctgtacac

SEQ ID NO: 91088 - DNA, 35 bp, Artificial Sequence
  Synthetic oligonucleotide
gaggcggacctaacctcgttgttacacccactgac

SEQ ID NO: 91089 - DNA, 35 bp, Artificial Sequence
  Synthetic oligonucleotide
gcccgcgagcaggctgcctcgacgatcgcacttac

SEQ ID NO: 91090 - DNA, 35 bp, Artificial Sequence
  Synthetic oligonucleotide
acaagcccctctccctccgtgtcgttttgtctccc

SEQ ID NO: 91091 - DNA, 35 bp, Artificial Sequence
  Synthetic oligonucleotide
gtttgctggcccagttcctattgttccagtttgcc

SEQ ID NO: 91092 - DNA, 35 bp, Artificial Sequence
  Synthetic oligonucleotide
gaacgaaacgcgcatactacccacaggtaaggtcc

SEQ ID NO: 91093 - DNA, 35 bp, Artificial Sequence
  Synthetic oligonucleotide
tccacacctactcactgtgcaccgatacacgttcc

SEQ ID NO: 91094 - DNA, 35 bp, Artificial Sequence
  Synthetic oligonucleotide
tccaccatccgcgctgacgccgcttattgacccgc

SEQ ID NO: 91095 - DNA, 35 bp, Artificial Sequence
  Synthetic oligonucleotide
agtggtcccgtcaaatcgcggtctttgtcacttgc

SEQ ID NO: 91096 - DNA, 35 bp, Artificial Sequence
  Synthetic oligonucleotide
atgacaccacgagcgttcttgattccctactaatc

SEQ ID NO: 91097 - DNA, 35 bp, Artificial Sequence
  Synthetic oligonucleotide
gctccgttcgcacggatgcgctacccgtaacactc

SEQ ID NO: 91098 - DNA, 35 bp, Artificial Sequence
  Synthetic oligonucleotide
tgtctgttgccacatcgcgacgcactcgccgtttc

SEQ ID NO: 91099 - DNA, 35 bp, Artificial Sequence
  Synthetic oligonucleotide
tcaaaggcacgggtggtggcgctcaatagtaagcg

SEQ ID NO: 91100 - DNA, 35 bp, Artificial Sequence
  Synthetic oligonucleotide
tgcctccgtcccacccttgtgcttctgaatcatcg

SEQ ID NO: 91101 - DNA, 35 bp, Artificial Sequence
  Synthetic oligonucleotide
accctccgcgaccaataaaacgtacccagaccagg

SEQ ID NO: 91102 - DNA, 35 bp, Artificial Sequence
  Synthetic oligonucleotide
atccttgcggggacgagggtgttctggggttgagg

SEQ ID NO: 91103 - DNA, 35 bp, Artificial Sequence
  Synthetic oligonucleotide
ttgcggacagaggaaaatgctagtgcacattgggg

SEQ ID NO: 91104 - DNA, 35 bp, Artificial Sequence
  Synthetic oligonucleotide
gatcagagcgagtgaggtggggtagccggttgggg

SEQ ID NO: 91105 - DNA, 35 bp, Artificial Sequence
  Synthetic oligonucleotide
tacaaccgcggatcaggtagtgtacaccctaatgg

SEQ ID NO: 91106 - DNA, 35 bp, Artificial Sequence
  Synthetic oligonucleotide
gccgatacagtggaaaggtagcgcaaggaggatgg

SEQ ID NO: 91107 - DNA, 35 bp, Artificial Sequence
  Synthetic oligonucleotide
acgaggtcgggggggaaacgtatgctgaggagctg

SEQ ID NO: 91108 - DNA, 35 bp, Artificial Sequence
  Synthetic oligonucleotide
tgttacagccaggccccttctaataggtcatacat

SEQ ID NO: 91109 - DNA, 35 bp, Artificial Sequence
  Synthetic oligonucleotide
gttgccaagagaaaaggcatgagtgggcggaatat

SEQ ID NO: 91110 - DNA, 35 bp, Artificial Sequence
  Synthetic oligonucleotide
aacgcccccggaacgtagtctacttgttttgctat

SEQ ID NO: 91111 - DNA, 35 bp, Artificial Sequence
  Synthetic oligonucleotide
accccccttcctgcgcataagtgattggcgtcact

SEQ ID NO: 91112 - DNA, 35 bp, Artificial Sequence
  Synthetic oligonucleotide
gtcgcttcactgcgttggtcaccctctacaatact

SEQ ID NO: 91113 - DNA, 35 bp, Artificial Sequence
  Synthetic oligonucleotide
acgccggtgagatatctacctcctgcccctatact

SEQ ID NO: 91114 - DNA, 35 bp, Artificial Sequence
  Synthetic oligonucleotide
tatcgcacacgttatagctgccctttaacgctact

SEQ ID NO: 91115 - DNA, 34 bp, Artificial Sequence
  Synthetic oligonucleotide
tagatcctgattccgttcatcgcttccagttact

SEQ ID NO: 91116 - DNA, 35 bp, Artificial Sequence
  Synthetic oligonucleotide
gccacatccaattctactttactgcctaggttcct

SEQ ID NO: 91117 - DNA, 35 bp, Artificial Sequence
  Synthetic oligonucleotide
gttggatacgccgatgttcacattccattactgct

SEQ ID NO: 91118 - DNA, 35 bp, Artificial Sequence
  Synthetic oligonucleotide
acctgcccatccgctgtctattgcgtggccctgct

SEQ ID NO: 91119 - DNA, 35 bp, Artificial Sequence
  Synthetic oligonucleotide
gccgccacgtctacctgcgatacacctgcagtagt

SEQ ID NO: 91120 - DNA, 35 bp, Artificial Sequence
  Synthetic oligonucleotide
gcgcaacatagcgcgtttacttgtactgccacggt

SEQ ID NO: 91121 - DNA, 35 bp, Artificial Sequence
  Synthetic oligonucleotide
atcgcccggatgaaccagcgaccctatccacgtgt

SEQ ID NO: 91122 - DNA, 35 bp, Artificial Sequence
  Synthetic oligonucleotide
tggaaggaggtagtggaagggcggtaacggcgtgt

SEQ ID NO: 91123 - DNA, 35 bp, Artificial Sequence
  Synthetic oligonucleotide
tagtgccacacgttctgtaaaccgccatcgtttgt

SEQ ID NO: 91124 - DNA, 35 bp, Artificial Sequence
  Synthetic oligonucleotide
taccctgcctccaggcccacgttaactaccgcatt

SEQ ID NO: 91125 - DNA, 35 bp, Artificial Sequence
  Synthetic oligonucleotide
gccgtagggctctgtgcttactcgtgtcatccctt

SEQ ID NO: 91126 - DNA, 35 bp, Artificial Sequence
  Synthetic oligonucleotide
atgccacccgcgtggctacgaatctctcaggagtt

SEQ ID NO: 91127 - DNA, 35 bp, Artificial Sequence
  Synthetic oligonucleotide
tctaccacgtggttcggggcctgggtgacttggtt

SEQ ID NO: 91128 - DNA, 35 bp, Artificial Sequence
  Synthetic oligonucleotide
gacggagtccactgacctgctgcctatcacttgtt

SEQ ID NO: 91129 - DNA, 35 bp, Artificial Sequence
  Synthetic oligonucleotide
gccaggtgggtgggtggaaacttttctggcccttt

SEQ ID NO: 91130 - DNA, 35 bp, Artificial Sequence
  Synthetic oligonucleotide
tagtaccccactgccttcgagccgaccatcatttt

SEQ ID NO: 91131 - DNA, 35 bp, Artificial Sequence
  Synthetic oligonucleotide
tccagcgtgcgctcagcctactcaagtccactttt

SEQ ID NO: 91132 - DNA, 34 bp, Artificial Sequence
  Synthetic oligonucleotide
taacaacgcatattttctggggtcactgctcaaa

SEQ ID NO: 91133 - DNA, 35 bp, Artificial Sequence
  Synthetic oligonucleotide
tgtggagacgcgtgcatgaagggaatgatcggaaa

SEQ ID NO: 91134 - DNA, 36 bp, Artificial Sequence
  Synthetic oligonucleotide
gtgtagtcggtcaagcaactgcgacgcattaataaa

SEQ ID NO: 91135 - DNA, 35 bp, Artificial Sequence
  Synthetic oligonucleotide
gtcccgccaacgagcccatgccacgtgagactaaa

SEQ ID NO: 91136 - DNA, 36 bp, Artificial Sequence
  Synthetic oligonucleotide
atgaacgccgactcatgacctatattgctctgccaa

SEQ ID NO: 91137 - DNA, 35 bp, Artificial Sequence
  Synthetic oligonucleotide
gtggacctgccgtgtccctccctgttgtaatccaa

SEQ ID NO: 91138 - DNA, 36 bp, Artificial Sequence
  Synthetic oligonucleotide
gagaggagtacaaggaggggtatcgaaggggttcaa

SEQ ID NO: 91139 - DNA, 36 bp, Artificial Sequence
  Synthetic oligonucleotide
tccgctccctcggttgctgccaaaaatctttcataa

SEQ ID NO: 91140 - DNA, 36 bp, Artificial Sequence
  Synthetic oligonucleotide
gaattgcccgcctgctgtatgcggtgccgaccttaa

SEQ ID NO: 91141 - DNA, 36 bp, Artificial Sequence
  Synthetic oligonucleotide
tccactgccaagatggcgccacacactccaccaaca

SEQ ID NO: 91142 - DNA, 36 bp, Artificial Sequence
  Synthetic oligonucleotide
tagccgcctgcacctaatccgtgatgcttttacaca

SEQ ID NO: 91143 - DNA, 33 bp, Artificial Sequence
  Synthetic oligonucleotide
acctccctgatgcgctttcgttgcgttttcaca

SEQ ID NO: 91144 - DNA, 36 bp, Artificial Sequence
  Synthetic oligonucleotide
gtgtgccacaaatagtggacgggtggaacatggaca

SEQ ID NO: 91145 - DNA, 36 bp, Artificial Sequence
  Synthetic oligonucleotide
taagccgcggctcgggaggaacaaacggggtgtaca

SEQ ID NO: 91146 - DNA, 35 bp, Artificial Sequence
  Synthetic oligonucleotide
gcactgcgcgtcggtcatgaccactttggacccca

SEQ ID NO: 91147 - DNA, 35 bp, Artificial Sequence
  Synthetic oligonucleotide
gaatcacagagattcagcgtttatcgccacttcca

SEQ ID NO: 91148 - DNA, 36 bp, Artificial Sequence
  Synthetic oligonucleotide
tcaacactcgcgcgacgctttgcagcacattgagca

SEQ ID NO: 91149 - DNA, 36 bp, Artificial Sequence
  Synthetic oligonucleotide
gcatacgcaagttcttttatttgtccactggtggca

SEQ ID NO: 91150 - DNA, 36 bp, Artificial Sequence
  Synthetic oligonucleotide
tactgcagagacgttaggaaaccaatctgccatgca

SEQ ID NO: 91151 - DNA, 36 bp, Artificial Sequence
  Synthetic oligonucleotide
tcatgcgcacttagcggtgtgccatggacgtatgca

SEQ ID NO: 91152 - DNA, 36 bp, Artificial Sequence
  Synthetic oligonucleotide
gcgcgccgccccgtcgagcttgacttccgaattgca

SEQ ID NO: 91153 - DNA, 36 bp, Artificial Sequence
  Synthetic oligonucleotide
tattcgctgaacacattggccaccgtgtcaaactca

SEQ ID NO: 91154 - DNA, 35 bp, Artificial Sequence
  Synthetic oligonucleotide
tcatcagcacacctgaagaagtcccacccgagtca

SEQ ID NO: 91155 - DNA, 36 bp, Artificial Sequence
  Synthetic oligonucleotide
tgtggacatgtccgcatgtcacaaacccgatattca

SEQ ID NO: 91156 - DNA, 36 bp, Artificial Sequence
  Synthetic oligonucleotide
agaccatgccgtcaccaacgttgcatcatccgttca

SEQ ID NO: 91157 - DNA, 35 bp, Artificial Sequence
  Synthetic oligonucleotide
gcaatcacacgttgcgctctctttagctgctttca

SEQ ID NO: 91158 - DNA, 37 bp, Artificial Sequence
  Synthetic oligonucleotide
atggggggcatcaaactggggatataaaggcagaaga

SEQ ID NO: 91159 - DNA, 36 bp, Artificial Sequence
  Synthetic oligonucleotide
atagacgaggcagaacagaaaaaaaaccggttaaga

SEQ ID NO: 91160 - DNA, 37 bp, Artificial Sequence
  Synthetic oligonucleotide
gaccccactaccctcacgatgattcttggagacacga

SEQ ID NO: 91161 - DNA, 38 bp, Artificial Sequence
  Synthetic oligonucleotide
gtggtgagggggggtgggcaagatccatgcatcggcga

SEQ ID NO: 91162 - DNA, 36 bp, Artificial Sequence
  Synthetic oligonucleotide
atccactcgctcactatcgcccctaggctgttgcga

SEQ ID NO: 91163 - DNA, 37 bp, Artificial Sequence
  Synthetic oligonucleotide
tcatccgaggccaactctctggaccagtcgtggtcga

SEQ ID NO: 91164 - DNA, 37 bp, Artificial Sequence
  Synthetic oligonucleotide
gtgatggtcagaccgggaggagagcttgggtggtcga

SEQ ID NO: 91165 - DNA, 37 bp, Artificial Sequence
  Synthetic oligonucleotide
tatgctaaggggaatatagaggtgtggtgggcaagga

SEQ ID NO: 91166 - DNA, 36 bp, Artificial Sequence
  Synthetic oligonucleotide
tgattgaggactggggcaagtggtacggcataagga

SEQ ID NO: 91167 - DNA, 37 bp, Artificial Sequence
  Synthetic oligonucleotide
agtaccgggggagagaagttagcatgccggttaggga

SEQ ID NO: 91168 - DNA, 37 bp, Artificial Sequence
  Synthetic oligonucleotide
gtgtaacgcaaaaacgagacgagcggcatacggggga

SEQ ID NO: 91169 - DNA, 37 bp, Artificial Sequence
  Synthetic oligonucleotide
gactgcaccgccgatcctttagtcggttacccctgga

SEQ ID NO: 91170 - DNA, 37 bp, Artificial Sequence
  Synthetic oligonucleotide
tggaacagaagacggagtgagattgtgcaggggtgga

SEQ ID NO: 91171 - DNA, 37 bp, Artificial Sequence
  Synthetic oligonucleotide
tctgcggccgttaacctcgcctctccaacagtgtgga

SEQ ID NO: 91172 - DNA, 37 bp, Artificial Sequence
  Synthetic oligonucleotide
gtgcaccatcctcaaggcccggagtcctgctattgga

SEQ ID NO: 91173 - DNA, 37 bp, Artificial Sequence
  Synthetic oligonucleotide
acttcgcaatagggggtgttggtgggcaattgttgga

SEQ ID NO: 91174 - DNA, 37 bp, Artificial Sequence
  Synthetic oligonucleotide
taacccaccgccatttctgacctagctttcatttgga

SEQ ID NO: 91175 - DNA, 36 bp, Artificial Sequence
  Synthetic oligonucleotide
tgaggccatgcccattttttacgccccagagaatga

SEQ ID NO: 91176 - DNA, 36 bp, Artificial Sequence
  Synthetic oligonucleotide
atacatgaccgctgttatgtgcgctttccaccatga

SEQ ID NO: 91177 - DNA, 38 bp, Artificial Sequence
  Synthetic oligonucleotide
acatgccacatccagcgacctcagacattatgcgatga

SEQ ID NO: 91178 - DNA, 38 bp, Artificial Sequence
  Synthetic oligonucleotide
gacggacgagatgctaggataaatggctgggcctatga

SEQ ID NO: 91179 - DNA, 38 bp, Artificial Sequence
  Synthetic oligonucleotide
tcagacccactatctgtagtgccatcttctcgcactga

SEQ ID NO: 91180 - DNA, 38 bp, Artificial Sequence
  Synthetic oligonucleotide
gacagggggggagtgtgggtggaaacttgcttacctga

SEQ ID NO: 91181 - DNA, 35 bp, Artificial Sequence
  Synthetic oligonucleotide
gcgctcaatcacacgcgcacatactctatgcctga

SEQ ID NO: 91182 - DNA, 37 bp, Artificial Sequence
  Synthetic oligonucleotide
acctcagcatcactcccttaccgttgcctttggctga

SEQ ID NO: 91183 - DNA, 37 bp, Artificial Sequence
  Synthetic oligonucleotide
atgcgggcaatccgctcaccaactcatccactgctga

SEQ ID NO: 91184 - DNA, 36 bp, Artificial Sequence
  Synthetic oligonucleotide
gctcattatccgggtgtatctcgccttcccatctga

SEQ ID NO: 91185 - DNA, 38 bp, Artificial Sequence
  Synthetic oligonucleotide
gatccgtgcgtgttggctccaagcctctcacttagtga

SEQ ID NO: 91186 - DNA, 38 bp, Artificial Sequence
  Synthetic oligonucleotide
acatcacagcagtaccagacgaggagcggaaaacgtga

SEQ ID NO: 91187 - DNA, 37 bp, Artificial Sequence
  Synthetic oligonucleotide
tcacgctccagcaaattaggtttccagttctacgtga

SEQ ID NO: 91188 - DNA, 38 bp, Artificial Sequence
  Synthetic oligonucleotide
gacacccgacgcatctcggatcagtcaatagttcgtga

SEQ ID NO: 91189 - DNA, 38 bp, Artificial Sequence
  Synthetic oligonucleotide
atggtgagatagcggaggcatcgggaagacggtggtga

SEQ ID NO: 91190 - DNA, 35 bp, Artificial Sequence
  Synthetic oligonucleotide
tcagactccatctctacgttgcatttaacctgtga

SEQ ID NO: 91191 - DNA, 38 bp, Artificial Sequence
  Synthetic oligonucleotide
aggggatggtcgagggatgagatcagtcaggggtgtga

SEQ ID NO: 91192 - DNA, 37 bp, Artificial Sequence
  Synthetic oligonucleotide
gtgatgcgggcctttggggaagggaaaatgattgtga

SEQ ID NO: 91193 - DNA, 37 bp, Artificial Sequence
  Synthetic oligonucleotide
atcacgccgagactgtcaaggaggccgggggaattga

SEQ ID NO: 91194 - DNA, 38 bp, Artificial Sequence
  Synthetic oligonucleotide
gcacaaatgaacgtgtggtgacggcgggaggacattga

SEQ ID NO: 91195 - DNA, 37 bp, Artificial Sequence
  Synthetic oligonucleotide
gacaacagcggagctgtactttctcaccgctcattga

SEQ ID NO: 91196 - DNA, 37 bp, Artificial Sequence
  Synthetic oligonucleotide
gcacaacccgtatgtgtgtgttaggaatgttgattga

SEQ ID NO: 91197 - DNA, 38 bp, Artificial Sequence
  Synthetic oligonucleotide
ttgtgtgcagtcaaactgtcttcaaccgtctctcttga

SEQ ID NO: 91198 - DNA, 38 bp, Artificial Sequence
  Synthetic oligonucleotide
gcaataggcacatccgcccctcagccaagaccggttga

SEQ ID NO: 91199 - DNA, 37 bp, Artificial Sequence
  Synthetic oligonucleotide
tcaaattgcgttcagctcccgttatctcgccgtttga

SEQ ID NO: 91200 - DNA, 38 bp, Artificial Sequence
  Synthetic oligonucleotide
gcacgtagactcttggccgttcccctgttccggtttga

SEQ ID NO: 91201 - DNA, 38 bp, Artificial Sequence
  Synthetic oligonucleotide
atgttccactatcacgacgttgtactcacactttttga

SEQ ID NO: 91202 - DNA, 36 bp, Artificial Sequence
  Synthetic oligonucleotide
agtcactccggccaaccatgcaacatgggatccata

SEQ ID NO: 91203 - DNA, 35 bp, Artificial Sequence
  Synthetic oligonucleotide
gcatctgaccgcccggccattacctatgaatcata

SEQ ID NO: 91204 - DNA, 36 bp, Artificial Sequence
  Synthetic oligonucleotide
atgaggtgggagtacaattaaataggggtaaggata

SEQ ID NO: 91205 - DNA, 36 bp, Artificial Sequence
  Synthetic oligonucleotide
gcaggacgcttcgtgaaacgaccatgcacataccta

SEQ ID NO: 91206 - DNA, 35 bp, Artificial Sequence
  Synthetic oligonucleotide
atgattgcaccgggtgcccctcttagttttaccta

SEQ ID NO: 91207 - DNA, 36 bp, Artificial Sequence
  Synthetic oligonucleotide
acgcccgacccagagcgatgcactgtcgctgcccta

SEQ ID NO: 91208 - DNA, 36 bp, Artificial Sequence
  Synthetic oligonucleotide
agctcgccaccccgcccatttagccctcatggccta

SEQ ID NO: 91209 - DNA, 36 bp, Artificial Sequence
  Synthetic oligonucleotide
tcaccgtcgtctagtgtgactggcctatacctccta

SEQ ID NO: 91210 - DNA, 36 bp, Artificial Sequence
  Synthetic oligonucleotide
gagcggtctaaacatggatcacgcactctagtccta

SEQ ID NO: 91211 - DNA, 36 bp, Artificial Sequence
  Synthetic oligonucleotide
taaacacgggcagaccttttagtagcggaggggcta

SEQ ID NO: 91212 - DNA, 36 bp, Artificial Sequence
  Synthetic oligonucleotide
gtcatcagtccgtatggtaccatgccgctatctcta

SEQ ID NO: 91213 - DNA, 36 bp, Artificial Sequence
  Synthetic oligonucleotide
aagacgggacgtgaggataagcaaatgggtaaagta

SEQ ID NO: 91214 - DNA, 36 bp, Artificial Sequence
  Synthetic oligonucleotide
ttacgctacagggcgtgataccatctaacataagta

SEQ ID NO: 91215 - DNA, 36 bp, Artificial Sequence
  Synthetic oligonucleotide
gttggtggagtgggtgaggctacggggtgcacagta

SEQ ID NO: 91216 - DNA, 36 bp, Artificial Sequence
  Synthetic oligonucleotide
tgcccgttagcctctcgtctctcatcaaacctggta

SEQ ID NO: 91217 - DNA, 36 bp, Artificial Sequence
  Synthetic oligonucleotide
tagtggccggcctccttatgcgaattaccgtagtta

SEQ ID NO: 91218 - DNA, 36 bp, Artificial Sequence
  Synthetic oligonucleotide
gtgaccatcccgcctgtttcaaaaattgaagcgtta

SEQ ID NO: 91219 - DNA, 35 bp, Artificial Sequence
  Synthetic oligonucleotide
ggggtagggaggtgggcggcaataagcaatgtaac

SEQ ID NO: 91220 - DNA, 35 bp, Artificial Sequence
  Synthetic oligonucleotide
actgcgacggagtacatcatcccctacgcatacac

SEQ ID NO: 91221 - DNA, 35 bp, Artificial Sequence
  Synthetic oligonucleotide
gccctgctatccgacatgactcgcagggattccac

SEQ ID NO: 91222 - DNA, 35 bp, Artificial Sequence
  Synthetic oligonucleotide
acacttgcgatcacgatccccccgcttctgattac

SEQ ID NO: 91223 - DNA, 35 bp, Artificial Sequence
  Synthetic oligonucleotide
gatgccccagaggacacgtgaattacagcaatccc

SEQ ID NO: 91224 - DNA, 36 bp, Artificial Sequence
  Synthetic oligonucleotide
aatcacggaggcagattgtccctcttgtagttctcc

SEQ ID NO: 91225 - DNA, 35 bp, Artificial Sequence
  Synthetic oligonucleotide
gtgatgccggtgcatccatcatgacgatcttgagc

SEQ ID NO: 91226 - DNA, 35 bp, Artificial Sequence
  Synthetic oligonucleotide
gaccgccaggggtctttctaacaatcgccgttcgc

SEQ ID NO: 91227 - DNA, 35 bp, Artificial Sequence
  Synthetic oligonucleotide
tcagaccagttagctccccaacatagactctttgc

SEQ ID NO: 91228 - DNA, 35 bp, Artificial Sequence
  Synthetic oligonucleotide
actgtcctgccgactacgaagctggtaatccactc

SEQ ID NO: 91229 - DNA, 35 bp, Artificial Sequence
  Synthetic oligonucleotide
ggagggtcacaatgttggttcctgatttgcacctc

SEQ ID NO: 91230 - DNA, 35 bp, Artificial Sequence
  Synthetic oligonucleotide
gcccctctacctcagattgccagtaaccgcatctc

SEQ ID NO: 91231 - DNA, 35 bp, Artificial Sequence
  Synthetic oligonucleotide
gtcgggtcaagtagtggtgaggggggggtttagtc

SEQ ID NO: 91232 - DNA, 35 bp, Artificial Sequence
  Synthetic oligonucleotide
ttaacagcaaccgctttgatacaacctgtgtcgtc

SEQ ID NO: 91233 - DNA, 35 bp, Artificial Sequence
  Synthetic oligonucleotide
gtcgccgtagatcgctgtggtgtggtggtttcgtc

SEQ ID NO: 91234 - DNA, 35 bp, Artificial Sequence
  Synthetic oligonucleotide
agatgggagggagtggcaccgatcgtagcaatgtc

SEQ ID NO: 91235 - DNA, 35 bp, Artificial Sequence
  Synthetic oligonucleotide
ttcgaggggggtggtgcggtgtggcgaatcggttc

SEQ ID NO: 91236 - DNA, 35 bp, Artificial Sequence
  Synthetic oligonucleotide
agccggatccactgagtccacgaatcgaccctttc

SEQ ID NO: 91237 - DNA, 35 bp, Artificial Sequence
  Synthetic oligonucleotide
gtaaggtggtgtcgtgggtgcgtggaggtaagaag

SEQ ID NO: 91238 - DNA, 35 bp, Artificial Sequence
  Synthetic oligonucleotide
tcctacccacggcatggcaatctctcgtccgccag

SEQ ID NO: 91239 - DNA, 35 bp, Artificial Sequence
  Synthetic oligonucleotide
tgagctggatcgaggggaacgggattattaatgag

SEQ ID NO: 91240 - DNA, 35 bp, Artificial Sequence
  Synthetic oligonucleotide
tacagccaccacatactccgccccgcgtcttaacg

SEQ ID NO: 91241 - DNA, 35 bp, Artificial Sequence
  Synthetic oligonucleotide
tctcgcctcgctgggtggcttgccctcgatctccg

SEQ ID NO: 91242 - DNA, 35 bp, Artificial Sequence
  Synthetic oligonucleotide
atctcatccccgccctgttatgtccgactgttccg

SEQ ID NO: 91243 - DNA, 35 bp, Artificial Sequence
  Synthetic oligonucleotide
aagtagaggtcagtcagggttagggtgggagccgg

SEQ ID NO: 91244 - DNA, 35 bp, Artificial Sequence
  Synthetic oligonucleotide
aacgtggggtaggcaaagtgggttatgacgtctgg

SEQ ID NO: 91245 - DNA, 35 bp, Artificial Sequence
  Synthetic oligonucleotide
tcatgccggtacgtgtccacggttattttctttgg

SEQ ID NO: 91246 - DNA, 35 bp, Artificial Sequence
  Synthetic oligonucleotide
tgcgctcgcagtcctgatgttttgtttgtttgttg

SEQ ID NO: 91247 - DNA, 35 bp, Artificial Sequence
  Synthetic oligonucleotide
ttgtgcgacgtgcttagcttcgttatcaagttttg

SEQ ID NO: 91248 - DNA, 35 bp, Artificial Sequence
  Synthetic oligonucleotide
tgttgccgctgcctaatcaccattttcttgtccat

SEQ ID NO: 91249 - DNA, 35 bp, Artificial Sequence
  Synthetic oligonucleotide
atgaacacatcgccgctgcaggccctgcttcctat

SEQ ID NO: 91250 - DNA, 34 bp, Artificial Sequence
  Synthetic oligonucleotide
aattggggaaacgggacgaaggtgaagaagctat

SEQ ID NO: 91251 - DNA, 34 bp, Artificial Sequence
  Synthetic oligonucleotide
gagagccccaaaggctaagccactacttcgctat

SEQ ID NO: 91252 - DNA, 35 bp, Artificial Sequence
  Synthetic oligonucleotide
tcatcacaccctctaaatatgaagcgcgatctact

SEQ ID NO: 91253 - DNA, 35 bp, Artificial Sequence
  Synthetic oligonucleotide
tgccgatgtacgtagtcaaaacgagttcatgccct

SEQ ID NO: 91254 - DNA, 35 bp, Artificial Sequence
  Synthetic oligonucleotide
tatgcgcgtagcctggaactctcagtggcttgtct

SEQ ID NO: 91255 - DNA, 35 bp, Artificial Sequence
  Synthetic oligonucleotide
acccagaccggttgctcgagccacatcttcccagt

SEQ ID NO: 91256 - DNA, 35 bp, Artificial Sequence
  Synthetic oligonucleotide
ggaatgagaggggggtaggtccgcctgagtaaggt

SEQ ID NO: 91257 - DNA, 35 bp, Artificial Sequence
  Synthetic oligonucleotide
tccgagcgctgagcctacactacttcaccgctggt

SEQ ID NO: 91258 - DNA, 35 bp, Artificial Sequence
  Synthetic oligonucleotide
tacgatgtctctgctctccttgtttgccgtggtgt

SEQ ID NO: 91259 - DNA, 35 bp, Artificial Sequence
  Synthetic oligonucleotide
gcactccacaatctctactaggttccgtactttgt

SEQ ID NO: 91260 - DNA, 35 bp, Artificial Sequence
  Synthetic oligonucleotide
gaagtgagccctccactgcttgacattccggactt

SEQ ID NO: 91261 - DNA, 35 bp, Artificial Sequence
  Synthetic oligonucleotide
gccgctgcaggctaacgttggattcgtctctcttt

SEQ ID NO: 91262 - DNA, 36 bp, Artificial Sequence
  Synthetic oligonucleotide
accatgcatccaccgtcgcctgagatacactccaaa

SEQ ID NO: 91263 - DNA, 36 bp, Artificial Sequence
  Synthetic oligonucleotide
tctgacatcacctgattcgactctcctcccgcgaaa

SEQ ID NO: 91264 - DNA, 35 bp, Artificial Sequence
  Synthetic oligonucleotide
aaaagaaggaagtaggacaacggagaacagtgaaa

SEQ ID NO: 91265 - DNA, 35 bp, Artificial Sequence
  Synthetic oligonucleotide
ggacacgggagtgagtggttgtgaagcgtggtaaa

SEQ ID NO: 91266 - DNA, 35 bp, Artificial Sequence
  Synthetic oligonucleotide
gacgatggaaacacagggggagatcagtttaacaa

SEQ ID NO: 91267 - DNA, 36 bp, Artificial Sequence
  Synthetic oligonucleotide
ttcatgtcacctagtgaccccttcatggtctaccaa

SEQ ID NO: 91268 - DNA, 35 bp, Artificial Sequence
  Synthetic oligonucleotide
gaacctcagcagcctgcaccctcagagaacgccaa

SEQ ID NO: 91269 - DNA, 35 bp, Artificial Sequence
  Synthetic oligonucleotide
tccgagtgctggtgcggaactagaggaggtggcaa

SEQ ID NO: 91270 - DNA, 36 bp, Artificial Sequence
  Synthetic oligonucleotide
gacgagcggagctgggtggaagattggtaacacgaa

SEQ ID NO: 91271 - DNA, 36 bp, Artificial Sequence
  Synthetic oligonucleotide
gcatccgcagcctgctttaacgctttgacaattgaa

SEQ ID NO: 91272 - DNA, 35 bp, Artificial Sequence
  Synthetic oligonucleotide
acaacctcatctcatgcattacatggcatccataa

SEQ ID NO: 91273 - DNA, 36 bp, Artificial Sequence
  Synthetic oligonucleotide
cagtggaggaaacgatggctggatctggctccgtaa

SEQ ID NO: 91274 - DNA, 36 bp, Artificial Sequence
  Synthetic oligonucleotide
acatcggcgagcaaaccaaaaagggtacaggggtaa

SEQ ID NO: 91275 - DNA, 35 bp, Artificial Sequence
  Synthetic oligonucleotide
tcctgtcgccgtggtgggcttacatgccccattaa

SEQ ID NO: 91276 - DNA, 36 bp, Artificial Sequence
  Synthetic oligonucleotide
tgtccccgctgccggtacctgttacattcctattaa

SEQ ID NO: 91277 - DNA, 36 bp, Artificial Sequence
  Synthetic oligonucleotide
gacgcgatgccgggattctgcaccctaaatttaaca

SEQ ID NO: 91278 - DNA, 35 bp, Artificial Sequence
  Synthetic oligonucleotide
gctacacaaacatggcaaaggtacgtgggaatcca

SEQ ID NO: 91279 - DNA, 36 bp, Artificial Sequence
  Synthetic oligonucleotide
tgaatcgaatcgcacacggtcccgctacactgtcca

SEQ ID NO: 91280 - DNA, 37 bp, Artificial Sequence
  Synthetic oligonucleotide
ggagggctgtagtagggaaaactgagggacgggagca

SEQ ID NO: 91281 - DNA, 36 bp, Artificial Sequence
  Synthetic oligonucleotide
aacacccagctgatctgaaagaccccggatctagca

SEQ ID NO: 91282 - DNA, 35 bp, Artificial Sequence
  Synthetic oligonucleotide
tacgcgtggggaggataggattgaattatggcgca

SEQ ID NO: 91283 - DNA, 35 bp, Artificial Sequence
  Synthetic oligonucleotide
taccccagtgcacggtgctgctaccattgagggca

SEQ ID NO: 91284 - DNA, 36 bp, Artificial Sequence
  Synthetic oligonucleotide
atcgcggatcagcttttttgcggtactcctctatca

SEQ ID NO: 91285 - DNA, 35 bp, Artificial Sequence
  Synthetic oligonucleotide
gcacacgctgggcccgattttgccttggcgactca

SEQ ID NO: 91286 - DNA, 38 bp, Artificial Sequence
  Synthetic oligonucleotide
gcccacaccctcaatcgctgctttgacactagccctca

SEQ ID NO: 91287 - DNA, 36 bp, Artificial Sequence
  Synthetic oligonucleotide
aacaggaggtagggacgtattgacaacgggcgctca

SEQ ID NO: 91288 - DNA, 36 bp, Artificial Sequence
  Synthetic oligonucleotide
attccgaccatcaccatggggtcaagccatccttca

SEQ ID NO: 91289 - DNA, 37 bp, Artificial Sequence
  Synthetic oligonucleotide
ggtcaggaagcggacgtgggaaaagatgagtggaaga

SEQ ID NO: 91290 - DNA, 37 bp, Artificial Sequence
  Synthetic oligonucleotide
acaatcgaagagagggagtgaggcatagcaatgaaga

SEQ ID NO: 91291 - DNA, 35 bp, Artificial Sequence
  Synthetic oligonucleotide
atcgacaagaatgcgtggaacgtaagggatgaaga

SEQ ID NO: 91292 - DNA, 35 bp, Artificial Sequence
  Synthetic oligonucleotide
gtaagcgccaccgccacgttccaccctccttaaga

SEQ ID NO: 91293 - DNA, 37 bp, Artificial Sequence
  Synthetic oligonucleotide
gctcagctgagggcaaacaaaaggggagcaatacaga

SEQ ID NO: 91294 - DNA, 37 bp, Artificial Sequence
  Synthetic oligonucleotide
ggttagacggaagggtaatgggcggatttgatgcaga

SEQ ID NO: 91295 - DNA, 37 bp, Artificial Sequence
  Synthetic oligonucleotide
gaccacctccaatgatcagacttgacacagtcagaga

SEQ ID NO: 91296 - DNA, 36 bp, Artificial Sequence
  Synthetic oligonucleotide
ggtgccctcactcgccgcttctaatccgaccggaga

SEQ ID NO: 91297 - DNA, 37 bp, Artificial Sequence
  Synthetic oligonucleotide
acctgcgcactcgtgaacgggggacggaggactgaga

SEQ ID NO: 91298 - DNA, 37 bp, Artificial Sequence
  Synthetic oligonucleotide
agaaagggaggaccgggggcttgaaggggacttgaga

SEQ ID NO: 91299 - DNA, 36 bp, Artificial Sequence
  Synthetic oligonucleotide
cacatgtcgcgtgttgacaaggggttaatcggtaga

SEQ ID NO: 91300 - DNA, 36 bp, Artificial Sequence
  Synthetic oligonucleotide
tgcacgcagtacaccatctcacacaccctcggtaga

SEQ ID NO: 91301 - DNA, 37 bp, Artificial Sequence
  Synthetic oligonucleotide
gtccccctcagctcgatatactttgccgtaccgacga

SEQ ID NO: 91302 - DNA, 37 bp, Artificial Sequence
  Synthetic oligonucleotide
gtaacccgcccgtatccagcttgtctatgtccgacga

SEQ ID NO: 91303 - DNA, 36 bp, Artificial Sequence
  Synthetic oligonucleotide
aatgcaaacaggggatgagggcgaggtaggtaccga

SEQ ID NO: 91304 - DNA, 37 bp, Artificial Sequence
  Synthetic oligonucleotide
gatggtccgaacgcgtgaaggaggggtgttgacccga

SEQ ID NO: 91305 - DNA, 37 bp, Artificial Sequence
  Synthetic oligonucleotide
atacatgcgctaatatccttcgtggcgaaacctccga

SEQ ID NO: 91306 - DNA, 36 bp, Artificial Sequence
  Synthetic oligonucleotide
tagggggcggtagttcggtaaggaaaagggtcgcga

SEQ ID NO: 91307 - DNA, 36 bp, Artificial Sequence
  Synthetic oligonucleotide
gaaggacggtggttccagagagctgcagatgaagga

SEQ ID NO: 91308 - DNA, 36 bp, Artificial Sequence
  Synthetic oligonucleotide
gccagaggaactggggagtataacaaaggagcagga

SEQ ID NO: 91309 - DNA, 37 bp, Artificial Sequence
  Synthetic oligonucleotide
accttctgcgcccatctagtttagtagttgccccgga

SEQ ID NO: 91310 - DNA, 37 bp, Artificial Sequence
  Synthetic oligonucleotide
tcatgagcgaggacacgtagcgggaacatatagcgga

SEQ ID NO: 91311 - DNA, 37 bp, Artificial Sequence
  Synthetic oligonucleotide
gcaagacattgcggaataaggggatgaagtagaggga

SEQ ID NO: 91312 - DNA, 37 bp, Artificial Sequence
  Synthetic oligonucleotide
attgcaaaagcaaagcaagcgaaaggtacgggaggga

SEQ ID NO: 91313 - DNA, 37 bp, Artificial Sequence
  Synthetic oligonucleotide
gtgacgtaccaaaaagtgttcggattgaccttaggga

SEQ ID NO: 91314 - DNA, 37 bp, Artificial Sequence
  Synthetic oligonucleotide
gacatcaccatccctttgatagcattccggtacggga

SEQ ID NO: 91315 - DNA, 37 bp, Artificial Sequence
  Synthetic oligonucleotide
agagaccaacggaaatatgggtgctcgtagaagggga

SEQ ID NO: 91316 - DNA, 37 bp, Artificial Sequence
  Synthetic oligonucleotide
tcagggaaagggccgaggggtcgatcagactagggga

SEQ ID NO: 91317 - DNA, 37 bp, Artificial Sequence
  Synthetic oligonucleotide
tgtagtgcgggccagagaaagttcatggcgggtggga

SEQ ID NO: 91318 - DNA, 36 bp, Artificial Sequence
  Synthetic oligonucleotide
agcacactcactatccccaaacccgcaggctatgga

SEQ ID NO: 91319 - DNA, 36 bp, Artificial Sequence
  Synthetic oligonucleotide
acaacaggagccagcctgtgctcacccgcttatgga

SEQ ID NO: 91320 - DNA, 37 bp, Artificial Sequence
  Synthetic oligonucleotide
acaccatcccctcagtcatgccaggccgagatctgga

SEQ ID NO: 91321 - DNA, 37 bp, Artificial Sequence
  Synthetic oligonucleotide
atgcggccaccttcgatacctgttctagcacgttgga

SEQ ID NO: 91322 - DNA, 35 bp, Artificial Sequence
  Synthetic oligonucleotide
ggggaagggcaggagcgacgaacccgtaatttgga

SEQ ID NO: 91323 - DNA, 38 bp, Artificial Sequence
  Synthetic oligonucleotide
agagtcgccagaactaaacgtcgcccgcccttccatga

SEQ ID NO: 91324 - DNA, 38 bp, Artificial Sequence
  Synthetic oligonucleotide
gactccgtgcaggagggggccttggatctaggggatga

SEQ ID NO: 91325 - DNA, 35 bp, Artificial Sequence
  Synthetic oligonucleotide
gttactgcctgcaccaccgattctcctcagtatga

SEQ ID NO: 91326 - DNA, 38 bp, Artificial Sequence
  Synthetic oligonucleotide
ttagacccctgccaccatctgtccatacctcgcactga

SEQ ID NO: 91327 - DNA, 38 bp, Artificial Sequence
  Synthetic oligonucleotide
gaacactgcgagctgctacttctaccgcttgggactga

SEQ ID NO: 91328 - DNA, 38 bp, Artificial Sequence
  Synthetic oligonucleotide
tgtagatggaagaatgggagggtggacaggagacctga

SEQ ID NO: 91329 - DNA, 37 bp, Artificial Sequence
  Synthetic oligonucleotide
gtcaagctgcaacctctatttcccgtgccatccctga

SEQ ID NO: 91330 - DNA, 38 bp, Artificial Sequence
  Synthetic oligonucleotide
aactgggcttctaccgtccaccgtgcttgtttccctga

SEQ ID NO: 91331 - DNA, 38 bp, Artificial Sequence
  Synthetic oligonucleotide
acccactgcttacattttgaatgtctgacatcccgtga

SEQ ID NO: 91332 - DNA, 38 bp, Artificial Sequence
  Synthetic oligonucleotide
tcacgacgactagcgcatttccagaacctccttcgtga

SEQ ID NO: 91333 - DNA, 38 bp, Artificial Sequence
  Synthetic oligonucleotide
acttgcacggagtacaaggtagaggggggtgacggtga

SEQ ID NO: 91334 - DNA, 38 bp, Artificial Sequence
  Synthetic oligonucleotide
gatctgtggagacctgtaatcccgctacccattggtga

SEQ ID NO: 91335 - DNA, 37 bp, Artificial Sequence
  Synthetic oligonucleotide
acgagggaaagtggtggcgtgggcagacatactgtga

SEQ ID NO: 91336 - DNA, 38 bp, Artificial Sequence
  Synthetic oligonucleotide
gatggtacacgggcggtaggcattaggagagagtgtga

SEQ ID NO: 91337 - DNA, 38 bp, Artificial Sequence
  Synthetic oligonucleotide
tgaggccgacgtaggcctggtgatatttaactcattga

SEQ ID NO: 91338 - DNA, 38 bp, Artificial Sequence
  Synthetic oligonucleotide
accaacgtactgaactaaaaggggaggggtacgattga

SEQ ID NO: 91339 - DNA, 37 bp, Artificial Sequence
  Synthetic oligonucleotide
agtcgcaccccgagcgagtgacctcaccttatattga

SEQ ID NO: 91340 - DNA, 38 bp, Artificial Sequence
  Synthetic oligonucleotide
gctcgccgccgagaagctgcatactcccacattattga

SEQ ID NO: 91341 - DNA, 38 bp, Artificial Sequence
  Synthetic oligonucleotide
gaacgccggccactgtttcggcatcaccagttccttga

SEQ ID NO: 91342 - DNA, 34 bp, Artificial Sequence
  Synthetic oligonucleotide
ccacgaatcaccgctcgttgtccaccatgcttga

SEQ ID NO: 91343 - DNA, 38 bp, Artificial Sequence
  Synthetic oligonucleotide
gacccggccaccttcttgtaacctcatggaaatcttga

SEQ ID NO: 91344 - DNA, 38 bp, Artificial Sequence
  Synthetic oligonucleotide
taacactcgcttgacgggttgcgcacttccactcttga

SEQ ID NO: 91345 - DNA, 38 bp, Artificial Sequence
  Synthetic oligonucleotide
tcatcacctccatacatcacttaaagacgctaggttga

SEQ ID NO: 91346 - DNA, 38 bp, Artificial Sequence
  Synthetic oligonucleotide
acccggccacactacgacgaccgtctgccagtctttga

SEQ ID NO: 91347 - DNA, 35 bp, Artificial Sequence
  Synthetic oligonucleotide
tctgtccggccttaactgccaggggttccacaata

SEQ ID NO: 91348 - DNA, 36 bp, Artificial Sequence
  Synthetic oligonucleotide
accaccccacgaagaaatctcgctataacatgcata

SEQ ID NO: 91349 - DNA, 36 bp, Artificial Sequence
  Synthetic oligonucleotide
tgtaggagcacaccgaagtctcatatcaccacacta

SEQ ID NO: 91350 - DNA, 35 bp, Artificial Sequence
  Synthetic oligonucleotide
tccgccatcccatttagcatagcggtacttcccta

SEQ ID NO: 91351 - DNA, 36 bp, Artificial Sequence
  Synthetic oligonucleotide
gccgccatagtgcgtgtttcatcggcttcctgccta

SEQ ID NO: 91352 - DNA, 36 bp, Artificial Sequence
  Synthetic oligonucleotide
atcccggtgggtgccatctagttagtctttctccta

SEQ ID NO: 91353 - DNA, 36 bp, Artificial Sequence
  Synthetic oligonucleotide
tccgactgcgtggcttctggctcggtctgtactcta

SEQ ID NO: 91354 - DNA, 35 bp, Artificial Sequence
  Synthetic oligonucleotide
tcgcaaccctgcgttgaacttatccgtcttcatta

SEQ ID NO: 91355 - DNA, 36 bp, Artificial Sequence
  Synthetic oligonucleotide
aagtccacgacacatccccgacccagtcatggttta

SEQ ID NO: 91356 - DNA, 35 bp, Artificial Sequence
  Synthetic oligonucleotide
gtgacccccgcatcggcctctaacgcctgtcttac

SEQ ID NO: 91357 - DNA, 35 bp, Artificial Sequence
  Synthetic oligonucleotide
gagcctgtccagagtatcgctggccgtaatatccc

SEQ ID NO: 91358 - DNA, 35 bp, Artificial Sequence
  Synthetic oligonucleotide
gatccacgacgctggagcaaaaattaagtggggcc

SEQ ID NO: 91359 - DNA, 35 bp, Artificial Sequence
  Synthetic oligonucleotide
tgaaaccccgcctatgcaacatccatggctcctcc

SEQ ID NO: 91360 - DNA, 35 bp, Artificial Sequence
  Synthetic oligonucleotide
gtgcctggttacgatgcgctgctgtctacccttcc

SEQ ID NO: 91361 - DNA, 35 bp, Artificial Sequence
  Synthetic oligonucleotide
gcccatctcacaggacatggcggggttattgacgc

SEQ ID NO: 91362 - DNA, 35 bp, Artificial Sequence
  Synthetic oligonucleotide
agagatgcccagtcactatacaacgctgtactcgc

SEQ ID NO: 91363 - DNA, 35 bp, Artificial Sequence
  Synthetic oligonucleotide
gctccacctcagcgtgctgtcttttaggcctcggc

SEQ ID NO: 91364 - DNA, 35 bp, Artificial Sequence
  Synthetic oligonucleotide
tacgtgtaccatcccatcaaggtagttgctatggc

SEQ ID NO: 91365 - DNA, 35 bp, Artificial Sequence
  Synthetic oligonucleotide
tgtacacccgatgtcacgctcctctaaacatgtgc

SEQ ID NO: 91366 - DNA, 34 bp, Artificial Sequence
  Synthetic oligonucleotide
gctgttctgccccccgctgactgacgtttccctc

SEQ ID NO: 91367 - DNA, 35 bp, Artificial Sequence
  Synthetic oligonucleotide
aagaccctgccctttgcattgagccctactgtctc

SEQ ID NO: 91368 - DNA, 35 bp, Artificial Sequence
  Synthetic oligonucleotide
accgcatgtctacccgttttctaggtgaccttctc

SEQ ID NO: 91369 - DNA, 35 bp, Artificial Sequence
  Synthetic oligonucleotide
gttggcctgaccaaatctccgtgtctcccaaagtc

SEQ ID NO: 91370 - DNA, 35 bp, Artificial Sequence
  Synthetic oligonucleotide
gctgcaggccagaccaacgcagttgcgcaacattc

SEQ ID NO: 91371 - DNA, 35 bp, Artificial Sequence
  Synthetic oligonucleotide
gtcactcccggtcggtgttagggtcgccattcttc

SEQ ID NO: 91372 - DNA, 35 bp, Artificial Sequence
  Synthetic oligonucleotide
gatgcggtgggaagcgtttcaggttcttgatcaag

SEQ ID NO: 91373 - DNA, 35 bp, Artificial Sequence
  Synthetic oligonucleotide
tccaagagaggaggaaagagataggaaatgctcag

SEQ ID NO: 91374 - DNA, 35 bp, Artificial Sequence
  Synthetic oligonucleotide
gagaccactcacagtgtacacatcagttcattcag

SEQ ID NO: 91375 - DNA, 35 bp, Artificial Sequence
  Synthetic oligonucleotide
gagtagtagcaggaattgggtgaagttcgaacacg

SEQ ID NO: 91376 - DNA, 35 bp, Artificial Sequence
  Synthetic oligonucleotide
tgagcgccacatacaagcctctagaacatctatcg

SEQ ID NO: 91377 - DNA, 35 bp, Artificial Sequence
  Synthetic oligonucleotide
gatcgaaggtgggtcggagaggccctgcatatcgg

SEQ ID NO: 91378 - DNA, 35 bp, Artificial Sequence
  Synthetic oligonucleotide
gcataactcaccgcgggaccagcacttcccaatgg

SEQ ID NO: 91379 - DNA, 35 bp, Artificial Sequence
  Synthetic oligonucleotide
acaccgggagacagtacgagcgatcacctaccatg

SEQ ID NO: 91380 - DNA, 35 bp, Artificial Sequence
  Synthetic oligonucleotide
tccacgtcatggcctaaccaggcctctgccacctg

SEQ ID NO: 91381 - DNA, 35 bp, Artificial Sequence
  Synthetic oligonucleotide
tagtgcacggatctatacagatgaacactcacctg

SEQ ID NO: 91382 - DNA, 35 bp, Artificial Sequence
  Synthetic oligonucleotide
aagagagagagtgagagggtggtgtatacatgctg

SEQ ID NO: 91383 - DNA, 35 bp, Artificial Sequence
  Synthetic oligonucleotide
atccgacgtcctgctctttccagctaacgcttctg

SEQ ID NO: 91384 - DNA, 34 bp, Artificial Sequence
  Synthetic oligonucleotide
gaacattcactcagtatctctttggggccacgtg

SEQ ID NO: 91385 - DNA, 35 bp, Artificial Sequence
  Synthetic oligonucleotide
gcccatggcgcatctgcttgaacctcctttttgtg

SEQ ID NO: 91386 - DNA, 35 bp, Artificial Sequence
  Synthetic oligonucleotide
tgtgtacggagggtttgtggtatataattgttttg

SEQ ID NO: 91387 - DNA, 35 bp, Artificial Sequence
  Synthetic oligonucleotide
acagtcgagcagacatttcaccactagcgccgaat

SEQ ID NO: 91388 - DNA, 35 bp, Artificial Sequence
  Synthetic oligonucleotide
gaaacgtaacgagaccggggacagaaggacggaat

SEQ ID NO: 91389 - DNA, 35 bp, Artificial Sequence
  Synthetic oligonucleotide
gtggtgagggacatcgaggaagaatcaggttgaat

SEQ ID NO: 91390 - DNA, 35 bp, Artificial Sequence
  Synthetic oligonucleotide
aacacagatgggaaatagaatctggttagttccat

SEQ ID NO: 91391 - DNA, 35 bp, Artificial Sequence
  Synthetic oligonucleotide
ttacgccgccgggtccctctccagtctcctccgat

SEQ ID NO: 91392 - DNA, 36 bp, Artificial Sequence
  Synthetic oligonucleotide
acttgacccgaccaacacgagctgggcacagctact

SEQ ID NO: 91393 - DNA, 35 bp, Artificial Sequence
  Synthetic oligonucleotide
gtcatccgcccttgctagagttttggttaacacct

SEQ ID NO: 91394 - DNA, 35 bp, Artificial Sequence
  Synthetic oligonucleotide
gcgacacgaacatgctgcttggccttgtcttccct

SEQ ID NO: 91395 - DNA, 35 bp, Artificial Sequence
  Synthetic oligonucleotide
tcacctggggtgtagggaaaggagtaacgatgcct

SEQ ID NO: 91396 - DNA, 35 bp, Artificial Sequence
  Synthetic oligonucleotide
gtggttgggcgcgtagggtagttaaatgggtgtct

SEQ ID NO: 91397 - DNA, 35 bp, Artificial Sequence
  Synthetic oligonucleotide
gtacggggcgagccgatctgccgggcctcatcatt

SEQ ID NO: 91398 - DNA, 35 bp, Artificial Sequence
  Synthetic oligonucleotide
aaccaagcgccacagtcatattccactcatcgctt

SEQ ID NO: 91399 - DNA, 35 bp, Artificial Sequence
  Synthetic oligonucleotide
gtggccgtgttagactttccttgtttcgtcttctt

SEQ ID NO: 91400 - DNA, 35 bp, Artificial Sequence
  Synthetic oligonucleotide
tgactggtaagggagcaaagggtttggttgaggtt

SEQ ID NO: 91401 - DNA, 35 bp, Artificial Sequence
  Synthetic oligonucleotide
gccgttcactctgctcatttccatcgactaggttt

SEQ ID NO: 91402 - DNA, 35 bp, Artificial Sequence
  Synthetic oligonucleotide
accccgatccccgccgagatactcatttgccaaaa

SEQ ID NO: 91403 - DNA, 35 bp, Artificial Sequence
  Synthetic oligonucleotide
actgaggaagggggcggtgcgtcttgaactacaaa

SEQ ID NO: 91404 - DNA, 35 bp, Artificial Sequence
  Synthetic oligonucleotide
taaagggaagtgggaatggcgtagtgctgcggaaa

SEQ ID NO: 91405 - DNA, 35 bp, Artificial Sequence
  Synthetic oligonucleotide
tgctggggggggaatgcgaacagggagcatggaaa

SEQ ID NO: 91406 - DNA, 36 bp, Artificial Sequence
  Synthetic oligonucleotide
gggaagagggacgggctaccagtgcagtggtggaaa

SEQ ID NO: 91407 - DNA, 36 bp, Artificial Sequence
  Synthetic oligonucleotide
tccgacgcattctcgagaccctgccaggcactgaaa

SEQ ID NO: 91408 - DNA, 36 bp, Artificial Sequence
  Synthetic oligonucleotide
gttgggacatggagattcgaggttaggagggtgaaa

SEQ ID NO: 91409 - DNA, 36 bp, Artificial Sequence
  Synthetic oligonucleotide
ttcaggacgagaaatttaatggagctggacgaacaa

SEQ ID NO: 91410 - DNA, 36 bp, Artificial Sequence
  Synthetic oligonucleotide
gatggactagttggggttgaggaatgagggcggcaa

SEQ ID NO: 91411 - DNA, 36 bp, Artificial Sequence
  Synthetic oligonucleotide
accacgccattggtgcgacacctaaaacgtttgcaa

SEQ ID NO: 91412 - DNA, 36 bp, Artificial Sequence
  Synthetic oligonucleotide
gatggaacgaagggtccgcgtgtggtgggggaagaa

SEQ ID NO: 91413 - DNA, 36 bp, Artificial Sequence
  Synthetic oligonucleotide
gataacagaggatgcaagggggaggttgggaaggaa

SEQ ID NO: 91414 - DNA, 36 bp, Artificial Sequence
  Synthetic oligonucleotide
tgtagtgggaaggtagaatggggttgagggattgaa

SEQ ID NO: 91415 - DNA, 36 bp, Artificial Sequence
  Synthetic oligonucleotide
tgtcgcactgcatatccttagccgcactttccgtaa

SEQ ID NO: 91416 - DNA, 35 bp, Artificial Sequence
  Synthetic oligonucleotide
aacagtgcaccccgtcccgcaagccccatcattaa

SEQ ID NO: 91417 - DNA, 37 bp, Artificial Sequence
  Synthetic oligonucleotide
acacgataggcgacggactgcagttggagaggtttaa

SEQ ID NO: 91418 - DNA, 35 bp, Artificial Sequence
  Synthetic oligonucleotide
acgcgccacgctggtttgggtctcaattcgcaaca

SEQ ID NO: 91419 - DNA, 35 bp, Artificial Sequence
  Synthetic oligonucleotide
tgaacgccgatatgccccgagtctatcacctcaca

SEQ ID NO: 91420 - DNA, 36 bp, Artificial Sequence
  Synthetic oligonucleotide
taaaccacacactgcatatgtgagatatagctcaca

SEQ ID NO: 91421 - DNA, 35 bp, Artificial Sequence
  Synthetic oligonucleotide
ttgtcaccctctgtttacatacgcgagttccgaca

SEQ ID NO: 91422 - DNA, 35 bp, Artificial Sequence
  Synthetic oligonucleotide
atcatcgaacactggacgtagccttgcaatataca

SEQ ID NO: 91423 - DNA, 35 bp, Artificial Sequence
  Synthetic oligonucleotide
ttctcgcttgcactatctcgtatgcacctgctaca

SEQ ID NO: 91424 - DNA, 36 bp, Artificial Sequence
  Synthetic oligonucleotide
agatgtggtgctgtccctttagtcttgtatgttaca

SEQ ID NO: 91425 - DNA, 36 bp, Artificial Sequence
  Synthetic oligonucleotide
gccgaaggagagtgctggtggggctaggttacacca

SEQ ID NO: 91426 - DNA, 36 bp, Artificial Sequence
  Synthetic oligonucleotide
atcaggccgtcaagccaatcacgccccgtaatacca

SEQ ID NO: 91427 - DNA, 36 bp, Artificial Sequence
  Synthetic oligonucleotide
atggaagccatcaccacccctagagccacctgccca

SEQ ID NO: 91428 - DNA, 36 bp, Artificial Sequence
  Synthetic oligonucleotide
gcaccgcactactgcttgatcaactcctctctcgca

SEQ ID NO: 91429 - DNA, 35 bp, Artificial Sequence
  Synthetic oligonucleotide
gagattccgccacatacaactacgcacagtaggca

SEQ ID NO: 91430 - DNA, 36 bp, Artificial Sequence
  Synthetic oligonucleotide
agttcggtcaaagcaggaatgtagctgggggaatca

SEQ ID NO: 91431 - DNA, 36 bp, Artificial Sequence
  Synthetic oligonucleotide
ttgcacatcgattctgaacagctctcagggtactca

SEQ ID NO: 91432 - DNA, 36 bp, Artificial Sequence
  Synthetic oligonucleotide
gctggaggcaccaaaattgatctgcgcgccgcctca

SEQ ID NO: 91433 - DNA, 36 bp, Artificial Sequence
  Synthetic oligonucleotide
tactcggggccagtggctacaaacaccaagctctca

SEQ ID NO: 91434 - DNA, 36 bp, Artificial Sequence
  Synthetic oligonucleotide
agaccgtccatgtcgtcctcttcaccgtttctgtca

SEQ ID NO: 91435 - DNA, 36 bp, Artificial Sequence
  Synthetic oligonucleotide
acatcccggatctgtgaacgcggtctgataccttca

SEQ ID NO: 91436 - DNA, 37 bp, Artificial Sequence
  Synthetic oligonucleotide
tagtgcgggatcaggagcggagatttggacttgaaga

SEQ ID NO: 91437 - DNA, 37 bp, Artificial Sequence
  Synthetic oligonucleotide
tatcaccgtgacgaggggggttttttgtatgtacaga

SEQ ID NO: 91438 - DNA, 37 bp, Artificial Sequence
  Synthetic oligonucleotide
accagacgaggcggattgggctcaagtggaccagaga

SEQ ID NO: 91439 - DNA, 37 bp, Artificial Sequence
  Synthetic oligonucleotide
gaggtcaaagacagggaacggacatgggtagaataga

SEQ ID NO: 91440 - DNA, 36 bp, Artificial Sequence
  Synthetic oligonucleotide
gtgggtgagtcgcgatgtattgttgatgttggtaga

SEQ ID NO: 91441 - DNA, 37 bp, Artificial Sequence
  Synthetic oligonucleotide
atgccgtgcagtcgactttaatcccccggcatcacga

SEQ ID NO: 91442 - DNA, 37 bp, Artificial Sequence
  Synthetic oligonucleotide
tcaactgcgccgtacaagacttcctgcgacaccccga

SEQ ID NO: 91443 - DNA, 37 bp, Artificial Sequence
  Synthetic oligonucleotide
gcgccacacgtattgttgcttttctgattgccgccga

SEQ ID NO: 91444 - DNA, 37 bp, Artificial Sequence
  Synthetic oligonucleotide
acaaccggcgacctacatgcagctcattatgtgccga

SEQ ID NO: 91445 - DNA, 37 bp, Artificial Sequence
  Synthetic oligonucleotide
accacgtggtcgagggtggagaaaaggatgcgcgcga

SEQ ID NO: 91446 - DNA, 37 bp, Artificial Sequence
  Synthetic oligonucleotide
agcgaggaagccaagtaacaagggagaggtcgcgcga

SEQ ID NO: 91447 - DNA, 37 bp, Artificial Sequence
  Synthetic oligonucleotide
tagcccatgatgtcctcctctgcgtttgcccctgcga

SEQ ID NO: 91448 - DNA, 37 bp, Artificial Sequence
  Synthetic oligonucleotide
acagccctcttcagcgtactatcaacctgtatctcga

SEQ ID NO: 91449 - DNA, 37 bp, Artificial Sequence
  Synthetic oligonucleotide
gatctagcgcatactggccactggtgctcaccttcga

SEQ ID NO: 91450 - DNA, 36 bp, Artificial Sequence
  Synthetic oligonucleotide
ttccaccgatcgcaggttgattttcatcccacagga

SEQ ID NO: 91451 - DNA, 35 bp, Artificial Sequence
  Synthetic oligonucleotide
ggacacctgtccgcggtacgtgcattatcccagga

SEQ ID NO: 91452 - DNA, 37 bp, Artificial Sequence
  Synthetic oligonucleotide
gttgtcacagtgggaatgaggggagtgactccgagga

SEQ ID NO: 91453 - DNA, 37 bp, Artificial Sequence
  Synthetic oligonucleotide
gtttgggagcggggcacaggggagaatctcagtagga

SEQ ID NO: 91454 - DNA, 37 bp, Artificial Sequence
  Synthetic oligonucleotide
acacaccaacaggtctgtaccaaccgttcggttagga

SEQ ID NO: 91455 - DNA, 36 bp, Artificial Sequence
  Synthetic oligonucleotide
ggttgcacaatcacgcgtttcatgccataccccgga

SEQ ID NO: 91456 - DNA, 37 bp, Artificial Sequence
  Synthetic oligonucleotide
tacctagggggggagatggaggttggtccagtccgga

SEQ ID NO: 91457 - DNA, 37 bp, Artificial Sequence
  Synthetic oligonucleotide
ttcgcacggtccccgctccattcagtcgcgaatcgga

SEQ ID NO: 91458 - DNA, 37 bp, Artificial Sequence
  Synthetic oligonucleotide
gtgaatagtggccgataagtgcgagagggaagaggga

SEQ ID NO: 91459 - DNA, 37 bp, Artificial Sequence
  Synthetic oligonucleotide
taatgtcggcggaggggtagggtttggcgccgcggga

SEQ ID NO: 91460 - DNA, 37 bp, Artificial Sequence
  Synthetic oligonucleotide
gagtgtgcgatccgggggataagtggtaggaggggga

SEQ ID NO: 91461 - DNA, 37 bp, Artificial Sequence
  Synthetic oligonucleotide
gccatacgtagcatctgatctaaatactttcatggga

SEQ ID NO: 91462 - DNA, 37 bp, Artificial Sequence
  Synthetic oligonucleotide
tacgtgtcacgagtgtcaacgcctgcctagacctgga

SEQ ID NO: 91463 - DNA, 37 bp, Artificial Sequence
  Synthetic oligonucleotide
tgcccaggccgcacatctcttcttccggtcatttgga

SEQ ID NO: 91464 - DNA, 37 bp, Artificial Sequence
  Synthetic oligonucleotide
tccgtacccctgctgtactgtaatggtcctttcatga

SEQ ID NO: 91465 - DNA, 38 bp, Artificial Sequence
  Synthetic oligonucleotide
aacggtgcgtggagggttttatggaagtaaggtgatga

SEQ ID NO: 91466 - DNA, 38 bp, Artificial Sequence
  Synthetic oligonucleotide
ttggacaacagaggacagatcgagggggggcattatga

SEQ ID NO: 91467 - DNA, 38 bp, Artificial Sequence
  Synthetic oligonucleotide
gtgcgatgtagctgcccttttgaggatttatcacctga

SEQ ID NO: 91468 - DNA, 38 bp, Artificial Sequence
  Synthetic oligonucleotide
ggacgagtgatcggggtaaaacgggggttgggagctga

SEQ ID NO: 91469 - DNA, 38 bp, Artificial Sequence
  Synthetic oligonucleotide
gttgtggcaaggtcctattaatctcacacactagctga

SEQ ID NO: 91470 - DNA, 38 bp, Artificial Sequence
  Synthetic oligonucleotide
atttgcatcgcactgagtctacacactttcttctctga

SEQ ID NO: 91471 - DNA, 38 bp, Artificial Sequence
  Synthetic oligonucleotide
aatgctggggtcgacggggacaagaacgggagacgtga

SEQ ID NO: 91472 - DNA, 38 bp, Artificial Sequence
  Synthetic oligonucleotide
aagtgcctcaggcttccttccagtttctgtctccgtga

SEQ ID NO: 91473 - DNA, 38 bp, Artificial Sequence
  Synthetic oligonucleotide
tccatgtccctccatacagcgccaacctgaacaggtga

SEQ ID NO: 91474 - DNA, 38 bp, Artificial Sequence
  Synthetic oligonucleotide
actacgcgtgacttttagccctctccatccataggtga

SEQ ID NO: 91475 - DNA, 38 bp, Artificial Sequence
  Synthetic oligonucleotide
gatgagtggcagacgcaaggaaggagtgttaccggtga

SEQ ID NO: 91476 - DNA, 38 bp, Artificial Sequence
  Synthetic oligonucleotide
gttgtcgaacaacatgggatactggggtacgggggtga

SEQ ID NO: 91477 - DNA, 38 bp, Artificial Sequence
  Synthetic oligonucleotide
gcacggaacggcagtagaaggggggtgagagtatgtga

SEQ ID NO: 91478 - DNA, 38 bp, Artificial Sequence
  Synthetic oligonucleotide
tacggtgtgcaaatgtaggtttaacggtgtgagtgtga

SEQ ID NO: 91479 - DNA, 37 bp, Artificial Sequence
  Synthetic oligonucleotide
acctgcgggaggaaaatgccagggcctaacggtgtga

SEQ ID NO: 91480 - DNA, 37 bp, Artificial Sequence
  Synthetic oligonucleotide
gaggacggaatgggtaaggtagagtgagaacttgtga

SEQ ID NO: 91481 - DNA, 38 bp, Artificial Sequence
  Synthetic oligonucleotide
tccgcatcagtacgtgggccactcaccccgcaaattga

SEQ ID NO: 91482 - DNA, 38 bp, Artificial Sequence
  Synthetic oligonucleotide
tgatgcacacagtcgctttattgtttggttttcattga

SEQ ID NO: 91483 - DNA, 38 bp, Artificial Sequence
  Synthetic oligonucleotide
gtgcgtccgtacctgtcctcttcataactgccgattga

SEQ ID NO: 91484 - DNA, 38 bp, Artificial Sequence
  Synthetic oligonucleotide
tctagcggagagatcggagaggaccagattcaggttga

SEQ ID NO: 91485 - DNA, 38 bp, Artificial Sequence
  Synthetic oligonucleotide
acacacgctcgtgtcctctaacgctattttcttgttga

SEQ ID NO: 91486 - DNA, 38 bp, Artificial Sequence
  Synthetic oligonucleotide
gttgggacgaatgagaacgatgaaggggttgttgttga

SEQ ID NO: 91487 - DNA, 38 bp, Artificial Sequence
  Synthetic oligonucleotide
gacccgccatcctggatctgtaccgcatttttctttga

SEQ ID NO: 91488 - DNA, 36 bp, Artificial Sequence
  Synthetic oligonucleotide
ttgcacctgtgatgagaattatcgcgcaccaaccta

SEQ ID NO: 91489 - DNA, 36 bp, Artificial Sequence
  Synthetic oligonucleotide
gtgctgcccagtatcaacacccttgcgctcactcta

SEQ ID NO: 91490 - DNA, 36 bp, Artificial Sequence
  Synthetic oligonucleotide
actgtacgcggggagtaatggttgtgcgaatgtgta

SEQ ID NO: 91491 - DNA, 36 bp, Artificial Sequence
  Synthetic oligonucleotide
ttcgcatctgcctggtcacccgctggtcacggatta

SEQ ID NO: 91492 - DNA, 36 bp, Artificial Sequence
  Synthetic oligonucleotide
tgccgaccccgagcgatcgtccaaatggcatcctta

SEQ ID NO: 91493 - DNA, 36 bp, Artificial Sequence
  Synthetic oligonucleotide
gctgacacgccgtcatcgatacatttgcttttctta

SEQ ID NO: 91494 - DNA, 36 bp, Artificial Sequence
  Synthetic oligonucleotide
gcaggctgggccgggggataggtgggttgcaggtta

SEQ ID NO: 91495 - DNA, 35 bp, Artificial Sequence
  Synthetic oligonucleotide
tcgctcctcaccacctcaagttcatcggacacaac

SEQ ID NO: 91496 - DNA, 35 bp, Artificial Sequence
  Synthetic oligonucleotide
tgaaccgttgccccctgtacttctgctggtactac

SEQ ID NO: 91497 - DNA, 35 bp, Artificial Sequence
  Synthetic oligonucleotide
aaccgtaccgcaacttcttaagggccactatttac

SEQ ID NO: 91498 - DNA, 35 bp, Artificial Sequence
  Synthetic oligonucleotide
tctacacccctctcatcccattcgtgtgtatttac

SEQ ID NO: 91499 - DNA, 35 bp, Artificial Sequence
  Synthetic oligonucleotide
gcacctactgagccgatgaggcgatatgtctttac

SEQ ID NO: 91500 - DNA, 36 bp, Artificial Sequence
  Synthetic oligonucleotide
tgtacgcaaaaaaaattgaacaggtgagtcggaacc

SEQ ID NO: 91501 - DNA, 35 bp, Artificial Sequence
  Synthetic oligonucleotide
acctgcacccctacggccactcaccaggctctacc

SEQ ID NO: 91502 - DNA, 35 bp, Artificial Sequence
  Synthetic oligonucleotide
ggatactccccgtgttcctttcgagtacctagccc

SEQ ID NO: 91503 - DNA, 35 bp, Artificial Sequence
  Synthetic oligonucleotide
agtcgcgaccccccctgaattgtgcgtaaaattcc

SEQ ID NO: 91504 - DNA, 36 bp, Artificial Sequence
  Synthetic oligonucleotide
tctactcgcattccgaagtccccgccacagtgttcc

SEQ ID NO: 91505 - DNA, 35 bp, Artificial Sequence
  Synthetic oligonucleotide
gttaggtggctgctccttaaaatagtaccttccgc

SEQ ID NO: 91506 - DNA, 35 bp, Artificial Sequence
  Synthetic oligonucleotide
gcccatctgcctgttcgttccatccaatcctctgc

SEQ ID NO: 91507 - DNA, 35 bp, Artificial Sequence
  Synthetic oligonucleotide
accgttaaccctgacaacacattctaacgtagtgc

SEQ ID NO: 91508 - DNA, 35 bp, Artificial Sequence
  Synthetic oligonucleotide
tccagggccaagcggtgctcggtctacaatattgc

SEQ ID NO: 91509 - DNA, 35 bp, Artificial Sequence
  Synthetic oligonucleotide
gacaatacctatgcggaaggggggtggatatactc

SEQ ID NO: 91510 - DNA, 35 bp, Artificial Sequence
  Synthetic oligonucleotide
gacatccctcagcttcgcgccccgcctatcggctc

SEQ ID NO: 91511 - DNA, 35 bp, Artificial Sequence
  Synthetic oligonucleotide
gtcgacgcaagtgcgtatctcttgatataccgttc

SEQ ID NO: 91512 - DNA, 35 bp, Artificial Sequence
  Synthetic oligonucleotide
atgcaaacgtctcgaagctagttactcccgatttc

SEQ ID NO: 91513 - DNA, 35 bp, Artificial Sequence
  Synthetic oligonucleotide
ttgggagatgcggagtatggagcgggaggtctaag

SEQ ID NO: 91514 - DNA, 35 bp, Artificial Sequence
  Synthetic oligonucleotide
acacgccggcccgtatcgctcaggtcgttccctag

SEQ ID NO: 91515 - DNA, 35 bp, Artificial Sequence
  Synthetic oligonucleotide
gccactccttatcgcatataccgaagccagacacg

SEQ ID NO: 91516 - DNA, 36 bp, Artificial Sequence
  Synthetic oligonucleotide
gttgagcgaccctggcgtaccctactagacttcacg

SEQ ID NO: 91517 - DNA, 35 bp, Artificial Sequence
  Synthetic oligonucleotide
tcttcctacagcgatgctccaccctattcaagacg

SEQ ID NO: 91518 - DNA, 35 bp, Artificial Sequence
  Synthetic oligonucleotide
gtactgaaccacctcgttgtcactatagagatacg

SEQ ID NO: 91519 - DNA, 35 bp, Artificial Sequence
  Synthetic oligonucleotide
tacatggtaactttcctgcctcgcccctcggagcg

SEQ ID NO: 91520 - DNA, 35 bp, Artificial Sequence
  Synthetic oligonucleotide
acacatccgcacccgggtcgatcatcgcaattgcg

SEQ ID NO: 91521 - DNA, 35 bp, Artificial Sequence
  Synthetic oligonucleotide
accacaaggagcgagggggaacagggttttgccgg

SEQ ID NO: 91522 - DNA, 35 bp, Artificial Sequence
  Synthetic oligonucleotide
agtgacaagtgaagtacgcggtacaatagaaatgg

SEQ ID NO: 91523 - DNA, 35 bp, Artificial Sequence
  Synthetic oligonucleotide
gctgatgactgttgcaggatagactgggggacatg

SEQ ID NO: 91524 - DNA, 35 bp, Artificial Sequence
  Synthetic oligonucleotide
agccttgcagcacctgcgatagcacccacgttctg

SEQ ID NO: 91525 - DNA, 35 bp, Artificial Sequence
  Synthetic oligonucleotide
attgccaccgctgttgccttcctagatgccttgtg

SEQ ID NO: 91526 - DNA, 35 bp, Artificial Sequence
  Synthetic oligonucleotide
tcaagataggtgggcggggtaaagtgcttttgttg

SEQ ID NO: 91527 - DNA, 35 bp, Artificial Sequence
  Synthetic oligonucleotide
aactgccctacctcagcacgctcaaagttaatttg

SEQ ID NO: 91528 - DNA, 35 bp, Artificial Sequence
  Synthetic oligonucleotide
ttgaatgctgcgtgcggaaaaggttgtgggtacat

SEQ ID NO: 91529 - DNA, 35 bp, Artificial Sequence
  Synthetic oligonucleotide
agtatgggagggggtaagaccgcggggctgggcat

SEQ ID NO: 91530 - DNA, 35 bp, Artificial Sequence
  Synthetic oligonucleotide
agctcggtctcgcatatacaatcggttaccacact

SEQ ID NO: 91531 - DNA, 35 bp, Artificial Sequence
  Synthetic oligonucleotide
tcatagcccgtgccatgtcttgcgtgggtgaacct

SEQ ID NO: 91532 - DNA, 35 bp, Artificial Sequence
  Synthetic oligonucleotide
tcgcacctccaccttgttcgcgttaccgttttcct

SEQ ID NO: 91533 - DNA, 35 bp, Artificial Sequence
  Synthetic oligonucleotide
atgctgccccaaagctctataccggtgtcacagct

SEQ ID NO: 91534 - DNA, 35 bp, Artificial Sequence
  Synthetic oligonucleotide
attgccccgctgggatgtaggtgattctaccctct

SEQ ID NO: 91535 - DNA, 35 bp, Artificial Sequence
  Synthetic oligonucleotide
gcccgggtgcctggtgaaaatgatggcatgggggt

SEQ ID NO: 91536 - DNA, 35 bp, Artificial Sequence
  Synthetic oligonucleotide
tgttggcctcaactttaacccggtcatccttatgt

SEQ ID NO: 91537 - DNA, 35 bp, Artificial Sequence
  Synthetic oligonucleotide
ttgcacacatcgtatgtcgggtcccgccgatcctt

SEQ ID NO: 91538 - DNA, 35 bp, Artificial Sequence
  Synthetic oligonucleotide
gcccactctcaatgctacatgcatccaccgctgtt

SEQ ID NO: 91539 - DNA, 35 bp, Artificial Sequence
  Synthetic oligonucleotide
gtctccactgcttgcactgtacatagtacgtgttt

SEQ ID NO: 91540 - DNA, 36 bp, Artificial Sequence
  Synthetic oligonucleotide
gtccgaacggaaatggtgaaaaaagggtaagcgaaa

SEQ ID NO: 91541 - DNA, 36 bp, Artificial Sequence
  Synthetic oligonucleotide
atggatccacctcactgtttgatatgccgacctaaa

SEQ ID NO: 91542 - DNA, 36 bp, Artificial Sequence
  Synthetic oligonucleotide
ttcgacctcgcctcggagcgttccctcgccgttcaa

SEQ ID NO: 91543 - DNA, 35 bp, Artificial Sequence
  Synthetic oligonucleotide
gcaccatacccgcgcctggcacttgtctacacgaa

SEQ ID NO: 91544 - DNA, 36 bp, Artificial Sequence
  Synthetic oligonucleotide
gtgggacgggctttgcttggggttaggaaaagggaa

SEQ ID NO: 91545 - DNA, 36 bp, Artificial Sequence
  Synthetic oligonucleotide
actggagaggggggcgcgggtaatcacagtttggaa

SEQ ID NO: 91546 - DNA, 36 bp, Artificial Sequence
  Synthetic oligonucleotide
ttcaacaacgcacccacatcccaacggacaatgtaa

SEQ ID NO: 91547 - DNA, 35 bp, Artificial Sequence
  Synthetic oligonucleotide
tgttcgctacgggccgtttcaccttttgagccaca

SEQ ID NO: 91548 - DNA, 36 bp, Artificial Sequence
  Synthetic oligonucleotide
gccggggacaatataggggtggtaagaaagggtaca

SEQ ID NO: 91549 - DNA, 35 bp, Artificial Sequence
  Synthetic oligonucleotide
tacgaacctcctccgaggtgcccacttggggtaca

SEQ ID NO: 91550 - DNA, 36 bp, Artificial Sequence
  Synthetic oligonucleotide
agacaccgacacatctagactcgccaaggctgacca

SEQ ID NO: 91551 - DNA, 35 bp, Artificial Sequence
  Synthetic oligonucleotide
gttgccgtaccaaatctcgtgaaatctgcgtgcca

SEQ ID NO: 91552 - DNA, 36 bp, Artificial Sequence
  Synthetic oligonucleotide
gtaccctactgccctgaggtaagactcttgtctcca

SEQ ID NO: 91553 - DNA, 36 bp, Artificial Sequence
  Synthetic oligonucleotide
tacatgtgtgcctgggttcgagaagcagtgtccgca

SEQ ID NO: 91554 - DNA, 35 bp, Artificial Sequence
  Synthetic oligonucleotide
tagtcgtccctcgcacatgtcctgcttatgaatca

SEQ ID NO: 91555 - DNA, 36 bp, Artificial Sequence
  Synthetic oligonucleotide
gcctgtgggggctggaaaggtctggtggggggctca

SEQ ID NO: 91556 - DNA, 37 bp, Artificial Sequence
  Synthetic oligonucleotide
ctggcacccgcacatatagtctgcatttttggcaaga

SEQ ID NO: 91557 - DNA, 37 bp, Artificial Sequence
  Synthetic oligonucleotide
acccagacggaggagggataggggacacggccgaaga

SEQ ID NO: 91558 - DNA, 36 bp, Artificial Sequence
  Synthetic oligonucleotide
ataatcgcacgtcaccccgccgcctgctttgccaga

SEQ ID NO: 91559 - DNA, 36 bp, Artificial Sequence
  Synthetic oligonucleotide
gcagtcgagggggctagtgtagggcgtacgcgcaga

SEQ ID NO: 91560 - DNA, 37 bp, Artificial Sequence
  Synthetic oligonucleotide
acggaggtgaggacggtgggccgggctagtggagaga

SEQ ID NO: 91561 - DNA, 35 bp, Artificial Sequence
  Synthetic oligonucleotide
gccatcacgactttgctgaccgtaacaccccgaga

SEQ ID NO: 91562 - DNA, 36 bp, Artificial Sequence
  Synthetic oligonucleotide
atgcgctggcatagcaaaacttgggagaaagggaga

SEQ ID NO: 91563 - DNA, 37 bp, Artificial Sequence
  Synthetic oligonucleotide
gagacgcagggggggaatgaggcatcaacatcaacga

SEQ ID NO: 91564 - DNA, 37 bp, Artificial Sequence
  Synthetic oligonucleotide
tcgcacacgtgccgtgtccactttccgtcactaacga

SEQ ID NO: 91565 - DNA, 38 bp, Artificial Sequence
  Synthetic oligonucleotide
gcaaccctttgttccgaccactcacgcccgtgggacga

SEQ ID NO: 91566 - DNA, 35 bp, Artificial Sequence
  Synthetic oligonucleotide
gatgcctcattttccgttacgtgatcacgctacga

SEQ ID NO: 91567 - DNA, 37 bp, Artificial Sequence
  Synthetic oligonucleotide
aacacccgccagtttatcgcgcgccacctatgagcga

SEQ ID NO: 91568 - DNA, 37 bp, Artificial Sequence
  Synthetic oligonucleotide
ttctgacgacctcacacgggtacatgtaaacactcga

SEQ ID NO: 91569 - DNA, 36 bp, Artificial Sequence
  Synthetic oligonucleotide
agttcgcatagggggactggaggcgatatttcagga

SEQ ID NO: 91570 - DNA, 36 bp, Artificial Sequence
  Synthetic oligonucleotide
aacaccgcctactcaccagtcgaacatgctgtagga

SEQ ID NO: 91571 - DNA, 37 bp, Artificial Sequence
  Synthetic oligonucleotide
atcacatccactgcccgtctccaatcgctaagccgga

SEQ ID NO: 91572 - DNA, 35 bp, Artificial Sequence
  Synthetic oligonucleotide
gaaatggggtggttcgaagaggaacggttcaggga

SEQ ID NO: 91573 - DNA, 36 bp, Artificial Sequence
  Synthetic oligonucleotide
gtgagagtgtgacaaccaatagagatgtggcgggga

SEQ ID NO: 91574 - DNA, 37 bp, Artificial Sequence
  Synthetic oligonucleotide
gcctaccaaattgcagtggaagctactgactggggga

SEQ ID NO: 91575 - DNA, 37 bp, Artificial Sequence
  Synthetic oligonucleotide
gtgcccaccggcattctattatcggataccttgggga

SEQ ID NO: 91576 - DNA, 37 bp, Artificial Sequence
  Synthetic oligonucleotide
gatcgaaccaggggggggttgaccgaagtcaatggga

SEQ ID NO: 91577 - DNA, 37 bp, Artificial Sequence
  Synthetic oligonucleotide
gagagccgccggattctcgtctctaatcattcctgga

SEQ ID NO: 91578 - DNA, 36 bp, Artificial Sequence
  Synthetic oligonucleotide
gatcccgcccatgcaatcactgccttttaatctgga

SEQ ID NO: 91579 - DNA, 37 bp, Artificial Sequence
  Synthetic oligonucleotide
atcgaaagacgaggttgaggaagctagggtcggtgga

SEQ ID NO: 91580 - DNA, 37 bp, Artificial Sequence
  Synthetic oligonucleotide
tactccctcaattgcaagtgcggccatccttcttgga

SEQ ID NO: 91581 - DNA, 37 bp, Artificial Sequence
  Synthetic oligonucleotide
taggaacggttagggtggcaggagtttgcgggttgga

SEQ ID NO: 91582 - DNA, 38 bp, Artificial Sequence
  Synthetic oligonucleotide
gcaccacgggtggtttaattaacaccacttcaccatga

SEQ ID NO: 91583 - DNA, 38 bp, Artificial Sequence
  Synthetic oligonucleotide
acgagcgcaacacggctaaacaaaggggaaggagatga

SEQ ID NO: 91584 - DNA, 38 bp, Artificial Sequence
  Synthetic oligonucleotide
tcgctgggtcctactgccataatacgctccacaactga

SEQ ID NO: 91585 - DNA, 38 bp, Artificial Sequence
  Synthetic oligonucleotide
tctggtcggggatacaataatgggggtgtgggcactga

SEQ ID NO: 91586 - DNA, 38 bp, Artificial Sequence
  Synthetic oligonucleotide
tatgtccacggtcagtcgtccatgtgcctcatcactga

SEQ ID NO: 91587 - DNA, 37 bp, Artificial Sequence
  Synthetic oligonucleotide
gcgggtgcaccacactttttaacctgcagttcactga

SEQ ID NO: 91588 - DNA, 38 bp, Artificial Sequence
  Synthetic oligonucleotide
gaacggacgataagatgtccgtgttatcgcccccctga

SEQ ID NO: 91589 - DNA, 38 bp, Artificial Sequence
  Synthetic oligonucleotide
gtgcatacgccggatgagcgtcctgttgcgccccctga

SEQ ID NO: 91590 - DNA, 38 bp, Artificial Sequence
  Synthetic oligonucleotide
gccagtgacatcaatttgcggctgcgagggcttcctga

SEQ ID NO: 91591 - DNA, 37 bp, Artificial Sequence
  Synthetic oligonucleotide
acacggggccgaagtgaggttcttgttctgttcctga

SEQ ID NO: 91592 - DNA, 38 bp, Artificial Sequence
  Synthetic oligonucleotide
gtagtcatgataagcaggtggtactgggagggggctga

SEQ ID NO: 91593 - DNA, 37 bp, Artificial Sequence
  Synthetic oligonucleotide
gtcgtagtgggggaggcgaggtaatgtcgggatctga

SEQ ID NO: 91594 - DNA, 38 bp, Artificial Sequence
  Synthetic oligonucleotide
gaacgcaagtgggaaggggcaagggatgcatcttctga

SEQ ID NO: 91595 - DNA, 36 bp, Artificial Sequence
  Synthetic oligonucleotide
gtgtgcataagtcgaggaggggattgtgcgcagtga

SEQ ID NO: 91596 - DNA, 37 bp, Artificial Sequence
  Synthetic oligonucleotide
ggacaccacatgaatgatggacaacatacgtcagtga

SEQ ID NO: 91597 - DNA, 38 bp, Artificial Sequence
  Synthetic oligonucleotide
gcacactgccctggaatcagtaagccaatctggcgtga

SEQ ID NO: 91598 - DNA, 36 bp, Artificial Sequence
  Synthetic oligonucleotide
gagtgcagtcaggcgttagggatggaagagaggtga

SEQ ID NO: 91599 - DNA, 38 bp, Artificial Sequence
  Synthetic oligonucleotide
acagcctcacctactatgctgcatctattcatgggtga

SEQ ID NO: 91600 - DNA, 38 bp, Artificial Sequence
  Synthetic oligonucleotide
tgagtcaccgttctgggcttgaatcttctcctgtgtga

SEQ ID NO: 91601 - DNA, 38 bp, Artificial Sequence
  Synthetic oligonucleotide
agtagtgctgtttggttctcatcgccgcacctttgtga

SEQ ID NO: 91602 - DNA, 38 bp, Artificial Sequence
  Synthetic oligonucleotide
cctgccgcacgcaacacctatggactgtttcaccttga

SEQ ID NO: 91603 - DNA, 38 bp, Artificial Sequence
  Synthetic oligonucleotide
atgccaccgtccactgtgctcccatgcctcccccttga

SEQ ID NO: 91604 - DNA, 38 bp, Artificial Sequence
  Synthetic oligonucleotide
tcatgtccagctcgtagccgcgcaatatttggccttga

SEQ ID NO: 91605 - DNA, 38 bp, Artificial Sequence
  Synthetic oligonucleotide
tgtccccatctgtgatcatagatcgctaatctccttga

SEQ ID NO: 91606 - DNA, 36 bp, Artificial Sequence
  Synthetic oligonucleotide
tacgtctgcggacggagtaccagacgttcaagttga

SEQ ID NO: 91607 - DNA, 37 bp, Artificial Sequence
  Synthetic oligonucleotide
atccaaccaagcgtgtaatggagcacgttatggttga

SEQ ID NO: 91608 - DNA, 37 bp, Artificial Sequence
  Synthetic oligonucleotide
tgagggagtgaggggggggacttagtatcggtgttga

SEQ ID NO: 91609 - DNA, 36 bp, Artificial Sequence
  Synthetic oligonucleotide
tcctgactggccgagttgaggccttagatcttttga

SEQ ID NO: 91610 - DNA, 36 bp, Artificial Sequence
  Synthetic oligonucleotide
acgcggcactccaagcatccgtttacctcgttcata

SEQ ID NO: 91611 - DNA, 35 bp, Artificial Sequence
  Synthetic oligonucleotide
tcatcacgatcttgggcgtgttttttacctttata

SEQ ID NO: 91612 - DNA, 36 bp, Artificial Sequence
  Synthetic oligonucleotide
gtgcagggagcaggggatggaattgagaacgtacta

SEQ ID NO: 91613 - DNA, 36 bp, Artificial Sequence
  Synthetic oligonucleotide
tctgccctgcaagctacttacttagtccacagccta

SEQ ID NO: 91614 - DNA, 36 bp, Artificial Sequence
  Synthetic oligonucleotide
gttcagtgcgtcaaccgtcgatcgccacatccgcta

SEQ ID NO: 91615 - DNA, 35 bp, Artificial Sequence
  Synthetic oligonucleotide
ggagacgtacactggttaaattacctttgcctcta

SEQ ID NO: 91616 - DNA, 36 bp, Artificial Sequence
  Synthetic oligonucleotide
gactgagcaacttggaagagggagggcgggggagta

SEQ ID NO: 91617 - DNA, 36 bp, Artificial Sequence
  Synthetic oligonucleotide
acacagccgcatgaatcatcgcggtgttactccgta

SEQ ID NO: 91618 - DNA, 36 bp, Artificial Sequence
  Synthetic oligonucleotide
gagtgatagtaggggggtaggataacggtctcatta

SEQ ID NO: 91619 - DNA, 35 bp, Artificial Sequence
  Synthetic oligonucleotide
gttcacgttcgtctattcttttaccgtactactta

SEQ ID NO: 91620 - DNA, 36 bp, Artificial Sequence
  Synthetic oligonucleotide
gaggaccgccctgtaactcgtggtattatcccctta

SEQ ID NO: 91621 - DNA, 35 bp, Artificial Sequence
  Synthetic oligonucleotide
gtaccacctcagtgcgcttagaatttcatctccac

SEQ ID NO: 91622 - DNA, 35 bp, Artificial Sequence
  Synthetic oligonucleotide
actgaaccaccccaaacgattgtccatagacagac

SEQ ID NO: 91623 - DNA, 35 bp, Artificial Sequence
  Synthetic oligonucleotide
accgggtgggatgggaggaactaaatggaatcgac

SEQ ID NO: 91624 - DNA, 35 bp, Artificial Sequence
  Synthetic oligonucleotide
gatcctctccagtggccaccagggcaccgaaatac

SEQ ID NO: 91625 - DNA, 35 bp, Artificial Sequence
  Synthetic oligonucleotide
tcccaacatcgattaatcgccgggttcctacatac

SEQ ID NO: 91626 - DNA, 35 bp, Artificial Sequence
  Synthetic oligonucleotide
accaagcagacgtacataaactacagtctgccccc

SEQ ID NO: 91627 - DNA, 35 bp, Artificial Sequence
  Synthetic oligonucleotide
tgaaagccgaggccgtcgtttcgttcgctattccc

SEQ ID NO: 91628 - DNA, 35 bp, Artificial Sequence
  Synthetic oligonucleotide
tacgccccatcccttccatatcgtcaaccggcgcc

SEQ ID NO: 91629 - DNA, 35 bp, Artificial Sequence
  Synthetic oligonucleotide
gatacctgctgttgagacgcctcacagaacttgcc

SEQ ID NO: 91630 - DNA, 34 bp, Artificial Sequence
  Synthetic oligonucleotide
atgcaagcttaattcctgcgggtctccgatctcc

SEQ ID NO: 91631 - DNA, 35 bp, Artificial Sequence
  Synthetic oligonucleotide
acgaagcaccgatgcctgtcttcattcacatccgc

SEQ ID NO: 91632 - DNA, 35 bp, Artificial Sequence
  Synthetic oligonucleotide
tctccctgccgcgaatcacattacttatgtcctgc

SEQ ID NO: 91633 - DNA, 35 bp, Artificial Sequence
  Synthetic oligonucleotide
aaagtgcaacaccactagcttctcataggcaactc

SEQ ID NO: 91634 - DNA, 35 bp, Artificial Sequence
  Synthetic oligonucleotide
gggtgggcatggtgatgcgtcgtttttccttactc

SEQ ID NO: 91635 - DNA, 35 bp, Artificial Sequence
  Synthetic oligonucleotide
gattcgcggagtcctttctatcccattagtgcttc

SEQ ID NO: 91636 - DNA, 35 bp, Artificial Sequence
  Synthetic oligonucleotide
acatgcggttgaacggaagggagtatacctttaag

SEQ ID NO: 91637 - DNA, 35 bp, Artificial Sequence
  Synthetic oligonucleotide
taccccgccgccaatgtctcctgactcatttctag

SEQ ID NO: 91638 - DNA, 35 bp, Artificial Sequence
  Synthetic oligonucleotide
aaacactgacaccccttggaaggaacagctggtag

SEQ ID NO: 91639 - DNA, 35 bp, Artificial Sequence
  Synthetic oligonucleotide
tgattggggccgaaatgaggggctaaccgttgacg

SEQ ID NO: 91640 - DNA, 35 bp, Artificial Sequence
  Synthetic oligonucleotide
gaccagtcgggggaggatcttccgggggggccccg

SEQ ID NO: 91641 - DNA, 35 bp, Artificial Sequence
  Synthetic oligonucleotide
gcatcacggggcaacctatacgacatgcgacgccg

SEQ ID NO: 91642 - DNA, 35 bp, Artificial Sequence
  Synthetic oligonucleotide
gtcaacacaacgtccactgatcaataccacctgcg

SEQ ID NO: 91643 - DNA, 35 bp, Artificial Sequence
  Synthetic oligonucleotide
gagtggactcgacaggagggggtggcggtagaagg

SEQ ID NO: 91644 - DNA, 35 bp, Artificial Sequence
  Synthetic oligonucleotide
tcatgcggggtggctcgggaaaggactacgactgg

SEQ ID NO: 91645 - DNA, 35 bp, Artificial Sequence
  Synthetic oligonucleotide
gagcgtgtagctaattgatccccccccgttattgg

SEQ ID NO: 91646 - DNA, 35 bp, Artificial Sequence
  Synthetic oligonucleotide
gttgacgacacgtgctttggccccaatgatctctg

SEQ ID NO: 91647 - DNA, 35 bp, Artificial Sequence
  Synthetic oligonucleotide
tccgcccgatgatctttacacccgctatttgagtg

SEQ ID NO: 91648 - DNA, 35 bp, Artificial Sequence
  Synthetic oligonucleotide
gtgccaagttcgaccgctaacgtcagccatttgtg

SEQ ID NO: 91649 - DNA, 35 bp, Artificial Sequence
  Synthetic oligonucleotide
ttatgccaatctatcacgtacagggccttgctttg

SEQ ID NO: 91650 - DNA, 35 bp, Artificial Sequence
  Synthetic oligonucleotide
gactgccatccggactaaagtctgtccaatcacat

SEQ ID NO: 91651 - DNA, 35 bp, Artificial Sequence
  Synthetic oligonucleotide
atttaggcccgtaccatcgctcagatcgaccccat

SEQ ID NO: 91652 - DNA, 35 bp, Artificial Sequence
  Synthetic oligonucleotide
taacgcctggtgcctacaagtccggaatgtcccat

SEQ ID NO: 91653 - DNA, 35 bp, Artificial Sequence
  Synthetic oligonucleotide
gtgggcacggcgcattaggtctgtttggtcgccat

SEQ ID NO: 91654 - DNA, 35 bp, Artificial Sequence
  Synthetic oligonucleotide
gtcaagcgctagtttggccaaacccccggatccat

SEQ ID NO: 91655 - DNA, 35 bp, Artificial Sequence
  Synthetic oligonucleotide
tcagaaggggaggtgcatgttcgcaataaatcgat

SEQ ID NO: 91656 - DNA, 35 bp, Artificial Sequence
  Synthetic oligonucleotide
agataaggtggggggaggtggttaaccggcgggat

SEQ ID NO: 91657 - DNA, 35 bp, Artificial Sequence
  Synthetic oligonucleotide
acaatcacgacggggtaaaggaaggagcggttgat

SEQ ID NO: 91658 - DNA, 35 bp, Artificial Sequence
  Synthetic oligonucleotide
tatgttagcgtagcaaccgccggttcccactcact

SEQ ID NO: 91659 - DNA, 35 bp, Artificial Sequence
  Synthetic oligonucleotide
aatgcggggggtagcggtgggtggggtcaaagact

SEQ ID NO: 91660 - DNA, 35 bp, Artificial Sequence
  Synthetic oligonucleotide
tatgctaggcacgccacaactgaaacttaagccct

SEQ ID NO: 91661 - DNA, 35 bp, Artificial Sequence
  Synthetic oligonucleotide
tgtggccacttgctgattctaagtttaaactgtct

SEQ ID NO: 91662 - DNA, 35 bp, Artificial Sequence
  Synthetic oligonucleotide
atatgagcgggcgacgtggttcgtgcgcgtgttct

SEQ ID NO: 91663 - DNA, 35 bp, Artificial Sequence
  Synthetic oligonucleotide
ggagaacgtgaggggagttcaagcgggcaaatagt

SEQ ID NO: 91664 - DNA, 35 bp, Artificial Sequence
  Synthetic oligonucleotide
gttcaacagacctcgttctatatgtcccactctgt

SEQ ID NO: 91665 - DNA, 34 bp, Artificial Sequence
  Synthetic oligonucleotide
gaatggctctattgtcgtatcgtcacacgccctt

SEQ ID NO: 91666 - DNA, 36 bp, Artificial Sequence
  Synthetic oligonucleotide
gccaccgcggaaggacaaacctgacgaagaatgaaa

SEQ ID NO: 91667 - DNA, 36 bp, Artificial Sequence
  Synthetic oligonucleotide
aggaaggggggggccgggaaagctgggtacacacaa

SEQ ID NO: 91668 - DNA, 36 bp, Artificial Sequence
  Synthetic oligonucleotide
gttgactacgtgtgctatagccgccctatcttacaa

SEQ ID NO: 91669 - DNA, 36 bp, Artificial Sequence
  Synthetic oligonucleotide
gctaccgggggggaaagaaggacagaaaatggtcaa

SEQ ID NO: 91670 - DNA, 36 bp, Artificial Sequence
  Synthetic oligonucleotide
acgacgcaagaaaagtgatagtatatagtggtagaa

SEQ ID NO: 91671 - DNA, 36 bp, Artificial Sequence
  Synthetic oligonucleotide
gtgatcagggagggtggacgcgtaaagaagggggaa

SEQ ID NO: 91672 - DNA, 35 bp, Artificial Sequence
  Synthetic oligonucleotide
gcacctggatcatggggccaggggccatttcctaa

SEQ ID NO: 91673 - DNA, 36 bp, Artificial Sequence
  Synthetic oligonucleotide
atgcacacttcacttttcgtccacatgtctttgtaa

SEQ ID NO: 91674 - DNA, 36 bp, Artificial Sequence
  Synthetic oligonucleotide
atctgaccccagtgatgtctgcctcgggtaggaaca

SEQ ID NO: 91675 - DNA, 35 bp, Artificial Sequence
  Synthetic oligonucleotide
ggatcggatgtcccctatagcgctttacttcacca

SEQ ID NO: 91676 - DNA, 36 bp, Artificial Sequence
  Synthetic oligonucleotide
gcacatctgcctttgcgaaaccttgccttgcatcca

SEQ ID NO: 91677 - DNA, 36 bp, Artificial Sequence
  Synthetic oligonucleotide
tcacgacgacgtgcagagggtagtgttctggctcca

SEQ ID NO: 91678 - DNA, 36 bp, Artificial Sequence
  Synthetic oligonucleotide
atgctggcaggtctcgctaccaccatgctttacgca

SEQ ID NO: 91679 - DNA, 35 bp, Artificial Sequence
  Synthetic oligonucleotide
gtacgctgcctttaagctgctgccgccccttcgca

SEQ ID NO: 91680 - DNA, 36 bp, Artificial Sequence
  Synthetic oligonucleotide
acgacgatggggggtaggcgggacggtaggcatgca

SEQ ID NO: 91681 - DNA, 36 bp, Artificial Sequence
  Synthetic oligonucleotide
gcacgacaaccatgagtccaatccactcgctttgca

SEQ ID NO: 91682 - DNA, 36 bp, Artificial Sequence
  Synthetic oligonucleotide
acacctaccaaacaggccatactcgcactgctatca

SEQ ID NO: 91683 - DNA, 36 bp, Artificial Sequence
  Synthetic oligonucleotide
gatgtgcggttgtaggagggcatctgcgaatcaaga

SEQ ID NO: 91684 - DNA, 36 bp, Artificial Sequence
  Synthetic oligonucleotide
tctgtcggacgtgggtataatggaaaaggaatgaga

SEQ ID NO: 91685 - DNA, 36 bp, Artificial Sequence
  Synthetic oligonucleotide
gtaggggtgggaggagcgagggacgtgtcaaataga

SEQ ID NO: 91686 - DNA, 36 bp, Artificial Sequence
  Synthetic oligonucleotide
tgaaagtgctgtggacatagggacaggggggctaga

SEQ ID NO: 91687 - DNA, 37 bp, Artificial Sequence
  Synthetic oligonucleotide
tgaggggttaggttgagggatggaaagggccggtaga

SEQ ID NO: 91688 - DNA, 37 bp, Artificial Sequence
  Synthetic oligonucleotide
tcacgggataagtgtgggatgggagggaagcaaacga

SEQ ID NO: 91689 - DNA, 37 bp, Artificial Sequence
  Synthetic oligonucleotide
gcgtacggtcagtctttctcaggtacataaccaccga

SEQ ID NO: 91690 - DNA, 37 bp, Artificial Sequence
  Synthetic oligonucleotide
gtcacacgcagctcctcatctaacccggtttcaccga

SEQ ID NO: 91691 - DNA, 37 bp, Artificial Sequence
  Synthetic oligonucleotide
ttgcgaaccgatcaaagtactacaagttcaaccccga

SEQ ID NO: 91692 - DNA, 36 bp, Artificial Sequence
  Synthetic oligonucleotide
tacaccctggtattcaatacactcggccgttgccga

SEQ ID NO: 91693 - DNA, 37 bp, Artificial Sequence
  Synthetic oligonucleotide
tctcgcggctcagtttcgtgctgtaacacccctccga

SEQ ID NO: 91694 - DNA, 35 bp, Artificial Sequence
  Synthetic oligonucleotide
agggacggaggccatgaataaactggacggagcga

SEQ ID NO: 91695 - DNA, 37 bp, Artificial Sequence
  Synthetic oligonucleotide
aagcacacacatcgcctttgagtcgcgaccatctcga

SEQ ID NO: 91696 - DNA, 37 bp, Artificial Sequence
  Synthetic oligonucleotide
tgcccatcccctcgtaaatgcagtgcgttgaattcga

SEQ ID NO: 91697 - DNA, 36 bp, Artificial Sequence
  Synthetic oligonucleotide
gttggacgtcacggaggggtgggaaatctggaagga

SEQ ID NO: 91698 - DNA, 37 bp, Artificial Sequence
  Synthetic oligonucleotide
tcccatccctcattgtgtagccttcatgcgtacagga

SEQ ID NO: 91699 - DNA, 37 bp, Artificial Sequence
  Synthetic oligonucleotide
gaacaccgtcccaatactgtccactcctcgccccgga

SEQ ID NO: 91700 - DNA, 37 bp, Artificial Sequence
  Synthetic oligonucleotide
atcacgccggccctgactatgtaacacgggagaggga

SEQ ID NO: 91701 - DNA, 37 bp, Artificial Sequence
  Synthetic oligonucleotide
gggaacgtgccgcaggtggaaggggattaaatgggga

SEQ ID NO: 91702 - DNA, 37 bp, Artificial Sequence
  Synthetic oligonucleotide
gccggtaaataagcaatggcgggaagaactggtggga

SEQ ID NO: 91703 - DNA, 37 bp, Artificial Sequence
  Synthetic oligonucleotide
gtcctaagtcgggatgtgccccagggctgggttggga

SEQ ID NO: 91704 - DNA, 37 bp, Artificial Sequence
  Synthetic oligonucleotide
gacagagagcaaagggcgggaacggacagaacctgga

SEQ ID NO: 91705 - DNA, 37 bp, Artificial Sequence
  Synthetic oligonucleotide
gtgagagtgcagggcggggaatggcgtgatctgtgga

SEQ ID NO: 91706 - DNA, 37 bp, Artificial Sequence
  Synthetic oligonucleotide
ttaggacgtagggcgggaatggaaagggaccgaatga

SEQ ID NO: 91707 - DNA, 38 bp, Artificial Sequence
  Synthetic oligonucleotide
gacacccagctgagcactagtcattcatctcgtaatga

SEQ ID NO: 91708 - DNA, 38 bp, Artificial Sequence
  Synthetic oligonucleotide
gcaacgcaaccacttaaggatcatcgacttcccgatga

SEQ ID NO: 91709 - DNA, 38 bp, Artificial Sequence
  Synthetic oligonucleotide
tgcagatagaaggtgggtgaccagaggaaacgggatga

SEQ ID NO: 91710 - DNA, 38 bp, Artificial Sequence
  Synthetic oligonucleotide
ggaagtgcaggtagtgggaggcgggatgcagtatatga

SEQ ID NO: 91711 - DNA, 38 bp, Artificial Sequence
  Synthetic oligonucleotide
gatgaggcggagatatataaacaacgtgatgagactga

SEQ ID NO: 91712 - DNA, 38 bp, Artificial Sequence
  Synthetic oligonucleotide
attccagcagcaggatataccgtagctgcccttactga

SEQ ID NO: 91713 - DNA, 38 bp, Artificial Sequence
  Synthetic oligonucleotide
gaggacatgccctcatatcccagaacccggattcctga

SEQ ID NO: 91714 - DNA, 38 bp, Artificial Sequence
  Synthetic oligonucleotide
aacatcacaagtgaggagtataagcaggtataagctga

SEQ ID NO: 91715 - DNA, 38 bp, Artificial Sequence
  Synthetic oligonucleotide
acgagcggaggcgggattggggagggtgaagacgctga

SEQ ID NO: 91716 - DNA, 38 bp, Artificial Sequence
  Synthetic oligonucleotide
gaaacgaagtggtgatggatgtacggatgccccgctga

SEQ ID NO: 91717 - DNA, 36 bp, Artificial Sequence
  Synthetic oligonucleotide
gaccacacggtcccctatatcaacgcatttcgctga

SEQ ID NO: 91718 - DNA, 38 bp, Artificial Sequence
  Synthetic oligonucleotide
taccaccctaacgactttttggacatccttgttagtga

SEQ ID NO: 91719 - DNA, 38 bp, Artificial Sequence
  Synthetic oligonucleotide
atctccccatcgctcaattcgcctttcgttacaggtga

SEQ ID NO: 91720 - DNA, 36 bp, Artificial Sequence
  Synthetic oligonucleotide
aaggccagacaggtggaaaacactaggcggaggtga

SEQ ID NO: 91721 - DNA, 37 bp, Artificial Sequence
  Synthetic oligonucleotide
gtgacatgatcaaggacggaggggatcaggtaggtga

SEQ ID NO: 91722 - DNA, 37 bp, Artificial Sequence
  Synthetic oligonucleotide
gtcatgggcgggggtggtaagagcgtagtaggggtga

SEQ ID NO: 91723 - DNA, 38 bp, Artificial Sequence
  Synthetic oligonucleotide
atagcctggccgtacatgtggggtgcggatcggggtga

SEQ ID NO: 91724 - DNA, 38 bp, Artificial Sequence
  Synthetic oligonucleotide
tacgacccgccgacagtcttaaaggagtggacatgtga

SEQ ID NO: 91725 - DNA, 38 bp, Artificial Sequence
  Synthetic oligonucleotide
atgcaccgctccgcagctgtacgaaaacgcgcttgtga

SEQ ID NO: 91726 - DNA, 38 bp, Artificial Sequence
  Synthetic oligonucleotide
tacaacactctttagcacagtcgcacacgtatttgtga

SEQ ID NO: 91727 - DNA, 38 bp, Artificial Sequence
  Synthetic oligonucleotide
tgtgggcctattccgtgagcgatccgcattttacttga

SEQ ID NO: 91728 - DNA, 38 bp, Artificial Sequence
  Synthetic oligonucleotide
agggacgggttacgggagtgggagggggagaaccttga

SEQ ID NO: 91729 - DNA, 37 bp, Artificial Sequence
  Synthetic oligonucleotide
gcctgtgttcagctacctaccttggtccacgccttga

SEQ ID NO: 91730 - DNA, 36 bp, Artificial Sequence
  Synthetic oligonucleotide
atcatcaccatatctgtgaatatcatcctgtcttga

SEQ ID NO: 91731 - DNA, 38 bp, Artificial Sequence
  Synthetic oligonucleotide
gcatgtgcgcaaatctgaaaccgtcgctactgtgttga

SEQ ID NO: 91732 - DNA, 38 bp, Artificial Sequence
  Synthetic oligonucleotide
tcatcgcacacaccatatggagccgaacgtacctttga

SEQ ID NO: 91733 - DNA, 36 bp, Artificial Sequence
  Synthetic oligonucleotide
aactgccactgccgacgctccatccttcggtccata

SEQ ID NO: 91734 - DNA, 36 bp, Artificial Sequence
  Synthetic oligonucleotide
tcctaagaaagcctgccgttacatggttcccgccta

SEQ ID NO: 91735 - DNA, 36 bp, Artificial Sequence
  Synthetic oligonucleotide
gcctgccatgagtctcattccacggagtgcaactta

SEQ ID NO: 91736 - DNA, 35 bp, Artificial Sequence
  Synthetic oligonucleotide
tcaccgcttcaacaggcttaaccaacacttttaac

SEQ ID NO: 91737 - DNA, 35 bp, Artificial Sequence
  Synthetic oligonucleotide
tatgactagccgcctctggtgcgtccctgttcgac

SEQ ID NO: 91738 - DNA, 35 bp, Artificial Sequence
  Synthetic oligonucleotide
ttgggaggcttctgccgccgttgccttcgacctac

SEQ ID NO: 91739 - DNA, 35 bp, Artificial Sequence
  Synthetic oligonucleotide
gttccacgactggaaaagctcctacgcctgtaacc

SEQ ID NO: 91740 - DNA, 35 bp, Artificial Sequence
  Synthetic oligonucleotide
gacccagcagaaatgagcttttgttcgcttgtacc

SEQ ID NO: 91741 - DNA, 35 bp, Artificial Sequence
  Synthetic oligonucleotide
acacggacaacgcacccggtcattctcagtctccc

SEQ ID NO: 91742 - DNA, 35 bp, Artificial Sequence
  Synthetic oligonucleotide
gctgatcgtgacagctcgtgccattatttcttccc

SEQ ID NO: 91743 - DNA, 35 bp, Artificial Sequence
  Synthetic oligonucleotide
ttgcattggcccttcagctagcatacccaccctcc

SEQ ID NO: 91744 - DNA, 35 bp, Artificial Sequence
  Synthetic oligonucleotide
gactaggggaacgaatgtcaagggtgagggtgtcc

SEQ ID NO: 91745 - DNA, 35 bp, Artificial Sequence
  Synthetic oligonucleotide
gtcaaagcggcctgcccccccacatcaggcgttcc

SEQ ID NO: 91746 - DNA, 35 bp, Artificial Sequence
  Synthetic oligonucleotide
tgttcgcccatatctatcgattcttttagggttcc

SEQ ID NO: 91747 - DNA, 35 bp, Artificial Sequence
  Synthetic oligonucleotide
aacacggaacactataacaagggataacaaggagc

SEQ ID NO: 91748 - DNA, 35 bp, Artificial Sequence
  Synthetic oligonucleotide
tcatcgatcagcctccctcacctacgacagtaatc

SEQ ID NO: 91749 - DNA, 35 bp, Artificial Sequence
  Synthetic oligonucleotide
gttgcatagttctcgttgcgcgaacatatcccatc

SEQ ID NO: 91750 - DNA, 35 bp, Artificial Sequence
  Synthetic oligonucleotide
tcccgccatcatcgaatactagatactttagcatc

SEQ ID NO: 91751 - DNA, 35 bp, Artificial Sequence
  Synthetic oligonucleotide
agttagcgcaggatatatacacctcaactcaagtc

SEQ ID NO: 91752 - DNA, 36 bp, Artificial Sequence
  Synthetic oligonucleotide
aatggtaggcatagtggcaaagccgtcctgaaattc

SEQ ID NO: 91753 - DNA, 35 bp, Artificial Sequence
  Synthetic oligonucleotide
atcagacgcatgtgcgtatgcttaacttccaattc

SEQ ID NO: 91754 - DNA, 35 bp, Artificial Sequence
  Synthetic oligonucleotide
gttgcttccaggttgtaaacctgacctttaacttc

SEQ ID NO: 91755 - DNA, 35 bp, Artificial Sequence
  Synthetic oligonucleotide
taatcacaatggcttaagccgtcaatgctactttc

SEQ ID NO: 91756 - DNA, 32 bp, Artificial Sequence
  Synthetic oligonucleotide
tagacaactgactctctggtcccctaagtttc

SEQ ID NO: 91757 - DNA, 35 bp, Artificial Sequence
  Synthetic oligonucleotide
atccacctgcagatcccaggtaaatatcttacacg

SEQ ID NO: 91758 - DNA, 35 bp, Artificial Sequence
  Synthetic oligonucleotide
atccgagctggctctcttgatgtccttttacgccg

SEQ ID NO: 91759 - DNA, 35 bp, Artificial Sequence
  Synthetic oligonucleotide
tgcatgaccgcaatcgaggacttgagagatgagcg

SEQ ID NO: 91760 - DNA, 35 bp, Artificial Sequence
  Synthetic oligonucleotide
tatgctcaaaggcgaaaggggagggggtgtacgcg

SEQ ID NO: 91761 - DNA, 35 bp, Artificial Sequence
  Synthetic oligonucleotide
tcaccgccgaggcatgcgggttggttccttggggg

SEQ ID NO: 91762 - DNA, 35 bp, Artificial Sequence
  Synthetic oligonucleotide
gaatcggtgcaggcaatagacataattgggtgtgg

SEQ ID NO: 91763 - DNA, 35 bp, Artificial Sequence
  Synthetic oligonucleotide
gtggttgaaggaggtaataacgaacgggccggatg

SEQ ID NO: 91764 - DNA, 35 bp, Artificial Sequence
  Synthetic oligonucleotide
atgcacctccggtattgcctcacacaccgtgcctg

SEQ ID NO: 91765 - DNA, 35 bp, Artificial Sequence
  Synthetic oligonucleotide
ttgaggaagactggtgggagaggcggtggtggcat

SEQ ID NO: 91766 - DNA, 35 bp, Artificial Sequence
  Synthetic oligonucleotide
ggggagtgggtggttggttgtgtagggtggtggat

SEQ ID NO: 91767 - DNA, 35 bp, Artificial Sequence
  Synthetic oligonucleotide
atgtggtggacgagcttggaaaatggtctggaact

SEQ ID NO: 91768 - DNA, 35 bp, Artificial Sequence
  Synthetic oligonucleotide
gtccggccagtaccatgtgacgccccattcaccct

SEQ ID NO: 91769 - DNA, 35 bp, Artificial Sequence
  Synthetic oligonucleotide
gcccgcctaagatatcgtgtcgtcacgctctccct

SEQ ID NO: 91770 - DNA, 34 bp, Artificial Sequence
  Synthetic oligonucleotide
gcctgccccagtccgtccctaattaaacgaagct

SEQ ID NO: 91771 - DNA, 35 bp, Artificial Sequence
  Synthetic oligonucleotide
gaaacggacgcgatgtttttttggttctggcatgt

SEQ ID NO: 91772 - DNA, 35 bp, Artificial Sequence
  Synthetic oligonucleotide
atcgtgtaggcgagtggagagaggttcggtcgtgt

SEQ ID NO: 91773 - DNA, 35 bp, Artificial Sequence
  Synthetic oligonucleotide
actaatccgggcgccgtgcttatctctgtccgatt

SEQ ID NO: 91774 - DNA, 35 bp, Artificial Sequence
  Synthetic oligonucleotide
gactccatcccctgaattgacgctgccactgtatt

SEQ ID NO: 91775 - DNA, 35 bp, Artificial Sequence
  Synthetic oligonucleotide
tacgacgttccctggccttgtaccccgagcccttt

SEQ ID NO: 91776 - DNA, 35 bp, Artificial Sequence
  Synthetic oligonucleotide
tgccttcctcctagccgttcctgacgttttgaaaa

SEQ ID NO: 91777 - DNA, 35 bp, Artificial Sequence
  Synthetic oligonucleotide
gtgggcggggcatgatgggcagtgaagatagcaaa

SEQ ID NO: 91778 - DNA, 36 bp, Artificial Sequence
  Synthetic oligonucleotide
gtggggtgatagaggggtaacggcggaagtaggaaa

SEQ ID NO: 91779 - DNA, 35 bp, Artificial Sequence
  Synthetic oligonucleotide
aaggggcgtacgggggcacctactcttactggaaa

SEQ ID NO: 91780 - DNA, 35 bp, Artificial Sequence
  Synthetic oligonucleotide
ttacccgagcctcaggggctatcctctcccgtaaa

SEQ ID NO: 91781 - DNA, 35 bp, Artificial Sequence
  Synthetic oligonucleotide
agcccacgcctgcgaagtgattacccttacaacaa

SEQ ID NO: 91782 - DNA, 37 bp, Artificial Sequence
  Synthetic oligonucleotide
aacatgaggagggaagtacgcgtaattggcgtgacaa

SEQ ID NO: 91783 - DNA, 36 bp, Artificial Sequence
  Synthetic oligonucleotide
agcctgtacgacctaatctgcactcccggttaccaa

SEQ ID NO: 91784 - DNA, 36 bp, Artificial Sequence
  Synthetic oligonucleotide
gacactactagacaacagctatcaaggggaggccaa

SEQ ID NO: 91785 - DNA, 36 bp, Artificial Sequence
  Synthetic oligonucleotide
tttgacatcgctccatcaagcccccgcctttgtcaa

SEQ ID NO: 91786 - DNA, 36 bp, Artificial Sequence
  Synthetic oligonucleotide
atgtgaagacaacgccgcccgtccacgctcaacgaa

SEQ ID NO: 91787 - DNA, 36 bp, Artificial Sequence
  Synthetic oligonucleotide
gatgcgctggtgtaggcagtcagcaagaatgacgaa

SEQ ID NO: 91788 - DNA, 36 bp, Artificial Sequence
  Synthetic oligonucleotide
gtgccagaaccggagtgcgcaaagtcgtagccggaa

SEQ ID NO: 91789 - DNA, 35 bp, Artificial Sequence
  Synthetic oligonucleotide
ttcaagcccacacttttggtaccacccaggtctaa

SEQ ID NO: 91790 - DNA, 36 bp, Artificial Sequence
  Synthetic oligonucleotide
gcctcgcaatcggttacatctgttctgtacttgtaa

SEQ ID NO: 91791 - DNA, 36 bp, Artificial Sequence
  Synthetic oligonucleotide
gctaccacccatgttccccactgcattgtcatttaa

SEQ ID NO: 91792 - DNA, 35 bp, Artificial Sequence
  Synthetic oligonucleotide
tcacggtagcgcgaaaacgtctacgcccacccaca

SEQ ID NO: 91793 - DNA, 36 bp, Artificial Sequence
  Synthetic oligonucleotide
aacaggggaacggggaagacctgtgtacgctgcaca

SEQ ID NO: 91794 - DNA, 35 bp, Artificial Sequence
  Synthetic oligonucleotide
aagtccacgcagacaggggaggggggaggcagaca

SEQ ID NO: 91795 - DNA, 36 bp, Artificial Sequence
  Synthetic oligonucleotide
tctaacctgccttcattggtattgcgctttaaacca

SEQ ID NO: 91796 - DNA, 36 bp, Artificial Sequence
  Synthetic oligonucleotide
taccagagcgcctttgctttaaaattactctgccca

SEQ ID NO: 91797 - DNA, 37 bp, Artificial Sequence
  Synthetic oligonucleotide
aacaaggcctactggcaagaaatgggtcccacctcca

SEQ ID NO: 91798 - DNA, 36 bp, Artificial Sequence
  Synthetic oligonucleotide
taggttggttcagggggtgggagggaggattgcgca

SEQ ID NO: 91799 - DNA, 36 bp, Artificial Sequence
  Synthetic oligonucleotide
ggtacggatggggtggtacaggggttcggacgtgca

SEQ ID NO: 91800 - DNA, 36 bp, Artificial Sequence
  Synthetic oligonucleotide
gtggagcgtgcacagtacggtcgattccttctctca

SEQ ID NO: 91801 - DNA, 36 bp, Artificial Sequence
  Synthetic oligonucleotide
gcgatgcaccgctctgagtgagcttactttctctca

SEQ ID NO: 91802 - DNA, 36 bp, Artificial Sequence
  Synthetic oligonucleotide
gcctagttgcagtttgctcctcccgtacgtttctca

SEQ ID NO: 91803 - DNA, 35 bp, Artificial Sequence
  Synthetic oligonucleotide
gacgcaaggtctaggatctatattgctatctttca

SEQ ID NO: 91804 - DNA, 37 bp, Artificial Sequence
  Synthetic oligonucleotide
gcacactgctccttcatcgccttgagtagaaccaaga

SEQ ID NO: 91805 - DNA, 37 bp, Artificial Sequence
  Synthetic oligonucleotide
gatgcgagtaagggagacggggggtagcagacgcaga

SEQ ID NO: 91806 - DNA, 37 bp, Artificial Sequence
  Synthetic oligonucleotide
tgtatagcacgagaagttggaaagatgggaggcgaga

SEQ ID NO: 91807 - DNA, 37 bp, Artificial Sequence
  Synthetic oligonucleotide
gaaccgggcatgggaaacggaggctgtaagtgtgaga

SEQ ID NO: 91808 - DNA, 37 bp, Artificial Sequence
  Synthetic oligonucleotide
gagccgtatcaaagagaaaggggcggtaagaggtaga

SEQ ID NO: 91809 - DNA, 37 bp, Artificial Sequence
  Synthetic oligonucleotide
gaatgaggtggtgggtatagcgagattatcagttaga

SEQ ID NO: 91810 - DNA, 37 bp, Artificial Sequence
  Synthetic oligonucleotide
gccgccgctctgtacataccttgcctcttgataacga

SEQ ID NO: 91811 - DNA, 35 bp, Artificial Sequence
  Synthetic oligonucleotide
ggggacggggaatcggatgaagtggtgaggaccga

SEQ ID NO: 91812 - DNA, 37 bp, Artificial Sequence
  Synthetic oligonucleotide
accccccccgttattgcgattagcgcgttacctccga

SEQ ID NO: 91813 - DNA, 37 bp, Artificial Sequence
  Synthetic oligonucleotide
gccacacactgcctcgagggccagttgctaagtgcga

SEQ ID NO: 91814 - DNA, 37 bp, Artificial Sequence
  Synthetic oligonucleotide
tagagccgaccaatgccaaagttagaaggaaaatcga

SEQ ID NO: 91815 - DNA, 37 bp, Artificial Sequence
  Synthetic oligonucleotide
tcctcgcaagggacgtgtactttgccttctcaatcga

SEQ ID NO: 91816 - DNA, 37 bp, Artificial Sequence
  Synthetic oligonucleotide
tcactccatccgtaaacgatcatagcatcgtaatcga

SEQ ID NO: 91817 - DNA, 37 bp, Artificial Sequence
  Synthetic oligonucleotide
tgctgaccctgagagggggaattcgaggaaggaagga

SEQ ID NO: 91818 - DNA, 37 bp, Artificial Sequence
  Synthetic oligonucleotide
aaccacgggagtaggttacaggagaccgggggaagga

SEQ ID NO: 91819 - DNA, 37 bp, Artificial Sequence
  Synthetic oligonucleotide
ggacggggtccacaatgacgggggaaacaacggagga

SEQ ID NO: 91820 - DNA, 37 bp, Artificial Sequence
  Synthetic oligonucleotide
gaaccgaacagtgcgtatcccgcgtataacctacgga

SEQ ID NO: 91821 - DNA, 36 bp, Artificial Sequence
  Synthetic oligonucleotide
gacccctcatcccagagtacgtccacggtaaccgga

SEQ ID NO: 91822 - DNA, 37 bp, Artificial Sequence
  Synthetic oligonucleotide
ttcatggggtggtggtaacaagtaggctgtacgcgga

SEQ ID NO: 91823 - DNA, 37 bp, Artificial Sequence
  Synthetic oligonucleotide
atgcgggagagtgaggggaggctggttcttaatcgga

SEQ ID NO: 91824 - DNA, 36 bp, Artificial Sequence
  Synthetic oligonucleotide
gcacatcttgtttagccttctttgccctttctcgga

SEQ ID NO: 91825 - DNA, 37 bp, Artificial Sequence
  Synthetic oligonucleotide
accccctgccgtacactgtaatcttggatacacggga

SEQ ID NO: 91826 - DNA, 37 bp, Artificial Sequence
  Synthetic oligonucleotide
tgcccaccaacctgtatgccttgcccgtgaatgggga

SEQ ID NO: 91827 - DNA, 37 bp, Artificial Sequence
  Synthetic oligonucleotide
aacactgccgcaaatgtcatccatacttccgcgtgga

SEQ ID NO: 91828 - DNA, 37 bp, Artificial Sequence
  Synthetic oligonucleotide
acctgccattgcatctttttgaacgcgtgcctttgga

SEQ ID NO: 91829 - DNA, 38 bp, Artificial Sequence
  Synthetic oligonucleotide
gtccaccgcagacggttggcccattgtcataggaatga

SEQ ID NO: 91830 - DNA, 37 bp, Artificial Sequence
  Synthetic oligonucleotide
gtgggggaaaattggggtagtgagatggccaccatga

SEQ ID NO: 91831 - DNA, 38 bp, Artificial Sequence
  Synthetic oligonucleotide
gacgacatacaaggggctcaggggacacacggtcatga

SEQ ID NO: 91832 - DNA, 38 bp, Artificial Sequence
  Synthetic oligonucleotide
gacggagtgccgtaggggagagagtggaaacaggatga

SEQ ID NO: 91833 - DNA, 37 bp, Artificial Sequence
  Synthetic oligonucleotide
ggaaaaggtggccgggttgagaagaaacggtggatga

SEQ ID NO: 91834 - DNA, 36 bp, Artificial Sequence
  Synthetic oligonucleotide
taccgaacgccacgacctgcaacaaggactttatga

SEQ ID NO: 91835 - DNA, 38 bp, Artificial Sequence
  Synthetic oligonucleotide
gacaccacagtggagcataggtatggcatgaacgctga

SEQ ID NO: 91836 - DNA, 37 bp, Artificial Sequence
  Synthetic oligonucleotide
gccactatctatatcgaaatactcactgtcatgctga

SEQ ID NO: 91837 - DNA, 38 bp, Artificial Sequence
  Synthetic oligonucleotide
atgcgcaagggtaagagcactcttaagagattaggtga

SEQ ID NO: 91838 - DNA, 38 bp, Artificial Sequence
  Synthetic oligonucleotide
tgaggacaggcagaaagacatcgggagtgtgggggtga

SEQ ID NO: 91839 - DNA, 37 bp, Artificial Sequence
  Synthetic oligonucleotide
tgagggagaccagagagtcttggtgtggcatgggtga

SEQ ID NO: 91840 - DNA, 37 bp, Artificial Sequence
  Synthetic oligonucleotide
gcacggtacgtgcttttgcgactctaccattctgtga

SEQ ID NO: 91841 - DNA, 38 bp, Artificial Sequence
  Synthetic oligonucleotide
atggcgaataagttagtggaagggagggatgggtgtga

SEQ ID NO: 91842 - DNA, 38 bp, Artificial Sequence
  Synthetic oligonucleotide
atgcggtcaacaatggcgcatggaagagaggacattga

SEQ ID NO: 91843 - DNA, 38 bp, Artificial Sequence
  Synthetic oligonucleotide
tcatggagcacttgcgtcatcacccttcgaatctttga

SEQ ID NO: 91844 - DNA, 38 bp, Artificial Sequence
  Synthetic oligonucleotide
tgtacgggccataggctgtctgttccacacttctttga

SEQ ID NO: 91845 - DNA, 38 bp, Artificial Sequence
  Synthetic oligonucleotide
tccaacgcccgtgtacggtttatgaattattggtttga

SEQ ID NO: 91846 - DNA, 38 bp, Artificial Sequence
  Synthetic oligonucleotide
gccgtctgtccctattgtgcccacttcactcattttga

SEQ ID NO: 91847 - DNA, 36 bp, Artificial Sequence
  Synthetic oligonucleotide
gcgctacccactgttttccaagttcgttaatgacta

SEQ ID NO: 91848 - DNA, 36 bp, Artificial Sequence
  Synthetic oligonucleotide
aagcacacacttccgtgtacggtccccacgttacta

SEQ ID NO: 91849 - DNA, 36 bp, Artificial Sequence
  Synthetic oligonucleotide
tcacggagctccctgatcctcgagctgtttcatcta

SEQ ID NO: 91850 - DNA, 36 bp, Artificial Sequence
  Synthetic oligonucleotide
gtgacctgccttcgttcgcacgagtctctatagtta

SEQ ID NO: 91851 - DNA, 36 bp, Artificial Sequence
  Synthetic oligonucleotide
atacatgcctggcgcccacttgttgaaataacgtta

SEQ ID NO: 91852 - DNA, 36 bp, Artificial Sequence
  Synthetic oligonucleotide
ttgcgcgctcgtccccatccggaaccgctattttta

SEQ ID NO: 91853 - DNA, 35 bp, Artificial Sequence
  Synthetic oligonucleotide
gactcctcgacgttcactgtccttaatttagtaac

SEQ ID NO: 91854 - DNA, 35 bp, Artificial Sequence
  Synthetic oligonucleotide
tagtgacacagattaggtcacttccggtctaccac

SEQ ID NO: 91855 - DNA, 35 bp, Artificial Sequence
  Synthetic oligonucleotide
gtccacctcgagccacaattaccaccttagtggac

SEQ ID NO: 91856 - DNA, 35 bp, Artificial Sequence
  Synthetic oligonucleotide
gcacagggtgcgggtagtggagtaaatagaaaacc

SEQ ID NO: 91857 - DNA, 34 bp, Artificial Sequence
  Synthetic oligonucleotide
tcaccaagtgctggtggtttgcattaggtcaacc

SEQ ID NO: 91858 - DNA, 35 bp, Artificial Sequence
  Synthetic oligonucleotide
tgtgctactgatttaatgcatccccgctgatcacc

SEQ ID NO: 91859 - DNA, 35 bp, Artificial Sequence
  Synthetic oligonucleotide
tatcctgcccatggtgattgctccaacctgagccc

SEQ ID NO: 91860 - DNA, 34 bp, Artificial Sequence
  Synthetic oligonucleotide
taagagccgccgttcgactcacgcgactttgccc

SEQ ID NO: 91861 - DNA, 35 bp, Artificial Sequence
  Synthetic oligonucleotide
tcaaccgcaaacgtgacttagccgctttttttccc

SEQ ID NO: 91862 - DNA, 35 bp, Artificial Sequence
  Synthetic oligonucleotide
gccaccttggcgcaacgtttactcctcctttggcc

SEQ ID NO: 91863 - DNA, 35 bp, Artificial Sequence
  Synthetic oligonucleotide
gattggtacccagatcggcaattaggcctctctcc

SEQ ID NO: 91864 - DNA, 35 bp, Artificial Sequence
  Synthetic oligonucleotide
acacccgcagtcccatcaatctagagtcctccgtc

SEQ ID NO: 91865 - DNA, 35 bp, Artificial Sequence
  Synthetic oligonucleotide
aagcaggcgcctgcccctgtgtcccccgctccttc

SEQ ID NO: 91866 - DNA, 32 bp, Artificial Sequence
  Synthetic oligonucleotide
tgattcagtcctttgcttcgtgccccaccgag

SEQ ID NO: 91867 - DNA, 37 bp, Artificial Sequence
  Synthetic oligonucleotide
gggacgaagagttcacaatagaggggtggcaggggag

SEQ ID NO: 91868 - DNA, 35 bp, Artificial Sequence
  Synthetic oligonucleotide
tatacactccaccgtcatgtttcaccaatagttag

SEQ ID NO: 91869 - DNA, 35 bp, Artificial Sequence
  Synthetic oligonucleotide
acccaattgcctcgctgtctttcgtttctggttag

SEQ ID NO: 91870 - DNA, 35 bp, Artificial Sequence
  Synthetic oligonucleotide
tccccaccgacgctcccgggcgctcaactcgtacg

SEQ ID NO: 91871 - DNA, 35 bp, Artificial Sequence
  Synthetic oligonucleotide
tcttgcatcgcagctttcctttctaatggcgcccg

SEQ ID NO: 91872 - DNA, 36 bp, Artificial Sequence
  Synthetic oligonucleotide
gcacacatccaggtctaccaggcacactacatttcg

SEQ ID NO: 91873 - DNA, 36 bp, Artificial Sequence
  Synthetic oligonucleotide
atggatttggagggggggtaagctgacgcggtgagg

SEQ ID NO: 91874 - DNA, 35 bp, Artificial Sequence
  Synthetic oligonucleotide
gattaagaggccataagatagagcaagcaaggggg

SEQ ID NO: 91875 - DNA, 35 bp, Artificial Sequence
  Synthetic oligonucleotide
gagggggagtagccgagtggtatcagggttggggg

SEQ ID NO: 91876 - DNA, 35 bp, Artificial Sequence
  Synthetic oligonucleotide
gcctgccccattgcttactgatataccctccctgg

SEQ ID NO: 91877 - DNA, 35 bp, Artificial Sequence
  Synthetic oligonucleotide
ggtccgagtcatatccattattttgcattccttgg

SEQ ID NO: 91878 - DNA, 35 bp, Artificial Sequence
  Synthetic oligonucleotide
atagcacccgtggaccatacactgaaattatcttg

SEQ ID NO: 91879 - DNA, 35 bp, Artificial Sequence
  Synthetic oligonucleotide
gaatgtccggggtggaaaagtcttaagacgtggat

SEQ ID NO: 91880 - DNA, 35 bp, Artificial Sequence
  Synthetic oligonucleotide
tccgaacgttcgattgcgaaatttttgcacgatat

SEQ ID NO: 91881 - DNA, 35 bp, Artificial Sequence
  Synthetic oligonucleotide
gcaccgcctggccctcgtaacaacaggcttacatt

SEQ ID NO: 91882 - DNA, 35 bp, Artificial Sequence
  Synthetic oligonucleotide
atatgcggagaggactgcaagggcggtgagtgatt

SEQ ID NO: 91883 - DNA, 36 bp, Artificial Sequence
  Synthetic oligonucleotide
ttgtcctccgcgcgttgcccttttctagcaacactt

SEQ ID NO: 91884 - DNA, 35 bp, Artificial Sequence
  Synthetic oligonucleotide
ggacagactctctcgcgcccatagggacccatctt

SEQ ID NO: 91885 - DNA, 35 bp, Artificial Sequence
  Synthetic oligonucleotide
gacgtcatacggcccaactcgaatacgaccttgtt

SEQ ID NO: 91886 - DNA, 35 bp, Artificial Sequence
  Synthetic oligonucleotide
agtgaggggacggggggcgtcaacgtttagtattt

SEQ ID NO: 91887 - DNA, 35 bp, Artificial Sequence
  Synthetic oligonucleotide
gcatcaacacaccgctgcaacgcctagccaccttt

SEQ ID NO: 91888 - DNA, 35 bp, Artificial Sequence
  Synthetic oligonucleotide
caccccgctcagggcgatgtttgaactgccccttt

SEQ ID NO: 91889 - DNA, 35 bp, Artificial Sequence
  Synthetic oligonucleotide
tgagggcgctattctgctcgcacttccacaagttt

SEQ ID NO: 91890 - DNA, 35 bp, Artificial Sequence
  Synthetic oligonucleotide
gtggtgcgtaccatccgttctattttcacgaaaaa

SEQ ID NO: 91891 - DNA, 33 bp, Artificial Sequence
  Synthetic oligonucleotide
gaccaagggcgggctgggggtcgtggcggaaaa

SEQ ID NO: 91892 - DNA, 36 bp, Artificial Sequence
  Synthetic oligonucleotide
atcgagccatgagcccctgctaggtacctgcacaaa

SEQ ID NO: 91893 - DNA, 36 bp, Artificial Sequence
  Synthetic oligonucleotide
tacggtgggagatcggaaaaggggtggggtggcaaa

SEQ ID NO: 91894 - DNA, 35 bp, Artificial Sequence
  Synthetic oligonucleotide
gacaaggcaacgttggtaaccctcggctgattaaa

SEQ ID NO: 91895 - DNA, 36 bp, Artificial Sequence
  Synthetic oligonucleotide
aaaccgtccgtatggcgcttcaacgttctacaccaa

SEQ ID NO: 91896 - DNA, 36 bp, Artificial Sequence
  Synthetic oligonucleotide
atcctagtgtgcccatccgttactgatacgtaccaa

SEQ ID NO: 91897 - DNA, 36 bp, Artificial Sequence
  Synthetic oligonucleotide
acgactgaacccccgtggaattaggctcctttccaa

SEQ ID NO: 91898 - DNA, 36 bp, Artificial Sequence
  Synthetic oligonucleotide
tctgtccgccccactgtcgtgcacctcctactgcaa

SEQ ID NO: 91899 - DNA, 35 bp, Artificial Sequence
  Synthetic oligonucleotide
acactcggtctatctgaactggtacctgacccgaa

SEQ ID NO: 91900 - DNA, 35 bp, Artificial Sequence
  Synthetic oligonucleotide
taaccctgtaccgctcgtgctatttcacggcctaa

SEQ ID NO: 91901 - DNA, 36 bp, Artificial Sequence
  Synthetic oligonucleotide
acactccgacatgaagcaagccctctctaacgttaa

SEQ ID NO: 91902 - DNA, 35 bp, Artificial Sequence
  Synthetic oligonucleotide
gacgctgacccgggattttaatttgttcactttaa

SEQ ID NO: 91903 - DNA, 35 bp, Artificial Sequence
  Synthetic oligonucleotide
tcccaatgcacgcctgagtggccaaatctcgtaca

SEQ ID NO: 91904 - DNA, 36 bp, Artificial Sequence
  Synthetic oligonucleotide
tacggtcgcgaagtgctctcgtgcaattgcccccca

SEQ ID NO: 91905 - DNA, 35 bp, Artificial Sequence
  Synthetic oligonucleotide
tacccacacactacatctcaagcctacgtttccca

SEQ ID NO: 91906 - DNA, 35 bp, Artificial Sequence
  Synthetic oligonucleotide
gaaccatgggagaatatgccgtttttgtgcctcca

SEQ ID NO: 91907 - DNA, 36 bp, Artificial Sequence
  Synthetic oligonucleotide
gtcgggggaagagtggagtggttggaaggggaagca

SEQ ID NO: 91908 - DNA, 36 bp, Artificial Sequence
  Synthetic oligonucleotide
tccaagcacgcaattgacccctatctagcctaggca

SEQ ID NO: 91909 - DNA, 36 bp, Artificial Sequence
  Synthetic oligonucleotide
gcatgtaggcgcgcccatcgaccgttttatcatgca

SEQ ID NO: 91910 - DNA, 36 bp, Artificial Sequence
  Synthetic oligonucleotide
tgcacgcagtgagatccgaccaccacatcacactca

SEQ ID NO: 91911 - DNA, 37 bp, Artificial Sequence
  Synthetic oligonucleotide
acgcatgaccagtcacaggtatccgctcccctcaaga

SEQ ID NO: 91912 - DNA, 37 bp, Artificial Sequence
  Synthetic oligonucleotide
atgacgtacgtccaggactattatggggccatccaga

SEQ ID NO: 91913 - DNA, 36 bp, Artificial Sequence
  Synthetic oligonucleotide
acgcggtcaaaccaggagaaaaatgatcgaaggaga

SEQ ID NO: 91914 - DNA, 37 bp, Artificial Sequence
  Synthetic oligonucleotide
gaagggcagtgggggtttgggttcttgctctcggaga

SEQ ID NO: 91915 - DNA, 38 bp, Artificial Sequence
  Synthetic oligonucleotide
gctgcagtcgtggtgcgaggggccgggtgagaatgaga

SEQ ID NO: 91916 - DNA, 37 bp, Artificial Sequence
  Synthetic oligonucleotide
attgcaaccactggtacttgatcctaattgacataga

SEQ ID NO: 91917 - DNA, 37 bp, Artificial Sequence
  Synthetic oligonucleotide
aatcacagccactgccatttatcaggcccaataacga

SEQ ID NO: 91918 - DNA, 37 bp, Artificial Sequence
  Synthetic oligonucleotide
ggatcactcacacgctcgcccagatccttgtccacga

SEQ ID NO: 91919 - DNA, 37 bp, Artificial Sequence
  Synthetic oligonucleotide
tattcaccggcagatagcgcactattcttccgcacga

SEQ ID NO: 91920 - DNA, 37 bp, Artificial Sequence
  Synthetic oligonucleotide
atcccacatcgtatatctcttcgaccgcccatgacga

SEQ ID NO: 91921 - DNA, 36 bp, Artificial Sequence
  Synthetic oligonucleotide
gttgacaccgcccgcactggtataccggctatacga

SEQ ID NO: 91922 - DNA, 37 bp, Artificial Sequence
  Synthetic oligonucleotide
atcctccgtctctcgtcctaagtcttgcggttcccga

SEQ ID NO: 91923 - DNA, 37 bp, Artificial Sequence
  Synthetic oligonucleotide
gtgaccgccgattgtagtcccagctgaaacaatccga

SEQ ID NO: 91924 - DNA, 37 bp, Artificial Sequence
  Synthetic oligonucleotide
atcgccgtgggatgtacggtgggaggtaaagggcgga

SEQ ID NO: 91925 - DNA, 37 bp, Artificial Sequence
  Synthetic oligonucleotide
ttggtaagtagttgggagtgggtagcatgaggaggga

SEQ ID NO: 91926 - DNA, 37 bp, Artificial Sequence
  Synthetic oligonucleotide
gaaggtggtagttacaatagtggctgatcaaacggga

SEQ ID NO: 91927 - DNA, 37 bp, Artificial Sequence
  Synthetic oligonucleotide
gggaggctggtggatggatcgaaaatacgggagggga

SEQ ID NO: 91928 - DNA, 36 bp, Artificial Sequence
  Synthetic oligonucleotide
gatgtaccgggcagaaagtgcgttgtatggctggga

SEQ ID NO: 91929 - DNA, 37 bp, Artificial Sequence
  Synthetic oligonucleotide
gttgacgaggcctcgagcgtgacattatgggcatgga

SEQ ID NO: 91930 - DNA, 35 bp, Artificial Sequence
  Synthetic oligonucleotide
gcaagccagtttcggtactgccctttctcgttgga

SEQ ID NO: 91931 - DNA, 37 bp, Artificial Sequence
  Synthetic oligonucleotide
tccacaatacgcaaacaaataaatgtcctgtccatga

SEQ ID NO: 91932 - DNA, 38 bp, Artificial Sequence
  Synthetic oligonucleotide
acgcaacagggttcgagacaagggcaaaatggcgatga

SEQ ID NO: 91933 - DNA, 37 bp, Artificial Sequence
  Synthetic oligonucleotide
gtccacatagcaaagtgcctccgaaaccttgacctga

SEQ ID NO: 91934 - DNA, 38 bp, Artificial Sequence
  Synthetic oligonucleotide
tcagtatcgttgggggggagggtagaaccgtgggctga

SEQ ID NO: 91935 - DNA, 38 bp, Artificial Sequence
  Synthetic oligonucleotide
atgccgcactagaatagcattgaacgcccacctgctga

SEQ ID NO: 91936 - DNA, 37 bp, Artificial Sequence
  Synthetic oligonucleotide
gacaaagaaggtgtacgggggggaatttctgaagtga

SEQ ID NO: 91937 - DNA, 37 bp, Artificial Sequence
  Synthetic oligonucleotide
gaagacccgtagatggataaggtgagggagggagtga

SEQ ID NO: 91938 - DNA, 38 bp, Artificial Sequence
  Synthetic oligonucleotide
ttgggtgtcggtgggataggtatgagtgggggccgtga

SEQ ID NO: 91939 - DNA, 37 bp, Artificial Sequence
  Synthetic oligonucleotide
tccacaacacacattatcgatagcgattgctccgtga

SEQ ID NO: 91940 - DNA, 38 bp, Artificial Sequence
  Synthetic oligonucleotide
tgcgggtgggggcgaagatgatgcaggggcgatcgtga

SEQ ID NO: 91941 - DNA, 37 bp, Artificial Sequence
  Synthetic oligonucleotide
tgaagcccagtgcttgttaggatggtcttcggtgtga

SEQ ID NO: 91942 - DNA, 37 bp, Artificial Sequence
  Synthetic oligonucleotide
gacacagctgcctccggtgccgtgactactgaattga

SEQ ID NO: 91943 - DNA, 38 bp, Artificial Sequence
  Synthetic oligonucleotide
agtgggacgggtatggggtatatagaggaagccattga

SEQ ID NO: 91944 - DNA, 38 bp, Artificial Sequence
  Synthetic oligonucleotide
accaccagtgcctgaagtcgaaggtgacttcgcattga

SEQ ID NO: 91945 - DNA, 37 bp, Artificial Sequence
  Synthetic oligonucleotide
tcaccgtcccccgccagtcacccagctagacgcttga

SEQ ID NO: 91946 - DNA, 38 bp, Artificial Sequence
  Synthetic oligonucleotide
agtgacgacggaacggagggtcgaacgggaatggttga

SEQ ID NO: 91947 - DNA, 38 bp, Artificial Sequence
  Synthetic oligonucleotide
ttgctcagctggtttactcactgcattgttttggttga

SEQ ID NO: 91948 - DNA, 38 bp, Artificial Sequence
  Synthetic oligonucleotide
gccctccgcacatattgacattttgatgattcttttga

SEQ ID NO: 91949 - DNA, 36 bp, Artificial Sequence
  Synthetic oligonucleotide
gctcgggtcccgttgtctctttgttccgcacttata

SEQ ID NO: 91950 - DNA, 36 bp, Artificial Sequence
  Synthetic oligonucleotide
tgatacgtccccctcgtatagcaccgctcttgtcta

SEQ ID NO: 91951 - DNA, 36 bp, Artificial Sequence
  Synthetic oligonucleotide
gtcgaacggaggacgagtaggtccgttaattaagta

SEQ ID NO: 91952 - DNA, 36 bp, Artificial Sequence
  Synthetic oligonucleotide
ttgaccatttgtcacccatgtgactacattttcgta

SEQ ID NO: 91953 - DNA, 36 bp, Artificial Sequence
  Synthetic oligonucleotide
tgatcagggaaaacggtccaagccgatgctggggta

SEQ ID NO: 91954 - DNA, 36 bp, Artificial Sequence
  Synthetic oligonucleotide
gtctcactgcgcattctgtctcatggggtccgtgta

SEQ ID NO: 91955 - DNA, 36 bp, Artificial Sequence
  Synthetic oligonucleotide
ataggcgcatctttcaggtcctgccctttctttgta

SEQ ID NO: 91956 - DNA, 36 bp, Artificial Sequence
  Synthetic oligonucleotide
aaacggagggattggcgaagcatgcagtcatggtta

SEQ ID NO: 91957 - DNA, 35 bp, Artificial Sequence
  Synthetic oligonucleotide
tatgcgttgcgcgatggtcccgttatgttctacac

SEQ ID NO: 91958 - DNA, 35 bp, Artificial Sequence
  Synthetic oligonucleotide
gcctgggtttgccccgttgaaaatgccacctcgac

SEQ ID NO: 91959 - DNA, 35 bp, Artificial Sequence
  Synthetic oligonucleotide
tactcaagcctacgaaggtacactcgcctcttgac

SEQ ID NO: 91960 - DNA, 35 bp, Artificial Sequence
  Synthetic oligonucleotide
ttgcgtaggcgcaacggttagccctttctatgtac

SEQ ID NO: 91961 - DNA, 35 bp, Artificial Sequence
  Synthetic oligonucleotide
gtgagcaggcttagccatccgaaagctgcttgtac

SEQ ID NO: 91962 - DNA, 35 bp, Artificial Sequence
  Synthetic oligonucleotide
ttgcaccgcatgcatagctgggacaatcattttac

SEQ ID NO: 91963 - DNA, 35 bp, Artificial Sequence
  Synthetic oligonucleotide
accgcaccgtgcccctacccggtcttaaaagaccc

SEQ ID NO: 91964 - DNA, 35 bp, Artificial Sequence
  Synthetic oligonucleotide
tcattgcgccgtccaatcctaccctccccacttcc

SEQ ID NO: 91965 - DNA, 35 bp, Artificial Sequence
  Synthetic oligonucleotide
accggggagggatgggcggtgtaagtgcatgacgc

SEQ ID NO: 91966 - DNA, 35 bp, Artificial Sequence
  Synthetic oligonucleotide
agcgtgcaacaacactcgctcgcctctgatctggc

SEQ ID NO: 91967 - DNA, 35 bp, Artificial Sequence
  Synthetic oligonucleotide
tcgatcacacaatctaggaatttagccgtttaatc

SEQ ID NO: 91968 - DNA, 35 bp, Artificial Sequence
  Synthetic oligonucleotide
aacccccaccgctcgtttgctggtttgttgccatc

SEQ ID NO: 91969 - DNA, 35 bp, Artificial Sequence
  Synthetic oligonucleotide
tacccacgcactgccgccccatgagctacactatc

SEQ ID NO: 91970 - DNA, 36 bp, Artificial Sequence
  Synthetic oligonucleotide
taacaccgactcggggtgtgggcctatcttccactc

SEQ ID NO: 91971 - DNA, 35 bp, Artificial Sequence
  Synthetic oligonucleotide
gccccgcaaaatttttcctcgtgtactcagccctc

SEQ ID NO: 91972 - DNA, 35 bp, Artificial Sequence
  Synthetic oligonucleotide
taggggggcacccgtccatctacactttctttctc

SEQ ID NO: 91973 - DNA, 35 bp, Artificial Sequence
  Synthetic oligonucleotide
gaccacacacgtttggggatccgttgtttactgtc

SEQ ID NO: 91974 - DNA, 35 bp, Artificial Sequence
  Synthetic oligonucleotide
taggagccatggtcacttttggggcttagttcttc

SEQ ID NO: 91975 - DNA, 35 bp, Artificial Sequence
  Synthetic oligonucleotide
ggagcgatgtcgtcgcgacgatacttcttttcttc

SEQ ID NO: 91976 - DNA, 35 bp, Artificial Sequence
  Synthetic oligonucleotide
gccacacctcacttgaaccgaccctcctttgtaag

SEQ ID NO: 91977 - DNA, 35 bp, Artificial Sequence
  Synthetic oligonucleotide
agtgcgagctggataaattctaacaagggggtcgg

SEQ ID NO: 91978 - DNA, 35 bp, Artificial Sequence
  Synthetic oligonucleotide
ttcgtgcgaatctttttggctggtccaccactctg

SEQ ID NO: 91979 - DNA, 35 bp, Artificial Sequence
  Synthetic oligonucleotide
tttggacgacgcgcctatccgtcattattatagtg

SEQ ID NO: 91980 - DNA, 35 bp, Artificial Sequence
  Synthetic oligonucleotide
tgagggagtgggtaacctaggggatttggaggttg

SEQ ID NO: 91981 - DNA, 35 bp, Artificial Sequence
  Synthetic oligonucleotide
gcgaaaggaagacgaggggatatagtgaagagaat

SEQ ID NO: 91982 - DNA, 35 bp, Artificial Sequence
  Synthetic oligonucleotide
actgcaactcctcacacgtcgatacgggcacatat

SEQ ID NO: 91983 - DNA, 35 bp, Artificial Sequence
  Synthetic oligonucleotide
acttgcccgcccgaagatcactcgaggcacgcact

SEQ ID NO: 91984 - DNA, 35 bp, Artificial Sequence
  Synthetic oligonucleotide
atcaagtccgtgctgctggacccctctgaattcct

SEQ ID NO: 91985 - DNA, 35 bp, Artificial Sequence
  Synthetic oligonucleotide
gaagagggcaggaacatagcagctaagtaaatgct

SEQ ID NO: 91986 - DNA, 35 bp, Artificial Sequence
  Synthetic oligonucleotide
gtagacggtcacctcgaatccggtgctcgaactct

SEQ ID NO: 91987 - DNA, 35 bp, Artificial Sequence
  Synthetic oligonucleotide
aaacgtagggtgcggaaaaattcggggaatgcagt

SEQ ID NO: 91988 - DNA, 35 bp, Artificial Sequence
  Synthetic oligonucleotide
tgtcaacaagtgtggagtgtaaggtggcggtttgt

SEQ ID NO: 91989 - DNA, 35 bp, Artificial Sequence
  Synthetic oligonucleotide
ggttgctccccgttttgcatgcatcaagtctcatt

SEQ ID NO: 91990 - DNA, 35 bp, Artificial Sequence
  Synthetic oligonucleotide
atggagcaggagagcgatgatttgtaggaaagatt

SEQ ID NO: 91991 - DNA, 35 bp, Artificial Sequence
  Synthetic oligonucleotide
ttgcctcatttgcacgcatgtgaacgatctccctt

SEQ ID NO: 91992 - DNA, 35 bp, Artificial Sequence
  Synthetic oligonucleotide
gaacaaccttgccgacacggggggagggaggattt

SEQ ID NO: 91993 - DNA, 35 bp, Artificial Sequence
  Synthetic oligonucleotide
gcaggatgaccggatgctgaataatatggtgtttt

SEQ ID NO: 91994 - DNA, 36 bp, Artificial Sequence
  Synthetic oligonucleotide
gcaaccggccgtaaacttgcagtgggttttaaaaaa

SEQ ID NO: 91995 - DNA, 36 bp, Artificial Sequence
  Synthetic oligonucleotide
taacacagctggacagtttactatagggcactcaaa

SEQ ID NO: 91996 - DNA, 35 bp, Artificial Sequence
  Synthetic oligonucleotide
taaagccggaaagggggagtcgaggggtttaacaa

SEQ ID NO: 91997 - DNA, 36 bp, Artificial Sequence
  Synthetic oligonucleotide
aatccaccgactctgtacatgcactgtcgtacccaa

SEQ ID NO: 91998 - DNA, 36 bp, Artificial Sequence
  Synthetic oligonucleotide
gttgaactgctactcattcgtgtcatgcgcgcccaa

SEQ ID NO: 91999 - DNA, 36 bp, Artificial Sequence
  Synthetic oligonucleotide
gagggtcggcgtaatatcggtctctgcgctggccaa

SEQ ID NO: 92000 - DNA, 36 bp, Artificial Sequence
  Synthetic oligonucleotide
accaggcgggtggggccgcactgattgggtgaggaa

SEQ ID NO: 92001 - DNA, 36 bp, Artificial Sequence
  Synthetic oligonucleotide
gtgcacgaaaggggagcgcggacgtccgacacggaa

SEQ ID NO: 92002 - DNA, 36 bp, Artificial Sequence
  Synthetic oligonucleotide
gatcaactcctgctgaatatccgtggaaaaccctaa

SEQ ID NO: 92003 - DNA, 36 bp, Artificial Sequence
  Synthetic oligonucleotide
actaacagttggtccagaactgctcctgtgcaaaca

SEQ ID NO: 92004 - DNA, 36 bp, Artificial Sequence
  Synthetic oligonucleotide
gtgcacattagccggggggagtttggtaacagaaca

SEQ ID NO: 92005 - DNA, 36 bp, Artificial Sequence
  Synthetic oligonucleotide
ttgtcaccccccagttcatgcacttggaagtgcaca

SEQ ID NO: 92006 - DNA, 35 bp, Artificial Sequence
  Synthetic oligonucleotide
aacacacgtgtgaggtgagtcgacggtattcgaca

SEQ ID NO: 92007 - DNA, 35 bp, Artificial Sequence
  Synthetic oligonucleotide
tactggacccacactgatttgcggatcaactgaca

SEQ ID NO: 92008 - DNA, 35 bp, Artificial Sequence
  Synthetic oligonucleotide
aagctgacgaatctgttcctccgtgcattaaacca

SEQ ID NO: 92009 - DNA, 36 bp, Artificial Sequence
  Synthetic oligonucleotide
tcagacccggtgacgggttgcatcaggctttaacca

SEQ ID NO: 92010 - DNA, 36 bp, Artificial Sequence
  Synthetic oligonucleotide
gtggcactcacacaactggcttctagtctagcacca

SEQ ID NO: 92011 - DNA, 35 bp, Artificial Sequence
  Synthetic oligonucleotide
acaaaacgacacccggtctgagtccaatgccccca

SEQ ID NO: 92012 - DNA, 36 bp, Artificial Sequence
  Synthetic oligonucleotide
acttgccctgttcagagggcgttcctttggtcccca

SEQ ID NO: 92013 - DNA, 36 bp, Artificial Sequence
  Synthetic oligonucleotide
tgtgcgggtagaggggaatggaaccaggtggagcca

SEQ ID NO: 92014 - DNA, 36 bp, Artificial Sequence
  Synthetic oligonucleotide
aacgcccggctcgaaatctaggacggccccccgcca

SEQ ID NO: 92015 - DNA, 36 bp, Artificial Sequence
  Synthetic oligonucleotide
aacctaacgcagagtggtacgccaggccttcatcca

SEQ ID NO: 92016 - DNA, 36 bp, Artificial Sequence
  Synthetic oligonucleotide
aacatcaccgatctaatcactcgacatcggagagca

SEQ ID NO: 92017 - DNA, 35 bp, Artificial Sequence
  Synthetic oligonucleotide
gcacggaggtaatgacatgggggattgatggcgca

SEQ ID NO: 92018 - DNA, 36 bp, Artificial Sequence
  Synthetic oligonucleotide
tgcaccgccgggcccttcacgaccctccgacatgca

SEQ ID NO: 92019 - DNA, 36 bp, Artificial Sequence
  Synthetic oligonucleotide
gcactattcccatgtcgacagcagcctaccccctca

SEQ ID NO: 92020 - DNA, 35 bp, Artificial Sequence
  Synthetic oligonucleotide
gttgtcgatccggctccgtccagattcacttctca

SEQ ID NO: 92021 - DNA, 35 bp, Artificial Sequence
  Synthetic oligonucleotide
aaccagtgaaaggtgggtgcgatgtaaccgggtca

SEQ ID NO: 92022 - DNA, 36 bp, Artificial Sequence
  Synthetic oligonucleotide
tgctcgcctccttccgctgtcagcccgtgtgtgtca

SEQ ID NO: 92023 - DNA, 35 bp, Artificial Sequence
  Synthetic oligonucleotide
tttgcactcacaagatacgcactatcctccgttca

SEQ ID NO: 92024 - DNA, 37 bp, Artificial Sequence
  Synthetic oligonucleotide
tctgtgacgccacatccttctcccgagcccaacaaga

SEQ ID NO: 92025 - DNA, 35 bp, Artificial Sequence
  Synthetic oligonucleotide
tgacaccaggagttgtgaaggggtaagggtcgaga

SEQ ID NO: 92026 - DNA, 37 bp, Artificial Sequence
  Synthetic oligonucleotide
gtcgatcggggtgagcatggggaaaagcgtcgtacga

SEQ ID NO: 92027 - DNA, 37 bp, Artificial Sequence
  Synthetic oligonucleotide
tgcaccgaccttagttgtctcgcatcatcaagcccga

SEQ ID NO: 92028 - DNA, 35 bp, Artificial Sequence
  Synthetic oligonucleotide
acaccgtcgaggcttcatcaaaactagcgatccga

SEQ ID NO: 92029 - DNA, 37 bp, Artificial Sequence
  Synthetic oligonucleotide
attgaagcagtggtcaataggggggggcacttagcga

SEQ ID NO: 92030 - DNA, 35 bp, Artificial Sequence
  Synthetic oligonucleotide
gacagaacgggggggggcggactgatgccagagga

SEQ ID NO: 92031 - DNA, 37 bp, Artificial Sequence
  Synthetic oligonucleotide
agccactatccactgtttttacttccggtaccacgga

SEQ ID NO: 92032 - DNA, 37 bp, Artificial Sequence
  Synthetic oligonucleotide
gtagtgaggaggaagagtaactcagagtacaagcgga

SEQ ID NO: 92033 - DNA, 37 bp, Artificial Sequence
  Synthetic oligonucleotide
gtgtgcaaaggtggagcataaggggcgtgcacgcgga

SEQ ID NO: 92034 - DNA, 36 bp, Artificial Sequence
  Synthetic oligonucleotide
acatacaggaagacggggttggaagtggttcgcgga

SEQ ID NO: 92035 - DNA, 37 bp, Artificial Sequence
  Synthetic oligonucleotide
gtcaagtcgtaggcttgaacgctggagaagggaggga

SEQ ID NO: 92036 - DNA, 35 bp, Artificial Sequence
  Synthetic oligonucleotide
atgcctcgaggcacctgcgcgaacatcaccatgga

SEQ ID NO: 92037 - DNA, 37 bp, Artificial Sequence
  Synthetic oligonucleotide
acgagtggagtgggaggttgttggcggatgtcttgga

SEQ ID NO: 92038 - DNA, 37 bp, Artificial Sequence
  Synthetic oligonucleotide
aactcgtcctacctgtcgtttacatttgattcttgga

SEQ ID NO: 92039 - DNA, 38 bp, Artificial Sequence
  Synthetic oligonucleotide
gtggcgactaaggactatagggatggaggaataaatga

SEQ ID NO: 92040 - DNA, 38 bp, Artificial Sequence
  Synthetic oligonucleotide
acccgccgcccttaacgcttagtaagtcatcaacatga

SEQ ID NO: 92041 - DNA, 37 bp, Artificial Sequence
  Synthetic oligonucleotide
gcacaccgagctttgaaccgatcccgtctgcacatga

SEQ ID NO: 92042 - DNA, 38 bp, Artificial Sequence
  Synthetic oligonucleotide
gtcacacttcgaactgtttaaggagaagatctgcatga

SEQ ID NO: 92043 - DNA, 38 bp, Artificial Sequence
  Synthetic oligonucleotide
ggaatgtcaagagagaagggacgggggccagagtatga

SEQ ID NO: 92044 - DNA, 38 bp, Artificial Sequence
  Synthetic oligonucleotide
tgcgcgtgagcaggtggcacaacgcgcaaagtttatga

SEQ ID NO: 92045 - DNA, 37 bp, Artificial Sequence
  Synthetic oligonucleotide
acgacaccgggctacggaacgtgggagtacgaactga

SEQ ID NO: 92046 - DNA, 38 bp, Artificial Sequence
  Synthetic oligonucleotide
gccacagtctggccgctgtcaggaacacttctcactga

SEQ ID NO: 92047 - DNA, 37 bp, Artificial Sequence
  Synthetic oligonucleotide
ggaacccatccaaacggagataagacttctcccctga

SEQ ID NO: 92048 - DNA, 36 bp, Artificial Sequence
  Synthetic oligonucleotide
tagccgagacggggtggggctggggactgtatctga

SEQ ID NO: 92049 - DNA, 38 bp, Artificial Sequence
  Synthetic oligonucleotide
attgacaccacatccagcttatagtagcctcattctga

SEQ ID NO: 92050 - DNA, 38 bp, Artificial Sequence
  Synthetic oligonucleotide
gataaggtggaagcaggaagcaggagcgaaacgagtga

SEQ ID NO: 92051 - DNA, 36 bp, Artificial Sequence
  Synthetic oligonucleotide
gcgcacaaacgcttccttcttcaccctacacggtga

SEQ ID NO: 92052 - DNA, 38 bp, Artificial Sequence
  Synthetic oligonucleotide
gtgggtgggctaccgggaatattaaagcatgtatgtga

SEQ ID NO: 92053 - DNA, 38 bp, Artificial Sequence
  Synthetic oligonucleotide
actccacgacgccagacccacacttcgcaccactgtga

SEQ ID NO: 92054 - DNA, 38 bp, Artificial Sequence
  Synthetic oligonucleotide
gtcgacgcccggcctaagctgcacacccatgattgtga

SEQ ID NO: 92055 - DNA, 38 bp, Artificial Sequence
  Synthetic oligonucleotide
gtgtgggggccgtggagattaagagggaagtattgtga

SEQ ID NO: 92056 - DNA, 38 bp, Artificial Sequence
  Synthetic oligonucleotide
attcaccgtaccttctgttttacgccacttggaattga

SEQ ID NO: 92057 - DNA, 38 bp, Artificial Sequence
  Synthetic oligonucleotide
aacagcagggagaacggcccagagcgaggggtgattga

SEQ ID NO: 92058 - DNA, 35 bp, Artificial Sequence
  Synthetic oligonucleotide
ttggtgcaggggatagtaagcgcgggtagtattga

SEQ ID NO: 92059 - DNA, 38 bp, Artificial Sequence
  Synthetic oligonucleotide
acatcacgatggtgcgaaaagcgtagtctgacacttga

SEQ ID NO: 92060 - DNA, 38 bp, Artificial Sequence
  Synthetic oligonucleotide
tgcaacaccctgattgtgcgtagctcattatctcttga

SEQ ID NO: 92061 - DNA, 38 bp, Artificial Sequence
  Synthetic oligonucleotide
gacggggggggacgaagtacttcgttaatgatagttga

SEQ ID NO: 92062 - DNA, 38 bp, Artificial Sequence
  Synthetic oligonucleotide
tcgacattgccctcgggtttggccaccacctcatttga

SEQ ID NO: 92063 - DNA, 36 bp, Artificial Sequence
  Synthetic oligonucleotide
gagccctaccagaggcttgaacgccttgttccccta

SEQ ID NO: 92064 - DNA, 36 bp, Artificial Sequence
  Synthetic oligonucleotide
aatgcatgcgatcgacctctccggctaacactccta

SEQ ID NO: 92065 - DNA, 35 bp, Artificial Sequence
  Synthetic oligonucleotide
gcgtacacacctggcgttcttaagcgagcacgcta

SEQ ID NO: 92066 - DNA, 36 bp, Artificial Sequence
  Synthetic oligonucleotide
tggtgaaacgagaactgcaggagaaggagagcggta

SEQ ID NO: 92067 - DNA, 36 bp, Artificial Sequence
  Synthetic oligonucleotide
gcacgcctccgaacctcgtatctcctagagaattta

SEQ ID NO: 92068 - DNA, 35 bp, Artificial Sequence
  Synthetic oligonucleotide
gtctgcccgatccgctcatcgtcgacgttcccgac

SEQ ID NO: 92069 - DNA, 35 bp, Artificial Sequence
  Synthetic oligonucleotide
gctgatgtgcagtgaactaaagacgaaaacgggac

SEQ ID NO: 92070 - DNA, 35 bp, Artificial Sequence
  Synthetic oligonucleotide
ggaaagggacgggagaatgaggaaaagccggtgac

SEQ ID NO: 92071 - DNA, 35 bp, Artificial Sequence
  Synthetic oligonucleotide
gaggaacaccggcacagacgctgccactttgttac

SEQ ID NO: 92072 - DNA, 35 bp, Artificial Sequence
  Synthetic oligonucleotide
gaggccaccaacttagcttgctatattctgtgacc

SEQ ID NO: 92073 - DNA, 35 bp, Artificial Sequence
  Synthetic oligonucleotide
agatccccaggtgcccaccttgacacggttgcccc

SEQ ID NO: 92074 - DNA, 35 bp, Artificial Sequence
  Synthetic oligonucleotide
acgctagctaactgtactgcttattttggccatcc

SEQ ID NO: 92075 - DNA, 35 bp, Artificial Sequence
  Synthetic oligonucleotide
gctacccccgccggtcacgaaacattggctacagc

SEQ ID NO: 92076 - DNA, 35 bp, Artificial Sequence
  Synthetic oligonucleotide
gcacacatagggagtatgcgaccccagattcgcgc

SEQ ID NO: 92077 - DNA, 35 bp, Artificial Sequence
  Synthetic oligonucleotide
aaccacgccctagccacgctaaactcggcacctgc

SEQ ID NO: 92078 - DNA, 35 bp, Artificial Sequence
  Synthetic oligonucleotide
gttgtgctgccgtggttttttagtcttagcggtgc

SEQ ID NO: 92079 - DNA, 35 bp, Artificial Sequence
  Synthetic oligonucleotide
tgagatggagggttgttggaacgcgaggggatatc

SEQ ID NO: 92080 - DNA, 35 bp, Artificial Sequence
  Synthetic oligonucleotide
gctgggtggaaatgtttggaagggtagcgaaggtc

SEQ ID NO: 92081 - DNA, 35 bp, Artificial Sequence
  Synthetic oligonucleotide
tccaggtaaggtgaagaaaatgcatgcggcgggtc

SEQ ID NO: 92082 - DNA, 35 bp, Artificial Sequence
  Synthetic oligonucleotide
agatgccccccgtgcaaggattgatgaaccatgtc

SEQ ID NO: 92083 - DNA, 35 bp, Artificial Sequence
  Synthetic oligonucleotide
gacccgctagtccaactgcgaccctggtttctgtc

SEQ ID NO: 92084 - DNA, 35 bp, Artificial Sequence
  Synthetic oligonucleotide
tcctgagtcgatccgatccggtgcttggttccttc

SEQ ID NO: 92085 - DNA, 35 bp, Artificial Sequence
  Synthetic oligonucleotide
atccccgtccacgccgcgatacctgtaatcgcaag

SEQ ID NO: 92086 - DNA, 35 bp, Artificial Sequence
  Synthetic oligonucleotide
agacggaggggtggtggaggcgagtacggcaccag

SEQ ID NO: 92087 - DNA, 35 bp, Artificial Sequence
  Synthetic oligonucleotide
gatcagcagggcataaactaggaaaaggagtccag

SEQ ID NO: 92088 - DNA, 35 bp, Artificial Sequence
  Synthetic oligonucleotide
gccacagcagtagggagggaggggtaatgggtgag

SEQ ID NO: 92089 - DNA, 36 bp, Artificial Sequence
  Synthetic oligonucleotide
agtcggggtggagagctgaaacgcgatgtggaaacg

SEQ ID NO: 92090 - DNA, 35 bp, Artificial Sequence
  Synthetic oligonucleotide
gaccaaccgaacacgcgctatcatattgtcgtacg

SEQ ID NO: 92091 - DNA, 35 bp, Artificial Sequence
  Synthetic oligonucleotide
aacaacaaccaaacaagggggcctgagacattacg

SEQ ID NO: 92092 - DNA, 35 bp, Artificial Sequence
  Synthetic oligonucleotide
taactccctctcgactgtatctccattcatgggcg

SEQ ID NO: 92093 - DNA, 35 bp, Artificial Sequence
  Synthetic oligonucleotide
ttgacgcattccagcttatccacacaagtcgtgcg

SEQ ID NO: 92094 - DNA, 35 bp, Artificial Sequence
  Synthetic oligonucleotide
gtttgtccgccgcccgttatgatccattagcccgg

SEQ ID NO: 92095 - DNA, 35 bp, Artificial Sequence
  Synthetic oligonucleotide
atgcgcgatacgtccaatccacaacacattgaggg

SEQ ID NO: 92096 - DNA, 35 bp, Artificial Sequence
  Synthetic oligonucleotide
tcatgggaatggttcagtgagaggggaggctaggg

SEQ ID NO: 92097 - DNA, 35 bp, Artificial Sequence
  Synthetic oligonucleotide
gactagctcaaagaaccattccccagtagtcactg

SEQ ID NO: 92098 - DNA, 35 bp, Artificial Sequence
  Synthetic oligonucleotide
tgaaccctgccatcctaatgatgatttttctactg

SEQ ID NO: 92099 - DNA, 35 bp, Artificial Sequence
  Synthetic oligonucleotide
gaccaagatcgcgggttggcatcagggaggggaat

SEQ ID NO: 92100 - DNA, 35 bp, Artificial Sequence
  Synthetic oligonucleotide
gatgtaatgctcgcttttctcatgtgtcgttccat

SEQ ID NO: 92101 - DNA, 35 bp, Artificial Sequence
  Synthetic oligonucleotide
gacacgaaacgtgacatactaccccggtgtttcat

SEQ ID NO: 92102 - DNA, 35 bp, Artificial Sequence
  Synthetic oligonucleotide
atgtctgccacggatattcgcccgttgcctcgact

SEQ ID NO: 92103 - DNA, 35 bp, Artificial Sequence
  Synthetic oligonucleotide
accatacggggcaaggaagggaggggaaccgtgct

SEQ ID NO: 92104 - DNA, 35 bp, Artificial Sequence
  Synthetic oligonucleotide
acgtacccgcaaccgaaacgctgaggtttgtttct

SEQ ID NO: 92105 - DNA, 35 bp, Artificial Sequence
  Synthetic oligonucleotide
gagcgcgaggtaagggggaaggtaggtctgtcagt

SEQ ID NO: 92106 - DNA, 35 bp, Artificial Sequence
  Synthetic oligonucleotide
gatcgtcgtactctttgcctccttcaccatgtagt

SEQ ID NO: 92107 - DNA, 35 bp, Artificial Sequence
  Synthetic oligonucleotide
tcaatgtgcagcagcactatgatgtttcggtccgt

SEQ ID NO: 92108 - DNA, 35 bp, Artificial Sequence
  Synthetic oligonucleotide
gtcaaacaccccagcgtaacaactcaaccgctcgt

SEQ ID NO: 92109 - DNA, 35 bp, Artificial Sequence
  Synthetic oligonucleotide
gtgcaacacggctaaacatcgcctcagggttcggt

SEQ ID NO: 92110 - DNA, 35 bp, Artificial Sequence
  Synthetic oligonucleotide
tgcgtgtggcggggaagtacgggcgatgagtgggt

SEQ ID NO: 92111 - DNA, 35 bp, Artificial Sequence
  Synthetic oligonucleotide
ctttcccgccgccctgtaatttgttaccgccactt

SEQ ID NO: 92112 - DNA, 35 bp, Artificial Sequence
  Synthetic oligonucleotide
taggatccgggccatgctctagttcgaacgctctt

SEQ ID NO: 92113 - DNA, 35 bp, Artificial Sequence
  Synthetic oligonucleotide
actcacttccggtaggagcgaaaagcctcctcttt

SEQ ID NO: 92114 - DNA, 35 bp, Artificial Sequence
  Synthetic oligonucleotide
tcagaggagaagaggctcagaggggcaagcgaaaa

SEQ ID NO: 92115 - DNA, 35 bp, Artificial Sequence
  Synthetic oligonucleotide
gctcgaaggcccggcgcataccaccacactgtaaa

SEQ ID NO: 92116 - DNA, 35 bp, Artificial Sequence
  Synthetic oligonucleotide
gtgagcgcgagatacagttctcaccctcctcacaa

SEQ ID NO: 92117 - DNA, 36 bp, Artificial Sequence
  Synthetic oligonucleotide
attgtcacaacagatccatgccatcacgccctcgaa

SEQ ID NO: 92118 - DNA, 36 bp, Artificial Sequence
  Synthetic oligonucleotide
tcactcagccgttgtactcgatatcgctcctctgaa

SEQ ID NO: 92119 - DNA, 36 bp, Artificial Sequence
  Synthetic oligonucleotide
gacaagcatggaggttctacaagtctctgcatcaca

SEQ ID NO: 92120 - DNA, 36 bp, Artificial Sequence
  Synthetic oligonucleotide
gcggagacgctcatatcactgtcatcctacctacca

SEQ ID NO: 92121 - DNA, 36 bp, Artificial Sequence
  Synthetic oligonucleotide
tacccactaccatctgacacattgaaggcgttacca

SEQ ID NO: 92122 - DNA, 35 bp, Artificial Sequence
  Synthetic oligonucleotide
tagccagcatcacacttgcttcctgttaagcccca

SEQ ID NO: 92123 - DNA, 36 bp, Artificial Sequence
  Synthetic oligonucleotide
gtcatgggcggagaagacggccactttaaaagagca

SEQ ID NO: 92124 - DNA, 36 bp, Artificial Sequence
  Synthetic oligonucleotide
tactcagggtccgtccgccgcactttgaacatcgca

SEQ ID NO: 92125 - DNA, 35 bp, Artificial Sequence
  Synthetic oligonucleotide
gtggacaggaacagcatgggcaccatgagggatca

SEQ ID NO: 92126 - DNA, 36 bp, Artificial Sequence
  Synthetic oligonucleotide
tagcacttcacttagcgcatcgacctgttttgctca

SEQ ID NO: 92127 - DNA, 36 bp, Artificial Sequence
  Synthetic oligonucleotide
gtgcctcgctatcataactcacgctctctacagtca

SEQ ID NO: 92128 - DNA, 35 bp, Artificial Sequence
  Synthetic oligonucleotide
atggtgcggatgggtggggggttgctgtcgggtca

SEQ ID NO: 92129 - DNA, 36 bp, Artificial Sequence
  Synthetic oligonucleotide
tgtccgaccactgcctcgagcgaatatcacaattca

SEQ ID NO: 92130 - DNA, 36 bp, Artificial Sequence
  Synthetic oligonucleotide
tttgagcgagggggagccgtgaaattaggtcgttca

SEQ ID NO: 92131 - DNA, 36 bp, Artificial Sequence
  Synthetic oligonucleotide
tagtcgaactgtacagctaggcctacaccgttttca

SEQ ID NO: 92132 - DNA, 37 bp, Artificial Sequence
  Synthetic oligonucleotide
taacacagcaaggggaagtggtttggtgggtggaaga

SEQ ID NO: 92133 - DNA, 35 bp, Artificial Sequence
  Synthetic oligonucleotide
accacacctccagcatttctaacaaagtcataaga

SEQ ID NO: 92134 - DNA, 37 bp, Artificial Sequence
  Synthetic oligonucleotide
tatccaccgactatgcatcactcgcgcacttttaaga

SEQ ID NO: 92135 - DNA, 37 bp, Artificial Sequence
  Synthetic oligonucleotide
gtgtaaggggcaatataaggtggagccgacgacgaga

SEQ ID NO: 92136 - DNA, 37 bp, Artificial Sequence
  Synthetic oligonucleotide
gttgatgctgtattgagttggtgttggaggggtgaga

SEQ ID NO: 92137 - DNA, 37 bp, Artificial Sequence
  Synthetic oligonucleotide
gctaccgccccaggactttgcactaactccctataga

SEQ ID NO: 92138 - DNA, 37 bp, Artificial Sequence
  Synthetic oligonucleotide
actgccaacccccgacggatcactctacatcgctaga

SEQ ID NO: 92139 - DNA, 37 bp, Artificial Sequence
  Synthetic oligonucleotide
taaaggacgaggggttaaggtgggcgagtaaggtaga

SEQ ID NO: 92140 - DNA, 37 bp, Artificial Sequence
  Synthetic oligonucleotide
gtgacaacaggttttaccagcccatggacagcaacga

SEQ ID NO: 92141 - DNA, 37 bp, Artificial Sequence
  Synthetic oligonucleotide
gacccccagaggtatcttctcccgttagtgataacga

SEQ ID NO: 92142 - DNA, 37 bp, Artificial Sequence
  Synthetic oligonucleotide
gctgcccgacaaaccatgcccaggaaccaccggacga

SEQ ID NO: 92143 - DNA, 37 bp, Artificial Sequence
  Synthetic oligonucleotide
gcgcgaaacgcagggacccgggcacaatggatgacga

SEQ ID NO: 92144 - DNA, 37 bp, Artificial Sequence
  Synthetic oligonucleotide
attggattgcgaggagagggcggagtgggaagtacga

SEQ ID NO: 92145 - DNA, 37 bp, Artificial Sequence
  Synthetic oligonucleotide
tctaccaccgcaaccactggctcggtcacctcaccga

SEQ ID NO: 92146 - DNA, 36 bp, Artificial Sequence
  Synthetic oligonucleotide
gcctgtccagcaaacttacaccacggatttcaccga

SEQ ID NO: 92147 - DNA, 36 bp, Artificial Sequence
  Synthetic oligonucleotide
tgaccaacccccagacctaatttagagctctaccga

SEQ ID NO: 92148 - DNA, 37 bp, Artificial Sequence
  Synthetic oligonucleotide
gatgctgacggtatagggggttagtacggtcgggcga

SEQ ID NO: 92149 - DNA, 36 bp, Artificial Sequence
  Synthetic oligonucleotide
gcaccactaactccctatcagtaactgccaatgcga

SEQ ID NO: 92150 - DNA, 37 bp, Artificial Sequence
  Synthetic oligonucleotide
acgctgagtaagcggtcatttttgtactatcctgcga

SEQ ID NO: 92151 - DNA, 37 bp, Artificial Sequence
  Synthetic oligonucleotide
taacgcgctgatgaactttaattttgcgctcgctcga

SEQ ID NO: 92152 - DNA, 37 bp, Artificial Sequence
  Synthetic oligonucleotide
atctgcccacagaacccgtttcgaattaattattcga

SEQ ID NO: 92153 - DNA, 37 bp, Artificial Sequence
  Synthetic oligonucleotide
gacctagctaagccgaggaaagggaaggaactcagga

SEQ ID NO: 92154 - DNA, 37 bp, Artificial Sequence
  Synthetic oligonucleotide
gataaatagcgctgatcatagcagggaggggggagga

SEQ ID NO: 92155 - DNA, 37 bp, Artificial Sequence
  Synthetic oligonucleotide
gacagatgggggaggtactagtgaatggtagtacgga

SEQ ID NO: 92156 - DNA, 37 bp, Artificial Sequence
  Synthetic oligonucleotide
agcactgctccatctcgatcggcatctatcacaggga

SEQ ID NO: 92157 - DNA, 37 bp, Artificial Sequence
  Synthetic oligonucleotide
tagacggaagggaatggtcacaagcggtgacggggga

SEQ ID NO: 92158 - DNA, 37 bp, Artificial Sequence
  Synthetic oligonucleotide
acgggccgggaaggcgaggcatggagctggaatggga

SEQ ID NO: 92159 - DNA, 37 bp, Artificial Sequence
  Synthetic oligonucleotide
tccaccgtcgctaatggaaattgcgctttttctggga

SEQ ID NO: 92160 - DNA, 36 bp, Artificial Sequence
  Synthetic oligonucleotide
tgttcgaacggaaggctgacaatagctgaggtggga

SEQ ID NO: 92161 - DNA, 37 bp, Artificial Sequence
  Synthetic oligonucleotide
gtgggcgggggggcagataatgttgggtaaagatgga

SEQ ID NO: 92162 - DNA, 37 bp, Artificial Sequence
  Synthetic oligonucleotide
accaacgccactgctgttcttctatttcttgtatgga

SEQ ID NO: 92163 - DNA, 35 bp, Artificial Sequence
  Synthetic oligonucleotide
acatcccgacaatatgcagtgatattgccactgga

SEQ ID NO: 92164 - DNA, 37 bp, Artificial Sequence
  Synthetic oligonucleotide
agacaccatcagccgactttatattttggttactgga

SEQ ID NO: 92165 - DNA, 37 bp, Artificial Sequence
  Synthetic oligonucleotide
tccaccctgaaccgtagtatgatccgcgtacgctgga

SEQ ID NO: 92166 - DNA, 37 bp, Artificial Sequence
  Synthetic oligonucleotide
gtcgctatcccccatgccgctgttccgtccatctgga

SEQ ID NO: 92167 - DNA, 35 bp, Artificial Sequence
  Synthetic oligonucleotide
gctacagtccgccctctccactgccgtatagtgga

SEQ ID NO: 92168 - DNA, 35 bp, Artificial Sequence
  Synthetic oligonucleotide
ttgaccaagggatgggggaatatcgagggtgtgga

SEQ ID NO: 92169 - DNA, 37 bp, Artificial Sequence
  Synthetic oligonucleotide
atatgccgccctatgcggtactacgctctctattgga

SEQ ID NO: 92170 - DNA, 38 bp, Artificial Sequence
  Synthetic oligonucleotide
ggagggcaaagagggccacgagggagccgggaaaatga

SEQ ID NO: 92171 - DNA, 38 bp, Artificial Sequence
  Synthetic oligonucleotide
gacgtagacgaggggaagggaaatcagaaagtaaatga

SEQ ID NO: 92172 - DNA, 38 bp, Artificial Sequence
  Synthetic oligonucleotide
gagagggggatgcgctagaagaaggatagtatcaatga

SEQ ID NO: 92173 - DNA, 38 bp, Artificial Sequence
  Synthetic oligonucleotide
gtcaaagcactagggcaacaaatgcaggattggaatga

SEQ ID NO: 92174 - DNA, 38 bp, Artificial Sequence
  Synthetic oligonucleotide
aaacagccacgaacatactcgacgctcccatctcatga

SEQ ID NO: 92175 - DNA, 38 bp, Artificial Sequence
  Synthetic oligonucleotide
gactacgtccatcacgtcccataaagttatagtcatga

SEQ ID NO: 92176 - DNA, 37 bp, Artificial Sequence
  Synthetic oligonucleotide
tgtgttagggcaaaaggggatcaaaggggcgtcatga

SEQ ID NO: 92177 - DNA, 38 bp, Artificial Sequence
  Synthetic oligonucleotide
gacacgacgtggaggtagacgtgtacgggctacgatga

SEQ ID NO: 92178 - DNA, 37 bp, Artificial Sequence
  Synthetic oligonucleotide
agaaaggaccggaagggggattatgcgaaaaggatga

SEQ ID NO: 92179 - DNA, 37 bp, Artificial Sequence
  Synthetic oligonucleotide
aatggggcattcggcgagaaaagtgctgaagggatga

SEQ ID NO: 92180 - DNA, 37 bp, Artificial Sequence
  Synthetic oligonucleotide
gtgtggtgaggctgtgcttggggctagtgggggatga

SEQ ID NO: 92181 - DNA, 38 bp, Artificial Sequence
  Synthetic oligonucleotide
tccagtcggacaggatattatcacctagtactgtatga

SEQ ID NO: 92182 - DNA, 37 bp, Artificial Sequence
  Synthetic oligonucleotide
aagagcgggggggagggaaatagggagctctttatga

SEQ ID NO: 92183 - DNA, 38 bp, Artificial Sequence
  Synthetic oligonucleotide
gcgatgcgactaacggcatctttgtctgctcaccctga

SEQ ID NO: 92184 - DNA, 37 bp, Artificial Sequence
  Synthetic oligonucleotide
acccacgttggtgttccgttgtctctgttcatcctga

SEQ ID NO: 92185 - DNA, 38 bp, Artificial Sequence
  Synthetic oligonucleotide
aacgaagggggatccacggggtttggaaaataggctga

SEQ ID NO: 92186 - DNA, 38 bp, Artificial Sequence
  Synthetic oligonucleotide
gatcgatgcatcagtagggtgttaggataaagtgctga

SEQ ID NO: 92187 - DNA, 38 bp, Artificial Sequence
  Synthetic oligonucleotide
acgtgacgtcaaagtagatccaccgtaacactctctga

SEQ ID NO: 92188 - DNA, 38 bp, Artificial Sequence
  Synthetic oligonucleotide
tcccacgtcccgacccttgatgtgtagctccggtctga

SEQ ID NO: 92189 - DNA, 38 bp, Artificial Sequence
  Synthetic oligonucleotide
atccatgtcggtccctgtttaactctggttcattctga

SEQ ID NO: 92190 - DNA, 35 bp, Artificial Sequence
  Synthetic oligonucleotide
tgaattggggcgaggaaacgagaacgttggcgtga

SEQ ID NO: 92191 - DNA, 38 bp, Artificial Sequence
  Synthetic oligonucleotide
tgcgggggggggagaagatgatgcaggggcgatcgtga

SEQ ID NO: 92192 - DNA, 38 bp, Artificial Sequence
  Synthetic oligonucleotide
gacaacgcatcacttctaccaacgtgacttcgtcgtga

SEQ ID NO: 92193 - DNA, 37 bp, Artificial Sequence
  Synthetic oligonucleotide
gaatgagagagggaaagagttaccgacatgatggtga

SEQ ID NO: 92194 - DNA, 37 bp, Artificial Sequence
  Synthetic oligonucleotide
acacccttacgtccagcccacttcactagttatgtga

SEQ ID NO: 92195 - DNA, 38 bp, Artificial Sequence
  Synthetic oligonucleotide
gcactggctctccgtctattattctgatcctcctgtga

SEQ ID NO: 92196 - DNA, 37 bp, Artificial Sequence
  Synthetic oligonucleotide
acgcgcatatcctatctgtgtcatccgccatctgtga

SEQ ID NO: 92197 - DNA, 37 bp, Artificial Sequence
  Synthetic oligonucleotide
gtcccgcctcccggttaagatgtacgtcctcgattga

SEQ ID NO: 92198 - DNA, 37 bp, Artificial Sequence
  Synthetic oligonucleotide
gttgcgagggaatgtggagaggaaattgaggtattga

SEQ ID NO: 92199 - DNA, 38 bp, Artificial Sequence
  Synthetic oligonucleotide
tcaacctgataactacctgtgctgggtgccatccttga

SEQ ID NO: 92200 - DNA, 38 bp, Artificial Sequence
  Synthetic oligonucleotide
taacgcatcgcctccactgagtagctccttttcgttga

SEQ ID NO: 92201 - DNA, 38 bp, Artificial Sequence
  Synthetic oligonucleotide
ttgtgcctagctgatgttgctttttcggctccctttga

SEQ ID NO: 92202 - DNA, 38 bp, Artificial Sequence
  Synthetic oligonucleotide
gacccaaccgtaccatactgtcgtatatcgggctttga

SEQ ID NO: 92203 - DNA, 36 bp, Artificial Sequence
  Synthetic oligonucleotide
tcgtgacccattgtgatttttgttccttcggtttga

SEQ ID NO: 92204 - DNA, 36 bp, Artificial Sequence
  Synthetic oligonucleotide
tccaactaccggctgtccaagaactcttcagcacta

SEQ ID NO: 92205 - DNA, 36 bp, Artificial Sequence
  Synthetic oligonucleotide
tgaggagagagaaacgcgatataaggtggcgtacta

SEQ ID NO: 92206 - DNA, 36 bp, Artificial Sequence
  Synthetic oligonucleotide
gatgagcgcacatatttttgacaactttcctagcta

SEQ ID NO: 92207 - DNA, 36 bp, Artificial Sequence
  Synthetic oligonucleotide
gcacccgcaagctgtcctccacccatgcctgcgcta

SEQ ID NO: 92208 - DNA, 36 bp, Artificial Sequence
  Synthetic oligonucleotide
tccaccccgcctgtttctacttgtacccggatgcta

SEQ ID NO: 92209 - DNA, 36 bp, Artificial Sequence
  Synthetic oligonucleotide
gccggggtcagccctagcaccttcgatccgaccgta

SEQ ID NO: 92210 - DNA, 35 bp, Artificial Sequence
  Synthetic oligonucleotide
aacagaagggcagaaaggtactgtgttggtgcgta

SEQ ID NO: 92211 - DNA, 36 bp, Artificial Sequence
  Synthetic oligonucleotide
taggagaggggtgcggggtattggtaccaggcggta

SEQ ID NO: 92212 - DNA, 36 bp, Artificial Sequence
  Synthetic oligonucleotide
gtcgcacactaaacattcacctctttcgctggggta

SEQ ID NO: 92213 - DNA, 36 bp, Artificial Sequence
  Synthetic oligonucleotide
gtcgcatcacatgcgagcagtacgggcagtagtgta

SEQ ID NO: 92214 - DNA, 35 bp, Artificial Sequence
  Synthetic oligonucleotide
atgtccagttccagcccaagccatgcacgctatta

SEQ ID NO: 92215 - DNA, 36 bp, Artificial Sequence
  Synthetic oligonucleotide
atacgcaatgggggggcatgggcttcacgggtctta

SEQ ID NO: 92216 - DNA, 36 bp, Artificial Sequence
  Synthetic oligonucleotide
gcaaacgctgacaggagacatggagggacatcttta

SEQ ID NO: 92217 - DNA, 35 bp, Artificial Sequence
  Synthetic oligonucleotide
tctagcccgaagtggtcctacactgcacacattac

SEQ ID NO: 92218 - DNA, 35 bp, Artificial Sequence
  Synthetic oligonucleotide
tgtgagcaccactgcctgcccggaatctgcgaacc

SEQ ID NO: 92219 - DNA, 35 bp, Artificial Sequence
  Synthetic oligonucleotide
actaaagcggtcacacatgcgtcatgtgctctacc

SEQ ID NO: 92220 - DNA, 35 bp, Artificial Sequence
  Synthetic oligonucleotide
gcacaacagtgcattatgaacttgcttcggagccc

SEQ ID NO: 92221 - DNA, 35 bp, Artificial Sequence
  Synthetic oligonucleotide
ggacactccgatcaaacagtgctttggtacatccc

SEQ ID NO: 92222 - DNA, 35 bp, Artificial Sequence
  Synthetic oligonucleotide
accgtcctgtcggtccactacatgcaaatagtccc

SEQ ID NO: 92223 - DNA, 35 bp, Artificial Sequence
  Synthetic oligonucleotide
aacacataccaaggtatgctgactacttgtaatcc

SEQ ID NO: 92224 - DNA, 30 bp, Artificial Sequence
  Synthetic oligonucleotide
tcaaccttagtcctcacaccgctgccgagc

SEQ ID NO: 92225 - DNA, 35 bp, Artificial Sequence
  Synthetic oligonucleotide
tagccgcaaagctaccgcacctctcagcccaccgc

SEQ ID NO: 92226 - DNA, 35 bp, Artificial Sequence
  Synthetic oligonucleotide
aacggaacaccatgaggtgaggggggaacgatcgc

SEQ ID NO: 92227 - DNA, 34 bp, Artificial Sequence
  Synthetic oligonucleotide
gtcgcaacgtgtcggtatcgcccatgtacgcatc

SEQ ID NO: 92228 - DNA, 35 bp, Artificial Sequence
  Synthetic oligonucleotide
tgacatcaccgcgctcattttgacacgctcttctc

SEQ ID NO: 92229 - DNA, 35 bp, Artificial Sequence
  Synthetic oligonucleotide
gaacggtagggggcctgtctggggtgcgccggttc

SEQ ID NO: 92230 - DNA, 35 bp, Artificial Sequence
  Synthetic oligonucleotide
gttgacgcgtcgggctccctcaactccctttgtag

SEQ ID NO: 92231 - DNA, 35 bp, Artificial Sequence
  Synthetic oligonucleotide
gccgacagagactacacccgcccgttcgccaaacg

SEQ ID NO: 92232 - DNA, 35 bp, Artificial Sequence
  Synthetic oligonucleotide
gacgcaatccgtggacgcttttttcctggtgtacg

SEQ ID NO: 92233 - DNA, 35 bp, Artificial Sequence
  Synthetic oligonucleotide
gtgggaaagcaatcgagacggggaatggtattacg

SEQ ID NO: 92234 - DNA, 35 bp, Artificial Sequence
  Synthetic oligonucleotide
gtgctaactcagtacacccttcatagtaacccccg

SEQ ID NO: 92235 - DNA, 35 bp, Artificial Sequence
  Synthetic oligonucleotide
attcgagggccccacgccaaccatacatctgttcg

SEQ ID NO: 92236 - DNA, 35 bp, Artificial Sequence
  Synthetic oligonucleotide
ttagacgtccgcctactttggtcactgatctttcg

SEQ ID NO: 92237 - DNA, 35 bp, Artificial Sequence
  Synthetic oligonucleotide
gagcagaccggcatgggttgggtcctaattaaagg

SEQ ID NO: 92238 - DNA, 35 bp, Artificial Sequence
  Synthetic oligonucleotide
gacaacaactttgaacagccttatcaggaagtagg

SEQ ID NO: 92239 - DNA, 35 bp, Artificial Sequence
  Synthetic oligonucleotide
gggtcgagagtcggtgcggaaatctaaatgaaggg

SEQ ID NO: 92240 - DNA, 35 bp, Artificial Sequence
  Synthetic oligonucleotide
gatagcctgcacgaatgggaactgtaagcaggggg

SEQ ID NO: 92241 - DNA, 35 bp, Artificial Sequence
  Synthetic oligonucleotide
gtgacgcgcctacagtgggagtagggggaatttgg

SEQ ID NO: 92242 - DNA, 35 bp, Artificial Sequence
  Synthetic oligonucleotide
gacatcagccctgcaccgatttgtgcgctcgcttg

SEQ ID NO: 92243 - DNA, 35 bp, Artificial Sequence
  Synthetic oligonucleotide
gcgccaaagcacacaccagatcacttgcgacccat

SEQ ID NO: 92244 - DNA, 35 bp, Artificial Sequence
  Synthetic oligonucleotide
ggtcatcacccgcagccaaaatggaaccgtactat

SEQ ID NO: 92245 - DNA, 35 bp, Artificial Sequence
  Synthetic oligonucleotide
ttcgcaagtaggatggtctgtggggggaaatgtat

SEQ ID NO: 92246 - DNA, 35 bp, Artificial Sequence
  Synthetic oligonucleotide
gacaggggtacagcactctcttaccaagacaaact

SEQ ID NO: 92247 - DNA, 35 bp, Artificial Sequence
  Synthetic oligonucleotide
atcgactggtcccagcccatgtcaaaaaatcgcct

SEQ ID NO: 92248 - DNA, 35 bp, Artificial Sequence
  Synthetic oligonucleotide
gcccagcactgtaaccgtatgtccgccctcacgct

SEQ ID NO: 92249 - DNA, 35 bp, Artificial Sequence
  Synthetic oligonucleotide
ttccccctgacgcgagatcacaatcaggcgatgct

SEQ ID NO: 92250 - DNA, 35 bp, Artificial Sequence
  Synthetic oligonucleotide
tcgcactgccctattcgaccaaccttgcctttgct

SEQ ID NO: 92251 - DNA, 35 bp, Artificial Sequence
  Synthetic oligonucleotide
tgctgatgacgctggccctagacataattgcctct

SEQ ID NO: 92252 - DNA, 35 bp, Artificial Sequence
  Synthetic oligonucleotide
gacgggtcatggaagaaactggagaacagtagggt

SEQ ID NO: 92253 - DNA, 35 bp, Artificial Sequence
  Synthetic oligonucleotide
acttccgcaaccagaagttgccgtttgacgctatt

SEQ ID NO: 92254 - DNA, 35 bp, Artificial Sequence
  Synthetic oligonucleotide
aaccattgccccatcagcttagcgactcaagtatt

SEQ ID NO: 92255 - DNA, 35 bp, Artificial Sequence
  Synthetic oligonucleotide
acctgcatgtgcattgtaatggatccttctcactt

SEQ ID NO: 92256 - DNA, 35 bp, Artificial Sequence
  Synthetic oligonucleotide
tacgactagggggctgaacaagcgccgataggctt

SEQ ID NO: 92257 - DNA, 35 bp, Artificial Sequence
  Synthetic oligonucleotide
tagagtccattcattgctgtcctgtgaccccagtt

SEQ ID NO: 92258 - DNA, 35 bp, Artificial Sequence
  Synthetic oligonucleotide
tcagcctgcctcctcacactccacatctcgcagtt

SEQ ID NO: 92259 - DNA, 35 bp, Artificial Sequence
  Synthetic oligonucleotide
gcaaaccaccgattggaccgaccatgctgcacgtt

SEQ ID NO: 92260 - DNA, 35 bp, Artificial Sequence
  Synthetic oligonucleotide
acatgcataaacaggagggcatcggcgtaggggtt

SEQ ID NO: 92261 - DNA, 35 bp, Artificial Sequence
  Synthetic oligonucleotide
gttgagtgggtgggaacaatcggggatctggggtt

SEQ ID NO: 92262 - DNA, 35 bp, Artificial Sequence
  Synthetic oligonucleotide
ttaggccccgcccgacatacatgtatcgcctggtt

SEQ ID NO: 92263 - DNA, 35 bp, Artificial Sequence
  Synthetic oligonucleotide
atgtaccgacctcgcatatggatgtccgtcctttt

SEQ ID NO: 92264 - DNA, 35 bp, Artificial Sequence
  Synthetic oligonucleotide
gttagaagaacgggggggaaagcgcgattgggaaa

SEQ ID NO: 92265 - DNA, 36 bp, Artificial Sequence
  Synthetic oligonucleotide
gtttgccgcaaaacaggagaatagcagatagataaa

SEQ ID NO: 92266 - DNA, 36 bp, Artificial Sequence
  Synthetic oligonucleotide
gagtactgcatcggtgtgcgaggacgggtgtataaa

SEQ ID NO: 92267 - DNA, 36 bp, Artificial Sequence
  Synthetic oligonucleotide
atcgggggaagaggaagcgagagcacaaggatacaa

SEQ ID NO: 92268 - DNA, 36 bp, Artificial Sequence
  Synthetic oligonucleotide
gatcaccacgcagccggccctaccatctttatgcaa

SEQ ID NO: 92269 - DNA, 36 bp, Artificial Sequence
  Synthetic oligonucleotide
atctatcccgcaagtgtatactcgcgccatcctcaa

SEQ ID NO: 92270 - DNA, 36 bp, Artificial Sequence
  Synthetic oligonucleotide
gtacgacaaagccatcaagggccagtacactctcaa

SEQ ID NO: 92271 - DNA, 36 bp, Artificial Sequence
  Synthetic oligonucleotide
aacaccaggaagaatggtgatacggtgtatcaggaa

SEQ ID NO: 92272 - DNA, 36 bp, Artificial Sequence
  Synthetic oligonucleotide
gcatacggtagaccgtgagggaaattgggctatgaa

SEQ ID NO: 92273 - DNA, 36 bp, Artificial Sequence
  Synthetic oligonucleotide
ttgatcggcggcacatctccagcgcgccacgggtaa

SEQ ID NO: 92274 - DNA, 36 bp, Artificial Sequence
  Synthetic oligonucleotide
gctgtcctcaccgctctacaaactggaacactgtaa

SEQ ID NO: 92275 - DNA, 35 bp, Artificial Sequence
  Synthetic oligonucleotide
ggatgcactggtcagaattttccaaccacccttaa

SEQ ID NO: 92276 - DNA, 35 bp, Artificial Sequence
  Synthetic oligonucleotide
ttcacgctaggcgacgctccttctgacaaccaaca

SEQ ID NO: 92277 - DNA, 35 bp, Artificial Sequence
  Synthetic oligonucleotide
tgtcccaactgcgccgtaacgcctcttcgagaaca

SEQ ID NO: 92278 - DNA, 36 bp, Artificial Sequence
  Synthetic oligonucleotide
tgtgactgggactcctgacttgaagaatgcgctaca

SEQ ID NO: 92279 - DNA, 35 bp, Artificial Sequence
  Synthetic oligonucleotide
tagtccacacagcatccacatcgcagcacccccca

SEQ ID NO: 92280 - DNA, 36 bp, Artificial Sequence
  Synthetic oligonucleotide
acgctggaccctcgggactgatgacactgctagcca

SEQ ID NO: 92281 - DNA, 36 bp, Artificial Sequence
  Synthetic oligonucleotide
accctcgctaatgcttacagtcctccgatcgatcca

SEQ ID NO: 92282 - DNA, 35 bp, Artificial Sequence
  Synthetic oligonucleotide
gcgcatccgctgctttatccccttcgccgactcca

SEQ ID NO: 92283 - DNA, 36 bp, Artificial Sequence
  Synthetic oligonucleotide
ttacgcctgcccttactggatcatcgcttgttagca

SEQ ID NO: 92284 - DNA, 36 bp, Artificial Sequence
  Synthetic oligonucleotide
ttcaatgactcacttgtcctatcaaactgtggatca

SEQ ID NO: 92285 - DNA, 36 bp, Artificial Sequence
  Synthetic oligonucleotide
tacacacagccttccgatcgactaagctagctatca

SEQ ID NO: 92286 - DNA, 36 bp, Artificial Sequence
  Synthetic oligonucleotide
gcgatctcgaatcgctcgtatcaccctgttctgtca

SEQ ID NO: 92287 - DNA, 36 bp, Artificial Sequence
  Synthetic oligonucleotide
tccacccgtttatcgtacttatcactgcactaaaga

SEQ ID NO: 92288 - DNA, 37 bp, Artificial Sequence
  Synthetic oligonucleotide
gcatgcagtggggttaagtagagtagtgagcggaaga

SEQ ID NO: 92289 - DNA, 35 bp, Artificial Sequence
  Synthetic oligonucleotide
atccacgggatgaggaacgaattggacggtacaga

SEQ ID NO: 92290 - DNA, 36 bp, Artificial Sequence
  Synthetic oligonucleotide
tgtacgggaagatatggggggggatcgtgctagaga

SEQ ID NO: 92291 - DNA, 37 bp, Artificial Sequence
  Synthetic oligonucleotide
taccaccacttgtgcgaaggcttcctccactgcgaga

SEQ ID NO: 92292 - DNA, 37 bp, Artificial Sequence
  Synthetic oligonucleotide
acacgtcatcgctggcaaggtggtgggtgagaggaga

SEQ ID NO: 92293 - DNA, 37 bp, Artificial Sequence
  Synthetic oligonucleotide
gtggatggattaaggaagggaaggctcaagggataga

SEQ ID NO: 92294 - DNA, 37 bp, Artificial Sequence
  Synthetic oligonucleotide
gactccgcaggagtcgtgtggcggaggcggatttaga

SEQ ID NO: 92295 - DNA, 37 bp, Artificial Sequence
  Synthetic oligonucleotide
tacacagggagacacgttgtagagtaggaggcgacga

SEQ ID NO: 92296 - DNA, 36 bp, Artificial Sequence
  Synthetic oligonucleotide
ggacctcaactggtgcacacctacttatcagaccga

SEQ ID NO: 92297 - DNA, 37 bp, Artificial Sequence
  Synthetic oligonucleotide
atgaacagcgtgagggtacacaccttcatcttgccga

SEQ ID NO: 92298 - DNA, 38 bp, Artificial Sequence
  Synthetic oligonucleotide
acttgacctcaaatcacgcactgacgacgactccgcga

SEQ ID NO: 92299 - DNA, 37 bp, Artificial Sequence
  Synthetic oligonucleotide
gtcaccaacttcctggtataaggcacaatccgcgcga

SEQ ID NO: 92300 - DNA, 35 bp, Artificial Sequence
  Synthetic oligonucleotide
ataatgcgcgggaagtagtgggagggagctcgcga

SEQ ID NO: 92301 - DNA, 37 bp, Artificial Sequence
  Synthetic oligonucleotide
agctagtgggccgggggtggattaggagctgaatcga

SEQ ID NO: 92302 - DNA, 37 bp, Artificial Sequence
  Synthetic oligonucleotide
atcgccatgcccgctcttgttttggacctgcgatcga

SEQ ID NO: 92303 - DNA, 36 bp, Artificial Sequence
  Synthetic oligonucleotide
gcatgacgggacaggataaatctgaagtagacagga

SEQ ID NO: 92304 - DNA, 37 bp, Artificial Sequence
  Synthetic oligonucleotide
acctgctcaaaacgctaacaacagctatcctccagga

SEQ ID NO: 92305 - DNA, 37 bp, Artificial Sequence
  Synthetic oligonucleotide
ggagggtcaagagggagatgtgggcggtcggaacgga

SEQ ID NO: 92306 - DNA, 37 bp, Artificial Sequence
  Synthetic oligonucleotide
tcatgtgttctgcaatcgctatcgttacccccccgga

SEQ ID NO: 92307 - DNA, 37 bp, Artificial Sequence
  Synthetic oligonucleotide
attcacgggccagggagggaatcggacgctaaaggga

SEQ ID NO: 92308 - DNA, 37 bp, Artificial Sequence
  Synthetic oligonucleotide
atcgcgccataacagactgactaacaggggaagggga

SEQ ID NO: 92309 - DNA, 37 bp, Artificial Sequence
  Synthetic oligonucleotide
tcagggtgcgagcattggtggaatggggttattggga

SEQ ID NO: 92310 - DNA, 37 bp, Artificial Sequence
  Synthetic oligonucleotide
tgtcacctccataaaaccactaggctccatcaatgga

SEQ ID NO: 92311 - DNA, 37 bp, Artificial Sequence
  Synthetic oligonucleotide
ttcgaagcgataacggcatatttacacacttcgatga

SEQ ID NO: 92312 - DNA, 38 bp, Artificial Sequence
  Synthetic oligonucleotide
tcataggagcaaggcaggtagtgcgtccggtactatga

SEQ ID NO: 92313 - DNA, 38 bp, Artificial Sequence
  Synthetic oligonucleotide
tagtagcctcccttgctagcctccaactcaatctatga

SEQ ID NO: 92314 - DNA, 37 bp, Artificial Sequence
  Synthetic oligonucleotide
tgtaccgtgcacacggtcgtttatgtcctttacctga

SEQ ID NO: 92315 - DNA, 38 bp, Artificial Sequence
  Synthetic oligonucleotide
gagtgacggattcacaggagagaggagatggagcctga

SEQ ID NO: 92316 - DNA, 38 bp, Artificial Sequence
  Synthetic oligonucleotide
accacctccctcccgttaaaggccagttcaccggctga

SEQ ID NO: 92317 - DNA, 38 bp, Artificial Sequence
  Synthetic oligonucleotide
actgcgacctcagttcaccgttacgctaccccctctga

SEQ ID NO: 92318 - DNA, 38 bp, Artificial Sequence
  Synthetic oligonucleotide
tgagtgaggaggttgggcattaacagttgggggtgtga

SEQ ID NO: 92319 - DNA, 38 bp, Artificial Sequence
  Synthetic oligonucleotide
gtcagagcaatccgcacctagtgtccctcaatttgtga

SEQ ID NO: 92320 - DNA, 38 bp, Artificial Sequence
  Synthetic oligonucleotide
gtcgcaatcggatctcagcgaaccgcaaatacacttga

SEQ ID NO: 92321 - DNA, 38 bp, Artificial Sequence
  Synthetic oligonucleotide
tccagccaacagccctatcgttggtccatgtcgcttga

SEQ ID NO: 92322 - DNA, 38 bp, Artificial Sequence
  Synthetic oligonucleotide
tagacgcactccaagttgtttccccattatgtcgttga

SEQ ID NO: 92323 - DNA, 36 bp, Artificial Sequence
  Synthetic oligonucleotide
tccacgtcggactcacgagcactcgcactccccgta

SEQ ID NO: 92324 - DNA, 36 bp, Artificial Sequence
  Synthetic oligonucleotide
gagcacattcaccactgtccttagcttgcccgggta

SEQ ID NO: 92325 - DNA, 36 bp, Artificial Sequence
  Synthetic oligonucleotide
taccaccacacaactgtgcattacttcacctcctta

SEQ ID NO: 92326 - DNA, 35 bp, Artificial Sequence
  Synthetic oligonucleotide
aagtacaatcgcagtgacaatagtctctttcctta

SEQ ID NO: 92327 - DNA, 34 bp, Artificial Sequence
  Synthetic oligonucleotide
ttccaagcccacttctctactcatcgtccagtta

SEQ ID NO: 92328 - DNA, 36 bp, Artificial Sequence
  Synthetic oligonucleotide
accgcttccggtcatcttttgccatgatcttggtta

SEQ ID NO: 92329 - DNA, 35 bp, Artificial Sequence
  Synthetic oligonucleotide
tacacccggtcccgcattaagctcgacgcaattta

SEQ ID NO: 92330 - DNA, 35 bp, Artificial Sequence
  Synthetic oligonucleotide
gcggaggggcgggaggggagggaaacgatgcgaac

SEQ ID NO: 92331 - DNA, 35 bp, Artificial Sequence
  Synthetic oligonucleotide
tgccccgcacccgttgctatctggttaattgttac

SEQ ID NO: 92332 - DNA, 35 bp, Artificial Sequence
  Synthetic oligonucleotide
attcaccacccgtggcgcgcttataaccatggacc

SEQ ID NO: 92333 - DNA, 35 bp, Artificial Sequence
  Synthetic oligonucleotide
tctccaccctccagtttgttcgactgtgcgccccc

SEQ ID NO: 92334 - DNA, 35 bp, Artificial Sequence
  Synthetic oligonucleotide
ttgacaacttagatcgccctgccattggctcgccc

SEQ ID NO: 92335 - DNA, 34 bp, Artificial Sequence
  Synthetic oligonucleotide
acccatcgcaccttttatacttcggtttatgccc

SEQ ID NO: 92336 - DNA, 35 bp, Artificial Sequence
  Synthetic oligonucleotide
acagacggtgcctcagtctgcgttccagcttgccc

SEQ ID NO: 92337 - DNA, 35 bp, Artificial Sequence
  Synthetic oligonucleotide
tcgcaccattcagatattgtcatctctgtctatcc

SEQ ID NO: 92338 - DNA, 35 bp, Artificial Sequence
  Synthetic oligonucleotide
tgtccgcctcccctgttccctgcgcctggcctcgc

SEQ ID NO: 92339 - DNA, 35 bp, Artificial Sequence
  Synthetic oligonucleotide
gacattagtgggtgcggtggaatggagtgcgtggc

SEQ ID NO: 92340 - DNA, 35 bp, Artificial Sequence
  Synthetic oligonucleotide
tttgcatagctggacccaccgctgcaccgggtggc

SEQ ID NO: 92341 - DNA, 35 bp, Artificial Sequence
  Synthetic oligonucleotide
gagcccccccgtagagttgcattggtagcaatctc

SEQ ID NO: 92342 - DNA, 35 bp, Artificial Sequence
  Synthetic oligonucleotide
gcgaaccccccccagatagttctccgtgtcctgtc

SEQ ID NO: 92343 - DNA, 35 bp, Artificial Sequence
  Synthetic oligonucleotide
acgatgcaccgaataaaacacgatgcctggagttc

SEQ ID NO: 92344 - DNA, 35 bp, Artificial Sequence
  Synthetic oligonucleotide
tgtggccaaaaggtcgcttcatcctccctcttaag

SEQ ID NO: 92345 - DNA, 36 bp, Artificial Sequence
  Synthetic oligonucleotide
gcgaggagggtaagaactaaaaacagtacggcggag

SEQ ID NO: 92346 - DNA, 35 bp, Artificial Sequence
  Synthetic oligonucleotide
tgtttcgcatcctccttttgttctggataacatcg

SEQ ID NO: 92347 - DNA, 35 bp, Artificial Sequence
  Synthetic oligonucleotide
aacatggtaggagggcgattaagtggccgggaagg

SEQ ID NO: 92348 - DNA, 35 bp, Artificial Sequence
  Synthetic oligonucleotide
tcagccatagcaaaccgcgttttggacccccgagg

SEQ ID NO: 92349 - DNA, 35 bp, Artificial Sequence
  Synthetic oligonucleotide
gtatggaaacgcgttaggggcggaagggattcggg

SEQ ID NO: 92350 - DNA, 35 bp, Artificial Sequence
  Synthetic oligonucleotide
tgagagcacggaacggaaaagaaggcaaaagctgg

SEQ ID NO: 92351 - DNA, 35 bp, Artificial Sequence
  Synthetic oligonucleotide
ttgtcccgtcctggttccagtctctaaggcccgtg

SEQ ID NO: 92352 - DNA, 35 bp, Artificial Sequence
  Synthetic oligonucleotide
taaaggggggtgagaggaaaacggggctggcgttg

SEQ ID NO: 92353 - DNA, 35 bp, Artificial Sequence
  Synthetic oligonucleotide
ggatagtgggtgagcattttgtagggggtgaacat

SEQ ID NO: 92354 - DNA, 35 bp, Artificial Sequence
  Synthetic oligonucleotide
tgtggggggagggcagaggatgtttctgaatagat

SEQ ID NO: 92355 - DNA, 35 bp, Artificial Sequence
  Synthetic oligonucleotide
gtgacacatcctaccacgccgaagcgcctcgcgat

SEQ ID NO: 92356 - DNA, 35 bp, Artificial Sequence
  Synthetic oligonucleotide
tctcacacctcgggttcacagagctgcatgtcact

SEQ ID NO: 92357 - DNA, 35 bp, Artificial Sequence
  Synthetic oligonucleotide
tccgcgaacggtaattccttgttgatgcctcgact

SEQ ID NO: 92358 - DNA, 35 bp, Artificial Sequence
  Synthetic oligonucleotide
gcacgtatgccagttccccctcaaccccgtttact

SEQ ID NO: 92359 - DNA, 35 bp, Artificial Sequence
  Synthetic oligonucleotide
gagcctcaccccctgtttatgtggtcttacgccct

SEQ ID NO: 92360 - DNA, 35 bp, Artificial Sequence
  Synthetic oligonucleotide
atcgacccgggactgtttggttcggaacttctcct

SEQ ID NO: 92361 - DNA, 35 bp, Artificial Sequence
  Synthetic oligonucleotide
gttggggttaggggagttaggcggccaggagagct

SEQ ID NO: 92362 - DNA, 35 bp, Artificial Sequence
  Synthetic oligonucleotide
gtgactgcggcctcgcggtccttcttgaccactct

SEQ ID NO: 92363 - DNA, 35 bp, Artificial Sequence
  Synthetic oligonucleotide
gacaacccggcccggtcgcgtacagagatagcagt

SEQ ID NO: 92364 - DNA, 35 bp, Artificial Sequence
  Synthetic oligonucleotide
gtcactatacaggccgggacctccttgagacgagt

SEQ ID NO: 92365 - DNA, 35 bp, Artificial Sequence
  Synthetic oligonucleotide
gatgcttgattgggaataggtggagggtaggacgt

SEQ ID NO: 92366 - DNA, 35 bp, Artificial Sequence
  Synthetic oligonucleotide
atgctctctagcacagtatcacactcgccgttggt

SEQ ID NO: 92367 - DNA, 35 bp, Artificial Sequence
  Synthetic oligonucleotide
gcacatgttcacataatctgtagtttacttttggt

SEQ ID NO: 92368 - DNA, 35 bp, Artificial Sequence
  Synthetic oligonucleotide
aatccgacgcctgcctactgacaggtattacttgt

SEQ ID NO: 92369 - DNA, 35 bp, Artificial Sequence
  Synthetic oligonucleotide
taaaccagccaccagaggcaatctggcccttgctt

SEQ ID NO: 92370 - DNA, 35 bp, Artificial Sequence
  Synthetic oligonucleotide
tgcacccagctttaggtctgactccaattactctt

SEQ ID NO: 92371 - DNA, 35 bp, Artificial Sequence
  Synthetic oligonucleotide
gaacctccagcaggattacagtagccctgcttctt

SEQ ID NO: 92372 - DNA, 35 bp, Artificial Sequence
  Synthetic oligonucleotide
tgttacacagcgcctacctcaccatttcaccagtt

SEQ ID NO: 92373 - DNA, 35 bp, Artificial Sequence
  Synthetic oligonucleotide
tgagacagggggtggtgctctcgttgacgaaaaaa

SEQ ID NO: 92374 - DNA, 36 bp, Artificial Sequence
  Synthetic oligonucleotide
ttacgccccgacgaaagacgccctttcgtaagtaaa

SEQ ID NO: 92375 - DNA, 34 bp, Artificial Sequence
  Synthetic oligonucleotide
accctgtgcccggggtgccaaatatcacgtacaa

SEQ ID NO: 92376 - DNA, 36 bp, Artificial Sequence
  Synthetic oligonucleotide
agtcacagggaccgggaaaataggggcagataggaa

SEQ ID NO: 92377 - DNA, 36 bp, Artificial Sequence
  Synthetic oligonucleotide
tcgtaacaagaggaggaagggcggaaaactggtgaa

SEQ ID NO: 92378 - DNA, 36 bp, Artificial Sequence
  Synthetic oligonucleotide
tgacccctaattccaacgtgcctgtctctacgctaa

SEQ ID NO: 92379 - DNA, 36 bp, Artificial Sequence
  Synthetic oligonucleotide
agcgatagatgataagatgggggggacggacaaaca

SEQ ID NO: 92380 - DNA, 36 bp, Artificial Sequence
  Synthetic oligonucleotide
aaccacgaaaaacgttttcgggaaccttggggaaca

SEQ ID NO: 92381 - DNA, 36 bp, Artificial Sequence
  Synthetic oligonucleotide
tacctggtcgcggtcattgcgcatcacgttaaacca

SEQ ID NO: 92382 - DNA, 36 bp, Artificial Sequence
  Synthetic oligonucleotide
gactcattgccgctgcagtggaattccgtcacacca

SEQ ID NO: 92383 - DNA, 36 bp, Artificial Sequence
  Synthetic oligonucleotide
actcccaccgattacatgtacattgaagctgaccca

SEQ ID NO: 92384 - DNA, 35 bp, Artificial Sequence
  Synthetic oligonucleotide
tatgtcagccgcttagtagcaggcgaatcccccca

SEQ ID NO: 92385 - DNA, 36 bp, Artificial Sequence
  Synthetic oligonucleotide
ttgacgatcacagccgatcgttcaacactgtatcca

SEQ ID NO: 92386 - DNA, 36 bp, Artificial Sequence
  Synthetic oligonucleotide
accacgaccccggggccatcaagcatggaatctcca

SEQ ID NO: 92387 - DNA, 36 bp, Artificial Sequence
  Synthetic oligonucleotide
tctgtgccgacgtcgtattgcccccccgtaagtcca

SEQ ID NO: 92388 - DNA, 36 bp, Artificial Sequence
  Synthetic oligonucleotide
ttcgccccagactacacgcgtgtacatgactccgca

SEQ ID NO: 92389 - DNA, 36 bp, Artificial Sequence
  Synthetic oligonucleotide
agtgtcgcgcgggaaaggggtcttaaggggttcgca

SEQ ID NO: 92390 - DNA, 36 bp, Artificial Sequence
  Synthetic oligonucleotide
atgatggtccaattgcagccacagtagatctaatca

SEQ ID NO: 92391 - DNA, 36 bp, Artificial Sequence
  Synthetic oligonucleotide
gtcctgggcacgtcaccgtcattcattacagtatca

SEQ ID NO: 92392 - DNA, 35 bp, Artificial Sequence
  Synthetic oligonucleotide
tgtacctgttcctgtttgaagcaacctcgacctca

SEQ ID NO: 92393 - DNA, 35 bp, Artificial Sequence
  Synthetic oligonucleotide
gtacaccgcaatatcagctagatctaatgccctca

SEQ ID NO: 92394 - DNA, 36 bp, Artificial Sequence
  Synthetic oligonucleotide
gcccagacaccatccgtgccagttaactttctttca

SEQ ID NO: 92395 - DNA, 37 bp, Artificial Sequence
  Synthetic oligonucleotide
tctacgcgtgctccttccgcgcatacttaatccaaga

SEQ ID NO: 92396 - DNA, 37 bp, Artificial Sequence
  Synthetic oligonucleotide
ccacgactagacccccgctcactggccgccacacaga

SEQ ID NO: 92397 - DNA, 37 bp, Artificial Sequence
  Synthetic oligonucleotide
aacatacgcgagcaagaaaggtgtaatctggggcaga

SEQ ID NO: 92398 - DNA, 37 bp, Artificial Sequence
  Synthetic oligonucleotide
gacgcctggacgggaaagtagagggtttatgatcaga

SEQ ID NO: 92399 - DNA, 37 bp, Artificial Sequence
  Synthetic oligonucleotide
accgatgctagcaattggccctactgctgacactaga

SEQ ID NO: 92400 - DNA, 35 bp, Artificial Sequence
  Synthetic oligonucleotide
ttatcgtgcagcccgggtccgctgtcactccccga

SEQ ID NO: 92401 - DNA, 35 bp, Artificial Sequence
  Synthetic oligonucleotide
atgagcagaaggcggatcattagcgctggtgtcga

SEQ ID NO: 92402 - DNA, 37 bp, Artificial Sequence
  Synthetic oligonucleotide
gtccactgctctccgacttgaccaggacggccttcga

SEQ ID NO: 92403 - DNA, 36 bp, Artificial Sequence
  Synthetic oligonucleotide
gagaagggaagaaagctgggtagtactagcaaagga

SEQ ID NO: 92404 - DNA, 37 bp, Artificial Sequence
  Synthetic oligonucleotide
tgccatcccgcctatcctaacagtagcagatctagga

SEQ ID NO: 92405 - DNA, 37 bp, Artificial Sequence
  Synthetic oligonucleotide
ttacatcatccctgccacgctatgtccgagaaccgga

SEQ ID NO: 92406 - DNA, 37 bp, Artificial Sequence
  Synthetic oligonucleotide
atgagcggggcgttgtaggcagaatagagagggcgga

SEQ ID NO: 92407 - DNA, 37 bp, Artificial Sequence
  Synthetic oligonucleotide
atcagccctgtaagcttacaatgcccttagtctcgga

SEQ ID NO: 92408 - DNA, 36 bp, Artificial Sequence
  Synthetic oligonucleotide
gacgatgaaggtggcgatcaattagggtgtgcggga

SEQ ID NO: 92409 - DNA, 37 bp, Artificial Sequence
  Synthetic oligonucleotide
ggaaccgccgagcaccgatcgatcatctccaggggga

SEQ ID NO: 92410 - DNA, 37 bp, Artificial Sequence
  Synthetic oligonucleotide
ggagagggggtgtgtgtgaattggagagtggtgtgga

SEQ ID NO: 92411 - DNA, 35 bp, Artificial Sequence
  Synthetic oligonucleotide
accacctcgtggccattccccatccttccattgga

SEQ ID NO: 92412 - DNA, 37 bp, Artificial Sequence
  Synthetic oligonucleotide
tagtacgcatgggcggcaggaccgcaaacgaaaatga

SEQ ID NO: 92413 - DNA, 38 bp, Artificial Sequence
  Synthetic oligonucleotide
actccacaggcatatgctctacttgaccagccacatga

SEQ ID NO: 92414 - DNA, 37 bp, Artificial Sequence
  Synthetic oligonucleotide
tccaagacagatgggacaacgagagataatgcgatga

SEQ ID NO: 92415 - DNA, 38 bp, Artificial Sequence
  Synthetic oligonucleotide
gaacgcacggtcctgatggcacacccgactttacctga

SEQ ID NO: 92416 - DNA, 37 bp, Artificial Sequence
  Synthetic oligonucleotide
tgtgcaccgtaccacaaaccagcttacgctctgctga

SEQ ID NO: 92417 - DNA, 38 bp, Artificial Sequence
  Synthetic oligonucleotide
gacgacaactgacgaggaaaaggggtggggtgtgctga

SEQ ID NO: 92418 - DNA, 38 bp, Artificial Sequence
  Synthetic oligonucleotide
tgacaccagaaggatgcgtcacaccattgctattctga

SEQ ID NO: 92419 - DNA, 36 bp, Artificial Sequence
  Synthetic oligonucleotide
agtcatgaagagggacaggagaatgtttgggcgtga

SEQ ID NO: 92420 - DNA, 37 bp, Artificial Sequence
  Synthetic oligonucleotide
atgatcggcgagactgcatgttgtgctctcacggtga

SEQ ID NO: 92421 - DNA, 38 bp, Artificial Sequence
  Synthetic oligonucleotide
gctgtgcagggaaagggtagtcagtcgcggtagggtga

SEQ ID NO: 92422 - DNA, 38 bp, Artificial Sequence
  Synthetic oligonucleotide
tgaccggtcggaatgtggtcgttgaactgaacgggtga

SEQ ID NO: 92423 - DNA, 38 bp, Artificial Sequence
  Synthetic oligonucleotide
gtgccgcatcgggtggtgatatagtgagggaaaattga

SEQ ID NO: 92424 - DNA, 35 bp, Artificial Sequence
  Synthetic oligonucleotide
tatcgccccaggttttcgcccgcgcttggccttga

SEQ ID NO: 92425 - DNA, 38 bp, Artificial Sequence
  Synthetic oligonucleotide
tcgaatgaacgtgtgggtgcgtgggtcgggcatcttga

SEQ ID NO: 92426 - DNA, 38 bp, Artificial Sequence
  Synthetic oligonucleotide
gacgacaccggctgccctccggctctgtcatctcttga

SEQ ID NO: 92427 - DNA, 38 bp, Artificial Sequence
  Synthetic oligonucleotide
taatcaggggaggtagtgcgtcgtagcgcaacggttga

SEQ ID NO: 92428 - DNA, 38 bp, Artificial Sequence
  Synthetic oligonucleotide
accagacgctggattctggatgtccactcgacctttga

SEQ ID NO: 92429 - DNA, 36 bp, Artificial Sequence
  Synthetic oligonucleotide
gactgcccacacgctccctgtaaacgatgacctata

SEQ ID NO: 92430 - DNA, 36 bp, Artificial Sequence
  Synthetic oligonucleotide
acaccgtgcgtgtggtgatctatgccgccttctata

SEQ ID NO: 92431 - DNA, 35 bp, Artificial Sequence
  Synthetic oligonucleotide
gccggaccaagcccccgatttcatatatcgaacta

SEQ ID NO: 92432 - DNA, 36 bp, Artificial Sequence
  Synthetic oligonucleotide
atggtcacgcctttagtctctatgcacccgcccgta

SEQ ID NO: 92433 - DNA, 35 bp, Artificial Sequence
  Synthetic oligonucleotide
tgacaacgttcaggctgatctccaacctccgcgta

SEQ ID NO: 92434 - DNA, 36 bp, Artificial Sequence
  Synthetic oligonucleotide
acatgcagaacgtatacctcgtttggccatgcatta

SEQ ID NO: 92435 - DNA, 36 bp, Artificial Sequence
  Synthetic oligonucleotide
tatacagcacgtaccgcggtatttacgcctctctta

SEQ ID NO: 92436 - DNA, 35 bp, Artificial Sequence
  Synthetic oligonucleotide
taggcccccactcgaaacttgcctactgtcgttta

SEQ ID NO: 92437 - DNA, 35 bp, Artificial Sequence
  Synthetic oligonucleotide
acgcatatgctccaactgtcgtttccacacgcaac

SEQ ID NO: 92438 - DNA, 35 bp, Artificial Sequence
  Synthetic oligonucleotide
tgagcctgccacacggttcacgtccaagacctgac

SEQ ID NO: 92439 - DNA, 35 bp, Artificial Sequence
  Synthetic oligonucleotide
taacattgcagagcgtttcgtgtctcccgccctac

SEQ ID NO: 92440 - DNA, 35 bp, Artificial Sequence
  Synthetic oligonucleotide
gccatgaaacgcgaactgccgtcctgacgagtccc

SEQ ID NO: 92441 - DNA, 35 bp, Artificial Sequence
  Synthetic oligonucleotide
gtaacgacgcgcgcaatccgttcacacgtccatcc

SEQ ID NO: 92442 - DNA, 35 bp, Artificial Sequence
  Synthetic oligonucleotide
tccacgtagcttgctctctcgacccgttacgaagc

SEQ ID NO: 92443 - DNA, 35 bp, Artificial Sequence
  Synthetic oligonucleotide
actcatcctctgttctgtcaaaccgtcctcgccgc

SEQ ID NO: 92444 - DNA, 35 bp, Artificial Sequence
  Synthetic oligonucleotide
gacggagcggacactccgtagacaactccactggc

SEQ ID NO: 92445 - DNA, 35 bp, Artificial Sequence
  Synthetic oligonucleotide
atcacggcctaacattccatcttctcagtcgtggc

SEQ ID NO: 92446 - DNA, 35 bp, Artificial Sequence
  Synthetic oligonucleotide
tcaactgggcggtaacatcaagcttccttccttgc

SEQ ID NO: 92447 - DNA, 35 bp, Artificial Sequence
  Synthetic oligonucleotide
acagtgccccctagttcaagctgctttctcacatc

SEQ ID NO: 92448 - DNA, 35 bp, Artificial Sequence
  Synthetic oligonucleotide
gtcacccatgagattatcgcccgattatttccatc

SEQ ID NO: 92449 - DNA, 35 bp, Artificial Sequence
  Synthetic oligonucleotide
gcccgtccgtccccctgcttccttattgcggactc

SEQ ID NO: 92450 - DNA, 35 bp, Artificial Sequence
  Synthetic oligonucleotide
acgtggagccattgagtcgttcctgccacatactc

SEQ ID NO: 92451 - DNA, 35 bp, Artificial Sequence
  Synthetic oligonucleotide
atgtgcacatccatcgtgcttctcctattgcgctc

SEQ ID NO: 92452 - DNA, 35 bp, Artificial Sequence
  Synthetic oligonucleotide
acgcccatgtgccggttcaagctgatacggatctc

SEQ ID NO: 92453 - DNA, 35 bp, Artificial Sequence
  Synthetic oligonucleotide
aatgcctgagtcacgtccttcccatttctgacttc

SEQ ID NO: 92454 - DNA, 35 bp, Artificial Sequence
  Synthetic oligonucleotide
gaacaacgggacgtggggatgaaatactgtgagag

SEQ ID NO: 92455 - DNA, 35 bp, Artificial Sequence
  Synthetic oligonucleotide
gccatgggactacctgtatactcctcgaattaacg

SEQ ID NO: 92456 - DNA, 35 bp, Artificial Sequence
  Synthetic oligonucleotide
atactcacgcacgcatgcacgcatttgacaatgcg

SEQ ID NO: 92457 - DNA, 35 bp, Artificial Sequence
  Synthetic oligonucleotide
tccgacaaacgctagaattctgcctccgctaccgg

SEQ ID NO: 92458 - DNA, 35 bp, Artificial Sequence
  Synthetic oligonucleotide
gtccaacggaaaggactgggcaagagagatggggg

SEQ ID NO: 92459 - DNA, 35 bp, Artificial Sequence
  Synthetic oligonucleotide
tagaaaaggggcaacgaacgaggttagggtggggg

SEQ ID NO: 92460 - DNA, 35 bp, Artificial Sequence
  Synthetic oligonucleotide
tgtgactcgtgaaaaatggttggtgtgaaggtctg

SEQ ID NO: 92461 - DNA, 35 bp, Artificial Sequence
  Synthetic oligonucleotide
agtacggagaggtctagaatccggtgggaaaggtg

SEQ ID NO: 92462 - DNA, 35 bp, Artificial Sequence
  Synthetic oligonucleotide
gtgcaagtccgtcgtgtgctaccatccgaggggtg

SEQ ID NO: 92463 - DNA, 35 bp, Artificial Sequence
  Synthetic oligonucleotide
gtccgtgggggggataggagaatcatgcttgggtg

SEQ ID NO: 92464 - DNA, 34 bp, Artificial Sequence
  Synthetic oligonucleotide
tgtccagagaagcgagaaaaggaagaaggtggtg

SEQ ID NO: 92465 - DNA, 35 bp, Artificial Sequence
  Synthetic oligonucleotide
acacacagggacgctccgtgacttatgcttttttg

SEQ ID NO: 92466 - DNA, 35 bp, Artificial Sequence
  Synthetic oligonucleotide
atcgacggggccatcaaagcgaagggggggcgcat

SEQ ID NO: 92467 - DNA, 35 bp, Artificial Sequence
  Synthetic oligonucleotide
aagtgtggacagggtgtgtgaggagcgtggtggat

SEQ ID NO: 92468 - DNA, 35 bp, Artificial Sequence
  Synthetic oligonucleotide
tcactcacagccttgacaaaatgagacccttacct

SEQ ID NO: 92469 - DNA, 35 bp, Artificial Sequence
  Synthetic oligonucleotide
gcgaaacgttgggtccgcgtggaagggaattcgct

SEQ ID NO: 92470 - DNA, 35 bp, Artificial Sequence
  Synthetic oligonucleotide
tacagccacgccctgagcctgttattcttccctct

SEQ ID NO: 92471 - DNA, 35 bp, Artificial Sequence
  Synthetic oligonucleotide
tactccgctgcgttcggccatccgtctgtctacgt

SEQ ID NO: 92472 - DNA, 35 bp, Artificial Sequence
  Synthetic oligonucleotide
tgtccccgcaacataagccgtatcgcaaccgcatt

SEQ ID NO: 92473 - DNA, 35 bp, Artificial Sequence
  Synthetic oligonucleotide
tgacgccgttccagggaaccgagcgtaccttcatt

SEQ ID NO: 92474 - DNA, 34 bp, Artificial Sequence
  Synthetic oligonucleotide
tgtgggcaagatgagggggtaggtgaaggcgatt

SEQ ID NO: 92475 - DNA, 35 bp, Artificial Sequence
  Synthetic oligonucleotide
gacaggtgtagtgtagtaagtcgggcgggtggatt

SEQ ID NO: 92476 - DNA, 35 bp, Artificial Sequence
  Synthetic oligonucleotide
gacacaacatagtctgtatatcccaactccaactt

SEQ ID NO: 92477 - DNA, 35 bp, Artificial Sequence
  Synthetic oligonucleotide
gtaaatggggcccgaggaagtgtagtggcccattt

SEQ ID NO: 92478 - DNA, 35 bp, Artificial Sequence
  Synthetic oligonucleotide
gatgcgaaccgtgggttcgttaccttcaattattt

SEQ ID NO: 92479 - DNA, 36 bp, Artificial Sequence
  Synthetic oligonucleotide
acctacaatcgcacagggctattcgaaggcataaaa

SEQ ID NO: 92480 - DNA, 36 bp, Artificial Sequence
  Synthetic oligonucleotide
atgccagccgagacacgatcgggggtggatgagcaa

SEQ ID NO: 92481 - DNA, 36 bp, Artificial Sequence
  Synthetic oligonucleotide
gaacagtgggggggctggttccgttcatatagggaa

SEQ ID NO: 92482 - DNA, 36 bp, Artificial Sequence
  Synthetic oligonucleotide
ggtacaggggggaatagcaaggggagccgctgataa

SEQ ID NO: 92483 - DNA, 35 bp, Artificial Sequence
  Synthetic oligonucleotide
agcacccactctcccacgtatggatgccatgcaca

SEQ ID NO: 92484 - DNA, 36 bp, Artificial Sequence
  Synthetic oligonucleotide
cgcaactgttgcgtctagctgctacataggcggaca

SEQ ID NO: 92485 - DNA, 35 bp, Artificial Sequence
  Synthetic oligonucleotide
gacagggcgaccacgaaagagtcgacggatataca

SEQ ID NO: 92486 - DNA, 36 bp, Artificial Sequence
  Synthetic oligonucleotide
tgacccccattgcgaaataaaaagcgatgtctacca

SEQ ID NO: 92487 - DNA, 34 bp, Artificial Sequence
  Synthetic oligonucleotide
gccaacccctttctgttaacctctacgcattcca

SEQ ID NO: 92488 - DNA, 35 bp, Artificial Sequence
  Synthetic oligonucleotide
gatcatggggtgcaaagtggaagggtgagtgcgca

SEQ ID NO: 92489 - DNA, 35 bp, Artificial Sequence
  Synthetic oligonucleotide
acgcaacgcacccattcgttcaataggggttatca

SEQ ID NO: 92490 - DNA, 36 bp, Artificial Sequence
  Synthetic oligonucleotide
actgagagcggtacgacgcaactccccactttgtca

SEQ ID NO: 92491 - DNA, 35 bp, Artificial Sequence
  Synthetic oligonucleotide
tcatacatcgctactttattaagcctgttggttca

SEQ ID NO: 92492 - DNA, 35 bp, Artificial Sequence
  Synthetic oligonucleotide
gaatgcaaaacgtagcgtgggcccgtatcatttca

SEQ ID NO: 92493 - DNA, 36 bp, Artificial Sequence
  Synthetic oligonucleotide
atcggtcataccccattcgcaataaagcaactttca

SEQ ID NO: 92494 - DNA, 37 bp, Artificial Sequence
  Synthetic oligonucleotide
acgagaagcacaccgcaaggggcttgggaagacaaga

SEQ ID NO: 92495 - DNA, 37 bp, Artificial Sequence
  Synthetic oligonucleotide
gacgtccgtcacgatcgccctctaaactttcccaaga

SEQ ID NO: 92496 - DNA, 37 bp, Artificial Sequence
  Synthetic oligonucleotide
tcacaccacacatcacaacgaccatgtaccagtaaga

SEQ ID NO: 92497 - DNA, 37 bp, Artificial Sequence
  Synthetic oligonucleotide
accgcagggaaagctcggttatgtgacggaatgcaga

SEQ ID NO: 92498 - DNA, 37 bp, Artificial Sequence
  Synthetic oligonucleotide
taaccctgtggcccacctgtctacaatacgtctcaga

SEQ ID NO: 92499 - DNA, 37 bp, Artificial Sequence
  Synthetic oligonucleotide
tacagacagcggacacgtatttttttatgttggacga

SEQ ID NO: 92500 - DNA, 36 bp, Artificial Sequence
  Synthetic oligonucleotide
attggaaccaccgcagacgttatagtctcgctccga

SEQ ID NO: 92501 - DNA, 37 bp, Artificial Sequence
  Synthetic oligonucleotide
gatcgcgcgcatggtttcgcctctcgaaggattccga

SEQ ID NO: 92502 - DNA, 37 bp, Artificial Sequence
  Synthetic oligonucleotide
agagcacagggataaaggcggggtgggtctattccga

SEQ ID NO: 92503 - DNA, 37 bp, Artificial Sequence
  Synthetic oligonucleotide
acgacacacttaagtgtaatttaaccatgccttccga

SEQ ID NO: 92504 - DNA, 37 bp, Artificial Sequence
  Synthetic oligonucleotide
tcacacgtccaaaaatacaagatggcgccactcgcga

SEQ ID NO: 92505 - DNA, 37 bp, Artificial Sequence
  Synthetic oligonucleotide
gggggaggtgacacaagacagaagaataagagtgcga

SEQ ID NO: 92506 - DNA, 36 bp, Artificial Sequence
  Synthetic oligonucleotide
gggtacgcacaaggagaggaacgggggacaggtcga

SEQ ID NO: 92507 - DNA, 36 bp, Artificial Sequence
  Synthetic oligonucleotide
tacgactacgtcctgcccatcggacgcgaccttcga

SEQ ID NO: 92508 - DNA, 37 bp, Artificial Sequence
  Synthetic oligonucleotide
gtgaccccccgatatctacctaacgacctgttccgga

SEQ ID NO: 92509 - DNA, 37 bp, Artificial Sequence
  Synthetic oligonucleotide
tcaaggggaagaaggggataaagctgctctattcgga

SEQ ID NO: 92510 - DNA, 36 bp, Artificial Sequence
  Synthetic oligonucleotide
tgaacgtcgaccacactagcgaaaacagagaaggga

SEQ ID NO: 92511 - DNA, 37 bp, Artificial Sequence
  Synthetic oligonucleotide
tacggggggggccgcatgattggggagtcggtaggga

SEQ ID NO: 92512 - DNA, 37 bp, Artificial Sequence
  Synthetic oligonucleotide
gaaaagagatgggggggtgtgtaaagttcgctcggga

SEQ ID NO: 92513 - DNA, 37 bp, Artificial Sequence
  Synthetic oligonucleotide
gatggggaacgataagcggagctagcacgggagggga

SEQ ID NO: 92514 - DNA, 37 bp, Artificial Sequence
  Synthetic oligonucleotide
agaatacgcggaggatgaagtaagtatggggagggga

SEQ ID NO: 92515 - DNA, 37 bp, Artificial Sequence
  Synthetic oligonucleotide
aatcgggacaatggtggataaaatagatgatagggga

SEQ ID NO: 92516 - DNA, 37 bp, Artificial Sequence
  Synthetic oligonucleotide
atcatcgaacaggggatcagcgtacggatatggggga

SEQ ID NO: 92517 - DNA, 37 bp, Artificial Sequence
  Synthetic oligonucleotide
aatggtgagaacgggctggagataagcaaaggatgga

SEQ ID NO: 92518 - DNA, 37 bp, Artificial Sequence
  Synthetic oligonucleotide
accacctgtcctgacgaattctataaaacatacatga

SEQ ID NO: 92519 - DNA, 37 bp, Artificial Sequence
  Synthetic oligonucleotide
acctgcccgctttgccctcttggttcaggctacatga

SEQ ID NO: 92520 - DNA, 38 bp, Artificial Sequence
  Synthetic oligonucleotide
tccgtagcacagactgctaatagcgttcccgtacatga

SEQ ID NO: 92521 - DNA, 37 bp, Artificial Sequence
  Synthetic oligonucleotide
acctgtccatgcgatattgcaagcccactctgcatga

SEQ ID NO: 92522 - DNA, 38 bp, Artificial Sequence
  Synthetic oligonucleotide
ggggtggtaccaagggaatggcggcgagaggatactga

SEQ ID NO: 92523 - DNA, 37 bp, Artificial Sequence
  Synthetic oligonucleotide
tcccggagacgggataagcctgcaattgcccccgtga

SEQ ID NO: 92524 - DNA, 38 bp, Artificial Sequence
  Synthetic oligonucleotide
gcgatcgccgaccagtagattcttcatccctcccgtga

SEQ ID NO: 92525 - DNA, 38 bp, Artificial Sequence
  Synthetic oligonucleotide
tcaacctggaggggggggacgtcgtgctgttggcgtga

SEQ ID NO: 92526 - DNA, 38 bp, Artificial Sequence
  Synthetic oligonucleotide
tcatcgagcctcagtcacgtcaactttagccactgtga

SEQ ID NO: 92527 - DNA, 38 bp, Artificial Sequence
  Synthetic oligonucleotide
gacgacaatcgcctcccgatttagacgcctatcattga

SEQ ID NO: 92528 - DNA, 37 bp, Artificial Sequence
  Synthetic oligonucleotide
gtctggcgcaacggaggacggaaagacttgggattga

SEQ ID NO: 92529 - DNA, 38 bp, Artificial Sequence
  Synthetic oligonucleotide
tccccgagacgcaatccggggacttttgacaaccttga

SEQ ID NO: 92530 - DNA, 38 bp, Artificial Sequence
  Synthetic oligonucleotide
atgggcatgcaccttgcgtactttacctcgtcccttga

SEQ ID NO: 92531 - DNA, 37 bp, Artificial Sequence
  Synthetic oligonucleotide
tccactgcagcacgtgactccaaccgcttgttcttga

SEQ ID NO: 92532 - DNA, 37 bp, Artificial Sequence
  Synthetic oligonucleotide
tgacagtgcgccgtagaagggcttgaggtaaggttga

SEQ ID NO: 92533 - DNA, 37 bp, Artificial Sequence
  Synthetic oligonucleotide
gtaccaccccggcaaacgcgatttcagtccaggttga

SEQ ID NO: 92534 - DNA, 38 bp, Artificial Sequence
  Synthetic oligonucleotide
ttcgcacgtgggcacgctgtgggaggagggggggttga

SEQ ID NO: 92535 - DNA, 38 bp, Artificial Sequence
  Synthetic oligonucleotide
acacccgcaggtgacatatattggtggtgcatggttga

SEQ ID NO: 92536 - DNA, 38 bp, Artificial Sequence
  Synthetic oligonucleotide
gcccaccactcgcctttgcctttgacgttacttgttga

SEQ ID NO: 92537 - DNA, 38 bp, Artificial Sequence
  Synthetic oligonucleotide
acctgtcgctcgctgttctaaccgtccctccagtttga

SEQ ID NO: 92538 - DNA, 37 bp, Artificial Sequence
  Synthetic oligonucleotide
tgatagcgtagccgtccttccgattctacgtttttga

SEQ ID NO: 92539 - DNA, 35 bp, Artificial Sequence
  Synthetic oligonucleotide
tgctaccgccgcatctaatgaaccttgcccgaata

SEQ ID NO: 92540 - DNA, 36 bp, Artificial Sequence
  Synthetic oligonucleotide
gactccgccgaacctttatgccatctgtcttacgta

SEQ ID NO: 92541 - DNA, 36 bp, Artificial Sequence
  Synthetic oligonucleotide
aaacgccacgcatcaccgttcctctcgagcgcctta

SEQ ID NO: 92542 - DNA, 35 bp, Artificial Sequence
  Synthetic oligonucleotide
tccgtcacggcacttttcccgggccttcccgcaac

SEQ ID NO: 92543 - DNA, 35 bp, Artificial Sequence
  Synthetic oligonucleotide
ttaattgcagccctctgcgtccctgtaatatctac

SEQ ID NO: 92544 - DNA, 35 bp, Artificial Sequence
  Synthetic oligonucleotide
gcccactccccagtacttttgtcttacggatttac

SEQ ID NO: 92545 - DNA, 35 bp, Artificial Sequence
  Synthetic oligonucleotide
gctgctcaggaaaaaccccagcgtactcctttacc

SEQ ID NO: 92546 - DNA, 35 bp, Artificial Sequence
  Synthetic oligonucleotide
agctgtacgcatgactatagtgcccctgaacaccc

SEQ ID NO: 92547 - DNA, 35 bp, Artificial Sequence
  Synthetic oligonucleotide
tgagatgggacaatcgttgcgaactgacttccgcc

SEQ ID NO: 92548 - DNA, 35 bp, Artificial Sequence
  Synthetic oligonucleotide
atggtcaggattcaaggggggggttaggagatagc

SEQ ID NO: 92549 - DNA, 35 bp, Artificial Sequence
  Synthetic oligonucleotide
ttggagggatcgggtagggtcggatcggaacacgc

SEQ ID NO: 92550 - DNA, 35 bp, Artificial Sequence
  Synthetic oligonucleotide
ttcactttacgtacccatgcgaagaatctcctcgc

SEQ ID NO: 92551 - DNA, 35 bp, Artificial Sequence
  Synthetic oligonucleotide
tcaccatccatcggcgatcacaggtctttataggc

SEQ ID NO: 92552 - DNA, 35 bp, Artificial Sequence
  Synthetic oligonucleotide
gtgattgcccgatcgttttgcgtgccctgttctgc

SEQ ID NO: 92553 - DNA, 35 bp, Artificial Sequence
  Synthetic oligonucleotide
tcctgcgtgtttgccgtcactttacgtctttttgc

SEQ ID NO: 92554 - DNA, 35 bp, Artificial Sequence
  Synthetic oligonucleotide
acgagccacggtacctaggtgattgcggctccatc

SEQ ID NO: 92555 - DNA, 35 bp, Artificial Sequence
  Synthetic oligonucleotide
gtacgaccccgtcccagtcctaagttcctggcatc

SEQ ID NO: 92556 - DNA, 35 bp, Artificial Sequence
  Synthetic oligonucleotide
tcgagcacaccccggtaatatgccagtctcatctc

SEQ ID NO: 92557 - DNA, 35 bp, Artificial Sequence
  Synthetic oligonucleotide
ttgtgtaacagtctcatgagcgctagtggcctttc

SEQ ID NO: 92558 - DNA, 35 bp, Artificial Sequence
  Synthetic oligonucleotide
tcagtagagtcttcacaacggaaagaaaggggagg

SEQ ID NO: 92559 - DNA, 35 bp, Artificial Sequence
  Synthetic oligonucleotide
gatacacttccggagcgcatctctcaccatatagg

SEQ ID NO: 92560 - DNA, 35 bp, Artificial Sequence
  Synthetic oligonucleotide
tgaaggccggggggtggtggattgcgttactaggg

SEQ ID NO: 92561 - DNA, 35 bp, Artificial Sequence
  Synthetic oligonucleotide
aatcacggggaaggagcctgattatgagtgagggg

SEQ ID NO: 92562 - DNA, 35 bp, Artificial Sequence
  Synthetic oligonucleotide
gtacagtcagtgacaattaggggcgtttgtagggg

SEQ ID NO: 92563 - DNA, 35 bp, Artificial Sequence
  Synthetic oligonucleotide
gaaaaccgggacgttgttgtacaggtgttggggtg

SEQ ID NO: 92564 - DNA, 35 bp, Artificial Sequence
  Synthetic oligonucleotide
atctgctgcacagtctctggaaatccgtcacattg

SEQ ID NO: 92565 - DNA, 35 bp, Artificial Sequence
  Synthetic oligonucleotide
ttcgccaatgcgcctgacctgcaccgagtcacaat

SEQ ID NO: 92566 - DNA, 35 bp, Artificial Sequence
  Synthetic oligonucleotide
tcccccgtaactcctgtgctaggtctcaggttaat

SEQ ID NO: 92567 - DNA, 35 bp, Artificial Sequence
  Synthetic oligonucleotide
atccgcccagctctccaggtcacctctttagtcat

SEQ ID NO: 92568 - DNA, 35 bp, Artificial Sequence
  Synthetic oligonucleotide
tgcctccgctcgcctcccataaggacatcggtgat

SEQ ID NO: 92569 - DNA, 35 bp, Artificial Sequence
  Synthetic oligonucleotide
tcaaggcaaagtcacacgcgaccaaaacgccacct

SEQ ID NO: 92570 - DNA, 35 bp, Artificial Sequence
  Synthetic oligonucleotide
tgaagacgccttcatctagcttagtgtctcaccct

SEQ ID NO: 92571 - DNA, 35 bp, Artificial Sequence
  Synthetic oligonucleotide
gcctgactcgcttattgacctgtacttttggtgct

SEQ ID NO: 92572 - DNA, 35 bp, Artificial Sequence
  Synthetic oligonucleotide
gtgcggggggtatgtgtggcgggttaaggtcatct

SEQ ID NO: 92573 - DNA, 35 bp, Artificial Sequence
  Synthetic oligonucleotide
tgtagagccgtccaaatgtcccgcatcttacctgt

SEQ ID NO: 92574 - DNA, 35 bp, Artificial Sequence
  Synthetic oligonucleotide
aacaaggaagaggtcgtggtaatagcggaaattgt

SEQ ID NO: 92575 - DNA, 35 bp, Artificial Sequence
  Synthetic oligonucleotide
tttacgcgggatggagtagggtgtgcaatgtgatt

SEQ ID NO: 92576 - DNA, 35 bp, Artificial Sequence
  Synthetic oligonucleotide
gctggagtagaagaattaaggcagtagggtgggtt

SEQ ID NO: 92577 - DNA, 35 bp, Artificial Sequence
  Synthetic oligonucleotide
atgcaacccacctgtatttggccgtccaatttgtt

SEQ ID NO: 92578 - DNA, 35 bp, Artificial Sequence
  Synthetic oligonucleotide
tgttgaccctcggtagctataatcccctgcccttt

SEQ ID NO: 92579 - DNA, 35 bp, Artificial Sequence
  Synthetic oligonucleotide
gagcaacccctcagatttgcctctcggtccggttt

SEQ ID NO: 92580 - DNA, 35 bp, Artificial Sequence
  Synthetic oligonucleotide
atgccgatgcgttgtggttgcgctcattactgttt

SEQ ID NO: 92581 - DNA, 36 bp, Artificial Sequence
  Synthetic oligonucleotide
accacaaatacacgtgtgttattcgcccctgccaaa

SEQ ID NO: 92582 - DNA, 36 bp, Artificial Sequence
  Synthetic oligonucleotide
tactgatgtggcggtagtacccctcgtgattccaaa

SEQ ID NO: 92583 - DNA, 36 bp, Artificial Sequence
  Synthetic oligonucleotide
tcgtagggggcaaggggaaggtgataatgcctgaaa

SEQ ID NO: 92584 - DNA, 35 bp, Artificial Sequence
  Synthetic oligonucleotide
gacctgtgaggcgcaaagtagactgcagtgacgaa

SEQ ID NO: 92585 - DNA, 36 bp, Artificial Sequence
  Synthetic oligonucleotide
atgcaccaacgcctccgcttcctgtacgacaaggaa

SEQ ID NO: 92586 - DNA, 36 bp, Artificial Sequence
  Synthetic oligonucleotide
actcccccgctgttcacccaagtagttctcgaggaa

SEQ ID NO: 92587 - DNA, 35 bp, Artificial Sequence
  Synthetic oligonucleotide
ttgagccgccctgtggtatccacatcccactgtaa

SEQ ID NO: 92588 - DNA, 36 bp, Artificial Sequence
  Synthetic oligonucleotide
gaaggagcaagtcgtggaaaacgatcttgggtaaca

SEQ ID NO: 92589 - DNA, 37 bp, Artificial Sequence
  Synthetic oligonucleotide
gtagggggaggtaggtggagggaggggacaacagaca

SEQ ID NO: 92590 - DNA, 36 bp, Artificial Sequence
  Synthetic oligonucleotide
gccaccaacgcccacgagtcctgcttatgccagaca

SEQ ID NO: 92591 - DNA, 36 bp, Artificial Sequence
  Synthetic oligonucleotide
tagacaggggagtggaacggattggtgataggtaca

SEQ ID NO: 92592 - DNA, 36 bp, Artificial Sequence
  Synthetic oligonucleotide
gactagccaaagtatgacacggcagtgaaggttaca

SEQ ID NO: 92593 - DNA, 36 bp, Artificial Sequence
  Synthetic oligonucleotide
gatcgcacggcgttctctattctggtccagggccca

SEQ ID NO: 92594 - DNA, 36 bp, Artificial Sequence
  Synthetic oligonucleotide
tcacggtccatgataacgcccccttactcaacgcca

SEQ ID NO: 92595 - DNA, 36 bp, Artificial Sequence
  Synthetic oligonucleotide
acaagccgtttcgctgcacgcattagtcctggtcca

SEQ ID NO: 92596 - DNA, 35 bp, Artificial Sequence
  Synthetic oligonucleotide
tcatgcaagcgagccaaggcctcagacccccagca

SEQ ID NO: 92597 - DNA, 36 bp, Artificial Sequence
  Synthetic oligonucleotide
tacacccgcaattggatgagtgttatacattcagca

SEQ ID NO: 92598 - DNA, 35 bp, Artificial Sequence
  Synthetic oligonucleotide
tacgaagccaccgtatgatggatctgccccacgca

SEQ ID NO: 92599 - DNA, 36 bp, Artificial Sequence
  Synthetic oligonucleotide
tacgcatgcaagtggggtacggagtgtgtttcggca

SEQ ID NO: 92600 - DNA, 36 bp, Artificial Sequence
  Synthetic oligonucleotide
taggcccggctggttatgctcttcgcacctctatca

SEQ ID NO: 92601 - DNA, 37 bp, Artificial Sequence
  Synthetic oligonucleotide
gaggggccggagagaaacttagctactgactgtaaga

SEQ ID NO: 92602 - DNA, 37 bp, Artificial Sequence
  Synthetic oligonucleotide
tcacccaccctgctgatgcgttcgtcgatttagacga

SEQ ID NO: 92603 - DNA, 37 bp, Artificial Sequence
  Synthetic oligonucleotide
tccatcttacaccatcgttttcagttcatcgttacga

SEQ ID NO: 92604 - DNA, 37 bp, Artificial Sequence
  Synthetic oligonucleotide
gaccgtcatggtcaagttctgccgcatccctgcccga

SEQ ID NO: 92605 - DNA, 37 bp, Artificial Sequence
  Synthetic oligonucleotide
ttgtaatgcctctgcggctggttcgccactctcccga

SEQ ID NO: 92606 - DNA, 37 bp, Artificial Sequence
  Synthetic oligonucleotide
acagaaagggaggatagcgcggggccagtgagggcga

SEQ ID NO: 92607 - DNA, 37 bp, Artificial Sequence
  Synthetic oligonucleotide
atgcatccgctcaacctccaatgactgtagcatgcga

SEQ ID NO: 92608 - DNA, 37 bp, Artificial Sequence
  Synthetic oligonucleotide
ttgtcccatcctgcatttgttatttgaacgcggtcga

SEQ ID NO: 92609 - DNA, 37 bp, Artificial Sequence
  Synthetic oligonucleotide
gaggacgttaggctaaggcaaggagtggaaggcagga

SEQ ID NO: 92610 - DNA, 37 bp, Artificial Sequence
  Synthetic oligonucleotide
gtgaagcaacacgggacagggaaagccataaggagga

SEQ ID NO: 92611 - DNA, 37 bp, Artificial Sequence
  Synthetic oligonucleotide
tgtttgcggtcggtgagcgcttatagcaagcatggga

SEQ ID NO: 92612 - DNA, 36 bp, Artificial Sequence
  Synthetic oligonucleotide
acacgcctcccagtccgaaaggtgtcttgtaatgga

SEQ ID NO: 92613 - DNA, 35 bp, Artificial Sequence
  Synthetic oligonucleotide
gtcactcacttgagttgcttattgccttcactgga

SEQ ID NO: 92614 - DNA, 37 bp, Artificial Sequence
  Synthetic oligonucleotide
gtccacacacagtactaggcaagatgagccgtttgga

SEQ ID NO: 92615 - DNA, 38 bp, Artificial Sequence
  Synthetic oligonucleotide
gaagccaaagacgaggggaggagggtactagttaatga

SEQ ID NO: 92616 - DNA, 38 bp, Artificial Sequence
  Synthetic oligonucleotide
tagcacggttctatcgtcattgcccagttcacgcatga

SEQ ID NO: 92617 - DNA, 37 bp, Artificial Sequence
  Synthetic oligonucleotide
aaatcgcacgcccttacctgtgttattatctgcatga

SEQ ID NO: 92618 - DNA, 36 bp, Artificial Sequence
  Synthetic oligonucleotide
tcgctggggagcctatgcggttttcactacacctga

SEQ ID NO: 92619 - DNA, 38 bp, Artificial Sequence
  Synthetic oligonucleotide
gtagcccggtgacgcgcactgaccttgttattccctga

SEQ ID NO: 92620 - DNA, 35 bp, Artificial Sequence
  Synthetic oligonucleotide
gtcgatcataaacctgtactttagtgtcctcctga

SEQ ID NO: 92621 - DNA, 38 bp, Artificial Sequence
  Synthetic oligonucleotide
gactgcactatgcagggtacagccgcccaccccgctga

SEQ ID NO: 92622 - DNA, 38 bp, Artificial Sequence
  Synthetic oligonucleotide
ggtcaggaccaccggtttatgccacttgaactatctga

SEQ ID NO: 92623 - DNA, 37 bp, Artificial Sequence
  Synthetic oligonucleotide
gccctggcagaagctcgtcaccgcccccactccgtga

SEQ ID NO: 92624 - DNA, 38 bp, Artificial Sequence
  Synthetic oligonucleotide
gatgcagtacagaaactgtgattcgattgtgtgcgtga

SEQ ID NO: 92625 - DNA, 37 bp, Artificial Sequence
  Synthetic oligonucleotide
ttggtccacctcacttgtcaggtttcccttttcgtga

SEQ ID NO: 92626 - DNA, 38 bp, Artificial Sequence
  Synthetic oligonucleotide
accaggactgacggccctacccaccttacacgcggtga

SEQ ID NO: 92627 - DNA, 38 bp, Artificial Sequence
  Synthetic oligonucleotide
gtagcagtacggcaagtgggggatttgatcaggggtga

SEQ ID NO: 92628 - DNA, 38 bp, Artificial Sequence
  Synthetic oligonucleotide
gacgctcgccaatgtccactcctcgtaatgccatgtga

SEQ ID NO: 92629 - DNA, 37 bp, Artificial Sequence
  Synthetic oligonucleotide
acagccccacctcacacagatttcgaccccgccttga

SEQ ID NO: 92630 - DNA, 38 bp, Artificial Sequence
  Synthetic oligonucleotide
aagtgcgcgcgtagtaagccctttatacccatccttga

SEQ ID NO: 92631 - DNA, 38 bp, Artificial Sequence
  Synthetic oligonucleotide
ttacagtcataaggagggacgagctggaagggagttga

SEQ ID NO: 92632 - DNA, 36 bp, Artificial Sequence
  Synthetic oligonucleotide
tacccaccgcttgctatttgctctttggaaaacata

SEQ ID NO: 92633 - DNA, 36 bp, Artificial Sequence
  Synthetic oligonucleotide
gctgaaacggcggggaaacgagggggcacattcata

SEQ ID NO: 92634 - DNA, 36 bp, Artificial Sequence
  Synthetic oligonucleotide
tagccggtccctcgataaatggcatttgctacgata

SEQ ID NO: 92635 - DNA, 36 bp, Artificial Sequence
  Synthetic oligonucleotide
acgtggccgccttatgtttctggccattgttaccta

SEQ ID NO: 92636 - DNA, 36 bp, Artificial Sequence
  Synthetic oligonucleotide
tacctgcctggtgccttgtattcggccacaacgcta

SEQ ID NO: 92637 - DNA, 35 bp, Artificial Sequence
  Synthetic oligonucleotide
gctgcgacggtcaaaggcacctcttcgtttcgcta

SEQ ID NO: 92638 - DNA, 36 bp, Artificial Sequence
  Synthetic oligonucleotide
tactgctcgttacgcagtccaacgaccacacctcta

SEQ ID NO: 92639 - DNA, 36 bp, Artificial Sequence
  Synthetic oligonucleotide
gaccctgtgcccttcagcatttatatatgcccagta

SEQ ID NO: 92640 - DNA, 36 bp, Artificial Sequence
  Synthetic oligonucleotide
tcgaggggggtgggaagggtggaaacgatacgggta

SEQ ID NO: 92641 - DNA, 36 bp, Artificial Sequence
  Synthetic oligonucleotide
tcaagagggataatcgatggggggagaggccatgta

SEQ ID NO: 92642 - DNA, 36 bp, Artificial Sequence
  Synthetic oligonucleotide
gactcctgtctctggtttttggatactctgcctgta

SEQ ID NO: 92643 - DNA, 36 bp, Artificial Sequence
  Synthetic oligonucleotide
ttagcccatgcttactcctgattatctgatgcctta

SEQ ID NO: 92644 - DNA, 35 bp, Artificial Sequence
  Synthetic oligonucleotide
atcgcacgagcctccaaaccacctgcattagatac

SEQ ID NO: 92645 - DNA, 35 bp, Artificial Sequence
  Synthetic oligonucleotide
tacgcgtgccctttattcgtctagccttcgactac

SEQ ID NO: 92646 - DNA, 35 bp, Artificial Sequence
  Synthetic oligonucleotide
gtccttgccacgattatactactgaagccttttac

SEQ ID NO: 92647 - DNA, 35 bp, Artificial Sequence
  Synthetic oligonucleotide
gtgaacccggtacgcttcttggtcgacattttacc

SEQ ID NO: 92648 - DNA, 36 bp, Artificial Sequence
  Synthetic oligonucleotide
ttgtcatctgccgtcctttttgattcgccacgaccc

SEQ ID NO: 92649 - DNA, 35 bp, Artificial Sequence
  Synthetic oligonucleotide
tgctgccaggcattaccagtcccgtacccgtgtcc

SEQ ID NO: 92650 - DNA, 35 bp, Artificial Sequence
  Synthetic oligonucleotide
gacccctaaccacgtgtttttcctccacggcccgc

SEQ ID NO: 92651 - DNA, 35 bp, Artificial Sequence
  Synthetic oligonucleotide
taacagccgcatgctgattaacacgtgatccgcgc

SEQ ID NO: 92652 - DNA, 35 bp, Artificial Sequence
  Synthetic oligonucleotide
tgcaacgaaatggaggaagctggtaagcatagggc

SEQ ID NO: 92653 - DNA, 35 bp, Artificial Sequence
  Synthetic oligonucleotide
aaactccgcccaattcgcgcattagggtgccatgc

SEQ ID NO: 92654 - DNA, 35 bp, Artificial Sequence
  Synthetic oligonucleotide
gtgcgatccacaaggttagccgttactattaaatc

SEQ ID NO: 92655 - DNA, 35 bp, Artificial Sequence
  Synthetic oligonucleotide
gttcacgatacctgttttccggtcaagattcactc

SEQ ID NO: 92656 - DNA, 36 bp, Artificial Sequence
  Synthetic oligonucleotide
gccgcacgtctaggtcggcaccaactttctacagtc

SEQ ID NO: 92657 - DNA, 35 bp, Artificial Sequence
  Synthetic oligonucleotide
ttcacaaccgttgccgggcagggctccctgagttc

SEQ ID NO: 92658 - DNA, 35 bp, Artificial Sequence
  Synthetic oligonucleotide
gactacacgtctgttcacgacatgttgttctgttc

SEQ ID NO: 92659 - DNA, 35 bp, Artificial Sequence
  Synthetic oligonucleotide
gacgacggacgaagtgaagaatgggaggggcaaag

SEQ ID NO: 92660 - DNA, 35 bp, Artificial Sequence
  Synthetic oligonucleotide
aaacaggcgctgatccggtactttttttcaggaag

SEQ ID NO: 92661 - DNA, 35 bp, Artificial Sequence
  Synthetic oligonucleotide
tgacgatcaagtgctgaagtttaaggggtgggaag

SEQ ID NO: 92662 - DNA, 36 bp, Artificial Sequence
  Synthetic oligonucleotide
gcactgccgcgcatagtgcttagggtgataacacag

SEQ ID NO: 92663 - DNA, 35 bp, Artificial Sequence
  Synthetic oligonucleotide
gtgcccgccccgccgtacatgtaggttgtttccag

SEQ ID NO: 92664 - DNA, 35 bp, Artificial Sequence
  Synthetic oligonucleotide
ttgaaccccgatcacgtctaaaggaatcacccgag

SEQ ID NO: 92665 - DNA, 35 bp, Artificial Sequence
  Synthetic oligonucleotide
gtagggcccacagctaccttttgcatttgcttacg

SEQ ID NO: 92666 - DNA, 35 bp, Artificial Sequence
  Synthetic oligonucleotide
tgaatccgctccaagtgcttcaaccttctgacccg

SEQ ID NO: 92667 - DNA, 35 bp, Artificial Sequence
  Synthetic oligonucleotide
tatgcccgggtcaagttgcttccgtagcctgatcg

SEQ ID NO: 92668 - DNA, 35 bp, Artificial Sequence
  Synthetic oligonucleotide
gaacagccgggaggtatgggaatttgggggccagg

SEQ ID NO: 92669 - DNA, 35 bp, Artificial Sequence
  Synthetic oligonucleotide
tttgatcccaccgcttttacccagcgtggtaaaat

SEQ ID NO: 92670 - DNA, 35 bp, Artificial Sequence
  Synthetic oligonucleotide
tgtgcccgaaggtgcggagcccacgaacgtcgaat

SEQ ID NO: 92671 - DNA, 35 bp, Artificial Sequence
  Synthetic oligonucleotide
gtggcctgcaggaagataacacttcaccttcccat

SEQ ID NO: 92672 - DNA, 35 bp, Artificial Sequence
  Synthetic oligonucleotide
ttgatcgcagtgtgacctcccgtttcctcccgtat

SEQ ID NO: 92673 - DNA, 35 bp, Artificial Sequence
  Synthetic oligonucleotide
tacgaccacgaatctcgcttgtggcttaatccact

SEQ ID NO: 92674 - DNA, 35 bp, Artificial Sequence
  Synthetic oligonucleotide
ttcgcgcaccacccccattggctctaatactacct

SEQ ID NO: 92675 - DNA, 35 bp, Artificial Sequence
  Synthetic oligonucleotide
atcgacgctggtctttcttccgatttctggggcct

SEQ ID NO: 92676 - DNA, 35 bp, Artificial Sequence
  Synthetic oligonucleotide
agcactgtaggtggagggggtggactaacagcgct

SEQ ID NO: 92677 - DNA, 35 bp, Artificial Sequence
  Synthetic oligonucleotide
agcaacatggaaggggaggcttgcgaccgatctct

SEQ ID NO: 92678 - DNA, 35 bp, Artificial Sequence
  Synthetic oligonucleotide
tctcgacccagataggacacttgttctattcttct

SEQ ID NO: 92679 - DNA, 35 bp, Artificial Sequence
  Synthetic oligonucleotide
gggacggggggagcggattgagcattacttgaggt

SEQ ID NO: 92680 - DNA, 35 bp, Artificial Sequence
  Synthetic oligonucleotide
tcacgcggacagcatcccgcccgagcctcttaggt

SEQ ID NO: 92681 - DNA, 35 bp, Artificial Sequence
  Synthetic oligonucleotide
tgttcaccttgatagctctaagcggttctctctgt

SEQ ID NO: 92682 - DNA, 35 bp, Artificial Sequence
  Synthetic oligonucleotide
gtcgcaacgctgcaaaaagcctagcaaggggaaaa

SEQ ID NO: 92683 - DNA, 36 bp, Artificial Sequence
  Synthetic oligonucleotide
gcactcgcaggggtaggcgaatgcggtgataggaaa

SEQ ID NO: 92684 - DNA, 36 bp, Artificial Sequence
  Synthetic oligonucleotide
tacgttgccccctttagtatttgtctgccacaccaa

SEQ ID NO: 92685 - DNA, 36 bp, Artificial Sequence
  Synthetic oligonucleotide
gagcgtacgcgtgggattacgtggccctccctccaa

SEQ ID NO: 92686 - DNA, 36 bp, Artificial Sequence
  Synthetic oligonucleotide
gcacacccgtcagaaaatcagcccattatttactaa

SEQ ID NO: 92687 - DNA, 36 bp, Artificial Sequence
  Synthetic oligonucleotide
gcacgttggttgttaattttgtgtccgctgccttaa

SEQ ID NO: 92688 - DNA, 36 bp, Artificial Sequence
  Synthetic oligonucleotide
tccacagcaccacacgcccgcctcgaccattgttaa

SEQ ID NO: 92689 - DNA, 35 bp, Artificial Sequence
  Synthetic oligonucleotide
tatgcgctctcaccgaaagttaggcctacgaaaca

SEQ ID NO: 92690 - DNA, 35 bp, Artificial Sequence
  Synthetic oligonucleotide
tcctcaacagagtgcactcaactgacaccgcaaca

SEQ ID NO: 92691 - DNA, 35 bp, Artificial Sequence
  Synthetic oligonucleotide
taccacaatccgatggcgtttctcggttgctaaca

SEQ ID NO: 92692 - DNA, 36 bp, Artificial Sequence
  Synthetic oligonucleotide
gcgtcaagcgcctctgtccctatcgctcgtctccca

SEQ ID NO: 92693 - DNA, 36 bp, Artificial Sequence
  Synthetic oligonucleotide
acatagcctgcaaactactgaccaggttctcctcca

SEQ ID NO: 92694 - DNA, 36 bp, Artificial Sequence
  Synthetic oligonucleotide
acctcccgagttagtctatccacacgtacatgttca

SEQ ID NO: 92695 - DNA, 37 bp, Artificial Sequence
  Synthetic oligonucleotide
gttacttgcccaaactactacagacggtcttgaaaga

SEQ ID NO: 92696 - DNA, 35 bp, Artificial Sequence
  Synthetic oligonucleotide
gtgacaccgcctctctccattgcatcaggtaaaga

SEQ ID NO: 92697 - DNA, 37 bp, Artificial Sequence
  Synthetic oligonucleotide
gatgtgggccgagactgtcaaagtaggctggtcaaga

SEQ ID NO: 92698 - DNA, 37 bp, Artificial Sequence
  Synthetic oligonucleotide
tgatcacgcgacgaaaaagggctgattagagggaaga

SEQ ID NO: 92699 - DNA, 37 bp, Artificial Sequence
  Synthetic oligonucleotide
atggccgacattgcagcatttacaagcctcttacaga

SEQ ID NO: 92700 - DNA, 37 bp, Artificial Sequence
  Synthetic oligonucleotide
agatgccagcgcagcaacggggaaggtcacaagcaga

SEQ ID NO: 92701 - DNA, 37 bp, Artificial Sequence
  Synthetic oligonucleotide
taacgtggaagatatgggtgttgggtgggtgaagaga

SEQ ID NO: 92702 - DNA, 36 bp, Artificial Sequence
  Synthetic oligonucleotide
tgtacctgaccaacacttagtagaccctcattgaga

SEQ ID NO: 92703 - DNA, 37 bp, Artificial Sequence
  Synthetic oligonucleotide
tgtaccaccacgtatttctctggctatgggacctaga

SEQ ID NO: 92704 - DNA, 37 bp, Artificial Sequence
  Synthetic oligonucleotide
agtatgtgtgggtggaagctaataggaagggcaacga

SEQ ID NO: 92705 - DNA, 37 bp, Artificial Sequence
  Synthetic oligonucleotide
gtaacggtgcagttgaatcgaatcgtcctacccccga

SEQ ID NO: 92706 - DNA, 37 bp, Artificial Sequence
  Synthetic oligonucleotide
agttccagcacaccgagatctaatccaccctgcccga

SEQ ID NO: 92707 - DNA, 37 bp, Artificial Sequence
  Synthetic oligonucleotide
ttccgccctccagctcctgaattgttcataactgcga

SEQ ID NO: 92708 - DNA, 37 bp, Artificial Sequence
  Synthetic oligonucleotide
gaccccgccagttttcccatgtaagtcagactctcga

SEQ ID NO: 92709 - DNA, 37 bp, Artificial Sequence
  Synthetic oligonucleotide
gaagcgcctcctccggtccactggccagacttttcga

SEQ ID NO: 92710 - DNA, 36 bp, Artificial Sequence
  Synthetic oligonucleotide
ggaaacaggtagctaccagcatggggggactccgga

SEQ ID NO: 92711 - DNA, 37 bp, Artificial Sequence
  Synthetic oligonucleotide
gtcacccctatcggttaggtttacttccctgcctgga

SEQ ID NO: 92712 - DNA, 37 bp, Artificial Sequence
  Synthetic oligonucleotide
gccaccggatttatactgcacctcttccatctgtgga

SEQ ID NO: 92713 - DNA, 35 bp, Artificial Sequence
  Synthetic oligonucleotide
ggggggagggtaaggccgcggaaggggggattgga

SEQ ID NO: 92714 - DNA, 38 bp, Artificial Sequence
  Synthetic oligonucleotide
ttgccggtgccagcttatgacctcgttcccatacatga

SEQ ID NO: 92715 - DNA, 38 bp, Artificial Sequence
  Synthetic oligonucleotide
tcacaactatcacgatgtcgccttttcactcctcatga

SEQ ID NO: 92716 - DNA, 38 bp, Artificial Sequence
  Synthetic oligonucleotide
gcgacacgcctcggctctgctccctaaccctctcatga

SEQ ID NO: 92717 - DNA, 38 bp, Artificial Sequence
  Synthetic oligonucleotide
tacaggcgagagaggcgaggcgcgggctggaaagatga

SEQ ID NO: 92718 - DNA, 38 bp, Artificial Sequence
  Synthetic oligonucleotide
aatcaagccgggaggcgggctaaggccatgggggatga

SEQ ID NO: 92719 - DNA, 38 bp, Artificial Sequence
  Synthetic oligonucleotide
gtgacaagtgacgtgaaggagtgggaaggtgagtatga

SEQ ID NO: 92720 - DNA, 38 bp, Artificial Sequence
  Synthetic oligonucleotide
gcgtgcccacattctggtgatacgtgctgcccttatga

SEQ ID NO: 92721 - DNA, 38 bp, Artificial Sequence
  Synthetic oligonucleotide
ttggatcaggggaagggtggtgtcggcgtaggttatga

SEQ ID NO: 92722 - DNA, 37 bp, Artificial Sequence
  Synthetic oligonucleotide
tgccatcagcacaagttttttcgaaacaccatactga

SEQ ID NO: 92723 - DNA, 38 bp, Artificial Sequence
  Synthetic oligonucleotide
gatgcctcgtcatacctctgcatccttggcatacctga

SEQ ID NO: 92724 - DNA, 38 bp, Artificial Sequence
  Synthetic oligonucleotide
ttggctcgctaattgcaccatatgatctttcgccctga

SEQ ID NO: 92725 - DNA, 38 bp, Artificial Sequence
  Synthetic oligonucleotide
ttaagccatgctcccacctgattaggcgctaggcctga

SEQ ID NO: 92726 - DNA, 38 bp, Artificial Sequence
  Synthetic oligonucleotide
tctgtcgccaggttatgcattatcgaaatccttcctga

SEQ ID NO: 92727 - DNA, 38 bp, Artificial Sequence
  Synthetic oligonucleotide
tgcctccctcaagtacgctaacgtgtcaacgatgctga

SEQ ID NO: 92728 - DNA, 38 bp, Artificial Sequence
  Synthetic oligonucleotide
tagagcaccgcatgttggtccggtccctccattgctga

SEQ ID NO: 92729 - DNA, 38 bp, Artificial Sequence
  Synthetic oligonucleotide
tagtgaatgggggcaggtgcgcaaagggggttccgtga

SEQ ID NO: 92730 - DNA, 36 bp, Artificial Sequence
  Synthetic oligonucleotide
aatgtggagggtgcagctagggtgagctgggcgtga

SEQ ID NO: 92731 - DNA, 38 bp, Artificial Sequence
  Synthetic oligonucleotide
gaccctcagccggccacaaagcgttgaagtctgcgtga

SEQ ID NO: 92732 - DNA, 38 bp, Artificial Sequence
  Synthetic oligonucleotide
gttgagaggaaaacggttagggaggagtccgcaggtga

SEQ ID NO: 92733 - DNA, 38 bp, Artificial Sequence
  Synthetic oligonucleotide
gagggagaggggcgagcgtcggcgaaggagcatggtga

SEQ ID NO: 92734 - DNA, 37 bp, Artificial Sequence
  Synthetic oligonucleotide
gtgtagtcctttcagcgggctccatccaatcatgtga

SEQ ID NO: 92735 - DNA, 38 bp, Artificial Sequence
  Synthetic oligonucleotide
gcgaacgtactgtggaggcttatgaacatttgatgtga

SEQ ID NO: 92736 - DNA, 38 bp, Artificial Sequence
  Synthetic oligonucleotide
gacgtagagcggaaagaaatgtccaggtggacgtgtga

SEQ ID NO: 92737 - DNA, 38 bp, Artificial Sequence
  Synthetic oligonucleotide
ggggtgggccgggtgttgtacgggcggatccgaattga

SEQ ID NO: 92738 - DNA, 38 bp, Artificial Sequence
  Synthetic oligonucleotide
ggtggcccaggagagaggcgaaataggcggaaagttga

SEQ ID NO: 92739 - DNA, 38 bp, Artificial Sequence
  Synthetic oligonucleotide
gtgacacgccatccctctacactagcctgaatagttga

SEQ ID NO: 92740 - DNA, 37 bp, Artificial Sequence
  Synthetic oligonucleotide
gatgccggcgaatcaagataaggaacggagtggttga

SEQ ID NO: 92741 - DNA, 35 bp, Artificial Sequence
  Synthetic oligonucleotide
gtggacaggtacaaggagaaacggtggtacgacta

SEQ ID NO: 92742 - DNA, 36 bp, Artificial Sequence
  Synthetic oligonucleotide
gttgccccgccaatgttgaaatctatgaatcatcta

SEQ ID NO: 92743 - DNA, 35 bp, Artificial Sequence
  Synthetic oligonucleotide
gacgtggcatcggcagtagctcattcgcctctcta

SEQ ID NO: 92744 - DNA, 36 bp, Artificial Sequence
  Synthetic oligonucleotide
tgccaatacgctgtgatacccctgcgcccctgtcta

SEQ ID NO: 92745 - DNA, 36 bp, Artificial Sequence
  Synthetic oligonucleotide
ggtcgcgatacgaagattggaggggggagttaagta

SEQ ID NO: 92746 - DNA, 36 bp, Artificial Sequence
  Synthetic oligonucleotide
acatgcaagactggtccgagggaggtgggaacggta

SEQ ID NO: 92747 - DNA, 35 bp, Artificial Sequence
  Synthetic oligonucleotide
gttggggtagtgagaggttaggattgaactgtgta

SEQ ID NO: 92748 - DNA, 36 bp, Artificial Sequence
  Synthetic oligonucleotide
ttcggaacgtctaaaggggggagtagttgatttgta

SEQ ID NO: 92749 - DNA, 35 bp, Artificial Sequence
  Synthetic oligonucleotide
gcacatcgaggcttggttcttaggatggttggtta

SEQ ID NO: 92750 - DNA, 36 bp, Artificial Sequence
  Synthetic oligonucleotide
tcgcaccaccgtggagcgccgatttttcacacttta

SEQ ID NO: 92751 - DNA, 35 bp, Artificial Sequence
  Synthetic oligonucleotide
agagccccgcgttccgcaaccatcgcacagccaac

SEQ ID NO: 92752 - DNA, 35 bp, Artificial Sequence
  Synthetic oligonucleotide
tagtggccccacacacctttatacccgtcgagtac

SEQ ID NO: 92753 - DNA, 35 bp, Artificial Sequence
  Synthetic oligonucleotide
gtactgcgagggaaaaaagtcagggctgggcttac

SEQ ID NO: 92754 - DNA, 35 bp, Artificial Sequence
  Synthetic oligonucleotide
acgtccagccgcctcgtttcgcttgcttctacccc

SEQ ID NO: 92755 - DNA, 35 bp, Artificial Sequence
  Synthetic oligonucleotide
gagaccatcacaatatggttttcgtctacatagcc

SEQ ID NO: 92756 - DNA, 35 bp, Artificial Sequence
  Synthetic oligonucleotide
taacccaacacctgtatgtcatgtcccgccttagc

SEQ ID NO: 92757 - DNA, 35 bp, Artificial Sequence
  Synthetic oligonucleotide
actgggccgcccgccccactcttgagagcacacgc

SEQ ID NO: 92758 - DNA, 35 bp, Artificial Sequence
  Synthetic oligonucleotide
tgtgcccgcctactccactcagtcaaagcctcggc

SEQ ID NO: 92759 - DNA, 35 bp, Artificial Sequence
  Synthetic oligonucleotide
atcaccgtggacgccattgatttaccggtttctgc

SEQ ID NO: 92760 - DNA, 35 bp, Artificial Sequence
  Synthetic oligonucleotide
gacaccctgaggatttgttctacgtgttctgcttc

SEQ ID NO: 92761 - DNA, 35 bp, Artificial Sequence
  Synthetic oligonucleotide
gtagcctgtccgcttattgaagctgtccacatttc

SEQ ID NO: 92762 - DNA, 35 bp, Artificial Sequence
  Synthetic oligonucleotide
acgtgggaggaaggggtaaactgggcaggtaatag

SEQ ID NO: 92763 - DNA, 35 bp, Artificial Sequence
  Synthetic oligonucleotide
gaactaaagaatcagaaaggggaaaaggggcttag

SEQ ID NO: 92764 - DNA, 35 bp, Artificial Sequence
  Synthetic oligonucleotide
accaagtgggtggggggggaagggtagtagatacg

SEQ ID NO: 92765 - DNA, 35 bp, Artificial Sequence
  Synthetic oligonucleotide
gacgcacatcttgtgttcggcgtttttgctgcccg

SEQ ID NO: 92766 - DNA, 35 bp, Artificial Sequence
  Synthetic oligonucleotide
tcacactgcaccaatccgttcactacaccagctcg

SEQ ID NO: 92767 - DNA, 35 bp, Artificial Sequence
  Synthetic oligonucleotide
aaccaccgcgctccacgtcttctaactcccagatg

SEQ ID NO: 92768 - DNA, 35 bp, Artificial Sequence
  Synthetic oligonucleotide
tagtaccggagtaatgaaagggtgagctaagagtg

SEQ ID NO: 92769 - DNA, 35 bp, Artificial Sequence
  Synthetic oligonucleotide
tcacgtcactggtcccatactttatttggtattat

SEQ ID NO: 92770 - DNA, 35 bp, Artificial Sequence
  Synthetic oligonucleotide
aacagtacgcccgttaagtttggccatgttacgct

SEQ ID NO: 92771 - DNA, 35 bp, Artificial Sequence
  Synthetic oligonucleotide
gaaccgccgccctcttaggcaatgatccgctttct

SEQ ID NO: 92772 - DNA, 35 bp, Artificial Sequence
  Synthetic oligonucleotide
tgacaaagacacatagcgcacttaacgcgtgaagt

SEQ ID NO: 92773 - DNA, 35 bp, Artificial Sequence
  Synthetic oligonucleotide
ggatccatcgtatgtcttcactggaccacacattt

SEQ ID NO: 92774 - DNA, 36 bp, Artificial Sequence
  Synthetic oligonucleotide
tgaacactggtcgcatgacccataaataccgggaaa

SEQ ID NO: 92775 - DNA, 36 bp, Artificial Sequence
  Synthetic oligonucleotide
tcccacaaataacgttccaagacctgacatttgaaa

SEQ ID NO: 92776 - DNA, 36 bp, Artificial Sequence
  Synthetic oligonucleotide
actccgcccatccgcgtcagtttccgcctgagtgaa

SEQ ID NO: 92777 - DNA, 35 bp, Artificial Sequence
  Synthetic oligonucleotide
agggaacagcaagagggcgataatgaaggcggaca

SEQ ID NO: 92778 - DNA, 35 bp, Artificial Sequence
  Synthetic oligonucleotide
gccggctcctttgatcttgtcattacgtactgcca

SEQ ID NO: 92779 - DNA, 36 bp, Artificial Sequence
  Synthetic oligonucleotide
gccacgtggagaggtatcatggggaagggacaagca

SEQ ID NO: 92780 - DNA, 36 bp, Artificial Sequence
  Synthetic oligonucleotide
tccacctcagccgcttcagggggcacgctccacgca

SEQ ID NO: 92781 - DNA, 36 bp, Artificial Sequence
  Synthetic oligonucleotide
acgacgcatcctaggggccctttcggacgttatgca

SEQ ID NO: 92782 - DNA, 36 bp, Artificial Sequence
  Synthetic oligonucleotide
tgcaaggcaagagggctgggaagccgggtgggtgca

SEQ ID NO: 92783 - DNA, 34 bp, Artificial Sequence
  Synthetic oligonucleotide
aatggagggaggcggtggagtttgagccgattca

SEQ ID NO: 92784 - DNA, 36 bp, Artificial Sequence
  Synthetic oligonucleotide
ttgagtcgcccgccatgcaagtttaaccgttcttca

SEQ ID NO: 92785 - DNA, 35 bp, Artificial Sequence
  Synthetic oligonucleotide
tgcaccttggatgccataacaccctatcacgttca

SEQ ID NO: 92786 - DNA, 35 bp, Artificial Sequence
  Synthetic oligonucleotide
acgattgcactgtatccatggcctgatctttttca

SEQ ID NO: 92787 - DNA, 37 bp, Artificial Sequence
  Synthetic oligonucleotide
gaggatggtgtgcgagggtatgatcagatgtgtaaga

SEQ ID NO: 92788 - DNA, 36 bp, Artificial Sequence
  Synthetic oligonucleotide
acctgcccccctgtgccctcgctgtcagctttaaga

SEQ ID NO: 92789 - DNA, 37 bp, Artificial Sequence
  Synthetic oligonucleotide
gtgtgcagagcatagagagatgggagggtgagtcaga

SEQ ID NO: 92790 - DNA, 37 bp, Artificial Sequence
  Synthetic oligonucleotide
acgctctgcagagcgacgaacttgccccctttgacga

SEQ ID NO: 92791 - DNA, 36 bp, Artificial Sequence
  Synthetic oligonucleotide
tgcctcacctcggtatgttgggagcataccgcccga

SEQ ID NO: 92792 - DNA, 36 bp, Artificial Sequence
  Synthetic oligonucleotide
gtgacatcctcggctactagaatcgggagttcccga

SEQ ID NO: 92793 - DNA, 37 bp, Artificial Sequence
  Synthetic oligonucleotide
gcccgtgagcacgtacgtatacgaataaaccctccga

SEQ ID NO: 92794 - DNA, 35 bp, Artificial Sequence
  Synthetic oligonucleotide
atggatgagccggaacaaatacagcacgaaggcga

SEQ ID NO: 92795 - DNA, 36 bp, Artificial Sequence
  Synthetic oligonucleotide
gttgccctggacctggataaataatcccatgatcga

SEQ ID NO: 92796 - DNA, 36 bp, Artificial Sequence
  Synthetic oligonucleotide
gtgaggtgcagaaacataattggatcaaggtaggga

SEQ ID NO: 92797 - DNA, 35 bp, Artificial Sequence
  Synthetic oligonucleotide
tagcaacaggagtatgggagttcggacggggggga

SEQ ID NO: 92798 - DNA, 37 bp, Artificial Sequence
  Synthetic oligonucleotide
gtcacggagacggtaggagaaaaagacagtaatggga

SEQ ID NO: 92799 - DNA, 37 bp, Artificial Sequence
  Synthetic oligonucleotide
aggacgctcgcctcaattagaatcgctctaccctgga

SEQ ID NO: 92800 - DNA, 37 bp, Artificial Sequence
  Synthetic oligonucleotide
agcgggcgaacgccggggccctacacctcctattgga

SEQ ID NO: 92801 - DNA, 37 bp, Artificial Sequence
  Synthetic oligonucleotide
tcgcaaggtcccttgtttcaccttacatcattttgga

SEQ ID NO: 92802 - DNA, 38 bp, Artificial Sequence
  Synthetic oligonucleotide
gcacgtagaatcgtaaaggtgggcggacgggggaatga

SEQ ID NO: 92803 - DNA, 38 bp, Artificial Sequence
  Synthetic oligonucleotide
tcagaaacaaccgcgtggggggagaccaggcgtaatga

SEQ ID NO: 92804 - DNA, 38 bp, Artificial Sequence
  Synthetic oligonucleotide
accgctgagccgccattttcctgtcaatttagtcatga

SEQ ID NO: 92805 - DNA, 38 bp, Artificial Sequence
  Synthetic oligonucleotide
aaccaactggcagagggtgtgtgggtggttcaagatga

SEQ ID NO: 92806 - DNA, 38 bp, Artificial Sequence
  Synthetic oligonucleotide
tccggtgtgtgcacggtggagctaactggacgggatga

SEQ ID NO: 92807 - DNA, 37 bp, Artificial Sequence
  Synthetic oligonucleotide
gtggaggtcaaatagagaggggggtagggcgcactga

SEQ ID NO: 92808 - DNA, 36 bp, Artificial Sequence
  Synthetic oligonucleotide
gttccatgtcagatcatgttcccgctgcatcactga

SEQ ID NO: 92809 - DNA, 37 bp, Artificial Sequence
  Synthetic oligonucleotide
taagagcgcgcgcattgttgattacctcctaccctga

SEQ ID NO: 92810 - DNA, 38 bp, Artificial Sequence
  Synthetic oligonucleotide
gcacgacgcccacgattccacatagagccgctcgctga

SEQ ID NO: 92811 - DNA, 37 bp, Artificial Sequence
  Synthetic oligonucleotide
tgactgggccgccctcatattgacatcatggatctga

SEQ ID NO: 92812 - DNA, 38 bp, Artificial Sequence
  Synthetic oligonucleotide
gacgtcgcacatcgtggttttccaagtaatcattctga

SEQ ID NO: 92813 - DNA, 38 bp, Artificial Sequence
  Synthetic oligonucleotide
gcacccgagactgtcatacatacttccctaccacgtga

SEQ ID NO: 92814 - DNA, 38 bp, Artificial Sequence
  Synthetic oligonucleotide
taacgacagggggagggttggcatgaaataacaggtga

SEQ ID NO: 92815 - DNA, 38 bp, Artificial Sequence
  Synthetic oligonucleotide
gttccccatgcagagtatcattgcctgccccttggtga

SEQ ID NO: 92816 - DNA, 38 bp, Artificial Sequence
  Synthetic oligonucleotide
gacgctgcgaaggtaggcaagaagtcgagtgttggtga

SEQ ID NO: 92817 - DNA, 35 bp, Artificial Sequence
  Synthetic oligonucleotide
tacatctggacgacggagtattttacaccctgtga

SEQ ID NO: 92818 - DNA, 38 bp, Artificial Sequence
  Synthetic oligonucleotide
tccccctgcacacgtagttactatacagatagctgtga

SEQ ID NO: 92819 - DNA, 38 bp, Artificial Sequence
  Synthetic oligonucleotide
acgcagatgggcgggaggggtgagatatagcgaattga

SEQ ID NO: 92820 - DNA, 38 bp, Artificial Sequence
  Synthetic oligonucleotide
gcaacatgagcgatcgggaggcgggaagggactattga

SEQ ID NO: 92821 - DNA, 38 bp, Artificial Sequence
  Synthetic oligonucleotide
tccaccccagtcttgggttgtcactccacttttattga

SEQ ID NO: 92822 - DNA, 38 bp, Artificial Sequence
  Synthetic oligonucleotide
ttcgacgagcatgagtgacattaaccatcctgccttga

SEQ ID NO: 92823 - DNA, 38 bp, Artificial Sequence
  Synthetic oligonucleotide
gcccccaccttgtggatttccacctgtctttatcttga

SEQ ID NO: 92824 - DNA, 38 bp, Artificial Sequence
  Synthetic oligonucleotide
tcacaacgttggggttggagatgagaagtgccagttga

SEQ ID NO: 92825 - DNA, 38 bp, Artificial Sequence
  Synthetic oligonucleotide
acacgctcggggacatttggtgtatagaggggggttga

SEQ ID NO: 92826 - DNA, 38 bp, Artificial Sequence
  Synthetic oligonucleotide
gctggctgttcaacccctgttctatcgtcgtcctttga

SEQ ID NO: 92827 - DNA, 38 bp, Artificial Sequence
  Synthetic oligonucleotide
gccgctcctgctggttccttgaaagatcttttgtttga

SEQ ID NO: 92828 - DNA, 36 bp, Artificial Sequence
  Synthetic oligonucleotide
tgatgcccaatgctgttggcctggcgcttattttga

SEQ ID NO: 92829 - DNA, 35 bp, Artificial Sequence
  Synthetic oligonucleotide
gacacagaaccttcaacatcacggggagacacata

SEQ ID NO: 92830 - DNA, 35 bp, Artificial Sequence
  Synthetic oligonucleotide
gggaccgctcccgaatgaatctaatgtcgcccata

SEQ ID NO: 92831 - DNA, 36 bp, Artificial Sequence
  Synthetic oligonucleotide
aagtactccaccgattgagctattgcctcactacta

SEQ ID NO: 92832 - DNA, 34 bp, Artificial Sequence
  Synthetic oligonucleotide
ttgcgtagaagcaagcggaggttagggggagcta

SEQ ID NO: 92833 - DNA, 35 bp, Artificial Sequence
  Synthetic oligonucleotide
tcaccgctatggtgaaatggattgtgctcaacgta

SEQ ID NO: 92834 - DNA, 35 bp, Artificial Sequence
  Synthetic oligonucleotide
ttggacgatgcggtgagatgggggtgattcatgta

SEQ ID NO: 92835 - DNA, 35 bp, Artificial Sequence
  Synthetic oligonucleotide
taccgcattacacattgtactatcgcttctaatta

SEQ ID NO: 92836 - DNA, 36 bp, Artificial Sequence
  Synthetic oligonucleotide
atgcgctggaactgcagagtgacattctgggcctta

SEQ ID NO: 92837 - DNA, 38 bp, Artificial Sequence
  Synthetic oligonucleotide
tcacatcccaattgtatcgggccatccctggtagctta

SEQ ID NO: 92838 - DNA, 36 bp, Artificial Sequence
  Synthetic oligonucleotide
tcaaccggacagttaggaggacaaggggggccgtta

SEQ ID NO: 92839 - DNA, 35 bp, Artificial Sequence
  Synthetic oligonucleotide
tgactccacctgtgcagccaatgtcccagctttta

SEQ ID NO: 92840 - DNA, 35 bp, Artificial Sequence
  Synthetic oligonucleotide
tagagcggggatcaggagggtcgggtagaggaaac

SEQ ID NO: 92841 - DNA, 35 bp, Artificial Sequence
  Synthetic oligonucleotide
aacacacatgcagcctgctcgaggaagtctccaac

SEQ ID NO: 92842 - DNA, 35 bp, Artificial Sequence
  Synthetic oligonucleotide
gcaaacatgacacctgatataaggtcaacccccac

SEQ ID NO: 92843 - DNA, 35 bp, Artificial Sequence
  Synthetic oligonucleotide
acctacatgtgcagtgccgcccccgaatatgctac

SEQ ID NO: 92844 - DNA, 35 bp, Artificial Sequence
  Synthetic oligonucleotide
tttcaacgccggagtcaaagcgcaccacctacagc

SEQ ID NO: 92845 - DNA, 35 bp, Artificial Sequence
  Synthetic oligonucleotide
gttgactgagcatctttgtaaggtaccgttactgc

SEQ ID NO: 92846 - DNA, 35 bp, Artificial Sequence
  Synthetic oligonucleotide
accctcacacatccaacaggtgacggtccttctgc

SEQ ID NO: 92847 - DNA, 35 bp, Artificial Sequence
  Synthetic oligonucleotide
accctccgtacacaggagttcgtggcttatgaatc

SEQ ID NO: 92848 - DNA, 35 bp, Artificial Sequence
  Synthetic oligonucleotide
gtggtacgtctggctatgtcctccaatatcgcatc

SEQ ID NO: 92849 - DNA, 35 bp, Artificial Sequence
  Synthetic oligonucleotide
aaaagacaggagatgagagaggggtaagcgcccag

SEQ ID NO: 92850 - DNA, 35 bp, Artificial Sequence
  Synthetic oligonucleotide
gacacgaaggtcacacggccaacccatctttaacg

SEQ ID NO: 92851 - DNA, 35 bp, Artificial Sequence
  Synthetic oligonucleotide
tgtgcctcctgtaacaaagcaacctctccagtgcg

SEQ ID NO: 92852 - DNA, 36 bp, Artificial Sequence
  Synthetic oligonucleotide
agcctgtcccaccctcgatgatagcctcgcaaatcg

SEQ ID NO: 92853 - DNA, 35 bp, Artificial Sequence
  Synthetic oligonucleotide
ttagtggggggatgcggaaaggataggacatcatg

SEQ ID NO: 92854 - DNA, 35 bp, Artificial Sequence
  Synthetic oligonucleotide
acattcccgcccagtcttgtcgcgtcacagtcatg

SEQ ID NO: 92855 - DNA, 35 bp, Artificial Sequence
  Synthetic oligonucleotide
tgcgccgacatcatgtggccacccgttttgtcatg

SEQ ID NO: 92856 - DNA, 35 bp, Artificial Sequence
  Synthetic oligonucleotide
gatgtgcgtgacaagagtgtgaaccggtggggatg

SEQ ID NO: 92857 - DNA, 35 bp, Artificial Sequence
  Synthetic oligonucleotide
tcaggacctgtccggcactcgcacactatcatgtg

SEQ ID NO: 92858 - DNA, 35 bp, Artificial Sequence
  Synthetic oligonucleotide
ttagtcgccgcttatctctctccgtgagggccttg

SEQ ID NO: 92859 - DNA, 35 bp, Artificial Sequence
  Synthetic oligonucleotide
tgatacctgttgagctggaaccgaaatcaaataat

SEQ ID NO: 92860 - DNA, 35 bp, Artificial Sequence
  Synthetic oligonucleotide
agctgatgaacacaggatctaagggtgggaaacat

SEQ ID NO: 92861 - DNA, 35 bp, Artificial Sequence
  Synthetic oligonucleotide
aatcagccacccgtcgacccttgggcgcatcccat

SEQ ID NO: 92862 - DNA, 35 bp, Artificial Sequence
  Synthetic oligonucleotide
gatcgccatgatcgtcataacctcaatgaatccat

SEQ ID NO: 92863 - DNA, 35 bp, Artificial Sequence
  Synthetic oligonucleotide
tgcacttcaatcaaacttagtccactgctcttcat

SEQ ID NO: 92864 - DNA, 35 bp, Artificial Sequence
  Synthetic oligonucleotide
atgttgcctcccatcgttgattagcgctctcctat

SEQ ID NO: 92865 - DNA, 35 bp, Artificial Sequence
  Synthetic oligonucleotide
tgtataggtgcaggactgggtggtgagggctctat

SEQ ID NO: 92866 - DNA, 35 bp, Artificial Sequence
  Synthetic oligonucleotide
gcactccacttcacagggacccacttcaccttgct

SEQ ID NO: 92867 - DNA, 35 bp, Artificial Sequence
  Synthetic oligonucleotide
ttcagtgaggctcatgactgtgtgaatagggctct

SEQ ID NO: 92868 - DNA, 35 bp, Artificial Sequence
  Synthetic oligonucleotide
tcaccgtcctgtctgacccggtcaccaaaccaagt

SEQ ID NO: 92869 - DNA, 35 bp, Artificial Sequence
  Synthetic oligonucleotide
tacctgcgcctcttcagtattccccaggtcctagt

SEQ ID NO: 92870 - DNA, 35 bp, Artificial Sequence
  Synthetic oligonucleotide
gcgatacgtcagtacttcgcgttcgtacacctcgt

SEQ ID NO: 92871 - DNA, 35 bp, Artificial Sequence
  Synthetic oligonucleotide
gacgaccccttccgcgttcgctacggaagtaactt

SEQ ID NO: 92872 - DNA, 35 bp, Artificial Sequence
  Synthetic oligonucleotide
gctgcccgtgtcacacccattggtccagtcgcctt

SEQ ID NO: 92873 - DNA, 35 bp, Artificial Sequence
  Synthetic oligonucleotide
gacacacacacagtacaagaggtatgcggatattt

SEQ ID NO: 92874 - DNA, 35 bp, Artificial Sequence
  Synthetic oligonucleotide
attgaagtgcgtcaacgtcttcccctactggcttt

SEQ ID NO: 92875 - DNA, 35 bp, Artificial Sequence
  Synthetic oligonucleotide
ttggatgtctgtgctggttcgccttctctcttttt

SEQ ID NO: 92876 - DNA, 35 bp, Artificial Sequence
  Synthetic oligonucleotide
tacccaatggcgcctggcatgcctggacttttttt

SEQ ID NO: 92877 - DNA, 35 bp, Artificial Sequence
  Synthetic oligonucleotide
gtggggtacatagatgggaagtaggcgcgcaacaa

SEQ ID NO: 92878 - DNA, 36 bp, Artificial Sequence
  Synthetic oligonucleotide
tcacacctgtaccgctaaaagcactgttgctcccaa

SEQ ID NO: 92879 - DNA, 34 bp, Artificial Sequence
  Synthetic oligonucleotide
tgccaccttgaggttcccgtacatttccccgcaa

SEQ ID NO: 92880 - DNA, 35 bp, Artificial Sequence
  Synthetic oligonucleotide
atacgcacacacttgctaggcataaagccaccgaa

SEQ ID NO: 92881 - DNA, 36 bp, Artificial Sequence
  Synthetic oligonucleotide
tagacccatcgtatgaactttctctttggtgccgaa

SEQ ID NO: 92882 - DNA, 36 bp, Artificial Sequence
  Synthetic oligonucleotide
tcagtggccggggtgcatgggaagatgtctagcgaa

SEQ ID NO: 92883 - DNA, 36 bp, Artificial Sequence
  Synthetic oligonucleotide
tagggagagcataagggaaccggggtgagttgggaa

SEQ ID NO: 92884 - DNA, 36 bp, Artificial Sequence
  Synthetic oligonucleotide
atgacaaaacctatgagtaggggggggaggctctaa

SEQ ID NO: 92885 - DNA, 36 bp, Artificial Sequence
  Synthetic oligonucleotide
tgcccgattaagggctcgataacagttacaacaaca

SEQ ID NO: 92886 - DNA, 35 bp, Artificial Sequence
  Synthetic oligonucleotide
atgcgggtcgaacaaaggaaaggattctgagtaca

SEQ ID NO: 92887 - DNA, 36 bp, Artificial Sequence
  Synthetic oligonucleotide
tgaccatcccggacgctctctattgacacatcccca

SEQ ID NO: 92888 - DNA, 35 bp, Artificial Sequence
  Synthetic oligonucleotide
tgccacttcccgatccataggtagcatacgcagca

SEQ ID NO: 92889 - DNA, 35 bp, Artificial Sequence
  Synthetic oligonucleotide
atggttcgagtaagggatatcggaaggtcggagca

SEQ ID NO: 92890 - DNA, 36 bp, Artificial Sequence
  Synthetic oligonucleotide
ttagctacgctctcacgtttactggcctgccacgca

SEQ ID NO: 92891 - DNA, 35 bp, Artificial Sequence
  Synthetic oligonucleotide
gttgcatgcgcaaccccctttgccatggagacgca

SEQ ID NO: 92892 - DNA, 35 bp, Artificial Sequence
  Synthetic oligonucleotide
tgcatgaagtcgcatgcaccgtgtgctatcactca

SEQ ID NO: 92893 - DNA, 36 bp, Artificial Sequence
  Synthetic oligonucleotide
gaacgtcctacgccggacctatgcaagttgccctca

SEQ ID NO: 92894 - DNA, 36 bp, Artificial Sequence
  Synthetic oligonucleotide
taccacggtgcgcgtatcgatactgataattcctca

SEQ ID NO: 92895 - DNA, 36 bp, Artificial Sequence
  Synthetic oligonucleotide
ttcatcactcccgggcgtatgcagacaccggtctca

SEQ ID NO: 92896 - DNA, 35 bp, Artificial Sequence
  Synthetic oligonucleotide
ttcgaggctgttcgccgagcaaatatcctagttca

SEQ ID NO: 92897 - DNA, 35 bp, Artificial Sequence
  Synthetic oligonucleotide
tccccaggcacgctcgtaattcgtctatgatttca

SEQ ID NO: 92898 - DNA, 37 bp, Artificial Sequence
  Synthetic oligonucleotide
tcagacgggcataggttaatactggggggggaaaaga

SEQ ID NO: 92899 - DNA, 37 bp, Artificial Sequence
  Synthetic oligonucleotide
gagaggtgggggaacgtatcagggttgtcggccgaga

SEQ ID NO: 92900 - DNA, 37 bp, Artificial Sequence
  Synthetic oligonucleotide
gacggggttgagtgctatcgggatgacggaagataga

SEQ ID NO: 92901 - DNA, 36 bp, Artificial Sequence
  Synthetic oligonucleotide
gacaactcaaactgttcaagtcgctactggcctaga

SEQ ID NO: 92902 - DNA, 37 bp, Artificial Sequence
  Synthetic oligonucleotide
tccgtagtgcgcgggaaactgactttttgatcgacga

SEQ ID NO: 92903 - DNA, 37 bp, Artificial Sequence
  Synthetic oligonucleotide
accacagtagaaaggcatgcaggaataggagggacga

SEQ ID NO: 92904 - DNA, 37 bp, Artificial Sequence
  Synthetic oligonucleotide
gatggccacctgctcctatggtctatctaacatacga

SEQ ID NO: 92905 - DNA, 37 bp, Artificial Sequence
  Synthetic oligonucleotide
gcgaaagtggatggtgaaatttgtgtgggagggccga

SEQ ID NO: 92906 - DNA, 37 bp, Artificial Sequence
  Synthetic oligonucleotide
atgtactgacgagcgagggtggatacagtgatagcga

SEQ ID NO: 92907 - DNA, 37 bp, Artificial Sequence
  Synthetic oligonucleotide
gttgacgcagtggtcattgtcaaaccgctcactgcga

SEQ ID NO: 92908 - DNA, 37 bp, Artificial Sequence
  Synthetic oligonucleotide
gcatccattagtaggccgtacttagactcatttgcga

SEQ ID NO: 92909 - DNA, 37 bp, Artificial Sequence
  Synthetic oligonucleotide
tcggaacgaacgtgcgcgtggacagcaaccgggtcga

SEQ ID NO: 92910 - DNA, 36 bp, Artificial Sequence
  Synthetic oligonucleotide
aggacacccactaaccgcctaaagcattcatttcga

SEQ ID NO: 92911 - DNA, 35 bp, Artificial Sequence
  Synthetic oligonucleotide
taacaggagagaatgagcaacgatcaggggaagga

SEQ ID NO: 92912 - DNA, 37 bp, Artificial Sequence
  Synthetic oligonucleotide
acaagggtgaagagggagtgtgggggagccgagagga

SEQ ID NO: 92913 - DNA, 35 bp, Artificial Sequence
  Synthetic oligonucleotide
gacgctggcactcgcttgcgtttccttcctccgga

SEQ ID NO: 92914 - DNA, 37 bp, Artificial Sequence
  Synthetic oligonucleotide
atgtgctgtggtgagggactttgggacatgtggcgga

SEQ ID NO: 92915 - DNA, 37 bp, Artificial Sequence
  Synthetic oligonucleotide
gccgacgggaggaagttatggagtgaatcacgaggga

SEQ ID NO: 92916 - DNA, 37 bp, Artificial Sequence
  Synthetic oligonucleotide
acatgccacacgcaggtgctacgacaaccgataggga

SEQ ID NO: 92917 - DNA, 36 bp, Artificial Sequence
  Synthetic oligonucleotide
gacaacgaaagcgtgcgggaatcggataatctggga

SEQ ID NO: 92918 - DNA, 37 bp, Artificial Sequence
  Synthetic oligonucleotide
gacacaagacacatctggcatctcctgtaccggtgga

SEQ ID NO: 92919 - DNA, 38 bp, Artificial Sequence
  Synthetic oligonucleotide
gcccggaagcacacgacaactagctacgccatacatga

SEQ ID NO: 92920 - DNA, 38 bp, Artificial Sequence
  Synthetic oligonucleotide
gattggagatgggatgggtgagggcggagttccgatga

SEQ ID NO: 92921 - DNA, 38 bp, Artificial Sequence
  Synthetic oligonucleotide
gtcgaacgtaaggaggggagcctactgcgacaggatga

SEQ ID NO: 92922 - DNA, 38 bp, Artificial Sequence
  Synthetic oligonucleotide
ttgagcaggtggggtggttggtgaggggttcatgatga

SEQ ID NO: 92923 - DNA, 38 bp, Artificial Sequence
  Synthetic oligonucleotide
ttgcccccggctgtactttgtcccaattgaccctatga

SEQ ID NO: 92924 - DNA, 38 bp, Artificial Sequence
  Synthetic oligonucleotide
tcatgtccgaaggcacctccgaatccgtctctttatga

SEQ ID NO: 92925 - DNA, 38 bp, Artificial Sequence
  Synthetic oligonucleotide
gtagtgcgacgggtgcttgccgagcgggggggaactga

SEQ ID NO: 92926 - DNA, 38 bp, Artificial Sequence
  Synthetic oligonucleotide
gaaacgtgggaaaagttagacgggaatggtgggactga

SEQ ID NO: 92927 - DNA, 37 bp, Artificial Sequence
  Synthetic oligonucleotide
gacgggggactcggtggggtggagctacgggacctga

SEQ ID NO: 92928 - DNA, 38 bp, Artificial Sequence
  Synthetic oligonucleotide
aaacacggccattgattccgttataccttttgacctga

SEQ ID NO: 92929 - DNA, 38 bp, Artificial Sequence
  Synthetic oligonucleotide
acgcccaacccgtccttccccagtgatacagtgcctga

SEQ ID NO: 92930 - DNA, 37 bp, Artificial Sequence
  Synthetic oligonucleotide
gtgggcgaacaggagacattgaggaagggccagctga

SEQ ID NO: 92931 - DNA, 38 bp, Artificial Sequence
  Synthetic oligonucleotide
gtggggtcgcgcgtgggtggtgaggttgagatggctga

SEQ ID NO: 92932 - DNA, 38 bp, Artificial Sequence
  Synthetic oligonucleotide
agccgagggcttccaccacctattcgaaaccagtctga

SEQ ID NO: 92933 - DNA, 38 bp, Artificial Sequence
  Synthetic oligonucleotide
gccacaccttgtccattccgagactgcacactgtctga

SEQ ID NO: 92934 - DNA, 38 bp, Artificial Sequence
  Synthetic oligonucleotide
attcacccagtgtgttgttccccgccgacgcgttctga

SEQ ID NO: 92935 - DNA, 38 bp, Artificial Sequence
  Synthetic oligonucleotide
tacgccgttccctatattcgtccacccgccctgagtga

SEQ ID NO: 92936 - DNA, 38 bp, Artificial Sequence
  Synthetic oligonucleotide
tatgccagcctcaacattctctcatgctacaaacgtga

SEQ ID NO: 92937 - DNA, 38 bp, Artificial Sequence
  Synthetic oligonucleotide
gactgggtggattccaaagggacgccggagcggtgtga

SEQ ID NO: 92938 - DNA, 38 bp, Artificial Sequence
  Synthetic oligonucleotide
gtcatggtggtggtgagaatgagatcggagcggtgtga

SEQ ID NO: 92939 - DNA, 38 bp, Artificial Sequence
  Synthetic oligonucleotide
tacgtcgggggaacgaatattcatgaaagcctgtgtga

SEQ ID NO: 92940 - DNA, 38 bp, Artificial Sequence
  Synthetic oligonucleotide
gcagaggtacggtggagttgactactgtgaggaattga

SEQ ID NO: 92941 - DNA, 37 bp, Artificial Sequence
  Synthetic oligonucleotide
acgcgaaggggtctggtaaacaaagtgagggaattga

SEQ ID NO: 92942 - DNA, 38 bp, Artificial Sequence
  Synthetic oligonucleotide
accggggggtacgtggttgtagggagggcgtgaattga

SEQ ID NO: 92943 - DNA, 38 bp, Artificial Sequence
  Synthetic oligonucleotide
ggagggcgggagcacgggcgctagtgaaggtcgattga

SEQ ID NO: 92944 - DNA, 38 bp, Artificial Sequence
  Synthetic oligonucleotide
tacaacagcctccatttagctctagcatacgtacttga

SEQ ID NO: 92945 - DNA, 35 bp, Artificial Sequence
  Synthetic oligonucleotide
gccacgcctgtctcccatcgtctttccacccttga

SEQ ID NO: 92946 - DNA, 37 bp, Artificial Sequence
  Synthetic oligonucleotide
tgccgggtggaggaagggcgtgtggtgggatccttga

SEQ ID NO: 92947 - DNA, 38 bp, Artificial Sequence
  Synthetic oligonucleotide
gcatgcccgccgttaagcacccctggcagtttccttga

SEQ ID NO: 92948 - DNA, 38 bp, Artificial Sequence
  Synthetic oligonucleotide
atgcacggccagagtagggggataggtaatgctgttga

SEQ ID NO: 92949 - DNA, 37 bp, Artificial Sequence
  Synthetic oligonucleotide
ttggatgctgccggggtacggtaatcatctcctttga

SEQ ID NO: 92950 - DNA, 36 bp, Artificial Sequence
  Synthetic oligonucleotide
taaccccgtcgtctccccaatgcgagcgccaaacta

SEQ ID NO: 92951 - DNA, 36 bp, Artificial Sequence
  Synthetic oligonucleotide
atccctgcactcttcacatatcgatcctgagcacta

SEQ ID NO: 92952 - DNA, 36 bp, Artificial Sequence
  Synthetic oligonucleotide
gtcacccaaaagcatcctcaccgtccgggggtcgta

SEQ ID NO: 92953 - DNA, 36 bp, Artificial Sequence
  Synthetic oligonucleotide
gggaggggggatcagtgaatagggcaagatagggta

SEQ ID NO: 92954 - DNA, 35 bp, Artificial Sequence
  Synthetic oligonucleotide
gggacacgagccgattcaacaccgcctggaactta

SEQ ID NO: 92955 - DNA, 36 bp, Artificial Sequence
  Synthetic oligonucleotide
atggtgggagcaggggggctaaaggcggtctgctta

SEQ ID NO: 92956 - DNA, 35 bp, Artificial Sequence
  Synthetic oligonucleotide
gcctgcgcagaattacacttaacccccagtgctta

SEQ ID NO: 92957 - DNA, 36 bp, Artificial Sequence
  Synthetic oligonucleotide
tcacaccgcacagcccctggtctatttactccttta

SEQ ID NO: 92958 - DNA, 35 bp, Artificial Sequence
  Synthetic oligonucleotide
actatccatccgctacactgccccggatcgagaac

SEQ ID NO: 92959 - DNA, 35 bp, Artificial Sequence
  Synthetic oligonucleotide
tgcccagtcgcgctgttcgtagtccgtcctaccac

SEQ ID NO: 92960 - DNA, 35 bp, Artificial Sequence
  Synthetic oligonucleotide
acgtagggcggaggagaaggataattaagtcgcac

SEQ ID NO: 92961 - DNA, 35 bp, Artificial Sequence
  Synthetic oligonucleotide
acacacgacttcggattttccttccccatactcac

SEQ ID NO: 92962 - DNA, 35 bp, Artificial Sequence
  Synthetic oligonucleotide
tactacacctgctgaatcgaaccgccaaggattac

SEQ ID NO: 92963 - DNA, 35 bp, Artificial Sequence
  Synthetic oligonucleotide
ggacacatccactctgttttttcttgcttggttac

SEQ ID NO: 92964 - DNA, 35 bp, Artificial Sequence
  Synthetic oligonucleotide
tgtctcacgcacagccgcaagatgcgctttccacc

SEQ ID NO: 92965 - DNA, 35 bp, Artificial Sequence
  Synthetic oligonucleotide
gagtgcgctcggtagcttaacactagtctcgcacc

SEQ ID NO: 92966 - DNA, 35 bp, Artificial Sequence
  Synthetic oligonucleotide
gatgtcacgtggggagcacgtgtccacatattacc

SEQ ID NO: 92967 - DNA, 35 bp, Artificial Sequence
  Synthetic oligonucleotide
taactcgcacagaacgtgggcataaccagtgcccc

SEQ ID NO: 92968 - DNA, 35 bp, Artificial Sequence
  Synthetic oligonucleotide
gccacccgtgccgccgttaagccactttctcatcc

SEQ ID NO: 92969 - DNA, 35 bp, Artificial Sequence
  Synthetic oligonucleotide
gatgcacatacaaacgcgcgaagtgaggctcctcc

SEQ ID NO: 92970 - DNA, 35 bp, Artificial Sequence
  Synthetic oligonucleotide
atactgcgagctatcacacgttgttgttgtcctcc

SEQ ID NO: 92971 - DNA, 34 bp, Artificial Sequence
  Synthetic oligonucleotide
tccactatccagatcgctgctccatgccctgtcc

SEQ ID NO: 92972 - DNA, 35 bp, Artificial Sequence
  Synthetic oligonucleotide
gccaggacgaaccgggcactttgggataggatcgc

SEQ ID NO: 92973 - DNA, 35 bp, Artificial Sequence
  Synthetic oligonucleotide
ttcccgactatagaatgccccgctgctgtgctcgc

SEQ ID NO: 92974 - DNA, 35 bp, Artificial Sequence
  Synthetic oligonucleotide
tgagctgtacaatcgccgcacaagtgcgtccctgc

SEQ ID NO: 92975 - DNA, 35 bp, Artificial Sequence
  Synthetic oligonucleotide
acatcgagcactcgccgaagaagatttctgcctgc

SEQ ID NO: 92976 - DNA, 35 bp, Artificial Sequence
  Synthetic oligonucleotide
acccgagggtaagggtgcattacggtacgggtgtc

SEQ ID NO: 92977 - DNA, 36 bp, Artificial Sequence
  Synthetic oligonucleotide
tgtcgacacctgactctgctgttatattcaccgttc

SEQ ID NO: 92978 - DNA, 35 bp, Artificial Sequence
  Synthetic oligonucleotide
aacagccatctggcaattgcaaccttatcattttc

SEQ ID NO: 92979 - DNA, 35 bp, Artificial Sequence
  Synthetic oligonucleotide
gcagaaacgacagggatagggttaacggaaagaag

SEQ ID NO: 92980 - DNA, 35 bp, Artificial Sequence
  Synthetic oligonucleotide
gcgcaaccgccagctcagctcacatggcaacacag

SEQ ID NO: 92981 - DNA, 35 bp, Artificial Sequence
  Synthetic oligonucleotide
gtagccggcttcctcgagttccatagttcacccag

SEQ ID NO: 92982 - DNA, 35 bp, Artificial Sequence
  Synthetic oligonucleotide
gccaagcccagaggaggaaaaggtgtggactctag

SEQ ID NO: 92983 - DNA, 35 bp, Artificial Sequence
  Synthetic oligonucleotide
aagtgaatgggagtggaacggttagccggagggcg

SEQ ID NO: 92984 - DNA, 35 bp, Artificial Sequence
  Synthetic oligonucleotide
attgcccgccccattctccgtaagtccaccgctgg

SEQ ID NO: 92985 - DNA, 35 bp, Artificial Sequence
  Synthetic oligonucleotide
gacaacgatctagtgcaatccctggtgctctttgg

SEQ ID NO: 92986 - DNA, 35 bp, Artificial Sequence
  Synthetic oligonucleotide
acccctgcccgcatgatgcacggttgtgttgcttg

SEQ ID NO: 92987 - DNA, 35 bp, Artificial Sequence
  Synthetic oligonucleotide
atgggacggtgcacatgggaaaatgctggccgaat

SEQ ID NO: 92988 - DNA, 35 bp, Artificial Sequence
  Synthetic oligonucleotide
ttacaaccccggtcgctaccgactgctcaccacat

SEQ ID NO: 92989 - DNA, 35 bp, Artificial Sequence
  Synthetic oligonucleotide
acacacgatatgcgtaaccgcccacgggatcccat

SEQ ID NO: 92990 - DNA, 35 bp, Artificial Sequence
  Synthetic oligonucleotide
tgtccggtccgttcacttaggttatcacaccctat

SEQ ID NO: 92991 - DNA, 35 bp, Artificial Sequence
  Synthetic oligonucleotide
gtcacctgcagctgaagactcatacctgattttat

SEQ ID NO: 92992 - DNA, 35 bp, Artificial Sequence
  Synthetic oligonucleotide
taccgccgccttctggcattctaggcatggaccct

SEQ ID NO: 92993 - DNA, 35 bp, Artificial Sequence
  Synthetic oligonucleotide
gcacccggctcaccctgatacctcaactgcatgct

SEQ ID NO: 92994 - DNA, 35 bp, Artificial Sequence
  Synthetic oligonucleotide
atcgcaatcaggcctcgtctcgaacatccatgtct

SEQ ID NO: 92995 - DNA, 35 bp, Artificial Sequence
  Synthetic oligonucleotide
gatggccagaaagagtggatcagtgcttggtgtct

SEQ ID NO: 92996 - DNA, 35 bp, Artificial Sequence
  Synthetic oligonucleotide
atcgtacctcgagagctgtacacacctcctttagt

SEQ ID NO: 92997 - DNA, 35 bp, Artificial Sequence
  Synthetic oligonucleotide
gtacggtgtgaatggggggtggatgagactgcggt

SEQ ID NO: 92998 - DNA, 35 bp, Artificial Sequence
  Synthetic oligonucleotide
tgaaaccgagtccacgaggtaccctcttttgcatt

SEQ ID NO: 92999 - DNA, 35 bp, Artificial Sequence
  Synthetic oligonucleotide
ttgtaccatctcggggtctaatcaccagacaggtt

SEQ ID NO: 93000 - DNA, 35 bp, Artificial Sequence
  Synthetic oligonucleotide
tcaaccggccagcccattcatcgcatgttgctgtt

SEQ ID NO: 93001 - DNA, 35 bp, Artificial Sequence
  Synthetic oligonucleotide
tgtgactggaccgctccctcctttgccgtatcaaa

SEQ ID NO: 93002 - DNA, 36 bp, Artificial Sequence
  Synthetic oligonucleotide
acgcactcccaattactatcactggctgttccgaaa

SEQ ID NO: 93003 - DNA, 35 bp, Artificial Sequence
  Synthetic oligonucleotide
taccacatcctcgccgcgttattagcgttatacaa

SEQ ID NO: 93004 - DNA, 35 bp, Artificial Sequence
  Synthetic oligonucleotide
atccaaacttccatgcgtggtgcaatcctctacaa

SEQ ID NO: 93005 - DNA, 36 bp, Artificial Sequence
  Synthetic oligonucleotide
attggcctccgctagatcaagccaccagcctaccaa

SEQ ID NO: 93006 - DNA, 36 bp, Artificial Sequence
  Synthetic oligonucleotide
gtcactgccatgaaatgccgtttcgttccttaccaa

SEQ ID NO: 93007 - DNA, 36 bp, Artificial Sequence
  Synthetic oligonucleotide
tcaccgaccgtgatctaataccagcatctcccccaa

SEQ ID NO: 93008 - DNA, 35 bp, Artificial Sequence
  Synthetic oligonucleotide
atgaagtaggagcgggcggggggggttatgagcaa

SEQ ID NO: 93009 - DNA, 36 bp, Artificial Sequence
  Synthetic oligonucleotide
accaccccaccatgctctcgtcgcctttacccgcaa

SEQ ID NO: 93010 - DNA, 36 bp, Artificial Sequence
  Synthetic oligonucleotide
ggagagagagctgggttagatggcactggatggcaa

SEQ ID NO: 93011 - DNA, 36 bp, Artificial Sequence
  Synthetic oligonucleotide
tcacaacacgcgaatactaatgcagccttaatgcaa

SEQ ID NO: 93012 - DNA, 35 bp, Artificial Sequence
  Synthetic oligonucleotide
tgaagtacgacacactctgcgacgatccctttcaa

SEQ ID NO: 93013 - DNA, 35 bp, Artificial Sequence
  Synthetic oligonucleotide
tcgccgtacgtccgtttcccctgcgcctctcttaa

SEQ ID NO: 93014 - DNA, 35 bp, Artificial Sequence
  Synthetic oligonucleotide
aacaactgagcctggtctcgagggatgggaccaca

SEQ ID NO: 93015 - DNA, 36 bp, Artificial Sequence
  Synthetic oligonucleotide
ttaggtaggcgtgcgaatcggggggagtgggcgaca

SEQ ID NO: 93016 - DNA, 36 bp, Artificial Sequence
  Synthetic oligonucleotide
tgcgccacgaaatgggggtggtgggaatgcatgaca

SEQ ID NO: 93017 - DNA, 35 bp, Artificial Sequence
  Synthetic oligonucleotide
gccacttacctcctcttttatgcagggccccacca

SEQ ID NO: 93018 - DNA, 35 bp, Artificial Sequence
  Synthetic oligonucleotide
ggaggagaaaaactgagtaaacaggagagtgccca

SEQ ID NO: 93019 - DNA, 35 bp, Artificial Sequence
  Synthetic oligonucleotide
tcgctaacccccgtgcgcgagtcccccggaatcca

SEQ ID NO: 93020 - DNA, 36 bp, Artificial Sequence
  Synthetic oligonucleotide
aatgaatccgtacctggtatcgtgcaacactttcca

SEQ ID NO: 93021 - DNA, 35 bp, Artificial Sequence
  Synthetic oligonucleotide
acccactccaggttcgctattcgttccgcatagca

SEQ ID NO: 93022 - DNA, 36 bp, Artificial Sequence
  Synthetic oligonucleotide
tagaccatccttcggcatatccgcgttacatgcgca

SEQ ID NO: 93023 - DNA, 35 bp, Artificial Sequence
  Synthetic oligonucleotide
tctgccatcaactcaggacttggccaatattcgca

SEQ ID NO: 93024 - DNA, 36 bp, Artificial Sequence
  Synthetic oligonucleotide
atcaaaagacggaagggaaggtaattcgtgcgggca

SEQ ID NO: 93025 - DNA, 36 bp, Artificial Sequence
  Synthetic oligonucleotide
ggtgtgctgcatatggcttactcataccctcctgca

SEQ ID NO: 93026 - DNA, 35 bp, Artificial Sequence
  Synthetic oligonucleotide
gccaacgtgaaggggactgggggcttggacgctca

SEQ ID NO: 93027 - DNA, 36 bp, Artificial Sequence
  Synthetic oligonucleotide
acacaaaccgcgcacgtgggttatatgtctcgctca

SEQ ID NO: 93028 - DNA, 37 bp, Artificial Sequence
  Synthetic oligonucleotide
gaaggaggcgagggaagacaccgaccgtacatagaga

SEQ ID NO: 93029 - DNA, 36 bp, Artificial Sequence
  Synthetic oligonucleotide
gccatgcgaagtattagaacactcgaacgaatgaga

SEQ ID NO: 93030 - DNA, 37 bp, Artificial Sequence
  Synthetic oligonucleotide
gtccacgtgaccggtctaggccctgcacctcatgaga

SEQ ID NO: 93031 - DNA, 36 bp, Artificial Sequence
  Synthetic oligonucleotide
ggatgcaagcaggagggatgaatgtaacagtaacga

SEQ ID NO: 93032 - DNA, 37 bp, Artificial Sequence
  Synthetic oligonucleotide
acgcacttcaagttcaccgtatcaaaccgctccacga

SEQ ID NO: 93033 - DNA, 37 bp, Artificial Sequence
  Synthetic oligonucleotide
gtcgcctccatcaataccagactgcgagtcggtacga

SEQ ID NO: 93034 - DNA, 37 bp, Artificial Sequence
  Synthetic oligonucleotide
gccgacgacctcactgggcttagcggtgtctaaccga

SEQ ID NO: 93035 - DNA, 37 bp, Artificial Sequence
  Synthetic oligonucleotide
gtaacggagcgagatttgggggtgggtggccgggcga

SEQ ID NO: 93036 - DNA, 37 bp, Artificial Sequence
  Synthetic oligonucleotide
atgtcgcatccgtaggttaaaggttccgtttttgcga

SEQ ID NO: 93037 - DNA, 37 bp, Artificial Sequence
  Synthetic oligonucleotide
gtgacagtgcggaggttctgcattggtgttacttcga

SEQ ID NO: 93038 - DNA, 35 bp, Artificial Sequence
  Synthetic oligonucleotide
ttgggggtaggagtttagggcggtcacgggaagga

SEQ ID NO: 93039 - DNA, 37 bp, Artificial Sequence
  Synthetic oligonucleotide
gagtacgcgttacagattgtttaggagagggtaagga

SEQ ID NO: 93040 - DNA, 37 bp, Artificial Sequence
  Synthetic oligonucleotide
atcaccaccgcagtctcaccgatttcgctccggcgga

SEQ ID NO: 93041 - DNA, 37 bp, Artificial Sequence
  Synthetic oligonucleotide
tgatgcgcgcgggatcgaagcgtggggggagggcgga

SEQ ID NO: 93042 - DNA, 37 bp, Artificial Sequence
  Synthetic oligonucleotide
aacacccgatcgacccggaaagagggagtgcgatgga

SEQ ID NO: 93043 - DNA, 37 bp, Artificial Sequence
  Synthetic oligonucleotide
tatccagcgggcgcgaaatgacactctgcaacctgga

SEQ ID NO: 93044 - DNA, 37 bp, Artificial Sequence
  Synthetic oligonucleotide
acagccctcgccaccgtttgttcccacagtctgtgga

SEQ ID NO: 93045 - DNA, 37 bp, Artificial Sequence
  Synthetic oligonucleotide
gagccaccatcagatttgcgctgcctgctgatttgga

SEQ ID NO: 93046 - DNA, 37 bp, Artificial Sequence
  Synthetic oligonucleotide
tacgttgcgcatttcctacactgggttcgactttgga

SEQ ID NO: 93047 - DNA, 38 bp, Artificial Sequence
  Synthetic oligonucleotide
gtgcctcctctggctttatgtagcaccttcctcaatga

SEQ ID NO: 93048 - DNA, 37 bp, Artificial Sequence
  Synthetic oligonucleotide
gcacagcacaaggctggtcttggacaaccactaatga

SEQ ID NO: 93049 - DNA, 36 bp, Artificial Sequence
  Synthetic oligonucleotide
gaagagggacggacgagcaatcaaccggtcacatga

SEQ ID NO: 93050 - DNA, 36 bp, Artificial Sequence
  Synthetic oligonucleotide
agacccgcccatcttggtttagactcttggacatga

SEQ ID NO: 93051 - DNA, 38 bp, Artificial Sequence
  Synthetic oligonucleotide
gcccactgcagaagcaagaccaacagcacacaccatga

SEQ ID NO: 93052 - DNA, 38 bp, Artificial Sequence
  Synthetic oligonucleotide
gacactgcagagtcttacctaattgctccactgcatga

SEQ ID NO: 93053 - DNA, 38 bp, Artificial Sequence
  Synthetic oligonucleotide
acaacgttagtggacaggagccgtggaaggaatgatga

SEQ ID NO: 93054 - DNA, 38 bp, Artificial Sequence
  Synthetic oligonucleotide
ttcgagacgcgatatttaacacgcctgccttactatga

SEQ ID NO: 93055 - DNA, 37 bp, Artificial Sequence
  Synthetic oligonucleotide
tgcctcccagaggatcgcattatggctacaccactga

SEQ ID NO: 93056 - DNA, 38 bp, Artificial Sequence
  Synthetic oligonucleotide
tcataggccctcaatagcataacgtctcaccactctga

SEQ ID NO: 93057 - DNA, 38 bp, Artificial Sequence
  Synthetic oligonucleotide
tccagtcacactccgcatatggtttgtcgattttctga

SEQ ID NO: 93058 - DNA, 38 bp, Artificial Sequence
  Synthetic oligonucleotide
atcgccgcccccgagccgtattcgttcattatgagtga

SEQ ID NO: 93059 - DNA, 38 bp, Artificial Sequence
  Synthetic oligonucleotide
atccccacgctccttgtaggcagtgcagtcttgagtga

SEQ ID NO: 93060 - DNA, 38 bp, Artificial Sequence
  Synthetic oligonucleotide
gccacacggccatagtactgaccacgcgcttgacgtga

SEQ ID NO: 93061 - DNA, 37 bp, Artificial Sequence
  Synthetic oligonucleotide
ttagcgaagcgtagaagcctatggacaaggagtgtga

SEQ ID NO: 93062 - DNA, 38 bp, Artificial Sequence
  Synthetic oligonucleotide
gagaggaaggcgcgaattcgtgggtagggggtgtgtga

SEQ ID NO: 93063 - DNA, 38 bp, Artificial Sequence
  Synthetic oligonucleotide
aacctcacagctgtgtagcgtaagggggagtggattga

SEQ ID NO: 93064 - DNA, 36 bp, Artificial Sequence
  Synthetic oligonucleotide
ataccgacccgcctgttgccctgttaatttgattga

SEQ ID NO: 93065 - DNA, 37 bp, Artificial Sequence
  Synthetic oligonucleotide
gcacgcccgggtgtgcactatccgcgcagtactttga

SEQ ID NO: 93066 - DNA, 36 bp, Artificial Sequence
  Synthetic oligonucleotide
tccaagagagcagggtaggtgcaggaaattgaaata

SEQ ID NO: 93067 - DNA, 36 bp, Artificial Sequence
  Synthetic oligonucleotide
aacatccgcactgggtagggtaggggcgtaggccta

SEQ ID NO: 93068 - DNA, 36 bp, Artificial Sequence
  Synthetic oligonucleotide
gtactgcgtagggatgtcaaatatgtgggtgtagta

SEQ ID NO: 93069 - DNA, 36 bp, Artificial Sequence
  Synthetic oligonucleotide
gggtctgaccggcgcgtttaacacctgttgcaatta

SEQ ID NO: 93070 - DNA, 35 bp, Artificial Sequence
  Synthetic oligonucleotide
tgacaggcaaggtgttgcattgatcactaatgaac

SEQ ID NO: 93071 - DNA, 34 bp, Artificial Sequence
  Synthetic oligonucleotide
gtggctcaccgccttcctaagtcatgagcttaac

SEQ ID NO: 93072 - DNA, 35 bp, Artificial Sequence
  Synthetic oligonucleotide
tctgcacccactatctcgtcatacatccatctcac

SEQ ID NO: 93073 - DNA, 35 bp, Artificial Sequence
  Synthetic oligonucleotide
ggatgaaccatccgacactgaatcctcccttggac

SEQ ID NO: 93074 - DNA, 35 bp, Artificial Sequence
  Synthetic oligonucleotide
tccacaacagaccgattcctgtacccgaatgcccc

SEQ ID NO: 93075 - DNA, 35 bp, Artificial Sequence
  Synthetic oligonucleotide
acagactgcattgccgcgggctaagcccacttccc

SEQ ID NO: 93076 - DNA, 35 bp, Artificial Sequence
  Synthetic oligonucleotide
gtgcgaccgcctgcccggcatcgcctcctgatgcc

SEQ ID NO: 93077 - DNA, 35 bp, Artificial Sequence
  Synthetic oligonucleotide
tccacccgtgccgccggtaagccactttctcatcc

SEQ ID NO: 93078 - DNA, 35 bp, Artificial Sequence
  Synthetic oligonucleotide
tgacccaccgcaatcatagtagatcgccatgttcc

SEQ ID NO: 93079 - DNA, 35 bp, Artificial Sequence
  Synthetic oligonucleotide
aagcagactctgcgctcctacactattgcactcgc

SEQ ID NO: 93080 - DNA, 35 bp, Artificial Sequence
  Synthetic oligonucleotide
gcgacgcccctgttctctttcacgccgctacttgc

SEQ ID NO: 93081 - DNA, 35 bp, Artificial Sequence
  Synthetic oligonucleotide
atccatacactccggctccaaggcacatctgttgc

SEQ ID NO: 93082 - DNA, 35 bp, Artificial Sequence
  Synthetic oligonucleotide
tattaccgcggatgtattctgccggtccgaatctc

SEQ ID NO: 93083 - DNA, 35 bp, Artificial Sequence
  Synthetic oligonucleotide
ttacgccgctcactccacgcctgacaaagttggtc

SEQ ID NO: 93084 - DNA, 35 bp, Artificial Sequence
  Synthetic oligonucleotide
taggggctgcaagaggactgcccactcccccgttc

SEQ ID NO: 93085 - DNA, 35 bp, Artificial Sequence
  Synthetic oligonucleotide
atcgacactctacagccaatctttcggaaactttc

SEQ ID NO: 93086 - DNA, 35 bp, Artificial Sequence
  Synthetic oligonucleotide
tcccacggcttatgtgcatgtcaacatatgctttc

SEQ ID NO: 93087 - DNA, 35 bp, Artificial Sequence
  Synthetic oligonucleotide
atcaccacctgtctcctcattaagttgagagcaag

SEQ ID NO: 93088 - DNA, 35 bp, Artificial Sequence
  Synthetic oligonucleotide
gaaacgctgggtattttggtggtgtgaggtaacag

SEQ ID NO: 93089 - DNA, 35 bp, Artificial Sequence
  Synthetic oligonucleotide
gatggaggaggaggggtcgaggttgacgggtacag

SEQ ID NO: 93090 - DNA, 35 bp, Artificial Sequence
  Synthetic oligonucleotide
tgcggggaggagggccaaactgaacagccagggag

SEQ ID NO: 93091 - DNA, 35 bp, Artificial Sequence
  Synthetic oligonucleotide
gagaggggtacaggggtgtgtaagtgatgcatgag

SEQ ID NO: 93092 - DNA, 35 bp, Artificial Sequence
  Synthetic oligonucleotide
agctgcagaacgacactctttctaggtgccttccg

SEQ ID NO: 93093 - DNA, 35 bp, Artificial Sequence
  Synthetic oligonucleotide
gtccgataaggacaggtatgagagggagtgcggcg

SEQ ID NO: 93094 - DNA, 35 bp, Artificial Sequence
  Synthetic oligonucleotide
gccgtgcacctactcgttcaatagtgatcatttcg

SEQ ID NO: 93095 - DNA, 35 bp, Artificial Sequence
  Synthetic oligonucleotide
agcgagggccgtcgataaaaaggaagttgacgggg

SEQ ID NO: 93096 - DNA, 35 bp, Artificial Sequence
  Synthetic oligonucleotide
ttgtgatggagcagcaggatgaggaaaggttatgg

SEQ ID NO: 93097 - DNA, 36 bp, Artificial Sequence
  Synthetic oligonucleotide
gtgccacatcctgtttaggggagaaaggacctgtgg

SEQ ID NO: 93098 - DNA, 35 bp, Artificial Sequence
  Synthetic oligonucleotide
gctgggacggggaaatgcaaactgtcaagccaatg

SEQ ID NO: 93099 - DNA, 35 bp, Artificial Sequence
  Synthetic oligonucleotide
atggagcacaaggagggaaaaatggtgcgcgcctg

SEQ ID NO: 93100 - DNA, 33 bp, Artificial Sequence
  Synthetic oligonucleotide
tgctgccatccccacaccttgcacgtccgacat

SEQ ID NO: 93101 - DNA, 35 bp, Artificial Sequence
  Synthetic oligonucleotide
gtctgcactccctgacaatgtccgcaccatgccat

SEQ ID NO: 93102 - DNA, 35 bp, Artificial Sequence
  Synthetic oligonucleotide
atgaacccatagccgctgcaggccctgcttcctat

SEQ ID NO: 93103 - DNA, 35 bp, Artificial Sequence
  Synthetic oligonucleotide
actcagccaatcggttatttgaatccgctccaact

SEQ ID NO: 93104 - DNA, 35 bp, Artificial Sequence
  Synthetic oligonucleotide
gggaagggatgagaggatagggcgagaacggcact

SEQ ID NO: 93105 - DNA, 35 bp, Artificial Sequence
  Synthetic oligonucleotide
tttacgcggctgccttggccaaggtgaacgttcct

SEQ ID NO: 93106 - DNA, 34 bp, Artificial Sequence
  Synthetic oligonucleotide
gcaacgcaaaccctttttttttgactgtccgtct

SEQ ID NO: 93107 - DNA, 35 bp, Artificial Sequence
  Synthetic oligonucleotide
gtgcctaccatcataagtacccttcaaccttcggt

SEQ ID NO: 93108 - DNA, 35 bp, Artificial Sequence
  Synthetic oligonucleotide
tgtcggagaagggggtggtgtcgtccccagagggt

SEQ ID NO: 93109 - DNA, 34 bp, Artificial Sequence
  Synthetic oligonucleotide
atgccatgcccctgccctccttgtttaccctggt

SEQ ID NO: 93110 - DNA, 35 bp, Artificial Sequence
  Synthetic oligonucleotide
ggaagcccaggcccgtccactttgctgaagtaatt

SEQ ID NO: 93111 - DNA, 35 bp, Artificial Sequence
  Synthetic oligonucleotide
ttcacgctgggtccaggcactgtcactggtgcatt

SEQ ID NO: 93112 - DNA, 35 bp, Artificial Sequence
  Synthetic oligonucleotide
aatgctgtacaggcagcctgtaaatgatcttcgtt

SEQ ID NO: 93113 - DNA, 35 bp, Artificial Sequence
  Synthetic oligonucleotide
gtgcctcccttgcaatcggacatgtactgtcgttt

SEQ ID NO: 93114 - DNA, 35 bp, Artificial Sequence
  Synthetic oligonucleotide
tacacgcaaccactaccgcgtcgtctgtacatttt

SEQ ID NO: 93115 - DNA, 35 bp, Artificial Sequence
  Synthetic oligonucleotide
gccgcccgccgatccaaacttgcgtccaactgaaa

SEQ ID NO: 93116 - DNA, 36 bp, Artificial Sequence
  Synthetic oligonucleotide
agtggagttgagggtgggtgggatccacagaataaa

SEQ ID NO: 93117 - DNA, 36 bp, Artificial Sequence
  Synthetic oligonucleotide
gaaccaggcctccctaatgcagtcgaacgaatacaa

SEQ ID NO: 93118 - DNA, 35 bp, Artificial Sequence
  Synthetic oligonucleotide
agactcaccgaccactccaccgtatttgaggagaa

SEQ ID NO: 93119 - DNA, 35 bp, Artificial Sequence
  Synthetic oligonucleotide
gtgccccgacacgagtggtgccttactttgccgaa

SEQ ID NO: 93120 - DNA, 36 bp, Artificial Sequence
  Synthetic oligonucleotide
atcaccgccatgacgtagggactcgtactgcaataa

SEQ ID NO: 93121 - DNA, 36 bp, Artificial Sequence
  Synthetic oligonucleotide
accacaacaggctgctctgttcctacttctgacaca

SEQ ID NO: 93122 - DNA, 36 bp, Artificial Sequence
  Synthetic oligonucleotide
tcatctgcactgttgggcgctatgtactgtgctaca

SEQ ID NO: 93123 - DNA, 36 bp, Artificial Sequence
  Synthetic oligonucleotide
tgtacgactgtacggaaggtcccaggcgcatctaca

SEQ ID NO: 93124 - DNA, 36 bp, Artificial Sequence
  Synthetic oligonucleotide
gatccactactcagtccggtatgggacccctctaca

SEQ ID NO: 93125 - DNA, 36 bp, Artificial Sequence
  Synthetic oligonucleotide
acgagatgctcacctgattgctacttcacttcacca

SEQ ID NO: 93126 - DNA, 36 bp, Artificial Sequence
  Synthetic oligonucleotide
agtgagcggtaggagggttcgtcacatgaaaagcca

SEQ ID NO: 93127 - DNA, 36 bp, Artificial Sequence
  Synthetic oligonucleotide
ttcacacccctgaagctaaacctggcatcatggcca

SEQ ID NO: 93128 - DNA, 35 bp, Artificial Sequence
  Synthetic oligonucleotide
gaaccacaaacacgtgagggggagttaacgagtca

SEQ ID NO: 93129 - DNA, 36 bp, Artificial Sequence
  Synthetic oligonucleotide
tcgatgccgcacttcgtcgttcgtattccttgttca

SEQ ID NO: 93130 - DNA, 37 bp, Artificial Sequence
  Synthetic oligonucleotide
gtgggagtggcgggagtaataactggaccaggagaga

SEQ ID NO: 93131 - DNA, 37 bp, Artificial Sequence
  Synthetic oligonucleotide
ggaggggggggccgggtctgccgagacaggactgaga

SEQ ID NO: 93132 - DNA, 37 bp, Artificial Sequence
  Synthetic oligonucleotide
tagacgaacctcgtaactgtaacgctccatcaataga

SEQ ID NO: 93133 - DNA, 37 bp, Artificial Sequence
  Synthetic oligonucleotide
gatggccacatatcatccgctatatatactgttacga

SEQ ID NO: 93134 - DNA, 37 bp, Artificial Sequence
  Synthetic oligonucleotide
gaacctcccgaggagtttaccttagttgcttttacga

SEQ ID NO: 93135 - DNA, 37 bp, Artificial Sequence
  Synthetic oligonucleotide
atgaccgtatattggtagccctgaccttgctccccga

SEQ ID NO: 93136 - DNA, 37 bp, Artificial Sequence
  Synthetic oligonucleotide
gtcacccccagaggtgaggtcaactattccatcccga

SEQ ID NO: 93137 - DNA, 37 bp, Artificial Sequence
  Synthetic oligonucleotide
atgtacacagggcaggaggaaggtcgctcagctccga

SEQ ID NO: 93138 - DNA, 36 bp, Artificial Sequence
  Synthetic oligonucleotide
tgccaacccacgcattgagacgtacacgatttgcga

SEQ ID NO: 93139 - DNA, 37 bp, Artificial Sequence
  Synthetic oligonucleotide
gaacacgtcttggcaaacccacgcctctctgcctcga

SEQ ID NO: 93140 - DNA, 37 bp, Artificial Sequence
  Synthetic oligonucleotide
tcacgtcgcccttgggatagctccacagtattctcga

SEQ ID NO: 93141 - DNA, 37 bp, Artificial Sequence
  Synthetic oligonucleotide
gatgggagggggaggctattaagaatgggtttaagga

SEQ ID NO: 93142 - DNA, 37 bp, Artificial Sequence
  Synthetic oligonucleotide
tgtccctccaacgtttaggccctccagggttaccgga

SEQ ID NO: 93143 - DNA, 37 bp, Artificial Sequence
  Synthetic oligonucleotide
agcgaaggagacgtcaagcgggggaagtatgacggga

SEQ ID NO: 93144 - DNA, 37 bp, Artificial Sequence
  Synthetic oligonucleotide
gactgcagtgcactcgcgttatggagatgggggggga

SEQ ID NO: 93145 - DNA, 37 bp, Artificial Sequence
  Synthetic oligonucleotide
ggtagcctaggaggcgcaactactgaaaaactgggga

SEQ ID NO: 93146 - DNA, 37 bp, Artificial Sequence
  Synthetic oligonucleotide
tatggaggcacggaaggaaatgtggctgtaattggga

SEQ ID NO: 93147 - DNA, 37 bp, Artificial Sequence
  Synthetic oligonucleotide
atggtggggtgggactgtacagctgaaggtcattgga

SEQ ID NO: 93148 - DNA, 37 bp, Artificial Sequence
  Synthetic oligonucleotide
atctgggtgaggagagcattgaaggcacgttgttgga

SEQ ID NO: 93149 - DNA, 36 bp, Artificial Sequence
  Synthetic oligonucleotide
gaagagcagggcggttaagggcggagttcagaatga

SEQ ID NO: 93150 - DNA, 37 bp, Artificial Sequence
  Synthetic oligonucleotide
gtgtggatgacagaaagggtgcgggcaaggcgaatga

SEQ ID NO: 93151 - DNA, 38 bp, Artificial Sequence
  Synthetic oligonucleotide
acgagagacgcgaggggacacggggcagtagagcatga

SEQ ID NO: 93152 - DNA, 38 bp, Artificial Sequence
  Synthetic oligonucleotide
gtgcaaaagggaggtggtgaatgcatggtacgttatga

SEQ ID NO: 93153 - DNA, 38 bp, Artificial Sequence
  Synthetic oligonucleotide
gcgagaagccctcattatatatcactccacctaactga

SEQ ID NO: 93154 - DNA, 36 bp, Artificial Sequence
  Synthetic oligonucleotide
tatcaagggtgggaagaaggatctgggcttgactga

SEQ ID NO: 93155 - DNA, 38 bp, Artificial Sequence
  Synthetic oligonucleotide
tccacatcggttcattgtctcaaattgcctatacctga

SEQ ID NO: 93156 - DNA, 37 bp, Artificial Sequence
  Synthetic oligonucleotide
tgtgcgactatttttcaagtgtcaactccccccctga

SEQ ID NO: 93157 - DNA, 38 bp, Artificial Sequence
  Synthetic oligonucleotide
atgtacctgcgccttgctgtgatttttctatcccctga

SEQ ID NO: 93158 - DNA, 38 bp, Artificial Sequence
  Synthetic oligonucleotide
tgaatgggcggtgtggagggccaaagatgagacgctga

SEQ ID NO: 93159 - DNA, 38 bp, Artificial Sequence
  Synthetic oligonucleotide
gtgcaaagcacgggaacttggggggaaaagcgggctga

SEQ ID NO: 93160 - DNA, 38 bp, Artificial Sequence
  Synthetic oligonucleotide
atccatcaacataatggcaccacacagtcatgggctga

SEQ ID NO: 93161 - DNA, 38 bp, Artificial Sequence
  Synthetic oligonucleotide
gacatggtggagatctcgggtatggtgtagacatctga

SEQ ID NO: 93162 - DNA, 36 bp, Artificial Sequence
  Synthetic oligonucleotide
ttcgtggctcatggtctcattcccgtgcttctctga

SEQ ID NO: 93163 - DNA, 35 bp, Artificial Sequence
  Synthetic oligonucleotide
gccataaccgcccagccttgcgtcattaggtctga

SEQ ID NO: 93164 - DNA, 38 bp, Artificial Sequence
  Synthetic oligonucleotide
ggggaaccgcgtgggtagatggggcaaggtggaagtga

SEQ ID NO: 93165 - DNA, 37 bp, Artificial Sequence
  Synthetic oligonucleotide
gtgtggcggtggtggcgcggaaggcggagtgcagtga

SEQ ID NO: 93166 - DNA, 38 bp, Artificial Sequence
  Synthetic oligonucleotide
ttgggctgggggagtgaaaatgcacggaattgcagtga

SEQ ID NO: 93167 - DNA, 38 bp, Artificial Sequence
  Synthetic oligonucleotide
tcagcacgttctgctaagccttctagtatcatccgtga

SEQ ID NO: 93168 - DNA, 38 bp, Artificial Sequence
  Synthetic oligonucleotide
acctccaccggtattgttggccttgacagacaaggtga

SEQ ID NO: 93169 - DNA, 38 bp, Artificial Sequence
  Synthetic oligonucleotide
gaccagtgtcagccagcaaaggaagggaggtggggtga

SEQ ID NO: 93170 - DNA, 38 bp, Artificial Sequence
  Synthetic oligonucleotide
gacgaacggtgcacaggtgcatctgcattccctggtga

SEQ ID NO: 93171 - DNA, 37 bp, Artificial Sequence
  Synthetic oligonucleotide
gaagagacacacgtgttgggcaggagagttattgtga

SEQ ID NO: 93172 - DNA, 37 bp, Artificial Sequence
  Synthetic oligonucleotide
gtggaaggggaggtgagatcaagatctgggaaattga

SEQ ID NO: 93173 - DNA, 38 bp, Artificial Sequence
  Synthetic oligonucleotide
tcgagaggagcgtgtgtgatgaggtggacgggaattga

SEQ ID NO: 93174 - DNA, 38 bp, Artificial Sequence
  Synthetic oligonucleotide
tacgcggacacctgagtaccgggcctctttctaattga

SEQ ID NO: 93175 - DNA, 38 bp, Artificial Sequence
  Synthetic oligonucleotide
tgatcgcctctgtggattgtaactctacgccaccttga

SEQ ID NO: 93176 - DNA, 38 bp, Artificial Sequence
  Synthetic oligonucleotide
gatctgcgcgcctgtccatttaaagttcttgtccttga

SEQ ID NO: 93177 - DNA, 38 bp, Artificial Sequence
  Synthetic oligonucleotide
ggaaggaggggtagtaggaaacggtggaagagagttga

SEQ ID NO: 93178 - DNA, 38 bp, Artificial Sequence
  Synthetic oligonucleotide
gaagccgatcggtggtggcgataggggaacgacgttga

SEQ ID NO: 93179 - DNA, 38 bp, Artificial Sequence
  Synthetic oligonucleotide
gacgtcaccgcctgcacccgttgaaaacaagactttga

SEQ ID NO: 93180 - DNA, 38 bp, Artificial Sequence
  Synthetic oligonucleotide
gacaagtaccgcccacgtatgctcctaactccgtttga

SEQ ID NO: 93181 - DNA, 36 bp, Artificial Sequence
  Synthetic oligonucleotide
gaccgcccgcccaactccagaatgacgacgttttga

SEQ ID NO: 93182 - DNA, 35 bp, Artificial Sequence
  Synthetic oligonucleotide
tgaatggtcggctcagtatcctctccggcttcata

SEQ ID NO: 93183 - DNA, 35 bp, Artificial Sequence
  Synthetic oligonucleotide
atccagcccgtcatgaactctgcttccgataccta

SEQ ID NO: 93184 - DNA, 35 bp, Artificial Sequence
  Synthetic oligonucleotide
gccttccatgccgatcggcccgggcgggtacccta

SEQ ID NO: 93185 - DNA, 35 bp, Artificial Sequence
  Synthetic oligonucleotide
aaccatgcgctcgttgcgatgttgcctttgcccta

SEQ ID NO: 93186 - DNA, 36 bp, Artificial Sequence
  Synthetic oligonucleotide
tcctcacatagcccgttggtacctatgcccaatcta

SEQ ID NO: 93187 - DNA, 36 bp, Artificial Sequence
  Synthetic oligonucleotide
tacgcgcacctggacactaagggggcaaacgatcta

SEQ ID NO: 93188 - DNA, 35 bp, Artificial Sequence
  Synthetic oligonucleotide
tagcacatcatccgcgggtcgccttctcaattcta

SEQ ID NO: 93189 - DNA, 36 bp, Artificial Sequence
  Synthetic oligonucleotide
gatcgaccctctgttgtttcttgtccacctgtggta

SEQ ID NO: 93190 - DNA, 36 bp, Artificial Sequence
  Synthetic oligonucleotide
gcaagggagaggactggggtagattaagaaggatta

SEQ ID NO: 93191 - DNA, 35 bp, Artificial Sequence
  Synthetic oligonucleotide
aatgccatcctcgtggggtttccattatgacctta

SEQ ID NO: 93192 - DNA, 36 bp, Artificial Sequence
  Synthetic oligonucleotide
actacaactcgcagtcttaggtccaagtctccctta

SEQ ID NO: 93193 - DNA, 36 bp, Artificial Sequence
  Synthetic oligonucleotide
gcacaaccgtgcgtaacgcatttgcatttgcgctta

SEQ ID NO: 93194 - DNA, 35 bp, Artificial Sequence
  Synthetic oligonucleotide
tgtaatcgccaccgcatctaatatgatcctagtta

SEQ ID NO: 93195 - DNA, 36 bp, Artificial Sequence
  Synthetic oligonucleotide
gttcacggactatgcatcatcgcggccatcccttta

SEQ ID NO: 93196 - DNA, 36 bp, Artificial Sequence
  Synthetic oligonucleotide
agtacgtatgcccactcgactcccgtatagctttta

SEQ ID NO: 93197 - DNA, 35 bp, Artificial Sequence
  Synthetic oligonucleotide
atgtctccatccaagcggttcattgcattgcaaac

SEQ ID NO: 93198 - DNA, 34 bp, Artificial Sequence
  Synthetic oligonucleotide
aaaccacccgctgttacgacctccttcatgaaac

SEQ ID NO: 93199 - DNA, 35 bp, Artificial Sequence
  Synthetic oligonucleotide
tgacctgaccactagccgttggcatgtcactacac

SEQ ID NO: 93200 - DNA, 35 bp, Artificial Sequence
  Synthetic oligonucleotide
gagttggtcaacctgcgggtcgccttagccaccac

SEQ ID NO: 93201 - DNA, 35 bp, Artificial Sequence
  Synthetic oligonucleotide
gccccgccttcaactttcctgctacgtacgctgac

SEQ ID NO: 93202 - DNA, 35 bp, Artificial Sequence
  Synthetic oligonucleotide
aacgtgaggaatcgcagccgcacactctggttgac

SEQ ID NO: 93203 - DNA, 35 bp, Artificial Sequence
  Synthetic oligonucleotide
gatgccaaacggtcggatccccgatcgtggactac

SEQ ID NO: 93204 - DNA, 35 bp, Artificial Sequence
  Synthetic oligonucleotide
atgaagaacagcagctagggtaggatgggctgtac

SEQ ID NO: 93205 - DNA, 35 bp, Artificial Sequence
  Synthetic oligonucleotide
aaatgaggtggcgcggctcctggctccatttaacc

SEQ ID NO: 93206 - DNA, 35 bp, Artificial Sequence
  Synthetic oligonucleotide
aaccggtgctacagccatctcgtcgaactattacc

SEQ ID NO: 93207 - DNA, 35 bp, Artificial Sequence
  Synthetic oligonucleotide
gccgcctcttgatgaggcaattcaccttcttaccc

SEQ ID NO: 93208 - DNA, 35 bp, Artificial Sequence
  Synthetic oligonucleotide
tagaaccctcaccaaggctgtctaattacaacccc

SEQ ID NO: 93209 - DNA, 35 bp, Artificial Sequence
  Synthetic oligonucleotide
acgctgaggcccaatctatcgcaagtgcttctccc

SEQ ID NO: 93210 - DNA, 35 bp, Artificial Sequence
  Synthetic oligonucleotide
tcaccacctccgctccaattgatatatgtaagtcc

SEQ ID NO: 93211 - DNA, 35 bp, Artificial Sequence
  Synthetic oligonucleotide
atgtcactgtcctggctaattcacgctgtacttcc

SEQ ID NO: 93212 - DNA, 35 bp, Artificial Sequence
  Synthetic oligonucleotide
tcagacgcacacccgcaccatagttcgtttatcgc

SEQ ID NO: 93213 - DNA, 35 bp, Artificial Sequence
  Synthetic oligonucleotide
actcccgcctccgctggttaacgtaccactttggc

SEQ ID NO: 93214 - DNA, 32 bp, Artificial Sequence
  Synthetic oligonucleotide
tgatgtaccaccggtaggaataacactcaatc

SEQ ID NO: 93215 - DNA, 35 bp, Artificial Sequence
  Synthetic oligonucleotide
tcattcatccaatcacctgtcgatgacgacttatc

SEQ ID NO: 93216 - DNA, 35 bp, Artificial Sequence
  Synthetic oligonucleotide
tttgtccagtgccatgatccggatccccgaccctc

SEQ ID NO: 93217 - DNA, 35 bp, Artificial Sequence
  Synthetic oligonucleotide
ttccacgcactctggctgatcgctagatttgcctc

SEQ ID NO: 93218 - DNA, 35 bp, Artificial Sequence
  Synthetic oligonucleotide
ttgcgcgacaaccgagtccggcccatctccgagtc

SEQ ID NO: 93219 - DNA, 35 bp, Artificial Sequence
  Synthetic oligonucleotide
gctagggaaggaaaggtaggtgtaattgtggtgtc

SEQ ID NO: 93220 - DNA, 35 bp, Artificial Sequence
  Synthetic oligonucleotide
gtgacaactcttcgccgtgacatatggaacggttc

SEQ ID NO: 93221 - DNA, 35 bp, Artificial Sequence
  Synthetic oligonucleotide
ttagcgcactgtgaggtgggctggtgtaggggttc

SEQ ID NO: 93222 - DNA, 35 bp, Artificial Sequence
  Synthetic oligonucleotide
gtaagcgggcctgtgtgtggtggtgattaatgtag

SEQ ID NO: 93223 - DNA, 35 bp, Artificial Sequence
  Synthetic oligonucleotide
tccacaacagcgtgtcctggtttacgttgcatgcg

SEQ ID NO: 93224 - DNA, 35 bp, Artificial Sequence
  Synthetic oligonucleotide
tgagggagaggcaaagggagcctgaggagatttcg

SEQ ID NO: 93225 - DNA, 35 bp, Artificial Sequence
  Synthetic oligonucleotide
agcaccagcagggtaaaaatcgttgtgttgtctgg

SEQ ID NO: 93226 - DNA, 35 bp, Artificial Sequence
  Synthetic oligonucleotide
gtaaaggtatgggggagaagaagcggacagagatg

SEQ ID NO: 93227 - DNA, 35 bp, Artificial Sequence
  Synthetic oligonucleotide
gctgtacaccgcacacttccgttcgcataggtatg

SEQ ID NO: 93228 - DNA, 35 bp, Artificial Sequence
  Synthetic oligonucleotide
tgactcccaatacatgcagacgacctataatcctg

SEQ ID NO: 93229 - DNA, 35 bp, Artificial Sequence
  Synthetic oligonucleotide
ttgccaacggtacaggctagccacaacgctctctg

SEQ ID NO: 93230 - DNA, 35 bp, Artificial Sequence
  Synthetic oligonucleotide
atcacgggctggatcgcgattaggggagtggagtg

SEQ ID NO: 93231 - DNA, 35 bp, Artificial Sequence
  Synthetic oligonucleotide
attgccacccacttactcgcccgatgttgtatgtg

SEQ ID NO: 93232 - DNA, 35 bp, Artificial Sequence
  Synthetic oligonucleotide
gtgcggtctgcagtgtgttcccccccgtatccaat

SEQ ID NO: 93233 - DNA, 35 bp, Artificial Sequence
  Synthetic oligonucleotide
gcactgcaagccctgttaatcttgtggtcacacat

SEQ ID NO: 93234 - DNA, 35 bp, Artificial Sequence
  Synthetic oligonucleotide
atgctcctgcttggcgatttgcacaataataccat

SEQ ID NO: 93235 - DNA, 35 bp, Artificial Sequence
  Synthetic oligonucleotide
acacctaacgcccacccatcgctcgtcacgagact

SEQ ID NO: 93236 - DNA, 35 bp, Artificial Sequence
  Synthetic oligonucleotide
gcacacattccgtacccccggagccagatatacct

SEQ ID NO: 93237 - DNA, 35 bp, Artificial Sequence
  Synthetic oligonucleotide
tctgatcctctcccgcgtaatgcttcgtgcatcct

SEQ ID NO: 93238 - DNA, 35 bp, Artificial Sequence
  Synthetic oligonucleotide
gtgagcgagtaatcctggctaaaaaagttctggct

SEQ ID NO: 93239 - DNA, 35 bp, Artificial Sequence
  Synthetic oligonucleotide
tgagagcggtgcacctgcgggtcaatcgtacatct

SEQ ID NO: 93240 - DNA, 35 bp, Artificial Sequence
  Synthetic oligonucleotide
agcacagtgcatagccatctaacgatacgacacgt

SEQ ID NO: 93241 - DNA, 35 bp, Artificial Sequence
  Synthetic oligonucleotide
gcagaccggtgttgaagcgtgtgggtagaaggggt

SEQ ID NO: 93242 - DNA, 35 bp, Artificial Sequence
  Synthetic oligonucleotide
tccatacgtcctcgatctgaacccgtctatcctgt

SEQ ID NO: 93243 - DNA, 35 bp, Artificial Sequence
  Synthetic oligonucleotide
aacgtacgcggtcggatatttcatgagtgatgtgt

SEQ ID NO: 93244 - DNA, 35 bp, Artificial Sequence
  Synthetic oligonucleotide
gtcgggccccggtcgcgtaacacacacgatcaatt

SEQ ID NO: 93245 - DNA, 35 bp, Artificial Sequence
  Synthetic oligonucleotide
acgccgcgcaatggcttttgttcacccgcattctt

SEQ ID NO: 93246 - DNA, 35 bp, Artificial Sequence
  Synthetic oligonucleotide
tatccctgctgcattatgttctagcgtccgtagtt

SEQ ID NO: 93247 - DNA, 35 bp, Artificial Sequence
  Synthetic oligonucleotide
acaacgccctccccagtgcccatagggcattagtt

SEQ ID NO: 93248 - DNA, 35 bp, Artificial Sequence
  Synthetic oligonucleotide
acacatgccttgactcggtgcaaatcgaaaggttt

SEQ ID NO: 93249 - DNA, 35 bp, Artificial Sequence
  Synthetic oligonucleotide
ggagggcacctccgatacattcgtgtccacttttt

SEQ ID NO: 93250 - DNA, 36 bp, Artificial Sequence
  Synthetic oligonucleotide
gtatcttaagcggaggtaacgggcaatcggaggaaa

SEQ ID NO: 93251 - DNA, 36 bp, Artificial Sequence
  Synthetic oligonucleotide
gaagagtgggagtagtgctgagcatggatatggaaa

SEQ ID NO: 93252 - DNA, 35 bp, Artificial Sequence
  Synthetic oligonucleotide
aacacgcctccaaccgcgggacagacttcttacaa

SEQ ID NO: 93253 - DNA, 35 bp, Artificial Sequence
  Synthetic oligonucleotide
gtcgcacccgggaattttctgcgcaacgcacagaa

SEQ ID NO: 93254 - DNA, 36 bp, Artificial Sequence
  Synthetic oligonucleotide
tcacatcctacttgccatacgacaatcttccgagaa

SEQ ID NO: 93255 - DNA, 38 bp, Artificial Sequence
  Synthetic oligonucleotide
tggtccgaaggcaaggggaggatgggaggcttaattaa

SEQ ID NO: 93256 - DNA, 36 bp, Artificial Sequence
  Synthetic oligonucleotide
tatcctcgccggctttcgtgtttcatccatcgttaa

SEQ ID NO: 93257 - DNA, 35 bp, Artificial Sequence
  Synthetic oligonucleotide
tgttactaccactctgctcttttgatcactgtaca

SEQ ID NO: 93258 - DNA, 36 bp, Artificial Sequence
  Synthetic oligonucleotide
ttcaccacacccagggataggggaagtgggatgcca

SEQ ID NO: 93259 - DNA, 35 bp, Artificial Sequence
  Synthetic oligonucleotide
gcctgaaccgttgctctcttgcccaatcccccgca

SEQ ID NO: 93260 - DNA, 36 bp, Artificial Sequence
  Synthetic oligonucleotide
atcatttgtagtgggcggtggaaggcaagtaaggca

SEQ ID NO: 93261 - DNA, 36 bp, Artificial Sequence
  Synthetic oligonucleotide
tttagacacactcacaatccttaccgacagtctgca

SEQ ID NO: 93262 - DNA, 37 bp, Artificial Sequence
  Synthetic oligonucleotide
gttcacccaaggacgcgtgctattcgtaccctgtgca

SEQ ID NO: 93263 - DNA, 36 bp, Artificial Sequence
  Synthetic oligonucleotide
agttgccaccctcgtgccctttgagatacgcgctca

SEQ ID NO: 93264 - DNA, 36 bp, Artificial Sequence
  Synthetic oligonucleotide
gcctcattgcctagaacacgcccatcacttacgtca

SEQ ID NO: 93265 - DNA, 35 bp, Artificial Sequence
  Synthetic oligonucleotide
atccgaacggacggtccacctttattgtactgtca

SEQ ID NO: 93266 - DNA, 36 bp, Artificial Sequence
  Synthetic oligonucleotide
atccgcccgcagctcgccttagcaaggccacgttca

SEQ ID NO: 93267 - DNA, 37 bp, Artificial Sequence
  Synthetic oligonucleotide
gcctgcaccatcaacctgttcccagaggcttcagaga

SEQ ID NO: 93268 - DNA, 37 bp, Artificial Sequence
  Synthetic oligonucleotide
agctcgtctaaggcaaaaaaggtggaggggagtgaga

SEQ ID NO: 93269 - DNA, 37 bp, Artificial Sequence
  Synthetic oligonucleotide
aacacagtgactaggaggtggagtaaaattgctacga

SEQ ID NO: 93270 - DNA, 37 bp, Artificial Sequence
  Synthetic oligonucleotide
tagacaagtggagtgcttcagtgggctgctgttacga

SEQ ID NO: 93271 - DNA, 35 bp, Artificial Sequence
  Synthetic oligonucleotide
gaaaggcggaggcgaagaaacggccagggacgcga

SEQ ID NO: 93272 - DNA, 36 bp, Artificial Sequence
  Synthetic oligonucleotide
gcgaacactgcagtatcgcattacaacatcctgcga

SEQ ID NO: 93273 - DNA, 37 bp, Artificial Sequence
  Synthetic oligonucleotide
gagggagagcgggagagtagtggcacgtacggtgcga

SEQ ID NO: 93274 - DNA, 37 bp, Artificial Sequence
  Synthetic oligonucleotide
ggtgaaccatccgtagtgcttgctattgccaattcga

SEQ ID NO: 93275 - DNA, 36 bp, Artificial Sequence
  Synthetic oligonucleotide
actcgaacagcatctaagaatttccacctctttcga

SEQ ID NO: 93276 - DNA, 36 bp, Artificial Sequence
  Synthetic oligonucleotide
agatacggtgtaggggaacaaaaagcgggtccagga

SEQ ID NO: 93277 - DNA, 37 bp, Artificial Sequence
  Synthetic oligonucleotide
gttgccgtgtctattactcttttccttccggttagga

SEQ ID NO: 93278 - DNA, 37 bp, Artificial Sequence
  Synthetic oligonucleotide
accggatgcgaagggaaagcaaatgcacgtggccgga

SEQ ID NO: 93279 - DNA, 37 bp, Artificial Sequence
  Synthetic oligonucleotide
gtaaagtccgggtcaaaggtggcaggagtggagcgga

SEQ ID NO: 93280 - DNA, 37 bp, Artificial Sequence
  Synthetic oligonucleotide
gtagcgcacaacacccccagggcccgtcagtcaggga

SEQ ID NO: 93281 - DNA, 37 bp, Artificial Sequence
  Synthetic oligonucleotide
gtgggcatacacggagtgagcaaattggagctgggga

SEQ ID NO: 93282 - DNA, 37 bp, Artificial Sequence
  Synthetic oligonucleotide
tgacgaggggattgctagcgttgagagcgtgatggga

SEQ ID NO: 93283 - DNA, 38 bp, Artificial Sequence
  Synthetic oligonucleotide
gacatgatggatgatgaagatagctagccgacaaatga

SEQ ID NO: 93284 - DNA, 38 bp, Artificial Sequence
  Synthetic oligonucleotide
accgccgtacggactccacccccagacacgtttaatga

SEQ ID NO: 93285 - DNA, 38 bp, Artificial Sequence
  Synthetic oligonucleotide
ttgtcgggtccctaccgtgaacgtgtgcctctccatga

SEQ ID NO: 93286 - DNA, 38 bp, Artificial Sequence
  Synthetic oligonucleotide
gatgatcgaagggtggggcgggactgtagagcgcatga

SEQ ID NO: 93287 - DNA, 37 bp, Artificial Sequence
  Synthetic oligonucleotide
gaggggtaggggtgccggacgtactgcatctcgatga

SEQ ID NO: 93288 - DNA, 37 bp, Artificial Sequence
  Synthetic oligonucleotide
atacgccgggagatgggggtttgaaggatggttatga

SEQ ID NO: 93289 - DNA, 38 bp, Artificial Sequence
  Synthetic oligonucleotide
gctgccaagcacgtatagttggaaaaccaatgaactga

SEQ ID NO: 93290 - DNA, 38 bp, Artificial Sequence
  Synthetic oligonucleotide
gaggagaggacggtgatccagtgggtggtggcgactga

SEQ ID NO: 93291 - DNA, 37 bp, Artificial Sequence
  Synthetic oligonucleotide
gtatgtcgccgttgctaacccgtcttcatgaacctga

SEQ ID NO: 93292 - DNA, 35 bp, Artificial Sequence
  Synthetic oligonucleotide
gcgtgcgccttcatggtcttccctggccttcctga

SEQ ID NO: 93293 - DNA, 35 bp, Artificial Sequence
  Synthetic oligonucleotide
gtttcagtccgtcaaggccccgcaatcccaagtga

SEQ ID NO: 93294 - DNA, 38 bp, Artificial Sequence
  Synthetic oligonucleotide
gcatggcatcggggggggcggggagtctggggccgtga

SEQ ID NO: 93295 - DNA, 38 bp, Artificial Sequence
  Synthetic oligonucleotide
ggagacgtacacgagaggggagaacgggattgaggtga

SEQ ID NO: 93296 - DNA, 37 bp, Artificial Sequence
  Synthetic oligonucleotide
aatgggtggtgagggagtctgggaccatgtagggtga

SEQ ID NO: 93297 - DNA, 36 bp, Artificial Sequence
  Synthetic oligonucleotide
tgcctcgggcggcactctttttggaacactgggtga

SEQ ID NO: 93298 - DNA, 35 bp, Artificial Sequence
  Synthetic oligonucleotide
tccaccccatcactgaactcagggcacctttgtga

SEQ ID NO: 93299 - DNA, 38 bp, Artificial Sequence
  Synthetic oligonucleotide
gtggcccgaacccggtgagatttatgccttgcacttga

SEQ ID NO: 93300 - DNA, 38 bp, Artificial Sequence
  Synthetic oligonucleotide
gccgaagggaatgatggtctcccagtatcccaccttga

SEQ ID NO: 93301 - DNA, 38 bp, Artificial Sequence
  Synthetic oligonucleotide
atgcaagcaagcggttgtactgcttatcccctatttga

SEQ ID NO: 93302 - DNA, 38 bp, Artificial Sequence
  Synthetic oligonucleotide
gtccgtcgctactgctgccccaaacttgccgattttga

SEQ ID NO: 93303 - DNA, 38 bp, Artificial Sequence
  Synthetic oligonucleotide
atctggtcgccctgtgaaacacctaccttgtcttttga

SEQ ID NO: 93304 - DNA, 35 bp, Artificial Sequence
  Synthetic oligonucleotide
atcatgcccccacgttgtcccaaactgttaacata

SEQ ID NO: 93305 - DNA, 35 bp, Artificial Sequence
  Synthetic oligonucleotide
taccacgctgcacacgggaaacttggacaaatgta

SEQ ID NO: 93306 - DNA, 36 bp, Artificial Sequence
  Synthetic oligonucleotide
gtaaccaggagaggggaagttacggacccgaatgta

SEQ ID NO: 93307 - DNA, 35 bp, Artificial Sequence
  Synthetic oligonucleotide
gactacgatcgatccgagaataccaaccacctgta

SEQ ID NO: 93308 - DNA, 36 bp, Artificial Sequence
  Synthetic oligonucleotide
atgccactcacagactgaggtggcagaatagttgta

SEQ ID NO: 93309 - DNA, 37 bp, Artificial Sequence
  Synthetic oligonucleotide
gaccgctctggtgtagggccaccaacctccccactta

SEQ ID NO: 93310 - DNA, 35 bp, Artificial Sequence
  Synthetic oligonucleotide
gacatcagcaatgcgggtcgtaaagaagcgcctta

SEQ ID NO: 93311 - DNA, 38 bp, Artificial Sequence
  Synthetic oligonucleotide
gacaccacgtcgtaaattcgtcagtatcaccgcagtta

SEQ ID NO: 93312 - DNA, 35 bp, Artificial Sequence
  Synthetic oligonucleotide
gcccccgaactgcgccgtgaccacgtaacccttta

SEQ ID NO: 93313 - DNA, 36 bp, Artificial Sequence
  Synthetic oligonucleotide
gccaggacttgtgtggttcatcgttttcatctttta

SEQ ID NO: 93314 - DNA, 35 bp, Artificial Sequence
  Synthetic oligonucleotide
tgtccgcctgacatctattcacgactacatacaac

SEQ ID NO: 93315 - DNA, 35 bp, Artificial Sequence
  Synthetic oligonucleotide
ttcaccgctaaaaagtaccaccgacatgttacaac

SEQ ID NO: 93316 - DNA, 35 bp, Artificial Sequence
  Synthetic oligonucleotide
gtacgccctcacccacactttgtgcccaggcacac

SEQ ID NO: 93317 - DNA, 35 bp, Artificial Sequence
  Synthetic oligonucleotide
gctaagggcaaacaaggtaaatcatgctgtcccac

SEQ ID NO: 93318 - DNA, 35 bp, Artificial Sequence
  Synthetic oligonucleotide
tccgaccccaaaccacagctggcgatcagcccacc

SEQ ID NO: 93319 - DNA, 35 bp, Artificial Sequence
  Synthetic oligonucleotide
tatccaccagggtgtcctagttccctgttaatacc

SEQ ID NO: 93320 - DNA, 35 bp, Artificial Sequence
  Synthetic oligonucleotide
gatgacgtatcgatggttagcgtacgtcgtttccc

SEQ ID NO: 93321 - DNA, 35 bp, Artificial Sequence
  Synthetic oligonucleotide
gggacacccctaacgttgtccgtgacaggaaagcc

SEQ ID NO: 93322 - DNA, 36 bp, Artificial Sequence
  Synthetic oligonucleotide
gcattagtccccgccaggcgaagcattgttctatcc

SEQ ID NO: 93323 - DNA, 35 bp, Artificial Sequence
  Synthetic oligonucleotide
taaacgccgggctgtcacctttggtagctgggtcc

SEQ ID NO: 93324 - DNA, 35 bp, Artificial Sequence
  Synthetic oligonucleotide
gctacgttagccggtgttccgcctttcacacacgc

SEQ ID NO: 93325 - DNA, 34 bp, Artificial Sequence
  Synthetic oligonucleotide
gcaaagggagggtaaaacttggagctgagacggc

SEQ ID NO: 93326 - DNA, 36 bp, Artificial Sequence
  Synthetic oligonucleotide
tgaggagacaaagaggggcttaggttcaggtagggc

SEQ ID NO: 93327 - DNA, 35 bp, Artificial Sequence
  Synthetic oligonucleotide
accgcatgtctgcccagtactgctcccgcgatggc

SEQ ID NO: 93328 - DNA, 35 bp, Artificial Sequence
  Synthetic oligonucleotide
gacactttctctgcgcttagatccttgattcctgc

SEQ ID NO: 93329 - DNA, 35 bp, Artificial Sequence
  Synthetic oligonucleotide
tctgtctgaccccggacttgccttcgcagtaaatc

SEQ ID NO: 93330 - DNA, 35 bp, Artificial Sequence
  Synthetic oligonucleotide
gaagccccgtacccgcccaggccgactattaagtc

SEQ ID NO: 93331 - DNA, 35 bp, Artificial Sequence
  Synthetic oligonucleotide
gcatcctcccgttttgtaatgcttccgaattagtc

SEQ ID NO: 93332 - DNA, 35 bp, Artificial Sequence
  Synthetic oligonucleotide
tgtggcctgcccagcttgccctgttaatatcggtc

SEQ ID NO: 93333 - DNA, 35 bp, Artificial Sequence
  Synthetic oligonucleotide
atgcacccgttcatctatgtcgaacttttgcattc

SEQ ID NO: 93334 - DNA, 35 bp, Artificial Sequence
  Synthetic oligonucleotide
tcacggccctccatccagcagacaagaatatattc

SEQ ID NO: 93335 - DNA, 35 bp, Artificial Sequence
  Synthetic oligonucleotide
gatatccatcgatagggaccggcgacgggaacttc

SEQ ID NO: 93336 - DNA, 35 bp, Artificial Sequence
  Synthetic oligonucleotide
tgcctcgtcaaagttcttcttatgcaacggccttc

SEQ ID NO: 93337 - DNA, 35 bp, Artificial Sequence
  Synthetic oligonucleotide
gacattggtccatgaggtccagtggctacaatttc

SEQ ID NO: 93338 - DNA, 35 bp, Artificial Sequence
  Synthetic oligonucleotide
gccggtaccgcctattcttgtcccctccccatttc

SEQ ID NO: 93339 - DNA, 35 bp, Artificial Sequence
  Synthetic oligonucleotide
tgagacaaaggagaagtagagaatctggtaacaag

SEQ ID NO: 93340 - DNA, 35 bp, Artificial Sequence
  Synthetic oligonucleotide
atcacacactcacacccggctatcgatgctgccag

SEQ ID NO: 93341 - DNA, 35 bp, Artificial Sequence
  Synthetic oligonucleotide
gccatgggcggcttttggattctcctgactttgag

SEQ ID NO: 93342 - DNA, 35 bp, Artificial Sequence
  Synthetic oligonucleotide
tgttcgccccagctctttcccgttccgctcgtacg

SEQ ID NO: 93343 - DNA, 35 bp, Artificial Sequence
  Synthetic oligonucleotide
gtaagcaaggtggaattctgggagatggtggtacg

SEQ ID NO: 93344 - DNA, 35 bp, Artificial Sequence
  Synthetic oligonucleotide
actccaagtgcacgcgctgataagccactcatccg

SEQ ID NO: 93345 - DNA, 35 bp, Artificial Sequence
  Synthetic oligonucleotide
atcgcaacgggtcacggctgttctcttgggcatcg

SEQ ID NO: 93346 - DNA, 35 bp, Artificial Sequence
  Synthetic oligonucleotide
gacgaagcgctgcactcagcatcacactactcggg

SEQ ID NO: 93347 - DNA, 35 bp, Artificial Sequence
  Synthetic oligonucleotide
tatctgcgccgcatgcctccctatccagacctggg

SEQ ID NO: 93348 - DNA, 35 bp, Artificial Sequence
  Synthetic oligonucleotide
aaacacgaggcctgctccataacagcccaacgtgg

SEQ ID NO: 93349 - DNA, 35 bp, Artificial Sequence
  Synthetic oligonucleotide
taaccgcatcctaccccagacatccctcgataatg

SEQ ID NO: 93350 - DNA, 35 bp, Artificial Sequence
  Synthetic oligonucleotide
gtccatgttcaagccgtaccctatctctgttaact

SEQ ID NO: 93351 - DNA, 35 bp, Artificial Sequence
  Synthetic oligonucleotide
tgacgacggctatcaaagcattatactatcttact

SEQ ID NO: 93352 - DNA, 35 bp, Artificial Sequence
  Synthetic oligonucleotide
tccagctcggttcttcgtttagactctttcccgct

SEQ ID NO: 93353 - DNA, 35 bp, Artificial Sequence
  Synthetic oligonucleotide
tcctcgttcccagatctgctccggtccctcacggt

SEQ ID NO: 93354 - DNA, 35 bp, Artificial Sequence
  Synthetic oligonucleotide
ggatgtcggtcgggtcttagctgttctcgctctgt

SEQ ID NO: 93355 - DNA, 35 bp, Artificial Sequence
  Synthetic oligonucleotide
tgagcaacatcgacttaacactctggtccacttgt

SEQ ID NO: 93356 - DNA, 35 bp, Artificial Sequence
  Synthetic oligonucleotide
gcgaaagcatgaccgttcgaatacactgcaccatt

SEQ ID NO: 93357 - DNA, 35 bp, Artificial Sequence
  Synthetic oligonucleotide
ctttcccgccgccctttaattggttaccgccactt

SEQ ID NO: 93358 - DNA, 34 bp, Artificial Sequence
  Synthetic oligonucleotide
tttgcgtcgcgggtcctactatgctcgggtggtt

SEQ ID NO: 93359 - DNA, 36 bp, Artificial Sequence
  Synthetic oligonucleotide
gaggtgccgctaacatgcacttaaaaatcaacgaaa

SEQ ID NO: 93360 - DNA, 36 bp, Artificial Sequence
  Synthetic oligonucleotide
tcctggtccgcatcgataagcagaacaggtgtgaaa

SEQ ID NO: 93361 - DNA, 36 bp, Artificial Sequence
  Synthetic oligonucleotide
ttcagcccccagcttgttatgtgcccgctccaccaa

SEQ ID NO: 93362 - DNA, 35 bp, Artificial Sequence
  Synthetic oligonucleotide
gttcccccacgcctgtcccatttgttgtgccccaa

SEQ ID NO: 93363 - DNA, 36 bp, Artificial Sequence
  Synthetic oligonucleotide
gtgacagttcgaagcggtagcagtcggttcggcgaa

SEQ ID NO: 93364 - DNA, 35 bp, Artificial Sequence
  Synthetic oligonucleotide
gattagacaaggggctagggcgagaacggaatgaa

SEQ ID NO: 93365 - DNA, 35 bp, Artificial Sequence
  Synthetic oligonucleotide
ttccgccaccggtcgctcgtcgttacgcttttgaa

SEQ ID NO: 93366 - DNA, 36 bp, Artificial Sequence
  Synthetic oligonucleotide
tacccacgcctgtctgcgctatgctgcaatcgttaa

SEQ ID NO: 93367 - DNA, 35 bp, Artificial Sequence
  Synthetic oligonucleotide
ggatgaagtggtgtgggggttcggaatcagtttaa

SEQ ID NO: 93368 - DNA, 37 bp, Artificial Sequence
  Synthetic oligonucleotide
tgctgctgatgccaaacgtacgatgctctgttacaca

SEQ ID NO: 93369 - DNA, 36 bp, Artificial Sequence
  Synthetic oligonucleotide
tccgaagccgactgtcactaatatccggtccataca

SEQ ID NO: 93370 - DNA, 36 bp, Artificial Sequence
  Synthetic oligonucleotide
tatgatgtcgagcaacgcgtaaatagccaatcacca

SEQ ID NO: 93371 - DNA, 36 bp, Artificial Sequence
  Synthetic oligonucleotide
gcaccaggaactcactctgccgtcttgacacctgca

SEQ ID NO: 93372 - DNA, 35 bp, Artificial Sequence
  Synthetic oligonucleotide
gtgagccctgcctcacattttatttggaatttgca

SEQ ID NO: 93373 - DNA, 36 bp, Artificial Sequence
  Synthetic oligonucleotide
acgcacctgtccttgacacgcgtttttactaactca

SEQ ID NO: 93374 - DNA, 36 bp, Artificial Sequence
  Synthetic oligonucleotide
gaacgcagatataactcgccccatcccgttcattca

SEQ ID NO: 93375 - DNA, 37 bp, Artificial Sequence
  Synthetic oligonucleotide
gccaagtccaaatccccccccgttgaccagtagaaga

SEQ ID NO: 93376 - DNA, 37 bp, Artificial Sequence
  Synthetic oligonucleotide
aaggagacggtggtacggggcaacgggaaaggcgaga

SEQ ID NO: 93377 - DNA, 37 bp, Artificial Sequence
  Synthetic oligonucleotide
tcacggggggagttggggcttagttcgctaggcgaga

SEQ ID NO: 93378 - DNA, 37 bp, Artificial Sequence
  Synthetic oligonucleotide
tgaactggagcgatcgaaagggcagaagagcttgaga

SEQ ID NO: 93379 - DNA, 37 bp, Artificial Sequence
  Synthetic oligonucleotide
tcagaagcgtgctctgttgtcttgacccacccctaga

SEQ ID NO: 93380 - DNA, 36 bp, Artificial Sequence
  Synthetic oligonucleotide
gtgagagggccagtgacagttacgagctgttgtaga

SEQ ID NO: 93381 - DNA, 36 bp, Artificial Sequence
  Synthetic oligonucleotide
gatacaactccgacggtactccatctccgtgtacga

SEQ ID NO: 93382 - DNA, 37 bp, Artificial Sequence
  Synthetic oligonucleotide
ttgtccagctcacccacgtctatccgggtacttacga

SEQ ID NO: 93383 - DNA, 37 bp, Artificial Sequence
  Synthetic oligonucleotide
tgtcaacagattgtcccccgtgtgctgacccacccga

SEQ ID NO: 93384 - DNA, 37 bp, Artificial Sequence
  Synthetic oligonucleotide
tcaacatgtaggactgatacgcgagttacgtgcccga

SEQ ID NO: 93385 - DNA, 37 bp, Artificial Sequence
  Synthetic oligonucleotide
acacccacctgtttatctagtgtattgtggttcccga

SEQ ID NO: 93386 - DNA, 37 bp, Artificial Sequence
  Synthetic oligonucleotide
aagacggagcctaggagaactagttgaaaagctgcga

SEQ ID NO: 93387 - DNA, 36 bp, Artificial Sequence
  Synthetic oligonucleotide
gccgcggcccgacgttacgcatattggatccctcga

SEQ ID NO: 93388 - DNA, 35 bp, Artificial Sequence
  Synthetic oligonucleotide
tctacccgggcgtcacttcttcggcaatatctcga

SEQ ID NO: 93389 - DNA, 35 bp, Artificial Sequence
  Synthetic oligonucleotide
accattgtgcggcatggttcctatccaatcttcga

SEQ ID NO: 93390 - DNA, 35 bp, Artificial Sequence
  Synthetic oligonucleotide
gagccgacccgcggtgtttcacctgctaatttcga

SEQ ID NO: 93391 - DNA, 37 bp, Artificial Sequence
  Synthetic oligonucleotide
tgcaccgccgccagctcttcccctgaccgtacaagga

SEQ ID NO: 93392 - DNA, 37 bp, Artificial Sequence
  Synthetic oligonucleotide
gtccacactgctattctaatctccgtccgaggccgga

SEQ ID NO: 93393 - DNA, 37 bp, Artificial Sequence
  Synthetic oligonucleotide
gatacaccccttagctctgtccagatcattacgcgga

SEQ ID NO: 93394 - DNA, 35 bp, Artificial Sequence
  Synthetic oligonucleotide
tgctcactcagggcttgtctctccacggtatcgga

SEQ ID NO: 93395 - DNA, 37 bp, Artificial Sequence
  Synthetic oligonucleotide
aaaggagctgcaactggtaggatgtgtcgggggggga

SEQ ID NO: 93396 - DNA, 35 bp, Artificial Sequence
  Synthetic oligonucleotide
atgataggaccaggatggaatagctgaactgggga

SEQ ID NO: 93397 - DNA, 37 bp, Artificial Sequence
  Synthetic oligonucleotide
gcgcactcgccgtcggactgggaatgtgggggtggga

SEQ ID NO: 93398 - DNA, 37 bp, Artificial Sequence
  Synthetic oligonucleotide
gtcacagcaagtggaagtaaagggtgcgcccactgga

SEQ ID NO: 93399 - DNA, 37 bp, Artificial Sequence
  Synthetic oligonucleotide
tcgagacgggagtcgatttgcatgattgctgagtgga

SEQ ID NO: 93400 - DNA, 36 bp, Artificial Sequence
  Synthetic oligonucleotide
gacatcaacacacatacattaaacggaatccttgga

SEQ ID NO: 93401 - DNA, 37 bp, Artificial Sequence
  Synthetic oligonucleotide
ggggaaaggtgggtgcggttggccggggcagtttgga

SEQ ID NO: 93402 - DNA, 37 bp, Artificial Sequence
  Synthetic oligonucleotide
gacagaacgtgcctgctgatttccgagattttttgga

SEQ ID NO: 93403 - DNA, 38 bp, Artificial Sequence
  Synthetic oligonucleotide
gaaagggaggtgtcctgaggatgacgcggacggaatga

SEQ ID NO: 93404 - DNA, 38 bp, Artificial Sequence
  Synthetic oligonucleotide
tgctcacccgccgaccgtgtgcagaacactccacatga

SEQ ID NO: 93405 - DNA, 38 bp, Artificial Sequence
  Synthetic oligonucleotide
gtgcggagcactcagcttttcgggttccaggcccatga

SEQ ID NO: 93406 - DNA, 38 bp, Artificial Sequence
  Synthetic oligonucleotide
accccccgagtacacttggggtatagtacttcccatga

SEQ ID NO: 93407 - DNA, 37 bp, Artificial Sequence
  Synthetic oligonucleotide
gcgctcgccccgttgcgtaccttgctcagtgccctga

SEQ ID NO: 93408 - DNA, 37 bp, Artificial Sequence
  Synthetic oligonucleotide
tccgagcatcgcccttctgtacactgctcctccctga

SEQ ID NO: 93409 - DNA, 38 bp, Artificial Sequence
  Synthetic oligonucleotide
gtgcaccacctcacgggcaatgaggcacattttgctga

SEQ ID NO: 93410 - DNA, 38 bp, Artificial Sequence
  Synthetic oligonucleotide
gaagcggtcgccgggatgaaactaacacctttgtctga

SEQ ID NO: 93411 - DNA, 38 bp, Artificial Sequence
  Synthetic oligonucleotide
acaccaccatggccagaaacgtagaccgtagtacgtga

SEQ ID NO: 93412 - DNA, 38 bp, Artificial Sequence
  Synthetic oligonucleotide
aacgcacggagtactcatgtgcggaagtgaataggtga

SEQ ID NO: 93413 - DNA, 38 bp, Artificial Sequence
  Synthetic oligonucleotide
gggtaggaggcgcggggcaaatagacatgggtgggtga

SEQ ID NO: 93414 - DNA, 37 bp, Artificial Sequence
  Synthetic oligonucleotide
agaccgtatcaccgcactcttcgtaaacacttggtga

SEQ ID NO: 93415 - DNA, 38 bp, Artificial Sequence
  Synthetic oligonucleotide
gagtgacgacagcatttgaatttagttttgccctgtga

SEQ ID NO: 93416 - DNA, 35 bp, Artificial Sequence
  Synthetic oligonucleotide
tgcctcgccccttattcttgcggtttgcaaattga

SEQ ID NO: 93417 - DNA, 38 bp, Artificial Sequence
  Synthetic oligonucleotide
gacctgacggcgtggtgatgaataggggctggaattga

SEQ ID NO: 93418 - DNA, 37 bp, Artificial Sequence
  Synthetic oligonucleotide
tccgttgcgggtggtatgtgggtttcgggtagattga

SEQ ID NO: 93419 - DNA, 37 bp, Artificial Sequence
  Synthetic oligonucleotide
aacgcgacaggggaggccaagggaacccggaagttga

SEQ ID NO: 93420 - DNA, 38 bp, Artificial Sequence
  Synthetic oligonucleotide
actccatcctcagttccgcacgagctttacgcatttga

SEQ ID NO: 93421 - DNA, 38 bp, Artificial Sequence
  Synthetic oligonucleotide
gtgctcctgccctgtgatctacacgtcgctgattttga

SEQ ID NO: 93422 - DNA, 36 bp, Artificial Sequence
  Synthetic oligonucleotide
tacgcatcagcccgggaatgagctgagctctcaata

SEQ ID NO: 93423 - DNA, 36 bp, Artificial Sequence
  Synthetic oligonucleotide
tcgctcacctcgccatgtggtttcgatacccacata

SEQ ID NO: 93424 - DNA, 35 bp, Artificial Sequence
  Synthetic oligonucleotide
tcctgcatccgctctaccgcgcgatcacttgacta

SEQ ID NO: 93425 - DNA, 37 bp, Artificial Sequence
  Synthetic oligonucleotide
gaccaccgatccgcactgttgcactttcttgacccta

SEQ ID NO: 93426 - DNA, 35 bp, Artificial Sequence
  Synthetic oligonucleotide
tgactgggacgagattaaggcatggtgggggcgta

SEQ ID NO: 93427 - DNA, 35 bp, Artificial Sequence
  Synthetic oligonucleotide
tacccaatcggcctccttgtaccttaataatcgta

SEQ ID NO: 93428 - DNA, 36 bp, Artificial Sequence
  Synthetic oligonucleotide
gacccgtcacttctcaagccattatggtccatcgta

SEQ ID NO: 93429 - DNA, 36 bp, Artificial Sequence
  Synthetic oligonucleotide
gatctccacagatgcctcccctatgcttgccaggta

SEQ ID NO: 93430 - DNA, 36 bp, Artificial Sequence
  Synthetic oligonucleotide
gtcgccgggccccagtcggtctattttcatcgggta

SEQ ID NO: 93431 - DNA, 36 bp, Artificial Sequence
  Synthetic oligonucleotide
tcccacatgctccccgcaaggtctaacgagtatgta

SEQ ID NO: 93432 - DNA, 36 bp, Artificial Sequence
  Synthetic oligonucleotide
ttacgcaacgtgttcagttgaacttccattccctta

SEQ ID NO: 93433 - DNA, 36 bp, Artificial Sequence
  Synthetic oligonucleotide
tacagtcgggccaatctgattctctatctgtcgtta

SEQ ID NO: 93434 - DNA, 34 bp, Artificial Sequence
  Synthetic oligonucleotide
tcttgcaccccgtctccctctgcctatggccacc

SEQ ID NO: 93435 - DNA, 35 bp, Artificial Sequence
  Synthetic oligonucleotide
tgacccagacagcacccataaacttcctgcgtgcc

SEQ ID NO: 93436 - DNA, 35 bp, Artificial Sequence
  Synthetic oligonucleotide
gtgtgcccctccccagtgtgacccgttttccgtcc

SEQ ID NO: 93437 - DNA, 35 bp, Artificial Sequence
  Synthetic oligonucleotide
taacgacccgtacctgctgtacatggcgatggtcc

SEQ ID NO: 93438 - DNA, 35 bp, Artificial Sequence
  Synthetic oligonucleotide
acgctgcgaacaagttaggtcgcagtcaaaccatc

SEQ ID NO: 93439 - DNA, 35 bp, Artificial Sequence
  Synthetic oligonucleotide
acccactccgctctactcttcagtccaggcgcatc

SEQ ID NO: 93440 - DNA, 35 bp, Artificial Sequence
  Synthetic oligonucleotide
tactgcgggaccacattgcaatggctcaaggcctc

SEQ ID NO: 93441 - DNA, 35 bp, Artificial Sequence
  Synthetic oligonucleotide
tcgccctcttccggatcgttgggctacagttcctc

SEQ ID NO: 93442 - DNA, 35 bp, Artificial Sequence
  Synthetic oligonucleotide
ttgccgacccaaggagtcccttctcatgagaattc

SEQ ID NO: 93443 - DNA, 35 bp, Artificial Sequence
  Synthetic oligonucleotide
gagccctcaaacgctgggtatgatttctgcccttc

SEQ ID NO: 93444 - DNA, 35 bp, Artificial Sequence
  Synthetic oligonucleotide
actgccgttcgacgtcgaacccacacctactcttc

SEQ ID NO: 93445 - DNA, 35 bp, Artificial Sequence
  Synthetic oligonucleotide
gcccccatggtcgtttccatcacggtacgttgttc

SEQ ID NO: 93446 - DNA, 35 bp, Artificial Sequence
  Synthetic oligonucleotide
gcaggttgtgtggtacttgtttgcccgcctatttc

SEQ ID NO: 93447 - DNA, 35 bp, Artificial Sequence
  Synthetic oligonucleotide
tcgtacccgaatcggaattcatagcggtgcctttc

SEQ ID NO: 93448 - DNA, 35 bp, Artificial Sequence
  Synthetic oligonucleotide
gccgccccgtcctttgtaccacgccctgcggccag

SEQ ID NO: 93449 - DNA, 35 bp, Artificial Sequence
  Synthetic oligonucleotide
atgagagggggagtacggaaataccgcaacgagag

SEQ ID NO: 93450 - DNA, 35 bp, Artificial Sequence
  Synthetic oligonucleotide
tcatcgtgtgaagcggggaatgggtcggatacagg

SEQ ID NO: 93451 - DNA, 35 bp, Artificial Sequence
  Synthetic oligonucleotide
gtggaagtggaggtgtcaggggaagggtgaatagg

SEQ ID NO: 93452 - DNA, 35 bp, Artificial Sequence
  Synthetic oligonucleotide
ggacgtgggacgaggaaaatcagcggaggtgcggg

SEQ ID NO: 93453 - DNA, 30 bp, Artificial Sequence
  Synthetic oligonucleotide
accccgcgccccgggagtcatttttcatgg

SEQ ID NO: 93454 - DNA, 35 bp, Artificial Sequence
  Synthetic oligonucleotide
tgcgtaccagtttctccctagcgtcccatgactgg

SEQ ID NO: 93455 - DNA, 35 bp, Artificial Sequence
  Synthetic oligonucleotide
tgtcggtcaactagtgacgtggtgggagggattgg

SEQ ID NO: 93456 - DNA, 35 bp, Artificial Sequence
  Synthetic oligonucleotide
agtggtggagtcatacaggggcctatgaaaagatg

SEQ ID NO: 93457 - DNA, 35 bp, Artificial Sequence
  Synthetic oligonucleotide
tacacaactgggtcgatgggcaggggggggaactg

SEQ ID NO: 93458 - DNA, 35 bp, Artificial Sequence
  Synthetic oligonucleotide
tcgatgccacacaataatctcagaacgcgcgactg

SEQ ID NO: 93459 - DNA, 35 bp, Artificial Sequence
  Synthetic oligonucleotide
tcccagcccacacctcaccccaacatacagtactg

SEQ ID NO: 93460 - DNA, 35 bp, Artificial Sequence
  Synthetic oligonucleotide
taccacatcgtcgtgtatctccttatcctttcgtg

SEQ ID NO: 93461 - DNA, 35 bp, Artificial Sequence
  Synthetic oligonucleotide
taccccgtacctcgccgccttgacttttcactttg

SEQ ID NO: 93462 - DNA, 35 bp, Artificial Sequence
  Synthetic oligonucleotide
gcacgtatgccaggtccccctcaaccccgtttaat

SEQ ID NO: 93463 - DNA, 35 bp, Artificial Sequence
  Synthetic oligonucleotide
gaggggtacgtgcggggtggtgttacaatgatcat

SEQ ID NO: 93464 - DNA, 35 bp, Artificial Sequence
  Synthetic oligonucleotide
gactcgtccgcactgtgatggctacgtggttatat

SEQ ID NO: 93465 - DNA, 35 bp, Artificial Sequence
  Synthetic oligonucleotide
accatacatgccgatagtgccggttatttctctat

SEQ ID NO: 93466 - DNA, 35 bp, Artificial Sequence
  Synthetic oligonucleotide
gaccacagctccgcctgggactgtacatgttctat

SEQ ID NO: 93467 - DNA, 35 bp, Artificial Sequence
  Synthetic oligonucleotide
ccacgccaccaacctcgagcaccaccggtcgtgct

SEQ ID NO: 93468 - DNA, 35 bp, Artificial Sequence
  Synthetic oligonucleotide
gtcaggggcaggggaagacggtgatgcatgttagt

SEQ ID NO: 93469 - DNA, 35 bp, Artificial Sequence
  Synthetic oligonucleotide
gaacgcaggccagtctgtcaagccttaactggggt

SEQ ID NO: 93470 - DNA, 35 bp, Artificial Sequence
  Synthetic oligonucleotide
cactttcgtagagcgcttataagttaattgaagtt

SEQ ID NO: 93471 - DNA, 35 bp, Artificial Sequence
  Synthetic oligonucleotide
tccgacgctgccgggatctgcccctcacacgcttt

SEQ ID NO: 93472 - DNA, 35 bp, Artificial Sequence
  Synthetic oligonucleotide
gtgaggatagggggagatgtatgtgttgacgcttt

SEQ ID NO: 93473 - DNA, 36 bp, Artificial Sequence
  Synthetic oligonucleotide
ttgtacaaatggtagagccatggacagtgttaacaa

SEQ ID NO: 93474 - DNA, 36 bp, Artificial Sequence
  Synthetic oligonucleotide
atcggaacgcactcaggttgcaataccgccatccaa

SEQ ID NO: 93475 - DNA, 36 bp, Artificial Sequence
  Synthetic oligonucleotide
ggaggggcggaaggtacctgtcagcaaaggaaggaa

SEQ ID NO: 93476 - DNA, 36 bp, Artificial Sequence
  Synthetic oligonucleotide
ggtgaaaaccgtggagcaggtgatggagcaacggaa

SEQ ID NO: 93477 - DNA, 35 bp, Artificial Sequence
  Synthetic oligonucleotide
ataccgccccaaacatgggtagtcactgcaactaa

SEQ ID NO: 93478 - DNA, 35 bp, Artificial Sequence
  Synthetic oligonucleotide
acatgacgccctgacccatagtctatgaaacctaa

SEQ ID NO: 93479 - DNA, 36 bp, Artificial Sequence
  Synthetic oligonucleotide
taatccccgaccgacgtcataggccggaacgcctaa

SEQ ID NO: 93480 - DNA, 36 bp, Artificial Sequence
  Synthetic oligonucleotide
agatcaacagccgagcctctgcttacatactcgtaa

SEQ ID NO: 93481 - DNA, 36 bp, Artificial Sequence
  Synthetic oligonucleotide
atgctgctgccaacacatctgtctttaatgtggaca

SEQ ID NO: 93482 - DNA, 36 bp, Artificial Sequence
  Synthetic oligonucleotide
gcgggggtggggtggctcaaagggggggcgctgaca

SEQ ID NO: 93483 - DNA, 36 bp, Artificial Sequence
  Synthetic oligonucleotide
agtccgtgacgtgctgttcgtctgtccttatttaca

SEQ ID NO: 93484 - DNA, 36 bp, Artificial Sequence
  Synthetic oligonucleotide
gtcaggacccaatacacacgtgacgtctgaatacca

SEQ ID NO: 93485 - DNA, 36 bp, Artificial Sequence
  Synthetic oligonucleotide
tagttccagccgctatattcatcattgcacactcca

SEQ ID NO: 93486 - DNA, 36 bp, Artificial Sequence
  Synthetic oligonucleotide
gcgcatctccgcttctgcattcgacaatcattcgca

SEQ ID NO: 93487 - DNA, 35 bp, Artificial Sequence
  Synthetic oligonucleotide
gagacagggcagttaagactcatgaggatagggca

SEQ ID NO: 93488 - DNA, 36 bp, Artificial Sequence
  Synthetic oligonucleotide
aaatgaacgacgaaaggcggatagatcagtcgatca

SEQ ID NO: 93489 - DNA, 36 bp, Artificial Sequence
  Synthetic oligonucleotide
tgcattgcgcacctgtcaccgactttgctgtactca

SEQ ID NO: 93490 - DNA, 37 bp, Artificial Sequence
  Synthetic oligonucleotide
tacatatccacacacgtaactgacaaggtctgaaaga

SEQ ID NO: 93491 - DNA, 36 bp, Artificial Sequence
  Synthetic oligonucleotide
agtgcttggcacggaaaaaggggggtcgaatgaaga

SEQ ID NO: 93492 - DNA, 37 bp, Artificial Sequence
  Synthetic oligonucleotide
gatcccaggtcgcccggtataccaccacacccagaga

SEQ ID NO: 93493 - DNA, 37 bp, Artificial Sequence
  Synthetic oligonucleotide
gacacctgctttttatgtttccttctgccagtagaga

SEQ ID NO: 93494 - DNA, 37 bp, Artificial Sequence
  Synthetic oligonucleotide
gttcatgccatgcctgtcgataagccctacccataga

SEQ ID NO: 93495 - DNA, 37 bp, Artificial Sequence
  Synthetic oligonucleotide
agcagaaaggaggagggtccgatgggggttttctaga

SEQ ID NO: 93496 - DNA, 37 bp, Artificial Sequence
  Synthetic oligonucleotide
gatcgaagcgggcaagcagcaacaagcgacggttaga

SEQ ID NO: 93497 - DNA, 37 bp, Artificial Sequence
  Synthetic oligonucleotide
actgcctccgttaggtattgttccttccatggcacga

SEQ ID NO: 93498 - DNA, 35 bp, Artificial Sequence
  Synthetic oligonucleotide
tataccgccggaggaatgctctggcgcaaggacga

SEQ ID NO: 93499 - DNA, 37 bp, Artificial Sequence
  Synthetic oligonucleotide
tctggagagcgataagttgactttggaggatcgtcga

SEQ ID NO: 93500 - DNA, 37 bp, Artificial Sequence
  Synthetic oligonucleotide
tcatgcggagacaggatgcgaataaaagcagattcga

SEQ ID NO: 93501 - DNA, 37 bp, Artificial Sequence
  Synthetic oligonucleotide
gacacgagggctgtgacagttaaaggggggagaagga

SEQ ID NO: 93502 - DNA, 36 bp, Artificial Sequence
  Synthetic oligonucleotide
gacacgcactagtgtacgtacacgccattaagagga

SEQ ID NO: 93503 - DNA, 37 bp, Artificial Sequence
  Synthetic oligonucleotide
gttgtgtgatgtaggaagaagaaggaggggcggagga

SEQ ID NO: 93504 - DNA, 37 bp, Artificial Sequence
  Synthetic oligonucleotide
gcaacctggagtggggggggcgtgacaagcgggagga

SEQ ID NO: 93505 - DNA, 37 bp, Artificial Sequence
  Synthetic oligonucleotide
acatgggtggcgctgatggattgagggggacgacgga

SEQ ID NO: 93506 - DNA, 37 bp, Artificial Sequence
  Synthetic oligonucleotide
gtggtagggggtggtctaaaagggttactacgaggga

SEQ ID NO: 93507 - DNA, 37 bp, Artificial Sequence
  Synthetic oligonucleotide
acaagggctgcagggtgtcgtatcgacgaggggggga

SEQ ID NO: 93508 - DNA, 35 bp, Artificial Sequence
  Synthetic oligonucleotide
ggaggtgtagagaggagtgggagagtagggatgga

SEQ ID NO: 93509 - DNA, 37 bp, Artificial Sequence
  Synthetic oligonucleotide
acatctcattgggccatcgcacggcacatgtcctgga

SEQ ID NO: 93510 - DNA, 37 bp, Artificial Sequence
  Synthetic oligonucleotide
tacgactgcaggaagaattttttggcggtgagctgga

SEQ ID NO: 93511 - DNA, 37 bp, Artificial Sequence
  Synthetic oligonucleotide
gtcctccgccacacccacagcctccaatctcagtgga

SEQ ID NO: 93512 - DNA, 36 bp, Artificial Sequence
  Synthetic oligonucleotide
ttccaacgcacgagggccaagggtattcaaattgga

SEQ ID NO: 93513 - DNA, 38 bp, Artificial Sequence
  Synthetic oligonucleotide
gcacgaggggaagtaggcgtgtggcactaagaaaatga

SEQ ID NO: 93514 - DNA, 36 bp, Artificial Sequence
  Synthetic oligonucleotide
atgcccctccattgttttacctatgacggtccatga

SEQ ID NO: 93515 - DNA, 38 bp, Artificial Sequence
  Synthetic oligonucleotide
atgcaaatagcagggaagagaggctctaggggggatga

SEQ ID NO: 93516 - DNA, 38 bp, Artificial Sequence
  Synthetic oligonucleotide
agacaagggcggccggacggacatagggcgcatgatga

SEQ ID NO: 93517 - DNA, 37 bp, Artificial Sequence
  Synthetic oligonucleotide
gtgcatcagccgcctctactcgcctgactcagtatga

SEQ ID NO: 93518 - DNA, 38 bp, Artificial Sequence
  Synthetic oligonucleotide
gccgtaacatccactgcgttaaaacccgggttttatga

SEQ ID NO: 93519 - DNA, 37 bp, Artificial Sequence
  Synthetic oligonucleotide
gcacccagcatgtctcgcctgaattgtgcccaactga

SEQ ID NO: 93520 - DNA, 38 bp, Artificial Sequence
  Synthetic oligonucleotide
tcccaacaccatctcgaagacgcacaggggccacctga

SEQ ID NO: 93521 - DNA, 37 bp, Artificial Sequence
  Synthetic oligonucleotide
aggacccccgcagtacgtcaaattgaccctgccctga

SEQ ID NO: 93522 - DNA, 37 bp, Artificial Sequence
  Synthetic oligonucleotide
tctgccccagacgcggggtagcgcactcttttgctga

SEQ ID NO: 93523 - DNA, 38 bp, Artificial Sequence
  Synthetic oligonucleotide
atgaaggtaagggagggggggacgagacaaccttctga

SEQ ID NO: 93524 - DNA, 38 bp, Artificial Sequence
  Synthetic oligonucleotide
ttgacgcgcatgtgggtgaggcgggaacagtagagtga

SEQ ID NO: 93525 - DNA, 38 bp, Artificial Sequence
  Synthetic oligonucleotide
gtgggcgtgggcaagggaaatcagcgagttgctagtga

SEQ ID NO: 93526 - DNA, 37 bp, Artificial Sequence
  Synthetic oligonucleotide
gtccacgcacacggtgaaaggcactgggagtacgtga

SEQ ID NO: 93527 - DNA, 38 bp, Artificial Sequence
  Synthetic oligonucleotide
gccgttccgttacttatttcgccccacaccttcggtga

SEQ ID NO: 93528 - DNA, 37 bp, Artificial Sequence
  Synthetic oligonucleotide
gatgtggaagcgcaatggtgaagggcataaagggtga

SEQ ID NO: 93529 - DNA, 38 bp, Artificial Sequence
  Synthetic oligonucleotide
tcatgaaggagggcgaggagactgactcaatcatgtga

SEQ ID NO: 93530 - DNA, 38 bp, Artificial Sequence
  Synthetic oligonucleotide
gctgaaggtcagagtaatagggaggctttgggctgtga

SEQ ID NO: 93531 - DNA, 36 bp, Artificial Sequence
  Synthetic oligonucleotide
ttcattccccacccgcagtcaacggctcacttgtga

SEQ ID NO: 93532 - DNA, 38 bp, Artificial Sequence
  Synthetic oligonucleotide
tcacgctggacggggcgtacttggataggtttttgtga

SEQ ID NO: 93533 - DNA, 38 bp, Artificial Sequence
  Synthetic oligonucleotide
gagacacagcgagtggtgcgagatcgggaggtaattga

SEQ ID NO: 93534 - DNA, 38 bp, Artificial Sequence
  Synthetic oligonucleotide
gaatgtcgaagcggggaaagcaagttaggcaacattga

SEQ ID NO: 93535 - DNA, 36 bp, Artificial Sequence
  Synthetic oligonucleotide
tgagagccgcctaaggcctattttcatcccccttga

SEQ ID NO: 93536 - DNA, 37 bp, Artificial Sequence
  Synthetic oligonucleotide
aatgcccccgctggttgggttcagctctcatccttga

SEQ ID NO: 93537 - DNA, 36 bp, Artificial Sequence
  Synthetic oligonucleotide
aacccatctggctactgcttatacagcatatcttga

SEQ ID NO: 93538 - DNA, 38 bp, Artificial Sequence
  Synthetic oligonucleotide
acgacgccatccatggttttgcgcctatgaactcttga

SEQ ID NO: 93539 - DNA, 38 bp, Artificial Sequence
  Synthetic oligonucleotide
tcagcgcacacattacatagccttatcctttcagttga

SEQ ID NO: 93540 - DNA, 37 bp, Artificial Sequence
  Synthetic oligonucleotide
gtcaactcggagcgttgggcccagtgcttccctttga

SEQ ID NO: 93541 - DNA, 36 bp, Artificial Sequence
  Synthetic oligonucleotide
atacacacccggatggaaggttgattccgtgggata

SEQ ID NO: 93542 - DNA, 34 bp, Artificial Sequence
  Synthetic oligonucleotide
gttgccgtacgtcctcccgggggttcgaattata

SEQ ID NO: 93543 - DNA, 36 bp, Artificial Sequence
  Synthetic oligonucleotide
atactgccctctgcctctacacaggtttccattata

SEQ ID NO: 93544 - DNA, 36 bp, Artificial Sequence
  Synthetic oligonucleotide
acgccccacggtcaaatgagctacccgatttgcgta

SEQ ID NO: 93545 - DNA, 36 bp, Artificial Sequence
  Synthetic oligonucleotide
gttcacacgtacaaagagttgcgaaaggggacggta

SEQ ID NO: 93546 - DNA, 34 bp, Artificial Sequence
  Synthetic oligonucleotide
aaggaccggtgacgccgaaaatgggtggttggta

SEQ ID NO: 93547 - DNA, 36 bp, Artificial Sequence
  Synthetic oligonucleotide
gccgagggttcggggagtatcggtgttacaggtgta

SEQ ID NO: 93548 - DNA, 36 bp, Artificial Sequence
  Synthetic oligonucleotide
atacacccggtggtgtgttgttcgcgccttacatta

SEQ ID NO: 93549 - DNA, 35 bp, Artificial Sequence
  Synthetic oligonucleotide
aactggtcacagccggttctagttctttgctctta

SEQ ID NO: 93550 - DNA, 36 bp, Artificial Sequence
  Synthetic oligonucleotide
atagggcaacgtaagtgtgtcgccccgtccctgtta

SEQ ID NO: 93551 - DNA, 35 bp, Artificial Sequence
  Synthetic oligonucleotide
agtgggggggggtgtggatgcctgtatgggtcaac

SEQ ID NO: 93552 - DNA, 35 bp, Artificial Sequence
  Synthetic oligonucleotide
tacccacgcaccgccgccccatgagctacactaac

SEQ ID NO: 93553 - DNA, 35 bp, Artificial Sequence
  Synthetic oligonucleotide
aacacaccatgataatggccaacagtagttgccac

SEQ ID NO: 93554 - DNA, 35 bp, Artificial Sequence
  Synthetic oligonucleotide
acacaaccgattgactgaccgagtgcaagccatac

SEQ ID NO: 93555 - DNA, 35 bp, Artificial Sequence
  Synthetic oligonucleotide
tcctcccggacactggctcaatccatacagtatac

SEQ ID NO: 93556 - DNA, 35 bp, Artificial Sequence
  Synthetic oligonucleotide
tcgcactcctcaatcacgcataattctggaccacc

SEQ ID NO: 93557 - DNA, 35 bp, Artificial Sequence
  Synthetic oligonucleotide
gccgtacgatgtccctcctttatcgctgatccacc

SEQ ID NO: 93558 - DNA, 35 bp, Artificial Sequence
  Synthetic oligonucleotide
tctgactagtgccgaccgtgccatgacattatacc

SEQ ID NO: 93559 - DNA, 35 bp, Artificial Sequence
  Synthetic oligonucleotide
ttagtcgaccattattactgtctcgggacctgccc

SEQ ID NO: 93560 - DNA, 35 bp, Artificial Sequence
  Synthetic oligonucleotide
ttacgcgccacgactgcaaattgccgccttcatcc

SEQ ID NO: 93561 - DNA, 35 bp, Artificial Sequence
  Synthetic oligonucleotide
atgcaggggcacagtctgcgcaagcgatccgctcc

SEQ ID NO: 93562 - DNA, 35 bp, Artificial Sequence
  Synthetic oligonucleotide
tcagatacccaatgatggcatttgaatctgtctcc

SEQ ID NO: 93563 - DNA, 35 bp, Artificial Sequence
  Synthetic oligonucleotide
gccacatcctccactccggcctccccgagccgtcc

SEQ ID NO: 93564 - DNA, 35 bp, Artificial Sequence
  Synthetic oligonucleotide
gaggaacagttgcagactattaccttccgtgttcc

SEQ ID NO: 93565 - DNA, 35 bp, Artificial Sequence
  Synthetic oligonucleotide
gcccacctgccaatggcccgaacctgcgactttcc

SEQ ID NO: 93566 - DNA, 35 bp, Artificial Sequence
  Synthetic oligonucleotide
gccaaaagccagacgacgtactgtcggagacccgc

SEQ ID NO: 93567 - DNA, 35 bp, Artificial Sequence
  Synthetic oligonucleotide
tacattgtaccatctggctcgcatcaatcactcgc

SEQ ID NO: 93568 - DNA, 35 bp, Artificial Sequence
  Synthetic oligonucleotide
gtctgacacgcacatggtagccggtccatcttcgc

SEQ ID NO: 93569 - DNA, 35 bp, Artificial Sequence
  Synthetic oligonucleotide
tcgctgggtagatcagatttctgtcacctcttcgc

SEQ ID NO: 93570 - DNA, 35 bp, Artificial Sequence
  Synthetic oligonucleotide
tgtacacgctcaaaccgcaacgctctgactccggc

SEQ ID NO: 93571 - DNA, 35 bp, Artificial Sequence
  Synthetic oligonucleotide
gcgacggggggccattgcgtatgatgaagtccggc

SEQ ID NO: 93572 - DNA, 35 bp, Artificial Sequence
  Synthetic oligonucleotide
tccagcgttgcgtgctgtcttttcacaattgttgc

SEQ ID NO: 93573 - DNA, 35 bp, Artificial Sequence
  Synthetic oligonucleotide
ccacgcccgccttttagtaccgaccacctcgtgtc

SEQ ID NO: 93574 - DNA, 35 bp, Artificial Sequence
  Synthetic oligonucleotide
gtgggcttcttcctcatgcgtggtaacaacttgtc

SEQ ID NO: 93575 - DNA, 35 bp, Artificial Sequence
  Synthetic oligonucleotide
tgagggcaaggggcgggcatgtaggtgtactccag

SEQ ID NO: 93576 - DNA, 35 bp, Artificial Sequence
  Synthetic oligonucleotide
tccctgggcggggctgggtggtgagggatttagag

SEQ ID NO: 93577 - DNA, 35 bp, Artificial Sequence
  Synthetic oligonucleotide
agaacatgcaaaggagctggggttgatccgtggag

SEQ ID NO: 93578 - DNA, 35 bp, Artificial Sequence
  Synthetic oligonucleotide
gatcaaccaccatgcctcgtgtatagaccagttag

SEQ ID NO: 93579 - DNA, 35 bp, Artificial Sequence
  Synthetic oligonucleotide
tacaccgccgcttcggacgcacgactgtcaagccg

SEQ ID NO: 93580 - DNA, 35 bp, Artificial Sequence
  Synthetic oligonucleotide
gagagcagtaggcggagtcatttaagtgggaatgg

SEQ ID NO: 93581 - DNA, 35 bp, Artificial Sequence
  Synthetic oligonucleotide
atgacagggatgcatacgatttgacgtgggattgg

SEQ ID NO: 93582 - DNA, 35 bp, Artificial Sequence
  Synthetic oligonucleotide
tacgtcagtgttgcggtcctgattcacccgtgctg

SEQ ID NO: 93583 - DNA, 34 bp, Artificial Sequence
  Synthetic oligonucleotide
tcttgaccaccctctagcgtatgtacggctaaat

SEQ ID NO: 93584 - DNA, 35 bp, Artificial Sequence
  Synthetic oligonucleotide
tagtccctcccccgtttgccaactgaccacgttat

SEQ ID NO: 93585 - DNA, 35 bp, Artificial Sequence
  Synthetic oligonucleotide
gtagtgggggtgtccgttggtgttgtctgggttct

SEQ ID NO: 93586 - DNA, 35 bp, Artificial Sequence
  Synthetic oligonucleotide
acgtgaagggtcagtggaatggtgggatttgaagt

SEQ ID NO: 93587 - DNA, 35 bp, Artificial Sequence
  Synthetic oligonucleotide
agaaagtagtagtaacggagaggaagttgagcggt

SEQ ID NO: 93588 - DNA, 35 bp, Artificial Sequence
  Synthetic oligonucleotide
agtgaagcaaagtaggagccgagtttggaggtggt

SEQ ID NO: 93589 - DNA, 35 bp, Artificial Sequence
  Synthetic oligonucleotide
gcaaattgcaaccgtccctgtccatcgtggacatt

SEQ ID NO: 93590 - DNA, 35 bp, Artificial Sequence
  Synthetic oligonucleotide
acacgggaccgttatggtcagcaaaccgtttgctt

SEQ ID NO: 93591 - DNA, 35 bp, Artificial Sequence
  Synthetic oligonucleotide
tcacacaaacacactcggtgaagaatagaattgtt

SEQ ID NO: 93592 - DNA, 35 bp, Artificial Sequence
  Synthetic oligonucleotide
agtcctgaccctctagctgtatgatcgcttttgtt

SEQ ID NO: 93593 - DNA, 36 bp, Artificial Sequence
  Synthetic oligonucleotide
atacccagtccatcccccggtgttgtcacgactaaa

SEQ ID NO: 93594 - DNA, 36 bp, Artificial Sequence
  Synthetic oligonucleotide
atgccccaccacaccgtctcattgtcggccattaaa

SEQ ID NO: 93595 - DNA, 36 bp, Artificial Sequence
  Synthetic oligonucleotide
gactccatgggccgtgatctaggggaagagtggcaa

SEQ ID NO: 93596 - DNA, 35 bp, Artificial Sequence
  Synthetic oligonucleotide
gaagagtaggccgggcaatgagcagatctgctgaa

SEQ ID NO: 93597 - DNA, 36 bp, Artificial Sequence
  Synthetic oligonucleotide
atgtcacccctccgcatcgcgcccgtatagcgataa

SEQ ID NO: 93598 - DNA, 36 bp, Artificial Sequence
  Synthetic oligonucleotide
aatggccacccgtgccagcaattctatatggcctaa

SEQ ID NO: 93599 - DNA, 35 bp, Artificial Sequence
  Synthetic oligonucleotide
tcacaccacgcatacctgtacgcccctagtgctaa

SEQ ID NO: 93600 - DNA, 36 bp, Artificial Sequence
  Synthetic oligonucleotide
gaccactgacttattttcctactagactagcgcaca

SEQ ID NO: 93601 - DNA, 36 bp, Artificial Sequence
  Synthetic oligonucleotide
atgccgccctttcctaagtgcccttgatggttcaca

SEQ ID NO: 93602 - DNA, 36 bp, Artificial Sequence
  Synthetic oligonucleotide
acccctccaccacatgcgcgtgtgacccggtgacca

SEQ ID NO: 93603 - DNA, 35 bp, Artificial Sequence
  Synthetic oligonucleotide
aatggggtaggacgggatggcaggggttactacca

SEQ ID NO: 93604 - DNA, 36 bp, Artificial Sequence
  Synthetic oligonucleotide
gatgggggctcaagttatattgccatctctatccca

SEQ ID NO: 93605 - DNA, 36 bp, Artificial Sequence
  Synthetic oligonucleotide
accgccctacccacctgtgtcttgccacgtactgca

SEQ ID NO: 93606 - DNA, 36 bp, Artificial Sequence
  Synthetic oligonucleotide
acccgacttcagtcatcccatgccaggtcaccatca

SEQ ID NO: 93607 - DNA, 37 bp, Artificial Sequence
  Synthetic oligonucleotide
tagaccatccaagcaacagcggaccccaaattggtca

SEQ ID NO: 93608 - DNA, 36 bp, Artificial Sequence
  Synthetic oligonucleotide
gtcaacagtgcaaattgttagactcataaaatgtca

SEQ ID NO: 93609 - DNA, 36 bp, Artificial Sequence
  Synthetic oligonucleotide
atgccgacgccgggggtagatacatcagagttgtca

SEQ ID NO: 93610 - DNA, 37 bp, Artificial Sequence
  Synthetic oligonucleotide
gagggggaataaaggtcgcaggaaggatagctaaaga

SEQ ID NO: 93611 - DNA, 37 bp, Artificial Sequence
  Synthetic oligonucleotide
aacagtcgcaccctgttaagttggttacaggactaga

SEQ ID NO: 93612 - DNA, 37 bp, Artificial Sequence
  Synthetic oligonucleotide
atggtggtagggataaacaatggggaggacaggtaga

SEQ ID NO: 93613 - DNA, 36 bp, Artificial Sequence
  Synthetic oligonucleotide
gaacacacgaacacagggctcactctcaactttaga

SEQ ID NO: 93614 - DNA, 37 bp, Artificial Sequence
  Synthetic oligonucleotide
gaccctgcgcaaagtgtccactctctcgaaacaacga

SEQ ID NO: 93615 - DNA, 37 bp, Artificial Sequence
  Synthetic oligonucleotide
tggttggagaggagggttttggaggggaggtgaacga

SEQ ID NO: 93616 - DNA, 37 bp, Artificial Sequence
  Synthetic oligonucleotide
gtagagcatcgatctccacttaagctaacgcccacga

SEQ ID NO: 93617 - DNA, 37 bp, Artificial Sequence
  Synthetic oligonucleotide
tatgaccatgccgaccagctactcggagaaccgacga

SEQ ID NO: 93618 - DNA, 37 bp, Artificial Sequence
  Synthetic oligonucleotide
aagccatggagcggggggacagaggcggtgcggacga

SEQ ID NO: 93619 - DNA, 37 bp, Artificial Sequence
  Synthetic oligonucleotide
gatccagccgtaggatactccactcttgttgttgcga

SEQ ID NO: 93620 - DNA, 37 bp, Artificial Sequence
  Synthetic oligonucleotide
gacgaagtacgaaggtagtatattacggctcaatcga

SEQ ID NO: 93621 - DNA, 37 bp, Artificial Sequence
  Synthetic oligonucleotide
ttgacaggggcagtggaaatggcggtgcattaatcga

SEQ ID NO: 93622 - DNA, 37 bp, Artificial Sequence
  Synthetic oligonucleotide
ttcgtgtcgccgggtgggtagaggtgggttgattcga

SEQ ID NO: 93623 - DNA, 36 bp, Artificial Sequence
  Synthetic oligonucleotide
tgttgcaaggtggggggtggtgaagaatttattcga

SEQ ID NO: 93624 - DNA, 37 bp, Artificial Sequence
  Synthetic oligonucleotide
ttggcaagcaaggtagggggggggttagttaacagga

SEQ ID NO: 93625 - DNA, 36 bp, Artificial Sequence
  Synthetic oligonucleotide
acaccatcccgccatagtagcgcatttaggagagga

SEQ ID NO: 93626 - DNA, 37 bp, Artificial Sequence
  Synthetic oligonucleotide
gcgtacgcaaagggttgtcgaatggagtgggatagga

SEQ ID NO: 93627 - DNA, 36 bp, Artificial Sequence
  Synthetic oligonucleotide
ttgcccacagaccactttttcactcaagccgtagga

SEQ ID NO: 93628 - DNA, 37 bp, Artificial Sequence
  Synthetic oligonucleotide
gaccaaccgtgcctcatctctcagtacagccccggga

SEQ ID NO: 93629 - DNA, 37 bp, Artificial Sequence
  Synthetic oligonucleotide
atgccatgtcggggccgatgaggtcatgggtagggga

SEQ ID NO: 93630 - DNA, 37 bp, Artificial Sequence
  Synthetic oligonucleotide
ttgtaggtcggacatgagcggacggggctaaggggga

SEQ ID NO: 93631 - DNA, 37 bp, Artificial Sequence
  Synthetic oligonucleotide
gtggatgcacgtctgcaaaggcaggaagtagatggga

SEQ ID NO: 93632 - DNA, 37 bp, Artificial Sequence
  Synthetic oligonucleotide
gtgtcatgcggggtcggctcaagatagggggctggga

SEQ ID NO: 93633 - DNA, 37 bp, Artificial Sequence
  Synthetic oligonucleotide
aaaaactatgaggggtggggcaaggaatggacatgga

SEQ ID NO: 93634 - DNA, 37 bp, Artificial Sequence
  Synthetic oligonucleotide
tccctccgccgccatgttacctagtgcatgtgctgga

SEQ ID NO: 93635 - DNA, 37 bp, Artificial Sequence
  Synthetic oligonucleotide
gatgagggggcataggtagcttggactaatcggtgga

SEQ ID NO: 93636 - DNA, 37 bp, Artificial Sequence
  Synthetic oligonucleotide
tgacacgcgggggggtaatcataagggcataatatga

SEQ ID NO: 93637 - DNA, 38 bp, Artificial Sequence
  Synthetic oligonucleotide
gacacgtagtggaacttaatgcggaggggaaactatga

SEQ ID NO: 93638 - DNA, 38 bp, Artificial Sequence
  Synthetic oligonucleotide
tcaaagggggtcacgtggggaagcagaggacggactga

SEQ ID NO: 93639 - DNA, 35 bp, Artificial Sequence
  Synthetic oligonucleotide
ttgatgctccgcctgactcagttcgtactacctga

SEQ ID NO: 93640 - DNA, 37 bp, Artificial Sequence
  Synthetic oligonucleotide
gagtacgcatcactgttgcgtctgtttagacccctga

SEQ ID NO: 93641 - DNA, 37 bp, Artificial Sequence
  Synthetic oligonucleotide
tacgacgccaccgagtttttaagtcccgtcatgctga

SEQ ID NO: 93642 - DNA, 38 bp, Artificial Sequence
  Synthetic oligonucleotide
gcgatgcgggaaggaaatgacgggtgggactctgctga

SEQ ID NO: 93643 - DNA, 38 bp, Artificial Sequence
  Synthetic oligonucleotide
gagggcacgtggttgtaaagggtgtggtggggatctga

SEQ ID NO: 93644 - DNA, 37 bp, Artificial Sequence
  Synthetic oligonucleotide
gcatggctcaccaattgaatgaccgatccacctctga

SEQ ID NO: 93645 - DNA, 38 bp, Artificial Sequence
  Synthetic oligonucleotide
tgcgctcactgagtccagccttaacctcccatttctga

SEQ ID NO: 93646 - DNA, 38 bp, Artificial Sequence
  Synthetic oligonucleotide
tcatacgttggccgatcgtggtgaaggggggcccgtga

SEQ ID NO: 93647 - DNA, 37 bp, Artificial Sequence
  Synthetic oligonucleotide
aaagtgaagaacgtatatgcgacaatgggtggcgtga

SEQ ID NO: 93648 - DNA, 37 bp, Artificial Sequence
  Synthetic oligonucleotide
gattgggagggacaagggataagtcagtgagaggtga

SEQ ID NO: 93649 - DNA, 38 bp, Artificial Sequence
  Synthetic oligonucleotide
taatgagggtaagtgctggtgaatgggaaggtcggtga

SEQ ID NO: 93650 - DNA, 38 bp, Artificial Sequence
  Synthetic oligonucleotide
acaacacataaggtgtgaatagcgggtggggggggtga

SEQ ID NO: 93651 - DNA, 38 bp, Artificial Sequence
  Synthetic oligonucleotide
gtgggtgcaaggcgcgggaagaagaacgcagttggtga

SEQ ID NO: 93652 - DNA, 38 bp, Artificial Sequence
  Synthetic oligonucleotide
acccgcactagtcagcattttataatcggcctttgtga

SEQ ID NO: 93653 - DNA, 38 bp, Artificial Sequence
  Synthetic oligonucleotide
ttggacgcgcgtcacttgttcttcctacccgtttgtga

SEQ ID NO: 93654 - DNA, 38 bp, Artificial Sequence
  Synthetic oligonucleotide
acccgagcgtgctgccagccgtcttttgtcctaattga

SEQ ID NO: 93655 - DNA, 37 bp, Artificial Sequence
  Synthetic oligonucleotide
ggggcatcatccaggctattatgctaaccctccttga

SEQ ID NO: 93656 - DNA, 37 bp, Artificial Sequence
  Synthetic oligonucleotide
agtcccgcagtctggtccctcgtctgcgtttccttga

SEQ ID NO: 93657 - DNA, 38 bp, Artificial Sequence
  Synthetic oligonucleotide
aacgtcacaccgatctccatgaaattatcgctgcttga

SEQ ID NO: 93658 - DNA, 37 bp, Artificial Sequence
  Synthetic oligonucleotide
tatggcctggatcgtctcatgcacccacttgtcttga

SEQ ID NO: 93659 - DNA, 36 bp, Artificial Sequence
  Synthetic oligonucleotide
tggaggggaagaagaaggagggtacgttacagttga

SEQ ID NO: 93660 - DNA, 38 bp, Artificial Sequence
  Synthetic oligonucleotide
gccaaagcgcaggacacaccataaacactgaaatttga

SEQ ID NO: 93661 - DNA, 37 bp, Artificial Sequence
  Synthetic oligonucleotide
tccatgcgagctgtgctatcgcaatcgtgccttttga

SEQ ID NO: 93662 - DNA, 37 bp, Artificial Sequence
  Synthetic oligonucleotide
gtcgtacactcgctcactgtgatcatttgttttttga

SEQ ID NO: 93663 - DNA, 35 bp, Artificial Sequence
  Synthetic oligonucleotide
aacggaaggagatagtgagaagagtgtgggcaata

SEQ ID NO: 93664 - DNA, 35 bp, Artificial Sequence
  Synthetic oligonucleotide
gagagaggagcatcttgcgtttagcacatcctata

SEQ ID NO: 93665 - DNA, 35 bp, Artificial Sequence
  Synthetic oligonucleotide
gtccaatggccgtctctgaacttcgcggttaccta

SEQ ID NO: 93666 - DNA, 35 bp, Artificial Sequence
  Synthetic oligonucleotide
gttgagggtgcagggccacgggggttattgcagta

SEQ ID NO: 93667 - DNA, 35 bp, Artificial Sequence
  Synthetic oligonucleotide
gacctgcccacaccgtacccccactttctggcgta

SEQ ID NO: 93668 - DNA, 36 bp, Artificial Sequence
  Synthetic oligonucleotide
gaacgcttggctgacgttcccctagtccagttcgta

SEQ ID NO: 93669 - DNA, 36 bp, Artificial Sequence
  Synthetic oligonucleotide
gactgacccaatatggaggacttacacgatgcctta

SEQ ID NO: 93670 - DNA, 36 bp, Artificial Sequence
  Synthetic oligonucleotide
gccagaagaagcaacgtggggggaaaagtcaggtta

SEQ ID NO: 93671 - DNA, 35 bp, Artificial Sequence
  Synthetic oligonucleotide
ttcacgtacgtggaaactgctaccatcacccacac

SEQ ID NO: 93672 - DNA, 35 bp, Artificial Sequence
  Synthetic oligonucleotide
tgtagtggactcagccaacctcacctgcggatcac

SEQ ID NO: 93673 - DNA, 35 bp, Artificial Sequence
  Synthetic oligonucleotide
accccttgcacctcttcagttggcgtccccctcac

SEQ ID NO: 93674 - DNA, 35 bp, Artificial Sequence
  Synthetic oligonucleotide
agcgggtcaagaagggcctgaagggcgggatcgac

SEQ ID NO: 93675 - DNA, 35 bp, Artificial Sequence
  Synthetic oligonucleotide
aactgaacccgcgcctacatctgctctggcctgac

SEQ ID NO: 93676 - DNA, 35 bp, Artificial Sequence
  Synthetic oligonucleotide
aaatgcgaactgcctactgcgttctttagtggtac

SEQ ID NO: 93677 - DNA, 35 bp, Artificial Sequence
  Synthetic oligonucleotide
gatgggtggcgtgatccgcatgcaccttcgtttac

SEQ ID NO: 93678 - DNA, 35 bp, Artificial Sequence
  Synthetic oligonucleotide
ggacactatcacattacttctgcggcgctatcccc

SEQ ID NO: 93679 - DNA, 35 bp, Artificial Sequence
  Synthetic oligonucleotide
tcctacacgcgcccacacacttgtactaaaaagcc

SEQ ID NO: 93680 - DNA, 35 bp, Artificial Sequence
  Synthetic oligonucleotide
attgtacagtgccaccaactttcggccgaagtgcc

SEQ ID NO: 93681 - DNA, 35 bp, Artificial Sequence
  Synthetic oligonucleotide
tagtgacgtacttgagcatatctgcccctcaccgc

SEQ ID NO: 93682 - DNA, 35 bp, Artificial Sequence
  Synthetic oligonucleotide
gacttgctcaattttgtaggtcctgttcgctccgc

SEQ ID NO: 93683 - DNA, 35 bp, Artificial Sequence
  Synthetic oligonucleotide
ggggaggggaggtggaggttgaggcggccacaggc

SEQ ID NO: 93684 - DNA, 35 bp, Artificial Sequence
  Synthetic oligonucleotide
atggaaaggcatgaggggtggcggattgagctggc

SEQ ID NO: 93685 - DNA, 35 bp, Artificial Sequence
  Synthetic oligonucleotide
tccacggggggggtagctagtggaagcgggagtgc

SEQ ID NO: 93686 - DNA, 35 bp, Artificial Sequence
  Synthetic oligonucleotide
tccgtgacgaatacgtggagctggccgccctcctc

SEQ ID NO: 93687 - DNA, 35 bp, Artificial Sequence
  Synthetic oligonucleotide
aacccgctaggtttcggagccctgctgttcctctc

SEQ ID NO: 93688 - DNA, 35 bp, Artificial Sequence
  Synthetic oligonucleotide
gcacgttatcactgtgcttatcttatctcgctgtc

SEQ ID NO: 93689 - DNA, 35 bp, Artificial Sequence
  Synthetic oligonucleotide
tgtgacctagctctgacccggccgaccccagtttc

SEQ ID NO: 93690 - DNA, 35 bp, Artificial Sequence
  Synthetic oligonucleotide
tcaaggggagtgggtagggttcaagatattgcaag

SEQ ID NO: 93691 - DNA, 35 bp, Artificial Sequence
  Synthetic oligonucleotide
gaaacgtaggagggtaggggcctgtaggcgcaacg

SEQ ID NO: 93692 - DNA, 35 bp, Artificial Sequence
  Synthetic oligonucleotide
tgatgcatatagcccttaccgagaggacctccccg

SEQ ID NO: 93693 - DNA, 35 bp, Artificial Sequence
  Synthetic oligonucleotide
aaccagcatgccctctgaatggcctctgctcatcg

SEQ ID NO: 93694 - DNA, 35 bp, Artificial Sequence
  Synthetic oligonucleotide
acgatcgcgccacatcccattaatgctgcttctcg

SEQ ID NO: 93695 - DNA, 35 bp, Artificial Sequence
  Synthetic oligonucleotide
aacgcggtagcgggggtaaccaaaatatatgcagg

SEQ ID NO: 93696 - DNA, 35 bp, Artificial Sequence
  Synthetic oligonucleotide
aaggtggaacgaaaccagtggcaacacggacttgg

SEQ ID NO: 93697 - DNA, 35 bp, Artificial Sequence
  Synthetic oligonucleotide
ggtaacagggagggactgtggggccgataggaatg

SEQ ID NO: 93698 - DNA, 35 bp, Artificial Sequence
  Synthetic oligonucleotide
gagacgatgttcgtcgagcttttgatccgggccct

SEQ ID NO: 93699 - DNA, 35 bp, Artificial Sequence
  Synthetic oligonucleotide
aacaccgagtgccatgatctgtacctgcagcttct

SEQ ID NO: 93700 - DNA, 35 bp, Artificial Sequence
  Synthetic oligonucleotide
gcaccggaggctggttctcattccctctaccactt

SEQ ID NO: 93701 - DNA, 36 bp, Artificial Sequence
  Synthetic oligonucleotide
tcaacaaggaggttcagggcgtggtgcgaactggtt

SEQ ID NO: 93702 - DNA, 35 bp, Artificial Sequence
  Synthetic oligonucleotide
tgagccctaatccgccgttggctgcaacacaattt

SEQ ID NO: 93703 - DNA, 35 bp, Artificial Sequence
  Synthetic oligonucleotide
gtatgcgtcgtctttctgcgtggcattggtttttt

SEQ ID NO: 93704 - DNA, 35 bp, Artificial Sequence
  Synthetic oligonucleotide
aactgccgtagggctatatgcgatgtgagtgtaaa

SEQ ID NO: 93705 - DNA, 35 bp, Artificial Sequence
  Synthetic oligonucleotide
tccgaaccatcatcggctcgggccgtatgttacaa

SEQ ID NO: 93706 - DNA, 36 bp, Artificial Sequence
  Synthetic oligonucleotide
gagtgccgcctgttttgctctgtgcctcccatccaa

SEQ ID NO: 93707 - DNA, 36 bp, Artificial Sequence
  Synthetic oligonucleotide
gacacgtgcaatgggctctttagctctcgctggcaa

SEQ ID NO: 93708 - DNA, 36 bp, Artificial Sequence
  Synthetic oligonucleotide
acgagagcaggacagtactggtcatatgtcactcaa

SEQ ID NO: 93709 - DNA, 36 bp, Artificial Sequence
  Synthetic oligonucleotide
ggtccacgaaccctgtttcttatgcattcccgggaa

SEQ ID NO: 93710 - DNA, 36 bp, Artificial Sequence
  Synthetic oligonucleotide
gacatagcgatcgtgggagcgagctggcttggggaa

SEQ ID NO: 93711 - DNA, 35 bp, Artificial Sequence
  Synthetic oligonucleotide
gtccgcccctgatttcctactgtccttcgcatgaa

SEQ ID NO: 93712 - DNA, 36 bp, Artificial Sequence
  Synthetic oligonucleotide
agaccgactgcccgtctccccagcatatcccctgaa

SEQ ID NO: 93713 - DNA, 36 bp, Artificial Sequence
  Synthetic oligonucleotide
accacccccatgcgatcggccttatatggctcataa

SEQ ID NO: 93714 - DNA, 36 bp, Artificial Sequence
  Synthetic oligonucleotide
tcagtgctgcatttatctacctgccttgaacacaca

SEQ ID NO: 93715 - DNA, 34 bp, Artificial Sequence
  Synthetic oligonucleotide
gatcaggcggtagtaaccgaacaaacgagagaca

SEQ ID NO: 93716 - DNA, 37 bp, Artificial Sequence
  Synthetic oligonucleotide
gcacgagggggttgaagacgactacagaacatagaca

SEQ ID NO: 93717 - DNA, 34 bp, Artificial Sequence
  Synthetic oligonucleotide
gcacgtgggcgtcgttcctactgtctggctgaca

SEQ ID NO: 93718 - DNA, 36 bp, Artificial Sequence
  Synthetic oligonucleotide
gttggggccctcatatacgctgtccctagttgacca

SEQ ID NO: 93719 - DNA, 35 bp, Artificial Sequence
  Synthetic oligonucleotide
gaccgggtccccatacgattacgctgctttgtgca

SEQ ID NO: 93720 - DNA, 37 bp, Artificial Sequence
  Synthetic oligonucleotide
actgcggtggagggtggaaatggggtgaaggtgatca

SEQ ID NO: 93721 - DNA, 35 bp, Artificial Sequence
  Synthetic oligonucleotide
gcatcctcacaactgtacctcctcttggattctca

SEQ ID NO: 93722 - DNA, 36 bp, Artificial Sequence
  Synthetic oligonucleotide
gaacggtgccctgtgactaggccccaattctcttca

SEQ ID NO: 93723 - DNA, 37 bp, Artificial Sequence
  Synthetic oligonucleotide
gatgccagtcgaggcgaagtttggataggctaaaaga

SEQ ID NO: 93724 - DNA, 37 bp, Artificial Sequence
  Synthetic oligonucleotide
accaccactaccgccaatcctgtgtaggagtcaaaga

SEQ ID NO: 93725 - DNA, 37 bp, Artificial Sequence
  Synthetic oligonucleotide
gggaagagaatgagtaggggtgggcaaagcgtacaga

SEQ ID NO: 93726 - DNA, 37 bp, Artificial Sequence
  Synthetic oligonucleotide
gccacgccagtgtgcatgtagcgatgctactttcaga

SEQ ID NO: 93727 - DNA, 36 bp, Artificial Sequence
  Synthetic oligonucleotide
acaccaacctgctactgtcaacgggctctatcgaga

SEQ ID NO: 93728 - DNA, 35 bp, Artificial Sequence
  Synthetic oligonucleotide
gaagccacgcccagctcgcgcattcaaacctgaga

SEQ ID NO: 93729 - DNA, 37 bp, Artificial Sequence
  Synthetic oligonucleotide
ggaggggaaggagattcaatgaagtaagcatgtgaga

SEQ ID NO: 93730 - DNA, 37 bp, Artificial Sequence
  Synthetic oligonucleotide
tgaccggtgctgtgtaaaccggaacgtacgatataga

SEQ ID NO: 93731 - DNA, 37 bp, Artificial Sequence
  Synthetic oligonucleotide
ggacgtgcaagggataggaagcacaatggagtctaga

SEQ ID NO: 93732 - DNA, 37 bp, Artificial Sequence
  Synthetic oligonucleotide
tgagggagagtgcaacaggagggaagcggttattaga

SEQ ID NO: 93733 - DNA, 37 bp, Artificial Sequence
  Synthetic oligonucleotide
tcacaccgcccctaacatgcatgtactgacttcacga

SEQ ID NO: 93734 - DNA, 37 bp, Artificial Sequence
  Synthetic oligonucleotide
ttaggcacctgtgctcttacttgcatttcttcgacga

SEQ ID NO: 93735 - DNA, 36 bp, Artificial Sequence
  Synthetic oligonucleotide
gaagagcaacaggaacgtctgaactgactgatacga

SEQ ID NO: 93736 - DNA, 37 bp, Artificial Sequence
  Synthetic oligonucleotide
ttggacagtgagggtctttgtgggaggggcattacga

SEQ ID NO: 93737 - DNA, 37 bp, Artificial Sequence
  Synthetic oligonucleotide
atcagtcccgccaagtgtcgagccccatttacaccga

SEQ ID NO: 93738 - DNA, 37 bp, Artificial Sequence
  Synthetic oligonucleotide
gacgccgggtaaggttcaaagcgtcgcctccccccga

SEQ ID NO: 93739 - DNA, 37 bp, Artificial Sequence
  Synthetic oligonucleotide
aacgcgagccaggattatacttaagcaaacttcccga

SEQ ID NO: 93740 - DNA, 37 bp, Artificial Sequence
  Synthetic oligonucleotide
tcacgagctagtgaacggccaaaagaagagaatgcga

SEQ ID NO: 93741 - DNA, 37 bp, Artificial Sequence
  Synthetic oligonucleotide
agctgtgcgatctttatgccttccgattcaactgcga

SEQ ID NO: 93742 - DNA, 37 bp, Artificial Sequence
  Synthetic oligonucleotide
gagtcccacccagcgtcatacctttagttctcatcga

SEQ ID NO: 93743 - DNA, 37 bp, Artificial Sequence
  Synthetic oligonucleotide
tgcaccctgtcgtcactaacgaaccaatctctttcga

SEQ ID NO: 93744 - DNA, 37 bp, Artificial Sequence
  Synthetic oligonucleotide
ggtgcatgacgtaagggaggggggcgcgcgagtagga

SEQ ID NO: 93745 - DNA, 37 bp, Artificial Sequence
  Synthetic oligonucleotide
gaaacggtctcaagagggagttatgatgccacgcgga

SEQ ID NO: 93746 - DNA, 37 bp, Artificial Sequence
  Synthetic oligonucleotide
tagggaaggaaaattcgtgttatacacgagcatggga

SEQ ID NO: 93747 - DNA, 34 bp, Artificial Sequence
  Synthetic oligonucleotide
tacgcgcgccgcaacaggggatatacacgtggga

SEQ ID NO: 93748 - DNA, 38 bp, Artificial Sequence
  Synthetic oligonucleotide
ttgggattcagcagcatgggcatggagtacgggtggga

SEQ ID NO: 93749 - DNA, 36 bp, Artificial Sequence
  Synthetic oligonucleotide
gttaccgtctaccccctccgtcagccctaattggga

SEQ ID NO: 93750 - DNA, 37 bp, Artificial Sequence
  Synthetic oligonucleotide
tagggccagatgttacgggggggatgagtaggatgga

SEQ ID NO: 93751 - DNA, 36 bp, Artificial Sequence
  Synthetic oligonucleotide
acgtacggaagggcgaacatcaatacccaggttgga

SEQ ID NO: 93752 - DNA, 38 bp, Artificial Sequence
  Synthetic oligonucleotide
gcgccaaagggtagatggatgggggaacccgagaatga

SEQ ID NO: 93753 - DNA, 38 bp, Artificial Sequence
  Synthetic oligonucleotide
gacaacgtgcagtgacgggaggggcggaaatttaatga

SEQ ID NO: 93754 - DNA, 38 bp, Artificial Sequence
  Synthetic oligonucleotide
gagtgaaagtcaagagcactcccgcacccgccacatga

SEQ ID NO: 93755 - DNA, 38 bp, Artificial Sequence
  Synthetic oligonucleotide
tcccacgtcagttgttgatctactttttctttgcatga

SEQ ID NO: 93756 - DNA, 38 bp, Artificial Sequence
  Synthetic oligonucleotide
gatacggacgaagggaggaaaggttaaagcaaagatga

SEQ ID NO: 93757 - DNA, 38 bp, Artificial Sequence
  Synthetic oligonucleotide
aactgcgtgggcacacgggaaaggggtataaaggatga

SEQ ID NO: 93758 - DNA, 38 bp, Artificial Sequence
  Synthetic oligonucleotide
tagtgccgacaggtgggaggaggtggggaataggatga

SEQ ID NO: 93759 - DNA, 38 bp, Artificial Sequence
  Synthetic oligonucleotide
tcacatgcgggcaagaggggacgagagggtttgtatga

SEQ ID NO: 93760 - DNA, 37 bp, Artificial Sequence
  Synthetic oligonucleotide
tgatcagccattgacgtacccgcgctctctcttatga

SEQ ID NO: 93761 - DNA, 38 bp, Artificial Sequence
  Synthetic oligonucleotide
gaccaagccacaaagtgttgtgcgggggggttaactga

SEQ ID NO: 93762 - DNA, 37 bp, Artificial Sequence
  Synthetic oligonucleotide
gatcgggggacggggacaacagagagaacggtactga

SEQ ID NO: 93763 - DNA, 38 bp, Artificial Sequence
  Synthetic oligonucleotide
gcaccacgggtcaaggcctggaggaccattattactga

SEQ ID NO: 93764 - DNA, 38 bp, Artificial Sequence
  Synthetic oligonucleotide
gaccggaaggcatgggcgaaaaggagagaaatatctga

SEQ ID NO: 93765 - DNA, 38 bp, Artificial Sequence
  Synthetic oligonucleotide
gagcacgcagctctgtaactcaaaggggggtggggtga

SEQ ID NO: 93766 - DNA, 37 bp, Artificial Sequence
  Synthetic oligonucleotide
gaacggtggataacagcgaggagctagggggtggtga

SEQ ID NO: 93767 - DNA, 38 bp, Artificial Sequence
  Synthetic oligonucleotide
gacgcgatcgtacggaattaggtgagtgaggaatgtga

SEQ ID NO: 93768 - DNA, 38 bp, Artificial Sequence
  Synthetic oligonucleotide
tgcggaacgggggggggcattgaaacactttaccttga

SEQ ID NO: 93769 - DNA, 38 bp, Artificial Sequence
  Synthetic oligonucleotide
gctgatagcgcgatttcgaatgggggctcagggcttga

SEQ ID NO: 93770 - DNA, 36 bp, Artificial Sequence
  Synthetic oligonucleotide
actcatcccgaagcaccgctcccatggggagccata

SEQ ID NO: 93771 - DNA, 31 bp, Artificial Sequence
  Synthetic oligonucleotide
tatacaacccccgtctcagtcctcacgcata

SEQ ID NO: 93772 - DNA, 35 bp, Artificial Sequence
  Synthetic oligonucleotide
tgacaggggggcacaaaggggatgtaatgagtata

SEQ ID NO: 93773 - DNA, 35 bp, Artificial Sequence
  Synthetic oligonucleotide
attgcctcgactgttgccagcgtcgtcattcacta

SEQ ID NO: 93774 - DNA, 36 bp, Artificial Sequence
  Synthetic oligonucleotide
tcacacaggggagtgcatcgccgaccacgctgacta

SEQ ID NO: 93775 - DNA, 35 bp, Artificial Sequence
  Synthetic oligonucleotide
atgactgctccaaagtccactgcgttaccggccta

SEQ ID NO: 93776 - DNA, 36 bp, Artificial Sequence
  Synthetic oligonucleotide
tcagagactcggaaatgcccaacagggacccacgta

SEQ ID NO: 93777 - DNA, 36 bp, Artificial Sequence
  Synthetic oligonucleotide
gcgcacgcaacagcatcagtcttcccatttcatgta

SEQ ID NO: 93778 - DNA, 35 bp, Artificial Sequence
  Synthetic oligonucleotide
tgtttacgcactcgggattattatcgtcgccctta

SEQ ID NO: 93779 - DNA, 36 bp, Artificial Sequence
  Synthetic oligonucleotide
gtggaccgcactatcgcttgtttgaaacgctcctta

SEQ ID NO: 93780 - DNA, 36 bp, Artificial Sequence
  Synthetic oligonucleotide
aacgcgtgacattcgtcatcgttactttttgattta

SEQ ID NO: 93781 - DNA, 35 bp, Artificial Sequence
  Synthetic oligonucleotide
accgcagattcgccaccaagcttcttcggtcttta

SEQ ID NO: 93782 - DNA, 35 bp, Artificial Sequence
  Synthetic oligonucleotide
tcactcctcactgctactgttgttcggctcgaaac

SEQ ID NO: 93783 - DNA, 35 bp, Artificial Sequence
  Synthetic oligonucleotide
tgttggccctggcactgatcatattaccgcttgac

SEQ ID NO: 93784 - DNA, 35 bp, Artificial Sequence
  Synthetic oligonucleotide
taccaacacggttcccttttgcagagactacctac

SEQ ID NO: 93785 - DNA, 35 bp, Artificial Sequence
  Synthetic oligonucleotide
tcttgcacacgcacttttaggcccacgatccctac

SEQ ID NO: 93786 - DNA, 35 bp, Artificial Sequence
  Synthetic oligonucleotide
taacgcggaacgtccttgcaaacaccgggaggtac

SEQ ID NO: 93787 - DNA, 34 bp, Artificial Sequence
  Synthetic oligonucleotide
tccactatccagatcgctgatccatgccctgtac

SEQ ID NO: 93788 - DNA, 35 bp, Artificial Sequence
  Synthetic oligonucleotide
gcaccgtacgcgtgcacacctcttctaccaaaccc

SEQ ID NO: 93789 - DNA, 35 bp, Artificial Sequence
  Synthetic oligonucleotide
gtttacgccccgagtgacagttccatgccgtaccc

SEQ ID NO: 93790 - DNA, 35 bp, Artificial Sequence
  Synthetic oligonucleotide
tccagcctagcgaaccaacagacatctactacccc

SEQ ID NO: 93791 - DNA, 35 bp, Artificial Sequence
  Synthetic oligonucleotide
tgagcctcgtcttatactatcataccggttacccc

SEQ ID NO: 93792 - DNA, 35 bp, Artificial Sequence
  Synthetic oligonucleotide
atcccaagcgcatagaacgcttaatatgcgctccc

SEQ ID NO: 93793 - DNA, 35 bp, Artificial Sequence
  Synthetic oligonucleotide
tcacgggtccgaatttgtcggtctagaatttttcc

SEQ ID NO: 93794 - DNA, 35 bp, Artificial Sequence
  Synthetic oligonucleotide
gatgattagcgtccgtctcgcttctggcgcccctc

SEQ ID NO: 93795 - DNA, 35 bp, Artificial Sequence
  Synthetic oligonucleotide
tgaagtccgccccgagttttgaagcccggttcctc

SEQ ID NO: 93796 - DNA, 35 bp, Artificial Sequence
  Synthetic oligonucleotide
ttgaaacagcagtgtttgggacagacggttgtctc

SEQ ID NO: 93797 - DNA, 35 bp, Artificial Sequence
  Synthetic oligonucleotide
gctcgagtcgaagcgcgaaacctgtatcctttgtc

SEQ ID NO: 93798 - DNA, 35 bp, Artificial Sequence
  Synthetic oligonucleotide
tgagaacgccacattcccttctgttcccggtgttc

SEQ ID NO: 93799 - DNA, 35 bp, Artificial Sequence
  Synthetic oligonucleotide
acatgagccgtcctgatttttttgccgtcaatgag

SEQ ID NO: 93800 - DNA, 35 bp, Artificial Sequence
  Synthetic oligonucleotide
acactcatcagtcgttgtttttacactcaatcacg

SEQ ID NO: 93801 - DNA, 35 bp, Artificial Sequence
  Synthetic oligonucleotide
gcaccccctagtgtgtcctgatggaccatctcacg

SEQ ID NO: 93802 - DNA, 35 bp, Artificial Sequence
  Synthetic oligonucleotide
gatgcgaaaacttattcggacactgcgcgagaccg

SEQ ID NO: 93803 - DNA, 35 bp, Artificial Sequence
  Synthetic oligonucleotide
gagacgacctgatgataagtaattttggggggggg

SEQ ID NO: 93804 - DNA, 36 bp, Artificial Sequence
  Synthetic oligonucleotide
gtgggccctcccttttgcattttcacagctttgggg

SEQ ID NO: 93805 - DNA, 35 bp, Artificial Sequence
  Synthetic oligonucleotide
gcgccggaaggggacggattattgtatgtcgttgg

SEQ ID NO: 93806 - DNA, 35 bp, Artificial Sequence
  Synthetic oligonucleotide
gttgagacacgtgtaaagaggccgggagaattatg

SEQ ID NO: 93807 - DNA, 37 bp, Artificial Sequence
  Synthetic oligonucleotide
acctcgcgctgtgctgtggctcgccctcgaatatctg

SEQ ID NO: 93808 - DNA, 35 bp, Artificial Sequence
  Synthetic oligonucleotide
tctaggggcggaaaaaacaacgtggtggaccggtg

SEQ ID NO: 93809 - DNA, 35 bp, Artificial Sequence
  Synthetic oligonucleotide
ggaacgccccagcactgcactaagattgagggcat

SEQ ID NO: 93810 - DNA, 35 bp, Artificial Sequence
  Synthetic oligonucleotide
tgtgccgcaggttggctactgatcctgactgcact

SEQ ID NO: 93811 - DNA, 35 bp, Artificial Sequence
  Synthetic oligonucleotide
ttaaggcgccgaacatgaagcacctcgcatttcct

SEQ ID NO: 93812 - DNA, 35 bp, Artificial Sequence
  Synthetic oligonucleotide
gaagccttcggaccgtcgctacttagtcctccgct

SEQ ID NO: 93813 - DNA, 35 bp, Artificial Sequence
  Synthetic oligonucleotide
gtcacccagccacttgtagacggaccgtaccgtct

SEQ ID NO: 93814 - DNA, 35 bp, Artificial Sequence
  Synthetic oligonucleotide
gagtggctcaccgtcctacttaccctctttaaagt

SEQ ID NO: 93815 - DNA, 35 bp, Artificial Sequence
  Synthetic oligonucleotide
gagccgtcacctccctcccgctagaccgttctagt

SEQ ID NO: 93816 - DNA, 35 bp, Artificial Sequence
  Synthetic oligonucleotide
tgcggggggcagacagtttttgggggttgggaggt

SEQ ID NO: 93817 - DNA, 35 bp, Artificial Sequence
  Synthetic oligonucleotide
gcgaccaacagaagggctgcagcttgatttacggt

SEQ ID NO: 93818 - DNA, 35 bp, Artificial Sequence
  Synthetic oligonucleotide
gtgtcacgggtggtatatactcccacttccctggt

SEQ ID NO: 93819 - DNA, 34 bp, Artificial Sequence
  Synthetic oligonucleotide
gagatgggaccgtgatggacatcaggacaaatgt

SEQ ID NO: 93820 - DNA, 35 bp, Artificial Sequence
  Synthetic oligonucleotide
tagcctgtgaccccctacttgataatgcatcatgt

SEQ ID NO: 93821 - DNA, 35 bp, Artificial Sequence
  Synthetic oligonucleotide
aatgcacgccgtacccatcgcgcctccttcttatt

SEQ ID NO: 93822 - DNA, 35 bp, Artificial Sequence
  Synthetic oligonucleotide
tcccgcgcaactcctgatttcggttttaacgcctt

SEQ ID NO: 93823 - DNA, 35 bp, Artificial Sequence
  Synthetic oligonucleotide
agatgccgtagtgggggtcgggcaaagaaagcgtt

SEQ ID NO: 93824 - DNA, 35 bp, Artificial Sequence
  Synthetic oligonucleotide
acacagggtagcaagtactagaaattcttgtggtt

SEQ ID NO: 93825 - DNA, 36 bp, Artificial Sequence
  Synthetic oligonucleotide
aaagtggaaaggacgtgctaagggaaagggggacaa

SEQ ID NO: 93826 - DNA, 36 bp, Artificial Sequence
  Synthetic oligonucleotide
tatgcaaaggggagcaagtgagccaggctgtagcaa

SEQ ID NO: 93827 - DNA, 36 bp, Artificial Sequence
  Synthetic oligonucleotide
ttgcccagtccgccgattagcttatttctgttgcaa

SEQ ID NO: 93828 - DNA, 35 bp, Artificial Sequence
  Synthetic oligonucleotide
tactccatcccgtatacgcatacgatacatctgaa

SEQ ID NO: 93829 - DNA, 36 bp, Artificial Sequence
  Synthetic oligonucleotide
gctctcgcccacgaattcggatctgtccccattgaa

SEQ ID NO: 93830 - DNA, 35 bp, Artificial Sequence
  Synthetic oligonucleotide
gtacaacgcctccatgactcgtacgaacagttgaa

SEQ ID NO: 93831 - DNA, 36 bp, Artificial Sequence
  Synthetic oligonucleotide
ggaccgtgatcagggggggcagttgcaaatcgataa

SEQ ID NO: 93832 - DNA, 36 bp, Artificial Sequence
  Synthetic oligonucleotide
ttagcgagaaaggcgagaggattgggagtggggtaa

SEQ ID NO: 93833 - DNA, 36 bp, Artificial Sequence
  Synthetic oligonucleotide
gcagtacgaactgccctgtcgatacgttttctcaca

SEQ ID NO: 93834 - DNA, 36 bp, Artificial Sequence
  Synthetic oligonucleotide
tgtaggtccacggtttgtttcacgccgctctcacca

SEQ ID NO: 93835 - DNA, 36 bp, Artificial Sequence
  Synthetic oligonucleotide
atgatgcacagtgtggacaaggggtatcactgtgca

SEQ ID NO: 93836 - DNA, 35 bp, Artificial Sequence
  Synthetic oligonucleotide
atggccaatgcctccttatttattcccatcgttca

SEQ ID NO: 93837 - DNA, 37 bp, Artificial Sequence
  Synthetic oligonucleotide
taacaacgggctaggaggggtaattgttgcaggaaga

SEQ ID NO: 93838 - DNA, 37 bp, Artificial Sequence
  Synthetic oligonucleotide
tgcggaaggcttcggaggggactgagggtgggccaga

SEQ ID NO: 93839 - DNA, 37 bp, Artificial Sequence
  Synthetic oligonucleotide
gaagtgggggatggttgcgtaaacggttgtcagcaga

SEQ ID NO: 93840 - DNA, 36 bp, Artificial Sequence
  Synthetic oligonucleotide
atctgtcgccgtgggccctactgttcagtctcgaga

SEQ ID NO: 93841 - DNA, 37 bp, Artificial Sequence
  Synthetic oligonucleotide
ggaccctaccactgcgcatatctagagttctccacga

SEQ ID NO: 93842 - DNA, 36 bp, Artificial Sequence
  Synthetic oligonucleotide
aaacaaccccgcattcgtaacggacgcttagaccga

SEQ ID NO: 93843 - DNA, 37 bp, Artificial Sequence
  Synthetic oligonucleotide
tacccacgcccgacctacgagtcacggttccgaccga

SEQ ID NO: 93844 - DNA, 37 bp, Artificial Sequence
  Synthetic oligonucleotide
tagggcactgatctgcgcgcgcaccacgtaatcccga

SEQ ID NO: 93845 - DNA, 37 bp, Artificial Sequence
  Synthetic oligonucleotide
atgcagggcggaaggaacggccactgttaaacagcga

SEQ ID NO: 93846 - DNA, 36 bp, Artificial Sequence
  Synthetic oligonucleotide
gcccaccacaactcgaggagagcgataactacgcga

SEQ ID NO: 93847 - DNA, 36 bp, Artificial Sequence
  Synthetic oligonucleotide
atgtgtgtggtagcgctttatgaatccttgcctcga

SEQ ID NO: 93848 - DNA, 37 bp, Artificial Sequence
  Synthetic oligonucleotide
gcctgatacctaccgtttgccactaaccgacccagga

SEQ ID NO: 93849 - DNA, 36 bp, Artificial Sequence
  Synthetic oligonucleotide
ttagtgggcggttgggcagggaatcttgaaaccgga

SEQ ID NO: 93850 - DNA, 37 bp, Artificial Sequence
  Synthetic oligonucleotide
ttgtgctgccgaaggatcaggtggtgggaatgaggga

SEQ ID NO: 93851 - DNA, 36 bp, Artificial Sequence
  Synthetic oligonucleotide
agcaccactcatcaagtgccctatcaaacaccggga

SEQ ID NO: 93852 - DNA, 37 bp, Artificial Sequence
  Synthetic oligonucleotide
accgaaccggcacttttctaactcgtatacctcggga

SEQ ID NO: 93853 - DNA, 37 bp, Artificial Sequence
  Synthetic oligonucleotide
ggggtggtaccgggggcggataaggacgtgaggggga

SEQ ID NO: 93854 - DNA, 37 bp, Artificial Sequence
  Synthetic oligonucleotide
gactgccaatgtggaatattgttgtggcaagatggga

SEQ ID NO: 93855 - DNA, 37 bp, Artificial Sequence
  Synthetic oligonucleotide
tacccagtattcctctcgtacttgcgccatccctgga

SEQ ID NO: 93856 - DNA, 36 bp, Artificial Sequence
  Synthetic oligonucleotide
tcccacgcacagcacacggacatatggtagtttgga

SEQ ID NO: 93857 - DNA, 37 bp, Artificial Sequence
  Synthetic oligonucleotide
gatcgtgcatagcttgggtatctatcatcattttgga

SEQ ID NO: 93858 - DNA, 37 bp, Artificial Sequence
  Synthetic oligonucleotide
gacacgcaacgatctcaaccgattgtcctcccaatga

SEQ ID NO: 93859 - DNA, 38 bp, Artificial Sequence
  Synthetic oligonucleotide
aaacgcggatgcagatttcacacacttcgacgctatga

SEQ ID NO: 93860 - DNA, 38 bp, Artificial Sequence
  Synthetic oligonucleotide
tcaaggcatcacgatcctcctaactgatccacatctga

SEQ ID NO: 93861 - DNA, 38 bp, Artificial Sequence
  Synthetic oligonucleotide
tgacgcctccacccattcatttactataagagcagtga

SEQ ID NO: 93862 - DNA, 38 bp, Artificial Sequence
  Synthetic oligonucleotide
acagatggtgtacggattggcggactatgaggctgtga

SEQ ID NO: 93863 - DNA, 37 bp, Artificial Sequence
  Synthetic oligonucleotide
tgcccagttcctctgccgtagtaacatcgtaacttga

SEQ ID NO: 93864 - DNA, 38 bp, Artificial Sequence
  Synthetic oligonucleotide
gacacgtaatcagcggtaggtaggggggcggacgttga

SEQ ID NO: 93865 - DNA, 38 bp, Artificial Sequence
  Synthetic oligonucleotide
aaccacagctgcacggcgtgggttaagtagatggttga

SEQ ID NO: 93866 - DNA, 36 bp, Artificial Sequence
  Synthetic oligonucleotide
gttgcgctatgaattcacaccagctatcacatttga

SEQ ID NO: 93867 - DNA, 38 bp, Artificial Sequence
  Synthetic oligonucleotide
ttgtcgtcggtagtctgtcctcccctgtacatctttga

SEQ ID NO: 93868 - DNA, 36 bp, Artificial Sequence
  Synthetic oligonucleotide
agtcgagccaccagcctttctcgctcctctgaacta

SEQ ID NO: 93869 - DNA, 35 bp, Artificial Sequence
  Synthetic oligonucleotide
tccccgccccgacgtctactaccgctgaaccacta

SEQ ID NO: 93870 - DNA, 36 bp, Artificial Sequence
  Synthetic oligonucleotide
tggtcctcccctcttggatgagcacttccgttccta

SEQ ID NO: 93871 - DNA, 36 bp, Artificial Sequence
  Synthetic oligonucleotide
gtgagagcggttaagatagtgggtgatggtgctgta

SEQ ID NO: 93872 - DNA, 36 bp, Artificial Sequence
  Synthetic oligonucleotide
atctcccgtacctgggttctttatctggattcatta

SEQ ID NO: 93873 - DNA, 36 bp, Artificial Sequence
  Synthetic oligonucleotide
gagtgctatacgttgatcttccatgtgcccctctta

SEQ ID NO: 93874 - DNA, 36 bp, Artificial Sequence
  Synthetic oligonucleotide
gagaaaagcacgaggcgagaggggacaatgttgtta

SEQ ID NO: 93875 - DNA, 35 bp, Artificial Sequence
  Synthetic oligonucleotide
tgcatgtgaaagagttctatccgcccactaccaac

SEQ ID NO: 93876 - DNA, 35 bp, Artificial Sequence
  Synthetic oligonucleotide
tcccatgccgagatacttctgggccttaccaccac

SEQ ID NO: 93877 - DNA, 33 bp, Artificial Sequence
  Synthetic oligonucleotide
gagacgcggcccgctttcacttgcgccgttcac

SEQ ID NO: 93878 - DNA, 35 bp, Artificial Sequence
  Synthetic oligonucleotide
gtcgccgccgcacatgtacacaccgcgccaaaacc

SEQ ID NO: 93879 - DNA, 35 bp, Artificial Sequence
  Synthetic oligonucleotide
tcctggcccacgtgaatcttgttgtcgatcactgc

SEQ ID NO: 93880 - DNA, 36 bp, Artificial Sequence
  Synthetic oligonucleotide
agccacggtatccaatgacttgacccgtactccatc

SEQ ID NO: 93881 - DNA, 35 bp, Artificial Sequence
  Synthetic oligonucleotide
tgtacagacgcgcagctactgtgcccttccttatc

SEQ ID NO: 93882 - DNA, 35 bp, Artificial Sequence
  Synthetic oligonucleotide
ttgtgtcatcacaatgactgttgccacttatactc

SEQ ID NO: 93883 - DNA, 35 bp, Artificial Sequence
  Synthetic oligonucleotide
gagactgctcgcttcaacgatccggggtttgggtc

SEQ ID NO: 93884 - DNA, 35 bp, Artificial Sequence
  Synthetic oligonucleotide
tgccgccctacatttcctgaagcgtgtacctggtc

SEQ ID NO: 93885 - DNA, 35 bp, Artificial Sequence
  Synthetic oligonucleotide
tcaacagcgctagcggtagtgtcctgctttggttc

SEQ ID NO: 93886 - DNA, 35 bp, Artificial Sequence
  Synthetic oligonucleotide
acgccacagtgtgcccctgttatgcgtagcctttc

SEQ ID NO: 93887 - DNA, 35 bp, Artificial Sequence
  Synthetic oligonucleotide
gtcacccccggacagtatattcgacgagttctttc

SEQ ID NO: 93888 - DNA, 35 bp, Artificial Sequence
  Synthetic oligonucleotide
tcacatcagtagtgggcgccgttatggagttggag

SEQ ID NO: 93889 - DNA, 35 bp, Artificial Sequence
  Synthetic oligonucleotide
gtgccagcagataggtgggggggtgcggtaatgag

SEQ ID NO: 93890 - DNA, 35 bp, Artificial Sequence
  Synthetic oligonucleotide
aacaccgcccgcttatactgggtaccctaatttag

SEQ ID NO: 93891 - DNA, 35 bp, Artificial Sequence
  Synthetic oligonucleotide
gggggcgcttccgtaacaccactgcagtatcctcg

SEQ ID NO: 93892 - DNA, 35 bp, Artificial Sequence
  Synthetic oligonucleotide
gttgggcttgccgtcgatatcggcttaacatcttg

SEQ ID NO: 93893 - DNA, 35 bp, Artificial Sequence
  Synthetic oligonucleotide
gcagagcggactccggtacacgtatgcaactcaat

SEQ ID NO: 93894 - DNA, 35 bp, Artificial Sequence
  Synthetic oligonucleotide
gacatcaaaatggtgggcactaacgggtggggaat

SEQ ID NO: 93895 - DNA, 35 bp, Artificial Sequence
  Synthetic oligonucleotide
gatgggggcggcaaatggtgatgggatcaggtcat

SEQ ID NO: 93896 - DNA, 35 bp, Artificial Sequence
  Synthetic oligonucleotide
gtgcatcccaccaaccctagccagacctgtacgat

SEQ ID NO: 93897 - DNA, 35 bp, Artificial Sequence
  Synthetic oligonucleotide
gtgcgggtgaagggtgagtagtgcatgacgcttat

SEQ ID NO: 93898 - DNA, 35 bp, Artificial Sequence
  Synthetic oligonucleotide
gacctcgcgccggatcagtctttctaatcgcaact

SEQ ID NO: 93899 - DNA, 35 bp, Artificial Sequence
  Synthetic oligonucleotide
accatcaccgggctgtgccattggagtgtcccact

SEQ ID NO: 93900 - DNA, 35 bp, Artificial Sequence
  Synthetic oligonucleotide
aacaccccgctcgggtccgatcgcttcgtgaaatt

SEQ ID NO: 93901 - DNA, 35 bp, Artificial Sequence
  Synthetic oligonucleotide
tgcacctgtcgattactagtccgaattgctacctt

SEQ ID NO: 93902 - DNA, 36 bp, Artificial Sequence
  Synthetic oligonucleotide
ggggggggggaaggataggtagggacggagactctt

SEQ ID NO: 93903 - DNA, 35 bp, Artificial Sequence
  Synthetic oligonucleotide
gatgctgagccgaaaaagggagtggagcgatagtt

SEQ ID NO: 93904 - DNA, 35 bp, Artificial Sequence
  Synthetic oligonucleotide
atccgctgcctttaagtgtacacctttgtcccttt

SEQ ID NO: 93905 - DNA, 35 bp, Artificial Sequence
  Synthetic oligonucleotide
tcccacgccctatacaccaggccccctgtacaaaa

SEQ ID NO: 93906 - DNA, 35 bp, Artificial Sequence
  Synthetic oligonucleotide
gacggtgcccgcgtgtacgtcccggcccatttaaa

SEQ ID NO: 93907 - DNA, 36 bp, Artificial Sequence
  Synthetic oligonucleotide
gcaacgactaggagtggtagcggaaaaagttgacaa

SEQ ID NO: 93908 - DNA, 36 bp, Artificial Sequence
  Synthetic oligonucleotide
tgggggcctcctgacgaccttactcactcttggcaa

SEQ ID NO: 93909 - DNA, 33 bp, Artificial Sequence
  Synthetic oligonucleotide
aacgatagtggggaggggcttcaagagcgagaa

SEQ ID NO: 93910 - DNA, 36 bp, Artificial Sequence
  Synthetic oligonucleotide
gctgagccacccagcaagctatcgacacttcgtgaa

SEQ ID NO: 93911 - DNA, 36 bp, Artificial Sequence
  Synthetic oligonucleotide
tcacatgattctgtgcctcgatgcaatttcgcataa

SEQ ID NO: 93912 - DNA, 35 bp, Artificial Sequence
  Synthetic oligonucleotide
gttgcccctgagcgttaacctgtccagcctattaa

SEQ ID NO: 93913 - DNA, 36 bp, Artificial Sequence
  Synthetic oligonucleotide
gcatgtacgccctctgatccccgtctctcttgaaca

SEQ ID NO: 93914 - DNA, 36 bp, Artificial Sequence
  Synthetic oligonucleotide
ggatagcacgcctaacaagacaatgcaggtgtaaca

SEQ ID NO: 93915 - DNA, 36 bp, Artificial Sequence
  Synthetic oligonucleotide
gtggtggtgggtgatagggacaaggtggcaggcaca

SEQ ID NO: 93916 - DNA, 35 bp, Artificial Sequence
  Synthetic oligonucleotide
tgtcatcgttacgacggcccacgcttttcactaca

SEQ ID NO: 93917 - DNA, 36 bp, Artificial Sequence
  Synthetic oligonucleotide
tacgtcaccacccttcgcctggacgcttggattaca

SEQ ID NO: 93918 - DNA, 36 bp, Artificial Sequence
  Synthetic oligonucleotide
accaatggcgcaggggtcggccatactctccttaca

SEQ ID NO: 93919 - DNA, 33 bp, Artificial Sequence
  Synthetic oligonucleotide
ataccgcgcgcacaactaagccttaacctgcca

SEQ ID NO: 93920 - DNA, 35 bp, Artificial Sequence
  Synthetic oligonucleotide
gattcgtgagagggtaggtggcatggctaaaagca

SEQ ID NO: 93921 - DNA, 36 bp, Artificial Sequence
  Synthetic oligonucleotide
acagggaggttgtagaaagggtactattgaccggca

SEQ ID NO: 93922 - DNA, 36 bp, Artificial Sequence
  Synthetic oligonucleotide
gcctccgttcacacatttagccccatttgctcggca

SEQ ID NO: 93923 - DNA, 36 bp, Artificial Sequence
  Synthetic oligonucleotide
tactagccccataacggacatatggcaccattctca

SEQ ID NO: 93924 - DNA, 35 bp, Artificial Sequence
  Synthetic oligonucleotide
agacgacacaattagcgctcttacgtacaccttca

SEQ ID NO: 93925 - DNA, 35 bp, Artificial Sequence
  Synthetic oligonucleotide
gatcgacatggtgaaggcgggatggagaatgaaga

SEQ ID NO: 93926 - DNA, 37 bp, Artificial Sequence
  Synthetic oligonucleotide
gcatcgcggctgtactctagcgcacccaccttcgaga

SEQ ID NO: 93927 - DNA, 37 bp, Artificial Sequence
  Synthetic oligonucleotide
gagtggatcgaaagggttcagcagctcgggggggaga

SEQ ID NO: 93928 - DNA, 36 bp, Artificial Sequence
  Synthetic oligonucleotide
acacgtagccggaagctagggacaattaaagataga

SEQ ID NO: 93929 - DNA, 37 bp, Artificial Sequence
  Synthetic oligonucleotide
gtctggcacagtctcaatgctatcttctagggaacga

SEQ ID NO: 93930 - DNA, 37 bp, Artificial Sequence
  Synthetic oligonucleotide
aacgcaacacaagtggtttgacacttgaccagtacga

SEQ ID NO: 93931 - DNA, 37 bp, Artificial Sequence
  Synthetic oligonucleotide
tttgccgagctgtatttgttcaatcgctccagaccga

SEQ ID NO: 93932 - DNA, 35 bp, Artificial Sequence
  Synthetic oligonucleotide
acccacctcaccctatcctattacggacggaccga

SEQ ID NO: 93933 - DNA, 37 bp, Artificial Sequence
  Synthetic oligonucleotide
accacatggcgggtgagattagcctgcgcattaccga

SEQ ID NO: 93934 - DNA, 37 bp, Artificial Sequence
  Synthetic oligonucleotide
aaggaaagggaaggtaggactgaacattggatagcga

SEQ ID NO: 93935 - DNA, 37 bp, Artificial Sequence
  Synthetic oligonucleotide
gagaaaaccgccacatctgttttagcctaacattcga

SEQ ID NO: 93936 - DNA, 37 bp, Artificial Sequence
  Synthetic oligonucleotide
acccgtccgctacatgatactttaacatgcctttcga

SEQ ID NO: 93937 - DNA, 37 bp, Artificial Sequence
  Synthetic oligonucleotide
ttagcgcacgagagcattgatggagataaaggacgga

SEQ ID NO: 93938 - DNA, 37 bp, Artificial Sequence
  Synthetic oligonucleotide
tcagtcgggcagggagggataggtaagcgggcaggga

SEQ ID NO: 93939 - DNA, 37 bp, Artificial Sequence
  Synthetic oligonucleotide
agtcgccgggcaagcaggagaaaggggaagggcggga

SEQ ID NO: 93940 - DNA, 37 bp, Artificial Sequence
  Synthetic oligonucleotide
tgagtggccacggggaacgagaagaagtatcggggga

SEQ ID NO: 93941 - DNA, 37 bp, Artificial Sequence
  Synthetic oligonucleotide
gtgtgcaacggcggtggggcacatgaatagtatggga

SEQ ID NO: 93942 - DNA, 37 bp, Artificial Sequence
  Synthetic oligonucleotide
gcgcatggcagtattctgcgttgcctcgtttcttgga

SEQ ID NO: 93943 - DNA, 38 bp, Artificial Sequence
  Synthetic oligonucleotide
gtcgaccttcgcaccactcagagacaagcaactcatga

SEQ ID NO: 93944 - DNA, 38 bp, Artificial Sequence
  Synthetic oligonucleotide
aaccgcaagagagctgcgaaatggaaaagtgtttatga

SEQ ID NO: 93945 - DNA, 38 bp, Artificial Sequence
  Synthetic oligonucleotide
tcatcgaagccgataggtatctgtttcatttgccctga

SEQ ID NO: 93946 - DNA, 35 bp, Artificial Sequence
  Synthetic oligonucleotide
gactgcacaagcgcacgaaatgattctgctcctga

SEQ ID NO: 93947 - DNA, 38 bp, Artificial Sequence
  Synthetic oligonucleotide
tcactggtgtcagatcatctttctttacattgctctga

SEQ ID NO: 93948 - DNA, 38 bp, Artificial Sequence
  Synthetic oligonucleotide
tactccgacactgtgccgcacctctcggcgttccgtga

SEQ ID NO: 93949 - DNA, 37 bp, Artificial Sequence
  Synthetic oligonucleotide
gagcaacacgcacatcatacccttaccatgtcggtga

SEQ ID NO: 93950 - DNA, 38 bp, Artificial Sequence
  Synthetic oligonucleotide
tgatcaggggggatggtgaatcactggttgatgggtga

SEQ ID NO: 93951 - DNA, 37 bp, Artificial Sequence
  Synthetic oligonucleotide
gaatccactacggttcttaagacagacttgccattga

SEQ ID NO: 93952 - DNA, 37 bp, Artificial Sequence
  Synthetic oligonucleotide
ttggtacatcctgattttcctgcggccactctattga

SEQ ID NO: 93953 - DNA, 37 bp, Artificial Sequence
  Synthetic oligonucleotide
gccacccgccttataaattagttcatccgccagttga

SEQ ID NO: 93954 - DNA, 35 bp, Artificial Sequence
  Synthetic oligonucleotide
tagtgctcatctgacttgtcttcgtaccttcaata

SEQ ID NO: 93955 - DNA, 36 bp, Artificial Sequence
  Synthetic oligonucleotide
gtcggagggcggtatctagggggggagggccagata

SEQ ID NO: 93956 - DNA, 36 bp, Artificial Sequence
  Synthetic oligonucleotide
gatgacgggcagggggatcgggggacattggcgata

SEQ ID NO: 93957 - DNA, 36 bp, Artificial Sequence
  Synthetic oligonucleotide
ttccgtacgctaccgagtgccggtattgaaccacta

SEQ ID NO: 93958 - DNA, 36 bp, Artificial Sequence
  Synthetic oligonucleotide
tatagcggcaccaatcaatgtccttgcccacgacta

SEQ ID NO: 93959 - DNA, 36 bp, Artificial Sequence
  Synthetic oligonucleotide
gacgtctggccacattgcttcgccgctccggatcta

SEQ ID NO: 93960 - DNA, 35 bp, Artificial Sequence
  Synthetic oligonucleotide
tcatccctactgagctggaattgatcagtccggta

SEQ ID NO: 93961 - DNA, 36 bp, Artificial Sequence
  Synthetic oligonucleotide
tctggtgaagcaaggttgggaaggcggatgtatgta

SEQ ID NO: 93962 - DNA, 36 bp, Artificial Sequence
  Synthetic oligonucleotide
tataaggaaggggagaagggagtggaaggtagtgta

SEQ ID NO: 93963 - DNA, 36 bp, Artificial Sequence
  Synthetic oligonucleotide
gccatcgacgccttgaatccggccgtacttaaatta

SEQ ID NO: 93964 - DNA, 36 bp, Artificial Sequence
  Synthetic oligonucleotide
gtttggcgacaaggcccactgtctactttccactta

SEQ ID NO: 93965 - DNA, 35 bp, Artificial Sequence
  Synthetic oligonucleotide
gctatgctccaaacgcggtgtgcggaacctcctta

SEQ ID NO: 93966 - DNA, 35 bp, Artificial Sequence
  Synthetic oligonucleotide
ggtcggtgtgctgcattcgtctggccatctcaaac

SEQ ID NO: 93967 - DNA, 35 bp, Artificial Sequence
  Synthetic oligonucleotide
gacacaacttgtgcttttctctatgatccttcgac

SEQ ID NO: 93968 - DNA, 35 bp, Artificial Sequence
  Synthetic oligonucleotide
attcgggcccgcaatcatatttcctttcgtcgtac

SEQ ID NO: 93969 - DNA, 35 bp, Artificial Sequence
  Synthetic oligonucleotide
gtccactgtgggcactatcgtttggtacgccttac

SEQ ID NO: 93970 - DNA, 35 bp, Artificial Sequence
  Synthetic oligonucleotide
aacagtcacagaaaacggtattgctgccggttacc

SEQ ID NO: 93971 - DNA, 35 bp, Artificial Sequence
  Synthetic oligonucleotide
acgcactcctaagacgccgccttatgcactccccc

SEQ ID NO: 93972 - DNA, 35 bp, Artificial Sequence
  Synthetic oligonucleotide
accccaatcccccgcctctgtgaaggtcctgtgcc

SEQ ID NO: 93973 - DNA, 35 bp, Artificial Sequence
  Synthetic oligonucleotide
gttaccgcccgattcccaagggatcttcggcctcc

SEQ ID NO: 93974 - DNA, 35 bp, Artificial Sequence
  Synthetic oligonucleotide
tccacgaggaacaaggactgcaagagggaaaccgc

SEQ ID NO: 93975 - DNA, 35 bp, Artificial Sequence
  Synthetic oligonucleotide
tacgaacaggtaggcggatgagtgtggcgtccggc

SEQ ID NO: 93976 - DNA, 35 bp, Artificial Sequence
  Synthetic oligonucleotide
gcgcaaccgtgcgctaccgaatgtccttgtcgtgc

SEQ ID NO: 93977 - DNA, 35 bp, Artificial Sequence
  Synthetic oligonucleotide
gccaccggcacggacattacaaccgcaccttaatc

SEQ ID NO: 93978 - DNA, 35 bp, Artificial Sequence
  Synthetic oligonucleotide
cgaccacccgtttaggttaggctccacctcaactc

SEQ ID NO: 93979 - DNA, 35 bp, Artificial Sequence
  Synthetic oligonucleotide
gccacgcaccgcaacctgacacatcccgtgacctc

SEQ ID NO: 93980 - DNA, 35 bp, Artificial Sequence
  Synthetic oligonucleotide
tccactatcgcaaggctcaccgggagaactatctc

SEQ ID NO: 93981 - DNA, 35 bp, Artificial Sequence
  Synthetic oligonucleotide
gaaggtggagaagcaggtgctatttgaaggttgag

SEQ ID NO: 93982 - DNA, 35 bp, Artificial Sequence
  Synthetic oligonucleotide
gtggggggacgggcgggggtggaaagaatgggtag

SEQ ID NO: 93983 - DNA, 35 bp, Artificial Sequence
  Synthetic oligonucleotide
gtgtggtgcacaaaagaaaggctaaagggagccgg

SEQ ID NO: 93984 - DNA, 35 bp, Artificial Sequence
  Synthetic oligonucleotide
gtgtacgggggagaaagtataggcgaaggtatcgg

SEQ ID NO: 93985 - DNA, 35 bp, Artificial Sequence
  Synthetic oligonucleotide
gcacgaaccgtcatacatcggagtatttggaatgg

SEQ ID NO: 93986 - DNA, 35 bp, Artificial Sequence
  Synthetic oligonucleotide
tcaatagcccaggactgcgtacagatctccgctgg

SEQ ID NO: 93987 - DNA, 35 bp, Artificial Sequence
  Synthetic oligonucleotide
tcatccgccggccaaaggctgtcacgtgccaactg

SEQ ID NO: 93988 - DNA, 35 bp, Artificial Sequence
  Synthetic oligonucleotide
gcacaacggtgcctttgagttggatccatttagtg

SEQ ID NO: 93989 - DNA, 35 bp, Artificial Sequence
  Synthetic oligonucleotide
gagggaggaatagcgtagtaataggggaggccgtg

SEQ ID NO: 93990 - DNA, 35 bp, Artificial Sequence
  Synthetic oligonucleotide
tgaggccacagggaacgttcgttggaggaaaggtg

SEQ ID NO: 93991 - DNA, 35 bp, Artificial Sequence
  Synthetic oligonucleotide
atgtccgaccccgcatccagtagcccgccgccttg

SEQ ID NO: 93992 - DNA, 35 bp, Artificial Sequence
  Synthetic oligonucleotide
gctacgtctgcttcgttttacagccccaatctact

SEQ ID NO: 93993 - DNA, 35 bp, Artificial Sequence
  Synthetic oligonucleotide
tctagacaacgcaggtctatcttagtatgtttcgt

SEQ ID NO: 93994 - DNA, 35 bp, Artificial Sequence
  Synthetic oligonucleotide
tacgctgagcgaaggaagaaaaactgtgcctgggt

SEQ ID NO: 93995 - DNA, 35 bp, Artificial Sequence
  Synthetic oligonucleotide
gtgacgaacccataggaaagggaaagaatagcatt

SEQ ID NO: 93996 - DNA, 35 bp, Artificial Sequence
  Synthetic oligonucleotide
tcaacgaatgatggaaaggttgcatggggagtatt

SEQ ID NO: 93997 - DNA, 35 bp, Artificial Sequence
  Synthetic oligonucleotide
agtgagaggagtcgaaggatagcgaaacggcagtt

SEQ ID NO: 93998 - DNA, 35 bp, Artificial Sequence
  Synthetic oligonucleotide
aatgcgaccagctgggaaagtgcgcgattgacttt

SEQ ID NO: 93999 - DNA, 35 bp, Artificial Sequence
  Synthetic oligonucleotide
accacttcagctcttagggtcttacactttctttt

SEQ ID NO: 94000 - DNA, 35 bp, Artificial Sequence
  Synthetic oligonucleotide
tgctgtggcggatcactactccgaccaattttttt

SEQ ID NO: 94001 - DNA, 36 bp, Artificial Sequence
  Synthetic oligonucleotide
aacacgacaagtcccgttataggtggttggttgcaa

SEQ ID NO: 94002 - DNA, 36 bp, Artificial Sequence
  Synthetic oligonucleotide
aggagcacatgtgtcgaccccggatccaccttcgaa

SEQ ID NO: 94003 - DNA, 35 bp, Artificial Sequence
  Synthetic oligonucleotide
tgtcgccacgcttgagatatcgcacctcgttctaa

SEQ ID NO: 94004 - DNA, 36 bp, Artificial Sequence
  Synthetic oligonucleotide
gcacatcacaggttctattagtatggcccatcgtaa

SEQ ID NO: 94005 - DNA, 36 bp, Artificial Sequence
  Synthetic oligonucleotide
gatgccggggaagaatatcgggaacggtcggacaca

SEQ ID NO: 94006 - DNA, 36 bp, Artificial Sequence
  Synthetic oligonucleotide
tacgacagggggatgccacgaagcaaggccgggaca

SEQ ID NO: 94007 - DNA, 36 bp, Artificial Sequence
  Synthetic oligonucleotide
tcctcaacaccgggtgccgtgttttgatctaaccca

SEQ ID NO: 94008 - DNA, 36 bp, Artificial Sequence
  Synthetic oligonucleotide
gttcgcaagctcttctgacctttgatagcgcaccca

SEQ ID NO: 94009 - DNA, 36 bp, Artificial Sequence
  Synthetic oligonucleotide
atccaccctgtccagtttagttttctatcgttgcca

SEQ ID NO: 94010 - DNA, 36 bp, Artificial Sequence
  Synthetic oligonucleotide
agatgctagtgggggggtgaaatgacgattgcatca

SEQ ID NO: 94011 - DNA, 36 bp, Artificial Sequence
  Synthetic oligonucleotide
gtgctaatcacactgtcatttatctgtccgtcatca

SEQ ID NO: 94012 - DNA, 37 bp, Artificial Sequence
  Synthetic oligonucleotide
gatctcaatgcctgtgtaccatccccgccctccttca

SEQ ID NO: 94013 - DNA, 37 bp, Artificial Sequence
  Synthetic oligonucleotide
agtgccccgcaatagagacacgagagataggtgaaga

SEQ ID NO: 94014 - DNA, 35 bp, Artificial Sequence
  Synthetic oligonucleotide
agaggcatggaaatagggtggtgggtgagggcaga

SEQ ID NO: 94015 - DNA, 37 bp, Artificial Sequence
  Synthetic oligonucleotide
tgttcgcgcggtcgagaaagggggactaggggcgaga

SEQ ID NO: 94016 - DNA, 36 bp, Artificial Sequence
  Synthetic oligonucleotide
gtattagcacggggagagatcggaggctgggggaga

SEQ ID NO: 94017 - DNA, 36 bp, Artificial Sequence
  Synthetic oligonucleotide
agtgaagaccggaaatgggaaatcagaaaggtgaga

SEQ ID NO: 94018 - DNA, 36 bp, Artificial Sequence
  Synthetic oligonucleotide
agaacagccacacactttctcgccaggaacactaga

SEQ ID NO: 94019 - DNA, 37 bp, Artificial Sequence
  Synthetic oligonucleotide
gactcagagtgggcataaggcgggtgttggaggtaga

SEQ ID NO: 94020 - DNA, 37 bp, Artificial Sequence
  Synthetic oligonucleotide
gacaccccgcctcgtaggtataagttaacacgttaga

SEQ ID NO: 94021 - DNA, 37 bp, Artificial Sequence
  Synthetic oligonucleotide
gagaccgcgggggtttgatggggaggggaaagaacga

SEQ ID NO: 94022 - DNA, 37 bp, Artificial Sequence
  Synthetic oligonucleotide
gcagggagggagaattagcaggataaagcacgtacga

SEQ ID NO: 94023 - DNA, 37 bp, Artificial Sequence
  Synthetic oligonucleotide
gtcgccgctgaattttcgcgacttaatcttatcccga

SEQ ID NO: 94024 - DNA, 37 bp, Artificial Sequence
  Synthetic oligonucleotide
tgactggtcaggcgtgagatgagatgtgggggtgcga

SEQ ID NO: 94025 - DNA, 37 bp, Artificial Sequence
  Synthetic oligonucleotide
gtacaaatgcgggaatgggggcggaaggaacaatcga

SEQ ID NO: 94026 - DNA, 37 bp, Artificial Sequence
  Synthetic oligonucleotide
tacgcagccgccccggctattgtacgctccacctcga

SEQ ID NO: 94027 - DNA, 37 bp, Artificial Sequence
  Synthetic oligonucleotide
gtggaacctcctttgtagtatcatcacctcaacagga

SEQ ID NO: 94028 - DNA, 37 bp, Artificial Sequence
  Synthetic oligonucleotide
tcagggtgtagaggttgtggggatggaagtgcaggga

SEQ ID NO: 94029 - DNA, 37 bp, Artificial Sequence
  Synthetic oligonucleotide
tggacacgacgacgtgtgttggacggggagagaggga

SEQ ID NO: 94030 - DNA, 35 bp, Artificial Sequence
  Synthetic oligonucleotide
ttccgcgaagagaaacgggatgcagtctcatggga

SEQ ID NO: 94031 - DNA, 37 bp, Artificial Sequence
  Synthetic oligonucleotide
gatcacgcaatgtagctggcttaggaaggggatggga

SEQ ID NO: 94032 - DNA, 37 bp, Artificial Sequence
  Synthetic oligonucleotide
gacgcctacgcatcaaaacgtgcacttttaccctgga

SEQ ID NO: 94033 - DNA, 36 bp, Artificial Sequence
  Synthetic oligonucleotide
gacgcacgggggggggcagtgcaaaacaaaggtgga

SEQ ID NO: 94034 - DNA, 37 bp, Artificial Sequence
  Synthetic oligonucleotide
gtcactgcaccattgtttcgcgttacctcctggtgga

SEQ ID NO: 94035 - DNA, 38 bp, Artificial Sequence
  Synthetic oligonucleotide
gccttcgccggttgcaatcggacccacctttacaatga

SEQ ID NO: 94036 - DNA, 37 bp, Artificial Sequence
  Synthetic oligonucleotide
gacccctccttcattgcacccgagtcgactgacatga

SEQ ID NO: 94037 - DNA, 38 bp, Artificial Sequence
  Synthetic oligonucleotide
gcgaatgcgacgcacgtggtctgctgtacatggcatga

SEQ ID NO: 94038 - DNA, 38 bp, Artificial Sequence
  Synthetic oligonucleotide
acactacttccgcacagttcgagatcccacatcgatga

SEQ ID NO: 94039 - DNA, 38 bp, Artificial Sequence
  Synthetic oligonucleotide
aagcgatgagatccgggaggaatgaaggaggtggatga

SEQ ID NO: 94040 - DNA, 38 bp, Artificial Sequence
  Synthetic oligonucleotide
attgcccctcacttgtgttctctcccagtccagtatga

SEQ ID NO: 94041 - DNA, 38 bp, Artificial Sequence
  Synthetic oligonucleotide
gttacctcgggccacttgcatagttccggtcttactga

SEQ ID NO: 94042 - DNA, 37 bp, Artificial Sequence
  Synthetic oligonucleotide
ttccgaagcctctgtcgaataattccgcctcatctga

SEQ ID NO: 94043 - DNA, 37 bp, Artificial Sequence
  Synthetic oligonucleotide
acctaggaggtggagaagtggaggaagcgagatctga

SEQ ID NO: 94044 - DNA, 38 bp, Artificial Sequence
  Synthetic oligonucleotide
acatcgcgctggttggtggtagtgctctcgatctctga

SEQ ID NO: 94045 - DNA, 38 bp, Artificial Sequence
  Synthetic oligonucleotide
gagacaaccgttagaaacgccatcgagggggccagtga

SEQ ID NO: 94046 - DNA, 38 bp, Artificial Sequence
  Synthetic oligonucleotide
tcacggacgggttgagagagggaaagatcgatcagtga

SEQ ID NO: 94047 - DNA, 36 bp, Artificial Sequence
  Synthetic oligonucleotide
acgccacatcgcgcgccttttcgttccgtaacgtga

SEQ ID NO: 94048 - DNA, 38 bp, Artificial Sequence
  Synthetic oligonucleotide
gaacagccacggtgcgatgcatggggggagggacgtga

SEQ ID NO: 94049 - DNA, 38 bp, Artificial Sequence
  Synthetic oligonucleotide
ggggaacgacggtgagttagccggcgaagaaaaggtga

SEQ ID NO: 94050 - DNA, 37 bp, Artificial Sequence
  Synthetic oligonucleotide
gagaggagtagtagtgtaagacgggtaagaggggtga

SEQ ID NO: 94051 - DNA, 36 bp, Artificial Sequence
  Synthetic oligonucleotide
taggaagtgcgcatgataaagttgcgaaaatggtga

SEQ ID NO: 94052 - DNA, 37 bp, Artificial Sequence
  Synthetic oligonucleotide
gacgcgggaatagtgcaatggggctttagaatggtga

SEQ ID NO: 94053 - DNA, 38 bp, Artificial Sequence
  Synthetic oligonucleotide
tgccacgcacggcgcctatcgtttcccataatatgtga

SEQ ID NO: 94054 - DNA, 38 bp, Artificial Sequence
  Synthetic oligonucleotide
accacgtcatcgacctctaaccacagtacatgctgtga

SEQ ID NO: 94055 - DNA, 38 bp, Artificial Sequence
  Synthetic oligonucleotide
gatggggatgagtgcgacggaatcttagtcgtgtgtga

SEQ ID NO: 94056 - DNA, 37 bp, Artificial Sequence
  Synthetic oligonucleotide
atgtcaaggaggtggagggtcggataggaccaattga

SEQ ID NO: 94057 - DNA, 38 bp, Artificial Sequence
  Synthetic oligonucleotide
gcacgcatacgtccggtctctcttctggggtcaattga

SEQ ID NO: 94058 - DNA, 38 bp, Artificial Sequence
  Synthetic oligonucleotide
gacaccgaccacaaccctaggtagcagtttacccttga

SEQ ID NO: 94059 - DNA, 36 bp, Artificial Sequence
  Synthetic oligonucleotide
gacgtacaggccaaccgagtacgtcacggtccttga

SEQ ID NO: 94060 - DNA, 37 bp, Artificial Sequence
  Synthetic oligonucleotide
tgcggaaacgagaaagggtggaatgcagtgggcttga

SEQ ID NO: 94061 - DNA, 38 bp, Artificial Sequence
  Synthetic oligonucleotide
gtacgtgcgtaccccattatttaacgcgtccatcttga

SEQ ID NO: 94062 - DNA, 37 bp, Artificial Sequence
  Synthetic oligonucleotide
aatgccgccgggcgagttgctttcgtctcatctttga

SEQ ID NO: 94063 - DNA, 36 bp, Artificial Sequence
  Synthetic oligonucleotide
gcacatcgtggggtaatgggggtgaggcggttttga

SEQ ID NO: 94064 - DNA, 35 bp, Artificial Sequence
  Synthetic oligonucleotide
gacgaagcacggagctgaaatgagatggtgaaata

SEQ ID NO: 94065 - DNA, 36 bp, Artificial Sequence
  Synthetic oligonucleotide
ttgcggtgcactcgagccctcgcgatcccctcgata

SEQ ID NO: 94066 - DNA, 36 bp, Artificial Sequence
  Synthetic oligonucleotide
attcccgaacagcttgccccttcgacagtgacccta

SEQ ID NO: 94067 - DNA, 36 bp, Artificial Sequence
  Synthetic oligonucleotide
gacgcatcagaggattgctccgtagttgcaggggta

SEQ ID NO: 94068 - DNA, 35 bp, Artificial Sequence
  Synthetic oligonucleotide
atgcccgtataatgcgcgtgcctgttcaccctgta

SEQ ID NO: 94069 - DNA, 35 bp, Artificial Sequence
  Synthetic oligonucleotide
tgtaaacctactgccacggacaggccttttctgta

SEQ ID NO: 94070 - DNA, 35 bp, Artificial Sequence
  Synthetic oligonucleotide
gccactattcgaccacgcatggactattcaactta

SEQ ID NO: 94071 - DNA, 36 bp, Artificial Sequence
  Synthetic oligonucleotide
tagacccacggcgaagcgaaccaggggaacgggtta

SEQ ID NO: 94072 - DNA, 36 bp, Artificial Sequence
  Synthetic oligonucleotide
tgtcaaccggccccaaaacggttgagggatacttta

SEQ ID NO: 94073 - DNA, 35 bp, Artificial Sequence
  Synthetic oligonucleotide
attagcgcgcacatgccaagctcctaggccctaac

SEQ ID NO: 94074 - DNA, 35 bp, Artificial Sequence
  Synthetic oligonucleotide
gatccgcacactttcgcctgtcaagccgcacttac

SEQ ID NO: 94075 - DNA, 35 bp, Artificial Sequence
  Synthetic oligonucleotide
gaccacctccgtgttatccatgtataggcccttac

SEQ ID NO: 94076 - DNA, 35 bp, Artificial Sequence
  Synthetic oligonucleotide
atgctgcacaaccttacagcaaactagtgttttac

SEQ ID NO: 94077 - DNA, 34 bp, Artificial Sequence
  Synthetic oligonucleotide
aactgacccggatggcaaaaaacatttggtaacc

SEQ ID NO: 94078 - DNA, 35 bp, Artificial Sequence
  Synthetic oligonucleotide
agcctcacaactgttgtgcttccggacaccccccc

SEQ ID NO: 94079 - DNA, 35 bp, Artificial Sequence
  Synthetic oligonucleotide
tatgtcaggaaacgggaggagcaacggtaatagcc

SEQ ID NO: 94080 - DNA, 35 bp, Artificial Sequence
  Synthetic oligonucleotide
atccatgcacgtccttagccttatggactagggcc

SEQ ID NO: 94081 - DNA, 35 bp, Artificial Sequence
  Synthetic oligonucleotide
acagccgcaactaaaaagacattcgtacccggtcc

SEQ ID NO: 94082 - DNA, 35 bp, Artificial Sequence
  Synthetic oligonucleotide
atgccgtcggtcctcgcgcatggccactaccttcc

SEQ ID NO: 94083 - DNA, 35 bp, Artificial Sequence
  Synthetic oligonucleotide
atgctcgccgggctggttggtggcctgcgctttcc

SEQ ID NO: 94084 - DNA, 35 bp, Artificial Sequence
  Synthetic oligonucleotide
gcacgaccgccgaggtagctcgggaccaattccgc

SEQ ID NO: 94085 - DNA, 35 bp, Artificial Sequence
  Synthetic oligonucleotide
ttgacgaccgccgtacctctgtgcatagggcgcgc

SEQ ID NO: 94086 - DNA, 35 bp, Artificial Sequence
  Synthetic oligonucleotide
gtcacaacgtatcggcttcgtatcttccttggggc

SEQ ID NO: 94087 - DNA, 35 bp, Artificial Sequence
  Synthetic oligonucleotide
tttgcacatcggcgattgagcgcaacccgcatggc

SEQ ID NO: 94088 - DNA, 35 bp, Artificial Sequence
  Synthetic oligonucleotide
tcccatcacccgccacataacgtccggcccttggc

SEQ ID NO: 94089 - DNA, 35 bp, Artificial Sequence
  Synthetic oligonucleotide
tcagtcgccaaaacgcgtaagttcgcctagcctgc

SEQ ID NO: 94090 - DNA, 35 bp, Artificial Sequence
  Synthetic oligonucleotide
tgtgcgggcatttcattttgttgcggttttggatc

SEQ ID NO: 94091 - DNA, 35 bp, Artificial Sequence
  Synthetic oligonucleotide
tctccaccctcaagtttgttcgactgtgcgccctc

SEQ ID NO: 94092 - DNA, 35 bp, Artificial Sequence
  Synthetic oligonucleotide
tggactgagacctcctatatgtaccatccctcctc

SEQ ID NO: 94093 - DNA, 35 bp, Artificial Sequence
  Synthetic oligonucleotide
agtaccggaccgaaaaggggaggacattttcattc

SEQ ID NO: 94094 - DNA, 35 bp, Artificial Sequence
  Synthetic oligonucleotide
gctcacaacagttgactgtggggccccaatccttc

SEQ ID NO: 94095 - DNA, 35 bp, Artificial Sequence
  Synthetic oligonucleotide
tgcaagagtactggtcccatctcagaatagctttc

SEQ ID NO: 94096 - DNA, 35 bp, Artificial Sequence
  Synthetic oligonucleotide
tgcggagagagctgacgcggggggagagaataaag

SEQ ID NO: 94097 - DNA, 35 bp, Artificial Sequence
  Synthetic oligonucleotide
acacgtgcaggcgttaacggggggaatgataggag

SEQ ID NO: 94098 - DNA, 35 bp, Artificial Sequence
  Synthetic oligonucleotide
aacctgtagagtaggagttgtggaagggtacggag

SEQ ID NO: 94099 - DNA, 35 bp, Artificial Sequence
  Synthetic oligonucleotide
ttgctcggcatgagtaacggaacgggggaggagcg

SEQ ID NO: 94100 - DNA, 35 bp, Artificial Sequence
  Synthetic oligonucleotide
acttcctccgtacgccataagtagcacgactcgcg

SEQ ID NO: 94101 - DNA, 35 bp, Artificial Sequence
  Synthetic oligonucleotide
gtcgaaagggcgaaattgagtgtgatgaccggtcg

SEQ ID NO: 94102 - DNA, 35 bp, Artificial Sequence
  Synthetic oligonucleotide
ggaggaccaaaccaggtagaacggggggaagaagg

SEQ ID NO: 94103 - DNA, 35 bp, Artificial Sequence
  Synthetic oligonucleotide
acctccccaccccatattcgtcatagtgagacagg

SEQ ID NO: 94104 - DNA, 35 bp, Artificial Sequence
  Synthetic oligonucleotide
gtgtccgggtggaagagtaggatgagaggaaatgg

SEQ ID NO: 94105 - DNA, 35 bp, Artificial Sequence
  Synthetic oligonucleotide
tccaaccctctctgtcattgcccggttcggtctgg

SEQ ID NO: 94106 - DNA, 35 bp, Artificial Sequence
  Synthetic oligonucleotide
gatgcgttgaggaattcggtgggcaaagatggtgg

SEQ ID NO: 94107 - DNA, 35 bp, Artificial Sequence
  Synthetic oligonucleotide
tctgtgggactgaagggcagagaactgcgaggatg

SEQ ID NO: 94108 - DNA, 35 bp, Artificial Sequence
  Synthetic oligonucleotide
tccgatcctccctctctcattgcctgtacagcttg

SEQ ID NO: 94109 - DNA, 35 bp, Artificial Sequence
  Synthetic oligonucleotide
gaagggacaatggacaaaatgacgtgcagggacat

SEQ ID NO: 94110 - DNA, 35 bp, Artificial Sequence
  Synthetic oligonucleotide
gacaggagatgagttggggggtggaatacgaggat

SEQ ID NO: 94111 - DNA, 35 bp, Artificial Sequence
  Synthetic oligonucleotide
ttggactcacaccagttccgtatcgacgtatgtat

SEQ ID NO: 94112 - DNA, 35 bp, Artificial Sequence
  Synthetic oligonucleotide
aacgcgtttagcataacacccccgccatcactgct

SEQ ID NO: 94113 - DNA, 35 bp, Artificial Sequence
  Synthetic oligonucleotide
agtcccatcaggcactcactcagttcaactcccgt

SEQ ID NO: 94114 - DNA, 35 bp, Artificial Sequence
  Synthetic oligonucleotide
tacgccgactgggttgggtgatccgtacgtttctt

SEQ ID NO: 94115 - DNA, 35 bp, Artificial Sequence
  Synthetic oligonucleotide
tagtaccggcctggactcccaacatacccctagtt

SEQ ID NO: 94116 - DNA, 35 bp, Artificial Sequence
  Synthetic oligonucleotide
gaacgctgcatcaacctgcgtactctgtcgtgttt

SEQ ID NO: 94117 - DNA, 35 bp, Artificial Sequence
  Synthetic oligonucleotide
taggaccacgcatcttcctgagctgcccttttttt

SEQ ID NO: 94118 - DNA, 36 bp, Artificial Sequence
  Synthetic oligonucleotide
gctaaccctcgggtggactacctcaacatggccaaa

SEQ ID NO: 94119 - DNA, 36 bp, Artificial Sequence
  Synthetic oligonucleotide
acaagggtacgaggtgaggaactcgggtgtaagaaa

SEQ ID NO: 94120 - DNA, 35 bp, Artificial Sequence
  Synthetic oligonucleotide
tgtgcccgacgaccatctctcatgccctctggaaa

SEQ ID NO: 94121 - DNA, 35 bp, Artificial Sequence
  Synthetic oligonucleotide
gcgcaccctacagtagttgccatcctgatctgaaa

SEQ ID NO: 94122 - DNA, 36 bp, Artificial Sequence
  Synthetic oligonucleotide
tgcatacagcatactaaacagtccgctccaccccaa

SEQ ID NO: 94123 - DNA, 36 bp, Artificial Sequence
  Synthetic oligonucleotide
gtcgcaccgctttcgccacttccagtccttccgcaa

SEQ ID NO: 94124 - DNA, 36 bp, Artificial Sequence
  Synthetic oligonucleotide
acactactagccgcacatatgccaggctctccctaa

SEQ ID NO: 94125 - DNA, 36 bp, Artificial Sequence
  Synthetic oligonucleotide
gagggggtgcgggaagggccgacgagttgcacgtaa

SEQ ID NO: 94126 - DNA, 36 bp, Artificial Sequence
  Synthetic oligonucleotide
accccgccgcccctagaccctggttatcgctggaca

SEQ ID NO: 94127 - DNA, 35 bp, Artificial Sequence
  Synthetic oligonucleotide
acactcgcgcgaggaaagcctttgtccctcagcca

SEQ ID NO: 94128 - DNA, 35 bp, Artificial Sequence
  Synthetic oligonucleotide
aacacacggcgtcgcccgcttacccagtcatgcca

SEQ ID NO: 94129 - DNA, 36 bp, Artificial Sequence
  Synthetic oligonucleotide
tagtgcgtacaggctctacgacgttgccttcttcca

SEQ ID NO: 94130 - DNA, 35 bp, Artificial Sequence
  Synthetic oligonucleotide
tcacccgtccatcagataactcagctatagtagca

SEQ ID NO: 94131 - DNA, 36 bp, Artificial Sequence
  Synthetic oligonucleotide
acacgagatcaatgcctctcatgcacaagctccgca

SEQ ID NO: 94132 - DNA, 36 bp, Artificial Sequence
  Synthetic oligonucleotide
atccgccttccgaccgcatcgtcgtacaattcctca

SEQ ID NO: 94133 - DNA, 36 bp, Artificial Sequence
  Synthetic oligonucleotide
tagccggagtcgttgatccatcaaacgtcatgctca

SEQ ID NO: 94134 - DNA, 36 bp, Artificial Sequence
  Synthetic oligonucleotide
tgacccacgtcttgcgttctattctgcgatgattca

SEQ ID NO: 94135 - DNA, 36 bp, Artificial Sequence
  Synthetic oligonucleotide
aacgttgcaggatcagtaactttcactttgcccaga

SEQ ID NO: 94136 - DNA, 37 bp, Artificial Sequence
  Synthetic oligonucleotide
aacacagtaggtggccgtcacgttcatctctccacga

SEQ ID NO: 94137 - DNA, 37 bp, Artificial Sequence
  Synthetic oligonucleotide
actcaccggctgatcaccgcctcgaaagatatcgcga

SEQ ID NO: 94138 - DNA, 37 bp, Artificial Sequence
  Synthetic oligonucleotide
tacggaaggcggacaacgcgaatgggctggcaaagga

SEQ ID NO: 94139 - DNA, 37 bp, Artificial Sequence
  Synthetic oligonucleotide
tcacgtggagggggagtaggtgactcgccagggagga

SEQ ID NO: 94140 - DNA, 37 bp, Artificial Sequence
  Synthetic oligonucleotide
ggggaggcagtagggggaaagggggcttgcgtgagga

SEQ ID NO: 94141 - DNA, 37 bp, Artificial Sequence
  Synthetic oligonucleotide
tccgacgaagcactgggaaggagagtccatcgccgga

SEQ ID NO: 94142 - DNA, 37 bp, Artificial Sequence
  Synthetic oligonucleotide
gtccacttcggttgcaaacattcgcccctactccgga

SEQ ID NO: 94143 - DNA, 37 bp, Artificial Sequence
  Synthetic oligonucleotide
tcaacgccgttagttccccagtgttcgcaattccgga

SEQ ID NO: 94144 - DNA, 37 bp, Artificial Sequence
  Synthetic oligonucleotide
tccacctgaagccgtgcgtacttaacacatccgcgga

SEQ ID NO: 94145 - DNA, 37 bp, Artificial Sequence
  Synthetic oligonucleotide
gccatgccaaacgtgccagcttcctacatcacaggga

SEQ ID NO: 94146 - DNA, 37 bp, Artificial Sequence
  Synthetic oligonucleotide
atgagtcgcactgcaaagtaatggaaaagttagggga

SEQ ID NO: 94147 - DNA, 36 bp, Artificial Sequence
  Synthetic oligonucleotide
tcgagagcctgagagggtggttgggtgcgaggggga

SEQ ID NO: 94148 - DNA, 37 bp, Artificial Sequence
  Synthetic oligonucleotide
tctgagcaaggtgggggccgttcacgagtggggggga

SEQ ID NO: 94149 - DNA, 36 bp, Artificial Sequence
  Synthetic oligonucleotide
aagacgccccacggtggtgaggtaagggctggggga

SEQ ID NO: 94150 - DNA, 37 bp, Artificial Sequence
  Synthetic oligonucleotide
aagtagacgtaacaggagtacaaagcagaggtgggga

SEQ ID NO: 94151 - DNA, 37 bp, Artificial Sequence
  Synthetic oligonucleotide
tcaatgggcgtaagggaggattcagggattgtgggga

SEQ ID NO: 94152 - DNA, 37 bp, Artificial Sequence
  Synthetic oligonucleotide
atggactacgccacactaaacagtaattgtcactgga

SEQ ID NO: 94153 - DNA, 37 bp, Artificial Sequence
  Synthetic oligonucleotide
tacaactacagatccgcggatcgtagccacacctgga

SEQ ID NO: 94154 - DNA, 37 bp, Artificial Sequence
  Synthetic oligonucleotide
gtggggatgggcgctggatcactgacgtagtattgga

SEQ ID NO: 94155 - DNA, 37 bp, Artificial Sequence
  Synthetic oligonucleotide
gccacggccattcccggtactgcgccacaggcttgga

SEQ ID NO: 94156 - DNA, 38 bp, Artificial Sequence
  Synthetic oligonucleotide
tgcgaacgagggaacggggggtggacgcagggaaatga

SEQ ID NO: 94157 - DNA, 36 bp, Artificial Sequence
  Synthetic oligonucleotide
gaaaccgtagcgcattccatgttcgttcccacatga

SEQ ID NO: 94158 - DNA, 37 bp, Artificial Sequence
  Synthetic oligonucleotide
aatgcccggccaattcccctccatgtcattaatatga

SEQ ID NO: 94159 - DNA, 38 bp, Artificial Sequence
  Synthetic oligonucleotide
atgcgatacagcaagcgtattgcacccccaatatatga

SEQ ID NO: 94160 - DNA, 38 bp, Artificial Sequence
  Synthetic oligonucleotide
tatgcaacgtatgagggtgagggtcggggagggtatga

SEQ ID NO: 94161 - DNA, 38 bp, Artificial Sequence
  Synthetic oligonucleotide
gtccgggttggagcggggcgagggcgtagtatcactga

SEQ ID NO: 94162 - DNA, 38 bp, Artificial Sequence
  Synthetic oligonucleotide
ttagtcgccgatctttttgccaatgccgcacctgctga

SEQ ID NO: 94163 - DNA, 38 bp, Artificial Sequence
  Synthetic oligonucleotide
tctagcacgggccacaatccgaataggtaatcatctga

SEQ ID NO: 94164 - DNA, 38 bp, Artificial Sequence
  Synthetic oligonucleotide
gtggcggggaacggaaatagggaattgcattgatctga

SEQ ID NO: 94165 - DNA, 38 bp, Artificial Sequence
  Synthetic oligonucleotide
gcacgcatccgcaatgatttacgctctcacatctctga

SEQ ID NO: 94166 - DNA, 38 bp, Artificial Sequence
  Synthetic oligonucleotide
gatgccgggcactgatgttaagtgtcattgcaaagtga

SEQ ID NO: 94167 - DNA, 38 bp, Artificial Sequence
  Synthetic oligonucleotide
tcaacgcggtagggaatgaacgtggggttgcgaagtga

SEQ ID NO: 94168 - DNA, 37 bp, Artificial Sequence
  Synthetic oligonucleotide
gttgggccccagccatttgatccttgtcccacagtga

SEQ ID NO: 94169 - DNA, 37 bp, Artificial Sequence
  Synthetic oligonucleotide
gtgtagcacgtatggaaagggggcctgcgagtagtga

SEQ ID NO: 94170 - DNA, 35 bp, Artificial Sequence
  Synthetic oligonucleotide
atcatgcgtaacccccagtccttcctctgtcgtga

SEQ ID NO: 94171 - DNA, 37 bp, Artificial Sequence
  Synthetic oligonucleotide
ggaggagaaggtgggatagagctgcaggacagggtga

SEQ ID NO: 94172 - DNA, 37 bp, Artificial Sequence
  Synthetic oligonucleotide
gaaacacgcctcattcatgcgtcgacgtactctgtga

SEQ ID NO: 94173 - DNA, 37 bp, Artificial Sequence
  Synthetic oligonucleotide
gctccactaacacgcattatgactagtccgcttgtga

SEQ ID NO: 94174 - DNA, 38 bp, Artificial Sequence
  Synthetic oligonucleotide
gtgtggcgatgatctctagccgacgccctatcttgtga

SEQ ID NO: 94175 - DNA, 38 bp, Artificial Sequence
  Synthetic oligonucleotide
gatgctgagggtgaatagagcaatgaggacatgattga

SEQ ID NO: 94176 - DNA, 38 bp, Artificial Sequence
  Synthetic oligonucleotide
tgactcaccctgtagctggtgggcttcaacacccttga

SEQ ID NO: 94177 - DNA, 35 bp, Artificial Sequence
  Synthetic oligonucleotide
attatccgccggtcagttattaggccctatcttga

SEQ ID NO: 94178 - DNA, 38 bp, Artificial Sequence
  Synthetic oligonucleotide
tcgaccataccttctcgccataatgtcagtcctcttga

SEQ ID NO: 94179 - DNA, 38 bp, Artificial Sequence
  Synthetic oligonucleotide
gagacaacgtacaaacgagggagggcggaaggctttga

SEQ ID NO: 94180 - DNA, 36 bp, Artificial Sequence
  Synthetic oligonucleotide
ttgacttccgccccgtacacgccttgcctgctacta

SEQ ID NO: 94181 - DNA, 36 bp, Artificial Sequence
  Synthetic oligonucleotide
gtgccgaatcccgtgatgccgttcctgcttggccta

SEQ ID NO: 94182 - DNA, 36 bp, Artificial Sequence
  Synthetic oligonucleotide
tgatccgtacgtcgattcttctaggtccaatgccta

SEQ ID NO: 94183 - DNA, 36 bp, Artificial Sequence
  Synthetic oligonucleotide
tatcgcgagcagtacgcgatgacgtcgccagttcta

SEQ ID NO: 94184 - DNA, 35 bp, Artificial Sequence
  Synthetic oligonucleotide
tgccactttgcgccacgtttctccctaagctagta

SEQ ID NO: 94185 - DNA, 36 bp, Artificial Sequence
  Synthetic oligonucleotide
gaaacccccaaccgtgtagcgaacgccgtcaacgta

SEQ ID NO: 94186 - DNA, 36 bp, Artificial Sequence
  Synthetic oligonucleotide
actagcgcggtgaaggcgaggggacgtggggactta

SEQ ID NO: 94187 - DNA, 35 bp, Artificial Sequence
  Synthetic oligonucleotide
atctcctgctgtccgaccttattacatcaaagtta

SEQ ID NO: 94188 - DNA, 36 bp, Artificial Sequence
  Synthetic oligonucleotide
tcactcgcgggtggtcgcaacaggcgctgaaagtta

SEQ ID NO: 94189 - DNA, 35 bp, Artificial Sequence
  Synthetic oligonucleotide
gatagtgtgggtgaggtggaagcgttagcaagtta

SEQ ID NO: 94190 - DNA, 36 bp, Artificial Sequence
  Synthetic oligonucleotide
attgtgccagctccccccgcgttccatgtatcgtta

SEQ ID NO: 94191 - DNA, 36 bp, Artificial Sequence
  Synthetic oligonucleotide
ttgcactattcctacctgtatttgcccacttcgtta

SEQ ID NO: 94192 - DNA, 36 bp, Artificial Sequence
  Synthetic oligonucleotide
gaacggggcagactactcatatgctgacatgggtta

SEQ ID NO: 94193 - DNA, 35 bp, Artificial Sequence
  Synthetic oligonucleotide
gagcgacgaaaccggagtctaatgaaaacatgtac

SEQ ID NO: 94194 - DNA, 35 bp, Artificial Sequence
  Synthetic oligonucleotide
gttagcatcagacagccttgaactatatacccccc

SEQ ID NO: 94195 - DNA, 35 bp, Artificial Sequence
  Synthetic oligonucleotide
tgtggcctcatgacttacgtgcgtgttgaattccc

SEQ ID NO: 94196 - DNA, 35 bp, Artificial Sequence
  Synthetic oligonucleotide
gacatccctagccctgtaaagtacgtgccctgtcc

SEQ ID NO: 94197 - DNA, 35 bp, Artificial Sequence
  Synthetic oligonucleotide
gaggggtcggtgtatcgttcaccctttcctattcc

SEQ ID NO: 94198 - DNA, 34 bp, Artificial Sequence
  Synthetic oligonucleotide
gtcgtcaaaaaggggtaggagtaaaggaggaggc

SEQ ID NO: 94199 - DNA, 35 bp, Artificial Sequence
  Synthetic oligonucleotide
ttcatcatccgtccaagttgtccttgggtcctggc

SEQ ID NO: 94200 - DNA, 35 bp, Artificial Sequence
  Synthetic oligonucleotide
taccgagagagccctcgtatcctgaaagacgcctc

SEQ ID NO: 94201 - DNA, 35 bp, Artificial Sequence
  Synthetic oligonucleotide
tcgctgggaagtgttttactgctcctcacactctc

SEQ ID NO: 94202 - DNA, 35 bp, Artificial Sequence
  Synthetic oligonucleotide
accccccccattatgcatagcccacggttcccttc

SEQ ID NO: 94203 - DNA, 35 bp, Artificial Sequence
  Synthetic oligonucleotide
aagacccgtggcggctaaaatttagctactccttc

SEQ ID NO: 94204 - DNA, 34 bp, Artificial Sequence
  Synthetic oligonucleotide
gatgtgcccgtctctcgagaatgcatgtagtttc

SEQ ID NO: 94205 - DNA, 35 bp, Artificial Sequence
  Synthetic oligonucleotide
gtgacaacgcaaggggtgtcacgtatttaaagaag

SEQ ID NO: 94206 - DNA, 36 bp, Artificial Sequence
  Synthetic oligonucleotide
acctcgagagagggatgttaattatgcagtggtaag

SEQ ID NO: 94207 - DNA, 35 bp, Artificial Sequence
  Synthetic oligonucleotide
gtcctcacagcacgcgcacccctccgtttccttag

SEQ ID NO: 94208 - DNA, 35 bp, Artificial Sequence
  Synthetic oligonucleotide
gcacaataatcacgtcccaaagaccacgcatcacg

SEQ ID NO: 94209 - DNA, 35 bp, Artificial Sequence
  Synthetic oligonucleotide
taacatgggtcggggattgttttgacgcgatcagg

SEQ ID NO: 94210 - DNA, 35 bp, Artificial Sequence
  Synthetic oligonucleotide
taacagaaagtaggctggccgtgatagggatgagg

SEQ ID NO: 94211 - DNA, 35 bp, Artificial Sequence
  Synthetic oligonucleotide
gacgacactgtggggggatttaagttgatgacggg

SEQ ID NO: 94212 - DNA, 35 bp, Artificial Sequence
  Synthetic oligonucleotide
gttataccccgccgccaatgtaccttggtcagatg

SEQ ID NO: 94213 - DNA, 35 bp, Artificial Sequence
  Synthetic oligonucleotide
acaaccccagcgttctgatctggcacatcctcctg

SEQ ID NO: 94214 - DNA, 35 bp, Artificial Sequence
  Synthetic oligonucleotide
gattggccgatgtggagtggggaaaaaaagccaat

SEQ ID NO: 94215 - DNA, 35 bp, Artificial Sequence
  Synthetic oligonucleotide
gagtggtgcaggacgtggagggctcagtgcggtat

SEQ ID NO: 94216 - DNA, 33 bp, Artificial Sequence
  Synthetic oligonucleotide
atgccaaccgccgccctatctcttggcaaaact

SEQ ID NO: 94217 - DNA, 35 bp, Artificial Sequence
  Synthetic oligonucleotide
gtatgcccccgttgctagcaagaagtatctcatct

SEQ ID NO: 94218 - DNA, 35 bp, Artificial Sequence
  Synthetic oligonucleotide
actgccccggctgctatttcaagaccgctgactct

SEQ ID NO: 94219 - DNA, 35 bp, Artificial Sequence
  Synthetic oligonucleotide
tcaaaaggggtgggaggtaagtggtcaaatcgtct

SEQ ID NO: 94220 - DNA, 35 bp, Artificial Sequence
  Synthetic oligonucleotide
ggtgcaacgctaacgaggaagcatggtagctatgt

SEQ ID NO: 94221 - DNA, 35 bp, Artificial Sequence
  Synthetic oligonucleotide
gagatcggtgggtggcacgaaggtcgggtttatgt

SEQ ID NO: 94222 - DNA, 35 bp, Artificial Sequence
  Synthetic oligonucleotide
acacgactcggaagggaagccctaaccgggaggtt

SEQ ID NO: 94223 - DNA, 35 bp, Artificial Sequence
  Synthetic oligonucleotide
accaaacggcctgtgttgtcaccacgtctttggtt

SEQ ID NO: 94224 - DNA, 35 bp, Artificial Sequence
  Synthetic oligonucleotide
gagtcaaccacgctccaagctacttacattatgtt

SEQ ID NO: 94225 - DNA, 35 bp, Artificial Sequence
  Synthetic oligonucleotide
gccttgcccgcgagacatacaatcgcgcacttgtt

SEQ ID NO: 94226 - DNA, 35 bp, Artificial Sequence
  Synthetic oligonucleotide
atgcaatccgccgcttacatgacgacaatcacttt

SEQ ID NO: 94227 - DNA, 35 bp, Artificial Sequence
  Synthetic oligonucleotide
gtgcctgttccgccatcatgtcgagtggcactttt

SEQ ID NO: 94228 - DNA, 35 bp, Artificial Sequence
  Synthetic oligonucleotide
gagactagtgaggagtcgggtctgggcttggtaaa

SEQ ID NO: 94229 - DNA, 36 bp, Artificial Sequence
  Synthetic oligonucleotide
gccactgccatcaatggccattctcctgctccacaa

SEQ ID NO: 94230 - DNA, 36 bp, Artificial Sequence
  Synthetic oligonucleotide
gacaaaaacgtacaccccaaccagacgacggcacaa

SEQ ID NO: 94231 - DNA, 36 bp, Artificial Sequence
  Synthetic oligonucleotide
acatccggagccgttatggttgaggtgtcgctacaa

SEQ ID NO: 94232 - DNA, 36 bp, Artificial Sequence
  Synthetic oligonucleotide
tacgcatcgtacacggactacttcaggaattagcaa

SEQ ID NO: 94233 - DNA, 36 bp, Artificial Sequence
  Synthetic oligonucleotide
tccatgcacagtaacgtcatcgcaactcgccttcaa

SEQ ID NO: 94234 - DNA, 36 bp, Artificial Sequence
  Synthetic oligonucleotide
aacgatccgagtaggtgggtgttgggggacaaggaa

SEQ ID NO: 94235 - DNA, 35 bp, Artificial Sequence
  Synthetic oligonucleotide
tgcgcccaacatctatacacgcagtacatccggaa

SEQ ID NO: 94236 - DNA, 36 bp, Artificial Sequence
  Synthetic oligonucleotide
gctggaccacgtgctgctcaggaacacgcaagtgaa

SEQ ID NO: 94237 - DNA, 36 bp, Artificial Sequence
  Synthetic oligonucleotide
tccatacgcagaaagtccgcagaagctccggaaaca

SEQ ID NO: 94238 - DNA, 36 bp, Artificial Sequence
  Synthetic oligonucleotide
tacccatccggttgttcaggtatggccaatgccaca

SEQ ID NO: 94239 - DNA, 35 bp, Artificial Sequence
  Synthetic oligonucleotide
gtacgcctcaatagctaacgcaagatccgctcaca

SEQ ID NO: 94240 - DNA, 35 bp, Artificial Sequence
  Synthetic oligonucleotide
gccatcgcccgctgttctcttgagtcgctcagaca

SEQ ID NO: 94241 - DNA, 35 bp, Artificial Sequence
  Synthetic oligonucleotide
tccctacccacagaggattcgtcccatttaggaca

SEQ ID NO: 94242 - DNA, 36 bp, Artificial Sequence
  Synthetic oligonucleotide
tgcacccagtgtcgcaactggccttattcattacca

SEQ ID NO: 94243 - DNA, 36 bp, Artificial Sequence
  Synthetic oligonucleotide
gtacacgaacatcccgtgcatgccaacgaggcccca

SEQ ID NO: 94244 - DNA, 35 bp, Artificial Sequence
  Synthetic oligonucleotide
gtgcaacaagcttgttccgcactccatcttgccca

SEQ ID NO: 94245 - DNA, 34 bp, Artificial Sequence
  Synthetic oligonucleotide
tacctggaacttggtggttagcaacttgaatcca

SEQ ID NO: 94246 - DNA, 36 bp, Artificial Sequence
  Synthetic oligonucleotide
gacaatcacttagtgtgcggacgtccccccatagca

SEQ ID NO: 94247 - DNA, 36 bp, Artificial Sequence
  Synthetic oligonucleotide
gtcacctcacatccttacgtgcctaggttcgtagca

SEQ ID NO: 94248 - DNA, 36 bp, Artificial Sequence
  Synthetic oligonucleotide
tgacagataggagggcgttcagggggctcaatggca

SEQ ID NO: 94249 - DNA, 36 bp, Artificial Sequence
  Synthetic oligonucleotide
gatcactgccagcgtggctatcgtgagttcttggca

SEQ ID NO: 94250 - DNA, 35 bp, Artificial Sequence
  Synthetic oligonucleotide
gtctcgcagggcacatttgagtttttctgcattca

SEQ ID NO: 94251 - DNA, 36 bp, Artificial Sequence
  Synthetic oligonucleotide
gatacggtcgcatgcaatatacaccgagggtcttca

SEQ ID NO: 94252 - DNA, 37 bp, Artificial Sequence
  Synthetic oligonucleotide
gaaaacgggggggagaaggagtgaggagagtcgaaga

SEQ ID NO: 94253 - DNA, 37 bp, Artificial Sequence
  Synthetic oligonucleotide
tcaactagcgaaggcgggggggacggggatacccaga

SEQ ID NO: 94254 - DNA, 37 bp, Artificial Sequence
  Synthetic oligonucleotide
accactcgctaactgtcctaaacccgccggccggaga

SEQ ID NO: 94255 - DNA, 35 bp, Artificial Sequence
  Synthetic oligonucleotide
tgcgggaaggaggaggcttacgtaaggggctgaga

SEQ ID NO: 94256 - DNA, 35 bp, Artificial Sequence
  Synthetic oligonucleotide
gcctaacctgtctgccgctaatacccgtccataga

SEQ ID NO: 94257 - DNA, 37 bp, Artificial Sequence
  Synthetic oligonucleotide
acatgaagcatcggcacacagcactcattactctaga

SEQ ID NO: 94258 - DNA, 36 bp, Artificial Sequence
  Synthetic oligonucleotide
gctgtgcgggtcgcgtgggggaagggttgtagacga

SEQ ID NO: 94259 - DNA, 37 bp, Artificial Sequence
  Synthetic oligonucleotide
tgcacacactggatacctggctctcactacaatacga

SEQ ID NO: 94260 - DNA, 37 bp, Artificial Sequence
  Synthetic oligonucleotide
tgaacgctgtaggaaatcaaagacgtggggggtacga

SEQ ID NO: 94261 - DNA, 37 bp, Artificial Sequence
  Synthetic oligonucleotide
tcagcaacacaactctttctacagtgacttggaccga

SEQ ID NO: 94262 - DNA, 34 bp, Artificial Sequence
  Synthetic oligonucleotide
tacattgccggggcttgtaaaaaagtcgatccga

SEQ ID NO: 94263 - DNA, 36 bp, Artificial Sequence
  Synthetic oligonucleotide
taggagccctttccgtgattctactcagctctccga

SEQ ID NO: 94264 - DNA, 37 bp, Artificial Sequence
  Synthetic oligonucleotide
ttgccatgaggcggaggaaggatggagggaagagcga

SEQ ID NO: 94265 - DNA, 37 bp, Artificial Sequence
  Synthetic oligonucleotide
tcactccgctgactttttacgtcgttttaatcatcga

SEQ ID NO: 94266 - DNA, 36 bp, Artificial Sequence
  Synthetic oligonucleotide
ttggtaggtccgaacatcatagtattttgctctcga

SEQ ID NO: 94267 - DNA, 37 bp, Artificial Sequence
  Synthetic oligonucleotide
tcatgcaccaccggtttatgggtcaccggtcattcga

SEQ ID NO: 94268 - DNA, 38 bp, Artificial Sequence
  Synthetic oligonucleotide
gagacggggctgtgatgattatgtgtgtcctaggagga

SEQ ID NO: 94269 - DNA, 37 bp, Artificial Sequence
  Synthetic oligonucleotide
gccggaaagggcacgtggaacgctggggtttgtagga

SEQ ID NO: 94270 - DNA, 36 bp, Artificial Sequence
  Synthetic oligonucleotide
acgcaacacaagggggaacggtcgaaaagtagcgga

SEQ ID NO: 94271 - DNA, 36 bp, Artificial Sequence
  Synthetic oligonucleotide
gatgctcggcttagcacgcaattccatcacagggga

SEQ ID NO: 94272 - DNA, 37 bp, Artificial Sequence
  Synthetic oligonucleotide
atagtgtgggcagacaacggtgacactaaggggggga

SEQ ID NO: 94273 - DNA, 37 bp, Artificial Sequence
  Synthetic oligonucleotide
aagcacacgtgcgggatcaagctaattggggggggga

SEQ ID NO: 94274 - DNA, 36 bp, Artificial Sequence
  Synthetic oligonucleotide
gccgtgggcaggccgtaaacaattggggagtgggga

SEQ ID NO: 94275 - DNA, 37 bp, Artificial Sequence
  Synthetic oligonucleotide
attagccgaggcattagtcgtgagggggggttgggga

SEQ ID NO: 94276 - DNA, 37 bp, Artificial Sequence
  Synthetic oligonucleotide
tcagagcgacaggggagtacgatggaagttaagtgga

SEQ ID NO: 94277 - DNA, 37 bp, Artificial Sequence
  Synthetic oligonucleotide
tacaagagaagaaggagtacgatggagaacgtgtgga

SEQ ID NO: 94278 - DNA, 37 bp, Artificial Sequence
  Synthetic oligonucleotide
gaccccgagtgctgcttctcacgtcctgctttgtgga

SEQ ID NO: 94279 - DNA, 38 bp, Artificial Sequence
  Synthetic oligonucleotide
acaggactcagggggggaggggcatcagggtaccatga

SEQ ID NO: 94280 - DNA, 38 bp, Artificial Sequence
  Synthetic oligonucleotide
aagacgggaggacgggggaggctgtactgtagccatga

SEQ ID NO: 94281 - DNA, 38 bp, Artificial Sequence
  Synthetic oligonucleotide
acctaggccgtactgccgctctattctgccatccatga

SEQ ID NO: 94282 - DNA, 37 bp, Artificial Sequence
  Synthetic oligonucleotide
gctgatcccgctgatcggtgtgggggtgggtggatga

SEQ ID NO: 94283 - DNA, 37 bp, Artificial Sequence
  Synthetic oligonucleotide
gactctcgccatcatctgctcgttagttcacctatga

SEQ ID NO: 94284 - DNA, 38 bp, Artificial Sequence
  Synthetic oligonucleotide
tgttgaccggctgtgactctgtaacacctcatttatga

SEQ ID NO: 94285 - DNA, 38 bp, Artificial Sequence
  Synthetic oligonucleotide
gactcggatgtctacttagatttcgctcctgatcctga

SEQ ID NO: 94286 - DNA, 35 bp, Artificial Sequence
  Synthetic oligonucleotide
gactccctcctgactcgtgttacaagacgagctga

SEQ ID NO: 94287 - DNA, 37 bp, Artificial Sequence
  Synthetic oligonucleotide
gatgcgtagtctgttctgctcttcatccgagttctga

SEQ ID NO: 94288 - DNA, 38 bp, Artificial Sequence
  Synthetic oligonucleotide
taggcggaacagcactccacacactctcgattttctga

SEQ ID NO: 94289 - DNA, 38 bp, Artificial Sequence
  Synthetic oligonucleotide
gtggaggggcaaagtgccgaacggagacgcctaagtga

SEQ ID NO: 94290 - DNA, 38 bp, Artificial Sequence
  Synthetic oligonucleotide
gatgagtggacggggcataatgagcaatccggacgtga

SEQ ID NO: 94291 - DNA, 38 bp, Artificial Sequence
  Synthetic oligonucleotide
ggatcaccgcccgtgctttagtcttagttctctcgtga

SEQ ID NO: 94292 - DNA, 36 bp, Artificial Sequence
  Synthetic oligonucleotide
gacaaccctaaaccttcgcgaggtcaccgttcgtga

SEQ ID NO: 94293 - DNA, 37 bp, Artificial Sequence
  Synthetic oligonucleotide
gccgatgggactataaaaggagcaagggacaaggtga

SEQ ID NO: 94294 - DNA, 37 bp, Artificial Sequence
  Synthetic oligonucleotide
tgtgagacaaaggggccaaaacgaacggagacggtga

SEQ ID NO: 94295 - DNA, 37 bp, Artificial Sequence
  Synthetic oligonucleotide
tacaggccaaggtcggctaataggtaaaggctggtga

SEQ ID NO: 94296 - DNA, 38 bp, Artificial Sequence
  Synthetic oligonucleotide
gacctgtcgtcgctcctccgtaatacaactcagtgtga

SEQ ID NO: 94297 - DNA, 38 bp, Artificial Sequence
  Synthetic oligonucleotide
ttagccacgcaccgagtttcctctttgactacaattga

SEQ ID NO: 94298 - DNA, 38 bp, Artificial Sequence
  Synthetic oligonucleotide
acctgtcggtcgatgtcgatcatctttccacctattga

SEQ ID NO: 94299 - DNA, 38 bp, Artificial Sequence
  Synthetic oligonucleotide
gccctacatccagtcgtcgtcgcaatcgaatttattga

SEQ ID NO: 94300 - DNA, 38 bp, Artificial Sequence
  Synthetic oligonucleotide
gtttagccctcacatgatccatattctttctgccttga

SEQ ID NO: 94301 - DNA, 37 bp, Artificial Sequence
  Synthetic oligonucleotide
tgctgtgaccctgcacctgctcaatcaaccagcttga

SEQ ID NO: 94302 - DNA, 38 bp, Artificial Sequence
  Synthetic oligonucleotide
gtgcgggggagcgacggtagtatggctcaaaatgttga

SEQ ID NO: 94303 - DNA, 37 bp, Artificial Sequence
  Synthetic oligonucleotide
gcgagtgaccggggaaaaaagggtcggaatagtttga

SEQ ID NO: 94304 - DNA, 36 bp, Artificial Sequence
  Synthetic oligonucleotide
tcacgttgcgtggtagtttccatgtgatcccgcata

SEQ ID NO: 94305 - DNA, 36 bp, Artificial Sequence
  Synthetic oligonucleotide
acgccgacgcaatacgaatgcgtttatcattaacta

SEQ ID NO: 94306 - DNA, 36 bp, Artificial Sequence
  Synthetic oligonucleotide
aacaccgtaacgaacctcgccactagattgagccta

SEQ ID NO: 94307 - DNA, 36 bp, Artificial Sequence
  Synthetic oligonucleotide
agatcacagtacggatctcgaaacaatgtttgccta

SEQ ID NO: 94308 - DNA, 35 bp, Artificial Sequence
  Synthetic oligonucleotide
agcgacagtcatctcatgtgacttccctactccta

SEQ ID NO: 94309 - DNA, 36 bp, Artificial Sequence
  Synthetic oligonucleotide
gatcacgtcggtagtttgccatcccaggttactcta

SEQ ID NO: 94310 - DNA, 35 bp, Artificial Sequence
  Synthetic oligonucleotide
gatcagtgcagctccttcggcgataacactttgta

SEQ ID NO: 94311 - DNA, 35 bp, Artificial Sequence
  Synthetic oligonucleotide
gacccaccatcacagtcctaagtctgcggatctta

SEQ ID NO: 94312 - DNA, 34 bp, Artificial Sequence
  Synthetic oligonucleotide
acatggcaaccacgatccccccacagttttgtta

SEQ ID NO: 94313 - DNA, 35 bp, Artificial Sequence
  Synthetic oligonucleotide
gatcggggggggagtatggtactcgattgggaaac

SEQ ID NO: 94314 - DNA, 35 bp, Artificial Sequence
  Synthetic oligonucleotide
tgtcatcccgcctccttttgctcgatagttttaac

SEQ ID NO: 94315 - DNA, 35 bp, Artificial Sequence
  Synthetic oligonucleotide
tccatctgattgtgtccgttcctttcgtcactcac

SEQ ID NO: 94316 - DNA, 35 bp, Artificial Sequence
  Synthetic oligonucleotide
gacctctcaactgcgcgctccactgccaccgggac

SEQ ID NO: 94317 - DNA, 35 bp, Artificial Sequence
  Synthetic oligonucleotide
atgtgagggtccggttcgtttcaccctataacacc

SEQ ID NO: 94318 - DNA, 35 bp, Artificial Sequence
  Synthetic oligonucleotide
gttgcgtactcccctcgtgtgcgatactccctacc

SEQ ID NO: 94319 - DNA, 35 bp, Artificial Sequence
  Synthetic oligonucleotide
tccatcacagtcccaggtacggagctcacggtacc

SEQ ID NO: 94320 - DNA, 35 bp, Artificial Sequence
  Synthetic oligonucleotide
gcaaacattaatgcatggctacaggcgctcgctcc

SEQ ID NO: 94321 - DNA, 35 bp, Artificial Sequence
  Synthetic oligonucleotide
tccgatccgttatttcgttattgtacctctgtagc

SEQ ID NO: 94322 - DNA, 35 bp, Artificial Sequence
  Synthetic oligonucleotide
gagaaaggggcaaaccagggctatgggtagaaggc

SEQ ID NO: 94323 - DNA, 35 bp, Artificial Sequence
  Synthetic oligonucleotide
ggaccgggtcacagcatcttcgttctccagcaggc

SEQ ID NO: 94324 - DNA, 35 bp, Artificial Sequence
  Synthetic oligonucleotide
accataaacgcggggggagtacagggtaggtttgc

SEQ ID NO: 94325 - DNA, 34 bp, Artificial Sequence
  Synthetic oligonucleotide
ttgcaagtctagcctcccacataacttattactc

SEQ ID NO: 94326 - DNA, 35 bp, Artificial Sequence
  Synthetic oligonucleotide
aaggcgcatcgccgtggctacgggtgctctccctc

SEQ ID NO: 94327 - DNA, 35 bp, Artificial Sequence
  Synthetic oligonucleotide
tctcatccaccaggctttgtgtagtattatttgtc

SEQ ID NO: 94328 - DNA, 35 bp, Artificial Sequence
  Synthetic oligonucleotide
acacggttgaaggtcatcgcttctggtttgcattc

SEQ ID NO: 94329 - DNA, 35 bp, Artificial Sequence
  Synthetic oligonucleotide
gagagggcgtatggcgacctctggtttgtgatttc

SEQ ID NO: 94330 - DNA, 35 bp, Artificial Sequence
  Synthetic oligonucleotide
tgcaacgtgctgctccaggccggtacctgggtttc

SEQ ID NO: 94331 - DNA, 35 bp, Artificial Sequence
  Synthetic oligonucleotide
tgcaccatcctttcatgttgcggtactcctgcaag

SEQ ID NO: 94332 - DNA, 35 bp, Artificial Sequence
  Synthetic oligonucleotide
tcagggtggagggtattggagtagtaaagggggag

SEQ ID NO: 94333 - DNA, 35 bp, Artificial Sequence
  Synthetic oligonucleotide
gacaaaggtgacatgtcgacggaatagaggtggag

SEQ ID NO: 94334 - DNA, 34 bp, Artificial Sequence
  Synthetic oligonucleotide
gaccatgcgaaaaattagagaggagtatgcttag

SEQ ID NO: 94335 - DNA, 35 bp, Artificial Sequence
  Synthetic oligonucleotide
agcgacgcataatgctgcttattcgcctgttgccg

SEQ ID NO: 94336 - DNA, 35 bp, Artificial Sequence
  Synthetic oligonucleotide
tcacctgccctttcaacctgcgggagatttactcg

SEQ ID NO: 94337 - DNA, 35 bp, Artificial Sequence
  Synthetic oligonucleotide
atccgctggttcgttcactatcacccattacaagg

SEQ ID NO: 94338 - DNA, 35 bp, Artificial Sequence
  Synthetic oligonucleotide
gcgctgaccgacacagtagcaggggagggctaagg

SEQ ID NO: 94339 - DNA, 35 bp, Artificial Sequence
  Synthetic oligonucleotide
gacctggcggtggagggagggccataatgtgacgg

SEQ ID NO: 94340 - DNA, 35 bp, Artificial Sequence
  Synthetic oligonucleotide
gcattccacctctgtgccgtaaccttccagctggg

SEQ ID NO: 94341 - DNA, 35 bp, Artificial Sequence
  Synthetic oligonucleotide
ttgtcgcggagtatggaaatgtgtataattctggg

SEQ ID NO: 94342 - DNA, 35 bp, Artificial Sequence
  Synthetic oligonucleotide
gtgtagggtcagggggaaatgctgattgacgtggg

SEQ ID NO: 94343 - DNA, 35 bp, Artificial Sequence
  Synthetic oligonucleotide
taccgcccacagtcaagcgtccgatcctgattctg

SEQ ID NO: 94344 - DNA, 35 bp, Artificial Sequence
  Synthetic oligonucleotide
gtccccatctcccgcgtttgtcgacgacttgtttg

SEQ ID NO: 94345 - DNA, 35 bp, Artificial Sequence
  Synthetic oligonucleotide
acaagcacgccgttccagcacctcagttactccat

SEQ ID NO: 94346 - DNA, 35 bp, Artificial Sequence
  Synthetic oligonucleotide
catcatcttgcaggctccaggttcgcctcatgtat

SEQ ID NO: 94347 - DNA, 35 bp, Artificial Sequence
  Synthetic oligonucleotide
ggaccctcgctgccttctgagtaaactgcttcact

SEQ ID NO: 94348 - DNA, 35 bp, Artificial Sequence
  Synthetic oligonucleotide
gcacagctccgatgtatccacaccatgtgcgtcct

SEQ ID NO: 94349 - DNA, 35 bp, Artificial Sequence
  Synthetic oligonucleotide
agtccggagaggggaaacgagaaggaatgacctgt

SEQ ID NO: 94350 - DNA, 35 bp, Artificial Sequence
  Synthetic oligonucleotide
tgacacccagtccagaaaaaagcctatgtctcatt

SEQ ID NO: 94351 - DNA, 35 bp, Artificial Sequence
  Synthetic oligonucleotide
tacccgtaggctccgagtgcttcgcgcacctactt

SEQ ID NO: 94352 - DNA, 35 bp, Artificial Sequence
  Synthetic oligonucleotide
ttcatcaggctgggatgtgtggcgggtgctggttt

SEQ ID NO: 94353 - DNA, 35 bp, Artificial Sequence
  Synthetic oligonucleotide
gcaacacacgcacgcgggaccaaggctaaacgaaa

SEQ ID NO: 94354 - DNA, 36 bp, Artificial Sequence
  Synthetic oligonucleotide
gacgcagtagactatcggaaagcctgacgaatgaaa

SEQ ID NO: 94355 - DNA, 34 bp, Artificial Sequence
  Synthetic oligonucleotide
gctgctcgcaaccggtagcccatcgcaaatacaa

SEQ ID NO: 94356 - DNA, 36 bp, Artificial Sequence
  Synthetic oligonucleotide
tgtctcaccgcgagccgtgcacgtgccctcttacaa

SEQ ID NO: 94357 - DNA, 36 bp, Artificial Sequence
  Synthetic oligonucleotide
gtgcactccatccgaggaattctggcatcacatcaa

SEQ ID NO: 94358 - DNA, 36 bp, Artificial Sequence
  Synthetic oligonucleotide
tagtcacctggccaatcttgatacgctacgattcaa

SEQ ID NO: 94359 - DNA, 36 bp, Artificial Sequence
  Synthetic oligonucleotide
gcacaacagtgaaaccaagcatttcaagaagacgaa

SEQ ID NO: 94360 - DNA, 36 bp, Artificial Sequence
  Synthetic oligonucleotide
ggggccctacaggggagaaggacaacaatggacgaa

SEQ ID NO: 94361 - DNA, 36 bp, Artificial Sequence
  Synthetic oligonucleotide
gctggcgaagaagggtgaaattatgggcgaggggaa

SEQ ID NO: 94362 - DNA, 36 bp, Artificial Sequence
  Synthetic oligonucleotide
acaagctgcctcctcgtcgtttatgccgatcgtgaa

SEQ ID NO: 94363 - DNA, 36 bp, Artificial Sequence
  Synthetic oligonucleotide
tcagaacctaggaaagggtagagaggcgaagaataa

SEQ ID NO: 94364 - DNA, 36 bp, Artificial Sequence
  Synthetic oligonucleotide
acgtgcgctgacactatagcgactttttccgacaca

SEQ ID NO: 94365 - DNA, 36 bp, Artificial Sequence
  Synthetic oligonucleotide
acccgccaggtcctattgatcaccatcgaacaacca

SEQ ID NO: 94366 - DNA, 35 bp, Artificial Sequence
  Synthetic oligonucleotide
accactgcccacgcccggtcgacgaccgctaccca

SEQ ID NO: 94367 - DNA, 36 bp, Artificial Sequence
  Synthetic oligonucleotide
tcctgctctgtgtgcgtttactttgctagtctgcca

SEQ ID NO: 94368 - DNA, 37 bp, Artificial Sequence
  Synthetic oligonucleotide
tcctacccgacggtagactagacacatggacgctcca

SEQ ID NO: 94369 - DNA, 35 bp, Artificial Sequence
  Synthetic oligonucleotide
gcacacagcgtttctttctcgcgtcatatcgtcca

SEQ ID NO: 94370 - DNA, 35 bp, Artificial Sequence
  Synthetic oligonucleotide
gaggagaacgccctcctctttggacttcttgagca

SEQ ID NO: 94371 - DNA, 36 bp, Artificial Sequence
  Synthetic oligonucleotide
gcaacgtcactcgatccttctcacgacgtactggca

SEQ ID NO: 94372 - DNA, 35 bp, Artificial Sequence
  Synthetic oligonucleotide
tgagacccaggactgcagacgccatcagtgctgca

SEQ ID NO: 94373 - DNA, 36 bp, Artificial Sequence
  Synthetic oligonucleotide
gaccaagtcgtacgtagcagtaaccgaggcagtgca

SEQ ID NO: 94374 - DNA, 35 bp, Artificial Sequence
  Synthetic oligonucleotide
ttcccccgccgtacgccgtgctctagtactcaaga

SEQ ID NO: 94375 - DNA, 37 bp, Artificial Sequence
  Synthetic oligonucleotide
ggaggaggcgtatggaggggttcaggcggtcggaaga

SEQ ID NO: 94376 - DNA, 37 bp, Artificial Sequence
  Synthetic oligonucleotide
tgcgacgcagtgggttctagaatgaagggctgagaga

SEQ ID NO: 94377 - DNA, 37 bp, Artificial Sequence
  Synthetic oligonucleotide
aacaggcgggggatcaagaaatggggtggtagataga

SEQ ID NO: 94378 - DNA, 37 bp, Artificial Sequence
  Synthetic oligonucleotide
gaacggtgtggaggatatgggttgagtcgaacgacga

SEQ ID NO: 94379 - DNA, 37 bp, Artificial Sequence
  Synthetic oligonucleotide
aacgcacgggagatcggtgacggtgagagatgtacga

SEQ ID NO: 94380 - DNA, 37 bp, Artificial Sequence
  Synthetic oligonucleotide
agctccgccgctttgcccagaggccattcaataccga

SEQ ID NO: 94381 - DNA, 37 bp, Artificial Sequence
  Synthetic oligonucleotide
tagggctcgctcaccacgtctactgatccacctccga

SEQ ID NO: 94382 - DNA, 36 bp, Artificial Sequence
  Synthetic oligonucleotide
gaaacgaggtatgctatgggcggccgtgagaagcga

SEQ ID NO: 94383 - DNA, 37 bp, Artificial Sequence
  Synthetic oligonucleotide
tgagcgacagtcattccatagcttccatgttccgcga

SEQ ID NO: 94384 - DNA, 35 bp, Artificial Sequence
  Synthetic oligonucleotide
gacgcgcgccgaacggcacatttggcccttctcga

SEQ ID NO: 94385 - DNA, 36 bp, Artificial Sequence
  Synthetic oligonucleotide
atgcgggaaggaaggccttgtgggcggggacgagga

SEQ ID NO: 94386 - DNA, 36 bp, Artificial Sequence
  Synthetic oligonucleotide
gcaggggaggaaacatgccgtaaacaaaggggagga

SEQ ID NO: 94387 - DNA, 37 bp, Artificial Sequence
  Synthetic oligonucleotide
tccgtgctccaatccgtggctgagttccccgtgagga

SEQ ID NO: 94388 - DNA, 37 bp, Artificial Sequence
  Synthetic oligonucleotide
acagtagagatgaagcagaatagtagaagggggcgga

SEQ ID NO: 94389 - DNA, 37 bp, Artificial Sequence
  Synthetic oligonucleotide
gtagaagagaggggaaagcgcgtcacaggaaagggga

SEQ ID NO: 94390 - DNA, 37 bp, Artificial Sequence
  Synthetic oligonucleotide
tgaccactcaccactcagaatgagcataccaatggga

SEQ ID NO: 94391 - DNA, 37 bp, Artificial Sequence
  Synthetic oligonucleotide
tacaccgccgcccgtggtacaaccgatgccctatgga

SEQ ID NO: 94392 - DNA, 37 bp, Artificial Sequence
  Synthetic oligonucleotide
gaacacgcagtgctgaggggggggcgctcttattgga

SEQ ID NO: 94393 - DNA, 37 bp, Artificial Sequence
  Synthetic oligonucleotide
gacggacacggggcgagtttgcgtttgtgcaaaatga

SEQ ID NO: 94394 - DNA, 37 bp, Artificial Sequence
  Synthetic oligonucleotide
tacgctgagcccacgctgtccgtactatatctaatga

SEQ ID NO: 94395 - DNA, 38 bp, Artificial Sequence
  Synthetic oligonucleotide
gcacgtgaaagcggggacggagactgcaatttatatga

SEQ ID NO: 94396 - DNA, 37 bp, Artificial Sequence
  Synthetic oligonucleotide
taggcgacgggaggggggttcaatgggtggactatga

SEQ ID NO: 94397 - DNA, 37 bp, Artificial Sequence
  Synthetic oligonucleotide
tcaagagggcccagcccgcattccaccctgggactga

SEQ ID NO: 94398 - DNA, 38 bp, Artificial Sequence
  Synthetic oligonucleotide
ggaatggggggaggtagccaatgtgtgacgggacctga

SEQ ID NO: 94399 - DNA, 37 bp, Artificial Sequence
  Synthetic oligonucleotide
gaccgaaagaaggaagagcacggaaaggacgagctga

SEQ ID NO: 94400 - DNA, 38 bp, Artificial Sequence
  Synthetic oligonucleotide
tcccttaaccgccattgctatcgaacgactctggctga

SEQ ID NO: 94401 - DNA, 37 bp, Artificial Sequence
  Synthetic oligonucleotide
gctgacaatggaagttggcatgggcacactaaagtga

SEQ ID NO: 94402 - DNA, 37 bp, Artificial Sequence
  Synthetic oligonucleotide
acatcagggggacgtacggtacatgttgaaacagtga

SEQ ID NO: 94403 - DNA, 38 bp, Artificial Sequence
  Synthetic oligonucleotide
agtcactgtagtttggagtaagggtaggtggtgagtga

SEQ ID NO: 94404 - DNA, 37 bp, Artificial Sequence
  Synthetic oligonucleotide
acgagagaggtcggcacgagtgagtacgttatagtga

SEQ ID NO: 94405 - DNA, 38 bp, Artificial Sequence
  Synthetic oligonucleotide
ttgaagaaagagtggtgagggaatgggcacaaacgtga

SEQ ID NO: 94406 - DNA, 38 bp, Artificial Sequence
  Synthetic oligonucleotide
gtcgaacgactgggggagaaagtatggtctatgcgtga

SEQ ID NO: 94407 - DNA, 37 bp, Artificial Sequence
  Synthetic oligonucleotide
gaagcaggggaggtgcctgggtgtgagaatggggtga

SEQ ID NO: 94408 - DNA, 38 bp, Artificial Sequence
  Synthetic oligonucleotide
atcacgccagaaatgctggatctttcgccgaggtgtga

SEQ ID NO: 94409 - DNA, 38 bp, Artificial Sequence
  Synthetic oligonucleotide
tacgtggtcctcccatttgtacgaacttatctgtgtga

SEQ ID NO: 94410 - DNA, 38 bp, Artificial Sequence
  Synthetic oligonucleotide
ggggtgggcgtgcgaagggggggcgtaaggcacattga

SEQ ID NO: 94411 - DNA, 36 bp, Artificial Sequence
  Synthetic oligonucleotide
acaccatccagccagggtaaagcaccgtgcgattga

SEQ ID NO: 94412 - DNA, 37 bp, Artificial Sequence
  Synthetic oligonucleotide
agcgtgccatatcgtccgggtacatcctccgtattga

SEQ ID NO: 94413 - DNA, 37 bp, Artificial Sequence
  Synthetic oligonucleotide
ttagcactcccgtcaatctcattcactcagcagttga

SEQ ID NO: 94414 - DNA, 38 bp, Artificial Sequence
  Synthetic oligonucleotide
ggaccacgggacacggcctgacttacatgcaaatttga

SEQ ID NO: 94415 - DNA, 37 bp, Artificial Sequence
  Synthetic oligonucleotide
tcactacgtctgcaagggattagggggtgacatttga

SEQ ID NO: 94416 - DNA, 36 bp, Artificial Sequence
  Synthetic oligonucleotide
gtgcaaccggggcggaaaagtaatggggaaataata

SEQ ID NO: 94417 - DNA, 35 bp, Artificial Sequence
  Synthetic oligonucleotide
gtcccaacagagtgtgagaaaaggtcgttcaagta

SEQ ID NO: 94418 - DNA, 36 bp, Artificial Sequence
  Synthetic oligonucleotide
gaaggtggcgaaaaggtgtgggtgaagcgctacgta

SEQ ID NO: 94419 - DNA, 36 bp, Artificial Sequence
  Synthetic oligonucleotide
gatggcgggtctcgaattggcggtggagcgtgggta

SEQ ID NO: 94420 - DNA, 36 bp, Artificial Sequence
  Synthetic oligonucleotide
gctgacctacctaaccgagactgtcgtaatttggta

SEQ ID NO: 94421 - DNA, 36 bp, Artificial Sequence
  Synthetic oligonucleotide
tcagtcatggcactgggcattactagctcgcactta

SEQ ID NO: 94422 - DNA, 35 bp, Artificial Sequence
  Synthetic oligonucleotide
acgcatccaccctgaaggtagtggtcttgaaccac

SEQ ID NO: 94423 - DNA, 35 bp, Artificial Sequence
  Synthetic oligonucleotide
agtcatactctcagtttgcgatccacaattcccac

SEQ ID NO: 94424 - DNA, 34 bp, Artificial Sequence
  Synthetic oligonucleotide
atcgcattcatccctggcgtaacagtgcgctcac

SEQ ID NO: 94425 - DNA, 35 bp, Artificial Sequence
  Synthetic oligonucleotide
aacgaagacagcaccgctccatctctcatgactac

SEQ ID NO: 94426 - DNA, 35 bp, Artificial Sequence
  Synthetic oligonucleotide
tgacatacttctgacctgtttgactagatataacc

SEQ ID NO: 94427 - DNA, 35 bp, Artificial Sequence
  Synthetic oligonucleotide
atgctgcgcccactcctacgatagaatagcttccc

SEQ ID NO: 94428 - DNA, 35 bp, Artificial Sequence
  Synthetic oligonucleotide
tcaacttgctcgccgcttgatctttccccagacgc

SEQ ID NO: 94429 - DNA, 35 bp, Artificial Sequence
  Synthetic oligonucleotide
gtgccccatagtgcgcgatgactcgcacgtaaatc

SEQ ID NO: 94430 - DNA, 35 bp, Artificial Sequence
  Synthetic oligonucleotide
agtgcaacgtccaagcgggccccaatagttccctc

SEQ ID NO: 94431 - DNA, 35 bp, Artificial Sequence
  Synthetic oligonucleotide
gagagacacggtggccacgagagaagcgagaaaag

SEQ ID NO: 94432 - DNA, 35 bp, Artificial Sequence
  Synthetic oligonucleotide
agtgccaaacaccccgttccccgatgagctgaaag

SEQ ID NO: 94433 - DNA, 35 bp, Artificial Sequence
  Synthetic oligonucleotide
acactcgtagtccgtgtctaacactaactgtaaag

SEQ ID NO: 94434 - DNA, 35 bp, Artificial Sequence
  Synthetic oligonucleotide
tgttagtgaatggggggaacgtatgaggtaaggag

SEQ ID NO: 94435 - DNA, 35 bp, Artificial Sequence
  Synthetic oligonucleotide
actacacacatgtgttcccccaggaaatacaaacg

SEQ ID NO: 94436 - DNA, 35 bp, Artificial Sequence
  Synthetic oligonucleotide
gatcactcaatccatggctctttgggactagaccg

SEQ ID NO: 94437 - DNA, 35 bp, Artificial Sequence
  Synthetic oligonucleotide
tttggaggagggagggagcaagttcgaagggatcg

SEQ ID NO: 94438 - DNA, 35 bp, Artificial Sequence
  Synthetic oligonucleotide
gttaaggcccaaacgttttatcacgcacaacttcg

SEQ ID NO: 94439 - DNA, 35 bp, Artificial Sequence
  Synthetic oligonucleotide
acgccaccgccaactcttgaaccactggaccaggg

SEQ ID NO: 94440 - DNA, 35 bp, Artificial Sequence
  Synthetic oligonucleotide
gagcaaggcggtacagtagagaagctgtggtaggg

SEQ ID NO: 94441 - DNA, 35 bp, Artificial Sequence
  Synthetic oligonucleotide
agtgggaagaggggaggccgaaacgcgaggagggg

SEQ ID NO: 94442 - DNA, 35 bp, Artificial Sequence
  Synthetic oligonucleotide
gaccgggtgtaaataacgagaaaagaacggagggg

SEQ ID NO: 94443 - DNA, 35 bp, Artificial Sequence
  Synthetic oligonucleotide
gttacacgccgcacgaaccgtgaccgatagcccat

SEQ ID NO: 94444 - DNA, 35 bp, Artificial Sequence
  Synthetic oligonucleotide
gtgtggtgtcgcgaaggaggatggtgctagcgtat

SEQ ID NO: 94445 - DNA, 35 bp, Artificial Sequence
  Synthetic oligonucleotide
tacatggttcggcgcattctttcgacctacgacct

SEQ ID NO: 94446 - DNA, 35 bp, Artificial Sequence
  Synthetic oligonucleotide
taggagctccgagcgggactttcgcgatacaccct

SEQ ID NO: 94447 - DNA, 35 bp, Artificial Sequence
  Synthetic oligonucleotide
gttcacatccgtaagtgaatgactcatattgccct

SEQ ID NO: 94448 - DNA, 35 bp, Artificial Sequence
  Synthetic oligonucleotide
aacgacacctgtctgcatatgcggtacttcattct

SEQ ID NO: 94449 - DNA, 35 bp, Artificial Sequence
  Synthetic oligonucleotide
tacgattacacctgcaccacacgatagttgtttct

SEQ ID NO: 94450 - DNA, 35 bp, Artificial Sequence
  Synthetic oligonucleotide
gcacagcagtaattgaagaatgcggaggtccacgt

SEQ ID NO: 94451 - DNA, 35 bp, Artificial Sequence
  Synthetic oligonucleotide
tccaaggtagatgaagggagtgggcggtcaaaatt

SEQ ID NO: 94452 - DNA, 36 bp, Artificial Sequence
  Synthetic oligonucleotide
tcaggacacttggcctgtacactgaacctctttaaa

SEQ ID NO: 94453 - DNA, 35 bp, Artificial Sequence
  Synthetic oligonucleotide
gtgtcgtcgcccagccgtttaaccttacatgtcaa

SEQ ID NO: 94454 - DNA, 36 bp, Artificial Sequence
  Synthetic oligonucleotide
ttcatccgcaacactcgtactcgtgacctacacgaa

SEQ ID NO: 94455 - DNA, 36 bp, Artificial Sequence
  Synthetic oligonucleotide
gaagagacggcatggagtattttcagcgaggtcgaa

SEQ ID NO: 94456 - DNA, 36 bp, Artificial Sequence
  Synthetic oligonucleotide
tacgcccactggttttgctcgtagctcccgaaggaa

SEQ ID NO: 94457 - DNA, 36 bp, Artificial Sequence
  Synthetic oligonucleotide
aaggttgggggaagtctggaggaagactcgggggaa

SEQ ID NO: 94458 - DNA, 35 bp, Artificial Sequence
  Synthetic oligonucleotide
atccacccgccggcggggatctaccaaccgtggaa

SEQ ID NO: 94459 - DNA, 36 bp, Artificial Sequence
  Synthetic oligonucleotide
tgaccacctggtaggtaacgtactggtcaaaaataa

SEQ ID NO: 94460 - DNA, 36 bp, Artificial Sequence
  Synthetic oligonucleotide
aacgacggggtagtctaaacaagggataggggctaa

SEQ ID NO: 94461 - DNA, 35 bp, Artificial Sequence
  Synthetic oligonucleotide
gctgaccgccgactcatagatattccctacataca

SEQ ID NO: 94462 - DNA, 35 bp, Artificial Sequence
  Synthetic oligonucleotide
tgatacgggtcggtcggcgaatttcttgcattaca

SEQ ID NO: 94463 - DNA, 36 bp, Artificial Sequence
  Synthetic oligonucleotide
tagcccggcgttactgatcgaatttatgttctccca

SEQ ID NO: 94464 - DNA, 35 bp, Artificial Sequence
  Synthetic oligonucleotide
gccgactgtcgcatgaacatttccgtcttatagca

SEQ ID NO: 94465 - DNA, 36 bp, Artificial Sequence
  Synthetic oligonucleotide
aatgcctccaccaggttccctaacaggcacattgca

SEQ ID NO: 94466 - DNA, 35 bp, Artificial Sequence
  Synthetic oligonucleotide
tagtacgcctaaccaccgtctgtcttagacttgca

SEQ ID NO: 94467 - DNA, 36 bp, Artificial Sequence
  Synthetic oligonucleotide
tctgccactatctgctgcggcgatgcactttcatca

SEQ ID NO: 94468 - DNA, 36 bp, Artificial Sequence
  Synthetic oligonucleotide
atctgctcgcgttcacttgtaactccgcgcttctca

SEQ ID NO: 94469 - DNA, 35 bp, Artificial Sequence
  Synthetic oligonucleotide
agcgcctcggtgctgatttttgtgctcccgtttca

SEQ ID NO: 94470 - DNA, 37 bp, Artificial Sequence
  Synthetic oligonucleotide
agaccgggatggtgagcgaaagactcggagtcgcaga

SEQ ID NO: 94471 - DNA, 37 bp, Artificial Sequence
  Synthetic oligonucleotide
ggttgggggagtgatcaaatggcaggcaccatgcaga

SEQ ID NO: 94472 - DNA, 37 bp, Artificial Sequence
  Synthetic oligonucleotide
gtgaccgcgagaggaataaagcggtgggtaacggaga

SEQ ID NO: 94473 - DNA, 37 bp, Artificial Sequence
  Synthetic oligonucleotide
gtcaggggtaggagaatcgagtgggactactcgtaga

SEQ ID NO: 94474 - DNA, 37 bp, Artificial Sequence
  Synthetic oligonucleotide
gacacaggggtggggagagctgaaactgagtggtaga

SEQ ID NO: 94475 - DNA, 37 bp, Artificial Sequence
  Synthetic oligonucleotide
accacgcgcacctgagcaggttggtgccatttgtaga

SEQ ID NO: 94476 - DNA, 37 bp, Artificial Sequence
  Synthetic oligonucleotide
gcctccgccggtgccctacagcacgctattaattaga

SEQ ID NO: 94477 - DNA, 37 bp, Artificial Sequence
  Synthetic oligonucleotide
gtgcacatggtgtgtcttttcctgggtctgaaaacga

SEQ ID NO: 94478 - DNA, 37 bp, Artificial Sequence
  Synthetic oligonucleotide
tgcggacgcacgcgctatgttagtgcccatgtaacga

SEQ ID NO: 94479 - DNA, 36 bp, Artificial Sequence
  Synthetic oligonucleotide
acgcgactaacctcctatgctgcacggtggtaccga

SEQ ID NO: 94480 - DNA, 37 bp, Artificial Sequence
  Synthetic oligonucleotide
tcacaccagactgtggggcccccttgctacgttccga

SEQ ID NO: 94481 - DNA, 37 bp, Artificial Sequence
  Synthetic oligonucleotide
gaatccgcccgcgcgaatttatagcctttccttgcga

SEQ ID NO: 94482 - DNA, 37 bp, Artificial Sequence
  Synthetic oligonucleotide
tgtccatcccaagcacctgttcgcgtgtccctcagga

SEQ ID NO: 94483 - DNA, 36 bp, Artificial Sequence
  Synthetic oligonucleotide
acactgacgcttctattcgcacatttagcccccgga

SEQ ID NO: 94484 - DNA, 37 bp, Artificial Sequence
  Synthetic oligonucleotide
aaacaccgcagatcgtatcgtctgcgtcttgcccgga

SEQ ID NO: 94485 - DNA, 37 bp, Artificial Sequence
  Synthetic oligonucleotide
tgttccgccccgttcataatgccttggctccttcgga

SEQ ID NO: 94486 - DNA, 36 bp, Artificial Sequence
  Synthetic oligonucleotide
gatcatgcgccatcatgtgaaagtattgtaaaggga

SEQ ID NO: 94487 - DNA, 36 bp, Artificial Sequence
  Synthetic oligonucleotide
tagggcgagtgagaccgtagtaacaggagggaggga

SEQ ID NO: 94488 - DNA, 37 bp, Artificial Sequence
  Synthetic oligonucleotide
gatgagcgaagtagggcgggccgggatagtctgtgga

SEQ ID NO: 94489 - DNA, 38 bp, Artificial Sequence
  Synthetic oligonucleotide
gtcagacacgcctgaaatgtcgctgaatacaaccatga

SEQ ID NO: 94490 - DNA, 37 bp, Artificial Sequence
  Synthetic oligonucleotide
gttgccacatgtacagtctttttgacgctccccatga

SEQ ID NO: 94491 - DNA, 38 bp, Artificial Sequence
  Synthetic oligonucleotide
ttggaacgcggggctgtacaacaccatggctcttatga

SEQ ID NO: 94492 - DNA, 37 bp, Artificial Sequence
  Synthetic oligonucleotide
gtgtacgggatgtgagtaggggggggcgcggttatga

SEQ ID NO: 94493 - DNA, 38 bp, Artificial Sequence
  Synthetic oligonucleotide
gccgtgagggggcataaggagggccgctgaaagactga

SEQ ID NO: 94494 - DNA, 38 bp, Artificial Sequence
  Synthetic oligonucleotide
ggtcactgaagggaggagagagggggtagtgagactga

SEQ ID NO: 94495 - DNA, 38 bp, Artificial Sequence
  Synthetic oligonucleotide
gcgagtcgaggggtgaggggcttcgaatcgtggactga

SEQ ID NO: 94496 - DNA, 38 bp, Artificial Sequence
  Synthetic oligonucleotide
gtcgattccaccgatgctgtgtccggcacacttactga

SEQ ID NO: 94497 - DNA, 38 bp, Artificial Sequence
  Synthetic oligonucleotide
tgactacttatcacttgtgtaccctccacgttccctga

SEQ ID NO: 94498 - DNA, 38 bp, Artificial Sequence
  Synthetic oligonucleotide
gatggcgcaaagggcaacggaagtacagagctggctga

SEQ ID NO: 94499 - DNA, 38 bp, Artificial Sequence
  Synthetic oligonucleotide
gatgcactgcatcatgtccgccttaaatccgaatctga

SEQ ID NO: 94500 - DNA, 38 bp, Artificial Sequence
  Synthetic oligonucleotide
gttgcacctctactgcgtacctgacaaattgcgagtga

SEQ ID NO: 94501 - DNA, 38 bp, Artificial Sequence
  Synthetic oligonucleotide
aacacgctgactgatcagctacccagaccaccgcgtga

SEQ ID NO: 94502 - DNA, 38 bp, Artificial Sequence
  Synthetic oligonucleotide
acatgcgagccacctccatacgcgcggtcctctcgtga

SEQ ID NO: 94503 - DNA, 37 bp, Artificial Sequence
  Synthetic oligonucleotide
gacgagcacaaagcccacccttttagtccggttgtga

SEQ ID NO: 94504 - DNA, 37 bp, Artificial Sequence
  Synthetic oligonucleotide
tgagacgcccgggatgcgaaacgcgaccgattattga

SEQ ID NO: 94505 - DNA, 36 bp, Artificial Sequence
  Synthetic oligonucleotide
gctagcactccaccaccactcaacgtcggacgttga

SEQ ID NO: 94506 - DNA, 37 bp, Artificial Sequence
  Synthetic oligonucleotide
tcacctcggagtgcgcgtacttccgtccatacgttga

SEQ ID NO: 94507 - DNA, 37 bp, Artificial Sequence
  Synthetic oligonucleotide
ttttgcaccgtacgccctgataggtactcgcctttga

SEQ ID NO: 94508 - DNA, 38 bp, Artificial Sequence
  Synthetic oligonucleotide
tgcgggggcggaactcgtactaactcgcgcccttttga

SEQ ID NO: 94509 - DNA, 36 bp, Artificial Sequence
  Synthetic oligonucleotide
tgaaccgctgtacgaatgcgcgagccgcccctccta

SEQ ID NO: 94510 - DNA, 36 bp, Artificial Sequence
  Synthetic oligonucleotide
tgctggagggaaaagcaaaagggtctgtagtaggta

SEQ ID NO: 94511 - DNA, 35 bp, Artificial Sequence
  Synthetic oligonucleotide
ttcgagtcctccgttcgtcatcccttagttcgtta

SEQ ID NO: 94512 - DNA, 36 bp, Artificial Sequence
  Synthetic oligonucleotide
tcatggtggagtgaagtatagaagaaggctgattta

SEQ ID NO: 94513 - DNA, 35 bp, Artificial Sequence
  Synthetic oligonucleotide
atccatccctcctccgagttatagggattcgttta

SEQ ID NO: 94514 - DNA, 34 bp, Artificial Sequence
  Synthetic oligonucleotide
aggagtggaggggaggatatggatgttatgttta

SEQ ID NO: 94515 - DNA, 35 bp, Artificial Sequence
  Synthetic oligonucleotide
acccgactattcgtaaactgtcctgggacgtgaac

SEQ ID NO: 94516 - DNA, 35 bp, Artificial Sequence
  Synthetic oligonucleotide
atggacgtgtcacatctatggcacatctaccccac

SEQ ID NO: 94517 - DNA, 35 bp, Artificial Sequence
  Synthetic oligonucleotide
tgatgggcaaaggtagcttgagcccgaaaatccac

SEQ ID NO: 94518 - DNA, 35 bp, Artificial Sequence
  Synthetic oligonucleotide
gattgtggaacgggcaagtggggccgggatgagac

SEQ ID NO: 94519 - DNA, 35 bp, Artificial Sequence
  Synthetic oligonucleotide
tacacaccgccccttaatggaaattaacactcacc

SEQ ID NO: 94520 - DNA, 36 bp, Artificial Sequence
  Synthetic oligonucleotide
actccacgagtcgattcttttgctgcgactttcacc

SEQ ID NO: 94521 - DNA, 35 bp, Artificial Sequence
  Synthetic oligonucleotide
acacaggagagagcgaaaaaactggactctgtacc

SEQ ID NO: 94522 - DNA, 35 bp, Artificial Sequence
  Synthetic oligonucleotide
taactatcggccagagttaactcgtactgcacgcc

SEQ ID NO: 94523 - DNA, 35 bp, Artificial Sequence
  Synthetic oligonucleotide
gactgctatagcaaggttttactcagtcctcctgc

SEQ ID NO: 94524 - DNA, 35 bp, Artificial Sequence
  Synthetic oligonucleotide
tggggtgtggaggggtgaagaagaatgtttgttgc

SEQ ID NO: 94525 - DNA, 35 bp, Artificial Sequence
  Synthetic oligonucleotide
gttatcccacatccgcagcctcgttctaggccatc

SEQ ID NO: 94526 - DNA, 35 bp, Artificial Sequence
  Synthetic oligonucleotide
ttaccccacggcccgaatgtcttccgacgcggatc

SEQ ID NO: 94527 - DNA, 35 bp, Artificial Sequence
  Synthetic oligonucleotide
gcgcatgctcgttctgctcactctgtgtttttatc

SEQ ID NO: 94528 - DNA, 35 bp, Artificial Sequence
  Synthetic oligonucleotide
agtacaacctgggaatggaatggctgtaaaaactc

SEQ ID NO: 94529 - DNA, 35 bp, Artificial Sequence
  Synthetic oligonucleotide
tccccccgctaccctgaggagaaagttacttcctc

SEQ ID NO: 94530 - DNA, 35 bp, Artificial Sequence
  Synthetic oligonucleotide
tcactgctaatccaattgtagtgcgactccacttc

SEQ ID NO: 94531 - DNA, 35 bp, Artificial Sequence
  Synthetic oligonucleotide
tcgcggtcgctcacatggctcgtccaaagcccttc

SEQ ID NO: 94532 - DNA, 35 bp, Artificial Sequence
  Synthetic oligonucleotide
gcgaatcagtcgctagattcttacgccctaatttc

SEQ ID NO: 94533 - DNA, 35 bp, Artificial Sequence
  Synthetic oligonucleotide
ggacgcattcgtttcgatcaattgccccctattag

SEQ ID NO: 94534 - DNA, 35 bp, Artificial Sequence
  Synthetic oligonucleotide
ttaggatggcgggaggagtggggattttgggtccg

SEQ ID NO: 94535 - DNA, 35 bp, Artificial Sequence
  Synthetic oligonucleotide
gcaacgagaccgttttagcatttacacactcctcg

SEQ ID NO: 94536 - DNA, 35 bp, Artificial Sequence
  Synthetic oligonucleotide
tcgaggccccgcaccctgtcttacctaacaacagg

SEQ ID NO: 94537 - DNA, 35 bp, Artificial Sequence
  Synthetic oligonucleotide
taactccagccgggttgccatattctgtcgatcgg

SEQ ID NO: 94538 - DNA, 36 bp, Artificial Sequence
  Synthetic oligonucleotide
gacagggggctgtgagcgaaatggcgatagaacggg

SEQ ID NO: 94539 - DNA, 35 bp, Artificial Sequence
  Synthetic oligonucleotide
gtgacgagtcgtctagcatctttctcttaacctgg

SEQ ID NO: 94540 - DNA, 35 bp, Artificial Sequence
  Synthetic oligonucleotide
gcatcaccaccggagctttagaacttaaaagttgg

SEQ ID NO: 94541 - DNA, 35 bp, Artificial Sequence
  Synthetic oligonucleotide
tcatctcggccccagccctgttttcacgcttcctg

SEQ ID NO: 94542 - DNA, 35 bp, Artificial Sequence
  Synthetic oligonucleotide
tatgatgccgctcggatgatttacgaattttcttg

SEQ ID NO: 94543 - DNA, 35 bp, Artificial Sequence
  Synthetic oligonucleotide
atgggagggatcgaagcaccgacacgctttcgttg

SEQ ID NO: 94544 - DNA, 35 bp, Artificial Sequence
  Synthetic oligonucleotide
tgagagcggtcggaaggcacattagtggagtcgat

SEQ ID NO: 94545 - DNA, 35 bp, Artificial Sequence
  Synthetic oligonucleotide
actgtacccacgtccgagcgctcatcctcgccact

SEQ ID NO: 94546 - DNA, 35 bp, Artificial Sequence
  Synthetic oligonucleotide
atcgccaccctctattctatatctatgtcacccct

SEQ ID NO: 94547 - DNA, 36 bp, Artificial Sequence
  Synthetic oligonucleotide
ttgccatgctcagacagtccgctacctgcccttcct

SEQ ID NO: 94548 - DNA, 35 bp, Artificial Sequence
  Synthetic oligonucleotide
atgacacatcgagcgtaaacaagacgggagtggct

SEQ ID NO: 94549 - DNA, 35 bp, Artificial Sequence
  Synthetic oligonucleotide
gaagggggcggcgtgtgaccggggcaaggtatcgt

SEQ ID NO: 94550 - DNA, 35 bp, Artificial Sequence
  Synthetic oligonucleotide
gcactccggcaagattgctgcttctatcgatcggt

SEQ ID NO: 94551 - DNA, 35 bp, Artificial Sequence
  Synthetic oligonucleotide
tatccacgccgtccaacgtccacagagttgacctt

SEQ ID NO: 94552 - DNA, 35 bp, Artificial Sequence
  Synthetic oligonucleotide
ttgctgcaacggctcggtaagcggtcgcccccttt

SEQ ID NO: 94553 - DNA, 35 bp, Artificial Sequence
  Synthetic oligonucleotide
tccagtcggcgctacgaactgcttcctttgccttt

SEQ ID NO: 94554 - DNA, 35 bp, Artificial Sequence
  Synthetic oligonucleotide
gaagcccacatgtaccgcccctgcccggtgggttt

SEQ ID NO: 94555 - DNA, 36 bp, Artificial Sequence
  Synthetic oligonucleotide
gtgacctccactaccgcccctatgtctggggacaaa

SEQ ID NO: 94556 - DNA, 36 bp, Artificial Sequence
  Synthetic oligonucleotide
tctgccccactatgactcaccctgctcgttgaacaa

SEQ ID NO: 94557 - DNA, 37 bp, Artificial Sequence
  Synthetic oligonucleotide
ttgtgccgctggacaggctggcacatggagaacggaa

SEQ ID NO: 94558 - DNA, 36 bp, Artificial Sequence
  Synthetic oligonucleotide
gatgagtgagtagataggtagcatgctggaagggaa

SEQ ID NO: 94559 - DNA, 35 bp, Artificial Sequence
  Synthetic oligonucleotide
ttgacacgacaacatgtcacctatcgtgttgttaa

SEQ ID NO: 94560 - DNA, 36 bp, Artificial Sequence
  Synthetic oligonucleotide
gattaccctgagtgtagtgtctcccatgcgcacaca

SEQ ID NO: 94561 - DNA, 36 bp, Artificial Sequence
  Synthetic oligonucleotide
gtcatgtgaaaggggagcaaaggaatacggtataca

SEQ ID NO: 94562 - DNA, 36 bp, Artificial Sequence
  Synthetic oligonucleotide
tgacgacgcactttcaaggccagcacgggttctaca

SEQ ID NO: 94563 - DNA, 35 bp, Artificial Sequence
  Synthetic oligonucleotide
tatcccgagcacattgttgtcacatgtgatcccca

SEQ ID NO: 94564 - DNA, 36 bp, Artificial Sequence
  Synthetic oligonucleotide
gccaggctcacaccggacttctctcaatcagagcca

SEQ ID NO: 94565 - DNA, 37 bp, Artificial Sequence
  Synthetic oligonucleotide
cttgccaccacgtccggcatgcgttatccttagtcca

SEQ ID NO: 94566 - DNA, 36 bp, Artificial Sequence
  Synthetic oligonucleotide
acaccatgcaacgagtatgtcgtgaactggagagca

SEQ ID NO: 94567 - DNA, 35 bp, Artificial Sequence
  Synthetic oligonucleotide
gcccgaatcacgcggtcctgaaaattgccttcgca

SEQ ID NO: 94568 - DNA, 36 bp, Artificial Sequence
  Synthetic oligonucleotide
gaccccaatccaatatataagcgaatggttttcgca

SEQ ID NO: 94569 - DNA, 36 bp, Artificial Sequence
  Synthetic oligonucleotide
gtcgggagtaggtggtcgagtaggggtagaggggca

SEQ ID NO: 94570 - DNA, 36 bp, Artificial Sequence
  Synthetic oligonucleotide
tatcacccaccccggacatacgttaggagactggca

SEQ ID NO: 94571 - DNA, 36 bp, Artificial Sequence
  Synthetic oligonucleotide
tcatacgatcgctcgctgcctgagatttgccgatca

SEQ ID NO: 94572 - DNA, 35 bp, Artificial Sequence
  Synthetic oligonucleotide
aacatcccacatgtttacattgtcatatagactca

SEQ ID NO: 94573 - DNA, 37 bp, Artificial Sequence
  Synthetic oligonucleotide
tgactaagcttagagggggaggggttggtagatcaga

SEQ ID NO: 94574 - DNA, 37 bp, Artificial Sequence
  Synthetic oligonucleotide
atcagaatcaaggtgaagcagggagaatttggtcaga

SEQ ID NO: 94575 - DNA, 36 bp, Artificial Sequence
  Synthetic oligonucleotide
gcacaccagggatatcgtctatcgcacaccgggaga

SEQ ID NO: 94576 - DNA, 35 bp, Artificial Sequence
  Synthetic oligonucleotide
tatgatggtcgatgcagccacattgcctccctaga

SEQ ID NO: 94577 - DNA, 37 bp, Artificial Sequence
  Synthetic oligonucleotide
acacaggcaagggcaaggcaaaggcggggtgtcccga

SEQ ID NO: 94578 - DNA, 37 bp, Artificial Sequence
  Synthetic oligonucleotide
acaaccaaccgtgcagaccgctcctcagagttcccga

SEQ ID NO: 94579 - DNA, 37 bp, Artificial Sequence
  Synthetic oligonucleotide
ttacgtcccccgatggctatttgcttccacaggccga

SEQ ID NO: 94580 - DNA, 37 bp, Artificial Sequence
  Synthetic oligonucleotide
aacgcaagtgaacccgatcgaattggaggagttccga

SEQ ID NO: 94581 - DNA, 37 bp, Artificial Sequence
  Synthetic oligonucleotide
gctgacgccgagatattcctttcccagttacacgcga

SEQ ID NO: 94582 - DNA, 35 bp, Artificial Sequence
  Synthetic oligonucleotide
gatgtgtgccggtatacaaaggtgggcgaaggcga

SEQ ID NO: 94583 - DNA, 35 bp, Artificial Sequence
  Synthetic oligonucleotide
gtgagatcaagtgcaggggtgtggtggttcgtcga

SEQ ID NO: 94584 - DNA, 36 bp, Artificial Sequence
  Synthetic oligonucleotide
tcaatccgggcctcgatgtacagtgcatgcattcga

SEQ ID NO: 94585 - DNA, 36 bp, Artificial Sequence
  Synthetic oligonucleotide
acttcacacatccgcatgttaatgatttacgttcga

SEQ ID NO: 94586 - DNA, 37 bp, Artificial Sequence
  Synthetic oligonucleotide
gacatgttcgttgtattccatgtgccgccctgttcga

SEQ ID NO: 94587 - DNA, 37 bp, Artificial Sequence
  Synthetic oligonucleotide
gtgacgctcccggaccattctgagccagtcacacgga

SEQ ID NO: 94588 - DNA, 37 bp, Artificial Sequence
  Synthetic oligonucleotide
tgcgagtgacgcgcgatagaggacgacatggggcgga

SEQ ID NO: 94589 - DNA, 36 bp, Artificial Sequence
  Synthetic oligonucleotide
tagagcacaggagtaactggaggagcacaacaggga

SEQ ID NO: 94590 - DNA, 37 bp, Artificial Sequence
  Synthetic oligonucleotide
acaccgtgagaatgcgtgcataaaagccttctaggga

SEQ ID NO: 94591 - DNA, 37 bp, Artificial Sequence
  Synthetic oligonucleotide
ggaccacctcactcatagcagcaggagtctaccggga

SEQ ID NO: 94592 - DNA, 36 bp, Artificial Sequence
  Synthetic oligonucleotide
tgtgtgccgtcgacgctggttcttggtggagtggga

SEQ ID NO: 94593 - DNA, 37 bp, Artificial Sequence
  Synthetic oligonucleotide
tccaaatgccaggctgtggcaataaaggacgtttgga

SEQ ID NO: 94594 - DNA, 38 bp, Artificial Sequence
  Synthetic oligonucleotide
agcatagagccacgcacgggaaggaagagaatggatga

SEQ ID NO: 94595 - DNA, 37 bp, Artificial Sequence
  Synthetic oligonucleotide
ttgagctcagagcggaccaacgtacaggtaaatatga

SEQ ID NO: 94596 - DNA, 38 bp, Artificial Sequence
  Synthetic oligonucleotide
gcaaacgccagctactttaacgctccggtcctctatga

SEQ ID NO: 94597 - DNA, 38 bp, Artificial Sequence
  Synthetic oligonucleotide
tgtacctcctccccggtctagcaggcattcatcactga

SEQ ID NO: 94598 - DNA, 38 bp, Artificial Sequence
  Synthetic oligonucleotide
tgaaccgcctgcattccactatggcctttcatgactga

SEQ ID NO: 94599 - DNA, 38 bp, Artificial Sequence
  Synthetic oligonucleotide
taatccgcacatcgccccactgcactaagacgagctga

SEQ ID NO: 94600 - DNA, 38 bp, Artificial Sequence
  Synthetic oligonucleotide
ttgacaagcgaggaaatgggagtggtgactgtggctga

SEQ ID NO: 94601 - DNA, 37 bp, Artificial Sequence
  Synthetic oligonucleotide
accccgccaactttatgttgtacaaccacgaaagtga

SEQ ID NO: 94602 - DNA, 37 bp, Artificial Sequence
  Synthetic oligonucleotide
tctacgctgccacacaccctgatttaacactcagtga

SEQ ID NO: 94603 - DNA, 38 bp, Artificial Sequence
  Synthetic oligonucleotide
gatgctccaaattacctaacgcacagtctcacacgtga

SEQ ID NO: 94604 - DNA, 38 bp, Artificial Sequence
  Synthetic oligonucleotide
ttgaccgcctcacccatggtccctgtacgaggtcgtga

SEQ ID NO: 94605 - DNA, 37 bp, Artificial Sequence
  Synthetic oligonucleotide
tcagacgactaggtctggagttcattaatgatggtga

SEQ ID NO: 94606 - DNA, 37 bp, Artificial Sequence
  Synthetic oligonucleotide
tacaggccaagcataggattgtgttctttgttggtga

SEQ ID NO: 94607 - DNA, 37 bp, Artificial Sequence
  Synthetic oligonucleotide
agatcaggtcgtcaagaataggagatgaaaggtgtga

SEQ ID NO: 94608 - DNA, 38 bp, Artificial Sequence
  Synthetic oligonucleotide
acactgaactcaggaagatagggggagttacgttgtga

SEQ ID NO: 94609 - DNA, 38 bp, Artificial Sequence
  Synthetic oligonucleotide
accacccttggtgttcttgctaacacagtctaaattga

SEQ ID NO: 94610 - DNA, 38 bp, Artificial Sequence
  Synthetic oligonucleotide
atgagcgcagatgacatgttggaggagggtggaattga

SEQ ID NO: 94611 - DNA, 38 bp, Artificial Sequence
  Synthetic oligonucleotide
aacgagatcatgcggctgtcaaaaagggcagtaattga

SEQ ID NO: 94612 - DNA, 38 bp, Artificial Sequence
  Synthetic oligonucleotide
aacgcgtgccctctcatttgcaagtgcatacgcattga

SEQ ID NO: 94613 - DNA, 36 bp, Artificial Sequence
  Synthetic oligonucleotide
gatctgccacacttgccgtaaaattgctcatgttga

SEQ ID NO: 94614 - DNA, 38 bp, Artificial Sequence
  Synthetic oligonucleotide
gacgcgggggggagaattaggcaagggttaatatttga

SEQ ID NO: 94615 - DNA, 38 bp, Artificial Sequence
  Synthetic oligonucleotide
ggtgctccgcaaggagaccacgtcccagccgtatttga

SEQ ID NO: 94616 - DNA, 37 bp, Artificial Sequence
  Synthetic oligonucleotide
gacaaacgatggtagttgggggctgtgaaacgtttga

SEQ ID NO: 94617 - DNA, 36 bp, Artificial Sequence
  Synthetic oligonucleotide
ttatcaaccagccctatgcttagtccgtggtcacta

SEQ ID NO: 94618 - DNA, 37 bp, Artificial Sequence
  Synthetic oligonucleotide
aacccacagcagacgaatgggaccgtctcctgcgcta

SEQ ID NO: 94619 - DNA, 34 bp, Artificial Sequence
  Synthetic oligonucleotide
gaccctcctccaggccatgcgacgacatacagta

SEQ ID NO: 94620 - DNA, 36 bp, Artificial Sequence
  Synthetic oligonucleotide
gcatgtcctacacctcacatgtcgtaccaattagta

SEQ ID NO: 94621 - DNA, 35 bp, Artificial Sequence
  Synthetic oligonucleotide
aaaggacggagacaggggcgcgaaatgggcaggta

SEQ ID NO: 94622 - DNA, 35 bp, Artificial Sequence
  Synthetic oligonucleotide
tgagcctcctacttattaacgtgcccaagtggtta

SEQ ID NO: 94623 - DNA, 36 bp, Artificial Sequence
  Synthetic oligonucleotide
gacttccgacctgtactcgtacaattcatgttttta

SEQ ID NO: 94624 - DNA, 35 bp, Artificial Sequence
  Synthetic oligonucleotide
tgaccggaggaggggtttgggcagagttcttcaac

SEQ ID NO: 94625 - DNA, 35 bp, Artificial Sequence
  Synthetic oligonucleotide
acaccactgactcatgctttatttcatgttaacac

SEQ ID NO: 94626 - DNA, 35 bp, Artificial Sequence
  Synthetic oligonucleotide
gacaacgtagctaggagaggtgacacgtgactcac

SEQ ID NO: 94627 - DNA, 35 bp, Artificial Sequence
  Synthetic oligonucleotide
aagacgccacataagctgtacgatgtcgttacacc

SEQ ID NO: 94628 - DNA, 35 bp, Artificial Sequence
  Synthetic oligonucleotide
tgtcaccctactcacagtcctgctggccactaccc

SEQ ID NO: 94629 - DNA, 35 bp, Artificial Sequence
  Synthetic oligonucleotide
tgctgctccgggtgctctattgcaaacgctatccc

SEQ ID NO: 94630 - DNA, 35 bp, Artificial Sequence
  Synthetic oligonucleotide
ttgcgcaccgctattggcccttcgtctcagctccc

SEQ ID NO: 94631 - DNA, 35 bp, Artificial Sequence
  Synthetic oligonucleotide
ggaccagaagtcggattcaccttcatccggtatcc

SEQ ID NO: 94632 - DNA, 35 bp, Artificial Sequence
  Synthetic oligonucleotide
tgggacgtgccaggccgttttgtctctctgtttcc

SEQ ID NO: 94633 - DNA, 35 bp, Artificial Sequence
  Synthetic oligonucleotide
tccggagcatagccaagcgactgtccctactccgc

SEQ ID NO: 94634 - DNA, 35 bp, Artificial Sequence
  Synthetic oligonucleotide
gagcgcatcattgtcactatcctccatcgggcggc

SEQ ID NO: 94635 - DNA, 36 bp, Artificial Sequence
  Synthetic oligonucleotide
gttgggcaatgcagcaagaggacttagcggaagggc

SEQ ID NO: 94636 - DNA, 35 bp, Artificial Sequence
  Synthetic oligonucleotide
tgggtcgcaccgctcctacaggctggggttaactc

SEQ ID NO: 94637 - DNA, 35 bp, Artificial Sequence
  Synthetic oligonucleotide
ggtcgggagaggaatggtttgatggcgggaaggtc

SEQ ID NO: 94638 - DNA, 35 bp, Artificial Sequence
  Synthetic oligonucleotide
agtcccgacgctggtagtgattcgtacttcatttc

SEQ ID NO: 94639 - DNA, 35 bp, Artificial Sequence
  Synthetic oligonucleotide
gcgtggtcgccatggagtttttctttcgtcctttc

SEQ ID NO: 94640 - DNA, 35 bp, Artificial Sequence
  Synthetic oligonucleotide
acatccgatccgaccgcctacgtgcttttcctaag

SEQ ID NO: 94641 - DNA, 35 bp, Artificial Sequence
  Synthetic oligonucleotide
ttaagcacggtgtcctgcatcaagggggaggggcg

SEQ ID NO: 94642 - DNA, 35 bp, Artificial Sequence
  Synthetic oligonucleotide
gaactgcggggttgacaattatgctcacgggatcg

SEQ ID NO: 94643 - DNA, 35 bp, Artificial Sequence
  Synthetic oligonucleotide
tgacaaatccccccccgcatcaagcccatctgggg

SEQ ID NO: 94644 - DNA, 34 bp, Artificial Sequence
  Synthetic oligonucleotide
gaacacggatgtggttcagtaatttagggctggg

SEQ ID NO: 94645 - DNA, 35 bp, Artificial Sequence
  Synthetic oligonucleotide
aacgtagagccaaggaaggcagaagcatcaacgtg

SEQ ID NO: 94646 - DNA, 35 bp, Artificial Sequence
  Synthetic oligonucleotide
tacacaaggacgtgactaaggtaggagaaggtgtg

SEQ ID NO: 94647 - DNA, 35 bp, Artificial Sequence
  Synthetic oligonucleotide
tgagatggtcgcagtttgaaaacagccgtgaattg

SEQ ID NO: 94648 - DNA, 35 bp, Artificial Sequence
  Synthetic oligonucleotide
accatgccctacacacgcgttgcgttctacgtaat

SEQ ID NO: 94649 - DNA, 35 bp, Artificial Sequence
  Synthetic oligonucleotide
gatgacggatgtgtgtgcacctgccctcaacccat

SEQ ID NO: 94650 - DNA, 35 bp, Artificial Sequence
  Synthetic oligonucleotide
gacgagggaagactaggaggggttgaattcgtact

SEQ ID NO: 94651 - DNA, 35 bp, Artificial Sequence
  Synthetic oligonucleotide
gatcatagtggaggcgcatgtttggcggataaagt

SEQ ID NO: 94652 - DNA, 35 bp, Artificial Sequence
  Synthetic oligonucleotide
ttgcaggcgcaaggaaatgactttgggaggtgggt

SEQ ID NO: 94653 - DNA, 35 bp, Artificial Sequence
  Synthetic oligonucleotide
agaagggggtgagggagtccaggggaaaccggatt

SEQ ID NO: 94654 - DNA, 35 bp, Artificial Sequence
  Synthetic oligonucleotide
tagtaggagccgactggtaggtcaggagaatggtt

SEQ ID NO: 94655 - DNA, 36 bp, Artificial Sequence
  Synthetic oligonucleotide
agagaggaaaaggcagtgagacggcacgattaaaaa

SEQ ID NO: 94656 - DNA, 36 bp, Artificial Sequence
  Synthetic oligonucleotide
gccatgaaggaacaatgtgtggatggggtgatagaa

SEQ ID NO: 94657 - DNA, 36 bp, Artificial Sequence
  Synthetic oligonucleotide
gagcgcaacaccggtgtgttgccgaatgcccttgaa

SEQ ID NO: 94658 - DNA, 35 bp, Artificial Sequence
  Synthetic oligonucleotide
tagctgggcggatagtaatttggtagggggcgtaa

SEQ ID NO: 94659 - DNA, 35 bp, Artificial Sequence
  Synthetic oligonucleotide
ttcgccaccccagactgcaacagctggctgtgtaa

SEQ ID NO: 94660 - DNA, 35 bp, Artificial Sequence
  Synthetic oligonucleotide
gagaccacgaccctaccgtgcacgagggcaaaaca

SEQ ID NO: 94661 - DNA, 36 bp, Artificial Sequence
  Synthetic oligonucleotide
gtagccgcattggacggacgtgcccttttctcccca

SEQ ID NO: 94662 - DNA, 36 bp, Artificial Sequence
  Synthetic oligonucleotide
gctgtgacgctcagctcttttgtttgcgccggccca

SEQ ID NO: 94663 - DNA, 36 bp, Artificial Sequence
  Synthetic oligonucleotide
gagcaagagggaggggtcgcggtagaggcgtatcca

SEQ ID NO: 94664 - DNA, 36 bp, Artificial Sequence
  Synthetic oligonucleotide
actgtcgaccagctgtccgctccagtcgttactcca

SEQ ID NO: 94665 - DNA, 36 bp, Artificial Sequence
  Synthetic oligonucleotide
gggtcacggaaggggtgctgaaggcggaatggggca

SEQ ID NO: 94666 - DNA, 36 bp, Artificial Sequence
  Synthetic oligonucleotide
ttgcggctgaccccgtccgtttttgactctctggca

SEQ ID NO: 94667 - DNA, 35 bp, Artificial Sequence
  Synthetic oligonucleotide
gtcaacagtccattccccgtatcggcgcacgtgca

SEQ ID NO: 94668 - DNA, 30 bp, Artificial Sequence
  Synthetic oligonucleotide
tccccatgctcgttttcctctacctcttca

SEQ ID NO: 94669 - DNA, 36 bp, Artificial Sequence
  Synthetic oligonucleotide
ttcgcgggtgggcatcggtaaggaacgggaggaaga

SEQ ID NO: 94670 - DNA, 37 bp, Artificial Sequence
  Synthetic oligonucleotide
acaagcgcaggcctggaggaatgagtgtagtctcaga

SEQ ID NO: 94671 - DNA, 37 bp, Artificial Sequence
  Synthetic oligonucleotide
gacgacggggagaagggttgcgttagcgggccagaga

SEQ ID NO: 94672 - DNA, 37 bp, Artificial Sequence
  Synthetic oligonucleotide
tgtgaccaggggcacaagatccactcacccatcgaga

SEQ ID NO: 94673 - DNA, 36 bp, Artificial Sequence
  Synthetic oligonucleotide
taccacacaaccgcagatagcctctgtgttcctaga

SEQ ID NO: 94674 - DNA, 37 bp, Artificial Sequence
  Synthetic oligonucleotide
tagccactgggcgggaaagggtctcacatagggtaga

SEQ ID NO: 94675 - DNA, 37 bp, Artificial Sequence
  Synthetic oligonucleotide
acggagcaatcctgttggcaactacacacctctacga

SEQ ID NO: 94676 - DNA, 37 bp, Artificial Sequence
  Synthetic oligonucleotide
ggtccactcgcagcatggctatgcctcccgtttacga

SEQ ID NO: 94677 - DNA, 37 bp, Artificial Sequence
  Synthetic oligonucleotide
aagatggagccgagggaagcaaaggcaaccgtgccga

SEQ ID NO: 94678 - DNA, 36 bp, Artificial Sequence
  Synthetic oligonucleotide
tgtggtgagctgctatttggcctgtcttgttgccga

SEQ ID NO: 94679 - DNA, 36 bp, Artificial Sequence
  Synthetic oligonucleotide
gcaccgtaaagtccttgtcgtgccacactcatccga

SEQ ID NO: 94680 - DNA, 37 bp, Artificial Sequence
  Synthetic oligonucleotide
gtgagtgcgcggtcgtaataatgcttttcgtactcga

SEQ ID NO: 94681 - DNA, 37 bp, Artificial Sequence
  Synthetic oligonucleotide
tagccacggataaagggttaggggaagaggctttcga

SEQ ID NO: 94682 - DNA, 37 bp, Artificial Sequence
  Synthetic oligonucleotide
gtggagtgcggggtggtagcgtggggttacgaaagga

SEQ ID NO: 94683 - DNA, 37 bp, Artificial Sequence
  Synthetic oligonucleotide
acccgacgatctgttgctagttttgcacctcttagga

SEQ ID NO: 94684 - DNA, 37 bp, Artificial Sequence
  Synthetic oligonucleotide
tatcatcccgcagttctattagggtctccgtttcgga

SEQ ID NO: 94685 - DNA, 37 bp, Artificial Sequence
  Synthetic oligonucleotide
tgaccttccgcaccatgacacccgcggcaacacggga

SEQ ID NO: 94686 - DNA, 37 bp, Artificial Sequence
  Synthetic oligonucleotide
gttgacgcgccgccggggaaaagatgaattgacggga

SEQ ID NO: 94687 - DNA, 37 bp, Artificial Sequence
  Synthetic oligonucleotide
acacctgacgcgaaatgcattaagtgcaacgggggga

SEQ ID NO: 94688 - DNA, 37 bp, Artificial Sequence
  Synthetic oligonucleotide
agtagaggacgggaggttttgcgaaggaaaaggtgga

SEQ ID NO: 94689 - DNA, 37 bp, Artificial Sequence
  Synthetic oligonucleotide
gatgcggagtcaacgagggagctgggcgagaacatga

SEQ ID NO: 94690 - DNA, 38 bp, Artificial Sequence
  Synthetic oligonucleotide
gaggaccacgtcgaatgatatgctgtttgttgccatga

SEQ ID NO: 94691 - DNA, 38 bp, Artificial Sequence
  Synthetic oligonucleotide
tcctgaacgacgacccctgtcatatccctcagtcatga

SEQ ID NO: 94692 - DNA, 38 bp, Artificial Sequence
  Synthetic oligonucleotide
taatacgcaccaccacttgtacctccagtaaggtatga

SEQ ID NO: 94693 - DNA, 37 bp, Artificial Sequence
  Synthetic oligonucleotide
tgtcgacccagcggatattcgttactgaacccactga

SEQ ID NO: 94694 - DNA, 38 bp, Artificial Sequence
  Synthetic oligonucleotide
gacatgggagatgaaattaaagtggatgggcggactga

SEQ ID NO: 94695 - DNA, 37 bp, Artificial Sequence
  Synthetic oligonucleotide
tcctcagagctgactcgttatctaatctccttcctga

SEQ ID NO: 94696 - DNA, 38 bp, Artificial Sequence
  Synthetic oligonucleotide
agacaccctatgccgtatcatctgtttagtaacgctga

SEQ ID NO: 94697 - DNA, 37 bp, Artificial Sequence
  Synthetic oligonucleotide
gaacggagaatggatgggatgtagggcatggatctga

SEQ ID NO: 94698 - DNA, 38 bp, Artificial Sequence
  Synthetic oligonucleotide
gaagtgcggtgggggatgaggggttgcttataaagtga

SEQ ID NO: 94699 - DNA, 36 bp, Artificial Sequence
  Synthetic oligonucleotide
tctggaggggggcaagagaatgaggcatacaagtga

SEQ ID NO: 94700 - DNA, 38 bp, Artificial Sequence
  Synthetic oligonucleotide
ggtgagggaagagtataaagggatgatgggctaagtga

SEQ ID NO: 94701 - DNA, 38 bp, Artificial Sequence
  Synthetic oligonucleotide
gatccaccgcacactctgttttgggatgatttccgtga

SEQ ID NO: 94702 - DNA, 38 bp, Artificial Sequence
  Synthetic oligonucleotide
atcgacatgggacgggcttggtggtgacgcgaaggtga

SEQ ID NO: 94703 - DNA, 38 bp, Artificial Sequence
  Synthetic oligonucleotide
aatcaacagtcgaatggtcttcgaagaaagctgggtga

SEQ ID NO: 94704 - DNA, 38 bp, Artificial Sequence
  Synthetic oligonucleotide
tgacttgggcgaactaggaggaatgggcttaatggtga

SEQ ID NO: 94705 - DNA, 38 bp, Artificial Sequence
  Synthetic oligonucleotide
gcaccatcacttctgcggcattatatcaacacatgtga

SEQ ID NO: 94706 - DNA, 38 bp, Artificial Sequence
  Synthetic oligonucleotide
ttccgagaaggagcggtaataagcgagggaagaattga

SEQ ID NO: 94707 - DNA, 38 bp, Artificial Sequence
  Synthetic oligonucleotide
gctgtggcacgtgcggtacgatgtaccggaaccattga

SEQ ID NO: 94708 - DNA, 38 bp, Artificial Sequence
  Synthetic oligonucleotide
ttgtgcaacaaaaggaatatggcgggacgaggacttga

SEQ ID NO: 94709 - DNA, 38 bp, Artificial Sequence
  Synthetic oligonucleotide
tcagtagagcctgggagttttcttgatccatcccttga

SEQ ID NO: 94710 - DNA, 38 bp, Artificial Sequence
  Synthetic oligonucleotide
tacgcctcaatatgccaaatattaaccatgttccttga

SEQ ID NO: 94711 - DNA, 37 bp, Artificial Sequence
  Synthetic oligonucleotide
ggagtgagggtgtaggaggggagtggcagtacgttga

SEQ ID NO: 94712 - DNA, 38 bp, Artificial Sequence
  Synthetic oligonucleotide
ttggacgcaagaaaagaagtcagtcagggaggggttga

SEQ ID NO: 94713 - DNA, 37 bp, Artificial Sequence
  Synthetic oligonucleotide
gtctggcagggtgagaagggggaagtgggagttttga

SEQ ID NO: 94714 - DNA, 35 bp, Artificial Sequence
  Synthetic oligonucleotide
gttccacctcttcacacatgtgactctatgtgata

SEQ ID NO: 94715 - DNA, 36 bp, Artificial Sequence
  Synthetic oligonucleotide
gaagcactgccgaccagcgcttaattgcacactata

SEQ ID NO: 94716 - DNA, 35 bp, Artificial Sequence
  Synthetic oligonucleotide
aacgcccaccagcactgcacagtttcccagaacta

SEQ ID NO: 94717 - DNA, 35 bp, Artificial Sequence
  Synthetic oligonucleotide
tgccccataactgtttgccattgaccctagcccta

SEQ ID NO: 94718 - DNA, 36 bp, Artificial Sequence
  Synthetic oligonucleotide
gcgaagcaacacaaaaaaatgccgtacacgttgcta

SEQ ID NO: 94719 - DNA, 36 bp, Artificial Sequence
  Synthetic oligonucleotide
tgaacacattccgatagcggtccgcaaacatacgta

SEQ ID NO: 94720 - DNA, 36 bp, Artificial Sequence
  Synthetic oligonucleotide
tttgaccgccaccacataacgtatcggcgattatta

SEQ ID NO: 94721 - DNA, 36 bp, Artificial Sequence
  Synthetic oligonucleotide
atctcaccgccggaccactcactaagcccacggtta

SEQ ID NO: 94722 - DNA, 34 bp, Artificial Sequence
  Synthetic oligonucleotide
ttgaccccacttgctaaaccggattctggtttta

SEQ ID NO: 94723 - DNA, 35 bp, Artificial Sequence
  Synthetic oligonucleotide
gacaacaagcccaccggatctcttctatggtaaac

SEQ ID NO: 94724 - DNA, 35 bp, Artificial Sequence
  Synthetic oligonucleotide
gccgatgcatctgagctcaccatccccgtattcac

SEQ ID NO: 94725 - DNA, 35 bp, Artificial Sequence
  Synthetic oligonucleotide
gtgggagtcttctgccgccgttgccttcgacctac

SEQ ID NO: 94726 - DNA, 35 bp, Artificial Sequence
  Synthetic oligonucleotide
gcaccgacaagcggggatgtccgctcctgccgtac

SEQ ID NO: 94727 - DNA, 35 bp, Artificial Sequence
  Synthetic oligonucleotide
tgtacagaccagactgctgtcgatgaccttgaccc

SEQ ID NO: 94728 - DNA, 35 bp, Artificial Sequence
  Synthetic oligonucleotide
acaccacggatgttctggaagcacgaagcacgccc

SEQ ID NO: 94729 - DNA, 35 bp, Artificial Sequence
  Synthetic oligonucleotide
gcacagccccaaatcgttctaaggcgattgccgcc

SEQ ID NO: 94730 - DNA, 35 bp, Artificial Sequence
  Synthetic oligonucleotide
gtcgctcacccccggattctttaaaaaccgtttgc

SEQ ID NO: 94731 - DNA, 35 bp, Artificial Sequence
  Synthetic oligonucleotide
atcgtccatacgcaggatgcgatgtaccttaactc

SEQ ID NO: 94732 - DNA, 35 bp, Artificial Sequence
  Synthetic oligonucleotide
gcaaccgcttagggtctcttggtcgtagcctactc

SEQ ID NO: 94733 - DNA, 35 bp, Artificial Sequence
  Synthetic oligonucleotide
gttcacacgctatgcctgattcgcgccactttgtc

SEQ ID NO: 94734 - DNA, 35 bp, Artificial Sequence
  Synthetic oligonucleotide
atgccgggccctatcacgcatgctaaaggtggttc

SEQ ID NO: 94735 - DNA, 28 bp, Artificial Sequence
  Synthetic oligonucleotide
gagttggacaaggggaagggtacaccag

SEQ ID NO: 94736 - DNA, 36 bp, Artificial Sequence
  Synthetic oligonucleotide
gacactcacgaaccctttaatgcatgcccgttccag

SEQ ID NO: 94737 - DNA, 35 bp, Artificial Sequence
  Synthetic oligonucleotide
acaatgaggcgtatggataggcggggtggacggag

SEQ ID NO: 94738 - DNA, 35 bp, Artificial Sequence
  Synthetic oligonucleotide
tcacacggcaatacggccaacgcccacactttacg

SEQ ID NO: 94739 - DNA, 35 bp, Artificial Sequence
  Synthetic oligonucleotide
gtcgggggtaaggaggtaagagttagtgaggagcg

SEQ ID NO: 94740 - DNA, 35 bp, Artificial Sequence
  Synthetic oligonucleotide
gatgagccgctgtctatccgccatgttcgcttagg

SEQ ID NO: 94741 - DNA, 35 bp, Artificial Sequence
  Synthetic oligonucleotide
tagggcgggtgctgcaagggattggagcagaaggg

SEQ ID NO: 94742 - DNA, 35 bp, Artificial Sequence
  Synthetic oligonucleotide
actggccctttccaccgtgtacttaaacgctcggg

SEQ ID NO: 94743 - DNA, 35 bp, Artificial Sequence
  Synthetic oligonucleotide
acgataactccgatgcccttgtgcactcctctatg

SEQ ID NO: 94744 - DNA, 35 bp, Artificial Sequence
  Synthetic oligonucleotide
gatggccaatgccttatgacttttgtgatccactg

SEQ ID NO: 94745 - DNA, 35 bp, Artificial Sequence
  Synthetic oligonucleotide
gcgattagtgctacactggtccacgacaccttttg

SEQ ID NO: 94746 - DNA, 35 bp, Artificial Sequence
  Synthetic oligonucleotide
agcgaaggggcggatgggtggtaaactgcggccat

SEQ ID NO: 94747 - DNA, 35 bp, Artificial Sequence
  Synthetic oligonucleotide
tggtccagagtccaaatcatccgcgacccactcat

SEQ ID NO: 94748 - DNA, 35 bp, Artificial Sequence
  Synthetic oligonucleotide
aagtgacagggaccgaggtaggttgggaggaggat

SEQ ID NO: 94749 - DNA, 35 bp, Artificial Sequence
  Synthetic oligonucleotide
taccacatcctagagccgacacggaggatccctat

SEQ ID NO: 94750 - DNA, 35 bp, Artificial Sequence
  Synthetic oligonucleotide
atgtctggctcgcaaactcacaagtcctgatttat

SEQ ID NO: 94751 - DNA, 35 bp, Artificial Sequence
  Synthetic oligonucleotide
tattctcccccgtaccgcaggaggcttacgcaact

SEQ ID NO: 94752 - DNA, 35 bp, Artificial Sequence
  Synthetic oligonucleotide
gtgcttggccaaccccggctagagcttacttcact

SEQ ID NO: 94753 - DNA, 35 bp, Artificial Sequence
  Synthetic oligonucleotide
tcataccgtacgctgctgctgacctcggtcttcct

SEQ ID NO: 94754 - DNA, 35 bp, Artificial Sequence
  Synthetic oligonucleotide
atgggaagggctcgggaggtggtgcggagggtggt

SEQ ID NO: 94755 - DNA, 35 bp, Artificial Sequence
  Synthetic oligonucleotide
gcactcgaacacatttgcccatagatccagagctt

SEQ ID NO: 94756 - DNA, 35 bp, Artificial Sequence
  Synthetic oligonucleotide
atatgcatgcctgtcgcctcctccccgaaagtttt

SEQ ID NO: 94757 - DNA, 35 bp, Artificial Sequence
  Synthetic oligonucleotide
gagtgcctcgccggggcatgtcaattccaacgaaa

SEQ ID NO: 94758 - DNA, 36 bp, Artificial Sequence
  Synthetic oligonucleotide
ggatgcaccgcgtttgcttcttattctatcgaccaa

SEQ ID NO: 94759 - DNA, 36 bp, Artificial Sequence
  Synthetic oligonucleotide
tcgagcaccacgtgtccctaccagccatgctacgaa

SEQ ID NO: 94760 - DNA, 35 bp, Artificial Sequence
  Synthetic oligonucleotide
tacccgtttagccacgtcctattgccaaatgcaca

SEQ ID NO: 94761 - DNA, 35 bp, Artificial Sequence
  Synthetic oligonucleotide
gctgcctcgcttcatcgtatttctcgttttcgaca

SEQ ID NO: 94762 - DNA, 35 bp, Artificial Sequence
  Synthetic oligonucleotide
gccagccaccgggtgtagtatccgtccccctccca

SEQ ID NO: 94763 - DNA, 36 bp, Artificial Sequence
  Synthetic oligonucleotide
atcgcaccatattcatgttagtaaccatcttttcca

SEQ ID NO: 94764 - DNA, 36 bp, Artificial Sequence
  Synthetic oligonucleotide
acatgcatacgtttatgaataactcatccaccagca

SEQ ID NO: 94765 - DNA, 35 bp, Artificial Sequence
  Synthetic oligonucleotide
tctatccggccacgtactcgcattgaccccctgca

SEQ ID NO: 94766 - DNA, 35 bp, Artificial Sequence
  Synthetic oligonucleotide
accagatgcactgtctggaaccgtaccgtattgca

SEQ ID NO: 94767 - DNA, 36 bp, Artificial Sequence
  Synthetic oligonucleotide
gatcccgacgaaccgtcgacatgacatgacccctca

SEQ ID NO: 94768 - DNA, 37 bp, Artificial Sequence
  Synthetic oligonucleotide
acccatcagccaccctttagtctccattcctggaaga

SEQ ID NO: 94769 - DNA, 35 bp, Artificial Sequence
  Synthetic oligonucleotide
gccacgaatggtgggttggttggctgggggagaga

SEQ ID NO: 94770 - DNA, 36 bp, Artificial Sequence
  Synthetic oligonucleotide
tagtcgccgtaactgaatgtgctggtgatgttgaga

SEQ ID NO: 94771 - DNA, 37 bp, Artificial Sequence
  Synthetic oligonucleotide
atagtgagggggggggcatgatggactgtcgagtaga

SEQ ID NO: 94772 - DNA, 37 bp, Artificial Sequence
  Synthetic oligonucleotide
gactcaaccgcgggtgcttggtaacaagccttaacga

SEQ ID NO: 94773 - DNA, 37 bp, Artificial Sequence
  Synthetic oligonucleotide
ttcatccgcccattgttttatcttctgacccatacga

SEQ ID NO: 94774 - DNA, 37 bp, Artificial Sequence
  Synthetic oligonucleotide
atgactgccgccatccgcatttaagcaggggaaccga

SEQ ID NO: 94775 - DNA, 35 bp, Artificial Sequence
  Synthetic oligonucleotide
tcttacatcctgggttgacgcatgagcctgaccga

SEQ ID NO: 94776 - DNA, 37 bp, Artificial Sequence
  Synthetic oligonucleotide
atcgcgccaatcatgaccttcgcctacacctccgcga

SEQ ID NO: 94777 - DNA, 36 bp, Artificial Sequence
  Synthetic oligonucleotide
tgacacgtctctagtatctttgtactccacctgcga

SEQ ID NO: 94778 - DNA, 36 bp, Artificial Sequence
  Synthetic oligonucleotide
tagcccaactggctctttacacgaagacttactcga

SEQ ID NO: 94779 - DNA, 36 bp, Artificial Sequence
  Synthetic oligonucleotide
gccacgacggaagagggggtcgtctcgatacctcga

SEQ ID NO: 94780 - DNA, 37 bp, Artificial Sequence
  Synthetic oligonucleotide
actcgacggcaagttaaagagcatggtggaggttcga

SEQ ID NO: 94781 - DNA, 36 bp, Artificial Sequence
  Synthetic oligonucleotide
tgacacgacgtcggttgggagctatggggtggcgga

SEQ ID NO: 94782 - DNA, 37 bp, Artificial Sequence
  Synthetic oligonucleotide
gaagggaaaaagtgtggtggatattcggaagagggga

SEQ ID NO: 94783 - DNA, 37 bp, Artificial Sequence
  Synthetic oligonucleotide
gctgacccgagcgtcgctatctgcgctaaattctgga

SEQ ID NO: 94784 - DNA, 36 bp, Artificial Sequence
  Synthetic oligonucleotide
acttcgaccgccacaatctcaaggatcctttctgga

SEQ ID NO: 94785 - DNA, 37 bp, Artificial Sequence
  Synthetic oligonucleotide
ggaacgccccccggacatcgggcagacacctggtgga

SEQ ID NO: 94786 - DNA, 35 bp, Artificial Sequence
  Synthetic oligonucleotide
tcaaggtgcacgaacccaatacaactgccgaatga

SEQ ID NO: 94787 - DNA, 38 bp, Artificial Sequence
  Synthetic oligonucleotide
tgtgaccagtggcattatgacgggggatcgagggatga

SEQ ID NO: 94788 - DNA, 38 bp, Artificial Sequence
  Synthetic oligonucleotide
gagcccggaaagtgggtgaaggggtcggaaaagtatga

SEQ ID NO: 94789 - DNA, 38 bp, Artificial Sequence
  Synthetic oligonucleotide
taccatcgaccgaccctatggctgcttgtcacaactga

SEQ ID NO: 94790 - DNA, 38 bp, Artificial Sequence
  Synthetic oligonucleotide
gtgcacaccctaggacgacatggcaaggagcaacctga

SEQ ID NO: 94791 - DNA, 38 bp, Artificial Sequence
  Synthetic oligonucleotide
tacatgcaactccctccacgatctttcaagggacctga

SEQ ID NO: 94792 - DNA, 36 bp, Artificial Sequence
  Synthetic oligonucleotide
tgttgggagggtagcagaagggcgaacatgaagtga

SEQ ID NO: 94793 - DNA, 38 bp, Artificial Sequence
  Synthetic oligonucleotide
tcaatcatggcacctatatacctctgtcatcaccgtga

SEQ ID NO: 94794 - DNA, 37 bp, Artificial Sequence
  Synthetic oligonucleotide
ttctgccccatctctgagcttcgtttaagttgcgtga

SEQ ID NO: 94795 - DNA, 38 bp, Artificial Sequence
  Synthetic oligonucleotide
ttggaaactgcgagtggagtgtactagcgggagggtga

SEQ ID NO: 94796 - DNA, 34 bp, Artificial Sequence
  Synthetic oligonucleotide
gtccgaccggggcaaactgcaaaccaaactgtga

SEQ ID NO: 94797 - DNA, 37 bp, Artificial Sequence
  Synthetic oligonucleotide
tatgccgagcagtgaattgatcgctccgattttgtga

SEQ ID NO: 94798 - DNA, 38 bp, Artificial Sequence
  Synthetic oligonucleotide
ttggagcaccgcctaggtccgaagctttcctacattga

SEQ ID NO: 94799 - DNA, 38 bp, Artificial Sequence
  Synthetic oligonucleotide
attcccgccccatgtctttgattgagcattaatcttga

SEQ ID NO: 94800 - DNA, 38 bp, Artificial Sequence
  Synthetic oligonucleotide
tccgatgagtgtgggggataggggacttgacacgttga

SEQ ID NO: 94801 - DNA, 38 bp, Artificial Sequence
  Synthetic oligonucleotide
ttgggggtagcagcagaaggtgagttagggggggttga

SEQ ID NO: 94802 - DNA, 38 bp, Artificial Sequence
  Synthetic oligonucleotide
gtctccgccagcctgcgtaaattctgcttgttttttga

SEQ ID NO: 94803 - DNA, 35 bp, Artificial Sequence
  Synthetic oligonucleotide
ttacactaggctgaacgcgcatcgagctcctcata

SEQ ID NO: 94804 - DNA, 36 bp, Artificial Sequence
  Synthetic oligonucleotide
acacaggaacacaaacagaaggccagtgggttgata

SEQ ID NO: 94805 - DNA, 35 bp, Artificial Sequence
  Synthetic oligonucleotide
acttgtcgcctggttcctatggttctgtcaaacta

SEQ ID NO: 94806 - DNA, 34 bp, Artificial Sequence
  Synthetic oligonucleotide
gcgcttatcagcagcaccaatcacagggaagcta

SEQ ID NO: 94807 - DNA, 36 bp, Artificial Sequence
  Synthetic oligonucleotide
gtgcgatgcacaattggcgaaatgccggtctttcta

SEQ ID NO: 94808 - DNA, 36 bp, Artificial Sequence
  Synthetic oligonucleotide
tcacacaacggacacatgcctcagtaaaaaacggta

SEQ ID NO: 94809 - DNA, 36 bp, Artificial Sequence
  Synthetic oligonucleotide
aaaggggagggcagggagggacacttaacgacggta

SEQ ID NO: 94810 - DNA, 36 bp, Artificial Sequence
  Synthetic oligonucleotide
aatgcgccgcagagatcgagagtagtgggtcggtta

SEQ ID NO: 94811 - DNA, 36 bp, Artificial Sequence
  Synthetic oligonucleotide
atctgtaggtcgctgatgaccgcgctaccatgttta

SEQ ID NO: 94812 - DNA, 35 bp, Artificial Sequence
  Synthetic oligonucleotide
acctgtcccgttgacgcttacaacccccgtagcac

SEQ ID NO: 94813 - DNA, 34 bp, Artificial Sequence
  Synthetic oligonucleotide
acccatcgcaccttttatccttcggtttatgcac

SEQ ID NO: 94814 - DNA, 35 bp, Artificial Sequence
  Synthetic oligonucleotide
acacgatggcaccggaaggcagtttcttgctcgac

SEQ ID NO: 94815 - DNA, 35 bp, Artificial Sequence
  Synthetic oligonucleotide
gatggctctccggtgcactatccccgaccgtatac

SEQ ID NO: 94816 - DNA, 35 bp, Artificial Sequence
  Synthetic oligonucleotide
gcctctgcactgtttgctgttctcccgctggctac

SEQ ID NO: 94817 - DNA, 35 bp, Artificial Sequence
  Synthetic oligonucleotide
acatcccgatccgttagtgcatcactgctggcgcc

SEQ ID NO: 94818 - DNA, 35 bp, Artificial Sequence
  Synthetic oligonucleotide
gcgccccagtcactagcgcgatcggagtcccctcc

SEQ ID NO: 94819 - DNA, 35 bp, Artificial Sequence
  Synthetic oligonucleotide
gactccagcctgtatgaggttttgtgtcactctcc

SEQ ID NO: 94820 - DNA, 35 bp, Artificial Sequence
  Synthetic oligonucleotide
ttagcaccaccagttcttcagcgtgaccgcattcc

SEQ ID NO: 94821 - DNA, 35 bp, Artificial Sequence
  Synthetic oligonucleotide
ttgcacttgcgcgttgtccatcaagctactcaatc

SEQ ID NO: 94822 - DNA, 35 bp, Artificial Sequence
  Synthetic oligonucleotide
gaaatcgggggggagaggaaacgtcacggggaatc

SEQ ID NO: 94823 - DNA, 35 bp, Artificial Sequence
  Synthetic oligonucleotide
acacagcctactctgtcttgtcgtctccggatctc

SEQ ID NO: 94824 - DNA, 35 bp, Artificial Sequence
  Synthetic oligonucleotide
gatgagcagacacgttccacgcccgtataactctc

SEQ ID NO: 94825 - DNA, 35 bp, Artificial Sequence
  Synthetic oligonucleotide
acaccaaagcgggaagaattaaacgtgaaaatgtc

SEQ ID NO: 94826 - DNA, 35 bp, Artificial Sequence
  Synthetic oligonucleotide
gtaacagcaccacattcagcatcgcaattccattc

SEQ ID NO: 94827 - DNA, 35 bp, Artificial Sequence
  Synthetic oligonucleotide
atccgggcccctgtgtttttggctctcacaccttc

SEQ ID NO: 94828 - DNA, 35 bp, Artificial Sequence
  Synthetic oligonucleotide
gagtccctgtcccatgcggggattacctattgttc

SEQ ID NO: 94829 - DNA, 35 bp, Artificial Sequence
  Synthetic oligonucleotide
gtcgccccatccatctactcgttccaactttgaag

SEQ ID NO: 94830 - DNA, 35 bp, Artificial Sequence
  Synthetic oligonucleotide
gtagccccaaccctcatcgcgacaccccatggacg

SEQ ID NO: 94831 - DNA, 35 bp, Artificial Sequence
  Synthetic oligonucleotide
tttagcgcaccaggttctcactctcttggctttcg

SEQ ID NO: 94832 - DNA, 35 bp, Artificial Sequence
  Synthetic oligonucleotide
ggtatagtcgggtagggatggagagtggaaatagg

SEQ ID NO: 94833 - DNA, 35 bp, Artificial Sequence
  Synthetic oligonucleotide
atgtgccgcaaagatatgactggtggcggcaaggg

SEQ ID NO: 94834 - DNA, 35 bp, Artificial Sequence
  Synthetic oligonucleotide
tacttgctccacgacgccctcagccatactgctgg

SEQ ID NO: 94835 - DNA, 35 bp, Artificial Sequence
  Synthetic oligonucleotide
ttacgtgcgcagggatggatcagtgggactgcatg

SEQ ID NO: 94836 - DNA, 35 bp, Artificial Sequence
  Synthetic oligonucleotide
gtagggatacgaggaaccgtggggacagtcatttg

SEQ ID NO: 94837 - DNA, 35 bp, Artificial Sequence
  Synthetic oligonucleotide
aatccatcctggcccgccccagagagacatggagt

SEQ ID NO: 94838 - DNA, 35 bp, Artificial Sequence
  Synthetic oligonucleotide
agttgtcgcggaacggtcggaggcttgggtacggt

SEQ ID NO: 94839 - DNA, 35 bp, Artificial Sequence
  Synthetic oligonucleotide
gactgccgtacagccgtaccactttcttcacactt

SEQ ID NO: 94840 - DNA, 35 bp, Artificial Sequence
  Synthetic oligonucleotide
gcacccagctgcagctcttggcaccacctcgactt

SEQ ID NO: 94841 - DNA, 35 bp, Artificial Sequence
  Synthetic oligonucleotide
tggtccgcaacatgcccgtgttgcttcgtatactt

SEQ ID NO: 94842 - DNA, 36 bp, Artificial Sequence
  Synthetic oligonucleotide
gccagacgggaagaaataggacgggtgaagtagaaa

SEQ ID NO: 94843 - DNA, 36 bp, Artificial Sequence
  Synthetic oligonucleotide
ttggaaggtggttgtgtaagggcatgtcgtctacaa

SEQ ID NO: 94844 - DNA, 35 bp, Artificial Sequence
  Synthetic oligonucleotide
gactatcggagagggttatgacggagatagggcaa

SEQ ID NO: 94845 - DNA, 36 bp, Artificial Sequence
  Synthetic oligonucleotide
gcacaccggagaggtgggacaaagagggtattttaa

SEQ ID NO: 94846 - DNA, 35 bp, Artificial Sequence
  Synthetic oligonucleotide
gtgagcactcattggacgaaaatacggtttgaaca

SEQ ID NO: 94847 - DNA, 35 bp, Artificial Sequence
  Synthetic oligonucleotide
atgcccaccacgcacgtagatccattatcagcaca

SEQ ID NO: 94848 - DNA, 36 bp, Artificial Sequence
  Synthetic oligonucleotide
gaaatccgcggtgtcctggtcatcccgtccgtacca

SEQ ID NO: 94849 - DNA, 36 bp, Artificial Sequence
  Synthetic oligonucleotide
tgtcgccgttcccttccgctaaaggtacgattacca

SEQ ID NO: 94850 - DNA, 36 bp, Artificial Sequence
  Synthetic oligonucleotide
tcacggtccatgataactcccccttcctcaacgcca

SEQ ID NO: 94851 - DNA, 36 bp, Artificial Sequence
  Synthetic oligonucleotide
tagctgccactcgtccgctggatacctccgctgcca

SEQ ID NO: 94852 - DNA, 36 bp, Artificial Sequence
  Synthetic oligonucleotide
agattcgtccatcttagcgatcgcgtgttccatcca

SEQ ID NO: 94853 - DNA, 35 bp, Artificial Sequence
  Synthetic oligonucleotide
aatgcgcgcgccccacctatctgacttagggtcca

SEQ ID NO: 94854 - DNA, 35 bp, Artificial Sequence
  Synthetic oligonucleotide
agccgggatccacaaggggcatgtagggaaaggca

SEQ ID NO: 94855 - DNA, 35 bp, Artificial Sequence
  Synthetic oligonucleotide
gaccgacaatcatccgtctattggcgttaccctca

SEQ ID NO: 94856 - DNA, 36 bp, Artificial Sequence
  Synthetic oligonucleotide
acgtacgacgagcgcatcttattggggtctggctca

SEQ ID NO: 94857 - DNA, 36 bp, Artificial Sequence
  Synthetic oligonucleotide
gcacccgccgcaccttttcctgttctctagaggtca

SEQ ID NO: 94858 - DNA, 36 bp, Artificial Sequence
  Synthetic oligonucleotide
taccagtcgccgttgttagcttttgtgccagccaga

SEQ ID NO: 94859 - DNA, 37 bp, Artificial Sequence
  Synthetic oligonucleotide
atgttgggtcgggcatagcaaacggctgataagcaga

SEQ ID NO: 94860 - DNA, 37 bp, Artificial Sequence
  Synthetic oligonucleotide
atggatagtgaaggcggaagaaagacaacgaggcaga

SEQ ID NO: 94861 - DNA, 35 bp, Artificial Sequence
  Synthetic oligonucleotide
acaacgtgactgcagatgaaatgctggggatgaga

SEQ ID NO: 94862 - DNA, 35 bp, Artificial Sequence
  Synthetic oligonucleotide
gtaggccacttgagctatcttgcatttttctgaga

SEQ ID NO: 94863 - DNA, 36 bp, Artificial Sequence
  Synthetic oligonucleotide
tgcataacgcagctctgtacttttttgcttaaccga

SEQ ID NO: 94864 - DNA, 37 bp, Artificial Sequence
  Synthetic oligonucleotide
aactgcccaacaggagtcgaacatagtcccaggccga

SEQ ID NO: 94865 - DNA, 36 bp, Artificial Sequence
  Synthetic oligonucleotide
gacggaacgatgggaaattctgtaggtgaaggagga

SEQ ID NO: 94866 - DNA, 35 bp, Artificial Sequence
  Synthetic oligonucleotide
gcactggcacagggaattggtccactaagggagga

SEQ ID NO: 94867 - DNA, 35 bp, Artificial Sequence
  Synthetic oligonucleotide
accacaatcacaagcccttatagatgatagtagga

SEQ ID NO: 94868 - DNA, 37 bp, Artificial Sequence
  Synthetic oligonucleotide
ttcacgcaagcgaccttcgaaaaagggggtacaggga

SEQ ID NO: 94869 - DNA, 37 bp, Artificial Sequence
  Synthetic oligonucleotide
gaggaagggaagcaggctagagagacaacaggtggga

SEQ ID NO: 94870 - DNA, 35 bp, Artificial Sequence
  Synthetic oligonucleotide
tgccagggagagcggaacggtaggttcatgtggga

SEQ ID NO: 94871 - DNA, 37 bp, Artificial Sequence
  Synthetic oligonucleotide
gccctgaacctgcctcaaccgggactgtcctattgga

SEQ ID NO: 94872 - DNA, 37 bp, Artificial Sequence
  Synthetic oligonucleotide
ttggccgttcgacacatcctcgttaacctgctttgga

SEQ ID NO: 94873 - DNA, 35 bp, Artificial Sequence
  Synthetic oligonucleotide
gatgctacaacaacatacacgtcgtcatacaatga

SEQ ID NO: 94874 - DNA, 36 bp, Artificial Sequence
  Synthetic oligonucleotide
tatggtcgagcagagaacaagaagccgattcaatga

SEQ ID NO: 94875 - DNA, 38 bp, Artificial Sequence
  Synthetic oligonucleotide
atgttgaggggaggggaggggccgaggaataagaatga

SEQ ID NO: 94876 - DNA, 38 bp, Artificial Sequence
  Synthetic oligonucleotide
agacgccaccaaatcatagctatgagttcaccgaatga

SEQ ID NO: 94877 - DNA, 38 bp, Artificial Sequence
  Synthetic oligonucleotide
tgtacacctatcgccttgctaaagagccacctgaatga

SEQ ID NO: 94878 - DNA, 38 bp, Artificial Sequence
  Synthetic oligonucleotide
gagccagaggatggctatgagtcgacgggggaggatga

SEQ ID NO: 94879 - DNA, 38 bp, Artificial Sequence
  Synthetic oligonucleotide
gtgggtacgaatagagctggagtaaaaatggcggatga

SEQ ID NO: 94880 - DNA, 38 bp, Artificial Sequence
  Synthetic oligonucleotide
tgtgctgtggtctcccgcgctttctccacagtcactga

SEQ ID NO: 94881 - DNA, 37 bp, Artificial Sequence
  Synthetic oligonucleotide
gtagtacgtctgaagtcctcacctcttcttacgctga

SEQ ID NO: 94882 - DNA, 37 bp, Artificial Sequence
  Synthetic oligonucleotide
gactgcctccagactccgcactgcttgtctaatctga

SEQ ID NO: 94883 - DNA, 38 bp, Artificial Sequence
  Synthetic oligonucleotide
gagatcacaggccctggttacaagcgatccatctctga

SEQ ID NO: 94884 - DNA, 37 bp, Artificial Sequence
  Synthetic oligonucleotide
aactccgacccgaatagtggcgatcaatccaccgtga

SEQ ID NO: 94885 - DNA, 36 bp, Artificial Sequence
  Synthetic oligonucleotide
acaagccgttcaggcctggctaccctacttccgtga

SEQ ID NO: 94886 - DNA, 38 bp, Artificial Sequence
  Synthetic oligonucleotide
tcaccaggtggtagaaagcgtggcgacaacatgcgtga

SEQ ID NO: 94887 - DNA, 38 bp, Artificial Sequence
  Synthetic oligonucleotide
acatcttgccaaacatttttaacgtcatcccttcgtga

SEQ ID NO: 94888 - DNA, 38 bp, Artificial Sequence
  Synthetic oligonucleotide
aacgcgtgagcaagaatatcggggaatggctaaggtga

SEQ ID NO: 94889 - DNA, 38 bp, Artificial Sequence
  Synthetic oligonucleotide
tacagggaggggtgcacgagtccatgacaggaatgtga

SEQ ID NO: 94890 - DNA, 36 bp, Artificial Sequence
  Synthetic oligonucleotide
gcccgcactcctgatttcggtccgtcattcttgtga

SEQ ID NO: 94891 - DNA, 38 bp, Artificial Sequence
  Synthetic oligonucleotide
acaacgacatccatattgacacagtcaacagaaattga

SEQ ID NO: 94892 - DNA, 37 bp, Artificial Sequence
  Synthetic oligonucleotide
aatagcccacgtgtgtccatctctcattatccattga

SEQ ID NO: 94893 - DNA, 38 bp, Artificial Sequence
  Synthetic oligonucleotide
atcaggcccgcctccaattacgtgtgatcctttattga

SEQ ID NO: 94894 - DNA, 38 bp, Artificial Sequence
  Synthetic oligonucleotide
aacacgcgatgctacgggcgcgactctctatcacttga

SEQ ID NO: 94895 - DNA, 37 bp, Artificial Sequence
  Synthetic oligonucleotide
accgccgccaaggagggattacgagccctctcgttga

SEQ ID NO: 94896 - DNA, 38 bp, Artificial Sequence
  Synthetic oligonucleotide
agtcaccactcgtattttgcacctgcgttccctgttga

SEQ ID NO: 94897 - DNA, 38 bp, Artificial Sequence
  Synthetic oligonucleotide
atcaccacagtgcccctgagttctcgccgttcctttga

SEQ ID NO: 94898 - DNA, 38 bp, Artificial Sequence
  Synthetic oligonucleotide
acccgcttcacatgcctccttattgaagccttctttga

SEQ ID NO: 94899 - DNA, 37 bp, Artificial Sequence
  Synthetic oligonucleotide
tgagggccgacctggagtgctttcgctggttctttga

SEQ ID NO: 94900 - DNA, 36 bp, Artificial Sequence
  Synthetic oligonucleotide
ttgaacacacgccctgttgaaaatggtttacaccta

SEQ ID NO: 94901 - DNA, 36 bp, Artificial Sequence
  Synthetic oligonucleotide
actcgcctcagggcctgaatgatctcgttgcttcta

SEQ ID NO: 94902 - DNA, 35 bp, Artificial Sequence
  Synthetic oligonucleotide
agccaccattccgcttgcccattaaccagtgagta

SEQ ID NO: 94903 - DNA, 35 bp, Artificial Sequence
  Synthetic oligonucleotide
gcacgctaccggtccatttagctccaccgtgcgta

SEQ ID NO: 94904 - DNA, 36 bp, Artificial Sequence
  Synthetic oligonucleotide
tagacctccgcctgctccttgtagagctgaaattta

SEQ ID NO: 94905 - DNA, 35 bp, Artificial Sequence
  Synthetic oligonucleotide
gcgatagccgccctagtccttacccacccgtgaac

SEQ ID NO: 94906 - DNA, 35 bp, Artificial Sequence
  Synthetic oligonucleotide
aatgcacctgaggtcgacttgtctttccctctcac

SEQ ID NO: 94907 - DNA, 35 bp, Artificial Sequence
  Synthetic oligonucleotide
tgacccggtaacagacatcttcaaaagccacagac

SEQ ID NO: 94908 - DNA, 35 bp, Artificial Sequence
  Synthetic oligonucleotide
agacccccacatgctactgccactggtcttgggac

SEQ ID NO: 94909 - DNA, 35 bp, Artificial Sequence
  Synthetic oligonucleotide
accgcctcaggccctcctgtaccctgagcctatac

SEQ ID NO: 94910 - DNA, 34 bp, Artificial Sequence
  Synthetic oligonucleotide
atgcaccccgcttagatccacctaagtttacacc

SEQ ID NO: 94911 - DNA, 35 bp, Artificial Sequence
  Synthetic oligonucleotide
tgtcccaccgccctgtatcccagcttatataggcc

SEQ ID NO: 94912 - DNA, 35 bp, Artificial Sequence
  Synthetic oligonucleotide
gagctcgactcactcgcgagaagacccgccatgcc

SEQ ID NO: 94913 - DNA, 35 bp, Artificial Sequence
  Synthetic oligonucleotide
tctgcccgcaaggtcgcttcacaggtttgtttgcc

SEQ ID NO: 94914 - DNA, 34 bp, Artificial Sequence
  Synthetic oligonucleotide
atcccgcacaatcgttcgaacaagggccaccagc

SEQ ID NO: 94915 - DNA, 35 bp, Artificial Sequence
  Synthetic oligonucleotide
gagacagccttgctggaagtcaatcctattatcgc

SEQ ID NO: 94916 - DNA, 35 bp, Artificial Sequence
  Synthetic oligonucleotide
tgtgccatgcaacaatatgatcgtcccaaccgtgc

SEQ ID NO: 94917 - DNA, 35 bp, Artificial Sequence
  Synthetic oligonucleotide
taccatggcgcgcgctacttacgtcagacacaatc

SEQ ID NO: 94918 - DNA, 34 bp, Artificial Sequence
  Synthetic oligonucleotide
gaaaaccccgccgacattccctatgggagacatc

SEQ ID NO: 94919 - DNA, 35 bp, Artificial Sequence
  Synthetic oligonucleotide
tccgcaactcgcttcgagtaaacttgtgatgcctc

SEQ ID NO: 94920 - DNA, 35 bp, Artificial Sequence
  Synthetic oligonucleotide
acgacgggacactggtgaggacggtgggtctagag

SEQ ID NO: 94921 - DNA, 35 bp, Artificial Sequence
  Synthetic oligonucleotide
tccatggggagacaaaaggaatgtataggaaggag

SEQ ID NO: 94922 - DNA, 35 bp, Artificial Sequence
  Synthetic oligonucleotide
gaagtgagccaataaagattcaggagatcagggag

SEQ ID NO: 94923 - DNA, 35 bp, Artificial Sequence
  Synthetic oligonucleotide
agcaggagtagggggtacaggaatggtcggattag

SEQ ID NO: 94924 - DNA, 35 bp, Artificial Sequence
  Synthetic oligonucleotide
accagccaccttgtatatttattgtatgcccgccg

SEQ ID NO: 94925 - DNA, 35 bp, Artificial Sequence
  Synthetic oligonucleotide
ggacaaactcgcagacacctgatttaggcccatcg

SEQ ID NO: 94926 - DNA, 35 bp, Artificial Sequence
  Synthetic oligonucleotide
atgctggtggggaaagaagacaccagcgggaaagg

SEQ ID NO: 94927 - DNA, 35 bp, Artificial Sequence
  Synthetic oligonucleotide
agtggtggccaatttacggtaagggatggtggagg

SEQ ID NO: 94928 - DNA, 35 bp, Artificial Sequence
  Synthetic oligonucleotide
taccgacccagatggcaaagggggagcatggtggg

SEQ ID NO: 94929 - DNA, 35 bp, Artificial Sequence
  Synthetic oligonucleotide
gaagggacgcgtggtcgctgtctaactcattgttg

SEQ ID NO: 94930 - DNA, 35 bp, Artificial Sequence
  Synthetic oligonucleotide
aacacccggacgggaggcagaggagccatcttttg

SEQ ID NO: 94931 - DNA, 35 bp, Artificial Sequence
  Synthetic oligonucleotide
tgcacgccacccctccccactacgaatgccgcaat

SEQ ID NO: 94932 - DNA, 35 bp, Artificial Sequence
  Synthetic oligonucleotide
accgcccacgtactaacgcgaacacatccgaccat

SEQ ID NO: 94933 - DNA, 35 bp, Artificial Sequence
  Synthetic oligonucleotide
gcgatgcaagccatcatcgtcgcctatttacctat

SEQ ID NO: 94934 - DNA, 34 bp, Artificial Sequence
  Synthetic oligonucleotide
taaccatggagcttgaatgtagctgtttcaccct

SEQ ID NO: 94935 - DNA, 35 bp, Artificial Sequence
  Synthetic oligonucleotide
acaatgcggagccaggtgaccaccgtactatttct

SEQ ID NO: 94936 - DNA, 35 bp, Artificial Sequence
  Synthetic oligonucleotide
acacaatcgggagggtccgggagagagaggtgcgt

SEQ ID NO: 94937 - DNA, 35 bp, Artificial Sequence
  Synthetic oligonucleotide
agacgagaacggtacggggaaggttaatagtcggt

SEQ ID NO: 94938 - DNA, 35 bp, Artificial Sequence
  Synthetic oligonucleotide
tacgtacagagtcacatacattcatgctaccttgt

SEQ ID NO: 94939 - DNA, 35 bp, Artificial Sequence
  Synthetic oligonucleotide
agtgtgcctgccgtttatccgctctatccgtgatt

SEQ ID NO: 94940 - DNA, 35 bp, Artificial Sequence
  Synthetic oligonucleotide
gactgtagcctccgtgaccctatgtcttcataaaa

SEQ ID NO: 94941 - DNA, 36 bp, Artificial Sequence
  Synthetic oligonucleotide
gtccaaacggcgctgggcatccggggtgggcacaaa

SEQ ID NO: 94942 - DNA, 35 bp, Artificial Sequence
  Synthetic oligonucleotide
gacgactggtagtgaagggaggtaagatagcgaaa

SEQ ID NO: 94943 - DNA, 35 bp, Artificial Sequence
  Synthetic oligonucleotide
tagcgcgtaactgcgtcgtctatttgccctcgaaa

SEQ ID NO: 94944 - DNA, 36 bp, Artificial Sequence
  Synthetic oligonucleotide
gtcgccacctccctggtcaattgtacaccgctccaa

SEQ ID NO: 94945 - DNA, 36 bp, Artificial Sequence
  Synthetic oligonucleotide
aatgagagggaggagagtgagcggtattagcatgaa

SEQ ID NO: 94946 - DNA, 36 bp, Artificial Sequence
  Synthetic oligonucleotide
gccgcgtagtaacggggccttctgactcagccaaca

SEQ ID NO: 94947 - DNA, 36 bp, Artificial Sequence
  Synthetic oligonucleotide
tgtgacgatagagcggaactcccacatttttcaaca

SEQ ID NO: 94948 - DNA, 36 bp, Artificial Sequence
  Synthetic oligonucleotide
gcaaaggtggaccgggaaagttggaatgcgggaaca

SEQ ID NO: 94949 - DNA, 35 bp, Artificial Sequence
  Synthetic oligonucleotide
atgtccccggaacagggagtttactctacgtaaca

SEQ ID NO: 94950 - DNA, 35 bp, Artificial Sequence
  Synthetic oligonucleotide
tagtgtgcatgcgctgaaacacgtcttcaaaccca

SEQ ID NO: 94951 - DNA, 36 bp, Artificial Sequence
  Synthetic oligonucleotide
tgtagggtagctgttccttagcagcacatgcctcca

SEQ ID NO: 94952 - DNA, 36 bp, Artificial Sequence
  Synthetic oligonucleotide
tacccctacagtgagacggcttacatgctttgagca

SEQ ID NO: 94953 - DNA, 35 bp, Artificial Sequence
  Synthetic oligonucleotide
gcacggtcgtgttcgatattcgatcctgccactca

SEQ ID NO: 94954 - DNA, 35 bp, Artificial Sequence
  Synthetic oligonucleotide
gatcaatgcagacggtgcacgggcaatggtgttca

SEQ ID NO: 94955 - DNA, 37 bp, Artificial Sequence
  Synthetic oligonucleotide
tctacacatcctgttaccaattatctgtcgctgcaga

SEQ ID NO: 94956 - DNA, 37 bp, Artificial Sequence
  Synthetic oligonucleotide
gtccagaggagtgagcgggggtaagggtttgttcaga

SEQ ID NO: 94957 - DNA, 37 bp, Artificial Sequence
  Synthetic oligonucleotide
taacaggggggagggctaaagtcaaccgggggggaga

SEQ ID NO: 94958 - DNA, 37 bp, Artificial Sequence
  Synthetic oligonucleotide
gcatgctgcaaagcggtttggacggagggctttgaga

SEQ ID NO: 94959 - DNA, 36 bp, Artificial Sequence
  Synthetic oligonucleotide
atactgacgacgaggggggactttattggagaacga

SEQ ID NO: 94960 - DNA, 37 bp, Artificial Sequence
  Synthetic oligonucleotide
ttgttgggcggccaatgggaaaactgggggggaacga

SEQ ID NO: 94961 - DNA, 37 bp, Artificial Sequence
  Synthetic oligonucleotide
tacgcacttggatgttgttgttgtcattcccgaccga

SEQ ID NO: 94962 - DNA, 37 bp, Artificial Sequence
  Synthetic oligonucleotide
tccacggtccaagtgacgactaaatcacgtccgccga

SEQ ID NO: 94963 - DNA, 37 bp, Artificial Sequence
  Synthetic oligonucleotide
gacccgccctcgggattggctagcccaccgtctccga

SEQ ID NO: 94964 - DNA, 35 bp, Artificial Sequence
  Synthetic oligonucleotide
ggactgcaaagcaacgaaggggttacgaaacgcga

SEQ ID NO: 94965 - DNA, 37 bp, Artificial Sequence
  Synthetic oligonucleotide
gatgagcctgctgtggtattatgctgcggaagggcga

SEQ ID NO: 94966 - DNA, 37 bp, Artificial Sequence
  Synthetic oligonucleotide
tagccataggactgaggggagtggggacgttgttcga

SEQ ID NO: 94967 - DNA, 36 bp, Artificial Sequence
  Synthetic oligonucleotide
gacactggcaagtatagggagcgatccgggaaagga

SEQ ID NO: 94968 - DNA, 37 bp, Artificial Sequence
  Synthetic oligonucleotide
gacatgcggggtgtaggagagggcattggtgtaagga

SEQ ID NO: 94969 - DNA, 37 bp, Artificial Sequence
  Synthetic oligonucleotide
tgttgcgctaccagccctattatgtttgccctgagga

SEQ ID NO: 94970 - DNA, 37 bp, Artificial Sequence
  Synthetic oligonucleotide
gagtgccgcagcacgctacactggaccagatatagga

SEQ ID NO: 94971 - DNA, 37 bp, Artificial Sequence
  Synthetic oligonucleotide
gatgcacacccatggttcgcgtagcagtccacacgga

SEQ ID NO: 94972 - DNA, 37 bp, Artificial Sequence
  Synthetic oligonucleotide
tattgcggggagcttatgcagagggagggtgggcgga

SEQ ID NO: 94973 - DNA, 37 bp, Artificial Sequence
  Synthetic oligonucleotide
gctgatgaggtagatcagtagagtaatacaggtggga

SEQ ID NO: 94974 - DNA, 36 bp, Artificial Sequence
  Synthetic oligonucleotide
tgaactagggtgagtagtgtgctcacggcacatgga

SEQ ID NO: 94975 - DNA, 37 bp, Artificial Sequence
  Synthetic oligonucleotide
ttcactgtaaagacgtaatgaggggggaacggatgga

SEQ ID NO: 94976 - DNA, 35 bp, Artificial Sequence
  Synthetic oligonucleotide
tcagcccactacagaccacccgcgctccacctgga

SEQ ID NO: 94977 - DNA, 37 bp, Artificial Sequence
  Synthetic oligonucleotide
gcctagcccaacatgtgtacgcacgctacccgaatga

SEQ ID NO: 94978 - DNA, 37 bp, Artificial Sequence
  Synthetic oligonucleotide
tgagatgcctcaaggggatatggggtggtcgacatga

SEQ ID NO: 94979 - DNA, 37 bp, Artificial Sequence
  Synthetic oligonucleotide
gcccatggtcacgacgcttttctcatggtaaccatga

SEQ ID NO: 94980 - DNA, 38 bp, Artificial Sequence
  Synthetic oligonucleotide
acaggccgactctgcgtaccaccgggttattaccatga

SEQ ID NO: 94981 - DNA, 38 bp, Artificial Sequence
  Synthetic oligonucleotide
tgcatttgccgtccatatcatctatagccgctccatga

SEQ ID NO: 94982 - DNA, 38 bp, Artificial Sequence
  Synthetic oligonucleotide
tacgaagggtccgcagcagataacgatcagggagatga

SEQ ID NO: 94983 - DNA, 38 bp, Artificial Sequence
  Synthetic oligonucleotide
gaagatggaagacgggacgtagaaggcgtaggtgatga

SEQ ID NO: 94984 - DNA, 38 bp, Artificial Sequence
  Synthetic oligonucleotide
aacgagaaacgtggagtaggtagtggaagtctgtatga

SEQ ID NO: 94985 - DNA, 37 bp, Artificial Sequence
  Synthetic oligonucleotide
tgacaccatcgccgccctcccgagcatcgatcactga

SEQ ID NO: 94986 - DNA, 38 bp, Artificial Sequence
  Synthetic oligonucleotide
gtagcgtagcagtgcacgaacccctgattttcccctga

SEQ ID NO: 94987 - DNA, 38 bp, Artificial Sequence
  Synthetic oligonucleotide
gatgcgccactgtgcctcttgccgggaacgttccctga

SEQ ID NO: 94988 - DNA, 38 bp, Artificial Sequence
  Synthetic oligonucleotide
tccaaactccacggtcacatgatgcacacagcatctga

SEQ ID NO: 94989 - DNA, 38 bp, Artificial Sequence
  Synthetic oligonucleotide
gaagcatgactcaatctcctatgggacatcatgcgtga

SEQ ID NO: 94990 - DNA, 38 bp, Artificial Sequence
  Synthetic oligonucleotide
ggtaggtaacagatggggcatacggggagttatcgtga

SEQ ID NO: 94991 - DNA, 36 bp, Artificial Sequence
  Synthetic oligonucleotide
tgtacgggagggctgggaggtagattacgtgtgtga

SEQ ID NO: 94992 - DNA, 37 bp, Artificial Sequence
  Synthetic oligonucleotide
tgggaggggctaagatgtttaggggacaggggattga

SEQ ID NO: 94993 - DNA, 38 bp, Artificial Sequence
  Synthetic oligonucleotide
tgaggcccagccaacattgtccagcgccgacctattga

SEQ ID NO: 94994 - DNA, 38 bp, Artificial Sequence
  Synthetic oligonucleotide
aggaccgcacccgtgttgtatcaacgcccccttattga

SEQ ID NO: 94995 - DNA, 37 bp, Artificial Sequence
  Synthetic oligonucleotide
atttgcgcacgaatccagacgatctttctcccgttga

SEQ ID NO: 94996 - DNA, 35 bp, Artificial Sequence
  Synthetic oligonucleotide
tgcccatcctcgctcatcagcttccagggttttga

SEQ ID NO: 94997 - DNA, 35 bp, Artificial Sequence
  Synthetic oligonucleotide
aacctgcaagccaactgcgcaccacttggagaata

SEQ ID NO: 94998 - DNA, 36 bp, Artificial Sequence
  Synthetic oligonucleotide
gatgaggtggggtcttagcgcttaggaggaagtata

SEQ ID NO: 94999 - DNA, 36 bp, Artificial Sequence
  Synthetic oligonucleotide
gaccaatgtcgatcgattcgtgccatcgcccaacta

SEQ ID NO: 95000 - DNA, 36 bp, Artificial Sequence
  Synthetic oligonucleotide
aacatacgccccgttgcgtaaccgagttcgaaccta

SEQ ID NO: 95001 - DNA, 36 bp, Artificial Sequence
  Synthetic oligonucleotide
taccatctccgccgaagttaaagtcgctgtaaccta

SEQ ID NO: 95002 - DNA, 36 bp, Artificial Sequence
  Synthetic oligonucleotide
tcaacgcgcacatacacttcctgacgttcgtagcta

SEQ ID NO: 95003 - DNA, 36 bp, Artificial Sequence
  Synthetic oligonucleotide
gagagatgggcccgagtaacagggagaaggcgagta

SEQ ID NO: 95004 - DNA, 36 bp, Artificial Sequence
  Synthetic oligonucleotide
tcccagctcctgaccatcatactcacagccaccgta

SEQ ID NO: 95005 - DNA, 36 bp, Artificial Sequence
  Synthetic oligonucleotide
ttcgtagtggggggagaacttcaagacgcactgtta

SEQ ID NO: 95006 - DNA, 35 bp, Artificial Sequence
  Synthetic oligonucleotide
gccactcggcggaattcacagcgaaggccctttta

SEQ ID NO: 95007 - DNA, 35 bp, Artificial Sequence
  Synthetic oligonucleotide
acaaaggcacgcacttgcccactccttggttcaac

SEQ ID NO: 95008 - DNA, 35 bp, Artificial Sequence
  Synthetic oligonucleotide
aaccacagctaatggctttcgattacttatttaac

SEQ ID NO: 95009 - DNA, 34 bp, Artificial Sequence
  Synthetic oligonucleotide
gtttagcgcagctctccttgcacctgcctctcac

SEQ ID NO: 95010 - DNA, 35 bp, Artificial Sequence
  Synthetic oligonucleotide
gaggtggccagggggaaggaagcgcggcaaactac

SEQ ID NO: 95011 - DNA, 35 bp, Artificial Sequence
  Synthetic oligonucleotide
tcattaccgccaaatctgcacagtaatatccctac

SEQ ID NO: 95012 - DNA, 35 bp, Artificial Sequence
  Synthetic oligonucleotide
acgtgtaaagcggtcaacatataatcaccgtcacc

SEQ ID NO: 95013 - DNA, 34 bp, Artificial Sequence
  Synthetic oligonucleotide
ggttagcgcagctctccttgcacctgcctctccc

SEQ ID NO: 95014 - DNA, 35 bp, Artificial Sequence
  Synthetic oligonucleotide
tgcaaatccagctgccgtcccccccgaccccatcc

SEQ ID NO: 95015 - DNA, 35 bp, Artificial Sequence
  Synthetic oligonucleotide
gcgaactgcgaagcgtttcgtctccatttagctcc

SEQ ID NO: 95016 - DNA, 34 bp, Artificial Sequence
  Synthetic oligonucleotide
ggtcgccgtacgacggacagggaataaagatagc

SEQ ID NO: 95017 - DNA, 35 bp, Artificial Sequence
  Synthetic oligonucleotide
accacccgagagcttacgtcatggaatttccaatc

SEQ ID NO: 95018 - DNA, 35 bp, Artificial Sequence
  Synthetic oligonucleotide
tctaacagccccacaaacaagtgtcatcccggatc

SEQ ID NO: 95019 - DNA, 35 bp, Artificial Sequence
  Synthetic oligonucleotide
ttgcacccagctcaccccagtatgtcaccacgctc

SEQ ID NO: 95020 - DNA, 35 bp, Artificial Sequence
  Synthetic oligonucleotide
tccgatcaacctcgcgtagtcgctaaaatgatctc

SEQ ID NO: 95021 - DNA, 35 bp, Artificial Sequence
  Synthetic oligonucleotide
tgtacccaacgtagcatcaagctgactccatattc

SEQ ID NO: 95022 - DNA, 35 bp, Artificial Sequence
  Synthetic oligonucleotide
acatgatgggagaacggcgaaaagagacgctcttc

SEQ ID NO: 95023 - DNA, 36 bp, Artificial Sequence
  Synthetic oligonucleotide
gaggagaggatggaagtctaggggcaagggtccgag

SEQ ID NO: 95024 - DNA, 35 bp, Artificial Sequence
  Synthetic oligonucleotide
gcccacgactcctcgaatgctgcacaggttcatag

SEQ ID NO: 95025 - DNA, 35 bp, Artificial Sequence
  Synthetic oligonucleotide
tcagtccagggccgtttcgcactatcacatattag

SEQ ID NO: 95026 - DNA, 35 bp, Artificial Sequence
  Synthetic oligonucleotide
acatgtgacgcaacatgtattgaggattggaaacg

SEQ ID NO: 95027 - DNA, 35 bp, Artificial Sequence
  Synthetic oligonucleotide
tgcagagctactgcataatccggaaccttgcttcg

SEQ ID NO: 95028 - DNA, 35 bp, Artificial Sequence
  Synthetic oligonucleotide
gtggtggccgggagaggcatgacacgaatcaacgg

SEQ ID NO: 95029 - DNA, 35 bp, Artificial Sequence
  Synthetic oligonucleotide
gccgttcccccggtctgttatattccctgcgcatg

SEQ ID NO: 95030 - DNA, 35 bp, Artificial Sequence
  Synthetic oligonucleotide
tgccatcactaatacggtcgacggaaacattactg

SEQ ID NO: 95031 - DNA, 35 bp, Artificial Sequence
  Synthetic oligonucleotide
tcctgggcctacgattagtgttctggttccatctg

SEQ ID NO: 95032 - DNA, 35 bp, Artificial Sequence
  Synthetic oligonucleotide
taccacagcctggcccgacgcatgacttatgcttg

SEQ ID NO: 95033 - DNA, 36 bp, Artificial Sequence
  Synthetic oligonucleotide
tgtgtgctgggccagagaaaaattgggtgggggttg

SEQ ID NO: 95034 - DNA, 35 bp, Artificial Sequence
  Synthetic oligonucleotide
tactctgaacgtcccgcagcctcagactctcgtct

SEQ ID NO: 95035 - DNA, 35 bp, Artificial Sequence
  Synthetic oligonucleotide
gagaagtgagagttatagggtggaaaagattgcgt

SEQ ID NO: 95036 - DNA, 35 bp, Artificial Sequence
  Synthetic oligonucleotide
tagattcaccagcctgatcgccgttgctgaaatgt

SEQ ID NO: 95037 - DNA, 35 bp, Artificial Sequence
  Synthetic oligonucleotide
agatgtgcgggcacgagtgtcgcaataaaacctgt

SEQ ID NO: 95038 - DNA, 35 bp, Artificial Sequence
  Synthetic oligonucleotide
gacttgcaccctgcccgtatatgtcatgtcccttt

SEQ ID NO: 95039 - DNA, 35 bp, Artificial Sequence
  Synthetic oligonucleotide
gacaggggacaacaggaatcctcgaaaaatgcaaa

SEQ ID NO: 95040 - DNA, 35 bp, Artificial Sequence
  Synthetic oligonucleotide
tgacgcatcaagcatacgcttcttcaaacatgaaa

SEQ ID NO: 95041 - DNA, 35 bp, Artificial Sequence
  Synthetic oligonucleotide
gtgacagacgcgacttgtcccgattacactgacaa

SEQ ID NO: 95042 - DNA, 36 bp, Artificial Sequence
  Synthetic oligonucleotide
gaagatgggcggctgggataacattcttcctgacaa

SEQ ID NO: 95043 - DNA, 36 bp, Artificial Sequence
  Synthetic oligonucleotide
aacatgtcaggagtagtggggagcatggggctcgaa

SEQ ID NO: 95044 - DNA, 36 bp, Artificial Sequence
  Synthetic oligonucleotide
gccaccgccccgctaaatatcttatcgcactgataa

SEQ ID NO: 95045 - DNA, 35 bp, Artificial Sequence
  Synthetic oligonucleotide
tggaggcaactgcctcgcactactttacatgctaa

SEQ ID NO: 95046 - DNA, 35 bp, Artificial Sequence
  Synthetic oligonucleotide
gacgacgcctcttgttttgtcctggtcatcagtaa

SEQ ID NO: 95047 - DNA, 36 bp, Artificial Sequence
  Synthetic oligonucleotide
ttgggtggagtggtcgtgtatatagtgatggtgtaa

SEQ ID NO: 95048 - DNA, 36 bp, Artificial Sequence
  Synthetic oligonucleotide
accctgcatcgcatactgaaggccacaggaaaaaca

SEQ ID NO: 95049 - DNA, 35 bp, Artificial Sequence
  Synthetic oligonucleotide
gatcgacgcccgagcattcaagaagtgctcacaca

SEQ ID NO: 95050 - DNA, 35 bp, Artificial Sequence
  Synthetic oligonucleotide
acaccgcggacgagatagagtcacgatgcaataca

SEQ ID NO: 95051 - DNA, 35 bp, Artificial Sequence
  Synthetic oligonucleotide
gcctgacgctgttgcctaattatcttaagtcccca

SEQ ID NO: 95052 - DNA, 36 bp, Artificial Sequence
  Synthetic oligonucleotide
atcgcacaactgattcagctcataatgtaatcgcca

SEQ ID NO: 95053 - DNA, 35 bp, Artificial Sequence
  Synthetic oligonucleotide
gtgattacgcatgcctcccgattcgttcggttcca

SEQ ID NO: 95054 - DNA, 35 bp, Artificial Sequence
  Synthetic oligonucleotide
gacgatgacagcagcggtaaacttcgacctgtgca

SEQ ID NO: 95055 - DNA, 36 bp, Artificial Sequence
  Synthetic oligonucleotide
gcattggggcatgaggacaaagggaggtgattgtca

SEQ ID NO: 95056 - DNA, 37 bp, Artificial Sequence
  Synthetic oligonucleotide
tccgacaagagacaaatgtatacaaccggggaaaaga

SEQ ID NO: 95057 - DNA, 37 bp, Artificial Sequence
  Synthetic oligonucleotide
tcgaaagggagcgagtgatatcgtaaaggaccacaga

SEQ ID NO: 95058 - DNA, 36 bp, Artificial Sequence
  Synthetic oligonucleotide
gagacacttgagagtgtagggggtgcacggagcaga

SEQ ID NO: 95059 - DNA, 37 bp, Artificial Sequence
  Synthetic oligonucleotide
tagattgcccacgcttagcacagcccacagtcgtaga

SEQ ID NO: 95060 - DNA, 37 bp, Artificial Sequence
  Synthetic oligonucleotide
gcaaatgagcctggtgaataggtgggtgaagggtaga

SEQ ID NO: 95061 - DNA, 36 bp, Artificial Sequence
  Synthetic oligonucleotide
gaccctaccagcactcagtcagttcaacatccacga

SEQ ID NO: 95062 - DNA, 37 bp, Artificial Sequence
  Synthetic oligonucleotide
aagtgcatgcctcacatatagtgccccgacttcacga

SEQ ID NO: 95063 - DNA, 37 bp, Artificial Sequence
  Synthetic oligonucleotide
gccgcccagcgcgtatttgcgcccacacgatatacga

SEQ ID NO: 95064 - DNA, 37 bp, Artificial Sequence
  Synthetic oligonucleotide
gccaccgcaagtattatttaatgtctttgtaacccga

SEQ ID NO: 95065 - DNA, 37 bp, Artificial Sequence
  Synthetic oligonucleotide
tgctccacccctctgagtgcacgctaacctcacccga

SEQ ID NO: 95066 - DNA, 36 bp, Artificial Sequence
  Synthetic oligonucleotide
tcaaccgcaggctgcaacttaatcagccctttccga

SEQ ID NO: 95067 - DNA, 37 bp, Artificial Sequence
  Synthetic oligonucleotide
tagtgaaggaagttatggaaatgggaagtcaccagga

SEQ ID NO: 95068 - DNA, 37 bp, Artificial Sequence
  Synthetic oligonucleotide
gatgggcgcggggaaaactgtcttggcaaacaacgga

SEQ ID NO: 95069 - DNA, 37 bp, Artificial Sequence
  Synthetic oligonucleotide
tccgaggtgaaggaaagagtggggagcacgtaacgga

SEQ ID NO: 95070 - DNA, 37 bp, Artificial Sequence
  Synthetic oligonucleotide
ttcgctggaccaccatgtacctcaccgccgagacgga

SEQ ID NO: 95071 - DNA, 37 bp, Artificial Sequence
  Synthetic oligonucleotide
atcccacgacagcctggcctcatcaagtccatacgga

SEQ ID NO: 95072 - DNA, 37 bp, Artificial Sequence
  Synthetic oligonucleotide
tccacacctcatcgagttttccaagtcatccggggga

SEQ ID NO: 95073 - DNA, 36 bp, Artificial Sequence
  Synthetic oligonucleotide
gaagcccgggaggggaaaaggggcgttatactggga

SEQ ID NO: 95074 - DNA, 36 bp, Artificial Sequence
  Synthetic oligonucleotide
accccataacctatccgatgctgtgagccacctgga

SEQ ID NO: 95075 - DNA, 38 bp, Artificial Sequence
  Synthetic oligonucleotide
tgctaccaggtagatatatgcctggtccctttccatga

SEQ ID NO: 95076 - DNA, 37 bp, Artificial Sequence
  Synthetic oligonucleotide
acatcggaccacagcacgtgtgagaaggtgaagatga

SEQ ID NO: 95077 - DNA, 38 bp, Artificial Sequence
  Synthetic oligonucleotide
gttgacgcaaacaatgggttatgggaccaacatgatga

SEQ ID NO: 95078 - DNA, 37 bp, Artificial Sequence
  Synthetic oligonucleotide
acatcgctggggggagaaatgagctcgggattgatga

SEQ ID NO: 95079 - DNA, 38 bp, Artificial Sequence
  Synthetic oligonucleotide
gcaccaccttcattgctggcttagtttgcacggtatga

SEQ ID NO: 95080 - DNA, 36 bp, Artificial Sequence
  Synthetic oligonucleotide
gatggccaacggcaagaaaagaacactgcggtatga

SEQ ID NO: 95081 - DNA, 37 bp, Artificial Sequence
  Synthetic oligonucleotide
tcctacacccggcaaacatgttagagcctgacactga

SEQ ID NO: 95082 - DNA, 38 bp, Artificial Sequence
  Synthetic oligonucleotide
gtgaccgtcgccgacccagagtccggttatcctcctga

SEQ ID NO: 95083 - DNA, 38 bp, Artificial Sequence
  Synthetic oligonucleotide
taagggcaaaaaaggagcgggggaatagagggagctga

SEQ ID NO: 95084 - DNA, 38 bp, Artificial Sequence
  Synthetic oligonucleotide
accgacatgtcagactatcgtttcagaacgtacgctga

SEQ ID NO: 95085 - DNA, 37 bp, Artificial Sequence
  Synthetic oligonucleotide
accaccagctggatagcctcgtcttaattcttgctga

SEQ ID NO: 95086 - DNA, 38 bp, Artificial Sequence
  Synthetic oligonucleotide
tcctgcggaagattcactctattgcgccacgactctga

SEQ ID NO: 95087 - DNA, 37 bp, Artificial Sequence
  Synthetic oligonucleotide
atctgccacctacgtccttacatagacctgtttctga

SEQ ID NO: 95088 - DNA, 38 bp, Artificial Sequence
  Synthetic oligonucleotide
gactgagctagtgggatggtgaccgatgcatgacgtga

SEQ ID NO: 95089 - DNA, 37 bp, Artificial Sequence
  Synthetic oligonucleotide
acttacgctgaaaggccgagtgggattgggtccgtga

SEQ ID NO: 95090 - DNA, 38 bp, Artificial Sequence
  Synthetic oligonucleotide
attgcgcgaggtggtgcgggtcaggaggaagagcgtga

SEQ ID NO: 95091 - DNA, 38 bp, Artificial Sequence
  Synthetic oligonucleotide
gacatggcctctgacgcgtttcgtagcttgtttggtga

SEQ ID NO: 95092 - DNA, 38 bp, Artificial Sequence
  Synthetic oligonucleotide
tcctgtgcagcattgtagccctcgatccactccgttga

SEQ ID NO: 95093 - DNA, 37 bp, Artificial Sequence
  Synthetic oligonucleotide
atcaggaggagggcgaatgaagggcagattcctttga

SEQ ID NO: 95094 - DNA, 38 bp, Artificial Sequence
  Synthetic oligonucleotide
tcactcacattgattggctcccagtctgacaggtttga

SEQ ID NO: 95095 - DNA, 36 bp, Artificial Sequence
  Synthetic oligonucleotide
tcccaccccaaccagcggtctaatatggtgatcata

SEQ ID NO: 95096 - DNA, 36 bp, Artificial Sequence
  Synthetic oligonucleotide
tgagggtacagcctgaatcaccgctacacatttata

SEQ ID NO: 95097 - DNA, 36 bp, Artificial Sequence
  Synthetic oligonucleotide
ttcgccacggaacaaaggattaccgtcatagcccta

SEQ ID NO: 95098 - DNA, 35 bp, Artificial Sequence
  Synthetic oligonucleotide
atagtggcaccctgcatgaaggccttagctcccta

SEQ ID NO: 95099 - DNA, 36 bp, Artificial Sequence
  Synthetic oligonucleotide
tttgagagccgggcatggtaggatcagacaacggta

SEQ ID NO: 95100 - DNA, 36 bp, Artificial Sequence
  Synthetic oligonucleotide
atgtgcgcactccaggaaagcctttgaaacccggta

SEQ ID NO: 95101 - DNA, 36 bp, Artificial Sequence
  Synthetic oligonucleotide
taacgcactgttggctcgctgactccgttatactta

SEQ ID NO: 95102 - DNA, 36 bp, Artificial Sequence
  Synthetic oligonucleotide
gtggaacagggcggagaggttcgacggatacgctta

SEQ ID NO: 95103 - DNA, 35 bp, Artificial Sequence
  Synthetic oligonucleotide
gaccagatcacgaatcctcggccaggagctggtta

SEQ ID NO: 95104 - DNA, 36 bp, Artificial Sequence
  Synthetic oligonucleotide
gacgtgactaagctttgaatttgggtgtccctgtta

SEQ ID NO: 95105 - DNA, 35 bp, Artificial Sequence
  Synthetic oligonucleotide
tacgcgacatcatgatggctgccttagtcgtaaac

SEQ ID NO: 95106 - DNA, 35 bp, Artificial Sequence
  Synthetic oligonucleotide
tttgctgtccagttctcatcggaattcgtttacac

SEQ ID NO: 95107 - DNA, 35 bp, Artificial Sequence
  Synthetic oligonucleotide
tgcaccccatgacttgcaccgacgccacaccggac

SEQ ID NO: 95108 - DNA, 35 bp, Artificial Sequence
  Synthetic oligonucleotide
gtcacacctgttgccctcacgtaaaacgctattac

SEQ ID NO: 95109 - DNA, 35 bp, Artificial Sequence
  Synthetic oligonucleotide
tcaaccacccgattttacgttggcttagtgccacc

SEQ ID NO: 95110 - DNA, 35 bp, Artificial Sequence
  Synthetic oligonucleotide
gcgcgcacctggtttgtcggtctcgtggttctccc

SEQ ID NO: 95111 - DNA, 35 bp, Artificial Sequence
  Synthetic oligonucleotide
tgcaaaccctgctccccacgcccataacttaagcc

SEQ ID NO: 95112 - DNA, 35 bp, Artificial Sequence
  Synthetic oligonucleotide
tatgtggccgagcgcacctttgaccgttttgggcc

SEQ ID NO: 95113 - DNA, 35 bp, Artificial Sequence
  Synthetic oligonucleotide
gatcatccaccgaaaggtattgtgtacggtgttcc

SEQ ID NO: 95114 - DNA, 35 bp, Artificial Sequence
  Synthetic oligonucleotide
gcaggaaaaaggggggccgatcgcgtagtcaaagc

SEQ ID NO: 95115 - DNA, 35 bp, Artificial Sequence
  Synthetic oligonucleotide
tccaccccctgccctcgttaaacggcatcttatgc

SEQ ID NO: 95116 - DNA, 35 bp, Artificial Sequence
  Synthetic oligonucleotide
atacctccacaccgtcatgcgcatctctgacgtgc

SEQ ID NO: 95117 - DNA, 35 bp, Artificial Sequence
  Synthetic oligonucleotide
gaagacgggccaaacgaggataaatacggagttgc

SEQ ID NO: 95118 - DNA, 35 bp, Artificial Sequence
  Synthetic oligonucleotide
gtccccatccgccgcgaggtccaggtcccaccatc

SEQ ID NO: 95119 - DNA, 35 bp, Artificial Sequence
  Synthetic oligonucleotide
acttaccaccgctcattttccgtaggctgagactc

SEQ ID NO: 95120 - DNA, 35 bp, Artificial Sequence
  Synthetic oligonucleotide
gagtggggggggagaggtcttggtccggctgactc

SEQ ID NO: 95121 - DNA, 35 bp, Artificial Sequence
  Synthetic oligonucleotide
atgtcaacccactgactggccttgatcccctactc

SEQ ID NO: 95122 - DNA, 35 bp, Artificial Sequence
  Synthetic oligonucleotide
acgacaagctgtattcggtattgttttcccttgtc

SEQ ID NO: 95123 - DNA, 35 bp, Artificial Sequence
  Synthetic oligonucleotide
ttgcatgaccgccccacatcatcggttcatttgtc

SEQ ID NO: 95124 - DNA, 35 bp, Artificial Sequence
  Synthetic oligonucleotide
atgatcagcagtacgccgcgcgtaggcgaaggttc

SEQ ID NO: 95125 - DNA, 35 bp, Artificial Sequence
  Synthetic oligonucleotide
tgcgtaacggaggaagatagaaaggttgcgaggag

SEQ ID NO: 95126 - DNA, 35 bp, Artificial Sequence
  Synthetic oligonucleotide
gtggtaagaaggtaagtattgcgctggggagggag

SEQ ID NO: 95127 - DNA, 35 bp, Artificial Sequence
  Synthetic oligonucleotide
gtgccggggagggactactattaaggggacatgag

SEQ ID NO: 95128 - DNA, 35 bp, Artificial Sequence
  Synthetic oligonucleotide
tttcccccatccgatccggtttgagcctgccgacg

SEQ ID NO: 95129 - DNA, 35 bp, Artificial Sequence
  Synthetic oligonucleotide
ttagacgtgtccgatccgcttaggcttaatccccg

SEQ ID NO: 95130 - DNA, 35 bp, Artificial Sequence
  Synthetic oligonucleotide
gacaggctccaggcgctttcacaggaccatccccg

SEQ ID NO: 95131 - DNA, 35 bp, Artificial Sequence
  Synthetic oligonucleotide
atccatggaactggggtgtaggaaacgatgtagcg

SEQ ID NO: 95132 - DNA, 35 bp, Artificial Sequence
  Synthetic oligonucleotide
tcatccgcccctgttaccccttgtataagagctcg

SEQ ID NO: 95133 - DNA, 35 bp, Artificial Sequence
  Synthetic oligonucleotide
tgccacggcaagttcgtttccagtattttgtctgg

SEQ ID NO: 95134 - DNA, 35 bp, Artificial Sequence
  Synthetic oligonucleotide
tgaccctcctgggaaataactctccggccttttgg

SEQ ID NO: 95135 - DNA, 35 bp, Artificial Sequence
  Synthetic oligonucleotide
tacccaacctctgactttattacgagcaacggatg

SEQ ID NO: 95136 - DNA, 35 bp, Artificial Sequence
  Synthetic oligonucleotide
tgccgcatgcctatgtctctgctattttgtccctg

SEQ ID NO: 95137 - DNA, 35 bp, Artificial Sequence
  Synthetic oligonucleotide
tatgccgtccgagctggggagattattggtcattg

SEQ ID NO: 95138 - DNA, 35 bp, Artificial Sequence
  Synthetic oligonucleotide
tcataacaccggagacaggtaaaggggggatcttg

SEQ ID NO: 95139 - DNA, 35 bp, Artificial Sequence
  Synthetic oligonucleotide
tgatcgcacggggggtggagttaggaactggaaat

SEQ ID NO: 95140 - DNA, 35 bp, Artificial Sequence
  Synthetic oligonucleotide
gtaccaccctcatcccagaaactgtagtgacccat

SEQ ID NO: 95141 - DNA, 35 bp, Artificial Sequence
  Synthetic oligonucleotide
tagtccagggcgggggaacggtagccatgatatat

SEQ ID NO: 95142 - DNA, 35 bp, Artificial Sequence
  Synthetic oligonucleotide
tcccacccagcaatttgcgttcaattacgaggact

SEQ ID NO: 95143 - DNA, 35 bp, Artificial Sequence
  Synthetic oligonucleotide
acgttcagcccccctgttgtaactcggtgtcgcct

SEQ ID NO: 95144 - DNA, 35 bp, Artificial Sequence
  Synthetic oligonucleotide
ttgatccacgttgagcgttcgtcatagtcgctcct

SEQ ID NO: 95145 - DNA, 35 bp, Artificial Sequence
  Synthetic oligonucleotide
acacctcacacgtgtgatatccgatcaattgtcct

SEQ ID NO: 95146 - DNA, 35 bp, Artificial Sequence
  Synthetic oligonucleotide
acgtctccgccggtacctctatcgctgactacgct

SEQ ID NO: 95147 - DNA, 35 bp, Artificial Sequence
  Synthetic oligonucleotide
acccgaaggatcgtaggaacaggtaggtcgtacgt

SEQ ID NO: 95148 - DNA, 35 bp, Artificial Sequence
  Synthetic oligonucleotide
tccgtgcgctggttgcttctcgtgggtgctcgtgt

SEQ ID NO: 95149 - DNA, 35 bp, Artificial Sequence
  Synthetic oligonucleotide
gctgtccgtcactcacgtcattcggattgcccatt

SEQ ID NO: 95150 - DNA, 35 bp, Artificial Sequence
  Synthetic oligonucleotide
aaccaggggtggggcggtgcgtggtggagtcgctt

SEQ ID NO: 95151 - DNA, 35 bp, Artificial Sequence
  Synthetic oligonucleotide
actcactccatggccgttattagtagccggctgtt

SEQ ID NO: 95152 - DNA, 35 bp, Artificial Sequence
  Synthetic oligonucleotide
tcgcactctgacccgcttaagaccatcacgaattt

SEQ ID NO: 95153 - DNA, 36 bp, Artificial Sequence
  Synthetic oligonucleotide
gacgaagtaagtattgtagagcgtctgctaacaaaa

SEQ ID NO: 95154 - DNA, 36 bp, Artificial Sequence
  Synthetic oligonucleotide
aagcagaaaggggagcgggcaaaagcttcattaaaa

SEQ ID NO: 95155 - DNA, 36 bp, Artificial Sequence
  Synthetic oligonucleotide
gaatgggtaggggtgttatattaggcagagtacaaa

SEQ ID NO: 95156 - DNA, 35 bp, Artificial Sequence
  Synthetic oligonucleotide
gaaaccggatgcaaagcgtctcaaggaagggcaaa

SEQ ID NO: 95157 - DNA, 36 bp, Artificial Sequence
  Synthetic oligonucleotide
gaggggcgcgctgctcccacaataatgcacctgaaa

SEQ ID NO: 95158 - DNA, 36 bp, Artificial Sequence
  Synthetic oligonucleotide
gaccccggcccatctacaccatgcccagttcaccaa

SEQ ID NO: 95159 - DNA, 35 bp, Artificial Sequence
  Synthetic oligonucleotide
acccacactcctggtcctgcgccgtacccgcgcaa

SEQ ID NO: 95160 - DNA, 36 bp, Artificial Sequence
  Synthetic oligonucleotide
tacaggtggtaccataggtgaggggtcgggtgggaa

SEQ ID NO: 95161 - DNA, 36 bp, Artificial Sequence
  Synthetic oligonucleotide
tgtcatcagccgtgccatctcccgtcagcccttgaa

SEQ ID NO: 95162 - DNA, 36 bp, Artificial Sequence
  Synthetic oligonucleotide
ttgtacatcctcattgccgacatgcaggacgactaa

SEQ ID NO: 95163 - DNA, 36 bp, Artificial Sequence
  Synthetic oligonucleotide
tgacaccatcggtatttaacgcgcgtatcgtactaa

SEQ ID NO: 95164 - DNA, 36 bp, Artificial Sequence
  Synthetic oligonucleotide
tcagtacgggaccagtggaatagaggaggaacgtaa

SEQ ID NO: 95165 - DNA, 36 bp, Artificial Sequence
  Synthetic oligonucleotide
gcggggaaaaagggagaagagagcacgttcgggtaa

SEQ ID NO: 95166 - DNA, 36 bp, Artificial Sequence
  Synthetic oligonucleotide
taaccgcaatgaccgacctgtatggtaccatcttaa

SEQ ID NO: 95167 - DNA, 36 bp, Artificial Sequence
  Synthetic oligonucleotide
tcagacacgccacacagcggaacgagcccgctttaa

SEQ ID NO: 95168 - DNA, 36 bp, Artificial Sequence
  Synthetic oligonucleotide
ggttcaccgccatccgcgatccgtactgacactaca

SEQ ID NO: 95169 - DNA, 36 bp, Artificial Sequence
  Synthetic oligonucleotide
taaccagcaaggattgtgatcattctagctctacca

SEQ ID NO: 95170 - DNA, 35 bp, Artificial Sequence
  Synthetic oligonucleotide
taccatccgcgtcaccgcgctgagcgtattcccca

SEQ ID NO: 95171 - DNA, 36 bp, Artificial Sequence
  Synthetic oligonucleotide
ttgcgacccggagcttttacttccgtttgttcctca

SEQ ID NO: 95172 - DNA, 36 bp, Artificial Sequence
  Synthetic oligonucleotide
gacgtgttccgtagggcttctaatctgctctcttca

SEQ ID NO: 95173 - DNA, 37 bp, Artificial Sequence
  Synthetic oligonucleotide
atcgaagcaaggtcagaaggcatgaaagttgaaaaga

SEQ ID NO: 95174 - DNA, 37 bp, Artificial Sequence
  Synthetic oligonucleotide
tagcgacgaggggggcgagaaatagggtggtcaaaga

SEQ ID NO: 95175 - DNA, 37 bp, Artificial Sequence
  Synthetic oligonucleotide
tgtgagtgacgaaggggaggtggtaaattcgccaaga

SEQ ID NO: 95176 - DNA, 37 bp, Artificial Sequence
  Synthetic oligonucleotide
tcagagaggctaggggataggatcaagggaagacaga

SEQ ID NO: 95177 - DNA, 36 bp, Artificial Sequence
  Synthetic oligonucleotide
gtagccaaccaatccgcataggagctaatctccaga

SEQ ID NO: 95178 - DNA, 37 bp, Artificial Sequence
  Synthetic oligonucleotide
gtgcggtgcacatggctctcactgaaagcacaggaga

SEQ ID NO: 95179 - DNA, 37 bp, Artificial Sequence
  Synthetic oligonucleotide
ttgcaaatccgtctccaccttccactctcttgtgaga

SEQ ID NO: 95180 - DNA, 37 bp, Artificial Sequence
  Synthetic oligonucleotide
accaatgggaagatatggagggaacaaagtgggtaga

SEQ ID NO: 95181 - DNA, 37 bp, Artificial Sequence
  Synthetic oligonucleotide
gacgccggtaacattgcaagtcaccattctgttacga

SEQ ID NO: 95182 - DNA, 37 bp, Artificial Sequence
  Synthetic oligonucleotide
atccgatcgacgctgttgataacctcgcaattcccga

SEQ ID NO: 95183 - DNA, 37 bp, Artificial Sequence
  Synthetic oligonucleotide
ttcaccccactattgtataaggcgttcgttccgccga

SEQ ID NO: 95184 - DNA, 37 bp, Artificial Sequence
  Synthetic oligonucleotide
aacccaatgccgtgccgtctaccagtgaaaactccga

SEQ ID NO: 95185 - DNA, 35 bp, Artificial Sequence
  Synthetic oligonucleotide
tgatgccggggcaataagcaataggctaagagcga

SEQ ID NO: 95186 - DNA, 37 bp, Artificial Sequence
  Synthetic oligonucleotide
gatgctagtggaggaaggccggatagggtcgccgcga

SEQ ID NO: 95187 - DNA, 37 bp, Artificial Sequence
  Synthetic oligonucleotide
gatctatgcgggaaggttgattgagggcgaagggcga

SEQ ID NO: 95188 - DNA, 37 bp, Artificial Sequence
  Synthetic oligonucleotide
ttaacgcccctaagcacgctgatgtgtcccccatcga

SEQ ID NO: 95189 - DNA, 36 bp, Artificial Sequence
  Synthetic oligonucleotide
gtagacgggtggttagggcaggaagtaatgtcagga

SEQ ID NO: 95190 - DNA, 37 bp, Artificial Sequence
  Synthetic oligonucleotide
tactgccccggacgcgcaatcgctattcctattagga

SEQ ID NO: 95191 - DNA, 37 bp, Artificial Sequence
  Synthetic oligonucleotide
agcaaacggagaacggacactgcagacgggaaaggga

SEQ ID NO: 95192 - DNA, 37 bp, Artificial Sequence
  Synthetic oligonucleotide
acgaaaaggccatgatgtagggaaatgcgatggggga

SEQ ID NO: 95193 - DNA, 37 bp, Artificial Sequence
  Synthetic oligonucleotide
tgatccggctctggatggatcatgggttactggggga

SEQ ID NO: 95194 - DNA, 37 bp, Artificial Sequence
  Synthetic oligonucleotide
tgtggaggagggagcagtgtgggacattggcatggga

SEQ ID NO: 95195 - DNA, 37 bp, Artificial Sequence
  Synthetic oligonucleotide
tccatgtcgtcagtgactatgagttggggggaatgga

SEQ ID NO: 95196 - DNA, 36 bp, Artificial Sequence
  Synthetic oligonucleotide
gtgcggatatgcggggggtggaaggctaggcctgga

SEQ ID NO: 95197 - DNA, 37 bp, Artificial Sequence
  Synthetic oligonucleotide
tcagtgctgtcatcaaaaccacgtcgagacatgatga

SEQ ID NO: 95198 - DNA, 38 bp, Artificial Sequence
  Synthetic oligonucleotide
gagcatgtaggtgtggaaggcaagtatgagatatatga

SEQ ID NO: 95199 - DNA, 37 bp, Artificial Sequence
  Synthetic oligonucleotide
gagactaagtagggaaggtaaggggctgggattatga

SEQ ID NO: 95200 - DNA, 38 bp, Artificial Sequence
  Synthetic oligonucleotide
gcaagggagaaggggtctagggcgacgatggtcactga

SEQ ID NO: 95201 - DNA, 38 bp, Artificial Sequence
  Synthetic oligonucleotide
actgctgcagccccagcgataaaagccctgacctctga

SEQ ID NO: 95202 - DNA, 38 bp, Artificial Sequence
  Synthetic oligonucleotide
tgctacgcactctggtgttcaaacgatccccgctctga

SEQ ID NO: 95203 - DNA, 38 bp, Artificial Sequence
  Synthetic oligonucleotide
atcaaacgggaaggggggtggataaaaccagggtctga

SEQ ID NO: 95204 - DNA, 38 bp, Artificial Sequence
  Synthetic oligonucleotide
gcctgatacagcggtctactcatcactcctgacagtga

SEQ ID NO: 95205 - DNA, 38 bp, Artificial Sequence
  Synthetic oligonucleotide
tgtcgcgctagggcggacaggtatgcagggaggagtga

SEQ ID NO: 95206 - DNA, 38 bp, Artificial Sequence
  Synthetic oligonucleotide
gccgccaggtccatggattcctgtagctccctccgtga

SEQ ID NO: 95207 - DNA, 38 bp, Artificial Sequence
  Synthetic oligonucleotide
tgcgggggggggctaagatgatgcaggggcgatcgtga

SEQ ID NO: 95208 - DNA, 38 bp, Artificial Sequence
  Synthetic oligonucleotide
aagcagggcaagagaggttaaattgttagggagggtga

SEQ ID NO: 95209 - DNA, 38 bp, Artificial Sequence
  Synthetic oligonucleotide
gcaagagggaagaggaaggtggtggtaacacgctgtga

SEQ ID NO: 95210 - DNA, 37 bp, Artificial Sequence
  Synthetic oligonucleotide
tacgcgacttagaggagtgagaggggtggagacttga

SEQ ID NO: 95211 - DNA, 38 bp, Artificial Sequence
  Synthetic oligonucleotide
gttacgccacatgccctggagcatcacaatggacttga

SEQ ID NO: 95212 - DNA, 37 bp, Artificial Sequence
  Synthetic oligonucleotide
gactccaacgtgacacaatatcgtgaactgcccttga

SEQ ID NO: 95213 - DNA, 38 bp, Artificial Sequence
  Synthetic oligonucleotide
atgcgagagtgagaaattgcacaagggatagaagttga

SEQ ID NO: 95214 - DNA, 38 bp, Artificial Sequence
  Synthetic oligonucleotide
gcagtcacagcgtaggaacggggagtcatagctgttga

SEQ ID NO: 95215 - DNA, 38 bp, Artificial Sequence
  Synthetic oligonucleotide
atgcccgcgtagcccagtgtttcgtacctccgttttga

SEQ ID NO: 95216 - DNA, 35 bp, Artificial Sequence
  Synthetic oligonucleotide
gtgcgacatcctagcgcgattccaggcattcaata

SEQ ID NO: 95217 - DNA, 36 bp, Artificial Sequence
  Synthetic oligonucleotide
tatcccgttcgagtgcgcccttgagcacatgacata

SEQ ID NO: 95218 - DNA, 36 bp, Artificial Sequence
  Synthetic oligonucleotide
gtgacaacacatacggggaagggaactggcggcata

SEQ ID NO: 95219 - DNA, 36 bp, Artificial Sequence
  Synthetic oligonucleotide
gacgccctccagggaccagtgtgccttcattgcata

SEQ ID NO: 95220 - DNA, 35 bp, Artificial Sequence
  Synthetic oligonucleotide
acctggggcaccaggggagaaccgataaggttata

SEQ ID NO: 95221 - DNA, 36 bp, Artificial Sequence
  Synthetic oligonucleotide
tcccaccagacgcagaaacaggttcctgtttgccta

SEQ ID NO: 95222 - DNA, 35 bp, Artificial Sequence
  Synthetic oligonucleotide
atgacagccaactgtgacttgggcctctcgatcta

SEQ ID NO: 95223 - DNA, 36 bp, Artificial Sequence
  Synthetic oligonucleotide
gacgccgtctttcagttatacgttacaccgcctcta

SEQ ID NO: 95224 - DNA, 35 bp, Artificial Sequence
  Synthetic oligonucleotide
ttacacaacctgacattacactgcagtacaaagta

SEQ ID NO: 95225 - DNA, 36 bp, Artificial Sequence
  Synthetic oligonucleotide
gacaccttcacccagataagtccgatagggcgatta

SEQ ID NO: 95226 - DNA, 36 bp, Artificial Sequence
  Synthetic oligonucleotide
atcgtatcctcttgtgcaccattacctgggttatta

SEQ ID NO: 95227 - DNA, 35 bp, Artificial Sequence
  Synthetic oligonucleotide
tcacggtggtgtgagaatcctccgtcttggcctta

SEQ ID NO: 95228 - DNA, 38 bp, Artificial Sequence
  Synthetic oligonucleotide
gtgacacaccacatgactatagcgtacaacctctctta

SEQ ID NO: 95229 - DNA, 35 bp, Artificial Sequence
  Synthetic oligonucleotide
tatgtgccgactcacgaactgttttgctttggtta

SEQ ID NO: 95230 - DNA, 36 bp, Artificial Sequence
  Synthetic oligonucleotide
gccgccccactattacactgtgatccgttacgttta

SEQ ID NO: 95231 - DNA, 35 bp, Artificial Sequence
  Synthetic oligonucleotide
ataccgtccgtctcgatagcttctccctcatggac

SEQ ID NO: 95232 - DNA, 35 bp, Artificial Sequence
  Synthetic oligonucleotide
tccaccctacgtcagccaggaatggacccatatac

SEQ ID NO: 95233 - DNA, 35 bp, Artificial Sequence
  Synthetic oligonucleotide
aatgcaaccgcagcctatcgcgtttactttccacc

SEQ ID NO: 95234 - DNA, 35 bp, Artificial Sequence
  Synthetic oligonucleotide
tagcctaggcacagcctgttgagcaaccgtatccc

SEQ ID NO: 95235 - DNA, 35 bp, Artificial Sequence
  Synthetic oligonucleotide
gcgataacgggggtggactgaaaaagtagggggcc

SEQ ID NO: 95236 - DNA, 35 bp, Artificial Sequence
  Synthetic oligonucleotide
gaagccaccatgctgacgtactctcctgatctgcc

SEQ ID NO: 95237 - DNA, 35 bp, Artificial Sequence
  Synthetic oligonucleotide
gctgactagggcgtggagaggggagatagaacagc

SEQ ID NO: 95238 - DNA, 35 bp, Artificial Sequence
  Synthetic oligonucleotide
ttggaccatgcatatcatgatgttcacattctagc

SEQ ID NO: 95239 - DNA, 35 bp, Artificial Sequence
  Synthetic oligonucleotide
agtgagcgagaagggtggtgagagggtaagagcgc

SEQ ID NO: 95240 - DNA, 35 bp, Artificial Sequence
  Synthetic oligonucleotide
agcccaagccagccctttgcactagaagtcaactc

SEQ ID NO: 95241 - DNA, 35 bp, Artificial Sequence
  Synthetic oligonucleotide
ggtccctgccaccggatctctaaacttgctgcctc

SEQ ID NO: 95242 - DNA, 35 bp, Artificial Sequence
  Synthetic oligonucleotide
ttagcccgtcattcctgtaccgcctgcatctattc

SEQ ID NO: 95243 - DNA, 35 bp, Artificial Sequence
  Synthetic oligonucleotide
ttgagctggcacgttgcgggtcctgtaatactttc

SEQ ID NO: 95244 - DNA, 35 bp, Artificial Sequence
  Synthetic oligonucleotide
tacgctgttcgctgtcgttttgtcacttgtttttc

SEQ ID NO: 95245 - DNA, 32 bp, Artificial Sequence
  Synthetic oligonucleotide
acttgcgccctgactatactgaatcctgatcg

SEQ ID NO: 95246 - DNA, 35 bp, Artificial Sequence
  Synthetic oligonucleotide
gttaacgatccatggtaacaggtccccagtaaatg

SEQ ID NO: 95247 - DNA, 37 bp, Artificial Sequence
  Synthetic oligonucleotide
gcgaccgcccggtctgaaatgccgaccctcccacgtg

SEQ ID NO: 95248 - DNA, 35 bp, Artificial Sequence
  Synthetic oligonucleotide
tcccagccacaccttgtcaaatcgtccaaccggtg

SEQ ID NO: 95249 - DNA, 35 bp, Artificial Sequence
  Synthetic oligonucleotide
taagaggagggatgataagattaaacggaaggttg

SEQ ID NO: 95250 - DNA, 35 bp, Artificial Sequence
  Synthetic oligonucleotide
agtgggccatccacaacatctgcgggcaaacacat

SEQ ID NO: 95251 - DNA, 35 bp, Artificial Sequence
  Synthetic oligonucleotide
agatcaatgaacgaaggggtgtgaaggtatggcat

SEQ ID NO: 95252 - DNA, 35 bp, Artificial Sequence
  Synthetic oligonucleotide
gactttgccccttgcgatcataacactgtttttat

SEQ ID NO: 95253 - DNA, 35 bp, Artificial Sequence
  Synthetic oligonucleotide
gataccacagacactcggttagcctgaggcgccct

SEQ ID NO: 95254 - DNA, 35 bp, Artificial Sequence
  Synthetic oligonucleotide
aacctggcaacagccagtggtgctggatttttcct

SEQ ID NO: 95255 - DNA, 35 bp, Artificial Sequence
  Synthetic oligonucleotide
accagccatcggtgcccagtacttctccaattgct

SEQ ID NO: 95256 - DNA, 35 bp, Artificial Sequence
  Synthetic oligonucleotide
gcgtggccctgctccctgatttattcgccgtgtct

SEQ ID NO: 95257 - DNA, 35 bp, Artificial Sequence
  Synthetic oligonucleotide
gtgccacatcgcttgcatgggagtaccgcaattct

SEQ ID NO: 95258 - DNA, 35 bp, Artificial Sequence
  Synthetic oligonucleotide
ttcagatgccactgttctctcaccaccttgagggt

SEQ ID NO: 95259 - DNA, 35 bp, Artificial Sequence
  Synthetic oligonucleotide
gctgaaggccggatagtctgtgtttcctttctgtt

SEQ ID NO: 95260 - DNA, 35 bp, Artificial Sequence
  Synthetic oligonucleotide
acgatacgctatgtcgcccaatgagggtactcttt

SEQ ID NO: 95261 - DNA, 35 bp, Artificial Sequence
  Synthetic oligonucleotide
tatgacacgccatacccatgctaacgccggggttt

SEQ ID NO: 95262 - DNA, 36 bp, Artificial Sequence
  Synthetic oligonucleotide
aacgctggctgctgttcccgacatgagtgatcccaa

SEQ ID NO: 95263 - DNA, 36 bp, Artificial Sequence
  Synthetic oligonucleotide
atcacgcgcacctagaatctggtcgtattttcccaa

SEQ ID NO: 95264 - DNA, 36 bp, Artificial Sequence
  Synthetic oligonucleotide
aacgccgggcccagtctgcgttttctccctggccaa

SEQ ID NO: 95265 - DNA, 36 bp, Artificial Sequence
  Synthetic oligonucleotide
tgcatccgccgtatttgctcactcaaccatcctcaa

SEQ ID NO: 95266 - DNA, 35 bp, Artificial Sequence
  Synthetic oligonucleotide
tcgcaaccacatggtccgcaagacaccgccttcaa

SEQ ID NO: 95267 - DNA, 35 bp, Artificial Sequence
  Synthetic oligonucleotide
gactgggccagtgagaggcatgcgtaggtctagaa

SEQ ID NO: 95268 - DNA, 35 bp, Artificial Sequence
  Synthetic oligonucleotide
atcacaatgcactgccaatcttgctgttcaacgaa

SEQ ID NO: 95269 - DNA, 36 bp, Artificial Sequence
  Synthetic oligonucleotide
gtgggccggagggggagcaagcgacatcaccgctaa

SEQ ID NO: 95270 - DNA, 36 bp, Artificial Sequence
  Synthetic oligonucleotide
gactctggcgccagtcaatccctcagcttgccgtaa

SEQ ID NO: 95271 - DNA, 36 bp, Artificial Sequence
  Synthetic oligonucleotide
gagtcctccccacccgtgtgtcagtggttcgaaaca

SEQ ID NO: 95272 - DNA, 35 bp, Artificial Sequence
  Synthetic oligonucleotide
acattcactacaggggagcaagtaggaggtgaaca

SEQ ID NO: 95273 - DNA, 36 bp, Artificial Sequence
  Synthetic oligonucleotide
actcacgagcgagggtggcacgacctgcctcttaca

SEQ ID NO: 95274 - DNA, 36 bp, Artificial Sequence
  Synthetic oligonucleotide
acgacatcggcttgtttttcccgtgcgtacgtccca

SEQ ID NO: 95275 - DNA, 36 bp, Artificial Sequence
  Synthetic oligonucleotide
tgcccactacccacgcaatgaactgtatgtcaagca

SEQ ID NO: 95276 - DNA, 36 bp, Artificial Sequence
  Synthetic oligonucleotide
ggtcaccgctgccagcatcacgaagattgtccatca

SEQ ID NO: 95277 - DNA, 36 bp, Artificial Sequence
  Synthetic oligonucleotide
gtccatgacgacatatgacggcattgacacgactca

SEQ ID NO: 95278 - DNA, 36 bp, Artificial Sequence
  Synthetic oligonucleotide
tccacgccggcggaccgtgaatcgcctcatatctca

SEQ ID NO: 95279 - DNA, 37 bp, Artificial Sequence
  Synthetic oligonucleotide
atggtggagcagtctgtgaagttgaaacctgaaaaga

SEQ ID NO: 95280 - DNA, 37 bp, Artificial Sequence
  Synthetic oligonucleotide
aacaaccaccaactgcgctgttctctaagaactgaga

SEQ ID NO: 95281 - DNA, 36 bp, Artificial Sequence
  Synthetic oligonucleotide
tgtacaagtaggtacattaaggagggaggtttgaga

SEQ ID NO: 95282 - DNA, 37 bp, Artificial Sequence
  Synthetic oligonucleotide
tgatgcccggtggtttaccctgattcatttttgtaga

SEQ ID NO: 95283 - DNA, 36 bp, Artificial Sequence
  Synthetic oligonucleotide
gccaggagcctaagcgtataggcctatctccaccga

SEQ ID NO: 95284 - DNA, 37 bp, Artificial Sequence
  Synthetic oligonucleotide
atcgatgcgcacgagggccttatgtgcatgcacccga

SEQ ID NO: 95285 - DNA, 36 bp, Artificial Sequence
  Synthetic oligonucleotide
tagtagtgcattgatggttcgcgtgtgcctgcccga

SEQ ID NO: 95286 - DNA, 37 bp, Artificial Sequence
  Synthetic oligonucleotide
tattggcaacgttccagatcgttccttccttcgccga

SEQ ID NO: 95287 - DNA, 37 bp, Artificial Sequence
  Synthetic oligonucleotide
gcgaaagtcctcagatgctcttttactgcccggccga

SEQ ID NO: 95288 - DNA, 37 bp, Artificial Sequence
  Synthetic oligonucleotide
ggtgggctggggatgagtgtgaatagggaaaaaagga

SEQ ID NO: 95289 - DNA, 37 bp, Artificial Sequence
  Synthetic oligonucleotide
tttacgcacagtgattctctgccccgtctctcaagga

SEQ ID NO: 95290 - DNA, 37 bp, Artificial Sequence
  Synthetic oligonucleotide
gtgcaagaagcaacgggtacacagtgtgaccgcagga

SEQ ID NO: 95291 - DNA, 36 bp, Artificial Sequence
  Synthetic oligonucleotide
ggaccggagccgggcctgttgtgcagtataggggga

SEQ ID NO: 95292 - DNA, 37 bp, Artificial Sequence
  Synthetic oligonucleotide
gaagggagcatgaggtcaacaggggttgcaagtggga

SEQ ID NO: 95293 - DNA, 37 bp, Artificial Sequence
  Synthetic oligonucleotide
gtccacagcgcgtatctcttttgttttccctttggga

SEQ ID NO: 95294 - DNA, 36 bp, Artificial Sequence
  Synthetic oligonucleotide
gcgaggcccgccgtacatgcacacacttcttatgga

SEQ ID NO: 95295 - DNA, 36 bp, Artificial Sequence
  Synthetic oligonucleotide
agtacgcagtcggttctatggccgtttatttctgga

SEQ ID NO: 95296 - DNA, 37 bp, Artificial Sequence
  Synthetic oligonucleotide
tacccgtgcctggtcgctggctcttcttgtccgtgga

SEQ ID NO: 95297 - DNA, 37 bp, Artificial Sequence
  Synthetic oligonucleotide
tggagaaggggggcaagaatagaggtaagacattgga

SEQ ID NO: 95298 - DNA, 37 bp, Artificial Sequence
  Synthetic oligonucleotide
aaacagtggggcaaagcggtaatggggctagattgga

SEQ ID NO: 95299 - DNA, 36 bp, Artificial Sequence
  Synthetic oligonucleotide
agccgaggagtggagtgttgggaaacggttcaatga

SEQ ID NO: 95300 - DNA, 38 bp, Artificial Sequence
  Synthetic oligonucleotide
gtgagagaccgggcagaaagcatggagggcaacgatga

SEQ ID NO: 95301 - DNA, 37 bp, Artificial Sequence
  Synthetic oligonucleotide
gagaaagggacacggactttgagacaactaaatatga

SEQ ID NO: 95302 - DNA, 36 bp, Artificial Sequence
  Synthetic oligonucleotide
cacagcctgcattgaatatttcctctcatgatatga

SEQ ID NO: 95303 - DNA, 38 bp, Artificial Sequence
  Synthetic oligonucleotide
ttacctccgctctgtttcgtcagtattacatcaactga

SEQ ID NO: 95304 - DNA, 38 bp, Artificial Sequence
  Synthetic oligonucleotide
acacgctatcctatacaactatacagtccatccactga

SEQ ID NO: 95305 - DNA, 38 bp, Artificial Sequence
  Synthetic oligonucleotide
aagggaggagcaggggtgttgggcacggtgaggactga

SEQ ID NO: 95306 - DNA, 37 bp, Artificial Sequence
  Synthetic oligonucleotide
aattgccaagcgatgccttgcccgatactcctcctga

SEQ ID NO: 95307 - DNA, 38 bp, Artificial Sequence
  Synthetic oligonucleotide
tagtaccacgtggtgtagcagcctccctcttcatctga

SEQ ID NO: 95308 - DNA, 38 bp, Artificial Sequence
  Synthetic oligonucleotide
tacggagtcgccgggacgttgacggaagaaacgagtga

SEQ ID NO: 95309 - DNA, 38 bp, Artificial Sequence
  Synthetic oligonucleotide
gtgggagggggagtaattggaatcgtaatagaccgtga

SEQ ID NO: 95310 - DNA, 37 bp, Artificial Sequence
  Synthetic oligonucleotide
ggacaccgggggggtggcgcatgacggtgggccgtga

SEQ ID NO: 95311 - DNA, 37 bp, Artificial Sequence
  Synthetic oligonucleotide
ttcgcacttcgccacctacgattccgcttttgcgtga

SEQ ID NO: 95312 - DNA, 37 bp, Artificial Sequence
  Synthetic oligonucleotide
gacaagtggtgatggaggtttaaaggtgaatgggtga

SEQ ID NO: 95313 - DNA, 38 bp, Artificial Sequence
  Synthetic oligonucleotide
gagtgggggagaggggctcagcgagcaagactatgtga

SEQ ID NO: 95314 - DNA, 37 bp, Artificial Sequence
  Synthetic oligonucleotide
tagtcaagcccgactccctattacgcgaaagctgtga

SEQ ID NO: 95315 - DNA, 37 bp, Artificial Sequence
  Synthetic oligonucleotide
tcacaactacgcacgggaaggagactaaacggtgtga

SEQ ID NO: 95316 - DNA, 38 bp, Artificial Sequence
  Synthetic oligonucleotide
acaaccggtaggcgcaaaacaggggggactgggattga

SEQ ID NO: 95317 - DNA, 36 bp, Artificial Sequence
  Synthetic oligonucleotide
tgatgacggttctgttagcctgccgacccctattga

SEQ ID NO: 95318 - DNA, 38 bp, Artificial Sequence
  Synthetic oligonucleotide
acacgctcagccccgatacgtttggcttgaatccttga

SEQ ID NO: 95319 - DNA, 38 bp, Artificial Sequence
  Synthetic oligonucleotide
gcgactccctgcactttgttgtccattcagatccttga

SEQ ID NO: 95320 - DNA, 38 bp, Artificial Sequence
  Synthetic oligonucleotide
tcaagccggggggaaactgtgctggcgggatatcttga

SEQ ID NO: 95321 - DNA, 38 bp, Artificial Sequence
  Synthetic oligonucleotide
gcgaatagactaggggtggatcaggggggagaagttga

SEQ ID NO: 95322 - DNA, 37 bp, Artificial Sequence
  Synthetic oligonucleotide
acacacgttaatggggggtggaacaaaggctggttga

SEQ ID NO: 95323 - DNA, 38 bp, Artificial Sequence
  Synthetic oligonucleotide
acgccgaccagtgtcgtcctgcatgccccggattttga

SEQ ID NO: 95324 - DNA, 36 bp, Artificial Sequence
  Synthetic oligonucleotide
tgacatcacgcccgtttcgcaacgctactagaaata

SEQ ID NO: 95325 - DNA, 36 bp, Artificial Sequence
  Synthetic oligonucleotide
gagtgcctgccccatacaatgctgtacccctaaata

SEQ ID NO: 95326 - DNA, 35 bp, Artificial Sequence
  Synthetic oligonucleotide
gtgcaacgcacaacatggtgatgacaaaaagccta

SEQ ID NO: 95327 - DNA, 36 bp, Artificial Sequence
  Synthetic oligonucleotide
tcatgacaatttgacccatcgtgagacaccaaagta

SEQ ID NO: 95328 - DNA, 36 bp, Artificial Sequence
  Synthetic oligonucleotide
tactatgcagccacggactaggaaggggcacgggta

SEQ ID NO: 95329 - DNA, 36 bp, Artificial Sequence
  Synthetic oligonucleotide
ttatggccgtatcatatacgcattgctccatcatta

SEQ ID NO: 95330 - DNA, 36 bp, Artificial Sequence
  Synthetic oligonucleotide
ttcccaccttcccattttctctgaagtgagacttta

SEQ ID NO: 95331 - DNA, 35 bp, Artificial Sequence
  Synthetic oligonucleotide
taggatgcacttgtcccagtttctatgcctcatac

SEQ ID NO: 95332 - DNA, 35 bp, Artificial Sequence
  Synthetic oligonucleotide
tccatcacgctgctgcttcggttactcttgcgtac

SEQ ID NO: 95333 - DNA, 36 bp, Artificial Sequence
  Synthetic oligonucleotide
gacgcaaaggggcgcgatttcatgaaaagggggtac

SEQ ID NO: 95334 - DNA, 35 bp, Artificial Sequence
  Synthetic oligonucleotide
ggtcaacaggcacgtgagagaggatggagggttac

SEQ ID NO: 95335 - DNA, 35 bp, Artificial Sequence
  Synthetic oligonucleotide
gacactcagatttactccggcgcttcattggtacc

SEQ ID NO: 95336 - DNA, 35 bp, Artificial Sequence
  Synthetic oligonucleotide
tatgccaatgagggcatgggatggcgctcttaccc

SEQ ID NO: 95337 - DNA, 35 bp, Artificial Sequence
  Synthetic oligonucleotide
gtctccctcacgttcctcgctaactgcgccctgcc

SEQ ID NO: 95338 - DNA, 35 bp, Artificial Sequence
  Synthetic oligonucleotide
aagtgcatcatgaattgcgggacctgccctgatcc

SEQ ID NO: 95339 - DNA, 35 bp, Artificial Sequence
  Synthetic oligonucleotide
gaaacgcatgcataatttggggcttcggtgcaagc

SEQ ID NO: 95340 - DNA, 35 bp, Artificial Sequence
  Synthetic oligonucleotide
acaccccaccgtatattcgcggatatgctacttgc

SEQ ID NO: 95341 - DNA, 35 bp, Artificial Sequence
  Synthetic oligonucleotide
tgtacccctctgtggtgtgtcctaatggttctatc

SEQ ID NO: 95342 - DNA, 35 bp, Artificial Sequence
  Synthetic oligonucleotide
ttggggaagccctccataatcttgtacttccactc

SEQ ID NO: 95343 - DNA, 35 bp, Artificial Sequence
  Synthetic oligonucleotide
acacacataacgtcaagtgatcactctcaccagtc

SEQ ID NO: 95344 - DNA, 35 bp, Artificial Sequence
  Synthetic oligonucleotide
tacatctgcggggcgaccctgtaattcaacttgtc

SEQ ID NO: 95345 - DNA, 35 bp, Artificial Sequence
  Synthetic oligonucleotide
gaagatgccacggcccgcactcacctcgtcttgag

SEQ ID NO: 95346 - DNA, 35 bp, Artificial Sequence
  Synthetic oligonucleotide
aacgtggagaagtacggagggaaagcgagaagtag

SEQ ID NO: 95347 - DNA, 35 bp, Artificial Sequence
  Synthetic oligonucleotide
tcgactgtgaacggggaatcggcttggaaagaggg

SEQ ID NO: 95348 - DNA, 35 bp, Artificial Sequence
  Synthetic oligonucleotide
aacgatggccgaatagcgtggatttagggggcggg

SEQ ID NO: 95349 - DNA, 35 bp, Artificial Sequence
  Synthetic oligonucleotide
agagatggtaaggaggtgggataggaatgtcgctg

SEQ ID NO: 95350 - DNA, 35 bp, Artificial Sequence
  Synthetic oligonucleotide
gaaagttgcaagggaggggagtgaccactagtaat

SEQ ID NO: 95351 - DNA, 35 bp, Artificial Sequence
  Synthetic oligonucleotide
attgcacgcgagttatgtcgctcgtgcttaaacat

SEQ ID NO: 95352 - DNA, 35 bp, Artificial Sequence
  Synthetic oligonucleotide
gaagggcgatgagcatggtttaaggcaggtacgat

SEQ ID NO: 95353 - DNA, 35 bp, Artificial Sequence
  Synthetic oligonucleotide
gagccacgcactaagtcgcaaacaggcatttgtat

SEQ ID NO: 95354 - DNA, 36 bp, Artificial Sequence
  Synthetic oligonucleotide
gtgccatgctcagacagtcctctacctgcccttcct

SEQ ID NO: 95355 - DNA, 35 bp, Artificial Sequence
  Synthetic oligonucleotide
gaaatcacgaaggacacagcaactcggacatctct

SEQ ID NO: 95356 - DNA, 35 bp, Artificial Sequence
  Synthetic oligonucleotide
gagaaacgacacctggcgtatttaataatttctct

SEQ ID NO: 95357 - DNA, 35 bp, Artificial Sequence
  Synthetic oligonucleotide
ggatggagtgagggggcgttacgtgcaaaaggggt

SEQ ID NO: 95358 - DNA, 35 bp, Artificial Sequence
  Synthetic oligonucleotide
atccaccccagacaatctgcccctgccaccattgt

SEQ ID NO: 95359 - DNA, 35 bp, Artificial Sequence
  Synthetic oligonucleotide
actgacgggtcaaagggctccctcccacctggatt

SEQ ID NO: 95360 - DNA, 35 bp, Artificial Sequence
  Synthetic oligonucleotide
ggtggggtagaactgggctaggggggccgatgatt

SEQ ID NO: 95361 - DNA, 35 bp, Artificial Sequence
  Synthetic oligonucleotide
gaaatgcaaagcgttacgaagggatgaagggggtt

SEQ ID NO: 95362 - DNA, 35 bp, Artificial Sequence
  Synthetic oligonucleotide
accgagcaggtagaccaattaatgccgttccaaaa

SEQ ID NO: 95363 - DNA, 35 bp, Artificial Sequence
  Synthetic oligonucleotide
tccactacggatcctgaatgtctactatctgaaaa

SEQ ID NO: 95364 - DNA, 36 bp, Artificial Sequence
  Synthetic oligonucleotide
accgaaccgaacatcaccgctgaagctgactagaaa

SEQ ID NO: 95365 - DNA, 36 bp, Artificial Sequence
  Synthetic oligonucleotide
agcacccgaaccggaactacagactccaaggggaaa

SEQ ID NO: 95366 - DNA, 36 bp, Artificial Sequence
  Synthetic oligonucleotide
tcttgcacagggcccatcgcgtaggggaatgctaaa

SEQ ID NO: 95367 - DNA, 36 bp, Artificial Sequence
  Synthetic oligonucleotide
tcacacgggtcacgccggcttaacggatattatcaa

SEQ ID NO: 95368 - DNA, 35 bp, Artificial Sequence
  Synthetic oligonucleotide
aagggtacgcaacgggacatggaaggatgattgaa

SEQ ID NO: 95369 - DNA, 36 bp, Artificial Sequence
  Synthetic oligonucleotide
tatcccacgacccttagttattcagtgctctggtaa

SEQ ID NO: 95370 - DNA, 35 bp, Artificial Sequence
  Synthetic oligonucleotide
atagtacacgccacaagcttaccccgctcatgtaa

SEQ ID NO: 95371 - DNA, 36 bp, Artificial Sequence
  Synthetic oligonucleotide
tgatacgcatagcatgttctccggacctcatagcca

SEQ ID NO: 95372 - DNA, 36 bp, Artificial Sequence
  Synthetic oligonucleotide
tcacgcgcagttaatttcccgcagcaagcgcccgca

SEQ ID NO: 95373 - DNA, 35 bp, Artificial Sequence
  Synthetic oligonucleotide
attgagagctcggggggtagtagtgaaagagctca

SEQ ID NO: 95374 - DNA, 35 bp, Artificial Sequence
  Synthetic oligonucleotide
gccagaccgcacctttcttattaggctttccttca

SEQ ID NO: 95375 - DNA, 37 bp, Artificial Sequence
  Synthetic oligonucleotide
gaacaagggtgtcatggaaagtgaggggagggaaaga

SEQ ID NO: 95376 - DNA, 37 bp, Artificial Sequence
  Synthetic oligonucleotide
tcgacggaaggagaggaggcgagggtcggattaaaga

SEQ ID NO: 95377 - DNA, 37 bp, Artificial Sequence
  Synthetic oligonucleotide
tatggaaaggtaagtgcgaagaggacggcagtcaaga

SEQ ID NO: 95378 - DNA, 36 bp, Artificial Sequence
  Synthetic oligonucleotide
tttgtcccaccacactgtcccgtaattgtctcgaga

SEQ ID NO: 95379 - DNA, 37 bp, Artificial Sequence
  Synthetic oligonucleotide
gaacaagtacggaagtttagatggaggaggagggaga

SEQ ID NO: 95380 - DNA, 37 bp, Artificial Sequence
  Synthetic oligonucleotide
gatccgcgaagtcggagtagggaactggcatgggaga

SEQ ID NO: 95381 - DNA, 35 bp, Artificial Sequence
  Synthetic oligonucleotide
tgactaaacagagggcagaagaaaagaaagtgaga

SEQ ID NO: 95382 - DNA, 37 bp, Artificial Sequence
  Synthetic oligonucleotide
acactccggggatgctatccgataagaggctacacga

SEQ ID NO: 95383 - DNA, 37 bp, Artificial Sequence
  Synthetic oligonucleotide
ggacagtcgccaccccctcgtgcctgtacatggacga

SEQ ID NO: 95384 - DNA, 37 bp, Artificial Sequence
  Synthetic oligonucleotide
agccggtgcgcatgaagatgagcgccttttgctacga

SEQ ID NO: 95385 - DNA, 37 bp, Artificial Sequence
  Synthetic oligonucleotide
acagacagaaagccgtgctgtatgagatacgttacga

SEQ ID NO: 95386 - DNA, 36 bp, Artificial Sequence
  Synthetic oligonucleotide
gccgactacgcagacgcagcaatcacgcttattcga

SEQ ID NO: 95387 - DNA, 37 bp, Artificial Sequence
  Synthetic oligonucleotide
ttcaccgccctgtcttctttaggtaccagagtttcga

SEQ ID NO: 95388 - DNA, 37 bp, Artificial Sequence
  Synthetic oligonucleotide
gccccatagcagtattaactgccagttgctgtaagga

SEQ ID NO: 95389 - DNA, 37 bp, Artificial Sequence
  Synthetic oligonucleotide
aatgggcaagggggcaggtcggctgaacggaacagga

SEQ ID NO: 95390 - DNA, 37 bp, Artificial Sequence
  Synthetic oligonucleotide
accaccatcaacgtatcgcaccgccttgtacgcagga

SEQ ID NO: 95391 - DNA, 37 bp, Artificial Sequence
  Synthetic oligonucleotide
acgcaaggcgtacggtctgcccatctaatagcacgga

SEQ ID NO: 95392 - DNA, 37 bp, Artificial Sequence
  Synthetic oligonucleotide
ttgccacccccagccctctttagtaccctcttgcgga

SEQ ID NO: 95393 - DNA, 35 bp, Artificial Sequence
  Synthetic oligonucleotide
atcaacaagcgggggtatgaacgtataacatggga

SEQ ID NO: 95394 - DNA, 37 bp, Artificial Sequence
  Synthetic oligonucleotide
taccacagtcacacttctttcccacatccatgatgga

SEQ ID NO: 95395 - DNA, 36 bp, Artificial Sequence
  Synthetic oligonucleotide
gatctgccaaccaaaccggctcagtccactcgtgga

SEQ ID NO: 95396 - DNA, 36 bp, Artificial Sequence
  Synthetic oligonucleotide
gcacggggggaataggagcacgatagctgcggtgga

SEQ ID NO: 95397 - DNA, 37 bp, Artificial Sequence
  Synthetic oligonucleotide
aacaaacgccaatgcgcttgggagtgggctatttgga

SEQ ID NO: 95398 - DNA, 37 bp, Artificial Sequence
  Synthetic oligonucleotide
accaaccaacgggacacttttcgcgattcgccaatga

SEQ ID NO: 95399 - DNA, 37 bp, Artificial Sequence
  Synthetic oligonucleotide
atgggcagaaggtggggaacagtaaacagtggaatga

SEQ ID NO: 95400 - DNA, 38 bp, Artificial Sequence
  Synthetic oligonucleotide
acgaggaggaactggcggggaacggggtctagttatga

SEQ ID NO: 95401 - DNA, 38 bp, Artificial Sequence
  Synthetic oligonucleotide
gcgacaggtaatgggattgggagaggcgggctcactga

SEQ ID NO: 95402 - DNA, 36 bp, Artificial Sequence
  Synthetic oligonucleotide
aacaaacccgcgggcagggttttatatccctactga

SEQ ID NO: 95403 - DNA, 37 bp, Artificial Sequence
  Synthetic oligonucleotide
tccgaatcgccgaattcgtttattaccacattactga

SEQ ID NO: 95404 - DNA, 38 bp, Artificial Sequence
  Synthetic oligonucleotide
atggtcgccatcgccgtggttaaagtttctctacctga

SEQ ID NO: 95405 - DNA, 37 bp, Artificial Sequence
  Synthetic oligonucleotide
acgaccgcagtgctggaagcaaatttaaaaacagtga

SEQ ID NO: 95406 - DNA, 38 bp, Artificial Sequence
  Synthetic oligonucleotide
tctgcgaggggcaagaagaaggatcaaactaagagtga

SEQ ID NO: 95407 - DNA, 37 bp, Artificial Sequence
  Synthetic oligonucleotide
attgcgaggataaacggggacaaagaagtaggagtga

SEQ ID NO: 95408 - DNA, 38 bp, Artificial Sequence
  Synthetic oligonucleotide
gcaccgctaattgatacctcgcctctgcagtgacgtga

SEQ ID NO: 95409 - DNA, 38 bp, Artificial Sequence
  Synthetic oligonucleotide
gacgcgtacatcagagggaaggaggaattgtgtcgtga

SEQ ID NO: 95410 - DNA, 38 bp, Artificial Sequence
  Synthetic oligonucleotide
tagtgaagcagattagtggtatatgatgccaggggtga

SEQ ID NO: 95411 - DNA, 36 bp, Artificial Sequence
  Synthetic oligonucleotide
tgagagaagggaagggaaatggggttgcattggtga

SEQ ID NO: 95412 - DNA, 38 bp, Artificial Sequence
  Synthetic oligonucleotide
gacaccggaggcagatcgtttttgaggggcctgtgtga

SEQ ID NO: 95413 - DNA, 37 bp, Artificial Sequence
  Synthetic oligonucleotide
gatgtcgccgggtaggccttgagtcatctccttgtga

SEQ ID NO: 95414 - DNA, 38 bp, Artificial Sequence
  Synthetic oligonucleotide
tgccccccctgccttggcgtatttggttccgtttgtga

SEQ ID NO: 95415 - DNA, 38 bp, Artificial Sequence
  Synthetic oligonucleotide
tagagatgcgcatcccacatgctttgttgtacacttga

SEQ ID NO: 95416 - DNA, 38 bp, Artificial Sequence
  Synthetic oligonucleotide
tgccatcagttgacccaccattcaccactttggcttga

SEQ ID NO: 95417 - DNA, 38 bp, Artificial Sequence
  Synthetic oligonucleotide
ggatggggacgtggtgaggagaggaacgggcatcttga

SEQ ID NO: 95418 - DNA, 37 bp, Artificial Sequence
  Synthetic oligonucleotide
tcacatgcaggacagtttgacgtgttgcgcgctttga

SEQ ID NO: 95419 - DNA, 37 bp, Artificial Sequence
  Synthetic oligonucleotide
tacccgcactgtgctgacttactggggaatagtttga

SEQ ID NO: 95420 - DNA, 38 bp, Artificial Sequence
  Synthetic oligonucleotide
tagcaccgaggagccgagcccccatgacacagttttga

SEQ ID NO: 95421 - DNA, 38 bp, Artificial Sequence
  Synthetic oligonucleotide
ttcgtcggtcggcttgacttacttccccgctgttttga

SEQ ID NO: 95422 - DNA, 38 bp, Artificial Sequence
  Synthetic oligonucleotide
tgagcgacgtccttgtgtgttgattcttttttttttga

SEQ ID NO: 95423 - DNA, 35 bp, Artificial Sequence
  Synthetic oligonucleotide
ttgtggtgcaagggctcgtattgcacaaaattata

SEQ ID NO: 95424 - DNA, 36 bp, Artificial Sequence
  Synthetic oligonucleotide
tagtgaccggcgcaggccgtactcgacttcccacta

SEQ ID NO: 95425 - DNA, 35 bp, Artificial Sequence
  Synthetic oligonucleotide
gctgtgcgaacacctatcctacgtccacatcgcta

SEQ ID NO: 95426 - DNA, 36 bp, Artificial Sequence
  Synthetic oligonucleotide
ttacccataagtgtcctgccgtgacgctcccccgta

SEQ ID NO: 95427 - DNA, 35 bp, Artificial Sequence
  Synthetic oligonucleotide
agagtgcacacgggagccttaactgggcgcgatta

SEQ ID NO: 95428 - DNA, 36 bp, Artificial Sequence
  Synthetic oligonucleotide
aagcccaacgcccgctgtctgtccctcgtactctta

SEQ ID NO: 95429 - DNA, 35 bp, Artificial Sequence
  Synthetic oligonucleotide
atcgagcgcgcttgttggtttttctcctgttgcac

SEQ ID NO: 95430 - DNA, 35 bp, Artificial Sequence
  Synthetic oligonucleotide
ggagacagtaccagtaggtgaacgaagataacgac

SEQ ID NO: 95431 - DNA, 35 bp, Artificial Sequence
  Synthetic oligonucleotide
accacggccacatctaatatcagtccccacgcgac

SEQ ID NO: 95432 - DNA, 36 bp, Artificial Sequence
  Synthetic oligonucleotide
gctaccaccgccacacttgttcggtgtggggaaacc

SEQ ID NO: 95433 - DNA, 35 bp, Artificial Sequence
  Synthetic oligonucleotide
tgtacgatcgtcctgtctctctcgggctcctctcc

SEQ ID NO: 95434 - DNA, 35 bp, Artificial Sequence
  Synthetic oligonucleotide
tgaggtacgcccgacttaatgctcggaaaccttcc

SEQ ID NO: 95435 - DNA, 35 bp, Artificial Sequence
  Synthetic oligonucleotide
tcacatcccgtgtacttactgcgattttgtcttcc

SEQ ID NO: 95436 - DNA, 35 bp, Artificial Sequence
  Synthetic oligonucleotide
aagtgggagcgctcaggtacgggattagggagggc

SEQ ID NO: 95437 - DNA, 35 bp, Artificial Sequence
  Synthetic oligonucleotide
gatataagggaggttgagggtggtagagatggggc

SEQ ID NO: 95438 - DNA, 35 bp, Artificial Sequence
  Synthetic oligonucleotide
aactgtgcacgctggcgaggaggaggaatgattgc

SEQ ID NO: 95439 - DNA, 35 bp, Artificial Sequence
  Synthetic oligonucleotide
tttgggcatcctggcctcgagttctgtgcactatc

SEQ ID NO: 95440 - DNA, 35 bp, Artificial Sequence
  Synthetic oligonucleotide
gcctggccgaactcgaagagcaatagttagtcctc

SEQ ID NO: 95441 - DNA, 35 bp, Artificial Sequence
  Synthetic oligonucleotide
atgacgtgcggggtagtagcttggtgtcaccggtc

SEQ ID NO: 95442 - DNA, 35 bp, Artificial Sequence
  Synthetic oligonucleotide
ttgcgcctctacataaaggccctggtaatctcttc

SEQ ID NO: 95443 - DNA, 35 bp, Artificial Sequence
  Synthetic oligonucleotide
atacgtagcgctatccaataaggttcacctctttc

SEQ ID NO: 95444 - DNA, 35 bp, Artificial Sequence
  Synthetic oligonucleotide
gactaggctcggggtacggtatggcagttagagag

SEQ ID NO: 95445 - DNA, 35 bp, Artificial Sequence
  Synthetic oligonucleotide
gcgtggacgtggggaaaactggtagtgcgaaggag

SEQ ID NO: 95446 - DNA, 35 bp, Artificial Sequence
  Synthetic oligonucleotide
tttaccgccgccgtgacatctaataggaccctagg

SEQ ID NO: 95447 - DNA, 35 bp, Artificial Sequence
  Synthetic oligonucleotide
ttcagcaccttgggacccaaataacgacttcacgg

SEQ ID NO: 95448 - DNA, 35 bp, Artificial Sequence
  Synthetic oligonucleotide
gtcgcacaccgcacacgctgtcagactcaacctgg

SEQ ID NO: 95449 - DNA, 35 bp, Artificial Sequence
  Synthetic oligonucleotide
atggtcacgggagggggtaggaagaggtcaacctg

SEQ ID NO: 95450 - DNA, 35 bp, Artificial Sequence
  Synthetic oligonucleotide
ttgacttgcccgaacattcgatagttgcgaccctg

SEQ ID NO: 95451 - DNA, 35 bp, Artificial Sequence
  Synthetic oligonucleotide
acacgccctcaccttcgcgtagacgagctaccctg

SEQ ID NO: 95452 - DNA, 35 bp, Artificial Sequence
  Synthetic oligonucleotide
atagcgcaatgcaattctgttgaacgatccctctg

SEQ ID NO: 95453 - DNA, 35 bp, Artificial Sequence
  Synthetic oligonucleotide
tacgactgctcaacaaatgcggtcgaatgaatcat

SEQ ID NO: 95454 - DNA, 35 bp, Artificial Sequence
  Synthetic oligonucleotide
ggtgtcgcgcatccggcaaactctacagacgccct

SEQ ID NO: 95455 - DNA, 35 bp, Artificial Sequence
  Synthetic oligonucleotide
agtgggaccgaagttgggcaggagagtgtgtcgct

SEQ ID NO: 95456 - DNA, 35 bp, Artificial Sequence
  Synthetic oligonucleotide
ttcgacgtggcggtttggtgccttcttttgcgtct

SEQ ID NO: 95457 - DNA, 35 bp, Artificial Sequence
  Synthetic oligonucleotide
tcgaggcggatacggatggaaaggctggtgggagt

SEQ ID NO: 95458 - DNA, 35 bp, Artificial Sequence
  Synthetic oligonucleotide
ttcagtcacccctctgacatgctaagtttaaacgt

SEQ ID NO: 95459 - DNA, 35 bp, Artificial Sequence
  Synthetic oligonucleotide
attgcgcactgtcgtcaatttcgcttgcctatggt

SEQ ID NO: 95460 - DNA, 35 bp, Artificial Sequence
  Synthetic oligonucleotide
tgttacggggcgtgccactagccaatgtacccatt

SEQ ID NO: 95461 - DNA, 35 bp, Artificial Sequence
  Synthetic oligonucleotide
atgatgccgccatccgcaaagcatgcagcatactt

SEQ ID NO: 95462 - DNA, 35 bp, Artificial Sequence
  Synthetic oligonucleotide
gagtcatcttccagccataagctccgattttcctt

SEQ ID NO: 95463 - DNA, 35 bp, Artificial Sequence
  Synthetic oligonucleotide
gcatggtgcttgtacgctctacttttccggacttt

SEQ ID NO: 95464 - DNA, 36 bp, Artificial Sequence
  Synthetic oligonucleotide
acagggtggagggcgggctgggactgtgagagaaaa

SEQ ID NO: 95465 - DNA, 36 bp, Artificial Sequence
  Synthetic oligonucleotide
tgcacccaccagccaagcgtctacaggatcaccaaa

SEQ ID NO: 95466 - DNA, 35 bp, Artificial Sequence
  Synthetic oligonucleotide
gaactgcccgcggagccactaaggccacactacaa

SEQ ID NO: 95467 - DNA, 36 bp, Artificial Sequence
  Synthetic oligonucleotide
acgacccgccatccgttgcgacacactgtccaccaa

SEQ ID NO: 95468 - DNA, 36 bp, Artificial Sequence
  Synthetic oligonucleotide
atcacgcaaattgcataccacccggcctttgaccaa

SEQ ID NO: 95469 - DNA, 36 bp, Artificial Sequence
  Synthetic oligonucleotide
tccgaccggcgccatgtctctcatcatcctctccaa

SEQ ID NO: 95470 - DNA, 35 bp, Artificial Sequence
  Synthetic oligonucleotide
gaccatcactatgtctccgaaccacctataagcaa

SEQ ID NO: 95471 - DNA, 36 bp, Artificial Sequence
  Synthetic oligonucleotide
acactacagccgctctattcgctattgccccagcaa

SEQ ID NO: 95472 - DNA, 36 bp, Artificial Sequence
  Synthetic oligonucleotide
ggtggtgaagttgggggcggagaatagaaaaggcaa

SEQ ID NO: 95473 - DNA, 33 bp, Artificial Sequence
  Synthetic oligonucleotide
acacaccttcatctggcttgccgtacccttcaa

SEQ ID NO: 95474 - DNA, 36 bp, Artificial Sequence
  Synthetic oligonucleotide
ttaccatccacacgtagcgattgcgtggaacacgaa

SEQ ID NO: 95475 - DNA, 35 bp, Artificial Sequence
  Synthetic oligonucleotide
cacgacgcaagatcgtgcccgtgtgcccctcttaa

SEQ ID NO: 95476 - DNA, 35 bp, Artificial Sequence
  Synthetic oligonucleotide
tgagggccctgacacgaaaaaaacctcgtgctaca

SEQ ID NO: 95477 - DNA, 35 bp, Artificial Sequence
  Synthetic oligonucleotide
taaccgccctgaagcgattgcaaaaatcacatcca

SEQ ID NO: 95478 - DNA, 35 bp, Artificial Sequence
  Synthetic oligonucleotide
gttgagcggagactggtgaaggagtttggagggca

SEQ ID NO: 95479 - DNA, 35 bp, Artificial Sequence
  Synthetic oligonucleotide
ggaccatacgccagtattcacatcacgattttgca

SEQ ID NO: 95480 - DNA, 36 bp, Artificial Sequence
  Synthetic oligonucleotide
actgccggggacacttaagggttcatgacgggatca

SEQ ID NO: 95481 - DNA, 36 bp, Artificial Sequence
  Synthetic oligonucleotide
gccattacgcatggtcatacgacaccacgcatatca

SEQ ID NO: 95482 - DNA, 36 bp, Artificial Sequence
  Synthetic oligonucleotide
acaggctacgaccatgaacagccaccgtacctctca

SEQ ID NO: 95483 - DNA, 36 bp, Artificial Sequence
  Synthetic oligonucleotide
acgtccaccgcagctggaattccgtcatctccttca

SEQ ID NO: 95484 - DNA, 37 bp, Artificial Sequence
  Synthetic oligonucleotide
aacaggaaaggcggggggtgtaaggggggcgtccaga

SEQ ID NO: 95485 - DNA, 37 bp, Artificial Sequence
  Synthetic oligonucleotide
acccttcaccacctgcgctaagagacgaagttgcaga

SEQ ID NO: 95486 - DNA, 37 bp, Artificial Sequence
  Synthetic oligonucleotide
gtgatgcgtggggtggcatttcggatcaatcaagaga

SEQ ID NO: 95487 - DNA, 37 bp, Artificial Sequence
  Synthetic oligonucleotide
gaccaacgataagtcgtgggagtggaagcaggagaga

SEQ ID NO: 95488 - DNA, 38 bp, Artificial Sequence
  Synthetic oligonucleotide
gagtaggaaaggatggtaagcgtaatggcgcgctgaga

SEQ ID NO: 95489 - DNA, 37 bp, Artificial Sequence
  Synthetic oligonucleotide
gacactcgatctccttaggaccgttccgataactaga

SEQ ID NO: 95490 - DNA, 35 bp, Artificial Sequence
  Synthetic oligonucleotide
ttcgtcccgatcggccttgttcctctacactacga

SEQ ID NO: 95491 - DNA, 37 bp, Artificial Sequence
  Synthetic oligonucleotide
gtgggggttcgacattgatttaatctgctgctaccga

SEQ ID NO: 95492 - DNA, 37 bp, Artificial Sequence
  Synthetic oligonucleotide
gtggtcaccctacccccatatctcttcacgctgccga

SEQ ID NO: 95493 - DNA, 37 bp, Artificial Sequence
  Synthetic oligonucleotide
ggatgaaggccgaggggctggcgtgaggaaagcgcga

SEQ ID NO: 95494 - DNA, 37 bp, Artificial Sequence
  Synthetic oligonucleotide
taagccatggatagaacggggtgtggtgcccaggcga

SEQ ID NO: 95495 - DNA, 37 bp, Artificial Sequence
  Synthetic oligonucleotide
gccaagtagtggaagtaaaaactgaaaaggtggtcga

SEQ ID NO: 95496 - DNA, 37 bp, Artificial Sequence
  Synthetic oligonucleotide
gagccggtacaccgtggcattatattgatcttttcga

SEQ ID NO: 95497 - DNA, 37 bp, Artificial Sequence
  Synthetic oligonucleotide
tggtgggaacaggggatttcagggaacgggctaagga

SEQ ID NO: 95498 - DNA, 35 bp, Artificial Sequence
  Synthetic oligonucleotide
gtacagcaccttactgagtttcgcatttgccagga

SEQ ID NO: 95499 - DNA, 37 bp, Artificial Sequence
  Synthetic oligonucleotide
tcaacatgttccacctggtattgtgcataccttagga

SEQ ID NO: 95500 - DNA, 35 bp, Artificial Sequence
  Synthetic oligonucleotide
atccgccgcacctctcgaagcgtatcgttatcgga

SEQ ID NO: 95501 - DNA, 35 bp, Artificial Sequence
  Synthetic oligonucleotide
ttggtggggagtgagattgaaccgtggagggggga

SEQ ID NO: 95502 - DNA, 37 bp, Artificial Sequence
  Synthetic oligonucleotide
gcacgaccacctgtaaaattaattggtaagccatgga

SEQ ID NO: 95503 - DNA, 36 bp, Artificial Sequence
  Synthetic oligonucleotide
acgtgacgtgggcaggtcgttaacgtaacgggtgga

SEQ ID NO: 95504 - DNA, 35 bp, Artificial Sequence
  Synthetic oligonucleotide
gactacgttactttgctggtgctccaatctgtgga

SEQ ID NO: 95505 - DNA, 37 bp, Artificial Sequence
  Synthetic oligonucleotide
gagacgcggacagacgtacgtgataaattcccttgga

SEQ ID NO: 95506 - DNA, 38 bp, Artificial Sequence
  Synthetic oligonucleotide
tacacgcgcccggtgatggtgtaatgccttgctcatga

SEQ ID NO: 95507 - DNA, 38 bp, Artificial Sequence
  Synthetic oligonucleotide
gatgacaccgccgcaggtgcaccgccagtcctcgatga

SEQ ID NO: 95508 - DNA, 38 bp, Artificial Sequence
  Synthetic oligonucleotide
tcacccatcgtcattgctttactatctactgtcgatga

SEQ ID NO: 95509 - DNA, 38 bp, Artificial Sequence
  Synthetic oligonucleotide
tgttgcccagtggtctgcaatgttcccatatcgcctga

SEQ ID NO: 95510 - DNA, 38 bp, Artificial Sequence
  Synthetic oligonucleotide
tacacgtacggggggtaagaaaaaggccggatgcctga

SEQ ID NO: 95511 - DNA, 38 bp, Artificial Sequence
  Synthetic oligonucleotide
gacgacaagaccggcggaggacggagaatgctggctga

SEQ ID NO: 95512 - DNA, 35 bp, Artificial Sequence
  Synthetic oligonucleotide
gtccgggccgatctgcacagcaacacgttatctga

SEQ ID NO: 95513 - DNA, 36 bp, Artificial Sequence
  Synthetic oligonucleotide
gatagagacacggagcagtaggtaagggacgagtga

SEQ ID NO: 95514 - DNA, 38 bp, Artificial Sequence
  Synthetic oligonucleotide
ggtggtgtgaagggggggaagatgtccgcgtcacgtga

SEQ ID NO: 95515 - DNA, 38 bp, Artificial Sequence
  Synthetic oligonucleotide
ggacacaggcctgtgatttcctccaccgtatacggtga

SEQ ID NO: 95516 - DNA, 38 bp, Artificial Sequence
  Synthetic oligonucleotide
aatgatgctcggaacaggaaaggggaagatcagtgtga

SEQ ID NO: 95517 - DNA, 37 bp, Artificial Sequence
  Synthetic oligonucleotide
gcgccccatccggccgcgttcgtggaaccttttgtga

SEQ ID NO: 95518 - DNA, 38 bp, Artificial Sequence
  Synthetic oligonucleotide
gacgcgacggaaagaagggcctcgcacagataccttga

SEQ ID NO: 95519 - DNA, 38 bp, Artificial Sequence
  Synthetic oligonucleotide
tactctgccacacatagttcccagtaaggcacccttga

SEQ ID NO: 95520 - DNA, 37 bp, Artificial Sequence
  Synthetic oligonucleotide
accaaagcatcacggattagttccgttgccattttga

SEQ ID NO: 95521 - DNA, 36 bp, Artificial Sequence
  Synthetic oligonucleotide
tttgtgcggcctgacttccggagcctaatcaaacta

SEQ ID NO: 95522 - DNA, 36 bp, Artificial Sequence
  Synthetic oligonucleotide
acacacgctgtgtcgttttcgtctgaatacccacta

SEQ ID NO: 95523 - DNA, 36 bp, Artificial Sequence
  Synthetic oligonucleotide
acaacacgacaaattgaaccgaacagcctgtggcta

SEQ ID NO: 95524 - DNA, 36 bp, Artificial Sequence
  Synthetic oligonucleotide
tgcacaccgaaaatctgccaaccatcagaaactcta

SEQ ID NO: 95525 - DNA, 36 bp, Artificial Sequence
  Synthetic oligonucleotide
tacatccaacgattgagagggtccatctgcctcgta

SEQ ID NO: 95526 - DNA, 36 bp, Artificial Sequence
  Synthetic oligonucleotide
gtgtgcaaccgcaggagaggatgtaggatcacggta

SEQ ID NO: 95527 - DNA, 36 bp, Artificial Sequence
  Synthetic oligonucleotide
gactggccggacttccggggggaaaagtgggtgtta

SEQ ID NO: 95528 - DNA, 35 bp, Artificial Sequence
  Synthetic oligonucleotide
tcatcctcaggtcacattgcacatgaacgcattta

SEQ ID NO: 95529 - DNA, 35 bp, Artificial Sequence
  Synthetic oligonucleotide
atgtctgaagcacagccgcccttctgttccaccac

SEQ ID NO: 95530 - DNA, 35 bp, Artificial Sequence
  Synthetic oligonucleotide
gaggagggtcgactctctcttttcgcatactccac

SEQ ID NO: 95531 - DNA, 35 bp, Artificial Sequence
  Synthetic oligonucleotide
tatatgcagaacggccactacattctccgttccac

SEQ ID NO: 95532 - DNA, 35 bp, Artificial Sequence
  Synthetic oligonucleotide
ttgtcgggcccccacatgccagactgccttattac

SEQ ID NO: 95533 - DNA, 35 bp, Artificial Sequence
  Synthetic oligonucleotide
attacaggccgtgaaatgatccatcccgtttcccc

SEQ ID NO: 95534 - DNA, 35 bp, Artificial Sequence
  Synthetic oligonucleotide
ggtcatccacgtatggtgccactcaatgccaagcc

SEQ ID NO: 95535 - DNA, 35 bp, Artificial Sequence
  Synthetic oligonucleotide
gacacgagcgtataccgtcactgctgaactccgcc

SEQ ID NO: 95536 - DNA, 35 bp, Artificial Sequence
  Synthetic oligonucleotide
gtgctcccacagtagcgaaaacatctgggtcctcc

SEQ ID NO: 95537 - DNA, 35 bp, Artificial Sequence
  Synthetic oligonucleotide
gccacattcgttactggattgtgtaaccattctcc

SEQ ID NO: 95538 - DNA, 35 bp, Artificial Sequence
  Synthetic oligonucleotide
tcgaagtcgggttcatgcactcaacactggcttcc

SEQ ID NO: 95539 - DNA, 35 bp, Artificial Sequence
  Synthetic oligonucleotide
ggacgcagttacagtccaccatgcttcctctttcc

SEQ ID NO: 95540 - DNA, 35 bp, Artificial Sequence
  Synthetic oligonucleotide
tcacgcgtttatccagctgcaccgtcttatatcgc

SEQ ID NO: 95541 - DNA, 35 bp, Artificial Sequence
  Synthetic oligonucleotide
gtggacgcctaactgaggaattggattaacttggc

SEQ ID NO: 95542 - DNA, 35 bp, Artificial Sequence
  Synthetic oligonucleotide
gaacgcaagtactctctcatcggacaggaacctgc

SEQ ID NO: 95543 - DNA, 35 bp, Artificial Sequence
  Synthetic oligonucleotide
gtgccgggacgtaggctgttgcaatatttaccatc

SEQ ID NO: 95544 - DNA, 35 bp, Artificial Sequence
  Synthetic oligonucleotide
tagggggggtggattggacttgtgaaagttaggtc

SEQ ID NO: 95545 - DNA, 35 bp, Artificial Sequence
  Synthetic oligonucleotide
gaagcgagcgcacactaaatctgtagcatatggtc

SEQ ID NO: 95546 - DNA, 35 bp, Artificial Sequence
  Synthetic oligonucleotide
tccgactatgaccggtgtgctccgtggtgctggtc

SEQ ID NO: 95547 - DNA, 35 bp, Artificial Sequence
  Synthetic oligonucleotide
aatgtcatcagtgggcggagggattggagattgtc

SEQ ID NO: 95548 - DNA, 35 bp, Artificial Sequence
  Synthetic oligonucleotide
acaacatcagcagaacgtggagggctggaaacgag

SEQ ID NO: 95549 - DNA, 35 bp, Artificial Sequence
  Synthetic oligonucleotide
aacgggcggaacggggaacgccatttaggggggag

SEQ ID NO: 95550 - DNA, 35 bp, Artificial Sequence
  Synthetic oligonucleotide
gacctgctccccacatttagacgcattaatatacg

SEQ ID NO: 95551 - DNA, 35 bp, Artificial Sequence
  Synthetic oligonucleotide
atacgcatcgaatcatggggaggaagggggttgcg

SEQ ID NO: 95552 - DNA, 35 bp, Artificial Sequence
  Synthetic oligonucleotide
agtgtacgtggggggagaaatagacccgggcaagg

SEQ ID NO: 95553 - DNA, 35 bp, Artificial Sequence
  Synthetic oligonucleotide
gttagcctgaactcgtaatctgtttgccatatggg

SEQ ID NO: 95554 - DNA, 35 bp, Artificial Sequence
  Synthetic oligonucleotide
ttacggaccagcgcttaatttatcggaactcctgg

SEQ ID NO: 95555 - DNA, 35 bp, Artificial Sequence
  Synthetic oligonucleotide
gtgtgggagaacaatgtattagatgagagctgatg

SEQ ID NO: 95556 - DNA, 35 bp, Artificial Sequence
  Synthetic oligonucleotide
gacagggcaactggaattagatcggggttggggtg

SEQ ID NO: 95557 - DNA, 35 bp, Artificial Sequence
  Synthetic oligonucleotide
attcaagcgaatgatgctcctcttctaaacctgtg

SEQ ID NO: 95558 - DNA, 35 bp, Artificial Sequence
  Synthetic oligonucleotide
agttacacactgtttagtcacctgcatactgcttg

SEQ ID NO: 95559 - DNA, 35 bp, Artificial Sequence
  Synthetic oligonucleotide
gcactgcccacagtagcagtgcgtaatattctttg

SEQ ID NO: 95560 - DNA, 35 bp, Artificial Sequence
  Synthetic oligonucleotide
taggggatgtcaagcgagaggggggatgacacgat

SEQ ID NO: 95561 - DNA, 35 bp, Artificial Sequence
  Synthetic oligonucleotide
taccgtcactaggcccctccatccctactcatgat

SEQ ID NO: 95562 - DNA, 35 bp, Artificial Sequence
  Synthetic oligonucleotide
aaacacccagctcccatgagacccgttcagccact

SEQ ID NO: 95563 - DNA, 35 bp, Artificial Sequence
  Synthetic oligonucleotide
ttcgtgactccccagtgtgggatctctttctccct

SEQ ID NO: 95564 - DNA, 35 bp, Artificial Sequence
  Synthetic oligonucleotide
tagtgcccaacgggtagaaagggaataggggatct

SEQ ID NO: 95565 - DNA, 35 bp, Artificial Sequence
  Synthetic oligonucleotide
tcacccgttcgttgttggtttccggtcaaaaacgt

SEQ ID NO: 95566 - DNA, 34 bp, Artificial Sequence
  Synthetic oligonucleotide
aacaccgaggcgttccccagggataccggacggt

SEQ ID NO: 95567 - DNA, 35 bp, Artificial Sequence
  Synthetic oligonucleotide
gccagtcggcgctacttgacgtcttagctactggt

SEQ ID NO: 95568 - DNA, 35 bp, Artificial Sequence
  Synthetic oligonucleotide
tcaccggggatcaatgcatagggttcgtaccatgt

SEQ ID NO: 95569 - DNA, 35 bp, Artificial Sequence
  Synthetic oligonucleotide
acgagcccagtagccaagcctccacccctttatgt

SEQ ID NO: 95570 - DNA, 35 bp, Artificial Sequence
  Synthetic oligonucleotide
agcgccgccgactgtttgccaaaactgcctcttgt

SEQ ID NO: 95571 - DNA, 35 bp, Artificial Sequence
  Synthetic oligonucleotide
tattgacgcaggcttcggtcgcgacattttccctt

SEQ ID NO: 95572 - DNA, 35 bp, Artificial Sequence
  Synthetic oligonucleotide
gtcactgagccgtgtccgcccccgaggtcttagtt

SEQ ID NO: 95573 - DNA, 35 bp, Artificial Sequence
  Synthetic oligonucleotide
aacgcgcctcgctatccccaaacctctaacatgtt

SEQ ID NO: 95574 - DNA, 35 bp, Artificial Sequence
  Synthetic oligonucleotide
ttaccgcactggctacagaaccaccgtttcatttt

SEQ ID NO: 95575 - DNA, 36 bp, Artificial Sequence
  Synthetic oligonucleotide
gcgaggtcccagaaagggaactggaaaatttgcaaa

SEQ ID NO: 95576 - DNA, 36 bp, Artificial Sequence
  Synthetic oligonucleotide
tccaccatatccatctcgcgcgcctacaaggcacaa

SEQ ID NO: 95577 - DNA, 36 bp, Artificial Sequence
  Synthetic oligonucleotide
ggacggagacgagtgtatggtgtcaaagatagggaa

SEQ ID NO: 95578 - DNA, 36 bp, Artificial Sequence
  Synthetic oligonucleotide
ataagatgggggggagaaggaggaacgagcgtataa

SEQ ID NO: 95579 - DNA, 36 bp, Artificial Sequence
  Synthetic oligonucleotide
gttcagacacctccctttgtgttcggtggggtaaca

SEQ ID NO: 95580 - DNA, 35 bp, Artificial Sequence
  Synthetic oligonucleotide
gcaccggatgattgtatccttccttcgatctcaca

SEQ ID NO: 95581 - DNA, 36 bp, Artificial Sequence
  Synthetic oligonucleotide
ttcaccacaaacttgacccgtgagtttcttgagaca

SEQ ID NO: 95582 - DNA, 36 bp, Artificial Sequence
  Synthetic oligonucleotide
acgtcgcctctcatcattattcgcctggtaacgaca

SEQ ID NO: 95583 - DNA, 36 bp, Artificial Sequence
  Synthetic oligonucleotide
tacgcagagttggctattgttcttgtggtgtggaca

SEQ ID NO: 95584 - DNA, 36 bp, Artificial Sequence
  Synthetic oligonucleotide
accgaggcttccatggggaggggggtaacgtataca

SEQ ID NO: 95585 - DNA, 36 bp, Artificial Sequence
  Synthetic oligonucleotide
acccgccacactgccttctgccgtcaatctcaagca

SEQ ID NO: 95586 - DNA, 36 bp, Artificial Sequence
  Synthetic oligonucleotide
atgcaccaagccgctgccaacataggaccatgcgca

SEQ ID NO: 95587 - DNA, 36 bp, Artificial Sequence
  Synthetic oligonucleotide
tcccagcgggtgacgaggataaactgggggtgggca

SEQ ID NO: 95588 - DNA, 36 bp, Artificial Sequence
  Synthetic oligonucleotide
ggagtgggaaaggagcacagacaacgacagggatca

SEQ ID NO: 95589 - DNA, 36 bp, Artificial Sequence
  Synthetic oligonucleotide
gaccatgccaaacggtccgcatactgactcgcctca

SEQ ID NO: 95590 - DNA, 36 bp, Artificial Sequence
  Synthetic oligonucleotide
gtgacacgtagaattgggcagacatatatcgtctca

SEQ ID NO: 95591 - DNA, 35 bp, Artificial Sequence
  Synthetic oligonucleotide
atcctcagcgctcgtctcatgggccggttggttca

SEQ ID NO: 95592 - DNA, 37 bp, Artificial Sequence
  Synthetic oligonucleotide
tgcgaaggaggtggagctgaaggaaatgcgctaaaga

SEQ ID NO: 95593 - DNA, 37 bp, Artificial Sequence
  Synthetic oligonucleotide
tcaatcgcaggggatcgaggtggtaagcgtgtaaaga

SEQ ID NO: 95594 - DNA, 37 bp, Artificial Sequence
  Synthetic oligonucleotide
aacaccacaggttgcgtgatgtgtcggtagactaaga

SEQ ID NO: 95595 - DNA, 36 bp, Artificial Sequence
  Synthetic oligonucleotide
actgggggtggaacgcatttataacagggggggaga

SEQ ID NO: 95596 - DNA, 37 bp, Artificial Sequence
  Synthetic oligonucleotide
tcagtgctgccggagaatagagtccgtggagttgaga

SEQ ID NO: 95597 - DNA, 35 bp, Artificial Sequence
  Synthetic oligonucleotide
gcacctgacatcttggtaccattcaaacttataga

SEQ ID NO: 95598 - DNA, 37 bp, Artificial Sequence
  Synthetic oligonucleotide
acgcaacggttggaacgtgaggggtaggggtgtacga

SEQ ID NO: 95599 - DNA, 35 bp, Artificial Sequence
  Synthetic oligonucleotide
gactcaacaagagtggtctggcgacaattcaccga

SEQ ID NO: 95600 - DNA, 37 bp, Artificial Sequence
  Synthetic oligonucleotide
gcaaccgggggaaacaccatatgactagtactaccga

SEQ ID NO: 95601 - DNA, 37 bp, Artificial Sequence
  Synthetic oligonucleotide
ttgcccacccctaccttttccgtgtatacaggtccga

SEQ ID NO: 95602 - DNA, 36 bp, Artificial Sequence
  Synthetic oligonucleotide
ggtcaacaccccgaagtgaaagcgaccctctttcga

SEQ ID NO: 95603 - DNA, 37 bp, Artificial Sequence
  Synthetic oligonucleotide
gcgcgagctgaggtaaggaaatagctagtggggagga

SEQ ID NO: 95604 - DNA, 37 bp, Artificial Sequence
  Synthetic oligonucleotide
gacatgcggagattaaatatcgaacttatagtccgga

SEQ ID NO: 95605 - DNA, 37 bp, Artificial Sequence
  Synthetic oligonucleotide
gaagtcgcagagagcatgaacggcataaatagaggga

SEQ ID NO: 95606 - DNA, 37 bp, Artificial Sequence
  Synthetic oligonucleotide
tcaccaatcggacggaatgttctgcaacactgaggga

SEQ ID NO: 95607 - DNA, 37 bp, Artificial Sequence
  Synthetic oligonucleotide
tcggagggtgagtaggagtcgtagaagggaggcggga

SEQ ID NO: 95608 - DNA, 36 bp, Artificial Sequence
  Synthetic oligonucleotide
agacaacgtgtaaagggtcttgggttagggtcggga

SEQ ID NO: 95609 - DNA, 36 bp, Artificial Sequence
  Synthetic oligonucleotide
gatcacagcactgggtgttggaatgggtggtcggga

SEQ ID NO: 95610 - DNA, 37 bp, Artificial Sequence
  Synthetic oligonucleotide
gagcaagtgcacagtatggttggcatttttgggggga

SEQ ID NO: 95611 - DNA, 37 bp, Artificial Sequence
  Synthetic oligonucleotide
gattaggaggaggcggggtgacttgtgcatcggtgga

SEQ ID NO: 95612 - DNA, 37 bp, Artificial Sequence
  Synthetic oligonucleotide
tcacacaggacaagaattagggatagtgagtggtgga

SEQ ID NO: 95613 - DNA, 38 bp, Artificial Sequence
  Synthetic oligonucleotide
accaggtccggtcttcacctcgtcttgatactccatga

SEQ ID NO: 95614 - DNA, 37 bp, Artificial Sequence
  Synthetic oligonucleotide
accaaccctgtcccgttcatataagttcatacactga

SEQ ID NO: 95615 - DNA, 38 bp, Artificial Sequence
  Synthetic oligonucleotide
gatcgaggggaagtgcatggacaaggcgagactactga

SEQ ID NO: 95616 - DNA, 38 bp, Artificial Sequence
  Synthetic oligonucleotide
atcgcacgatacatcatgccatgactttagacccctga

SEQ ID NO: 95617 - DNA, 38 bp, Artificial Sequence
  Synthetic oligonucleotide
gtgacagccggatccgttctagctaacaaactccctga

SEQ ID NO: 95618 - DNA, 38 bp, Artificial Sequence
  Synthetic oligonucleotide
atccaggcgcccgttccgctatgctccttcctttctga

SEQ ID NO: 95619 - DNA, 38 bp, Artificial Sequence
  Synthetic oligonucleotide
gacgaacgcgatataaggttgttacatgagagaagtga

SEQ ID NO: 95620 - DNA, 38 bp, Artificial Sequence
  Synthetic oligonucleotide
acacgagtgaatgatgggacaaagcaagtgttaagtga

SEQ ID NO: 95621 - DNA, 38 bp, Artificial Sequence
  Synthetic oligonucleotide
tttgcgcccgttctgaatcggcctttttaacacagtga

SEQ ID NO: 95622 - DNA, 38 bp, Artificial Sequence
  Synthetic oligonucleotide
gccatgcagtagagacgagcaggtaatgatgcgagtga

SEQ ID NO: 95623 - DNA, 38 bp, Artificial Sequence
  Synthetic oligonucleotide
tgaatacgaggaagggtgaagaggtaggccaggagtga

SEQ ID NO: 95624 - DNA, 38 bp, Artificial Sequence
  Synthetic oligonucleotide
tcataaagcgttcctgcacctgctacccgtcatagtga

SEQ ID NO: 95625 - DNA, 37 bp, Artificial Sequence
  Synthetic oligonucleotide
tgtcaatcagcgggagagggggaaggtgtggtagtga

SEQ ID NO: 95626 - DNA, 37 bp, Artificial Sequence
  Synthetic oligonucleotide
gagtgctgctgagttcttctgcccgaggctctcgtga

SEQ ID NO: 95627 - DNA, 37 bp, Artificial Sequence
  Synthetic oligonucleotide
actgactgctcccttccatgttagcgattgccggtga

SEQ ID NO: 95628 - DNA, 38 bp, Artificial Sequence
  Synthetic oligonucleotide
tcacgtcgcacgtgcgtagggatcaaggggggcggtga

SEQ ID NO: 95629 - DNA, 38 bp, Artificial Sequence
  Synthetic oligonucleotide
gttgcctcaacgaatcccactctacagaactcgggtga

SEQ ID NO: 95630 - DNA, 38 bp, Artificial Sequence
  Synthetic oligonucleotide
tcaacatgtcgagggctcatgagaagggaggcaattga

SEQ ID NO: 95631 - DNA, 37 bp, Artificial Sequence
  Synthetic oligonucleotide
accatcgacgatcgctttaggtttcattctgcattga

SEQ ID NO: 95632 - DNA, 37 bp, Artificial Sequence
  Synthetic oligonucleotide
acgtggctgctgcaattactctatgggcctatcttga

SEQ ID NO: 95633 - DNA, 38 bp, Artificial Sequence
  Synthetic oligonucleotide
gacaaaggaaggtgggggaggtcgggacgtttagttga

SEQ ID NO: 95634 - DNA, 37 bp, Artificial Sequence
  Synthetic oligonucleotide
gcaaaaaccgtaccacaacccagtctgactccgttga

SEQ ID NO: 95635 - DNA, 38 bp, Artificial Sequence
  Synthetic oligonucleotide
tgaagacatcggctataggtggctgaagggagggttga

SEQ ID NO: 95636 - DNA, 38 bp, Artificial Sequence
  Synthetic oligonucleotide
aaaccagccgcatgagtccatcccggtatactctttga

SEQ ID NO: 95637 - DNA, 35 bp, Artificial Sequence
  Synthetic oligonucleotide
ttaggagtggtgtggacgaggacaggggtggaata

SEQ ID NO: 95638 - DNA, 35 bp, Artificial Sequence
  Synthetic oligonucleotide
atagaacggttgatgagggaactggggggggcata

SEQ ID NO: 95639 - DNA, 36 bp, Artificial Sequence
  Synthetic oligonucleotide
aacacgagcggaaaatccagtaggggtgtaaggata

SEQ ID NO: 95640 - DNA, 35 bp, Artificial Sequence
  Synthetic oligonucleotide
actgacgaaaaggggatggagtacaatgtcatata

SEQ ID NO: 95641 - DNA, 35 bp, Artificial Sequence
  Synthetic oligonucleotide
gtccatcgccgtctaaggtggccctatcactccta

SEQ ID NO: 95642 - DNA, 36 bp, Artificial Sequence
  Synthetic oligonucleotide
actgtgccatgcccgtgaattatcggactggaagta

SEQ ID NO: 95643 - DNA, 36 bp, Artificial Sequence
  Synthetic oligonucleotide
accatgacgaatgtctatacaccggatcaccccgta

SEQ ID NO: 95644 - DNA, 36 bp, Artificial Sequence
  Synthetic oligonucleotide
gacacccaccgtcgtgaaatttagcgtgcaccggta

SEQ ID NO: 95645 - DNA, 36 bp, Artificial Sequence
  Synthetic oligonucleotide
tgacctagcacgtacataatggagggggttggggta

SEQ ID NO: 95646 - DNA, 36 bp, Artificial Sequence
  Synthetic oligonucleotide
gtgtgggcgtgcattaggggattttaagcatcctta

SEQ ID NO: 95647 - DNA, 36 bp, Artificial Sequence
  Synthetic oligonucleotide
ttggtcgacgggggtttagtcagatggggatggtta

SEQ ID NO: 95648 - DNA, 35 bp, Artificial Sequence
  Synthetic oligonucleotide
ggagacaaacccatcagcttgcgtgcctgccacac

SEQ ID NO: 95649 - DNA, 35 bp, Artificial Sequence
  Synthetic oligonucleotide
tgaacgccaatcgcgtcttacggcattgcctccac

SEQ ID NO: 95650 - DNA, 35 bp, Artificial Sequence
  Synthetic oligonucleotide
gagaccatcagcccgtgccgtgtcacacctttcac

SEQ ID NO: 95651 - DNA, 35 bp, Artificial Sequence
  Synthetic oligonucleotide
gccagagcgattacctgtatcacccatgacctccc

SEQ ID NO: 95652 - DNA, 35 bp, Artificial Sequence
  Synthetic oligonucleotide
atgcccaaggcgtttccgcatacgttttccttgcc

SEQ ID NO: 95653 - DNA, 35 bp, Artificial Sequence
  Synthetic oligonucleotide
accaccgctgaggggcccaatatgattcacaatcc

SEQ ID NO: 95654 - DNA, 35 bp, Artificial Sequence
  Synthetic oligonucleotide
tagtaccgtcacccatcatccgtggcccgatctcc

SEQ ID NO: 95655 - DNA, 35 bp, Artificial Sequence
  Synthetic oligonucleotide
tccaccgacgttgtcagtccgcttcctacccgtcc

SEQ ID NO: 95656 - DNA, 35 bp, Artificial Sequence
  Synthetic oligonucleotide
gaatcgctcacagcctgttctgcttaccgttttcc

SEQ ID NO: 95657 - DNA, 35 bp, Artificial Sequence
  Synthetic oligonucleotide
atccagggaagggcactagcaggctaaaggttagc

SEQ ID NO: 95658 - DNA, 35 bp, Artificial Sequence
  Synthetic oligonucleotide
gaccggatcagttatgccacgctatgcttctacgc

SEQ ID NO: 95659 - DNA, 35 bp, Artificial Sequence
  Synthetic oligonucleotide
tcagctacaccgcagcttttaaagttaaccgtggc

SEQ ID NO: 95660 - DNA, 35 bp, Artificial Sequence
  Synthetic oligonucleotide
ttacaccgcacgagcgcacctagctgtctcccctc

SEQ ID NO: 95661 - DNA, 35 bp, Artificial Sequence
  Synthetic oligonucleotide
gaggggcgcccactatatcgggtacttggtttgtc

SEQ ID NO: 95662 - DNA, 35 bp, Artificial Sequence
  Synthetic oligonucleotide
aaccgatgaagagaggactaagaaggctggcgcag

SEQ ID NO: 95663 - DNA, 35 bp, Artificial Sequence
  Synthetic oligonucleotide
gtaggcgggggagaatggaatgtaatgctggaacg

SEQ ID NO: 95664 - DNA, 35 bp, Artificial Sequence
  Synthetic oligonucleotide
gaagcacacatggataggctgggtaatggtgcacg

SEQ ID NO: 95665 - DNA, 35 bp, Artificial Sequence
  Synthetic oligonucleotide
gatggtgcggggggggactttacggacacgaagcg

SEQ ID NO: 95666 - DNA, 35 bp, Artificial Sequence
  Synthetic oligonucleotide
atgagaccaccatggcggggaaagaggaatgctcg

SEQ ID NO: 95667 - DNA, 35 bp, Artificial Sequence
  Synthetic oligonucleotide
gatgcctcaatggaatgaacgggcaggaagaacgg

SEQ ID NO: 95668 - DNA, 35 bp, Artificial Sequence
  Synthetic oligonucleotide
atctggtgggacgcaagggagggacggagcttcgg

SEQ ID NO: 95669 - DNA, 35 bp, Artificial Sequence
  Synthetic oligonucleotide
aaaccgcacactttccagatcgcccctgttactgg

SEQ ID NO: 95670 - DNA, 35 bp, Artificial Sequence
  Synthetic oligonucleotide
gaacaacgcaacgttaatctgcttcattgcattgg

SEQ ID NO: 95671 - DNA, 35 bp, Artificial Sequence
  Synthetic oligonucleotide
actacggcccactgcggaggactactcacacaatg

SEQ ID NO: 95672 - DNA, 35 bp, Artificial Sequence
  Synthetic oligonucleotide
acagatgccgttgcagggcgtggggagttatcaat

SEQ ID NO: 95673 - DNA, 35 bp, Artificial Sequence
  Synthetic oligonucleotide
gaccaccctggttcgtgtacccgcttttgcctact

SEQ ID NO: 95674 - DNA, 35 bp, Artificial Sequence
  Synthetic oligonucleotide
tacatccgtcgtccggcgatactggcggtcaccct

SEQ ID NO: 95675 - DNA, 35 bp, Artificial Sequence
  Synthetic oligonucleotide
acgccaacctaaagcatattttgaggaacaccgct

SEQ ID NO: 95676 - DNA, 35 bp, Artificial Sequence
  Synthetic oligonucleotide
tgcaacacagcatatgcaaaccgatgatcaatgct

SEQ ID NO: 95677 - DNA, 35 bp, Artificial Sequence
  Synthetic oligonucleotide
acagtgctggcacggtccttttttggtactccagt

SEQ ID NO: 95678 - DNA, 35 bp, Artificial Sequence
  Synthetic oligonucleotide
tacaaaaggcgcaccctcaccgactctgtctgagt

SEQ ID NO: 95679 - DNA, 35 bp, Artificial Sequence
  Synthetic oligonucleotide
tagtggagtgggaatagggtgacgacccgcatcgt

SEQ ID NO: 95680 - DNA, 35 bp, Artificial Sequence
  Synthetic oligonucleotide
gatgacggcaacgttaaacaagttccttccctcgt

SEQ ID NO: 95681 - DNA, 35 bp, Artificial Sequence
  Synthetic oligonucleotide
gacctgtgcggcatcctagccctttccttataggt

SEQ ID NO: 95682 - DNA, 35 bp, Artificial Sequence
  Synthetic oligonucleotide
gctgatcgcatgctagtctgctaattcactttggt

SEQ ID NO: 95683 - DNA, 35 bp, Artificial Sequence
  Synthetic oligonucleotide
gtaccgcaccaaatggctctgatttttgtcgcatt

SEQ ID NO: 95684 - DNA, 35 bp, Artificial Sequence
  Synthetic oligonucleotide
gcacgttcatcgctcgtaagcaccgtgttgccctt

SEQ ID NO: 95685 - DNA, 35 bp, Artificial Sequence
  Synthetic oligonucleotide
gcaaatgtcagttgagatcgttaaggtggtcgctt

SEQ ID NO: 95686 - DNA, 35 bp, Artificial Sequence
  Synthetic oligonucleotide
gatgcagacatagagtgtcagctcatgtaacattt

SEQ ID NO: 95687 - DNA, 36 bp, Artificial Sequence
  Synthetic oligonucleotide
gtctcgccgacgcattccttacttggtgtcaccaaa

SEQ ID NO: 95688 - DNA, 36 bp, Artificial Sequence
  Synthetic oligonucleotide
gatcgcgggcacaaccgaagagacagaaggtgacaa

SEQ ID NO: 95689 - DNA, 35 bp, Artificial Sequence
  Synthetic oligonucleotide
gggaagagcgtagggggtaatggtgggatgaggaa

SEQ ID NO: 95690 - DNA, 35 bp, Artificial Sequence
  Synthetic oligonucleotide
acacaccgctccatggtccctctcctgccggggaa

SEQ ID NO: 95691 - DNA, 35 bp, Artificial Sequence
  Synthetic oligonucleotide
ggggatactggcggaggaggtataaggcgggtgaa

SEQ ID NO: 95692 - DNA, 35 bp, Artificial Sequence
  Synthetic oligonucleotide
agctcgcctcgaggtagttctacgttttctccaca

SEQ ID NO: 95693 - DNA, 35 bp, Artificial Sequence
  Synthetic oligonucleotide
gccatgccattctgtaagcctctgttcccttcaca

SEQ ID NO: 95694 - DNA, 35 bp, Artificial Sequence
  Synthetic oligonucleotide
gcaaaccggagaactgttcctgccatcagtataca

SEQ ID NO: 95695 - DNA, 35 bp, Artificial Sequence
  Synthetic oligonucleotide
gtatgtccgcagaatcgcccttgggaccctttaca

SEQ ID NO: 95696 - DNA, 36 bp, Artificial Sequence
  Synthetic oligonucleotide
tagtgcctcacccgtcctacactgaaaccggtccca

SEQ ID NO: 95697 - DNA, 36 bp, Artificial Sequence
  Synthetic oligonucleotide
tatcacgcccctcagccttgattgatgacaccagca

SEQ ID NO: 95698 - DNA, 36 bp, Artificial Sequence
  Synthetic oligonucleotide
aacaaccgcacagaacgttttctcaaattacgtgca

SEQ ID NO: 95699 - DNA, 36 bp, Artificial Sequence
  Synthetic oligonucleotide
acatggccgatctgtcccgtgtaaccgttcgcctca

SEQ ID NO: 95700 - DNA, 36 bp, Artificial Sequence
  Synthetic oligonucleotide
tcccatgccaccgacggtctatttctagttacttca

SEQ ID NO: 95701 - DNA, 36 bp, Artificial Sequence
  Synthetic oligonucleotide
tctcaggcaccggactttggttgggccgtctcttca

SEQ ID NO: 95702 - DNA, 35 bp, Artificial Sequence
  Synthetic oligonucleotide
tccacctccctccgatttgcattcgcttgttttca

SEQ ID NO: 95703 - DNA, 37 bp, Artificial Sequence
  Synthetic oligonucleotide
tgtgctcagcatcccctgctccacgaaccgtgtaaga

SEQ ID NO: 95704 - DNA, 36 bp, Artificial Sequence
  Synthetic oligonucleotide
gactagggaacgcaaggcatcggggcgggttgcaga

SEQ ID NO: 95705 - DNA, 37 bp, Artificial Sequence
  Synthetic oligonucleotide
gaccgattagggagggggaattaaactggacgataga

SEQ ID NO: 95706 - DNA, 37 bp, Artificial Sequence
  Synthetic oligonucleotide
gctcgggctacatgctgcattcccaactcaggctaga

SEQ ID NO: 95707 - DNA, 36 bp, Artificial Sequence
  Synthetic oligonucleotide
tacgctactcgccgcgaggacaaagccaactaacga

SEQ ID NO: 95708 - DNA, 37 bp, Artificial Sequence
  Synthetic oligonucleotide
gatgatcaacagacaggaaagtgggcagatgtagcga

SEQ ID NO: 95709 - DNA, 37 bp, Artificial Sequence
  Synthetic oligonucleotide
tacccacaacaggagtgagcgaagcagtattacgcga

SEQ ID NO: 95710 - DNA, 37 bp, Artificial Sequence
  Synthetic oligonucleotide
gcacccatcctaaggacgacccgtagggatctatcga

SEQ ID NO: 95711 - DNA, 37 bp, Artificial Sequence
  Synthetic oligonucleotide
ggggcgccgcacatctgcttctttggtatccgttcga

SEQ ID NO: 95712 - DNA, 37 bp, Artificial Sequence
  Synthetic oligonucleotide
ggaaaaggggtaggtagtctaaagaagcgcgaaagga

SEQ ID NO: 95713 - DNA, 36 bp, Artificial Sequence
  Synthetic oligonucleotide
tagacgaccgtaggaggataagcgttagggggcgga

SEQ ID NO: 95714 - DNA, 37 bp, Artificial Sequence
  Synthetic oligonucleotide
gcgaagcaagaggtgcacaaatgggcgagatgaggga

SEQ ID NO: 95715 - DNA, 37 bp, Artificial Sequence
  Synthetic oligonucleotide
gcccgagcacgtggttatgagcacacggtgttaggga

SEQ ID NO: 95716 - DNA, 36 bp, Artificial Sequence
  Synthetic oligonucleotide
tgccaaccgccaacatatgctttaacgcagactgga

SEQ ID NO: 95717 - DNA, 37 bp, Artificial Sequence
  Synthetic oligonucleotide
tgagggagggggagctaagggaccatgcgaacgtgga

SEQ ID NO: 95718 - DNA, 37 bp, Artificial Sequence
  Synthetic oligonucleotide
gaggggctgggcatgttatattgggcgggattgtgga

SEQ ID NO: 95719 - DNA, 36 bp, Artificial Sequence
  Synthetic oligonucleotide
gtgctgaagatggacgtgagcgaagaaagggttgga

SEQ ID NO: 95720 - DNA, 38 bp, Artificial Sequence
  Synthetic oligonucleotide
gtcacgcacgcctctctagtgcacgctaccacaaatga

SEQ ID NO: 95721 - DNA, 38 bp, Artificial Sequence
  Synthetic oligonucleotide
gaaccacgcgaggggcgtaagacgggggaactagatga

SEQ ID NO: 95722 - DNA, 37 bp, Artificial Sequence
  Synthetic oligonucleotide
agtaaggccgcaaggggcaaagtaggagatacgatga

SEQ ID NO: 95723 - DNA, 38 bp, Artificial Sequence
  Synthetic oligonucleotide
gatgcaatgcgcgggtatgtgttcttgtgaaactatga

SEQ ID NO: 95724 - DNA, 38 bp, Artificial Sequence
  Synthetic oligonucleotide
tatggccacttatgcttgtaacaccacacagtgtatga

SEQ ID NO: 95725 - DNA, 38 bp, Artificial Sequence
  Synthetic oligonucleotide
tacgcggaacagctcctaaattcatgacgcctcactga

SEQ ID NO: 95726 - DNA, 38 bp, Artificial Sequence
  Synthetic oligonucleotide
ttgagggcagggggagcacggagcctggttttcactga

SEQ ID NO: 95727 - DNA, 37 bp, Artificial Sequence
  Synthetic oligonucleotide
ttgaactgcacgcagtcgtattcacactttcccctga

SEQ ID NO: 95728 - DNA, 38 bp, Artificial Sequence
  Synthetic oligonucleotide
taggggaggccagtgcagtacagtgggcggccgagtga

SEQ ID NO: 95729 - DNA, 37 bp, Artificial Sequence
  Synthetic oligonucleotide
gaagcgactagagaaggaaggaggggttagtgagtga

SEQ ID NO: 95730 - DNA, 37 bp, Artificial Sequence
  Synthetic oligonucleotide
ggataagaccgcatagatggggaagggggatgcgtga

SEQ ID NO: 95731 - DNA, 38 bp, Artificial Sequence
  Synthetic oligonucleotide
gtgtggagcaaagtgtatagggagaaaggattgcgtga

SEQ ID NO: 95732 - DNA, 37 bp, Artificial Sequence
  Synthetic oligonucleotide
acccaagtgaaaaatggtgtgtggaatgaggtcgtga

SEQ ID NO: 95733 - DNA, 38 bp, Artificial Sequence
  Synthetic oligonucleotide
ggatgcgaggtggtaatacgcggatcgggggatggtga

SEQ ID NO: 95734 - DNA, 37 bp, Artificial Sequence
  Synthetic oligonucleotide
atgtggagccaaaagggagggatatcggaggctgtga

SEQ ID NO: 95735 - DNA, 37 bp, Artificial Sequence
  Synthetic oligonucleotide
aagccggggcaatgggaggcactagggcgacaattga

SEQ ID NO: 95736 - DNA, 37 bp, Artificial Sequence
  Synthetic oligonucleotide
gcgtatcgcaggtcctcactgaatcacccataattga

SEQ ID NO: 95737 - DNA, 38 bp, Artificial Sequence
  Synthetic oligonucleotide
tcagggggtgagaaaggatgtgtgatgggcgatattga

SEQ ID NO: 95738 - DNA, 37 bp, Artificial Sequence
  Synthetic oligonucleotide
atgagcaggtacgagagtgggaaaaacctcgtattga

SEQ ID NO: 95739 - DNA, 36 bp, Artificial Sequence
  Synthetic oligonucleotide
aaacgagcagtagatcagttcaagtgaggtaagata

SEQ ID NO: 95740 - DNA, 35 bp, Artificial Sequence
  Synthetic oligonucleotide
acacgacccactgagcgtttcagtctacgccgata

SEQ ID NO: 95741 - DNA, 36 bp, Artificial Sequence
  Synthetic oligonucleotide
gattccactgtcgcgagttgactatccttaacccta

SEQ ID NO: 95742 - DNA, 35 bp, Artificial Sequence
  Synthetic oligonucleotide
accgaaggaccggtctgtcgccacttttttgccta

SEQ ID NO: 95743 - DNA, 35 bp, Artificial Sequence
  Synthetic oligonucleotide
gctgtccacacatattgaaatcctggacgctccta

SEQ ID NO: 95744 - DNA, 36 bp, Artificial Sequence
  Synthetic oligonucleotide
atcatgccgccgatagtatgtcgcaacattggagta

SEQ ID NO: 95745 - DNA, 35 bp, Artificial Sequence
  Synthetic oligonucleotide
acatccttgccgtgcagtctattaccgactaccac

SEQ ID NO: 95746 - DNA, 35 bp, Artificial Sequence
  Synthetic oligonucleotide
tagttcgtccgggcaacagcgagtattctatcacc

SEQ ID NO: 95747 - DNA, 35 bp, Artificial Sequence
  Synthetic oligonucleotide
tgttccaccccatttgactgcaaagatgcagcccc

SEQ ID NO: 95748 - DNA, 35 bp, Artificial Sequence
  Synthetic oligonucleotide
taacaagacacagaagttcacatgggacgaccgcc

SEQ ID NO: 95749 - DNA, 35 bp, Artificial Sequence
  Synthetic oligonucleotide
tgtgctgtagccgtacctgacctccgtattgtgcc

SEQ ID NO: 95750 - DNA, 35 bp, Artificial Sequence
  Synthetic oligonucleotide
tcacttgtcgtgatatccgcggaacatttccatcc

SEQ ID NO: 95751 - DNA, 35 bp, Artificial Sequence
  Synthetic oligonucleotide
tcttaccaaacagtctgtacgtgatgctaccctcc

SEQ ID NO: 95752 - DNA, 35 bp, Artificial Sequence
  Synthetic oligonucleotide
gtctgacgccgtctgccgttctacctccttgttcc

SEQ ID NO: 95753 - DNA, 35 bp, Artificial Sequence
  Synthetic oligonucleotide
gaccaatcttggcctgtttaggaccgcacaaacgc

SEQ ID NO: 95754 - DNA, 35 bp, Artificial Sequence
  Synthetic oligonucleotide
tccccaatgcagctgtatgtgccaccgtacgctgc

SEQ ID NO: 95755 - DNA, 35 bp, Artificial Sequence
  Synthetic oligonucleotide
atgaaccgctggaccgggcctgatttgccgcaatc

SEQ ID NO: 95756 - DNA, 35 bp, Artificial Sequence
  Synthetic oligonucleotide
atacgcgtgcacctatgtcacacccacggttcctc

SEQ ID NO: 95757 - DNA, 35 bp, Artificial Sequence
  Synthetic oligonucleotide
aacaccgtcatacgcttctaccgtaccaatagctc

SEQ ID NO: 95758 - DNA, 35 bp, Artificial Sequence
  Synthetic oligonucleotide
tcaccggatgaacgtcgcactggccactcccggtc

SEQ ID NO: 95759 - DNA, 35 bp, Artificial Sequence
  Synthetic oligonucleotide
gtaggacggccactgtcacttcagccacaatatcg

SEQ ID NO: 95760 - DNA, 35 bp, Artificial Sequence
  Synthetic oligonucleotide
gctcgcggcgacgaccatctacgccactaacttcg

SEQ ID NO: 95761 - DNA, 35 bp, Artificial Sequence
  Synthetic oligonucleotide
gtcgagggtgccagttgtcattcgcttcctgttcg

SEQ ID NO: 95762 - DNA, 35 bp, Artificial Sequence
  Synthetic oligonucleotide
agactcgggcgactgcgaaaggaacaggggtgagg

SEQ ID NO: 95763 - DNA, 35 bp, Artificial Sequence
  Synthetic oligonucleotide
ctcgacaactggcccggttttgccacccacttctg

SEQ ID NO: 95764 - DNA, 35 bp, Artificial Sequence
  Synthetic oligonucleotide
gacgccaacgcggccactttgccattgggtaccat

SEQ ID NO: 95765 - DNA, 35 bp, Artificial Sequence
  Synthetic oligonucleotide
ttcaagccccttgcgtctaactctcctgtacgcat

SEQ ID NO: 95766 - DNA, 35 bp, Artificial Sequence
  Synthetic oligonucleotide
gcacaagccgttaaatatctgcagaatgggtatat

SEQ ID NO: 95767 - DNA, 35 bp, Artificial Sequence
  Synthetic oligonucleotide
gtgacactgcctgaacttgcccaccctgtttctat

SEQ ID NO: 95768 - DNA, 35 bp, Artificial Sequence
  Synthetic oligonucleotide
tgaaaagaccgtgggtggggggtacatgggatact

SEQ ID NO: 95769 - DNA, 35 bp, Artificial Sequence
  Synthetic oligonucleotide
ttacggacggaagggaatgtagtgggcagtcagct

SEQ ID NO: 95770 - DNA, 35 bp, Artificial Sequence
  Synthetic oligonucleotide
gtgcaagaggaagccccggaatcgaatggaactct

SEQ ID NO: 95771 - DNA, 35 bp, Artificial Sequence
  Synthetic oligonucleotide
agggatgaagcagggaaaaggggctaagagagcgt

SEQ ID NO: 95772 - DNA, 35 bp, Artificial Sequence
  Synthetic oligonucleotide
acacacagctcacatactcttgcaaacaggacttt

SEQ ID NO: 95773 - DNA, 35 bp, Artificial Sequence
  Synthetic oligonucleotide
tttgcgcgagcgtacgttacacccggttccatttt

SEQ ID NO: 95774 - DNA, 35 bp, Artificial Sequence
  Synthetic oligonucleotide
acacacgatggctcgtaccacttctatgtaccaaa

SEQ ID NO: 95775 - DNA, 36 bp, Artificial Sequence
  Synthetic oligonucleotide
atgaacaagcggacgaaaggagtggtgtcatgcgaa

SEQ ID NO: 95776 - DNA, 36 bp, Artificial Sequence
  Synthetic oligonucleotide
gcccggtacacaggggtatgacggtaggaaaaggaa

SEQ ID NO: 95777 - DNA, 36 bp, Artificial Sequence
  Synthetic oligonucleotide
gcacacacctgtccagtgttctctttgggccggtaa

SEQ ID NO: 95778 - DNA, 36 bp, Artificial Sequence
  Synthetic oligonucleotide
gacgaagcgcaggtcgcatccactgacctgcctaca

SEQ ID NO: 95779 - DNA, 36 bp, Artificial Sequence
  Synthetic oligonucleotide
acccgcgacagtcggtaatgtaggacttgggtggca

SEQ ID NO: 95780 - DNA, 36 bp, Artificial Sequence
  Synthetic oligonucleotide
tttgctacggccaacacgttttgtgagcgctgatca

SEQ ID NO: 95781 - DNA, 38 bp, Artificial Sequence
  Synthetic oligonucleotide
ttagccccctgccaccatctgtccatacctcgcactca

SEQ ID NO: 95782 - DNA, 35 bp, Artificial Sequence
  Synthetic oligonucleotide
gtacagtgcagacctgccgccgataattgttctca

SEQ ID NO: 95783 - DNA, 36 bp, Artificial Sequence
  Synthetic oligonucleotide
tctccccccaccccgttagtatgaaatacactgtca

SEQ ID NO: 95784 - DNA, 37 bp, Artificial Sequence
  Synthetic oligonucleotide
aggatgacgccatggtcatacgctctcatttccaaga

SEQ ID NO: 95785 - DNA, 37 bp, Artificial Sequence
  Synthetic oligonucleotide
ggtagtcggggggaagggtgcagctccaagagctaga

SEQ ID NO: 95786 - DNA, 37 bp, Artificial Sequence
  Synthetic oligonucleotide
gatgagtgtgtggagggtttgtaagaacgcgggtaga

SEQ ID NO: 95787 - DNA, 37 bp, Artificial Sequence
  Synthetic oligonucleotide
gttgcacaggcacccatatatagtcttccgataacga

SEQ ID NO: 95788 - DNA, 37 bp, Artificial Sequence
  Synthetic oligonucleotide
gacatcgggcggatacgggcgacgaaagaagccacga

SEQ ID NO: 95789 - DNA, 37 bp, Artificial Sequence
  Synthetic oligonucleotide
atgtccaggcggaacggtaagacaaaaaggagtacga

SEQ ID NO: 95790 - DNA, 37 bp, Artificial Sequence
  Synthetic oligonucleotide
tatggcgtagggttagaggatggggagaagcagccga

SEQ ID NO: 95791 - DNA, 37 bp, Artificial Sequence
  Synthetic oligonucleotide
tgggagagcaatcagggtatcagggcagggcgggcga

SEQ ID NO: 95792 - DNA, 35 bp, Artificial Sequence
  Synthetic oligonucleotide
ttatgcgcgctgggacccatttgctgtttcatcga

SEQ ID NO: 95793 - DNA, 36 bp, Artificial Sequence
  Synthetic oligonucleotide
ttcagcaggggtcaaatggaaggggtacggttagga

SEQ ID NO: 95794 - DNA, 36 bp, Artificial Sequence
  Synthetic oligonucleotide
tctgagccacactagagctgcggaaaggttaccgga

SEQ ID NO: 95795 - DNA, 37 bp, Artificial Sequence
  Synthetic oligonucleotide
gcgacctactccaacagttttgaacgatccctgcgga

SEQ ID NO: 95796 - DNA, 37 bp, Artificial Sequence
  Synthetic oligonucleotide
ggagagtgatgaacagtgttaagtggtgatggaggga

SEQ ID NO: 95797 - DNA, 37 bp, Artificial Sequence
  Synthetic oligonucleotide
taagcagggctgtaaaatgtgcttaatgtatttggga

SEQ ID NO: 95798 - DNA, 37 bp, Artificial Sequence
  Synthetic oligonucleotide
ttagtgagcaggaatcagcaaaggaacggttaatgga

SEQ ID NO: 95799 - DNA, 36 bp, Artificial Sequence
  Synthetic oligonucleotide
aacctggagcacgccgataacgacctatccgttgga

SEQ ID NO: 95800 - DNA, 38 bp, Artificial Sequence
  Synthetic oligonucleotide
tacggaatccgaggggaagggtggcatttggtaaatga

SEQ ID NO: 95801 - DNA, 38 bp, Artificial Sequence
  Synthetic oligonucleotide
aactgcactgtcgctccagtctgttctaccccacatga

SEQ ID NO: 95802 - DNA, 38 bp, Artificial Sequence
  Synthetic oligonucleotide
tgagccactagcacgttgttacactctgttttccatga

SEQ ID NO: 95803 - DNA, 37 bp, Artificial Sequence
  Synthetic oligonucleotide
aacacacggcaaatgctaaataaactggtaacgatga

SEQ ID NO: 95804 - DNA, 38 bp, Artificial Sequence
  Synthetic oligonucleotide
atacagggacgaggtggtactaagcagcttgtgtatga

SEQ ID NO: 95805 - DNA, 38 bp, Artificial Sequence
  Synthetic oligonucleotide
ttcgaccaacctcacccttctaagtaccctcatcctga

SEQ ID NO: 95806 - DNA, 38 bp, Artificial Sequence
  Synthetic oligonucleotide
gacacaggttgggtgaaatgaggggtgagcgctagtga

SEQ ID NO: 95807 - DNA, 38 bp, Artificial Sequence
  Synthetic oligonucleotide
gagggaggagcgggagggcgtcgctatagtttacgtga

SEQ ID NO: 95808 - DNA, 37 bp, Artificial Sequence
  Synthetic oligonucleotide
tgagcaagggtggagtgacgctcatccgggaaggtga

SEQ ID NO: 95809 - DNA, 38 bp, Artificial Sequence
  Synthetic oligonucleotide
gaagccacccgttcgttgcgctattcttgcataattga

SEQ ID NO: 95810 - DNA, 38 bp, Artificial Sequence
  Synthetic oligonucleotide
tgaccggacgcctggttagacagcgtgctttgcattga

SEQ ID NO: 95811 - DNA, 37 bp, Artificial Sequence
  Synthetic oligonucleotide
acagtacgcagaactgtcggtggccaactacacttga

SEQ ID NO: 95812 - DNA, 37 bp, Artificial Sequence
  Synthetic oligonucleotide
gtccggtaatgggtggaagaatagagggaagtcttga

SEQ ID NO: 95813 - DNA, 36 bp, Artificial Sequence
  Synthetic oligonucleotide
aatgccgccatgtctgtagctagccccactcgaata

SEQ ID NO: 95814 - DNA, 36 bp, Artificial Sequence
  Synthetic oligonucleotide
gatccactccgagtgtgtcccaggcagttgaaccta

SEQ ID NO: 95815 - DNA, 35 bp, Artificial Sequence
  Synthetic oligonucleotide
atgagcggacggagcccgattgcgcaacttaccta

SEQ ID NO: 95816 - DNA, 36 bp, Artificial Sequence
  Synthetic oligonucleotide
agtacgatggaggtggggatatggtgatcggtagta

SEQ ID NO: 95817 - DNA, 35 bp, Artificial Sequence
  Synthetic oligonucleotide
tccatgctgtcgctgttcatccgcctcgttacgta

SEQ ID NO: 95818 - DNA, 36 bp, Artificial Sequence
  Synthetic oligonucleotide
tctcgacaactcgctgcattgttcgtaattctggta

SEQ ID NO: 95819 - DNA, 36 bp, Artificial Sequence
  Synthetic oligonucleotide
acgaacgacaaatcggacacgctgacgctaacatta

SEQ ID NO: 95820 - DNA, 36 bp, Artificial Sequence
  Synthetic oligonucleotide
gacctgcgttaatctgcttgcgtgcgcctctactta

SEQ ID NO: 95821 - DNA, 36 bp, Artificial Sequence
  Synthetic oligonucleotide
gcatcgacgcaggccgtactcaacgaaaactcttta

SEQ ID NO: 95822 - DNA, 35 bp, Artificial Sequence
  Synthetic oligonucleotide
atccccgcgtgcgtgtaccattgcgccgcatgaac

SEQ ID NO: 95823 - DNA, 35 bp, Artificial Sequence
  Synthetic oligonucleotide
tagacacccgaccgcccttgaggctgcgtaaccac

SEQ ID NO: 95824 - DNA, 35 bp, Artificial Sequence
  Synthetic oligonucleotide
gtccaaccctggtgatatcgactcgtaaaacgtac

SEQ ID NO: 95825 - DNA, 35 bp, Artificial Sequence
  Synthetic oligonucleotide
tctgccacatcaaaatctgatagttggcccgaacc

SEQ ID NO: 95826 - DNA, 35 bp, Artificial Sequence
  Synthetic oligonucleotide
tgatcggtcgtaatcggcgccctccaagctttgcc

SEQ ID NO: 95827 - DNA, 35 bp, Artificial Sequence
  Synthetic oligonucleotide
ttgcatccgcattctcactgggatttcgaggtatc

SEQ ID NO: 95828 - DNA, 35 bp, Artificial Sequence
  Synthetic oligonucleotide
gccgcctcaatgcgtacgtccgataacaagtcctc

SEQ ID NO: 95829 - DNA, 35 bp, Artificial Sequence
  Synthetic oligonucleotide
accgcgggcccaaccgtggtagcatgtctcatgtc

SEQ ID NO: 95830 - DNA, 35 bp, Artificial Sequence
  Synthetic oligonucleotide
ttcgcgtgagccaaatatttaggagtttcggcttc

SEQ ID NO: 95831 - DNA, 35 bp, Artificial Sequence
  Synthetic oligonucleotide
tacaccccgttgtagggctttatgttaccccgttc

SEQ ID NO: 95832 - DNA, 35 bp, Artificial Sequence
  Synthetic oligonucleotide
gccaacacagtaagccccagtcccagtattttgcg

SEQ ID NO: 95833 - DNA, 35 bp, Artificial Sequence
  Synthetic oligonucleotide
gagtgcagaacggtaacttgtgctcgtattattcg

SEQ ID NO: 95834 - DNA, 35 bp, Artificial Sequence
  Synthetic oligonucleotide
tcgtcgtgcaccatccaatacagcgtttctcccgg

SEQ ID NO: 95835 - DNA, 35 bp, Artificial Sequence
  Synthetic oligonucleotide
gttgcgcaccatgcgttggacgaaaaaatggcaat

SEQ ID NO: 95836 - DNA, 35 bp, Artificial Sequence
  Synthetic oligonucleotide
gcaaggggaaatgccgaaagtgccacacggtcact

SEQ ID NO: 95837 - DNA, 35 bp, Artificial Sequence
  Synthetic oligonucleotide
tactcgctgaagaactggccatccgatcggtacct

SEQ ID NO: 95838 - DNA, 35 bp, Artificial Sequence
  Synthetic oligonucleotide
atgccctgccacctactttgatccagccacacgct

SEQ ID NO: 95839 - DNA, 35 bp, Artificial Sequence
  Synthetic oligonucleotide
tcgatgcacgctgtgtctcacctgaccattccgct

SEQ ID NO: 95840 - DNA, 35 bp, Artificial Sequence
  Synthetic oligonucleotide
gacacccgccgttttcctttatggtgatccctgct

SEQ ID NO: 95841 - DNA, 35 bp, Artificial Sequence
  Synthetic oligonucleotide
gttcaggaggggggtaaatggagaagtcacttgct

SEQ ID NO: 95842 - DNA, 35 bp, Artificial Sequence
  Synthetic oligonucleotide
tagccagagcaaaagtgctagtacaccgcacatct

SEQ ID NO: 95843 - DNA, 35 bp, Artificial Sequence
  Synthetic oligonucleotide
gcaccacgctaatggcgatcgtgggcccaatatct

SEQ ID NO: 95844 - DNA, 35 bp, Artificial Sequence
  Synthetic oligonucleotide
atagcactacaaccctgtggtaactttacctgtct

SEQ ID NO: 95845 - DNA, 35 bp, Artificial Sequence
  Synthetic oligonucleotide
atgaccagggggaggtatcatgcgatagtgggatt

SEQ ID NO: 95846 - DNA, 35 bp, Artificial Sequence
  Synthetic oligonucleotide
tcacacactatggtaaggtagaaattgtcgccctt

SEQ ID NO: 95847 - DNA, 35 bp, Artificial Sequence
  Synthetic oligonucleotide
tcagcctgcctccgaacactccacatctcgcagtt

SEQ ID NO: 95848 - DNA, 35 bp, Artificial Sequence
  Synthetic oligonucleotide
aagtgccgagcatctccttatcgatttgggccttt

SEQ ID NO: 95849 - DNA, 36 bp, Artificial Sequence
  Synthetic oligonucleotide
gaataagggggagatgttaggtcagtgtgacgtaaa

SEQ ID NO: 95850 - DNA, 36 bp, Artificial Sequence
  Synthetic oligonucleotide
aatgcaaataggtgggatagaagcaagtggcgtaaa

SEQ ID NO: 95851 - DNA, 35 bp, Artificial Sequence
  Synthetic oligonucleotide
accgcaaaccctctacttgctatgccccagaacaa

SEQ ID NO: 95852 - DNA, 36 bp, Artificial Sequence
  Synthetic oligonucleotide
gttccacaccatgccccctatcgtacaggagcccaa

SEQ ID NO: 95853 - DNA, 36 bp, Artificial Sequence
  Synthetic oligonucleotide
aggggctgggaggaggagaggatttcagacggggaa

SEQ ID NO: 95854 - DNA, 36 bp, Artificial Sequence
  Synthetic oligonucleotide
tgccccgagtgacatgctcgtgaacccacaatctaa

SEQ ID NO: 95855 - DNA, 35 bp, Artificial Sequence
  Synthetic oligonucleotide
gatgcaaaaggctagcgtactgaccccacctgtaa

SEQ ID NO: 95856 - DNA, 36 bp, Artificial Sequence
  Synthetic oligonucleotide
tctcgacaggagattacacgctgtgtatcgttcaca

SEQ ID NO: 95857 - DNA, 35 bp, Artificial Sequence
  Synthetic oligonucleotide
tccgatcagagtctagtccatgcacctccattaca

SEQ ID NO: 95858 - DNA, 36 bp, Artificial Sequence
  Synthetic oligonucleotide
ttgaccacaataactaggtataacaagctcacacca

SEQ ID NO: 95859 - DNA, 36 bp, Artificial Sequence
  Synthetic oligonucleotide
ggtgtgcgcgatcctctttcggagcctgcttgtcca

SEQ ID NO: 95860 - DNA, 35 bp, Artificial Sequence
  Synthetic oligonucleotide
ttgccaccatcagggagagctgccagtacttagca

SEQ ID NO: 95861 - DNA, 36 bp, Artificial Sequence
  Synthetic oligonucleotide
gtgatgcgacgggactaacgggctgcagtctgggca

SEQ ID NO: 95862 - DNA, 36 bp, Artificial Sequence
  Synthetic oligonucleotide
atcgagcaagactgtgagatggtgggggaggatgca

SEQ ID NO: 95863 - DNA, 36 bp, Artificial Sequence
  Synthetic oligonucleotide
agaccgtccatggcgtcctcttcaccttttctgtca

SEQ ID NO: 95864 - DNA, 36 bp, Artificial Sequence
  Synthetic oligonucleotide
gatgcgagggaatggaggagtatagtactgaataga

SEQ ID NO: 95865 - DNA, 37 bp, Artificial Sequence
  Synthetic oligonucleotide
gaagagtcgaacgagggagtgatgggttggacaacga

SEQ ID NO: 95866 - DNA, 37 bp, Artificial Sequence
  Synthetic oligonucleotide
tcctcctgccaggttcttgaccgcctatttggtacga

SEQ ID NO: 95867 - DNA, 37 bp, Artificial Sequence
  Synthetic oligonucleotide
tgacactctcaattaatcctatgcacaccgatatcga

SEQ ID NO: 95868 - DNA, 35 bp, Artificial Sequence
  Synthetic oligonucleotide
gttgaggagggacagtgacggcgcaaacagaagga

SEQ ID NO: 95869 - DNA, 37 bp, Artificial Sequence
  Synthetic oligonucleotide
tatgcaccggaaagggattaaaaataggggagtagga

SEQ ID NO: 95870 - DNA, 36 bp, Artificial Sequence
  Synthetic oligonucleotide
aatgcaacggcccgttggtctatcataatgcacgga

SEQ ID NO: 95871 - DNA, 36 bp, Artificial Sequence
  Synthetic oligonucleotide
attgcaggagggtaggtgtgggatcaaaagcgcgga

SEQ ID NO: 95872 - DNA, 37 bp, Artificial Sequence
  Synthetic oligonucleotide
tgaacggaggtgatagggagattcgagtaatggcgga

SEQ ID NO: 95873 - DNA, 37 bp, Artificial Sequence
  Synthetic oligonucleotide
ttgctgcggaggggctgcagtcaggcgagtggaggga

SEQ ID NO: 95874 - DNA, 36 bp, Artificial Sequence
  Synthetic oligonucleotide
ttgtcaccgaggtagggggggagtagccagtgggga

SEQ ID NO: 95875 - DNA, 37 bp, Artificial Sequence
  Synthetic oligonucleotide
gtgtagcacggacagcggggaagtaaggtcgctggga

SEQ ID NO: 95876 - DNA, 37 bp, Artificial Sequence
  Synthetic oligonucleotide
agtctgtgccgagggtcgttatcggaaacgtgttgga

SEQ ID NO: 95877 - DNA, 38 bp, Artificial Sequence
  Synthetic oligonucleotide
gagtacgcgcaaacctttcctccggagaccaacaatga

SEQ ID NO: 95878 - DNA, 38 bp, Artificial Sequence
  Synthetic oligonucleotide
tcgtggcctcctcatcatacacattcgcctggacatga

SEQ ID NO: 95879 - DNA, 37 bp, Artificial Sequence
  Synthetic oligonucleotide
gaccccgccctcgattctacagcgagcctacccatga

SEQ ID NO: 95880 - DNA, 38 bp, Artificial Sequence
  Synthetic oligonucleotide
acgtgccccatctctgctcttgtaaagggtatccatga

SEQ ID NO: 95881 - DNA, 38 bp, Artificial Sequence
  Synthetic oligonucleotide
gcagacgatcggagccctgagtgaacgtgttatcctga

SEQ ID NO: 95882 - DNA, 37 bp, Artificial Sequence
  Synthetic oligonucleotide
gtgaacctcccccgctgtatgatcagattttggctga

SEQ ID NO: 95883 - DNA, 37 bp, Artificial Sequence
  Synthetic oligonucleotide
gacgaaccataggtgaggtgaaatttgccatttctga

SEQ ID NO: 95884 - DNA, 38 bp, Artificial Sequence
  Synthetic oligonucleotide
ttgaccacatcagctcagaatgagcggcaatctagtga

SEQ ID NO: 95885 - DNA, 35 bp, Artificial Sequence
  Synthetic oligonucleotide
gacgaacgccttgaaaggggtaaggagaaacgtga

SEQ ID NO: 95886 - DNA, 36 bp, Artificial Sequence
  Synthetic oligonucleotide
acaacacgtcacgagtaccccccgattagtttgtga

SEQ ID NO: 95887 - DNA, 38 bp, Artificial Sequence
  Synthetic oligonucleotide
acaggacgcacgggaaatggggaataggttacgattga

SEQ ID NO: 95888 - DNA, 38 bp, Artificial Sequence
  Synthetic oligonucleotide
aactagccagctcaactcggcacataaggccctcttga

SEQ ID NO: 95889 - DNA, 37 bp, Artificial Sequence
  Synthetic oligonucleotide
gactcgccaaatgatattgatggctcctctttcttga

SEQ ID NO: 95890 - DNA, 37 bp, Artificial Sequence
  Synthetic oligonucleotide
tccatcgcagaaggtagctttcccgccgccactttga

SEQ ID NO: 95891 - DNA, 37 bp, Artificial Sequence
  Synthetic oligonucleotide
gagcacgtgtaggcctggtaatgggcgggtactttga

SEQ ID NO: 95892 - DNA, 38 bp, Artificial Sequence
  Synthetic oligonucleotide
gtcgacgactaaccgccggaacgactagttcattttga

SEQ ID NO: 95893 - DNA, 38 bp, Artificial Sequence
  Synthetic oligonucleotide
gatgcccgatcactgctgcaccgtcagtcattttttga

SEQ ID NO: 95894 - DNA, 35 bp, Artificial Sequence
  Synthetic oligonucleotide
tgcctaaccacagagtttccccgatgaacctcata

SEQ ID NO: 95895 - DNA, 36 bp, Artificial Sequence
  Synthetic oligonucleotide
tctatcaggaccgggccaaacgttgcacactagcta

SEQ ID NO: 95896 - DNA, 36 bp, Artificial Sequence
  Synthetic oligonucleotide
ttcgccacaaccaagctgttcttgccacggactgta

SEQ ID NO: 95897 - DNA, 35 bp, Artificial Sequence
  Synthetic oligonucleotide
aaccgccccgctatcaattgcgtctagcaacctta

SEQ ID NO: 95898 - DNA, 36 bp, Artificial Sequence
  Synthetic oligonucleotide
tcacgtgctaagggaaaaatactaggactgatgtta

SEQ ID NO: 95899 - DNA, 35 bp, Artificial Sequence
  Synthetic oligonucleotide
tgcaccgagatggatttcccaccgacctaacttta

SEQ ID NO: 95900 - DNA, 36 bp, Artificial Sequence
  Synthetic oligonucleotide
accgccatcattcaacattttaacacgaaacgttta

SEQ ID NO: 95901 - DNA, 35 bp, Artificial Sequence
  Synthetic oligonucleotide
accccgccaacattcgtagtagcactccttcgaac

SEQ ID NO: 95902 - DNA, 35 bp, Artificial Sequence
  Synthetic oligonucleotide
gacatagtccgcataatatctgtcttcctcggaac

SEQ ID NO: 95903 - DNA, 35 bp, Artificial Sequence
  Synthetic oligonucleotide
acccaactcactcacttatgctggaccgtaactac

SEQ ID NO: 95904 - DNA, 35 bp, Artificial Sequence
  Synthetic oligonucleotide
agtgtcacgcgtcaactcgatccgttccacttacc

SEQ ID NO: 95905 - DNA, 35 bp, Artificial Sequence
  Synthetic oligonucleotide
gatgcaggggtccgcatgattcacctatacccccc

SEQ ID NO: 95906 - DNA, 35 bp, Artificial Sequence
  Synthetic oligonucleotide
gcatacaccgcaaattgtttgccctttctttggcc

SEQ ID NO: 95907 - DNA, 35 bp, Artificial Sequence
  Synthetic oligonucleotide
tcaatccgcctgtacatgcctcacacactgaatcc

SEQ ID NO: 95908 - DNA, 35 bp, Artificial Sequence
  Synthetic oligonucleotide
ggggatcgcacctgccctttgaccgctcgcttggc

SEQ ID NO: 95909 - DNA, 35 bp, Artificial Sequence
  Synthetic oligonucleotide
acccggtcaaggcaacagagggtgatctctttggc

SEQ ID NO: 95910 - DNA, 35 bp, Artificial Sequence
  Synthetic oligonucleotide
gtgcactgcacgcatgccgtagacccgttcccatc

SEQ ID NO: 95911 - DNA, 35 bp, Artificial Sequence
  Synthetic oligonucleotide
tctcatccccggagtcttgcgatccacatcgggtc

SEQ ID NO: 95912 - DNA, 35 bp, Artificial Sequence
  Synthetic oligonucleotide
atgcactgccatgtactctacgctaaaactacttc

SEQ ID NO: 95913 - DNA, 36 bp, Artificial Sequence
  Synthetic oligonucleotide
acgcaaacagtaaacgagggtactgagaaaagcaag

SEQ ID NO: 95914 - DNA, 35 bp, Artificial Sequence
  Synthetic oligonucleotide
gctggggtggcggagaggggaagtactttgtgcag

SEQ ID NO: 95915 - DNA, 35 bp, Artificial Sequence
  Synthetic oligonucleotide
atcgaccaaaaaacagcaggtggtaaggtagagag

SEQ ID NO: 95916 - DNA, 35 bp, Artificial Sequence
  Synthetic oligonucleotide
gccaccctccacgtttatgctgagtagacctatcg

SEQ ID NO: 95917 - DNA, 36 bp, Artificial Sequence
  Synthetic oligonucleotide
tagacaggtccgagagaggctacgcgtaggggaggg

SEQ ID NO: 95918 - DNA, 35 bp, Artificial Sequence
  Synthetic oligonucleotide
gataagggcattagcggtgatggatgcaggtgggg

SEQ ID NO: 95919 - DNA, 35 bp, Artificial Sequence
  Synthetic oligonucleotide
tctgcgggagcaatcaaagtcagaacgtactgtgg

SEQ ID NO: 95920 - DNA, 35 bp, Artificial Sequence
  Synthetic oligonucleotide
tttggacccacaggtggtgttacgcagatccttgg

SEQ ID NO: 95921 - DNA, 35 bp, Artificial Sequence
  Synthetic oligonucleotide
aaaatagcagaggccgcggagagtagggacggatg

SEQ ID NO: 95922 - DNA, 35 bp, Artificial Sequence
  Synthetic oligonucleotide
tgcactcgtttgctcccgatccgactgttgtactg

SEQ ID NO: 95923 - DNA, 35 bp, Artificial Sequence
  Synthetic oligonucleotide
gccctcaccccactttgaactacagtacccgcctg

SEQ ID NO: 95924 - DNA, 36 bp, Artificial Sequence
  Synthetic oligonucleotide
gccctaggccgccacaaaaatcgcacatgctagctg

SEQ ID NO: 95925 - DNA, 35 bp, Artificial Sequence
  Synthetic oligonucleotide
tttgcccactgggtagcgtgacttactttattgtg

SEQ ID NO: 95926 - DNA, 35 bp, Artificial Sequence
  Synthetic oligonucleotide
tagccccatccatatcattgcgaaaagcgagagat

SEQ ID NO: 95927 - DNA, 35 bp, Artificial Sequence
  Synthetic oligonucleotide
gcactgcaatccctgttaatcttgtggtcacacct

SEQ ID NO: 95928 - DNA, 35 bp, Artificial Sequence
  Synthetic oligonucleotide
agcgctcactgctactccaacaggatcaatggcct

SEQ ID NO: 95929 - DNA, 35 bp, Artificial Sequence
  Synthetic oligonucleotide
tcacgccacccacctcgagcaccaccggtcgtgct

SEQ ID NO: 95930 - DNA, 35 bp, Artificial Sequence
  Synthetic oligonucleotide
ttgtacgtagcgaaaagcagccccaatcttttgct

SEQ ID NO: 95931 - DNA, 35 bp, Artificial Sequence
  Synthetic oligonucleotide
tcacatcctccttaccgtgtgtcgttactccctgt

SEQ ID NO: 95932 - DNA, 35 bp, Artificial Sequence
  Synthetic oligonucleotide
acctggctgccttactcgcaatacaaagttcactt

SEQ ID NO: 95933 - DNA, 35 bp, Artificial Sequence
  Synthetic oligonucleotide
acacgcacacccggtaggttacaggagttcttttt

SEQ ID NO: 95934 - DNA, 36 bp, Artificial Sequence
  Synthetic oligonucleotide
tcagggacgggccgggacaatatgagagggcacaaa

SEQ ID NO: 95935 - DNA, 36 bp, Artificial Sequence
  Synthetic oligonucleotide
gtgcctgcctcggctctctgttgccaggactggaaa

SEQ ID NO: 95936 - DNA, 35 bp, Artificial Sequence
  Synthetic oligonucleotide
gcactgctcagtatttcgactccgccatcttgaaa

SEQ ID NO: 95937 - DNA, 36 bp, Artificial Sequence
  Synthetic oligonucleotide
aggggacgagggaacacatgtggagggggaaaacaa

SEQ ID NO: 95938 - DNA, 36 bp, Artificial Sequence
  Synthetic oligonucleotide
tcacaggcgcgagtcgcttttcctacagtgccacaa

SEQ ID NO: 95939 - DNA, 36 bp, Artificial Sequence
  Synthetic oligonucleotide
tgccacacgactctgagaatccgttcaccgtgacaa

SEQ ID NO: 95940 - DNA, 36 bp, Artificial Sequence
  Synthetic oligonucleotide
tagccgctcatcctattttgcccgtttgtgttgcaa

SEQ ID NO: 95941 - DNA, 36 bp, Artificial Sequence
  Synthetic oligonucleotide
gcacgaggtgacatggtctgaaagaaatggggagaa

SEQ ID NO: 95942 - DNA, 36 bp, Artificial Sequence
  Synthetic oligonucleotide
ttccatcatcggagcacgccacacactcctcacgaa

SEQ ID NO: 95943 - DNA, 35 bp, Artificial Sequence
  Synthetic oligonucleotide
gtgacggtacgaaagactatcgttgactgctataa

SEQ ID NO: 95944 - DNA, 36 bp, Artificial Sequence
  Synthetic oligonucleotide
gaagatggacaggacgtgtttggaagggtggagtaa

SEQ ID NO: 95945 - DNA, 36 bp, Artificial Sequence
  Synthetic oligonucleotide
accaaatgcgcacttgcggccgaacagctcttcaca

SEQ ID NO: 95946 - DNA, 35 bp, Artificial Sequence
  Synthetic oligonucleotide
aatccccgcattgcattggtatttgctctcataca

SEQ ID NO: 95947 - DNA, 35 bp, Artificial Sequence
  Synthetic oligonucleotide
gtgggcctcaacactgacttagcaatacgggtaca

SEQ ID NO: 95948 - DNA, 36 bp, Artificial Sequence
  Synthetic oligonucleotide
gagccggacaggagtatgcgactgactcaacctcca

SEQ ID NO: 95949 - DNA, 35 bp, Artificial Sequence
  Synthetic oligonucleotide
ggacacacgtggtcactgcatcttttaacacggca

SEQ ID NO: 95950 - DNA, 36 bp, Artificial Sequence
  Synthetic oligonucleotide
gactgggcaagaaaatgggatgagcaaggtagggca

SEQ ID NO: 95951 - DNA, 35 bp, Artificial Sequence
  Synthetic oligonucleotide
gatgcgaggcgagagagcatcgagggcagaaatca

SEQ ID NO: 95952 - DNA, 36 bp, Artificial Sequence
  Synthetic oligonucleotide
tagcactcctcgccctcaagaaaccctcagggttca

SEQ ID NO: 95953 - DNA, 37 bp, Artificial Sequence
  Synthetic oligonucleotide
aaagcggtgagagcggcggggaggcgggcacttaaga

SEQ ID NO: 95954 - DNA, 37 bp, Artificial Sequence
  Synthetic oligonucleotide
tagacggacgtgaagtatgcttcggggaagggccaga

SEQ ID NO: 95955 - DNA, 37 bp, Artificial Sequence
  Synthetic oligonucleotide
gaaggaacagggcgtaatagggcattaattgggcaga

SEQ ID NO: 95956 - DNA, 37 bp, Artificial Sequence
  Synthetic oligonucleotide
tgtgagcatacataaaagcaaggtgaaggtagggaga

SEQ ID NO: 95957 - DNA, 37 bp, Artificial Sequence
  Synthetic oligonucleotide
gacgcatgttcgagtggggtggtgtatgggcaataga

SEQ ID NO: 95958 - DNA, 35 bp, Artificial Sequence
  Synthetic oligonucleotide
gaacccaccgcgctaaggtggtaacaacacttaga

SEQ ID NO: 95959 - DNA, 37 bp, Artificial Sequence
  Synthetic oligonucleotide
ggaccggacgaggatcactccaaaaaacgaaagacga

SEQ ID NO: 95960 - DNA, 37 bp, Artificial Sequence
  Synthetic oligonucleotide
tccaagcactccgtggcccaggacccccccttatcga

SEQ ID NO: 95961 - DNA, 37 bp, Artificial Sequence
  Synthetic oligonucleotide
ggagacggacaccgttacaaatgcctgatcttatcga

SEQ ID NO: 95962 - DNA, 37 bp, Artificial Sequence
  Synthetic oligonucleotide
acatcacccgcacagacacgaaccgagtattcccgga

SEQ ID NO: 95963 - DNA, 35 bp, Artificial Sequence
  Synthetic oligonucleotide
ggggacggcggaagagagggggggtgatccaggga

SEQ ID NO: 95964 - DNA, 37 bp, Artificial Sequence
  Synthetic oligonucleotide
gtgacacgcagtaagctaaaacagtatgtactaggga

SEQ ID NO: 95965 - DNA, 37 bp, Artificial Sequence
  Synthetic oligonucleotide
tgacaccggcgaactgagtaggctaattgggagggga

SEQ ID NO: 95966 - DNA, 37 bp, Artificial Sequence
  Synthetic oligonucleotide
aaaaagagcagagttcgagaggcagatacgggtggga

SEQ ID NO: 95967 - DNA, 35 bp, Artificial Sequence
  Synthetic oligonucleotide
gacgccatggtccacctccgccatatgaattggga

SEQ ID NO: 95968 - DNA, 37 bp, Artificial Sequence
  Synthetic oligonucleotide
tgagtcgcctatgtgcttaaattttcgctgcaatgga

SEQ ID NO: 95969 - DNA, 37 bp, Artificial Sequence
  Synthetic oligonucleotide
gaatgccgggtcgggcgggtcggtcgagagtactgga

SEQ ID NO: 95970 - DNA, 37 bp, Artificial Sequence
  Synthetic oligonucleotide
ttgccaagtaaggcttacaagggaagggaaggctgga

SEQ ID NO: 95971 - DNA, 37 bp, Artificial Sequence
  Synthetic oligonucleotide
ttacgcgcacacatagtctaaggtcgcttctggtgga

SEQ ID NO: 95972 - DNA, 38 bp, Artificial Sequence
  Synthetic oligonucleotide
ttgacactggccacaatcatcgtgttatactgccatga

SEQ ID NO: 95973 - DNA, 35 bp, Artificial Sequence
  Synthetic oligonucleotide
tccgagagcaccttccatccattacgacgtcatga

SEQ ID NO: 95974 - DNA, 38 bp, Artificial Sequence
  Synthetic oligonucleotide
aagcccgtaggaggaacgtatgacgtagggctttatga

SEQ ID NO: 95975 - DNA, 37 bp, Artificial Sequence
  Synthetic oligonucleotide
gtgagccacacgtaatcatctcagtcttttaacctga

SEQ ID NO: 95976 - DNA, 37 bp, Artificial Sequence
  Synthetic oligonucleotide
gacagaggtcgcagtttgttgttggacatttctctga

SEQ ID NO: 95977 - DNA, 38 bp, Artificial Sequence
  Synthetic oligonucleotide
gatgccgatccgcttctgttaaccctgtattttcgtga

SEQ ID NO: 95978 - DNA, 38 bp, Artificial Sequence
  Synthetic oligonucleotide
tggacgaatgcagagtgtgacatatggaagagaggtga

SEQ ID NO: 95979 - DNA, 38 bp, Artificial Sequence
  Synthetic oligonucleotide
gagtcaggggggaaaggtttacggctacaagacggtga

SEQ ID NO: 95980 - DNA, 37 bp, Artificial Sequence
  Synthetic oligonucleotide
tagtcatagccaagcaccgttttgtcgtcacacttga

SEQ ID NO: 95981 - DNA, 36 bp, Artificial Sequence
  Synthetic oligonucleotide
gaatgcataccccgccctgagagatcggtcacttga

SEQ ID NO: 95982 - DNA, 38 bp, Artificial Sequence
  Synthetic oligonucleotide
agagcacagggtgcctaacgcgcttcctacacgcttga

SEQ ID NO: 95983 - DNA, 37 bp, Artificial Sequence
  Synthetic oligonucleotide
tcactcgccactaccgtacatacgaccttttgcttga

SEQ ID NO: 95984 - DNA, 37 bp, Artificial Sequence
  Synthetic oligonucleotide
tgccactcattgcgccttttcatcaagtaattcttga

SEQ ID NO: 95985 - DNA, 38 bp, Artificial Sequence
  Synthetic oligonucleotide
atgaccggccttaagtctaccaattcgaccaatgttga

SEQ ID NO: 95986 - DNA, 38 bp, Artificial Sequence
  Synthetic oligonucleotide
tcacgccatcagtgggcgggggaatctaccaatgttga

SEQ ID NO: 95987 - DNA, 38 bp, Artificial Sequence
  Synthetic oligonucleotide
gacggtggggagaaggtgatatttgcgtcgcgtgttga

SEQ ID NO: 95988 - DNA, 38 bp, Artificial Sequence
  Synthetic oligonucleotide
tccgacacgccgcggagtctttccggaataaactttga

SEQ ID NO: 95989 - DNA, 36 bp, Artificial Sequence
  Synthetic oligonucleotide
acaccagaggaacaagggttaggtgcagttagacta

SEQ ID NO: 95990 - DNA, 36 bp, Artificial Sequence
  Synthetic oligonucleotide
ggaaacaccccgcaccgtccaagccgcgagtcgcta

SEQ ID NO: 95991 - DNA, 35 bp, Artificial Sequence
  Synthetic oligonucleotide
gcacgagacgtggggttgatgaatttcattaggta

SEQ ID NO: 95992 - DNA, 35 bp, Artificial Sequence
  Synthetic oligonucleotide
gaatcgtcgagtgtgctgattgcgcgccctcttta

SEQ ID NO: 95993 - DNA, 36 bp, Artificial Sequence
  Synthetic oligonucleotide
gatgctgctcgtgggttggcacgaagggaaggttta

SEQ ID NO: 95994 - DNA, 35 bp, Artificial Sequence
  Synthetic oligonucleotide
aacacgaacggtagaagtaccgctaaaggaccaac

SEQ ID NO: 95995 - DNA, 35 bp, Artificial Sequence
  Synthetic oligonucleotide
gacgccatcatcctgcaaggtccgagggacaccac

SEQ ID NO: 95996 - DNA, 35 bp, Artificial Sequence
  Synthetic oligonucleotide
gtacctgtctagtgtacgcgcttcattcccttgac

SEQ ID NO: 95997 - DNA, 35 bp, Artificial Sequence
  Synthetic oligonucleotide
taacgggggtggaagctaaaattggcggtgaatac

SEQ ID NO: 95998 - DNA, 34 bp, Artificial Sequence
  Synthetic oligonucleotide
gcaacgtgggtgccagttgttaactcatttgtac

SEQ ID NO: 95999 - DNA, 35 bp, Artificial Sequence
  Synthetic oligonucleotide
gagacgcagggggaaagttgtacggaagctatacc

SEQ ID NO: 96000 - DNA, 35 bp, Artificial Sequence
  Synthetic oligonucleotide
tgagctcagaccgttttccttgcactatcctcccc

SEQ ID NO: 96001 - DNA, 35 bp, Artificial Sequence
  Synthetic oligonucleotide
gactgctcccttgattacgctggctatacactgcc

SEQ ID NO: 96002 - DNA, 35 bp, Artificial Sequence
  Synthetic oligonucleotide
acatacgtagggaagcatagcgatgacgataaagc

SEQ ID NO: 96003 - DNA, 35 bp, Artificial Sequence
  Synthetic oligonucleotide
tcctccgaccgccgcacattaggtctctatcgatc

SEQ ID NO: 96004 - DNA, 35 bp, Artificial Sequence
  Synthetic oligonucleotide
tgtccctgccaccggatcgctaaacttgctgcctc

SEQ ID NO: 96005 - DNA, 35 bp, Artificial Sequence
  Synthetic oligonucleotide
gattacagcggggatcccgcgtcttgacaattctc

SEQ ID NO: 96006 - DNA, 35 bp, Artificial Sequence
  Synthetic oligonucleotide
gtgacaccttcaacagtcgcgattggactgttctc

SEQ ID NO: 96007 - DNA, 35 bp, Artificial Sequence
  Synthetic oligonucleotide
actgccgttcgacgtctaacccacacctacgcttc

SEQ ID NO: 96008 - DNA, 35 bp, Artificial Sequence
  Synthetic oligonucleotide
atgattgcactgcctcccatgctcaagcccaccag

SEQ ID NO: 96009 - DNA, 35 bp, Artificial Sequence
  Synthetic oligonucleotide
aaccaagggaaagaaccatgttaaagaaaagagag

SEQ ID NO: 96010 - DNA, 35 bp, Artificial Sequence
  Synthetic oligonucleotide
gcgcggagagggcaggaaaaagggggacaggagag

SEQ ID NO: 96011 - DNA, 35 bp, Artificial Sequence
  Synthetic oligonucleotide
atcgcggacccagtctttgaacccagagaggtgag

SEQ ID NO: 96012 - DNA, 35 bp, Artificial Sequence
  Synthetic oligonucleotide
tacggtacggacgcgggtacgaaggtgggtggtag

SEQ ID NO: 96013 - DNA, 35 bp, Artificial Sequence
  Synthetic oligonucleotide
ataccacggacaagattttcgggatagggacaacg

SEQ ID NO: 96014 - DNA, 35 bp, Artificial Sequence
  Synthetic oligonucleotide
gaggatgaccaaagcggaatgggaagaactgcgcg

SEQ ID NO: 96015 - DNA, 35 bp, Artificial Sequence
  Synthetic oligonucleotide
tcccactaccaggcgtggacactgttccaatcgcg

SEQ ID NO: 96016 - DNA, 35 bp, Artificial Sequence
  Synthetic oligonucleotide
gacgcaccactcgctcatggtaacatggcatatcg

SEQ ID NO: 96017 - DNA, 35 bp, Artificial Sequence
  Synthetic oligonucleotide
ttacgccgactcctattgactgaccgaagacctcg

SEQ ID NO: 96018 - DNA, 35 bp, Artificial Sequence
  Synthetic oligonucleotide
tccgaccgcagtgttcggcctcctggagcctgtcg

SEQ ID NO: 96019 - DNA, 35 bp, Artificial Sequence
  Synthetic oligonucleotide
gaaggggtcgggagaagggaaaaagatgagaacgg

SEQ ID NO: 96020 - DNA, 35 bp, Artificial Sequence
  Synthetic oligonucleotide
aagctccaccgaacttctcagccgttttaccacgg

SEQ ID NO: 96021 - DNA, 35 bp, Artificial Sequence
  Synthetic oligonucleotide
atgacgttcggtcggtaaacacaaagggtgagggg

SEQ ID NO: 96022 - DNA, 35 bp, Artificial Sequence
  Synthetic oligonucleotide
tcaataacgcagccacgggtcaagtgggtgggggg

SEQ ID NO: 96023 - DNA, 35 bp, Artificial Sequence
  Synthetic oligonucleotide
ttcgcccacacgaattttttttctgccaatttttg

SEQ ID NO: 96024 - DNA, 35 bp, Artificial Sequence
  Synthetic oligonucleotide
acgactccccgtgttttgcacctttatgactaaat

SEQ ID NO: 96025 - DNA, 35 bp, Artificial Sequence
  Synthetic oligonucleotide
aacactctggtatggccatttcatgagcaccgaat

SEQ ID NO: 96026 - DNA, 35 bp, Artificial Sequence
  Synthetic oligonucleotide
gcaggagaagcaatgaggttaaggtggggttcgat

SEQ ID NO: 96027 - DNA, 35 bp, Artificial Sequence
  Synthetic oligonucleotide
tccaggccaagcctggtcgtgaatgatctctcact

SEQ ID NO: 96028 - DNA, 35 bp, Artificial Sequence
  Synthetic oligonucleotide
gcacacgccgacatccttttgcttctccgttgact

SEQ ID NO: 96029 - DNA, 35 bp, Artificial Sequence
  Synthetic oligonucleotide
actccaccctcgaaaaccagcaacctgacggttct

SEQ ID NO: 96030 - DNA, 35 bp, Artificial Sequence
  Synthetic oligonucleotide
tcatcggtccggtcttaagctgtcctcaacatagt

SEQ ID NO: 96031 - DNA, 35 bp, Artificial Sequence
  Synthetic oligonucleotide
tcctcccccatagcccattacgccggaccttacgt

SEQ ID NO: 96032 - DNA, 35 bp, Artificial Sequence
  Synthetic oligonucleotide
gtccacgtacgctggcgagaatctgggacgaaggt

SEQ ID NO: 96033 - DNA, 35 bp, Artificial Sequence
  Synthetic oligonucleotide
gacaggactcagggaatctgacaacatcacttggt

SEQ ID NO: 96034 - DNA, 35 bp, Artificial Sequence
  Synthetic oligonucleotide
tgctaccgtcctctttgctgggccattccatgatt

SEQ ID NO: 96035 - DNA, 35 bp, Artificial Sequence
  Synthetic oligonucleotide
tgatgtgtaaaactacccagctcatcttgattctt

SEQ ID NO: 96036 - DNA, 35 bp, Artificial Sequence
  Synthetic oligonucleotide
gcgtggcaccatgtgattcctttcccctgcgtgtt

SEQ ID NO: 96037 - DNA, 35 bp, Artificial Sequence
  Synthetic oligonucleotide
atcgagggcaaatggttcacatccacgctcacttt

SEQ ID NO: 96038 - DNA, 35 bp, Artificial Sequence
  Synthetic oligonucleotide
gccgcttgccgtgcctacatgatcattccctcttt

SEQ ID NO: 96039 - DNA, 36 bp, Artificial Sequence
  Synthetic oligonucleotide
gagacaacaatacggattagaacggtggtgaaaaaa

SEQ ID NO: 96040 - DNA, 35 bp, Artificial Sequence
  Synthetic oligonucleotide
tgcacgcgcggtagcgcaatcccccagacaccaaa

SEQ ID NO: 96041 - DNA, 36 bp, Artificial Sequence
  Synthetic oligonucleotide
tcgacaaccgtcgagcgaaatccgtccatcaccaaa

SEQ ID NO: 96042 - DNA, 35 bp, Artificial Sequence
  Synthetic oligonucleotide
gaacccagttgcttgtctgtccgacgagtctcaaa

SEQ ID NO: 96043 - DNA, 35 bp, Artificial Sequence
  Synthetic oligonucleotide
gacgactctgagcaccataggccctttcgtgacaa

SEQ ID NO: 96044 - DNA, 36 bp, Artificial Sequence
  Synthetic oligonucleotide
ttgagcgactccgtccatgcctactaacgtcaccaa

SEQ ID NO: 96045 - DNA, 36 bp, Artificial Sequence
  Synthetic oligonucleotide
gcgagaggggagaaggcgatagagatatcgaagcaa

SEQ ID NO: 96046 - DNA, 35 bp, Artificial Sequence
  Synthetic oligonucleotide
tcgaacgtcatacacattcagcactttcttagcaa

SEQ ID NO: 96047 - DNA, 36 bp, Artificial Sequence
  Synthetic oligonucleotide
gtcgaagtgtgggtgaggataatgcctgatccggaa

SEQ ID NO: 96048 - DNA, 36 bp, Artificial Sequence
  Synthetic oligonucleotide
ttgaccgcaagcaaaaacgctgatcagttccgggaa

SEQ ID NO: 96049 - DNA, 31 bp, Artificial Sequence
  Synthetic oligonucleotide
aaagagtggctggggtggggaggaaggggaa

SEQ ID NO: 96050 - DNA, 35 bp, Artificial Sequence
  Synthetic oligonucleotide
acactcaccgaccgaattttaaccccctgccttaa

SEQ ID NO: 96051 - DNA, 36 bp, Artificial Sequence
  Synthetic oligonucleotide
tatcgccgtgccacatcagagccgcgttatgccaca

SEQ ID NO: 96052 - DNA, 36 bp, Artificial Sequence
  Synthetic oligonucleotide
atcacgtcgaagagacgtctcgatgaggtttataca

SEQ ID NO: 96053 - DNA, 36 bp, Artificial Sequence
  Synthetic oligonucleotide
tgcgatgcacagcgcctttttcattttcagggtaca

SEQ ID NO: 96054 - DNA, 36 bp, Artificial Sequence
  Synthetic oligonucleotide
atacccgacagatcgtacctagttgctttgattaca

SEQ ID NO: 96055 - DNA, 36 bp, Artificial Sequence
  Synthetic oligonucleotide
gattgcgcggtaacttgcgaggcaccacggccccca

SEQ ID NO: 96056 - DNA, 35 bp, Artificial Sequence
  Synthetic oligonucleotide
accgacggaccggtctgtcgccacttttttgccca

SEQ ID NO: 96057 - DNA, 36 bp, Artificial Sequence
  Synthetic oligonucleotide
tgtgacggctcctcgtcccctttcactgtgatccca

SEQ ID NO: 96058 - DNA, 36 bp, Artificial Sequence
  Synthetic oligonucleotide
gtgggggtacacagaaaatgagatagcttgggtcca

SEQ ID NO: 96059 - DNA, 36 bp, Artificial Sequence
  Synthetic oligonucleotide
tagtacgcgacgatgttcgtcaattccacatgtcca

SEQ ID NO: 96060 - DNA, 35 bp, Artificial Sequence
  Synthetic oligonucleotide
tcactagcacaaacttttattcacagcactacgca

SEQ ID NO: 96061 - DNA, 36 bp, Artificial Sequence
  Synthetic oligonucleotide
tacgcgcggacaagaattggagagctggttggggca

SEQ ID NO: 96062 - DNA, 36 bp, Artificial Sequence
  Synthetic oligonucleotide
tgatccacagggggtacctccctcgactgtgactca

SEQ ID NO: 96063 - DNA, 37 bp, Artificial Sequence
  Synthetic oligonucleotide
acaagaggtcagcaggaataggcttagggttggaaga

SEQ ID NO: 96064 - DNA, 37 bp, Artificial Sequence
  Synthetic oligonucleotide
gagccgtgagacacacaatatcggcctcctttcgaga

SEQ ID NO: 96065 - DNA, 37 bp, Artificial Sequence
  Synthetic oligonucleotide
tgtagacatggcggacatggaggagggggggaataga

SEQ ID NO: 96066 - DNA, 35 bp, Artificial Sequence
  Synthetic oligonucleotide
gccaccgcccgttatcgtacaatcttacacgtaga

SEQ ID NO: 96067 - DNA, 36 bp, Artificial Sequence
  Synthetic oligonucleotide
gactgcccgacttctgtagggaccctcatcaaacga

SEQ ID NO: 96068 - DNA, 37 bp, Artificial Sequence
  Synthetic oligonucleotide
gacgaaacgccgactgcaaacaactctagttaaacga

SEQ ID NO: 96069 - DNA, 37 bp, Artificial Sequence
  Synthetic oligonucleotide
ggaccacacgtattctgtagggactgctgtagaacga

SEQ ID NO: 96070 - DNA, 37 bp, Artificial Sequence
  Synthetic oligonucleotide
ttgggatcgacgaaaaaggtgacatagggagtgacga

SEQ ID NO: 96071 - DNA, 37 bp, Artificial Sequence
  Synthetic oligonucleotide
gcccatacaacacatcagcagagatagtcgaccccga

SEQ ID NO: 96072 - DNA, 35 bp, Artificial Sequence
  Synthetic oligonucleotide
gattgtcgagagggcatgggatggacaagtgccga

SEQ ID NO: 96073 - DNA, 37 bp, Artificial Sequence
  Synthetic oligonucleotide
tcatcaccggcatggattctccgcattttggttgcga

SEQ ID NO: 96074 - DNA, 37 bp, Artificial Sequence
  Synthetic oligonucleotide
gaaacgggcctccgaacgttacgtacagtctcttcga

SEQ ID NO: 96075 - DNA, 37 bp, Artificial Sequence
  Synthetic oligonucleotide
aacggggactggtaagcgatgggagggactgaaggga

SEQ ID NO: 96076 - DNA, 36 bp, Artificial Sequence
  Synthetic oligonucleotide
taacgccgcggaacttaaagcgggacggaaacggga

SEQ ID NO: 96077 - DNA, 37 bp, Artificial Sequence
  Synthetic oligonucleotide
gagtgggacacagaggatatggactgaagcgggggga

SEQ ID NO: 96078 - DNA, 37 bp, Artificial Sequence
  Synthetic oligonucleotide
tgtgctcgccacgcacacgagcactctctatttggga

SEQ ID NO: 96079 - DNA, 37 bp, Artificial Sequence
  Synthetic oligonucleotide
tgtaccaccacattgacttggactcatacctgttgga

SEQ ID NO: 96080 - DNA, 36 bp, Artificial Sequence
  Synthetic oligonucleotide
atgatctccgtgtaagtgtgcactggtgttgttgga

SEQ ID NO: 96081 - DNA, 38 bp, Artificial Sequence
  Synthetic oligonucleotide
gcgaaggaagatgggtgagggagcaaggaagggaatga

SEQ ID NO: 96082 - DNA, 36 bp, Artificial Sequence
  Synthetic oligonucleotide
aagtggaggtggacggataactggctgagggcatga

SEQ ID NO: 96083 - DNA, 38 bp, Artificial Sequence
  Synthetic oligonucleotide
gataacggtcattggtcacgccgcgacgcgcaaactga

SEQ ID NO: 96084 - DNA, 38 bp, Artificial Sequence
  Synthetic oligonucleotide
gacgacacacagcaagtccattgccacagttcaactga

SEQ ID NO: 96085 - DNA, 36 bp, Artificial Sequence
  Synthetic oligonucleotide
gtggagccgtaaacgtaatccaggacacgggactga

SEQ ID NO: 96086 - DNA, 38 bp, Artificial Sequence
  Synthetic oligonucleotide
tcacagcacagtagcccccattagcgccacactcctga

SEQ ID NO: 96087 - DNA, 38 bp, Artificial Sequence
  Synthetic oligonucleotide
tgacacctaccatcgcgattattcggacgtcccgctga

SEQ ID NO: 96088 - DNA, 38 bp, Artificial Sequence
  Synthetic oligonucleotide
aaagagtggggccaaggtgggtgctcaggatcggctga

SEQ ID NO: 96089 - DNA, 37 bp, Artificial Sequence
  Synthetic oligonucleotide
acgtacacggacaaggtaggggtggaaattaaagtga

SEQ ID NO: 96090 - DNA, 37 bp, Artificial Sequence
  Synthetic oligonucleotide
gcacaacggagtgaacgggaaaagcacgcgacagtga

SEQ ID NO: 96091 - DNA, 38 bp, Artificial Sequence
  Synthetic oligonucleotide
tgcaagtgccggtaaggttcttgcctgtctcaacgtga

SEQ ID NO: 96092 - DNA, 37 bp, Artificial Sequence
  Synthetic oligonucleotide
gacgcacatgcaatcctgaccaccggggagacggtga

SEQ ID NO: 96093 - DNA, 38 bp, Artificial Sequence
  Synthetic oligonucleotide
agcacccggtgataaaggtggtggatgtaacagggtga

SEQ ID NO: 96094 - DNA, 38 bp, Artificial Sequence
  Synthetic oligonucleotide
gtagacgtacagaaataacggacacttggggatggtga

SEQ ID NO: 96095 - DNA, 37 bp, Artificial Sequence
  Synthetic oligonucleotide
attgaaacgtggcagacagtgggaagaagggctgtga

SEQ ID NO: 96096 - DNA, 38 bp, Artificial Sequence
  Synthetic oligonucleotide
gggatcggtcgggcagaacgaggcgaggtggaaattga

SEQ ID NO: 96097 - DNA, 38 bp, Artificial Sequence
  Synthetic oligonucleotide
taatgacgcacagggtgtgtgccccaataggccattga

SEQ ID NO: 96098 - DNA, 37 bp, Artificial Sequence
  Synthetic oligonucleotide
gtggcgatgcatcattccttccgagggcctaccttga

SEQ ID NO: 96099 - DNA, 36 bp, Artificial Sequence
  Synthetic oligonucleotide
gacgtcacgcaggattgtttacaattcgtgaaaata

SEQ ID NO: 96100 - DNA, 35 bp, Artificial Sequence
  Synthetic oligonucleotide
tgacgggcctcactgttttcaccaccgcgaacata

SEQ ID NO: 96101 - DNA, 35 bp, Artificial Sequence
  Synthetic oligonucleotide
tctgctgggtgcgtagggaaggggggggcaagcta

SEQ ID NO: 96102 - DNA, 36 bp, Artificial Sequence
  Synthetic oligonucleotide
tgtgactgcccccatgtaggatctagccgttgtcta

SEQ ID NO: 96103 - DNA, 36 bp, Artificial Sequence
  Synthetic oligonucleotide
tccacgagctcacgggtacccacctactcaccagta

SEQ ID NO: 96104 - DNA, 36 bp, Artificial Sequence
  Synthetic oligonucleotide
ttcatcatgcccagcagcctgtaaatcgaactggta

SEQ ID NO: 96105 - DNA, 36 bp, Artificial Sequence
  Synthetic oligonucleotide
ggtgccatcgtttcgtttcagtctccatttcctgta

SEQ ID NO: 96106 - DNA, 36 bp, Artificial Sequence
  Synthetic oligonucleotide
acttgtgtgaggaagcaggagaagcagacaagtgta

SEQ ID NO: 96107 - DNA, 36 bp, Artificial Sequence
  Synthetic oligonucleotide
tccaacgcacgtgtgaggtccagtgtagccccatta

SEQ ID NO: 96108 - DNA, 36 bp, Artificial Sequence
  Synthetic oligonucleotide
ttggccatcgcccgaatctagctgttttgcctatta

SEQ ID NO: 96109 - DNA, 36 bp, Artificial Sequence
  Synthetic oligonucleotide
gaactgagccccgcaagccggtacacagtacactta

SEQ ID NO: 96110 - DNA, 35 bp, Artificial Sequence
  Synthetic oligonucleotide
tgcgacgctcattggacatagctgcgcctcactta

SEQ ID NO: 96111 - DNA, 35 bp, Artificial Sequence
  Synthetic oligonucleotide
gcaccaaacctcctagtcatgataagtctgtcaac

SEQ ID NO: 96112 - DNA, 35 bp, Artificial Sequence
  Synthetic oligonucleotide
gacgaggggtagaccggctacaaggcggtgaagac

SEQ ID NO: 96113 - DNA, 35 bp, Artificial Sequence
  Synthetic oligonucleotide
gcaacggaccacgcctcggtagttaccggttttac

SEQ ID NO: 96114 - DNA, 35 bp, Artificial Sequence
  Synthetic oligonucleotide
ttacctgccacagatgcgctagaacgcctcatgcc

SEQ ID NO: 96115 - DNA, 35 bp, Artificial Sequence
  Synthetic oligonucleotide
gagggcggtagcacggaaccgacacagatcacagc

SEQ ID NO: 96116 - DNA, 35 bp, Artificial Sequence
  Synthetic oligonucleotide
atccgaccgctctacctactatgatgaagcaccgc

SEQ ID NO: 96117 - DNA, 35 bp, Artificial Sequence
  Synthetic oligonucleotide
gccacgaaccgcatccttgtaaaacgacctagggc

SEQ ID NO: 96118 - DNA, 35 bp, Artificial Sequence
  Synthetic oligonucleotide
tcatgtgtagatccgggaccaccatttgaacctgc

SEQ ID NO: 96119 - DNA, 35 bp, Artificial Sequence
  Synthetic oligonucleotide
atgctggtgctaacctgcctgtcgttgcctctatc

SEQ ID NO: 96120 - DNA, 35 bp, Artificial Sequence
  Synthetic oligonucleotide
tgtcaacgcaacatattgtatacgtctgttttatc

SEQ ID NO: 96121 - DNA, 35 bp, Artificial Sequence
  Synthetic oligonucleotide
gttccctgccaccggatcgctaaacttgctgcctc

SEQ ID NO: 96122 - DNA, 35 bp, Artificial Sequence
  Synthetic oligonucleotide
aacggagcctcaacgctgctttgttctcctgtttc

SEQ ID NO: 96123 - DNA, 35 bp, Artificial Sequence
  Synthetic oligonucleotide
acaaaacagatggaggggcggtgtagagtcaacag

SEQ ID NO: 96124 - DNA, 35 bp, Artificial Sequence
  Synthetic oligonucleotide
tccatcgctgaatcatccttatatacctgcacgag

SEQ ID NO: 96125 - DNA, 34 bp, Artificial Sequence
  Synthetic oligonucleotide
tcgagtgcgcctgaagttcacattcttttactag

SEQ ID NO: 96126 - DNA, 35 bp, Artificial Sequence
  Synthetic oligonucleotide
gaacgacccatagtggcctcgatcctcacacaacg

SEQ ID NO: 96127 - DNA, 35 bp, Artificial Sequence
  Synthetic oligonucleotide
ggacaacccatccggtaaagcagtttccagtatcg

SEQ ID NO: 96128 - DNA, 35 bp, Artificial Sequence
  Synthetic oligonucleotide
tgatacgcaatgctagtccactgttctttctttcg

SEQ ID NO: 96129 - DNA, 35 bp, Artificial Sequence
  Synthetic oligonucleotide
gtgtggcgaaaagtggggaaaatgatcgatgaagg

SEQ ID NO: 96130 - DNA, 35 bp, Artificial Sequence
  Synthetic oligonucleotide
aaggacacaacgggtggaatggaggtttagtaggg

SEQ ID NO: 96131 - DNA, 35 bp, Artificial Sequence
  Synthetic oligonucleotide
gcactgccttgatgaactacccgaatgctgattgg

SEQ ID NO: 96132 - DNA, 35 bp, Artificial Sequence
  Synthetic oligonucleotide
gggacatcacagcatgtccttggaccttccctatg

SEQ ID NO: 96133 - DNA, 35 bp, Artificial Sequence
  Synthetic oligonucleotide
tgaggcgtagctgttatctctcatggattttcact

SEQ ID NO: 96134 - DNA, 35 bp, Artificial Sequence
  Synthetic oligonucleotide
tcagatgcatgccggatagcggaaacgatcctcct

SEQ ID NO: 96135 - DNA, 35 bp, Artificial Sequence
  Synthetic oligonucleotide
acaaccaaggctctgaccactaccgtccctgtcct

SEQ ID NO: 96136 - DNA, 35 bp, Artificial Sequence
  Synthetic oligonucleotide
gaaggaagggaggaaaggtggtcaagaaaagcggt

SEQ ID NO: 96137 - DNA, 35 bp, Artificial Sequence
  Synthetic oligonucleotide
atgacaaggctaatgacgtaagagtgcaggtctgt

SEQ ID NO: 96138 - DNA, 35 bp, Artificial Sequence
  Synthetic oligonucleotide
attgcaacccaacctgaaaagcttacctactgtgt

SEQ ID NO: 96139 - DNA, 35 bp, Artificial Sequence
  Synthetic oligonucleotide
tcagcccgtagtacatcttctcgtgcacactttgt

SEQ ID NO: 96140 - DNA, 35 bp, Artificial Sequence
  Synthetic oligonucleotide
gtccaaacgttcgacgcagtagtgtcgccgccatt

SEQ ID NO: 96141 - DNA, 35 bp, Artificial Sequence
  Synthetic oligonucleotide
gtgccgccctcgtatagccgttctatagaattctt

SEQ ID NO: 96142 - DNA, 35 bp, Artificial Sequence
  Synthetic oligonucleotide
aaacaacctgcagacgtgtatctacatgctacgtt

SEQ ID NO: 96143 - DNA, 36 bp, Artificial Sequence
  Synthetic oligonucleotide
gatgccacggggtgaggttagggtccgtgcctcaaa

SEQ ID NO: 96144 - DNA, 36 bp, Artificial Sequence
  Synthetic oligonucleotide
aaggaatgagcaggcgagagagaagataggtcgaaa

SEQ ID NO: 96145 - DNA, 35 bp, Artificial Sequence
  Synthetic oligonucleotide
ggtgggggcccaacggaatgttgacgggtggtaaa

SEQ ID NO: 96146 - DNA, 35 bp, Artificial Sequence
  Synthetic oligonucleotide
gacgcatcgattgaccctcgatcccattatggtaa

SEQ ID NO: 96147 - DNA, 35 bp, Artificial Sequence
  Synthetic oligonucleotide
agcggacgtggggtgatagaggatgaggattgtaa

SEQ ID NO: 96148 - DNA, 36 bp, Artificial Sequence
  Synthetic oligonucleotide
gacatagcccctattgatctgatcttcccccgttaa

SEQ ID NO: 96149 - DNA, 36 bp, Artificial Sequence
  Synthetic oligonucleotide
accactgcgcgtcgttttaccaggccttacatcaca

SEQ ID NO: 96150 - DNA, 35 bp, Artificial Sequence
  Synthetic oligonucleotide
aatgcatgaccagtccgccgccataggtgcaccca

SEQ ID NO: 96151 - DNA, 36 bp, Artificial Sequence
  Synthetic oligonucleotide
tcatcagccccgtctgtctggtgctactttttgcca

SEQ ID NO: 96152 - DNA, 35 bp, Artificial Sequence
  Synthetic oligonucleotide
gcaggcctccatacaacagatccgtgcctcatcca

SEQ ID NO: 96153 - DNA, 35 bp, Artificial Sequence
  Synthetic oligonucleotide
gaggagctccatgcgttatctcccaatactatcca

SEQ ID NO: 96154 - DNA, 36 bp, Artificial Sequence
  Synthetic oligonucleotide
gacttgccatcacacagccgcactcagtctactgca

SEQ ID NO: 96155 - DNA, 37 bp, Artificial Sequence
  Synthetic oligonucleotide
tggggaccggctaagcgtggggggaaacgggtcgaga

SEQ ID NO: 96156 - DNA, 36 bp, Artificial Sequence
  Synthetic oligonucleotide
tttggcgcactccaactgtttaccgctaccaggaga

SEQ ID NO: 96157 - DNA, 37 bp, Artificial Sequence
  Synthetic oligonucleotide
gtcagggtcgggaagtaataatgataggagcaggaga

SEQ ID NO: 96158 - DNA, 35 bp, Artificial Sequence
  Synthetic oligonucleotide
gtcggatgtcgggaggaaggttcggatgacggaga

SEQ ID NO: 96159 - DNA, 37 bp, Artificial Sequence
  Synthetic oligonucleotide
acatgacgcgcaccgtgaggacgcaaaacaatataga

SEQ ID NO: 96160 - DNA, 37 bp, Artificial Sequence
  Synthetic oligonucleotide
tcacaacacaggggcaccgtcatggggaactggtaga

SEQ ID NO: 96161 - DNA, 37 bp, Artificial Sequence
  Synthetic oligonucleotide
gagggatgtatgctgatgtaacggggaatgggaacga

SEQ ID NO: 96162 - DNA, 36 bp, Artificial Sequence
  Synthetic oligonucleotide
gacccagccccggcgataacagcaatcccttcccga

SEQ ID NO: 96163 - DNA, 37 bp, Artificial Sequence
  Synthetic oligonucleotide
actacacgcatgtatgtttcatatgctgctacttcga

SEQ ID NO: 96164 - DNA, 37 bp, Artificial Sequence
  Synthetic oligonucleotide
gccagatgcaaggggggtggaacttcatcgcaaagga

SEQ ID NO: 96165 - DNA, 37 bp, Artificial Sequence
  Synthetic oligonucleotide
aacgagagagcaaggtaggagggcgtgtctacaagga

SEQ ID NO: 96166 - DNA, 37 bp, Artificial Sequence
  Synthetic oligonucleotide
acagccctaagccgatgcgtggggggaaccttaagga

SEQ ID NO: 96167 - DNA, 37 bp, Artificial Sequence
  Synthetic oligonucleotide
atctgaggcaagctgcactacgaatgcccccaccgga

SEQ ID NO: 96168 - DNA, 37 bp, Artificial Sequence
  Synthetic oligonucleotide
ggtccattccgcagtgaaatcgccacgctcttaggga

SEQ ID NO: 96169 - DNA, 37 bp, Artificial Sequence
  Synthetic oligonucleotide
gatgcgctccagaggaacaagagggcgaagagcggga

SEQ ID NO: 96170 - DNA, 36 bp, Artificial Sequence
  Synthetic oligonucleotide
gatggcaagggacaatttcgtcatacggctcgggga

SEQ ID NO: 96171 - DNA, 37 bp, Artificial Sequence
  Synthetic oligonucleotide
aggatcagatcggctggtgtcgtaggtggggggggga

SEQ ID NO: 96172 - DNA, 35 bp, Artificial Sequence
  Synthetic oligonucleotide
tgctcccctttgcatcatacagacctccagtggga

SEQ ID NO: 96173 - DNA, 36 bp, Artificial Sequence
  Synthetic oligonucleotide
ttgccaccgcagtctacacgaccgtgcgcacatgga

SEQ ID NO: 96174 - DNA, 37 bp, Artificial Sequence
  Synthetic oligonucleotide
gatggtcacgcggaacaaaccggggtgggaagatgga

SEQ ID NO: 96175 - DNA, 37 bp, Artificial Sequence
  Synthetic oligonucleotide
gagaccagagggtaaaataggttgatcaggttatgga

SEQ ID NO: 96176 - DNA, 35 bp, Artificial Sequence
  Synthetic oligonucleotide
gtaacggaaacgatggggctaatgtagggaaatga

SEQ ID NO: 96177 - DNA, 38 bp, Artificial Sequence
  Synthetic oligonucleotide
tgtgacgcattattggaaggggtgagagtgaagaatga

SEQ ID NO: 96178 - DNA, 38 bp, Artificial Sequence
  Synthetic oligonucleotide
aatgaagcagcataaggtaggtcagaggttctgaatga

SEQ ID NO: 96179 - DNA, 38 bp, Artificial Sequence
  Synthetic oligonucleotide
tcaaggagtggaggaacgtaaactgggtgaagacatga

SEQ ID NO: 96180 - DNA, 36 bp, Artificial Sequence
  Synthetic oligonucleotide
tgtggcaccatcgacttatcgaaactatcaccatga

SEQ ID NO: 96181 - DNA, 38 bp, Artificial Sequence
  Synthetic oligonucleotide
ggggatgaggcggaggggtagataagaaccagggatga

SEQ ID NO: 96182 - DNA, 36 bp, Artificial Sequence
  Synthetic oligonucleotide
tgccacccacggtcacatacattattttagtgatga

SEQ ID NO: 96183 - DNA, 37 bp, Artificial Sequence
  Synthetic oligonucleotide
aatgcgacgagtaggcatgaagcgaggtatggtatga

SEQ ID NO: 96184 - DNA, 38 bp, Artificial Sequence
  Synthetic oligonucleotide
gcaagcccccatgcaacacgaacccaggcatcttatga

SEQ ID NO: 96185 - DNA, 38 bp, Artificial Sequence
  Synthetic oligonucleotide
gaacgcacgtgcagctcccgcatcacactaagacctga

SEQ ID NO: 96186 - DNA, 38 bp, Artificial Sequence
  Synthetic oligonucleotide
tacgcgcacgcagagtagttttctcttctaggccctga

SEQ ID NO: 96187 - DNA, 38 bp, Artificial Sequence
  Synthetic oligonucleotide
tcactgcctcctcttgtctaaccgggatttcgttctga

SEQ ID NO: 96188 - DNA, 38 bp, Artificial Sequence
  Synthetic oligonucleotide
ttgcaccggtcctaacttacatcgagatctctttctga

SEQ ID NO: 96189 - DNA, 38 bp, Artificial Sequence
  Synthetic oligonucleotide
gtggtgctgcagtgaagaatggttgagggtttttctga

SEQ ID NO: 96190 - DNA, 36 bp, Artificial Sequence
  Synthetic oligonucleotide
gtctcagacggatgtggtaggtaggaaatggagtga

SEQ ID NO: 96191 - DNA, 38 bp, Artificial Sequence
  Synthetic oligonucleotide
gtatcgctgggtggctgcacaaggggcatctggggtga

SEQ ID NO: 96192 - DNA, 38 bp, Artificial Sequence
  Synthetic oligonucleotide
tcagagcgatgtctgtgttttgtgttccatcggtgtga

SEQ ID NO: 96193 - DNA, 38 bp, Artificial Sequence
  Synthetic oligonucleotide
gaatgcgctcaagaaaatgccatattgggtgggtgtga

SEQ ID NO: 96194 - DNA, 38 bp, Artificial Sequence
  Synthetic oligonucleotide
atcgtccaggacggccgggaagcgagtactaccattga

SEQ ID NO: 96195 - DNA, 38 bp, Artificial Sequence
  Synthetic oligonucleotide
aagtacagcagagcaaacggtctacggtaggaacttga

SEQ ID NO: 96196 - DNA, 36 bp, Artificial Sequence
  Synthetic oligonucleotide
tgcgcctccacctgggctatctctactatatgttga

SEQ ID NO: 96197 - DNA, 38 bp, Artificial Sequence
  Synthetic oligonucleotide
atgcaagagctccagcttgccttaaatgcctcttttga

SEQ ID NO: 96198 - DNA, 36 bp, Artificial Sequence
  Synthetic oligonucleotide
tccacaccaccgaataattcatagctactatgaata

SEQ ID NO: 96199 - DNA, 36 bp, Artificial Sequence
  Synthetic oligonucleotide
ttacagctcgctatctttccgatacaccctttggta

SEQ ID NO: 96200 - DNA, 35 bp, Artificial Sequence
  Synthetic oligonucleotide
gcaccatcgtggcctgtcatagggaatcatttgta

SEQ ID NO: 96201 - DNA, 36 bp, Artificial Sequence
  Synthetic oligonucleotide
gacaaccggacacagaggaaaaataatgtcatctta

SEQ ID NO: 96202 - DNA, 37 bp, Artificial Sequence
  Synthetic oligonucleotide
tgcatgctaagcggacgtttcatcgcctctcctttta

SEQ ID NO: 96203 - DNA, 35 bp, Artificial Sequence
  Synthetic oligonucleotide
actgaagcacgcccgaccccagccagttaagtcac

SEQ ID NO: 96204 - DNA, 35 bp, Artificial Sequence
  Synthetic oligonucleotide
gtcatcgcccgcagaaactgacagcaaagcattac

SEQ ID NO: 96205 - DNA, 35 bp, Artificial Sequence
  Synthetic oligonucleotide
tcataggtagcgcccttgtgtgtactcttaccccc

SEQ ID NO: 96206 - DNA, 35 bp, Artificial Sequence
  Synthetic oligonucleotide
gcctgagcacgtccgttcgtctcctttcttgtgcc

SEQ ID NO: 96207 - DNA, 35 bp, Artificial Sequence
  Synthetic oligonucleotide
gacgatcgcgcacgagagtgggaattgagattgcc

SEQ ID NO: 96208 - DNA, 35 bp, Artificial Sequence
  Synthetic oligonucleotide
acattcacagtgccaatcgagttcggtgaaaatcc

SEQ ID NO: 96209 - DNA, 35 bp, Artificial Sequence
  Synthetic oligonucleotide
aatccgaacttgcgccttcataactggtacagtcc

SEQ ID NO: 96210 - DNA, 35 bp, Artificial Sequence
  Synthetic oligonucleotide
gagagggaactgcacttatacagggtttcacacgc

SEQ ID NO: 96211 - DNA, 35 bp, Artificial Sequence
  Synthetic oligonucleotide
tcatagggaggccaaagacgagaagggaggacggc

SEQ ID NO: 96212 - DNA, 35 bp, Artificial Sequence
  Synthetic oligonucleotide
tgtgcctcatcccaagaaatgtacttggttactgc

SEQ ID NO: 96213 - DNA, 35 bp, Artificial Sequence
  Synthetic oligonucleotide
gccaccggcacggacattaacaccgcaccttaatc

SEQ ID NO: 96214 - DNA, 35 bp, Artificial Sequence
  Synthetic oligonucleotide
agagagcgcaccccgctacatggcgacgtctcatc

SEQ ID NO: 96215 - DNA, 35 bp, Artificial Sequence
  Synthetic oligonucleotide
taactcccccatgaagacctgcactctccttcgtc

SEQ ID NO: 96216 - DNA, 35 bp, Artificial Sequence
  Synthetic oligonucleotide
tgcacacggggaaacaatgacacgcagtttatgtc

SEQ ID NO: 96217 - DNA, 35 bp, Artificial Sequence
  Synthetic oligonucleotide
taagactgacgcactccgtttttgtagttcaattc

SEQ ID NO: 96218 - DNA, 35 bp, Artificial Sequence
  Synthetic oligonucleotide
gcacctcgcaagaaggtagccgacaatccttattc

SEQ ID NO: 96219 - DNA, 35 bp, Artificial Sequence
  Synthetic oligonucleotide
gagctccgccgaaagtcaatatcgacgatcctttc

SEQ ID NO: 96220 - DNA, 35 bp, Artificial Sequence
  Synthetic oligonucleotide
gaacaaagtgcagggggacatactcgggtgaaaag

SEQ ID NO: 96221 - DNA, 35 bp, Artificial Sequence
  Synthetic oligonucleotide
gctgtgttatcccccctaggccttttacgaggaag

SEQ ID NO: 96222 - DNA, 35 bp, Artificial Sequence
  Synthetic oligonucleotide
tgaccacaaccctatatgtttacagtaactttaag

SEQ ID NO: 96223 - DNA, 35 bp, Artificial Sequence
  Synthetic oligonucleotide
gatgctgtgggcatcgaaatacatgatcaaaaacg

SEQ ID NO: 96224 - DNA, 35 bp, Artificial Sequence
  Synthetic oligonucleotide
acaacttgcgggcctacatgcttaactacaccacg

SEQ ID NO: 96225 - DNA, 35 bp, Artificial Sequence
  Synthetic oligonucleotide
gcccacctcaccgcccatgccctccctgtctagcg

SEQ ID NO: 96226 - DNA, 35 bp, Artificial Sequence
  Synthetic oligonucleotide
gacgctcatcaatctccatacagtcgacaagggcg

SEQ ID NO: 96227 - DNA, 35 bp, Artificial Sequence
  Synthetic oligonucleotide
gccatggttgggtggaagttggcgcacagtgtagg

SEQ ID NO: 96228 - DNA, 35 bp, Artificial Sequence
  Synthetic oligonucleotide
gaggaacagcagagcggaggaagggctttggcatg

SEQ ID NO: 96229 - DNA, 35 bp, Artificial Sequence
  Synthetic oligonucleotide
ggacaggcccaataattttgaggtgtcttaacctg

SEQ ID NO: 96230 - DNA, 35 bp, Artificial Sequence
  Synthetic oligonucleotide
tctgatggcccgtgtcggttagatatccattcctg

SEQ ID NO: 96231 - DNA, 35 bp, Artificial Sequence
  Synthetic oligonucleotide
acacagacgggatggacggatagtgggatgcgctg

SEQ ID NO: 96232 - DNA, 35 bp, Artificial Sequence
  Synthetic oligonucleotide
acaggaaggcaggaggtagaggtacgcccagattg

SEQ ID NO: 96233 - DNA, 35 bp, Artificial Sequence
  Synthetic oligonucleotide
ttggccacaaccgatactgtcgagtgcctcacttg

SEQ ID NO: 96234 - DNA, 35 bp, Artificial Sequence
  Synthetic oligonucleotide
tcccagcctcacctgtccgcccatggcgatcaaat

SEQ ID NO: 96235 - DNA, 35 bp, Artificial Sequence
  Synthetic oligonucleotide
acaccagcgggttgggcgagggatgtaggattaat

SEQ ID NO: 96236 - DNA, 35 bp, Artificial Sequence
  Synthetic oligonucleotide
atgccacgcacagtcccaatgtaccttctgcccat

SEQ ID NO: 96237 - DNA, 35 bp, Artificial Sequence
  Synthetic oligonucleotide
tgatgcccagttgggagggccgaagagttaggcat

SEQ ID NO: 96238 - DNA, 35 bp, Artificial Sequence
  Synthetic oligonucleotide
taatgccactgcctctatagtccatgctcttctat

SEQ ID NO: 96239 - DNA, 35 bp, Artificial Sequence
  Synthetic oligonucleotide
acatgccggccagaatatgcaagagggtcttctat

SEQ ID NO: 96240 - DNA, 35 bp, Artificial Sequence
  Synthetic oligonucleotide
agtgatcccagcggtataaaaattcgccgcaacct

SEQ ID NO: 96241 - DNA, 35 bp, Artificial Sequence
  Synthetic oligonucleotide
gctatcggcaatgttctacgtccgtaaccttacct

SEQ ID NO: 96242 - DNA, 35 bp, Artificial Sequence
  Synthetic oligonucleotide
gcctcatgcgtgctgttcctatgtgcgatcctcgt

SEQ ID NO: 96243 - DNA, 35 bp, Artificial Sequence
  Synthetic oligonucleotide
tcaccccgcgctaaatcgatcatgccggtcccggt

SEQ ID NO: 96244 - DNA, 35 bp, Artificial Sequence
  Synthetic oligonucleotide
tgcggaccatccggcgttacactaggccctaatgt

SEQ ID NO: 96245 - DNA, 35 bp, Artificial Sequence
  Synthetic oligonucleotide
gtatgtcgaaaaatgggaaggggaggtaagggtgt

SEQ ID NO: 96246 - DNA, 35 bp, Artificial Sequence
  Synthetic oligonucleotide
gacaaacgcagggctgagttgatagagaggggatt

SEQ ID NO: 96247 - DNA, 36 bp, Artificial Sequence
  Synthetic oligonucleotide
atctgccggacgaccagggctaggaatttgcacctt

SEQ ID NO: 96248 - DNA, 35 bp, Artificial Sequence
  Synthetic oligonucleotide
acgcaccccacagcgtatgccgtcaagtcgaagtt

SEQ ID NO: 96249 - DNA, 36 bp, Artificial Sequence
  Synthetic oligonucleotide
gcaccccagcggaccgttggctttggatcgttcaaa

SEQ ID NO: 96250 - DNA, 35 bp, Artificial Sequence
  Synthetic oligonucleotide
gtccgtgcgcagaccctcgggacgctctacctaaa

SEQ ID NO: 96251 - DNA, 36 bp, Artificial Sequence
  Synthetic oligonucleotide
ttcgcaacccggagtgtacccaccaatctctcacaa

SEQ ID NO: 96252 - DNA, 36 bp, Artificial Sequence
  Synthetic oligonucleotide
attgtcacgccgccctgagctccgaatcgcttgcaa

SEQ ID NO: 96253 - DNA, 35 bp, Artificial Sequence
  Synthetic oligonucleotide
aacaccggtgaggaaggcgatcccaaaagagcgaa

SEQ ID NO: 96254 - DNA, 35 bp, Artificial Sequence
  Synthetic oligonucleotide
ttccaccgccccagaatctaccacacgacacataa

SEQ ID NO: 96255 - DNA, 36 bp, Artificial Sequence
  Synthetic oligonucleotide
gccccaatcggcacacgtggccaaatcctctactaa

SEQ ID NO: 96256 - DNA, 35 bp, Artificial Sequence
  Synthetic oligonucleotide
atgggacgcaaccgacccatgtctcaaggtaccca

SEQ ID NO: 96257 - DNA, 36 bp, Artificial Sequence
  Synthetic oligonucleotide
acgcacgtatgagtggactacaagtaaatggcccca

SEQ ID NO: 96258 - DNA, 36 bp, Artificial Sequence
  Synthetic oligonucleotide
gcccgcaccacatcataatgtattcagcttagccca

SEQ ID NO: 96259 - DNA, 36 bp, Artificial Sequence
  Synthetic oligonucleotide
gtgcattacacaagctgctataccgtttacgtccca

SEQ ID NO: 96260 - DNA, 35 bp, Artificial Sequence
  Synthetic oligonucleotide
tgacctaccacgtagcggatgagttccgattccca

SEQ ID NO: 96261 - DNA, 36 bp, Artificial Sequence
  Synthetic oligonucleotide
gtggtggtcggcctgtctgaaacctcttcgctgcca

SEQ ID NO: 96262 - DNA, 36 bp, Artificial Sequence
  Synthetic oligonucleotide
tacatacgtcccatgtgcactgatctccgtactcca

SEQ ID NO: 96263 - DNA, 35 bp, Artificial Sequence
  Synthetic oligonucleotide
tgctatccagccactctaacgttacacagcctcca

SEQ ID NO: 96264 - DNA, 35 bp, Artificial Sequence
  Synthetic oligonucleotide
atgccacagccattgaacaggtaactacccgagca

SEQ ID NO: 96265 - DNA, 36 bp, Artificial Sequence
  Synthetic oligonucleotide
acgatacatcacgaggcctcttcatagagcgaatca

SEQ ID NO: 96266 - DNA, 36 bp, Artificial Sequence
  Synthetic oligonucleotide
accagacccaagttgcgtttgcctgaatgtccatca

SEQ ID NO: 96267 - DNA, 38 bp, Artificial Sequence
  Synthetic oligonucleotide
gccaactcagcggcatcatcccacttccgccttcgtca

SEQ ID NO: 96268 - DNA, 36 bp, Artificial Sequence
  Synthetic oligonucleotide
gtccatgggaacgcagctgacttatcttcccgttca

SEQ ID NO: 96269 - DNA, 36 bp, Artificial Sequence
  Synthetic oligonucleotide
gacacgattgcagcacccccgataaaacgctgttca

SEQ ID NO: 96270 - DNA, 37 bp, Artificial Sequence
  Synthetic oligonucleotide
taagtgcatgccgccggaccaattcgcaaagacaaga

SEQ ID NO: 96271 - DNA, 36 bp, Artificial Sequence
  Synthetic oligonucleotide
gtagtcgaaataggaaaagatggcagagatggaaga

SEQ ID NO: 96272 - DNA, 37 bp, Artificial Sequence
  Synthetic oligonucleotide
tgtgggggaggctccgatagtgtgggtgggcttaaga

SEQ ID NO: 96273 - DNA, 38 bp, Artificial Sequence
  Synthetic oligonucleotide
gtacgtcatcggaagtgtgcggagagtcagggttaaga

SEQ ID NO: 96274 - DNA, 37 bp, Artificial Sequence
  Synthetic oligonucleotide
ttcggagagaggggggggatggtgcaagctattgaga

SEQ ID NO: 96275 - DNA, 36 bp, Artificial Sequence
  Synthetic oligonucleotide
gtaagcaccgcctctagttaactccatcttcgtaga

SEQ ID NO: 96276 - DNA, 37 bp, Artificial Sequence
  Synthetic oligonucleotide
agcgcggaagagtacatctatggggggctgggcacga

SEQ ID NO: 96277 - DNA, 37 bp, Artificial Sequence
  Synthetic oligonucleotide
gacaaggcccagacaacatagcggctcagtgtaccga

SEQ ID NO: 96278 - DNA, 37 bp, Artificial Sequence
  Synthetic oligonucleotide
tctcagcccctgaactctaacctctctctgggtgcga

SEQ ID NO: 96279 - DNA, 37 bp, Artificial Sequence
  Synthetic oligonucleotide
ggtgggaaccgagagcgaaaaacaaaaacagactcga

SEQ ID NO: 96280 - DNA, 37 bp, Artificial Sequence
  Synthetic oligonucleotide
gaaacctagctggttggaacgggggggcgagactcga

SEQ ID NO: 96281 - DNA, 35 bp, Artificial Sequence
  Synthetic oligonucleotide
gattctccgccgaccccgtttattgcttacctcga

SEQ ID NO: 96282 - DNA, 37 bp, Artificial Sequence
  Synthetic oligonucleotide
gacaaccgggcattaggtattctttactgacgttcga

SEQ ID NO: 96283 - DNA, 37 bp, Artificial Sequence
  Synthetic oligonucleotide
gcctctcgccggagaataatcccagcctactgttcga

SEQ ID NO: 96284 - DNA, 37 bp, Artificial Sequence
  Synthetic oligonucleotide
gtcaaaatgcgctagaatagtaaggggggacgtagga

SEQ ID NO: 96285 - DNA, 37 bp, Artificial Sequence
  Synthetic oligonucleotide
gtggggatgtagatggtgaaggcgttacgtgatcgga

SEQ ID NO: 96286 - DNA, 36 bp, Artificial Sequence
  Synthetic oligonucleotide
gtagcggtggggcggcccatatgagaacggctcgga

SEQ ID NO: 96287 - DNA, 36 bp, Artificial Sequence
  Synthetic oligonucleotide
taccagtcaggaggaatcaatggagggcttacggga

SEQ ID NO: 96288 - DNA, 38 bp, Artificial Sequence
  Synthetic oligonucleotide
gcacaacgctggttgctaatcatattcatcctccggga

SEQ ID NO: 96289 - DNA, 37 bp, Artificial Sequence
  Synthetic oligonucleotide
tgcacaccggttgcgttgtaattaccttatgcctgga

SEQ ID NO: 96290 - DNA, 37 bp, Artificial Sequence
  Synthetic oligonucleotide
gaatcactgcgaagatgtaaagttgtgggtgggtgga

SEQ ID NO: 96291 - DNA, 38 bp, Artificial Sequence
  Synthetic oligonucleotide
ggtggaaggaggcgagttagggatcgcgactgaaatga

SEQ ID NO: 96292 - DNA, 37 bp, Artificial Sequence
  Synthetic oligonucleotide
taacagggagagggtggttagagctggcgaggaatga

SEQ ID NO: 96293 - DNA, 37 bp, Artificial Sequence
  Synthetic oligonucleotide
acccacaaagaatgtgaagtggagtaaaacggaatga

SEQ ID NO: 96294 - DNA, 37 bp, Artificial Sequence
  Synthetic oligonucleotide
gatgctcctcccccatgaacagttgactggcagatga

SEQ ID NO: 96295 - DNA, 37 bp, Artificial Sequence
  Synthetic oligonucleotide
acagcaagcctggggaggataggaagtgaggttatga

SEQ ID NO: 96296 - DNA, 34 bp, Artificial Sequence
  Synthetic oligonucleotide
agaggtgaggagggcgaaagggacggaccgctga

SEQ ID NO: 96297 - DNA, 37 bp, Artificial Sequence
  Synthetic oligonucleotide
gcaccgaagatgtgcccagttcaccccttatttctga

SEQ ID NO: 96298 - DNA, 37 bp, Artificial Sequence
  Synthetic oligonucleotide
gaggtaggcgaggggtggcgggcaaagacttaagtga

SEQ ID NO: 96299 - DNA, 38 bp, Artificial Sequence
  Synthetic oligonucleotide
gccgatgcgtactagtctgttgtggtggtgttccgtga

SEQ ID NO: 96300 - DNA, 38 bp, Artificial Sequence
  Synthetic oligonucleotide
accgcgcggcggctagtgagggcgggtgagtgaggtga

SEQ ID NO: 96301 - DNA, 36 bp, Artificial Sequence
  Synthetic oligonucleotide
aaaggggacaaacggagcatacagagggggcggtga

SEQ ID NO: 96302 - DNA, 36 bp, Artificial Sequence
  Synthetic oligonucleotide
ttgcctgccctctcggatcctttaagctctctgtga

SEQ ID NO: 96303 - DNA, 38 bp, Artificial Sequence
  Synthetic oligonucleotide
ggggtggagccacgagagtagacgaacggtagttgtga

SEQ ID NO: 96304 - DNA, 38 bp, Artificial Sequence
  Synthetic oligonucleotide
gcgattcgcacggtactaataggagcattgccaattga

SEQ ID NO: 96305 - DNA, 38 bp, Artificial Sequence
  Synthetic oligonucleotide
gcatagcgatcgcatttgcaacactacactatcattga

SEQ ID NO: 96306 - DNA, 38 bp, Artificial Sequence
  Synthetic oligonucleotide
atccaccctcttcagccgagaatgcgagtttcgattga

SEQ ID NO: 96307 - DNA, 37 bp, Artificial Sequence
  Synthetic oligonucleotide
gccacctctgcctaccttccccagtcgctccacttga

SEQ ID NO: 96308 - DNA, 37 bp, Artificial Sequence
  Synthetic oligonucleotide
tcacgctcagtaacgatcgatttaatcatgaccttga

SEQ ID NO: 96309 - DNA, 37 bp, Artificial Sequence
  Synthetic oligonucleotide
gtggatgcagggttgttcagaaccactacttccttga

SEQ ID NO: 96310 - DNA, 38 bp, Artificial Sequence
  Synthetic oligonucleotide
gagcatagctgagcctccagaccatctcgacttcttga

SEQ ID NO: 96311 - DNA, 36 bp, Artificial Sequence
  Synthetic oligonucleotide
acctgggagggtgggaagatgggtaccacccaaata

SEQ ID NO: 96312 - DNA, 35 bp, Artificial Sequence
  Synthetic oligonucleotide
gtggatgcaaacgttgcattaaatcgcatagaata

SEQ ID NO: 96313 - DNA, 36 bp, Artificial Sequence
  Synthetic oligonucleotide
tccaccgagccgacctgggtttttacgatttcccta

SEQ ID NO: 96314 - DNA, 35 bp, Artificial Sequence
  Synthetic oligonucleotide
tagacccgatcctgaacaccttcacataagacgta

SEQ ID NO: 96315 - DNA, 35 bp, Artificial Sequence
  Synthetic oligonucleotide
tgcacactgaagctcccgggacatccttccccaac

SEQ ID NO: 96316 - DNA, 35 bp, Artificial Sequence
  Synthetic oligonucleotide
gtacccgctatgactctggattattttctgtcgac

SEQ ID NO: 96317 - DNA, 35 bp, Artificial Sequence
  Synthetic oligonucleotide
ggactacgcacggtcgccccttcatttccacgtac

SEQ ID NO: 96318 - DNA, 35 bp, Artificial Sequence
  Synthetic oligonucleotide
ttgcaccaaccacagctattaattgctaggcaccc

SEQ ID NO: 96319 - DNA, 35 bp, Artificial Sequence
  Synthetic oligonucleotide
ttgcctgccacttggagtgttcgtaccgcttaccc

SEQ ID NO: 96320 - DNA, 35 bp, Artificial Sequence
  Synthetic oligonucleotide
atagcgggacaatgtgtgattttggcgccgtcccc

SEQ ID NO: 96321 - DNA, 35 bp, Artificial Sequence
  Synthetic oligonucleotide
atggtcgcagtttagtggtcggcccccaaattgcc

SEQ ID NO: 96322 - DNA, 35 bp, Artificial Sequence
  Synthetic oligonucleotide
ttgcctcatccggacggctaggtgcccttctttcc

SEQ ID NO: 96323 - DNA, 35 bp, Artificial Sequence
  Synthetic oligonucleotide
actgacgtcctcatcatcaagacctgatgctacgc

SEQ ID NO: 96324 - DNA, 35 bp, Artificial Sequence
  Synthetic oligonucleotide
tcgatcccccgacgttcatggcagcccgaataggc

SEQ ID NO: 96325 - DNA, 35 bp, Artificial Sequence
  Synthetic oligonucleotide
gtaaggctatcctgctcacatagtgcaccccctgc

SEQ ID NO: 96326 - DNA, 35 bp, Artificial Sequence
  Synthetic oligonucleotide
gggatggccggaggagcttagggacggggttaatc

SEQ ID NO: 96327 - DNA, 35 bp, Artificial Sequence
  Synthetic oligonucleotide
gccctgtgcatagtgcctttttgtgagttaacatc

SEQ ID NO: 96328 - DNA, 35 bp, Artificial Sequence
  Synthetic oligonucleotide
acatgcgcatccgtctattaggtcccattacgatc

SEQ ID NO: 96329 - DNA, 35 bp, Artificial Sequence
  Synthetic oligonucleotide
atgacgaacggtcatcgaaggtcaatcggttgatc

SEQ ID NO: 96330 - DNA, 35 bp, Artificial Sequence
  Synthetic oligonucleotide
acctgggctaagaaactgcttagaccgatccactc

SEQ ID NO: 96331 - DNA, 35 bp, Artificial Sequence
  Synthetic oligonucleotide
gcaacggagaatggggcaggggaggctacttagtc

SEQ ID NO: 96332 - DNA, 35 bp, Artificial Sequence
  Synthetic oligonucleotide
tctgacgtgaccgcgtcactctgaccttgttattc

SEQ ID NO: 96333 - DNA, 35 bp, Artificial Sequence
  Synthetic oligonucleotide
gtagccccatgtggcctcgacctttcacgcccttc

SEQ ID NO: 96334 - DNA, 35 bp, Artificial Sequence
  Synthetic oligonucleotide
gccacgaagagattgcttgataagggcggggcaag

SEQ ID NO: 96335 - DNA, 35 bp, Artificial Sequence
  Synthetic oligonucleotide
ttcacactccaggtatcacactcgtccgctcgtag

SEQ ID NO: 96336 - DNA, 35 bp, Artificial Sequence
  Synthetic oligonucleotide
gtccaagcgcaacagggtacggatgggaaggcacg

SEQ ID NO: 96337 - DNA, 35 bp, Artificial Sequence
  Synthetic oligonucleotide
actccccgccacacgaacagcagatgcggcattcg

SEQ ID NO: 96338 - DNA, 35 bp, Artificial Sequence
  Synthetic oligonucleotide
ggatagctgcgggtggtacggtgggataggcgggg

SEQ ID NO: 96339 - DNA, 35 bp, Artificial Sequence
  Synthetic oligonucleotide
ttcgtagccccgtaaactaaccattgcccacatgg

SEQ ID NO: 96340 - DNA, 35 bp, Artificial Sequence
  Synthetic oligonucleotide
tgcacccggtccatagtcctcggttccagaccatg

SEQ ID NO: 96341 - DNA, 35 bp, Artificial Sequence
  Synthetic oligonucleotide
attgcaaaaggtgcgtgcatgaggggggggaactg

SEQ ID NO: 96342 - DNA, 35 bp, Artificial Sequence
  Synthetic oligonucleotide
ttcagcttcacgcgaccactgacctccatattttg

SEQ ID NO: 96343 - DNA, 35 bp, Artificial Sequence
  Synthetic oligonucleotide
gtacccgacggtcgacgtgcataacccttacccat

SEQ ID NO: 96344 - DNA, 34 bp, Artificial Sequence
  Synthetic oligonucleotide
atggaagggggatcaggccggccaatagctatat

SEQ ID NO: 96345 - DNA, 35 bp, Artificial Sequence
  Synthetic oligonucleotide
gagaccgagaggttgcgtcgatacacatgtttact

SEQ ID NO: 96346 - DNA, 35 bp, Artificial Sequence
  Synthetic oligonucleotide
aaccaccgccgattcccggagctattgtgggtgct

SEQ ID NO: 96347 - DNA, 35 bp, Artificial Sequence
  Synthetic oligonucleotide
tgacggtaggcgagggtaaacgtaccggggggtgt

SEQ ID NO: 96348 - DNA, 35 bp, Artificial Sequence
  Synthetic oligonucleotide
atagggtgcaggtctgcaagggagggagcgaaatt

SEQ ID NO: 96349 - DNA, 35 bp, Artificial Sequence
  Synthetic oligonucleotide
gatgcatttctacactgtcagagacctccatgctt

SEQ ID NO: 96350 - DNA, 36 bp, Artificial Sequence
  Synthetic oligonucleotide
tggacacgtaaccaggaagggcatgggttcgcgaaa

SEQ ID NO: 96351 - DNA, 35 bp, Artificial Sequence
  Synthetic oligonucleotide
ggacactgtataggatcgaattggtgtgggtgaaa

SEQ ID NO: 96352 - DNA, 35 bp, Artificial Sequence
  Synthetic oligonucleotide
gttaaggggaggaagcaatgggtcttggatagcaa

SEQ ID NO: 96353 - DNA, 36 bp, Artificial Sequence
  Synthetic oligonucleotide
gttcaccgcagtagcgtatctgtcctcctctctcaa

SEQ ID NO: 96354 - DNA, 36 bp, Artificial Sequence
  Synthetic oligonucleotide
atcacggtcctgccgtacatagtttccgccaacgaa

SEQ ID NO: 96355 - DNA, 36 bp, Artificial Sequence
  Synthetic oligonucleotide
agagtgacaaagtgggtacgtgagggaccgaggtaa

SEQ ID NO: 96356 - DNA, 36 bp, Artificial Sequence
  Synthetic oligonucleotide
gagcacatcatttctaactacagactaaaggcaaca

SEQ ID NO: 96357 - DNA, 36 bp, Artificial Sequence
  Synthetic oligonucleotide
tcagtccgcacctcgcttgtccatcgttggacacca

SEQ ID NO: 96358 - DNA, 36 bp, Artificial Sequence
  Synthetic oligonucleotide
aacgcgacgatccatgtacttttgccaagccagcca

SEQ ID NO: 96359 - DNA, 36 bp, Artificial Sequence
  Synthetic oligonucleotide
attggacatgccagcccctgtctatcaccagttcca

SEQ ID NO: 96360 - DNA, 36 bp, Artificial Sequence
  Synthetic oligonucleotide
tgttcggtagtgtgggcaacatcatgcattctatca

SEQ ID NO: 96361 - DNA, 36 bp, Artificial Sequence
  Synthetic oligonucleotide
tcacagcccgataaagtcactgcagttcgatcctca

SEQ ID NO: 96362 - DNA, 37 bp, Artificial Sequence
  Synthetic oligonucleotide
aagtgatgggggttgggtaaatgaagcgggtcaaaga

SEQ ID NO: 96363 - DNA, 35 bp, Artificial Sequence
  Synthetic oligonucleotide
tagtgggggagggggcagtatgtatgataccaaga

SEQ ID NO: 96364 - DNA, 37 bp, Artificial Sequence
  Synthetic oligonucleotide
ggacggtcgggtgagtgggagcggtgctaggggaaga

SEQ ID NO: 96365 - DNA, 37 bp, Artificial Sequence
  Synthetic oligonucleotide
gaccggtgcagaaggattcacgtcagcgggcaccaga

SEQ ID NO: 96366 - DNA, 36 bp, Artificial Sequence
  Synthetic oligonucleotide
gtgaggcggaacatagtattaactttagggaggaga

SEQ ID NO: 96367 - DNA, 37 bp, Artificial Sequence
  Synthetic oligonucleotide
ggacaggaagggaggtgcaacgctacggcaagggaga

SEQ ID NO: 96368 - DNA, 36 bp, Artificial Sequence
  Synthetic oligonucleotide
tctgagagcgactgaggagacaggtagataggtaga

SEQ ID NO: 96369 - DNA, 36 bp, Artificial Sequence
  Synthetic oligonucleotide
ggactctgccgtcagtcatatctctgctcccttaga

SEQ ID NO: 96370 - DNA, 37 bp, Artificial Sequence
  Synthetic oligonucleotide
acgtggggggggcaaagggtggctagataccactcga

SEQ ID NO: 96371 - DNA, 37 bp, Artificial Sequence
  Synthetic oligonucleotide
acgagcacgcatcataggggctagggggagtggagga

SEQ ID NO: 96372 - DNA, 37 bp, Artificial Sequence
  Synthetic oligonucleotide
gagtgtgaaggctgtacatgggctaggatattacgga

SEQ ID NO: 96373 - DNA, 37 bp, Artificial Sequence
  Synthetic oligonucleotide
gtacaggagactaagggggcgaagggaggattgcgga

SEQ ID NO: 96374 - DNA, 36 bp, Artificial Sequence
  Synthetic oligonucleotide
tccacacactcaggccctacagctcgttccaaggga

SEQ ID NO: 96375 - DNA, 37 bp, Artificial Sequence
  Synthetic oligonucleotide
agtcgccgggcaagcaggagcaaggggaagggaggga

SEQ ID NO: 96376 - DNA, 37 bp, Artificial Sequence
  Synthetic oligonucleotide
agtggcgaagcggtggaagaggaagatgagagcggga

SEQ ID NO: 96377 - DNA, 36 bp, Artificial Sequence
  Synthetic oligonucleotide
gagtcagtggccaagagagggagggagcattcggga

SEQ ID NO: 96378 - DNA, 37 bp, Artificial Sequence
  Synthetic oligonucleotide
attgaagagttcagagagggagggcgcacgtggggga

SEQ ID NO: 96379 - DNA, 38 bp, Artificial Sequence
  Synthetic oligonucleotide
acaccgaaacggggtaggaagaagggaaggctcaatga

SEQ ID NO: 96380 - DNA, 38 bp, Artificial Sequence
  Synthetic oligonucleotide
gcacccggtgccaatggcttacgactcaacagacatga

SEQ ID NO: 96381 - DNA, 37 bp, Artificial Sequence
  Synthetic oligonucleotide
acgtacgaagggcactaggagggttggtgagtcatga

SEQ ID NO: 96382 - DNA, 36 bp, Artificial Sequence
  Synthetic oligonucleotide
gcaaccgtacgaagagctccggaactgccccgatga

SEQ ID NO: 96383 - DNA, 38 bp, Artificial Sequence
  Synthetic oligonucleotide
gacatcgggaggcagtgacgggaatggatcgaatatga

SEQ ID NO: 96384 - DNA, 38 bp, Artificial Sequence
  Synthetic oligonucleotide
gaagaggacaggagggttcagcaaggacagcaggctga

SEQ ID NO: 96385 - DNA, 38 bp, Artificial Sequence
  Synthetic oligonucleotide
tagaccaggggtacagtatcaattccgagctggtctga

SEQ ID NO: 96386 - DNA, 38 bp, Artificial Sequence
  Synthetic oligonucleotide
acaacgccgtcccccatgctgcaaggttaagtcagtga

SEQ ID NO: 96387 - DNA, 38 bp, Artificial Sequence
  Synthetic oligonucleotide
aagtggaggtggggcacacaagcagtcacaacgggtga

SEQ ID NO: 96388 - DNA, 38 bp, Artificial Sequence
  Synthetic oligonucleotide
gacgcggtggggggggtctgggttttcgaggcacttga

SEQ ID NO: 96389 - DNA, 38 bp, Artificial Sequence
  Synthetic oligonucleotide
aatgccgacggtatggggcgctccaatgccatccttga

SEQ ID NO: 96390 - DNA, 38 bp, Artificial Sequence
  Synthetic oligonucleotide
tccggtcatcaatgtcgcgtcgacgtcccaactcttga

SEQ ID NO: 96391 - DNA, 37 bp, Artificial Sequence
  Synthetic oligonucleotide
gtgggccgacggactgcatgcactgtctcaaggttga

SEQ ID NO: 96392 - DNA, 35 bp, Artificial Sequence
  Synthetic oligonucleotide
gagtgggcgaattggaggtaaattgagggtgttga

SEQ ID NO: 96393 - DNA, 38 bp, Artificial Sequence
  Synthetic oligonucleotide
gctgagagagcgtcggagtggggtgtgggatagtttga

SEQ ID NO: 96394 - DNA, 37 bp, Artificial Sequence
  Synthetic oligonucleotide
gcacgctgactgctactgttccattaaccgcttttga

SEQ ID NO: 96395 - DNA, 38 bp, Artificial Sequence
  Synthetic oligonucleotide
tgtcccactgtaccgcttcatcaggtcggtctttttga

SEQ ID NO: 96396 - DNA, 36 bp, Artificial Sequence
  Synthetic oligonucleotide
tcacgcgaccctgcctggcttcgttaaccgcgccta

SEQ ID NO: 96397 - DNA, 36 bp, Artificial Sequence
  Synthetic oligonucleotide
acgacgacctaccggcgcaagtattgcgacttccta

SEQ ID NO: 96398 - DNA, 36 bp, Artificial Sequence
  Synthetic oligonucleotide
gacgggggatgggtcgggaactgtggaccggtgcta

SEQ ID NO: 96399 - DNA, 36 bp, Artificial Sequence
  Synthetic oligonucleotide
taacagctcaggagaaaaatcggggtggctaatcta

SEQ ID NO: 96400 - DNA, 36 bp, Artificial Sequence
  Synthetic oligonucleotide
tccaattgcagcagaaggcacacatcactgcatcta

SEQ ID NO: 96401 - DNA, 35 bp, Artificial Sequence
  Synthetic oligonucleotide
accatcaggctctttctggtaacttcaatctggta

SEQ ID NO: 96402 - DNA, 36 bp, Artificial Sequence
  Synthetic oligonucleotide
tcagacggatcggccgaacgggaatggggaattgta

SEQ ID NO: 96403 - DNA, 35 bp, Artificial Sequence
  Synthetic oligonucleotide
gcacggtctcggcacgtttcacaccttagtactta

SEQ ID NO: 96404 - DNA, 34 bp, Artificial Sequence
  Synthetic oligonucleotide
atatagcgcgactcggtccgaacgccctgcctta

SEQ ID NO: 96405 - DNA, 35 bp, Artificial Sequence
  Synthetic oligonucleotide
gacaagttagtcacggggaacagcacctcatttta

SEQ ID NO: 96406 - DNA, 35 bp, Artificial Sequence
  Synthetic oligonucleotide
tgtatcgcaccagttctgatcaacatttttggcac

SEQ ID NO: 96407 - DNA, 35 bp, Artificial Sequence
  Synthetic oligonucleotide
atgctaatcgactctttgccttcctgtgacctgac

SEQ ID NO: 96408 - DNA, 35 bp, Artificial Sequence
  Synthetic oligonucleotide
tcagctcacgtctttctctcataacagcctcttac

SEQ ID NO: 96409 - DNA, 35 bp, Artificial Sequence
  Synthetic oligonucleotide
gtccactccccagtacgtttgtcttacggatttac

SEQ ID NO: 96410 - DNA, 35 bp, Artificial Sequence
  Synthetic oligonucleotide
gtgcgctcatcgcggtgaactgtttctgtctttac

SEQ ID NO: 96411 - DNA, 35 bp, Artificial Sequence
  Synthetic oligonucleotide
atactaccgcgtgagttttctccccatgttcgacc

SEQ ID NO: 96412 - DNA, 35 bp, Artificial Sequence
  Synthetic oligonucleotide
gatacgcgcagagtttcctgcaaacttggcgcccc

SEQ ID NO: 96413 - DNA, 35 bp, Artificial Sequence
  Synthetic oligonucleotide
gaggacgtcataccttcacctgctgagggcctccc

SEQ ID NO: 96414 - DNA, 35 bp, Artificial Sequence
  Synthetic oligonucleotide
gaacaaccacatgcgcccatcgccggacgtcagcc

SEQ ID NO: 96415 - DNA, 35 bp, Artificial Sequence
  Synthetic oligonucleotide
gacgcgcctccgtcaatacaacaccagaagcatcc

SEQ ID NO: 96416 - DNA, 35 bp, Artificial Sequence
  Synthetic oligonucleotide
gtgcgaatcacacattcatcctgggcatctagtcc

SEQ ID NO: 96417 - DNA, 35 bp, Artificial Sequence
  Synthetic oligonucleotide
gaccgaatggatgcctcgattgacctcatgctcgc

SEQ ID NO: 96418 - DNA, 35 bp, Artificial Sequence
  Synthetic oligonucleotide
atgaacacatacactattgtcgtgaacgaggactc

SEQ ID NO: 96419 - DNA, 36 bp, Artificial Sequence
  Synthetic oligonucleotide
atgtgtcgtccacaacattgcgtgatcgctctcttc

SEQ ID NO: 96420 - DNA, 35 bp, Artificial Sequence
  Synthetic oligonucleotide
aaccagtcatctctgagtctgtacttcctgctttc

SEQ ID NO: 96421 - DNA, 35 bp, Artificial Sequence
  Synthetic oligonucleotide
tcaaccgcggtagtggaaagactggaatcctgcag

SEQ ID NO: 96422 - DNA, 35 bp, Artificial Sequence
  Synthetic oligonucleotide
gtcacaggccgttccgcttcggtaaaactacttag

SEQ ID NO: 96423 - DNA, 35 bp, Artificial Sequence
  Synthetic oligonucleotide
agacggggaggggggacttcggagacgacctaacg

SEQ ID NO: 96424 - DNA, 35 bp, Artificial Sequence
  Synthetic oligonucleotide
ggacaagcgcctttttcctagtgctacatcttcgg

SEQ ID NO: 96425 - DNA, 35 bp, Artificial Sequence
  Synthetic oligonucleotide
tagagaccatggtacttcccacatcactgagaggg

SEQ ID NO: 96426 - DNA, 35 bp, Artificial Sequence
  Synthetic oligonucleotide
actgcatcaggcacgtgagtcttcaggaaatgatg

SEQ ID NO: 96427 - DNA, 35 bp, Artificial Sequence
  Synthetic oligonucleotide
gccccgtagcggtctttaatattactgttgcactg

SEQ ID NO: 96428 - DNA, 35 bp, Artificial Sequence
  Synthetic oligonucleotide
gtggggacggggatgagtggggcgatgggcacctg

SEQ ID NO: 96429 - DNA, 35 bp, Artificial Sequence
  Synthetic oligonucleotide
ggaccgtcgagtgtcccaatccacatttacatctg

SEQ ID NO: 96430 - DNA, 35 bp, Artificial Sequence
  Synthetic oligonucleotide
taacgtcgggggcacatggaaggaacgggaaggtg

SEQ ID NO: 96431 - DNA, 35 bp, Artificial Sequence
  Synthetic oligonucleotide
taggaggagggacggtgcaggacttggggtgtttg

SEQ ID NO: 96432 - DNA, 35 bp, Artificial Sequence
  Synthetic oligonucleotide
tcacaagccgccttgtccgagttacccctcccaat

SEQ ID NO: 96433 - DNA, 34 bp, Artificial Sequence
  Synthetic oligonucleotide
gcatacatcctgtgaccacgccggatccacacat

SEQ ID NO: 96434 - DNA, 35 bp, Artificial Sequence
  Synthetic oligonucleotide
tattcgactgctgccaccgcgattttgggagcgat

SEQ ID NO: 96435 - DNA, 35 bp, Artificial Sequence
  Synthetic oligonucleotide
atgcaccccctcctgtacgcactcggattttcgat

SEQ ID NO: 96436 - DNA, 35 bp, Artificial Sequence
  Synthetic oligonucleotide
gagggagtgcgcacagtaacatcatggggggggat

SEQ ID NO: 96437 - DNA, 35 bp, Artificial Sequence
  Synthetic oligonucleotide
atgaacccatcgcagctgcaggccctgcttcctat

SEQ ID NO: 96438 - DNA, 35 bp, Artificial Sequence
  Synthetic oligonucleotide
tcccaggccagaccaggactccactcccaagctat

SEQ ID NO: 96439 - DNA, 35 bp, Artificial Sequence
  Synthetic oligonucleotide
gtgacaccgacgtgagtaatgggtgcccattttat

SEQ ID NO: 96440 - DNA, 35 bp, Artificial Sequence
  Synthetic oligonucleotide
tatcatcccggcgtgcatcagcggtagcgttccct

SEQ ID NO: 96441 - DNA, 35 bp, Artificial Sequence
  Synthetic oligonucleotide
tatgacaatcctgcgccggcttacctgcgacctct

SEQ ID NO: 96442 - DNA, 35 bp, Artificial Sequence
  Synthetic oligonucleotide
gactggagcagaagcgggcggtgcatggattctct

SEQ ID NO: 96443 - DNA, 35 bp, Artificial Sequence
  Synthetic oligonucleotide
ggtcaaagctcacaggcctaggtatcgttctttct

SEQ ID NO: 96444 - DNA, 35 bp, Artificial Sequence
  Synthetic oligonucleotide
tccaccgtagtgtacgtgtcaaacgctccacaagt

SEQ ID NO: 96445 - DNA, 36 bp, Artificial Sequence
  Synthetic oligonucleotide
gacacgagtggcaaagaggaaccgaggcaaattagt

SEQ ID NO: 96446 - DNA, 35 bp, Artificial Sequence
  Synthetic oligonucleotide
taccgcacggtagaagctgggggctggaatacggt

SEQ ID NO: 96447 - DNA, 35 bp, Artificial Sequence
  Synthetic oligonucleotide
tgacgcccaggttcgtagggggaatttatatgctt

SEQ ID NO: 96448 - DNA, 35 bp, Artificial Sequence
  Synthetic oligonucleotide
tagaccacccgcgcgttagcatcgttcacaaggtt

SEQ ID NO: 96449 - DNA, 35 bp, Artificial Sequence
  Synthetic oligonucleotide
ttcaacgcctattgccacttacccatatcggggtt

SEQ ID NO: 96450 - DNA, 35 bp, Artificial Sequence
  Synthetic oligonucleotide
gcgagcaccgcgcctgtccctcttccatctctgtt

SEQ ID NO: 96451 - DNA, 35 bp, Artificial Sequence
  Synthetic oligonucleotide
gacgacgccatgccttactgcttctgtgcacattt

SEQ ID NO: 96452 - DNA, 35 bp, Artificial Sequence
  Synthetic oligonucleotide
gtctcccgaggtgcttccgtatgacgttcgccttt

SEQ ID NO: 96453 - DNA, 35 bp, Artificial Sequence
  Synthetic oligonucleotide
tggatcatcacgtttcgcgtactagtttcatccaa

SEQ ID NO: 96454 - DNA, 36 bp, Artificial Sequence
  Synthetic oligonucleotide
atgtactgcctccattaggtaaagactgggtaggaa

SEQ ID NO: 96455 - DNA, 36 bp, Artificial Sequence
  Synthetic oligonucleotide
acacgtggagactgctgagcaatgtacgggtgggaa

SEQ ID NO: 96456 - DNA, 35 bp, Artificial Sequence
  Synthetic oligonucleotide
aacatgcctgtaggtcaagggaagcaggtatggaa

SEQ ID NO: 96457 - DNA, 36 bp, Artificial Sequence
  Synthetic oligonucleotide
gccgcggagagtgcgggaagggggaagggggtggaa

SEQ ID NO: 96458 - DNA, 36 bp, Artificial Sequence
  Synthetic oligonucleotide
gatagcctggtgggtgcatagggtgagatgactgaa

SEQ ID NO: 96459 - DNA, 35 bp, Artificial Sequence
  Synthetic oligonucleotide
ttgtgcagggcggagggggaagggggtgccggtaa

SEQ ID NO: 96460 - DNA, 36 bp, Artificial Sequence
  Synthetic oligonucleotide
gattgcccctcggacgcgagataaaccatcgcttaa

SEQ ID NO: 96461 - DNA, 36 bp, Artificial Sequence
  Synthetic oligonucleotide
tctaccaccagcatgcctgctaatcgattcttacca

SEQ ID NO: 96462 - DNA, 36 bp, Artificial Sequence
  Synthetic oligonucleotide
gtcactcccgcaacgtagatgaggctgtagtttcca

SEQ ID NO: 96463 - DNA, 36 bp, Artificial Sequence
  Synthetic oligonucleotide
gctaccgcgctggagcctttgattgacaccgtagca

SEQ ID NO: 96464 - DNA, 35 bp, Artificial Sequence
  Synthetic oligonucleotide
accacctcgtggccatgccccatccttccattgca

SEQ ID NO: 96465 - DNA, 36 bp, Artificial Sequence
  Synthetic oligonucleotide
actatcacagagtgatacccgtaactgtatcgatca

SEQ ID NO: 96466 - DNA, 36 bp, Artificial Sequence
  Synthetic oligonucleotide
taacgcacagtcaccgcgtaagccgtaagcctatca

SEQ ID NO: 96467 - DNA, 36 bp, Artificial Sequence
  Synthetic oligonucleotide
gcacgctctgtaacgctaattctgagtaccctctca

SEQ ID NO: 96468 - DNA, 37 bp, Artificial Sequence
  Synthetic oligonucleotide
aggtacggtacgggggggttgaggatcacacttaaga

SEQ ID NO: 96469 - DNA, 36 bp, Artificial Sequence
  Synthetic oligonucleotide
taggaggggagcgaataaacaagacaaccagtcaga

SEQ ID NO: 96470 - DNA, 37 bp, Artificial Sequence
  Synthetic oligonucleotide
accgtagtgcggtacgaagtctaaagaatgagggaga

SEQ ID NO: 96471 - DNA, 37 bp, Artificial Sequence
  Synthetic oligonucleotide
gcgaagcatgtcacctgtgcgctcctcatatgctaga

SEQ ID NO: 96472 - DNA, 37 bp, Artificial Sequence
  Synthetic oligonucleotide
ttgggccgagtgggtggaagaaggcgtacccgttaga

SEQ ID NO: 96473 - DNA, 37 bp, Artificial Sequence
  Synthetic oligonucleotide
tcaaacatgctgtcccccgtaattggtgtcttcacga

SEQ ID NO: 96474 - DNA, 37 bp, Artificial Sequence
  Synthetic oligonucleotide
gcgatcggacgattgcacggacaaagcgaggggacga

SEQ ID NO: 96475 - DNA, 37 bp, Artificial Sequence
  Synthetic oligonucleotide
tgaaaggtggtggttgggttgtgacgtggcattacga

SEQ ID NO: 96476 - DNA, 37 bp, Artificial Sequence
  Synthetic oligonucleotide
gtggagggaacagtcgtgggtgggatagggcaagcga

SEQ ID NO: 96477 - DNA, 35 bp, Artificial Sequence
  Synthetic oligonucleotide
gagagacgcgggtattgtagcacatgaggggagga

SEQ ID NO: 96478 - DNA, 37 bp, Artificial Sequence
  Synthetic oligonucleotide
tatcatgcgcatagaagtgatgaggtgaggaatagga

SEQ ID NO: 96479 - DNA, 37 bp, Artificial Sequence
  Synthetic oligonucleotide
aggacatcaccgaccgtgcctcctaccgtaattagga

SEQ ID NO: 96480 - DNA, 35 bp, Artificial Sequence
  Synthetic oligonucleotide
gatatgaaggtaggggagcgacggccgtcaaggga

SEQ ID NO: 96481 - DNA, 37 bp, Artificial Sequence
  Synthetic oligonucleotide
tgaagcaacgacgcaagcgtaagagaaggagaaggga

SEQ ID NO: 96482 - DNA, 36 bp, Artificial Sequence
  Synthetic oligonucleotide
gacgcgtgtacgcgtggaggataaggtaaagcggga

SEQ ID NO: 96483 - DNA, 37 bp, Artificial Sequence
  Synthetic oligonucleotide
aactgcctgccaccgaagtcatattaagacgggggga

SEQ ID NO: 96484 - DNA, 37 bp, Artificial Sequence
  Synthetic oligonucleotide
ggacctcggtcgggatggtgtatgtctgtgtgtggga

SEQ ID NO: 96485 - DNA, 37 bp, Artificial Sequence
  Synthetic oligonucleotide
tgagagccgcatgcacgtaagtaattgcacccctgga

SEQ ID NO: 96486 - DNA, 37 bp, Artificial Sequence
  Synthetic oligonucleotide
acccacacatgccccctatagacaggatcattctgga

SEQ ID NO: 96487 - DNA, 38 bp, Artificial Sequence
  Synthetic oligonucleotide
gatgcaggccaaggaaataaacgctgccaagacaatga

SEQ ID NO: 96488 - DNA, 38 bp, Artificial Sequence
  Synthetic oligonucleotide
gaccagagcactggaaggggaaagcagtgaacccatga

SEQ ID NO: 96489 - DNA, 37 bp, Artificial Sequence
  Synthetic oligonucleotide
tgcaaagagcgagggggaacggttgatggcgccatga

SEQ ID NO: 96490 - DNA, 38 bp, Artificial Sequence
  Synthetic oligonucleotide
aacgttgggcaggttggttttgtgctgtggccctatga

SEQ ID NO: 96491 - DNA, 37 bp, Artificial Sequence
  Synthetic oligonucleotide
tgaggtggggtgaggaggctggtgcggaagtctatga

SEQ ID NO: 96492 - DNA, 38 bp, Artificial Sequence
  Synthetic oligonucleotide
gatgacacagggagacttaggagggggacggcttatga

SEQ ID NO: 96493 - DNA, 38 bp, Artificial Sequence
  Synthetic oligonucleotide
tgatcagggcaggacacgggcacacacaatccaactga

SEQ ID NO: 96494 - DNA, 37 bp, Artificial Sequence
  Synthetic oligonucleotide
gtagagtcatgaggggaaggacgggtacatcgtctga

SEQ ID NO: 96495 - DNA, 36 bp, Artificial Sequence
  Synthetic oligonucleotide
gcacgtagggtgtgatctcaaccaccttctttctga

SEQ ID NO: 96496 - DNA, 36 bp, Artificial Sequence
  Synthetic oligonucleotide
aactgccgtggcggaatagggccttcagtggagtga

SEQ ID NO: 96497 - DNA, 37 bp, Artificial Sequence
  Synthetic oligonucleotide
agtacgtggcgggttaaatgttgacggaaggacgtga

SEQ ID NO: 96498 - DNA, 36 bp, Artificial Sequence
  Synthetic oligonucleotide
tctccgacctgcagatgtactagtccctgcccgtga

SEQ ID NO: 96499 - DNA, 38 bp, Artificial Sequence
  Synthetic oligonucleotide
gccataagccggagacagtaaaaacgcgaggaaggtga

SEQ ID NO: 96500 - DNA, 37 bp, Artificial Sequence
  Synthetic oligonucleotide
ttactgagcggatcgaaaaaataagcggcggaggtga

SEQ ID NO: 96501 - DNA, 38 bp, Artificial Sequence
  Synthetic oligonucleotide
tgaaggtcggtatgtgcgaggtgggctggagggggtga

SEQ ID NO: 96502 - DNA, 38 bp, Artificial Sequence
  Synthetic oligonucleotide
tccggaacgggaggagaggaggttagggaaccatgtga

SEQ ID NO: 96503 - DNA, 38 bp, Artificial Sequence
  Synthetic oligonucleotide
aaacagcctcggaccatctgataaacacgcccctgtga

SEQ ID NO: 96504 - DNA, 38 bp, Artificial Sequence
  Synthetic oligonucleotide
tcccccctacgccccgtggaaagagctctccgttgtga

SEQ ID NO: 96505 - DNA, 38 bp, Artificial Sequence
  Synthetic oligonucleotide
gcagtactgcgcaacgacattcgagtcatgcaaattga

SEQ ID NO: 96506 - DNA, 37 bp, Artificial Sequence
  Synthetic oligonucleotide
gggagccgaaaaggaacgtagtgggcggctcaattga

SEQ ID NO: 96507 - DNA, 38 bp, Artificial Sequence
  Synthetic oligonucleotide
tgtacaatcggatgtatcatcgcattgcctcttcttga

SEQ ID NO: 96508 - DNA, 38 bp, Artificial Sequence
  Synthetic oligonucleotide
gaggaacccctgtctggccttaggtaagcctattttga

SEQ ID NO: 96509 - DNA, 37 bp, Artificial Sequence
  Synthetic oligonucleotide
acagacccaggaccggtaggttcgagcatttttttga

SEQ ID NO: 96510 - DNA, 35 bp, Artificial Sequence
  Synthetic oligonucleotide
gacaactgagggcggtgggggaagggaaggaaata

SEQ ID NO: 96511 - DNA, 35 bp, Artificial Sequence
  Synthetic oligonucleotide
tgttcagatcctcagattctcctgccactttcata

SEQ ID NO: 96512 - DNA, 36 bp, Artificial Sequence
  Synthetic oligonucleotide
tgcgaaaagaccgctgcataggtctgaggccaacta

SEQ ID NO: 96513 - DNA, 35 bp, Artificial Sequence
  Synthetic oligonucleotide
gtcaactatgcgctccaggtccacacttcaaccta

SEQ ID NO: 96514 - DNA, 35 bp, Artificial Sequence
  Synthetic oligonucleotide
tgtgacaagctatacccggattctaattatgccta

SEQ ID NO: 96515 - DNA, 36 bp, Artificial Sequence
  Synthetic oligonucleotide
tcagccgctaaactgcttgtctattctgtcaacgta

SEQ ID NO: 96516 - DNA, 36 bp, Artificial Sequence
  Synthetic oligonucleotide
tagcctcggcgaagtttgggagatgtgggtaccgta

SEQ ID NO: 96517 - DNA, 36 bp, Artificial Sequence
  Synthetic oligonucleotide
tagtgcaagcaagacggcgtggttcaatctagcgta

SEQ ID NO: 96518 - DNA, 36 bp, Artificial Sequence
  Synthetic oligonucleotide
tccagcccgccttgctatttggcctcttatatcgta

SEQ ID NO: 96519 - DNA, 36 bp, Artificial Sequence
  Synthetic oligonucleotide
gagagggggtgggtggggctctagatggaaagggta

SEQ ID NO: 96520 - DNA, 36 bp, Artificial Sequence
  Synthetic oligonucleotide
acgagagcaaattagttcgggcaggaggagcgggta

SEQ ID NO: 96521 - DNA, 36 bp, Artificial Sequence
  Synthetic oligonucleotide
gttacgtccgggaagtgcacctcctcgtacgttgta

SEQ ID NO: 96522 - DNA, 36 bp, Artificial Sequence
  Synthetic oligonucleotide
tccaggccgaacccaggaaatctggatgaatcctta

SEQ ID NO: 96523 - DNA, 36 bp, Artificial Sequence
  Synthetic oligonucleotide
tgataacgctcaaaaggggaagggtctgagatctta

SEQ ID NO: 96524 - DNA, 36 bp, Artificial Sequence
  Synthetic oligonucleotide
agtccctatccgaatcggatacaccgtgacttctta

SEQ ID NO: 96525 - DNA, 36 bp, Artificial Sequence
  Synthetic oligonucleotide
aacaccagtgcaggtaacggtatgttacgttattta

SEQ ID NO: 96526 - DNA, 36 bp, Artificial Sequence
  Synthetic oligonucleotide
tagtcggtcacgctatatcgaatcggttgggtttta

SEQ ID NO: 96527 - DNA, 35 bp, Artificial Sequence
  Synthetic oligonucleotide
tagatctgagcaccaactgccagcgggttccacac

SEQ ID NO: 96528 - DNA, 35 bp, Artificial Sequence
  Synthetic oligonucleotide
ttgtcctcgatggttgccttgttttgttcctgcac

SEQ ID NO: 96529 - DNA, 35 bp, Artificial Sequence
  Synthetic oligonucleotide
atgacagggggacgaaagtgcctcggtgtgcctac

SEQ ID NO: 96530 - DNA, 35 bp, Artificial Sequence
  Synthetic oligonucleotide
caatcagcacggtcatttaatcgggcactccaccc

SEQ ID NO: 96531 - DNA, 35 bp, Artificial Sequence
  Synthetic oligonucleotide
tgtgcactcagggccctgatgtttctacattcccc

SEQ ID NO: 96532 - DNA, 35 bp, Artificial Sequence
  Synthetic oligonucleotide
tgtagtgcaggtctcttgaaggatttacaatgccc

SEQ ID NO: 96533 - DNA, 35 bp, Artificial Sequence
  Synthetic oligonucleotide
gagacactacttagcgtgattgggggagcagatgc

SEQ ID NO: 96534 - DNA, 35 bp, Artificial Sequence
  Synthetic oligonucleotide
tcacgcggaaccgggtacgggtcggacaaaactgc

SEQ ID NO: 96535 - DNA, 35 bp, Artificial Sequence
  Synthetic oligonucleotide
tcatatgtcgcatgggattgtcgcccgccacttgc

SEQ ID NO: 96536 - DNA, 35 bp, Artificial Sequence
  Synthetic oligonucleotide
gttgaacgtacgtccacctgacacgatgtattgag

SEQ ID NO: 96537 - DNA, 35 bp, Artificial Sequence
  Synthetic oligonucleotide
gagccgcttagacaagctcgagccgccccccctcg

SEQ ID NO: 96538 - DNA, 35 bp, Artificial Sequence
  Synthetic oligonucleotide
ggagtagcgagggaaataaataagggggttgtcgg

SEQ ID NO: 96539 - DNA, 35 bp, Artificial Sequence
  Synthetic oligonucleotide
tgccaacatgggtgagggaggtcttagtatgcggg

SEQ ID NO: 96540 - DNA, 35 bp, Artificial Sequence
  Synthetic oligonucleotide
gccaggggaatatgcagtagcggtgagagacgggg

SEQ ID NO: 96541 - DNA, 35 bp, Artificial Sequence
  Synthetic oligonucleotide
gatagccgcaggaagcaggataagggtggtgcatg

SEQ ID NO: 96542 - DNA, 35 bp, Artificial Sequence
  Synthetic oligonucleotide
acccagccttaactgagcttaccacgacactgttg

SEQ ID NO: 96543 - DNA, 35 bp, Artificial Sequence
  Synthetic oligonucleotide
accatccgtcggtcgtacttcgattatccgggaat

SEQ ID NO: 96544 - DNA, 35 bp, Artificial Sequence
  Synthetic oligonucleotide
gtcaactgctcccggttgtcgttatgttgttccat

SEQ ID NO: 96545 - DNA, 35 bp, Artificial Sequence
  Synthetic oligonucleotide
gatgaagaaggtgagagaccaggactgttagcgat

SEQ ID NO: 96546 - DNA, 35 bp, Artificial Sequence
  Synthetic oligonucleotide
aactacgaaaaggcaaaagacgcttggcgataact

SEQ ID NO: 96547 - DNA, 35 bp, Artificial Sequence
  Synthetic oligonucleotide
ttgcccgcacgattgcttcaacgaatgttcatact

SEQ ID NO: 96548 - DNA, 35 bp, Artificial Sequence
  Synthetic oligonucleotide
tgtagagcggagagttgggctccggtgaagtgggt

SEQ ID NO: 96549 - DNA, 35 bp, Artificial Sequence
  Synthetic oligonucleotide
gccagtcctggcgcgacataagtagttgcatttgt

SEQ ID NO: 96550 - DNA, 35 bp, Artificial Sequence
  Synthetic oligonucleotide
gactacccccaagtggttcgcttctttggcccctt

SEQ ID NO: 96551 - DNA, 35 bp, Artificial Sequence
  Synthetic oligonucleotide
aatccgcacactcggggtaaggcttctgaatcctt

SEQ ID NO: 96552 - DNA, 35 bp, Artificial Sequence
  Synthetic oligonucleotide
tagttcggggtcaggctgaggagtggaggtgagtt

SEQ ID NO: 96553 - DNA, 35 bp, Artificial Sequence
  Synthetic oligonucleotide
gttcacgctggggaaaccaagagcctctgcatgtt

SEQ ID NO: 96554 - DNA, 35 bp, Artificial Sequence
  Synthetic oligonucleotide
acacatagccggcgcctgttctaacgttagtcttt

SEQ ID NO: 96555 - DNA, 35 bp, Artificial Sequence
  Synthetic oligonucleotide
gtgacaggtcccttggttggccgtcacctcttttt

SEQ ID NO: 96556 - DNA, 36 bp, Artificial Sequence
  Synthetic oligonucleotide
gtgcggactgggccgagggtgttggagtagaacaaa

SEQ ID NO: 96557 - DNA, 36 bp, Artificial Sequence
  Synthetic oligonucleotide
tgtagccgactccacttgtgaaaatgcccattcaaa

SEQ ID NO: 96558 - DNA, 36 bp, Artificial Sequence
  Synthetic oligonucleotide
tacatccccagggtgaccagcctagaccccgaccaa

SEQ ID NO: 96559 - DNA, 35 bp, Artificial Sequence
  Synthetic oligonucleotide
gccactcgtcgctaatttgatcaccatgctttcaa

SEQ ID NO: 96560 - DNA, 36 bp, Artificial Sequence
  Synthetic oligonucleotide
ttgtgcatccgactcatccagtgcatctaacgcgaa

SEQ ID NO: 96561 - DNA, 36 bp, Artificial Sequence
  Synthetic oligonucleotide
gcccgggccgggggggataggaagattttcacggaa

SEQ ID NO: 96562 - DNA, 36 bp, Artificial Sequence
  Synthetic oligonucleotide
gacaagtgaagtaatcggcaacagtaaaattcataa

SEQ ID NO: 96563 - DNA, 36 bp, Artificial Sequence
  Synthetic oligonucleotide
actgtcgctgccggttatatcgcttaccttttttaa

SEQ ID NO: 96564 - DNA, 36 bp, Artificial Sequence
  Synthetic oligonucleotide
ttgcgccaccgtctgaattaggtcaactgctgcaca

SEQ ID NO: 96565 - DNA, 36 bp, Artificial Sequence
  Synthetic oligonucleotide
gaccggtgccgcggagatttaatcttgtctttcaca

SEQ ID NO: 96566 - DNA, 36 bp, Artificial Sequence
  Synthetic oligonucleotide
gtgacagaacgaaaaccggtagtaggccgtaagaca

SEQ ID NO: 96567 - DNA, 36 bp, Artificial Sequence
  Synthetic oligonucleotide
gatggagaacgtctgcctttatatgcactcgcgcca

SEQ ID NO: 96568 - DNA, 35 bp, Artificial Sequence
  Synthetic oligonucleotide
gactgggctccgtgtccctgaagctaatctcgcca

SEQ ID NO: 96569 - DNA, 35 bp, Artificial Sequence
  Synthetic oligonucleotide
aacgaaggagcacgcagaactgggtttgttggcca

SEQ ID NO: 96570 - DNA, 35 bp, Artificial Sequence
  Synthetic oligonucleotide
gagacccccacatgcggagaagctctatgtctcca

SEQ ID NO: 96571 - DNA, 36 bp, Artificial Sequence
  Synthetic oligonucleotide
tccgtcaagctgttctccggagaggcctacatcgca

SEQ ID NO: 96572 - DNA, 35 bp, Artificial Sequence
  Synthetic oligonucleotide
gcacgcctacttgccgaccttccagtctcggatca

SEQ ID NO: 96573 - DNA, 36 bp, Artificial Sequence
  Synthetic oligonucleotide
tcccgcccccaggaatgagccagtaattctggatca

SEQ ID NO: 96574 - DNA, 36 bp, Artificial Sequence
  Synthetic oligonucleotide
gtcatacgcctccatcttccctcgactaagtgatca

SEQ ID NO: 96575 - DNA, 36 bp, Artificial Sequence
  Synthetic oligonucleotide
tgcgacgtccagcgagcgcccctttccggttattca

SEQ ID NO: 96576 - DNA, 37 bp, Artificial Sequence
  Synthetic oligonucleotide
acgatggtcatcgttggtgatagaaaacggggaaaga

SEQ ID NO: 96577 - DNA, 37 bp, Artificial Sequence
  Synthetic oligonucleotide
gttgaagaaggaaagtgcagtagcagttagcagaaga

SEQ ID NO: 96578 - DNA, 37 bp, Artificial Sequence
  Synthetic oligonucleotide
acgcaagccgcccggccttttacagcttctcccgaga

SEQ ID NO: 96579 - DNA, 36 bp, Artificial Sequence
  Synthetic oligonucleotide
acgcgcctcccctgtttcaggaaccgcctactgaga

SEQ ID NO: 96580 - DNA, 37 bp, Artificial Sequence
  Synthetic oligonucleotide
gagcgacggaatgagggcacggagggtgacggtgaga

SEQ ID NO: 96581 - DNA, 37 bp, Artificial Sequence
  Synthetic oligonucleotide
tcaaccacttgacgacgggcaggagtccatccataga

SEQ ID NO: 96582 - DNA, 37 bp, Artificial Sequence
  Synthetic oligonucleotide
tagccacacagtctctgcgtcccgctccccagaacga

SEQ ID NO: 96583 - DNA, 37 bp, Artificial Sequence
  Synthetic oligonucleotide
tactggggggcgggtgtggaatggatgtgtaccccga

SEQ ID NO: 96584 - DNA, 37 bp, Artificial Sequence
  Synthetic oligonucleotide
tccgccggcaggcgagaacgtatagcaggccatccga

SEQ ID NO: 96585 - DNA, 38 bp, Artificial Sequence
  Synthetic oligonucleotide
gccagaccccactctgccgaataagcgtgatttcgcga

SEQ ID NO: 96586 - DNA, 37 bp, Artificial Sequence
  Synthetic oligonucleotide
tacgaacgagccggcattagggatgggttgtgttcga

SEQ ID NO: 96587 - DNA, 36 bp, Artificial Sequence
  Synthetic oligonucleotide
actcctactcggccagatgcttcatcactgtacgga

SEQ ID NO: 96588 - DNA, 37 bp, Artificial Sequence
  Synthetic oligonucleotide
gaactcgcctcaattgcggcatacttgtaccatcgga

SEQ ID NO: 96589 - DNA, 37 bp, Artificial Sequence
  Synthetic oligonucleotide
gatgtgtgtccaatgatttaacaagggggaaacggga

SEQ ID NO: 96590 - DNA, 37 bp, Artificial Sequence
  Synthetic oligonucleotide
atagcgagggtgaaggcggatagtggttcgaatggga

SEQ ID NO: 96591 - DNA, 37 bp, Artificial Sequence
  Synthetic oligonucleotide
tgcatgtgaaaggatgtggggatgggcggggtctgga

SEQ ID NO: 96592 - DNA, 37 bp, Artificial Sequence
  Synthetic oligonucleotide
gatggggcggtgcgtagacggtggatttgatggtgga

SEQ ID NO: 96593 - DNA, 38 bp, Artificial Sequence
  Synthetic oligonucleotide
gaacatgagccccatcgacctgacagtcatctcaatga

SEQ ID NO: 96594 - DNA, 38 bp, Artificial Sequence
  Synthetic oligonucleotide
gtcatccgagaggggagattgaggaagggttagaatga

SEQ ID NO: 96595 - DNA, 38 bp, Artificial Sequence
  Synthetic oligonucleotide
acagggtgagggggcggatgaaattaggttgcatatga

SEQ ID NO: 96596 - DNA, 37 bp, Artificial Sequence
  Synthetic oligonucleotide
tgcacaatctgttgctctccactaccaggacctatga

SEQ ID NO: 96597 - DNA, 38 bp, Artificial Sequence
  Synthetic oligonucleotide
gtgcgtagcacgtagggagagactgaaggaagttatga

SEQ ID NO: 96598 - DNA, 37 bp, Artificial Sequence
  Synthetic oligonucleotide
tgtgagcacgatgagggtgaatgatagggctggctga

SEQ ID NO: 96599 - DNA, 38 bp, Artificial Sequence
  Synthetic oligonucleotide
accacaacccagaatgcgatttcagcaggtcatgctga

SEQ ID NO: 96600 - DNA, 38 bp, Artificial Sequence
  Synthetic oligonucleotide
tagtaacgcgcaacacctgtcctcattgacaactctga

SEQ ID NO: 96601 - DNA, 38 bp, Artificial Sequence
  Synthetic oligonucleotide
acacagggtggagcctagtgtgaatgtggcggtagtga

SEQ ID NO: 96602 - DNA, 37 bp, Artificial Sequence
  Synthetic oligonucleotide
tcaggaatcaggtggaggaagggcccagagctcgtga

SEQ ID NO: 96603 - DNA, 38 bp, Artificial Sequence
  Synthetic oligonucleotide
gagacggtatcgaggggaaaacacgcagtctaaggtga

SEQ ID NO: 96604 - DNA, 38 bp, Artificial Sequence
  Synthetic oligonucleotide
aaaccgctcagatgttcgttcgttccttcccgcggtga

SEQ ID NO: 96605 - DNA, 38 bp, Artificial Sequence
  Synthetic oligonucleotide
acgtacgtcgaaatcgtaccaaccactctcttcggtga

SEQ ID NO: 96606 - DNA, 37 bp, Artificial Sequence
  Synthetic oligonucleotide
atgcgatatcgcagatgattcttttacggtggggtga

SEQ ID NO: 96607 - DNA, 38 bp, Artificial Sequence
  Synthetic oligonucleotide
tccacgcgaggagcaaggtggggctggatgaatggtga

SEQ ID NO: 96608 - DNA, 38 bp, Artificial Sequence
  Synthetic oligonucleotide
tcgcagggcgggggttagggagaggttatgaatggtga

SEQ ID NO: 96609 - DNA, 38 bp, Artificial Sequence
  Synthetic oligonucleotide
tgtgcgccccaatatcgtccatatacaggacctggtga

SEQ ID NO: 96610 - DNA, 37 bp, Artificial Sequence
  Synthetic oligonucleotide
ggggaaagctgcagaaagacagggggagggctggtga

SEQ ID NO: 96611 - DNA, 38 bp, Artificial Sequence
  Synthetic oligonucleotide
tcagaggcgaaggatgcgcaggaatgttacgcgtgtga

SEQ ID NO: 96612 - DNA, 38 bp, Artificial Sequence
  Synthetic oligonucleotide
gcaaaccgcagtggtacacagtttatcccgatcattga

SEQ ID NO: 96613 - DNA, 38 bp, Artificial Sequence
  Synthetic oligonucleotide
agtcagggaaggaaggcgatagcgcatctaattattga

SEQ ID NO: 96614 - DNA, 38 bp, Artificial Sequence
  Synthetic oligonucleotide
gatgtgccacgggaaagagttgtaacagctggacttga

SEQ ID NO: 96615 - DNA, 38 bp, Artificial Sequence
  Synthetic oligonucleotide
gccaacggggtaggtgtgcgggagaacggtaaagttga

SEQ ID NO: 96616 - DNA, 38 bp, Artificial Sequence
  Synthetic oligonucleotide
gagtgcacaagtgggagggccggacaaatgcaagttga

SEQ ID NO: 96617 - DNA, 37 bp, Artificial Sequence
  Synthetic oligonucleotide
ggagacgtggggcggaactgaggctagtgaaggttga

SEQ ID NO: 96618 - DNA, 37 bp, Artificial Sequence
  Synthetic oligonucleotide
atcccctgcggcggagagcataggagtatatggttga

SEQ ID NO: 96619 - DNA, 38 bp, Artificial Sequence
  Synthetic oligonucleotide
atgcacaatcggatgggggggacggttatgtagtttga

SEQ ID NO: 96620 - DNA, 38 bp, Artificial Sequence
  Synthetic oligonucleotide
accgaggacggacatagcgtgaggggggaacgttttga

SEQ ID NO: 96621 - DNA, 36 bp, Artificial Sequence
  Synthetic oligonucleotide
gtcatgagtagggggagattcgggaggaattgaata

SEQ ID NO: 96622 - DNA, 36 bp, Artificial Sequence
  Synthetic oligonucleotide
gaagacgccatgctttttacatcacgtctccatata

SEQ ID NO: 96623 - DNA, 35 bp, Artificial Sequence
  Synthetic oligonucleotide
gaacgccttccttagggttgatatttctggtgcta

SEQ ID NO: 96624 - DNA, 36 bp, Artificial Sequence
  Synthetic oligonucleotide
gacggagccagagccgcttactcatcagtgagtcta

SEQ ID NO: 96625 - DNA, 36 bp, Artificial Sequence
  Synthetic oligonucleotide
tgtgaaatgctatccacttcgtgcttcacccacgta

SEQ ID NO: 96626 - DNA, 36 bp, Artificial Sequence
  Synthetic oligonucleotide
gagcgcacaccatcgccctgcataagcgcacgcgta

SEQ ID NO: 96627 - DNA, 36 bp, Artificial Sequence
  Synthetic oligonucleotide
ttagccacccatagccttgaatgtcggttactggta

SEQ ID NO: 96628 - DNA, 36 bp, Artificial Sequence
  Synthetic oligonucleotide
tcctggcccaaattctaccggtcggtactgcttgta

SEQ ID NO: 96629 - DNA, 36 bp, Artificial Sequence
  Synthetic oligonucleotide
gggacggtgcggggagctcgaagccattttttgtta

SEQ ID NO: 96630 - DNA, 35 bp, Artificial Sequence
  Synthetic oligonucleotide
accgaacccttggctgttactgttctgattgccac

SEQ ID NO: 96631 - DNA, 35 bp, Artificial Sequence
  Synthetic oligonucleotide
gaccacagagagcggtaattatcgactgagtcgac

SEQ ID NO: 96632 - DNA, 35 bp, Artificial Sequence
  Synthetic oligonucleotide
gcacgcaaacgagcacccctgtactgtggcaggac

SEQ ID NO: 96633 - DNA, 33 bp, Artificial Sequence
  Synthetic oligonucleotide
gtacacgccacagtctcgtgccctcactatccc

SEQ ID NO: 96634 - DNA, 35 bp, Artificial Sequence
  Synthetic oligonucleotide
acccacgcatcaaggcccctgttaatcaccaggcc

SEQ ID NO: 96635 - DNA, 35 bp, Artificial Sequence
  Synthetic oligonucleotide
tgaatctgctgtcccctgatggtgcttacgcctcc

SEQ ID NO: 96636 - DNA, 35 bp, Artificial Sequence
  Synthetic oligonucleotide
gacggggcaacacaggtgaagatacgtgcttaagc

SEQ ID NO: 96637 - DNA, 35 bp, Artificial Sequence
  Synthetic oligonucleotide
gacaccaccgatgcaacctgtacggtccccatcgc

SEQ ID NO: 96638 - DNA, 35 bp, Artificial Sequence
  Synthetic oligonucleotide
aacgaggagtggtagagctgacgcaaaaagtaggc

SEQ ID NO: 96639 - DNA, 35 bp, Artificial Sequence
  Synthetic oligonucleotide
tgagcgaagcctcttgtccggatcactctccctgc

SEQ ID NO: 96640 - DNA, 35 bp, Artificial Sequence
  Synthetic oligonucleotide
acagaagcaacaacactaccgttttacgagctatc

SEQ ID NO: 96641 - DNA, 35 bp, Artificial Sequence
  Synthetic oligonucleotide
gccacgcaccgcaaccctacacatcccgtgacctc

SEQ ID NO: 96642 - DNA, 35 bp, Artificial Sequence
  Synthetic oligonucleotide
attcgagcaggaaaagcatatcgccaccttaagtc

SEQ ID NO: 96643 - DNA, 35 bp, Artificial Sequence
  Synthetic oligonucleotide
agcggggcgggaaactgaggaaggaacaatatgtc

SEQ ID NO: 96644 - DNA, 35 bp, Artificial Sequence
  Synthetic oligonucleotide
tagacccgggccgctcgtaccagaattagtttgtc

SEQ ID NO: 96645 - DNA, 35 bp, Artificial Sequence
  Synthetic oligonucleotide
tccgcgaacgtgaaatgagcctagttcggggattc

SEQ ID NO: 96646 - DNA, 35 bp, Artificial Sequence
  Synthetic oligonucleotide
gcatgcgccatgactctatccaaacacttgcgttc

SEQ ID NO: 96647 - DNA, 35 bp, Artificial Sequence
  Synthetic oligonucleotide
gtggacaggacgccagggaaaaaagggacagtcag

SEQ ID NO: 96648 - DNA, 35 bp, Artificial Sequence
  Synthetic oligonucleotide
gatgcatccgcgctaccataggcttatcgcttgag

SEQ ID NO: 96649 - DNA, 35 bp, Artificial Sequence
  Synthetic oligonucleotide
gcgcacgggctcccatccgtactgtgaacgtaccg

SEQ ID NO: 96650 - DNA, 35 bp, Artificial Sequence
  Synthetic oligonucleotide
ttggttccacctgacaccctctaagagctctcccg

SEQ ID NO: 96651 - DNA, 35 bp, Artificial Sequence
  Synthetic oligonucleotide
ttgagaccgaaaacgagtaaggcgaagacgagtcg

SEQ ID NO: 96652 - DNA, 35 bp, Artificial Sequence
  Synthetic oligonucleotide
aacctgcacccactcacttaacctacgctacaagg

SEQ ID NO: 96653 - DNA, 35 bp, Artificial Sequence
  Synthetic oligonucleotide
gtcccatgcgcgccaagtaggcctaccttattggg

SEQ ID NO: 96654 - DNA, 35 bp, Artificial Sequence
  Synthetic oligonucleotide
ttgagcagagtagtcagtgagtgagtttagggtgg

SEQ ID NO: 96655 - DNA, 35 bp, Artificial Sequence
  Synthetic oligonucleotide
ttggacccaggtgcgaatgaatcaaggaagtgtgg

SEQ ID NO: 96656 - DNA, 35 bp, Artificial Sequence
  Synthetic oligonucleotide
aactacacggcatactcgcatacatccagcatatg

SEQ ID NO: 96657 - DNA, 35 bp, Artificial Sequence
  Synthetic oligonucleotide
ttgcccgccgagacttaattattagcatggatatg

SEQ ID NO: 96658 - DNA, 35 bp, Artificial Sequence
  Synthetic oligonucleotide
tgcccccacggttgccgcccacaccccgagaaaat

SEQ ID NO: 96659 - DNA, 35 bp, Artificial Sequence
  Synthetic oligonucleotide
tgtgtacggctacacggctcacgtattcctgctat

SEQ ID NO: 96660 - DNA, 35 bp, Artificial Sequence
  Synthetic oligonucleotide
tccctagccacaccttagtatgttgtatctctact

SEQ ID NO: 96661 - DNA, 35 bp, Artificial Sequence
  Synthetic oligonucleotide
tagaccatcacgcgcattgacttgggatatctcct

SEQ ID NO: 96662 - DNA, 35 bp, Artificial Sequence
  Synthetic oligonucleotide
gacagagaacaggtggaaactggctgtgtgtggct

SEQ ID NO: 96663 - DNA, 35 bp, Artificial Sequence
  Synthetic oligonucleotide
tctcgaacgtggtggtgtgcacatcattgggttct

SEQ ID NO: 96664 - DNA, 35 bp, Artificial Sequence
  Synthetic oligonucleotide
tagggtcataaagggcttggcaagggtagggtagt

SEQ ID NO: 96665 - DNA, 35 bp, Artificial Sequence
  Synthetic oligonucleotide
tatcgcctacggtgccctgttttcaagaatcttgt

SEQ ID NO: 96666 - DNA, 36 bp, Artificial Sequence
  Synthetic oligonucleotide
tgatccgccgccctggtagctgggacacatgctaaa

SEQ ID NO: 96667 - DNA, 35 bp, Artificial Sequence
  Synthetic oligonucleotide
tcgatcgtttattgcaataccacgtttcctaccaa

SEQ ID NO: 96668 - DNA, 35 bp, Artificial Sequence
  Synthetic oligonucleotide
gttatgcctcaccagttattggttatcgtttccaa

SEQ ID NO: 96669 - DNA, 36 bp, Artificial Sequence
  Synthetic oligonucleotide
tcaacgcacgcaaatcgaggacgtaaaactctgcaa

SEQ ID NO: 96670 - DNA, 35 bp, Artificial Sequence
  Synthetic oligonucleotide
gattagcgtgaaggcagaatgaagaggggaccgaa

SEQ ID NO: 96671 - DNA, 35 bp, Artificial Sequence
  Synthetic oligonucleotide
ataccccgccgacaattggtataggctgtgggtaa

SEQ ID NO: 96672 - DNA, 36 bp, Artificial Sequence
  Synthetic oligonucleotide
atcacccagtgcagccgaatgcaagctacttattaa

SEQ ID NO: 96673 - DNA, 36 bp, Artificial Sequence
  Synthetic oligonucleotide
gtggtcaggtagagttgaggctgcggggtatggaca

SEQ ID NO: 96674 - DNA, 36 bp, Artificial Sequence
  Synthetic oligonucleotide
gttgcatgccgttcaagaatatctcacgcaactaca

SEQ ID NO: 96675 - DNA, 36 bp, Artificial Sequence
  Synthetic oligonucleotide
tatgaccgacggtgcttcacacgttaaaaccttaca

SEQ ID NO: 96676 - DNA, 36 bp, Artificial Sequence
  Synthetic oligonucleotide
gttgtaacaggctctatatacctctcgtggtctcca

SEQ ID NO: 96677 - DNA, 36 bp, Artificial Sequence
  Synthetic oligonucleotide
gccgacccgtcacgactcttaaaaatcgcaagcgca

SEQ ID NO: 96678 - DNA, 35 bp, Artificial Sequence
  Synthetic oligonucleotide
ggatgtatggtgggaaacaaggactaagtgcggca

SEQ ID NO: 96679 - DNA, 36 bp, Artificial Sequence
  Synthetic oligonucleotide
gacaacgctactcgtacgttatgtgagatgactgca

SEQ ID NO: 96680 - DNA, 36 bp, Artificial Sequence
  Synthetic oligonucleotide
acacccgacatctgaacgctccattttcattctgca

SEQ ID NO: 96681 - DNA, 35 bp, Artificial Sequence
  Synthetic oligonucleotide
tccaacatacgacgtcgatgtcacggcctacatca

SEQ ID NO: 96682 - DNA, 35 bp, Artificial Sequence
  Synthetic oligonucleotide
acgctagcccctagatctacatttagtccttgtca

SEQ ID NO: 96683 - DNA, 36 bp, Artificial Sequence
  Synthetic oligonucleotide
gattgctccccccaggtttgcacgagtgatgattca

SEQ ID NO: 96684 - DNA, 35 bp, Artificial Sequence
  Synthetic oligonucleotide
ggacaagggctgggatgataaacggatagacaaga

SEQ ID NO: 96685 - DNA, 37 bp, Artificial Sequence
  Synthetic oligonucleotide
tgagtgatgcaacgtgctgcagaatctccgagcaaga

SEQ ID NO: 96686 - DNA, 36 bp, Artificial Sequence
  Synthetic oligonucleotide
gcaatgagcgcagggggggacagagccgaacgaaga

SEQ ID NO: 96687 - DNA, 37 bp, Artificial Sequence
  Synthetic oligonucleotide
gaacaccgatcaagctacgaggaggtcagttcgaaga

SEQ ID NO: 96688 - DNA, 37 bp, Artificial Sequence
  Synthetic oligonucleotide
aatcgccgagagaaggtatgtgcgattacgagtaaga

SEQ ID NO: 96689 - DNA, 37 bp, Artificial Sequence
  Synthetic oligonucleotide
gttgtgacagtgagattgtaggtgtgtgggggctaga

SEQ ID NO: 96690 - DNA, 37 bp, Artificial Sequence
  Synthetic oligonucleotide
agactcggtgccagggtcgtattcgggggggagtaga

SEQ ID NO: 96691 - DNA, 37 bp, Artificial Sequence
  Synthetic oligonucleotide
gggtgcaacgagttcgggcatgagcagggattgtaga

SEQ ID NO: 96692 - DNA, 37 bp, Artificial Sequence
  Synthetic oligonucleotide
accgccttatgcaggccctgactaacagtcacaccga

SEQ ID NO: 96693 - DNA, 37 bp, Artificial Sequence
  Synthetic oligonucleotide
tcccacctcctctgtcgtaccgctggcctttactcga

SEQ ID NO: 96694 - DNA, 37 bp, Artificial Sequence
  Synthetic oligonucleotide
gggtagggttgggctgggatggatctaacaggctcga

SEQ ID NO: 96695 - DNA, 37 bp, Artificial Sequence
  Synthetic oligonucleotide
accgcccccttggatgtcgtacgctctaggccccgga

SEQ ID NO: 96696 - DNA, 35 bp, Artificial Sequence
  Synthetic oligonucleotide
aagagtagggcaaaatgcggacacaaaatacggga

SEQ ID NO: 96697 - DNA, 37 bp, Artificial Sequence
  Synthetic oligonucleotide
attcgcgcagataggactggggacgggaggtgctgga

SEQ ID NO: 96698 - DNA, 37 bp, Artificial Sequence
  Synthetic oligonucleotide
tgcagagaagcggaaggaagcgcgggtagggcaatga

SEQ ID NO: 96699 - DNA, 38 bp, Artificial Sequence
  Synthetic oligonucleotide
acatgccagtgttcctgcgtctctatgcgccatcatga

SEQ ID NO: 96700 - DNA, 38 bp, Artificial Sequence
  Synthetic oligonucleotide
taccgataggtgcgaggaatagacagggacggggatga

SEQ ID NO: 96701 - DNA, 37 bp, Artificial Sequence
  Synthetic oligonucleotide
gacgaagggcgcggaaagtaccacaggggcgatatga

SEQ ID NO: 96702 - DNA, 38 bp, Artificial Sequence
  Synthetic oligonucleotide
gatcgctcaacaggagaagcgggacgaagggaaactga

SEQ ID NO: 96703 - DNA, 38 bp, Artificial Sequence
  Synthetic oligonucleotide
gttgcgcaccacggctccttaagcagttactaccctga

SEQ ID NO: 96704 - DNA, 36 bp, Artificial Sequence
  Synthetic oligonucleotide
gtgatcatcccgcagtttatctatccaagtagctga

SEQ ID NO: 96705 - DNA, 38 bp, Artificial Sequence
  Synthetic oligonucleotide
atgcgacaggtagcttgtgcctgcctccctttagctga

SEQ ID NO: 96706 - DNA, 38 bp, Artificial Sequence
  Synthetic oligonucleotide
taactggcgtagggcaaccggagacaggtaacggctga

SEQ ID NO: 96707 - DNA, 38 bp, Artificial Sequence
  Synthetic oligonucleotide
tcccgcggaacggaggagagcggatcaagggctgctga

SEQ ID NO: 96708 - DNA, 36 bp, Artificial Sequence
  Synthetic oligonucleotide
gtgacgcgccaaatcaacaatggggaagctttctga

SEQ ID NO: 96709 - DNA, 38 bp, Artificial Sequence
  Synthetic oligonucleotide
tgtcgtgcacggactcgcatcaattgacctcccagtga

SEQ ID NO: 96710 - DNA, 38 bp, Artificial Sequence
  Synthetic oligonucleotide
gagggtagagagcgagagctaatgagtgaggggagtga

SEQ ID NO: 96711 - DNA, 37 bp, Artificial Sequence
  Synthetic oligonucleotide
gtggtgggcggggggtatacaagtgtgggactcgtga

SEQ ID NO: 96712 - DNA, 38 bp, Artificial Sequence
  Synthetic oligonucleotide
tgaggcgtagggagggagcaaacggacggctttcttga

SEQ ID NO: 96713 - DNA, 38 bp, Artificial Sequence
  Synthetic oligonucleotide
gtcaggacagacagatgttgggggaacggatcggttga

SEQ ID NO: 96714 - DNA, 37 bp, Artificial Sequence
  Synthetic oligonucleotide
gcccaccttcccccatttatttacacagttaatttga

SEQ ID NO: 96715 - DNA, 38 bp, Artificial Sequence
  Synthetic oligonucleotide
gttgaggagaggttgagaaaaagacacattccatttga

SEQ ID NO: 96716 - DNA, 38 bp, Artificial Sequence
  Synthetic oligonucleotide
tagcgcccagattcggccttgctgtaccttcgctttga

SEQ ID NO: 96717 - DNA, 36 bp, Artificial Sequence
  Synthetic oligonucleotide
tgacgtacccaggatggccctcccacatagtacata

SEQ ID NO: 96718 - DNA, 36 bp, Artificial Sequence
  Synthetic oligonucleotide
aacaacgagtgggagggagtctaaattggtagcata

SEQ ID NO: 96719 - DNA, 36 bp, Artificial Sequence
  Synthetic oligonucleotide
agaccccgccatcggtaggtctaaaccagtgcacta

SEQ ID NO: 96720 - DNA, 35 bp, Artificial Sequence
  Synthetic oligonucleotide
tgacatagcctggaattggcctactactacgagta

SEQ ID NO: 96721 - DNA, 36 bp, Artificial Sequence
  Synthetic oligonucleotide
gaacgcagtgggacttgatttctcggttcaaccgta

SEQ ID NO: 96722 - DNA, 36 bp, Artificial Sequence
  Synthetic oligonucleotide
gtgataacgccggaacttaaaagggcaggatgcgta

SEQ ID NO: 96723 - DNA, 35 bp, Artificial Sequence
  Synthetic oligonucleotide
acatccaccgccttgagcttatccgccgcctttta

SEQ ID NO: 96724 - DNA, 35 bp, Artificial Sequence
  Synthetic oligonucleotide
gacgccaccccactataccttccctggtaaggaac

SEQ ID NO: 96725 - DNA, 35 bp, Artificial Sequence
  Synthetic oligonucleotide
gttgtcccagagagtcgttatctctcgttcgtacc

SEQ ID NO: 96726 - DNA, 35 bp, Artificial Sequence
  Synthetic oligonucleotide
gataggtcgaaaaagataacgcactgccatcaccc

SEQ ID NO: 96727 - DNA, 35 bp, Artificial Sequence
  Synthetic oligonucleotide
tagactcaccgcatcccctttggtttcctcgcccc

SEQ ID NO: 96728 - DNA, 35 bp, Artificial Sequence
  Synthetic oligonucleotide
acgcaaacaatcacctctcgattagagaacctccc

SEQ ID NO: 96729 - DNA, 35 bp, Artificial Sequence
  Synthetic oligonucleotide
tggtccacacttcattccgatggtaactgcccgcc

SEQ ID NO: 96730 - DNA, 35 bp, Artificial Sequence
  Synthetic oligonucleotide
tcataggtgaagtgttcctaacgtcgcgatcctcc

SEQ ID NO: 96731 - DNA, 35 bp, Artificial Sequence
  Synthetic oligonucleotide
actccgatgccccggtctggttaattcgcacacgc

SEQ ID NO: 96732 - DNA, 35 bp, Artificial Sequence
  Synthetic oligonucleotide
gagaccggaacatctgctctgttgacacggtacgc

SEQ ID NO: 96733 - DNA, 35 bp, Artificial Sequence
  Synthetic oligonucleotide
acatgaaccaatgcttgttccaggcactggcttgc

SEQ ID NO: 96734 - DNA, 35 bp, Artificial Sequence
  Synthetic oligonucleotide
tgcctgcccttttggaaagcattctatgccccatc

SEQ ID NO: 96735 - DNA, 35 bp, Artificial Sequence
  Synthetic oligonucleotide
agacccgagctctccatcgagctatgacctgcatc

SEQ ID NO: 96736 - DNA, 35 bp, Artificial Sequence
  Synthetic oligonucleotide
acgcggggaggacacttaactgaatagcttgcatc

SEQ ID NO: 96737 - DNA, 35 bp, Artificial Sequence
  Synthetic oligonucleotide
tcccgcctacgccagttacttcccgctgtccactc

SEQ ID NO: 96738 - DNA, 35 bp, Artificial Sequence
  Synthetic oligonucleotide
gcctgtgcacagttatagttccgcagaaccacttc

SEQ ID NO: 96739 - DNA, 35 bp, Artificial Sequence
  Synthetic oligonucleotide
gttgcccataaggcagagcacccccctcttccaag

SEQ ID NO: 96740 - DNA, 35 bp, Artificial Sequence
  Synthetic oligonucleotide
atccccggatggctccctctatggtcgacgtaacg

SEQ ID NO: 96741 - DNA, 35 bp, Artificial Sequence
  Synthetic oligonucleotide
ggatggacgtagtggggagggttgaagggggggcg

SEQ ID NO: 96742 - DNA, 35 bp, Artificial Sequence
  Synthetic oligonucleotide
taccctgactagccccgttccaggttaaatgatcg

SEQ ID NO: 96743 - DNA, 35 bp, Artificial Sequence
  Synthetic oligonucleotide
aaccaaaggaacatcatggagggccagatataggg

SEQ ID NO: 96744 - DNA, 35 bp, Artificial Sequence
  Synthetic oligonucleotide
gagtggaaaaagtaatacggagatgagatgcgtgg

SEQ ID NO: 96745 - DNA, 35 bp, Artificial Sequence
  Synthetic oligonucleotide
tacccgcgcagaaggctaatatagggagaagggtg

SEQ ID NO: 96746 - DNA, 35 bp, Artificial Sequence
  Synthetic oligonucleotide
acacctacagcgcgaaggtccttgataacttgaat

SEQ ID NO: 96747 - DNA, 35 bp, Artificial Sequence
  Synthetic oligonucleotide
actgatccgcattacccccgcttgggtgtcttcat

SEQ ID NO: 96748 - DNA, 35 bp, Artificial Sequence
  Synthetic oligonucleotide
acacacgggcgagtataacgccacctatgagctat

SEQ ID NO: 96749 - DNA, 35 bp, Artificial Sequence
  Synthetic oligonucleotide
ataggccgctgaatagatcgtctcgttccatcgct

SEQ ID NO: 96750 - DNA, 35 bp, Artificial Sequence
  Synthetic oligonucleotide
accatgctgaagttcaccagtgtacttgctactct

SEQ ID NO: 96751 - DNA, 35 bp, Artificial Sequence
  Synthetic oligonucleotide
gacaccctcggagcctgcatccggttaacttctct

SEQ ID NO: 96752 - DNA, 35 bp, Artificial Sequence
  Synthetic oligonucleotide
atggtcaccgtggagtttgggttgctcgtattcgt

SEQ ID NO: 96753 - DNA, 35 bp, Artificial Sequence
  Synthetic oligonucleotide
gtacaatcaggggccaagcagccgtttactcaatt

SEQ ID NO: 96754 - DNA, 35 bp, Artificial Sequence
  Synthetic oligonucleotide
gccctcatcaggccacgtacacatgtcttcgaatt

SEQ ID NO: 96755 - DNA, 35 bp, Artificial Sequence
  Synthetic oligonucleotide
tcatagcgcactggctcatgtggggtcactgcatt

SEQ ID NO: 96756 - DNA, 35 bp, Artificial Sequence
  Synthetic oligonucleotide
actgaccgccaccctgactcctaacacatgtactt

SEQ ID NO: 96757 - DNA, 35 bp, Artificial Sequence
  Synthetic oligonucleotide
gcatcagctccatgcgtaggtcacctctgtctgtt

SEQ ID NO: 96758 - DNA, 35 bp, Artificial Sequence
  Synthetic oligonucleotide
tgttagcagacatggtccgttccatcacacgtgtt

SEQ ID NO: 96759 - DNA, 35 bp, Artificial Sequence
  Synthetic oligonucleotide
gtctagctccccgaacactggtatcgcactggaaa

SEQ ID NO: 96760 - DNA, 35 bp, Artificial Sequence
  Synthetic oligonucleotide
taatgaagggggtatggaggcgcaacaacaatcaa

SEQ ID NO: 96761 - DNA, 36 bp, Artificial Sequence
  Synthetic oligonucleotide
tacgcgaaggcgatggtgtagtggggtgcagagtaa

SEQ ID NO: 96762 - DNA, 36 bp, Artificial Sequence
  Synthetic oligonucleotide
tcacgacaggataccggctggttttgcggggtttaa

SEQ ID NO: 96763 - DNA, 36 bp, Artificial Sequence
  Synthetic oligonucleotide
gatcaggccaagcggagttcgtcacttgattacaca

SEQ ID NO: 96764 - DNA, 36 bp, Artificial Sequence
  Synthetic oligonucleotide
gcaccaccgccgactgtttacgaccgctagagcaca

SEQ ID NO: 96765 - DNA, 35 bp, Artificial Sequence
  Synthetic oligonucleotide
tcacctccgccctgatctacgttttttagtcccca

SEQ ID NO: 96766 - DNA, 36 bp, Artificial Sequence
  Synthetic oligonucleotide
tcctagcacaggggcctctccgggtgcactgttcca

SEQ ID NO: 96767 - DNA, 35 bp, Artificial Sequence
  Synthetic oligonucleotide
acaagtccggccccgatactcatagtcacatagca

SEQ ID NO: 96768 - DNA, 36 bp, Artificial Sequence
  Synthetic oligonucleotide
ttgccggtccccttttcctcactggcgtatctcgca

SEQ ID NO: 96769 - DNA, 36 bp, Artificial Sequence
  Synthetic oligonucleotide
gagagggccaatggagactgggatttgaggcaggca

SEQ ID NO: 96770 - DNA, 35 bp, Artificial Sequence
  Synthetic oligonucleotide
gaaacgtactaaggggtggtatggctgagaaatca

SEQ ID NO: 96771 - DNA, 36 bp, Artificial Sequence
  Synthetic oligonucleotide
attgcgccctccgactgacaatcggacacatgctca

SEQ ID NO: 96772 - DNA, 36 bp, Artificial Sequence
  Synthetic oligonucleotide
tccacgcagaaggtacttccgtagcggtaaacttca

SEQ ID NO: 96773 - DNA, 35 bp, Artificial Sequence
  Synthetic oligonucleotide
actcgatcccaaccaagggaaatgacagactttca

SEQ ID NO: 96774 - DNA, 35 bp, Artificial Sequence
  Synthetic oligonucleotide
gtgcactcgaacagccgccccgacccgccgtttca

SEQ ID NO: 96775 - DNA, 36 bp, Artificial Sequence
  Synthetic oligonucleotide
aacgagatggagaggtgatgatgatggcaagaaaga

SEQ ID NO: 96776 - DNA, 37 bp, Artificial Sequence
  Synthetic oligonucleotide
ggtgggtgcgtgaaggaggatagtggtgctgtgaaga

SEQ ID NO: 96777 - DNA, 37 bp, Artificial Sequence
  Synthetic oligonucleotide
gtgcggagtacggggatggatcataacgcgcaagaga

SEQ ID NO: 96778 - DNA, 37 bp, Artificial Sequence
  Synthetic oligonucleotide
tcacagggggatggaacacagcggcccacagactaga

SEQ ID NO: 96779 - DNA, 37 bp, Artificial Sequence
  Synthetic oligonucleotide
tccaaacacatctgggcctgtttatatctactctaga

SEQ ID NO: 96780 - DNA, 37 bp, Artificial Sequence
  Synthetic oligonucleotide
gacgagggagattcgagtgaacacagggatggttaga

SEQ ID NO: 96781 - DNA, 38 bp, Artificial Sequence
  Synthetic oligonucleotide
tgttggccagggggagggcgagccagtatcgagaacga

SEQ ID NO: 96782 - DNA, 37 bp, Artificial Sequence
  Synthetic oligonucleotide
tcaagcggagaacagtggggttatgaggtacgaccga

SEQ ID NO: 96783 - DNA, 36 bp, Artificial Sequence
  Synthetic oligonucleotide
tacacctccaatcacatcgggtacttctccgaccga

SEQ ID NO: 96784 - DNA, 37 bp, Artificial Sequence
  Synthetic oligonucleotide
gctcgctgcctgttaacagccatcctacccaacccga

SEQ ID NO: 96785 - DNA, 37 bp, Artificial Sequence
  Synthetic oligonucleotide
acatccgacgcgaggacaggataaagtgctggttcga

SEQ ID NO: 96786 - DNA, 36 bp, Artificial Sequence
  Synthetic oligonucleotide
gccaacaagcaatgaagttgagatcgttcgacagga

SEQ ID NO: 96787 - DNA, 37 bp, Artificial Sequence
  Synthetic oligonucleotide
acccacggaaggcgtaaaggagagttcggcgtgagga

SEQ ID NO: 96788 - DNA, 37 bp, Artificial Sequence
  Synthetic oligonucleotide
ggaaaaaggccgagaagagaccggtgacgggggcgga

SEQ ID NO: 96789 - DNA, 36 bp, Artificial Sequence
  Synthetic oligonucleotide
gggaatgagcgcgaggaaaattgaaggcaaaaggga

SEQ ID NO: 96790 - DNA, 37 bp, Artificial Sequence
  Synthetic oligonucleotide
gatgatgaacaatgggtaggctgacgagacgatggga

SEQ ID NO: 96791 - DNA, 37 bp, Artificial Sequence
  Synthetic oligonucleotide
gatggtcgcggaactgggcgtgaaagcacaacctgga

SEQ ID NO: 96792 - DNA, 37 bp, Artificial Sequence
  Synthetic oligonucleotide
tcacgacagagcgtagtgcaacggttactgagctgga

SEQ ID NO: 96793 - DNA, 36 bp, Artificial Sequence
  Synthetic oligonucleotide
accatcagggacgtacggtctcagcacttcagtgga

SEQ ID NO: 96794 - DNA, 37 bp, Artificial Sequence
  Synthetic oligonucleotide
tccgaccgagcgtagagctgcaagatttagtggtgga

SEQ ID NO: 96795 - DNA, 38 bp, Artificial Sequence
  Synthetic oligonucleotide
acagcactcccacagtgctagatgacgcatctaaatga

SEQ ID NO: 96796 - DNA, 37 bp, Artificial Sequence
  Synthetic oligonucleotide
accgcgtacgtacacctgatgtcctctaagccaatga

SEQ ID NO: 96797 - DNA, 38 bp, Artificial Sequence
  Synthetic oligonucleotide
accacggccgaacatcacgtgcttcatactcgccatga

SEQ ID NO: 96798 - DNA, 38 bp, Artificial Sequence
  Synthetic oligonucleotide
aaaccgcacgggcctaagatggttccagttgttcatga

SEQ ID NO: 96799 - DNA, 38 bp, Artificial Sequence
  Synthetic oligonucleotide
atcacgcaccaacgttaagtgcccgccttagattatga

SEQ ID NO: 96800 - DNA, 35 bp, Artificial Sequence
  Synthetic oligonucleotide
actcgcccagcagctgcttgatctataccccctga

SEQ ID NO: 96801 - DNA, 38 bp, Artificial Sequence
  Synthetic oligonucleotide
gtgtgccgcaatgcgcgtgggacgaggaggaaggctga

SEQ ID NO: 96802 - DNA, 38 bp, Artificial Sequence
  Synthetic oligonucleotide
gcacctgcaccagtctgtcgcctcaccatctctgctga

SEQ ID NO: 96803 - DNA, 38 bp, Artificial Sequence
  Synthetic oligonucleotide
gtgggaccgcaccatgccgctagacaactccgttctga

SEQ ID NO: 96804 - DNA, 38 bp, Artificial Sequence
  Synthetic oligonucleotide
tttgctgacggagtgattgtaggtggtggctttggtga

SEQ ID NO: 96805 - DNA, 38 bp, Artificial Sequence
  Synthetic oligonucleotide
ggtgaggctaaagggggaaaaaggatcgtgtcgattga

SEQ ID NO: 96806 - DNA, 38 bp, Artificial Sequence
  Synthetic oligonucleotide
gaccggagtcaaggcaaatgaaggcctgtcaggcttga

SEQ ID NO: 96807 - DNA, 38 bp, Artificial Sequence
  Synthetic oligonucleotide
gagcaccgggcgggaggatgcctgcaggaagaagttga

SEQ ID NO: 96808 - DNA, 38 bp, Artificial Sequence
  Synthetic oligonucleotide
acatacctcggtgggaaactagggacagctttcgttga

SEQ ID NO: 96809 - DNA, 38 bp, Artificial Sequence
  Synthetic oligonucleotide
acgccacaagtgagggcggtgaatgccagggaggttga

SEQ ID NO: 96810 - DNA, 38 bp, Artificial Sequence
  Synthetic oligonucleotide
tgcagaacagatgcttccactgccccgtcctaatttga

SEQ ID NO: 96811 - DNA, 38 bp, Artificial Sequence
  Synthetic oligonucleotide
tccaacgcgctagccgtaagtacacgcgcttcctttga

SEQ ID NO: 96812 - DNA, 37 bp, Artificial Sequence
  Synthetic oligonucleotide
tagccaccgtacattcgcgattgggctccctttttga

SEQ ID NO: 96813 - DNA, 36 bp, Artificial Sequence
  Synthetic oligonucleotide
atggggaggagcgagattgattggtacggtcatata

SEQ ID NO: 96814 - DNA, 35 bp, Artificial Sequence
  Synthetic oligonucleotide
aatccccgctcccttggtttacagatgacgaacta

SEQ ID NO: 96815 - DNA, 34 bp, Artificial Sequence
  Synthetic oligonucleotide
tttgcacgaacagcgtggtgtctttcgcccccta

SEQ ID NO: 96816 - DNA, 37 bp, Artificial Sequence
  Synthetic oligonucleotide
tgtgccgtgccaccttgcactgtatactagtgctcta

SEQ ID NO: 96817 - DNA, 35 bp, Artificial Sequence
  Synthetic oligonucleotide
tgcgcccacgaccgtgaattttgccttatcgcgta

SEQ ID NO: 96818 - DNA, 36 bp, Artificial Sequence
  Synthetic oligonucleotide
gaatggggtagagacggatagccagtttcggagtta

SEQ ID NO: 96819 - DNA, 36 bp, Artificial Sequence
  Synthetic oligonucleotide
gtaaggttcgaaccgggatgaggcggtgataggtta

SEQ ID NO: 96820 - DNA, 36 bp, Artificial Sequence
  Synthetic oligonucleotide
gccactcgccctatggagtgagcgatttccttgtta

SEQ ID NO: 96821 - DNA, 36 bp, Artificial Sequence
  Synthetic oligonucleotide
gtgagctgtgctgggcgaacgtaacctggaaattta

SEQ ID NO: 96822 - DNA, 35 bp, Artificial Sequence
  Synthetic oligonucleotide
atggggcggtaagagtagcccccgccttaatgaac

SEQ ID NO: 96823 - DNA, 35 bp, Artificial Sequence
  Synthetic oligonucleotide
tgcaaagcgatttcagcaccgatcctcgtcgatac

SEQ ID NO: 96824 - DNA, 35 bp, Artificial Sequence
  Synthetic oligonucleotide
atcaggtcggactccaactactgcactggctgacc

SEQ ID NO: 96825 - DNA, 37 bp, Artificial Sequence
  Synthetic oligonucleotide
ggacgccggcgtcttgctggtcctccacacgtctacc

SEQ ID NO: 96826 - DNA, 35 bp, Artificial Sequence
  Synthetic oligonucleotide
gatgccaacaagaggtagaggggaagacgacagcc

SEQ ID NO: 96827 - DNA, 35 bp, Artificial Sequence
  Synthetic oligonucleotide
tccctcccgcgtactcctctcggctagtttcctcc

SEQ ID NO: 96828 - DNA, 35 bp, Artificial Sequence
  Synthetic oligonucleotide
tccgagccgccgggaagctgatcatcataatatgc

SEQ ID NO: 96829 - DNA, 35 bp, Artificial Sequence
  Synthetic oligonucleotide
tagactaacgttgcacatatcaccactgcaattgc

SEQ ID NO: 96830 - DNA, 35 bp, Artificial Sequence
  Synthetic oligonucleotide
tccacggccaacctatgcgttcatgcgccccttgc

SEQ ID NO: 96831 - DNA, 35 bp, Artificial Sequence
  Synthetic oligonucleotide
tgtcacatgccagtggctgtttcaccgtgctaatc

SEQ ID NO: 96832 - DNA, 35 bp, Artificial Sequence
  Synthetic oligonucleotide
gaactcgccaacagagtgtcaggcacttccacctc

SEQ ID NO: 96833 - DNA, 35 bp, Artificial Sequence
  Synthetic oligonucleotide
tacaccaccgtagaaagttgaatggtcatcacctc

SEQ ID NO: 96834 - DNA, 35 bp, Artificial Sequence
  Synthetic oligonucleotide
taacgaaccacccgccgcctacgcgatcacatctc

SEQ ID NO: 96835 - DNA, 35 bp, Artificial Sequence
  Synthetic oligonucleotide
aacacgaggatctgtcaccacacgttatcactgtc

SEQ ID NO: 96836 - DNA, 35 bp, Artificial Sequence
  Synthetic oligonucleotide
tcgagccactgtggttttgccgggctttaattttc

SEQ ID NO: 96837 - DNA, 35 bp, Artificial Sequence
  Synthetic oligonucleotide
atcgacccctctctgcattagcaatcgttacaaag

SEQ ID NO: 96838 - DNA, 35 bp, Artificial Sequence
  Synthetic oligonucleotide
aaccatacaggtgggttcatggttacgtaataccg

SEQ ID NO: 96839 - DNA, 35 bp, Artificial Sequence
  Synthetic oligonucleotide
attgggcccaaactatcctgtcaacgactttctcg

SEQ ID NO: 96840 - DNA, 35 bp, Artificial Sequence
  Synthetic oligonucleotide
actgcagggggtttgtagcaaaataatatgcaggg

SEQ ID NO: 96841 - DNA, 35 bp, Artificial Sequence
  Synthetic oligonucleotide
gaaacgagagcaaaggtgaaacgataatctgttgg

SEQ ID NO: 96842 - DNA, 35 bp, Artificial Sequence
  Synthetic oligonucleotide
accgagaggtaactggtgagttaatcaagagcgtg

SEQ ID NO: 96843 - DNA, 35 bp, Artificial Sequence
  Synthetic oligonucleotide
atgtctgagctccgttcccctatatccaccgcttg

SEQ ID NO: 96844 - DNA, 35 bp, Artificial Sequence
  Synthetic oligonucleotide
gtctggcccacccgagttacgcgcaccctatcttg

SEQ ID NO: 96845 - DNA, 35 bp, Artificial Sequence
  Synthetic oligonucleotide
gaccacggtcttccatatgttagtcttgtcttttg

SEQ ID NO: 96846 - DNA, 35 bp, Artificial Sequence
  Synthetic oligonucleotide
gtgatgccgcatgaccgtggaattaatctgtgcat

SEQ ID NO: 96847 - DNA, 35 bp, Artificial Sequence
  Synthetic oligonucleotide
acccgctgacgactgctctagtcactcgcccttat

SEQ ID NO: 96848 - DNA, 35 bp, Artificial Sequence
  Synthetic oligonucleotide
gacatgagcgtagtcgtcacaaaggcaaactttat

SEQ ID NO: 96849 - DNA, 35 bp, Artificial Sequence
  Synthetic oligonucleotide
gtggagggcaaccagttcgctctaccttgttttat

SEQ ID NO: 96850 - DNA, 35 bp, Artificial Sequence
  Synthetic oligonucleotide
tagtacgcacaccacccagaaacgataagtaatct

SEQ ID NO: 96851 - DNA, 35 bp, Artificial Sequence
  Synthetic oligonucleotide
gtccccacgagcgaactggcttgcgagtgtattct

SEQ ID NO: 96852 - DNA, 35 bp, Artificial Sequence
  Synthetic oligonucleotide
gccaccgcgggcatcatcacagctacacagctagt

SEQ ID NO: 96853 - DNA, 35 bp, Artificial Sequence
  Synthetic oligonucleotide
gtcaccgaccgcaagctgtacgaaaccttattggt

SEQ ID NO: 96854 - DNA, 35 bp, Artificial Sequence
  Synthetic oligonucleotide
gacccacctcggatgtgccttgcagtttgctgtgt

SEQ ID NO: 96855 - DNA, 35 bp, Artificial Sequence
  Synthetic oligonucleotide
atggtagaggagaggaagggcgtacgcatcaaatt

SEQ ID NO: 96856 - DNA, 35 bp, Artificial Sequence
  Synthetic oligonucleotide
tgatccaaccagaattggcctataactgaatgctt

SEQ ID NO: 96857 - DNA, 35 bp, Artificial Sequence
  Synthetic oligonucleotide
gctaagcaggaagaggagttgaaacataagtccaa

SEQ ID NO: 96858 - DNA, 36 bp, Artificial Sequence
  Synthetic oligonucleotide
acgcatgcccaatcacggaaatggtgccggttaaca

SEQ ID NO: 96859 - DNA, 35 bp, Artificial Sequence
  Synthetic oligonucleotide
gagacccacctgtaacgttactggttaccgagaca

SEQ ID NO: 96860 - DNA, 36 bp, Artificial Sequence
  Synthetic oligonucleotide
cctcgccaaatgggcaattccctgtgtttctataca

SEQ ID NO: 96861 - DNA, 35 bp, Artificial Sequence
  Synthetic oligonucleotide
gcaccgcggatgctcctgaaccctactatgctaca

SEQ ID NO: 96862 - DNA, 36 bp, Artificial Sequence
  Synthetic oligonucleotide
acaccccgtcgcggagtcgttaatgcgagcgttaca

SEQ ID NO: 96863 - DNA, 36 bp, Artificial Sequence
  Synthetic oligonucleotide
gacgaagggtcacattcttcgatcctggatctccca

SEQ ID NO: 96864 - DNA, 36 bp, Artificial Sequence
  Synthetic oligonucleotide
atctcgcacggaagggctcctttgaaaccccctcca

SEQ ID NO: 96865 - DNA, 35 bp, Artificial Sequence
  Synthetic oligonucleotide
tacgtcggaactcccatatttagcatcttgacgca

SEQ ID NO: 96866 - DNA, 35 bp, Artificial Sequence
  Synthetic oligonucleotide
actaacctctctgctacatctagtacatggtatca

SEQ ID NO: 96867 - DNA, 36 bp, Artificial Sequence
  Synthetic oligonucleotide
tcttgccgcagcacaatcgagcaaccaccaagctca

SEQ ID NO: 96868 - DNA, 34 bp, Artificial Sequence
  Synthetic oligonucleotide
gaacactgaccgggtgggaggggacctcgaaaga

SEQ ID NO: 96869 - DNA, 37 bp, Artificial Sequence
  Synthetic oligonucleotide
atgccgggtaagggagtaggatagatcaaacacaaga

SEQ ID NO: 96870 - DNA, 37 bp, Artificial Sequence
  Synthetic oligonucleotide
gcacatacggagtgcggggagatgactggaggacaga

SEQ ID NO: 96871 - DNA, 37 bp, Artificial Sequence
  Synthetic oligonucleotide
tacgtgcgacccccttagattttgatcatccttgaga

SEQ ID NO: 96872 - DNA, 37 bp, Artificial Sequence
  Synthetic oligonucleotide
gcatgcctccacgcaagtgtccctctttagacataga

SEQ ID NO: 96873 - DNA, 36 bp, Artificial Sequence
  Synthetic oligonucleotide
tcaaacgcatagtatgggcacaatcccggtacccga

SEQ ID NO: 96874 - DNA, 37 bp, Artificial Sequence
  Synthetic oligonucleotide
gaagtggagagagaatctggatacaggtccggtgcga

SEQ ID NO: 96875 - DNA, 37 bp, Artificial Sequence
  Synthetic oligonucleotide
aactgctggaagggcatggacatatcgtagttatcga

SEQ ID NO: 96876 - DNA, 37 bp, Artificial Sequence
  Synthetic oligonucleotide
atgggcactgggtggagggacggatagggagtctcga

SEQ ID NO: 96877 - DNA, 37 bp, Artificial Sequence
  Synthetic oligonucleotide
tcagaggggatgagggggtggggaattaatcggagga

SEQ ID NO: 96878 - DNA, 37 bp, Artificial Sequence
  Synthetic oligonucleotide
gtccgacggggggcacgaatgaacagtaactggagga

SEQ ID NO: 96879 - DNA, 35 bp, Artificial Sequence
  Synthetic oligonucleotide
gaacggcgtgagatgcggggaatcgctgtggagga

SEQ ID NO: 96880 - DNA, 37 bp, Artificial Sequence
  Synthetic oligonucleotide
ggacaggtacgcaggaaataaggcgcggaggctagga

SEQ ID NO: 96881 - DNA, 37 bp, Artificial Sequence
  Synthetic oligonucleotide
taagcctgacatagggggtgtatagggagcggacgga

SEQ ID NO: 96882 - DNA, 36 bp, Artificial Sequence
  Synthetic oligonucleotide
attggaaagtggagaggggaagcatggagcatcgga

SEQ ID NO: 96883 - DNA, 37 bp, Artificial Sequence
  Synthetic oligonucleotide
tcacacaagttgaaggcgaaacggcaacaggagggga

SEQ ID NO: 96884 - DNA, 36 bp, Artificial Sequence
  Synthetic oligonucleotide
gcatacagcacgtcgtagaagaaggggatgagggga

SEQ ID NO: 96885 - DNA, 37 bp, Artificial Sequence
  Synthetic oligonucleotide
gtgcgggtatcagacacggggaaacgattgtggggga

SEQ ID NO: 96886 - DNA, 37 bp, Artificial Sequence
  Synthetic oligonucleotide
ttcacccccacggatgtgcgatttcctctgtgttgga

SEQ ID NO: 96887 - DNA, 38 bp, Artificial Sequence
  Synthetic oligonucleotide
ttgtcgcacggatgttgtctcttacactctctaaatga

SEQ ID NO: 96888 - DNA, 38 bp, Artificial Sequence
  Synthetic oligonucleotide
ttgatgccgccccatcatggtattgcaattctacatga

SEQ ID NO: 96889 - DNA, 38 bp, Artificial Sequence
  Synthetic oligonucleotide
gcaccgcactaactctgtaatctcgcacgagcccatga

SEQ ID NO: 96890 - DNA, 38 bp, Artificial Sequence
  Synthetic oligonucleotide
atacagcacgagggatcgagcaatagacgtattgatga

SEQ ID NO: 96891 - DNA, 38 bp, Artificial Sequence
  Synthetic oligonucleotide
atggaaaaggtaggtagttaagaggcggaggggtatga

SEQ ID NO: 96892 - DNA, 38 bp, Artificial Sequence
  Synthetic oligonucleotide
gctgcaggcccaggtctgcacttttgtaccatttatga

SEQ ID NO: 96893 - DNA, 38 bp, Artificial Sequence
  Synthetic oligonucleotide
gaagagagaatgggaagagacggaatttgtgatgctga

SEQ ID NO: 96894 - DNA, 38 bp, Artificial Sequence
  Synthetic oligonucleotide
aacgacgccggcgcggtccctctatcaaactggcgtga

SEQ ID NO: 96895 - DNA, 38 bp, Artificial Sequence
  Synthetic oligonucleotide
tctgcggccactttgccggctaattcacgcactcgtga

SEQ ID NO: 96896 - DNA, 36 bp, Artificial Sequence
  Synthetic oligonucleotide
gcacgcgagcagcattaaacaggagagggatggtga

SEQ ID NO: 96897 - DNA, 38 bp, Artificial Sequence
  Synthetic oligonucleotide
agggtggtgccgttgcaggaaaggagcgtttctggtga

SEQ ID NO: 96898 - DNA, 38 bp, Artificial Sequence
  Synthetic oligonucleotide
taacatcatctgccccgtaagtgacgcaccacatgtga

SEQ ID NO: 96899 - DNA, 38 bp, Artificial Sequence
  Synthetic oligonucleotide
gctagtgctgtggtgagagggatgacggggggatgtga

SEQ ID NO: 96900 - DNA, 38 bp, Artificial Sequence
  Synthetic oligonucleotide
gacaacgcactgtgtcgatggttaacaacacgaattga

SEQ ID NO: 96901 - DNA, 38 bp, Artificial Sequence
  Synthetic oligonucleotide
acacaaagcgcatctttgcaccggagggctttcattga

SEQ ID NO: 96902 - DNA, 38 bp, Artificial Sequence
  Synthetic oligonucleotide
taccacccgacgattcttccaatgaactgtgttgttga

SEQ ID NO: 96903 - DNA, 38 bp, Artificial Sequence
  Synthetic oligonucleotide
gatgcgtgaggtgggatccggacatatttagcgtttga

SEQ ID NO: 96904 - DNA, 38 bp, Artificial Sequence
  Synthetic oligonucleotide
tcacagacgtcgccaggggggatgcgggttgggtttga

SEQ ID NO: 96905 - DNA, 38 bp, Artificial Sequence
  Synthetic oligonucleotide
gactgctgtataggccggtacttgagcctcccttttga

SEQ ID NO: 96906 - DNA, 35 bp, Artificial Sequence
  Synthetic oligonucleotide
tcaatgtgctatcaatcgctgaaaagccactcata

SEQ ID NO: 96907 - DNA, 36 bp, Artificial Sequence
  Synthetic oligonucleotide
tgacaacctcctgttacagtcacgtcatcagaccta

SEQ ID NO: 96908 - DNA, 36 bp, Artificial Sequence
  Synthetic oligonucleotide
gattagcatgatgcaagttgtgaggtggaaaagcta

SEQ ID NO: 96909 - DNA, 35 bp, Artificial Sequence
  Synthetic oligonucleotide
gcccccagagaaaaggagtggaggagtggagagta

SEQ ID NO: 96910 - DNA, 36 bp, Artificial Sequence
  Synthetic oligonucleotide
gcacagtgccgttgcaatacgttaaaggatggggta

SEQ ID NO: 96911 - DNA, 35 bp, Artificial Sequence
  Synthetic oligonucleotide
gatgctgcctattcctgtctaaaagcacacgcaac

SEQ ID NO: 96912 - DNA, 35 bp, Artificial Sequence
  Synthetic oligonucleotide
gtccgcatcgtccgtcggtccctgttcctttgtac

SEQ ID NO: 96913 - DNA, 35 bp, Artificial Sequence
  Synthetic oligonucleotide
gctccggggcgctgacttccattcgccggtaaccc

SEQ ID NO: 96914 - DNA, 35 bp, Artificial Sequence
  Synthetic oligonucleotide
taacacgccaggaacggttcagagtaccttaacgc

SEQ ID NO: 96915 - DNA, 35 bp, Artificial Sequence
  Synthetic oligonucleotide
tacacaagcacgctagcaagatcaggttgagatgc

SEQ ID NO: 96916 - DNA, 35 bp, Artificial Sequence
  Synthetic oligonucleotide
gctatggtgagaactaactgtcgctggcttaactc

SEQ ID NO: 96917 - DNA, 35 bp, Artificial Sequence
  Synthetic oligonucleotide
tcgactcgtctcaccttgtctgccttgggttcgtc

SEQ ID NO: 96918 - DNA, 35 bp, Artificial Sequence
  Synthetic oligonucleotide
gacaccgtggaaacgcgcggtggaacggtttggtc

SEQ ID NO: 96919 - DNA, 35 bp, Artificial Sequence
  Synthetic oligonucleotide
gtggaacgccacttaaccccgatcgactgcaattc

SEQ ID NO: 96920 - DNA, 33 bp, Artificial Sequence
  Synthetic oligonucleotide
tccctatcacgggcatgttacttgacgcgtttc

SEQ ID NO: 96921 - DNA, 35 bp, Artificial Sequence
  Synthetic oligonucleotide
tgacgcggcgcccttccccttttacatagcccccg

SEQ ID NO: 96922 - DNA, 35 bp, Artificial Sequence
  Synthetic oligonucleotide
gaaggtggtggcaagagtgatgatggcgtcgggcg

SEQ ID NO: 96923 - DNA, 35 bp, Artificial Sequence
  Synthetic oligonucleotide
agaagccgaacagtaggaggtaggggcgtttgcgg

SEQ ID NO: 96924 - DNA, 35 bp, Artificial Sequence
  Synthetic oligonucleotide
atccccacccgaccaggggtagccaacccataggg

SEQ ID NO: 96925 - DNA, 35 bp, Artificial Sequence
  Synthetic oligonucleotide
tgaaggcggagagggcggtcgctagtgagggaatg

SEQ ID NO: 96926 - DNA, 35 bp, Artificial Sequence
  Synthetic oligonucleotide
gtggggcgtacgggaacaagctgacggaatacgtg

SEQ ID NO: 96927 - DNA, 35 bp, Artificial Sequence
  Synthetic oligonucleotide
gatcaccgcactcatgttgtcactcccttggtttg

SEQ ID NO: 96928 - DNA, 35 bp, Artificial Sequence
  Synthetic oligonucleotide
gacactaacaaacgtctcgaatgaccgggtttcat

SEQ ID NO: 96929 - DNA, 35 bp, Artificial Sequence
  Synthetic oligonucleotide
atcatcagagtgcatggccccgtcactctacaact

SEQ ID NO: 96930 - DNA, 35 bp, Artificial Sequence
  Synthetic oligonucleotide
ttggtccgagactgttctgaatgtagtgccctcct

SEQ ID NO: 96931 - DNA, 35 bp, Artificial Sequence
  Synthetic oligonucleotide
gcactcacagcaagtctctgttccttagcatagct

SEQ ID NO: 96932 - DNA, 35 bp, Artificial Sequence
  Synthetic oligonucleotide
ttgccggctcccaggcctactcgcttgcacttgct

SEQ ID NO: 96933 - DNA, 35 bp, Artificial Sequence
  Synthetic oligonucleotide
gaaactgctacagtgcattctcaactgaaccccgt

SEQ ID NO: 96934 - DNA, 35 bp, Artificial Sequence
  Synthetic oligonucleotide
acgtcgcaacaaaggaaacgggataggagtgtggt

SEQ ID NO: 96935 - DNA, 35 bp, Artificial Sequence
  Synthetic oligonucleotide
gcgccccaggccccgttatgatccatttactttgt

SEQ ID NO: 96936 - DNA, 35 bp, Artificial Sequence
  Synthetic oligonucleotide
gtgcctgatcgtactccgccttggtttctgtcatt

SEQ ID NO: 96937 - DNA, 35 bp, Artificial Sequence
  Synthetic oligonucleotide
tcacaggggactagcagtcgcgacaataaatcctt

SEQ ID NO: 96938 - DNA, 35 bp, Artificial Sequence
  Synthetic oligonucleotide
gccagacgtttgcggctccatcccgtatcacggtt

SEQ ID NO: 96939 - DNA, 35 bp, Artificial Sequence
  Synthetic oligonucleotide
gagtgagagcgcaaagggagtgcgggcgcaaattt

SEQ ID NO: 96940 - DNA, 35 bp, Artificial Sequence
  Synthetic oligonucleotide
ggacactgcacggggacacctgaagataatccttt

SEQ ID NO: 96941 - DNA, 36 bp, Artificial Sequence
  Synthetic oligonucleotide
gaacacaaaggaatgggaagtactggtttcgcgaaa

SEQ ID NO: 96942 - DNA, 36 bp, Artificial Sequence
  Synthetic oligonucleotide
tcacgtgcgcgagagttacacctgagtttgacccaa

SEQ ID NO: 96943 - DNA, 35 bp, Artificial Sequence
  Synthetic oligonucleotide
tcacccatctgccgatcctggatactgtccacgaa

SEQ ID NO: 96944 - DNA, 35 bp, Artificial Sequence
  Synthetic oligonucleotide
tgagacaagtcagccaggtgagtggaaatgaggaa

SEQ ID NO: 96945 - DNA, 35 bp, Artificial Sequence
  Synthetic oligonucleotide
gacaggcgccggagaaagcctacttgcctcaaaca

SEQ ID NO: 96946 - DNA, 35 bp, Artificial Sequence
  Synthetic oligonucleotide
gattggggcgctgaaccaagactggatgtctcaca

SEQ ID NO: 96947 - DNA, 36 bp, Artificial Sequence
  Synthetic oligonucleotide
atcaccattcgatcactatagtcacagcccttacca

SEQ ID NO: 96948 - DNA, 35 bp, Artificial Sequence
  Synthetic oligonucleotide
accactgcccacgcccggtagacgcccgctaccca

SEQ ID NO: 96949 - DNA, 36 bp, Artificial Sequence
  Synthetic oligonucleotide
tcaccacaaccccacgcttaagacgtgctttgccca

SEQ ID NO: 96950 - DNA, 37 bp, Artificial Sequence
  Synthetic oligonucleotide
gatgaccgaggtaggagggtcgcaattgagggaggca

SEQ ID NO: 96951 - DNA, 35 bp, Artificial Sequence
  Synthetic oligonucleotide
tacgcgctcaagtcgaggtacggtaaagaatggca

SEQ ID NO: 96952 - DNA, 37 bp, Artificial Sequence
  Synthetic oligonucleotide
aaccgccgatcagggtggtgaggcggattgaaaaaga

SEQ ID NO: 96953 - DNA, 37 bp, Artificial Sequence
  Synthetic oligonucleotide
ttgagggaagtcgggaatataggtgcagtagggaaga

SEQ ID NO: 96954 - DNA, 36 bp, Artificial Sequence
  Synthetic oligonucleotide
gaaacgccggatggtaagaggcggtaggcacacaga

SEQ ID NO: 96955 - DNA, 35 bp, Artificial Sequence
  Synthetic oligonucleotide
gtgccacaaaaaggtgttagaaggggtgggttaga

SEQ ID NO: 96956 - DNA, 37 bp, Artificial Sequence
  Synthetic oligonucleotide
gtgtcgcgacacacggcttgagaattccgttttacga

SEQ ID NO: 96957 - DNA, 37 bp, Artificial Sequence
  Synthetic oligonucleotide
gttctgcgcccctcctctattgacagtcctataccga

SEQ ID NO: 96958 - DNA, 36 bp, Artificial Sequence
  Synthetic oligonucleotide
gaacacacgtccctgcccgttcttgtatgagcccga

SEQ ID NO: 96959 - DNA, 37 bp, Artificial Sequence
  Synthetic oligonucleotide
gtcgactggtccgaacacatcatcccacgtcatccga

SEQ ID NO: 96960 - DNA, 37 bp, Artificial Sequence
  Synthetic oligonucleotide
tccagagacgggttgtgtggtatatgttatggggcga

SEQ ID NO: 96961 - DNA, 37 bp, Artificial Sequence
  Synthetic oligonucleotide
accgaagacgggagtatgcttgtgcgactcattgcga

SEQ ID NO: 96962 - DNA, 37 bp, Artificial Sequence
  Synthetic oligonucleotide
aaagcacatgcatctacatgaggggtaggggggagga

SEQ ID NO: 96963 - DNA, 37 bp, Artificial Sequence
  Synthetic oligonucleotide
tttgcacgggcgtaacacaataagggcaatgggcgga

SEQ ID NO: 96964 - DNA, 37 bp, Artificial Sequence
  Synthetic oligonucleotide
gattcatcagccgcattactcgaccccttgtctcgga

SEQ ID NO: 96965 - DNA, 37 bp, Artificial Sequence
  Synthetic oligonucleotide
tattgcggggcgggaccatggaacgtacgatgaggga

SEQ ID NO: 96966 - DNA, 37 bp, Artificial Sequence
  Synthetic oligonucleotide
gcaagaggcgagacggggaaagaaaagtagtcgggga

SEQ ID NO: 96967 - DNA, 36 bp, Artificial Sequence
  Synthetic oligonucleotide
tgtggcggagttaggtggatggctgacaagatggga

SEQ ID NO: 96968 - DNA, 37 bp, Artificial Sequence
  Synthetic oligonucleotide
accatcgatcaggtcgctcataaccgctacctatgga

SEQ ID NO: 96969 - DNA, 37 bp, Artificial Sequence
  Synthetic oligonucleotide
tgccagtcccgaaggctggtatatcgcttgatctgga

SEQ ID NO: 96970 - DNA, 36 bp, Artificial Sequence
  Synthetic oligonucleotide
gccacgtcgtactctactgcgcccgcctcaattgga

SEQ ID NO: 96971 - DNA, 37 bp, Artificial Sequence
  Synthetic oligonucleotide
atcccaccgccttggttagtctactggtcgtcttgga

SEQ ID NO: 96972 - DNA, 38 bp, Artificial Sequence
  Synthetic oligonucleotide
tgctacggatgcagacggcgggggagggagcaaaatga

SEQ ID NO: 96973 - DNA, 38 bp, Artificial Sequence
  Synthetic oligonucleotide
gtcgccatgctgctgaccgttaatggcacacataatga

SEQ ID NO: 96974 - DNA, 38 bp, Artificial Sequence
  Synthetic oligonucleotide
aaccccatggccagttgggatggagcgtgatcatatga

SEQ ID NO: 96975 - DNA, 38 bp, Artificial Sequence
  Synthetic oligonucleotide
tgacagacagggagggcagatacagcggcgggaactga

SEQ ID NO: 96976 - DNA, 37 bp, Artificial Sequence
  Synthetic oligonucleotide
gacgaggccagacttgatagtggttgtccccccctga

SEQ ID NO: 96977 - DNA, 38 bp, Artificial Sequence
  Synthetic oligonucleotide
ttcgacctcgcccgttactttgttcagacactccctga

SEQ ID NO: 96978 - DNA, 38 bp, Artificial Sequence
  Synthetic oligonucleotide
gcaacgtgaagtactgagggtgagattcggttagctga

SEQ ID NO: 96979 - DNA, 38 bp, Artificial Sequence
  Synthetic oligonucleotide
tagcacccgtagtgaaaagctccacacatcgatagtga

SEQ ID NO: 96980 - DNA, 38 bp, Artificial Sequence
  Synthetic oligonucleotide
aggacagtaaggcaaggaggggtcaattgacgacgtga

SEQ ID NO: 96981 - DNA, 38 bp, Artificial Sequence
  Synthetic oligonucleotide
gagtgctcaagtagctgctggggaggaggcaaaggtga

SEQ ID NO: 96982 - DNA, 38 bp, Artificial Sequence
  Synthetic oligonucleotide
gtgacctacagggagtacgtcaaagcagtaggaggtga

SEQ ID NO: 96983 - DNA, 37 bp, Artificial Sequence
  Synthetic oligonucleotide
acgacgatgaggttggcggttaagggcggtgtggtga

SEQ ID NO: 96984 - DNA, 38 bp, Artificial Sequence
  Synthetic oligonucleotide
agcacgcagagaagatgaggggagggctagagatgtga

SEQ ID NO: 96985 - DNA, 38 bp, Artificial Sequence
  Synthetic oligonucleotide
acatgtggaagcgctcagtgtatctttgccccacttga

SEQ ID NO: 96986 - DNA, 38 bp, Artificial Sequence
  Synthetic oligonucleotide
gtgggtggtcaggtgataagggaagtgaactatcttga

SEQ ID NO: 96987 - DNA, 36 bp, Artificial Sequence
  Synthetic oligonucleotide
tgtgtcgtccagcactcacgcctgtcccgtcgttga

SEQ ID NO: 96988 - DNA, 38 bp, Artificial Sequence
  Synthetic oligonucleotide
agacaggtggcagtgaaaggttgcgggattgaggttga

SEQ ID NO: 96989 - DNA, 36 bp, Artificial Sequence
  Synthetic oligonucleotide
acactgcggacacatctaagtcgcaacaggatttga

SEQ ID NO: 96990 - DNA, 35 bp, Artificial Sequence
  Synthetic oligonucleotide
gattaatagaccggatgggatgggagcaggagata

SEQ ID NO: 96991 - DNA, 36 bp, Artificial Sequence
  Synthetic oligonucleotide
gccaccccgcctgtttctacttgtacccgtatgcta

SEQ ID NO: 96992 - DNA, 36 bp, Artificial Sequence
  Synthetic oligonucleotide
agcaccaatctgttcagctacctttggtctcacgta

SEQ ID NO: 96993 - DNA, 36 bp, Artificial Sequence
  Synthetic oligonucleotide
ttttagccctgccacgttgcgatcgcagaccttgta

SEQ ID NO: 96994 - DNA, 35 bp, Artificial Sequence
  Synthetic oligonucleotide
gccgttacagcagtactctacccgatctggtcaac

SEQ ID NO: 96995 - DNA, 35 bp, Artificial Sequence
  Synthetic oligonucleotide
accccaaccactcactggtggtgtaagtaacgaac

SEQ ID NO: 96996 - DNA, 35 bp, Artificial Sequence
  Synthetic oligonucleotide
tgcgtgatcgtcggaccagcgcaccctcccggaac

SEQ ID NO: 96997 - DNA, 35 bp, Artificial Sequence
  Synthetic oligonucleotide
aattcgcacacccggttatttattctgcaggtaac

SEQ ID NO: 96998 - DNA, 35 bp, Artificial Sequence
  Synthetic oligonucleotide
atgcctcgccaccactttctggcctacggttccac

SEQ ID NO: 96999 - DNA, 35 bp, Artificial Sequence
  Synthetic oligonucleotide
atcactactgccttccgtgaccggtccaatattac

SEQ ID NO: 97000 - DNA, 35 bp, Artificial Sequence
  Synthetic oligonucleotide
ttcgatcgctccacgtggttacgtactatcaaccc

SEQ ID NO: 97001 - DNA, 35 bp, Artificial Sequence
  Synthetic oligonucleotide
cgaccacccggttaggttaggctccacctcaaccc

SEQ ID NO: 97002 - DNA, 35 bp, Artificial Sequence
  Synthetic oligonucleotide
gatgaggctgaggtggtggtgctaaatggtttgcc

SEQ ID NO: 97003 - DNA, 35 bp, Artificial Sequence
  Synthetic oligonucleotide
aacaggacaggcgtagtgcttgtgtctgtcgttcc

SEQ ID NO: 97004 - DNA, 36 bp, Artificial Sequence
  Synthetic oligonucleotide
cagccatcacgctcgctactctgatcaccggtcggc

SEQ ID NO: 97005 - DNA, 35 bp, Artificial Sequence
  Synthetic oligonucleotide
tcatcactccgtttctcaagccaccgctttgaatc

SEQ ID NO: 97006 - DNA, 35 bp, Artificial Sequence
  Synthetic oligonucleotide
gtgacacaccatgattctatcgactcgcttgggtc

SEQ ID NO: 97007 - DNA, 35 bp, Artificial Sequence
  Synthetic oligonucleotide
tcatcacgcactcgccgtgacatagctcccgcttc

SEQ ID NO: 97008 - DNA, 35 bp, Artificial Sequence
  Synthetic oligonucleotide
gggacggtcgggctccccttgagtcgctggctttc

SEQ ID NO: 97009 - DNA, 35 bp, Artificial Sequence
  Synthetic oligonucleotide
tgcggaggagaaggtgtgcactagggcggtgaaag

SEQ ID NO: 97010 - DNA, 35 bp, Artificial Sequence
  Synthetic oligonucleotide
gactcgtcctgcacccatctgcacttacttgacag

SEQ ID NO: 97011 - DNA, 35 bp, Artificial Sequence
  Synthetic oligonucleotide
gcccacccgcacgacccgccgagtagcaccttgag

SEQ ID NO: 97012 - DNA, 35 bp, Artificial Sequence
  Synthetic oligonucleotide
atgacacgccatcgttctttgagagtttgtttcgg

SEQ ID NO: 97013 - DNA, 35 bp, Artificial Sequence
  Synthetic oligonucleotide
aaaaccggtgtaaggtggatcgaacctgggctggg

SEQ ID NO: 97014 - DNA, 35 bp, Artificial Sequence
  Synthetic oligonucleotide
taataggcgatggggttgggatggcgggggcttgg

SEQ ID NO: 97015 - DNA, 35 bp, Artificial Sequence
  Synthetic oligonucleotide
tcgcaaccttacgcttttaatcgtccaccttcgat

SEQ ID NO: 97016 - DNA, 35 bp, Artificial Sequence
  Synthetic oligonucleotide
gagctcggtccgtatcagaacgagcatgcactact

SEQ ID NO: 97017 - DNA, 35 bp, Artificial Sequence
  Synthetic oligonucleotide
tggaggccacgaagtcgctctaaggtatcctgtct

SEQ ID NO: 97018 - DNA, 35 bp, Artificial Sequence
  Synthetic oligonucleotide
atatcgagcacagcagagctaacgggggagggagt

SEQ ID NO: 97019 - DNA, 35 bp, Artificial Sequence
  Synthetic oligonucleotide
gacatcaagaaagacagggagtgtgagcggatcgt

SEQ ID NO: 97020 - DNA, 35 bp, Artificial Sequence
  Synthetic oligonucleotide
tgcaaacaggcaggggggtcttgaaatgaatcggt

SEQ ID NO: 97021 - DNA, 35 bp, Artificial Sequence
  Synthetic oligonucleotide
acatgcggtcgacctcgttatgtttcctgaatggt

SEQ ID NO: 97022 - DNA, 35 bp, Artificial Sequence
  Synthetic oligonucleotide
ccacgccacccacctcgagcaccaccggtcgtggt

SEQ ID NO: 97023 - DNA, 35 bp, Artificial Sequence
  Synthetic oligonucleotide
gatcaagctgggggctgcacagatcaggtatgatt

SEQ ID NO: 97024 - DNA, 35 bp, Artificial Sequence
  Synthetic oligonucleotide
gtcggaggaggagggatattgcggacggaggcctt

SEQ ID NO: 97025 - DNA, 35 bp, Artificial Sequence
  Synthetic oligonucleotide
gtccgaccagagcggatcagcagttttggcaattt

SEQ ID NO: 97026 - DNA, 36 bp, Artificial Sequence
  Synthetic oligonucleotide
atcagctagcccacaatagtcctccaaagcatccaa

SEQ ID NO: 97027 - DNA, 35 bp, Artificial Sequence
  Synthetic oligonucleotide
accgaccaccctcagttgtgaaacgccccaccgaa

SEQ ID NO: 97028 - DNA, 36 bp, Artificial Sequence
  Synthetic oligonucleotide
tacccatcggtttccagctgatatgccaccacggaa

SEQ ID NO: 97029 - DNA, 35 bp, Artificial Sequence
  Synthetic oligonucleotide
tgtgcaccatctgaactccccttttggtcacctaa

SEQ ID NO: 97030 - DNA, 36 bp, Artificial Sequence
  Synthetic oligonucleotide
acgtccaccgcagctggaattccgtcatctccgtaa

SEQ ID NO: 97031 - DNA, 36 bp, Artificial Sequence
  Synthetic oligonucleotide
ggataccccgcctcgttttggccctcctcgttttaa

SEQ ID NO: 97032 - DNA, 35 bp, Artificial Sequence
  Synthetic oligonucleotide
atgatgcaggtgctggtcgggaagaggggcaaaca

SEQ ID NO: 97033 - DNA, 36 bp, Artificial Sequence
  Synthetic oligonucleotide
tccagccatgccttgttctaccctgcggttctcaca

SEQ ID NO: 97034 - DNA, 36 bp, Artificial Sequence
  Synthetic oligonucleotide
actgcggacagttacatacgttgggtccacttcaca

SEQ ID NO: 97035 - DNA, 35 bp, Artificial Sequence
  Synthetic oligonucleotide
tgatcaaccccccaacttcggtatcgcgacataca

SEQ ID NO: 97036 - DNA, 36 bp, Artificial Sequence
  Synthetic oligonucleotide
ttgtcacccgaagtgcgttttgcctaccttttccca

SEQ ID NO: 97037 - DNA, 35 bp, Artificial Sequence
  Synthetic oligonucleotide
tgcgaaccattgccctagtatcgttgactgtgcca

SEQ ID NO: 97038 - DNA, 37 bp, Artificial Sequence
  Synthetic oligonucleotide
acaccgtccaggactgtctttaccgtgattactcgca

SEQ ID NO: 97039 - DNA, 35 bp, Artificial Sequence
  Synthetic oligonucleotide
tgactgctcgtggccataacataattcttcgggca

SEQ ID NO: 97040 - DNA, 36 bp, Artificial Sequence
  Synthetic oligonucleotide
tgtctcatgtgagggcgggaaggagggttatttgca

SEQ ID NO: 97041 - DNA, 36 bp, Artificial Sequence
  Synthetic oligonucleotide
acgaaagcaagcgtaaatcctggaactggctggtca

SEQ ID NO: 97042 - DNA, 36 bp, Artificial Sequence
  Synthetic oligonucleotide
gacccagtcccatgctttttagcagcctgtatgtca

SEQ ID NO: 97043 - DNA, 36 bp, Artificial Sequence
  Synthetic oligonucleotide
agcatcaggtcggctggcttatctgtacgatgttca

SEQ ID NO: 97044 - DNA, 36 bp, Artificial Sequence
  Synthetic oligonucleotide
tgttggggaacacaggaagcgaagggagaggtttca

SEQ ID NO: 97045 - DNA, 37 bp, Artificial Sequence
  Synthetic oligonucleotide
atgcccgggggatgatacatgccctagtctgaaaaga

SEQ ID NO: 97046 - DNA, 37 bp, Artificial Sequence
  Synthetic oligonucleotide
tagacactcactcgttgctctgtacgtcttccagaga

SEQ ID NO: 97047 - DNA, 36 bp, Artificial Sequence
  Synthetic oligonucleotide
tttgccgccacacacacgcctacacaagacactaga

SEQ ID NO: 97048 - DNA, 37 bp, Artificial Sequence
  Synthetic oligonucleotide
gagctgacctctgccggtttcatcttcttcggaacga

SEQ ID NO: 97049 - DNA, 37 bp, Artificial Sequence
  Synthetic oligonucleotide
tacctcctcatcacacggcacacacccttgtcaccga

SEQ ID NO: 97050 - DNA, 37 bp, Artificial Sequence
  Synthetic oligonucleotide
gatgcaacaggatccatttcaaccgcgattttagcga

SEQ ID NO: 97051 - DNA, 38 bp, Artificial Sequence
  Synthetic oligonucleotide
attgcatggggggaacgcggtaatagggcgtgatgcga

SEQ ID NO: 97052 - DNA, 35 bp, Artificial Sequence
  Synthetic oligonucleotide
gccagctgccactccctgcacaaacgcagacagga

SEQ ID NO: 97053 - DNA, 37 bp, Artificial Sequence
  Synthetic oligonucleotide
gcaaaccgtgccggactaactggaggagagaccagga

SEQ ID NO: 97054 - DNA, 36 bp, Artificial Sequence
  Synthetic oligonucleotide
aaaggtagggtaaaggggtggaggctcagtccagga

SEQ ID NO: 97055 - DNA, 37 bp, Artificial Sequence
  Synthetic oligonucleotide
gcacacagcacgttgcggtgtaggataaaaacccgga

SEQ ID NO: 97056 - DNA, 36 bp, Artificial Sequence
  Synthetic oligonucleotide
tgaacctcggggaatggcctttatgtgacctccgga

SEQ ID NO: 97057 - DNA, 37 bp, Artificial Sequence
  Synthetic oligonucleotide
aaacagatggctgatagaaatagtaggagaacaggga

SEQ ID NO: 97058 - DNA, 37 bp, Artificial Sequence
  Synthetic oligonucleotide
aatggcacatcaagggggcgggggaaagcgacaggga

SEQ ID NO: 97059 - DNA, 37 bp, Artificial Sequence
  Synthetic oligonucleotide
gatccggtagacaggcacatgcatcgaggaaggggga

SEQ ID NO: 97060 - DNA, 37 bp, Artificial Sequence
  Synthetic oligonucleotide
atggttcagggacacagcgtgccagaaagaatgggga

SEQ ID NO: 97061 - DNA, 37 bp, Artificial Sequence
  Synthetic oligonucleotide
gatctcatgcccaatgcggtttttcttcacactggga

SEQ ID NO: 97062 - DNA, 37 bp, Artificial Sequence
  Synthetic oligonucleotide
agtggagccctcactcgttaagccaacccttcatgga

SEQ ID NO: 97063 - DNA, 37 bp, Artificial Sequence
  Synthetic oligonucleotide
gagctgagggttaggccgagggaaggggcatactgga

SEQ ID NO: 97064 - DNA, 38 bp, Artificial Sequence
  Synthetic oligonucleotide
actcccgacgcggtatctccttgtaaggacgtcgatga

SEQ ID NO: 97065 - DNA, 37 bp, Artificial Sequence
  Synthetic oligonucleotide
atgtcgcgacggcctaggaaagaagtatggaggatga

SEQ ID NO: 97066 - DNA, 38 bp, Artificial Sequence
  Synthetic oligonucleotide
gcctggcacgtggcttgaatcgcgtcacgaccttatga

SEQ ID NO: 97067 - DNA, 38 bp, Artificial Sequence
  Synthetic oligonucleotide
gtccagtgccggccgcagtacacgctcaatatttatga

SEQ ID NO: 97068 - DNA, 38 bp, Artificial Sequence
  Synthetic oligonucleotide
ggtgacgcccgtttggcaactatactaatctgtcctga

SEQ ID NO: 97069 - DNA, 38 bp, Artificial Sequence
  Synthetic oligonucleotide
tcttgcccagaaccgattccaactgccatacaagctga

SEQ ID NO: 97070 - DNA, 38 bp, Artificial Sequence
  Synthetic oligonucleotide
ttcacgctacgtacacctgcgaatcgacatctagctga

SEQ ID NO: 97071 - DNA, 37 bp, Artificial Sequence
  Synthetic oligonucleotide
gcacatcgcacgaccttcgctgctacggtccttctga

SEQ ID NO: 97072 - DNA, 38 bp, Artificial Sequence
  Synthetic oligonucleotide
ttgccaccacccgtattgcaagtcaactcaccacgtga

SEQ ID NO: 97073 - DNA, 36 bp, Artificial Sequence
  Synthetic oligonucleotide
gacgacatcgctacgcccgcccagtcattcacgtga

SEQ ID NO: 97074 - DNA, 38 bp, Artificial Sequence
  Synthetic oligonucleotide
gtatgacgttgtggggggagggaagacactgctcgtga

SEQ ID NO: 97075 - DNA, 38 bp, Artificial Sequence
  Synthetic oligonucleotide
atgaggagacagactggtggcattgtggatagatgtga

SEQ ID NO: 97076 - DNA, 38 bp, Artificial Sequence
  Synthetic oligonucleotide
gtgatccgcttacgttataacgcgtttccctactgtga

SEQ ID NO: 97077 - DNA, 37 bp, Artificial Sequence
  Synthetic oligonucleotide
attgcgctagcgagtgtattgtttttgtggagtgtga

SEQ ID NO: 97078 - DNA, 35 bp, Artificial Sequence
  Synthetic oligonucleotide
aacagggagagactggcaagtgaggtttggtgtga

SEQ ID NO: 97079 - DNA, 38 bp, Artificial Sequence
  Synthetic oligonucleotide
accctacgtcaaggggtgatgtcgtaactctcacttga

SEQ ID NO: 97080 - DNA, 37 bp, Artificial Sequence
  Synthetic oligonucleotide
taccgaacagttgacagtggtacgtttcaaaccttga

SEQ ID NO: 97081 - DNA, 37 bp, Artificial Sequence
  Synthetic oligonucleotide
acaggggcgaagggagcgataagtcaagtaaggttga

SEQ ID NO: 97082 - DNA, 37 bp, Artificial Sequence
  Synthetic oligonucleotide
aagtactgaacagagtgtacaggagtgtcggggttga

SEQ ID NO: 97083 - DNA, 36 bp, Artificial Sequence
  Synthetic oligonucleotide
gacacttaccagatggttacattgtggggttgcata

SEQ ID NO: 97084 - DNA, 36 bp, Artificial Sequence
  Synthetic oligonucleotide
actgtgacagccccatggtggtcacgttccccgata

SEQ ID NO: 97085 - DNA, 35 bp, Artificial Sequence
  Synthetic oligonucleotide
atgtgaccgactctgcgtagaaaggtcggttgata

SEQ ID NO: 97086 - DNA, 36 bp, Artificial Sequence
  Synthetic oligonucleotide
agggcgctcgaagccctatgctcatgtactcttata

SEQ ID NO: 97087 - DNA, 35 bp, Artificial Sequence
  Synthetic oligonucleotide
acaccacctcagtacactcaacctgtccaacgtta

SEQ ID NO: 97088 - DNA, 35 bp, Artificial Sequence
  Synthetic oligonucleotide
tacgctgtcgcaacatttttttagtcatctcttta

SEQ ID NO: 97089 - DNA, 35 bp, Artificial Sequence
  Synthetic oligonucleotide
tcgaccggtcggccttttttccttcttgcacaaac

SEQ ID NO: 97090 - DNA, 35 bp, Artificial Sequence
  Synthetic oligonucleotide
gtcgcctcgcattgtcgccacttctttcgcaacac

SEQ ID NO: 97091 - DNA, 35 bp, Artificial Sequence
  Synthetic oligonucleotide
acgttgtggagggggggtagggacaggcggatcac

SEQ ID NO: 97092 - DNA, 35 bp, Artificial Sequence
  Synthetic oligonucleotide
gaaccatccactttcgactatacgcaggggagtac

SEQ ID NO: 97093 - DNA, 35 bp, Artificial Sequence
  Synthetic oligonucleotide
gcaccacgaactgctcagcccggccactgtcttac

SEQ ID NO: 97094 - DNA, 35 bp, Artificial Sequence
  Synthetic oligonucleotide
ttgacctgggtgggccaggaataaagggggtttac

SEQ ID NO: 97095 - DNA, 35 bp, Artificial Sequence
  Synthetic oligonucleotide
tcgacgagcacattttcatcctgtctcaggacacc

SEQ ID NO: 97096 - DNA, 35 bp, Artificial Sequence
  Synthetic oligonucleotide
aagcgaactcgaactgctggtgatatgtcctgccc

SEQ ID NO: 97097 - DNA, 35 bp, Artificial Sequence
  Synthetic oligonucleotide
agacatctcagtccccaagcatgcactaggtctcc

SEQ ID NO: 97098 - DNA, 35 bp, Artificial Sequence
  Synthetic oligonucleotide
tgcaccccgtatcgtggacttagcgcggttcttcc

SEQ ID NO: 97099 - DNA, 35 bp, Artificial Sequence
  Synthetic oligonucleotide
atgcgccgcccatgctatgccttttagctccacgc

SEQ ID NO: 97100 - DNA, 35 bp, Artificial Sequence
  Synthetic oligonucleotide
tgtgccctccagctgactcccccagtcatctacgc

SEQ ID NO: 97101 - DNA, 35 bp, Artificial Sequence
  Synthetic oligonucleotide
gacaccagcttctattaggtccttcaacaacgcgc

SEQ ID NO: 97102 - DNA, 35 bp, Artificial Sequence
  Synthetic oligonucleotide
gagacgcaaggtactagaggtagtatggtgtaggc

SEQ ID NO: 97103 - DNA, 35 bp, Artificial Sequence
  Synthetic oligonucleotide
taaccgcactgttgcgatttttctacgagtccatc

SEQ ID NO: 97104 - DNA, 35 bp, Artificial Sequence
  Synthetic oligonucleotide
tcctacgcccagtttcccatgctcaacgaggtatc

SEQ ID NO: 97105 - DNA, 35 bp, Artificial Sequence
  Synthetic oligonucleotide
tcccaacctcaccgtgacctcattgtaccgaagtc

SEQ ID NO: 97106 - DNA, 35 bp, Artificial Sequence
  Synthetic oligonucleotide
taacgccgccaccaggggagcttagggaagggttc

SEQ ID NO: 97107 - DNA, 35 bp, Artificial Sequence
  Synthetic oligonucleotide
tgtggcccccgcctcacttgatagctacattatag

SEQ ID NO: 97108 - DNA, 35 bp, Artificial Sequence
  Synthetic oligonucleotide
atatgcccacgtcccaggaagcacacgatccctcg

SEQ ID NO: 97109 - DNA, 35 bp, Artificial Sequence
  Synthetic oligonucleotide
agttcggggaaagtgatggaagcgcgaaggaatgg

SEQ ID NO: 97110 - DNA, 35 bp, Artificial Sequence
  Synthetic oligonucleotide
tatgtcctcagcctccctagcccgcctctccatgg

SEQ ID NO: 97111 - DNA, 35 bp, Artificial Sequence
  Synthetic oligonucleotide
agagcacccacaccacgcacagctaacgtaatgtg

SEQ ID NO: 97112 - DNA, 35 bp, Artificial Sequence
  Synthetic oligonucleotide
tgcaatccgttcacattctacctggagttgctttg

SEQ ID NO: 97113 - DNA, 35 bp, Artificial Sequence
  Synthetic oligonucleotide
aatcgatgatcagcagtacacagaccctgtcacat

SEQ ID NO: 97114 - DNA, 35 bp, Artificial Sequence
  Synthetic oligonucleotide
gtgcgctcattcggttctttcaagtcataatccat

SEQ ID NO: 97115 - DNA, 35 bp, Artificial Sequence
  Synthetic oligonucleotide
acttgccgcccaggtcgaagtagatctgggctact

SEQ ID NO: 97116 - DNA, 36 bp, Artificial Sequence
  Synthetic oligonucleotide
gacccagtccacttcggccccataagtacacgcaaa

SEQ ID NO: 97117 - DNA, 36 bp, Artificial Sequence
  Synthetic oligonucleotide
tgagtggtgggtgggtataggcggtgcactgggaaa

SEQ ID NO: 97118 - DNA, 36 bp, Artificial Sequence
  Synthetic oligonucleotide
tgcctccacacgctgctgagcaccgtttttctacaa

SEQ ID NO: 97119 - DNA, 36 bp, Artificial Sequence
  Synthetic oligonucleotide
actacgccgaggtacgacggcaatccagtatcctaa

SEQ ID NO: 97120 - DNA, 35 bp, Artificial Sequence
  Synthetic oligonucleotide
agacgctcagcagcccaattcgccatccccgctaa

SEQ ID NO: 97121 - DNA, 37 bp, Artificial Sequence
  Synthetic oligonucleotide
gacgaaggcacgggaaggaaatggtgggggctaaaca

SEQ ID NO: 97122 - DNA, 35 bp, Artificial Sequence
  Synthetic oligonucleotide
tctaacaccaccttctatgggcaatggtttacaca

SEQ ID NO: 97123 - DNA, 36 bp, Artificial Sequence
  Synthetic oligonucleotide
gatacgcgtaatcacgtctacctagactcgtaccca

SEQ ID NO: 97124 - DNA, 35 bp, Artificial Sequence
  Synthetic oligonucleotide
tctgacgcaccgttactccttgaacaggaggccca

SEQ ID NO: 97125 - DNA, 36 bp, Artificial Sequence
  Synthetic oligonucleotide
tgttccgcgctgggtcacgtttcagcctccattgca

SEQ ID NO: 97126 - DNA, 35 bp, Artificial Sequence
  Synthetic oligonucleotide
tgatcgccgctgcgaactggccagtgtgactatca

SEQ ID NO: 97127 - DNA, 36 bp, Artificial Sequence
  Synthetic oligonucleotide
caagcacaggtccacgtgcctcagaatgattattca

SEQ ID NO: 97128 - DNA, 37 bp, Artificial Sequence
  Synthetic oligonucleotide
gagagggtagagggggccctgaggtgtacagtcaaga

SEQ ID NO: 97129 - DNA, 38 bp, Artificial Sequence
  Synthetic oligonucleotide
gtgcctcggccgagtttacagcgagagtggggaacaga

SEQ ID NO: 97130 - DNA, 37 bp, Artificial Sequence
  Synthetic oligonucleotide
accagtgcgtagggaagcgagaggagaccggaagaga

SEQ ID NO: 97131 - DNA, 36 bp, Artificial Sequence
  Synthetic oligonucleotide
tacactgcccgtttcgtaggaagcctctcctggaga

SEQ ID NO: 97132 - DNA, 37 bp, Artificial Sequence
  Synthetic oligonucleotide
agtgacgcgtcctctgctcactcggccttcctaacga

SEQ ID NO: 97133 - DNA, 37 bp, Artificial Sequence
  Synthetic oligonucleotide
ggacaacaaccgattctgatacacgacttccacacga

SEQ ID NO: 97134 - DNA, 37 bp, Artificial Sequence
  Synthetic oligonucleotide
aaccgccacctcgcaatccgcctttgagttcctacga

SEQ ID NO: 97135 - DNA, 37 bp, Artificial Sequence
  Synthetic oligonucleotide
gatcgactgacccagatacgcattttcgctgatccga

SEQ ID NO: 97136 - DNA, 37 bp, Artificial Sequence
  Synthetic oligonucleotide
gagacggcctaagctggacgaaggactatgggagcga

SEQ ID NO: 97137 - DNA, 37 bp, Artificial Sequence
  Synthetic oligonucleotide
gccggagtgggagagagggataacagctttactgcga

SEQ ID NO: 97138 - DNA, 37 bp, Artificial Sequence
  Synthetic oligonucleotide
ggtgcacaacaattacgactacggtgtcagctctcga

SEQ ID NO: 97139 - DNA, 36 bp, Artificial Sequence
  Synthetic oligonucleotide
acacatggagtggcacacaagtgtatgtgctctcga

SEQ ID NO: 97140 - DNA, 37 bp, Artificial Sequence
  Synthetic oligonucleotide
tgcggatgggaatgctcatgtggcatggtgggacgga

SEQ ID NO: 97141 - DNA, 37 bp, Artificial Sequence
  Synthetic oligonucleotide
gcatgaggtacgcatgcacggtaaatgtgcataggga

SEQ ID NO: 97142 - DNA, 37 bp, Artificial Sequence
  Synthetic oligonucleotide
taatgccgcccctcgacacagtcctttatattgggga

SEQ ID NO: 97143 - DNA, 36 bp, Artificial Sequence
  Synthetic oligonucleotide
tgcaaccaccttctaccgcggactattcacctggga

SEQ ID NO: 97144 - DNA, 38 bp, Artificial Sequence
  Synthetic oligonucleotide
gtggtgggaaaaggtagtacagggacttatgagtggga

SEQ ID NO: 97145 - DNA, 37 bp, Artificial Sequence
  Synthetic oligonucleotide
tacacgcacacccgagctgtcgagcgatccccgtgga

SEQ ID NO: 97146 - DNA, 37 bp, Artificial Sequence
  Synthetic oligonucleotide
ggtgtcaagcgtgaactgcaggatagatgatggtgga

SEQ ID NO: 97147 - DNA, 37 bp, Artificial Sequence
  Synthetic oligonucleotide
atcgacaccacctctaacagtaaagcgatacattgga

SEQ ID NO: 97148 - DNA, 37 bp, Artificial Sequence
  Synthetic oligonucleotide
gcaatgacgcacatcaatcggacacactgggcttgga

SEQ ID NO: 97149 - DNA, 38 bp, Artificial Sequence
  Synthetic oligonucleotide
tcaacgggggaggttggaaactggaacgagaataatga

SEQ ID NO: 97150 - DNA, 37 bp, Artificial Sequence
  Synthetic oligonucleotide
actgccatcggccccctccctgatcccttggccatga

SEQ ID NO: 97151 - DNA, 35 bp, Artificial Sequence
  Synthetic oligonucleotide
gactagggatgggacataacggggagttgtactga

SEQ ID NO: 97152 - DNA, 38 bp, Artificial Sequence
  Synthetic oligonucleotide
tccacgcaacagccccggacacacctggattctcctga

SEQ ID NO: 97153 - DNA, 38 bp, Artificial Sequence
  Synthetic oligonucleotide
gtgacgtatgtgccatcggatacccttgcctctagtga

SEQ ID NO: 97154 - DNA, 38 bp, Artificial Sequence
  Synthetic oligonucleotide
aaagcatgggggtgtggtgttggatggaacggtcgtga

SEQ ID NO: 97155 - DNA, 37 bp, Artificial Sequence
  Synthetic oligonucleotide
gagtagaggaagttgtggaaggggaggaataaggtga

SEQ ID NO: 97156 - DNA, 37 bp, Artificial Sequence
  Synthetic oligonucleotide
tagggacatacaaaggcgaatagcgatagggaggtga

SEQ ID NO: 97157 - DNA, 38 bp, Artificial Sequence
  Synthetic oligonucleotide
acacccccggcgtatggtgccctctcgacattttgtga

SEQ ID NO: 97158 - DNA, 38 bp, Artificial Sequence
  Synthetic oligonucleotide
gtgacaggggcggtcggcctgctggatcttcaccttga

SEQ ID NO: 97159 - DNA, 38 bp, Artificial Sequence
  Synthetic oligonucleotide
gaactgcgctgtctgtttgttcacgctccgttcgttga

SEQ ID NO: 97160 - DNA, 36 bp, Artificial Sequence
  Synthetic oligonucleotide
aacctgacgccactgggggggaaagacggtggttga

SEQ ID NO: 97161 - DNA, 37 bp, Artificial Sequence
  Synthetic oligonucleotide
gtgatgtggagaactgtggtgggcgggaccttgttga

SEQ ID NO: 97162 - DNA, 36 bp, Artificial Sequence
  Synthetic oligonucleotide
tgctcatcagcttactagccgccttgccttgacata

SEQ ID NO: 97163 - DNA, 35 bp, Artificial Sequence
  Synthetic oligonucleotide
tcctcatgccgaacatcgggccccaacatactata

SEQ ID NO: 97164 - DNA, 35 bp, Artificial Sequence
  Synthetic oligonucleotide
gcaatgcccagtctcggtttcccgtgcgaatccta

SEQ ID NO: 97165 - DNA, 36 bp, Artificial Sequence
  Synthetic oligonucleotide
tacacaccgcataaggggagtccttcacgacatcta

SEQ ID NO: 97166 - DNA, 35 bp, Artificial Sequence
  Synthetic oligonucleotide
acactagccctgtgagtaacactgacccgcacgta

SEQ ID NO: 97167 - DNA, 35 bp, Artificial Sequence
  Synthetic oligonucleotide
agcggactcgccacgttgaacttgacctgtcgaac

SEQ ID NO: 97168 - DNA, 36 bp, Artificial Sequence
  Synthetic oligonucleotide
atagtgcggggctaaacgagtaggaaaggaaggcac

SEQ ID NO: 97169 - DNA, 35 bp, Artificial Sequence
  Synthetic oligonucleotide
gaccgaacagacagcgggcattcgcttctttgtac

SEQ ID NO: 97170 - DNA, 35 bp, Artificial Sequence
  Synthetic oligonucleotide
tgtcgccccggtcctttataacccctcctgcgccc

SEQ ID NO: 97171 - DNA, 33 bp, Artificial Sequence
  Synthetic oligonucleotide
gagacgctgcccgctttcacttgcgccgttccc

SEQ ID NO: 97172 - DNA, 35 bp, Artificial Sequence
  Synthetic oligonucleotide
gtagtgtgccgcgatttgcatctgttcactgggcc

SEQ ID NO: 97173 - DNA, 35 bp, Artificial Sequence
  Synthetic oligonucleotide
ttgtcacgacgcctggcctgatccacatgtgtggc

SEQ ID NO: 97174 - DNA, 35 bp, Artificial Sequence
  Synthetic oligonucleotide
gggacgacctggaccatcgatgaagcgcatcttgc

SEQ ID NO: 97175 - DNA, 35 bp, Artificial Sequence
  Synthetic oligonucleotide
gtgtgctccaccactccccagagggaggcctttgc

SEQ ID NO: 97176 - DNA, 35 bp, Artificial Sequence
  Synthetic oligonucleotide
ttgaaccgggtttcgcgtaagtgagccggcctatc

SEQ ID NO: 97177 - DNA, 35 bp, Artificial Sequence
  Synthetic oligonucleotide
gtgaactgcaggtaaagggcgagtgggttaaaccg

SEQ ID NO: 97178 - DNA, 34 bp, Artificial Sequence
  Synthetic oligonucleotide
atcgacatcactcccaactttttctcggcgaccg

SEQ ID NO: 97179 - DNA, 35 bp, Artificial Sequence
  Synthetic oligonucleotide
gtatgcccgcgcaattttaacatccaactgtttcg

SEQ ID NO: 97180 - DNA, 36 bp, Artificial Sequence
  Synthetic oligonucleotide
atctgccaggtacgagtaatcccaatgtgacccggg

SEQ ID NO: 97181 - DNA, 35 bp, Artificial Sequence
  Synthetic oligonucleotide
ttgcctgagcgcggtggaagtagcagttggtgggg

SEQ ID NO: 97182 - DNA, 35 bp, Artificial Sequence
  Synthetic oligonucleotide
gccctctcaccagatatgtcaccacgttctatggg

SEQ ID NO: 97183 - DNA, 34 bp, Artificial Sequence
  Synthetic oligonucleotide
taacgcccatccgctcttctcagactgccgttgg

SEQ ID NO: 97184 - DNA, 35 bp, Artificial Sequence
  Synthetic oligonucleotide
atgcaaagctccgttagactctaagtctgttttgg

SEQ ID NO: 97185 - DNA, 35 bp, Artificial Sequence
  Synthetic oligonucleotide
acctccaccagcgcaccttcaatttgaaaatagtg

SEQ ID NO: 97186 - DNA, 35 bp, Artificial Sequence
  Synthetic oligonucleotide
gtggatgacgatgtagagggaggagatccatagtg

SEQ ID NO: 97187 - DNA, 35 bp, Artificial Sequence
  Synthetic oligonucleotide
acactcacagctttctttgtctatgtttcttccat

SEQ ID NO: 97188 - DNA, 35 bp, Artificial Sequence
  Synthetic oligonucleotide
tctgacatggcattaggggctcaagctagaactat

SEQ ID NO: 97189 - DNA, 35 bp, Artificial Sequence
  Synthetic oligonucleotide
ggttccaggggcaggcgaatggggacgggaaaggt

SEQ ID NO: 97190 - DNA, 34 bp, Artificial Sequence
  Synthetic oligonucleotide
ttacacacatgagatgtcctcgttcgatcctctt

SEQ ID NO: 97191 - DNA, 35 bp, Artificial Sequence
  Synthetic oligonucleotide
gttgactagcggtcccatgatccacaactttattt

SEQ ID NO: 97192 - DNA, 36 bp, Artificial Sequence
  Synthetic oligonucleotide
gagatacacgcctaacatcaagaacttgacgctcaa

SEQ ID NO: 97193 - DNA, 36 bp, Artificial Sequence
  Synthetic oligonucleotide
gcgcaccacagtatgtctacactcatattgtgataa

SEQ ID NO: 97194 - DNA, 37 bp, Artificial Sequence
  Synthetic oligonucleotide
tagcccgccgtctctgcttcagtccgctttgctctaa

SEQ ID NO: 97195 - DNA, 35 bp, Artificial Sequence
  Synthetic oligonucleotide
gtgccaccgaatgtactcacttcttcgtgccttaa

SEQ ID NO: 97196 - DNA, 36 bp, Artificial Sequence
  Synthetic oligonucleotide
gaaacgccagtcgcgcagattacgggtcgaggaaca

SEQ ID NO: 97197 - DNA, 36 bp, Artificial Sequence
  Synthetic oligonucleotide
gcacgccgcaccgtttagtgcctcgacccacccaca

SEQ ID NO: 97198 - DNA, 36 bp, Artificial Sequence
  Synthetic oligonucleotide
gatggagcgaagaaagagcttaactagcatgtccca

SEQ ID NO: 97199 - DNA, 36 bp, Artificial Sequence
  Synthetic oligonucleotide
gaacgcacgtaataatgcctagtccatcttagtcca

SEQ ID NO: 97200 - DNA, 36 bp, Artificial Sequence
  Synthetic oligonucleotide
acatggaaagccagtcgtaacggaagaggtggtcca

SEQ ID NO: 97201 - DNA, 37 bp, Artificial Sequence
  Synthetic oligonucleotide
gctgcatctatgaactggatggaaggggatgggagca

SEQ ID NO: 97202 - DNA, 36 bp, Artificial Sequence
  Synthetic oligonucleotide
ggaagggggggggtaaggaacaatggtgcatccgca

SEQ ID NO: 97203 - DNA, 36 bp, Artificial Sequence
  Synthetic oligonucleotide
gatgggacatcagtgggcggcatgacaagatactca

SEQ ID NO: 97204 - DNA, 37 bp, Artificial Sequence
  Synthetic oligonucleotide
tgaacaggcccctttgtcttagctacaaacctataga

SEQ ID NO: 97205 - DNA, 37 bp, Artificial Sequence
  Synthetic oligonucleotide
tcacgcgcgctacattgactgggaaccgcactcccga

SEQ ID NO: 97206 - DNA, 37 bp, Artificial Sequence
  Synthetic oligonucleotide
gacacgggtccagttaaagaggatcgatctattccga

SEQ ID NO: 97207 - DNA, 37 bp, Artificial Sequence
  Synthetic oligonucleotide
ttacccgggtggggagtagcatgaagggagtcaggga

SEQ ID NO: 97208 - DNA, 37 bp, Artificial Sequence
  Synthetic oligonucleotide
agatgcacggatgtaaagcgggaggggttgggcggga

SEQ ID NO: 97209 - DNA, 37 bp, Artificial Sequence
  Synthetic oligonucleotide
gtgcgtagaatgagtaggagggggtagaagtatggga

SEQ ID NO: 97210 - DNA, 37 bp, Artificial Sequence
  Synthetic oligonucleotide
gaaaacggtgcagggtagaaaacgggctgacgtggga

SEQ ID NO: 97211 - DNA, 36 bp, Artificial Sequence
  Synthetic oligonucleotide
gcatcagcacggccttgagattggtccaccaatgga

SEQ ID NO: 97212 - DNA, 37 bp, Artificial Sequence
  Synthetic oligonucleotide
aaacaacggtaggaaggcgggaaataggtgctatgga

SEQ ID NO: 97213 - DNA, 38 bp, Artificial Sequence
  Synthetic oligonucleotide
acctccaccgcatactgagggtacgctcacttaaatga

SEQ ID NO: 97214 - DNA, 38 bp, Artificial Sequence
  Synthetic oligonucleotide
gagtgccagacaaaactgctaggtaccgctttccatga

SEQ ID NO: 97215 - DNA, 38 bp, Artificial Sequence
  Synthetic oligonucleotide
gtactcgacagtgggtggcgggcgggggacagagatga

SEQ ID NO: 97216 - DNA, 37 bp, Artificial Sequence
  Synthetic oligonucleotide
gttgtacgtgagatagatatgcggtagtgatggatga

SEQ ID NO: 97217 - DNA, 38 bp, Artificial Sequence
  Synthetic oligonucleotide
agtcggggagggcgtaatgggagcaaaggtataactga

SEQ ID NO: 97218 - DNA, 38 bp, Artificial Sequence
  Synthetic oligonucleotide
acgagtacgcaggagggtgggtcgcacgggaagactga

SEQ ID NO: 97219 - DNA, 38 bp, Artificial Sequence
  Synthetic oligonucleotide
gtcccccgcagacgtttaatcccgcgtcgtgcacctga

SEQ ID NO: 97220 - DNA, 38 bp, Artificial Sequence
  Synthetic oligonucleotide
aacgtcagacggtcgcccctgcttaaatctgctcctga

SEQ ID NO: 97221 - DNA, 38 bp, Artificial Sequence
  Synthetic oligonucleotide
accccgccacaaggacggtctggaccagtgtacgctga

SEQ ID NO: 97222 - DNA, 38 bp, Artificial Sequence
  Synthetic oligonucleotide
tgaattgtccggaccgtcactcacactgctctggctga

SEQ ID NO: 97223 - DNA, 38 bp, Artificial Sequence
  Synthetic oligonucleotide
accgcgagtggcggatcgaaggctaaacgaaaaagtga

SEQ ID NO: 97224 - DNA, 36 bp, Artificial Sequence
  Synthetic oligonucleotide
tccatctaacccactgctgtattcgaacgttagtga

SEQ ID NO: 97225 - DNA, 38 bp, Artificial Sequence
  Synthetic oligonucleotide
acgaggagagcccaagaatagattggagaacggcgtga

SEQ ID NO: 97226 - DNA, 38 bp, Artificial Sequence
  Synthetic oligonucleotide
gcccagcacgcgatgagaaaggcgggtgccatgcgtga

SEQ ID NO: 97227 - DNA, 38 bp, Artificial Sequence
  Synthetic oligonucleotide
gacgcgatccctgcctatttaggcttgccctatcgtga

SEQ ID NO: 97228 - DNA, 37 bp, Artificial Sequence
  Synthetic oligonucleotide
ttcgacccggacacagtggttcgcttcaacttcgtga

SEQ ID NO: 97229 - DNA, 38 bp, Artificial Sequence
  Synthetic oligonucleotide
ttcagacgaagagaggatggttacggggatggcggtga

SEQ ID NO: 97230 - DNA, 38 bp, Artificial Sequence
  Synthetic oligonucleotide
acctcgcgtggaaggaggagttcgtaggagtagggtga

SEQ ID NO: 97231 - DNA, 38 bp, Artificial Sequence
  Synthetic oligonucleotide
gaccacatacaactaccggagagacaaggccaatgtga

SEQ ID NO: 97232 - DNA, 37 bp, Artificial Sequence
  Synthetic oligonucleotide
gtgcgggaccgggaggtgagagagattgcgcgtgtga

SEQ ID NO: 97233 - DNA, 37 bp, Artificial Sequence
  Synthetic oligonucleotide
agcacattgtgcggtaatgcggataggtgccacttga

SEQ ID NO: 97234 - DNA, 38 bp, Artificial Sequence
  Synthetic oligonucleotide
aagggggggtgagagggtcaggggtcagatcgacttga

SEQ ID NO: 97235 - DNA, 38 bp, Artificial Sequence
  Synthetic oligonucleotide
tcatcaccggtaattggcttcccatacgcagtccttga

SEQ ID NO: 97236 - DNA, 37 bp, Artificial Sequence
  Synthetic oligonucleotide
aaccagctgctatcctatggactattggtcacgttga

SEQ ID NO: 97237 - DNA, 35 bp, Artificial Sequence
  Synthetic oligonucleotide
taacatctgtcggacgtcaacctaacacgtcgcta

SEQ ID NO: 97238 - DNA, 36 bp, Artificial Sequence
  Synthetic oligonucleotide
tgacgaggtcgatagtccaggcgcggggggtccgta

SEQ ID NO: 97239 - DNA, 35 bp, Artificial Sequence
  Synthetic oligonucleotide
gccccatagccgttattgataccgtaccggtttta

SEQ ID NO: 97240 - DNA, 35 bp, Artificial Sequence
  Synthetic oligonucleotide
gcaagagccgttccatcgtacagttactaccgaac

SEQ ID NO: 97241 - DNA, 35 bp, Artificial Sequence
  Synthetic oligonucleotide
tcaccgtccaaggccactgctactggtccgggaac

SEQ ID NO: 97242 - DNA, 35 bp, Artificial Sequence
  Synthetic oligonucleotide
actgacacgtcccagaaacgaaaagcctattagac

SEQ ID NO: 97243 - DNA, 35 bp, Artificial Sequence
  Synthetic oligonucleotide
acctagcagtcccctagtgcatcttgcaaaaatac

SEQ ID NO: 97244 - DNA, 35 bp, Artificial Sequence
  Synthetic oligonucleotide
acgcaaagcactcggtaacacgcgcttctctttac

SEQ ID NO: 97245 - DNA, 29 bp, Artificial Sequence
  Synthetic oligonucleotide
atcccaattcggtctcttgaagtttagcc

SEQ ID NO: 97246 - DNA, 35 bp, Artificial Sequence
  Synthetic oligonucleotide
accgacgcactgaccatccccttcagctcttacgc

SEQ ID NO: 97247 - DNA, 35 bp, Artificial Sequence
  Synthetic oligonucleotide
tccaccaccacgttgccgtacactactgactcggc

SEQ ID NO: 97248 - DNA, 35 bp, Artificial Sequence
  Synthetic oligonucleotide
actactgcggccctctgatttcctagacgtgcctc

SEQ ID NO: 97249 - DNA, 35 bp, Artificial Sequence
  Synthetic oligonucleotide
gccaacatgggccggtggacgtaacagtcgggctc

SEQ ID NO: 97250 - DNA, 35 bp, Artificial Sequence
  Synthetic oligonucleotide
gcacaccacgtcccctttaggcaaccccttttctc

SEQ ID NO: 97251 - DNA, 35 bp, Artificial Sequence
  Synthetic oligonucleotide
ttgtggaaggaacggaaaggtgcgctatctgaaag

SEQ ID NO: 97252 - DNA, 35 bp, Artificial Sequence
  Synthetic oligonucleotide
tagccagtgacaaaaaaggggccttggcgagatag

SEQ ID NO: 97253 - DNA, 35 bp, Artificial Sequence
  Synthetic oligonucleotide
attctggcacatctccggcatgaccttgcatatag

SEQ ID NO: 97254 - DNA, 35 bp, Artificial Sequence
  Synthetic oligonucleotide
gcagagccgcgtatcgtgcatgtgcccccctatcg

SEQ ID NO: 97255 - DNA, 35 bp, Artificial Sequence
  Synthetic oligonucleotide
gcaccggggatctattcttacataccttaccatgg

SEQ ID NO: 97256 - DNA, 35 bp, Artificial Sequence
  Synthetic oligonucleotide
atgctcccgacgtgcgcaatactgtgcctggctgg

SEQ ID NO: 97257 - DNA, 35 bp, Artificial Sequence
  Synthetic oligonucleotide
actctccattctctcggcattcgatacacgcactg

SEQ ID NO: 97258 - DNA, 35 bp, Artificial Sequence
  Synthetic oligonucleotide
acactctccgcttgcatcagctttgcccacccttg

SEQ ID NO: 97259 - DNA, 35 bp, Artificial Sequence
  Synthetic oligonucleotide
tagtcccggtcccactgccctccctagatcgtaat

SEQ ID NO: 97260 - DNA, 35 bp, Artificial Sequence
  Synthetic oligonucleotide
gagacccaaccctgatgcgtgtcccggtttgacat

SEQ ID NO: 97261 - DNA, 35 bp, Artificial Sequence
  Synthetic oligonucleotide
acgtgtgtcctcgcgatatcttggattttacccat

SEQ ID NO: 97262 - DNA, 35 bp, Artificial Sequence
  Synthetic oligonucleotide
caaagggcacctccacccacagctctcgccggcat

SEQ ID NO: 97263 - DNA, 35 bp, Artificial Sequence
  Synthetic oligonucleotide
gactgcctgtagtgaagtcagtagatccgtgtcat

SEQ ID NO: 97264 - DNA, 35 bp, Artificial Sequence
  Synthetic oligonucleotide
tacgccagccttggagctgtttgcattatcttcat

SEQ ID NO: 97265 - DNA, 35 bp, Artificial Sequence
  Synthetic oligonucleotide
attgactcgagcctcctttccgccagatcatagat

SEQ ID NO: 97266 - DNA, 35 bp, Artificial Sequence
  Synthetic oligonucleotide
ttgtcacagccgaggttcctaatacttgggtcact

SEQ ID NO: 97267 - DNA, 35 bp, Artificial Sequence
  Synthetic oligonucleotide
ttggacccgcactatattcgttcaaggcctcccct

SEQ ID NO: 97268 - DNA, 32 bp, Artificial Sequence
  Synthetic oligonucleotide
agacccgctcgatccgctccatctattcgcct

SEQ ID NO: 97269 - DNA, 33 bp, Artificial Sequence
  Synthetic oligonucleotide
gatcagcgccccctgagtttgatcgtcgctcct

SEQ ID NO: 97270 - DNA, 35 bp, Artificial Sequence
  Synthetic oligonucleotide
acaaccaaggctctgaccacgacagtccctgtcct

SEQ ID NO: 97271 - DNA, 35 bp, Artificial Sequence
  Synthetic oligonucleotide
atgttgcaatccagccctgtgtaccacaccatgct

SEQ ID NO: 97272 - DNA, 35 bp, Artificial Sequence
  Synthetic oligonucleotide
accatgtctgcggatacatctgctatttggttgct

SEQ ID NO: 97273 - DNA, 35 bp, Artificial Sequence
  Synthetic oligonucleotide
ttccaccgccttgacgatgtcctttgtaagcacgt

SEQ ID NO: 97274 - DNA, 35 bp, Artificial Sequence
  Synthetic oligonucleotide
gaaccagacacgtcgctgtctgatgagcttatctt

SEQ ID NO: 97275 - DNA, 35 bp, Artificial Sequence
  Synthetic oligonucleotide
acaacccgcggcccggttacgttcaaactccggtt

SEQ ID NO: 97276 - DNA, 35 bp, Artificial Sequence
  Synthetic oligonucleotide
tacgaatggggaggggccaaagagttagttggttt

SEQ ID NO: 97277 - DNA, 35 bp, Artificial Sequence
  Synthetic oligonucleotide
atgatggggggtcaagaacgatggaaggtgacaaa

SEQ ID NO: 97278 - DNA, 35 bp, Artificial Sequence
  Synthetic oligonucleotide
gcaagtcgcagggagagtgacgggaacgtaccaaa

SEQ ID NO: 97279 - DNA, 35 bp, Artificial Sequence
  Synthetic oligonucleotide
tagccaccccatgctagtgcaattaggatcccaaa

SEQ ID NO: 97280 - DNA, 36 bp, Artificial Sequence
  Synthetic oligonucleotide
gccggggacgtaacattgacgaatcgagggagcaaa

SEQ ID NO: 97281 - DNA, 36 bp, Artificial Sequence
  Synthetic oligonucleotide
tcattgaacgggcaggaaactgtacattaggggaaa

SEQ ID NO: 97282 - DNA, 36 bp, Artificial Sequence
  Synthetic oligonucleotide
gaccgacaacgacttcagggtctcctgactagacaa

SEQ ID NO: 97283 - DNA, 35 bp, Artificial Sequence
  Synthetic oligonucleotide
gtagccacatcgacagacagcccgcttctctccaa

SEQ ID NO: 97284 - DNA, 36 bp, Artificial Sequence
  Synthetic oligonucleotide
acagtgaagggcggacaggaatcgtacgactggcaa

SEQ ID NO: 97285 - DNA, 35 bp, Artificial Sequence
  Synthetic oligonucleotide
acaaccaggagagcaggtataattagatggtagaa

SEQ ID NO: 97286 - DNA, 34 bp, Artificial Sequence
  Synthetic oligonucleotide
gacgcacgcagaaagcggaactggatttggggaa

SEQ ID NO: 97287 - DNA, 36 bp, Artificial Sequence
  Synthetic oligonucleotide
gttcaagcaaagaggtatgttgaaaaggggtggcca

SEQ ID NO: 97288 - DNA, 35 bp, Artificial Sequence
  Synthetic oligonucleotide
gtgaacgagtggaaacgtaataggagtacggggca

SEQ ID NO: 97289 - DNA, 36 bp, Artificial Sequence
  Synthetic oligonucleotide
gtgacgacacgatttgcgaacctttatgcactggca

SEQ ID NO: 97290 - DNA, 36 bp, Artificial Sequence
  Synthetic oligonucleotide
agaccctcagccgcgagtttccttcgctcatctgca

SEQ ID NO: 97291 - DNA, 36 bp, Artificial Sequence
  Synthetic oligonucleotide
gttgacgtcagtggcctgggttctattccttactca

SEQ ID NO: 97292 - DNA, 35 bp, Artificial Sequence
  Synthetic oligonucleotide
tacagaccagcgctgtaccatctggcattccttca

SEQ ID NO: 97293 - DNA, 37 bp, Artificial Sequence
  Synthetic oligonucleotide
gtatggtagggccgatgggtgggcatgcagggaaaga

SEQ ID NO: 97294 - DNA, 37 bp, Artificial Sequence
  Synthetic oligonucleotide
tcccatgtccgctttcaaaactagtctgctcgcaaga

SEQ ID NO: 97295 - DNA, 36 bp, Artificial Sequence
  Synthetic oligonucleotide
gcggaacagggccaaatggggggaaaaatgggaaga

SEQ ID NO: 97296 - DNA, 37 bp, Artificial Sequence
  Synthetic oligonucleotide
gtgaagggccaacaagatggagaaggtcggcctaaga

SEQ ID NO: 97297 - DNA, 36 bp, Artificial Sequence
  Synthetic oligonucleotide
tgataggaaagattaaggggggccgaagccgcgaga

SEQ ID NO: 97298 - DNA, 37 bp, Artificial Sequence
  Synthetic oligonucleotide
ttgcgggggtggctcgactggggattaacatgggaga

SEQ ID NO: 97299 - DNA, 35 bp, Artificial Sequence
  Synthetic oligonucleotide
tcacaggtggaacgttggcagggaaacggattaga

SEQ ID NO: 97300 - DNA, 37 bp, Artificial Sequence
  Synthetic oligonucleotide
agcagggagccaggcggtaaaatggcaaggggttaga

SEQ ID NO: 97301 - DNA, 37 bp, Artificial Sequence
  Synthetic oligonucleotide
gatggagcaactgggcactagccgaaacagaggacga

SEQ ID NO: 97302 - DNA, 37 bp, Artificial Sequence
  Synthetic oligonucleotide
ttaccacactcgatcgatatgcccaccgtttgcccga

SEQ ID NO: 97303 - DNA, 36 bp, Artificial Sequence
  Synthetic oligonucleotide
gacgagagcatgaagtaaaggagttactgagagcga

SEQ ID NO: 97304 - DNA, 36 bp, Artificial Sequence
  Synthetic oligonucleotide
taagacaaagataggggtgggacgccgggggggcga

SEQ ID NO: 97305 - DNA, 37 bp, Artificial Sequence
  Synthetic oligonucleotide
aacatcctgccttaatgttttgaacttgagccctcga

SEQ ID NO: 97306 - DNA, 37 bp, Artificial Sequence
  Synthetic oligonucleotide
gtgcgatgatggtaagggaagatagcgcaggacagga

SEQ ID NO: 97307 - DNA, 37 bp, Artificial Sequence
  Synthetic oligonucleotide
tcacgggcattagtggaagggtgcgggaatccgagga

SEQ ID NO: 97308 - DNA, 37 bp, Artificial Sequence
  Synthetic oligonucleotide
atgtacgcaaggcgctgaggcacaagtcgggaaggga

SEQ ID NO: 97309 - DNA, 37 bp, Artificial Sequence
  Synthetic oligonucleotide
tactgctacgccacaattcgttgtacgggaactggga

SEQ ID NO: 97310 - DNA, 37 bp, Artificial Sequence
  Synthetic oligonucleotide
ttgcacgtaagaagctggtgctaggaacttggatgga

SEQ ID NO: 97311 - DNA, 37 bp, Artificial Sequence
  Synthetic oligonucleotide
aagcacactcagaagctatcgtgcatagatcgctgga

SEQ ID NO: 97312 - DNA, 35 bp, Artificial Sequence
  Synthetic oligonucleotide
ttggagccgcacacacccatcggtacgaggctgga

SEQ ID NO: 97313 - DNA, 38 bp, Artificial Sequence
  Synthetic oligonucleotide
acgacccatccgactgtgtcgtctttctcacgacatga

SEQ ID NO: 97314 - DNA, 38 bp, Artificial Sequence
  Synthetic oligonucleotide
ttcaccatctgaaccgctttttagtgcgtccctcatga

SEQ ID NO: 97315 - DNA, 38 bp, Artificial Sequence
  Synthetic oligonucleotide
acagacaggcgggatgcggaagaaggaggtatcactga

SEQ ID NO: 97316 - DNA, 38 bp, Artificial Sequence
  Synthetic oligonucleotide
ggaggtcgtccgtctcgtgaacgcgcacttgctcctga

SEQ ID NO: 97317 - DNA, 37 bp, Artificial Sequence
  Synthetic oligonucleotide
tctcacgagtgtgaggatatgtacatgtgagggctga

SEQ ID NO: 97318 - DNA, 38 bp, Artificial Sequence
  Synthetic oligonucleotide
tacatgaccgcagcaggttttttgtacatttttgctga

SEQ ID NO: 97319 - DNA, 38 bp, Artificial Sequence
  Synthetic oligonucleotide
agagcccatccaccataccgtcaacgtacagtctctga

SEQ ID NO: 97320 - DNA, 37 bp, Artificial Sequence
  Synthetic oligonucleotide
gaaggacgggagaggtggtgtgcggaacggacggtga

SEQ ID NO: 97321 - DNA, 37 bp, Artificial Sequence
  Synthetic oligonucleotide
aaagacgacgagcagtgtgcgtcttggaccgatgtga

SEQ ID NO: 97322 - DNA, 38 bp, Artificial Sequence
  Synthetic oligonucleotide
gtgaaggcgagggggtaggattcgggcggggggtgtga

SEQ ID NO: 97323 - DNA, 38 bp, Artificial Sequence
  Synthetic oligonucleotide
acgcatgccaccgtgttacgcgctcagaatcctattga

SEQ ID NO: 97324 - DNA, 38 bp, Artificial Sequence
  Synthetic oligonucleotide
tccacactcttctggtcgttgcttgccttcatacttga

SEQ ID NO: 97325 - DNA, 35 bp, Artificial Sequence
  Synthetic oligonucleotide
gaggggcaggggcgaagacatattgacctgcaata

SEQ ID NO: 97326 - DNA, 36 bp, Artificial Sequence
  Synthetic oligonucleotide
ggtcgtgagagatggtgcaaacgggtggtgaagata

SEQ ID NO: 97327 - DNA, 36 bp, Artificial Sequence
  Synthetic oligonucleotide
gcatagggcacgaatggggcaccagccattttccta

SEQ ID NO: 97328 - DNA, 35 bp, Artificial Sequence
  Synthetic oligonucleotide
gacgggtaacatgggggcaaagggttaggaacgta

SEQ ID NO: 97329 - DNA, 36 bp, Artificial Sequence
  Synthetic oligonucleotide
tgagacgagagttagcaataagttcggacgggcgta

SEQ ID NO: 97330 - DNA, 37 bp, Artificial Sequence
  Synthetic oligonucleotide
gtggtgcgaaagcgccggtatttaggccaccacggta

SEQ ID NO: 97331 - DNA, 35 bp, Artificial Sequence
  Synthetic oligonucleotide
gaaccgtacgccgatcggaccttgtagcagaatta

SEQ ID NO: 97332 - DNA, 35 bp, Artificial Sequence
  Synthetic oligonucleotide
gaggaacgcccgttgcgatgcaccttttgctgaac

SEQ ID NO: 97333 - DNA, 35 bp, Artificial Sequence
  Synthetic oligonucleotide
tgaatgagggaagtaatggtaccatggagcagcac

SEQ ID NO: 97334 - DNA, 35 bp, Artificial Sequence
  Synthetic oligonucleotide
accccccccatgatgcatagcccacggttccctac

SEQ ID NO: 97335 - DNA, 35 bp, Artificial Sequence
  Synthetic oligonucleotide
gccaaccaccatccacggccccgcgaacagggtac

SEQ ID NO: 97336 - DNA, 35 bp, Artificial Sequence
  Synthetic oligonucleotide
tgttccctcgccatctgtatttggattcttggtac

SEQ ID NO: 97337 - DNA, 35 bp, Artificial Sequence
  Synthetic oligonucleotide
tctaccccccgttcccgattgcatggcctgttacc

SEQ ID NO: 97338 - DNA, 35 bp, Artificial Sequence
  Synthetic oligonucleotide
atgcacggcgtttcgattctagcgcgatatttacc

SEQ ID NO: 97339 - DNA, 35 bp, Artificial Sequence
  Synthetic oligonucleotide
atgcgctcggtccttccatttagcaacatgtgccc

SEQ ID NO: 97340 - DNA, 35 bp, Artificial Sequence
  Synthetic oligonucleotide
attcacgcgcataggcgaattagcgcagcactccc

SEQ ID NO: 97341 - DNA, 35 bp, Artificial Sequence
  Synthetic oligonucleotide
atgaagcccatgcaagacaacgccggctacactcc

SEQ ID NO: 97342 - DNA, 35 bp, Artificial Sequence
  Synthetic oligonucleotide
tacacgacgctgcctgcgtatcgctgcaacattcc

SEQ ID NO: 97343 - DNA, 35 bp, Artificial Sequence
  Synthetic oligonucleotide
gttgtgccagcggtttagtccacctagcatcttcc

SEQ ID NO: 97344 - DNA, 34 bp, Artificial Sequence
  Synthetic oligonucleotide
gtcacgcctgtcccacacacgattgtaccacctc

SEQ ID NO: 97345 - DNA, 35 bp, Artificial Sequence
  Synthetic oligonucleotide
gacgaaggtcggacatgtatgtgctgatggctgtc

SEQ ID NO: 97346 - DNA, 35 bp, Artificial Sequence
  Synthetic oligonucleotide
tcacgccatcgttctacattcagcttacgttgttc

SEQ ID NO: 97347 - DNA, 35 bp, Artificial Sequence
  Synthetic oligonucleotide
tccactgcatgagaccttctgtagccctctgaaag

SEQ ID NO: 97348 - DNA, 35 bp, Artificial Sequence
  Synthetic oligonucleotide
acacgcgagtgaaccattgccgccccagactacag

SEQ ID NO: 97349 - DNA, 35 bp, Artificial Sequence
  Synthetic oligonucleotide
gttgatgaccgtcctgtaactaggttgacgtttcg

SEQ ID NO: 97350 - DNA, 35 bp, Artificial Sequence
  Synthetic oligonucleotide
atcaccacgatgggtattggttctttgatgtaggg

SEQ ID NO: 97351 - DNA, 35 bp, Artificial Sequence
  Synthetic oligonucleotide
gacaggagccggagattttgggatggagcattatg

SEQ ID NO: 97352 - DNA, 35 bp, Artificial Sequence
  Synthetic oligonucleotide
aatgggagaggctgaggtgtcggaggttagggtat

SEQ ID NO: 97353 - DNA, 35 bp, Artificial Sequence
  Synthetic oligonucleotide
tgttcgctccgggacattgcaggactacccacact

SEQ ID NO: 97354 - DNA, 35 bp, Artificial Sequence
  Synthetic oligonucleotide
actgccaatgctcgccgacataaggacttgtgcct

SEQ ID NO: 97355 - DNA, 35 bp, Artificial Sequence
  Synthetic oligonucleotide
aacgcaaacgtagcgtgctggacccatcagcctgt

SEQ ID NO: 97356 - DNA, 35 bp, Artificial Sequence
  Synthetic oligonucleotide
ttggtccagtcgttgtgcactgttccacgccttgt

SEQ ID NO: 97357 - DNA, 35 bp, Artificial Sequence
  Synthetic oligonucleotide
tcagcacagaatacggccattgtcttgatatcatt

SEQ ID NO: 97358 - DNA, 35 bp, Artificial Sequence
  Synthetic oligonucleotide
atgtcaagcggtggtgcttaatagcgtgattactt

SEQ ID NO: 97359 - DNA, 35 bp, Artificial Sequence
  Synthetic oligonucleotide
gcccaggcgcactgccctaccaaccgcactgggtt

SEQ ID NO: 97360 - DNA, 35 bp, Artificial Sequence
  Synthetic oligonucleotide
aaccgatgccattggacggtaccaatatacgattt

SEQ ID NO: 97361 - DNA, 35 bp, Artificial Sequence
  Synthetic oligonucleotide
aacacaggctggaccgcgtcacactcctattgttt

SEQ ID NO: 97362 - DNA, 34 bp, Artificial Sequence
  Synthetic oligonucleotide
tctatcaccgcacataatccaggtcttgtgaaaa

SEQ ID NO: 97363 - DNA, 36 bp, Artificial Sequence
  Synthetic oligonucleotide
tcagaccaccaccgccgttctaaactgtaacttcaa

SEQ ID NO: 97364 - DNA, 35 bp, Artificial Sequence
  Synthetic oligonucleotide
ggggcgagagggcgggtagaaggtctgaaaaggaa

SEQ ID NO: 97365 - DNA, 36 bp, Artificial Sequence
  Synthetic oligonucleotide
gcagtgcctgagggctcaaaagtgtgcggtggggaa

SEQ ID NO: 97366 - DNA, 36 bp, Artificial Sequence
  Synthetic oligonucleotide
ttgcacccatgcactccctgtccgacctgtcctaca

SEQ ID NO: 97367 - DNA, 35 bp, Artificial Sequence
  Synthetic oligonucleotide
gaacgcctaccggtttctctgctgtgatttcacca

SEQ ID NO: 97368 - DNA, 36 bp, Artificial Sequence
  Synthetic oligonucleotide
gtgccgcccacattaactcgacatgccaggggtcca

SEQ ID NO: 97369 - DNA, 35 bp, Artificial Sequence
  Synthetic oligonucleotide
gagccggaacgagcttcgtgagccctgacatggca

SEQ ID NO: 97370 - DNA, 35 bp, Artificial Sequence
  Synthetic oligonucleotide
acacttgccgatgacctatgccgtagtgattgtca

SEQ ID NO: 97371 - DNA, 37 bp, Artificial Sequence
  Synthetic oligonucleotide
gtgtagaccagggggtagaaagggggacgtgctaaga

SEQ ID NO: 97372 - DNA, 37 bp, Artificial Sequence
  Synthetic oligonucleotide
gccgcctaccacagctcctaagatccgacttgtacga

SEQ ID NO: 97373 - DNA, 37 bp, Artificial Sequence
  Synthetic oligonucleotide
tgtccgcctgctgattatgctcataaccctttatcga

SEQ ID NO: 97374 - DNA, 37 bp, Artificial Sequence
  Synthetic oligonucleotide
gatgcacagttcgtcaagggagttgatcgaacaagga

SEQ ID NO: 97375 - DNA, 37 bp, Artificial Sequence
  Synthetic oligonucleotide
accccacagcaggcatatgcattggttatattgagga

SEQ ID NO: 97376 - DNA, 37 bp, Artificial Sequence
  Synthetic oligonucleotide
aggacaaggcagggggacaagggggaccgagtcggga

SEQ ID NO: 97377 - DNA, 35 bp, Artificial Sequence
  Synthetic oligonucleotide
tagagcaactcgttggggggaattggtgggtggga

SEQ ID NO: 97378 - DNA, 37 bp, Artificial Sequence
  Synthetic oligonucleotide
actcgcggggaaacctaggggactagacacaagtgga

SEQ ID NO: 97379 - DNA, 37 bp, Artificial Sequence
  Synthetic oligonucleotide
gggggaggtgtcaaggggggtgtgacaaggatgtgga

SEQ ID NO: 97380 - DNA, 38 bp, Artificial Sequence
  Synthetic oligonucleotide
gggggagaaggggtatgggttgaatggacgacgaatga

SEQ ID NO: 97381 - DNA, 38 bp, Artificial Sequence
  Synthetic oligonucleotide
agttgctagctgccacaccatgcctgtccttcacatga

SEQ ID NO: 97382 - DNA, 37 bp, Artificial Sequence
  Synthetic oligonucleotide
accaccaccactggcaaccacagtcactcgttcatga

SEQ ID NO: 97383 - DNA, 38 bp, Artificial Sequence
  Synthetic oligonucleotide
tcgtatgcacgatagtaaagtgggggtggaaaatatga

SEQ ID NO: 97384 - DNA, 37 bp, Artificial Sequence
  Synthetic oligonucleotide
gctgacaccacagtacgctgaataactttacgtatga

SEQ ID NO: 97385 - DNA, 34 bp, Artificial Sequence
  Synthetic oligonucleotide
ttgacatgttgcgtgcaatccattctttaactga

SEQ ID NO: 97386 - DNA, 38 bp, Artificial Sequence
  Synthetic oligonucleotide
agcggagacgctacgtaatgagtagggatcgtgactga

SEQ ID NO: 97387 - DNA, 37 bp, Artificial Sequence
  Synthetic oligonucleotide
gtagccacagggacctgatatgggagggggaacctga

SEQ ID NO: 97388 - DNA, 35 bp, Artificial Sequence
  Synthetic oligonucleotide
gaagggagactagtcggataatggcgggtgagtga

SEQ ID NO: 97389 - DNA, 37 bp, Artificial Sequence
  Synthetic oligonucleotide
agtgcgactctcaacctgtggctccatcccgacgtga

SEQ ID NO: 97390 - DNA, 38 bp, Artificial Sequence
  Synthetic oligonucleotide
aacaccatctgcgctacagttctccgacgcaagcgtga

SEQ ID NO: 97391 - DNA, 37 bp, Artificial Sequence
  Synthetic oligonucleotide
acaaaagacacacgccaacgcactgatcactgcgtga

SEQ ID NO: 97392 - DNA, 36 bp, Artificial Sequence
  Synthetic oligonucleotide
tctcacccgctcataatctgacgatgcaattcgtga

SEQ ID NO: 97393 - DNA, 38 bp, Artificial Sequence
  Synthetic oligonucleotide
agtgacgtacagaagtgtttgttgacgttggggggtga

SEQ ID NO: 97394 - DNA, 37 bp, Artificial Sequence
  Synthetic oligonucleotide
gaaccaggggtgtgagcggaatgcagaaatggggtga

SEQ ID NO: 97395 - DNA, 37 bp, Artificial Sequence
  Synthetic oligonucleotide
tccgcgcaggcggaaaggtgtttatgttgcatggtga

SEQ ID NO: 97396 - DNA, 38 bp, Artificial Sequence
  Synthetic oligonucleotide
ttggtgacagggaggggaagggatagggtcaagtgtga

SEQ ID NO: 97397 - DNA, 37 bp, Artificial Sequence
  Synthetic oligonucleotide
ggagcacggcgagaaaggaaaagggtacggtgtgtga

SEQ ID NO: 97398 - DNA, 38 bp, Artificial Sequence
  Synthetic oligonucleotide
gaagcagaatggggtagtgcagaagaggggttgtgtga

SEQ ID NO: 97399 - DNA, 38 bp, Artificial Sequence
  Synthetic oligonucleotide
tgagttgcgacggggacagtgcagggcggaagtattga

SEQ ID NO: 97400 - DNA, 35 bp, Artificial Sequence
  Synthetic oligonucleotide
gctgccagaaggattttcttgccgcactttattga

SEQ ID NO: 97401 - DNA, 38 bp, Artificial Sequence
  Synthetic oligonucleotide
gtgcaacacagctggttcgtacggggtttggcacttga

SEQ ID NO: 97402 - DNA, 37 bp, Artificial Sequence
  Synthetic oligonucleotide
acgacgtgaagccgatttgagcaactgattgccttga

SEQ ID NO: 97403 - DNA, 38 bp, Artificial Sequence
  Synthetic oligonucleotide
gcaaggcgacctactcattgtacatatcaaatgcttga

SEQ ID NO: 97404 - DNA, 37 bp, Artificial Sequence
  Synthetic oligonucleotide
gatggcacgctcctcgcgtttcgcacttgtccgttga

SEQ ID NO: 97405 - DNA, 38 bp, Artificial Sequence
  Synthetic oligonucleotide
tgtgcgcagcccaatcgtgttctttgcgtggtggttga

SEQ ID NO: 97406 - DNA, 38 bp, Artificial Sequence
  Synthetic oligonucleotide
agacacgccagaactttatacgtgagttgcccttttga

SEQ ID NO: 97407 - DNA, 36 bp, Artificial Sequence
  Synthetic oligonucleotide
tccctgctgcagcatctcaaaaggcaccatgcgcta

SEQ ID NO: 97408 - DNA, 36 bp, Artificial Sequence
  Synthetic oligonucleotide
tgagggtggggatgtcgtggaaagtgttcggaggta

SEQ ID NO: 97409 - DNA, 36 bp, Artificial Sequence
  Synthetic oligonucleotide
gatgcaggcaggggggtcaggaccacgggggaatta

SEQ ID NO: 97410 - DNA, 36 bp, Artificial Sequence
  Synthetic oligonucleotide
tcagacaagcacgaacatgttcctttccactaatta

SEQ ID NO: 97411 - DNA, 36 bp, Artificial Sequence
  Synthetic oligonucleotide
gacgacgtgagatctggtcacgctgggagtacatta

SEQ ID NO: 97412 - DNA, 36 bp, Artificial Sequence
  Synthetic oligonucleotide
acacgactcggtgcggagaataaaggcgcgatatta

SEQ ID NO: 97413 - DNA, 35 bp, Artificial Sequence
  Synthetic oligonucleotide
gattgcgttgctcctcgagtagtcactgctcccac

SEQ ID NO: 97414 - DNA, 35 bp, Artificial Sequence
  Synthetic oligonucleotide
atgaggaagagcaggacttggtggagcggggagac

SEQ ID NO: 97415 - DNA, 35 bp, Artificial Sequence
  Synthetic oligonucleotide
tccccagagcaccgtaactttgctctgcatactac

SEQ ID NO: 97416 - DNA, 35 bp, Artificial Sequence
  Synthetic oligonucleotide
aagccgcccgcccttgtccgctctcttgtccgtac

SEQ ID NO: 97417 - DNA, 35 bp, Artificial Sequence
  Synthetic oligonucleotide
tcgtaacctctgtctgtcgtagctcaccctcaccc

SEQ ID NO: 97418 - DNA, 35 bp, Artificial Sequence
  Synthetic oligonucleotide
gcgtcaaatgcttcctctcttcgtgactgttcccc

SEQ ID NO: 97419 - DNA, 35 bp, Artificial Sequence
  Synthetic oligonucleotide
actgcatgactgacacttttggacgctccagtccc

SEQ ID NO: 97420 - DNA, 35 bp, Artificial Sequence
  Synthetic oligonucleotide
agagccgacccaatcctgtagtcttcactggttcc

SEQ ID NO: 97421 - DNA, 35 bp, Artificial Sequence
  Synthetic oligonucleotide
aagcgggccccgttccgtaggtccaaggcttttcc

SEQ ID NO: 97422 - DNA, 35 bp, Artificial Sequence
  Synthetic oligonucleotide
gctggggccaatggtcttaatcaccagctcgcatc

SEQ ID NO: 97423 - DNA, 35 bp, Artificial Sequence
  Synthetic oligonucleotide
gacacgactgcctctttttagctcgtttcctactc

SEQ ID NO: 97424 - DNA, 35 bp, Artificial Sequence
  Synthetic oligonucleotide
tccgcgccaatcttattggttcggctttattactc

SEQ ID NO: 97425 - DNA, 35 bp, Artificial Sequence
  Synthetic oligonucleotide
aacgcgctccgataggctctactgccggtccgctc

SEQ ID NO: 97426 - DNA, 35 bp, Artificial Sequence
  Synthetic oligonucleotide
attcccccgacgtttattggcacttaggcaatctc

SEQ ID NO: 97427 - DNA, 35 bp, Artificial Sequence
  Synthetic oligonucleotide
gacacattattgcattgaggacggggagaagctag

SEQ ID NO: 97428 - DNA, 35 bp, Artificial Sequence
  Synthetic oligonucleotide
actagacaggagcacagtaaaaaaaggcagacacg

SEQ ID NO: 97429 - DNA, 35 bp, Artificial Sequence
  Synthetic oligonucleotide
gaatcgaagaaggagggggcaacgcgtcgagtacg

SEQ ID NO: 97430 - DNA, 35 bp, Artificial Sequence
  Synthetic oligonucleotide
aacatgtaccagtaaagtcgcgctggctttttgcg

SEQ ID NO: 97431 - DNA, 35 bp, Artificial Sequence
  Synthetic oligonucleotide
gctgccgtcggttaggtctttgcccacttttgtcg

SEQ ID NO: 97432 - DNA, 35 bp, Artificial Sequence
  Synthetic oligonucleotide
gttggtaacactagaccgggtgaaggaggccgagg

SEQ ID NO: 97433 - DNA, 35 bp, Artificial Sequence
  Synthetic oligonucleotide
tgtcggagctgggcctatatttgtttctttcgctg

SEQ ID NO: 97434 - DNA, 35 bp, Artificial Sequence
  Synthetic oligonucleotide
ggatgatgtaggaatgaagaacgcgcaagatgctg

SEQ ID NO: 97435 - DNA, 34 bp, Artificial Sequence
  Synthetic oligonucleotide
gcaagtggagcagagataaaagggggtcacagtg

SEQ ID NO: 97436 - DNA, 35 bp, Artificial Sequence
  Synthetic oligonucleotide
aagtggggcagaaaataggctggagagattacgtg

SEQ ID NO: 97437 - DNA, 35 bp, Artificial Sequence
  Synthetic oligonucleotide
gtgatgaaggaaggtgcaaagtgatccctggagat

SEQ ID NO: 97438 - DNA, 35 bp, Artificial Sequence
  Synthetic oligonucleotide
taagccggcgcctgacgagcttcgccactccccct

SEQ ID NO: 97439 - DNA, 35 bp, Artificial Sequence
  Synthetic oligonucleotide
taacgcggccaaaactggacacgaagcgccctcct

SEQ ID NO: 97440 - DNA, 35 bp, Artificial Sequence
  Synthetic oligonucleotide
gtggaacgccgcgctacatattaccaggggtgatt

SEQ ID NO: 97441 - DNA, 35 bp, Artificial Sequence
  Synthetic oligonucleotide
gcgcaatcggctagatcgcacggcttaaaggagtt

SEQ ID NO: 97442 - DNA, 35 bp, Artificial Sequence
  Synthetic oligonucleotide
tgatccctgcctcctggccgttgtagatcattgtt

SEQ ID NO: 97443 - DNA, 36 bp, Artificial Sequence
  Synthetic oligonucleotide
actagccacctcagtcctgtctacaggcattcaaaa

SEQ ID NO: 97444 - DNA, 36 bp, Artificial Sequence
  Synthetic oligonucleotide
gccaaaaaccgggaaggaggagtccaagtaggcaaa

SEQ ID NO: 97445 - DNA, 36 bp, Artificial Sequence
  Synthetic oligonucleotide
gcacatggggagaaggcggatctgagatagtcgaaa

SEQ ID NO: 97446 - DNA, 36 bp, Artificial Sequence
  Synthetic oligonucleotide
gaatgcaacctagaagcagctagcataacaatgaaa

SEQ ID NO: 97447 - DNA, 36 bp, Artificial Sequence
  Synthetic oligonucleotide
ggtaaacaggaaggcaaagaggaatcggagtgtaaa

SEQ ID NO: 97448 - DNA, 35 bp, Artificial Sequence
  Synthetic oligonucleotide
tgtaacatctcaggtcacagccgctcggtaaccaa

SEQ ID NO: 97449 - DNA, 35 bp, Artificial Sequence
  Synthetic oligonucleotide
aatgcgtagggaggcgggtgcaggacaggacagaa

SEQ ID NO: 97450 - DNA, 36 bp, Artificial Sequence
  Synthetic oligonucleotide
gctcaccgaccccaacaacgaatagtcccaatggaa

SEQ ID NO: 97451 - DNA, 36 bp, Artificial Sequence
  Synthetic oligonucleotide
tgatcgccactgagcttgaaacagctccaatctgaa

SEQ ID NO: 97452 - DNA, 36 bp, Artificial Sequence
  Synthetic oligonucleotide
atagcgacctggccgtgcatgtatctctctcgttaa

SEQ ID NO: 97453 - DNA, 35 bp, Artificial Sequence
  Synthetic oligonucleotide
acaacgtgtgaggggtaggggttaagatgagaaca

SEQ ID NO: 97454 - DNA, 36 bp, Artificial Sequence
  Synthetic oligonucleotide
gcagaggcatcccgatcatgtaaacatctgctaaca

SEQ ID NO: 97455 - DNA, 35 bp, Artificial Sequence
  Synthetic oligonucleotide
agggtgggggtggtatggcagtatatcaggggaca

SEQ ID NO: 97456 - DNA, 36 bp, Artificial Sequence
  Synthetic oligonucleotide
gatgcaatcgtgccacgatgcaaatggagatataca

SEQ ID NO: 97457 - DNA, 36 bp, Artificial Sequence
  Synthetic oligonucleotide
gatcagtccgaccgctccatctgctcgtcgtttcca

SEQ ID NO: 97458 - DNA, 36 bp, Artificial Sequence
  Synthetic oligonucleotide
gtccaagcatccacttgatttgggtcccattctgca

SEQ ID NO: 97459 - DNA, 35 bp, Artificial Sequence
  Synthetic oligonucleotide
gttgacgctatcagatcgggaaacgcccacactca

SEQ ID NO: 97460 - DNA, 36 bp, Artificial Sequence
  Synthetic oligonucleotide
agcatccacatttcgcatcgacggtccttgttttca

SEQ ID NO: 97461 - DNA, 37 bp, Artificial Sequence
  Synthetic oligonucleotide
gatgtggtgtggtgatggttatggagttcagggcaga

SEQ ID NO: 97462 - DNA, 37 bp, Artificial Sequence
  Synthetic oligonucleotide
gcgattgtaggtgggtgtggagaaggtgcgtcagaga

SEQ ID NO: 97463 - DNA, 37 bp, Artificial Sequence
  Synthetic oligonucleotide
ttgagactggccaggagagtcataatggcgggagaga

SEQ ID NO: 97464 - DNA, 37 bp, Artificial Sequence
  Synthetic oligonucleotide
tcaaggtcaggtgcaaaggagtgaggtagacagtaga

SEQ ID NO: 97465 - DNA, 37 bp, Artificial Sequence
  Synthetic oligonucleotide
atgacgtgatggcggtggagaaccgagtgttggacga

SEQ ID NO: 97466 - DNA, 35 bp, Artificial Sequence
  Synthetic oligonucleotide
aacgcatgggtcagagcgattcttctattgtccga

SEQ ID NO: 97467 - DNA, 37 bp, Artificial Sequence
  Synthetic oligonucleotide
gattgagcggtacacatggatagcatggggggatcga

SEQ ID NO: 97468 - DNA, 36 bp, Artificial Sequence
  Synthetic oligonucleotide
gtgagaggacaagttgaaagtggaggaataggtcga

SEQ ID NO: 97469 - DNA, 37 bp, Artificial Sequence
  Synthetic oligonucleotide
ttactgccacccacaagtcagagcgatcgttcttcga

SEQ ID NO: 97470 - DNA, 36 bp, Artificial Sequence
  Synthetic oligonucleotide
gtgatgtgccggtattaattttggaggtgagttcga

SEQ ID NO: 97471 - DNA, 37 bp, Artificial Sequence
  Synthetic oligonucleotide
gttgtgccaggtggaggatgaatgcgcgaaggtagga

SEQ ID NO: 97472 - DNA, 36 bp, Artificial Sequence
  Synthetic oligonucleotide
accgataggtactgctgtctgtctgtgtggtccgga

SEQ ID NO: 97473 - DNA, 37 bp, Artificial Sequence
  Synthetic oligonucleotide
tagcagaaggaatcgggattatggaacagggatcgga

SEQ ID NO: 97474 - DNA, 37 bp, Artificial Sequence
  Synthetic oligonucleotide
gaatagcggggaatgtggattagggggaggggcggga

SEQ ID NO: 97475 - DNA, 36 bp, Artificial Sequence
  Synthetic oligonucleotide
aacgtggcggggggacaaggcggtttaatcggggga

SEQ ID NO: 97476 - DNA, 36 bp, Artificial Sequence
  Synthetic oligonucleotide
actcagggagggcgcatacgggcagtaggactggga

SEQ ID NO: 97477 - DNA, 36 bp, Artificial Sequence
  Synthetic oligonucleotide
tcacatacggcatcttatcactacattgcgggtgga

SEQ ID NO: 97478 - DNA, 38 bp, Artificial Sequence
  Synthetic oligonucleotide
tacaaaggagggggtgagaagcggaggtttgatcatga

SEQ ID NO: 97479 - DNA, 38 bp, Artificial Sequence
  Synthetic oligonucleotide
gtgagcacgtcgctggagtagcaggttgaaaaagatga

SEQ ID NO: 97480 - DNA, 37 bp, Artificial Sequence
  Synthetic oligonucleotide
gacaagcacagcgcgtggcaaacggcggtagagctga

SEQ ID NO: 97481 - DNA, 38 bp, Artificial Sequence
  Synthetic oligonucleotide
gacagactagatcggaaggggagtacgacaatcagtga

SEQ ID NO: 97482 - DNA, 37 bp, Artificial Sequence
  Synthetic oligonucleotide
gcgaatatcgcacacttgtatagtacccttatcgtga

SEQ ID NO: 97483 - DNA, 38 bp, Artificial Sequence
  Synthetic oligonucleotide
gcacagggggaagggatgtgcaaatatggattaggtga

SEQ ID NO: 97484 - DNA, 38 bp, Artificial Sequence
  Synthetic oligonucleotide
atgacacgagcggggcgcgatcgggagaacaggggtga

SEQ ID NO: 97485 - DNA, 37 bp, Artificial Sequence
  Synthetic oligonucleotide
gcgacattacgccctaccctgttagccacacctgtga

SEQ ID NO: 97486 - DNA, 37 bp, Artificial Sequence
  Synthetic oligonucleotide
gcagtcggtagggaggaagttacagtgcaaggtgtga

SEQ ID NO: 97487 - DNA, 38 bp, Artificial Sequence
  Synthetic oligonucleotide
gacgatggctggagagatcagggatagccatcgattga

SEQ ID NO: 97488 - DNA, 36 bp, Artificial Sequence
  Synthetic oligonucleotide
agacgcccggagagaaagcgcatccacaccccttga

SEQ ID NO: 97489 - DNA, 36 bp, Artificial Sequence
  Synthetic oligonucleotide
gccggacgccactcctactatcagatgctagcttga

SEQ ID NO: 97490 - DNA, 37 bp, Artificial Sequence
  Synthetic oligonucleotide
tacatgtccgcctgtcgctactccttagaccgcttga

SEQ ID NO: 97491 - DNA, 35 bp, Artificial Sequence
  Synthetic oligonucleotide
acgatagcaaaggtgagatagtacgagggagttga

SEQ ID NO: 97492 - DNA, 37 bp, Artificial Sequence
  Synthetic oligonucleotide
tcgttctccctggtaattagctaacgcccttatttga

SEQ ID NO: 97493 - DNA, 37 bp, Artificial Sequence
  Synthetic oligonucleotide
gcgaacgtgccatcttgttttgaaatgtaacctttga

SEQ ID NO: 97494 - DNA, 38 bp, Artificial Sequence
  Synthetic oligonucleotide
tgagggagcaaggtggaaggtagagggcttgattttga

SEQ ID NO: 97495 - DNA, 36 bp, Artificial Sequence
  Synthetic oligonucleotide
gacgaccccactcagtaggcctggagctgcagcata

SEQ ID NO: 97496 - DNA, 36 bp, Artificial Sequence
  Synthetic oligonucleotide
aactacacctcagctgattaacccaccatggcgata

SEQ ID NO: 97497 - DNA, 36 bp, Artificial Sequence
  Synthetic oligonucleotide
tcgactggtcatccgatgcacctccctcttggtcta

SEQ ID NO: 97498 - DNA, 36 bp, Artificial Sequence
  Synthetic oligonucleotide
gaatgacgtactgcgctctacattagggttcccgta

SEQ ID NO: 97499 - DNA, 36 bp, Artificial Sequence
  Synthetic oligonucleotide
gagagggggtgggtggtgctcgagatggaaagggta

SEQ ID NO: 97500 - DNA, 35 bp, Artificial Sequence
  Synthetic oligonucleotide
aagccaggtccgataggcctcccgatagctccaac

SEQ ID NO: 97501 - DNA, 35 bp, Artificial Sequence
  Synthetic oligonucleotide
gatggtcacctgccgtactttcatgcttactcgac

SEQ ID NO: 97502 - DNA, 35 bp, Artificial Sequence
  Synthetic oligonucleotide
gatacgcgttagattatgcgccatcattaataacc

SEQ ID NO: 97503 - DNA, 35 bp, Artificial Sequence
  Synthetic oligonucleotide
acgttaccgcccaaacggtgtggcgtgccgctccc

SEQ ID NO: 97504 - DNA, 35 bp, Artificial Sequence
  Synthetic oligonucleotide
aactcgggctggtacgtaccggaacaggcggttcc

SEQ ID NO: 97505 - DNA, 35 bp, Artificial Sequence
  Synthetic oligonucleotide
acctggacgacagagttccgttgccgcttgttatc

SEQ ID NO: 97506 - DNA, 35 bp, Artificial Sequence
  Synthetic oligonucleotide
atcgacgggatcagccgcgtcactctatctttatc

SEQ ID NO: 97507 - DNA, 35 bp, Artificial Sequence
  Synthetic oligonucleotide
tgccgccgatcatagaagctcctgaacctcgcgtc

SEQ ID NO: 97508 - DNA, 35 bp, Artificial Sequence
  Synthetic oligonucleotide
gcctgccccgagatttatattccaccgtccctgtc

SEQ ID NO: 97509 - DNA, 33 bp, Artificial Sequence
  Synthetic oligonucleotide
atgtcacgctgctccgcccaccacattttgaag

SEQ ID NO: 97510 - DNA, 35 bp, Artificial Sequence
  Synthetic oligonucleotide
tacctgtgcaatgaggtgacaggtctggctttcag

SEQ ID NO: 97511 - DNA, 35 bp, Artificial Sequence
  Synthetic oligonucleotide
tgtcccgacccttcctgttccaggtgcacctatag

SEQ ID NO: 97512 - DNA, 35 bp, Artificial Sequence
  Synthetic oligonucleotide
tgtgcgggaaggggggaagtagggagggcccctag

SEQ ID NO: 97513 - DNA, 35 bp, Artificial Sequence
  Synthetic oligonucleotide
tcacccgcatcgggtacttagttgaaacttgcccg

SEQ ID NO: 97514 - DNA, 35 bp, Artificial Sequence
  Synthetic oligonucleotide
gtgtagctccagtaccctttagatgtattccacgg

SEQ ID NO: 97515 - DNA, 35 bp, Artificial Sequence
  Synthetic oligonucleotide
gtcttgcccccacgagtgtcttccatcggtccgtg

SEQ ID NO: 97516 - DNA, 35 bp, Artificial Sequence
  Synthetic oligonucleotide
gactggacaaggagtgattggaaaggcgcagacat

SEQ ID NO: 97517 - DNA, 35 bp, Artificial Sequence
  Synthetic oligonucleotide
gatgtggcgggaaatgttgttagcgtcgttaggat

SEQ ID NO: 97518 - DNA, 35 bp, Artificial Sequence
  Synthetic oligonucleotide
tttggcgcaacattcatataccaaccgtgaacgct

SEQ ID NO: 97519 - DNA, 35 bp, Artificial Sequence
  Synthetic oligonucleotide
aagaccggcgcctgctcatactctggattttcggt

SEQ ID NO: 97520 - DNA, 35 bp, Artificial Sequence
  Synthetic oligonucleotide
gacgagtcgccttgcattatgttaatagtctgggt

SEQ ID NO: 97521 - DNA, 35 bp, Artificial Sequence
  Synthetic oligonucleotide
tgatagtcccacaccgcaatttttggtatctctgt

SEQ ID NO: 97522 - DNA, 35 bp, Artificial Sequence
  Synthetic oligonucleotide
tcaccaccacgataacgtatgcctagaatattctt

SEQ ID NO: 97523 - DNA, 36 bp, Artificial Sequence
  Synthetic oligonucleotide
aatgcgtgtgggtgcccagcctgtgcccaagttaaa

SEQ ID NO: 97524 - DNA, 36 bp, Artificial Sequence
  Synthetic oligonucleotide
gcgtgctgcccagtactataaacggcctcatgtcaa

SEQ ID NO: 97525 - DNA, 36 bp, Artificial Sequence
  Synthetic oligonucleotide
ggtcgcagaggagtgaggagggagtacatgggtgaa

SEQ ID NO: 97526 - DNA, 36 bp, Artificial Sequence
  Synthetic oligonucleotide
tcaccgaccgaaggggttgcggcttttagttactaa

SEQ ID NO: 97527 - DNA, 36 bp, Artificial Sequence
  Synthetic oligonucleotide
gtcgccgcctgaagcttaagcgtcgtccttctcaca

SEQ ID NO: 97528 - DNA, 36 bp, Artificial Sequence
  Synthetic oligonucleotide
gagccgggggaaagtagtagttgcgcgcaggggaca

SEQ ID NO: 97529 - DNA, 36 bp, Artificial Sequence
  Synthetic oligonucleotide
tgtgcgcagccgtacggtgcacccgtattcaacgca

SEQ ID NO: 97530 - DNA, 36 bp, Artificial Sequence
  Synthetic oligonucleotide
tctgtggggcggtgggtcgaaagcgggctatgggca

SEQ ID NO: 97531 - DNA, 36 bp, Artificial Sequence
  Synthetic oligonucleotide
tcacaagtgcaacgtataggaagccccattctatca

SEQ ID NO: 97532 - DNA, 35 bp, Artificial Sequence
  Synthetic oligonucleotide
tgcaagctgcagatattctttagctcttaccctca

SEQ ID NO: 97533 - DNA, 36 bp, Artificial Sequence
  Synthetic oligonucleotide
gtgtgcgccccagccgaatggacttttgcctagtca

SEQ ID NO: 97534 - DNA, 35 bp, Artificial Sequence
  Synthetic oligonucleotide
gtgaccacgcaagtgagtggcaatattaaccttca

SEQ ID NO: 97535 - DNA, 35 bp, Artificial Sequence
  Synthetic oligonucleotide
tcacactcgccttgagggctctcgtttctgtttca

SEQ ID NO: 97536 - DNA, 36 bp, Artificial Sequence
  Synthetic oligonucleotide
tccagccggaaaattctacacagagctgagccaaga

SEQ ID NO: 97537 - DNA, 37 bp, Artificial Sequence
  Synthetic oligonucleotide
tgtaggccccagtgatatctctcctgcccacataaga

SEQ ID NO: 97538 - DNA, 37 bp, Artificial Sequence
  Synthetic oligonucleotide
gtcaccgatgtgatttgttttttcaacttggttcaga

SEQ ID NO: 97539 - DNA, 36 bp, Artificial Sequence
  Synthetic oligonucleotide
catacagtccgtccctgcagcactttcccgacgaga

SEQ ID NO: 97540 - DNA, 37 bp, Artificial Sequence
  Synthetic oligonucleotide
acctgagcacataccaccgttcgtctcgtggacgaga

SEQ ID NO: 97541 - DNA, 37 bp, Artificial Sequence
  Synthetic oligonucleotide
gccacatcgtgtgggcacctcttccgtctcctcgaga

SEQ ID NO: 97542 - DNA, 37 bp, Artificial Sequence
  Synthetic oligonucleotide
gtaaggcggggaccggaaattcgataaaaaggggaga

SEQ ID NO: 97543 - DNA, 37 bp, Artificial Sequence
  Synthetic oligonucleotide
gtaacatggggggagtgttgcaatgcggacagaacga

SEQ ID NO: 97544 - DNA, 37 bp, Artificial Sequence
  Synthetic oligonucleotide
gctgcctgcccatattctacccgccgtccaagtacga

SEQ ID NO: 97545 - DNA, 37 bp, Artificial Sequence
  Synthetic oligonucleotide
gtctggacctcatcatatgcttaagcatctacttcga

SEQ ID NO: 97546 - DNA, 37 bp, Artificial Sequence
  Synthetic oligonucleotide
gaaaccctgccatgagaacacacgtccgttcagcgga

SEQ ID NO: 97547 - DNA, 37 bp, Artificial Sequence
  Synthetic oligonucleotide
gtgtggaaagcgccaccattgctagtgatctgtggga

SEQ ID NO: 97548 - DNA, 37 bp, Artificial Sequence
  Synthetic oligonucleotide
aatgtgccctggatgacctttttgatagacgtgtgga

SEQ ID NO: 97549 - DNA, 36 bp, Artificial Sequence
  Synthetic oligonucleotide
acagcaggaacgcgggttgggaccaaggagattgga

SEQ ID NO: 97550 - DNA, 37 bp, Artificial Sequence
  Synthetic oligonucleotide
aacacgggaggtgaggcttacacacggggattttgga

SEQ ID NO: 97551 - DNA, 38 bp, Artificial Sequence
  Synthetic oligonucleotide
cacgaagttagccgatgtaggggaggtggacaaaatga

SEQ ID NO: 97552 - DNA, 35 bp, Artificial Sequence
  Synthetic oligonucleotide
gatctcacggggaagggctgaatgttggtcaatga

SEQ ID NO: 97553 - DNA, 38 bp, Artificial Sequence
  Synthetic oligonucleotide
tgaagcgttcaataaggaaggagggggggatataatga

SEQ ID NO: 97554 - DNA, 38 bp, Artificial Sequence
  Synthetic oligonucleotide
agtggggggggtgagtcggtcgcatggacggtgcatga

SEQ ID NO: 97555 - DNA, 36 bp, Artificial Sequence
  Synthetic oligonucleotide
tactcgtgctcagttgcttatcccctcttctgatga

SEQ ID NO: 97556 - DNA, 38 bp, Artificial Sequence
  Synthetic oligonucleotide
tgacacaaaccgccaaggagtaaacagcatggacctga

SEQ ID NO: 97557 - DNA, 37 bp, Artificial Sequence
  Synthetic oligonucleotide
tcagacatagaactataccaacgtccactttagctga

SEQ ID NO: 97558 - DNA, 38 bp, Artificial Sequence
  Synthetic oligonucleotide
accccaccacggacaggcagagacggcccttgatctga

SEQ ID NO: 97559 - DNA, 35 bp, Artificial Sequence
  Synthetic oligonucleotide
accgatcgcgttcgagtttgcttgatttgatctga

SEQ ID NO: 97560 - DNA, 35 bp, Artificial Sequence
  Synthetic oligonucleotide
gtgaaaccagggaaagaaatgaggaataacagtga

SEQ ID NO: 97561 - DNA, 36 bp, Artificial Sequence
  Synthetic oligonucleotide
tgccagagcaagggcctcaaagctacaaattggtga

SEQ ID NO: 97562 - DNA, 38 bp, Artificial Sequence
  Synthetic oligonucleotide
tcagaggagaaagggtggcttgagattggaaaatgtga

SEQ ID NO: 97563 - DNA, 38 bp, Artificial Sequence
  Synthetic oligonucleotide
accaagggcagggaatacaggggaactaacaaatgtga

SEQ ID NO: 97564 - DNA, 38 bp, Artificial Sequence
  Synthetic oligonucleotide
gtcgacgtaaactcaaatctattgagcacctccattga

SEQ ID NO: 97565 - DNA, 38 bp, Artificial Sequence
  Synthetic oligonucleotide
gtggggagggccgacgggatccaggggtccaggcttga

SEQ ID NO: 97566 - DNA, 38 bp, Artificial Sequence
  Synthetic oligonucleotide
tgaggaaagatagagggggaatgcggtcaaggggttga

SEQ ID NO: 97567 - DNA, 38 bp, Artificial Sequence
  Synthetic oligonucleotide
acgacacagtgggtggtagtagcgaggtaaaatgttga

SEQ ID NO: 97568 - DNA, 35 bp, Artificial Sequence
  Synthetic oligonucleotide
tagtgcggggaactgggaagcaactagtgtctata

SEQ ID NO: 97569 - DNA, 36 bp, Artificial Sequence
  Synthetic oligonucleotide
actttgagccgacatcgaaaattttacgcgattcta

SEQ ID NO: 97570 - DNA, 36 bp, Artificial Sequence
  Synthetic oligonucleotide
gtcccacaagcgggtcatcattacaagctacctgta

SEQ ID NO: 97571 - DNA, 36 bp, Artificial Sequence
  Synthetic oligonucleotide
accgctagtgccactgatttctgtttcggcccatta

SEQ ID NO: 97572 - DNA, 35 bp, Artificial Sequence
  Synthetic oligonucleotide
acccacccggtaattggaataacgctcatttcaac

SEQ ID NO: 97573 - DNA, 35 bp, Artificial Sequence
  Synthetic oligonucleotide
gccaaccgcgtgcgctactcacaattctggcgaac

SEQ ID NO: 97574 - DNA, 35 bp, Artificial Sequence
  Synthetic oligonucleotide
ggattcagccctcgctatgtacgttagtatcacac

SEQ ID NO: 97575 - DNA, 35 bp, Artificial Sequence
  Synthetic oligonucleotide
tcagccaccaatcggttggggaacattctagccac

SEQ ID NO: 97576 - DNA, 35 bp, Artificial Sequence
  Synthetic oligonucleotide
tcacaccgcccccccaggtaacccttgtagttcac

SEQ ID NO: 97577 - DNA, 35 bp, Artificial Sequence
  Synthetic oligonucleotide
aagaggagtgagagagaatcgaagcgtgtggggac

SEQ ID NO: 97578 - DNA, 35 bp, Artificial Sequence
  Synthetic oligonucleotide
gtccacagccagtcgtaccgaacgcattattcccc

SEQ ID NO: 97579 - DNA, 35 bp, Artificial Sequence
  Synthetic oligonucleotide
tgtcacaacttcgagccatttgacggccatgatcc

SEQ ID NO: 97580 - DNA, 35 bp, Artificial Sequence
  Synthetic oligonucleotide
tcactggtccctatgtctatcgtttccccatctcc

SEQ ID NO: 97581 - DNA, 35 bp, Artificial Sequence
  Synthetic oligonucleotide
gcctgccctgaagtacagcaacggtcgagtttctc

SEQ ID NO: 97582 - DNA, 35 bp, Artificial Sequence
  Synthetic oligonucleotide
attgtcagcccaggccaatccatagtctcagtgtc

SEQ ID NO: 97583 - DNA, 35 bp, Artificial Sequence
  Synthetic oligonucleotide
gcaaaactagcccggatgtggtgagggaaattaag

SEQ ID NO: 97584 - DNA, 35 bp, Artificial Sequence
  Synthetic oligonucleotide
agtcacgtacaaggagaaatcacttaacataccag

SEQ ID NO: 97585 - DNA, 35 bp, Artificial Sequence
  Synthetic oligonucleotide
accctcacctgtgccatctttatcgagaatagacg

SEQ ID NO: 97586 - DNA, 35 bp, Artificial Sequence
  Synthetic oligonucleotide
agaccggtcaaactgccgagcttacccgttacccg

SEQ ID NO: 97587 - DNA, 35 bp, Artificial Sequence
  Synthetic oligonucleotide
gggacgctggggacaacacagaggggtcaagagcg

SEQ ID NO: 97588 - DNA, 35 bp, Artificial Sequence
  Synthetic oligonucleotide
tcacgaactgggcagatcgggtggatcggtgggcg

SEQ ID NO: 97589 - DNA, 35 bp, Artificial Sequence
  Synthetic oligonucleotide
gtgtgcgtagggggtggggacggaaacaagatgcg

SEQ ID NO: 97590 - DNA, 35 bp, Artificial Sequence
  Synthetic oligonucleotide
tcaagtcacgagaggatgatcgtacagaaggaagg

SEQ ID NO: 97591 - DNA, 35 bp, Artificial Sequence
  Synthetic oligonucleotide
aaagtgcagtgtgtggaagatagcgttaggggggg

SEQ ID NO: 97592 - DNA, 35 bp, Artificial Sequence
  Synthetic oligonucleotide
attgaccgcccctccaagtgtaacgaatcctctgg

SEQ ID NO: 97593 - DNA, 35 bp, Artificial Sequence
  Synthetic oligonucleotide
atgactacgcgctgtctctgatatctctgcctatg

SEQ ID NO: 97594 - DNA, 35 bp, Artificial Sequence
  Synthetic oligonucleotide
tcaacgatcacagtgggctgctagtcggaccaaat

SEQ ID NO: 97595 - DNA, 35 bp, Artificial Sequence
  Synthetic oligonucleotide
aggtggtggccggatcgaaaacacatacgttgcat

SEQ ID NO: 97596 - DNA, 35 bp, Artificial Sequence
  Synthetic oligonucleotide
agctgaggtggtgggcaaaccgctggggggaacct

SEQ ID NO: 97597 - DNA, 35 bp, Artificial Sequence
  Synthetic oligonucleotide
gaatgcgcctcacaatcctttaaggccccagagct

SEQ ID NO: 97598 - DNA, 35 bp, Artificial Sequence
  Synthetic oligonucleotide
cacgcccaaccgtcgcttggtactatcttaatgct

SEQ ID NO: 97599 - DNA, 35 bp, Artificial Sequence
  Synthetic oligonucleotide
tgtgactgtgcggaacgcggtcacacagcctttct

SEQ ID NO: 97600 - DNA, 35 bp, Artificial Sequence
  Synthetic oligonucleotide
gtgtgacgaacagcgagggtacgtggatggcaagt

SEQ ID NO: 97601 - DNA, 35 bp, Artificial Sequence
  Synthetic oligonucleotide
acatccgcagtgtgggctgtgtgtgtggatatagt

SEQ ID NO: 97602 - DNA, 35 bp, Artificial Sequence
  Synthetic oligonucleotide
gtcactccctatgcccaccacatgacactaactgt

SEQ ID NO: 97603 - DNA, 35 bp, Artificial Sequence
  Synthetic oligonucleotide
tcccccccctcagttgcgtaggtactcgaccctgt

SEQ ID NO: 97604 - DNA, 35 bp, Artificial Sequence
  Synthetic oligonucleotide
tgagtaagacaccattcctgtacctctgaccttgt

SEQ ID NO: 97605 - DNA, 35 bp, Artificial Sequence
  Synthetic oligonucleotide
gttgagcactgtatgtctatccgaaggtcgctttt

SEQ ID NO: 97606 - DNA, 36 bp, Artificial Sequence
  Synthetic oligonucleotide
tgcaccacctggacatgcttgacaccgcctacccaa

SEQ ID NO: 97607 - DNA, 35 bp, Artificial Sequence
  Synthetic oligonucleotide
aggggatgggacgcaggaagaagagtgattggcaa

SEQ ID NO: 97608 - DNA, 36 bp, Artificial Sequence
  Synthetic oligonucleotide
gctgcaacggggaaacaatggctggggtctgtgcaa

SEQ ID NO: 97609 - DNA, 36 bp, Artificial Sequence
  Synthetic oligonucleotide
tgctctcgggcgaagtctctgccacatatttatcaa

SEQ ID NO: 97610 - DNA, 36 bp, Artificial Sequence
  Synthetic oligonucleotide
atcggtggaggccggaacgaaagaagtttagtagaa

SEQ ID NO: 97611 - DNA, 36 bp, Artificial Sequence
  Synthetic oligonucleotide
gatgacatgccggaccggagttagagtcgctacgaa

SEQ ID NO: 97612 - DNA, 36 bp, Artificial Sequence
  Synthetic oligonucleotide
tacgcaatgtgcccttgatgatctagcacccgtaca

SEQ ID NO: 97613 - DNA, 35 bp, Artificial Sequence
  Synthetic oligonucleotide
gtgacatgtgcctttttaacagcgtctcgggacca

SEQ ID NO: 97614 - DNA, 36 bp, Artificial Sequence
  Synthetic oligonucleotide
tgactgccgtgagacctgccgttttttctagtacca

SEQ ID NO: 97615 - DNA, 36 bp, Artificial Sequence
  Synthetic oligonucleotide
gtccagccggtgagggttcaccctggacttactcca

SEQ ID NO: 97616 - DNA, 36 bp, Artificial Sequence
  Synthetic oligonucleotide
ttgtacgtacgcagcgaacaatttacagattcatca

SEQ ID NO: 97617 - DNA, 36 bp, Artificial Sequence
  Synthetic oligonucleotide
tacgcctcgtaccaactttaaatgcagctgatatca

SEQ ID NO: 97618 - DNA, 36 bp, Artificial Sequence
  Synthetic oligonucleotide
attgccccctcagttgtgacacccctgctactctca

SEQ ID NO: 97619 - DNA, 36 bp, Artificial Sequence
  Synthetic oligonucleotide
gatccaagtggtgggtatcgggacacgtaaaagtca

SEQ ID NO: 97620 - DNA, 35 bp, Artificial Sequence
  Synthetic oligonucleotide
acacaccttctgtgacgtgaatcatcaacgtgtca

SEQ ID NO: 97621 - DNA, 35 bp, Artificial Sequence
  Synthetic oligonucleotide
ttgacagagcggtcggcacataatatggcagttca

SEQ ID NO: 97622 - DNA, 37 bp, Artificial Sequence
  Synthetic oligonucleotide
accgagacccatcaaaggtactgtactcccaacaaga

SEQ ID NO: 97623 - DNA, 37 bp, Artificial Sequence
  Synthetic oligonucleotide
gtgtggcgttgggtgtaaagggagcgcgggggtgaga

SEQ ID NO: 97624 - DNA, 36 bp, Artificial Sequence
  Synthetic oligonucleotide
aaccacgagccaagtgaccggacgaaccatcctaga

SEQ ID NO: 97625 - DNA, 35 bp, Artificial Sequence
  Synthetic oligonucleotide
gacgaacgaggaggcgtatcattgcccatcctaga

SEQ ID NO: 97626 - DNA, 37 bp, Artificial Sequence
  Synthetic oligonucleotide
tatgggtgctaatgtgtggagaagggtggtggttaga

SEQ ID NO: 97627 - DNA, 36 bp, Artificial Sequence
  Synthetic oligonucleotide
aagggacggtgaagactataggggacgaacttacga

SEQ ID NO: 97628 - DNA, 37 bp, Artificial Sequence
  Synthetic oligonucleotide
aacaccgatctcatctgcgcacaaggcggtacaccga

SEQ ID NO: 97629 - DNA, 37 bp, Artificial Sequence
  Synthetic oligonucleotide
gtcacgatagccctcgtagttgcgtcgttcctttcga

SEQ ID NO: 97630 - DNA, 37 bp, Artificial Sequence
  Synthetic oligonucleotide
aactggcccccacccgctcttgattaagatgtttcga

SEQ ID NO: 97631 - DNA, 37 bp, Artificial Sequence
  Synthetic oligonucleotide
gaggggtggaggttacgatataatgacgtgtaaagga

SEQ ID NO: 97632 - DNA, 37 bp, Artificial Sequence
  Synthetic oligonucleotide
ggtgtgggaaggcggtacaagggcaaggtagccagga

SEQ ID NO: 97633 - DNA, 37 bp, Artificial Sequence
  Synthetic oligonucleotide
ggtaggggggagcatgttgtacacattgagtggcgga

SEQ ID NO: 97634 - DNA, 35 bp, Artificial Sequence
  Synthetic oligonucleotide
gtcacgaaacgggggaatagtaaggtttttaggga

SEQ ID NO: 97635 - DNA, 37 bp, Artificial Sequence
  Synthetic oligonucleotide
tgaaaggggttatagtggggaaaagggtcggggggga

SEQ ID NO: 97636 - DNA, 38 bp, Artificial Sequence
  Synthetic oligonucleotide
aagagggaggttcggggagggttgagccatgtcaatga

SEQ ID NO: 97637 - DNA, 37 bp, Artificial Sequence
  Synthetic oligonucleotide
gaaccgccgtattgtggaggggaaagattcagaatga

SEQ ID NO: 97638 - DNA, 38 bp, Artificial Sequence
  Synthetic oligonucleotide
ttgcatgtccccacgcgtgattttcgtccttttaatga

SEQ ID NO: 97639 - DNA, 36 bp, Artificial Sequence
  Synthetic oligonucleotide
gtgccccgtacacggaacaaaaggcgtatcccatga

SEQ ID NO: 97640 - DNA, 38 bp, Artificial Sequence
  Synthetic oligonucleotide
gatgagcgcaatgcgtataggtgtgggaataacgatga

SEQ ID NO: 97641 - DNA, 38 bp, Artificial Sequence
  Synthetic oligonucleotide
gaacgcacaacgcaggaggagggggagtccgacgatga

SEQ ID NO: 97642 - DNA, 38 bp, Artificial Sequence
  Synthetic oligonucleotide
acgcacgaaggtaacgtatgagcggcgtaatttgatga

SEQ ID NO: 97643 - DNA, 38 bp, Artificial Sequence
  Synthetic oligonucleotide
aatgtgcgacaggagcagattagggaagcacggtctga

SEQ ID NO: 97644 - DNA, 37 bp, Artificial Sequence
  Synthetic oligonucleotide
accgcacaggaatgggtgcatgtgcggacgattctga

SEQ ID NO: 97645 - DNA, 36 bp, Artificial Sequence
  Synthetic oligonucleotide
ttccgcccaccagatcttgatcgattacaccggtga

SEQ ID NO: 97646 - DNA, 38 bp, Artificial Sequence
  Synthetic oligonucleotide
aaacgaacgtggaaggtgaccttgggaaacacgggtga

SEQ ID NO: 97647 - DNA, 38 bp, Artificial Sequence
  Synthetic oligonucleotide
tggacgatggtgcgctgaatagcaggaaatggtggtga

SEQ ID NO: 97648 - DNA, 36 bp, Artificial Sequence
  Synthetic oligonucleotide
gacaccgcactgcactgcacgccacccaaattgtga

SEQ ID NO: 97649 - DNA, 38 bp, Artificial Sequence
  Synthetic oligonucleotide
ggaaccaaagaggttggaatagggtgagtttagattga

SEQ ID NO: 97650 - DNA, 35 bp, Artificial Sequence
  Synthetic oligonucleotide
tgactgagtgtgggggaaagaaagatgatgcttga

SEQ ID NO: 97651 - DNA, 37 bp, Artificial Sequence
  Synthetic oligonucleotide
acatcaccgtcacacgactaacctgtcaccttgttga

SEQ ID NO: 97652 - DNA, 38 bp, Artificial Sequence
  Synthetic oligonucleotide
tagacgacgcaaaagaccggattaagacgtaggtttga

SEQ ID NO: 97653 - DNA, 36 bp, Artificial Sequence
  Synthetic oligonucleotide
tcacgcgcgacttaagggattaacgggatgagagta

SEQ ID NO: 97654 - DNA, 35 bp, Artificial Sequence
  Synthetic oligonucleotide
tacgtgcccctggtgatcatagttctagcctcgta

SEQ ID NO: 97655 - DNA, 35 bp, Artificial Sequence
  Synthetic oligonucleotide
ttccaggctgcctccaacccgcctaaaggagctta

SEQ ID NO: 97656 - DNA, 36 bp, Artificial Sequence
  Synthetic oligonucleotide
acaccccggttgtgcctcatcatggttatgatctta

SEQ ID NO: 97657 - DNA, 36 bp, Artificial Sequence
  Synthetic oligonucleotide
gttgcccgagcatcgggtgttaccatcgacgtgtta

SEQ ID NO: 97658 - DNA, 35 bp, Artificial Sequence
  Synthetic oligonucleotide
gtgagcggacagaacaaaaaaagggcgctctttta

SEQ ID NO: 97659 - DNA, 35 bp, Artificial Sequence
  Synthetic oligonucleotide
ttcacccggtcaccaacgctagcgaggtcatctac

SEQ ID NO: 97660 - DNA, 35 bp, Artificial Sequence
  Synthetic oligonucleotide
agacgaccgcccgggtgccgactgtcgaactgccc

SEQ ID NO: 97661 - DNA, 35 bp, Artificial Sequence
  Synthetic oligonucleotide
taactcccccaggaagacctgcactctccttcgcc

SEQ ID NO: 97662 - DNA, 35 bp, Artificial Sequence
  Synthetic oligonucleotide
ggactcggctaactgctaccgaagaggtaccatcc

SEQ ID NO: 97663 - DNA, 35 bp, Artificial Sequence
  Synthetic oligonucleotide
aacaagccaggttgctagcctcacacatttgatcc

SEQ ID NO: 97664 - DNA, 35 bp, Artificial Sequence
  Synthetic oligonucleotide
actagcatccttccagatgcttcatcactggttcc

SEQ ID NO: 97665 - DNA, 35 bp, Artificial Sequence
  Synthetic oligonucleotide
gatgcaagggatgggtgttcatggatggattacgc

SEQ ID NO: 97666 - DNA, 35 bp, Artificial Sequence
  Synthetic oligonucleotide
gatctccgcatagggcattgcagcctctcttgcgc

SEQ ID NO: 97667 - DNA, 35 bp, Artificial Sequence
  Synthetic oligonucleotide
gacctgacaccatagctagagtacccaatgactgc

SEQ ID NO: 97668 - DNA, 35 bp, Artificial Sequence
  Synthetic oligonucleotide
gtcaccacttgaaggtgtactccccgggctcattc

SEQ ID NO: 97669 - DNA, 35 bp, Artificial Sequence
  Synthetic oligonucleotide
tgaggcccctgattcgagttgttcggtcaccgttc

SEQ ID NO: 97670 - DNA, 35 bp, Artificial Sequence
  Synthetic oligonucleotide
atcaacccggccacaccgcgatcctcgaacttaag

SEQ ID NO: 97671 - DNA, 35 bp, Artificial Sequence
  Synthetic oligonucleotide
gccgcacccgaccacctctcactggcccttaggag

SEQ ID NO: 97672 - DNA, 35 bp, Artificial Sequence
  Synthetic oligonucleotide
gtgctgcctcgcgtaccacaatcccatcttccccg

SEQ ID NO: 97673 - DNA, 35 bp, Artificial Sequence
  Synthetic oligonucleotide
agtgatggcgtggagacaggatgggaaatagtagg

SEQ ID NO: 97674 - DNA, 35 bp, Artificial Sequence
  Synthetic oligonucleotide
acgagaaggaaggggtaccagaacgtaaatcactg

SEQ ID NO: 97675 - DNA, 35 bp, Artificial Sequence
  Synthetic oligonucleotide
ttacgcctttccgacgatatgcctcgaactccctg

SEQ ID NO: 97676 - DNA, 35 bp, Artificial Sequence
  Synthetic oligonucleotide
atgggtgaaaggaggcaaagaaggtacagcaggtg

SEQ ID NO: 97677 - DNA, 35 bp, Artificial Sequence
  Synthetic oligonucleotide
tccacctgccgttaaaagtgatgaccctgaatgtg

SEQ ID NO: 97678 - DNA, 35 bp, Artificial Sequence
  Synthetic oligonucleotide
tgaagtgggaggaggacaggaatatagagaatttg

SEQ ID NO: 97679 - DNA, 35 bp, Artificial Sequence
  Synthetic oligonucleotide
tgccacccgtggctttgcaacatttattccgtaat

SEQ ID NO: 97680 - DNA, 35 bp, Artificial Sequence
  Synthetic oligonucleotide
tgaggccctccatatgaacattcctgacgatcgat

SEQ ID NO: 97681 - DNA, 34 bp, Artificial Sequence
  Synthetic oligonucleotide
gaacgggtgggtagggagggaatccggacaggat

SEQ ID NO: 97682 - DNA, 35 bp, Artificial Sequence
  Synthetic oligonucleotide
tgacgtgaggagaagcacgagttaatgatggttat

SEQ ID NO: 97683 - DNA, 35 bp, Artificial Sequence
  Synthetic oligonucleotide
tcatccgacaccctgttatggtccgcaattacact

SEQ ID NO: 97684 - DNA, 35 bp, Artificial Sequence
  Synthetic oligonucleotide
gacggacctcctgcttgtgagacttctacaccgct

SEQ ID NO: 97685 - DNA, 35 bp, Artificial Sequence
  Synthetic oligonucleotide
atggtggaactggcgggtaacgacagaagggcgct

SEQ ID NO: 97686 - DNA, 35 bp, Artificial Sequence
  Synthetic oligonucleotide
acctacactcgctcacctagggatctataccaaaa

SEQ ID NO: 97687 - DNA, 36 bp, Artificial Sequence
  Synthetic oligonucleotide
tacatcgcggaggagaccatacagttttcggggaaa

SEQ ID NO: 97688 - DNA, 36 bp, Artificial Sequence
  Synthetic oligonucleotide
tactacactgccagatcctagttgtctccggtgaaa

SEQ ID NO: 97689 - DNA, 36 bp, Artificial Sequence
  Synthetic oligonucleotide
tagttcagcggcacacgtcacaccctctccaggcaa

SEQ ID NO: 97690 - DNA, 36 bp, Artificial Sequence
  Synthetic oligonucleotide
agtcggaggggtgaaacttaggcagagggcggtcaa

SEQ ID NO: 97691 - DNA, 35 bp, Artificial Sequence
  Synthetic oligonucleotide
gatgggggtcggggcaggtaagtacacgtagagaa

SEQ ID NO: 97692 - DNA, 36 bp, Artificial Sequence
  Synthetic oligonucleotide
gttgatatcaagcgggggaaaggtactgagcgggaa

SEQ ID NO: 97693 - DNA, 36 bp, Artificial Sequence
  Synthetic oligonucleotide
gcacgccgttgaaggtcactgggcgggtctggggaa

SEQ ID NO: 97694 - DNA, 36 bp, Artificial Sequence
  Synthetic oligonucleotide
tcctaaacgcagaccgtggtctagcgatactactaa

SEQ ID NO: 97695 - DNA, 36 bp, Artificial Sequence
  Synthetic oligonucleotide
aagaccgatgtgcggttgagtatggcatgtgtaaca

SEQ ID NO: 97696 - DNA, 36 bp, Artificial Sequence
  Synthetic oligonucleotide
gacacaactcagcaatatgacgaattgcctatgaca

SEQ ID NO: 97697 - DNA, 35 bp, Artificial Sequence
  Synthetic oligonucleotide
tccctgtatgccatcttcgctgacttatgcaacca

SEQ ID NO: 97698 - DNA, 35 bp, Artificial Sequence
  Synthetic oligonucleotide
gcacgcgcacatgcgcaatatgttctgttccagca

SEQ ID NO: 97699 - DNA, 36 bp, Artificial Sequence
  Synthetic oligonucleotide
ggaccaggggggtggggtcgttattgagccgaatca

SEQ ID NO: 97700 - DNA, 35 bp, Artificial Sequence
  Synthetic oligonucleotide
ttcatcagaccacctgcgctgtacatacgttatca

SEQ ID NO: 97701 - DNA, 36 bp, Artificial Sequence
  Synthetic oligonucleotide
gcagggaaacgcgggaagaagcatgggggtttatca

SEQ ID NO: 97702 - DNA, 35 bp, Artificial Sequence
  Synthetic oligonucleotide
tgccgagatggcaggcacgtacgcatcgatattca

SEQ ID NO: 97703 - DNA, 37 bp, Artificial Sequence
  Synthetic oligonucleotide
ggtgggagacggggagatagggtcagatggcagcaga

SEQ ID NO: 97704 - DNA, 35 bp, Artificial Sequence
  Synthetic oligonucleotide
tacggtctgacgcgccctactcctgcctattgaga

SEQ ID NO: 97705 - DNA, 37 bp, Artificial Sequence
  Synthetic oligonucleotide
atgacacggcagatctcccttactcccatatttgaga

SEQ ID NO: 97706 - DNA, 37 bp, Artificial Sequence
  Synthetic oligonucleotide
atgtgtgcaggacgtagcggtgggggacaggcgtaga

SEQ ID NO: 97707 - DNA, 37 bp, Artificial Sequence
  Synthetic oligonucleotide
tctcgttagcgctcacatctgcccttcgctagtacga

SEQ ID NO: 97708 - DNA, 36 bp, Artificial Sequence
  Synthetic oligonucleotide
tctccaccgtgccacattgtttgtcatgagcaccga

SEQ ID NO: 97709 - DNA, 37 bp, Artificial Sequence
  Synthetic oligonucleotide
tgtgtgggacgggaagtggccgggtggaggacgccga

SEQ ID NO: 97710 - DNA, 36 bp, Artificial Sequence
  Synthetic oligonucleotide
gccacacagcgtgcagtgcgcacataacgcctccga

SEQ ID NO: 97711 - DNA, 37 bp, Artificial Sequence
  Synthetic oligonucleotide
atgtccagcagtccttcgggagccatacataatgcga

SEQ ID NO: 97712 - DNA, 37 bp, Artificial Sequence
  Synthetic oligonucleotide
aatgcggcacgacgaattttatgcaactccccttcga

SEQ ID NO: 97713 - DNA, 37 bp, Artificial Sequence
  Synthetic oligonucleotide
attgccacgtagcgcgggaacttgatcactccttcga

SEQ ID NO: 97714 - DNA, 37 bp, Artificial Sequence
  Synthetic oligonucleotide
aattccacatcacaggacgagaaagacaccgcaagga

SEQ ID NO: 97715 - DNA, 37 bp, Artificial Sequence
  Synthetic oligonucleotide
actgcacaagacccaccacaccgcgctgcctctcgga

SEQ ID NO: 97716 - DNA, 37 bp, Artificial Sequence
  Synthetic oligonucleotide
tgagaacgctcctctgaccactcaatcctccatggga

SEQ ID NO: 97717 - DNA, 36 bp, Artificial Sequence
  Synthetic oligonucleotide
aagtgctgcagggcgtttcgtgatgagggtctggga

SEQ ID NO: 97718 - DNA, 37 bp, Artificial Sequence
  Synthetic oligonucleotide
gcgatcacccaccatgttgcctggaccagccactgga

SEQ ID NO: 97719 - DNA, 37 bp, Artificial Sequence
  Synthetic oligonucleotide
tagggtgtgtggcgcggggtgggagggaccagtatga

SEQ ID NO: 97720 - DNA, 37 bp, Artificial Sequence
  Synthetic oligonucleotide
tgatagtgcgagagggatggggaaggcttgattatga

SEQ ID NO: 97721 - DNA, 38 bp, Artificial Sequence
  Synthetic oligonucleotide
gacgagccgtaaggggaataagagtaactttatactga

SEQ ID NO: 97722 - DNA, 38 bp, Artificial Sequence
  Synthetic oligonucleotide
aaaagaggtaggggtgataggagtagaaggtgtagtga

SEQ ID NO: 97723 - DNA, 37 bp, Artificial Sequence
  Synthetic oligonucleotide
ttgggtgaacgtacagagttgggagggaaatccgtga

SEQ ID NO: 97724 - DNA, 38 bp, Artificial Sequence
  Synthetic oligonucleotide
acactccgaagtgacgaacccagccgcctattccgtga

SEQ ID NO: 97725 - DNA, 38 bp, Artificial Sequence
  Synthetic oligonucleotide
tcaagctgcgaggcatttaatgcaacgggagagggtga

SEQ ID NO: 97726 - DNA, 37 bp, Artificial Sequence
  Synthetic oligonucleotide
aacgacgacgagagtttgaacaagagtggaggggtga

SEQ ID NO: 97727 - DNA, 38 bp, Artificial Sequence
  Synthetic oligonucleotide
gagcaaacgaagagtatgacctatatggtcagctgtga

SEQ ID NO: 97728 - DNA, 37 bp, Artificial Sequence
  Synthetic oligonucleotide
ttgcggcacacattggttagaacccccctttctgtga

SEQ ID NO: 97729 - DNA, 38 bp, Artificial Sequence
  Synthetic oligonucleotide
aagaccacagtgccaccatagggagacgttcattgtga

SEQ ID NO: 97730 - DNA, 38 bp, Artificial Sequence
  Synthetic oligonucleotide
gagtggcggggtcggggcagataggagaggcacgttga

SEQ ID NO: 97731 - DNA, 38 bp, Artificial Sequence
  Synthetic oligonucleotide
tcgatctgcggtgaggggttgcacgggcatatttttga

SEQ ID NO: 97732 - DNA, 37 bp, Artificial Sequence
  Synthetic oligonucleotide
acgaccaaacttaggaatcagtcacctgccagtaata

SEQ ID NO: 97733 - DNA, 36 bp, Artificial Sequence
  Synthetic oligonucleotide
ttcgccatccgttctgggtttttacgtccatctata

SEQ ID NO: 97734 - DNA, 36 bp, Artificial Sequence
  Synthetic oligonucleotide
ttgatccctgccccgaaacacatcgtgactcgatta

SEQ ID NO: 97735 - DNA, 35 bp, Artificial Sequence
  Synthetic oligonucleotide
gacgcatgataaggcggcacggaaggaataagtta

SEQ ID NO: 97736 - DNA, 35 bp, Artificial Sequence
  Synthetic oligonucleotide
aagagcacactgcgccaaatctccacgcctacaac

SEQ ID NO: 97737 - DNA, 35 bp, Artificial Sequence
  Synthetic oligonucleotide
gctaaccagcctcactcccttgctactaataccac

SEQ ID NO: 97738 - DNA, 35 bp, Artificial Sequence
  Synthetic oligonucleotide
gctgccgtactcatcccatgtcatttggctatcac

SEQ ID NO: 97739 - DNA, 35 bp, Artificial Sequence
  Synthetic oligonucleotide
acgagaccgaggatacatctgctcttgtttactac

SEQ ID NO: 97740 - DNA, 35 bp, Artificial Sequence
  Synthetic oligonucleotide
gattccactcagcttgttgcgaattcctggcctac

SEQ ID NO: 97741 - DNA, 35 bp, Artificial Sequence
  Synthetic oligonucleotide
gagtgcctgatccggccaattagctttagtcctac

SEQ ID NO: 97742 - DNA, 35 bp, Artificial Sequence
  Synthetic oligonucleotide
tgtagccactaaatgcagcactatccggtctctac

SEQ ID NO: 97743 - DNA, 35 bp, Artificial Sequence
  Synthetic oligonucleotide
tgtgaccacatatactacaccgtgcgtttcacgcc

SEQ ID NO: 97744 - DNA, 35 bp, Artificial Sequence
  Synthetic oligonucleotide
tgcaaaccctgctccccacgccaataacttacgcc

SEQ ID NO: 97745 - DNA, 35 bp, Artificial Sequence
  Synthetic oligonucleotide
aactcgcgcaagtgataatacctcggttctggatc

SEQ ID NO: 97746 - DNA, 35 bp, Artificial Sequence
  Synthetic oligonucleotide
gcaacacgtagatagctgggcttttaccgttcttc

SEQ ID NO: 97747 - DNA, 34 bp, Artificial Sequence
  Synthetic oligonucleotide
attccacatccgcatatgatttctgttactgttc

SEQ ID NO: 97748 - DNA, 35 bp, Artificial Sequence
  Synthetic oligonucleotide
agtcgagccgcaaacggaggctgtcaccccttttc

SEQ ID NO: 97749 - DNA, 35 bp, Artificial Sequence
  Synthetic oligonucleotide
gatcgccgccatcttcatagcacaggctggtaccg

SEQ ID NO: 97750 - DNA, 35 bp, Artificial Sequence
  Synthetic oligonucleotide
acaggggtgggtagttgagtgctaaagagtgaggg

SEQ ID NO: 97751 - DNA, 35 bp, Artificial Sequence
  Synthetic oligonucleotide
gacgcagaacagacgggggatagaatgtgggtatg

SEQ ID NO: 97752 - DNA, 35 bp, Artificial Sequence
  Synthetic oligonucleotide
gtgtgcaggccagttctctactacttcttcttctg

SEQ ID NO: 97753 - DNA, 35 bp, Artificial Sequence
  Synthetic oligonucleotide
ggatgctgtcgaagagggagaaaaggatgttgttg

SEQ ID NO: 97754 - DNA, 35 bp, Artificial Sequence
  Synthetic oligonucleotide
tgccctggccacatctcaccccctttgtttgcaat

SEQ ID NO: 97755 - DNA, 35 bp, Artificial Sequence
  Synthetic oligonucleotide
tacttcaccggctccagattctcgtgcgaccgaat

SEQ ID NO: 97756 - DNA, 35 bp, Artificial Sequence
  Synthetic oligonucleotide
tgcccgacccatacatcgcgctctgctcaagttat

SEQ ID NO: 97757 - DNA, 35 bp, Artificial Sequence
  Synthetic oligonucleotide
acgacactcgagctacaggaccacttggttcaact

SEQ ID NO: 97758 - DNA, 35 bp, Artificial Sequence
  Synthetic oligonucleotide
acatcgccccactaaactatactcgcacacacact

SEQ ID NO: 97759 - DNA, 35 bp, Artificial Sequence
  Synthetic oligonucleotide
ttagtgcgggaaggaggtgattggggactagggct

SEQ ID NO: 97760 - DNA, 35 bp, Artificial Sequence
  Synthetic oligonucleotide
gactgtccagccgaaataaaggtcttcccgatgct

SEQ ID NO: 97761 - DNA, 35 bp, Artificial Sequence
  Synthetic oligonucleotide
aaaatgggagtgaggatgcgtgtgtagtgggcagt

SEQ ID NO: 97762 - DNA, 35 bp, Artificial Sequence
  Synthetic oligonucleotide
gacatgccttccatatcttggaagatcatttaatt

SEQ ID NO: 97763 - DNA, 35 bp, Artificial Sequence
  Synthetic oligonucleotide
atgcccgccaattagttggctcccgacactgattt

SEQ ID NO: 97764 - DNA, 36 bp, Artificial Sequence
  Synthetic oligonucleotide
gcacacgactgtccaaaggagttgttgacaaggaaa

SEQ ID NO: 97765 - DNA, 36 bp, Artificial Sequence
  Synthetic oligonucleotide
gcgtaatcgcacagccttattccacagttagtacaa

SEQ ID NO: 97766 - DNA, 36 bp, Artificial Sequence
  Synthetic oligonucleotide
gtcacggacagggataaaacacatagtagtgggcaa

SEQ ID NO: 97767 - DNA, 36 bp, Artificial Sequence
  Synthetic oligonucleotide
gcaggaacgggtagtgtgatgtacgatagaatgcaa

SEQ ID NO: 97768 - DNA, 36 bp, Artificial Sequence
  Synthetic oligonucleotide
gctaaccctttccaccatgtacacacacgtactgaa

SEQ ID NO: 97769 - DNA, 37 bp, Artificial Sequence
  Synthetic oligonucleotide
accactgccttcaagtcctccctaggctgttacataa

SEQ ID NO: 97770 - DNA, 36 bp, Artificial Sequence
  Synthetic oligonucleotide
gtacacgtctcagacttcttgttatccgttcaaaca

SEQ ID NO: 97771 - DNA, 35 bp, Artificial Sequence
  Synthetic oligonucleotide
gatgtgtcacgtagtgtgacgaacatggcctaaca

SEQ ID NO: 97772 - DNA, 36 bp, Artificial Sequence
  Synthetic oligonucleotide
gttgcctcggtccaagagcactggcccaaattaaca

SEQ ID NO: 97773 - DNA, 36 bp, Artificial Sequence
  Synthetic oligonucleotide
gtcaaccataggtgctacaacaaactttcgatcgca

SEQ ID NO: 97774 - DNA, 36 bp, Artificial Sequence
  Synthetic oligonucleotide
gatcgacgacttgtacctaacccgcttttgcctgca

SEQ ID NO: 97775 - DNA, 36 bp, Artificial Sequence
  Synthetic oligonucleotide
tatggctgcgaacctgtgtgcattctccacctctca

SEQ ID NO: 97776 - DNA, 36 bp, Artificial Sequence
  Synthetic oligonucleotide
tgccaaacaacacatcatggatcggacttctagtca

SEQ ID NO: 97777 - DNA, 36 bp, Artificial Sequence
  Synthetic oligonucleotide
gacgagtgaccaaaaatgtgcggaaaaatcgtgtca

SEQ ID NO: 97778 - DNA, 37 bp, Artificial Sequence
  Synthetic oligonucleotide
agtggtgggcgcagtgagtcgcagttgaataaacaga

SEQ ID NO: 97779 - DNA, 37 bp, Artificial Sequence
  Synthetic oligonucleotide
aaacatgagagctgaggtgtgtgatgcggtgtagaga

SEQ ID NO: 97780 - DNA, 37 bp, Artificial Sequence
  Synthetic oligonucleotide
tgtgtgacagtgcattaaaggagggcaaacgatgaga

SEQ ID NO: 97781 - DNA, 37 bp, Artificial Sequence
  Synthetic oligonucleotide
tgccatcgatccggcgcactaagctccactttataga

SEQ ID NO: 97782 - DNA, 37 bp, Artificial Sequence
  Synthetic oligonucleotide
aagcccaggcgtgggggcttagtacgagatcattaga

SEQ ID NO: 97783 - DNA, 33 bp, Artificial Sequence
  Synthetic oligonucleotide
tccgcacactgctagattagccccgcaacacga

SEQ ID NO: 97784 - DNA, 37 bp, Artificial Sequence
  Synthetic oligonucleotide
gcactcagaggaggtctgtgaggaagaagcgggggga

SEQ ID NO: 97785 - DNA, 37 bp, Artificial Sequence
  Synthetic oligonucleotide
gagcaggtagggacgggaaagttggctcgtactggga

SEQ ID NO: 97786 - DNA, 37 bp, Artificial Sequence
  Synthetic oligonucleotide
gtagagacggaaaatggaaatgagctatttggaatga

SEQ ID NO: 97787 - DNA, 37 bp, Artificial Sequence
  Synthetic oligonucleotide
tagctcgccgcccacaaagcaaaagatcacatcatga

SEQ ID NO: 97788 - DNA, 37 bp, Artificial Sequence
  Synthetic oligonucleotide
ttgccgccatacagaagtcctgcacctcgaaccctga

SEQ ID NO: 97789 - DNA, 37 bp, Artificial Sequence
  Synthetic oligonucleotide
tacagccacatgaaacccccaagttgtccagtcctga

SEQ ID NO: 97790 - DNA, 38 bp, Artificial Sequence
  Synthetic oligonucleotide
gcaagtggcctcagttgttcttcttgtgccaaatctga

SEQ ID NO: 97791 - DNA, 38 bp, Artificial Sequence
  Synthetic oligonucleotide
accagccaagggaacgtcttagtaggtgcttttcgtga

SEQ ID NO: 97792 - DNA, 37 bp, Artificial Sequence
  Synthetic oligonucleotide
gcaggagccggagaattactggagtaccttaaggtga

SEQ ID NO: 97793 - DNA, 38 bp, Artificial Sequence
  Synthetic oligonucleotide
agatggacaaggggggtggaattgtgcaagggcggtga

SEQ ID NO: 97794 - DNA, 35 bp, Artificial Sequence
  Synthetic oligonucleotide
acctcaacccatccggtttgagagttctatcttga

SEQ ID NO: 97795 - DNA, 35 bp, Artificial Sequence
  Synthetic oligonucleotide
tcagtccacgggcggtattcgtaagtctgccaata

SEQ ID NO: 97796 - DNA, 36 bp, Artificial Sequence
  Synthetic oligonucleotide
gatcaatgtcatgttctgtctggtctcgttttgcta

SEQ ID NO: 97797 - DNA, 36 bp, Artificial Sequence
  Synthetic oligonucleotide
agtacgcaggggagccaacttagtcgggttgatcta

SEQ ID NO: 97798 - DNA, 36 bp, Artificial Sequence
  Synthetic oligonucleotide
tgaacaagcgcattaagggggatgatgtaaccagta

SEQ ID NO: 97799 - DNA, 35 bp, Artificial Sequence
  Synthetic oligonucleotide
gcccgagtccaaagccaatttcccgtcctcgagta

SEQ ID NO: 97800 - DNA, 35 bp, Artificial Sequence
  Synthetic oligonucleotide
tcaacgtgccaagagaatacggaggacgggaggta

SEQ ID NO: 97801 - DNA, 35 bp, Artificial Sequence
  Synthetic oligonucleotide
tacaagcgaagagaaacggggagggggctaaatta

SEQ ID NO: 97802 - DNA, 35 bp, Artificial Sequence
  Synthetic oligonucleotide
gtagagccaccgctgagtgattcctctcaataaac

SEQ ID NO: 97803 - DNA, 35 bp, Artificial Sequence
  Synthetic oligonucleotide
ttacacccagccgtgccatagcctttgggattcac

SEQ ID NO: 97804 - DNA, 35 bp, Artificial Sequence
  Synthetic oligonucleotide
tgttgtgcgttcacagctcctatcgcccccagtac

SEQ ID NO: 97805 - DNA, 35 bp, Artificial Sequence
  Synthetic oligonucleotide
acgcgaaggtcgagctcgaatcatgaccattgccc

SEQ ID NO: 97806 - DNA, 35 bp, Artificial Sequence
  Synthetic oligonucleotide
tacgaggcgtgcccgacgcgtagccacttcttatc

SEQ ID NO: 97807 - DNA, 35 bp, Artificial Sequence
  Synthetic oligonucleotide
gacgttagtcagcatgtcatccctacccctctctc

SEQ ID NO: 97808 - DNA, 35 bp, Artificial Sequence
  Synthetic oligonucleotide
tcacatgcaggcgatctttcagatggtacgtcttc

SEQ ID NO: 97809 - DNA, 35 bp, Artificial Sequence
  Synthetic oligonucleotide
gaaacatgaggggtggacgaaagagtcgatgttag

SEQ ID NO: 97810 - DNA, 35 bp, Artificial Sequence
  Synthetic oligonucleotide
gccaccattctggtctgtcacggagcaggcccacg

SEQ ID NO: 97811 - DNA, 35 bp, Artificial Sequence
  Synthetic oligonucleotide
attcgtcgcactccatcaatgcgtgatcctctacg

SEQ ID NO: 97812 - DNA, 35 bp, Artificial Sequence
  Synthetic oligonucleotide
acaccctgttatgtcttggcaacactatgcttacg

SEQ ID NO: 97813 - DNA, 35 bp, Artificial Sequence
  Synthetic oligonucleotide
gtacgactagctcaggacgtcctactttttctgcg

SEQ ID NO: 97814 - DNA, 35 bp, Artificial Sequence
  Synthetic oligonucleotide
gactacagcacaagattgggtggggtaaatcttcg

SEQ ID NO: 97815 - DNA, 35 bp, Artificial Sequence
  Synthetic oligonucleotide
tccacaacacatcaatggtcatcaatcacccttgg

SEQ ID NO: 97816 - DNA, 35 bp, Artificial Sequence
  Synthetic oligonucleotide
tcaagcaaagcgggtcctggcaatcacaaatcgtg

SEQ ID NO: 97817 - DNA, 35 bp, Artificial Sequence
  Synthetic oligonucleotide
aacgaccagttcagtaattcagaggtctacgtttg

SEQ ID NO: 97818 - DNA, 35 bp, Artificial Sequence
  Synthetic oligonucleotide
ttgcgcacgagggcctttagcattggttacacaat

SEQ ID NO: 97819 - DNA, 35 bp, Artificial Sequence
  Synthetic oligonucleotide
gactcaccaccggatcgaccccgataatgtcccat

SEQ ID NO: 97820 - DNA, 35 bp, Artificial Sequence
  Synthetic oligonucleotide
gagcctcaatgcaccctcgttccgtactaaagcat

SEQ ID NO: 97821 - DNA, 35 bp, Artificial Sequence
  Synthetic oligonucleotide
atgaacccatcgccgctgcaggcccttcttcctat

SEQ ID NO: 97822 - DNA, 35 bp, Artificial Sequence
  Synthetic oligonucleotide
atagccccacccaggtacgttatttctacaggtat

SEQ ID NO: 97823 - DNA, 35 bp, Artificial Sequence
  Synthetic oligonucleotide
atcgcacagagtagcgtgtggtaattgatgtttat

SEQ ID NO: 97824 - DNA, 35 bp, Artificial Sequence
  Synthetic oligonucleotide
ttcacagccatagcttggaatgacgctttcaccct

SEQ ID NO: 97825 - DNA, 35 bp, Artificial Sequence
  Synthetic oligonucleotide
tgactaaggagccccctcacgttcgtaccacccct

SEQ ID NO: 97826 - DNA, 35 bp, Artificial Sequence
  Synthetic oligonucleotide
gatcgctcaggcccgactgccatgtcaccatctgt

SEQ ID NO: 97827 - DNA, 35 bp, Artificial Sequence
  Synthetic oligonucleotide
ggtcacctgcctcggtaagggtgactacatctatt

SEQ ID NO: 97828 - DNA, 35 bp, Artificial Sequence
  Synthetic oligonucleotide
gcgccatgcttctcatgcgccgtaccaccttgttt

SEQ ID NO: 97829 - DNA, 35 bp, Artificial Sequence
  Synthetic oligonucleotide
gatgcatctcctttggttagtacatccctatcgaa

SEQ ID NO: 97830 - DNA, 35 bp, Artificial Sequence
  Synthetic oligonucleotide
gccttggcgcccaccgtgattaacccctccagtaa

SEQ ID NO: 97831 - DNA, 36 bp, Artificial Sequence
  Synthetic oligonucleotide
tacatgcgctctgcatttactgccgagaattaaaca

SEQ ID NO: 97832 - DNA, 36 bp, Artificial Sequence
  Synthetic oligonucleotide
ttgggtatcgccgctgcctgcaccataccattgaca

SEQ ID NO: 97833 - DNA, 35 bp, Artificial Sequence
  Synthetic oligonucleotide
ttccaccgccagtaggctttgacccattatgtaca

SEQ ID NO: 97834 - DNA, 35 bp, Artificial Sequence
  Synthetic oligonucleotide
tgcaatgggaggaggcgcccataatggaaattaca

SEQ ID NO: 97835 - DNA, 35 bp, Artificial Sequence
  Synthetic oligonucleotide
gacacatattcccacgtcctctctcctatgagcca

SEQ ID NO: 97836 - DNA, 36 bp, Artificial Sequence
  Synthetic oligonucleotide
gcctgcccatattgccgcatagggaaatcccttcca

SEQ ID NO: 97837 - DNA, 34 bp, Artificial Sequence
  Synthetic oligonucleotide
atacgccaccgactcgcccgcccatcacccggca

SEQ ID NO: 97838 - DNA, 36 bp, Artificial Sequence
  Synthetic oligonucleotide
gaccccgcccaggactgttggtttcgcgttttatca

SEQ ID NO: 97839 - DNA, 36 bp, Artificial Sequence
  Synthetic oligonucleotide
agaccgtccattgcgtcctcttcaccgtttctgtca

SEQ ID NO: 97840 - DNA, 35 bp, Artificial Sequence
  Synthetic oligonucleotide
tcaagacgaagacaaggggaaggggcacgaacaga

SEQ ID NO: 97841 - DNA, 37 bp, Artificial Sequence
  Synthetic oligonucleotide
tgaccaagtgatgattgggtgccaggagtagtggaga

SEQ ID NO: 97842 - DNA, 37 bp, Artificial Sequence
  Synthetic oligonucleotide
accacaaccccggtcagtgtatgtctaccaactgaga

SEQ ID NO: 97843 - DNA, 36 bp, Artificial Sequence
  Synthetic oligonucleotide
atgtgaaggggccgaagtgctagaacacggcataga

SEQ ID NO: 97844 - DNA, 37 bp, Artificial Sequence
  Synthetic oligonucleotide
aacgagaggggaaggggagacttagagtcgcgctaga

SEQ ID NO: 97845 - DNA, 37 bp, Artificial Sequence
  Synthetic oligonucleotide
gatgggcacgagcaaggaggacggaactcgtaaacga

SEQ ID NO: 97846 - DNA, 37 bp, Artificial Sequence
  Synthetic oligonucleotide
tcagggtgaggtgaagtgggctgaccgccatgaacga

SEQ ID NO: 97847 - DNA, 37 bp, Artificial Sequence
  Synthetic oligonucleotide
tgcacgcacgagtttttctctcttggccagcctacga

SEQ ID NO: 97848 - DNA, 36 bp, Artificial Sequence
  Synthetic oligonucleotide
gatgcgggtaggttgagaaatcgggaacatcagcga

SEQ ID NO: 97849 - DNA, 37 bp, Artificial Sequence
  Synthetic oligonucleotide
gctcgcgcaaaagcgggcacgtgttattgcgatgcga

SEQ ID NO: 97850 - DNA, 37 bp, Artificial Sequence
  Synthetic oligonucleotide
acgaatgccacacaaaaaggcggagacaacagttcga

SEQ ID NO: 97851 - DNA, 38 bp, Artificial Sequence
  Synthetic oligonucleotide
taacgctcatggtgaagggggtaggaatgtaagcagga

SEQ ID NO: 97852 - DNA, 37 bp, Artificial Sequence
  Synthetic oligonucleotide
tgcacgtgtgccgcggaggtaaaagcaggatagagga

SEQ ID NO: 97853 - DNA, 37 bp, Artificial Sequence
  Synthetic oligonucleotide
acgcccggacacaaaagggttaaggaaatggcgagga

SEQ ID NO: 97854 - DNA, 35 bp, Artificial Sequence
  Synthetic oligonucleotide
gtggagggagctgggccgaagagagtgagaccgga

SEQ ID NO: 97855 - DNA, 37 bp, Artificial Sequence
  Synthetic oligonucleotide
taagcatgaaggcggaaagcacgtaagggtcatcgga

SEQ ID NO: 97856 - DNA, 37 bp, Artificial Sequence
  Synthetic oligonucleotide
tcagagtggaagacagcgtaatagaagttcattggga

SEQ ID NO: 97857 - DNA, 37 bp, Artificial Sequence
  Synthetic oligonucleotide
tacactactgcctcaagacttgctcctagaccctgga

SEQ ID NO: 97858 - DNA, 38 bp, Artificial Sequence
  Synthetic oligonucleotide
tacggtggaggtacggccgggttggaaccgagtaatga

SEQ ID NO: 97859 - DNA, 38 bp, Artificial Sequence
  Synthetic oligonucleotide
gaggatgacgcagtgcttagacctgcccgccaacatga

SEQ ID NO: 97860 - DNA, 38 bp, Artificial Sequence
  Synthetic oligonucleotide
gtgggaagggcacaacgggtgcggtatgacagacatga

SEQ ID NO: 97861 - DNA, 38 bp, Artificial Sequence
  Synthetic oligonucleotide
acgcacatctagtggtcctccttctctgtcagccatga

SEQ ID NO: 97862 - DNA, 38 bp, Artificial Sequence
  Synthetic oligonucleotide
gcaactagtcagccgagtttggggactagttatgatga

SEQ ID NO: 97863 - DNA, 38 bp, Artificial Sequence
  Synthetic oligonucleotide
acacgaggtgtcgaaggtatgggatgataacgatatga

SEQ ID NO: 97864 - DNA, 38 bp, Artificial Sequence
  Synthetic oligonucleotide
atgaccaaggcggggcggaagagcacactacgatatga

SEQ ID NO: 97865 - DNA, 38 bp, Artificial Sequence
  Synthetic oligonucleotide
tccgcaacagaggaatgaggagatggggctcattatga

SEQ ID NO: 97866 - DNA, 36 bp, Artificial Sequence
  Synthetic oligonucleotide
tccccacccgttcatgagcagagggtgcctacctga

SEQ ID NO: 97867 - DNA, 38 bp, Artificial Sequence
  Synthetic oligonucleotide
accgcccagactgatattagcctacccacttgctctga

SEQ ID NO: 97868 - DNA, 38 bp, Artificial Sequence
  Synthetic oligonucleotide
gacgatgaaaaggtgggggggacacaggtggattctga

SEQ ID NO: 97869 - DNA, 38 bp, Artificial Sequence
  Synthetic oligonucleotide
atcgcaccaacccacctgaatttgtaactgtcaagtga

SEQ ID NO: 97870 - DNA, 38 bp, Artificial Sequence
  Synthetic oligonucleotide
gccggggcaatgagggttttagctgtcgagggaagtga

SEQ ID NO: 97871 - DNA, 38 bp, Artificial Sequence
  Synthetic oligonucleotide
gacacctccagtggtaacttccgcgaactaacgcgtga

SEQ ID NO: 97872 - DNA, 38 bp, Artificial Sequence
  Synthetic oligonucleotide
taacactcgcacttggccctgttctcgaagtctcgtga

SEQ ID NO: 97873 - DNA, 38 bp, Artificial Sequence
  Synthetic oligonucleotide
atggaggcgtaagctgagggaaatgaggtgcgtcgtga

SEQ ID NO: 97874 - DNA, 38 bp, Artificial Sequence
  Synthetic oligonucleotide
gccaggagacacgcgtgggataaaggttagtgttgtga

SEQ ID NO: 97875 - DNA, 38 bp, Artificial Sequence
  Synthetic oligonucleotide
gttcatggcgtcgactcctattcaacactgtgcattga

SEQ ID NO: 97876 - DNA, 38 bp, Artificial Sequence
  Synthetic oligonucleotide
tccaccgtcgacggcgccgaagacctacaaatgattga

SEQ ID NO: 97877 - DNA, 35 bp, Artificial Sequence
  Synthetic oligonucleotide
gaggaccggaacgggtggaatattccccaacttga

SEQ ID NO: 97878 - DNA, 37 bp, Artificial Sequence
  Synthetic oligonucleotide
gtcccctctgacggaagatggcgccccttacgcttga

SEQ ID NO: 97879 - DNA, 37 bp, Artificial Sequence
  Synthetic oligonucleotide
gatccatgcccggaactacattcgacttagtctttga

SEQ ID NO: 97880 - DNA, 35 bp, Artificial Sequence
  Synthetic oligonucleotide
gacaaagacgcgcgctaagtcaactgccttgaata

SEQ ID NO: 97881 - DNA, 36 bp, Artificial Sequence
  Synthetic oligonucleotide
tcacccggtgagggtccagcgacttttcaactaata

SEQ ID NO: 97882 - DNA, 37 bp, Artificial Sequence
  Synthetic oligonucleotide
tcgcacccatcacatgtccccattcggttcatccata

SEQ ID NO: 97883 - DNA, 36 bp, Artificial Sequence
  Synthetic oligonucleotide
accacgagccgtaggttgtccgtcacttctatcata

SEQ ID NO: 97884 - DNA, 36 bp, Artificial Sequence
  Synthetic oligonucleotide
tagccggtcactctgcagccctggccttctttgata

SEQ ID NO: 97885 - DNA, 36 bp, Artificial Sequence
  Synthetic oligonucleotide
tcgcatcctcccgaattgtcacttagccccgtccta

SEQ ID NO: 97886 - DNA, 36 bp, Artificial Sequence
  Synthetic oligonucleotide
aactacacctgacgaaagcatgtaatgtaccatcta

SEQ ID NO: 97887 - DNA, 36 bp, Artificial Sequence
  Synthetic oligonucleotide
gtgtttccgccctctcgagtgcagtacaatgacgta

SEQ ID NO: 97888 - DNA, 36 bp, Artificial Sequence
  Synthetic oligonucleotide
gcaagacggggttccatgaggcggaggcgggtcgta

SEQ ID NO: 97889 - DNA, 36 bp, Artificial Sequence
  Synthetic oligonucleotide
aacgcctgatatcgcattgtttagggccctcctgta

SEQ ID NO: 97890 - DNA, 36 bp, Artificial Sequence
  Synthetic oligonucleotide
acacaacacagaggccttgactgccggggtctctta

SEQ ID NO: 97891 - DNA, 35 bp, Artificial Sequence
  Synthetic oligonucleotide
gactcgacgatcatgatacgtcaccttgattcaac

SEQ ID NO: 97892 - DNA, 35 bp, Artificial Sequence
  Synthetic oligonucleotide
tctagcaccaaccccacggcacaggagtcgctaac

SEQ ID NO: 97893 - DNA, 35 bp, Artificial Sequence
  Synthetic oligonucleotide
atccaccagacacttcaaggcctccaggagacgac

SEQ ID NO: 97894 - DNA, 35 bp, Artificial Sequence
  Synthetic oligonucleotide
ggggaggatggggtgttggtaaaagggtagatgac

SEQ ID NO: 97895 - DNA, 35 bp, Artificial Sequence
  Synthetic oligonucleotide
gtctccgccttacacacagtgctgttcgtacctac

SEQ ID NO: 97896 - DNA, 35 bp, Artificial Sequence
  Synthetic oligonucleotide
ttgagggtgccagtgagtgtagcgtagtctcaacc

SEQ ID NO: 97897 - DNA, 35 bp, Artificial Sequence
  Synthetic oligonucleotide
gccacccacatgatctttattcgttcacacacccc

SEQ ID NO: 97898 - DNA, 35 bp, Artificial Sequence
  Synthetic oligonucleotide
accgctactgcctgaactcacttgacacccgatcc

SEQ ID NO: 97899 - DNA, 35 bp, Artificial Sequence
  Synthetic oligonucleotide
gacgagtaagggcaggtgtgtcgcgggatgctggc

SEQ ID NO: 97900 - DNA, 35 bp, Artificial Sequence
  Synthetic oligonucleotide
tacgtgtcgtcgatgacacaattaaacgtcactgc

SEQ ID NO: 97901 - DNA, 35 bp, Artificial Sequence
  Synthetic oligonucleotide
ggaacacgggccgtttcgtgtcgaaattcttcatc

SEQ ID NO: 97902 - DNA, 35 bp, Artificial Sequence
  Synthetic oligonucleotide
gatcattgcgccgtctaagtctctgcacacgactc

SEQ ID NO: 97903 - DNA, 35 bp, Artificial Sequence
  Synthetic oligonucleotide
gtgctaacaccgcagttgttgttcactcgatcttc

SEQ ID NO: 97904 - DNA, 35 bp, Artificial Sequence
  Synthetic oligonucleotide
ggtgatgcagcacgtacaagattgggctggaaaag

SEQ ID NO: 97905 - DNA, 35 bp, Artificial Sequence
  Synthetic oligonucleotide
gtgacgtccggcctgtcttacctctttgcctcaag

SEQ ID NO: 97906 - DNA, 35 bp, Artificial Sequence
  Synthetic oligonucleotide
aagtccgcaggggatggctaggaaaggcgatggag

SEQ ID NO: 97907 - DNA, 35 bp, Artificial Sequence
  Synthetic oligonucleotide
gagtaggaagaaggctagaaagggcgttagtcccg

SEQ ID NO: 97908 - DNA, 35 bp, Artificial Sequence
  Synthetic oligonucleotide
tagtggcgatccggctcgtttcttcttgatgttcg

SEQ ID NO: 97909 - DNA, 35 bp, Artificial Sequence
  Synthetic oligonucleotide
gacacgcacattgagccagagaattcggggtgggg

SEQ ID NO: 97910 - DNA, 35 bp, Artificial Sequence
  Synthetic oligonucleotide
atgacgccgactgctgaaccttggaccctgagcat

SEQ ID NO: 97911 - DNA, 35 bp, Artificial Sequence
  Synthetic oligonucleotide
tcgaagcctgtcatctcttcaggacgcttcttcat

SEQ ID NO: 97912 - DNA, 35 bp, Artificial Sequence
  Synthetic oligonucleotide
ggagaggaaggtgggacgcagatcaggtttgcact

SEQ ID NO: 97913 - DNA, 35 bp, Artificial Sequence
  Synthetic oligonucleotide
gtagtcacggccgtagtcgtaccaattgtcccgct

SEQ ID NO: 97914 - DNA, 35 bp, Artificial Sequence
  Synthetic oligonucleotide
aaccgccaatgcccatgccctccgtaaggtcctct

SEQ ID NO: 97915 - DNA, 35 bp, Artificial Sequence
  Synthetic oligonucleotide
tatcggtcgactccacaggcacatcctttctggtt

SEQ ID NO: 97916 - DNA, 35 bp, Artificial Sequence
  Synthetic oligonucleotide
aacgaggaggatatcacgtggagacggggggaaaa

SEQ ID NO: 97917 - DNA, 36 bp, Artificial Sequence
  Synthetic oligonucleotide
gaagcaacgcggagtgttcccaaccttaatgatcaa

SEQ ID NO: 97918 - DNA, 35 bp, Artificial Sequence
  Synthetic oligonucleotide
tgtgaggccccaatgctccttcagttcgccctcaa

SEQ ID NO: 97919 - DNA, 35 bp, Artificial Sequence
  Synthetic oligonucleotide
tcactcacaggtgaatggtagtgcggacattcgaa

SEQ ID NO: 97920 - DNA, 35 bp, Artificial Sequence
  Synthetic oligonucleotide
aacgcatgcagaacgcgcttgaggtaggtggggaa

SEQ ID NO: 97921 - DNA, 36 bp, Artificial Sequence
  Synthetic oligonucleotide
taacaccttgcacgacgtgcctctcaagatactgaa

SEQ ID NO: 97922 - DNA, 36 bp, Artificial Sequence
  Synthetic oligonucleotide
aacaacgccccattgaagctatccgctagttgtgaa

SEQ ID NO: 97923 - DNA, 35 bp, Artificial Sequence
  Synthetic oligonucleotide
gtgcgggtgaggggtgatgttgttccacagcgtaa

SEQ ID NO: 97924 - DNA, 36 bp, Artificial Sequence
  Synthetic oligonucleotide
gtagccaggctacacagatggcttataatttgaaca

SEQ ID NO: 97925 - DNA, 36 bp, Artificial Sequence
  Synthetic oligonucleotide
taaccggtcagggatgaaaacggctcacgtttaaca

SEQ ID NO: 97926 - DNA, 36 bp, Artificial Sequence
  Synthetic oligonucleotide
atcgcacttcgccacattcctatcttctgtgaccca

SEQ ID NO: 97927 - DNA, 36 bp, Artificial Sequence
  Synthetic oligonucleotide
tgccacgcagtgtgacgtgaacctgtacattatcca

SEQ ID NO: 97928 - DNA, 35 bp, Artificial Sequence
  Synthetic oligonucleotide
tgaacgacgccagcgcctccctacaggactcatca

SEQ ID NO: 97929 - DNA, 37 bp, Artificial Sequence
  Synthetic oligonucleotide
tcgataacgaggcggaaggataggaaaccacacaaga

SEQ ID NO: 97930 - DNA, 37 bp, Artificial Sequence
  Synthetic oligonucleotide
tgagacagggggacagccgacaaagaacggtcataga

SEQ ID NO: 97931 - DNA, 37 bp, Artificial Sequence
  Synthetic oligonucleotide
gatgtcagtgtccccgcgcgtgctcctaatctttaga

SEQ ID NO: 97932 - DNA, 35 bp, Artificial Sequence
  Synthetic oligonucleotide
tagatccgcgctgcctaatgaagatgctcccccga

SEQ ID NO: 97933 - DNA, 37 bp, Artificial Sequence
  Synthetic oligonucleotide
gcatcccaccacgtgtctaagctctgcgggttctcga

SEQ ID NO: 97934 - DNA, 36 bp, Artificial Sequence
  Synthetic oligonucleotide
gtcaagacctggacgggtattattggagacgcagga

SEQ ID NO: 97935 - DNA, 37 bp, Artificial Sequence
  Synthetic oligonucleotide
tcacggggaggttcaacggtcaagtggctaccacgga

SEQ ID NO: 97936 - DNA, 37 bp, Artificial Sequence
  Synthetic oligonucleotide
atccacgctgtctcatgtatgtttctttaacggggga

SEQ ID NO: 97937 - DNA, 37 bp, Artificial Sequence
  Synthetic oligonucleotide
gggagggggagctgggtggtcgcgttcccaatgggga

SEQ ID NO: 97938 - DNA, 37 bp, Artificial Sequence
  Synthetic oligonucleotide
atgacaggtaggagttgagggaaacatcgcgagtgga

SEQ ID NO: 97939 - DNA, 36 bp, Artificial Sequence
  Synthetic oligonucleotide
gccacaagcgcagaacaacccgttgctagttgatga

SEQ ID NO: 97940 - DNA, 38 bp, Artificial Sequence
  Synthetic oligonucleotide
tccacctcattgtatgctacctactcagttcatactga

SEQ ID NO: 97941 - DNA, 36 bp, Artificial Sequence
  Synthetic oligonucleotide
tactggtgtacagtaggaggatgaaggagatactga

SEQ ID NO: 97942 - DNA, 38 bp, Artificial Sequence
  Synthetic oligonucleotide
gaggagagactcgaggtagtacggtggaggatagctga

SEQ ID NO: 97943 - DNA, 38 bp, Artificial Sequence
  Synthetic oligonucleotide
agccgcagacagttggctatcgaggggagggtggctga

SEQ ID NO: 97944 - DNA, 38 bp, Artificial Sequence
  Synthetic oligonucleotide
gcgaaccccgcctatttgattggtaacaatcgacgtga

SEQ ID NO: 97945 - DNA, 37 bp, Artificial Sequence
  Synthetic oligonucleotide
tgagacgtgacgtaaggtacgtaggtattatacgtga

SEQ ID NO: 97946 - DNA, 38 bp, Artificial Sequence
  Synthetic oligonucleotide
gaacaccacagttacgcaaatacagtctatggatgtga

SEQ ID NO: 97947 - DNA, 37 bp, Artificial Sequence
  Synthetic oligonucleotide
atgtgaagcaccggtacgcctcataacagctgattga

SEQ ID NO: 97948 - DNA, 38 bp, Artificial Sequence
  Synthetic oligonucleotide
gccgatgcacgggctgtctctaaacgggaacggcttga

SEQ ID NO: 97949 - DNA, 38 bp, Artificial Sequence
  Synthetic oligonucleotide
tatgacggccgtagagttcgcgtaaccctctctcttga

SEQ ID NO: 97950 - DNA, 38 bp, Artificial Sequence
  Synthetic oligonucleotide
atgcatatcgcatatgtagatgtggggtgttacgttga

SEQ ID NO: 97951 - DNA, 35 bp, Artificial Sequence
  Synthetic oligonucleotide
gcgccgtcggaacactacgaacacattccactata

SEQ ID NO: 97952 - DNA, 36 bp, Artificial Sequence
  Synthetic oligonucleotide
gacacagcctgctcgatgtctctgaacaattgccta

SEQ ID NO: 97953 - DNA, 35 bp, Artificial Sequence
  Synthetic oligonucleotide
tgaacgacgcgagggtcaagctgccgtgttactta

SEQ ID NO: 97954 - DNA, 36 bp, Artificial Sequence
  Synthetic oligonucleotide
gagtgcatccaccaatctggtactcgttgacagtta

SEQ ID NO: 97955 - DNA, 36 bp, Artificial Sequence
  Synthetic oligonucleotide
ttgtgacacccagctgttctatctgccacagtgtta

SEQ ID NO: 97956 - DNA, 35 bp, Artificial Sequence
  Synthetic oligonucleotide
acagtcacagctcagttcgggggggctgttgacac

SEQ ID NO: 97957 - DNA, 35 bp, Artificial Sequence
  Synthetic oligonucleotide
tgcgctacgcggtaagctgactcacgacctcaacc

SEQ ID NO: 97958 - DNA, 35 bp, Artificial Sequence
  Synthetic oligonucleotide
tgcgcatcccgacgctggcgcattaaccctccacc

SEQ ID NO: 97959 - DNA, 36 bp, Artificial Sequence
  Synthetic oligonucleotide
gactcgagtgccgaggcgattgacacccacgtgccc

SEQ ID NO: 97960 - DNA, 35 bp, Artificial Sequence
  Synthetic oligonucleotide
gccctctgctggttgttctgtccagaaagattccc

SEQ ID NO: 97961 - DNA, 34 bp, Artificial Sequence
  Synthetic oligonucleotide
gtgagtagggatggacgtgaaaagggagatgagc

SEQ ID NO: 97962 - DNA, 35 bp, Artificial Sequence
  Synthetic oligonucleotide
taatcatgctcattcgtcaatagcgcctactccgc

SEQ ID NO: 97963 - DNA, 35 bp, Artificial Sequence
  Synthetic oligonucleotide
aacgccggcaagtaactgtactggggaactactgc

SEQ ID NO: 97964 - DNA, 35 bp, Artificial Sequence
  Synthetic oligonucleotide
agtacgcgaaatgtcttcgggctttggcacacctc

SEQ ID NO: 97965 - DNA, 35 bp, Artificial Sequence
  Synthetic oligonucleotide
tcactccgtcgccttccgtactcgcggagtatctc

SEQ ID NO: 97966 - DNA, 35 bp, Artificial Sequence
  Synthetic oligonucleotide
aactgcttagctgccttacgagagcgtgggctctc

SEQ ID NO: 97967 - DNA, 35 bp, Artificial Sequence
  Synthetic oligonucleotide
tacgtagtccacagtactgtcataacactcggttc

SEQ ID NO: 97968 - DNA, 35 bp, Artificial Sequence
  Synthetic oligonucleotide
gtgggcaacggtccccattgtttgtttatcatttc

SEQ ID NO: 97969 - DNA, 35 bp, Artificial Sequence
  Synthetic oligonucleotide
gtaccccctccgcgatttctagtcaaacagtcacg

SEQ ID NO: 97970 - DNA, 35 bp, Artificial Sequence
  Synthetic oligonucleotide
gatatcggtaagggaaggcaatcgaaatagagacg

SEQ ID NO: 97971 - DNA, 35 bp, Artificial Sequence
  Synthetic oligonucleotide
taagccagaagtatataaccctcctgtttgttccg

SEQ ID NO: 97972 - DNA, 35 bp, Artificial Sequence
  Synthetic oligonucleotide
ggagccacaggaggggatttcggcatagggagagg

SEQ ID NO: 97973 - DNA, 35 bp, Artificial Sequence
  Synthetic oligonucleotide
gggacgtgtcaaacgcaaggtctcccattctccgg

SEQ ID NO: 97974 - DNA, 33 bp, Artificial Sequence
  Synthetic oligonucleotide
ttgggcccatgatgggaggtaaataaggggggg

SEQ ID NO: 97975 - DNA, 35 bp, Artificial Sequence
  Synthetic oligonucleotide
agcctggacaagctgtatggggaggggaagtatgg

SEQ ID NO: 97976 - DNA, 35 bp, Artificial Sequence
  Synthetic oligonucleotide
ttccaatcgctgccttatatgtattcatgcccttg

SEQ ID NO: 97977 - DNA, 35 bp, Artificial Sequence
  Synthetic oligonucleotide
acgcccaattcagcccttcctaaagatacttcttg

SEQ ID NO: 97978 - DNA, 35 bp, Artificial Sequence
  Synthetic oligonucleotide
gactgtagcacagtgttctattcaccaccggatat

SEQ ID NO: 97979 - DNA, 35 bp, Artificial Sequence
  Synthetic oligonucleotide
ttgccgctctcggttccggactgtggtcccgtcct

SEQ ID NO: 97980 - DNA, 35 bp, Artificial Sequence
  Synthetic oligonucleotide
atgaccgcacacacgtgctgacgaacttccgatct

SEQ ID NO: 97981 - DNA, 35 bp, Artificial Sequence
  Synthetic oligonucleotide
gtgtgccacctctagggcctgagccttgtccctgt

SEQ ID NO: 97982 - DNA, 35 bp, Artificial Sequence
  Synthetic oligonucleotide
gaaccggaagaagatggacccacgtggcgtacatt

SEQ ID NO: 97983 - DNA, 35 bp, Artificial Sequence
  Synthetic oligonucleotide
gtggtggccgcaatgttgacgtaggtggtggagtt

SEQ ID NO: 97984 - DNA, 35 bp, Artificial Sequence
  Synthetic oligonucleotide
tctgacaaccgtgagcctccacccaagggaatgtt

SEQ ID NO: 97985 - DNA, 35 bp, Artificial Sequence
  Synthetic oligonucleotide
ttgccccccgttcgaattagtgcggttgtttgttt

SEQ ID NO: 97986 - DNA, 36 bp, Artificial Sequence
  Synthetic oligonucleotide
taggaggtagtgagcgggaaaggaccacagagcaaa

SEQ ID NO: 97987 - DNA, 36 bp, Artificial Sequence
  Synthetic oligonucleotide
tagagcactcaggaagtacgagggatggataaggaa

SEQ ID NO: 97988 - DNA, 35 bp, Artificial Sequence
  Synthetic oligonucleotide
agtgtccgcagggtagcaacgggaacgtgaggtaa

SEQ ID NO: 97989 - DNA, 36 bp, Artificial Sequence
  Synthetic oligonucleotide
tcaaagggttgggtggtgggtacacggtttcgacca

SEQ ID NO: 97990 - DNA, 36 bp, Artificial Sequence
  Synthetic oligonucleotide
accccaccatgctagcgagttcagagaggagctgca

SEQ ID NO: 97991 - DNA, 36 bp, Artificial Sequence
  Synthetic oligonucleotide
gaacacccgacctgatcaggactagcaccaatttca

SEQ ID NO: 97992 - DNA, 37 bp, Artificial Sequence
  Synthetic oligonucleotide
gtgccttatccgcctgagcttttgttacgacgcaaga

SEQ ID NO: 97993 - DNA, 37 bp, Artificial Sequence
  Synthetic oligonucleotide
tatgcgcgggcaacaaagagtactggggcggggaaga

SEQ ID NO: 97994 - DNA, 36 bp, Artificial Sequence
  Synthetic oligonucleotide
gccaaagtgtgcaagggttggcgaagtgactgcaga

SEQ ID NO: 97995 - DNA, 37 bp, Artificial Sequence
  Synthetic oligonucleotide
tcaggtcgaaggatcagagcaaatgatagggtcgaga

SEQ ID NO: 97996 - DNA, 35 bp, Artificial Sequence
  Synthetic oligonucleotide
gatcgccccatgacgtatgaagatcgaaccgtaga

SEQ ID NO: 97997 - DNA, 37 bp, Artificial Sequence
  Synthetic oligonucleotide
ggtggggggaggggaaatcgaaagacgatggtggcga

SEQ ID NO: 97998 - DNA, 37 bp, Artificial Sequence
  Synthetic oligonucleotide
gagcccctcccataatgacactgccagctattgtcga

SEQ ID NO: 97999 - DNA, 37 bp, Artificial Sequence
  Synthetic oligonucleotide
agtagacccaggatgaaggtgagacgtggaggaagga

SEQ ID NO: 98000 - DNA, 37 bp, Artificial Sequence
  Synthetic oligonucleotide
agacactgcctgacttactacctccatttatcgagga

SEQ ID NO: 98001 - DNA, 33 bp, Artificial Sequence
  Synthetic oligonucleotide
ttcgtgggcgaggaggtaggggggtacgaggga

SEQ ID NO: 98002 - DNA, 37 bp, Artificial Sequence
  Synthetic oligonucleotide
aaggacaggtggaggattgtcatataaaaggtaggga

SEQ ID NO: 98003 - DNA, 35 bp, Artificial Sequence
  Synthetic oligonucleotide
gagagggtgaaggacacgttacagatcggttggga

SEQ ID NO: 98004 - DNA, 36 bp, Artificial Sequence
  Synthetic oligonucleotide
gcatcgccaccattgtctcatggaacattttctgga

SEQ ID NO: 98005 - DNA, 37 bp, Artificial Sequence
  Synthetic oligonucleotide
gagcagtggggggggaagcaggcaagtgacctgtgga

SEQ ID NO: 98006 - DNA, 38 bp, Artificial Sequence
  Synthetic oligonucleotide
gctggacaggggctggttacgtttaagaagcgaaatga

SEQ ID NO: 98007 - DNA, 37 bp, Artificial Sequence
  Synthetic oligonucleotide
gatgtgcgatgggctgacacaagggatttggcaatga

SEQ ID NO: 98008 - DNA, 38 bp, Artificial Sequence
  Synthetic oligonucleotide
gaagtagggtaccggatggtatacaatggatggaatga

SEQ ID NO: 98009 - DNA, 37 bp, Artificial Sequence
  Synthetic oligonucleotide
tcgatgtcggtccaccaccattggagacattttatga

SEQ ID NO: 98010 - DNA, 38 bp, Artificial Sequence
  Synthetic oligonucleotide
gctacgctgggcaaggactcacggtacactcaaactga

SEQ ID NO: 98011 - DNA, 38 bp, Artificial Sequence
  Synthetic oligonucleotide
gtcaacgcacatgcgctgtcgccacaatcctggactga

SEQ ID NO: 98012 - DNA, 38 bp, Artificial Sequence
  Synthetic oligonucleotide
gacgccattacaacactcccccagactgtccgacctga

SEQ ID NO: 98013 - DNA, 38 bp, Artificial Sequence
  Synthetic oligonucleotide
acacccagggtattatggtagcaggagcattgctctga

SEQ ID NO: 98014 - DNA, 38 bp, Artificial Sequence
  Synthetic oligonucleotide
gaggacggtgggtccaggcgagagttcgctgggagtga

SEQ ID NO: 98015 - DNA, 38 bp, Artificial Sequence
  Synthetic oligonucleotide
gtgcccgctccgaacacttaacatgacctcgatagtga

SEQ ID NO: 98016 - DNA, 38 bp, Artificial Sequence
  Synthetic oligonucleotide
gtgggtggccggaatatagatgtattagaggtacgtga

SEQ ID NO: 98017 - DNA, 38 bp, Artificial Sequence
  Synthetic oligonucleotide
gctgacaacctatatgcctcttcgaaacgggtacgtga

SEQ ID NO: 98018 - DNA, 38 bp, Artificial Sequence
  Synthetic oligonucleotide
gaagcaagcagtccgatcgttgaggggaatgctggtga

SEQ ID NO: 98019 - DNA, 37 bp, Artificial Sequence
  Synthetic oligonucleotide
ccaccgggcttccatgacgataggaacctacgtgtga

SEQ ID NO: 98020 - DNA, 37 bp, Artificial Sequence
  Synthetic oligonucleotide
taacgcgccgagaacctccttagcgtctgtcctttga

SEQ ID NO: 98021 - DNA, 35 bp, Artificial Sequence
  Synthetic oligonucleotide
tagacccgaacgtccggtgctctgggtccgttcta

SEQ ID NO: 98022 - DNA, 36 bp, Artificial Sequence
  Synthetic oligonucleotide
tccgcggcatactagtgcggaatgatcctctgctta

SEQ ID NO: 98023 - DNA, 36 bp, Artificial Sequence
  Synthetic oligonucleotide
atgcgaaaggggagatgagtcgatgtatgtgattta

SEQ ID NO: 98024 - DNA, 35 bp, Artificial Sequence
  Synthetic oligonucleotide
tgagtacccaccctctgtataccccgagctacaac

SEQ ID NO: 98025 - DNA, 35 bp, Artificial Sequence
  Synthetic oligonucleotide
tcttgaccgtcgcaccgtgtgtcctgttacgccac

SEQ ID NO: 98026 - DNA, 35 bp, Artificial Sequence
  Synthetic oligonucleotide
tagaatagtaggagcgggaaaaagaattaaggtac

SEQ ID NO: 98027 - DNA, 35 bp, Artificial Sequence
  Synthetic oligonucleotide
ggtaggccctggtagtctgctccgatttctgttac

SEQ ID NO: 98028 - DNA, 35 bp, Artificial Sequence
  Synthetic oligonucleotide
gcactgaggcggacctaagaattcccgcttaaacc

SEQ ID NO: 98029 - DNA, 35 bp, Artificial Sequence
  Synthetic oligonucleotide
tgcaaaccctgctccccacgcctataacttacgcc

SEQ ID NO: 98030 - DNA, 35 bp, Artificial Sequence
  Synthetic oligonucleotide
tcagtggaacgctgagcggcaaggcaaaccccgcc

SEQ ID NO: 98031 - DNA, 35 bp, Artificial Sequence
  Synthetic oligonucleotide
tacatccgccgactccatgtccaattgtagggtcc

SEQ ID NO: 98032 - DNA, 35 bp, Artificial Sequence
  Synthetic oligonucleotide
tccagccccgcccatcctccatgaacgatcccatc

SEQ ID NO: 98033 - DNA, 35 bp, Artificial Sequence
  Synthetic oligonucleotide
gctaggcccaggtcatatcttctcggcgacctctc

SEQ ID NO: 98034 - DNA, 35 bp, Artificial Sequence
  Synthetic oligonucleotide
ttcagccaagcctagtaaggggacaagaagaggag

SEQ ID NO: 98035 - DNA, 35 bp, Artificial Sequence
  Synthetic oligonucleotide
ggatcgccacagctagcttgtctcccattgatgag

SEQ ID NO: 98036 - DNA, 36 bp, Artificial Sequence
  Synthetic oligonucleotide
accccaaccctgaggtgtttaccgccgctactctag

SEQ ID NO: 98037 - DNA, 35 bp, Artificial Sequence
  Synthetic oligonucleotide
ttgactgtagacctgaatgcggcccagcaacatcg

SEQ ID NO: 98038 - DNA, 35 bp, Artificial Sequence
  Synthetic oligonucleotide
ttcgacaacaagctcgttcgccacactttcttagg

SEQ ID NO: 98039 - DNA, 35 bp, Artificial Sequence
  Synthetic oligonucleotide
taatgcccgttcacctatccacagttctgactggg

SEQ ID NO: 98040 - DNA, 35 bp, Artificial Sequence
  Synthetic oligonucleotide
acaacacgccggttaggtggaaaacgcatgctggg

SEQ ID NO: 98041 - DNA, 35 bp, Artificial Sequence
  Synthetic oligonucleotide
tttgcaaaacagggaaatagggcggtagagcatgg

SEQ ID NO: 98042 - DNA, 35 bp, Artificial Sequence
  Synthetic oligonucleotide
gacccgtgtcagtagtttggttgtggtgtggaatg

SEQ ID NO: 98043 - DNA, 35 bp, Artificial Sequence
  Synthetic oligonucleotide
gtgatggttcggctggaaatgacatgaaagttatg

SEQ ID NO: 98044 - DNA, 35 bp, Artificial Sequence
  Synthetic oligonucleotide
tcatcctgctccttcagattatgaaccctgctttg

SEQ ID NO: 98045 - DNA, 35 bp, Artificial Sequence
  Synthetic oligonucleotide
gtcatgggagggagaaaaatacgtcgcgagtccat

SEQ ID NO: 98046 - DNA, 34 bp, Artificial Sequence
  Synthetic oligonucleotide
gacggagccactccggggtgcattccattttcat

SEQ ID NO: 98047 - DNA, 35 bp, Artificial Sequence
  Synthetic oligonucleotide
gggaatgcgcgggggagggtagggtaagtaccgat

SEQ ID NO: 98048 - DNA, 35 bp, Artificial Sequence
  Synthetic oligonucleotide
ttacgctccggcccaaaattggaacgagttatcct

SEQ ID NO: 98049 - DNA, 35 bp, Artificial Sequence
  Synthetic oligonucleotide
gcactagagtgcactaacggtccatgtttccagct

SEQ ID NO: 98050 - DNA, 35 bp, Artificial Sequence
  Synthetic oligonucleotide
tcaaccagaactttcatcagtcagcgcaattagct

SEQ ID NO: 98051 - DNA, 35 bp, Artificial Sequence
  Synthetic oligonucleotide
aacgagcactaggggagcgagttttatacacctct

SEQ ID NO: 98052 - DNA, 35 bp, Artificial Sequence
  Synthetic oligonucleotide
tccaccgacggggaaacgggtaaaacgtttatcgt

SEQ ID NO: 98053 - DNA, 35 bp, Artificial Sequence
  Synthetic oligonucleotide
taagtggcgtgaacagcgaggaaaggaacaatggt

SEQ ID NO: 98054 - DNA, 35 bp, Artificial Sequence
  Synthetic oligonucleotide
tacccgccacacagtgtggtagtgagctggggttt

SEQ ID NO: 98055 - DNA, 36 bp, Artificial Sequence
  Synthetic oligonucleotide
gatggtgcaggggtcttaatactcacgacaaataaa

SEQ ID NO: 98056 - DNA, 36 bp, Artificial Sequence
  Synthetic oligonucleotide
gatgtgcgacgttattcatatgaagctggccataaa

SEQ ID NO: 98057 - DNA, 35 bp, Artificial Sequence
  Synthetic oligonucleotide
gttgaagagataggacgagagggccaggtcaacaa

SEQ ID NO: 98058 - DNA, 36 bp, Artificial Sequence
  Synthetic oligonucleotide
atggatagaagccgggttagggaagagacaatgcaa

SEQ ID NO: 98059 - DNA, 36 bp, Artificial Sequence
  Synthetic oligonucleotide
gagatagctaggtgagcaaaaaatagggaggaggaa

SEQ ID NO: 98060 - DNA, 36 bp, Artificial Sequence
  Synthetic oligonucleotide
agacaaggtgggcgtgcagtcggaagaaatgaggaa

SEQ ID NO: 98061 - DNA, 36 bp, Artificial Sequence
  Synthetic oligonucleotide
acccacctcaatccttcctacctaatgtgctaggaa

SEQ ID NO: 98062 - DNA, 36 bp, Artificial Sequence
  Synthetic oligonucleotide
acgaaagccacggtaggtgaacggggagtaggggaa

SEQ ID NO: 98063 - DNA, 35 bp, Artificial Sequence
  Synthetic oligonucleotide
aatgccacccttcgtaaagaattagctaactggaa

SEQ ID NO: 98064 - DNA, 36 bp, Artificial Sequence
  Synthetic oligonucleotide
actctccgcccaccttcgattcgtgcgtgctcccca

SEQ ID NO: 98065 - DNA, 36 bp, Artificial Sequence
  Synthetic oligonucleotide
gatgcctgcataggagagtacgcgctccattgtcca

SEQ ID NO: 98066 - DNA, 36 bp, Artificial Sequence
  Synthetic oligonucleotide
tccatcgtccaaaatgttccttggcaaccgttctca

SEQ ID NO: 98067 - DNA, 36 bp, Artificial Sequence
  Synthetic oligonucleotide
gtcaacagacgctaagataagccccctctgttctca

SEQ ID NO: 98068 - DNA, 36 bp, Artificial Sequence
  Synthetic oligonucleotide
gagcggggggaagacgggaacgaaatggccgtgtca

SEQ ID NO: 98069 - DNA, 37 bp, Artificial Sequence
  Synthetic oligonucleotide
gtacgatgcacaggagaggtgacgtatatggggaaga

SEQ ID NO: 98070 - DNA, 37 bp, Artificial Sequence
  Synthetic oligonucleotide
tctgcgagtgtgaaggaaggtgaatatggtgatgaga

SEQ ID NO: 98071 - DNA, 37 bp, Artificial Sequence
  Synthetic oligonucleotide
gctcgcactcgaggtatttcctgaaacgatcggacga

SEQ ID NO: 98072 - DNA, 37 bp, Artificial Sequence
  Synthetic oligonucleotide
gcacgtgagagcagggagttgtaagacagaggcgcga

SEQ ID NO: 98073 - DNA, 37 bp, Artificial Sequence
  Synthetic oligonucleotide
accaccaatcagaccagtccccccttccaacatgcga

SEQ ID NO: 98074 - DNA, 37 bp, Artificial Sequence
  Synthetic oligonucleotide
tccccagcagcattcgtccatttgatgaccacgtcga

SEQ ID NO: 98075 - DNA, 36 bp, Artificial Sequence
  Synthetic oligonucleotide
ggaccacagcatgaaggcccttccgatccgtttcga

SEQ ID NO: 98076 - DNA, 37 bp, Artificial Sequence
  Synthetic oligonucleotide
gaggagtacggagaaaaagggtaatgacggaacagga

SEQ ID NO: 98077 - DNA, 35 bp, Artificial Sequence
  Synthetic oligonucleotide
gattacgcaacaggggacaggtatcaaccgcagga

SEQ ID NO: 98078 - DNA, 37 bp, Artificial Sequence
  Synthetic oligonucleotide
aagccgatcggcgcgaggtaattagaaatggggcgga

SEQ ID NO: 98079 - DNA, 37 bp, Artificial Sequence
  Synthetic oligonucleotide
tcagtttgcgccaccacggtcaagactcaaaaatgga

SEQ ID NO: 98080 - DNA, 36 bp, Artificial Sequence
  Synthetic oligonucleotide
aaccgctcgagcatggtggatatcgttgttgctgga

SEQ ID NO: 98081 - DNA, 37 bp, Artificial Sequence
  Synthetic oligonucleotide
gaccaggttggggaaactacgagcgaaatgccaatga

SEQ ID NO: 98082 - DNA, 37 bp, Artificial Sequence
  Synthetic oligonucleotide
gtgtgcaggccgataataatttgttgcactccaatga

SEQ ID NO: 98083 - DNA, 36 bp, Artificial Sequence
  Synthetic oligonucleotide
gcgacgcacacaactgtcacacaacggacgacatga

SEQ ID NO: 98084 - DNA, 37 bp, Artificial Sequence
  Synthetic oligonucleotide
gatgatcagggaggaattattgaggaagtatgcatga

SEQ ID NO: 98085 - DNA, 37 bp, Artificial Sequence
  Synthetic oligonucleotide
accactcactgcctggcgagacctggcattctcatga

SEQ ID NO: 98086 - DNA, 37 bp, Artificial Sequence
  Synthetic oligonucleotide
gcatactgcgactatgtaattaggggaaggttcatga

SEQ ID NO: 98087 - DNA, 38 bp, Artificial Sequence
  Synthetic oligonucleotide
gtcgcaggtctcgaaaagggccgggggggaaactatga

SEQ ID NO: 98088 - DNA, 37 bp, Artificial Sequence
  Synthetic oligonucleotide
acaccagagctcgaaggggatgtctcagagttgctga

SEQ ID NO: 98089 - DNA, 38 bp, Artificial Sequence
  Synthetic oligonucleotide
ggtgaacgggcagaacgcgggaattgggcatcctctga

SEQ ID NO: 98090 - DNA, 37 bp, Artificial Sequence
  Synthetic oligonucleotide
gattggggaaagagggacgaataaaagcgcggagtga

SEQ ID NO: 98091 - DNA, 38 bp, Artificial Sequence
  Synthetic oligonucleotide
gtgggatgcgtccacaagaggaaaacggggtgacgtga

SEQ ID NO: 98092 - DNA, 38 bp, Artificial Sequence
  Synthetic oligonucleotide
gtgtgtcgggacacggttccaagggagacacagggtga

SEQ ID NO: 98093 - DNA, 37 bp, Artificial Sequence
  Synthetic oligonucleotide
gcacgtgacgtagttacgtgaactgaccgaatggtga

SEQ ID NO: 98094 - DNA, 38 bp, Artificial Sequence
  Synthetic oligonucleotide
tcaatcgcgcggtagaaagcagcaacatgttgctgtga

SEQ ID NO: 98095 - DNA, 37 bp, Artificial Sequence
  Synthetic oligonucleotide
acaccagccgacagttctgtaacccgccattgtgtga

SEQ ID NO: 98096 - DNA, 38 bp, Artificial Sequence
  Synthetic oligonucleotide
cctgccgcacgaaacacctatggcctgtttcaccttga

SEQ ID NO: 98097 - DNA, 38 bp, Artificial Sequence
  Synthetic oligonucleotide
gatgctcccctgctgcctcgtattagagctgacgttga

SEQ ID NO: 98098 - DNA, 37 bp, Artificial Sequence
  Synthetic oligonucleotide
acagtatggggaacgagtgtgggggcggatgctttga

SEQ ID NO: 98099 - DNA, 37 bp, Artificial Sequence
  Synthetic oligonucleotide
gagcaacagccgaatgcgaatcctgaaaccattttga

SEQ ID NO: 98100 - DNA, 36 bp, Artificial Sequence
  Synthetic oligonucleotide
agacgagcctcatggcttggatcaacccccttttga

SEQ ID NO: 98101 - DNA, 38 bp, Artificial Sequence
  Synthetic oligonucleotide
ttcactgcacaactgtcatatccaggcctctcttttga

SEQ ID NO: 98102 - DNA, 35 bp, Artificial Sequence
  Synthetic oligonucleotide
atctgacggagatgtcctaaacctgctggcacata

SEQ ID NO: 98103 - DNA, 36 bp, Artificial Sequence
  Synthetic oligonucleotide
gtctagcacgcacaccctaatggatacttgtagcta

SEQ ID NO: 98104 - DNA, 36 bp, Artificial Sequence
  Synthetic oligonucleotide
gaagggcccactggataaagggagggatatactcta

SEQ ID NO: 98105 - DNA, 36 bp, Artificial Sequence
  Synthetic oligonucleotide
gcacgctcacatgataacgaattatagccttctcta

SEQ ID NO: 98106 - DNA, 36 bp, Artificial Sequence
  Synthetic oligonucleotide
tacgaaacgatcgggtgggaaaacgattctagggta

SEQ ID NO: 98107 - DNA, 36 bp, Artificial Sequence
  Synthetic oligonucleotide
atgaccattaccgtccacgtcctctcggatcctgta

SEQ ID NO: 98108 - DNA, 35 bp, Artificial Sequence
  Synthetic oligonucleotide
tgtggatgccagaagggatagggaagagagttgta

SEQ ID NO: 98109 - DNA, 36 bp, Artificial Sequence
  Synthetic oligonucleotide
ttcgactgctcgccgtccaatgctaccccgctctta

SEQ ID NO: 98110 - DNA, 35 bp, Artificial Sequence
  Synthetic oligonucleotide
tcctgcgccctgagtttcacgttcctgatggttac

SEQ ID NO: 98111 - DNA, 35 bp, Artificial Sequence
  Synthetic oligonucleotide
gtagtgcaacgggacacgtatggtgggaggaaagc

SEQ ID NO: 98112 - DNA, 35 bp, Artificial Sequence
  Synthetic oligonucleotide
tagcgatcgctactcgtgactaatttgcaccaagc

SEQ ID NO: 98113 - DNA, 35 bp, Artificial Sequence
  Synthetic oligonucleotide
ttactaacggccgaaggtcgaatcccgtttttgtc

SEQ ID NO: 98114 - DNA, 35 bp, Artificial Sequence
  Synthetic oligonucleotide
taacggaagcgagcgtcccatctgtgccttcgttc

SEQ ID NO: 98115 - DNA, 35 bp, Artificial Sequence
  Synthetic oligonucleotide
gatcaactatgtggtgcctcatcactgcaattttc

SEQ ID NO: 98116 - DNA, 35 bp, Artificial Sequence
  Synthetic oligonucleotide
gtccaccgtaccgacgcatttactcattctccaag

SEQ ID NO: 98117 - DNA, 35 bp, Artificial Sequence
  Synthetic oligonucleotide
ggacagaagttacatcccctgcccttacttaagag

SEQ ID NO: 98118 - DNA, 35 bp, Artificial Sequence
  Synthetic oligonucleotide
aacgcgaggtgcggggtcaagataatgacggggag

SEQ ID NO: 98119 - DNA, 35 bp, Artificial Sequence
  Synthetic oligonucleotide
gtacgaggcccagggtaacggaggatacaatttcg

SEQ ID NO: 98120 - DNA, 35 bp, Artificial Sequence
  Synthetic oligonucleotide
tcccaccacacgcgtcttaacaccgcctggtttcg

SEQ ID NO: 98121 - DNA, 35 bp, Artificial Sequence
  Synthetic oligonucleotide
atggtggtacgtgctgttgtagggttcttgtcggg

SEQ ID NO: 98122 - DNA, 35 bp, Artificial Sequence
  Synthetic oligonucleotide
gagtgcaaacgagtaaaagtgattaggtggagggg

SEQ ID NO: 98123 - DNA, 35 bp, Artificial Sequence
  Synthetic oligonucleotide
tccacgcaggtgtacgaagctgcgtcctatgaatg

SEQ ID NO: 98124 - DNA, 35 bp, Artificial Sequence
  Synthetic oligonucleotide
ttcgacccgacgtgacgtatggcccttacactctg

SEQ ID NO: 98125 - DNA, 35 bp, Artificial Sequence
  Synthetic oligonucleotide
acatcgagcgccgtcaatactcgggggcctgtgtg

SEQ ID NO: 98126 - DNA, 35 bp, Artificial Sequence
  Synthetic oligonucleotide
gacgttaaccggaaagagggtcaggatacaatttg

SEQ ID NO: 98127 - DNA, 35 bp, Artificial Sequence
  Synthetic oligonucleotide
ttgacatgacttgttgataccctcgaacatttttg

SEQ ID NO: 98128 - DNA, 35 bp, Artificial Sequence
  Synthetic oligonucleotide
acgaacaccatccgctataggactccttatcccat

SEQ ID NO: 98129 - DNA, 35 bp, Artificial Sequence
  Synthetic oligonucleotide
atgcgacagtcattccgtaatagccgggtcttcat

SEQ ID NO: 98130 - DNA, 35 bp, Artificial Sequence
  Synthetic oligonucleotide
gaccagacgcgtgaattcacctgcccatgacttat

SEQ ID NO: 98131 - DNA, 35 bp, Artificial Sequence
  Synthetic oligonucleotide
gtcagacgcatagttactcgtagagcgaatgagct

SEQ ID NO: 98132 - DNA, 35 bp, Artificial Sequence
  Synthetic oligonucleotide
gtgtgctaggaaagggaaggtttgataagtgcagt

SEQ ID NO: 98133 - DNA, 35 bp, Artificial Sequence
  Synthetic oligonucleotide
tctgtagtgcaggtagtgtcgggaccctttctcgt

SEQ ID NO: 98134 - DNA, 35 bp, Artificial Sequence
  Synthetic oligonucleotide
tgacgcacgatcgtcggagcaggtgaaaggctggt

SEQ ID NO: 98135 - DNA, 35 bp, Artificial Sequence
  Synthetic oligonucleotide
gatagggcacgtgctcacattgttgttgcttaatt

SEQ ID NO: 98136 - DNA, 35 bp, Artificial Sequence
  Synthetic oligonucleotide
tgagtgtgtagaagggtgtgcgtggaaggcgactt

SEQ ID NO: 98137 - DNA, 35 bp, Artificial Sequence
  Synthetic oligonucleotide
tgtacgtcacctcggtactggccacaattaaattt

SEQ ID NO: 98138 - DNA, 36 bp, Artificial Sequence
  Synthetic oligonucleotide
aacgcagggagggtaggcgcacgaagtgactgacaa

SEQ ID NO: 98139 - DNA, 36 bp, Artificial Sequence
  Synthetic oligonucleotide
taaggtacgcgcacaaattcatttattaacgtacaa

SEQ ID NO: 98140 - DNA, 36 bp, Artificial Sequence
  Synthetic oligonucleotide
gtgcatgcagaggagaattaatggagtgaggatcaa

SEQ ID NO: 98141 - DNA, 36 bp, Artificial Sequence
  Synthetic oligonucleotide
acactgccactatggctgtcttaagtccatgtcgaa

SEQ ID NO: 98142 - DNA, 35 bp, Artificial Sequence
  Synthetic oligonucleotide
ttagcccagccgccataactattggatcagcctaa

SEQ ID NO: 98143 - DNA, 35 bp, Artificial Sequence
  Synthetic oligonucleotide
gagtgtcgccgcaccatgtggctgtacccgcttaa

SEQ ID NO: 98144 - DNA, 35 bp, Artificial Sequence
  Synthetic oligonucleotide
ggttcaccagccgacctgctatcatcccccgcaca

SEQ ID NO: 98145 - DNA, 36 bp, Artificial Sequence
  Synthetic oligonucleotide
ttgtaccgcactgtatatgcttccgatacccagcca

SEQ ID NO: 98146 - DNA, 36 bp, Artificial Sequence
  Synthetic oligonucleotide
gatagccgctccgactgaatcgggagagctccatca

SEQ ID NO: 98147 - DNA, 36 bp, Artificial Sequence
  Synthetic oligonucleotide
actccgagggagggaagaaatgggaggacagtatca

SEQ ID NO: 98148 - DNA, 35 bp, Artificial Sequence
  Synthetic oligonucleotide
atgccccacgggttgctccggacacaggattatca

SEQ ID NO: 98149 - DNA, 36 bp, Artificial Sequence
  Synthetic oligonucleotide
ggtcatccgccgttctctcgattcaggcctttatca

SEQ ID NO: 98150 - DNA, 37 bp, Artificial Sequence
  Synthetic oligonucleotide
actgacgggcggtggtagggacgataaacgtgaaaga

SEQ ID NO: 98151 - DNA, 37 bp, Artificial Sequence
  Synthetic oligonucleotide
tccccatcaacagttatcaccaagggatctcaataga

SEQ ID NO: 98152 - DNA, 36 bp, Artificial Sequence
  Synthetic oligonucleotide
tatgcatccggtgaagcaatgccgatagtaggtaga

SEQ ID NO: 98153 - DNA, 37 bp, Artificial Sequence
  Synthetic oligonucleotide
gttggcaaggcaaggggaagtagggctctcttgtaga

SEQ ID NO: 98154 - DNA, 37 bp, Artificial Sequence
  Synthetic oligonucleotide
tgagaagagcaaggggaacggggaacagctccagcga

SEQ ID NO: 98155 - DNA, 37 bp, Artificial Sequence
  Synthetic oligonucleotide
gaaccatcacaagagatagccccatcacctttagcga

SEQ ID NO: 98156 - DNA, 37 bp, Artificial Sequence
  Synthetic oligonucleotide
tagctgacccagtgatcgggagggggaggctatgcga

SEQ ID NO: 98157 - DNA, 37 bp, Artificial Sequence
  Synthetic oligonucleotide
gcaagggcgggaagaatgacgcgcagtgtttgctcga

SEQ ID NO: 98158 - DNA, 37 bp, Artificial Sequence
  Synthetic oligonucleotide
tagtacgagtgaggggggagcatgaggctgttttcga

SEQ ID NO: 98159 - DNA, 36 bp, Artificial Sequence
  Synthetic oligonucleotide
gtgcaccctagaccccttttgcacgacacacaagga

SEQ ID NO: 98160 - DNA, 35 bp, Artificial Sequence
  Synthetic oligonucleotide
gagacacatgaggtgataacggaacggggagagga

SEQ ID NO: 98161 - DNA, 37 bp, Artificial Sequence
  Synthetic oligonucleotide
gtgcacatacaccgagagaaacaggcagggaggagga

SEQ ID NO: 98162 - DNA, 37 bp, Artificial Sequence
  Synthetic oligonucleotide
aaccgagacagaatgatcataaggtgggaggctagga

SEQ ID NO: 98163 - DNA, 37 bp, Artificial Sequence
  Synthetic oligonucleotide
tcaagtcgcagtcactaaggagatgagagaagccgga

SEQ ID NO: 98164 - DNA, 37 bp, Artificial Sequence
  Synthetic oligonucleotide
gctgtcggtagggggaagcgaagggtcctagaaggga

SEQ ID NO: 98165 - DNA, 37 bp, Artificial Sequence
  Synthetic oligonucleotide
gcagggacaacaatgtatgatggggctcgaacatgga

SEQ ID NO: 98166 - DNA, 38 bp, Artificial Sequence
  Synthetic oligonucleotide
taacgctgcctacagttcagattccgcccccacgatga

SEQ ID NO: 98167 - DNA, 38 bp, Artificial Sequence
  Synthetic oligonucleotide
gacgtgtgggtgcagaaaacgtcgacgttttaggatga

SEQ ID NO: 98168 - DNA, 38 bp, Artificial Sequence
  Synthetic oligonucleotide
gatggtgctgaggtggtatagcgtcgagtaggtagtga

SEQ ID NO: 98169 - DNA, 38 bp, Artificial Sequence
  Synthetic oligonucleotide
tccaaggacgagtgtgtgtaagtatattgtgggcgtga

SEQ ID NO: 98170 - DNA, 38 bp, Artificial Sequence
  Synthetic oligonucleotide
gtcactgcacgtgtctatgtctgctcactgctgcgtga

SEQ ID NO: 98171 - DNA, 38 bp, Artificial Sequence
  Synthetic oligonucleotide
aatacagtggggcggacgtggttgggttggcgttgtga

SEQ ID NO: 98172 - DNA, 35 bp, Artificial Sequence
  Synthetic oligonucleotide
actcaggtccaaaaggaaaaaaaagaacaaattga

SEQ ID NO: 98173 - DNA, 38 bp, Artificial Sequence
  Synthetic oligonucleotide
gtggaccgacacgggggcaaagtaagcggagaacttga

SEQ ID NO: 98174 - DNA, 37 bp, Artificial Sequence
  Synthetic oligonucleotide
gcgactcctccagcaccctcaactagagctcacttga

SEQ ID NO: 98175 - DNA, 38 bp, Artificial Sequence
  Synthetic oligonucleotide
aaagccagaagtgaaggctgagggtacactacggttga

SEQ ID NO: 98176 - DNA, 38 bp, Artificial Sequence
  Synthetic oligonucleotide
atggtgggtagtcagtagtgagagtgactgcggtttga

SEQ ID NO: 98177 - DNA, 36 bp, Artificial Sequence
  Synthetic oligonucleotide
tgtacgggcgggtgcgagggagaaggagcgtacgta

SEQ ID NO: 98178 - DNA, 35 bp, Artificial Sequence
  Synthetic oligonucleotide
tacgccccagccgactgcctctcgcggatatctta

SEQ ID NO: 98179 - DNA, 36 bp, Artificial Sequence
  Synthetic oligonucleotide
gcgaacgccaccgctacgtaatggctagacccgtta

SEQ ID NO: 98180 - DNA, 35 bp, Artificial Sequence
  Synthetic oligonucleotide
gaattcaaccctggagtgtagtacgcacgacctac

SEQ ID NO: 98181 - DNA, 35 bp, Artificial Sequence
  Synthetic oligonucleotide
gtcgccctgcccataaatacgtgcaaatcacgtac

SEQ ID NO: 98182 - DNA, 35 bp, Artificial Sequence
  Synthetic oligonucleotide
acgaacgaccgtagtacgggagtactctgaattac

SEQ ID NO: 98183 - DNA, 35 bp, Artificial Sequence
  Synthetic oligonucleotide
tacctcgacaggcgagcatgctctcggctttaacc

SEQ ID NO: 98184 - DNA, 35 bp, Artificial Sequence
  Synthetic oligonucleotide
gacatgtcactaattgaagtttctcctcgcatcgc

SEQ ID NO: 98185 - DNA, 35 bp, Artificial Sequence
  Synthetic oligonucleotide
tacttgacgactgttacttctttcatgaggtcctc

SEQ ID NO: 98186 - DNA, 35 bp, Artificial Sequence
  Synthetic oligonucleotide
tccctatgcggcgtgattatacaccactttccttc

SEQ ID NO: 98187 - DNA, 35 bp, Artificial Sequence
  Synthetic oligonucleotide
tcaagacaccgcattattctgcctgcctgtcctcg

SEQ ID NO: 98188 - DNA, 35 bp, Artificial Sequence
  Synthetic oligonucleotide
gactgcccgcagaagcgagcgaaagaagatggagg

SEQ ID NO: 98189 - DNA, 35 bp, Artificial Sequence
  Synthetic oligonucleotide
tgtagggagagcctggggataaaggcgaattgtgg

SEQ ID NO: 98190 - DNA, 35 bp, Artificial Sequence
  Synthetic oligonucleotide
accgattcacttgtcccctctgtttgcttctcatg

SEQ ID NO: 98191 - DNA, 35 bp, Artificial Sequence
  Synthetic oligonucleotide
gaccacacgccacaaactggggtgcactcattttg

SEQ ID NO: 98192 - DNA, 35 bp, Artificial Sequence
  Synthetic oligonucleotide
gttcagcaaacggtgaggggtgggcctatcaacat

SEQ ID NO: 98193 - DNA, 35 bp, Artificial Sequence
  Synthetic oligonucleotide
acacagtgctggcggtggagaagaaattgttccat

SEQ ID NO: 98194 - DNA, 35 bp, Artificial Sequence
  Synthetic oligonucleotide
tccacaggcacgggtggctagaggagaacagggat

SEQ ID NO: 98195 - DNA, 35 bp, Artificial Sequence
  Synthetic oligonucleotide
taacacgagctcatacgcgtagtgtttgccaaact

SEQ ID NO: 98196 - DNA, 35 bp, Artificial Sequence
  Synthetic oligonucleotide
ttccgctatcctgcgtactattcacgttatgaagt

SEQ ID NO: 98197 - DNA, 35 bp, Artificial Sequence
  Synthetic oligonucleotide
aagtgaaagagcggggaaggagtatttgcagacgt

SEQ ID NO: 98198 - DNA, 35 bp, Artificial Sequence
  Synthetic oligonucleotide
tttggcccacgtacggtccataagccttattttgt

SEQ ID NO: 98199 - DNA, 35 bp, Artificial Sequence
  Synthetic oligonucleotide
gtggcatagtcacgggcacactgcgcaatttcctt

SEQ ID NO: 98200 - DNA, 35 bp, Artificial Sequence
  Synthetic oligonucleotide
gacgaacgtctgcctatatgaaggtgttctctttt

SEQ ID NO: 98201 - DNA, 36 bp, Artificial Sequence
  Synthetic oligonucleotide
ggatacgggaagcgggacacagggagagttgggcaa

SEQ ID NO: 98202 - DNA, 36 bp, Artificial Sequence
  Synthetic oligonucleotide
tgatcactcatccgatggcgatcgattccacatcaa

SEQ ID NO: 98203 - DNA, 36 bp, Artificial Sequence
  Synthetic oligonucleotide
gacggtcaaacgagacagcgggatggggtagtgtaa

SEQ ID NO: 98204 - DNA, 36 bp, Artificial Sequence
  Synthetic oligonucleotide
tagttcagcacaccatactctttgaaggaagcttaa

SEQ ID NO: 98205 - DNA, 36 bp, Artificial Sequence
  Synthetic oligonucleotide
actgggcgagacacaggacaattcatgggtgggaca

SEQ ID NO: 98206 - DNA, 35 bp, Artificial Sequence
  Synthetic oligonucleotide
tgcacctcccggcgacgacattcgagtgctaccca

SEQ ID NO: 98207 - DNA, 35 bp, Artificial Sequence
  Synthetic oligonucleotide
aagcacgccacgtcccggcttattagggtggtcca

SEQ ID NO: 98208 - DNA, 37 bp, Artificial Sequence
  Synthetic oligonucleotide
tcaccatgcttggctgtttctgctttatactcttcca

SEQ ID NO: 98209 - DNA, 36 bp, Artificial Sequence
  Synthetic oligonucleotide
tgtcgctagacgtaacccagtaaccgcttcatcgca

SEQ ID NO: 98210 - DNA, 35 bp, Artificial Sequence
  Synthetic oligonucleotide
gaatgtggcagggcgtgcggtggggcggtgcggca

SEQ ID NO: 98211 - DNA, 35 bp, Artificial Sequence
  Synthetic oligonucleotide
attcactcctgacgttagctccctcccgtggtgca

SEQ ID NO: 98212 - DNA, 35 bp, Artificial Sequence
  Synthetic oligonucleotide
gaaaccgtgagtaagggaagaggatggccagatca

SEQ ID NO: 98213 - DNA, 35 bp, Artificial Sequence
  Synthetic oligonucleotide
ttgatgcaactgcaggatactgtcaccacgcctca

SEQ ID NO: 98214 - DNA, 37 bp, Artificial Sequence
  Synthetic oligonucleotide
gactgcatgtcgtagggggacttggaagctaaggaga

SEQ ID NO: 98215 - DNA, 37 bp, Artificial Sequence
  Synthetic oligonucleotide
gccggaagacggccggaatcaatggactggtaggaga

SEQ ID NO: 98216 - DNA, 37 bp, Artificial Sequence
  Synthetic oligonucleotide
ggggcaaggggctaatgggaataggaagtaaggtaga

SEQ ID NO: 98217 - DNA, 36 bp, Artificial Sequence
  Synthetic oligonucleotide
gccatgggcgggcgatcggaccaatacgtaacacga

SEQ ID NO: 98218 - DNA, 37 bp, Artificial Sequence
  Synthetic oligonucleotide
gacagaccacaggctgtagggcaggcgcaaaatacga

SEQ ID NO: 98219 - DNA, 37 bp, Artificial Sequence
  Synthetic oligonucleotide
gcaccataggagagaggcggtagtggacgtcgggcga

SEQ ID NO: 98220 - DNA, 36 bp, Artificial Sequence
  Synthetic oligonucleotide
tcacaccggcggagggggtcaacggatgtgattcga

SEQ ID NO: 98221 - DNA, 37 bp, Artificial Sequence
  Synthetic oligonucleotide
taacgtgctcaggaggccagagatggacaagtgagga

SEQ ID NO: 98222 - DNA, 37 bp, Artificial Sequence
  Synthetic oligonucleotide
atccgagtgcaaggggggcgcggagaggccgtgagga

SEQ ID NO: 98223 - DNA, 37 bp, Artificial Sequence
  Synthetic oligonucleotide
gacgtgaagctatggcaagtggagggttggtgcggga

SEQ ID NO: 98224 - DNA, 36 bp, Artificial Sequence
  Synthetic oligonucleotide
tcgagctgggccgcaaacgaagaagtgatggtggga

SEQ ID NO: 98225 - DNA, 36 bp, Artificial Sequence
  Synthetic oligonucleotide
ggatggggttggcggacgtaagggggtcagaatgga

SEQ ID NO: 98226 - DNA, 37 bp, Artificial Sequence
  Synthetic oligonucleotide
ttcacgcctacatgggagttcaatatctgcccctgga

SEQ ID NO: 98227 - DNA, 37 bp, Artificial Sequence
  Synthetic oligonucleotide
gcagacagacctgtactatctatcgtaaacgagtgga

SEQ ID NO: 98228 - DNA, 37 bp, Artificial Sequence
  Synthetic oligonucleotide
tacctgtccaatggcgttcactttcaccctctgtgga

SEQ ID NO: 98229 - DNA, 36 bp, Artificial Sequence
  Synthetic oligonucleotide
gctcgccgaaattctgacctcttatcgaacgttgga

SEQ ID NO: 98230 - DNA, 38 bp, Artificial Sequence
  Synthetic oligonucleotide
tccgcaccatccctgctcgctgcacagctacattatga

SEQ ID NO: 98231 - DNA, 38 bp, Artificial Sequence
  Synthetic oligonucleotide
gaaggggcggatagtacacatgattccaaaatggctga

SEQ ID NO: 98232 - DNA, 38 bp, Artificial Sequence
  Synthetic oligonucleotide
acaacgccaactgtcactcgctagtctttccactctga

SEQ ID NO: 98233 - DNA, 38 bp, Artificial Sequence
  Synthetic oligonucleotide
aacagcgacgatgttgcgttatgattctccctttctga

SEQ ID NO: 98234 - DNA, 38 bp, Artificial Sequence
  Synthetic oligonucleotide
agcctcctcgccggttaacacctccattgtcaaagtga

SEQ ID NO: 98235 - DNA, 38 bp, Artificial Sequence
  Synthetic oligonucleotide
tccgcctcaggctaatacgttccactctgtcagagtga

SEQ ID NO: 98236 - DNA, 38 bp, Artificial Sequence
  Synthetic oligonucleotide
gagaccactgagtgagcatactggccgtagggtagtga

SEQ ID NO: 98237 - DNA, 38 bp, Artificial Sequence
  Synthetic oligonucleotide
tacacgccgcatacatctagtccgaatccgctcggtga

SEQ ID NO: 98238 - DNA, 38 bp, Artificial Sequence
  Synthetic oligonucleotide
tagacgcaccatcacgttaggtaggaattcaatggtga

SEQ ID NO: 98239 - DNA, 38 bp, Artificial Sequence
  Synthetic oligonucleotide
tgacaagcccactgccatggttagtgccatcattgtga

SEQ ID NO: 98240 - DNA, 36 bp, Artificial Sequence
  Synthetic oligonucleotide
gatacgtgctatgaccctgaatagtatcacccttga

SEQ ID NO: 98241 - DNA, 38 bp, Artificial Sequence
  Synthetic oligonucleotide
agccacccctaacgctctaataatgagcggatctttga

SEQ ID NO: 98242 - DNA, 38 bp, Artificial Sequence
  Synthetic oligonucleotide
tcacaaacgcaattcgtacttgctcatagcaattttga

SEQ ID NO: 98243 - DNA, 35 bp, Artificial Sequence
  Synthetic oligonucleotide
gtaagcgggcaggaatggtacaggggtgggctata

SEQ ID NO: 98244 - DNA, 35 bp, Artificial Sequence
  Synthetic oligonucleotide
tccgctcggacatacggtgttcccttttcgtgcta

SEQ ID NO: 98245 - DNA, 35 bp, Artificial Sequence
  Synthetic oligonucleotide
gactgacgctcgatatttcctgagggtcttttgta

SEQ ID NO: 98246 - DNA, 35 bp, Artificial Sequence
  Synthetic oligonucleotide
tcgaacgtccatgcgagtcattaaactaggccaac

SEQ ID NO: 98247 - DNA, 35 bp, Artificial Sequence
  Synthetic oligonucleotide
gtgggaggcatcacttccgtcacatgtcccgcaac

SEQ ID NO: 98248 - DNA, 35 bp, Artificial Sequence
  Synthetic oligonucleotide
gccaccggctgaaccatttccgacacgggcataac

SEQ ID NO: 98249 - DNA, 35 bp, Artificial Sequence
  Synthetic oligonucleotide
tccgcgagcacagacttatgccagtcatagcggac

SEQ ID NO: 98250 - DNA, 35 bp, Artificial Sequence
  Synthetic oligonucleotide
attgggccctacaggtggcgaacacccattatgac

SEQ ID NO: 98251 - DNA, 35 bp, Artificial Sequence
  Synthetic oligonucleotide
gcgacgtagaacaaaaaggaaggaaggaagctccc

SEQ ID NO: 98252 - DNA, 35 bp, Artificial Sequence
  Synthetic oligonucleotide
gccaccggccatcattgcctgccaagaccgcagcc

SEQ ID NO: 98253 - DNA, 35 bp, Artificial Sequence
  Synthetic oligonucleotide
agtacgtcaagtcggcaaaacggtcagaactccgc

SEQ ID NO: 98254 - DNA, 35 bp, Artificial Sequence
  Synthetic oligonucleotide
gaccgatcctgaactggcgcgtgcaggaccgaatc

SEQ ID NO: 98255 - DNA, 35 bp, Artificial Sequence
  Synthetic oligonucleotide
atgtcacctcctgtcctgtcatcagccatgggctc

SEQ ID NO: 98256 - DNA, 35 bp, Artificial Sequence
  Synthetic oligonucleotide
aacaccaccgtcgctacgaggcgctctctacattc

SEQ ID NO: 98257 - DNA, 35 bp, Artificial Sequence
  Synthetic oligonucleotide
gtcgagacaggtctggtctgtatcaagttgtacag

SEQ ID NO: 98258 - DNA, 35 bp, Artificial Sequence
  Synthetic oligonucleotide
acgagatcacgccccatttttgcgaggccacctag

SEQ ID NO: 98259 - DNA, 35 bp, Artificial Sequence
  Synthetic oligonucleotide
aacgcatcagcacagtgtctactgaaccgccaacg

SEQ ID NO: 98260 - DNA, 35 bp, Artificial Sequence
  Synthetic oligonucleotide
tacatccgcagttgtcggcctcccgccacagcacg

SEQ ID NO: 98261 - DNA, 35 bp, Artificial Sequence
  Synthetic oligonucleotide
tccgcacactgagttgtgaaacaaatcgtttcacg

SEQ ID NO: 98262 - DNA, 35 bp, Artificial Sequence
  Synthetic oligonucleotide
gactgggggggggccaagagacaaacgagatctcg

SEQ ID NO: 98263 - DNA, 35 bp, Artificial Sequence
  Synthetic oligonucleotide
ggtgagggccaaggacgtataaggagagttaaggg

SEQ ID NO: 98264 - DNA, 35 bp, Artificial Sequence
  Synthetic oligonucleotide
tagtgagaaaggcggtggtgaaatagacatggggg

SEQ ID NO: 98265 - DNA, 35 bp, Artificial Sequence
  Synthetic oligonucleotide
tcaaacatgcgtctgtcactatcgcactcatgtgg

SEQ ID NO: 98266 - DNA, 35 bp, Artificial Sequence
  Synthetic oligonucleotide
aagacccggtcggtgaaaggcaattggacacgctg

SEQ ID NO: 98267 - DNA, 35 bp, Artificial Sequence
  Synthetic oligonucleotide
gcagaccaccttcatgatatctctatgtaacattg

SEQ ID NO: 98268 - DNA, 35 bp, Artificial Sequence
  Synthetic oligonucleotide
gccctgacagggttgtgcgctccatcctctgcaat

SEQ ID NO: 98269 - DNA, 35 bp, Artificial Sequence
  Synthetic oligonucleotide
gtggacacgcactatattcgttcaaggcctcccct

SEQ ID NO: 98270 - DNA, 35 bp, Artificial Sequence
  Synthetic oligonucleotide
acccaatgcgacacaggtagtaatgggcccggtct

SEQ ID NO: 98271 - DNA, 35 bp, Artificial Sequence
  Synthetic oligonucleotide
tgtgacgtcactgttgctactggcttacgatttct

SEQ ID NO: 98272 - DNA, 35 bp, Artificial Sequence
  Synthetic oligonucleotide
agtgcacccctcatctgtcggtcccatctatcggt

SEQ ID NO: 98273 - DNA, 35 bp, Artificial Sequence
  Synthetic oligonucleotide
atgccctgtgccatggtgagaacggaccgtgcatt

SEQ ID NO: 98274 - DNA, 35 bp, Artificial Sequence
  Synthetic oligonucleotide
tatgcccctgtgctcattggtacaacttccaactt

SEQ ID NO: 98275 - DNA, 35 bp, Artificial Sequence
  Synthetic oligonucleotide
acgacatgggttgggacatggtgatgttgtacgtt

SEQ ID NO: 98276 - DNA, 35 bp, Artificial Sequence
  Synthetic oligonucleotide
atccgacggttagaaggtcgagcgggggtgggaaa

SEQ ID NO: 98277 - DNA, 35 bp, Artificial Sequence
  Synthetic oligonucleotide
agctcacccatcaccaaggctaaacgttcaccgaa

SEQ ID NO: 98278 - DNA, 35 bp, Artificial Sequence
  Synthetic oligonucleotide
gacgaacccgccattagttacctgggcttgtggaa

SEQ ID NO: 98279 - DNA, 35 bp, Artificial Sequence
  Synthetic oligonucleotide
actcacccgttctgcagttcacgtaacacctacca

SEQ ID NO: 98280 - DNA, 35 bp, Artificial Sequence
  Synthetic oligonucleotide
gccaaccccagtcagtgcttcttcgtagttcccca

SEQ ID NO: 98281 - DNA, 36 bp, Artificial Sequence
  Synthetic oligonucleotide
tgtgacggctcctaggcccctttcactgtgatccca

SEQ ID NO: 98282 - DNA, 35 bp, Artificial Sequence
  Synthetic oligonucleotide
gttgcaccgctgaactacagctacacattcctcca

SEQ ID NO: 98283 - DNA, 36 bp, Artificial Sequence
  Synthetic oligonucleotide
gacaggggcgcaggcggcttgggacacgagtgtgca

SEQ ID NO: 98284 - DNA, 37 bp, Artificial Sequence
  Synthetic oligonucleotide
taagtccgagggagttgcgggaagggaccactggaga

SEQ ID NO: 98285 - DNA, 36 bp, Artificial Sequence
  Synthetic oligonucleotide
gatgcgagctgcatcacccttgcctagaatatgaga

SEQ ID NO: 98286 - DNA, 36 bp, Artificial Sequence
  Synthetic oligonucleotide
accgcctacaccgacgcagtatcgagagttctacga

SEQ ID NO: 98287 - DNA, 37 bp, Artificial Sequence
  Synthetic oligonucleotide
gatgacaggtacgtatgttaaatttctgttggtacga

SEQ ID NO: 98288 - DNA, 35 bp, Artificial Sequence
  Synthetic oligonucleotide
gatctaccgtgcagctacctttgccctttgtacga

SEQ ID NO: 98289 - DNA, 35 bp, Artificial Sequence
  Synthetic oligonucleotide
taggccaacccgcaacatgacccgagcccacccga

SEQ ID NO: 98290 - DNA, 38 bp, Artificial Sequence
  Synthetic oligonucleotide
tacgacaacgaatccgcgggcttcaacacattctccga

SEQ ID NO: 98291 - DNA, 37 bp, Artificial Sequence
  Synthetic oligonucleotide
gagggccgtgagacaagtgctgaaggaaagagtgcga

SEQ ID NO: 98292 - DNA, 36 bp, Artificial Sequence
  Synthetic oligonucleotide
actcacgactgggggcggatggagaatacgtgagga

SEQ ID NO: 98293 - DNA, 37 bp, Artificial Sequence
  Synthetic oligonucleotide
gccatgcaacgaagagggacgtgatgaggtggtagga

SEQ ID NO: 98294 - DNA, 37 bp, Artificial Sequence
  Synthetic oligonucleotide
gaatagcgggcatggggaaaggcaaaggggtaccgga

SEQ ID NO: 98295 - DNA, 36 bp, Artificial Sequence
  Synthetic oligonucleotide
gacacttcgcactcctgtcgccacgcctcacgggga

SEQ ID NO: 98296 - DNA, 37 bp, Artificial Sequence
  Synthetic oligonucleotide
acatgcgctgtgcttcaaacatccctgtcctggtgga

SEQ ID NO: 98297 - DNA, 36 bp, Artificial Sequence
  Synthetic oligonucleotide
gagggggagaagatgcacgaggaaaggatagaatga

SEQ ID NO: 98298 - DNA, 38 bp, Artificial Sequence
  Synthetic oligonucleotide
acactaccacagcgggctaataaaacaaattcacatga

SEQ ID NO: 98299 - DNA, 38 bp, Artificial Sequence
  Synthetic oligonucleotide
gacagcaaacgagtgacaaaggggaggaggttggatga

SEQ ID NO: 98300 - DNA, 37 bp, Artificial Sequence
  Synthetic oligonucleotide
gaacagaggggcgggaagatccaagacggagttatga

SEQ ID NO: 98301 - DNA, 38 bp, Artificial Sequence
  Synthetic oligonucleotide
tgaaacaggccaggaccaggaaaggagcacgacactga

SEQ ID NO: 98302 - DNA, 38 bp, Artificial Sequence
  Synthetic oligonucleotide
gtgcaaacgaccctaaagcgtaattagtaccctcctga

SEQ ID NO: 98303 - DNA, 38 bp, Artificial Sequence
  Synthetic oligonucleotide
gtgagcgagtgacagggtgcatgtttgcctaaaagtga

SEQ ID NO: 98304 - DNA, 38 bp, Artificial Sequence
  Synthetic oligonucleotide
aatgtgtagagtgagggcgaagaggaagttaggagtga

SEQ ID NO: 98305 - DNA, 37 bp, Artificial Sequence
  Synthetic oligonucleotide
gacgggcactgtttgcgtactcacgatctcttagtga

SEQ ID NO: 98306 - DNA, 38 bp, Artificial Sequence
  Synthetic oligonucleotide
tcaaccaggtgacatagtgctattttgccttgtggtga

SEQ ID NO: 98307 - DNA, 37 bp, Artificial Sequence
  Synthetic oligonucleotide
tcatcccgaattcacacgtgccttgcagtccatgtga

SEQ ID NO: 98308 - DNA, 37 bp, Artificial Sequence
  Synthetic oligonucleotide
tcacacctacatggtgtcatgacaaatacgcaattga

SEQ ID NO: 98309 - DNA, 36 bp, Artificial Sequence
  Synthetic oligonucleotide
accaggcccaccaggagctgaagttgaacaggccta

SEQ ID NO: 98310 - DNA, 36 bp, Artificial Sequence
  Synthetic oligonucleotide
tgatctccctacctcgtgaatgttatgcctggtgta

SEQ ID NO: 98311 - DNA, 38 bp, Artificial Sequence
  Synthetic oligonucleotide
tcatcgctgccagaccgccgttatccttgtgcctctta

SEQ ID NO: 98312 - DNA, 36 bp, Artificial Sequence
  Synthetic oligonucleotide
tctgccgaccgatccaaggccccaagagacgagtta

SEQ ID NO: 98313 - DNA, 35 bp, Artificial Sequence
  Synthetic oligonucleotide
atcgcaagcaggcaggcggtgagtggagtgattta

SEQ ID NO: 98314 - DNA, 36 bp, Artificial Sequence
  Synthetic oligonucleotide
tctgtccccgctgtgtcgaaccacatgtccgtttta

SEQ ID NO: 98315 - DNA, 35 bp, Artificial Sequence
  Synthetic oligonucleotide
agcatcaccatttcccctcacatacacgagtgcac

SEQ ID NO: 98316 - DNA, 35 bp, Artificial Sequence
  Synthetic oligonucleotide
tcccgccgctcacagcgcctcccgacctccctgcc

SEQ ID NO: 98317 - DNA, 35 bp, Artificial Sequence
  Synthetic oligonucleotide
atgtcactgtcctggctaatgcacgctttacttcc

SEQ ID NO: 98318 - DNA, 35 bp, Artificial Sequence
  Synthetic oligonucleotide
taccaggagatgtaagtccgttatgtcccacccgc

SEQ ID NO: 98319 - DNA, 35 bp, Artificial Sequence
  Synthetic oligonucleotide
gacacccatgcagggatgtacagataaacatcggc

SEQ ID NO: 98320 - DNA, 35 bp, Artificial Sequence
  Synthetic oligonucleotide
gagtgcacacttagctggtgagccctaacaattgc

SEQ ID NO: 98321 - DNA, 35 bp, Artificial Sequence
  Synthetic oligonucleotide
agccatcccaatgccctccgagtacggatttcatc

SEQ ID NO: 98322 - DNA, 35 bp, Artificial Sequence
  Synthetic oligonucleotide
tccctccgccttgtttttttggtccgtcgtcactc

SEQ ID NO: 98323 - DNA, 35 bp, Artificial Sequence
  Synthetic oligonucleotide
gctccccagctgggactcatcaagactgctctctc

SEQ ID NO: 98324 - DNA, 35 bp, Artificial Sequence
  Synthetic oligonucleotide
taacccacccggcgcgagaactactacagctcacg

SEQ ID NO: 98325 - DNA, 35 bp, Artificial Sequence
  Synthetic oligonucleotide
gacgtatcgccactcgcacacagctacagctcgcg

SEQ ID NO: 98326 - DNA, 35 bp, Artificial Sequence
  Synthetic oligonucleotide
gtaataaccggaaaagggaagaggggcgaggctcg

SEQ ID NO: 98327 - DNA, 35 bp, Artificial Sequence
  Synthetic oligonucleotide
aagccgccccctctggacacattgagcaccgtggg

SEQ ID NO: 98328 - DNA, 35 bp, Artificial Sequence
  Synthetic oligonucleotide
aacctgggctccgtttccactcacgcgatgtgttg

SEQ ID NO: 98329 - DNA, 35 bp, Artificial Sequence
  Synthetic oligonucleotide
tttagagcgtacaccaactgcaccatccagctttg

SEQ ID NO: 98330 - DNA, 35 bp, Artificial Sequence
  Synthetic oligonucleotide
gcatggatgccggcacatcgggaagggtcctacat

SEQ ID NO: 98331 - DNA, 35 bp, Artificial Sequence
  Synthetic oligonucleotide
aacatgcacggacggagctctattctgacgcccat

SEQ ID NO: 98332 - DNA, 35 bp, Artificial Sequence
  Synthetic oligonucleotide
gcaaccaggggggggttaacagtaagaagcttcat

SEQ ID NO: 98333 - DNA, 35 bp, Artificial Sequence
  Synthetic oligonucleotide
gtaacatcaaccgagcaaatagatcatgagaaact

SEQ ID NO: 98334 - DNA, 35 bp, Artificial Sequence
  Synthetic oligonucleotide
atgcgcagatgacaaagggaggaagggcgtacgct

SEQ ID NO: 98335 - DNA, 35 bp, Artificial Sequence
  Synthetic oligonucleotide
tgtcccttagctgatacgaccctttacctaccggt

SEQ ID NO: 98336 - DNA, 35 bp, Artificial Sequence
  Synthetic oligonucleotide
atccggtgagggtcgcagtgaagggggaatgcatt

SEQ ID NO: 98337 - DNA, 35 bp, Artificial Sequence
  Synthetic oligonucleotide
aacaaccagcaccatcccgctattagaatgttatt

SEQ ID NO: 98338 - DNA, 36 bp, Artificial Sequence
  Synthetic oligonucleotide
taccgaccgacgaaggtactatgaatccttatggaa

SEQ ID NO: 98339 - DNA, 36 bp, Artificial Sequence
  Synthetic oligonucleotide
gtgcaatggtgagactgaagcgggaagggcgataca

SEQ ID NO: 98340 - DNA, 36 bp, Artificial Sequence
  Synthetic oligonucleotide
agccaccattctgagagttctgtaattactgctcca

SEQ ID NO: 98341 - DNA, 36 bp, Artificial Sequence
  Synthetic oligonucleotide
gatagctgcacctatgacagacgagtccggatcgca

SEQ ID NO: 98342 - DNA, 36 bp, Artificial Sequence
  Synthetic oligonucleotide
gccacaggttgtagggagaaggggggagaggttgca

SEQ ID NO: 98343 - DNA, 35 bp, Artificial Sequence
  Synthetic oligonucleotide
tcacgcgaactcccctatggttacccggctcatca

SEQ ID NO: 98344 - DNA, 36 bp, Artificial Sequence
  Synthetic oligonucleotide
tggaaatgcccgctgatctgtcgtaacccaccctca

SEQ ID NO: 98345 - DNA, 35 bp, Artificial Sequence
  Synthetic oligonucleotide
tacccctcgctctttcgtagtgccgtcgcacttca

SEQ ID NO: 98346 - DNA, 36 bp, Artificial Sequence
  Synthetic oligonucleotide
gtatgtctccggacgcatatatacatgccttgttca

SEQ ID NO: 98347 - DNA, 37 bp, Artificial Sequence
  Synthetic oligonucleotide
gctgaaggttgaggggttcggaagggagaacgcaaga

SEQ ID NO: 98348 - DNA, 37 bp, Artificial Sequence
  Synthetic oligonucleotide
atgacaatggggtgggcgagggtatagtggcttgaga

SEQ ID NO: 98349 - DNA, 37 bp, Artificial Sequence
  Synthetic oligonucleotide
ttgacaggagtgagagacgaaggtaggtcaatataga

SEQ ID NO: 98350 - DNA, 36 bp, Artificial Sequence
  Synthetic oligonucleotide
gccaagcaaaactgcgtgaaaggttaacacctacga

SEQ ID NO: 98351 - DNA, 37 bp, Artificial Sequence
  Synthetic oligonucleotide
atgcgctggcactaccgtgatcagggcctctctacga

SEQ ID NO: 98352 - DNA, 37 bp, Artificial Sequence
  Synthetic oligonucleotide
gcgacgggcacgcctgttaatttcactccagaaccga

SEQ ID NO: 98353 - DNA, 37 bp, Artificial Sequence
  Synthetic oligonucleotide
gaaacgcatcacgggagtgtaccatcgaccatcccga

SEQ ID NO: 98354 - DNA, 36 bp, Artificial Sequence
  Synthetic oligonucleotide
tccaagcaacaccaatagtgaagagccttgtggcga

SEQ ID NO: 98355 - DNA, 37 bp, Artificial Sequence
  Synthetic oligonucleotide
tacgcctccactctctgttaatagatgtgctcctcga

SEQ ID NO: 98356 - DNA, 37 bp, Artificial Sequence
  Synthetic oligonucleotide
tacatgtcccaagtgagcaacaggcggatcgtaagga

SEQ ID NO: 98357 - DNA, 37 bp, Artificial Sequence
  Synthetic oligonucleotide
acgaagggagcgggcacgttgtaggtgaaggtgagga

SEQ ID NO: 98358 - DNA, 37 bp, Artificial Sequence
  Synthetic oligonucleotide
gaagggcgctgagagggtgaagtggggagacaaggga

SEQ ID NO: 98359 - DNA, 37 bp, Artificial Sequence
  Synthetic oligonucleotide
ggaagaacaggccggaaatagaatggggcgagaggga

SEQ ID NO: 98360 - DNA, 37 bp, Artificial Sequence
  Synthetic oligonucleotide
tacgtactggcaatggagggcaagggacgcaggggga

SEQ ID NO: 98361 - DNA, 35 bp, Artificial Sequence
  Synthetic oligonucleotide
ggacgatctgaagctgaattacctcttgtgctgga

SEQ ID NO: 98362 - DNA, 38 bp, Artificial Sequence
  Synthetic oligonucleotide
gagtgcccgggcaagtgtgcaaaaagtattgacgatga

SEQ ID NO: 98363 - DNA, 38 bp, Artificial Sequence
  Synthetic oligonucleotide
tagagccggtttgagcgtattcctgccgattcacctga

SEQ ID NO: 98364 - DNA, 38 bp, Artificial Sequence
  Synthetic oligonucleotide
tctgccaacacgaggcggaaagggaaggattggagtga

SEQ ID NO: 98365 - DNA, 37 bp, Artificial Sequence
  Synthetic oligonucleotide
tccaccaccacaccattctaagcacgctaactagtga

SEQ ID NO: 98366 - DNA, 37 bp, Artificial Sequence
  Synthetic oligonucleotide
tctggaacgaggaaaatatggagcggggacgaggtga

SEQ ID NO: 98367 - DNA, 37 bp, Artificial Sequence
  Synthetic oligonucleotide
tgaacatcccggtgagaggagagtggtgaaccggtga

SEQ ID NO: 98368 - DNA, 38 bp, Artificial Sequence
  Synthetic oligonucleotide
agccacagtcggtaagcgggttaggtagatgatggtga

SEQ ID NO: 98369 - DNA, 38 bp, Artificial Sequence
  Synthetic oligonucleotide
gtcgagctctgtgtgatgctggatggatgaggatgtga

SEQ ID NO: 98370 - DNA, 38 bp, Artificial Sequence
  Synthetic oligonucleotide
tgctccatagctgtcgtacggggtggttccttgtgtga

SEQ ID NO: 98371 - DNA, 37 bp, Artificial Sequence
  Synthetic oligonucleotide
actgcaagatcatggggtcgggagagaggacagttga

SEQ ID NO: 98372 - DNA, 38 bp, Artificial Sequence
  Synthetic oligonucleotide
tgcgggaagcggttcgccgggtactgtgggagggttga

SEQ ID NO: 98373 - DNA, 35 bp, Artificial Sequence
  Synthetic oligonucleotide
tgtccgttgctgactacgacccctttgaaactata

SEQ ID NO: 98374 - DNA, 36 bp, Artificial Sequence
  Synthetic oligonucleotide
gctcatggcaaacgtatgctagcgcgattcactcta

SEQ ID NO: 98375 - DNA, 36 bp, Artificial Sequence
  Synthetic oligonucleotide
tcaccactcccatccgaaagggcagtctagttcgta

SEQ ID NO: 98376 - DNA, 35 bp, Artificial Sequence
  Synthetic oligonucleotide
gagaggtgctgaatgtgagggggtgctgtacggta

SEQ ID NO: 98377 - DNA, 36 bp, Artificial Sequence
  Synthetic oligonucleotide
gatgcgctgctccacccgggaatggcatactgctta

SEQ ID NO: 98378 - DNA, 36 bp, Artificial Sequence
  Synthetic oligonucleotide
atctccgcacagtcctgtgaaagccctatgcgttta

SEQ ID NO: 98379 - DNA, 34 bp, Artificial Sequence
  Synthetic oligonucleotide
tcaataggggcgattgggagcgatagggggttta

SEQ ID NO: 98380 - DNA, 35 bp, Artificial Sequence
  Synthetic oligonucleotide
tgcctcccagtatacgtgcaaacggactacacaac

SEQ ID NO: 98381 - DNA, 35 bp, Artificial Sequence
  Synthetic oligonucleotide
tacgccccgacatggaaccgacgcagtccccgcac

SEQ ID NO: 98382 - DNA, 35 bp, Artificial Sequence
  Synthetic oligonucleotide
gaaccgtgcgcatgactgtagctcatatcactcac

SEQ ID NO: 98383 - DNA, 35 bp, Artificial Sequence
  Synthetic oligonucleotide
tcgatcaccaccccagctcgcgactacatagtcac

SEQ ID NO: 98384 - DNA, 34 bp, Artificial Sequence
  Synthetic oligonucleotide
gatgtccacggcccccatgtctcatagaaaagcc

SEQ ID NO: 98385 - DNA, 35 bp, Artificial Sequence
  Synthetic oligonucleotide
gcacttgagcgccccactctagccaggattttgcc

SEQ ID NO: 98386 - DNA, 35 bp, Artificial Sequence
  Synthetic oligonucleotide
gaagcgccgcaaactgtgcctttaacgccttctcc

SEQ ID NO: 98387 - DNA, 35 bp, Artificial Sequence
  Synthetic oligonucleotide
gcccacagtgggatttgcaggactggtgggagggc

SEQ ID NO: 98388 - DNA, 35 bp, Artificial Sequence
  Synthetic oligonucleotide
taaccgctgccccactccttgcatggaccatttgc

SEQ ID NO: 98389 - DNA, 35 bp, Artificial Sequence
  Synthetic oligonucleotide
actgccgttcgacgtagaacccacacctacgcttc

SEQ ID NO: 98390 - DNA, 35 bp, Artificial Sequence
  Synthetic oligonucleotide
gatagtgggaggtgtggtgaggtgatcaaagagag

SEQ ID NO: 98391 - DNA, 35 bp, Artificial Sequence
  Synthetic oligonucleotide
aaacgcacacagagttgtatcgagggtttggtgag

SEQ ID NO: 98392 - DNA, 35 bp, Artificial Sequence
  Synthetic oligonucleotide
gaccatcaagggcaaaatcgattagtgaggcaagg

SEQ ID NO: 98393 - DNA, 35 bp, Artificial Sequence
  Synthetic oligonucleotide
agcccatctcccaggcaacgatatacatcgtcttg

SEQ ID NO: 98394 - DNA, 35 bp, Artificial Sequence
  Synthetic oligonucleotide
tccaagtgcagcctagtaacagtctagctcaccat

SEQ ID NO: 98395 - DNA, 32 bp, Artificial Sequence
  Synthetic oligonucleotide
tcccaatcgctcctaggccctcttgaattgat

SEQ ID NO: 98396 - DNA, 35 bp, Artificial Sequence
  Synthetic oligonucleotide
gcattgcacccgacctgattcaccccatatcttat

SEQ ID NO: 98397 - DNA, 35 bp, Artificial Sequence
  Synthetic oligonucleotide
atgacacggtgtctagccgttccacatgttttact

SEQ ID NO: 98398 - DNA, 35 bp, Artificial Sequence
  Synthetic oligonucleotide
gttgcaatagtgacacgtacgggtgggggagacgt

SEQ ID NO: 98399 - DNA, 35 bp, Artificial Sequence
  Synthetic oligonucleotide
taatgcgataggtacgctacttcatactgcttatt

SEQ ID NO: 98400 - DNA, 35 bp, Artificial Sequence
  Synthetic oligonucleotide
gaggacgtgcaatcactcaaccgccctcactcctt

SEQ ID NO: 98401 - DNA, 35 bp, Artificial Sequence
  Synthetic oligonucleotide
ataacagggctagggtggatgggctagagtgcgtt

SEQ ID NO: 98402 - DNA, 36 bp, Artificial Sequence
  Synthetic oligonucleotide
gacatgttgcagtgtaaagtggagagcgcgtgcaaa

SEQ ID NO: 98403 - DNA, 36 bp, Artificial Sequence
  Synthetic oligonucleotide
gcagtgatgcacgggacgcacatagacccgtagaaa

SEQ ID NO: 98404 - DNA, 35 bp, Artificial Sequence
  Synthetic oligonucleotide
tactcgcgcacaaagtgcatgacggagtgtttaaa

SEQ ID NO: 98405 - DNA, 35 bp, Artificial Sequence
  Synthetic oligonucleotide
agtccgtgcattacacaaggggggggaggaaacaa

SEQ ID NO: 98406 - DNA, 36 bp, Artificial Sequence
  Synthetic oligonucleotide
gacgccatccgcaaaggacctacttaaggcctggaa

SEQ ID NO: 98407 - DNA, 35 bp, Artificial Sequence
  Synthetic oligonucleotide
gggaagggagggttgggatgacggccctgtttgaa

SEQ ID NO: 98408 - DNA, 36 bp, Artificial Sequence
  Synthetic oligonucleotide
accagccacgcgcacatgttacgtcattctccctaa

SEQ ID NO: 98409 - DNA, 35 bp, Artificial Sequence
  Synthetic oligonucleotide
tcaaaatcggcacgaatttggctaaacacccgaca

SEQ ID NO: 98410 - DNA, 35 bp, Artificial Sequence
  Synthetic oligonucleotide
gctgctggtcgttatcacacggagcctcacccgca

SEQ ID NO: 98411 - DNA, 36 bp, Artificial Sequence
  Synthetic oligonucleotide
accgggggtggagcaatgggcgttggacagtgggca

SEQ ID NO: 98412 - DNA, 37 bp, Artificial Sequence
  Synthetic oligonucleotide
gcccacgcagtcgcttctcgccgaccatgactcaaga

SEQ ID NO: 98413 - DNA, 37 bp, Artificial Sequence
  Synthetic oligonucleotide
aaatgtcaggggggtgtggtaatggtaggggagacga

SEQ ID NO: 98414 - DNA, 37 bp, Artificial Sequence
  Synthetic oligonucleotide
gacgcactggagacttaagactgacgcgacattacga

SEQ ID NO: 98415 - DNA, 37 bp, Artificial Sequence
  Synthetic oligonucleotide
ttggagggtggaagtatcggggcacgacgagactcga

SEQ ID NO: 98416 - DNA, 36 bp, Artificial Sequence
  Synthetic oligonucleotide
tacaacacgacacagcattagtagtcacaactagga

SEQ ID NO: 98417 - DNA, 37 bp, Artificial Sequence
  Synthetic oligonucleotide
agtgcgtaataactgccaactgctggggacactagga

SEQ ID NO: 98418 - DNA, 37 bp, Artificial Sequence
  Synthetic oligonucleotide
gtggtggtaggaagtatgcagatatctgttgcgcgga

SEQ ID NO: 98419 - DNA, 38 bp, Artificial Sequence
  Synthetic oligonucleotide
ttcgccagggggggttgggtcagacaagctgaggatga

SEQ ID NO: 98420 - DNA, 37 bp, Artificial Sequence
  Synthetic oligonucleotide
gccacgcccagacgcacatagttggttgttcacctga

SEQ ID NO: 98421 - DNA, 38 bp, Artificial Sequence
  Synthetic oligonucleotide
tcacttcacatccggggtttccacagtcactatgctga

SEQ ID NO: 98422 - DNA, 37 bp, Artificial Sequence
  Synthetic oligonucleotide
aacatgggtggggatgagaagtgctgtgacggagtga

SEQ ID NO: 98423 - DNA, 37 bp, Artificial Sequence
  Synthetic oligonucleotide
tgtgggtcgaggtgctgaggacgggggacgggagtga

SEQ ID NO: 98424 - DNA, 38 bp, Artificial Sequence
  Synthetic oligonucleotide
ggtccgggagagatgtagagaggaaagaaggaacgtga

SEQ ID NO: 98425 - DNA, 36 bp, Artificial Sequence
  Synthetic oligonucleotide
accaagggacggcggttgattgggaatcgaccgtga

SEQ ID NO: 98426 - DNA, 38 bp, Artificial Sequence
  Synthetic oligonucleotide
gtacatgcggctgagtctgctaactcctttccccgtga

SEQ ID NO: 98427 - DNA, 38 bp, Artificial Sequence
  Synthetic oligonucleotide
gcatgtcacacgttacaggtgagagcacatgggggtga

SEQ ID NO: 98428 - DNA, 37 bp, Artificial Sequence
  Synthetic oligonucleotide
aatgcagtaacaagtggggggtgggtgacattggtga

SEQ ID NO: 98429 - DNA, 38 bp, Artificial Sequence
  Synthetic oligonucleotide
tatgtgcacgaacatatttttccatagccaccatgtga

SEQ ID NO: 98430 - DNA, 38 bp, Artificial Sequence
  Synthetic oligonucleotide
ggacacaaaagctaaatgtgaggcgcgtctctatgtga

SEQ ID NO: 98431 - DNA, 38 bp, Artificial Sequence
  Synthetic oligonucleotide
gaggacgtggcgtaggcaccaaagatgcagtgctgtga

SEQ ID NO: 98432 - DNA, 38 bp, Artificial Sequence
  Synthetic oligonucleotide
gcccatgcgtattacacgcgtgctgaaccattcattga

SEQ ID NO: 98433 - DNA, 37 bp, Artificial Sequence
  Synthetic oligonucleotide
gtgtgccacattgtgttaacacctccttctaatttga

SEQ ID NO: 98434 - DNA, 38 bp, Artificial Sequence
  Synthetic oligonucleotide
ttagccagaggaaagagggggccatgtactcagtttga

SEQ ID NO: 98435 - DNA, 36 bp, Artificial Sequence
  Synthetic oligonucleotide
gtgtacagtcaggtgtatatcaaccttcctgcaata

SEQ ID NO: 98436 - DNA, 36 bp, Artificial Sequence
  Synthetic oligonucleotide
gggggcatgagagagcaggttaagaaagggacgata

SEQ ID NO: 98437 - DNA, 36 bp, Artificial Sequence
  Synthetic oligonucleotide
gatgcccctcgaggtaggtggaagtgcctggttata

SEQ ID NO: 98438 - DNA, 36 bp, Artificial Sequence
  Synthetic oligonucleotide
gccgggccaaggcgcgtattggtaccctttacacta

SEQ ID NO: 98439 - DNA, 35 bp, Artificial Sequence
  Synthetic oligonucleotide
atgcgaggtgggagggtaccactatagggaagcta

SEQ ID NO: 98440 - DNA, 36 bp, Artificial Sequence
  Synthetic oligonucleotide
gcacacacgacggcatggatactccgtaatgttcta

SEQ ID NO: 98441 - DNA, 36 bp, Artificial Sequence
  Synthetic oligonucleotide
aaagggggggtacgactgtaagagggtgccggcgta

SEQ ID NO: 98442 - DNA, 36 bp, Artificial Sequence
  Synthetic oligonucleotide
acctgtgcatgctgcgaatccgggcctcaactcgta

SEQ ID NO: 98443 - DNA, 36 bp, Artificial Sequence
  Synthetic oligonucleotide
atcggatcgccgtgggacatggtggaactggtatta

SEQ ID NO: 98444 - DNA, 36 bp, Artificial Sequence
  Synthetic oligonucleotide
gccggagtgaggctgcatccaacgcactttcattta

SEQ ID NO: 98445 - DNA, 35 bp, Artificial Sequence
  Synthetic oligonucleotide
tagtacacgactacggtctatatttgggcgaaaac

SEQ ID NO: 98446 - DNA, 35 bp, Artificial Sequence
  Synthetic oligonucleotide
tgtacacacctctctcacgtctaatctgaaagcac

SEQ ID NO: 98447 - DNA, 35 bp, Artificial Sequence
  Synthetic oligonucleotide
gtgtgaccctatgatcttcgcgaaggtcccctgac

SEQ ID NO: 98448 - DNA, 35 bp, Artificial Sequence
  Synthetic oligonucleotide
gtagccttatgcacctaaatcatgtgacgcgatac

SEQ ID NO: 98449 - DNA, 35 bp, Artificial Sequence
  Synthetic oligonucleotide
acgcaactgagtccgatgctttcacatcccgtacc

SEQ ID NO: 98450 - DNA, 35 bp, Artificial Sequence
  Synthetic oligonucleotide
gatcacacgcctgatggattaacgtctgtccaccc

SEQ ID NO: 98451 - DNA, 35 bp, Artificial Sequence
  Synthetic oligonucleotide
gcaccgtggaggggaaggaaatgagaaggcgttcc

SEQ ID NO: 98452 - DNA, 36 bp, Artificial Sequence
  Synthetic oligonucleotide
gactcggactcagatggtgtgctactccccttcagc

SEQ ID NO: 98453 - DNA, 35 bp, Artificial Sequence
  Synthetic oligonucleotide
gtcacacaggtgctaaatactagcttctggcactc

SEQ ID NO: 98454 - DNA, 35 bp, Artificial Sequence
  Synthetic oligonucleotide
gcccgttcgcgatatccgtctcggcccgagtactc

SEQ ID NO: 98455 - DNA, 35 bp, Artificial Sequence
  Synthetic oligonucleotide
gaccgtcgcactatgtgcttagcctctcttacctc

SEQ ID NO: 98456 - DNA, 35 bp, Artificial Sequence
  Synthetic oligonucleotide
tgaccgtgcgcatatcgtatcgtcctgccctgttc

SEQ ID NO: 98457 - DNA, 35 bp, Artificial Sequence
  Synthetic oligonucleotide
gcaccgacgaagcgaatggtgccgctgtttatttc

SEQ ID NO: 98458 - DNA, 35 bp, Artificial Sequence
  Synthetic oligonucleotide
acccggagccggtcgagttttgtgcaagtctaacg

SEQ ID NO: 98459 - DNA, 35 bp, Artificial Sequence
  Synthetic oligonucleotide
ggtcaccatacatcttcaacaaatagcgggcctcg

SEQ ID NO: 98460 - DNA, 35 bp, Artificial Sequence
  Synthetic oligonucleotide
gatagtgcatgaaaccggagagtcagaacgttggg

SEQ ID NO: 98461 - DNA, 35 bp, Artificial Sequence
  Synthetic oligonucleotide
tagatgggacgggggccggagtagtatacgggcat

SEQ ID NO: 98462 - DNA, 35 bp, Artificial Sequence
  Synthetic oligonucleotide
gagccaagggggaagtactaggcgatcgattacct

SEQ ID NO: 98463 - DNA, 35 bp, Artificial Sequence
  Synthetic oligonucleotide
gcccgcctccctctcgattatggcagagcggtgct

SEQ ID NO: 98464 - DNA, 35 bp, Artificial Sequence
  Synthetic oligonucleotide
gtgcggccctgctcttctggctttatatctagtct

SEQ ID NO: 98465 - DNA, 35 bp, Artificial Sequence
  Synthetic oligonucleotide
ttgacacgtacggtatcactagcttcatgaacagt

SEQ ID NO: 98466 - DNA, 35 bp, Artificial Sequence
  Synthetic oligonucleotide
gacacacccagacgccctcttcctgtgcgcaccaa

SEQ ID NO: 98467 - DNA, 36 bp, Artificial Sequence
  Synthetic oligonucleotide
tcagggctgcaccaccaacacacctcacacgctgaa

SEQ ID NO: 98468 - DNA, 36 bp, Artificial Sequence
  Synthetic oligonucleotide
gcaccgataggaggagtcaatgtactggcacgataa

SEQ ID NO: 98469 - DNA, 36 bp, Artificial Sequence
  Synthetic oligonucleotide
tcaagtgggatgtagtgcatgtggaatgcgggataa

SEQ ID NO: 98470 - DNA, 35 bp, Artificial Sequence
  Synthetic oligonucleotide
aaaccgcagttgggtgggaagtgctaacgttaaca

SEQ ID NO: 98471 - DNA, 35 bp, Artificial Sequence
  Synthetic oligonucleotide
accactgcccacgcccggtcgacgccagctaccca

SEQ ID NO: 98472 - DNA, 36 bp, Artificial Sequence
  Synthetic oligonucleotide
gtgtacgcaggcggtcatacctgaggcgttactcca

SEQ ID NO: 98473 - DNA, 36 bp, Artificial Sequence
  Synthetic oligonucleotide
tgccaccagcttccaaccatcgtatacacatgtcca

SEQ ID NO: 98474 - DNA, 35 bp, Artificial Sequence
  Synthetic oligonucleotide
gtaacccagcgttggcatttacttgatccgttgca

SEQ ID NO: 98475 - DNA, 36 bp, Artificial Sequence
  Synthetic oligonucleotide
aacgacatcaggattgattcggcgtactgaccctca

SEQ ID NO: 98476 - DNA, 37 bp, Artificial Sequence
  Synthetic oligonucleotide
gtggtgagaatggaggcatgaagcgcaggaacgcaga

SEQ ID NO: 98477 - DNA, 36 bp, Artificial Sequence
  Synthetic oligonucleotide
ttgacatgggagaatgatggaggcacagtgacgaga

SEQ ID NO: 98478 - DNA, 37 bp, Artificial Sequence
  Synthetic oligonucleotide
acagccaagcaaggcgttaaacacggaacggcataga

SEQ ID NO: 98479 - DNA, 35 bp, Artificial Sequence
  Synthetic oligonucleotide
gtgaacgtactgaaaaagggacttagccacaacga

SEQ ID NO: 98480 - DNA, 35 bp, Artificial Sequence
  Synthetic oligonucleotide
atcatcctaccgtgtgcttcaatgcatctgtacga

SEQ ID NO: 98481 - DNA, 37 bp, Artificial Sequence
  Synthetic oligonucleotide
aatccgccatcatcgcaagagtagtccgatttcgcga

SEQ ID NO: 98482 - DNA, 37 bp, Artificial Sequence
  Synthetic oligonucleotide
gcccacggatggttgtagccattgccccctgtttcga

SEQ ID NO: 98483 - DNA, 37 bp, Artificial Sequence
  Synthetic oligonucleotide
ggagaacgacgatagataggtgctgagtacacaagga

SEQ ID NO: 98484 - DNA, 37 bp, Artificial Sequence
  Synthetic oligonucleotide
ttggactcgacgggaactaactacggacggacaagga

SEQ ID NO: 98485 - DNA, 37 bp, Artificial Sequence
  Synthetic oligonucleotide
gtgtcagtggcgtttacaaaagggaagcgggaaggga

SEQ ID NO: 98486 - DNA, 37 bp, Artificial Sequence
  Synthetic oligonucleotide
tgtgcacgatagaagggatgggctgctgtcgtttgga

SEQ ID NO: 98487 - DNA, 37 bp, Artificial Sequence
  Synthetic oligonucleotide
tgatagtacgaggaaagggtgacagtgggaacaatga

SEQ ID NO: 98488 - DNA, 38 bp, Artificial Sequence
  Synthetic oligonucleotide
ttcgacacaagggagtatgtgcatcttcgcctcaatga

SEQ ID NO: 98489 - DNA, 38 bp, Artificial Sequence
  Synthetic oligonucleotide
tacgacagcacggtggcgatacctgacggagaacatga

SEQ ID NO: 98490 - DNA, 37 bp, Artificial Sequence
  Synthetic oligonucleotide
tcacacagaggggaagaagcagtgacttggcatatga

SEQ ID NO: 98491 - DNA, 38 bp, Artificial Sequence
  Synthetic oligonucleotide
gatgtggtgaaggagtggccaaaggatggcaagtatga

SEQ ID NO: 98492 - DNA, 38 bp, Artificial Sequence
  Synthetic oligonucleotide
ttcctgccgccagaatgcacctttgcgcaccgttatga

SEQ ID NO: 98493 - DNA, 38 bp, Artificial Sequence
  Synthetic oligonucleotide
taccctgcctcagcacgctacgatggctcaatcactga

SEQ ID NO: 98494 - DNA, 38 bp, Artificial Sequence
  Synthetic oligonucleotide
gacacaggcctgctgcaaaaaagcccttccggacctga

SEQ ID NO: 98495 - DNA, 37 bp, Artificial Sequence
  Synthetic oligonucleotide
tgacgcactgtaatcgcacatgttctgactcccctga

SEQ ID NO: 98496 - DNA, 38 bp, Artificial Sequence
  Synthetic oligonucleotide
gtcgccgaccatcattgaatccatcgtgcgctttctga

SEQ ID NO: 98497 - DNA, 38 bp, Artificial Sequence
  Synthetic oligonucleotide
acatgatgcgcaagaactggttaggaaaaccagggtga

SEQ ID NO: 98498 - DNA, 38 bp, Artificial Sequence
  Synthetic oligonucleotide
taggtaccgccaaagtggtgggcaggcaaagagggtga

SEQ ID NO: 98499 - DNA, 38 bp, Artificial Sequence
  Synthetic oligonucleotide
tcgaaggaagagaggaatatgtggtagtatgagggtga

SEQ ID NO: 98500 - DNA, 37 bp, Artificial Sequence
  Synthetic oligonucleotide
gtgaacagggataggtcgggatcagcaaaggtggtga

SEQ ID NO: 98501 - DNA, 38 bp, Artificial Sequence
  Synthetic oligonucleotide
gatcacgctgagtgatccggattcataattctctgtga

SEQ ID NO: 98502 - DNA, 38 bp, Artificial Sequence
  Synthetic oligonucleotide
gtgagccggagtcagaagttgagtggtgacgggtgtga

SEQ ID NO: 98503 - DNA, 38 bp, Artificial Sequence
  Synthetic oligonucleotide
agtgtgcgtaggggatgtaatacacagcaggggattga

SEQ ID NO: 98504 - DNA, 37 bp, Artificial Sequence
  Synthetic oligonucleotide
atccgacagtgacctgtttatgttacgcccttcttga

SEQ ID NO: 98505 - DNA, 38 bp, Artificial Sequence
  Synthetic oligonucleotide
tgtccgtgctcttgtaaactgtccttctcctgcgttga

SEQ ID NO: 98506 - DNA, 38 bp, Artificial Sequence
  Synthetic oligonucleotide
tccacagtccatagtgtcgttagaaaccccttctttga

SEQ ID NO: 98507 - DNA, 36 bp, Artificial Sequence
  Synthetic oligonucleotide
gtgtagacggggagggggatagaaagccaaattata

SEQ ID NO: 98508 - DNA, 35 bp, Artificial Sequence
  Synthetic oligonucleotide
tcaacacgacgtccttgtagaccttgtgatcccta

SEQ ID NO: 98509 - DNA, 36 bp, Artificial Sequence
  Synthetic oligonucleotide
gattccggtcgaccgtgctccacaaccgtgtgccta

SEQ ID NO: 98510 - DNA, 35 bp, Artificial Sequence
  Synthetic oligonucleotide
gatgactcacccgagtccattggagagctacgcta

SEQ ID NO: 98511 - DNA, 36 bp, Artificial Sequence
  Synthetic oligonucleotide
taaacgcacgaaatgaggatgttgaatggggtgcta

SEQ ID NO: 98512 - DNA, 35 bp, Artificial Sequence
  Synthetic oligonucleotide
ggagtgcgaaacggaggtaggttgaaatgtgagta

SEQ ID NO: 98513 - DNA, 36 bp, Artificial Sequence
  Synthetic oligonucleotide
tggaggagcgggatagtacgagggaagagtggggta

SEQ ID NO: 98514 - DNA, 36 bp, Artificial Sequence
  Synthetic oligonucleotide
tcgaaggtcattattgtaacggccatcactccctta

SEQ ID NO: 98515 - DNA, 36 bp, Artificial Sequence
  Synthetic oligonucleotide
tgcgacgggtagggggtatgtcgatgttcggcgtta

SEQ ID NO: 98516 - DNA, 35 bp, Artificial Sequence
  Synthetic oligonucleotide
gaaccatctttccaccctcatattgacgggtcaac

SEQ ID NO: 98517 - DNA, 35 bp, Artificial Sequence
  Synthetic oligonucleotide
acgagtgtctcaccgccctcgtcatgcccacgaac

SEQ ID NO: 98518 - DNA, 35 bp, Artificial Sequence
  Synthetic oligonucleotide
taggagcgaacagctctcctccacctcacgtgcac

SEQ ID NO: 98519 - DNA, 35 bp, Artificial Sequence
  Synthetic oligonucleotide
attgcctggccccgattcccctagagctttatcac

SEQ ID NO: 98520 - DNA, 35 bp, Artificial Sequence
  Synthetic oligonucleotide
gcgacatgtgcctgtaggctcttgaaggttggacc

SEQ ID NO: 98521 - DNA, 35 bp, Artificial Sequence
  Synthetic oligonucleotide
tgccctaggcaacggttaattacggctcgggtacc

SEQ ID NO: 98522 - DNA, 35 bp, Artificial Sequence
  Synthetic oligonucleotide
tgtctatccccagtttgcgtagtttactccgcgcc

SEQ ID NO: 98523 - DNA, 35 bp, Artificial Sequence
  Synthetic oligonucleotide
gccagaccccctagttgacgtaacgctgccgctcc

SEQ ID NO: 98524 - DNA, 35 bp, Artificial Sequence
  Synthetic oligonucleotide
acactgcagagggttacagcgggagtataaatggc

SEQ ID NO: 98525 - DNA, 35 bp, Artificial Sequence
  Synthetic oligonucleotide
acagagctgccagcacttaatgctcgatattcatc

SEQ ID NO: 98526 - DNA, 35 bp, Artificial Sequence
  Synthetic oligonucleotide
tccaaaccgctcattttgaatcttggtggtgactc

SEQ ID NO: 98527 - DNA, 35 bp, Artificial Sequence
  Synthetic oligonucleotide
tgtaccacgaagagagactaagtacggcaagggtc

SEQ ID NO: 98528 - DNA, 35 bp, Artificial Sequence
  Synthetic oligonucleotide
ttgcgaacgacgcgcactatcacagtcggctgttc

SEQ ID NO: 98529 - DNA, 35 bp, Artificial Sequence
  Synthetic oligonucleotide
tttcactcaacggcacattgacaccgacccatacg

SEQ ID NO: 98530 - DNA, 35 bp, Artificial Sequence
  Synthetic oligonucleotide
gcgacttgtcgtgaccatgagcccccctcgaaccg

SEQ ID NO: 98531 - DNA, 35 bp, Artificial Sequence
  Synthetic oligonucleotide
tgatcggcccctcgactatacttttatgcaacgcg

SEQ ID NO: 98532 - DNA, 35 bp, Artificial Sequence
  Synthetic oligonucleotide
gatacggactagaagtgagtgtgaagagggatgcg

SEQ ID NO: 98533 - DNA, 35 bp, Artificial Sequence
  Synthetic oligonucleotide
gatctgcgtgagcctcacatttcaaactttcttcg

SEQ ID NO: 98534 - DNA, 35 bp, Artificial Sequence
  Synthetic oligonucleotide
acacatcacgacgggattgtaacagttgttaaggt

SEQ ID NO: 98535 - DNA, 35 bp, Artificial Sequence
  Synthetic oligonucleotide
gagcgccaaatagttctgactcccgtttttctctt

SEQ ID NO: 98536 - DNA, 36 bp, Artificial Sequence
  Synthetic oligonucleotide
taatcggggggggtcagaggggtgattgggcaccaa

SEQ ID NO: 98537 - DNA, 36 bp, Artificial Sequence
  Synthetic oligonucleotide
ttgaccccccatccaaatgctataactggagaccaa

SEQ ID NO: 98538 - DNA, 36 bp, Artificial Sequence
  Synthetic oligonucleotide
gatcacgggaactggtgtagaacggtcatagtggaa

SEQ ID NO: 98539 - DNA, 35 bp, Artificial Sequence
  Synthetic oligonucleotide
ggacataacctcaccgtgcatttgcaaccgaataa

SEQ ID NO: 98540 - DNA, 36 bp, Artificial Sequence
  Synthetic oligonucleotide
gcaacgcgtacatagtaacagaagcgttgtcgataa

SEQ ID NO: 98541 - DNA, 36 bp, Artificial Sequence
  Synthetic oligonucleotide
tccacactacatcagcaggtttgtgccccgtgtaca

SEQ ID NO: 98542 - DNA, 36 bp, Artificial Sequence
  Synthetic oligonucleotide
tgagcaggctcagctgtcttttagcctctacacgca

SEQ ID NO: 98543 - DNA, 36 bp, Artificial Sequence
  Synthetic oligonucleotide
acttggccccatcaagcacttaatcgagtggcttca

SEQ ID NO: 98544 - DNA, 35 bp, Artificial Sequence
  Synthetic oligonucleotide
acgaagacgggtcgggaaatccatgcaagtagaga

SEQ ID NO: 98545 - DNA, 37 bp, Artificial Sequence
  Synthetic oligonucleotide
taagccaggtagcttgagcatcaggaatgacgggaga

SEQ ID NO: 98546 - DNA, 37 bp, Artificial Sequence
  Synthetic oligonucleotide
taatgcagggctcggcaagaagggacgggggcaacga

SEQ ID NO: 98547 - DNA, 37 bp, Artificial Sequence
  Synthetic oligonucleotide
gtctgcagacgatctaattactacacgtggctctcga

SEQ ID NO: 98548 - DNA, 37 bp, Artificial Sequence
  Synthetic oligonucleotide
gaggggcatgaaagagggaaacgggagtcggcgtcga

SEQ ID NO: 98549 - DNA, 36 bp, Artificial Sequence
  Synthetic oligonucleotide
ttcacaccatccgccttggttccagtggctcttcga

SEQ ID NO: 98550 - DNA, 37 bp, Artificial Sequence
  Synthetic oligonucleotide
gatgcaatcaagtggagggcaatctggctccttagga

SEQ ID NO: 98551 - DNA, 36 bp, Artificial Sequence
  Synthetic oligonucleotide
atgatgcagggcacgggctcagaaagaaagtcggga

SEQ ID NO: 98552 - DNA, 36 bp, Artificial Sequence
  Synthetic oligonucleotide
gtcatcccccgttgtacatgccagtttgtacaatga

SEQ ID NO: 98553 - DNA, 38 bp, Artificial Sequence
  Synthetic oligonucleotide
gcataggagtggcggtgagatggacgcgttggtaatga

SEQ ID NO: 98554 - DNA, 38 bp, Artificial Sequence
  Synthetic oligonucleotide
acacaggggacgatgttaccttctcacaagcatcctga

SEQ ID NO: 98555 - DNA, 38 bp, Artificial Sequence
  Synthetic oligonucleotide
gctgtacgcagatacgttatccgcacctggtatgctga

SEQ ID NO: 98556 - DNA, 38 bp, Artificial Sequence
  Synthetic oligonucleotide
taggagggtcgggagtagtggcaaaacgcgcagtctga

SEQ ID NO: 98557 - DNA, 36 bp, Artificial Sequence
  Synthetic oligonucleotide
tcagttcgggcgtgagagagggcttatggggagtga

SEQ ID NO: 98558 - DNA, 38 bp, Artificial Sequence
  Synthetic oligonucleotide
tgtgaaagtgtcggaaatcggttggaggtaggtagtga

SEQ ID NO: 98559 - DNA, 38 bp, Artificial Sequence
  Synthetic oligonucleotide
accctatccccagaactgcccttgtgaaggcctcgtga

SEQ ID NO: 98560 - DNA, 38 bp, Artificial Sequence
  Synthetic oligonucleotide
gtgtgtgtcagtagctgagcgttacagagtgggggtga

SEQ ID NO: 98561 - DNA, 37 bp, Artificial Sequence
  Synthetic oligonucleotide
tgcggagcaagggaagtgataacagatggagtggtga

SEQ ID NO: 98562 - DNA, 38 bp, Artificial Sequence
  Synthetic oligonucleotide
tcaaccggtcctcattgcatctggagaagtccgtgtga

SEQ ID NO: 98563 - DNA, 38 bp, Artificial Sequence
  Synthetic oligonucleotide
tagtgcgttagacctgttcctatggtttctctgattga

SEQ ID NO: 98564 - DNA, 38 bp, Artificial Sequence
  Synthetic oligonucleotide
tgtgaggacgcacagaggatctgaaaggggtgggttga

SEQ ID NO: 98565 - DNA, 36 bp, Artificial Sequence
  Synthetic oligonucleotide
tacacacgtatgggtccgaatacgtgaaagcttata

SEQ ID NO: 98566 - DNA, 36 bp, Artificial Sequence
  Synthetic oligonucleotide
gatgacgcacatatgcggtggagctaatattgagta

SEQ ID NO: 98567 - DNA, 36 bp, Artificial Sequence
  Synthetic oligonucleotide
ggatgcgatggggatctaccacgtcgaatccacgta

SEQ ID NO: 98568 - DNA, 35 bp, Artificial Sequence
  Synthetic oligonucleotide
tgcatcaccgccctactgcccacccatgctaggac

SEQ ID NO: 98569 - DNA, 35 bp, Artificial Sequence
  Synthetic oligonucleotide
gcactagctgcattactgtctacgggctaaatacc

SEQ ID NO: 98570 - DNA, 35 bp, Artificial Sequence
  Synthetic oligonucleotide
tgtgtggaacggacgtgggtaacggcaacagtccc

SEQ ID NO: 98571 - DNA, 35 bp, Artificial Sequence
  Synthetic oligonucleotide
tagccggagggtttggtaaccagcaagctaagggc

SEQ ID NO: 98572 - DNA, 35 bp, Artificial Sequence
  Synthetic oligonucleotide
acacacgacacggatgatcggcgttgattgatggc

SEQ ID NO: 98573 - DNA, 35 bp, Artificial Sequence
  Synthetic oligonucleotide
atgtgcagagcagatcgcatgacgtggctggattc

SEQ ID NO: 98574 - DNA, 35 bp, Artificial Sequence
  Synthetic oligonucleotide
acaggtggagggggagcgcgggggggaaaagtcag

SEQ ID NO: 98575 - DNA, 35 bp, Artificial Sequence
  Synthetic oligonucleotide
gtttccgcggtagaaaggagttataggcgtggtag

SEQ ID NO: 98576 - DNA, 35 bp, Artificial Sequence
  Synthetic oligonucleotide
atgaaaggctgaggcggtgtggcatggaggcttag

SEQ ID NO: 98577 - DNA, 35 bp, Artificial Sequence
  Synthetic oligonucleotide
tacgctactggattgtctcgtcctcgctacttacg

SEQ ID NO: 98578 - DNA, 35 bp, Artificial Sequence
  Synthetic oligonucleotide
aacgcgcattctcggctgtcttttctcctagctcg

SEQ ID NO: 98579 - DNA, 35 bp, Artificial Sequence
  Synthetic oligonucleotide
gtgtaccgcctgctcgtggttatgaccttagttcg

SEQ ID NO: 98580 - DNA, 35 bp, Artificial Sequence
  Synthetic oligonucleotide
tagaacgcgggggcgggcgtatcggatctggaagg

SEQ ID NO: 98581 - DNA, 35 bp, Artificial Sequence
  Synthetic oligonucleotide
aacacgcctggactgcgtggtgagccgctaaatgg

SEQ ID NO: 98582 - DNA, 35 bp, Artificial Sequence
  Synthetic oligonucleotide
gcatacacgctcagaggtgtgttcgcccctccctg

SEQ ID NO: 98583 - DNA, 35 bp, Artificial Sequence
  Synthetic oligonucleotide
ggaaagcaggctcacccatcgccgtatccactctg

SEQ ID NO: 98584 - DNA, 35 bp, Artificial Sequence
  Synthetic oligonucleotide
tgatccaccggggaaagtaccgcacaggggacgtg

SEQ ID NO: 98585 - DNA, 35 bp, Artificial Sequence
  Synthetic oligonucleotide
aacaacaggagacaggtcgaaaacaaagcacgttg

SEQ ID NO: 98586 - DNA, 35 bp, Artificial Sequence
  Synthetic oligonucleotide
gaagcgagatgcagttatgaaggaaggaccggaat

SEQ ID NO: 98587 - DNA, 35 bp, Artificial Sequence
  Synthetic oligonucleotide
acatcatactccaccgccgaccagttaagccgcat

SEQ ID NO: 98588 - DNA, 35 bp, Artificial Sequence
  Synthetic oligonucleotide
actgccccagtacgagcgtcatcgagttctttcgt

SEQ ID NO: 98589 - DNA, 35 bp, Artificial Sequence
  Synthetic oligonucleotide
accatgccattagtacgcgataaacatctatctgt

SEQ ID NO: 98590 - DNA, 35 bp, Artificial Sequence
  Synthetic oligonucleotide
gttgtgcacggttaattgagaatcaggctgagatt

SEQ ID NO: 98591 - DNA, 35 bp, Artificial Sequence
  Synthetic oligonucleotide
accccggtcatgtgaggcatctttgtacccgtatt

SEQ ID NO: 98592 - DNA, 35 bp, Artificial Sequence
  Synthetic oligonucleotide
tagacacatgacggaatgggaagtgtgggactaaa

SEQ ID NO: 98593 - DNA, 36 bp, Artificial Sequence
  Synthetic oligonucleotide
ggggggaggccacactttgctcaggagatggaacaa

SEQ ID NO: 98594 - DNA, 36 bp, Artificial Sequence
  Synthetic oligonucleotide
ttcaaggggcgtgcagggaggatgagagtgaagcaa

SEQ ID NO: 98595 - DNA, 35 bp, Artificial Sequence
  Synthetic oligonucleotide
ttcgacataaccgatctacttcaagcaccttgcaa

SEQ ID NO: 98596 - DNA, 35 bp, Artificial Sequence
  Synthetic oligonucleotide
gcaatgcaagggtgacacgaaagtctagccttgaa

SEQ ID NO: 98597 - DNA, 35 bp, Artificial Sequence
  Synthetic oligonucleotide
taaccatccatcgatctgctcaagcccctcgctaa

SEQ ID NO: 98598 - DNA, 36 bp, Artificial Sequence
  Synthetic oligonucleotide
gcaggagaagaaatggtatgggtggcgaaatggtaa

SEQ ID NO: 98599 - DNA, 36 bp, Artificial Sequence
  Synthetic oligonucleotide
atttacccgcgcgcccttccattgcgaaacctgtaa

SEQ ID NO: 98600 - DNA, 36 bp, Artificial Sequence
  Synthetic oligonucleotide
tgctgtgcaagatttatagtactctcccctgctaca

SEQ ID NO: 98601 - DNA, 36 bp, Artificial Sequence
  Synthetic oligonucleotide
atggaaggcggtagggtaggtagagccgaatgagca

SEQ ID NO: 98602 - DNA, 36 bp, Artificial Sequence
  Synthetic oligonucleotide
acagtcgacagtgttgttattttaccccgcgcatca

SEQ ID NO: 98603 - DNA, 35 bp, Artificial Sequence
  Synthetic oligonucleotide
actcgtgcgaacggcctcctcatacccgcagatca

SEQ ID NO: 98604 - DNA, 36 bp, Artificial Sequence
  Synthetic oligonucleotide
tgccaccctcgactagggctagtagcatggatctca

SEQ ID NO: 98605 - DNA, 36 bp, Artificial Sequence
  Synthetic oligonucleotide
ggtccatcccctcgagcaaccgagccagtttcaaga

SEQ ID NO: 98606 - DNA, 37 bp, Artificial Sequence
  Synthetic oligonucleotide
gacagggtggggggtacatgcgctagcgtgttacaga

SEQ ID NO: 98607 - DNA, 37 bp, Artificial Sequence
  Synthetic oligonucleotide
gatgaggcatccatgcatacagcttactcactcgaga

SEQ ID NO: 98608 - DNA, 37 bp, Artificial Sequence
  Synthetic oligonucleotide
gatgcaatgcagatctgtgggactattttgtgtgaga

SEQ ID NO: 98609 - DNA, 37 bp, Artificial Sequence
  Synthetic oligonucleotide
tagcgcagacgacggagtagggggggtagctcataga

SEQ ID NO: 98610 - DNA, 36 bp, Artificial Sequence
  Synthetic oligonucleotide
tcaaacgcacaccccttctagcagtcaacccctaga

SEQ ID NO: 98611 - DNA, 37 bp, Artificial Sequence
  Synthetic oligonucleotide
gaaggggcaaaccgtaacacgaggtacagtggaacga

SEQ ID NO: 98612 - DNA, 37 bp, Artificial Sequence
  Synthetic oligonucleotide
tatggtcgatcctgtaacgacatggactatgccccga

SEQ ID NO: 98613 - DNA, 37 bp, Artificial Sequence
  Synthetic oligonucleotide
gagacgtagatgggggggaggtattatcacctggcga

SEQ ID NO: 98614 - DNA, 37 bp, Artificial Sequence
  Synthetic oligonucleotide
gctggcccgtccgtacaaatcccgccgcccacgtcga

SEQ ID NO: 98615 - DNA, 38 bp, Artificial Sequence
  Synthetic oligonucleotide
agcgacacggagggctctggggactaatgattggtcga

SEQ ID NO: 98616 - DNA, 37 bp, Artificial Sequence
  Synthetic oligonucleotide
gaccattgcagctgcaccttcagagtctcatcttcga

SEQ ID NO: 98617 - DNA, 36 bp, Artificial Sequence
  Synthetic oligonucleotide
gcatatcggcgatcccatctcgtgccctgtcgagga

SEQ ID NO: 98618 - DNA, 37 bp, Artificial Sequence
  Synthetic oligonucleotide
tgagtacgaactgtagatgtattgcttagcacaggga

SEQ ID NO: 98619 - DNA, 37 bp, Artificial Sequence
  Synthetic oligonucleotide
tagtcaggcaggggggtgacaaaaatgagtgtcggga

SEQ ID NO: 98620 - DNA, 37 bp, Artificial Sequence
  Synthetic oligonucleotide
gaaatgccgccggaaggtagtgtaggtaccggtggga

SEQ ID NO: 98621 - DNA, 37 bp, Artificial Sequence
  Synthetic oligonucleotide
gccaccggtatagggggagagagatgacacaccatga

SEQ ID NO: 98622 - DNA, 38 bp, Artificial Sequence
  Synthetic oligonucleotide
atcgatcatcgagtggggtgtgtgcgcggggaaagtga

SEQ ID NO: 98623 - DNA, 38 bp, Artificial Sequence
  Synthetic oligonucleotide
gaacaggtaggaagtacatgggaagttggccatagtga

SEQ ID NO: 98624 - DNA, 37 bp, Artificial Sequence
  Synthetic oligonucleotide
aatgactgcacatcaacagcagggattgatttcgtga

SEQ ID NO: 98625 - DNA, 38 bp, Artificial Sequence
  Synthetic oligonucleotide
atgatgcgctccaagcctgttctagaatccgaatgtga

SEQ ID NO: 98626 - DNA, 38 bp, Artificial Sequence
  Synthetic oligonucleotide
gttagcgagggtgtaagggtttgcggctagggatgtga

SEQ ID NO: 98627 - DNA, 38 bp, Artificial Sequence
  Synthetic oligonucleotide
aacagctgagcgcgataacgatcttcccatctctgtga

SEQ ID NO: 98628 - DNA, 38 bp, Artificial Sequence
  Synthetic oligonucleotide
agtgtgccaaaggggtgggaaagtgacctacgccttga

SEQ ID NO: 98629 - DNA, 38 bp, Artificial Sequence
  Synthetic oligonucleotide
tgcgccccacaatgatccacggacctaactaatgttga

SEQ ID NO: 98630 - DNA, 35 bp, Artificial Sequence
  Synthetic oligonucleotide
tagatgcgcgtacagggaccgaggtgacgtggata

SEQ ID NO: 98631 - DNA, 35 bp, Artificial Sequence
  Synthetic oligonucleotide
aattgcaccacctacttagcgctctaagaccttta

SEQ ID NO: 98632 - DNA, 36 bp, Artificial Sequence
  Synthetic oligonucleotide
gatgctgcaccctagtccgctgttgcgcttgcttta

SEQ ID NO: 98633 - DNA, 35 bp, Artificial Sequence
  Synthetic oligonucleotide
tcaacgccgatgttcttgtttgcacgcgtaccaac

SEQ ID NO: 98634 - DNA, 35 bp, Artificial Sequence
  Synthetic oligonucleotide
gtgccccgccaccactttctggcctacggttccac

SEQ ID NO: 98635 - DNA, 35 bp, Artificial Sequence
  Synthetic oligonucleotide
atcgccgctggccgtatttcatttgccgccatcac

SEQ ID NO: 98636 - DNA, 35 bp, Artificial Sequence
  Synthetic oligonucleotide
tacgcaacgcgtgcttttttaaaacgtgtgacccc

SEQ ID NO: 98637 - DNA, 35 bp, Artificial Sequence
  Synthetic oligonucleotide
atcgtagggtcgccgcgcgtaagcaccagtccccc

SEQ ID NO: 98638 - DNA, 35 bp, Artificial Sequence
  Synthetic oligonucleotide
tacacgtcggatccctctgtgcgttccattccccc

SEQ ID NO: 98639 - DNA, 36 bp, Artificial Sequence
  Synthetic oligonucleotide
gacacatccgccgtaaacgtgtctcgcgtgatcccc

SEQ ID NO: 98640 - DNA, 35 bp, Artificial Sequence
  Synthetic oligonucleotide
gcaagaactgctgaagggggggagacggatcttcc

SEQ ID NO: 98641 - DNA, 35 bp, Artificial Sequence
  Synthetic oligonucleotide
tatgcaccgtgcagtacagcggattcccctaaagc

SEQ ID NO: 98642 - DNA, 35 bp, Artificial Sequence
  Synthetic oligonucleotide
gatcaccctcagattatactccgccctcctgccgc

SEQ ID NO: 98643 - DNA, 35 bp, Artificial Sequence
  Synthetic oligonucleotide
taaccacgcaccgccgccccatgagctacactatc

SEQ ID NO: 98644 - DNA, 35 bp, Artificial Sequence
  Synthetic oligonucleotide
tagacactgacgggagttaacacaaactcggcctc

SEQ ID NO: 98645 - DNA, 35 bp, Artificial Sequence
  Synthetic oligonucleotide
gacctgaccaggcatgatctgcactctcctacttc

SEQ ID NO: 98646 - DNA, 35 bp, Artificial Sequence
  Synthetic oligonucleotide
agccacctgttagaccactccccacccacttgtag

SEQ ID NO: 98647 - DNA, 35 bp, Artificial Sequence
  Synthetic oligonucleotide
agataaggggccacaaactatatatggtgacggcg

SEQ ID NO: 98648 - DNA, 36 bp, Artificial Sequence
  Synthetic oligonucleotide
gtgacgcggtacaatgttcacgttttgggcgggggg

SEQ ID NO: 98649 - DNA, 35 bp, Artificial Sequence
  Synthetic oligonucleotide
gactgagacggggtggcgttggtcttgcatagctg

SEQ ID NO: 98650 - DNA, 35 bp, Artificial Sequence
  Synthetic oligonucleotide
gacaacacgccccgaagtgtggtagggctgatttg

SEQ ID NO: 98651 - DNA, 35 bp, Artificial Sequence
  Synthetic oligonucleotide
gcctcaggcggtcgttatcctccagccatgcaaat

SEQ ID NO: 98652 - DNA, 35 bp, Artificial Sequence
  Synthetic oligonucleotide
acgttacgtcgccgcccgatacccgctgcctgtat

SEQ ID NO: 98653 - DNA, 35 bp, Artificial Sequence
  Synthetic oligonucleotide
accaactcgttgcatcttagcggatcctgccgcct

SEQ ID NO: 98654 - DNA, 34 bp, Artificial Sequence
  Synthetic oligonucleotide
gcgaatgcgaccacttgtaattatgcccttcgct

SEQ ID NO: 98655 - DNA, 35 bp, Artificial Sequence
  Synthetic oligonucleotide
tacccggaccgccgctgcctcatcagttctcgtgt

SEQ ID NO: 98656 - DNA, 35 bp, Artificial Sequence
  Synthetic oligonucleotide
tgcaaggtctcgacctgtcctaaccacccggcctt

SEQ ID NO: 98657 - DNA, 36 bp, Artificial Sequence
  Synthetic oligonucleotide
gccatgagttggtgggtggagggattagggtttaaa

SEQ ID NO: 98658 - DNA, 36 bp, Artificial Sequence
  Synthetic oligonucleotide
tgctcctgccgccgatcgttcccatctgcagcccaa

SEQ ID NO: 98659 - DNA, 35 bp, Artificial Sequence
  Synthetic oligonucleotide
ttataccgcgcatcactatcacctaggcacgggaa

SEQ ID NO: 98660 - DNA, 36 bp, Artificial Sequence
  Synthetic oligonucleotide
gtcgcacgcccgttctgtcataaatttcccctataa

SEQ ID NO: 98661 - DNA, 36 bp, Artificial Sequence
  Synthetic oligonucleotide
gactcgtgcggctgtcttggcctactgaacttctaa

SEQ ID NO: 98662 - DNA, 36 bp, Artificial Sequence
  Synthetic oligonucleotide
tacgccactcggaggtcgtcctcgccatattattaa

SEQ ID NO: 98663 - DNA, 35 bp, Artificial Sequence
  Synthetic oligonucleotide
acatgccagtcgatactattcgacagcctccgaca

SEQ ID NO: 98664 - DNA, 36 bp, Artificial Sequence
  Synthetic oligonucleotide
gtaacccgtctgtgcgcgctcatcctctgtttgaca

SEQ ID NO: 98665 - DNA, 36 bp, Artificial Sequence
  Synthetic oligonucleotide
tgtcaaccgacgacagctaagcacacacatcgtaca

SEQ ID NO: 98666 - DNA, 36 bp, Artificial Sequence
  Synthetic oligonucleotide
aagtgtgcgcatcgtgacattcgattcccgttccca

SEQ ID NO: 98667 - DNA, 36 bp, Artificial Sequence
  Synthetic oligonucleotide
gtcacctgtctcctgtcaaatggtccgatttatcca

SEQ ID NO: 98668 - DNA, 35 bp, Artificial Sequence
  Synthetic oligonucleotide
atacgaaacatcccggtcctgtgctatccttgtca

SEQ ID NO: 98669 - DNA, 37 bp, Artificial Sequence
  Synthetic oligonucleotide
atgagcggccgacaggtactagtagcgggaaaaaaga

SEQ ID NO: 98670 - DNA, 37 bp, Artificial Sequence
  Synthetic oligonucleotide
acacaggcgtgggggtatgacaaagggtggcaggaga

SEQ ID NO: 98671 - DNA, 37 bp, Artificial Sequence
  Synthetic oligonucleotide
tgacggagcagtactgtcgagaaggatggtaagtaga

SEQ ID NO: 98672 - DNA, 35 bp, Artificial Sequence
  Synthetic oligonucleotide
gaatagtgccgtgcgaatgagaaatgcggcaacga

SEQ ID NO: 98673 - DNA, 36 bp, Artificial Sequence
  Synthetic oligonucleotide
gcctgatcagacatttgcgtacactggtacttccga

SEQ ID NO: 98674 - DNA, 36 bp, Artificial Sequence
  Synthetic oligonucleotide
taacagcaaccatgcgtgcgattcggttttcatcga

SEQ ID NO: 98675 - DNA, 36 bp, Artificial Sequence
  Synthetic oligonucleotide
gaagggaagggaggttttggccagggttaatgtcga

SEQ ID NO: 98676 - DNA, 37 bp, Artificial Sequence
  Synthetic oligonucleotide
gaggacaaacggctggaatgcaaacgtcactgttcga

SEQ ID NO: 98677 - DNA, 37 bp, Artificial Sequence
  Synthetic oligonucleotide
gtcacgcaaacacgagaaagaacacaagcacgaagga

SEQ ID NO: 98678 - DNA, 36 bp, Artificial Sequence
  Synthetic oligonucleotide
tacgcctgaccacaagctcgataggacgacgcagga

SEQ ID NO: 98679 - DNA, 37 bp, Artificial Sequence
  Synthetic oligonucleotide
tgcgaaggtgagaaccgtgttggaggcggacttagga

SEQ ID NO: 98680 - DNA, 37 bp, Artificial Sequence
  Synthetic oligonucleotide
gaggtgaccggcagatcaggacagggaaggtttagga

SEQ ID NO: 98681 - DNA, 37 bp, Artificial Sequence
  Synthetic oligonucleotide
tagatggaggggcacggttattgggacgtttttcgga

SEQ ID NO: 98682 - DNA, 36 bp, Artificial Sequence
  Synthetic oligonucleotide
gcatggagggaggacgtactggtgcctggtcaggga

SEQ ID NO: 98683 - DNA, 36 bp, Artificial Sequence
  Synthetic oligonucleotide
tactggaccgattgctaggctaatctcggataggga

SEQ ID NO: 98684 - DNA, 37 bp, Artificial Sequence
  Synthetic oligonucleotide
tgagagcagaactgaactgtggggaaaggagggggga

SEQ ID NO: 98685 - DNA, 37 bp, Artificial Sequence
  Synthetic oligonucleotide
gacgagggaagttggaggtcggatttggcccgttgga

SEQ ID NO: 98686 - DNA, 37 bp, Artificial Sequence
  Synthetic oligonucleotide
tactgcctccctgtacgctattcatggtgatgaatga

SEQ ID NO: 98687 - DNA, 38 bp, Artificial Sequence
  Synthetic oligonucleotide
tgaccctcagcagcctttagaaccgctacttcgtatga

SEQ ID NO: 98688 - DNA, 38 bp, Artificial Sequence
  Synthetic oligonucleotide
atgcctcgcgaccatgtctacacgatgtcctgctctga

SEQ ID NO: 98689 - DNA, 38 bp, Artificial Sequence
  Synthetic oligonucleotide
aatgaacgggcagatggggggaggtgaaaatggagtga

SEQ ID NO: 98690 - DNA, 38 bp, Artificial Sequence
  Synthetic oligonucleotide
gcgatcgccactacttactaagacgcgtcactaattga

SEQ ID NO: 98691 - DNA, 38 bp, Artificial Sequence
  Synthetic oligonucleotide
gcggagggggcgcacgggagaaggagactggcgattga

SEQ ID NO: 98692 - DNA, 38 bp, Artificial Sequence
  Synthetic oligonucleotide
gtcgcacgcctgcactgaatcttcactgtcgaacttga

SEQ ID NO: 98693 - DNA, 36 bp, Artificial Sequence
  Synthetic oligonucleotide
gacacgttggagtagccccatgtagtccatccttga

SEQ ID NO: 98694 - DNA, 37 bp, Artificial Sequence
  Synthetic oligonucleotide
gttgcacccgcaacggtttacagtcattcagcgttga

SEQ ID NO: 98695 - DNA, 36 bp, Artificial Sequence
  Synthetic oligonucleotide
gtcacgcggcagtcaatctgtccggctctacgaata

SEQ ID NO: 98696 - DNA, 36 bp, Artificial Sequence
  Synthetic oligonucleotide
acgccccatagcctattcgacattcgctgcacgata

SEQ ID NO: 98697 - DNA, 34 bp, Artificial Sequence
  Synthetic oligonucleotide
atgtccgccccgcgcatgtgatggctaatcccta

SEQ ID NO: 98698 - DNA, 36 bp, Artificial Sequence
  Synthetic oligonucleotide
atcgagtcgcgccacgtttttgcgtgcacttgccta

SEQ ID NO: 98699 - DNA, 35 bp, Artificial Sequence
  Synthetic oligonucleotide
actcacatcgccattgcttctccgcgattatatta

SEQ ID NO: 98700 - DNA, 36 bp, Artificial Sequence
  Synthetic oligonucleotide
atatgcaggggcctgcgtgtcactcacctccattta

SEQ ID NO: 98701 - DNA, 35 bp, Artificial Sequence
  Synthetic oligonucleotide
accaccctccgagcctcgttctgtccgttgttaac

SEQ ID NO: 98702 - DNA, 35 bp, Artificial Sequence
  Synthetic oligonucleotide
tgacgtacaacaggctctatacacgagggttatcc

SEQ ID NO: 98703 - DNA, 35 bp, Artificial Sequence
  Synthetic oligonucleotide
aagcgcaggacaacattgtagtacacacagagcgc

SEQ ID NO: 98704 - DNA, 35 bp, Artificial Sequence
  Synthetic oligonucleotide
gacaccgacgccccttagaactgccaccctagcgc

SEQ ID NO: 98705 - DNA, 35 bp, Artificial Sequence
  Synthetic oligonucleotide
taccctgccacaacagtcggaagaagtgttcgctc

SEQ ID NO: 98706 - DNA, 35 bp, Artificial Sequence
  Synthetic oligonucleotide
atacatgcagtgttgtctccccgtcgaagatcttc

SEQ ID NO: 98707 - DNA, 36 bp, Artificial Sequence
  Synthetic oligonucleotide
ttgccatcagaacggtaaccgtgtactctgctcttc

SEQ ID NO: 98708 - DNA, 35 bp, Artificial Sequence
  Synthetic oligonucleotide
gagcctacaacagctcgcactcacgccttatccag

SEQ ID NO: 98709 - DNA, 35 bp, Artificial Sequence
  Synthetic oligonucleotide
gtttggtgcggaagttagaggaacatgtcattgcg

SEQ ID NO: 98710 - DNA, 35 bp, Artificial Sequence
  Synthetic oligonucleotide
caccctcgcccctttttgacattgctgtttattcg

SEQ ID NO: 98711 - DNA, 35 bp, Artificial Sequence
  Synthetic oligonucleotide
ttatgcatagctgggaaagagaaatggataggggg

SEQ ID NO: 98712 - DNA, 35 bp, Artificial Sequence
  Synthetic oligonucleotide
tgccacctgcaatgcgctgatattccatcgagtgg

SEQ ID NO: 98713 - DNA, 35 bp, Artificial Sequence
  Synthetic oligonucleotide
gagcgagagatgagtgaatggaggtggtcgggctg

SEQ ID NO: 98714 - DNA, 35 bp, Artificial Sequence
  Synthetic oligonucleotide
acagtgcgactatgatagcatatggaatgaatgtg

SEQ ID NO: 98715 - DNA, 35 bp, Artificial Sequence
  Synthetic oligonucleotide
actgccgggaatgctgaaaaagttggtacggtttg

SEQ ID NO: 98716 - DNA, 35 bp, Artificial Sequence
  Synthetic oligonucleotide
gaagcgctgagaacagggggaagatatagggtcat

SEQ ID NO: 98717 - DNA, 35 bp, Artificial Sequence
  Synthetic oligonucleotide
ttgcagtccacatgcctatccaataggtctcgcct

SEQ ID NO: 98718 - DNA, 35 bp, Artificial Sequence
  Synthetic oligonucleotide
aacatcatgcccccgccttcaagtgacttgctcct

SEQ ID NO: 98719 - DNA, 35 bp, Artificial Sequence
  Synthetic oligonucleotide
gcaaccatagaggtcctaggtcacgactgcaggct

SEQ ID NO: 98720 - DNA, 35 bp, Artificial Sequence
  Synthetic oligonucleotide
gtgtgccaccagcagcatttttagtgaagaggtct

SEQ ID NO: 98721 - DNA, 35 bp, Artificial Sequence
  Synthetic oligonucleotide
gagagagagagatgtaagtgtaatcatggaagagt

SEQ ID NO: 98722 - DNA, 35 bp, Artificial Sequence
  Synthetic oligonucleotide
tgccgtacctcctgactcgttcattatatacagtt

SEQ ID NO: 98723 - DNA, 36 bp, Artificial Sequence
  Synthetic oligonucleotide
taacatgcagagcgggtatggggagtgggccaggaa

SEQ ID NO: 98724 - DNA, 36 bp, Artificial Sequence
  Synthetic oligonucleotide
gtcatacgcctccatctgccctcgactaagtgataa

SEQ ID NO: 98725 - DNA, 36 bp, Artificial Sequence
  Synthetic oligonucleotide
accaccccactcgctaaacacaccgacggtctataa

SEQ ID NO: 98726 - DNA, 35 bp, Artificial Sequence
  Synthetic oligonucleotide
aacctacctccagagtctgtcatttctgttcgtaa

SEQ ID NO: 98727 - DNA, 35 bp, Artificial Sequence
  Synthetic oligonucleotide
atcacagtcggttccacgggtacaagtgatcgaca

SEQ ID NO: 98728 - DNA, 36 bp, Artificial Sequence
  Synthetic oligonucleotide
gtacctgcctgtttgataataccacttcttgtgaca

SEQ ID NO: 98729 - DNA, 37 bp, Artificial Sequence
  Synthetic oligonucleotide
agtgccagcacaccgagatctaatccaccctgcccca

SEQ ID NO: 98730 - DNA, 36 bp, Artificial Sequence
  Synthetic oligonucleotide
gaccggtggggcagttaaatagtacgtacgtaagca

SEQ ID NO: 98731 - DNA, 34 bp, Artificial Sequence
  Synthetic oligonucleotide
tacgttggtcgtcaacgggcttcttaaccacgca

SEQ ID NO: 98732 - DNA, 35 bp, Artificial Sequence
  Synthetic oligonucleotide
tcaaaaccgctcagctctattgcaaaaacttgtca

SEQ ID NO: 98733 - DNA, 37 bp, Artificial Sequence
  Synthetic oligonucleotide
atgtaagggcggggtggccaagacgagcaagaaaaga

SEQ ID NO: 98734 - DNA, 35 bp, Artificial Sequence
  Synthetic oligonucleotide
tagcacaattgctgatggaggaacggtgtgacaga

SEQ ID NO: 98735 - DNA, 37 bp, Artificial Sequence
  Synthetic oligonucleotide
tcacaggaccagcgcgttaaccaaaattttgaccaga

SEQ ID NO: 98736 - DNA, 37 bp, Artificial Sequence
  Synthetic oligonucleotide
tgagccccatcgatatccaatactgtgctcaacgaga

SEQ ID NO: 98737 - DNA, 37 bp, Artificial Sequence
  Synthetic oligonucleotide
acactacgcggtagtgatgggcttctatttctcgaga

SEQ ID NO: 98738 - DNA, 37 bp, Artificial Sequence
  Synthetic oligonucleotide
tgtggtgtagcgtggggcaaagtaagaggtcgggaga

SEQ ID NO: 98739 - DNA, 36 bp, Artificial Sequence
  Synthetic oligonucleotide
gtctgctcaaatccgcaacggcccactgacttgaga

SEQ ID NO: 98740 - DNA, 36 bp, Artificial Sequence
  Synthetic oligonucleotide
gatgagggggaggtatgggtaatcacgtttacacga

SEQ ID NO: 98741 - DNA, 36 bp, Artificial Sequence
  Synthetic oligonucleotide
gttgaaggctcacaggagtaccgcccatctcatcga

SEQ ID NO: 98742 - DNA, 37 bp, Artificial Sequence
  Synthetic oligonucleotide
tagttaaccgaaggagatgcctcagagactgggcgga

SEQ ID NO: 98743 - DNA, 37 bp, Artificial Sequence
  Synthetic oligonucleotide
gtgaccgccgcaggacggttgagagatggaggtcgga

SEQ ID NO: 98744 - DNA, 37 bp, Artificial Sequence
  Synthetic oligonucleotide
aagtgggagggtgagagggactggtggacaacgggga

SEQ ID NO: 98745 - DNA, 37 bp, Artificial Sequence
  Synthetic oligonucleotide
gccaaggtagaatgcggacgggatgatgccccgggga

SEQ ID NO: 98746 - DNA, 37 bp, Artificial Sequence
  Synthetic oligonucleotide
aagactgccacatctggttggttgcctctattatgga

SEQ ID NO: 98747 - DNA, 38 bp, Artificial Sequence
  Synthetic oligonucleotide
tagcatggcgaaggaaaactgggtggtggtgtgaatga

SEQ ID NO: 98748 - DNA, 38 bp, Artificial Sequence
  Synthetic oligonucleotide
gatgcgaggtgactgatatgtgtaaagggttgtaatga

SEQ ID NO: 98749 - DNA, 36 bp, Artificial Sequence
  Synthetic oligonucleotide
tacacccgtaggagctacgtgacagaccaggagtga

SEQ ID NO: 98750 - DNA, 38 bp, Artificial Sequence
  Synthetic oligonucleotide
tgcaccgcacggagtaaccaatctaccgcttaccgtga

SEQ ID NO: 98751 - DNA, 38 bp, Artificial Sequence
  Synthetic oligonucleotide
tccgaacggcaggtgacctacaagacgggaggcggtga

SEQ ID NO: 98752 - DNA, 38 bp, Artificial Sequence
  Synthetic oligonucleotide
gaagcatgcccgcggtgtagcatttagcctgttggtga

SEQ ID NO: 98753 - DNA, 38 bp, Artificial Sequence
  Synthetic oligonucleotide
atgcggagagacaaggcggttgagacgggcgactgtga

SEQ ID NO: 98754 - DNA, 38 bp, Artificial Sequence
  Synthetic oligonucleotide
aatgcacggtcacctggcgtgcggacctccccctgtga

SEQ ID NO: 98755 - DNA, 38 bp, Artificial Sequence
  Synthetic oligonucleotide
gtgtggcgcacatgaccagaggagctggcattcattga

SEQ ID NO: 98756 - DNA, 38 bp, Artificial Sequence
  Synthetic oligonucleotide
aacgcaggccagtctgcttaaccctagtgctttattga

SEQ ID NO: 98757 - DNA, 38 bp, Artificial Sequence
  Synthetic oligonucleotide
atgcgagaccacatcgagtgctatacgaaaacggttga

SEQ ID NO: 98758 - DNA, 37 bp, Artificial Sequence
  Synthetic oligonucleotide
atgcggagggtaggatcatggtgagcgtagttgttga

SEQ ID NO: 98759 - DNA, 37 bp, Artificial Sequence
  Synthetic oligonucleotide
gggacgtgcgccattgtccaattcgtgcttattttga

SEQ ID NO: 98760 - DNA, 35 bp, Artificial Sequence
  Synthetic oligonucleotide
aacgtgcgagaacgacaagggaacgcatacgcata

SEQ ID NO: 98761 - DNA, 35 bp, Artificial Sequence
  Synthetic oligonucleotide
aaagccaaagggagggtagacttggagacacgata

SEQ ID NO: 98762 - DNA, 35 bp, Artificial Sequence
  Synthetic oligonucleotide
tgcgaggacacggtggttgggagaatggggtgata

SEQ ID NO: 98763 - DNA, 36 bp, Artificial Sequence
  Synthetic oligonucleotide
agcatcgcatgccattacctgagccaccgttatcta

SEQ ID NO: 98764 - DNA, 35 bp, Artificial Sequence
  Synthetic oligonucleotide
acacgtgtcgacaaggtgtctaagacaggttagta

SEQ ID NO: 98765 - DNA, 36 bp, Artificial Sequence
  Synthetic oligonucleotide
tcactacgcaagtatcggggggtgcatactgaggta

SEQ ID NO: 98766 - DNA, 36 bp, Artificial Sequence
  Synthetic oligonucleotide
tgtacgccaatacccatcgcgctggtactcccgtta

SEQ ID NO: 98767 - DNA, 35 bp, Artificial Sequence
  Synthetic oligonucleotide
gcctcaatcacatgcgctaatggcgagtggtgaac

SEQ ID NO: 98768 - DNA, 35 bp, Artificial Sequence
  Synthetic oligonucleotide
acgcgagggacgttttatctgtggcttgcaatcac

SEQ ID NO: 98769 - DNA, 35 bp, Artificial Sequence
  Synthetic oligonucleotide
tactaacgcagttttagccacgaggcctccatgac

SEQ ID NO: 98770 - DNA, 35 bp, Artificial Sequence
  Synthetic oligonucleotide
actgcccgacgcactttttacagtacccctatgac

SEQ ID NO: 98771 - DNA, 35 bp, Artificial Sequence
  Synthetic oligonucleotide
tttcacgctgccttgttcatagatgccaatcgtac

SEQ ID NO: 98772 - DNA, 35 bp, Artificial Sequence
  Synthetic oligonucleotide
ttgtcagtcgcagaactgcctttccctgtttgtac

SEQ ID NO: 98773 - DNA, 35 bp, Artificial Sequence
  Synthetic oligonucleotide
ttcgagcctgtgatcgcatacgtgcagttccgacc

SEQ ID NO: 98774 - DNA, 35 bp, Artificial Sequence
  Synthetic oligonucleotide
acatcccgatccgttagtgactcactgctggcgcc

SEQ ID NO: 98775 - DNA, 35 bp, Artificial Sequence
  Synthetic oligonucleotide
accaatgcagggtgttggtgagtttatagggctgc

SEQ ID NO: 98776 - DNA, 35 bp, Artificial Sequence
  Synthetic oligonucleotide
tgacgtcgatgcgcgagttccattaagtggtttgc

SEQ ID NO: 98777 - DNA, 35 bp, Artificial Sequence
  Synthetic oligonucleotide
taagcctgcacaatgtcctcctatgtggtcttatc

SEQ ID NO: 98778 - DNA, 35 bp, Artificial Sequence
  Synthetic oligonucleotide
actcacggttccattcggtttagggtttacatttc

SEQ ID NO: 98779 - DNA, 35 bp, Artificial Sequence
  Synthetic oligonucleotide
atgtacgtgggcaatagtactagagggtaaggaag

SEQ ID NO: 98780 - DNA, 36 bp, Artificial Sequence
  Synthetic oligonucleotide
ggggacaacgaggaggatggttgactaggtggcacg

SEQ ID NO: 98781 - DNA, 35 bp, Artificial Sequence
  Synthetic oligonucleotide
aaagaggaaagagcgctaagggggacactgaaagg

SEQ ID NO: 98782 - DNA, 35 bp, Artificial Sequence
  Synthetic oligonucleotide
ttacgcctttccgacgatcttcctcgaactccctg

SEQ ID NO: 98783 - DNA, 35 bp, Artificial Sequence
  Synthetic oligonucleotide
gcaacaacgccccaagaatgattagggaaggtgtg

SEQ ID NO: 98784 - DNA, 35 bp, Artificial Sequence
  Synthetic oligonucleotide
gctgaagccgaatgagtatcgaaggctttatgtat

SEQ ID NO: 98785 - DNA, 35 bp, Artificial Sequence
  Synthetic oligonucleotide
gcctgcggtagcagaaaaacaggacaaatggtgct

SEQ ID NO: 98786 - DNA, 35 bp, Artificial Sequence
  Synthetic oligonucleotide
tatctcgacacagtgcgaaaatgaccacttgctct

SEQ ID NO: 98787 - DNA, 35 bp, Artificial Sequence
  Synthetic oligonucleotide
tagtacgcagggttagggtactcgcaataaatagt

SEQ ID NO: 98788 - DNA, 35 bp, Artificial Sequence
  Synthetic oligonucleotide
tagggagcatgggtaggaaataaccacaaaacaaa

SEQ ID NO: 98789 - DNA, 36 bp, Artificial Sequence
  Synthetic oligonucleotide
gatgatcgaaaggggggagagtataggacgcactaa

SEQ ID NO: 98790 - DNA, 36 bp, Artificial Sequence
  Synthetic oligonucleotide
gcaacccactgtagttactccatcccctgtgggtaa

SEQ ID NO: 98791 - DNA, 36 bp, Artificial Sequence
  Synthetic oligonucleotide
acgtgaggcgcaaaaatgagataaaggtggttgtaa

SEQ ID NO: 98792 - DNA, 36 bp, Artificial Sequence
  Synthetic oligonucleotide
gtccacagccacaccttgtacttaacaggctattaa

SEQ ID NO: 98793 - DNA, 36 bp, Artificial Sequence
  Synthetic oligonucleotide
ttgtggccggagggggaaatagtatgcatgcgttaa

SEQ ID NO: 98794 - DNA, 36 bp, Artificial Sequence
  Synthetic oligonucleotide
tcgacgtccatcgccgccatcctctctgtctagaca

SEQ ID NO: 98795 - DNA, 35 bp, Artificial Sequence
  Synthetic oligonucleotide
gataccacccttacagatcgtcgaggctcgcccca

SEQ ID NO: 98796 - DNA, 36 bp, Artificial Sequence
  Synthetic oligonucleotide
gtaacacgcatggtgaactcctatggacctttggca

SEQ ID NO: 98797 - DNA, 36 bp, Artificial Sequence
  Synthetic oligonucleotide
atctccgcccccgttcgatctttccgcctgtcttca

SEQ ID NO: 98798 - DNA, 35 bp, Artificial Sequence
  Synthetic oligonucleotide
gtgaacgctgggggcaacgaagcagttattgaaga

SEQ ID NO: 98799 - DNA, 37 bp, Artificial Sequence
  Synthetic oligonucleotide
acccgcaccggcttggccgaactttgctctaccgaga

SEQ ID NO: 98800 - DNA, 37 bp, Artificial Sequence
  Synthetic oligonucleotide
atgttgcaaggaagcaaagggggattgacagtggaga

SEQ ID NO: 98801 - DNA, 37 bp, Artificial Sequence
  Synthetic oligonucleotide
aacgaagggggccgcacaggaaggtaaaatgtataga

SEQ ID NO: 98802 - DNA, 36 bp, Artificial Sequence
  Synthetic oligonucleotide
gtgacctcacatcctacgtggtatagcactacacga

SEQ ID NO: 98803 - DNA, 37 bp, Artificial Sequence
  Synthetic oligonucleotide
aacgcccaatgcgtttgggccagtctcggtaccacga

SEQ ID NO: 98804 - DNA, 37 bp, Artificial Sequence
  Synthetic oligonucleotide
cacagaacatcagccctggtcgcaagtaagagcacga

SEQ ID NO: 98805 - DNA, 36 bp, Artificial Sequence
  Synthetic oligonucleotide
tggaatgccacttcgaaaatgacccatcgtaaccga

SEQ ID NO: 98806 - DNA, 37 bp, Artificial Sequence
  Synthetic oligonucleotide
aacgacaagttcacacagtccctgccacttctagcga

SEQ ID NO: 98807 - DNA, 37 bp, Artificial Sequence
  Synthetic oligonucleotide
gtggatgaatgtgtagggggggacaaacaatgcgcga

SEQ ID NO: 98808 - DNA, 37 bp, Artificial Sequence
  Synthetic oligonucleotide
gtccattcgccggtattacccttaggagcattcgcga

SEQ ID NO: 98809 - DNA, 37 bp, Artificial Sequence
  Synthetic oligonucleotide
gtcaagccccccgagcgaagtttcatctacagtgcga

SEQ ID NO: 98810 - DNA, 36 bp, Artificial Sequence
  Synthetic oligonucleotide
acagacggaaaaagggataaggctcggtggcaagga

SEQ ID NO: 98811 - DNA, 37 bp, Artificial Sequence
  Synthetic oligonucleotide
gtagcgcaaaggaatcgaaaaagaggaggggacagga

SEQ ID NO: 98812 - DNA, 37 bp, Artificial Sequence
  Synthetic oligonucleotide
aatggagccgcccgcgacaaggacagtgtttgtagga

SEQ ID NO: 98813 - DNA, 37 bp, Artificial Sequence
  Synthetic oligonucleotide
tcgaccgatccatgcagtcttaaagtctaccaccgga

SEQ ID NO: 98814 - DNA, 35 bp, Artificial Sequence
  Synthetic oligonucleotide
taacgagaacgaacaagtatagagcgcggtaggga

SEQ ID NO: 98815 - DNA, 37 bp, Artificial Sequence
  Synthetic oligonucleotide
gacacggatgctggtcgtaaggggcgtcaaaagggga

SEQ ID NO: 98816 - DNA, 36 bp, Artificial Sequence
  Synthetic oligonucleotide
gtgaagacgaaaaagcgagacaatgttcgcgatgga

SEQ ID NO: 98817 - DNA, 36 bp, Artificial Sequence
  Synthetic oligonucleotide
aattagagccgaggacagtaaaagcggaagtatgga

SEQ ID NO: 98818 - DNA, 38 bp, Artificial Sequence
  Synthetic oligonucleotide
accgagagacgggaggtagtctaaaatgacccaaatga

SEQ ID NO: 98819 - DNA, 35 bp, Artificial Sequence
  Synthetic oligonucleotide
atcacgcgcaacggaattcacggatgcacgaatga

SEQ ID NO: 98820 - DNA, 38 bp, Artificial Sequence
  Synthetic oligonucleotide
gagtgggaagggtgtccgaatgtaagggtgagacatga

SEQ ID NO: 98821 - DNA, 37 bp, Artificial Sequence
  Synthetic oligonucleotide
tccacatacccccactgtagattgtgacccccgatga

SEQ ID NO: 98822 - DNA, 37 bp, Artificial Sequence
  Synthetic oligonucleotide
tgtcccgcccccagcctatcacttatacacgcactga

SEQ ID NO: 98823 - DNA, 36 bp, Artificial Sequence
  Synthetic oligonucleotide
tgagactgccgaagtgatcgtgcatatgctcactga

SEQ ID NO: 98824 - DNA, 37 bp, Artificial Sequence
  Synthetic oligonucleotide
aaccgccgtaacgtacatgcacgctccttgaccctga

SEQ ID NO: 98825 - DNA, 38 bp, Artificial Sequence
  Synthetic oligonucleotide
aaccacaacctggcccccgttatttatcagtcctctga

SEQ ID NO: 98826 - DNA, 38 bp, Artificial Sequence
  Synthetic oligonucleotide
ggaccgaagagggaatgtagctggggtaatgacggtga

SEQ ID NO: 98827 - DNA, 38 bp, Artificial Sequence
  Synthetic oligonucleotide
gaggggtgcaggagcaaagcaagagcagacagatgtga

SEQ ID NO: 98828 - DNA, 38 bp, Artificial Sequence
  Synthetic oligonucleotide
tcatcccgctcgacagaccccaagaggagacagattga

SEQ ID NO: 98829 - DNA, 38 bp, Artificial Sequence
  Synthetic oligonucleotide
gtgggcggctcatgtctatccccttcgctgcctattga

SEQ ID NO: 98830 - DNA, 38 bp, Artificial Sequence
  Synthetic oligonucleotide
gtcgaccccctcaatgagatacaggacaatctgtttga

SEQ ID NO: 98831 - DNA, 36 bp, Artificial Sequence
  Synthetic oligonucleotide
gtcaagctgctggccttgattaggttcttactgata

SEQ ID NO: 98832 - DNA, 35 bp, Artificial Sequence
  Synthetic oligonucleotide
gcctgctctctccctctagctacggactcctccta

SEQ ID NO: 98833 - DNA, 36 bp, Artificial Sequence
  Synthetic oligonucleotide
tgtggaagtgagcgatggggtgggcagtatttgcta

SEQ ID NO: 98834 - DNA, 35 bp, Artificial Sequence
  Synthetic oligonucleotide
aacgtccctagctggtgcattttgccgaactcgta

SEQ ID NO: 98835 - DNA, 35 bp, Artificial Sequence
  Synthetic oligonucleotide
tacagcccacgcatgtcacccaactgtccaatgta

SEQ ID NO: 98836 - DNA, 36 bp, Artificial Sequence
  Synthetic oligonucleotide
gacgcaatcctcgcgtcatgcgacggtccctgatta

SEQ ID NO: 98837 - DNA, 35 bp, Artificial Sequence
  Synthetic oligonucleotide
atacgccgcgacctagcatcacggctcttccacac

SEQ ID NO: 98838 - DNA, 35 bp, Artificial Sequence
  Synthetic oligonucleotide
tgaccccgggagtccatcgctattgtcccacccac

SEQ ID NO: 98839 - DNA, 35 bp, Artificial Sequence
  Synthetic oligonucleotide
aaataccacctgttcctctgaggtcattagcgacc

SEQ ID NO: 98840 - DNA, 35 bp, Artificial Sequence
  Synthetic oligonucleotide
ttagagccacgtcaacttcagcctatactgctccc

SEQ ID NO: 98841 - DNA, 35 bp, Artificial Sequence
  Synthetic oligonucleotide
tccagccgactagactttggtcgatacatcatgcc

SEQ ID NO: 98842 - DNA, 35 bp, Artificial Sequence
  Synthetic oligonucleotide
taccaaagagggtggaatgaggagtggaaatgtgc

SEQ ID NO: 98843 - DNA, 35 bp, Artificial Sequence
  Synthetic oligonucleotide
gaatacgaggcgcgcagggtaagaagtttgattgc

SEQ ID NO: 98844 - DNA, 35 bp, Artificial Sequence
  Synthetic oligonucleotide
tagtacggcacaaaacgtaagtccactagcgagtc

SEQ ID NO: 98845 - DNA, 35 bp, Artificial Sequence
  Synthetic oligonucleotide
gcccttgaccaactccctacctgcacgatgtagtc

SEQ ID NO: 98846 - DNA, 35 bp, Artificial Sequence
  Synthetic oligonucleotide
tatgtgcgatcgttccatctctatacgatcacttc

SEQ ID NO: 98847 - DNA, 35 bp, Artificial Sequence
  Synthetic oligonucleotide
ttgagcgccgacacccatagaccagtaggtgacag

SEQ ID NO: 98848 - DNA, 35 bp, Artificial Sequence
  Synthetic oligonucleotide
gatggaggaggaggggtcgaggtggaagggtacag

SEQ ID NO: 98849 - DNA, 35 bp, Artificial Sequence
  Synthetic oligonucleotide
tgttaacgaggtggggaaaactgaaatcaaaagag

SEQ ID NO: 98850 - DNA, 35 bp, Artificial Sequence
  Synthetic oligonucleotide
atgcaaccctcagcttcccatatcggtgtgaaccg

SEQ ID NO: 98851 - DNA, 35 bp, Artificial Sequence
  Synthetic oligonucleotide
tactgccgcgaggtctatttaatgctccgtctccg

SEQ ID NO: 98852 - DNA, 35 bp, Artificial Sequence
  Synthetic oligonucleotide
actgcaccatcctgcgacataaacttatgtctatg

SEQ ID NO: 98853 - DNA, 35 bp, Artificial Sequence
  Synthetic oligonucleotide
tcagtaccgatgcaaccacccgccgcttcgccgtg

SEQ ID NO: 98854 - DNA, 35 bp, Artificial Sequence
  Synthetic oligonucleotide
gactcccaccaccaccgtgtttttatcgaggtaat

SEQ ID NO: 98855 - DNA, 35 bp, Artificial Sequence
  Synthetic oligonucleotide
ttgtgcccaattggtaataactttcacacgatgat

SEQ ID NO: 98856 - DNA, 35 bp, Artificial Sequence
  Synthetic oligonucleotide
ggactagggtccctccgtctgtatcgacctggcct

SEQ ID NO: 98857 - DNA, 35 bp, Artificial Sequence
  Synthetic oligonucleotide
gagggtcacggtcgaggggacgaggcaaaacaggt

SEQ ID NO: 98858 - DNA, 35 bp, Artificial Sequence
  Synthetic oligonucleotide
aagagcaaccggtattgggcaatggggaaggaggt

SEQ ID NO: 98859 - DNA, 35 bp, Artificial Sequence
  Synthetic oligonucleotide
gccacacgccggtataccaattttgatccttcggt

SEQ ID NO: 98860 - DNA, 35 bp, Artificial Sequence
  Synthetic oligonucleotide
gaaaagtgccgaggcgcacgtctaatccaaaaatt

SEQ ID NO: 98861 - DNA, 35 bp, Artificial Sequence
  Synthetic oligonucleotide
gtgcacccctttgtttgaatatccagcgaattctt

SEQ ID NO: 98862 - DNA, 36 bp, Artificial Sequence
  Synthetic oligonucleotide
aaactggcgcacatccatattctggctgactaccaa

SEQ ID NO: 98863 - DNA, 35 bp, Artificial Sequence
  Synthetic oligonucleotide
acctaccgccctgacatccagtggatccaatccaa

SEQ ID NO: 98864 - DNA, 36 bp, Artificial Sequence
  Synthetic oligonucleotide
gaccccaaagaaagcgtgagtcgaggcattgacgaa

SEQ ID NO: 98865 - DNA, 36 bp, Artificial Sequence
  Synthetic oligonucleotide
tcaggagggcactcgtagtcaaaagtaagtagtgaa

SEQ ID NO: 98866 - DNA, 36 bp, Artificial Sequence
  Synthetic oligonucleotide
tgagggagcacgaagatgggatgcggagggctgtaa

SEQ ID NO: 98867 - DNA, 36 bp, Artificial Sequence
  Synthetic oligonucleotide
gagcacaagcgggtgccctggaggaggcaggcaaca

SEQ ID NO: 98868 - DNA, 35 bp, Artificial Sequence
  Synthetic oligonucleotide
aactctgcgcagacggcacttgtcagccttcgaca

SEQ ID NO: 98869 - DNA, 36 bp, Artificial Sequence
  Synthetic oligonucleotide
tcatcgcacctactcacataagtgggattgaaacca

SEQ ID NO: 98870 - DNA, 36 bp, Artificial Sequence
  Synthetic oligonucleotide
atgacgaagccacatcgccatttgttgtgaaccgca

SEQ ID NO: 98871 - DNA, 36 bp, Artificial Sequence
  Synthetic oligonucleotide
tcacaaccagttgtaaaactacactccagcaccgca

SEQ ID NO: 98872 - DNA, 36 bp, Artificial Sequence
  Synthetic oligonucleotide
tctgatccagctcctcggtccacagtcgcactggca

SEQ ID NO: 98873 - DNA, 35 bp, Artificial Sequence
  Synthetic oligonucleotide
acaaccaccgactcaggcctcgtattacccactca

SEQ ID NO: 98874 - DNA, 36 bp, Artificial Sequence
  Synthetic oligonucleotide
aagcggagccacgcgctttaacgtctcaagacctca

SEQ ID NO: 98875 - DNA, 37 bp, Artificial Sequence
  Synthetic oligonucleotide
ggacagataggagggaaacaaacagccggagacaaga

SEQ ID NO: 98876 - DNA, 37 bp, Artificial Sequence
  Synthetic oligonucleotide
gagcgaggggggtgtaaaacatgtgccgcgacataga

SEQ ID NO: 98877 - DNA, 35 bp, Artificial Sequence
  Synthetic oligonucleotide
tgtaggaggcagggaggaacagtctggatggtaga

SEQ ID NO: 98878 - DNA, 35 bp, Artificial Sequence
  Synthetic oligonucleotide
gtcacccgcacatcattgggtctcgtacttgtaga

SEQ ID NO: 98879 - DNA, 36 bp, Artificial Sequence
  Synthetic oligonucleotide
tgtgctacatctctcatctcagtctggtcacttaga

SEQ ID NO: 98880 - DNA, 36 bp, Artificial Sequence
  Synthetic oligonucleotide
gtgacatcgcccctttgtacggtttgcaatatgcga

SEQ ID NO: 98881 - DNA, 37 bp, Artificial Sequence
  Synthetic oligonucleotide
ttgctcctccgtggctttgcatccctgtactttagga

SEQ ID NO: 98882 - DNA, 37 bp, Artificial Sequence
  Synthetic oligonucleotide
tgtttgcccacccccgcccgtagatccctcgaaggga

SEQ ID NO: 98883 - DNA, 36 bp, Artificial Sequence
  Synthetic oligonucleotide
actcggaggcgctacattatcctttgacatccggga

SEQ ID NO: 98884 - DNA, 37 bp, Artificial Sequence
  Synthetic oligonucleotide
gtgtgggaaccttgagtcgactatgagcgggtcggga

SEQ ID NO: 98885 - DNA, 36 bp, Artificial Sequence
  Synthetic oligonucleotide
gggaggtccgtgtcaaggttagggaaagggcgggga

SEQ ID NO: 98886 - DNA, 37 bp, Artificial Sequence
  Synthetic oligonucleotide
ttgcggacggcggaaagagtttgagtggattaatgga

SEQ ID NO: 98887 - DNA, 37 bp, Artificial Sequence
  Synthetic oligonucleotide
atgccgccgattcgttctataccgtcatccatatgga

SEQ ID NO: 98888 - DNA, 36 bp, Artificial Sequence
  Synthetic oligonucleotide
gttgcgcgatgtaccacgatcttacccagctttgga

SEQ ID NO: 98889 - DNA, 38 bp, Artificial Sequence
  Synthetic oligonucleotide
gacaacgcagtgatggcgtagtttggggagctgactga

SEQ ID NO: 98890 - DNA, 38 bp, Artificial Sequence
  Synthetic oligonucleotide
tgcgggggggggcgaagatgatgcaggggagatcgtga

SEQ ID NO: 98891 - DNA, 35 bp, Artificial Sequence
  Synthetic oligonucleotide
gatgcgaaatgtggccgtgagtatcacagtggtga

SEQ ID NO: 98892 - DNA, 38 bp, Artificial Sequence
  Synthetic oligonucleotide
ggggaaggtgagaatacgagttgcgagagggagattga

SEQ ID NO: 98893 - DNA, 38 bp, Artificial Sequence
  Synthetic oligonucleotide
ttgacggtcagcaaggaaaaaggcgataagttgcttga

SEQ ID NO: 98894 - DNA, 37 bp, Artificial Sequence
  Synthetic oligonucleotide
tacggggtaggtgaaggagagagcgtggaaggtttga

SEQ ID NO: 98895 - DNA, 35 bp, Artificial Sequence
  Synthetic oligonucleotide
tgccgcccggcctccttaaccacatgtattgcata

SEQ ID NO: 98896 - DNA, 36 bp, Artificial Sequence
  Synthetic oligonucleotide
cacgaatcggtagatcactaatcgccttcggaccta

SEQ ID NO: 98897 - DNA, 36 bp, Artificial Sequence
  Synthetic oligonucleotide
tgacccgtgccacattagtctttggtcccttccgta

SEQ ID NO: 98898 - DNA, 35 bp, Artificial Sequence
  Synthetic oligonucleotide
acgcgaaggcccgagcgtccgttatcttggtggta

SEQ ID NO: 98899 - DNA, 36 bp, Artificial Sequence
  Synthetic oligonucleotide
tccatgccccgttctgcagtatcgtacgggagctta

SEQ ID NO: 98900 - DNA, 36 bp, Artificial Sequence
  Synthetic oligonucleotide
acatgccgttcgacgctctagtaggatcaatcgtta

SEQ ID NO: 98901 - DNA, 35 bp, Artificial Sequence
  Synthetic oligonucleotide
atgacacgctcaatgaaactttaccgcctcacgcc

SEQ ID NO: 98902 - DNA, 35 bp, Artificial Sequence
  Synthetic oligonucleotide
gttgggatcaagtgtgatccgcgctctccaccagc

SEQ ID NO: 98903 - DNA, 35 bp, Artificial Sequence
  Synthetic oligonucleotide
atccgcctagttcgtgcctctagtttatggcctgc

SEQ ID NO: 98904 - DNA, 35 bp, Artificial Sequence
  Synthetic oligonucleotide
gcgatcgtgctcgcacaactcacagggaaataatc

SEQ ID NO: 98905 - DNA, 35 bp, Artificial Sequence
  Synthetic oligonucleotide
ttcgcccaaacatcttcgttccaatgccatacatc

SEQ ID NO: 98906 - DNA, 35 bp, Artificial Sequence
  Synthetic oligonucleotide
gtgcgcccacttgtacccgacgttgcctcatcctc

SEQ ID NO: 98907 - DNA, 35 bp, Artificial Sequence
  Synthetic oligonucleotide
gtaatcgctacttctggatgacgcctgtgattttc

SEQ ID NO: 98908 - DNA, 35 bp, Artificial Sequence
  Synthetic oligonucleotide
ataccccaagcggggtcacttgtccctttcactag

SEQ ID NO: 98909 - DNA, 35 bp, Artificial Sequence
  Synthetic oligonucleotide
tgagtgggaacgtaggaaaactgaggcgtacctcg

SEQ ID NO: 98910 - DNA, 35 bp, Artificial Sequence
  Synthetic oligonucleotide
gatggccagtcgggtgggttggtagaagttgtggg

SEQ ID NO: 98911 - DNA, 35 bp, Artificial Sequence
  Synthetic oligonucleotide
attgcgtggcccgaccgtcctagacaaaaccccat

SEQ ID NO: 98912 - DNA, 35 bp, Artificial Sequence
  Synthetic oligonucleotide
taaccacacaggcgagctcacagtggtatttccat

SEQ ID NO: 98913 - DNA, 35 bp, Artificial Sequence
  Synthetic oligonucleotide
aagcatccacatggctacgcggacccctcaacgct

SEQ ID NO: 98914 - DNA, 35 bp, Artificial Sequence
  Synthetic oligonucleotide
gccgctggcacctgtaattggtaactgtaaactct

SEQ ID NO: 98915 - DNA, 35 bp, Artificial Sequence
  Synthetic oligonucleotide
gtagagccaacggtaccgagaatgcaggtgggggt

SEQ ID NO: 98916 - DNA, 35 bp, Artificial Sequence
  Synthetic oligonucleotide
gatgagcaacaggagatatgaccacggctgtactt

SEQ ID NO: 98917 - DNA, 36 bp, Artificial Sequence
  Synthetic oligonucleotide
attgcgcctcctgtgtcatttcccgtgcgttacaaa

SEQ ID NO: 98918 - DNA, 36 bp, Artificial Sequence
  Synthetic oligonucleotide
gtcgagggacggacaaagggctgaggtaaccgggaa

SEQ ID NO: 98919 - DNA, 36 bp, Artificial Sequence
  Synthetic oligonucleotide
aagaggggccaggacaaggcaacaaggggggtggaa

SEQ ID NO: 98920 - DNA, 35 bp, Artificial Sequence
  Synthetic oligonucleotide
tagccgcatggcgtcactttcccaccctcgctgaa

SEQ ID NO: 98921 - DNA, 36 bp, Artificial Sequence
  Synthetic oligonucleotide
tacaatacgcaggcgtgggagggcctgtggggttaa

SEQ ID NO: 98922 - DNA, 36 bp, Artificial Sequence
  Synthetic oligonucleotide
gtgcagaagccgcgagccctataatatgctgacaca

SEQ ID NO: 98923 - DNA, 36 bp, Artificial Sequence
  Synthetic oligonucleotide
gacgaggggggcatatggagggaggtaagagtcaca

SEQ ID NO: 98924 - DNA, 35 bp, Artificial Sequence
  Synthetic oligonucleotide
tccgcactctccgcattctcactcacgaccggaca

SEQ ID NO: 98925 - DNA, 36 bp, Artificial Sequence
  Synthetic oligonucleotide
atgtgcagcccgagttctgcacaggcccccagtaca

SEQ ID NO: 98926 - DNA, 35 bp, Artificial Sequence
  Synthetic oligonucleotide
agtcacgcctgtcccacgtcagccactgctcccca

SEQ ID NO: 98927 - DNA, 36 bp, Artificial Sequence
  Synthetic oligonucleotide
ttgatgcggacaataatgatgaaatagacggggcca

SEQ ID NO: 98928 - DNA, 35 bp, Artificial Sequence
  Synthetic oligonucleotide
acacctcgcggtccgcaagttcatttcccgtagca

SEQ ID NO: 98929 - DNA, 35 bp, Artificial Sequence
  Synthetic oligonucleotide
atgcacatcacattagtcttcccgcagagttcgca

SEQ ID NO: 98930 - DNA, 36 bp, Artificial Sequence
  Synthetic oligonucleotide
tgacatgagggacgctgatgaggccgggggagctca

SEQ ID NO: 98931 - DNA, 37 bp, Artificial Sequence
  Synthetic oligonucleotide
gtggtgtggaggccgggaatagacgtcgctacagaga

SEQ ID NO: 98932 - DNA, 37 bp, Artificial Sequence
  Synthetic oligonucleotide
atgggatagaacgacggacgcaaaggacgagcagaga

SEQ ID NO: 98933 - DNA, 37 bp, Artificial Sequence
  Synthetic oligonucleotide
gaaagggaggacaggcaggtgaacggattacgtgaga

SEQ ID NO: 98934 - DNA, 37 bp, Artificial Sequence
  Synthetic oligonucleotide
taaccgcgaactgcccttaggtaacgaaccaatacga

SEQ ID NO: 98935 - DNA, 36 bp, Artificial Sequence
  Synthetic oligonucleotide
tcagatcccacagctccgtaccagcccacgctacga

SEQ ID NO: 98936 - DNA, 37 bp, Artificial Sequence
  Synthetic oligonucleotide
gaccagaggttagctcagtcaggggagaaggatccga

SEQ ID NO: 98937 - DNA, 37 bp, Artificial Sequence
  Synthetic oligonucleotide
gatagcaccccccatgttttatcgatctgtatctcga

SEQ ID NO: 98938 - DNA, 35 bp, Artificial Sequence
  Synthetic oligonucleotide
gtggtcacacttcgaaatcctctgttagccaggga

SEQ ID NO: 98939 - DNA, 37 bp, Artificial Sequence
  Synthetic oligonucleotide
attggagcacatcaagacggatagagaggtataggga

SEQ ID NO: 98940 - DNA, 37 bp, Artificial Sequence
  Synthetic oligonucleotide
ggaatgtgtgggaggtgaagtaggtgacggtagggga

SEQ ID NO: 98941 - DNA, 35 bp, Artificial Sequence
  Synthetic oligonucleotide
accagtgcattgcgtttggctcttattctggggga

SEQ ID NO: 98942 - DNA, 37 bp, Artificial Sequence
  Synthetic oligonucleotide
aatacatgcctgccccgttataacacttgccttggga

SEQ ID NO: 98943 - DNA, 37 bp, Artificial Sequence
  Synthetic oligonucleotide
gctggagggcggtagacaggcaatatgaaccactgga

SEQ ID NO: 98944 - DNA, 37 bp, Artificial Sequence
  Synthetic oligonucleotide
tggaaaacaggggagtataggaggctagagggctgga

SEQ ID NO: 98945 - DNA, 38 bp, Artificial Sequence
  Synthetic oligonucleotide
tgcccgtgtccatcgaccgtctctcagtctccccatga

SEQ ID NO: 98946 - DNA, 38 bp, Artificial Sequence
  Synthetic oligonucleotide
ggaacgggtcggcactgatatgggtggcctgaatatga

SEQ ID NO: 98947 - DNA, 35 bp, Artificial Sequence
  Synthetic oligonucleotide
tcccaccgcacaccaagagttttcgaataatatga

SEQ ID NO: 98948 - DNA, 37 bp, Artificial Sequence
  Synthetic oligonucleotide
tatgatgtgccgatgagaagagtcgcgtgtggtatga

SEQ ID NO: 98949 - DNA, 38 bp, Artificial Sequence
  Synthetic oligonucleotide
gactgtggccaggagcttcattcgtgaccacttcctga

SEQ ID NO: 98950 - DNA, 38 bp, Artificial Sequence
  Synthetic oligonucleotide
gacacgcccgatgattcgtttggatttactcaccgtga

SEQ ID NO: 98951 - DNA, 38 bp, Artificial Sequence
  Synthetic oligonucleotide
gacgccatgcagtaaggccggaagagaaggaagtgtga

SEQ ID NO: 98952 - DNA, 38 bp, Artificial Sequence
  Synthetic oligonucleotide
gcacctgcaaatgttcggcgttacactctaactattga

SEQ ID NO: 98953 - DNA, 36 bp, Artificial Sequence
  Synthetic oligonucleotide
tccgaccccgccaagacgaaacggtcagtttcttga

SEQ ID NO: 98954 - DNA, 38 bp, Artificial Sequence
  Synthetic oligonucleotide
actgcaaagatagtgcgaaggggatgttgagtggttga

SEQ ID NO: 98955 - DNA, 35 bp, Artificial Sequence
  Synthetic oligonucleotide
attggccacactcactctgggcatcaagcctttga

SEQ ID NO: 98956 - DNA, 38 bp, Artificial Sequence
  Synthetic oligonucleotide
gtagcgacgccccaagcgttgcataattttgcttttga

SEQ ID NO: 98957 - DNA, 35 bp, Artificial Sequence
  Synthetic oligonucleotide
ttgatgcgcaacatccctgtcgacagatttaggta

SEQ ID NO: 98958 - DNA, 35 bp, Artificial Sequence
  Synthetic oligonucleotide
atggcacagtatgcagtaatactgcctcgtttcac

SEQ ID NO: 98959 - DNA, 35 bp, Artificial Sequence
  Synthetic oligonucleotide
atccgtagccacggtacgggataatcaccagttac

SEQ ID NO: 98960 - DNA, 36 bp, Artificial Sequence
  Synthetic oligonucleotide
gctgatcgccatctatgcatcacctatcacggaacc

SEQ ID NO: 98961 - DNA, 35 bp, Artificial Sequence
  Synthetic oligonucleotide
tatgcgcacaacctgcagtgttgtactattcaccc

SEQ ID NO: 98962 - DNA, 35 bp, Artificial Sequence
  Synthetic oligonucleotide
atgcgtacggcccaagagtatgtttgcctttttgc

SEQ ID NO: 98963 - DNA, 35 bp, Artificial Sequence
  Synthetic oligonucleotide
tgatgttgaccccatctggtgcagagatgctcctc

SEQ ID NO: 98964 - DNA, 35 bp, Artificial Sequence
  Synthetic oligonucleotide
tccatcgctccacctggtacagtctctgccactag

SEQ ID NO: 98965 - DNA, 35 bp, Artificial Sequence
  Synthetic oligonucleotide
gtcacgccaatccgaaataacgccagttgcgaccg

SEQ ID NO: 98966 - DNA, 35 bp, Artificial Sequence
  Synthetic oligonucleotide
gtgcgtacgtggggagccgggtgacgagatgcagg

SEQ ID NO: 98967 - DNA, 35 bp, Artificial Sequence
  Synthetic oligonucleotide
gccgaagagttattgaggatatgaacgtgttgggg

SEQ ID NO: 98968 - DNA, 35 bp, Artificial Sequence
  Synthetic oligonucleotide
gtcgagagagggaaggggccagacgaaaattttgg

SEQ ID NO: 98969 - DNA, 35 bp, Artificial Sequence
  Synthetic oligonucleotide
accacggttccatgtcaataagcaatatcgttctg

SEQ ID NO: 98970 - DNA, 35 bp, Artificial Sequence
  Synthetic oligonucleotide
atcagtcgcgagctagtatgcccttattccttgat

SEQ ID NO: 98971 - DNA, 35 bp, Artificial Sequence
  Synthetic oligonucleotide
taaccgcaagtaggggtggacggggaaagggatat

SEQ ID NO: 98972 - DNA, 35 bp, Artificial Sequence
  Synthetic oligonucleotide
tactccaaccctagtgcgctatatcgcgtgttcct

SEQ ID NO: 98973 - DNA, 35 bp, Artificial Sequence
  Synthetic oligonucleotide
gaggacggtcgggcttcgattggcaacacaactct

SEQ ID NO: 98974 - DNA, 35 bp, Artificial Sequence
  Synthetic oligonucleotide
gaccaaccatcgctgcaccgcctctctatcggtgt

SEQ ID NO: 98975 - DNA, 36 bp, Artificial Sequence
  Synthetic oligonucleotide
accgagaccgaagttgttaatgaaagaatcaggcaa

SEQ ID NO: 98976 - DNA, 36 bp, Artificial Sequence
  Synthetic oligonucleotide
gaagggtaggcgtaattggcatggcttggagaggaa

SEQ ID NO: 98977 - DNA, 37 bp, Artificial Sequence
  Synthetic oligonucleotide
gagcaaacgtgggtggtaggcccggggagaaaagaca

SEQ ID NO: 98978 - DNA, 36 bp, Artificial Sequence
  Synthetic oligonucleotide
gtgaccggttcaactagtaaaacgtgaactcatcca

SEQ ID NO: 98979 - DNA, 36 bp, Artificial Sequence
  Synthetic oligonucleotide
gaggaggtaggtggtcatggagcggagcgaactcca

SEQ ID NO: 98980 - DNA, 36 bp, Artificial Sequence
  Synthetic oligonucleotide
gttgaggggtgcagaggaagttgagttagagttcca

SEQ ID NO: 98981 - DNA, 36 bp, Artificial Sequence
  Synthetic oligonucleotide
gagagggaggagcgtggtgcggaaagagcaatagca

SEQ ID NO: 98982 - DNA, 36 bp, Artificial Sequence
  Synthetic oligonucleotide
taccaccatccctgcactacgtacgtgagccctgca

SEQ ID NO: 98983 - DNA, 38 bp, Artificial Sequence
  Synthetic oligonucleotide
atccacctcactatgttcccgcactgatccctgcctca

SEQ ID NO: 98984 - DNA, 36 bp, Artificial Sequence
  Synthetic oligonucleotide
gacacatcgagctgttgccgtaactccatctattca

SEQ ID NO: 98985 - DNA, 37 bp, Artificial Sequence
  Synthetic oligonucleotide
gctgccccccactgatagcagtcgtctggccccaaga

SEQ ID NO: 98986 - DNA, 35 bp, Artificial Sequence
  Synthetic oligonucleotide
gcaatgcaaacgagggtgtggatgatgccgctaga

SEQ ID NO: 98987 - DNA, 37 bp, Artificial Sequence
  Synthetic oligonucleotide
acctgtgccgcaagttgttacccactcgatacgtaga

SEQ ID NO: 98988 - DNA, 37 bp, Artificial Sequence
  Synthetic oligonucleotide
taactcgcccacttgaaacaggttacagtctgaacga

SEQ ID NO: 98989 - DNA, 37 bp, Artificial Sequence
  Synthetic oligonucleotide
atcgagccgacaggcaccggaccaggactcacaagga

SEQ ID NO: 98990 - DNA, 37 bp, Artificial Sequence
  Synthetic oligonucleotide
gaggacgacgcacgacccctgttaggtacggcaagga

SEQ ID NO: 98991 - DNA, 37 bp, Artificial Sequence
  Synthetic oligonucleotide
atgaagtggaaagtggagggactgcctagaggtggga

SEQ ID NO: 98992 - DNA, 37 bp, Artificial Sequence
  Synthetic oligonucleotide
tctagcgccagaagactgcttgaatggtgggttggga

SEQ ID NO: 98993 - DNA, 37 bp, Artificial Sequence
  Synthetic oligonucleotide
gtagggtaaggaggggcgtatcaatggcaaacatgga

SEQ ID NO: 98994 - DNA, 38 bp, Artificial Sequence
  Synthetic oligonucleotide
tggtcgggaaaagaggaagaataaaggtggagtcatga

SEQ ID NO: 98995 - DNA, 37 bp, Artificial Sequence
  Synthetic oligonucleotide
gacggagggactatgtgtggagggtgactggggatga

SEQ ID NO: 98996 - DNA, 38 bp, Artificial Sequence
  Synthetic oligonucleotide
gccgaacgcagggagtggtgatcacaggagacgactga

SEQ ID NO: 98997 - DNA, 35 bp, Artificial Sequence
  Synthetic oligonucleotide
acgcgataagcgcagatacttatgtcccgacctga

SEQ ID NO: 98998 - DNA, 38 bp, Artificial Sequence
  Synthetic oligonucleotide
tgacaagccagagtggcgagtttaggagcaggacgtga

SEQ ID NO: 98999 - DNA, 37 bp, Artificial Sequence
  Synthetic oligonucleotide
gaatccggggcggatgggtaacggaagatcgtggtga

SEQ ID NO: 99000 - DNA, 37 bp, Artificial Sequence
  Synthetic oligonucleotide
tacatcccccaaggtgacccgctgcaagaatacttga

SEQ ID NO: 99001 - DNA, 38 bp, Artificial Sequence
  Synthetic oligonucleotide
gacgggggagacaaagagcttgatgttgaggcagttga

SEQ ID NO: 99002 - DNA, 38 bp, Artificial Sequence
  Synthetic oligonucleotide
tagtccacaccgctccccgacggccctaaggacgttga

SEQ ID NO: 99003 - DNA, 37 bp, Artificial Sequence
  Synthetic oligonucleotide
aacacctacggagacgtagttgcgagattctttttga

SEQ ID NO: 99004 - DNA, 36 bp, Artificial Sequence
  Synthetic oligonucleotide
gcaacctcgaatcgttacaaagattccaatttgcta

SEQ ID NO: 99005 - DNA, 35 bp, Artificial Sequence
  Synthetic oligonucleotide
agtactggccccacacatgaccgacaaggtgatta

SEQ ID NO: 99006 - DNA, 35 bp, Artificial Sequence
  Synthetic oligonucleotide
atgagggaccgggagtgttctgggggcgaatgaac

SEQ ID NO: 99007 - DNA, 35 bp, Artificial Sequence
  Synthetic oligonucleotide
atacactacggaggggcgtagtagccatactgaac

SEQ ID NO: 99008 - DNA, 35 bp, Artificial Sequence
  Synthetic oligonucleotide
ttgcgcaaactcctagcggtgctctccaacaatac

SEQ ID NO: 99009 - DNA, 35 bp, Artificial Sequence
  Synthetic oligonucleotide
gaggacacattacgtggaatgccttttcggtttac

SEQ ID NO: 99010 - DNA, 35 bp, Artificial Sequence
  Synthetic oligonucleotide
tcagtacgtgcaacgctattatgagtgatcctccc

SEQ ID NO: 99011 - DNA, 35 bp, Artificial Sequence
  Synthetic oligonucleotide
tcacgctcccgtctctcttccgtatttgcctgtcc

SEQ ID NO: 99012 - DNA, 35 bp, Artificial Sequence
  Synthetic oligonucleotide
tgcatcccgcatgctggaagggggggaaatgtagc

SEQ ID NO: 99013 - DNA, 35 bp, Artificial Sequence
  Synthetic oligonucleotide
gccgaacactgacccatcaagaaggtacttttctc

SEQ ID NO: 99014 - DNA, 35 bp, Artificial Sequence
  Synthetic oligonucleotide
gatgtcgcctgtccaccctccatgcaatgcgattc

SEQ ID NO: 99015 - DNA, 35 bp, Artificial Sequence
  Synthetic oligonucleotide
accccgttccacctaagtcctgcccttgcagcaag

SEQ ID NO: 99016 - DNA, 35 bp, Artificial Sequence
  Synthetic oligonucleotide
gagacggatgagcgtggatctaaaacgggctacag

SEQ ID NO: 99017 - DNA, 35 bp, Artificial Sequence
  Synthetic oligonucleotide
gtgagacggtagtacattcatagaagcgtgtggag

SEQ ID NO: 99018 - DNA, 35 bp, Artificial Sequence
  Synthetic oligonucleotide
taaggagcgcttggggggtagggtggcagtcaccg

SEQ ID NO: 99019 - DNA, 35 bp, Artificial Sequence
  Synthetic oligonucleotide
gtgtcagggaaatggcgcacaagggagagacagcg

SEQ ID NO: 99020 - DNA, 35 bp, Artificial Sequence
  Synthetic oligonucleotide
acacgggcgtggagaatctcatgatggaggcaagg

SEQ ID NO: 99021 - DNA, 35 bp, Artificial Sequence
  Synthetic oligonucleotide
atggtagcagggtaagaaacaagggacggaatagg

SEQ ID NO: 99022 - DNA, 35 bp, Artificial Sequence
  Synthetic oligonucleotide
acagaagagaggggtagtttagagttgggtacggg

SEQ ID NO: 99023 - DNA, 35 bp, Artificial Sequence
  Synthetic oligonucleotide
gcccgtgcatgctgcctgacagcacgagattccat

SEQ ID NO: 99024 - DNA, 35 bp, Artificial Sequence
  Synthetic oligonucleotide
ttcgacaccccgtccatgtacaatgcgtgattact

SEQ ID NO: 99025 - DNA, 35 bp, Artificial Sequence
  Synthetic oligonucleotide
gattggcacaggcgcacgtacatcagctcccatct

SEQ ID NO: 99026 - DNA, 35 bp, Artificial Sequence
  Synthetic oligonucleotide
atccgagcggcctcatctattgtccacccgccagt

SEQ ID NO: 99027 - DNA, 35 bp, Artificial Sequence
  Synthetic oligonucleotide
atgtacacccaatgtacgtacgcgattttccaatt

SEQ ID NO: 99028 - DNA, 35 bp, Artificial Sequence
  Synthetic oligonucleotide
tagccgtaggtggggaactttggcgtgtttgaatt

SEQ ID NO: 99029 - DNA, 35 bp, Artificial Sequence
  Synthetic oligonucleotide
gatgctacgtctaacatagtgctaatcctgctgtt

SEQ ID NO: 99030 - DNA, 35 bp, Artificial Sequence
  Synthetic oligonucleotide
tgatccatcagggccccaggcatgtgcttcacttt

SEQ ID NO: 99031 - DNA, 35 bp, Artificial Sequence
  Synthetic oligonucleotide
gctccactcctgtgttccgctgtgctagggcacaa

SEQ ID NO: 99032 - DNA, 35 bp, Artificial Sequence
  Synthetic oligonucleotide
tctcgacgtagcatgagcctcattccgcattccaa

SEQ ID NO: 99033 - DNA, 35 bp, Artificial Sequence
  Synthetic oligonucleotide
gtgccacaagtgggcgaaagagtaggcagtcgcaa

SEQ ID NO: 99034 - DNA, 35 bp, Artificial Sequence
  Synthetic oligonucleotide
acatacgcatcgcaaagcaatccgagtgggtggaa

SEQ ID NO: 99035 - DNA, 36 bp, Artificial Sequence
  Synthetic oligonucleotide
gacatgccaccgttttgaataggctcatcaccctaa

SEQ ID NO: 99036 - DNA, 36 bp, Artificial Sequence
  Synthetic oligonucleotide
tcaccctccgccctgtctcaacaatatcagtcctaa

SEQ ID NO: 99037 - DNA, 36 bp, Artificial Sequence
  Synthetic oligonucleotide
tacggacggagacaccgtgggaaaggtggggcaaca

SEQ ID NO: 99038 - DNA, 35 bp, Artificial Sequence
  Synthetic oligonucleotide
gatcattcgcaagaccggctactggaccactcaca

SEQ ID NO: 99039 - DNA, 36 bp, Artificial Sequence
  Synthetic oligonucleotide
tccacgccctcaccgcccctaatgcgaagtgcgaca

SEQ ID NO: 99040 - DNA, 36 bp, Artificial Sequence
  Synthetic oligonucleotide
acttcatgcgccgaagcccttactttggaccatcca

SEQ ID NO: 99041 - DNA, 36 bp, Artificial Sequence
  Synthetic oligonucleotide
gtcctgcatcggagccaagagcgcagacgcattcca

SEQ ID NO: 99042 - DNA, 36 bp, Artificial Sequence
  Synthetic oligonucleotide
gcacgccctcgctttgcccgacaggatcgatacgca

SEQ ID NO: 99043 - DNA, 36 bp, Artificial Sequence
  Synthetic oligonucleotide
tcaaacgcatcgcggtccagaagggaaacctgctca

SEQ ID NO: 99044 - DNA, 37 bp, Artificial Sequence
  Synthetic oligonucleotide
actgccaggacggagaacgattagggagggagcaaga

SEQ ID NO: 99045 - DNA, 37 bp, Artificial Sequence
  Synthetic oligonucleotide
gatcctgcccgaatattcatagggtcacagtcgaaga

SEQ ID NO: 99046 - DNA, 37 bp, Artificial Sequence
  Synthetic oligonucleotide
gtgtgtccggttccggttctagcttttctccttgaga

SEQ ID NO: 99047 - DNA, 36 bp, Artificial Sequence
  Synthetic oligonucleotide
gccaatgtgcgagatgaagcatgtgtgcgtgatcga

SEQ ID NO: 99048 - DNA, 37 bp, Artificial Sequence
  Synthetic oligonucleotide
tgcgacaccaaccgattctaagcacaccccttccgga

SEQ ID NO: 99049 - DNA, 36 bp, Artificial Sequence
  Synthetic oligonucleotide
accgagctgcaatagggtttccttgaacgaagcgga

SEQ ID NO: 99050 - DNA, 36 bp, Artificial Sequence
  Synthetic oligonucleotide
gagggacagtgaaagggacgagaatagttagaggga

SEQ ID NO: 99051 - DNA, 35 bp, Artificial Sequence
  Synthetic oligonucleotide
tagtactcccaaccgcttagtacagaccaagggga

SEQ ID NO: 99052 - DNA, 37 bp, Artificial Sequence
  Synthetic oligonucleotide
acgtcaaaggtgggtggggaaggacagctagggggga

SEQ ID NO: 99053 - DNA, 37 bp, Artificial Sequence
  Synthetic oligonucleotide
gtgtggtgcaggtgcatagggcctatgtgcgttggga

SEQ ID NO: 99054 - DNA, 36 bp, Artificial Sequence
  Synthetic oligonucleotide
tcaagaccacaagtgctatgctaagagggggctgga

SEQ ID NO: 99055 - DNA, 37 bp, Artificial Sequence
  Synthetic oligonucleotide
atgacacaagagcaactgggtggagagggggggtgga

SEQ ID NO: 99056 - DNA, 37 bp, Artificial Sequence
  Synthetic oligonucleotide
tgaccggaactcataggtctttcagatcacgcactga

SEQ ID NO: 99057 - DNA, 37 bp, Artificial Sequence
  Synthetic oligonucleotide
aaccacgccagacataccacacgtgccgccatactga

SEQ ID NO: 99058 - DNA, 38 bp, Artificial Sequence
  Synthetic oligonucleotide
gtgactgcatcgatggttaatcgaggttggtatggtga

SEQ ID NO: 99059 - DNA, 38 bp, Artificial Sequence
  Synthetic oligonucleotide
agtggaacgagaaatgggttgaacgggacaagcgttga

SEQ ID NO: 99060 - DNA, 37 bp, Artificial Sequence
  Synthetic oligonucleotide
tcagagaggaggtacgtaaagaatgagagtgtgttga

SEQ ID NO: 99061 - DNA, 38 bp, Artificial Sequence
  Synthetic oligonucleotide
aagtgcggcccggtccatatggacggtttttggtttga

SEQ ID NO: 99062 - DNA, 38 bp, Artificial Sequence
  Synthetic oligonucleotide
tgacctcacccgggggcctgtacccttgactgttttga

SEQ ID NO: 99063 - DNA, 35 bp, Artificial Sequence
  Synthetic oligonucleotide
aatgccacagtagctcgcgcatctaattagtggta

SEQ ID NO: 99064 - DNA, 36 bp, Artificial Sequence
  Synthetic oligonucleotide
tgcaccgcagggcccttcacgaccctccgacatgta

SEQ ID NO: 99065 - DNA, 35 bp, Artificial Sequence
  Synthetic oligonucleotide
aacaccgcggtttggtaagtctcgctcatcatgta

SEQ ID NO: 99066 - DNA, 35 bp, Artificial Sequence
  Synthetic oligonucleotide
gtcgccgccgcacatgtacacacctcgccaaaaac

SEQ ID NO: 99067 - DNA, 35 bp, Artificial Sequence
  Synthetic oligonucleotide
tgaacaccccatcgttatcctgcgcactcatcgac

SEQ ID NO: 99068 - DNA, 35 bp, Artificial Sequence
  Synthetic oligonucleotide
acaccagggctatgaatgaaatccgtgttccctac

SEQ ID NO: 99069 - DNA, 35 bp, Artificial Sequence
  Synthetic oligonucleotide
tagcatgacgccgcctctatgcctatcaacgctac

SEQ ID NO: 99070 - DNA, 35 bp, Artificial Sequence
  Synthetic oligonucleotide
atacgcggtacatcgacgtatggccgaatccttac

SEQ ID NO: 99071 - DNA, 35 bp, Artificial Sequence
  Synthetic oligonucleotide
gccacccacaaccaggacgtcgactggtcgcggcc

SEQ ID NO: 99072 - DNA, 35 bp, Artificial Sequence
  Synthetic oligonucleotide
acgaccgtcacacatacgcaagtgtttatcccccg

SEQ ID NO: 99073 - DNA, 35 bp, Artificial Sequence
  Synthetic oligonucleotide
tgaccatacagcccgccccttacacgtgaactgcg

SEQ ID NO: 99074 - DNA, 35 bp, Artificial Sequence
  Synthetic oligonucleotide
gacgcggtcgctgaggattgtctccacctcctgcg

SEQ ID NO: 99075 - DNA, 35 bp, Artificial Sequence
  Synthetic oligonucleotide
gcgatctgggaaaaaggttatgggagatataaatg

SEQ ID NO: 99076 - DNA, 35 bp, Artificial Sequence
  Synthetic oligonucleotide
gttccggtgaagtaggggctaaggtcgggaatatg

SEQ ID NO: 99077 - DNA, 35 bp, Artificial Sequence
  Synthetic oligonucleotide
agtccactcccactgccgctctggtctcaaccctg

SEQ ID NO: 99078 - DNA, 35 bp, Artificial Sequence
  Synthetic oligonucleotide
aactgccccggatcaggaaaggcgatctgacacat

SEQ ID NO: 99079 - DNA, 35 bp, Artificial Sequence
  Synthetic oligonucleotide
acttccatcgccgctcactcgtctgggcgcacgat

SEQ ID NO: 99080 - DNA, 35 bp, Artificial Sequence
  Synthetic oligonucleotide
tcccctcggggctggaacgtttcatcgctacctat

SEQ ID NO: 99081 - DNA, 35 bp, Artificial Sequence
  Synthetic oligonucleotide
acagtgcgcgcacatgccttcccttccgagacagt

SEQ ID NO: 99082 - DNA, 35 bp, Artificial Sequence
  Synthetic oligonucleotide
gactggacccggacgcctccgatcagacagctagt

SEQ ID NO: 99083 - DNA, 35 bp, Artificial Sequence
  Synthetic oligonucleotide
gctgacgtaaggtctggctgggaggaagggttagt

SEQ ID NO: 99084 - DNA, 35 bp, Artificial Sequence
  Synthetic oligonucleotide
gaaccggagtgagcgggttttagacaatgtcgggt

SEQ ID NO: 99085 - DNA, 35 bp, Artificial Sequence
  Synthetic oligonucleotide
gaccccgacatcgatctcaactaatgcagaaggtt

SEQ ID NO: 99086 - DNA, 35 bp, Artificial Sequence
  Synthetic oligonucleotide
taccagggggacagacgtaatgtacgggggttgtt

SEQ ID NO: 99087 - DNA, 36 bp, Artificial Sequence
  Synthetic oligonucleotide
gtacaaccctcggacggtccgaaacacatgccaaaa

SEQ ID NO: 99088 - DNA, 36 bp, Artificial Sequence
  Synthetic oligonucleotide
gcactacgtaccggaagttcgttttgtggccacaaa

SEQ ID NO: 99089 - DNA, 35 bp, Artificial Sequence
  Synthetic oligonucleotide
tgaggaagagggacgttcggaggagatgagaacaa

SEQ ID NO: 99090 - DNA, 36 bp, Artificial Sequence
  Synthetic oligonucleotide
atgccatcccaataaacatatgcacgttccggagaa

SEQ ID NO: 99091 - DNA, 36 bp, Artificial Sequence
  Synthetic oligonucleotide
gtgaacggaaaaacgggtgaacaagcgataggcgaa

SEQ ID NO: 99092 - DNA, 35 bp, Artificial Sequence
  Synthetic oligonucleotide
tgtgagcagtgagaccgtaaaaaagggagagggaa

SEQ ID NO: 99093 - DNA, 36 bp, Artificial Sequence
  Synthetic oligonucleotide
agtccgcacgtctgtgttctaaacgcacctctttaa

SEQ ID NO: 99094 - DNA, 36 bp, Artificial Sequence
  Synthetic oligonucleotide
ttgaccgcatagaagattggagtgtaagggaaaaca

SEQ ID NO: 99095 - DNA, 36 bp, Artificial Sequence
  Synthetic oligonucleotide
ttgcggacacgctgacactcccgtgcgaccctaaca

SEQ ID NO: 99096 - DNA, 37 bp, Artificial Sequence
  Synthetic oligonucleotide
tcccatcccccatactgttgactctgaacctgccgca

SEQ ID NO: 99097 - DNA, 36 bp, Artificial Sequence
  Synthetic oligonucleotide
aatgaggacgaagtgggttaacgagtaagtgaggca

SEQ ID NO: 99098 - DNA, 35 bp, Artificial Sequence
  Synthetic oligonucleotide
tacccagcagttcgcaaagggggttacaaggggca

SEQ ID NO: 99099 - DNA, 37 bp, Artificial Sequence
  Synthetic oligonucleotide
gccggtcaagcaagcgcgtgcggcacggacttcaaga

SEQ ID NO: 99100 - DNA, 37 bp, Artificial Sequence
  Synthetic oligonucleotide
ttcgacaaccccccatgtgctttacgtcgaatacaga

SEQ ID NO: 99101 - DNA, 37 bp, Artificial Sequence
  Synthetic oligonucleotide
gtggtaacggaggagtacgggaatagtagggtacaga

SEQ ID NO: 99102 - DNA, 36 bp, Artificial Sequence
  Synthetic oligonucleotide
gaggaagctagcgaggaatggaagggaaggagcaga

SEQ ID NO: 99103 - DNA, 37 bp, Artificial Sequence
  Synthetic oligonucleotide
aggggatgtccaggagatcaagggaaagcgggagaga

SEQ ID NO: 99104 - DNA, 37 bp, Artificial Sequence
  Synthetic oligonucleotide
atgtaaacgcacatgtggcggagaactatcgtagaga

SEQ ID NO: 99105 - DNA, 37 bp, Artificial Sequence
  Synthetic oligonucleotide
tactgagccggagtagggttgaggattcggatggaga

SEQ ID NO: 99106 - DNA, 37 bp, Artificial Sequence
  Synthetic oligonucleotide
atccacgggcatgtctacacactaccggatttaccga

SEQ ID NO: 99107 - DNA, 37 bp, Artificial Sequence
  Synthetic oligonucleotide
aacaacgcatcacattgatacgcacgttcatgtgcga

SEQ ID NO: 99108 - DNA, 37 bp, Artificial Sequence
  Synthetic oligonucleotide
gatgcatgacccggtgcgctgattgatctgtctagga

SEQ ID NO: 99109 - DNA, 37 bp, Artificial Sequence
  Synthetic oligonucleotide
gacacctctagaagctttcacaattcatcccttcgga

SEQ ID NO: 99110 - DNA, 37 bp, Artificial Sequence
  Synthetic oligonucleotide
gacggacaaacagttgcgtctcccccgactacaggga

SEQ ID NO: 99111 - DNA, 36 bp, Artificial Sequence
  Synthetic oligonucleotide
tatgagaggcgtacaaggttatacgacaacgaggga

SEQ ID NO: 99112 - DNA, 37 bp, Artificial Sequence
  Synthetic oligonucleotide
gtgagccctgcgagcacggagccagacgacacgggga

SEQ ID NO: 99113 - DNA, 37 bp, Artificial Sequence
  Synthetic oligonucleotide
gtagccgtaagaacagggcggttgacagaacggtgga

SEQ ID NO: 99114 - DNA, 37 bp, Artificial Sequence
  Synthetic oligonucleotide
acaaaccctgcgcagaggatctatgtctgcgggtgga

SEQ ID NO: 99115 - DNA, 38 bp, Artificial Sequence
  Synthetic oligonucleotide
gacacacccgttgtgtctaacctctatcgaacaaatga

SEQ ID NO: 99116 - DNA, 38 bp, Artificial Sequence
  Synthetic oligonucleotide
gtgaggccggtgggaggaaggatagataatcgtgatga

SEQ ID NO: 99117 - DNA, 38 bp, Artificial Sequence
  Synthetic oligonucleotide
ggaaatggaaggagggaaagaaaggctgaggaaactga

SEQ ID NO: 99118 - DNA, 37 bp, Artificial Sequence
  Synthetic oligonucleotide
gccaactgtacagccttgttcgggatcacgtaactga

SEQ ID NO: 99119 - DNA, 38 bp, Artificial Sequence
  Synthetic oligonucleotide
gtgagcgcaaggcggggaggaggcagaactgggtgtga

SEQ ID NO: 99120 - DNA, 37 bp, Artificial Sequence
  Synthetic oligonucleotide
gcatagggcgggtgaggtaacgggtagcagtttgtga

SEQ ID NO: 99121 - DNA, 38 bp, Artificial Sequence
  Synthetic oligonucleotide
gccgacgcatctaatggccttccggtcttgtccattga

SEQ ID NO: 99122 - DNA, 36 bp, Artificial Sequence
  Synthetic oligonucleotide
tcaggacacgagaaaatcgagaagggaagacgttga

SEQ ID NO: 99123 - DNA, 34 bp, Artificial Sequence
  Synthetic oligonucleotide
gcctgcctcttgtcactgcgttctccccttaata

SEQ ID NO: 99124 - DNA, 36 bp, Artificial Sequence
  Synthetic oligonucleotide
gtgccagctgcctgccaacagtcgcaacaggacata

SEQ ID NO: 99125 - DNA, 35 bp, Artificial Sequence
  Synthetic oligonucleotide
gaatcgcacccgatagcatagccccgtaggtgcta

SEQ ID NO: 99126 - DNA, 36 bp, Artificial Sequence
  Synthetic oligonucleotide
gttgcgcatccgcaacgatgtaaagcacttacatta

SEQ ID NO: 99127 - DNA, 35 bp, Artificial Sequence
  Synthetic oligonucleotide
catggagcactgactctgcctgctaacaaaagcac

SEQ ID NO: 99128 - DNA, 35 bp, Artificial Sequence
  Synthetic oligonucleotide
gaccaagtgaagcctcgtgctccgcccacctgcac

SEQ ID NO: 99129 - DNA, 35 bp, Artificial Sequence
  Synthetic oligonucleotide
aacccaacctcaggacagttcgcccattttgtcac

SEQ ID NO: 99130 - DNA, 35 bp, Artificial Sequence
  Synthetic oligonucleotide
ataccactcgtggcattgagcctgctacttaatac

SEQ ID NO: 99131 - DNA, 35 bp, Artificial Sequence
  Synthetic oligonucleotide
tacactggctgactatgtttcactggaaacagtac

SEQ ID NO: 99132 - DNA, 35 bp, Artificial Sequence
  Synthetic oligonucleotide
tcacccgcgaactcgacgcgcatacatccacgacc

SEQ ID NO: 99133 - DNA, 35 bp, Artificial Sequence
  Synthetic oligonucleotide
gtgtgcccgcgcgccgtctattcatcgctacatcc

SEQ ID NO: 99134 - DNA, 35 bp, Artificial Sequence
  Synthetic oligonucleotide
aacacacggggcaatgacgctagtgtagtggatcc

SEQ ID NO: 99135 - DNA, 35 bp, Artificial Sequence
  Synthetic oligonucleotide
tacccgccgaagcacagcgaatatgcgaggtttcc

SEQ ID NO: 99136 - DNA, 34 bp, Artificial Sequence
  Synthetic oligonucleotide
actcgctccggatggtttcttgtctccacaaacg

SEQ ID NO: 99137 - DNA, 35 bp, Artificial Sequence
  Synthetic oligonucleotide
gacattcacctatcttaattaagacgtggtatccg

SEQ ID NO: 99138 - DNA, 35 bp, Artificial Sequence
  Synthetic oligonucleotide
gttgccccagaggccctttatgatagagtgaggcg

SEQ ID NO: 99139 - DNA, 35 bp, Artificial Sequence
  Synthetic oligonucleotide
gtgtaggccccacttgttgcgcagctcttccacat

SEQ ID NO: 99140 - DNA, 35 bp, Artificial Sequence
  Synthetic oligonucleotide
tgatacgccaacgagaagcaagggaatcgtgacct

SEQ ID NO: 99141 - DNA, 35 bp, Artificial Sequence
  Synthetic oligonucleotide
gcccgaggaggagagatgtcaggacagatcccagt

SEQ ID NO: 99142 - DNA, 35 bp, Artificial Sequence
  Synthetic oligonucleotide
gtcaaacacccgtcaatatgtgaattatcggcagt

SEQ ID NO: 99143 - DNA, 35 bp, Artificial Sequence
  Synthetic oligonucleotide
tgcatagtcgagcattccagggcccatcgtttagt

SEQ ID NO: 99144 - DNA, 35 bp, Artificial Sequence
  Synthetic oligonucleotide
tacgccgtggccgctgtggcacattcaatacctgt

SEQ ID NO: 99145 - DNA, 35 bp, Artificial Sequence
  Synthetic oligonucleotide
gtcggaccgctgcataccgcctggttttttctatt

SEQ ID NO: 99146 - DNA, 35 bp, Artificial Sequence
  Synthetic oligonucleotide
tacacccatgcccctgttgataatcgtgaatcgtt

SEQ ID NO: 99147 - DNA, 35 bp, Artificial Sequence
  Synthetic oligonucleotide
tgctgggaggggtatggggcgtacattacgaattt

SEQ ID NO: 99148 - DNA, 35 bp, Artificial Sequence
  Synthetic oligonucleotide
gcattggaggcggagcgggaagaacgggttttgaa

SEQ ID NO: 99149 - DNA, 36 bp, Artificial Sequence
  Synthetic oligonucleotide
gacgcatcagctgtggtgtacttgggttgggtagca

SEQ ID NO: 99150 - DNA, 36 bp, Artificial Sequence
  Synthetic oligonucleotide
gaccaacagggctagggggcaggaggtggttacgca

SEQ ID NO: 99151 - DNA, 36 bp, Artificial Sequence
  Synthetic oligonucleotide
gattgcacagccaatctgatcgagcgggaccctgca

SEQ ID NO: 99152 - DNA, 37 bp, Artificial Sequence
  Synthetic oligonucleotide
aggatggggagcggtggaaagcaaccgggggttaaga

SEQ ID NO: 99153 - DNA, 37 bp, Artificial Sequence
  Synthetic oligonucleotide
gaatgggaccccgaagagaatcgagagacgtgtgaga

SEQ ID NO: 99154 - DNA, 37 bp, Artificial Sequence
  Synthetic oligonucleotide
acacacgtgccgtaataggggctaggagtactcccga

SEQ ID NO: 99155 - DNA, 37 bp, Artificial Sequence
  Synthetic oligonucleotide
taaatccgtacgaggaagtaaaaaggggaggcttcga

SEQ ID NO: 99156 - DNA, 37 bp, Artificial Sequence
  Synthetic oligonucleotide
gacagggtaacacaaaggcaaacgggcaatggttcga

SEQ ID NO: 99157 - DNA, 37 bp, Artificial Sequence
  Synthetic oligonucleotide
gccatggccgcctgggttttgcactttgacctgagga

SEQ ID NO: 99158 - DNA, 37 bp, Artificial Sequence
  Synthetic oligonucleotide
ttgcccgcactgagatctatcatcccgcgtcctagga

SEQ ID NO: 99159 - DNA, 35 bp, Artificial Sequence
  Synthetic oligonucleotide
tccaagaaaagcaggggcactggtgggggggtgga

SEQ ID NO: 99160 - DNA, 38 bp, Artificial Sequence
  Synthetic oligonucleotide
gactactgagctgtgacgtagggagctgggaggtatga

SEQ ID NO: 99161 - DNA, 38 bp, Artificial Sequence
  Synthetic oligonucleotide
atacgcaggcgcctgtctctatctacgacccctcctga

SEQ ID NO: 99162 - DNA, 38 bp, Artificial Sequence
  Synthetic oligonucleotide
cccgtcagagcgcgcgtggtccatctgacagtctctga

SEQ ID NO: 99163 - DNA, 37 bp, Artificial Sequence
  Synthetic oligonucleotide
gatgcgcgctcaagtacgtgaacccccgaatgtctga

SEQ ID NO: 99164 - DNA, 38 bp, Artificial Sequence
  Synthetic oligonucleotide
acaaccacgcgagaatgtaataaggggtagggttctga

SEQ ID NO: 99165 - DNA, 38 bp, Artificial Sequence
  Synthetic oligonucleotide
accggaggggggcataagtattgggagtaacaaggtga

SEQ ID NO: 99166 - DNA, 38 bp, Artificial Sequence
  Synthetic oligonucleotide
tcacacgcctcgtgagtcataactgatagccgcggtga

SEQ ID NO: 99167 - DNA, 38 bp, Artificial Sequence
  Synthetic oligonucleotide
gagatggccagctgttcgtatcccttcacctcatgtga

SEQ ID NO: 99168 - DNA, 38 bp, Artificial Sequence
  Synthetic oligonucleotide
tgcccccgcccgcggtcgtatttttgtctgtgcattga

SEQ ID NO: 99169 - DNA, 36 bp, Artificial Sequence
  Synthetic oligonucleotide
aaccttcgcctgtccctttcaatgaagccaatttga

SEQ ID NO: 99170 - DNA, 36 bp, Artificial Sequence
  Synthetic oligonucleotide
gacgagggtccagggactataacgagtccatcagta

SEQ ID NO: 99171 - DNA, 36 bp, Artificial Sequence
  Synthetic oligonucleotide
tctacacgtggaccctaatggaggaacgagcacgta

SEQ ID NO: 99172 - DNA, 35 bp, Artificial Sequence
  Synthetic oligonucleotide
gaactgcgcggtggtcatcaggtgaccatgcgtta

SEQ ID NO: 99173 - DNA, 35 bp, Artificial Sequence
  Synthetic oligonucleotide
atgtgacgccatcttgtagatcccagccaaattta

SEQ ID NO: 99174 - DNA, 35 bp, Artificial Sequence
  Synthetic oligonucleotide
atctagccacgttgtccgcgatgaacggccatacc

SEQ ID NO: 99175 - DNA, 35 bp, Artificial Sequence
  Synthetic oligonucleotide
gttccacgcctgtttgagtcccgaggccgctgccc

SEQ ID NO: 99176 - DNA, 34 bp, Artificial Sequence
  Synthetic oligonucleotide
ggacacacgctgcgtttcgtaagatcttggtgcc

SEQ ID NO: 99177 - DNA, 35 bp, Artificial Sequence
  Synthetic oligonucleotide
gcaccacagttaccgttgtacgttacaccatttcc

SEQ ID NO: 99178 - DNA, 35 bp, Artificial Sequence
  Synthetic oligonucleotide
gacttgcgagagggggggggttgtagaaggtgggc

SEQ ID NO: 99179 - DNA, 35 bp, Artificial Sequence
  Synthetic oligonucleotide
gtcatcacgttcctgccatagtttctgagttatgc

SEQ ID NO: 99180 - DNA, 35 bp, Artificial Sequence
  Synthetic oligonucleotide
tctgacactcgtgggaatatcagcccggttcgttc

SEQ ID NO: 99181 - DNA, 35 bp, Artificial Sequence
  Synthetic oligonucleotide
tacgccgttagcaccatggcatgagccccccaacg

SEQ ID NO: 99182 - DNA, 35 bp, Artificial Sequence
  Synthetic oligonucleotide
gaccgggaccgtggaaaagaggcaggaaatatggg

SEQ ID NO: 99183 - DNA, 35 bp, Artificial Sequence
  Synthetic oligonucleotide
tagtcatgcaatgcagtgccctataatgttcctgg

SEQ ID NO: 99184 - DNA, 35 bp, Artificial Sequence
  Synthetic oligonucleotide
tcatcccaggccatgaccactcccgttttgagtgg

SEQ ID NO: 99185 - DNA, 35 bp, Artificial Sequence
  Synthetic oligonucleotide
tagagagcggatagccgattgcatagggtagactg

SEQ ID NO: 99186 - DNA, 35 bp, Artificial Sequence
  Synthetic oligonucleotide
gacggtgcatcatcctgcaatcatctcatgtcctg

SEQ ID NO: 99187 - DNA, 35 bp, Artificial Sequence
  Synthetic oligonucleotide
gcagtcgaggacaggaaggaacgcgggaagtgcat

SEQ ID NO: 99188 - DNA, 35 bp, Artificial Sequence
  Synthetic oligonucleotide
gacaagcaaccgttgacgactatgagctagatcat

SEQ ID NO: 99189 - DNA, 35 bp, Artificial Sequence
  Synthetic oligonucleotide
tacgacacagcatataacgactttcacctcgcgat

SEQ ID NO: 99190 - DNA, 35 bp, Artificial Sequence
  Synthetic oligonucleotide
tcacccgtcagcaaatacataccggcctaacacct

SEQ ID NO: 99191 - DNA, 35 bp, Artificial Sequence
  Synthetic oligonucleotide
agcgagcaccgcgcgatcgctatgactactcccct

SEQ ID NO: 99192 - DNA, 35 bp, Artificial Sequence
  Synthetic oligonucleotide
gggaacccgcagtagtctttagcttgcctcgccct

SEQ ID NO: 99193 - DNA, 35 bp, Artificial Sequence
  Synthetic oligonucleotide
tggtcaaccgccctaacgttttatgactcgatcct

SEQ ID NO: 99194 - DNA, 35 bp, Artificial Sequence
  Synthetic oligonucleotide
gatagggcgggtcaacaaggaggagtgagaaggct

SEQ ID NO: 99195 - DNA, 35 bp, Artificial Sequence
  Synthetic oligonucleotide
gcctgaacaccgtagaccgtgaggtagtgctgtct

SEQ ID NO: 99196 - DNA, 35 bp, Artificial Sequence
  Synthetic oligonucleotide
acccgcagtggaacgccgattcatgcatttattct

SEQ ID NO: 99197 - DNA, 35 bp, Artificial Sequence
  Synthetic oligonucleotide
gaccaccgctcgactgagcacagtttagccttggt

SEQ ID NO: 99198 - DNA, 35 bp, Artificial Sequence
  Synthetic oligonucleotide
tcatcgcacaatctagtcgaaaccttacgaccgtt

SEQ ID NO: 99199 - DNA, 35 bp, Artificial Sequence
  Synthetic oligonucleotide
accgatgctagggggagcaatgagaagattccgtt

SEQ ID NO: 99200 - DNA, 35 bp, Artificial Sequence
  Synthetic oligonucleotide
acaggcctgcacctcgctatgtcacagtcgaattt

SEQ ID NO: 99201 - DNA, 36 bp, Artificial Sequence
  Synthetic oligonucleotide
aaccaacgtggtgggattacatagtactacgttaaa

SEQ ID NO: 99202 - DNA, 36 bp, Artificial Sequence
  Synthetic oligonucleotide
tgccactcgctcacagacctgccattatagtcacaa

SEQ ID NO: 99203 - DNA, 36 bp, Artificial Sequence
  Synthetic oligonucleotide
atgccgcactagctcttattcttgaaacgtgcccaa

SEQ ID NO: 99204 - DNA, 36 bp, Artificial Sequence
  Synthetic oligonucleotide
gagacacacgggaaggggcaagggcaatcacagcaa

SEQ ID NO: 99205 - DNA, 36 bp, Artificial Sequence
  Synthetic oligonucleotide
gttgcgcacgaatggttcaacattaagcgaggggaa

SEQ ID NO: 99206 - DNA, 36 bp, Artificial Sequence
  Synthetic oligonucleotide
gaacgacgcgtgtactaccctgtgccctccatgtaa

SEQ ID NO: 99207 - DNA, 36 bp, Artificial Sequence
  Synthetic oligonucleotide
tgcactggggggtgaggaaggccgagggagccaaca

SEQ ID NO: 99208 - DNA, 35 bp, Artificial Sequence
  Synthetic oligonucleotide
gagtgcccacacggggttagttcgagccttgacca

SEQ ID NO: 99209 - DNA, 37 bp, Artificial Sequence
  Synthetic oligonucleotide
ttgcgacgtcgcaggctaagtttggaaggggggaaga

SEQ ID NO: 99210 - DNA, 37 bp, Artificial Sequence
  Synthetic oligonucleotide
ggtagggtaccgcggactggtaaacggcgaattaaga

SEQ ID NO: 99211 - DNA, 37 bp, Artificial Sequence
  Synthetic oligonucleotide
gatagggggcatggaattgcataagtgatgggagaga

SEQ ID NO: 99212 - DNA, 37 bp, Artificial Sequence
  Synthetic oligonucleotide
ttgacgggccggggggaaaaggtcagctaatccgaga

SEQ ID NO: 99213 - DNA, 36 bp, Artificial Sequence
  Synthetic oligonucleotide
agatcgtacgctaattcccaacgggcacactggaga

SEQ ID NO: 99214 - DNA, 36 bp, Artificial Sequence
  Synthetic oligonucleotide
ttgcggaatgatgggactaaaggatgagggatgaga

SEQ ID NO: 99215 - DNA, 35 bp, Artificial Sequence
  Synthetic oligonucleotide
aatcacacagtccagccggcttaattagcttacga

SEQ ID NO: 99216 - DNA, 37 bp, Artificial Sequence
  Synthetic oligonucleotide
accatgggaaggatgtgtaccagacgtgatgaggcga

SEQ ID NO: 99217 - DNA, 37 bp, Artificial Sequence
  Synthetic oligonucleotide
tgacccgtgttgtgccgtagaagggtggtaggtgcga

SEQ ID NO: 99218 - DNA, 37 bp, Artificial Sequence
  Synthetic oligonucleotide
gatgggaagggcgaacaaaaggacgggtagccctcga

SEQ ID NO: 99219 - DNA, 37 bp, Artificial Sequence
  Synthetic oligonucleotide
actgagggtcggactaagagagatagcagcgaaagga

SEQ ID NO: 99220 - DNA, 36 bp, Artificial Sequence
  Synthetic oligonucleotide
tgcgaagacgaatgcaatggcgggtaggaacatgga

SEQ ID NO: 99221 - DNA, 38 bp, Artificial Sequence
  Synthetic oligonucleotide
aaccgccacgcaataagtggttgggaactgatgaatga

SEQ ID NO: 99222 - DNA, 37 bp, Artificial Sequence
  Synthetic oligonucleotide
agtcaagctcatccatcaagttgccacccacgcatga

SEQ ID NO: 99223 - DNA, 38 bp, Artificial Sequence
  Synthetic oligonucleotide
gcaacagttcggcacattgctgcgacactgccatatga

SEQ ID NO: 99224 - DNA, 37 bp, Artificial Sequence
  Synthetic oligonucleotide
ttccatcccgtgtcgcctattcggaactgtcgtatga

SEQ ID NO: 99225 - DNA, 38 bp, Artificial Sequence
  Synthetic oligonucleotide
gacaacgggatggaagcacaaaaaggggatgattatga

SEQ ID NO: 99226 - DNA, 38 bp, Artificial Sequence
  Synthetic oligonucleotide
gtagaccaacctcacccttctaagtaccctcatcctga

SEQ ID NO: 99227 - DNA, 38 bp, Artificial Sequence
  Synthetic oligonucleotide
gacaacgcaaaggttacatcagatcaatctttgagtga

SEQ ID NO: 99228 - DNA, 38 bp, Artificial Sequence
  Synthetic oligonucleotide
tccaccacgagtaaggggagaatgatggacaaaggtga

SEQ ID NO: 99229 - DNA, 38 bp, Artificial Sequence
  Synthetic oligonucleotide
gtaaaccggatgcatgttaagagcagatatggcggtga

SEQ ID NO: 99230 - DNA, 35 bp, Artificial Sequence
  Synthetic oligonucleotide
tgaagaaccggagtaggggcgtgatacagtggtga

SEQ ID NO: 99231 - DNA, 38 bp, Artificial Sequence
  Synthetic oligonucleotide
tgtggggcgggagggtctgcgggtagactacagtgtga

SEQ ID NO: 99232 - DNA, 38 bp, Artificial Sequence
  Synthetic oligonucleotide
tgacttggcgcagtgatcaactataaatgcaattgtga

SEQ ID NO: 99233 - DNA, 37 bp, Artificial Sequence
  Synthetic oligonucleotide
tgcaagcactcggggattttcttgctctttaaattga

SEQ ID NO: 99234 - DNA, 35 bp, Artificial Sequence
  Synthetic oligonucleotide
tccactcacggctttggataacaccacagggttga

SEQ ID NO: 99235 - DNA, 38 bp, Artificial Sequence
  Synthetic oligonucleotide
gtgactgtgccatatgcgaattgtggccttccatttga

SEQ ID NO: 99236 - DNA, 36 bp, Artificial Sequence
  Synthetic oligonucleotide
gaatacggtggagatgcttagtcgggaaggcatata

SEQ ID NO: 99237 - DNA, 35 bp, Artificial Sequence
  Synthetic oligonucleotide
gccggtcgggcacttgttttcgtaataccagggta

SEQ ID NO: 99238 - DNA, 35 bp, Artificial Sequence
  Synthetic oligonucleotide
gagcccacacataaaacagcaggttctcacaacac

SEQ ID NO: 99239 - DNA, 35 bp, Artificial Sequence
  Synthetic oligonucleotide
accaatgctacgtacatcgtgctgccccgttctac

SEQ ID NO: 99240 - DNA, 35 bp, Artificial Sequence
  Synthetic oligonucleotide
tcctcttgcgcatagatgctccctcgcctagtgcc

SEQ ID NO: 99241 - DNA, 35 bp, Artificial Sequence
  Synthetic oligonucleotide
gtgacaccatctaaatcgtggaggtccctaaccgc

SEQ ID NO: 99242 - DNA, 35 bp, Artificial Sequence
  Synthetic oligonucleotide
accaaccaccataataaggaccagggctaccactc

SEQ ID NO: 99243 - DNA, 35 bp, Artificial Sequence
  Synthetic oligonucleotide
gacgctccgggccaagttccatcataaggctgctc

SEQ ID NO: 99244 - DNA, 35 bp, Artificial Sequence
  Synthetic oligonucleotide
tgaactcagctcctcctcgtcaagcagccattctc

SEQ ID NO: 99245 - DNA, 35 bp, Artificial Sequence
  Synthetic oligonucleotide
ttagcccaggcataactaggaaaatgcgtgacttc

SEQ ID NO: 99246 - DNA, 35 bp, Artificial Sequence
  Synthetic oligonucleotide
tatggaggaggaggggtcgaggtggacgggtacag

SEQ ID NO: 99247 - DNA, 35 bp, Artificial Sequence
  Synthetic oligonucleotide
attgcctgcctttccgttctgcctcttgcgcctcg

SEQ ID NO: 99248 - DNA, 35 bp, Artificial Sequence
  Synthetic oligonucleotide
gacaaccacatttgttatatactatccgtgttagg

SEQ ID NO: 99249 - DNA, 35 bp, Artificial Sequence
  Synthetic oligonucleotide
agagtcagacagtttcaatggaatggagggagggg

SEQ ID NO: 99250 - DNA, 35 bp, Artificial Sequence
  Synthetic oligonucleotide
actcaccagcaactaaggatcacgacgacagactg

SEQ ID NO: 99251 - DNA, 35 bp, Artificial Sequence
  Synthetic oligonucleotide
tgaatcatccccgcgcgtattggtccgcatacttg

SEQ ID NO: 99252 - DNA, 35 bp, Artificial Sequence
  Synthetic oligonucleotide
taacaccaacctcggagggcataacaccttccttg

SEQ ID NO: 99253 - DNA, 35 bp, Artificial Sequence
  Synthetic oligonucleotide
ggacggagggccaggtggatggttacggctaggat

SEQ ID NO: 99254 - DNA, 35 bp, Artificial Sequence
  Synthetic oligonucleotide
ttcactgaacgcatggaatcctacttgagccatat

SEQ ID NO: 99255 - DNA, 35 bp, Artificial Sequence
  Synthetic oligonucleotide
ttgtacgcgccaccgaaaattcgacgtgtcatcct

SEQ ID NO: 99256 - DNA, 35 bp, Artificial Sequence
  Synthetic oligonucleotide
acgtactgcgcacctgagccctctatttctcccgt

SEQ ID NO: 99257 - DNA, 35 bp, Artificial Sequence
  Synthetic oligonucleotide
atgacaaagatggtaggtgatataggggcaacgtt

SEQ ID NO: 99258 - DNA, 35 bp, Artificial Sequence
  Synthetic oligonucleotide
gactgcaatggcacgaatatagggttgggacagaa

SEQ ID NO: 99259 - DNA, 36 bp, Artificial Sequence
  Synthetic oligonucleotide
acacgcatggtggtcggctatgtagtagtaaaggaa

SEQ ID NO: 99260 - DNA, 35 bp, Artificial Sequence
  Synthetic oligonucleotide
acacaggcgcacgcacgagccaaggaccaggataa

SEQ ID NO: 99261 - DNA, 35 bp, Artificial Sequence
  Synthetic oligonucleotide
atcacgcacccaactgtcagagaacggcattaaca

SEQ ID NO: 99262 - DNA, 35 bp, Artificial Sequence
  Synthetic oligonucleotide
gcatgggagaacggtggaaagtggttaagcgcaca

SEQ ID NO: 99263 - DNA, 35 bp, Artificial Sequence
  Synthetic oligonucleotide
gatgagagtgttgagggacgatagggggaggggca

SEQ ID NO: 99264 - DNA, 35 bp, Artificial Sequence
  Synthetic oligonucleotide
atctgccacccggcctgtaccgactcttcgtggca

SEQ ID NO: 99265 - DNA, 35 bp, Artificial Sequence
  Synthetic oligonucleotide
aacacgtggtgcatcaatgaagccatggtcgatca

SEQ ID NO: 99266 - DNA, 35 bp, Artificial Sequence
  Synthetic oligonucleotide
ggatcaactccacattcatcacccggtccacctca

SEQ ID NO: 99267 - DNA, 36 bp, Artificial Sequence
  Synthetic oligonucleotide
gaagacccaacagactagaccgtgttacgggagtca

SEQ ID NO: 99268 - DNA, 37 bp, Artificial Sequence
  Synthetic oligonucleotide
gaggggcactggataagtggtataagagtggaaaaga

SEQ ID NO: 99269 - DNA, 37 bp, Artificial Sequence
  Synthetic oligonucleotide
gtgtcaccacctcagtactgttcctttcggactaaga

SEQ ID NO: 99270 - DNA, 37 bp, Artificial Sequence
  Synthetic oligonucleotide
actgggctgggtggtgggcgacgaggatgcactgaga

SEQ ID NO: 99271 - DNA, 37 bp, Artificial Sequence
  Synthetic oligonucleotide
tgaggccgagaaacatagaaagggagaaataagtaga

SEQ ID NO: 99272 - DNA, 37 bp, Artificial Sequence
  Synthetic oligonucleotide
gatgacgaacattttctgtgacagtttcccgtgacga

SEQ ID NO: 99273 - DNA, 36 bp, Artificial Sequence
  Synthetic oligonucleotide
gtgtggctgccacatggcctgaaacgagctgaccga

SEQ ID NO: 99274 - DNA, 35 bp, Artificial Sequence
  Synthetic oligonucleotide
gacaaccccgaatctgtccatatccatagccccga

SEQ ID NO: 99275 - DNA, 35 bp, Artificial Sequence
  Synthetic oligonucleotide
gccgaaccgtccgtgttttcctttgtatccagcga

SEQ ID NO: 99276 - DNA, 36 bp, Artificial Sequence
  Synthetic oligonucleotide
gaagggagggggctagaggttttgtgggagcttcga

SEQ ID NO: 99277 - DNA, 37 bp, Artificial Sequence
  Synthetic oligonucleotide
acatgcatggtggacttgagagatcggcatgcaagga

SEQ ID NO: 99278 - DNA, 37 bp, Artificial Sequence
  Synthetic oligonucleotide
aatgggagagcgagagggagtaaggccgggagaagga

SEQ ID NO: 99279 - DNA, 37 bp, Artificial Sequence
  Synthetic oligonucleotide
acttccagcatcggagtacggactgctctgtgaagga

SEQ ID NO: 99280 - DNA, 37 bp, Artificial Sequence
  Synthetic oligonucleotide
agagaagacaagggggcacaacgagacccggagagga

SEQ ID NO: 99281 - DNA, 37 bp, Artificial Sequence
  Synthetic oligonucleotide
tatgtacgccaagctgcgattagctgactctctcgga

SEQ ID NO: 99282 - DNA, 37 bp, Artificial Sequence
  Synthetic oligonucleotide
actgcggaaagcagtacagctcgatatatggtatgga

SEQ ID NO: 99283 - DNA, 37 bp, Artificial Sequence
  Synthetic oligonucleotide
tagcgatgcagtgagggtgaataggtagattggtgga

SEQ ID NO: 99284 - DNA, 37 bp, Artificial Sequence
  Synthetic oligonucleotide
tacgagacgcacatcggtagagtgtgtccttctatga

SEQ ID NO: 99285 - DNA, 38 bp, Artificial Sequence
  Synthetic oligonucleotide
ggaccatgctgaggaactgaataggggggatgaactga

SEQ ID NO: 99286 - DNA, 38 bp, Artificial Sequence
  Synthetic oligonucleotide
tcacccgcccctccccaatcaaaccactgtccgagtga

SEQ ID NO: 99287 - DNA, 38 bp, Artificial Sequence
  Synthetic oligonucleotide
ttcatggcagacagggaacagggcaagaggtggagtga

SEQ ID NO: 99288 - DNA, 37 bp, Artificial Sequence
  Synthetic oligonucleotide
agcatggcgggaggataagggagtgtaaaccgggtga

SEQ ID NO: 99289 - DNA, 38 bp, Artificial Sequence
  Synthetic oligonucleotide
gatgacaggcgcaagtgggggtgagcgacttgatgtga

SEQ ID NO: 99290 - DNA, 38 bp, Artificial Sequence
  Synthetic oligonucleotide
gtggaaacgcccgacctcccaatctgctcgccgattga

SEQ ID NO: 99291 - DNA, 38 bp, Artificial Sequence
  Synthetic oligonucleotide
agtgtgacgggacaagagacaggtagagagaggattga

SEQ ID NO: 99292 - DNA, 36 bp, Artificial Sequence
  Synthetic oligonucleotide
taacagcccttagcaggacgaaagaccagagagcta

SEQ ID NO: 99293 - DNA, 36 bp, Artificial Sequence
  Synthetic oligonucleotide
acacactgtggtgctaaacgtacgggcctggggcta

SEQ ID NO: 99294 - DNA, 36 bp, Artificial Sequence
  Synthetic oligonucleotide
gttgccagcagggaattcatgagcgggaagtatcta

SEQ ID NO: 99295 - DNA, 36 bp, Artificial Sequence
  Synthetic oligonucleotide
gttaacagccctcatcaccaggtaagctttgctgta

SEQ ID NO: 99296 - DNA, 35 bp, Artificial Sequence
  Synthetic oligonucleotide
ttgcgaagtcagtacgttcgcacgtgaggaggtta

SEQ ID NO: 99297 - DNA, 35 bp, Artificial Sequence
  Synthetic oligonucleotide
gagctacgcataagccctatcgtgcactttaacac

SEQ ID NO: 99298 - DNA, 35 bp, Artificial Sequence
  Synthetic oligonucleotide
gtctgcagaaaggggaagggagaattgtgcccgac

SEQ ID NO: 99299 - DNA, 35 bp, Artificial Sequence
  Synthetic oligonucleotide
tcaacacgagggggtaattaccgggagcaggcgac

SEQ ID NO: 99300 - DNA, 35 bp, Artificial Sequence
  Synthetic oligonucleotide
tgcgctcttgacgatcctctaatgtcctgctcgac

SEQ ID NO: 99301 - DNA, 35 bp, Artificial Sequence
  Synthetic oligonucleotide
tgtccccgcccactcagtgctataggcaagtaacc

SEQ ID NO: 99302 - DNA, 35 bp, Artificial Sequence
  Synthetic oligonucleotide
gacaacgcctccattcgcattcgactaccactacc

SEQ ID NO: 99303 - DNA, 35 bp, Artificial Sequence
  Synthetic oligonucleotide
aacgagtggggccaagttggggggcgataaacggc

SEQ ID NO: 99304 - DNA, 35 bp, Artificial Sequence
  Synthetic oligonucleotide
atgcgagaagacatggaggggaggatgaatgtgtc

SEQ ID NO: 99305 - DNA, 32 bp, Artificial Sequence
  Synthetic oligonucleotide
tgtcacgttcgcgggccctcttcacagaattc

SEQ ID NO: 99306 - DNA, 35 bp, Artificial Sequence
  Synthetic oligonucleotide
tgacccggccatctgaatgctcccctcagtccttc

SEQ ID NO: 99307 - DNA, 35 bp, Artificial Sequence
  Synthetic oligonucleotide
agtgtggacggaggtacagaggagtgcttattacg

SEQ ID NO: 99308 - DNA, 35 bp, Artificial Sequence
  Synthetic oligonucleotide
gtgtaagcaccaacaccgctataccttccccatcg

SEQ ID NO: 99309 - DNA, 35 bp, Artificial Sequence
  Synthetic oligonucleotide
aacaagtgggtggggggggaagggtagtagatagg

SEQ ID NO: 99310 - DNA, 35 bp, Artificial Sequence
  Synthetic oligonucleotide
tacacccccaaacgttgcattactagcatacacat

SEQ ID NO: 99311 - DNA, 35 bp, Artificial Sequence
  Synthetic oligonucleotide
tgaaaagcggaacatagaaaccattgatgagacat

SEQ ID NO: 99312 - DNA, 35 bp, Artificial Sequence
  Synthetic oligonucleotide
acgcacgggtacacggtctttgctaattccctcat

SEQ ID NO: 99313 - DNA, 35 bp, Artificial Sequence
  Synthetic oligonucleotide
gccaagtaccgccgcatttatgaaccatcctgact

SEQ ID NO: 99314 - DNA, 35 bp, Artificial Sequence
  Synthetic oligonucleotide
atcgtccctcggcagaatttcccttagttagtact

SEQ ID NO: 99315 - DNA, 35 bp, Artificial Sequence
  Synthetic oligonucleotide
gtgacacctaagctgcggtcagggcctactcctgt

SEQ ID NO: 99316 - DNA, 33 bp, Artificial Sequence
  Synthetic oligonucleotide
tagacggaggaacggaggtgggagtcaaggaaa

SEQ ID NO: 99317 - DNA, 36 bp, Artificial Sequence
  Synthetic oligonucleotide
tccaaacgacagcttgcccaccttacactatttaaa

SEQ ID NO: 99318 - DNA, 36 bp, Artificial Sequence
  Synthetic oligonucleotide
gtgtaaaacaggaggcatgaggaaggggtcaggcaa

SEQ ID NO: 99319 - DNA, 36 bp, Artificial Sequence
  Synthetic oligonucleotide
aaccaggagaatcggtggaggagatgaaaagggtaa

SEQ ID NO: 99320 - DNA, 36 bp, Artificial Sequence
  Synthetic oligonucleotide
tgcaaagccagggtaggagttgggggatgggcaaca

SEQ ID NO: 99321 - DNA, 36 bp, Artificial Sequence
  Synthetic oligonucleotide
ggagtgacaggggcgatcagaaaagatgggcggaca

SEQ ID NO: 99322 - DNA, 36 bp, Artificial Sequence
  Synthetic oligonucleotide
tattggctgagaccctccgctcacttccagtttaca

SEQ ID NO: 99323 - DNA, 36 bp, Artificial Sequence
  Synthetic oligonucleotide
atcgacgacgacagctcgagcgcccctcctctgcca

SEQ ID NO: 99324 - DNA, 36 bp, Artificial Sequence
  Synthetic oligonucleotide
tgatgtgacgggtggagatataacacatagaaatca

SEQ ID NO: 99325 - DNA, 36 bp, Artificial Sequence
  Synthetic oligonucleotide
tgccgccaaaacgtacattgtaccggtcttctatca

SEQ ID NO: 99326 - DNA, 37 bp, Artificial Sequence
  Synthetic oligonucleotide
gccatgtacgtcagataaggcggtaatgggagggaga

SEQ ID NO: 99327 - DNA, 37 bp, Artificial Sequence
  Synthetic oligonucleotide
aatgcacgcacaggaaggggagatttacagcagacga

SEQ ID NO: 99328 - DNA, 35 bp, Artificial Sequence
  Synthetic oligonucleotide
tcacccaaccgccatggggtctgtgtactcaccga

SEQ ID NO: 99329 - DNA, 36 bp, Artificial Sequence
  Synthetic oligonucleotide
gtcccaggacacccgtaacagctataccacgcccga

SEQ ID NO: 99330 - DNA, 37 bp, Artificial Sequence
  Synthetic oligonucleotide
tagtgctgcatacagttgcatgttcccgcggtcccga

SEQ ID NO: 99331 - DNA, 37 bp, Artificial Sequence
  Synthetic oligonucleotide
gtgaagcagtcgttcgagggagtgttagggggagcga

SEQ ID NO: 99332 - DNA, 35 bp, Artificial Sequence
  Synthetic oligonucleotide
gagtggagtgctagttagggaatgagtctgagcga

SEQ ID NO: 99333 - DNA, 37 bp, Artificial Sequence
  Synthetic oligonucleotide
gcacactcgcttacctgtactacagccacatgcagga

SEQ ID NO: 99334 - DNA, 35 bp, Artificial Sequence
  Synthetic oligonucleotide
gcgatggtggaaggggtatgcaagggtgcatagga

SEQ ID NO: 99335 - DNA, 37 bp, Artificial Sequence
  Synthetic oligonucleotide
gaaccgcacacatgagtaaactgacgttggattggga

SEQ ID NO: 99336 - DNA, 37 bp, Artificial Sequence
  Synthetic oligonucleotide
gaccacggagtatgtcatatggtccgtccattgtgga

SEQ ID NO: 99337 - DNA, 38 bp, Artificial Sequence
  Synthetic oligonucleotide
tcacgcgccggaataattggagagagagtaaggaatga

SEQ ID NO: 99338 - DNA, 37 bp, Artificial Sequence
  Synthetic oligonucleotide
tgatacgccgacgttatcgtaccctcagctgccctga

SEQ ID NO: 99339 - DNA, 38 bp, Artificial Sequence
  Synthetic oligonucleotide
aaacagtcgcaatgtatgatctgccacaatacttctga

SEQ ID NO: 99340 - DNA, 38 bp, Artificial Sequence
  Synthetic oligonucleotide
atggacagggcgggtcagtcaaatggaaaggtaagtga

SEQ ID NO: 99341 - DNA, 38 bp, Artificial Sequence
  Synthetic oligonucleotide
aactacgcagggccgtacacatggacgatacctagtga

SEQ ID NO: 99342 - DNA, 38 bp, Artificial Sequence
  Synthetic oligonucleotide
gaccgacgaccacagtgatcgtaattcgccctcggtga

SEQ ID NO: 99343 - DNA, 37 bp, Artificial Sequence
  Synthetic oligonucleotide
tcacgtgtctgaaaaaagtgacgtgaagagggggtga

SEQ ID NO: 99344 - DNA, 38 bp, Artificial Sequence
  Synthetic oligonucleotide
accccgtgcggagtataggattaagggtgttgctgtga

SEQ ID NO: 99345 - DNA, 38 bp, Artificial Sequence
  Synthetic oligonucleotide
accagctgcctgggtcatcctcacttaacctctgttga

SEQ ID NO: 99346 - DNA, 38 bp, Artificial Sequence
  Synthetic oligonucleotide
actcagccgcacgtggacagagaacgcgtaattgttga

SEQ ID NO: 99347 - DNA, 37 bp, Artificial Sequence
  Synthetic oligonucleotide
aacgagggccatagtggtagtacggaggataatttga

SEQ ID NO: 99348 - DNA, 37 bp, Artificial Sequence
  Synthetic oligonucleotide
gtgttgcgcaagctcataggacaaccccgcattttga

SEQ ID NO: 99349 - DNA, 36 bp, Artificial Sequence
  Synthetic oligonucleotide
gacgaagagcgcacagtagagcttgtaaaagtgcta

SEQ ID NO: 99350 - DNA, 36 bp, Artificial Sequence
  Synthetic oligonucleotide
gtacgacatcctggcctgtgaacgttctactgagta

SEQ ID NO: 99351 - DNA, 35 bp, Artificial Sequence
  Synthetic oligonucleotide
acagccgcaagacaaacaagtactggatgtaggta

SEQ ID NO: 99352 - DNA, 35 bp, Artificial Sequence
  Synthetic oligonucleotide
acgaaaggactgtggggtgtaggtagagaggggta

SEQ ID NO: 99353 - DNA, 36 bp, Artificial Sequence
  Synthetic oligonucleotide
taagcatcggaggagagatcgggggtaaatgtggta

SEQ ID NO: 99354 - DNA, 35 bp, Artificial Sequence
  Synthetic oligonucleotide
tgctcaagcggctccatccctcagtcagttcccac

SEQ ID NO: 99355 - DNA, 35 bp, Artificial Sequence
  Synthetic oligonucleotide
tgaggctacagctttaagaccactgctgactccac

SEQ ID NO: 99356 - DNA, 35 bp, Artificial Sequence
  Synthetic oligonucleotide
gccctccgacgtgacgtgcccggtctggctagtac

SEQ ID NO: 99357 - DNA, 35 bp, Artificial Sequence
  Synthetic oligonucleotide
tacgccccagcacttccatatcgtcaaccggcgcc

SEQ ID NO: 99358 - DNA, 35 bp, Artificial Sequence
  Synthetic oligonucleotide
gtgagccccgttgaccacaccccctcgctttggcc

SEQ ID NO: 99359 - DNA, 35 bp, Artificial Sequence
  Synthetic oligonucleotide
gtagcccgtcattcctgtaccgcctgcatctatcc

SEQ ID NO: 99360 - DNA, 35 bp, Artificial Sequence
  Synthetic oligonucleotide
acgagccacctggggggtctccctcaaatttttcc

SEQ ID NO: 99361 - DNA, 35 bp, Artificial Sequence
  Synthetic oligonucleotide
caaaacacccccgttagacagccgctgcgcacagc

SEQ ID NO: 99362 - DNA, 35 bp, Artificial Sequence
  Synthetic oligonucleotide
gcgcaaccacgtctaactcgtccggctcttgattc

SEQ ID NO: 99363 - DNA, 36 bp, Artificial Sequence
  Synthetic oligonucleotide
gtgcaatcctggcctgctgctattttttgttcacag

SEQ ID NO: 99364 - DNA, 35 bp, Artificial Sequence
  Synthetic oligonucleotide
tatgacagtgtcgaaacggggaggtacatatgcag

SEQ ID NO: 99365 - DNA, 35 bp, Artificial Sequence
  Synthetic oligonucleotide
gcgaccccgcccacaccctttacatcaactgttcg

SEQ ID NO: 99366 - DNA, 35 bp, Artificial Sequence
  Synthetic oligonucleotide
gcaaccgagggggagaaatatatcgatttaagtgg

SEQ ID NO: 99367 - DNA, 35 bp, Artificial Sequence
  Synthetic oligonucleotide
gatagcgcaaaggtcaaaattggagggccgggctg

SEQ ID NO: 99368 - DNA, 35 bp, Artificial Sequence
  Synthetic oligonucleotide
gctcatgcacactccagcctatggccgacgatcat

SEQ ID NO: 99369 - DNA, 35 bp, Artificial Sequence
  Synthetic oligonucleotide
atacgggagagcaggaagacataagaggtgaggat

SEQ ID NO: 99370 - DNA, 35 bp, Artificial Sequence
  Synthetic oligonucleotide
gcccctcacaggaccgaaactggctcatcactgat

SEQ ID NO: 99371 - DNA, 35 bp, Artificial Sequence
  Synthetic oligonucleotide
aatgccagtgcacgtagggtaaacattcttttgat

SEQ ID NO: 99372 - DNA, 35 bp, Artificial Sequence
  Synthetic oligonucleotide
atggataagccatcgcaccctgtcccatctgttat

SEQ ID NO: 99373 - DNA, 35 bp, Artificial Sequence
  Synthetic oligonucleotide
tcgacgacggacgtaatgggaacaatttggtacgt

SEQ ID NO: 99374 - DNA, 35 bp, Artificial Sequence
  Synthetic oligonucleotide
ggtctcgctagagaacacgcattaccttacatggt

SEQ ID NO: 99375 - DNA, 35 bp, Artificial Sequence
  Synthetic oligonucleotide
acccgccaggagtacgattcttcttaaaccggttt

SEQ ID NO: 99376 - DNA, 35 bp, Artificial Sequence
  Synthetic oligonucleotide
tgtgcgcgtgctcctgccacttcgggttttatttt

SEQ ID NO: 99377 - DNA, 35 bp, Artificial Sequence
  Synthetic oligonucleotide
tacacacgtggaggagccgagtgtagtgcgtaaaa

SEQ ID NO: 99378 - DNA, 35 bp, Artificial Sequence
  Synthetic oligonucleotide
tccacaacagagtaaactggaccgattaacaccaa

SEQ ID NO: 99379 - DNA, 36 bp, Artificial Sequence
  Synthetic oligonucleotide
tccacccctcaacgctagaagagcaggtcaggccaa

SEQ ID NO: 99380 - DNA, 36 bp, Artificial Sequence
  Synthetic oligonucleotide
atgtacgcaggtgtatctaatggccatctgcctgaa

SEQ ID NO: 99381 - DNA, 36 bp, Artificial Sequence
  Synthetic oligonucleotide
tgaccgccagtgaaaagacatggacataggagataa

SEQ ID NO: 99382 - DNA, 36 bp, Artificial Sequence
  Synthetic oligonucleotide
ttgacggaggagcagagttgtcggctgaatggataa

SEQ ID NO: 99383 - DNA, 36 bp, Artificial Sequence
  Synthetic oligonucleotide
aacctaacgccaagtgtctcgttacaatatcgctaa

SEQ ID NO: 99384 - DNA, 36 bp, Artificial Sequence
  Synthetic oligonucleotide
tgcgctccgtctaatgtcgcctctgcttccttacca

SEQ ID NO: 99385 - DNA, 35 bp, Artificial Sequence
  Synthetic oligonucleotide
tgatggagagcagaaatgggagaatgggatggcca

SEQ ID NO: 99386 - DNA, 36 bp, Artificial Sequence
  Synthetic oligonucleotide
tcccaccccgccgtatcatgaccggccttatggcca

SEQ ID NO: 99387 - DNA, 35 bp, Artificial Sequence
  Synthetic oligonucleotide
gaggatggacaacgcaaaagggcgggggtagagca

SEQ ID NO: 99388 - DNA, 37 bp, Artificial Sequence
  Synthetic oligonucleotide
tgcacccctcagcgctccctcgccaatctttccggca

SEQ ID NO: 99389 - DNA, 37 bp, Artificial Sequence
  Synthetic oligonucleotide
gagagagcgtaagcagaatgatggtggggataaaaga

SEQ ID NO: 99390 - DNA, 36 bp, Artificial Sequence
  Synthetic oligonucleotide
gtcaacggaggtcgtggacggcggtaaataggaaga

SEQ ID NO: 99391 - DNA, 36 bp, Artificial Sequence
  Synthetic oligonucleotide
aactgggcacgaggggaccgaagatcttggttacga

SEQ ID NO: 99392 - DNA, 37 bp, Artificial Sequence
  Synthetic oligonucleotide
gatggagtgcgcagacataaaactactgctatatcga

SEQ ID NO: 99393 - DNA, 37 bp, Artificial Sequence
  Synthetic oligonucleotide
ggatggaaacagtgagcgtgaagtcagaatggcagga

SEQ ID NO: 99394 - DNA, 37 bp, Artificial Sequence
  Synthetic oligonucleotide
aacacaccatcatcatgagttgaagatgtagtcagga

SEQ ID NO: 99395 - DNA, 37 bp, Artificial Sequence
  Synthetic oligonucleotide
gagcacccatccggaatttgactgactgagaatcgga

SEQ ID NO: 99396 - DNA, 37 bp, Artificial Sequence
  Synthetic oligonucleotide
agtcaccggccactgcattttctggacccgattcgga

SEQ ID NO: 99397 - DNA, 37 bp, Artificial Sequence
  Synthetic oligonucleotide
gcgcaactgcgcgcgtaatttcgaagtatacaaggga

SEQ ID NO: 99398 - DNA, 38 bp, Artificial Sequence
  Synthetic oligonucleotide
gactgtcgtacagcatccgttcccgaagcctccaatga

SEQ ID NO: 99399 - DNA, 38 bp, Artificial Sequence
  Synthetic oligonucleotide
acacagggctaatggtgttggagtggagcacaggatga

SEQ ID NO: 99400 - DNA, 37 bp, Artificial Sequence
  Synthetic oligonucleotide
gagacgcaccaatgagtgcatcatgtgatgtaactga

SEQ ID NO: 99401 - DNA, 37 bp, Artificial Sequence
  Synthetic oligonucleotide
tgtcatccagcctccctagcatattgcggtatcctga

SEQ ID NO: 99402 - DNA, 38 bp, Artificial Sequence
  Synthetic oligonucleotide
tcacctaccactgtcgccgctcccctccgtagatctga

SEQ ID NO: 99403 - DNA, 38 bp, Artificial Sequence
  Synthetic oligonucleotide
ttgcagtgcgaaatggcctgcgagcatccacactctga

SEQ ID NO: 99404 - DNA, 37 bp, Artificial Sequence
  Synthetic oligonucleotide
gtgagagcggaggggaattgaagttagtactgagtga

SEQ ID NO: 99405 - DNA, 38 bp, Artificial Sequence
  Synthetic oligonucleotide
ggtgaattgagagtggggaaaggggaacaatggggtga

SEQ ID NO: 99406 - DNA, 38 bp, Artificial Sequence
  Synthetic oligonucleotide
agcacctcgccctgtgatctgccctcaagtcgcattga

SEQ ID NO: 99407 - DNA, 37 bp, Artificial Sequence
  Synthetic oligonucleotide
tgcatgccccctaccctgtatttgcacgatgccttga

SEQ ID NO: 99408 - DNA, 37 bp, Artificial Sequence
  Synthetic oligonucleotide
taacacgctgcaggtagtaccaactcacgtgtcttga

SEQ ID NO: 99409 - DNA, 38 bp, Artificial Sequence
  Synthetic oligonucleotide
tccacggcgtaggccgtaacctccgtagtcctgtttga

SEQ ID NO: 99410 - DNA, 36 bp, Artificial Sequence
  Synthetic oligonucleotide
gtacgcgtcccataggcgtactctacttggttttta

SEQ ID NO: 99411 - DNA, 35 bp, Artificial Sequence
  Synthetic oligonucleotide
gtggggggaagtagcatataggggcattgaaagac

SEQ ID NO: 99412 - DNA, 35 bp, Artificial Sequence
  Synthetic oligonucleotide
aagccacatacggactctacgatatctgcgtgacc

SEQ ID NO: 99413 - DNA, 35 bp, Artificial Sequence
  Synthetic oligonucleotide
gaacacgagcctcggatagcgagatgccatttacc

SEQ ID NO: 99414 - DNA, 35 bp, Artificial Sequence
  Synthetic oligonucleotide
acctcgggcacccatgccaacgaagttcattctcc

SEQ ID NO: 99415 - DNA, 35 bp, Artificial Sequence
  Synthetic oligonucleotide
gtacacccagacactgaactttgacataggaaggc

SEQ ID NO: 99416 - DNA, 35 bp, Artificial Sequence
  Synthetic oligonucleotide
acccctccacccttatacattagcatggcacctgc

SEQ ID NO: 99417 - DNA, 35 bp, Artificial Sequence
  Synthetic oligonucleotide
gtcacacaggttctcgtcctaatatcgggtttgtc

SEQ ID NO: 99418 - DNA, 35 bp, Artificial Sequence
  Synthetic oligonucleotide
tcgcacgtcactgtttgtacttcgttgcccgtttc

SEQ ID NO: 99419 - DNA, 35 bp, Artificial Sequence
  Synthetic oligonucleotide
gctggtgcgagggaggaggaaagtttagagatacg

SEQ ID NO: 99420 - DNA, 35 bp, Artificial Sequence
  Synthetic oligonucleotide
tcaccgaacgtaggggcttaacaggatcttgattg

SEQ ID NO: 99421 - DNA, 35 bp, Artificial Sequence
  Synthetic oligonucleotide
ggagaggaatcgtgggttgaacaggagagtgacat

SEQ ID NO: 99422 - DNA, 35 bp, Artificial Sequence
  Synthetic oligonucleotide
gccatcctcaaggccataaacagggaacgctgact

SEQ ID NO: 99423 - DNA, 35 bp, Artificial Sequence
  Synthetic oligonucleotide
gcagtggaaatgaggatggaaagtctacggagggt

SEQ ID NO: 99424 - DNA, 35 bp, Artificial Sequence
  Synthetic oligonucleotide
agcacgatgctgggtgcatcaattatactgggggt

SEQ ID NO: 99425 - DNA, 35 bp, Artificial Sequence
  Synthetic oligonucleotide
atgcatcggtaagagcacataggggcggatatatt

SEQ ID NO: 99426 - DNA, 35 bp, Artificial Sequence
  Synthetic oligonucleotide
gacgcaggcgcgtgtgtcggtcctctccggtactt

SEQ ID NO: 99427 - DNA, 35 bp, Artificial Sequence
  Synthetic oligonucleotide
aagtcaaccgcactcagccaccacgcacaatcgtt

SEQ ID NO: 99428 - DNA, 36 bp, Artificial Sequence
  Synthetic oligonucleotide
gacgaaatgcaaaaggatgaaggtaggttatggcaa

SEQ ID NO: 99429 - DNA, 35 bp, Artificial Sequence
  Synthetic oligonucleotide
gaccccacagccggagattttttgctagtcaaaca

SEQ ID NO: 99430 - DNA, 36 bp, Artificial Sequence
  Synthetic oligonucleotide
ggaccactgcaaacgtttatcgcccaggattcaaca

SEQ ID NO: 99431 - DNA, 35 bp, Artificial Sequence
  Synthetic oligonucleotide
gacaagcgataccgaagccgaattcgcacttgaca

SEQ ID NO: 99432 - DNA, 36 bp, Artificial Sequence
  Synthetic oligonucleotide
gatgactcaagctgtgattctcgcgggggccaccca

SEQ ID NO: 99433 - DNA, 36 bp, Artificial Sequence
  Synthetic oligonucleotide
tgacacgaccggagaaaggagggacatactggatca

SEQ ID NO: 99434 - DNA, 34 bp, Artificial Sequence
  Synthetic oligonucleotide
atacagccgcctagtgtcccccatccacctgtca

SEQ ID NO: 99435 - DNA, 37 bp, Artificial Sequence
  Synthetic oligonucleotide
acacatggcagtggtgtggggtaggacgaagagaaga

SEQ ID NO: 99436 - DNA, 37 bp, Artificial Sequence
  Synthetic oligonucleotide
gggggaggtgaacagtggtagttgaaggcatacgaga

SEQ ID NO: 99437 - DNA, 37 bp, Artificial Sequence
  Synthetic oligonucleotide
tgtacatgcttacaccgatctgttgagaccagctaga

SEQ ID NO: 99438 - DNA, 36 bp, Artificial Sequence
  Synthetic oligonucleotide
taagagcagggagtgtaggcgtcactttgtaaccga

SEQ ID NO: 99439 - DNA, 37 bp, Artificial Sequence
  Synthetic oligonucleotide
tacacgcttctgacaagttaccaccaccacgcgccga

SEQ ID NO: 99440 - DNA, 37 bp, Artificial Sequence
  Synthetic oligonucleotide
ttgactgccacattcttctcaacacatcttcactcga

SEQ ID NO: 99441 - DNA, 37 bp, Artificial Sequence
  Synthetic oligonucleotide
ttgacggcacatcctatcgctttaagtccctgctcga

SEQ ID NO: 99442 - DNA, 35 bp, Artificial Sequence
  Synthetic oligonucleotide
ttgaacactgcagattggcgaggattccagttcga

SEQ ID NO: 99443 - DNA, 36 bp, Artificial Sequence
  Synthetic oligonucleotide
gcaacatctgccagacaaacaccactcaagtcagga

SEQ ID NO: 99444 - DNA, 36 bp, Artificial Sequence
  Synthetic oligonucleotide
gacgctgttagagcggtgacggaaaaattgtgagga

SEQ ID NO: 99445 - DNA, 37 bp, Artificial Sequence
  Synthetic oligonucleotide
gtagggaggggcggtgttagagcgttcggaaacggga

SEQ ID NO: 99446 - DNA, 38 bp, Artificial Sequence
  Synthetic oligonucleotide
tgagagacggaattggtgaacaaaggtgacatgaatga

SEQ ID NO: 99447 - DNA, 38 bp, Artificial Sequence
  Synthetic oligonucleotide
atgcgactaggcaacacgggtatagaggggtgacatga

SEQ ID NO: 99448 - DNA, 37 bp, Artificial Sequence
  Synthetic oligonucleotide
tgcggtgcatatggcgaatattgggatgggggtatga

SEQ ID NO: 99449 - DNA, 38 bp, Artificial Sequence
  Synthetic oligonucleotide
gtgaacgtgctgcagctggagttatagcacatagctga

SEQ ID NO: 99450 - DNA, 38 bp, Artificial Sequence
  Synthetic oligonucleotide
gagagccaggggccgaaagaatggcgcgaatacagtga

SEQ ID NO: 99451 - DNA, 38 bp, Artificial Sequence
  Synthetic oligonucleotide
gtgagagtaggtgggaagagtcccgacagcttgagtga

SEQ ID NO: 99452 - DNA, 36 bp, Artificial Sequence
  Synthetic oligonucleotide
aacacgggcgcgatacgtctggattctgggtgttga

SEQ ID NO: 99453 - DNA, 37 bp, Artificial Sequence
  Synthetic oligonucleotide
tacgacgggttaggtaaaggtctggggtggcatttga

SEQ ID NO: 99454 - DNA, 38 bp, Artificial Sequence
  Synthetic oligonucleotide
atgctggaggggtgaagtggttaagcaaatgcttttga

SEQ ID NO: 99455 - DNA, 36 bp, Artificial Sequence
  Synthetic oligonucleotide
aacgcgcgactcctggtaccaaacttagcgcaacta

SEQ ID NO: 99456 - DNA, 36 bp, Artificial Sequence
  Synthetic oligonucleotide
ttgtacccgccaattgacacagccaccttcttccta

SEQ ID NO: 99457 - DNA, 36 bp, Artificial Sequence
  Synthetic oligonucleotide
gagggaagtgcggggaaagtactatagggagccgta

SEQ ID NO: 99458 - DNA, 36 bp, Artificial Sequence
  Synthetic oligonucleotide
gaagaatggcgaagtgaggggtagacgaggttcgta

SEQ ID NO: 99459 - DNA, 36 bp, Artificial Sequence
  Synthetic oligonucleotide
acactaccccacatggacagacactccttgctctta

SEQ ID NO: 99460 - DNA, 35 bp, Artificial Sequence
  Synthetic oligonucleotide
gtgaagtgaggcccaacggagggagagcaggaaac

SEQ ID NO: 99461 - DNA, 35 bp, Artificial Sequence
  Synthetic oligonucleotide
ttgtcgggcccaatgtttgacttttattgtacaac

SEQ ID NO: 99462 - DNA, 35 bp, Artificial Sequence
  Synthetic oligonucleotide
tgtggtgccttaccgttcttcgccaattgttccac

SEQ ID NO: 99463 - DNA, 35 bp, Artificial Sequence
  Synthetic oligonucleotide
tgatacgtgctattcatctgacaccgctgcaatac

SEQ ID NO: 99464 - DNA, 34 bp, Artificial Sequence
  Synthetic oligonucleotide
aacagacagctgacatgcactgtttcgttgtacc

SEQ ID NO: 99465 - DNA, 35 bp, Artificial Sequence
  Synthetic oligonucleotide
ttcaccgggattcgaactggaccggtactattacc

SEQ ID NO: 99466 - DNA, 35 bp, Artificial Sequence
  Synthetic oligonucleotide
tcttgaccactgcactgcatacctgaaggctcccc

SEQ ID NO: 99467 - DNA, 35 bp, Artificial Sequence
  Synthetic oligonucleotide
agacacatcgttactcgctagtaccgcgctacgcc

SEQ ID NO: 99468 - DNA, 35 bp, Artificial Sequence
  Synthetic oligonucleotide
atgcacacgaaatgcgctactccatccgttctatc

SEQ ID NO: 99469 - DNA, 35 bp, Artificial Sequence
  Synthetic oligonucleotide
ggagggcccgtacacgcaatgccgtatccattatc

SEQ ID NO: 99470 - DNA, 35 bp, Artificial Sequence
  Synthetic oligonucleotide
gacaacgtggggggaatttgacgggggattgggtc

SEQ ID NO: 99471 - DNA, 35 bp, Artificial Sequence
  Synthetic oligonucleotide
tcgatagcgcaccgcttcctactccgccatcaaag

SEQ ID NO: 99472 - DNA, 35 bp, Artificial Sequence
  Synthetic oligonucleotide
tcatccagtcccccgtacgtcgaattatgtcccag

SEQ ID NO: 99473 - DNA, 35 bp, Artificial Sequence
  Synthetic oligonucleotide
gccacgctaagcactgtgcagaggcccgcatacat

SEQ ID NO: 99474 - DNA, 35 bp, Artificial Sequence
  Synthetic oligonucleotide
tgtgccaccgccaagggtcaattcgtccagtttat

SEQ ID NO: 99475 - DNA, 35 bp, Artificial Sequence
  Synthetic oligonucleotide
gtgacgagcaacaggatatattgttgctgaaacct

SEQ ID NO: 99476 - DNA, 35 bp, Artificial Sequence
  Synthetic oligonucleotide
aaacccgcgcgcattatcgtgctctttctctccct

SEQ ID NO: 99477 - DNA, 35 bp, Artificial Sequence
  Synthetic oligonucleotide
tacgcatgtcccactttttacgacgtgagtatcct

SEQ ID NO: 99478 - DNA, 36 bp, Artificial Sequence
  Synthetic oligonucleotide
gtgtctcgcagctatccctattatccttaggaacaa

SEQ ID NO: 99479 - DNA, 36 bp, Artificial Sequence
  Synthetic oligonucleotide
tagtcaaactcgctgtctttctaccaaggtgcccaa

SEQ ID NO: 99480 - DNA, 36 bp, Artificial Sequence
  Synthetic oligonucleotide
gaggaacgcggcacaatgactttacaaatgttgcaa

SEQ ID NO: 99481 - DNA, 36 bp, Artificial Sequence
  Synthetic oligonucleotide
tcaaccggccaatcatttgcatacgatacaatcgaa

SEQ ID NO: 99482 - DNA, 35 bp, Artificial Sequence
  Synthetic oligonucleotide
tgtcctgacgcatactgcctgatcacctgaggaca

SEQ ID NO: 99483 - DNA, 35 bp, Artificial Sequence
  Synthetic oligonucleotide
tgtgcactgccgtggacttctagtaccgtaaacca

SEQ ID NO: 99484 - DNA, 36 bp, Artificial Sequence
  Synthetic oligonucleotide
gttagcggaaggggatgacagtgatcgggacaggca

SEQ ID NO: 99485 - DNA, 36 bp, Artificial Sequence
  Synthetic oligonucleotide
catccgatactatcgatgtggattcacttttcctca

SEQ ID NO: 99486 - DNA, 36 bp, Artificial Sequence
  Synthetic oligonucleotide
tacgcttagcctgaaatcccttatacgtgaccttca

SEQ ID NO: 99487 - DNA, 37 bp, Artificial Sequence
  Synthetic oligonucleotide
tcccgccatcgcccacggaaggcccacagtctgcaga

SEQ ID NO: 99488 - DNA, 37 bp, Artificial Sequence
  Synthetic oligonucleotide
tgacacatccaaagcggtccacaaggattcctggcga

SEQ ID NO: 99489 - DNA, 37 bp, Artificial Sequence
  Synthetic oligonucleotide
tcaaggagaggcatgggagggtacgtaatatatcgga

SEQ ID NO: 99490 - DNA, 35 bp, Artificial Sequence
  Synthetic oligonucleotide
ttcagaggcgaagtaggcacaggttagccgaggga

SEQ ID NO: 99491 - DNA, 37 bp, Artificial Sequence
  Synthetic oligonucleotide
gaaccaagagaaaggtgaacgaatgcgcagtccggga

SEQ ID NO: 99492 - DNA, 37 bp, Artificial Sequence
  Synthetic oligonucleotide
atgggctgagacgagttgaaggggtgtagggagggga

SEQ ID NO: 99493 - DNA, 37 bp, Artificial Sequence
  Synthetic oligonucleotide
taggtgtgcgaaggacaagggggggagacatagggga

SEQ ID NO: 99494 - DNA, 37 bp, Artificial Sequence
  Synthetic oligonucleotide
aagaccggcgataggagagtacctagggaggtatgga

SEQ ID NO: 99495 - DNA, 38 bp, Artificial Sequence
  Synthetic oligonucleotide
gaagcgagagaagggtgtcgataggtagtcgagaatga

SEQ ID NO: 99496 - DNA, 37 bp, Artificial Sequence
  Synthetic oligonucleotide
gccacatccagcgtgactgttttgaccaagggaatga

SEQ ID NO: 99497 - DNA, 38 bp, Artificial Sequence
  Synthetic oligonucleotide
gtcaccaccgctcagacagtagtttctgggttccatga

SEQ ID NO: 99498 - DNA, 38 bp, Artificial Sequence
  Synthetic oligonucleotide
tgaggacgtgaggcgggagggacgtaaatcacagctga

SEQ ID NO: 99499 - DNA, 38 bp, Artificial Sequence
  Synthetic oligonucleotide
taccagacaccccaagacatcgtagtccagtccgctga

SEQ ID NO: 99500 - DNA, 37 bp, Artificial Sequence
  Synthetic oligonucleotide
acacccagtggaggaaggacgggcagaatggaagtga

SEQ ID NO: 99501 - DNA, 38 bp, Artificial Sequence
  Synthetic oligonucleotide
aagacactcagaggtggacaagttggggggtgaagtga

SEQ ID NO: 99502 - DNA, 38 bp, Artificial Sequence
  Synthetic oligonucleotide
aactgcacagcaacacgatcgagtcagaatgtgcgtga

SEQ ID NO: 99503 - DNA, 38 bp, Artificial Sequence
  Synthetic oligonucleotide
acaagggacgatgtaaacgagaggggccagggatgtga

SEQ ID NO: 99504 - DNA, 38 bp, Artificial Sequence
  Synthetic oligonucleotide
agatgcaaagcggagaaacgaggagcggtaccgtgtga

SEQ ID NO: 99505 - DNA, 38 bp, Artificial Sequence
  Synthetic oligonucleotide
tagacacaactgttctgtttgacggacagcaattgtga

SEQ ID NO: 99506 - DNA, 38 bp, Artificial Sequence
  Synthetic oligonucleotide
aacccagtctgggtgccaacgcacatacaactggttga

SEQ ID NO: 99507 - DNA, 38 bp, Artificial Sequence
  Synthetic oligonucleotide
tccacatgccacgatggggatgaggaggggacctttga

SEQ ID NO: 99508 - DNA, 36 bp, Artificial Sequence
  Synthetic oligonucleotide
gcgatacgacgtctaaccattgtgccccagctgcta

SEQ ID NO: 99509 - DNA, 35 bp, Artificial Sequence
  Synthetic oligonucleotide
gcctcaggccgttttgcgccatccgcaggctccac

SEQ ID NO: 99510 - DNA, 35 bp, Artificial Sequence
  Synthetic oligonucleotide
gaatacgctgcttaatgtcattgcgccactttcac

SEQ ID NO: 99511 - DNA, 35 bp, Artificial Sequence
  Synthetic oligonucleotide
agtgtgcaccccctgacctcagtgaccgcccctac

SEQ ID NO: 99512 - DNA, 35 bp, Artificial Sequence
  Synthetic oligonucleotide
gtgaccgcccaccattaagttttgcagcattaagc

SEQ ID NO: 99513 - DNA, 35 bp, Artificial Sequence
  Synthetic oligonucleotide
acctggggcaacactgcttctaagtcaacggcctc

SEQ ID NO: 99514 - DNA, 35 bp, Artificial Sequence
  Synthetic oligonucleotide
acactggcacgacaaccggcttctctaatatcctc

SEQ ID NO: 99515 - DNA, 35 bp, Artificial Sequence
  Synthetic oligonucleotide
tcgaacgacacgctgctatacggtagccgtagctc

SEQ ID NO: 99516 - DNA, 35 bp, Artificial Sequence
  Synthetic oligonucleotide
acatggggtgcacgcataggaaacgggagttagtc

SEQ ID NO: 99517 - DNA, 35 bp, Artificial Sequence
  Synthetic oligonucleotide
tacctgccgcgggtcaaagtagtgcgttcgtgtag

SEQ ID NO: 99518 - DNA, 35 bp, Artificial Sequence
  Synthetic oligonucleotide
acagaagagggcaggaaggtttggcaaggagaacg

SEQ ID NO: 99519 - DNA, 35 bp, Artificial Sequence
  Synthetic oligonucleotide
aacggaccagggcgcaccatcaccgtcaccgaggg

SEQ ID NO: 99520 - DNA, 35 bp, Artificial Sequence
  Synthetic oligonucleotide
tgagtggcatagtaggagtttcattgttcatctgg

SEQ ID NO: 99521 - DNA, 35 bp, Artificial Sequence
  Synthetic oligonucleotide
acgcacgaacgtccgcatgttactgtaaaaattgg

SEQ ID NO: 99522 - DNA, 35 bp, Artificial Sequence
  Synthetic oligonucleotide
gagtagacgagtggagttggagaagtagtcgattg

SEQ ID NO: 99523 - DNA, 35 bp, Artificial Sequence
  Synthetic oligonucleotide
gagcgacgggatagggagaaagtggatttgtaaat

SEQ ID NO: 99524 - DNA, 35 bp, Artificial Sequence
  Synthetic oligonucleotide
tctgaccccacgtcctctcttgttcaggctgttat

SEQ ID NO: 99525 - DNA, 35 bp, Artificial Sequence
  Synthetic oligonucleotide
aatgagggcatatcagcaggtggaggaaggtcggt

SEQ ID NO: 99526 - DNA, 35 bp, Artificial Sequence
  Synthetic oligonucleotide
tgacgaacgtactgcttccctgacacagtccgggt

SEQ ID NO: 99527 - DNA, 35 bp, Artificial Sequence
  Synthetic oligonucleotide
gcattgggcggaggtggtcaagaggactcggtggt

SEQ ID NO: 99528 - DNA, 35 bp, Artificial Sequence
  Synthetic oligonucleotide
gcatcacggcgaggattatgccagaagaaaaatgt

SEQ ID NO: 99529 - DNA, 35 bp, Artificial Sequence
  Synthetic oligonucleotide
gtccatcgacgaatccaggacatatggctttatgt

SEQ ID NO: 99530 - DNA, 35 bp, Artificial Sequence
  Synthetic oligonucleotide
ttcaccaacgacattatggcaggccatcttatctt

SEQ ID NO: 99531 - DNA, 35 bp, Artificial Sequence
  Synthetic oligonucleotide
agtgcgaagggggggttgagagcaacctgctagtt

SEQ ID NO: 99532 - DNA, 35 bp, Artificial Sequence
  Synthetic oligonucleotide
tgagtgcctgagcttattcgtcctatagtcccgtt

SEQ ID NO: 99533 - DNA, 36 bp, Artificial Sequence
  Synthetic oligonucleotide
ggaacgaagcagaaataggcgtggcgtggggaagaa

SEQ ID NO: 99534 - DNA, 35 bp, Artificial Sequence
  Synthetic oligonucleotide
atacgctcccctgttccatattctagtactgctaa

SEQ ID NO: 99535 - DNA, 31 bp, Artificial Sequence
  Synthetic oligonucleotide
gatgtccacgtgcccgataccactgagtaca

SEQ ID NO: 99536 - DNA, 35 bp, Artificial Sequence
  Synthetic oligonucleotide
gcaacgactggccgccgcgtacgcacctggttcca

SEQ ID NO: 99537 - DNA, 36 bp, Artificial Sequence
  Synthetic oligonucleotide
gacgtgaaggagagacgaaggtaagtagaggtggca

SEQ ID NO: 99538 - DNA, 36 bp, Artificial Sequence
  Synthetic oligonucleotide
ttgtccccgtgcccttcccacatgagcttggtctca

SEQ ID NO: 99539 - DNA, 36 bp, Artificial Sequence
  Synthetic oligonucleotide
atcaacgccacgtttcaattgcactgactctcttca

SEQ ID NO: 99540 - DNA, 37 bp, Artificial Sequence
  Synthetic oligonucleotide
gatgcagagggcattcataatatggggacgtaaaaga

SEQ ID NO: 99541 - DNA, 35 bp, Artificial Sequence
  Synthetic oligonucleotide
aatgagcacgctgacacggggatgaggggaagcga

SEQ ID NO: 99542 - DNA, 37 bp, Artificial Sequence
  Synthetic oligonucleotide
gaaggaaggggcacgaaagtaagtgcggtgtccgcga

SEQ ID NO: 99543 - DNA, 37 bp, Artificial Sequence
  Synthetic oligonucleotide
acgctgcacacaaagataaagggtcgggaagcaagga

SEQ ID NO: 99544 - DNA, 37 bp, Artificial Sequence
  Synthetic oligonucleotide
tcgaggtaaggagaccagtgtgttggccaagtgagga

SEQ ID NO: 99545 - DNA, 35 bp, Artificial Sequence
  Synthetic oligonucleotide
gccgagacgatgatgagagatacgaaacgggcgga

SEQ ID NO: 99546 - DNA, 37 bp, Artificial Sequence
  Synthetic oligonucleotide
gtaggggcgggaccgtgaatgatctggggggaaggga

SEQ ID NO: 99547 - DNA, 37 bp, Artificial Sequence
  Synthetic oligonucleotide
gcatcaatcgggggcaaaagggtggggtccaacggga

SEQ ID NO: 99548 - DNA, 37 bp, Artificial Sequence
  Synthetic oligonucleotide
aattgggagggggggaaagcagcgattagccagggga

SEQ ID NO: 99549 - DNA, 37 bp, Artificial Sequence
  Synthetic oligonucleotide
gtgcattggccgagaatcaagagcaggggtgggggga

SEQ ID NO: 99550 - DNA, 37 bp, Artificial Sequence
  Synthetic oligonucleotide
ggtctatggggccacgtacggatgaaacagtggggga

SEQ ID NO: 99551 - DNA, 37 bp, Artificial Sequence
  Synthetic oligonucleotide
gacacagccgttctgttcctagttcgcactcaatgga

SEQ ID NO: 99552 - DNA, 38 bp, Artificial Sequence
  Synthetic oligonucleotide
gggacacgtaggctactcattcgacccactgaacatga

SEQ ID NO: 99553 - DNA, 37 bp, Artificial Sequence
  Synthetic oligonucleotide
tcggatcagacgccaattaatatcactaccgccatga

SEQ ID NO: 99554 - DNA, 38 bp, Artificial Sequence
  Synthetic oligonucleotide
gaccatgccagggggtagtacgagccttggcgtgatga

SEQ ID NO: 99555 - DNA, 37 bp, Artificial Sequence
  Synthetic oligonucleotide
aagtagtgcagtgcgatagagtgaagccaggttatga

SEQ ID NO: 99556 - DNA, 38 bp, Artificial Sequence
  Synthetic oligonucleotide
tagaaccgcctgctgatgatcttcgacttccttcctga

SEQ ID NO: 99557 - DNA, 38 bp, Artificial Sequence
  Synthetic oligonucleotide
gaacaacgcaaaaccctcacgcccacccagatctctga

SEQ ID NO: 99558 - DNA, 38 bp, Artificial Sequence
  Synthetic oligonucleotide
taggggtgcaagtggtgtctacacagaggactcagtga

SEQ ID NO: 99559 - DNA, 38 bp, Artificial Sequence
  Synthetic oligonucleotide
gcacgcccgcgaggatttggactacggagggggagtga

SEQ ID NO: 99560 - DNA, 36 bp, Artificial Sequence
  Synthetic oligonucleotide
tcagaagagaggcggtgggcgagctacgcggggtga

SEQ ID NO: 99561 - DNA, 37 bp, Artificial Sequence
  Synthetic oligonucleotide
aagaggaggactgggtacaactaagagatcggtgtga

SEQ ID NO: 99562 - DNA, 36 bp, Artificial Sequence
  Synthetic oligonucleotide
gaatcactggaaggaaagtaggatggggggacttga

SEQ ID NO: 99563 - DNA, 37 bp, Artificial Sequence
  Synthetic oligonucleotide
gatgtcacaggaaggggcaaatatagtgtcggtttga

SEQ ID NO: 99564 - DNA, 35 bp, Artificial Sequence
  Synthetic oligonucleotide
gcaaccgcacgacgttgcacagttttgaaaaaata

SEQ ID NO: 99565 - DNA, 36 bp, Artificial Sequence
  Synthetic oligonucleotide
gacgctacaacttggccgtgcagttccatcacaata

SEQ ID NO: 99566 - DNA, 36 bp, Artificial Sequence
  Synthetic oligonucleotide
ttgagccgtacgactcctgctattgctctttgcata

SEQ ID NO: 99567 - DNA, 36 bp, Artificial Sequence
  Synthetic oligonucleotide
tgagagccagatcatgtctcatcacgtggcctgcta

SEQ ID NO: 99568 - DNA, 36 bp, Artificial Sequence
  Synthetic oligonucleotide
acaaaccgcgtgcgttgagaaccaacatgggtagta

SEQ ID NO: 99569 - DNA, 36 bp, Artificial Sequence
  Synthetic oligonucleotide
atgctacggcacaattcatcaaggccactggtagta

SEQ ID NO: 99570 - DNA, 36 bp, Artificial Sequence
  Synthetic oligonucleotide
gagtaaaggcgagaatatgagagggcaaagtgcgta

SEQ ID NO: 99571 - DNA, 35 bp, Artificial Sequence
  Synthetic oligonucleotide
gacgccaccccaatataccttccctggtaaggcac

SEQ ID NO: 99572 - DNA, 35 bp, Artificial Sequence
  Synthetic oligonucleotide
atgccaacgattagtcgtttgtaacgactcggtac

SEQ ID NO: 99573 - DNA, 35 bp, Artificial Sequence
  Synthetic oligonucleotide
gacggggacctgttagtgcttcgttttcctcaacc

SEQ ID NO: 99574 - DNA, 35 bp, Artificial Sequence
  Synthetic oligonucleotide
atgagtcgcactcgaactgacttttctacaagccc

SEQ ID NO: 99575 - DNA, 35 bp, Artificial Sequence
  Synthetic oligonucleotide
agtgcagtcaccatgtttttggtcgacccgcctcc

SEQ ID NO: 99576 - DNA, 35 bp, Artificial Sequence
  Synthetic oligonucleotide
tcgattagccgtactgttgtccatattccgcctcc

SEQ ID NO: 99577 - DNA, 35 bp, Artificial Sequence
  Synthetic oligonucleotide
gcccatctgcctgttcggtccatccaatcctctcc

SEQ ID NO: 99578 - DNA, 35 bp, Artificial Sequence
  Synthetic oligonucleotide
gatactccctctgtgtcctacatccggccgcatgc

SEQ ID NO: 99579 - DNA, 35 bp, Artificial Sequence
  Synthetic oligonucleotide
gcccgacgacggtacagggttcttgtacattactc

SEQ ID NO: 99580 - DNA, 35 bp, Artificial Sequence
  Synthetic oligonucleotide
tcccaacctcacagtgccctcattgtaccgaagtc

SEQ ID NO: 99581 - DNA, 35 bp, Artificial Sequence
  Synthetic oligonucleotide
ttcacaaaggggaaaggcgtggaccacaggagacg

SEQ ID NO: 99582 - DNA, 35 bp, Artificial Sequence
  Synthetic oligonucleotide
actgactgcatctccttcgttttgggcctgctacg

SEQ ID NO: 99583 - DNA, 35 bp, Artificial Sequence
  Synthetic oligonucleotide
agcaaccccggatagcacacccatgatgatgcagg

SEQ ID NO: 99584 - DNA, 35 bp, Artificial Sequence
  Synthetic oligonucleotide
gaccacatggaggtaagtaaggttcgaatgaaggg

SEQ ID NO: 99585 - DNA, 35 bp, Artificial Sequence
  Synthetic oligonucleotide
acacgagaggatgggatcatcaagcagcaggaggg

SEQ ID NO: 99586 - DNA, 35 bp, Artificial Sequence
  Synthetic oligonucleotide
tagtgtgcaagatgtttcagtcgagaatggtggtg

SEQ ID NO: 99587 - DNA, 35 bp, Artificial Sequence
  Synthetic oligonucleotide
gaagcagggggtaagaaaaggttaggtagcaattg

SEQ ID NO: 99588 - DNA, 35 bp, Artificial Sequence
  Synthetic oligonucleotide
gtcgccctcccgaagtctaaacggtctatttattg

SEQ ID NO: 99589 - DNA, 35 bp, Artificial Sequence
  Synthetic oligonucleotide
gttggaccaagtcaagggcgaggggagaggagttg

SEQ ID NO: 99590 - DNA, 35 bp, Artificial Sequence
  Synthetic oligonucleotide
aagacgggggcggtgggcgctggcaacatatcaat

SEQ ID NO: 99591 - DNA, 35 bp, Artificial Sequence
  Synthetic oligonucleotide
ttctacccgtcgagtgacctcgatggccagactat

SEQ ID NO: 99592 - DNA, 35 bp, Artificial Sequence
  Synthetic oligonucleotide
ttcgtgggacccatctcgtttattgcctagcctat

SEQ ID NO: 99593 - DNA, 35 bp, Artificial Sequence
  Synthetic oligonucleotide
gaacgagcgaattgggcatcgcacctctacttcgt

SEQ ID NO: 99594 - DNA, 35 bp, Artificial Sequence
  Synthetic oligonucleotide
gcattgaccgcactatcaagtcatcacgacccaaa

SEQ ID NO: 99595 - DNA, 36 bp, Artificial Sequence
  Synthetic oligonucleotide
aagacagccaacaatgaagaggtggagcagggacaa

SEQ ID NO: 99596 - DNA, 36 bp, Artificial Sequence
  Synthetic oligonucleotide
gccgaaccgacccgatctctttagggggggagggaa

SEQ ID NO: 99597 - DNA, 36 bp, Artificial Sequence
  Synthetic oligonucleotide
atcacaagggcgcccggagcgtcgtacacacgctaa

SEQ ID NO: 99598 - DNA, 36 bp, Artificial Sequence
  Synthetic oligonucleotide
aggaacatgagcaggaagcagggacgggtagggaca

SEQ ID NO: 99599 - DNA, 35 bp, Artificial Sequence
  Synthetic oligonucleotide
gatgtcgtcgtcccgcagatttatgctctcttaca

SEQ ID NO: 99600 - DNA, 36 bp, Artificial Sequence
  Synthetic oligonucleotide
attgagcgcacaacgaggcctctgatcacacttcca

SEQ ID NO: 99601 - DNA, 36 bp, Artificial Sequence
  Synthetic oligonucleotide
gagccagtgatcatcatcttacaccgggctaacgca

SEQ ID NO: 99602 - DNA, 36 bp, Artificial Sequence
  Synthetic oligonucleotide
atacacctcccacctgctgccagaaagtactgcgca

SEQ ID NO: 99603 - DNA, 33 bp, Artificial Sequence
  Synthetic oligonucleotide
gacgaaggtggaagggggttgatcaaagtcgca

SEQ ID NO: 99604 - DNA, 36 bp, Artificial Sequence
  Synthetic oligonucleotide
tgtcatgagccgggccccttatcagtgcggattgca

SEQ ID NO: 99605 - DNA, 36 bp, Artificial Sequence
  Synthetic oligonucleotide
gagccgcatagatagggccacggaccaactcactca

SEQ ID NO: 99606 - DNA, 36 bp, Artificial Sequence
  Synthetic oligonucleotide
gagtcgggagggctcacgaaactgctcgggatccga

SEQ ID NO: 99607 - DNA, 37 bp, Artificial Sequence
  Synthetic oligonucleotide
tgacgtgccatatcttcctagtgcgtgacattggcga

SEQ ID NO: 99608 - DNA, 37 bp, Artificial Sequence
  Synthetic oligonucleotide
atgtggtggagggagtgttcagcgctagggatcagga

SEQ ID NO: 99609 - DNA, 37 bp, Artificial Sequence
  Synthetic oligonucleotide
aagtcacagtgggggtggtggagccggcaaactagga

SEQ ID NO: 99610 - DNA, 37 bp, Artificial Sequence
  Synthetic oligonucleotide
aagaatggggagcgaactggttgagcggcaaggcgga

SEQ ID NO: 99611 - DNA, 35 bp, Artificial Sequence
  Synthetic oligonucleotide
tcatgccgagtaggcgaacgtggacccagcatgga

SEQ ID NO: 99612 - DNA, 38 bp, Artificial Sequence
  Synthetic oligonucleotide
atgggagggggagcttagatgaagtgaaaggtaaatga

SEQ ID NO: 99613 - DNA, 38 bp, Artificial Sequence
  Synthetic oligonucleotide
tcacgcaccggacgtgaatacagttgtttgaggcatga

SEQ ID NO: 99614 - DNA, 38 bp, Artificial Sequence
  Synthetic oligonucleotide
gagacaccctcggacagatagggctgtggcattcatga

SEQ ID NO: 99615 - DNA, 38 bp, Artificial Sequence
  Synthetic oligonucleotide
taccacgcgtgctcgagctcgtaatcccttcacactga

SEQ ID NO: 99616 - DNA, 35 bp, Artificial Sequence
  Synthetic oligonucleotide
tgacggatggtgatatagggtgggtgaagtactga

SEQ ID NO: 99617 - DNA, 38 bp, Artificial Sequence
  Synthetic oligonucleotide
tacaccttcagtgagcctctatctccagtcggccctga

SEQ ID NO: 99618 - DNA, 37 bp, Artificial Sequence
  Synthetic oligonucleotide
tacgcacaccagcggtttggtcgacagtaatatctga

SEQ ID NO: 99619 - DNA, 37 bp, Artificial Sequence
  Synthetic oligonucleotide
taatcgcagtcgtcgccacgtccgcaccacactctga

SEQ ID NO: 99620 - DNA, 38 bp, Artificial Sequence
  Synthetic oligonucleotide
gaagtgtgggcagtaaggaattgggaggtagtacgtga

SEQ ID NO: 99621 - DNA, 38 bp, Artificial Sequence
  Synthetic oligonucleotide
acagtgctgcagtgccataaagcgaatatctcccgtga

SEQ ID NO: 99622 - DNA, 38 bp, Artificial Sequence
  Synthetic oligonucleotide
atggtcagacggtgggaatgtcggttcgagcagggtga

SEQ ID NO: 99623 - DNA, 37 bp, Artificial Sequence
  Synthetic oligonucleotide
ggggtgatgaaggggaaacaaagagcgtggggggtga

SEQ ID NO: 99624 - DNA, 35 bp, Artificial Sequence
  Synthetic oligonucleotide
gacgcgcgggggggaaaaagcagaactcgctgtga

SEQ ID NO: 99625 - DNA, 37 bp, Artificial Sequence
  Synthetic oligonucleotide
gatacgtagggtagggaagaaaaagttagctgcttga

SEQ ID NO: 99626 - DNA, 37 bp, Artificial Sequence
  Synthetic oligonucleotide
acgacattagccgctgttcctctccgtatctagttga

SEQ ID NO: 99627 - DNA, 36 bp, Artificial Sequence
  Synthetic oligonucleotide
gtcgcatcgacgactccttggattacagcctcgcta

SEQ ID NO: 99628 - DNA, 36 bp, Artificial Sequence
  Synthetic oligonucleotide
ttgcttcacccgacgtccttccagtgcaattatcta

SEQ ID NO: 99629 - DNA, 36 bp, Artificial Sequence
  Synthetic oligonucleotide
gttgtagccacccgggaatgacacagcccttgatta

SEQ ID NO: 99630 - DNA, 35 bp, Artificial Sequence
  Synthetic oligonucleotide
aacgaccacgccctcatgttgattttcgcttgtta

SEQ ID NO: 99631 - DNA, 36 bp, Artificial Sequence
  Synthetic oligonucleotide
gacggcccaccaactcagtaccgaatcactacttta

SEQ ID NO: 99632 - DNA, 36 bp, Artificial Sequence
  Synthetic oligonucleotide
tatacacgaagaagggaagaaactaggattgaagac

SEQ ID NO: 99633 - DNA, 35 bp, Artificial Sequence
  Synthetic oligonucleotide
atgccagagtgggtgtaggtgtcggtggagtggac

SEQ ID NO: 99634 - DNA, 35 bp, Artificial Sequence
  Synthetic oligonucleotide
ggaaccccgtgagatccctctttgttacacgttac

SEQ ID NO: 99635 - DNA, 35 bp, Artificial Sequence
  Synthetic oligonucleotide
gcaggagcgcgtggctgttcctgtaatatcttacc

SEQ ID NO: 99636 - DNA, 35 bp, Artificial Sequence
  Synthetic oligonucleotide
gttgaacctacccgatcgtacaattttggccttgc

SEQ ID NO: 99637 - DNA, 35 bp, Artificial Sequence
  Synthetic oligonucleotide
gtcgatgcacaaagggtggggttggatgtacaatc

SEQ ID NO: 99638 - DNA, 35 bp, Artificial Sequence
  Synthetic oligonucleotide
accgaggcaagtggggatattcatggggggtcatc

SEQ ID NO: 99639 - DNA, 35 bp, Artificial Sequence
  Synthetic oligonucleotide
gacgtgtcacctgaacattagtgaaacacaagatc

SEQ ID NO: 99640 - DNA, 35 bp, Artificial Sequence
  Synthetic oligonucleotide
gccacgcaccgcaacccgacacatctcgtgacctc

SEQ ID NO: 99641 - DNA, 35 bp, Artificial Sequence
  Synthetic oligonucleotide
gccgccatctgtaagttggctctttccccaatttc

SEQ ID NO: 99642 - DNA, 35 bp, Artificial Sequence
  Synthetic oligonucleotide
gtgcccgacgtgggcaggaataagggtcagaaaag

SEQ ID NO: 99643 - DNA, 35 bp, Artificial Sequence
  Synthetic oligonucleotide
gctgcttgcagtagctttcatttccttcaccctag

SEQ ID NO: 99644 - DNA, 34 bp, Artificial Sequence
  Synthetic oligonucleotide
gcgtgacgaacgctctctgaactgaatatccacg

SEQ ID NO: 99645 - DNA, 35 bp, Artificial Sequence
  Synthetic oligonucleotide
gatggaggctggtttcctattttggcgcctgtggg

SEQ ID NO: 99646 - DNA, 35 bp, Artificial Sequence
  Synthetic oligonucleotide
agttagcacaacacccatgccctgaggagagattg

SEQ ID NO: 99647 - DNA, 35 bp, Artificial Sequence
  Synthetic oligonucleotide
aaagcctgacctcattgcatcaccaaagtctttct

SEQ ID NO: 99648 - DNA, 35 bp, Artificial Sequence
  Synthetic oligonucleotide
gtgctgccacagtcgaggtcctttgttgggcgggt

SEQ ID NO: 99649 - DNA, 35 bp, Artificial Sequence
  Synthetic oligonucleotide
gacattgcagggatgtcgtccatattaaccactgt

SEQ ID NO: 99650 - DNA, 35 bp, Artificial Sequence
  Synthetic oligonucleotide
gatccacagcgctttagtatttcggtccagcactt

SEQ ID NO: 99651 - DNA, 35 bp, Artificial Sequence
  Synthetic oligonucleotide
acccacgtatgttcgatgtgacgactgcattgttt

SEQ ID NO: 99652 - DNA, 35 bp, Artificial Sequence
  Synthetic oligonucleotide
tttcgagccgaacgcacctgctgaaccgacacaaa

SEQ ID NO: 99653 - DNA, 36 bp, Artificial Sequence
  Synthetic oligonucleotide
tagtaccagaccgcgtgtcaacttgtcaggtggaaa

SEQ ID NO: 99654 - DNA, 35 bp, Artificial Sequence
  Synthetic oligonucleotide
gagtgggaggattagcagaataaagcaacgcgcaa

SEQ ID NO: 99655 - DNA, 36 bp, Artificial Sequence
  Synthetic oligonucleotide
atacaccaccatgtggctacaacagaatcatctcaa

SEQ ID NO: 99656 - DNA, 36 bp, Artificial Sequence
  Synthetic oligonucleotide
tccaacccataagtgtcaagctgcaggcaaaagaca

SEQ ID NO: 99657 - DNA, 35 bp, Artificial Sequence
  Synthetic oligonucleotide
tcaacacgtggagttatttagcacggagggggaca

SEQ ID NO: 99658 - DNA, 36 bp, Artificial Sequence
  Synthetic oligonucleotide
gagaccgctgctgtcacactcgttctactcgactca

SEQ ID NO: 99659 - DNA, 36 bp, Artificial Sequence
  Synthetic oligonucleotide
gtcagatcgcatgatctgcactcatacagcccttca

SEQ ID NO: 99660 - DNA, 37 bp, Artificial Sequence
  Synthetic oligonucleotide
gtgaacattagggtggaagaagtagttagtattaaga

SEQ ID NO: 99661 - DNA, 37 bp, Artificial Sequence
  Synthetic oligonucleotide
gacgaagtcaccagggaaagaactttctagtcggaga

SEQ ID NO: 99662 - DNA, 37 bp, Artificial Sequence
  Synthetic oligonucleotide
attgccatgcgacgagcgggtgttcggccttacacga

SEQ ID NO: 99663 - DNA, 37 bp, Artificial Sequence
  Synthetic oligonucleotide
aacagaacgcaccatgaggtacaaaatagtatgacga

SEQ ID NO: 99664 - DNA, 37 bp, Artificial Sequence
  Synthetic oligonucleotide
gcacgggatgacaatggggtagggatggaatctgcga

SEQ ID NO: 99665 - DNA, 35 bp, Artificial Sequence
  Synthetic oligonucleotide
gcacataggcgaagggaacatggaatggcccagga

SEQ ID NO: 99666 - DNA, 37 bp, Artificial Sequence
  Synthetic oligonucleotide
gcacacctcagtgggagaattaatcgttacgggagga

SEQ ID NO: 99667 - DNA, 35 bp, Artificial Sequence
  Synthetic oligonucleotide
tacacctgcgcggcccgtgcttattgttggtcgga

SEQ ID NO: 99668 - DNA, 37 bp, Artificial Sequence
  Synthetic oligonucleotide
ggacgtacgaggggaagcttgggtaggccgataggga

SEQ ID NO: 99669 - DNA, 37 bp, Artificial Sequence
  Synthetic oligonucleotide
gtcgaagaaggctgattaagggcctggattacgggga

SEQ ID NO: 99670 - DNA, 37 bp, Artificial Sequence
  Synthetic oligonucleotide
ggtacacgtacaatgtgctaattcggtttggggggga

SEQ ID NO: 99671 - DNA, 37 bp, Artificial Sequence
  Synthetic oligonucleotide
tctggaaacggccggagagatacgggacatggtggga

SEQ ID NO: 99672 - DNA, 37 bp, Artificial Sequence
  Synthetic oligonucleotide
gcaatgcccccggattcgtcgaaatgagatggttgga

SEQ ID NO: 99673 - DNA, 38 bp, Artificial Sequence
  Synthetic oligonucleotide
taagccgccccgaaggccacacgcagcctatgaaatga

SEQ ID NO: 99674 - DNA, 37 bp, Artificial Sequence
  Synthetic oligonucleotide
gaagacatggggggcttacaggagggacatgtcatga

SEQ ID NO: 99675 - DNA, 38 bp, Artificial Sequence
  Synthetic oligonucleotide
aaccactgcaggactatgcgtaagctcaccgttactga

SEQ ID NO: 99676 - DNA, 38 bp, Artificial Sequence
  Synthetic oligonucleotide
gccggatcaggcgcggtaaggaaatgaacgaatgctga

SEQ ID NO: 99677 - DNA, 38 bp, Artificial Sequence
  Synthetic oligonucleotide
ttggtgggcgcgaacggtcgagagcactagcacagtga

SEQ ID NO: 99678 - DNA, 37 bp, Artificial Sequence
  Synthetic oligonucleotide
gtcgaagggaggactatctccggccataggctagtga

SEQ ID NO: 99679 - DNA, 38 bp, Artificial Sequence
  Synthetic oligonucleotide
accgatcacatgccacgcatacaagacctcattcgtga

SEQ ID NO: 99680 - DNA, 37 bp, Artificial Sequence
  Synthetic oligonucleotide
gatggtgacaggaagaatttaataagggtgtgggtga

SEQ ID NO: 99681 - DNA, 36 bp, Artificial Sequence
  Synthetic oligonucleotide
gaaaagagcaaagcggataagggaaagaccgtgtga

SEQ ID NO: 99682 - DNA, 38 bp, Artificial Sequence
  Synthetic oligonucleotide
gatcaacgtgttggagtgtggattcaggaagtgtgtga

SEQ ID NO: 99683 - DNA, 37 bp, Artificial Sequence
  Synthetic oligonucleotide
tgaccgaccgcacattatgtctcaagacctaccttga

SEQ ID NO: 99684 - DNA, 38 bp, Artificial Sequence
  Synthetic oligonucleotide
tagacaaagcattctaagcaggaggaagagatggttga

SEQ ID NO: 99685 - DNA, 38 bp, Artificial Sequence
  Synthetic oligonucleotide
gaccggtgtccgtacgttcttcattggcctccttttga

SEQ ID NO: 99686 - DNA, 36 bp, Artificial Sequence
  Synthetic oligonucleotide
tctaccaccgtgactcgtacttgtaactggcgtata

SEQ ID NO: 99687 - DNA, 35 bp, Artificial Sequence
  Synthetic oligonucleotide
gctagaccagggaggcctaagggtggaaggtacta

SEQ ID NO: 99688 - DNA, 35 bp, Artificial Sequence
  Synthetic oligonucleotide
atgaccgccgccgattccccaccaaccttatcgta

SEQ ID NO: 99689 - DNA, 36 bp, Artificial Sequence
  Synthetic oligonucleotide
agctcaggtagcatagtaggagggagagggggggta

SEQ ID NO: 99690 - DNA, 36 bp, Artificial Sequence
  Synthetic oligonucleotide
ggacagagctgtaggtcaatatacctccctgttgta

SEQ ID NO: 99691 - DNA, 35 bp, Artificial Sequence
  Synthetic oligonucleotide
gtcatcccacccgactggcgtataacgtactaccc

SEQ ID NO: 99692 - DNA, 35 bp, Artificial Sequence
  Synthetic oligonucleotide
tcagagacaccgctaattaaccatgccatcacagc

SEQ ID NO: 99693 - DNA, 32 bp, Artificial Sequence
  Synthetic oligonucleotide
tccaatcccgacgcacaacggataattccatc

SEQ ID NO: 99694 - DNA, 35 bp, Artificial Sequence
  Synthetic oligonucleotide
gtgatggacgtcatcccgccattttgttccacttc

SEQ ID NO: 99695 - DNA, 35 bp, Artificial Sequence
  Synthetic oligonucleotide
gcaccgcatggcatcccgacgccttcaactggacg

SEQ ID NO: 99696 - DNA, 35 bp, Artificial Sequence
  Synthetic oligonucleotide
agcgaaggccgtgggcaaacgggacagggcgggcg

SEQ ID NO: 99697 - DNA, 35 bp, Artificial Sequence
  Synthetic oligonucleotide
tgaccatccagaccgccccttacacgtgaactgcg

SEQ ID NO: 99698 - DNA, 35 bp, Artificial Sequence
  Synthetic oligonucleotide
gacaaccactgacacgttcgctcatatgcgtgtcg

SEQ ID NO: 99699 - DNA, 35 bp, Artificial Sequence
  Synthetic oligonucleotide
agtggagccacacattccctagctcttgggcctgg

SEQ ID NO: 99700 - DNA, 34 bp, Artificial Sequence
  Synthetic oligonucleotide
ttcattcacactgtcctgctgctgttctaccctg

SEQ ID NO: 99701 - DNA, 35 bp, Artificial Sequence
  Synthetic oligonucleotide
ttggtccggcaaagacggcgaacatagggaagctg

SEQ ID NO: 99702 - DNA, 35 bp, Artificial Sequence
  Synthetic oligonucleotide
taagagaacaagagaggaggacacaatagagcttg

SEQ ID NO: 99703 - DNA, 35 bp, Artificial Sequence
  Synthetic oligonucleotide
gcctcatgtcgtcatacctcttaggttcccgtttg

SEQ ID NO: 99704 - DNA, 35 bp, Artificial Sequence
  Synthetic oligonucleotide
gatacgcgtcaccggtcaaatccatcacatttttg

SEQ ID NO: 99705 - DNA, 35 bp, Artificial Sequence
  Synthetic oligonucleotide
gtgggctcacttatgctgtttctcacatgttgaat

SEQ ID NO: 99706 - DNA, 35 bp, Artificial Sequence
  Synthetic oligonucleotide
gaaaagggttgcagggttggtagagtggcagacat

SEQ ID NO: 99707 - DNA, 35 bp, Artificial Sequence
  Synthetic oligonucleotide
gttgttccggagtcattcgttcgatgtaactttat

SEQ ID NO: 99708 - DNA, 35 bp, Artificial Sequence
  Synthetic oligonucleotide
agaaccaccacagatgaggcgaatgccaatgcact

SEQ ID NO: 99709 - DNA, 35 bp, Artificial Sequence
  Synthetic oligonucleotide
agatggaagggcaaaaaagcgtgtaggatggatct

SEQ ID NO: 99710 - DNA, 35 bp, Artificial Sequence
  Synthetic oligonucleotide
gccgtgtccgcaggtaattcacctagattctgtct

SEQ ID NO: 99711 - DNA, 36 bp, Artificial Sequence
  Synthetic oligonucleotide
tgtcacggggggaggcctatctaggcaaagttaaaa

SEQ ID NO: 99712 - DNA, 35 bp, Artificial Sequence
  Synthetic oligonucleotide
gaacaccggtcgaagcgctttagaaccacgccaaa

SEQ ID NO: 99713 - DNA, 36 bp, Artificial Sequence
  Synthetic oligonucleotide
acacggaggcctggaaataggtgtgtgcaggtgaaa

SEQ ID NO: 99714 - DNA, 36 bp, Artificial Sequence
  Synthetic oligonucleotide
acctgcgtccaaacgacgtcctatgggcccaaacaa

SEQ ID NO: 99715 - DNA, 36 bp, Artificial Sequence
  Synthetic oligonucleotide
gctcacccaggagtaatcaatctgttgtggccagaa

SEQ ID NO: 99716 - DNA, 35 bp, Artificial Sequence
  Synthetic oligonucleotide
aacgcctgttgccgatgtcccagcctgtgagcgaa

SEQ ID NO: 99717 - DNA, 36 bp, Artificial Sequence
  Synthetic oligonucleotide
tccactaccagcctgtgggcaaactccatccaataa

SEQ ID NO: 99718 - DNA, 35 bp, Artificial Sequence
  Synthetic oligonucleotide
tgcatcagccagacaatacccgggccattctctaa

SEQ ID NO: 99719 - DNA, 35 bp, Artificial Sequence
  Synthetic oligonucleotide
gcgcacacataggtctctcggacgaagctcatcca

SEQ ID NO: 99720 - DNA, 35 bp, Artificial Sequence
  Synthetic oligonucleotide
ggttgcacagctggtgcctttttccagtaactcca

SEQ ID NO: 99721 - DNA, 36 bp, Artificial Sequence
  Synthetic oligonucleotide
tgtggggggcggtatatatatgtgaagggggatgca

SEQ ID NO: 99722 - DNA, 36 bp, Artificial Sequence
  Synthetic oligonucleotide
gtcgccctcctagttctaagagtacccggattatca

SEQ ID NO: 99723 - DNA, 36 bp, Artificial Sequence
  Synthetic oligonucleotide
gatgagtgtggccgggagaaatttcgcagacattca

SEQ ID NO: 99724 - DNA, 37 bp, Artificial Sequence
  Synthetic oligonucleotide
gacgaaggaacgggaaggaaatggtgggggctaaaga

SEQ ID NO: 99725 - DNA, 37 bp, Artificial Sequence
  Synthetic oligonucleotide
gaggacttgaagatgggtggagatacgggcgaacaga

SEQ ID NO: 99726 - DNA, 36 bp, Artificial Sequence
  Synthetic oligonucleotide
taagcacaccgggacggatttagtgccaggatacga

SEQ ID NO: 99727 - DNA, 37 bp, Artificial Sequence
  Synthetic oligonucleotide
acgagcactcaagcgtatcccgatctattcttaccga

SEQ ID NO: 99728 - DNA, 37 bp, Artificial Sequence
  Synthetic oligonucleotide
gctcaccatcctgtgcactttgagtctgatggatcga

SEQ ID NO: 99729 - DNA, 37 bp, Artificial Sequence
  Synthetic oligonucleotide
actgatccactgtctatttagcccgcgatatactcga

SEQ ID NO: 99730 - DNA, 36 bp, Artificial Sequence
  Synthetic oligonucleotide
aacgcgccctctctgcttgcaacacgttttgttcga

SEQ ID NO: 99731 - DNA, 37 bp, Artificial Sequence
  Synthetic oligonucleotide
tgcaaccaaacatgtatgatcgtagagatggtgagga

SEQ ID NO: 99732 - DNA, 37 bp, Artificial Sequence
  Synthetic oligonucleotide
tcaaggacaagtggcgatcagtaatggtagagtagga

SEQ ID NO: 99733 - DNA, 37 bp, Artificial Sequence
  Synthetic oligonucleotide
tcgcaagatgggaggttgcggtataactgttgaggga

SEQ ID NO: 99734 - DNA, 37 bp, Artificial Sequence
  Synthetic oligonucleotide
gacacacctaacatagccttataatgccagcttggga

SEQ ID NO: 99735 - DNA, 38 bp, Artificial Sequence
  Synthetic oligonucleotide
agttaccagccgaaggtgcatagtgagtagagtaatga

SEQ ID NO: 99736 - DNA, 36 bp, Artificial Sequence
  Synthetic oligonucleotide
gcgccgagaggcgtcgttaaaaatattcaccactga

SEQ ID NO: 99737 - DNA, 37 bp, Artificial Sequence
  Synthetic oligonucleotide
gttgaccctgagtgcgttcgcagtcgattccatctga

SEQ ID NO: 99738 - DNA, 37 bp, Artificial Sequence
  Synthetic oligonucleotide
tcgagtgggggacttggtatggttgggtatcttctga

SEQ ID NO: 99739 - DNA, 38 bp, Artificial Sequence
  Synthetic oligonucleotide
tacgagagccgttcagataacgcgagcccttccggtga

SEQ ID NO: 99740 - DNA, 38 bp, Artificial Sequence
  Synthetic oligonucleotide
tgaggtggcggaagggttggggaaggtccttcgggtga

SEQ ID NO: 99741 - DNA, 38 bp, Artificial Sequence
  Synthetic oligonucleotide
tggacatgttgacagggaaggaggggcgctattggtga

SEQ ID NO: 99742 - DNA, 38 bp, Artificial Sequence
  Synthetic oligonucleotide
tagtgcgacgttcggtgtgaggagaacgcaaagtgtga

SEQ ID NO: 99743 - DNA, 38 bp, Artificial Sequence
  Synthetic oligonucleotide
aaggaagggcacggtgcggaactcaaggcgatctttga

SEQ ID NO: 99744 - DNA, 37 bp, Artificial Sequence
  Synthetic oligonucleotide
aactgccatacagggaatgtgtatgcgttcaggcata

SEQ ID NO: 99745 - DNA, 36 bp, Artificial Sequence
  Synthetic oligonucleotide
tgatggtgcatggggctgcacaagtaactgggcata

SEQ ID NO: 99746 - DNA, 36 bp, Artificial Sequence
  Synthetic oligonucleotide
actggacggtgagggagttggtctgaaaatgagata

SEQ ID NO: 99747 - DNA, 36 bp, Artificial Sequence
  Synthetic oligonucleotide
ttgccatcacaagaagtaacaagcgtgagtggccta

SEQ ID NO: 99748 - DNA, 35 bp, Artificial Sequence
  Synthetic oligonucleotide
gcacgcgtgtgactccggctgccgtactctatcta

SEQ ID NO: 99749 - DNA, 36 bp, Artificial Sequence
  Synthetic oligonucleotide
ttcgccgggaagtaggaaaggggcgacgacatggta

SEQ ID NO: 99750 - DNA, 35 bp, Artificial Sequence
  Synthetic oligonucleotide
aacctcaagccatctggcctcttgtacatgtggta

SEQ ID NO: 99751 - DNA, 35 bp, Artificial Sequence
  Synthetic oligonucleotide
cattacgatgccttccatgtccgtgagaacctacc

SEQ ID NO: 99752 - DNA, 35 bp, Artificial Sequence
  Synthetic oligonucleotide
ttcaacagtcgccatagctgcacgatagctcatcc

SEQ ID NO: 99753 - DNA, 35 bp, Artificial Sequence
  Synthetic oligonucleotide
tttcagaccactctggtcaagtgaccttaccatgc

SEQ ID NO: 99754 - DNA, 35 bp, Artificial Sequence
  Synthetic oligonucleotide
gagtccgtgccatcgttgtctgattagcttcctgc

SEQ ID NO: 99755 - DNA, 35 bp, Artificial Sequence
  Synthetic oligonucleotide
gactccccggtggtagcaaaaagaaacaatgtttc

SEQ ID NO: 99756 - DNA, 35 bp, Artificial Sequence
  Synthetic oligonucleotide
tggaagtctggggaaaggcgaagagcggagatcag

SEQ ID NO: 99757 - DNA, 35 bp, Artificial Sequence
  Synthetic oligonucleotide
gcacatcgactatagcctcccgaccccacccctag

SEQ ID NO: 99758 - DNA, 35 bp, Artificial Sequence
  Synthetic oligonucleotide
ggacagaacatctctgcccatatgattaccacccg

SEQ ID NO: 99759 - DNA, 35 bp, Artificial Sequence
  Synthetic oligonucleotide
gacaccgagacgagtgaatgccccccgttttatcg

SEQ ID NO: 99760 - DNA, 36 bp, Artificial Sequence
  Synthetic oligonucleotide
gcatgcaagggaggggcggagaatgcaagatcgtcg

SEQ ID NO: 99761 - DNA, 35 bp, Artificial Sequence
  Synthetic oligonucleotide
gtctagtggggaataacgaggaatggaatggcggg

SEQ ID NO: 99762 - DNA, 35 bp, Artificial Sequence
  Synthetic oligonucleotide
gcgtgagcagtatgggcgggagattgaagcagatg

SEQ ID NO: 99763 - DNA, 35 bp, Artificial Sequence
  Synthetic oligonucleotide
gtgccggaggcaggggggtgtaaaagtcgattgtg

SEQ ID NO: 99764 - DNA, 35 bp, Artificial Sequence
  Synthetic oligonucleotide
gacccgccgcgggcatcacttctaagtcctccgat

SEQ ID NO: 99765 - DNA, 35 bp, Artificial Sequence
  Synthetic oligonucleotide
actgcattgagcggtcatgtgtgggaaatggtgat

SEQ ID NO: 99766 - DNA, 35 bp, Artificial Sequence
  Synthetic oligonucleotide
tccctcgcaacggaagcgctctcaaagcttcccct

SEQ ID NO: 99767 - DNA, 35 bp, Artificial Sequence
  Synthetic oligonucleotide
tctgacaccgccgccctgtagtacatcttttcgtt

SEQ ID NO: 99768 - DNA, 36 bp, Artificial Sequence
  Synthetic oligonucleotide
gttgtccccgagctctatccttcgaatacactgaaa

SEQ ID NO: 99769 - DNA, 36 bp, Artificial Sequence
  Synthetic oligonucleotide
aacaagacggtggggatacatgtaaggcgggtacaa

SEQ ID NO: 99770 - DNA, 35 bp, Artificial Sequence
  Synthetic oligonucleotide
tgtaaagtcaaatcgcgctccctcacactgctgaa

SEQ ID NO: 99771 - DNA, 36 bp, Artificial Sequence
  Synthetic oligonucleotide
tgtggacaggtggggagcaaggaagtcgtgacctaa

SEQ ID NO: 99772 - DNA, 35 bp, Artificial Sequence
  Synthetic oligonucleotide
acacgcgcattccggcgaactacgcagagagcaca

SEQ ID NO: 99773 - DNA, 35 bp, Artificial Sequence
  Synthetic oligonucleotide
atgcacaccgcctctgtagtagatcattataccca

SEQ ID NO: 99774 - DNA, 36 bp, Artificial Sequence
  Synthetic oligonucleotide
tgacacggcgtagtaacggcactacggctcctcgca

SEQ ID NO: 99775 - DNA, 35 bp, Artificial Sequence
  Synthetic oligonucleotide
tcaacaaccgaataaggacagtgggggtgacaaga

SEQ ID NO: 99776 - DNA, 37 bp, Artificial Sequence
  Synthetic oligonucleotide
tgcgggtggagttggcgagatagaatggagggcaaga

SEQ ID NO: 99777 - DNA, 36 bp, Artificial Sequence
  Synthetic oligonucleotide
gagtgccccacagctgtcttgaagatagcatgcaga

SEQ ID NO: 99778 - DNA, 37 bp, Artificial Sequence
  Synthetic oligonucleotide
gaccacgctggacgtggctaggtacgtgggaactaga

SEQ ID NO: 99779 - DNA, 37 bp, Artificial Sequence
  Synthetic oligonucleotide
taccgaccaccgttccgcatgcgtattcccacctaga

SEQ ID NO: 99780 - DNA, 37 bp, Artificial Sequence
  Synthetic oligonucleotide
tcagggagggtacaagggtactgacttgacaggccga

SEQ ID NO: 99781 - DNA, 37 bp, Artificial Sequence
  Synthetic oligonucleotide
gaatcgccccgatctggctacacagcgcatcctgcga

SEQ ID NO: 99782 - DNA, 37 bp, Artificial Sequence
  Synthetic oligonucleotide
acaccaagtcgtcatgcaggatcgggagggaagcgga

SEQ ID NO: 99783 - DNA, 37 bp, Artificial Sequence
  Synthetic oligonucleotide
ttgacaccggggcaaaaacggatggatagtcgtggga

SEQ ID NO: 99784 - DNA, 37 bp, Artificial Sequence
  Synthetic oligonucleotide
ttcacctgaccctctgattactcgcccagtctaatga

SEQ ID NO: 99785 - DNA, 38 bp, Artificial Sequence
  Synthetic oligonucleotide
gcacaccgcaacttgtgagggctgacacgggaccatga

SEQ ID NO: 99786 - DNA, 36 bp, Artificial Sequence
  Synthetic oligonucleotide
gatgccgtcccatcgcatagtggtaccgtaccatga

SEQ ID NO: 99787 - DNA, 37 bp, Artificial Sequence
  Synthetic oligonucleotide
gacaccaagcaggcgcatcaacccggtcacatcatga

SEQ ID NO: 99788 - DNA, 38 bp, Artificial Sequence
  Synthetic oligonucleotide
tcatcggacgtactgagagcagtgttagtgagtcatga

SEQ ID NO: 99789 - DNA, 38 bp, Artificial Sequence
  Synthetic oligonucleotide
tacgcacggggacatgctgttcgaagtcagactgatga

SEQ ID NO: 99790 - DNA, 37 bp, Artificial Sequence
  Synthetic oligonucleotide
gaatcgcaagtgcgtccatagcttaccacctacttga

SEQ ID NO: 99791 - DNA, 38 bp, Artificial Sequence
  Synthetic oligonucleotide
tacacgcgcagacgccatcgccacccaggttggtttga

SEQ ID NO: 99792 - DNA, 35 bp, Artificial Sequence
  Synthetic oligonucleotide
aacacacggtaaggcggttggacgcaagcaggata

SEQ ID NO: 99793 - DNA, 37 bp, Artificial Sequence
  Synthetic oligonucleotide
caggatgggagaggcagtagtgtctgtgtgcaggata

SEQ ID NO: 99794 - DNA, 35 bp, Artificial Sequence
  Synthetic oligonucleotide
gtgagctcacccaccgggttaataatgtcacaaac

SEQ ID NO: 99795 - DNA, 35 bp, Artificial Sequence
  Synthetic oligonucleotide
aagacacccactgatccgtcttcgtcattttctac

SEQ ID NO: 99796 - DNA, 36 bp, Artificial Sequence
  Synthetic oligonucleotide
ttggtccccagcttacttgtagtcgttcctcctagc

SEQ ID NO: 99797 - DNA, 35 bp, Artificial Sequence
  Synthetic oligonucleotide
taggacgggaatcgaaaaaagagtagcatgcggtc

SEQ ID NO: 99798 - DNA, 35 bp, Artificial Sequence
  Synthetic oligonucleotide
gtaccaccgacgtttgatctgagctcaaaatgaag

SEQ ID NO: 99799 - DNA, 35 bp, Artificial Sequence
  Synthetic oligonucleotide
gccatccgtcataggcacacgctgagcaccgtaag

SEQ ID NO: 99800 - DNA, 35 bp, Artificial Sequence
  Synthetic oligonucleotide
gattgcacgagcggtaaataagaagcaacgaacag

SEQ ID NO: 99801 - DNA, 35 bp, Artificial Sequence
  Synthetic oligonucleotide
atcgtacggacgttgggaagaggcaaggggttacg

SEQ ID NO: 99802 - DNA, 35 bp, Artificial Sequence
  Synthetic oligonucleotide
gtgaaatgccacaggaacgttacaacggacggggg

SEQ ID NO: 99803 - DNA, 35 bp, Artificial Sequence
  Synthetic oligonucleotide
tcaatcgctcccgcataccgtccctatctgacctg

SEQ ID NO: 99804 - DNA, 35 bp, Artificial Sequence
  Synthetic oligonucleotide
tgtcccacttacgctagtatttctgatctcctgtg

SEQ ID NO: 99805 - DNA, 35 bp, Artificial Sequence
  Synthetic oligonucleotide
ggtccgaccggcactctaattactgacacttgcat

SEQ ID NO: 99806 - DNA, 35 bp, Artificial Sequence
  Synthetic oligonucleotide
ttcgacgatcctcacgagcattctggtccacctat

SEQ ID NO: 99807 - DNA, 35 bp, Artificial Sequence
  Synthetic oligonucleotide
tgcccggtcagtggagttttaattgttccaaccct

SEQ ID NO: 99808 - DNA, 35 bp, Artificial Sequence
  Synthetic oligonucleotide
ggatccgccaccacgcaggccacccgttgcaccct

SEQ ID NO: 99809 - DNA, 36 bp, Artificial Sequence
  Synthetic oligonucleotide
gatgtacgcccgcaatgttttcggtgtctctataaa

SEQ ID NO: 99810 - DNA, 35 bp, Artificial Sequence
  Synthetic oligonucleotide
tgacgaacggccacatagcgtaccacagtattaaa

SEQ ID NO: 99811 - DNA, 36 bp, Artificial Sequence
  Synthetic oligonucleotide
ttcgctgcctggtctgacacagcctcgtaatttaaa

SEQ ID NO: 99812 - DNA, 36 bp, Artificial Sequence
  Synthetic oligonucleotide
acagccccgcagaacacgaaacagcctgggcggtaa

SEQ ID NO: 99813 - DNA, 36 bp, Artificial Sequence
  Synthetic oligonucleotide
gtgcgagccacatcgtgatctaggctcggactcaca

SEQ ID NO: 99814 - DNA, 36 bp, Artificial Sequence
  Synthetic oligonucleotide
gctacgcggagcaattgggtcaatcagggagaagca

SEQ ID NO: 99815 - DNA, 37 bp, Artificial Sequence
  Synthetic oligonucleotide
gggtcaggggtagggatttatgaggcgggcaggaaga

SEQ ID NO: 99816 - DNA, 37 bp, Artificial Sequence
  Synthetic oligonucleotide
gaagcgaaatggggcaagtacttacgaaacgtcgaga

SEQ ID NO: 99817 - DNA, 37 bp, Artificial Sequence
  Synthetic oligonucleotide
gatgccgtgtcgcagaggttaagatgggggacaacga

SEQ ID NO: 99818 - DNA, 37 bp, Artificial Sequence
  Synthetic oligonucleotide
gaacaccatccgataggtatcagaagctgctagacga

SEQ ID NO: 99819 - DNA, 37 bp, Artificial Sequence
  Synthetic oligonucleotide
tgtccacctgcctaaccgtgttgctttgaacccgcga

SEQ ID NO: 99820 - DNA, 37 bp, Artificial Sequence
  Synthetic oligonucleotide
taagacgcatcaagggattgaggtagcatcataagga

SEQ ID NO: 99821 - DNA, 35 bp, Artificial Sequence
  Synthetic oligonucleotide
gaggacacagtgagtgcacaagaagggggggagga

SEQ ID NO: 99822 - DNA, 37 bp, Artificial Sequence
  Synthetic oligonucleotide
agcatccccgaagctcattactgtcaggtcagccgga

SEQ ID NO: 99823 - DNA, 37 bp, Artificial Sequence
  Synthetic oligonucleotide
gcgtggaacgcacggtactcgggatcaatactaggga

SEQ ID NO: 99824 - DNA, 37 bp, Artificial Sequence
  Synthetic oligonucleotide
gttgcaagccgaacgcctcatttacaatccgaatgga

SEQ ID NO: 99825 - DNA, 38 bp, Artificial Sequence
  Synthetic oligonucleotide
tacatcggagagtgtcacgtactagggaactggaatga

SEQ ID NO: 99826 - DNA, 38 bp, Artificial Sequence
  Synthetic oligonucleotide
gcacaggtggagagttcagaaagaccagggggtgatga

SEQ ID NO: 99827 - DNA, 38 bp, Artificial Sequence
  Synthetic oligonucleotide
tgtgccacccgctggtgctcttatgccacagtccctga

SEQ ID NO: 99828 - DNA, 38 bp, Artificial Sequence
  Synthetic oligonucleotide
ggagtgggatgggattaatggcgttcggaacggtctga

SEQ ID NO: 99829 - DNA, 37 bp, Artificial Sequence
  Synthetic oligonucleotide
tcaatgcgagcagacacatataagcgtaccggagtga

SEQ ID NO: 99830 - DNA, 37 bp, Artificial Sequence
  Synthetic oligonucleotide
tctaggacagtgcagcatcggcaaagagagatagtga

SEQ ID NO: 99831 - DNA, 37 bp, Artificial Sequence
  Synthetic oligonucleotide
gtgaggggggatagcgcaatggacgtttcacacgtga

SEQ ID NO: 99832 - DNA, 38 bp, Artificial Sequence
  Synthetic oligonucleotide
gcatcgcacgccggtgatgggtaacatggtaagggtga

SEQ ID NO: 99833 - DNA, 36 bp, Artificial Sequence
  Synthetic oligonucleotide
gcccggacgggcaaagggtgaggcacactctcgcta

SEQ ID NO: 99834 - DNA, 36 bp, Artificial Sequence
  Synthetic oligonucleotide
aacacaacaggtggaggatttaacaacatgggagta

SEQ ID NO: 99835 - DNA, 35 bp, Artificial Sequence
  Synthetic oligonucleotide
atgtctgcgggtcacggtcgaatttaagtggagta

SEQ ID NO: 99836 - DNA, 35 bp, Artificial Sequence
  Synthetic oligonucleotide
atgaccgccgccgatgccccaccaacattatcgta

SEQ ID NO: 99837 - DNA, 35 bp, Artificial Sequence
  Synthetic oligonucleotide
ggtcgcacgaacactcgcactgcaacctcggttta

SEQ ID NO: 99838 - DNA, 35 bp, Artificial Sequence
  Synthetic oligonucleotide
acatccccgctatcatgaaatcctggctgcttgac

SEQ ID NO: 99839 - DNA, 35 bp, Artificial Sequence
  Synthetic oligonucleotide
tcaaccaatcaagctagcgcggctgacacacttac

SEQ ID NO: 99840 - DNA, 35 bp, Artificial Sequence
  Synthetic oligonucleotide
tctgatgcggtgcgtttctaagcctctgttgaacc

SEQ ID NO: 99841 - DNA, 35 bp, Artificial Sequence
  Synthetic oligonucleotide
gcctagctccgaactgagtttcgccagcgctagcc

SEQ ID NO: 99842 - DNA, 35 bp, Artificial Sequence
  Synthetic oligonucleotide
gcgattagccgtactgttgtccatattcctcctcc

SEQ ID NO: 99843 - DNA, 35 bp, Artificial Sequence
  Synthetic oligonucleotide
gtcgaacggagggaccactgggacggctgagaagc

SEQ ID NO: 99844 - DNA, 35 bp, Artificial Sequence
  Synthetic oligonucleotide
tccaggacgggatacgtacaaaatgactgataagc

SEQ ID NO: 99845 - DNA, 35 bp, Artificial Sequence
  Synthetic oligonucleotide
gaacgaatcagcgtgccacaagtcaaccgagtatc

SEQ ID NO: 99846 - DNA, 35 bp, Artificial Sequence
  Synthetic oligonucleotide
accgagccgggtgtgcgccaatatacctctgcttc

SEQ ID NO: 99847 - DNA, 35 bp, Artificial Sequence
  Synthetic oligonucleotide
gaattgggtggaagtgacttgaacggcaatcagag

SEQ ID NO: 99848 - DNA, 35 bp, Artificial Sequence
  Synthetic oligonucleotide
aacacgctaagacgaagaactgggaatgagtttag

SEQ ID NO: 99849 - DNA, 35 bp, Artificial Sequence
  Synthetic oligonucleotide
gatgcatagcaatgggggagaagtccatcaggagg

SEQ ID NO: 99850 - DNA, 35 bp, Artificial Sequence
  Synthetic oligonucleotide
acatgccggctacagggtggcattaacaatcttgg

SEQ ID NO: 99851 - DNA, 35 bp, Artificial Sequence
  Synthetic oligonucleotide
tcacacgcgtgaaccggcgaatataccgatcgttg

SEQ ID NO: 99852 - DNA, 35 bp, Artificial Sequence
  Synthetic oligonucleotide
tactgtaacggccaggtgctccaactaccgaccct

SEQ ID NO: 99853 - DNA, 35 bp, Artificial Sequence
  Synthetic oligonucleotide
gaacacaccgagacggatagaatgtaagtactcgt

SEQ ID NO: 99854 - DNA, 34 bp, Artificial Sequence
  Synthetic oligonucleotide
atgccctgcccatgccctccttgtttaccctggt

SEQ ID NO: 99855 - DNA, 35 bp, Artificial Sequence
  Synthetic oligonucleotide
tccacgcagaccaatctgtgcttaggggagttggt

SEQ ID NO: 99856 - DNA, 35 bp, Artificial Sequence
  Synthetic oligonucleotide
gcccaacaccgagtgtaagggcatagaggatactt

SEQ ID NO: 99857 - DNA, 35 bp, Artificial Sequence
  Synthetic oligonucleotide
atcgacacgccggacagtcttggctcacgatcctt

SEQ ID NO: 99858 - DNA, 35 bp, Artificial Sequence
  Synthetic oligonucleotide
tgtctacccccacgcccaatctcgctgttagcaaa

SEQ ID NO: 99859 - DNA, 35 bp, Artificial Sequence
  Synthetic oligonucleotide
tgcgatagccgcagtgttgcttgtccttgttgaaa

SEQ ID NO: 99860 - DNA, 36 bp, Artificial Sequence
  Synthetic oligonucleotide
aatgcgccacctatctgtctcagtccattgcaccaa

SEQ ID NO: 99861 - DNA, 36 bp, Artificial Sequence
  Synthetic oligonucleotide
acgtgccacagcttgcgcatcactcacccccttgaa

SEQ ID NO: 99862 - DNA, 36 bp, Artificial Sequence
  Synthetic oligonucleotide
gacaagcgcatgaacggcgcattcccgacaaggtaa

SEQ ID NO: 99863 - DNA, 36 bp, Artificial Sequence
  Synthetic oligonucleotide
tggagtagcccagcgggaaagggggggtcgaggaca

SEQ ID NO: 99864 - DNA, 36 bp, Artificial Sequence
  Synthetic oligonucleotide
tgagacacagcccactagtattaagccgtgtgtcca

SEQ ID NO: 99865 - DNA, 35 bp, Artificial Sequence
  Synthetic oligonucleotide
gatgacaggtccgccctgcattgacatagtaatca

SEQ ID NO: 99866 - DNA, 37 bp, Artificial Sequence
  Synthetic oligonucleotide
gagtgacagtcgcggtgaactatggaaatggtgaaga

SEQ ID NO: 99867 - DNA, 36 bp, Artificial Sequence
  Synthetic oligonucleotide
aagtggggacgagcgggggtttatagccacgtaaga

SEQ ID NO: 99868 - DNA, 37 bp, Artificial Sequence
  Synthetic oligonucleotide
tgatgctccaaacatgttatgtttctgttccaccaga

SEQ ID NO: 99869 - DNA, 37 bp, Artificial Sequence
  Synthetic oligonucleotide
gagagggggagtgtggtgagcaatcgcgtattgcaga

SEQ ID NO: 99870 - DNA, 35 bp, Artificial Sequence
  Synthetic oligonucleotide
acaacctgactgcagaccaaaagacgaggactaga

SEQ ID NO: 99871 - DNA, 37 bp, Artificial Sequence
  Synthetic oligonucleotide
tgaggaagtccagatgataggggggaggcttagtaga

SEQ ID NO: 99872 - DNA, 37 bp, Artificial Sequence
  Synthetic oligonucleotide
aaccgcaaacgaggggggggatagggcgaagtgtaga

SEQ ID NO: 99873 - DNA, 37 bp, Artificial Sequence
  Synthetic oligonucleotide
tagtaccgcacatggcacgtataagactatgtttaga

SEQ ID NO: 99874 - DNA, 37 bp, Artificial Sequence
  Synthetic oligonucleotide
gacacggtgaggtatggcggaacatgggaggtacgga

SEQ ID NO: 99875 - DNA, 37 bp, Artificial Sequence
  Synthetic oligonucleotide
gaaggggaagggggagggtttcgagacgaaaagcgga

SEQ ID NO: 99876 - DNA, 36 bp, Artificial Sequence
  Synthetic oligonucleotide
acacgagtgttgcgcgaacggggagaaaaagtcgga

SEQ ID NO: 99877 - DNA, 37 bp, Artificial Sequence
  Synthetic oligonucleotide
gcactatcagaggaaaagatcagaaccaaggaaggga

SEQ ID NO: 99878 - DNA, 38 bp, Artificial Sequence
  Synthetic oligonucleotide
accgacagtggaccgagggaagaagaggaggtggatga

SEQ ID NO: 99879 - DNA, 38 bp, Artificial Sequence
  Synthetic oligonucleotide
accaccgccccagtctctctggcatcacttaagtatga

SEQ ID NO: 99880 - DNA, 36 bp, Artificial Sequence
  Synthetic oligonucleotide
gccggatcacacggttggcctttttcgcactcctga

SEQ ID NO: 99881 - DNA, 38 bp, Artificial Sequence
  Synthetic oligonucleotide
gcactggaaggacagtgggagggagagggcatttctga

SEQ ID NO: 99882 - DNA, 37 bp, Artificial Sequence
  Synthetic oligonucleotide
gcacgcagtgcggtgatagaaaaacttctcagtgtga

SEQ ID NO: 99883 - DNA, 35 bp, Artificial Sequence
  Synthetic oligonucleotide
acgacccgccgatcgctcgtattgaacgaatttga

SEQ ID NO: 99884 - DNA, 36 bp, Artificial Sequence
  Synthetic oligonucleotide
gtgtcgaacacggtggatagtagtgctgatgcgata

SEQ ID NO: 99885 - DNA, 37 bp, Artificial Sequence
  Synthetic oligonucleotide
ttagagccgcggcctttcaccaccacagactagtcta

SEQ ID NO: 99886 - DNA, 36 bp, Artificial Sequence
  Synthetic oligonucleotide
atcgagcatgtggatatgtgattggtgggggtagta

SEQ ID NO: 99887 - DNA, 36 bp, Artificial Sequence
  Synthetic oligonucleotide
agagggggtcgcatcgagctgttccatctacaatta

SEQ ID NO: 99888 - DNA, 36 bp, Artificial Sequence
  Synthetic oligonucleotide
tcactggcaacccagccatcgctgcagtgtgcctta

SEQ ID NO: 99889 - DNA, 35 bp, Artificial Sequence
  Synthetic oligonucleotide
tcagtagctccacagctgcgattaccatcgataac

SEQ ID NO: 99890 - DNA, 35 bp, Artificial Sequence
  Synthetic oligonucleotide
tccccacgagctgtaaagcacttcctcgctgacac

SEQ ID NO: 99891 - DNA, 35 bp, Artificial Sequence
  Synthetic oligonucleotide
gcacgacaatctctcccgtagctatgtcatttcac

SEQ ID NO: 99892 - DNA, 35 bp, Artificial Sequence
  Synthetic oligonucleotide
tatggctagtcatccccgctgtcctatcgtactac

SEQ ID NO: 99893 - DNA, 35 bp, Artificial Sequence
  Synthetic oligonucleotide
atccgcaggctaacaatgggcttacaaattccacc

SEQ ID NO: 99894 - DNA, 35 bp, Artificial Sequence
  Synthetic oligonucleotide
tcaaccgcaaacgtgacttagcctctttgtttccc

SEQ ID NO: 99895 - DNA, 35 bp, Artificial Sequence
  Synthetic oligonucleotide
atctatcggccctgcctcgatcccctgcttcaagc

SEQ ID NO: 99896 - DNA, 35 bp, Artificial Sequence
  Synthetic oligonucleotide
ggaccaccactatctctctaatccgactgactcgc

SEQ ID NO: 99897 - DNA, 35 bp, Artificial Sequence
  Synthetic oligonucleotide
gccgaagcgcggggtggcgggcttggcacatgaag

SEQ ID NO: 99898 - DNA, 35 bp, Artificial Sequence
  Synthetic oligonucleotide
agagcaacaaaagcgatcgggaacatgggcactag

SEQ ID NO: 99899 - DNA, 35 bp, Artificial Sequence
  Synthetic oligonucleotide
agcgaaagccgatttgaagagggttggataagagg

SEQ ID NO: 99900 - DNA, 34 bp, Artificial Sequence
  Synthetic oligonucleotide
acaagagaaagagggattagagagggaggtacgg

SEQ ID NO: 99901 - DNA, 35 bp, Artificial Sequence
  Synthetic oligonucleotide
gacgtgctgccgtagcgtgggttctatctgggggg

SEQ ID NO: 99902 - DNA, 35 bp, Artificial Sequence
  Synthetic oligonucleotide
tgagaacggtaggcgtggtaggagagttgggtggg

SEQ ID NO: 99903 - DNA, 35 bp, Artificial Sequence
  Synthetic oligonucleotide
ttcgcccaacgtcatcctttctgttgtctgggcat

SEQ ID NO: 99904 - DNA, 35 bp, Artificial Sequence
  Synthetic oligonucleotide
ttccgccccatctctgacaccaggacgttcctcct

SEQ ID NO: 99905 - DNA, 35 bp, Artificial Sequence
  Synthetic oligonucleotide
tgtccatcgcattactacagcaccatctctaatct

SEQ ID NO: 99906 - DNA, 35 bp, Artificial Sequence
  Synthetic oligonucleotide
gagatcgcggcacccattatttcctgatctgactt

SEQ ID NO: 99907 - DNA, 35 bp, Artificial Sequence
  Synthetic oligonucleotide
tgacaaagtgcgacggtttttggtcactatagctt

SEQ ID NO: 99908 - DNA, 35 bp, Artificial Sequence
  Synthetic oligonucleotide
acaccacactgagcaccggactgactgtttgaaaa

SEQ ID NO: 99909 - DNA, 36 bp, Artificial Sequence
  Synthetic oligonucleotide
gattaccgtacagcactgtgtaaaccaacacccaaa

SEQ ID NO: 99910 - DNA, 33 bp, Artificial Sequence
  Synthetic oligonucleotide
tacatgacggacaaaaggctcattcggggcaaa

SEQ ID NO: 99911 - DNA, 36 bp, Artificial Sequence
  Synthetic oligonucleotide
accgctgcatcacgactgacccatctcccatccgaa

SEQ ID NO: 99912 - DNA, 35 bp, Artificial Sequence
  Synthetic oligonucleotide
ttccacgcccgtccacacgcattttcaggtccgaa

SEQ ID NO: 99913 - DNA, 35 bp, Artificial Sequence
  Synthetic oligonucleotide
taggacaacaagcgctgttctgtggggagggtgaa

SEQ ID NO: 99914 - DNA, 36 bp, Artificial Sequence
  Synthetic oligonucleotide
gacatcaggatggagttattgaagagtgaagtgaca

SEQ ID NO: 99915 - DNA, 35 bp, Artificial Sequence
  Synthetic oligonucleotide
tcagaggagcaaatggtcccgtctagggctttaca

SEQ ID NO: 99916 - DNA, 35 bp, Artificial Sequence
  Synthetic oligonucleotide
tgcagaagcacctgtctccctggcaccctttacca

SEQ ID NO: 99917 - DNA, 35 bp, Artificial Sequence
  Synthetic oligonucleotide
gcctccgacccgtccattctaggctggtgcctgca

SEQ ID NO: 99918 - DNA, 37 bp, Artificial Sequence
  Synthetic oligonucleotide
gtggagtggacgaggttgaggatgtggaggcttcaga

SEQ ID NO: 99919 - DNA, 37 bp, Artificial Sequence
  Synthetic oligonucleotide
gtagggccacagcataagtaggacggctatttggaga

SEQ ID NO: 99920 - DNA, 37 bp, Artificial Sequence
  Synthetic oligonucleotide
tgccatccaccccgaatagtatcagttcgacaataga

SEQ ID NO: 99921 - DNA, 36 bp, Artificial Sequence
  Synthetic oligonucleotide
tgagaccgcccagtatgttgtaaacatacacctaga

SEQ ID NO: 99922 - DNA, 35 bp, Artificial Sequence
  Synthetic oligonucleotide
gacagggcggtccgcagctgaccattttacctaga

SEQ ID NO: 99923 - DNA, 36 bp, Artificial Sequence
  Synthetic oligonucleotide
taagcacatgtagagggtgaatgaggagttacagga

SEQ ID NO: 99924 - DNA, 37 bp, Artificial Sequence
  Synthetic oligonucleotide
gacaagcgcgaacgggcagttgaggcgatgttaggga

SEQ ID NO: 99925 - DNA, 38 bp, Artificial Sequence
  Synthetic oligonucleotide
agtggcgacacatgccgattatgtcccgtatgctatga

SEQ ID NO: 99926 - DNA, 38 bp, Artificial Sequence
  Synthetic oligonucleotide
tgtcggtcccggccaccgctctttgtcgctatcactga

SEQ ID NO: 99927 - DNA, 38 bp, Artificial Sequence
  Synthetic oligonucleotide
gaggtccgaggcagggtacgacatccaagctcttctga

SEQ ID NO: 99928 - DNA, 38 bp, Artificial Sequence
  Synthetic oligonucleotide
tcaacaagacgggcagaggtgcaactatcctctggtga

SEQ ID NO: 99929 - DNA, 38 bp, Artificial Sequence
  Synthetic oligonucleotide
gatgccgtggcaagtattcgggtaggagggggatgtga

SEQ ID NO: 99930 - DNA, 38 bp, Artificial Sequence
  Synthetic oligonucleotide
acatgtcctcgcccgagatataccaacctgtcttgtga

SEQ ID NO: 99931 - DNA, 38 bp, Artificial Sequence
  Synthetic oligonucleotide
tcgaacaggggaaggtttgggatgagggtgatacttga

SEQ ID NO: 99932 - DNA, 36 bp, Artificial Sequence
  Synthetic oligonucleotide
gtgtgcctggaggatacacgtacttggactgtgcta

SEQ ID NO: 99933 - DNA, 36 bp, Artificial Sequence
  Synthetic oligonucleotide
atcgccgctcaagcatcctcaaacggccccaaggta

SEQ ID NO: 99934 - DNA, 36 bp, Artificial Sequence
  Synthetic oligonucleotide
actccgcctcgagccacgggtcgtgttaaatcttta

SEQ ID NO: 99935 - DNA, 35 bp, Artificial Sequence
  Synthetic oligonucleotide
gaacccagggtagaacgaagtcagtgatgactatc

SEQ ID NO: 99936 - DNA, 35 bp, Artificial Sequence
  Synthetic oligonucleotide
tctcccactgccgtacttcccccttacgatggttc

SEQ ID NO: 99937 - DNA, 35 bp, Artificial Sequence
  Synthetic oligonucleotide
tccgcggtcgactcgcaaaacaaaacctgcaaaag

SEQ ID NO: 99938 - DNA, 35 bp, Artificial Sequence
  Synthetic oligonucleotide
atggaggggcgaagggaatgccgagactctctgag

SEQ ID NO: 99939 - DNA, 35 bp, Artificial Sequence
  Synthetic oligonucleotide
tatgcaccataggaattgggagtagagttagggcg

SEQ ID NO: 99940 - DNA, 35 bp, Artificial Sequence
  Synthetic oligonucleotide
tgactcaatcagcgacgtacctcactacatcatgg

SEQ ID NO: 99941 - DNA, 35 bp, Artificial Sequence
  Synthetic oligonucleotide
gttaagtgccgttgtggtgaggggaggtctcgatg

SEQ ID NO: 99942 - DNA, 35 bp, Artificial Sequence
  Synthetic oligonucleotide
ggaccagtagcaatgagaggttggagtaggtcttg

SEQ ID NO: 99943 - DNA, 35 bp, Artificial Sequence
  Synthetic oligonucleotide
gtcatccaccgtcccacccgtgtccatgcaacact

SEQ ID NO: 99944 - DNA, 35 bp, Artificial Sequence
  Synthetic oligonucleotide
tgaggtacgcgaacaagggcgaggaggggggtgct

SEQ ID NO: 99945 - DNA, 35 bp, Artificial Sequence
  Synthetic oligonucleotide
tcacatcctccttccagtgtgtcgttactccctgt

SEQ ID NO: 99946 - DNA, 35 bp, Artificial Sequence
  Synthetic oligonucleotide
tagtgcccgctgaatacatctcgtctgctacgctt

SEQ ID NO: 99947 - DNA, 35 bp, Artificial Sequence
  Synthetic oligonucleotide
tccgccacacgatatctagtccccgaacgccagtt

SEQ ID NO: 99948 - DNA, 35 bp, Artificial Sequence
  Synthetic oligonucleotide
ttgaccatcacatgcgaatgcccctcactcgattt

SEQ ID NO: 99949 - DNA, 35 bp, Artificial Sequence
  Synthetic oligonucleotide
atgtcgacgccctgttgttcaagcattccatgttt

SEQ ID NO: 99950 - DNA, 35 bp, Artificial Sequence
  Synthetic oligonucleotide
aagtgaacaagggcaagggaagtaagcaaagaaaa

SEQ ID NO: 99951 - DNA, 36 bp, Artificial Sequence
  Synthetic oligonucleotide
tagtagtgtagacaagggaatgtggacaggcaggaa

SEQ ID NO: 99952 - DNA, 35 bp, Artificial Sequence
  Synthetic oligonucleotide
acagatcggaggctcgtaagaaggctggggtggaa

SEQ ID NO: 99953 - DNA, 36 bp, Artificial Sequence
  Synthetic oligonucleotide
tatgacccgtacacctgcattatagcaaaatattaa

SEQ ID NO: 99954 - DNA, 36 bp, Artificial Sequence
  Synthetic oligonucleotide
gtgcacagaggagggttcggacaaattaaatagaca

SEQ ID NO: 99955 - DNA, 36 bp, Artificial Sequence
  Synthetic oligonucleotide
acaccatgctaaaagctgttgtaatagtgtctgcca

SEQ ID NO: 99956 - DNA, 36 bp, Artificial Sequence
  Synthetic oligonucleotide
ttcgtgtcagctgccctgaccgttcatcgatttcca

SEQ ID NO: 99957 - DNA, 36 bp, Artificial Sequence
  Synthetic oligonucleotide
gaagaacgcgctcctgaatcctgtacggtgaatgca

SEQ ID NO: 99958 - DNA, 36 bp, Artificial Sequence
  Synthetic oligonucleotide
attgccccctccgttgtgacacccatgctactctca

SEQ ID NO: 99959 - DNA, 36 bp, Artificial Sequence
  Synthetic oligonucleotide
gcgcaccctctcgcatgtctaaacactctcgcttca

SEQ ID NO: 99960 - DNA, 36 bp, Artificial Sequence
  Synthetic oligonucleotide
tgaacagcatacaggggagatgacatagtgagcaga

SEQ ID NO: 99961 - DNA, 37 bp, Artificial Sequence
  Synthetic oligonucleotide
gttcaacgtccagtatgtgcagtttggcatgtgtaga

SEQ ID NO: 99962 - DNA, 36 bp, Artificial Sequence
  Synthetic oligonucleotide
aaaacgcaatgacgggaaggggaggtgattggccga

SEQ ID NO: 99963 - DNA, 37 bp, Artificial Sequence
  Synthetic oligonucleotide
gaaacgcagggcaaggaggggcatggtatcagcgcga

SEQ ID NO: 99964 - DNA, 37 bp, Artificial Sequence
  Synthetic oligonucleotide
gatagccacgtacatacagatcaccggctcaaggcga

SEQ ID NO: 99965 - DNA, 37 bp, Artificial Sequence
  Synthetic oligonucleotide
aagcacggggggtgatgaggagcggttgagaaatcga

SEQ ID NO: 99966 - DNA, 37 bp, Artificial Sequence
  Synthetic oligonucleotide
tctcgccccccgacaatctttactagaagtacgtcga

SEQ ID NO: 99967 - DNA, 37 bp, Artificial Sequence
  Synthetic oligonucleotide
aatgcgggtgtgtgctcgttcattcttactccacgga

SEQ ID NO: 99968 - DNA, 37 bp, Artificial Sequence
  Synthetic oligonucleotide
gacttgccacgtgcctgaaattaagaacagtatcgga

SEQ ID NO: 99969 - DNA, 37 bp, Artificial Sequence
  Synthetic oligonucleotide
gtcaggcaacatcgctagtgggatgggaggagcggga

SEQ ID NO: 99970 - DNA, 37 bp, Artificial Sequence
  Synthetic oligonucleotide
tcaacccagggttgtttacaccgttcctcttgcggga

SEQ ID NO: 99971 - DNA, 37 bp, Artificial Sequence
  Synthetic oligonucleotide
tagtcgagcacacatcgttaatcatgacacacaatga

SEQ ID NO: 99972 - DNA, 38 bp, Artificial Sequence
  Synthetic oligonucleotide
gaacgacgccctgggtaacaggtagccttatctactga

SEQ ID NO: 99973 - DNA, 37 bp, Artificial Sequence
  Synthetic oligonucleotide
acatctaggcacttacaccggttcgccatacccctga

SEQ ID NO: 99974 - DNA, 38 bp, Artificial Sequence
  Synthetic oligonucleotide
atccacgaatgggcgtaggccacggttttccttcctga

SEQ ID NO: 99975 - DNA, 37 bp, Artificial Sequence
  Synthetic oligonucleotide
gtatgggaggggtagaacggtcgagacgtcgaagtga

SEQ ID NO: 99976 - DNA, 38 bp, Artificial Sequence
  Synthetic oligonucleotide
tcatgccccgaccagagaccgtcattggagtgaggtga

SEQ ID NO: 99977 - DNA, 38 bp, Artificial Sequence
  Synthetic oligonucleotide
gtgatggtcagaagtgtggggaggaaatgacgcggtga

SEQ ID NO: 99978 - DNA, 36 bp, Artificial Sequence
  Synthetic oligonucleotide
gtgtaactgcctgtgcgaataatatctctcgtgtga

SEQ ID NO: 99979 - DNA, 38 bp, Artificial Sequence
  Synthetic oligonucleotide
gatgcgatggtcatctgaggaagaggtagagattgtga

SEQ ID NO: 99980 - DNA, 36 bp, Artificial Sequence
  Synthetic oligonucleotide
ggtaacggacagggacgctataggagggtgagggta

SEQ ID NO: 99981 - DNA, 35 bp, Artificial Sequence
  Synthetic oligonucleotide
gcgaaccgactcgagtgcacatccttcacctggta

SEQ ID NO: 99982 - DNA, 36 bp, Artificial Sequence
  Synthetic oligonucleotide
acagaggggctgcaagtagctaaggtggagggctta

SEQ ID NO: 99983 - DNA, 35 bp, Artificial Sequence
  Synthetic oligonucleotide
aacccggagcggacattgatcgaacatcacaatac

SEQ ID NO: 99984 - DNA, 35 bp, Artificial Sequence
  Synthetic oligonucleotide
ttgtccacttagaacatgttaccgtgtccacatac

SEQ ID NO: 99985 - DNA, 35 bp, Artificial Sequence
  Synthetic oligonucleotide
gaccgtcgcactatgtgcttagcctctcttacccc

SEQ ID NO: 99986 - DNA, 35 bp, Artificial Sequence
  Synthetic oligonucleotide
gtgggcgctgtactgcactctgacttcttttctcc

SEQ ID NO: 99987 - DNA, 36 bp, Artificial Sequence
  Synthetic oligonucleotide
acctgagtcagggagagtgaagggagcagggagcgc

SEQ ID NO: 99988 - DNA, 35 bp, Artificial Sequence
  Synthetic oligonucleotide
gagacgggcaatgaagcgtaggtggaggaggggag

SEQ ID NO: 99989 - DNA, 35 bp, Artificial Sequence
  Synthetic oligonucleotide
gtgcaccgacatccgtcccttttgctagcccgccg

SEQ ID NO: 99990 - DNA, 35 bp, Artificial Sequence
  Synthetic oligonucleotide
attgcacgccccattctccgtacgtccaccgctgg

SEQ ID NO: 99991 - DNA, 35 bp, Artificial Sequence
  Synthetic oligonucleotide
acacaagggcggggggtgtgtaaacctgggagatg

SEQ ID NO: 99992 - DNA, 34 bp, Artificial Sequence
  Synthetic oligonucleotide
tacataacacactcattgggctgatcgaaccttg

SEQ ID NO: 99993 - DNA, 35 bp, Artificial Sequence
  Synthetic oligonucleotide
gcaaaccatggaccgagtagtaggccagtttagat

SEQ ID NO: 99994 - DNA, 35 bp, Artificial Sequence
  Synthetic oligonucleotide
gaacacgaagaggcaatgagcagctaagcgcctat

SEQ ID NO: 99995 - DNA, 35 bp, Artificial Sequence
  Synthetic oligonucleotide
tgtgctgcctttattgtgtacacttcgaactctct

SEQ ID NO: 99996 - DNA, 35 bp, Artificial Sequence
  Synthetic oligonucleotide
gcaacgtgaaaggactcctaatacacaaggcgggt

SEQ ID NO: 99997 - DNA, 35 bp, Artificial Sequence
  Synthetic oligonucleotide
gacgtgtgctgactggctatcgggaaatattttgt

SEQ ID NO: 99998 - DNA, 35 bp, Artificial Sequence
  Synthetic oligonucleotide
gtagcaactgccggcaaaacggacaccagctattt

SEQ ID NO: 99999 - DNA, 35 bp, Artificial Sequence
  Synthetic oligonucleotide
aacaaccgggcagagatcgatatattagccggttt

SEQ ID NO: 100000 - DNA, 35 bp, Artificial Sequence
  Synthetic oligonucleotide
gatgctgcccttatctcaccgagggtcacgctttt

SEQ ID NO: 100001 - DNA, 35 bp, Artificial Sequence
  Synthetic oligonucleotide
tccccctgaccgcacttctagacgactgccacaaa

SEQ ID NO: 100002 - DNA, 36 bp, Artificial Sequence
  Synthetic oligonucleotide
acatggtgcagcctctatctatttacactcgccaaa

SEQ ID NO: 100003 - DNA, 36 bp, Artificial Sequence
  Synthetic oligonucleotide
gggaaaggctggaaagaacggggtctagggatataa

SEQ ID NO: 100004 - DNA, 35 bp, Artificial Sequence
  Synthetic oligonucleotide
gtgcctcactgcttcatccaatcccagttaccaca

SEQ ID NO: 100005 - DNA, 36 bp, Artificial Sequence
  Synthetic oligonucleotide
gaacgcatcgtgctttgggacacagtatgcgaacca

SEQ ID NO: 100006 - DNA, 35 bp, Artificial Sequence
  Synthetic oligonucleotide
taagccagcattggggaaaatactgcgtgattgca

SEQ ID NO: 100007 - DNA, 36 bp, Artificial Sequence
  Synthetic oligonucleotide
aagacacgagtcgcatccgtagttatgaacttttca

SEQ ID NO: 100008 - DNA, 37 bp, Artificial Sequence
  Synthetic oligonucleotide
gccataagtcgtgatggcaataaccgaacggacgaga

SEQ ID NO: 100009 - DNA, 37 bp, Artificial Sequence
  Synthetic oligonucleotide
gtgatgacaagccagtgtagtaatagtagtggggaga

SEQ ID NO: 100010 - DNA, 37 bp, Artificial Sequence
  Synthetic oligonucleotide
gctaacgagcaggagggaaggcgaggggatctggaga

SEQ ID NO: 100011 - DNA, 37 bp, Artificial Sequence
  Synthetic oligonucleotide
actacaccctccagtgccgatagccatagttctacga

SEQ ID NO: 100012 - DNA, 37 bp, Artificial Sequence
  Synthetic oligonucleotide
gactgtggggcacgagtgagtgggaggagaaggccga

SEQ ID NO: 100013 - DNA, 37 bp, Artificial Sequence
  Synthetic oligonucleotide
attgccgtggaacagagggatggactggaggcaagga

SEQ ID NO: 100014 - DNA, 37 bp, Artificial Sequence
  Synthetic oligonucleotide
gccatgataacgtggaaggagaggtgaatggggagga

SEQ ID NO: 100015 - DNA, 37 bp, Artificial Sequence
  Synthetic oligonucleotide
agccgcaagagctaagtttaggggcagaggggtagga

SEQ ID NO: 100016 - DNA, 37 bp, Artificial Sequence
  Synthetic oligonucleotide
tagctgcaccgacacgcttttctagctaacagtggga

SEQ ID NO: 100017 - DNA, 38 bp, Artificial Sequence
  Synthetic oligonucleotide
atgcgtagggtaagacaagtgaggagtcaacatcatga

SEQ ID NO: 100018 - DNA, 38 bp, Artificial Sequence
  Synthetic oligonucleotide
aatgccgggccttgcatatttcacggagaccatgttga

SEQ ID NO: 100019 - DNA, 37 bp, Artificial Sequence
  Synthetic oligonucleotide
gatgagctaccattgatcggcatgagggacgttttga

SEQ ID NO: 100020 - DNA, 35 bp, Artificial Sequence
  Synthetic oligonucleotide
tcctgctctcgccctctagctacggactcctccta

SEQ ID NO: 100021 - DNA, 36 bp, Artificial Sequence
  Synthetic oligonucleotide
tacacgttcgcgcaatgcctgagcactactttgcta

SEQ ID NO: 100022 - DNA, 36 bp, Artificial Sequence
  Synthetic oligonucleotide
gacgatgcagtggtggttgtgtatcgtacgggagta

SEQ ID NO: 100023 - DNA, 36 bp, Artificial Sequence
  Synthetic oligonucleotide
accgccactcgtgggacggtatctccacgtatctta

SEQ ID NO: 100024 - DNA, 36 bp, Artificial Sequence
  Synthetic oligonucleotide
tcgatccctcagtgaagctagcggccacggttctta

SEQ ID NO: 100025 - DNA, 36 bp, Artificial Sequence
  Synthetic oligonucleotide
gaacatggcgccgtcaacatcccacagtcatggtta

SEQ ID NO: 100026 - DNA, 36 bp, Artificial Sequence
  Synthetic oligonucleotide
acaaaggtcgtcacggtctagggggagggttcttta

SEQ ID NO: 100027 - DNA, 35 bp, Artificial Sequence
  Synthetic oligonucleotide
gagacaagcagcccgtgccgtgtcacacctttcac

SEQ ID NO: 100028 - DNA, 35 bp, Artificial Sequence
  Synthetic oligonucleotide
gttgcaaacgaggctactgagcgcgacagacatac

SEQ ID NO: 100029 - DNA, 35 bp, Artificial Sequence
  Synthetic oligonucleotide
gacgccatgcctcccattaaggtgcgtagggttac

SEQ ID NO: 100030 - DNA, 35 bp, Artificial Sequence
  Synthetic oligonucleotide
tgatccagaccgcatctgagcgctgtagtgctacc

SEQ ID NO: 100031 - DNA, 35 bp, Artificial Sequence
  Synthetic oligonucleotide
aacacctccagtcaccacggattccccctgacgcc

SEQ ID NO: 100032 - DNA, 35 bp, Artificial Sequence
  Synthetic oligonucleotide
gcaacgtgcacaaggggtatggttgcaagaaaagc

SEQ ID NO: 100033 - DNA, 34 bp, Artificial Sequence
  Synthetic oligonucleotide
acaccgtgccccctatcgggatatgacatttagc

SEQ ID NO: 100034 - DNA, 35 bp, Artificial Sequence
  Synthetic oligonucleotide
tcagcacagaagtctagctttcgcccgtcctgcgc

SEQ ID NO: 100035 - DNA, 35 bp, Artificial Sequence
  Synthetic oligonucleotide
tcatcgcccgttccgcaaaaatatgcgaaggtatc

SEQ ID NO: 100036 - DNA, 35 bp, Artificial Sequence
  Synthetic oligonucleotide
tacgcctctcttcgagggatgcacaaacattactc

SEQ ID NO: 100037 - DNA, 35 bp, Artificial Sequence
  Synthetic oligonucleotide
gagtgggtaaggtggatgggtgacagaatcagagg

SEQ ID NO: 100038 - DNA, 35 bp, Artificial Sequence
  Synthetic oligonucleotide
agtactggcaaggcgacttgaaccctgattaactg

SEQ ID NO: 100039 - DNA, 35 bp, Artificial Sequence
  Synthetic oligonucleotide
tgtgacggcaatggctccccaaccgaaccaccctg

SEQ ID NO: 100040 - DNA, 34 bp, Artificial Sequence
  Synthetic oligonucleotide
gtgatccccaccaggtccgcccgaccacaccaat

SEQ ID NO: 100041 - DNA, 35 bp, Artificial Sequence
  Synthetic oligonucleotide
gcacacgctcctgcctaaggttattctgttgacat

SEQ ID NO: 100042 - DNA, 35 bp, Artificial Sequence
  Synthetic oligonucleotide
gcccccgcataatcacacgcactttgacgcgtgat

SEQ ID NO: 100043 - DNA, 35 bp, Artificial Sequence
  Synthetic oligonucleotide
acacaccgtcgattagatgttcggtccttatctgt

SEQ ID NO: 100044 - DNA, 36 bp, Artificial Sequence
  Synthetic oligonucleotide
tgacgctccgatcgtccgcagtaatcgctgtaccaa

SEQ ID NO: 100045 - DNA, 36 bp, Artificial Sequence
  Synthetic oligonucleotide
aatgcaggagccactatgccgtgcccattattccaa

SEQ ID NO: 100046 - DNA, 35 bp, Artificial Sequence
  Synthetic oligonucleotide
tccctcatccacctctcgaagtacataacggtcaa

SEQ ID NO: 100047 - DNA, 35 bp, Artificial Sequence
  Synthetic oligonucleotide
gacgaaggtaggcaacaggagacttggagttcgaa

SEQ ID NO: 100048 - DNA, 36 bp, Artificial Sequence
  Synthetic oligonucleotide
gaacagcaccatctgtattatgtaggccttccacca

SEQ ID NO: 100049 - DNA, 36 bp, Artificial Sequence
  Synthetic oligonucleotide
ggacgcggtatcaaggggggggaactgtggcaatca

SEQ ID NO: 100050 - DNA, 36 bp, Artificial Sequence
  Synthetic oligonucleotide
aagagagcagagggggtacatctagaatacgaaaga

SEQ ID NO: 100051 - DNA, 37 bp, Artificial Sequence
  Synthetic oligonucleotide
ttgacaaggaagaggtatggtggaacgagggtcgaga

SEQ ID NO: 100052 - DNA, 37 bp, Artificial Sequence
  Synthetic oligonucleotide
gactgggccaatgacttatttaaaacagctgtgtaga

SEQ ID NO: 100053 - DNA, 37 bp, Artificial Sequence
  Synthetic oligonucleotide
gaatcggagggtggaatttgaggtaaactcgatacga

SEQ ID NO: 100054 - DNA, 35 bp, Artificial Sequence
  Synthetic oligonucleotide
acacacagccgtgttacatgctcaggatgaatcga

SEQ ID NO: 100055 - DNA, 37 bp, Artificial Sequence
  Synthetic oligonucleotide
tcacacaaccatgagagaagctcagtaccacgtagga

SEQ ID NO: 100056 - DNA, 36 bp, Artificial Sequence
  Synthetic oligonucleotide
tgcgcaagcaactccatatgacatttctaccgcgga

SEQ ID NO: 100057 - DNA, 36 bp, Artificial Sequence
  Synthetic oligonucleotide
atgacaagtcggcaagaaaggaagctgggggctgga

SEQ ID NO: 100058 - DNA, 37 bp, Artificial Sequence
  Synthetic oligonucleotide
gttgatgccgtaacgtatttatgcgagagtggaatga

SEQ ID NO: 100059 - DNA, 38 bp, Artificial Sequence
  Synthetic oligonucleotide
gagcacgagaggagggggcatggtcagcatggtgatga

SEQ ID NO: 100060 - DNA, 38 bp, Artificial Sequence
  Synthetic oligonucleotide
tgaactgcagaagtgaaactgtacggccgcccttatga

SEQ ID NO: 100061 - DNA, 37 bp, Artificial Sequence
  Synthetic oligonucleotide
gaccggagagagtaccgagactgcagagggaagctga

SEQ ID NO: 100062 - DNA, 37 bp, Artificial Sequence
  Synthetic oligonucleotide
ggtcaaccacggacggtttagtagggcggtaaagtga

SEQ ID NO: 100063 - DNA, 38 bp, Artificial Sequence
  Synthetic oligonucleotide
tccgtggaacggaccgatgatgtaaaaggtcgtagtga

SEQ ID NO: 100064 - DNA, 37 bp, Artificial Sequence
  Synthetic oligonucleotide
ggactggaccggtacatgggaccgtccaacattgtga

SEQ ID NO: 100065 - DNA, 35 bp, Artificial Sequence
  Synthetic oligonucleotide
gacacgtgagtaagtctggggcagggatggattga

SEQ ID NO: 100066 - DNA, 35 bp, Artificial Sequence
  Synthetic oligonucleotide
taatgcgctggtcacagcttttatccacacccaac

SEQ ID NO: 100067 - DNA, 35 bp, Artificial Sequence
  Synthetic oligonucleotide
tgaacactgacaacgacctatcgaatacagcttac

SEQ ID NO: 100068 - DNA, 35 bp, Artificial Sequence
  Synthetic oligonucleotide
gtgtaacacccccgtgatcaatgtcgcttctttac

SEQ ID NO: 100069 - DNA, 35 bp, Artificial Sequence
  Synthetic oligonucleotide
tcatcactgcagagcctgaagcgaccctgatcacc

SEQ ID NO: 100070 - DNA, 35 bp, Artificial Sequence
  Synthetic oligonucleotide
gcgattagcagtactgttgtccatattccgcctcc

SEQ ID NO: 100071 - DNA, 35 bp, Artificial Sequence
  Synthetic oligonucleotide
tacgcgacaaaaagctgttgctttggagctggtcc

SEQ ID NO: 100072 - DNA, 35 bp, Artificial Sequence
  Synthetic oligonucleotide
tcaccacctccacgaatgatctggagtgcccttcc

SEQ ID NO: 100073 - DNA, 35 bp, Artificial Sequence
  Synthetic oligonucleotide
gcacatcgatcgcggggaggagtgtggagctaggc

SEQ ID NO: 100074 - DNA, 35 bp, Artificial Sequence
  Synthetic oligonucleotide
tctaggggcgctgtatcatgtaaacactatcaatc

SEQ ID NO: 100075 - DNA, 35 bp, Artificial Sequence
  Synthetic oligonucleotide
tgaaccgtggagggggtgtgataagcgtactgtgg

SEQ ID NO: 100076 - DNA, 35 bp, Artificial Sequence
  Synthetic oligonucleotide
ttgactccgcgccggaacttaagttcaacaaaatg

SEQ ID NO: 100077 - DNA, 35 bp, Artificial Sequence
  Synthetic oligonucleotide
aacaccgaacgtcgccgctccgtctcatacatgtg

SEQ ID NO: 100078 - DNA, 35 bp, Artificial Sequence
  Synthetic oligonucleotide
gagggacgactgggagggttagggagggcgaattg

SEQ ID NO: 100079 - DNA, 35 bp, Artificial Sequence
  Synthetic oligonucleotide
tgtgtgagcagaaccgaaatggatgagttgaggat

SEQ ID NO: 100080 - DNA, 36 bp, Artificial Sequence
  Synthetic oligonucleotide
atagacgaggagtggatcgatgatgggggttaacgt

SEQ ID NO: 100081 - DNA, 35 bp, Artificial Sequence
  Synthetic oligonucleotide
tagcggggtgggagcgaaacgtagggaagtctatt

SEQ ID NO: 100082 - DNA, 35 bp, Artificial Sequence
  Synthetic oligonucleotide
tagccacgcctgcgtgcttaacaaaaacctttttt

SEQ ID NO: 100083 - DNA, 36 bp, Artificial Sequence
  Synthetic oligonucleotide
gactccgccacaccctcttctccagttacagtgaaa

SEQ ID NO: 100084 - DNA, 36 bp, Artificial Sequence
  Synthetic oligonucleotide
taagatgcgccatccatccgctaacaggctttccaa

SEQ ID NO: 100085 - DNA, 36 bp, Artificial Sequence
  Synthetic oligonucleotide
gcaaaccataagcatacagtcgaacggggcggggaa

SEQ ID NO: 100086 - DNA, 36 bp, Artificial Sequence
  Synthetic oligonucleotide
aaccaggcctctatcctgttgcgtcgcttatacaca

SEQ ID NO: 100087 - DNA, 35 bp, Artificial Sequence
  Synthetic oligonucleotide
atgccgcaggaaatgaaagttcgctaattcccaca

SEQ ID NO: 100088 - DNA, 36 bp, Artificial Sequence
  Synthetic oligonucleotide
gactgacgaaggattgatattggatggggtcctaca

SEQ ID NO: 100089 - DNA, 35 bp, Artificial Sequence
  Synthetic oligonucleotide
gggaccaggtcgtaacgctgtcattcgtacttcca

SEQ ID NO: 100090 - DNA, 35 bp, Artificial Sequence
  Synthetic oligonucleotide
tagtgggggggcggggaattgacgggtgaatttca

SEQ ID NO: 100091 - DNA, 37 bp, Artificial Sequence
  Synthetic oligonucleotide
gttgggcaacacgcgagacggagggtgggaggggaga

SEQ ID NO: 100092 - DNA, 37 bp, Artificial Sequence
  Synthetic oligonucleotide
gagtgccgcactttggagaatgtcacgattttttaga

SEQ ID NO: 100093 - DNA, 37 bp, Artificial Sequence
  Synthetic oligonucleotide
gcatccaccccagtggtttattctttctgtgagacga

SEQ ID NO: 100094 - DNA, 37 bp, Artificial Sequence
  Synthetic oligonucleotide
gcgaacgcaaatgaggtagcactattcagccatccga

SEQ ID NO: 100095 - DNA, 37 bp, Artificial Sequence
  Synthetic oligonucleotide
gacatacgtggagtgaagtgtcaagagacgtacagga

SEQ ID NO: 100096 - DNA, 37 bp, Artificial Sequence
  Synthetic oligonucleotide
tgaaagggtggacggatatggagatgtggcttgagga

SEQ ID NO: 100097 - DNA, 37 bp, Artificial Sequence
  Synthetic oligonucleotide
aaggaaggactcattgggattttgagggagggtggga

SEQ ID NO: 100098 - DNA, 38 bp, Artificial Sequence
  Synthetic oligonucleotide
aatgcgtggcaggatggtgaagctggcatgtttaatga

SEQ ID NO: 100099 - DNA, 38 bp, Artificial Sequence
  Synthetic oligonucleotide
gagcgccggcacactcataggatgtcacacgtacctga

SEQ ID NO: 100100 - DNA, 38 bp, Artificial Sequence
  Synthetic oligonucleotide
gaagggagtacgcagacactagatatagacggatctga

SEQ ID NO: 100101 - DNA, 37 bp, Artificial Sequence
  Synthetic oligonucleotide
taggacacaatcaggagaggtcaaaaaagatacgtga

SEQ ID NO: 100102 - DNA, 38 bp, Artificial Sequence
  Synthetic oligonucleotide
acaacagctgacgtggaggttagacatcgggggggtga

SEQ ID NO: 100103 - DNA, 38 bp, Artificial Sequence
  Synthetic oligonucleotide
tgcaaacggccgaagggagaaacaagtagttgatgtga

SEQ ID NO: 100104 - DNA, 38 bp, Artificial Sequence
  Synthetic oligonucleotide
tcagccccgaggcttgaataaggcactcctttctgtga

SEQ ID NO: 100105 - DNA, 37 bp, Artificial Sequence
  Synthetic oligonucleotide
gtgggccgtgttatcctgtctttctcgtcacttgtga

SEQ ID NO: 100106 - DNA, 37 bp, Artificial Sequence
  Synthetic oligonucleotide
gaagggtggagtgcagagaagcttgcacataccttga

SEQ ID NO: 100107 - DNA, 37 bp, Artificial Sequence
  Synthetic oligonucleotide
tgtacgggaagagatgaggcagaaggatccgagttga

SEQ ID NO: 100108 - DNA, 36 bp, Artificial Sequence
  Synthetic oligonucleotide
acaacgtgaggagaagtgaaagtacggaggttagta

SEQ ID NO: 100109 - DNA, 36 bp, Artificial Sequence
  Synthetic oligonucleotide
gtgcacaggttcaatctgctctactgtacgatttta

SEQ ID NO: 100110 - DNA, 35 bp, Artificial Sequence
  Synthetic oligonucleotide
atcctgtcccgagtctcctgcgcaccaccatggac

SEQ ID NO: 100111 - DNA, 35 bp, Artificial Sequence
  Synthetic oligonucleotide
gacgaggcatacaacgcatgtatgcttttccatac

SEQ ID NO: 100112 - DNA, 35 bp, Artificial Sequence
  Synthetic oligonucleotide
tcaccgctgggtgtagctccgagtcccgaccctac

SEQ ID NO: 100113 - DNA, 35 bp, Artificial Sequence
  Synthetic oligonucleotide
tgcgcacccaccttatatcgaggccaaacccttac

SEQ ID NO: 100114 - DNA, 35 bp, Artificial Sequence
  Synthetic oligonucleotide
tgcaatgcatgacctgtcctgactctgcccttttc

SEQ ID NO: 100115 - DNA, 35 bp, Artificial Sequence
  Synthetic oligonucleotide
gacactggaggtggggttgggagatagttaatcgg

SEQ ID NO: 100116 - DNA, 35 bp, Artificial Sequence
  Synthetic oligonucleotide
tatacgcaagggtcacaaagtatgtaggtgctgtg

SEQ ID NO: 100117 - DNA, 36 bp, Artificial Sequence
  Synthetic oligonucleotide
gcctcaccgctcctcagttctaggcctcaccccgat

SEQ ID NO: 100118 - DNA, 35 bp, Artificial Sequence
  Synthetic oligonucleotide
gctggtcacatccatccgctcccagacgttaatat

SEQ ID NO: 100119 - DNA, 35 bp, Artificial Sequence
  Synthetic oligonucleotide
ccacgccacccaactcgagcaccaccggtcgtgct

SEQ ID NO: 100120 - DNA, 35 bp, Artificial Sequence
  Synthetic oligonucleotide
gtggaccgacttcacgacctgttaactgggattct

SEQ ID NO: 100121 - DNA, 35 bp, Artificial Sequence
  Synthetic oligonucleotide
gcatggcaccacttctacgttatgccgggttactt

SEQ ID NO: 100122 - DNA, 35 bp, Artificial Sequence
  Synthetic oligonucleotide
tagccagacaaagagaaaagtggatttgacaagtt

SEQ ID NO: 100123 - DNA, 35 bp, Artificial Sequence
  Synthetic oligonucleotide
actacacccgctctacaggtcttgaaaccaacgtt

SEQ ID NO: 100124 - DNA, 35 bp, Artificial Sequence
  Synthetic oligonucleotide
acaagccacacacgcacggtataggcgtcgacttt

SEQ ID NO: 100125 - DNA, 37 bp, Artificial Sequence
  Synthetic oligonucleotide
aagcaacggcatccatctcaccggcactgtatcgaaa

SEQ ID NO: 100126 - DNA, 36 bp, Artificial Sequence
  Synthetic oligonucleotide
tgaccccggtctgtattcgcaccactgcgctgcgaa

SEQ ID NO: 100127 - DNA, 36 bp, Artificial Sequence
  Synthetic oligonucleotide
aatcaagggccgagacgctgactgagatcggaggaa

SEQ ID NO: 100128 - DNA, 35 bp, Artificial Sequence
  Synthetic oligonucleotide
acgcctccccgcctcacgatccccatgtggcctaa

SEQ ID NO: 100129 - DNA, 35 bp, Artificial Sequence
  Synthetic oligonucleotide
gacacacagtacgatggtgagtcaacgtatcccca

SEQ ID NO: 100130 - DNA, 35 bp, Artificial Sequence
  Synthetic oligonucleotide
gtaggggggctgcagtctaaagaagttgtgggcca

SEQ ID NO: 100131 - DNA, 36 bp, Artificial Sequence
  Synthetic oligonucleotide
gaccaagtcaccatttgaaatagcgtcgttttgcca

SEQ ID NO: 100132 - DNA, 36 bp, Artificial Sequence
  Synthetic oligonucleotide
gacaccacgcaagagttattgagtcaatctcgtgca

SEQ ID NO: 100133 - DNA, 37 bp, Artificial Sequence
  Synthetic oligonucleotide
gatgagctgtgagggtagtgcggcgcaagtagagaga

SEQ ID NO: 100134 - DNA, 37 bp, Artificial Sequence
  Synthetic oligonucleotide
tcaactcctccattgtaccgtgatctcagtaatgaga

SEQ ID NO: 100135 - DNA, 38 bp, Artificial Sequence
  Synthetic oligonucleotide
gtcacgctgtagatctcgaaaggatggagtgggaacga

SEQ ID NO: 100136 - DNA, 37 bp, Artificial Sequence
  Synthetic oligonucleotide
atgcaactagctgtggtgttcctgaagtgaagaccga

SEQ ID NO: 100137 - DNA, 37 bp, Artificial Sequence
  Synthetic oligonucleotide
gaccgcgggatgcgccatattcagctgcccctatcga

SEQ ID NO: 100138 - DNA, 37 bp, Artificial Sequence
  Synthetic oligonucleotide
atccgacaggacatgtgaggactcgctaattcttcga

SEQ ID NO: 100139 - DNA, 36 bp, Artificial Sequence
  Synthetic oligonucleotide
taccgaacgcactgttctgtccagacagtgaatgga

SEQ ID NO: 100140 - DNA, 37 bp, Artificial Sequence
  Synthetic oligonucleotide
tgcagagggtggaatgtacgatggctgggcttatgga

SEQ ID NO: 100141 - DNA, 37 bp, Artificial Sequence
  Synthetic oligonucleotide
gagaaggtggcaaaggcgaatgcggtggcgtgctgga

SEQ ID NO: 100142 - DNA, 37 bp, Artificial Sequence
  Synthetic oligonucleotide
ggatcgaagaagggacgtccggacaggaaaggaatga

SEQ ID NO: 100143 - DNA, 38 bp, Artificial Sequence
  Synthetic oligonucleotide
atgtggtcgcagcaataggtccgagtccctgagagtga

SEQ ID NO: 100144 - DNA, 38 bp, Artificial Sequence
  Synthetic oligonucleotide
aacaggagggttagagggggtagactagtcatgagtga

SEQ ID NO: 100145 - DNA, 38 bp, Artificial Sequence
  Synthetic oligonucleotide
gacatgccaaagcgacccaaatggcctcactatcgtga

SEQ ID NO: 100146 - DNA, 37 bp, Artificial Sequence
  Synthetic oligonucleotide
aacagccgcccaaccggtaccgcagatcccaatttga

SEQ ID NO: 100147 - DNA, 38 bp, Artificial Sequence
  Synthetic oligonucleotide
gatgtcgaggaaatgggcgtaggaggaggatcgtttga

SEQ ID NO: 100148 - DNA, 36 bp, Artificial Sequence
  Synthetic oligonucleotide
tcctgcgccacatccgcttactgctcgtgcgcagta

SEQ ID NO: 100149 - DNA, 35 bp, Artificial Sequence
  Synthetic oligonucleotide
tatggctcgccgttattgctctctcgcctcgctac

SEQ ID NO: 100150 - DNA, 35 bp, Artificial Sequence
  Synthetic oligonucleotide
taccaggcgtgcataaccgcgtaccactcactgcc

SEQ ID NO: 100151 - DNA, 35 bp, Artificial Sequence
  Synthetic oligonucleotide
acactacgacaagaaagctttggaacacgctgggc

SEQ ID NO: 100152 - DNA, 35 bp, Artificial Sequence
  Synthetic oligonucleotide
gccgaagatgcgagtgaggacggagagggctagcg

SEQ ID NO: 100153 - DNA, 35 bp, Artificial Sequence
  Synthetic oligonucleotide
aactcacgatagctctgcaaatgagcgtaaattcg

SEQ ID NO: 100154 - DNA, 35 bp, Artificial Sequence
  Synthetic oligonucleotide
tagaccaccagtcgcgttgtgtaagagtgagaagg

SEQ ID NO: 100155 - DNA, 35 bp, Artificial Sequence
  Synthetic oligonucleotide
gagacgtaggcgtaggccgaacagaataactattg

SEQ ID NO: 100156 - DNA, 35 bp, Artificial Sequence
  Synthetic oligonucleotide
tgctcgcactgtccccctcacgcgtagttatacat

SEQ ID NO: 100157 - DNA, 35 bp, Artificial Sequence
  Synthetic oligonucleotide
aaggagcacgcccactgacagtcacaactggccct

SEQ ID NO: 100158 - DNA, 35 bp, Artificial Sequence
  Synthetic oligonucleotide
ttgcattgcgcgccgcaatttttccgcccatttct

SEQ ID NO: 100159 - DNA, 35 bp, Artificial Sequence
  Synthetic oligonucleotide
tatgcaccaaacgtgggttattagtgcgtggtagt

SEQ ID NO: 100160 - DNA, 34 bp, Artificial Sequence
  Synthetic oligonucleotide
tttgcacgaccatgtatctcgctatctattaggt

SEQ ID NO: 100161 - DNA, 35 bp, Artificial Sequence
  Synthetic oligonucleotide
tacctacgccaaggccgtcgtttacgtggacatgt

SEQ ID NO: 100162 - DNA, 35 bp, Artificial Sequence
  Synthetic oligonucleotide
ttggcaagacaggtgcggaagaaagggggcagatt

SEQ ID NO: 100163 - DNA, 35 bp, Artificial Sequence
  Synthetic oligonucleotide
aacacagcccacgactctggtactttgaacatatt

SEQ ID NO: 100164 - DNA, 35 bp, Artificial Sequence
  Synthetic oligonucleotide
gatccaccgcactactgaaccctaaccagtaactt

SEQ ID NO: 100165 - DNA, 32 bp, Artificial Sequence
  Synthetic oligonucleotide
tacaccacgtgttccgtttcgagttcaccgtt

SEQ ID NO: 100166 - DNA, 35 bp, Artificial Sequence
  Synthetic oligonucleotide
agcgcaacgggctgagtgagtggtcctccttgttt

SEQ ID NO: 100167 - DNA, 35 bp, Artificial Sequence
  Synthetic oligonucleotide
ggtcactgcgtggagttgaggaggggggtaatcaa

SEQ ID NO: 100168 - DNA, 36 bp, Artificial Sequence
  Synthetic oligonucleotide
gaagcgtagctcctatagctcctcgataattccgaa

SEQ ID NO: 100169 - DNA, 36 bp, Artificial Sequence
  Synthetic oligonucleotide
gacgcaggggtggggctgggatggggcctcggataa

SEQ ID NO: 100170 - DNA, 36 bp, Artificial Sequence
  Synthetic oligonucleotide
gaccagtagggtggagttgaggagcacagtgttcca

SEQ ID NO: 100171 - DNA, 36 bp, Artificial Sequence
  Synthetic oligonucleotide
gaggtacatccaacctggatagccatttgcttcgca

SEQ ID NO: 100172 - DNA, 36 bp, Artificial Sequence
  Synthetic oligonucleotide
attgccccctcctttgtgacacccctgctactctca

SEQ ID NO: 100173 - DNA, 38 bp, Artificial Sequence
  Synthetic oligonucleotide
tccatcacctgcctgccgtatatccgatcccatattca

SEQ ID NO: 100174 - DNA, 35 bp, Artificial Sequence
  Synthetic oligonucleotide
gtgaacgtactgccaaggcttctgaatgctccaga

SEQ ID NO: 100175 - DNA, 36 bp, Artificial Sequence
  Synthetic oligonucleotide
agtgaggggatgtaggtgtgcaatcttagtgtcaga

SEQ ID NO: 100176 - DNA, 37 bp, Artificial Sequence
  Synthetic oligonucleotide
gaagggagacgcgggactgaaagggagcagtgcgaga

SEQ ID NO: 100177 - DNA, 36 bp, Artificial Sequence
  Synthetic oligonucleotide
tgcacccttccgcatgcgtgaccgctagtccgtaga

SEQ ID NO: 100178 - DNA, 37 bp, Artificial Sequence
  Synthetic oligonucleotide
gcgagggtatcaggagcaaaaacaaggcagaattcga

SEQ ID NO: 100179 - DNA, 37 bp, Artificial Sequence
  Synthetic oligonucleotide
acagagtgcgagggtgggaatgacaaggtacgaagga

SEQ ID NO: 100180 - DNA, 37 bp, Artificial Sequence
  Synthetic oligonucleotide
ttgaagcgggagtcgggtaaggcgaggggggaaggga

SEQ ID NO: 100181 - DNA, 37 bp, Artificial Sequence
  Synthetic oligonucleotide
gatccaatgcagcttgtgaggtagggctggacgtgga

SEQ ID NO: 100182 - DNA, 37 bp, Artificial Sequence
  Synthetic oligonucleotide
atgacatggcgcacattcgtttcttgggcctcgtgga

SEQ ID NO: 100183 - DNA, 38 bp, Artificial Sequence
  Synthetic oligonucleotide
ttgttactgcccgatcgatgaggccactctcaggatga

SEQ ID NO: 100184 - DNA, 38 bp, Artificial Sequence
  Synthetic oligonucleotide
gtgatgcaggctggtaagttaaagggaggggagagtga

SEQ ID NO: 100185 - DNA, 38 bp, Artificial Sequence
  Synthetic oligonucleotide
tacgcaccaacaaccatcagtgacgttcacggacgtga

SEQ ID NO: 100186 - DNA, 37 bp, Artificial Sequence
  Synthetic oligonucleotide
tacctacaccgatccacacaatacgtgttatttgtga

SEQ ID NO: 100187 - DNA, 38 bp, Artificial Sequence
  Synthetic oligonucleotide
ttgacaccgctgccatttgatttctatgctctcattga

SEQ ID NO: 100188 - DNA, 38 bp, Artificial Sequence
  Synthetic oligonucleotide
gttgggtccgggaagtgaacgaagagggctgggcttga

SEQ ID NO: 100189 - DNA, 36 bp, Artificial Sequence
  Synthetic oligonucleotide
gctcaggtccgttgttccctttgcacaccactcata

SEQ ID NO: 100190 - DNA, 35 bp, Artificial Sequence
  Synthetic oligonucleotide
gatcaggaagcgagggcggacgtgggactttacta

SEQ ID NO: 100191 - DNA, 36 bp, Artificial Sequence
  Synthetic oligonucleotide
gccggatgtggcgtctgagttcaagcccctctccta

SEQ ID NO: 100192 - DNA, 36 bp, Artificial Sequence
  Synthetic oligonucleotide
tagacgttggggcgcgagagaagggtccaaatgcta

SEQ ID NO: 100193 - DNA, 35 bp, Artificial Sequence
  Synthetic oligonucleotide
tactagcgctgacaagcttggccatcgcatatcta

SEQ ID NO: 100194 - DNA, 35 bp, Artificial Sequence
  Synthetic oligonucleotide
gaaccgcgcggactcttcatcgtagccgttttcta

SEQ ID NO: 100195 - DNA, 36 bp, Artificial Sequence
  Synthetic oligonucleotide
ttgaccgcgggaaaagggatgagacctgcacgggta

SEQ ID NO: 100196 - DNA, 35 bp, Artificial Sequence
  Synthetic oligonucleotide
gtgaagcacgtattgcgaaaccgggtcggtgatta

SEQ ID NO: 100197 - DNA, 35 bp, Artificial Sequence
  Synthetic oligonucleotide
gaacatgaaaggggtgaaggatactgacgtactta

SEQ ID NO: 100198 - DNA, 36 bp, Artificial Sequence
  Synthetic oligonucleotide
gtgaccgtcaccaacgcaaggactcacactctttta

SEQ ID NO: 100199 - DNA, 35 bp, Artificial Sequence
  Synthetic oligonucleotide
accgacgttgcgtgcacatcaagtcttcttcacac

SEQ ID NO: 100200 - DNA, 35 bp, Artificial Sequence
  Synthetic oligonucleotide
gcatcgtgaactctgctgttacatccttgcgtgcc

SEQ ID NO: 100201 - DNA, 35 bp, Artificial Sequence
  Synthetic oligonucleotide
tgaaccccattacggagctgtagcgacatgccagc

SEQ ID NO: 100202 - DNA, 35 bp, Artificial Sequence
  Synthetic oligonucleotide
atgcccggagccatggcaagcaactctcccgaatc

SEQ ID NO: 100203 - DNA, 35 bp, Artificial Sequence
  Synthetic oligonucleotide
tcacgacaccgcattattctgcctgcctgtactcg

SEQ ID NO: 100204 - DNA, 35 bp, Artificial Sequence
  Synthetic oligonucleotide
attgcaagctacacattggtctgtgcacactctcg

SEQ ID NO: 100205 - DNA, 35 bp, Artificial Sequence
  Synthetic oligonucleotide
atgggtagggcagaccggtgggacccgaaaaaggg

SEQ ID NO: 100206 - DNA, 35 bp, Artificial Sequence
  Synthetic oligonucleotide
gtgaggggcgggtactgggtgaatatcgttaatgg

SEQ ID NO: 100207 - DNA, 35 bp, Artificial Sequence
  Synthetic oligonucleotide
gctggagaaatacacttggggtcaccctaaccatg

SEQ ID NO: 100208 - DNA, 35 bp, Artificial Sequence
  Synthetic oligonucleotide
tgcaccagttaggtgctgcccctatgcattggaat

SEQ ID NO: 100209 - DNA, 35 bp, Artificial Sequence
  Synthetic oligonucleotide
aataccatttacaccgcacacatcgttgtttgcct

SEQ ID NO: 100210 - DNA, 35 bp, Artificial Sequence
  Synthetic oligonucleotide
tgcggagccaacgtctcagagaaaagcttcgttgt

SEQ ID NO: 100211 - DNA, 34 bp, Artificial Sequence
  Synthetic oligonucleotide
tgagtggacgattgacggattttgagatgtgctt

SEQ ID NO: 100212 - DNA, 35 bp, Artificial Sequence
  Synthetic oligonucleotide
acacgccgtgggcagtagtggtcccgttcctgaaa

SEQ ID NO: 100213 - DNA, 36 bp, Artificial Sequence
  Synthetic oligonucleotide
gcaccggacggaagttaaaaccggggaatgagtgaa

SEQ ID NO: 100214 - DNA, 36 bp, Artificial Sequence
  Synthetic oligonucleotide
tacgacgctcacatctaccctaacctcgccattgaa

SEQ ID NO: 100215 - DNA, 36 bp, Artificial Sequence
  Synthetic oligonucleotide
tccatgcgcaagaagatatgggaatcatgcgtcaca

SEQ ID NO: 100216 - DNA, 36 bp, Artificial Sequence
  Synthetic oligonucleotide
gacgcccctgtcgatatgtccgtaatccggtttaca

SEQ ID NO: 100217 - DNA, 37 bp, Artificial Sequence
  Synthetic oligonucleotide
atcaccgtctgacggtcaaccgcggtacttcctatca

SEQ ID NO: 100218 - DNA, 36 bp, Artificial Sequence
  Synthetic oligonucleotide
gatcgatcacagctgttctcgggcgacttgagctca

SEQ ID NO: 100219 - DNA, 36 bp, Artificial Sequence
  Synthetic oligonucleotide
attagctgtcaccctccgtatggcagaacccgctca

SEQ ID NO: 100220 - DNA, 35 bp, Artificial Sequence
  Synthetic oligonucleotide
tccaccccatcactgaactccgggcacctttgtca

SEQ ID NO: 100221 - DNA, 37 bp, Artificial Sequence
  Synthetic oligonucleotide
tatgagcgggcaggacggtgacttgaacgtaaacaga

SEQ ID NO: 100222 - DNA, 37 bp, Artificial Sequence
  Synthetic oligonucleotide
gttcaaccgccgggattactaatggcagggattgaga

SEQ ID NO: 100223 - DNA, 37 bp, Artificial Sequence
  Synthetic oligonucleotide
gtgatacgcgatgtgctccatgattacctgtgataga

SEQ ID NO: 100224 - DNA, 37 bp, Artificial Sequence
  Synthetic oligonucleotide
acagcagggtggggaagcggtggagagaattgaacga

SEQ ID NO: 100225 - DNA, 37 bp, Artificial Sequence
  Synthetic oligonucleotide
tagccggacgtaaccggtggttctgtgtaccgttcga

SEQ ID NO: 100226 - DNA, 37 bp, Artificial Sequence
  Synthetic oligonucleotide
tgtagtacagggtggaagggggagtaagtctgaggga

SEQ ID NO: 100227 - DNA, 36 bp, Artificial Sequence
  Synthetic oligonucleotide
atcaccaggcgaactgggcgagcatattggagggga

SEQ ID NO: 100228 - DNA, 37 bp, Artificial Sequence
  Synthetic oligonucleotide
gaggagggaggcaagggtttgcgagagcaggttggga

SEQ ID NO: 100229 - DNA, 36 bp, Artificial Sequence
  Synthetic oligonucleotide
gagggccgaagtgtgggcaaatattgcaggagtgga

SEQ ID NO: 100230 - DNA, 38 bp, Artificial Sequence
  Synthetic oligonucleotide
atgaacgccacggattccggtaccaagctcacccatga

SEQ ID NO: 100231 - DNA, 38 bp, Artificial Sequence
  Synthetic oligonucleotide
actggtagggtacagtgctaaaaggggtggacttatga

SEQ ID NO: 100232 - DNA, 38 bp, Artificial Sequence
  Synthetic oligonucleotide
atgaccagccctaccatgactcagtcgtaccatcctga

SEQ ID NO: 100233 - DNA, 38 bp, Artificial Sequence
  Synthetic oligonucleotide
atgacaagtcatgggggttggagaaggatcaaagctga

SEQ ID NO: 100234 - DNA, 35 bp, Artificial Sequence
  Synthetic oligonucleotide
acccgttgggtacgaggggagtgaaggaaaattga

SEQ ID NO: 100235 - DNA, 36 bp, Artificial Sequence
  Synthetic oligonucleotide
gacgcaccggctgccactgctgttaatttctcttga

SEQ ID NO: 100236 - DNA, 36 bp, Artificial Sequence
  Synthetic oligonucleotide
cagcccactcggtactggagtgcaaatttttcttga

SEQ ID NO: 100237 - DNA, 38 bp, Artificial Sequence
  Synthetic oligonucleotide
gaagacgacagaaagaagacgttagcgggtggagttga

SEQ ID NO: 100238 - DNA, 38 bp, Artificial Sequence
  Synthetic oligonucleotide
gacacccaaaccgatcgtcgtctgtcctctcctgttga

SEQ ID NO: 100239 - DNA, 35 bp, Artificial Sequence
  Synthetic oligonucleotide
acacccgatcgtacttacgtgagcatccttgcata

SEQ ID NO: 100240 - DNA, 36 bp, Artificial Sequence
  Synthetic oligonucleotide
atgcggaccagttaaggcggggaccaggcgggacta

SEQ ID NO: 100241 - DNA, 36 bp, Artificial Sequence
  Synthetic oligonucleotide
tccgcaccctcctttgggctatcctaccgctctcta

SEQ ID NO: 100242 - DNA, 35 bp, Artificial Sequence
  Synthetic oligonucleotide
gtgagactccctacctgacaggttccgctatacac

SEQ ID NO: 100243 - DNA, 35 bp, Artificial Sequence
  Synthetic oligonucleotide
atcgctcacaactgaatgacattatatctcgccac

SEQ ID NO: 100244 - DNA, 35 bp, Artificial Sequence
  Synthetic oligonucleotide
aagaggggtggggggcacatgaaagtcgggtgatc

SEQ ID NO: 100245 - DNA, 36 bp, Artificial Sequence
  Synthetic oligonucleotide
gctaggaaggggagtaataaagcctgatgtcaagag

SEQ ID NO: 100246 - DNA, 35 bp, Artificial Sequence
  Synthetic oligonucleotide
gacgcgaacatggggatgaagatacaggcgagagg

SEQ ID NO: 100247 - DNA, 35 bp, Artificial Sequence
  Synthetic oligonucleotide
atgatgagtggtggaaaagtcgttcaagagcaaat

SEQ ID NO: 100248 - DNA, 35 bp, Artificial Sequence
  Synthetic oligonucleotide
gcccactatcacagcgccctgcccgctccattcat

SEQ ID NO: 100249 - DNA, 35 bp, Artificial Sequence
  Synthetic oligonucleotide
atgaacccatcgccgctgcaggacctgcttcctat

SEQ ID NO: 100250 - DNA, 35 bp, Artificial Sequence
  Synthetic oligonucleotide
ttgacctcagcggcctagcacatggtctgctctat

SEQ ID NO: 100251 - DNA, 35 bp, Artificial Sequence
  Synthetic oligonucleotide
tctcagtgccatgtacgttctaatttgctgtgcct

SEQ ID NO: 100252 - DNA, 35 bp, Artificial Sequence
  Synthetic oligonucleotide
gaataccatcacggagacaggcaggaagcttagct

SEQ ID NO: 100253 - DNA, 35 bp, Artificial Sequence
  Synthetic oligonucleotide
tcacactcgttgacggtaacacgactcgtattgct

SEQ ID NO: 100254 - DNA, 35 bp, Artificial Sequence
  Synthetic oligonucleotide
gaccgagtaagtggtggaagagaaaaccgatcgaa

SEQ ID NO: 100255 - DNA, 35 bp, Artificial Sequence
  Synthetic oligonucleotide
ataccggacataatggggtggggtagacggattaa

SEQ ID NO: 100256 - DNA, 35 bp, Artificial Sequence
  Synthetic oligonucleotide
tcactggctgagggtgggaacgggtgatggagaca

SEQ ID NO: 100257 - DNA, 36 bp, Artificial Sequence
  Synthetic oligonucleotide
tgtagcaccacagccgacgtcgactgatcgcaccca

SEQ ID NO: 100258 - DNA, 36 bp, Artificial Sequence
  Synthetic oligonucleotide
tgacgggaaggacggttggataggactggggaagca

SEQ ID NO: 100259 - DNA, 34 bp, Artificial Sequence
  Synthetic oligonucleotide
atcgcgaggctagtgttttcgcccatcccaatca

SEQ ID NO: 100260 - DNA, 36 bp, Artificial Sequence
  Synthetic oligonucleotide
gtacacgcaacgaacgaagggggctaaaagggaaga

SEQ ID NO: 100261 - DNA, 37 bp, Artificial Sequence
  Synthetic oligonucleotide
tccactcgccacatcgagttagactgtcgtgaccaga

SEQ ID NO: 100262 - DNA, 37 bp, Artificial Sequence
  Synthetic oligonucleotide
aacgacaaggttaggttgtggctagatgaagacgaga

SEQ ID NO: 100263 - DNA, 37 bp, Artificial Sequence
  Synthetic oligonucleotide
gagcggagcatggccactgagcatcaaaatagcgaga

SEQ ID NO: 100264 - DNA, 37 bp, Artificial Sequence
  Synthetic oligonucleotide
agacaaagcgtggagcatgcaggacttagagcggaga

SEQ ID NO: 100265 - DNA, 37 bp, Artificial Sequence
  Synthetic oligonucleotide
aacgcatgtacggtgtgggctgggcgtaattgctaga

SEQ ID NO: 100266 - DNA, 37 bp, Artificial Sequence
  Synthetic oligonucleotide
gtgggacaccggtagattgtcgtactttgtcggtaga

SEQ ID NO: 100267 - DNA, 37 bp, Artificial Sequence
  Synthetic oligonucleotide
gaccaactctgtcgtcatcattgagcctccgtttaga

SEQ ID NO: 100268 - DNA, 37 bp, Artificial Sequence
  Synthetic oligonucleotide
taatgcaagcccagacttttttgctcatgacgaacga

SEQ ID NO: 100269 - DNA, 37 bp, Artificial Sequence
  Synthetic oligonucleotide
atgtgcggtggtgggattgaacaatgtccagtgacga

SEQ ID NO: 100270 - DNA, 35 bp, Artificial Sequence
  Synthetic oligonucleotide
gcactgtgctgcactaattaggccggtaaccccga

SEQ ID NO: 100271 - DNA, 37 bp, Artificial Sequence
  Synthetic oligonucleotide
agtcgccgggcaagcaggatcaaggggaagggcggga

SEQ ID NO: 100272 - DNA, 37 bp, Artificial Sequence
  Synthetic oligonucleotide
ttgaggagaccgggactaggaaagacagcatatggga

SEQ ID NO: 100273 - DNA, 38 bp, Artificial Sequence
  Synthetic oligonucleotide
gacatgcgcaacagcgtgattgagcagttagagtatga

SEQ ID NO: 100274 - DNA, 37 bp, Artificial Sequence
  Synthetic oligonucleotide
gtcgaagagtgggaggtcaatgaatcagtgaaagtga

SEQ ID NO: 100275 - DNA, 36 bp, Artificial Sequence
  Synthetic oligonucleotide
accacgcgagtaacagaaggtggaaagatagaaata

SEQ ID NO: 100276 - DNA, 36 bp, Artificial Sequence
  Synthetic oligonucleotide
gtcacggagagggaaaaggctagggactcaacggta

SEQ ID NO: 100277 - DNA, 36 bp, Artificial Sequence
  Synthetic oligonucleotide
tccaagggaacgcacgtggaaagaacaggcgctgta

SEQ ID NO: 100278 - DNA, 36 bp, Artificial Sequence
  Synthetic oligonucleotide
tcacatccaccgaagcgttctgaggacctatcgtta

SEQ ID NO: 100279 - DNA, 35 bp, Artificial Sequence
  Synthetic oligonucleotide
tcccaccgggaacgattatgagattatgtagatac

SEQ ID NO: 100280 - DNA, 35 bp, Artificial Sequence
  Synthetic oligonucleotide
tgctcgctctcggctcctgttccttgccatacacc

SEQ ID NO: 100281 - DNA, 35 bp, Artificial Sequence
  Synthetic oligonucleotide
attgcacgacggggcggacatatgccagaaatatc

SEQ ID NO: 100282 - DNA, 35 bp, Artificial Sequence
  Synthetic oligonucleotide
gcagagtagaccgcggataaaggtaaacgaaagcg

SEQ ID NO: 100283 - DNA, 35 bp, Artificial Sequence
  Synthetic oligonucleotide
gatgtgaggccgagcgaagaattaagtgcggaggg

SEQ ID NO: 100284 - DNA, 35 bp, Artificial Sequence
  Synthetic oligonucleotide
gcgagcaccgcaaggtgatcactcgcctttacctg

SEQ ID NO: 100285 - DNA, 35 bp, Artificial Sequence
  Synthetic oligonucleotide
gcacaccgcaagtgaaggacctttgtgttgaattg

SEQ ID NO: 100286 - DNA, 35 bp, Artificial Sequence
  Synthetic oligonucleotide
gacggagcgccggtcggtcactgctcaaccctcat

SEQ ID NO: 100287 - DNA, 35 bp, Artificial Sequence
  Synthetic oligonucleotide
acgacaccattcgccgggagtactgctgtaactat

SEQ ID NO: 100288 - DNA, 35 bp, Artificial Sequence
  Synthetic oligonucleotide
gccgcacaaccaccctcgtctgtaatgcgatctat

SEQ ID NO: 100289 - DNA, 35 bp, Artificial Sequence
  Synthetic oligonucleotide
aacgcgaggcactgaatacgtccggatcgcttgct

SEQ ID NO: 100290 - DNA, 35 bp, Artificial Sequence
  Synthetic oligonucleotide
gatccggccagtgcgcaactcatcaacggtcactt

SEQ ID NO: 100291 - DNA, 35 bp, Artificial Sequence
  Synthetic oligonucleotide
tatgtaatcggtgtcatgaaaaagatgttttcgtt

SEQ ID NO: 100292 - DNA, 35 bp, Artificial Sequence
  Synthetic oligonucleotide
gatagtgacagtgcggaatgagattagtaggtgtt

SEQ ID NO: 100293 - DNA, 34 bp, Artificial Sequence
  Synthetic oligonucleotide
tgacaacctgatgcatgtaaagcggactgtcaaa

SEQ ID NO: 100294 - DNA, 36 bp, Artificial Sequence
  Synthetic oligonucleotide
gtgcaggtcgcacattatactggtcgctacttgaaa

SEQ ID NO: 100295 - DNA, 36 bp, Artificial Sequence
  Synthetic oligonucleotide
tgtgggtcgcacgtacaactttagcaacgtttacaa

SEQ ID NO: 100296 - DNA, 35 bp, Artificial Sequence
  Synthetic oligonucleotide
gtaacgcacgagagaggttgaagcttgacggggaa

SEQ ID NO: 100297 - DNA, 35 bp, Artificial Sequence
  Synthetic oligonucleotide
gcaccacgatcgcgatgtacctcgcccaatgacca

SEQ ID NO: 100298 - DNA, 35 bp, Artificial Sequence
  Synthetic oligonucleotide
aacaaccgtccgtcgggcacttatagaggggggca

SEQ ID NO: 100299 - DNA, 37 bp, Artificial Sequence
  Synthetic oligonucleotide
gcaatgtatgaggattgaggtaggggtccgagacaga

SEQ ID NO: 100300 - DNA, 37 bp, Artificial Sequence
  Synthetic oligonucleotide
gagactaggcgcgagacgagagggtaagaacgggaga

SEQ ID NO: 100301 - DNA, 37 bp, Artificial Sequence
  Synthetic oligonucleotide
tgtcagggcgcagtacgtggcctgacagcgacttaga

SEQ ID NO: 100302 - DNA, 37 bp, Artificial Sequence
  Synthetic oligonucleotide
acccagccctcaccatgtgtcatcagcgtaatttaga

SEQ ID NO: 100303 - DNA, 37 bp, Artificial Sequence
  Synthetic oligonucleotide
agcgtgagcgtaaggaacggagtagtgtggtaaacga

SEQ ID NO: 100304 - DNA, 37 bp, Artificial Sequence
  Synthetic oligonucleotide
acctgactcatcagggatagggacagtaagagggcga

SEQ ID NO: 100305 - DNA, 37 bp, Artificial Sequence
  Synthetic oligonucleotide
gttggcgtaagcggagtgttcagtgctgttgatcgga

SEQ ID NO: 100306 - DNA, 37 bp, Artificial Sequence
  Synthetic oligonucleotide
tttgaccacaatcagaccgggttgggaggtagtggga

SEQ ID NO: 100307 - DNA, 37 bp, Artificial Sequence
  Synthetic oligonucleotide
gatggctgacagacaatctcgtaaactactccatgga

SEQ ID NO: 100308 - DNA, 38 bp, Artificial Sequence
  Synthetic oligonucleotide
ccacaggagtgagaataggattatagagttttgaatga

SEQ ID NO: 100309 - DNA, 38 bp, Artificial Sequence
  Synthetic oligonucleotide
gttgcaacgccaactggtgatacaaacgacgacgatga

SEQ ID NO: 100310 - DNA, 38 bp, Artificial Sequence
  Synthetic oligonucleotide
tatgacgatggaaggtgtgttctaacgcggggggatga

SEQ ID NO: 100311 - DNA, 36 bp, Artificial Sequence
  Synthetic oligonucleotide
gtcgtagttcctcacctagtattcgcgtaccactga

SEQ ID NO: 100312 - DNA, 38 bp, Artificial Sequence
  Synthetic oligonucleotide
gtgtctgtccgcgacctgtatgcaagcttcgtacctga

SEQ ID NO: 100313 - DNA, 37 bp, Artificial Sequence
  Synthetic oligonucleotide
aatggagggaccagtgcgtacgggggatcgtgtctga

SEQ ID NO: 100314 - DNA, 38 bp, Artificial Sequence
  Synthetic oligonucleotide
gatggtacagctcttgggggaataatggggtcaagtga

SEQ ID NO: 100315 - DNA, 38 bp, Artificial Sequence
  Synthetic oligonucleotide
taccaggaggatgatgggcaggtaagagggagcggtga

SEQ ID NO: 100316 - DNA, 35 bp, Artificial Sequence
  Synthetic oligonucleotide
aacacgacagacagacctagaccgacattgagaac

SEQ ID NO: 100317 - DNA, 35 bp, Artificial Sequence
  Synthetic oligonucleotide
taatacgcgaggatagaacggggggggagggccac

SEQ ID NO: 100318 - DNA, 35 bp, Artificial Sequence
  Synthetic oligonucleotide
aaacaccccactatggccataatcgtttacatccc

SEQ ID NO: 100319 - DNA, 35 bp, Artificial Sequence
  Synthetic oligonucleotide
acaagccccgctccctccttgtcgttttgtctccc

SEQ ID NO: 100320 - DNA, 35 bp, Artificial Sequence
  Synthetic oligonucleotide
ggggggagtacaattggggtaacacggaaaatatg

SEQ ID NO: 100321 - DNA, 35 bp, Artificial Sequence
  Synthetic oligonucleotide
gccaaataggagggtgggtatggaaagtaaggaat

SEQ ID NO: 100322 - DNA, 35 bp, Artificial Sequence
  Synthetic oligonucleotide
acacaacggacggctggtttctcgctcacactcgt

SEQ ID NO: 100323 - DNA, 35 bp, Artificial Sequence
  Synthetic oligonucleotide
tccaaacgcccgaactgtgtgctacgcgttggaaa

SEQ ID NO: 100324 - DNA, 36 bp, Artificial Sequence
  Synthetic oligonucleotide
accacgaccgtctcaacccctgtgcttatctcgcaa

SEQ ID NO: 100325 - DNA, 36 bp, Artificial Sequence
  Synthetic oligonucleotide
gcattcgtaacatcattcaagctcattgcttggcaa

SEQ ID NO: 100326 - DNA, 36 bp, Artificial Sequence
  Synthetic oligonucleotide
gaacacccaccgatcaatcaagagccccgcactcaa

SEQ ID NO: 100327 - DNA, 35 bp, Artificial Sequence
  Synthetic oligonucleotide
ttgaacgagtccagggaaggtgatactagaaggaa

SEQ ID NO: 100328 - DNA, 36 bp, Artificial Sequence
  Synthetic oligonucleotide
gatgtggttgcaagtgatctatcagggtcgagggaa

SEQ ID NO: 100329 - DNA, 36 bp, Artificial Sequence
  Synthetic oligonucleotide
tgcgtgtcgcaacctgtgcactcaatcctcacttaa

SEQ ID NO: 100330 - DNA, 36 bp, Artificial Sequence
  Synthetic oligonucleotide
gtcgacccagctctcgacgtttattgtctagcttaa

SEQ ID NO: 100331 - DNA, 36 bp, Artificial Sequence
  Synthetic oligonucleotide
gacacacagaataggggatgtgctgggggcaaaaca

SEQ ID NO: 100332 - DNA, 34 bp, Artificial Sequence
  Synthetic oligonucleotide
acaacccgcctcattctttatttgttcgtttaca

SEQ ID NO: 100333 - DNA, 36 bp, Artificial Sequence
  Synthetic oligonucleotide
taggccggtccagaatacctgtaactgtccactcca

SEQ ID NO: 100334 - DNA, 36 bp, Artificial Sequence
  Synthetic oligonucleotide
taacatgcaaagacggtaggagcgtataagagggca

SEQ ID NO: 100335 - DNA, 36 bp, Artificial Sequence
  Synthetic oligonucleotide
gtaacgcccgagtggtccgcaactcgctgaatttca

SEQ ID NO: 100336 - DNA, 35 bp, Artificial Sequence
  Synthetic oligonucleotide
tatggagagcgagggtcgcgaacaatgatgtttca

SEQ ID NO: 100337 - DNA, 36 bp, Artificial Sequence
  Synthetic oligonucleotide
ggaacgcaggaaaactggggtggttcggggtaccga

SEQ ID NO: 100338 - DNA, 37 bp, Artificial Sequence
  Synthetic oligonucleotide
gtcgaatcaaaaggggcataagggtaggtgatatcga

SEQ ID NO: 100339 - DNA, 37 bp, Artificial Sequence
  Synthetic oligonucleotide
atcgcattgcagtaatggaatggaagtgtagagagga

SEQ ID NO: 100340 - DNA, 36 bp, Artificial Sequence
  Synthetic oligonucleotide
taatgggcgggatcgggaaagttggaagtggaggga

SEQ ID NO: 100341 - DNA, 36 bp, Artificial Sequence
  Synthetic oligonucleotide
agacacactcaaaagcgagggagagattgggcggga

SEQ ID NO: 100342 - DNA, 37 bp, Artificial Sequence
  Synthetic oligonucleotide
accacaccgaagagtcaccgaagactgatcgatggga

SEQ ID NO: 100343 - DNA, 37 bp, Artificial Sequence
  Synthetic oligonucleotide
tgtcggtagggagaagaaggagaaacaggggattgga

SEQ ID NO: 100344 - DNA, 37 bp, Artificial Sequence
  Synthetic oligonucleotide
gacgagggagggttgtaacaattaatgagggtttgga

SEQ ID NO: 100345 - DNA, 38 bp, Artificial Sequence
  Synthetic oligonucleotide
ttgtgcggaacagagctcctggacaccgtcgctactga

SEQ ID NO: 100346 - DNA, 35 bp, Artificial Sequence
  Synthetic oligonucleotide
tgaatgctgagagggtagaagaggtgtgtatctga

SEQ ID NO: 100347 - DNA, 38 bp, Artificial Sequence
  Synthetic oligonucleotide
tagccaatgcgtgcgaggatggcatgaaggtgaagtga

SEQ ID NO: 100348 - DNA, 38 bp, Artificial Sequence
  Synthetic oligonucleotide
taggacaggtcgagagtcgtactcaaggtgattcgtga

SEQ ID NO: 100349 - DNA, 38 bp, Artificial Sequence
  Synthetic oligonucleotide
ttaggttgagcagggtatatggtaagcaagaggtgtga

SEQ ID NO: 100350 - DNA, 38 bp, Artificial Sequence
  Synthetic oligonucleotide
gaacgagcggagggtgtgcggagaggagggaaaattga

SEQ ID NO: 100351 - DNA, 37 bp, Artificial Sequence
  Synthetic oligonucleotide
gacacgagcactagaagacaaaggaagtgagtcttga

SEQ ID NO: 100352 - DNA, 37 bp, Artificial Sequence
  Synthetic oligonucleotide
agaccgggacagtaaaataacgaggagttcgatttga

SEQ ID NO: 100353 - DNA, 38 bp, Artificial Sequence
  Synthetic oligonucleotide
tagatacgagggagtggaggaaaagattcagcctttga

SEQ ID NO: 100354 - DNA, 38 bp, Artificial Sequence
  Synthetic oligonucleotide
gtgggcggggggcgatacaacaacattacaggttttga

SEQ ID NO: 100355 - DNA, 36 bp, Artificial Sequence
  Synthetic oligonucleotide
gagttacgcaagctttgtcgagccaccacaaccata

SEQ ID NO: 100356 - DNA, 36 bp, Artificial Sequence
  Synthetic oligonucleotide
tagccaacggattggtgggatggtgcatgttaggta

SEQ ID NO: 100357 - DNA, 35 bp, Artificial Sequence
  Synthetic oligonucleotide
acgtacgctcggcactctttcttacacttatgtta

SEQ ID NO: 100358 - DNA, 35 bp, Artificial Sequence
  Synthetic oligonucleotide
acatacaaagggcgagaaagagaaggtctgtgtgc

SEQ ID NO: 100359 - DNA, 35 bp, Artificial Sequence
  Synthetic oligonucleotide
gtgaagtgaagcggaacaagagctgaggttccgtc

SEQ ID NO: 100360 - DNA, 35 bp, Artificial Sequence
  Synthetic oligonucleotide
agatgactccggtgtgggtgggaggaggtgaaacg

SEQ ID NO: 100361 - DNA, 35 bp, Artificial Sequence
  Synthetic oligonucleotide
tcaggcctcctcgaaccccccctacacagcacacg

SEQ ID NO: 100362 - DNA, 35 bp, Artificial Sequence
  Synthetic oligonucleotide
gggatgacgaagcggataggacgggaatagtctgg

SEQ ID NO: 100363 - DNA, 35 bp, Artificial Sequence
  Synthetic oligonucleotide
atgacccgacatcctgcttacaattagtacatgat

SEQ ID NO: 100364 - DNA, 35 bp, Artificial Sequence
  Synthetic oligonucleotide
gagcctcgcaaacgcggtaccacactgaacttgat

SEQ ID NO: 100365 - DNA, 35 bp, Artificial Sequence
  Synthetic oligonucleotide
acaccgctctccgcacatcttccatcagcctgcct

SEQ ID NO: 100366 - DNA, 35 bp, Artificial Sequence
  Synthetic oligonucleotide
tgtcacgctcgacacgatattcaccgtgatgctct

SEQ ID NO: 100367 - DNA, 36 bp, Artificial Sequence
  Synthetic oligonucleotide
tcctcacgcccactacgccgaactggacgatgtcaa

SEQ ID NO: 100368 - DNA, 36 bp, Artificial Sequence
  Synthetic oligonucleotide
atgctccactagacatcactatgacccagctttcaa

SEQ ID NO: 100369 - DNA, 35 bp, Artificial Sequence
  Synthetic oligonucleotide
taatcgacgggggaatatgagaggtcgatggcgaa

SEQ ID NO: 100370 - DNA, 36 bp, Artificial Sequence
  Synthetic oligonucleotide
gttgcgcgcattacgttcttgcgctggatcgaaaca

SEQ ID NO: 100371 - DNA, 35 bp, Artificial Sequence
  Synthetic oligonucleotide
gatgcacggattaacatagggagcctactgaaaca

SEQ ID NO: 100372 - DNA, 35 bp, Artificial Sequence
  Synthetic oligonucleotide
gatggggagacgactgcgggggatgggagtagaca

SEQ ID NO: 100373 - DNA, 36 bp, Artificial Sequence
  Synthetic oligonucleotide
gtgagcgcacctgctacgtagtttaattttacacca

SEQ ID NO: 100374 - DNA, 36 bp, Artificial Sequence
  Synthetic oligonucleotide
tcacgacccagggtgctactcagaccatggctgcca

SEQ ID NO: 100375 - DNA, 36 bp, Artificial Sequence
  Synthetic oligonucleotide
tgaaggacagtaatagtgaacggaagcgggatagca

SEQ ID NO: 100376 - DNA, 36 bp, Artificial Sequence
  Synthetic oligonucleotide
tcccggcccacacctgcgactgttttcggtccatca

SEQ ID NO: 100377 - DNA, 36 bp, Artificial Sequence
  Synthetic oligonucleotide
tcaacatcagcaatggccagcacgataggcctctca

SEQ ID NO: 100378 - DNA, 37 bp, Artificial Sequence
  Synthetic oligonucleotide
aaacgcaacgttggtacgggatctggggcgtggaaga

SEQ ID NO: 100379 - DNA, 37 bp, Artificial Sequence
  Synthetic oligonucleotide
atcacgtgcgggagaacgaagaggagtgggctatcga

SEQ ID NO: 100380 - DNA, 37 bp, Artificial Sequence
  Synthetic oligonucleotide
taacacgggaaatggctataagagttaggctgaggga

SEQ ID NO: 100381 - DNA, 37 bp, Artificial Sequence
  Synthetic oligonucleotide
agtcgccgggcaatcaggagcaaggggaagggcggga

SEQ ID NO: 100382 - DNA, 37 bp, Artificial Sequence
  Synthetic oligonucleotide
acatagcgctcactccgccgtctaagtcttgttggga

SEQ ID NO: 100383 - DNA, 38 bp, Artificial Sequence
  Synthetic oligonucleotide
tgtgtcagggaaaaaggtgaatcagatggtatcctgga

SEQ ID NO: 100384 - DNA, 37 bp, Artificial Sequence
  Synthetic oligonucleotide
gaccacacgctggtgatggatcgtaagcatgtttgga

SEQ ID NO: 100385 - DNA, 37 bp, Artificial Sequence
  Synthetic oligonucleotide
gatgaggaaggggagatcgcggaagcacgtcaaatga

SEQ ID NO: 100386 - DNA, 37 bp, Artificial Sequence
  Synthetic oligonucleotide
gatcatcgcacagtcctcgctataaggcatgatctga

SEQ ID NO: 100387 - DNA, 38 bp, Artificial Sequence
  Synthetic oligonucleotide
gtgtcagtgcgcacaaagtacaataggtgggacagtga

SEQ ID NO: 100388 - DNA, 38 bp, Artificial Sequence
  Synthetic oligonucleotide
atgcttagcatggttcaacccaccgtgttctttcttga

SEQ ID NO: 100389 - DNA, 37 bp, Artificial Sequence
  Synthetic oligonucleotide
gacacccagtagcaggtggagtacatgatccctttga

SEQ ID NO: 100390 - DNA, 38 bp, Artificial Sequence
  Synthetic oligonucleotide
gacaccgtgcgagagttgttcaggattgtacagtttga

SEQ ID NO: 100391 - DNA, 35 bp, Artificial Sequence
  Synthetic oligonucleotide
atcgacggacgaacggatcatattagcggtgagta

SEQ ID NO: 100392 - DNA, 35 bp, Artificial Sequence
  Synthetic oligonucleotide
aaacagacggtcagacacctgtcgttctcacttta

SEQ ID NO: 100393 - DNA, 35 bp, Artificial Sequence
  Synthetic oligonucleotide
gactgccagaggcccacgccctactttttcccaac

SEQ ID NO: 100394 - DNA, 35 bp, Artificial Sequence
  Synthetic oligonucleotide
gggggcgacacacgccctcctaagccactgcgaac

SEQ ID NO: 100395 - DNA, 35 bp, Artificial Sequence
  Synthetic oligonucleotide
gaacatgacgtagacgcgttatcggcgttgatccc

SEQ ID NO: 100396 - DNA, 35 bp, Artificial Sequence
  Synthetic oligonucleotide
gaatcaccgccggatagatgattcgacgaatatcc

SEQ ID NO: 100397 - DNA, 35 bp, Artificial Sequence
  Synthetic oligonucleotide
gccaccggaacggacattaccaccgcaccttaatc

SEQ ID NO: 100398 - DNA, 35 bp, Artificial Sequence
  Synthetic oligonucleotide
aaccgacgccgcactcaacatccgctaccccctag

SEQ ID NO: 100399 - DNA, 35 bp, Artificial Sequence
  Synthetic oligonucleotide
gacacatcctccctgtactcttgagaaaagcaatg

SEQ ID NO: 100400 - DNA, 35 bp, Artificial Sequence
  Synthetic oligonucleotide
gattcgatccctgaatggtatgcctgaaccacatg

SEQ ID NO: 100401 - DNA, 35 bp, Artificial Sequence
  Synthetic oligonucleotide
gatgcccgatcctgtttcagttctatagtgctatg

SEQ ID NO: 100402 - DNA, 35 bp, Artificial Sequence
  Synthetic oligonucleotide
aacgagacacgggacgggacagcaaataaggtgat

SEQ ID NO: 100403 - DNA, 35 bp, Artificial Sequence
  Synthetic oligonucleotide
gaagacaattggtgtggtgcggagaagaggcgtct

SEQ ID NO: 100404 - DNA, 35 bp, Artificial Sequence
  Synthetic oligonucleotide
gtacaccgcatagttacccgccgaccctccaaagt

SEQ ID NO: 100405 - DNA, 35 bp, Artificial Sequence
  Synthetic oligonucleotide
gccaattaccgccgcatttatgaaccatcctgagt

SEQ ID NO: 100406 - DNA, 36 bp, Artificial Sequence
  Synthetic oligonucleotide
gagactagcaggggagagagtttaacagggtgggtt

SEQ ID NO: 100407 - DNA, 35 bp, Artificial Sequence
  Synthetic oligonucleotide
gtggacctgccttgtccctccctgttgtaatccca

SEQ ID NO: 100408 - DNA, 35 bp, Artificial Sequence
  Synthetic oligonucleotide
attgccaccgccgccttccaagtccgcccctcgca

SEQ ID NO: 100409 - DNA, 37 bp, Artificial Sequence
  Synthetic oligonucleotide
agagagggggggatctgaatcgcatgggatgacaaga

SEQ ID NO: 100410 - DNA, 37 bp, Artificial Sequence
  Synthetic oligonucleotide
taacagtggtaggtggcgtaaaggtggaatgcagaga

SEQ ID NO: 100411 - DNA, 37 bp, Artificial Sequence
  Synthetic oligonucleotide
atggaaagcaggagggatatgaaggatactaccgaga

SEQ ID NO: 100412 - DNA, 35 bp, Artificial Sequence
  Synthetic oligonucleotide
gtgagcgcactttgggctaatcctaactctttaga

SEQ ID NO: 100413 - DNA, 37 bp, Artificial Sequence
  Synthetic oligonucleotide
atgcgaggtcacaggagctacccaggaggacatagga

SEQ ID NO: 100414 - DNA, 36 bp, Artificial Sequence
  Synthetic oligonucleotide
attgcgtggcccaggaagtcatagtgaaggggcgga

SEQ ID NO: 100415 - DNA, 37 bp, Artificial Sequence
  Synthetic oligonucleotide
gtgcatgggatgtagcgataaatggggcgggtatgga

SEQ ID NO: 100416 - DNA, 38 bp, Artificial Sequence
  Synthetic oligonucleotide
gaccccccagaccgtgtagtcgaagcccactctactga

SEQ ID NO: 100417 - DNA, 37 bp, Artificial Sequence
  Synthetic oligonucleotide
aacgctcgtgcgttcgtactcagggagaccgggctga

SEQ ID NO: 100418 - DNA, 38 bp, Artificial Sequence
  Synthetic oligonucleotide
atcaacgcagtcaatgaggggaataaggacgggagtga

SEQ ID NO: 100419 - DNA, 38 bp, Artificial Sequence
  Synthetic oligonucleotide
acaaggggggagaggtgtgggccaagctctacacgtga

SEQ ID NO: 100420 - DNA, 37 bp, Artificial Sequence
  Synthetic oligonucleotide
gcaccaatgacaacaagagcagagacacgggctgtga

SEQ ID NO: 100421 - DNA, 38 bp, Artificial Sequence
  Synthetic oligonucleotide
ttagctgggagcaacgcgtatcatgccccgaaccttga

SEQ ID NO: 100422 - DNA, 38 bp, Artificial Sequence
  Synthetic oligonucleotide
gcacaagcccgttcccgtttagactgcactgtcgttga

SEQ ID NO: 100423 - DNA, 37 bp, Artificial Sequence
  Synthetic oligonucleotide
gacgggagatagcagtcaggggatgggggaatgttga

SEQ ID NO: 100424 - DNA, 36 bp, Artificial Sequence
  Synthetic oligonucleotide
aagccacaccccctaccgtatcatgcttggttttga

SEQ ID NO: 100425 - DNA, 36 bp, Artificial Sequence
  Synthetic oligonucleotide
tacaacacggcaaagggaaaggagagacgtgctata

SEQ ID NO: 100426 - DNA, 36 bp, Artificial Sequence
  Synthetic oligonucleotide
gcacccgcaagctgtccgccacccatgccttcgcta

SEQ ID NO: 100427 - DNA, 36 bp, Artificial Sequence
  Synthetic oligonucleotide
ttaccatccaggctgtgcatcccgggccatcccgta

SEQ ID NO: 100428 - DNA, 35 bp, Artificial Sequence
  Synthetic oligonucleotide
gatggatggtgggaagaggacactgtacatgggta

SEQ ID NO: 100429 - DNA, 36 bp, Artificial Sequence
  Synthetic oligonucleotide
actccaaccgctacatgttattgctgcttcccctta

SEQ ID NO: 100430 - DNA, 36 bp, Artificial Sequence
  Synthetic oligonucleotide
taaccggggacgagctttttaatgctgatttgctta

SEQ ID NO: 100431 - DNA, 35 bp, Artificial Sequence
  Synthetic oligonucleotide
gtgagaggaccatgagtgccctcccttcgatccac

SEQ ID NO: 100432 - DNA, 35 bp, Artificial Sequence
  Synthetic oligonucleotide
cagaatcacagcaattctgttccatggtccatcac

SEQ ID NO: 100433 - DNA, 35 bp, Artificial Sequence
  Synthetic oligonucleotide
accggacgcatcctagccacctgttccgctgttac

SEQ ID NO: 100434 - DNA, 35 bp, Artificial Sequence
  Synthetic oligonucleotide
gtgaaccgcctgaaaaatcgaaacctgcgtccgcc

SEQ ID NO: 100435 - DNA, 35 bp, Artificial Sequence
  Synthetic oligonucleotide
gtgccatgctgcgaactatatacggtgtcgcgctc

SEQ ID NO: 100436 - DNA, 34 bp, Artificial Sequence
  Synthetic oligonucleotide
gcaactggaattgctacagagttccatctatctg

SEQ ID NO: 100437 - DNA, 35 bp, Artificial Sequence
  Synthetic oligonucleotide
aacaagtacgcggcaaaaacatcgatgacagtaat

SEQ ID NO: 100438 - DNA, 35 bp, Artificial Sequence
  Synthetic oligonucleotide
tgtgtgtaggaaaaaaaaatggttcgatctcgtat

SEQ ID NO: 100439 - DNA, 35 bp, Artificial Sequence
  Synthetic oligonucleotide
ttgtgccccctcctcatttcgcctggtagcccaaa

SEQ ID NO: 100440 - DNA, 36 bp, Artificial Sequence
  Synthetic oligonucleotide
atggtcacgaactgtgtgttatcatcttactccaaa

SEQ ID NO: 100441 - DNA, 36 bp, Artificial Sequence
  Synthetic oligonucleotide
tccatccctgttgtcgtttccgtaccctgtggtaaa

SEQ ID NO: 100442 - DNA, 36 bp, Artificial Sequence
  Synthetic oligonucleotide
tgacgatccctggtgctgtttatcgtctgccatgaa

SEQ ID NO: 100443 - DNA, 36 bp, Artificial Sequence
  Synthetic oligonucleotide
ttggacaagagcagctcgtgagatggacgcgcataa

SEQ ID NO: 100444 - DNA, 35 bp, Artificial Sequence
  Synthetic oligonucleotide
gacacgctctatcgcaaaggaaagaaaataagcca

SEQ ID NO: 100445 - DNA, 37 bp, Artificial Sequence
  Synthetic oligonucleotide
ttccactacgcccggtcgcatatgccccttctctcca

SEQ ID NO: 100446 - DNA, 35 bp, Artificial Sequence
  Synthetic oligonucleotide
gccaccaggataaacagtgaccggtaatggtagca

SEQ ID NO: 100447 - DNA, 36 bp, Artificial Sequence
  Synthetic oligonucleotide
tgtgaacgcgcacgatcttagtcgccactgttcgca

SEQ ID NO: 100448 - DNA, 36 bp, Artificial Sequence
  Synthetic oligonucleotide
tgaaacgcatgaccgagtatcaagtactcgttttca

SEQ ID NO: 100449 - DNA, 37 bp, Artificial Sequence
  Synthetic oligonucleotide
aacatgggaacaggaggaatagcggccaaaggcgaga

SEQ ID NO: 100450 - DNA, 37 bp, Artificial Sequence
  Synthetic oligonucleotide
tgagggagggaggcgtgggctcgacagatctctgaga

SEQ ID NO: 100451 - DNA, 37 bp, Artificial Sequence
  Synthetic oligonucleotide
aacatggtaagagacgtcattcaggaggacgggtaga

SEQ ID NO: 100452 - DNA, 36 bp, Artificial Sequence
  Synthetic oligonucleotide
atgtactgccaacgtatcaagggaatgagcttccga

SEQ ID NO: 100453 - DNA, 36 bp, Artificial Sequence
  Synthetic oligonucleotide
gtcgacgtcctgagcgttactaatttctgtgccgga

SEQ ID NO: 100454 - DNA, 37 bp, Artificial Sequence
  Synthetic oligonucleotide
acacgccgagacaggacgtcgtagacaatatcgtgga

SEQ ID NO: 100455 - DNA, 37 bp, Artificial Sequence
  Synthetic oligonucleotide
atgatccgaaagctgggaggaaaggagttaatttgga

SEQ ID NO: 100456 - DNA, 37 bp, Artificial Sequence
  Synthetic oligonucleotide
gacgggctgagatggacaagggctgttaatttgatga

SEQ ID NO: 100457 - DNA, 38 bp, Artificial Sequence
  Synthetic oligonucleotide
tgaggccgtccgaagaggtgttctaccatcctacctga

SEQ ID NO: 100458 - DNA, 38 bp, Artificial Sequence
  Synthetic oligonucleotide
acccactcccactagattattgctgacagcgggcctga

SEQ ID NO: 100459 - DNA, 37 bp, Artificial Sequence
  Synthetic oligonucleotide
tgagggaaacaaaggtatagatgagccagatgcctga

SEQ ID NO: 100460 - DNA, 38 bp, Artificial Sequence
  Synthetic oligonucleotide
gcaacgctagcagttgcatcggcgttttccataggtga

SEQ ID NO: 100461 - DNA, 37 bp, Artificial Sequence
  Synthetic oligonucleotide
gtgtgaaggtctggtgcgaaagcatggaagtgtgtga

SEQ ID NO: 100462 - DNA, 38 bp, Artificial Sequence
  Synthetic oligonucleotide
agtgaggagaagaggtgggccaggggcacttctattga

SEQ ID NO: 100463 - DNA, 38 bp, Artificial Sequence
  Synthetic oligonucleotide
ttgtcgaaagaggggtggaagaggggtgaggtatttga

SEQ ID NO: 100464 - DNA, 36 bp, Artificial Sequence
  Synthetic oligonucleotide
ggtggacgccgtttattgtacttccgtcagacgata

SEQ ID NO: 100465 - DNA, 36 bp, Artificial Sequence
  Synthetic oligonucleotide
ttgacctacccgtaccatctgtgcaacagtgctata

SEQ ID NO: 100466 - DNA, 35 bp, Artificial Sequence
  Synthetic oligonucleotide
tcatggcctgccgtgtttaccaacaagtttgccta

SEQ ID NO: 100467 - DNA, 35 bp, Artificial Sequence
  Synthetic oligonucleotide
gcaggacggggaaagtagaggcgagaggcgcatta

SEQ ID NO: 100468 - DNA, 36 bp, Artificial Sequence
  Synthetic oligonucleotide
tgaacaacggaacgtgatggaacgcggagaatctta

SEQ ID NO: 100469 - DNA, 36 bp, Artificial Sequence
  Synthetic oligonucleotide
gccacccttgatgatgctctatgccctgtctagtta

SEQ ID NO: 100470 - DNA, 38 bp, Artificial Sequence
  Synthetic oligonucleotide
aacccaccccacccgatagtccgtagtgacatcgttta

SEQ ID NO: 100471 - DNA, 35 bp, Artificial Sequence
  Synthetic oligonucleotide
atcgcccgccacggaaactgtaacccgtagacaac

SEQ ID NO: 100472 - DNA, 35 bp, Artificial Sequence
  Synthetic oligonucleotide
tgagccacaagggtcttggaaggcagataatacac

SEQ ID NO: 100473 - DNA, 35 bp, Artificial Sequence
  Synthetic oligonucleotide
gccgacacggcccatctagtctcagtcttggaccc

SEQ ID NO: 100474 - DNA, 35 bp, Artificial Sequence
  Synthetic oligonucleotide
actgccgttcgacgtcgaacccacacctacgctcc

SEQ ID NO: 100475 - DNA, 35 bp, Artificial Sequence
  Synthetic oligonucleotide
gtagccccatgtggactcgaccttgcacgcccttc

SEQ ID NO: 100476 - DNA, 35 bp, Artificial Sequence
  Synthetic oligonucleotide
tcagacacgcccaattggatagcacgagggaaaag

SEQ ID NO: 100477 - DNA, 35 bp, Artificial Sequence
  Synthetic oligonucleotide
atcgcggagccggttgaaatggcgattaggtaaag

SEQ ID NO: 100478 - DNA, 35 bp, Artificial Sequence
  Synthetic oligonucleotide
gtgagtgacgggagtcgggagaggaaatggtgacg

SEQ ID NO: 100479 - DNA, 35 bp, Artificial Sequence
  Synthetic oligonucleotide
aacaaagccggtggtaacagtgagagtgtgggtcg

SEQ ID NO: 100480 - DNA, 35 bp, Artificial Sequence
  Synthetic oligonucleotide
atcgatcgagcggtgtggccctcaaaatttggtcg

SEQ ID NO: 100481 - DNA, 35 bp, Artificial Sequence
  Synthetic oligonucleotide
gaagtagggtaaatgggggagaagaaagacggagg

SEQ ID NO: 100482 - DNA, 35 bp, Artificial Sequence
  Synthetic oligonucleotide
atcagccacgaatcgtgttattctatccctagtgg

SEQ ID NO: 100483 - DNA, 35 bp, Artificial Sequence
  Synthetic oligonucleotide
gcacgccccttgctcggtattcgtgtgcgttctat

SEQ ID NO: 100484 - DNA, 35 bp, Artificial Sequence
  Synthetic oligonucleotide
gaccgccccacttcctgtacaacgacgtagttgct

SEQ ID NO: 100485 - DNA, 35 bp, Artificial Sequence
  Synthetic oligonucleotide
gccaacgctgtaaaggggtaatgacgaagaggggt

SEQ ID NO: 100486 - DNA, 35 bp, Artificial Sequence
  Synthetic oligonucleotide
gatcaagcgcgacctcaacgaaccacgtggtgatt

SEQ ID NO: 100487 - DNA, 35 bp, Artificial Sequence
  Synthetic oligonucleotide
tacatccgacagtctgtgctcagttactgcgcctt

SEQ ID NO: 100488 - DNA, 36 bp, Artificial Sequence
  Synthetic oligonucleotide
ttgcatccatggtaggtcgaaggaggaatcacaaaa

SEQ ID NO: 100489 - DNA, 35 bp, Artificial Sequence
  Synthetic oligonucleotide
acatactgcccctgattcgccgatttccctggaaa

SEQ ID NO: 100490 - DNA, 35 bp, Artificial Sequence
  Synthetic oligonucleotide
aacagctcgccgtcccttataccctgtctgaagaa

SEQ ID NO: 100491 - DNA, 36 bp, Artificial Sequence
  Synthetic oligonucleotide
tctgccctgagcctacaccgcgacacctttctcaca

SEQ ID NO: 100492 - DNA, 35 bp, Artificial Sequence
  Synthetic oligonucleotide
tccagagtgagagagctaaggtgagaggcaagaca

SEQ ID NO: 100493 - DNA, 36 bp, Artificial Sequence
  Synthetic oligonucleotide
gatcgtgggcaggatgcgctacatacaaaatcacca

SEQ ID NO: 100494 - DNA, 36 bp, Artificial Sequence
  Synthetic oligonucleotide
tcagactgaagtcggagtggtagtgatatccaggca

SEQ ID NO: 100495 - DNA, 36 bp, Artificial Sequence
  Synthetic oligonucleotide
ttgcgctaacacggtatcttgtgatctccttctgca

SEQ ID NO: 100496 - DNA, 37 bp, Artificial Sequence
  Synthetic oligonucleotide
gattgaggcaaagggtggtcgaactggcagagggaga

SEQ ID NO: 100497 - DNA, 37 bp, Artificial Sequence
  Synthetic oligonucleotide
gcagacaggcatggggaaaacagcgaggcacctagga

SEQ ID NO: 100498 - DNA, 37 bp, Artificial Sequence
  Synthetic oligonucleotide
tagcctcatcggtgtccccccctcgttagtagctgga

SEQ ID NO: 100499 - DNA, 38 bp, Artificial Sequence
  Synthetic oligonucleotide
gtgaggggacacaggcgaggagggcatgacagggatga

SEQ ID NO: 100500 - DNA, 38 bp, Artificial Sequence
  Synthetic oligonucleotide
tgaaccgaagccacgtgcgaggagggatgcatccctga

SEQ ID NO: 100501 - DNA, 38 bp, Artificial Sequence
  Synthetic oligonucleotide
acatgcagacggtagggttttacaagcaaagtgggtga

SEQ ID NO: 100502 - DNA, 38 bp, Artificial Sequence
  Synthetic oligonucleotide
tgtcaccccacatattccactgttccatcttcatttga

SEQ ID NO: 100503 - DNA, 36 bp, Artificial Sequence
  Synthetic oligonucleotide
aatgagcgcaaattgccatgcctcacttaccatata

SEQ ID NO: 100504 - DNA, 35 bp, Artificial Sequence
  Synthetic oligonucleotide
gaacaacgacggcattcgcgaccgcccccacgtac

SEQ ID NO: 100505 - DNA, 35 bp, Artificial Sequence
  Synthetic oligonucleotide
tacgtcccgcacacttttgatagccttgtcccccc

SEQ ID NO: 100506 - DNA, 35 bp, Artificial Sequence
  Synthetic oligonucleotide
gatgggggccggttagttttacgtgcaggaaaggc

SEQ ID NO: 100507 - DNA, 35 bp, Artificial Sequence
  Synthetic oligonucleotide
tcacgatcctagggtttgggatgggagtggagggc

SEQ ID NO: 100508 - DNA, 35 bp, Artificial Sequence
  Synthetic oligonucleotide
tacccacgcaccgctgccccatgagctacactatc

SEQ ID NO: 100509 - DNA, 35 bp, Artificial Sequence
  Synthetic oligonucleotide
atccacccctgcctgccaagaaacccggtttgttc

SEQ ID NO: 100510 - DNA, 36 bp, Artificial Sequence
  Synthetic oligonucleotide
tctgaccaacggctgaacgtagcatgaactgcgggg

SEQ ID NO: 100511 - DNA, 35 bp, Artificial Sequence
  Synthetic oligonucleotide
tatgaaacgcggggaaaggatcaagatgaaggggg

SEQ ID NO: 100512 - DNA, 35 bp, Artificial Sequence
  Synthetic oligonucleotide
gagcgacagaacctaacaacgatcactcgcctctg

SEQ ID NO: 100513 - DNA, 35 bp, Artificial Sequence
  Synthetic oligonucleotide
ttgagcgcaatgttcacccggccctggcacttgtg

SEQ ID NO: 100514 - DNA, 35 bp, Artificial Sequence
  Synthetic oligonucleotide
aaccgcaaggggaagaagggaggggaataggagat

SEQ ID NO: 100515 - DNA, 35 bp, Artificial Sequence
  Synthetic oligonucleotide
tacaacaagggatgacgtaatcatgttgacgaagt

SEQ ID NO: 100516 - DNA, 35 bp, Artificial Sequence
  Synthetic oligonucleotide
aactgcgcaagactactaattgtttcccaccgggt

SEQ ID NO: 100517 - DNA, 35 bp, Artificial Sequence
  Synthetic oligonucleotide
ttgaagcccacgcctttgtactgaaacttaagaaa

SEQ ID NO: 100518 - DNA, 35 bp, Artificial Sequence
  Synthetic oligonucleotide
acctcagaggctacccgcacacgtgacgtcttcaa

SEQ ID NO: 100519 - DNA, 36 bp, Artificial Sequence
  Synthetic oligonucleotide
tgacgcacatgttggctttaaagaacgtagagggaa

SEQ ID NO: 100520 - DNA, 36 bp, Artificial Sequence
  Synthetic oligonucleotide
acatacgctgcaacaagatagtcacgtcactagtaa

SEQ ID NO: 100521 - DNA, 36 bp, Artificial Sequence
  Synthetic oligonucleotide
gccacagcatggcatgttttgttgtgaactatatca

SEQ ID NO: 100522 - DNA, 37 bp, Artificial Sequence
  Synthetic oligonucleotide
gacaggccaactcgaatggcaactcccaccacaaaga

SEQ ID NO: 100523 - DNA, 37 bp, Artificial Sequence
  Synthetic oligonucleotide
atgcgcacgcaggctattatgcgcatggtcgggaaga

SEQ ID NO: 100524 - DNA, 37 bp, Artificial Sequence
  Synthetic oligonucleotide
gacagggggaggattaggggttatagtagagttaaga

SEQ ID NO: 100525 - DNA, 37 bp, Artificial Sequence
  Synthetic oligonucleotide
gcgaacgtccatgcgactataacgaaatatcctgaga

SEQ ID NO: 100526 - DNA, 37 bp, Artificial Sequence
  Synthetic oligonucleotide
tgtggatggggaatgagtcaacaggcacggtgaacga

SEQ ID NO: 100527 - DNA, 36 bp, Artificial Sequence
  Synthetic oligonucleotide
tcaggtagggaagagggtaacagttcgttgacacga

SEQ ID NO: 100528 - DNA, 37 bp, Artificial Sequence
  Synthetic oligonucleotide
gaccaagtcatgtggtaagtgacaggcgggggatgga

SEQ ID NO: 100529 - DNA, 36 bp, Artificial Sequence
  Synthetic oligonucleotide
tgacacatggagcgcgcattatgatctccgcttgga

SEQ ID NO: 100530 - DNA, 38 bp, Artificial Sequence
  Synthetic oligonucleotide
tacgaggggtgcaaggcaaagagctgggactactgtga

SEQ ID NO: 100531 - DNA, 35 bp, Artificial Sequence
  Synthetic oligonucleotide
tcaccaccgatctgtaggtccacgtcgtcgcatta

SEQ ID NO: 100532 - DNA, 35 bp, Artificial Sequence
  Synthetic oligonucleotide
gaccatccaatccccctggtcgagagacttccgac

SEQ ID NO: 100533 - DNA, 35 bp, Artificial Sequence
  Synthetic oligonucleotide
tgctaggcagggcctcccccgtgcgaacacgctac

SEQ ID NO: 100534 - DNA, 36 bp, Artificial Sequence
  Synthetic oligonucleotide
agccaaagggacgtggtcggacgaacgttttccttc

SEQ ID NO: 100535 - DNA, 35 bp, Artificial Sequence
  Synthetic oligonucleotide
actatagcacggcggccgcacccttgtccacccag

SEQ ID NO: 100536 - DNA, 35 bp, Artificial Sequence
  Synthetic oligonucleotide
tcaccaagccgctgccgtacagtgttggttcaacg

SEQ ID NO: 100537 - DNA, 35 bp, Artificial Sequence
  Synthetic oligonucleotide
tgatcggttgaacgtgggtgaggagcggacggggg

SEQ ID NO: 100538 - DNA, 35 bp, Artificial Sequence
  Synthetic oligonucleotide
ggaaagtcacagcatgcgttaacgaggaggggggg

SEQ ID NO: 100539 - DNA, 35 bp, Artificial Sequence
  Synthetic oligonucleotide
tcagcccaggcgcaagggttaggaggatcaagtgg

SEQ ID NO: 100540 - DNA, 35 bp, Artificial Sequence
  Synthetic oligonucleotide
gcaactctgcgcatctgtcttattccatacgttgg

SEQ ID NO: 100541 - DNA, 35 bp, Artificial Sequence
  Synthetic oligonucleotide
gtcacagagggaaagggccggatagtgaccgtgtg

SEQ ID NO: 100542 - DNA, 35 bp, Artificial Sequence
  Synthetic oligonucleotide
acaacgccggctccccttagatatatgccacacat

SEQ ID NO: 100543 - DNA, 35 bp, Artificial Sequence
  Synthetic oligonucleotide
tccgggtcgggtcaaaaaggaacgtacttacgtat

SEQ ID NO: 100544 - DNA, 35 bp, Artificial Sequence
  Synthetic oligonucleotide
atcatagtgcagtcaatacggggagaatgaacgtt

SEQ ID NO: 100545 - DNA, 35 bp, Artificial Sequence
  Synthetic oligonucleotide
tacatcgtacgatcccccttagtgccgatttcttt

SEQ ID NO: 100546 - DNA, 35 bp, Artificial Sequence
  Synthetic oligonucleotide
acccggaacaccccgacgcgaatttaccgacaaaa

SEQ ID NO: 100547 - DNA, 35 bp, Artificial Sequence
  Synthetic oligonucleotide
gtacgcccgaggaaaaaggtggagagttgtgaaaa

SEQ ID NO: 100548 - DNA, 35 bp, Artificial Sequence
  Synthetic oligonucleotide
tcctccgcccccaaagtgctctatttaagcctaaa

SEQ ID NO: 100549 - DNA, 35 bp, Artificial Sequence
  Synthetic oligonucleotide
gacgggtggatgaagttcgttaagtggggttagaa

SEQ ID NO: 100550 - DNA, 35 bp, Artificial Sequence
  Synthetic oligonucleotide
gaagggccacaacagtaagttacacggtacgtgaa

SEQ ID NO: 100551 - DNA, 36 bp, Artificial Sequence
  Synthetic oligonucleotide
gaccacagatcctaatgaccgacgttattggggtaa

SEQ ID NO: 100552 - DNA, 36 bp, Artificial Sequence
  Synthetic oligonucleotide
ttgccgtgcctcgaaaggtaacttaggaccatgcca

SEQ ID NO: 100553 - DNA, 37 bp, Artificial Sequence
  Synthetic oligonucleotide
ttgactgccacattctgctcaacacatcttcactcca

SEQ ID NO: 100554 - DNA, 36 bp, Artificial Sequence
  Synthetic oligonucleotide
gaacacgcaggtatggctgtcaatacggtttacgca

SEQ ID NO: 100555 - DNA, 36 bp, Artificial Sequence
  Synthetic oligonucleotide
gcactaccggccgttctgtaattcgcggcatcttca

SEQ ID NO: 100556 - DNA, 35 bp, Artificial Sequence
  Synthetic oligonucleotide
aatgcgaggcgcaaggaacttagggggttagttca

SEQ ID NO: 100557 - DNA, 37 bp, Artificial Sequence
  Synthetic oligonucleotide
gagaagatggcaggagctgggagaggaagggtaaaga

SEQ ID NO: 100558 - DNA, 36 bp, Artificial Sequence
  Synthetic oligonucleotide
gactccaaacgatacgactatgggacaggttgaaga

SEQ ID NO: 100559 - DNA, 37 bp, Artificial Sequence
  Synthetic oligonucleotide
actgggcgaaggtgaataattaggagctggaaagcga

SEQ ID NO: 100560 - DNA, 37 bp, Artificial Sequence
  Synthetic oligonucleotide
tagggcgtgagttagaggggtgttagataggttgcga

SEQ ID NO: 100561 - DNA, 38 bp, Artificial Sequence
  Synthetic oligonucleotide
acgcacggcgaggttgaaagcatgggagtcgtgaatga

SEQ ID NO: 100562 - DNA, 38 bp, Artificial Sequence
  Synthetic oligonucleotide
atccgccgaggtggactaggtgaagaatggcgggatga

SEQ ID NO: 100563 - DNA, 38 bp, Artificial Sequence
  Synthetic oligonucleotide
gactgctcacaggtgactatgcatccaagtctctctga

SEQ ID NO: 100564 - DNA, 36 bp, Artificial Sequence
  Synthetic oligonucleotide
gccatggtgaggcggactaaggatagagagatgtga

SEQ ID NO: 100565 - DNA, 38 bp, Artificial Sequence
  Synthetic oligonucleotide
tagtgctgctagagcggaaccgaataggacgacattga

SEQ ID NO: 100566 - DNA, 35 bp, Artificial Sequence
  Synthetic oligonucleotide
taagggagttggaggtgcggtgggtgcgaaacata

SEQ ID NO: 100567 - DNA, 36 bp, Artificial Sequence
  Synthetic oligonucleotide
gcacatccgaagatcatgataatgtctggactgcta

SEQ ID NO: 100568 - DNA, 36 bp, Artificial Sequence
  Synthetic oligonucleotide
atcaccattcgccctcgtgtgcctacagtacagtta

SEQ ID NO: 100569 - DNA, 36 bp, Artificial Sequence
  Synthetic oligonucleotide
tgagtgcagtccgaggagggccacgggagatcgtta

SEQ ID NO: 100570 - DNA, 35 bp, Artificial Sequence
  Synthetic oligonucleotide
gagcgcacatctgaaccgtgacaccttgctcttta

SEQ ID NO: 100571 - DNA, 35 bp, Artificial Sequence
  Synthetic oligonucleotide
gttgcactgctgttatgtcacctctcggcacacac

SEQ ID NO: 100572 - DNA, 35 bp, Artificial Sequence
  Synthetic oligonucleotide
gctgatgtatgtagctcgaacagatccaccttccc

SEQ ID NO: 100573 - DNA, 35 bp, Artificial Sequence
  Synthetic oligonucleotide
gcaacagcaatggtccaaaagtcactgcctacgcc

SEQ ID NO: 100574 - DNA, 35 bp, Artificial Sequence
  Synthetic oligonucleotide
gtgggcctccatccattagttctagacagtgctcc

SEQ ID NO: 100575 - DNA, 35 bp, Artificial Sequence
  Synthetic oligonucleotide
gatgagaggtagttgctgcatcaaggggggtttgc

SEQ ID NO: 100576 - DNA, 35 bp, Artificial Sequence
  Synthetic oligonucleotide
gaggacgtacaataaacttgatcactggttgcgat

SEQ ID NO: 100577 - DNA, 35 bp, Artificial Sequence
  Synthetic oligonucleotide
acgagcccagtagccaagccgccacccctttatct

SEQ ID NO: 100578 - DNA, 35 bp, Artificial Sequence
  Synthetic oligonucleotide
gagtggcaatgggagaaaacgattgacattgctct

SEQ ID NO: 100579 - DNA, 35 bp, Artificial Sequence
  Synthetic oligonucleotide
tccagacggtgactgtgcactggcgttacattggt

SEQ ID NO: 100580 - DNA, 35 bp, Artificial Sequence
  Synthetic oligonucleotide
gtgtgccacctctcgtgcctgagccttgtccctgt

SEQ ID NO: 100581 - DNA, 35 bp, Artificial Sequence
  Synthetic oligonucleotide
tgcttaccccagatattgacgcattaatctaggtt

SEQ ID NO: 100582 - DNA, 36 bp, Artificial Sequence
  Synthetic oligonucleotide
atgaccacctcctcatggcgcattggtcaccctttt

SEQ ID NO: 100583 - DNA, 36 bp, Artificial Sequence
  Synthetic oligonucleotide
gatgcactctgccacatgacaagcaactcatactaa

SEQ ID NO: 100584 - DNA, 36 bp, Artificial Sequence
  Synthetic oligonucleotide
taccacgccggaagctgtttgtttcagttctactaa

SEQ ID NO: 100585 - DNA, 36 bp, Artificial Sequence
  Synthetic oligonucleotide
atcaccgcacatacattggatgagagtttacacaca

SEQ ID NO: 100586 - DNA, 37 bp, Artificial Sequence
  Synthetic oligonucleotide
tgaacatgacgtggtagagcacggatgcgatagaaga

SEQ ID NO: 100587 - DNA, 37 bp, Artificial Sequence
  Synthetic oligonucleotide
ttggagtcgggagggagggatgaagatacggctaaga

SEQ ID NO: 100588 - DNA, 37 bp, Artificial Sequence
  Synthetic oligonucleotide
ttgagtggggcacatcgtgtaacatatggcgggcaga

SEQ ID NO: 100589 - DNA, 37 bp, Artificial Sequence
  Synthetic oligonucleotide
gacgataacgagggagaggtggaggcgggcggatcga

SEQ ID NO: 100590 - DNA, 37 bp, Artificial Sequence
  Synthetic oligonucleotide
ttgacgtggcgatgtggaggtgggtaggaacggagga

SEQ ID NO: 100591 - DNA, 38 bp, Artificial Sequence
  Synthetic oligonucleotide
ggacacgggacagacgggaaccacaatcgcctccatga

SEQ ID NO: 100592 - DNA, 37 bp, Artificial Sequence
  Synthetic oligonucleotide
gtcgattgagccgtccacttagttgcccttccgatga

SEQ ID NO: 100593 - DNA, 37 bp, Artificial Sequence
  Synthetic oligonucleotide
tgacggtaggagaggtaggtggatgccagtgatatga

SEQ ID NO: 100594 - DNA, 38 bp, Artificial Sequence
  Synthetic oligonucleotide
aaagcaagctgcgatcgctacatgcgctgtttccctga

SEQ ID NO: 100595 - DNA, 38 bp, Artificial Sequence
  Synthetic oligonucleotide
gccacgcaacgatggcatgattttgtgtgcctggctga

SEQ ID NO: 100596 - DNA, 38 bp, Artificial Sequence
  Synthetic oligonucleotide
gtgggaagcacttgttgcgtctactctagacttgctga

SEQ ID NO: 100597 - DNA, 38 bp, Artificial Sequence
  Synthetic oligonucleotide
gtgacaagcacactgcaactgtattaggccgcaagtga

SEQ ID NO: 100598 - DNA, 38 bp, Artificial Sequence
  Synthetic oligonucleotide
atgcagtccgggggaggaatataaacactatgcagtga

SEQ ID NO: 100599 - DNA, 38 bp, Artificial Sequence
  Synthetic oligonucleotide
gaatgtaggggaagcatatgagtggaggtgtgaggtga

SEQ ID NO: 100600 - DNA, 38 bp, Artificial Sequence
  Synthetic oligonucleotide
atgcaatacaacagaacgtggaagatagaagcgggtga

SEQ ID NO: 100601 - DNA, 37 bp, Artificial Sequence
  Synthetic oligonucleotide
tacgagcgacgagagatgaggtcatatatgggggtga

SEQ ID NO: 100602 - DNA, 38 bp, Artificial Sequence
  Synthetic oligonucleotide
agatgctgctaggtggatggagtaagaagttcgtgtga

SEQ ID NO: 100603 - DNA, 38 bp, Artificial Sequence
  Synthetic oligonucleotide
tgcataccatcctagcgcgatttagccggtgaacttga

SEQ ID NO: 100604 - DNA, 36 bp, Artificial Sequence
  Synthetic oligonucleotide
tcaccgggtgggcaagcaggcccttggacttcgtta

SEQ ID NO: 100605 - DNA, 36 bp, Artificial Sequence
  Synthetic oligonucleotide
tgtgccacctactgaccactcccttgagtcttttta

SEQ ID NO: 100606 - DNA, 35 bp, Artificial Sequence
  Synthetic oligonucleotide
tgaaaccccgcctatgcaacatccatggcgcctac

SEQ ID NO: 100607 - DNA, 35 bp, Artificial Sequence
  Synthetic oligonucleotide
gtggaaccatcaagacgtgcagtaaaatttcgtcc

SEQ ID NO: 100608 - DNA, 35 bp, Artificial Sequence
  Synthetic oligonucleotide
tcacgccgcattactgctgtccgctatccacttcc

SEQ ID NO: 100609 - DNA, 35 bp, Artificial Sequence
  Synthetic oligonucleotide
tcatgacggcgttttatgtgatccccccgttccgc

SEQ ID NO: 100610 - DNA, 35 bp, Artificial Sequence
  Synthetic oligonucleotide
gaccatgtactgtgttgcgacgagtgctcgacctc

SEQ ID NO: 100611 - DNA, 35 bp, Artificial Sequence
  Synthetic oligonucleotide
agaggaagggggggtagaacgcagatccgttagag

SEQ ID NO: 100612 - DNA, 35 bp, Artificial Sequence
  Synthetic oligonucleotide
ggagagcgcgacggtccctatccctgctgacgtag

SEQ ID NO: 100613 - DNA, 35 bp, Artificial Sequence
  Synthetic oligonucleotide
gttgggctaaggaaacgggcagattggagcgaaat

SEQ ID NO: 100614 - DNA, 35 bp, Artificial Sequence
  Synthetic oligonucleotide
ttacatgcaccacgagtactatcagtgttagcaat

SEQ ID NO: 100615 - DNA, 35 bp, Artificial Sequence
  Synthetic oligonucleotide
gccaacttaggtgcgccatacatttacgggtgaat

SEQ ID NO: 100616 - DNA, 35 bp, Artificial Sequence
  Synthetic oligonucleotide
acaatgtgccacgtccaaccgcgtaagaggcccat

SEQ ID NO: 100617 - DNA, 34 bp, Artificial Sequence
  Synthetic oligonucleotide
ttgatgtcagaaggcgtggtggggccggatccat

SEQ ID NO: 100618 - DNA, 35 bp, Artificial Sequence
  Synthetic oligonucleotide
gatgtgcctcaatgccgctcgtacgttccaccgat

SEQ ID NO: 100619 - DNA, 35 bp, Artificial Sequence
  Synthetic oligonucleotide
tccacgcaatgttctacgcctatctggaaactgat

SEQ ID NO: 100620 - DNA, 36 bp, Artificial Sequence
  Synthetic oligonucleotide
gaccacgtcctatcttcctttcggtgacgatccaaa

SEQ ID NO: 100621 - DNA, 35 bp, Artificial Sequence
  Synthetic oligonucleotide
aagtcaaccgacagtagttcacgcctaaatgacaa

SEQ ID NO: 100622 - DNA, 35 bp, Artificial Sequence
  Synthetic oligonucleotide
catgcaggcagagaggtatgattacaagtacccaa

SEQ ID NO: 100623 - DNA, 35 bp, Artificial Sequence
  Synthetic oligonucleotide
tccacctaaccgctaccgaccgtttatacacgcaa

SEQ ID NO: 100624 - DNA, 36 bp, Artificial Sequence
  Synthetic oligonucleotide
atgtcacgtacgcctgaccataagggtgcagaagaa

SEQ ID NO: 100625 - DNA, 36 bp, Artificial Sequence
  Synthetic oligonucleotide
gccatgcagggatgggtctgttttggtactatcgaa

SEQ ID NO: 100626 - DNA, 36 bp, Artificial Sequence
  Synthetic oligonucleotide
taactgccccggggtctaaacgagcgaagcattgaa

SEQ ID NO: 100627 - DNA, 36 bp, Artificial Sequence
  Synthetic oligonucleotide
tcacgcgacagttaaaaaccatgaggaccaccgtaa

SEQ ID NO: 100628 - DNA, 31 bp, Artificial Sequence
  Synthetic oligonucleotide
gagtgtgcaggtggaaggggggggggcgtaa

SEQ ID NO: 100629 - DNA, 36 bp, Artificial Sequence
  Synthetic oligonucleotide
attgccccctccgttgtgacaaccctgctactctca

SEQ ID NO: 100630 - DNA, 36 bp, Artificial Sequence
  Synthetic oligonucleotide
gaaaacgcaacgatatgtttctcgccctccctgtca

SEQ ID NO: 100631 - DNA, 37 bp, Artificial Sequence
  Synthetic oligonucleotide
gtgctccgactgatctgaagttgggagggagggaaga

SEQ ID NO: 100632 - DNA, 37 bp, Artificial Sequence
  Synthetic oligonucleotide
gaggggcgggagcagagaacgtatagaggtcaaacga

SEQ ID NO: 100633 - DNA, 37 bp, Artificial Sequence
  Synthetic oligonucleotide
ttacgtgcctcagagctcttactaaacctcttcacga

SEQ ID NO: 100634 - DNA, 37 bp, Artificial Sequence
  Synthetic oligonucleotide
tcaacaggccacatgaaagctgatatttggtctacga

SEQ ID NO: 100635 - DNA, 37 bp, Artificial Sequence
  Synthetic oligonucleotide
ttgggaggacattcgtagaagaggggggggaatgcga

SEQ ID NO: 100636 - DNA, 37 bp, Artificial Sequence
  Synthetic oligonucleotide
acgacccgcggcatcccctatcaggtcagacattcga

SEQ ID NO: 100637 - DNA, 36 bp, Artificial Sequence
  Synthetic oligonucleotide
tcacacatgatgtagattcgcaccgttccaggcgga

SEQ ID NO: 100638 - DNA, 35 bp, Artificial Sequence
  Synthetic oligonucleotide
tgagtgggagcggagggtatggtatggagtaggga

SEQ ID NO: 100639 - DNA, 37 bp, Artificial Sequence
  Synthetic oligonucleotide
gaaacgaaggatgttgcgatgagacgtatgcggggga

SEQ ID NO: 100640 - DNA, 37 bp, Artificial Sequence
  Synthetic oligonucleotide
tacgtgagcaggcttggtcttgtagagggcgaatgga

SEQ ID NO: 100641 - DNA, 38 bp, Artificial Sequence
  Synthetic oligonucleotide
gtgagacggtcgtaagcgggaaaagtacttgtcactga

SEQ ID NO: 100642 - DNA, 38 bp, Artificial Sequence
  Synthetic oligonucleotide
ggggatgaaggtaggttaagagggggaggatgagctga

SEQ ID NO: 100643 - DNA, 38 bp, Artificial Sequence
  Synthetic oligonucleotide
tgcatagcaacaggggaaggtggtttgctcaatagtga

SEQ ID NO: 100644 - DNA, 38 bp, Artificial Sequence
  Synthetic oligonucleotide
tgcaacctagccaaatctatatgctcattcatgggtga

SEQ ID NO: 100645 - DNA, 38 bp, Artificial Sequence
  Synthetic oligonucleotide
gacgcaaacggccaaattgggtgtccaaaatcgattga

SEQ ID NO: 100646 - DNA, 38 bp, Artificial Sequence
  Synthetic oligonucleotide
acaacatgaccgatcaaagtgctggtgagtcgtgttga

SEQ ID NO: 100647 - DNA, 35 bp, Artificial Sequence
  Synthetic oligonucleotide
tgatgcctcccagggaattgtcatttgtccgcata

SEQ ID NO: 100648 - DNA, 36 bp, Artificial Sequence
  Synthetic oligonucleotide
attcccctccccgccccccgatggtgcctaagtata

SEQ ID NO: 100649 - DNA, 35 bp, Artificial Sequence
  Synthetic oligonucleotide
acgcagacacccgggccgctatgctctgactcgta

SEQ ID NO: 100650 - DNA, 35 bp, Artificial Sequence
  Synthetic oligonucleotide
gttatccgtgttgataggaacacgactcccgctta

SEQ ID NO: 100651 - DNA, 36 bp, Artificial Sequence
  Synthetic oligonucleotide
gactcggtccgacaatgcaccacgcccttcgagtta

SEQ ID NO: 100652 - DNA, 35 bp, Artificial Sequence
  Synthetic oligonucleotide
gaatgccaccggatggagtctacgtcccagtaaac

SEQ ID NO: 100653 - DNA, 35 bp, Artificial Sequence
  Synthetic oligonucleotide
tcatgaccatcaccatatgttgaaacacgtgccac

SEQ ID NO: 100654 - DNA, 35 bp, Artificial Sequence
  Synthetic oligonucleotide
tcaacgaaatgtacggagttacgggtggaaaggac

SEQ ID NO: 100655 - DNA, 35 bp, Artificial Sequence
  Synthetic oligonucleotide
atccgacgcagatgacgtgccgagctgtcctcccc

SEQ ID NO: 100656 - DNA, 35 bp, Artificial Sequence
  Synthetic oligonucleotide
aacaacgacacggaatgtgataggtaggacagggc

SEQ ID NO: 100657 - DNA, 35 bp, Artificial Sequence
  Synthetic oligonucleotide
tacacccattgaaatgaatgatgatcgcgccctag

SEQ ID NO: 100658 - DNA, 35 bp, Artificial Sequence
  Synthetic oligonucleotide
ttcacgactgacggccatccaccttccgttcttag

SEQ ID NO: 100659 - DNA, 35 bp, Artificial Sequence
  Synthetic oligonucleotide
gtggatagcaagagagggaacggaaacatgccagg

SEQ ID NO: 100660 - DNA, 35 bp, Artificial Sequence
  Synthetic oligonucleotide
gaggacagtctgcggaggtggcaaggggaaacatg

SEQ ID NO: 100661 - DNA, 35 bp, Artificial Sequence
  Synthetic oligonucleotide
aaaccacgcaaaatatcgtcagaggagaagaggat

SEQ ID NO: 100662 - DNA, 35 bp, Artificial Sequence
  Synthetic oligonucleotide
gtgccagacacgcaaaaagagcatttggaggagct

SEQ ID NO: 100663 - DNA, 35 bp, Artificial Sequence
  Synthetic oligonucleotide
tagcgcaacatcgatgcagccagtgcaccttcctt

SEQ ID NO: 100664 - DNA, 35 bp, Artificial Sequence
  Synthetic oligonucleotide
accgtacgagagatgttcgctctggcttccatgtt

SEQ ID NO: 100665 - DNA, 36 bp, Artificial Sequence
  Synthetic oligonucleotide
gtgccccacgacggttttaagccacctgcaccccaa

SEQ ID NO: 100666 - DNA, 35 bp, Artificial Sequence
  Synthetic oligonucleotide
tctgatgcggcccagctccgtttccgtccatagaa

SEQ ID NO: 100667 - DNA, 35 bp, Artificial Sequence
  Synthetic oligonucleotide
tcaatcggaacggaggaggaacaaagggtgggtca

SEQ ID NO: 100668 - DNA, 36 bp, Artificial Sequence
  Synthetic oligonucleotide
aacaacgaaccgcgggtggggggtctcgtcttaaga

SEQ ID NO: 100669 - DNA, 37 bp, Artificial Sequence
  Synthetic oligonucleotide
atgcctgccctccgtactcgtcagttttggctacaga

SEQ ID NO: 100670 - DNA, 37 bp, Artificial Sequence
  Synthetic oligonucleotide
gtcacgatcggagtatttaagtcagtattacgccaga

SEQ ID NO: 100671 - DNA, 37 bp, Artificial Sequence
  Synthetic oligonucleotide
cccgcgacaccacggccccgagccatacgaacgacga

SEQ ID NO: 100672 - DNA, 37 bp, Artificial Sequence
  Synthetic oligonucleotide
gacgctccgacgttttaatggcgactcaatatgacga

SEQ ID NO: 100673 - DNA, 37 bp, Artificial Sequence
  Synthetic oligonucleotide
ttgcacatcggagtagatgtttactgtgtaatcccga

SEQ ID NO: 100674 - DNA, 36 bp, Artificial Sequence
  Synthetic oligonucleotide
gagaagggcatagtgggtaagggacgtagcgatgga

SEQ ID NO: 100675 - DNA, 37 bp, Artificial Sequence
  Synthetic oligonucleotide
aaagtgtgtgcaacaggcggagatgaggtcagttgga

SEQ ID NO: 100676 - DNA, 38 bp, Artificial Sequence
  Synthetic oligonucleotide
gtactgcggtcatttggttggggaagagacagggatga

SEQ ID NO: 100677 - DNA, 38 bp, Artificial Sequence
  Synthetic oligonucleotide
gaagccgaaaatggcgtgtgagcgatagaatctgatga

SEQ ID NO: 100678 - DNA, 37 bp, Artificial Sequence
  Synthetic oligonucleotide
tcacccgtcacggtggttacgttggttgctgtgctga

SEQ ID NO: 100679 - DNA, 38 bp, Artificial Sequence
  Synthetic oligonucleotide
tgttacgtacgctgcgacgaaggatgtacacgtagtga

SEQ ID NO: 100680 - DNA, 37 bp, Artificial Sequence
  Synthetic oligonucleotide
gatgcacgctatacttgacgcttggtgacacacgtga

SEQ ID NO: 100681 - DNA, 38 bp, Artificial Sequence
  Synthetic oligonucleotide
aacgtgggcggatggtggagaaaagctgcgaggggtga

SEQ ID NO: 100682 - DNA, 38 bp, Artificial Sequence
  Synthetic oligonucleotide
agacacgcaatcaagtcacggagtgtggcaactggtga

SEQ ID NO: 100683 - DNA, 35 bp, Artificial Sequence
  Synthetic oligonucleotide
aacacgacggggagaatacggataaagttgtgtga

SEQ ID NO: 100684 - DNA, 38 bp, Artificial Sequence
  Synthetic oligonucleotide
tgtagcccactaatatgagccatactgacttagcttga

SEQ ID NO: 100685 - DNA, 36 bp, Artificial Sequence
  Synthetic oligonucleotide
tccaccacacggaagcaaggtacaaagtagacaata

SEQ ID NO: 100686 - DNA, 36 bp, Artificial Sequence
  Synthetic oligonucleotide
aatgggaacgagcggataaagtagatgggagtacta

SEQ ID NO: 100687 - DNA, 35 bp, Artificial Sequence
  Synthetic oligonucleotide
tgcggagcacgaggcaagaatatgctactgcgtta

SEQ ID NO: 100688 - DNA, 36 bp, Artificial Sequence
  Synthetic oligonucleotide
tacggagccgccaaaggtaactccatgccagtttta

SEQ ID NO: 100689 - DNA, 35 bp, Artificial Sequence
  Synthetic oligonucleotide
ttccacaccaacgtgtaacctggtacgctatcaac

SEQ ID NO: 100690 - DNA, 35 bp, Artificial Sequence
  Synthetic oligonucleotide
ccgatccggtcattgctcccgacgtaccacctaac

SEQ ID NO: 100691 - DNA, 35 bp, Artificial Sequence
  Synthetic oligonucleotide
acagagcccgcttgattttttgggccttccaccac

SEQ ID NO: 100692 - DNA, 35 bp, Artificial Sequence
  Synthetic oligonucleotide
tccccaggccaaaatctgacaagcgtcacggcccc

SEQ ID NO: 100693 - DNA, 35 bp, Artificial Sequence
  Synthetic oligonucleotide
ttctgcccccatatgtagtccacaagcgctcctgc

SEQ ID NO: 100694 - DNA, 35 bp, Artificial Sequence
  Synthetic oligonucleotide
tgaacaagctgccacagcctcgccggtacgtactc

SEQ ID NO: 100695 - DNA, 35 bp, Artificial Sequence
  Synthetic oligonucleotide
acacaggccggtggtgggagggggatggtttgttc

SEQ ID NO: 100696 - DNA, 35 bp, Artificial Sequence
  Synthetic oligonucleotide
ttacgcctttccgacgatctgcctcgaactccccg

SEQ ID NO: 100697 - DNA, 35 bp, Artificial Sequence
  Synthetic oligonucleotide
atgtacgctgcagagggatacgcgatcgtttgcat

SEQ ID NO: 100698 - DNA, 35 bp, Artificial Sequence
  Synthetic oligonucleotide
ttaggagcccaccccctcatgtattcttggctact

SEQ ID NO: 100699 - DNA, 35 bp, Artificial Sequence
  Synthetic oligonucleotide
acgtacaccctctcgccttgggccacgaagtccct

SEQ ID NO: 100700 - DNA, 36 bp, Artificial Sequence
  Synthetic oligonucleotide
tgaccatcatcattgtaacattcggaagtgctcgct

SEQ ID NO: 100701 - DNA, 35 bp, Artificial Sequence
  Synthetic oligonucleotide
gatccaccgcactattgaaccctaaccagtcactt

SEQ ID NO: 100702 - DNA, 35 bp, Artificial Sequence
  Synthetic oligonucleotide
gcgagccttcactgagttctagtgttccgcacctt

SEQ ID NO: 100703 - DNA, 35 bp, Artificial Sequence
  Synthetic oligonucleotide
tacgtgccggccggatccaatatgcaccatgtttt

SEQ ID NO: 100704 - DNA, 36 bp, Artificial Sequence
  Synthetic oligonucleotide
atcaacagatgtaacatggcatataggagggaaaaa

SEQ ID NO: 100705 - DNA, 36 bp, Artificial Sequence
  Synthetic oligonucleotide
gaccatggagaagggacgggagagacttacataaaa

SEQ ID NO: 100706 - DNA, 36 bp, Artificial Sequence
  Synthetic oligonucleotide
gccccagcccatcggttacgactgcgtcgcaaaaca

SEQ ID NO: 100707 - DNA, 36 bp, Artificial Sequence
  Synthetic oligonucleotide
gaggatcagcggagggagaaggatgggaatgaaaca

SEQ ID NO: 100708 - DNA, 36 bp, Artificial Sequence
  Synthetic oligonucleotide
tcaaagccaacagtctctaccttgaaccagacaaca

SEQ ID NO: 100709 - DNA, 34 bp, Artificial Sequence
  Synthetic oligonucleotide
taaccaactgcactcatgtcaagtactatgctca

SEQ ID NO: 100710 - DNA, 36 bp, Artificial Sequence
  Synthetic oligonucleotide
gcaaagcgcaccttttagcgttgacctggttggtca

SEQ ID NO: 100711 - DNA, 36 bp, Artificial Sequence
  Synthetic oligonucleotide
gtgacaccactgccagtagagcgtgagaaatcttca

SEQ ID NO: 100712 - DNA, 37 bp, Artificial Sequence
  Synthetic oligonucleotide
gactgggctgcaacacaagggcgaagaaatagtaaga

SEQ ID NO: 100713 - DNA, 37 bp, Artificial Sequence
  Synthetic oligonucleotide
atgtgacacgatgatgtaggaaatggcggtagggaga

SEQ ID NO: 100714 - DNA, 37 bp, Artificial Sequence
  Synthetic oligonucleotide
taggaacgccatcacagcgttttagaaatagccacga

SEQ ID NO: 100715 - DNA, 37 bp, Artificial Sequence
  Synthetic oligonucleotide
gttgacctctgggcttatgatacccctggccgaagga

SEQ ID NO: 100716 - DNA, 37 bp, Artificial Sequence
  Synthetic oligonucleotide
aatcaggaagaagcactcgtgcaggaggggggcagga

SEQ ID NO: 100717 - DNA, 37 bp, Artificial Sequence
  Synthetic oligonucleotide
gtcaggggggacaggaaaaagattgaccggagatgga

SEQ ID NO: 100718 - DNA, 37 bp, Artificial Sequence
  Synthetic oligonucleotide
tggaagaggaggcaggttatcgaaaagggggtgtgga

SEQ ID NO: 100719 - DNA, 38 bp, Artificial Sequence
  Synthetic oligonucleotide
gacgaggacgcaaagaatgaggaggcacggtgacatga

SEQ ID NO: 100720 - DNA, 38 bp, Artificial Sequence
  Synthetic oligonucleotide
tagcacccctccaggctgccctttatgctgtccagtga

SEQ ID NO: 100721 - DNA, 38 bp, Artificial Sequence
  Synthetic oligonucleotide
agaacggggaggtgctattatcgtgctcgcgaacgtga

SEQ ID NO: 100722 - DNA, 37 bp, Artificial Sequence
  Synthetic oligonucleotide
taggacgagagccatggatagtaaagtacgaccgtga

SEQ ID NO: 100723 - DNA, 36 bp, Artificial Sequence
  Synthetic oligonucleotide
gccatcgctttcaaccctcccgactataccgattga

SEQ ID NO: 100724 - DNA, 37 bp, Artificial Sequence
  Synthetic oligonucleotide
tatgcgggcgcactgataccccgttcgtcctttttga

SEQ ID NO: 100725 - DNA, 36 bp, Artificial Sequence
  Synthetic oligonucleotide
taacgccctcctacattgctgggactactttgcata

SEQ ID NO: 100726 - DNA, 36 bp, Artificial Sequence
  Synthetic oligonucleotide
gttgcaagggccgtggtaggagtggaagcatcgata

SEQ ID NO: 100727 - DNA, 36 bp, Artificial Sequence
  Synthetic oligonucleotide
gtgaacgtactgatcccgtttagtaccacttcggta

SEQ ID NO: 100728 - DNA, 35 bp, Artificial Sequence
  Synthetic oligonucleotide
atggaccacaggtagctctatgcgagcgtaactta

SEQ ID NO: 100729 - DNA, 36 bp, Artificial Sequence
  Synthetic oligonucleotide
gcgcggaggggggtaggtaaaagtacgtgggggtta

SEQ ID NO: 100730 - DNA, 35 bp, Artificial Sequence
  Synthetic oligonucleotide
gccgcctatcaattgctctttccctgcgttataac

SEQ ID NO: 100731 - DNA, 35 bp, Artificial Sequence
  Synthetic oligonucleotide
attggtgcactcacaattattaagccatttcacac

SEQ ID NO: 100732 - DNA, 35 bp, Artificial Sequence
  Synthetic oligonucleotide
gcacgacaatctctcccgtagctatgtactttcac

SEQ ID NO: 100733 - DNA, 35 bp, Artificial Sequence
  Synthetic oligonucleotide
taggtcctacactgacctgtatcattcaccctgac

SEQ ID NO: 100734 - DNA, 35 bp, Artificial Sequence
  Synthetic oligonucleotide
ttacatcgggggaggatagggaagtggtgtgttac

SEQ ID NO: 100735 - DNA, 35 bp, Artificial Sequence
  Synthetic oligonucleotide
gacgccctgatgtacccgccatgtctcacccgtcc

SEQ ID NO: 100736 - DNA, 35 bp, Artificial Sequence
  Synthetic oligonucleotide
acgcacccgatggaggtctcgcttctgcacttatc

SEQ ID NO: 100737 - DNA, 35 bp, Artificial Sequence
  Synthetic oligonucleotide
tagagggcgagggtacggaagtcgtgagccatgcg

SEQ ID NO: 100738 - DNA, 35 bp, Artificial Sequence
  Synthetic oligonucleotide
tcatggagcggtacagaagggggcatactggctgg

SEQ ID NO: 100739 - DNA, 35 bp, Artificial Sequence
  Synthetic oligonucleotide
aacgccccgctggtcccctctatctctccttccat

SEQ ID NO: 100740 - DNA, 35 bp, Artificial Sequence
  Synthetic oligonucleotide
tatgtggggtgcactataagacaaggggagaggct

SEQ ID NO: 100741 - DNA, 35 bp, Artificial Sequence
  Synthetic oligonucleotide
atgcgcaggtgccaaatataacggtgcctgtttgt

SEQ ID NO: 100742 - DNA, 34 bp, Artificial Sequence
  Synthetic oligonucleotide
gtgcacgcaggcttttgccccaccctccacacaa

SEQ ID NO: 100743 - DNA, 36 bp, Artificial Sequence
  Synthetic oligonucleotide
gtgttcccgtcctcttctcgtcatggtgatcgccaa

SEQ ID NO: 100744 - DNA, 36 bp, Artificial Sequence
  Synthetic oligonucleotide
gtgcaccccaccgaggtactcgagcgaccgaaggaa

SEQ ID NO: 100745 - DNA, 35 bp, Artificial Sequence
  Synthetic oligonucleotide
ttccgcctcccggtgaacatacacttcttaactaa

SEQ ID NO: 100746 - DNA, 36 bp, Artificial Sequence
  Synthetic oligonucleotide
tatgcgcaaggggcctcaaggtagaggggcgactaa

SEQ ID NO: 100747 - DNA, 36 bp, Artificial Sequence
  Synthetic oligonucleotide
gcacccggcctcccatggtcctcgagatgcaggtaa

SEQ ID NO: 100748 - DNA, 35 bp, Artificial Sequence
  Synthetic oligonucleotide
atgggaccactcgcagttattgcctatgcctcaca

SEQ ID NO: 100749 - DNA, 36 bp, Artificial Sequence
  Synthetic oligonucleotide
tgcgactcctatcccaacgtgcgccacccgaaccca

SEQ ID NO: 100750 - DNA, 37 bp, Artificial Sequence
  Synthetic oligonucleotide
accatcgccgtcgtggatcagacgcaagaacgaaaga

SEQ ID NO: 100751 - DNA, 37 bp, Artificial Sequence
  Synthetic oligonucleotide
ttacagggacgggggaggaacagtatttccaagcaga

SEQ ID NO: 100752 - DNA, 37 bp, Artificial Sequence
  Synthetic oligonucleotide
atcaaggggaggctgaatgcatgagggcttagcagga

SEQ ID NO: 100753 - DNA, 37 bp, Artificial Sequence
  Synthetic oligonucleotide
gtgcaagggggacgatatgaaaaggtagcattgagga

SEQ ID NO: 100754 - DNA, 37 bp, Artificial Sequence
  Synthetic oligonucleotide
tgactgccgccatttacgtgaactcactggccaggga

SEQ ID NO: 100755 - DNA, 37 bp, Artificial Sequence
  Synthetic oligonucleotide
tgaaagaggtctggtgcaggaacatggaaactaggga

SEQ ID NO: 100756 - DNA, 38 bp, Artificial Sequence
  Synthetic oligonucleotide
ttagcgaggaggggacaatggacagtgactgttgatga

SEQ ID NO: 100757 - DNA, 38 bp, Artificial Sequence
  Synthetic oligonucleotide
tgaatcgaaagaggtcagtagatagggcaggagactga

SEQ ID NO: 100758 - DNA, 37 bp, Artificial Sequence
  Synthetic oligonucleotide
gatgtacagcggagatgatcagaaacgggaggggtga

SEQ ID NO: 100759 - DNA, 37 bp, Artificial Sequence
  Synthetic oligonucleotide
gaagacgtggctggtgtttagcatggcagtggattga

SEQ ID NO: 100760 - DNA, 38 bp, Artificial Sequence
  Synthetic oligonucleotide
accgcgtgaggcaagttggtaggcaaagaggtggttga

SEQ ID NO: 100761 - DNA, 38 bp, Artificial Sequence
  Synthetic oligonucleotide
gcacgctacgcacatttatatttcgccaaacctgttga

SEQ ID NO: 100762 - DNA, 38 bp, Artificial Sequence
  Synthetic oligonucleotide
ttgcaccggctgtctgtaattcgcgcgccgcttgttga

SEQ ID NO: 100763 - DNA, 36 bp, Artificial Sequence
  Synthetic oligonucleotide
gatacgccacaggatgagcgagaaccactgctcgta

SEQ ID NO: 100764 - DNA, 36 bp, Artificial Sequence
  Synthetic oligonucleotide
tacatgggaaaggggggtgttagagcgcatatggta

SEQ ID NO: 100765 - DNA, 36 bp, Artificial Sequence
  Synthetic oligonucleotide
aaccgactgacgatcatcttaccattttggttttta

SEQ ID NO: 100766 - DNA, 35 bp, Artificial Sequence
  Synthetic oligonucleotide
gaatgcacgctatttttttgacgtctgaacccgac

SEQ ID NO: 100767 - DNA, 35 bp, Artificial Sequence
  Synthetic oligonucleotide
gacgtcgacggcctctttccatatccaggagcacc

SEQ ID NO: 100768 - DNA, 35 bp, Artificial Sequence
  Synthetic oligonucleotide
atcattcagctggcacgaaactcacacgcttattc

SEQ ID NO: 100769 - DNA, 35 bp, Artificial Sequence
  Synthetic oligonucleotide
gtacacgagggagaggggaggcttatggaataacg

SEQ ID NO: 100770 - DNA, 35 bp, Artificial Sequence
  Synthetic oligonucleotide
acccaccacagtaggggactacaccaaacataaat

SEQ ID NO: 100771 - DNA, 34 bp, Artificial Sequence
  Synthetic oligonucleotide
atgtcagacagtgcatgaaatgcggtaatcgtat

SEQ ID NO: 100772 - DNA, 35 bp, Artificial Sequence
  Synthetic oligonucleotide
gccccgccgtatcattccattgtgcccaactcgct

SEQ ID NO: 100773 - DNA, 35 bp, Artificial Sequence
  Synthetic oligonucleotide
gacgcacgctgagccggcggtgaagtaactgcagt

SEQ ID NO: 100774 - DNA, 35 bp, Artificial Sequence
  Synthetic oligonucleotide
ttgcccctgagtgaaatatcgcgcatgatagaatt

SEQ ID NO: 100775 - DNA, 36 bp, Artificial Sequence
  Synthetic oligonucleotide
gcgacatgggtaggtgagagagaagggataggtcaa

SEQ ID NO: 100776 - DNA, 36 bp, Artificial Sequence
  Synthetic oligonucleotide
taacaacagcacgggcacagtaatgaggggagggaa

SEQ ID NO: 100777 - DNA, 35 bp, Artificial Sequence
  Synthetic oligonucleotide
tctcaccacctggcccggccccccccaggttggaa

SEQ ID NO: 100778 - DNA, 35 bp, Artificial Sequence
  Synthetic oligonucleotide
aagacggactgcacggaatcggacaaggcgctgaa

SEQ ID NO: 100779 - DNA, 36 bp, Artificial Sequence
  Synthetic oligonucleotide
gagcctgtcgcttcctggttctcttcacgtttttaa

SEQ ID NO: 100780 - DNA, 36 bp, Artificial Sequence
  Synthetic oligonucleotide
tcagcacgtttgaatcttttgatcgccctgttgaca

SEQ ID NO: 100781 - DNA, 36 bp, Artificial Sequence
  Synthetic oligonucleotide
acacaccaggaagagtatgtacgagtatgtcaagca

SEQ ID NO: 100782 - DNA, 36 bp, Artificial Sequence
  Synthetic oligonucleotide
acacatggcaccgaaggaaggtctatcgcgtgctca

SEQ ID NO: 100783 - DNA, 36 bp, Artificial Sequence
  Synthetic oligonucleotide
tgtccaccacatctgatagcgctatgctggaagtca

SEQ ID NO: 100784 - DNA, 38 bp, Artificial Sequence
  Synthetic oligonucleotide
atcacgctactttccagtgtctcatgagaactcacaga

SEQ ID NO: 100785 - DNA, 37 bp, Artificial Sequence
  Synthetic oligonucleotide
agtgaccgcaatgggttaatggtacccagttccgaga

SEQ ID NO: 100786 - DNA, 37 bp, Artificial Sequence
  Synthetic oligonucleotide
atacccccgcagctgtttcacttgtagttcttcgaga

SEQ ID NO: 100787 - DNA, 37 bp, Artificial Sequence
  Synthetic oligonucleotide
gacaaggagcaggtttttgattatcgcaccctctcga

SEQ ID NO: 100788 - DNA, 37 bp, Artificial Sequence
  Synthetic oligonucleotide
acacgagggggagcctgtaaacttacgctacgaagga

SEQ ID NO: 100789 - DNA, 36 bp, Artificial Sequence
  Synthetic oligonucleotide
ttacacgcactggaggtcagaagaagacgtggtgga

SEQ ID NO: 100790 - DNA, 36 bp, Artificial Sequence
  Synthetic oligonucleotide
gacaaagtgagatctcgtgctcatgggggagttgga

SEQ ID NO: 100791 - DNA, 38 bp, Artificial Sequence
  Synthetic oligonucleotide
tacgacggtcggaaggcatgaataaggggcggtaatga

SEQ ID NO: 100792 - DNA, 38 bp, Artificial Sequence
  Synthetic oligonucleotide
atccgagcatgaagctggacatgtgaggacgaatatga

SEQ ID NO: 100793 - DNA, 38 bp, Artificial Sequence
  Synthetic oligonucleotide
gcacgcaacgtgcagcataccgtacacggaccctatga

SEQ ID NO: 100794 - DNA, 38 bp, Artificial Sequence
  Synthetic oligonucleotide
gtgagacagggaggtgtgagggaggctacaggttctga

SEQ ID NO: 100795 - DNA, 38 bp, Artificial Sequence
  Synthetic oligonucleotide
tcaatgaggaggggcgggtagaaaaaagacaggggtga

SEQ ID NO: 100796 - DNA, 36 bp, Artificial Sequence
  Synthetic oligonucleotide
tgtacaggtaaaggctctggaagttggggggggtga

SEQ ID NO: 100797 - DNA, 38 bp, Artificial Sequence
  Synthetic oligonucleotide
ggacggtagacagggggtcaacattagacaagtggtga

SEQ ID NO: 100798 - DNA, 38 bp, Artificial Sequence
  Synthetic oligonucleotide
gatgacggattgcaggtaaagagcagagtgcaacttga

SEQ ID NO: 100799 - DNA, 38 bp, Artificial Sequence
  Synthetic oligonucleotide
aaggactgcagcttaagattggagttataccgcgttga

SEQ ID NO: 100800 - DNA, 37 bp, Artificial Sequence
  Synthetic oligonucleotide
gtgcaggtgggactgcggtatgaagttgaggggttga

SEQ ID NO: 100801 - DNA, 37 bp, Artificial Sequence
  Synthetic oligonucleotide
gactccgccagctgaaacttattttcagccactttga

SEQ ID NO: 100802 - DNA, 35 bp, Artificial Sequence
  Synthetic oligonucleotide
gaccagacgtacacatcgatattaaggtcccgata

SEQ ID NO: 100803 - DNA, 35 bp, Artificial Sequence
  Synthetic oligonucleotide
gcctctagccctgagtgcccgttgtccatacgcac

SEQ ID NO: 100804 - DNA, 35 bp, Artificial Sequence
  Synthetic oligonucleotide
agtgccaagggaatggataagtgaggatggggcac

SEQ ID NO: 100805 - DNA, 35 bp, Artificial Sequence
  Synthetic oligonucleotide
atgcccggggggaagagatacccaagaaagcagcc

SEQ ID NO: 100806 - DNA, 35 bp, Artificial Sequence
  Synthetic oligonucleotide
tgcaaccatccacatgtgtgtggactcttacgcgc

SEQ ID NO: 100807 - DNA, 35 bp, Artificial Sequence
  Synthetic oligonucleotide
gcaacgcacgtgaaaccgttataaagtggttgctc

SEQ ID NO: 100808 - DNA, 35 bp, Artificial Sequence
  Synthetic oligonucleotide
tacgtactgcctcagtcttctatccatgtgccgtc

SEQ ID NO: 100809 - DNA, 35 bp, Artificial Sequence
  Synthetic oligonucleotide
tgaccatgcgcatagtctccatgtgagggcgaagg

SEQ ID NO: 100810 - DNA, 34 bp, Artificial Sequence
  Synthetic oligonucleotide
tgagggaaggtcggggtaaacgggtcgaacgaat

SEQ ID NO: 100811 - DNA, 35 bp, Artificial Sequence
  Synthetic oligonucleotide
gaggaacacgagagggcgaatatccaacacaacat

SEQ ID NO: 100812 - DNA, 35 bp, Artificial Sequence
  Synthetic oligonucleotide
agacctccccccccagaaacgcgaacagcaacgat

SEQ ID NO: 100813 - DNA, 35 bp, Artificial Sequence
  Synthetic oligonucleotide
gtctgcccggacggccaataagtcgtagataaact

SEQ ID NO: 100814 - DNA, 35 bp, Artificial Sequence
  Synthetic oligonucleotide
taggtacgtggacgggaggaagttgggagggctct

SEQ ID NO: 100815 - DNA, 36 bp, Artificial Sequence
  Synthetic oligonucleotide
gacatgacaaggggatagatcctaggcaggggtaaa

SEQ ID NO: 100816 - DNA, 36 bp, Artificial Sequence
  Synthetic oligonucleotide
gccccaccccgtgacgcttggacaatatcgaaacaa

SEQ ID NO: 100817 - DNA, 36 bp, Artificial Sequence
  Synthetic oligonucleotide
aagacaggacgcaggcttatatcacccgccccccaa

SEQ ID NO: 100818 - DNA, 36 bp, Artificial Sequence
  Synthetic oligonucleotide
tcagccaggaccgatccctctctacgcgcactccaa

SEQ ID NO: 100819 - DNA, 36 bp, Artificial Sequence
  Synthetic oligonucleotide
gagtgccagaacaagggaagttacggtatgcatcaa

SEQ ID NO: 100820 - DNA, 36 bp, Artificial Sequence
  Synthetic oligonucleotide
acagtgccccgatcaggcagatgccagtacactgaa

SEQ ID NO: 100821 - DNA, 36 bp, Artificial Sequence
  Synthetic oligonucleotide
gaacaactggcaatctgcaaacagcccgctttataa

SEQ ID NO: 100822 - DNA, 36 bp, Artificial Sequence
  Synthetic oligonucleotide
gaacaatgacgaggtatcgagcgaatcttcttaaca

SEQ ID NO: 100823 - DNA, 36 bp, Artificial Sequence
  Synthetic oligonucleotide
gccaacacatcgtttagcgggcttcataccatccca

SEQ ID NO: 100824 - DNA, 36 bp, Artificial Sequence
  Synthetic oligonucleotide
gtacgaatggggtggagtggaaatggggctagggca

SEQ ID NO: 100825 - DNA, 37 bp, Artificial Sequence
  Synthetic oligonucleotide
tgctacacgtgcccaccttaccccgctgcattaacga

SEQ ID NO: 100826 - DNA, 37 bp, Artificial Sequence
  Synthetic oligonucleotide
accgcgcacagcggtcgtactccctactatttctcga

SEQ ID NO: 100827 - DNA, 38 bp, Artificial Sequence
  Synthetic oligonucleotide
gaagacagacgagctatacgaaggggcatgcgacatga

SEQ ID NO: 100828 - DNA, 38 bp, Artificial Sequence
  Synthetic oligonucleotide
gacggagaagacagacccaaatagtagagggtccatga

SEQ ID NO: 100829 - DNA, 38 bp, Artificial Sequence
  Synthetic oligonucleotide
tcagtgcccggtgtaaaaaaaattgtctgtgttgatga

SEQ ID NO: 100830 - DNA, 38 bp, Artificial Sequence
  Synthetic oligonucleotide
tacaccggaatggtcaggactcactgcattccatgtga

SEQ ID NO: 100831 - DNA, 38 bp, Artificial Sequence
  Synthetic oligonucleotide
agacgcctcggcgagggaggaaaaaggggaacttgtga

SEQ ID NO: 100832 - DNA, 38 bp, Artificial Sequence
  Synthetic oligonucleotide
tagggccacggcggccgtgttcctctctggttaattga

SEQ ID NO: 100833 - DNA, 38 bp, Artificial Sequence
  Synthetic oligonucleotide
ggaataagcacagtggagcaaagggtgagaggtgttga

SEQ ID NO: 100834 - DNA, 35 bp, Artificial Sequence
  Synthetic oligonucleotide
gcacccgctggtaggcccactcatatctatagcac

SEQ ID NO: 100835 - DNA, 35 bp, Artificial Sequence
  Synthetic oligonucleotide
gcaggctccgttcaccatgctttctcgaatatcac

SEQ ID NO: 100836 - DNA, 35 bp, Artificial Sequence
  Synthetic oligonucleotide
gacacctgccgttgcttgagatggctctgtatagg

SEQ ID NO: 100837 - DNA, 35 bp, Artificial Sequence
  Synthetic oligonucleotide
gactacgacagcactcaccgacacactcatcgcgg

SEQ ID NO: 100838 - DNA, 35 bp, Artificial Sequence
  Synthetic oligonucleotide
gactgcccggaacgagtgtgagcaaacctgatatg

SEQ ID NO: 100839 - DNA, 35 bp, Artificial Sequence
  Synthetic oligonucleotide
tacggacatgacacgagttgtggttcaacgtgctg

SEQ ID NO: 100840 - DNA, 35 bp, Artificial Sequence
  Synthetic oligonucleotide
gctgccagtcgtttacaagcccggacttgttgatt

SEQ ID NO: 100841 - DNA, 35 bp, Artificial Sequence
  Synthetic oligonucleotide
tgtggtgcggcacatacgcattgtggtcggccaaa

SEQ ID NO: 100842 - DNA, 37 bp, Artificial Sequence
  Synthetic oligonucleotide
agagcgcctccccgtaccagagtaccaaccccgctaa

SEQ ID NO: 100843 - DNA, 36 bp, Artificial Sequence
  Synthetic oligonucleotide
gtgaagacgtcacaaagacctgccagtagacgaaca

SEQ ID NO: 100844 - DNA, 36 bp, Artificial Sequence
  Synthetic oligonucleotide
gagcaaggctaaagtggggggggatggaggagggca

SEQ ID NO: 100845 - DNA, 37 bp, Artificial Sequence
  Synthetic oligonucleotide
gcgacgctccaccagatcagactcaccttttatcaga

SEQ ID NO: 100846 - DNA, 37 bp, Artificial Sequence
  Synthetic oligonucleotide
tgcaggagaacagaccgtgcaattgaagggtcggaga

SEQ ID NO: 100847 - DNA, 37 bp, Artificial Sequence
  Synthetic oligonucleotide
atgaccgacataagggaggacacgaattaacaaccga

SEQ ID NO: 100848 - DNA, 37 bp, Artificial Sequence
  Synthetic oligonucleotide
ggacaagccgccctacagtcttttaggacaagttcga

SEQ ID NO: 100849 - DNA, 38 bp, Artificial Sequence
  Synthetic oligonucleotide
tgacacgacgttatctcgtatgcgatgaagttcaagga

SEQ ID NO: 100850 - DNA, 35 bp, Artificial Sequence
  Synthetic oligonucleotide
acgaacgtgagtgcgaatcacggaagaatgaagga

SEQ ID NO: 100851 - DNA, 38 bp, Artificial Sequence
  Synthetic oligonucleotide
tccgaccgaggaaacagaagaggggggaacagtcatga

SEQ ID NO: 100852 - DNA, 37 bp, Artificial Sequence
  Synthetic oligonucleotide
tacgaacaggcgagaaaaacgttgcgagacaggatga

SEQ ID NO: 100853 - DNA, 37 bp, Artificial Sequence
  Synthetic oligonucleotide
agagctgacgggatgggaagcaggaacggcggagtga

SEQ ID NO: 100854 - DNA, 38 bp, Artificial Sequence
  Synthetic oligonucleotide
tgacgaaggggaggagttgatttaccagcaggtggtga

SEQ ID NO: 100855 - DNA, 38 bp, Artificial Sequence
  Synthetic oligonucleotide
tagcacgctgcttaatcgtggccgaacactacaattga

SEQ ID NO: 100856 - DNA, 36 bp, Artificial Sequence
  Synthetic oligonucleotide
tttacgcggcactgcctcgacgactttcggaattga

SEQ ID NO: 100857 - DNA, 38 bp, Artificial Sequence
  Synthetic oligonucleotide
gtgtgccgcactaggagagtgctttggggataacttga

SEQ ID NO: 100858 - DNA, 35 bp, Artificial Sequence
  Synthetic oligonucleotide
aagagcgtgctgcaaccccgtcttcccttggcgac

SEQ ID NO: 100859 - DNA, 35 bp, Artificial Sequence
  Synthetic oligonucleotide
taagcagaggagaagcaagaaagatacaatgtgac

SEQ ID NO: 100860 - DNA, 35 bp, Artificial Sequence
  Synthetic oligonucleotide
atactgcgcacatcggaataattcatatcgcaatg

SEQ ID NO: 100861 - DNA, 35 bp, Artificial Sequence
  Synthetic oligonucleotide
tcccccacatgtatatcatgcatcgccatctgcat

SEQ ID NO: 100862 - DNA, 35 bp, Artificial Sequence
  Synthetic oligonucleotide
atcacaggggagggagctgagagttaccatggagt

SEQ ID NO: 100863 - DNA, 35 bp, Artificial Sequence
  Synthetic oligonucleotide
gaagcgtgcgagcgcggacaactacagcattcgtt

SEQ ID NO: 100864 - DNA, 35 bp, Artificial Sequence
  Synthetic oligonucleotide
tccgggcaggacgtttgatctaactgcagttgttt

SEQ ID NO: 100865 - DNA, 36 bp, Artificial Sequence
  Synthetic oligonucleotide
acacgagcatcagcctgcgcatttgttctgtggaaa

SEQ ID NO: 100866 - DNA, 36 bp, Artificial Sequence
  Synthetic oligonucleotide
gatgtccgcagtgctctctccatcagcatggacgaa

SEQ ID NO: 100867 - DNA, 35 bp, Artificial Sequence
  Synthetic oligonucleotide
ggtgcaaccagggggatgagctacccgtaaatgaa

SEQ ID NO: 100868 - DNA, 36 bp, Artificial Sequence
  Synthetic oligonucleotide
ggatcgagcaggggagcataagtggcctcatcctaa

SEQ ID NO: 100869 - DNA, 36 bp, Artificial Sequence
  Synthetic oligonucleotide
agcgaagcgagaggttggcggacaagacatgaacca

SEQ ID NO: 100870 - DNA, 38 bp, Artificial Sequence
  Synthetic oligonucleotide
tgtcaccccacatatgccactgttccatcttcatttca

SEQ ID NO: 100871 - DNA, 37 bp, Artificial Sequence
  Synthetic oligonucleotide
atgccaccacccacgtgttttgaggccactctaagga

SEQ ID NO: 100872 - DNA, 37 bp, Artificial Sequence
  Synthetic oligonucleotide
tcaagtgcaaccacgcctaaaagagtccggcaacgga

SEQ ID NO: 100873 - DNA, 37 bp, Artificial Sequence
  Synthetic oligonucleotide
acagacgactcggaatgtacacgcaccgctcatcgga

SEQ ID NO: 100874 - DNA, 36 bp, Artificial Sequence
  Synthetic oligonucleotide
tacaggacgaagaaggagggaaccggtcgacgggga

SEQ ID NO: 100875 - DNA, 37 bp, Artificial Sequence
  Synthetic oligonucleotide
tcacccgttgtactccgctgtgcccttctttcgtgga

SEQ ID NO: 100876 - DNA, 37 bp, Artificial Sequence
  Synthetic oligonucleotide
aaagtcgcagaatgggcaaatggaatgaatttgtgga

SEQ ID NO: 100877 - DNA, 35 bp, Artificial Sequence
  Synthetic oligonucleotide
acgaccacacacctgtcaaacggtctagtattgga

SEQ ID NO: 100878 - DNA, 37 bp, Artificial Sequence
  Synthetic oligonucleotide
gtcagaccacatgattgcgtatgggaaattggttgga

SEQ ID NO: 100879 - DNA, 38 bp, Artificial Sequence
  Synthetic oligonucleotide
atgtcacagcgggtgcacagatatcaggcaggaagtga

SEQ ID NO: 100880 - DNA, 37 bp, Artificial Sequence
  Synthetic oligonucleotide
gagtgggaaggggaaggtgcgataagacgcttcgtga

SEQ ID NO: 100881 - DNA, 38 bp, Artificial Sequence
  Synthetic oligonucleotide
gacgtggacacacgtaataatgaggaggactggtgtga

SEQ ID NO: 100882 - DNA, 38 bp, Artificial Sequence
  Synthetic oligonucleotide
gcgaagcatgcagccattcctgcaagtataccacttga

SEQ ID NO: 100883 - DNA, 38 bp, Artificial Sequence
  Synthetic oligonucleotide
tccgcaggccctttccgttgccaacagcctagacttga

SEQ ID NO: 100884 - DNA, 36 bp, Artificial Sequence
  Synthetic oligonucleotide
tacgacactgtaacgtactgaaggcactaggtttga

SEQ ID NO: 100885 - DNA, 36 bp, Artificial Sequence
  Synthetic oligonucleotide
gtggtacagtccattcgtaaaaacactgcctgaata

SEQ ID NO: 100886 - DNA, 36 bp, Artificial Sequence
  Synthetic oligonucleotide
tacaaccgcccctgctgatgcgtcgacatacgttta

SEQ ID NO: 100887 - DNA, 35 bp, Artificial Sequence
  Synthetic oligonucleotide
tcaccgagggggactgatgcgatataagaagaggg

SEQ ID NO: 100888 - DNA, 35 bp, Artificial Sequence
  Synthetic oligonucleotide
tcgaaacgcaatgagtcttccattggttctacctg

SEQ ID NO: 100889 - DNA, 35 bp, Artificial Sequence
  Synthetic oligonucleotide
aatgtgaagcgggagcgtggtaagtagcaaataat

SEQ ID NO: 100890 - DNA, 35 bp, Artificial Sequence
  Synthetic oligonucleotide
tagaccgcaccgtcgcatacttcaaccctttcgat

SEQ ID NO: 100891 - DNA, 35 bp, Artificial Sequence
  Synthetic oligonucleotide
gaaggtgcaacaacgttataaggaaaattggcagt

SEQ ID NO: 100892 - DNA, 36 bp, Artificial Sequence
  Synthetic oligonucleotide
atccgcagacagtggcgcagggtaccatctcatgtt

SEQ ID NO: 100893 - DNA, 35 bp, Artificial Sequence
  Synthetic oligonucleotide
tgaacgtaacccattgtctggaagacgggtggaaa

SEQ ID NO: 100894 - DNA, 35 bp, Artificial Sequence
  Synthetic oligonucleotide
tagacacacggctactggcatcgacacgctgccaa

SEQ ID NO: 100895 - DNA, 36 bp, Artificial Sequence
  Synthetic oligonucleotide
tcacgcacgctaacagattcgacaaacattctgcaa

SEQ ID NO: 100896 - DNA, 36 bp, Artificial Sequence
  Synthetic oligonucleotide
tagaaaggagagggaaagagctatgtgacattgtaa

SEQ ID NO: 100897 - DNA, 36 bp, Artificial Sequence
  Synthetic oligonucleotide
atgcaacggccatcgtatgtcctaacgcctcccgca

SEQ ID NO: 100898 - DNA, 37 bp, Artificial Sequence
  Synthetic oligonucleotide
tagctggaggaagaaacgtaatgagagttggtagaga

SEQ ID NO: 100899 - DNA, 37 bp, Artificial Sequence
  Synthetic oligonucleotide
ttcgaaggcgatgagtgaggccaggcccagacataga

SEQ ID NO: 100900 - DNA, 37 bp, Artificial Sequence
  Synthetic oligonucleotide
gagtgctgcagtatagcattgagataactacttccga

SEQ ID NO: 100901 - DNA, 37 bp, Artificial Sequence
  Synthetic oligonucleotide
gatgagcggtattggaagcaaagatctcgatactcga

SEQ ID NO: 100902 - DNA, 37 bp, Artificial Sequence
  Synthetic oligonucleotide
atgacggtgcattggaggggagactacattgactgga

SEQ ID NO: 100903 - DNA, 37 bp, Artificial Sequence
  Synthetic oligonucleotide
gagactggcataagaggtttaaaggtgaaggggtgga

SEQ ID NO: 100904 - DNA, 38 bp, Artificial Sequence
  Synthetic oligonucleotide
gaagacaggggtcacgagcactagagagtgtgggatga

SEQ ID NO: 100905 - DNA, 38 bp, Artificial Sequence
  Synthetic oligonucleotide
ttgtacccccgcttcgtctattggagacgcttttatga

SEQ ID NO: 100906 - DNA, 38 bp, Artificial Sequence
  Synthetic oligonucleotide
gtcgtccaccacgacctaaccaccggtccataacctga

SEQ ID NO: 100907 - DNA, 38 bp, Artificial Sequence
  Synthetic oligonucleotide
tacggagccacgaagagagtagacctagatcatggtga

SEQ ID NO: 100908 - DNA, 36 bp, Artificial Sequence
  Synthetic oligonucleotide
acagggggaagaaagtggggtaccaagacagtgtga

SEQ ID NO: 100909 - DNA, 38 bp, Artificial Sequence
  Synthetic oligonucleotide
acacgcccggctcctcctgcgattggtgaaaggcttga

SEQ ID NO: 100910 - DNA, 36 bp, Artificial Sequence
  Synthetic oligonucleotide
gatgacgccggtcaagcgtagtacaaaccgcaccta

SEQ ID NO: 100911 - DNA, 36 bp, Artificial Sequence
  Synthetic oligonucleotide
gagggaaggagaggagaccagtggcacagttatgta

SEQ ID NO: 100912 - DNA, 35 bp, Artificial Sequence
  Synthetic oligonucleotide
tcacaacctccaaagggatactgcagaacacctta

SEQ ID NO: 100913 - DNA, 35 bp, Artificial Sequence
  Synthetic oligonucleotide
gtgacctcacctcatgcttatctgaaatggtctta

SEQ ID NO: 100914 - DNA, 35 bp, Artificial Sequence
  Synthetic oligonucleotide
aacatccggctctggggaggggataggcggtgtgc

SEQ ID NO: 100915 - DNA, 35 bp, Artificial Sequence
  Synthetic oligonucleotide
actacatctgcccagtatcttcataatgaagttgc

SEQ ID NO: 100916 - DNA, 35 bp, Artificial Sequence
  Synthetic oligonucleotide
gcacaagtcagatagtacagctgatatactcgctc

SEQ ID NO: 100917 - DNA, 35 bp, Artificial Sequence
  Synthetic oligonucleotide
gacacaacctggagaatatgaagatgcatgggccg

SEQ ID NO: 100918 - DNA, 35 bp, Artificial Sequence
  Synthetic oligonucleotide
gtgcactcgctcgccccgtgactcaatcccacaat

SEQ ID NO: 100919 - DNA, 35 bp, Artificial Sequence
  Synthetic oligonucleotide
taccccgacgaagcccgtctactatagccctcaat

SEQ ID NO: 100920 - DNA, 35 bp, Artificial Sequence
  Synthetic oligonucleotide
acgacttccacctgaccactgctatcgaaagccat

SEQ ID NO: 100921 - DNA, 35 bp, Artificial Sequence
  Synthetic oligonucleotide
gtgcaacattccacatcgtatctaacttcttgtat

SEQ ID NO: 100922 - DNA, 35 bp, Artificial Sequence
  Synthetic oligonucleotide
gaccaaagtgcagtgggtatcgggctcttaatgtt

SEQ ID NO: 100923 - DNA, 35 bp, Artificial Sequence
  Synthetic oligonucleotide
ttacctagcgcgggatatagggggggggtgacttt

SEQ ID NO: 100924 - DNA, 36 bp, Artificial Sequence
  Synthetic oligonucleotide
tagggtggggagagggtagacagtactagggggaaa

SEQ ID NO: 100925 - DNA, 36 bp, Artificial Sequence
  Synthetic oligonucleotide
tatcgcaatgctggtgcactttaacgctctgtcgaa

SEQ ID NO: 100926 - DNA, 36 bp, Artificial Sequence
  Synthetic oligonucleotide
aacctgcgcatccgggaatagtgacaagggagggaa

SEQ ID NO: 100927 - DNA, 32 bp, Artificial Sequence
  Synthetic oligonucleotide
gagtgtgcaggtggaagggggggggggcgtaa

SEQ ID NO: 100928 - DNA, 36 bp, Artificial Sequence
  Synthetic oligonucleotide
gcatcgtgcagaagatgcatcctactcgtgaacaca

SEQ ID NO: 100929 - DNA, 31 bp, Artificial Sequence
  Synthetic oligonucleotide
gagccgccattagtcgccactactccaacca

SEQ ID NO: 100930 - DNA, 37 bp, Artificial Sequence
  Synthetic oligonucleotide
tcccccgatcagtcgcaccttttgctaccgtctccca

SEQ ID NO: 100931 - DNA, 36 bp, Artificial Sequence
  Synthetic oligonucleotide
aacgccaagcgagcattagggacattgatataagca

SEQ ID NO: 100932 - DNA, 37 bp, Artificial Sequence
  Synthetic oligonucleotide
gggtggcgctgtggggaaagatggaggaggcgagaga

SEQ ID NO: 100933 - DNA, 37 bp, Artificial Sequence
  Synthetic oligonucleotide
gacaccgtcgggtcgagtaacatcttaactggctaga

SEQ ID NO: 100934 - DNA, 35 bp, Artificial Sequence
  Synthetic oligonucleotide
tcagtgcggagccgggaaatttttgagaggaagga

SEQ ID NO: 100935 - DNA, 36 bp, Artificial Sequence
  Synthetic oligonucleotide
gactgtgctcagttgtctttttctcacgccgacgga

SEQ ID NO: 100936 - DNA, 37 bp, Artificial Sequence
  Synthetic oligonucleotide
atgctgcagtaggaaagacgacaaaggactccccgga

SEQ ID NO: 100937 - DNA, 37 bp, Artificial Sequence
  Synthetic oligonucleotide
agtgggcacagggactaaaaatatggagtggggggga

SEQ ID NO: 100938 - DNA, 37 bp, Artificial Sequence
  Synthetic oligonucleotide
tccgcaaggaacgtgggtctgagattttttgttggga

SEQ ID NO: 100939 - DNA, 35 bp, Artificial Sequence
  Synthetic oligonucleotide
atgaacgcacggagagtctaataccatagcatgga

SEQ ID NO: 100940 - DNA, 35 bp, Artificial Sequence
  Synthetic oligonucleotide
gctggaacgccggtaagcaggacattaaggaatga

SEQ ID NO: 100941 - DNA, 37 bp, Artificial Sequence
  Synthetic oligonucleotide
ttgagcaagcggatggtgaagctccccactaccatga

SEQ ID NO: 100942 - DNA, 38 bp, Artificial Sequence
  Synthetic oligonucleotide
gccctgttgccattgccgccatcatatacgttccctga

SEQ ID NO: 100943 - DNA, 38 bp, Artificial Sequence
  Synthetic oligonucleotide
gtgacatcgccggaggattacctgcctgcactgcgtga

SEQ ID NO: 100944 - DNA, 38 bp, Artificial Sequence
  Synthetic oligonucleotide
gacactcctaaacgtaatgcgggtccggccttacttga

SEQ ID NO: 100945 - DNA, 38 bp, Artificial Sequence
  Synthetic oligonucleotide
tccggactgcaggctgagggctatggtaagttatttga

SEQ ID NO: 100946 - DNA, 35 bp, Artificial Sequence
  Synthetic oligonucleotide
atccaaccccgcggactgtccctaccgacagctac

SEQ ID NO: 100947 - DNA, 35 bp, Artificial Sequence
  Synthetic oligonucleotide
gctgccgggtggaaaggggaaggatgcaaacagcc

SEQ ID NO: 100948 - DNA, 35 bp, Artificial Sequence
  Synthetic oligonucleotide
gcctgagcacgtccgttagtctccttgcttgtgcc

SEQ ID NO: 100949 - DNA, 35 bp, Artificial Sequence
  Synthetic oligonucleotide
gtgaggtcgtaactctggtttgacgtgcactttcc

SEQ ID NO: 100950 - DNA, 35 bp, Artificial Sequence
  Synthetic oligonucleotide
tacgcatagtgacagcgctttgttatgtcgccctc

SEQ ID NO: 100951 - DNA, 35 bp, Artificial Sequence
  Synthetic oligonucleotide
gcaacgggaaaggtaccgaagagagatgactgaag

SEQ ID NO: 100952 - DNA, 35 bp, Artificial Sequence
  Synthetic oligonucleotide
atgagagcaaggagtgtgtggtggacttccggccg

SEQ ID NO: 100953 - DNA, 35 bp, Artificial Sequence
  Synthetic oligonucleotide
gatgcctcttcgccttcctcttaccagactgtaat

SEQ ID NO: 100954 - DNA, 35 bp, Artificial Sequence
  Synthetic oligonucleotide
gttcagagccgtagattatcaggtcctcgtaccat

SEQ ID NO: 100955 - DNA, 35 bp, Artificial Sequence
  Synthetic oligonucleotide
tttgccccgacccgtcgttattcttcagttcccat

SEQ ID NO: 100956 - DNA, 35 bp, Artificial Sequence
  Synthetic oligonucleotide
tagctgccgacaagttggcgtggtgactaatccct

SEQ ID NO: 100957 - DNA, 35 bp, Artificial Sequence
  Synthetic oligonucleotide
gccgagcaggagtaatccagaatgaggggctccct

SEQ ID NO: 100958 - DNA, 35 bp, Artificial Sequence
  Synthetic oligonucleotide
tacgacaggggaggacgtgaaactacgttcgaaaa

SEQ ID NO: 100959 - DNA, 36 bp, Artificial Sequence
  Synthetic oligonucleotide
aacagccacagtcctgtactgcattgcagcatgcaa

SEQ ID NO: 100960 - DNA, 35 bp, Artificial Sequence
  Synthetic oligonucleotide
gtggagggtgcgcaagagttacagaaaggtgagaa

SEQ ID NO: 100961 - DNA, 36 bp, Artificial Sequence
  Synthetic oligonucleotide
tcaccacacctatcgtgcattgtacgtacttgttaa

SEQ ID NO: 100962 - DNA, 36 bp, Artificial Sequence
  Synthetic oligonucleotide
acgtgctcccgtaccatctttaccttgtgacctcca

SEQ ID NO: 100963 - DNA, 36 bp, Artificial Sequence
  Synthetic oligonucleotide
aatcaccgcttggtacgccttaggacagtttgcgca

SEQ ID NO: 100964 - DNA, 35 bp, Artificial Sequence
  Synthetic oligonucleotide
accacctgccctaactgtcccgtatagcccattca

SEQ ID NO: 100965 - DNA, 36 bp, Artificial Sequence
  Synthetic oligonucleotide
agacgtgcagtcggagcgtcttggcgaattctttca

SEQ ID NO: 100966 - DNA, 36 bp, Artificial Sequence
  Synthetic oligonucleotide
tttagtgcggagaggagtgagcggtaacattggaga

SEQ ID NO: 100967 - DNA, 36 bp, Artificial Sequence
  Synthetic oligonucleotide
actcagccgcaggaggtgggtgattaggcattgaga

SEQ ID NO: 100968 - DNA, 37 bp, Artificial Sequence
  Synthetic oligonucleotide
gacgagggatgaacgtgagattcgggacttaagtaga

SEQ ID NO: 100969 - DNA, 37 bp, Artificial Sequence
  Synthetic oligonucleotide
aaacggaggatgataagagatgacaaatgatggtcga

SEQ ID NO: 100970 - DNA, 37 bp, Artificial Sequence
  Synthetic oligonucleotide
gccggtaggcgcggtctatataggcaacgtgtttcga

SEQ ID NO: 100971 - DNA, 37 bp, Artificial Sequence
  Synthetic oligonucleotide
gacatgacaggggaaagtgttggatgattcaccagga

SEQ ID NO: 100972 - DNA, 37 bp, Artificial Sequence
  Synthetic oligonucleotide
tctcacgaggaacgtactacaggcgagagtttctgga

SEQ ID NO: 100973 - DNA, 38 bp, Artificial Sequence
  Synthetic oligonucleotide
gactagagacgcgtgtgggaattagtggtggtaaatga

SEQ ID NO: 100974 - DNA, 37 bp, Artificial Sequence
  Synthetic oligonucleotide
ggtgcacgaggtggaagttaagtaggcgatgaactga

SEQ ID NO: 100975 - DNA, 36 bp, Artificial Sequence
  Synthetic oligonucleotide
gtgcgtgccaccgttcacagccgtacaacaaagtga

SEQ ID NO: 100976 - DNA, 38 bp, Artificial Sequence
  Synthetic oligonucleotide
gaccagacgcaagtggttgaatagaatggatttggtga

SEQ ID NO: 100977 - DNA, 37 bp, Artificial Sequence
  Synthetic oligonucleotide
gtgacactccgaaggtcgaatgtgccgtaccggttga

SEQ ID NO: 100978 - DNA, 36 bp, Artificial Sequence
  Synthetic oligonucleotide
gcactagcacatgtgattttggcaactgcctacata

SEQ ID NO: 100979 - DNA, 36 bp, Artificial Sequence
  Synthetic oligonucleotide
gccatcaaagggagtgaagaagacggttgaatgcta

SEQ ID NO: 100980 - DNA, 36 bp, Artificial Sequence
  Synthetic oligonucleotide
tccgatgcaatcggacaaatggtagtcgaagtgcta

SEQ ID NO: 100981 - DNA, 36 bp, Artificial Sequence
  Synthetic oligonucleotide
cctaggagccaccgaccctgatgtaaaaatgatgta

SEQ ID NO: 100982 - DNA, 35 bp, Artificial Sequence
  Synthetic oligonucleotide
agtacgacggcactccacacgtatcgtacacatta

SEQ ID NO: 100983 - DNA, 35 bp, Artificial Sequence
  Synthetic oligonucleotide
tttgcatcacactcaggaccatactttcgcgtaac

SEQ ID NO: 100984 - DNA, 35 bp, Artificial Sequence
  Synthetic oligonucleotide
tatctgaccccacgttcgcgaaaactaaaccccac

SEQ ID NO: 100985 - DNA, 35 bp, Artificial Sequence
  Synthetic oligonucleotide
gtgcgcccactggtacccgacgttgcctcatcccc

SEQ ID NO: 100986 - DNA, 35 bp, Artificial Sequence
  Synthetic oligonucleotide
actgtgtctcccctgaatccgttcccgacggtctc

SEQ ID NO: 100987 - DNA, 35 bp, Artificial Sequence
  Synthetic oligonucleotide
atgccacgattggggtttaagctgggtgaaggtag

SEQ ID NO: 100988 - DNA, 35 bp, Artificial Sequence
  Synthetic oligonucleotide
atagggaccacagcaggtaacgggagaggttaagg

SEQ ID NO: 100989 - DNA, 35 bp, Artificial Sequence
  Synthetic oligonucleotide
gatagacgcaggaagcaggataagggtggtgcatg

SEQ ID NO: 100990 - DNA, 35 bp, Artificial Sequence
  Synthetic oligonucleotide
acctggcccagaggtcgcgttggtaccttaacttg

SEQ ID NO: 100991 - DNA, 35 bp, Artificial Sequence
  Synthetic oligonucleotide
tcaacacgtgccggtgttgaacatattgatttcct

SEQ ID NO: 100992 - DNA, 35 bp, Artificial Sequence
  Synthetic oligonucleotide
acacacgcgcacgattatcgcaccgtcctaatggt

SEQ ID NO: 100993 - DNA, 36 bp, Artificial Sequence
  Synthetic oligonucleotide
gacaaaccgctatgcgcatatgcatctacttccaaa

SEQ ID NO: 100994 - DNA, 36 bp, Artificial Sequence
  Synthetic oligonucleotide
tgcgaatgcacatggcataaacaattcctaccccaa

SEQ ID NO: 100995 - DNA, 36 bp, Artificial Sequence
  Synthetic oligonucleotide
taacacctccgaaatctgcgaccctgcctcgacgaa

SEQ ID NO: 100996 - DNA, 33 bp, Artificial Sequence
  Synthetic oligonucleotide
tcatcccggcacagagtacggcgttcgacggaa

SEQ ID NO: 100997 - DNA, 35 bp, Artificial Sequence
  Synthetic oligonucleotide
acacacaccgggcaaacgtttgaatcgatctgtaa

SEQ ID NO: 100998 - DNA, 36 bp, Artificial Sequence
  Synthetic oligonucleotide
ttgagcggaaaggacatggaagaatgtgagatttaa

SEQ ID NO: 100999 - DNA, 35 bp, Artificial Sequence
  Synthetic oligonucleotide
acaggacggagtgctgcaaaaagggatgaagtaca

SEQ ID NO: 101000 - DNA, 36 bp, Artificial Sequence
  Synthetic oligonucleotide
aatgctgggtgacatgaaagcatcgcagagactcca

SEQ ID NO: 101001 - DNA, 37 bp, Artificial Sequence
  Synthetic oligonucleotide
acactcgcaaccccaggcccaccaccaggcacgatca

SEQ ID NO: 101002 - DNA, 36 bp, Artificial Sequence
  Synthetic oligonucleotide
tctcacgagcaagaaaggggatacagagaggcgtca

SEQ ID NO: 101003 - DNA, 37 bp, Artificial Sequence
  Synthetic oligonucleotide
gtgcgctggagccgttaacagttgtccgacgatgcga

SEQ ID NO: 101004 - DNA, 37 bp, Artificial Sequence
  Synthetic oligonucleotide
acacacagctagcgggaaatagggcaaactgcaatga

SEQ ID NO: 101005 - DNA, 37 bp, Artificial Sequence
  Synthetic oligonucleotide
gcgaagaagaggaggaagcacgcatagaacagaatga

SEQ ID NO: 101006 - DNA, 38 bp, Artificial Sequence
  Synthetic oligonucleotide
tgagacacgtaagggttaggcgtaggagatattgatga

SEQ ID NO: 101007 - DNA, 38 bp, Artificial Sequence
  Synthetic oligonucleotide
aagccagtaagatcagggacaggacggaggaagggtga

SEQ ID NO: 101008 - DNA, 38 bp, Artificial Sequence
  Synthetic oligonucleotide
gaagggaacttgtagagaagggcggacagctttggtga

SEQ ID NO: 101009 - DNA, 37 bp, Artificial Sequence
  Synthetic oligonucleotide
gtttcacaaaggcagaggggatggggaccatatgtga

SEQ ID NO: 101010 - DNA, 38 bp, Artificial Sequence
  Synthetic oligonucleotide
gatcagaacaggagaacgtaaaacgagtacagagttga

SEQ ID NO: 101011 - DNA, 36 bp, Artificial Sequence
  Synthetic oligonucleotide
gactccgtcgtgcaaatttaaagcgggaaaggaata

SEQ ID NO: 101012 - DNA, 35 bp, Artificial Sequence
  Synthetic oligonucleotide
atgcactccagagaacgtagagcgggcgtactcta

SEQ ID NO: 101013 - DNA, 35 bp, Artificial Sequence
  Synthetic oligonucleotide
gatgagccaaggcgtagtggaggtagcttgacgta

SEQ ID NO: 101014 - DNA, 36 bp, Artificial Sequence
  Synthetic oligonucleotide
gtaatcaaagcagcagtctgtgtctccctcctctta

SEQ ID NO: 101015 - DNA, 35 bp, Artificial Sequence
  Synthetic oligonucleotide
tcatgcctcgaccccaatcgtcatactactgtttc

SEQ ID NO: 101016 - DNA, 35 bp, Artificial Sequence
  Synthetic oligonucleotide
tacaccggcgggatctaatgacacactgtgtgaag

SEQ ID NO: 101017 - DNA, 35 bp, Artificial Sequence
  Synthetic oligonucleotide
gcccgccgccccatcatccagcctgtcgaatgcag

SEQ ID NO: 101018 - DNA, 35 bp, Artificial Sequence
  Synthetic oligonucleotide
gaagggatcgagagacggtgattagggcgtctgag

SEQ ID NO: 101019 - DNA, 35 bp, Artificial Sequence
  Synthetic oligonucleotide
gattcgtgctaactattccgccatccacttcatag

SEQ ID NO: 101020 - DNA, 35 bp, Artificial Sequence
  Synthetic oligonucleotide
tcagccctgcccccctatccgtgacatcaggcacg

SEQ ID NO: 101021 - DNA, 35 bp, Artificial Sequence
  Synthetic oligonucleotide
gtcatccccgcaaaagtcgtcatgcagttttcatg

SEQ ID NO: 101022 - DNA, 35 bp, Artificial Sequence
  Synthetic oligonucleotide
aacggccccactgcccgatattatttttctgctct

SEQ ID NO: 101023 - DNA, 36 bp, Artificial Sequence
  Synthetic oligonucleotide
tcatcccgtcccgaacccgtcctgacttatgccaaa

SEQ ID NO: 101024 - DNA, 35 bp, Artificial Sequence
  Synthetic oligonucleotide
tccttaaccagtccttgccagatcggttcgaacaa

SEQ ID NO: 101025 - DNA, 36 bp, Artificial Sequence
  Synthetic oligonucleotide
gacttgccatcaaacagccgcactcagtctactgaa

SEQ ID NO: 101026 - DNA, 36 bp, Artificial Sequence
  Synthetic oligonucleotide
tcgaaccggtcgatagcctccctagcggttccaaca

SEQ ID NO: 101027 - DNA, 36 bp, Artificial Sequence
  Synthetic oligonucleotide
agatgggggggcagaaaagaaaggggagggagcgca

SEQ ID NO: 101028 - DNA, 36 bp, Artificial Sequence
  Synthetic oligonucleotide
tggatgctgcagaagagcaatctacgcaccacctca

SEQ ID NO: 101029 - DNA, 37 bp, Artificial Sequence
  Synthetic oligonucleotide
aaagagcgatgaggggggaagggcgtgctcttacaga

SEQ ID NO: 101030 - DNA, 35 bp, Artificial Sequence
  Synthetic oligonucleotide
gccaaagcgttcgggtgggcaataaagggctcaga

SEQ ID NO: 101031 - DNA, 37 bp, Artificial Sequence
  Synthetic oligonucleotide
agtacgggtcggactctagaataatgggactgcgaga

SEQ ID NO: 101032 - DNA, 36 bp, Artificial Sequence
  Synthetic oligonucleotide
ggtgagtacaccggctatttgatgcacacgagtcga

SEQ ID NO: 101033 - DNA, 37 bp, Artificial Sequence
  Synthetic oligonucleotide
tcagtggggtacagattgacagggtagggaggccgga

SEQ ID NO: 101034 - DNA, 37 bp, Artificial Sequence
  Synthetic oligonucleotide
gatgcagatcaggagatcaaaagttatcgtcggggga

SEQ ID NO: 101035 - DNA, 37 bp, Artificial Sequence
  Synthetic oligonucleotide
gccacagattagcgttgtatgggatgggtggggggga

SEQ ID NO: 101036 - DNA, 38 bp, Artificial Sequence
  Synthetic oligonucleotide
gacgcaatgtgcgtctggaaccgttgaaggcccactga

SEQ ID NO: 101037 - DNA, 38 bp, Artificial Sequence
  Synthetic oligonucleotide
tcaacctgcatcaaggcgttaaagcgccatacaggtga

SEQ ID NO: 101038 - DNA, 37 bp, Artificial Sequence
  Synthetic oligonucleotide
atcacgcagagtctcccaacagccacccatattgtga

SEQ ID NO: 101039 - DNA, 37 bp, Artificial Sequence
  Synthetic oligonucleotide
gtgccaacctcttatgcccttcttacctgggcattga

SEQ ID NO: 101040 - DNA, 36 bp, Artificial Sequence
  Synthetic oligonucleotide
gaaggacgccactgttcacctctagcgatagcttta

SEQ ID NO: 101041 - DNA, 36 bp, Artificial Sequence
  Synthetic oligonucleotide
gccaagtgacaggcacgttgttcagagggattttta

SEQ ID NO: 101042 - DNA, 35 bp, Artificial Sequence
  Synthetic oligonucleotide
atgtggcccgccttccatgttattattcttcgtac

SEQ ID NO: 101043 - DNA, 35 bp, Artificial Sequence
  Synthetic oligonucleotide
tgaagccctgttcggcatgccacgctacaacttac

SEQ ID NO: 101044 - DNA, 35 bp, Artificial Sequence
  Synthetic oligonucleotide
gtagtgctcgcagaactgttacttattgcctaacc

SEQ ID NO: 101045 - DNA, 35 bp, Artificial Sequence
  Synthetic oligonucleotide
aaactgcactcctgtatctatgacctcgtatcgcc

SEQ ID NO: 101046 - DNA, 35 bp, Artificial Sequence
  Synthetic oligonucleotide
gtcaccacacccaattcagtaacgacgatttccgc

SEQ ID NO: 101047 - DNA, 35 bp, Artificial Sequence
  Synthetic oligonucleotide
tgctccgtcactcctatacacccgcttcctatcag

SEQ ID NO: 101048 - DNA, 35 bp, Artificial Sequence
  Synthetic oligonucleotide
tcgaccgtaggaagggttagttgaaagttgttacg

SEQ ID NO: 101049 - DNA, 35 bp, Artificial Sequence
  Synthetic oligonucleotide
ggagtcgcacgtaaggagattagggaacggaaccg

SEQ ID NO: 101050 - DNA, 35 bp, Artificial Sequence
  Synthetic oligonucleotide
agcccaccatccgttattagtgtcctgttcgcaat

SEQ ID NO: 101051 - DNA, 35 bp, Artificial Sequence
  Synthetic oligonucleotide
agtactgtgggcatttttctctacctgcattacct

SEQ ID NO: 101052 - DNA, 35 bp, Artificial Sequence
  Synthetic oligonucleotide
ttgacaggtcaactagacgaacgcggttaccatct

SEQ ID NO: 101053 - DNA, 35 bp, Artificial Sequence
  Synthetic oligonucleotide
ggtggacgggagatattatggggtcttgataaggt

SEQ ID NO: 101054 - DNA, 34 bp, Artificial Sequence
  Synthetic oligonucleotide
atgatgccacggctaaacggacactggaggtcaa

SEQ ID NO: 101055 - DNA, 36 bp, Artificial Sequence
  Synthetic oligonucleotide
ggacccattcgccacgttattgcacacggatcataa

SEQ ID NO: 101056 - DNA, 36 bp, Artificial Sequence
  Synthetic oligonucleotide
gacccagatcactcacactcttatgccagtatataa

SEQ ID NO: 101057 - DNA, 35 bp, Artificial Sequence
  Synthetic oligonucleotide
atcccctcccctaagtaactgccccttgattagca

SEQ ID NO: 101058 - DNA, 36 bp, Artificial Sequence
  Synthetic oligonucleotide
accagcaacatcctgtttttcgatcatctctccgca

SEQ ID NO: 101059 - DNA, 36 bp, Artificial Sequence
  Synthetic oligonucleotide
atgccgagacgggagaatgaaaggctaggcctcgca

SEQ ID NO: 101060 - DNA, 37 bp, Artificial Sequence
  Synthetic oligonucleotide
gacccgccggcaaactgaccgccctcttagttcctca

SEQ ID NO: 101061 - DNA, 37 bp, Artificial Sequence
  Synthetic oligonucleotide
acatcacacggagggacattgagaagtagagttccga

SEQ ID NO: 101062 - DNA, 38 bp, Artificial Sequence
  Synthetic oligonucleotide
actacaaggcaaatggtgcatgggaacaagcacggtga

SEQ ID NO: 101063 - DNA, 38 bp, Artificial Sequence
  Synthetic oligonucleotide
gcattcaagcacggaaacggggtaagagagcgtattga

SEQ ID NO: 101064 - DNA, 36 bp, Artificial Sequence
  Synthetic oligonucleotide
ttcaccgccgggcccttcacgaccctccgacatgta

SEQ ID NO: 101065 - DNA, 35 bp, Artificial Sequence
  Synthetic oligonucleotide
tgtagcctcgcaacgacaaggccaactgttcatta

SEQ ID NO: 101066 - DNA, 36 bp, Artificial Sequence
  Synthetic oligonucleotide
ttcgccctccgcgttgttaacgacccgtctacttta

SEQ ID NO: 101067 - DNA, 35 bp, Artificial Sequence
  Synthetic oligonucleotide
taccacgtgtcgaatagttattgtcctcgtacaac

SEQ ID NO: 101068 - DNA, 35 bp, Artificial Sequence
  Synthetic oligonucleotide
tagggccacacgacgtctatcaccgcttctcctcc

SEQ ID NO: 101069 - DNA, 35 bp, Artificial Sequence
  Synthetic oligonucleotide
tacagagcggtgcgttacccccatgcttcatattc

SEQ ID NO: 101070 - DNA, 35 bp, Artificial Sequence
  Synthetic oligonucleotide
aacccctacccgactagcccattgacgcatttaag

SEQ ID NO: 101071 - DNA, 35 bp, Artificial Sequence
  Synthetic oligonucleotide
atcaccagcggagacgtggttagcacggagtcgag

SEQ ID NO: 101072 - DNA, 35 bp, Artificial Sequence
  Synthetic oligonucleotide
acgagagacggggggatcatcaatccggtagatat

SEQ ID NO: 101073 - DNA, 35 bp, Artificial Sequence
  Synthetic oligonucleotide
gtccacctcacctacgtgcggtcacatatctctat

SEQ ID NO: 101074 - DNA, 35 bp, Artificial Sequence
  Synthetic oligonucleotide
aacgccggcactcatagccccgtttccgtgattat

SEQ ID NO: 101075 - DNA, 35 bp, Artificial Sequence
  Synthetic oligonucleotide
tcagccgcccaataccgtcttagctacgaccaagt

SEQ ID NO: 101076 - DNA, 35 bp, Artificial Sequence
  Synthetic oligonucleotide
acacgacgagtggttagtgctaaaatggctcactt

SEQ ID NO: 101077 - DNA, 36 bp, Artificial Sequence
  Synthetic oligonucleotide
ttagaacgacactggtaaaagttggaggggagtgaa

SEQ ID NO: 101078 - DNA, 35 bp, Artificial Sequence
  Synthetic oligonucleotide
ggttaccgtcaggcctgctccgccacgaacccaca

SEQ ID NO: 101079 - DNA, 37 bp, Artificial Sequence
  Synthetic oligonucleotide
gatccgcagacagagttacgtagagaaggggttgaga

SEQ ID NO: 101080 - DNA, 37 bp, Artificial Sequence
  Synthetic oligonucleotide
tccacgggagggggaacgggactgaacgttttgtaga

SEQ ID NO: 101081 - DNA, 37 bp, Artificial Sequence
  Synthetic oligonucleotide
actcacagtcagtgtatctgggtaagctgaggatcga

SEQ ID NO: 101082 - DNA, 37 bp, Artificial Sequence
  Synthetic oligonucleotide
atacaccgacacacagcaaagagggtccggattggga

SEQ ID NO: 101083 - DNA, 36 bp, Artificial Sequence
  Synthetic oligonucleotide
gcccccgatcgccatcttttagagctttcacctgga

SEQ ID NO: 101084 - DNA, 38 bp, Artificial Sequence
  Synthetic oligonucleotide
aatgcccgcctgcagtgttctagtcgcttgtacgctga

SEQ ID NO: 101085 - DNA, 38 bp, Artificial Sequence
  Synthetic oligonucleotide
gatgatgccccgatggtaagcatggagtcgaatagtga

SEQ ID NO: 101086 - DNA, 38 bp, Artificial Sequence
  Synthetic oligonucleotide
tccaggaggccaagagcgaaaatgaccacacgtagtga

SEQ ID NO: 101087 - DNA, 38 bp, Artificial Sequence
  Synthetic oligonucleotide
ttgagacggcgaaggaagggggaggtgacaattcgtga

SEQ ID NO: 101088 - DNA, 38 bp, Artificial Sequence
  Synthetic oligonucleotide
ggaatggcgcaggggagaggtaaaaaggcgggaattga

SEQ ID NO: 101089 - DNA, 38 bp, Artificial Sequence
  Synthetic oligonucleotide
gcgtgagcacgttctacgtagggataggactggcttga

SEQ ID NO: 101090 - DNA, 36 bp, Artificial Sequence
  Synthetic oligonucleotide
gacgagcatctatgactttctttgcaactgtacgta

SEQ ID NO: 101091 - DNA, 35 bp, Artificial Sequence
  Synthetic oligonucleotide
agttccaccgccccatgaattccagtcgcctgaac

SEQ ID NO: 101092 - DNA, 35 bp, Artificial Sequence
  Synthetic oligonucleotide
acacgggccaccctcgcatagaatagttccctaac

SEQ ID NO: 101093 - DNA, 35 bp, Artificial Sequence
  Synthetic oligonucleotide
tcacacacgcagatttttaacactatttttctgac

SEQ ID NO: 101094 - DNA, 35 bp, Artificial Sequence
  Synthetic oligonucleotide
gcaccacagttaccgttgtacgttacaccatgtac

SEQ ID NO: 101095 - DNA, 35 bp, Artificial Sequence
  Synthetic oligonucleotide
agacaggtccacaggccgtcaccaagggtcttctc

SEQ ID NO: 101096 - DNA, 35 bp, Artificial Sequence
  Synthetic oligonucleotide
acatagcgcaacgtgtctctttcccctggatattc

SEQ ID NO: 101097 - DNA, 35 bp, Artificial Sequence
  Synthetic oligonucleotide
tgcgatgacacgacctgctgcacctccaactcaag

SEQ ID NO: 101098 - DNA, 35 bp, Artificial Sequence
  Synthetic oligonucleotide
gctgagaagcagacaaggggatataaggacgacag

SEQ ID NO: 101099 - DNA, 35 bp, Artificial Sequence
  Synthetic oligonucleotide
atgtggtgcagtgcgagtggactagcccaatccag

SEQ ID NO: 101100 - DNA, 35 bp, Artificial Sequence
  Synthetic oligonucleotide
tcaatggcggtggaggggcggttagggtggatccg

SEQ ID NO: 101101 - DNA, 35 bp, Artificial Sequence
  Synthetic oligonucleotide
tgctccaactgttgtatagagctaaggtggtgggg

SEQ ID NO: 101102 - DNA, 35 bp, Artificial Sequence
  Synthetic oligonucleotide
atgcgcaccgacgtgtctgcgggcctaactggaat

SEQ ID NO: 101103 - DNA, 35 bp, Artificial Sequence
  Synthetic oligonucleotide
gaacaggggcaattgctggctcatagcaaaaagct

SEQ ID NO: 101104 - DNA, 35 bp, Artificial Sequence
  Synthetic oligonucleotide
gatccaccgcactactgaaccataaccagtcactt

SEQ ID NO: 101105 - DNA, 36 bp, Artificial Sequence
  Synthetic oligonucleotide
ccacacaccggccatgtctgtacctcattgggcgaa

SEQ ID NO: 101106 - DNA, 36 bp, Artificial Sequence
  Synthetic oligonucleotide
gccgaagcaagaattaggagcacgaataacagggaa

SEQ ID NO: 101107 - DNA, 36 bp, Artificial Sequence
  Synthetic oligonucleotide
atacgccgtgccccgccaatcacagtcacatctgaa

SEQ ID NO: 101108 - DNA, 35 bp, Artificial Sequence
  Synthetic oligonucleotide
atggccacataccaccgccactaggtccgttataa

SEQ ID NO: 101109 - DNA, 36 bp, Artificial Sequence
  Synthetic oligonucleotide
gacgcaggtgtctcgatcgctcttgtggcaatttaa

SEQ ID NO: 101110 - DNA, 36 bp, Artificial Sequence
  Synthetic oligonucleotide
gaacaggccaccatgtgcaaggactcacgtgtctca

SEQ ID NO: 101111 - DNA, 37 bp, Artificial Sequence
  Synthetic oligonucleotide
ttgtgcaggagttcagaaggtagtagtttggctgaga

SEQ ID NO: 101112 - DNA, 37 bp, Artificial Sequence
  Synthetic oligonucleotide
gcccacccccaggtctgacgagatagtcgagggtaga

SEQ ID NO: 101113 - DNA, 37 bp, Artificial Sequence
  Synthetic oligonucleotide
gagtcccgaaaaggtcccggctccatctaatacacga

SEQ ID NO: 101114 - DNA, 36 bp, Artificial Sequence
  Synthetic oligonucleotide
gacacgacctccatgtagtcactcttagtcctacga

SEQ ID NO: 101115 - DNA, 37 bp, Artificial Sequence
  Synthetic oligonucleotide
gaccgtgagtggtggaagggagctatcacggttacga

SEQ ID NO: 101116 - DNA, 34 bp, Artificial Sequence
  Synthetic oligonucleotide
gcaagggggtagtgggtgcagaataaggctcgga

SEQ ID NO: 101117 - DNA, 37 bp, Artificial Sequence
  Synthetic oligonucleotide
gatgggtggaagatgtgaaatcaacagtcgaacggga

SEQ ID NO: 101118 - DNA, 38 bp, Artificial Sequence
  Synthetic oligonucleotide
gatggaacgcttcgacgataagggatgagtattgatga

SEQ ID NO: 101119 - DNA, 38 bp, Artificial Sequence
  Synthetic oligonucleotide
gagagcgcaacatgtctatcccactccaaagctactga

SEQ ID NO: 101120 - DNA, 38 bp, Artificial Sequence
  Synthetic oligonucleotide
gcgatgccaatgaagcttgaagacggtcgtaaacgtga

SEQ ID NO: 101121 - DNA, 38 bp, Artificial Sequence
  Synthetic oligonucleotide
tgactcacggctcgaggaaggcaagacgaggagtgtga

SEQ ID NO: 101122 - DNA, 37 bp, Artificial Sequence
  Synthetic oligonucleotide
atcccccgccacatttatctatgcgacccgctcttga

SEQ ID NO: 101123 - DNA, 38 bp, Artificial Sequence
  Synthetic oligonucleotide
gccaccggcgactctatgagaaggctttgcttcgttga

SEQ ID NO: 101124 - DNA, 38 bp, Artificial Sequence
  Synthetic oligonucleotide
gaccagcacaacagtgaagaaggtggcagggtggttga

SEQ ID NO: 101125 - DNA, 38 bp, Artificial Sequence
  Synthetic oligonucleotide
ccaccagtaaggctggtgtacccacggacactttttga

SEQ ID NO: 101126 - DNA, 35 bp, Artificial Sequence
  Synthetic oligonucleotide
gccagaggagaagacatgcgcgtacgtggagagta

SEQ ID NO: 101127 - DNA, 35 bp, Artificial Sequence
  Synthetic oligonucleotide
tggacgtggtgacggacaacgtgcgtaggcgactc

SEQ ID NO: 101128 - DNA, 35 bp, Artificial Sequence
  Synthetic oligonucleotide
gaccgcactctccagcgtgccccctgcctattgtc

SEQ ID NO: 101129 - DNA, 35 bp, Artificial Sequence
  Synthetic oligonucleotide
tcaccgtcaccaatggggggaaaggcctggaaaag

SEQ ID NO: 101130 - DNA, 35 bp, Artificial Sequence
  Synthetic oligonucleotide
aagttgggggcaaagaggaagagctagcaggtaag

SEQ ID NO: 101131 - DNA, 35 bp, Artificial Sequence
  Synthetic oligonucleotide
gatgacgtcagtatgtcccccgactgcaatccttt

SEQ ID NO: 101132 - DNA, 35 bp, Artificial Sequence
  Synthetic oligonucleotide
ttgaggaccacaccacggaagtgaacgcatacgaa

SEQ ID NO: 101133 - DNA, 31 bp, Artificial Sequence
  Synthetic oligonucleotide
gcaccaccctttggctctagtactttttgaa

SEQ ID NO: 101134 - DNA, 36 bp, Artificial Sequence
  Synthetic oligonucleotide
gtgacgcggtagcatacgtatgattagcgtttgtaa

SEQ ID NO: 101135 - DNA, 35 bp, Artificial Sequence
  Synthetic oligonucleotide
ttcgtgaacgcagggtgcaatctttgtctcgttaa

SEQ ID NO: 101136 - DNA, 35 bp, Artificial Sequence
  Synthetic oligonucleotide
gaccgatggagctgggttaacgtagtctgggaaca

SEQ ID NO: 101137 - DNA, 36 bp, Artificial Sequence
  Synthetic oligonucleotide
gttagcgcaagacactgctttcgaacactcatccca

SEQ ID NO: 101138 - DNA, 36 bp, Artificial Sequence
  Synthetic oligonucleotide
acacacggtaaggtgtagagcagtaagatacgcgca

SEQ ID NO: 101139 - DNA, 38 bp, Artificial Sequence
  Synthetic oligonucleotide
tcactcaccgctgatctcaatcgactacctccctgtca

SEQ ID NO: 101140 - DNA, 36 bp, Artificial Sequence
  Synthetic oligonucleotide
gaaggaggagcaagaggaaaggagaaggtgcacaga

SEQ ID NO: 101141 - DNA, 37 bp, Artificial Sequence
  Synthetic oligonucleotide
tacactgccagggtgcatcacgccggtcatatgcaga

SEQ ID NO: 101142 - DNA, 37 bp, Artificial Sequence
  Synthetic oligonucleotide
agaaacgccgagcgaggaatggagggagcgatcgaga

SEQ ID NO: 101143 - DNA, 37 bp, Artificial Sequence
  Synthetic oligonucleotide
ggaacgtgcaaatgtacaaaaaagccataatcggaga

SEQ ID NO: 101144 - DNA, 37 bp, Artificial Sequence
  Synthetic oligonucleotide
tacaaccggcggattgggaatggagcttgaagtagga

SEQ ID NO: 101145 - DNA, 37 bp, Artificial Sequence
  Synthetic oligonucleotide
tcaaaggcacggagaaaatgcttaagcatagtactga

SEQ ID NO: 101146 - DNA, 38 bp, Artificial Sequence
  Synthetic oligonucleotide
tgaacgtaggtggaggtcgtactggtgacgtggcgtga

SEQ ID NO: 101147 - DNA, 38 bp, Artificial Sequence
  Synthetic oligonucleotide
gaagggacggaaagacaagcgactagagaccattgtga

SEQ ID NO: 101148 - DNA, 38 bp, Artificial Sequence
  Synthetic oligonucleotide
atgccatgcacaggtagggtgtctcgcgcctcaattga

SEQ ID NO: 101149 - DNA, 38 bp, Artificial Sequence
  Synthetic oligonucleotide
ggaaagggaacgggaggaataggcaaatggcccgttga

SEQ ID NO: 101150 - DNA, 36 bp, Artificial Sequence
  Synthetic oligonucleotide
gtcaggtcgcagtctacttaccacacttcctaccta

SEQ ID NO: 101151 - DNA, 35 bp, Artificial Sequence
  Synthetic oligonucleotide
gtgcgctccaagctggcaataaatctaatctcgta

SEQ ID NO: 101152 - DNA, 35 bp, Artificial Sequence
  Synthetic oligonucleotide
tgacacgtgaaaccccgctatcacactgcactaac

SEQ ID NO: 101153 - DNA, 35 bp, Artificial Sequence
  Synthetic oligonucleotide
acccgcagggctgctgtaatgatttagccattccc

SEQ ID NO: 101154 - DNA, 35 bp, Artificial Sequence
  Synthetic oligonucleotide
tatgcccgcagacgggcgaaggatatgggggaagc

SEQ ID NO: 101155 - DNA, 35 bp, Artificial Sequence
  Synthetic oligonucleotide
gccagacctcctcctcgctattcacgttggctcag

SEQ ID NO: 101156 - DNA, 35 bp, Artificial Sequence
  Synthetic oligonucleotide
gtgaaggtgaaggatagaaagggggaaggtgatcg

SEQ ID NO: 101157 - DNA, 35 bp, Artificial Sequence
  Synthetic oligonucleotide
tccgctagccacaatatgtctccttaatgcatgct

SEQ ID NO: 101158 - DNA, 35 bp, Artificial Sequence
  Synthetic oligonucleotide
tactgctgagctggctgacggtctatttgggtctt

SEQ ID NO: 101159 - DNA, 35 bp, Artificial Sequence
  Synthetic oligonucleotide
accgacaacgaaccgtggttcagttgaacttggtt

SEQ ID NO: 101160 - DNA, 36 bp, Artificial Sequence
  Synthetic oligonucleotide
agccaccgcctcggatagaacgcccaccgttagcaa

SEQ ID NO: 101161 - DNA, 36 bp, Artificial Sequence
  Synthetic oligonucleotide
aattgcatcagaatctagccgcctgagcccgaaaca

SEQ ID NO: 101162 - DNA, 36 bp, Artificial Sequence
  Synthetic oligonucleotide
gcccgaagagaatggagagcggtaaaggagaacaga

SEQ ID NO: 101163 - DNA, 37 bp, Artificial Sequence
  Synthetic oligonucleotide
ttgacgtgcattggtaggtattgtgggtgcccgtcga

SEQ ID NO: 101164 - DNA, 37 bp, Artificial Sequence
  Synthetic oligonucleotide
ttcacacctcgcatgtgatggtggtacccgtttcgga

SEQ ID NO: 101165 - DNA, 38 bp, Artificial Sequence
  Synthetic oligonucleotide
gttaactgcgaaatggtagggtacagttaacacggtga

SEQ ID NO: 101166 - DNA, 37 bp, Artificial Sequence
  Synthetic oligonucleotide
gaaccacgacagggagacgtaaacggtacgtctgtga

SEQ ID NO: 101167 - DNA, 38 bp, Artificial Sequence
  Synthetic oligonucleotide
tgaccgcaacgtatgtatagcctccaaaattccgttga

SEQ ID NO: 101168 - DNA, 38 bp, Artificial Sequence
  Synthetic oligonucleotide
gaccaagcagggcaatctggcacgaagcgcatatttga

SEQ ID NO: 101169 - DNA, 35 bp, Artificial Sequence
  Synthetic oligonucleotide
tcactgctgtagctcgttccccgtccattcgtata

SEQ ID NO: 101170 - DNA, 36 bp, Artificial Sequence
  Synthetic oligonucleotide
ttgggccccagcttacttgtagtcgttcctcctacc

SEQ ID NO: 101171 - DNA, 35 bp, Artificial Sequence
  Synthetic oligonucleotide
tgcccctactgttctgcttcccatcacggataccc

SEQ ID NO: 101172 - DNA, 35 bp, Artificial Sequence
  Synthetic oligonucleotide
ggactgagccatcgtttgctcaatatttacgttcc

SEQ ID NO: 101173 - DNA, 35 bp, Artificial Sequence
  Synthetic oligonucleotide
gatggggcaagtggagcctatggggagcgcgacgc

SEQ ID NO: 101174 - DNA, 35 bp, Artificial Sequence
  Synthetic oligonucleotide
atccccccatgagaccacctcgtctgcgctaggtc

SEQ ID NO: 101175 - DNA, 35 bp, Artificial Sequence
  Synthetic oligonucleotide
gacacgacgcttgccctagacctcgaaattgctcg

SEQ ID NO: 101176 - DNA, 35 bp, Artificial Sequence
  Synthetic oligonucleotide
gtctgcctcagcttcgggctatctcaccttcaaat

SEQ ID NO: 101177 - DNA, 35 bp, Artificial Sequence
  Synthetic oligonucleotide
tcagccctcatattcaacatcacatggttatccat

SEQ ID NO: 101178 - DNA, 35 bp, Artificial Sequence
  Synthetic oligonucleotide
gaaccgtccgctccgatcactgctattctccttct

SEQ ID NO: 101179 - DNA, 35 bp, Artificial Sequence
  Synthetic oligonucleotide
gacactccgcttgtgcttaagttctcccctgggtt

SEQ ID NO: 101180 - DNA, 36 bp, Artificial Sequence
  Synthetic oligonucleotide
gtgcacccctggcctgtccgacatgtcccccgtaaa

SEQ ID NO: 101181 - DNA, 35 bp, Artificial Sequence
  Synthetic oligonucleotide
tccgactggtagtacttgactgcaacctgggacaa

SEQ ID NO: 101182 - DNA, 35 bp, Artificial Sequence
  Synthetic oligonucleotide
gatgacgaagaatgtaaggggtcatggtcatacaa

SEQ ID NO: 101183 - DNA, 36 bp, Artificial Sequence
  Synthetic oligonucleotide
ttgttgccagggagggcgggggaggtaacaaagcaa

SEQ ID NO: 101184 - DNA, 36 bp, Artificial Sequence
  Synthetic oligonucleotide
acaccaccgtacggacaataattctacctgttctaa

SEQ ID NO: 101185 - DNA, 36 bp, Artificial Sequence
  Synthetic oligonucleotide
tgatgtgtgctggttgcgatattgccagttcagcca

SEQ ID NO: 101186 - DNA, 35 bp, Artificial Sequence
  Synthetic oligonucleotide
gctggccccttctacgattgttgctggctaatgca

SEQ ID NO: 101187 - DNA, 36 bp, Artificial Sequence
  Synthetic oligonucleotide
accgcaccccagccccttcacctcacaggtctttca

SEQ ID NO: 101188 - DNA, 36 bp, Artificial Sequence
  Synthetic oligonucleotide
tgtaacgaaaggttggatggagattcggcatggaga

SEQ ID NO: 101189 - DNA, 36 bp, Artificial Sequence
  Synthetic oligonucleotide
acattgggagggatgggtaaatgactagagggacga

SEQ ID NO: 101190 - DNA, 37 bp, Artificial Sequence
  Synthetic oligonucleotide
atgtgccaggatagtgggagaagagaaagaaaacgga

SEQ ID NO: 101191 - DNA, 38 bp, Artificial Sequence
  Synthetic oligonucleotide
atgactcggtgagagagtcgagaacaagtgtgggatga

SEQ ID NO: 101192 - DNA, 38 bp, Artificial Sequence
  Synthetic oligonucleotide
gcacaggtcggacggtgaaccccgtgagctgaatctga

SEQ ID NO: 101193 - DNA, 38 bp, Artificial Sequence
  Synthetic oligonucleotide
aacacgcccggttatgttaagccatatcctaattctga

SEQ ID NO: 101194 - DNA, 37 bp, Artificial Sequence
  Synthetic oligonucleotide
tgagccaaagggaggaggagggatcgatgaaaagtga

SEQ ID NO: 101195 - DNA, 36 bp, Artificial Sequence
  Synthetic oligonucleotide
tgtgcaagggaggcatacggtgtaggaggcttccta

SEQ ID NO: 101196 - DNA, 35 bp, Artificial Sequence
  Synthetic oligonucleotide
tacgaacgcaaatggtttgtagaggcaagtgagta

SEQ ID NO: 101197 - DNA, 36 bp, Artificial Sequence
  Synthetic oligonucleotide
tgaccacggggaaagcgtaccactagaaacacgtta

SEQ ID NO: 101198 - DNA, 36 bp, Artificial Sequence
  Synthetic oligonucleotide
tcatgatccccggtgccgtatcctgtagacctctac

SEQ ID NO: 101199 - DNA, 35 bp, Artificial Sequence
  Synthetic oligonucleotide
gcgatcctgccaggtgattgacgccgcccgtttgc

SEQ ID NO: 101200 - DNA, 35 bp, Artificial Sequence
  Synthetic oligonucleotide
agtagtgcagtggttgggggagacaaattggccat

SEQ ID NO: 101201 - DNA, 35 bp, Artificial Sequence
  Synthetic oligonucleotide
atcgacgtaggtgagcacacaaagtacgttgccat

SEQ ID NO: 101202 - DNA, 35 bp, Artificial Sequence
  Synthetic oligonucleotide
aaccatgcccctagaagacgtagctgtgatccttt

SEQ ID NO: 101203 - DNA, 35 bp, Artificial Sequence
  Synthetic oligonucleotide
gttgccagcctatttccgatttctctcgaggacaa

SEQ ID NO: 101204 - DNA, 35 bp, Artificial Sequence
  Synthetic oligonucleotide
tagcaacagtgcaagcaatgcacaaaacaaaggaa

SEQ ID NO: 101205 - DNA, 36 bp, Artificial Sequence
  Synthetic oligonucleotide
tcagcctggcctcaaggatcgccctccctccgctaa

SEQ ID NO: 101206 - DNA, 35 bp, Artificial Sequence
  Synthetic oligonucleotide
tcacgcgcttacaacggttctgcacacatagggca

SEQ ID NO: 101207 - DNA, 38 bp, Artificial Sequence
  Synthetic oligonucleotide
gtcgccgtgacgtacttattacctagccccatctgtca

SEQ ID NO: 101208 - DNA, 38 bp, Artificial Sequence
  Synthetic oligonucleotide
tatgcgcaaacgggtgatcgggcagttgcagaagaaga

SEQ ID NO: 101209 - DNA, 37 bp, Artificial Sequence
  Synthetic oligonucleotide
tcaggactgcacatgtattcccagtacgtttgtaaga

SEQ ID NO: 101210 - DNA, 37 bp, Artificial Sequence
  Synthetic oligonucleotide
tcgaacacgtggggaggtgaggatattagcatcagga

SEQ ID NO: 101211 - DNA, 38 bp, Artificial Sequence
  Synthetic oligonucleotide
gacgagcagtccgaggcctcgacgacagttgacactga

SEQ ID NO: 101212 - DNA, 38 bp, Artificial Sequence
  Synthetic oligonucleotide
gaggacactggcagataacgtgggaattggaatgctga

SEQ ID NO: 101213 - DNA, 38 bp, Artificial Sequence
  Synthetic oligonucleotide
gacacgccggagaggtgatgtccttgaccattgggtga

SEQ ID NO: 101214 - DNA, 38 bp, Artificial Sequence
  Synthetic oligonucleotide
tagacgggacgaggagtactgcagaagaggaacattga

SEQ ID NO: 101215 - DNA, 38 bp, Artificial Sequence
  Synthetic oligonucleotide
tgtacgtgtcgggaggccaacccccacgctttgattga

SEQ ID NO: 101216 - DNA, 36 bp, Artificial Sequence
  Synthetic oligonucleotide
ggggtcccacccgatatattgatcatcccttcttga

SEQ ID NO: 101217 - DNA, 36 bp, Artificial Sequence
  Synthetic oligonucleotide
atcaccgcacggccaattccgactcgtacagtccta

SEQ ID NO: 101218 - DNA, 35 bp, Artificial Sequence
  Synthetic oligonucleotide
ggatacacagcttgactgcagaccactcctccaac

SEQ ID NO: 101219 - DNA, 35 bp, Artificial Sequence
  Synthetic oligonucleotide
tagagcgtagcccagcctccgaccatcctggccac

SEQ ID NO: 101220 - DNA, 35 bp, Artificial Sequence
  Synthetic oligonucleotide
tgcatcatatcgcgcatcgaccagcattttctacc

SEQ ID NO: 101221 - DNA, 35 bp, Artificial Sequence
  Synthetic oligonucleotide
gacaggtgctgcattccctgtatctgtttcattcc

SEQ ID NO: 101222 - DNA, 35 bp, Artificial Sequence
  Synthetic oligonucleotide
tgactaggcctgctggttgactgcggttgttcttc

SEQ ID NO: 101223 - DNA, 36 bp, Artificial Sequence
  Synthetic oligonucleotide
tcagacggaatccgaggaggggaaaaaggaccgacg

SEQ ID NO: 101224 - DNA, 35 bp, Artificial Sequence
  Synthetic oligonucleotide
tccccaactgcctgtgacgttcattatttgcattg

SEQ ID NO: 101225 - DNA, 32 bp, Artificial Sequence
  Synthetic oligonucleotide
gactggccccctatcgcactttctgaacacct

SEQ ID NO: 101226 - DNA, 35 bp, Artificial Sequence
  Synthetic oligonucleotide
gagctgcacggacgagttacggggggaaacagagt

SEQ ID NO: 101227 - DNA, 35 bp, Artificial Sequence
  Synthetic oligonucleotide
gacgtggacaggcgtaagaactcacggaggtaggt

SEQ ID NO: 101228 - DNA, 36 bp, Artificial Sequence
  Synthetic oligonucleotide
cctcagctccttgttcccccgtctatgtagtctcaa

SEQ ID NO: 101229 - DNA, 36 bp, Artificial Sequence
  Synthetic oligonucleotide
acgtgcatccccccactctctggttcgctggtccca

SEQ ID NO: 101230 - DNA, 36 bp, Artificial Sequence
  Synthetic oligonucleotide
gtcgccgaaccacctgtcatttccagtactatgcca

SEQ ID NO: 101231 - DNA, 37 bp, Artificial Sequence
  Synthetic oligonucleotide
tgagagagcaacagtatggtgtgatagatgacaggga

SEQ ID NO: 101232 - DNA, 38 bp, Artificial Sequence
  Synthetic oligonucleotide
accgaacggtcgcaggttatcatatggttgaaagatga

SEQ ID NO: 101233 - DNA, 38 bp, Artificial Sequence
  Synthetic oligonucleotide
gatcgcaatggaataaagatggacacaggtaggactga

SEQ ID NO: 101234 - DNA, 37 bp, Artificial Sequence
  Synthetic oligonucleotide
tgacgactcagacgggttgaaaagcatagcggggtga

SEQ ID NO: 101235 - DNA, 37 bp, Artificial Sequence
  Synthetic oligonucleotide
gaccagctcaaaatcaatgcgtcaaccgacatattga

SEQ ID NO: 101236 - DNA, 38 bp, Artificial Sequence
  Synthetic oligonucleotide
gcaccacaatgtgcatacgggggggaatcacggcttga

SEQ ID NO: 101237 - DNA, 38 bp, Artificial Sequence
  Synthetic oligonucleotide
gaacaggagagatgcgattgagatgggccagcagttga

SEQ ID NO: 101238 - DNA, 38 bp, Artificial Sequence
  Synthetic oligonucleotide
gtccaccagcatgatataaggccagggtgaagggttga

SEQ ID NO: 101239 - DNA, 38 bp, Artificial Sequence
  Synthetic oligonucleotide
ttgagcgccgcaggctagacgtttacacgaaagtttga

SEQ ID NO: 101240 - DNA, 36 bp, Artificial Sequence
  Synthetic oligonucleotide
tatgacagacgccttccgcctgggatttgccacata

SEQ ID NO: 101241 - DNA, 36 bp, Artificial Sequence
  Synthetic oligonucleotide
gacacggggagtgagggcatcgatagtcgggcacta

SEQ ID NO: 101242 - DNA, 35 bp, Artificial Sequence
  Synthetic oligonucleotide
ataccccacggttagctttacgaggacacttagta

SEQ ID NO: 101243 - DNA, 35 bp, Artificial Sequence
  Synthetic oligonucleotide
gcacaacatccgtatgattagcggtccatagctac

SEQ ID NO: 101244 - DNA, 36 bp, Artificial Sequence
  Synthetic oligonucleotide
taacagccggactagggcaaggagagggacatgaag

SEQ ID NO: 101245 - DNA, 35 bp, Artificial Sequence
  Synthetic oligonucleotide
gtgcactactgtttacctgtctactggctccatag

SEQ ID NO: 101246 - DNA, 35 bp, Artificial Sequence
  Synthetic oligonucleotide
gtgtgcgaacacgggccaagtggagaagggaaaat

SEQ ID NO: 101247 - DNA, 36 bp, Artificial Sequence
  Synthetic oligonucleotide
acagtcaccccagacgtaggagtggcggcctataaa

SEQ ID NO: 101248 - DNA, 36 bp, Artificial Sequence
  Synthetic oligonucleotide
gttgcgtgctgcagtgaaacgctccatcttatcgaa

SEQ ID NO: 101249 - DNA, 37 bp, Artificial Sequence
  Synthetic oligonucleotide
tcagagccgggtctggcttaagattgatcgctgaaga

SEQ ID NO: 101250 - DNA, 37 bp, Artificial Sequence
  Synthetic oligonucleotide
gcgctacgcacagtggacgagaggatttcaaaagaga

SEQ ID NO: 101251 - DNA, 37 bp, Artificial Sequence
  Synthetic oligonucleotide
tgaagaggccagaagggaaacggcaaaaggcacggga

SEQ ID NO: 101252 - DNA, 37 bp, Artificial Sequence
  Synthetic oligonucleotide
acttagcggacgcctaatgaatgaacagtgtggtgga

SEQ ID NO: 101253 - DNA, 38 bp, Artificial Sequence
  Synthetic oligonucleotide
tgaccgcacgcgtacgggttgcaactcggctcctatga

SEQ ID NO: 101254 - DNA, 38 bp, Artificial Sequence
  Synthetic oligonucleotide
gtgcccctctcacctgccatactaagagtcgtgactga

SEQ ID NO: 101255 - DNA, 38 bp, Artificial Sequence
  Synthetic oligonucleotide
tctactgccgcccatgtgtgttcttatcaactgggtga

SEQ ID NO: 101256 - DNA, 38 bp, Artificial Sequence
  Synthetic oligonucleotide
gcacggggggctttaacgcaaggcgcgatgaatggtga

SEQ ID NO: 101257 - DNA, 37 bp, Artificial Sequence
  Synthetic oligonucleotide
gttgcccccactgtcatttgtgtgcaaatgtttttga

SEQ ID NO: 101258 - DNA, 36 bp, Artificial Sequence
  Synthetic oligonucleotide
tacgagcggctggctggcctcgtttacttctaccta

SEQ ID NO: 101259 - DNA, 35 bp, Artificial Sequence
  Synthetic oligonucleotide
gacaggacgaggcaagttagtgcgtatgatgttcc

SEQ ID NO: 101260 - DNA, 35 bp, Artificial Sequence
  Synthetic oligonucleotide
acacggggtaggggagtcgcgaaggctggtgacag

SEQ ID NO: 101261 - DNA, 35 bp, Artificial Sequence
  Synthetic oligonucleotide
tacatgacgtttgcctttccctcccgcgatagcag

SEQ ID NO: 101262 - DNA, 35 bp, Artificial Sequence
  Synthetic oligonucleotide
tgagctaggataggatgtaatggagggggagttag

SEQ ID NO: 101263 - DNA, 35 bp, Artificial Sequence
  Synthetic oligonucleotide
agtaacatcggagggcggaatggacaggtggtgcg

SEQ ID NO: 101264 - DNA, 35 bp, Artificial Sequence
  Synthetic oligonucleotide
attgacaccagctgatctctgcctccgagtcccat

SEQ ID NO: 101265 - DNA, 35 bp, Artificial Sequence
  Synthetic oligonucleotide
gccaccccgcccaccatgtgatctcaaactggttt

SEQ ID NO: 101266 - DNA, 36 bp, Artificial Sequence
  Synthetic oligonucleotide
acatgcccctgacgcgccttggcaatcccttgacaa

SEQ ID NO: 101267 - DNA, 35 bp, Artificial Sequence
  Synthetic oligonucleotide
gatcggacccttgctgattcgttctcgtttgtcaa

SEQ ID NO: 101268 - DNA, 36 bp, Artificial Sequence
  Synthetic oligonucleotide
ttccacggcccgcctgttttgccccctgcgatttaa

SEQ ID NO: 101269 - DNA, 35 bp, Artificial Sequence
  Synthetic oligonucleotide
gttgcgctcacaccataatcaattagtgccaaaca

SEQ ID NO: 101270 - DNA, 36 bp, Artificial Sequence
  Synthetic oligonucleotide
gccagggaatgggacccaaggctaggttatattaca

SEQ ID NO: 101271 - DNA, 37 bp, Artificial Sequence
  Synthetic oligonucleotide
tgtggggcttacgtcatggggaacgtttggggtggca

SEQ ID NO: 101272 - DNA, 36 bp, Artificial Sequence
  Synthetic oligonucleotide
gtagcgatgagcgtaatttcagtgaggaagtgtaga

SEQ ID NO: 101273 - DNA, 36 bp, Artificial Sequence
  Synthetic oligonucleotide
ttcgtaccggcaattatttttgctcacagaccccga

SEQ ID NO: 101274 - DNA, 37 bp, Artificial Sequence
  Synthetic oligonucleotide
atgccaagcgcaaccgcattaccgcgtcagaccccga

SEQ ID NO: 101275 - DNA, 37 bp, Artificial Sequence
  Synthetic oligonucleotide
gacacgtagatggcacgctataccacagaagcaggga

SEQ ID NO: 101276 - DNA, 37 bp, Artificial Sequence
  Synthetic oligonucleotide
accacagtgtgaggtgacaatgaggatgagacctgga

SEQ ID NO: 101277 - DNA, 36 bp, Artificial Sequence
  Synthetic oligonucleotide
atgcggggggggtgcacgggggagggcgttgctgga

SEQ ID NO: 101278 - DNA, 38 bp, Artificial Sequence
  Synthetic oligonucleotide
taagcggttagggcgggtgtgagcgcagcaaggaatga

SEQ ID NO: 101279 - DNA, 38 bp, Artificial Sequence
  Synthetic oligonucleotide
gaccaggcggggagagaggtggtacgctgcaattatga

SEQ ID NO: 101280 - DNA, 38 bp, Artificial Sequence
  Synthetic oligonucleotide
atccacgcccaatcgtgatgctagctggtccttcttga

SEQ ID NO: 101281 - DNA, 35 bp, Artificial Sequence
  Synthetic oligonucleotide
gaaccatcccacgcagctccgtgtaccctgtccac

SEQ ID NO: 101282 - DNA, 35 bp, Artificial Sequence
  Synthetic oligonucleotide
ttgcacagcagatccagcccacgatctaagaattc

SEQ ID NO: 101283 - DNA, 35 bp, Artificial Sequence
  Synthetic oligonucleotide
gaagtgagggcagtaggtgcgtaggacagtcatag

SEQ ID NO: 101284 - DNA, 35 bp, Artificial Sequence
  Synthetic oligonucleotide
ccaagcgcaactccacgctactctgaacgtacgcg

SEQ ID NO: 101285 - DNA, 35 bp, Artificial Sequence
  Synthetic oligonucleotide
actgtgaggaacaatgggatgcgagggcgaagggg

SEQ ID NO: 101286 - DNA, 35 bp, Artificial Sequence
  Synthetic oligonucleotide
tatgcaagggactagatgaagaaaaatgaagtggg

SEQ ID NO: 101287 - DNA, 35 bp, Artificial Sequence
  Synthetic oligonucleotide
taggtaggggggaggcaagtccaagtgagacaatg

SEQ ID NO: 101288 - DNA, 35 bp, Artificial Sequence
  Synthetic oligonucleotide
acatccagcagagcagtgtaacgaacgccaattct

SEQ ID NO: 101289 - DNA, 36 bp, Artificial Sequence
  Synthetic oligonucleotide
tagagaggaaggggtggcgagctagaaggagtgtaa

SEQ ID NO: 101290 - DNA, 36 bp, Artificial Sequence
  Synthetic oligonucleotide
gtgcgccacactgtcgtcgtttgctaccctgcccca

SEQ ID NO: 101291 - DNA, 35 bp, Artificial Sequence
  Synthetic oligonucleotide
aacgcaggcaggtggcaggctgtttacgcggaaga

SEQ ID NO: 101292 - DNA, 37 bp, Artificial Sequence
  Synthetic oligonucleotide
gtcgaggagcacagcgacaaagggaccacctgttaga

SEQ ID NO: 101293 - DNA, 34 bp, Artificial Sequence
  Synthetic oligonucleotide
gtgagcgctagcgacctatctgccaccacctcga

SEQ ID NO: 101294 - DNA, 37 bp, Artificial Sequence
  Synthetic oligonucleotide
gtgcacacacgcatgagaagacgatgaactgtttcga

SEQ ID NO: 101295 - DNA, 37 bp, Artificial Sequence
  Synthetic oligonucleotide
gcgtaggggagatgtagtagaaagtagtgtagtgtga

SEQ ID NO: 101296 - DNA, 36 bp, Artificial Sequence
  Synthetic oligonucleotide
tacgccacgtagaggggcaaacatcaaggcatacta

SEQ ID NO: 101297 - DNA, 35 bp, Artificial Sequence
  Synthetic oligonucleotide
tgtacgactacagccctttctcctgcatttgcgac

SEQ ID NO: 101298 - DNA, 35 bp, Artificial Sequence
  Synthetic oligonucleotide
aacttccgtcggtactgcttgccaatctctctgac

SEQ ID NO: 101299 - DNA, 35 bp, Artificial Sequence
  Synthetic oligonucleotide
acacctggtccaacactgactttcgcttgtcctgc

SEQ ID NO: 101300 - DNA, 35 bp, Artificial Sequence
  Synthetic oligonucleotide
gccaaggcgaatcattgaggtgggaggatagcatg

SEQ ID NO: 101301 - DNA, 35 bp, Artificial Sequence
  Synthetic oligonucleotide
gtcacggtgttccctcttcgtcttcgacgccattg

SEQ ID NO: 101302 - DNA, 35 bp, Artificial Sequence
  Synthetic oligonucleotide
gtgacaccgacgacgctgaggaacatggcttttct

SEQ ID NO: 101303 - DNA, 35 bp, Artificial Sequence
  Synthetic oligonucleotide
tacaacgcactttcccccgctggagacaccccgtt

SEQ ID NO: 101304 - DNA, 35 bp, Artificial Sequence
  Synthetic oligonucleotide
gacaaggggagttactacaaaggcgtggaatgttt

SEQ ID NO: 101305 - DNA, 36 bp, Artificial Sequence
  Synthetic oligonucleotide
gaagtgcgcaatcagtaaagcgcaagctaccaccaa

SEQ ID NO: 101306 - DNA, 36 bp, Artificial Sequence
  Synthetic oligonucleotide
gccgccgtgcacagtctgtgtcctcaggtactatca

SEQ ID NO: 101307 - DNA, 38 bp, Artificial Sequence
  Synthetic oligonucleotide
gtgtgcggagataggcaatcggaaagtagtgtgaaaga

SEQ ID NO: 101308 - DNA, 37 bp, Artificial Sequence
  Synthetic oligonucleotide
gatgcaaggtgcgcgtgtccagaagagcacgcaacga

SEQ ID NO: 101309 - DNA, 37 bp, Artificial Sequence
  Synthetic oligonucleotide
gaacagactggtggcggtggtgaaggtcgtcgaagga

SEQ ID NO: 101310 - DNA, 36 bp, Artificial Sequence
  Synthetic oligonucleotide
tacgcgcatgatgtactaactgtggtatgctgggga

SEQ ID NO: 101311 - DNA, 38 bp, Artificial Sequence
  Synthetic oligonucleotide
acacgcgcatggaaggtgggcccaaggagccagcatga

SEQ ID NO: 101312 - DNA, 38 bp, Artificial Sequence
  Synthetic oligonucleotide
atgtacgtgcagaacggtacatagaggacagggattga

SEQ ID NO: 101313 - DNA, 38 bp, Artificial Sequence
  Synthetic oligonucleotide
tcaacccgacccagagtgtgaacgccagtcgatcttga

SEQ ID NO: 101314 - DNA, 36 bp, Artificial Sequence
  Synthetic oligonucleotide
gacggacaccgcctgtttacgtttcgccccgctata

SEQ ID NO: 101315 - DNA, 36 bp, Artificial Sequence
  Synthetic oligonucleotide
tgaaccgtagaagcccgaactgtttagtgatgcgta

SEQ ID NO: 101316 - DNA, 35 bp, Artificial Sequence
  Synthetic oligonucleotide
gtgacgctaacaacccccgttccgtccacttgaac

SEQ ID NO: 101317 - DNA, 35 bp, Artificial Sequence
  Synthetic oligonucleotide
atgacacgctcaatgaaactgtaccgcctcacgac

SEQ ID NO: 101318 - DNA, 35 bp, Artificial Sequence
  Synthetic oligonucleotide
tgattagggccacgtttaccgcaacatgtctctcc

SEQ ID NO: 101319 - DNA, 35 bp, Artificial Sequence
  Synthetic oligonucleotide
atcattgcagaccattactatcggtgactgacatc

SEQ ID NO: 101320 - DNA, 35 bp, Artificial Sequence
  Synthetic oligonucleotide
tacgacgaaacctgtcgcatagagacctaactcag

SEQ ID NO: 101321 - DNA, 35 bp, Artificial Sequence
  Synthetic oligonucleotide
ggaacaagagaggggtatagataattggaagggag

SEQ ID NO: 101322 - DNA, 35 bp, Artificial Sequence
  Synthetic oligonucleotide
acatctgcctcagctcttacgttctgttccgttaa

SEQ ID NO: 101323 - DNA, 36 bp, Artificial Sequence
  Synthetic oligonucleotide
taccaccacacaactgtgcattacttcacctcctca

SEQ ID NO: 101324 - DNA, 37 bp, Artificial Sequence
  Synthetic oligonucleotide
ttagctgcagacagcacggtgattggcgcagatacga

SEQ ID NO: 101325 - DNA, 37 bp, Artificial Sequence
  Synthetic oligonucleotide
tacgaaggatcgtcggggtgagattgaaggggaggga

SEQ ID NO: 101326 - DNA, 37 bp, Artificial Sequence
  Synthetic oligonucleotide
acgaagctgaggtggggtgaggtgagagtggaaatga

SEQ ID NO: 101327 - DNA, 38 bp, Artificial Sequence
  Synthetic oligonucleotide
ttgacacaccacatgactatagcgtacaacctctctga

SEQ ID NO: 101328 - DNA, 36 bp, Artificial Sequence
  Synthetic oligonucleotide
gagacaagtgagaggtgagggcggcatgggtagtga

SEQ ID NO: 101329 - DNA, 36 bp, Artificial Sequence
  Synthetic oligonucleotide
tcagacgtaagggcaatggaagatcgcaacacgtga

SEQ ID NO: 101330 - DNA, 38 bp, Artificial Sequence
  Synthetic oligonucleotide
attcccatcctctacgtgagctggtccttatcttgtga

SEQ ID NO: 101331 - DNA, 38 bp, Artificial Sequence
  Synthetic oligonucleotide
acgcgagccatctttgcgtcctaagccgtcaaacttga

SEQ ID NO: 101332 - DNA, 38 bp, Artificial Sequence
  Synthetic oligonucleotide
atgctggccccccgcccgttactattacttcttcttga

SEQ ID NO: 101333 - DNA, 36 bp, Artificial Sequence
  Synthetic oligonucleotide
acacgccaatagtgtggaacactctgctccctttga

SEQ ID NO: 101334 - DNA, 35 bp, Artificial Sequence
  Synthetic oligonucleotide
gatcacgtagaggcataagtccaaagctagagagc

SEQ ID NO: 101335 - DNA, 35 bp, Artificial Sequence
  Synthetic oligonucleotide
aacgttcgcaccgagccttgtagtgtaggatctag

SEQ ID NO: 101336 - DNA, 36 bp, Artificial Sequence
  Synthetic oligonucleotide
atacgcaagtgagggatcgtttagggagagtccggg

SEQ ID NO: 101337 - DNA, 35 bp, Artificial Sequence
  Synthetic oligonucleotide
ttaacgcacgacagagtcaaccttccatccttggg

SEQ ID NO: 101338 - DNA, 35 bp, Artificial Sequence
  Synthetic oligonucleotide
accctgacctagccttttatggaaccgccctactg

SEQ ID NO: 101339 - DNA, 35 bp, Artificial Sequence
  Synthetic oligonucleotide
tcacagcaaaccatccgtctttagtcgagaatctg

SEQ ID NO: 101340 - DNA, 35 bp, Artificial Sequence
  Synthetic oligonucleotide
atcgcacgtcgacctgtccctgtccttccacgaat

SEQ ID NO: 101341 - DNA, 35 bp, Artificial Sequence
  Synthetic oligonucleotide
gcaggcctcaacagcaggcctggaatgaccactat

SEQ ID NO: 101342 - DNA, 35 bp, Artificial Sequence
  Synthetic oligonucleotide
tccgcctcaaggccagggcttatttaacactgttt

SEQ ID NO: 101343 - DNA, 36 bp, Artificial Sequence
  Synthetic oligonucleotide
aacaccagtgagtttatgggggaattgtacgtataa

SEQ ID NO: 101344 - DNA, 36 bp, Artificial Sequence
  Synthetic oligonucleotide
atgacgcaaaggacggaaaccgagggaggcataaca

SEQ ID NO: 101345 - DNA, 36 bp, Artificial Sequence
  Synthetic oligonucleotide
tgtccggccccacctgtctcctgtcacataccacca

SEQ ID NO: 101346 - DNA, 35 bp, Artificial Sequence
  Synthetic oligonucleotide
gcatattcggtccgagcttagcgttcacctaccca

SEQ ID NO: 101347 - DNA, 36 bp, Artificial Sequence
  Synthetic oligonucleotide
gtgacacacccagatgcagagttagcgcgctagtca

SEQ ID NO: 101348 - DNA, 36 bp, Artificial Sequence
  Synthetic oligonucleotide
gatgagtgaagtgtagaggggcaggaaacgcgtcga

SEQ ID NO: 101349 - DNA, 37 bp, Artificial Sequence
  Synthetic oligonucleotide
gagacaggttagcctgaactaggtgacatggatggga

SEQ ID NO: 101350 - DNA, 37 bp, Artificial Sequence
  Synthetic oligonucleotide
tacgagaagcgagctggagttgcattaatgtgaatga

SEQ ID NO: 101351 - DNA, 37 bp, Artificial Sequence
  Synthetic oligonucleotide
atgcgacgacgaaagtggcaaagtaaaacttaactga

SEQ ID NO: 101352 - DNA, 37 bp, Artificial Sequence
  Synthetic oligonucleotide
tatgggggcgcacgggtgggctccagtagacgattga

SEQ ID NO: 101353 - DNA, 35 bp, Artificial Sequence
  Synthetic oligonucleotide
atgcaaaagtgtgcagaatgtctctgtttttcgta

SEQ ID NO: 101354 - DNA, 36 bp, Artificial Sequence
  Synthetic oligonucleotide
gctaggggcggaggacaaaaacctgggacagcatta

SEQ ID NO: 101355 - DNA, 35 bp, Artificial Sequence
  Synthetic oligonucleotide
tacccactgtgtctgccttaactcacggagcttac

SEQ ID NO: 101356 - DNA, 34 bp, Artificial Sequence
  Synthetic oligonucleotide
aactgtcccgccggccttcttgagtgcccccttc

SEQ ID NO: 101357 - DNA, 35 bp, Artificial Sequence
  Synthetic oligonucleotide
tgggatgtgcccgggtacacttcagtaccttaaat

SEQ ID NO: 101358 - DNA, 35 bp, Artificial Sequence
  Synthetic oligonucleotide
gctacgggtgggcgccctaggaccttcatttgact

SEQ ID NO: 101359 - DNA, 35 bp, Artificial Sequence
  Synthetic oligonucleotide
tctgacctagggtaacagcaggtcttctatttgct

SEQ ID NO: 101360 - DNA, 35 bp, Artificial Sequence
  Synthetic oligonucleotide
gcaatgagggaaacgcgaagagacgaggccacggt

SEQ ID NO: 101361 - DNA, 36 bp, Artificial Sequence
  Synthetic oligonucleotide
acacagggcaggagcatgaagcgggatgattaatgt

SEQ ID NO: 101362 - DNA, 35 bp, Artificial Sequence
  Synthetic oligonucleotide
actcacgcccacgaacgtctgatcttcaccggatt

SEQ ID NO: 101363 - DNA, 36 bp, Artificial Sequence
  Synthetic oligonucleotide
gtgtccccgtgcccttcccacatgagcttggtctaa

SEQ ID NO: 101364 - DNA, 36 bp, Artificial Sequence
  Synthetic oligonucleotide
gtgcggtgcctaaatctgtcatctcgcaggagtcca

SEQ ID NO: 101365 - DNA, 36 bp, Artificial Sequence
  Synthetic oligonucleotide
tgcgactgctcgccgtccaatgctaccccgctctca

SEQ ID NO: 101366 - DNA, 35 bp, Artificial Sequence
  Synthetic oligonucleotide
gctgactgccgttcaaagggttctcacacctgtca

SEQ ID NO: 101367 - DNA, 37 bp, Artificial Sequence
  Synthetic oligonucleotide
gacgcggcgaaggtacggggagttcatgtgtactgga

SEQ ID NO: 101368 - DNA, 38 bp, Artificial Sequence
  Synthetic oligonucleotide
gactcacggatgcgataaaaagtcaggtctttagatga

SEQ ID NO: 101369 - DNA, 38 bp, Artificial Sequence
  Synthetic oligonucleotide
taacacgcaacctgttacttaccttgtcacttaagtga

SEQ ID NO: 101370 - DNA, 37 bp, Artificial Sequence
  Synthetic oligonucleotide
gcgccgagcacgttgtgttgtcaaactcgcgggttga

SEQ ID NO: 101371 - DNA, 36 bp, Artificial Sequence
  Synthetic oligonucleotide
taccaccacagatgggtgaaaattggccacccttta

SEQ ID NO: 101372 - DNA, 35 bp, Artificial Sequence
  Synthetic oligonucleotide
ttgggcctcgcgagttgttcctctgtgattcgaac

SEQ ID NO: 101373 - DNA, 35 bp, Artificial Sequence
  Synthetic oligonucleotide
gtgcactactgctttgccaccatcctgtgactccc

SEQ ID NO: 101374 - DNA, 35 bp, Artificial Sequence
  Synthetic oligonucleotide
ttgtcagtcgcagcactgcctttccctgtttgtcc

SEQ ID NO: 101375 - DNA, 35 bp, Artificial Sequence
  Synthetic oligonucleotide
gagggcggtaatgggagtaatgtggcgcgtgatgc

SEQ ID NO: 101376 - DNA, 35 bp, Artificial Sequence
  Synthetic oligonucleotide
tgaggggccagaaaggagaagagttaatcgtacag

SEQ ID NO: 101377 - DNA, 35 bp, Artificial Sequence
  Synthetic oligonucleotide
gaacagccgagtggaatggattgaaggcgtttcgg

SEQ ID NO: 101378 - DNA, 35 bp, Artificial Sequence
  Synthetic oligonucleotide
tctgtactgcgcctggaagaaacgagggaggggtg

SEQ ID NO: 101379 - DNA, 35 bp, Artificial Sequence
  Synthetic oligonucleotide
gacgaatactgactgcgcacactatgggtctccct

SEQ ID NO: 101380 - DNA, 35 bp, Artificial Sequence
  Synthetic oligonucleotide
aacatgcgacggcggaagaggagaacgtcgctatt

SEQ ID NO: 101381 - DNA, 35 bp, Artificial Sequence
  Synthetic oligonucleotide
gtcaagagggagggcagaatcaacgttgcttacaa

SEQ ID NO: 101382 - DNA, 36 bp, Artificial Sequence
  Synthetic oligonucleotide
agcaccaccattccgttaagcaacagatgagcctca

SEQ ID NO: 101383 - DNA, 37 bp, Artificial Sequence
  Synthetic oligonucleotide
tgatgcatagtcgacttgcaggggggacggaggtaga

SEQ ID NO: 101384 - DNA, 36 bp, Artificial Sequence
  Synthetic oligonucleotide
gcgtggaccgtggcgggtaaaggaggttggtggcga

SEQ ID NO: 101385 - DNA, 38 bp, Artificial Sequence
  Synthetic oligonucleotide
agagtcagaggtgggcggtgaaagactccggtgaatga

SEQ ID NO: 101386 - DNA, 38 bp, Artificial Sequence
  Synthetic oligonucleotide
tgcgggggggggcgaagatgatgaaggggcgatcgtga

SEQ ID NO: 101387 - DNA, 38 bp, Artificial Sequence
  Synthetic oligonucleotide
agacatgagggaggtgattaaggaagaggatagggtga

SEQ ID NO: 101388 - DNA, 36 bp, Artificial Sequence
  Synthetic oligonucleotide
attcacgcgcctccttgtccgtgactcgacctttga

SEQ ID NO: 101389 - DNA, 38 bp, Artificial Sequence
  Synthetic oligonucleotide
gaacacgacgcccatcgtgctatatacttcatttttga

SEQ ID NO: 101390 - DNA, 36 bp, Artificial Sequence
  Synthetic oligonucleotide
gaacagagcgctcaggtatgtaaggtactcgggata

SEQ ID NO: 101391 - DNA, 36 bp, Artificial Sequence
  Synthetic oligonucleotide
gtggggcacatctcagcgcgtcaccatacccagcta

SEQ ID NO: 101392 - DNA, 35 bp, Artificial Sequence
  Synthetic oligonucleotide
tatgtcgccgagggttgtgttgtttcacgttatta

SEQ ID NO: 101393 - DNA, 34 bp, Artificial Sequence
  Synthetic oligonucleotide
tacagcaccgacctccctcttccgtgtcgtaaac

SEQ ID NO: 101394 - DNA, 35 bp, Artificial Sequence
  Synthetic oligonucleotide
agcgctcgccacctcgacccagccaaagcttttac

SEQ ID NO: 101395 - DNA, 35 bp, Artificial Sequence
  Synthetic oligonucleotide
tacacgcgcaacacagtcttatacgccggaaccgc

SEQ ID NO: 101396 - DNA, 35 bp, Artificial Sequence
  Synthetic oligonucleotide
tgacgaggagggattacgtggcgaagagggtttgc

SEQ ID NO: 101397 - DNA, 35 bp, Artificial Sequence
  Synthetic oligonucleotide
gatgcgtacaaagcgttaatccagcacacagactc

SEQ ID NO: 101398 - DNA, 35 bp, Artificial Sequence
  Synthetic oligonucleotide
gatggcggggaggtggcgaattaagaatcttggag

SEQ ID NO: 101399 - DNA, 35 bp, Artificial Sequence
  Synthetic oligonucleotide
ttcagcgcaccttctaccactatcggctatttgag

SEQ ID NO: 101400 - DNA, 35 bp, Artificial Sequence
  Synthetic oligonucleotide
acaccacatccgacgctgatagagcactgatcggg

SEQ ID NO: 101401 - DNA, 35 bp, Artificial Sequence
  Synthetic oligonucleotide
ttcgaggtcgcccctactacgtcgtgtttcctgtg

SEQ ID NO: 101402 - DNA, 35 bp, Artificial Sequence
  Synthetic oligonucleotide
gtgaccgagccgagttgtaaagccacctagtgaat

SEQ ID NO: 101403 - DNA, 35 bp, Artificial Sequence
  Synthetic oligonucleotide
tccgatcgctacctttgcttggggactcactatat

SEQ ID NO: 101404 - DNA, 35 bp, Artificial Sequence
  Synthetic oligonucleotide
aaccacccgtctgcgaactgatctaggtcccgtct

SEQ ID NO: 101405 - DNA, 35 bp, Artificial Sequence
  Synthetic oligonucleotide
taggtgggggcggacatagtaggcgtgcagaaagt

SEQ ID NO: 101406 - DNA, 35 bp, Artificial Sequence
  Synthetic oligonucleotide
aacatacctagtcgggcccgcactccagaattctt

SEQ ID NO: 101407 - DNA, 35 bp, Artificial Sequence
  Synthetic oligonucleotide
atccccgccaatgtgattcgttacattctggcgtt

SEQ ID NO: 101408 - DNA, 36 bp, Artificial Sequence
  Synthetic oligonucleotide
gagacaggcctcggcttccgtgtttagcctccgaaa

SEQ ID NO: 101409 - DNA, 36 bp, Artificial Sequence
  Synthetic oligonucleotide
gacaccacacttccttatcatggacgtttttgccaa

SEQ ID NO: 101410 - DNA, 36 bp, Artificial Sequence
  Synthetic oligonucleotide
tcaccactcgtatcattgcgttatcataaatgtcaa

SEQ ID NO: 101411 - DNA, 35 bp, Artificial Sequence
  Synthetic oligonucleotide
ttgccccgacgccgagaatgagtccgcgtgcttca

SEQ ID NO: 101412 - DNA, 36 bp, Artificial Sequence
  Synthetic oligonucleotide
gtggacactgcagcatgacagtgggggtaggtaaga

SEQ ID NO: 101413 - DNA, 37 bp, Artificial Sequence
  Synthetic oligonucleotide
acacctgcattgcattcgaggccttacaccacccaga

SEQ ID NO: 101414 - DNA, 37 bp, Artificial Sequence
  Synthetic oligonucleotide
gctggtcgagagggagggggtacatcagcgggggaga

SEQ ID NO: 101415 - DNA, 36 bp, Artificial Sequence
  Synthetic oligonucleotide
gacatctcaaagcagtgacgacgctccatacaccga

SEQ ID NO: 101416 - DNA, 38 bp, Artificial Sequence
  Synthetic oligonucleotide
gacacggggaaggaggtgtgaagatgggatagccatga

SEQ ID NO: 101417 - DNA, 38 bp, Artificial Sequence
  Synthetic oligonucleotide
tgtgggttcataaggcgggagccgcgttcctttcatga

SEQ ID NO: 101418 - DNA, 38 bp, Artificial Sequence
  Synthetic oligonucleotide
tatgcaaccgcatccaaggtgtggaaagtagccggtga

SEQ ID NO: 101419 - DNA, 35 bp, Artificial Sequence
  Synthetic oligonucleotide
gagccactctgacttgttccacattgccactccta

SEQ ID NO: 101420 - DNA, 35 bp, Artificial Sequence
  Synthetic oligonucleotide
taacacgtcggagccagtttccattctgcctttac

SEQ ID NO: 101421 - DNA, 35 bp, Artificial Sequence
  Synthetic oligonucleotide
agccattcgccactccgcatccagaccttgacccc

SEQ ID NO: 101422 - DNA, 35 bp, Artificial Sequence
  Synthetic oligonucleotide
gcagatcaggcctcgaccccacgcccaagtctctc

SEQ ID NO: 101423 - DNA, 35 bp, Artificial Sequence
  Synthetic oligonucleotide
aaacaagcgtggagcatgtggtcgctgcatttgtc

SEQ ID NO: 101424 - DNA, 35 bp, Artificial Sequence
  Synthetic oligonucleotide
gacccagagcaggtcaatacgacggaccatttttc

SEQ ID NO: 101425 - DNA, 35 bp, Artificial Sequence
  Synthetic oligonucleotide
acatgcccctctggctgatttattacctggcccag

SEQ ID NO: 101426 - DNA, 35 bp, Artificial Sequence
  Synthetic oligonucleotide
tacgaccgggacaaaatgcatagtagtagtgcccg

SEQ ID NO: 101427 - DNA, 35 bp, Artificial Sequence
  Synthetic oligonucleotide
tttgctgtccctcctcacttcgtgtcagtcacaat

SEQ ID NO: 101428 - DNA, 35 bp, Artificial Sequence
  Synthetic oligonucleotide
tcgcccctccatattattgctctcatccgggtgct

SEQ ID NO: 101429 - DNA, 35 bp, Artificial Sequence
  Synthetic oligonucleotide
gcgaacgcacaagcagttctagacaccatcccatt

SEQ ID NO: 101430 - DNA, 35 bp, Artificial Sequence
  Synthetic oligonucleotide
gtgccaaacacctgccataattactgacgctgctt

SEQ ID NO: 101431 - DNA, 35 bp, Artificial Sequence
  Synthetic oligonucleotide
gacttgacatacgtaggggaaggcgggatcgaaaa

SEQ ID NO: 101432 - DNA, 35 bp, Artificial Sequence
  Synthetic oligonucleotide
aaccgccataacatatgtagtactctgcctcccaa

SEQ ID NO: 101433 - DNA, 37 bp, Artificial Sequence
  Synthetic oligonucleotide
gacgaaggcaagggaaggaaatggtgggggctaaaga

SEQ ID NO: 101434 - DNA, 37 bp, Artificial Sequence
  Synthetic oligonucleotide
actgcggtctcacgcaccaaatgacatctctcggcga

SEQ ID NO: 101435 - DNA, 37 bp, Artificial Sequence
  Synthetic oligonucleotide
tccaacacatcaggacgcatttagcctgcgctgtcga

SEQ ID NO: 101436 - DNA, 38 bp, Artificial Sequence
  Synthetic oligonucleotide
gcaccaccccatagccacgcttacgcagtatgtcctga

SEQ ID NO: 101437 - DNA, 36 bp, Artificial Sequence
  Synthetic oligonucleotide
gtgccatgcgtaggggtacgaacgaatgtggaacta

SEQ ID NO: 101438 - DNA, 36 bp, Artificial Sequence
  Synthetic oligonucleotide
gagggccggtgtggtataccgccaagtcccacctta

SEQ ID NO: 101439 - DNA, 35 bp, Artificial Sequence
  Synthetic oligonucleotide
ggggaccacggatggctttttaacggtctcatagc

SEQ ID NO: 101440 - DNA, 35 bp, Artificial Sequence
  Synthetic oligonucleotide
tgagccataccgaactgttcgcactgatacgcctc

SEQ ID NO: 101441 - DNA, 35 bp, Artificial Sequence
  Synthetic oligonucleotide
tgagaaggcccatgtcgggaggaaaggctttgtcg

SEQ ID NO: 101442 - DNA, 35 bp, Artificial Sequence
  Synthetic oligonucleotide
tttgccgtaccctcgcaacttttgtccatcccatg

SEQ ID NO: 101443 - DNA, 35 bp, Artificial Sequence
  Synthetic oligonucleotide
tgacaaccggtccgataaggacatacggccgactt

SEQ ID NO: 101444 - DNA, 36 bp, Artificial Sequence
  Synthetic oligonucleotide
gaaacaacagttagtgcaggagctagtgtcacacaa

SEQ ID NO: 101445 - DNA, 35 bp, Artificial Sequence
  Synthetic oligonucleotide
tgccaagggcctacttttgtcttcactcttcgcaa

SEQ ID NO: 101446 - DNA, 36 bp, Artificial Sequence
  Synthetic oligonucleotide
tccctcgcagcctaaccgaaggttctcgatctctaa

SEQ ID NO: 101447 - DNA, 37 bp, Artificial Sequence
  Synthetic oligonucleotide
taacagccgcaccccccctgtattcagctccatccca

SEQ ID NO: 101448 - DNA, 36 bp, Artificial Sequence
  Synthetic oligonucleotide
acaaccagggacgtgggaaacggagttggtcttgca

SEQ ID NO: 101449 - DNA, 36 bp, Artificial Sequence
  Synthetic oligonucleotide
acgtgccgttattccaccatgatcgtcccacctcga

SEQ ID NO: 101450 - DNA, 37 bp, Artificial Sequence
  Synthetic oligonucleotide
acacacgtacggtagccggggagtccaacagtacgga

SEQ ID NO: 101451 - DNA, 37 bp, Artificial Sequence
  Synthetic oligonucleotide
atcgacaccccttcattgatactccctctcactagta

SEQ ID NO: 101452 - DNA, 35 bp, Artificial Sequence
  Synthetic oligonucleotide
gtacgccgtacgtacacgagtgagtacccatctcg

SEQ ID NO: 101453 - DNA, 35 bp, Artificial Sequence
  Synthetic oligonucleotide
gctgacggatgcagaaacactgagggaggaatggg

SEQ ID NO: 101454 - DNA, 35 bp, Artificial Sequence
  Synthetic oligonucleotide
tagacgactggaagcacaccgaagatagtcattgt

SEQ ID NO: 101455 - DNA, 35 bp, Artificial Sequence
  Synthetic oligonucleotide
gcgaaccctatgcctcatacgttaaatcaccactt

SEQ ID NO: 101456 - DNA, 35 bp, Artificial Sequence
  Synthetic oligonucleotide
ttacagcccagatcgccttgctttccaggcctgtt

SEQ ID NO: 101457 - DNA, 36 bp, Artificial Sequence
  Synthetic oligonucleotide
gaagacgagggtacaaaagtgtgaaagttggggaaa

SEQ ID NO: 101458 - DNA, 36 bp, Artificial Sequence
  Synthetic oligonucleotide
tccgacaccacgctgaatggcaaagctaactaccaa

SEQ ID NO: 101459 - DNA, 36 bp, Artificial Sequence
  Synthetic oligonucleotide
gcatccgtccaccatccgcccggccagtccgtttaa

SEQ ID NO: 101460 - DNA, 34 bp, Artificial Sequence
  Synthetic oligonucleotide
aaacaccacttttgccattagacagtcggtgaca

SEQ ID NO: 101461 - DNA, 37 bp, Artificial Sequence
  Synthetic oligonucleotide
tcacacactgcgatttggcatgtggcttttgaaacga

SEQ ID NO: 101462 - DNA, 36 bp, Artificial Sequence
  Synthetic oligonucleotide
gcatcgcaacaggcctatgtgacgcgtggtatccga

SEQ ID NO: 101463 - DNA, 37 bp, Artificial Sequence
  Synthetic oligonucleotide
atgtccctcggcatacggtctcaagtctctcattgga

SEQ ID NO: 101464 - DNA, 38 bp, Artificial Sequence
  Synthetic oligonucleotide
aacccgggtggaccgtgggggagaaattgaaatgatga

SEQ ID NO: 101465 - DNA, 37 bp, Artificial Sequence
  Synthetic oligonucleotide
atcgcattccgtccacatgacgcccgacaagcactga

SEQ ID NO: 101466 - DNA, 38 bp, Artificial Sequence
  Synthetic oligonucleotide
tcacgtccatcgggtgtatcattatgggaaacctctga

SEQ ID NO: 101467 - DNA, 38 bp, Artificial Sequence
  Synthetic oligonucleotide
gcaggagagagccaatgaaattggtgtaggcggagtga

SEQ ID NO: 101468 - DNA, 37 bp, Artificial Sequence
  Synthetic oligonucleotide
gatgggagccagacatgcgaggaggaagccaaggtga

SEQ ID NO: 101469 - DNA, 35 bp, Artificial Sequence
  Synthetic oligonucleotide
tcccaactgattcgtctgatccttgtgggaacata

SEQ ID NO: 101470 - DNA, 36 bp, Artificial Sequence
  Synthetic oligonucleotide
gtggaatgcgtgatgtgacagagggaagaagacata

SEQ ID NO: 101471 - DNA, 36 bp, Artificial Sequence
  Synthetic oligonucleotide
gaagagtacgtggaaagggccatggatggaaagtta

SEQ ID NO: 101472 - DNA, 36 bp, Artificial Sequence
  Synthetic oligonucleotide
gactcgcaacgcaattatgtaccctggaccctttta

SEQ ID NO: 101473 - DNA, 35 bp, Artificial Sequence
  Synthetic oligonucleotide
agtgtgcaccccctgaccgcagtgacagcccctac

SEQ ID NO: 101474 - DNA, 35 bp, Artificial Sequence
  Synthetic oligonucleotide
ggaacgtgggaacagtcgggtggaagacactggag

SEQ ID NO: 101475 - DNA, 36 bp, Artificial Sequence
  Synthetic oligonucleotide
gtgacgaagtctattacatcctttgcccccttagcg

SEQ ID NO: 101476 - DNA, 35 bp, Artificial Sequence
  Synthetic oligonucleotide
gaccaccgcacgtgtaggcaccgtggatagaacat

SEQ ID NO: 101477 - DNA, 36 bp, Artificial Sequence
  Synthetic oligonucleotide
gaccgatccgcctccattagctcgctgtatcctaaa

SEQ ID NO: 101478 - DNA, 36 bp, Artificial Sequence
  Synthetic oligonucleotide
gccgcaccccccgtctcatctcctttagccagtaaa

SEQ ID NO: 101479 - DNA, 36 bp, Artificial Sequence
  Synthetic oligonucleotide
attggacgggaaatattaggggaggaagaagtacaa

SEQ ID NO: 101480 - DNA, 36 bp, Artificial Sequence
  Synthetic oligonucleotide
atcatgtccgacgctttggctagtttacttttacaa

SEQ ID NO: 101481 - DNA, 36 bp, Artificial Sequence
  Synthetic oligonucleotide
tgatagacggcagaatataggaagtttcgatggcaa

SEQ ID NO: 101482 - DNA, 37 bp, Artificial Sequence
  Synthetic oligonucleotide
actgaggtacgtacgtgatgagaaacaaagaaaccga

SEQ ID NO: 101483 - DNA, 38 bp, Artificial Sequence
  Synthetic oligonucleotide
tcatgagccatgaactgtggaaaagtcaagcagagtga

SEQ ID NO: 101484 - DNA, 37 bp, Artificial Sequence
  Synthetic oligonucleotide
tcaaactgccgcacgttgcgaaatatatactacgtga

SEQ ID NO: 101485 - DNA, 38 bp, Artificial Sequence
  Synthetic oligonucleotide
gtacgggggaggatgggaacgagggagtacaccgttga

SEQ ID NO: 101486 - DNA, 36 bp, Artificial Sequence
  Synthetic oligonucleotide
tgtcaccccagtccgcatactaagcgctgcaattta

SEQ ID NO: 101487 - DNA, 35 bp, Artificial Sequence
  Synthetic oligonucleotide
tacaccaccaatcacggacagacagcagggcttag

SEQ ID NO: 101488 - DNA, 35 bp, Artificial Sequence
  Synthetic oligonucleotide
acctgcgacggctgaagctaataggtcaacgtggg

SEQ ID NO: 101489 - DNA, 35 bp, Artificial Sequence
  Synthetic oligonucleotide
atgcaccaggctgaggatgattctgaaattgaatg

SEQ ID NO: 101490 - DNA, 35 bp, Artificial Sequence
  Synthetic oligonucleotide
gagagaacgcaaactgtgcggaaacaacatacatg

SEQ ID NO: 101491 - DNA, 36 bp, Artificial Sequence
  Synthetic oligonucleotide
tgtgtgtcgagaaaggagggtagaaaaggtccataa

SEQ ID NO: 101492 - DNA, 36 bp, Artificial Sequence
  Synthetic oligonucleotide
gatcccgacgaaccgtcgacatgacctgacccctaa

SEQ ID NO: 101493 - DNA, 35 bp, Artificial Sequence
  Synthetic oligonucleotide
accccattccgcccgatagttctaaggatttctaa

SEQ ID NO: 101494 - DNA, 36 bp, Artificial Sequence
  Synthetic oligonucleotide
gcccacgtaagatgagcttgcgtaatcgagttgtaa

SEQ ID NO: 101495 - DNA, 36 bp, Artificial Sequence
  Synthetic oligonucleotide
gtgctatgccccagttagcctttttgttctcgttaa

SEQ ID NO: 101496 - DNA, 36 bp, Artificial Sequence
  Synthetic oligonucleotide
acgatgagctctgcacgttcacttcccctgttttaa

SEQ ID NO: 101497 - DNA, 36 bp, Artificial Sequence
  Synthetic oligonucleotide
tgcaccacctggacatgcttgacaccgccgacccca

SEQ ID NO: 101498 - DNA, 36 bp, Artificial Sequence
  Synthetic oligonucleotide
gatgaggggggaagtgtcaaagctcctgggggaaga

SEQ ID NO: 101499 - DNA, 37 bp, Artificial Sequence
  Synthetic oligonucleotide
ttgccacgcagcatttactcgatccgcctgggagaga

SEQ ID NO: 101500 - DNA, 36 bp, Artificial Sequence
  Synthetic oligonucleotide
gccttgcccagttatgccttagttacaccagttcga

SEQ ID NO: 101501 - DNA, 37 bp, Artificial Sequence
  Synthetic oligonucleotide
agcacgaaagtgcgccgtactgctaagtgtaagcgga

SEQ ID NO: 101502 - DNA, 37 bp, Artificial Sequence
  Synthetic oligonucleotide
gaatgagggtgagatcgatggatgacgtcgagaggga

SEQ ID NO: 101503 - DNA, 38 bp, Artificial Sequence
  Synthetic oligonucleotide
gaagacacaatgcatgaaaaagggatcagttgaactga

SEQ ID NO: 101504 - DNA, 38 bp, Artificial Sequence
  Synthetic oligonucleotide
gaacgcactcacgcctttcgctccatcagcttgcctga

SEQ ID NO: 101505 - DNA, 37 bp, Artificial Sequence
  Synthetic oligonucleotide
tcacaaggccggagtgtgggcggacgggttactctga

SEQ ID NO: 101506 - DNA, 38 bp, Artificial Sequence
  Synthetic oligonucleotide
aatgtggaggtgaggttgagacggtgactgtgaagtga

SEQ ID NO: 101507 - DNA, 38 bp, Artificial Sequence
  Synthetic oligonucleotide
atgtgacctagccgtagcattgaatggggcggtcgtga

SEQ ID NO: 101508 - DNA, 38 bp, Artificial Sequence
  Synthetic oligonucleotide
acacaggcacaagcgggtggaacagcaggcctacttga

SEQ ID NO: 101509 - DNA, 37 bp, Artificial Sequence
  Synthetic oligonucleotide
tatgccggcggagagaccttatacacgtcggttttga

SEQ ID NO: 101510 - DNA, 35 bp, Artificial Sequence
  Synthetic oligonucleotide
tacagcccttatcccgtctacatcttggcttggac

SEQ ID NO: 101511 - DNA, 35 bp, Artificial Sequence
  Synthetic oligonucleotide
aagcacgaactctcctgatccagcccaacgttgac

SEQ ID NO: 101512 - DNA, 35 bp, Artificial Sequence
  Synthetic oligonucleotide
acatcgccaataagatgtttctttcgttcaccatc

SEQ ID NO: 101513 - DNA, 34 bp, Artificial Sequence
  Synthetic oligonucleotide
gtcacgccttgcccacacacgattgtaccacctc

SEQ ID NO: 101514 - DNA, 35 bp, Artificial Sequence
  Synthetic oligonucleotide
aaaggtggtgggggaggagggaccaggggataaag

SEQ ID NO: 101515 - DNA, 35 bp, Artificial Sequence
  Synthetic oligonucleotide
gatgaagaggccgaatacaggaaagacgagctgag

SEQ ID NO: 101516 - DNA, 35 bp, Artificial Sequence
  Synthetic oligonucleotide
tatccactcgcagtccttgtttacttcatcgctag

SEQ ID NO: 101517 - DNA, 36 bp, Artificial Sequence
  Synthetic oligonucleotide
aacgcaggccaaagctgtagaaacggtggacacgaa

SEQ ID NO: 101518 - DNA, 36 bp, Artificial Sequence
  Synthetic oligonucleotide
taggacggccgtcgacctatcctcgccgtggaaaca

SEQ ID NO: 101519 - DNA, 35 bp, Artificial Sequence
  Synthetic oligonucleotide
acgccccaacttcatagttatatcggcctgagcca

SEQ ID NO: 101520 - DNA, 37 bp, Artificial Sequence
  Synthetic oligonucleotide
tagtaaggaggcaagtgtgtgtgaagaagcgggtaga

SEQ ID NO: 101521 - DNA, 37 bp, Artificial Sequence
  Synthetic oligonucleotide
tagagacgcagagggtcagagatttggcttacaccga

SEQ ID NO: 101522 - DNA, 37 bp, Artificial Sequence
  Synthetic oligonucleotide
aaagacacgcgccagaaaaacatacaaagtgtacgga

SEQ ID NO: 101523 - DNA, 38 bp, Artificial Sequence
  Synthetic oligonucleotide
actgaccgcatgccagatgacctagagaacgggaatga

SEQ ID NO: 101524 - DNA, 38 bp, Artificial Sequence
  Synthetic oligonucleotide
tgatgacggtcgattgtgaaggttgggatatctgatga

SEQ ID NO: 101525 - DNA, 35 bp, Artificial Sequence
  Synthetic oligonucleotide
atggtggggggggagggaagatcgagacaggagac

SEQ ID NO: 101526 - DNA, 35 bp, Artificial Sequence
  Synthetic oligonucleotide
ttgcctcactccagcgtagccctgctgccttcacc

SEQ ID NO: 101527 - DNA, 35 bp, Artificial Sequence
  Synthetic oligonucleotide
tagcattgcatcgctggtccgcccctcttgccaag

SEQ ID NO: 101528 - DNA, 35 bp, Artificial Sequence
  Synthetic oligonucleotide
tacagccaggccctgagcctgttattcttccctat

SEQ ID NO: 101529 - DNA, 35 bp, Artificial Sequence
  Synthetic oligonucleotide
ttgctactgccacagccctttctgacttccgctat

SEQ ID NO: 101530 - DNA, 35 bp, Artificial Sequence
  Synthetic oligonucleotide
atgtgcacgaagtagagggtaagggatgcggtagt

SEQ ID NO: 101531 - DNA, 35 bp, Artificial Sequence
  Synthetic oligonucleotide
tccgacgccacaaagtctatacctgctgttagcaa

SEQ ID NO: 101532 - DNA, 35 bp, Artificial Sequence
  Synthetic oligonucleotide
gtggattgcctccgataggggaacaaaggtgtgaa

SEQ ID NO: 101533 - DNA, 36 bp, Artificial Sequence
  Synthetic oligonucleotide
attctccccagtatgttacgcatcgctagtgcctaa

SEQ ID NO: 101534 - DNA, 36 bp, Artificial Sequence
  Synthetic oligonucleotide
gcacccaagagacgcaatcgatgtggattgctagca

SEQ ID NO: 101535 - DNA, 36 bp, Artificial Sequence
  Synthetic oligonucleotide
tcaacggtgaggatagaatgagtatgcgtgacggca

SEQ ID NO: 101536 - DNA, 37 bp, Artificial Sequence
  Synthetic oligonucleotide
gcgcgcaaggaatcaacatggggagggagtgtgacga

SEQ ID NO: 101537 - DNA, 37 bp, Artificial Sequence
  Synthetic oligonucleotide
taccagtagcaggcaggggatttggaggcgaaaggga

SEQ ID NO: 101538 - DNA, 38 bp, Artificial Sequence
  Synthetic oligonucleotide
acaccaactgcatgcgtggaattagtggcctccagtga

SEQ ID NO: 101539 - DNA, 37 bp, Artificial Sequence
  Synthetic oligonucleotide
agaaggaggggccgcggggggaagatgaaagggttga

SEQ ID NO: 101540 - DNA, 36 bp, Artificial Sequence
  Synthetic oligonucleotide
gatcccgtgtgcattgcggactgggaatgatctata

SEQ ID NO: 101541 - DNA, 35 bp, Artificial Sequence
  Synthetic oligonucleotide
atcgcacacccgaggcaggcgaataagtgttaacc

SEQ ID NO: 101542 - DNA, 35 bp, Artificial Sequence
  Synthetic oligonucleotide
tcacgctaaggaacgatgtgattgaacaagagttg

SEQ ID NO: 101543 - DNA, 35 bp, Artificial Sequence
  Synthetic oligonucleotide
agaggggggagggagttcaggaagggtgatgggct

SEQ ID NO: 101544 - DNA, 36 bp, Artificial Sequence
  Synthetic oligonucleotide
gacagtctgatacctgggttaatgcaacggtaaaaa

SEQ ID NO: 101545 - DNA, 36 bp, Artificial Sequence
  Synthetic oligonucleotide
tttggccacccagctcaccgcggtacctgttcctaa

SEQ ID NO: 101546 - DNA, 36 bp, Artificial Sequence
  Synthetic oligonucleotide
gcgacaccctcctcacacacactgcgacctaagtaa

SEQ ID NO: 101547 - DNA, 38 bp, Artificial Sequence
  Synthetic oligonucleotide
gaagcgcggacggacaggtaaggaggagtaaagaatga

SEQ ID NO: 101548 - DNA, 36 bp, Artificial Sequence
  Synthetic oligonucleotide
gaaagcgggggggtagaggagagagtagggttctga

SEQ ID NO: 101549 - DNA, 36 bp, Artificial Sequence
  Synthetic oligonucleotide
tacgcaccgcgtatagcatttgtgcccgtatctgta

SEQ ID NO: 101550 - DNA, 35 bp, Artificial Sequence
  Synthetic oligonucleotide
tcaacaccaactcggactatagtcgcctgtcccac

SEQ ID NO: 101551 - DNA, 35 bp, Artificial Sequence
  Synthetic oligonucleotide
tacgcgatacaggtgggcgaatataatgggtggcc

SEQ ID NO: 101552 - DNA, 34 bp, Artificial Sequence
  Synthetic oligonucleotide
gagccacgtgcttcttatatcactgcttacctcc

SEQ ID NO: 101553 - DNA, 35 bp, Artificial Sequence
  Synthetic oligonucleotide
tcaacactacatcttatgaccatctgacttgtttc

SEQ ID NO: 101554 - DNA, 35 bp, Artificial Sequence
  Synthetic oligonucleotide
tgtacgggagacggatgttgcttatgggagtaaag

SEQ ID NO: 101555 - DNA, 35 bp, Artificial Sequence
  Synthetic oligonucleotide
tcacgacaccgcattattctgcctgactgtcctcg

SEQ ID NO: 101556 - DNA, 35 bp, Artificial Sequence
  Synthetic oligonucleotide
tcacgcagtgaacagacctggactaagaggcgtgg

SEQ ID NO: 101557 - DNA, 35 bp, Artificial Sequence
  Synthetic oligonucleotide
gaagaaggcggagtaaggagtcttggagtataaat

SEQ ID NO: 101558 - DNA, 35 bp, Artificial Sequence
  Synthetic oligonucleotide
agtcccaccatatgacttgatgatcgccattctat

SEQ ID NO: 101559 - DNA, 34 bp, Artificial Sequence
  Synthetic oligonucleotide
tccgacgtaatgcatccaccgcgcgtacccataa

SEQ ID NO: 101560 - DNA, 36 bp, Artificial Sequence
  Synthetic oligonucleotide
tgcctcactcagtcgttctcgccgcattctccataa

SEQ ID NO: 101561 - DNA, 37 bp, Artificial Sequence
  Synthetic oligonucleotide
gattggggctgggaggggttccgattagtcttgggca

SEQ ID NO: 101562 - DNA, 37 bp, Artificial Sequence
  Synthetic oligonucleotide
gctgacgaaaggtttaatatgtgggcagtgaaagcga

SEQ ID NO: 101563 - DNA, 37 bp, Artificial Sequence
  Synthetic oligonucleotide
taattgccaacggggatgacacacaaggcagtatgga

SEQ ID NO: 101564 - DNA, 38 bp, Artificial Sequence
  Synthetic oligonucleotide
gacgaccgcatatgtgccttagtttaggcgctatatga

SEQ ID NO: 101565 - DNA, 38 bp, Artificial Sequence
  Synthetic oligonucleotide
agacgcggccagaagtgcaggggggaatgggtaactga

SEQ ID NO: 101566 - DNA, 37 bp, Artificial Sequence
  Synthetic oligonucleotide
gagcgagacatgaggggagggactataggggtactga

SEQ ID NO: 101567 - DNA, 36 bp, Artificial Sequence
  Synthetic oligonucleotide
actgagccagtgatgcgcgtcgcaagcagccttcta

SEQ ID NO: 101568 - DNA, 35 bp, Artificial Sequence
  Synthetic oligonucleotide
ccaggagcccctcccatgtcatcctattgtcgtac

SEQ ID NO: 101569 - DNA, 35 bp, Artificial Sequence
  Synthetic oligonucleotide
tatcggtcgcacccctgccgtgatctccgtgcccc

SEQ ID NO: 101570 - DNA, 35 bp, Artificial Sequence
  Synthetic oligonucleotide
attgcatccgcaacaatctgttttctactcactcc

SEQ ID NO: 101571 - DNA, 35 bp, Artificial Sequence
  Synthetic oligonucleotide
tgcgctccacaagtcgttccttccttccacgttag

SEQ ID NO: 101572 - DNA, 35 bp, Artificial Sequence
  Synthetic oligonucleotide
atcaccgcagtttccatcctccccgtccgctttag

SEQ ID NO: 101573 - DNA, 35 bp, Artificial Sequence
  Synthetic oligonucleotide
gtcacctgtagttggtaagtactcacttccacact

SEQ ID NO: 101574 - DNA, 35 bp, Artificial Sequence
  Synthetic oligonucleotide
tgctcgtgcacggtcaccgacttgctttttcccaa

SEQ ID NO: 101575 - DNA, 36 bp, Artificial Sequence
  Synthetic oligonucleotide
tccgctccccacgggtctacactgggttctacctaa

SEQ ID NO: 101576 - DNA, 36 bp, Artificial Sequence
  Synthetic oligonucleotide
tcgttcaacgctaactcaggccaccgcttcatgcca

SEQ ID NO: 101577 - DNA, 37 bp, Artificial Sequence
  Synthetic oligonucleotide
gatgcgacaaggctttgaaagatgtctctggggaaga

SEQ ID NO: 101578 - DNA, 37 bp, Artificial Sequence
  Synthetic oligonucleotide
gacgaagctcaagctgcgtcacatattgataggtgga

SEQ ID NO: 101579 - DNA, 38 bp, Artificial Sequence
  Synthetic oligonucleotide
gtggacacgtagggtagtaacccgtggcttgatcctga

SEQ ID NO: 101580 - DNA, 35 bp, Artificial Sequence
  Synthetic oligonucleotide
gtgagctacaccaccgcccgtcttttgaccgccac

SEQ ID NO: 101581 - DNA, 35 bp, Artificial Sequence
  Synthetic oligonucleotide
ggatcccgaacacagtcacaccccgaggtcgaacc

SEQ ID NO: 101582 - DNA, 35 bp, Artificial Sequence
  Synthetic oligonucleotide
gtgcaaccactgaaacacctgacctagacagctcc

SEQ ID NO: 101583 - DNA, 35 bp, Artificial Sequence
  Synthetic oligonucleotide
tacgcagtccgatgccgtttaggcccccctgattc

SEQ ID NO: 101584 - DNA, 35 bp, Artificial Sequence
  Synthetic oligonucleotide
gtggaatgccgcgtgcaaacagacgaggtgaagtt

SEQ ID NO: 101585 - DNA, 35 bp, Artificial Sequence
  Synthetic oligonucleotide
tcgagaggcggaacgcggtgggaggtcaggtagaa

SEQ ID NO: 101586 - DNA, 35 bp, Artificial Sequence
  Synthetic oligonucleotide
gcaccaggcgctccccctcctctattagcccttaa

SEQ ID NO: 101587 - DNA, 36 bp, Artificial Sequence
  Synthetic oligonucleotide
aaggactgcaagtgcgtgattaaaggtgtgttcaca

SEQ ID NO: 101588 - DNA, 37 bp, Artificial Sequence
  Synthetic oligonucleotide
gcacgaggtgaaggggaataatgtgaaggatggaaga

SEQ ID NO: 101589 - DNA, 38 bp, Artificial Sequence
  Synthetic oligonucleotide
gagtggcatacgagataggtgaatctgaatacgtatga

SEQ ID NO: 101590 - DNA, 35 bp, Artificial Sequence
  Synthetic oligonucleotide
gaccccgctctccgaagtattggccatcaccgaac

SEQ ID NO: 101591 - DNA, 35 bp, Artificial Sequence
  Synthetic oligonucleotide
tccatgactgtctcatattagccaccggaactcac

SEQ ID NO: 101592 - DNA, 35 bp, Artificial Sequence
  Synthetic oligonucleotide
gaagcgccgcaaactgtgcctttaacgccgtctac

SEQ ID NO: 101593 - DNA, 35 bp, Artificial Sequence
  Synthetic oligonucleotide
gcggaggccacaccttttttgtcctcgattcgttc

SEQ ID NO: 101594 - DNA, 35 bp, Artificial Sequence
  Synthetic oligonucleotide
aacacgagagcgctgaaggcaaccggaacacgaag

SEQ ID NO: 101595 - DNA, 35 bp, Artificial Sequence
  Synthetic oligonucleotide
gagggacgaaagaagagatagctcgattgcggtgg

SEQ ID NO: 101596 - DNA, 35 bp, Artificial Sequence
  Synthetic oligonucleotide
gaccatcgcccatcgccctttcttgtagtgctcat

SEQ ID NO: 101597 - DNA, 35 bp, Artificial Sequence
  Synthetic oligonucleotide
tgatcacttttccacctcgaccagacgtgtcctgt

SEQ ID NO: 101598 - DNA, 35 bp, Artificial Sequence
  Synthetic oligonucleotide
aagacgtggcacatgactgggatgggaaacgggtt

SEQ ID NO: 101599 - DNA, 36 bp, Artificial Sequence
  Synthetic oligonucleotide
tatacactcgctgccctcttccccagtgttgcacaa

SEQ ID NO: 101600 - DNA, 36 bp, Artificial Sequence
  Synthetic oligonucleotide
acaccgcccgtgcactgtgtccctcccgtgagggca

SEQ ID NO: 101601 - DNA, 36 bp, Artificial Sequence
  Synthetic oligonucleotide
tgtgacgagccaggttgtctgttctgctgtctatca

SEQ ID NO: 101602 - DNA, 36 bp, Artificial Sequence
  Synthetic oligonucleotide
gccgccacccctgaggcgccacaccatttcttggga

SEQ ID NO: 101603 - DNA, 37 bp, Artificial Sequence
  Synthetic oligonucleotide
aacgcggacacaagatgagcagcctctgcatccatga

SEQ ID NO: 101604 - DNA, 38 bp, Artificial Sequence
  Synthetic oligonucleotide
atcgagccagggatagcggtaacgacagaacagtatga

SEQ ID NO: 101605 - DNA, 36 bp, Artificial Sequence
  Synthetic oligonucleotide
gacagtgaggggagcgataagtgtggtgttacacta

SEQ ID NO: 101606 - DNA, 35 bp, Artificial Sequence
  Synthetic oligonucleotide
gacacggtagatcgctctgtgcccctcagttagta

SEQ ID NO: 101607 - DNA, 35 bp, Artificial Sequence
  Synthetic oligonucleotide
gtgctcacccctccattacgtgtctgccgagcaac

SEQ ID NO: 101608 - DNA, 35 bp, Artificial Sequence
  Synthetic oligonucleotide
accacgcggagggcaaatctttccgcgttcttaac

SEQ ID NO: 101609 - DNA, 35 bp, Artificial Sequence
  Synthetic oligonucleotide
gcgaggtgcagatagagcttataaacgtgcaatgg

SEQ ID NO: 101610 - DNA, 35 bp, Artificial Sequence
  Synthetic oligonucleotide
ggagccatagcccctttctttgctgaattatgcat

SEQ ID NO: 101611 - DNA, 35 bp, Artificial Sequence
  Synthetic oligonucleotide
atgtcgcacatccgcgaatggtccatctctttgat

SEQ ID NO: 101612 - DNA, 35 bp, Artificial Sequence
  Synthetic oligonucleotide
tgccactcggccgacacgcttaatacgcaccatat

SEQ ID NO: 101613 - DNA, 35 bp, Artificial Sequence
  Synthetic oligonucleotide
atgaacccatcgacgctgcaggccctgcttcctat

SEQ ID NO: 101614 - DNA, 35 bp, Artificial Sequence
  Synthetic oligonucleotide
gacgatgtcgtaaacacaactccgccctttgccaa

SEQ ID NO: 101615 - DNA, 36 bp, Artificial Sequence
  Synthetic oligonucleotide
tcatggtcagctgactgataggaattactgccccca

SEQ ID NO: 101616 - DNA, 37 bp, Artificial Sequence
  Synthetic oligonucleotide
gagggggggcgggcggaatttagaaggatggggagca

SEQ ID NO: 101617 - DNA, 35 bp, Artificial Sequence
  Synthetic oligonucleotide
atgtacgacggcactaagccagatcatccatagca

SEQ ID NO: 101618 - DNA, 35 bp, Artificial Sequence
  Synthetic oligonucleotide
tgaggaccggctgaccaatacccgtagcttcctca

SEQ ID NO: 101619 - DNA, 37 bp, Artificial Sequence
  Synthetic oligonucleotide
gacaacgcacaattcaacgaagcacagcaatgtggga

SEQ ID NO: 101620 - DNA, 37 bp, Artificial Sequence
  Synthetic oligonucleotide
acactcgcaaccccagtcccaccaccaggcacgatga

SEQ ID NO: 101621 - DNA, 38 bp, Artificial Sequence
  Synthetic oligonucleotide
agagggggcaaagacggttacgacatgtgcggtgatga

SEQ ID NO: 101622 - DNA, 38 bp, Artificial Sequence
  Synthetic oligonucleotide
tagagtgagagatagggaggcagacagccaatctatga

SEQ ID NO: 101623 - DNA, 35 bp, Artificial Sequence
  Synthetic oligonucleotide
agccacacattggggttccagacagttgactgtga

SEQ ID NO: 101624 - DNA, 37 bp, Artificial Sequence
  Synthetic oligonucleotide
gaagcagttgggcacgatcaacgggggggctacttga

SEQ ID NO: 101625 - DNA, 35 bp, Artificial Sequence
  Synthetic oligonucleotide
tcccaaccccacgcagttataaacggtttttcacc

SEQ ID NO: 101626 - DNA, 35 bp, Artificial Sequence
  Synthetic oligonucleotide
gaagcatcagcaggaaaacacaagcatagcgcagc

SEQ ID NO: 101627 - DNA, 35 bp, Artificial Sequence
  Synthetic oligonucleotide
ttgtgagaggaggtgaatatccgagtagtgggggg

SEQ ID NO: 101628 - DNA, 35 bp, Artificial Sequence
  Synthetic oligonucleotide
actcggggggcatgaggtaggttttttggttttgg

SEQ ID NO: 101629 - DNA, 35 bp, Artificial Sequence
  Synthetic oligonucleotide
gaatccacgccgtcctagttcctcgaagctttcat

SEQ ID NO: 101630 - DNA, 37 bp, Artificial Sequence
  Synthetic oligonucleotide
gacacgcagtgaggtagggcccgttgtccagagtaga

SEQ ID NO: 101631 - DNA, 37 bp, Artificial Sequence
  Synthetic oligonucleotide
tatgagccgaggaggttgcgttcatggtacagtctga

SEQ ID NO: 101632 - DNA, 38 bp, Artificial Sequence
  Synthetic oligonucleotide
gacgtagtcaagggaagaactgcaggcacagtcagtga

SEQ ID NO: 101633 - DNA, 36 bp, Artificial Sequence
  Synthetic oligonucleotide
gtcactgtaaggtgcgtcttgcccgtgttccattta

SEQ ID NO: 101634 - DNA, 35 bp, Artificial Sequence
  Synthetic oligonucleotide
taactcccccagtaagacctgcactctccttcgtc

SEQ ID NO: 101635 - DNA, 35 bp, Artificial Sequence
  Synthetic oligonucleotide
gcgaccatccgccgcctaatcttgtgtgccccaag

SEQ ID NO: 101636 - DNA, 35 bp, Artificial Sequence
  Synthetic oligonucleotide
agctgatcccctgtcctcgtgcttgcatttattag

SEQ ID NO: 101637 - DNA, 35 bp, Artificial Sequence
  Synthetic oligonucleotide
tgccacccccgtttcctctgcccttaaatgggaat

SEQ ID NO: 101638 - DNA, 35 bp, Artificial Sequence
  Synthetic oligonucleotide
accaacagcgcgattcctcgatctgtcatgactgt

SEQ ID NO: 101639 - DNA, 36 bp, Artificial Sequence
  Synthetic oligonucleotide
tcctgcctccacggtattttgggttaccgttctaaa

SEQ ID NO: 101640 - DNA, 35 bp, Artificial Sequence
  Synthetic oligonucleotide
tccgccccacctagtgcgactcactagacacacaa

SEQ ID NO: 101641 - DNA, 35 bp, Artificial Sequence
  Synthetic oligonucleotide
accaccccgaccaaattcccactgtgcgtatacaa

SEQ ID NO: 101642 - DNA, 36 bp, Artificial Sequence
  Synthetic oligonucleotide
ttgagcaccaccgaaccatgcgagaaggatcatgaa

SEQ ID NO: 101643 - DNA, 36 bp, Artificial Sequence
  Synthetic oligonucleotide
tactacatcagggcggtctaaacgcctgtactctaa

SEQ ID NO: 101644 - DNA, 36 bp, Artificial Sequence
  Synthetic oligonucleotide
gacaagggtaggatgagagggtggataagttagaga

SEQ ID NO: 101645 - DNA, 37 bp, Artificial Sequence
  Synthetic oligonucleotide
gagcacacaacttaaacgtaaggagaaagttcgtgga

SEQ ID NO: 101646 - DNA, 37 bp, Artificial Sequence
  Synthetic oligonucleotide
gcaggacggttcctctaagccagccaccacgacatga

SEQ ID NO: 101647 - DNA, 38 bp, Artificial Sequence
  Synthetic oligonucleotide
gagcatgaggcaggtgtgaaatgaaggagtgtgtatga

SEQ ID NO: 101648 - DNA, 38 bp, Artificial Sequence
  Synthetic oligonucleotide
gatgcagaggagcggatgaggcaattgtgattgtatga

SEQ ID NO: 101649 - DNA, 38 bp, Artificial Sequence
  Synthetic oligonucleotide
tcagagcgagcaccaacagtactaacctttagggttga

SEQ ID NO: 101650 - DNA, 36 bp, Artificial Sequence
  Synthetic oligonucleotide
tttcacggcttgttcaagtcctgatgcccctaccta

SEQ ID NO: 101651 - DNA, 35 bp, Artificial Sequence
  Synthetic oligonucleotide
ttccagccgaccgctttcgatgaaccggggattac

SEQ ID NO: 101652 - DNA, 35 bp, Artificial Sequence
  Synthetic oligonucleotide
tcaacgtgctgtggttgaagattagtgttctccag

SEQ ID NO: 101653 - DNA, 35 bp, Artificial Sequence
  Synthetic oligonucleotide
acccttccaccttcataatgcaggcacatgagcat

SEQ ID NO: 101654 - DNA, 36 bp, Artificial Sequence
  Synthetic oligonucleotide
gttgtgcagtggttagggtgacagatgtcgtgataa

SEQ ID NO: 101655 - DNA, 36 bp, Artificial Sequence
  Synthetic oligonucleotide
gtccgcaacacccacatcgacgctgagcgcccacca

SEQ ID NO: 101656 - DNA, 36 bp, Artificial Sequence
  Synthetic oligonucleotide
tgaccccgaccagtgtgtttacgattttgatccgca

SEQ ID NO: 101657 - DNA, 37 bp, Artificial Sequence
  Synthetic oligonucleotide
atgactgccaccggtgtctaccatcctgcccacttca

SEQ ID NO: 101658 - DNA, 37 bp, Artificial Sequence
  Synthetic oligonucleotide
ttgtgcctcctccatgattcatggcactcattcccga

SEQ ID NO: 101659 - DNA, 37 bp, Artificial Sequence
  Synthetic oligonucleotide
gaccatgctcccaaccgtaaaggtagactggcgagga

SEQ ID NO: 101660 - DNA, 35 bp, Artificial Sequence
  Synthetic oligonucleotide
tctcaccgcccaatcaacacacattgcgagaccag

SEQ ID NO: 101661 - DNA, 35 bp, Artificial Sequence
  Synthetic oligonucleotide
acccgactctcgaatgcctttaagccgaaccacat

SEQ ID NO: 101662 - DNA, 35 bp, Artificial Sequence
  Synthetic oligonucleotide
tacgacggcacactactcggtaaactatctgccat

SEQ ID NO: 101663 - DNA, 35 bp, Artificial Sequence
  Synthetic oligonucleotide
gtccacaggcacttggtatgctcgccccccgcaaa

SEQ ID NO: 101664 - DNA, 35 bp, Artificial Sequence
  Synthetic oligonucleotide
aaccaagcatgtcgcaatagccaaagttcatcaca

SEQ ID NO: 101665 - DNA, 36 bp, Artificial Sequence
  Synthetic oligonucleotide
tatcccctgaccgtaatgcagaaaaactctattcca

SEQ ID NO: 101666 - DNA, 37 bp, Artificial Sequence
  Synthetic oligonucleotide
gctatcgtcgcatgctcaattccaactgactggacga

SEQ ID NO: 101667 - DNA, 37 bp, Artificial Sequence
  Synthetic oligonucleotide
tacaccacagatgtatactaggttacggggaggggga

SEQ ID NO: 101668 - DNA, 37 bp, Artificial Sequence
  Synthetic oligonucleotide
ggagtgcgaacgaatggttgtcaacacagtagtggga

SEQ ID NO: 101669 - DNA, 37 bp, Artificial Sequence
  Synthetic oligonucleotide
tagggaagtaagtggggtatagtggagtacatctgga

SEQ ID NO: 101670 - DNA, 38 bp, Artificial Sequence
  Synthetic oligonucleotide
aatggaaggacgacggcgcgtagttcataaagttatga

SEQ ID NO: 101671 - DNA, 35 bp, Artificial Sequence
  Synthetic oligonucleotide
gtccaccgcaccaaggtgaggcttttcctgtgcac

SEQ ID NO: 101672 - DNA, 34 bp, Artificial Sequence
  Synthetic oligonucleotide
gtcacgcatggcccacacacgattgtaccacctc

SEQ ID NO: 101673 - DNA, 35 bp, Artificial Sequence
  Synthetic oligonucleotide
acatcgcctcggctttttgcactggtcctcatcat

SEQ ID NO: 101674 - DNA, 35 bp, Artificial Sequence
  Synthetic oligonucleotide
gccatccagactgtctctctcgctcgtgaccgctt

SEQ ID NO: 101675 - DNA, 36 bp, Artificial Sequence
  Synthetic oligonucleotide
ttgacagtcgcaggctgtgaaacggggggactgaaa

SEQ ID NO: 101676 - DNA, 35 bp, Artificial Sequence
  Synthetic oligonucleotide
agtgtggtcacatgccgatccatcctcgtactcaa

SEQ ID NO: 101677 - DNA, 36 bp, Artificial Sequence
  Synthetic oligonucleotide
gcgattgcgcggtatgtattatgtgctcggatagaa

SEQ ID NO: 101678 - DNA, 36 bp, Artificial Sequence
  Synthetic oligonucleotide
attgccccgcctacctgcatgtcttactagcccgaa

SEQ ID NO: 101679 - DNA, 35 bp, Artificial Sequence
  Synthetic oligonucleotide
gagtacagaggaggaacggtcagctacctgtaaca

SEQ ID NO: 101680 - DNA, 36 bp, Artificial Sequence
  Synthetic oligonucleotide
gacccatgccatttgtacgctgcgccgacttactca

SEQ ID NO: 101681 - DNA, 38 bp, Artificial Sequence
  Synthetic oligonucleotide
aatacgcgcaaaggggagtgggctgtcactggaaatga

SEQ ID NO: 101682 - DNA, 38 bp, Artificial Sequence
  Synthetic oligonucleotide
gatgacgaatacgtcaaaggtgggataagggcgaatga

SEQ ID NO: 101683 - DNA, 38 bp, Artificial Sequence
  Synthetic oligonucleotide
gctgagcacggacaggatgctagtacattgcatggtga

SEQ ID NO: 101684 - DNA, 38 bp, Artificial Sequence
  Synthetic oligonucleotide
tatcaagcgcacgaagggtgatgtaggaataggtttga

SEQ ID NO: 101685 - DNA, 36 bp, Artificial Sequence
  Synthetic oligonucleotide
gatgctcgcgtgcatagatgaattggtggccaaata

SEQ ID NO: 101686 - DNA, 35 bp, Artificial Sequence
  Synthetic oligonucleotide
tccagccttggcctgtacgcatatcgtttgccgac

SEQ ID NO: 101687 - DNA, 35 bp, Artificial Sequence
  Synthetic oligonucleotide
gtagccccccttacgtactgcaagcttgaggctag

SEQ ID NO: 101688 - DNA, 35 bp, Artificial Sequence
  Synthetic oligonucleotide
tcccagagccaccgctttttgatttgccattttcg

SEQ ID NO: 101689 - DNA, 34 bp, Artificial Sequence
  Synthetic oligonucleotide
tatgtcacagcgcacatccgtcctgtgcgaacat

SEQ ID NO: 101690 - DNA, 35 bp, Artificial Sequence
  Synthetic oligonucleotide
gcaaacgtgccgcagcgaagcattcaaaaggctat

SEQ ID NO: 101691 - DNA, 35 bp, Artificial Sequence
  Synthetic oligonucleotide
gtgtggagaagggcggaaagtgacacgagattagt

SEQ ID NO: 101692 - DNA, 36 bp, Artificial Sequence
  Synthetic oligonucleotide
attgcagcccatccgtactggctcttatatagcaca

SEQ ID NO: 101693 - DNA, 36 bp, Artificial Sequence
  Synthetic oligonucleotide
tgcgaccaccccgctctttgtccgttgaccgaatca

SEQ ID NO: 101694 - DNA, 37 bp, Artificial Sequence
  Synthetic oligonucleotide
gctgagcccgagccctcacttcgtcccgggacgaaga

SEQ ID NO: 101695 - DNA, 37 bp, Artificial Sequence
  Synthetic oligonucleotide
attgccggagcagtggtaaaggtcgataaagggtaga

SEQ ID NO: 101696 - DNA, 38 bp, Artificial Sequence
  Synthetic oligonucleotide
acacgcggatagtgcagaagtcagatactgcaccatga

SEQ ID NO: 101697 - DNA, 38 bp, Artificial Sequence
  Synthetic oligonucleotide
aagcacgtagtagtgctacgtacggcattatcggatga

SEQ ID NO: 101698 - DNA, 35 bp, Artificial Sequence
  Synthetic oligonucleotide
atgccagccctatttgcatccacatcctgttgcac

SEQ ID NO: 101699 - DNA, 35 bp, Artificial Sequence
  Synthetic oligonucleotide
gcactgcctttctcgtctcacgcctgggacctcac

SEQ ID NO: 101700 - DNA, 35 bp, Artificial Sequence
  Synthetic oligonucleotide
gtagagacaaagcgcagagtaaggataggtcacat

SEQ ID NO: 101701 - DNA, 35 bp, Artificial Sequence
  Synthetic oligonucleotide
ttgatcgcagtgtgaccgcccgtttcctcccgtct

SEQ ID NO: 101702 - DNA, 36 bp, Artificial Sequence
  Synthetic oligonucleotide
gccaatgcatggttatagcccggcctgagacaaaaa

SEQ ID NO: 101703 - DNA, 35 bp, Artificial Sequence
  Synthetic oligonucleotide
tgtagaccccacgccggacccagctcacttttaaa

SEQ ID NO: 101704 - DNA, 37 bp, Artificial Sequence
  Synthetic oligonucleotide
tacgaaggcacgggaaggaaatggtgggggctaaaga

SEQ ID NO: 101705 - DNA, 37 bp, Artificial Sequence
  Synthetic oligonucleotide
agcaaggcgagggtgggtacaagggtagacgcgccga

SEQ ID NO: 101706 - DNA, 38 bp, Artificial Sequence
  Synthetic oligonucleotide
atgtgcgtgcagggatacgagggagcgggccaaaatga

SEQ ID NO: 101707 - DNA, 38 bp, Artificial Sequence
  Synthetic oligonucleotide
tgcaacaaaggcatgtcagtctaagtgtgtgtctatga

SEQ ID NO: 101708 - DNA, 38 bp, Artificial Sequence
  Synthetic oligonucleotide
gacagggtgtatggagggtgaaagaaataccagtatga

SEQ ID NO: 101709 - DNA, 38 bp, Artificial Sequence
  Synthetic oligonucleotide
tgtgggggggggcgaagatgatgcaggggcgatcgtga

SEQ ID NO: 101710 - DNA, 38 bp, Artificial Sequence
  Synthetic oligonucleotide
aatggacgaactcagggagtagagaagtcattacttga

SEQ ID NO: 101711 - DNA, 35 bp, Artificial Sequence
  Synthetic oligonucleotide
gagccggtcagccgatgaatcggacgattctttac

SEQ ID NO: 101712 - DNA, 35 bp, Artificial Sequence
  Synthetic oligonucleotide
accagtcgcagtaacaaagtgtactagactcactc

SEQ ID NO: 101713 - DNA, 35 bp, Artificial Sequence
  Synthetic oligonucleotide
agatggagcgcatgactgtgtagaaaggggttgag

SEQ ID NO: 101714 - DNA, 35 bp, Artificial Sequence
  Synthetic oligonucleotide
aacacaggcgtcacggtagaggggcgaaagttacg

SEQ ID NO: 101715 - DNA, 35 bp, Artificial Sequence
  Synthetic oligonucleotide
gtacacgcatccaaatcgtctcaagcaacgcgagg

SEQ ID NO: 101716 - DNA, 35 bp, Artificial Sequence
  Synthetic oligonucleotide
tagagcggaacgctcagtgtcaacgtactcgatat

SEQ ID NO: 101717 - DNA, 35 bp, Artificial Sequence
  Synthetic oligonucleotide
tccgctactcacacctggcaagcacccaactcact

SEQ ID NO: 101718 - DNA, 35 bp, Artificial Sequence
  Synthetic oligonucleotide
agagtgggatagaacccagggtggataatatagct

SEQ ID NO: 101719 - DNA, 35 bp, Artificial Sequence
  Synthetic oligonucleotide
tgcattcgccacggttttcgatcgtttgcctctct

SEQ ID NO: 101720 - DNA, 36 bp, Artificial Sequence
  Synthetic oligonucleotide
gttacacccgcgacgtacaggcaaagggtcgagaca

SEQ ID NO: 101721 - DNA, 37 bp, Artificial Sequence
  Synthetic oligonucleotide
tagacacgccaccgcacccgtattttgcaccacctca

SEQ ID NO: 101722 - DNA, 37 bp, Artificial Sequence
  Synthetic oligonucleotide
actgccatcggcccccgcccttatcccttggccatga

SEQ ID NO: 101723 - DNA, 35 bp, Artificial Sequence
  Synthetic oligonucleotide
gcagatccggcctcgaccccacgcccaagtctccc

SEQ ID NO: 101724 - DNA, 35 bp, Artificial Sequence
  Synthetic oligonucleotide
gatctgcacatgatggccttcccacttacccagcc

SEQ ID NO: 101725 - DNA, 35 bp, Artificial Sequence
  Synthetic oligonucleotide
atgcgccatacgtaaaaaagggggagagctgtgtg

SEQ ID NO: 101726 - DNA, 35 bp, Artificial Sequence
  Synthetic oligonucleotide
gttcacgagttacgtgtgtgtcgacccctcccttg

SEQ ID NO: 101727 - DNA, 35 bp, Artificial Sequence
  Synthetic oligonucleotide
ggtgcgaaggaacggcgacgggacaaaattacaat

SEQ ID NO: 101728 - DNA, 35 bp, Artificial Sequence
  Synthetic oligonucleotide
gcaacgcttagttcataaaacgtccagtggccgat

SEQ ID NO: 101729 - DNA, 36 bp, Artificial Sequence
  Synthetic oligonucleotide
gtgaactcgcgggaggattaagctggggcaggcaaa

SEQ ID NO: 101730 - DNA, 36 bp, Artificial Sequence
  Synthetic oligonucleotide
ttacgcgccaccaacctcatagctcacaggcctgaa

SEQ ID NO: 101731 - DNA, 38 bp, Artificial Sequence
  Synthetic oligonucleotide
acgaccccctaggcctggtgggtgggaaaaattactga

SEQ ID NO: 101732 - DNA, 38 bp, Artificial Sequence
  Synthetic oligonucleotide
taacagacggatgttggctaacaaatgaaggaacgtga

SEQ ID NO: 101733 - DNA, 37 bp, Artificial Sequence
  Synthetic oligonucleotide
tagtcaggggcacggtacatcgaatagtttaaattga

SEQ ID NO: 101734 - DNA, 38 bp, Artificial Sequence
  Synthetic oligonucleotide
gggggccgggtggtggggactaggtgggaggctgttga

SEQ ID NO: 101735 - DNA, 36 bp, Artificial Sequence
  Synthetic oligonucleotide
gtggcggacgcaaccctgcgttcgacgcactttgta

SEQ ID NO: 101736 - DNA, 35 bp, Artificial Sequence
  Synthetic oligonucleotide
gttgactacctcctttccgtaccgtgagcagtaac

SEQ ID NO: 101737 - DNA, 35 bp, Artificial Sequence
  Synthetic oligonucleotide
gactgccagtgaggatcattccacgcctccaatac

SEQ ID NO: 101738 - DNA, 35 bp, Artificial Sequence
  Synthetic oligonucleotide
taccatatcgtgccacccgtagccacctgccagtt

SEQ ID NO: 101739 - DNA, 35 bp, Artificial Sequence
  Synthetic oligonucleotide
tgatccctctgactcatataccgtgcccctcaaaa

SEQ ID NO: 101740 - DNA, 36 bp, Artificial Sequence
  Synthetic oligonucleotide
gtgggagccgcaagaagtaagctatcccgaaatcaa

SEQ ID NO: 101741 - DNA, 36 bp, Artificial Sequence
  Synthetic oligonucleotide
gacgctcgtccccaacgctttatatatacgctacca

SEQ ID NO: 101742 - DNA, 35 bp, Artificial Sequence
  Synthetic oligonucleotide
acaccacctcagtacactcaacctggccaacgtca

SEQ ID NO: 101743 - DNA, 38 bp, Artificial Sequence
  Synthetic oligonucleotide
ttagccagacaccgtattataagggatctggcctatga

SEQ ID NO: 101744 - DNA, 36 bp, Artificial Sequence
  Synthetic oligonucleotide
gaggtgcaccaatgacttagttgcagtaatagacta

SEQ ID NO: 101745 - DNA, 36 bp, Artificial Sequence
  Synthetic oligonucleotide
gagaggagaatgcaagtagagtagagtgtgtgacta

SEQ ID NO: 101746 - DNA, 35 bp, Artificial Sequence
  Synthetic oligonucleotide
gtgtgacgcgcagagtttccatttagttcccatac

SEQ ID NO: 101747 - DNA, 35 bp, Artificial Sequence
  Synthetic oligonucleotide
tcctcagtcgctggccttgcttgaacgcactgtac

SEQ ID NO: 101748 - DNA, 33 bp, Artificial Sequence
  Synthetic oligonucleotide
gttcaatcacgtacctgtgcaaacccacaatcc

SEQ ID NO: 101749 - DNA, 35 bp, Artificial Sequence
  Synthetic oligonucleotide
gacgcagtagcgtccatgtgttgatgaacgactag

SEQ ID NO: 101750 - DNA, 35 bp, Artificial Sequence
  Synthetic oligonucleotide
tacgttgcgacaaggactacaaacacgtcgtacat

SEQ ID NO: 101751 - DNA, 34 bp, Artificial Sequence
  Synthetic oligonucleotide
tgtgatccgcaagatctgatcacatgccttccat

SEQ ID NO: 101752 - DNA, 35 bp, Artificial Sequence
  Synthetic oligonucleotide
tcgcacatcgagcgggcacaggaagtaccatcggt

SEQ ID NO: 101753 - DNA, 35 bp, Artificial Sequence
  Synthetic oligonucleotide
atcacactccacatcatacgactgttgtaacctaa

SEQ ID NO: 101754 - DNA, 35 bp, Artificial Sequence
  Synthetic oligonucleotide
acaccacatcatcgattcgcggaccgcactcccat

SEQ ID NO: 101755 - DNA, 36 bp, Artificial Sequence
  Synthetic oligonucleotide
gcatcggtaggaggtggcattggcagtattgtgaaa

SEQ ID NO: 101756 - DNA, 36 bp, Artificial Sequence
  Synthetic oligonucleotide
gccaaccccacggtagtaagcccgcattcttttaaa

SEQ ID NO: 101757 - DNA, 36 bp, Artificial Sequence
  Synthetic oligonucleotide
gaagggcgtaggggaggggaacgggaggagtacgca

SEQ ID NO: 101758 - DNA, 35 bp, Artificial Sequence
  Synthetic oligonucleotide
gaaccacctttgtttcctacgtgagcctcgtttta

SEQ ID NO: 101759 - DNA, 35 bp, Artificial Sequence
  Synthetic oligonucleotide
gagtgcaacgggcaggggacatctgacacgaactc

SEQ ID NO: 101760 - DNA, 35 bp, Artificial Sequence
  Synthetic oligonucleotide
tgctacgtgaattcctgaaccgccgccactgcctc

SEQ ID NO: 101761 - DNA, 35 bp, Artificial Sequence
  Synthetic oligonucleotide
atcaccgcttgccacatttgaactacgcctccgat

SEQ ID NO: 101762 - DNA, 32 bp, Artificial Sequence
  Synthetic oligonucleotide
atggttgcctgccacctgtcccgtattcatat

SEQ ID NO: 101763 - DNA, 35 bp, Artificial Sequence
  Synthetic oligonucleotide
tctagcttgcccactttactgtcttggctgaatct

SEQ ID NO: 101764 - DNA, 35 bp, Artificial Sequence
  Synthetic oligonucleotide
gtcaccgatacggtgcctcttcccctgattccaaa

SEQ ID NO: 101765 - DNA, 37 bp, Artificial Sequence
  Synthetic oligonucleotide
accacaggcaggttacaatagcctctggcaaaggtga

SEQ ID NO: 101766 - DNA, 35 bp, Artificial Sequence
  Synthetic oligonucleotide
acacctgcctcccataatctccgtgctctaagtag

SEQ ID NO: 101767 - DNA, 35 bp, Artificial Sequence
  Synthetic oligonucleotide
acataccaccgcgcaacacctaaggaacatgcatg
